United States Patent 11,492,591 (UNIVERSAL DONOR STEM CELLS AND RELATED METHODS) - sequence listing, part 22

SEQ ID NO: 706983 - DNA, 20 bp, Artificial
  CRISPR gRNA sequence
ggcagtctggcgcccatgat

SEQ ID NO: 706984 - DNA, 20 bp, Artificial
  CRISPR gRNA sequence
cagtctggcgcccatgatgg

SEQ ID NO: 706985 - DNA, 20 bp, Artificial
  CRISPR gRNA sequence
agtctggcgcccatgatggg

SEQ ID NO: 706986 - DNA, 20 bp, Artificial
  CRISPR gRNA sequence
gtctggcgcccatgatggga

SEQ ID NO: 706987 - DNA, 20 bp, Artificial
  CRISPR gRNA sequence
aaataatgcacttccttacc

SEQ ID NO: 706988 - DNA, 20 bp, Artificial
  CRISPR gRNA sequence
taatgcacttccttacctag

SEQ ID NO: 706989 - DNA, 20 bp, Artificial
  CRISPR gRNA sequence
aaaaatccataaaatcctta

SEQ ID NO: 706990 - DNA, 20 bp, Artificial
  CRISPR gRNA sequence
taaaatccttaaagaactgt

SEQ ID NO: 706991 - DNA, 20 bp, Artificial
  CRISPR gRNA sequence
aaaatccttaaagaactgta

SEQ ID NO: 706992 - DNA, 20 bp, Artificial
  CRISPR gRNA sequence
ccttaaagaactgtaaggct

SEQ ID NO: 706993 - DNA, 20 bp, Artificial
  CRISPR gRNA sequence
cttaaagaactgtaaggctg

SEQ ID NO: 706994 - DNA, 20 bp, Artificial
  CRISPR gRNA sequence
aggacatgatcatcgaaatt

SEQ ID NO: 706995 - DNA, 20 bp, Artificial
  CRISPR gRNA sequence
gacatgatcatcgaaattga

SEQ ID NO: 706996 - DNA, 20 bp, Artificial
  CRISPR gRNA sequence
aattgagagtatgttattaa

SEQ ID NO: 706997 - DNA, 20 bp, Artificial
  CRISPR gRNA sequence
atgttattaatagaacccct

SEQ ID NO: 706998 - DNA, 20 bp, Artificial
  CRISPR gRNA sequence
ttattaatagaacccctgag

SEQ ID NO: 706999 - DNA, 20 bp, Artificial
  CRISPR gRNA sequence
ttaatagaacccctgagcag

SEQ ID NO: 707000 - DNA, 20 bp, Artificial
  CRISPR gRNA sequence
atagaacccctgagcagaag

SEQ ID NO: 707001 - DNA, 20 bp, Artificial
  CRISPR gRNA sequence
cccctgagcagaagtggctt

SEQ ID NO: 707002 - DNA, 20 bp, Artificial
  CRISPR gRNA sequence
ccctgagcagaagtggcttt

SEQ ID NO: 707003 - DNA, 20 bp, Artificial
  CRISPR gRNA sequence
ctgagcagaagtggctttgg

SEQ ID NO: 707004 - DNA, 20 bp, Artificial
  CRISPR gRNA sequence
aagtggctttgggagtctcc

SEQ ID NO: 707005 - DNA, 20 bp, Artificial
  CRISPR gRNA sequence
tggctttgggagtctcccag

SEQ ID NO: 707006 - DNA, 20 bp, Artificial
  CRISPR gRNA sequence
ggctttgggagtctcccagc

SEQ ID NO: 707007 - DNA, 20 bp, Artificial
  CRISPR gRNA sequence
gctttgggagtctcccagca

SEQ ID NO: 707008 - DNA, 20 bp, Artificial
  CRISPR gRNA sequence
ttgggagtctcccagcaggg

SEQ ID NO: 707009 - DNA, 20 bp, Artificial
  CRISPR gRNA sequence
tgggagtctcccagcagggc

SEQ ID NO: 707010 - DNA, 20 bp, Artificial
  CRISPR gRNA sequence
agtgggaattcctgccctgc

SEQ ID NO: 707011 - DNA, 20 bp, Artificial
  CRISPR gRNA sequence
gtgggaattcctgccctgct

SEQ ID NO: 707012 - DNA, 20 bp, Artificial
  CRISPR gRNA sequence
gggaattcctgccctgctgg

SEQ ID NO: 707013 - DNA, 20 bp, Artificial
  CRISPR gRNA sequence
gccctgctgggagactccca

SEQ ID NO: 707014 - DNA, 20 bp, Artificial
  CRISPR gRNA sequence
ctcccaaagccacttctgct

SEQ ID NO: 707015 - DNA, 20 bp, Artificial
  CRISPR gRNA sequence
tcccaaagccacttctgctc

SEQ ID NO: 707016 - DNA, 20 bp, Artificial
  CRISPR gRNA sequence
cccaaagccacttctgctca

SEQ ID NO: 707017 - DNA, 20 bp, Artificial
  CRISPR gRNA sequence
ccaaagccacttctgctcag

SEQ ID NO: 707018 - DNA, 20 bp, Artificial
  CRISPR gRNA sequence
aatttcgatgatcatgtcct

SEQ ID NO: 707019 - DNA, 20 bp, Artificial
  CRISPR gRNA sequence
tgatcatgtcctcagcctta

SEQ ID NO: 707020 - DNA, 20 bp, Artificial
  CRISPR gRNA sequence
cctcagccttacagttcttt

SEQ ID NO: 707021 - DNA, 20 bp, Artificial
  CRISPR gRNA sequence
ctcagccttacagttcttta

SEQ ID NO: 707022 - DNA, 20 bp, Artificial
  CRISPR gRNA sequence
acagttctttaaggatttta

SEQ ID NO: 707023 - DNA, 20 bp, Artificial
  CRISPR gRNA sequence
ttaaggattttatggatttt

SEQ ID NO: 707024 - DNA, 20 bp, Artificial
  CRISPR gRNA sequence
aaggattttatggattttta

SEQ ID NO: 707025 - DNA, 20 bp, Artificial
  CRISPR gRNA sequence
atggatttttagagattcaa

SEQ ID NO: 707026 - DNA, 20 bp, Artificial
  CRISPR gRNA sequence
agagattcaaaagttgtgtg

SEQ ID NO: 707027 - DNA, 20 bp, Artificial
  CRISPR gRNA sequence
gagattcaaaagttgtgtga

SEQ ID NO: 707028 - DNA, 20 bp, Artificial
  CRISPR gRNA sequence
agattcaaaagttgtgtgaa

SEQ ID NO: 707029 - DNA, 20 bp, Artificial
  CRISPR gRNA sequence
aaagttgtgtgaagggccac

SEQ ID NO: 707030 - DNA, 20 bp, Artificial
  CRISPR gRNA sequence
aagttgtgtgaagggccact

SEQ ID NO: 707031 - DNA, 20 bp, Artificial
  CRISPR gRNA sequence
tgtgtgaagggccactaggt

SEQ ID NO: 707032 - DNA, 20 bp, Artificial
  CRISPR gRNA sequence
gtgtgaagggccactaggta

SEQ ID NO: 707033 - DNA, 20 bp, Artificial
  CRISPR gRNA sequence
tgaagggccactaggtaagg

SEQ ID NO: 707034 - DNA, 20 bp, Artificial
  CRISPR gRNA sequence
catgtcaatccctcccatca

SEQ ID NO: 707035 - DNA, 20 bp, Artificial
  CRISPR gRNA sequence
atgtcaatccctcccatcat

SEQ ID NO: 707036 - DNA, 20 bp, Artificial
  CRISPR gRNA sequence
atccctcccatcatgggcgc

SEQ ID NO: 707037 - DNA, 20 bp, Artificial
  CRISPR gRNA sequence
gggcgccagactgccctgcc

SEQ ID NO: 707038 - DNA, 20 bp, Artificial
  CRISPR gRNA sequence
cgccagactgccctgcctgg

SEQ ID NO: 707039 - DNA, 20 bp, Artificial
  CRISPR gRNA sequence
gccagactgccctgcctggc

SEQ ID NO: 707040 - DNA, 20 bp, Artificial
  CRISPR gRNA sequence
cctggcaggcgtgtgccttc

SEQ ID NO: 707041 - DNA, 20 bp, Artificial
  CRISPR gRNA sequence
gtgccttccagcgtgcctta

SEQ ID NO: 707042 - DNA, 20 bp, Artificial
  CRISPR gRNA sequence
tccagcgtgccttacagctg

SEQ ID NO: 707043 - DNA, 20 bp, Artificial
  CRISPR gRNA sequence
gtgccttacagctgcggctg

SEQ ID NO: 707044 - DNA, 20 bp, Artificial
  CRISPR gRNA sequence
tgccttacagctgcggctgt

SEQ ID NO: 707045 - DNA, 20 bp, Artificial
  CRISPR gRNA sequence
agctgcggctgtgggtgatg

SEQ ID NO: 707046 - DNA, 20 bp, Artificial
  CRISPR gRNA sequence
ctgcggctgtgggtgatgca

SEQ ID NO: 707047 - DNA, 20 bp, Artificial
  CRISPR gRNA sequence
ctccatccttgcacaaacac

SEQ ID NO: 707048 - DNA, 20 bp, Artificial
  CRISPR gRNA sequence
tccatccttgcacaaacact

SEQ ID NO: 707049 - DNA, 20 bp, Artificial
  CRISPR gRNA sequence
ttgcacaaacactgggcaaa

SEQ ID NO: 707050 - DNA, 20 bp, Artificial
  CRISPR gRNA sequence
caaacagtgtctgcccactt

SEQ ID NO: 707051 - DNA, 20 bp, Artificial
  CRISPR gRNA sequence
ctgcccacttaagcttcttc

SEQ ID NO: 707052 - DNA, 20 bp, Artificial
  CRISPR gRNA sequence
agcttcttctggccaatgtc

SEQ ID NO: 707053 - DNA, 20 bp, Artificial
  CRISPR gRNA sequence
gcttcttctggccaatgtcc

SEQ ID NO: 707054 - DNA, 20 bp, Artificial
  CRISPR gRNA sequence
tctggccaatgtccaggttc

SEQ ID NO: 707055 - DNA, 20 bp, Artificial
  CRISPR gRNA sequence
ctggtgtaaccacctctcgc

SEQ ID NO: 707056 - DNA, 20 bp, Artificial
  CRISPR gRNA sequence
tggtgtaaccacctctcgca

SEQ ID NO: 707057 - DNA, 20 bp, Artificial
  CRISPR gRNA sequence
aaccacctctcgcaaggcca

SEQ ID NO: 707058 - DNA, 20 bp, Artificial
  CRISPR gRNA sequence
caactttccccaaaacatct

SEQ ID NO: 707059 - DNA, 20 bp, Artificial
  CRISPR gRNA sequence
ctttccccaaaacatctgag

SEQ ID NO: 707060 - DNA, 20 bp, Artificial
  CRISPR gRNA sequence
ccaaaacatctgagcggttt

SEQ ID NO: 707061 - DNA, 20 bp, Artificial
  CRISPR gRNA sequence
tcagaaactatcacttcctc

SEQ ID NO: 707062 - DNA, 20 bp, Artificial
  CRISPR gRNA sequence
agaaactatcacttcctcca

SEQ ID NO: 707063 - DNA, 20 bp, Artificial
  CRISPR gRNA sequence
aaactatcacttcctccaga

SEQ ID NO: 707064 - DNA, 20 bp, Artificial
  CRISPR gRNA sequence
cacttcctccagagagcacg

SEQ ID NO: 707065 - DNA, 20 bp, Artificial
  CRISPR gRNA sequence
agagcacgtggctgcccgat

SEQ ID NO: 707066 - DNA, 20 bp, Artificial
  CRISPR gRNA sequence
gtggctgcccgatgagtaaa

SEQ ID NO: 707067 - DNA, 20 bp, Artificial
  CRISPR gRNA sequence
gctgcccgatgagtaaacag

SEQ ID NO: 707068 - DNA, 20 bp, Artificial
  CRISPR gRNA sequence
tgagtaaacagcagccttcc

SEQ ID NO: 707069 - DNA, 20 bp, Artificial
  CRISPR gRNA sequence
gagtaaacagcagccttccc

SEQ ID NO: 707070 - DNA, 20 bp, Artificial
  CRISPR gRNA sequence
agccttcccgggcctgcctc

SEQ ID NO: 707071 - DNA, 20 bp, Artificial
  CRISPR gRNA sequence
gccttcccgggcctgcctcc

SEQ ID NO: 707072 - DNA, 20 bp, Artificial
  CRISPR gRNA sequence
ttcccgggcctgcctccagg

SEQ ID NO: 707073 - DNA, 20 bp, Artificial
  CRISPR gRNA sequence
cgggcctgcctccaggcggt

SEQ ID NO: 707074 - DNA, 20 bp, Artificial
  CRISPR gRNA sequence
cctccaggcggtaagtccac

SEQ ID NO: 707075 - DNA, 20 bp, Artificial
  CRISPR gRNA sequence
gcggtaagtccacgagtctc

SEQ ID NO: 707076 - DNA, 20 bp, Artificial
  CRISPR gRNA sequence
cggtaagtccacgagtctcc

SEQ ID NO: 707077 - DNA, 20 bp, Artificial
  CRISPR gRNA sequence
tccaggctgcccgcaactcc

SEQ ID NO: 707078 - DNA, 20 bp, Artificial
  CRISPR gRNA sequence
ctcatttgcatacacgtctg

SEQ ID NO: 707079 - DNA, 20 bp, Artificial
  CRISPR gRNA sequence
tcatttgcatacacgtctga

SEQ ID NO: 707080 - DNA, 20 bp, Artificial
  CRISPR gRNA sequence
gcatacacgtctgaaggccc

SEQ ID NO: 707081 - DNA, 20 bp, Artificial
  CRISPR gRNA sequence
catacacgtctgaaggccct

SEQ ID NO: 707082 - DNA, 20 bp, Artificial
  CRISPR gRNA sequence
atacacgtctgaaggcccta

SEQ ID NO: 707083 - DNA, 20 bp, Artificial
  CRISPR gRNA sequence
acacgtctgaaggccctagg

SEQ ID NO: 707084 - DNA, 20 bp, Artificial
  CRISPR gRNA sequence
gtctgaaggccctagggagt

SEQ ID NO: 707085 - DNA, 20 bp, Artificial
  CRISPR gRNA sequence
gaaggccctagggagtcagc

SEQ ID NO: 707086 - DNA, 20 bp, Artificial
  CRISPR gRNA sequence
gccctagggagtcagctggc

SEQ ID NO: 707087 - DNA, 20 bp, Artificial
  CRISPR gRNA sequence
gagtcagctggccagccgac

SEQ ID NO: 707088 - DNA, 20 bp, Artificial
  CRISPR gRNA sequence
tcagctggccagccgaccgg

SEQ ID NO: 707089 - DNA, 20 bp, Artificial
  CRISPR gRNA sequence
ctggccagccgaccggaagt

SEQ ID NO: 707090 - DNA, 20 bp, Artificial
  CRISPR gRNA sequence
tggccagccgaccggaagtc

SEQ ID NO: 707091 - DNA, 20 bp, Artificial
  CRISPR gRNA sequence
ggccagccgaccggaagtca

SEQ ID NO: 707092 - DNA, 20 bp, Artificial
  CRISPR gRNA sequence
aagtcagggccactactcct

SEQ ID NO: 707093 - DNA, 20 bp, Artificial
  CRISPR gRNA sequence
atcctgatgaaacctccaaa

SEQ ID NO: 707094 - DNA, 20 bp, Artificial
  CRISPR gRNA sequence
ccaaacggtcttgtttccta

SEQ ID NO: 707095 - DNA, 20 bp, Artificial
  CRISPR gRNA sequence
cggtcttgtttcctatggtc

SEQ ID NO: 707096 - DNA, 20 bp, Artificial
  CRISPR gRNA sequence
gtcttgtttcctatggtcca

SEQ ID NO: 707097 - DNA, 20 bp, Artificial
  CRISPR gRNA sequence
gtttcctatggtccagagta

SEQ ID NO: 707098 - DNA, 20 bp, Artificial
  CRISPR gRNA sequence
tcctatggtccagagtaaag

SEQ ID NO: 707099 - DNA, 20 bp, Artificial
  CRISPR gRNA sequence
tccagagtaaagcagatgcc

SEQ ID NO: 707100 - DNA, 20 bp, Artificial
  CRISPR gRNA sequence
ccagagtaaagcagatgcct

SEQ ID NO: 707101 - DNA, 20 bp, Artificial
  CRISPR gRNA sequence
agtaaagcagatgcctgggt

SEQ ID NO: 707102 - DNA, 20 bp, Artificial
  CRISPR gRNA sequence
gtaaagcagatgcctgggtg

SEQ ID NO: 707103 - DNA, 20 bp, Artificial
  CRISPR gRNA sequence
cagatgcctgggtgaggccg

SEQ ID NO: 707104 - DNA, 20 bp, Artificial
  CRISPR gRNA sequence
ctctcgacatccacacccca

SEQ ID NO: 707105 - DNA, 20 bp, Artificial
  CRISPR gRNA sequence
catccacaccccaaagcgtg

SEQ ID NO: 707106 - DNA, 20 bp, Artificial
  CRISPR gRNA sequence
tccacaccccaaagcgtgca

SEQ ID NO: 707107 - DNA, 20 bp, Artificial
  CRISPR gRNA sequence
caccccaaagcgtgcagagc

SEQ ID NO: 707108 - DNA, 20 bp, Artificial
  CRISPR gRNA sequence
aaagcgtgcagagccggaac

SEQ ID NO: 707109 - DNA, 20 bp, Artificial
  CRISPR gRNA sequence
aagcgtgcagagccggaacc

SEQ ID NO: 707110 - DNA, 20 bp, Artificial
  CRISPR gRNA sequence
cgtgcagagccggaaccagg

SEQ ID NO: 707111 - DNA, 20 bp, Artificial
  CRISPR gRNA sequence
gcagagccggaaccaggtgg

SEQ ID NO: 707112 - DNA, 20 bp, Artificial
  CRISPR gRNA sequence
cagagccggaaccaggtggt

SEQ ID NO: 707113 - DNA, 20 bp, Artificial
  CRISPR gRNA sequence
agagccggaaccaggtggtg

SEQ ID NO: 707114 - DNA, 20 bp, Artificial
  CRISPR gRNA sequence
ccggaaccaggtggtggggt

SEQ ID NO: 707115 - DNA, 20 bp, Artificial
  CRISPR gRNA sequence
ccaggtggtggggtcggtgc

SEQ ID NO: 707116 - DNA, 20 bp, Artificial
  CRISPR gRNA sequence
ggtggtggggtcggtgctag

SEQ ID NO: 707117 - DNA, 20 bp, Artificial
  CRISPR gRNA sequence
gtcggtgctagtggatttgc

SEQ ID NO: 707118 - DNA, 20 bp, Artificial
  CRISPR gRNA sequence
ggtgctagtggatttgcaag

SEQ ID NO: 707119 - DNA, 20 bp, Artificial
  CRISPR gRNA sequence
gtgctagtggatttgcaagc

SEQ ID NO: 707120 - DNA, 20 bp, Artificial
  CRISPR gRNA sequence
tgctagtggatttgcaagca

SEQ ID NO: 707121 - DNA, 20 bp, Artificial
  CRISPR gRNA sequence
tagtggatttgcaagcaggg

SEQ ID NO: 707122 - DNA, 20 bp, Artificial
  CRISPR gRNA sequence
tttgcaagcagggcagacct

SEQ ID NO: 707123 - DNA, 20 bp, Artificial
  CRISPR gRNA sequence
ttgcaagcagggcagaccta

SEQ ID NO: 707124 - DNA, 20 bp, Artificial
  CRISPR gRNA sequence
caagcagggcagacctaagg

SEQ ID NO: 707125 - DNA, 20 bp, Artificial
  CRISPR gRNA sequence
gaagatgcttcttcatttcc

SEQ ID NO: 707126 - DNA, 20 bp, Artificial
  CRISPR gRNA sequence
aagatgcttcttcatttccc

SEQ ID NO: 707127 - DNA, 20 bp, Artificial
  CRISPR gRNA sequence
tgcttcttcatttcccagga

SEQ ID NO: 707128 - DNA, 20 bp, Artificial
  CRISPR gRNA sequence
cttcttcatttcccaggaca

SEQ ID NO: 707129 - DNA, 20 bp, Artificial
  CRISPR gRNA sequence
cttcatttcccaggacagag

SEQ ID NO: 707130 - DNA, 20 bp, Artificial
  CRISPR gRNA sequence
ttcatttcccaggacagagt

SEQ ID NO: 707131 - DNA, 20 bp, Artificial
  CRISPR gRNA sequence
atttcccaggacagagtggg

SEQ ID NO: 707132 - DNA, 20 bp, Artificial
  CRISPR gRNA sequence
tttcccaggacagagtgggt

SEQ ID NO: 707133 - DNA, 20 bp, Artificial
  CRISPR gRNA sequence
ttcccaggacagagtgggtg

SEQ ID NO: 707134 - DNA, 20 bp, Artificial
  CRISPR gRNA sequence
gacagagtgggtggggccca

SEQ ID NO: 707135 - DNA, 20 bp, Artificial
  CRISPR gRNA sequence
cagagtgggtggggcccaca

SEQ ID NO: 707136 - DNA, 20 bp, Artificial
  CRISPR gRNA sequence
gagtgggtggggcccacaga

SEQ ID NO: 707137 - DNA, 20 bp, Artificial
  CRISPR gRNA sequence
tgggtggggcccacagagag

SEQ ID NO: 707138 - DNA, 20 bp, Artificial
  CRISPR gRNA sequence
ggggcccacagagagcggtc

SEQ ID NO: 707139 - DNA, 20 bp, Artificial
  CRISPR gRNA sequence
gggcccacagagagcggtca

SEQ ID NO: 707140 - DNA, 20 bp, Artificial
  CRISPR gRNA sequence
cagagagcggtcaaggactc

SEQ ID NO: 707141 - DNA, 20 bp, Artificial
  CRISPR gRNA sequence
agagagcggtcaaggactcc

SEQ ID NO: 707142 - DNA, 20 bp, Artificial
  CRISPR gRNA sequence
gagcggtcaaggactccagg

SEQ ID NO: 707143 - DNA, 20 bp, Artificial
  CRISPR gRNA sequence
agcggtcaaggactccaggc

SEQ ID NO: 707144 - DNA, 20 bp, Artificial
  CRISPR gRNA sequence
gcggtcaaggactccaggca

SEQ ID NO: 707145 - DNA, 20 bp, Artificial
  CRISPR gRNA sequence
aggactccaggcagggcccg

SEQ ID NO: 707146 - DNA, 20 bp, Artificial
  CRISPR gRNA sequence
cgaagttccccatgttcaca

SEQ ID NO: 707147 - DNA, 20 bp, Artificial
  CRISPR gRNA sequence
gaagttccccatgttcacat

SEQ ID NO: 707148 - DNA, 20 bp, Artificial
  CRISPR gRNA sequence
aagttccccatgttcacatg

SEQ ID NO: 707149 - DNA, 20 bp, Artificial
  CRISPR gRNA sequence
gttccccatgttcacatggg

SEQ ID NO: 707150 - DNA, 20 bp, Artificial
  CRISPR gRNA sequence
ttccccatgttcacatgggg

SEQ ID NO: 707151 - DNA, 20 bp, Artificial
  CRISPR gRNA sequence
cccatgttcacatggggagg

SEQ ID NO: 707152 - DNA, 20 bp, Artificial
  CRISPR gRNA sequence
tcacatggggaggaagtccc

SEQ ID NO: 707153 - DNA, 20 bp, Artificial
  CRISPR gRNA sequence
cacatggggaggaagtccct

SEQ ID NO: 707154 - DNA, 20 bp, Artificial
  CRISPR gRNA sequence
ggggaggaagtccctgggca

SEQ ID NO: 707155 - DNA, 20 bp, Artificial
  CRISPR gRNA sequence
ggaagtccctgggcaaagta

SEQ ID NO: 707156 - DNA, 20 bp, Artificial
  CRISPR gRNA sequence
agtccctgggcaaagtaaag

SEQ ID NO: 707157 - DNA, 20 bp, Artificial
  CRISPR gRNA sequence
gtccctgggcaaagtaaagc

SEQ ID NO: 707158 - DNA, 20 bp, Artificial
  CRISPR gRNA sequence
gcaaagtaaagcaggttctc

SEQ ID NO: 707159 - DNA, 20 bp, Artificial
  CRISPR gRNA sequence
caaagtaaagcaggttctct

SEQ ID NO: 707160 - DNA, 20 bp, Artificial
  CRISPR gRNA sequence
gtaaagcaggttctctgggt

SEQ ID NO: 707161 - DNA, 20 bp, Artificial
  CRISPR gRNA sequence
agcaggttctctgggttggt

SEQ ID NO: 707162 - DNA, 20 bp, Artificial
  CRISPR gRNA sequence
gcaggttctctgggttggtg

SEQ ID NO: 707163 - DNA, 20 bp, Artificial
  CRISPR gRNA sequence
caggttctctgggttggtga

SEQ ID NO: 707164 - DNA, 20 bp, Artificial
  CRISPR gRNA sequence
aggttctctgggttggtgag

SEQ ID NO: 707165 - DNA, 20 bp, Artificial
  CRISPR gRNA sequence
ttctctgggttggtgagggg

SEQ ID NO: 707166 - DNA, 20 bp, Artificial
  CRISPR gRNA sequence
ggttggtgaggggcggtctg

SEQ ID NO: 707167 - DNA, 20 bp, Artificial
  CRISPR gRNA sequence
aggggcggtctgcagctgct

SEQ ID NO: 707168 - DNA, 20 bp, Artificial
  CRISPR gRNA sequence
ggggcggtctgcagctgctg

SEQ ID NO: 707169 - DNA, 20 bp, Artificial
  CRISPR gRNA sequence
gggcggtctgcagctgctga

SEQ ID NO: 707170 - DNA, 20 bp, Artificial
  CRISPR gRNA sequence
tctgcagctgctgagggctg

SEQ ID NO: 707171 - DNA, 20 bp, Artificial
  CRISPR gRNA sequence
tgctgagggctgcagacatc

SEQ ID NO: 707172 - DNA, 20 bp, Artificial
  CRISPR gRNA sequence
gctgagggctgcagacatct

SEQ ID NO: 707173 - DNA, 20 bp, Artificial
  CRISPR gRNA sequence
gctgcagacatctgggaccc

SEQ ID NO: 707174 - DNA, 20 bp, Artificial
  CRISPR gRNA sequence
ctgcagacatctgggacccg

SEQ ID NO: 707175 - DNA, 20 bp, Artificial
  CRISPR gRNA sequence
gggacccgaggcgcctgctg

SEQ ID NO: 707176 - DNA, 20 bp, Artificial
  CRISPR gRNA sequence
acccgaggcgcctgctgtgg

SEQ ID NO: 707177 - DNA, 20 bp, Artificial
  CRISPR gRNA sequence
cccgaggcgcctgctgtggc

SEQ ID NO: 707178 - DNA, 20 bp, Artificial
  CRISPR gRNA sequence
ccgaggcgcctgctgtggcg

SEQ ID NO: 707179 - DNA, 20 bp, Artificial
  CRISPR gRNA sequence
gcgcctgctgtggcggggat

SEQ ID NO: 707180 - DNA, 20 bp, Artificial
  CRISPR gRNA sequence
cctgctgtggcggggattgg

SEQ ID NO: 707181 - DNA, 20 bp, Artificial
  CRISPR gRNA sequence
ctgctgtggcggggattggt

SEQ ID NO: 707182 - DNA, 20 bp, Artificial
  CRISPR gRNA sequence
tgctgtggcggggattggtg

SEQ ID NO: 707183 - DNA, 20 bp, Artificial
  CRISPR gRNA sequence
gggattggtggggacattct

SEQ ID NO: 707184 - DNA, 20 bp, Artificial
  CRISPR gRNA sequence
tggtggggacattctgagat

SEQ ID NO: 707185 - DNA, 20 bp, Artificial
  CRISPR gRNA sequence
tgagatgagtgacttgatcc

SEQ ID NO: 707186 - DNA, 20 bp, Artificial
  CRISPR gRNA sequence
gagatgagtgacttgatcct

SEQ ID NO: 707187 - DNA, 20 bp, Artificial
  CRISPR gRNA sequence
agtgacttgatcctgggccc

SEQ ID NO: 707188 - DNA, 20 bp, Artificial
  CRISPR gRNA sequence
gtgacttgatcctgggccct

SEQ ID NO: 707189 - DNA, 20 bp, Artificial
  CRISPR gRNA sequence
tgatcctgggccctaggccc

SEQ ID NO: 707190 - DNA, 20 bp, Artificial
  CRISPR gRNA sequence
gatcctgggccctaggccct

SEQ ID NO: 707191 - DNA, 20 bp, Artificial
  CRISPR gRNA sequence
ccctaggccctgggcccacc

SEQ ID NO: 707192 - DNA, 20 bp, Artificial
  CRISPR gRNA sequence
cctaggccctgggcccaccg

SEQ ID NO: 707193 - DNA, 20 bp, Artificial
  CRISPR gRNA sequence
ctaggccctgggcccaccga

SEQ ID NO: 707194 - DNA, 20 bp, Artificial
  CRISPR gRNA sequence
taggccctgggcccaccgag

SEQ ID NO: 707195 - DNA, 20 bp, Artificial
  CRISPR gRNA sequence
aggccctgggcccaccgagg

SEQ ID NO: 707196 - DNA, 20 bp, Artificial
  CRISPR gRNA sequence
tgggcccaccgagggggcta

SEQ ID NO: 707197 - DNA, 20 bp, Artificial
  CRISPR gRNA sequence
gggcccaccgagggggctac

SEQ ID NO: 707198 - DNA, 20 bp, Artificial
  CRISPR gRNA sequence
ccaccgagggggctacagga

SEQ ID NO: 707199 - DNA, 20 bp, Artificial
  CRISPR gRNA sequence
caccgagggggctacaggac

SEQ ID NO: 707200 - DNA, 20 bp, Artificial
  CRISPR gRNA sequence
accgagggggctacaggaca

SEQ ID NO: 707201 - DNA, 20 bp, Artificial
  CRISPR gRNA sequence
gagggggctacaggacaggg

SEQ ID NO: 707202 - DNA, 20 bp, Artificial
  CRISPR gRNA sequence
agggggctacaggacaggga

SEQ ID NO: 707203 - DNA, 20 bp, Artificial
  CRISPR gRNA sequence
gggctacaggacagggaagg

SEQ ID NO: 707204 - DNA, 20 bp, Artificial
  CRISPR gRNA sequence
ggctacaggacagggaaggt

SEQ ID NO: 707205 - DNA, 20 bp, Artificial
  CRISPR gRNA sequence
tacaggacagggaaggtggg

SEQ ID NO: 707206 - DNA, 20 bp, Artificial
  CRISPR gRNA sequence
acagggaaggtgggcagcac

SEQ ID NO: 707207 - DNA, 20 bp, Artificial
  CRISPR gRNA sequence
cagggaaggtgggcagcacc

SEQ ID NO: 707208 - DNA, 20 bp, Artificial
  CRISPR gRNA sequence
gggaaggtgggcagcaccag

SEQ ID NO: 707209 - DNA, 20 bp, Artificial
  CRISPR gRNA sequence
ggaaggtgggcagcaccagg

SEQ ID NO: 707210 - DNA, 20 bp, Artificial
  CRISPR gRNA sequence
gaaggtgggcagcaccagga

SEQ ID NO: 707211 - DNA, 20 bp, Artificial
  CRISPR gRNA sequence
gcagcaccaggagggtccca

SEQ ID NO: 707212 - DNA, 20 bp, Artificial
  CRISPR gRNA sequence
accaggagggtcccacagtc

SEQ ID NO: 707213 - DNA, 20 bp, Artificial
  CRISPR gRNA sequence
ccaggagggtcccacagtcc

SEQ ID NO: 707214 - DNA, 20 bp, Artificial
  CRISPR gRNA sequence
ggagggtcccacagtccagg

SEQ ID NO: 707215 - DNA, 20 bp, Artificial
  CRISPR gRNA sequence
gagggtcccacagtccaggc

SEQ ID NO: 707216 - DNA, 20 bp, Artificial
  CRISPR gRNA sequence
agggtcccacagtccaggca

SEQ ID NO: 707217 - DNA, 20 bp, Artificial
  CRISPR gRNA sequence
gggtcccacagtccaggcag

SEQ ID NO: 707218 - DNA, 20 bp, Artificial
  CRISPR gRNA sequence
ccaggcaggggccctcacac

SEQ ID NO: 707219 - DNA, 20 bp, Artificial
  CRISPR gRNA sequence
caggggccctcacaccagtg

SEQ ID NO: 707220 - DNA, 20 bp, Artificial
  CRISPR gRNA sequence
ggggccctcacaccagtgca

SEQ ID NO: 707221 - DNA, 20 bp, Artificial
  CRISPR gRNA sequence
cctcacaccagtgcagagta

SEQ ID NO: 707222 - DNA, 20 bp, Artificial
  CRISPR gRNA sequence
caccagtgcagagtacagtg

SEQ ID NO: 707223 - DNA, 20 bp, Artificial
  CRISPR gRNA sequence
agagtacagtgtggccgctg

SEQ ID NO: 707224 - DNA, 20 bp, Artificial
  CRISPR gRNA sequence
gtacagtgtggccgctgcag

SEQ ID NO: 707225 - DNA, 20 bp, Artificial
  CRISPR gRNA sequence
acagtgtggccgctgcagca

SEQ ID NO: 707226 - DNA, 20 bp, Artificial
  CRISPR gRNA sequence
tgtggccgctgcagcagaga

SEQ ID NO: 707227 - DNA, 20 bp, Artificial
  CRISPR gRNA sequence
cgctgcagcagagacagtgc

SEQ ID NO: 707228 - DNA, 20 bp, Artificial
  CRISPR gRNA sequence
ctcgacttcccttttgactc

SEQ ID NO: 707229 - DNA, 20 bp, Artificial
  CRISPR gRNA sequence
cgacttcccttttgactctg

SEQ ID NO: 707230 - DNA, 20 bp, Artificial
  CRISPR gRNA sequence
tgactctggagaaacaacca

SEQ ID NO: 707231 - DNA, 20 bp, Artificial
  CRISPR gRNA sequence
gactctggagaaacaaccac

SEQ ID NO: 707232 - DNA, 20 bp, Artificial
  CRISPR gRNA sequence
ggagaaacaaccacaggcac

SEQ ID NO: 707233 - DNA, 20 bp, Artificial
  CRISPR gRNA sequence
ggcactggctccatgcccac

SEQ ID NO: 707234 - DNA, 20 bp, Artificial
  CRISPR gRNA sequence
gcactggctccatgcccact

SEQ ID NO: 707235 - DNA, 20 bp, Artificial
  CRISPR gRNA sequence
cactggctccatgcccactg

SEQ ID NO: 707236 - DNA, 20 bp, Artificial
  CRISPR gRNA sequence
actggctccatgcccactgg

SEQ ID NO: 707237 - DNA, 20 bp, Artificial
  CRISPR gRNA sequence
cccactgggggccacattta

SEQ ID NO: 707238 - DNA, 20 bp, Artificial
  CRISPR gRNA sequence
ggggccacatttacagtaac

SEQ ID NO: 707239 - DNA, 20 bp, Artificial
  CRISPR gRNA sequence
gggccacatttacagtaact

SEQ ID NO: 707240 - DNA, 20 bp, Artificial
  CRISPR gRNA sequence
ggccacatttacagtaactg

SEQ ID NO: 707241 - DNA, 20 bp, Artificial
  CRISPR gRNA sequence
gccacatttacagtaactgg

SEQ ID NO: 707242 - DNA, 20 bp, Artificial
  CRISPR gRNA sequence
tacagtaactgggggcatgc

SEQ ID NO: 707243 - DNA, 20 bp, Artificial
  CRISPR gRNA sequence
agtaactgggggcatgccgg

SEQ ID NO: 707244 - DNA, 20 bp, Artificial
  CRISPR gRNA sequence
gtaactgggggcatgccgga

SEQ ID NO: 707245 - DNA, 20 bp, Artificial
  CRISPR gRNA sequence
taactgggggcatgccggaa

SEQ ID NO: 707246 - DNA, 20 bp, Artificial
  CRISPR gRNA sequence
ggcatgccggaagggcccaa

SEQ ID NO: 707247 - DNA, 20 bp, Artificial
  CRISPR gRNA sequence
gcatgccggaagggcccaat

SEQ ID NO: 707248 - DNA, 20 bp, Artificial
  CRISPR gRNA sequence
gcccaatgggtgtcacctct

SEQ ID NO: 707249 - DNA, 20 bp, Artificial
  CRISPR gRNA sequence
cccaatgggtgtcacctctg

SEQ ID NO: 707250 - DNA, 20 bp, Artificial
  CRISPR gRNA sequence
tgggtgtcacctctgaggtc

SEQ ID NO: 707251 - DNA, 20 bp, Artificial
  CRISPR gRNA sequence
gggtgtcacctctgaggtcc

SEQ ID NO: 707252 - DNA, 20 bp, Artificial
  CRISPR gRNA sequence
ggtgtcacctctgaggtcca

SEQ ID NO: 707253 - DNA, 20 bp, Artificial
  CRISPR gRNA sequence
tgtcacctctgaggtccagg

SEQ ID NO: 707254 - DNA, 20 bp, Artificial
  CRISPR gRNA sequence
tcacctctgaggtccaggga

SEQ ID NO: 707255 - DNA, 20 bp, Artificial
  CRISPR gRNA sequence
acctctgaggtccagggaga

SEQ ID NO: 707256 - DNA, 20 bp, Artificial
  CRISPR gRNA sequence
cctctgaggtccagggagag

SEQ ID NO: 707257 - DNA, 20 bp, Artificial
  CRISPR gRNA sequence
tctgaggtccagggagagag

SEQ ID NO: 707258 - DNA, 20 bp, Artificial
  CRISPR gRNA sequence
tgaggtccagggagagagga

SEQ ID NO: 707259 - DNA, 20 bp, Artificial
  CRISPR gRNA sequence
ggtccagggagagaggagag

SEQ ID NO: 707260 - DNA, 20 bp, Artificial
  CRISPR gRNA sequence
gtccagggagagaggagagt

SEQ ID NO: 707261 - DNA, 20 bp, Artificial
  CRISPR gRNA sequence
tccagggagagaggagagta

SEQ ID NO: 707262 - DNA, 20 bp, Artificial
  CRISPR gRNA sequence
gagagaggagagtagggtta

SEQ ID NO: 707263 - DNA, 20 bp, Artificial
  CRISPR gRNA sequence
agagaggagagtagggttac

SEQ ID NO: 707264 - DNA, 20 bp, Artificial
  CRISPR gRNA sequence
gagaggagagtagggttaca

SEQ ID NO: 707265 - DNA, 20 bp, Artificial
  CRISPR gRNA sequence
agaggagagtagggttacag

SEQ ID NO: 707266 - DNA, 20 bp, Artificial
  CRISPR gRNA sequence
gagtagggttacaggggccc

SEQ ID NO: 707267 - DNA, 20 bp, Artificial
  CRISPR gRNA sequence
agtagggttacaggggcccc

SEQ ID NO: 707268 - DNA, 20 bp, Artificial
  CRISPR gRNA sequence
tagggttacaggggccccgg

SEQ ID NO: 707269 - DNA, 20 bp, Artificial
  CRISPR gRNA sequence
gttacaggggccccgggagc

SEQ ID NO: 707270 - DNA, 20 bp, Artificial
  CRISPR gRNA sequence
cctcacgacctctccctcgc

SEQ ID NO: 707271 - DNA, 20 bp, Artificial
  CRISPR gRNA sequence
ctcacgacctctccctcgct

SEQ ID NO: 707272 - DNA, 20 bp, Artificial
  CRISPR gRNA sequence
acctctccctcgctgggctg

SEQ ID NO: 707273 - DNA, 20 bp, Artificial
  CRISPR gRNA sequence
cctctccctcgctgggctgt

SEQ ID NO: 707274 - DNA, 20 bp, Artificial
  CRISPR gRNA sequence
ccctcgctgggctgtgggcc

SEQ ID NO: 707275 - DNA, 20 bp, Artificial
  CRISPR gRNA sequence
tcgctgggctgtgggcctgg

SEQ ID NO: 707276 - DNA, 20 bp, Artificial
  CRISPR gRNA sequence
gggctgtgggcctggtggtt

SEQ ID NO: 707277 - DNA, 20 bp, Artificial
  CRISPR gRNA sequence
ggctgtgggcctggtggtta

SEQ ID NO: 707278 - DNA, 20 bp, Artificial
  CRISPR gRNA sequence
ggtggttaaggtctgatgcc

SEQ ID NO: 707279 - DNA, 20 bp, Artificial
  CRISPR gRNA sequence
gtggttaaggtctgatgccc

SEQ ID NO: 707280 - DNA, 20 bp, Artificial
  CRISPR gRNA sequence
tggttaaggtctgatgccca

SEQ ID NO: 707281 - DNA, 20 bp, Artificial
  CRISPR gRNA sequence
aggtctgatgcccagggctc

SEQ ID NO: 707282 - DNA, 20 bp, Artificial
  CRISPR gRNA sequence
ggtctgatgcccagggctct

SEQ ID NO: 707283 - DNA, 20 bp, Artificial
  CRISPR gRNA sequence
tctgggaccaatgctgttct

SEQ ID NO: 707284 - DNA, 20 bp, Artificial
  CRISPR gRNA sequence
gggaccaatgctgttctcgg

SEQ ID NO: 707285 - DNA, 20 bp, Artificial
  CRISPR gRNA sequence
gcctcaaccaacatcactgc

SEQ ID NO: 707286 - DNA, 20 bp, Artificial
  CRISPR gRNA sequence
cctcaaccaacatcactgct

SEQ ID NO: 707287 - DNA, 20 bp, Artificial
  CRISPR gRNA sequence
ccaacatcactgctgggatc

SEQ ID NO: 707288 - DNA, 20 bp, Artificial
  CRISPR gRNA sequence
ctgctgggatccagtcccct

SEQ ID NO: 707289 - DNA, 20 bp, Artificial
  CRISPR gRNA sequence
ttggactgtctcttctgtac

SEQ ID NO: 707290 - DNA, 20 bp, Artificial
  CRISPR gRNA sequence
tgtctcttctgtacaagccc

SEQ ID NO: 707291 - DNA, 20 bp, Artificial
  CRISPR gRNA sequence
tgtacaagccccggatcccc

SEQ ID NO: 707292 - DNA, 20 bp, Artificial
  CRISPR gRNA sequence
gtacaagccccggatcccct

SEQ ID NO: 707293 - DNA, 20 bp, Artificial
  CRISPR gRNA sequence
gccccggatcccctaggctc

SEQ ID NO: 707294 - DNA, 20 bp, Artificial
  CRISPR gRNA sequence
ccccggatcccctaggctct

SEQ ID NO: 707295 - DNA, 20 bp, Artificial
  CRISPR gRNA sequence
ggatcccctaggctctgggt

SEQ ID NO: 707296 - DNA, 20 bp, Artificial
  CRISPR gRNA sequence
gatcccctaggctctgggtc

SEQ ID NO: 707297 - DNA, 20 bp, Artificial
  CRISPR gRNA sequence
atcccctaggctctgggtca

SEQ ID NO: 707298 - DNA, 20 bp, Artificial
  CRISPR gRNA sequence
tcccctaggctctgggtcag

SEQ ID NO: 707299 - DNA, 20 bp, Artificial
  CRISPR gRNA sequence
ctaggctctgggtcagggga

SEQ ID NO: 707300 - DNA, 20 bp, Artificial
  CRISPR gRNA sequence
ctctgggtcaggggacagct

SEQ ID NO: 707301 - DNA, 20 bp, Artificial
  CRISPR gRNA sequence
gggtcaggggacagctaagt

SEQ ID NO: 707302 - DNA, 20 bp, Artificial
  CRISPR gRNA sequence
ggtcaggggacagctaagtt

SEQ ID NO: 707303 - DNA, 20 bp, Artificial
  CRISPR gRNA sequence
gtcaggggacagctaagttg

SEQ ID NO: 707304 - DNA, 20 bp, Artificial
  CRISPR gRNA sequence
gacagctaagttggggatgc

SEQ ID NO: 707305 - DNA, 20 bp, Artificial
  CRISPR gRNA sequence
agctaagttggggatgcaag

SEQ ID NO: 707306 - DNA, 20 bp, Artificial
  CRISPR gRNA sequence
ctaagttggggatgcaagca

SEQ ID NO: 707307 - DNA, 20 bp, Artificial
  CRISPR gRNA sequence
gggatgcaagcagagaccac

SEQ ID NO: 707308 - DNA, 20 bp, Artificial
  CRISPR gRNA sequence
cagagaccaccagacccctg

SEQ ID NO: 707309 - DNA, 20 bp, Artificial
  CRISPR gRNA sequence
caccagacccctgcagtgac

SEQ ID NO: 707310 - DNA, 20 bp, Artificial
  CRISPR gRNA sequence
agacccctgcagtgaccggc

SEQ ID NO: 707311 - DNA, 20 bp, Artificial
  CRISPR gRNA sequence
gtgaccggccggtccaccac

SEQ ID NO: 707312 - DNA, 20 bp, Artificial
  CRISPR gRNA sequence
gccggtccaccactagatgc

SEQ ID NO: 707313 - DNA, 20 bp, Artificial
  CRISPR gRNA sequence
cggtccaccactagatgctg

SEQ ID NO: 707314 - DNA, 20 bp, Artificial
  CRISPR gRNA sequence
accactagatgctggagcct

SEQ ID NO: 707315 - DNA, 20 bp, Artificial
  CRISPR gRNA sequence
tagatgctggagcctcagtt

SEQ ID NO: 707316 - DNA, 20 bp, Artificial
  CRISPR gRNA sequence
agatgctggagcctcagttc

SEQ ID NO: 707317 - DNA, 20 bp, Artificial
  CRISPR gRNA sequence
gctggagcctcagttcaggc

SEQ ID NO: 707318 - DNA, 20 bp, Artificial
  CRISPR gRNA sequence
gagcctcagttcaggccaga

SEQ ID NO: 707319 - DNA, 20 bp, Artificial
  CRISPR gRNA sequence
agcctcagttcaggccagat

SEQ ID NO: 707320 - DNA, 20 bp, Artificial
  CRISPR gRNA sequence
tgggcctctgcccccaacct

SEQ ID NO: 707321 - DNA, 20 bp, Artificial
  CRISPR gRNA sequence
gcccccaacctcggtgccaa

SEQ ID NO: 707322 - DNA, 20 bp, Artificial
  CRISPR gRNA sequence
cggtgccaacagtgccatcc

SEQ ID NO: 707323 - DNA, 20 bp, Artificial
  CRISPR gRNA sequence
acagtgccatcctggcctcc

SEQ ID NO: 707324 - DNA, 20 bp, Artificial
  CRISPR gRNA sequence
agtgccatcctggcctccca

SEQ ID NO: 707325 - DNA, 20 bp, Artificial
  CRISPR gRNA sequence
gtgccatcctggcctcccag

SEQ ID NO: 707326 - DNA, 20 bp, Artificial
  CRISPR gRNA sequence
aggccaccctgctgccctcc

SEQ ID NO: 707327 - DNA, 20 bp, Artificial
  CRISPR gRNA sequence
ccctgctgccctcctagccc

SEQ ID NO: 707328 - DNA, 20 bp, Artificial
  CRISPR gRNA sequence
ctgccctcctagccccagcc

SEQ ID NO: 707329 - DNA, 20 bp, Artificial
  CRISPR gRNA sequence
ctcctagccccagcccagcc

SEQ ID NO: 707330 - DNA, 20 bp, Artificial
  CRISPR gRNA sequence
tcctagccccagcccagccc

SEQ ID NO: 707331 - DNA, 20 bp, Artificial
  CRISPR gRNA sequence
ccagcccaggcctcactttc

SEQ ID NO: 707332 - DNA, 20 bp, Artificial
  CRISPR gRNA sequence
agcccaggcctcactttcca

SEQ ID NO: 707333 - DNA, 20 bp, Artificial
  CRISPR gRNA sequence
gcccaggcctcactttccag

SEQ ID NO: 707334 - DNA, 20 bp, Artificial
  CRISPR gRNA sequence
caggcctcactttccagagg

SEQ ID NO: 707335 - DNA, 20 bp, Artificial
  CRISPR gRNA sequence
tcactttccagaggcagctg

SEQ ID NO: 707336 - DNA, 20 bp, Artificial
  CRISPR gRNA sequence
cactttccagaggcagctgt

SEQ ID NO: 707337 - DNA, 20 bp, Artificial
  CRISPR gRNA sequence
ttccagaggcagctgtgggc

SEQ ID NO: 707338 - DNA, 20 bp, Artificial
  CRISPR gRNA sequence
tccagaggcagctgtgggca

SEQ ID NO: 707339 - DNA, 20 bp, Artificial
  CRISPR gRNA sequence
ccagaggcagctgtgggcaa

SEQ ID NO: 707340 - DNA, 20 bp, Artificial
  CRISPR gRNA sequence
cagaggcagctgtgggcaag

SEQ ID NO: 707341 - DNA, 20 bp, Artificial
  CRISPR gRNA sequence
ctttcccttcctcttccact

SEQ ID NO: 707342 - DNA, 20 bp, Artificial
  CRISPR gRNA sequence
ttcccttcctcttccactga

SEQ ID NO: 707343 - DNA, 20 bp, Artificial
  CRISPR gRNA sequence
ctgagagcatgacatcgctg

SEQ ID NO: 707344 - DNA, 20 bp, Artificial
  CRISPR gRNA sequence
atgacatcgctgcagctgcc

SEQ ID NO: 707345 - DNA, 20 bp, Artificial
  CRISPR gRNA sequence
gacatcgctgcagctgccca

SEQ ID NO: 707346 - DNA, 20 bp, Artificial
  CRISPR gRNA sequence
acatcgctgcagctgcccag

SEQ ID NO: 707347 - DNA, 20 bp, Artificial
  CRISPR gRNA sequence
tcgctgcagctgcccagagg

SEQ ID NO: 707348 - DNA, 20 bp, Artificial
  CRISPR gRNA sequence
aggcggttctgtctcctgct

SEQ ID NO: 707349 - DNA, 20 bp, Artificial
  CRISPR gRNA sequence
ggcggttctgtctcctgctc

SEQ ID NO: 707350 - DNA, 20 bp, Artificial
  CRISPR gRNA sequence
gcggttctgtctcctgctcg

SEQ ID NO: 707351 - DNA, 20 bp, Artificial
  CRISPR gRNA sequence
gttctgtctcctgctcgggg

SEQ ID NO: 707352 - DNA, 20 bp, Artificial
  CRISPR gRNA sequence
ctgtctcctgctcggggtag

SEQ ID NO: 707353 - DNA, 20 bp, Artificial
  CRISPR gRNA sequence
tgtctcctgctcggggtagt

SEQ ID NO: 707354 - DNA, 20 bp, Artificial
  CRISPR gRNA sequence
gtctcctgctcggggtagtg

SEQ ID NO: 707355 - DNA, 20 bp, Artificial
  CRISPR gRNA sequence
tctcctgctcggggtagtgg

SEQ ID NO: 707356 - DNA, 20 bp, Artificial
  CRISPR gRNA sequence
ctcctgctcggggtagtggg

SEQ ID NO: 707357 - DNA, 20 bp, Artificial
  CRISPR gRNA sequence
gctcggggtagtggggggta

SEQ ID NO: 707358 - DNA, 20 bp, Artificial
  CRISPR gRNA sequence
tggggggtatggtccgcctc

SEQ ID NO: 707359 - DNA, 20 bp, Artificial
  CRISPR gRNA sequence
ctccagctcctcctccaact

SEQ ID NO: 707360 - DNA, 20 bp, Artificial
  CRISPR gRNA sequence
tccagctcctcctccaactc

SEQ ID NO: 707361 - DNA, 20 bp, Artificial
  CRISPR gRNA sequence
tcctccaactcgggctctgc

SEQ ID NO: 707362 - DNA, 20 bp, Artificial
  CRISPR gRNA sequence
tcgggctctgctggccccgc

SEQ ID NO: 707363 - DNA, 20 bp, Artificial
  CRISPR gRNA sequence
cgggctctgctggccccgcc

SEQ ID NO: 707364 - DNA, 20 bp, Artificial
  CRISPR gRNA sequence
ctgctggccccgccaggccc

SEQ ID NO: 707365 - DNA, 20 bp, Artificial
  CRISPR gRNA sequence
cccgccaggccccggccctc

SEQ ID NO: 707366 - DNA, 20 bp, Artificial
  CRISPR gRNA sequence
gccaggccccggccctccgg

SEQ ID NO: 707367 - DNA, 20 bp, Artificial
  CRISPR gRNA sequence
gccccggccctccggcagct

SEQ ID NO: 707368 - DNA, 20 bp, Artificial
  CRISPR gRNA sequence
ctccggcagctcagccttca

SEQ ID NO: 707369 - DNA, 20 bp, Artificial
  CRISPR gRNA sequence
cttcacggtccccacgatca

SEQ ID NO: 707370 - DNA, 20 bp, Artificial
  CRISPR gRNA sequence
ggtccccacgatcacggtgt

SEQ ID NO: 707371 - DNA, 20 bp, Artificial
  CRISPR gRNA sequence
cggtgtcagccttcatgatg

SEQ ID NO: 707372 - DNA, 20 bp, Artificial
  CRISPR gRNA sequence
atgatgtagattttctctgc

SEQ ID NO: 707373 - DNA, 20 bp, Artificial
  CRISPR gRNA sequence
tgatgtagattttctctgca

SEQ ID NO: 707374 - DNA, 20 bp, Artificial
  CRISPR gRNA sequence
agattttctctgcaaggcaa

SEQ ID NO: 707375 - DNA, 20 bp, Artificial
  CRISPR gRNA sequence
gattttctctgcaaggcaaa

SEQ ID NO: 707376 - DNA, 20 bp, Artificial
  CRISPR gRNA sequence
ttctctgcaaggcaaaagga

SEQ ID NO: 707377 - DNA, 20 bp, Artificial
  CRISPR gRNA sequence
tctctgcaaggcaaaaggat

SEQ ID NO: 707378 - DNA, 20 bp, Artificial
  CRISPR gRNA sequence
tgcaaggcaaaaggatgggt

SEQ ID NO: 707379 - DNA, 20 bp, Artificial
  CRISPR gRNA sequence
aggcaaaaggatgggtgagc

SEQ ID NO: 707380 - DNA, 20 bp, Artificial
  CRISPR gRNA sequence
ggcaaaaggatgggtgagcg

SEQ ID NO: 707381 - DNA, 20 bp, Artificial
  CRISPR gRNA sequence
gcaaaaggatgggtgagcga

SEQ ID NO: 707382 - DNA, 20 bp, Artificial
  CRISPR gRNA sequence
aaaaggatgggtgagcgagg

SEQ ID NO: 707383 - DNA, 20 bp, Artificial
  CRISPR gRNA sequence
aaaggatgggtgagcgaggg

SEQ ID NO: 707384 - DNA, 20 bp, Artificial
  CRISPR gRNA sequence
gatgggtgagcgagggaggc

SEQ ID NO: 707385 - DNA, 20 bp, Artificial
  CRISPR gRNA sequence
tgggtgagcgagggaggcca

SEQ ID NO: 707386 - DNA, 20 bp, Artificial
  CRISPR gRNA sequence
agcgagggaggccagagcac

SEQ ID NO: 707387 - DNA, 20 bp, Artificial
  CRISPR gRNA sequence
agggaggccagagcaccagc

SEQ ID NO: 707388 - DNA, 20 bp, Artificial
  CRISPR gRNA sequence
gggaggccagagcaccagcc

SEQ ID NO: 707389 - DNA, 20 bp, Artificial
  CRISPR gRNA sequence
ggccagagcaccagccagga

SEQ ID NO: 707390 - DNA, 20 bp, Artificial
  CRISPR gRNA sequence
gccagagcaccagccaggat

SEQ ID NO: 707391 - DNA, 20 bp, Artificial
  CRISPR gRNA sequence
cagagcaccagccaggatgg

SEQ ID NO: 707392 - DNA, 20 bp, Artificial
  CRISPR gRNA sequence
caccagccaggatgggagca

SEQ ID NO: 707393 - DNA, 20 bp, Artificial
  CRISPR gRNA sequence
ccagccaggatgggagcaaa

SEQ ID NO: 707394 - DNA, 20 bp, Artificial
  CRISPR gRNA sequence
cagccaggatgggagcaaag

SEQ ID NO: 707395 - DNA, 20 bp, Artificial
  CRISPR gRNA sequence
ccaggatgggagcaaagagg

SEQ ID NO: 707396 - DNA, 20 bp, Artificial
  CRISPR gRNA sequence
aggatgggagcaaagaggca

SEQ ID NO: 707397 - DNA, 20 bp, Artificial
  CRISPR gRNA sequence
atgggagcaaagaggcagag

SEQ ID NO: 707398 - DNA, 20 bp, Artificial
  CRISPR gRNA sequence
tgggagcaaagaggcagaga

SEQ ID NO: 707399 - DNA, 20 bp, Artificial
  CRISPR gRNA sequence
gggagcaaagaggcagagaa

SEQ ID NO: 707400 - DNA, 20 bp, Artificial
  CRISPR gRNA sequence
caaagaggcagagaagggcc

SEQ ID NO: 707401 - DNA, 20 bp, Artificial
  CRISPR gRNA sequence
aaagaggcagagaagggccg

SEQ ID NO: 707402 - DNA, 20 bp, Artificial
  CRISPR gRNA sequence
ggcagagaagggccgaggcc

SEQ ID NO: 707403 - DNA, 20 bp, Artificial
  CRISPR gRNA sequence
gaagggccgaggcccagtgc

SEQ ID NO: 707404 - DNA, 20 bp, Artificial
  CRISPR gRNA sequence
cccagtgctggtacacctgc

SEQ ID NO: 707405 - DNA, 20 bp, Artificial
  CRISPR gRNA sequence
ccagtgctggtacacctgcc

SEQ ID NO: 707406 - DNA, 20 bp, Artificial
  CRISPR gRNA sequence
gtgctggtacacctgccggg

SEQ ID NO: 707407 - DNA, 20 bp, Artificial
  CRISPR gRNA sequence
gtacacctgccgggtggctt

SEQ ID NO: 707408 - DNA, 20 bp, Artificial
  CRISPR gRNA sequence
tacacctgccgggtggcttc

SEQ ID NO: 707409 - DNA, 20 bp, Artificial
  CRISPR gRNA sequence
gccgggtggcttcaggctga

SEQ ID NO: 707410 - DNA, 20 bp, Artificial
  CRISPR gRNA sequence
gtggcttcaggctgatggca

SEQ ID NO: 707411 - DNA, 20 bp, Artificial
  CRISPR gRNA sequence
agcctctctgatgtacctta

SEQ ID NO: 707412 - DNA, 20 bp, Artificial
  CRISPR gRNA sequence
gcctctctgatgtaccttac

SEQ ID NO: 707413 - DNA, 20 bp, Artificial
  CRISPR gRNA sequence
gatgtaccttacaggcatcc

SEQ ID NO: 707414 - DNA, 20 bp, Artificial
  CRISPR gRNA sequence
atgtaccttacaggcatcct

SEQ ID NO: 707415 - DNA, 20 bp, Artificial
  CRISPR gRNA sequence
tgtaccttacaggcatcctg

SEQ ID NO: 707416 - DNA, 20 bp, Artificial
  CRISPR gRNA sequence
gtaccttacaggcatcctgg

SEQ ID NO: 707417 - DNA, 20 bp, Artificial
  CRISPR gRNA sequence
ttacaggcatcctgggggct

SEQ ID NO: 707418 - DNA, 20 bp, Artificial
  CRISPR gRNA sequence
acaggcatcctgggggctca

SEQ ID NO: 707419 - DNA, 20 bp, Artificial
  CRISPR gRNA sequence
caggcatcctgggggctcag

SEQ ID NO: 707420 - DNA, 20 bp, Artificial
  CRISPR gRNA sequence
tcctgggggctcagaggaaa

SEQ ID NO: 707421 - DNA, 20 bp, Artificial
  CRISPR gRNA sequence
ggggctcagaggaaatagaa

SEQ ID NO: 707422 - DNA, 20 bp, Artificial
  CRISPR gRNA sequence
ctcagaggaaatagaacagc

SEQ ID NO: 707423 - DNA, 20 bp, Artificial
  CRISPR gRNA sequence
tcagaggaaatagaacagct

SEQ ID NO: 707424 - DNA, 20 bp, Artificial
  CRISPR gRNA sequence
agaggaaatagaacagctag

SEQ ID NO: 707425 - DNA, 20 bp, Artificial
  CRISPR gRNA sequence
gaaatagaacagctaggagc

SEQ ID NO: 707426 - DNA, 20 bp, Artificial
  CRISPR gRNA sequence
aaatagaacagctaggagct

SEQ ID NO: 707427 - DNA, 20 bp, Artificial
  CRISPR gRNA sequence
acagctaggagctgggcctt

SEQ ID NO: 707428 - DNA, 20 bp, Artificial
  CRISPR gRNA sequence
cagctaggagctgggccttg

SEQ ID NO: 707429 - DNA, 20 bp, Artificial
  CRISPR gRNA sequence
gctaggagctgggccttgag

SEQ ID NO: 707430 - DNA, 20 bp, Artificial
  CRISPR gRNA sequence
gagctgggccttgaggagtt

SEQ ID NO: 707431 - DNA, 20 bp, Artificial
  CRISPR gRNA sequence
ggccttgaggagttaagaac

SEQ ID NO: 707432 - DNA, 20 bp, Artificial
  CRISPR gRNA sequence
agaaccagcccacttgtact

SEQ ID NO: 707433 - DNA, 20 bp, Artificial
  CRISPR gRNA sequence
gaaccagcccacttgtactt

SEQ ID NO: 707434 - DNA, 20 bp, Artificial
  CRISPR gRNA sequence
acttgtacttaggattttct

SEQ ID NO: 707435 - DNA, 20 bp, Artificial
  CRISPR gRNA sequence
attttctcagcacatctctg

SEQ ID NO: 707436 - DNA, 20 bp, Artificial
  CRISPR gRNA sequence
tctcagcacatctctgcgga

SEQ ID NO: 707437 - DNA, 20 bp, Artificial
  CRISPR gRNA sequence
ctcagcacatctctgcggat

SEQ ID NO: 707438 - DNA, 20 bp, Artificial
  CRISPR gRNA sequence
agcacatctctgcggatggg

SEQ ID NO: 707439 - DNA, 20 bp, Artificial
  CRISPR gRNA sequence
gcacatctctgcggatgggt

SEQ ID NO: 707440 - DNA, 20 bp, Artificial
  CRISPR gRNA sequence
cacatctctgcggatgggta

SEQ ID NO: 707441 - DNA, 20 bp, Artificial
  CRISPR gRNA sequence
atctctgcggatgggtaggg

SEQ ID NO: 707442 - DNA, 20 bp, Artificial
  CRISPR gRNA sequence
tctgcggatgggtagggaag

SEQ ID NO: 707443 - DNA, 20 bp, Artificial
  CRISPR gRNA sequence
tgcggatgggtagggaagaa

SEQ ID NO: 707444 - DNA, 20 bp, Artificial
  CRISPR gRNA sequence
gcggatgggtagggaagaag

SEQ ID NO: 707445 - DNA, 20 bp, Artificial
  CRISPR gRNA sequence
atgggtagggaagaagagga

SEQ ID NO: 707446 - DNA, 20 bp, Artificial
  CRISPR gRNA sequence
tgggtagggaagaagaggac

SEQ ID NO: 707447 - DNA, 20 bp, Artificial
  CRISPR gRNA sequence
gggtagggaagaagaggaca

SEQ ID NO: 707448 - DNA, 20 bp, Artificial
  CRISPR gRNA sequence
tagggaagaagaggacaggg

SEQ ID NO: 707449 - DNA, 20 bp, Artificial
  CRISPR gRNA sequence
agggaagaagaggacagggt

SEQ ID NO: 707450 - DNA, 20 bp, Artificial
  CRISPR gRNA sequence
aagaagaggacagggtggga

SEQ ID NO: 707451 - DNA, 20 bp, Artificial
  CRISPR gRNA sequence
agaggacagggtgggacaga

SEQ ID NO: 707452 - DNA, 20 bp, Artificial
  CRISPR gRNA sequence
gtgggacagaaagcaaactg

SEQ ID NO: 707453 - DNA, 20 bp, Artificial
  CRISPR gRNA sequence
aagcaaactgtggacaaaaa

SEQ ID NO: 707454 - DNA, 20 bp, Artificial
  CRISPR gRNA sequence
agcaaactgtggacaaaaac

SEQ ID NO: 707455 - DNA, 20 bp, Artificial
  CRISPR gRNA sequence
actgtggacaaaaacaggca

SEQ ID NO: 707456 - DNA, 20 bp, Artificial
  CRISPR gRNA sequence
gacaaaaacaggcaaagccg

SEQ ID NO: 707457 - DNA, 20 bp, Artificial
  CRISPR gRNA sequence
acaaaaacaggcaaagccgt

SEQ ID NO: 707458 - DNA, 20 bp, Artificial
  CRISPR gRNA sequence
caggcaaagccgtgggtaac

SEQ ID NO: 707459 - DNA, 20 bp, Artificial
  CRISPR gRNA sequence
ggcaaagccgtgggtaacca

SEQ ID NO: 707460 - DNA, 20 bp, Artificial
  CRISPR gRNA sequence
gccgtgggtaaccagagcac

SEQ ID NO: 707461 - DNA, 20 bp, Artificial
  CRISPR gRNA sequence
gtgggtaaccagagcacgag

SEQ ID NO: 707462 - DNA, 20 bp, Artificial
  CRISPR gRNA sequence
aaccagagcacgagcagaaa

SEQ ID NO: 707463 - DNA, 20 bp, Artificial
  CRISPR gRNA sequence
cagagcacgagcagaaacag

SEQ ID NO: 707464 - DNA, 20 bp, Artificial
  CRISPR gRNA sequence
gagcacgagcagaaacagca

SEQ ID NO: 707465 - DNA, 20 bp, Artificial
  CRISPR gRNA sequence
cgagcagaaacagcagagct

SEQ ID NO: 707466 - DNA, 20 bp, Artificial
  CRISPR gRNA sequence
gcagaaacagcagagctgag

SEQ ID NO: 707467 - DNA, 20 bp, Artificial
  CRISPR gRNA sequence
agtttccacacccccactcc

SEQ ID NO: 707468 - DNA, 20 bp, Artificial
  CRISPR gRNA sequence
gtttccacacccccactcct

SEQ ID NO: 707469 - DNA, 20 bp, Artificial
  CRISPR gRNA sequence
cacccccactcctgggtccc

SEQ ID NO: 707470 - DNA, 20 bp, Artificial
  CRISPR gRNA sequence
tgggtccccagccctcctgc

SEQ ID NO: 707471 - DNA, 20 bp, Artificial
  CRISPR gRNA sequence
gggtccccagccctcctgca

SEQ ID NO: 707472 - DNA, 20 bp, Artificial
  CRISPR gRNA sequence
tccccagccctcctgcaagg

SEQ ID NO: 707473 - DNA, 20 bp, Artificial
  CRISPR gRNA sequence
cctgcaaggcggaccccatc

SEQ ID NO: 707474 - DNA, 20 bp, Artificial
  CRISPR gRNA sequence
cccatcaagattcccattta

SEQ ID NO: 707475 - DNA, 20 bp, Artificial
  CRISPR gRNA sequence
ccatcaagattcccatttac

SEQ ID NO: 707476 - DNA, 20 bp, Artificial
  CRISPR gRNA sequence
caagattcccatttacaggt

SEQ ID NO: 707477 - DNA, 20 bp, Artificial
  CRISPR gRNA sequence
catttacaggtaagaatctg

SEQ ID NO: 707478 - DNA, 20 bp, Artificial
  CRISPR gRNA sequence
acaggtaagaatctgaagcc

SEQ ID NO: 707479 - DNA, 20 bp, Artificial
  CRISPR gRNA sequence
aggtaagaatctgaagcctg

SEQ ID NO: 707480 - DNA, 20 bp, Artificial
  CRISPR gRNA sequence
gtaagaatctgaagcctgga

SEQ ID NO: 707481 - DNA, 20 bp, Artificial
  CRISPR gRNA sequence
taagaatctgaagcctggag

SEQ ID NO: 707482 - DNA, 20 bp, Artificial
  CRISPR gRNA sequence
agaggttaaatgacctgccc

SEQ ID NO: 707483 - DNA, 20 bp, Artificial
  CRISPR gRNA sequence
gaggttaaatgacctgccca

SEQ ID NO: 707484 - DNA, 20 bp, Artificial
  CRISPR gRNA sequence
acctgcccaaggtcgccacg

SEQ ID NO: 707485 - DNA, 20 bp, Artificial
  CRISPR gRNA sequence
gcccaaggtcgccacgtagt

SEQ ID NO: 707486 - DNA, 20 bp, Artificial
  CRISPR gRNA sequence
cccaaggtcgccacgtagtt

SEQ ID NO: 707487 - DNA, 20 bp, Artificial
  CRISPR gRNA sequence
caaggtcgccacgtagttag

SEQ ID NO: 707488 - DNA, 20 bp, Artificial
  CRISPR gRNA sequence
aaaaaaccacccactccgcc

SEQ ID NO: 707489 - DNA, 20 bp, Artificial
  CRISPR gRNA sequence
aaaccacccactccgcctgg

SEQ ID NO: 707490 - DNA, 20 bp, Artificial
  CRISPR gRNA sequence
tgctcctatctgtgtgcctg

SEQ ID NO: 707491 - DNA, 20 bp, Artificial
  CRISPR gRNA sequence
gtgtgcctgcagccaaaacc

SEQ ID NO: 707492 - DNA, 20 bp, Artificial
  CRISPR gRNA sequence
tgtgcctgcagccaaaaccc

SEQ ID NO: 707493 - DNA, 20 bp, Artificial
  CRISPR gRNA sequence
gtgcctgcagccaaaacccg

SEQ ID NO: 707494 - DNA, 20 bp, Artificial
  CRISPR gRNA sequence
cccggggtgaccaacttgtc

SEQ ID NO: 707495 - DNA, 20 bp, Artificial
  CRISPR gRNA sequence
accaacttgtccagcttgcc

SEQ ID NO: 707496 - DNA, 20 bp, Artificial
  CRISPR gRNA sequence
ccaacttgtccagcttgccc

SEQ ID NO: 707497 - DNA, 20 bp, Artificial
  CRISPR gRNA sequence
agcttgcccgggaacattcc

SEQ ID NO: 707498 - DNA, 20 bp, Artificial
  CRISPR gRNA sequence
attcctggttctactactgc

SEQ ID NO: 707499 - DNA, 20 bp, Artificial
  CRISPR gRNA sequence
ctactgcaagtcccgtgtcc

SEQ ID NO: 707500 - DNA, 20 bp, Artificial
  CRISPR gRNA sequence
tactgcaagtcccgtgtcct

SEQ ID NO: 707501 - DNA, 20 bp, Artificial
  CRISPR gRNA sequence
ctgcaagtcccgtgtcctgg

SEQ ID NO: 707502 - DNA, 20 bp, Artificial
  CRISPR gRNA sequence
ccgtgtcctgggagtcccct

SEQ ID NO: 707503 - DNA, 20 bp, Artificial
  CRISPR gRNA sequence
tcctgggagtcccctcggtc

SEQ ID NO: 707504 - DNA, 20 bp, Artificial
  CRISPR gRNA sequence
cctgggagtcccctcggtcc

SEQ ID NO: 707505 - DNA, 20 bp, Artificial
  CRISPR gRNA sequence
cccctcggtccgggcaaact

SEQ ID NO: 707506 - DNA, 20 bp, Artificial
  CRISPR gRNA sequence
tcggtccgggcaaactcagc

SEQ ID NO: 707507 - DNA, 20 bp, Artificial
  CRISPR gRNA sequence
agccagcctgtcacatcctg

SEQ ID NO: 707508 - DNA, 20 bp, Artificial
  CRISPR gRNA sequence
gtcacatcctgcagaaaacc

SEQ ID NO: 707509 - DNA, 20 bp, Artificial
  CRISPR gRNA sequence
agaaaacccggccccctcaa

SEQ ID NO: 707510 - DNA, 20 bp, Artificial
  CRISPR gRNA sequence
gaaaacccggccccctcaat

SEQ ID NO: 707511 - DNA, 20 bp, Artificial
  CRISPR gRNA sequence
ccggccccctcaataggtct

SEQ ID NO: 707512 - DNA, 20 bp, Artificial
  CRISPR gRNA sequence
gccccctcaataggtctcgg

SEQ ID NO: 707513 - DNA, 20 bp, Artificial
  CRISPR gRNA sequence
ggtctcggcagcccatgatt

SEQ ID NO: 707514 - DNA, 20 bp, Artificial
  CRISPR gRNA sequence
tcggcagcccatgattgaga

SEQ ID NO: 707515 - DNA, 20 bp, Artificial
  CRISPR gRNA sequence
agcccatgattgagacagcc

SEQ ID NO: 707516 - DNA, 20 bp, Artificial
  CRISPR gRNA sequence
atgattgagacagcctggct

SEQ ID NO: 707517 - DNA, 20 bp, Artificial
  CRISPR gRNA sequence
tgattgagacagcctggctc

SEQ ID NO: 707518 - DNA, 20 bp, Artificial
  CRISPR gRNA sequence
ctggctcaggccgtgaattt

SEQ ID NO: 707519 - DNA, 20 bp, Artificial
  CRISPR gRNA sequence
tggctcaggccgtgaatttc

SEQ ID NO: 707520 - DNA, 20 bp, Artificial
  CRISPR gRNA sequence
ggctcaggccgtgaatttcg

SEQ ID NO: 707521 - DNA, 20 bp, Artificial
  CRISPR gRNA sequence
atttcggggcttactgctca

SEQ ID NO: 707522 - DNA, 20 bp, Artificial
  CRISPR gRNA sequence
cggggcttactgctcacagc

SEQ ID NO: 707523 - DNA, 20 bp, Artificial
  CRISPR gRNA sequence
cacagccggtctcctgcctg

SEQ ID NO: 707524 - DNA, 20 bp, Artificial
  CRISPR gRNA sequence
tctcctgcctgcagcgtgca

SEQ ID NO: 707525 - DNA, 20 bp, Artificial
  CRISPR gRNA sequence
agcgtgcatggctgtgctgt

SEQ ID NO: 707526 - DNA, 20 bp, Artificial
  CRISPR gRNA sequence
atggctgtgctgtgagcaca

SEQ ID NO: 707527 - DNA, 20 bp, Artificial
  CRISPR gRNA sequence
gctgtgctgtgagcacatgg

SEQ ID NO: 707528 - DNA, 20 bp, Artificial
  CRISPR gRNA sequence
ctgtgctgtgagcacatggt

SEQ ID NO: 707529 - DNA, 20 bp, Artificial
  CRISPR gRNA sequence
gtgctgtgagcacatggtgg

SEQ ID NO: 707530 - DNA, 20 bp, Artificial
  CRISPR gRNA sequence
gtgagcacatggtgggagct

SEQ ID NO: 707531 - DNA, 20 bp, Artificial
  CRISPR gRNA sequence
gcacatggtgggagcttgga

SEQ ID NO: 707532 - DNA, 20 bp, Artificial
  CRISPR gRNA sequence
acatggtgggagcttggacg

SEQ ID NO: 707533 - DNA, 20 bp, Artificial
  CRISPR gRNA sequence
catggtgggagcttggacgg

SEQ ID NO: 707534 - DNA, 20 bp, Artificial
  CRISPR gRNA sequence
atggtgggagcttggacgga

SEQ ID NO: 707535 - DNA, 20 bp, Artificial
  CRISPR gRNA sequence
tgggagcttggacggagggc

SEQ ID NO: 707536 - DNA, 20 bp, Artificial
  CRISPR gRNA sequence
cggagggccggtcctcgcca

SEQ ID NO: 707537 - DNA, 20 bp, Artificial
  CRISPR gRNA sequence
gtcctcgccacagtctgatg

SEQ ID NO: 707538 - DNA, 20 bp, Artificial
  CRISPR gRNA sequence
tcctcgccacagtctgatgt

SEQ ID NO: 707539 - DNA, 20 bp, Artificial
  CRISPR gRNA sequence
cctcgccacagtctgatgtg

SEQ ID NO: 707540 - DNA, 20 bp, Artificial
  CRISPR gRNA sequence
ctcgccacagtctgatgtgg

SEQ ID NO: 707541 - DNA, 20 bp, Artificial
  CRISPR gRNA sequence
cagtctgatgtgggggcttc

SEQ ID NO: 707542 - DNA, 20 bp, Artificial
  CRISPR gRNA sequence
tgatgtgggggcttctggtg

SEQ ID NO: 707543 - DNA, 20 bp, Artificial
  CRISPR gRNA sequence
cttctggtgtggccttctga

SEQ ID NO: 707544 - DNA, 20 bp, Artificial
  CRISPR gRNA sequence
tctggtgtggccttctgata

SEQ ID NO: 707545 - DNA, 20 bp, Artificial
  CRISPR gRNA sequence
ctggtgtggccttctgatag

SEQ ID NO: 707546 - DNA, 20 bp, Artificial
  CRISPR gRNA sequence
tggtgtggccttctgataga

SEQ ID NO: 707547 - DNA, 20 bp, Artificial
  CRISPR gRNA sequence
ggtgtggccttctgatagag

SEQ ID NO: 707548 - DNA, 20 bp, Artificial
  CRISPR gRNA sequence
gccttctgatagaggggaca

SEQ ID NO: 707549 - DNA, 20 bp, Artificial
  CRISPR gRNA sequence
ccttctgatagaggggacat

SEQ ID NO: 707550 - DNA, 20 bp, Artificial
  CRISPR gRNA sequence
cttctgatagaggggacatg

SEQ ID NO: 707551 - DNA, 20 bp, Artificial
  CRISPR gRNA sequence
ttctgatagaggggacatgg

SEQ ID NO: 707552 - DNA, 20 bp, Artificial
  CRISPR gRNA sequence
atagaggggacatgggggct

SEQ ID NO: 707553 - DNA, 20 bp, Artificial
  CRISPR gRNA sequence
tagaggggacatgggggctc

SEQ ID NO: 707554 - DNA, 20 bp, Artificial
  CRISPR gRNA sequence
gggacatgggggctcaggtt

SEQ ID NO: 707555 - DNA, 20 bp, Artificial
  CRISPR gRNA sequence
acatgggggctcaggttcag

SEQ ID NO: 707556 - DNA, 20 bp, Artificial
  CRISPR gRNA sequence
gggctcaggttcagtggccc

SEQ ID NO: 707557 - DNA, 20 bp, Artificial
  CRISPR gRNA sequence
ggctcaggttcagtggcccg

SEQ ID NO: 707558 - DNA, 20 bp, Artificial
  CRISPR gRNA sequence
ctcaggttcagtggcccgag

SEQ ID NO: 707559 - DNA, 20 bp, Artificial
  CRISPR gRNA sequence
ggttcagtggcccgaggagc

SEQ ID NO: 707560 - DNA, 20 bp, Artificial
  CRISPR gRNA sequence
gttcagtggcccgaggagct

SEQ ID NO: 707561 - DNA, 20 bp, Artificial
  CRISPR gRNA sequence
ttcagtggcccgaggagctg

SEQ ID NO: 707562 - DNA, 20 bp, Artificial
  CRISPR gRNA sequence
cagtggcccgaggagctggg

SEQ ID NO: 707563 - DNA, 20 bp, Artificial
  CRISPR gRNA sequence
tggcccgaggagctggggag

SEQ ID NO: 707564 - DNA, 20 bp, Artificial
  CRISPR gRNA sequence
ggcccgaggagctggggagt

SEQ ID NO: 707565 - DNA, 20 bp, Artificial
  CRISPR gRNA sequence
gcccgaggagctggggagtg

SEQ ID NO: 707566 - DNA, 20 bp, Artificial
  CRISPR gRNA sequence
cgaggagctggggagtgggg

SEQ ID NO: 707567 - DNA, 20 bp, Artificial
  CRISPR gRNA sequence
agctggggagtggggaagcc

SEQ ID NO: 707568 - DNA, 20 bp, Artificial
  CRISPR gRNA sequence
ggggaagcctggcctccgcc

SEQ ID NO: 707569 - DNA, 20 bp, Artificial
  CRISPR gRNA sequence
cctggcctccgcccagctga

SEQ ID NO: 707570 - DNA, 20 bp, Artificial
  CRISPR gRNA sequence
tccgcccagctgatggtgtc

SEQ ID NO: 707571 - DNA, 20 bp, Artificial
  CRISPR gRNA sequence
ccagctgatggtgtctggct

SEQ ID NO: 707572 - DNA, 20 bp, Artificial
  CRISPR gRNA sequence
cagctgatggtgtctggctc

SEQ ID NO: 707573 - DNA, 20 bp, Artificial
  CRISPR gRNA sequence
agctgatggtgtctggctca

SEQ ID NO: 707574 - DNA, 20 bp, Artificial
  CRISPR gRNA sequence
tgatggtgtctggctcaggg

SEQ ID NO: 707575 - DNA, 20 bp, Artificial
  CRISPR gRNA sequence
gatggtgtctggctcagggt

SEQ ID NO: 707576 - DNA, 20 bp, Artificial
  CRISPR gRNA sequence
gtgtctggctcagggtgggc

SEQ ID NO: 707577 - DNA, 20 bp, Artificial
  CRISPR gRNA sequence
gctcagggtgggctggctcc

SEQ ID NO: 707578 - DNA, 20 bp, Artificial
  CRISPR gRNA sequence
ggctcccagctgttctgcgc

SEQ ID NO: 707579 - DNA, 20 bp, Artificial
  CRISPR gRNA sequence
agctgttctgcgctggactc

SEQ ID NO: 707580 - DNA, 20 bp, Artificial
  CRISPR gRNA sequence
ctgttctgcgctggactctg

SEQ ID NO: 707581 - DNA, 20 bp, Artificial
  CRISPR gRNA sequence
tgttctgcgctggactctgg

SEQ ID NO: 707582 - DNA, 20 bp, Artificial
  CRISPR gRNA sequence
ctgcgctggactctggaggc

SEQ ID NO: 707583 - DNA, 20 bp, Artificial
  CRISPR gRNA sequence
ctggactctggaggccagaa

SEQ ID NO: 707584 - DNA, 20 bp, Artificial
  CRISPR gRNA sequence
tggactctggaggccagaat

SEQ ID NO: 707585 - DNA, 20 bp, Artificial
  CRISPR gRNA sequence
ggactctggaggccagaatg

SEQ ID NO: 707586 - DNA, 20 bp, Artificial
  CRISPR gRNA sequence
ctctggaggccagaatgggg

SEQ ID NO: 707587 - DNA, 20 bp, Artificial
  CRISPR gRNA sequence
aggccagaatggggaagctc

SEQ ID NO: 707588 - DNA, 20 bp, Artificial
  CRISPR gRNA sequence
gccagaatggggaagctcaa

SEQ ID NO: 707589 - DNA, 20 bp, Artificial
  CRISPR gRNA sequence
ccagaatggggaagctcaag

SEQ ID NO: 707590 - DNA, 20 bp, Artificial
  CRISPR gRNA sequence
cagaatggggaagctcaaga

SEQ ID NO: 707591 - DNA, 20 bp, Artificial
  CRISPR gRNA sequence
ggaagctcaagagggaactt

SEQ ID NO: 707592 - DNA, 20 bp, Artificial
  CRISPR gRNA sequence
aagctcaagagggaacttga

SEQ ID NO: 707593 - DNA, 20 bp, Artificial
  CRISPR gRNA sequence
tcaagagggaacttgagagc

SEQ ID NO: 707594 - DNA, 20 bp, Artificial
  CRISPR gRNA sequence
caagagggaacttgagagct

SEQ ID NO: 707595 - DNA, 20 bp, Artificial
  CRISPR gRNA sequence
aagagggaacttgagagctg

SEQ ID NO: 707596 - DNA, 20 bp, Artificial
  CRISPR gRNA sequence
agggaacttgagagctgggg

SEQ ID NO: 707597 - DNA, 20 bp, Artificial
  CRISPR gRNA sequence
gggaacttgagagctggggt

SEQ ID NO: 707598 - DNA, 20 bp, Artificial
  CRISPR gRNA sequence
ggaacttgagagctggggtg

SEQ ID NO: 707599 - DNA, 20 bp, Artificial
  CRISPR gRNA sequence
acttgagagctggggtgggg

SEQ ID NO: 707600 - DNA, 20 bp, Artificial
  CRISPR gRNA sequence
cttgagagctggggtggggt

SEQ ID NO: 707601 - DNA, 20 bp, Artificial
  CRISPR gRNA sequence
ttgagagctggggtggggtg

SEQ ID NO: 707602 - DNA, 20 bp, Artificial
  CRISPR gRNA sequence
tgagagctggggtggggtgg

SEQ ID NO: 707603 - DNA, 20 bp, Artificial
  CRISPR gRNA sequence
gctggggtggggtgggggtg

SEQ ID NO: 707604 - DNA, 20 bp, Artificial
  CRISPR gRNA sequence
ctggggtggggtgggggtgc

SEQ ID NO: 707605 - DNA, 20 bp, Artificial
  CRISPR gRNA sequence
tggggtggggtgggggtgca

SEQ ID NO: 707606 - DNA, 20 bp, Artificial
  CRISPR gRNA sequence
tgcagggacccctgcctttc

SEQ ID NO: 707607 - DNA, 20 bp, Artificial
  CRISPR gRNA sequence
gcagggacccctgcctttct

SEQ ID NO: 707608 - DNA, 20 bp, Artificial
  CRISPR gRNA sequence
ccctgcctttctgggtaatg

SEQ ID NO: 707609 - DNA, 20 bp, Artificial
  CRISPR gRNA sequence
ggtaatgcagttatacccct

SEQ ID NO: 707610 - DNA, 20 bp, Artificial
  CRISPR gRNA sequence
gcagttatacccctcggatt

SEQ ID NO: 707611 - DNA, 20 bp, Artificial
  CRISPR gRNA sequence
cagttatacccctcggattc

SEQ ID NO: 707612 - DNA, 20 bp, Artificial
  CRISPR gRNA sequence
tcggattcaggaaccccaaa

SEQ ID NO: 707613 - DNA, 20 bp, Artificial
  CRISPR gRNA sequence
cggattcaggaaccccaaaa

SEQ ID NO: 707614 - DNA, 20 bp, Artificial
  CRISPR gRNA sequence
ggaaccccaaaaaggttctc

SEQ ID NO: 707615 - DNA, 20 bp, Artificial
  CRISPR gRNA sequence
tcaaccctattgcatgacgc

SEQ ID NO: 707616 - DNA, 20 bp, Artificial
  CRISPR gRNA sequence
tgacgctggttcttctattc

SEQ ID NO: 707617 - DNA, 20 bp, Artificial
  CRISPR gRNA sequence
attctggttttgaacacccc

SEQ ID NO: 707618 - DNA, 20 bp, Artificial
  CRISPR gRNA sequence
ttctggttttgaacaccccc

SEQ ID NO: 707619 - DNA, 20 bp, Artificial
  CRISPR gRNA sequence
ggttttgaacacccccagga

SEQ ID NO: 707620 - DNA, 20 bp, Artificial
  CRISPR gRNA sequence
ttttgaacacccccaggaaa

SEQ ID NO: 707621 - DNA, 20 bp, Artificial
  CRISPR gRNA sequence
ttgaacacccccaggaaaga

SEQ ID NO: 707622 - DNA, 20 bp, Artificial
  CRISPR gRNA sequence
aacacccccaggaaagagag

SEQ ID NO: 707623 - DNA, 20 bp, Artificial
  CRISPR gRNA sequence
aaagagagaagtgcgccaaa

SEQ ID NO: 707624 - DNA, 20 bp, Artificial
  CRISPR gRNA sequence
gagagaagtgcgccaaacgg

SEQ ID NO: 707625 - DNA, 20 bp, Artificial
  CRISPR gRNA sequence
gaagtgcgccaaacggcagc

SEQ ID NO: 707626 - DNA, 20 bp, Artificial
  CRISPR gRNA sequence
agtgcgccaaacggcagcaa

SEQ ID NO: 707627 - DNA, 20 bp, Artificial
  CRISPR gRNA sequence
gtgcgccaaacggcagcaag

SEQ ID NO: 707628 - DNA, 20 bp, Artificial
  CRISPR gRNA sequence
gcgccaaacggcagcaagag

SEQ ID NO: 707629 - DNA, 20 bp, Artificial
  CRISPR gRNA sequence
ccaaacggcagcaagaggag

SEQ ID NO: 707630 - DNA, 20 bp, Artificial
  CRISPR gRNA sequence
caaacggcagcaagaggaga

SEQ ID NO: 707631 - DNA, 20 bp, Artificial
  CRISPR gRNA sequence
ggcagcaagaggagaaggcc

SEQ ID NO: 707632 - DNA, 20 bp, Artificial
  CRISPR gRNA sequence
cagcaagaggagaaggccca

SEQ ID NO: 707633 - DNA, 20 bp, Artificial
  CRISPR gRNA sequence
agaggagaaggcccagagtg

SEQ ID NO: 707634 - DNA, 20 bp, Artificial
  CRISPR gRNA sequence
gaggagaaggcccagagtgc

SEQ ID NO: 707635 - DNA, 20 bp, Artificial
  CRISPR gRNA sequence
agaaggcccagagtgcggga

SEQ ID NO: 707636 - DNA, 20 bp, Artificial
  CRISPR gRNA sequence
gaaggcccagagtgcgggac

SEQ ID NO: 707637 - DNA, 20 bp, Artificial
  CRISPR gRNA sequence
ccagagtgcgggacaggcta

SEQ ID NO: 707638 - DNA, 20 bp, Artificial
  CRISPR gRNA sequence
cagagtgcgggacaggctat

SEQ ID NO: 707639 - DNA, 20 bp, Artificial
  CRISPR gRNA sequence
gtgcgggacaggctatgggc

SEQ ID NO: 707640 - DNA, 20 bp, Artificial
  CRISPR gRNA sequence
tgcgggacaggctatgggct

SEQ ID NO: 707641 - DNA, 20 bp, Artificial
  CRISPR gRNA sequence
ctatgggctgggcgccccca

SEQ ID NO: 707642 - DNA, 20 bp, Artificial
  CRISPR gRNA sequence
cgcccccacagaccccaaaa

SEQ ID NO: 707643 - DNA, 20 bp, Artificial
  CRISPR gRNA sequence
cccccacagaccccaaaaca

SEQ ID NO: 707644 - DNA, 20 bp, Artificial
  CRISPR gRNA sequence
ccacagaccccaaaacagag

SEQ ID NO: 707645 - DNA, 20 bp, Artificial
  CRISPR gRNA sequence
cacagaccccaaaacagagc

SEQ ID NO: 707646 - DNA, 20 bp, Artificial
  CRISPR gRNA sequence
acagaccccaaaacagagca

SEQ ID NO: 707647 - DNA, 20 bp, Artificial
  CRISPR gRNA sequence
cccaaaacagagcagggcct

SEQ ID NO: 707648 - DNA, 20 bp, Artificial
  CRISPR gRNA sequence
agcactccccacacctccat

SEQ ID NO: 707649 - DNA, 20 bp, Artificial
  CRISPR gRNA sequence
gcactccccacacctccatc

SEQ ID NO: 707650 - DNA, 20 bp, Artificial
  CRISPR gRNA sequence
ccacacctccatcaggcttg

SEQ ID NO: 707651 - DNA, 20 bp, Artificial
  CRISPR gRNA sequence
cacacctccatcaggcttgt

SEQ ID NO: 707652 - DNA, 20 bp, Artificial
  CRISPR gRNA sequence
ccatcaggcttgtgggctcc

SEQ ID NO: 707653 - DNA, 20 bp, Artificial
  CRISPR gRNA sequence
ggcttgtgggctcccagccc

SEQ ID NO: 707654 - DNA, 20 bp, Artificial
  CRISPR gRNA sequence
gcttgtgggctcccagccct

SEQ ID NO: 707655 - DNA, 20 bp, Artificial
  CRISPR gRNA sequence
ttgtgggctcccagccctag

SEQ ID NO: 707656 - DNA, 20 bp, Artificial
  CRISPR gRNA sequence
tcccagccctaggagcccta

SEQ ID NO: 707657 - DNA, 20 bp, Artificial
  CRISPR gRNA sequence
ccagccctaggagccctata

SEQ ID NO: 707658 - DNA, 20 bp, Artificial
  CRISPR gRNA sequence
cagccctaggagccctatag

SEQ ID NO: 707659 - DNA, 20 bp, Artificial
  CRISPR gRNA sequence
agccctaggagccctataga

SEQ ID NO: 707660 - DNA, 20 bp, Artificial
  CRISPR gRNA sequence
ctaggagccctatagagggc

SEQ ID NO: 707661 - DNA, 20 bp, Artificial
  CRISPR gRNA sequence
taggagccctatagagggct

SEQ ID NO: 707662 - DNA, 20 bp, Artificial
  CRISPR gRNA sequence
ccctatagagggctgggcaa

SEQ ID NO: 707663 - DNA, 20 bp, Artificial
  CRISPR gRNA sequence
atagagggctgggcaaaaga

SEQ ID NO: 707664 - DNA, 20 bp, Artificial
  CRISPR gRNA sequence
tagagggctgggcaaaagat

SEQ ID NO: 707665 - DNA, 20 bp, Artificial
  CRISPR gRNA sequence
agagggctgggcaaaagatg

SEQ ID NO: 707666 - DNA, 20 bp, Artificial
  CRISPR gRNA sequence
gagggctgggcaaaagatgg

SEQ ID NO: 707667 - DNA, 20 bp, Artificial
  CRISPR gRNA sequence
gctgggcaaaagatgggggc

SEQ ID NO: 707668 - DNA, 20 bp, Artificial
  CRISPR gRNA sequence
ctgggcaaaagatgggggcc

SEQ ID NO: 707669 - DNA, 20 bp, Artificial
  CRISPR gRNA sequence
tgggcaaaagatgggggccg

SEQ ID NO: 707670 - DNA, 20 bp, Artificial
  CRISPR gRNA sequence
gggcaaaagatgggggccgg

SEQ ID NO: 707671 - DNA, 20 bp, Artificial
  CRISPR gRNA sequence
caaaagatgggggccggggg

SEQ ID NO: 707672 - DNA, 20 bp, Artificial
  CRISPR gRNA sequence
agatgggggccgggggtggt

SEQ ID NO: 707673 - DNA, 20 bp, Artificial
  CRISPR gRNA sequence
atgggggccgggggtggtga

SEQ ID NO: 707674 - DNA, 20 bp, Artificial
  CRISPR gRNA sequence
gggggccgggggtggtgaga

SEQ ID NO: 707675 - DNA, 20 bp, Artificial
  CRISPR gRNA sequence
ggggccgggggtggtgagag

SEQ ID NO: 707676 - DNA, 20 bp, Artificial
  CRISPR gRNA sequence
ggccgggggtggtgagagag

SEQ ID NO: 707677 - DNA, 20 bp, Artificial
  CRISPR gRNA sequence
ggtggtgagagaggagaccc

SEQ ID NO: 707678 - DNA, 20 bp, Artificial
  CRISPR gRNA sequence
gtggtgagagaggagacccc

SEQ ID NO: 707679 - DNA, 20 bp, Artificial
  CRISPR gRNA sequence
ggtgagagaggagaccccag

SEQ ID NO: 707680 - DNA, 20 bp, Artificial
  CRISPR gRNA sequence
gtgagagaggagaccccagg

SEQ ID NO: 707681 - DNA, 20 bp, Artificial
  CRISPR gRNA sequence
tgagagaggagaccccagga

SEQ ID NO: 707682 - DNA, 20 bp, Artificial
  CRISPR gRNA sequence
gagagaggagaccccaggag

SEQ ID NO: 707683 - DNA, 20 bp, Artificial
  CRISPR gRNA sequence
gagaggagaccccaggaggg

SEQ ID NO: 707684 - DNA, 20 bp, Artificial
  CRISPR gRNA sequence
gaggagaccccaggagggga

SEQ ID NO: 707685 - DNA, 20 bp, Artificial
  CRISPR gRNA sequence
gagaccccaggaggggagag

SEQ ID NO: 707686 - DNA, 20 bp, Artificial
  CRISPR gRNA sequence
agaccccaggaggggagaga

SEQ ID NO: 707687 - DNA, 20 bp, Artificial
  CRISPR gRNA sequence
ccaggaggggagagaaggcc

SEQ ID NO: 707688 - DNA, 20 bp, Artificial
  CRISPR gRNA sequence
aggaggggagagaaggccca

SEQ ID NO: 707689 - DNA, 20 bp, Artificial
  CRISPR gRNA sequence
ggaggggagagaaggcccag

SEQ ID NO: 707690 - DNA, 20 bp, Artificial
  CRISPR gRNA sequence
gaggggagagaaggcccaga

SEQ ID NO: 707691 - DNA, 20 bp, Artificial
  CRISPR gRNA sequence
aggggagagaaggcccagag

SEQ ID NO: 707692 - DNA, 20 bp, Artificial
  CRISPR gRNA sequence
ggggagagaaggcccagagg

SEQ ID NO: 707693 - DNA, 20 bp, Artificial
  CRISPR gRNA sequence
agagaaggcccagaggggga

SEQ ID NO: 707694 - DNA, 20 bp, Artificial
  CRISPR gRNA sequence
gagaaggcccagagggggat

SEQ ID NO: 707695 - DNA, 20 bp, Artificial
  CRISPR gRNA sequence
aaggcccagagggggatggg

SEQ ID NO: 707696 - DNA, 20 bp, Artificial
  CRISPR gRNA sequence
ggcccagagggggatgggca

SEQ ID NO: 707697 - DNA, 20 bp, Artificial
  CRISPR gRNA sequence
ccagagggggatgggcagag

SEQ ID NO: 707698 - DNA, 20 bp, Artificial
  CRISPR gRNA sequence
gggggatgggcagagaagat

SEQ ID NO: 707699 - DNA, 20 bp, Artificial
  CRISPR gRNA sequence
gggatgggcagagaagatga

SEQ ID NO: 707700 - DNA, 20 bp, Artificial
  CRISPR gRNA sequence
ggatgggcagagaagatgag

SEQ ID NO: 707701 - DNA, 20 bp, Artificial
  CRISPR gRNA sequence
tgggcagagaagatgagagg

SEQ ID NO: 707702 - DNA, 20 bp, Artificial
  CRISPR gRNA sequence
gggcagagaagatgagaggc

SEQ ID NO: 707703 - DNA, 20 bp, Artificial
  CRISPR gRNA sequence
cagagaagatgagaggcggg

SEQ ID NO: 707704 - DNA, 20 bp, Artificial
  CRISPR gRNA sequence
agagaagatgagaggcgggt

SEQ ID NO: 707705 - DNA, 20 bp, Artificial
  CRISPR gRNA sequence
gagaagatgagaggcgggtg

SEQ ID NO: 707706 - DNA, 20 bp, Artificial
  CRISPR gRNA sequence
agatgagaggcgggtggggt

SEQ ID NO: 707707 - DNA, 20 bp, Artificial
  CRISPR gRNA sequence
gatgagaggcgggtggggtc

SEQ ID NO: 707708 - DNA, 20 bp, Artificial
  CRISPR gRNA sequence
gagaggcgggtggggtcagg

SEQ ID NO: 707709 - DNA, 20 bp, Artificial
  CRISPR gRNA sequence
agaggcgggtggggtcaggt

SEQ ID NO: 707710 - DNA, 20 bp, Artificial
  CRISPR gRNA sequence
aggcgggtggggtcaggtgg

SEQ ID NO: 707711 - DNA, 20 bp, Artificial
  CRISPR gRNA sequence
ggcgggtggggtcaggtggg

SEQ ID NO: 707712 - DNA, 20 bp, Artificial
  CRISPR gRNA sequence
gcgggtggggtcaggtggga

SEQ ID NO: 707713 - DNA, 20 bp, Artificial
  CRISPR gRNA sequence
ggtggggtcaggtgggaggg

SEQ ID NO: 707714 - DNA, 20 bp, Artificial
  CRISPR gRNA sequence
gggtcaggtgggagggaagt

SEQ ID NO: 707715 - DNA, 20 bp, Artificial
  CRISPR gRNA sequence
ggtcaggtgggagggaagtg

SEQ ID NO: 707716 - DNA, 20 bp, Artificial
  CRISPR gRNA sequence
gtcaggtgggagggaagtga

SEQ ID NO: 707717 - DNA, 20 bp, Artificial
  CRISPR gRNA sequence
aggtgggagggaagtgaggg

SEQ ID NO: 707718 - DNA, 20 bp, Artificial
  CRISPR gRNA sequence
ggtgggagggaagtgagggt

SEQ ID NO: 707719 - DNA, 20 bp, Artificial
  CRISPR gRNA sequence
gtgggagggaagtgagggtg

SEQ ID NO: 707720 - DNA, 20 bp, Artificial
  CRISPR gRNA sequence
tgggagggaagtgagggtgg

SEQ ID NO: 707721 - DNA, 20 bp, Artificial
  CRISPR gRNA sequence
ggaagtgagggtgggggtgc

SEQ ID NO: 707722 - DNA, 20 bp, Artificial
  CRISPR gRNA sequence
tgagggtgggggtgctggat

SEQ ID NO: 707723 - DNA, 20 bp, Artificial
  CRISPR gRNA sequence
gagggtgggggtgctggatt

SEQ ID NO: 707724 - DNA, 20 bp, Artificial
  CRISPR gRNA sequence
agggtgggggtgctggatta

SEQ ID NO: 707725 - DNA, 20 bp, Artificial
  CRISPR gRNA sequence
ggtgggggtgctggattagg

SEQ ID NO: 707726 - DNA, 20 bp, Artificial
  CRISPR gRNA sequence
gggggtgctggattagggag

SEQ ID NO: 707727 - DNA, 20 bp, Artificial
  CRISPR gRNA sequence
ggggtgctggattagggaga

SEQ ID NO: 707728 - DNA, 20 bp, Artificial
  CRISPR gRNA sequence
ggtgctggattagggagaag

SEQ ID NO: 707729 - DNA, 20 bp, Artificial
  CRISPR gRNA sequence
ggattagggagaaggagcca

SEQ ID NO: 707730 - DNA, 20 bp, Artificial
  CRISPR gRNA sequence
tagggagaaggagccacagc

SEQ ID NO: 707731 - DNA, 20 bp, Artificial
  CRISPR gRNA sequence
agggagaaggagccacagct

SEQ ID NO: 707732 - DNA, 20 bp, Artificial
  CRISPR gRNA sequence
gggagaaggagccacagctg

SEQ ID NO: 707733 - DNA, 20 bp, Artificial
  CRISPR gRNA sequence
gaaggagccacagctgggga

SEQ ID NO: 707734 - DNA, 20 bp, Artificial
  CRISPR gRNA sequence
aaggagccacagctggggac

SEQ ID NO: 707735 - DNA, 20 bp, Artificial
  CRISPR gRNA sequence
agccacagctggggacaggc

SEQ ID NO: 707736 - DNA, 20 bp, Artificial
  CRISPR gRNA sequence
gctggtcccctcacattcct

SEQ ID NO: 707737 - DNA, 20 bp, Artificial
  CRISPR gRNA sequence
ctggtcccctcacattcctc

SEQ ID NO: 707738 - DNA, 20 bp, Artificial
  CRISPR gRNA sequence
tggtcccctcacattcctca

SEQ ID NO: 707739 - DNA, 20 bp, Artificial
  CRISPR gRNA sequence
cctcacattcctcagggaaa

SEQ ID NO: 707740 - DNA, 20 bp, Artificial
  CRISPR gRNA sequence
ctcacattcctcagggaaat

SEQ ID NO: 707741 - DNA, 20 bp, Artificial
  CRISPR gRNA sequence
acattcctcagggaaatggg

SEQ ID NO: 707742 - DNA, 20 bp, Artificial
  CRISPR gRNA sequence
cattcctcagggaaatgggc

SEQ ID NO: 707743 - DNA, 20 bp, Artificial
  CRISPR gRNA sequence
ttcctcagggaaatgggcag

SEQ ID NO: 707744 - DNA, 20 bp, Artificial
  CRISPR gRNA sequence
gggaaatgggcaggagtccc

SEQ ID NO: 707745 - DNA, 20 bp, Artificial
  CRISPR gRNA sequence
ggaaatgggcaggagtcccc

SEQ ID NO: 707746 - DNA, 20 bp, Artificial
  CRISPR gRNA sequence
gcaggagtccccaggaaatc

SEQ ID NO: 707747 - DNA, 20 bp, Artificial
  CRISPR gRNA sequence
ccaggaaatctggaattaac

SEQ ID NO: 707748 - DNA, 20 bp, Artificial
  CRISPR gRNA sequence
tctggaattaactggattca

SEQ ID NO: 707749 - DNA, 20 bp, Artificial
  CRISPR gRNA sequence
ggaattaactggattcaaag

SEQ ID NO: 707750 - DNA, 20 bp, Artificial
  CRISPR gRNA sequence
attaactggattcaaagcgg

SEQ ID NO: 707751 - DNA, 20 bp, Artificial
  CRISPR gRNA sequence
tggattcaaagcggtggaat

SEQ ID NO: 707752 - DNA, 20 bp, Artificial
  CRISPR gRNA sequence
agcggtggaattggctgctc

SEQ ID NO: 707753 - DNA, 20 bp, Artificial
  CRISPR gRNA sequence
gcggtggaattggctgctct

SEQ ID NO: 707754 - DNA, 20 bp, Artificial
  CRISPR gRNA sequence
tggaattggctgctctgggt

SEQ ID NO: 707755 - DNA, 20 bp, Artificial
  CRISPR gRNA sequence
ggaattggctgctctgggtg

SEQ ID NO: 707756 - DNA, 20 bp, Artificial
  CRISPR gRNA sequence
attggctgctctgggtgagg

SEQ ID NO: 707757 - DNA, 20 bp, Artificial
  CRISPR gRNA sequence
ggctgctctgggtgaggaag

SEQ ID NO: 707758 - DNA, 20 bp, Artificial
  CRISPR gRNA sequence
gtgaggaagcagctcccact

SEQ ID NO: 707759 - DNA, 20 bp, Artificial
  CRISPR gRNA sequence
gaagcagctcccactgagct

SEQ ID NO: 707760 - DNA, 20 bp, Artificial
  CRISPR gRNA sequence
gcagctcccactgagctcgg

SEQ ID NO: 707761 - DNA, 20 bp, Artificial
  CRISPR gRNA sequence
cccactgagctcggaagtga

SEQ ID NO: 707762 - DNA, 20 bp, Artificial
  CRISPR gRNA sequence
cactgagctcggaagtgaaa

SEQ ID NO: 707763 - DNA, 20 bp, Artificial
  CRISPR gRNA sequence
actgagctcggaagtgaaag

SEQ ID NO: 707764 - DNA, 20 bp, Artificial
  CRISPR gRNA sequence
ctgagctcggaagtgaaaga

SEQ ID NO: 707765 - DNA, 20 bp, Artificial
  CRISPR gRNA sequence
tgagctcggaagtgaaagag

SEQ ID NO: 707766 - DNA, 20 bp, Artificial
  CRISPR gRNA sequence
tcggaagtgaaagaggggtc

SEQ ID NO: 707767 - DNA, 20 bp, Artificial
  CRISPR gRNA sequence
aaagaggggtctggaaactt

SEQ ID NO: 707768 - DNA, 20 bp, Artificial
  CRISPR gRNA sequence
agaggggtctggaaacttca

SEQ ID NO: 707769 - DNA, 20 bp, Artificial
  CRISPR gRNA sequence
gggtctggaaacttcagagc

SEQ ID NO: 707770 - DNA, 20 bp, Artificial
  CRISPR gRNA sequence
gaaacttcagagccggccat

SEQ ID NO: 707771 - DNA, 20 bp, Artificial
  CRISPR gRNA sequence
aaacttcagagccggccatg

SEQ ID NO: 707772 - DNA, 20 bp, Artificial
  CRISPR gRNA sequence
aacttcagagccggccatga

SEQ ID NO: 707773 - DNA, 20 bp, Artificial
  CRISPR gRNA sequence
acttcagagccggccatgag

SEQ ID NO: 707774 - DNA, 20 bp, Artificial
  CRISPR gRNA sequence
atgaggggtctgccccgctc

SEQ ID NO: 707775 - DNA, 20 bp, Artificial
  CRISPR gRNA sequence
ctctggctctgcccccatca

SEQ ID NO: 707776 - DNA, 20 bp, Artificial
  CRISPR gRNA sequence
tctggctctgcccccatcac

SEQ ID NO: 707777 - DNA, 20 bp, Artificial
  CRISPR gRNA sequence
atcacaggctgcctactccc

SEQ ID NO: 707778 - DNA, 20 bp, Artificial
  CRISPR gRNA sequence
tcacaggctgcctactcccc

SEQ ID NO: 707779 - DNA, 20 bp, Artificial
  CRISPR gRNA sequence
gctgcctactccccaggctg

SEQ ID NO: 707780 - DNA, 20 bp, Artificial
  CRISPR gRNA sequence
ctgcctactccccaggctgt

SEQ ID NO: 707781 - DNA, 20 bp, Artificial
  CRISPR gRNA sequence
tgcctactccccaggctgtg

SEQ ID NO: 707782 - DNA, 20 bp, Artificial
  CRISPR gRNA sequence
gcctactccccaggctgtgg

SEQ ID NO: 707783 - DNA, 20 bp, Artificial
  CRISPR gRNA sequence
tactccccaggctgtggggg

SEQ ID NO: 707784 - DNA, 20 bp, Artificial
  CRISPR gRNA sequence
aggctgtgggggtggcttcc

SEQ ID NO: 707785 - DNA, 20 bp, Artificial
  CRISPR gRNA sequence
ggctgtgggggtggcttcca

SEQ ID NO: 707786 - DNA, 20 bp, Artificial
  CRISPR gRNA sequence
gctgtgggggtggcttccaa

SEQ ID NO: 707787 - DNA, 20 bp, Artificial
  CRISPR gRNA sequence
ggtggcttccaagggctgca

SEQ ID NO: 707788 - DNA, 20 bp, Artificial
  CRISPR gRNA sequence
tggatttcctgccccctccc

SEQ ID NO: 707789 - DNA, 20 bp, Artificial
  CRISPR gRNA sequence
gatttcctgccccctcccca

SEQ ID NO: 707790 - DNA, 20 bp, Artificial
  CRISPR gRNA sequence
ctgccccctccccagagctc

SEQ ID NO: 707791 - DNA, 20 bp, Artificial
  CRISPR gRNA sequence
gccccctccccagagctcca

SEQ ID NO: 707792 - DNA, 20 bp, Artificial
  CRISPR gRNA sequence
ctccccagagctccagagtc

SEQ ID NO: 707793 - DNA, 20 bp, Artificial
  CRISPR gRNA sequence
tccccagagctccagagtcc

SEQ ID NO: 707794 - DNA, 20 bp, Artificial
  CRISPR gRNA sequence
ccccagagctccagagtcca

SEQ ID NO: 707795 - DNA, 20 bp, Artificial
  CRISPR gRNA sequence
agagtccagggaattcatct

SEQ ID NO: 707796 - DNA, 20 bp, Artificial
  CRISPR gRNA sequence
gggaattcatcttggctatg

SEQ ID NO: 707797 - DNA, 20 bp, Artificial
  CRISPR gRNA sequence
ggaattcatcttggctatgt

SEQ ID NO: 707798 - DNA, 20 bp, Artificial
  CRISPR gRNA sequence
gaattcatcttggctatgtg

SEQ ID NO: 707799 - DNA, 20 bp, Artificial
  CRISPR gRNA sequence
attcatcttggctatgtggg

SEQ ID NO: 707800 - DNA, 20 bp, Artificial
  CRISPR gRNA sequence
ttcatcttggctatgtgggg

SEQ ID NO: 707801 - DNA, 20 bp, Artificial
  CRISPR gRNA sequence
tcatcttggctatgtgggga

SEQ ID NO: 707802 - DNA, 20 bp, Artificial
  CRISPR gRNA sequence
tcttggctatgtggggaggg

SEQ ID NO: 707803 - DNA, 20 bp, Artificial
  CRISPR gRNA sequence
cttggctatgtggggagggc

SEQ ID NO: 707804 - DNA, 20 bp, Artificial
  CRISPR gRNA sequence
gctatgtggggagggcaggt

SEQ ID NO: 707805 - DNA, 20 bp, Artificial
  CRISPR gRNA sequence
ctatgtggggagggcaggtg

SEQ ID NO: 707806 - DNA, 20 bp, Artificial
  CRISPR gRNA sequence
tgtggggagggcaggtgagg

SEQ ID NO: 707807 - DNA, 20 bp, Artificial
  CRISPR gRNA sequence
gggagggcaggtgaggaagt

SEQ ID NO: 707808 - DNA, 20 bp, Artificial
  CRISPR gRNA sequence
ggagggcaggtgaggaagtt

SEQ ID NO: 707809 - DNA, 20 bp, Artificial
  CRISPR gRNA sequence
gagggcaggtgaggaagttg

SEQ ID NO: 707810 - DNA, 20 bp, Artificial
  CRISPR gRNA sequence
agggcaggtgaggaagttgg

SEQ ID NO: 707811 - DNA, 20 bp, Artificial
  CRISPR gRNA sequence
gggcaggtgaggaagttggg

SEQ ID NO: 707812 - DNA, 20 bp, Artificial
  CRISPR gRNA sequence
aggtgaggaagttgggggga

SEQ ID NO: 707813 - DNA, 20 bp, Artificial
  CRISPR gRNA sequence
ggtgaggaagttggggggaa

SEQ ID NO: 707814 - DNA, 20 bp, Artificial
  CRISPR gRNA sequence
gtgaggaagttggggggaaa

SEQ ID NO: 707815 - DNA, 20 bp, Artificial
  CRISPR gRNA sequence
tgaggaagttggggggaaag

SEQ ID NO: 707816 - DNA, 20 bp, Artificial
  CRISPR gRNA sequence
aaaggggttcttcccttgcc

SEQ ID NO: 707817 - DNA, 20 bp, Artificial
  CRISPR gRNA sequence
ttcttcccttgcctggttcc

SEQ ID NO: 707818 - DNA, 20 bp, Artificial
  CRISPR gRNA sequence
tcttcccttgcctggttccc

SEQ ID NO: 707819 - DNA, 20 bp, Artificial
  CRISPR gRNA sequence
cttcccttgcctggttccca

SEQ ID NO: 707820 - DNA, 20 bp, Artificial
  CRISPR gRNA sequence
ttcccttgcctggttcccag

SEQ ID NO: 707821 - DNA, 20 bp, Artificial
  CRISPR gRNA sequence
ccttgcctggttcccagggg

SEQ ID NO: 707822 - DNA, 20 bp, Artificial
  CRISPR gRNA sequence
ttgcctggttcccaggggaa

SEQ ID NO: 707823 - DNA, 20 bp, Artificial
  CRISPR gRNA sequence
tgcctggttcccaggggaag

SEQ ID NO: 707824 - DNA, 20 bp, Artificial
  CRISPR gRNA sequence
gcctggttcccaggggaaga

SEQ ID NO: 707825 - DNA, 20 bp, Artificial
  CRISPR gRNA sequence
aggggaagagggacgatgta

SEQ ID NO: 707826 - DNA, 20 bp, Artificial
  CRISPR gRNA sequence
gagggacgatgtacagaccc

SEQ ID NO: 707827 - DNA, 20 bp, Artificial
  CRISPR gRNA sequence
gaccccagtgtgacccctct

SEQ ID NO: 707828 - DNA, 20 bp, Artificial
  CRISPR gRNA sequence
accccagtgtgacccctctt

SEQ ID NO: 707829 - DNA, 20 bp, Artificial
  CRISPR gRNA sequence
gtgtgacccctcttgggaac

SEQ ID NO: 707830 - DNA, 20 bp, Artificial
  CRISPR gRNA sequence
gacccctcttgggaactgga

SEQ ID NO: 707831 - DNA, 20 bp, Artificial
  CRISPR gRNA sequence
acccctcttgggaactggat

SEQ ID NO: 707832 - DNA, 20 bp, Artificial
  CRISPR gRNA sequence
cctcttgggaactggatggg

SEQ ID NO: 707833 - DNA, 20 bp, Artificial
  CRISPR gRNA sequence
ctcttgggaactggatggga

SEQ ID NO: 707834 - DNA, 20 bp, Artificial
  CRISPR gRNA sequence
tcttgggaactggatgggaa

SEQ ID NO: 707835 - DNA, 20 bp, Artificial
  CRISPR gRNA sequence
cttgggaactggatgggaag

SEQ ID NO: 707836 - DNA, 20 bp, Artificial
  CRISPR gRNA sequence
ttgggaactggatgggaagg

SEQ ID NO: 707837 - DNA, 20 bp, Artificial
  CRISPR gRNA sequence
gggaagggggaacgctaccc

SEQ ID NO: 707838 - DNA, 20 bp, Artificial
  CRISPR gRNA sequence
ggaagggggaacgctaccct

SEQ ID NO: 707839 - DNA, 20 bp, Artificial
  CRISPR gRNA sequence
gggggaacgctaccctgggc

SEQ ID NO: 707840 - DNA, 20 bp, Artificial
  CRISPR gRNA sequence
acgctaccctgggctggcat

SEQ ID NO: 707841 - DNA, 20 bp, Artificial
  CRISPR gRNA sequence
cgctaccctgggctggcatt

SEQ ID NO: 707842 - DNA, 20 bp, Artificial
  CRISPR gRNA sequence
ctaccctgggctggcattag

SEQ ID NO: 707843 - DNA, 20 bp, Artificial
  CRISPR gRNA sequence
taccctgggctggcattagg

SEQ ID NO: 707844 - DNA, 20 bp, Artificial
  CRISPR gRNA sequence
tgggctggcattaggaggac

SEQ ID NO: 707845 - DNA, 20 bp, Artificial
  CRISPR gRNA sequence
gggctggcattaggaggaca

SEQ ID NO: 707846 - DNA, 20 bp, Artificial
  CRISPR gRNA sequence
ggctggcattaggaggacaa

SEQ ID NO: 707847 - DNA, 20 bp, Artificial
  CRISPR gRNA sequence
gctggcattaggaggacaag

SEQ ID NO: 707848 - DNA, 20 bp, Artificial
  CRISPR gRNA sequence
ctggcattaggaggacaagg

SEQ ID NO: 707849 - DNA, 20 bp, Artificial
  CRISPR gRNA sequence
caagggggttgcctgtgtct

SEQ ID NO: 707850 - DNA, 20 bp, Artificial
  CRISPR gRNA sequence
aagggggttgcctgtgtctt

SEQ ID NO: 707851 - DNA, 20 bp, Artificial
  CRISPR gRNA sequence
tgcctgtgtcttgggtgccc

SEQ ID NO: 707852 - DNA, 20 bp, Artificial
  CRISPR gRNA sequence
cctgtgtcttgggtgcccaa

SEQ ID NO: 707853 - DNA, 20 bp, Artificial
  CRISPR gRNA sequence
gggtgcccaagagaacctcc

SEQ ID NO: 707854 - DNA, 20 bp, Artificial
  CRISPR gRNA sequence
ggtgcccaagagaacctcca

SEQ ID NO: 707855 - DNA, 20 bp, Artificial
  CRISPR gRNA sequence
aaggccttccctttccacca

SEQ ID NO: 707856 - DNA, 20 bp, Artificial
  CRISPR gRNA sequence
gccttccctttccaccatgg

SEQ ID NO: 707857 - DNA, 20 bp, Artificial
  CRISPR gRNA sequence
cttccctttccaccatggcg

SEQ ID NO: 707858 - DNA, 20 bp, Artificial
  CRISPR gRNA sequence
ttccctttccaccatggcgg

SEQ ID NO: 707859 - DNA, 20 bp, Artificial
  CRISPR gRNA sequence
cctttccaccatggcggagg

SEQ ID NO: 707860 - DNA, 20 bp, Artificial
  CRISPR gRNA sequence
gtggcccccgatccactcac

SEQ ID NO: 707861 - DNA, 20 bp, Artificial
  CRISPR gRNA sequence
cccccgatccactcaccagc

SEQ ID NO: 707862 - DNA, 20 bp, Artificial
  CRISPR gRNA sequence
ccccgatccactcaccagca

SEQ ID NO: 707863 - DNA, 20 bp, Artificial
  CRISPR gRNA sequence
ccactcaccagcaaggcctg

SEQ ID NO: 707864 - DNA, 20 bp, Artificial
  CRISPR gRNA sequence
cactcaccagcaaggcctgc

SEQ ID NO: 707865 - DNA, 20 bp, Artificial
  CRISPR gRNA sequence
gcaaggcctgcaggccatgc

SEQ ID NO: 707866 - DNA, 20 bp, Artificial
  CRISPR gRNA sequence
caaggcctgcaggccatgcc

SEQ ID NO: 707867 - DNA, 20 bp, Artificial
  CRISPR gRNA sequence
aaggcctgcaggccatgcca

SEQ ID NO: 707868 - DNA, 20 bp, Artificial
  CRISPR gRNA sequence
aggcctgcaggccatgccag

SEQ ID NO: 707869 - DNA, 20 bp, Artificial
  CRISPR gRNA sequence
gcctgcaggccatgccaggg

SEQ ID NO: 707870 - DNA, 20 bp, Artificial
  CRISPR gRNA sequence
cctgcaggccatgccagggg

SEQ ID NO: 707871 - DNA, 20 bp, Artificial
  CRISPR gRNA sequence
ctgcaggccatgccagggga

SEQ ID NO: 707872 - DNA, 20 bp, Artificial
  CRISPR gRNA sequence
caggccatgccaggggaggg

SEQ ID NO: 707873 - DNA, 20 bp, Artificial
  CRISPR gRNA sequence
ggggagggcagcccacacct

SEQ ID NO: 707874 - DNA, 20 bp, Artificial
  CRISPR gRNA sequence
agggcagcccacacctgagc

SEQ ID NO: 707875 - DNA, 20 bp, Artificial
  CRISPR gRNA sequence
ccacacctgagccagctgcc

SEQ ID NO: 707876 - DNA, 20 bp, Artificial
  CRISPR gRNA sequence
cacacctgagccagctgcct

SEQ ID NO: 707877 - DNA, 20 bp, Artificial
  CRISPR gRNA sequence
cacctgagccagctgcctgg

SEQ ID NO: 707878 - DNA, 20 bp, Artificial
  CRISPR gRNA sequence
gagccagctgcctgggagcc

SEQ ID NO: 707879 - DNA, 20 bp, Artificial
  CRISPR gRNA sequence
caccctctgaaccccacccc

SEQ ID NO: 707880 - DNA, 20 bp, Artificial
  CRISPR gRNA sequence
accctctgaaccccacccct

SEQ ID NO: 707881 - DNA, 20 bp, Artificial
  CRISPR gRNA sequence
gaaccccacccctgggattc

SEQ ID NO: 707882 - DNA, 20 bp, Artificial
  CRISPR gRNA sequence
aaccccacccctgggattcc

SEQ ID NO: 707883 - DNA, 20 bp, Artificial
  CRISPR gRNA sequence
gggattccaggcactgtact

SEQ ID NO: 707884 - DNA, 20 bp, Artificial
  CRISPR gRNA sequence
tccaggcactgtactcagtg

SEQ ID NO: 707885 - DNA, 20 bp, Artificial
  CRISPR gRNA sequence
cactgtactcagtgtggact

SEQ ID NO: 707886 - DNA, 20 bp, Artificial
  CRISPR gRNA sequence
tgtactcagtgtggactcag

SEQ ID NO: 707887 - DNA, 20 bp, Artificial
  CRISPR gRNA sequence
cagtgtggactcagaagttc

SEQ ID NO: 707888 - DNA, 20 bp, Artificial
  CRISPR gRNA sequence
gtggactcagaagttccagt

SEQ ID NO: 707889 - DNA, 20 bp, Artificial
  CRISPR gRNA sequence
tggactcagaagttccagtt

SEQ ID NO: 707890 - DNA, 20 bp, Artificial
  CRISPR gRNA sequence
aagttccagttaggacttct

SEQ ID NO: 707891 - DNA, 20 bp, Artificial
  CRISPR gRNA sequence
agttccagttaggacttctt

SEQ ID NO: 707892 - DNA, 20 bp, Artificial
  CRISPR gRNA sequence
aggacttcttaggaattctg

SEQ ID NO: 707893 - DNA, 20 bp, Artificial
  CRISPR gRNA sequence
acttcttaggaattctgaag

SEQ ID NO: 707894 - DNA, 20 bp, Artificial
  CRISPR gRNA sequence
aattctgaagaagcctttga

SEQ ID NO: 707895 - DNA, 20 bp, Artificial
  CRISPR gRNA sequence
tttcaaataaaacttactaa

SEQ ID NO: 707896 - DNA, 20 bp, Artificial
  CRISPR gRNA sequence
actaaaagctaccatttcaa

SEQ ID NO: 707897 - DNA, 20 bp, Artificial
  CRISPR gRNA sequence
agctaccatttcaaaagctt

SEQ ID NO: 707898 - DNA, 20 bp, Artificial
  CRISPR gRNA sequence
aaagcttcagtttgttacaa

SEQ ID NO: 707899 - DNA, 20 bp, Artificial
  CRISPR gRNA sequence
gtttgttacaaaagactgcc

SEQ ID NO: 707900 - DNA, 20 bp, Artificial
  CRISPR gRNA sequence
tttgttacaaaagactgccc

SEQ ID NO: 707901 - DNA, 20 bp, Artificial
  CRISPR gRNA sequence
ttacaaaagactgcccaggc

SEQ ID NO: 707902 - DNA, 20 bp, Artificial
  CRISPR gRNA sequence
tacaaaagactgcccaggct

SEQ ID NO: 707903 - DNA, 20 bp, Artificial
  CRISPR gRNA sequence
aagactgcccaggctgggca

SEQ ID NO: 707904 - DNA, 20 bp, Artificial
  CRISPR gRNA sequence
actgcccaggctgggcatgg

SEQ ID NO: 707905 - DNA, 20 bp, Artificial
  CRISPR gRNA sequence
gtggctcatgcctataatcc

SEQ ID NO: 707906 - DNA, 20 bp, Artificial
  CRISPR gRNA sequence
tgcctataatcccagtactt

SEQ ID NO: 707907 - DNA, 20 bp, Artificial
  CRISPR gRNA sequence
gcctataatcccagtacttt

SEQ ID NO: 707908 - DNA, 20 bp, Artificial
  CRISPR gRNA sequence
ctataatcccagtactttgg

SEQ ID NO: 707909 - DNA, 20 bp, Artificial
  CRISPR gRNA sequence
tataatcccagtactttggg

SEQ ID NO: 707910 - DNA, 20 bp, Artificial
  CRISPR gRNA sequence
tcccagtactttgggaggcc

SEQ ID NO: 707911 - DNA, 20 bp, Artificial
  CRISPR gRNA sequence
cccagtactttgggaggcca

SEQ ID NO: 707912 - DNA, 20 bp, Artificial
  CRISPR gRNA sequence
agtactttgggaggccaagg

SEQ ID NO: 707913 - DNA, 20 bp, Artificial
  CRISPR gRNA sequence
gtactttgggaggccaaggc

SEQ ID NO: 707914 - DNA, 20 bp, Artificial
  CRISPR gRNA sequence
ctttgggaggccaaggcagg

SEQ ID NO: 707915 - DNA, 20 bp, Artificial
  CRISPR gRNA sequence
caaggcaggcagatcacctt

SEQ ID NO: 707916 - DNA, 20 bp, Artificial
  CRISPR gRNA sequence
aaggcaggcagatcaccttg

SEQ ID NO: 707917 - DNA, 20 bp, Artificial
  CRISPR gRNA sequence
caggcagatcaccttgaggc

SEQ ID NO: 707918 - DNA, 20 bp, Artificial
  CRISPR gRNA sequence
aggcagatcaccttgaggcc

SEQ ID NO: 707919 - DNA, 20 bp, Artificial
  CRISPR gRNA sequence
gcagatcaccttgaggccag

SEQ ID NO: 707920 - DNA, 20 bp, Artificial
  CRISPR gRNA sequence
caccttgaggccaggagttc

SEQ ID NO: 707921 - DNA, 20 bp, Artificial
  CRISPR gRNA sequence
tgaggccaggagttccagac

SEQ ID NO: 707922 - DNA, 20 bp, Artificial
  CRISPR gRNA sequence
ccaggagttccagaccagcc

SEQ ID NO: 707923 - DNA, 20 bp, Artificial
  CRISPR gRNA sequence
ttccagaccagcctggccaa

SEQ ID NO: 707924 - DNA, 20 bp, Artificial
  CRISPR gRNA sequence
ccagaccagcctggccaaca

SEQ ID NO: 707925 - DNA, 20 bp, Artificial
  CRISPR gRNA sequence
ctactaaaaatacaaaaaat

SEQ ID NO: 707926 - DNA, 20 bp, Artificial
  CRISPR gRNA sequence
taaaaatacaaaaaattagc

SEQ ID NO: 707927 - DNA, 20 bp, Artificial
  CRISPR gRNA sequence
aaaaatacaaaaaattagcc

SEQ ID NO: 707928 - DNA, 20 bp, Artificial
  CRISPR gRNA sequence
atgacactcgcccataatcc

SEQ ID NO: 707929 - DNA, 20 bp, Artificial
  CRISPR gRNA sequence
cgcccataatcccagctact

SEQ ID NO: 707930 - DNA, 20 bp, Artificial
  CRISPR gRNA sequence
gcccataatcccagctactc

SEQ ID NO: 707931 - DNA, 20 bp, Artificial
  CRISPR gRNA sequence
ccataatcccagctactcag

SEQ ID NO: 707932 - DNA, 20 bp, Artificial
  CRISPR gRNA sequence
cataatcccagctactcagg

SEQ ID NO: 707933 - DNA, 20 bp, Artificial
  CRISPR gRNA sequence
caggaggctgaaaaaataaa

SEQ ID NO: 707934 - DNA, 20 bp, Artificial
  CRISPR gRNA sequence
ggaggctgaaaaaataaaaa

SEQ ID NO: 707935 - DNA, 20 bp, Artificial
  CRISPR gRNA sequence
ggctgaaaaaataaaaagag

SEQ ID NO: 707936 - DNA, 20 bp, Artificial
  CRISPR gRNA sequence
aagagaagatgactgccctg

SEQ ID NO: 707937 - DNA, 20 bp, Artificial
  CRISPR gRNA sequence
gagaagatgactgccctgaa

SEQ ID NO: 707938 - DNA, 20 bp, Artificial
  CRISPR gRNA sequence
atgactgccctgaagagttc

SEQ ID NO: 707939 - DNA, 20 bp, Artificial
  CRISPR gRNA sequence
ctggccaccactgtctgcca

SEQ ID NO: 707940 - DNA, 20 bp, Artificial
  CRISPR gRNA sequence
ctgtctgccatagaaatgca

SEQ ID NO: 707941 - DNA, 20 bp, Artificial
  CRISPR gRNA sequence
tgtctgccatagaaatgcac

SEQ ID NO: 707942 - DNA, 20 bp, Artificial
  CRISPR gRNA sequence
gacaattacaaatgactctt

SEQ ID NO: 707943 - DNA, 20 bp, Artificial
  CRISPR gRNA sequence
atgactcttcagtattatcc

SEQ ID NO: 707944 - DNA, 20 bp, Artificial
  CRISPR gRNA sequence
cttcagtattatcccagtgc

SEQ ID NO: 707945 - DNA, 20 bp, Artificial
  CRISPR gRNA sequence
cccagtgccagttacccttc

SEQ ID NO: 707946 - DNA, 20 bp, Artificial
  CRISPR gRNA sequence
agtgccagttacccttccag

SEQ ID NO: 707947 - DNA, 20 bp, Artificial
  CRISPR gRNA sequence
agttacccttccagaagcga

SEQ ID NO: 707948 - DNA, 20 bp, Artificial
  CRISPR gRNA sequence
ttacccttccagaagcgaca

SEQ ID NO: 707949 - DNA, 20 bp, Artificial
  CRISPR gRNA sequence
tacccttccagaagcgacag

SEQ ID NO: 707950 - DNA, 20 bp, Artificial
  CRISPR gRNA sequence
ccttccagaagcgacagagg

SEQ ID NO: 707951 - DNA, 20 bp, Artificial
  CRISPR gRNA sequence
cttccagaagcgacagaggt

SEQ ID NO: 707952 - DNA, 20 bp, Artificial
  CRISPR gRNA sequence
ttccagaagcgacagaggtg

SEQ ID NO: 707953 - DNA, 20 bp, Artificial
  CRISPR gRNA sequence
cgacagaggtggggtccacc

SEQ ID NO: 707954 - DNA, 20 bp, Artificial
  CRISPR gRNA sequence
gacagaggtggggtccacca

SEQ ID NO: 707955 - DNA, 20 bp, Artificial
  CRISPR gRNA sequence
gtccaccaaggccctgccca

SEQ ID NO: 707956 - DNA, 20 bp, Artificial
  CRISPR gRNA sequence
tccaccaaggccctgcccac

SEQ ID NO: 707957 - DNA, 20 bp, Artificial
  CRISPR gRNA sequence
ccaccaaggccctgcccaca

SEQ ID NO: 707958 - DNA, 20 bp, Artificial
  CRISPR gRNA sequence
accaaggccctgcccacagg

SEQ ID NO: 707959 - DNA, 20 bp, Artificial
  CRISPR gRNA sequence
ccctgcccacagggagcaca

SEQ ID NO: 707960 - DNA, 20 bp, Artificial
  CRISPR gRNA sequence
gcccacagggagcacaaagc

SEQ ID NO: 707961 - DNA, 20 bp, Artificial
  CRISPR gRNA sequence
cccacagggagcacaaagcc

SEQ ID NO: 707962 - DNA, 20 bp, Artificial
  CRISPR gRNA sequence
acagggagcacaaagccagg

SEQ ID NO: 707963 - DNA, 20 bp, Artificial
  CRISPR gRNA sequence
agggagcacaaagccaggtg

SEQ ID NO: 707964 - DNA, 20 bp, Artificial
  CRISPR gRNA sequence
gggagcacaaagccaggtgg

SEQ ID NO: 707965 - DNA, 20 bp, Artificial
  CRISPR gRNA sequence
agcacaaagccaggtggagg

SEQ ID NO: 707966 - DNA, 20 bp, Artificial
  CRISPR gRNA sequence
cacaaagccaggtggaggtg

SEQ ID NO: 707967 - DNA, 20 bp, Artificial
  CRISPR gRNA sequence
acaaagccaggtggaggtgg

SEQ ID NO: 707968 - DNA, 20 bp, Artificial
  CRISPR gRNA sequence
aagccaggtggaggtggagg

SEQ ID NO: 707969 - DNA, 20 bp, Artificial
  CRISPR gRNA sequence
agccaggtggaggtggagga

SEQ ID NO: 707970 - DNA, 20 bp, Artificial
  CRISPR gRNA sequence
ggaggaaggctataaacacg

SEQ ID NO: 707971 - DNA, 20 bp, Artificial
  CRISPR gRNA sequence
taaacacgcagtcacaccac

SEQ ID NO: 707972 - DNA, 20 bp, Artificial
  CRISPR gRNA sequence
aaacacgcagtcacaccact

SEQ ID NO: 707973 - DNA, 20 bp, Artificial
  CRISPR gRNA sequence
gcagtcacaccactgggtgc

SEQ ID NO: 707974 - DNA, 20 bp, Artificial
  CRISPR gRNA sequence
cagtcacaccactgggtgct

SEQ ID NO: 707975 - DNA, 20 bp, Artificial
  CRISPR gRNA sequence
accactgggtgctaggacac

SEQ ID NO: 707976 - DNA, 20 bp, Artificial
  CRISPR gRNA sequence
ccactgggtgctaggacacc

SEQ ID NO: 707977 - DNA, 20 bp, Artificial
  CRISPR gRNA sequence
ctgggtgctaggacaccggg

SEQ ID NO: 707978 - DNA, 20 bp, Artificial
  CRISPR gRNA sequence
tgggtgctaggacaccgggt

SEQ ID NO: 707979 - DNA, 20 bp, Artificial
  CRISPR gRNA sequence
gggtgctaggacaccgggta

SEQ ID NO: 707980 - DNA, 20 bp, Artificial
  CRISPR gRNA sequence
ggtgctaggacaccgggtag

SEQ ID NO: 707981 - DNA, 20 bp, Artificial
  CRISPR gRNA sequence
tgctaggacaccgggtaggg

SEQ ID NO: 707982 - DNA, 20 bp, Artificial
  CRISPR gRNA sequence
gctaggacaccgggtagggg

SEQ ID NO: 707983 - DNA, 20 bp, Artificial
  CRISPR gRNA sequence
gacaccgggtaggggaggcc

SEQ ID NO: 707984 - DNA, 20 bp, Artificial
  CRISPR gRNA sequence
acaccgggtaggggaggcct

SEQ ID NO: 707985 - DNA, 20 bp, Artificial
  CRISPR gRNA sequence
gtaggggaggcctgggttct

SEQ ID NO: 707986 - DNA, 20 bp, Artificial
  CRISPR gRNA sequence
taggggaggcctgggttctt

SEQ ID NO: 707987 - DNA, 20 bp, Artificial
  CRISPR gRNA sequence
aggggaggcctgggttctta

SEQ ID NO: 707988 - DNA, 20 bp, Artificial
  CRISPR gRNA sequence
gggaggcctgggttcttagg

SEQ ID NO: 707989 - DNA, 20 bp, Artificial
  CRISPR gRNA sequence
gcctgggttcttagggagca

SEQ ID NO: 707990 - DNA, 20 bp, Artificial
  CRISPR gRNA sequence
ggttcttagggagcatagca

SEQ ID NO: 707991 - DNA, 20 bp, Artificial
  CRISPR gRNA sequence
tcttagggagcatagcatgg

SEQ ID NO: 707992 - DNA, 20 bp, Artificial
  CRISPR gRNA sequence
ttagggagcatagcatggtg

SEQ ID NO: 707993 - DNA, 20 bp, Artificial
  CRISPR gRNA sequence
agggagcatagcatggtgga

SEQ ID NO: 707994 - DNA, 20 bp, Artificial
  CRISPR gRNA sequence
gggagcatagcatggtggag

SEQ ID NO: 707995 - DNA, 20 bp, Artificial
  CRISPR gRNA sequence
ggagcatagcatggtggaga

SEQ ID NO: 707996 - DNA, 20 bp, Artificial
  CRISPR gRNA sequence
atagcatggtggagagggca

SEQ ID NO: 707997 - DNA, 20 bp, Artificial
  CRISPR gRNA sequence
gcatggtggagagggcacag

SEQ ID NO: 707998 - DNA, 20 bp, Artificial
  CRISPR gRNA sequence
catggtggagagggcacaga

SEQ ID NO: 707999 - DNA, 20 bp, Artificial
  CRISPR gRNA sequence
agagggcacagaaggcttcc

SEQ ID NO: 708000 - DNA, 20 bp, Artificial
  CRISPR gRNA sequence
agggcacagaaggcttcctg

SEQ ID NO: 708001 - DNA, 20 bp, Artificial
  CRISPR gRNA sequence
gggcacagaaggcttcctgg

SEQ ID NO: 708002 - DNA, 20 bp, Artificial
  CRISPR gRNA sequence
cacagaaggcttcctggagg

SEQ ID NO: 708003 - DNA, 20 bp, Artificial
  CRISPR gRNA sequence
acagaaggcttcctggagga

SEQ ID NO: 708004 - DNA, 20 bp, Artificial
  CRISPR gRNA sequence
cagaaggcttcctggaggaa

SEQ ID NO: 708005 - DNA, 20 bp, Artificial
  CRISPR gRNA sequence
agaaggcttcctggaggaag

SEQ ID NO: 708006 - DNA, 20 bp, Artificial
  CRISPR gRNA sequence
tcctggaggaaggggcaaat

SEQ ID NO: 708007 - DNA, 20 bp, Artificial
  CRISPR gRNA sequence
tggaggaaggggcaaataag

SEQ ID NO: 708008 - DNA, 20 bp, Artificial
  CRISPR gRNA sequence
ggaggaaggggcaaataagc

SEQ ID NO: 708009 - DNA, 20 bp, Artificial
  CRISPR gRNA sequence
gaggaaggggcaaataagca

SEQ ID NO: 708010 - DNA, 20 bp, Artificial
  CRISPR gRNA sequence
gggcaaataagcagggtccc

SEQ ID NO: 708011 - DNA, 20 bp, Artificial
  CRISPR gRNA sequence
ggcaaataagcagggtcccc

SEQ ID NO: 708012 - DNA, 20 bp, Artificial
  CRISPR gRNA sequence
agcagggtccccaggatatc

SEQ ID NO: 708013 - DNA, 20 bp, Artificial
  CRISPR gRNA sequence
ccaggatatccagaattaac

SEQ ID NO: 708014 - DNA, 20 bp, Artificial
  CRISPR gRNA sequence
atccagaattaactggattc

SEQ ID NO: 708015 - DNA, 20 bp, Artificial
  CRISPR gRNA sequence
tccagaattaactggattca

SEQ ID NO: 708016 - DNA, 20 bp, Artificial
  CRISPR gRNA sequence
agaattaactggattcaagg

SEQ ID NO: 708017 - DNA, 20 bp, Artificial
  CRISPR gRNA sequence
attaactggattcaaggcag

SEQ ID NO: 708018 - DNA, 20 bp, Artificial
  CRISPR gRNA sequence
taactggattcaaggcagtg

SEQ ID NO: 708019 - DNA, 20 bp, Artificial
  CRISPR gRNA sequence
tggattcaaggcagtggagt

SEQ ID NO: 708020 - DNA, 20 bp, Artificial
  CRISPR gRNA sequence
ggcagtggagttggctattt

SEQ ID NO: 708021 - DNA, 20 bp, Artificial
  CRISPR gRNA sequence
gcagtggagttggctatttc

SEQ ID NO: 708022 - DNA, 20 bp, Artificial
  CRISPR gRNA sequence
tggagttggctatttcaggc

SEQ ID NO: 708023 - DNA, 20 bp, Artificial
  CRISPR gRNA sequence
ggagttggctatttcaggcg

SEQ ID NO: 708024 - DNA, 20 bp, Artificial
  CRISPR gRNA sequence
gagttggctatttcaggcga

SEQ ID NO: 708025 - DNA, 20 bp, Artificial
  CRISPR gRNA sequence
agttggctatttcaggcgag

SEQ ID NO: 708026 - DNA, 20 bp, Artificial
  CRISPR gRNA sequence
gttggctatttcaggcgagg

SEQ ID NO: 708027 - DNA, 20 bp, Artificial
  CRISPR gRNA sequence
ggctatttcaggcgaggggg

SEQ ID NO: 708028 - DNA, 20 bp, Artificial
  CRISPR gRNA sequence
gcgagggggtagctcccatt

SEQ ID NO: 708029 - DNA, 20 bp, Artificial
  CRISPR gRNA sequence
agggggtagctcccattgag

SEQ ID NO: 708030 - DNA, 20 bp, Artificial
  CRISPR gRNA sequence
gtagctcccattgagaagct

SEQ ID NO: 708031 - DNA, 20 bp, Artificial
  CRISPR gRNA sequence
gctcccattgagaagctcag

SEQ ID NO: 708032 - DNA, 20 bp, Artificial
  CRISPR gRNA sequence
attgagaagctcagaagtga

SEQ ID NO: 708033 - DNA, 20 bp, Artificial
  CRISPR gRNA sequence
tgagaagctcagaagtgaca

SEQ ID NO: 708034 - DNA, 20 bp, Artificial
  CRISPR gRNA sequence
gagaagctcagaagtgacag

SEQ ID NO: 708035 - DNA, 20 bp, Artificial
  CRISPR gRNA sequence
agaagctcagaagtgacaga

SEQ ID NO: 708036 - DNA, 20 bp, Artificial
  CRISPR gRNA sequence
gaagctcagaagtgacagag

SEQ ID NO: 708037 - DNA, 20 bp, Artificial
  CRISPR gRNA sequence
gacagaggggtctgtaaatt

SEQ ID NO: 708038 - DNA, 20 bp, Artificial
  CRISPR gRNA sequence
acagaggggtctgtaaattt

SEQ ID NO: 708039 - DNA, 20 bp, Artificial
  CRISPR gRNA sequence
agaggggtctgtaaatttgg

SEQ ID NO: 708040 - DNA, 20 bp, Artificial
  CRISPR gRNA sequence
taaatttgggagactgccat

SEQ ID NO: 708041 - DNA, 20 bp, Artificial
  CRISPR gRNA sequence
aaatttgggagactgccatg

SEQ ID NO: 708042 - DNA, 20 bp, Artificial
  CRISPR gRNA sequence
aatttgggagactgccatga

SEQ ID NO: 708043 - DNA, 20 bp, Artificial
  CRISPR gRNA sequence
atttgggagactgccatgag

SEQ ID NO: 708044 - DNA, 20 bp, Artificial
  CRISPR gRNA sequence
tttgggagactgccatgagg

SEQ ID NO: 708045 - DNA, 20 bp, Artificial
  CRISPR gRNA sequence
tgggagactgccatgagggg

SEQ ID NO: 708046 - DNA, 20 bp, Artificial
  CRISPR gRNA sequence
gggagactgccatgaggggg

SEQ ID NO: 708047 - DNA, 20 bp, Artificial
  CRISPR gRNA sequence
ggagactgccatgaggggga

SEQ ID NO: 708048 - DNA, 20 bp, Artificial
  CRISPR gRNA sequence
actgccatgagggggaggga

SEQ ID NO: 708049 - DNA, 20 bp, Artificial
  CRISPR gRNA sequence
tgagggggagggacagactg

SEQ ID NO: 708050 - DNA, 20 bp, Artificial
  CRISPR gRNA sequence
gagggggagggacagactgt

SEQ ID NO: 708051 - DNA, 20 bp, Artificial
  CRISPR gRNA sequence
agggggagggacagactgtg

SEQ ID NO: 708052 - DNA, 20 bp, Artificial
  CRISPR gRNA sequence
ggagggacagactgtggggt

SEQ ID NO: 708053 - DNA, 20 bp, Artificial
  CRISPR gRNA sequence
gggacagactgtggggtcag

SEQ ID NO: 708054 - DNA, 20 bp, Artificial
  CRISPR gRNA sequence
ggacagactgtggggtcaga

SEQ ID NO: 708055 - DNA, 20 bp, Artificial
  CRISPR gRNA sequence
cagactgtggggtcagaagg

SEQ ID NO: 708056 - DNA, 20 bp, Artificial
  CRISPR gRNA sequence
agactgtggggtcagaaggt

SEQ ID NO: 708057 - DNA, 20 bp, Artificial
  CRISPR gRNA sequence
tgtggggtcagaaggtaggt

SEQ ID NO: 708058 - DNA, 20 bp, Artificial
  CRISPR gRNA sequence
ggtcagaaggtaggtgagtc

SEQ ID NO: 708059 - DNA, 20 bp, Artificial
  CRISPR gRNA sequence
agaaggtaggtgagtctggt

SEQ ID NO: 708060 - DNA, 20 bp, Artificial
  CRISPR gRNA sequence
gaaggtaggtgagtctggtc

SEQ ID NO: 708061 - DNA, 20 bp, Artificial
  CRISPR gRNA sequence
aaggtaggtgagtctggtcg

SEQ ID NO: 708062 - DNA, 20 bp, Artificial
  CRISPR gRNA sequence
ggtaggtgagtctggtcggg

SEQ ID NO: 708063 - DNA, 20 bp, Artificial
  CRISPR gRNA sequence
ggggagctacaacttgctgt

SEQ ID NO: 708064 - DNA, 20 bp, Artificial
  CRISPR gRNA sequence
tacaacttgctgtcagcctt

SEQ ID NO: 708065 - DNA, 20 bp, Artificial
  CRISPR gRNA sequence
ttgctgtcagccttgagtgc

SEQ ID NO: 708066 - DNA, 20 bp, Artificial
  CRISPR gRNA sequence
tcagccttgagtgctggaat

SEQ ID NO: 708067 - DNA, 20 bp, Artificial
  CRISPR gRNA sequence
gagtgctggaataagaatgc

SEQ ID NO: 708068 - DNA, 20 bp, Artificial
  CRISPR gRNA sequence
gaatgctggaattcatccca

SEQ ID NO: 708069 - DNA, 20 bp, Artificial
  CRISPR gRNA sequence
aatgctggaattcatcccat

SEQ ID NO: 708070 - DNA, 20 bp, Artificial
  CRISPR gRNA sequence
atgctggaattcatcccata

SEQ ID NO: 708071 - DNA, 20 bp, Artificial
  CRISPR gRNA sequence
ggaattcatcccatagggaa

SEQ ID NO: 708072 - DNA, 20 bp, Artificial
  CRISPR gRNA sequence
gaattcatcccatagggaat

SEQ ID NO: 708073 - DNA, 20 bp, Artificial
  CRISPR gRNA sequence
ttcatcccatagggaatggg

SEQ ID NO: 708074 - DNA, 20 bp, Artificial
  CRISPR gRNA sequence
catagggaatgggaagctgc

SEQ ID NO: 708075 - DNA, 20 bp, Artificial
  CRISPR gRNA sequence
tagggaatgggaagctgctg

SEQ ID NO: 708076 - DNA, 20 bp, Artificial
  CRISPR gRNA sequence
agggaatgggaagctgctgg

SEQ ID NO: 708077 - DNA, 20 bp, Artificial
  CRISPR gRNA sequence
ggaagctgctggaggcttct

SEQ ID NO: 708078 - DNA, 20 bp, Artificial
  CRISPR gRNA sequence
agctgctggaggcttctcgg

SEQ ID NO: 708079 - DNA, 20 bp, Artificial
  CRISPR gRNA sequence
gctgctggaggcttctcggc

SEQ ID NO: 708080 - DNA, 20 bp, Artificial
  CRISPR gRNA sequence
tgctggaggcttctcggcag

SEQ ID NO: 708081 - DNA, 20 bp, Artificial
  CRISPR gRNA sequence
gcttctcggcaggagtgcaa

SEQ ID NO: 708082 - DNA, 20 bp, Artificial
  CRISPR gRNA sequence
cttctcggcaggagtgcaat

SEQ ID NO: 708083 - DNA, 20 bp, Artificial
  CRISPR gRNA sequence
ttctcggcaggagtgcaata

SEQ ID NO: 708084 - DNA, 20 bp, Artificial
  CRISPR gRNA sequence
cggcaggagtgcaatagggt

SEQ ID NO: 708085 - DNA, 20 bp, Artificial
  CRISPR gRNA sequence
ggcaggagtgcaatagggtc

SEQ ID NO: 708086 - DNA, 20 bp, Artificial
  CRISPR gRNA sequence
atagggtcaggtatacattt

SEQ ID NO: 708087 - DNA, 20 bp, Artificial
  CRISPR gRNA sequence
tagggtcaggtatacatttt

SEQ ID NO: 708088 - DNA, 20 bp, Artificial
  CRISPR gRNA sequence
agggtcaggtatacattttg

SEQ ID NO: 708089 - DNA, 20 bp, Artificial
  CRISPR gRNA sequence
tttggggaaaatgccgtacc

SEQ ID NO: 708090 - DNA, 20 bp, Artificial
  CRISPR gRNA sequence
ttggggaaaatgccgtacca

SEQ ID NO: 708091 - DNA, 20 bp, Artificial
  CRISPR gRNA sequence
aaatgccgtaccaaggtgat

SEQ ID NO: 708092 - DNA, 20 bp, Artificial
  CRISPR gRNA sequence
tgccgtaccaaggtgatgag

SEQ ID NO: 708093 - DNA, 20 bp, Artificial
  CRISPR gRNA sequence
gtaccaaggtgatgagaagc

SEQ ID NO: 708094 - DNA, 20 bp, Artificial
  CRISPR gRNA sequence
accaaggtgatgagaagcaa

SEQ ID NO: 708095 - DNA, 20 bp, Artificial
  CRISPR gRNA sequence
caaggtgatgagaagcaaga

SEQ ID NO: 708096 - DNA, 20 bp, Artificial
  CRISPR gRNA sequence
aaggtgatgagaagcaagag

SEQ ID NO: 708097 - DNA, 20 bp, Artificial
  CRISPR gRNA sequence
ggtgatgagaagcaagagag

SEQ ID NO: 708098 - DNA, 20 bp, Artificial
  CRISPR gRNA sequence
gtgatgagaagcaagagagg

SEQ ID NO: 708099 - DNA, 20 bp, Artificial
  CRISPR gRNA sequence
atgagaagcaagagaggagg

SEQ ID NO: 708100 - DNA, 20 bp, Artificial
  CRISPR gRNA sequence
tgagaagcaagagaggaggc

SEQ ID NO: 708101 - DNA, 20 bp, Artificial
  CRISPR gRNA sequence
gagaagcaagagaggaggca

SEQ ID NO: 708102 - DNA, 20 bp, Artificial
  CRISPR gRNA sequence
gaagcaagagaggaggcagg

SEQ ID NO: 708103 - DNA, 20 bp, Artificial
  CRISPR gRNA sequence
aagcaagagaggaggcaggg

SEQ ID NO: 708104 - DNA, 20 bp, Artificial
  CRISPR gRNA sequence
agaggaggcagggaggccca

SEQ ID NO: 708105 - DNA, 20 bp, Artificial
  CRISPR gRNA sequence
gaggaggcagggaggcccac

SEQ ID NO: 708106 - DNA, 20 bp, Artificial
  CRISPR gRNA sequence
ggaggcagggaggcccacag

SEQ ID NO: 708107 - DNA, 20 bp, Artificial
  CRISPR gRNA sequence
gaggcagggaggcccacagg

SEQ ID NO: 708108 - DNA, 20 bp, Artificial
  CRISPR gRNA sequence
gggaggcccacaggaggcca

SEQ ID NO: 708109 - DNA, 20 bp, Artificial
  CRISPR gRNA sequence
ggccaaagccaatgtctgtc

SEQ ID NO: 708110 - DNA, 20 bp, Artificial
  CRISPR gRNA sequence
gccaaagccaatgtctgtcc

SEQ ID NO: 708111 - DNA, 20 bp, Artificial
  CRISPR gRNA sequence
aagccaatgtctgtccaggc

SEQ ID NO: 708112 - DNA, 20 bp, Artificial
  CRISPR gRNA sequence
ccaatgtctgtccaggctgg

SEQ ID NO: 708113 - DNA, 20 bp, Artificial
  CRISPR gRNA sequence
atgtctgtccaggctggcag

SEQ ID NO: 708114 - DNA, 20 bp, Artificial
  CRISPR gRNA sequence
aggctggcagcagctgccgt

SEQ ID NO: 708115 - DNA, 20 bp, Artificial
  CRISPR gRNA sequence
ggctggcagcagctgccgtt

SEQ ID NO: 708116 - DNA, 20 bp, Artificial
  CRISPR gRNA sequence
tggcagcagctgccgttggg

SEQ ID NO: 708117 - DNA, 20 bp, Artificial
  CRISPR gRNA sequence
gttgggaagctctgaacatc

SEQ ID NO: 708118 - DNA, 20 bp, Artificial
  CRISPR gRNA sequence
ttgggaagctctgaacatct

SEQ ID NO: 708119 - DNA, 20 bp, Artificial
  CRISPR gRNA sequence
catctgtcctcctgcttctg

SEQ ID NO: 708120 - DNA, 20 bp, Artificial
  CRISPR gRNA sequence
tctgtcctcctgcttctgca

SEQ ID NO: 708121 - DNA, 20 bp, Artificial
  CRISPR gRNA sequence
ctgtcctcctgcttctgcag

SEQ ID NO: 708122 - DNA, 20 bp, Artificial
  CRISPR gRNA sequence
tgtcctcctgcttctgcaga

SEQ ID NO: 708123 - DNA, 20 bp, Artificial
  CRISPR gRNA sequence
cctcctgcttctgcagaggg

SEQ ID NO: 708124 - DNA, 20 bp, Artificial
  CRISPR gRNA sequence
ctcctgcttctgcagagggt

SEQ ID NO: 708125 - DNA, 20 bp, Artificial
  CRISPR gRNA sequence
ctgcttctgcagagggtggg

SEQ ID NO: 708126 - DNA, 20 bp, Artificial
  CRISPR gRNA sequence
gcagagggtgggtggtaacg

SEQ ID NO: 708127 - DNA, 20 bp, Artificial
  CRISPR gRNA sequence
gtggtaacgtggacaaacca

SEQ ID NO: 708128 - DNA, 20 bp, Artificial
  CRISPR gRNA sequence
tggtaacgtggacaaaccac

SEQ ID NO: 708129 - DNA, 20 bp, Artificial
  CRISPR gRNA sequence
gtggacaaaccacgggcttc

SEQ ID NO: 708130 - DNA, 20 bp, Artificial
  CRISPR gRNA sequence
tggacaaaccacgggcttca

SEQ ID NO: 708131 - DNA, 20 bp, Artificial
  CRISPR gRNA sequence
aaaccacgggcttcaaggcc

SEQ ID NO: 708132 - DNA, 20 bp, Artificial
  CRISPR gRNA sequence
ccacgggcttcaaggcccag

SEQ ID NO: 708133 - DNA, 20 bp, Artificial
  CRISPR gRNA sequence
gcttcaaggcccagcagatg

SEQ ID NO: 708134 - DNA, 20 bp, Artificial
  CRISPR gRNA sequence
cttcaaggcccagcagatgc

SEQ ID NO: 708135 - DNA, 20 bp, Artificial
  CRISPR gRNA sequence
aggcccagcagatgcgggac

SEQ ID NO: 708136 - DNA, 20 bp, Artificial
  CRISPR gRNA sequence
agcagatgcgggacgagttc

SEQ ID NO: 708137 - DNA, 20 bp, Artificial
  CRISPR gRNA sequence
cgagttccagctgtgccact

SEQ ID NO: 708138 - DNA, 20 bp, Artificial
  CRISPR gRNA sequence
gttccagctgtgccacttag

SEQ ID NO: 708139 - DNA, 20 bp, Artificial
  CRISPR gRNA sequence
gccacttagtagccatgcaa

SEQ ID NO: 708140 - DNA, 20 bp, Artificial
  CRISPR gRNA sequence
ccacttagtagccatgcaat

SEQ ID NO: 708141 - DNA, 20 bp, Artificial
  CRISPR gRNA sequence
cacttagtagccatgcaatg

SEQ ID NO: 708142 - DNA, 20 bp, Artificial
  CRISPR gRNA sequence
ggaaaatcacttcaccctct

SEQ ID NO: 708143 - DNA, 20 bp, Artificial
  CRISPR gRNA sequence
tcacttcaccctctgagcca

SEQ ID NO: 708144 - DNA, 20 bp, Artificial
  CRISPR gRNA sequence
cggtctccccaactgtaaaa

SEQ ID NO: 708145 - DNA, 20 bp, Artificial
  CRISPR gRNA sequence
ggtctccccaactgtaaaat

SEQ ID NO: 708146 - DNA, 20 bp, Artificial
  CRISPR gRNA sequence
gtctccccaactgtaaaatg

SEQ ID NO: 708147 - DNA, 20 bp, Artificial
  CRISPR gRNA sequence
ctccccaactgtaaaatggg

SEQ ID NO: 708148 - DNA, 20 bp, Artificial
  CRISPR gRNA sequence
ccaactgtaaaatggggaga

SEQ ID NO: 708149 - DNA, 20 bp, Artificial
  CRISPR gRNA sequence
ggggagaaagacaccatcca

SEQ ID NO: 708150 - DNA, 20 bp, Artificial
  CRISPR gRNA sequence
gagaaagacaccatccaaag

SEQ ID NO: 708151 - DNA, 20 bp, Artificial
  CRISPR gRNA sequence
agaaagacaccatccaaaga

SEQ ID NO: 708152 - DNA, 20 bp, Artificial
  CRISPR gRNA sequence
aagacaccatccaaagaagg

SEQ ID NO: 708153 - DNA, 20 bp, Artificial
  CRISPR gRNA sequence
caccatccaaagaaggtggt

SEQ ID NO: 708154 - DNA, 20 bp, Artificial
  CRISPR gRNA sequence
aaagaaggtggtgagaccat

SEQ ID NO: 708155 - DNA, 20 bp, Artificial
  CRISPR gRNA sequence
agaaggtggtgagaccatca

SEQ ID NO: 708156 - DNA, 20 bp, Artificial
  CRISPR gRNA sequence
tggtgagaccatcagagatg

SEQ ID NO: 708157 - DNA, 20 bp, Artificial
  CRISPR gRNA sequence
gtgagaccatcagagatgaa

SEQ ID NO: 708158 - DNA, 20 bp, Artificial
  CRISPR gRNA sequence
gaccatcagagatgaagaga

SEQ ID NO: 708159 - DNA, 20 bp, Artificial
  CRISPR gRNA sequence
atgaagagatggcacctaca

SEQ ID NO: 708160 - DNA, 20 bp, Artificial
  CRISPR gRNA sequence
gatggcacctacacagtgcc

SEQ ID NO: 708161 - DNA, 20 bp, Artificial
  CRISPR gRNA sequence
acacagtgcccggaatgcgc

SEQ ID NO: 708162 - DNA, 20 bp, Artificial
  CRISPR gRNA sequence
gtgcccggaatgcgccagac

SEQ ID NO: 708163 - DNA, 20 bp, Artificial
  CRISPR gRNA sequence
cccggaatgcgccagacaag

SEQ ID NO: 708164 - DNA, 20 bp, Artificial
  CRISPR gRNA sequence
ggaatgcgccagacaagtgg

SEQ ID NO: 708165 - DNA, 20 bp, Artificial
  CRISPR gRNA sequence
gaatgcgccagacaagtggc

SEQ ID NO: 708166 - DNA, 20 bp, Artificial
  CRISPR gRNA sequence
gtggcaggtcctgtgaccac

SEQ ID NO: 708167 - DNA, 20 bp, Artificial
  CRISPR gRNA sequence
acgtcttcctcctgtcccct

SEQ ID NO: 708168 - DNA, 20 bp, Artificial
  CRISPR gRNA sequence
cgtcttcctcctgtcccctc

SEQ ID NO: 708169 - DNA, 20 bp, Artificial
  CRISPR gRNA sequence
ctcctgtcccctcgggtgct

SEQ ID NO: 708170 - DNA, 20 bp, Artificial
  CRISPR gRNA sequence
tcccctcgggtgctcggtgt

SEQ ID NO: 708171 - DNA, 20 bp, Artificial
  CRISPR gRNA sequence
cccctcgggtgctcggtgtt

SEQ ID NO: 708172 - DNA, 20 bp, Artificial
  CRISPR gRNA sequence
ccctcgggtgctcggtgttg

SEQ ID NO: 708173 - DNA, 20 bp, Artificial
  CRISPR gRNA sequence
cctcgggtgctcggtgttgg

SEQ ID NO: 708174 - DNA, 20 bp, Artificial
  CRISPR gRNA sequence
gggtgctcggtgttgggggc

SEQ ID NO: 708175 - DNA, 20 bp, Artificial
  CRISPR gRNA sequence
ggtgctcggtgttgggggct

SEQ ID NO: 708176 - DNA, 20 bp, Artificial
  CRISPR gRNA sequence
gtgctcggtgttgggggctg

SEQ ID NO: 708177 - DNA, 20 bp, Artificial
  CRISPR gRNA sequence
ctcggtgttgggggctgggg

SEQ ID NO: 708178 - DNA, 20 bp, Artificial
  CRISPR gRNA sequence
gggtggtgttcgttttttat

SEQ ID NO: 708179 - DNA, 20 bp, Artificial
  CRISPR gRNA sequence
tgttcgttttttatgagtaa

SEQ ID NO: 708180 - DNA, 20 bp, Artificial
  CRISPR gRNA sequence
tcgttttttatgagtaacag

SEQ ID NO: 708181 - DNA, 20 bp, Artificial
  CRISPR gRNA sequence
cgttttttatgagtaacagc

SEQ ID NO: 708182 - DNA, 20 bp, Artificial
  CRISPR gRNA sequence
agcaggcatctcatgcacac

SEQ ID NO: 708183 - DNA, 20 bp, Artificial
  CRISPR gRNA sequence
tggctcatgaatccgcacaa

SEQ ID NO: 708184 - DNA, 20 bp, Artificial
  CRISPR gRNA sequence
gaatccgcacaatggcctac

SEQ ID NO: 708185 - DNA, 20 bp, Artificial
  CRISPR gRNA sequence
aatccgcacaatggcctacg

SEQ ID NO: 708186 - DNA, 20 bp, Artificial
  CRISPR gRNA sequence
cgcacaatggcctacgaggt

SEQ ID NO: 708187 - DNA, 20 bp, Artificial
  CRISPR gRNA sequence
accctcgctgtccctactta

SEQ ID NO: 708188 - DNA, 20 bp, Artificial
  CRISPR gRNA sequence
ctacttacagaaacttcaat

SEQ ID NO: 708189 - DNA, 20 bp, Artificial
  CRISPR gRNA sequence
tacttacagaaacttcaatt

SEQ ID NO: 708190 - DNA, 20 bp, Artificial
  CRISPR gRNA sequence
acttacagaaacttcaattg

SEQ ID NO: 708191 - DNA, 20 bp, Artificial
  CRISPR gRNA sequence
cagaaacttcaattggggtg

SEQ ID NO: 708192 - DNA, 20 bp, Artificial
  CRISPR gRNA sequence
aatctatgcctctcctttcc

SEQ ID NO: 708193 - DNA, 20 bp, Artificial
  CRISPR gRNA sequence
atctatgcctctcctttcct

SEQ ID NO: 708194 - DNA, 20 bp, Artificial
  CRISPR gRNA sequence
tttcctgggcctttcaactc

SEQ ID NO: 708195 - DNA, 20 bp, Artificial
  CRISPR gRNA sequence
ttcctgggcctttcaactcc

SEQ ID NO: 708196 - DNA, 20 bp, Artificial
  CRISPR gRNA sequence
tcctgggcctttcaactcca

SEQ ID NO: 708197 - DNA, 20 bp, Artificial
  CRISPR gRNA sequence
cctttcaactccagggtctc

SEQ ID NO: 708198 - DNA, 20 bp, Artificial
  CRISPR gRNA sequence
ctttcaactccagggtctcc

SEQ ID NO: 708199 - DNA, 20 bp, Artificial
  CRISPR gRNA sequence
cagggtctccaggtcccttc

SEQ ID NO: 708200 - DNA, 20 bp, Artificial
  CRISPR gRNA sequence
agggtctccaggtcccttcc

SEQ ID NO: 708201 - DNA, 20 bp, Artificial
  CRISPR gRNA sequence
gggtctccaggtcccttcca

SEQ ID NO: 708202 - DNA, 20 bp, Artificial
  CRISPR gRNA sequence
tccaggtcccttccagggcc

SEQ ID NO: 708203 - DNA, 20 bp, Artificial
  CRISPR gRNA sequence
ccaggtcccttccagggccc

SEQ ID NO: 708204 - DNA, 20 bp, Artificial
  CRISPR gRNA sequence
caggtcccttccagggccca

SEQ ID NO: 708205 - DNA, 20 bp, Artificial
  CRISPR gRNA sequence
attcatctcccatctgcccc

SEQ ID NO: 708206 - DNA, 20 bp, Artificial
  CRISPR gRNA sequence
ttcatctcccatctgcccct

SEQ ID NO: 708207 - DNA, 20 bp, Artificial
  CRISPR gRNA sequence
tcccatctgcccctgggctg

SEQ ID NO: 708208 - DNA, 20 bp, Artificial
  CRISPR gRNA sequence
cccatctgcccctgggctgc

SEQ ID NO: 708209 - DNA, 20 bp, Artificial
  CRISPR gRNA sequence
ccatctgcccctgggctgca

SEQ ID NO: 708210 - DNA, 20 bp, Artificial
  CRISPR gRNA sequence
catctgcccctgggctgcag

SEQ ID NO: 708211 - DNA, 20 bp, Artificial
  CRISPR gRNA sequence
ctgcaggggacctcccaaaa

SEQ ID NO: 708212 - DNA, 20 bp, Artificial
  CRISPR gRNA sequence
tgcaggggacctcccaaaac

SEQ ID NO: 708213 - DNA, 20 bp, Artificial
  CRISPR gRNA sequence
tgactcaccaatcttgttat

SEQ ID NO: 708214 - DNA, 20 bp, Artificial
  CRISPR gRNA sequence
cttgttattggtgtgctccg

SEQ ID NO: 708215 - DNA, 20 bp, Artificial
  CRISPR gRNA sequence
tggtgtgctccgtggacacc

SEQ ID NO: 708216 - DNA, 20 bp, Artificial
  CRISPR gRNA sequence
ggtgtgctccgtggacaccc

SEQ ID NO: 708217 - DNA, 20 bp, Artificial
  CRISPR gRNA sequence
gtgtgctccgtggacacccg

SEQ ID NO: 708218 - DNA, 20 bp, Artificial
  CRISPR gRNA sequence
ctccgtggacacccggggct

SEQ ID NO: 708219 - DNA, 20 bp, Artificial
  CRISPR gRNA sequence
tccgtggacacccggggctc

SEQ ID NO: 708220 - DNA, 20 bp, Artificial
  CRISPR gRNA sequence
gtggacacccggggctcagg

SEQ ID NO: 708221 - DNA, 20 bp, Artificial
  CRISPR gRNA sequence
tggacacccggggctcagga

SEQ ID NO: 708222 - DNA, 20 bp, Artificial
  CRISPR gRNA sequence
ccggggctcaggaaggtccc

SEQ ID NO: 708223 - DNA, 20 bp, Artificial
  CRISPR gRNA sequence
cggggctcaggaaggtccct

SEQ ID NO: 708224 - DNA, 20 bp, Artificial
  CRISPR gRNA sequence
ggggctcaggaaggtccctg

SEQ ID NO: 708225 - DNA, 20 bp, Artificial
  CRISPR gRNA sequence
gggctcaggaaggtccctgg

SEQ ID NO: 708226 - DNA, 20 bp, Artificial
  CRISPR gRNA sequence
caggaaggtccctgggggac

SEQ ID NO: 708227 - DNA, 20 bp, Artificial
  CRISPR gRNA sequence
aggaaggtccctgggggacg

SEQ ID NO: 708228 - DNA, 20 bp, Artificial
  CRISPR gRNA sequence
ggaaggtccctgggggacga

SEQ ID NO: 708229 - DNA, 20 bp, Artificial
  CRISPR gRNA sequence
gaaggtccctgggggacgag

SEQ ID NO: 708230 - DNA, 20 bp, Artificial
  CRISPR gRNA sequence
cctgggggacgaggggcccc

SEQ ID NO: 708231 - DNA, 20 bp, Artificial
  CRISPR gRNA sequence
ggggacgaggggcccccggc

SEQ ID NO: 708232 - DNA, 20 bp, Artificial
  CRISPR gRNA sequence
gggacgaggggcccccggcc

SEQ ID NO: 708233 - DNA, 20 bp, Artificial
  CRISPR gRNA sequence
cgaggggcccccggccgggc

SEQ ID NO: 708234 - DNA, 20 bp, Artificial
  CRISPR gRNA sequence
ccggccgggctggcatcctg

SEQ ID NO: 708235 - DNA, 20 bp, Artificial
  CRISPR gRNA sequence
gccgggctggcatcctgcag

SEQ ID NO: 708236 - DNA, 20 bp, Artificial
  CRISPR gRNA sequence
gggctggcatcctgcagcgg

SEQ ID NO: 708237 - DNA, 20 bp, Artificial
  CRISPR gRNA sequence
ggctggcatcctgcagcggc

SEQ ID NO: 708238 - DNA, 20 bp, Artificial
  CRISPR gRNA sequence
tcctgcagcggcaggctctc

SEQ ID NO: 708239 - DNA, 20 bp, Artificial
  CRISPR gRNA sequence
cctgcagcggcaggctctcc

SEQ ID NO: 708240 - DNA, 20 bp, Artificial
  CRISPR gRNA sequence
gcagcggcaggctctccagg

SEQ ID NO: 708241 - DNA, 20 bp, Artificial
  CRISPR gRNA sequence
cagcggcaggctctccaggt

SEQ ID NO: 708242 - DNA, 20 bp, Artificial
  CRISPR gRNA sequence
ggtaggctgcccccacgctg

SEQ ID NO: 708243 - DNA, 20 bp, Artificial
  CRISPR gRNA sequence
aggctgcccccacgctgtgg

SEQ ID NO: 708244 - DNA, 20 bp, Artificial
  CRISPR gRNA sequence
ggctgcccccacgctgtggc

SEQ ID NO: 708245 - DNA, 20 bp, Artificial
  CRISPR gRNA sequence
acgctgtggcaggtctccat

SEQ ID NO: 708246 - DNA, 20 bp, Artificial
  CRISPR gRNA sequence
ctgtggcaggtctccatcag

SEQ ID NO: 708247 - DNA, 20 bp, Artificial
  CRISPR gRNA sequence
ggcaggtctccatcagtggc

SEQ ID NO: 708248 - DNA, 20 bp, Artificial
  CRISPR gRNA sequence
taaccctcgctcttccgcga

SEQ ID NO: 708249 - DNA, 20 bp, Artificial
  CRISPR gRNA sequence
aaccctcgctcttccgcgac

SEQ ID NO: 708250 - DNA, 20 bp, Artificial
  CRISPR gRNA sequence
gtcaccgacgcaccactcct

SEQ ID NO: 708251 - DNA, 20 bp, Artificial
  CRISPR gRNA sequence
gcaccactcctcagctgctg

SEQ ID NO: 708252 - DNA, 20 bp, Artificial
  CRISPR gRNA sequence
caccactcctcagctgctgt

SEQ ID NO: 708253 - DNA, 20 bp, Artificial
  CRISPR gRNA sequence
actcctcagctgctgtggga

SEQ ID NO: 708254 - DNA, 20 bp, Artificial
  CRISPR gRNA sequence
ctcctcagctgctgtgggac

SEQ ID NO: 708255 - DNA, 20 bp, Artificial
  CRISPR gRNA sequence
cagctgctgtgggacgggaa

SEQ ID NO: 708256 - DNA, 20 bp, Artificial
  CRISPR gRNA sequence
agctgctgtgggacgggaat

SEQ ID NO: 708257 - DNA, 20 bp, Artificial
  CRISPR gRNA sequence
gacgggaatgggtgctgctg

SEQ ID NO: 708258 - DNA, 20 bp, Artificial
  CRISPR gRNA sequence
acgggaatgggtgctgctgc

SEQ ID NO: 708259 - DNA, 20 bp, Artificial
  CRISPR gRNA sequence
cgggaatgggtgctgctgca

SEQ ID NO: 708260 - DNA, 20 bp, Artificial
  CRISPR gRNA sequence
ggtacccccaacctccccac

SEQ ID NO: 708261 - DNA, 20 bp, Artificial
  CRISPR gRNA sequence
ctccccaccagtctctgaac

SEQ ID NO: 708262 - DNA, 20 bp, Artificial
  CRISPR gRNA sequence
tccccaccagtctctgaact

SEQ ID NO: 708263 - DNA, 20 bp, Artificial
  CRISPR gRNA sequence
cccaccagtctctgaactgg

SEQ ID NO: 708264 - DNA, 20 bp, Artificial
  CRISPR gRNA sequence
ccaccagtctctgaactggg

SEQ ID NO: 708265 - DNA, 20 bp, Artificial
  CRISPR gRNA sequence
ccttttttttttcatctcta

SEQ ID NO: 708266 - DNA, 20 bp, Artificial
  CRISPR gRNA sequence
tttttcatctctacagaccc

SEQ ID NO: 708267 - DNA, 20 bp, Artificial
  CRISPR gRNA sequence
tcatctctacagaccccagt

SEQ ID NO: 708268 - DNA, 20 bp, Artificial
  CRISPR gRNA sequence
agtccccctttctgctttaa

SEQ ID NO: 708269 - DNA, 20 bp, Artificial
  CRISPR gRNA sequence
tctgctttaaaagctgccat

SEQ ID NO: 708270 - DNA, 20 bp, Artificial
  CRISPR gRNA sequence
aaagctgccatgagctgccc

SEQ ID NO: 708271 - DNA, 20 bp, Artificial
  CRISPR gRNA sequence
aagctgccatgagctgcccc

SEQ ID NO: 708272 - DNA, 20 bp, Artificial
  CRISPR gRNA sequence
atgagctgccccgggcttct

SEQ ID NO: 708273 - DNA, 20 bp, Artificial
  CRISPR gRNA sequence
ccccgggcttctcagctttc

SEQ ID NO: 708274 - DNA, 20 bp, Artificial
  CRISPR gRNA sequence
cccgggcttctcagctttct

SEQ ID NO: 708275 - DNA, 20 bp, Artificial
  CRISPR gRNA sequence
gcttctcagctttctgggtg

SEQ ID NO: 708276 - DNA, 20 bp, Artificial
  CRISPR gRNA sequence
tgcttttaatttgtactaaa

SEQ ID NO: 708277 - DNA, 20 bp, Artificial
  CRISPR gRNA sequence
ttttaatttgtactaaatag

SEQ ID NO: 708278 - DNA, 20 bp, Artificial
  CRISPR gRNA sequence
tttaatttgtactaaatagt

SEQ ID NO: 708279 - DNA, 20 bp, Artificial
  CRISPR gRNA sequence
ttaatttgtactaaatagta

SEQ ID NO: 708280 - DNA, 20 bp, Artificial
  CRISPR gRNA sequence
taatttgtactaaatagtag

SEQ ID NO: 708281 - DNA, 20 bp, Artificial
  CRISPR gRNA sequence
gtactaaatagtaggggtaa

SEQ ID NO: 708282 - DNA, 20 bp, Artificial
  CRISPR gRNA sequence
taaatagtaggggtaacagt

SEQ ID NO: 708283 - DNA, 20 bp, Artificial
  CRISPR gRNA sequence
gggtaacagtcagcgactca

SEQ ID NO: 708284 - DNA, 20 bp, Artificial
  CRISPR gRNA sequence
ggtaacagtcagcgactcac

SEQ ID NO: 708285 - DNA, 20 bp, Artificial
  CRISPR gRNA sequence
gtaacagtcagcgactcaca

SEQ ID NO: 708286 - DNA, 20 bp, Artificial
  CRISPR gRNA sequence
agggtgctcgccacgtccgt

SEQ ID NO: 708287 - DNA, 20 bp, Artificial
  CRISPR gRNA sequence
cgtccgttggccctgtccta

SEQ ID NO: 708288 - DNA, 20 bp, Artificial
  CRISPR gRNA sequence
aatcctcacaaccactgtat

SEQ ID NO: 708289 - DNA, 20 bp, Artificial
  CRISPR gRNA sequence
atcctcacaaccactgtatg

SEQ ID NO: 708290 - DNA, 20 bp, Artificial
  CRISPR gRNA sequence
ctcacaaccactgtatgagg

SEQ ID NO: 708291 - DNA, 20 bp, Artificial
  CRISPR gRNA sequence
tcacaaccactgtatgaggt

SEQ ID NO: 708292 - DNA, 20 bp, Artificial
  CRISPR gRNA sequence
ccactgtatgaggtgggtaa

SEQ ID NO: 708293 - DNA, 20 bp, Artificial
  CRISPR gRNA sequence
acagcccactccccatttta

SEQ ID NO: 708294 - DNA, 20 bp, Artificial
  CRISPR gRNA sequence
ccactccccattttacagat

SEQ ID NO: 708295 - DNA, 20 bp, Artificial
  CRISPR gRNA sequence
cactccccattttacagatg

SEQ ID NO: 708296 - DNA, 20 bp, Artificial
  CRISPR gRNA sequence
attttacagatgaggaaact

SEQ ID NO: 708297 - DNA, 20 bp, Artificial
  CRISPR gRNA sequence
ttttacagatgaggaaactg

SEQ ID NO: 708298 - DNA, 20 bp, Artificial
  CRISPR gRNA sequence
cagatgaggaaactgaggca

SEQ ID NO: 708299 - DNA, 20 bp, Artificial
  CRISPR gRNA sequence
gatgaggaaactgaggcaca

SEQ ID NO: 708300 - DNA, 20 bp, Artificial
  CRISPR gRNA sequence
atgaggaaactgaggcacag

SEQ ID NO: 708301 - DNA, 20 bp, Artificial
  CRISPR gRNA sequence
gaggaaactgaggcacagag

SEQ ID NO: 708302 - DNA, 20 bp, Artificial
  CRISPR gRNA sequence
aactgaggcacagaggagtc

SEQ ID NO: 708303 - DNA, 20 bp, Artificial
  CRISPR gRNA sequence
gcacagaggagtcgagtaat

SEQ ID NO: 708304 - DNA, 20 bp, Artificial
  CRISPR gRNA sequence
gaggagtcgagtaattggcc

SEQ ID NO: 708305 - DNA, 20 bp, Artificial
  CRISPR gRNA sequence
aggagtcgagtaattggccc

SEQ ID NO: 708306 - DNA, 20 bp, Artificial
  CRISPR gRNA sequence
ggagtcgagtaattggccca

SEQ ID NO: 708307 - DNA, 20 bp, Artificial
  CRISPR gRNA sequence
cccagggttataccatcaat

SEQ ID NO: 708308 - DNA, 20 bp, Artificial
  CRISPR gRNA sequence
tataccatcaataagtatct

SEQ ID NO: 708309 - DNA, 20 bp, Artificial
  CRISPR gRNA sequence
ccatcaataagtatctgagc

SEQ ID NO: 708310 - DNA, 20 bp, Artificial
  CRISPR gRNA sequence
catcaataagtatctgagct

SEQ ID NO: 708311 - DNA, 20 bp, Artificial
  CRISPR gRNA sequence
ctgagctaggatttgaaccc

SEQ ID NO: 708312 - DNA, 20 bp, Artificial
  CRISPR gRNA sequence
aggatttgaaccctggcatc

SEQ ID NO: 708313 - DNA, 20 bp, Artificial
  CRISPR gRNA sequence
ggtccataacccacactcat

SEQ ID NO: 708314 - DNA, 20 bp, Artificial
  CRISPR gRNA sequence
acccacactcataagcaccc

SEQ ID NO: 708315 - DNA, 20 bp, Artificial
  CRISPR gRNA sequence
tcataagcacccaagtctgt

SEQ ID NO: 708316 - DNA, 20 bp, Artificial
  CRISPR gRNA sequence
gcacccaagtctgtaagtac

SEQ ID NO: 708317 - DNA, 20 bp, Artificial
  CRISPR gRNA sequence
aagtctgtaagtaccagctc

SEQ ID NO: 708318 - DNA, 20 bp, Artificial
  CRISPR gRNA sequence
agtctgtaagtaccagctcc

SEQ ID NO: 708319 - DNA, 20 bp, Artificial
  CRISPR gRNA sequence
gctccaggtcccccacctcc

SEQ ID NO: 708320 - DNA, 20 bp, Artificial
  CRISPR gRNA sequence
tccaggtcccccacctcctg

SEQ ID NO: 708321 - DNA, 20 bp, Artificial
  CRISPR gRNA sequence
aggtcccccacctcctggag

SEQ ID NO: 708322 - DNA, 20 bp, Artificial
  CRISPR gRNA sequence
acctcctggagcagcccctc

SEQ ID NO: 708323 - DNA, 20 bp, Artificial
  CRISPR gRNA sequence
gagcagcccctccagctccc

SEQ ID NO: 708324 - DNA, 20 bp, Artificial
  CRISPR gRNA sequence
gctccccagccccgacatcc

SEQ ID NO: 708325 - DNA, 20 bp, Artificial
  CRISPR gRNA sequence
cccagccccgacatcctgga

SEQ ID NO: 708326 - DNA, 20 bp, Artificial
  CRISPR gRNA sequence
agccccgacatcctggaaag

SEQ ID NO: 708327 - DNA, 20 bp, Artificial
  CRISPR gRNA sequence
agtcttttatgatcacactc

SEQ ID NO: 708328 - DNA, 20 bp, Artificial
  CRISPR gRNA sequence
acactcaagcattctaaaaa

SEQ ID NO: 708329 - DNA, 20 bp, Artificial
  CRISPR gRNA sequence
ttctaaaaacagactactgt

SEQ ID NO: 708330 - DNA, 20 bp, Artificial
  CRISPR gRNA sequence
aaacagactactgttagttc

SEQ ID NO: 708331 - DNA, 20 bp, Artificial
  CRISPR gRNA sequence
ctactgttagttcaagtgac

SEQ ID NO: 708332 - DNA, 20 bp, Artificial
  CRISPR gRNA sequence
gttagttcaagtgacaagcc

SEQ ID NO: 708333 - DNA, 20 bp, Artificial
  CRISPR gRNA sequence
aacaaaaaaaaacaaaaaaa

SEQ ID NO: 708334 - DNA, 20 bp, Artificial
  CRISPR gRNA sequence
caaaaaaacagctatgtcat

SEQ ID NO: 708335 - DNA, 20 bp, Artificial
  CRISPR gRNA sequence
aaaaaaacagctatgtcatg

SEQ ID NO: 708336 - DNA, 20 bp, Artificial
  CRISPR gRNA sequence
aaacagctatgtcatgagga

SEQ ID NO: 708337 - DNA, 20 bp, Artificial
  CRISPR gRNA sequence
ctatgtcatgaggaaagtgt

SEQ ID NO: 708338 - DNA, 20 bp, Artificial
  CRISPR gRNA sequence
tcatgaggaaagtgtcagtt

SEQ ID NO: 708339 - DNA, 20 bp, Artificial
  CRISPR gRNA sequence
agtttagtttttgattttta

SEQ ID NO: 708340 - DNA, 20 bp, Artificial
  CRISPR gRNA sequence
gtttagtttttgatttttac

SEQ ID NO: 708341 - DNA, 20 bp, Artificial
  CRISPR gRNA sequence
agtttttgatttttacaggt

SEQ ID NO: 708342 - DNA, 20 bp, Artificial
  CRISPR gRNA sequence
gtttttgatttttacaggta

SEQ ID NO: 708343 - DNA, 20 bp, Artificial
  CRISPR gRNA sequence
tttttgatttttacaggtaa

SEQ ID NO: 708344 - DNA, 20 bp, Artificial
  CRISPR gRNA sequence
gatttttacaggtaagggca

SEQ ID NO: 708345 - DNA, 20 bp, Artificial
  CRISPR gRNA sequence
ttttacaggtaagggcaaag

SEQ ID NO: 708346 - DNA, 20 bp, Artificial
  CRISPR gRNA sequence
tacaggtaagggcaaagaag

SEQ ID NO: 708347 - DNA, 20 bp, Artificial
  CRISPR gRNA sequence
atgtcctgatgccttcaaaa

SEQ ID NO: 708348 - DNA, 20 bp, Artificial
  CRISPR gRNA sequence
gtcctgatgccttcaaaatg

SEQ ID NO: 708349 - DNA, 20 bp, Artificial
  CRISPR gRNA sequence
tgatgccttcaaaatggagt

SEQ ID NO: 708350 - DNA, 20 bp, Artificial
  CRISPR gRNA sequence
cttcaaaatggagtgagtgt

SEQ ID NO: 708351 - DNA, 20 bp, Artificial
  CRISPR gRNA sequence
tggagtgagtgtgagtaatt

SEQ ID NO: 708352 - DNA, 20 bp, Artificial
  CRISPR gRNA sequence
gagtgagtgtgagtaattca

SEQ ID NO: 708353 - DNA, 20 bp, Artificial
  CRISPR gRNA sequence
agtgagtgtgagtaattcag

SEQ ID NO: 708354 - DNA, 20 bp, Artificial
  CRISPR gRNA sequence
tgagtgtgagtaattcagag

SEQ ID NO: 708355 - DNA, 20 bp, Artificial
  CRISPR gRNA sequence
gagtgtgagtaattcagagg

SEQ ID NO: 708356 - DNA, 20 bp, Artificial
  CRISPR gRNA sequence
tgtgagtaattcagaggagg

SEQ ID NO: 708357 - DNA, 20 bp, Artificial
  CRISPR gRNA sequence
gtgagtaattcagaggaggc

SEQ ID NO: 708358 - DNA, 20 bp, Artificial
  CRISPR gRNA sequence
tgagtaattcagaggaggca

SEQ ID NO: 708359 - DNA, 20 bp, Artificial
  CRISPR gRNA sequence
gtgctgacgcaatgattctc

SEQ ID NO: 708360 - DNA, 20 bp, Artificial
  CRISPR gRNA sequence
tgctgacgcaatgattctca

SEQ ID NO: 708361 - DNA, 20 bp, Artificial
  CRISPR gRNA sequence
acgcaatgattctcaaggca

SEQ ID NO: 708362 - DNA, 20 bp, Artificial
  CRISPR gRNA sequence
gcaatgattctcaaggcaca

SEQ ID NO: 708363 - DNA, 20 bp, Artificial
  CRISPR gRNA sequence
caatgattctcaaggcacag

SEQ ID NO: 708364 - DNA, 20 bp, Artificial
  CRISPR gRNA sequence
aatgattctcaaggcacaga

SEQ ID NO: 708365 - DNA, 20 bp, Artificial
  CRISPR gRNA sequence
ggcacagagggcgtatcttt

SEQ ID NO: 708366 - DNA, 20 bp, Artificial
  CRISPR gRNA sequence
agagggcgtatcttttagat

SEQ ID NO: 708367 - DNA, 20 bp, Artificial
  CRISPR gRNA sequence
tatcttttagattggtgcaa

SEQ ID NO: 708368 - DNA, 20 bp, Artificial
  CRISPR gRNA sequence
attattttttactttttaaa

SEQ ID NO: 708369 - DNA, 20 bp, Artificial
  CRISPR gRNA sequence
taaattctactttcccaaaa

SEQ ID NO: 708370 - DNA, 20 bp, Artificial
  CRISPR gRNA sequence
aaattctactttcccaaaac

SEQ ID NO: 708371 - DNA, 20 bp, Artificial
  CRISPR gRNA sequence
attctactttcccaaaacag

SEQ ID NO: 708372 - DNA, 20 bp, Artificial
  CRISPR gRNA sequence
aaccacataataacttttaa

SEQ ID NO: 708373 - DNA, 20 bp, Artificial
  CRISPR gRNA sequence
accacataataacttttaaa

SEQ ID NO: 708374 - DNA, 20 bp, Artificial
  CRISPR gRNA sequence
aataacttttaaaaggcgct

SEQ ID NO: 708375 - DNA, 20 bp, Artificial
  CRISPR gRNA sequence
taaaaggcgctgagattcct

SEQ ID NO: 708376 - DNA, 20 bp, Artificial
  CRISPR gRNA sequence
cgctgagattcctcagcttc

SEQ ID NO: 708377 - DNA, 20 bp, Artificial
  CRISPR gRNA sequence
tcagcttccagatcactgct

SEQ ID NO: 708378 - DNA, 20 bp, Artificial
  CRISPR gRNA sequence
cttccagatcactgctgagc

SEQ ID NO: 708379 - DNA, 20 bp, Artificial
  CRISPR gRNA sequence
actgctgagctagaaaaata

SEQ ID NO: 708380 - DNA, 20 bp, Artificial
  CRISPR gRNA sequence
aaaaataaagtttgttctac

SEQ ID NO: 708381 - DNA, 20 bp, Artificial
  CRISPR gRNA sequence
aaaataaagtttgttctacc

SEQ ID NO: 708382 - DNA, 20 bp, Artificial
  CRISPR gRNA sequence
gtttgttctaccaggaacca

SEQ ID NO: 708383 - DNA, 20 bp, Artificial
  CRISPR gRNA sequence
ttctaccaggaaccacagct

SEQ ID NO: 708384 - DNA, 20 bp, Artificial
  CRISPR gRNA sequence
aggaaccacagcttagaact

SEQ ID NO: 708385 - DNA, 20 bp, Artificial
  CRISPR gRNA sequence
ctgagtattcttcactcgct

SEQ ID NO: 708386 - DNA, 20 bp, Artificial
  CRISPR gRNA sequence
gagtattcttcactcgctaa

SEQ ID NO: 708387 - DNA, 20 bp, Artificial
  CRISPR gRNA sequence
catcaccactccctaatctc

SEQ ID NO: 708388 - DNA, 20 bp, Artificial
  CRISPR gRNA sequence
actccctaatctcaagtacc

SEQ ID NO: 708389 - DNA, 20 bp, Artificial
  CRISPR gRNA sequence
ctccctaatctcaagtaccc

SEQ ID NO: 708390 - DNA, 20 bp, Artificial
  CRISPR gRNA sequence
tccctaatctcaagtaccca

SEQ ID NO: 708391 - DNA, 20 bp, Artificial
  CRISPR gRNA sequence
acccagggacacaaacactg

SEQ ID NO: 708392 - DNA, 20 bp, Artificial
  CRISPR gRNA sequence
cagggacacaaacactgcgg

SEQ ID NO: 708393 - DNA, 20 bp, Artificial
  CRISPR gRNA sequence
agggacacaaacactgcgga

SEQ ID NO: 708394 - DNA, 20 bp, Artificial
  CRISPR gRNA sequence
gacacaaacactgcggaagg

SEQ ID NO: 708395 - DNA, 20 bp, Artificial
  CRISPR gRNA sequence
acaaacactgcggaaggcgg

SEQ ID NO: 708396 - DNA, 20 bp, Artificial
  CRISPR gRNA sequence
caaacactgcggaaggcggc

SEQ ID NO: 708397 - DNA, 20 bp, Artificial
  CRISPR gRNA sequence
aaacactgcggaaggcggca

SEQ ID NO: 708398 - DNA, 20 bp, Artificial
  CRISPR gRNA sequence
aggcggcagggccctctgcc

SEQ ID NO: 708399 - DNA, 20 bp, Artificial
  CRISPR gRNA sequence
ggcggcagggccctctgcct

SEQ ID NO: 708400 - DNA, 20 bp, Artificial
  CRISPR gRNA sequence
ggccctctgcctaggaaaac

SEQ ID NO: 708401 - DNA, 20 bp, Artificial
  CRISPR gRNA sequence
ccctctgcctaggaaaacca

SEQ ID NO: 708402 - DNA, 20 bp, Artificial
  CRISPR gRNA sequence
cctgccaaatccccctctct

SEQ ID NO: 708403 - DNA, 20 bp, Artificial
  CRISPR gRNA sequence
cccctctctgagaaacaccc

SEQ ID NO: 708404 - DNA, 20 bp, Artificial
  CRISPR gRNA sequence
aaaaaaaaaaaaaaaaaaaa

SEQ ID NO: 708405 - DNA, 20 bp, Artificial
  CRISPR gRNA sequence
aaaaaaaaaaaaaaagaact

SEQ ID NO: 708406 - DNA, 20 bp, Artificial
  CRISPR gRNA sequence
aaagaactgagtatttttca

SEQ ID NO: 708407 - DNA, 20 bp, Artificial
  CRISPR gRNA sequence
gaactgagtatttttcaaag

SEQ ID NO: 708408 - DNA, 20 bp, Artificial
  CRISPR gRNA sequence
atttttcaaagtggaaattc

SEQ ID NO: 708409 - DNA, 20 bp, Artificial
  CRISPR gRNA sequence
ttttcaaagtggaaattcta

SEQ ID NO: 708410 - DNA, 20 bp, Artificial
  CRISPR gRNA sequence
aaagtggaaattctagagtg

SEQ ID NO: 708411 - DNA, 20 bp, Artificial
  CRISPR gRNA sequence
tctagagtgtggtgtcactc

SEQ ID NO: 708412 - DNA, 20 bp, Artificial
  CRISPR gRNA sequence
gtgtggtgtcactccagaca

SEQ ID NO: 708413 - DNA, 20 bp, Artificial
  CRISPR gRNA sequence
caacatccacaactacctat

SEQ ID NO: 708414 - DNA, 20 bp, Artificial
  CRISPR gRNA sequence
catccacaactacctatcag

SEQ ID NO: 708415 - DNA, 20 bp, Artificial
  CRISPR gRNA sequence
atccacaactacctatcaga

SEQ ID NO: 708416 - DNA, 20 bp, Artificial
  CRISPR gRNA sequence
tccacaactacctatcagaa

SEQ ID NO: 708417 - DNA, 20 bp, Artificial
  CRISPR gRNA sequence
acctatcagaagggttaaac

SEQ ID NO: 708418 - DNA, 20 bp, Artificial
  CRISPR gRNA sequence
cctatcagaagggttaaacc

SEQ ID NO: 708419 - DNA, 20 bp, Artificial
  CRISPR gRNA sequence
aggtttgccattacttttaa

SEQ ID NO: 708420 - DNA, 20 bp, Artificial
  CRISPR gRNA sequence
ccattacttttaatggcaaa

SEQ ID NO: 708421 - DNA, 20 bp, Artificial
  CRISPR gRNA sequence
tactctttcataataatatg

SEQ ID NO: 708422 - DNA, 20 bp, Artificial
  CRISPR gRNA sequence
actctttcataataatatga

SEQ ID NO: 708423 - DNA, 20 bp, Artificial
  CRISPR gRNA sequence
cataataatatgaaggctaa

SEQ ID NO: 708424 - DNA, 20 bp, Artificial
  CRISPR gRNA sequence
cctttttttttttttttttt

SEQ ID NO: 708425 - DNA, 20 bp, Artificial
  CRISPR gRNA sequence
ttttttttttttttttcaga

SEQ ID NO: 708426 - DNA, 20 bp, Artificial
  CRISPR gRNA sequence
ttttttttttttttcagatg

SEQ ID NO: 708427 - DNA, 20 bp, Artificial
  CRISPR gRNA sequence
tggagtctcactctgttacc

SEQ ID NO: 708428 - DNA, 20 bp, Artificial
  CRISPR gRNA sequence
ggagtctcactctgttaccc

SEQ ID NO: 708429 - DNA, 20 bp, Artificial
  CRISPR gRNA sequence
tctcactctgttacccgggc

SEQ ID NO: 708430 - DNA, 20 bp, Artificial
  CRISPR gRNA sequence
ctcactctgttacccgggct

SEQ ID NO: 708431 - DNA, 20 bp, Artificial
  CRISPR gRNA sequence
cactctgttacccgggctgg

SEQ ID NO: 708432 - DNA, 20 bp, Artificial
  CRISPR gRNA sequence
ctctgttacccgggctggga

SEQ ID NO: 708433 - DNA, 20 bp, Artificial
  CRISPR gRNA sequence
tgttacccgggctgggagag

SEQ ID NO: 708434 - DNA, 20 bp, Artificial
  CRISPR gRNA sequence
tacccgggctgggagagcag

SEQ ID NO: 708435 - DNA, 20 bp, Artificial
  CRISPR gRNA sequence
ggagagcagtggtgcaatct

SEQ ID NO: 708436 - DNA, 20 bp, Artificial
  CRISPR gRNA sequence
tccctgcaacctctgtcccc

SEQ ID NO: 708437 - DNA, 20 bp, Artificial
  CRISPR gRNA sequence
ccctgcaacctctgtccccc

SEQ ID NO: 708438 - DNA, 20 bp, Artificial
  CRISPR gRNA sequence
aacctctgtcccccaggctc

SEQ ID NO: 708439 - DNA, 20 bp, Artificial
  CRISPR gRNA sequence
ctcaagcgattctcctgcct

SEQ ID NO: 708440 - DNA, 20 bp, Artificial
  CRISPR gRNA sequence
ttctcctgcctcagcctcct

SEQ ID NO: 708441 - DNA, 20 bp, Artificial
  CRISPR gRNA sequence
tcctgcctcagcctcctgag

SEQ ID NO: 708442 - DNA, 20 bp, Artificial
  CRISPR gRNA sequence
gcctcagcctcctgagtagc

SEQ ID NO: 708443 - DNA, 20 bp, Artificial
  CRISPR gRNA sequence
cctcagcctcctgagtagct

SEQ ID NO: 708444 - DNA, 20 bp, Artificial
  CRISPR gRNA sequence
ctcctgagtagctgggacta

SEQ ID NO: 708445 - DNA, 20 bp, Artificial
  CRISPR gRNA sequence
tcctgagtagctgggactac

SEQ ID NO: 708446 - DNA, 20 bp, Artificial
  CRISPR gRNA sequence
caggcgtgtgccactacacc

SEQ ID NO: 708447 - DNA, 20 bp, Artificial
  CRISPR gRNA sequence
ctacacctggatactttttg

SEQ ID NO: 708448 - DNA, 20 bp, Artificial
  CRISPR gRNA sequence
ctggatactttttgtagttt

SEQ ID NO: 708449 - DNA, 20 bp, Artificial
  CRISPR gRNA sequence
gatactttttgtagttttag

SEQ ID NO: 708450 - DNA, 20 bp, Artificial
  CRISPR gRNA sequence
tactttttgtagttttagta

SEQ ID NO: 708451 - DNA, 20 bp, Artificial
  CRISPR gRNA sequence
ttttgtagttttagtagaga

SEQ ID NO: 708452 - DNA, 20 bp, Artificial
  CRISPR gRNA sequence
tttgtagttttagtagagac

SEQ ID NO: 708453 - DNA, 20 bp, Artificial
  CRISPR gRNA sequence
ttgtagttttagtagagacg

SEQ ID NO: 708454 - DNA, 20 bp, Artificial
  CRISPR gRNA sequence
gagacggggtttcactatgt

SEQ ID NO: 708455 - DNA, 20 bp, Artificial
  CRISPR gRNA sequence
cggggtttcactatgttggc

SEQ ID NO: 708456 - DNA, 20 bp, Artificial
  CRISPR gRNA sequence
ggggtttcactatgttggca

SEQ ID NO: 708457 - DNA, 20 bp, Artificial
  CRISPR gRNA sequence
tttcactatgttggcaaggc

SEQ ID NO: 708458 - DNA, 20 bp, Artificial
  CRISPR gRNA sequence
tggtctcgaactcctgacct

SEQ ID NO: 708459 - DNA, 20 bp, Artificial
  CRISPR gRNA sequence
ggtctcgaactcctgacctc

SEQ ID NO: 708460 - DNA, 20 bp, Artificial
  CRISPR gRNA sequence
ctcaggtgatccgcctgcct

SEQ ID NO: 708461 - DNA, 20 bp, Artificial
  CRISPR gRNA sequence
gcctcagcctcccaaaatgc

SEQ ID NO: 708462 - DNA, 20 bp, Artificial
  CRISPR gRNA sequence
cctcagcctcccaaaatgct

SEQ ID NO: 708463 - DNA, 20 bp, Artificial
  CRISPR gRNA sequence
tcccaaaatgctgggatttt

SEQ ID NO: 708464 - DNA, 20 bp, Artificial
  CRISPR gRNA sequence
aatgctgggattttaagtgt

SEQ ID NO: 708465 - DNA, 20 bp, Artificial
  CRISPR gRNA sequence
taagtgtgagccatcatatc

SEQ ID NO: 708466 - DNA, 20 bp, Artificial
  CRISPR gRNA sequence
gagccatcatatccggccaa

SEQ ID NO: 708467 - DNA, 20 bp, Artificial
  CRISPR gRNA sequence
aaaagactgcattttaaaac

SEQ ID NO: 708468 - DNA, 20 bp, Artificial
  CRISPR gRNA sequence
acaagttactattaatgcat

SEQ ID NO: 708469 - DNA, 20 bp, Artificial
  CRISPR gRNA sequence
tattaatgcattggcctatg

SEQ ID NO: 708470 - DNA, 20 bp, Artificial
  CRISPR gRNA sequence
acctctttcatgaaatttct

SEQ ID NO: 708471 - DNA, 20 bp, Artificial
  CRISPR gRNA sequence
gaaatttctcagtattgtaa

SEQ ID NO: 708472 - DNA, 20 bp, Artificial
  CRISPR gRNA sequence
aacagccacttgtcacatcc

SEQ ID NO: 708473 - DNA, 20 bp, Artificial
  CRISPR gRNA sequence
cccataatttgaaactgaac

SEQ ID NO: 708474 - DNA, 20 bp, Artificial
  CRISPR gRNA sequence
ttgaaactgaactagcatta

SEQ ID NO: 708475 - DNA, 20 bp, Artificial
  CRISPR gRNA sequence
tatattatattgaaaaatga

SEQ ID NO: 708476 - DNA, 20 bp, Artificial
  CRISPR gRNA sequence
atattatattgaaaaatgaa

SEQ ID NO: 708477 - DNA, 20 bp, Artificial
  CRISPR gRNA sequence
tatattgaaaaatgaaagga

SEQ ID NO: 708478 - DNA, 20 bp, Artificial
  CRISPR gRNA sequence
tgtatgaatgcttgaattaa

SEQ ID NO: 708479 - DNA, 20 bp, Artificial
  CRISPR gRNA sequence
tgaatgcttgaattaaaaga

SEQ ID NO: 708480 - DNA, 20 bp, Artificial
  CRISPR gRNA sequence
cttgaattaaaagaaagtaa

SEQ ID NO: 708481 - DNA, 20 bp, Artificial
  CRISPR gRNA sequence
gaattaaaagaaagtaatgg

SEQ ID NO: 708482 - DNA, 20 bp, Artificial
  CRISPR gRNA sequence
gaaagtaatggaagaactga

SEQ ID NO: 708483 - DNA, 20 bp, Artificial
  CRISPR gRNA sequence
gtaatggaagaactgacaga

SEQ ID NO: 708484 - DNA, 20 bp, Artificial
  CRISPR gRNA sequence
taatggaagaactgacagat

SEQ ID NO: 708485 - DNA, 20 bp, Artificial
  CRISPR gRNA sequence
aatggaagaactgacagatg

SEQ ID NO: 708486 - DNA, 20 bp, Artificial
  CRISPR gRNA sequence
cagatggggaaaaaaaaaaa

SEQ ID NO: 708487 - DNA, 20 bp, Artificial
  CRISPR gRNA sequence
agatggggaaaaaaaaaaaa

SEQ ID NO: 708488 - DNA, 20 bp, Artificial
  CRISPR gRNA sequence
gggaaaaaaaaaaaaaggaa

SEQ ID NO: 708489 - DNA, 20 bp, Artificial
  CRISPR gRNA sequence
aaaaaaaaaggaatggacca

SEQ ID NO: 708490 - DNA, 20 bp, Artificial
  CRISPR gRNA sequence
tagccacctgctctgtcatc

SEQ ID NO: 708491 - DNA, 20 bp, Artificial
  CRISPR gRNA sequence
acctgctctgtcatccagct

SEQ ID NO: 708492 - DNA, 20 bp, Artificial
  CRISPR gRNA sequence
ctgctctgtcatccagcttg

SEQ ID NO: 708493 - DNA, 20 bp, Artificial
  CRISPR gRNA sequence
tgctctgtcatccagcttgg

SEQ ID NO: 708494 - DNA, 20 bp, Artificial
  CRISPR gRNA sequence
tgtcatccagcttggaggat

SEQ ID NO: 708495 - DNA, 20 bp, Artificial
  CRISPR gRNA sequence
agcttggaggatgagattca

SEQ ID NO: 708496 - DNA, 20 bp, Artificial
  CRISPR gRNA sequence
ttggaggatgagattcatgg

SEQ ID NO: 708497 - DNA, 20 bp, Artificial
  CRISPR gRNA sequence
ggaggatgagattcatggaa

SEQ ID NO: 708498 - DNA, 20 bp, Artificial
  CRISPR gRNA sequence
atgagattcatggaagagta

SEQ ID NO: 708499 - DNA, 20 bp, Artificial
  CRISPR gRNA sequence
attcatggaagagtaaagaa

SEQ ID NO: 708500 - DNA, 20 bp, Artificial
  CRISPR gRNA sequence
ttcatggaagagtaaagaaa

SEQ ID NO: 708501 - DNA, 20 bp, Artificial
  CRISPR gRNA sequence
tcatggaagagtaaagaaaa

SEQ ID NO: 708502 - DNA, 20 bp, Artificial
  CRISPR gRNA sequence
catggaagagtaaagaaaag

SEQ ID NO: 708503 - DNA, 20 bp, Artificial
  CRISPR gRNA sequence
agaaaaggggaaaatgaaca

SEQ ID NO: 708504 - DNA, 20 bp, Artificial
  CRISPR gRNA sequence
aacacagtcttcctcctgac

SEQ ID NO: 708505 - DNA, 20 bp, Artificial
  CRISPR gRNA sequence
gtcttcctcctgaccagacc

SEQ ID NO: 708506 - DNA, 20 bp, Artificial
  CRISPR gRNA sequence
tgaccagacctggtacccaa

SEQ ID NO: 708507 - DNA, 20 bp, Artificial
  CRISPR gRNA sequence
ccagacctggtacccaaaag

SEQ ID NO: 708508 - DNA, 20 bp, Artificial
  CRISPR gRNA sequence
caaaccaaatccactgtgtg

SEQ ID NO: 708509 - DNA, 20 bp, Artificial
  CRISPR gRNA sequence
aaaccaaatccactgtgtgc

SEQ ID NO: 708510 - DNA, 20 bp, Artificial
  CRISPR gRNA sequence
ccactgtgtgcaggcccttc

SEQ ID NO: 708511 - DNA, 20 bp, Artificial
  CRISPR gRNA sequence
caggcccttctggaaattcc

SEQ ID NO: 708512 - DNA, 20 bp, Artificial
  CRISPR gRNA sequence
gcccttctggaaattcccgg

SEQ ID NO: 708513 - DNA, 20 bp, Artificial
  CRISPR gRNA sequence
cccttctggaaattcccggc

SEQ ID NO: 708514 - DNA, 20 bp, Artificial
  CRISPR gRNA sequence
ctggaaattcccggcaggct

SEQ ID NO: 708515 - DNA, 20 bp, Artificial
  CRISPR gRNA sequence
aaattcccggcaggctgagc

SEQ ID NO: 708516 - DNA, 20 bp, Artificial
  CRISPR gRNA sequence
aattcccggcaggctgagcc

SEQ ID NO: 708517 - DNA, 20 bp, Artificial
  CRISPR gRNA sequence
ttcccggcaggctgagccag

SEQ ID NO: 708518 - DNA, 20 bp, Artificial
  CRISPR gRNA sequence
cggcaggctgagccaggagc

SEQ ID NO: 708519 - DNA, 20 bp, Artificial
  CRISPR gRNA sequence
gcaggctgagccaggagctg

SEQ ID NO: 708520 - DNA, 20 bp, Artificial
  CRISPR gRNA sequence
caggctgagccaggagctgg

SEQ ID NO: 708521 - DNA, 20 bp, Artificial
  CRISPR gRNA sequence
caggagctggaggctgctat

SEQ ID NO: 708522 - DNA, 20 bp, Artificial
  CRISPR gRNA sequence
aggagctggaggctgctatg

SEQ ID NO: 708523 - DNA, 20 bp, Artificial
  CRISPR gRNA sequence
ggagctggaggctgctatga

SEQ ID NO: 708524 - DNA, 20 bp, Artificial
  CRISPR gRNA sequence
gctggaggctgctatgaggg

SEQ ID NO: 708525 - DNA, 20 bp, Artificial
  CRISPR gRNA sequence
ctggaggctgctatgagggt

SEQ ID NO: 708526 - DNA, 20 bp, Artificial
  CRISPR gRNA sequence
tggaggctgctatgagggtg

SEQ ID NO: 708527 - DNA, 20 bp, Artificial
  CRISPR gRNA sequence
agggtggggctctccatcct

SEQ ID NO: 708528 - DNA, 20 bp, Artificial
  CRISPR gRNA sequence
ggggctctccatccttagcc

SEQ ID NO: 708529 - DNA, 20 bp, Artificial
  CRISPR gRNA sequence
gggctctccatccttagcca

SEQ ID NO: 708530 - DNA, 20 bp, Artificial
  CRISPR gRNA sequence
ctccatccttagccaaggcc

SEQ ID NO: 708531 - DNA, 20 bp, Artificial
  CRISPR gRNA sequence
tccttagccaaggcctggct

SEQ ID NO: 708532 - DNA, 20 bp, Artificial
  CRISPR gRNA sequence
ccttagccaaggcctggctg

SEQ ID NO: 708533 - DNA, 20 bp, Artificial
  CRISPR gRNA sequence
ccaaggcctggctgaggccc

SEQ ID NO: 708534 - DNA, 20 bp, Artificial
  CRISPR gRNA sequence
caaggcctggctgaggcccc

SEQ ID NO: 708535 - DNA, 20 bp, Artificial
  CRISPR gRNA sequence
gcctggctgaggccccaggc

SEQ ID NO: 708536 - DNA, 20 bp, Artificial
  CRISPR gRNA sequence
cctggctgaggccccaggcg

SEQ ID NO: 708537 - DNA, 20 bp, Artificial
  CRISPR gRNA sequence
ccaggcgaggcctctgtgca

SEQ ID NO: 708538 - DNA, 20 bp, Artificial
  CRISPR gRNA sequence
aggcgaggcctctgtgcaca

SEQ ID NO: 708539 - DNA, 20 bp, Artificial
  CRISPR gRNA sequence
ggcgaggcctctgtgcacag

SEQ ID NO: 708540 - DNA, 20 bp, Artificial
  CRISPR gRNA sequence
tctgtgcacagaggtccctg

SEQ ID NO: 708541 - DNA, 20 bp, Artificial
  CRISPR gRNA sequence
gtgcacagaggtccctgtgg

SEQ ID NO: 708542 - DNA, 20 bp, Artificial
  CRISPR gRNA sequence
tgcacagaggtccctgtggt

SEQ ID NO: 708543 - DNA, 20 bp, Artificial
  CRISPR gRNA sequence
cagaggtccctgtggtgggt

SEQ ID NO: 708544 - DNA, 20 bp, Artificial
  CRISPR gRNA sequence
tccctgtggtgggtcagact

SEQ ID NO: 708545 - DNA, 20 bp, Artificial
  CRISPR gRNA sequence
tcagactcagcctgaacttg

SEQ ID NO: 708546 - DNA, 20 bp, Artificial
  CRISPR gRNA sequence
cagactcagcctgaacttgc

SEQ ID NO: 708547 - DNA, 20 bp, Artificial
  CRISPR gRNA sequence
ctcagcctgaacttgcagga

SEQ ID NO: 708548 - DNA, 20 bp, Artificial
  CRISPR gRNA sequence
tcagcctgaacttgcaggac

SEQ ID NO: 708549 - DNA, 20 bp, Artificial
  CRISPR gRNA sequence
tgcaggacgggcctgcaccc

SEQ ID NO: 708550 - DNA, 20 bp, Artificial
  CRISPR gRNA sequence
gcaggacgggcctgcaccct

SEQ ID NO: 708551 - DNA, 20 bp, Artificial
  CRISPR gRNA sequence
ggcctgcaccctgggcactg

SEQ ID NO: 708552 - DNA, 20 bp, Artificial
  CRISPR gRNA sequence
gcctgcaccctgggcactgt

SEQ ID NO: 708553 - DNA, 20 bp, Artificial
  CRISPR gRNA sequence
ctgcaccctgggcactgtgg

SEQ ID NO: 708554 - DNA, 20 bp, Artificial
  CRISPR gRNA sequence
tgcaccctgggcactgtggg

SEQ ID NO: 708555 - DNA, 20 bp, Artificial
  CRISPR gRNA sequence
gcaccctgggcactgtggga

SEQ ID NO: 708556 - DNA, 20 bp, Artificial
  CRISPR gRNA sequence
caccctgggcactgtgggag

SEQ ID NO: 708557 - DNA, 20 bp, Artificial
  CRISPR gRNA sequence
tgggcactgtgggaggggaa

SEQ ID NO: 708558 - DNA, 20 bp, Artificial
  CRISPR gRNA sequence
cactgtgggaggggaatggc

SEQ ID NO: 708559 - DNA, 20 bp, Artificial
  CRISPR gRNA sequence
cccctccctctcccttcccc

SEQ ID NO: 708560 - DNA, 20 bp, Artificial
  CRISPR gRNA sequence
ctccctctcccttcccccag

SEQ ID NO: 708561 - DNA, 20 bp, Artificial
  CRISPR gRNA sequence
cccagcagctctcaaaactt

SEQ ID NO: 708562 - DNA, 20 bp, Artificial
  CRISPR gRNA sequence
tctcaaaacttcagatctgt

SEQ ID NO: 708563 - DNA, 20 bp, Artificial
  CRISPR gRNA sequence
ctcaaaacttcagatctgtt

SEQ ID NO: 708564 - DNA, 20 bp, Artificial
  CRISPR gRNA sequence
tcaaaacttcagatctgtta

SEQ ID NO: 708565 - DNA, 20 bp, Artificial
  CRISPR gRNA sequence
aaacttcagatctgttaggg

SEQ ID NO: 708566 - DNA, 20 bp, Artificial
  CRISPR gRNA sequence
aacttcagatctgttaggga

SEQ ID NO: 708567 - DNA, 20 bp, Artificial
  CRISPR gRNA sequence
cttcagatctgttagggaag

SEQ ID NO: 708568 - DNA, 20 bp, Artificial
  CRISPR gRNA sequence
agatctgttagggaaggagt

SEQ ID NO: 708569 - DNA, 20 bp, Artificial
  CRISPR gRNA sequence
gttagggaaggagtcagatt

SEQ ID NO: 708570 - DNA, 20 bp, Artificial
  CRISPR gRNA sequence
ttagggaaggagtcagattt

SEQ ID NO: 708571 - DNA, 20 bp, Artificial
  CRISPR gRNA sequence
tagggaaggagtcagattta

SEQ ID NO: 708572 - DNA, 20 bp, Artificial
  CRISPR gRNA sequence
agggaaggagtcagatttag

SEQ ID NO: 708573 - DNA, 20 bp, Artificial
  CRISPR gRNA sequence
gagtcagatttaggggcacg

SEQ ID NO: 708574 - DNA, 20 bp, Artificial
  CRISPR gRNA sequence
agatttaggggcacgaagct

SEQ ID NO: 708575 - DNA, 20 bp, Artificial
  CRISPR gRNA sequence
gatttaggggcacgaagctg

SEQ ID NO: 708576 - DNA, 20 bp, Artificial
  CRISPR gRNA sequence
ttaggggcacgaagctgagg

SEQ ID NO: 708577 - DNA, 20 bp, Artificial
  CRISPR gRNA sequence
taggggcacgaagctgaggt

SEQ ID NO: 708578 - DNA, 20 bp, Artificial
  CRISPR gRNA sequence
aggggcacgaagctgaggtg

SEQ ID NO: 708579 - DNA, 20 bp, Artificial
  CRISPR gRNA sequence
ggggcacgaagctgaggtgg

SEQ ID NO: 708580 - DNA, 20 bp, Artificial
  CRISPR gRNA sequence
cacgaagctgaggtgggggc

SEQ ID NO: 708581 - DNA, 20 bp, Artificial
  CRISPR gRNA sequence
acgaagctgaggtgggggca

SEQ ID NO: 708582 - DNA, 20 bp, Artificial
  CRISPR gRNA sequence
cgaagctgaggtgggggcaa

SEQ ID NO: 708583 - DNA, 20 bp, Artificial
  CRISPR gRNA sequence
aagctgaggtgggggcaagg

SEQ ID NO: 708584 - DNA, 20 bp, Artificial
  CRISPR gRNA sequence
agctgaggtgggggcaaggg

SEQ ID NO: 708585 - DNA, 20 bp, Artificial
  CRISPR gRNA sequence
gctgaggtgggggcaaggga

SEQ ID NO: 708586 - DNA, 20 bp, Artificial
  CRISPR gRNA sequence
ctgaggtgggggcaagggag

SEQ ID NO: 708587 - DNA, 20 bp, Artificial
  CRISPR gRNA sequence
agggaggggtacttaccgtt

SEQ ID NO: 708588 - DNA, 20 bp, Artificial
  CRISPR gRNA sequence
acttaccgttgagctcctcc

SEQ ID NO: 708589 - DNA, 20 bp, Artificial
  CRISPR gRNA sequence
cttaccgttgagctcctcct

SEQ ID NO: 708590 - DNA, 20 bp, Artificial
  CRISPR gRNA sequence
cgttgagctcctcctgggtc

SEQ ID NO: 708591 - DNA, 20 bp, Artificial
  CRISPR gRNA sequence
ctgggtctggaatctgcaaa

SEQ ID NO: 708592 - DNA, 20 bp, Artificial
  CRISPR gRNA sequence
gtctggaatctgcaaaaagc

SEQ ID NO: 708593 - DNA, 20 bp, Artificial
  CRISPR gRNA sequence
ctggaatctgcaaaaagcaa

SEQ ID NO: 708594 - DNA, 20 bp, Artificial
  CRISPR gRNA sequence
gaatctgcaaaaagcaagag

SEQ ID NO: 708595 - DNA, 20 bp, Artificial
  CRISPR gRNA sequence
gcaagagcagcaacttcacc

SEQ ID NO: 708596 - DNA, 20 bp, Artificial
  CRISPR gRNA sequence
caagagcagcaacttcacca

SEQ ID NO: 708597 - DNA, 20 bp, Artificial
  CRISPR gRNA sequence
agagcagcaacttcaccaag

SEQ ID NO: 708598 - DNA, 20 bp, Artificial
  CRISPR gRNA sequence
agcaacttcaccaaggagtc

SEQ ID NO: 708599 - DNA, 20 bp, Artificial
  CRISPR gRNA sequence
aacttcaccaaggagtctgg

SEQ ID NO: 708600 - DNA, 20 bp, Artificial
  CRISPR gRNA sequence
ccaaggagtctggcagcccc

SEQ ID NO: 708601 - DNA, 20 bp, Artificial
  CRISPR gRNA sequence
gccccacccgccccaactat

SEQ ID NO: 708602 - DNA, 20 bp, Artificial
  CRISPR gRNA sequence
ccgccccaactattggcaaa

SEQ ID NO: 708603 - DNA, 20 bp, Artificial
  CRISPR gRNA sequence
ctattggcaaatggtcctcc

SEQ ID NO: 708604 - DNA, 20 bp, Artificial
  CRISPR gRNA sequence
caaatggtcctcctggatca

SEQ ID NO: 708605 - DNA, 20 bp, Artificial
  CRISPR gRNA sequence
aaatggtcctcctggatcac

SEQ ID NO: 708606 - DNA, 20 bp, Artificial
  CRISPR gRNA sequence
tggtcctcctggatcacagg

SEQ ID NO: 708607 - DNA, 20 bp, Artificial
  CRISPR gRNA sequence
atcacaggtggtgctgaact

SEQ ID NO: 708608 - DNA, 20 bp, Artificial
  CRISPR gRNA sequence
aggtggtgctgaactcagcc

SEQ ID NO: 708609 - DNA, 20 bp, Artificial
  CRISPR gRNA sequence
ggtggtgctgaactcagccc

SEQ ID NO: 708610 - DNA, 20 bp, Artificial
  CRISPR gRNA sequence
gtggtgctgaactcagccca

SEQ ID NO: 708611 - DNA, 20 bp, Artificial
  CRISPR gRNA sequence
tggtgctgaactcagcccag

SEQ ID NO: 708612 - DNA, 20 bp, Artificial
  CRISPR gRNA sequence
gctgaactcagcccaggggt

SEQ ID NO: 708613 - DNA, 20 bp, Artificial
  CRISPR gRNA sequence
ctgaactcagcccaggggtc

SEQ ID NO: 708614 - DNA, 20 bp, Artificial
  CRISPR gRNA sequence
cagcccaggggtcaggtcct

SEQ ID NO: 708615 - DNA, 20 bp, Artificial
  CRISPR gRNA sequence
caggggtcaggtcctcagtc

SEQ ID NO: 708616 - DNA, 20 bp, Artificial
  CRISPR gRNA sequence
ggggtcaggtcctcagtctg

SEQ ID NO: 708617 - DNA, 20 bp, Artificial
  CRISPR gRNA sequence
ggtcaggtcctcagtctgga

SEQ ID NO: 708618 - DNA, 20 bp, Artificial
  CRISPR gRNA sequence
tcagtctggagagccctcga

SEQ ID NO: 708619 - DNA, 20 bp, Artificial
  CRISPR gRNA sequence
cagtctggagagccctcgat

SEQ ID NO: 708620 - DNA, 20 bp, Artificial
  CRISPR gRNA sequence
ggagagccctcgatgggttt

SEQ ID NO: 708621 - DNA, 20 bp, Artificial
  CRISPR gRNA sequence
agagccctcgatgggtttca

SEQ ID NO: 708622 - DNA, 20 bp, Artificial
  CRISPR gRNA sequence
ccctcgatgggtttcagagt

SEQ ID NO: 708623 - DNA, 20 bp, Artificial
  CRISPR gRNA sequence
ttcagagtcagtgcccaccc

SEQ ID NO: 708624 - DNA, 20 bp, Artificial
  CRISPR gRNA sequence
gtcagtgcccaccccagctc

SEQ ID NO: 708625 - DNA, 20 bp, Artificial
  CRISPR gRNA sequence
tcagtgcccaccccagctca

SEQ ID NO: 708626 - DNA, 20 bp, Artificial
  CRISPR gRNA sequence
tgcccaccccagctcaaggc

SEQ ID NO: 708627 - DNA, 20 bp, Artificial
  CRISPR gRNA sequence
gcccaccccagctcaaggca

SEQ ID NO: 708628 - DNA, 20 bp, Artificial
  CRISPR gRNA sequence
ccaccccagctcaaggcaag

SEQ ID NO: 708629 - DNA, 20 bp, Artificial
  CRISPR gRNA sequence
caccccagctcaaggcaagg

SEQ ID NO: 708630 - DNA, 20 bp, Artificial
  CRISPR gRNA sequence
ggcaaggaggctcacttctc

SEQ ID NO: 708631 - DNA, 20 bp, Artificial
  CRISPR gRNA sequence
aaggaggctcacttctccag

SEQ ID NO: 708632 - DNA, 20 bp, Artificial
  CRISPR gRNA sequence
gaggctcacttctccagtgg

SEQ ID NO: 708633 - DNA, 20 bp, Artificial
  CRISPR gRNA sequence
ctcacttctccagtggcaga

SEQ ID NO: 708634 - DNA, 20 bp, Artificial
  CRISPR gRNA sequence
cacttctccagtggcagatg

SEQ ID NO: 708635 - DNA, 20 bp, Artificial
  CRISPR gRNA sequence
acttctccagtggcagatgg

SEQ ID NO: 708636 - DNA, 20 bp, Artificial
  CRISPR gRNA sequence
ctccagtggcagatggagga

SEQ ID NO: 708637 - DNA, 20 bp, Artificial
  CRISPR gRNA sequence
tccagtggcagatggaggac

SEQ ID NO: 708638 - DNA, 20 bp, Artificial
  CRISPR gRNA sequence
ccagtggcagatggaggaca

SEQ ID NO: 708639 - DNA, 20 bp, Artificial
  CRISPR gRNA sequence
cagtggcagatggaggacag

SEQ ID NO: 708640 - DNA, 20 bp, Artificial
  CRISPR gRNA sequence
aggggaccacctctatcccc

SEQ ID NO: 708641 - DNA, 20 bp, Artificial
  CRISPR gRNA sequence
cctttttttttttttttttt

SEQ ID NO: 708642 - DNA, 20 bp, Artificial
  CRISPR gRNA sequence
ttttttttttttttttgaga

SEQ ID NO: 708643 - DNA, 20 bp, Artificial
  CRISPR gRNA sequence
ttttttttttttttgagatg

SEQ ID NO: 708644 - DNA, 20 bp, Artificial
  CRISPR gRNA sequence
tggagtctcactctgtcacc

SEQ ID NO: 708645 - DNA, 20 bp, Artificial
  CRISPR gRNA sequence
ggagtctcactctgtcaccc

SEQ ID NO: 708646 - DNA, 20 bp, Artificial
  CRISPR gRNA sequence
tctcactctgtcacccaggc

SEQ ID NO: 708647 - DNA, 20 bp, Artificial
  CRISPR gRNA sequence
tcactctgtcacccaggcta

SEQ ID NO: 708648 - DNA, 20 bp, Artificial
  CRISPR gRNA sequence
ctgtcacccaggctagagtg

SEQ ID NO: 708649 - DNA, 20 bp, Artificial
  CRISPR gRNA sequence
tcacccaggctagagtgcag

SEQ ID NO: 708650 - DNA, 20 bp, Artificial
  CRISPR gRNA sequence
agagtgcagtggcatgatct

SEQ ID NO: 708651 - DNA, 20 bp, Artificial
  CRISPR gRNA sequence
tcaatgtaacctccgcctcc

SEQ ID NO: 708652 - DNA, 20 bp, Artificial
  CRISPR gRNA sequence
caatgtaacctccgcctcct

SEQ ID NO: 708653 - DNA, 20 bp, Artificial
  CRISPR gRNA sequence
aacctccgcctcctgggttc

SEQ ID NO: 708654 - DNA, 20 bp, Artificial
  CRISPR gRNA sequence
ttcaagtgattctcatgcct

SEQ ID NO: 708655 - DNA, 20 bp, Artificial
  CRISPR gRNA sequence
tcatgcctcagcctcccgaa

SEQ ID NO: 708656 - DNA, 20 bp, Artificial
  CRISPR gRNA sequence
gcctcagcctcccgaatagc

SEQ ID NO: 708657 - DNA, 20 bp, Artificial
  CRISPR gRNA sequence
cctcagcctcccgaatagct

SEQ ID NO: 708658 - DNA, 20 bp, Artificial
  CRISPR gRNA sequence
ctcccgaatagctgggatta

SEQ ID NO: 708659 - DNA, 20 bp, Artificial
  CRISPR gRNA sequence
tcccgaatagctgggattat

SEQ ID NO: 708660 - DNA, 20 bp, Artificial
  CRISPR gRNA sequence
taggctcgtgccaccaaccc

SEQ ID NO: 708661 - DNA, 20 bp, Artificial
  CRISPR gRNA sequence
agctaatttttttgtatttt

SEQ ID NO: 708662 - DNA, 20 bp, Artificial
  CRISPR gRNA sequence
taatttttttgtattttcag

SEQ ID NO: 708663 - DNA, 20 bp, Artificial
  CRISPR gRNA sequence
atttttttgtattttcagta

SEQ ID NO: 708664 - DNA, 20 bp, Artificial
  CRISPR gRNA sequence
ttttgtattttcagtagaga

SEQ ID NO: 708665 - DNA, 20 bp, Artificial
  CRISPR gRNA sequence
tttgtattttcagtagagac

SEQ ID NO: 708666 - DNA, 20 bp, Artificial
  CRISPR gRNA sequence
ttgtattttcagtagagacg

SEQ ID NO: 708667 - DNA, 20 bp, Artificial
  CRISPR gRNA sequence
gagacggggtttcaccacgt

SEQ ID NO: 708668 - DNA, 20 bp, Artificial
  CRISPR gRNA sequence
cggggtttcaccacgttggc

SEQ ID NO: 708669 - DNA, 20 bp, Artificial
  CRISPR gRNA sequence
ggggtttcaccacgttggcc

SEQ ID NO: 708670 - DNA, 20 bp, Artificial
  CRISPR gRNA sequence
tttcaccacgttggccaggc

SEQ ID NO: 708671 - DNA, 20 bp, Artificial
  CRISPR gRNA sequence
acctcctgacctgcccgcct

SEQ ID NO: 708672 - DNA, 20 bp, Artificial
  CRISPR gRNA sequence
ctgcccgccttggccttgca

SEQ ID NO: 708673 - DNA, 20 bp, Artificial
  CRISPR gRNA sequence
gccttggccttgcaaagtgc

SEQ ID NO: 708674 - DNA, 20 bp, Artificial
  CRISPR gRNA sequence
ccttggccttgcaaagtgct

SEQ ID NO: 708675 - DNA, 20 bp, Artificial
  CRISPR gRNA sequence
cttgcaaagtgctgggatta

SEQ ID NO: 708676 - DNA, 20 bp, Artificial
  CRISPR gRNA sequence
ttgcaaagtgctgggattac

SEQ ID NO: 708677 - DNA, 20 bp, Artificial
  CRISPR gRNA sequence
agtgctgggattacaggcgt

SEQ ID NO: 708678 - DNA, 20 bp, Artificial
  CRISPR gRNA sequence
caggcgtgagccaccacacc

SEQ ID NO: 708679 - DNA, 20 bp, Artificial
  CRISPR gRNA sequence
ccccacccccgcgcacatgc

SEQ ID NO: 708680 - DNA, 20 bp, Artificial
  CRISPR gRNA sequence
cccacccccgcgcacatgca

SEQ ID NO: 708681 - DNA, 20 bp, Artificial
  CRISPR gRNA sequence
ccccgcgcacatgcaaggat

SEQ ID NO: 708682 - DNA, 20 bp, Artificial
  CRISPR gRNA sequence
acatgcaaggattggttcac

SEQ ID NO: 708683 - DNA, 20 bp, Artificial
  CRISPR gRNA sequence
tgcaaggattggttcacgag

SEQ ID NO: 708684 - DNA, 20 bp, Artificial
  CRISPR gRNA sequence
ggattggttcacgagaagca

SEQ ID NO: 708685 - DNA, 20 bp, Artificial
  CRISPR gRNA sequence
gattggttcacgagaagcac

SEQ ID NO: 708686 - DNA, 20 bp, Artificial
  CRISPR gRNA sequence
acgagaagcacaggcccaac

SEQ ID NO: 708687 - DNA, 20 bp, Artificial
  CRISPR gRNA sequence
gagaagcacaggcccaacca

SEQ ID NO: 708688 - DNA, 20 bp, Artificial
  CRISPR gRNA sequence
gcacaggcccaaccagagcc

SEQ ID NO: 708689 - DNA, 20 bp, Artificial
  CRISPR gRNA sequence
cacaggcccaaccagagccc

SEQ ID NO: 708690 - DNA, 20 bp, Artificial
  CRISPR gRNA sequence
caggcccaaccagagcccag

SEQ ID NO: 708691 - DNA, 20 bp, Artificial
  CRISPR gRNA sequence
aggcccaaccagagcccagg

SEQ ID NO: 708692 - DNA, 20 bp, Artificial
  CRISPR gRNA sequence
agagcccaggaggcttccac

SEQ ID NO: 708693 - DNA, 20 bp, Artificial
  CRISPR gRNA sequence
gagcccaggaggcttccact

SEQ ID NO: 708694 - DNA, 20 bp, Artificial
  CRISPR gRNA sequence
ccaggaggcttccactgggt

SEQ ID NO: 708695 - DNA, 20 bp, Artificial
  CRISPR gRNA sequence
aggaggcttccactgggtca

SEQ ID NO: 708696 - DNA, 20 bp, Artificial
  CRISPR gRNA sequence
ggaggcttccactgggtcag

SEQ ID NO: 708697 - DNA, 20 bp, Artificial
  CRISPR gRNA sequence
ctgggtcagaggctcgtctg

SEQ ID NO: 708698 - DNA, 20 bp, Artificial
  CRISPR gRNA sequence
tgcgcccaccttactgtctc

SEQ ID NO: 708699 - DNA, 20 bp, Artificial
  CRISPR gRNA sequence
gcgcccaccttactgtctcc

SEQ ID NO: 708700 - DNA, 20 bp, Artificial
  CRISPR gRNA sequence
cgcccaccttactgtctcca

SEQ ID NO: 708701 - DNA, 20 bp, Artificial
  CRISPR gRNA sequence
accttactgtctccagggtg

SEQ ID NO: 708702 - DNA, 20 bp, Artificial
  CRISPR gRNA sequence
cttactgtctccagggtgtg

SEQ ID NO: 708703 - DNA, 20 bp, Artificial
  CRISPR gRNA sequence
tactgtctccagggtgtgga

SEQ ID NO: 708704 - DNA, 20 bp, Artificial
  CRISPR gRNA sequence
gtggagagccccgaattctc

SEQ ID NO: 708705 - DNA, 20 bp, Artificial
  CRISPR gRNA sequence
ccccgaattctctggaatac

SEQ ID NO: 708706 - DNA, 20 bp, Artificial
  CRISPR gRNA sequence
cccgaattctctggaatacc

SEQ ID NO: 708707 - DNA, 20 bp, Artificial
  CRISPR gRNA sequence
aataccaggcaaaacccaca

SEQ ID NO: 708708 - DNA, 20 bp, Artificial
  CRISPR gRNA sequence
taccaggcaaaacccacatg

SEQ ID NO: 708709 - DNA, 20 bp, Artificial
  CRISPR gRNA sequence
accaggcaaaacccacatgg

SEQ ID NO: 708710 - DNA, 20 bp, Artificial
  CRISPR gRNA sequence
aaacccacatggaggacctc

SEQ ID NO: 708711 - DNA, 20 bp, Artificial
  CRISPR gRNA sequence
aacccacatggaggacctca

SEQ ID NO: 708712 - DNA, 20 bp, Artificial
  CRISPR gRNA sequence
ccacatggaggacctcaagg

SEQ ID NO: 708713 - DNA, 20 bp, Artificial
  CRISPR gRNA sequence
cacatggaggacctcaaggc

SEQ ID NO: 708714 - DNA, 20 bp, Artificial
  CRISPR gRNA sequence
gaggacctcaaggcaggtca

SEQ ID NO: 708715 - DNA, 20 bp, Artificial
  CRISPR gRNA sequence
ggacctcaaggcaggtcatg

SEQ ID NO: 708716 - DNA, 20 bp, Artificial
  CRISPR gRNA sequence
ctcaaggcaggtcatggaga

SEQ ID NO: 708717 - DNA, 20 bp, Artificial
  CRISPR gRNA sequence
tcaaggcaggtcatggagac

SEQ ID NO: 708718 - DNA, 20 bp, Artificial
  CRISPR gRNA sequence
aggtcatggagacaggatga

SEQ ID NO: 708719 - DNA, 20 bp, Artificial
  CRISPR gRNA sequence
agacaggatgatggatcctg

SEQ ID NO: 708720 - DNA, 20 bp, Artificial
  CRISPR gRNA sequence
tggatcctgcagatgccacc

SEQ ID NO: 708721 - DNA, 20 bp, Artificial
  CRISPR gRNA sequence
gatgccacctggaccctgcc

SEQ ID NO: 708722 - DNA, 20 bp, Artificial
  CRISPR gRNA sequence
atgccacctggaccctgcct

SEQ ID NO: 708723 - DNA, 20 bp, Artificial
  CRISPR gRNA sequence
ccctgcctgggacacgcccg

SEQ ID NO: 708724 - DNA, 20 bp, Artificial
  CRISPR gRNA sequence
gcctgggacacgcccgaagc

SEQ ID NO: 708725 - DNA, 20 bp, Artificial
  CRISPR gRNA sequence
cgcccgaagccagtctgctg

SEQ ID NO: 708726 - DNA, 20 bp, Artificial
  CRISPR gRNA sequence
cccgaagccagtctgctgtg

SEQ ID NO: 708727 - DNA, 20 bp, Artificial
  CRISPR gRNA sequence
ctgtggagcccttctgactc

SEQ ID NO: 708728 - DNA, 20 bp, Artificial
  CRISPR gRNA sequence
ggagcccttctgactccagc

SEQ ID NO: 708729 - DNA, 20 bp, Artificial
  CRISPR gRNA sequence
tttctctttcttgtgcctga

SEQ ID NO: 708730 - DNA, 20 bp, Artificial
  CRISPR gRNA sequence
ttcttgtgcctgaaagcacc

SEQ ID NO: 708731 - DNA, 20 bp, Artificial
  CRISPR gRNA sequence
tcttgtgcctgaaagcaccc

SEQ ID NO: 708732 - DNA, 20 bp, Artificial
  CRISPR gRNA sequence
tgtgcctgaaagcacccagg

SEQ ID NO: 708733 - DNA, 20 bp, Artificial
  CRISPR gRNA sequence
gcctgaaagcacccaggtgg

SEQ ID NO: 708734 - DNA, 20 bp, Artificial
  CRISPR gRNA sequence
gcacccaggtggcagccttc

SEQ ID NO: 708735 - DNA, 20 bp, Artificial
  CRISPR gRNA sequence
cacccaggtggcagccttcg

SEQ ID NO: 708736 - DNA, 20 bp, Artificial
  CRISPR gRNA sequence
cccaggtggcagccttcgag

SEQ ID NO: 708737 - DNA, 20 bp, Artificial
  CRISPR gRNA sequence
ccaggtggcagccttcgagg

SEQ ID NO: 708738 - DNA, 20 bp, Artificial
  CRISPR gRNA sequence
tcgaggaggacaactgctct

SEQ ID NO: 708739 - DNA, 20 bp, Artificial
  CRISPR gRNA sequence
cgaggaggacaactgctctc

SEQ ID NO: 708740 - DNA, 20 bp, Artificial
  CRISPR gRNA sequence
ccttcaatcccatccttttg

SEQ ID NO: 708741 - DNA, 20 bp, Artificial
  CRISPR gRNA sequence
cttcaatcccatccttttgt

SEQ ID NO: 708742 - DNA, 20 bp, Artificial
  CRISPR gRNA sequence
atcccatccttttgtaggct

SEQ ID NO: 708743 - DNA, 20 bp, Artificial
  CRISPR gRNA sequence
tcccatccttttgtaggctc

SEQ ID NO: 708744 - DNA, 20 bp, Artificial
  CRISPR gRNA sequence
ccatccttttgtaggctcag

SEQ ID NO: 708745 - DNA, 20 bp, Artificial
  CRISPR gRNA sequence
catccttttgtaggctcagg

SEQ ID NO: 708746 - DNA, 20 bp, Artificial
  CRISPR gRNA sequence
cattgttctcccatattaaa

SEQ ID NO: 708747 - DNA, 20 bp, Artificial
  CRISPR gRNA sequence
attgttctcccatattaaac

SEQ ID NO: 708748 - DNA, 20 bp, Artificial
  CRISPR gRNA sequence
ttgttctcccatattaaaca

SEQ ID NO: 708749 - DNA, 20 bp, Artificial
  CRISPR gRNA sequence
tgttctcccatattaaacag

SEQ ID NO: 708750 - DNA, 20 bp, Artificial
  CRISPR gRNA sequence
ctcccatattaaacaggggc

SEQ ID NO: 708751 - DNA, 20 bp, Artificial
  CRISPR gRNA sequence
tcccatattaaacaggggcc

SEQ ID NO: 708752 - DNA, 20 bp, Artificial
  CRISPR gRNA sequence
acaggggccaggtcacgccc

SEQ ID NO: 708753 - DNA, 20 bp, Artificial
  CRISPR gRNA sequence
tgacatttaacatttaacct

SEQ ID NO: 708754 - DNA, 20 bp, Artificial
  CRISPR gRNA sequence
aacatttaaccttggctcac

SEQ ID NO: 708755 - DNA, 20 bp, Artificial
  CRISPR gRNA sequence
ccttggctcactggccatct

SEQ ID NO: 708756 - DNA, 20 bp, Artificial
  CRISPR gRNA sequence
ggctcactggccatctgaga

SEQ ID NO: 708757 - DNA, 20 bp, Artificial
  CRISPR gRNA sequence
gctcactggccatctgagaa

SEQ ID NO: 708758 - DNA, 20 bp, Artificial
  CRISPR gRNA sequence
actggccatctgagaaaggt

SEQ ID NO: 708759 - DNA, 20 bp, Artificial
  CRISPR gRNA sequence
tggccatctgagaaaggtga

SEQ ID NO: 708760 - DNA, 20 bp, Artificial
  CRISPR gRNA sequence
ggccatctgagaaaggtgag

SEQ ID NO: 708761 - DNA, 20 bp, Artificial
  CRISPR gRNA sequence
gccatctgagaaaggtgaga

SEQ ID NO: 708762 - DNA, 20 bp, Artificial
  CRISPR gRNA sequence
gagaaaggtgagagggcatc

SEQ ID NO: 708763 - DNA, 20 bp, Artificial
  CRISPR gRNA sequence
agaaaggtgagagggcatcc

SEQ ID NO: 708764 - DNA, 20 bp, Artificial
  CRISPR gRNA sequence
tccgggcatctaactcatcc

SEQ ID NO: 708765 - DNA, 20 bp, Artificial
  CRISPR gRNA sequence
cgggcatctaactcatcctg

SEQ ID NO: 708766 - DNA, 20 bp, Artificial
  CRISPR gRNA sequence
catctaactcatcctggagc

SEQ ID NO: 708767 - DNA, 20 bp, Artificial
  CRISPR gRNA sequence
taactcatcctggagcaagt

SEQ ID NO: 708768 - DNA, 20 bp, Artificial
  CRISPR gRNA sequence
tcctggagcaagtcagttcc

SEQ ID NO: 708769 - DNA, 20 bp, Artificial
  CRISPR gRNA sequence
ctggagcaagtcagttccca

SEQ ID NO: 708770 - DNA, 20 bp, Artificial
  CRISPR gRNA sequence
gagcaagtcagttcccagag

SEQ ID NO: 708771 - DNA, 20 bp, Artificial
  CRISPR gRNA sequence
tcccagagcagaccatcctc

SEQ ID NO: 708772 - DNA, 20 bp, Artificial
  CRISPR gRNA sequence
cccagagcagaccatcctcc

SEQ ID NO: 708773 - DNA, 20 bp, Artificial
  CRISPR gRNA sequence
ccagagcagaccatcctcca

SEQ ID NO: 708774 - DNA, 20 bp, Artificial
  CRISPR gRNA sequence
gaccatcctccagggatgcc

SEQ ID NO: 708775 - DNA, 20 bp, Artificial
  CRISPR gRNA sequence
cccagcttttaaccactcct

SEQ ID NO: 708776 - DNA, 20 bp, Artificial
  CRISPR gRNA sequence
actcctgagaacgctaccta

SEQ ID NO: 708777 - DNA, 20 bp, Artificial
  CRISPR gRNA sequence
tcctgagaacgctacctacg

SEQ ID NO: 708778 - DNA, 20 bp, Artificial
  CRISPR gRNA sequence
gaacgctacctacggagatc

SEQ ID NO: 708779 - DNA, 20 bp, Artificial
  CRISPR gRNA sequence
gatctggaatatgctgttgt

SEQ ID NO: 708780 - DNA, 20 bp, Artificial
  CRISPR gRNA sequence
atctggaatatgctgttgtc

SEQ ID NO: 708781 - DNA, 20 bp, Artificial
  CRISPR gRNA sequence
tgttgtcaggcacacatccc

SEQ ID NO: 708782 - DNA, 20 bp, Artificial
  CRISPR gRNA sequence
gtcaggcacacatccctggc

SEQ ID NO: 708783 - DNA, 20 bp, Artificial
  CRISPR gRNA sequence
ggctagacaaatctgccacc

SEQ ID NO: 708784 - DNA, 20 bp, Artificial
  CRISPR gRNA sequence
ccaccaagatgcccgtatgt

SEQ ID NO: 708785 - DNA, 20 bp, Artificial
  CRISPR gRNA sequence
cctgcacacatctctgactt

SEQ ID NO: 708786 - DNA, 20 bp, Artificial
  CRISPR gRNA sequence
gcacacatctctgacttcag

SEQ ID NO: 708787 - DNA, 20 bp, Artificial
  CRISPR gRNA sequence
atctctgacttcagcagctc

SEQ ID NO: 708788 - DNA, 20 bp, Artificial
  CRISPR gRNA sequence
ctctgacttcagcagctctg

SEQ ID NO: 708789 - DNA, 20 bp, Artificial
  CRISPR gRNA sequence
ctgacttcagcagctctgga

SEQ ID NO: 708790 - DNA, 20 bp, Artificial
  CRISPR gRNA sequence
cagcagctctggagagccac

SEQ ID NO: 708791 - DNA, 20 bp, Artificial
  CRISPR gRNA sequence
tctggagagccaccagccct

SEQ ID NO: 708792 - DNA, 20 bp, Artificial
  CRISPR gRNA sequence
ccaccagccctgagtcctca

SEQ ID NO: 708793 - DNA, 20 bp, Artificial
  CRISPR gRNA sequence
gtcctcacagatatgctcac

SEQ ID NO: 708794 - DNA, 20 bp, Artificial
  CRISPR gRNA sequence
cagatatgctcaccagtgct

SEQ ID NO: 708795 - DNA, 20 bp, Artificial
  CRISPR gRNA sequence
ctcaccagtgctcagtcaac

SEQ ID NO: 708796 - DNA, 20 bp, Artificial
  CRISPR gRNA sequence
accagtgctcagtcaacaag

SEQ ID NO: 708797 - DNA, 20 bp, Artificial
  CRISPR gRNA sequence
ccagtgctcagtcaacaagt

SEQ ID NO: 708798 - DNA, 20 bp, Artificial
  CRISPR gRNA sequence
ctcagtcaacaagtaggata

SEQ ID NO: 708799 - DNA, 20 bp, Artificial
  CRISPR gRNA sequence
aagtaggataaagtatacgc

SEQ ID NO: 708800 - DNA, 20 bp, Artificial
  CRISPR gRNA sequence
gaccatttgaacacgctgtg

SEQ ID NO: 708801 - DNA, 20 bp, Artificial
  CRISPR gRNA sequence
tgaacacgctgtgtggacac

SEQ ID NO: 708802 - DNA, 20 bp, Artificial
  CRISPR gRNA sequence
gaacacgctgtgtggacact

SEQ ID NO: 708803 - DNA, 20 bp, Artificial
  CRISPR gRNA sequence
acgctgtgtggacactaggt

SEQ ID NO: 708804 - DNA, 20 bp, Artificial
  CRISPR gRNA sequence
gtgtggacactaggtgagtt

SEQ ID NO: 708805 - DNA, 20 bp, Artificial
  CRISPR gRNA sequence
tgtggacactaggtgagttt

SEQ ID NO: 708806 - DNA, 20 bp, Artificial
  CRISPR gRNA sequence
gtgagtttgggaaacactct

SEQ ID NO: 708807 - DNA, 20 bp, Artificial
  CRISPR gRNA sequence
tgagtttgggaaacactctt

SEQ ID NO: 708808 - DNA, 20 bp, Artificial
  CRISPR gRNA sequence
gagtttgggaaacactctta

SEQ ID NO: 708809 - DNA, 20 bp, Artificial
  CRISPR gRNA sequence
agtttgggaaacactcttag

SEQ ID NO: 708810 - DNA, 20 bp, Artificial
  CRISPR gRNA sequence
gggtaattttttcttttttt

SEQ ID NO: 708811 - DNA, 20 bp, Artificial
  CRISPR gRNA sequence
aattttttctttttttgaga

SEQ ID NO: 708812 - DNA, 20 bp, Artificial
  CRISPR gRNA sequence
ttttttctttttttgagaca

SEQ ID NO: 708813 - DNA, 20 bp, Artificial
  CRISPR gRNA sequence
cagagtctcactctgtcacc

SEQ ID NO: 708814 - DNA, 20 bp, Artificial
  CRISPR gRNA sequence
agagtctcactctgtcaccc

SEQ ID NO: 708815 - DNA, 20 bp, Artificial
  CRISPR gRNA sequence
tctcactctgtcacccaggc

SEQ ID NO: 708816 - DNA, 20 bp, Artificial
  CRISPR gRNA sequence
tcactctgtcacccaggctg

SEQ ID NO: 708817 - DNA, 20 bp, Artificial
  CRISPR gRNA sequence
ctgtcacccaggctggagtg

SEQ ID NO: 708818 - DNA, 20 bp, Artificial
  CRISPR gRNA sequence
tcacccaggctggagtgcag

SEQ ID NO: 708819 - DNA, 20 bp, Artificial
  CRISPR gRNA sequence
ggagtgcagtggcacgatct

SEQ ID NO: 708820 - DNA, 20 bp, Artificial
  CRISPR gRNA sequence
tcactgcaacctctgcctca

SEQ ID NO: 708821 - DNA, 20 bp, Artificial
  CRISPR gRNA sequence
cactgcaacctctgcctcac

SEQ ID NO: 708822 - DNA, 20 bp, Artificial
  CRISPR gRNA sequence
aacctctgcctcacaggttt

SEQ ID NO: 708823 - DNA, 20 bp, Artificial
  CRISPR gRNA sequence
caggtttaagcaattctcac

SEQ ID NO: 708824 - DNA, 20 bp, Artificial
  CRISPR gRNA sequence
gtttaagcaattctcacaag

SEQ ID NO: 708825 - DNA, 20 bp, Artificial
  CRISPR gRNA sequence
aagcaattctcacaagtagc

SEQ ID NO: 708826 - DNA, 20 bp, Artificial
  CRISPR gRNA sequence
agcaattctcacaagtagct

SEQ ID NO: 708827 - DNA, 20 bp, Artificial
  CRISPR gRNA sequence
ccgacatgtgccaccacgcc

SEQ ID NO: 708828 - DNA, 20 bp, Artificial
  CRISPR gRNA sequence
ccggctaatttttgtatttt

SEQ ID NO: 708829 - DNA, 20 bp, Artificial
  CRISPR gRNA sequence
gctaatttttgtatttttag

SEQ ID NO: 708830 - DNA, 20 bp, Artificial
  CRISPR gRNA sequence
tttgtatttttagtagaaac

SEQ ID NO: 708831 - DNA, 20 bp, Artificial
  CRISPR gRNA sequence
ttgtatttttagtagaaaca

SEQ ID NO: 708832 - DNA, 20 bp, Artificial
  CRISPR gRNA sequence
gaaacaaggtttcaccatgt

SEQ ID NO: 708833 - DNA, 20 bp, Artificial
  CRISPR gRNA sequence
caaggtttcaccatgttggc

SEQ ID NO: 708834 - DNA, 20 bp, Artificial
  CRISPR gRNA sequence
aaggtttcaccatgttggcc

SEQ ID NO: 708835 - DNA, 20 bp, Artificial
  CRISPR gRNA sequence
tttcaccatgttggccaggt

SEQ ID NO: 708836 - DNA, 20 bp, Artificial
  CRISPR gRNA sequence
tggtctccaactcctgacct

SEQ ID NO: 708837 - DNA, 20 bp, Artificial
  CRISPR gRNA sequence
ggtctccaactcctgacctc

SEQ ID NO: 708838 - DNA, 20 bp, Artificial
  CRISPR gRNA sequence
ctcaggtgatctgcccgcct

SEQ ID NO: 708839 - DNA, 20 bp, Artificial
  CRISPR gRNA sequence
ctgcccgcctcggcctctcg

SEQ ID NO: 708840 - DNA, 20 bp, Artificial
  CRISPR gRNA sequence
gcctcggcctctcgaagtgc

SEQ ID NO: 708841 - DNA, 20 bp, Artificial
  CRISPR gRNA sequence
cctcggcctctcgaagtgct

SEQ ID NO: 708842 - DNA, 20 bp, Artificial
  CRISPR gRNA sequence
ctctcgaagtgctgggatta

SEQ ID NO: 708843 - DNA, 20 bp, Artificial
  CRISPR gRNA sequence
tctcgaagtgctgggattac

SEQ ID NO: 708844 - DNA, 20 bp, Artificial
  CRISPR gRNA sequence
agtgctgggattacaggcat

SEQ ID NO: 708845 - DNA, 20 bp, Artificial
  CRISPR gRNA sequence
caggcatgagccaccttgcc

SEQ ID NO: 708846 - DNA, 20 bp, Artificial
  CRISPR gRNA sequence
catgagccaccttgcccggc

SEQ ID NO: 708847 - DNA, 20 bp, Artificial
  CRISPR gRNA sequence
atgagccaccttgcccggcc

SEQ ID NO: 708848 - DNA, 20 bp, Artificial
  CRISPR gRNA sequence
tgagccaccttgcccggcca

SEQ ID NO: 708849 - DNA, 20 bp, Artificial
  CRISPR gRNA sequence
gagccaccttgcccggccag

SEQ ID NO: 708850 - DNA, 20 bp, Artificial
  CRISPR gRNA sequence
tttttttttttttttttttt

SEQ ID NO: 708851 - DNA, 20 bp, Artificial
  CRISPR gRNA sequence
ttttttttttttttttgaga

SEQ ID NO: 708852 - DNA, 20 bp, Artificial
  CRISPR gRNA sequence
ttttttttttttttgagatg

SEQ ID NO: 708853 - DNA, 20 bp, Artificial
  CRISPR gRNA sequence
atggagtctaactctgtcgc

SEQ ID NO: 708854 - DNA, 20 bp, Artificial
  CRISPR gRNA sequence
tggagtctaactctgtcgcc

SEQ ID NO: 708855 - DNA, 20 bp, Artificial
  CRISPR gRNA sequence
ggagtctaactctgtcgcca

SEQ ID NO: 708856 - DNA, 20 bp, Artificial
  CRISPR gRNA sequence
ctaactctgtcgccagggtg

SEQ ID NO: 708857 - DNA, 20 bp, Artificial
  CRISPR gRNA sequence
tctgtcgccagggtgaagtg

SEQ ID NO: 708858 - DNA, 20 bp, Artificial
  CRISPR gRNA sequence
gtcgccagggtgaagtgcag

SEQ ID NO: 708859 - DNA, 20 bp, Artificial
  CRISPR gRNA sequence
gaagtgcagcagcgcgatct

SEQ ID NO: 708860 - DNA, 20 bp, Artificial
  CRISPR gRNA sequence
tcactgcaacctccgcctcc

SEQ ID NO: 708861 - DNA, 20 bp, Artificial
  CRISPR gRNA sequence
cactgcaacctccgcctcct

SEQ ID NO: 708862 - DNA, 20 bp, Artificial
  CRISPR gRNA sequence
aacctccgcctcctgggttc

SEQ ID NO: 708863 - DNA, 20 bp, Artificial
  CRISPR gRNA sequence
ttcaagcgattctcctgcct

SEQ ID NO: 708864 - DNA, 20 bp, Artificial
  CRISPR gRNA sequence
ttctcctgcctcagcctccc

SEQ ID NO: 708865 - DNA, 20 bp, Artificial
  CRISPR gRNA sequence
tcctgcctcagcctcccgag

SEQ ID NO: 708866 - DNA, 20 bp, Artificial
  CRISPR gRNA sequence
gcctcagcctcccgagtagc

SEQ ID NO: 708867 - DNA, 20 bp, Artificial
  CRISPR gRNA sequence
cctcagcctcccgagtagct

SEQ ID NO: 708868 - DNA, 20 bp, Artificial
  CRISPR gRNA sequence
ctcccgagtagctgggatta

SEQ ID NO: 708869 - DNA, 20 bp, Artificial
  CRISPR gRNA sequence
tcccgagtagctgggattac

SEQ ID NO: 708870 - DNA, 20 bp, Artificial
  CRISPR gRNA sequence
caggcacgcaccaccatgct

SEQ ID NO: 708871 - DNA, 20 bp, Artificial
  CRISPR gRNA sequence
tcagctaatttttgtatttt

SEQ ID NO: 708872 - DNA, 20 bp, Artificial
  CRISPR gRNA sequence
gctaatttttgtatttttag

SEQ ID NO: 708873 - DNA, 20 bp, Artificial
  CRISPR gRNA sequence
taatttttgtatttttagta

SEQ ID NO: 708874 - DNA, 20 bp, Artificial
  CRISPR gRNA sequence
ttttgtatttttagtagaga

SEQ ID NO: 708875 - DNA, 20 bp, Artificial
  CRISPR gRNA sequence
tttgtatttttagtagagac

SEQ ID NO: 708876 - DNA, 20 bp, Artificial
  CRISPR gRNA sequence
ttgtatttttagtagagacg

SEQ ID NO: 708877 - DNA, 20 bp, Artificial
  CRISPR gRNA sequence
gagacggggtttcaccatgt

SEQ ID NO: 708878 - DNA, 20 bp, Artificial
  CRISPR gRNA sequence
cggggtttcaccatgttggc

SEQ ID NO: 708879 - DNA, 20 bp, Artificial
  CRISPR gRNA sequence
ggggtttcaccatgttggcc

SEQ ID NO: 708880 - DNA, 20 bp, Artificial
  CRISPR gRNA sequence
tttcaccatgttggccaggc

SEQ ID NO: 708881 - DNA, 20 bp, Artificial
  CRISPR gRNA sequence
acctcgtgatccacccgcct

SEQ ID NO: 708882 - DNA, 20 bp, Artificial
  CRISPR gRNA sequence
ccacccgcctcggcctccca

SEQ ID NO: 708883 - DNA, 20 bp, Artificial
  CRISPR gRNA sequence
gcctcggcctcccaaagtgc

SEQ ID NO: 708884 - DNA, 20 bp, Artificial
  CRISPR gRNA sequence
cctcggcctcccaaagtgct

SEQ ID NO: 708885 - DNA, 20 bp, Artificial
  CRISPR gRNA sequence
ctcccaaagtgctgggatta

SEQ ID NO: 708886 - DNA, 20 bp, Artificial
  CRISPR gRNA sequence
tcccaaagtgctgggattac

SEQ ID NO: 708887 - DNA, 20 bp, Artificial
  CRISPR gRNA sequence
agtgctgggattacaggcgt

SEQ ID NO: 708888 - DNA, 20 bp, Artificial
  CRISPR gRNA sequence
gggattacaggcgtgagcca

SEQ ID NO: 708889 - DNA, 20 bp, Artificial
  CRISPR gRNA sequence
caggcgtgagccacggcacc

SEQ ID NO: 708890 - DNA, 20 bp, Artificial
  CRISPR gRNA sequence
gtgagccacggcacccggcc

SEQ ID NO: 708891 - DNA, 20 bp, Artificial
  CRISPR gRNA sequence
tgagccacggcacccggccg

SEQ ID NO: 708892 - DNA, 20 bp, Artificial
  CRISPR gRNA sequence
cacattcttttcaatgacgt

SEQ ID NO: 708893 - DNA, 20 bp, Artificial
  CRISPR gRNA sequence
acgtcagtgaaactaaatca

SEQ ID NO: 708894 - DNA, 20 bp, Artificial
  CRISPR gRNA sequence
aaactaaatcatggtccctc

SEQ ID NO: 708895 - DNA, 20 bp, Artificial
  CRISPR gRNA sequence
actaaatcatggtccctcca

SEQ ID NO: 708896 - DNA, 20 bp, Artificial
  CRISPR gRNA sequence
ggtccctccagagtgatttt

SEQ ID NO: 708897 - DNA, 20 bp, Artificial
  CRISPR gRNA sequence
agagtgattttgagttttac

SEQ ID NO: 708898 - DNA, 20 bp, Artificial
  CRISPR gRNA sequence
gtgattttgagttttacaag

SEQ ID NO: 708899 - DNA, 20 bp, Artificial
  CRISPR gRNA sequence
acaagcagccaactgttctt

SEQ ID NO: 708900 - DNA, 20 bp, Artificial
  CRISPR gRNA sequence
gccaactgttctttggtacc

SEQ ID NO: 708901 - DNA, 20 bp, Artificial
  CRISPR gRNA sequence
gttctttggtaccaagtcac

SEQ ID NO: 708902 - DNA, 20 bp, Artificial
  CRISPR gRNA sequence
ttctttggtaccaagtcact

SEQ ID NO: 708903 - DNA, 20 bp, Artificial
  CRISPR gRNA sequence
tctttggtaccaagtcactg

SEQ ID NO: 708904 - DNA, 20 bp, Artificial
  CRISPR gRNA sequence
ctttggtaccaagtcactgg

SEQ ID NO: 708905 - DNA, 20 bp, Artificial
  CRISPR gRNA sequence
tggtaccaagtcactggggg

SEQ ID NO: 708906 - DNA, 20 bp, Artificial
  CRISPR gRNA sequence
aagtcactgggggtggccaa

SEQ ID NO: 708907 - DNA, 20 bp, Artificial
  CRISPR gRNA sequence
ccaacagaataaaaaaaaaa

SEQ ID NO: 708908 - DNA, 20 bp, Artificial
  CRISPR gRNA sequence
aaaaaaaaaaaagtgtgaca

SEQ ID NO: 708909 - DNA, 20 bp, Artificial
  CRISPR gRNA sequence
taaataaaaatgacacaact

SEQ ID NO: 708910 - DNA, 20 bp, Artificial
  CRISPR gRNA sequence
aatgacacaactcggccttg

SEQ ID NO: 708911 - DNA, 20 bp, Artificial
  CRISPR gRNA sequence
atgacacaactcggccttga

SEQ ID NO: 708912 - DNA, 20 bp, Artificial
  CRISPR gRNA sequence
tgacacaactcggccttgaa

SEQ ID NO: 708913 - DNA, 20 bp, Artificial
  CRISPR gRNA sequence
gacacaactcggccttgaag

SEQ ID NO: 708914 - DNA, 20 bp, Artificial
  CRISPR gRNA sequence
acaactcggccttgaagggg

SEQ ID NO: 708915 - DNA, 20 bp, Artificial
  CRISPR gRNA sequence
actcggccttgaaggggaag

SEQ ID NO: 708916 - DNA, 20 bp, Artificial
  CRISPR gRNA sequence
ctcggccttgaaggggaagt

SEQ ID NO: 708917 - DNA, 20 bp, Artificial
  CRISPR gRNA sequence
ttgaaggggaagtgggtgaa

SEQ ID NO: 708918 - DNA, 20 bp, Artificial
  CRISPR gRNA sequence
tgaaggggaagtgggtgaac

SEQ ID NO: 708919 - DNA, 20 bp, Artificial
  CRISPR gRNA sequence
gaagtgggtgaacgggatcg

SEQ ID NO: 708920 - DNA, 20 bp, Artificial
  CRISPR gRNA sequence
agtgggtgaacgggatcgca

SEQ ID NO: 708921 - DNA, 20 bp, Artificial
  CRISPR gRNA sequence
gcagagctgcccataccctg

SEQ ID NO: 708922 - DNA, 20 bp, Artificial
  CRISPR gRNA sequence
cagagctgcccataccctgc

SEQ ID NO: 708923 - DNA, 20 bp, Artificial
  CRISPR gRNA sequence
gctgcccataccctgcaggc

SEQ ID NO: 708924 - DNA, 20 bp, Artificial
  CRISPR gRNA sequence
aggctggttccatttttcta

SEQ ID NO: 708925 - DNA, 20 bp, Artificial
  CRISPR gRNA sequence
gctggttccatttttctaaa

SEQ ID NO: 708926 - DNA, 20 bp, Artificial
  CRISPR gRNA sequence
catttttctaaagagccatc

SEQ ID NO: 708927 - DNA, 20 bp, Artificial
  CRISPR gRNA sequence
aaaacctcacactctttacc

SEQ ID NO: 708928 - DNA, 20 bp, Artificial
  CRISPR gRNA sequence
tttacccagtcatccctctt

SEQ ID NO: 708929 - DNA, 20 bp, Artificial
  CRISPR gRNA sequence
ttacccagtcatccctcttg

SEQ ID NO: 708930 - DNA, 20 bp, Artificial
  CRISPR gRNA sequence
tacccagtcatccctcttga

SEQ ID NO: 708931 - DNA, 20 bp, Artificial
  CRISPR gRNA sequence
ctcttgagggaacacaccct

SEQ ID NO: 708932 - DNA, 20 bp, Artificial
  CRISPR gRNA sequence
tcttgagggaacacaccctc

SEQ ID NO: 708933 - DNA, 20 bp, Artificial
  CRISPR gRNA sequence
accctcaggaaataacccga

SEQ ID NO: 708934 - DNA, 20 bp, Artificial
  CRISPR gRNA sequence
ataacccgaaagaaaacaaa

SEQ ID NO: 708935 - DNA, 20 bp, Artificial
  CRISPR gRNA sequence
taacccgaaagaaaacaaaa

SEQ ID NO: 708936 - DNA, 20 bp, Artificial
  CRISPR gRNA sequence
cgaaagaaaacaaaaaggcc

SEQ ID NO: 708937 - DNA, 20 bp, Artificial
  CRISPR gRNA sequence
gaaaacaaaaaggccgagca

SEQ ID NO: 708938 - DNA, 20 bp, Artificial
  CRISPR gRNA sequence
aacaaaaaggccgagcacag

SEQ ID NO: 708939 - DNA, 20 bp, Artificial
  CRISPR gRNA sequence
aaaaaggccgagcacagcag

SEQ ID NO: 708940 - DNA, 20 bp, Artificial
  CRISPR gRNA sequence
aaaaggccgagcacagcagc

SEQ ID NO: 708941 - DNA, 20 bp, Artificial
  CRISPR gRNA sequence
ataaccctcaaattgaaaac

SEQ ID NO: 708942 - DNA, 20 bp, Artificial
  CRISPR gRNA sequence
agccaaatgtcaaaaacaat

SEQ ID NO: 708943 - DNA, 20 bp, Artificial
  CRISPR gRNA sequence
gccaaatgtcaaaaacaatg

SEQ ID NO: 708944 - DNA, 20 bp, Artificial
  CRISPR gRNA sequence
tcaaaaacaatgaggccgct

SEQ ID NO: 708945 - DNA, 20 bp, Artificial
  CRISPR gRNA sequence
atgaggccgcttagccaccc

SEQ ID NO: 708946 - DNA, 20 bp, Artificial
  CRISPR gRNA sequence
gaggccgcttagccaccctg

SEQ ID NO: 708947 - DNA, 20 bp, Artificial
  CRISPR gRNA sequence
gccgcttagccaccctggag

SEQ ID NO: 708948 - DNA, 20 bp, Artificial
  CRISPR gRNA sequence
ccgcttagccaccctggagc

SEQ ID NO: 708949 - DNA, 20 bp, Artificial
  CRISPR gRNA sequence
cgcttagccaccctggagca

SEQ ID NO: 708950 - DNA, 20 bp, Artificial
  CRISPR gRNA sequence
gcttagccaccctggagcag

SEQ ID NO: 708951 - DNA, 20 bp, Artificial
  CRISPR gRNA sequence
ccctggagcaggggcctcct

SEQ ID NO: 708952 - DNA, 20 bp, Artificial
  CRISPR gRNA sequence
tggagcaggggcctccttgg

SEQ ID NO: 708953 - DNA, 20 bp, Artificial
  CRISPR gRNA sequence
gcctccttggcggtgaaact

SEQ ID NO: 708954 - DNA, 20 bp, Artificial
  CRISPR gRNA sequence
caatattacttcccttctcc

SEQ ID NO: 708955 - DNA, 20 bp, Artificial
  CRISPR gRNA sequence
tctccgagcctctgtcctcc

SEQ ID NO: 708956 - DNA, 20 bp, Artificial
  CRISPR gRNA sequence
cgagcctctgtcctcccagc

SEQ ID NO: 708957 - DNA, 20 bp, Artificial
  CRISPR gRNA sequence
ctgtcctcccagctggaaaa

SEQ ID NO: 708958 - DNA, 20 bp, Artificial
  CRISPR gRNA sequence
tgtcctcccagctggaaaat

SEQ ID NO: 708959 - DNA, 20 bp, Artificial
  CRISPR gRNA sequence
gggatgaatcacatcaactt

SEQ ID NO: 708960 - DNA, 20 bp, Artificial
  CRISPR gRNA sequence
ggatgaatcacatcaacttt

SEQ ID NO: 708961 - DNA, 20 bp, Artificial
  CRISPR gRNA sequence
gatgaatcacatcaactttg

SEQ ID NO: 708962 - DNA, 20 bp, Artificial
  CRISPR gRNA sequence
catcaactttggggcttgtt

SEQ ID NO: 708963 - DNA, 20 bp, Artificial
  CRISPR gRNA sequence
caactttggggcttgttgag

SEQ ID NO: 708964 - DNA, 20 bp, Artificial
  CRISPR gRNA sequence
gggcttgttgagaagattaa

SEQ ID NO: 708965 - DNA, 20 bp, Artificial
  CRISPR gRNA sequence
gcttgttgagaagattaaaa

SEQ ID NO: 708966 - DNA, 20 bp, Artificial
  CRISPR gRNA sequence
aagattaaaagagatatcaa

SEQ ID NO: 708967 - DNA, 20 bp, Artificial
  CRISPR gRNA sequence
taaaagagatatcaaaagtg

SEQ ID NO: 708968 - DNA, 20 bp, Artificial
  CRISPR gRNA sequence
aaaagagatatcaaaagtga

SEQ ID NO: 708969 - DNA, 20 bp, Artificial
  CRISPR gRNA sequence
atatcaaaagtgaaggtgcc

SEQ ID NO: 708970 - DNA, 20 bp, Artificial
  CRISPR gRNA sequence
tcaaaagtgaaggtgcccag

SEQ ID NO: 708971 - DNA, 20 bp, Artificial
  CRISPR gRNA sequence
gaaggtgcccagtggtaaat

SEQ ID NO: 708972 - DNA, 20 bp, Artificial
  CRISPR gRNA sequence
aaggtgcccagtggtaaatc

SEQ ID NO: 708973 - DNA, 20 bp, Artificial
  CRISPR gRNA sequence
tttttttttttttttttttt

SEQ ID NO: 708974 - DNA, 20 bp, Artificial
  CRISPR gRNA sequence
ttttttttttttttttgaga

SEQ ID NO: 708975 - DNA, 20 bp, Artificial
  CRISPR gRNA sequence
ttttttttttttttgagatg

SEQ ID NO: 708976 - DNA, 20 bp, Artificial
  CRISPR gRNA sequence
tggagtctcgctctgtcacc

SEQ ID NO: 708977 - DNA, 20 bp, Artificial
  CRISPR gRNA sequence
ggagtctcgctctgtcaccg

SEQ ID NO: 708978 - DNA, 20 bp, Artificial
  CRISPR gRNA sequence
tctcgctctgtcaccgaggc

SEQ ID NO: 708979 - DNA, 20 bp, Artificial
  CRISPR gRNA sequence
tcgctctgtcaccgaggctg

SEQ ID NO: 708980 - DNA, 20 bp, Artificial
  CRISPR gRNA sequence
ctgtcaccgaggctggagtg

SEQ ID NO: 708981 - DNA, 20 bp, Artificial
  CRISPR gRNA sequence
tcaccgaggctggagtgtag

SEQ ID NO: 708982 - DNA, 20 bp, Artificial
  CRISPR gRNA sequence
ggagtgtagtggcacgttct

SEQ ID NO: 708983 - DNA, 20 bp, Artificial
  CRISPR gRNA sequence
ctcaatgcaacctctgcctc

SEQ ID NO: 708984 - DNA, 20 bp, Artificial
  CRISPR gRNA sequence
tcaatgcaacctctgcctct

SEQ ID NO: 708985 - DNA, 20 bp, Artificial
  CRISPR gRNA sequence
caatgcaacctctgcctctg

SEQ ID NO: 708986 - DNA, 20 bp, Artificial
  CRISPR gRNA sequence
aacctctgcctctggggttt

SEQ ID NO: 708987 - DNA, 20 bp, Artificial
  CRISPR gRNA sequence
tttaagcgatcctcctgcct

SEQ ID NO: 708988 - DNA, 20 bp, Artificial
  CRISPR gRNA sequence
tcctcctgcctcagcctccc

SEQ ID NO: 708989 - DNA, 20 bp, Artificial
  CRISPR gRNA sequence
tcctgcctcagcctcccaag

SEQ ID NO: 708990 - DNA, 20 bp, Artificial
  CRISPR gRNA sequence
gcctcagcctcccaagtagc

SEQ ID NO: 708991 - DNA, 20 bp, Artificial
  CRISPR gRNA sequence
cctcagcctcccaagtagct

SEQ ID NO: 708992 - DNA, 20 bp, Artificial
  CRISPR gRNA sequence
ctcccaagtagctgggacta

SEQ ID NO: 708993 - DNA, 20 bp, Artificial
  CRISPR gRNA sequence
tcccaagtagctgggactac

SEQ ID NO: 708994 - DNA, 20 bp, Artificial
  CRISPR gRNA sequence
caggtgcgtgtcatgacacc

SEQ ID NO: 708995 - DNA, 20 bp, Artificial
  CRISPR gRNA sequence
ccggctaatttttgtatttt

SEQ ID NO: 708996 - DNA, 20 bp, Artificial
  CRISPR gRNA sequence
gctaatttttgtattttcgg

SEQ ID NO: 708997 - DNA, 20 bp, Artificial
  CRISPR gRNA sequence
taatttttgtattttcggta

SEQ ID NO: 708998 - DNA, 20 bp, Artificial
  CRISPR gRNA sequence
ttttgtattttcggtagaga

SEQ ID NO: 708999 - DNA, 20 bp, Artificial
  CRISPR gRNA sequence
tttgtattttcggtagagac

SEQ ID NO: 709000 - DNA, 20 bp, Artificial
  CRISPR gRNA sequence
ttgtattttcggtagagaca

SEQ ID NO: 709001 - DNA, 20 bp, Artificial
  CRISPR gRNA sequence
gagacagggtttcaccatgt

SEQ ID NO: 709002 - DNA, 20 bp, Artificial
  CRISPR gRNA sequence
cagggtttcaccatgttggc

SEQ ID NO: 709003 - DNA, 20 bp, Artificial
  CRISPR gRNA sequence
agggtttcaccatgttggcc

SEQ ID NO: 709004 - DNA, 20 bp, Artificial
  CRISPR gRNA sequence
tttcaccatgttggccaggc

SEQ ID NO: 709005 - DNA, 20 bp, Artificial
  CRISPR gRNA sequence
tggtctcaaactcctgacct

SEQ ID NO: 709006 - DNA, 20 bp, Artificial
  CRISPR gRNA sequence
ggtctcaaactcctgacctc

SEQ ID NO: 709007 - DNA, 20 bp, Artificial
  CRISPR gRNA sequence
cctgacctcaggtgatctgc

SEQ ID NO: 709008 - DNA, 20 bp, Artificial
  CRISPR gRNA sequence
ctgacctcaggtgatctgcc

SEQ ID NO: 709009 - DNA, 20 bp, Artificial
  CRISPR gRNA sequence
ctcaggtgatctgccaggct

SEQ ID NO: 709010 - DNA, 20 bp, Artificial
  CRISPR gRNA sequence
ctgccaggcttggcctccca

SEQ ID NO: 709011 - DNA, 20 bp, Artificial
  CRISPR gRNA sequence
ggcttggcctcccaaagtgc

SEQ ID NO: 709012 - DNA, 20 bp, Artificial
  CRISPR gRNA sequence
gcttggcctcccaaagtgct

SEQ ID NO: 709013 - DNA, 20 bp, Artificial
  CRISPR gRNA sequence
ctcccaaagtgctgggatta

SEQ ID NO: 709014 - DNA, 20 bp, Artificial
  CRISPR gRNA sequence
tcccaaagtgctgggattac

SEQ ID NO: 709015 - DNA, 20 bp, Artificial
  CRISPR gRNA sequence
agtgctgggattacaggcat

SEQ ID NO: 709016 - DNA, 20 bp, Artificial
  CRISPR gRNA sequence
caggcatgagctactgcgcc

SEQ ID NO: 709017 - DNA, 20 bp, Artificial
  CRISPR gRNA sequence
atgagctactgcgcccagcc

SEQ ID NO: 709018 - DNA, 20 bp, Artificial
  CRISPR gRNA sequence
cagccaagatttgatgtgat

SEQ ID NO: 709019 - DNA, 20 bp, Artificial
  CRISPR gRNA sequence
agcatgacgtttcacctctg

SEQ ID NO: 709020 - DNA, 20 bp, Artificial
  CRISPR gRNA sequence
cttcccccaatgcataactc

SEQ ID NO: 709021 - DNA, 20 bp, Artificial
  CRISPR gRNA sequence
gcataactccagtctaatca

SEQ ID NO: 709022 - DNA, 20 bp, Artificial
  CRISPR gRNA sequence
cataactccagtctaatcat

SEQ ID NO: 709023 - DNA, 20 bp, Artificial
  CRISPR gRNA sequence
ataactccagtctaatcatg

SEQ ID NO: 709024 - DNA, 20 bp, Artificial
  CRISPR gRNA sequence
actccagtctaatcatgggg

SEQ ID NO: 709025 - DNA, 20 bp, Artificial
  CRISPR gRNA sequence
tctaatcatggggaagacat

SEQ ID NO: 709026 - DNA, 20 bp, Artificial
  CRISPR gRNA sequence
atcatggggaagacatcaga

SEQ ID NO: 709027 - DNA, 20 bp, Artificial
  CRISPR gRNA sequence
ggaagacatcagacagatcc

SEQ ID NO: 709028 - DNA, 20 bp, Artificial
  CRISPR gRNA sequence
gaagacatcagacagatccc

SEQ ID NO: 709029 - DNA, 20 bp, Artificial
  CRISPR gRNA sequence
agacatcagacagatcccag

SEQ ID NO: 709030 - DNA, 20 bp, Artificial
  CRISPR gRNA sequence
atcagacagatcccaggaga

SEQ ID NO: 709031 - DNA, 20 bp, Artificial
  CRISPR gRNA sequence
tcagacagatcccaggagac

SEQ ID NO: 709032 - DNA, 20 bp, Artificial
  CRISPR gRNA sequence
atcaatactcaaaaactgcc

SEQ ID NO: 709033 - DNA, 20 bp, Artificial
  CRISPR gRNA sequence
tcaatactcaaaaactgcca

SEQ ID NO: 709034 - DNA, 20 bp, Artificial
  CRISPR gRNA sequence
tcaaaaactgccaaggccat

SEQ ID NO: 709035 - DNA, 20 bp, Artificial
  CRISPR gRNA sequence
caaaaactgccaaggccatc

SEQ ID NO: 709036 - DNA, 20 bp, Artificial
  CRISPR gRNA sequence
aaaaactgccaaggccatca

SEQ ID NO: 709037 - DNA, 20 bp, Artificial
  CRISPR gRNA sequence
gccaaggccatcagggaaac

SEQ ID NO: 709038 - DNA, 20 bp, Artificial
  CRISPR gRNA sequence
ccatcagggaaactggtctt

SEQ ID NO: 709039 - DNA, 20 bp, Artificial
  CRISPR gRNA sequence
ggaaactggtcttgagaaac

SEQ ID NO: 709040 - DNA, 20 bp, Artificial
  CRISPR gRNA sequence
ggtcttgagaaacaagatct

SEQ ID NO: 709041 - DNA, 20 bp, Artificial
  CRISPR gRNA sequence
gagaaacaagatctgagaaa

SEQ ID NO: 709042 - DNA, 20 bp, Artificial
  CRISPR gRNA sequence
caagatctgagaaacggcca

SEQ ID NO: 709043 - DNA, 20 bp, Artificial
  CRISPR gRNA sequence
aagatctgagaaacggccac

SEQ ID NO: 709044 - DNA, 20 bp, Artificial
  CRISPR gRNA sequence
tctgagaaacggccacaggc

SEQ ID NO: 709045 - DNA, 20 bp, Artificial
  CRISPR gRNA sequence
tgagaaacggccacaggcca

SEQ ID NO: 709046 - DNA, 20 bp, Artificial
  CRISPR gRNA sequence
gaaacggccacaggccagag

SEQ ID NO: 709047 - DNA, 20 bp, Artificial
  CRISPR gRNA sequence
gccacaggccagagtagcct

SEQ ID NO: 709048 - DNA, 20 bp, Artificial
  CRISPR gRNA sequence
ccacaggccagagtagccta

SEQ ID NO: 709049 - DNA, 20 bp, Artificial
  CRISPR gRNA sequence
catgatgactgaatgtgacg

SEQ ID NO: 709050 - DNA, 20 bp, Artificial
  CRISPR gRNA sequence
actgaatgtgacgtggctcc

SEQ ID NO: 709051 - DNA, 20 bp, Artificial
  CRISPR gRNA sequence
aatgtgacgtggctcctgga

SEQ ID NO: 709052 - DNA, 20 bp, Artificial
  CRISPR gRNA sequence
atgtgacgtggctcctggat

SEQ ID NO: 709053 - DNA, 20 bp, Artificial
  CRISPR gRNA sequence
gtggctcctggatgggatcc

SEQ ID NO: 709054 - DNA, 20 bp, Artificial
  CRISPR gRNA sequence
tggatgggatcctggaacct

SEQ ID NO: 709055 - DNA, 20 bp, Artificial
  CRISPR gRNA sequence
ggatgggatcctggaacctt

SEQ ID NO: 709056 - DNA, 20 bp, Artificial
  CRISPR gRNA sequence
cctggaaccttaggcaatgc

SEQ ID NO: 709057 - DNA, 20 bp, Artificial
  CRISPR gRNA sequence
ctggaaccttaggcaatgca

SEQ ID NO: 709058 - DNA, 20 bp, Artificial
  CRISPR gRNA sequence
tggaaccttaggcaatgcaa

SEQ ID NO: 709059 - DNA, 20 bp, Artificial
  CRISPR gRNA sequence
atgcaagggaaccctgaaca

SEQ ID NO: 709060 - DNA, 20 bp, Artificial
  CRISPR gRNA sequence
agggaaccctgaacacagtg

SEQ ID NO: 709061 - DNA, 20 bp, Artificial
  CRISPR gRNA sequence
gggaaccctgaacacagtgt

SEQ ID NO: 709062 - DNA, 20 bp, Artificial
  CRISPR gRNA sequence
ttgtaatcctgtgtcaataa

SEQ ID NO: 709063 - DNA, 20 bp, Artificial
  CRISPR gRNA sequence
ttttgacaaatgaacgatgc

SEQ ID NO: 709064 - DNA, 20 bp, Artificial
  CRISPR gRNA sequence
caaatgaacgatgctggctt

SEQ ID NO: 709065 - DNA, 20 bp, Artificial
  CRISPR gRNA sequence
ctggcttaagatgctaatca

SEQ ID NO: 709066 - DNA, 20 bp, Artificial
  CRISPR gRNA sequence
ggcttaagatgctaatcaca

SEQ ID NO: 709067 - DNA, 20 bp, Artificial
  CRISPR gRNA sequence
gcttaagatgctaatcacag

SEQ ID NO: 709068 - DNA, 20 bp, Artificial
  CRISPR gRNA sequence
atgctaatcacagaggaaac

SEQ ID NO: 709069 - DNA, 20 bp, Artificial
  CRISPR gRNA sequence
tgctaatcacagaggaaact

SEQ ID NO: 709070 - DNA, 20 bp, Artificial
  CRISPR gRNA sequence
atcacagaggaaactgggtg

SEQ ID NO: 709071 - DNA, 20 bp, Artificial
  CRISPR gRNA sequence
tcacagaggaaactgggtgt

SEQ ID NO: 709072 - DNA, 20 bp, Artificial
  CRISPR gRNA sequence
cacagaggaaactgggtgtg

SEQ ID NO: 709073 - DNA, 20 bp, Artificial
  CRISPR gRNA sequence
gaaactgggtgtggggcatg

SEQ ID NO: 709074 - DNA, 20 bp, Artificial
  CRISPR gRNA sequence
aaactgggtgtggggcatgt

SEQ ID NO: 709075 - DNA, 20 bp, Artificial
  CRISPR gRNA sequence
ctaaaactatttttaaaaat

SEQ ID NO: 709076 - DNA, 20 bp, Artificial
  CRISPR gRNA sequence
actatttttaaaaatgagac

SEQ ID NO: 709077 - DNA, 20 bp, Artificial
  CRISPR gRNA sequence
ctatttttaaaaatgagact

SEQ ID NO: 709078 - DNA, 20 bp, Artificial
  CRISPR gRNA sequence
tttaaaaatgagactgggcg

SEQ ID NO: 709079 - DNA, 20 bp, Artificial
  CRISPR gRNA sequence
aaaaatgagactgggcgtgg

SEQ ID NO: 709080 - DNA, 20 bp, Artificial
  CRISPR gRNA sequence
gtggctcatgcctgtaatcc

SEQ ID NO: 709081 - DNA, 20 bp, Artificial
  CRISPR gRNA sequence
tgcctgtaatcccagtattt

SEQ ID NO: 709082 - DNA, 20 bp, Artificial
  CRISPR gRNA sequence
gcctgtaatcccagtatttt

SEQ ID NO: 709083 - DNA, 20 bp, Artificial
  CRISPR gRNA sequence
ctgtaatcccagtattttgg

SEQ ID NO: 709084 - DNA, 20 bp, Artificial
  CRISPR gRNA sequence
tgtaatcccagtattttggg

SEQ ID NO: 709085 - DNA, 20 bp, Artificial
  CRISPR gRNA sequence
tcccagtattttgggaggct

SEQ ID NO: 709086 - DNA, 20 bp, Artificial
  CRISPR gRNA sequence
cccagtattttgggaggctg

SEQ ID NO: 709087 - DNA, 20 bp, Artificial
  CRISPR gRNA sequence
agtattttgggaggctgagg

SEQ ID NO: 709088 - DNA, 20 bp, Artificial
  CRISPR gRNA sequence
gtattttgggaggctgaggt

SEQ ID NO: 709089 - DNA, 20 bp, Artificial
  CRISPR gRNA sequence
aggtgggcaaatcacgatgc

SEQ ID NO: 709090 - DNA, 20 bp, Artificial
  CRISPR gRNA sequence
ggtgggcaaatcacgatgcc

SEQ ID NO: 709091 - DNA, 20 bp, Artificial
  CRISPR gRNA sequence
tgggcaaatcacgatgccag

SEQ ID NO: 709092 - DNA, 20 bp, Artificial
  CRISPR gRNA sequence
aatcacgatgccaggagttc

SEQ ID NO: 709093 - DNA, 20 bp, Artificial
  CRISPR gRNA sequence
cgatgccaggagttccagac

SEQ ID NO: 709094 - DNA, 20 bp, Artificial
  CRISPR gRNA sequence
ccaggagttccagaccagcc

SEQ ID NO: 709095 - DNA, 20 bp, Artificial
  CRISPR gRNA sequence
ccagaccagcctggccaacc

SEQ ID NO: 709096 - DNA, 20 bp, Artificial
  CRISPR gRNA sequence
tctactaaaaatacaaaaat

SEQ ID NO: 709097 - DNA, 20 bp, Artificial
  CRISPR gRNA sequence
ctaaaaatacaaaaattagc

SEQ ID NO: 709098 - DNA, 20 bp, Artificial
  CRISPR gRNA sequence
taaaaatacaaaaattagct

SEQ ID NO: 709099 - DNA, 20 bp, Artificial
  CRISPR gRNA sequence
atacaaaaattagctgggca

SEQ ID NO: 709100 - DNA, 20 bp, Artificial
  CRISPR gRNA sequence
caaaaattagctgggcatgg

SEQ ID NO: 709101 - DNA, 20 bp, Artificial
  CRISPR gRNA sequence
gtggcgcgcgcctataatcc

SEQ ID NO: 709102 - DNA, 20 bp, Artificial
  CRISPR gRNA sequence
cgcctataatcccagctact

SEQ ID NO: 709103 - DNA, 20 bp, Artificial
  CRISPR gRNA sequence
gcctataatcccagctactc

SEQ ID NO: 709104 - DNA, 20 bp, Artificial
  CRISPR gRNA sequence
ctataatcccagctactcgg

SEQ ID NO: 709105 - DNA, 20 bp, Artificial
  CRISPR gRNA sequence
tataatcccagctactcggg

SEQ ID NO: 709106 - DNA, 20 bp, Artificial
  CRISPR gRNA sequence
tcccagctactcgggaggct

SEQ ID NO: 709107 - DNA, 20 bp, Artificial
  CRISPR gRNA sequence
cccagctactcgggaggctg

SEQ ID NO: 709108 - DNA, 20 bp, Artificial
  CRISPR gRNA sequence
agctactcgggaggctgagg

SEQ ID NO: 709109 - DNA, 20 bp, Artificial
  CRISPR gRNA sequence
gctactcgggaggctgaggc

SEQ ID NO: 709110 - DNA, 20 bp, Artificial
  CRISPR gRNA sequence
tactcgggaggctgaggcag

SEQ ID NO: 709111 - DNA, 20 bp, Artificial
  CRISPR gRNA sequence
ggctgaggcaggagaattgc

SEQ ID NO: 709112 - DNA, 20 bp, Artificial
  CRISPR gRNA sequence
gcaggagaattgctggaacc

SEQ ID NO: 709113 - DNA, 20 bp, Artificial
  CRISPR gRNA sequence
caggagaattgctggaaccc

SEQ ID NO: 709114 - DNA, 20 bp, Artificial
  CRISPR gRNA sequence
gagaattgctggaacccggg

SEQ ID NO: 709115 - DNA, 20 bp, Artificial
  CRISPR gRNA sequence
aattgctggaacccgggaag

SEQ ID NO: 709116 - DNA, 20 bp, Artificial
  CRISPR gRNA sequence
ttgctggaacccgggaagca

SEQ ID NO: 709117 - DNA, 20 bp, Artificial
  CRISPR gRNA sequence
tgctggaacccgggaagcag

SEQ ID NO: 709118 - DNA, 20 bp, Artificial
  CRISPR gRNA sequence
aacccgggaagcagaggttg

SEQ ID NO: 709119 - DNA, 20 bp, Artificial
  CRISPR gRNA sequence
cgggaagcagaggttgcagt

SEQ ID NO: 709120 - DNA, 20 bp, Artificial
  CRISPR gRNA sequence
agcagaggttgcagtgagct

SEQ ID NO: 709121 - DNA, 20 bp, Artificial
  CRISPR gRNA sequence
tgcgccattgcactccaacc

SEQ ID NO: 709122 - DNA, 20 bp, Artificial
  CRISPR gRNA sequence
gcgccattgcactccaacct

SEQ ID NO: 709123 - DNA, 20 bp, Artificial
  CRISPR gRNA sequence
ttgcactccaacctgggcaa

SEQ ID NO: 709124 - DNA, 20 bp, Artificial
  CRISPR gRNA sequence
gcactccaacctgggcaaca

SEQ ID NO: 709125 - DNA, 20 bp, Artificial
  CRISPR gRNA sequence
tccaacctgggcaacagagc

SEQ ID NO: 709126 - DNA, 20 bp, Artificial
  CRISPR gRNA sequence
ctctgcctcaaaaaaaaaat

SEQ ID NO: 709127 - DNA, 20 bp, Artificial
  CRISPR gRNA sequence
tctgcctcaaaaaaaaaatg

SEQ ID NO: 709128 - DNA, 20 bp, Artificial
  CRISPR gRNA sequence
ctcaaaaaaaaaatgaggac

SEQ ID NO: 709129 - DNA, 20 bp, Artificial
  CRISPR gRNA sequence
aaaaaaaaatgaggactagc

SEQ ID NO: 709130 - DNA, 20 bp, Artificial
  CRISPR gRNA sequence
aaaaaaaatgaggactagct

SEQ ID NO: 709131 - DNA, 20 bp, Artificial
  CRISPR gRNA sequence
aaatgaggactagctgggca

SEQ ID NO: 709132 - DNA, 20 bp, Artificial
  CRISPR gRNA sequence
tgaggactagctgggcacag

SEQ ID NO: 709133 - DNA, 20 bp, Artificial
  CRISPR gRNA sequence
gtggctctcgcctataatcc

SEQ ID NO: 709134 - DNA, 20 bp, Artificial
  CRISPR gRNA sequence
cgcctataatccaagcactt

SEQ ID NO: 709135 - DNA, 20 bp, Artificial
  CRISPR gRNA sequence
gcctataatccaagcacttt

SEQ ID NO: 709136 - DNA, 20 bp, Artificial
  CRISPR gRNA sequence
ctataatccaagcactttgg

SEQ ID NO: 709137 - DNA, 20 bp, Artificial
  CRISPR gRNA sequence
tataatccaagcactttggg

SEQ ID NO: 709138 - DNA, 20 bp, Artificial
  CRISPR gRNA sequence
tccaagcactttgggaggcc

SEQ ID NO: 709139 - DNA, 20 bp, Artificial
  CRISPR gRNA sequence
ccaagcactttgggaggccg

SEQ ID NO: 709140 - DNA, 20 bp, Artificial
  CRISPR gRNA sequence
agcactttgggaggccgagg

SEQ ID NO: 709141 - DNA, 20 bp, Artificial
  CRISPR gRNA sequence
gcactttgggaggccgaggt

SEQ ID NO: 709142 - DNA, 20 bp, Artificial
  CRISPR gRNA sequence
ctttgggaggccgaggtggg

SEQ ID NO: 709143 - DNA, 20 bp, Artificial
  CRISPR gRNA sequence
ccgaggtgggcagatcactt

SEQ ID NO: 709144 - DNA, 20 bp, Artificial
  CRISPR gRNA sequence
gtgggcagatcacttgagct

SEQ ID NO: 709145 - DNA, 20 bp, Artificial
  CRISPR gRNA sequence
tgggcagatcacttgagctc

SEQ ID NO: 709146 - DNA, 20 bp, Artificial
  CRISPR gRNA sequence
ggcagatcacttgagctcag

SEQ ID NO: 709147 - DNA, 20 bp, Artificial
  CRISPR gRNA sequence
gatcacttgagctcaggagt

SEQ ID NO: 709148 - DNA, 20 bp, Artificial
  CRISPR gRNA sequence
tcacttgagctcaggagtta

SEQ ID NO: 709149 - DNA, 20 bp, Artificial
  CRISPR gRNA sequence
tgagctcaggagttagagac

SEQ ID NO: 709150 - DNA, 20 bp, Artificial
  CRISPR gRNA sequence
agagaccagcctgcacaaca

SEQ ID NO: 709151 - DNA, 20 bp, Artificial
  CRISPR gRNA sequence
gagaccagcctgcacaacaa

SEQ ID NO: 709152 - DNA, 20 bp, Artificial
  CRISPR gRNA sequence
agaccagcctgcacaacaaa

SEQ ID NO: 709153 - DNA, 20 bp, Artificial
  CRISPR gRNA sequence
accagcctgcacaacaaagg

SEQ ID NO: 709154 - DNA, 20 bp, Artificial
  CRISPR gRNA sequence
ctgcacaacaaagggagacc

SEQ ID NO: 709155 - DNA, 20 bp, Artificial
  CRISPR gRNA sequence
gacctggtctctacaaaaaa

SEQ ID NO: 709156 - DNA, 20 bp, Artificial
  CRISPR gRNA sequence
ggtctctacaaaaaatagaa

SEQ ID NO: 709157 - DNA, 20 bp, Artificial
  CRISPR gRNA sequence
tctacaaaaaatagaaaagt

SEQ ID NO: 709158 - DNA, 20 bp, Artificial
  CRISPR gRNA sequence
caaaaaatagaaaagttagc

SEQ ID NO: 709159 - DNA, 20 bp, Artificial
  CRISPR gRNA sequence
aaaaaatagaaaagttagct

SEQ ID NO: 709160 - DNA, 20 bp, Artificial
  CRISPR gRNA sequence
atagaaaagttagctgggcg

SEQ ID NO: 709161 - DNA, 20 bp, Artificial
  CRISPR gRNA sequence
gaaaagttagctgggcgtgg

SEQ ID NO: 709162 - DNA, 20 bp, Artificial
  CRISPR gRNA sequence
ggcgtggtggtgtgtatctg

SEQ ID NO: 709163 - DNA, 20 bp, Artificial
  CRISPR gRNA sequence
gtggtgtgtatctgtagtcc

SEQ ID NO: 709164 - DNA, 20 bp, Artificial
  CRISPR gRNA sequence
gtatctgtagtcccagctac

SEQ ID NO: 709165 - DNA, 20 bp, Artificial
  CRISPR gRNA sequence
tatctgtagtcccagctact

SEQ ID NO: 709166 - DNA, 20 bp, Artificial
  CRISPR gRNA sequence
atctgtagtcccagctactg

SEQ ID NO: 709167 - DNA, 20 bp, Artificial
  CRISPR gRNA sequence
ctgtagtcccagctactggg

SEQ ID NO: 709168 - DNA, 20 bp, Artificial
  CRISPR gRNA sequence
tgtagtcccagctactgggg

SEQ ID NO: 709169 - DNA, 20 bp, Artificial
  CRISPR gRNA sequence
tcccagctactggggaggct

SEQ ID NO: 709170 - DNA, 20 bp, Artificial
  CRISPR gRNA sequence
cccagctactggggaggctg

SEQ ID NO: 709171 - DNA, 20 bp, Artificial
  CRISPR gRNA sequence
ccagctactggggaggctga

SEQ ID NO: 709172 - DNA, 20 bp, Artificial
  CRISPR gRNA sequence
gctgagggatcacttgaacc

SEQ ID NO: 709173 - DNA, 20 bp, Artificial
  CRISPR gRNA sequence
ctgagggatcacttgaaccc

SEQ ID NO: 709174 - DNA, 20 bp, Artificial
  CRISPR gRNA sequence
gagggatcacttgaacccag

SEQ ID NO: 709175 - DNA, 20 bp, Artificial
  CRISPR gRNA sequence
agggatcacttgaacccagg

SEQ ID NO: 709176 - DNA, 20 bp, Artificial
  CRISPR gRNA sequence
tcacttgaacccaggaggtc

SEQ ID NO: 709177 - DNA, 20 bp, Artificial
  CRISPR gRNA sequence
cacttgaacccaggaggtca

SEQ ID NO: 709178 - DNA, 20 bp, Artificial
  CRISPR gRNA sequence
aacccaggaggtcaaggctg

SEQ ID NO: 709179 - DNA, 20 bp, Artificial
  CRISPR gRNA sequence
caggaggtcaaggctgcagt

SEQ ID NO: 709180 - DNA, 20 bp, Artificial
  CRISPR gRNA sequence
agtgagccatgattgtacca

SEQ ID NO: 709181 - DNA, 20 bp, Artificial
  CRISPR gRNA sequence
atgattgtaccatggcactc

SEQ ID NO: 709182 - DNA, 20 bp, Artificial
  CRISPR gRNA sequence
gattgtaccatggcactcca

SEQ ID NO: 709183 - DNA, 20 bp, Artificial
  CRISPR gRNA sequence
aaacaaaaaacttaaaaatg

SEQ ID NO: 709184 - DNA, 20 bp, Artificial
  CRISPR gRNA sequence
aacaaaaaacttaaaaatga

SEQ ID NO: 709185 - DNA, 20 bp, Artificial
  CRISPR gRNA sequence
acttaaaaatgaaggccact

SEQ ID NO: 709186 - DNA, 20 bp, Artificial
  CRISPR gRNA sequence
tttgtttgtttgtttgtttt

SEQ ID NO: 709187 - DNA, 20 bp, Artificial
  CRISPR gRNA sequence
tttgtttgtttgttttgaga

SEQ ID NO: 709188 - DNA, 20 bp, Artificial
  CRISPR gRNA sequence
tgtttgtttgttttgagacg

SEQ ID NO: 709189 - DNA, 20 bp, Artificial
  CRISPR gRNA sequence
gtttgtttgttttgagacgg

SEQ ID NO: 709190 - DNA, 20 bp, Artificial
  CRISPR gRNA sequence
cggaggctcgctctgttgct

SEQ ID NO: 709191 - DNA, 20 bp, Artificial
  CRISPR gRNA sequence
gctcgctctgttgctcagcc

SEQ ID NO: 709192 - DNA, 20 bp, Artificial
  CRISPR gRNA sequence
tcgctctgttgctcagcctg

SEQ ID NO: 709193 - DNA, 20 bp, Artificial
  CRISPR gRNA sequence
ctgttgctcagcctggagtg

SEQ ID NO: 709194 - DNA, 20 bp, Artificial
  CRISPR gRNA sequence
ttgctcagcctggagtgcag

SEQ ID NO: 709195 - DNA, 20 bp, Artificial
  CRISPR gRNA sequence
ggagtgcagtggtgcaatct

SEQ ID NO: 709196 - DNA, 20 bp, Artificial
  CRISPR gRNA sequence
tcactgcaacctccacctcc

SEQ ID NO: 709197 - DNA, 20 bp, Artificial
  CRISPR gRNA sequence
cactgcaacctccacctccc

SEQ ID NO: 709198 - DNA, 20 bp, Artificial
  CRISPR gRNA sequence
aacctccacctcccaggttc

SEQ ID NO: 709199 - DNA, 20 bp, Artificial
  CRISPR gRNA sequence
ttcaagaaattctcctgcct

SEQ ID NO: 709200 - DNA, 20 bp, Artificial
  CRISPR gRNA sequence
ttctcctgcctcagcctccc

SEQ ID NO: 709201 - DNA, 20 bp, Artificial
  CRISPR gRNA sequence
tcctgcctcagcctcccgag

SEQ ID NO: 709202 - DNA, 20 bp, Artificial
  CRISPR gRNA sequence
gcctcagcctcccgagtagc

SEQ ID NO: 709203 - DNA, 20 bp, Artificial
  CRISPR gRNA sequence
cctcagcctcccgagtagct

SEQ ID NO: 709204 - DNA, 20 bp, Artificial
  CRISPR gRNA sequence
ctcccgagtagctgggatta

SEQ ID NO: 709205 - DNA, 20 bp, Artificial
  CRISPR gRNA sequence
tcccgagtagctgggattac

SEQ ID NO: 709206 - DNA, 20 bp, Artificial
  CRISPR gRNA sequence
caggtgtgtgccaccatgcc

SEQ ID NO: 709207 - DNA, 20 bp, Artificial
  CRISPR gRNA sequence
ctggctaatttttttatttt

SEQ ID NO: 709208 - DNA, 20 bp, Artificial
  CRISPR gRNA sequence
gctaatttttttatttttag

SEQ ID NO: 709209 - DNA, 20 bp, Artificial
  CRISPR gRNA sequence
taatttttttatttttagta

SEQ ID NO: 709210 - DNA, 20 bp, Artificial
  CRISPR gRNA sequence
ttttttatttttagtagaga

SEQ ID NO: 709211 - DNA, 20 bp, Artificial
  CRISPR gRNA sequence
tttttatttttagtagagat

SEQ ID NO: 709212 - DNA, 20 bp, Artificial
  CRISPR gRNA sequence
ttttatttttagtagagatg

SEQ ID NO: 709213 - DNA, 20 bp, Artificial
  CRISPR gRNA sequence
gagatggggttttgtcttgt

SEQ ID NO: 709214 - DNA, 20 bp, Artificial
  CRISPR gRNA sequence
tggggttttgtcttgttggc

SEQ ID NO: 709215 - DNA, 20 bp, Artificial
  CRISPR gRNA sequence
ggggttttgtcttgttggcc

SEQ ID NO: 709216 - DNA, 20 bp, Artificial
  CRISPR gRNA sequence
ttttgtcttgttggccaggc

SEQ ID NO: 709217 - DNA, 20 bp, Artificial
  CRISPR gRNA sequence
tggtcttgaactctcgacct

SEQ ID NO: 709218 - DNA, 20 bp, Artificial
  CRISPR gRNA sequence
ggtcttgaactctcgacctc

SEQ ID NO: 709219 - DNA, 20 bp, Artificial
  CRISPR gRNA sequence
ctcaggtgatccacccacct

SEQ ID NO: 709220 - DNA, 20 bp, Artificial
  CRISPR gRNA sequence
ccacccaccttggcctccca

SEQ ID NO: 709221 - DNA, 20 bp, Artificial
  CRISPR gRNA sequence
accttggcctcccaaagtgc

SEQ ID NO: 709222 - DNA, 20 bp, Artificial
  CRISPR gRNA sequence
ccttggcctcccaaagtgct

SEQ ID NO: 709223 - DNA, 20 bp, Artificial
  CRISPR gRNA sequence
ctcccaaagtgctgggatta

SEQ ID NO: 709224 - DNA, 20 bp, Artificial
  CRISPR gRNA sequence
tcccaaagtgctgggattac

SEQ ID NO: 709225 - DNA, 20 bp, Artificial
  CRISPR gRNA sequence
agtgctgggattacaggtgt

SEQ ID NO: 709226 - DNA, 20 bp, Artificial
  CRISPR gRNA sequence
caggtgtgagccactacacc

SEQ ID NO: 709227 - DNA, 20 bp, Artificial
  CRISPR gRNA sequence
gccactacacctggcctact

SEQ ID NO: 709228 - DNA, 20 bp, Artificial
  CRISPR gRNA sequence
aaaaattaaactattttaaa

SEQ ID NO: 709229 - DNA, 20 bp, Artificial
  CRISPR gRNA sequence
aattaaactattttaaaaag

SEQ ID NO: 709230 - DNA, 20 bp, Artificial
  CRISPR gRNA sequence
attaaactattttaaaaaga

SEQ ID NO: 709231 - DNA, 20 bp, Artificial
  CRISPR gRNA sequence
tattttaaaaagaaggtgtc

SEQ ID NO: 709232 - DNA, 20 bp, Artificial
  CRISPR gRNA sequence
attttaaaaagaaggtgtcc

SEQ ID NO: 709233 - DNA, 20 bp, Artificial
  CRISPR gRNA sequence
aaggtgtccaggatgctgtt

SEQ ID NO: 709234 - DNA, 20 bp, Artificial
  CRISPR gRNA sequence
ccaggatgctgttgagcaca

SEQ ID NO: 709235 - DNA, 20 bp, Artificial
  CRISPR gRNA sequence
ggatgctgttgagcacacag

SEQ ID NO: 709236 - DNA, 20 bp, Artificial
  CRISPR gRNA sequence
gatgctgttgagcacacagc

SEQ ID NO: 709237 - DNA, 20 bp, Artificial
  CRISPR gRNA sequence
tgttgagcacacagcaggtt

SEQ ID NO: 709238 - DNA, 20 bp, Artificial
  CRISPR gRNA sequence
gttgagcacacagcaggttc

SEQ ID NO: 709239 - DNA, 20 bp, Artificial
  CRISPR gRNA sequence
gcacacagcaggttcaggaa

SEQ ID NO: 709240 - DNA, 20 bp, Artificial
  CRISPR gRNA sequence
cagcaggttcaggaaaagcc

SEQ ID NO: 709241 - DNA, 20 bp, Artificial
  CRISPR gRNA sequence
agcaggttcaggaaaagccc

SEQ ID NO: 709242 - DNA, 20 bp, Artificial
  CRISPR gRNA sequence
ggttcaggaaaagcccagga

SEQ ID NO: 709243 - DNA, 20 bp, Artificial
  CRISPR gRNA sequence
caggaaaagcccaggatggt

SEQ ID NO: 709244 - DNA, 20 bp, Artificial
  CRISPR gRNA sequence
gcccaggatggtaagtaaca

SEQ ID NO: 709245 - DNA, 20 bp, Artificial
  CRISPR gRNA sequence
ctgcactccgtcacactgaa

SEQ ID NO: 709246 - DNA, 20 bp, Artificial
  CRISPR gRNA sequence
actccgtcacactgaatgga

SEQ ID NO: 709247 - DNA, 20 bp, Artificial
  CRISPR gRNA sequence
cgtcacactgaatggaaagt

SEQ ID NO: 709248 - DNA, 20 bp, Artificial
  CRISPR gRNA sequence
tcacactgaatggaaagtca

SEQ ID NO: 709249 - DNA, 20 bp, Artificial
  CRISPR gRNA sequence
caataccgactctcccaaac

SEQ ID NO: 709250 - DNA, 20 bp, Artificial
  CRISPR gRNA sequence
cccaaacaagtgtaaaatca

SEQ ID NO: 709251 - DNA, 20 bp, Artificial
  CRISPR gRNA sequence
caaacaagtgtaaaatcaca

SEQ ID NO: 709252 - DNA, 20 bp, Artificial
  CRISPR gRNA sequence
aaacaagtgtaaaatcacag

SEQ ID NO: 709253 - DNA, 20 bp, Artificial
  CRISPR gRNA sequence
tgtaaaatcacagaggtaaa

SEQ ID NO: 709254 - DNA, 20 bp, Artificial
  CRISPR gRNA sequence
gtaaaatcacagaggtaaaa

SEQ ID NO: 709255 - DNA, 20 bp, Artificial
  CRISPR gRNA sequence
aaatcacagaggtaaaaagg

SEQ ID NO: 709256 - DNA, 20 bp, Artificial
  CRISPR gRNA sequence
agaggtaaaaaggcggaatc

SEQ ID NO: 709257 - DNA, 20 bp, Artificial
  CRISPR gRNA sequence
ggtaaaaaggcggaatctgg

SEQ ID NO: 709258 - DNA, 20 bp, Artificial
  CRISPR gRNA sequence
gtaaaaaggcggaatctgga

SEQ ID NO: 709259 - DNA, 20 bp, Artificial
  CRISPR gRNA sequence
tggaaggctctgacattgac

SEQ ID NO: 709260 - DNA, 20 bp, Artificial
  CRISPR gRNA sequence
gaaggctctgacattgacaa

SEQ ID NO: 709261 - DNA, 20 bp, Artificial
  CRISPR gRNA sequence
agagccgtgttacaacccat

SEQ ID NO: 709262 - DNA, 20 bp, Artificial
  CRISPR gRNA sequence
gagccgtgttacaacccatg

SEQ ID NO: 709263 - DNA, 20 bp, Artificial
  CRISPR gRNA sequence
aacccatgaggattttgata

SEQ ID NO: 709264 - DNA, 20 bp, Artificial
  CRISPR gRNA sequence
tgaggattttgataaagacc

SEQ ID NO: 709265 - DNA, 20 bp, Artificial
  CRISPR gRNA sequence
gacccagaacaaatcttgcc

SEQ ID NO: 709266 - DNA, 20 bp, Artificial
  CRISPR gRNA sequence
agaacaaatcttgccaagta

SEQ ID NO: 709267 - DNA, 20 bp, Artificial
  CRISPR gRNA sequence
aacaaatcttgccaagtaca

SEQ ID NO: 709268 - DNA, 20 bp, Artificial
  CRISPR gRNA sequence
acaaatcttgccaagtacag

SEQ ID NO: 709269 - DNA, 20 bp, Artificial
  CRISPR gRNA sequence
atcttgccaagtacagaggt

SEQ ID NO: 709270 - DNA, 20 bp, Artificial
  CRISPR gRNA sequence
aaaatgttgattctatctgc

SEQ ID NO: 709271 - DNA, 20 bp, Artificial
  CRISPR gRNA sequence
tatctgctagtcttatttgt

SEQ ID NO: 709272 - DNA, 20 bp, Artificial
  CRISPR gRNA sequence
ttgttggtttccttgccttt

SEQ ID NO: 709273 - DNA, 20 bp, Artificial
  CRISPR gRNA sequence
aataaccactgtcttcttgt

SEQ ID NO: 709274 - DNA, 20 bp, Artificial
  CRISPR gRNA sequence
tgtcttcttgtaagcctgtc

SEQ ID NO: 709275 - DNA, 20 bp, Artificial
  CRISPR gRNA sequence
gtaagcctgtctggtacccc

SEQ ID NO: 709276 - DNA, 20 bp, Artificial
  CRISPR gRNA sequence
taagcctgtctggtaccccc

SEQ ID NO: 709277 - DNA, 20 bp, Artificial
  CRISPR gRNA sequence
aagcctgtctggtaccccca

SEQ ID NO: 709278 - DNA, 20 bp, Artificial
  CRISPR gRNA sequence
tctggtacccccagggacac

SEQ ID NO: 709279 - DNA, 20 bp, Artificial
  CRISPR gRNA sequence
tacccccagggacacaagtc

SEQ ID NO: 709280 - DNA, 20 bp, Artificial
  CRISPR gRNA sequence
acccccagggacacaagtcc

SEQ ID NO: 709281 - DNA, 20 bp, Artificial
  CRISPR gRNA sequence
acacaagtccaggaccatgc

SEQ ID NO: 709282 - DNA, 20 bp, Artificial
  CRISPR gRNA sequence
cacaagtccaggaccatgct

SEQ ID NO: 709283 - DNA, 20 bp, Artificial
  CRISPR gRNA sequence
aagtccaggaccatgctggg

SEQ ID NO: 709284 - DNA, 20 bp, Artificial
  CRISPR gRNA sequence
tccaggaccatgctgggcag

SEQ ID NO: 709285 - DNA, 20 bp, Artificial
  CRISPR gRNA sequence
aggaccatgctgggcagcag

SEQ ID NO: 709286 - DNA, 20 bp, Artificial
  CRISPR gRNA sequence
ggaccatgctgggcagcagc

SEQ ID NO: 709287 - DNA, 20 bp, Artificial
  CRISPR gRNA sequence
agcagcaggcccccttgcac

SEQ ID NO: 709288 - DNA, 20 bp, Artificial
  CRISPR gRNA sequence
ggcccccttgcacaagtgca

SEQ ID NO: 709289 - DNA, 20 bp, Artificial
  CRISPR gRNA sequence
tgcacaagtgcacggtgtca

SEQ ID NO: 709290 - DNA, 20 bp, Artificial
  CRISPR gRNA sequence
gcacaagtgcacggtgtcac

SEQ ID NO: 709291 - DNA, 20 bp, Artificial
  CRISPR gRNA sequence
cggtgtcacaggctgctctg

SEQ ID NO: 709292 - DNA, 20 bp, Artificial
  CRISPR gRNA sequence
tgctctgaagcccacgctca

SEQ ID NO: 709293 - DNA, 20 bp, Artificial
  CRISPR gRNA sequence
ctctgaagcccacgctcacg

SEQ ID NO: 709294 - DNA, 20 bp, Artificial
  CRISPR gRNA sequence
gcgttctcacatgcgatgta

SEQ ID NO: 709295 - DNA, 20 bp, Artificial
  CRISPR gRNA sequence
cacatgcgatgtaaagctct

SEQ ID NO: 709296 - DNA, 20 bp, Artificial
  CRISPR gRNA sequence
tccctgttattctccacttt

SEQ ID NO: 709297 - DNA, 20 bp, Artificial
  CRISPR gRNA sequence
ttttagtcccctcccctctc

SEQ ID NO: 709298 - DNA, 20 bp, Artificial
  CRISPR gRNA sequence
ctctctggcctgtgattccc

SEQ ID NO: 709299 - DNA, 20 bp, Artificial
  CRISPR gRNA sequence
cctgtgattccccagtgctg

SEQ ID NO: 709300 - DNA, 20 bp, Artificial
  CRISPR gRNA sequence
ctgtgattccccagtgctgt

SEQ ID NO: 709301 - DNA, 20 bp, Artificial
  CRISPR gRNA sequence
tgattccccagtgctgtggg

SEQ ID NO: 709302 - DNA, 20 bp, Artificial
  CRISPR gRNA sequence
ttccccagtgctgtgggaag

SEQ ID NO: 709303 - DNA, 20 bp, Artificial
  CRISPR gRNA sequence
cagtgctgtgggaagcagaa

SEQ ID NO: 709304 - DNA, 20 bp, Artificial
  CRISPR gRNA sequence
agtgctgtgggaagcagaac

SEQ ID NO: 709305 - DNA, 20 bp, Artificial
  CRISPR gRNA sequence
gtgggaagcagaacaggccc

SEQ ID NO: 709306 - DNA, 20 bp, Artificial
  CRISPR gRNA sequence
tgggaagcagaacaggccca

SEQ ID NO: 709307 - DNA, 20 bp, Artificial
  CRISPR gRNA sequence
gggaagcagaacaggcccaa

SEQ ID NO: 709308 - DNA, 20 bp, Artificial
  CRISPR gRNA sequence
ggaagcagaacaggcccaag

SEQ ID NO: 709309 - DNA, 20 bp, Artificial
  CRISPR gRNA sequence
gaagcagaacaggcccaagg

SEQ ID NO: 709310 - DNA, 20 bp, Artificial
  CRISPR gRNA sequence
aagcagaacaggcccaaggg

SEQ ID NO: 709311 - DNA, 20 bp, Artificial
  CRISPR gRNA sequence
acaggcccaaggggggaatt

SEQ ID NO: 709312 - DNA, 20 bp, Artificial
  CRISPR gRNA sequence
cccaaggggggaatttggca

SEQ ID NO: 709313 - DNA, 20 bp, Artificial
  CRISPR gRNA sequence
caaggggggaatttggcaca

SEQ ID NO: 709314 - DNA, 20 bp, Artificial
  CRISPR gRNA sequence
aaggggggaatttggcacag

SEQ ID NO: 709315 - DNA, 20 bp, Artificial
  CRISPR gRNA sequence
gggaatttggcacagaggtt

SEQ ID NO: 709316 - DNA, 20 bp, Artificial
  CRISPR gRNA sequence
atttggcacagaggttcagc

SEQ ID NO: 709317 - DNA, 20 bp, Artificial
  CRISPR gRNA sequence
tttggcacagaggttcagct

SEQ ID NO: 709318 - DNA, 20 bp, Artificial
  CRISPR gRNA sequence
acagaggttcagctaggctt

SEQ ID NO: 709319 - DNA, 20 bp, Artificial
  CRISPR gRNA sequence
gttcagctaggctttggcaa

SEQ ID NO: 709320 - DNA, 20 bp, Artificial
  CRISPR gRNA sequence
ttcagctaggctttggcaac

SEQ ID NO: 709321 - DNA, 20 bp, Artificial
  CRISPR gRNA sequence
gctttggcaacaggtacccc

SEQ ID NO: 709322 - DNA, 20 bp, Artificial
  CRISPR gRNA sequence
gtaccccgagatgcaaaccc

SEQ ID NO: 709323 - DNA, 20 bp, Artificial
  CRISPR gRNA sequence
taccccgagatgcaaacccc

SEQ ID NO: 709324 - DNA, 20 bp, Artificial
  CRISPR gRNA sequence
gatgcaaaccccgggctcct

SEQ ID NO: 709325 - DNA, 20 bp, Artificial
  CRISPR gRNA sequence
tgcaaaccccgggctccttg

SEQ ID NO: 709326 - DNA, 20 bp, Artificial
  CRISPR gRNA sequence
caaaccccgggctccttgga

SEQ ID NO: 709327 - DNA, 20 bp, Artificial
  CRISPR gRNA sequence
aaaccccgggctccttggag

SEQ ID NO: 709328 - DNA, 20 bp, Artificial
  CRISPR gRNA sequence
ccccgggctccttggagagg

SEQ ID NO: 709329 - DNA, 20 bp, Artificial
  CRISPR gRNA sequence
cttggagaggcagctgattc

SEQ ID NO: 709330 - DNA, 20 bp, Artificial
  CRISPR gRNA sequence
ttggagaggcagctgattcc

SEQ ID NO: 709331 - DNA, 20 bp, Artificial
  CRISPR gRNA sequence
tggagaggcagctgattcca

SEQ ID NO: 709332 - DNA, 20 bp, Artificial
  CRISPR gRNA sequence
gaggcagctgattccagggc

SEQ ID NO: 709333 - DNA, 20 bp, Artificial
  CRISPR gRNA sequence
aggcagctgattccagggcc

SEQ ID NO: 709334 - DNA, 20 bp, Artificial
  CRISPR gRNA sequence
ggcagctgattccagggccg

SEQ ID NO: 709335 - DNA, 20 bp, Artificial
  CRISPR gRNA sequence
agctgattccagggccgggg

SEQ ID NO: 709336 - DNA, 20 bp, Artificial
  CRISPR gRNA sequence
gctgattccagggccggggc

SEQ ID NO: 709337 - DNA, 20 bp, Artificial
  CRISPR gRNA sequence
tgattccagggccggggcag

SEQ ID NO: 709338 - DNA, 20 bp, Artificial
  CRISPR gRNA sequence
gggccggggcaggagcacac

SEQ ID NO: 709339 - DNA, 20 bp, Artificial
  CRISPR gRNA sequence
ggggcaggagcacacaagtt

SEQ ID NO: 709340 - DNA, 20 bp, Artificial
  CRISPR gRNA sequence
caggagcacacaagttaagc

SEQ ID NO: 709341 - DNA, 20 bp, Artificial
  CRISPR gRNA sequence
aggagcacacaagttaagct

SEQ ID NO: 709342 - DNA, 20 bp, Artificial
  CRISPR gRNA sequence
aagttaagctgggaacatct

SEQ ID NO: 709343 - DNA, 20 bp, Artificial
  CRISPR gRNA sequence
agctgggaacatctcagaat

SEQ ID NO: 709344 - DNA, 20 bp, Artificial
  CRISPR gRNA sequence
gctgggaacatctcagaata

SEQ ID NO: 709345 - DNA, 20 bp, Artificial
  CRISPR gRNA sequence
ctgggaacatctcagaataa

SEQ ID NO: 709346 - DNA, 20 bp, Artificial
  CRISPR gRNA sequence
cagaataagggacgtgctca

SEQ ID NO: 709347 - DNA, 20 bp, Artificial
  CRISPR gRNA sequence
taagggacgtgctcaaagca

SEQ ID NO: 709348 - DNA, 20 bp, Artificial
  CRISPR gRNA sequence
aagggacgtgctcaaagcac

SEQ ID NO: 709349 - DNA, 20 bp, Artificial
  CRISPR gRNA sequence
acgtgctcaaagcacaggat

SEQ ID NO: 709350 - DNA, 20 bp, Artificial
  CRISPR gRNA sequence
cgtgctcaaagcacaggatg

SEQ ID NO: 709351 - DNA, 20 bp, Artificial
  CRISPR gRNA sequence
cacaggatgaggatacacca

SEQ ID NO: 709352 - DNA, 20 bp, Artificial
  CRISPR gRNA sequence
gaggatacaccaaagcacac

SEQ ID NO: 709353 - DNA, 20 bp, Artificial
  CRISPR gRNA sequence
ggatacaccaaagcacacaa

SEQ ID NO: 709354 - DNA, 20 bp, Artificial
  CRISPR gRNA sequence
acaccaaagcacacaagagc

SEQ ID NO: 709355 - DNA, 20 bp, Artificial
  CRISPR gRNA sequence
agcacacaagagccagctta

SEQ ID NO: 709356 - DNA, 20 bp, Artificial
  CRISPR gRNA sequence
gcacacaagagccagcttaa

SEQ ID NO: 709357 - DNA, 20 bp, Artificial
  CRISPR gRNA sequence
cacacaagagccagcttaaa

SEQ ID NO: 709358 - DNA, 20 bp, Artificial
  CRISPR gRNA sequence
acacaagagccagcttaaag

SEQ ID NO: 709359 - DNA, 20 bp, Artificial
  CRISPR gRNA sequence
gggctctccctgacctcatc

SEQ ID NO: 709360 - DNA, 20 bp, Artificial
  CRISPR gRNA sequence
ggctctccctgacctcatct

SEQ ID NO: 709361 - DNA, 20 bp, Artificial
  CRISPR gRNA sequence
gacctcatctgggaccattt

SEQ ID NO: 709362 - DNA, 20 bp, Artificial
  CRISPR gRNA sequence
agcaccaaaataaaaaatga

SEQ ID NO: 709363 - DNA, 20 bp, Artificial
  CRISPR gRNA sequence
ccaaaataaaaaatgatggt

SEQ ID NO: 709364 - DNA, 20 bp, Artificial
  CRISPR gRNA sequence
aaaataaaaaatgatggtaa

SEQ ID NO: 709365 - DNA, 20 bp, Artificial
  CRISPR gRNA sequence
agagattacaacccattgaa

SEQ ID NO: 709366 - DNA, 20 bp, Artificial
  CRISPR gRNA sequence
ttacaacccattgaacagaa

SEQ ID NO: 709367 - DNA, 20 bp, Artificial
  CRISPR gRNA sequence
tacaacccattgaacagaac

SEQ ID NO: 709368 - DNA, 20 bp, Artificial
  CRISPR gRNA sequence
acaacccattgaacagaaca

SEQ ID NO: 709369 - DNA, 20 bp, Artificial
  CRISPR gRNA sequence
cagggccccatgaatccata

SEQ ID NO: 709370 - DNA, 20 bp, Artificial
  CRISPR gRNA sequence
ccatacagatataaatatgt

SEQ ID NO: 709371 - DNA, 20 bp, Artificial
  CRISPR gRNA sequence
cagatataaatatgtaagtg

SEQ ID NO: 709372 - DNA, 20 bp, Artificial
  CRISPR gRNA sequence
atatgtaagtgaagaaaatt

SEQ ID NO: 709373 - DNA, 20 bp, Artificial
  CRISPR gRNA sequence
aagtgaagaaaattaagttc

SEQ ID NO: 709374 - DNA, 20 bp, Artificial
  CRISPR gRNA sequence
agtgaagaaaattaagttct

SEQ ID NO: 709375 - DNA, 20 bp, Artificial
  CRISPR gRNA sequence
aagaaaattaagttctgggc

SEQ ID NO: 709376 - DNA, 20 bp, Artificial
  CRISPR gRNA sequence
agaaaattaagttctgggct

SEQ ID NO: 709377 - DNA, 20 bp, Artificial
  CRISPR gRNA sequence
attaagttctgggctgggcg

SEQ ID NO: 709378 - DNA, 20 bp, Artificial
  CRISPR gRNA sequence
aagttctgggctgggcgcgg

SEQ ID NO: 709379 - DNA, 20 bp, Artificial
  CRISPR gRNA sequence
ttctgggctgggcgcggtgg

SEQ ID NO: 709380 - DNA, 20 bp, Artificial
  CRISPR gRNA sequence
cgcctgtcatccctgaactt

SEQ ID NO: 709381 - DNA, 20 bp, Artificial
  CRISPR gRNA sequence
gcctgtcatccctgaacttt

SEQ ID NO: 709382 - DNA, 20 bp, Artificial
  CRISPR gRNA sequence
ctgtcatccctgaactttgg

SEQ ID NO: 709383 - DNA, 20 bp, Artificial
  CRISPR gRNA sequence
tgtcatccctgaactttggg

SEQ ID NO: 709384 - DNA, 20 bp, Artificial
  CRISPR gRNA sequence
tccctgaactttgggaggcc

SEQ ID NO: 709385 - DNA, 20 bp, Artificial
  CRISPR gRNA sequence
ccctgaactttgggaggccg

SEQ ID NO: 709386 - DNA, 20 bp, Artificial
  CRISPR gRNA sequence
tgaactttgggaggccgagg

SEQ ID NO: 709387 - DNA, 20 bp, Artificial
  CRISPR gRNA sequence
gaactttgggaggccgaggc

SEQ ID NO: 709388 - DNA, 20 bp, Artificial
  CRISPR gRNA sequence
actttgggaggccgaggcgg

SEQ ID NO: 709389 - DNA, 20 bp, Artificial
  CRISPR gRNA sequence
ctttgggaggccgaggcggg

SEQ ID NO: 709390 - DNA, 20 bp, Artificial
  CRISPR gRNA sequence
ccgaggcgggaggaccactt

SEQ ID NO: 709391 - DNA, 20 bp, Artificial
  CRISPR gRNA sequence
cgaggcgggaggaccacttg

SEQ ID NO: 709392 - DNA, 20 bp, Artificial
  CRISPR gRNA sequence
gcgggaggaccacttgaggc

SEQ ID NO: 709393 - DNA, 20 bp, Artificial
  CRISPR gRNA sequence
cgggaggaccacttgaggcc

SEQ ID NO: 709394 - DNA, 20 bp, Artificial
  CRISPR gRNA sequence
ggaggaccacttgaggccag

SEQ ID NO: 709395 - DNA, 20 bp, Artificial
  CRISPR gRNA sequence
ccacttgaggccaggagttc

SEQ ID NO: 709396 - DNA, 20 bp, Artificial
  CRISPR gRNA sequence
tgaggccaggagttcgagac

SEQ ID NO: 709397 - DNA, 20 bp, Artificial
  CRISPR gRNA sequence
ccaggagttcgagaccagcc

SEQ ID NO: 709398 - DNA, 20 bp, Artificial
  CRISPR gRNA sequence
cgagaccagcctggccaaca

SEQ ID NO: 709399 - DNA, 20 bp, Artificial
  CRISPR gRNA sequence
ctactgaaaatacaaaaaat

SEQ ID NO: 709400 - DNA, 20 bp, Artificial
  CRISPR gRNA sequence
tgaaaatacaaaaaatgagc

SEQ ID NO: 709401 - DNA, 20 bp, Artificial
  CRISPR gRNA sequence
gaaaatacaaaaaatgagcc

SEQ ID NO: 709402 - DNA, 20 bp, Artificial
  CRISPR gRNA sequence
aaaatgagccaggcattgtg

SEQ ID NO: 709403 - DNA, 20 bp, Artificial
  CRISPR gRNA sequence
gtggcacacgcctgtaatcc

SEQ ID NO: 709404 - DNA, 20 bp, Artificial
  CRISPR gRNA sequence
cgcctgtaatcccagccact

SEQ ID NO: 709405 - DNA, 20 bp, Artificial
  CRISPR gRNA sequence
gcctgtaatcccagccactt

SEQ ID NO: 709406 - DNA, 20 bp, Artificial
  CRISPR gRNA sequence
ctgtaatcccagccacttgg

SEQ ID NO: 709407 - DNA, 20 bp, Artificial
  CRISPR gRNA sequence
tgtaatcccagccacttggg

SEQ ID NO: 709408 - DNA, 20 bp, Artificial
  CRISPR gRNA sequence
cccagccacttgggaggctg

SEQ ID NO: 709409 - DNA, 20 bp, Artificial
  CRISPR gRNA sequence
agccacttgggaggctgaag

SEQ ID NO: 709410 - DNA, 20 bp, Artificial
  CRISPR gRNA sequence
gccacttgggaggctgaagc

SEQ ID NO: 709411 - DNA, 20 bp, Artificial
  CRISPR gRNA sequence
cacttgggaggctgaagcag

SEQ ID NO: 709412 - DNA, 20 bp, Artificial
  CRISPR gRNA sequence
gcaggagaattgcttgaacc

SEQ ID NO: 709413 - DNA, 20 bp, Artificial
  CRISPR gRNA sequence
caggagaattgcttgaaccc

SEQ ID NO: 709414 - DNA, 20 bp, Artificial
  CRISPR gRNA sequence
ggagaattgcttgaacccag

SEQ ID NO: 709415 - DNA, 20 bp, Artificial
  CRISPR gRNA sequence
gagaattgcttgaacccagg

SEQ ID NO: 709416 - DNA, 20 bp, Artificial
  CRISPR gRNA sequence
aattgcttgaacccaggagg

SEQ ID NO: 709417 - DNA, 20 bp, Artificial
  CRISPR gRNA sequence
attgcttgaacccaggaggc

SEQ ID NO: 709418 - DNA, 20 bp, Artificial
  CRISPR gRNA sequence
ttgcttgaacccaggaggcg

SEQ ID NO: 709419 - DNA, 20 bp, Artificial
  CRISPR gRNA sequence
tgcttgaacccaggaggcgg

SEQ ID NO: 709420 - DNA, 20 bp, Artificial
  CRISPR gRNA sequence
aacccaggaggcgggggttg

SEQ ID NO: 709421 - DNA, 20 bp, Artificial
  CRISPR gRNA sequence
caggaggcgggggttgcagt

SEQ ID NO: 709422 - DNA, 20 bp, Artificial
  CRISPR gRNA sequence
ggcgggggttgcagtaagcc

SEQ ID NO: 709423 - DNA, 20 bp, Artificial
  CRISPR gRNA sequence
gagatcacactactgcactc

SEQ ID NO: 709424 - DNA, 20 bp, Artificial
  CRISPR gRNA sequence
cacactactgcactccagcc

SEQ ID NO: 709425 - DNA, 20 bp, Artificial
  CRISPR gRNA sequence
acactactgcactccagcct

SEQ ID NO: 709426 - DNA, 20 bp, Artificial
  CRISPR gRNA sequence
ctgcactccagcctgggtga

SEQ ID NO: 709427 - DNA, 20 bp, Artificial
  CRISPR gRNA sequence
gcactccagcctgggtgaca

SEQ ID NO: 709428 - DNA, 20 bp, Artificial
  CRISPR gRNA sequence
tccagcctgggtgacagagc

SEQ ID NO: 709429 - DNA, 20 bp, Artificial
  CRISPR gRNA sequence
caaaaaaataaacaaataaa

SEQ ID NO: 709430 - DNA, 20 bp, Artificial
  CRISPR gRNA sequence
aaaaaataaacaaataaata

SEQ ID NO: 709431 - DNA, 20 bp, Artificial
  CRISPR gRNA sequence
acaaataaatagagaaaatg

SEQ ID NO: 709432 - DNA, 20 bp, Artificial
  CRISPR gRNA sequence
caaataaatagagaaaatga

SEQ ID NO: 709433 - DNA, 20 bp, Artificial
  CRISPR gRNA sequence
gagaaaatgaaggtctgctg

SEQ ID NO: 709434 - DNA, 20 bp, Artificial
  CRISPR gRNA sequence
aatgaaggtctgctgaagaa

SEQ ID NO: 709435 - DNA, 20 bp, Artificial
  CRISPR gRNA sequence
atgaaggtctgctgaagaat

SEQ ID NO: 709436 - DNA, 20 bp, Artificial
  CRISPR gRNA sequence
tgaagaatgggctattgaca

SEQ ID NO: 709437 - DNA, 20 bp, Artificial
  CRISPR gRNA sequence
tgggctattgacatagtctc

SEQ ID NO: 709438 - DNA, 20 bp, Artificial
  CRISPR gRNA sequence
agtctcaagtaacgccccta

SEQ ID NO: 709439 - DNA, 20 bp, Artificial
  CRISPR gRNA sequence
aagtaacgcccctaaagact

SEQ ID NO: 709440 - DNA, 20 bp, Artificial
  CRISPR gRNA sequence
ctaaagacttagtaatgacc

SEQ ID NO: 709441 - DNA, 20 bp, Artificial
  CRISPR gRNA sequence
taaagacttagtaatgaccg

SEQ ID NO: 709442 - DNA, 20 bp, Artificial
  CRISPR gRNA sequence
aagacttagtaatgaccgag

SEQ ID NO: 709443 - DNA, 20 bp, Artificial
  CRISPR gRNA sequence
agtaatgaccgaggagcaaa

SEQ ID NO: 709444 - DNA, 20 bp, Artificial
  CRISPR gRNA sequence
taatgaccgaggagcaaatg

SEQ ID NO: 709445 - DNA, 20 bp, Artificial
  CRISPR gRNA sequence
aggagcaaatggagacgtca

SEQ ID NO: 709446 - DNA, 20 bp, Artificial
  CRISPR gRNA sequence
agcaaatggagacgtcacag

SEQ ID NO: 709447 - DNA, 20 bp, Artificial
  CRISPR gRNA sequence
caaatggagacgtcacagtg

SEQ ID NO: 709448 - DNA, 20 bp, Artificial
  CRISPR gRNA sequence
aatggagacgtcacagtgga

SEQ ID NO: 709449 - DNA, 20 bp, Artificial
  CRISPR gRNA sequence
atggagacgtcacagtggag

SEQ ID NO: 709450 - DNA, 20 bp, Artificial
  CRISPR gRNA sequence
gacgtcacagtggagaggcc

SEQ ID NO: 709451 - DNA, 20 bp, Artificial
  CRISPR gRNA sequence
gtcacagtggagaggcccgg

SEQ ID NO: 709452 - DNA, 20 bp, Artificial
  CRISPR gRNA sequence
tcacagtggagaggcccggc

SEQ ID NO: 709453 - DNA, 20 bp, Artificial
  CRISPR gRNA sequence
ggcaggacatcacctccgtc

SEQ ID NO: 709454 - DNA, 20 bp, Artificial
  CRISPR gRNA sequence
tcacctccgtcgagcgctca

SEQ ID NO: 709455 - DNA, 20 bp, Artificial
  CRISPR gRNA sequence
cgtcgagcgctcaaagtaca

SEQ ID NO: 709456 - DNA, 20 bp, Artificial
  CRISPR gRNA sequence
gcgctcaaagtacacagcac

SEQ ID NO: 709457 - DNA, 20 bp, Artificial
  CRISPR gRNA sequence
cgctcaaagtacacagcacc

SEQ ID NO: 709458 - DNA, 20 bp, Artificial
  CRISPR gRNA sequence
caaagtacacagcaccagga

SEQ ID NO: 709459 - DNA, 20 bp, Artificial
  CRISPR gRNA sequence
aaagtacacagcaccaggaa

SEQ ID NO: 709460 - DNA, 20 bp, Artificial
  CRISPR gRNA sequence
aagtacacagcaccaggaaa

SEQ ID NO: 709461 - DNA, 20 bp, Artificial
  CRISPR gRNA sequence
gtacacagcaccaggaaagg

SEQ ID NO: 709462 - DNA, 20 bp, Artificial
  CRISPR gRNA sequence
gaaagggagacatcgaaacc

SEQ ID NO: 709463 - DNA, 20 bp, Artificial
  CRISPR gRNA sequence
agggagacatcgaaacctgg

SEQ ID NO: 709464 - DNA, 20 bp, Artificial
  CRISPR gRNA sequence
gggagacatcgaaacctggc

SEQ ID NO: 709465 - DNA, 20 bp, Artificial
  CRISPR gRNA sequence
gaaacctggcaggacgccct

SEQ ID NO: 709466 - DNA, 20 bp, Artificial
  CRISPR gRNA sequence
aacctggcaggacgccctga

SEQ ID NO: 709467 - DNA, 20 bp, Artificial
  CRISPR gRNA sequence
cctggcaggacgccctgaga

SEQ ID NO: 709468 - DNA, 20 bp, Artificial
  CRISPR gRNA sequence
ggcaggacgccctgagagag

SEQ ID NO: 709469 - DNA, 20 bp, Artificial
  CRISPR gRNA sequence
caggacgccctgagagagaa

SEQ ID NO: 709470 - DNA, 20 bp, Artificial
  CRISPR gRNA sequence
aggacgccctgagagagaag

SEQ ID NO: 709471 - DNA, 20 bp, Artificial
  CRISPR gRNA sequence
cgccctgagagagaagaggc

SEQ ID NO: 709472 - DNA, 20 bp, Artificial
  CRISPR gRNA sequence
gaagaggccagcatcattcc

SEQ ID NO: 709473 - DNA, 20 bp, Artificial
  CRISPR gRNA sequence
aagaggccagcatcattcct

SEQ ID NO: 709474 - DNA, 20 bp, Artificial
  CRISPR gRNA sequence
gcatcattcctgggaccttc

SEQ ID NO: 709475 - DNA, 20 bp, Artificial
  CRISPR gRNA sequence
ttcctgggaccttccagccc

SEQ ID NO: 709476 - DNA, 20 bp, Artificial
  CRISPR gRNA sequence
atgcatgacctgaatccact

SEQ ID NO: 709477 - DNA, 20 bp, Artificial
  CRISPR gRNA sequence
tgcatgacctgaatccactc

SEQ ID NO: 709478 - DNA, 20 bp, Artificial
  CRISPR gRNA sequence
catgacctgaatccactcgg

SEQ ID NO: 709479 - DNA, 20 bp, Artificial
  CRISPR gRNA sequence
atccactcgggagaaaacac

SEQ ID NO: 709480 - DNA, 20 bp, Artificial
  CRISPR gRNA sequence
gaaaacaccagacaaaccca

SEQ ID NO: 709481 - DNA, 20 bp, Artificial
  CRISPR gRNA sequence
acaccagacaaacccaaagc

SEQ ID NO: 709482 - DNA, 20 bp, Artificial
  CRISPR gRNA sequence
caccagacaaacccaaagca

SEQ ID NO: 709483 - DNA, 20 bp, Artificial
  CRISPR gRNA sequence
ccagacaaacccaaagcaag

SEQ ID NO: 709484 - DNA, 20 bp, Artificial
  CRISPR gRNA sequence
aggagcatccatgaaatcac

SEQ ID NO: 709485 - DNA, 20 bp, Artificial
  CRISPR gRNA sequence
tcaccagcctgcgctcttcc

SEQ ID NO: 709486 - DNA, 20 bp, Artificial
  CRISPR gRNA sequence
cagcctgcgctcttcccagt

SEQ ID NO: 709487 - DNA, 20 bp, Artificial
  CRISPR gRNA sequence
gcgctcttcccagtaagtga

SEQ ID NO: 709488 - DNA, 20 bp, Artificial
  CRISPR gRNA sequence
cagtaagtgaaagaaacgcc

SEQ ID NO: 709489 - DNA, 20 bp, Artificial
  CRISPR gRNA sequence
agtaagtgaaagaaacgcct

SEQ ID NO: 709490 - DNA, 20 bp, Artificial
  CRISPR gRNA sequence
gtaagtgaaagaaacgcctg

SEQ ID NO: 709491 - DNA, 20 bp, Artificial
  CRISPR gRNA sequence
tgaaagaaacgcctggggaa

SEQ ID NO: 709492 - DNA, 20 bp, Artificial
  CRISPR gRNA sequence
aaacgcctggggaacggatc

SEQ ID NO: 709493 - DNA, 20 bp, Artificial
  CRISPR gRNA sequence
gcctggggaacggatccgga

SEQ ID NO: 709494 - DNA, 20 bp, Artificial
  CRISPR gRNA sequence
tggggaacggatccggacag

SEQ ID NO: 709495 - DNA, 20 bp, Artificial
  CRISPR gRNA sequence
ggggaacggatccggacaga

SEQ ID NO: 709496 - DNA, 20 bp, Artificial
  CRISPR gRNA sequence
ggaacggatccggacagaag

SEQ ID NO: 709497 - DNA, 20 bp, Artificial
  CRISPR gRNA sequence
atccggacagaaggagactc

SEQ ID NO: 709498 - DNA, 20 bp, Artificial
  CRISPR gRNA sequence
cagaaggagactcgagaaac

SEQ ID NO: 709499 - DNA, 20 bp, Artificial
  CRISPR gRNA sequence
ggagactcgagaaaccagac

SEQ ID NO: 709500 - DNA, 20 bp, Artificial
  CRISPR gRNA sequence
agacaagcaaatgtaacacg

SEQ ID NO: 709501 - DNA, 20 bp, Artificial
  CRISPR gRNA sequence
caaatgtaacacgtggccct

SEQ ID NO: 709502 - DNA, 20 bp, Artificial
  CRISPR gRNA sequence
tgtaacacgtggccctgagc

SEQ ID NO: 709503 - DNA, 20 bp, Artificial
  CRISPR gRNA sequence
taacacgtggccctgagctg

SEQ ID NO: 709504 - DNA, 20 bp, Artificial
  CRISPR gRNA sequence
agctggagtcctctgctata

SEQ ID NO: 709505 - DNA, 20 bp, Artificial
  CRISPR gRNA sequence
gctggagtcctctgctataa

SEQ ID NO: 709506 - DNA, 20 bp, Artificial
  CRISPR gRNA sequence
tctgctataaaggacattat

SEQ ID NO: 709507 - DNA, 20 bp, Artificial
  CRISPR gRNA sequence
ctgctataaaggacattatt

SEQ ID NO: 709508 - DNA, 20 bp, Artificial
  CRISPR gRNA sequence
ggacattattgggacaaata

SEQ ID NO: 709509 - DNA, 20 bp, Artificial
  CRISPR gRNA sequence
gacaaataaagaaacttcaa

SEQ ID NO: 709510 - DNA, 20 bp, Artificial
  CRISPR gRNA sequence
acaaataaagaaacttcaac

SEQ ID NO: 709511 - DNA, 20 bp, Artificial
  CRISPR gRNA sequence
caaataaagaaacttcaaca

SEQ ID NO: 709512 - DNA, 20 bp, Artificial
  CRISPR gRNA sequence
aagaaacttcaacagggcct

SEQ ID NO: 709513 - DNA, 20 bp, Artificial
  CRISPR gRNA sequence
cagggcctgagaattcattg

SEQ ID NO: 709514 - DNA, 20 bp, Artificial
  CRISPR gRNA sequence
agggcctgagaattcattgt

SEQ ID NO: 709515 - DNA, 20 bp, Artificial
  CRISPR gRNA sequence
attcattgtgggtcatgtat

SEQ ID NO: 709516 - DNA, 20 bp, Artificial
  CRISPR gRNA sequence
tctgtctgaaacacacactg

SEQ ID NO: 709517 - DNA, 20 bp, Artificial
  CRISPR gRNA sequence
gaaacacacactgaagtttt

SEQ ID NO: 709518 - DNA, 20 bp, Artificial
  CRISPR gRNA sequence
aaacacacactgaagttttc

SEQ ID NO: 709519 - DNA, 20 bp, Artificial
  CRISPR gRNA sequence
aacacacactgaagttttcg

SEQ ID NO: 709520 - DNA, 20 bp, Artificial
  CRISPR gRNA sequence
cacactgaagttttcggggt

SEQ ID NO: 709521 - DNA, 20 bp, Artificial
  CRISPR gRNA sequence
cactgaagttttcggggtga

SEQ ID NO: 709522 - DNA, 20 bp, Artificial
  CRISPR gRNA sequence
ttttcggggtgagagacatc

SEQ ID NO: 709523 - DNA, 20 bp, Artificial
  CRISPR gRNA sequence
cggggtgagagacatccagt

SEQ ID NO: 709524 - DNA, 20 bp, Artificial
  CRISPR gRNA sequence
gtgagagacatccagtcagt

SEQ ID NO: 709525 - DNA, 20 bp, Artificial
  CRISPR gRNA sequence
gtcagtcagttactctcaaa

SEQ ID NO: 709526 - DNA, 20 bp, Artificial
  CRISPR gRNA sequence
tcagttactctcaaatggtt

SEQ ID NO: 709527 - DNA, 20 bp, Artificial
  CRISPR gRNA sequence
cagttactctcaaatggttc

SEQ ID NO: 709528 - DNA, 20 bp, Artificial
  CRISPR gRNA sequence
catacttataccatttctat

SEQ ID NO: 709529 - DNA, 20 bp, Artificial
  CRISPR gRNA sequence
aaactgtttcaaaacaaaaa

SEQ ID NO: 709530 - DNA, 20 bp, Artificial
  CRISPR gRNA sequence
tctttcaacctaaatctccc

SEQ ID NO: 709531 - DNA, 20 bp, Artificial
  CRISPR gRNA sequence
cctaaatctccctggaataa

SEQ ID NO: 709532 - DNA, 20 bp, Artificial
  CRISPR gRNA sequence
ggaataatagaaaatgactc

SEQ ID NO: 709533 - DNA, 20 bp, Artificial
  CRISPR gRNA sequence
ctcaagtgctcataaaaatg

SEQ ID NO: 709534 - DNA, 20 bp, Artificial
  CRISPR gRNA sequence
tcaagtgctcataaaaatga

SEQ ID NO: 709535 - DNA, 20 bp, Artificial
  CRISPR gRNA sequence
tcataaaaatgaaggattaa

SEQ ID NO: 709536 - DNA, 20 bp, Artificial
  CRISPR gRNA sequence
tgaaggattaaaagaatttt

SEQ ID NO: 709537 - DNA, 20 bp, Artificial
  CRISPR gRNA sequence
gaaggattaaaagaatttta

SEQ ID NO: 709538 - DNA, 20 bp, Artificial
  CRISPR gRNA sequence
gattaaaagaattttaaggc

SEQ ID NO: 709539 - DNA, 20 bp, Artificial
  CRISPR gRNA sequence
attaaaagaattttaaggcc

SEQ ID NO: 709540 - DNA, 20 bp, Artificial
  CRISPR gRNA sequence
aagaattttaaggccaggca

SEQ ID NO: 709541 - DNA, 20 bp, Artificial
  CRISPR gRNA sequence
aattttaaggccaggcatgg

SEQ ID NO: 709542 - DNA, 20 bp, Artificial
  CRISPR gRNA sequence
gtggctcatgcctgcaaacc

SEQ ID NO: 709543 - DNA, 20 bp, Artificial
  CRISPR gRNA sequence
tgcctgcaaacccagcactt

SEQ ID NO: 709544 - DNA, 20 bp, Artificial
  CRISPR gRNA sequence
gcctgcaaacccagcacttt

SEQ ID NO: 709545 - DNA, 20 bp, Artificial
  CRISPR gRNA sequence
ctgcaaacccagcactttgg

SEQ ID NO: 709546 - DNA, 20 bp, Artificial
  CRISPR gRNA sequence
tgcaaacccagcactttggg

SEQ ID NO: 709547 - DNA, 20 bp, Artificial
  CRISPR gRNA sequence
acccagcactttgggaggcc

SEQ ID NO: 709548 - DNA, 20 bp, Artificial
  CRISPR gRNA sequence
cccagcactttgggaggccg

SEQ ID NO: 709549 - DNA, 20 bp, Artificial
  CRISPR gRNA sequence
agcactttgggaggccgagg

SEQ ID NO: 709550 - DNA, 20 bp, Artificial
  CRISPR gRNA sequence
gcactttgggaggccgaggc

SEQ ID NO: 709551 - DNA, 20 bp, Artificial
  CRISPR gRNA sequence
ctttgggaggccgaggcagg

SEQ ID NO: 709552 - DNA, 20 bp, Artificial
  CRISPR gRNA sequence
ggccgaggcaggcggatcat

SEQ ID NO: 709553 - DNA, 20 bp, Artificial
  CRISPR gRNA sequence
gccgaggcaggcggatcatg

SEQ ID NO: 709554 - DNA, 20 bp, Artificial
  CRISPR gRNA sequence
aggcaggcggatcatgaggt

SEQ ID NO: 709555 - DNA, 20 bp, Artificial
  CRISPR gRNA sequence
ggcaggcggatcatgaggtc

SEQ ID NO: 709556 - DNA, 20 bp, Artificial
  CRISPR gRNA sequence
caggcggatcatgaggtcag

SEQ ID NO: 709557 - DNA, 20 bp, Artificial
  CRISPR gRNA sequence
gatcatgaggtcaggagttt

SEQ ID NO: 709558 - DNA, 20 bp, Artificial
  CRISPR gRNA sequence
tgaggtcaggagtttgagac

SEQ ID NO: 709559 - DNA, 20 bp, Artificial
  CRISPR gRNA sequence
tcaggagtttgagaccagcc

SEQ ID NO: 709560 - DNA, 20 bp, Artificial
  CRISPR gRNA sequence
tgagaccagcctggccaaca

SEQ ID NO: 709561 - DNA, 20 bp, Artificial
  CRISPR gRNA sequence
tctactaaaaataccaaaat

SEQ ID NO: 709562 - DNA, 20 bp, Artificial
  CRISPR gRNA sequence
ctaaaaataccaaaattagc

SEQ ID NO: 709563 - DNA, 20 bp, Artificial
  CRISPR gRNA sequence
taaaaataccaaaattagcc

SEQ ID NO: 709564 - DNA, 20 bp, Artificial
  CRISPR gRNA sequence
ataccaaaattagccaggca

SEQ ID NO: 709565 - DNA, 20 bp, Artificial
  CRISPR gRNA sequence
ccaaaattagccaggcatgg

SEQ ID NO: 709566 - DNA, 20 bp, Artificial
  CRISPR gRNA sequence
aaattagccaggcatggtgg

SEQ ID NO: 709567 - DNA, 20 bp, Artificial
  CRISPR gRNA sequence
aattagccaggcatggtggc

SEQ ID NO: 709568 - DNA, 20 bp, Artificial
  CRISPR gRNA sequence
ttagccaggcatggtggcag

SEQ ID NO: 709569 - DNA, 20 bp, Artificial
  CRISPR gRNA sequence
gtggcaggagcctgtaatcc

SEQ ID NO: 709570 - DNA, 20 bp, Artificial
  CRISPR gRNA sequence
agcctgtaatcccagctact

SEQ ID NO: 709571 - DNA, 20 bp, Artificial
  CRISPR gRNA sequence
gcctgtaatcccagctactc

SEQ ID NO: 709572 - DNA, 20 bp, Artificial
  CRISPR gRNA sequence
ctgtaatcccagctactcag

SEQ ID NO: 709573 - DNA, 20 bp, Artificial
  CRISPR gRNA sequence
tgtaatcccagctactcagg

SEQ ID NO: 709574 - DNA, 20 bp, Artificial
  CRISPR gRNA sequence
tcccagctactcaggaggct

SEQ ID NO: 709575 - DNA, 20 bp, Artificial
  CRISPR gRNA sequence
cccagctactcaggaggctg

SEQ ID NO: 709576 - DNA, 20 bp, Artificial
  CRISPR gRNA sequence
agctactcaggaggctgagg

SEQ ID NO: 709577 - DNA, 20 bp, Artificial
  CRISPR gRNA sequence
gctactcaggaggctgaggc

SEQ ID NO: 709578 - DNA, 20 bp, Artificial
  CRISPR gRNA sequence
tactcaggaggctgaggcag

SEQ ID NO: 709579 - DNA, 20 bp, Artificial
  CRISPR gRNA sequence
ggagaatcacttgaacccgt

SEQ ID NO: 709580 - DNA, 20 bp, Artificial
  CRISPR gRNA sequence
gagaatcacttgaacccgtg

SEQ ID NO: 709581 - DNA, 20 bp, Artificial
  CRISPR gRNA sequence
aatcacttgaacccgtgagg

SEQ ID NO: 709582 - DNA, 20 bp, Artificial
  CRISPR gRNA sequence
tcacttgaacccgtgaggcg

SEQ ID NO: 709583 - DNA, 20 bp, Artificial
  CRISPR gRNA sequence
cacttgaacccgtgaggcgg

SEQ ID NO: 709584 - DNA, 20 bp, Artificial
  CRISPR gRNA sequence
aacccgtgaggcggaggttg

SEQ ID NO: 709585 - DNA, 20 bp, Artificial
  CRISPR gRNA sequence
ggcggaggttgcagtgaacc

SEQ ID NO: 709586 - DNA, 20 bp, Artificial
  CRISPR gRNA sequence
gaggttgcagtgaacccaga

SEQ ID NO: 709587 - DNA, 20 bp, Artificial
  CRISPR gRNA sequence
gcagtgaacccagatggcac

SEQ ID NO: 709588 - DNA, 20 bp, Artificial
  CRISPR gRNA sequence
cagatggcaccagtgcactc

SEQ ID NO: 709589 - DNA, 20 bp, Artificial
  CRISPR gRNA sequence
ggcaccagtgcactccagcc

SEQ ID NO: 709590 - DNA, 20 bp, Artificial
  CRISPR gRNA sequence
gcaccagtgcactccagcct

SEQ ID NO: 709591 - DNA, 20 bp, Artificial
  CRISPR gRNA sequence
gtgcactccagcctgggtga

SEQ ID NO: 709592 - DNA, 20 bp, Artificial
  CRISPR gRNA sequence
gcactccagcctgggtgaca

SEQ ID NO: 709593 - DNA, 20 bp, Artificial
  CRISPR gRNA sequence
tccagcctgggtgacagagc

SEQ ID NO: 709594 - DNA, 20 bp, Artificial
  CRISPR gRNA sequence
ctcaaaaaaaaaaaaaaaaa

SEQ ID NO: 709595 - DNA, 20 bp, Artificial
  CRISPR gRNA sequence
aaaaaaaaaaaaaagaattt

SEQ ID NO: 709596 - DNA, 20 bp, Artificial
  CRISPR gRNA sequence
aaaaaaaaagaattttagac

SEQ ID NO: 709597 - DNA, 20 bp, Artificial
  CRISPR gRNA sequence
aaaaaagaattttagaccag

SEQ ID NO: 709598 - DNA, 20 bp, Artificial
  CRISPR gRNA sequence
ttagaccagtggttctcaac

SEQ ID NO: 709599 - DNA, 20 bp, Artificial
  CRISPR gRNA sequence
tagaccagtggttctcaacc

SEQ ID NO: 709600 - DNA, 20 bp, Artificial
  CRISPR gRNA sequence
gaccagtggttctcaaccag

SEQ ID NO: 709601 - DNA, 20 bp, Artificial
  CRISPR gRNA sequence
accagtggttctcaaccagg

SEQ ID NO: 709602 - DNA, 20 bp, Artificial
  CRISPR gRNA sequence
ctcaaccaggaggttttccc

SEQ ID NO: 709603 - DNA, 20 bp, Artificial
  CRISPR gRNA sequence
tcaaccaggaggttttcccc

SEQ ID NO: 709604 - DNA, 20 bp, Artificial
  CRISPR gRNA sequence
caaccaggaggttttcccca

SEQ ID NO: 709605 - DNA, 20 bp, Artificial
  CRISPR gRNA sequence
aaccaggaggttttccccag

SEQ ID NO: 709606 - DNA, 20 bp, Artificial
  CRISPR gRNA sequence
ggttttccccaggggccaca

SEQ ID NO: 709607 - DNA, 20 bp, Artificial
  CRISPR gRNA sequence
aggggccacatggcaatgtc

SEQ ID NO: 709608 - DNA, 20 bp, Artificial
  CRISPR gRNA sequence
gggccacatggcaatgtcta

SEQ ID NO: 709609 - DNA, 20 bp, Artificial
  CRISPR gRNA sequence
gcaatgtctagagacatttt

SEQ ID NO: 709610 - DNA, 20 bp, Artificial
  CRISPR gRNA sequence
gagacatttttggttgtccc

SEQ ID NO: 709611 - DNA, 20 bp, Artificial
  CRISPR gRNA sequence
acatttttggttgtcccaag

SEQ ID NO: 709612 - DNA, 20 bp, Artificial
  CRISPR gRNA sequence
catttttggttgtcccaagt

SEQ ID NO: 709613 - DNA, 20 bp, Artificial
  CRISPR gRNA sequence
atttttggttgtcccaagta

SEQ ID NO: 709614 - DNA, 20 bp, Artificial
  CRISPR gRNA sequence
tttggttgtcccaagtaggg

SEQ ID NO: 709615 - DNA, 20 bp, Artificial
  CRISPR gRNA sequence
ttggttgtcccaagtaggga

SEQ ID NO: 709616 - DNA, 20 bp, Artificial
  CRISPR gRNA sequence
tcccaagtagggaaggttac

SEQ ID NO: 709617 - DNA, 20 bp, Artificial
  CRISPR gRNA sequence
tagggaaggttactggcatc

SEQ ID NO: 709618 - DNA, 20 bp, Artificial
  CRISPR gRNA sequence
gggaaggttactggcatcta

SEQ ID NO: 709619 - DNA, 20 bp, Artificial
  CRISPR gRNA sequence
ggaaggttactggcatctag

SEQ ID NO: 709620 - DNA, 20 bp, Artificial
  CRISPR gRNA sequence
gaaggttactggcatctaga

SEQ ID NO: 709621 - DNA, 20 bp, Artificial
  CRISPR gRNA sequence
aaggttactggcatctagag

SEQ ID NO: 709622 - DNA, 20 bp, Artificial
  CRISPR gRNA sequence
aggggctgtacaacgtccta

SEQ ID NO: 709623 - DNA, 20 bp, Artificial
  CRISPR gRNA sequence
ggggctgtacaacgtcctat

SEQ ID NO: 709624 - DNA, 20 bp, Artificial
  CRISPR gRNA sequence
ctgtacaacgtcctatagga

SEQ ID NO: 709625 - DNA, 20 bp, Artificial
  CRISPR gRNA sequence
tcctataggatagcgctcca

SEQ ID NO: 709626 - DNA, 20 bp, Artificial
  CRISPR gRNA sequence
taggatagcgctccacagca

SEQ ID NO: 709627 - DNA, 20 bp, Artificial
  CRISPR gRNA sequence
catccattcccaaatgtcaa

SEQ ID NO: 709628 - DNA, 20 bp, Artificial
  CRISPR gRNA sequence
tcccaaatgtcaatggtgcc

SEQ ID NO: 709629 - DNA, 20 bp, Artificial
  CRISPR gRNA sequence
cccaaatgtcaatggtgcca

SEQ ID NO: 709630 - DNA, 20 bp, Artificial
  CRISPR gRNA sequence
ccaaatgtcaatggtgccaa

SEQ ID NO: 709631 - DNA, 20 bp, Artificial
  CRISPR gRNA sequence
acgataaaatccccgtccta

SEQ ID NO: 709632 - DNA, 20 bp, Artificial
  CRISPR gRNA sequence
tccccgtcctacggctcacc

SEQ ID NO: 709633 - DNA, 20 bp, Artificial
  CRISPR gRNA sequence
cctacggctcacccagcacg

SEQ ID NO: 709634 - DNA, 20 bp, Artificial
  CRISPR gRNA sequence
tacttcaccatcctgtgcct

SEQ ID NO: 709635 - DNA, 20 bp, Artificial
  CRISPR gRNA sequence
acttcaccatcctgtgcctt

SEQ ID NO: 709636 - DNA, 20 bp, Artificial
  CRISPR gRNA sequence
taggctgctaatctgtgcaa

SEQ ID NO: 709637 - DNA, 20 bp, Artificial
  CRISPR gRNA sequence
aggctgctaatctgtgcaac

SEQ ID NO: 709638 - DNA, 20 bp, Artificial
  CRISPR gRNA sequence
ggctgctaatctgtgcaacg

SEQ ID NO: 709639 - DNA, 20 bp, Artificial
  CRISPR gRNA sequence
aatctgtgcaacggggataa

SEQ ID NO: 709640 - DNA, 20 bp, Artificial
  CRISPR gRNA sequence
tgtgcaacggggataacagt

SEQ ID NO: 709641 - DNA, 20 bp, Artificial
  CRISPR gRNA sequence
ggataacagtaagtacctca

SEQ ID NO: 709642 - DNA, 20 bp, Artificial
  CRISPR gRNA sequence
gataacagtaagtacctcac

SEQ ID NO: 709643 - DNA, 20 bp, Artificial
  CRISPR gRNA sequence
gtaagtacctcacaggccac

SEQ ID NO: 709644 - DNA, 20 bp, Artificial
  CRISPR gRNA sequence
aagtacctcacaggccaccg

SEQ ID NO: 709645 - DNA, 20 bp, Artificial
  CRISPR gRNA sequence
agtacctcacaggccaccgg

SEQ ID NO: 709646 - DNA, 20 bp, Artificial
  CRISPR gRNA sequence
tacctcacaggccaccggag

SEQ ID NO: 709647 - DNA, 20 bp, Artificial
  CRISPR gRNA sequence
ctcacaggccaccggaggag

SEQ ID NO: 709648 - DNA, 20 bp, Artificial
  CRISPR gRNA sequence
aggccaccggaggagtggat

SEQ ID NO: 709649 - DNA, 20 bp, Artificial
  CRISPR gRNA sequence
ctttgcaaatgcctgtcacc

SEQ ID NO: 709650 - DNA, 20 bp, Artificial
  CRISPR gRNA sequence
tttgcaaatgcctgtcaccg

SEQ ID NO: 709651 - DNA, 20 bp, Artificial
  CRISPR gRNA sequence
cctgtcaccgaggacacaca

SEQ ID NO: 709652 - DNA, 20 bp, Artificial
  CRISPR gRNA sequence
ctgtcaccgaggacacacac

SEQ ID NO: 709653 - DNA, 20 bp, Artificial
  CRISPR gRNA sequence
tcaccgaggacacacacggg

SEQ ID NO: 709654 - DNA, 20 bp, Artificial
  CRISPR gRNA sequence
caccgaggacacacacggga

SEQ ID NO: 709655 - DNA, 20 bp, Artificial
  CRISPR gRNA sequence
acgggaaggtcgatccactc

SEQ ID NO: 709656 - DNA, 20 bp, Artificial
  CRISPR gRNA sequence
cgggaaggtcgatccactcg

SEQ ID NO: 709657 - DNA, 20 bp, Artificial
  CRISPR gRNA sequence
gggaaggtcgatccactcga

SEQ ID NO: 709658 - DNA, 20 bp, Artificial
  CRISPR gRNA sequence
aggtcgatccactcgagggc

SEQ ID NO: 709659 - DNA, 20 bp, Artificial
  CRISPR gRNA sequence
cgatccactcgagggctggt

SEQ ID NO: 709660 - DNA, 20 bp, Artificial
  CRISPR gRNA sequence
tccactcgagggctggttgg

SEQ ID NO: 709661 - DNA, 20 bp, Artificial
  CRISPR gRNA sequence
ccactcgagggctggttggt

SEQ ID NO: 709662 - DNA, 20 bp, Artificial
  CRISPR gRNA sequence
ggcctctcatcgcacctgca

SEQ ID NO: 709663 - DNA, 20 bp, Artificial
  CRISPR gRNA sequence
catcgcacctgcacggacca

SEQ ID NO: 709664 - DNA, 20 bp, Artificial
  CRISPR gRNA sequence
cctgatgtgctcactgctca

SEQ ID NO: 709665 - DNA, 20 bp, Artificial
  CRISPR gRNA sequence
ctgatgtgctcactgctcaa

SEQ ID NO: 709666 - DNA, 20 bp, Artificial
  CRISPR gRNA sequence
gctcactgctcaaaggaacc

SEQ ID NO: 709667 - DNA, 20 bp, Artificial
  CRISPR gRNA sequence
tcactgctcaaaggaaccaa

SEQ ID NO: 709668 - DNA, 20 bp, Artificial
  CRISPR gRNA sequence
accaagagcaccctctgccc

SEQ ID NO: 709669 - DNA, 20 bp, Artificial
  CRISPR gRNA sequence
ccaagagcaccctctgcccc

SEQ ID NO: 709670 - DNA, 20 bp, Artificial
  CRISPR gRNA sequence
agcaccctctgccccaggtc

SEQ ID NO: 709671 - DNA, 20 bp, Artificial
  CRISPR gRNA sequence
gcaccctctgccccaggtct

SEQ ID NO: 709672 - DNA, 20 bp, Artificial
  CRISPR gRNA sequence
tctgccccaggtctgggatg

SEQ ID NO: 709673 - DNA, 20 bp, Artificial
  CRISPR gRNA sequence
ctgccccaggtctgggatgt

SEQ ID NO: 709674 - DNA, 20 bp, Artificial
  CRISPR gRNA sequence
gccccaggtctgggatgtgg

SEQ ID NO: 709675 - DNA, 20 bp, Artificial
  CRISPR gRNA sequence
ccccaggtctgggatgtggg

SEQ ID NO: 709676 - DNA, 20 bp, Artificial
  CRISPR gRNA sequence
ggtctgggatgtgggaggcc

SEQ ID NO: 709677 - DNA, 20 bp, Artificial
  CRISPR gRNA sequence
gtctgggatgtgggaggcca

SEQ ID NO: 709678 - DNA, 20 bp, Artificial
  CRISPR gRNA sequence
tctgggatgtgggaggccaa

SEQ ID NO: 709679 - DNA, 20 bp, Artificial
  CRISPR gRNA sequence
ctgggatgtgggaggccaag

SEQ ID NO: 709680 - DNA, 20 bp, Artificial
  CRISPR gRNA sequence
actcccctcccgtctgcctt

SEQ ID NO: 709681 - DNA, 20 bp, Artificial
  CRISPR gRNA sequence
ccgtctgcctttggcctctg

SEQ ID NO: 709682 - DNA, 20 bp, Artificial
  CRISPR gRNA sequence
cgtctgcctttggcctctgc

SEQ ID NO: 709683 - DNA, 20 bp, Artificial
  CRISPR gRNA sequence
ctgcctttggcctctgcggg

SEQ ID NO: 709684 - DNA, 20 bp, Artificial
  CRISPR gRNA sequence
ctttggcctctgcgggcagt

SEQ ID NO: 709685 - DNA, 20 bp, Artificial
  CRISPR gRNA sequence
cctctgcgggcagtcggaat

SEQ ID NO: 709686 - DNA, 20 bp, Artificial
  CRISPR gRNA sequence
ggcagtcggaattagtctaa

SEQ ID NO: 709687 - DNA, 20 bp, Artificial
  CRISPR gRNA sequence
tcggaattagtctaaaagct

SEQ ID NO: 709688 - DNA, 20 bp, Artificial
  CRISPR gRNA sequence
ggaattagtctaaaagcttg

SEQ ID NO: 709689 - DNA, 20 bp, Artificial
  CRISPR gRNA sequence
gaattagtctaaaagcttgg

SEQ ID NO: 709690 - DNA, 20 bp, Artificial
  CRISPR gRNA sequence
aattagtctaaaagcttgga

SEQ ID NO: 709691 - DNA, 20 bp, Artificial
  CRISPR gRNA sequence
ttagtctaaaagcttggagg

SEQ ID NO: 709692 - DNA, 20 bp, Artificial
  CRISPR gRNA sequence
tctaaaagcttggagggagc

SEQ ID NO: 709693 - DNA, 20 bp, Artificial
  CRISPR gRNA sequence
aagcttggagggagctagaa

SEQ ID NO: 709694 - DNA, 20 bp, Artificial
  CRISPR gRNA sequence
gagggagctagaacagcttc

SEQ ID NO: 709695 - DNA, 20 bp, Artificial
  CRISPR gRNA sequence
agggagctagaacagcttct

SEQ ID NO: 709696 - DNA, 20 bp, Artificial
  CRISPR gRNA sequence
gctagaacagcttctgggcc

SEQ ID NO: 709697 - DNA, 20 bp, Artificial
  CRISPR gRNA sequence
aacagcttctgggcccggca

SEQ ID NO: 709698 - DNA, 20 bp, Artificial
  CRISPR gRNA sequence
cagcttctgggcccggcaca

SEQ ID NO: 709699 - DNA, 20 bp, Artificial
  CRISPR gRNA sequence
gggcccggcacagagcctgc

SEQ ID NO: 709700 - DNA, 20 bp, Artificial
  CRISPR gRNA sequence
ggcccggcacagagcctgca

SEQ ID NO: 709701 - DNA, 20 bp, Artificial
  CRISPR gRNA sequence
cccggcacagagcctgcaag

SEQ ID NO: 709702 - DNA, 20 bp, Artificial
  CRISPR gRNA sequence
ccggcacagagcctgcaagg

SEQ ID NO: 709703 - DNA, 20 bp, Artificial
  CRISPR gRNA sequence
gcacagagcctgcaaggagg

SEQ ID NO: 709704 - DNA, 20 bp, Artificial
  CRISPR gRNA sequence
caaggaggaagtgctccgtg

SEQ ID NO: 709705 - DNA, 20 bp, Artificial
  CRISPR gRNA sequence
ctccgtgaagaccatgtgaa

SEQ ID NO: 709706 - DNA, 20 bp, Artificial
  CRISPR gRNA sequence
gaatgaacgaaccaataaac

SEQ ID NO: 709707 - DNA, 20 bp, Artificial
  CRISPR gRNA sequence
ataaaccagtgccaataaac

SEQ ID NO: 709708 - DNA, 20 bp, Artificial
  CRISPR gRNA sequence
cttccctccttcaccaccca

SEQ ID NO: 709709 - DNA, 20 bp, Artificial
  CRISPR gRNA sequence
ctccttcaccacccacggct

SEQ ID NO: 709710 - DNA, 20 bp, Artificial
  CRISPR gRNA sequence
tccttcaccacccacggctc

SEQ ID NO: 709711 - DNA, 20 bp, Artificial
  CRISPR gRNA sequence
cttcaccacccacggctcag

SEQ ID NO: 709712 - DNA, 20 bp, Artificial
  CRISPR gRNA sequence
ttcaccacccacggctcagg

SEQ ID NO: 709713 - DNA, 20 bp, Artificial
  CRISPR gRNA sequence
tcaccacccacggctcagga

SEQ ID NO: 709714 - DNA, 20 bp, Artificial
  CRISPR gRNA sequence
cacccacggctcaggaggga

SEQ ID NO: 709715 - DNA, 20 bp, Artificial
  CRISPR gRNA sequence
acccacggctcaggagggaa

SEQ ID NO: 709716 - DNA, 20 bp, Artificial
  CRISPR gRNA sequence
cccacggctcaggagggaaa

SEQ ID NO: 709717 - DNA, 20 bp, Artificial
  CRISPR gRNA sequence
ccacggctcaggagggaaag

SEQ ID NO: 709718 - DNA, 20 bp, Artificial
  CRISPR gRNA sequence
tcaggagggaaaggggcatc

SEQ ID NO: 709719 - DNA, 20 bp, Artificial
  CRISPR gRNA sequence
gagggaaaggggcatccggc

SEQ ID NO: 709720 - DNA, 20 bp, Artificial
  CRISPR gRNA sequence
aaaggggcatccggccagct

SEQ ID NO: 709721 - DNA, 20 bp, Artificial
  CRISPR gRNA sequence
cagctcggtccattctcacc

SEQ ID NO: 709722 - DNA, 20 bp, Artificial
  CRISPR gRNA sequence
attctcacccggtgctctgt

SEQ ID NO: 709723 - DNA, 20 bp, Artificial
  CRISPR gRNA sequence
ctctgtgagcttgcctgtct

SEQ ID NO: 709724 - DNA, 20 bp, Artificial
  CRISPR gRNA sequence
cttcactttctgtccatctt

SEQ ID NO: 709725 - DNA, 20 bp, Artificial
  CRISPR gRNA sequence
tttctgtccatcttgagcct

SEQ ID NO: 709726 - DNA, 20 bp, Artificial
  CRISPR gRNA sequence
ccatcttgagcctcggaacc

SEQ ID NO: 709727 - DNA, 20 bp, Artificial
  CRISPR gRNA sequence
agcctcggaacccagacccc

SEQ ID NO: 709728 - DNA, 20 bp, Artificial
  CRISPR gRNA sequence
gcctcggaacccagacccca

SEQ ID NO: 709729 - DNA, 20 bp, Artificial
  CRISPR gRNA sequence
cccagaccccaaggtcccac

SEQ ID NO: 709730 - DNA, 20 bp, Artificial
  CRISPR gRNA sequence
agaccccaaggtcccaccag

SEQ ID NO: 709731 - DNA, 20 bp, Artificial
  CRISPR gRNA sequence
cccaaggtcccaccagaagc

SEQ ID NO: 709732 - DNA, 20 bp, Artificial
  CRISPR gRNA sequence
caaggtcccaccagaagcta

SEQ ID NO: 709733 - DNA, 20 bp, Artificial
  CRISPR gRNA sequence
aaggtcccaccagaagctag

SEQ ID NO: 709734 - DNA, 20 bp, Artificial
  CRISPR gRNA sequence
aggtcccaccagaagctaga

SEQ ID NO: 709735 - DNA, 20 bp, Artificial
  CRISPR gRNA sequence
tagagggtcaaaaacgacct

SEQ ID NO: 709736 - DNA, 20 bp, Artificial
  CRISPR gRNA sequence
ggtcaaaaacgacctgagat

SEQ ID NO: 709737 - DNA, 20 bp, Artificial
  CRISPR gRNA sequence
gagataagatgtccaccatt

SEQ ID NO: 709738 - DNA, 20 bp, Artificial
  CRISPR gRNA sequence
agatgtccaccattgagtct

SEQ ID NO: 709739 - DNA, 20 bp, Artificial
  CRISPR gRNA sequence
gatgtccaccattgagtctc

SEQ ID NO: 709740 - DNA, 20 bp, Artificial
  CRISPR gRNA sequence
atgtccaccattgagtctca

SEQ ID NO: 709741 - DNA, 20 bp, Artificial
  CRISPR gRNA sequence
caccattgagtctcagggct

SEQ ID NO: 709742 - DNA, 20 bp, Artificial
  CRISPR gRNA sequence
tctcagggctcagttctttg

SEQ ID NO: 709743 - DNA, 20 bp, Artificial
  CRISPR gRNA sequence
ggctcagttctttgtagacc

SEQ ID NO: 709744 - DNA, 20 bp, Artificial
  CRISPR gRNA sequence
tctttgtagacctggcttct

SEQ ID NO: 709745 - DNA, 20 bp, Artificial
  CRISPR gRNA sequence
ctttgtagacctggcttctt

SEQ ID NO: 709746 - DNA, 20 bp, Artificial
  CRISPR gRNA sequence
tttgtagacctggcttctta

SEQ ID NO: 709747 - DNA, 20 bp, Artificial
  CRISPR gRNA sequence
ttgtagacctggcttcttag

SEQ ID NO: 709748 - DNA, 20 bp, Artificial
  CRISPR gRNA sequence
tagacctggcttcttagggg

SEQ ID NO: 709749 - DNA, 20 bp, Artificial
  CRISPR gRNA sequence
agacctggcttcttagggga

SEQ ID NO: 709750 - DNA, 20 bp, Artificial
  CRISPR gRNA sequence
ctgtaacaaaactgctctca

SEQ ID NO: 709751 - DNA, 20 bp, Artificial
  CRISPR gRNA sequence
gtaacaaaactgctctcaca

SEQ ID NO: 709752 - DNA, 20 bp, Artificial
  CRISPR gRNA sequence
taacaaaactgctctcacag

SEQ ID NO: 709753 - DNA, 20 bp, Artificial
  CRISPR gRNA sequence
actgctctcacagaggtttg

SEQ ID NO: 709754 - DNA, 20 bp, Artificial
  CRISPR gRNA sequence
gaagaaaaaaaataaactga

SEQ ID NO: 709755 - DNA, 20 bp, Artificial
  CRISPR gRNA sequence
aaaaaataaactgacggcaa

SEQ ID NO: 709756 - DNA, 20 bp, Artificial
  CRISPR gRNA sequence
ggcaatggaaattctaatac

SEQ ID NO: 709757 - DNA, 20 bp, Artificial
  CRISPR gRNA sequence
tctaatactagaaaaatgtc

SEQ ID NO: 709758 - DNA, 20 bp, Artificial
  CRISPR gRNA sequence
atactagaaaaatgtcaaga

SEQ ID NO: 709759 - DNA, 20 bp, Artificial
  CRISPR gRNA sequence
aatgtcaagaaagcaaacgc

SEQ ID NO: 709760 - DNA, 20 bp, Artificial
  CRISPR gRNA sequence
aagcaaacgccggtttcaat

SEQ ID NO: 709761 - DNA, 20 bp, Artificial
  CRISPR gRNA sequence
gccggtttcaatgagacact

SEQ ID NO: 709762 - DNA, 20 bp, Artificial
  CRISPR gRNA sequence
caatgagacactcagcctga

SEQ ID NO: 709763 - DNA, 20 bp, Artificial
  CRISPR gRNA sequence
aatgagacactcagcctgac

SEQ ID NO: 709764 - DNA, 20 bp, Artificial
  CRISPR gRNA sequence
acactcagcctgacaggtca

SEQ ID NO: 709765 - DNA, 20 bp, Artificial
  CRISPR gRNA sequence
agcctgacaggtcatggaaa

SEQ ID NO: 709766 - DNA, 20 bp, Artificial
  CRISPR gRNA sequence
gcctgacaggtcatggaaac

SEQ ID NO: 709767 - DNA, 20 bp, Artificial
  CRISPR gRNA sequence
acacaaaaaccccccttgca

SEQ ID NO: 709768 - DNA, 20 bp, Artificial
  CRISPR gRNA sequence
cacaaaaaccccccttgcac

SEQ ID NO: 709769 - DNA, 20 bp, Artificial
  CRISPR gRNA sequence
acaaaaaccccccttgcaca

SEQ ID NO: 709770 - DNA, 20 bp, Artificial
  CRISPR gRNA sequence
ccccccttgcacagggacca

SEQ ID NO: 709771 - DNA, 20 bp, Artificial
  CRISPR gRNA sequence
gtcaaattcaaaacatgcct

SEQ ID NO: 709772 - DNA, 20 bp, Artificial
  CRISPR gRNA sequence
aaattcaaaacatgcctcag

SEQ ID NO: 709773 - DNA, 20 bp, Artificial
  CRISPR gRNA sequence
tggactgtgtttttgtgccc

SEQ ID NO: 709774 - DNA, 20 bp, Artificial
  CRISPR gRNA sequence
tgtttttgtgcccaagtcaa

SEQ ID NO: 709775 - DNA, 20 bp, Artificial
  CRISPR gRNA sequence
tttgtgcccaagtcaacagt

SEQ ID NO: 709776 - DNA, 20 bp, Artificial
  CRISPR gRNA sequence
agtcaacagtcagcctatgc

SEQ ID NO: 709777 - DNA, 20 bp, Artificial
  CRISPR gRNA sequence
gtcaacagtcagcctatgca

SEQ ID NO: 709778 - DNA, 20 bp, Artificial
  CRISPR gRNA sequence
tcaacagtcagcctatgcaa

SEQ ID NO: 709779 - DNA, 20 bp, Artificial
  CRISPR gRNA sequence
gcctatgcaagggcctctgc

SEQ ID NO: 709780 - DNA, 20 bp, Artificial
  CRISPR gRNA sequence
cctatgcaagggcctctgca

SEQ ID NO: 709781 - DNA, 20 bp, Artificial
  CRISPR gRNA sequence
ctatgcaagggcctctgcaa

SEQ ID NO: 709782 - DNA, 20 bp, Artificial
  CRISPR gRNA sequence
aagggcctctgcaagggtcc

SEQ ID NO: 709783 - DNA, 20 bp, Artificial
  CRISPR gRNA sequence
agggcctctgcaagggtcct

SEQ ID NO: 709784 - DNA, 20 bp, Artificial
  CRISPR gRNA sequence
gggcctctgcaagggtcctg

SEQ ID NO: 709785 - DNA, 20 bp, Artificial
  CRISPR gRNA sequence
gcctctgcaagggtcctggg

SEQ ID NO: 709786 - DNA, 20 bp, Artificial
  CRISPR gRNA sequence
tgcaagggtcctggggagat

SEQ ID NO: 709787 - DNA, 20 bp, Artificial
  CRISPR gRNA sequence
gcaagggtcctggggagatc

SEQ ID NO: 709788 - DNA, 20 bp, Artificial
  CRISPR gRNA sequence
caagggtcctggggagatca

SEQ ID NO: 709789 - DNA, 20 bp, Artificial
  CRISPR gRNA sequence
aagggtcctggggagatcag

SEQ ID NO: 709790 - DNA, 20 bp, Artificial
  CRISPR gRNA sequence
gtcctggggagatcagggga

SEQ ID NO: 709791 - DNA, 20 bp, Artificial
  CRISPR gRNA sequence
tcctggggagatcaggggac

SEQ ID NO: 709792 - DNA, 20 bp, Artificial
  CRISPR gRNA sequence
ggggagatcaggggacgggc

SEQ ID NO: 709793 - DNA, 20 bp, Artificial
  CRISPR gRNA sequence
gggagatcaggggacgggcc

SEQ ID NO: 709794 - DNA, 20 bp, Artificial
  CRISPR gRNA sequence
ggagatcaggggacgggcca

SEQ ID NO: 709795 - DNA, 20 bp, Artificial
  CRISPR gRNA sequence
tcaggggacgggccagggcc

SEQ ID NO: 709796 - DNA, 20 bp, Artificial
  CRISPR gRNA sequence
gacgggccagggcctggcct

SEQ ID NO: 709797 - DNA, 20 bp, Artificial
  CRISPR gRNA sequence
acgggccagggcctggcctt

SEQ ID NO: 709798 - DNA, 20 bp, Artificial
  CRISPR gRNA sequence
ccagggcctggccttaggct

SEQ ID NO: 709799 - DNA, 20 bp, Artificial
  CRISPR gRNA sequence
ctggccttaggctgagcacg

SEQ ID NO: 709800 - DNA, 20 bp, Artificial
  CRISPR gRNA sequence
taggctgagcacgtggctct

SEQ ID NO: 709801 - DNA, 20 bp, Artificial
  CRISPR gRNA sequence
aggctgagcacgtggctctt

SEQ ID NO: 709802 - DNA, 20 bp, Artificial
  CRISPR gRNA sequence
ctgagcacgtggctcttggg

SEQ ID NO: 709803 - DNA, 20 bp, Artificial
  CRISPR gRNA sequence
tgagcacgtggctcttgggt

SEQ ID NO: 709804 - DNA, 20 bp, Artificial
  CRISPR gRNA sequence
ctcttgggtaggcattgcga

SEQ ID NO: 709805 - DNA, 20 bp, Artificial
  CRISPR gRNA sequence
ttgggtaggcattgcgatgg

SEQ ID NO: 709806 - DNA, 20 bp, Artificial
  CRISPR gRNA sequence
gtaggcattgcgatggtgga

SEQ ID NO: 709807 - DNA, 20 bp, Artificial
  CRISPR gRNA sequence
aggcattgcgatggtggaca

SEQ ID NO: 709808 - DNA, 20 bp, Artificial
  CRISPR gRNA sequence
attgcgatggtggacagagc

SEQ ID NO: 709809 - DNA, 20 bp, Artificial
  CRISPR gRNA sequence
gcgatggtggacagagctgg

SEQ ID NO: 709810 - DNA, 20 bp, Artificial
  CRISPR gRNA sequence
cgatggtggacagagctggc

SEQ ID NO: 709811 - DNA, 20 bp, Artificial
  CRISPR gRNA sequence
gatggtggacagagctggca

SEQ ID NO: 709812 - DNA, 20 bp, Artificial
  CRISPR gRNA sequence
atggtggacagagctggcag

SEQ ID NO: 709813 - DNA, 20 bp, Artificial
  CRISPR gRNA sequence
tggtggacagagctggcagg

SEQ ID NO: 709814 - DNA, 20 bp, Artificial
  CRISPR gRNA sequence
tggacagagctggcaggggg

SEQ ID NO: 709815 - DNA, 20 bp, Artificial
  CRISPR gRNA sequence
ggacagagctggcaggggga

SEQ ID NO: 709816 - DNA, 20 bp, Artificial
  CRISPR gRNA sequence
cagagctggcagggggaagg

SEQ ID NO: 709817 - DNA, 20 bp, Artificial
  CRISPR gRNA sequence
gagctggcagggggaaggaa

SEQ ID NO: 709818 - DNA, 20 bp, Artificial
  CRISPR gRNA sequence
agctggcagggggaaggaag

SEQ ID NO: 709819 - DNA, 20 bp, Artificial
  CRISPR gRNA sequence
gctggcagggggaaggaaga

SEQ ID NO: 709820 - DNA, 20 bp, Artificial
  CRISPR gRNA sequence
ctggcagggggaaggaagag

SEQ ID NO: 709821 - DNA, 20 bp, Artificial
  CRISPR gRNA sequence
cagggggaaggaagagggga

SEQ ID NO: 709822 - DNA, 20 bp, Artificial
  CRISPR gRNA sequence
agggggaaggaagaggggac

SEQ ID NO: 709823 - DNA, 20 bp, Artificial
  CRISPR gRNA sequence
gggggaaggaagaggggaca

SEQ ID NO: 709824 - DNA, 20 bp, Artificial
  CRISPR gRNA sequence
aaggaagaggggacagggct

SEQ ID NO: 709825 - DNA, 20 bp, Artificial
  CRISPR gRNA sequence
cctttacaaaccaaaacccc

SEQ ID NO: 709826 - DNA, 20 bp, Artificial
  CRISPR gRNA sequence
ctttacaaaccaaaacccct

SEQ ID NO: 709827 - DNA, 20 bp, Artificial
  CRISPR gRNA sequence
caaaccaaaacccctaggac

SEQ ID NO: 709828 - DNA, 20 bp, Artificial
  CRISPR gRNA sequence
aacccctaggaccagtgcct

SEQ ID NO: 709829 - DNA, 20 bp, Artificial
  CRISPR gRNA sequence
acccctaggaccagtgcctg

SEQ ID NO: 709830 - DNA, 20 bp, Artificial
  CRISPR gRNA sequence
ctaggaccagtgcctgaggc

SEQ ID NO: 709831 - DNA, 20 bp, Artificial
  CRISPR gRNA sequence
gaggctggctgtgccactgc

SEQ ID NO: 709832 - DNA, 20 bp, Artificial
  CRISPR gRNA sequence
aggctggctgtgccactgcc

SEQ ID NO: 709833 - DNA, 20 bp, Artificial
  CRISPR gRNA sequence
tgtgccactgccaggctgtg

SEQ ID NO: 709834 - DNA, 20 bp, Artificial
  CRISPR gRNA sequence
actgccaggctgtgtggccc

SEQ ID NO: 709835 - DNA, 20 bp, Artificial
  CRISPR gRNA sequence
ctgccaggctgtgtggccct

SEQ ID NO: 709836 - DNA, 20 bp, Artificial
  CRISPR gRNA sequence
caggctgtgtggccctgggc

SEQ ID NO: 709837 - DNA, 20 bp, Artificial
  CRISPR gRNA sequence
ggccagccgtccaccttgct

SEQ ID NO: 709838 - DNA, 20 bp, Artificial
  CRISPR gRNA sequence
tgagccctgcctcctccttg

SEQ ID NO: 709839 - DNA, 20 bp, Artificial
  CRISPR gRNA sequence
tgcctcctccttgcagaaca

SEQ ID NO: 709840 - DNA, 20 bp, Artificial
  CRISPR gRNA sequence
gcctcctccttgcagaacaa

SEQ ID NO: 709841 - DNA, 20 bp, Artificial
  CRISPR gRNA sequence
tgcagaacaaaggtcatcac

SEQ ID NO: 709842 - DNA, 20 bp, Artificial
  CRISPR gRNA sequence
gcagaacaaaggtcatcact

SEQ ID NO: 709843 - DNA, 20 bp, Artificial
  CRISPR gRNA sequence
cagaacaaaggtcatcactg

SEQ ID NO: 709844 - DNA, 20 bp, Artificial
  CRISPR gRNA sequence
agaacaaaggtcatcactgg

SEQ ID NO: 709845 - DNA, 20 bp, Artificial
  CRISPR gRNA sequence
aacaaaggtcatcactgggg

SEQ ID NO: 709846 - DNA, 20 bp, Artificial
  CRISPR gRNA sequence
aggtcatcactgggggagta

SEQ ID NO: 709847 - DNA, 20 bp, Artificial
  CRISPR gRNA sequence
ggtcatcactgggggagtac

SEQ ID NO: 709848 - DNA, 20 bp, Artificial
  CRISPR gRNA sequence
catcactgggggagtacagg

SEQ ID NO: 709849 - DNA, 20 bp, Artificial
  CRISPR gRNA sequence
gggagtacaggaagcctgta

SEQ ID NO: 709850 - DNA, 20 bp, Artificial
  CRISPR gRNA sequence
ggagtacaggaagcctgtat

SEQ ID NO: 709851 - DNA, 20 bp, Artificial
  CRISPR gRNA sequence
agtacaggaagcctgtatgg

SEQ ID NO: 709852 - DNA, 20 bp, Artificial
  CRISPR gRNA sequence
tgggagcccaccttgcaaat

SEQ ID NO: 709853 - DNA, 20 bp, Artificial
  CRISPR gRNA sequence
caccttgcaaatcagaaacg

SEQ ID NO: 709854 - DNA, 20 bp, Artificial
  CRISPR gRNA sequence
accttgcaaatcagaaacga

SEQ ID NO: 709855 - DNA, 20 bp, Artificial
  CRISPR gRNA sequence
gcaaatcagaaacgaaggct

SEQ ID NO: 709856 - DNA, 20 bp, Artificial
  CRISPR gRNA sequence
ggctcagacgattcccccat

SEQ ID NO: 709857 - DNA, 20 bp, Artificial
  CRISPR gRNA sequence
ctcagacgattcccccatca

SEQ ID NO: 709858 - DNA, 20 bp, Artificial
  CRISPR gRNA sequence
acgattcccccatcagagcc

SEQ ID NO: 709859 - DNA, 20 bp, Artificial
  CRISPR gRNA sequence
tcccccatcagagcccagca

SEQ ID NO: 709860 - DNA, 20 bp, Artificial
  CRISPR gRNA sequence
ccccatcagagcccagcaca

SEQ ID NO: 709861 - DNA, 20 bp, Artificial
  CRISPR gRNA sequence
catcagagcccagcacagag

SEQ ID NO: 709862 - DNA, 20 bp, Artificial
  CRISPR gRNA sequence
atcagagcccagcacagagc

SEQ ID NO: 709863 - DNA, 20 bp, Artificial
  CRISPR gRNA sequence
ggcacccaatccatgccatg

SEQ ID NO: 709864 - DNA, 20 bp, Artificial
  CRISPR gRNA sequence
aatccatgccatgcagtgct

SEQ ID NO: 709865 - DNA, 20 bp, Artificial
  CRISPR gRNA sequence
atccatgccatgcagtgctg

SEQ ID NO: 709866 - DNA, 20 bp, Artificial
  CRISPR gRNA sequence
catgccatgcagtgctgagg

SEQ ID NO: 709867 - DNA, 20 bp, Artificial
  CRISPR gRNA sequence
tgcagtgctgaggaagaccc

SEQ ID NO: 709868 - DNA, 20 bp, Artificial
  CRISPR gRNA sequence
gaagaccctggcctgccttg

SEQ ID NO: 709869 - DNA, 20 bp, Artificial
  CRISPR gRNA sequence
aagaccctggcctgccttga

SEQ ID NO: 709870 - DNA, 20 bp, Artificial
  CRISPR gRNA sequence
agaccctggcctgccttgaa

SEQ ID NO: 709871 - DNA, 20 bp, Artificial
  CRISPR gRNA sequence
gaccctggcctgccttgaag

SEQ ID NO: 709872 - DNA, 20 bp, Artificial
  CRISPR gRNA sequence
cctgccttgaaggggctgcc

SEQ ID NO: 709873 - DNA, 20 bp, Artificial
  CRISPR gRNA sequence
ctgccttgaaggggctgccc

SEQ ID NO: 709874 - DNA, 20 bp, Artificial
  CRISPR gRNA sequence
gccttgaaggggctgcccag

SEQ ID NO: 709875 - DNA, 20 bp, Artificial
  CRISPR gRNA sequence
cttgaaggggctgcccagga

SEQ ID NO: 709876 - DNA, 20 bp, Artificial
  CRISPR gRNA sequence
tgaaggggctgcccaggaga

SEQ ID NO: 709877 - DNA, 20 bp, Artificial
  CRISPR gRNA sequence
aggggctgcccaggagagag

SEQ ID NO: 709878 - DNA, 20 bp, Artificial
  CRISPR gRNA sequence
ggggctgcccaggagagaga

SEQ ID NO: 709879 - DNA, 20 bp, Artificial
  CRISPR gRNA sequence
cccaggagagagaaggtgct

SEQ ID NO: 709880 - DNA, 20 bp, Artificial
  CRISPR gRNA sequence
agagagaaggtgcttggcac

SEQ ID NO: 709881 - DNA, 20 bp, Artificial
  CRISPR gRNA sequence
agaaggtgcttggcacaaga

SEQ ID NO: 709882 - DNA, 20 bp, Artificial
  CRISPR gRNA sequence
ggtgcttggcacaagatagc

SEQ ID NO: 709883 - DNA, 20 bp, Artificial
  CRISPR gRNA sequence
gtgcttggcacaagatagct

SEQ ID NO: 709884 - DNA, 20 bp, Artificial
  CRISPR gRNA sequence
gcttggcacaagatagctgg

SEQ ID NO: 709885 - DNA, 20 bp, Artificial
  CRISPR gRNA sequence
tagctgggagccccctgccc

SEQ ID NO: 709886 - DNA, 20 bp, Artificial
  CRISPR gRNA sequence
agctgggagccccctgcccc

SEQ ID NO: 709887 - DNA, 20 bp, Artificial
  CRISPR gRNA sequence
gggagccccctgccccaggt

SEQ ID NO: 709888 - DNA, 20 bp, Artificial
  CRISPR gRNA sequence
gagccccctgccccaggtga

SEQ ID NO: 709889 - DNA, 20 bp, Artificial
  CRISPR gRNA sequence
cccctgccccaggtgagagc

SEQ ID NO: 709890 - DNA, 20 bp, Artificial
  CRISPR gRNA sequence
ctgccccaggtgagagctag

SEQ ID NO: 709891 - DNA, 20 bp, Artificial
  CRISPR gRNA sequence
gctagaagacacacgctgta

SEQ ID NO: 709892 - DNA, 20 bp, Artificial
  CRISPR gRNA sequence
gctgtatagacgaccctgcc

SEQ ID NO: 709893 - DNA, 20 bp, Artificial
  CRISPR gRNA sequence
tatagacgaccctgcctgga

SEQ ID NO: 709894 - DNA, 20 bp, Artificial
  CRISPR gRNA sequence
atagacgaccctgcctggac

SEQ ID NO: 709895 - DNA, 20 bp, Artificial
  CRISPR gRNA sequence
acgaccctgcctggacaggt

SEQ ID NO: 709896 - DNA, 20 bp, Artificial
  CRISPR gRNA sequence
cgaccctgcctggacaggtg

SEQ ID NO: 709897 - DNA, 20 bp, Artificial
  CRISPR gRNA sequence
accctgcctggacaggtgag

SEQ ID NO: 709898 - DNA, 20 bp, Artificial
  CRISPR gRNA sequence
ccctgcctggacaggtgagg

SEQ ID NO: 709899 - DNA, 20 bp, Artificial
  CRISPR gRNA sequence
cctgcctggacaggtgagga

SEQ ID NO: 709900 - DNA, 20 bp, Artificial
  CRISPR gRNA sequence
tggacaggtgaggagggttc

SEQ ID NO: 709901 - DNA, 20 bp, Artificial
  CRISPR gRNA sequence
tgaggagggttccagctccc

SEQ ID NO: 709902 - DNA, 20 bp, Artificial
  CRISPR gRNA sequence
gaggagggttccagctccca

SEQ ID NO: 709903 - DNA, 20 bp, Artificial
  CRISPR gRNA sequence
aggagggttccagctcccaa

SEQ ID NO: 709904 - DNA, 20 bp, Artificial
  CRISPR gRNA sequence
tccagctcccaagggctgcc

SEQ ID NO: 709905 - DNA, 20 bp, Artificial
  CRISPR gRNA sequence
agctcccaagggctgcctgg

SEQ ID NO: 709906 - DNA, 20 bp, Artificial
  CRISPR gRNA sequence
ctcccaagggctgcctggaa

SEQ ID NO: 709907 - DNA, 20 bp, Artificial
  CRISPR gRNA sequence
caagggctgcctggaagagc

SEQ ID NO: 709908 - DNA, 20 bp, Artificial
  CRISPR gRNA sequence
gctgcctggaagagctggcc

SEQ ID NO: 709909 - DNA, 20 bp, Artificial
  CRISPR gRNA sequence
tgcctggaagagctggccca

SEQ ID NO: 709910 - DNA, 20 bp, Artificial
  CRISPR gRNA sequence
gcctggaagagctggcccag

SEQ ID NO: 709911 - DNA, 20 bp, Artificial
  CRISPR gRNA sequence
ggaagagctggcccagaggc

SEQ ID NO: 709912 - DNA, 20 bp, Artificial
  CRISPR gRNA sequence
gaagagctggcccagaggct

SEQ ID NO: 709913 - DNA, 20 bp, Artificial
  CRISPR gRNA sequence
gagctggcccagaggctggg

SEQ ID NO: 709914 - DNA, 20 bp, Artificial
  CRISPR gRNA sequence
agctggcccagaggctgggc

SEQ ID NO: 709915 - DNA, 20 bp, Artificial
  CRISPR gRNA sequence
gctggcccagaggctgggca

SEQ ID NO: 709916 - DNA, 20 bp, Artificial
  CRISPR gRNA sequence
cccagaggctgggcagggat

SEQ ID NO: 709917 - DNA, 20 bp, Artificial
  CRISPR gRNA sequence
cagaggctgggcagggatca

SEQ ID NO: 709918 - DNA, 20 bp, Artificial
  CRISPR gRNA sequence
gctgggcagggatcagagtg

SEQ ID NO: 709919 - DNA, 20 bp, Artificial
  CRISPR gRNA sequence
ctgggcagggatcagagtgc

SEQ ID NO: 709920 - DNA, 20 bp, Artificial
  CRISPR gRNA sequence
tgggcagggatcagagtgca

SEQ ID NO: 709921 - DNA, 20 bp, Artificial
  CRISPR gRNA sequence
agggatcagagtgcagggac

SEQ ID NO: 709922 - DNA, 20 bp, Artificial
  CRISPR gRNA sequence
gggatcagagtgcagggacc

SEQ ID NO: 709923 - DNA, 20 bp, Artificial
  CRISPR gRNA sequence
ggatcagagtgcagggacca

SEQ ID NO: 709924 - DNA, 20 bp, Artificial
  CRISPR gRNA sequence
atcagagtgcagggaccagg

SEQ ID NO: 709925 - DNA, 20 bp, Artificial
  CRISPR gRNA sequence
tcagagtgcagggaccaggg

SEQ ID NO: 709926 - DNA, 20 bp, Artificial
  CRISPR gRNA sequence
cagagtgcagggaccaggga

SEQ ID NO: 709927 - DNA, 20 bp, Artificial
  CRISPR gRNA sequence
agagtgcagggaccagggag

SEQ ID NO: 709928 - DNA, 20 bp, Artificial
  CRISPR gRNA sequence
gagtgcagggaccagggagg

SEQ ID NO: 709929 - DNA, 20 bp, Artificial
  CRISPR gRNA sequence
gcagggaccagggagggggt

SEQ ID NO: 709930 - DNA, 20 bp, Artificial
  CRISPR gRNA sequence
gggaccagggagggggtcag

SEQ ID NO: 709931 - DNA, 20 bp, Artificial
  CRISPR gRNA sequence
gggagggggtcagaagcacc

SEQ ID NO: 709932 - DNA, 20 bp, Artificial
  CRISPR gRNA sequence
ggagggggtcagaagcaccc

SEQ ID NO: 709933 - DNA, 20 bp, Artificial
  CRISPR gRNA sequence
ggtcagaagcacccaggact

SEQ ID NO: 709934 - DNA, 20 bp, Artificial
  CRISPR gRNA sequence
gtcagaagcacccaggactc

SEQ ID NO: 709935 - DNA, 20 bp, Artificial
  CRISPR gRNA sequence
agaagcacccaggactcagg

SEQ ID NO: 709936 - DNA, 20 bp, Artificial
  CRISPR gRNA sequence
gaagcacccaggactcagga

SEQ ID NO: 709937 - DNA, 20 bp, Artificial
  CRISPR gRNA sequence
ccaggactcaggaaggcctg

SEQ ID NO: 709938 - DNA, 20 bp, Artificial
  CRISPR gRNA sequence
tcaggaaggcctgaagcttc

SEQ ID NO: 709939 - DNA, 20 bp, Artificial
  CRISPR gRNA sequence
caggaaggcctgaagcttcc

SEQ ID NO: 709940 - DNA, 20 bp, Artificial
  CRISPR gRNA sequence
gaaggcctgaagcttccagg

SEQ ID NO: 709941 - DNA, 20 bp, Artificial
  CRISPR gRNA sequence
aaggcctgaagcttccagga

SEQ ID NO: 709942 - DNA, 20 bp, Artificial
  CRISPR gRNA sequence
tgaagcttccaggaaggaaa

SEQ ID NO: 709943 - DNA, 20 bp, Artificial
  CRISPR gRNA sequence
ttccaggaaggaaaaagccc

SEQ ID NO: 709944 - DNA, 20 bp, Artificial
  CRISPR gRNA sequence
tccaggaaggaaaaagcccc

SEQ ID NO: 709945 - DNA, 20 bp, Artificial
  CRISPR gRNA sequence
gaaggaaaaagccccaggca

SEQ ID NO: 709946 - DNA, 20 bp, Artificial
  CRISPR gRNA sequence
aaggaaaaagccccaggcac

SEQ ID NO: 709947 - DNA, 20 bp, Artificial
  CRISPR gRNA sequence
aaaaagccccaggcacaggc

SEQ ID NO: 709948 - DNA, 20 bp, Artificial
  CRISPR gRNA sequence
ggcacaggccagcctgtcaa

SEQ ID NO: 709949 - DNA, 20 bp, Artificial
  CRISPR gRNA sequence
gcacaggccagcctgtcaat

SEQ ID NO: 709950 - DNA, 20 bp, Artificial
  CRISPR gRNA sequence
caggccagcctgtcaatagg

SEQ ID NO: 709951 - DNA, 20 bp, Artificial
  CRISPR gRNA sequence
gccagcctgtcaataggcag

SEQ ID NO: 709952 - DNA, 20 bp, Artificial
  CRISPR gRNA sequence
taggcagcagccaccgattg

SEQ ID NO: 709953 - DNA, 20 bp, Artificial
  CRISPR gRNA sequence
aggcagcagccaccgattgc

SEQ ID NO: 709954 - DNA, 20 bp, Artificial
  CRISPR gRNA sequence
cagcagccaccgattgcagg

SEQ ID NO: 709955 - DNA, 20 bp, Artificial
  CRISPR gRNA sequence
agcagccaccgattgcaggc

SEQ ID NO: 709956 - DNA, 20 bp, Artificial
  CRISPR gRNA sequence
gtactccacgatgcgcttaa

SEQ ID NO: 709957 - DNA, 20 bp, Artificial
  CRISPR gRNA sequence
gcccgacctcgacgaatcca

SEQ ID NO: 709958 - DNA, 20 bp, Artificial
  CRISPR gRNA sequence
cccgacctcgacgaatccac

SEQ ID NO: 709959 - DNA, 20 bp, Artificial
  CRISPR gRNA sequence
cctcgacgaatccacaggcc

SEQ ID NO: 709960 - DNA, 20 bp, Artificial
  CRISPR gRNA sequence
atccacaggccaagcctctg

SEQ ID NO: 709961 - DNA, 20 bp, Artificial
  CRISPR gRNA sequence
cacaggccaagcctctgaag

SEQ ID NO: 709962 - DNA, 20 bp, Artificial
  CRISPR gRNA sequence
attctaccatctgcattttc

SEQ ID NO: 709963 - DNA, 20 bp, Artificial
  CRISPR gRNA sequence
accatctgcattttccggat

SEQ ID NO: 709964 - DNA, 20 bp, Artificial
  CRISPR gRNA sequence
ccatctgcattttccggatg

SEQ ID NO: 709965 - DNA, 20 bp, Artificial
  CRISPR gRNA sequence
attttccggatgaggaaact

SEQ ID NO: 709966 - DNA, 20 bp, Artificial
  CRISPR gRNA sequence
cggatgaggaaactgagaca

SEQ ID NO: 709967 - DNA, 20 bp, Artificial
  CRISPR gRNA sequence
ggatgaggaaactgagacac

SEQ ID NO: 709968 - DNA, 20 bp, Artificial
  CRISPR gRNA sequence
aactgagacacaggacaatt

SEQ ID NO: 709969 - DNA, 20 bp, Artificial
  CRISPR gRNA sequence
ggacaattcagtaactcacc

SEQ ID NO: 709970 - DNA, 20 bp, Artificial
  CRISPR gRNA sequence
gacaattcagtaactcaccc

SEQ ID NO: 709971 - DNA, 20 bp, Artificial
  CRISPR gRNA sequence
acaattcagtaactcaccca

SEQ ID NO: 709972 - DNA, 20 bp, Artificial
  CRISPR gRNA sequence
gtaactcacccagggtcaca

SEQ ID NO: 709973 - DNA, 20 bp, Artificial
  CRISPR gRNA sequence
cccagggtcacacagcttgt

SEQ ID NO: 709974 - DNA, 20 bp, Artificial
  CRISPR gRNA sequence
agggtcacacagcttgtaag

SEQ ID NO: 709975 - DNA, 20 bp, Artificial
  CRISPR gRNA sequence
gtcacacagcttgtaagtgg

SEQ ID NO: 709976 - DNA, 20 bp, Artificial
  CRISPR gRNA sequence
cagcttgtaagtggcagaac

SEQ ID NO: 709977 - DNA, 20 bp, Artificial
  CRISPR gRNA sequence
agcttgtaagtggcagaacc

SEQ ID NO: 709978 - DNA, 20 bp, Artificial
  CRISPR gRNA sequence
gcttgtaagtggcagaacca

SEQ ID NO: 709979 - DNA, 20 bp, Artificial
  CRISPR gRNA sequence
ctcctttcccctcctgcccc

SEQ ID NO: 709980 - DNA, 20 bp, Artificial
  CRISPR gRNA sequence
tcctttcccctcctgcccct

SEQ ID NO: 709981 - DNA, 20 bp, Artificial
  CRISPR gRNA sequence
ctgcccctgggctgacttgc

SEQ ID NO: 709982 - DNA, 20 bp, Artificial
  CRISPR gRNA sequence
tgcccctgggctgacttgcc

SEQ ID NO: 709983 - DNA, 20 bp, Artificial
  CRISPR gRNA sequence
ccctgggctgacttgccagg

SEQ ID NO: 709984 - DNA, 20 bp, Artificial
  CRISPR gRNA sequence
tgggctgacttgccaggtgg

SEQ ID NO: 709985 - DNA, 20 bp, Artificial
  CRISPR gRNA sequence
gctgacttgccaggtggtag

SEQ ID NO: 709986 - DNA, 20 bp, Artificial
  CRISPR gRNA sequence
tgacttgccaggtggtagaa

SEQ ID NO: 709987 - DNA, 20 bp, Artificial
  CRISPR gRNA sequence
gacttgccaggtggtagaag

SEQ ID NO: 709988 - DNA, 20 bp, Artificial
  CRISPR gRNA sequence
acttgccaggtggtagaaga

SEQ ID NO: 709989 - DNA, 20 bp, Artificial
  CRISPR gRNA sequence
cttgccaggtggtagaagag

SEQ ID NO: 709990 - DNA, 20 bp, Artificial
  CRISPR gRNA sequence
ttgccaggtggtagaagagg

SEQ ID NO: 709991 - DNA, 20 bp, Artificial
  CRISPR gRNA sequence
gccaggtggtagaagagggg

SEQ ID NO: 709992 - DNA, 20 bp, Artificial
  CRISPR gRNA sequence
caggtggtagaagaggggga

SEQ ID NO: 709993 - DNA, 20 bp, Artificial
  CRISPR gRNA sequence
ggtggtagaagagggggaga

SEQ ID NO: 709994 - DNA, 20 bp, Artificial
  CRISPR gRNA sequence
gtggtagaagagggggagag

SEQ ID NO: 709995 - DNA, 20 bp, Artificial
  CRISPR gRNA sequence
tggtagaagagggggagaga

SEQ ID NO: 709996 - DNA, 20 bp, Artificial
  CRISPR gRNA sequence
ggtagaagagggggagagag

SEQ ID NO: 709997 - DNA, 20 bp, Artificial
  CRISPR gRNA sequence
gaagagggggagagagggga

SEQ ID NO: 709998 - DNA, 20 bp, Artificial
  CRISPR gRNA sequence
agagggggagagaggggaaa

SEQ ID NO: 709999 - DNA, 20 bp, Artificial
  CRISPR gRNA sequence
ggggagagaggggaaagaga

SEQ ID NO: 710000 - DNA, 20 bp, Artificial
  CRISPR gRNA sequence
ggagagaggggaaagagaaa

SEQ ID NO: 710001 - DNA, 20 bp, Artificial
  CRISPR gRNA sequence
gagaggggaaagagaaagag

SEQ ID NO: 710002 - DNA, 20 bp, Artificial
  CRISPR gRNA sequence
agaggggaaagagaaagaga

SEQ ID NO: 710003 - DNA, 20 bp, Artificial
  CRISPR gRNA sequence
aggggaaagagaaagagaag

SEQ ID NO: 710004 - DNA, 20 bp, Artificial
  CRISPR gRNA sequence
ggggaaagagaaagagaagg

SEQ ID NO: 710005 - DNA, 20 bp, Artificial
  CRISPR gRNA sequence
gggaaagagaaagagaagga

SEQ ID NO: 710006 - DNA, 20 bp, Artificial
  CRISPR gRNA sequence
gaaagagaaagagaaggagg

SEQ ID NO: 710007 - DNA, 20 bp, Artificial
  CRISPR gRNA sequence
aagagaaagagaaggaggga

SEQ ID NO: 710008 - DNA, 20 bp, Artificial
  CRISPR gRNA sequence
agagaaagagaaggagggag

SEQ ID NO: 710009 - DNA, 20 bp, Artificial
  CRISPR gRNA sequence
gagaaagagaaggagggaga

SEQ ID NO: 710010 - DNA, 20 bp, Artificial
  CRISPR gRNA sequence
gaaagagaaggagggagagg

SEQ ID NO: 710011 - DNA, 20 bp, Artificial
  CRISPR gRNA sequence
gagaaggagggagagggaga

SEQ ID NO: 710012 - DNA, 20 bp, Artificial
  CRISPR gRNA sequence
agaaggagggagagggagaa

SEQ ID NO: 710013 - DNA, 20 bp, Artificial
  CRISPR gRNA sequence
gaaggagggagagggagaaa

SEQ ID NO: 710014 - DNA, 20 bp, Artificial
  CRISPR gRNA sequence
aggagggagagggagaaagg

SEQ ID NO: 710015 - DNA, 20 bp, Artificial
  CRISPR gRNA sequence
ggagggagagggagaaaggg

SEQ ID NO: 710016 - DNA, 20 bp, Artificial
  CRISPR gRNA sequence
gagggagagggagaaaggga

SEQ ID NO: 710017 - DNA, 20 bp, Artificial
  CRISPR gRNA sequence
ggagagggagaaagggaggg

SEQ ID NO: 710018 - DNA, 20 bp, Artificial
  CRISPR gRNA sequence
gagaaagggagggtagaatg

SEQ ID NO: 710019 - DNA, 20 bp, Artificial
  CRISPR gRNA sequence
gaaagggagggtagaatgta

SEQ ID NO: 710020 - DNA, 20 bp, Artificial
  CRISPR gRNA sequence
aagggagggtagaatgtaga

SEQ ID NO: 710021 - DNA, 20 bp, Artificial
  CRISPR gRNA sequence
agggagggtagaatgtagag

SEQ ID NO: 710022 - DNA, 20 bp, Artificial
  CRISPR gRNA sequence
gagggtagaatgtagagagg

SEQ ID NO: 710023 - DNA, 20 bp, Artificial
  CRISPR gRNA sequence
agggtagaatgtagagagga

SEQ ID NO: 710024 - DNA, 20 bp, Artificial
  CRISPR gRNA sequence
tagaatgtagagaggaaggc

SEQ ID NO: 710025 - DNA, 20 bp, Artificial
  CRISPR gRNA sequence
agaatgtagagaggaaggca

SEQ ID NO: 710026 - DNA, 20 bp, Artificial
  CRISPR gRNA sequence
tgtagagaggaaggcaaggc

SEQ ID NO: 710027 - DNA, 20 bp, Artificial
  CRISPR gRNA sequence
agagaggaaggcaaggctgg

SEQ ID NO: 710028 - DNA, 20 bp, Artificial
  CRISPR gRNA sequence
gagaggaaggcaaggctggc

SEQ ID NO: 710029 - DNA, 20 bp, Artificial
  CRISPR gRNA sequence
aggctggcaggaatgccccc

SEQ ID NO: 710030 - DNA, 20 bp, Artificial
  CRISPR gRNA sequence
ggctggcaggaatgccccct

SEQ ID NO: 710031 - DNA, 20 bp, Artificial
  CRISPR gRNA sequence
gctggcaggaatgccccctg

SEQ ID NO: 710032 - DNA, 20 bp, Artificial
  CRISPR gRNA sequence
ctggcaggaatgccccctgg

SEQ ID NO: 710033 - DNA, 20 bp, Artificial
  CRISPR gRNA sequence
ggaatgccccctgggggtac

SEQ ID NO: 710034 - DNA, 20 bp, Artificial
  CRISPR gRNA sequence
aatgccccctgggggtactg

SEQ ID NO: 710035 - DNA, 20 bp, Artificial
  CRISPR gRNA sequence
atgccccctgggggtactgg

SEQ ID NO: 710036 - DNA, 20 bp, Artificial
  CRISPR gRNA sequence
cctgggggtactggaggaaa

SEQ ID NO: 710037 - DNA, 20 bp, Artificial
  CRISPR gRNA sequence
ggtactggaggaaaaagtga

SEQ ID NO: 710038 - DNA, 20 bp, Artificial
  CRISPR gRNA sequence
tggaggaaaaagtgacagac

SEQ ID NO: 710039 - DNA, 20 bp, Artificial
  CRISPR gRNA sequence
ggaaaaagtgacagacaaga

SEQ ID NO: 710040 - DNA, 20 bp, Artificial
  CRISPR gRNA sequence
agacttttaaacgttcatgc

SEQ ID NO: 710041 - DNA, 20 bp, Artificial
  CRISPR gRNA sequence
cgttcatgccagcatccatc

SEQ ID NO: 710042 - DNA, 20 bp, Artificial
  CRISPR gRNA sequence
gttcatgccagcatccatcc

SEQ ID NO: 710043 - DNA, 20 bp, Artificial
  CRISPR gRNA sequence
catccatccaggtgctgctc

SEQ ID NO: 710044 - DNA, 20 bp, Artificial
  CRISPR gRNA sequence
atccatccaggtgctgctct

SEQ ID NO: 710045 - DNA, 20 bp, Artificial
  CRISPR gRNA sequence
atccaggtgctgctctgggc

SEQ ID NO: 710046 - DNA, 20 bp, Artificial
  CRISPR gRNA sequence
gctgctctgggcaagccaca

SEQ ID NO: 710047 - DNA, 20 bp, Artificial
  CRISPR gRNA sequence
agccacacagtcgtcacacc

SEQ ID NO: 710048 - DNA, 20 bp, Artificial
  CRISPR gRNA sequence
cacagtcgtcacacccagta

SEQ ID NO: 710049 - DNA, 20 bp, Artificial
  CRISPR gRNA sequence
attgcattctccacacgcat

SEQ ID NO: 710050 - DNA, 20 bp, Artificial
  CRISPR gRNA sequence
tcacccacattgcatcccta

SEQ ID NO: 710051 - DNA, 20 bp, Artificial
  CRISPR gRNA sequence
attgcatccctacagatgta

SEQ ID NO: 710052 - DNA, 20 bp, Artificial
  CRISPR gRNA sequence
tacagatgtacagaatgcga

SEQ ID NO: 710053 - DNA, 20 bp, Artificial
  CRISPR gRNA sequence
acagatgtacagaatgcgac

SEQ ID NO: 710054 - DNA, 20 bp, Artificial
  CRISPR gRNA sequence
agatgtacagaatgcgacag

SEQ ID NO: 710055 - DNA, 20 bp, Artificial
  CRISPR gRNA sequence
acagaatgcgacaggagcca

SEQ ID NO: 710056 - DNA, 20 bp, Artificial
  CRISPR gRNA sequence
aatgcgacaggagccacaga

SEQ ID NO: 710057 - DNA, 20 bp, Artificial
  CRISPR gRNA sequence
atgcgacaggagccacagac

SEQ ID NO: 710058 - DNA, 20 bp, Artificial
  CRISPR gRNA sequence
tgcgacaggagccacagaca

SEQ ID NO: 710059 - DNA, 20 bp, Artificial
  CRISPR gRNA sequence
cgacaggagccacagacagg

SEQ ID NO: 710060 - DNA, 20 bp, Artificial
  CRISPR gRNA sequence
agccacagacagggagcttc

SEQ ID NO: 710061 - DNA, 20 bp, Artificial
  CRISPR gRNA sequence
gccacagacagggagcttcg

SEQ ID NO: 710062 - DNA, 20 bp, Artificial
  CRISPR gRNA sequence
cagacagggagcttcgaggc

SEQ ID NO: 710063 - DNA, 20 bp, Artificial
  CRISPR gRNA sequence
agacagggagcttcgaggct

SEQ ID NO: 710064 - DNA, 20 bp, Artificial
  CRISPR gRNA sequence
gacagggagcttcgaggctg

SEQ ID NO: 710065 - DNA, 20 bp, Artificial
  CRISPR gRNA sequence
agggagcttcgaggctgggg

SEQ ID NO: 710066 - DNA, 20 bp, Artificial
  CRISPR gRNA sequence
gagcttcgaggctggggtag

SEQ ID NO: 710067 - DNA, 20 bp, Artificial
  CRISPR gRNA sequence
tcgaggctggggtagaagtt

SEQ ID NO: 710068 - DNA, 20 bp, Artificial
  CRISPR gRNA sequence
tggggtagaagttcagtctc

SEQ ID NO: 710069 - DNA, 20 bp, Artificial
  CRISPR gRNA sequence
gggtagaagttcagtctctg

SEQ ID NO: 710070 - DNA, 20 bp, Artificial
  CRISPR gRNA sequence
agtctctggagcccacgccc

SEQ ID NO: 710071 - DNA, 20 bp, Artificial
  CRISPR gRNA sequence
gtctctggagcccacgcccc

SEQ ID NO: 710072 - DNA, 20 bp, Artificial
  CRISPR gRNA sequence
tggagcccacgccccgggcc

SEQ ID NO: 710073 - DNA, 20 bp, Artificial
  CRISPR gRNA sequence
gagcccacgccccgggccca

SEQ ID NO: 710074 - DNA, 20 bp, Artificial
  CRISPR gRNA sequence
agagctgccctgtgttcctc

SEQ ID NO: 710075 - DNA, 20 bp, Artificial
  CRISPR gRNA sequence
tgccctgtgttcctctggct

SEQ ID NO: 710076 - DNA, 20 bp, Artificial
  CRISPR gRNA sequence
gccctgtgttcctctggctc

SEQ ID NO: 710077 - DNA, 20 bp, Artificial
  CRISPR gRNA sequence
ctgtgttcctctggctcggg

SEQ ID NO: 710078 - DNA, 20 bp, Artificial
  CRISPR gRNA sequence
tctggctcgggcagcccctt

SEQ ID NO: 710079 - DNA, 20 bp, Artificial
  CRISPR gRNA sequence
gctcgggcagcccctttgga

SEQ ID NO: 710080 - DNA, 20 bp, Artificial
  CRISPR gRNA sequence
gggcagcccctttggacggc

SEQ ID NO: 710081 - DNA, 20 bp, Artificial
  CRISPR gRNA sequence
acggctggacactcacccac

SEQ ID NO: 710082 - DNA, 20 bp, Artificial
  CRISPR gRNA sequence
ggacactcacccacaagctc

SEQ ID NO: 710083 - DNA, 20 bp, Artificial
  CRISPR gRNA sequence
ctcacccacaagctctagct

SEQ ID NO: 710084 - DNA, 20 bp, Artificial
  CRISPR gRNA sequence
tcacccacaagctctagctt

SEQ ID NO: 710085 - DNA, 20 bp, Artificial
  CRISPR gRNA sequence
ccacaagctctagcttgggc

SEQ ID NO: 710086 - DNA, 20 bp, Artificial
  CRISPR gRNA sequence
cacaagctctagcttgggct

SEQ ID NO: 710087 - DNA, 20 bp, Artificial
  CRISPR gRNA sequence
caagctctagcttgggctgg

SEQ ID NO: 710088 - DNA, 20 bp, Artificial
  CRISPR gRNA sequence
aagctctagcttgggctggg

SEQ ID NO: 710089 - DNA, 20 bp, Artificial
  CRISPR gRNA sequence
ctagcttgggctgggaggtc

SEQ ID NO: 710090 - DNA, 20 bp, Artificial
  CRISPR gRNA sequence
ttgggctgggaggtctggac

SEQ ID NO: 710091 - DNA, 20 bp, Artificial
  CRISPR gRNA sequence
tgggctgggaggtctggacc

SEQ ID NO: 710092 - DNA, 20 bp, Artificial
  CRISPR gRNA sequence
gctgggaggtctggaccggg

SEQ ID NO: 710093 - DNA, 20 bp, Artificial
  CRISPR gRNA sequence
gaggtctggaccgggtagca

SEQ ID NO: 710094 - DNA, 20 bp, Artificial
  CRISPR gRNA sequence
aggtctggaccgggtagcac

SEQ ID NO: 710095 - DNA, 20 bp, Artificial
  CRISPR gRNA sequence
tctggaccgggtagcacagg

SEQ ID NO: 710096 - DNA, 20 bp, Artificial
  CRISPR gRNA sequence
tggaccgggtagcacaggtg

SEQ ID NO: 710097 - DNA, 20 bp, Artificial
  CRISPR gRNA sequence
gtggagctctgaaacgacac

SEQ ID NO: 710098 - DNA, 20 bp, Artificial
  CRISPR gRNA sequence
tggagctctgaaacgacacc

SEQ ID NO: 710099 - DNA, 20 bp, Artificial
  CRISPR gRNA sequence
gagctctgaaacgacaccag

SEQ ID NO: 710100 - DNA, 20 bp, Artificial
  CRISPR gRNA sequence
agctctgaaacgacaccagg

SEQ ID NO: 710101 - DNA, 20 bp, Artificial
  CRISPR gRNA sequence
tctgaaacgacaccaggagg

SEQ ID NO: 710102 - DNA, 20 bp, Artificial
  CRISPR gRNA sequence
ctgaaacgacaccaggagga

SEQ ID NO: 710103 - DNA, 20 bp, Artificial
  CRISPR gRNA sequence
aacgacaccaggaggaaggc

SEQ ID NO: 710104 - DNA, 20 bp, Artificial
  CRISPR gRNA sequence
acgacaccaggaggaaggct

SEQ ID NO: 710105 - DNA, 20 bp, Artificial
  CRISPR gRNA sequence
cgacaccaggaggaaggctg

SEQ ID NO: 710106 - DNA, 20 bp, Artificial
  CRISPR gRNA sequence
gacaccaggaggaaggctgg

SEQ ID NO: 710107 - DNA, 20 bp, Artificial
  CRISPR gRNA sequence
accaggaggaaggctggggg

SEQ ID NO: 710108 - DNA, 20 bp, Artificial
  CRISPR gRNA sequence
aggaggaaggctgggggtgg

SEQ ID NO: 710109 - DNA, 20 bp, Artificial
  CRISPR gRNA sequence
aaggctgggggtggcggcct

SEQ ID NO: 710110 - DNA, 20 bp, Artificial
  CRISPR gRNA sequence
ggctgggggtggcggcctca

SEQ ID NO: 710111 - DNA, 20 bp, Artificial
  CRISPR gRNA sequence
ctgggggtggcggcctcaga

SEQ ID NO: 710112 - DNA, 20 bp, Artificial
  CRISPR gRNA sequence
ggggtggcggcctcagagag

SEQ ID NO: 710113 - DNA, 20 bp, Artificial
  CRISPR gRNA sequence
gggtggcggcctcagagagc

SEQ ID NO: 710114 - DNA, 20 bp, Artificial
  CRISPR gRNA sequence
gtggcggcctcagagagcag

SEQ ID NO: 710115 - DNA, 20 bp, Artificial
  CRISPR gRNA sequence
gcggcctcagagagcaggag

SEQ ID NO: 710116 - DNA, 20 bp, Artificial
  CRISPR gRNA sequence
cggcctcagagagcaggagc

SEQ ID NO: 710117 - DNA, 20 bp, Artificial
  CRISPR gRNA sequence
cctcagagagcaggagcagg

SEQ ID NO: 710118 - DNA, 20 bp, Artificial
  CRISPR gRNA sequence
ctcagagagcaggagcaggc

SEQ ID NO: 710119 - DNA, 20 bp, Artificial
  CRISPR gRNA sequence
tcagagagcaggagcaggca

SEQ ID NO: 710120 - DNA, 20 bp, Artificial
  CRISPR gRNA sequence
agagcaggagcaggcaggga

SEQ ID NO: 710121 - DNA, 20 bp, Artificial
  CRISPR gRNA sequence
gagcaggcagggaaagaacc

SEQ ID NO: 710122 - DNA, 20 bp, Artificial
  CRISPR gRNA sequence
agcaggcagggaaagaaccc

SEQ ID NO: 710123 - DNA, 20 bp, Artificial
  CRISPR gRNA sequence
ggcagggaaagaacccaggc

SEQ ID NO: 710124 - DNA, 20 bp, Artificial
  CRISPR gRNA sequence
gcagggaaagaacccaggcc

SEQ ID NO: 710125 - DNA, 20 bp, Artificial
  CRISPR gRNA sequence
ggaaagaacccaggccaggc

SEQ ID NO: 710126 - DNA, 20 bp, Artificial
  CRISPR gRNA sequence
aagaacccaggccaggctgg

SEQ ID NO: 710127 - DNA, 20 bp, Artificial
  CRISPR gRNA sequence
gaacccaggccaggctggca

SEQ ID NO: 710128 - DNA, 20 bp, Artificial
  CRISPR gRNA sequence
acccaggccaggctggcaga

SEQ ID NO: 710129 - DNA, 20 bp, Artificial
  CRISPR gRNA sequence
gagagcaacctgtcctcccc

SEQ ID NO: 710130 - DNA, 20 bp, Artificial
  CRISPR gRNA sequence
agagcaacctgtcctcccca

SEQ ID NO: 710131 - DNA, 20 bp, Artificial
  CRISPR gRNA sequence
cctgtcctccccaaggcccc

SEQ ID NO: 710132 - DNA, 20 bp, Artificial
  CRISPR gRNA sequence
ctgtcctccccaaggcccca

SEQ ID NO: 710133 - DNA, 20 bp, Artificial
  CRISPR gRNA sequence
tccccaaggccccaaggaca

SEQ ID NO: 710134 - DNA, 20 bp, Artificial
  CRISPR gRNA sequence
tctgccgaattcgcttcctg

SEQ ID NO: 710135 - DNA, 20 bp, Artificial
  CRISPR gRNA sequence
ctgccgaattcgcttcctgc

SEQ ID NO: 710136 - DNA, 20 bp, Artificial
  CRISPR gRNA sequence
ttcgcttcctgcaggccctc

SEQ ID NO: 710137 - DNA, 20 bp, Artificial
  CRISPR gRNA sequence
gcttcctgcaggccctccgg

SEQ ID NO: 710138 - DNA, 20 bp, Artificial
  CRISPR gRNA sequence
ctgcaggccctccggtggca

SEQ ID NO: 710139 - DNA, 20 bp, Artificial
  CRISPR gRNA sequence
tgcaggccctccggtggcac

SEQ ID NO: 710140 - DNA, 20 bp, Artificial
  CRISPR gRNA sequence
caggccctccggtggcacag

SEQ ID NO: 710141 - DNA, 20 bp, Artificial
  CRISPR gRNA sequence
aggccctccggtggcacagg

SEQ ID NO: 710142 - DNA, 20 bp, Artificial
  CRISPR gRNA sequence
ccctccggtggcacaggagg

SEQ ID NO: 710143 - DNA, 20 bp, Artificial
  CRISPR gRNA sequence
cctccggtggcacaggagga

SEQ ID NO: 710144 - DNA, 20 bp, Artificial
  CRISPR gRNA sequence
gtggcacaggaggaaggcgc

SEQ ID NO: 710145 - DNA, 20 bp, Artificial
  CRISPR gRNA sequence
ggcacaggaggaaggcgctg

SEQ ID NO: 710146 - DNA, 20 bp, Artificial
  CRISPR gRNA sequence
ccgaccaccacaaccaacac

SEQ ID NO: 710147 - DNA, 20 bp, Artificial
  CRISPR gRNA sequence
cgaccaccacaaccaacacc

SEQ ID NO: 710148 - DNA, 20 bp, Artificial
  CRISPR gRNA sequence
caaccaacaccaggatcacc

SEQ ID NO: 710149 - DNA, 20 bp, Artificial
  CRISPR gRNA sequence
ccaacaccaggatcacccag

SEQ ID NO: 710150 - DNA, 20 bp, Artificial
  CRISPR gRNA sequence
aacaccaggatcacccagaa

SEQ ID NO: 710151 - DNA, 20 bp, Artificial
  CRISPR gRNA sequence
aggatcacccagaagagcac

SEQ ID NO: 710152 - DNA, 20 bp, Artificial
  CRISPR gRNA sequence
acccagaagagcactggccc

SEQ ID NO: 710153 - DNA, 20 bp, Artificial
  CRISPR gRNA sequence
agagcactggccctggaaca

SEQ ID NO: 710154 - DNA, 20 bp, Artificial
  CRISPR gRNA sequence
agcactggccctggaacaca

SEQ ID NO: 710155 - DNA, 20 bp, Artificial
  CRISPR gRNA sequence
ttgccttgctgcaaccacac

SEQ ID NO: 710156 - DNA, 20 bp, Artificial
  CRISPR gRNA sequence
cttgctgcaaccacacaaga

SEQ ID NO: 710157 - DNA, 20 bp, Artificial
  CRISPR gRNA sequence
gcaaccacacaagacagccc

SEQ ID NO: 710158 - DNA, 20 bp, Artificial
  CRISPR gRNA sequence
acacaagacagccccagccc

SEQ ID NO: 710159 - DNA, 20 bp, Artificial
  CRISPR gRNA sequence
agacgacttcctccttctcc

SEQ ID NO: 710160 - DNA, 20 bp, Artificial
  CRISPR gRNA sequence
gacgacttcctccttctcct

SEQ ID NO: 710161 - DNA, 20 bp, Artificial
  CRISPR gRNA sequence
ttcctccttctcctgggaca

SEQ ID NO: 710162 - DNA, 20 bp, Artificial
  CRISPR gRNA sequence
ctgggacacagcttccatca

SEQ ID NO: 710163 - DNA, 20 bp, Artificial
  CRISPR gRNA sequence
tccatcatggctaacaacaa

SEQ ID NO: 710164 - DNA, 20 bp, Artificial
  CRISPR gRNA sequence
ccatcatggctaacaacaac

SEQ ID NO: 710165 - DNA, 20 bp, Artificial
  CRISPR gRNA sequence
aacaacaacaggtcctttcc

SEQ ID NO: 710166 - DNA, 20 bp, Artificial
  CRISPR gRNA sequence
caacaggtcctttccaagcc

SEQ ID NO: 710167 - DNA, 20 bp, Artificial
  CRISPR gRNA sequence
aacaggtcctttccaagcca

SEQ ID NO: 710168 - DNA, 20 bp, Artificial
  CRISPR gRNA sequence
gccaaggctcttatctcatc

SEQ ID NO: 710169 - DNA, 20 bp, Artificial
  CRISPR gRNA sequence
tcatccagccctccctcgcc

SEQ ID NO: 710170 - DNA, 20 bp, Artificial
  CRISPR gRNA sequence
agccctccctcgcctggctc

SEQ ID NO: 710171 - DNA, 20 bp, Artificial
  CRISPR gRNA sequence
gccctccctcgcctggctcc

SEQ ID NO: 710172 - DNA, 20 bp, Artificial
  CRISPR gRNA sequence
ctccctcgcctggctccagg

SEQ ID NO: 710173 - DNA, 20 bp, Artificial
  CRISPR gRNA sequence
aggaagctgatcaactattg

SEQ ID NO: 710174 - DNA, 20 bp, Artificial
  CRISPR gRNA sequence
ggaagctgatcaactattga

SEQ ID NO: 710175 - DNA, 20 bp, Artificial
  CRISPR gRNA sequence
ctgatcaactattgaaggct

SEQ ID NO: 710176 - DNA, 20 bp, Artificial
  CRISPR gRNA sequence
gatcaactattgaaggctga

SEQ ID NO: 710177 - DNA, 20 bp, Artificial
  CRISPR gRNA sequence
caactattgaaggctgagag

SEQ ID NO: 710178 - DNA, 20 bp, Artificial
  CRISPR gRNA sequence
aactattgaaggctgagaga

SEQ ID NO: 710179 - DNA, 20 bp, Artificial
  CRISPR gRNA sequence
actattgaaggctgagagaa

SEQ ID NO: 710180 - DNA, 20 bp, Artificial
  CRISPR gRNA sequence
agagaagggcaaactgtgtc

SEQ ID NO: 710181 - DNA, 20 bp, Artificial
  CRISPR gRNA sequence
agaagggcaaactgtgtcta

SEQ ID NO: 710182 - DNA, 20 bp, Artificial
  CRISPR gRNA sequence
aagggcaaactgtgtctaga

SEQ ID NO: 710183 - DNA, 20 bp, Artificial
  CRISPR gRNA sequence
gcaaactgtgtctagagagt

SEQ ID NO: 710184 - DNA, 20 bp, Artificial
  CRISPR gRNA sequence
tgtctagagagtgagaaatt

SEQ ID NO: 710185 - DNA, 20 bp, Artificial
  CRISPR gRNA sequence
gtctagagagtgagaaattg

SEQ ID NO: 710186 - DNA, 20 bp, Artificial
  CRISPR gRNA sequence
gagtgagaaattgaggcgtc

SEQ ID NO: 710187 - DNA, 20 bp, Artificial
  CRISPR gRNA sequence
agtgagaaattgaggcgtct

SEQ ID NO: 710188 - DNA, 20 bp, Artificial
  CRISPR gRNA sequence
tgagaaattgaggcgtctag

SEQ ID NO: 710189 - DNA, 20 bp, Artificial
  CRISPR gRNA sequence
aaattgaggcgtctaggagc

SEQ ID NO: 710190 - DNA, 20 bp, Artificial
  CRISPR gRNA sequence
ggcgtctaggagccagaaca

SEQ ID NO: 710191 - DNA, 20 bp, Artificial
  CRISPR gRNA sequence
gcgtctaggagccagaacaa

SEQ ID NO: 710192 - DNA, 20 bp, Artificial
  CRISPR gRNA sequence
ggagccagaacaaaggaatt

SEQ ID NO: 710193 - DNA, 20 bp, Artificial
  CRISPR gRNA sequence
gagccagaacaaaggaattg

SEQ ID NO: 710194 - DNA, 20 bp, Artificial
  CRISPR gRNA sequence
acaaaggaattgaggtccaa

SEQ ID NO: 710195 - DNA, 20 bp, Artificial
  CRISPR gRNA sequence
aggtccaatagaccaaaatt

SEQ ID NO: 710196 - DNA, 20 bp, Artificial
  CRISPR gRNA sequence
ggtccaatagaccaaaattt

SEQ ID NO: 710197 - DNA, 20 bp, Artificial
  CRISPR gRNA sequence
gtccaatagaccaaaatttg

SEQ ID NO: 710198 - DNA, 20 bp, Artificial
  CRISPR gRNA sequence
agaccaaaatttggggactg

SEQ ID NO: 710199 - DNA, 20 bp, Artificial
  CRISPR gRNA sequence
aaaatttggggactgtggac

SEQ ID NO: 710200 - DNA, 20 bp, Artificial
  CRISPR gRNA sequence
aaatttggggactgtggacg

SEQ ID NO: 710201 - DNA, 20 bp, Artificial
  CRISPR gRNA sequence
aatttggggactgtggacga

SEQ ID NO: 710202 - DNA, 20 bp, Artificial
  CRISPR gRNA sequence
ggggactgtggacgagggcc

SEQ ID NO: 710203 - DNA, 20 bp, Artificial
  CRISPR gRNA sequence
ggacgagggcccggtgtgac

SEQ ID NO: 710204 - DNA, 20 bp, Artificial
  CRISPR gRNA sequence
ggcccggtgtgaccggcatc

SEQ ID NO: 710205 - DNA, 20 bp, Artificial
  CRISPR gRNA sequence
ccggtgtgaccggcatctgg

SEQ ID NO: 710206 - DNA, 20 bp, Artificial
  CRISPR gRNA sequence
ccggcatctggcagcactgc

SEQ ID NO: 710207 - DNA, 20 bp, Artificial
  CRISPR gRNA sequence
atctggcagcactgctggtg

SEQ ID NO: 710208 - DNA, 20 bp, Artificial
  CRISPR gRNA sequence
ggcagcactgctggtgtggc

SEQ ID NO: 710209 - DNA, 20 bp, Artificial
  CRISPR gRNA sequence
cagcactgctggtgtggccg

SEQ ID NO: 710210 - DNA, 20 bp, Artificial
  CRISPR gRNA sequence
actgctggtgtggccggagt

SEQ ID NO: 710211 - DNA, 20 bp, Artificial
  CRISPR gRNA sequence
ctgctggtgtggccggagtc

SEQ ID NO: 710212 - DNA, 20 bp, Artificial
  CRISPR gRNA sequence
tgctggtgtggccggagtca

SEQ ID NO: 710213 - DNA, 20 bp, Artificial
  CRISPR gRNA sequence
tggtgtggccggagtcaggg

SEQ ID NO: 710214 - DNA, 20 bp, Artificial
  CRISPR gRNA sequence
ggtgtggccggagtcagggt

SEQ ID NO: 710215 - DNA, 20 bp, Artificial
  CRISPR gRNA sequence
gtgtggccggagtcagggtg

SEQ ID NO: 710216 - DNA, 20 bp, Artificial
  CRISPR gRNA sequence
gtggccggagtcagggtggg

SEQ ID NO: 710217 - DNA, 20 bp, Artificial
  CRISPR gRNA sequence
tggccggagtcagggtgggg

SEQ ID NO: 710218 - DNA, 20 bp, Artificial
  CRISPR gRNA sequence
ggccggagtcagggtgggga

SEQ ID NO: 710219 - DNA, 20 bp, Artificial
  CRISPR gRNA sequence
gagtcagggtggggagggcc

SEQ ID NO: 710220 - DNA, 20 bp, Artificial
  CRISPR gRNA sequence
tcagggtggggagggccaag

SEQ ID NO: 710221 - DNA, 20 bp, Artificial
  CRISPR gRNA sequence
ggtggggagggccaagcagt

SEQ ID NO: 710222 - DNA, 20 bp, Artificial
  CRISPR gRNA sequence
gtggggagggccaagcagtg

SEQ ID NO: 710223 - DNA, 20 bp, Artificial
  CRISPR gRNA sequence
tggggagggccaagcagtga

SEQ ID NO: 710224 - DNA, 20 bp, Artificial
  CRISPR gRNA sequence
ggggagggccaagcagtgag

SEQ ID NO: 710225 - DNA, 20 bp, Artificial
  CRISPR gRNA sequence
gagggccaagcagtgagggg

SEQ ID NO: 710226 - DNA, 20 bp, Artificial
  CRISPR gRNA sequence
agggccaagcagtgagggga

SEQ ID NO: 710227 - DNA, 20 bp, Artificial
  CRISPR gRNA sequence
gccaagcagtgaggggaagg

SEQ ID NO: 710228 - DNA, 20 bp, Artificial
  CRISPR gRNA sequence
caagcagtgaggggaaggaa

SEQ ID NO: 710229 - DNA, 20 bp, Artificial
  CRISPR gRNA sequence
aagcagtgaggggaaggaag

SEQ ID NO: 710230 - DNA, 20 bp, Artificial
  CRISPR gRNA sequence
gggaaggaagaggttgaacc

SEQ ID NO: 710231 - DNA, 20 bp, Artificial
  CRISPR gRNA sequence
ggttgaacccagtcccctcc

SEQ ID NO: 710232 - DNA, 20 bp, Artificial
  CRISPR gRNA sequence
tcccctcccggccaaccctc

SEQ ID NO: 710233 - DNA, 20 bp, Artificial
  CRISPR gRNA sequence
accctctagacctgcttgat

SEQ ID NO: 710234 - DNA, 20 bp, Artificial
  CRISPR gRNA sequence
ccctctagacctgcttgatg

SEQ ID NO: 710235 - DNA, 20 bp, Artificial
  CRISPR gRNA sequence
cctctagacctgcttgatga

SEQ ID NO: 710236 - DNA, 20 bp, Artificial
  CRISPR gRNA sequence
ctagacctgcttgatgaggg

SEQ ID NO: 710237 - DNA, 20 bp, Artificial
  CRISPR gRNA sequence
tagacctgcttgatgagggc

SEQ ID NO: 710238 - DNA, 20 bp, Artificial
  CRISPR gRNA sequence
ctgcttgatgagggcaggca

SEQ ID NO: 710239 - DNA, 20 bp, Artificial
  CRISPR gRNA sequence
gcttgatgagggcaggcatg

SEQ ID NO: 710240 - DNA, 20 bp, Artificial
  CRISPR gRNA sequence
tgcacataaacacaccccac

SEQ ID NO: 710241 - DNA, 20 bp, Artificial
  CRISPR gRNA sequence
tgatccccaaccctatgccc

SEQ ID NO: 710242 - DNA, 20 bp, Artificial
  CRISPR gRNA sequence
gatccccaaccctatgccct

SEQ ID NO: 710243 - DNA, 20 bp, Artificial
  CRISPR gRNA sequence
ctaggcaccgtcactacctt

SEQ ID NO: 710244 - DNA, 20 bp, Artificial
  CRISPR gRNA sequence
actaccttcagtttaaaaat

SEQ ID NO: 710245 - DNA, 20 bp, Artificial
  CRISPR gRNA sequence
ctaccttcagtttaaaaatg

SEQ ID NO: 710246 - DNA, 20 bp, Artificial
  CRISPR gRNA sequence
taccttcagtttaaaaatga

SEQ ID NO: 710247 - DNA, 20 bp, Artificial
  CRISPR gRNA sequence
accttcagtttaaaaatgag

SEQ ID NO: 710248 - DNA, 20 bp, Artificial
  CRISPR gRNA sequence
cttcagtttaaaaatgaggg

SEQ ID NO: 710249 - DNA, 20 bp, Artificial
  CRISPR gRNA sequence
gtttaaaaatgaggggagct

SEQ ID NO: 710250 - DNA, 20 bp, Artificial
  CRISPR gRNA sequence
tttaaaaatgaggggagctg

SEQ ID NO: 710251 - DNA, 20 bp, Artificial
  CRISPR gRNA sequence
aggggagctgaggctcacga

SEQ ID NO: 710252 - DNA, 20 bp, Artificial
  CRISPR gRNA sequence
gaggctcacgaaagttcgtt

SEQ ID NO: 710253 - DNA, 20 bp, Artificial
  CRISPR gRNA sequence
gaaagttcgttaagttgccc

SEQ ID NO: 710254 - DNA, 20 bp, Artificial
  CRISPR gRNA sequence
aaagttcgttaagttgccca

SEQ ID NO: 710255 - DNA, 20 bp, Artificial
  CRISPR gRNA sequence
aagttgcccaaggtcaccct

SEQ ID NO: 710256 - DNA, 20 bp, Artificial
  CRISPR gRNA sequence
gttgcccaaggtcaccctga

SEQ ID NO: 710257 - DNA, 20 bp, Artificial
  CRISPR gRNA sequence
cccaaggtcaccctgagagt

SEQ ID NO: 710258 - DNA, 20 bp, Artificial
  CRISPR gRNA sequence
aaggtcaccctgagagtaag

SEQ ID NO: 710259 - DNA, 20 bp, Artificial
  CRISPR gRNA sequence
gtcaccctgagagtaagtgg

SEQ ID NO: 710260 - DNA, 20 bp, Artificial
  CRISPR gRNA sequence
caccctgagagtaagtggca

SEQ ID NO: 710261 - DNA, 20 bp, Artificial
  CRISPR gRNA sequence
gagagtaagtggcagagccc

SEQ ID NO: 710262 - DNA, 20 bp, Artificial
  CRISPR gRNA sequence
taagtggcagagccccagcc

SEQ ID NO: 710263 - DNA, 20 bp, Artificial
  CRISPR gRNA sequence
aagtggcagagccccagccc

SEQ ID NO: 710264 - DNA, 20 bp, Artificial
  CRISPR gRNA sequence
ggcagagccccagcccaggc

SEQ ID NO: 710265 - DNA, 20 bp, Artificial
  CRISPR gRNA sequence
gcagagccccagcccaggcc

SEQ ID NO: 710266 - DNA, 20 bp, Artificial
  CRISPR gRNA sequence
agccccagcccaggccaggc

SEQ ID NO: 710267 - DNA, 20 bp, Artificial
  CRISPR gRNA sequence
gccccagcccaggccaggcc

SEQ ID NO: 710268 - DNA, 20 bp, Artificial
  CRISPR gRNA sequence
cagcccaggccaggccaggc

SEQ ID NO: 710269 - DNA, 20 bp, Artificial
  CRISPR gRNA sequence
agcccaggccaggccaggcc

SEQ ID NO: 710270 - DNA, 20 bp, Artificial
  CRISPR gRNA sequence
gcccaggccaggccaggccg

SEQ ID NO: 710271 - DNA, 20 bp, Artificial
  CRISPR gRNA sequence
cccaggccaggccaggccgg

SEQ ID NO: 710272 - DNA, 20 bp, Artificial
  CRISPR gRNA sequence
ccaggccaggccaggccggg

SEQ ID NO: 710273 - DNA, 20 bp, Artificial
  CRISPR gRNA sequence
aggccaggccggggggactg

SEQ ID NO: 710274 - DNA, 20 bp, Artificial
  CRISPR gRNA sequence
ggccaggccggggggactgc

SEQ ID NO: 710275 - DNA, 20 bp, Artificial
  CRISPR gRNA sequence
gccaggccggggggactgca

SEQ ID NO: 710276 - DNA, 20 bp, Artificial
  CRISPR gRNA sequence
ccacgctcttaacccctatc

SEQ ID NO: 710277 - DNA, 20 bp, Artificial
  CRISPR gRNA sequence
agatctacttcttcacacct

SEQ ID NO: 710278 - DNA, 20 bp, Artificial
  CRISPR gRNA sequence
tttttcccttttgtcactta

SEQ ID NO: 710279 - DNA, 20 bp, Artificial
  CRISPR gRNA sequence
tttcccttttgtcacttaca

SEQ ID NO: 710280 - DNA, 20 bp, Artificial
  CRISPR gRNA sequence
tttgtcacttacagagatca

SEQ ID NO: 710281 - DNA, 20 bp, Artificial
  CRISPR gRNA sequence
tgtcacttacagagatcata

SEQ ID NO: 710282 - DNA, 20 bp, Artificial
  CRISPR gRNA sequence
acttacagagatcatagagc

SEQ ID NO: 710283 - DNA, 20 bp, Artificial
  CRISPR gRNA sequence
ctagtgattgcactttattg

SEQ ID NO: 710284 - DNA, 20 bp, Artificial
  CRISPR gRNA sequence
actttattgaagtccatgtt

SEQ ID NO: 710285 - DNA, 20 bp, Artificial
  CRISPR gRNA sequence
tccatgtttagatgtttaaa

SEQ ID NO: 710286 - DNA, 20 bp, Artificial
  CRISPR gRNA sequence
atgtttagatgtttaaaaag

SEQ ID NO: 710287 - DNA, 20 bp, Artificial
  CRISPR gRNA sequence
gtttaaaaagtagtatatgc

SEQ ID NO: 710288 - DNA, 20 bp, Artificial
  CRISPR gRNA sequence
aaaagtagtatatgccagtt

SEQ ID NO: 710289 - DNA, 20 bp, Artificial
  CRISPR gRNA sequence
tcaaacgttaatgtgcacat

SEQ ID NO: 710290 - DNA, 20 bp, Artificial
  CRISPR gRNA sequence
taatgtgcacatgagtgccc

SEQ ID NO: 710291 - DNA, 20 bp, Artificial
  CRISPR gRNA sequence
atgtgcacatgagtgccctg

SEQ ID NO: 710292 - DNA, 20 bp, Artificial
  CRISPR gRNA sequence
gtgccctggagatcttgtta

SEQ ID NO: 710293 - DNA, 20 bp, Artificial
  CRISPR gRNA sequence
ctggagatcttgttaaagtg

SEQ ID NO: 710294 - DNA, 20 bp, Artificial
  CRISPR gRNA sequence
aagtgcagtttctgattctc

SEQ ID NO: 710295 - DNA, 20 bp, Artificial
  CRISPR gRNA sequence
agtgcagtttctgattctct

SEQ ID NO: 710296 - DNA, 20 bp, Artificial
  CRISPR gRNA sequence
agtttctgattctctaggtc

SEQ ID NO: 710297 - DNA, 20 bp, Artificial
  CRISPR gRNA sequence
gtttctgattctctaggtct

SEQ ID NO: 710298 - DNA, 20 bp, Artificial
  CRISPR gRNA sequence
ctgattctctaggtctggga

SEQ ID NO: 710299 - DNA, 20 bp, Artificial
  CRISPR gRNA sequence
tgattctctaggtctgggat

SEQ ID NO: 710300 - DNA, 20 bp, Artificial
  CRISPR gRNA sequence
gattctctaggtctgggatg

SEQ ID NO: 710301 - DNA, 20 bp, Artificial
  CRISPR gRNA sequence
ccataatttgctttcctaac

SEQ ID NO: 710302 - DNA, 20 bp, Artificial
  CRISPR gRNA sequence
ttgctttcctaacaagttcc

SEQ ID NO: 710303 - DNA, 20 bp, Artificial
  CRISPR gRNA sequence
tttcctaacaagttcccagc

SEQ ID NO: 710304 - DNA, 20 bp, Artificial
  CRISPR gRNA sequence
ccagccggtgccaatgctgc

SEQ ID NO: 710305 - DNA, 20 bp, Artificial
  CRISPR gRNA sequence
ccggtgccaatgctgccaga

SEQ ID NO: 710306 - DNA, 20 bp, Artificial
  CRISPR gRNA sequence
cggtgccaatgctgccagac

SEQ ID NO: 710307 - DNA, 20 bp, Artificial
  CRISPR gRNA sequence
gccagacgggaccgcacttt

SEQ ID NO: 710308 - DNA, 20 bp, Artificial
  CRISPR gRNA sequence
gaccgcactttcagaaactc

SEQ ID NO: 710309 - DNA, 20 bp, Artificial
  CRISPR gRNA sequence
gcactttcagaaactctggc

SEQ ID NO: 710310 - DNA, 20 bp, Artificial
  CRISPR gRNA sequence
actttcagaaactctggccg

SEQ ID NO: 710311 - DNA, 20 bp, Artificial
  CRISPR gRNA sequence
gcactactgccacctcgtgt

SEQ ID NO: 710312 - DNA, 20 bp, Artificial
  CRISPR gRNA sequence
tgccacctcgtgtcagccac

SEQ ID NO: 710313 - DNA, 20 bp, Artificial
  CRISPR gRNA sequence
gtgtcagccactagaactgc

SEQ ID NO: 710314 - DNA, 20 bp, Artificial
  CRISPR gRNA sequence
agaactgcaagtcctaaaat

SEQ ID NO: 710315 - DNA, 20 bp, Artificial
  CRISPR gRNA sequence
aagtcctaaaatgagtaacc

SEQ ID NO: 710316 - DNA, 20 bp, Artificial
  CRISPR gRNA sequence
gtaacctggcatctttccct

SEQ ID NO: 710317 - DNA, 20 bp, Artificial
  CRISPR gRNA sequence
aacctggcatctttccctaa

SEQ ID NO: 710318 - DNA, 20 bp, Artificial
  CRISPR gRNA sequence
tttccctaagagctaactct

SEQ ID NO: 710319 - DNA, 20 bp, Artificial
  CRISPR gRNA sequence
ttccctaagagctaactctt

SEQ ID NO: 710320 - DNA, 20 bp, Artificial
  CRISPR gRNA sequence
tccctaagagctaactcttg

SEQ ID NO: 710321 - DNA, 20 bp, Artificial
  CRISPR gRNA sequence
ccctaagagctaactcttgg

SEQ ID NO: 710322 - DNA, 20 bp, Artificial
  CRISPR gRNA sequence
tgttttgttttgttttgttt

SEQ ID NO: 710323 - DNA, 20 bp, Artificial
  CRISPR gRNA sequence
ctgattctcattctgctgct

SEQ ID NO: 710324 - DNA, 20 bp, Artificial
  CRISPR gRNA sequence
tgattctcattctgctgctc

SEQ ID NO: 710325 - DNA, 20 bp, Artificial
  CRISPR gRNA sequence
tctcattctgctgctcaggc

SEQ ID NO: 710326 - DNA, 20 bp, Artificial
  CRISPR gRNA sequence
tcattctgctgctcaggctg

SEQ ID NO: 710327 - DNA, 20 bp, Artificial
  CRISPR gRNA sequence
ctgctgctcaggctggagtg

SEQ ID NO: 710328 - DNA, 20 bp, Artificial
  CRISPR gRNA sequence
ctgctcaggctggagtgcag

SEQ ID NO: 710329 - DNA, 20 bp, Artificial
  CRISPR gRNA sequence
ggagtgcagcggtgcaatct

SEQ ID NO: 710330 - DNA, 20 bp, Artificial
  CRISPR gRNA sequence
accttgcaacctccgcctcc

SEQ ID NO: 710331 - DNA, 20 bp, Artificial
  CRISPR gRNA sequence
ccttgcaacctccgcctccc

SEQ ID NO: 710332 - DNA, 20 bp, Artificial
  CRISPR gRNA sequence
aacctccgcctcccgggttc

SEQ ID NO: 710333 - DNA, 20 bp, Artificial
  CRISPR gRNA sequence
ttcaagcgattctcctgcct

SEQ ID NO: 710334 - DNA, 20 bp, Artificial
  CRISPR gRNA sequence
ttctcctgcctcagcctcct

SEQ ID NO: 710335 - DNA, 20 bp, Artificial
  CRISPR gRNA sequence
tcctgcctcagcctcctgag

SEQ ID NO: 710336 - DNA, 20 bp, Artificial
  CRISPR gRNA sequence
gcctcagcctcctgagtagc

SEQ ID NO: 710337 - DNA, 20 bp, Artificial
  CRISPR gRNA sequence
cctcagcctcctgagtagct

SEQ ID NO: 710338 - DNA, 20 bp, Artificial
  CRISPR gRNA sequence
ctcctgagtagctgggatta

SEQ ID NO: 710339 - DNA, 20 bp, Artificial
  CRISPR gRNA sequence
tcctgagtagctgggattac

SEQ ID NO: 710340 - DNA, 20 bp, Artificial
  CRISPR gRNA sequence
caggcgcgcgccaccacgcc

SEQ ID NO: 710341 - DNA, 20 bp, Artificial
  CRISPR gRNA sequence
ctggctaatttttgtatttt

SEQ ID NO: 710342 - DNA, 20 bp, Artificial
  CRISPR gRNA sequence
gctaatttttgtatttttag

SEQ ID NO: 710343 - DNA, 20 bp, Artificial
  CRISPR gRNA sequence
taatttttgtatttttagta

SEQ ID NO: 710344 - DNA, 20 bp, Artificial
  CRISPR gRNA sequence
ttgtatttttagtagagatg

SEQ ID NO: 710345 - DNA, 20 bp, Artificial
  CRISPR gRNA sequence
gagatgtggtttcatcgtgt

SEQ ID NO: 710346 - DNA, 20 bp, Artificial
  CRISPR gRNA sequence
tgtggtttcatcgtgttggc

SEQ ID NO: 710347 - DNA, 20 bp, Artificial
  CRISPR gRNA sequence
gtggtttcatcgtgttggcc

SEQ ID NO: 710348 - DNA, 20 bp, Artificial
  CRISPR gRNA sequence
tttcatcgtgttggccaggc

SEQ ID NO: 710349 - DNA, 20 bp, Artificial
  CRISPR gRNA sequence
acctcgtgatccacccacct

SEQ ID NO: 710350 - DNA, 20 bp, Artificial
  CRISPR gRNA sequence
ccacccaccttggcctccca

SEQ ID NO: 710351 - DNA, 20 bp, Artificial
  CRISPR gRNA sequence
accttggcctcccaaagtgc

SEQ ID NO: 710352 - DNA, 20 bp, Artificial
  CRISPR gRNA sequence
ccttggcctcccaaagtgct

SEQ ID NO: 710353 - DNA, 20 bp, Artificial
  CRISPR gRNA sequence
ctcccaaagtgctgggatta

SEQ ID NO: 710354 - DNA, 20 bp, Artificial
  CRISPR gRNA sequence
tcccaaagtgctgggattac

SEQ ID NO: 710355 - DNA, 20 bp, Artificial
  CRISPR gRNA sequence
agtgctgggattacaggcgt

SEQ ID NO: 710356 - DNA, 20 bp, Artificial
  CRISPR gRNA sequence
caggcgtgagccaccgcgtc

SEQ ID NO: 710357 - DNA, 20 bp, Artificial
  CRISPR gRNA sequence
tgagccaccgcgtccagcct

SEQ ID NO: 710358 - DNA, 20 bp, Artificial
  CRISPR gRNA sequence
agccaccgcgtccagcctaa

SEQ ID NO: 710359 - DNA, 20 bp, Artificial
  CRISPR gRNA sequence
agcctaagagctaactctga

SEQ ID NO: 710360 - DNA, 20 bp, Artificial
  CRISPR gRNA sequence
cctaagagctaactctgaca

SEQ ID NO: 710361 - DNA, 20 bp, Artificial
  CRISPR gRNA sequence
ctaagagctaactctgacag

SEQ ID NO: 710362 - DNA, 20 bp, Artificial
  CRISPR gRNA sequence
acactgcttataaccctgca

SEQ ID NO: 710363 - DNA, 20 bp, Artificial
  CRISPR gRNA sequence
tctctgccattaccattgta

SEQ ID NO: 710364 - DNA, 20 bp, Artificial
  CRISPR gRNA sequence
gccattaccattgtatagat

SEQ ID NO: 710365 - DNA, 20 bp, Artificial
  CRISPR gRNA sequence
attgtatagatgagacaact

SEQ ID NO: 710366 - DNA, 20 bp, Artificial
  CRISPR gRNA sequence
ttgtatagatgagacaactg

SEQ ID NO: 710367 - DNA, 20 bp, Artificial
  CRISPR gRNA sequence
gatgagacaactgaggctca

SEQ ID NO: 710368 - DNA, 20 bp, Artificial
  CRISPR gRNA sequence
atgagacaactgaggctcaa

SEQ ID NO: 710369 - DNA, 20 bp, Artificial
  CRISPR gRNA sequence
ggctcaaaggctcgaacaac

SEQ ID NO: 710370 - DNA, 20 bp, Artificial
  CRISPR gRNA sequence
aaggctcgaacaactagtca

SEQ ID NO: 710371 - DNA, 20 bp, Artificial
  CRISPR gRNA sequence
agtcatgaaatcaatcaaca

SEQ ID NO: 710372 - DNA, 20 bp, Artificial
  CRISPR gRNA sequence
tcaacaaagacctattttct

SEQ ID NO: 710373 - DNA, 20 bp, Artificial
  CRISPR gRNA sequence
acaaagacctattttctgag

SEQ ID NO: 710374 - DNA, 20 bp, Artificial
  CRISPR gRNA sequence
attttctgagtagcaattat

SEQ ID NO: 710375 - DNA, 20 bp, Artificial
  CRISPR gRNA sequence
gagtagcaattataagccac

SEQ ID NO: 710376 - DNA, 20 bp, Artificial
  CRISPR gRNA sequence
agtagcaattataagccacg

SEQ ID NO: 710377 - DNA, 20 bp, Artificial
  CRISPR gRNA sequence
aattataagccacgaggatg

SEQ ID NO: 710378 - DNA, 20 bp, Artificial
  CRISPR gRNA sequence
tgaaaaaaattcctgcctac

SEQ ID NO: 710379 - DNA, 20 bp, Artificial
  CRISPR gRNA sequence
attcctgcctacaagaatta

SEQ ID NO: 710380 - DNA, 20 bp, Artificial
  CRISPR gRNA sequence
tgcctacaagaattaaagaa

SEQ ID NO: 710381 - DNA, 20 bp, Artificial
  CRISPR gRNA sequence
aagaattaaagaatagtcac

SEQ ID NO: 710382 - DNA, 20 bp, Artificial
  CRISPR gRNA sequence
aattaaagaatagtcactag

SEQ ID NO: 710383 - DNA, 20 bp, Artificial
  CRISPR gRNA sequence
aaagaatagtcactagcagc

SEQ ID NO: 710384 - DNA, 20 bp, Artificial
  CRISPR gRNA sequence
aagaatagtcactagcagcc

SEQ ID NO: 710385 - DNA, 20 bp, Artificial
  CRISPR gRNA sequence
tagtcactagcagccaggcg

SEQ ID NO: 710386 - DNA, 20 bp, Artificial
  CRISPR gRNA sequence
tcactagcagccaggcgcag

SEQ ID NO: 710387 - DNA, 20 bp, Artificial
  CRISPR gRNA sequence
gtggttcacacctataatcc

SEQ ID NO: 710388 - DNA, 20 bp, Artificial
  CRISPR gRNA sequence
cacctataatcctagcactt

SEQ ID NO: 710389 - DNA, 20 bp, Artificial
  CRISPR gRNA sequence
acctataatcctagcacttt

SEQ ID NO: 710390 - DNA, 20 bp, Artificial
  CRISPR gRNA sequence
ctataatcctagcactttgg

SEQ ID NO: 710391 - DNA, 20 bp, Artificial
  CRISPR gRNA sequence
tataatcctagcactttggg

SEQ ID NO: 710392 - DNA, 20 bp, Artificial
  CRISPR gRNA sequence
cctagcactttgggaggctg

SEQ ID NO: 710393 - DNA, 20 bp, Artificial
  CRISPR gRNA sequence
agcactttgggaggctgaag

SEQ ID NO: 710394 - DNA, 20 bp, Artificial
  CRISPR gRNA sequence
gcactttgggaggctgaagc

SEQ ID NO: 710395 - DNA, 20 bp, Artificial
  CRISPR gRNA sequence
ctttgggaggctgaagcagg

SEQ ID NO: 710396 - DNA, 20 bp, Artificial
  CRISPR gRNA sequence
ctgaagcaggtggatcacct

SEQ ID NO: 710397 - DNA, 20 bp, Artificial
  CRISPR gRNA sequence
tgaagcaggtggatcacctg

SEQ ID NO: 710398 - DNA, 20 bp, Artificial
  CRISPR gRNA sequence
gcaggtggatcacctgaggt

SEQ ID NO: 710399 - DNA, 20 bp, Artificial
  CRISPR gRNA sequence
caggtggatcacctgaggtc

SEQ ID NO: 710400 - DNA, 20 bp, Artificial
  CRISPR gRNA sequence
ggtggatcacctgaggtcag

SEQ ID NO: 710401 - DNA, 20 bp, Artificial
  CRISPR gRNA sequence
tcacctgaggtcaggagttt

SEQ ID NO: 710402 - DNA, 20 bp, Artificial
  CRISPR gRNA sequence
tcaggagtttgagaccaacc

SEQ ID NO: 710403 - DNA, 20 bp, Artificial
  CRISPR gRNA sequence
tgagaccaacctggacaaca

SEQ ID NO: 710404 - DNA, 20 bp, Artificial
  CRISPR gRNA sequence
ctaaaaattaaaaaaaaatt

SEQ ID NO: 710405 - DNA, 20 bp, Artificial
  CRISPR gRNA sequence
aaattaaaaaaaaatttagc

SEQ ID NO: 710406 - DNA, 20 bp, Artificial
  CRISPR gRNA sequence
aattaaaaaaaaatttagcc

SEQ ID NO: 710407 - DNA, 20 bp, Artificial
  CRISPR gRNA sequence
aaaaaaaatttagccaggcg

SEQ ID NO: 710408 - DNA, 20 bp, Artificial
  CRISPR gRNA sequence
aaaaatttagccaggcgtgg

SEQ ID NO: 710409 - DNA, 20 bp, Artificial
  CRISPR gRNA sequence
atttagccaggcgtggtggc

SEQ ID NO: 710410 - DNA, 20 bp, Artificial
  CRISPR gRNA sequence
gtggcaagcgcctgtaaacc

SEQ ID NO: 710411 - DNA, 20 bp, Artificial
  CRISPR gRNA sequence
cgcctgtaaacccagctact

SEQ ID NO: 710412 - DNA, 20 bp, Artificial
  CRISPR gRNA sequence
gcctgtaaacccagctactc

SEQ ID NO: 710413 - DNA, 20 bp, Artificial
  CRISPR gRNA sequence
ctgtaaacccagctactcgg

SEQ ID NO: 710414 - DNA, 20 bp, Artificial
  CRISPR gRNA sequence
tgtaaacccagctactcggg

SEQ ID NO: 710415 - DNA, 20 bp, Artificial
  CRISPR gRNA sequence
acccagctactcgggaggct

SEQ ID NO: 710416 - DNA, 20 bp, Artificial
  CRISPR gRNA sequence
agctactcgggaggctgaga

SEQ ID NO: 710417 - DNA, 20 bp, Artificial
  CRISPR gRNA sequence
gctactcgggaggctgagac

SEQ ID NO: 710418 - DNA, 20 bp, Artificial
  CRISPR gRNA sequence
tactcgggaggctgagacag

SEQ ID NO: 710419 - DNA, 20 bp, Artificial
  CRISPR gRNA sequence
acaggagaatctcttgaacc

SEQ ID NO: 710420 - DNA, 20 bp, Artificial
  CRISPR gRNA sequence
caggagaatctcttgaacct

SEQ ID NO: 710421 - DNA, 20 bp, Artificial
  CRISPR gRNA sequence
ggagaatctcttgaacctgg

SEQ ID NO: 710422 - DNA, 20 bp, Artificial
  CRISPR gRNA sequence
gagaatctcttgaacctggg

SEQ ID NO: 710423 - DNA, 20 bp, Artificial
  CRISPR gRNA sequence
aatctcttgaacctgggagg

SEQ ID NO: 710424 - DNA, 20 bp, Artificial
  CRISPR gRNA sequence
tctcttgaacctgggaggtg

SEQ ID NO: 710425 - DNA, 20 bp, Artificial
  CRISPR gRNA sequence
ctcttgaacctgggaggtgg

SEQ ID NO: 710426 - DNA, 20 bp, Artificial
  CRISPR gRNA sequence
aacctgggaggtggaggttg

SEQ ID NO: 710427 - DNA, 20 bp, Artificial
  CRISPR gRNA sequence
tgggaggtggaggttgcagt

SEQ ID NO: 710428 - DNA, 20 bp, Artificial
  CRISPR gRNA sequence
ggtggaggttgcagtgagcc

SEQ ID NO: 710429 - DNA, 20 bp, Artificial
  CRISPR gRNA sequence
gaggttgcagtgagccaaga

SEQ ID NO: 710430 - DNA, 20 bp, Artificial
  CRISPR gRNA sequence
aggttgcagtgagccaagat

SEQ ID NO: 710431 - DNA, 20 bp, Artificial
  CRISPR gRNA sequence
agatgggtgccactgccctc

SEQ ID NO: 710432 - DNA, 20 bp, Artificial
  CRISPR gRNA sequence
gtgccactgccctccagcct

SEQ ID NO: 710433 - DNA, 20 bp, Artificial
  CRISPR gRNA sequence
ctgccctccagcctgagcaa

SEQ ID NO: 710434 - DNA, 20 bp, Artificial
  CRISPR gRNA sequence
gccctccagcctgagcaaca

SEQ ID NO: 710435 - DNA, 20 bp, Artificial
  CRISPR gRNA sequence
tccagcctgagcaacagagt

SEQ ID NO: 710436 - DNA, 20 bp, Artificial
  CRISPR gRNA sequence
cagagtgagactgtttcaaa

SEQ ID NO: 710437 - DNA, 20 bp, Artificial
  CRISPR gRNA sequence
tgagactgtttcaaaaagaa

SEQ ID NO: 710438 - DNA, 20 bp, Artificial
  CRISPR gRNA sequence
ctgtttcaaaaagaaaagaa

SEQ ID NO: 710439 - DNA, 20 bp, Artificial
  CRISPR gRNA sequence
aaaaagaaaagaatagtcac

SEQ ID NO: 710440 - DNA, 20 bp, Artificial
  CRISPR gRNA sequence
agaaaagaatagtcactagc

SEQ ID NO: 710441 - DNA, 20 bp, Artificial
  CRISPR gRNA sequence
gaatagtcactagcaagtgc

SEQ ID NO: 710442 - DNA, 20 bp, Artificial
  CRISPR gRNA sequence
atagtcactagcaagtgcca

SEQ ID NO: 710443 - DNA, 20 bp, Artificial
  CRISPR gRNA sequence
actagcaagtgccagagcca

SEQ ID NO: 710444 - DNA, 20 bp, Artificial
  CRISPR gRNA sequence
cagagccacagcaccaactc

SEQ ID NO: 710445 - DNA, 20 bp, Artificial
  CRISPR gRNA sequence
agccacagcaccaactcaag

SEQ ID NO: 710446 - DNA, 20 bp, Artificial
  CRISPR gRNA sequence
acagcaccaactcaagaagc

SEQ ID NO: 710447 - DNA, 20 bp, Artificial
  CRISPR gRNA sequence
aactcaagaagccagaaacc

SEQ ID NO: 710448 - DNA, 20 bp, Artificial
  CRISPR gRNA sequence
actcaagaagccagaaacct

SEQ ID NO: 710449 - DNA, 20 bp, Artificial
  CRISPR gRNA sequence
ctcaagaagccagaaacctg

SEQ ID NO: 710450 - DNA, 20 bp, Artificial
  CRISPR gRNA sequence
tcaaccttaatcccccttct

SEQ ID NO: 710451 - DNA, 20 bp, Artificial
  CRISPR gRNA sequence
cttctcagaccatacccaca

SEQ ID NO: 710452 - DNA, 20 bp, Artificial
  CRISPR gRNA sequence
ttctcagaccatacccacaa

SEQ ID NO: 710453 - DNA, 20 bp, Artificial
  CRISPR gRNA sequence
ctcagaccatacccacaaag

SEQ ID NO: 710454 - DNA, 20 bp, Artificial
  CRISPR gRNA sequence
agaccatacccacaaaggag

SEQ ID NO: 710455 - DNA, 20 bp, Artificial
  CRISPR gRNA sequence
acaaaggagaagctccctcc

SEQ ID NO: 710456 - DNA, 20 bp, Artificial
  CRISPR gRNA sequence
tcccccaatccacacttccc

SEQ ID NO: 710457 - DNA, 20 bp, Artificial
  CRISPR gRNA sequence
cccccaatccacacttcccc

SEQ ID NO: 710458 - DNA, 20 bp, Artificial
  CRISPR gRNA sequence
cccaatccacacttccccag

SEQ ID NO: 710459 - DNA, 20 bp, Artificial
  CRISPR gRNA sequence
ccaatccacacttccccagg

SEQ ID NO: 710460 - DNA, 20 bp, Artificial
  CRISPR gRNA sequence
atccacacttccccaggagg

SEQ ID NO: 710461 - DNA, 20 bp, Artificial
  CRISPR gRNA sequence
ccccaggaggaagcccctgc

SEQ ID NO: 710462 - DNA, 20 bp, Artificial
  CRISPR gRNA sequence
cccaggaggaagcccctgct

SEQ ID NO: 710463 - DNA, 20 bp, Artificial
  CRISPR gRNA sequence
caggaggaagcccctgctgg

SEQ ID NO: 710464 - DNA, 20 bp, Artificial
  CRISPR gRNA sequence
gaggaagcccctgctgggag

SEQ ID NO: 710465 - DNA, 20 bp, Artificial
  CRISPR gRNA sequence
aggaagcccctgctgggagt

SEQ ID NO: 710466 - DNA, 20 bp, Artificial
  CRISPR gRNA sequence
ggaagcccctgctgggagta

SEQ ID NO: 710467 - DNA, 20 bp, Artificial
  CRISPR gRNA sequence
gaagcccctgctgggagtag

SEQ ID NO: 710468 - DNA, 20 bp, Artificial
  CRISPR gRNA sequence
cccctgctgggagtaggggt

SEQ ID NO: 710469 - DNA, 20 bp, Artificial
  CRISPR gRNA sequence
ctgctgggagtaggggtgag

SEQ ID NO: 710470 - DNA, 20 bp, Artificial
  CRISPR gRNA sequence
tgctgggagtaggggtgagt

SEQ ID NO: 710471 - DNA, 20 bp, Artificial
  CRISPR gRNA sequence
gggagtaggggtgagtgggc

SEQ ID NO: 710472 - DNA, 20 bp, Artificial
  CRISPR gRNA sequence
ggagtaggggtgagtgggct

SEQ ID NO: 710473 - DNA, 20 bp, Artificial
  CRISPR gRNA sequence
ctgggaccattacctgcatc

SEQ ID NO: 710474 - DNA, 20 bp, Artificial
  CRISPR gRNA sequence
accattacctgcatccagaa

SEQ ID NO: 710475 - DNA, 20 bp, Artificial
  CRISPR gRNA sequence
ccattacctgcatccagaac

SEQ ID NO: 710476 - DNA, 20 bp, Artificial
  CRISPR gRNA sequence
atccagaacgggcttccccg

SEQ ID NO: 710477 - DNA, 20 bp, Artificial
  CRISPR gRNA sequence
ccagaacgggcttccccgtg

SEQ ID NO: 710478 - DNA, 20 bp, Artificial
  CRISPR gRNA sequence
cagaacgggcttccccgtgg

SEQ ID NO: 710479 - DNA, 20 bp, Artificial
  CRISPR gRNA sequence
gaacgggcttccccgtggag

SEQ ID NO: 710480 - DNA, 20 bp, Artificial
  CRISPR gRNA sequence
acgggcttccccgtggagga

SEQ ID NO: 710481 - DNA, 20 bp, Artificial
  CRISPR gRNA sequence
gggcttccccgtggaggaga

SEQ ID NO: 710482 - DNA, 20 bp, Artificial
  CRISPR gRNA sequence
ccccgtggaggagagagcga

SEQ ID NO: 710483 - DNA, 20 bp, Artificial
  CRISPR gRNA sequence
cccgtggaggagagagcgac

SEQ ID NO: 710484 - DNA, 20 bp, Artificial
  CRISPR gRNA sequence
cgtggaggagagagcgacgg

SEQ ID NO: 710485 - DNA, 20 bp, Artificial
  CRISPR gRNA sequence
ggagagagcgacgggagcgc

SEQ ID NO: 710486 - DNA, 20 bp, Artificial
  CRISPR gRNA sequence
agagcgacgggagcgctggt

SEQ ID NO: 710487 - DNA, 20 bp, Artificial
  CRISPR gRNA sequence
gagcgacgggagcgctggtt

SEQ ID NO: 710488 - DNA, 20 bp, Artificial
  CRISPR gRNA sequence
gacgggagcgctggttggga

SEQ ID NO: 710489 - DNA, 20 bp, Artificial
  CRISPR gRNA sequence
acgggagcgctggttgggat

SEQ ID NO: 710490 - DNA, 20 bp, Artificial
  CRISPR gRNA sequence
ggagcgctggttgggatggg

SEQ ID NO: 710491 - DNA, 20 bp, Artificial
  CRISPR gRNA sequence
tgggatgggcagcgtcttac

SEQ ID NO: 710492 - DNA, 20 bp, Artificial
  CRISPR gRNA sequence
tgggcagcgtcttactggcc

SEQ ID NO: 710493 - DNA, 20 bp, Artificial
  CRISPR gRNA sequence
gggcagcgtcttactggcct

SEQ ID NO: 710494 - DNA, 20 bp, Artificial
  CRISPR gRNA sequence
gcagcgtcttactggcctgg

SEQ ID NO: 710495 - DNA, 20 bp, Artificial
  CRISPR gRNA sequence
ttactggcctgggagtccac

SEQ ID NO: 710496 - DNA, 20 bp, Artificial
  CRISPR gRNA sequence
tggcctgggagtccaccagc

SEQ ID NO: 710497 - DNA, 20 bp, Artificial
  CRISPR gRNA sequence
ggagtccaccagcaagctct

SEQ ID NO: 710498 - DNA, 20 bp, Artificial
  CRISPR gRNA sequence
gtccaccagcaagctctgag

SEQ ID NO: 710499 - DNA, 20 bp, Artificial
  CRISPR gRNA sequence
tccaccagcaagctctgagt

SEQ ID NO: 710500 - DNA, 20 bp, Artificial
  CRISPR gRNA sequence
ccaccagcaagctctgagtg

SEQ ID NO: 710501 - DNA, 20 bp, Artificial
  CRISPR gRNA sequence
cagcaagctctgagtggggc

SEQ ID NO: 710502 - DNA, 20 bp, Artificial
  CRISPR gRNA sequence
tctgagtggggctggtgctg

SEQ ID NO: 710503 - DNA, 20 bp, Artificial
  CRISPR gRNA sequence
ctgagtggggctggtgctgc

SEQ ID NO: 710504 - DNA, 20 bp, Artificial
  CRISPR gRNA sequence
tgagtggggctggtgctgcg

SEQ ID NO: 710505 - DNA, 20 bp, Artificial
  CRISPR gRNA sequence
agtggggctggtgctgcggg

SEQ ID NO: 710506 - DNA, 20 bp, Artificial
  CRISPR gRNA sequence
ggggctggtgctgcggggag

SEQ ID NO: 710507 - DNA, 20 bp, Artificial
  CRISPR gRNA sequence
ggtgctgcggggagaagccc

SEQ ID NO: 710508 - DNA, 20 bp, Artificial
  CRISPR gRNA sequence
gtgctgcggggagaagccca

SEQ ID NO: 710509 - DNA, 20 bp, Artificial
  CRISPR gRNA sequence
ctgcggggagaagcccaagg

SEQ ID NO: 710510 - DNA, 20 bp, Artificial
  CRISPR gRNA sequence
tgcggggagaagcccaaggc

SEQ ID NO: 710511 - DNA, 20 bp, Artificial
  CRISPR gRNA sequence
cggggagaagcccaaggcag

SEQ ID NO: 710512 - DNA, 20 bp, Artificial
  CRISPR gRNA sequence
agcccaaggcaggagtgatg

SEQ ID NO: 710513 - DNA, 20 bp, Artificial
  CRISPR gRNA sequence
caaggcaggagtgatgaaga

SEQ ID NO: 710514 - DNA, 20 bp, Artificial
  CRISPR gRNA sequence
aaggcaggagtgatgaagat

SEQ ID NO: 710515 - DNA, 20 bp, Artificial
  CRISPR gRNA sequence
gcaggagtgatgaagatggg

SEQ ID NO: 710516 - DNA, 20 bp, Artificial
  CRISPR gRNA sequence
aggagtgatgaagatgggaa

SEQ ID NO: 710517 - DNA, 20 bp, Artificial
  CRISPR gRNA sequence
ggagtgatgaagatgggaag

SEQ ID NO: 710518 - DNA, 20 bp, Artificial
  CRISPR gRNA sequence
gagtgatgaagatgggaaga

SEQ ID NO: 710519 - DNA, 20 bp, Artificial
  CRISPR gRNA sequence
tgatgaagatgggaagaggg

SEQ ID NO: 710520 - DNA, 20 bp, Artificial
  CRISPR gRNA sequence
tgaagatgggaagagggaag

SEQ ID NO: 710521 - DNA, 20 bp, Artificial
  CRISPR gRNA sequence
gaagatgggaagagggaagt

SEQ ID NO: 710522 - DNA, 20 bp, Artificial
  CRISPR gRNA sequence
ggaagagggaagtgggtctt

SEQ ID NO: 710523 - DNA, 20 bp, Artificial
  CRISPR gRNA sequence
gaagagggaagtgggtcttc

SEQ ID NO: 710524 - DNA, 20 bp, Artificial
  CRISPR gRNA sequence
caggaataattccctttctc

SEQ ID NO: 710525 - DNA, 20 bp, Artificial
  CRISPR gRNA sequence
ggaataattccctttctctg

SEQ ID NO: 710526 - DNA, 20 bp, Artificial
  CRISPR gRNA sequence
ttctctggagactgcgcaac

SEQ ID NO: 710527 - DNA, 20 bp, Artificial
  CRISPR gRNA sequence
ctctggagactgcgcaacca

SEQ ID NO: 710528 - DNA, 20 bp, Artificial
  CRISPR gRNA sequence
gagactgcgcaaccagagcc

SEQ ID NO: 710529 - DNA, 20 bp, Artificial
  CRISPR gRNA sequence
agactgcgcaaccagagcct

SEQ ID NO: 710530 - DNA, 20 bp, Artificial
  CRISPR gRNA sequence
gcaaccagagcctgggcccc

SEQ ID NO: 710531 - DNA, 20 bp, Artificial
  CRISPR gRNA sequence
gcccctagatcctctgcccc

SEQ ID NO: 710532 - DNA, 20 bp, Artificial
  CRISPR gRNA sequence
cctctgccccgagtctctgc

SEQ ID NO: 710533 - DNA, 20 bp, Artificial
  CRISPR gRNA sequence
ctctgccccgagtctctgcc

SEQ ID NO: 710534 - DNA, 20 bp, Artificial
  CRISPR gRNA sequence
gagtctctgccaggcatttt

SEQ ID NO: 710535 - DNA, 20 bp, Artificial
  CRISPR gRNA sequence
agtctctgccaggcattttg

SEQ ID NO: 710536 - DNA, 20 bp, Artificial
  CRISPR gRNA sequence
gtctctgccaggcattttga

SEQ ID NO: 710537 - DNA, 20 bp, Artificial
  CRISPR gRNA sequence
tctgccaggcattttgaggg

SEQ ID NO: 710538 - DNA, 20 bp, Artificial
  CRISPR gRNA sequence
ctgccaggcattttgagggc

SEQ ID NO: 710539 - DNA, 20 bp, Artificial
  CRISPR gRNA sequence
tgccaggcattttgagggca

SEQ ID NO: 710540 - DNA, 20 bp, Artificial
  CRISPR gRNA sequence
ggcattttgagggcagggac

SEQ ID NO: 710541 - DNA, 20 bp, Artificial
  CRISPR gRNA sequence
gcattttgagggcagggact

SEQ ID NO: 710542 - DNA, 20 bp, Artificial
  CRISPR gRNA sequence
gagggcagggactgggtttc

SEQ ID NO: 710543 - DNA, 20 bp, Artificial
  CRISPR gRNA sequence
agggcagggactgggtttca

SEQ ID NO: 710544 - DNA, 20 bp, Artificial
  CRISPR gRNA sequence
gactgggtttcaaggccttc

SEQ ID NO: 710545 - DNA, 20 bp, Artificial
  CRISPR gRNA sequence
aaggccttctggctttccaa

SEQ ID NO: 710546 - DNA, 20 bp, Artificial
  CRISPR gRNA sequence
ttctggctttccaatggtgt

SEQ ID NO: 710547 - DNA, 20 bp, Artificial
  CRISPR gRNA sequence
gctttccaatggtgtcagca

SEQ ID NO: 710548 - DNA, 20 bp, Artificial
  CRISPR gRNA sequence
tttccaatggtgtcagcaaa

SEQ ID NO: 710549 - DNA, 20 bp, Artificial
  CRISPR gRNA sequence
caatggtgtcagcaaagaga

SEQ ID NO: 710550 - DNA, 20 bp, Artificial
  CRISPR gRNA sequence
aatggtgtcagcaaagagat

SEQ ID NO: 710551 - DNA, 20 bp, Artificial
  CRISPR gRNA sequence
gatgggcacacatttaacaa

SEQ ID NO: 710552 - DNA, 20 bp, Artificial
  CRISPR gRNA sequence
tgggcacacatttaacaaaa

SEQ ID NO: 710553 - DNA, 20 bp, Artificial
  CRISPR gRNA sequence
gcacacatttaacaaaagag

SEQ ID NO: 710554 - DNA, 20 bp, Artificial
  CRISPR gRNA sequence
catttaacaaaagagcagcc

SEQ ID NO: 710555 - DNA, 20 bp, Artificial
  CRISPR gRNA sequence
atttaacaaaagagcagccc

SEQ ID NO: 710556 - DNA, 20 bp, Artificial
  CRISPR gRNA sequence
ccaggccccacctccacccc

SEQ ID NO: 710557 - DNA, 20 bp, Artificial
  CRISPR gRNA sequence
ccccacctccacccccagcc

SEQ ID NO: 710558 - DNA, 20 bp, Artificial
  CRISPR gRNA sequence
cccccagcccagctgcctcc

SEQ ID NO: 710559 - DNA, 20 bp, Artificial
  CRISPR gRNA sequence
ccccagcccagctgcctccc

SEQ ID NO: 710560 - DNA, 20 bp, Artificial
  CRISPR gRNA sequence
gctgcctcccaggcatcccc

SEQ ID NO: 710561 - DNA, 20 bp, Artificial
  CRISPR gRNA sequence
ctgcctcccaggcatcccct

SEQ ID NO: 710562 - DNA, 20 bp, Artificial
  CRISPR gRNA sequence
tcccaggcatcccctgggca

SEQ ID NO: 710563 - DNA, 20 bp, Artificial
  CRISPR gRNA sequence
caggcatcccctgggcatgg

SEQ ID NO: 710564 - DNA, 20 bp, Artificial
  CRISPR gRNA sequence
aggcatcccctgggcatggc

SEQ ID NO: 710565 - DNA, 20 bp, Artificial
  CRISPR gRNA sequence
ggcatcccctgggcatggca

SEQ ID NO: 710566 - DNA, 20 bp, Artificial
  CRISPR gRNA sequence
tcccctgggcatggcaggga

SEQ ID NO: 710567 - DNA, 20 bp, Artificial
  CRISPR gRNA sequence
gcagggacagctccctcctg

SEQ ID NO: 710568 - DNA, 20 bp, Artificial
  CRISPR gRNA sequence
gggacagctccctcctgcag

SEQ ID NO: 710569 - DNA, 20 bp, Artificial
  CRISPR gRNA sequence
tccctcctgcagcagccaaa

SEQ ID NO: 710570 - DNA, 20 bp, Artificial
  CRISPR gRNA sequence
cctcctgcagcagccaaaca

SEQ ID NO: 710571 - DNA, 20 bp, Artificial
  CRISPR gRNA sequence
tcctgcagcagccaaacaga

SEQ ID NO: 710572 - DNA, 20 bp, Artificial
  CRISPR gRNA sequence
tgcagcagccaaacagagag

SEQ ID NO: 710573 - DNA, 20 bp, Artificial
  CRISPR gRNA sequence
gcagcagccaaacagagaga

SEQ ID NO: 710574 - DNA, 20 bp, Artificial
  CRISPR gRNA sequence
cagcagccaaacagagagaa

SEQ ID NO: 710575 - DNA, 20 bp, Artificial
  CRISPR gRNA sequence
agcagccaaacagagagaag

SEQ ID NO: 710576 - DNA, 20 bp, Artificial
  CRISPR gRNA sequence
agccaaacagagagaagggg

SEQ ID NO: 710577 - DNA, 20 bp, Artificial
  CRISPR gRNA sequence
gccaaacagagagaaggggt

SEQ ID NO: 710578 - DNA, 20 bp, Artificial
  CRISPR gRNA sequence
ccaaacagagagaaggggtg

SEQ ID NO: 710579 - DNA, 20 bp, Artificial
  CRISPR gRNA sequence
caaacagagagaaggggtgg

SEQ ID NO: 710580 - DNA, 20 bp, Artificial
  CRISPR gRNA sequence
aacagagagaaggggtgggg

SEQ ID NO: 710581 - DNA, 20 bp, Artificial
  CRISPR gRNA sequence
gaaggggtgggggagtcacc

SEQ ID NO: 710582 - DNA, 20 bp, Artificial
  CRISPR gRNA sequence
ggggtgggggagtcacctgg

SEQ ID NO: 710583 - DNA, 20 bp, Artificial
  CRISPR gRNA sequence
gggtgggggagtcacctggc

SEQ ID NO: 710584 - DNA, 20 bp, Artificial
  CRISPR gRNA sequence
gcaggcgcctcgccattctc

SEQ ID NO: 710585 - DNA, 20 bp, Artificial
  CRISPR gRNA sequence
caggcgcctcgccattctct

SEQ ID NO: 710586 - DNA, 20 bp, Artificial
  CRISPR gRNA sequence
aggcgcctcgccattctctg

SEQ ID NO: 710587 - DNA, 20 bp, Artificial
  CRISPR gRNA sequence
cgcctcgccattctctgggg

SEQ ID NO: 710588 - DNA, 20 bp, Artificial
  CRISPR gRNA sequence
gcctcgccattctctggggt

SEQ ID NO: 710589 - DNA, 20 bp, Artificial
  CRISPR gRNA sequence
cctcgccattctctggggtg

SEQ ID NO: 710590 - DNA, 20 bp, Artificial
  CRISPR gRNA sequence
cattctctggggtggggttg

SEQ ID NO: 710591 - DNA, 20 bp, Artificial
  CRISPR gRNA sequence
tctggggtggggttgcagtc

SEQ ID NO: 710592 - DNA, 20 bp, Artificial
  CRISPR gRNA sequence
gggtggggttgcagtccggc

SEQ ID NO: 710593 - DNA, 20 bp, Artificial
  CRISPR gRNA sequence
ggtggggttgcagtccggct

SEQ ID NO: 710594 - DNA, 20 bp, Artificial
  CRISPR gRNA sequence
ttgcagtccggctgggtccc

SEQ ID NO: 710595 - DNA, 20 bp, Artificial
  CRISPR gRNA sequence
tgcagtccggctgggtcccc

SEQ ID NO: 710596 - DNA, 20 bp, Artificial
  CRISPR gRNA sequence
gcagtccggctgggtcccca

SEQ ID NO: 710597 - DNA, 20 bp, Artificial
  CRISPR gRNA sequence
cagtccggctgggtccccag

SEQ ID NO: 710598 - DNA, 20 bp, Artificial
  CRISPR gRNA sequence
tccggctgggtccccagggg

SEQ ID NO: 710599 - DNA, 20 bp, Artificial
  CRISPR gRNA sequence
tccccaggggtggcgcctca

SEQ ID NO: 710600 - DNA, 20 bp, Artificial
  CRISPR gRNA sequence
ccccaggggtggcgcctcaa

SEQ ID NO: 710601 - DNA, 20 bp, Artificial
  CRISPR gRNA sequence
caggggtggcgcctcaaagg

SEQ ID NO: 710602 - DNA, 20 bp, Artificial
  CRISPR gRNA sequence
ctcaaaggtggtgtccttct

SEQ ID NO: 710603 - DNA, 20 bp, Artificial
  CRISPR gRNA sequence
gtccttctcagccatatctg

SEQ ID NO: 710604 - DNA, 20 bp, Artificial
  CRISPR gRNA sequence
ccttctcagccatatctgca

SEQ ID NO: 710605 - DNA, 20 bp, Artificial
  CRISPR gRNA sequence
cttctcagccatatctgcag

SEQ ID NO: 710606 - DNA, 20 bp, Artificial
  CRISPR gRNA sequence
ttctcagccatatctgcaga

SEQ ID NO: 710607 - DNA, 20 bp, Artificial
  CRISPR gRNA sequence
tctcagccatatctgcagag

SEQ ID NO: 710608 - DNA, 20 bp, Artificial
  CRISPR gRNA sequence
gcagaggggacgtaacatct

SEQ ID NO: 710609 - DNA, 20 bp, Artificial
  CRISPR gRNA sequence
gggacgtaacatctgagaac

SEQ ID NO: 710610 - DNA, 20 bp, Artificial
  CRISPR gRNA sequence
aacatctgagaaccagcgcc

SEQ ID NO: 710611 - DNA, 20 bp, Artificial
  CRISPR gRNA sequence
acatctgagaaccagcgcca

SEQ ID NO: 710612 - DNA, 20 bp, Artificial
  CRISPR gRNA sequence
atctgagaaccagcgccaag

SEQ ID NO: 710613 - DNA, 20 bp, Artificial
  CRISPR gRNA sequence
tctgagaaccagcgccaagg

SEQ ID NO: 710614 - DNA, 20 bp, Artificial
  CRISPR gRNA sequence
agaaccagcgccaaggaggc

SEQ ID NO: 710615 - DNA, 20 bp, Artificial
  CRISPR gRNA sequence
gccaaggaggctggtgtctc

SEQ ID NO: 710616 - DNA, 20 bp, Artificial
  CRISPR gRNA sequence
ccaaggaggctggtgtctcc

SEQ ID NO: 710617 - DNA, 20 bp, Artificial
  CRISPR gRNA sequence
ggaggctggtgtctccagga

SEQ ID NO: 710618 - DNA, 20 bp, Artificial
  CRISPR gRNA sequence
aggctggtgtctccaggaaa

SEQ ID NO: 710619 - DNA, 20 bp, Artificial
  CRISPR gRNA sequence
gtctccaggaaagagttaac

SEQ ID NO: 710620 - DNA, 20 bp, Artificial
  CRISPR gRNA sequence
tccaggaaagagttaaccag

SEQ ID NO: 710621 - DNA, 20 bp, Artificial
  CRISPR gRNA sequence
ccaggaaagagttaaccagc

SEQ ID NO: 710622 - DNA, 20 bp, Artificial
  CRISPR gRNA sequence
caggaaagagttaaccagca

SEQ ID NO: 710623 - DNA, 20 bp, Artificial
  CRISPR gRNA sequence
aagagttaaccagcagggac

SEQ ID NO: 710624 - DNA, 20 bp, Artificial
  CRISPR gRNA sequence
agttaaccagcagggactgg

SEQ ID NO: 710625 - DNA, 20 bp, Artificial
  CRISPR gRNA sequence
cagcagggactggtggcttc

SEQ ID NO: 710626 - DNA, 20 bp, Artificial
  CRISPR gRNA sequence
agggactggtggcttccagc

SEQ ID NO: 710627 - DNA, 20 bp, Artificial
  CRISPR gRNA sequence
gggactggtggcttccagcg

SEQ ID NO: 710628 - DNA, 20 bp, Artificial
  CRISPR gRNA sequence
cttccagcgaggcaacaccg

SEQ ID NO: 710629 - DNA, 20 bp, Artificial
  CRISPR gRNA sequence
ttccagcgaggcaacaccgt

SEQ ID NO: 710630 - DNA, 20 bp, Artificial
  CRISPR gRNA sequence
ccagcgaggcaacaccgtgg

SEQ ID NO: 710631 - DNA, 20 bp, Artificial
  CRISPR gRNA sequence
gaggcaacaccgtgggagct

SEQ ID NO: 710632 - DNA, 20 bp, Artificial
  CRISPR gRNA sequence
caacaccgtgggagctaaga

SEQ ID NO: 710633 - DNA, 20 bp, Artificial
  CRISPR gRNA sequence
accgtgggagctaagacagt

SEQ ID NO: 710634 - DNA, 20 bp, Artificial
  CRISPR gRNA sequence
cagtcagatttgtgtttcaa

SEQ ID NO: 710635 - DNA, 20 bp, Artificial
  CRISPR gRNA sequence
atttgtgtttcaaaagatca

SEQ ID NO: 710636 - DNA, 20 bp, Artificial
  CRISPR gRNA sequence
tgtgtttcaaaagatcaaag

SEQ ID NO: 710637 - DNA, 20 bp, Artificial
  CRISPR gRNA sequence
ttcaaaagatcaaagtggaa

SEQ ID NO: 710638 - DNA, 20 bp, Artificial
  CRISPR gRNA sequence
aaagatcaaagtggaaaagc

SEQ ID NO: 710639 - DNA, 20 bp, Artificial
  CRISPR gRNA sequence
atcaaagtggaaaagctggc

SEQ ID NO: 710640 - DNA, 20 bp, Artificial
  CRISPR gRNA sequence
tcaaagtggaaaagctggcc

SEQ ID NO: 710641 - DNA, 20 bp, Artificial
  CRISPR gRNA sequence
gaaaagctggccaggcacat

SEQ ID NO: 710642 - DNA, 20 bp, Artificial
  CRISPR gRNA sequence
ttggctcacacctgtaatca

SEQ ID NO: 710643 - DNA, 20 bp, Artificial
  CRISPR gRNA sequence
cacctgtaatcacagcattt

SEQ ID NO: 710644 - DNA, 20 bp, Artificial
  CRISPR gRNA sequence
acctgtaatcacagcatttt

SEQ ID NO: 710645 - DNA, 20 bp, Artificial
  CRISPR gRNA sequence
ctgtaatcacagcattttgg

SEQ ID NO: 710646 - DNA, 20 bp, Artificial
  CRISPR gRNA sequence
tgtaatcacagcattttggg

SEQ ID NO: 710647 - DNA, 20 bp, Artificial
  CRISPR gRNA sequence
tcacagcattttgggaggct

SEQ ID NO: 710648 - DNA, 20 bp, Artificial
  CRISPR gRNA sequence
cacagcattttgggaggctg

SEQ ID NO: 710649 - DNA, 20 bp, Artificial
  CRISPR gRNA sequence
agcattttgggaggctgagg

SEQ ID NO: 710650 - DNA, 20 bp, Artificial
  CRISPR gRNA sequence
gcattttgggaggctgaggc

SEQ ID NO: 710651 - DNA, 20 bp, Artificial
  CRISPR gRNA sequence
attttgggaggctgaggcag

SEQ ID NO: 710652 - DNA, 20 bp, Artificial
  CRISPR gRNA sequence
ttttgggaggctgaggcagg

SEQ ID NO: 710653 - DNA, 20 bp, Artificial
  CRISPR gRNA sequence
ctgaggcaggaggaccactt

SEQ ID NO: 710654 - DNA, 20 bp, Artificial
  CRISPR gRNA sequence
tgaggcaggaggaccacttg

SEQ ID NO: 710655 - DNA, 20 bp, Artificial
  CRISPR gRNA sequence
gcaggaggaccacttgaggt

SEQ ID NO: 710656 - DNA, 20 bp, Artificial
  CRISPR gRNA sequence
caggaggaccacttgaggtc

SEQ ID NO: 710657 - DNA, 20 bp, Artificial
  CRISPR gRNA sequence
ggaggaccacttgaggtcag

SEQ ID NO: 710658 - DNA, 20 bp, Artificial
  CRISPR gRNA sequence
ccacttgaggtcaggagttc

SEQ ID NO: 710659 - DNA, 20 bp, Artificial
  CRISPR gRNA sequence
tgaggtcaggagttcgagac

SEQ ID NO: 710660 - DNA, 20 bp, Artificial
  CRISPR gRNA sequence
cgagaccagcctgaccaaca

SEQ ID NO: 710661 - DNA, 20 bp, Artificial
  CRISPR gRNA sequence
tctactaaaaacacaaaaat

SEQ ID NO: 710662 - DNA, 20 bp, Artificial
  CRISPR gRNA sequence
ctaaaaacacaaaaattagc

SEQ ID NO: 710663 - DNA, 20 bp, Artificial
  CRISPR gRNA sequence
taaaaacacaaaaattagcc

SEQ ID NO: 710664 - DNA, 20 bp, Artificial
  CRISPR gRNA sequence
caaaaattagccaggtgtga

SEQ ID NO: 710665 - DNA, 20 bp, Artificial
  CRISPR gRNA sequence
atggcacacacctgtaatcc

SEQ ID NO: 710666 - DNA, 20 bp, Artificial
  CRISPR gRNA sequence
cacctgtaatcctagctact

SEQ ID NO: 710667 - DNA, 20 bp, Artificial
  CRISPR gRNA sequence
acctgtaatcctagctactc

SEQ ID NO: 710668 - DNA, 20 bp, Artificial
  CRISPR gRNA sequence
ctgtaatcctagctactcag

SEQ ID NO: 710669 - DNA, 20 bp, Artificial
  CRISPR gRNA sequence
tgtaatcctagctactcagg

SEQ ID NO: 710670 - DNA, 20 bp, Artificial
  CRISPR gRNA sequence
tcctagctactcaggaggct

SEQ ID NO: 710671 - DNA, 20 bp, Artificial
  CRISPR gRNA sequence
cctagctactcaggaggctg

SEQ ID NO: 710672 - DNA, 20 bp, Artificial
  CRISPR gRNA sequence
agctactcaggaggctgagg

SEQ ID NO: 710673 - DNA, 20 bp, Artificial
  CRISPR gRNA sequence
gctactcaggaggctgaggc

SEQ ID NO: 710674 - DNA, 20 bp, Artificial
  CRISPR gRNA sequence
tactcaggaggctgaggcag

SEQ ID NO: 710675 - DNA, 20 bp, Artificial
  CRISPR gRNA sequence
gcaggagaatcgtttgaacc

SEQ ID NO: 710676 - DNA, 20 bp, Artificial
  CRISPR gRNA sequence
caggagaatcgtttgaaccc

SEQ ID NO: 710677 - DNA, 20 bp, Artificial
  CRISPR gRNA sequence
ggagaatcgtttgaacccgg

SEQ ID NO: 710678 - DNA, 20 bp, Artificial
  CRISPR gRNA sequence
gagaatcgtttgaacccggg

SEQ ID NO: 710679 - DNA, 20 bp, Artificial
  CRISPR gRNA sequence
aatcgtttgaacccgggagg

SEQ ID NO: 710680 - DNA, 20 bp, Artificial
  CRISPR gRNA sequence
tcgtttgaacccgggaggtg

SEQ ID NO: 710681 - DNA, 20 bp, Artificial
  CRISPR gRNA sequence
cgtttgaacccgggaggtgg

SEQ ID NO: 710682 - DNA, 20 bp, Artificial
  CRISPR gRNA sequence
aacccgggaggtggaggctg

SEQ ID NO: 710683 - DNA, 20 bp, Artificial
  CRISPR gRNA sequence
cgggaggtggaggctgcagt

SEQ ID NO: 710684 - DNA, 20 bp, Artificial
  CRISPR gRNA sequence
ggtggaggctgcagtgagct

SEQ ID NO: 710685 - DNA, 20 bp, Artificial
  CRISPR gRNA sequence
gagatcatgccactgcactc

SEQ ID NO: 710686 - DNA, 20 bp, Artificial
  CRISPR gRNA sequence
catgccactgcactccagcc

SEQ ID NO: 710687 - DNA, 20 bp, Artificial
  CRISPR gRNA sequence
atgccactgcactccagcct

SEQ ID NO: 710688 - DNA, 20 bp, Artificial
  CRISPR gRNA sequence
ctgcactccagcctgggcga

SEQ ID NO: 710689 - DNA, 20 bp, Artificial
  CRISPR gRNA sequence
gcactccagcctgggcgaca

SEQ ID NO: 710690 - DNA, 20 bp, Artificial
  CRISPR gRNA sequence
tccagcctgggcgacagaga

SEQ ID NO: 710691 - DNA, 20 bp, Artificial
  CRISPR gRNA sequence
gactcaaaataaataaaaca

SEQ ID NO: 710692 - DNA, 20 bp, Artificial
  CRISPR gRNA sequence
tcaaaataaataaaacaaag

SEQ ID NO: 710693 - DNA, 20 bp, Artificial
  CRISPR gRNA sequence
aaaataaataaaacaaagtg

SEQ ID NO: 710694 - DNA, 20 bp, Artificial
  CRISPR gRNA sequence
ataaataaaacaaagtggag

SEQ ID NO: 710695 - DNA, 20 bp, Artificial
  CRISPR gRNA sequence
aagttgctacttgtctctaa

SEQ ID NO: 710696 - DNA, 20 bp, Artificial
  CRISPR gRNA sequence
ctacttgtctctaacagctg

SEQ ID NO: 710697 - DNA, 20 bp, Artificial
  CRISPR gRNA sequence
ctctaacagctgtggtcacc

SEQ ID NO: 710698 - DNA, 20 bp, Artificial
  CRISPR gRNA sequence
tctaacagctgtggtcaccc

SEQ ID NO: 710699 - DNA, 20 bp, Artificial
  CRISPR gRNA sequence
aacagctgtggtcacccagg

SEQ ID NO: 710700 - DNA, 20 bp, Artificial
  CRISPR gRNA sequence
acagctgtggtcacccagga

SEQ ID NO: 710701 - DNA, 20 bp, Artificial
  CRISPR gRNA sequence
ggtcacccaggaaggtgaaa

SEQ ID NO: 710702 - DNA, 20 bp, Artificial
  CRISPR gRNA sequence
ggaaggtgaaacagtgacgc

SEQ ID NO: 710703 - DNA, 20 bp, Artificial
  CRISPR gRNA sequence
acgctagaccttttgctttt

SEQ ID NO: 710704 - DNA, 20 bp, Artificial
  CRISPR gRNA sequence
gctagaccttttgcttttaa

SEQ ID NO: 710705 - DNA, 20 bp, Artificial
  CRISPR gRNA sequence
aatcgcctaatgtttaaata

SEQ ID NO: 710706 - DNA, 20 bp, Artificial
  CRISPR gRNA sequence
aaatacagcctcaattttta

SEQ ID NO: 710707 - DNA, 20 bp, Artificial
  CRISPR gRNA sequence
tcttttaaatcaactttatt

SEQ ID NO: 710708 - DNA, 20 bp, Artificial
  CRISPR gRNA sequence
cttttaaatcaactttatta

SEQ ID NO: 710709 - DNA, 20 bp, Artificial
  CRISPR gRNA sequence
ttatttatgtttaatttttt

SEQ ID NO: 710710 - DNA, 20 bp, Artificial
  CRISPR gRNA sequence
atgtttaattttttgagatt

SEQ ID NO: 710711 - DNA, 20 bp, Artificial
  CRISPR gRNA sequence
ttgagtcttcctctgctgcc

SEQ ID NO: 710712 - DNA, 20 bp, Artificial
  CRISPR gRNA sequence
tcttcctctgctgcccagac

SEQ ID NO: 710713 - DNA, 20 bp, Artificial
  CRISPR gRNA sequence
ttcctctgctgcccagactg

SEQ ID NO: 710714 - DNA, 20 bp, Artificial
  CRISPR gRNA sequence
ctgctgcccagactggagtg

SEQ ID NO: 710715 - DNA, 20 bp, Artificial
  CRISPR gRNA sequence
ctgcccagactggagtgcag

SEQ ID NO: 710716 - DNA, 20 bp, Artificial
  CRISPR gRNA sequence
ggagtgcagtggcacgatct

SEQ ID NO: 710717 - DNA, 20 bp, Artificial
  CRISPR gRNA sequence
tcattgcaacttctgcctcc

SEQ ID NO: 710718 - DNA, 20 bp, Artificial
  CRISPR gRNA sequence
aacttctgcctcccggattc

SEQ ID NO: 710719 - DNA, 20 bp, Artificial
  CRISPR gRNA sequence
ttcaagtgattctcctgcct

SEQ ID NO: 710720 - DNA, 20 bp, Artificial
  CRISPR gRNA sequence
ttctcctgcctcagcctcct

SEQ ID NO: 710721 - DNA, 20 bp, Artificial
  CRISPR gRNA sequence
tcctgcctcagcctcctgag

SEQ ID NO: 710722 - DNA, 20 bp, Artificial
  CRISPR gRNA sequence
gcctcagcctcctgagtagc

SEQ ID NO: 710723 - DNA, 20 bp, Artificial
  CRISPR gRNA sequence
cctcagcctcctgagtagct

SEQ ID NO: 710724 - DNA, 20 bp, Artificial
  CRISPR gRNA sequence
ctcctgagtagctgggatta

SEQ ID NO: 710725 - DNA, 20 bp, Artificial
  CRISPR gRNA sequence
tcctgagtagctgggattac

SEQ ID NO: 710726 - DNA, 20 bp, Artificial
  CRISPR gRNA sequence
caggtgcctgccaacatgcc

SEQ ID NO: 710727 - DNA, 20 bp, Artificial
  CRISPR gRNA sequence
ccagctaatttttgtatttt

SEQ ID NO: 710728 - DNA, 20 bp, Artificial
  CRISPR gRNA sequence
gctaatttttgtatttttag

SEQ ID NO: 710729 - DNA, 20 bp, Artificial
  CRISPR gRNA sequence
ttttgtatttttagtagaaa

SEQ ID NO: 710730 - DNA, 20 bp, Artificial
  CRISPR gRNA sequence
tttgtatttttagtagaaac

SEQ ID NO: 710731 - DNA, 20 bp, Artificial
  CRISPR gRNA sequence
ttgtatttttagtagaaaca

SEQ ID NO: 710732 - DNA, 20 bp, Artificial
  CRISPR gRNA sequence
cagggtttcaccatgttgac

SEQ ID NO: 710733 - DNA, 20 bp, Artificial
  CRISPR gRNA sequence
agggtttcaccatgttgacc

SEQ ID NO: 710734 - DNA, 20 bp, Artificial
  CRISPR gRNA sequence
tttcaccatgttgaccaggc

SEQ ID NO: 710735 - DNA, 20 bp, Artificial
  CRISPR gRNA sequence
ggtctcgaactcctgacctc

SEQ ID NO: 710736 - DNA, 20 bp, Artificial
  CRISPR gRNA sequence
ctcaagtgatccgcccacct

SEQ ID NO: 710737 - DNA, 20 bp, Artificial
  CRISPR gRNA sequence
ccgcccacctcagcctccca

SEQ ID NO: 710738 - DNA, 20 bp, Artificial
  CRISPR gRNA sequence
acctcagcctcccaaagtgc

SEQ ID NO: 710739 - DNA, 20 bp, Artificial
  CRISPR gRNA sequence
cctcagcctcccaaagtgct

SEQ ID NO: 710740 - DNA, 20 bp, Artificial
  CRISPR gRNA sequence
ctcccaaagtgctgggatcg

SEQ ID NO: 710741 - DNA, 20 bp, Artificial
  CRISPR gRNA sequence
tcccaaagtgctgggatcgt

SEQ ID NO: 710742 - DNA, 20 bp, Artificial
  CRISPR gRNA sequence
agtgctgggatcgtaggcgt

SEQ ID NO: 710743 - DNA, 20 bp, Artificial
  CRISPR gRNA sequence
taggcgtgagccaccatgcc

SEQ ID NO: 710744 - DNA, 20 bp, Artificial
  CRISPR gRNA sequence
tgagccaccatgcccagcct

SEQ ID NO: 710745 - DNA, 20 bp, Artificial
  CRISPR gRNA sequence
gagccaccatgcccagccta

SEQ ID NO: 710746 - DNA, 20 bp, Artificial
  CRISPR gRNA sequence
ctaaggcaacatttatatac

SEQ ID NO: 710747 - DNA, 20 bp, Artificial
  CRISPR gRNA sequence
ggcaacatttatatacaaga

SEQ ID NO: 710748 - DNA, 20 bp, Artificial
  CRISPR gRNA sequence
atatacaagaaagtatcccc

SEQ ID NO: 710749 - DNA, 20 bp, Artificial
  CRISPR gRNA sequence
tacaagaaagtatcccctgg

SEQ ID NO: 710750 - DNA, 20 bp, Artificial
  CRISPR gRNA sequence
acaagaaagtatcccctggc

SEQ ID NO: 710751 - DNA, 20 bp, Artificial
  CRISPR gRNA sequence
caagaaagtatcccctggca

SEQ ID NO: 710752 - DNA, 20 bp, Artificial
  CRISPR gRNA sequence
gaaagtatcccctggcaggg

SEQ ID NO: 710753 - DNA, 20 bp, Artificial
  CRISPR gRNA sequence
aaagtatcccctggcagggt

SEQ ID NO: 710754 - DNA, 20 bp, Artificial
  CRISPR gRNA sequence
aagtatcccctggcagggta

SEQ ID NO: 710755 - DNA, 20 bp, Artificial
  CRISPR gRNA sequence
tatcccctggcagggtaggg

SEQ ID NO: 710756 - DNA, 20 bp, Artificial
  CRISPR gRNA sequence
gtggctcccgcctgtaatcc

SEQ ID NO: 710757 - DNA, 20 bp, Artificial
  CRISPR gRNA sequence
cgcctgtaatcccagcactt

SEQ ID NO: 710758 - DNA, 20 bp, Artificial
  CRISPR gRNA sequence
gcctgtaatcccagcacttt

SEQ ID NO: 710759 - DNA, 20 bp, Artificial
  CRISPR gRNA sequence
ctgtaatcccagcactttgg

SEQ ID NO: 710760 - DNA, 20 bp, Artificial
  CRISPR gRNA sequence
tgtaatcccagcactttggg

SEQ ID NO: 710761 - DNA, 20 bp, Artificial
  CRISPR gRNA sequence
cccagcactttgggaggctg

SEQ ID NO: 710762 - DNA, 20 bp, Artificial
  CRISPR gRNA sequence
agcactttgggaggctgaag

SEQ ID NO: 710763 - DNA, 20 bp, Artificial
  CRISPR gRNA sequence
gcactttgggaggctgaagc

SEQ ID NO: 710764 - DNA, 20 bp, Artificial
  CRISPR gRNA sequence
ctttgggaggctgaagcagg

SEQ ID NO: 710765 - DNA, 20 bp, Artificial
  CRISPR gRNA sequence
ctgaagcaggcagatcactt

SEQ ID NO: 710766 - DNA, 20 bp, Artificial
  CRISPR gRNA sequence
gcaggcagatcacttgagct

SEQ ID NO: 710767 - DNA, 20 bp, Artificial
  CRISPR gRNA sequence
caggcagatcacttgagctc

SEQ ID NO: 710768 - DNA, 20 bp, Artificial
  CRISPR gRNA sequence
ggcagatcacttgagctcag

SEQ ID NO: 710769 - DNA, 20 bp, Artificial
  CRISPR gRNA sequence
tgagctcaggagttcgaaac

SEQ ID NO: 710770 - DNA, 20 bp, Artificial
  CRISPR gRNA sequence
caggagttcgaaaccagcct

SEQ ID NO: 710771 - DNA, 20 bp, Artificial
  CRISPR gRNA sequence
cgaaaccagcctaagcaaca

SEQ ID NO: 710772 - DNA, 20 bp, Artificial
  CRISPR gRNA sequence
accagcctaagcaacatagc

SEQ ID NO: 710773 - DNA, 20 bp, Artificial
  CRISPR gRNA sequence
accctgtctctatttttaat

SEQ ID NO: 710774 - DNA, 20 bp, Artificial
  CRISPR gRNA sequence
ttaataagtaaaaataaaaa

SEQ ID NO: 710775 - DNA, 20 bp, Artificial
  CRISPR gRNA sequence
taaaaaaagaaaatgtccct

SEQ ID NO: 710776 - DNA, 20 bp, Artificial
  CRISPR gRNA sequence
aaaatgtccctaagtgtgta

SEQ ID NO: 710777 - DNA, 20 bp, Artificial
  CRISPR gRNA sequence
ctaagtgtgtacagcctgat

SEQ ID NO: 710778 - DNA, 20 bp, Artificial
  CRISPR gRNA sequence
cagcctgatgagttctgaca

SEQ ID NO: 710779 - DNA, 20 bp, Artificial
  CRISPR gRNA sequence
agcctgatgagttctgacaa

SEQ ID NO: 710780 - DNA, 20 bp, Artificial
  CRISPR gRNA sequence
aactaactccaatcaaaata

SEQ ID NO: 710781 - DNA, 20 bp, Artificial
  CRISPR gRNA sequence
acagaacattctcatccctc

SEQ ID NO: 710782 - DNA, 20 bp, Artificial
  CRISPR gRNA sequence
gaacattctcatccctccag

SEQ ID NO: 710783 - DNA, 20 bp, Artificial
  CRISPR gRNA sequence
aacattctcatccctccaga

SEQ ID NO: 710784 - DNA, 20 bp, Artificial
  CRISPR gRNA sequence
catccctccagaaggttccc

SEQ ID NO: 710785 - DNA, 20 bp, Artificial
  CRISPR gRNA sequence
actcactctgcccccacctc

SEQ ID NO: 710786 - DNA, 20 bp, Artificial
  CRISPR gRNA sequence
tctgcccccacctccagatc

SEQ ID NO: 710787 - DNA, 20 bp, Artificial
  CRISPR gRNA sequence
ctgcccccacctccagatcc

SEQ ID NO: 710788 - DNA, 20 bp, Artificial
  CRISPR gRNA sequence
cgatctgctttatgtcacta

SEQ ID NO: 710789 - DNA, 20 bp, Artificial
  CRISPR gRNA sequence
atctgctttatgtcactata

SEQ ID NO: 710790 - DNA, 20 bp, Artificial
  CRISPR gRNA sequence
tctgctttatgtcactatag

SEQ ID NO: 710791 - DNA, 20 bp, Artificial
  CRISPR gRNA sequence
tgctttatgtcactatagag

SEQ ID NO: 710792 - DNA, 20 bp, Artificial
  CRISPR gRNA sequence
atagaggagtgtatctgttc

SEQ ID NO: 710793 - DNA, 20 bp, Artificial
  CRISPR gRNA sequence
gttccagaatttcatgtcga

SEQ ID NO: 710794 - DNA, 20 bp, Artificial
  CRISPR gRNA sequence
ttcatgtcgacagaatcatg

SEQ ID NO: 710795 - DNA, 20 bp, Artificial
  CRISPR gRNA sequence
atcatgcagtatgtactctt

SEQ ID NO: 710796 - DNA, 20 bp, Artificial
  CRISPR gRNA sequence
tcatgcagtatgtactcttt

SEQ ID NO: 710797 - DNA, 20 bp, Artificial
  CRISPR gRNA sequence
catgcagtatgtactctttg

SEQ ID NO: 710798 - DNA, 20 bp, Artificial
  CRISPR gRNA sequence
agtatgtactctttggggtc

SEQ ID NO: 710799 - DNA, 20 bp, Artificial
  CRISPR gRNA sequence
taatgtttttgatattcatt

SEQ ID NO: 710800 - DNA, 20 bp, Artificial
  CRISPR gRNA sequence
cattcctttctgttgccaaa

SEQ ID NO: 710801 - DNA, 20 bp, Artificial
  CRISPR gRNA sequence
ccaaatggcgttctgttgta

SEQ ID NO: 710802 - DNA, 20 bp, Artificial
  CRISPR gRNA sequence
ctgtttacatacccgttcgc

SEQ ID NO: 710803 - DNA, 20 bp, Artificial
  CRISPR gRNA sequence
catacccgttcgctagttga

SEQ ID NO: 710804 - DNA, 20 bp, Artificial
  CRISPR gRNA sequence
ttcgctagttgatggacatt

SEQ ID NO: 710805 - DNA, 20 bp, Artificial
  CRISPR gRNA sequence
tcgctagttgatggacattt

SEQ ID NO: 710806 - DNA, 20 bp, Artificial
  CRISPR gRNA sequence
atggacatttgggttgtttc

SEQ ID NO: 710807 - DNA, 20 bp, Artificial
  CRISPR gRNA sequence
cagtttgaactatgacgaac

SEQ ID NO: 710808 - DNA, 20 bp, Artificial
  CRISPR gRNA sequence
agtttgaactatgacgaaca

SEQ ID NO: 710809 - DNA, 20 bp, Artificial
  CRISPR gRNA sequence
ttgaactatgacgaacaagg

SEQ ID NO: 710810 - DNA, 20 bp, Artificial
  CRISPR gRNA sequence
atgacgaacaaggcagctgt

SEQ ID NO: 710811 - DNA, 20 bp, Artificial
  CRISPR gRNA sequence
cgtataatttcattcctctt

SEQ ID NO: 710812 - DNA, 20 bp, Artificial
  CRISPR gRNA sequence
tttcattcctcttgagtgcc

SEQ ID NO: 710813 - DNA, 20 bp, Artificial
  CRISPR gRNA sequence
ttcattcctcttgagtgcct

SEQ ID NO: 710814 - DNA, 20 bp, Artificial
  CRISPR gRNA sequence
attcctcttgagtgcctagg

SEQ ID NO: 710815 - DNA, 20 bp, Artificial
  CRISPR gRNA sequence
ttcctcttgagtgcctagga

SEQ ID NO: 710816 - DNA, 20 bp, Artificial
  CRISPR gRNA sequence
tcctcttgagtgcctaggaa

SEQ ID NO: 710817 - DNA, 20 bp, Artificial
  CRISPR gRNA sequence
tcttgagtgcctaggaaggg

SEQ ID NO: 710818 - DNA, 20 bp, Artificial
  CRISPR gRNA sequence
gagtgcctaggaagggtggc

SEQ ID NO: 710819 - DNA, 20 bp, Artificial
  CRISPR gRNA sequence
gggtggctggattgctatgc

SEQ ID NO: 710820 - DNA, 20 bp, Artificial
  CRISPR gRNA sequence
ggctggattgctatgctggc

SEQ ID NO: 710821 - DNA, 20 bp, Artificial
  CRISPR gRNA sequence
ggattgctatgctggccaga

SEQ ID NO: 710822 - DNA, 20 bp, Artificial
  CRISPR gRNA sequence
ggccagacggaatgtctctg

SEQ ID NO: 710823 - DNA, 20 bp, Artificial
  CRISPR gRNA sequence
gccagacggaatgtctctga

SEQ ID NO: 710824 - DNA, 20 bp, Artificial
  CRISPR gRNA sequence
gacggaatgtctctgaaggc

SEQ ID NO: 710825 - DNA, 20 bp, Artificial
  CRISPR gRNA sequence
tgtctctgaaggccagttca

SEQ ID NO: 710826 - DNA, 20 bp, Artificial
  CRISPR gRNA sequence
tctgaaggccagttcatagc

SEQ ID NO: 710827 - DNA, 20 bp, Artificial
  CRISPR gRNA sequence
agttcatagctggccaccac

SEQ ID NO: 710828 - DNA, 20 bp, Artificial
  CRISPR gRNA sequence
tggccaccactggtctgacc

SEQ ID NO: 710829 - DNA, 20 bp, Artificial
  CRISPR gRNA sequence
gacccagctaccttgtttta

SEQ ID NO: 710830 - DNA, 20 bp, Artificial
  CRISPR gRNA sequence
cagctaccttgttttacaga

SEQ ID NO: 710831 - DNA, 20 bp, Artificial
  CRISPR gRNA sequence
gctaccttgttttacagatg

SEQ ID NO: 710832 - DNA, 20 bp, Artificial
  CRISPR gRNA sequence
taccttgttttacagatgga

SEQ ID NO: 710833 - DNA, 20 bp, Artificial
  CRISPR gRNA sequence
ccttgttttacagatggaga

SEQ ID NO: 710834 - DNA, 20 bp, Artificial
  CRISPR gRNA sequence
tttacagatggagagagccg

SEQ ID NO: 710835 - DNA, 20 bp, Artificial
  CRISPR gRNA sequence
ttacagatggagagagccgc

SEQ ID NO: 710836 - DNA, 20 bp, Artificial
  CRISPR gRNA sequence
tacagatggagagagccgca

SEQ ID NO: 710837 - DNA, 20 bp, Artificial
  CRISPR gRNA sequence
gatggagagagccgcagggc

SEQ ID NO: 710838 - DNA, 20 bp, Artificial
  CRISPR gRNA sequence
tggagagagccgcagggctg

SEQ ID NO: 710839 - DNA, 20 bp, Artificial
  CRISPR gRNA sequence
gagccgcagggctggagcta

SEQ ID NO: 710840 - DNA, 20 bp, Artificial
  CRISPR gRNA sequence
cgcagggctggagctacagc

SEQ ID NO: 710841 - DNA, 20 bp, Artificial
  CRISPR gRNA sequence
gcagggctggagctacagcc

SEQ ID NO: 710842 - DNA, 20 bp, Artificial
  CRISPR gRNA sequence
ctggagctacagccaggaaa

SEQ ID NO: 710843 - DNA, 20 bp, Artificial
  CRISPR gRNA sequence
ggagctacagccaggaaaca

SEQ ID NO: 710844 - DNA, 20 bp, Artificial
  CRISPR gRNA sequence
ctacagccaggaaacagaga

SEQ ID NO: 710845 - DNA, 20 bp, Artificial
  CRISPR gRNA sequence
agccaggaaacagagatggc

SEQ ID NO: 710846 - DNA, 20 bp, Artificial
  CRISPR gRNA sequence
gaaacagagatggcgagttc

SEQ ID NO: 710847 - DNA, 20 bp, Artificial
  CRISPR gRNA sequence
agagatggcgagttccagcc

SEQ ID NO: 710848 - DNA, 20 bp, Artificial
  CRISPR gRNA sequence
agatggcgagttccagccca

SEQ ID NO: 710849 - DNA, 20 bp, Artificial
  CRISPR gRNA sequence
cagcccagagcactctcctc

SEQ ID NO: 710850 - DNA, 20 bp, Artificial
  CRISPR gRNA sequence
ccagagcactctcctctgga

SEQ ID NO: 710851 - DNA, 20 bp, Artificial
  CRISPR gRNA sequence
ggatggcactgcctcctgcc

SEQ ID NO: 710852 - DNA, 20 bp, Artificial
  CRISPR gRNA sequence
gatggcactgcctcctgcct

SEQ ID NO: 710853 - DNA, 20 bp, Artificial
  CRISPR gRNA sequence
atggcactgcctcctgcctg

SEQ ID NO: 710854 - DNA, 20 bp, Artificial
  CRISPR gRNA sequence
actgcctcctgcctggggac

SEQ ID NO: 710855 - DNA, 20 bp, Artificial
  CRISPR gRNA sequence
ctgcctcctgcctggggact

SEQ ID NO: 710856 - DNA, 20 bp, Artificial
  CRISPR gRNA sequence
gggactgggcaccttcttca

SEQ ID NO: 710857 - DNA, 20 bp, Artificial
  CRISPR gRNA sequence
ttcaaagcttcctgcttttc

SEQ ID NO: 710858 - DNA, 20 bp, Artificial
  CRISPR gRNA sequence
tcaaagcttcctgcttttct

SEQ ID NO: 710859 - DNA, 20 bp, Artificial
  CRISPR gRNA sequence
caaagcttcctgcttttctg

SEQ ID NO: 710860 - DNA, 20 bp, Artificial
  CRISPR gRNA sequence
agcttcctgcttttctgggg

SEQ ID NO: 710861 - DNA, 20 bp, Artificial
  CRISPR gRNA sequence
gcttcctgcttttctggggc

SEQ ID NO: 710862 - DNA, 20 bp, Artificial
  CRISPR gRNA sequence
ttttctggggcaggataatt

SEQ ID NO: 710863 - DNA, 20 bp, Artificial
  CRISPR gRNA sequence
caggataatttggcccacat

SEQ ID NO: 710864 - DNA, 20 bp, Artificial
  CRISPR gRNA sequence
gataatttggcccacattag

SEQ ID NO: 710865 - DNA, 20 bp, Artificial
  CRISPR gRNA sequence
aatttggcccacattagaag

SEQ ID NO: 710866 - DNA, 20 bp, Artificial
  CRISPR gRNA sequence
atttggcccacattagaagt

SEQ ID NO: 710867 - DNA, 20 bp, Artificial
  CRISPR gRNA sequence
cattagaagtgggttatgct

SEQ ID NO: 710868 - DNA, 20 bp, Artificial
  CRISPR gRNA sequence
tcactacacctctccacccc

SEQ ID NO: 710869 - DNA, 20 bp, Artificial
  CRISPR gRNA sequence
actacacctctccaccccca

SEQ ID NO: 710870 - DNA, 20 bp, Artificial
  CRISPR gRNA sequence
cctctccacccccagagccc

SEQ ID NO: 710871 - DNA, 20 bp, Artificial
  CRISPR gRNA sequence
ctccacccccagagccctgg

SEQ ID NO: 710872 - DNA, 20 bp, Artificial
  CRISPR gRNA sequence
ccacccccagagccctggtg

SEQ ID NO: 710873 - DNA, 20 bp, Artificial
  CRISPR gRNA sequence
cacccccagagccctggtgg

SEQ ID NO: 710874 - DNA, 20 bp, Artificial
  CRISPR gRNA sequence
ggaggcacccctttttgatg

SEQ ID NO: 710875 - DNA, 20 bp, Artificial
  CRISPR gRNA sequence
cccctttttgatgtggtaca

SEQ ID NO: 710876 - DNA, 20 bp, Artificial
  CRISPR gRNA sequence
acccacatctcccctctaca

SEQ ID NO: 710877 - DNA, 20 bp, Artificial
  CRISPR gRNA sequence
aaagtgttcgtgacgcctct

SEQ ID NO: 710878 - DNA, 20 bp, Artificial
  CRISPR gRNA sequence
ctctcagatttttcctcaaa

SEQ ID NO: 710879 - DNA, 20 bp, Artificial
  CRISPR gRNA sequence
ttttcctcaaatagacaaaa

SEQ ID NO: 710880 - DNA, 20 bp, Artificial
  CRISPR gRNA sequence
ctcaaatagacaaaaaagta

SEQ ID NO: 710881 - DNA, 20 bp, Artificial
  CRISPR gRNA sequence
aatagacaaaaaagtaaagc

SEQ ID NO: 710882 - DNA, 20 bp, Artificial
  CRISPR gRNA sequence
atagacaaaaaagtaaagcc

SEQ ID NO: 710883 - DNA, 20 bp, Artificial
  CRISPR gRNA sequence
ttaatttatttcttgcattg

SEQ ID NO: 710884 - DNA, 20 bp, Artificial
  CRISPR gRNA sequence
taatttatttcttgcattgt

SEQ ID NO: 710885 - DNA, 20 bp, Artificial
  CRISPR gRNA sequence
aatttatttcttgcattgta

SEQ ID NO: 710886 - DNA, 20 bp, Artificial
  CRISPR gRNA sequence
ttcttgcattgtagggttct

SEQ ID NO: 710887 - DNA, 20 bp, Artificial
  CRISPR gRNA sequence
tcttgcattgtagggttctg

SEQ ID NO: 710888 - DNA, 20 bp, Artificial
  CRISPR gRNA sequence
ttctgaggaacccccctctt

SEQ ID NO: 710889 - DNA, 20 bp, Artificial
  CRISPR gRNA sequence
tctgaggaacccccctcttt

SEQ ID NO: 710890 - DNA, 20 bp, Artificial
  CRISPR gRNA sequence
ctgaggaacccccctctttg

SEQ ID NO: 710891 - DNA, 20 bp, Artificial
  CRISPR gRNA sequence
aggaacccccctctttgggg

SEQ ID NO: 710892 - DNA, 20 bp, Artificial
  CRISPR gRNA sequence
ggaacccccctctttgggga

SEQ ID NO: 710893 - DNA, 20 bp, Artificial
  CRISPR gRNA sequence
ccctctttggggaaggtcac

SEQ ID NO: 710894 - DNA, 20 bp, Artificial
  CRISPR gRNA sequence
cactggactcttacctgaat

SEQ ID NO: 710895 - DNA, 20 bp, Artificial
  CRISPR gRNA sequence
ggactcttacctgaattagc

SEQ ID NO: 710896 - DNA, 20 bp, Artificial
  CRISPR gRNA sequence
actcttacctgaattagctg

SEQ ID NO: 710897 - DNA, 20 bp, Artificial
  CRISPR gRNA sequence
tacctgaattagctggagcc

SEQ ID NO: 710898 - DNA, 20 bp, Artificial
  CRISPR gRNA sequence
cctgaattagctggagcctg

SEQ ID NO: 710899 - DNA, 20 bp, Artificial
  CRISPR gRNA sequence
tagctggagcctggagacta

SEQ ID NO: 710900 - DNA, 20 bp, Artificial
  CRISPR gRNA sequence
agctggagcctggagactat

SEQ ID NO: 710901 - DNA, 20 bp, Artificial
  CRISPR gRNA sequence
gctggagcctggagactatg

SEQ ID NO: 710902 - DNA, 20 bp, Artificial
  CRISPR gRNA sequence
ggagcctggagactatgggg

SEQ ID NO: 710903 - DNA, 20 bp, Artificial
  CRISPR gRNA sequence
gatgatgcgatgtgttatga

SEQ ID NO: 710904 - DNA, 20 bp, Artificial
  CRISPR gRNA sequence
gttcctacatgctcgttaat

SEQ ID NO: 710905 - DNA, 20 bp, Artificial
  CRISPR gRNA sequence
tcgttaatcagtatttgaat

SEQ ID NO: 710906 - DNA, 20 bp, Artificial
  CRISPR gRNA sequence
gtatttgaatcagtgtttga

SEQ ID NO: 710907 - DNA, 20 bp, Artificial
  CRISPR gRNA sequence
tatttgaatcagtgtttgaa

SEQ ID NO: 710908 - DNA, 20 bp, Artificial
  CRISPR gRNA sequence
atcagtgtttgaaaggtcat

SEQ ID NO: 710909 - DNA, 20 bp, Artificial
  CRISPR gRNA sequence
tcagtgtttgaaaggtcatt

SEQ ID NO: 710910 - DNA, 20 bp, Artificial
  CRISPR gRNA sequence
tttgaaaggtcattgggttt

SEQ ID NO: 710911 - DNA, 20 bp, Artificial
  CRISPR gRNA sequence
tttcagtgaacacttacttt

SEQ ID NO: 710912 - DNA, 20 bp, Artificial
  CRISPR gRNA sequence
cagtgaacacttactttgag

SEQ ID NO: 710913 - DNA, 20 bp, Artificial
  CRISPR gRNA sequence
aacacttactttgagtggac

SEQ ID NO: 710914 - DNA, 20 bp, Artificial
  CRISPR gRNA sequence
cacttactttgagtggactg

SEQ ID NO: 710915 - DNA, 20 bp, Artificial
  CRISPR gRNA sequence
atgctcaaacccattaactg

SEQ ID NO: 710916 - DNA, 20 bp, Artificial
  CRISPR gRNA sequence
ccattaactgtggctattcc

SEQ ID NO: 710917 - DNA, 20 bp, Artificial
  CRISPR gRNA sequence
taactgtggctattcccagt

SEQ ID NO: 710918 - DNA, 20 bp, Artificial
  CRISPR gRNA sequence
ctattcccagtcagcatcat

SEQ ID NO: 710919 - DNA, 20 bp, Artificial
  CRISPR gRNA sequence
tattcccagtcagcatcatg

SEQ ID NO: 710920 - DNA, 20 bp, Artificial
  CRISPR gRNA sequence
ttcccagtcagcatcatgag

SEQ ID NO: 710921 - DNA, 20 bp, Artificial
  CRISPR gRNA sequence
cccagtcagcatcatgagga

SEQ ID NO: 710922 - DNA, 20 bp, Artificial
  CRISPR gRNA sequence
cagtcagcatcatgaggaga

SEQ ID NO: 710923 - DNA, 20 bp, Artificial
  CRISPR gRNA sequence
gagccccctgcctgctctcc

SEQ ID NO: 710924 - DNA, 20 bp, Artificial
  CRISPR gRNA sequence
agccccctgcctgctctcca

SEQ ID NO: 710925 - DNA, 20 bp, Artificial
  CRISPR gRNA sequence
cccctgcctgctctccaagg

SEQ ID NO: 710926 - DNA, 20 bp, Artificial
  CRISPR gRNA sequence
ccaaggcagcctgatgtaac

SEQ ID NO: 710927 - DNA, 20 bp, Artificial
  CRISPR gRNA sequence
ggcagcctgatgtaactaga

SEQ ID NO: 710928 - DNA, 20 bp, Artificial
  CRISPR gRNA sequence
gcagcctgatgtaactagac

SEQ ID NO: 710929 - DNA, 20 bp, Artificial
  CRISPR gRNA sequence
gatgtaactagacaggccca

SEQ ID NO: 710930 - DNA, 20 bp, Artificial
  CRISPR gRNA sequence
actagacaggcccatggtct

SEQ ID NO: 710931 - DNA, 20 bp, Artificial
  CRISPR gRNA sequence
ctgaaacacctgctgaaatc

SEQ ID NO: 710932 - DNA, 20 bp, Artificial
  CRISPR gRNA sequence
cacctgctgaaatccagcga

SEQ ID NO: 710933 - DNA, 20 bp, Artificial
  CRISPR gRNA sequence
tgctgtccctcctgtatgtg

SEQ ID NO: 710934 - DNA, 20 bp, Artificial
  CRISPR gRNA sequence
tgtccctcctgtatgtgcag

SEQ ID NO: 710935 - DNA, 20 bp, Artificial
  CRISPR gRNA sequence
gtccctcctgtatgtgcaga

SEQ ID NO: 710936 - DNA, 20 bp, Artificial
  CRISPR gRNA sequence
tccctcctgtatgtgcagaa

SEQ ID NO: 710937 - DNA, 20 bp, Artificial
  CRISPR gRNA sequence
ccctcctgtatgtgcagaag

SEQ ID NO: 710938 - DNA, 20 bp, Artificial
  CRISPR gRNA sequence
cctcctgtatgtgcagaagg

SEQ ID NO: 710939 - DNA, 20 bp, Artificial
  CRISPR gRNA sequence
ctcctgtatgtgcagaaggg

SEQ ID NO: 710940 - DNA, 20 bp, Artificial
  CRISPR gRNA sequence
atgtgcagaaggggggaacc

SEQ ID NO: 710941 - DNA, 20 bp, Artificial
  CRISPR gRNA sequence
ggggggaacctagtatccct

SEQ ID NO: 710942 - DNA, 20 bp, Artificial
  CRISPR gRNA sequence
gggggaacctagtatccctt

SEQ ID NO: 710943 - DNA, 20 bp, Artificial
  CRISPR gRNA sequence
aactttccttcttcctccct

SEQ ID NO: 710944 - DNA, 20 bp, Artificial
  CRISPR gRNA sequence
ttccttcttcctccctgagt

SEQ ID NO: 710945 - DNA, 20 bp, Artificial
  CRISPR gRNA sequence
cctccccttttcctcctctt

SEQ ID NO: 710946 - DNA, 20 bp, Artificial
  CRISPR gRNA sequence
tttcctcctctttggatttg

SEQ ID NO: 710947 - DNA, 20 bp, Artificial
  CRISPR gRNA sequence
ttcctcctctttggatttga

SEQ ID NO: 710948 - DNA, 20 bp, Artificial
  CRISPR gRNA sequence
tcctctttggatttgaaggt

SEQ ID NO: 710949 - DNA, 20 bp, Artificial
  CRISPR gRNA sequence
cctctttggatttgaaggtg

SEQ ID NO: 710950 - DNA, 20 bp, Artificial
  CRISPR gRNA sequence
tctttggatttgaaggtgag

SEQ ID NO: 710951 - DNA, 20 bp, Artificial
  CRISPR gRNA sequence
ttggatttgaaggtgaggag

SEQ ID NO: 710952 - DNA, 20 bp, Artificial
  CRISPR gRNA sequence
tggatttgaaggtgaggaga

SEQ ID NO: 710953 - DNA, 20 bp, Artificial
  CRISPR gRNA sequence
ggtgaggagaaggcattgtc

SEQ ID NO: 710954 - DNA, 20 bp, Artificial
  CRISPR gRNA sequence
agaaggcattgtctagcccc

SEQ ID NO: 710955 - DNA, 20 bp, Artificial
  CRISPR gRNA sequence
ggcattgtctagcccctagt

SEQ ID NO: 710956 - DNA, 20 bp, Artificial
  CRISPR gRNA sequence
gttggtctgcctgtgttctc

SEQ ID NO: 710957 - DNA, 20 bp, Artificial
  CRISPR gRNA sequence
ctgcctgtgttctctggtaa

SEQ ID NO: 710958 - DNA, 20 bp, Artificial
  CRISPR gRNA sequence
gttctctggtaatggcctac

SEQ ID NO: 710959 - DNA, 20 bp, Artificial
  CRISPR gRNA sequence
ctctggtaatggcctactgg

SEQ ID NO: 710960 - DNA, 20 bp, Artificial
  CRISPR gRNA sequence
ctggtaatggcctactggaa

SEQ ID NO: 710961 - DNA, 20 bp, Artificial
  CRISPR gRNA sequence
gtaatggcctactggaagag

SEQ ID NO: 710962 - DNA, 20 bp, Artificial
  CRISPR gRNA sequence
ggcctactggaagagaagaa

SEQ ID NO: 710963 - DNA, 20 bp, Artificial
  CRISPR gRNA sequence
aagaaaagaacctgcctact

SEQ ID NO: 710964 - DNA, 20 bp, Artificial
  CRISPR gRNA sequence
tgcctactcagcctccattt

SEQ ID NO: 710965 - DNA, 20 bp, Artificial
  CRISPR gRNA sequence
ctaaaaaaaatattatttac

SEQ ID NO: 710966 - DNA, 20 bp, Artificial
  CRISPR gRNA sequence
aaaaaatattatttaccaga

SEQ ID NO: 710967 - DNA, 20 bp, Artificial
  CRISPR gRNA sequence
tctctttaaatccaaacacc

SEQ ID NO: 710968 - DNA, 20 bp, Artificial
  CRISPR gRNA sequence
aaatccaaacacccagtcct

SEQ ID NO: 710969 - DNA, 20 bp, Artificial
  CRISPR gRNA sequence
aatccaaacacccagtcctt

SEQ ID NO: 710970 - DNA, 20 bp, Artificial
  CRISPR gRNA sequence
cccagtccttgggccattta

SEQ ID NO: 710971 - DNA, 20 bp, Artificial
  CRISPR gRNA sequence
ggccatttaaagaattgtct

SEQ ID NO: 710972 - DNA, 20 bp, Artificial
  CRISPR gRNA sequence
taaagaattgtctcagcatc

SEQ ID NO: 710973 - DNA, 20 bp, Artificial
  CRISPR gRNA sequence
aaagaattgtctcagcatca

SEQ ID NO: 710974 - DNA, 20 bp, Artificial
  CRISPR gRNA sequence
gtctcagcatcaaggccaaa

SEQ ID NO: 710975 - DNA, 20 bp, Artificial
  CRISPR gRNA sequence
agattctctttttgtacatc

SEQ ID NO: 710976 - DNA, 20 bp, Artificial
  CRISPR gRNA sequence
atccagcaatcgcttaaaat

SEQ ID NO: 710977 - DNA, 20 bp, Artificial
  CRISPR gRNA sequence
tccagcaatcgcttaaaatc

SEQ ID NO: 710978 - DNA, 20 bp, Artificial
  CRISPR gRNA sequence
tgaaatttcatcttcatatt

SEQ ID NO: 710979 - DNA, 20 bp, Artificial
  CRISPR gRNA sequence
ttgtcatctttttcttttcc

SEQ ID NO: 710980 - DNA, 20 bp, Artificial
  CRISPR gRNA sequence
tgtcatctttttcttttccc

SEQ ID NO: 710981 - DNA, 20 bp, Artificial
  CRISPR gRNA sequence
tcatctttttcttttcccgg

SEQ ID NO: 710982 - DNA, 20 bp, Artificial
  CRISPR gRNA sequence
tttctttttcttgttgataa

SEQ ID NO: 710983 - DNA, 20 bp, Artificial
  CRISPR gRNA sequence
ttctttttcttgttgataaa

SEQ ID NO: 710984 - DNA, 20 bp, Artificial
  CRISPR gRNA sequence
ttttcttgttgataaaagga

SEQ ID NO: 710985 - DNA, 20 bp, Artificial
  CRISPR gRNA sequence
gtgtgccctcaccatatcct

SEQ ID NO: 710986 - DNA, 20 bp, Artificial
  CRISPR gRNA sequence
tgtgccctcaccatatcctc

SEQ ID NO: 710987 - DNA, 20 bp, Artificial
  CRISPR gRNA sequence
acaattctctcttctattcc

SEQ ID NO: 710988 - DNA, 20 bp, Artificial
  CRISPR gRNA sequence
caattctctcttctattcct

SEQ ID NO: 710989 - DNA, 20 bp, Artificial
  CRISPR gRNA sequence
tattcctgggaacacttcct

SEQ ID NO: 710990 - DNA, 20 bp, Artificial
  CRISPR gRNA sequence
ttcctgggaacacttcctcg

SEQ ID NO: 710991 - DNA, 20 bp, Artificial
  CRISPR gRNA sequence
tccattttcctgctctgatc

SEQ ID NO: 710992 - DNA, 20 bp, Artificial
  CRISPR gRNA sequence
ctgctctgatctggctcaac

SEQ ID NO: 710993 - DNA, 20 bp, Artificial
  CRISPR gRNA sequence
tggtctataccacatcattc

SEQ ID NO: 710994 - DNA, 20 bp, Artificial
  CRISPR gRNA sequence
ggtctataccacatcattct

SEQ ID NO: 710995 - DNA, 20 bp, Artificial
  CRISPR gRNA sequence
acttcccttccttgctctgc

SEQ ID NO: 710996 - DNA, 20 bp, Artificial
  CRISPR gRNA sequence
cttcccttccttgctctgct

SEQ ID NO: 710997 - DNA, 20 bp, Artificial
  CRISPR gRNA sequence
ccttccttgctctgctagga

SEQ ID NO: 710998 - DNA, 20 bp, Artificial
  CRISPR gRNA sequence
ttccttgctctgctaggatg

SEQ ID NO: 710999 - DNA, 20 bp, Artificial
  CRISPR gRNA sequence
gctctgctaggatggagtgc

SEQ ID NO: 711000 - DNA, 20 bp, Artificial
  CRISPR gRNA sequence
taggatggagtgctggtctc

SEQ ID NO: 711001 - DNA, 20 bp, Artificial
  CRISPR gRNA sequence
gtgctggtctctagattcca

SEQ ID NO: 711002 - DNA, 20 bp, Artificial
  CRISPR gRNA sequence
ttcttttttgccccctcact

SEQ ID NO: 711003 - DNA, 20 bp, Artificial
  CRISPR gRNA sequence
tacatcttcaaatatcttcc

SEQ ID NO: 711004 - DNA, 20 bp, Artificial
  CRISPR gRNA sequence
acatcttcaaatatcttcct

SEQ ID NO: 711005 - DNA, 20 bp, Artificial
  CRISPR gRNA sequence
atcttcaaatatcttcctag

SEQ ID NO: 711006 - DNA, 20 bp, Artificial
  CRISPR gRNA sequence
cttcaaatatcttcctagga

SEQ ID NO: 711007 - DNA, 20 bp, Artificial
  CRISPR gRNA sequence
ttcaaatatcttcctaggag

SEQ ID NO: 711008 - DNA, 20 bp, Artificial
  CRISPR gRNA sequence
tatcttcctaggagaggata

SEQ ID NO: 711009 - DNA, 20 bp, Artificial
  CRISPR gRNA sequence
atcttcctaggagaggatat

SEQ ID NO: 711010 - DNA, 20 bp, Artificial
  CRISPR gRNA sequence
ttcctaggagaggatatagg

SEQ ID NO: 711011 - DNA, 20 bp, Artificial
  CRISPR gRNA sequence
aggagaggatataggaagaa

SEQ ID NO: 711012 - DNA, 20 bp, Artificial
  CRISPR gRNA sequence
atataggaagaaaagccttc

SEQ ID NO: 711013 - DNA, 20 bp, Artificial
  CRISPR gRNA sequence
cttcaaacttgattgtaatt

SEQ ID NO: 711014 - DNA, 20 bp, Artificial
  CRISPR gRNA sequence
acttgattgtaatttagctg

SEQ ID NO: 711015 - DNA, 20 bp, Artificial
  CRISPR gRNA sequence
tagctgaagtgactgtaatt

SEQ ID NO: 711016 - DNA, 20 bp, Artificial
  CRISPR gRNA sequence
tgaagtgactgtaatttagc

SEQ ID NO: 711017 - DNA, 20 bp, Artificial
  CRISPR gRNA sequence
gaagtgactgtaatttagct

SEQ ID NO: 711018 - DNA, 20 bp, Artificial
  CRISPR gRNA sequence
taatttagctgggtaaattc

SEQ ID NO: 711019 - DNA, 20 bp, Artificial
  CRISPR gRNA sequence
aatttagctgggtaaattct

SEQ ID NO: 711020 - DNA, 20 bp, Artificial
  CRISPR gRNA sequence
agctgggtaaattctaggtt

SEQ ID NO: 711021 - DNA, 20 bp, Artificial
  CRISPR gRNA sequence
taaattctaggttcagaact

SEQ ID NO: 711022 - DNA, 20 bp, Artificial
  CRISPR gRNA sequence
attctaggttcagaactaag

SEQ ID NO: 711023 - DNA, 20 bp, Artificial
  CRISPR gRNA sequence
ttctaggttcagaactaaga

SEQ ID NO: 711024 - DNA, 20 bp, Artificial
  CRISPR gRNA sequence
ctaggttcagaactaagaag

SEQ ID NO: 711025 - DNA, 20 bp, Artificial
  CRISPR gRNA sequence
taggttcagaactaagaagg

SEQ ID NO: 711026 - DNA, 20 bp, Artificial
  CRISPR gRNA sequence
gttcagaactaagaaggagg

SEQ ID NO: 711027 - DNA, 20 bp, Artificial
  CRISPR gRNA sequence
ttcagaactaagaaggaggt

SEQ ID NO: 711028 - DNA, 20 bp, Artificial
  CRISPR gRNA sequence
agaactaagaaggaggtggg

SEQ ID NO: 711029 - DNA, 20 bp, Artificial
  CRISPR gRNA sequence
gaactaagaaggaggtgggt

SEQ ID NO: 711030 - DNA, 20 bp, Artificial
  CRISPR gRNA sequence
ctaagaaggaggtgggtggg

SEQ ID NO: 711031 - DNA, 20 bp, Artificial
  CRISPR gRNA sequence
ggtgggtgggtggtgtcttc

SEQ ID NO: 711032 - DNA, 20 bp, Artificial
  CRISPR gRNA sequence
gggtgggtggtgtcttccag

SEQ ID NO: 711033 - DNA, 20 bp, Artificial
  CRISPR gRNA sequence
tgggtggtgtcttccagtgg

SEQ ID NO: 711034 - DNA, 20 bp, Artificial
  CRISPR gRNA sequence
gtcttccagtggaagtactc

SEQ ID NO: 711035 - DNA, 20 bp, Artificial
  CRISPR gRNA sequence
tcttccagtggaagtactct

SEQ ID NO: 711036 - DNA, 20 bp, Artificial
  CRISPR gRNA sequence
aagtactctgggctgaccct

SEQ ID NO: 711037 - DNA, 20 bp, Artificial
  CRISPR gRNA sequence
agtactctgggctgaccctt

SEQ ID NO: 711038 - DNA, 20 bp, Artificial
  CRISPR gRNA sequence
cccttgggatccctgcattc

SEQ ID NO: 711039 - DNA, 20 bp, Artificial
  CRISPR gRNA sequence
ggatccctgcattctggttc

SEQ ID NO: 711040 - DNA, 20 bp, Artificial
  CRISPR gRNA sequence
ctgcattctggttctagctt

SEQ ID NO: 711041 - DNA, 20 bp, Artificial
  CRISPR gRNA sequence
ttcggccctgtgcttctctc

SEQ ID NO: 711042 - DNA, 20 bp, Artificial
  CRISPR gRNA sequence
tcggccctgtgcttctctct

SEQ ID NO: 711043 - DNA, 20 bp, Artificial
  CRISPR gRNA sequence
ttctctctgggtgtaaaacg

SEQ ID NO: 711044 - DNA, 20 bp, Artificial
  CRISPR gRNA sequence
tctctctgggtgtaaaacga

SEQ ID NO: 711045 - DNA, 20 bp, Artificial
  CRISPR gRNA sequence
ctctctgggtgtaaaacgaa

SEQ ID NO: 711046 - DNA, 20 bp, Artificial
  CRISPR gRNA sequence
tctctgggtgtaaaacgaag

SEQ ID NO: 711047 - DNA, 20 bp, Artificial
  CRISPR gRNA sequence
gtaaaacgaaggggttgtat

SEQ ID NO: 711048 - DNA, 20 bp, Artificial
  CRISPR gRNA sequence
acgaaggggttgtatcagac

SEQ ID NO: 711049 - DNA, 20 bp, Artificial
  CRISPR gRNA sequence
gaaggggttgtatcagacca

SEQ ID NO: 711050 - DNA, 20 bp, Artificial
  CRISPR gRNA sequence
aaggggttgtatcagaccag

SEQ ID NO: 711051 - DNA, 20 bp, Artificial
  CRISPR gRNA sequence
tgtatcagaccagaggtatc

SEQ ID NO: 711052 - DNA, 20 bp, Artificial
  CRISPR gRNA sequence
cagaggtatccagctttgac

SEQ ID NO: 711053 - DNA, 20 bp, Artificial
  CRISPR gRNA sequence
aaacattctgactatgtgac

SEQ ID NO: 711054 - DNA, 20 bp, Artificial
  CRISPR gRNA sequence
atgtgaccagcacaatgacc

SEQ ID NO: 711055 - DNA, 20 bp, Artificial
  CRISPR gRNA sequence
aatgacctagccactcctcc

SEQ ID NO: 711056 - DNA, 20 bp, Artificial
  CRISPR gRNA sequence
atgacctagccactcctcct

SEQ ID NO: 711057 - DNA, 20 bp, Artificial
  CRISPR gRNA sequence
tgaaaatatacatccaccca

SEQ ID NO: 711058 - DNA, 20 bp, Artificial
  CRISPR gRNA sequence
atccacccaaagacttgtac

SEQ ID NO: 711059 - DNA, 20 bp, Artificial
  CRISPR gRNA sequence
ccaaagacttgtacaagaat

SEQ ID NO: 711060 - DNA, 20 bp, Artificial
  CRISPR gRNA sequence
agacttgtacaagaatcggc

SEQ ID NO: 711061 - DNA, 20 bp, Artificial
  CRISPR gRNA sequence
gtacaagaatcggccagtca

SEQ ID NO: 711062 - DNA, 20 bp, Artificial
  CRISPR gRNA sequence
caagaatcggccagtcatgg

SEQ ID NO: 711063 - DNA, 20 bp, Artificial
  CRISPR gRNA sequence
ccagtcatggtggctcatgc

SEQ ID NO: 711064 - DNA, 20 bp, Artificial
  CRISPR gRNA sequence
gtggctcatgccagtaatct

SEQ ID NO: 711065 - DNA, 20 bp, Artificial
  CRISPR gRNA sequence
tgccagtaatctcagcactg

SEQ ID NO: 711066 - DNA, 20 bp, Artificial
  CRISPR gRNA sequence
gccagtaatctcagcactgt

SEQ ID NO: 711067 - DNA, 20 bp, Artificial
  CRISPR gRNA sequence
cagtaatctcagcactgtgg

SEQ ID NO: 711068 - DNA, 20 bp, Artificial
  CRISPR gRNA sequence
agtaatctcagcactgtggg

SEQ ID NO: 711069 - DNA, 20 bp, Artificial
  CRISPR gRNA sequence
tctcagcactgtgggaggct

SEQ ID NO: 711070 - DNA, 20 bp, Artificial
  CRISPR gRNA sequence
ctcagcactgtgggaggctg

SEQ ID NO: 711071 - DNA, 20 bp, Artificial
  CRISPR gRNA sequence
agcactgtgggaggctgagg

SEQ ID NO: 711072 - DNA, 20 bp, Artificial
  CRISPR gRNA sequence
gcactgtgggaggctgaggt

SEQ ID NO: 711073 - DNA, 20 bp, Artificial
  CRISPR gRNA sequence
actgtgggaggctgaggtgg

SEQ ID NO: 711074 - DNA, 20 bp, Artificial
  CRISPR gRNA sequence
ctgtgggaggctgaggtggg

SEQ ID NO: 711075 - DNA, 20 bp, Artificial
  CRISPR gRNA sequence
ctgaggtgggaggatcgccc

SEQ ID NO: 711076 - DNA, 20 bp, Artificial
  CRISPR gRNA sequence
gtgggaggatcgcccgagcc

SEQ ID NO: 711077 - DNA, 20 bp, Artificial
  CRISPR gRNA sequence
tgggaggatcgcccgagccc

SEQ ID NO: 711078 - DNA, 20 bp, Artificial
  CRISPR gRNA sequence
ggaggatcgcccgagcccag

SEQ ID NO: 711079 - DNA, 20 bp, Artificial
  CRISPR gRNA sequence
agcccaggagttcaatgctg

SEQ ID NO: 711080 - DNA, 20 bp, Artificial
  CRISPR gRNA sequence
caggagttcaatgctgcagt

SEQ ID NO: 711081 - DNA, 20 bp, Artificial
  CRISPR gRNA sequence
gttcaatgctgcagtgagcc

SEQ ID NO: 711082 - DNA, 20 bp, Artificial
  CRISPR gRNA sequence
aagatcatgccactgcactc

SEQ ID NO: 711083 - DNA, 20 bp, Artificial
  CRISPR gRNA sequence
catgccactgcactccagcc

SEQ ID NO: 711084 - DNA, 20 bp, Artificial
  CRISPR gRNA sequence
ctgcactccagcctggaaca

SEQ ID NO: 711085 - DNA, 20 bp, Artificial
  CRISPR gRNA sequence
gcactccagcctggaacaca

SEQ ID NO: 711086 - DNA, 20 bp, Artificial
  CRISPR gRNA sequence
tccagcctggaacacagagt

SEQ ID NO: 711087 - DNA, 20 bp, Artificial
  CRISPR gRNA sequence
aataataaaaataataataa

SEQ ID NO: 711088 - DNA, 20 bp, Artificial
  CRISPR gRNA sequence
aaaataataataaaagatat

SEQ ID NO: 711089 - DNA, 20 bp, Artificial
  CRISPR gRNA sequence
atacatgttaaaaaaaaaaa

SEQ ID NO: 711090 - DNA, 20 bp, Artificial
  CRISPR gRNA sequence
aaaaaaaaaaagaatattca

SEQ ID NO: 711091 - DNA, 20 bp, Artificial
  CRISPR gRNA sequence
acagctgttttcattcataa

SEQ ID NO: 711092 - DNA, 20 bp, Artificial
  CRISPR gRNA sequence
cattcataatagccctaaac

SEQ ID NO: 711093 - DNA, 20 bp, Artificial
  CRISPR gRNA sequence
acaacccaaatgccatcaac

SEQ ID NO: 711094 - DNA, 20 bp, Artificial
  CRISPR gRNA sequence
acccaaatgccatcaaccgg

SEQ ID NO: 711095 - DNA, 20 bp, Artificial
  CRISPR gRNA sequence
cccaaatgccatcaaccggc

SEQ ID NO: 711096 - DNA, 20 bp, Artificial
  CRISPR gRNA sequence
aaatgccatcaaccggcagg

SEQ ID NO: 711097 - DNA, 20 bp, Artificial
  CRISPR gRNA sequence
ccggcaggtagataaaatca

SEQ ID NO: 711098 - DNA, 20 bp, Artificial
  CRISPR gRNA sequence
gcaggtagataaaatcatgg

SEQ ID NO: 711099 - DNA, 20 bp, Artificial
  CRISPR gRNA sequence
ggtggtgcatctattacatg

SEQ ID NO: 711100 - DNA, 20 bp, Artificial
  CRISPR gRNA sequence
tgcatctattacatgtagcg

SEQ ID NO: 711101 - DNA, 20 bp, Artificial
  CRISPR gRNA sequence
gcatctattacatgtagcgt

SEQ ID NO: 711102 - DNA, 20 bp, Artificial
  CRISPR gRNA sequence
cattaatcctgctttgctct

SEQ ID NO: 711103 - DNA, 20 bp, Artificial
  CRISPR gRNA sequence
taatcctgctttgctcttgg

SEQ ID NO: 711104 - DNA, 20 bp, Artificial
  CRISPR gRNA sequence
aatcctgctttgctcttggt

SEQ ID NO: 711105 - DNA, 20 bp, Artificial
  CRISPR gRNA sequence
tggtaggtccttttgacctg

SEQ ID NO: 711106 - DNA, 20 bp, Artificial
  CRISPR gRNA sequence
tgacctgaagtctatgcttc

SEQ ID NO: 711107 - DNA, 20 bp, Artificial
  CRISPR gRNA sequence
ctgaagtctatgcttctggt

SEQ ID NO: 711108 - DNA, 20 bp, Artificial
  CRISPR gRNA sequence
tgaagtctatgcttctggtc

SEQ ID NO: 711109 - DNA, 20 bp, Artificial
  CRISPR gRNA sequence
tatgcttctggtcaggtgca

SEQ ID NO: 711110 - DNA, 20 bp, Artificial
  CRISPR gRNA sequence
tgcttctggtcaggtgcaca

SEQ ID NO: 711111 - DNA, 20 bp, Artificial
  CRISPR gRNA sequence
gtcaggtgcacagagaaatt

SEQ ID NO: 711112 - DNA, 20 bp, Artificial
  CRISPR gRNA sequence
tcaggtgcacagagaaattg

SEQ ID NO: 711113 - DNA, 20 bp, Artificial
  CRISPR gRNA sequence
agaaattgaggctgccactg

SEQ ID NO: 711114 - DNA, 20 bp, Artificial
  CRISPR gRNA sequence
gaaattgaggctgccactgt

SEQ ID NO: 711115 - DNA, 20 bp, Artificial
  CRISPR gRNA sequence
aaattgaggctgccactgtg

SEQ ID NO: 711116 - DNA, 20 bp, Artificial
  CRISPR gRNA sequence
aattgaggctgccactgtgg

SEQ ID NO: 711117 - DNA, 20 bp, Artificial
  CRISPR gRNA sequence
ttgaggctgccactgtgggg

SEQ ID NO: 711118 - DNA, 20 bp, Artificial
  CRISPR gRNA sequence
gccactgtgggggagacgcc

SEQ ID NO: 711119 - DNA, 20 bp, Artificial
  CRISPR gRNA sequence
cactgtgggggagacgcctg

SEQ ID NO: 711120 - DNA, 20 bp, Artificial
  CRISPR gRNA sequence
gggagacgcctggagcactt

SEQ ID NO: 711121 - DNA, 20 bp, Artificial
  CRISPR gRNA sequence
ggagacgcctggagcacttt

SEQ ID NO: 711122 - DNA, 20 bp, Artificial
  CRISPR gRNA sequence
gagacgcctggagcactttg

SEQ ID NO: 711123 - DNA, 20 bp, Artificial
  CRISPR gRNA sequence
tggagcactttggggtgcca

SEQ ID NO: 711124 - DNA, 20 bp, Artificial
  CRISPR gRNA sequence
tttggggtgccaaagacctg

SEQ ID NO: 711125 - DNA, 20 bp, Artificial
  CRISPR gRNA sequence
gggtgccaaagacctgtggc

SEQ ID NO: 711126 - DNA, 20 bp, Artificial
  CRISPR gRNA sequence
tgccaaagacctgtggctgg

SEQ ID NO: 711127 - DNA, 20 bp, Artificial
  CRISPR gRNA sequence
gccaaagacctgtggctggt

SEQ ID NO: 711128 - DNA, 20 bp, Artificial
  CRISPR gRNA sequence
ccaaagacctgtggctggtg

SEQ ID NO: 711129 - DNA, 20 bp, Artificial
  CRISPR gRNA sequence
caaagacctgtggctggtgg

SEQ ID NO: 711130 - DNA, 20 bp, Artificial
  CRISPR gRNA sequence
tgtggctggtgggggatgca

SEQ ID NO: 711131 - DNA, 20 bp, Artificial
  CRISPR gRNA sequence
tggctggtgggggatgcaca

SEQ ID NO: 711132 - DNA, 20 bp, Artificial
  CRISPR gRNA sequence
ggctggtgggggatgcacag

SEQ ID NO: 711133 - DNA, 20 bp, Artificial
  CRISPR gRNA sequence
gctggtgggggatgcacaga

SEQ ID NO: 711134 - DNA, 20 bp, Artificial
  CRISPR gRNA sequence
gggggatgcacagagggaat

SEQ ID NO: 711135 - DNA, 20 bp, Artificial
  CRISPR gRNA sequence
ggggatgcacagagggaatc

SEQ ID NO: 711136 - DNA, 20 bp, Artificial
  CRISPR gRNA sequence
gggatgcacagagggaatca

SEQ ID NO: 711137 - DNA, 20 bp, Artificial
  CRISPR gRNA sequence
gatgcacagagggaatcagg

SEQ ID NO: 711138 - DNA, 20 bp, Artificial
  CRISPR gRNA sequence
cacagagggaatcagggagt

SEQ ID NO: 711139 - DNA, 20 bp, Artificial
  CRISPR gRNA sequence
acagagggaatcagggagtc

SEQ ID NO: 711140 - DNA, 20 bp, Artificial
  CRISPR gRNA sequence
agggagtcaggacacttttg

SEQ ID NO: 711141 - DNA, 20 bp, Artificial
  CRISPR gRNA sequence
caggacacttttgcagacat

SEQ ID NO: 711142 - DNA, 20 bp, Artificial
  CRISPR gRNA sequence
aggacacttttgcagacatg

SEQ ID NO: 711143 - DNA, 20 bp, Artificial
  CRISPR gRNA sequence
acttttgcagacatgaggcc

SEQ ID NO: 711144 - DNA, 20 bp, Artificial
  CRISPR gRNA sequence
gcacgtgccaatgtctgcat

SEQ ID NO: 711145 - DNA, 20 bp, Artificial
  CRISPR gRNA sequence
cacgtgccaatgtctgcatt

SEQ ID NO: 711146 - DNA, 20 bp, Artificial
  CRISPR gRNA sequence
cgtgccaatgtctgcattgg

SEQ ID NO: 711147 - DNA, 20 bp, Artificial
  CRISPR gRNA sequence
tgccaatgtctgcattggga

SEQ ID NO: 711148 - DNA, 20 bp, Artificial
  CRISPR gRNA sequence
tgcattgggagagccacatc

SEQ ID NO: 711149 - DNA, 20 bp, Artificial
  CRISPR gRNA sequence
gcattgggagagccacatca

SEQ ID NO: 711150 - DNA, 20 bp, Artificial
  CRISPR gRNA sequence
ttgggagagccacatcaagg

SEQ ID NO: 711151 - DNA, 20 bp, Artificial
  CRISPR gRNA sequence
agccacatcaaggtggtcac

SEQ ID NO: 711152 - DNA, 20 bp, Artificial
  CRISPR gRNA sequence
gccacatcaaggtggtcacc

SEQ ID NO: 711153 - DNA, 20 bp, Artificial
  CRISPR gRNA sequence
catcaaggtggtcaccaggc

SEQ ID NO: 711154 - DNA, 20 bp, Artificial
  CRISPR gRNA sequence
atcaaggtggtcaccaggcc

SEQ ID NO: 711155 - DNA, 20 bp, Artificial
  CRISPR gRNA sequence
aaggtggtcaccaggccagg

SEQ ID NO: 711156 - DNA, 20 bp, Artificial
  CRISPR gRNA sequence
gtggtcaccaggccaggcag

SEQ ID NO: 711157 - DNA, 20 bp, Artificial
  CRISPR gRNA sequence
tggtcaccaggccaggcagc

SEQ ID NO: 711158 - DNA, 20 bp, Artificial
  CRISPR gRNA sequence
gtcaccaggccaggcagcag

SEQ ID NO: 711159 - DNA, 20 bp, Artificial
  CRISPR gRNA sequence
ccaggccaggcagcaggagc

SEQ ID NO: 711160 - DNA, 20 bp, Artificial
  CRISPR gRNA sequence
ggccaggcagcaggagcaag

SEQ ID NO: 711161 - DNA, 20 bp, Artificial
  CRISPR gRNA sequence
caggagcaagaagaaacaaa

SEQ ID NO: 711162 - DNA, 20 bp, Artificial
  CRISPR gRNA sequence
agcaagaagaaacaaatggc

SEQ ID NO: 711163 - DNA, 20 bp, Artificial
  CRISPR gRNA sequence
gcaagaagaaacaaatggcc

SEQ ID NO: 711164 - DNA, 20 bp, Artificial
  CRISPR gRNA sequence
aagaaacaaatggccgggcg

SEQ ID NO: 711165 - DNA, 20 bp, Artificial
  CRISPR gRNA sequence
aaacaaatggccgggcgcag

SEQ ID NO: 711166 - DNA, 20 bp, Artificial
  CRISPR gRNA sequence
ccgggcgcagtggctcacgc

SEQ ID NO: 711167 - DNA, 20 bp, Artificial
  CRISPR gRNA sequence
gtggctcacgccggtaatcc

SEQ ID NO: 711168 - DNA, 20 bp, Artificial
  CRISPR gRNA sequence
ggtaatcccagcacttttgc

SEQ ID NO: 711169 - DNA, 20 bp, Artificial
  CRISPR gRNA sequence
gtaatcccagcacttttgcg

SEQ ID NO: 711170 - DNA, 20 bp, Artificial
  CRISPR gRNA sequence
cccagcacttttgcgaggcc

SEQ ID NO: 711171 - DNA, 20 bp, Artificial
  CRISPR gRNA sequence
ccagcacttttgcgaggccg

SEQ ID NO: 711172 - DNA, 20 bp, Artificial
  CRISPR gRNA sequence
gcacttttgcgaggccgagg

SEQ ID NO: 711173 - DNA, 20 bp, Artificial
  CRISPR gRNA sequence
cacttttgcgaggccgaggc

SEQ ID NO: 711174 - DNA, 20 bp, Artificial
  CRISPR gRNA sequence
ttttgcgaggccgaggcagg

SEQ ID NO: 711175 - DNA, 20 bp, Artificial
  CRISPR gRNA sequence
ggccgaggcaggcggatcac

SEQ ID NO: 711176 - DNA, 20 bp, Artificial
  CRISPR gRNA sequence
gccgaggcaggcggatcacc

SEQ ID NO: 711177 - DNA, 20 bp, Artificial
  CRISPR gRNA sequence
aggcaggcggatcaccaggt

SEQ ID NO: 711178 - DNA, 20 bp, Artificial
  CRISPR gRNA sequence
ggcaggcggatcaccaggtc

SEQ ID NO: 711179 - DNA, 20 bp, Artificial
  CRISPR gRNA sequence
caggcggatcaccaggtcag

SEQ ID NO: 711180 - DNA, 20 bp, Artificial
  CRISPR gRNA sequence
gatcaccaggtcaggagttc

SEQ ID NO: 711181 - DNA, 20 bp, Artificial
  CRISPR gRNA sequence
ccaggtcaggagttcgagac

SEQ ID NO: 711182 - DNA, 20 bp, Artificial
  CRISPR gRNA sequence
cgagaccagcctgaccatca

SEQ ID NO: 711183 - DNA, 20 bp, Artificial
  CRISPR gRNA sequence
tctactaaaaatacaaaaat

SEQ ID NO: 711184 - DNA, 20 bp, Artificial
  CRISPR gRNA sequence
ctaaaaatacaaaaattagc

SEQ ID NO: 711185 - DNA, 20 bp, Artificial
  CRISPR gRNA sequence
taaaaatacaaaaattagcc

SEQ ID NO: 711186 - DNA, 20 bp, Artificial
  CRISPR gRNA sequence
atacaaaaattagccaggcg

SEQ ID NO: 711187 - DNA, 20 bp, Artificial
  CRISPR gRNA sequence
caaaaattagccaggcgtgg

SEQ ID NO: 711188 - DNA, 20 bp, Artificial
  CRISPR gRNA sequence
gtggcgcgtgcctgtaatcc

SEQ ID NO: 711189 - DNA, 20 bp, Artificial
  CRISPR gRNA sequence
tgcctgtaatcccagctact

SEQ ID NO: 711190 - DNA, 20 bp, Artificial
  CRISPR gRNA sequence
gcctgtaatcccagctactc

SEQ ID NO: 711191 - DNA, 20 bp, Artificial
  CRISPR gRNA sequence
ctgtaatcccagctactcag

SEQ ID NO: 711192 - DNA, 20 bp, Artificial
  CRISPR gRNA sequence
tgtaatcccagctactcagg

SEQ ID NO: 711193 - DNA, 20 bp, Artificial
  CRISPR gRNA sequence
tcccagctactcaggaggct

SEQ ID NO: 711194 - DNA, 20 bp, Artificial
  CRISPR gRNA sequence
cccagctactcaggaggctg

SEQ ID NO: 711195 - DNA, 20 bp, Artificial
  CRISPR gRNA sequence
agctactcaggaggctgagg

SEQ ID NO: 711196 - DNA, 20 bp, Artificial
  CRISPR gRNA sequence
gctactcaggaggctgaggc

SEQ ID NO: 711197 - DNA, 20 bp, Artificial
  CRISPR gRNA sequence
gcaggaaaactgcttgaacc

SEQ ID NO: 711198 - DNA, 20 bp, Artificial
  CRISPR gRNA sequence
caggaaaactgcttgaaccc

SEQ ID NO: 711199 - DNA, 20 bp, Artificial
  CRISPR gRNA sequence
ggaaaactgcttgaacccgg

SEQ ID NO: 711200 - DNA, 20 bp, Artificial
  CRISPR gRNA sequence
gaaaactgcttgaacccggg

SEQ ID NO: 711201 - DNA, 20 bp, Artificial
  CRISPR gRNA sequence
aactgcttgaacccgggagg

SEQ ID NO: 711202 - DNA, 20 bp, Artificial
  CRISPR gRNA sequence
ctgcttgaacccgggaggtg

SEQ ID NO: 711203 - DNA, 20 bp, Artificial
  CRISPR gRNA sequence
tgcttgaacccgggaggtgg

SEQ ID NO: 711204 - DNA, 20 bp, Artificial
  CRISPR gRNA sequence
aacccgggaggtggaggttg

SEQ ID NO: 711205 - DNA, 20 bp, Artificial
  CRISPR gRNA sequence
ccgggaggtggaggttgtgg

SEQ ID NO: 711206 - DNA, 20 bp, Artificial
  CRISPR gRNA sequence
cgggaggtggaggttgtggt

SEQ ID NO: 711207 - DNA, 20 bp, Artificial
  CRISPR gRNA sequence
ggtggaggttgtggtgggcc

SEQ ID NO: 711208 - DNA, 20 bp, Artificial
  CRISPR gRNA sequence
aagatcgcgtcactgcactc

SEQ ID NO: 711209 - DNA, 20 bp, Artificial
  CRISPR gRNA sequence
cgcgtcactgcactccagcc

SEQ ID NO: 711210 - DNA, 20 bp, Artificial
  CRISPR gRNA sequence
gcgtcactgcactccagcct

SEQ ID NO: 711211 - DNA, 20 bp, Artificial
  CRISPR gRNA sequence
ctgcactccagcctgggcga

SEQ ID NO: 711212 - DNA, 20 bp, Artificial
  CRISPR gRNA sequence
gcactccagcctgggcgaca

SEQ ID NO: 711213 - DNA, 20 bp, Artificial
  CRISPR gRNA sequence
tccagcctgggcgacagagt

SEQ ID NO: 711214 - DNA, 20 bp, Artificial
  CRISPR gRNA sequence
gtgagactctgtctcaaaaa

SEQ ID NO: 711215 - DNA, 20 bp, Artificial
  CRISPR gRNA sequence
actctgtctcaaaaaaagaa

SEQ ID NO: 711216 - DNA, 20 bp, Artificial
  CRISPR gRNA sequence
aacaaaaaaacaaatgcaac

SEQ ID NO: 711217 - DNA, 20 bp, Artificial
  CRISPR gRNA sequence
aaaaaaacaaatgcaaccag

SEQ ID NO: 711218 - DNA, 20 bp, Artificial
  CRISPR gRNA sequence
aagcctccttcctcctgcga

SEQ ID NO: 711219 - DNA, 20 bp, Artificial
  CRISPR gRNA sequence
ttcctcctgcgatggccctc

SEQ ID NO: 711220 - DNA, 20 bp, Artificial
  CRISPR gRNA sequence
ggccctctagcgccctctgc

SEQ ID NO: 711221 - DNA, 20 bp, Artificial
  CRISPR gRNA sequence
ctctagcgccctctgctggc

SEQ ID NO: 711222 - DNA, 20 bp, Artificial
  CRISPR gRNA sequence
tctagcgccctctgctggca

SEQ ID NO: 711223 - DNA, 20 bp, Artificial
  CRISPR gRNA sequence
gcttaactgcatgctcccta

SEQ ID NO: 711224 - DNA, 20 bp, Artificial
  CRISPR gRNA sequence
ttaactgcatgctccctaca

SEQ ID NO: 711225 - DNA, 20 bp, Artificial
  CRISPR gRNA sequence
taactgcatgctccctacag

SEQ ID NO: 711226 - DNA, 20 bp, Artificial
  CRISPR gRNA sequence
actgcatgctccctacagag

SEQ ID NO: 711227 - DNA, 20 bp, Artificial
  CRISPR gRNA sequence
catgctccctacagaggaga

SEQ ID NO: 711228 - DNA, 20 bp, Artificial
  CRISPR gRNA sequence
atgctccctacagaggagaa

SEQ ID NO: 711229 - DNA, 20 bp, Artificial
  CRISPR gRNA sequence
ctccctacagaggagaaagg

SEQ ID NO: 711230 - DNA, 20 bp, Artificial
  CRISPR gRNA sequence
ccctacagaggagaaaggcg

SEQ ID NO: 711231 - DNA, 20 bp, Artificial
  CRISPR gRNA sequence
aaaggcggagccatcgttga

SEQ ID NO: 711232 - DNA, 20 bp, Artificial
  CRISPR gRNA sequence
ggcggagccatcgttgatgg

SEQ ID NO: 711233 - DNA, 20 bp, Artificial
  CRISPR gRNA sequence
gcggagccatcgttgatggc

SEQ ID NO: 711234 - DNA, 20 bp, Artificial
  CRISPR gRNA sequence
cggagccatcgttgatggca

SEQ ID NO: 711235 - DNA, 20 bp, Artificial
  CRISPR gRNA sequence
agccatcgttgatggcaggg

SEQ ID NO: 711236 - DNA, 20 bp, Artificial
  CRISPR gRNA sequence
gccatcgttgatggcagggc

SEQ ID NO: 711237 - DNA, 20 bp, Artificial
  CRISPR gRNA sequence
ccatcgttgatggcagggca

SEQ ID NO: 711238 - DNA, 20 bp, Artificial
  CRISPR gRNA sequence
cgttgatggcagggcaggga

SEQ ID NO: 711239 - DNA, 20 bp, Artificial
  CRISPR gRNA sequence
gatggcagggcagggatgga

SEQ ID NO: 711240 - DNA, 20 bp, Artificial
  CRISPR gRNA sequence
atggcagggcagggatggaa

SEQ ID NO: 711241 - DNA, 20 bp, Artificial
  CRISPR gRNA sequence
ggcagggatggaaaggtgaa

SEQ ID NO: 711242 - DNA, 20 bp, Artificial
  CRISPR gRNA sequence
cagggatggaaaggtgaatg

SEQ ID NO: 711243 - DNA, 20 bp, Artificial
  CRISPR gRNA sequence
ggaaaggtgaatggagaacc

SEQ ID NO: 711244 - DNA, 20 bp, Artificial
  CRISPR gRNA sequence
aaaggtgaatggagaaccta

SEQ ID NO: 711245 - DNA, 20 bp, Artificial
  CRISPR gRNA sequence
aatggagaacctagagatga

SEQ ID NO: 711246 - DNA, 20 bp, Artificial
  CRISPR gRNA sequence
atggagaacctagagatgat

SEQ ID NO: 711247 - DNA, 20 bp, Artificial
  CRISPR gRNA sequence
agagatgatgggctgatcac

SEQ ID NO: 711248 - DNA, 20 bp, Artificial
  CRISPR gRNA sequence
tcacaagcacactttctaaa

SEQ ID NO: 711249 - DNA, 20 bp, Artificial
  CRISPR gRNA sequence
tcccatattgttccttttca

SEQ ID NO: 711250 - DNA, 20 bp, Artificial
  CRISPR gRNA sequence
agcattctgtgcccacctta

SEQ ID NO: 711251 - DNA, 20 bp, Artificial
  CRISPR gRNA sequence
cgacttcgtgaatttttctg

SEQ ID NO: 711252 - DNA, 20 bp, Artificial
  CRISPR gRNA sequence
gacacgaatttaatgttgct

SEQ ID NO: 711253 - DNA, 20 bp, Artificial
  CRISPR gRNA sequence
gctaagtactcttctattcc

SEQ ID NO: 711254 - DNA, 20 bp, Artificial
  CRISPR gRNA sequence
ttctattcctggatttatca

SEQ ID NO: 711255 - DNA, 20 bp, Artificial
  CRISPR gRNA sequence
atttatcaaagcttcatgtg

SEQ ID NO: 711256 - DNA, 20 bp, Artificial
  CRISPR gRNA sequence
atcaaagcttcatgtgtggt

SEQ ID NO: 711257 - DNA, 20 bp, Artificial
  CRISPR gRNA sequence
tcatgtgtggtaagaatttc

SEQ ID NO: 711258 - DNA, 20 bp, Artificial
  CRISPR gRNA sequence
tatctttttattctcctttg

SEQ ID NO: 711259 - DNA, 20 bp, Artificial
  CRISPR gRNA sequence
atctttttattctcctttgt

SEQ ID NO: 711260 - DNA, 20 bp, Artificial
  CRISPR gRNA sequence
tctttttattctcctttgta

SEQ ID NO: 711261 - DNA, 20 bp, Artificial
  CRISPR gRNA sequence
tttattctcctttgtagggc

SEQ ID NO: 711262 - DNA, 20 bp, Artificial
  CRISPR gRNA sequence
ctcattcatatttattttaa

SEQ ID NO: 711263 - DNA, 20 bp, Artificial
  CRISPR gRNA sequence
tcattcatatttattttaaa

SEQ ID NO: 711264 - DNA, 20 bp, Artificial
  CRISPR gRNA sequence
cattcatatttattttaaaa

SEQ ID NO: 711265 - DNA, 20 bp, Artificial
  CRISPR gRNA sequence
tattttaaaagggttatgct

SEQ ID NO: 711266 - DNA, 20 bp, Artificial
  CRISPR gRNA sequence
ttaaaagggttatgcttggc

SEQ ID NO: 711267 - DNA, 20 bp, Artificial
  CRISPR gRNA sequence
taaaagggttatgcttggcc

SEQ ID NO: 711268 - DNA, 20 bp, Artificial
  CRISPR gRNA sequence
gggttatgcttggccgggtg

SEQ ID NO: 711269 - DNA, 20 bp, Artificial
  CRISPR gRNA sequence
ttatgcttggccgggtgcgg

SEQ ID NO: 711270 - DNA, 20 bp, Artificial
  CRISPR gRNA sequence
gtggctcacgcctgtaatcc

SEQ ID NO: 711271 - DNA, 20 bp, Artificial
  CRISPR gRNA sequence
cgcctgtaatcccagcactt

SEQ ID NO: 711272 - DNA, 20 bp, Artificial
  CRISPR gRNA sequence
gcctgtaatcccagcacttt

SEQ ID NO: 711273 - DNA, 20 bp, Artificial
  CRISPR gRNA sequence
ctgtaatcccagcactttgg

SEQ ID NO: 711274 - DNA, 20 bp, Artificial
  CRISPR gRNA sequence
tgtaatcccagcactttggg

SEQ ID NO: 711275 - DNA, 20 bp, Artificial
  CRISPR gRNA sequence
tcccagcactttgggaggct

SEQ ID NO: 711276 - DNA, 20 bp, Artificial
  CRISPR gRNA sequence
cccagcactttgggaggctg

SEQ ID NO: 711277 - DNA, 20 bp, Artificial
  CRISPR gRNA sequence
agcactttgggaggctgagg

SEQ ID NO: 711278 - DNA, 20 bp, Artificial
  CRISPR gRNA sequence
gcactttgggaggctgaggc

SEQ ID NO: 711279 - DNA, 20 bp, Artificial
  CRISPR gRNA sequence
ctttgggaggctgaggcagg

SEQ ID NO: 711280 - DNA, 20 bp, Artificial
  CRISPR gRNA sequence
gctgaggcaggcagatcacc

SEQ ID NO: 711281 - DNA, 20 bp, Artificial
  CRISPR gRNA sequence
ctgaggcaggcagatcacct

SEQ ID NO: 711282 - DNA, 20 bp, Artificial
  CRISPR gRNA sequence
tgaggcaggcagatcacctg

SEQ ID NO: 711283 - DNA, 20 bp, Artificial
  CRISPR gRNA sequence
gcaggcagatcacctggggt

SEQ ID NO: 711284 - DNA, 20 bp, Artificial
  CRISPR gRNA sequence
caggcagatcacctggggtc

SEQ ID NO: 711285 - DNA, 20 bp, Artificial
  CRISPR gRNA sequence
ggcagatcacctggggtcag

SEQ ID NO: 711286 - DNA, 20 bp, Artificial
  CRISPR gRNA sequence
tcacctggggtcaggagttc

SEQ ID NO: 711287 - DNA, 20 bp, Artificial
  CRISPR gRNA sequence
tggggtcaggagttcgagac

SEQ ID NO: 711288 - DNA, 20 bp, Artificial
  CRISPR gRNA sequence
cgagaccagcctgaccaatg

SEQ ID NO: 711289 - DNA, 20 bp, Artificial
  CRISPR gRNA sequence
tctactaaaaatacaaaaat

SEQ ID NO: 711290 - DNA, 20 bp, Artificial
  CRISPR gRNA sequence
ctaaaaatacaaaaattagc

SEQ ID NO: 711291 - DNA, 20 bp, Artificial
  CRISPR gRNA sequence
taaaaatacaaaaattagcc

SEQ ID NO: 711292 - DNA, 20 bp, Artificial
  CRISPR gRNA sequence
atacaaaaattagccgggtg

SEQ ID NO: 711293 - DNA, 20 bp, Artificial
  CRISPR gRNA sequence
caaaaattagccgggtgtgg

SEQ ID NO: 711294 - DNA, 20 bp, Artificial
  CRISPR gRNA sequence
gtggtgcacgcctgtaatcc

SEQ ID NO: 711295 - DNA, 20 bp, Artificial
  CRISPR gRNA sequence
cgcctgtaatcccagctact

SEQ ID NO: 711296 - DNA, 20 bp, Artificial
  CRISPR gRNA sequence
gcctgtaatcccagctactt

SEQ ID NO: 711297 - DNA, 20 bp, Artificial
  CRISPR gRNA sequence
ctgtaatcccagctacttgg

SEQ ID NO: 711298 - DNA, 20 bp, Artificial
  CRISPR gRNA sequence
tgtaatcccagctacttggg

SEQ ID NO: 711299 - DNA, 20 bp, Artificial
  CRISPR gRNA sequence
tcccagctacttgggaggct

SEQ ID NO: 711300 - DNA, 20 bp, Artificial
  CRISPR gRNA sequence
cccagctacttgggaggctg

SEQ ID NO: 711301 - DNA, 20 bp, Artificial
  CRISPR gRNA sequence
tacttgggaggctgaggcac

SEQ ID NO: 711302 - DNA, 20 bp, Artificial
  CRISPR gRNA sequence
gggaggctgaggcacaagaa

SEQ ID NO: 711303 - DNA, 20 bp, Artificial
  CRISPR gRNA sequence
gcacaagaatagctcaaacc

SEQ ID NO: 711304 - DNA, 20 bp, Artificial
  CRISPR gRNA sequence
cacaagaatagctcaaaccc

SEQ ID NO: 711305 - DNA, 20 bp, Artificial
  CRISPR gRNA sequence
caagaatagctcaaacccag

SEQ ID NO: 711306 - DNA, 20 bp, Artificial
  CRISPR gRNA sequence
aagaatagctcaaacccagg

SEQ ID NO: 711307 - DNA, 20 bp, Artificial
  CRISPR gRNA sequence
aatagctcaaacccaggagg

SEQ ID NO: 711308 - DNA, 20 bp, Artificial
  CRISPR gRNA sequence
tagctcaaacccaggaggca

SEQ ID NO: 711309 - DNA, 20 bp, Artificial
  CRISPR gRNA sequence
agctcaaacccaggaggcag

SEQ ID NO: 711310 - DNA, 20 bp, Artificial
  CRISPR gRNA sequence
caggaggcagaggttgccgt

SEQ ID NO: 711311 - DNA, 20 bp, Artificial
  CRISPR gRNA sequence
ggcagaggttgccgtgagcc

SEQ ID NO: 711312 - DNA, 20 bp, Artificial
  CRISPR gRNA sequence
gagaccataccactgcactc

SEQ ID NO: 711313 - DNA, 20 bp, Artificial
  CRISPR gRNA sequence
cataccactgcactccagcc

SEQ ID NO: 711314 - DNA, 20 bp, Artificial
  CRISPR gRNA sequence
ataccactgcactccagcct

SEQ ID NO: 711315 - DNA, 20 bp, Artificial
  CRISPR gRNA sequence
ctgcactccagcctgggcaa

SEQ ID NO: 711316 - DNA, 20 bp, Artificial
  CRISPR gRNA sequence
gcactccagcctgggcaaca

SEQ ID NO: 711317 - DNA, 20 bp, Artificial
  CRISPR gRNA sequence
tccagcctgggcaacagagc

SEQ ID NO: 711318 - DNA, 20 bp, Artificial
  CRISPR gRNA sequence
gagcgagactttgtctcaaa

SEQ ID NO: 711319 - DNA, 20 bp, Artificial
  CRISPR gRNA sequence
agactttgtctcaaaaagaa

SEQ ID NO: 711320 - DNA, 20 bp, Artificial
  CRISPR gRNA sequence
gactttgtctcaaaaagaaa

SEQ ID NO: 711321 - DNA, 20 bp, Artificial
  CRISPR gRNA sequence
actttgtctcaaaaagaaaa

SEQ ID NO: 711322 - DNA, 20 bp, Artificial
  CRISPR gRNA sequence
ttgtctcaaaaagaaaaggg

SEQ ID NO: 711323 - DNA, 20 bp, Artificial
  CRISPR gRNA sequence
tgtctcaaaaagaaaagggt

SEQ ID NO: 711324 - DNA, 20 bp, Artificial
  CRISPR gRNA sequence
gtctcaaaaagaaaagggtg

SEQ ID NO: 711325 - DNA, 20 bp, Artificial
  CRISPR gRNA sequence
tctcaaaaagaaaagggtgg

SEQ ID NO: 711326 - DNA, 20 bp, Artificial
  CRISPR gRNA sequence
ctcaaaaagaaaagggtggg

SEQ ID NO: 711327 - DNA, 20 bp, Artificial
  CRISPR gRNA sequence
tcaaaaagaaaagggtgggg

SEQ ID NO: 711328 - DNA, 20 bp, Artificial
  CRISPR gRNA sequence
caaaaagaaaagggtggggg

SEQ ID NO: 711329 - DNA, 20 bp, Artificial
  CRISPR gRNA sequence
aaaagaaaagggtggggggg

SEQ ID NO: 711330 - DNA, 20 bp, Artificial
  CRISPR gRNA sequence
aaagaaaagggtgggggggg

SEQ ID NO: 711331 - DNA, 20 bp, Artificial
  CRISPR gRNA sequence
aagaaaagggtgggggggga

SEQ ID NO: 711332 - DNA, 20 bp, Artificial
  CRISPR gRNA sequence
ggttatgctgcatccaccaa

SEQ ID NO: 711333 - DNA, 20 bp, Artificial
  CRISPR gRNA sequence
catccaccaatagataaatg

SEQ ID NO: 711334 - DNA, 20 bp, Artificial
  CRISPR gRNA sequence
aatgtggcatctatacacaa

SEQ ID NO: 711335 - DNA, 20 bp, Artificial
  CRISPR gRNA sequence
atacacaatggaatactact

SEQ ID NO: 711336 - DNA, 20 bp, Artificial
  CRISPR gRNA sequence
gaatactactcagccatcat

SEQ ID NO: 711337 - DNA, 20 bp, Artificial
  CRISPR gRNA sequence
aatactactcagccatcata

SEQ ID NO: 711338 - DNA, 20 bp, Artificial
  CRISPR gRNA sequence
ctactcagccatcataagga

SEQ ID NO: 711339 - DNA, 20 bp, Artificial
  CRISPR gRNA sequence
ccatcataaggaaagaaatc

SEQ ID NO: 711340 - DNA, 20 bp, Artificial
  CRISPR gRNA sequence
gaaagaaatcaagtctttcg

SEQ ID NO: 711341 - DNA, 20 bp, Artificial
  CRISPR gRNA sequence
tcaagtctttcgcagcaaca

SEQ ID NO: 711342 - DNA, 20 bp, Artificial
  CRISPR gRNA sequence
gtctttcgcagcaacatgga

SEQ ID NO: 711343 - DNA, 20 bp, Artificial
  CRISPR gRNA sequence
cagcaacatggatggaactg

SEQ ID NO: 711344 - DNA, 20 bp, Artificial
  CRISPR gRNA sequence
agcaacatggatggaactga

SEQ ID NO: 711345 - DNA, 20 bp, Artificial
  CRISPR gRNA sequence
gaactgaaggccatattctt

SEQ ID NO: 711346 - DNA, 20 bp, Artificial
  CRISPR gRNA sequence
gaaggccatattcttaagtg

SEQ ID NO: 711347 - DNA, 20 bp, Artificial
  CRISPR gRNA sequence
tattcttaagtgcagacatt

SEQ ID NO: 711348 - DNA, 20 bp, Artificial
  CRISPR gRNA sequence
taagtgcagacattcagaca

SEQ ID NO: 711349 - DNA, 20 bp, Artificial
  CRISPR gRNA sequence
tgcagacattcagacacaga

SEQ ID NO: 711350 - DNA, 20 bp, Artificial
  CRISPR gRNA sequence
tactgcctgttctcacttct

SEQ ID NO: 711351 - DNA, 20 bp, Artificial
  CRISPR gRNA sequence
tgcctgttctcacttctaag

SEQ ID NO: 711352 - DNA, 20 bp, Artificial
  CRISPR gRNA sequence
gcctgttctcacttctaagt

SEQ ID NO: 711353 - DNA, 20 bp, Artificial
  CRISPR gRNA sequence
ctgttctcacttctaagtgg

SEQ ID NO: 711354 - DNA, 20 bp, Artificial
  CRISPR gRNA sequence
agtgaaatactgtgtccaca

SEQ ID NO: 711355 - DNA, 20 bp, Artificial
  CRISPR gRNA sequence
tgaaatactgtgtccacacg

SEQ ID NO: 711356 - DNA, 20 bp, Artificial
  CRISPR gRNA sequence
atactgtgtccacacggagc

SEQ ID NO: 711357 - DNA, 20 bp, Artificial
  CRISPR gRNA sequence
actgtgtccacacggagctg

SEQ ID NO: 711358 - DNA, 20 bp, Artificial
  CRISPR gRNA sequence
tgtgtccacacggagctgga

SEQ ID NO: 711359 - DNA, 20 bp, Artificial
  CRISPR gRNA sequence
gtccacacggagctggagag

SEQ ID NO: 711360 - DNA, 20 bp, Artificial
  CRISPR gRNA sequence
ggagctggagagtggaataa

SEQ ID NO: 711361 - DNA, 20 bp, Artificial
  CRISPR gRNA sequence
gagctggagagtggaataaa

SEQ ID NO: 711362 - DNA, 20 bp, Artificial
  CRISPR gRNA sequence
gagagtggaataaaaggcaa

SEQ ID NO: 711363 - DNA, 20 bp, Artificial
  CRISPR gRNA sequence
gagtggaataaaaggcaaca

SEQ ID NO: 711364 - DNA, 20 bp, Artificial
  CRISPR gRNA sequence
aataaaaggcaacagagact

SEQ ID NO: 711365 - DNA, 20 bp, Artificial
  CRISPR gRNA sequence
aaaaggcaacagagacttag

SEQ ID NO: 711366 - DNA, 20 bp, Artificial
  CRISPR gRNA sequence
aaaggcaacagagacttaga

SEQ ID NO: 711367 - DNA, 20 bp, Artificial
  CRISPR gRNA sequence
aaggcaacagagacttagaa

SEQ ID NO: 711368 - DNA, 20 bp, Artificial
  CRISPR gRNA sequence
caacagagacttagaagggt

SEQ ID NO: 711369 - DNA, 20 bp, Artificial
  CRISPR gRNA sequence
aacagagacttagaagggtg

SEQ ID NO: 711370 - DNA, 20 bp, Artificial
  CRISPR gRNA sequence
acagagacttagaagggtga

SEQ ID NO: 711371 - DNA, 20 bp, Artificial
  CRISPR gRNA sequence
cagagacttagaagggtgag

SEQ ID NO: 711372 - DNA, 20 bp, Artificial
  CRISPR gRNA sequence
agagacttagaagggtgagg

SEQ ID NO: 711373 - DNA, 20 bp, Artificial
  CRISPR gRNA sequence
gacttagaagggtgaggggg

SEQ ID NO: 711374 - DNA, 20 bp, Artificial
  CRISPR gRNA sequence
acttagaagggtgagggggt

SEQ ID NO: 711375 - DNA, 20 bp, Artificial
  CRISPR gRNA sequence
ttagaagggtgagggggtgg

SEQ ID NO: 711376 - DNA, 20 bp, Artificial
  CRISPR gRNA sequence
tagaagggtgagggggtggg

SEQ ID NO: 711377 - DNA, 20 bp, Artificial
  CRISPR gRNA sequence
gggtgagggggtgggaggta

SEQ ID NO: 711378 - DNA, 20 bp, Artificial
  CRISPR gRNA sequence
ggtgagggggtgggaggtat

SEQ ID NO: 711379 - DNA, 20 bp, Artificial
  CRISPR gRNA sequence
gagggggtgggaggtatagg

SEQ ID NO: 711380 - DNA, 20 bp, Artificial
  CRISPR gRNA sequence
agggggtgggaggtataggt

SEQ ID NO: 711381 - DNA, 20 bp, Artificial
  CRISPR gRNA sequence
gggtgggaggtataggtagg

SEQ ID NO: 711382 - DNA, 20 bp, Artificial
  CRISPR gRNA sequence
ggtataggtaggtggaccat

SEQ ID NO: 711383 - DNA, 20 bp, Artificial
  CRISPR gRNA sequence
tggaccatgagaaattattt

SEQ ID NO: 711384 - DNA, 20 bp, Artificial
  CRISPR gRNA sequence
ggaccatgagaaattattta

SEQ ID NO: 711385 - DNA, 20 bp, Artificial
  CRISPR gRNA sequence
gaccatgagaaattatttaa

SEQ ID NO: 711386 - DNA, 20 bp, Artificial
  CRISPR gRNA sequence
accatgagaaattatttaag

SEQ ID NO: 711387 - DNA, 20 bp, Artificial
  CRISPR gRNA sequence
ggggtacaatgtatgctatt

SEQ ID NO: 711388 - DNA, 20 bp, Artificial
  CRISPR gRNA sequence
gggtacaatgtatgctattt

SEQ ID NO: 711389 - DNA, 20 bp, Artificial
  CRISPR gRNA sequence
acaatgtatgctatttgggt

SEQ ID NO: 711390 - DNA, 20 bp, Artificial
  CRISPR gRNA sequence
caatgtatgctatttgggtg

SEQ ID NO: 711391 - DNA, 20 bp, Artificial
  CRISPR gRNA sequence
aatgtatgctatttgggtga

SEQ ID NO: 711392 - DNA, 20 bp, Artificial
  CRISPR gRNA sequence
agggataccctaaacgtcct

SEQ ID NO: 711393 - DNA, 20 bp, Artificial
  CRISPR gRNA sequence
ctgagttcaccacccaatct

SEQ ID NO: 711394 - DNA, 20 bp, Artificial
  CRISPR gRNA sequence
tgcaaacaaaataaaatcct

SEQ ID NO: 711395 - DNA, 20 bp, Artificial
  CRISPR gRNA sequence
gcaaacaaaataaaatccta

SEQ ID NO: 711396 - DNA, 20 bp, Artificial
  CRISPR gRNA sequence
aaggactctactgaatattc

SEQ ID NO: 711397 - DNA, 20 bp, Artificial
  CRISPR gRNA sequence
tactgaatattccagtcact

SEQ ID NO: 711398 - DNA, 20 bp, Artificial
  CRISPR gRNA sequence
tgaatattccagtcactgag

SEQ ID NO: 711399 - DNA, 20 bp, Artificial
  CRISPR gRNA sequence
gaatattccagtcactgagc

SEQ ID NO: 711400 - DNA, 20 bp, Artificial
  CRISPR gRNA sequence
aatattccagtcactgagcg

SEQ ID NO: 711401 - DNA, 20 bp, Artificial
  CRISPR gRNA sequence
ttccagtcactgagcgggga

SEQ ID NO: 711402 - DNA, 20 bp, Artificial
  CRISPR gRNA sequence
gacagtttcttctgctgtgt

SEQ ID NO: 711403 - DNA, 20 bp, Artificial
  CRISPR gRNA sequence
ttagtatgtcctgttcacaa

SEQ ID NO: 711404 - DNA, 20 bp, Artificial
  CRISPR gRNA sequence
tagtatgtcctgttcacaat

SEQ ID NO: 711405 - DNA, 20 bp, Artificial
  CRISPR gRNA sequence
tcacaatgggtctcttccct

SEQ ID NO: 711406 - DNA, 20 bp, Artificial
  CRISPR gRNA sequence
caatgggtctcttccctgag

SEQ ID NO: 711407 - DNA, 20 bp, Artificial
  CRISPR gRNA sequence
aatgggtctcttccctgagt

SEQ ID NO: 711408 - DNA, 20 bp, Artificial
  CRISPR gRNA sequence
gggtctcttccctgagtagg

SEQ ID NO: 711409 - DNA, 20 bp, Artificial
  CRISPR gRNA sequence
ctcttccctgagtaggaagt

SEQ ID NO: 711410 - DNA, 20 bp, Artificial
  CRISPR gRNA sequence
tccctgagtaggaagttggc

SEQ ID NO: 711411 - DNA, 20 bp, Artificial
  CRISPR gRNA sequence
ccctgagtaggaagttggcc

SEQ ID NO: 711412 - DNA, 20 bp, Artificial
  CRISPR gRNA sequence
cctgagtaggaagttggcca

SEQ ID NO: 711413 - DNA, 20 bp, Artificial
  CRISPR gRNA sequence
ggaagttggccagggaaccc

SEQ ID NO: 711414 - DNA, 20 bp, Artificial
  CRISPR gRNA sequence
gaagttggccagggaaccct

SEQ ID NO: 711415 - DNA, 20 bp, Artificial
  CRISPR gRNA sequence
gccagggaaccctgggccca

SEQ ID NO: 711416 - DNA, 20 bp, Artificial
  CRISPR gRNA sequence
ccagggaaccctgggcccat

SEQ ID NO: 711417 - DNA, 20 bp, Artificial
  CRISPR gRNA sequence
gggaaccctgggcccatggg

SEQ ID NO: 711418 - DNA, 20 bp, Artificial
  CRISPR gRNA sequence
gaaccctgggcccatgggcg

SEQ ID NO: 711419 - DNA, 20 bp, Artificial
  CRISPR gRNA sequence
accctgggcccatgggcgga

SEQ ID NO: 711420 - DNA, 20 bp, Artificial
  CRISPR gRNA sequence
ggcccatgggcggagagtgt

SEQ ID NO: 711421 - DNA, 20 bp, Artificial
  CRISPR gRNA sequence
catgggcggagagtgtgagc

SEQ ID NO: 711422 - DNA, 20 bp, Artificial
  CRISPR gRNA sequence
gggcggagagtgtgagctgg

SEQ ID NO: 711423 - DNA, 20 bp, Artificial
  CRISPR gRNA sequence
tgagctggcagcctccattt

SEQ ID NO: 711424 - DNA, 20 bp, Artificial
  CRISPR gRNA sequence
gagctggcagcctccatttc

SEQ ID NO: 711425 - DNA, 20 bp, Artificial
  CRISPR gRNA sequence
agctggcagcctccatttca

SEQ ID NO: 711426 - DNA, 20 bp, Artificial
  CRISPR gRNA sequence
cagcctccatttcagggtga

SEQ ID NO: 711427 - DNA, 20 bp, Artificial
  CRISPR gRNA sequence
agcctccatttcagggtgat

SEQ ID NO: 711428 - DNA, 20 bp, Artificial
  CRISPR gRNA sequence
gcctccatttcagggtgatg

SEQ ID NO: 711429 - DNA, 20 bp, Artificial
  CRISPR gRNA sequence
catttcagggtgatggggtg

SEQ ID NO: 711430 - DNA, 20 bp, Artificial
  CRISPR gRNA sequence
tcagggtgatggggtgtggc

SEQ ID NO: 711431 - DNA, 20 bp, Artificial
  CRISPR gRNA sequence
gggtgtggctagcctgttga

SEQ ID NO: 711432 - DNA, 20 bp, Artificial
  CRISPR gRNA sequence
ggtgtggctagcctgttgac

SEQ ID NO: 711433 - DNA, 20 bp, Artificial
  CRISPR gRNA sequence
aggtgcacttccaaataccc

SEQ ID NO: 711434 - DNA, 20 bp, Artificial
  CRISPR gRNA sequence
cacttccaaatacccaagta

SEQ ID NO: 711435 - DNA, 20 bp, Artificial
  CRISPR gRNA sequence
cttccaaatacccaagtaaa

SEQ ID NO: 711436 - DNA, 20 bp, Artificial
  CRISPR gRNA sequence
ttccaaatacccaagtaaag

SEQ ID NO: 711437 - DNA, 20 bp, Artificial
  CRISPR gRNA sequence
tccaaatacccaagtaaaga

SEQ ID NO: 711438 - DNA, 20 bp, Artificial
  CRISPR gRNA sequence
agtaaagagggctttacaaa

SEQ ID NO: 711439 - DNA, 20 bp, Artificial
  CRISPR gRNA sequence
taaagagggctttacaaaca

SEQ ID NO: 711440 - DNA, 20 bp, Artificial
  CRISPR gRNA sequence
gggctttacaaacagagtga

SEQ ID NO: 711441 - DNA, 20 bp, Artificial
  CRISPR gRNA sequence
acagagtgacagcaccccac

SEQ ID NO: 711442 - DNA, 20 bp, Artificial
  CRISPR gRNA sequence
gagtgacagcaccccactag

SEQ ID NO: 711443 - DNA, 20 bp, Artificial
  CRISPR gRNA sequence
ctagtggcccgaactttccc

SEQ ID NO: 711444 - DNA, 20 bp, Artificial
  CRISPR gRNA sequence
ttccttcaatgttctgactc

SEQ ID NO: 711445 - DNA, 20 bp, Artificial
  CRISPR gRNA sequence
cttcaatgttctgactcaag

SEQ ID NO: 711446 - DNA, 20 bp, Artificial
  CRISPR gRNA sequence
tgactcaagaagacaattgt

SEQ ID NO: 711447 - DNA, 20 bp, Artificial
  CRISPR gRNA sequence
tcaagaagacaattgttggc

SEQ ID NO: 711448 - DNA, 20 bp, Artificial
  CRISPR gRNA sequence
caagaagacaattgttggcc

SEQ ID NO: 711449 - DNA, 20 bp, Artificial
  CRISPR gRNA sequence
agacaattgttggccaggca

SEQ ID NO: 711450 - DNA, 20 bp, Artificial
  CRISPR gRNA sequence
caattgttggccaggcacgg

SEQ ID NO: 711451 - DNA, 20 bp, Artificial
  CRISPR gRNA sequence
gtggctcacacctgtaatcc

SEQ ID NO: 711452 - DNA, 20 bp, Artificial
  CRISPR gRNA sequence
cacctgtaatcccagcactt

SEQ ID NO: 711453 - DNA, 20 bp, Artificial
  CRISPR gRNA sequence
acctgtaatcccagcacttt

SEQ ID NO: 711454 - DNA, 20 bp, Artificial
  CRISPR gRNA sequence
ctgtaatcccagcactttgg

SEQ ID NO: 711455 - DNA, 20 bp, Artificial
  CRISPR gRNA sequence
tgtaatcccagcactttggg

SEQ ID NO: 711456 - DNA, 20 bp, Artificial
  CRISPR gRNA sequence
aatcccagcactttgggagg

SEQ ID NO: 711457 - DNA, 20 bp, Artificial
  CRISPR gRNA sequence
tcccagcactttgggaggtg

SEQ ID NO: 711458 - DNA, 20 bp, Artificial
  CRISPR gRNA sequence
cccagcactttgggaggtgg

SEQ ID NO: 711459 - DNA, 20 bp, Artificial
  CRISPR gRNA sequence
agcactttgggaggtggagg

SEQ ID NO: 711460 - DNA, 20 bp, Artificial
  CRISPR gRNA sequence
gcactttgggaggtggaggc

SEQ ID NO: 711461 - DNA, 20 bp, Artificial
  CRISPR gRNA sequence
ctttgggaggtggaggcggg

SEQ ID NO: 711462 - DNA, 20 bp, Artificial
  CRISPR gRNA sequence
tggaggcgggcagatcactt

SEQ ID NO: 711463 - DNA, 20 bp, Artificial
  CRISPR gRNA sequence
ggaggcgggcagatcacttg

SEQ ID NO: 711464 - DNA, 20 bp, Artificial
  CRISPR gRNA sequence
gcgggcagatcacttgaggt

SEQ ID NO: 711465 - DNA, 20 bp, Artificial
  CRISPR gRNA sequence
cgggcagatcacttgaggtc

SEQ ID NO: 711466 - DNA, 20 bp, Artificial
  CRISPR gRNA sequence
ggcagatcacttgaggtcag

SEQ ID NO: 711467 - DNA, 20 bp, Artificial
  CRISPR gRNA sequence
tcacttgaggtcaggagttc

SEQ ID NO: 711468 - DNA, 20 bp, Artificial
  CRISPR gRNA sequence
tgaggtcaggagttccagac

SEQ ID NO: 711469 - DNA, 20 bp, Artificial
  CRISPR gRNA sequence
tcaggagttccagaccagcc

SEQ ID NO: 711470 - DNA, 20 bp, Artificial
  CRISPR gRNA sequence
ccagaccagcctggccaaca

SEQ ID NO: 711471 - DNA, 20 bp, Artificial
  CRISPR gRNA sequence
tctactaaaaatatgaaaat

SEQ ID NO: 711472 - DNA, 20 bp, Artificial
  CRISPR gRNA sequence
ctaaaaatatgaaaattagc

SEQ ID NO: 711473 - DNA, 20 bp, Artificial
  CRISPR gRNA sequence
taaaaatatgaaaattagct

SEQ ID NO: 711474 - DNA, 20 bp, Artificial
  CRISPR gRNA sequence
atatgaaaattagctgggtg

SEQ ID NO: 711475 - DNA, 20 bp, Artificial
  CRISPR gRNA sequence
tgaaaattagctgggtgtgg

SEQ ID NO: 711476 - DNA, 20 bp, Artificial
  CRISPR gRNA sequence
aaattagctgggtgtggtgg

SEQ ID NO: 711477 - DNA, 20 bp, Artificial
  CRISPR gRNA sequence
aattagctgggtgtggtggc

SEQ ID NO: 711478 - DNA, 20 bp, Artificial
  CRISPR gRNA sequence
gtggcgggcacctgtaatcc

SEQ ID NO: 711479 - DNA, 20 bp, Artificial
  CRISPR gRNA sequence
cacctgtaatcccagctact

SEQ ID NO: 711480 - DNA, 20 bp, Artificial
  CRISPR gRNA sequence
acctgtaatcccagctactc

SEQ ID NO: 711481 - DNA, 20 bp, Artificial
  CRISPR gRNA sequence
ctgtaatcccagctactcgg

SEQ ID NO: 711482 - DNA, 20 bp, Artificial
  CRISPR gRNA sequence
tgtaatcccagctactcggg

SEQ ID NO: 711483 - DNA, 20 bp, Artificial
  CRISPR gRNA sequence
tcccagctactcgggaggct

SEQ ID NO: 711484 - DNA, 20 bp, Artificial
  CRISPR gRNA sequence
cccagctactcgggaggctg

SEQ ID NO: 711485 - DNA, 20 bp, Artificial
  CRISPR gRNA sequence
agctactcgggaggctgagg

SEQ ID NO: 711486 - DNA, 20 bp, Artificial
  CRISPR gRNA sequence
gctactcgggaggctgaggc

SEQ ID NO: 711487 - DNA, 20 bp, Artificial
  CRISPR gRNA sequence
tactcgggaggctgaggcag

SEQ ID NO: 711488 - DNA, 20 bp, Artificial
  CRISPR gRNA sequence
gcaggagaattgcctgaacc

SEQ ID NO: 711489 - DNA, 20 bp, Artificial
  CRISPR gRNA sequence
caggagaattgcctgaaccc

SEQ ID NO: 711490 - DNA, 20 bp, Artificial
  CRISPR gRNA sequence
ggagaattgcctgaacccgg

SEQ ID NO: 711491 - DNA, 20 bp, Artificial
  CRISPR gRNA sequence
aattgcctgaacccgggaga

SEQ ID NO: 711492 - DNA, 20 bp, Artificial
  CRISPR gRNA sequence
ttgcctgaacccgggagacg

SEQ ID NO: 711493 - DNA, 20 bp, Artificial
  CRISPR gRNA sequence
tgcctgaacccgggagacgg

SEQ ID NO: 711494 - DNA, 20 bp, Artificial
  CRISPR gRNA sequence
aacccgggagacggaggttg

SEQ ID NO: 711495 - DNA, 20 bp, Artificial
  CRISPR gRNA sequence
cgggagacggaggttgcagt

SEQ ID NO: 711496 - DNA, 20 bp, Artificial
  CRISPR gRNA sequence
gacggaggttgcagtgagct

SEQ ID NO: 711497 - DNA, 20 bp, Artificial
  CRISPR gRNA sequence
gagattacaccactgcacat

SEQ ID NO: 711498 - DNA, 20 bp, Artificial
  CRISPR gRNA sequence
tacaccactgcacatcggcc

SEQ ID NO: 711499 - DNA, 20 bp, Artificial
  CRISPR gRNA sequence
acaccactgcacatcggcct

SEQ ID NO: 711500 - DNA, 20 bp, Artificial
  CRISPR gRNA sequence
cactgcacatcggcctgggc

SEQ ID NO: 711501 - DNA, 20 bp, Artificial
  CRISPR gRNA sequence
gcacatcggcctgggcaaga

SEQ ID NO: 711502 - DNA, 20 bp, Artificial
  CRISPR gRNA sequence
atcggcctgggcaagacagc

SEQ ID NO: 711503 - DNA, 20 bp, Artificial
  CRISPR gRNA sequence
cgagactccatctctaaaaa

SEQ ID NO: 711504 - DNA, 20 bp, Artificial
  CRISPR gRNA sequence
agactccatctctaaaaaaa

SEQ ID NO: 711505 - DNA, 20 bp, Artificial
  CRISPR gRNA sequence
gactccatctctaaaaaaag

SEQ ID NO: 711506 - DNA, 20 bp, Artificial
  CRISPR gRNA sequence
ctaaaaaaagaggaaaaaaa

SEQ ID NO: 711507 - DNA, 20 bp, Artificial
  CRISPR gRNA sequence
aggaaaaaaaaagacaatac

SEQ ID NO: 711508 - DNA, 20 bp, Artificial
  CRISPR gRNA sequence
ggaaaaaaaaagacaatact

SEQ ID NO: 711509 - DNA, 20 bp, Artificial
  CRISPR gRNA sequence
gaaaaaaaaagacaatactg

SEQ ID NO: 711510 - DNA, 20 bp, Artificial
  CRISPR gRNA sequence
aatactggggattaaaaact

SEQ ID NO: 711511 - DNA, 20 bp, Artificial
  CRISPR gRNA sequence
atactggggattaaaaactc

SEQ ID NO: 711512 - DNA, 20 bp, Artificial
  CRISPR gRNA sequence
caggcatcatctgtgcaaac

SEQ ID NO: 711513 - DNA, 20 bp, Artificial
  CRISPR gRNA sequence
catcatctgtgcaaactggt

SEQ ID NO: 711514 - DNA, 20 bp, Artificial
  CRISPR gRNA sequence
catctgtgcaaactggtcag

SEQ ID NO: 711515 - DNA, 20 bp, Artificial
  CRISPR gRNA sequence
tgccattgtaatacattttg

SEQ ID NO: 711516 - DNA, 20 bp, Artificial
  CRISPR gRNA sequence
acattttgaagttgtgtttg

SEQ ID NO: 711517 - DNA, 20 bp, Artificial
  CRISPR gRNA sequence
tgaagttgtgtttgaagatt

SEQ ID NO: 711518 - DNA, 20 bp, Artificial
  CRISPR gRNA sequence
agttgtgtttgaagatttag

SEQ ID NO: 711519 - DNA, 20 bp, Artificial
  CRISPR gRNA sequence
gtttgaagatttagtagtcc

SEQ ID NO: 711520 - DNA, 20 bp, Artificial
  CRISPR gRNA sequence
tttgaagatttagtagtccc

SEQ ID NO: 711521 - DNA, 20 bp, Artificial
  CRISPR gRNA sequence
ttcatctgcctgcctcttcc

SEQ ID NO: 711522 - DNA, 20 bp, Artificial
  CRISPR gRNA sequence
ctgcctgcctcttccaagcc

SEQ ID NO: 711523 - DNA, 20 bp, Artificial
  CRISPR gRNA sequence
gcctgcctcttccaagccca

SEQ ID NO: 711524 - DNA, 20 bp, Artificial
  CRISPR gRNA sequence
ttccaagcccagagcctctc

SEQ ID NO: 711525 - DNA, 20 bp, Artificial
  CRISPR gRNA sequence
tccaagcccagagcctctct

SEQ ID NO: 711526 - DNA, 20 bp, Artificial
  CRISPR gRNA sequence
ccaagcccagagcctctctg

SEQ ID NO: 711527 - DNA, 20 bp, Artificial
  CRISPR gRNA sequence
caagcccagagcctctctgg

SEQ ID NO: 711528 - DNA, 20 bp, Artificial
  CRISPR gRNA sequence
cagagcctctctgggggtcc

SEQ ID NO: 711529 - DNA, 20 bp, Artificial
  CRISPR gRNA sequence
agcctctctgggggtcctag

SEQ ID NO: 711530 - DNA, 20 bp, Artificial
  CRISPR gRNA sequence
tctctgggggtcctagaagc

SEQ ID NO: 711531 - DNA, 20 bp, Artificial
  CRISPR gRNA sequence
caagtcacccctcacttctc

SEQ ID NO: 711532 - DNA, 20 bp, Artificial
  CRISPR gRNA sequence
gtcacccctcacttctctgg

SEQ ID NO: 711533 - DNA, 20 bp, Artificial
  CRISPR gRNA sequence
cacttctctggcagccctca

SEQ ID NO: 711534 - DNA, 20 bp, Artificial
  CRISPR gRNA sequence
cttctctggcagccctcaca

SEQ ID NO: 711535 - DNA, 20 bp, Artificial
  CRISPR gRNA sequence
cagccctcacagagtcacat

SEQ ID NO: 711536 - DNA, 20 bp, Artificial
  CRISPR gRNA sequence
agccctcacagagtcacatt

SEQ ID NO: 711537 - DNA, 20 bp, Artificial
  CRISPR gRNA sequence
tgggtgaccttccctccact

SEQ ID NO: 711538 - DNA, 20 bp, Artificial
  CRISPR gRNA sequence
acttggttttttttcttttt

SEQ ID NO: 711539 - DNA, 20 bp, Artificial
  CRISPR gRNA sequence
cttggttttttttctttttt

SEQ ID NO: 711540 - DNA, 20 bp, Artificial
  CRISPR gRNA sequence
ggttttttttcttttttagg

SEQ ID NO: 711541 - DNA, 20 bp, Artificial
  CRISPR gRNA sequence
ttttttttcttttttaggca

SEQ ID NO: 711542 - DNA, 20 bp, Artificial
  CRISPR gRNA sequence
cagagtttcgccctgttgcc

SEQ ID NO: 711543 - DNA, 20 bp, Artificial
  CRISPR gRNA sequence
agagtttcgccctgttgccc

SEQ ID NO: 711544 - DNA, 20 bp, Artificial
  CRISPR gRNA sequence
tttcgccctgttgcccaggc

SEQ ID NO: 711545 - DNA, 20 bp, Artificial
  CRISPR gRNA sequence
tcgccctgttgcccaggctg

SEQ ID NO: 711546 - DNA, 20 bp, Artificial
  CRISPR gRNA sequence
ctgttgcccaggctggagtt

SEQ ID NO: 711547 - DNA, 20 bp, Artificial
  CRISPR gRNA sequence
ttgcccaggctggagttcag

SEQ ID NO: 711548 - DNA, 20 bp, Artificial
  CRISPR gRNA sequence
ggagttcagtggtgcaatct

SEQ ID NO: 711549 - DNA, 20 bp, Artificial
  CRISPR gRNA sequence
tcactgcaacctatgcctcc

SEQ ID NO: 711550 - DNA, 20 bp, Artificial
  CRISPR gRNA sequence
cactgcaacctatgcctccc

SEQ ID NO: 711551 - DNA, 20 bp, Artificial
  CRISPR gRNA sequence
aacctatgcctcccgggttc

SEQ ID NO: 711552 - DNA, 20 bp, Artificial
  CRISPR gRNA sequence
ttctcctgcctcaacctcct

SEQ ID NO: 711553 - DNA, 20 bp, Artificial
  CRISPR gRNA sequence
tcctgcctcaacctcctgag

SEQ ID NO: 711554 - DNA, 20 bp, Artificial
  CRISPR gRNA sequence
gcctcaacctcctgagtagc

SEQ ID NO: 711555 - DNA, 20 bp, Artificial
  CRISPR gRNA sequence
cctcaacctcctgagtagct

SEQ ID NO: 711556 - DNA, 20 bp, Artificial
  CRISPR gRNA sequence
ctcctgagtagctgggacta

SEQ ID NO: 711557 - DNA, 20 bp, Artificial
  CRISPR gRNA sequence
acggtgcccaccaccacacc

SEQ ID NO: 711558 - DNA, 20 bp, Artificial
  CRISPR gRNA sequence
ccagctaatttgtgtatttt

SEQ ID NO: 711559 - DNA, 20 bp, Artificial
  CRISPR gRNA sequence
gctaatttgtgtatttttag

SEQ ID NO: 711560 - DNA, 20 bp, Artificial
  CRISPR gRNA sequence
taatttgtgtatttttagta

SEQ ID NO: 711561 - DNA, 20 bp, Artificial
  CRISPR gRNA sequence
ttgtgtatttttagtagaga

SEQ ID NO: 711562 - DNA, 20 bp, Artificial
  CRISPR gRNA sequence
tgtgtatttttagtagagac

SEQ ID NO: 711563 - DNA, 20 bp, Artificial
  CRISPR gRNA sequence
gtgtatttttagtagagacg

SEQ ID NO: 711564 - DNA, 20 bp, Artificial
  CRISPR gRNA sequence
gagacggggttttgccatgt

SEQ ID NO: 711565 - DNA, 20 bp, Artificial
  CRISPR gRNA sequence
cggggttttgccatgttggt

SEQ ID NO: 711566 - DNA, 20 bp, Artificial
  CRISPR gRNA sequence
ggggttttgccatgttggtc

SEQ ID NO: 711567 - DNA, 20 bp, Artificial
  CRISPR gRNA sequence
ttttgccatgttggtcaggc

SEQ ID NO: 711568 - DNA, 20 bp, Artificial
  CRISPR gRNA sequence
ggtcttgaactcctgacctc

SEQ ID NO: 711569 - DNA, 20 bp, Artificial
  CRISPR gRNA sequence
ctcaagtgatccacctgcct

SEQ ID NO: 711570 - DNA, 20 bp, Artificial
  CRISPR gRNA sequence
ccacctgcctcagcctccca

SEQ ID NO: 711571 - DNA, 20 bp, Artificial
  CRISPR gRNA sequence
gcctcagcctcccaaagtgc

SEQ ID NO: 711572 - DNA, 20 bp, Artificial
  CRISPR gRNA sequence
cctcagcctcccaaagtgct

SEQ ID NO: 711573 - DNA, 20 bp, Artificial
  CRISPR gRNA sequence
ctcccaaagtgctgggatca

SEQ ID NO: 711574 - DNA, 20 bp, Artificial
  CRISPR gRNA sequence
tcccaaagtgctgggatcac

SEQ ID NO: 711575 - DNA, 20 bp, Artificial
  CRISPR gRNA sequence
agtgctgggatcacaggcgt

SEQ ID NO: 711576 - DNA, 20 bp, Artificial
  CRISPR gRNA sequence
caggcgtgagccaccacgcc

SEQ ID NO: 711577 - DNA, 20 bp, Artificial
  CRISPR gRNA sequence
ccacgcctggccattcccct

SEQ ID NO: 711578 - DNA, 20 bp, Artificial
  CRISPR gRNA sequence
tccatctgttttaaaccacc

SEQ ID NO: 711579 - DNA, 20 bp, Artificial
  CRISPR gRNA sequence
catctgttttaaaccacctg

SEQ ID NO: 711580 - DNA, 20 bp, Artificial
  CRISPR gRNA sequence
agatttgttaaaatctctca

SEQ ID NO: 711581 - DNA, 20 bp, Artificial
  CRISPR gRNA sequence
caacaacaacaaaaaactgt

SEQ ID NO: 711582 - DNA, 20 bp, Artificial
  CRISPR gRNA sequence
aacaacaacaaaaaactgtc

SEQ ID NO: 711583 - DNA, 20 bp, Artificial
  CRISPR gRNA sequence
acaacaacaaaaaactgtca

SEQ ID NO: 711584 - DNA, 20 bp, Artificial
  CRISPR gRNA sequence
acaaaaaactgtcagggttt

SEQ ID NO: 711585 - DNA, 20 bp, Artificial
  CRISPR gRNA sequence
ggttttagtttcctgcacac

SEQ ID NO: 711586 - DNA, 20 bp, Artificial
  CRISPR gRNA sequence
tagtttcctgcacactggta

SEQ ID NO: 711587 - DNA, 20 bp, Artificial
  CRISPR gRNA sequence
ggtaaagccaaccgtcctgt

SEQ ID NO: 711588 - DNA, 20 bp, Artificial
  CRISPR gRNA sequence
cgtcctgttagaaatctctt

SEQ ID NO: 711589 - DNA, 20 bp, Artificial
  CRISPR gRNA sequence
aacttgatattcatctctct

SEQ ID NO: 711590 - DNA, 20 bp, Artificial
  CRISPR gRNA sequence
atctctctaagtcaataaaa

SEQ ID NO: 711591 - DNA, 20 bp, Artificial
  CRISPR gRNA sequence
caataaaacagccttgcaaa

SEQ ID NO: 711592 - DNA, 20 bp, Artificial
  CRISPR gRNA sequence
aataaaacagccttgcaaac

SEQ ID NO: 711593 - DNA, 20 bp, Artificial
  CRISPR gRNA sequence
aacagccttgcaaacaggtc

SEQ ID NO: 711594 - DNA, 20 bp, Artificial
  CRISPR gRNA sequence
caaacaggtcaagattttac

SEQ ID NO: 711595 - DNA, 20 bp, Artificial
  CRISPR gRNA sequence
aggtcaagattttaccagcc

SEQ ID NO: 711596 - DNA, 20 bp, Artificial
  CRISPR gRNA sequence
ggtcaagattttaccagccc

SEQ ID NO: 711597 - DNA, 20 bp, Artificial
  CRISPR gRNA sequence
gtcaagattttaccagcccg

SEQ ID NO: 711598 - DNA, 20 bp, Artificial
  CRISPR gRNA sequence
agattttaccagcccggggc

SEQ ID NO: 711599 - DNA, 20 bp, Artificial
  CRISPR gRNA sequence
gattttaccagcccggggct

SEQ ID NO: 711600 - DNA, 20 bp, Artificial
  CRISPR gRNA sequence
taccagcccggggctgggca

SEQ ID NO: 711601 - DNA, 20 bp, Artificial
  CRISPR gRNA sequence
cagcccggggctgggcatgg

SEQ ID NO: 711602 - DNA, 20 bp, Artificial
  CRISPR gRNA sequence
cggggctgggcatggtggct

SEQ ID NO: 711603 - DNA, 20 bp, Artificial
  CRISPR gRNA sequence
ggggctgggcatggtggctc

SEQ ID NO: 711604 - DNA, 20 bp, Artificial
  CRISPR gRNA sequence
gtggctcaggcctgtaatcc

SEQ ID NO: 711605 - DNA, 20 bp, Artificial
  CRISPR gRNA sequence
gcctgtaatcccagcacttt

SEQ ID NO: 711606 - DNA, 20 bp, Artificial
  CRISPR gRNA sequence
ctgtaatcccagcactttga

SEQ ID NO: 711607 - DNA, 20 bp, Artificial
  CRISPR gRNA sequence
tgtaatcccagcactttgag

SEQ ID NO: 711608 - DNA, 20 bp, Artificial
  CRISPR gRNA sequence
tcccagcactttgagaggcc

SEQ ID NO: 711609 - DNA, 20 bp, Artificial
  CRISPR gRNA sequence
cccagcactttgagaggcca

SEQ ID NO: 711610 - DNA, 20 bp, Artificial
  CRISPR gRNA sequence
agcactttgagaggccaagg

SEQ ID NO: 711611 - DNA, 20 bp, Artificial
  CRISPR gRNA sequence
gcactttgagaggccaaggt

SEQ ID NO: 711612 - DNA, 20 bp, Artificial
  CRISPR gRNA sequence
ctttgagaggccaaggtggg

SEQ ID NO: 711613 - DNA, 20 bp, Artificial
  CRISPR gRNA sequence
ccaaggtgggtggatcacct

SEQ ID NO: 711614 - DNA, 20 bp, Artificial
  CRISPR gRNA sequence
caaggtgggtggatcacctg

SEQ ID NO: 711615 - DNA, 20 bp, Artificial
  CRISPR gRNA sequence
gtgggtggatcacctgaggt

SEQ ID NO: 711616 - DNA, 20 bp, Artificial
  CRISPR gRNA sequence
tgggtggatcacctgaggtc

SEQ ID NO: 711617 - DNA, 20 bp, Artificial
  CRISPR gRNA sequence
ggtggatcacctgaggtcgg

SEQ ID NO: 711618 - DNA, 20 bp, Artificial
  CRISPR gRNA sequence
tcacctgaggtcgggagttc

SEQ ID NO: 711619 - DNA, 20 bp, Artificial
  CRISPR gRNA sequence
tgaggtcgggagttcgagac

SEQ ID NO: 711620 - DNA, 20 bp, Artificial
  CRISPR gRNA sequence
cgagaccagcctgaccaaca

SEQ ID NO: 711621 - DNA, 20 bp, Artificial
  CRISPR gRNA sequence
agaccagcctgaccaacatg

SEQ ID NO: 711622 - DNA, 20 bp, Artificial
  CRISPR gRNA sequence
ctcttctaaaaatacaacat

SEQ ID NO: 711623 - DNA, 20 bp, Artificial
  CRISPR gRNA sequence
tctaaaaatacaacattagc

SEQ ID NO: 711624 - DNA, 20 bp, Artificial
  CRISPR gRNA sequence
aatacaacattagccggctg

SEQ ID NO: 711625 - DNA, 20 bp, Artificial
  CRISPR gRNA sequence
acaacattagccggctgtgg

SEQ ID NO: 711626 - DNA, 20 bp, Artificial
  CRISPR gRNA sequence
gtggcgaatgcttgtaaccc

SEQ ID NO: 711627 - DNA, 20 bp, Artificial
  CRISPR gRNA sequence
tgcttgtaaccccagctact

SEQ ID NO: 711628 - DNA, 20 bp, Artificial
  CRISPR gRNA sequence
ttgtaaccccagctactcag

SEQ ID NO: 711629 - DNA, 20 bp, Artificial
  CRISPR gRNA sequence
tgtaaccccagctactcaga

SEQ ID NO: 711630 - DNA, 20 bp, Artificial
  CRISPR gRNA sequence
ccccagctactcagaaggct

SEQ ID NO: 711631 - DNA, 20 bp, Artificial
  CRISPR gRNA sequence
cccagctactcagaaggctg

SEQ ID NO: 711632 - DNA, 20 bp, Artificial
  CRISPR gRNA sequence
agctactcagaaggctgagg

SEQ ID NO: 711633 - DNA, 20 bp, Artificial
  CRISPR gRNA sequence
gctactcagaaggctgaggc

SEQ ID NO: 711634 - DNA, 20 bp, Artificial
  CRISPR gRNA sequence
tactcagaaggctgaggcag

SEQ ID NO: 711635 - DNA, 20 bp, Artificial
  CRISPR gRNA sequence
gcaggagaattgcttgaacc

SEQ ID NO: 711636 - DNA, 20 bp, Artificial
  CRISPR gRNA sequence
caggagaattgcttgaaccc

SEQ ID NO: 711637 - DNA, 20 bp, Artificial
  CRISPR gRNA sequence
ggagaattgcttgaacccag

SEQ ID NO: 711638 - DNA, 20 bp, Artificial
  CRISPR gRNA sequence
gagaattgcttgaacccagg

SEQ ID NO: 711639 - DNA, 20 bp, Artificial
  CRISPR gRNA sequence
ttgcttgaacccaggaggtg

SEQ ID NO: 711640 - DNA, 20 bp, Artificial
  CRISPR gRNA sequence
tgcttgaacccaggaggtgc

SEQ ID NO: 711641 - DNA, 20 bp, Artificial
  CRISPR gRNA sequence
aacccaggaggtgcaggttg

SEQ ID NO: 711642 - DNA, 20 bp, Artificial
  CRISPR gRNA sequence
caggaggtgcaggttgcggt

SEQ ID NO: 711643 - DNA, 20 bp, Artificial
  CRISPR gRNA sequence
ggtgcaggttgcggtgagcc

SEQ ID NO: 711644 - DNA, 20 bp, Artificial
  CRISPR gRNA sequence
ggttgcggtgagccgagatt

SEQ ID NO: 711645 - DNA, 20 bp, Artificial
  CRISPR gRNA sequence
gagattgagccattgtactc

SEQ ID NO: 711646 - DNA, 20 bp, Artificial
  CRISPR gRNA sequence
tgagccattgtactccagcc

SEQ ID NO: 711647 - DNA, 20 bp, Artificial
  CRISPR gRNA sequence
gagccattgtactccagcct

SEQ ID NO: 711648 - DNA, 20 bp, Artificial
  CRISPR gRNA sequence
tactccagcctgggcaacat

SEQ ID NO: 711649 - DNA, 20 bp, Artificial
  CRISPR gRNA sequence
aactccatctcaaaaatata

SEQ ID NO: 711650 - DNA, 20 bp, Artificial
  CRISPR gRNA sequence
caaaaatataaagattttac

SEQ ID NO: 711651 - DNA, 20 bp, Artificial
  CRISPR gRNA sequence
ttttaccagcccaataattt

SEQ ID NO: 711652 - DNA, 20 bp, Artificial
  CRISPR gRNA sequence
tttaccagcccaataatttc

SEQ ID NO: 711653 - DNA, 20 bp, Artificial
  CRISPR gRNA sequence
accagcccaataatttcagg

SEQ ID NO: 711654 - DNA, 20 bp, Artificial
  CRISPR gRNA sequence
aagaatttttttttaatcaa

SEQ ID NO: 711655 - DNA, 20 bp, Artificial
  CRISPR gRNA sequence
tcttgccaaaatgctaaaac

SEQ ID NO: 711656 - DNA, 20 bp, Artificial
  CRISPR gRNA sequence
attttatcattccattcact

SEQ ID NO: 711657 - DNA, 20 bp, Artificial
  CRISPR gRNA sequence
tcactgagtctgactactca

SEQ ID NO: 711658 - DNA, 20 bp, Artificial
  CRISPR gRNA sequence
cactgagtctgactactcaa

SEQ ID NO: 711659 - DNA, 20 bp, Artificial
  CRISPR gRNA sequence
ctgactactcaaaggataac

SEQ ID NO: 711660 - DNA, 20 bp, Artificial
  CRISPR gRNA sequence
cccaaacctgacctaatgaa

SEQ ID NO: 711661 - DNA, 20 bp, Artificial
  CRISPR gRNA sequence
acctgacctaatgaacagcc

SEQ ID NO: 711662 - DNA, 20 bp, Artificial
  CRISPR gRNA sequence
cctgacctaatgaacagccg

SEQ ID NO: 711663 - DNA, 20 bp, Artificial
  CRISPR gRNA sequence
ctgacctaatgaacagccga

SEQ ID NO: 711664 - DNA, 20 bp, Artificial
  CRISPR gRNA sequence
ctaatgaacagccgagggtg

SEQ ID NO: 711665 - DNA, 20 bp, Artificial
  CRISPR gRNA sequence
taatgaacagccgagggtgt

SEQ ID NO: 711666 - DNA, 20 bp, Artificial
  CRISPR gRNA sequence
aggtcatttgcctccacccc

SEQ ID NO: 711667 - DNA, 20 bp, Artificial
  CRISPR gRNA sequence
ttgcctccacccctggctgt

SEQ ID NO: 711668 - DNA, 20 bp, Artificial
  CRISPR gRNA sequence
cctccacccctggctgttgg

SEQ ID NO: 711669 - DNA, 20 bp, Artificial
  CRISPR gRNA sequence
ctccacccctggctgttggt

SEQ ID NO: 711670 - DNA, 20 bp, Artificial
  CRISPR gRNA sequence
tccacccctggctgttggtg

SEQ ID NO: 711671 - DNA, 20 bp, Artificial
  CRISPR gRNA sequence
cacccctggctgttggtggg

SEQ ID NO: 711672 - DNA, 20 bp, Artificial
  CRISPR gRNA sequence
cccctggctgttggtgggga

SEQ ID NO: 711673 - DNA, 20 bp, Artificial
  CRISPR gRNA sequence
ccctggctgttggtggggag

SEQ ID NO: 711674 - DNA, 20 bp, Artificial
  CRISPR gRNA sequence
gttggtggggagaggcacaa

SEQ ID NO: 711675 - DNA, 20 bp, Artificial
  CRISPR gRNA sequence
ggtggggagaggcacaacag

SEQ ID NO: 711676 - DNA, 20 bp, Artificial
  CRISPR gRNA sequence
gtggggagaggcacaacagt

SEQ ID NO: 711677 - DNA, 20 bp, Artificial
  CRISPR gRNA sequence
tggggagaggcacaacagtg

SEQ ID NO: 711678 - DNA, 20 bp, Artificial
  CRISPR gRNA sequence
ggggagaggcacaacagtgg

SEQ ID NO: 711679 - DNA, 20 bp, Artificial
  CRISPR gRNA sequence
gaggcacaacagtgggggca

SEQ ID NO: 711680 - DNA, 20 bp, Artificial
  CRISPR gRNA sequence
ggggcacagactccaccctg

SEQ ID NO: 711681 - DNA, 20 bp, Artificial
  CRISPR gRNA sequence
acagactccaccctgtggtc

SEQ ID NO: 711682 - DNA, 20 bp, Artificial
  CRISPR gRNA sequence
cagactccaccctgtggtcg

SEQ ID NO: 711683 - DNA, 20 bp, Artificial
  CRISPR gRNA sequence
tccaccctgtggtcgaggcc

SEQ ID NO: 711684 - DNA, 20 bp, Artificial
  CRISPR gRNA sequence
ccaccctgtggtcgaggcct

SEQ ID NO: 711685 - DNA, 20 bp, Artificial
  CRISPR gRNA sequence
caccctgtggtcgaggcctg

SEQ ID NO: 711686 - DNA, 20 bp, Artificial
  CRISPR gRNA sequence
cctgtggtcgaggcctgggg

SEQ ID NO: 711687 - DNA, 20 bp, Artificial
  CRISPR gRNA sequence
ctgtggtcgaggcctggggt

SEQ ID NO: 711688 - DNA, 20 bp, Artificial
  CRISPR gRNA sequence
ggggtgggaactgcttaccc

SEQ ID NO: 711689 - DNA, 20 bp, Artificial
  CRISPR gRNA sequence
gggtgggaactgcttaccct

SEQ ID NO: 711690 - DNA, 20 bp, Artificial
  CRISPR gRNA sequence
ggtgggaactgcttaccctg

SEQ ID NO: 711691 - DNA, 20 bp, Artificial
  CRISPR gRNA sequence
gaactgcttaccctggggct

SEQ ID NO: 711692 - DNA, 20 bp, Artificial
  CRISPR gRNA sequence
tggtgaccgtctctgctgca

SEQ ID NO: 711693 - DNA, 20 bp, Artificial
  CRISPR gRNA sequence
accgtctctgctgcacagat

SEQ ID NO: 711694 - DNA, 20 bp, Artificial
  CRISPR gRNA sequence
ccgtctctgctgcacagatt

SEQ ID NO: 711695 - DNA, 20 bp, Artificial
  CRISPR gRNA sequence
tctctgctgcacagattggg

SEQ ID NO: 711696 - DNA, 20 bp, Artificial
  CRISPR gRNA sequence
ctctgctgcacagattgggt

SEQ ID NO: 711697 - DNA, 20 bp, Artificial
  CRISPR gRNA sequence
tctgctgcacagattgggta

SEQ ID NO: 711698 - DNA, 20 bp, Artificial
  CRISPR gRNA sequence
ctgctgcacagattgggtag

SEQ ID NO: 711699 - DNA, 20 bp, Artificial
  CRISPR gRNA sequence
cacagattgggtaggggaca

SEQ ID NO: 711700 - DNA, 20 bp, Artificial
  CRISPR gRNA sequence
agattgggtaggggacacag

SEQ ID NO: 711701 - DNA, 20 bp, Artificial
  CRISPR gRNA sequence
gattgggtaggggacacagc

SEQ ID NO: 711702 - DNA, 20 bp, Artificial
  CRISPR gRNA sequence
ggtaggggacacagcgggca

SEQ ID NO: 711703 - DNA, 20 bp, Artificial
  CRISPR gRNA sequence
gtaggggacacagcgggcac

SEQ ID NO: 711704 - DNA, 20 bp, Artificial
  CRISPR gRNA sequence
aggggacacagcgggcacag

SEQ ID NO: 711705 - DNA, 20 bp, Artificial
  CRISPR gRNA sequence
gacacagcgggcacaggagt

SEQ ID NO: 711706 - DNA, 20 bp, Artificial
  CRISPR gRNA sequence
acagcgggcacaggagttgg

SEQ ID NO: 711707 - DNA, 20 bp, Artificial
  CRISPR gRNA sequence
acaggagttggtggctgatg

SEQ ID NO: 711708 - DNA, 20 bp, Artificial
  CRISPR gRNA sequence
agttggtggctgatgtggca

SEQ ID NO: 711709 - DNA, 20 bp, Artificial
  CRISPR gRNA sequence
tgatgtggcacagatcatgc

SEQ ID NO: 711710 - DNA, 20 bp, Artificial
  CRISPR gRNA sequence
gatgtggcacagatcatgcc

SEQ ID NO: 711711 - DNA, 20 bp, Artificial
  CRISPR gRNA sequence
tcatgccaggtcgacattcg

SEQ ID NO: 711712 - DNA, 20 bp, Artificial
  CRISPR gRNA sequence
catgccaggtcgacattcgc

SEQ ID NO: 711713 - DNA, 20 bp, Artificial
  CRISPR gRNA sequence
caggtcgacattcgcaggtg

SEQ ID NO: 711714 - DNA, 20 bp, Artificial
  CRISPR gRNA sequence
aggtcgacattcgcaggtgc

SEQ ID NO: 711715 - DNA, 20 bp, Artificial
  CRISPR gRNA sequence
gtcgacattcgcaggtgcgg

SEQ ID NO: 711716 - DNA, 20 bp, Artificial
  CRISPR gRNA sequence
tcgacattcgcaggtgcggg

SEQ ID NO: 711717 - DNA, 20 bp, Artificial
  CRISPR gRNA sequence
gacattcgcaggtgcgggag

SEQ ID NO: 711718 - DNA, 20 bp, Artificial
  CRISPR gRNA sequence
cgggaggagttccatgcaca

SEQ ID NO: 711719 - DNA, 20 bp, Artificial
  CRISPR gRNA sequence
gcacatggcgtcttctccac

SEQ ID NO: 711720 - DNA, 20 bp, Artificial
  CRISPR gRNA sequence
cacatggcgtcttctccaca

SEQ ID NO: 711721 - DNA, 20 bp, Artificial
  CRISPR gRNA sequence
tcttctccacaaggtcatct

SEQ ID NO: 711722 - DNA, 20 bp, Artificial
  CRISPR gRNA sequence
cttctccacaaggtcatcta

SEQ ID NO: 711723 - DNA, 20 bp, Artificial
  CRISPR gRNA sequence
ttctccacaaggtcatctaa

SEQ ID NO: 711724 - DNA, 20 bp, Artificial
  CRISPR gRNA sequence
acaaggtcatctaagggaca

SEQ ID NO: 711725 - DNA, 20 bp, Artificial
  CRISPR gRNA sequence
gtcatctaagggacacagat

SEQ ID NO: 711726 - DNA, 20 bp, Artificial
  CRISPR gRNA sequence
tcatctaagggacacagatg

SEQ ID NO: 711727 - DNA, 20 bp, Artificial
  CRISPR gRNA sequence
agggacacagatgaggatca

SEQ ID NO: 711728 - DNA, 20 bp, Artificial
  CRISPR gRNA sequence
ggacacagatgaggatcacg

SEQ ID NO: 711729 - DNA, 20 bp, Artificial
  CRISPR gRNA sequence
acagatgaggatcacggaga

SEQ ID NO: 711730 - DNA, 20 bp, Artificial
  CRISPR gRNA sequence
tgaggatcacggagaaagat

SEQ ID NO: 711731 - DNA, 20 bp, Artificial
  CRISPR gRNA sequence
atcacggagaaagatcagta

SEQ ID NO: 711732 - DNA, 20 bp, Artificial
  CRISPR gRNA sequence
cggagaaagatcagtatggc

SEQ ID NO: 711733 - DNA, 20 bp, Artificial
  CRISPR gRNA sequence
ggagaaagatcagtatggca

SEQ ID NO: 711734 - DNA, 20 bp, Artificial
  CRISPR gRNA sequence
gagaaagatcagtatggcaa

SEQ ID NO: 711735 - DNA, 20 bp, Artificial
  CRISPR gRNA sequence
aaagatcagtatggcaaggg

SEQ ID NO: 711736 - DNA, 20 bp, Artificial
  CRISPR gRNA sequence
aagatcagtatggcaagggc

SEQ ID NO: 711737 - DNA, 20 bp, Artificial
  CRISPR gRNA sequence
agatcagtatggcaagggca

SEQ ID NO: 711738 - DNA, 20 bp, Artificial
  CRISPR gRNA sequence
gatcagtatggcaagggcag

SEQ ID NO: 711739 - DNA, 20 bp, Artificial
  CRISPR gRNA sequence
atcagtatggcaagggcagg

SEQ ID NO: 711740 - DNA, 20 bp, Artificial
  CRISPR gRNA sequence
tatggcaagggcagggggtc

SEQ ID NO: 711741 - DNA, 20 bp, Artificial
  CRISPR gRNA sequence
tggcaagggcagggggtcca

SEQ ID NO: 711742 - DNA, 20 bp, Artificial
  CRISPR gRNA sequence
gcaagggcagggggtccaga

SEQ ID NO: 711743 - DNA, 20 bp, Artificial
  CRISPR gRNA sequence
cagggggtccagagagcccc

SEQ ID NO: 711744 - DNA, 20 bp, Artificial
  CRISPR gRNA sequence
agggggtccagagagccccc

SEQ ID NO: 711745 - DNA, 20 bp, Artificial
  CRISPR gRNA sequence
gggtccagagagcccccagg

SEQ ID NO: 711746 - DNA, 20 bp, Artificial
  CRISPR gRNA sequence
ccagagagcccccaggaaga

SEQ ID NO: 711747 - DNA, 20 bp, Artificial
  CRISPR gRNA sequence
agagagcccccaggaagaca

SEQ ID NO: 711748 - DNA, 20 bp, Artificial
  CRISPR gRNA sequence
gagcccccaggaagacagag

SEQ ID NO: 711749 - DNA, 20 bp, Artificial
  CRISPR gRNA sequence
cccccaggaagacagagaag

SEQ ID NO: 711750 - DNA, 20 bp, Artificial
  CRISPR gRNA sequence
agacagagaagcagttgtcc

SEQ ID NO: 711751 - DNA, 20 bp, Artificial
  CRISPR gRNA sequence
gacagagaagcagttgtcca

SEQ ID NO: 711752 - DNA, 20 bp, Artificial
  CRISPR gRNA sequence
acagagaagcagttgtccaa

SEQ ID NO: 711753 - DNA, 20 bp, Artificial
  CRISPR gRNA sequence
ttgtccaagggtcatccaac

SEQ ID NO: 711754 - DNA, 20 bp, Artificial
  CRISPR gRNA sequence
gctcgtctgactatgccgtt

SEQ ID NO: 711755 - DNA, 20 bp, Artificial
  CRISPR gRNA sequence
cgtctgactatgccgttgag

SEQ ID NO: 711756 - DNA, 20 bp, Artificial
  CRISPR gRNA sequence
atgccgttgagcagctctcc

SEQ ID NO: 711757 - DNA, 20 bp, Artificial
  CRISPR gRNA sequence
gcatgctcaaaataattctg

SEQ ID NO: 711758 - DNA, 20 bp, Artificial
  CRISPR gRNA sequence
catgctcaaaataattctgc

SEQ ID NO: 711759 - DNA, 20 bp, Artificial
  CRISPR gRNA sequence
atgctcaaaataattctgca

SEQ ID NO: 711760 - DNA, 20 bp, Artificial
  CRISPR gRNA sequence
aaaataattctgcagggtga

SEQ ID NO: 711761 - DNA, 20 bp, Artificial
  CRISPR gRNA sequence
ataattctgcagggtgaaag

SEQ ID NO: 711762 - DNA, 20 bp, Artificial
  CRISPR gRNA sequence
taattctgcagggtgaaaga

SEQ ID NO: 711763 - DNA, 20 bp, Artificial
  CRISPR gRNA sequence
ttctgcagggtgaaagaagg

SEQ ID NO: 711764 - DNA, 20 bp, Artificial
  CRISPR gRNA sequence
tctgcagggtgaaagaaggc

SEQ ID NO: 711765 - DNA, 20 bp, Artificial
  CRISPR gRNA sequence
ggtgaaagaaggcaggcaaa

SEQ ID NO: 711766 - DNA, 20 bp, Artificial
  CRISPR gRNA sequence
aaagaaggcaggcaaaaagc

SEQ ID NO: 711767 - DNA, 20 bp, Artificial
  CRISPR gRNA sequence
aagaaggcaggcaaaaagcg

SEQ ID NO: 711768 - DNA, 20 bp, Artificial
  CRISPR gRNA sequence
agaaggcaggcaaaaagcga

SEQ ID NO: 711769 - DNA, 20 bp, Artificial
  CRISPR gRNA sequence
tgtatgtcgcatttacatgc

SEQ ID NO: 711770 - DNA, 20 bp, Artificial
  CRISPR gRNA sequence
tttacatgcaagctattgca

SEQ ID NO: 711771 - DNA, 20 bp, Artificial
  CRISPR gRNA sequence
agctattgcatggtgaccat

SEQ ID NO: 711772 - DNA, 20 bp, Artificial
  CRISPR gRNA sequence
tattgcatggtgaccataag

SEQ ID NO: 711773 - DNA, 20 bp, Artificial
  CRISPR gRNA sequence
attgcatggtgaccataagc

SEQ ID NO: 711774 - DNA, 20 bp, Artificial
  CRISPR gRNA sequence
ttgcatggtgaccataagca

SEQ ID NO: 711775 - DNA, 20 bp, Artificial
  CRISPR gRNA sequence
tgcatggtgaccataagcag

SEQ ID NO: 711776 - DNA, 20 bp, Artificial
  CRISPR gRNA sequence
tggtgaccataagcagggga

SEQ ID NO: 711777 - DNA, 20 bp, Artificial
  CRISPR gRNA sequence
ggtgaccataagcaggggat

SEQ ID NO: 711778 - DNA, 20 bp, Artificial
  CRISPR gRNA sequence
cataagcaggggatgggaaa

SEQ ID NO: 711779 - DNA, 20 bp, Artificial
  CRISPR gRNA sequence
aggggatgggaaatggtgac

SEQ ID NO: 711780 - DNA, 20 bp, Artificial
  CRISPR gRNA sequence
gaaatggtgacaagcaaccc

SEQ ID NO: 711781 - DNA, 20 bp, Artificial
  CRISPR gRNA sequence
aaatggtgacaagcaacccg

SEQ ID NO: 711782 - DNA, 20 bp, Artificial
  CRISPR gRNA sequence
aagcaacccgaggtaacttt

SEQ ID NO: 711783 - DNA, 20 bp, Artificial
  CRISPR gRNA sequence
gcaacccgaggtaactttta

SEQ ID NO: 711784 - DNA, 20 bp, Artificial
  CRISPR gRNA sequence
caacccgaggtaacttttag

SEQ ID NO: 711785 - DNA, 20 bp, Artificial
  CRISPR gRNA sequence
aacccgaggtaacttttaga

SEQ ID NO: 711786 - DNA, 20 bp, Artificial
  CRISPR gRNA sequence
acccgaggtaacttttagag

SEQ ID NO: 711787 - DNA, 20 bp, Artificial
  CRISPR gRNA sequence
cccgaggtaacttttagagg

SEQ ID NO: 711788 - DNA, 20 bp, Artificial
  CRISPR gRNA sequence
aggtaacttttagaggggga

SEQ ID NO: 711789 - DNA, 20 bp, Artificial
  CRISPR gRNA sequence
aacttttagagggggatggc

SEQ ID NO: 711790 - DNA, 20 bp, Artificial
  CRISPR gRNA sequence
gagggggatggctggttgct

SEQ ID NO: 711791 - DNA, 20 bp, Artificial
  CRISPR gRNA sequence
atgcatttgttaaaacttat

SEQ ID NO: 711792 - DNA, 20 bp, Artificial
  CRISPR gRNA sequence
atgcccactatctctcccta

SEQ ID NO: 711793 - DNA, 20 bp, Artificial
  CRISPR gRNA sequence
tctctccctaaagctgttaa

SEQ ID NO: 711794 - DNA, 20 bp, Artificial
  CRISPR gRNA sequence
tccctaaagctgttaaaaga

SEQ ID NO: 711795 - DNA, 20 bp, Artificial
  CRISPR gRNA sequence
gctgttaaaagaaagtcctc

SEQ ID NO: 711796 - DNA, 20 bp, Artificial
  CRISPR gRNA sequence
ctgttaaaagaaagtcctcc

SEQ ID NO: 711797 - DNA, 20 bp, Artificial
  CRISPR gRNA sequence
tgttaaaagaaagtcctcca

SEQ ID NO: 711798 - DNA, 20 bp, Artificial
  CRISPR gRNA sequence
gttaaaagaaagtcctccag

SEQ ID NO: 711799 - DNA, 20 bp, Artificial
  CRISPR gRNA sequence
aaagaaagtcctccagggga

SEQ ID NO: 711800 - DNA, 20 bp, Artificial
  CRISPR gRNA sequence
aagaaagtcctccaggggac

SEQ ID NO: 711801 - DNA, 20 bp, Artificial
  CRISPR gRNA sequence
agaaagtcctccaggggacg

SEQ ID NO: 711802 - DNA, 20 bp, Artificial
  CRISPR gRNA sequence
agtcctccaggggacggggt

SEQ ID NO: 711803 - DNA, 20 bp, Artificial
  CRISPR gRNA sequence
cctccaggggacggggtgag

SEQ ID NO: 711804 - DNA, 20 bp, Artificial
  CRISPR gRNA sequence
ctccaggggacggggtgagc

SEQ ID NO: 711805 - DNA, 20 bp, Artificial
  CRISPR gRNA sequence
ggggacggggtgagcgggca

SEQ ID NO: 711806 - DNA, 20 bp, Artificial
  CRISPR gRNA sequence
gggacggggtgagcgggcat

SEQ ID NO: 711807 - DNA, 20 bp, Artificial
  CRISPR gRNA sequence
ggggtgagcgggcatgggtg

SEQ ID NO: 711808 - DNA, 20 bp, Artificial
  CRISPR gRNA sequence
ggtgagcgggcatgggtgca

SEQ ID NO: 711809 - DNA, 20 bp, Artificial
  CRISPR gRNA sequence
gtgagcgggcatgggtgcag

SEQ ID NO: 711810 - DNA, 20 bp, Artificial
  CRISPR gRNA sequence
gagcgggcatgggtgcagag

SEQ ID NO: 711811 - DNA, 20 bp, Artificial
  CRISPR gRNA sequence
ggcatgggtgcagaggagcc

SEQ ID NO: 711812 - DNA, 20 bp, Artificial
  CRISPR gRNA sequence
gggtgcagaggagccaagac

SEQ ID NO: 711813 - DNA, 20 bp, Artificial
  CRISPR gRNA sequence
catgactccataaccgttta

SEQ ID NO: 711814 - DNA, 20 bp, Artificial
  CRISPR gRNA sequence
actccataaccgtttaaagc

SEQ ID NO: 711815 - DNA, 20 bp, Artificial
  CRISPR gRNA sequence
ctccataaccgtttaaagct

SEQ ID NO: 711816 - DNA, 20 bp, Artificial
  CRISPR gRNA sequence
aaccgtttaaagctgggtga

SEQ ID NO: 711817 - DNA, 20 bp, Artificial
  CRISPR gRNA sequence
taaagctgggtgatagtacg

SEQ ID NO: 711818 - DNA, 20 bp, Artificial
  CRISPR gRNA sequence
ttgaaatttttaataataaa

SEQ ID NO: 711819 - DNA, 20 bp, Artificial
  CRISPR gRNA sequence
ttaataataaaaagattttt

SEQ ID NO: 711820 - DNA, 20 bp, Artificial
  CRISPR gRNA sequence
taataaaaagattttttggc

SEQ ID NO: 711821 - DNA, 20 bp, Artificial
  CRISPR gRNA sequence
aaagattttttggccagaca

SEQ ID NO: 711822 - DNA, 20 bp, Artificial
  CRISPR gRNA sequence
gattttttggccagacacgg

SEQ ID NO: 711823 - DNA, 20 bp, Artificial
  CRISPR gRNA sequence
gtggctcacgactgtaatcc

SEQ ID NO: 711824 - DNA, 20 bp, Artificial
  CRISPR gRNA sequence
cgactgtaatcccggcactt

SEQ ID NO: 711825 - DNA, 20 bp, Artificial
  CRISPR gRNA sequence
gactgtaatcccggcacttt

SEQ ID NO: 711826 - DNA, 20 bp, Artificial
  CRISPR gRNA sequence
ctgtaatcccggcactttgg

SEQ ID NO: 711827 - DNA, 20 bp, Artificial
  CRISPR gRNA sequence
tgtaatcccggcactttggg

SEQ ID NO: 711828 - DNA, 20 bp, Artificial
  CRISPR gRNA sequence
tcccggcactttgggaggcc

SEQ ID NO: 711829 - DNA, 20 bp, Artificial
  CRISPR gRNA sequence
cccggcactttgggaggccg

SEQ ID NO: 711830 - DNA, 20 bp, Artificial
  CRISPR gRNA sequence
ggcactttgggaggccgagg

SEQ ID NO: 711831 - DNA, 20 bp, Artificial
  CRISPR gRNA sequence
gcactttgggaggccgaggc

SEQ ID NO: 711832 - DNA, 20 bp, Artificial
  CRISPR gRNA sequence
ctttgggaggccgaggcagg

SEQ ID NO: 711833 - DNA, 20 bp, Artificial
  CRISPR gRNA sequence
ggccgaggcaggcagatcac

SEQ ID NO: 711834 - DNA, 20 bp, Artificial
  CRISPR gRNA sequence
gccgaggcaggcagatcaca

SEQ ID NO: 711835 - DNA, 20 bp, Artificial
  CRISPR gRNA sequence
aggcaggcagatcacaaggt

SEQ ID NO: 711836 - DNA, 20 bp, Artificial
  CRISPR gRNA sequence
ggcaggcagatcacaaggtc

SEQ ID NO: 711837 - DNA, 20 bp, Artificial
  CRISPR gRNA sequence
caggcagatcacaaggtcag

SEQ ID NO: 711838 - DNA, 20 bp, Artificial
  CRISPR gRNA sequence
gatcacaaggtcaggagttc

SEQ ID NO: 711839 - DNA, 20 bp, Artificial
  CRISPR gRNA sequence
caaggtcaggagttcaagtc

SEQ ID NO: 711840 - DNA, 20 bp, Artificial
  CRISPR gRNA sequence
caagtccagcctgaccaaca

SEQ ID NO: 711841 - DNA, 20 bp, Artificial
  CRISPR gRNA sequence
tctactaaaaatacaaaaat

SEQ ID NO: 711842 - DNA, 20 bp, Artificial
  CRISPR gRNA sequence
atacaaaaattagccatgcc

SEQ ID NO: 711843 - DNA, 20 bp, Artificial
  CRISPR gRNA sequence
caaaaattagccatgcctgg

SEQ ID NO: 711844 - DNA, 20 bp, Artificial
  CRISPR gRNA sequence
gtggcacgtgcctgtaatcc

SEQ ID NO: 711845 - DNA, 20 bp, Artificial
  CRISPR gRNA sequence
tgcctgtaatcccagctact

SEQ ID NO: 711846 - DNA, 20 bp, Artificial
  CRISPR gRNA sequence
gcctgtaatcccagctactc

SEQ ID NO: 711847 - DNA, 20 bp, Artificial
  CRISPR gRNA sequence
ctgtaatcccagctactcag

SEQ ID NO: 711848 - DNA, 20 bp, Artificial
  CRISPR gRNA sequence
tgtaatcccagctactcagg

SEQ ID NO: 711849 - DNA, 20 bp, Artificial
  CRISPR gRNA sequence
tcccagctactcaggaggct

SEQ ID NO: 711850 - DNA, 20 bp, Artificial
  CRISPR gRNA sequence
cccagctactcaggaggctg

SEQ ID NO: 711851 - DNA, 20 bp, Artificial
  CRISPR gRNA sequence
agctactcaggaggctgagg

SEQ ID NO: 711852 - DNA, 20 bp, Artificial
  CRISPR gRNA sequence
gctactcaggaggctgaggc

SEQ ID NO: 711853 - DNA, 20 bp, Artificial
  CRISPR gRNA sequence
tactcaggaggctgaggcag

SEQ ID NO: 711854 - DNA, 20 bp, Artificial
  CRISPR gRNA sequence
gcaggagaatcacttgaacc

SEQ ID NO: 711855 - DNA, 20 bp, Artificial
  CRISPR gRNA sequence
caggagaatcacttgaacct

SEQ ID NO: 711856 - DNA, 20 bp, Artificial
  CRISPR gRNA sequence
ggagaatcacttgaacctgg

SEQ ID NO: 711857 - DNA, 20 bp, Artificial
  CRISPR gRNA sequence
gagaatcacttgaacctggg

SEQ ID NO: 711858 - DNA, 20 bp, Artificial
  CRISPR gRNA sequence
aatcacttgaacctgggagg

SEQ ID NO: 711859 - DNA, 20 bp, Artificial
  CRISPR gRNA sequence
tcacttgaacctgggaggca

SEQ ID NO: 711860 - DNA, 20 bp, Artificial
  CRISPR gRNA sequence
cacttgaacctgggaggcag

SEQ ID NO: 711861 - DNA, 20 bp, Artificial
  CRISPR gRNA sequence
aacctgggaggcagaggttg

SEQ ID NO: 711862 - DNA, 20 bp, Artificial
  CRISPR gRNA sequence
tgggaggcagaggttgcagt

SEQ ID NO: 711863 - DNA, 20 bp, Artificial
  CRISPR gRNA sequence
ggcagaggttgcagtgagcc

SEQ ID NO: 711864 - DNA, 20 bp, Artificial
  CRISPR gRNA sequence
gaggttgcagtgagccaaga

SEQ ID NO: 711865 - DNA, 20 bp, Artificial
  CRISPR gRNA sequence
aagatagtgccactgcactc

SEQ ID NO: 711866 - DNA, 20 bp, Artificial
  CRISPR gRNA sequence
agtgccactgcactccagcc

SEQ ID NO: 711867 - DNA, 20 bp, Artificial
  CRISPR gRNA sequence
gtgccactgcactccagcct

SEQ ID NO: 711868 - DNA, 20 bp, Artificial
  CRISPR gRNA sequence
ctgcactccagcctgggcga

SEQ ID NO: 711869 - DNA, 20 bp, Artificial
  CRISPR gRNA sequence
tccagcctgggcgacagaac

SEQ ID NO: 711870 - DNA, 20 bp, Artificial
  CRISPR gRNA sequence
aaaaaaaaaaaaaaaaaaaa

SEQ ID NO: 711871 - DNA, 20 bp, Artificial
  CRISPR gRNA sequence
aaagattttttttcctccaa

SEQ ID NO: 711872 - DNA, 20 bp, Artificial
  CRISPR gRNA sequence
aaagcaaaaaaaaaccatgt

SEQ ID NO: 711873 - DNA, 20 bp, Artificial
  CRISPR gRNA sequence
agcaaaaaaaaaccatgtta

SEQ ID NO: 711874 - DNA, 20 bp, Artificial
  CRISPR gRNA sequence
gcaaaaaaaaaccatgttag

SEQ ID NO: 711875 - DNA, 20 bp, Artificial
  CRISPR gRNA sequence
ttagaggtattatttttaat

SEQ ID NO: 711876 - DNA, 20 bp, Artificial
  CRISPR gRNA sequence
ataatgcatttgtacgtatt

SEQ ID NO: 711877 - DNA, 20 bp, Artificial
  CRISPR gRNA sequence
taatgcatttgtacgtattc

SEQ ID NO: 711878 - DNA, 20 bp, Artificial
  CRISPR gRNA sequence
atattttgcaacgctccact

SEQ ID NO: 711879 - DNA, 20 bp, Artificial
  CRISPR gRNA sequence
attttgcaacgctccactta

SEQ ID NO: 711880 - DNA, 20 bp, Artificial
  CRISPR gRNA sequence
ttttgcaacgctccacttag

SEQ ID NO: 711881 - DNA, 20 bp, Artificial
  CRISPR gRNA sequence
gctccacttagaggtaaata

SEQ ID NO: 711882 - DNA, 20 bp, Artificial
  CRISPR gRNA sequence
taaatacagaacgactgcat

SEQ ID NO: 711883 - DNA, 20 bp, Artificial
  CRISPR gRNA sequence
atacagaacgactgcatcag

SEQ ID NO: 711884 - DNA, 20 bp, Artificial
  CRISPR gRNA sequence
gaacgactgcatcagtagat

SEQ ID NO: 711885 - DNA, 20 bp, Artificial
  CRISPR gRNA sequence
aacgactgcatcagtagatt

SEQ ID NO: 711886 - DNA, 20 bp, Artificial
  CRISPR gRNA sequence
gcatcagtagattaggcaaa

SEQ ID NO: 711887 - DNA, 20 bp, Artificial
  CRISPR gRNA sequence
catcagtagattaggcaaat

SEQ ID NO: 711888 - DNA, 20 bp, Artificial
  CRISPR gRNA sequence
ggcaaatgggacctctccgc

SEQ ID NO: 711889 - DNA, 20 bp, Artificial
  CRISPR gRNA sequence
gcaaatgggacctctccgcg

SEQ ID NO: 711890 - DNA, 20 bp, Artificial
  CRISPR gRNA sequence
caaatgggacctctccgcga

SEQ ID NO: 711891 - DNA, 20 bp, Artificial
  CRISPR gRNA sequence
atgggacctctccgcgaggg

SEQ ID NO: 711892 - DNA, 20 bp, Artificial
  CRISPR gRNA sequence
ccgcgagggtagatctcaat

SEQ ID NO: 711893 - DNA, 20 bp, Artificial
  CRISPR gRNA sequence
cgagggtagatctcaatcag

SEQ ID NO: 711894 - DNA, 20 bp, Artificial
  CRISPR gRNA sequence
gagggtagatctcaatcagc

SEQ ID NO: 711895 - DNA, 20 bp, Artificial
  CRISPR gRNA sequence
atctcaatcagcaggatact

SEQ ID NO: 711896 - DNA, 20 bp, Artificial
  CRISPR gRNA sequence
ctcaatcagcaggatactta

SEQ ID NO: 711897 - DNA, 20 bp, Artificial
  CRISPR gRNA sequence
cagcaggatacttagagacc

SEQ ID NO: 711898 - DNA, 20 bp, Artificial
  CRISPR gRNA sequence
agacccagcatgataatgat

SEQ ID NO: 711899 - DNA, 20 bp, Artificial
  CRISPR gRNA sequence
gacccagcatgataatgata

SEQ ID NO: 711900 - DNA, 20 bp, Artificial
  CRISPR gRNA sequence
acccagcatgataatgataa

SEQ ID NO: 711901 - DNA, 20 bp, Artificial
  CRISPR gRNA sequence
agcatgataatgataagggc

SEQ ID NO: 711902 - DNA, 20 bp, Artificial
  CRISPR gRNA sequence
tgataatgataagggctgga

SEQ ID NO: 711903 - DNA, 20 bp, Artificial
  CRISPR gRNA sequence
cagtctcttcttacaacatc

SEQ ID NO: 711904 - DNA, 20 bp, Artificial
  CRISPR gRNA sequence
gtctcttcttacaacatcca

SEQ ID NO: 711905 - DNA, 20 bp, Artificial
  CRISPR gRNA sequence
cttcttacaacatccagagc

SEQ ID NO: 711906 - DNA, 20 bp, Artificial
  CRISPR gRNA sequence
ttcttacaacatccagagca

SEQ ID NO: 711907 - DNA, 20 bp, Artificial
  CRISPR gRNA sequence
tcttacaacatccagagcaa

SEQ ID NO: 711908 - DNA, 20 bp, Artificial
  CRISPR gRNA sequence
aacatccagagcaagggaac

SEQ ID NO: 711909 - DNA, 20 bp, Artificial
  CRISPR gRNA sequence
acatccagagcaagggaact

SEQ ID NO: 711910 - DNA, 20 bp, Artificial
  CRISPR gRNA sequence
tccagagcaagggaactggg

SEQ ID NO: 711911 - DNA, 20 bp, Artificial
  CRISPR gRNA sequence
ccagagcaagggaactgggc

SEQ ID NO: 711912 - DNA, 20 bp, Artificial
  CRISPR gRNA sequence
caagggaactgggcaggatt

SEQ ID NO: 711913 - DNA, 20 bp, Artificial
  CRISPR gRNA sequence
aagggaactgggcaggattt

SEQ ID NO: 711914 - DNA, 20 bp, Artificial
  CRISPR gRNA sequence
agggaactgggcaggatttg

SEQ ID NO: 711915 - DNA, 20 bp, Artificial
  CRISPR gRNA sequence
ggatttggggaatttgtgca

SEQ ID NO: 711916 - DNA, 20 bp, Artificial
  CRISPR gRNA sequence
gatttggggaatttgtgcaa

SEQ ID NO: 711917 - DNA, 20 bp, Artificial
  CRISPR gRNA sequence
atttggggaatttgtgcaaa

SEQ ID NO: 711918 - DNA, 20 bp, Artificial
  CRISPR gRNA sequence
tttgtgcaaagggtgtgtgt

SEQ ID NO: 711919 - DNA, 20 bp, Artificial
  CRISPR gRNA sequence
gcaaagggtgtgtgtgagct

SEQ ID NO: 711920 - DNA, 20 bp, Artificial
  CRISPR gRNA sequence
cagcaatgaatgaaaccatt

SEQ ID NO: 711921 - DNA, 20 bp, Artificial
  CRISPR gRNA sequence
agcaatgaatgaaaccattt

SEQ ID NO: 711922 - DNA, 20 bp, Artificial
  CRISPR gRNA sequence
aatgaaaccatttgggacaa

SEQ ID NO: 711923 - DNA, 20 bp, Artificial
  CRISPR gRNA sequence
gaaaccatttgggacaatgg

SEQ ID NO: 711924 - DNA, 20 bp, Artificial
  CRISPR gRNA sequence
agctattatcattattatta

SEQ ID NO: 711925 - DNA, 20 bp, Artificial
  CRISPR gRNA sequence
tcattattattatagctctt

SEQ ID NO: 711926 - DNA, 20 bp, Artificial
  CRISPR gRNA sequence
ttatagctcttaagataact

SEQ ID NO: 711927 - DNA, 20 bp, Artificial
  CRISPR gRNA sequence
taagataactgagtatgtgt

SEQ ID NO: 711928 - DNA, 20 bp, Artificial
  CRISPR gRNA sequence
ataactgagtatgtgtgaga

SEQ ID NO: 711929 - DNA, 20 bp, Artificial
  CRISPR gRNA sequence
actgagtatgtgtgagacag

SEQ ID NO: 711930 - DNA, 20 bp, Artificial
  CRISPR gRNA sequence
tatgtgtgagacagtagtct

SEQ ID NO: 711931 - DNA, 20 bp, Artificial
  CRISPR gRNA sequence
agtagtctcagcactctacc

SEQ ID NO: 711932 - DNA, 20 bp, Artificial
  CRISPR gRNA sequence
tcatgtattcaattctcaca

SEQ ID NO: 711933 - DNA, 20 bp, Artificial
  CRISPR gRNA sequence
caattctcacatggttctct

SEQ ID NO: 711934 - DNA, 20 bp, Artificial
  CRISPR gRNA sequence
tctcacatggttctctgaga

SEQ ID NO: 711935 - DNA, 20 bp, Artificial
  CRISPR gRNA sequence
ataatactatgcccattttg

SEQ ID NO: 711936 - DNA, 20 bp, Artificial
  CRISPR gRNA sequence
atactatgcccattttgcag

SEQ ID NO: 711937 - DNA, 20 bp, Artificial
  CRISPR gRNA sequence
actatgcccattttgcagca

SEQ ID NO: 711938 - DNA, 20 bp, Artificial
  CRISPR gRNA sequence
ctatgcccattttgcagcag

SEQ ID NO: 711939 - DNA, 20 bp, Artificial
  CRISPR gRNA sequence
attttgcagcagaggaaact

SEQ ID NO: 711940 - DNA, 20 bp, Artificial
  CRISPR gRNA sequence
ttttgcagcagaggaaactg

SEQ ID NO: 711941 - DNA, 20 bp, Artificial
  CRISPR gRNA sequence
cagcagaggaaactgaggca

SEQ ID NO: 711942 - DNA, 20 bp, Artificial
  CRISPR gRNA sequence
gcagaggaaactgaggcaca

SEQ ID NO: 711943 - DNA, 20 bp, Artificial
  CRISPR gRNA sequence
agaggaaactgaggcacaga

SEQ ID NO: 711944 - DNA, 20 bp, Artificial
  CRISPR gRNA sequence
gaggaaactgaggcacagag

SEQ ID NO: 711945 - DNA, 20 bp, Artificial
  CRISPR gRNA sequence
aaactgaggcacagagaggt

SEQ ID NO: 711946 - DNA, 20 bp, Artificial
  CRISPR gRNA sequence
aactgaggcacagagaggtt

SEQ ID NO: 711947 - DNA, 20 bp, Artificial
  CRISPR gRNA sequence
agaggttaggaaacctgctt

SEQ ID NO: 711948 - DNA, 20 bp, Artificial
  CRISPR gRNA sequence
gaggttaggaaacctgcttg

SEQ ID NO: 711949 - DNA, 20 bp, Artificial
  CRISPR gRNA sequence
aggaaacctgcttgaggtta

SEQ ID NO: 711950 - DNA, 20 bp, Artificial
  CRISPR gRNA sequence
ggaaacctgcttgaggttat

SEQ ID NO: 711951 - DNA, 20 bp, Artificial
  CRISPR gRNA sequence
gcttgaggttataggctatc

SEQ ID NO: 711952 - DNA, 20 bp, Artificial
  CRISPR gRNA sequence
tgaggttataggctatcaag

SEQ ID NO: 711953 - DNA, 20 bp, Artificial
  CRISPR gRNA sequence
gaggttataggctatcaagt

SEQ ID NO: 711954 - DNA, 20 bp, Artificial
  CRISPR gRNA sequence
ggttataggctatcaagtgg

SEQ ID NO: 711955 - DNA, 20 bp, Artificial
  CRISPR gRNA sequence
ttataggctatcaagtggga

SEQ ID NO: 711956 - DNA, 20 bp, Artificial
  CRISPR gRNA sequence
tataggctatcaagtgggag

SEQ ID NO: 711957 - DNA, 20 bp, Artificial
  CRISPR gRNA sequence
aggctatcaagtgggagagg

SEQ ID NO: 711958 - DNA, 20 bp, Artificial
  CRISPR gRNA sequence
ggctatcaagtgggagaggc

SEQ ID NO: 711959 - DNA, 20 bp, Artificial
  CRISPR gRNA sequence
ggagaggcgggatctgaacc

SEQ ID NO: 711960 - DNA, 20 bp, Artificial
  CRISPR gRNA sequence
cgggatctgaacccggcact

SEQ ID NO: 711961 - DNA, 20 bp, Artificial
  CRISPR gRNA sequence
gggatctgaacccggcactc

SEQ ID NO: 711962 - DNA, 20 bp, Artificial
  CRISPR gRNA sequence
tgaacccggcactcgggttc

SEQ ID NO: 711963 - DNA, 20 bp, Artificial
  CRISPR gRNA sequence
aacccggcactcgggttcta

SEQ ID NO: 711964 - DNA, 20 bp, Artificial
  CRISPR gRNA sequence
ggttctagagctcatgcctt

SEQ ID NO: 711965 - DNA, 20 bp, Artificial
  CRISPR gRNA sequence
tacaccactccactgcctcg

SEQ ID NO: 711966 - DNA, 20 bp, Artificial
  CRISPR gRNA sequence
acaccactccactgcctcgt

SEQ ID NO: 711967 - DNA, 20 bp, Artificial
  CRISPR gRNA sequence
caccactccactgcctcgtg

SEQ ID NO: 711968 - DNA, 20 bp, Artificial
  CRISPR gRNA sequence
tccactgcctcgtggggttt

SEQ ID NO: 711969 - DNA, 20 bp, Artificial
  CRISPR gRNA sequence
ctgcctcgtggggtttcagt

SEQ ID NO: 711970 - DNA, 20 bp, Artificial
  CRISPR gRNA sequence
tgcctcgtggggtttcagtt

SEQ ID NO: 711971 - DNA, 20 bp, Artificial
  CRISPR gRNA sequence
cctcgtggggtttcagttag

SEQ ID NO: 711972 - DNA, 20 bp, Artificial
  CRISPR gRNA sequence
tcgtggggtttcagttagga

SEQ ID NO: 711973 - DNA, 20 bp, Artificial
  CRISPR gRNA sequence
ggtttcagttaggagagctg

SEQ ID NO: 711974 - DNA, 20 bp, Artificial
  CRISPR gRNA sequence
gtttcagttaggagagctga

SEQ ID NO: 711975 - DNA, 20 bp, Artificial
  CRISPR gRNA sequence
aggagagctgaaggaattac

SEQ ID NO: 711976 - DNA, 20 bp, Artificial
  CRISPR gRNA sequence
ggagagctgaaggaattact

SEQ ID NO: 711977 - DNA, 20 bp, Artificial
  CRISPR gRNA sequence
gctgaaggaattactgggcc

SEQ ID NO: 711978 - DNA, 20 bp, Artificial
  CRISPR gRNA sequence
tgaaggaattactgggccca

SEQ ID NO: 711979 - DNA, 20 bp, Artificial
  CRISPR gRNA sequence
tctttctccatatgtccaca

SEQ ID NO: 711980 - DNA, 20 bp, Artificial
  CRISPR gRNA sequence
ttctccatatgtccacatgg

SEQ ID NO: 711981 - DNA, 20 bp, Artificial
  CRISPR gRNA sequence
atatgtccacatggtggttg

SEQ ID NO: 711982 - DNA, 20 bp, Artificial
  CRISPR gRNA sequence
tgtccacatggtggttgtgg

SEQ ID NO: 711983 - DNA, 20 bp, Artificial
  CRISPR gRNA sequence
gactgtatttccccaaaaca

SEQ ID NO: 711984 - DNA, 20 bp, Artificial
  CRISPR gRNA sequence
atttccccaaaacatggctg

SEQ ID NO: 711985 - DNA, 20 bp, Artificial
  CRISPR gRNA sequence
acatggctgcagtgatgttc

SEQ ID NO: 711986 - DNA, 20 bp, Artificial
  CRISPR gRNA sequence
cagtgatgttctggcccttc

SEQ ID NO: 711987 - DNA, 20 bp, Artificial
  CRISPR gRNA sequence
gtgatgttctggcccttcca

SEQ ID NO: 711988 - DNA, 20 bp, Artificial
  CRISPR gRNA sequence
gcctttgccacctacctgtc

SEQ ID NO: 711989 - DNA, 20 bp, Artificial
  CRISPR gRNA sequence
tttgccacctacctgtcaag

SEQ ID NO: 711990 - DNA, 20 bp, Artificial
  CRISPR gRNA sequence
tacaactgttttccttccct

SEQ ID NO: 711991 - DNA, 20 bp, Artificial
  CRISPR gRNA sequence
gttttccttcccttggtctc

SEQ ID NO: 711992 - DNA, 20 bp, Artificial
  CRISPR gRNA sequence
ttggtctcaagtgacatttg

SEQ ID NO: 711993 - DNA, 20 bp, Artificial
  CRISPR gRNA sequence
tttgtggttgcctcaacaaa

SEQ ID NO: 711994 - DNA, 20 bp, Artificial
  CRISPR gRNA sequence
tggttgcctcaacaaacaga

SEQ ID NO: 711995 - DNA, 20 bp, Artificial
  CRISPR gRNA sequence
ttgcctcaacaaacagaaag

SEQ ID NO: 711996 - DNA, 20 bp, Artificial
  CRISPR gRNA sequence
cctcaacaaacagaaagtgg

SEQ ID NO: 711997 - DNA, 20 bp, Artificial
  CRISPR gRNA sequence
caacaaacagaaagtggtag

SEQ ID NO: 711998 - DNA, 20 bp, Artificial
  CRISPR gRNA sequence
agaagttctgtgtgacttcc

SEQ ID NO: 711999 - DNA, 20 bp, Artificial
  CRISPR gRNA sequence
gaagttctgtgtgacttcca

SEQ ID NO: 712000 - DNA, 20 bp, Artificial
  CRISPR gRNA sequence
ttctgtgtgacttccaaggc

SEQ ID NO: 712001 - DNA, 20 bp, Artificial
  CRISPR gRNA sequence
tctgtgtgacttccaaggcc

SEQ ID NO: 712002 - DNA, 20 bp, Artificial
  CRISPR gRNA sequence
cttccaaggccaggtcataa

SEQ ID NO: 712003 - DNA, 20 bp, Artificial
  CRISPR gRNA sequence
ttccaaggccaggtcataaa

SEQ ID NO: 712004 - DNA, 20 bp, Artificial
  CRISPR gRNA sequence
ccaaggccaggtcataaaag

SEQ ID NO: 712005 - DNA, 20 bp, Artificial
  CRISPR gRNA sequence
caaggccaggtcataaaagg

SEQ ID NO: 712006 - DNA, 20 bp, Artificial
  CRISPR gRNA sequence
aaggccaggtcataaaagga

SEQ ID NO: 712007 - DNA, 20 bp, Artificial
  CRISPR gRNA sequence
aggccaggtcataaaaggag

SEQ ID NO: 712008 - DNA, 20 bp, Artificial
  CRISPR gRNA sequence
ccaggtcataaaaggagggg

SEQ ID NO: 712009 - DNA, 20 bp, Artificial
  CRISPR gRNA sequence
ctctgtctctctctgtctct

SEQ ID NO: 712010 - DNA, 20 bp, Artificial
  CRISPR gRNA sequence
tctgtctgtctctctctctc

SEQ ID NO: 712011 - DNA, 20 bp, Artificial
  CRISPR gRNA sequence
tctctctctcaagactttta

SEQ ID NO: 712012 - DNA, 20 bp, Artificial
  CRISPR gRNA sequence
tctctcaagacttttatggc

SEQ ID NO: 712013 - DNA, 20 bp, Artificial
  CRISPR gRNA sequence
ctctcaagacttttatggcc

SEQ ID NO: 712014 - DNA, 20 bp, Artificial
  CRISPR gRNA sequence
tctcaagacttttatggccg

SEQ ID NO: 712015 - DNA, 20 bp, Artificial
  CRISPR gRNA sequence
ctcaagacttttatggccgg

SEQ ID NO: 712016 - DNA, 20 bp, Artificial
  CRISPR gRNA sequence
acttttatggccgggggcaa

SEQ ID NO: 712017 - DNA, 20 bp, Artificial
  CRISPR gRNA sequence
tgcttgtaattccaacactt

SEQ ID NO: 712018 - DNA, 20 bp, Artificial
  CRISPR gRNA sequence
gcttgtaattccaacacttt

SEQ ID NO: 712019 - DNA, 20 bp, Artificial
  CRISPR gRNA sequence
ttgtaattccaacactttgg

SEQ ID NO: 712020 - DNA, 20 bp, Artificial
  CRISPR gRNA sequence
tgtaattccaacactttggg

SEQ ID NO: 712021 - DNA, 20 bp, Artificial
  CRISPR gRNA sequence
ttccaacactttgggaggcc

SEQ ID NO: 712022 - DNA, 20 bp, Artificial
  CRISPR gRNA sequence
tccaacactttgggaggcca

SEQ ID NO: 712023 - DNA, 20 bp, Artificial
  CRISPR gRNA sequence
acactttgggaggccaaggc

SEQ ID NO: 712024 - DNA, 20 bp, Artificial
  CRISPR gRNA sequence
ctttgggaggccaaggccgg

SEQ ID NO: 712025 - DNA, 20 bp, Artificial
  CRISPR gRNA sequence
ccaaggccggcggatcactt

SEQ ID NO: 712026 - DNA, 20 bp, Artificial
  CRISPR gRNA sequence
caaggccggcggatcacttg

SEQ ID NO: 712027 - DNA, 20 bp, Artificial
  CRISPR gRNA sequence
gccggcggatcacttgaggc

SEQ ID NO: 712028 - DNA, 20 bp, Artificial
  CRISPR gRNA sequence
ccggcggatcacttgaggcc

SEQ ID NO: 712029 - DNA, 20 bp, Artificial
  CRISPR gRNA sequence
ggcggatcacttgaggccag

SEQ ID NO: 712030 - DNA, 20 bp, Artificial
  CRISPR gRNA sequence
atcacttgaggccaggagtt

SEQ ID NO: 712031 - DNA, 20 bp, Artificial
  CRISPR gRNA sequence
tcacttgaggccaggagttt

SEQ ID NO: 712032 - DNA, 20 bp, Artificial
  CRISPR gRNA sequence
tgaggccaggagtttgggac

SEQ ID NO: 712033 - DNA, 20 bp, Artificial
  CRISPR gRNA sequence
ccaggagtttgggaccagcc

SEQ ID NO: 712034 - DNA, 20 bp, Artificial
  CRISPR gRNA sequence
tgggaccagcctggccaaca

SEQ ID NO: 712035 - DNA, 20 bp, Artificial
  CRISPR gRNA sequence
ctctactaaaaatacaaaaa

SEQ ID NO: 712036 - DNA, 20 bp, Artificial
  CRISPR gRNA sequence
aaaatacaaaaaaagaaaaa

SEQ ID NO: 712037 - DNA, 20 bp, Artificial
  CRISPR gRNA sequence
aatacaaaaaaagaaaaaaa

SEQ ID NO: 712038 - DNA, 20 bp, Artificial
  CRISPR gRNA sequence
aaaaaagaaaaaaagagaaa

SEQ ID NO: 712039 - DNA, 20 bp, Artificial
  CRISPR gRNA sequence
agagaaaaagacttcgcctt

SEQ ID NO: 712040 - DNA, 20 bp, Artificial
  CRISPR gRNA sequence
cgcctttagaacctaaccac

SEQ ID NO: 712041 - DNA, 20 bp, Artificial
  CRISPR gRNA sequence
gaacctaaccaccagaccat

SEQ ID NO: 712042 - DNA, 20 bp, Artificial
  CRISPR gRNA sequence
aacctaaccaccagaccatg

SEQ ID NO: 712043 - DNA, 20 bp, Artificial
  CRISPR gRNA sequence
ctaaccaccagaccatgagg

SEQ ID NO: 712044 - DNA, 20 bp, Artificial
  CRISPR gRNA sequence
accagaccatgaggaagccc

SEQ ID NO: 712045 - DNA, 20 bp, Artificial
  CRISPR gRNA sequence
ccagaccatgaggaagcccc

SEQ ID NO: 712046 - DNA, 20 bp, Artificial
  CRISPR gRNA sequence
accatgaggaagccccaggt

SEQ ID NO: 712047 - DNA, 20 bp, Artificial
  CRISPR gRNA sequence
gaagccccaggtaagacacg

SEQ ID NO: 712048 - DNA, 20 bp, Artificial
  CRISPR gRNA sequence
agccccaggtaagacacgaa

SEQ ID NO: 712049 - DNA, 20 bp, Artificial
  CRISPR gRNA sequence
gccccaggtaagacacgaag

SEQ ID NO: 712050 - DNA, 20 bp, Artificial
  CRISPR gRNA sequence
aagacacgaagaggccgaca

SEQ ID NO: 712051 - DNA, 20 bp, Artificial
  CRISPR gRNA sequence
acacgaagaggccgacatgg

SEQ ID NO: 712052 - DNA, 20 bp, Artificial
  CRISPR gRNA sequence
cacgaagaggccgacatgga

SEQ ID NO: 712053 - DNA, 20 bp, Artificial
  CRISPR gRNA sequence
acgaagaggccgacatggaa

SEQ ID NO: 712054 - DNA, 20 bp, Artificial
  CRISPR gRNA sequence
ggccgacatggaagggaacc

SEQ ID NO: 712055 - DNA, 20 bp, Artificial
  CRISPR gRNA sequence
gccgacatggaagggaacca

SEQ ID NO: 712056 - DNA, 20 bp, Artificial
  CRISPR gRNA sequence
atggaagggaaccaaggctg

SEQ ID NO: 712057 - DNA, 20 bp, Artificial
  CRISPR gRNA sequence
aagggaaccaaggctgcagc

SEQ ID NO: 712058 - DNA, 20 bp, Artificial
  CRISPR gRNA sequence
agggaaccaaggctgcagcc

SEQ ID NO: 712059 - DNA, 20 bp, Artificial
  CRISPR gRNA sequence
ggaaccaaggctgcagccag

SEQ ID NO: 712060 - DNA, 20 bp, Artificial
  CRISPR gRNA sequence
caggagccaacatcaacccc

SEQ ID NO: 712061 - DNA, 20 bp, Artificial
  CRISPR gRNA sequence
aggagccaacatcaacccca

SEQ ID NO: 712062 - DNA, 20 bp, Artificial
  CRISPR gRNA sequence
agccaacatcaaccccaagg

SEQ ID NO: 712063 - DNA, 20 bp, Artificial
  CRISPR gRNA sequence
gccaacatcaaccccaaggc

SEQ ID NO: 712064 - DNA, 20 bp, Artificial
  CRISPR gRNA sequence
ccaaggcaggtgaatgaatg

SEQ ID NO: 712065 - DNA, 20 bp, Artificial
  CRISPR gRNA sequence
caggtgaatgaatgaagctt

SEQ ID NO: 712066 - DNA, 20 bp, Artificial
  CRISPR gRNA sequence
gtgaatgaatgaagcttcag

SEQ ID NO: 712067 - DNA, 20 bp, Artificial
  CRISPR gRNA sequence
cttcagaagttcctgatctg

SEQ ID NO: 712068 - DNA, 20 bp, Artificial
  CRISPR gRNA sequence
agttcctgatctgcagcttt

SEQ ID NO: 712069 - DNA, 20 bp, Artificial
  CRISPR gRNA sequence
gttcctgatctgcagctttt

SEQ ID NO: 712070 - DNA, 20 bp, Artificial
  CRISPR gRNA sequence
tctgcagcttttgggctttc

SEQ ID NO: 712071 - DNA, 20 bp, Artificial
  CRISPR gRNA sequence
agcttttgggctttccagct

SEQ ID NO: 712072 - DNA, 20 bp, Artificial
  CRISPR gRNA sequence
gggctttccagctaagacct

SEQ ID NO: 712073 - DNA, 20 bp, Artificial
  CRISPR gRNA sequence
agctaagacctcagacattg

SEQ ID NO: 712074 - DNA, 20 bp, Artificial
  CRISPR gRNA sequence
ctaagacctcagacattgtg

SEQ ID NO: 712075 - DNA, 20 bp, Artificial
  CRISPR gRNA sequence
agacctcagacattgtggag

SEQ ID NO: 712076 - DNA, 20 bp, Artificial
  CRISPR gRNA sequence
acctcagacattgtggagca

SEQ ID NO: 712077 - DNA, 20 bp, Artificial
  CRISPR gRNA sequence
agacattgtggagcagagac

SEQ ID NO: 712078 - DNA, 20 bp, Artificial
  CRISPR gRNA sequence
gcagagacaagctgtccccg

SEQ ID NO: 712079 - DNA, 20 bp, Artificial
  CRISPR gRNA sequence
cctgtctgaattctgactca

SEQ ID NO: 712080 - DNA, 20 bp, Artificial
  CRISPR gRNA sequence
ttctgactcacagaatctgt

SEQ ID NO: 712081 - DNA, 20 bp, Artificial
  CRISPR gRNA sequence
tcacagaatctgtgagtaca

SEQ ID NO: 712082 - DNA, 20 bp, Artificial
  CRISPR gRNA sequence
aatgatttgttttcacaatt

SEQ ID NO: 712083 - DNA, 20 bp, Artificial
  CRISPR gRNA sequence
tgttttcacaattaagtttt

SEQ ID NO: 712084 - DNA, 20 bp, Artificial
  CRISPR gRNA sequence
ttttaagaaaatttgctatg

SEQ ID NO: 712085 - DNA, 20 bp, Artificial
  CRISPR gRNA sequence
gaaaatttgctatgcagcct

SEQ ID NO: 712086 - DNA, 20 bp, Artificial
  CRISPR gRNA sequence
tgctatgcagccttagtaac

SEQ ID NO: 712087 - DNA, 20 bp, Artificial
  CRISPR gRNA sequence
gctatgcagccttagtaact

SEQ ID NO: 712088 - DNA, 20 bp, Artificial
  CRISPR gRNA sequence
tgcagccttagtaactagga

SEQ ID NO: 712089 - DNA, 20 bp, Artificial
  CRISPR gRNA sequence
cagccttagtaactaggaca

SEQ ID NO: 712090 - DNA, 20 bp, Artificial
  CRISPR gRNA sequence
agacctccaatgacaacaaa

SEQ ID NO: 712091 - DNA, 20 bp, Artificial
  CRISPR gRNA sequence
atgacaacaaacagtgtctg

SEQ ID NO: 712092 - DNA, 20 bp, Artificial
  CRISPR gRNA sequence
acagtgtctgtggttctttt

SEQ ID NO: 712093 - DNA, 20 bp, Artificial
  CRISPR gRNA sequence
cactctgctttgctgcccaa

SEQ ID NO: 712094 - DNA, 20 bp, Artificial
  CRISPR gRNA sequence
tctgctttgctgcccaaaag

SEQ ID NO: 712095 - DNA, 20 bp, Artificial
  CRISPR gRNA sequence
ttgctgcccaaaagcagctc

SEQ ID NO: 712096 - DNA, 20 bp, Artificial
  CRISPR gRNA sequence
gcccaaaagcagctctggac

SEQ ID NO: 712097 - DNA, 20 bp, Artificial
  CRISPR gRNA sequence
cccaaaagcagctctggaca

SEQ ID NO: 712098 - DNA, 20 bp, Artificial
  CRISPR gRNA sequence
caaaagcagctctggacaag

SEQ ID NO: 712099 - DNA, 20 bp, Artificial
  CRISPR gRNA sequence
agcagctctggacaaggaga

SEQ ID NO: 712100 - DNA, 20 bp, Artificial
  CRISPR gRNA sequence
aggagacagacacacattcc

SEQ ID NO: 712101 - DNA, 20 bp, Artificial
  CRISPR gRNA sequence
agacagacacacattcccag

SEQ ID NO: 712102 - DNA, 20 bp, Artificial
  CRISPR gRNA sequence
ttcccagtggcctccgtgaa

SEQ ID NO: 712103 - DNA, 20 bp, Artificial
  CRISPR gRNA sequence
cagtggcctccgtgaatagc

SEQ ID NO: 712104 - DNA, 20 bp, Artificial
  CRISPR gRNA sequence
agtggcctccgtgaatagcc

SEQ ID NO: 712105 - DNA, 20 bp, Artificial
  CRISPR gRNA sequence
gtggcctccgtgaatagcca

SEQ ID NO: 712106 - DNA, 20 bp, Artificial
  CRISPR gRNA sequence
tgaatagccagggcctctaa

SEQ ID NO: 712107 - DNA, 20 bp, Artificial
  CRISPR gRNA sequence
gccagggcctctaacagtca

SEQ ID NO: 712108 - DNA, 20 bp, Artificial
  CRISPR gRNA sequence
agggcctctaacagtcacag

SEQ ID NO: 712109 - DNA, 20 bp, Artificial
  CRISPR gRNA sequence
ctaacagtcacagcagcctg

SEQ ID NO: 712110 - DNA, 20 bp, Artificial
  CRISPR gRNA sequence
gtcacagcagcctgtggcct

SEQ ID NO: 712111 - DNA, 20 bp, Artificial
  CRISPR gRNA sequence
ccccctgcccacatgcccct

SEQ ID NO: 712112 - DNA, 20 bp, Artificial
  CRISPR gRNA sequence
cccctgcccacatgcccctc

SEQ ID NO: 712113 - DNA, 20 bp, Artificial
  CRISPR gRNA sequence
ccctgcccacatgcccctcg

SEQ ID NO: 712114 - DNA, 20 bp, Artificial
  CRISPR gRNA sequence
catgcccctcggggtgctgc

SEQ ID NO: 712115 - DNA, 20 bp, Artificial
  CRISPR gRNA sequence
cctcggggtgctgctggcgc

SEQ ID NO: 712116 - DNA, 20 bp, Artificial
  CRISPR gRNA sequence
ctcggggtgctgctggcgct

SEQ ID NO: 712117 - DNA, 20 bp, Artificial
  CRISPR gRNA sequence
cggggtgctgctggcgctgg

SEQ ID NO: 712118 - DNA, 20 bp, Artificial
  CRISPR gRNA sequence
ggggtgctgctggcgctggg

SEQ ID NO: 712119 - DNA, 20 bp, Artificial
  CRISPR gRNA sequence
ctggcgctgggaggttgtga

SEQ ID NO: 712120 - DNA, 20 bp, Artificial
  CRISPR gRNA sequence
tggcgctgggaggttgtgat

SEQ ID NO: 712121 - DNA, 20 bp, Artificial
  CRISPR gRNA sequence
gctgggaggttgtgatgggc

SEQ ID NO: 712122 - DNA, 20 bp, Artificial
  CRISPR gRNA sequence
ctgggaggttgtgatgggct

SEQ ID NO: 712123 - DNA, 20 bp, Artificial
  CRISPR gRNA sequence
aggttgtgatgggctgggca

SEQ ID NO: 712124 - DNA, 20 bp, Artificial
  CRISPR gRNA sequence
ggttgtgatgggctgggcac

SEQ ID NO: 712125 - DNA, 20 bp, Artificial
  CRISPR gRNA sequence
gttgtgatgggctgggcaca

SEQ ID NO: 712126 - DNA, 20 bp, Artificial
  CRISPR gRNA sequence
gtgatgggctgggcacaggg

SEQ ID NO: 712127 - DNA, 20 bp, Artificial
  CRISPR gRNA sequence
tcgtgctgtgtctgtgcact

SEQ ID NO: 712128 - DNA, 20 bp, Artificial
  CRISPR gRNA sequence
gctgtgtctgtgcactcagt

SEQ ID NO: 712129 - DNA, 20 bp, Artificial
  CRISPR gRNA sequence
tcagtaagtgcttgtcaaaa

SEQ ID NO: 712130 - DNA, 20 bp, Artificial
  CRISPR gRNA sequence
gtgcttgtcaaaacagctcg

SEQ ID NO: 712131 - DNA, 20 bp, Artificial
  CRISPR gRNA sequence
tgcttgtcaaaacagctcgc

SEQ ID NO: 712132 - DNA, 20 bp, Artificial
  CRISPR gRNA sequence
tgtcaaaacagctcgcaggc

SEQ ID NO: 712133 - DNA, 20 bp, Artificial
  CRISPR gRNA sequence
gtcaaaacagctcgcaggcc

SEQ ID NO: 712134 - DNA, 20 bp, Artificial
  CRISPR gRNA sequence
aacagctcgcaggccgggca

SEQ ID NO: 712135 - DNA, 20 bp, Artificial
  CRISPR gRNA sequence
agctcgcaggccgggcatgg

SEQ ID NO: 712136 - DNA, 20 bp, Artificial
  CRISPR gRNA sequence
gtggctcatgcctataatcc

SEQ ID NO: 712137 - DNA, 20 bp, Artificial
  CRISPR gRNA sequence
tgcctataatcccagcaatt

SEQ ID NO: 712138 - DNA, 20 bp, Artificial
  CRISPR gRNA sequence
gcctataatcccagcaattt

SEQ ID NO: 712139 - DNA, 20 bp, Artificial
  CRISPR gRNA sequence
tataatcccagcaatttagg

SEQ ID NO: 712140 - DNA, 20 bp, Artificial
  CRISPR gRNA sequence
tcccagcaatttaggaagcc

SEQ ID NO: 712141 - DNA, 20 bp, Artificial
  CRISPR gRNA sequence
cccagcaatttaggaagcca

SEQ ID NO: 712142 - DNA, 20 bp, Artificial
  CRISPR gRNA sequence
agcaatttaggaagccaagg

SEQ ID NO: 712143 - DNA, 20 bp, Artificial
  CRISPR gRNA sequence
gcaatttaggaagccaaggt

SEQ ID NO: 712144 - DNA, 20 bp, Artificial
  CRISPR gRNA sequence
aatttaggaagccaaggtgg

SEQ ID NO: 712145 - DNA, 20 bp, Artificial
  CRISPR gRNA sequence
atttaggaagccaaggtggg

SEQ ID NO: 712146 - DNA, 20 bp, Artificial
  CRISPR gRNA sequence
ccaaggtgggaggaccattt

SEQ ID NO: 712147 - DNA, 20 bp, Artificial
  CRISPR gRNA sequence
gtgggaggaccatttgagtc

SEQ ID NO: 712148 - DNA, 20 bp, Artificial
  CRISPR gRNA sequence
tgggaggaccatttgagtcc

SEQ ID NO: 712149 - DNA, 20 bp, Artificial
  CRISPR gRNA sequence
ggaggaccatttgagtccag

SEQ ID NO: 712150 - DNA, 20 bp, Artificial
  CRISPR gRNA sequence
ccatttgagtccaggagttc

SEQ ID NO: 712151 - DNA, 20 bp, Artificial
  CRISPR gRNA sequence
atttgagtccaggagttcga

SEQ ID NO: 712152 - DNA, 20 bp, Artificial
  CRISPR gRNA sequence
tgagtccaggagttcgagag

SEQ ID NO: 712153 - DNA, 20 bp, Artificial
  CRISPR gRNA sequence
ccaggagttcgagagcagcc

SEQ ID NO: 712154 - DNA, 20 bp, Artificial
  CRISPR gRNA sequence
caggagttcgagagcagcct

SEQ ID NO: 712155 - DNA, 20 bp, Artificial
  CRISPR gRNA sequence
cgagagcagcctgggcaaca

SEQ ID NO: 712156 - DNA, 20 bp, Artificial
  CRISPR gRNA sequence
agcagcctgggcaacatagt

SEQ ID NO: 712157 - DNA, 20 bp, Artificial
  CRISPR gRNA sequence
gaaaaaaaattttttttaat

SEQ ID NO: 712158 - DNA, 20 bp, Artificial
  CRISPR gRNA sequence
aaaaattttttttaattagc

SEQ ID NO: 712159 - DNA, 20 bp, Artificial
  CRISPR gRNA sequence
aaaattttttttaattagcc

SEQ ID NO: 712160 - DNA, 20 bp, Artificial
  CRISPR gRNA sequence
tttttttaattagccaggca

SEQ ID NO: 712161 - DNA, 20 bp, Artificial
  CRISPR gRNA sequence
ttttaattagccaggcatgg

SEQ ID NO: 712162 - DNA, 20 bp, Artificial
  CRISPR gRNA sequence
ggcatggtagtgtgcaccta

SEQ ID NO: 712163 - DNA, 20 bp, Artificial
  CRISPR gRNA sequence
gtagtgtgcacctatagtcc

SEQ ID NO: 712164 - DNA, 20 bp, Artificial
  CRISPR gRNA sequence
ctatagtcccagccacttga

SEQ ID NO: 712165 - DNA, 20 bp, Artificial
  CRISPR gRNA sequence
tatagtcccagccacttgaa

SEQ ID NO: 712166 - DNA, 20 bp, Artificial
  CRISPR gRNA sequence
tcccagccacttgaaaggct

SEQ ID NO: 712167 - DNA, 20 bp, Artificial
  CRISPR gRNA sequence
cccagccacttgaaaggctg

SEQ ID NO: 712168 - DNA, 20 bp, Artificial
  CRISPR gRNA sequence
cacttgaaaggctgaggcaa

SEQ ID NO: 712169 - DNA, 20 bp, Artificial
  CRISPR gRNA sequence
acttgaaaggctgaggcaaa

SEQ ID NO: 712170 - DNA, 20 bp, Artificial
  CRISPR gRNA sequence
gcaaaaggatcatgtgatcc

SEQ ID NO: 712171 - DNA, 20 bp, Artificial
  CRISPR gRNA sequence
caaaaggatcatgtgatcct

SEQ ID NO: 712172 - DNA, 20 bp, Artificial
  CRISPR gRNA sequence
aaaggatcatgtgatcctgg

SEQ ID NO: 712173 - DNA, 20 bp, Artificial
  CRISPR gRNA sequence
aaggatcatgtgatcctggg

SEQ ID NO: 712174 - DNA, 20 bp, Artificial
  CRISPR gRNA sequence
catgtgatcctgggaggtca

SEQ ID NO: 712175 - DNA, 20 bp, Artificial
  CRISPR gRNA sequence
atcctgggaggtcacagctg

SEQ ID NO: 712176 - DNA, 20 bp, Artificial
  CRISPR gRNA sequence
tcctgggaggtcacagctgc

SEQ ID NO: 712177 - DNA, 20 bp, Artificial
  CRISPR gRNA sequence
cctgggaggtcacagctgca

SEQ ID NO: 712178 - DNA, 20 bp, Artificial
  CRISPR gRNA sequence
tgggaggtcacagctgcagg

SEQ ID NO: 712179 - DNA, 20 bp, Artificial
  CRISPR gRNA sequence
atgatcccaccaccgtactg

SEQ ID NO: 712180 - DNA, 20 bp, Artificial
  CRISPR gRNA sequence
cccaccaccgtactgcagct

SEQ ID NO: 712181 - DNA, 20 bp, Artificial
  CRISPR gRNA sequence
ccaccaccgtactgcagctt

SEQ ID NO: 712182 - DNA, 20 bp, Artificial
  CRISPR gRNA sequence
accgtactgcagcttgggtg

SEQ ID NO: 712183 - DNA, 20 bp, Artificial
  CRISPR gRNA sequence
ccgtactgcagcttgggtga

SEQ ID NO: 712184 - DNA, 20 bp, Artificial
  CRISPR gRNA sequence
gtactgcagcttgggtgaag

SEQ ID NO: 712185 - DNA, 20 bp, Artificial
  CRISPR gRNA sequence
tgcagcttgggtgaaggagt

SEQ ID NO: 712186 - DNA, 20 bp, Artificial
  CRISPR gRNA sequence
tgaaggagtgagaccctgtc

SEQ ID NO: 712187 - DNA, 20 bp, Artificial
  CRISPR gRNA sequence
gaaggagtgagaccctgtct

SEQ ID NO: 712188 - DNA, 20 bp, Artificial
  CRISPR gRNA sequence
ctgtctgggaaaaaaaaaaa

SEQ ID NO: 712189 - DNA, 20 bp, Artificial
  CRISPR gRNA sequence
gggaaaaaaaaaaaaagaat

SEQ ID NO: 712190 - DNA, 20 bp, Artificial
  CRISPR gRNA sequence
aaaaaaaaaaaaagaataag

SEQ ID NO: 712191 - DNA, 20 bp, Artificial
  CRISPR gRNA sequence
aaaaaagaataagtggctca

SEQ ID NO: 712192 - DNA, 20 bp, Artificial
  CRISPR gRNA sequence
aaaaagaataagtggctcat

SEQ ID NO: 712193 - DNA, 20 bp, Artificial
  CRISPR gRNA sequence
aaaagaataagtggctcata

SEQ ID NO: 712194 - DNA, 20 bp, Artificial
  CRISPR gRNA sequence
aaagaataagtggctcatag

SEQ ID NO: 712195 - DNA, 20 bp, Artificial
  CRISPR gRNA sequence
gaataagtggctcatagggg

SEQ ID NO: 712196 - DNA, 20 bp, Artificial
  CRISPR gRNA sequence
aagtggctcataggggcagc

SEQ ID NO: 712197 - DNA, 20 bp, Artificial
  CRISPR gRNA sequence
tggctcataggggcagcgag

SEQ ID NO: 712198 - DNA, 20 bp, Artificial
  CRISPR gRNA sequence
gctcataggggcagcgagtg

SEQ ID NO: 712199 - DNA, 20 bp, Artificial
  CRISPR gRNA sequence
cataggggcagcgagtggag

SEQ ID NO: 712200 - DNA, 20 bp, Artificial
  CRISPR gRNA sequence
gggcagcgagtggagtggac

SEQ ID NO: 712201 - DNA, 20 bp, Artificial
  CRISPR gRNA sequence
gagtggagtggacgagaacc

SEQ ID NO: 712202 - DNA, 20 bp, Artificial
  CRISPR gRNA sequence
gtggacgagaacctggaacc

SEQ ID NO: 712203 - DNA, 20 bp, Artificial
  CRISPR gRNA sequence
gacgagaacctggaacctgg

SEQ ID NO: 712204 - DNA, 20 bp, Artificial
  CRISPR gRNA sequence
ggaacctggtggcacctgtc

SEQ ID NO: 712205 - DNA, 20 bp, Artificial
  CRISPR gRNA sequence
gaacctggtggcacctgtct

SEQ ID NO: 712206 - DNA, 20 bp, Artificial
  CRISPR gRNA sequence
acctgtctgggttcaaactc

SEQ ID NO: 712207 - DNA, 20 bp, Artificial
  CRISPR gRNA sequence
tgggttcaaactccagccca

SEQ ID NO: 712208 - DNA, 20 bp, Artificial
  CRISPR gRNA sequence
aaactccagcccacagccct

SEQ ID NO: 712209 - DNA, 20 bp, Artificial
  CRISPR gRNA sequence
ctccagcccacagcccttgg

SEQ ID NO: 712210 - DNA, 20 bp, Artificial
  CRISPR gRNA sequence
ggaagttccctgacttccca

SEQ ID NO: 712211 - DNA, 20 bp, Artificial
  CRISPR gRNA sequence
ctccgtttcctcctctgtaa

SEQ ID NO: 712212 - DNA, 20 bp, Artificial
  CRISPR gRNA sequence
tccgtttcctcctctgtaaa

SEQ ID NO: 712213 - DNA, 20 bp, Artificial
  CRISPR gRNA sequence
ccgtttcctcctctgtaaaa

SEQ ID NO: 712214 - DNA, 20 bp, Artificial
  CRISPR gRNA sequence
cgtttcctcctctgtaaaag

SEQ ID NO: 712215 - DNA, 20 bp, Artificial
  CRISPR gRNA sequence
tgatcacaatgcttgaatca

SEQ ID NO: 712216 - DNA, 20 bp, Artificial
  CRISPR gRNA sequence
atcacaatgcttgaatcaca

SEQ ID NO: 712217 - DNA, 20 bp, Artificial
  CRISPR gRNA sequence
acaatgcttgaatcacagag

SEQ ID NO: 712218 - DNA, 20 bp, Artificial
  CRISPR gRNA sequence
gagtagttacaaacattgat

SEQ ID NO: 712219 - DNA, 20 bp, Artificial
  CRISPR gRNA sequence
gttacaaacattgatgagcc

SEQ ID NO: 712220 - DNA, 20 bp, Artificial
  CRISPR gRNA sequence
aaacattgatgagccgagtt

SEQ ID NO: 712221 - DNA, 20 bp, Artificial
  CRISPR gRNA sequence
ttgatgagccgagtttggaa

SEQ ID NO: 712222 - DNA, 20 bp, Artificial
  CRISPR gRNA sequence
tgatgagccgagtttggaac

SEQ ID NO: 712223 - DNA, 20 bp, Artificial
  CRISPR gRNA sequence
tgagccgagtttggaacagg

SEQ ID NO: 712224 - DNA, 20 bp, Artificial
  CRISPR gRNA sequence
gagccgagtttggaacaggt

SEQ ID NO: 712225 - DNA, 20 bp, Artificial
  CRISPR gRNA sequence
ggtgattcacaaacgcttcc

SEQ ID NO: 712226 - DNA, 20 bp, Artificial
  CRISPR gRNA sequence
gattcacaaacgcttcctgg

SEQ ID NO: 712227 - DNA, 20 bp, Artificial
  CRISPR gRNA sequence
attcacaaacgcttcctgga

SEQ ID NO: 712228 - DNA, 20 bp, Artificial
  CRISPR gRNA sequence
ggaaggaaataatatgccaa

SEQ ID NO: 712229 - DNA, 20 bp, Artificial
  CRISPR gRNA sequence
aggaaataatatgccaatgg

SEQ ID NO: 712230 - DNA, 20 bp, Artificial
  CRISPR gRNA sequence
gccaatggaagccctctgaa

SEQ ID NO: 712231 - DNA, 20 bp, Artificial
  CRISPR gRNA sequence
caatggaagccctctgaaaa

SEQ ID NO: 712232 - DNA, 20 bp, Artificial
  CRISPR gRNA sequence
aatggaagccctctgaaaag

SEQ ID NO: 712233 - DNA, 20 bp, Artificial
  CRISPR gRNA sequence
catcaaaaacccacaaacat

SEQ ID NO: 712234 - DNA, 20 bp, Artificial
  CRISPR gRNA sequence
atcaaaaacccacaaacata

SEQ ID NO: 712235 - DNA, 20 bp, Artificial
  CRISPR gRNA sequence
tcaaaaacccacaaacataa

SEQ ID NO: 712236 - DNA, 20 bp, Artificial
  CRISPR gRNA sequence
caaaaacccacaaacataag

SEQ ID NO: 712237 - DNA, 20 bp, Artificial
  CRISPR gRNA sequence
aaaaacccacaaacataagg

SEQ ID NO: 712238 - DNA, 20 bp, Artificial
  CRISPR gRNA sequence
aaacccacaaacataagggg

SEQ ID NO: 712239 - DNA, 20 bp, Artificial
  CRISPR gRNA sequence
cccacaaacataagggggag

SEQ ID NO: 712240 - DNA, 20 bp, Artificial
  CRISPR gRNA sequence
acataagggggagtagttac

SEQ ID NO: 712241 - DNA, 20 bp, Artificial
  CRISPR gRNA sequence
taagggggagtagttactgg

SEQ ID NO: 712242 - DNA, 20 bp, Artificial
  CRISPR gRNA sequence
gagtagttactggaagttca

SEQ ID NO: 712243 - DNA, 20 bp, Artificial
  CRISPR gRNA sequence
aagttcacggttcaaaaatg

SEQ ID NO: 712244 - DNA, 20 bp, Artificial
  CRISPR gRNA sequence
gttcacggttcaaaaatgca

SEQ ID NO: 712245 - DNA, 20 bp, Artificial
  CRISPR gRNA sequence
tcacggttcaaaaatgcaga

SEQ ID NO: 712246 - DNA, 20 bp, Artificial
  CRISPR gRNA sequence
cacggttcaaaaatgcagag

SEQ ID NO: 712247 - DNA, 20 bp, Artificial
  CRISPR gRNA sequence
aaaatgcagagaggtaaact

SEQ ID NO: 712248 - DNA, 20 bp, Artificial
  CRISPR gRNA sequence
aaatgcagagaggtaaactg

SEQ ID NO: 712249 - DNA, 20 bp, Artificial
  CRISPR gRNA sequence
cagagaggtaaactgaggcc

SEQ ID NO: 712250 - DNA, 20 bp, Artificial
  CRISPR gRNA sequence
agagaggtaaactgaggccc

SEQ ID NO: 712251 - DNA, 20 bp, Artificial
  CRISPR gRNA sequence
gagaggtaaactgaggcccg

SEQ ID NO: 712252 - DNA, 20 bp, Artificial
  CRISPR gRNA sequence
gaggtaaactgaggcccggg

SEQ ID NO: 712253 - DNA, 20 bp, Artificial
  CRISPR gRNA sequence
aggtaaactgaggcccgggg

SEQ ID NO: 712254 - DNA, 20 bp, Artificial
  CRISPR gRNA sequence
ggtaaactgaggcccgggga

SEQ ID NO: 712255 - DNA, 20 bp, Artificial
  CRISPR gRNA sequence
actgaggcccggggagggac

SEQ ID NO: 712256 - DNA, 20 bp, Artificial
  CRISPR gRNA sequence
ctgaggcccggggagggacg

SEQ ID NO: 712257 - DNA, 20 bp, Artificial
  CRISPR gRNA sequence
agggacgaggcccttacctc

SEQ ID NO: 712258 - DNA, 20 bp, Artificial
  CRISPR gRNA sequence
cgaggcccttacctcgagaa

SEQ ID NO: 712259 - DNA, 20 bp, Artificial
  CRISPR gRNA sequence
tacctcgagaacagctcacg

SEQ ID NO: 712260 - DNA, 20 bp, Artificial
  CRISPR gRNA sequence
acctcgagaacagctcacgc

SEQ ID NO: 712261 - DNA, 20 bp, Artificial
  CRISPR gRNA sequence
aacagctcacgcaggccgtg

SEQ ID NO: 712262 - DNA, 20 bp, Artificial
  CRISPR gRNA sequence
agctcacgcaggccgtgcag

SEQ ID NO: 712263 - DNA, 20 bp, Artificial
  CRISPR gRNA sequence
cacgcaggccgtgcagcggc

SEQ ID NO: 712264 - DNA, 20 bp, Artificial
  CRISPR gRNA sequence
gtgcagcggccggcctcgtc

SEQ ID NO: 712265 - DNA, 20 bp, Artificial
  CRISPR gRNA sequence
tgcagcggccggcctcgtcc

SEQ ID NO: 712266 - DNA, 20 bp, Artificial
  CRISPR gRNA sequence
agcggccggcctcgtccagg

SEQ ID NO: 712267 - DNA, 20 bp, Artificial
  CRISPR gRNA sequence
ggccggcctcgtccaggtag

SEQ ID NO: 712268 - DNA, 20 bp, Artificial
  CRISPR gRNA sequence
ggcctcgtccaggtagtagt

SEQ ID NO: 712269 - DNA, 20 bp, Artificial
  CRISPR gRNA sequence
gcctcgtccaggtagtagtc

SEQ ID NO: 712270 - DNA, 20 bp, Artificial
  CRISPR gRNA sequence
acactgctttctgcaatcac

SEQ ID NO: 712271 - DNA, 20 bp, Artificial
  CRISPR gRNA sequence
ctgcaatcaccagacccctc

SEQ ID NO: 712272 - DNA, 20 bp, Artificial
  CRISPR gRNA sequence
tgcaatcaccagacccctct

SEQ ID NO: 712273 - DNA, 20 bp, Artificial
  CRISPR gRNA sequence
tcaccagacccctctgggca

SEQ ID NO: 712274 - DNA, 20 bp, Artificial
  CRISPR gRNA sequence
ccctctgggcatggctgtgt

SEQ ID NO: 712275 - DNA, 20 bp, Artificial
  CRISPR gRNA sequence
cctctgggcatggctgtgtt

SEQ ID NO: 712276 - DNA, 20 bp, Artificial
  CRISPR gRNA sequence
ctctgggcatggctgtgttg

SEQ ID NO: 712277 - DNA, 20 bp, Artificial
  CRISPR gRNA sequence
gggcatggctgtgttgggga

SEQ ID NO: 712278 - DNA, 20 bp, Artificial
  CRISPR gRNA sequence
ggctgtgttggggacagacc

SEQ ID NO: 712279 - DNA, 20 bp, Artificial
  CRISPR gRNA sequence
gctgtgttggggacagacct

SEQ ID NO: 712280 - DNA, 20 bp, Artificial
  CRISPR gRNA sequence
ctgtgttggggacagacctg

SEQ ID NO: 712281 - DNA, 20 bp, Artificial
  CRISPR gRNA sequence
gttggggacagacctgggga

SEQ ID NO: 712282 - DNA, 20 bp, Artificial
  CRISPR gRNA sequence
ggggacagacctggggaaag

SEQ ID NO: 712283 - DNA, 20 bp, Artificial
  CRISPR gRNA sequence
gacagacctggggaaagaag

SEQ ID NO: 712284 - DNA, 20 bp, Artificial
  CRISPR gRNA sequence
cagacctggggaaagaagca

SEQ ID NO: 712285 - DNA, 20 bp, Artificial
  CRISPR gRNA sequence
acctggggaaagaagcagag

SEQ ID NO: 712286 - DNA, 20 bp, Artificial
  CRISPR gRNA sequence
ggaaagaagcagagaagctg

SEQ ID NO: 712287 - DNA, 20 bp, Artificial
  CRISPR gRNA sequence
gaaagaagcagagaagctgc

SEQ ID NO: 712288 - DNA, 20 bp, Artificial
  CRISPR gRNA sequence
gaagcagagaagctgcaggc

SEQ ID NO: 712289 - DNA, 20 bp, Artificial
  CRISPR gRNA sequence
aagcagagaagctgcaggcc

SEQ ID NO: 712290 - DNA, 20 bp, Artificial
  CRISPR gRNA sequence
agctgcaggccaggccgcct

SEQ ID NO: 712291 - DNA, 20 bp, Artificial
  CRISPR gRNA sequence
caggccaggccgccttggca

SEQ ID NO: 712292 - DNA, 20 bp, Artificial
  CRISPR gRNA sequence
aggccaggccgccttggcaa

SEQ ID NO: 712293 - DNA, 20 bp, Artificial
  CRISPR gRNA sequence
tcactccccacccaaccctg

SEQ ID NO: 712294 - DNA, 20 bp, Artificial
  CRISPR gRNA sequence
aagccccccatccctcaccg

SEQ ID NO: 712295 - DNA, 20 bp, Artificial
  CRISPR gRNA sequence
cccccatccctcaccgtggc

SEQ ID NO: 712296 - DNA, 20 bp, Artificial
  CRISPR gRNA sequence
agctcccaaactccgcatgt

SEQ ID NO: 712297 - DNA, 20 bp, Artificial
  CRISPR gRNA sequence
ccaaactccgcatgtcagct

SEQ ID NO: 712298 - DNA, 20 bp, Artificial
  CRISPR gRNA sequence
ctccgcatgtcagctcagtc

SEQ ID NO: 712299 - DNA, 20 bp, Artificial
  CRISPR gRNA sequence
gtcagctcagtccagccttt

SEQ ID NO: 712300 - DNA, 20 bp, Artificial
  CRISPR gRNA sequence
cagctcagtccagcctttca

SEQ ID NO: 712301 - DNA, 20 bp, Artificial
  CRISPR gRNA sequence
agctcagtccagcctttcag

SEQ ID NO: 712302 - DNA, 20 bp, Artificial
  CRISPR gRNA sequence
gctcagtccagcctttcaga

SEQ ID NO: 712303 - DNA, 20 bp, Artificial
  CRISPR gRNA sequence
tcagtccagcctttcagagg

SEQ ID NO: 712304 - DNA, 20 bp, Artificial
  CRISPR gRNA sequence
agcctttcagagggagtcct

SEQ ID NO: 712305 - DNA, 20 bp, Artificial
  CRISPR gRNA sequence
gcctttcagagggagtcctg

SEQ ID NO: 712306 - DNA, 20 bp, Artificial
  CRISPR gRNA sequence
tcagagggagtcctgaggct

SEQ ID NO: 712307 - DNA, 20 bp, Artificial
  CRISPR gRNA sequence
agagggagtcctgaggctca

SEQ ID NO: 712308 - DNA, 20 bp, Artificial
  CRISPR gRNA sequence
agggagtcctgaggctcaga

SEQ ID NO: 712309 - DNA, 20 bp, Artificial
  CRISPR gRNA sequence
gggagtcctgaggctcagag

SEQ ID NO: 712310 - DNA, 20 bp, Artificial
  CRISPR gRNA sequence
gtcctgaggctcagagagga

SEQ ID NO: 712311 - DNA, 20 bp, Artificial
  CRISPR gRNA sequence
tcctgaggctcagagaggac

SEQ ID NO: 712312 - DNA, 20 bp, Artificial
  CRISPR gRNA sequence
atgctgcgtgcattccacac

SEQ ID NO: 712313 - DNA, 20 bp, Artificial
  CRISPR gRNA sequence
gctgcgtgcattccacacga

SEQ ID NO: 712314 - DNA, 20 bp, Artificial
  CRISPR gRNA sequence
ctgcgtgcattccacacgag

SEQ ID NO: 712315 - DNA, 20 bp, Artificial
  CRISPR gRNA sequence
gcgtgcattccacacgagag

SEQ ID NO: 712316 - DNA, 20 bp, Artificial
  CRISPR gRNA sequence
cgtgcattccacacgagagg

SEQ ID NO: 712317 - DNA, 20 bp, Artificial
  CRISPR gRNA sequence
gtgcattccacacgagagga

SEQ ID NO: 712318 - DNA, 20 bp, Artificial
  CRISPR gRNA sequence
ggtactcattgccccccaac

SEQ ID NO: 712319 - DNA, 20 bp, Artificial
  CRISPR gRNA sequence
ccctgcccactgttcctcct

SEQ ID NO: 712320 - DNA, 20 bp, Artificial
  CRISPR gRNA sequence
cctgcccactgttcctcctg

SEQ ID NO: 712321 - DNA, 20 bp, Artificial
  CRISPR gRNA sequence
ctcctgaggccaccatgcca

SEQ ID NO: 712322 - DNA, 20 bp, Artificial
  CRISPR gRNA sequence
cttcccccaaccctgtctca

SEQ ID NO: 712323 - DNA, 20 bp, Artificial
  CRISPR gRNA sequence
cactcccctgctcaaaactt

SEQ ID NO: 712324 - DNA, 20 bp, Artificial
  CRISPR gRNA sequence
actcccctgctcaaaacttt

SEQ ID NO: 712325 - DNA, 20 bp, Artificial
  CRISPR gRNA sequence
cctgctcaaaactttgggaa

SEQ ID NO: 712326 - DNA, 20 bp, Artificial
  CRISPR gRNA sequence
actttgggaacagcttccct

SEQ ID NO: 712327 - DNA, 20 bp, Artificial
  CRISPR gRNA sequence
tttgggaacagcttccctga

SEQ ID NO: 712328 - DNA, 20 bp, Artificial
  CRISPR gRNA sequence
gaacagcttccctgagagct

SEQ ID NO: 712329 - DNA, 20 bp, Artificial
  CRISPR gRNA sequence
tccctgagagctcagcacac

SEQ ID NO: 712330 - DNA, 20 bp, Artificial
  CRISPR gRNA sequence
acactagcgtaactcctgtt

SEQ ID NO: 712331 - DNA, 20 bp, Artificial
  CRISPR gRNA sequence
agcgtaactcctgttcagaa

SEQ ID NO: 712332 - DNA, 20 bp, Artificial
  CRISPR gRNA sequence
actcctgttcagaatggtat

SEQ ID NO: 712333 - DNA, 20 bp, Artificial
  CRISPR gRNA sequence
ctcctgttcagaatggtatt

SEQ ID NO: 712334 - DNA, 20 bp, Artificial
  CRISPR gRNA sequence
ctgttcagaatggtattggg

SEQ ID NO: 712335 - DNA, 20 bp, Artificial
  CRISPR gRNA sequence
tgttcagaatggtattgggc

SEQ ID NO: 712336 - DNA, 20 bp, Artificial
  CRISPR gRNA sequence
gttcagaatggtattgggca

SEQ ID NO: 712337 - DNA, 20 bp, Artificial
  CRISPR gRNA sequence
tcagaatggtattgggcagg

SEQ ID NO: 712338 - DNA, 20 bp, Artificial
  CRISPR gRNA sequence
cagaatggtattgggcaggg

SEQ ID NO: 712339 - DNA, 20 bp, Artificial
  CRISPR gRNA sequence
agaatggtattgggcaggga

SEQ ID NO: 712340 - DNA, 20 bp, Artificial
  CRISPR gRNA sequence
gaatggtattgggcagggag

SEQ ID NO: 712341 - DNA, 20 bp, Artificial
  CRISPR gRNA sequence
ggtattgggcagggaggggc

SEQ ID NO: 712342 - DNA, 20 bp, Artificial
  CRISPR gRNA sequence
gtattgggcagggaggggct

SEQ ID NO: 712343 - DNA, 20 bp, Artificial
  CRISPR gRNA sequence
cctcctgcctccctctttta

SEQ ID NO: 712344 - DNA, 20 bp, Artificial
  CRISPR gRNA sequence
tgcctccctcttttaaagac

SEQ ID NO: 712345 - DNA, 20 bp, Artificial
  CRISPR gRNA sequence
ccctcttttaaagactggtg

SEQ ID NO: 712346 - DNA, 20 bp, Artificial
  CRISPR gRNA sequence
cctcttttaaagactggtgt

SEQ ID NO: 712347 - DNA, 20 bp, Artificial
  CRISPR gRNA sequence
ttttaaagactggtgtgggc

SEQ ID NO: 712348 - DNA, 20 bp, Artificial
  CRISPR gRNA sequence
tttaaagactggtgtgggcc

SEQ ID NO: 712349 - DNA, 20 bp, Artificial
  CRISPR gRNA sequence
agactggtgtgggccgggcg

SEQ ID NO: 712350 - DNA, 20 bp, Artificial
  CRISPR gRNA sequence
ctggtgtgggccgggcgcgg

SEQ ID NO: 712351 - DNA, 20 bp, Artificial
  CRISPR gRNA sequence
gtggctcacgtctgtaatcc

SEQ ID NO: 712352 - DNA, 20 bp, Artificial
  CRISPR gRNA sequence
cgtctgtaatcccagcactt

SEQ ID NO: 712353 - DNA, 20 bp, Artificial
  CRISPR gRNA sequence
gtctgtaatcccagcacttt

SEQ ID NO: 712354 - DNA, 20 bp, Artificial
  CRISPR gRNA sequence
ctgtaatcccagcactttgg

SEQ ID NO: 712355 - DNA, 20 bp, Artificial
  CRISPR gRNA sequence
tgtaatcccagcactttggg

SEQ ID NO: 712356 - DNA, 20 bp, Artificial
  CRISPR gRNA sequence
tcccagcactttgggaggct

SEQ ID NO: 712357 - DNA, 20 bp, Artificial
  CRISPR gRNA sequence
cccagcactttgggaggctg

SEQ ID NO: 712358 - DNA, 20 bp, Artificial
  CRISPR gRNA sequence
agcactttgggaggctgagg

SEQ ID NO: 712359 - DNA, 20 bp, Artificial
  CRISPR gRNA sequence
gcactttgggaggctgaggc

SEQ ID NO: 712360 - DNA, 20 bp, Artificial
  CRISPR gRNA sequence
ctttgggaggctgaggcggg

SEQ ID NO: 712361 - DNA, 20 bp, Artificial
  CRISPR gRNA sequence
ctgaggcgggtggattactt

SEQ ID NO: 712362 - DNA, 20 bp, Artificial
  CRISPR gRNA sequence
tgaggcgggtggattacttg

SEQ ID NO: 712363 - DNA, 20 bp, Artificial
  CRISPR gRNA sequence
gcgggtggattacttgaggc

SEQ ID NO: 712364 - DNA, 20 bp, Artificial
  CRISPR gRNA sequence
cgggtggattacttgaggcc

SEQ ID NO: 712365 - DNA, 20 bp, Artificial
  CRISPR gRNA sequence
ggtggattacttgaggccag

SEQ ID NO: 712366 - DNA, 20 bp, Artificial
  CRISPR gRNA sequence
tgaggccaggagtttgtgac

SEQ ID NO: 712367 - DNA, 20 bp, Artificial
  CRISPR gRNA sequence
ccaggagtttgtgaccagcc

SEQ ID NO: 712368 - DNA, 20 bp, Artificial
  CRISPR gRNA sequence
tgtgaccagcctggccaaca

SEQ ID NO: 712369 - DNA, 20 bp, Artificial
  CRISPR gRNA sequence
accccgtctctactaaaaaa

SEQ ID NO: 712370 - DNA, 20 bp, Artificial
  CRISPR gRNA sequence
gtctctactaaaaaaaagaa

SEQ ID NO: 712371 - DNA, 20 bp, Artificial
  CRISPR gRNA sequence
tctactaaaaaaaagaaaag

SEQ ID NO: 712372 - DNA, 20 bp, Artificial
  CRISPR gRNA sequence
aaaagaaaagtagccaaatg

SEQ ID NO: 712373 - DNA, 20 bp, Artificial
  CRISPR gRNA sequence
agaaaagtagccaaatgtgg

SEQ ID NO: 712374 - DNA, 20 bp, Artificial
  CRISPR gRNA sequence
aaagtagccaaatgtggtgg

SEQ ID NO: 712375 - DNA, 20 bp, Artificial
  CRISPR gRNA sequence
aagtagccaaatgtggtggc

SEQ ID NO: 712376 - DNA, 20 bp, Artificial
  CRISPR gRNA sequence
gtggcaggcgcctgtaatcc

SEQ ID NO: 712377 - DNA, 20 bp, Artificial
  CRISPR gRNA sequence
cgcctgtaatcccagctact

SEQ ID NO: 712378 - DNA, 20 bp, Artificial
  CRISPR gRNA sequence
gcctgtaatcccagctactc

SEQ ID NO: 712379 - DNA, 20 bp, Artificial
  CRISPR gRNA sequence
ctgtaatcccagctactcgg

SEQ ID NO: 712380 - DNA, 20 bp, Artificial
  CRISPR gRNA sequence
tgtaatcccagctactcggg

SEQ ID NO: 712381 - DNA, 20 bp, Artificial
  CRISPR gRNA sequence
tcccagctactcgggaggct

SEQ ID NO: 712382 - DNA, 20 bp, Artificial
  CRISPR gRNA sequence
cccagctactcgggaggctg

SEQ ID NO: 712383 - DNA, 20 bp, Artificial
  CRISPR gRNA sequence
agctactcgggaggctgagg

SEQ ID NO: 712384 - DNA, 20 bp, Artificial
  CRISPR gRNA sequence
gctactcgggaggctgaggc

SEQ ID NO: 712385 - DNA, 20 bp, Artificial
  CRISPR gRNA sequence
tactcgggaggctgaggcag

SEQ ID NO: 712386 - DNA, 20 bp, Artificial
  CRISPR gRNA sequence
gcaggagaattgcttgaacc

SEQ ID NO: 712387 - DNA, 20 bp, Artificial
  CRISPR gRNA sequence
caggagaattgcttgaaccc

SEQ ID NO: 712388 - DNA, 20 bp, Artificial
  CRISPR gRNA sequence
ggagaattgcttgaacccag

SEQ ID NO: 712389 - DNA, 20 bp, Artificial
  CRISPR gRNA sequence
gagaattgcttgaacccagg

SEQ ID NO: 712390 - DNA, 20 bp, Artificial
  CRISPR gRNA sequence
aattgcttgaacccaggagg

SEQ ID NO: 712391 - DNA, 20 bp, Artificial
  CRISPR gRNA sequence
ttgcttgaacccaggaggcg

SEQ ID NO: 712392 - DNA, 20 bp, Artificial
  CRISPR gRNA sequence
tgcttgaacccaggaggcgg

SEQ ID NO: 712393 - DNA, 20 bp, Artificial
  CRISPR gRNA sequence
aacccaggaggcggaggttg

SEQ ID NO: 712394 - DNA, 20 bp, Artificial
  CRISPR gRNA sequence
caggaggcggaggttgcagt

SEQ ID NO: 712395 - DNA, 20 bp, Artificial
  CRISPR gRNA sequence
ggcggaggttgcagtgagcc

SEQ ID NO: 712396 - DNA, 20 bp, Artificial
  CRISPR gRNA sequence
gagatcacgccactgcactc

SEQ ID NO: 712397 - DNA, 20 bp, Artificial
  CRISPR gRNA sequence
cacgccactgcactccagtc

SEQ ID NO: 712398 - DNA, 20 bp, Artificial
  CRISPR gRNA sequence
acgccactgcactccagtct

SEQ ID NO: 712399 - DNA, 20 bp, Artificial
  CRISPR gRNA sequence
ctgcactccagtctgggcga

SEQ ID NO: 712400 - DNA, 20 bp, Artificial
  CRISPR gRNA sequence
gcactccagtctgggcgaca

SEQ ID NO: 712401 - DNA, 20 bp, Artificial
  CRISPR gRNA sequence
tccagtctgggcgacagagc

SEQ ID NO: 712402 - DNA, 20 bp, Artificial
  CRISPR gRNA sequence
aaccacaaacaaacaaacaa

SEQ ID NO: 712403 - DNA, 20 bp, Artificial
  CRISPR gRNA sequence
caaacaaacaaaagacatca

SEQ ID NO: 712404 - DNA, 20 bp, Artificial
  CRISPR gRNA sequence
aacaaacaaaagacatcata

SEQ ID NO: 712405 - DNA, 20 bp, Artificial
  CRISPR gRNA sequence
caaacaaaagacatcataga

SEQ ID NO: 712406 - DNA, 20 bp, Artificial
  CRISPR gRNA sequence
aaagacatcatagagagaat

SEQ ID NO: 712407 - DNA, 20 bp, Artificial
  CRISPR gRNA sequence
catcatagagagaataagca

SEQ ID NO: 712408 - DNA, 20 bp, Artificial
  CRISPR gRNA sequence
agagagaataagcaaagcca

SEQ ID NO: 712409 - DNA, 20 bp, Artificial
  CRISPR gRNA sequence
agagaataagcaaagccatg

SEQ ID NO: 712410 - DNA, 20 bp, Artificial
  CRISPR gRNA sequence
gaataagcaaagccatggag

SEQ ID NO: 712411 - DNA, 20 bp, Artificial
  CRISPR gRNA sequence
aataagcaaagccatggagc

SEQ ID NO: 712412 - DNA, 20 bp, Artificial
  CRISPR gRNA sequence
taagcaaagccatggagcgg

SEQ ID NO: 712413 - DNA, 20 bp, Artificial
  CRISPR gRNA sequence
gcaaagccatggagcgggag

SEQ ID NO: 712414 - DNA, 20 bp, Artificial
  CRISPR gRNA sequence
caaagccatggagcgggaga

SEQ ID NO: 712415 - DNA, 20 bp, Artificial
  CRISPR gRNA sequence
agcgggagaaggtacaacta

SEQ ID NO: 712416 - DNA, 20 bp, Artificial
  CRISPR gRNA sequence
gcgggagaaggtacaactat

SEQ ID NO: 712417 - DNA, 20 bp, Artificial
  CRISPR gRNA sequence
agaaggtacaactataggaa

SEQ ID NO: 712418 - DNA, 20 bp, Artificial
  CRISPR gRNA sequence
aaggtacaactataggaaaa

SEQ ID NO: 712419 - DNA, 20 bp, Artificial
  CRISPR gRNA sequence
gagctccaacccaaaattgt

SEQ ID NO: 712420 - DNA, 20 bp, Artificial
  CRISPR gRNA sequence
ctccaacccaaaattgttag

SEQ ID NO: 712421 - DNA, 20 bp, Artificial
  CRISPR gRNA sequence
tttttttacaaaaccaaccc

SEQ ID NO: 712422 - DNA, 20 bp, Artificial
  CRISPR gRNA sequence
tttttacaaaaccaacccaa

SEQ ID NO: 712423 - DNA, 20 bp, Artificial
  CRISPR gRNA sequence
tacaaaaccaacccaagaga

SEQ ID NO: 712424 - DNA, 20 bp, Artificial
  CRISPR gRNA sequence
acaaaaccaacccaagagaa

SEQ ID NO: 712425 - DNA, 20 bp, Artificial
  CRISPR gRNA sequence
aaccaacccaagagaaagga

SEQ ID NO: 712426 - DNA, 20 bp, Artificial
  CRISPR gRNA sequence
aaggaaagcacatacacgca

SEQ ID NO: 712427 - DNA, 20 bp, Artificial
  CRISPR gRNA sequence
gtatttttctttcttcatta

SEQ ID NO: 712428 - DNA, 20 bp, Artificial
  CRISPR gRNA sequence
tctttcttcattatagtcaa

SEQ ID NO: 712429 - DNA, 20 bp, Artificial
  CRISPR gRNA sequence
ctttcttcattatagtcaaa

SEQ ID NO: 712430 - DNA, 20 bp, Artificial
  CRISPR gRNA sequence
tcttcattatagtcaaaagg

SEQ ID NO: 712431 - DNA, 20 bp, Artificial
  CRISPR gRNA sequence
caacccaaatattcaaaaac

SEQ ID NO: 712432 - DNA, 20 bp, Artificial
  CRISPR gRNA sequence
atattcaaaaactggataaa

SEQ ID NO: 712433 - DNA, 20 bp, Artificial
  CRISPR gRNA sequence
attcaaaaactggataaaca

SEQ ID NO: 712434 - DNA, 20 bp, Artificial
  CRISPR gRNA sequence
aaaactggataaacagagct

SEQ ID NO: 712435 - DNA, 20 bp, Artificial
  CRISPR gRNA sequence
agctcggcatatctacgcca

SEQ ID NO: 712436 - DNA, 20 bp, Artificial
  CRISPR gRNA sequence
ctcggcatatctacgccatg

SEQ ID NO: 712437 - DNA, 20 bp, Artificial
  CRISPR gRNA sequence
tcggcatatctacgccatgg

SEQ ID NO: 712438 - DNA, 20 bp, Artificial
  CRISPR gRNA sequence
cggcatatctacgccatgga

SEQ ID NO: 712439 - DNA, 20 bp, Artificial
  CRISPR gRNA sequence
ctacgccatggagggctatt

SEQ ID NO: 712440 - DNA, 20 bp, Artificial
  CRISPR gRNA sequence
agggctattcagtaataaaa

SEQ ID NO: 712441 - DNA, 20 bp, Artificial
  CRISPR gRNA sequence
gggctattcagtaataaaat

SEQ ID NO: 712442 - DNA, 20 bp, Artificial
  CRISPR gRNA sequence
attcagtaataaaatgggac

SEQ ID NO: 712443 - DNA, 20 bp, Artificial
  CRISPR gRNA sequence
ttcagtaataaaatgggact

SEQ ID NO: 712444 - DNA, 20 bp, Artificial
  CRISPR gRNA sequence
gtaataaaatgggactaggt

SEQ ID NO: 712445 - DNA, 20 bp, Artificial
  CRISPR gRNA sequence
taataaaatgggactaggtt

SEQ ID NO: 712446 - DNA, 20 bp, Artificial
  CRISPR gRNA sequence
aaatgggactaggttgggcg

SEQ ID NO: 712447 - DNA, 20 bp, Artificial
  CRISPR gRNA sequence
tgggactaggttgggcgcgg

SEQ ID NO: 712448 - DNA, 20 bp, Artificial
  CRISPR gRNA sequence
gctcacgcctgtaatcctcc

SEQ ID NO: 712449 - DNA, 20 bp, Artificial
  CRISPR gRNA sequence
ctgtaatcctcccagcactt

SEQ ID NO: 712450 - DNA, 20 bp, Artificial
  CRISPR gRNA sequence
tgtaatcctcccagcacttt

SEQ ID NO: 712451 - DNA, 20 bp, Artificial
  CRISPR gRNA sequence
taatcctcccagcactttgg

SEQ ID NO: 712452 - DNA, 20 bp, Artificial
  CRISPR gRNA sequence
aatcctcccagcactttggg

SEQ ID NO: 712453 - DNA, 20 bp, Artificial
  CRISPR gRNA sequence
tcccagcactttgggaggcc

SEQ ID NO: 712454 - DNA, 20 bp, Artificial
  CRISPR gRNA sequence
cccagcactttgggaggccg

SEQ ID NO: 712455 - DNA, 20 bp, Artificial
  CRISPR gRNA sequence
agcactttgggaggccgagg

SEQ ID NO: 712456 - DNA, 20 bp, Artificial
  CRISPR gRNA sequence
gcactttgggaggccgaggt

SEQ ID NO: 712457 - DNA, 20 bp, Artificial
  CRISPR gRNA sequence
ctttgggaggccgaggtggg

SEQ ID NO: 712458 - DNA, 20 bp, Artificial
  CRISPR gRNA sequence
ccgaggtgggcggatcacct

SEQ ID NO: 712459 - DNA, 20 bp, Artificial
  CRISPR gRNA sequence
cgaggtgggcggatcacctg

SEQ ID NO: 712460 - DNA, 20 bp, Artificial
  CRISPR gRNA sequence
gtgggcggatcacctgaggt

SEQ ID NO: 712461 - DNA, 20 bp, Artificial
  CRISPR gRNA sequence
tgggcggatcacctgaggtc

SEQ ID NO: 712462 - DNA, 20 bp, Artificial
  CRISPR gRNA sequence
ggcggatcacctgaggtcgg

SEQ ID NO: 712463 - DNA, 20 bp, Artificial
  CRISPR gRNA sequence
tcacctgaggtcgggagttc

SEQ ID NO: 712464 - DNA, 20 bp, Artificial
  CRISPR gRNA sequence
tgaggtcgggagttcgagac

SEQ ID NO: 712465 - DNA, 20 bp, Artificial
  CRISPR gRNA sequence
cgagaccagcctgaccaaca

SEQ ID NO: 712466 - DNA, 20 bp, Artificial
  CRISPR gRNA sequence
ccatctctactaaaaataca

SEQ ID NO: 712467 - DNA, 20 bp, Artificial
  CRISPR gRNA sequence
ctctactaaaaatacaaagt

SEQ ID NO: 712468 - DNA, 20 bp, Artificial
  CRISPR gRNA sequence
actaaaaatacaaagttagc

SEQ ID NO: 712469 - DNA, 20 bp, Artificial
  CRISPR gRNA sequence
ctaaaaatacaaagttagcc

SEQ ID NO: 712470 - DNA, 20 bp, Artificial
  CRISPR gRNA sequence
aatacaaagttagccaggcg

SEQ ID NO: 712471 - DNA, 20 bp, Artificial
  CRISPR gRNA sequence
acaaagttagccaggcgtgg

SEQ ID NO: 712472 - DNA, 20 bp, Artificial
  CRISPR gRNA sequence
aagttagccaggcgtggtgg

SEQ ID NO: 712473 - DNA, 20 bp, Artificial
  CRISPR gRNA sequence
agttagccaggcgtggtggt

SEQ ID NO: 712474 - DNA, 20 bp, Artificial
  CRISPR gRNA sequence
gtggtgggcacctgtaatcc

SEQ ID NO: 712475 - DNA, 20 bp, Artificial
  CRISPR gRNA sequence
cacctgtaatcccagctact

SEQ ID NO: 712476 - DNA, 20 bp, Artificial
  CRISPR gRNA sequence
acctgtaatcccagctactc

SEQ ID NO: 712477 - DNA, 20 bp, Artificial
  CRISPR gRNA sequence
ctgtaatcccagctactcag

SEQ ID NO: 712478 - DNA, 20 bp, Artificial
  CRISPR gRNA sequence
tgtaatcccagctactcagg

SEQ ID NO: 712479 - DNA, 20 bp, Artificial
  CRISPR gRNA sequence
tcccagctactcaggaggct

SEQ ID NO: 712480 - DNA, 20 bp, Artificial
  CRISPR gRNA sequence
cccagctactcaggaggctg

SEQ ID NO: 712481 - DNA, 20 bp, Artificial
  CRISPR gRNA sequence
agctactcaggaggctgagg

SEQ ID NO: 712482 - DNA, 20 bp, Artificial
  CRISPR gRNA sequence
gctactcaggaggctgaggc

SEQ ID NO: 712483 - DNA, 20 bp, Artificial
  CRISPR gRNA sequence
tactcaggaggctgaggcag

SEQ ID NO: 712484 - DNA, 20 bp, Artificial
  CRISPR gRNA sequence
gcaggagaatcgcttgaacc

SEQ ID NO: 712485 - DNA, 20 bp, Artificial
  CRISPR gRNA sequence
caggagaatcgcttgaaccc

SEQ ID NO: 712486 - DNA, 20 bp, Artificial
  CRISPR gRNA sequence
ggagaatcgcttgaacccag

SEQ ID NO: 712487 - DNA, 20 bp, Artificial
  CRISPR gRNA sequence
gagaatcgcttgaacccagg

SEQ ID NO: 712488 - DNA, 20 bp, Artificial
  CRISPR gRNA sequence
aatcgcttgaacccaggagg

SEQ ID NO: 712489 - DNA, 20 bp, Artificial
  CRISPR gRNA sequence
tcgcttgaacccaggaggtg

SEQ ID NO: 712490 - DNA, 20 bp, Artificial
  CRISPR gRNA sequence
cgcttgaacccaggaggtgg

SEQ ID NO: 712491 - DNA, 20 bp, Artificial
  CRISPR gRNA sequence
ttgaacccaggaggtggagg

SEQ ID NO: 712492 - DNA, 20 bp, Artificial
  CRISPR gRNA sequence
aacccaggaggtggaggtgg

SEQ ID NO: 712493 - DNA, 20 bp, Artificial
  CRISPR gRNA sequence
caggaggtggaggtggcagt

SEQ ID NO: 712494 - DNA, 20 bp, Artificial
  CRISPR gRNA sequence
ggtggaggtggcagtgagcc

SEQ ID NO: 712495 - DNA, 20 bp, Artificial
  CRISPR gRNA sequence
gagattgcgccactgcactc

SEQ ID NO: 712496 - DNA, 20 bp, Artificial
  CRISPR gRNA sequence
tgcgccactgcactccagcc

SEQ ID NO: 712497 - DNA, 20 bp, Artificial
  CRISPR gRNA sequence
gcgccactgcactccagcct

SEQ ID NO: 712498 - DNA, 20 bp, Artificial
  CRISPR gRNA sequence
cactccagcctgggcaacat

SEQ ID NO: 712499 - DNA, 20 bp, Artificial
  CRISPR gRNA sequence
cgaaactccgtctcaaaaaa

SEQ ID NO: 712500 - DNA, 20 bp, Artificial
  CRISPR gRNA sequence
tccgtctcaaaaaaaagaaa

SEQ ID NO: 712501 - DNA, 20 bp, Artificial
  CRISPR gRNA sequence
aaagaaaaagaaaaatgact

SEQ ID NO: 712502 - DNA, 20 bp, Artificial
  CRISPR gRNA sequence
aagaaaaagaaaaatgactg

SEQ ID NO: 712503 - DNA, 20 bp, Artificial
  CRISPR gRNA sequence
agaaaaagaaaaatgactga

SEQ ID NO: 712504 - DNA, 20 bp, Artificial
  CRISPR gRNA sequence
tgagggtcgacccttcgcca

SEQ ID NO: 712505 - DNA, 20 bp, Artificial
  CRISPR gRNA sequence
agggtcgacccttcgccatg

SEQ ID NO: 712506 - DNA, 20 bp, Artificial
  CRISPR gRNA sequence
cgacccttcgccatggagac

SEQ ID NO: 712507 - DNA, 20 bp, Artificial
  CRISPR gRNA sequence
gacccttcgccatggagacc

SEQ ID NO: 712508 - DNA, 20 bp, Artificial
  CRISPR gRNA sequence
cccttcgccatggagaccag

SEQ ID NO: 712509 - DNA, 20 bp, Artificial
  CRISPR gRNA sequence
ccttcgccatggagaccagg

SEQ ID NO: 712510 - DNA, 20 bp, Artificial
  CRISPR gRNA sequence
cttcgccatggagaccagga

SEQ ID NO: 712511 - DNA, 20 bp, Artificial
  CRISPR gRNA sequence
catggagaccaggagggcat

SEQ ID NO: 712512 - DNA, 20 bp, Artificial
  CRISPR gRNA sequence
gagaccaggagggcatcaga

SEQ ID NO: 712513 - DNA, 20 bp, Artificial
  CRISPR gRNA sequence
gggcatcagatggacacgtg

SEQ ID NO: 712514 - DNA, 20 bp, Artificial
  CRISPR gRNA sequence
gcatcagatggacacgtgca

SEQ ID NO: 712515 - DNA, 20 bp, Artificial
  CRISPR gRNA sequence
catcagatggacacgtgcag

SEQ ID NO: 712516 - DNA, 20 bp, Artificial
  CRISPR gRNA sequence
agatggacacgtgcagaggc

SEQ ID NO: 712517 - DNA, 20 bp, Artificial
  CRISPR gRNA sequence
ggacacgtgcagaggctggc

SEQ ID NO: 712518 - DNA, 20 bp, Artificial
  CRISPR gRNA sequence
cgtgcagaggctggccagct

SEQ ID NO: 712519 - DNA, 20 bp, Artificial
  CRISPR gRNA sequence
aggctggccagctgagtcgc

SEQ ID NO: 712520 - DNA, 20 bp, Artificial
  CRISPR gRNA sequence
ctgagtcgcaagtgtcacaa

SEQ ID NO: 712521 - DNA, 20 bp, Artificial
  CRISPR gRNA sequence
agtcgcaagtgtcacaacag

SEQ ID NO: 712522 - DNA, 20 bp, Artificial
  CRISPR gRNA sequence
tcgcaagtgtcacaacagca

SEQ ID NO: 712523 - DNA, 20 bp, Artificial
  CRISPR gRNA sequence
caagtgtcacaacagcagag

SEQ ID NO: 712524 - DNA, 20 bp, Artificial
  CRISPR gRNA sequence
aagtgtcacaacagcagagt

SEQ ID NO: 712525 - DNA, 20 bp, Artificial
  CRISPR gRNA sequence
ttccctctgacaaaccaacg

SEQ ID NO: 712526 - DNA, 20 bp, Artificial
  CRISPR gRNA sequence
ccctctgacaaaccaacgta

SEQ ID NO: 712527 - DNA, 20 bp, Artificial
  CRISPR gRNA sequence
cctctgacaaaccaacgtag

SEQ ID NO: 712528 - DNA, 20 bp, Artificial
  CRISPR gRNA sequence
ctctgacaaaccaacgtaga

SEQ ID NO: 712529 - DNA, 20 bp, Artificial
  CRISPR gRNA sequence
caaaccaacgtagagggaaa

SEQ ID NO: 712530 - DNA, 20 bp, Artificial
  CRISPR gRNA sequence
aaccaacgtagagggaaata

SEQ ID NO: 712531 - DNA, 20 bp, Artificial
  CRISPR gRNA sequence
accaacgtagagggaaatag

SEQ ID NO: 712532 - DNA, 20 bp, Artificial
  CRISPR gRNA sequence
ccaacgtagagggaaataga

SEQ ID NO: 712533 - DNA, 20 bp, Artificial
  CRISPR gRNA sequence
aacgtagagggaaatagagg

SEQ ID NO: 712534 - DNA, 20 bp, Artificial
  CRISPR gRNA sequence
cgtagagggaaatagaggga

SEQ ID NO: 712535 - DNA, 20 bp, Artificial
  CRISPR gRNA sequence
gagggaaatagagggagaga

SEQ ID NO: 712536 - DNA, 20 bp, Artificial
  CRISPR gRNA sequence
agggaaatagagggagagat

SEQ ID NO: 712537 - DNA, 20 bp, Artificial
  CRISPR gRNA sequence
gggaaatagagggagagatg

SEQ ID NO: 712538 - DNA, 20 bp, Artificial
  CRISPR gRNA sequence
atagagggagagatggggca

SEQ ID NO: 712539 - DNA, 20 bp, Artificial
  CRISPR gRNA sequence
tagagggagagatggggcac

SEQ ID NO: 712540 - DNA, 20 bp, Artificial
  CRISPR gRNA sequence
agagatggggcacgggtgtc

SEQ ID NO: 712541 - DNA, 20 bp, Artificial
  CRISPR gRNA sequence
ggggcacgggtgtccggcac

SEQ ID NO: 712542 - DNA, 20 bp, Artificial
  CRISPR gRNA sequence
gggcacgggtgtccggcaca

SEQ ID NO: 712543 - DNA, 20 bp, Artificial
  CRISPR gRNA sequence
cacgggtgtccggcacaagg

SEQ ID NO: 712544 - DNA, 20 bp, Artificial
  CRISPR gRNA sequence
acgggtgtccggcacaaggc

SEQ ID NO: 712545 - DNA, 20 bp, Artificial
  CRISPR gRNA sequence
aggcaggccctctgcactgc

SEQ ID NO: 712546 - DNA, 20 bp, Artificial
  CRISPR gRNA sequence
tgcactgctggcaaatgaat

SEQ ID NO: 712547 - DNA, 20 bp, Artificial
  CRISPR gRNA sequence
tggcaaatgaatgagccctc

SEQ ID NO: 712548 - DNA, 20 bp, Artificial
  CRISPR gRNA sequence
cctctgcccctcaatgcttt

SEQ ID NO: 712549 - DNA, 20 bp, Artificial
  CRISPR gRNA sequence
cccctcaatgctttcagccc

SEQ ID NO: 712550 - DNA, 20 bp, Artificial
  CRISPR gRNA sequence
ccaccgtcttctctccccac

SEQ ID NO: 712551 - DNA, 20 bp, Artificial
  CRISPR gRNA sequence
caccgtcttctctccccacc

SEQ ID NO: 712552 - DNA, 20 bp, Artificial
  CRISPR gRNA sequence
tcttctctccccaccaggaa

SEQ ID NO: 712553 - DNA, 20 bp, Artificial
  CRISPR gRNA sequence
tccccaccaggaaaagacca

SEQ ID NO: 712554 - DNA, 20 bp, Artificial
  CRISPR gRNA sequence
gctccaaacacccccactca

SEQ ID NO: 712555 - DNA, 20 bp, Artificial
  CRISPR gRNA sequence
ctccaaacacccccactcat

SEQ ID NO: 712556 - DNA, 20 bp, Artificial
  CRISPR gRNA sequence
tcatgggccatccaccaatc

SEQ ID NO: 712557 - DNA, 20 bp, Artificial
  CRISPR gRNA sequence
catccaccaatcgagcaccc

SEQ ID NO: 712558 - DNA, 20 bp, Artificial
  CRISPR gRNA sequence
atccaccaatcgagcacccc

SEQ ID NO: 712559 - DNA, 20 bp, Artificial
  CRISPR gRNA sequence
tccaccaatcgagcacccca

SEQ ID NO: 712560 - DNA, 20 bp, Artificial
  CRISPR gRNA sequence
caccaatcgagcaccccagg

SEQ ID NO: 712561 - DNA, 20 bp, Artificial
  CRISPR gRNA sequence
caccccagggagacgaccca

SEQ ID NO: 712562 - DNA, 20 bp, Artificial
  CRISPR gRNA sequence
ggagacgacccacagcttca

SEQ ID NO: 712563 - DNA, 20 bp, Artificial
  CRISPR gRNA sequence
gagacgacccacagcttcat

SEQ ID NO: 712564 - DNA, 20 bp, Artificial
  CRISPR gRNA sequence
agacgacccacagcttcatg

SEQ ID NO: 712565 - DNA, 20 bp, Artificial
  CRISPR gRNA sequence
agcttcatggggaaattacc

SEQ ID NO: 712566 - DNA, 20 bp, Artificial
  CRISPR gRNA sequence
gaaattacctggatctgaac

SEQ ID NO: 712567 - DNA, 20 bp, Artificial
  CRISPR gRNA sequence
aaattacctggatctgaact

SEQ ID NO: 712568 - DNA, 20 bp, Artificial
  CRISPR gRNA sequence
atctgaactaggccttccca

SEQ ID NO: 712569 - DNA, 20 bp, Artificial
  CRISPR gRNA sequence
ctgaactaggccttcccaca

SEQ ID NO: 712570 - DNA, 20 bp, Artificial
  CRISPR gRNA sequence
tgaactaggccttcccacag

SEQ ID NO: 712571 - DNA, 20 bp, Artificial
  CRISPR gRNA sequence
aactaggccttcccacagag

SEQ ID NO: 712572 - DNA, 20 bp, Artificial
  CRISPR gRNA sequence
actaggccttcccacagagg

SEQ ID NO: 712573 - DNA, 20 bp, Artificial
  CRISPR gRNA sequence
ctaggccttcccacagagga

SEQ ID NO: 712574 - DNA, 20 bp, Artificial
  CRISPR gRNA sequence
aggccttcccacagaggagg

SEQ ID NO: 712575 - DNA, 20 bp, Artificial
  CRISPR gRNA sequence
gccttcccacagaggaggga

SEQ ID NO: 712576 - DNA, 20 bp, Artificial
  CRISPR gRNA sequence
tcccacagaggagggagagt

SEQ ID NO: 712577 - DNA, 20 bp, Artificial
  CRISPR gRNA sequence
cccacagaggagggagagtc

SEQ ID NO: 712578 - DNA, 20 bp, Artificial
  CRISPR gRNA sequence
cacagaggagggagagtcgg

SEQ ID NO: 712579 - DNA, 20 bp, Artificial
  CRISPR gRNA sequence
ggagagtcgggagccctcgt

SEQ ID NO: 712580 - DNA, 20 bp, Artificial
  CRISPR gRNA sequence
gtcgggagccctcgtcagtt

SEQ ID NO: 712581 - DNA, 20 bp, Artificial
  CRISPR gRNA sequence
gggagccctcgtcagtttag

SEQ ID NO: 712582 - DNA, 20 bp, Artificial
  CRISPR gRNA sequence
agccctcgtcagtttagaag

SEQ ID NO: 712583 - DNA, 20 bp, Artificial
  CRISPR gRNA sequence
tcagtttagaagcagcttcc

SEQ ID NO: 712584 - DNA, 20 bp, Artificial
  CRISPR gRNA sequence
cagtttagaagcagcttcct

SEQ ID NO: 712585 - DNA, 20 bp, Artificial
  CRISPR gRNA sequence
ttagaagcagcttcctgggc

SEQ ID NO: 712586 - DNA, 20 bp, Artificial
  CRISPR gRNA sequence
tagaagcagcttcctgggcg

SEQ ID NO: 712587 - DNA, 20 bp, Artificial
  CRISPR gRNA sequence
aagcagcttcctgggcgagg

SEQ ID NO: 712588 - DNA, 20 bp, Artificial
  CRISPR gRNA sequence
agcagcttcctgggcgaggc

SEQ ID NO: 712589 - DNA, 20 bp, Artificial
  CRISPR gRNA sequence
gaggcgggtgccccctctta

SEQ ID NO: 712590 - DNA, 20 bp, Artificial
  CRISPR gRNA sequence
aggcgggtgccccctcttac

SEQ ID NO: 712591 - DNA, 20 bp, Artificial
  CRISPR gRNA sequence
ggtgccccctcttacaggca

SEQ ID NO: 712592 - DNA, 20 bp, Artificial
  CRISPR gRNA sequence
ccctcttacaggcatggtgc

SEQ ID NO: 712593 - DNA, 20 bp, Artificial
  CRISPR gRNA sequence
tacaggcatggtgctggcac

SEQ ID NO: 712594 - DNA, 20 bp, Artificial
  CRISPR gRNA sequence
caggcatggtgctggcactg

SEQ ID NO: 712595 - DNA, 20 bp, Artificial
  CRISPR gRNA sequence
aggcatggtgctggcactgg

SEQ ID NO: 712596 - DNA, 20 bp, Artificial
  CRISPR gRNA sequence
gtgctggcactggaggttgc

SEQ ID NO: 712597 - DNA, 20 bp, Artificial
  CRISPR gRNA sequence
tgctggcactggaggttgct

SEQ ID NO: 712598 - DNA, 20 bp, Artificial
  CRISPR gRNA sequence
gctggcactggaggttgctg

SEQ ID NO: 712599 - DNA, 20 bp, Artificial
  CRISPR gRNA sequence
ctggaggttgctggggacac

SEQ ID NO: 712600 - DNA, 20 bp, Artificial
  CRISPR gRNA sequence
tggaggttgctggggacacc

SEQ ID NO: 712601 - DNA, 20 bp, Artificial
  CRISPR gRNA sequence
ggaggttgctggggacaccg

SEQ ID NO: 712602 - DNA, 20 bp, Artificial
  CRISPR gRNA sequence
ggttgctggggacaccgggg

SEQ ID NO: 712603 - DNA, 20 bp, Artificial
  CRISPR gRNA sequence
gttgctggggacaccggggt

SEQ ID NO: 712604 - DNA, 20 bp, Artificial
  CRISPR gRNA sequence
tggggacaccggggtgggct

SEQ ID NO: 712605 - DNA, 20 bp, Artificial
  CRISPR gRNA sequence
acaccggggtgggcttggcc

SEQ ID NO: 712606 - DNA, 20 bp, Artificial
  CRISPR gRNA sequence
caccggggtgggcttggcct

SEQ ID NO: 712607 - DNA, 20 bp, Artificial
  CRISPR gRNA sequence
accggggtgggcttggcctg

SEQ ID NO: 712608 - DNA, 20 bp, Artificial
  CRISPR gRNA sequence
ccggggtgggcttggcctgg

SEQ ID NO: 712609 - DNA, 20 bp, Artificial
  CRISPR gRNA sequence
ggtgggcttggcctggggga

SEQ ID NO: 712610 - DNA, 20 bp, Artificial
  CRISPR gRNA sequence
ggcctgggggatggtgccac

SEQ ID NO: 712611 - DNA, 20 bp, Artificial
  CRISPR gRNA sequence
gcctgggggatggtgccact

SEQ ID NO: 712612 - DNA, 20 bp, Artificial
  CRISPR gRNA sequence
cctgggggatggtgccactg

SEQ ID NO: 712613 - DNA, 20 bp, Artificial
  CRISPR gRNA sequence
gggggatggtgccactgggg

SEQ ID NO: 712614 - DNA, 20 bp, Artificial
  CRISPR gRNA sequence
ggatggtgccactggggaag

SEQ ID NO: 712615 - DNA, 20 bp, Artificial
  CRISPR gRNA sequence
ggtgccactggggaagaagc

SEQ ID NO: 712616 - DNA, 20 bp, Artificial
  CRISPR gRNA sequence
tgccactggggaagaagcca

SEQ ID NO: 712617 - DNA, 20 bp, Artificial
  CRISPR gRNA sequence
actggggaagaagccagaga

SEQ ID NO: 712618 - DNA, 20 bp, Artificial
  CRISPR gRNA sequence
ctggggaagaagccagagat

SEQ ID NO: 712619 - DNA, 20 bp, Artificial
  CRISPR gRNA sequence
gggactgataattctgccaa

SEQ ID NO: 712620 - DNA, 20 bp, Artificial
  CRISPR gRNA sequence
ggactgataattctgccaat

SEQ ID NO: 712621 - DNA, 20 bp, Artificial
  CRISPR gRNA sequence
gactgataattctgccaatg

SEQ ID NO: 712622 - DNA, 20 bp, Artificial
  CRISPR gRNA sequence
gataattctgccaatggggc

SEQ ID NO: 712623 - DNA, 20 bp, Artificial
  CRISPR gRNA sequence
ataattctgccaatggggca

SEQ ID NO: 712624 - DNA, 20 bp, Artificial
  CRISPR gRNA sequence
taattctgccaatggggcaa

SEQ ID NO: 712625 - DNA, 20 bp, Artificial
  CRISPR gRNA sequence
attctgccaatggggcaagg

SEQ ID NO: 712626 - DNA, 20 bp, Artificial
  CRISPR gRNA sequence
ttctgccaatggggcaaggg

SEQ ID NO: 712627 - DNA, 20 bp, Artificial
  CRISPR gRNA sequence
caagggaggcctgtgctcac

SEQ ID NO: 712628 - DNA, 20 bp, Artificial
  CRISPR gRNA sequence
aggcctgtgctcacgagtaa

SEQ ID NO: 712629 - DNA, 20 bp, Artificial
  CRISPR gRNA sequence
ctcacgagtaacagtttcca

SEQ ID NO: 712630 - DNA, 20 bp, Artificial
  CRISPR gRNA sequence
cacgagtaacagtttccaca

SEQ ID NO: 712631 - DNA, 20 bp, Artificial
  CRISPR gRNA sequence
agtaacagtttccacagaga

SEQ ID NO: 712632 - DNA, 20 bp, Artificial
  CRISPR gRNA sequence
gtaacagtttccacagagat

SEQ ID NO: 712633 - DNA, 20 bp, Artificial
  CRISPR gRNA sequence
taacagtttccacagagatg

SEQ ID NO: 712634 - DNA, 20 bp, Artificial
  CRISPR gRNA sequence
tttccacagagatggggtcc

SEQ ID NO: 712635 - DNA, 20 bp, Artificial
  CRISPR gRNA sequence
ttccacagagatggggtccc

SEQ ID NO: 712636 - DNA, 20 bp, Artificial
  CRISPR gRNA sequence
gagatggggtcccaggccct

SEQ ID NO: 712637 - DNA, 20 bp, Artificial
  CRISPR gRNA sequence
ggcccttggcccactgcctc

SEQ ID NO: 712638 - DNA, 20 bp, Artificial
  CRISPR gRNA sequence
ccttggcccactgcctctgg

SEQ ID NO: 712639 - DNA, 20 bp, Artificial
  CRISPR gRNA sequence
cttggcccactgcctctggc

SEQ ID NO: 712640 - DNA, 20 bp, Artificial
  CRISPR gRNA sequence
gcctctggcgggcccactgt

SEQ ID NO: 712641 - DNA, 20 bp, Artificial
  CRISPR gRNA sequence
gcgggcccactgtaagctcc

SEQ ID NO: 712642 - DNA, 20 bp, Artificial
  CRISPR gRNA sequence
cgggcccactgtaagctcct

SEQ ID NO: 712643 - DNA, 20 bp, Artificial
  CRISPR gRNA sequence
ggcccactgtaagctcctgg

SEQ ID NO: 712644 - DNA, 20 bp, Artificial
  CRISPR gRNA sequence
cactgtaagctcctgggagc

SEQ ID NO: 712645 - DNA, 20 bp, Artificial
  CRISPR gRNA sequence
actgtaagctcctgggagca

SEQ ID NO: 712646 - DNA, 20 bp, Artificial
  CRISPR gRNA sequence
gagcaaggcctgtgttttct

SEQ ID NO: 712647 - DNA, 20 bp, Artificial
  CRISPR gRNA sequence
cctgtgttttctaagccctg

SEQ ID NO: 712648 - DNA, 20 bp, Artificial
  CRISPR gRNA sequence
ctgtgttttctaagccctgt

SEQ ID NO: 712649 - DNA, 20 bp, Artificial
  CRISPR gRNA sequence
ctgtgggtctcccatgtgct

SEQ ID NO: 712650 - DNA, 20 bp, Artificial
  CRISPR gRNA sequence
tgtgggtctcccatgtgctc

SEQ ID NO: 712651 - DNA, 20 bp, Artificial
  CRISPR gRNA sequence
gtgggtctcccatgtgctca

SEQ ID NO: 712652 - DNA, 20 bp, Artificial
  CRISPR gRNA sequence
ggtctcccatgtgctcaggg

SEQ ID NO: 712653 - DNA, 20 bp, Artificial
  CRISPR gRNA sequence
gtctcccatgtgctcagggc

SEQ ID NO: 712654 - DNA, 20 bp, Artificial
  CRISPR gRNA sequence
tctcccatgtgctcagggca

SEQ ID NO: 712655 - DNA, 20 bp, Artificial
  CRISPR gRNA sequence
ccatgtgctcagggcagggc

SEQ ID NO: 712656 - DNA, 20 bp, Artificial
  CRISPR gRNA sequence
catgtgctcagggcagggct

SEQ ID NO: 712657 - DNA, 20 bp, Artificial
  CRISPR gRNA sequence
gggcagggctgggcacaccc

SEQ ID NO: 712658 - DNA, 20 bp, Artificial
  CRISPR gRNA sequence
ggcagggctgggcacaccct

SEQ ID NO: 712659 - DNA, 20 bp, Artificial
  CRISPR gRNA sequence
gcagggctgggcacacccta

SEQ ID NO: 712660 - DNA, 20 bp, Artificial
  CRISPR gRNA sequence
cctagggcctcaaatgatct

SEQ ID NO: 712661 - DNA, 20 bp, Artificial
  CRISPR gRNA sequence
ctagggcctcaaatgatctg

SEQ ID NO: 712662 - DNA, 20 bp, Artificial
  CRISPR gRNA sequence
tagggcctcaaatgatctga

SEQ ID NO: 712663 - DNA, 20 bp, Artificial
  CRISPR gRNA sequence
agggcctcaaatgatctgag

SEQ ID NO: 712664 - DNA, 20 bp, Artificial
  CRISPR gRNA sequence
ctcaaatgatctgaggggct

SEQ ID NO: 712665 - DNA, 20 bp, Artificial
  CRISPR gRNA sequence
aaatgatctgaggggcttgg

SEQ ID NO: 712666 - DNA, 20 bp, Artificial
  CRISPR gRNA sequence
atgatctgaggggcttggca

SEQ ID NO: 712667 - DNA, 20 bp, Artificial
  CRISPR gRNA sequence
gatctgaggggcttggcaga

SEQ ID NO: 712668 - DNA, 20 bp, Artificial
  CRISPR gRNA sequence
atctgaggggcttggcagag

SEQ ID NO: 712669 - DNA, 20 bp, Artificial
  CRISPR gRNA sequence
cttggcagagaggcacccca

SEQ ID NO: 712670 - DNA, 20 bp, Artificial
  CRISPR gRNA sequence
accccaaagtgctgacacca

SEQ ID NO: 712671 - DNA, 20 bp, Artificial
  CRISPR gRNA sequence
ccccaaagtgctgacaccat

SEQ ID NO: 712672 - DNA, 20 bp, Artificial
  CRISPR gRNA sequence
ctgaatcccgcttacacccc

SEQ ID NO: 712673 - DNA, 20 bp, Artificial
  CRISPR gRNA sequence
tcccgcttacacccccagcc

SEQ ID NO: 712674 - DNA, 20 bp, Artificial
  CRISPR gRNA sequence
cccccagcccagttgtacca

SEQ ID NO: 712675 - DNA, 20 bp, Artificial
  CRISPR gRNA sequence
ccccagcccagttgtaccat

SEQ ID NO: 712676 - DNA, 20 bp, Artificial
  CRISPR gRNA sequence
gttgtaccatgggcgtcctg

SEQ ID NO: 712677 - DNA, 20 bp, Artificial
  CRISPR gRNA sequence
ttgtaccatgggcgtcctgt

SEQ ID NO: 712678 - DNA, 20 bp, Artificial
  CRISPR gRNA sequence
tgtaccatgggcgtcctgtg

SEQ ID NO: 712679 - DNA, 20 bp, Artificial
  CRISPR gRNA sequence
accatgggcgtcctgtgggg

SEQ ID NO: 712680 - DNA, 20 bp, Artificial
  CRISPR gRNA sequence
ccatgggcgtcctgtggggt

SEQ ID NO: 712681 - DNA, 20 bp, Artificial
  CRISPR gRNA sequence
catgggcgtcctgtggggtg

SEQ ID NO: 712682 - DNA, 20 bp, Artificial
  CRISPR gRNA sequence
gggcgtcctgtggggtgggg

SEQ ID NO: 712683 - DNA, 20 bp, Artificial
  CRISPR gRNA sequence
ggtggggcagcctcatctga

SEQ ID NO: 712684 - DNA, 20 bp, Artificial
  CRISPR gRNA sequence
gggcagcctcatctgaaagc

SEQ ID NO: 712685 - DNA, 20 bp, Artificial
  CRISPR gRNA sequence
gcctcatctgaaagccagct

SEQ ID NO: 712686 - DNA, 20 bp, Artificial
  CRISPR gRNA sequence
cctcatctgaaagccagctt

SEQ ID NO: 712687 - DNA, 20 bp, Artificial
  CRISPR gRNA sequence
ctcatctgaaagccagcttg

SEQ ID NO: 712688 - DNA, 20 bp, Artificial
  CRISPR gRNA sequence
tcatctgaaagccagcttgg

SEQ ID NO: 712689 - DNA, 20 bp, Artificial
  CRISPR gRNA sequence
tctgaaagccagcttggggg

SEQ ID NO: 712690 - DNA, 20 bp, Artificial
  CRISPR gRNA sequence
tgaaagccagcttgggggaa

SEQ ID NO: 712691 - DNA, 20 bp, Artificial
  CRISPR gRNA sequence
gaaagccagcttgggggaag

SEQ ID NO: 712692 - DNA, 20 bp, Artificial
  CRISPR gRNA sequence
aagccagcttgggggaagag

SEQ ID NO: 712693 - DNA, 20 bp, Artificial
  CRISPR gRNA sequence
agccagcttgggggaagagg

SEQ ID NO: 712694 - DNA, 20 bp, Artificial
  CRISPR gRNA sequence
ccagcttgggggaagaggag

SEQ ID NO: 712695 - DNA, 20 bp, Artificial
  CRISPR gRNA sequence
cagcttgggggaagaggagg

SEQ ID NO: 712696 - DNA, 20 bp, Artificial
  CRISPR gRNA sequence
tgggggaagaggaggaggca

SEQ ID NO: 712697 - DNA, 20 bp, Artificial
  CRISPR gRNA sequence
ggaagaggaggaggcaaagc

SEQ ID NO: 712698 - DNA, 20 bp, Artificial
  CRISPR gRNA sequence
gaagaggaggaggcaaagcc

SEQ ID NO: 712699 - DNA, 20 bp, Artificial
  CRISPR gRNA sequence
aagaggaggaggcaaagcca

SEQ ID NO: 712700 - DNA, 20 bp, Artificial
  CRISPR gRNA sequence
gaggaggaggcaaagccagg

SEQ ID NO: 712701 - DNA, 20 bp, Artificial
  CRISPR gRNA sequence
ggcaaagccagggagtcacc

SEQ ID NO: 712702 - DNA, 20 bp, Artificial
  CRISPR gRNA sequence
caaagccagggagtcacctg

SEQ ID NO: 712703 - DNA, 20 bp, Artificial
  CRISPR gRNA sequence
aaagccagggagtcacctgg

SEQ ID NO: 712704 - DNA, 20 bp, Artificial
  CRISPR gRNA sequence
aagccagggagtcacctgga

SEQ ID NO: 712705 - DNA, 20 bp, Artificial
  CRISPR gRNA sequence
gtcacctggagggttccttg

SEQ ID NO: 712706 - DNA, 20 bp, Artificial
  CRISPR gRNA sequence
gagggttccttgcagttctc

SEQ ID NO: 712707 - DNA, 20 bp, Artificial
  CRISPR gRNA sequence
agggttccttgcagttctct

SEQ ID NO: 712708 - DNA, 20 bp, Artificial
  CRISPR gRNA sequence
ttccttgcagttctctgggc

SEQ ID NO: 712709 - DNA, 20 bp, Artificial
  CRISPR gRNA sequence
tgcagttctctgggctggca

SEQ ID NO: 712710 - DNA, 20 bp, Artificial
  CRISPR gRNA sequence
gcagttctctgggctggcac

SEQ ID NO: 712711 - DNA, 20 bp, Artificial
  CRISPR gRNA sequence
gttctctgggctggcacagg

SEQ ID NO: 712712 - DNA, 20 bp, Artificial
  CRISPR gRNA sequence
ttctctgggctggcacaggc

SEQ ID NO: 712713 - DNA, 20 bp, Artificial
  CRISPR gRNA sequence
tctctgggctggcacaggca

SEQ ID NO: 712714 - DNA, 20 bp, Artificial
  CRISPR gRNA sequence
gcacaggcagggctgacccc

SEQ ID NO: 712715 - DNA, 20 bp, Artificial
  CRISPR gRNA sequence
cacaggcagggctgacccct

SEQ ID NO: 712716 - DNA, 20 bp, Artificial
  CRISPR gRNA sequence
acaggcagggctgacccctg

SEQ ID NO: 712717 - DNA, 20 bp, Artificial
  CRISPR gRNA sequence
ggcagggctgacccctgggg

SEQ ID NO: 712718 - DNA, 20 bp, Artificial
  CRISPR gRNA sequence
gggctgacccctggggaagc

SEQ ID NO: 712719 - DNA, 20 bp, Artificial
  CRISPR gRNA sequence
cccctggggaagccggctca

SEQ ID NO: 712720 - DNA, 20 bp, Artificial
  CRISPR gRNA sequence
gttcttctgcgccgtgcctg

SEQ ID NO: 712721 - DNA, 20 bp, Artificial
  CRISPR gRNA sequence
ttcttctgcgccgtgcctgc

SEQ ID NO: 712722 - DNA, 20 bp, Artificial
  CRISPR gRNA sequence
tcttctgcgccgtgcctgca

SEQ ID NO: 712723 - DNA, 20 bp, Artificial
  CRISPR gRNA sequence
cttctgcgccgtgcctgcag

SEQ ID NO: 712724 - DNA, 20 bp, Artificial
  CRISPR gRNA sequence
ttctgcgccgtgcctgcagg

SEQ ID NO: 712725 - DNA, 20 bp, Artificial
  CRISPR gRNA sequence
tctgcgccgtgcctgcaggg

SEQ ID NO: 712726 - DNA, 20 bp, Artificial
  CRISPR gRNA sequence
cgccgtgcctgcagggggga

SEQ ID NO: 712727 - DNA, 20 bp, Artificial
  CRISPR gRNA sequence
cgtgcctgcaggggggacag

SEQ ID NO: 712728 - DNA, 20 bp, Artificial
  CRISPR gRNA sequence
aggggggacagcagtgcctt

SEQ ID NO: 712729 - DNA, 20 bp, Artificial
  CRISPR gRNA sequence
gacagcagtgccttcagaat

SEQ ID NO: 712730 - DNA, 20 bp, Artificial
  CRISPR gRNA sequence
agtgccttcagaatcagtgt

SEQ ID NO: 712731 - DNA, 20 bp, Artificial
  CRISPR gRNA sequence
gtgccttcagaatcagtgtt

SEQ ID NO: 712732 - DNA, 20 bp, Artificial
  CRISPR gRNA sequence
tgccttcagaatcagtgttg

SEQ ID NO: 712733 - DNA, 20 bp, Artificial
  CRISPR gRNA sequence
gaatcagtgttggggaccca

SEQ ID NO: 712734 - DNA, 20 bp, Artificial
  CRISPR gRNA sequence
gttggggacccaaagtctcc

SEQ ID NO: 712735 - DNA, 20 bp, Artificial
  CRISPR gRNA sequence
gaatacacccttcactacca

SEQ ID NO: 712736 - DNA, 20 bp, Artificial
  CRISPR gRNA sequence
aatacacccttcactaccac

SEQ ID NO: 712737 - DNA, 20 bp, Artificial
  CRISPR gRNA sequence
cacccttcactaccacaggc

SEQ ID NO: 712738 - DNA, 20 bp, Artificial
  CRISPR gRNA sequence
cccttcactaccacaggcca

SEQ ID NO: 712739 - DNA, 20 bp, Artificial
  CRISPR gRNA sequence
tcactaccacaggccagagt

SEQ ID NO: 712740 - DNA, 20 bp, Artificial
  CRISPR gRNA sequence
actaccacaggccagagtcg

SEQ ID NO: 712741 - DNA, 20 bp, Artificial
  CRISPR gRNA sequence
ccacaggccagagtcggaga

SEQ ID NO: 712742 - DNA, 20 bp, Artificial
  CRISPR gRNA sequence
cacaggccagagtcggagat

SEQ ID NO: 712743 - DNA, 20 bp, Artificial
  CRISPR gRNA sequence
acaggccagagtcggagatg

SEQ ID NO: 712744 - DNA, 20 bp, Artificial
  CRISPR gRNA sequence
agagtcggagatggggccct

SEQ ID NO: 712745 - DNA, 20 bp, Artificial
  CRISPR gRNA sequence
gatggggcccttggaaaaca

SEQ ID NO: 712746 - DNA, 20 bp, Artificial
  CRISPR gRNA sequence
ggggcccttggaaaacacag

SEQ ID NO: 712747 - DNA, 20 bp, Artificial
  CRISPR gRNA sequence
tggaaaacacagcagtcatc

SEQ ID NO: 712748 - DNA, 20 bp, Artificial
  CRISPR gRNA sequence
gaaaacacagcagtcatctg

SEQ ID NO: 712749 - DNA, 20 bp, Artificial
  CRISPR gRNA sequence
aaaacacagcagtcatctgg

SEQ ID NO: 712750 - DNA, 20 bp, Artificial
  CRISPR gRNA sequence
acacagcagtcatctggagg

SEQ ID NO: 712751 - DNA, 20 bp, Artificial
  CRISPR gRNA sequence
atctggaggtggcacccgcc

SEQ ID NO: 712752 - DNA, 20 bp, Artificial
  CRISPR gRNA sequence
gcctggcacccgttcccctt

SEQ ID NO: 712753 - DNA, 20 bp, Artificial
  CRISPR gRNA sequence
ctggcacccgttccccttca

SEQ ID NO: 712754 - DNA, 20 bp, Artificial
  CRISPR gRNA sequence
acccgttccccttcagagta

SEQ ID NO: 712755 - DNA, 20 bp, Artificial
  CRISPR gRNA sequence
cgttccccttcagagtaaag

SEQ ID NO: 712756 - DNA, 20 bp, Artificial
  CRISPR gRNA sequence
taaagcagcctatctttccc

SEQ ID NO: 712757 - DNA, 20 bp, Artificial
  CRISPR gRNA sequence
aaagcagcctatctttccct

SEQ ID NO: 712758 - DNA, 20 bp, Artificial
  CRISPR gRNA sequence
aagcagcctatctttccctg

SEQ ID NO: 712759 - DNA, 20 bp, Artificial
  CRISPR gRNA sequence
aattactctccctctgatct

SEQ ID NO: 712760 - DNA, 20 bp, Artificial
  CRISPR gRNA sequence
ccctctgatctcagcatctg

SEQ ID NO: 712761 - DNA, 20 bp, Artificial
  CRISPR gRNA sequence
ctgatctcagcatctgtggt

SEQ ID NO: 712762 - DNA, 20 bp, Artificial
  CRISPR gRNA sequence
tgatctcagcatctgtggtt

SEQ ID NO: 712763 - DNA, 20 bp, Artificial
  CRISPR gRNA sequence
gatctcagcatctgtggtta

SEQ ID NO: 712764 - DNA, 20 bp, Artificial
  CRISPR gRNA sequence
atctcagcatctgtggttag

SEQ ID NO: 712765 - DNA, 20 bp, Artificial
  CRISPR gRNA sequence
cagcatctgtggttaggggt

SEQ ID NO: 712766 - DNA, 20 bp, Artificial
  CRISPR gRNA sequence
agcatctgtggttaggggtt

SEQ ID NO: 712767 - DNA, 20 bp, Artificial
  CRISPR gRNA sequence
ccgactgaaccccctttccc

SEQ ID NO: 712768 - DNA, 20 bp, Artificial
  CRISPR gRNA sequence
actgaaccccctttcccgag

SEQ ID NO: 712769 - DNA, 20 bp, Artificial
  CRISPR gRNA sequence
cccctttcccgagtggccat

SEQ ID NO: 712770 - DNA, 20 bp, Artificial
  CRISPR gRNA sequence
ttcccgagtggccatgagac

SEQ ID NO: 712771 - DNA, 20 bp, Artificial
  CRISPR gRNA sequence
tcccgagtggccatgagacc

SEQ ID NO: 712772 - DNA, 20 bp, Artificial
  CRISPR gRNA sequence
gagtggccatgagaccaggc

SEQ ID NO: 712773 - DNA, 20 bp, Artificial
  CRISPR gRNA sequence
atcaatccgttgcattcctc

SEQ ID NO: 712774 - DNA, 20 bp, Artificial
  CRISPR gRNA sequence
tgcattcctctggccacgat

SEQ ID NO: 712775 - DNA, 20 bp, Artificial
  CRISPR gRNA sequence
ttcctctggccacgatgagc

SEQ ID NO: 712776 - DNA, 20 bp, Artificial
  CRISPR gRNA sequence
ctggccacgatgagccagtt

SEQ ID NO: 712777 - DNA, 20 bp, Artificial
  CRISPR gRNA sequence
tggccacgatgagccagttc

SEQ ID NO: 712778 - DNA, 20 bp, Artificial
  CRISPR gRNA sequence
ggccacgatgagccagttca

SEQ ID NO: 712779 - DNA, 20 bp, Artificial
  CRISPR gRNA sequence
acgatgagccagttcaggga

SEQ ID NO: 712780 - DNA, 20 bp, Artificial
  CRISPR gRNA sequence
cagggacggacatgtgaccc

SEQ ID NO: 712781 - DNA, 20 bp, Artificial
  CRISPR gRNA sequence
gacatgtgacccaagcctgt

SEQ ID NO: 712782 - DNA, 20 bp, Artificial
  CRISPR gRNA sequence
acatgtgacccaagcctgtg

SEQ ID NO: 712783 - DNA, 20 bp, Artificial
  CRISPR gRNA sequence
tgtgacccaagcctgtgagg

SEQ ID NO: 712784 - DNA, 20 bp, Artificial
  CRISPR gRNA sequence
agcctgtgaggtagaattta

SEQ ID NO: 712785 - DNA, 20 bp, Artificial
  CRISPR gRNA sequence
gaggtagaatttaaagattc

SEQ ID NO: 712786 - DNA, 20 bp, Artificial
  CRISPR gRNA sequence
agaatttaaagattctggtt

SEQ ID NO: 712787 - DNA, 20 bp, Artificial
  CRISPR gRNA sequence
gaatttaaagattctggttt

SEQ ID NO: 712788 - DNA, 20 bp, Artificial
  CRISPR gRNA sequence
agattctggtttgggattta

SEQ ID NO: 712789 - DNA, 20 bp, Artificial
  CRISPR gRNA sequence
gattctggtttgggatttaa

SEQ ID NO: 712790 - DNA, 20 bp, Artificial
  CRISPR gRNA sequence
ggtttgggatttaaaggttt

SEQ ID NO: 712791 - DNA, 20 bp, Artificial
  CRISPR gRNA sequence
ggatttaaaggttttggttt

SEQ ID NO: 712792 - DNA, 20 bp, Artificial
  CRISPR gRNA sequence
gttttggatattaaaaatgt

SEQ ID NO: 712793 - DNA, 20 bp, Artificial
  CRISPR gRNA sequence
tggatattaaaaatgtaaga

SEQ ID NO: 712794 - DNA, 20 bp, Artificial
  CRISPR gRNA sequence
ggatattaaaaatgtaagaa

SEQ ID NO: 712795 - DNA, 20 bp, Artificial
  CRISPR gRNA sequence
gatattaaaaatgtaagaaa

SEQ ID NO: 712796 - DNA, 20 bp, Artificial
  CRISPR gRNA sequence
attaaaaatgtaagaaaggg

SEQ ID NO: 712797 - DNA, 20 bp, Artificial
  CRISPR gRNA sequence
aagggaagctgtcttcccac

SEQ ID NO: 712798 - DNA, 20 bp, Artificial
  CRISPR gRNA sequence
agctgtcttcccactggcgc

SEQ ID NO: 712799 - DNA, 20 bp, Artificial
  CRISPR gRNA sequence
gctgtcttcccactggcgct

SEQ ID NO: 712800 - DNA, 20 bp, Artificial
  CRISPR gRNA sequence
gtcttcccactggcgctggg

SEQ ID NO: 712801 - DNA, 20 bp, Artificial
  CRISPR gRNA sequence
cttcccactggcgctgggca

SEQ ID NO: 712802 - DNA, 20 bp, Artificial
  CRISPR gRNA sequence
cgctgggcagagctgcttgt

SEQ ID NO: 712803 - DNA, 20 bp, Artificial
  CRISPR gRNA sequence
gtatcttgccgatgaaccaa

SEQ ID NO: 712804 - DNA, 20 bp, Artificial
  CRISPR gRNA sequence
atcttgccgatgaaccaaca

SEQ ID NO: 712805 - DNA, 20 bp, Artificial
  CRISPR gRNA sequence
cttgccgatgaaccaacaga

SEQ ID NO: 712806 - DNA, 20 bp, Artificial
  CRISPR gRNA sequence
ttgccgatgaaccaacagag

SEQ ID NO: 712807 - DNA, 20 bp, Artificial
  CRISPR gRNA sequence
tgccgatgaaccaacagaga

SEQ ID NO: 712808 - DNA, 20 bp, Artificial
  CRISPR gRNA sequence
tgaaccaacagagagggaaa

SEQ ID NO: 712809 - DNA, 20 bp, Artificial
  CRISPR gRNA sequence
aaccaacagagagggaaata

SEQ ID NO: 712810 - DNA, 20 bp, Artificial
  CRISPR gRNA sequence
accaacagagagggaaatag

SEQ ID NO: 712811 - DNA, 20 bp, Artificial
  CRISPR gRNA sequence
acagagagggaaatagaggt

SEQ ID NO: 712812 - DNA, 20 bp, Artificial
  CRISPR gRNA sequence
agagagggaaatagaggtga

SEQ ID NO: 712813 - DNA, 20 bp, Artificial
  CRISPR gRNA sequence
agggaaatagaggtgagaga

SEQ ID NO: 712814 - DNA, 20 bp, Artificial
  CRISPR gRNA sequence
gggaaatagaggtgagagat

SEQ ID NO: 712815 - DNA, 20 bp, Artificial
  CRISPR gRNA sequence
ggaaatagaggtgagagatg

SEQ ID NO: 712816 - DNA, 20 bp, Artificial
  CRISPR gRNA sequence
atagaggtgagagatggggc

SEQ ID NO: 712817 - DNA, 20 bp, Artificial
  CRISPR gRNA sequence
aggtgagagatggggcaaga

SEQ ID NO: 712818 - DNA, 20 bp, Artificial
  CRISPR gRNA sequence
gtgagagatggggcaagatg

SEQ ID NO: 712819 - DNA, 20 bp, Artificial
  CRISPR gRNA sequence
gatggggcaagatggagccc

SEQ ID NO: 712820 - DNA, 20 bp, Artificial
  CRISPR gRNA sequence
gcaagatggagccctggatc

SEQ ID NO: 712821 - DNA, 20 bp, Artificial
  CRISPR gRNA sequence
cctggatccagccatgcctg

SEQ ID NO: 712822 - DNA, 20 bp, Artificial
  CRISPR gRNA sequence
cagccatgcctgaagcttct

SEQ ID NO: 712823 - DNA, 20 bp, Artificial
  CRISPR gRNA sequence
gccatgcctgaagcttctca

SEQ ID NO: 712824 - DNA, 20 bp, Artificial
  CRISPR gRNA sequence
aagcttctcagagctatccc

SEQ ID NO: 712825 - DNA, 20 bp, Artificial
  CRISPR gRNA sequence
agagctatccccagactttt

SEQ ID NO: 712826 - DNA, 20 bp, Artificial
  CRISPR gRNA sequence
agctacatgtgctaaaaaat

SEQ ID NO: 712827 - DNA, 20 bp, Artificial
  CRISPR gRNA sequence
gctacatgtgctaaaaaatt

SEQ ID NO: 712828 - DNA, 20 bp, Artificial
  CRISPR gRNA sequence
ctacatgtgctaaaaaattg

SEQ ID NO: 712829 - DNA, 20 bp, Artificial
  CRISPR gRNA sequence
gattttgctacatgcaatcc

SEQ ID NO: 712830 - DNA, 20 bp, Artificial
  CRISPR gRNA sequence
attttgctacatgcaatcca

SEQ ID NO: 712831 - DNA, 20 bp, Artificial
  CRISPR gRNA sequence
tttgctacatgcaatccaag

SEQ ID NO: 712832 - DNA, 20 bp, Artificial
  CRISPR gRNA sequence
atgcaatccaaggagtcctg

SEQ ID NO: 712833 - DNA, 20 bp, Artificial
  CRISPR gRNA sequence
caaggagtcctgaagaatgc

SEQ ID NO: 712834 - DNA, 20 bp, Artificial
  CRISPR gRNA sequence
gagtcctgaagaatgctgga

SEQ ID NO: 712835 - DNA, 20 bp, Artificial
  CRISPR gRNA sequence
tcctgaagaatgctggacag

SEQ ID NO: 712836 - DNA, 20 bp, Artificial
  CRISPR gRNA sequence
tgaagaatgctggacagaag

SEQ ID NO: 712837 - DNA, 20 bp, Artificial
  CRISPR gRNA sequence
aagaatgctggacagaagca

SEQ ID NO: 712838 - DNA, 20 bp, Artificial
  CRISPR gRNA sequence
aatgctggacagaagcagag

SEQ ID NO: 712839 - DNA, 20 bp, Artificial
  CRISPR gRNA sequence
tgctggacagaagcagagtg

SEQ ID NO: 712840 - DNA, 20 bp, Artificial
  CRISPR gRNA sequence
tggacagaagcagagtggag

SEQ ID NO: 712841 - DNA, 20 bp, Artificial
  CRISPR gRNA sequence
aagaaaacacacacatcgtc

SEQ ID NO: 712842 - DNA, 20 bp, Artificial
  CRISPR gRNA sequence
aaacacacacatcgtctagc

SEQ ID NO: 712843 - DNA, 20 bp, Artificial
  CRISPR gRNA sequence
atcgtctagccagtgcccct

SEQ ID NO: 712844 - DNA, 20 bp, Artificial
  CRISPR gRNA sequence
ctgctatgtcctaactgtgc

SEQ ID NO: 712845 - DNA, 20 bp, Artificial
  CRISPR gRNA sequence
tgctatgtcctaactgtgcc

SEQ ID NO: 712846 - DNA, 20 bp, Artificial
  CRISPR gRNA sequence
atgtcctaactgtgccagga

SEQ ID NO: 712847 - DNA, 20 bp, Artificial
  CRISPR gRNA sequence
acttgtttatttatttattt

SEQ ID NO: 712848 - DNA, 20 bp, Artificial
  CRISPR gRNA sequence
gtttatttatttatttgaga

SEQ ID NO: 712849 - DNA, 20 bp, Artificial
  CRISPR gRNA sequence
ttatttatttatttgagaca

SEQ ID NO: 712850 - DNA, 20 bp, Artificial
  CRISPR gRNA sequence
cagagtcttactctgtcgcc

SEQ ID NO: 712851 - DNA, 20 bp, Artificial
  CRISPR gRNA sequence
agagtcttactctgtcgccc

SEQ ID NO: 712852 - DNA, 20 bp, Artificial
  CRISPR gRNA sequence
tcttactctgtcgcccaggc

SEQ ID NO: 712853 - DNA, 20 bp, Artificial
  CRISPR gRNA sequence
ttactctgtcgcccaggctg

SEQ ID NO: 712854 - DNA, 20 bp, Artificial
  CRISPR gRNA sequence
ctgtcgcccaggctggagtg

SEQ ID NO: 712855 - DNA, 20 bp, Artificial
  CRISPR gRNA sequence
ggagtgcagtgatgcaatct

SEQ ID NO: 712856 - DNA, 20 bp, Artificial
  CRISPR gRNA sequence
tcactgcaacctctgcctcc

SEQ ID NO: 712857 - DNA, 20 bp, Artificial
  CRISPR gRNA sequence
cactgcaacctctgcctccc

SEQ ID NO: 712858 - DNA, 20 bp, Artificial
  CRISPR gRNA sequence
aacctctgcctcccaggttc

SEQ ID NO: 712859 - DNA, 20 bp, Artificial
  CRISPR gRNA sequence
ttcaagcaattctcctgcct

SEQ ID NO: 712860 - DNA, 20 bp, Artificial
  CRISPR gRNA sequence
ttctcctgcctcagcctcct

SEQ ID NO: 712861 - DNA, 20 bp, Artificial
  CRISPR gRNA sequence
tcctgcctcagcctcctgag

SEQ ID NO: 712862 - DNA, 20 bp, Artificial
  CRISPR gRNA sequence
gcctcagcctcctgagtagc

SEQ ID NO: 712863 - DNA, 20 bp, Artificial
  CRISPR gRNA sequence
cctcagcctcctgagtagct

SEQ ID NO: 712864 - DNA, 20 bp, Artificial
  CRISPR gRNA sequence
ctcctgagtagctgggatta

SEQ ID NO: 712865 - DNA, 20 bp, Artificial
  CRISPR gRNA sequence
tcctgagtagctgggattac

SEQ ID NO: 712866 - DNA, 20 bp, Artificial
  CRISPR gRNA sequence
caggtgcctgcaaccacgcc

SEQ ID NO: 712867 - DNA, 20 bp, Artificial
  CRISPR gRNA sequence
aaccacgcccggctaatttt

SEQ ID NO: 712868 - DNA, 20 bp, Artificial
  CRISPR gRNA sequence
cacgcccggctaatttttag

SEQ ID NO: 712869 - DNA, 20 bp, Artificial
  CRISPR gRNA sequence
cgcccggctaatttttagta

SEQ ID NO: 712870 - DNA, 20 bp, Artificial
  CRISPR gRNA sequence
cggctaatttttagtagaga

SEQ ID NO: 712871 - DNA, 20 bp, Artificial
  CRISPR gRNA sequence
ggctaatttttagtagagac

SEQ ID NO: 712872 - DNA, 20 bp, Artificial
  CRISPR gRNA sequence
gctaatttttagtagagaca

SEQ ID NO: 712873 - DNA, 20 bp, Artificial
  CRISPR gRNA sequence
gagacagggtttcgccatgt

SEQ ID NO: 712874 - DNA, 20 bp, Artificial
  CRISPR gRNA sequence
cagggtttcgccatgttggc

SEQ ID NO: 712875 - DNA, 20 bp, Artificial
  CRISPR gRNA sequence
agggtttcgccatgttggcc

SEQ ID NO: 712876 - DNA, 20 bp, Artificial
  CRISPR gRNA sequence
tttcgccatgttggccaggc

SEQ ID NO: 712877 - DNA, 20 bp, Artificial
  CRISPR gRNA sequence
tggtctcgaactcctgacct

SEQ ID NO: 712878 - DNA, 20 bp, Artificial
  CRISPR gRNA sequence
ggtctcgaactcctgacctc

SEQ ID NO: 712879 - DNA, 20 bp, Artificial
  CRISPR gRNA sequence
ctcaggtgatccaccctcct

SEQ ID NO: 712880 - DNA, 20 bp, Artificial
  CRISPR gRNA sequence
ccaccctcctcagcctccca

SEQ ID NO: 712881 - DNA, 20 bp, Artificial
  CRISPR gRNA sequence
tcctcagcctcccaaagtgc

SEQ ID NO: 712882 - DNA, 20 bp, Artificial
  CRISPR gRNA sequence
cctcagcctcccaaagtgct

SEQ ID NO: 712883 - DNA, 20 bp, Artificial
  CRISPR gRNA sequence
ctcccaaagtgctgggattt

SEQ ID NO: 712884 - DNA, 20 bp, Artificial
  CRISPR gRNA sequence
tcccaaagtgctgggatttc

SEQ ID NO: 712885 - DNA, 20 bp, Artificial
  CRISPR gRNA sequence
agtgctgggatttcaggcat

SEQ ID NO: 712886 - DNA, 20 bp, Artificial
  CRISPR gRNA sequence
caggcataagctgccgtgcc

SEQ ID NO: 712887 - DNA, 20 bp, Artificial
  CRISPR gRNA sequence
ataagctgccgtgcccagcc

SEQ ID NO: 712888 - DNA, 20 bp, Artificial
  CRISPR gRNA sequence
tataatcatacactcttcac

SEQ ID NO: 712889 - DNA, 20 bp, Artificial
  CRISPR gRNA sequence
ataatcatacactcttcacc

SEQ ID NO: 712890 - DNA, 20 bp, Artificial
  CRISPR gRNA sequence
actcttcaccaggctgtcgt

SEQ ID NO: 712891 - DNA, 20 bp, Artificial
  CRISPR gRNA sequence
ctcttcaccaggctgtcgtc

SEQ ID NO: 712892 - DNA, 20 bp, Artificial
  CRISPR gRNA sequence
caggctgtcgtcaggataaa

SEQ ID NO: 712893 - DNA, 20 bp, Artificial
  CRISPR gRNA sequence
gctgtcgtcaggataaacag

SEQ ID NO: 712894 - DNA, 20 bp, Artificial
  CRISPR gRNA sequence
tgtcgtcaggataaacagaa

SEQ ID NO: 712895 - DNA, 20 bp, Artificial
  CRISPR gRNA sequence
ataaacagaagagtgcacgt

SEQ ID NO: 712896 - DNA, 20 bp, Artificial
  CRISPR gRNA sequence
taaacagaagagtgcacgtg

SEQ ID NO: 712897 - DNA, 20 bp, Artificial
  CRISPR gRNA sequence
ccatcacattgcatgacata

SEQ ID NO: 712898 - DNA, 20 bp, Artificial
  CRISPR gRNA sequence
gctatgtccttacacccatc

SEQ ID NO: 712899 - DNA, 20 bp, Artificial
  CRISPR gRNA sequence
tggactcccatcccaacact

SEQ ID NO: 712900 - DNA, 20 bp, Artificial
  CRISPR gRNA sequence
actcccatcccaacacttag

SEQ ID NO: 712901 - DNA, 20 bp, Artificial
  CRISPR gRNA sequence
ctcccatcccaacacttaga

SEQ ID NO: 712902 - DNA, 20 bp, Artificial
  CRISPR gRNA sequence
gaaggtgacccgtatgtcgc

SEQ ID NO: 712903 - DNA, 20 bp, Artificial
  CRISPR gRNA sequence
aaggtgacccgtatgtcgcc

SEQ ID NO: 712904 - DNA, 20 bp, Artificial
  CRISPR gRNA sequence
gacccgtatgtcgccaggca

SEQ ID NO: 712905 - DNA, 20 bp, Artificial
  CRISPR gRNA sequence
ccgtatgtcgccaggcacgg

SEQ ID NO: 712906 - DNA, 20 bp, Artificial
  CRISPR gRNA sequence
cacctgtaatcccaacactt

SEQ ID NO: 712907 - DNA, 20 bp, Artificial
  CRISPR gRNA sequence
acctgtaatcccaacacttt

SEQ ID NO: 712908 - DNA, 20 bp, Artificial
  CRISPR gRNA sequence
ctgtaatcccaacactttgg

SEQ ID NO: 712909 - DNA, 20 bp, Artificial
  CRISPR gRNA sequence
tgtaatcccaacactttggg

SEQ ID NO: 712910 - DNA, 20 bp, Artificial
  CRISPR gRNA sequence
tcccaacactttgggaggcc

SEQ ID NO: 712911 - DNA, 20 bp, Artificial
  CRISPR gRNA sequence
cccaacactttgggaggccg

SEQ ID NO: 712912 - DNA, 20 bp, Artificial
  CRISPR gRNA sequence
aacactttgggaggccgagg

SEQ ID NO: 712913 - DNA, 20 bp, Artificial
  CRISPR gRNA sequence
acactttgggaggccgaggt

SEQ ID NO: 712914 - DNA, 20 bp, Artificial
  CRISPR gRNA sequence
ctttgggaggccgaggtggg

SEQ ID NO: 712915 - DNA, 20 bp, Artificial
  CRISPR gRNA sequence
ggccgaggtgggcggatcat

SEQ ID NO: 712916 - DNA, 20 bp, Artificial
  CRISPR gRNA sequence
gccgaggtgggcggatcatg

SEQ ID NO: 712917 - DNA, 20 bp, Artificial
  CRISPR gRNA sequence
aggtgggcggatcatgaggt

SEQ ID NO: 712918 - DNA, 20 bp, Artificial
  CRISPR gRNA sequence
ggtgggcggatcatgaggtc

SEQ ID NO: 712919 - DNA, 20 bp, Artificial
  CRISPR gRNA sequence
tgggcggatcatgaggtcag

SEQ ID NO: 712920 - DNA, 20 bp, Artificial
  CRISPR gRNA sequence
gatcatgaggtcaggagttc

SEQ ID NO: 712921 - DNA, 20 bp, Artificial
  CRISPR gRNA sequence
tgaggtcaggagttcgagac

SEQ ID NO: 712922 - DNA, 20 bp, Artificial
  CRISPR gRNA sequence
tcaggagttcgagaccagcc

SEQ ID NO: 712923 - DNA, 20 bp, Artificial
  CRISPR gRNA sequence
cgagaccagcctggacaaca

SEQ ID NO: 712924 - DNA, 20 bp, Artificial
  CRISPR gRNA sequence
ctactaaaattacaaaaaat

SEQ ID NO: 712925 - DNA, 20 bp, Artificial
  CRISPR gRNA sequence
taaaattacaaaaaattagc

SEQ ID NO: 712926 - DNA, 20 bp, Artificial
  CRISPR gRNA sequence
aaaattacaaaaaattagcc

SEQ ID NO: 712927 - DNA, 20 bp, Artificial
  CRISPR gRNA sequence
tacaaaaaattagccgggca

SEQ ID NO: 712928 - DNA, 20 bp, Artificial
  CRISPR gRNA sequence
aaaaaattagccgggcatgg

SEQ ID NO: 712929 - DNA, 20 bp, Artificial
  CRISPR gRNA sequence
aaattagccgggcatggtgg

SEQ ID NO: 712930 - DNA, 20 bp, Artificial
  CRISPR gRNA sequence
aattagccgggcatggtggc

SEQ ID NO: 712931 - DNA, 20 bp, Artificial
  CRISPR gRNA sequence
gtggcaggtacctgtaatcc

SEQ ID NO: 712932 - DNA, 20 bp, Artificial
  CRISPR gRNA sequence
tacctgtaatcccagctact

SEQ ID NO: 712933 - DNA, 20 bp, Artificial
  CRISPR gRNA sequence
acctgtaatcccagctactc

SEQ ID NO: 712934 - DNA, 20 bp, Artificial
  CRISPR gRNA sequence
ctgtaatcccagctactcag

SEQ ID NO: 712935 - DNA, 20 bp, Artificial
  CRISPR gRNA sequence
tgtaatcccagctactcagg

SEQ ID NO: 712936 - DNA, 20 bp, Artificial
  CRISPR gRNA sequence
tcccagctactcaggaggct

SEQ ID NO: 712937 - DNA, 20 bp, Artificial
  CRISPR gRNA sequence
cccagctactcaggaggctg

SEQ ID NO: 712938 - DNA, 20 bp, Artificial
  CRISPR gRNA sequence
agctactcaggaggctgagg

SEQ ID NO: 712939 - DNA, 20 bp, Artificial
  CRISPR gRNA sequence
gctactcaggaggctgaggc

SEQ ID NO: 712940 - DNA, 20 bp, Artificial
  CRISPR gRNA sequence
tactcaggaggctgaggcag

SEQ ID NO: 712941 - DNA, 20 bp, Artificial
  CRISPR gRNA sequence
gcaggagaatcacttgaatc

SEQ ID NO: 712942 - DNA, 20 bp, Artificial
  CRISPR gRNA sequence
caggagaatcacttgaatcc

SEQ ID NO: 712943 - DNA, 20 bp, Artificial
  CRISPR gRNA sequence
ggagaatcacttgaatccgg

SEQ ID NO: 712944 - DNA, 20 bp, Artificial
  CRISPR gRNA sequence
gagaatcacttgaatccggg

SEQ ID NO: 712945 - DNA, 20 bp, Artificial
  CRISPR gRNA sequence
aatcacttgaatccgggagg

SEQ ID NO: 712946 - DNA, 20 bp, Artificial
  CRISPR gRNA sequence
tcacttgaatccgggaggca

SEQ ID NO: 712947 - DNA, 20 bp, Artificial
  CRISPR gRNA sequence
cacttgaatccgggaggcag

SEQ ID NO: 712948 - DNA, 20 bp, Artificial
  CRISPR gRNA sequence
aatccgggaggcagaggttg

SEQ ID NO: 712949 - DNA, 20 bp, Artificial
  CRISPR gRNA sequence
cgggaggcagaggttgcagt

SEQ ID NO: 712950 - DNA, 20 bp, Artificial
  CRISPR gRNA sequence
ggcagaggttgcagtgagct

SEQ ID NO: 712951 - DNA, 20 bp, Artificial
  CRISPR gRNA sequence
gagatcacaccattgcactc

SEQ ID NO: 712952 - DNA, 20 bp, Artificial
  CRISPR gRNA sequence
cacaccattgcactctagtc

SEQ ID NO: 712953 - DNA, 20 bp, Artificial
  CRISPR gRNA sequence
acaccattgcactctagtct

SEQ ID NO: 712954 - DNA, 20 bp, Artificial
  CRISPR gRNA sequence
ttgcactctagtctgggtga

SEQ ID NO: 712955 - DNA, 20 bp, Artificial
  CRISPR gRNA sequence
tctagtctgggtgacagatc

SEQ ID NO: 712956 - DNA, 20 bp, Artificial
  CRISPR gRNA sequence
ctagtctgggtgacagatcg

SEQ ID NO: 712957 - DNA, 20 bp, Artificial
  CRISPR gRNA sequence
aaaaaaaaaaaataaaaaaa

SEQ ID NO: 712958 - DNA, 20 bp, Artificial
  CRISPR gRNA sequence
aaaaaaaaataaaaaaatgg

SEQ ID NO: 712959 - DNA, 20 bp, Artificial
  CRISPR gRNA sequence
aaaatggtggcctgtatgtg

SEQ ID NO: 712960 - DNA, 20 bp, Artificial
  CRISPR gRNA sequence
aaatggtggcctgtatgtgt

SEQ ID NO: 712961 - DNA, 20 bp, Artificial
  CRISPR gRNA sequence
atgtgtgggacttcgctctg

SEQ ID NO: 712962 - DNA, 20 bp, Artificial
  CRISPR gRNA sequence
cttcgctctgaagctttccg

SEQ ID NO: 712963 - DNA, 20 bp, Artificial
  CRISPR gRNA sequence
tcgctctgaagctttccgtg

SEQ ID NO: 712964 - DNA, 20 bp, Artificial
  CRISPR gRNA sequence
cgctctgaagctttccgtgg

SEQ ID NO: 712965 - DNA, 20 bp, Artificial
  CRISPR gRNA sequence
ctgaagctttccgtggaggt

SEQ ID NO: 712966 - DNA, 20 bp, Artificial
  CRISPR gRNA sequence
ctttccgtggaggtgagcgc

SEQ ID NO: 712967 - DNA, 20 bp, Artificial
  CRISPR gRNA sequence
tgctgacctctcgtgttctg

SEQ ID NO: 712968 - DNA, 20 bp, Artificial
  CRISPR gRNA sequence
acctctcgtgttctgtggca

SEQ ID NO: 712969 - DNA, 20 bp, Artificial
  CRISPR gRNA sequence
tctcgtgttctgtggcatgg

SEQ ID NO: 712970 - DNA, 20 bp, Artificial
  CRISPR gRNA sequence
tcgtgttctgtggcatggtg

SEQ ID NO: 712971 - DNA, 20 bp, Artificial
  CRISPR gRNA sequence
atggtggagtgatgacacct

SEQ ID NO: 712972 - DNA, 20 bp, Artificial
  CRISPR gRNA sequence
ggagtgatgacacctaagct

SEQ ID NO: 712973 - DNA, 20 bp, Artificial
  CRISPR gRNA sequence
catttcctgctctgtctccg

SEQ ID NO: 712974 - DNA, 20 bp, Artificial
  CRISPR gRNA sequence
atttcctgctctgtctccgc

SEQ ID NO: 712975 - DNA, 20 bp, Artificial
  CRISPR gRNA sequence
ggcaatttacctcccatctc

SEQ ID NO: 712976 - DNA, 20 bp, Artificial
  CRISPR gRNA sequence
cggacctcgatttccacacc

SEQ ID NO: 712977 - DNA, 20 bp, Artificial
  CRISPR gRNA sequence
cgatttccacacctggaaaa

SEQ ID NO: 712978 - DNA, 20 bp, Artificial
  CRISPR gRNA sequence
gatttccacacctggaaaat

SEQ ID NO: 712979 - DNA, 20 bp, Artificial
  CRISPR gRNA sequence
atttccacacctggaaaatg

SEQ ID NO: 712980 - DNA, 20 bp, Artificial
  CRISPR gRNA sequence
ggctaatactgtctgtctta

SEQ ID NO: 712981 - DNA, 20 bp, Artificial
  CRISPR gRNA sequence
ctaatactgtctgtcttatg

SEQ ID NO: 712982 - DNA, 20 bp, Artificial
  CRISPR gRNA sequence
tgtctgtcttatggagacgt

SEQ ID NO: 712983 - DNA, 20 bp, Artificial
  CRISPR gRNA sequence
ttatggagacgtgagaattt

SEQ ID NO: 712984 - DNA, 20 bp, Artificial
  CRISPR gRNA sequence
tatggagacgtgagaatttc

SEQ ID NO: 712985 - DNA, 20 bp, Artificial
  CRISPR gRNA sequence
tggagacgtgagaatttcag

SEQ ID NO: 712986 - DNA, 20 bp, Artificial
  CRISPR gRNA sequence
gagacgtgagaatttcagga

SEQ ID NO: 712987 - DNA, 20 bp, Artificial
  CRISPR gRNA sequence
cgtgagaatttcaggagaga

SEQ ID NO: 712988 - DNA, 20 bp, Artificial
  CRISPR gRNA sequence
agaatttcaggagagacagc

SEQ ID NO: 712989 - DNA, 20 bp, Artificial
  CRISPR gRNA sequence
ttcaggagagacagccagtg

SEQ ID NO: 712990 - DNA, 20 bp, Artificial
  CRISPR gRNA sequence
tcaggagagacagccagtga

SEQ ID NO: 712991 - DNA, 20 bp, Artificial
  CRISPR gRNA sequence
agacagccagtgaaggctct

SEQ ID NO: 712992 - DNA, 20 bp, Artificial
  CRISPR gRNA sequence
gccagtgaaggctcttagcg

SEQ ID NO: 712993 - DNA, 20 bp, Artificial
  CRISPR gRNA sequence
ccagtgaaggctcttagcgt

SEQ ID NO: 712994 - DNA, 20 bp, Artificial
  CRISPR gRNA sequence
cagtgaaggctcttagcgtg

SEQ ID NO: 712995 - DNA, 20 bp, Artificial
  CRISPR gRNA sequence
aaggctcttagcgtggggct

SEQ ID NO: 712996 - DNA, 20 bp, Artificial
  CRISPR gRNA sequence
tagcgtggggcttggctgac

SEQ ID NO: 712997 - DNA, 20 bp, Artificial
  CRISPR gRNA sequence
gcgtggggcttggctgactg

SEQ ID NO: 712998 - DNA, 20 bp, Artificial
  CRISPR gRNA sequence
cgtggggcttggctgactgg

SEQ ID NO: 712999 - DNA, 20 bp, Artificial
  CRISPR gRNA sequence
ggggcttggctgactggagg

SEQ ID NO: 713000 - DNA, 20 bp, Artificial
  CRISPR gRNA sequence
agaaactgctttctatttta

SEQ ID NO: 713001 - DNA, 20 bp, Artificial
  CRISPR gRNA sequence
actgctttctattttacagc

SEQ ID NO: 713002 - DNA, 20 bp, Artificial
  CRISPR gRNA sequence
tggaaaaaaaacaacaaccc

SEQ ID NO: 713003 - DNA, 20 bp, Artificial
  CRISPR gRNA sequence
gaaaaaaaacaacaaccccg

SEQ ID NO: 713004 - DNA, 20 bp, Artificial
  CRISPR gRNA sequence
aaaaaaacaacaaccccgga

SEQ ID NO: 713005 - DNA, 20 bp, Artificial
  CRISPR gRNA sequence
aaccccggagagctgcccca

SEQ ID NO: 713006 - DNA, 20 bp, Artificial
  CRISPR gRNA sequence
accccggagagctgccccat

SEQ ID NO: 713007 - DNA, 20 bp, Artificial
  CRISPR gRNA sequence
cggagagctgccccatgggt

SEQ ID NO: 713008 - DNA, 20 bp, Artificial
  CRISPR gRNA sequence
ctgccccatgggtgagtcca

SEQ ID NO: 713009 - DNA, 20 bp, Artificial
  CRISPR gRNA sequence
tgccccatgggtgagtccac

SEQ ID NO: 713010 - DNA, 20 bp, Artificial
  CRISPR gRNA sequence
gccccatgggtgagtccaca

SEQ ID NO: 713011 - DNA, 20 bp, Artificial
  CRISPR gRNA sequence
ccccatgggtgagtccacag

SEQ ID NO: 713012 - DNA, 20 bp, Artificial
  CRISPR gRNA sequence
ggtgagtccacaggggaccc

SEQ ID NO: 713013 - DNA, 20 bp, Artificial
  CRISPR gRNA sequence
tgagtccacaggggacccca

SEQ ID NO: 713014 - DNA, 20 bp, Artificial
  CRISPR gRNA sequence
aggggaccccagagattaac

SEQ ID NO: 713015 - DNA, 20 bp, Artificial
  CRISPR gRNA sequence
ggggaccccagagattaacc

SEQ ID NO: 713016 - DNA, 20 bp, Artificial
  CRISPR gRNA sequence
gggaccccagagattaacca

SEQ ID NO: 713017 - DNA, 20 bp, Artificial
  CRISPR gRNA sequence
cccagagattaaccagggtt

SEQ ID NO: 713018 - DNA, 20 bp, Artificial
  CRISPR gRNA sequence
agagattaaccagggtttgg

SEQ ID NO: 713019 - DNA, 20 bp, Artificial
  CRISPR gRNA sequence
ttaaccagggtttggcagct

SEQ ID NO: 713020 - DNA, 20 bp, Artificial
  CRISPR gRNA sequence
cagggtttggcagctgagat

SEQ ID NO: 713021 - DNA, 20 bp, Artificial
  CRISPR gRNA sequence
agattagaacacttctaaaa

SEQ ID NO: 713022 - DNA, 20 bp, Artificial
  CRISPR gRNA sequence
tctaaaacagtgctgtccaa

SEQ ID NO: 713023 - DNA, 20 bp, Artificial
  CRISPR gRNA sequence
taaaacagtgctgtccaaca

SEQ ID NO: 713024 - DNA, 20 bp, Artificial
  CRISPR gRNA sequence
gctgtccaacagagatatgc

SEQ ID NO: 713025 - DNA, 20 bp, Artificial
  CRISPR gRNA sequence
acagagatatgcgagtcaca

SEQ ID NO: 713026 - DNA, 20 bp, Artificial
  CRISPR gRNA sequence
cagagatatgcgagtcacac

SEQ ID NO: 713027 - DNA, 20 bp, Artificial
  CRISPR gRNA sequence
gatatgcgagtcacacaggc

SEQ ID NO: 713028 - DNA, 20 bp, Artificial
  CRISPR gRNA sequence
acaggccagctcaaatattc

SEQ ID NO: 713029 - DNA, 20 bp, Artificial
  CRISPR gRNA sequence
caggccagctcaaatattct

SEQ ID NO: 713030 - DNA, 20 bp, Artificial
  CRISPR gRNA sequence
ggccagctcaaatattctgg

SEQ ID NO: 713031 - DNA, 20 bp, Artificial
  CRISPR gRNA sequence
ttctgggagccacactttaa

SEQ ID NO: 713032 - DNA, 20 bp, Artificial
  CRISPR gRNA sequence
tctgggagccacactttaaa

SEQ ID NO: 713033 - DNA, 20 bp, Artificial
  CRISPR gRNA sequence
gccacactttaaaaggtaaa

SEQ ID NO: 713034 - DNA, 20 bp, Artificial
  CRISPR gRNA sequence
tttaaaaggtaaaaagaaat

SEQ ID NO: 713035 - DNA, 20 bp, Artificial
  CRISPR gRNA sequence
ttaattttcattatttaacc

SEQ ID NO: 713036 - DNA, 20 bp, Artificial
  CRISPR gRNA sequence
ctaaaatattaccatgtttg

SEQ ID NO: 713037 - DNA, 20 bp, Artificial
  CRISPR gRNA sequence
taaaatattaccatgtttgc

SEQ ID NO: 713038 - DNA, 20 bp, Artificial
  CRISPR gRNA sequence
attatattcttgtttatact

SEQ ID NO: 713039 - DNA, 20 bp, Artificial
  CRISPR gRNA sequence
tatactaagttttcgaaatc

SEQ ID NO: 713040 - DNA, 20 bp, Artificial
  CRISPR gRNA sequence
tccagtgcatattgtacaca

SEQ ID NO: 713041 - DNA, 20 bp, Artificial
  CRISPR gRNA sequence
acacacagcacttctcaatg

SEQ ID NO: 713042 - DNA, 20 bp, Artificial
  CRISPR gRNA sequence
gcattttttttattttttat

SEQ ID NO: 713043 - DNA, 20 bp, Artificial
  CRISPR gRNA sequence
atcggattttttttttgaaa

SEQ ID NO: 713044 - DNA, 20 bp, Artificial
  CRISPR gRNA sequence
cggattttttttttgaaaca

SEQ ID NO: 713045 - DNA, 20 bp, Artificial
  CRISPR gRNA sequence
cagagtctaactctgtcgcc

SEQ ID NO: 713046 - DNA, 20 bp, Artificial
  CRISPR gRNA sequence
agagtctaactctgtcgccc

SEQ ID NO: 713047 - DNA, 20 bp, Artificial
  CRISPR gRNA sequence
tctaactctgtcgcccaggt

SEQ ID NO: 713048 - DNA, 20 bp, Artificial
  CRISPR gRNA sequence
taactctgtcgcccaggttg

SEQ ID NO: 713049 - DNA, 20 bp, Artificial
  CRISPR gRNA sequence
ctgtcgcccaggttggagtg

SEQ ID NO: 713050 - DNA, 20 bp, Artificial
  CRISPR gRNA sequence
tcgcccaggttggagtgcag

SEQ ID NO: 713051 - DNA, 20 bp, Artificial
  CRISPR gRNA sequence
ggagtgcagtggcacaatct

SEQ ID NO: 713052 - DNA, 20 bp, Artificial
  CRISPR gRNA sequence
tcactacaacctccacctcc

SEQ ID NO: 713053 - DNA, 20 bp, Artificial
  CRISPR gRNA sequence
aacctccacctcccggattc

SEQ ID NO: 713054 - DNA, 20 bp, Artificial
  CRISPR gRNA sequence
ttcaagcaattctcatgcct

SEQ ID NO: 713055 - DNA, 20 bp, Artificial
  CRISPR gRNA sequence
ttctcatgcctcagcctccc

SEQ ID NO: 713056 - DNA, 20 bp, Artificial
  CRISPR gRNA sequence
tcatgcctcagcctcccaag

SEQ ID NO: 713057 - DNA, 20 bp, Artificial
  CRISPR gRNA sequence
cctcagcctcccaagtagtt

SEQ ID NO: 713058 - DNA, 20 bp, Artificial
  CRISPR gRNA sequence
tcccaagtagttgagatttc

SEQ ID NO: 713059 - DNA, 20 bp, Artificial
  CRISPR gRNA sequence
caagcacccgccaccacacc

SEQ ID NO: 713060 - DNA, 20 bp, Artificial
  CRISPR gRNA sequence
ctggccaacttttgtatttt

SEQ ID NO: 713061 - DNA, 20 bp, Artificial
  CRISPR gRNA sequence
gccaacttttgtatttttag

SEQ ID NO: 713062 - DNA, 20 bp, Artificial
  CRISPR gRNA sequence
caacttttgtatttttagta

SEQ ID NO: 713063 - DNA, 20 bp, Artificial
  CRISPR gRNA sequence
tttgtatttttagtagagac

SEQ ID NO: 713064 - DNA, 20 bp, Artificial
  CRISPR gRNA sequence
ttgtatttttagtagagacg

SEQ ID NO: 713065 - DNA, 20 bp, Artificial
  CRISPR gRNA sequence
gagacgaggtttcaccacat

SEQ ID NO: 713066 - DNA, 20 bp, Artificial
  CRISPR gRNA sequence
cgaggtttcaccacattggc

SEQ ID NO: 713067 - DNA, 20 bp, Artificial
  CRISPR gRNA sequence
gaggtttcaccacattggcc

SEQ ID NO: 713068 - DNA, 20 bp, Artificial
  CRISPR gRNA sequence
tttcaccacattggccaggc

SEQ ID NO: 713069 - DNA, 20 bp, Artificial
  CRISPR gRNA sequence
ggtctcaaactcctgacttc

SEQ ID NO: 713070 - DNA, 20 bp, Artificial
  CRISPR gRNA sequence
ttcaagtgatccgcctgcct

SEQ ID NO: 713071 - DNA, 20 bp, Artificial
  CRISPR gRNA sequence
gcctcagcctcccaaaatgc

SEQ ID NO: 713072 - DNA, 20 bp, Artificial
  CRISPR gRNA sequence
ctcccaaaatgctggaatta

SEQ ID NO: 713073 - DNA, 20 bp, Artificial
  CRISPR gRNA sequence
tcccaaaatgctggaattac

SEQ ID NO: 713074 - DNA, 20 bp, Artificial
  CRISPR gRNA sequence
aatgctggaattacaggtgt

SEQ ID NO: 713075 - DNA, 20 bp, Artificial
  CRISPR gRNA sequence
caggtgtgagccaccgcacc

SEQ ID NO: 713076 - DNA, 20 bp, Artificial
  CRISPR gRNA sequence
gagccaccgcacccggcccc

SEQ ID NO: 713077 - DNA, 20 bp, Artificial
  CRISPR gRNA sequence
ccggcccctagctgcatttt

SEQ ID NO: 713078 - DNA, 20 bp, Artificial
  CRISPR gRNA sequence
ctagctgcattttaagtgcg

SEQ ID NO: 713079 - DNA, 20 bp, Artificial
  CRISPR gRNA sequence
aagtgcgtggccacgtgcca

SEQ ID NO: 713080 - DNA, 20 bp, Artificial
  CRISPR gRNA sequence
agtgcgtggccacgtgccac

SEQ ID NO: 713081 - DNA, 20 bp, Artificial
  CRISPR gRNA sequence
cgtggccacgtgccacgggc

SEQ ID NO: 713082 - DNA, 20 bp, Artificial
  CRISPR gRNA sequence
gtggccacgtgccacgggcc

SEQ ID NO: 713083 - DNA, 20 bp, Artificial
  CRISPR gRNA sequence
tggccacgtgccacgggcca

SEQ ID NO: 713084 - DNA, 20 bp, Artificial
  CRISPR gRNA sequence
ggccacgtgccacgggccag

SEQ ID NO: 713085 - DNA, 20 bp, Artificial
  CRISPR gRNA sequence
acgggccaggggcactgcat

SEQ ID NO: 713086 - DNA, 20 bp, Artificial
  CRISPR gRNA sequence
cgggccaggggcactgcatt

SEQ ID NO: 713087 - DNA, 20 bp, Artificial
  CRISPR gRNA sequence
gccaggggcactgcattggg

SEQ ID NO: 713088 - DNA, 20 bp, Artificial
  CRISPR gRNA sequence
ggggcactgcattgggcagc

SEQ ID NO: 713089 - DNA, 20 bp, Artificial
  CRISPR gRNA sequence
gggcactgcattgggcagct

SEQ ID NO: 713090 - DNA, 20 bp, Artificial
  CRISPR gRNA sequence
ggcactgcattgggcagctg

SEQ ID NO: 713091 - DNA, 20 bp, Artificial
  CRISPR gRNA sequence
tgcattgggcagctggggtc

SEQ ID NO: 713092 - DNA, 20 bp, Artificial
  CRISPR gRNA sequence
gcattgggcagctggggtcc

SEQ ID NO: 713093 - DNA, 20 bp, Artificial
  CRISPR gRNA sequence
cattgggcagctggggtcca

SEQ ID NO: 713094 - DNA, 20 bp, Artificial
  CRISPR gRNA sequence
attgggcagctggggtccag

SEQ ID NO: 713095 - DNA, 20 bp, Artificial
  CRISPR gRNA sequence
gggcagctggggtccagggg

SEQ ID NO: 713096 - DNA, 20 bp, Artificial
  CRISPR gRNA sequence
gctggggtccaggggcagca

SEQ ID NO: 713097 - DNA, 20 bp, Artificial
  CRISPR gRNA sequence
ctggggtccaggggcagcaa

SEQ ID NO: 713098 - DNA, 20 bp, Artificial
  CRISPR gRNA sequence
tggggtccaggggcagcaaa

SEQ ID NO: 713099 - DNA, 20 bp, Artificial
  CRISPR gRNA sequence
gggtccaggggcagcaaagg

SEQ ID NO: 713100 - DNA, 20 bp, Artificial
  CRISPR gRNA sequence
ggtccaggggcagcaaaggg

SEQ ID NO: 713101 - DNA, 20 bp, Artificial
  CRISPR gRNA sequence
gggcagcaaagggaggcctc

SEQ ID NO: 713102 - DNA, 20 bp, Artificial
  CRISPR gRNA sequence
aggcctctggcgccgctgtg

SEQ ID NO: 713103 - DNA, 20 bp, Artificial
  CRISPR gRNA sequence
cctctggcgccgctgtgtgg

SEQ ID NO: 713104 - DNA, 20 bp, Artificial
  CRISPR gRNA sequence
gcgccgctgtgtggcagtct

SEQ ID NO: 713105 - DNA, 20 bp, Artificial
  CRISPR gRNA sequence
cgccgctgtgtggcagtctc

SEQ ID NO: 713106 - DNA, 20 bp, Artificial
  CRISPR gRNA sequence
gcagtctcaggaacactgcc

SEQ ID NO: 713107 - DNA, 20 bp, Artificial
  CRISPR gRNA sequence
tctcaggaacactgcccaga

SEQ ID NO: 713108 - DNA, 20 bp, Artificial
  CRISPR gRNA sequence
cactgcccagacagtccctc

SEQ ID NO: 713109 - DNA, 20 bp, Artificial
  CRISPR gRNA sequence
tgcccagacagtccctccag

SEQ ID NO: 713110 - DNA, 20 bp, Artificial
  CRISPR gRNA sequence
gcccagacagtccctccagc

SEQ ID NO: 713111 - DNA, 20 bp, Artificial
  CRISPR gRNA sequence
cagacagtccctccagcagg

SEQ ID NO: 713112 - DNA, 20 bp, Artificial
  CRISPR gRNA sequence
gtccctccagcaggaagcct

SEQ ID NO: 713113 - DNA, 20 bp, Artificial
  CRISPR gRNA sequence
ctccagcaggaagccttggc

SEQ ID NO: 713114 - DNA, 20 bp, Artificial
  CRISPR gRNA sequence
tggctggaacaactgaactc

SEQ ID NO: 713115 - DNA, 20 bp, Artificial
  CRISPR gRNA sequence
aactcaagatgtttttcaca

SEQ ID NO: 713116 - DNA, 20 bp, Artificial
  CRISPR gRNA sequence
agatgtttttcacaaagatg

SEQ ID NO: 713117 - DNA, 20 bp, Artificial
  CRISPR gRNA sequence
tgtttttcacaaagatgcag

SEQ ID NO: 713118 - DNA, 20 bp, Artificial
  CRISPR gRNA sequence
acaaagatgcagaagtttct

SEQ ID NO: 713119 - DNA, 20 bp, Artificial
  CRISPR gRNA sequence
agatgcagaagtttctgagc

SEQ ID NO: 713120 - DNA, 20 bp, Artificial
  CRISPR gRNA sequence
gtttctgagctggaaacttt

SEQ ID NO: 713121 - DNA, 20 bp, Artificial
  CRISPR gRNA sequence
tttctgagctggaaactttt

SEQ ID NO: 713122 - DNA, 20 bp, Artificial
  CRISPR gRNA sequence
ctgagctggaaacttttggg

SEQ ID NO: 713123 - DNA, 20 bp, Artificial
  CRISPR gRNA sequence
ctggaaacttttgggaagtt

SEQ ID NO: 713124 - DNA, 20 bp, Artificial
  CRISPR gRNA sequence
tttgggaagtttggcctttt

SEQ ID NO: 713125 - DNA, 20 bp, Artificial
  CRISPR gRNA sequence
tgggaagtttggcctttttg

SEQ ID NO: 713126 - DNA, 20 bp, Artificial
  CRISPR gRNA sequence
ggaagtttggcctttttgga

SEQ ID NO: 713127 - DNA, 20 bp, Artificial
  CRISPR gRNA sequence
gaagtttggcctttttggag

SEQ ID NO: 713128 - DNA, 20 bp, Artificial
  CRISPR gRNA sequence
gcctttttggagaggccccc

SEQ ID NO: 713129 - DNA, 20 bp, Artificial
  CRISPR gRNA sequence
cctttttggagaggccccca

SEQ ID NO: 713130 - DNA, 20 bp, Artificial
  CRISPR gRNA sequence
ggagaggcccccaaggcctt

SEQ ID NO: 713131 - DNA, 20 bp, Artificial
  CRISPR gRNA sequence
tcagttatacctcctcattt

SEQ ID NO: 713132 - DNA, 20 bp, Artificial
  CRISPR gRNA sequence
agttatacctcctcatttga

SEQ ID NO: 713133 - DNA, 20 bp, Artificial
  CRISPR gRNA sequence
atacctcctcatttgagaga

SEQ ID NO: 713134 - DNA, 20 bp, Artificial
  CRISPR gRNA sequence
tacctcctcatttgagagat

SEQ ID NO: 713135 - DNA, 20 bp, Artificial
  CRISPR gRNA sequence
acctcctcatttgagagatg

SEQ ID NO: 713136 - DNA, 20 bp, Artificial
  CRISPR gRNA sequence
ctcctcatttgagagatggg

SEQ ID NO: 713137 - DNA, 20 bp, Artificial
  CRISPR gRNA sequence
atttgagagatggggagacc

SEQ ID NO: 713138 - DNA, 20 bp, Artificial
  CRISPR gRNA sequence
tttgagagatggggagaccg

SEQ ID NO: 713139 - DNA, 20 bp, Artificial
  CRISPR gRNA sequence
gagatggggagaccgaggtc

SEQ ID NO: 713140 - DNA, 20 bp, Artificial
  CRISPR gRNA sequence
gatggggagaccgaggtcca

SEQ ID NO: 713141 - DNA, 20 bp, Artificial
  CRISPR gRNA sequence
atggggagaccgaggtccag

SEQ ID NO: 713142 - DNA, 20 bp, Artificial
  CRISPR gRNA sequence
gggagaccgaggtccagagg

SEQ ID NO: 713143 - DNA, 20 bp, Artificial
  CRISPR gRNA sequence
ggagaccgaggtccagaggc

SEQ ID NO: 713144 - DNA, 20 bp, Artificial
  CRISPR gRNA sequence
gaccgaggtccagaggcggg

SEQ ID NO: 713145 - DNA, 20 bp, Artificial
  CRISPR gRNA sequence
accgaggtccagaggcgggt

SEQ ID NO: 713146 - DNA, 20 bp, Artificial
  CRISPR gRNA sequence
gcgggtgggaacatgcccca

SEQ ID NO: 713147 - DNA, 20 bp, Artificial
  CRISPR gRNA sequence
tgcaaatctttgcaaaatcc

SEQ ID NO: 713148 - DNA, 20 bp, Artificial
  CRISPR gRNA sequence
gcaaatctttgcaaaatcct

SEQ ID NO: 713149 - DNA, 20 bp, Artificial
  CRISPR gRNA sequence
aatcctaggtatctgctgcc

SEQ ID NO: 713150 - DNA, 20 bp, Artificial
  CRISPR gRNA sequence
atctgctgcccagtccactc

SEQ ID NO: 713151 - DNA, 20 bp, Artificial
  CRISPR gRNA sequence
ccagcactctcccctgctta

SEQ ID NO: 713152 - DNA, 20 bp, Artificial
  CRISPR gRNA sequence
cagcactctcccctgcttat

SEQ ID NO: 713153 - DNA, 20 bp, Artificial
  CRISPR gRNA sequence
cactctcccctgcttatggg

SEQ ID NO: 713154 - DNA, 20 bp, Artificial
  CRISPR gRNA sequence
ctctcccctgcttatgggtg

SEQ ID NO: 713155 - DNA, 20 bp, Artificial
  CRISPR gRNA sequence
tctcccctgcttatgggtgg

SEQ ID NO: 713156 - DNA, 20 bp, Artificial
  CRISPR gRNA sequence
tggaggcctccatcattcct

SEQ ID NO: 713157 - DNA, 20 bp, Artificial
  CRISPR gRNA sequence
aggcctccatcattccttag

SEQ ID NO: 713158 - DNA, 20 bp, Artificial
  CRISPR gRNA sequence
gcctccatcattccttagca

SEQ ID NO: 713159 - DNA, 20 bp, Artificial
  CRISPR gRNA sequence
agagcgctctcccccgaccc

SEQ ID NO: 713160 - DNA, 20 bp, Artificial
  CRISPR gRNA sequence
ccccgaccctggaatttgac

SEQ ID NO: 713161 - DNA, 20 bp, Artificial
  CRISPR gRNA sequence
tttgaactccacccccccac

SEQ ID NO: 713162 - DNA, 20 bp, Artificial
  CRISPR gRNA sequence
actccacccccccaccagct

SEQ ID NO: 713163 - DNA, 20 bp, Artificial
  CRISPR gRNA sequence
tccacccccccaccagctcg

SEQ ID NO: 713164 - DNA, 20 bp, Artificial
  CRISPR gRNA sequence
accagctcggagctccctgt

SEQ ID NO: 713165 - DNA, 20 bp, Artificial
  CRISPR gRNA sequence
ccagctcggagctccctgtc

SEQ ID NO: 713166 - DNA, 20 bp, Artificial
  CRISPR gRNA sequence
cttaattcaatgaatctcta

SEQ ID NO: 713167 - DNA, 20 bp, Artificial
  CRISPR gRNA sequence
ttaattcaatgaatctctat

SEQ ID NO: 713168 - DNA, 20 bp, Artificial
  CRISPR gRNA sequence
taattcaatgaatctctatg

SEQ ID NO: 713169 - DNA, 20 bp, Artificial
  CRISPR gRNA sequence
attcaatgaatctctatggg

SEQ ID NO: 713170 - DNA, 20 bp, Artificial
  CRISPR gRNA sequence
caatgaatctctatggggag

SEQ ID NO: 713171 - DNA, 20 bp, Artificial
  CRISPR gRNA sequence
aatgaatctctatggggagc

SEQ ID NO: 713172 - DNA, 20 bp, Artificial
  CRISPR gRNA sequence
tggggagcaggtgccatgcc

SEQ ID NO: 713173 - DNA, 20 bp, Artificial
  CRISPR gRNA sequence
tgccatgcctagcatttgat

SEQ ID NO: 713174 - DNA, 20 bp, Artificial
  CRISPR gRNA sequence
gccatgcctagcatttgatc

SEQ ID NO: 713175 - DNA, 20 bp, Artificial
  CRISPR gRNA sequence
atgcctagcatttgatcagg

SEQ ID NO: 713176 - DNA, 20 bp, Artificial
  CRISPR gRNA sequence
cctagcatttgatcaggcag

SEQ ID NO: 713177 - DNA, 20 bp, Artificial
  CRISPR gRNA sequence
ctagcatttgatcaggcagt

SEQ ID NO: 713178 - DNA, 20 bp, Artificial
  CRISPR gRNA sequence
tagcatttgatcaggcagtg

SEQ ID NO: 713179 - DNA, 20 bp, Artificial
  CRISPR gRNA sequence
gcatttgatcaggcagtggg

SEQ ID NO: 713180 - DNA, 20 bp, Artificial
  CRISPR gRNA sequence
aggcagtggggagatgttga

SEQ ID NO: 713181 - DNA, 20 bp, Artificial
  CRISPR gRNA sequence
ggggagatgttgatggacac

SEQ ID NO: 713182 - DNA, 20 bp, Artificial
  CRISPR gRNA sequence
gggagatgttgatggacacc

SEQ ID NO: 713183 - DNA, 20 bp, Artificial
  CRISPR gRNA sequence
ggagatgttgatggacacca

SEQ ID NO: 713184 - DNA, 20 bp, Artificial
  CRISPR gRNA sequence
gagatgttgatggacaccag

SEQ ID NO: 713185 - DNA, 20 bp, Artificial
  CRISPR gRNA sequence
gttgatggacaccaggggca

SEQ ID NO: 713186 - DNA, 20 bp, Artificial
  CRISPR gRNA sequence
aggggcatggtctttgccct

SEQ ID NO: 713187 - DNA, 20 bp, Artificial
  CRISPR gRNA sequence
ggggcatggtctttgccctc

SEQ ID NO: 713188 - DNA, 20 bp, Artificial
  CRISPR gRNA sequence
gcatggtctttgccctcagg

SEQ ID NO: 713189 - DNA, 20 bp, Artificial
  CRISPR gRNA sequence
ctttgccctcaggaagcttc

SEQ ID NO: 713190 - DNA, 20 bp, Artificial
  CRISPR gRNA sequence
gccctcaggaagcttccagc

SEQ ID NO: 713191 - DNA, 20 bp, Artificial
  CRISPR gRNA sequence
ccctcaggaagcttccagcc

SEQ ID NO: 713192 - DNA, 20 bp, Artificial
  CRISPR gRNA sequence
cctcaggaagcttccagcca

SEQ ID NO: 713193 - DNA, 20 bp, Artificial
  CRISPR gRNA sequence
tcaggaagcttccagccagg

SEQ ID NO: 713194 - DNA, 20 bp, Artificial
  CRISPR gRNA sequence
caggaagcttccagccaggg

SEQ ID NO: 713195 - DNA, 20 bp, Artificial
  CRISPR gRNA sequence
aggaagcttccagccaggga

SEQ ID NO: 713196 - DNA, 20 bp, Artificial
  CRISPR gRNA sequence
gaagcttccagccagggagg

SEQ ID NO: 713197 - DNA, 20 bp, Artificial
  CRISPR gRNA sequence
cttccagccagggagggaga

SEQ ID NO: 713198 - DNA, 20 bp, Artificial
  CRISPR gRNA sequence
gagggagacagacattgatc

SEQ ID NO: 713199 - DNA, 20 bp, Artificial
  CRISPR gRNA sequence
agacagacattgatcaagcc

SEQ ID NO: 713200 - DNA, 20 bp, Artificial
  CRISPR gRNA sequence
acagacattgatcaagccaa

SEQ ID NO: 713201 - DNA, 20 bp, Artificial
  CRISPR gRNA sequence
acattgatcaagccaagaga

SEQ ID NO: 713202 - DNA, 20 bp, Artificial
  CRISPR gRNA sequence
attgatcaagccaagagaca

SEQ ID NO: 713203 - DNA, 20 bp, Artificial
  CRISPR gRNA sequence
tgatcaagccaagagacaga

SEQ ID NO: 713204 - DNA, 20 bp, Artificial
  CRISPR gRNA sequence
atcaagccaagagacagaga

SEQ ID NO: 713205 - DNA, 20 bp, Artificial
  CRISPR gRNA sequence
tcaagccaagagacagagag

SEQ ID NO: 713206 - DNA, 20 bp, Artificial
  CRISPR gRNA sequence
ggtatgtatccacatttgca

SEQ ID NO: 713207 - DNA, 20 bp, Artificial
  CRISPR gRNA sequence
gtatgtatccacatttgcaa

SEQ ID NO: 713208 - DNA, 20 bp, Artificial
  CRISPR gRNA sequence
atccacatttgcaaaggaca

SEQ ID NO: 713209 - DNA, 20 bp, Artificial
  CRISPR gRNA sequence
tgcaaaggacacagtgctac

SEQ ID NO: 713210 - DNA, 20 bp, Artificial
  CRISPR gRNA sequence
cacagtgctaccagcttccc

SEQ ID NO: 713211 - DNA, 20 bp, Artificial
  CRISPR gRNA sequence
gtgctaccagcttccctagt

SEQ ID NO: 713212 - DNA, 20 bp, Artificial
  CRISPR gRNA sequence
gctaccagcttccctagtga

SEQ ID NO: 713213 - DNA, 20 bp, Artificial
  CRISPR gRNA sequence
ctaccagcttccctagtgag

SEQ ID NO: 713214 - DNA, 20 bp, Artificial
  CRISPR gRNA sequence
cagcttccctagtgagaggc

SEQ ID NO: 713215 - DNA, 20 bp, Artificial
  CRISPR gRNA sequence
agcttccctagtgagaggcc

SEQ ID NO: 713216 - DNA, 20 bp, Artificial
  CRISPR gRNA sequence
gcttccctagtgagaggcca

SEQ ID NO: 713217 - DNA, 20 bp, Artificial
  CRISPR gRNA sequence
tccctagtgagaggccaggg

SEQ ID NO: 713218 - DNA, 20 bp, Artificial
  CRISPR gRNA sequence
ccctagtgagaggccaggga

SEQ ID NO: 713219 - DNA, 20 bp, Artificial
  CRISPR gRNA sequence
gaggccagggaaggcctctt

SEQ ID NO: 713220 - DNA, 20 bp, Artificial
  CRISPR gRNA sequence
aggccagggaaggcctcttg

SEQ ID NO: 713221 - DNA, 20 bp, Artificial
  CRISPR gRNA sequence
ccagggaaggcctcttgagg

SEQ ID NO: 713222 - DNA, 20 bp, Artificial
  CRISPR gRNA sequence
gggaaggcctcttgaggaag

SEQ ID NO: 713223 - DNA, 20 bp, Artificial
  CRISPR gRNA sequence
ggaaggcctcttgaggaagt

SEQ ID NO: 713224 - DNA, 20 bp, Artificial
  CRISPR gRNA sequence
gaaggcctcttgaggaagtg

SEQ ID NO: 713225 - DNA, 20 bp, Artificial
  CRISPR gRNA sequence
ggcctcttgaggaagtgggg

SEQ ID NO: 713226 - DNA, 20 bp, Artificial
  CRISPR gRNA sequence
cctcttgaggaagtggggtg

SEQ ID NO: 713227 - DNA, 20 bp, Artificial
  CRISPR gRNA sequence
tcttgaggaagtggggtgga

SEQ ID NO: 713228 - DNA, 20 bp, Artificial
  CRISPR gRNA sequence
aggaagtggggtggagagct

SEQ ID NO: 713229 - DNA, 20 bp, Artificial
  CRISPR gRNA sequence
ggaagtggggtggagagctc

SEQ ID NO: 713230 - DNA, 20 bp, Artificial
  CRISPR gRNA sequence
gaagtggggtggagagctca

SEQ ID NO: 713231 - DNA, 20 bp, Artificial
  CRISPR gRNA sequence
ggggtggagagctcagggct

SEQ ID NO: 713232 - DNA, 20 bp, Artificial
  CRISPR gRNA sequence
gtggagagctcagggctgag

SEQ ID NO: 713233 - DNA, 20 bp, Artificial
  CRISPR gRNA sequence
tggagagctcagggctgagt

SEQ ID NO: 713234 - DNA, 20 bp, Artificial
  CRISPR gRNA sequence
gggctgagtaggatttgact

SEQ ID NO: 713235 - DNA, 20 bp, Artificial
  CRISPR gRNA sequence
gtaggatttgactaagtgaa

SEQ ID NO: 713236 - DNA, 20 bp, Artificial
  CRISPR gRNA sequence
taggatttgactaagtgaat

SEQ ID NO: 713237 - DNA, 20 bp, Artificial
  CRISPR gRNA sequence
aggatttgactaagtgaatg

SEQ ID NO: 713238 - DNA, 20 bp, Artificial
  CRISPR gRNA sequence
gatttgactaagtgaatggg

SEQ ID NO: 713239 - DNA, 20 bp, Artificial
  CRISPR gRNA sequence
atttgactaagtgaatgggg

SEQ ID NO: 713240 - DNA, 20 bp, Artificial
  CRISPR gRNA sequence
tttgactaagtgaatgggga

SEQ ID NO: 713241 - DNA, 20 bp, Artificial
  CRISPR gRNA sequence
gactaagtgaatggggaggg

SEQ ID NO: 713242 - DNA, 20 bp, Artificial
  CRISPR gRNA sequence
actaagtgaatggggaggga

SEQ ID NO: 713243 - DNA, 20 bp, Artificial
  CRISPR gRNA sequence
ctaagtgaatggggagggaa

SEQ ID NO: 713244 - DNA, 20 bp, Artificial
  CRISPR gRNA sequence
ggagggaagggtgtctccga

SEQ ID NO: 713245 - DNA, 20 bp, Artificial
  CRISPR gRNA sequence
agggaagggtgtctccgaca

SEQ ID NO: 713246 - DNA, 20 bp, Artificial
  CRISPR gRNA sequence
ggaagggtgtctccgacaga

SEQ ID NO: 713247 - DNA, 20 bp, Artificial
  CRISPR gRNA sequence
ggtgtctccgacagagagaa

SEQ ID NO: 713248 - DNA, 20 bp, Artificial
  CRISPR gRNA sequence
gacagagagaacagcacgtg

SEQ ID NO: 713249 - DNA, 20 bp, Artificial
  CRISPR gRNA sequence
cagagagaacagcacgtgca

SEQ ID NO: 713250 - DNA, 20 bp, Artificial
  CRISPR gRNA sequence
agagagaacagcacgtgcag

SEQ ID NO: 713251 - DNA, 20 bp, Artificial
  CRISPR gRNA sequence
gagagaacagcacgtgcaga

SEQ ID NO: 713252 - DNA, 20 bp, Artificial
  CRISPR gRNA sequence
agaacagcacgtgcagaggg

SEQ ID NO: 713253 - DNA, 20 bp, Artificial
  CRISPR gRNA sequence
gaacagcacgtgcagagggc

SEQ ID NO: 713254 - DNA, 20 bp, Artificial
  CRISPR gRNA sequence
cagcacgtgcagagggcggg

SEQ ID NO: 713255 - DNA, 20 bp, Artificial
  CRISPR gRNA sequence
agcacgtgcagagggcgggt

SEQ ID NO: 713256 - DNA, 20 bp, Artificial
  CRISPR gRNA sequence
cgtgcagagggcgggtggga

SEQ ID NO: 713257 - DNA, 20 bp, Artificial
  CRISPR gRNA sequence
tgcagagggcgggtgggaca

SEQ ID NO: 713258 - DNA, 20 bp, Artificial
  CRISPR gRNA sequence
agagggcgggtgggacagag

SEQ ID NO: 713259 - DNA, 20 bp, Artificial
  CRISPR gRNA sequence
agcacacacgtcctccaacc

SEQ ID NO: 713260 - DNA, 20 bp, Artificial
  CRISPR gRNA sequence
acacacgtcctccaacctgg

SEQ ID NO: 713261 - DNA, 20 bp, Artificial
  CRISPR gRNA sequence
cacgtcctccaacctggaag

SEQ ID NO: 713262 - DNA, 20 bp, Artificial
  CRISPR gRNA sequence
acgtcctccaacctggaaga

SEQ ID NO: 713263 - DNA, 20 bp, Artificial
  CRISPR gRNA sequence
cgtcctccaacctggaagaa

SEQ ID NO: 713264 - DNA, 20 bp, Artificial
  CRISPR gRNA sequence
cctccaacctggaagaaggg

SEQ ID NO: 713265 - DNA, 20 bp, Artificial
  CRISPR gRNA sequence
aacctggaagaagggcagcg

SEQ ID NO: 713266 - DNA, 20 bp, Artificial
  CRISPR gRNA sequence
acctggaagaagggcagcgc

SEQ ID NO: 713267 - DNA, 20 bp, Artificial
  CRISPR gRNA sequence
tggaagaagggcagcgcagg

SEQ ID NO: 713268 - DNA, 20 bp, Artificial
  CRISPR gRNA sequence
gaagaagggcagcgcaggtg

SEQ ID NO: 713269 - DNA, 20 bp, Artificial
  CRISPR gRNA sequence
agggcagcgcaggtggagcc

SEQ ID NO: 713270 - DNA, 20 bp, Artificial
  CRISPR gRNA sequence
ggcagcgcaggtggagccca

SEQ ID NO: 713271 - DNA, 20 bp, Artificial
  CRISPR gRNA sequence
cagcgcaggtggagcccaga

SEQ ID NO: 713272 - DNA, 20 bp, Artificial
  CRISPR gRNA sequence
gcaggtggagcccagagagt

SEQ ID NO: 713273 - DNA, 20 bp, Artificial
  CRISPR gRNA sequence
caggtggagcccagagagtg

SEQ ID NO: 713274 - DNA, 20 bp, Artificial
  CRISPR gRNA sequence
aggtggagcccagagagtga

SEQ ID NO: 713275 - DNA, 20 bp, Artificial
  CRISPR gRNA sequence
gagcccagagagtgagggct

SEQ ID NO: 713276 - DNA, 20 bp, Artificial
  CRISPR gRNA sequence
gagagtgagggcttggtgct

SEQ ID NO: 713277 - DNA, 20 bp, Artificial
  CRISPR gRNA sequence
gagtgagggcttggtgctga

SEQ ID NO: 713278 - DNA, 20 bp, Artificial
  CRISPR gRNA sequence
gggcttggtgctgagagctg

SEQ ID NO: 713279 - DNA, 20 bp, Artificial
  CRISPR gRNA sequence
ttggtgctgagagctgaagc

SEQ ID NO: 713280 - DNA, 20 bp, Artificial
  CRISPR gRNA sequence
tggtgctgagagctgaagct

SEQ ID NO: 713281 - DNA, 20 bp, Artificial
  CRISPR gRNA sequence
gtgctgagagctgaagctgg

SEQ ID NO: 713282 - DNA, 20 bp, Artificial
  CRISPR gRNA sequence
tgagagctgaagctgggaga

SEQ ID NO: 713283 - DNA, 20 bp, Artificial
  CRISPR gRNA sequence
gagagctgaagctgggagaa

SEQ ID NO: 713284 - DNA, 20 bp, Artificial
  CRISPR gRNA sequence
gagctgaagctgggagaaag

SEQ ID NO: 713285 - DNA, 20 bp, Artificial
  CRISPR gRNA sequence
agctgaagctgggagaaagg

SEQ ID NO: 713286 - DNA, 20 bp, Artificial
  CRISPR gRNA sequence
gctgaagctgggagaaagga

SEQ ID NO: 713287 - DNA, 20 bp, Artificial
  CRISPR gRNA sequence
ctgaagctgggagaaaggag

SEQ ID NO: 713288 - DNA, 20 bp, Artificial
  CRISPR gRNA sequence
tgaagctgggagaaaggagg

SEQ ID NO: 713289 - DNA, 20 bp, Artificial
  CRISPR gRNA sequence
gagaaaggagggggctgtgt

SEQ ID NO: 713290 - DNA, 20 bp, Artificial
  CRISPR gRNA sequence
agaaaggagggggctgtgtt

SEQ ID NO: 713291 - DNA, 20 bp, Artificial
  CRISPR gRNA sequence
ctgtgttgggatcacatcct

SEQ ID NO: 713292 - DNA, 20 bp, Artificial
  CRISPR gRNA sequence
acatcctgagactctgattc

SEQ ID NO: 713293 - DNA, 20 bp, Artificial
  CRISPR gRNA sequence
catcctgagactctgattct

SEQ ID NO: 713294 - DNA, 20 bp, Artificial
  CRISPR gRNA sequence
cctgagactctgattctggg

SEQ ID NO: 713295 - DNA, 20 bp, Artificial
  CRISPR gRNA sequence
agactctgattctgggaaga

SEQ ID NO: 713296 - DNA, 20 bp, Artificial
  CRISPR gRNA sequence
ctgattctgggaagatggct

SEQ ID NO: 713297 - DNA, 20 bp, Artificial
  CRISPR gRNA sequence
tttcccctcatcctcccgcc

SEQ ID NO: 713298 - DNA, 20 bp, Artificial
  CRISPR gRNA sequence
ctcccgccaagaaccgctaa

SEQ ID NO: 713299 - DNA, 20 bp, Artificial
  CRISPR gRNA sequence
ccaagaaccgctaaaagccc

SEQ ID NO: 713300 - DNA, 20 bp, Artificial
  CRISPR gRNA sequence
attatgtacaaaataaatgt

SEQ ID NO: 713301 - DNA, 20 bp, Artificial
  CRISPR gRNA sequence
atgtacaaaataaatgtaag

SEQ ID NO: 713302 - DNA, 20 bp, Artificial
  CRISPR gRNA sequence
tgtacaaaataaatgtaaga

SEQ ID NO: 713303 - DNA, 20 bp, Artificial
  CRISPR gRNA sequence
taagaaggctctgaaacatg

SEQ ID NO: 713304 - DNA, 20 bp, Artificial
  CRISPR gRNA sequence
agaaggctctgaaacatgaa

SEQ ID NO: 713305 - DNA, 20 bp, Artificial
  CRISPR gRNA sequence
aggctctgaaacatgaagag

SEQ ID NO: 713306 - DNA, 20 bp, Artificial
  CRISPR gRNA sequence
ctctgaaacatgaagagaag

SEQ ID NO: 713307 - DNA, 20 bp, Artificial
  CRISPR gRNA sequence
tctgaaacatgaagagaaga

SEQ ID NO: 713308 - DNA, 20 bp, Artificial
  CRISPR gRNA sequence
gaaacatgaagagaagaagg

SEQ ID NO: 713309 - DNA, 20 bp, Artificial
  CRISPR gRNA sequence
aaacatgaagagaagaaggc

SEQ ID NO: 713310 - DNA, 20 bp, Artificial
  CRISPR gRNA sequence
agagaagaaggcaggtcaac

SEQ ID NO: 713311 - DNA, 20 bp, Artificial
  CRISPR gRNA sequence
gagaagaaggcaggtcaact

SEQ ID NO: 713312 - DNA, 20 bp, Artificial
  CRISPR gRNA sequence
agaagaaggcaggtcaactg

SEQ ID NO: 713313 - DNA, 20 bp, Artificial
  CRISPR gRNA sequence
gaagaaggcaggtcaactgg

SEQ ID NO: 713314 - DNA, 20 bp, Artificial
  CRISPR gRNA sequence
ggcaggtcaactgggggcct

SEQ ID NO: 713315 - DNA, 20 bp, Artificial
  CRISPR gRNA sequence
gcaggtcaactgggggcctt

SEQ ID NO: 713316 - DNA, 20 bp, Artificial
  CRISPR gRNA sequence
actgggggccttgggacctg

SEQ ID NO: 713317 - DNA, 20 bp, Artificial
  CRISPR gRNA sequence
ctgggggccttgggacctga

SEQ ID NO: 713318 - DNA, 20 bp, Artificial
  CRISPR gRNA sequence
ttgggacctgaaggacaccg

SEQ ID NO: 713319 - DNA, 20 bp, Artificial
  CRISPR gRNA sequence
gacctgaaggacaccgtggt

SEQ ID NO: 713320 - DNA, 20 bp, Artificial
  CRISPR gRNA sequence
aggacaccgtggtgagtccc

SEQ ID NO: 713321 - DNA, 20 bp, Artificial
  CRISPR gRNA sequence
gacaccgtggtgagtccctg

SEQ ID NO: 713322 - DNA, 20 bp, Artificial
  CRISPR gRNA sequence
cttttttttttttttttttt

SEQ ID NO: 713323 - DNA, 20 bp, Artificial
  CRISPR gRNA sequence
ttttttttttttttttgaga

SEQ ID NO: 713324 - DNA, 20 bp, Artificial
  CRISPR gRNA sequence
ttttttttttttttgagacg

SEQ ID NO: 713325 - DNA, 20 bp, Artificial
  CRISPR gRNA sequence
ggagtcttgctcttgtcacc

SEQ ID NO: 713326 - DNA, 20 bp, Artificial
  CRISPR gRNA sequence
gagtcttgctcttgtcaccc

SEQ ID NO: 713327 - DNA, 20 bp, Artificial
  CRISPR gRNA sequence
cttgctcttgtcacccaggc

SEQ ID NO: 713328 - DNA, 20 bp, Artificial
  CRISPR gRNA sequence
tgctcttgtcacccaggctg

SEQ ID NO: 713329 - DNA, 20 bp, Artificial
  CRISPR gRNA sequence
tcacccaggctggagtgcaa

SEQ ID NO: 713330 - DNA, 20 bp, Artificial
  CRISPR gRNA sequence
ggagtgcaatggctcaatct

SEQ ID NO: 713331 - DNA, 20 bp, Artificial
  CRISPR gRNA sequence
tcactgcaaccaccgcctcc

SEQ ID NO: 713332 - DNA, 20 bp, Artificial
  CRISPR gRNA sequence
cactgcaaccaccgcctccc

SEQ ID NO: 713333 - DNA, 20 bp, Artificial
  CRISPR gRNA sequence
aaccaccgcctcccaggttc

SEQ ID NO: 713334 - DNA, 20 bp, Artificial
  CRISPR gRNA sequence
caccgcctcccaggttcaag

SEQ ID NO: 713335 - DNA, 20 bp, Artificial
  CRISPR gRNA sequence
ttcaagtggttctcctgcct

SEQ ID NO: 713336 - DNA, 20 bp, Artificial
  CRISPR gRNA sequence
ttctcctgcctcagcctcct

SEQ ID NO: 713337 - DNA, 20 bp, Artificial
  CRISPR gRNA sequence
gcctcagcctcctgagtaaa

SEQ ID NO: 713338 - DNA, 20 bp, Artificial
  CRISPR gRNA sequence
ctcctgagtaaatggaatta

SEQ ID NO: 713339 - DNA, 20 bp, Artificial
  CRISPR gRNA sequence
tcctgagtaaatggaattac

SEQ ID NO: 713340 - DNA, 20 bp, Artificial
  CRISPR gRNA sequence
cctgagtaaatggaattaca

SEQ ID NO: 713341 - DNA, 20 bp, Artificial
  CRISPR gRNA sequence
aattacagggcacctgctgc

SEQ ID NO: 713342 - DNA, 20 bp, Artificial
  CRISPR gRNA sequence
attacagggcacctgctgcc

SEQ ID NO: 713343 - DNA, 20 bp, Artificial
  CRISPR gRNA sequence
ttacagggcacctgctgcca

SEQ ID NO: 713344 - DNA, 20 bp, Artificial
  CRISPR gRNA sequence
agggcacctgctgccagggc

SEQ ID NO: 713345 - DNA, 20 bp, Artificial
  CRISPR gRNA sequence
ctggctaatttttgtatttt

SEQ ID NO: 713346 - DNA, 20 bp, Artificial
  CRISPR gRNA sequence
gctaatttttgtatttttag

SEQ ID NO: 713347 - DNA, 20 bp, Artificial
  CRISPR gRNA sequence
taatttttgtatttttagta

SEQ ID NO: 713348 - DNA, 20 bp, Artificial
  CRISPR gRNA sequence
tttgtatttttagtagagat

SEQ ID NO: 713349 - DNA, 20 bp, Artificial
  CRISPR gRNA sequence
ttgtatttttagtagagatg

SEQ ID NO: 713350 - DNA, 20 bp, Artificial
  CRISPR gRNA sequence
gagatgaggtttcaccatgt

SEQ ID NO: 713351 - DNA, 20 bp, Artificial
  CRISPR gRNA sequence
tgaggtttcaccatgttggc

SEQ ID NO: 713352 - DNA, 20 bp, Artificial
  CRISPR gRNA sequence
gaggtttcaccatgttggcc

SEQ ID NO: 713353 - DNA, 20 bp, Artificial
  CRISPR gRNA sequence
tttcaccatgttggccaggc

SEQ ID NO: 713354 - DNA, 20 bp, Artificial
  CRISPR gRNA sequence
ggtcttgaactcctgacctc

SEQ ID NO: 713355 - DNA, 20 bp, Artificial
  CRISPR gRNA sequence
ctcaagtgatctgcctgcct

SEQ ID NO: 713356 - DNA, 20 bp, Artificial
  CRISPR gRNA sequence
ctgcctgccttggcctccca

SEQ ID NO: 713357 - DNA, 20 bp, Artificial
  CRISPR gRNA sequence
gccttggcctcccaaagtgc

SEQ ID NO: 713358 - DNA, 20 bp, Artificial
  CRISPR gRNA sequence
ccttggcctcccaaagtgct

SEQ ID NO: 713359 - DNA, 20 bp, Artificial
  CRISPR gRNA sequence
ctcccaaagtgctgggatta

SEQ ID NO: 713360 - DNA, 20 bp, Artificial
  CRISPR gRNA sequence
tcccaaagtgctgggattac

SEQ ID NO: 713361 - DNA, 20 bp, Artificial
  CRISPR gRNA sequence
agtgctgggattacaggcgt

SEQ ID NO: 713362 - DNA, 20 bp, Artificial
  CRISPR gRNA sequence
caggcgtaagccaccacacc

SEQ ID NO: 713363 - DNA, 20 bp, Artificial
  CRISPR gRNA sequence
tggccttgtgtccttatctt

SEQ ID NO: 713364 - DNA, 20 bp, Artificial
  CRISPR gRNA sequence
gccttgtgtccttatcttta

SEQ ID NO: 713365 - DNA, 20 bp, Artificial
  CRISPR gRNA sequence
tgtccttatctttagagtaa

SEQ ID NO: 713366 - DNA, 20 bp, Artificial
  CRISPR gRNA sequence
gtccttatctttagagtaac

SEQ ID NO: 713367 - DNA, 20 bp, Artificial
  CRISPR gRNA sequence
cttatctttagagtaacagg

SEQ ID NO: 713368 - DNA, 20 bp, Artificial
  CRISPR gRNA sequence
agagtaacaggaagatactg

SEQ ID NO: 713369 - DNA, 20 bp, Artificial
  CRISPR gRNA sequence
aggaagatactgaagcattt

SEQ ID NO: 713370 - DNA, 20 bp, Artificial
  CRISPR gRNA sequence
ggaagatactgaagcatttc

SEQ ID NO: 713371 - DNA, 20 bp, Artificial
  CRISPR gRNA sequence
gtgtgtgtgtgtgtgtgtgt

SEQ ID NO: 713372 - DNA, 20 bp, Artificial
  CRISPR gRNA sequence
gtgtgtgtgtgtgtgtgaga

SEQ ID NO: 713373 - DNA, 20 bp, Artificial
  CRISPR gRNA sequence
gtgtgtgtgtgtgtgagaca

SEQ ID NO: 713374 - DNA, 20 bp, Artificial
  CRISPR gRNA sequence
gtgtgtgtgtgtgagacaga

SEQ ID NO: 713375 - DNA, 20 bp, Artificial
  CRISPR gRNA sequence
gtgtgtgtgtgagacagaga

SEQ ID NO: 713376 - DNA, 20 bp, Artificial
  CRISPR gRNA sequence
gtgtgtgtgagacagagaga

SEQ ID NO: 713377 - DNA, 20 bp, Artificial
  CRISPR gRNA sequence
gtgtgagacagagagagagt

SEQ ID NO: 713378 - DNA, 20 bp, Artificial
  CRISPR gRNA sequence
gagacagagagagagtgagt

SEQ ID NO: 713379 - DNA, 20 bp, Artificial
  CRISPR gRNA sequence
cagagagagagtgagtgagt

SEQ ID NO: 713380 - DNA, 20 bp, Artificial
  CRISPR gRNA sequence
gagagagagtgagtgagtga

SEQ ID NO: 713381 - DNA, 20 bp, Artificial
  CRISPR gRNA sequence
gagagagtgagtgagtgaga

SEQ ID NO: 713382 - DNA, 20 bp, Artificial
  CRISPR gRNA sequence
gagagtgagtgagtgagaga

SEQ ID NO: 713383 - DNA, 20 bp, Artificial
  CRISPR gRNA sequence
gagtgagtgagtgagagaga

SEQ ID NO: 713384 - DNA, 20 bp, Artificial
  CRISPR gRNA sequence
gtgagtgagtgagagagaga

SEQ ID NO: 713385 - DNA, 20 bp, Artificial
  CRISPR gRNA sequence
gagtgagtgagagagagaga

SEQ ID NO: 713386 - DNA, 20 bp, Artificial
  CRISPR gRNA sequence
gtgagtgagagagagagaga

SEQ ID NO: 713387 - DNA, 20 bp, Artificial
  CRISPR gRNA sequence
gagtgagagagagagagaga

SEQ ID NO: 713388 - DNA, 20 bp, Artificial
  CRISPR gRNA sequence
gtgagagagagagagagaga

SEQ ID NO: 713389 - DNA, 20 bp, Artificial
  CRISPR gRNA sequence
gagagagagagagagagaga

SEQ ID NO: 713390 - DNA, 20 bp, Artificial
  CRISPR gRNA sequence
agagagagagagagagagag

SEQ ID NO: 713391 - DNA, 20 bp, Artificial
  CRISPR gRNA sequence
gagagagagagagagaggat

SEQ ID NO: 713392 - DNA, 20 bp, Artificial
  CRISPR gRNA sequence
gagagagagaggatcagatt

SEQ ID NO: 713393 - DNA, 20 bp, Artificial
  CRISPR gRNA sequence
gagaggatcagattcagatt

SEQ ID NO: 713394 - DNA, 20 bp, Artificial
  CRISPR gRNA sequence
agattcagatttggtcttgc

SEQ ID NO: 713395 - DNA, 20 bp, Artificial
  CRISPR gRNA sequence
gattcagatttggtcttgca

SEQ ID NO: 713396 - DNA, 20 bp, Artificial
  CRISPR gRNA sequence
attcagatttggtcttgcaa

SEQ ID NO: 713397 - DNA, 20 bp, Artificial
  CRISPR gRNA sequence
tggtcttgcaagggtcattc

SEQ ID NO: 713398 - DNA, 20 bp, Artificial
  CRISPR gRNA sequence
gtcattctggctgtctgcca

SEQ ID NO: 713399 - DNA, 20 bp, Artificial
  CRISPR gRNA sequence
tcattctggctgtctgccat

SEQ ID NO: 713400 - DNA, 20 bp, Artificial
  CRISPR gRNA sequence
cattctggctgtctgccatg

SEQ ID NO: 713401 - DNA, 20 bp, Artificial
  CRISPR gRNA sequence
attctggctgtctgccatgg

SEQ ID NO: 713402 - DNA, 20 bp, Artificial
  CRISPR gRNA sequence
gtctgccatgggggctgtat

SEQ ID NO: 713403 - DNA, 20 bp, Artificial
  CRISPR gRNA sequence
ctgccatgggggctgtataa

SEQ ID NO: 713404 - DNA, 20 bp, Artificial
  CRISPR gRNA sequence
ccatgggggctgtataagag

SEQ ID NO: 713405 - DNA, 20 bp, Artificial
  CRISPR gRNA sequence
catgggggctgtataagaga

SEQ ID NO: 713406 - DNA, 20 bp, Artificial
  CRISPR gRNA sequence
gctgtataagagaaggtatt

SEQ ID NO: 713407 - DNA, 20 bp, Artificial
  CRISPR gRNA sequence
ctgtataagagaaggtattc

SEQ ID NO: 713408 - DNA, 20 bp, Artificial
  CRISPR gRNA sequence
tgtataagagaaggtattcg

SEQ ID NO: 713409 - DNA, 20 bp, Artificial
  CRISPR gRNA sequence
taagagaaggtattcggggt

SEQ ID NO: 713410 - DNA, 20 bp, Artificial
  CRISPR gRNA sequence
gagaaggtattcggggtgag

SEQ ID NO: 713411 - DNA, 20 bp, Artificial
  CRISPR gRNA sequence
agaaggtattcggggtgaga

SEQ ID NO: 713412 - DNA, 20 bp, Artificial
  CRISPR gRNA sequence
aggtattcggggtgagaagg

SEQ ID NO: 713413 - DNA, 20 bp, Artificial
  CRISPR gRNA sequence
ggtattcggggtgagaaggt

SEQ ID NO: 713414 - DNA, 20 bp, Artificial
  CRISPR gRNA sequence
gtattcggggtgagaaggtg

SEQ ID NO: 713415 - DNA, 20 bp, Artificial
  CRISPR gRNA sequence
ttcggggtgagaaggtgggg

SEQ ID NO: 713416 - DNA, 20 bp, Artificial
  CRISPR gRNA sequence
gagaaggtggggaagataat

SEQ ID NO: 713417 - DNA, 20 bp, Artificial
  CRISPR gRNA sequence
gaaggtggggaagataattg

SEQ ID NO: 713418 - DNA, 20 bp, Artificial
  CRISPR gRNA sequence
aaggtggggaagataattgg

SEQ ID NO: 713419 - DNA, 20 bp, Artificial
  CRISPR gRNA sequence
ataattggaggccaaatcta

SEQ ID NO: 713420 - DNA, 20 bp, Artificial
  CRISPR gRNA sequence
taattggaggccaaatctac

SEQ ID NO: 713421 - DNA, 20 bp, Artificial
  CRISPR gRNA sequence
aggccaaatctacaggactc

SEQ ID NO: 713422 - DNA, 20 bp, Artificial
  CRISPR gRNA sequence
ggccaaatctacaggactcg

SEQ ID NO: 713423 - DNA, 20 bp, Artificial
  CRISPR gRNA sequence
aaatctacaggactcgagga

SEQ ID NO: 713424 - DNA, 20 bp, Artificial
  CRISPR gRNA sequence
aatctacaggactcgaggat

SEQ ID NO: 713425 - DNA, 20 bp, Artificial
  CRISPR gRNA sequence
tacaggactcgaggatgggc

SEQ ID NO: 713426 - DNA, 20 bp, Artificial
  CRISPR gRNA sequence
tcgaggatgggctggctgtg

SEQ ID NO: 713427 - DNA, 20 bp, Artificial
  CRISPR gRNA sequence
cgaggatgggctggctgtga

SEQ ID NO: 713428 - DNA, 20 bp, Artificial
  CRISPR gRNA sequence
atgggctggctgtgaaggat

SEQ ID NO: 713429 - DNA, 20 bp, Artificial
  CRISPR gRNA sequence
tgggctggctgtgaaggatg

SEQ ID NO: 713430 - DNA, 20 bp, Artificial
  CRISPR gRNA sequence
gggctggctgtgaaggatga

SEQ ID NO: 713431 - DNA, 20 bp, Artificial
  CRISPR gRNA sequence
gctgtgaaggatgagggaac

SEQ ID NO: 713432 - DNA, 20 bp, Artificial
  CRISPR gRNA sequence
ctgtgaaggatgagggaacg

SEQ ID NO: 713433 - DNA, 20 bp, Artificial
  CRISPR gRNA sequence
tgtgaaggatgagggaacga

SEQ ID NO: 713434 - DNA, 20 bp, Artificial
  CRISPR gRNA sequence
gaaggatgagggaacgaggg

SEQ ID NO: 713435 - DNA, 20 bp, Artificial
  CRISPR gRNA sequence
aaggatgagggaacgaggga

SEQ ID NO: 713436 - DNA, 20 bp, Artificial
  CRISPR gRNA sequence
agggaacgagggaaggataa

SEQ ID NO: 713437 - DNA, 20 bp, Artificial
  CRISPR gRNA sequence
gggaacgagggaaggataaa

SEQ ID NO: 713438 - DNA, 20 bp, Artificial
  CRISPR gRNA sequence
ggaacgagggaaggataaaa

SEQ ID NO: 713439 - DNA, 20 bp, Artificial
  CRISPR gRNA sequence
gaacgagggaaggataaaag

SEQ ID NO: 713440 - DNA, 20 bp, Artificial
  CRISPR gRNA sequence
cgagggaaggataaaagggg

SEQ ID NO: 713441 - DNA, 20 bp, Artificial
  CRISPR gRNA sequence
gagggaaggataaaaggggc

SEQ ID NO: 713442 - DNA, 20 bp, Artificial
  CRISPR gRNA sequence
ggaaggataaaaggggcagg

SEQ ID NO: 713443 - DNA, 20 bp, Artificial
  CRISPR gRNA sequence
aggataaaaggggcaggcag

SEQ ID NO: 713444 - DNA, 20 bp, Artificial
  CRISPR gRNA sequence
ataaaaggggcaggcagtgg

SEQ ID NO: 713445 - DNA, 20 bp, Artificial
  CRISPR gRNA sequence
ggggcaggcagtggtagcga

SEQ ID NO: 713446 - DNA, 20 bp, Artificial
  CRISPR gRNA sequence
gggcaggcagtggtagcgat

SEQ ID NO: 713447 - DNA, 20 bp, Artificial
  CRISPR gRNA sequence
ggcaggcagtggtagcgatg

SEQ ID NO: 713448 - DNA, 20 bp, Artificial
  CRISPR gRNA sequence
gcaggcagtggtagcgatgg

SEQ ID NO: 713449 - DNA, 20 bp, Artificial
  CRISPR gRNA sequence
tgggggtgactgccaatccc

SEQ ID NO: 713450 - DNA, 20 bp, Artificial
  CRISPR gRNA sequence
gggggtgactgccaatcccc

SEQ ID NO: 713451 - DNA, 20 bp, Artificial
  CRISPR gRNA sequence
caatccccaggtttgcacaa

SEQ ID NO: 713452 - DNA, 20 bp, Artificial
  CRISPR gRNA sequence
aatccccaggtttgcacaac

SEQ ID NO: 713453 - DNA, 20 bp, Artificial
  CRISPR gRNA sequence
atccccaggtttgcacaaca

SEQ ID NO: 713454 - DNA, 20 bp, Artificial
  CRISPR gRNA sequence
caggtttgcacaacagggca

SEQ ID NO: 713455 - DNA, 20 bp, Artificial
  CRISPR gRNA sequence
aggtttgcacaacagggcat

SEQ ID NO: 713456 - DNA, 20 bp, Artificial
  CRISPR gRNA sequence
cacaacagggcatgggactc

SEQ ID NO: 713457 - DNA, 20 bp, Artificial
  CRISPR gRNA sequence
caacagggcatgggactcca

SEQ ID NO: 713458 - DNA, 20 bp, Artificial
  CRISPR gRNA sequence
cagggcatgggactccagag

SEQ ID NO: 713459 - DNA, 20 bp, Artificial
  CRISPR gRNA sequence
agggcatgggactccagaga

SEQ ID NO: 713460 - DNA, 20 bp, Artificial
  CRISPR gRNA sequence
tgggactccagagaaggacc

SEQ ID NO: 713461 - DNA, 20 bp, Artificial
  CRISPR gRNA sequence
actccagagaaggacctggt

SEQ ID NO: 713462 - DNA, 20 bp, Artificial
  CRISPR gRNA sequence
ctccagagaaggacctggtt

SEQ ID NO: 713463 - DNA, 20 bp, Artificial
  CRISPR gRNA sequence
tccagagaaggacctggttg

SEQ ID NO: 713464 - DNA, 20 bp, Artificial
  CRISPR gRNA sequence
ccagagaaggacctggttgg

SEQ ID NO: 713465 - DNA, 20 bp, Artificial
  CRISPR gRNA sequence
agagaaggacctggttgggg

SEQ ID NO: 713466 - DNA, 20 bp, Artificial
  CRISPR gRNA sequence
gagaaggacctggttggggg

SEQ ID NO: 713467 - DNA, 20 bp, Artificial
  CRISPR gRNA sequence
agaaggacctggttggggga

SEQ ID NO: 713468 - DNA, 20 bp, Artificial
  CRISPR gRNA sequence
cctggttgggggagggacca

SEQ ID NO: 713469 - DNA, 20 bp, Artificial
  CRISPR gRNA sequence
ctggttgggggagggaccac

SEQ ID NO: 713470 - DNA, 20 bp, Artificial
  CRISPR gRNA sequence
gagggaccacaggcactttg

SEQ ID NO: 713471 - DNA, 20 bp, Artificial
  CRISPR gRNA sequence
ctttgtggcacttttctcct

SEQ ID NO: 713472 - DNA, 20 bp, Artificial
  CRISPR gRNA sequence
tgtggcacttttctcctcag

SEQ ID NO: 713473 - DNA, 20 bp, Artificial
  CRISPR gRNA sequence
gcacttttctcctcagtgga

SEQ ID NO: 713474 - DNA, 20 bp, Artificial
  CRISPR gRNA sequence
cttttctcctcagtggacag

SEQ ID NO: 713475 - DNA, 20 bp, Artificial
  CRISPR gRNA sequence
tcctcagtggacagtggaca

SEQ ID NO: 713476 - DNA, 20 bp, Artificial
  CRISPR gRNA sequence
cctcagtggacagtggacac

SEQ ID NO: 713477 - DNA, 20 bp, Artificial
  CRISPR gRNA sequence
ctcagtggacagtggacaca

SEQ ID NO: 713478 - DNA, 20 bp, Artificial
  CRISPR gRNA sequence
gtggacacagggctgcctct

SEQ ID NO: 713479 - DNA, 20 bp, Artificial
  CRISPR gRNA sequence
tgcctctgagcccatctccc

SEQ ID NO: 713480 - DNA, 20 bp, Artificial
  CRISPR gRNA sequence
cccatctccccggctccata

SEQ ID NO: 713481 - DNA, 20 bp, Artificial
  CRISPR gRNA sequence
ctccatacagtctgcaactg

SEQ ID NO: 713482 - DNA, 20 bp, Artificial
  CRISPR gRNA sequence
catacagtctgcaactgcgg

SEQ ID NO: 713483 - DNA, 20 bp, Artificial
  CRISPR gRNA sequence
ccactctgtgctgtgctcca

SEQ ID NO: 713484 - DNA, 20 bp, Artificial
  CRISPR gRNA sequence
cactcctcatgcctcccttc

SEQ ID NO: 713485 - DNA, 20 bp, Artificial
  CRISPR gRNA sequence
tcctcatgcctcccttctgg

SEQ ID NO: 713486 - DNA, 20 bp, Artificial
  CRISPR gRNA sequence
catgcctcccttctggaaga

SEQ ID NO: 713487 - DNA, 20 bp, Artificial
  CRISPR gRNA sequence
aagatggtcccaactccacc

SEQ ID NO: 713488 - DNA, 20 bp, Artificial
  CRISPR gRNA sequence
tggtcccaactccacccaga

SEQ ID NO: 713489 - DNA, 20 bp, Artificial
  CRISPR gRNA sequence
ggtcccaactccacccagac

SEQ ID NO: 713490 - DNA, 20 bp, Artificial
  CRISPR gRNA sequence
ctccacccagacaggttctg

SEQ ID NO: 713491 - DNA, 20 bp, Artificial
  CRISPR gRNA sequence
tgtggcccataccccttctc

SEQ ID NO: 713492 - DNA, 20 bp, Artificial
  CRISPR gRNA sequence
cataccccttctctggttaa

SEQ ID NO: 713493 - DNA, 20 bp, Artificial
  CRISPR gRNA sequence
accccttctctggttaaaag

SEQ ID NO: 713494 - DNA, 20 bp, Artificial
  CRISPR gRNA sequence
gccctgacaccttgtactat

SEQ ID NO: 713495 - DNA, 20 bp, Artificial
  CRISPR gRNA sequence
cctgacaccttgtactatca

SEQ ID NO: 713496 - DNA, 20 bp, Artificial
  CRISPR gRNA sequence
gacaccttgtactatcagag

SEQ ID NO: 713497 - DNA, 20 bp, Artificial
  CRISPR gRNA sequence
accttgtactatcagagaag

SEQ ID NO: 713498 - DNA, 20 bp, Artificial
  CRISPR gRNA sequence
ttgtactatcagagaagtag

SEQ ID NO: 713499 - DNA, 20 bp, Artificial
  CRISPR gRNA sequence
actatcagagaagtagaagt

SEQ ID NO: 713500 - DNA, 20 bp, Artificial
  CRISPR gRNA sequence
tatcagagaagtagaagtca

SEQ ID NO: 713501 - DNA, 20 bp, Artificial
  CRISPR gRNA sequence
tcagagaagtagaagtcaga

SEQ ID NO: 713502 - DNA, 20 bp, Artificial
  CRISPR gRNA sequence
cagagaagtagaagtcagag

SEQ ID NO: 713503 - DNA, 20 bp, Artificial
  CRISPR gRNA sequence
gaagtagaagtcagagaggt

SEQ ID NO: 713504 - DNA, 20 bp, Artificial
  CRISPR gRNA sequence
gagaggtaagaaacttgtct

SEQ ID NO: 713505 - DNA, 20 bp, Artificial
  CRISPR gRNA sequence
agaggtaagaaacttgtctg

SEQ ID NO: 713506 - DNA, 20 bp, Artificial
  CRISPR gRNA sequence
cttgtctgaggtcacacgat

SEQ ID NO: 713507 - DNA, 20 bp, Artificial
  CRISPR gRNA sequence
tctgaggtcacacgataagt

SEQ ID NO: 713508 - DNA, 20 bp, Artificial
  CRISPR gRNA sequence
ggtcacacgataagttggaa

SEQ ID NO: 713509 - DNA, 20 bp, Artificial
  CRISPR gRNA sequence
ataagttggaaaagaaaccc

SEQ ID NO: 713510 - DNA, 20 bp, Artificial
  CRISPR gRNA sequence
aaaagaaacccaagtttctc

SEQ ID NO: 713511 - DNA, 20 bp, Artificial
  CRISPR gRNA sequence
acccaagtttctcaagtctt

SEQ ID NO: 713512 - DNA, 20 bp, Artificial
  CRISPR gRNA sequence
agtttctcaagtcttgagcc

SEQ ID NO: 713513 - DNA, 20 bp, Artificial
  CRISPR gRNA sequence
gtttctcaagtcttgagcct

SEQ ID NO: 713514 - DNA, 20 bp, Artificial
  CRISPR gRNA sequence
tttctcaagtcttgagcctg

SEQ ID NO: 713515 - DNA, 20 bp, Artificial
  CRISPR gRNA sequence
tcaagtcttgagcctggggc

SEQ ID NO: 713516 - DNA, 20 bp, Artificial
  CRISPR gRNA sequence
gagcctggggccagatctct

SEQ ID NO: 713517 - DNA, 20 bp, Artificial
  CRISPR gRNA sequence
tcccaatgccctgaacctga

SEQ ID NO: 713518 - DNA, 20 bp, Artificial
  CRISPR gRNA sequence
cccaatgccctgaacctgaa

SEQ ID NO: 713519 - DNA, 20 bp, Artificial
  CRISPR gRNA sequence
ccaatgccctgaacctgaaa

SEQ ID NO: 713520 - DNA, 20 bp, Artificial
  CRISPR gRNA sequence
caatgccctgaacctgaaag

SEQ ID NO: 713521 - DNA, 20 bp, Artificial
  CRISPR gRNA sequence
aatgccctgaacctgaaagg

SEQ ID NO: 713522 - DNA, 20 bp, Artificial
  CRISPR gRNA sequence
gccctgaacctgaaaggggg

SEQ ID NO: 713523 - DNA, 20 bp, Artificial
  CRISPR gRNA sequence
ggaagccaaccccaatcttc

SEQ ID NO: 713524 - DNA, 20 bp, Artificial
  CRISPR gRNA sequence
gaagccaaccccaatcttct

SEQ ID NO: 713525 - DNA, 20 bp, Artificial
  CRISPR gRNA sequence
ccaatcttctaggaaactcc

SEQ ID NO: 713526 - DNA, 20 bp, Artificial
  CRISPR gRNA sequence
caatcttctaggaaactccc

SEQ ID NO: 713527 - DNA, 20 bp, Artificial
  CRISPR gRNA sequence
cttctaggaaactcccagga

SEQ ID NO: 713528 - DNA, 20 bp, Artificial
  CRISPR gRNA sequence
tctaggaaactcccaggaca

SEQ ID NO: 713529 - DNA, 20 bp, Artificial
  CRISPR gRNA sequence
aactcccaggacagagactt

SEQ ID NO: 713530 - DNA, 20 bp, Artificial
  CRISPR gRNA sequence
actcccaggacagagacttg

SEQ ID NO: 713531 - DNA, 20 bp, Artificial
  CRISPR gRNA sequence
tgaggttcccttcttgttta

SEQ ID NO: 713532 - DNA, 20 bp, Artificial
  CRISPR gRNA sequence
gaggttcccttcttgtttat

SEQ ID NO: 713533 - DNA, 20 bp, Artificial
  CRISPR gRNA sequence
aggttcccttcttgtttatg

SEQ ID NO: 713534 - DNA, 20 bp, Artificial
  CRISPR gRNA sequence
ccttcttgtttatggggcat

SEQ ID NO: 713535 - DNA, 20 bp, Artificial
  CRISPR gRNA sequence
catcagataacttctgcctt

SEQ ID NO: 713536 - DNA, 20 bp, Artificial
  CRISPR gRNA sequence
ctgccttgagcctcaaacca

SEQ ID NO: 713537 - DNA, 20 bp, Artificial
  CRISPR gRNA sequence
cttgagcctcaaaccaaagc

SEQ ID NO: 713538 - DNA, 20 bp, Artificial
  CRISPR gRNA sequence
aaccaaagcaagacctcctc

SEQ ID NO: 713539 - DNA, 20 bp, Artificial
  CRISPR gRNA sequence
aaagcaagacctcctccagc

SEQ ID NO: 713540 - DNA, 20 bp, Artificial
  CRISPR gRNA sequence
aagcaagacctcctccagcc

SEQ ID NO: 713541 - DNA, 20 bp, Artificial
  CRISPR gRNA sequence
tcctccagccaggtctatgc

SEQ ID NO: 713542 - DNA, 20 bp, Artificial
  CRISPR gRNA sequence
cctccagccaggtctatgcc

SEQ ID NO: 713543 - DNA, 20 bp, Artificial
  CRISPR gRNA sequence
ctccagccaggtctatgcca

SEQ ID NO: 713544 - DNA, 20 bp, Artificial
  CRISPR gRNA sequence
tccagccaggtctatgccag

SEQ ID NO: 713545 - DNA, 20 bp, Artificial
  CRISPR gRNA sequence
gccaggtctatgccagggga

SEQ ID NO: 713546 - DNA, 20 bp, Artificial
  CRISPR gRNA sequence
aggtctatgccaggggacag

SEQ ID NO: 713547 - DNA, 20 bp, Artificial
  CRISPR gRNA sequence
ggtctatgccaggggacagc

SEQ ID NO: 713548 - DNA, 20 bp, Artificial
  CRISPR gRNA sequence
gtctatgccaggggacagca

SEQ ID NO: 713549 - DNA, 20 bp, Artificial
  CRISPR gRNA sequence
cagcagggtctctctgcacc

SEQ ID NO: 713550 - DNA, 20 bp, Artificial
  CRISPR gRNA sequence
tctctctgcacctggaacac

SEQ ID NO: 713551 - DNA, 20 bp, Artificial
  CRISPR gRNA sequence
ctctctgcacctggaacaca

SEQ ID NO: 713552 - DNA, 20 bp, Artificial
  CRISPR gRNA sequence
tctgcacctggaacacaagg

SEQ ID NO: 713553 - DNA, 20 bp, Artificial
  CRISPR gRNA sequence
ctgcacctggaacacaaggt

SEQ ID NO: 713554 - DNA, 20 bp, Artificial
  CRISPR gRNA sequence
tgcacctggaacacaaggtg

SEQ ID NO: 713555 - DNA, 20 bp, Artificial
  CRISPR gRNA sequence
gcacctggaacacaaggtgg

SEQ ID NO: 713556 - DNA, 20 bp, Artificial
  CRISPR gRNA sequence
acctggaacacaaggtgggg

SEQ ID NO: 713557 - DNA, 20 bp, Artificial
  CRISPR gRNA sequence
cctggaacacaaggtggggg

SEQ ID NO: 713558 - DNA, 20 bp, Artificial
  CRISPR gRNA sequence
ctggaacacaaggtggggga

SEQ ID NO: 713559 - DNA, 20 bp, Artificial
  CRISPR gRNA sequence
gaacacaaggtgggggaggg

SEQ ID NO: 713560 - DNA, 20 bp, Artificial
  CRISPR gRNA sequence
cacaaggtgggggagggcag

SEQ ID NO: 713561 - DNA, 20 bp, Artificial
  CRISPR gRNA sequence
aaggtgggggagggcagcag

SEQ ID NO: 713562 - DNA, 20 bp, Artificial
  CRISPR gRNA sequence
aggtgggggagggcagcaga

SEQ ID NO: 713563 - DNA, 20 bp, Artificial
  CRISPR gRNA sequence
ggtgggggagggcagcagaa

SEQ ID NO: 713564 - DNA, 20 bp, Artificial
  CRISPR gRNA sequence
ggggagggcagcagaagggc

SEQ ID NO: 713565 - DNA, 20 bp, Artificial
  CRISPR gRNA sequence
gggagggcagcagaagggct

SEQ ID NO: 713566 - DNA, 20 bp, Artificial
  CRISPR gRNA sequence
gcagcagaagggctgggtgc

SEQ ID NO: 713567 - DNA, 20 bp, Artificial
  CRISPR gRNA sequence
cagcagaagggctgggtgct

SEQ ID NO: 713568 - DNA, 20 bp, Artificial
  CRISPR gRNA sequence
ctgggtgctgggtacatccc

SEQ ID NO: 713569 - DNA, 20 bp, Artificial
  CRISPR gRNA sequence
acatccctggcccatcgcca

SEQ ID NO: 713570 - DNA, 20 bp, Artificial
  CRISPR gRNA sequence
catccctggcccatcgccaa

SEQ ID NO: 713571 - DNA, 20 bp, Artificial
  CRISPR gRNA sequence
tccctggcccatcgccaaag

SEQ ID NO: 713572 - DNA, 20 bp, Artificial
  CRISPR gRNA sequence
aggagacatgatctgtccaa

SEQ ID NO: 713573 - DNA, 20 bp, Artificial
  CRISPR gRNA sequence
atgatctgtccaacagtctc

SEQ ID NO: 713574 - DNA, 20 bp, Artificial
  CRISPR gRNA sequence
tgatctgtccaacagtctcc

SEQ ID NO: 713575 - DNA, 20 bp, Artificial
  CRISPR gRNA sequence
tctgtccaacagtctccggg

SEQ ID NO: 713576 - DNA, 20 bp, Artificial
  CRISPR gRNA sequence
gtccaacagtctccgggaag

SEQ ID NO: 713577 - DNA, 20 bp, Artificial
  CRISPR gRNA sequence
tccaacagtctccgggaagc

SEQ ID NO: 713578 - DNA, 20 bp, Artificial
  CRISPR gRNA sequence
caacagtctccgggaagcgg

SEQ ID NO: 713579 - DNA, 20 bp, Artificial
  CRISPR gRNA sequence
aacagtctccgggaagcggg

SEQ ID NO: 713580 - DNA, 20 bp, Artificial
  CRISPR gRNA sequence
gtctccgggaagcgggaggt

SEQ ID NO: 713581 - DNA, 20 bp, Artificial
  CRISPR gRNA sequence
tccgggaagcgggaggtcgg

SEQ ID NO: 713582 - DNA, 20 bp, Artificial
  CRISPR gRNA sequence
agcgggaggtcggaagtcaa

SEQ ID NO: 713583 - DNA, 20 bp, Artificial
  CRISPR gRNA sequence
gtcggaagtcaacagtgcac

SEQ ID NO: 713584 - DNA, 20 bp, Artificial
  CRISPR gRNA sequence
tcggaagtcaacagtgcact

SEQ ID NO: 713585 - DNA, 20 bp, Artificial
  CRISPR gRNA sequence
cggaagtcaacagtgcactg

SEQ ID NO: 713586 - DNA, 20 bp, Artificial
  CRISPR gRNA sequence
aagtcaacagtgcactgggg

SEQ ID NO: 713587 - DNA, 20 bp, Artificial
  CRISPR gRNA sequence
agtcaacagtgcactggggt

SEQ ID NO: 713588 - DNA, 20 bp, Artificial
  CRISPR gRNA sequence
caacagtgcactggggtggg

SEQ ID NO: 713589 - DNA, 20 bp, Artificial
  CRISPR gRNA sequence
cagtgcactggggtgggcgg

SEQ ID NO: 713590 - DNA, 20 bp, Artificial
  CRISPR gRNA sequence
agtgcactggggtgggcgga

SEQ ID NO: 713591 - DNA, 20 bp, Artificial
  CRISPR gRNA sequence
actggggtgggcggaaggtg

SEQ ID NO: 713592 - DNA, 20 bp, Artificial
  CRISPR gRNA sequence
ggggtgggcggaaggtgcag

SEQ ID NO: 713593 - DNA, 20 bp, Artificial
  CRISPR gRNA sequence
ggcggaaggtgcagcagcaa

SEQ ID NO: 713594 - DNA, 20 bp, Artificial
  CRISPR gRNA sequence
aaggtgcagcagcaacagca

SEQ ID NO: 713595 - DNA, 20 bp, Artificial
  CRISPR gRNA sequence
acagcatagatctctgtcct

SEQ ID NO: 713596 - DNA, 20 bp, Artificial
  CRISPR gRNA sequence
atagatctctgtcctgagtt

SEQ ID NO: 713597 - DNA, 20 bp, Artificial
  CRISPR gRNA sequence
tagatctctgtcctgagtta

SEQ ID NO: 713598 - DNA, 20 bp, Artificial
  CRISPR gRNA sequence
agatctctgtcctgagttaa

SEQ ID NO: 713599 - DNA, 20 bp, Artificial
  CRISPR gRNA sequence
tctctgtcctgagttaaggg

SEQ ID NO: 713600 - DNA, 20 bp, Artificial
  CRISPR gRNA sequence
ctctgtcctgagttaagggt

SEQ ID NO: 713601 - DNA, 20 bp, Artificial
  CRISPR gRNA sequence
tctgtcctgagttaagggtg

SEQ ID NO: 713602 - DNA, 20 bp, Artificial
  CRISPR gRNA sequence
taagggtggggacactgacc

SEQ ID NO: 713603 - DNA, 20 bp, Artificial
  CRISPR gRNA sequence
aagggtggggacactgacct

SEQ ID NO: 713604 - DNA, 20 bp, Artificial
  CRISPR gRNA sequence
aacttgacaatcatccctgc

SEQ ID NO: 713605 - DNA, 20 bp, Artificial
  CRISPR gRNA sequence
tgacaatcatccctgccgga

SEQ ID NO: 713606 - DNA, 20 bp, Artificial
  CRISPR gRNA sequence
aatcatccctgccggacaga

SEQ ID NO: 713607 - DNA, 20 bp, Artificial
  CRISPR gRNA sequence
tccctgccggacagacagaa

SEQ ID NO: 713608 - DNA, 20 bp, Artificial
  CRISPR gRNA sequence
ctgccggacagacagaatgg

SEQ ID NO: 713609 - DNA, 20 bp, Artificial
  CRISPR gRNA sequence
ccggacagacagaatggaag

SEQ ID NO: 713610 - DNA, 20 bp, Artificial
  CRISPR gRNA sequence
gacagacagaatggaagaag

SEQ ID NO: 713611 - DNA, 20 bp, Artificial
  CRISPR gRNA sequence
agacagaatggaagaagcag

SEQ ID NO: 713612 - DNA, 20 bp, Artificial
  CRISPR gRNA sequence
gacagaatggaagaagcagc

SEQ ID NO: 713613 - DNA, 20 bp, Artificial
  CRISPR gRNA sequence
aatggaagaagcagcgggca

SEQ ID NO: 713614 - DNA, 20 bp, Artificial
  CRISPR gRNA sequence
atggaagaagcagcgggcac

SEQ ID NO: 713615 - DNA, 20 bp, Artificial
  CRISPR gRNA sequence
ggaagaagcagcgggcacag

SEQ ID NO: 713616 - DNA, 20 bp, Artificial
  CRISPR gRNA sequence
gcagcgggcacaggagttga

SEQ ID NO: 713617 - DNA, 20 bp, Artificial
  CRISPR gRNA sequence
gcgggcacaggagttgacgg

SEQ ID NO: 713618 - DNA, 20 bp, Artificial
  CRISPR gRNA sequence
acaggagttgacggcagacg

SEQ ID NO: 713619 - DNA, 20 bp, Artificial
  CRISPR gRNA sequence
agttgacggcagacgtggaa

SEQ ID NO: 713620 - DNA, 20 bp, Artificial
  CRISPR gRNA sequence
agacgtggaacagaacatgc

SEQ ID NO: 713621 - DNA, 20 bp, Artificial
  CRISPR gRNA sequence
gacgtggaacagaacatgcc

SEQ ID NO: 713622 - DNA, 20 bp, Artificial
  CRISPR gRNA sequence
acatgccgggtcgacattcg

SEQ ID NO: 713623 - DNA, 20 bp, Artificial
  CRISPR gRNA sequence
cgggtcgacattcgcagaca

SEQ ID NO: 713624 - DNA, 20 bp, Artificial
  CRISPR gRNA sequence
gggtcgacattcgcagacac

SEQ ID NO: 713625 - DNA, 20 bp, Artificial
  CRISPR gRNA sequence
gtcgacattcgcagacacgg

SEQ ID NO: 713626 - DNA, 20 bp, Artificial
  CRISPR gRNA sequence
tcgacattcgcagacacggg

SEQ ID NO: 713627 - DNA, 20 bp, Artificial
  CRISPR gRNA sequence
gacattcgcagacacgggag

SEQ ID NO: 713628 - DNA, 20 bp, Artificial
  CRISPR gRNA sequence
cgggaggagttccatgcaca

SEQ ID NO: 713629 - DNA, 20 bp, Artificial
  CRISPR gRNA sequence
gcacacggcgtcttctccac

SEQ ID NO: 713630 - DNA, 20 bp, Artificial
  CRISPR gRNA sequence
cacacggcgtcttctccacg

SEQ ID NO: 713631 - DNA, 20 bp, Artificial
  CRISPR gRNA sequence
tcttctccacgaggtcgtct

SEQ ID NO: 713632 - DNA, 20 bp, Artificial
  CRISPR gRNA sequence
cttctccacgaggtcgtcta

SEQ ID NO: 713633 - DNA, 20 bp, Artificial
  CRISPR gRNA sequence
ttctccacgaggtcgtctaa

SEQ ID NO: 713634 - DNA, 20 bp, Artificial
  CRISPR gRNA sequence
acgaggtcgtctaagggaca

SEQ ID NO: 713635 - DNA, 20 bp, Artificial
  CRISPR gRNA sequence
ggtcgtctaagggacacaga

SEQ ID NO: 713636 - DNA, 20 bp, Artificial
  CRISPR gRNA sequence
gtcgtctaagggacacagac

SEQ ID NO: 713637 - DNA, 20 bp, Artificial
  CRISPR gRNA sequence
tcgtctaagggacacagaca

SEQ ID NO: 713638 - DNA, 20 bp, Artificial
  CRISPR gRNA sequence
cgtctaagggacacagacag

SEQ ID NO: 713639 - DNA, 20 bp, Artificial
  CRISPR gRNA sequence
agggacacagacaggggtca

SEQ ID NO: 713640 - DNA, 20 bp, Artificial
  CRISPR gRNA sequence
ggacacagacaggggtcaca

SEQ ID NO: 713641 - DNA, 20 bp, Artificial
  CRISPR gRNA sequence
gacacagacaggggtcacag

SEQ ID NO: 713642 - DNA, 20 bp, Artificial
  CRISPR gRNA sequence
acacagacaggggtcacaga

SEQ ID NO: 713643 - DNA, 20 bp, Artificial
  CRISPR gRNA sequence
cacagacaggggtcacagag

SEQ ID NO: 713644 - DNA, 20 bp, Artificial
  CRISPR gRNA sequence
acaggggtcacagaggggaa

SEQ ID NO: 713645 - DNA, 20 bp, Artificial
  CRISPR gRNA sequence
ggggtcacagaggggaacag

SEQ ID NO: 713646 - DNA, 20 bp, Artificial
  CRISPR gRNA sequence
gggtcacagaggggaacaga

SEQ ID NO: 713647 - DNA, 20 bp, Artificial
  CRISPR gRNA sequence
tcacagaggggaacagaagg

SEQ ID NO: 713648 - DNA, 20 bp, Artificial
  CRISPR gRNA sequence
cacagaggggaacagaagga

SEQ ID NO: 713649 - DNA, 20 bp, Artificial
  CRISPR gRNA sequence
acagaaggaaggcgtctctc

SEQ ID NO: 713650 - DNA, 20 bp, Artificial
  CRISPR gRNA sequence
aaggaaggcgtctctccaga

SEQ ID NO: 713651 - DNA, 20 bp, Artificial
  CRISPR gRNA sequence
cgtctctccagatagctctt

SEQ ID NO: 713652 - DNA, 20 bp, Artificial
  CRISPR gRNA sequence
ctccagatagctcttgagat

SEQ ID NO: 713653 - DNA, 20 bp, Artificial
  CRISPR gRNA sequence
tccagatagctcttgagatg

SEQ ID NO: 713654 - DNA, 20 bp, Artificial
  CRISPR gRNA sequence
ccagatagctcttgagatga

SEQ ID NO: 713655 - DNA, 20 bp, Artificial
  CRISPR gRNA sequence
cagatagctcttgagatgag

SEQ ID NO: 713656 - DNA, 20 bp, Artificial
  CRISPR gRNA sequence
agatagctcttgagatgagg

SEQ ID NO: 713657 - DNA, 20 bp, Artificial
  CRISPR gRNA sequence
atagctcttgagatgagggg

SEQ ID NO: 713658 - DNA, 20 bp, Artificial
  CRISPR gRNA sequence
agctcttgagatgaggggga

SEQ ID NO: 713659 - DNA, 20 bp, Artificial
  CRISPR gRNA sequence
gctcttgagatgagggggag

SEQ ID NO: 713660 - DNA, 20 bp, Artificial
  CRISPR gRNA sequence
ctcttgagatgagggggaga

SEQ ID NO: 713661 - DNA, 20 bp, Artificial
  CRISPR gRNA sequence
ttgagatgagggggagaggg

SEQ ID NO: 713662 - DNA, 20 bp, Artificial
  CRISPR gRNA sequence
tgagatgagggggagagggc

SEQ ID NO: 713663 - DNA, 20 bp, Artificial
  CRISPR gRNA sequence
tgagggggagagggcaggtg

SEQ ID NO: 713664 - DNA, 20 bp, Artificial
  CRISPR gRNA sequence
ggcaggtgcagtccgcaacg

SEQ ID NO: 713665 - DNA, 20 bp, Artificial
  CRISPR gRNA sequence
gcaacgcagcctccgcctcc

SEQ ID NO: 713666 - DNA, 20 bp, Artificial
  CRISPR gRNA sequence
cgcctcccagctcaaccccc

SEQ ID NO: 713667 - DNA, 20 bp, Artificial
  CRISPR gRNA sequence
cccctggtgaccactaaaat

SEQ ID NO: 713668 - DNA, 20 bp, Artificial
  CRISPR gRNA sequence
aaatgcaaaaaaataaaaaa

SEQ ID NO: 713669 - DNA, 20 bp, Artificial
  CRISPR gRNA sequence
aaaaaaataaaaaaaagaca

SEQ ID NO: 713670 - DNA, 20 bp, Artificial
  CRISPR gRNA sequence
aaaaataaaaaaaagacatg

SEQ ID NO: 713671 - DNA, 20 bp, Artificial
  CRISPR gRNA sequence
aaaataaaaaaaagacatgg

SEQ ID NO: 713672 - DNA, 20 bp, Artificial
  CRISPR gRNA sequence
aaaaagacatggaggaaact

SEQ ID NO: 713673 - DNA, 20 bp, Artificial
  CRISPR gRNA sequence
agatacatattgctaaatga

SEQ ID NO: 713674 - DNA, 20 bp, Artificial
  CRISPR gRNA sequence
tattgctaaatgaaagacac

SEQ ID NO: 713675 - DNA, 20 bp, Artificial
  CRISPR gRNA sequence
atgaaagacaccagtctgaa

SEQ ID NO: 713676 - DNA, 20 bp, Artificial
  CRISPR gRNA sequence
tgaaagacaccagtctgaaa

SEQ ID NO: 713677 - DNA, 20 bp, Artificial
  CRISPR gRNA sequence
ttccaactacatgacatttc

SEQ ID NO: 713678 - DNA, 20 bp, Artificial
  CRISPR gRNA sequence
actacatgacatttctggaa

SEQ ID NO: 713679 - DNA, 20 bp, Artificial
  CRISPR gRNA sequence
ctggaaaagatgaaactatc

SEQ ID NO: 713680 - DNA, 20 bp, Artificial
  CRISPR gRNA sequence
aaaagatgaaactatcgaga

SEQ ID NO: 713681 - DNA, 20 bp, Artificial
  CRISPR gRNA sequence
gaaactatcgagacagtaaa

SEQ ID NO: 713682 - DNA, 20 bp, Artificial
  CRISPR gRNA sequence
tatcgagacagtaaaaagat

SEQ ID NO: 713683 - DNA, 20 bp, Artificial
  CRISPR gRNA sequence
cgagacagtaaaaagatcag

SEQ ID NO: 713684 - DNA, 20 bp, Artificial
  CRISPR gRNA sequence
gtaaaaagatcagtagctgc

SEQ ID NO: 713685 - DNA, 20 bp, Artificial
  CRISPR gRNA sequence
aaaaagatcagtagctgcca

SEQ ID NO: 713686 - DNA, 20 bp, Artificial
  CRISPR gRNA sequence
aaaagatcagtagctgccag

SEQ ID NO: 713687 - DNA, 20 bp, Artificial
  CRISPR gRNA sequence
atcagtagctgccagaggtt

SEQ ID NO: 713688 - DNA, 20 bp, Artificial
  CRISPR gRNA sequence
tcagtagctgccagaggttc

SEQ ID NO: 713689 - DNA, 20 bp, Artificial
  CRISPR gRNA sequence
cagtagctgccagaggttca

SEQ ID NO: 713690 - DNA, 20 bp, Artificial
  CRISPR gRNA sequence
agtagctgccagaggttcag

SEQ ID NO: 713691 - DNA, 20 bp, Artificial
  CRISPR gRNA sequence
gtagctgccagaggttcagg

SEQ ID NO: 713692 - DNA, 20 bp, Artificial
  CRISPR gRNA sequence
agctgccagaggttcagggg

SEQ ID NO: 713693 - DNA, 20 bp, Artificial
  CRISPR gRNA sequence
gctgccagaggttcaggggg

SEQ ID NO: 713694 - DNA, 20 bp, Artificial
  CRISPR gRNA sequence
ctgccagaggttcaggggga

SEQ ID NO: 713695 - DNA, 20 bp, Artificial
  CRISPR gRNA sequence
gccagaggttcagggggagg

SEQ ID NO: 713696 - DNA, 20 bp, Artificial
  CRISPR gRNA sequence
cagaggttcagggggaggga

SEQ ID NO: 713697 - DNA, 20 bp, Artificial
  CRISPR gRNA sequence
agaggttcagggggagggag

SEQ ID NO: 713698 - DNA, 20 bp, Artificial
  CRISPR gRNA sequence
ggagggagaggtgaaccaac

SEQ ID NO: 713699 - DNA, 20 bp, Artificial
  CRISPR gRNA sequence
gagaggtgaaccaacgagct

SEQ ID NO: 713700 - DNA, 20 bp, Artificial
  CRISPR gRNA sequence
agaggtgaaccaacgagctc

SEQ ID NO: 713701 - DNA, 20 bp, Artificial
  CRISPR gRNA sequence
caacgagctcaggacacatt

SEQ ID NO: 713702 - DNA, 20 bp, Artificial
  CRISPR gRNA sequence
aacgagctcaggacacattt

SEQ ID NO: 713703 - DNA, 20 bp, Artificial
  CRISPR gRNA sequence
acgagctcaggacacattta

SEQ ID NO: 713704 - DNA, 20 bp, Artificial
  CRISPR gRNA sequence
agctcaggacacatttaggg

SEQ ID NO: 713705 - DNA, 20 bp, Artificial
  CRISPR gRNA sequence
ttagggcagtgaaaatattc

SEQ ID NO: 713706 - DNA, 20 bp, Artificial
  CRISPR gRNA sequence
tgaaaatattctggatgcca

SEQ ID NO: 713707 - DNA, 20 bp, Artificial
  CRISPR gRNA sequence
tattctggatgccacggtga

SEQ ID NO: 713708 - DNA, 20 bp, Artificial
  CRISPR gRNA sequence
tctggatgccacggtgatgg

SEQ ID NO: 713709 - DNA, 20 bp, Artificial
  CRISPR gRNA sequence
ctggatgccacggtgatggt

SEQ ID NO: 713710 - DNA, 20 bp, Artificial
  CRISPR gRNA sequence
ccacggtgatggtgggcacg

SEQ ID NO: 713711 - DNA, 20 bp, Artificial
  CRISPR gRNA sequence
ggtcatcatccgtttgtcta

SEQ ID NO: 713712 - DNA, 20 bp, Artificial
  CRISPR gRNA sequence
catccgtttgtctaaagccc

SEQ ID NO: 713713 - DNA, 20 bp, Artificial
  CRISPR gRNA sequence
gtttgtctaaagccctagaa

SEQ ID NO: 713714 - DNA, 20 bp, Artificial
  CRISPR gRNA sequence
tttgtctaaagccctagaat

SEQ ID NO: 713715 - DNA, 20 bp, Artificial
  CRISPR gRNA sequence
gccctagaatgggcaacaca

SEQ ID NO: 713716 - DNA, 20 bp, Artificial
  CRISPR gRNA sequence
cctagaatgggcaacacaaa

SEQ ID NO: 713717 - DNA, 20 bp, Artificial
  CRISPR gRNA sequence
gtgaaccctgctgtaaacta

SEQ ID NO: 713718 - DNA, 20 bp, Artificial
  CRISPR gRNA sequence
ctgctgtaaactatggactt

SEQ ID NO: 713719 - DNA, 20 bp, Artificial
  CRISPR gRNA sequence
tgtaaactatggacttcagt

SEQ ID NO: 713720 - DNA, 20 bp, Artificial
  CRISPR gRNA sequence
taataataatgcatcattat

SEQ ID NO: 713721 - DNA, 20 bp, Artificial
  CRISPR gRNA sequence
aataataatgcatcattatc

SEQ ID NO: 713722 - DNA, 20 bp, Artificial
  CRISPR gRNA sequence
caattgtgccacactaatgc

SEQ ID NO: 713723 - DNA, 20 bp, Artificial
  CRISPR gRNA sequence
aattgtgccacactaatgca

SEQ ID NO: 713724 - DNA, 20 bp, Artificial
  CRISPR gRNA sequence
ctaatgcaaggtgttcgtga

SEQ ID NO: 713725 - DNA, 20 bp, Artificial
  CRISPR gRNA sequence
taatgcaaggtgttcgtgac

SEQ ID NO: 713726 - DNA, 20 bp, Artificial
  CRISPR gRNA sequence
aatgcaaggtgttcgtgaca

SEQ ID NO: 713727 - DNA, 20 bp, Artificial
  CRISPR gRNA sequence
atgcaaggtgttcgtgacag

SEQ ID NO: 713728 - DNA, 20 bp, Artificial
  CRISPR gRNA sequence
gcaaggtgttcgtgacaggg

SEQ ID NO: 713729 - DNA, 20 bp, Artificial
  CRISPR gRNA sequence
caaggtgttcgtgacagggg

SEQ ID NO: 713730 - DNA, 20 bp, Artificial
  CRISPR gRNA sequence
gtgttcgtgacaggggaggc

SEQ ID NO: 713731 - DNA, 20 bp, Artificial
  CRISPR gRNA sequence
tgttcgtgacaggggaggct

SEQ ID NO: 713732 - DNA, 20 bp, Artificial
  CRISPR gRNA sequence
gtgacaggggaggctgggtg

SEQ ID NO: 713733 - DNA, 20 bp, Artificial
  CRISPR gRNA sequence
acaggggaggctgggtgcag

SEQ ID NO: 713734 - DNA, 20 bp, Artificial
  CRISPR gRNA sequence
gtggctcacgcctttaatcc

SEQ ID NO: 713735 - DNA, 20 bp, Artificial
  CRISPR gRNA sequence
cgcctttaatcccagcactt

SEQ ID NO: 713736 - DNA, 20 bp, Artificial
  CRISPR gRNA sequence
gcctttaatcccagcacttt

SEQ ID NO: 713737 - DNA, 20 bp, Artificial
  CRISPR gRNA sequence
ctttaatcccagcactttgg

SEQ ID NO: 713738 - DNA, 20 bp, Artificial
  CRISPR gRNA sequence
tttaatcccagcactttggg

SEQ ID NO: 713739 - DNA, 20 bp, Artificial
  CRISPR gRNA sequence
tcccagcactttgggaggcc

SEQ ID NO: 713740 - DNA, 20 bp, Artificial
  CRISPR gRNA sequence
cccagcactttgggaggccg

SEQ ID NO: 713741 - DNA, 20 bp, Artificial
  CRISPR gRNA sequence
agcactttgggaggccgagg

SEQ ID NO: 713742 - DNA, 20 bp, Artificial
  CRISPR gRNA sequence
gcactttgggaggccgaggc

SEQ ID NO: 713743 - DNA, 20 bp, Artificial
  CRISPR gRNA sequence
actttgggaggccgaggcag

SEQ ID NO: 713744 - DNA, 20 bp, Artificial
  CRISPR gRNA sequence
ctttgggaggccgaggcagg

SEQ ID NO: 713745 - DNA, 20 bp, Artificial
  CRISPR gRNA sequence
gaggatcatttgccctcata

SEQ ID NO: 713746 - DNA, 20 bp, Artificial
  CRISPR gRNA sequence
tttgccctcatatggcgaca

SEQ ID NO: 713747 - DNA, 20 bp, Artificial
  CRISPR gRNA sequence
aatcccatctctataaaaca

SEQ ID NO: 713748 - DNA, 20 bp, Artificial
  CRISPR gRNA sequence
atcccatctctataaaacat

SEQ ID NO: 713749 - DNA, 20 bp, Artificial
  CRISPR gRNA sequence
tctataaaacatgggcaaca

SEQ ID NO: 713750 - DNA, 20 bp, Artificial
  CRISPR gRNA sequence
caaaaaaaaaatacaaaaat

SEQ ID NO: 713751 - DNA, 20 bp, Artificial
  CRISPR gRNA sequence
aaaaaaatacaaaaattagc

SEQ ID NO: 713752 - DNA, 20 bp, Artificial
  CRISPR gRNA sequence
aaaaaatacaaaaattagcc

SEQ ID NO: 713753 - DNA, 20 bp, Artificial
  CRISPR gRNA sequence
atacaaaaattagccaggca

SEQ ID NO: 713754 - DNA, 20 bp, Artificial
  CRISPR gRNA sequence
caaaaattagccaggcatgg

SEQ ID NO: 713755 - DNA, 20 bp, Artificial
  CRISPR gRNA sequence
ggcatggtagcacatgcctg

SEQ ID NO: 713756 - DNA, 20 bp, Artificial
  CRISPR gRNA sequence
gtagcacatgcctgtagtcc

SEQ ID NO: 713757 - DNA, 20 bp, Artificial
  CRISPR gRNA sequence
tgcctgtagtcccagctact

SEQ ID NO: 713758 - DNA, 20 bp, Artificial
  CRISPR gRNA sequence
gcctgtagtcccagctactt

SEQ ID NO: 713759 - DNA, 20 bp, Artificial
  CRISPR gRNA sequence
ctgtagtcccagctacttgg

SEQ ID NO: 713760 - DNA, 20 bp, Artificial
  CRISPR gRNA sequence
tgtagtcccagctacttggg

SEQ ID NO: 713761 - DNA, 20 bp, Artificial
  CRISPR gRNA sequence
tcccagctacttgggaggct

SEQ ID NO: 713762 - DNA, 20 bp, Artificial
  CRISPR gRNA sequence
cccagctacttgggaggctg

SEQ ID NO: 713763 - DNA, 20 bp, Artificial
  CRISPR gRNA sequence
agctacttgggaggctgagg

SEQ ID NO: 713764 - DNA, 20 bp, Artificial
  CRISPR gRNA sequence
gctacttgggaggctgaggc

SEQ ID NO: 713765 - DNA, 20 bp, Artificial
  CRISPR gRNA sequence
tacttgggaggctgaggcgg

SEQ ID NO: 713766 - DNA, 20 bp, Artificial
  CRISPR gRNA sequence
acttgggaggctgaggcggg

SEQ ID NO: 713767 - DNA, 20 bp, Artificial
  CRISPR gRNA sequence
ctgaggcgggaggatcgctt

SEQ ID NO: 713768 - DNA, 20 bp, Artificial
  CRISPR gRNA sequence
gcgggaggatcgcttgagcc

SEQ ID NO: 713769 - DNA, 20 bp, Artificial
  CRISPR gRNA sequence
cgggaggatcgcttgagccc

SEQ ID NO: 713770 - DNA, 20 bp, Artificial
  CRISPR gRNA sequence
ggaggatcgcttgagcccag

SEQ ID NO: 713771 - DNA, 20 bp, Artificial
  CRISPR gRNA sequence
gaggatcgcttgagcccagg

SEQ ID NO: 713772 - DNA, 20 bp, Artificial
  CRISPR gRNA sequence
tcgcttgagcccaggaggtt

SEQ ID NO: 713773 - DNA, 20 bp, Artificial
  CRISPR gRNA sequence
cgcttgagcccaggaggttg

SEQ ID NO: 713774 - DNA, 20 bp, Artificial
  CRISPR gRNA sequence
agcccaggaggttgaggctg

SEQ ID NO: 713775 - DNA, 20 bp, Artificial
  CRISPR gRNA sequence
caggaggttgaggctgtagt

SEQ ID NO: 713776 - DNA, 20 bp, Artificial
  CRISPR gRNA sequence
gtgattgcaccactgcactc

SEQ ID NO: 713777 - DNA, 20 bp, Artificial
  CRISPR gRNA sequence
tgcaccactgcactccagcc

SEQ ID NO: 713778 - DNA, 20 bp, Artificial
  CRISPR gRNA sequence
gcaccactgcactccagcct

SEQ ID NO: 713779 - DNA, 20 bp, Artificial
  CRISPR gRNA sequence
ctgcactccagcctgggcaa

SEQ ID NO: 713780 - DNA, 20 bp, Artificial
  CRISPR gRNA sequence
gcactccagcctgggcaaaa

SEQ ID NO: 713781 - DNA, 20 bp, Artificial
  CRISPR gRNA sequence
accctgtttcaaacaaaaaa

SEQ ID NO: 713782 - DNA, 20 bp, Artificial
  CRISPR gRNA sequence
ccctgtttcaaacaaaaaat

SEQ ID NO: 713783 - DNA, 20 bp, Artificial
  CRISPR gRNA sequence
cctgtttcaaacaaaaaata

SEQ ID NO: 713784 - DNA, 20 bp, Artificial
  CRISPR gRNA sequence
ctgtttcaaacaaaaaatag

SEQ ID NO: 713785 - DNA, 20 bp, Artificial
  CRISPR gRNA sequence
acaaaaaataggggaaactg

SEQ ID NO: 713786 - DNA, 20 bp, Artificial
  CRISPR gRNA sequence
caaaaaataggggaaactgt

SEQ ID NO: 713787 - DNA, 20 bp, Artificial
  CRISPR gRNA sequence
aaaaataggggaaactgtgg

SEQ ID NO: 713788 - DNA, 20 bp, Artificial
  CRISPR gRNA sequence
taggggaaactgtgggagat

SEQ ID NO: 713789 - DNA, 20 bp, Artificial
  CRISPR gRNA sequence
aggggaaactgtgggagatt

SEQ ID NO: 713790 - DNA, 20 bp, Artificial
  CRISPR gRNA sequence
ggaaactgtgggagattggg

SEQ ID NO: 713791 - DNA, 20 bp, Artificial
  CRISPR gRNA sequence
gaaactgtgggagattggga

SEQ ID NO: 713792 - DNA, 20 bp, Artificial
  CRISPR gRNA sequence
aaactgtgggagattgggaa

SEQ ID NO: 713793 - DNA, 20 bp, Artificial
  CRISPR gRNA sequence
aactgtgggagattgggaag

SEQ ID NO: 713794 - DNA, 20 bp, Artificial
  CRISPR gRNA sequence
actgtgggagattgggaagg

SEQ ID NO: 713795 - DNA, 20 bp, Artificial
  CRISPR gRNA sequence
gggagattgggaagggggtt

SEQ ID NO: 713796 - DNA, 20 bp, Artificial
  CRISPR gRNA sequence
ggagattgggaagggggttg

SEQ ID NO: 713797 - DNA, 20 bp, Artificial
  CRISPR gRNA sequence
gagattgggaagggggttga

SEQ ID NO: 713798 - DNA, 20 bp, Artificial
  CRISPR gRNA sequence
ggaagggggttgagggtata

SEQ ID NO: 713799 - DNA, 20 bp, Artificial
  CRISPR gRNA sequence
gaagggggttgagggtatat

SEQ ID NO: 713800 - DNA, 20 bp, Artificial
  CRISPR gRNA sequence
tgtaaacctaaaactgctct

SEQ ID NO: 713801 - DNA, 20 bp, Artificial
  CRISPR gRNA sequence
cctaaaactgctctaagaaa

SEQ ID NO: 713802 - DNA, 20 bp, Artificial
  CRISPR gRNA sequence
ttattaattttttttttttt

SEQ ID NO: 713803 - DNA, 20 bp, Artificial
  CRISPR gRNA sequence
taatttttttttttttaaga

SEQ ID NO: 713804 - DNA, 20 bp, Artificial
  CRISPR gRNA sequence
atttttttttttttaagaca

SEQ ID NO: 713805 - DNA, 20 bp, Artificial
  CRISPR gRNA sequence
cagagtctcactctgtcacc

SEQ ID NO: 713806 - DNA, 20 bp, Artificial
  CRISPR gRNA sequence
agagtctcactctgtcaccc

SEQ ID NO: 713807 - DNA, 20 bp, Artificial
  CRISPR gRNA sequence
tctcactctgtcacccaggt

SEQ ID NO: 713808 - DNA, 20 bp, Artificial
  CRISPR gRNA sequence
tcactctgtcacccaggttg

SEQ ID NO: 713809 - DNA, 20 bp, Artificial
  CRISPR gRNA sequence
tcacccaggttggagtgcaa

SEQ ID NO: 713810 - DNA, 20 bp, Artificial
  CRISPR gRNA sequence
ggagtgcaatggcgcaatct

SEQ ID NO: 713811 - DNA, 20 bp, Artificial
  CRISPR gRNA sequence
aatctcggctcactgcaacc

SEQ ID NO: 713812 - DNA, 20 bp, Artificial
  CRISPR gRNA sequence
atctcggctcactgcaacct

SEQ ID NO: 713813 - DNA, 20 bp, Artificial
  CRISPR gRNA sequence
gctcactgcaacctgggttc

SEQ ID NO: 713814 - DNA, 20 bp, Artificial
  CRISPR gRNA sequence
ttcaagtgattctcctgcct

SEQ ID NO: 713815 - DNA, 20 bp, Artificial
  CRISPR gRNA sequence
ttctcctgcctcagcctcct

SEQ ID NO: 713816 - DNA, 20 bp, Artificial
  CRISPR gRNA sequence
tcctgcctcagcctcctgag

SEQ ID NO: 713817 - DNA, 20 bp, Artificial
  CRISPR gRNA sequence
gcctcagcctcctgagtagc

SEQ ID NO: 713818 - DNA, 20 bp, Artificial
  CRISPR gRNA sequence
cctcagcctcctgagtagct

SEQ ID NO: 713819 - DNA, 20 bp, Artificial
  CRISPR gRNA sequence
ctcctgagtagctgggatta

SEQ ID NO: 713820 - DNA, 20 bp, Artificial
  CRISPR gRNA sequence
tcctgagtagctgggattac

SEQ ID NO: 713821 - DNA, 20 bp, Artificial
  CRISPR gRNA sequence
actaattttttgtattttta

SEQ ID NO: 713822 - DNA, 20 bp, Artificial
  CRISPR gRNA sequence
taattttttgtatttttata

SEQ ID NO: 713823 - DNA, 20 bp, Artificial
  CRISPR gRNA sequence
tttttgtatttttatagaga

SEQ ID NO: 713824 - DNA, 20 bp, Artificial
  CRISPR gRNA sequence
ttttgtatttttatagagac

SEQ ID NO: 713825 - DNA, 20 bp, Artificial
  CRISPR gRNA sequence
tttgtatttttatagagacg

SEQ ID NO: 713826 - DNA, 20 bp, Artificial
  CRISPR gRNA sequence
gagacggggtttcaccacgt

SEQ ID NO: 713827 - DNA, 20 bp, Artificial
  CRISPR gRNA sequence
cggggtttcaccacgttggc

SEQ ID NO: 713828 - DNA, 20 bp, Artificial
  CRISPR gRNA sequence
ggggtttcaccacgttggcc

SEQ ID NO: 713829 - DNA, 20 bp, Artificial
  CRISPR gRNA sequence
tttcaccacgttggccagga

SEQ ID NO: 713830 - DNA, 20 bp, Artificial
  CRISPR gRNA sequence
tggtctcaaactcctgacct

SEQ ID NO: 713831 - DNA, 20 bp, Artificial
  CRISPR gRNA sequence
ggtctcaaactcctgacctc

SEQ ID NO: 713832 - DNA, 20 bp, Artificial
  CRISPR gRNA sequence
ctcaggtgatccacccgcct

SEQ ID NO: 713833 - DNA, 20 bp, Artificial
  CRISPR gRNA sequence
ccacccgcctcggcctccca

SEQ ID NO: 713834 - DNA, 20 bp, Artificial
  CRISPR gRNA sequence
cctcggcctcccaaagtgct

SEQ ID NO: 713835 - DNA, 20 bp, Artificial
  CRISPR gRNA sequence
ctcccaaagtgctgagatta

SEQ ID NO: 713836 - DNA, 20 bp, Artificial
  CRISPR gRNA sequence
tcccaaagtgctgagattac

SEQ ID NO: 713837 - DNA, 20 bp, Artificial
  CRISPR gRNA sequence
agtgctgagattacaggcgt

SEQ ID NO: 713838 - DNA, 20 bp, Artificial
  CRISPR gRNA sequence
caggcgtgagccactgcacc

SEQ ID NO: 713839 - DNA, 20 bp, Artificial
  CRISPR gRNA sequence
cgtgagccactgcacccagc

SEQ ID NO: 713840 - DNA, 20 bp, Artificial
  CRISPR gRNA sequence
ccactgcacccagccagaaa

SEQ ID NO: 713841 - DNA, 20 bp, Artificial
  CRISPR gRNA sequence
tagtttattaatttttttaa

SEQ ID NO: 713842 - DNA, 20 bp, Artificial
  CRISPR gRNA sequence
attaatttttttaatggaca

SEQ ID NO: 713843 - DNA, 20 bp, Artificial
  CRISPR gRNA sequence
ttaatttttttaatggacaa

SEQ ID NO: 713844 - DNA, 20 bp, Artificial
  CRISPR gRNA sequence
ttttttaatggacaaaggac

SEQ ID NO: 713845 - DNA, 20 bp, Artificial
  CRISPR gRNA sequence
taatggacaaaggactggaa

SEQ ID NO: 713846 - DNA, 20 bp, Artificial
  CRISPR gRNA sequence
ctggaatagacatttctcta

SEQ ID NO: 713847 - DNA, 20 bp, Artificial
  CRISPR gRNA sequence
gaatagacatttctctaaag

SEQ ID NO: 713848 - DNA, 20 bp, Artificial
  CRISPR gRNA sequence
atttctctaaagaagataca

SEQ ID NO: 713849 - DNA, 20 bp, Artificial
  CRISPR gRNA sequence
ctctaaagaagatacacagc

SEQ ID NO: 713850 - DNA, 20 bp, Artificial
  CRISPR gRNA sequence
tgaaaaatgtcccacaccgt

SEQ ID NO: 713851 - DNA, 20 bp, Artificial
  CRISPR gRNA sequence
tgtcccacaccgttagccat

SEQ ID NO: 713852 - DNA, 20 bp, Artificial
  CRISPR gRNA sequence
gtcccacaccgttagccatt

SEQ ID NO: 713853 - DNA, 20 bp, Artificial
  CRISPR gRNA sequence
tcccacaccgttagccatta

SEQ ID NO: 713854 - DNA, 20 bp, Artificial
  CRISPR gRNA sequence
gttagccattagggaaatgc

SEQ ID NO: 713855 - DNA, 20 bp, Artificial
  CRISPR gRNA sequence
ggaaatgcaagtcaaaatca

SEQ ID NO: 713856 - DNA, 20 bp, Artificial
  CRISPR gRNA sequence
atgcaagtcaaaatcacagt

SEQ ID NO: 713857 - DNA, 20 bp, Artificial
  CRISPR gRNA sequence
agataccacttcacaaccac

SEQ ID NO: 713858 - DNA, 20 bp, Artificial
  CRISPR gRNA sequence
ctagaatgactcgaatcaaa

SEQ ID NO: 713859 - DNA, 20 bp, Artificial
  CRISPR gRNA sequence
aatgactcgaatcaaaaaga

SEQ ID NO: 713860 - DNA, 20 bp, Artificial
  CRISPR gRNA sequence
agacagataataacaactgc

SEQ ID NO: 713861 - DNA, 20 bp, Artificial
  CRISPR gRNA sequence
cagataataacaactgctgg

SEQ ID NO: 713862 - DNA, 20 bp, Artificial
  CRISPR gRNA sequence
agataataacaactgctggc

SEQ ID NO: 713863 - DNA, 20 bp, Artificial
  CRISPR gRNA sequence
ataacaactgctggcaggaa

SEQ ID NO: 713864 - DNA, 20 bp, Artificial
  CRISPR gRNA sequence
acaactgctggcaggaaaag

SEQ ID NO: 713865 - DNA, 20 bp, Artificial
  CRISPR gRNA sequence
caactgctggcaggaaaagc

SEQ ID NO: 713866 - DNA, 20 bp, Artificial
  CRISPR gRNA sequence
gcaggaaaagcaggaaatca

SEQ ID NO: 713867 - DNA, 20 bp, Artificial
  CRISPR gRNA sequence
caggaaaagcaggaaatcac

SEQ ID NO: 713868 - DNA, 20 bp, Artificial
  CRISPR gRNA sequence
aaaagcaggaaatcacaggt

SEQ ID NO: 713869 - DNA, 20 bp, Artificial
  CRISPR gRNA sequence
ggaaatcacaggttggttaa

SEQ ID NO: 713870 - DNA, 20 bp, Artificial
  CRISPR gRNA sequence
ggttggttaacagacataaa

SEQ ID NO: 713871 - DNA, 20 bp, Artificial
  CRISPR gRNA sequence
gttaacagacataaaaagta

SEQ ID NO: 713872 - DNA, 20 bp, Artificial
  CRISPR gRNA sequence
acagacataaaaagtacagc

SEQ ID NO: 713873 - DNA, 20 bp, Artificial
  CRISPR gRNA sequence
cagacataaaaagtacagct

SEQ ID NO: 713874 - DNA, 20 bp, Artificial
  CRISPR gRNA sequence
acataaaaagtacagctagg

SEQ ID NO: 713875 - DNA, 20 bp, Artificial
  CRISPR gRNA sequence
cataaaaagtacagctaggc

SEQ ID NO: 713876 - DNA, 20 bp, Artificial
  CRISPR gRNA sequence
ataaaaagtacagctaggcg

SEQ ID NO: 713877 - DNA, 20 bp, Artificial
  CRISPR gRNA sequence
aaaaagtacagctaggcggg

SEQ ID NO: 713878 - DNA, 20 bp, Artificial
  CRISPR gRNA sequence
aagtacagctaggcggggag

SEQ ID NO: 713879 - DNA, 20 bp, Artificial
  CRISPR gRNA sequence
tacagctaggcggggagtgg

SEQ ID NO: 713880 - DNA, 20 bp, Artificial
  CRISPR gRNA sequence
gtggttcacacttgtaatcc

SEQ ID NO: 713881 - DNA, 20 bp, Artificial
  CRISPR gRNA sequence
cacttgtaatcccagcactt

SEQ ID NO: 713882 - DNA, 20 bp, Artificial
  CRISPR gRNA sequence
acttgtaatcccagcacttt

SEQ ID NO: 713883 - DNA, 20 bp, Artificial
  CRISPR gRNA sequence
ttgtaatcccagcactttgg

SEQ ID NO: 713884 - DNA, 20 bp, Artificial
  CRISPR gRNA sequence
tgtaatcccagcactttggg

SEQ ID NO: 713885 - DNA, 20 bp, Artificial
  CRISPR gRNA sequence
tcccagcactttgggaggcc

SEQ ID NO: 713886 - DNA, 20 bp, Artificial
  CRISPR gRNA sequence
cccagcactttgggaggccg

SEQ ID NO: 713887 - DNA, 20 bp, Artificial
  CRISPR gRNA sequence
agcactttgggaggccgagg

SEQ ID NO: 713888 - DNA, 20 bp, Artificial
  CRISPR gRNA sequence
gcactttgggaggccgaggt

SEQ ID NO: 713889 - DNA, 20 bp, Artificial
  CRISPR gRNA sequence
ctttgggaggccgaggtggg

SEQ ID NO: 713890 - DNA, 20 bp, Artificial
  CRISPR gRNA sequence
ccgaggtgggcagatcacct

SEQ ID NO: 713891 - DNA, 20 bp, Artificial
  CRISPR gRNA sequence
cgaggtgggcagatcacctg

SEQ ID NO: 713892 - DNA, 20 bp, Artificial
  CRISPR gRNA sequence
gtgggcagatcacctgaggt

SEQ ID NO: 713893 - DNA, 20 bp, Artificial
  CRISPR gRNA sequence
tgggcagatcacctgaggtc

SEQ ID NO: 713894 - DNA, 20 bp, Artificial
  CRISPR gRNA sequence
ggcagatcacctgaggtcag

SEQ ID NO: 713895 - DNA, 20 bp, Artificial
  CRISPR gRNA sequence
tcacctgaggtcaggagttt

SEQ ID NO: 713896 - DNA, 20 bp, Artificial
  CRISPR gRNA sequence
tgaggtcaggagtttgagac

SEQ ID NO: 713897 - DNA, 20 bp, Artificial
  CRISPR gRNA sequence
tcaggagtttgagaccagcc

SEQ ID NO: 713898 - DNA, 20 bp, Artificial
  CRISPR gRNA sequence
tgagaccagcccggccaaca

SEQ ID NO: 713899 - DNA, 20 bp, Artificial
  CRISPR gRNA sequence
tctactaaaaatacaaaaat

SEQ ID NO: 713900 - DNA, 20 bp, Artificial
  CRISPR gRNA sequence
ctaaaaatacaaaaattagc

SEQ ID NO: 713901 - DNA, 20 bp, Artificial
  CRISPR gRNA sequence
taaaaatacaaaaattagcc

SEQ ID NO: 713902 - DNA, 20 bp, Artificial
  CRISPR gRNA sequence
atacaaaaattagccaggtg

SEQ ID NO: 713903 - DNA, 20 bp, Artificial
  CRISPR gRNA sequence
caaaaattagccaggtgtgg

SEQ ID NO: 713904 - DNA, 20 bp, Artificial
  CRISPR gRNA sequence
gtggtgcacacctgtaatcc

SEQ ID NO: 713905 - DNA, 20 bp, Artificial
  CRISPR gRNA sequence
acacctgtaatccaagctac

SEQ ID NO: 713906 - DNA, 20 bp, Artificial
  CRISPR gRNA sequence
cacctgtaatccaagctact

SEQ ID NO: 713907 - DNA, 20 bp, Artificial
  CRISPR gRNA sequence
acctgtaatccaagctactg

SEQ ID NO: 713908 - DNA, 20 bp, Artificial
  CRISPR gRNA sequence
ctgtaatccaagctactggg

SEQ ID NO: 713909 - DNA, 20 bp, Artificial
  CRISPR gRNA sequence
tgtaatccaagctactgggg

SEQ ID NO: 713910 - DNA, 20 bp, Artificial
  CRISPR gRNA sequence
tccaagctactggggaggct

SEQ ID NO: 713911 - DNA, 20 bp, Artificial
  CRISPR gRNA sequence
agctactggggaggctgaga

SEQ ID NO: 713912 - DNA, 20 bp, Artificial
  CRISPR gRNA sequence
gctactggggaggctgagac

SEQ ID NO: 713913 - DNA, 20 bp, Artificial
  CRISPR gRNA sequence
caggaaaatcacttgaaccc

SEQ ID NO: 713914 - DNA, 20 bp, Artificial
  CRISPR gRNA sequence
gaaaatcacttgaacccgag

SEQ ID NO: 713915 - DNA, 20 bp, Artificial
  CRISPR gRNA sequence
aatcacttgaacccgagaag

SEQ ID NO: 713916 - DNA, 20 bp, Artificial
  CRISPR gRNA sequence
tcacttgaacccgagaagtg

SEQ ID NO: 713917 - DNA, 20 bp, Artificial
  CRISPR gRNA sequence
cacttgaacccgagaagtgg

SEQ ID NO: 713918 - DNA, 20 bp, Artificial
  CRISPR gRNA sequence
aacccgagaagtggaggttg

SEQ ID NO: 713919 - DNA, 20 bp, Artificial
  CRISPR gRNA sequence
cgagaagtggaggttgcagt

SEQ ID NO: 713920 - DNA, 20 bp, Artificial
  CRISPR gRNA sequence
agtggaggttgcagtgagtt

SEQ ID NO: 713921 - DNA, 20 bp, Artificial
  CRISPR gRNA sequence
gaggttgcagtgagttgaga

SEQ ID NO: 713922 - DNA, 20 bp, Artificial
  CRISPR gRNA sequence
gagatggccccacttcactc

SEQ ID NO: 713923 - DNA, 20 bp, Artificial
  CRISPR gRNA sequence
ggccccacttcactccagcc

SEQ ID NO: 713924 - DNA, 20 bp, Artificial
  CRISPR gRNA sequence
gccccacttcactccagcct

SEQ ID NO: 713925 - DNA, 20 bp, Artificial
  CRISPR gRNA sequence
cttcactccagcctgggcaa

SEQ ID NO: 713926 - DNA, 20 bp, Artificial
  CRISPR gRNA sequence
tcactccagcctgggcaaaa

SEQ ID NO: 713927 - DNA, 20 bp, Artificial
  CRISPR gRNA sequence
tccagcctgggcaaaagagc

SEQ ID NO: 713928 - DNA, 20 bp, Artificial
  CRISPR gRNA sequence
aaaacaaaacaaaacaaaaa

SEQ ID NO: 713929 - DNA, 20 bp, Artificial
  CRISPR gRNA sequence
aaacaaaacaaaaatagcac

SEQ ID NO: 713930 - DNA, 20 bp, Artificial
  CRISPR gRNA sequence
aactaataattaatgtgtaa

SEQ ID NO: 713931 - DNA, 20 bp, Artificial
  CRISPR gRNA sequence
actaataattaatgtgtaac

SEQ ID NO: 713932 - DNA, 20 bp, Artificial
  CRISPR gRNA sequence
taattaatgtgtaacaggcc

SEQ ID NO: 713933 - DNA, 20 bp, Artificial
  CRISPR gRNA sequence
attaatgtgtaacaggcctg

SEQ ID NO: 713934 - DNA, 20 bp, Artificial
  CRISPR gRNA sequence
gtgtaacaggcctggagacc

SEQ ID NO: 713935 - DNA, 20 bp, Artificial
  CRISPR gRNA sequence
taacaggcctggagaccaag

SEQ ID NO: 713936 - DNA, 20 bp, Artificial
  CRISPR gRNA sequence
aacaggcctggagaccaaga

SEQ ID NO: 713937 - DNA, 20 bp, Artificial
  CRISPR gRNA sequence
acaggcctggagaccaagaa

SEQ ID NO: 713938 - DNA, 20 bp, Artificial
  CRISPR gRNA sequence
caggcctggagaccaagaag

SEQ ID NO: 713939 - DNA, 20 bp, Artificial
  CRISPR gRNA sequence
cctggagaccaagaaggggc

SEQ ID NO: 713940 - DNA, 20 bp, Artificial
  CRISPR gRNA sequence
agaccaagaaggggcaagct

SEQ ID NO: 713941 - DNA, 20 bp, Artificial
  CRISPR gRNA sequence
ccaagaaggggcaagcttgg

SEQ ID NO: 713942 - DNA, 20 bp, Artificial
  CRISPR gRNA sequence
aaggggcaagcttggcagat

SEQ ID NO: 713943 - DNA, 20 bp, Artificial
  CRISPR gRNA sequence
agcttggcagatcagaaacg

SEQ ID NO: 713944 - DNA, 20 bp, Artificial
  CRISPR gRNA sequence
gaagacaactccccgaaata

SEQ ID NO: 713945 - DNA, 20 bp, Artificial
  CRISPR gRNA sequence
gacaactccccgaaatacgg

SEQ ID NO: 713946 - DNA, 20 bp, Artificial
  CRISPR gRNA sequence
acaactccccgaaatacgga

SEQ ID NO: 713947 - DNA, 20 bp, Artificial
  CRISPR gRNA sequence
actccccgaaatacggaagg

SEQ ID NO: 713948 - DNA, 20 bp, Artificial
  CRISPR gRNA sequence
tccccgaaatacggaaggca

SEQ ID NO: 713949 - DNA, 20 bp, Artificial
  CRISPR gRNA sequence
ccccgaaatacggaaggcag

SEQ ID NO: 713950 - DNA, 20 bp, Artificial
  CRISPR gRNA sequence
gaaatacggaaggcagagga

SEQ ID NO: 713951 - DNA, 20 bp, Artificial
  CRISPR gRNA sequence
acggaaggcagaggacagat

SEQ ID NO: 713952 - DNA, 20 bp, Artificial
  CRISPR gRNA sequence
aggcagaggacagataagat

SEQ ID NO: 713953 - DNA, 20 bp, Artificial
  CRISPR gRNA sequence
gcagaggacagataagatca

SEQ ID NO: 713954 - DNA, 20 bp, Artificial
  CRISPR gRNA sequence
ggacagataagatcagagtg

SEQ ID NO: 713955 - DNA, 20 bp, Artificial
  CRISPR gRNA sequence
gacagataagatcagagtga

SEQ ID NO: 713956 - DNA, 20 bp, Artificial
  CRISPR gRNA sequence
cagataagatcagagtgaag

SEQ ID NO: 713957 - DNA, 20 bp, Artificial
  CRISPR gRNA sequence
gatcagagtgaaggagacca

SEQ ID NO: 713958 - DNA, 20 bp, Artificial
  CRISPR gRNA sequence
gagtgaaggagaccacagcc

SEQ ID NO: 713959 - DNA, 20 bp, Artificial
  CRISPR gRNA sequence
ggagaccacagcccagaatg

SEQ ID NO: 713960 - DNA, 20 bp, Artificial
  CRISPR gRNA sequence
ccacagcccagaatgcagcc

SEQ ID NO: 713961 - DNA, 20 bp, Artificial
  CRISPR gRNA sequence
cacagcccagaatgcagcca

SEQ ID NO: 713962 - DNA, 20 bp, Artificial
  CRISPR gRNA sequence
acagcccagaatgcagccaa

SEQ ID NO: 713963 - DNA, 20 bp, Artificial
  CRISPR gRNA sequence
cagcccagaatgcagccaag

SEQ ID NO: 713964 - DNA, 20 bp, Artificial
  CRISPR gRNA sequence
agcccagaatgcagccaagg

SEQ ID NO: 713965 - DNA, 20 bp, Artificial
  CRISPR gRNA sequence
cagccaagggggactctctg

SEQ ID NO: 713966 - DNA, 20 bp, Artificial
  CRISPR gRNA sequence
ccaagggggactctctgaag

SEQ ID NO: 713967 - DNA, 20 bp, Artificial
  CRISPR gRNA sequence
caagggggactctctgaaga

SEQ ID NO: 713968 - DNA, 20 bp, Artificial
  CRISPR gRNA sequence
aagggggactctctgaagaa

SEQ ID NO: 713969 - DNA, 20 bp, Artificial
  CRISPR gRNA sequence
agggggactctctgaagaag

SEQ ID NO: 713970 - DNA, 20 bp, Artificial
  CRISPR gRNA sequence
gggggactctctgaagaagg

SEQ ID NO: 713971 - DNA, 20 bp, Artificial
  CRISPR gRNA sequence
gactctctgaagaaggggga

SEQ ID NO: 713972 - DNA, 20 bp, Artificial
  CRISPR gRNA sequence
actctctgaagaagggggaa

SEQ ID NO: 713973 - DNA, 20 bp, Artificial
  CRISPR gRNA sequence
tgaagaagggggaaaggctc

SEQ ID NO: 713974 - DNA, 20 bp, Artificial
  CRISPR gRNA sequence
gaagggggaaaggctctgga

SEQ ID NO: 713975 - DNA, 20 bp, Artificial
  CRISPR gRNA sequence
gctcctcatcactcatgcca

SEQ ID NO: 713976 - DNA, 20 bp, Artificial
  CRISPR gRNA sequence
tcctcatcactcatgccaca

SEQ ID NO: 713977 - DNA, 20 bp, Artificial
  CRISPR gRNA sequence
catcactcatgccacagagc

SEQ ID NO: 713978 - DNA, 20 bp, Artificial
  CRISPR gRNA sequence
tcactcatgccacagagcca

SEQ ID NO: 713979 - DNA, 20 bp, Artificial
  CRISPR gRNA sequence
cactcatgccacagagccag

SEQ ID NO: 713980 - DNA, 20 bp, Artificial
  CRISPR gRNA sequence
aggccacgcgtcttcccgca

SEQ ID NO: 713981 - DNA, 20 bp, Artificial
  CRISPR gRNA sequence
gccacgcgtcttcccgcaaa

SEQ ID NO: 713982 - DNA, 20 bp, Artificial
  CRISPR gRNA sequence
ttcccgcaaagagactgttg

SEQ ID NO: 713983 - DNA, 20 bp, Artificial
  CRISPR gRNA sequence
agactgttgcagccccacct

SEQ ID NO: 713984 - DNA, 20 bp, Artificial
  CRISPR gRNA sequence
cacctgagccccattgccct

SEQ ID NO: 713985 - DNA, 20 bp, Artificial
  CRISPR gRNA sequence
cctgagccccattgccctca

SEQ ID NO: 713986 - DNA, 20 bp, Artificial
  CRISPR gRNA sequence
ctgagccccattgccctcag

SEQ ID NO: 713987 - DNA, 20 bp, Artificial
  CRISPR gRNA sequence
agccccattgccctcagagg

SEQ ID NO: 713988 - DNA, 20 bp, Artificial
  CRISPR gRNA sequence
gccccattgccctcagaggt

SEQ ID NO: 713989 - DNA, 20 bp, Artificial
  CRISPR gRNA sequence
ttgccctcagaggtgggttt

SEQ ID NO: 713990 - DNA, 20 bp, Artificial
  CRISPR gRNA sequence
ccctcagaggtgggtttcag

SEQ ID NO: 713991 - DNA, 20 bp, Artificial
  CRISPR gRNA sequence
ggtttcagaagccccattcg

SEQ ID NO: 713992 - DNA, 20 bp, Artificial
  CRISPR gRNA sequence
aagccccattcgcagaccac

SEQ ID NO: 713993 - DNA, 20 bp, Artificial
  CRISPR gRNA sequence
tcgcagaccaccggcatcat

SEQ ID NO: 713994 - DNA, 20 bp, Artificial
  CRISPR gRNA sequence
atcatgagatatgatgtgca

SEQ ID NO: 713995 - DNA, 20 bp, Artificial
  CRISPR gRNA sequence
agatatgatgtgcacagaac

SEQ ID NO: 713996 - DNA, 20 bp, Artificial
  CRISPR gRNA sequence
tatgatgtgcacagaactag

SEQ ID NO: 713997 - DNA, 20 bp, Artificial
  CRISPR gRNA sequence
aactagaagtcgccaaacat

SEQ ID NO: 713998 - DNA, 20 bp, Artificial
  CRISPR gRNA sequence
ctagaagtcgccaaacatca

SEQ ID NO: 713999 - DNA, 20 bp, Artificial
  CRISPR gRNA sequence
tagaagtcgccaaacatcag

SEQ ID NO: 714000 - DNA, 20 bp, Artificial
  CRISPR gRNA sequence
gccaaacatcagaggaaaac

SEQ ID NO: 714001 - DNA, 20 bp, Artificial
  CRISPR gRNA sequence
atcagaggaaaaccagcgcc

SEQ ID NO: 714002 - DNA, 20 bp, Artificial
  CRISPR gRNA sequence
tcagaggaaaaccagcgcca

SEQ ID NO: 714003 - DNA, 20 bp, Artificial
  CRISPR gRNA sequence
gaggaaaaccagcgccaagg

SEQ ID NO: 714004 - DNA, 20 bp, Artificial
  CRISPR gRNA sequence
ggaaaaccagcgccaaggaa

SEQ ID NO: 714005 - DNA, 20 bp, Artificial
  CRISPR gRNA sequence
gaaaaccagcgccaaggaag

SEQ ID NO: 714006 - DNA, 20 bp, Artificial
  CRISPR gRNA sequence
aaaccagcgccaaggaagag

SEQ ID NO: 714007 - DNA, 20 bp, Artificial
  CRISPR gRNA sequence
gaagaggagctctgaatgca

SEQ ID NO: 714008 - DNA, 20 bp, Artificial
  CRISPR gRNA sequence
agaggagctctgaatgcaaa

SEQ ID NO: 714009 - DNA, 20 bp, Artificial
  CRISPR gRNA sequence
tgcaaagagcactaacactc

SEQ ID NO: 714010 - DNA, 20 bp, Artificial
  CRISPR gRNA sequence
gcaaagagcactaacactca

SEQ ID NO: 714011 - DNA, 20 bp, Artificial
  CRISPR gRNA sequence
aaagagcactaacactcaag

SEQ ID NO: 714012 - DNA, 20 bp, Artificial
  CRISPR gRNA sequence
aagagcactaacactcaagg

SEQ ID NO: 714013 - DNA, 20 bp, Artificial
  CRISPR gRNA sequence
agcactaacactcaaggagg

SEQ ID NO: 714014 - DNA, 20 bp, Artificial
  CRISPR gRNA sequence
taacactcaaggaggcagaa

SEQ ID NO: 714015 - DNA, 20 bp, Artificial
  CRISPR gRNA sequence
acactcaaggaggcagaaaa

SEQ ID NO: 714016 - DNA, 20 bp, Artificial
  CRISPR gRNA sequence
cactcaaggaggcagaaaag

SEQ ID NO: 714017 - DNA, 20 bp, Artificial
  CRISPR gRNA sequence
actcaaggaggcagaaaaga

SEQ ID NO: 714018 - DNA, 20 bp, Artificial
  CRISPR gRNA sequence
gaggcagaaaagagggaaaa

SEQ ID NO: 714019 - DNA, 20 bp, Artificial
  CRISPR gRNA sequence
gggaaaacagaacaaaacat

SEQ ID NO: 714020 - DNA, 20 bp, Artificial
  CRISPR gRNA sequence
aatgataccttcacgcacca

SEQ ID NO: 714021 - DNA, 20 bp, Artificial
  CRISPR gRNA sequence
tgataccttcacgcaccaca

SEQ ID NO: 714022 - DNA, 20 bp, Artificial
  CRISPR gRNA sequence
cgcaccacagagcaacattt

SEQ ID NO: 714023 - DNA, 20 bp, Artificial
  CRISPR gRNA sequence
agcaacatttcagtcaacaa

SEQ ID NO: 714024 - DNA, 20 bp, Artificial
  CRISPR gRNA sequence
acatttcagtcaacaatgga

SEQ ID NO: 714025 - DNA, 20 bp, Artificial
  CRISPR gRNA sequence
atggatggcgtacatgatga

SEQ ID NO: 714026 - DNA, 20 bp, Artificial
  CRISPR gRNA sequence
gtacatgatgatggtcccac

SEQ ID NO: 714027 - DNA, 20 bp, Artificial
  CRISPR gRNA sequence
atggtcccacaagatcataa

SEQ ID NO: 714028 - DNA, 20 bp, Artificial
  CRISPR gRNA sequence
gtcccacaagatcataatgg

SEQ ID NO: 714029 - DNA, 20 bp, Artificial
  CRISPR gRNA sequence
cacaagatcataatggaagc

SEQ ID NO: 714030 - DNA, 20 bp, Artificial
  CRISPR gRNA sequence
acaagatcataatggaagcc

SEQ ID NO: 714031 - DNA, 20 bp, Artificial
  CRISPR gRNA sequence
atcataatggaagccgggcg

SEQ ID NO: 714032 - DNA, 20 bp, Artificial
  CRISPR gRNA sequence
ataatggaagccgggcgcgg

SEQ ID NO: 714033 - DNA, 20 bp, Artificial
  CRISPR gRNA sequence
gtggctcacgcctgtaatcc

SEQ ID NO: 714034 - DNA, 20 bp, Artificial
  CRISPR gRNA sequence
cgcctgtaatcccagcactt

SEQ ID NO: 714035 - DNA, 20 bp, Artificial
  CRISPR gRNA sequence
gcctgtaatcccagcacttt

SEQ ID NO: 714036 - DNA, 20 bp, Artificial
  CRISPR gRNA sequence
ctgtaatcccagcactttgg

SEQ ID NO: 714037 - DNA, 20 bp, Artificial
  CRISPR gRNA sequence
tgtaatcccagcactttggg

SEQ ID NO: 714038 - DNA, 20 bp, Artificial
  CRISPR gRNA sequence
tcccagcactttgggaggcc

SEQ ID NO: 714039 - DNA, 20 bp, Artificial
  CRISPR gRNA sequence
cccagcactttgggaggccg

SEQ ID NO: 714040 - DNA, 20 bp, Artificial
  CRISPR gRNA sequence
cagcactttgggaggccgag

SEQ ID NO: 714041 - DNA, 20 bp, Artificial
  CRISPR gRNA sequence
agcactttgggaggccgagg

SEQ ID NO: 714042 - DNA, 20 bp, Artificial
  CRISPR gRNA sequence
gcactttgggaggccgagga

SEQ ID NO: 714043 - DNA, 20 bp, Artificial
  CRISPR gRNA sequence
ctttgggaggccgaggaggg

SEQ ID NO: 714044 - DNA, 20 bp, Artificial
  CRISPR gRNA sequence
ccgaggagggcggataacct

SEQ ID NO: 714045 - DNA, 20 bp, Artificial
  CRISPR gRNA sequence
cgaggagggcggataacctg

SEQ ID NO: 714046 - DNA, 20 bp, Artificial
  CRISPR gRNA sequence
gagggcggataacctgaggt

SEQ ID NO: 714047 - DNA, 20 bp, Artificial
  CRISPR gRNA sequence
agggcggataacctgaggtc

SEQ ID NO: 714048 - DNA, 20 bp, Artificial
  CRISPR gRNA sequence
ggcggataacctgaggtcag

SEQ ID NO: 714049 - DNA, 20 bp, Artificial
  CRISPR gRNA sequence
tgaggtcaggagttcaaaac

SEQ ID NO: 714050 - DNA, 20 bp, Artificial
  CRISPR gRNA sequence
tcaggagttcaaaaccagcc

SEQ ID NO: 714051 - DNA, 20 bp, Artificial
  CRISPR gRNA sequence
caaaaccagcctggccaaca

SEQ ID NO: 714052 - DNA, 20 bp, Artificial
  CRISPR gRNA sequence
cctaaaaaaaatacaaaaat

SEQ ID NO: 714053 - DNA, 20 bp, Artificial
  CRISPR gRNA sequence
aaaaaaatacaaaaattagc

SEQ ID NO: 714054 - DNA, 20 bp, Artificial
  CRISPR gRNA sequence
aaaaaatacaaaaattagcc

SEQ ID NO: 714055 - DNA, 20 bp, Artificial
  CRISPR gRNA sequence
atacaaaaattagccaggca

SEQ ID NO: 714056 - DNA, 20 bp, Artificial
  CRISPR gRNA sequence
caaaaattagccaggcatgg

SEQ ID NO: 714057 - DNA, 20 bp, Artificial
  CRISPR gRNA sequence
gtggcgcatgcctgtaatcc

SEQ ID NO: 714058 - DNA, 20 bp, Artificial
  CRISPR gRNA sequence
gcctgtaatcccagctactt

SEQ ID NO: 714059 - DNA, 20 bp, Artificial
  CRISPR gRNA sequence
ctgtaatcccagctacttga

SEQ ID NO: 714060 - DNA, 20 bp, Artificial
  CRISPR gRNA sequence
tgtaatcccagctacttgag

SEQ ID NO: 714061 - DNA, 20 bp, Artificial
  CRISPR gRNA sequence
tcccagctacttgagaggct

SEQ ID NO: 714062 - DNA, 20 bp, Artificial
  CRISPR gRNA sequence
agctacttgagaggctaaga

SEQ ID NO: 714063 - DNA, 20 bp, Artificial
  CRISPR gRNA sequence
gctacttgagaggctaagac

SEQ ID NO: 714064 - DNA, 20 bp, Artificial
  CRISPR gRNA sequence
tacttgagaggctaagacag

SEQ ID NO: 714065 - DNA, 20 bp, Artificial
  CRISPR gRNA sequence
acaggagaatcgcttgaacc

SEQ ID NO: 714066 - DNA, 20 bp, Artificial
  CRISPR gRNA sequence
caggagaatcgcttgaaccc

SEQ ID NO: 714067 - DNA, 20 bp, Artificial
  CRISPR gRNA sequence
aatcgcttgaacccaggttg

SEQ ID NO: 714068 - DNA, 20 bp, Artificial
  CRISPR gRNA sequence
gcttgaacccaggttgcagt

SEQ ID NO: 714069 - DNA, 20 bp, Artificial
  CRISPR gRNA sequence
aacccaggttgcagtgagcc

SEQ ID NO: 714070 - DNA, 20 bp, Artificial
  CRISPR gRNA sequence
gagattgcgccattgcactc

SEQ ID NO: 714071 - DNA, 20 bp, Artificial
  CRISPR gRNA sequence
tgcgccattgcactccagcc

SEQ ID NO: 714072 - DNA, 20 bp, Artificial
  CRISPR gRNA sequence
gcgccattgcactccagcct

SEQ ID NO: 714073 - DNA, 20 bp, Artificial
  CRISPR gRNA sequence
ttgcactccagcctgggcaa

SEQ ID NO: 714074 - DNA, 20 bp, Artificial
  CRISPR gRNA sequence
gcactccagcctgggcaaca

SEQ ID NO: 714075 - DNA, 20 bp, Artificial
  CRISPR gRNA sequence
ctccagcctgggcaacagag

SEQ ID NO: 714076 - DNA, 20 bp, Artificial
  CRISPR gRNA sequence
tccagcctgggcaacagagc

SEQ ID NO: 714077 - DNA, 20 bp, Artificial
  CRISPR gRNA sequence
tcaaacaaaaaaaacaataa

SEQ ID NO: 714078 - DNA, 20 bp, Artificial
  CRISPR gRNA sequence
aaacaaaaaaaacaataaaa

SEQ ID NO: 714079 - DNA, 20 bp, Artificial
  CRISPR gRNA sequence
aacaataaaagagattataa

SEQ ID NO: 714080 - DNA, 20 bp, Artificial
  CRISPR gRNA sequence
caataaaagagattataatg

SEQ ID NO: 714081 - DNA, 20 bp, Artificial
  CRISPR gRNA sequence
gctgaaaaattcctattgcc

SEQ ID NO: 714082 - DNA, 20 bp, Artificial
  CRISPR gRNA sequence
cctattgcctagtgatgtca

SEQ ID NO: 714083 - DNA, 20 bp, Artificial
  CRISPR gRNA sequence
gcctagtgatgtcatagcca

SEQ ID NO: 714084 - DNA, 20 bp, Artificial
  CRISPR gRNA sequence
tcatagccacggcaatgtcg

SEQ ID NO: 714085 - DNA, 20 bp, Artificial
  CRISPR gRNA sequence
gtgcgttactcccatgtttg

SEQ ID NO: 714086 - DNA, 20 bp, Artificial
  CRISPR gRNA sequence
gcgttactcccatgtttgtg

SEQ ID NO: 714087 - DNA, 20 bp, Artificial
  CRISPR gRNA sequence
tcccatgtttgtggagatgt

SEQ ID NO: 714088 - DNA, 20 bp, Artificial
  CRISPR gRNA sequence
aaacaaacctactgccctgc

SEQ ID NO: 714089 - DNA, 20 bp, Artificial
  CRISPR gRNA sequence
ctgccctgccagttgtataa

SEQ ID NO: 714090 - DNA, 20 bp, Artificial
  CRISPR gRNA sequence
agttgtataaaagtgctgca

SEQ ID NO: 714091 - DNA, 20 bp, Artificial
  CRISPR gRNA sequence
ctgcatagcacatgcaatta

SEQ ID NO: 714092 - DNA, 20 bp, Artificial
  CRISPR gRNA sequence
atagcacatgcaattatgga

SEQ ID NO: 714093 - DNA, 20 bp, Artificial
  CRISPR gRNA sequence
gtaatacttgataatgatca

SEQ ID NO: 714094 - DNA, 20 bp, Artificial
  CRISPR gRNA sequence
tacttgataatgatcataga

SEQ ID NO: 714095 - DNA, 20 bp, Artificial
  CRISPR gRNA sequence
atcatagaaagctatattgc

SEQ ID NO: 714096 - DNA, 20 bp, Artificial
  CRISPR gRNA sequence
atcattttttttttttgaaa

SEQ ID NO: 714097 - DNA, 20 bp, Artificial
  CRISPR gRNA sequence
tcattttttttttttgaaac

SEQ ID NO: 714098 - DNA, 20 bp, Artificial
  CRISPR gRNA sequence
cattttttttttttgaaaca

SEQ ID NO: 714099 - DNA, 20 bp, Artificial
  CRISPR gRNA sequence
cagggtcttgctctgttgcc

SEQ ID NO: 714100 - DNA, 20 bp, Artificial
  CRISPR gRNA sequence
agggtcttgctctgttgccc

SEQ ID NO: 714101 - DNA, 20 bp, Artificial
  CRISPR gRNA sequence
tcttgctctgttgcccaggc

SEQ ID NO: 714102 - DNA, 20 bp, Artificial
  CRISPR gRNA sequence
ttgctctgttgcccaggctg

SEQ ID NO: 714103 - DNA, 20 bp, Artificial
  CRISPR gRNA sequence
ctgttgcccaggctggagtg

SEQ ID NO: 714104 - DNA, 20 bp, Artificial
  CRISPR gRNA sequence
ttgcccaggctggagtgcag

SEQ ID NO: 714105 - DNA, 20 bp, Artificial
  CRISPR gRNA sequence
ggagtgcagtggcatgatca

SEQ ID NO: 714106 - DNA, 20 bp, Artificial
  CRISPR gRNA sequence
tcactgtaacctcaacttcc

SEQ ID NO: 714107 - DNA, 20 bp, Artificial
  CRISPR gRNA sequence
cactgtaacctcaacttcct

SEQ ID NO: 714108 - DNA, 20 bp, Artificial
  CRISPR gRNA sequence
aacctcaacttcctgggctc

SEQ ID NO: 714109 - DNA, 20 bp, Artificial
  CRISPR gRNA sequence
ctcaagccatcctcccacct

SEQ ID NO: 714110 - DNA, 20 bp, Artificial
  CRISPR gRNA sequence
tcctcccacctcagcctcct

SEQ ID NO: 714111 - DNA, 20 bp, Artificial
  CRISPR gRNA sequence
tcccacctcagcctcctgag

SEQ ID NO: 714112 - DNA, 20 bp, Artificial
  CRISPR gRNA sequence
acctcagcctcctgagtagc

SEQ ID NO: 714113 - DNA, 20 bp, Artificial
  CRISPR gRNA sequence
cctcagcctcctgagtagct

SEQ ID NO: 714114 - DNA, 20 bp, Artificial
  CRISPR gRNA sequence
ctcctgagtagctgggacta

SEQ ID NO: 714115 - DNA, 20 bp, Artificial
  CRISPR gRNA sequence
tcctgagtagctgggactac

SEQ ID NO: 714116 - DNA, 20 bp, Artificial
  CRISPR gRNA sequence
caggcgcatgccaccacacc

SEQ ID NO: 714117 - DNA, 20 bp, Artificial
  CRISPR gRNA sequence
ctaatgtattttatcttgtg

SEQ ID NO: 714118 - DNA, 20 bp, Artificial
  CRISPR gRNA sequence
aatgtattttatcttgtgta

SEQ ID NO: 714119 - DNA, 20 bp, Artificial
  CRISPR gRNA sequence
tattttatcttgtgtagaga

SEQ ID NO: 714120 - DNA, 20 bp, Artificial
  CRISPR gRNA sequence
attttatcttgtgtagagat

SEQ ID NO: 714121 - DNA, 20 bp, Artificial
  CRISPR gRNA sequence
ttttatcttgtgtagagatg

SEQ ID NO: 714122 - DNA, 20 bp, Artificial
  CRISPR gRNA sequence
ggggatctcactgtgttgcc

SEQ ID NO: 714123 - DNA, 20 bp, Artificial
  CRISPR gRNA sequence
gggatctcactgtgttgccc

SEQ ID NO: 714124 - DNA, 20 bp, Artificial
  CRISPR gRNA sequence
tctcactgtgttgcccaggc

SEQ ID NO: 714125 - DNA, 20 bp, Artificial
  CRISPR gRNA sequence
ccaggctggtctcaaactcc

SEQ ID NO: 714126 - DNA, 20 bp, Artificial
  CRISPR gRNA sequence
ggtctcaaactcctggcctc

SEQ ID NO: 714127 - DNA, 20 bp, Artificial
  CRISPR gRNA sequence
ctggcctcaagtgattctcc

SEQ ID NO: 714128 - DNA, 20 bp, Artificial
  CRISPR gRNA sequence
ctcaagtgattctcccagcc

SEQ ID NO: 714129 - DNA, 20 bp, Artificial
  CRISPR gRNA sequence
tctcccagcctggcctccct

SEQ ID NO: 714130 - DNA, 20 bp, Artificial
  CRISPR gRNA sequence
gcctggcctccctaagtgct

SEQ ID NO: 714131 - DNA, 20 bp, Artificial
  CRISPR gRNA sequence
ctccctaagtgctgagactg

SEQ ID NO: 714132 - DNA, 20 bp, Artificial
  CRISPR gRNA sequence
tccctaagtgctgagactgc

SEQ ID NO: 714133 - DNA, 20 bp, Artificial
  CRISPR gRNA sequence
agtgctgagactgcaggcat

SEQ ID NO: 714134 - DNA, 20 bp, Artificial
  CRISPR gRNA sequence
gactgcaggcatcagccacc

SEQ ID NO: 714135 - DNA, 20 bp, Artificial
  CRISPR gRNA sequence
gcaggcatcagccaccaagc

SEQ ID NO: 714136 - DNA, 20 bp, Artificial
  CRISPR gRNA sequence
agccggccttatcattattt

SEQ ID NO: 714137 - DNA, 20 bp, Artificial
  CRISPR gRNA sequence
ccggccttatcattatttta

SEQ ID NO: 714138 - DNA, 20 bp, Artificial
  CRISPR gRNA sequence
actcctacttattaaaacaa

SEQ ID NO: 714139 - DNA, 20 bp, Artificial
  CRISPR gRNA sequence
aacaaaagttaactgtaata

SEQ ID NO: 714140 - DNA, 20 bp, Artificial
  CRISPR gRNA sequence
agttaactgtaatacagcct

SEQ ID NO: 714141 - DNA, 20 bp, Artificial
  CRISPR gRNA sequence
gttaactgtaatacagcctc

SEQ ID NO: 714142 - DNA, 20 bp, Artificial
  CRISPR gRNA sequence
aactgtaatacagcctcagg

SEQ ID NO: 714143 - DNA, 20 bp, Artificial
  CRISPR gRNA sequence
actgtaatacagcctcaggt

SEQ ID NO: 714144 - DNA, 20 bp, Artificial
  CRISPR gRNA sequence
gcctcaggtaggtccttctg

SEQ ID NO: 714145 - DNA, 20 bp, Artificial
  CRISPR gRNA sequence
cctcaggtaggtccttctgc

SEQ ID NO: 714146 - DNA, 20 bp, Artificial
  CRISPR gRNA sequence
taggtccttctgcaggtatc

SEQ ID NO: 714147 - DNA, 20 bp, Artificial
  CRISPR gRNA sequence
gtccttctgcaggtatccag

SEQ ID NO: 714148 - DNA, 20 bp, Artificial
  CRISPR gRNA sequence
cttctgcaggtatccagaag

SEQ ID NO: 714149 - DNA, 20 bp, Artificial
  CRISPR gRNA sequence
ttctgcaggtatccagaaga

SEQ ID NO: 714150 - DNA, 20 bp, Artificial
  CRISPR gRNA sequence
agaagaaggcattgttatca

SEQ ID NO: 714151 - DNA, 20 bp, Artificial
  CRISPR gRNA sequence
gaagaaggcattgttatcat

SEQ ID NO: 714152 - DNA, 20 bp, Artificial
  CRISPR gRNA sequence
agaaggcattgttatcatag

SEQ ID NO: 714153 - DNA, 20 bp, Artificial
  CRISPR gRNA sequence
atgttaccttaccgctcctg

SEQ ID NO: 714154 - DNA, 20 bp, Artificial
  CRISPR gRNA sequence
cgctcctgaagaccttccaa

SEQ ID NO: 714155 - DNA, 20 bp, Artificial
  CRISPR gRNA sequence
gctcctgaagaccttccaat

SEQ ID NO: 714156 - DNA, 20 bp, Artificial
  CRISPR gRNA sequence
ctgaagaccttccaatggga

SEQ ID NO: 714157 - DNA, 20 bp, Artificial
  CRISPR gRNA sequence
tgaagaccttccaatgggac

SEQ ID NO: 714158 - DNA, 20 bp, Artificial
  CRISPR gRNA sequence
attctttttttttttttttt

SEQ ID NO: 714159 - DNA, 20 bp, Artificial
  CRISPR gRNA sequence
ttttttttttttttttgaga

SEQ ID NO: 714160 - DNA, 20 bp, Artificial
  CRISPR gRNA sequence
ttttttttttttttgagaca

SEQ ID NO: 714161 - DNA, 20 bp, Artificial
  CRISPR gRNA sequence
cagagtctcattctgtcacc

SEQ ID NO: 714162 - DNA, 20 bp, Artificial
  CRISPR gRNA sequence
agagtctcattctgtcaccc

SEQ ID NO: 714163 - DNA, 20 bp, Artificial
  CRISPR gRNA sequence
tctcattctgtcacccaggc

SEQ ID NO: 714164 - DNA, 20 bp, Artificial
  CRISPR gRNA sequence
tcattctgtcacccaggctg

SEQ ID NO: 714165 - DNA, 20 bp, Artificial
  CRISPR gRNA sequence
ctgtcacccaggctggagtg

SEQ ID NO: 714166 - DNA, 20 bp, Artificial
  CRISPR gRNA sequence
tcacccaggctggagtgcag

SEQ ID NO: 714167 - DNA, 20 bp, Artificial
  CRISPR gRNA sequence
ggagtgcagtagcacaatct

SEQ ID NO: 714168 - DNA, 20 bp, Artificial
  CRISPR gRNA sequence
tcactgcaacctccgcctcc

SEQ ID NO: 714169 - DNA, 20 bp, Artificial
  CRISPR gRNA sequence
cactgcaacctccgcctccc

SEQ ID NO: 714170 - DNA, 20 bp, Artificial
  CRISPR gRNA sequence
aacctccgcctcccgggttc

SEQ ID NO: 714171 - DNA, 20 bp, Artificial
  CRISPR gRNA sequence
ttcaagcaattctcctgcct

SEQ ID NO: 714172 - DNA, 20 bp, Artificial
  CRISPR gRNA sequence
ttctcctgcctcagccacct

SEQ ID NO: 714173 - DNA, 20 bp, Artificial
  CRISPR gRNA sequence
tcctgcctcagccacctgag

SEQ ID NO: 714174 - DNA, 20 bp, Artificial
  CRISPR gRNA sequence
gcctcagccacctgagtagc

SEQ ID NO: 714175 - DNA, 20 bp, Artificial
  CRISPR gRNA sequence
cctcagccacctgagtagct

SEQ ID NO: 714176 - DNA, 20 bp, Artificial
  CRISPR gRNA sequence
cacctgagtagctgggatta

SEQ ID NO: 714177 - DNA, 20 bp, Artificial
  CRISPR gRNA sequence
acctgagtagctgggattac

SEQ ID NO: 714178 - DNA, 20 bp, Artificial
  CRISPR gRNA sequence
caggcgcatgccaacgtgcc

SEQ ID NO: 714179 - DNA, 20 bp, Artificial
  CRISPR gRNA sequence
ccggctaatttttatatttt

SEQ ID NO: 714180 - DNA, 20 bp, Artificial
  CRISPR gRNA sequence
gctaatttttatatttttag

SEQ ID NO: 714181 - DNA, 20 bp, Artificial
  CRISPR gRNA sequence
taatttttatatttttagta

SEQ ID NO: 714182 - DNA, 20 bp, Artificial
  CRISPR gRNA sequence
ttttatatttttagtagaga

SEQ ID NO: 714183 - DNA, 20 bp, Artificial
  CRISPR gRNA sequence
tttatatttttagtagagat

SEQ ID NO: 714184 - DNA, 20 bp, Artificial
  CRISPR gRNA sequence
ttatatttttagtagagatg

SEQ ID NO: 714185 - DNA, 20 bp, Artificial
  CRISPR gRNA sequence
gagatggggtttcaccatgt

SEQ ID NO: 714186 - DNA, 20 bp, Artificial
  CRISPR gRNA sequence
ggggtttcaccatgttggcc

SEQ ID NO: 714187 - DNA, 20 bp, Artificial
  CRISPR gRNA sequence
tttcaccatgttggccaagc

SEQ ID NO: 714188 - DNA, 20 bp, Artificial
  CRISPR gRNA sequence
ggtcttgaactcttgacctc

SEQ ID NO: 714189 - DNA, 20 bp, Artificial
  CRISPR gRNA sequence
ctcaagtgatctgcccacct

SEQ ID NO: 714190 - DNA, 20 bp, Artificial
  CRISPR gRNA sequence
ctgcccacctcggcttccca

SEQ ID NO: 714191 - DNA, 20 bp, Artificial
  CRISPR gRNA sequence
acctcggcttcccaaagtgc

SEQ ID NO: 714192 - DNA, 20 bp, Artificial
  CRISPR gRNA sequence
cctcggcttcccaaagtgct

SEQ ID NO: 714193 - DNA, 20 bp, Artificial
  CRISPR gRNA sequence
ttcccaaagtgctgggatta

SEQ ID NO: 714194 - DNA, 20 bp, Artificial
  CRISPR gRNA sequence
tcccaaagtgctgggattac

SEQ ID NO: 714195 - DNA, 20 bp, Artificial
  CRISPR gRNA sequence
agtgctgggattacaggtgt

SEQ ID NO: 714196 - DNA, 20 bp, Artificial
  CRISPR gRNA sequence
gagtcactgcacgctgccaa

SEQ ID NO: 714197 - DNA, 20 bp, Artificial
  CRISPR gRNA sequence
agtcactgcacgctgccaat

SEQ ID NO: 714198 - DNA, 20 bp, Artificial
  CRISPR gRNA sequence
ctgcacgctgccaatgggac

SEQ ID NO: 714199 - DNA, 20 bp, Artificial
  CRISPR gRNA sequence
gctgccaatgggacaagatt

SEQ ID NO: 714200 - DNA, 20 bp, Artificial
  CRISPR gRNA sequence
tgccaatgggacaagatttg

SEQ ID NO: 714201 - DNA, 20 bp, Artificial
  CRISPR gRNA sequence
gccaatgggacaagatttgg

SEQ ID NO: 714202 - DNA, 20 bp, Artificial
  CRISPR gRNA sequence
caatgggacaagatttggag

SEQ ID NO: 714203 - DNA, 20 bp, Artificial
  CRISPR gRNA sequence
aatgggacaagatttggagg

SEQ ID NO: 714204 - DNA, 20 bp, Artificial
  CRISPR gRNA sequence
gggacaagatttggaggagg

SEQ ID NO: 714205 - DNA, 20 bp, Artificial
  CRISPR gRNA sequence
caagatttggaggaggaaga

SEQ ID NO: 714206 - DNA, 20 bp, Artificial
  CRISPR gRNA sequence
ctgatgatcctgactctgtg

SEQ ID NO: 714207 - DNA, 20 bp, Artificial
  CRISPR gRNA sequence
tgatgatcctgactctgtgt

SEQ ID NO: 714208 - DNA, 20 bp, Artificial
  CRISPR gRNA sequence
tcctgactctgtgtaggcct

SEQ ID NO: 714209 - DNA, 20 bp, Artificial
  CRISPR gRNA sequence
tgtgtaggcctcggataatg

SEQ ID NO: 714210 - DNA, 20 bp, Artificial
  CRISPR gRNA sequence
gtgtaggcctcggataatgt

SEQ ID NO: 714211 - DNA, 20 bp, Artificial
  CRISPR gRNA sequence
taatgtaggtgtttgcgtct

SEQ ID NO: 714212 - DNA, 20 bp, Artificial
  CRISPR gRNA sequence
aataaaataataaaatttta

SEQ ID NO: 714213 - DNA, 20 bp, Artificial
  CRISPR gRNA sequence
aaaataataaaattttaaag

SEQ ID NO: 714214 - DNA, 20 bp, Artificial
  CRISPR gRNA sequence
taaaattttaaagtagaaaa

SEQ ID NO: 714215 - DNA, 20 bp, Artificial
  CRISPR gRNA sequence
tagaaaaaagtgtaatgaat

SEQ ID NO: 714216 - DNA, 20 bp, Artificial
  CRISPR gRNA sequence
agaaaaaagtgtaatgaata

SEQ ID NO: 714217 - DNA, 20 bp, Artificial
  CRISPR gRNA sequence
gtgtaatgaataaggctata

SEQ ID NO: 714218 - DNA, 20 bp, Artificial
  CRISPR gRNA sequence
ataaagaaaatatttttgta

SEQ ID NO: 714219 - DNA, 20 bp, Artificial
  CRISPR gRNA sequence
gtacgatgtgtttgtgcttt

SEQ ID NO: 714220 - DNA, 20 bp, Artificial
  CRISPR gRNA sequence
atgtgtttgtgctttaagct

SEQ ID NO: 714221 - DNA, 20 bp, Artificial
  CRISPR gRNA sequence
taagctaagtgttattacaa

SEQ ID NO: 714222 - DNA, 20 bp, Artificial
  CRISPR gRNA sequence
agctaagtgttattacaaaa

SEQ ID NO: 714223 - DNA, 20 bp, Artificial
  CRISPR gRNA sequence
tgttattacaaaagagccaa

SEQ ID NO: 714224 - DNA, 20 bp, Artificial
  CRISPR gRNA sequence
aaaagagccaaaagtttaaa

SEQ ID NO: 714225 - DNA, 20 bp, Artificial
  CRISPR gRNA sequence
gccaaaagtttaaaaagtta

SEQ ID NO: 714226 - DNA, 20 bp, Artificial
  CRISPR gRNA sequence
ttaaaaagttaaagtttata

SEQ ID NO: 714227 - DNA, 20 bp, Artificial
  CRISPR gRNA sequence
ttaaagtttataaagtgaaa

SEQ ID NO: 714228 - DNA, 20 bp, Artificial
  CRISPR gRNA sequence
agttgtttaatttattattg

SEQ ID NO: 714229 - DNA, 20 bp, Artificial
  CRISPR gRNA sequence
gtttaatttattattgaaga

SEQ ID NO: 714230 - DNA, 20 bp, Artificial
  CRISPR gRNA sequence
aaaaatgtgtcttataaatt

SEQ ID NO: 714231 - DNA, 20 bp, Artificial
  CRISPR gRNA sequence
tgtgtcttataaatttagta

SEQ ID NO: 714232 - DNA, 20 bp, Artificial
  CRISPR gRNA sequence
ttataaatttagtatagcct

SEQ ID NO: 714233 - DNA, 20 bp, Artificial
  CRISPR gRNA sequence
tttagtatagcctaagtgta

SEQ ID NO: 714234 - DNA, 20 bp, Artificial
  CRISPR gRNA sequence
ctaagtgtacagtgttgata

SEQ ID NO: 714235 - DNA, 20 bp, Artificial
  CRISPR gRNA sequence
tacagtgttgataaagtcca

SEQ ID NO: 714236 - DNA, 20 bp, Artificial
  CRISPR gRNA sequence
agtgttgataaagtccacag

SEQ ID NO: 714237 - DNA, 20 bp, Artificial
  CRISPR gRNA sequence
ataaagtccacagtagtgca

SEQ ID NO: 714238 - DNA, 20 bp, Artificial
  CRISPR gRNA sequence
agtagtgcatagtaatgccc

SEQ ID NO: 714239 - DNA, 20 bp, Artificial
  CRISPR gRNA sequence
gtagtgcatagtaatgcccc

SEQ ID NO: 714240 - DNA, 20 bp, Artificial
  CRISPR gRNA sequence
cacttactcattgactcacc

SEQ ID NO: 714241 - DNA, 20 bp, Artificial
  CRISPR gRNA sequence
agaacaacttcgtgtcctgc

SEQ ID NO: 714242 - DNA, 20 bp, Artificial
  CRISPR gRNA sequence
tgtcctgcaagctccattca

SEQ ID NO: 714243 - DNA, 20 bp, Artificial
  CRISPR gRNA sequence
ctgcaagctccattcacggt

SEQ ID NO: 714244 - DNA, 20 bp, Artificial
  CRISPR gRNA sequence
tcacggtaagtgccctgtac

SEQ ID NO: 714245 - DNA, 20 bp, Artificial
  CRISPR gRNA sequence
ttcatatcatattttttttt

SEQ ID NO: 714246 - DNA, 20 bp, Artificial
  CRISPR gRNA sequence
tatcatattttttttttaga

SEQ ID NO: 714247 - DNA, 20 bp, Artificial
  CRISPR gRNA sequence
tggtgtctcactctatcacc

SEQ ID NO: 714248 - DNA, 20 bp, Artificial
  CRISPR gRNA sequence
ggtgtctcactctatcaccc

SEQ ID NO: 714249 - DNA, 20 bp, Artificial
  CRISPR gRNA sequence
tctcactctatcacccaggc

SEQ ID NO: 714250 - DNA, 20 bp, Artificial
  CRISPR gRNA sequence
tcactctatcacccaggctg

SEQ ID NO: 714251 - DNA, 20 bp, Artificial
  CRISPR gRNA sequence
ctatcacccaggctggagtg

SEQ ID NO: 714252 - DNA, 20 bp, Artificial
  CRISPR gRNA sequence
tcacccaggctggagtgcag

SEQ ID NO: 714253 - DNA, 20 bp, Artificial
  CRISPR gRNA sequence
ggagtgcagtggcatgatct

SEQ ID NO: 714254 - DNA, 20 bp, Artificial
  CRISPR gRNA sequence
gcactgcaacctccgcctcc

SEQ ID NO: 714255 - DNA, 20 bp, Artificial
  CRISPR gRNA sequence
cactgcaacctccgcctccc

SEQ ID NO: 714256 - DNA, 20 bp, Artificial
  CRISPR gRNA sequence
aacctccgcctcccaggttc

SEQ ID NO: 714257 - DNA, 20 bp, Artificial
  CRISPR gRNA sequence
ttcaagcaattcttctgctt

SEQ ID NO: 714258 - DNA, 20 bp, Artificial
  CRISPR gRNA sequence
ttcttctgcttcagcctctt

SEQ ID NO: 714259 - DNA, 20 bp, Artificial
  CRISPR gRNA sequence
ttctgcttcagcctcttgag

SEQ ID NO: 714260 - DNA, 20 bp, Artificial
  CRISPR gRNA sequence
gcttcagcctcttgagtagc

SEQ ID NO: 714261 - DNA, 20 bp, Artificial
  CRISPR gRNA sequence
cttcagcctcttgagtagct

SEQ ID NO: 714262 - DNA, 20 bp, Artificial
  CRISPR gRNA sequence
ctcttgagtagctgggacta

SEQ ID NO: 714263 - DNA, 20 bp, Artificial
  CRISPR gRNA sequence
cagacacgtgccaccacgcc

SEQ ID NO: 714264 - DNA, 20 bp, Artificial
  CRISPR gRNA sequence
ccagctaatttttgtatttt

SEQ ID NO: 714265 - DNA, 20 bp, Artificial
  CRISPR gRNA sequence
gctaatttttgtatttttag

SEQ ID NO: 714266 - DNA, 20 bp, Artificial
  CRISPR gRNA sequence
taatttttgtatttttagta

SEQ ID NO: 714267 - DNA, 20 bp, Artificial
  CRISPR gRNA sequence
ttttgtatttttagtagaga

SEQ ID NO: 714268 - DNA, 20 bp, Artificial
  CRISPR gRNA sequence
tttgtatttttagtagagat

SEQ ID NO: 714269 - DNA, 20 bp, Artificial
  CRISPR gRNA sequence
ttgtatttttagtagagatg

SEQ ID NO: 714270 - DNA, 20 bp, Artificial
  CRISPR gRNA sequence
gagatggggtttcgccatgt

SEQ ID NO: 714271 - DNA, 20 bp, Artificial
  CRISPR gRNA sequence
tggggtttcgccatgttagc

SEQ ID NO: 714272 - DNA, 20 bp, Artificial
  CRISPR gRNA sequence
ggggtttcgccatgttagcc

SEQ ID NO: 714273 - DNA, 20 bp, Artificial
  CRISPR gRNA sequence
tttcgccatgttagccaggc

SEQ ID NO: 714274 - DNA, 20 bp, Artificial
  CRISPR gRNA sequence
tggtctcgaactcctgacct

SEQ ID NO: 714275 - DNA, 20 bp, Artificial
  CRISPR gRNA sequence
ggtctcgaactcctgacctc

SEQ ID NO: 714276 - DNA, 20 bp, Artificial
  CRISPR gRNA sequence
ctcaggtaatccaccctcct

SEQ ID NO: 714277 - DNA, 20 bp, Artificial
  CRISPR gRNA sequence
ccaccctcctcggcctccca

SEQ ID NO: 714278 - DNA, 20 bp, Artificial
  CRISPR gRNA sequence
tcctcggcctcccaaagtgc

SEQ ID NO: 714279 - DNA, 20 bp, Artificial
  CRISPR gRNA sequence
ctcccaaagtgctggcatta

SEQ ID NO: 714280 - DNA, 20 bp, Artificial
  CRISPR gRNA sequence
tcccaaagtgctggcattac

SEQ ID NO: 714281 - DNA, 20 bp, Artificial
  CRISPR gRNA sequence
agtgctggcattacaggtgt

SEQ ID NO: 714282 - DNA, 20 bp, Artificial
  CRISPR gRNA sequence
caggtgtgagtcactgtgcc

SEQ ID NO: 714283 - DNA, 20 bp, Artificial
  CRISPR gRNA sequence
tattgcaccttttctatgtt

SEQ ID NO: 714284 - DNA, 20 bp, Artificial
  CRISPR gRNA sequence
caaatactcacattgtgtca

SEQ ID NO: 714285 - DNA, 20 bp, Artificial
  CRISPR gRNA sequence
cattgtgtcacagctgccta

SEQ ID NO: 714286 - DNA, 20 bp, Artificial
  CRISPR gRNA sequence
tcacagctgcctacagtatt

SEQ ID NO: 714287 - DNA, 20 bp, Artificial
  CRISPR gRNA sequence
cacagctgcctacagtattc

SEQ ID NO: 714288 - DNA, 20 bp, Artificial
  CRISPR gRNA sequence
gctgcctacagtattcagga

SEQ ID NO: 714289 - DNA, 20 bp, Artificial
  CRISPR gRNA sequence
caggacagtcacatgctgtg

SEQ ID NO: 714290 - DNA, 20 bp, Artificial
  CRISPR gRNA sequence
ggacagtcacatgctgtgca

SEQ ID NO: 714291 - DNA, 20 bp, Artificial
  CRISPR gRNA sequence
tcacatgctgtgcagagttg

SEQ ID NO: 714292 - DNA, 20 bp, Artificial
  CRISPR gRNA sequence
tgctgtgcagagttgtagct

SEQ ID NO: 714293 - DNA, 20 bp, Artificial
  CRISPR gRNA sequence
gctgtgcagagttgtagctt

SEQ ID NO: 714294 - DNA, 20 bp, Artificial
  CRISPR gRNA sequence
tgtgcagagttgtagcttag

SEQ ID NO: 714295 - DNA, 20 bp, Artificial
  CRISPR gRNA sequence
gagttgtagcttaggagcaa

SEQ ID NO: 714296 - DNA, 20 bp, Artificial
  CRISPR gRNA sequence
agttgtagcttaggagcaaa

SEQ ID NO: 714297 - DNA, 20 bp, Artificial
  CRISPR gRNA sequence
aggagcaaaaggatctgcca

SEQ ID NO: 714298 - DNA, 20 bp, Artificial
  CRISPR gRNA sequence
aaaggatctgccatagaacc

SEQ ID NO: 714299 - DNA, 20 bp, Artificial
  CRISPR gRNA sequence
aaggatctgccatagaacct

SEQ ID NO: 714300 - DNA, 20 bp, Artificial
  CRISPR gRNA sequence
tgccatagaacctaggtgtg

SEQ ID NO: 714301 - DNA, 20 bp, Artificial
  CRISPR gRNA sequence
catagaacctaggtgtgcag

SEQ ID NO: 714302 - DNA, 20 bp, Artificial
  CRISPR gRNA sequence
atagaacctaggtgtgcagt

SEQ ID NO: 714303 - DNA, 20 bp, Artificial
  CRISPR gRNA sequence
gtgcagtaggctacatcatg

SEQ ID NO: 714304 - DNA, 20 bp, Artificial
  CRISPR gRNA sequence
tgcagtaggctacatcatgt

SEQ ID NO: 714305 - DNA, 20 bp, Artificial
  CRISPR gRNA sequence
tacatcatgtaggtgtgtgt

SEQ ID NO: 714306 - DNA, 20 bp, Artificial
  CRISPR gRNA sequence
tgtgtgtaagtacactaatc

SEQ ID NO: 714307 - DNA, 20 bp, Artificial
  CRISPR gRNA sequence
gtgtgtaagtacactaatct

SEQ ID NO: 714308 - DNA, 20 bp, Artificial
  CRISPR gRNA sequence
ttgcctaatgacacgtttgt

SEQ ID NO: 714309 - DNA, 20 bp, Artificial
  CRISPR gRNA sequence
cagaatgtattcctgtcaat

SEQ ID NO: 714310 - DNA, 20 bp, Artificial
  CRISPR gRNA sequence
atgactataatttatatcct

SEQ ID NO: 714311 - DNA, 20 bp, Artificial
  CRISPR gRNA sequence
gactataatttatatcctca

SEQ ID NO: 714312 - DNA, 20 bp, Artificial
  CRISPR gRNA sequence
gagacacacaaaaaaattgt

SEQ ID NO: 714313 - DNA, 20 bp, Artificial
  CRISPR gRNA sequence
cacacaaaaaaattgtaagt

SEQ ID NO: 714314 - DNA, 20 bp, Artificial
  CRISPR gRNA sequence
acacaaaaaaattgtaagtt

SEQ ID NO: 714315 - DNA, 20 bp, Artificial
  CRISPR gRNA sequence
aaaaaattgtaagttgggtg

SEQ ID NO: 714316 - DNA, 20 bp, Artificial
  CRISPR gRNA sequence
agttgggtgcagtaacatgc

SEQ ID NO: 714317 - DNA, 20 bp, Artificial
  CRISPR gRNA sequence
ggtgcagtaacatgcaagtg

SEQ ID NO: 714318 - DNA, 20 bp, Artificial
  CRISPR gRNA sequence
gtaacatgcaagtgcagccc

SEQ ID NO: 714319 - DNA, 20 bp, Artificial
  CRISPR gRNA sequence
caagtgcagccccagctact

SEQ ID NO: 714320 - DNA, 20 bp, Artificial
  CRISPR gRNA sequence
aagtgcagccccagctactc

SEQ ID NO: 714321 - DNA, 20 bp, Artificial
  CRISPR gRNA sequence
gtgcagccccagctactcgg

SEQ ID NO: 714322 - DNA, 20 bp, Artificial
  CRISPR gRNA sequence
tgcagccccagctactcggg

SEQ ID NO: 714323 - DNA, 20 bp, Artificial
  CRISPR gRNA sequence
ccccagctactcgggaggct

SEQ ID NO: 714324 - DNA, 20 bp, Artificial
  CRISPR gRNA sequence
cccagctactcgggaggctg

SEQ ID NO: 714325 - DNA, 20 bp, Artificial
  CRISPR gRNA sequence
agctactcgggaggctgagg

SEQ ID NO: 714326 - DNA, 20 bp, Artificial
  CRISPR gRNA sequence
gctactcgggaggctgaggc

SEQ ID NO: 714327 - DNA, 20 bp, Artificial
  CRISPR gRNA sequence
tactcgggaggctgaggcag

SEQ ID NO: 714328 - DNA, 20 bp, Artificial
  CRISPR gRNA sequence
actcgggaggctgaggcagg

SEQ ID NO: 714329 - DNA, 20 bp, Artificial
  CRISPR gRNA sequence
ctgaggcaggaggaacactt

SEQ ID NO: 714330 - DNA, 20 bp, Artificial
  CRISPR gRNA sequence
caggaggaacacttaagccc

SEQ ID NO: 714331 - DNA, 20 bp, Artificial
  CRISPR gRNA sequence
ggaggaacacttaagccctg

SEQ ID NO: 714332 - DNA, 20 bp, Artificial
  CRISPR gRNA sequence
acacttaagccctggagttt

SEQ ID NO: 714333 - DNA, 20 bp, Artificial
  CRISPR gRNA sequence
cacttaagccctggagttta

SEQ ID NO: 714334 - DNA, 20 bp, Artificial
  CRISPR gRNA sequence
taagccctggagtttaaggc

SEQ ID NO: 714335 - DNA, 20 bp, Artificial
  CRISPR gRNA sequence
cctggagtttaaggccagcc

SEQ ID NO: 714336 - DNA, 20 bp, Artificial
  CRISPR gRNA sequence
taaggccagcctggacaaca

SEQ ID NO: 714337 - DNA, 20 bp, Artificial
  CRISPR gRNA sequence
gccagcctggacaacaaagt

SEQ ID NO: 714338 - DNA, 20 bp, Artificial
  CRISPR gRNA sequence
agaccctgtcttaaaattta

SEQ ID NO: 714339 - DNA, 20 bp, Artificial
  CRISPR gRNA sequence
ctgtcttaaaatttaaagat

SEQ ID NO: 714340 - DNA, 20 bp, Artificial
  CRISPR gRNA sequence
aaaatttaaagataagaaat

SEQ ID NO: 714341 - DNA, 20 bp, Artificial
  CRISPR gRNA sequence
aaatttaaagataagaaatt

SEQ ID NO: 714342 - DNA, 20 bp, Artificial
  CRISPR gRNA sequence
ttaaagataagaaattgggc

SEQ ID NO: 714343 - DNA, 20 bp, Artificial
  CRISPR gRNA sequence
taaagataagaaattgggcc

SEQ ID NO: 714344 - DNA, 20 bp, Artificial
  CRISPR gRNA sequence
ataagaaattgggccgggaa

SEQ ID NO: 714345 - DNA, 20 bp, Artificial
  CRISPR gRNA sequence
cacctgtaatcccaacactt

SEQ ID NO: 714346 - DNA, 20 bp, Artificial
  CRISPR gRNA sequence
acctgtaatcccaacacttt

SEQ ID NO: 714347 - DNA, 20 bp, Artificial
  CRISPR gRNA sequence
ctgtaatcccaacactttag

SEQ ID NO: 714348 - DNA, 20 bp, Artificial
  CRISPR gRNA sequence
tgtaatcccaacactttagg

SEQ ID NO: 714349 - DNA, 20 bp, Artificial
  CRISPR gRNA sequence
tcccaacactttaggaggcc

SEQ ID NO: 714350 - DNA, 20 bp, Artificial
  CRISPR gRNA sequence
cccaacactttaggaggcca

SEQ ID NO: 714351 - DNA, 20 bp, Artificial
  CRISPR gRNA sequence
aacactttaggaggccaagg

SEQ ID NO: 714352 - DNA, 20 bp, Artificial
  CRISPR gRNA sequence
ctttaggaggccaaggcggc

SEQ ID NO: 714353 - DNA, 20 bp, Artificial
  CRISPR gRNA sequence
ccaaggcggctggatcactt

SEQ ID NO: 714354 - DNA, 20 bp, Artificial
  CRISPR gRNA sequence
caaggcggctggatcacttg

SEQ ID NO: 714355 - DNA, 20 bp, Artificial
  CRISPR gRNA sequence
gcggctggatcacttgaggt

SEQ ID NO: 714356 - DNA, 20 bp, Artificial
  CRISPR gRNA sequence
cggctggatcacttgaggtc

SEQ ID NO: 714357 - DNA, 20 bp, Artificial
  CRISPR gRNA sequence
gctggatcacttgaggtcag

SEQ ID NO: 714358 - DNA, 20 bp, Artificial
  CRISPR gRNA sequence
tcacttgaggtcaggagttt

SEQ ID NO: 714359 - DNA, 20 bp, Artificial
  CRISPR gRNA sequence
tgaggtcaggagtttgagac

SEQ ID NO: 714360 - DNA, 20 bp, Artificial
  CRISPR gRNA sequence
tcaggagtttgagaccagcc

SEQ ID NO: 714361 - DNA, 20 bp, Artificial
  CRISPR gRNA sequence
caggagtttgagaccagcct

SEQ ID NO: 714362 - DNA, 20 bp, Artificial
  CRISPR gRNA sequence
tcttctaaaaatacaaaaat

SEQ ID NO: 714363 - DNA, 20 bp, Artificial
  CRISPR gRNA sequence
ctaaaaatacaaaaattagc

SEQ ID NO: 714364 - DNA, 20 bp, Artificial
  CRISPR gRNA sequence
taaaaatacaaaaattagcc

SEQ ID NO: 714365 - DNA, 20 bp, Artificial
  CRISPR gRNA sequence
atacaaaaattagccaggcg

SEQ ID NO: 714366 - DNA, 20 bp, Artificial
  CRISPR gRNA sequence
caaaaattagccaggcgtgg

SEQ ID NO: 714367 - DNA, 20 bp, Artificial
  CRISPR gRNA sequence
gtggtgcatccctgtaatct

SEQ ID NO: 714368 - DNA, 20 bp, Artificial
  CRISPR gRNA sequence
tccctgtaatctcagctact

SEQ ID NO: 714369 - DNA, 20 bp, Artificial
  CRISPR gRNA sequence
ccctgtaatctcagctactc

SEQ ID NO: 714370 - DNA, 20 bp, Artificial
  CRISPR gRNA sequence
ctgtaatctcagctactcag

SEQ ID NO: 714371 - DNA, 20 bp, Artificial
  CRISPR gRNA sequence
tgtaatctcagctactcagg

SEQ ID NO: 714372 - DNA, 20 bp, Artificial
  CRISPR gRNA sequence
aatctcagctactcaggagg

SEQ ID NO: 714373 - DNA, 20 bp, Artificial
  CRISPR gRNA sequence
atctcagctactcaggaggc

SEQ ID NO: 714374 - DNA, 20 bp, Artificial
  CRISPR gRNA sequence
ctcagctactcaggaggcag

SEQ ID NO: 714375 - DNA, 20 bp, Artificial
  CRISPR gRNA sequence
gcaggagaatcgctcgaatc

SEQ ID NO: 714376 - DNA, 20 bp, Artificial
  CRISPR gRNA sequence
caggagaatcgctcgaatcc

SEQ ID NO: 714377 - DNA, 20 bp, Artificial
  CRISPR gRNA sequence
ggagaatcgctcgaatccag

SEQ ID NO: 714378 - DNA, 20 bp, Artificial
  CRISPR gRNA sequence
gagaatcgctcgaatccagg

SEQ ID NO: 714379 - DNA, 20 bp, Artificial
  CRISPR gRNA sequence
aatcgctcgaatccaggagg

SEQ ID NO: 714380 - DNA, 20 bp, Artificial
  CRISPR gRNA sequence
tcgctcgaatccaggaggta

SEQ ID NO: 714381 - DNA, 20 bp, Artificial
  CRISPR gRNA sequence
cgctcgaatccaggaggtag

SEQ ID NO: 714382 - DNA, 20 bp, Artificial
  CRISPR gRNA sequence
aatccaggaggtagaggttg

SEQ ID NO: 714383 - DNA, 20 bp, Artificial
  CRISPR gRNA sequence
caggaggtagaggttgtagt

SEQ ID NO: 714384 - DNA, 20 bp, Artificial
  CRISPR gRNA sequence
ggtagaggttgtagtgagcc

SEQ ID NO: 714385 - DNA, 20 bp, Artificial
  CRISPR gRNA sequence
gagattgcaccactgcactc

SEQ ID NO: 714386 - DNA, 20 bp, Artificial
  CRISPR gRNA sequence
tgcaccactgcactccagcc

SEQ ID NO: 714387 - DNA, 20 bp, Artificial
  CRISPR gRNA sequence
gcaccactgcactccagcct

SEQ ID NO: 714388 - DNA, 20 bp, Artificial
  CRISPR gRNA sequence
ctgcactccagcctgggcga

SEQ ID NO: 714389 - DNA, 20 bp, Artificial
  CRISPR gRNA sequence
gcactccagcctgggcgaca

SEQ ID NO: 714390 - DNA, 20 bp, Artificial
  CRISPR gRNA sequence
tccagcctgggcgacagagt

SEQ ID NO: 714391 - DNA, 20 bp, Artificial
  CRISPR gRNA sequence
gagtcagactctgtctcaaa

SEQ ID NO: 714392 - DNA, 20 bp, Artificial
  CRISPR gRNA sequence
tctgtctcaaaaagaaaaaa

SEQ ID NO: 714393 - DNA, 20 bp, Artificial
  CRISPR gRNA sequence
aaaaaaagaaaacaaaaata

SEQ ID NO: 714394 - DNA, 20 bp, Artificial
  CRISPR gRNA sequence
aaaaaagaaaacaaaaatat

SEQ ID NO: 714395 - DNA, 20 bp, Artificial
  CRISPR gRNA sequence
gaaaacaaaaatataggcaa

SEQ ID NO: 714396 - DNA, 20 bp, Artificial
  CRISPR gRNA sequence
caaaaatataggcaacagac

SEQ ID NO: 714397 - DNA, 20 bp, Artificial
  CRISPR gRNA sequence
catcctcaaacatgaaataa

SEQ ID NO: 714398 - DNA, 20 bp, Artificial
  CRISPR gRNA sequence
tcctcaaacatgaaataaca

SEQ ID NO: 714399 - DNA, 20 bp, Artificial
  CRISPR gRNA sequence
aaataacagagaatattgca

SEQ ID NO: 714400 - DNA, 20 bp, Artificial
  CRISPR gRNA sequence
acagagaatattgcaaagac

SEQ ID NO: 714401 - DNA, 20 bp, Artificial
  CRISPR gRNA sequence
ttcttgaaaaatccacctga

SEQ ID NO: 714402 - DNA, 20 bp, Artificial
  CRISPR gRNA sequence
atcactcaaatgatgaatca

SEQ ID NO: 714403 - DNA, 20 bp, Artificial
  CRISPR gRNA sequence
atgaatcaaagtgaaaaact

SEQ ID NO: 714404 - DNA, 20 bp, Artificial
  CRISPR gRNA sequence
tgaatcaaagtgaaaaactc

SEQ ID NO: 714405 - DNA, 20 bp, Artificial
  CRISPR gRNA sequence
caaagtgaaaaactcaggaa

SEQ ID NO: 714406 - DNA, 20 bp, Artificial
  CRISPR gRNA sequence
aagtgaaaaactcaggaaca

SEQ ID NO: 714407 - DNA, 20 bp, Artificial
  CRISPR gRNA sequence
tgaaaaactcaggaacagag

SEQ ID NO: 714408 - DNA, 20 bp, Artificial
  CRISPR gRNA sequence
catgaataataaaaaatgtt

SEQ ID NO: 714409 - DNA, 20 bp, Artificial
  CRISPR gRNA sequence
atgaataataaaaaatgtta

SEQ ID NO: 714410 - DNA, 20 bp, Artificial
  CRISPR gRNA sequence
aatgttaaggctaacatgcc

SEQ ID NO: 714411 - DNA, 20 bp, Artificial
  CRISPR gRNA sequence
atgttaaggctaacatgcca

SEQ ID NO: 714412 - DNA, 20 bp, Artificial
  CRISPR gRNA sequence
tgttaaggctaacatgccaa

SEQ ID NO: 714413 - DNA, 20 bp, Artificial
  CRISPR gRNA sequence
ctaacatgccaagggactta

SEQ ID NO: 714414 - DNA, 20 bp, Artificial
  CRISPR gRNA sequence
tgccaagggacttatggttg

SEQ ID NO: 714415 - DNA, 20 bp, Artificial
  CRISPR gRNA sequence
agggacttatggttgcagat

SEQ ID NO: 714416 - DNA, 20 bp, Artificial
  CRISPR gRNA sequence
agatgagaatataaacatta

SEQ ID NO: 714417 - DNA, 20 bp, Artificial
  CRISPR gRNA sequence
aaacattatagattatgaca

SEQ ID NO: 714418 - DNA, 20 bp, Artificial
  CRISPR gRNA sequence
tgacaaagtaaaatttgtgt

SEQ ID NO: 714419 - DNA, 20 bp, Artificial
  CRISPR gRNA sequence
gacaaagtaaaatttgtgta

SEQ ID NO: 714420 - DNA, 20 bp, Artificial
  CRISPR gRNA sequence
aaaatttgtgtaaggaataa

SEQ ID NO: 714421 - DNA, 20 bp, Artificial
  CRISPR gRNA sequence
tttgtgtaaggaataaaagt

SEQ ID NO: 714422 - DNA, 20 bp, Artificial
  CRISPR gRNA sequence
ttgtgtaaggaataaaagtc

SEQ ID NO: 714423 - DNA, 20 bp, Artificial
  CRISPR gRNA sequence
tgtaaggaataaaagtcagg

SEQ ID NO: 714424 - DNA, 20 bp, Artificial
  CRISPR gRNA sequence
taaggaataaaagtcaggaa

SEQ ID NO: 714425 - DNA, 20 bp, Artificial
  CRISPR gRNA sequence
aaggaataaaagtcaggaag

SEQ ID NO: 714426 - DNA, 20 bp, Artificial
  CRISPR gRNA sequence
ataaaagtcaggaagaggat

SEQ ID NO: 714427 - DNA, 20 bp, Artificial
  CRISPR gRNA sequence
taaaagtcaggaagaggatg

SEQ ID NO: 714428 - DNA, 20 bp, Artificial
  CRISPR gRNA sequence
aaagtcaggaagaggatgag

SEQ ID NO: 714429 - DNA, 20 bp, Artificial
  CRISPR gRNA sequence
aagtcaggaagaggatgagg

SEQ ID NO: 714430 - DNA, 20 bp, Artificial
  CRISPR gRNA sequence
tcaggaagaggatgaggagg

SEQ ID NO: 714431 - DNA, 20 bp, Artificial
  CRISPR gRNA sequence
caggaagaggatgaggaggt

SEQ ID NO: 714432 - DNA, 20 bp, Artificial
  CRISPR gRNA sequence
aattactttgttcttcatta

SEQ ID NO: 714433 - DNA, 20 bp, Artificial
  CRISPR gRNA sequence
attactttgttcttcattac

SEQ ID NO: 714434 - DNA, 20 bp, Artificial
  CRISPR gRNA sequence
ttactttgttcttcattaca

SEQ ID NO: 714435 - DNA, 20 bp, Artificial
  CRISPR gRNA sequence
actttgttcttcattacagg

SEQ ID NO: 714436 - DNA, 20 bp, Artificial
  CRISPR gRNA sequence
tactgtccaaaactcaaact

SEQ ID NO: 714437 - DNA, 20 bp, Artificial
  CRISPR gRNA sequence
tgtccaaaactcaaactaag

SEQ ID NO: 714438 - DNA, 20 bp, Artificial
  CRISPR gRNA sequence
gcagattttgcctttactgc

SEQ ID NO: 714439 - DNA, 20 bp, Artificial
  CRISPR gRNA sequence
agattttgcctttactgcaa

SEQ ID NO: 714440 - DNA, 20 bp, Artificial
  CRISPR gRNA sequence
tttgcctttactgcaagaga

SEQ ID NO: 714441 - DNA, 20 bp, Artificial
  CRISPR gRNA sequence
gcctttactgcaagagatag

SEQ ID NO: 714442 - DNA, 20 bp, Artificial
  CRISPR gRNA sequence
ataacctcctttcttaattt

SEQ ID NO: 714443 - DNA, 20 bp, Artificial
  CRISPR gRNA sequence
aacctcctttcttaatttta

SEQ ID NO: 714444 - DNA, 20 bp, Artificial
  CRISPR gRNA sequence
acctcctttcttaattttag

SEQ ID NO: 714445 - DNA, 20 bp, Artificial
  CRISPR gRNA sequence
cctcctttcttaattttaga

SEQ ID NO: 714446 - DNA, 20 bp, Artificial
  CRISPR gRNA sequence
ttagagggttttttttttta

SEQ ID NO: 714447 - DNA, 20 bp, Artificial
  CRISPR gRNA sequence
tagagggtttttttttttaa

SEQ ID NO: 714448 - DNA, 20 bp, Artificial
  CRISPR gRNA sequence
ttttttttttaaaggaattg

SEQ ID NO: 714449 - DNA, 20 bp, Artificial
  CRISPR gRNA sequence
aattgcagtatcttttgctg

SEQ ID NO: 714450 - DNA, 20 bp, Artificial
  CRISPR gRNA sequence
gaagatacattaatctgact

SEQ ID NO: 714451 - DNA, 20 bp, Artificial
  CRISPR gRNA sequence
aagatacattaatctgactg

SEQ ID NO: 714452 - DNA, 20 bp, Artificial
  CRISPR gRNA sequence
acattaatctgactgaggtt

SEQ ID NO: 714453 - DNA, 20 bp, Artificial
  CRISPR gRNA sequence
tcttaaaattccttctttgt

SEQ ID NO: 714454 - DNA, 20 bp, Artificial
  CRISPR gRNA sequence
tccttctttgtaagtgtgta

SEQ ID NO: 714455 - DNA, 20 bp, Artificial
  CRISPR gRNA sequence
ccttctttgtaagtgtgtac

SEQ ID NO: 714456 - DNA, 20 bp, Artificial
  CRISPR gRNA sequence
gtaagtgtgtacaggctgtc

SEQ ID NO: 714457 - DNA, 20 bp, Artificial
  CRISPR gRNA sequence
ctaacctacccatctttata

SEQ ID NO: 714458 - DNA, 20 bp, Artificial
  CRISPR gRNA sequence
aacctacccatctttataca

SEQ ID NO: 714459 - DNA, 20 bp, Artificial
  CRISPR gRNA sequence
cctacccatctttatacaga

SEQ ID NO: 714460 - DNA, 20 bp, Artificial
  CRISPR gRNA sequence
ctacccatctttatacagag

SEQ ID NO: 714461 - DNA, 20 bp, Artificial
  CRISPR gRNA sequence
cccatctttatacagagagg

SEQ ID NO: 714462 - DNA, 20 bp, Artificial
  CRISPR gRNA sequence
catctttatacagagaggta

SEQ ID NO: 714463 - DNA, 20 bp, Artificial
  CRISPR gRNA sequence
atctttatacagagaggtag

SEQ ID NO: 714464 - DNA, 20 bp, Artificial
  CRISPR gRNA sequence
acagagaggtagaggcgtgt

SEQ ID NO: 714465 - DNA, 20 bp, Artificial
  CRISPR gRNA sequence
tgtcagccatctaatgataa

SEQ ID NO: 714466 - DNA, 20 bp, Artificial
  CRISPR gRNA sequence
cagccatctaatgataatag

SEQ ID NO: 714467 - DNA, 20 bp, Artificial
  CRISPR gRNA sequence
atgataatagtagttatcta

SEQ ID NO: 714468 - DNA, 20 bp, Artificial
  CRISPR gRNA sequence
taatagtagttatctataga

SEQ ID NO: 714469 - DNA, 20 bp, Artificial
  CRISPR gRNA sequence
atagtagttatctatagatg

SEQ ID NO: 714470 - DNA, 20 bp, Artificial
  CRISPR gRNA sequence
tagtagttatctatagatgg

SEQ ID NO: 714471 - DNA, 20 bp, Artificial
  CRISPR gRNA sequence
agtagttatctatagatgga

SEQ ID NO: 714472 - DNA, 20 bp, Artificial
  CRISPR gRNA sequence
gttatctatagatggagggc

SEQ ID NO: 714473 - DNA, 20 bp, Artificial
  CRISPR gRNA sequence
ttatctatagatggagggct

SEQ ID NO: 714474 - DNA, 20 bp, Artificial
  CRISPR gRNA sequence
tatctatagatggagggctg

SEQ ID NO: 714475 - DNA, 20 bp, Artificial
  CRISPR gRNA sequence
tctatagatggagggctggg

SEQ ID NO: 714476 - DNA, 20 bp, Artificial
  CRISPR gRNA sequence
ctatagatggagggctgggg

SEQ ID NO: 714477 - DNA, 20 bp, Artificial
  CRISPR gRNA sequence
tatagatggagggctgggga

SEQ ID NO: 714478 - DNA, 20 bp, Artificial
  CRISPR gRNA sequence
aattttcatttcataaaatg

SEQ ID NO: 714479 - DNA, 20 bp, Artificial
  CRISPR gRNA sequence
taaaatgcagtcattacttt

SEQ ID NO: 714480 - DNA, 20 bp, Artificial
  CRISPR gRNA sequence
tcattacttttagaaattca

SEQ ID NO: 714481 - DNA, 20 bp, Artificial
  CRISPR gRNA sequence
ttagaaattcaaagatacac

SEQ ID NO: 714482 - DNA, 20 bp, Artificial
  CRISPR gRNA sequence
accagataaatgctaataaa

SEQ ID NO: 714483 - DNA, 20 bp, Artificial
  CRISPR gRNA sequence
gataaatgctaataaaaaga

SEQ ID NO: 714484 - DNA, 20 bp, Artificial
  CRISPR gRNA sequence
aaatgctaataaaaagaaag

SEQ ID NO: 714485 - DNA, 20 bp, Artificial
  CRISPR gRNA sequence
taataaaaagaaagaagaaa

SEQ ID NO: 714486 - DNA, 20 bp, Artificial
  CRISPR gRNA sequence
ttaacctttgctacttcttc

SEQ ID NO: 714487 - DNA, 20 bp, Artificial
  CRISPR gRNA sequence
taacctttgctacttcttcc

SEQ ID NO: 714488 - DNA, 20 bp, Artificial
  CRISPR gRNA sequence
cctttgctacttcttccagg

SEQ ID NO: 714489 - DNA, 20 bp, Artificial
  CRISPR gRNA sequence
ctttgctacttcttccagga

SEQ ID NO: 714490 - DNA, 20 bp, Artificial
  CRISPR gRNA sequence
ctacttcttccaggaaggaa

SEQ ID NO: 714491 - DNA, 20 bp, Artificial
  CRISPR gRNA sequence
tgccaaacaaatgtgaaatt

SEQ ID NO: 714492 - DNA, 20 bp, Artificial
  CRISPR gRNA sequence
gccaaacaaatgtgaaatta

SEQ ID NO: 714493 - DNA, 20 bp, Artificial
  CRISPR gRNA sequence
ccaaacaaatgtgaaattaa

SEQ ID NO: 714494 - DNA, 20 bp, Artificial
  CRISPR gRNA sequence
caaatgtgaaattaagggaa

SEQ ID NO: 714495 - DNA, 20 bp, Artificial
  CRISPR gRNA sequence
aaatgtgaaattaagggaaa

SEQ ID NO: 714496 - DNA, 20 bp, Artificial
  CRISPR gRNA sequence
attaagggaaaaggcattac

SEQ ID NO: 714497 - DNA, 20 bp, Artificial
  CRISPR gRNA sequence
ttaagggaaaaggcattaca

SEQ ID NO: 714498 - DNA, 20 bp, Artificial
  CRISPR gRNA sequence
ggaaaaggcattacaaggaa

SEQ ID NO: 714499 - DNA, 20 bp, Artificial
  CRISPR gRNA sequence
aaaaggcattacaaggaatg

SEQ ID NO: 714500 - DNA, 20 bp, Artificial
  CRISPR gRNA sequence
aaggcattacaaggaatgga

SEQ ID NO: 714501 - DNA, 20 bp, Artificial
  CRISPR gRNA sequence
aggcattacaaggaatggag

SEQ ID NO: 714502 - DNA, 20 bp, Artificial
  CRISPR gRNA sequence
aatggagaggtatattcatg

SEQ ID NO: 714503 - DNA, 20 bp, Artificial
  CRISPR gRNA sequence
ggtatattcatgtggataaa

SEQ ID NO: 714504 - DNA, 20 bp, Artificial
  CRISPR gRNA sequence
catttatgtacctaataaca

SEQ ID NO: 714505 - DNA, 20 bp, Artificial
  CRISPR gRNA sequence
acatagctttgacatatatg

SEQ ID NO: 714506 - DNA, 20 bp, Artificial
  CRISPR gRNA sequence
tgacatatatgaagcaaaaa

SEQ ID NO: 714507 - DNA, 20 bp, Artificial
  CRISPR gRNA sequence
atatatgaagcaaaaataga

SEQ ID NO: 714508 - DNA, 20 bp, Artificial
  CRISPR gRNA sequence
agaacacaatgaaaatctaa

SEQ ID NO: 714509 - DNA, 20 bp, Artificial
  CRISPR gRNA sequence
tgaaaatctaatagatgaac

SEQ ID NO: 714510 - DNA, 20 bp, Artificial
  CRISPR gRNA sequence
taatagatgaacaagtatac

SEQ ID NO: 714511 - DNA, 20 bp, Artificial
  CRISPR gRNA sequence
aatagatgaacaagtatact

SEQ ID NO: 714512 - DNA, 20 bp, Artificial
  CRISPR gRNA sequence
tagatgaacaagtatactgg

SEQ ID NO: 714513 - DNA, 20 bp, Artificial
  CRISPR gRNA sequence
gaacaagtatactgggagat

SEQ ID NO: 714514 - DNA, 20 bp, Artificial
  CRISPR gRNA sequence
taagattttaacacatctct

SEQ ID NO: 714515 - DNA, 20 bp, Artificial
  CRISPR gRNA sequence
taacacatctctcagaaata

SEQ ID NO: 714516 - DNA, 20 bp, Artificial
  CRISPR gRNA sequence
aacacatctctcagaaataa

SEQ ID NO: 714517 - DNA, 20 bp, Artificial
  CRISPR gRNA sequence
ctcagaaataaaggtgataa

SEQ ID NO: 714518 - DNA, 20 bp, Artificial
  CRISPR gRNA sequence
taaaggtgataaaagtaaat

SEQ ID NO: 714519 - DNA, 20 bp, Artificial
  CRISPR gRNA sequence
aaaggtgataaaagtaaata

SEQ ID NO: 714520 - DNA, 20 bp, Artificial
  CRISPR gRNA sequence
aaggtgataaaagtaaataa

SEQ ID NO: 714521 - DNA, 20 bp, Artificial
  CRISPR gRNA sequence
atttaaataacacaattaac

SEQ ID NO: 714522 - DNA, 20 bp, Artificial
  CRISPR gRNA sequence
aattaacaagcttaacttaa

SEQ ID NO: 714523 - DNA, 20 bp, Artificial
  CRISPR gRNA sequence
agcttaacttaatagatatg

SEQ ID NO: 714524 - DNA, 20 bp, Artificial
  CRISPR gRNA sequence
cttaacttaatagatatgta

SEQ ID NO: 714525 - DNA, 20 bp, Artificial
  CRISPR gRNA sequence
agaactttatacgcaacaaa

SEQ ID NO: 714526 - DNA, 20 bp, Artificial
  CRISPR gRNA sequence
catgatcatttattatttat

SEQ ID NO: 714527 - DNA, 20 bp, Artificial
  CRISPR gRNA sequence
attatttattagaccacaaa

SEQ ID NO: 714528 - DNA, 20 bp, Artificial
  CRISPR gRNA sequence
atccacacaaaaataaacac

SEQ ID NO: 714529 - DNA, 20 bp, Artificial
  CRISPR gRNA sequence
acacaaaaataaacactaga

SEQ ID NO: 714530 - DNA, 20 bp, Artificial
  CRISPR gRNA sequence
aataaacactagatagcaca

SEQ ID NO: 714531 - DNA, 20 bp, Artificial
  CRISPR gRNA sequence
ctgcattctctaaccataat

SEQ ID NO: 714532 - DNA, 20 bp, Artificial
  CRISPR gRNA sequence
gcattctctaaccataataa

SEQ ID NO: 714533 - DNA, 20 bp, Artificial
  CRISPR gRNA sequence
taataagagactaacaataa

SEQ ID NO: 714534 - DNA, 20 bp, Artificial
  CRISPR gRNA sequence
aataagagactaacaataaa

SEQ ID NO: 714535 - DNA, 20 bp, Artificial
  CRISPR gRNA sequence
aataaaaggtcatactgaaa

SEQ ID NO: 714536 - DNA, 20 bp, Artificial
  CRISPR gRNA sequence
tcatactgaaacagttttcc

SEQ ID NO: 714537 - DNA, 20 bp, Artificial
  CRISPR gRNA sequence
tactgaaacagttttcctgg

SEQ ID NO: 714538 - DNA, 20 bp, Artificial
  CRISPR gRNA sequence
tcctggaagtcctgtgatct

SEQ ID NO: 714539 - DNA, 20 bp, Artificial
  CRISPR gRNA sequence
cctggaagtcctgtgatctt

SEQ ID NO: 714540 - DNA, 20 bp, Artificial
  CRISPR gRNA sequence
aagtcctgtgatcttaggaa

SEQ ID NO: 714541 - DNA, 20 bp, Artificial
  CRISPR gRNA sequence
gtgatcttaggaaaagaaca

SEQ ID NO: 714542 - DNA, 20 bp, Artificial
  CRISPR gRNA sequence
taggaaaagaacacagctct

SEQ ID NO: 714543 - DNA, 20 bp, Artificial
  CRISPR gRNA sequence
aagaacacagctcttggtgt

SEQ ID NO: 714544 - DNA, 20 bp, Artificial
  CRISPR gRNA sequence
agaacacagctcttggtgtc

SEQ ID NO: 714545 - DNA, 20 bp, Artificial
  CRISPR gRNA sequence
tcaggccacaactcaaactc

SEQ ID NO: 714546 - DNA, 20 bp, Artificial
  CRISPR gRNA sequence
actccagttctgccacttac

SEQ ID NO: 714547 - DNA, 20 bp, Artificial
  CRISPR gRNA sequence
tccagttctgccacttacca

SEQ ID NO: 714548 - DNA, 20 bp, Artificial
  CRISPR gRNA sequence
ttaccagagttttgtaactt

SEQ ID NO: 714549 - DNA, 20 bp, Artificial
  CRISPR gRNA sequence
cagagttttgtaactttgga

SEQ ID NO: 714550 - DNA, 20 bp, Artificial
  CRISPR gRNA sequence
agagttttgtaactttggaa

SEQ ID NO: 714551 - DNA, 20 bp, Artificial
  CRISPR gRNA sequence
tcctcaaattcctcattgta

SEQ ID NO: 714552 - DNA, 20 bp, Artificial
  CRISPR gRNA sequence
caaattcctcattgtaaagt

SEQ ID NO: 714553 - DNA, 20 bp, Artificial
  CRISPR gRNA sequence
aaattcctcattgtaaagta

SEQ ID NO: 714554 - DNA, 20 bp, Artificial
  CRISPR gRNA sequence
cctcattgtaaagtaaggat

SEQ ID NO: 714555 - DNA, 20 bp, Artificial
  CRISPR gRNA sequence
attgtaaagtaaggataagc

SEQ ID NO: 714556 - DNA, 20 bp, Artificial
  CRISPR gRNA sequence
ataagcaagaaatcctcccc

SEQ ID NO: 714557 - DNA, 20 bp, Artificial
  CRISPR gRNA sequence
taagcaagaaatcctcccct

SEQ ID NO: 714558 - DNA, 20 bp, Artificial
  CRISPR gRNA sequence
aagcaagaaatcctccccta

SEQ ID NO: 714559 - DNA, 20 bp, Artificial
  CRISPR gRNA sequence
gaaatcctcccctagggctg

SEQ ID NO: 714560 - DNA, 20 bp, Artificial
  CRISPR gRNA sequence
tcctcccctagggctgtggt

SEQ ID NO: 714561 - DNA, 20 bp, Artificial
  CRISPR gRNA sequence
cctcccctagggctgtggtg

SEQ ID NO: 714562 - DNA, 20 bp, Artificial
  CRISPR gRNA sequence
gattaaactcaaaaaaatgt

SEQ ID NO: 714563 - DNA, 20 bp, Artificial
  CRISPR gRNA sequence
aaaatgtgagtcctctcctt

SEQ ID NO: 714564 - DNA, 20 bp, Artificial
  CRISPR gRNA sequence
aaatgtgagtcctctccttc

SEQ ID NO: 714565 - DNA, 20 bp, Artificial
  CRISPR gRNA sequence
tctccttcaggaaacatgtt

SEQ ID NO: 714566 - DNA, 20 bp, Artificial
  CRISPR gRNA sequence
aacatgttaagtctctgtga

SEQ ID NO: 714567 - DNA, 20 bp, Artificial
  CRISPR gRNA sequence
gttaagtctctgtgaaagta

SEQ ID NO: 714568 - DNA, 20 bp, Artificial
  CRISPR gRNA sequence
ctgtgaaagtatggatgcaa

SEQ ID NO: 714569 - DNA, 20 bp, Artificial
  CRISPR gRNA sequence
tgtgaaagtatggatgcaaa

SEQ ID NO: 714570 - DNA, 20 bp, Artificial
  CRISPR gRNA sequence
agtatggatgcaaaaggtca

SEQ ID NO: 714571 - DNA, 20 bp, Artificial
  CRISPR gRNA sequence
ctgatatcaaatcacaaatg

SEQ ID NO: 714572 - DNA, 20 bp, Artificial
  CRISPR gRNA sequence
gatatcaaatcacaaatgca

SEQ ID NO: 714573 - DNA, 20 bp, Artificial
  CRISPR gRNA sequence
tatcaaatcacaaatgcaga

SEQ ID NO: 714574 - DNA, 20 bp, Artificial
  CRISPR gRNA sequence
atcaaatcacaaatgcagag

SEQ ID NO: 714575 - DNA, 20 bp, Artificial
  CRISPR gRNA sequence
caaatgcagagaggtaaact

SEQ ID NO: 714576 - DNA, 20 bp, Artificial
  CRISPR gRNA sequence
aaatgcagagaggtaaactg

SEQ ID NO: 714577 - DNA, 20 bp, Artificial
  CRISPR gRNA sequence
agagaggtaaactgaggcac

SEQ ID NO: 714578 - DNA, 20 bp, Artificial
  CRISPR gRNA sequence
gagaggtaaactgaggcacc

SEQ ID NO: 714579 - DNA, 20 bp, Artificial
  CRISPR gRNA sequence
gaggtaaactgaggcaccag

SEQ ID NO: 714580 - DNA, 20 bp, Artificial
  CRISPR gRNA sequence
aggtaaactgaggcaccagg

SEQ ID NO: 714581 - DNA, 20 bp, Artificial
  CRISPR gRNA sequence
gaggcaccaggaggacaatt

SEQ ID NO: 714582 - DNA, 20 bp, Artificial
  CRISPR gRNA sequence
ggcaccaggaggacaattca

SEQ ID NO: 714583 - DNA, 20 bp, Artificial
  CRISPR gRNA sequence
caggaggacaattcagagaa

SEQ ID NO: 714584 - DNA, 20 bp, Artificial
  CRISPR gRNA sequence
tcatgatgctctccaccttc

SEQ ID NO: 714585 - DNA, 20 bp, Artificial
  CRISPR gRNA sequence
agattcttcacctctcctct

SEQ ID NO: 714586 - DNA, 20 bp, Artificial
  CRISPR gRNA sequence
gattcttcacctctcctctg

SEQ ID NO: 714587 - DNA, 20 bp, Artificial
  CRISPR gRNA sequence
tgaggacccctcatgctccc

SEQ ID NO: 714588 - DNA, 20 bp, Artificial
  CRISPR gRNA sequence
ggacccctcatgctccctag

SEQ ID NO: 714589 - DNA, 20 bp, Artificial
  CRISPR gRNA sequence
gacccctcatgctccctaga

SEQ ID NO: 714590 - DNA, 20 bp, Artificial
  CRISPR gRNA sequence
cccctcatgctccctagaag

SEQ ID NO: 714591 - DNA, 20 bp, Artificial
  CRISPR gRNA sequence
ccctcatgctccctagaagg

SEQ ID NO: 714592 - DNA, 20 bp, Artificial
  CRISPR gRNA sequence
tgctccctagaaggaggccc

SEQ ID NO: 714593 - DNA, 20 bp, Artificial
  CRISPR gRNA sequence
ctccctagaaggaggccctg

SEQ ID NO: 714594 - DNA, 20 bp, Artificial
  CRISPR gRNA sequence
ccctagaaggaggccctgga

SEQ ID NO: 714595 - DNA, 20 bp, Artificial
  CRISPR gRNA sequence
ctagaaggaggccctggaga

SEQ ID NO: 714596 - DNA, 20 bp, Artificial
  CRISPR gRNA sequence
ggaggccctggagagagaac

SEQ ID NO: 714597 - DNA, 20 bp, Artificial
  CRISPR gRNA sequence
gaggccctggagagagaaca

SEQ ID NO: 714598 - DNA, 20 bp, Artificial
  CRISPR gRNA sequence
gagaacaaggcccttacctc

SEQ ID NO: 714599 - DNA, 20 bp, Artificial
  CRISPR gRNA sequence
aaggcccttacctcgagaac

SEQ ID NO: 714600 - DNA, 20 bp, Artificial
  CRISPR gRNA sequence
tacctcgagaacaagtcacg

SEQ ID NO: 714601 - DNA, 20 bp, Artificial
  CRISPR gRNA sequence
acctcgagaacaagtcacgc

SEQ ID NO: 714602 - DNA, 20 bp, Artificial
  CRISPR gRNA sequence
aacaagtcacgcaggctgta

SEQ ID NO: 714603 - DNA, 20 bp, Artificial
  CRISPR gRNA sequence
aagtcacgcaggctgtacag

SEQ ID NO: 714604 - DNA, 20 bp, Artificial
  CRISPR gRNA sequence
cacgcaggctgtacagcggt

SEQ ID NO: 714605 - DNA, 20 bp, Artificial
  CRISPR gRNA sequence
gtacagcggtcggcctcatc

SEQ ID NO: 714606 - DNA, 20 bp, Artificial
  CRISPR gRNA sequence
tacagcggtcggcctcatcc

SEQ ID NO: 714607 - DNA, 20 bp, Artificial
  CRISPR gRNA sequence
agcggtcggcctcatccagg

SEQ ID NO: 714608 - DNA, 20 bp, Artificial
  CRISPR gRNA sequence
ggtcggcctcatccaggtag

SEQ ID NO: 714609 - DNA, 20 bp, Artificial
  CRISPR gRNA sequence
ggcctcatccaggtagtagt

SEQ ID NO: 714610 - DNA, 20 bp, Artificial
  CRISPR gRNA sequence
gcctcatccaggtagtagtc

SEQ ID NO: 714611 - DNA, 20 bp, Artificial
  CRISPR gRNA sequence
caggctcacactgcttcctg

SEQ ID NO: 714612 - DNA, 20 bp, Artificial
  CRISPR gRNA sequence
ctcacactgcttcctgcagt

SEQ ID NO: 714613 - DNA, 20 bp, Artificial
  CRISPR gRNA sequence
acactgcttcctgcagtcag

SEQ ID NO: 714614 - DNA, 20 bp, Artificial
  CRISPR gRNA sequence
cactgcttcctgcagtcagt

SEQ ID NO: 714615 - DNA, 20 bp, Artificial
  CRISPR gRNA sequence
ctgcagtcagtaggcctctg

SEQ ID NO: 714616 - DNA, 20 bp, Artificial
  CRISPR gRNA sequence
tgcagtcagtaggcctctgt

SEQ ID NO: 714617 - DNA, 20 bp, Artificial
  CRISPR gRNA sequence
ctctgtgggcactgctgtgt

SEQ ID NO: 714618 - DNA, 20 bp, Artificial
  CRISPR gRNA sequence
tctgtgggcactgctgtgtc

SEQ ID NO: 714619 - DNA, 20 bp, Artificial
  CRISPR gRNA sequence
gggcactgctgtgtcgggaa

SEQ ID NO: 714620 - DNA, 20 bp, Artificial
  CRISPR gRNA sequence
tgctgtgtcgggaacagccc

SEQ ID NO: 714621 - DNA, 20 bp, Artificial
  CRISPR gRNA sequence
gctgtgtcgggaacagccct

SEQ ID NO: 714622 - DNA, 20 bp, Artificial
  CRISPR gRNA sequence
gtcgggaacagccctgggaa

SEQ ID NO: 714623 - DNA, 20 bp, Artificial
  CRISPR gRNA sequence
aacagccctgggaaaagaaa

SEQ ID NO: 714624 - DNA, 20 bp, Artificial
  CRISPR gRNA sequence
cagccctgggaaaagaaaca

SEQ ID NO: 714625 - DNA, 20 bp, Artificial
  CRISPR gRNA sequence
ccctgggaaaagaaacagag

SEQ ID NO: 714626 - DNA, 20 bp, Artificial
  CRISPR gRNA sequence
aaaagaaacagagaagctcc

SEQ ID NO: 714627 - DNA, 20 bp, Artificial
  CRISPR gRNA sequence
gaaacagagaagctccaagc

SEQ ID NO: 714628 - DNA, 20 bp, Artificial
  CRISPR gRNA sequence
aaacagagaagctccaagcc

SEQ ID NO: 714629 - DNA, 20 bp, Artificial
  CRISPR gRNA sequence
agctccaagccaggctgact

SEQ ID NO: 714630 - DNA, 20 bp, Artificial
  CRISPR gRNA sequence
caagccaggctgacttagca

SEQ ID NO: 714631 - DNA, 20 bp, Artificial
  CRISPR gRNA sequence
aagccaggctgacttagcaa

SEQ ID NO: 714632 - DNA, 20 bp, Artificial
  CRISPR gRNA sequence
ctcatccctgacgcccctcc

SEQ ID NO: 714633 - DNA, 20 bp, Artificial
  CRISPR gRNA sequence
ctccaacccccgaaaactgt

SEQ ID NO: 714634 - DNA, 20 bp, Artificial
  CRISPR gRNA sequence
tcagtccaattcttgtgtta

SEQ ID NO: 714635 - DNA, 20 bp, Artificial
  CRISPR gRNA sequence
tccaattcttgtgttatgga

SEQ ID NO: 714636 - DNA, 20 bp, Artificial
  CRISPR gRNA sequence
aattcttgtgttatggatgg

SEQ ID NO: 714637 - DNA, 20 bp, Artificial
  CRISPR gRNA sequence
tggatggaagcactgacacc

SEQ ID NO: 714638 - DNA, 20 bp, Artificial
  CRISPR gRNA sequence
ggatggaagcactgacaccc

SEQ ID NO: 714639 - DNA, 20 bp, Artificial
  CRISPR gRNA sequence
atggaagcactgacacccag

SEQ ID NO: 714640 - DNA, 20 bp, Artificial
  CRISPR gRNA sequence
tggaagcactgacacccagg

SEQ ID NO: 714641 - DNA, 20 bp, Artificial
  CRISPR gRNA sequence
ggaagcactgacacccagga

SEQ ID NO: 714642 - DNA, 20 bp, Artificial
  CRISPR gRNA sequence
gaagcactgacacccaggag

SEQ ID NO: 714643 - DNA, 20 bp, Artificial
  CRISPR gRNA sequence
aggaggggcaaccctcgcct

SEQ ID NO: 714644 - DNA, 20 bp, Artificial
  CRISPR gRNA sequence
ggaggggcaaccctcgccta

SEQ ID NO: 714645 - DNA, 20 bp, Artificial
  CRISPR gRNA sequence
aaccctcgcctaaggtcccc

SEQ ID NO: 714646 - DNA, 20 bp, Artificial
  CRISPR gRNA sequence
cctcgcctaaggtcccctag

SEQ ID NO: 714647 - DNA, 20 bp, Artificial
  CRISPR gRNA sequence
ctcgcctaaggtcccctagc

SEQ ID NO: 714648 - DNA, 20 bp, Artificial
  CRISPR gRNA sequence
cctaaggtcccctagcaggc

SEQ ID NO: 714649 - DNA, 20 bp, Artificial
  CRISPR gRNA sequence
ctaaggtcccctagcaggca

SEQ ID NO: 714650 - DNA, 20 bp, Artificial
  CRISPR gRNA sequence
gtcccctagcaggcaaggaa

SEQ ID NO: 714651 - DNA, 20 bp, Artificial
  CRISPR gRNA sequence
gcaggcaaggaaaagcaaca

SEQ ID NO: 714652 - DNA, 20 bp, Artificial
  CRISPR gRNA sequence
aaggaaaagcaacatagtta

SEQ ID NO: 714653 - DNA, 20 bp, Artificial
  CRISPR gRNA sequence
ggaaaagcaacatagttata

SEQ ID NO: 714654 - DNA, 20 bp, Artificial
  CRISPR gRNA sequence
aaagcaacatagttatagag

SEQ ID NO: 714655 - DNA, 20 bp, Artificial
  CRISPR gRNA sequence
agcaacatagttatagagaa

SEQ ID NO: 714656 - DNA, 20 bp, Artificial
  CRISPR gRNA sequence
acatagttatagagaagagc

SEQ ID NO: 714657 - DNA, 20 bp, Artificial
  CRISPR gRNA sequence
catagttatagagaagagct

SEQ ID NO: 714658 - DNA, 20 bp, Artificial
  CRISPR gRNA sequence
ttatagagaagagctgggcc

SEQ ID NO: 714659 - DNA, 20 bp, Artificial
  CRISPR gRNA sequence
tatagagaagagctgggcct

SEQ ID NO: 714660 - DNA, 20 bp, Artificial
  CRISPR gRNA sequence
aagagctgggcctgggattc

SEQ ID NO: 714661 - DNA, 20 bp, Artificial
  CRISPR gRNA sequence
agagctgggcctgggattct

SEQ ID NO: 714662 - DNA, 20 bp, Artificial
  CRISPR gRNA sequence
gagctgggcctgggattcta

SEQ ID NO: 714663 - DNA, 20 bp, Artificial
  CRISPR gRNA sequence
ttgcgtgataatgaccttgt

SEQ ID NO: 714664 - DNA, 20 bp, Artificial
  CRISPR gRNA sequence
atttgtgtgtgtgtgtgtgt

SEQ ID NO: 714665 - DNA, 20 bp, Artificial
  CRISPR gRNA sequence
tttgtgtgtgtgtgtgtgtg

SEQ ID NO: 714666 - DNA, 20 bp, Artificial
  CRISPR gRNA sequence
ttgtgtgtgtgtgtgtgtga

SEQ ID NO: 714667 - DNA, 20 bp, Artificial
  CRISPR gRNA sequence
tgtgtgtgtgtgagggtaca

SEQ ID NO: 714668 - DNA, 20 bp, Artificial
  CRISPR gRNA sequence
acatagtacgtgtatatatt

SEQ ID NO: 714669 - DNA, 20 bp, Artificial
  CRISPR gRNA sequence
tgtatatatttagcactatt

SEQ ID NO: 714670 - DNA, 20 bp, Artificial
  CRISPR gRNA sequence
tatatttagcactattaagt

SEQ ID NO: 714671 - DNA, 20 bp, Artificial
  CRISPR gRNA sequence
tagcactattaagttagtaa

SEQ ID NO: 714672 - DNA, 20 bp, Artificial
  CRISPR gRNA sequence
agcactattaagttagtaat

SEQ ID NO: 714673 - DNA, 20 bp, Artificial
  CRISPR gRNA sequence
tagtaataggacccacctcc

SEQ ID NO: 714674 - DNA, 20 bp, Artificial
  CRISPR gRNA sequence
ccacctcctagtgttcttga

SEQ ID NO: 714675 - DNA, 20 bp, Artificial
  CRISPR gRNA sequence
cacctcctagtgttcttgaa

SEQ ID NO: 714676 - DNA, 20 bp, Artificial
  CRISPR gRNA sequence
gtgttcttgaaaggactgaa

SEQ ID NO: 714677 - DNA, 20 bp, Artificial
  CRISPR gRNA sequence
aaaggactgaatggactgtg

SEQ ID NO: 714678 - DNA, 20 bp, Artificial
  CRISPR gRNA sequence
tgtgaagataaatatgtata

SEQ ID NO: 714679 - DNA, 20 bp, Artificial
  CRISPR gRNA sequence
taaatatgtataaagtacta

SEQ ID NO: 714680 - DNA, 20 bp, Artificial
  CRISPR gRNA sequence
atatgtataaagtactacag

SEQ ID NO: 714681 - DNA, 20 bp, Artificial
  CRISPR gRNA sequence
taaagtactacagcagtccc

SEQ ID NO: 714682 - DNA, 20 bp, Artificial
  CRISPR gRNA sequence
agcagtccctggcacccaac

SEQ ID NO: 714683 - DNA, 20 bp, Artificial
  CRISPR gRNA sequence
gcacccaacaagcactatat

SEQ ID NO: 714684 - DNA, 20 bp, Artificial
  CRISPR gRNA sequence
aacaagcactatatgagcac

SEQ ID NO: 714685 - DNA, 20 bp, Artificial
  CRISPR gRNA sequence
ccggttgtcatcattctctg

SEQ ID NO: 714686 - DNA, 20 bp, Artificial
  CRISPR gRNA sequence
cggttgtcatcattctctgc

SEQ ID NO: 714687 - DNA, 20 bp, Artificial
  CRISPR gRNA sequence
ggttgtcatcattctctgca

SEQ ID NO: 714688 - DNA, 20 bp, Artificial
  CRISPR gRNA sequence
gttgtcatcattctctgcag

SEQ ID NO: 714689 - DNA, 20 bp, Artificial
  CRISPR gRNA sequence
gcaggggtcttatctcactg

SEQ ID NO: 714690 - DNA, 20 bp, Artificial
  CRISPR gRNA sequence
caggggtcttatctcactgc

SEQ ID NO: 714691 - DNA, 20 bp, Artificial
  CRISPR gRNA sequence
tcttatctcactgcaggaat

SEQ ID NO: 714692 - DNA, 20 bp, Artificial
  CRISPR gRNA sequence
cttatctcactgcaggaatt

SEQ ID NO: 714693 - DNA, 20 bp, Artificial
  CRISPR gRNA sequence
tatctcactgcaggaattag

SEQ ID NO: 714694 - DNA, 20 bp, Artificial
  CRISPR gRNA sequence
tctcactgcaggaattagga

SEQ ID NO: 714695 - DNA, 20 bp, Artificial
  CRISPR gRNA sequence
aattaggagagccataactt

SEQ ID NO: 714696 - DNA, 20 bp, Artificial
  CRISPR gRNA sequence
gccataactttagaccatga

SEQ ID NO: 714697 - DNA, 20 bp, Artificial
  CRISPR gRNA sequence
aactttagaccatgaaagtc

SEQ ID NO: 714698 - DNA, 20 bp, Artificial
  CRISPR gRNA sequence
agaccatgaaagtctagacc

SEQ ID NO: 714699 - DNA, 20 bp, Artificial
  CRISPR gRNA sequence
aagcttgtccaacccacgac

SEQ ID NO: 714700 - DNA, 20 bp, Artificial
  CRISPR gRNA sequence
aacccacgactagccgcatt

SEQ ID NO: 714701 - DNA, 20 bp, Artificial
  CRISPR gRNA sequence
acgactagccgcattcggcc

SEQ ID NO: 714702 - DNA, 20 bp, Artificial
  CRISPR gRNA sequence
cgactagccgcattcggccc

SEQ ID NO: 714703 - DNA, 20 bp, Artificial
  CRISPR gRNA sequence
tagccgcattcggcccagga

SEQ ID NO: 714704 - DNA, 20 bp, Artificial
  CRISPR gRNA sequence
ggcccaggacagctctgaat

SEQ ID NO: 714705 - DNA, 20 bp, Artificial
  CRISPR gRNA sequence
gcccaggacagctctgaatg

SEQ ID NO: 714706 - DNA, 20 bp, Artificial
  CRISPR gRNA sequence
aaactttcttaaaacattat

SEQ ID NO: 714707 - DNA, 20 bp, Artificial
  CRISPR gRNA sequence
attttttttttttttttttt

SEQ ID NO: 714708 - DNA, 20 bp, Artificial
  CRISPR gRNA sequence
tttttttttttttagctcat

SEQ ID NO: 714709 - DNA, 20 bp, Artificial
  CRISPR gRNA sequence
ttttttagctcatcagctat

SEQ ID NO: 714710 - DNA, 20 bp, Artificial
  CRISPR gRNA sequence
ataagctaaaacactatcct

SEQ ID NO: 714711 - DNA, 20 bp, Artificial
  CRISPR gRNA sequence
taaaacactatccttagtgt

SEQ ID NO: 714712 - DNA, 20 bp, Artificial
  CRISPR gRNA sequence
taacacttcttcttccaatg

SEQ ID NO: 714713 - DNA, 20 bp, Artificial
  CRISPR gRNA sequence
cttcttcttccaatgtggcc

SEQ ID NO: 714714 - DNA, 20 bp, Artificial
  CRISPR gRNA sequence
ttcttcttccaatgtggccc

SEQ ID NO: 714715 - DNA, 20 bp, Artificial
  CRISPR gRNA sequence
tcttcttccaatgtggccca

SEQ ID NO: 714716 - DNA, 20 bp, Artificial
  CRISPR gRNA sequence
tcttccaatgtggcccaggg

SEQ ID NO: 714717 - DNA, 20 bp, Artificial
  CRISPR gRNA sequence
atgtggcccagggaagccga

SEQ ID NO: 714718 - DNA, 20 bp, Artificial
  CRISPR gRNA sequence
gcccagggaagccgaaagat

SEQ ID NO: 714719 - DNA, 20 bp, Artificial
  CRISPR gRNA sequence
gattggacactcctgccact

SEQ ID NO: 714720 - DNA, 20 bp, Artificial
  CRISPR gRNA sequence
ctgccactaagaccctaatc

SEQ ID NO: 714721 - DNA, 20 bp, Artificial
  CRISPR gRNA sequence
ccctaatccagcctgatttc

SEQ ID NO: 714722 - DNA, 20 bp, Artificial
  CRISPR gRNA sequence
agcctgatttcgagataaac

SEQ ID NO: 714723 - DNA, 20 bp, Artificial
  CRISPR gRNA sequence
ttcgagataaacaagtcacc

SEQ ID NO: 714724 - DNA, 20 bp, Artificial
  CRISPR gRNA sequence
atcgctgcctaccttgcttc

SEQ ID NO: 714725 - DNA, 20 bp, Artificial
  CRISPR gRNA sequence
tcgctgcctaccttgcttcc

SEQ ID NO: 714726 - DNA, 20 bp, Artificial
  CRISPR gRNA sequence
gcctaccttgcttccaggat

SEQ ID NO: 714727 - DNA, 20 bp, Artificial
  CRISPR gRNA sequence
ccaggatgagcacatgaccc

SEQ ID NO: 714728 - DNA, 20 bp, Artificial
  CRISPR gRNA sequence
ggatgagcacatgacccaag

SEQ ID NO: 714729 - DNA, 20 bp, Artificial
  CRISPR gRNA sequence
gatgagcacatgacccaagc

SEQ ID NO: 714730 - DNA, 20 bp, Artificial
  CRISPR gRNA sequence
catgacccaagcaggccaat

SEQ ID NO: 714731 - DNA, 20 bp, Artificial
  CRISPR gRNA sequence
cttcttcccatcaatataat

SEQ ID NO: 714732 - DNA, 20 bp, Artificial
  CRISPR gRNA sequence
tcccatcaatataattggct

SEQ ID NO: 714733 - DNA, 20 bp, Artificial
  CRISPR gRNA sequence
cccatcaatataattggctc

SEQ ID NO: 714734 - DNA, 20 bp, Artificial
  CRISPR gRNA sequence
aagtattctgattggcctgc

SEQ ID NO: 714735 - DNA, 20 bp, Artificial
  CRISPR gRNA sequence
agcaaggtaggcagcgattg

SEQ ID NO: 714736 - DNA, 20 bp, Artificial
  CRISPR gRNA sequence
ttgtttatctcgaaatcagg

SEQ ID NO: 714737 - DNA, 20 bp, Artificial
  CRISPR gRNA sequence
atctcgaaatcaggctggat

SEQ ID NO: 714738 - DNA, 20 bp, Artificial
  CRISPR gRNA sequence
tggattagggtcttagtggc

SEQ ID NO: 714739 - DNA, 20 bp, Artificial
  CRISPR gRNA sequence
gaagtgttagtgtggaagaa

SEQ ID NO: 714740 - DNA, 20 bp, Artificial
  CRISPR gRNA sequence
agtgaatttagtctaacact

SEQ ID NO: 714741 - DNA, 20 bp, Artificial
  CRISPR gRNA sequence
ataatgttttaagaaagttt

SEQ ID NO: 714742 - DNA, 20 bp, Artificial
  CRISPR gRNA sequence
tcattcagagctgtcctggg

SEQ ID NO: 714743 - DNA, 20 bp, Artificial
  CRISPR gRNA sequence
tgggccgaatgcggctagtc

SEQ ID NO: 714744 - DNA, 20 bp, Artificial
  CRISPR gRNA sequence
agtgagataagacccctgca

SEQ ID NO: 714745 - DNA, 20 bp, Artificial
  CRISPR gRNA sequence
cggtgctcatatagtgcttg

SEQ ID NO: 714746 - DNA, 20 bp, Artificial
  CRISPR gRNA sequence
cctttcaagaacactaggag

SEQ ID NO: 714747 - DNA, 20 bp, Artificial
  CRISPR gRNA sequence
caattggcaaatggcagccc

SEQ ID NO: 714748 - DNA, 20 bp, Artificial
  CRISPR gRNA sequence
cctgctaggggaccttaggc

SEQ ID NO: 714749 - DNA, 20 bp, Artificial
  CRISPR gRNA sequence
ttaggcgagggttgcccctc

SEQ ID NO: 714750 - DNA, 20 bp, Artificial
  CRISPR gRNA sequence
agtgcttccatccataacac

SEQ ID NO: 714751 - DNA, 20 bp, Artificial
  CRISPR gRNA sequence
gaattggactgacagttttc

SEQ ID NO: 714752 - DNA, 20 bp, Artificial
  CRISPR gRNA sequence
gtggagctgggaggggcgtc

SEQ ID NO: 714753 - DNA, 20 bp, Artificial
  CRISPR gRNA sequence
gggatgagaggtgtggggca

SEQ ID NO: 714754 - DNA, 20 bp, Artificial
  CRISPR gRNA sequence
agtgtgagcctgactactac

SEQ ID NO: 714755 - DNA, 20 bp, Artificial
  CRISPR gRNA sequence
gcctccttctagggagcatg

SEQ ID NO: 714756 - DNA, 20 bp, Artificial
  CRISPR gRNA sequence
gggtcctcagaggagaggtg

SEQ ID NO: 714757 - DNA, 20 bp, Artificial
  CRISPR gRNA sequence
catgatttgatgtctgttct

SEQ ID NO: 714758 - DNA, 20 bp, Artificial
  CRISPR gRNA sequence
aggagaggactcacattttt

SEQ ID NO: 714759 - DNA, 20 bp, Artificial
  CRISPR gRNA sequence
tcctcaccacagccctaggg

SEQ ID NO: 714760 - DNA, 20 bp, Artificial
  CRISPR gRNA sequence
cttatccttactttacaatg

SEQ ID NO: 714761 - DNA, 20 bp, Artificial
  CRISPR gRNA sequence
tactttacaatgaggaattt

SEQ ID NO: 714762 - DNA, 20 bp, Artificial
  CRISPR gRNA sequence
actctggtaagtggcagaac

SEQ ID NO: 714763 - DNA, 20 bp, Artificial
  CRISPR gRNA sequence
gtaagtggcagaactggagt

SEQ ID NO: 714764 - DNA, 20 bp, Artificial
  CRISPR gRNA sequence
ttagtctcttattatggtta

SEQ ID NO: 714765 - DNA, 20 bp, Artificial
  CRISPR gRNA sequence
tatctagtgtttatttttgt

SEQ ID NO: 714766 - DNA, 20 bp, Artificial
  CRISPR gRNA sequence
tttttgtgtggatttttttg

SEQ ID NO: 714767 - DNA, 20 bp, Artificial
  CRISPR gRNA sequence
gtgtggatttttttgggggg

SEQ ID NO: 714768 - DNA, 20 bp, Artificial
  CRISPR gRNA sequence
aataaatgatcatgtatttt

SEQ ID NO: 714769 - DNA, 20 bp, Artificial
  CRISPR gRNA sequence
attttcagagtgttcagtgt

SEQ ID NO: 714770 - DNA, 20 bp, Artificial
  CRISPR gRNA sequence
tattaggtacataaatgttc

SEQ ID NO: 714771 - DNA, 20 bp, Artificial
  CRISPR gRNA sequence
atgaatgttatgtttttttg

SEQ ID NO: 714772 - DNA, 20 bp, Artificial
  CRISPR gRNA sequence
gggttgggctttttatccac

SEQ ID NO: 714773 - DNA, 20 bp, Artificial
  CRISPR gRNA sequence
agcatttatctggtgtatct

SEQ ID NO: 714774 - DNA, 20 bp, Artificial
  CRISPR gRNA sequence
tttaaaattcaagcaataca

SEQ ID NO: 714775 - DNA, 20 bp, Artificial
  CRISPR gRNA sequence
ctctacctctctgtataaag

SEQ ID NO: 714776 - DNA, 20 bp, Artificial
  CRISPR gRNA sequence
cctgtacacacttacaaaga

SEQ ID NO: 714777 - DNA, 20 bp, Artificial
  CRISPR gRNA sequence
ttacaaagaaggaattttaa

SEQ ID NO: 714778 - DNA, 20 bp, Artificial
  CRISPR gRNA sequence
aagaaagcgaagtgaaacag

SEQ ID NO: 714779 - DNA, 20 bp, Artificial
  CRISPR gRNA sequence
taagtggttaataatcattt

SEQ ID NO: 714780 - DNA, 20 bp, Artificial
  CRISPR gRNA sequence
aaaggcaaaatctgcttagt

SEQ ID NO: 714781 - DNA, 20 bp, Artificial
  CRISPR gRNA sequence
agtttgagttttggacagta

SEQ ID NO: 714782 - DNA, 20 bp, Artificial
  CRISPR gRNA sequence
aacattttttattattcatg

SEQ ID NO: 714783 - DNA, 20 bp, Artificial
  CRISPR gRNA sequence
ttggcacagcttctctgttc

SEQ ID NO: 714784 - DNA, 20 bp, Artificial
  CRISPR gRNA sequence
ttttcactttgattcatcat

SEQ ID NO: 714785 - DNA, 20 bp, Artificial
  CRISPR gRNA sequence
ttgattcatcatttgagtga

SEQ ID NO: 714786 - DNA, 20 bp, Artificial
  CRISPR gRNA sequence
tgattggattacactgtcag

SEQ ID NO: 714787 - DNA, 20 bp, Artificial
  CRISPR gRNA sequence
ttctctgttatttcatgttt

SEQ ID NO: 714788 - DNA, 20 bp, Artificial
  CRISPR gRNA sequence
tcttttttttctttttgaga

SEQ ID NO: 714789 - DNA, 20 bp, Artificial
  CRISPR gRNA sequence
tctgactctgtcgcccaggc

SEQ ID NO: 714790 - DNA, 20 bp, Artificial
  CRISPR gRNA sequence
ctcactacaacctctacctc

SEQ ID NO: 714791 - DNA, 20 bp, Artificial
  CRISPR gRNA sequence
tcgagcgattctcctgcctc

SEQ ID NO: 714792 - DNA, 20 bp, Artificial
  CRISPR gRNA sequence
tcctgagtagctgagattac

SEQ ID NO: 714793 - DNA, 20 bp, Artificial
  CRISPR gRNA sequence
ttttgtatttttagaagaga

SEQ ID NO: 714794 - DNA, 20 bp, Artificial
  CRISPR gRNA sequence
gccttggcctcctaaagtgt

SEQ ID NO: 714795 - DNA, 20 bp, Artificial
  CRISPR gRNA sequence
aaagtgttgggattacaggt

SEQ ID NO: 714796 - DNA, 20 bp, Artificial
  CRISPR gRNA sequence
cttatctttaaattttaaga

SEQ ID NO: 714797 - DNA, 20 bp, Artificial
  CRISPR gRNA sequence
gttcctcctgcctcagcctc

SEQ ID NO: 714798 - DNA, 20 bp, Artificial
  CRISPR gRNA sequence
caatttttttgtgtgtctct

SEQ ID NO: 714799 - DNA, 20 bp, Artificial
  CRISPR gRNA sequence
gtcatgtattgcttattgac

SEQ ID NO: 714800 - DNA, 20 bp, Artificial
  CRISPR gRNA sequence
ctgcacagcatgtgactgtc

SEQ ID NO: 714801 - DNA, 20 bp, Artificial
  CRISPR gRNA sequence
gtaggcagctgtgacacaat

SEQ ID NO: 714802 - DNA, 20 bp, Artificial
  CRISPR gRNA sequence
cagcactttgggaggccgag

SEQ ID NO: 714803 - DNA, 20 bp, Artificial
  CRISPR gRNA sequence
actttgggaggccgaggagg

SEQ ID NO: 714804 - DNA, 20 bp, Artificial
  CRISPR gRNA sequence
agggtggattacctgaggtc

SEQ ID NO: 714805 - DNA, 20 bp, Artificial
  CRISPR gRNA sequence
tactcaagaggctgaagcag

SEQ ID NO: 714806 - DNA, 20 bp, Artificial
  CRISPR gRNA sequence
tcatgccactgcactccagc

SEQ ID NO: 714807 - DNA, 20 bp, Artificial
  CRISPR gRNA sequence
ctgcactccagcctgggtga

SEQ ID NO: 714808 - DNA, 20 bp, Artificial
  CRISPR gRNA sequence
acttgtacagggcacttacc

SEQ ID NO: 714809 - DNA, 20 bp, Artificial
  CRISPR gRNA sequence
ttgcaggacacgaagttgtt

SEQ ID NO: 714810 - DNA, 20 bp, Artificial
  CRISPR gRNA sequence
aggacacgaagttgttctgg

SEQ ID NO: 714811 - DNA, 20 bp, Artificial
  CRISPR gRNA sequence
aagttgttctgggtgagtca

SEQ ID NO: 714812 - DNA, 20 bp, Artificial
  CRISPR gRNA sequence
ggtgagtcaatgagtaagtg

SEQ ID NO: 714813 - DNA, 20 bp, Artificial
  CRISPR gRNA sequence
agtcaatgagtaagtggtgg

SEQ ID NO: 714814 - DNA, 20 bp, Artificial
  CRISPR gRNA sequence
tacattatccgaggcctaca

SEQ ID NO: 714815 - DNA, 20 bp, Artificial
  CRISPR gRNA sequence
atccgaggcctacacagagt

SEQ ID NO: 714816 - DNA, 20 bp, Artificial
  CRISPR gRNA sequence
ctacacagagtcaggatcat

SEQ ID NO: 714817 - DNA, 20 bp, Artificial
  CRISPR gRNA sequence
tgggcagatcacttgaggtc

SEQ ID NO: 714818 - DNA, 20 bp, Artificial
  CRISPR gRNA sequence
tactcaggtggctgaggcag

SEQ ID NO: 714819 - DNA, 20 bp, Artificial
  CRISPR gRNA sequence
ttgtgctactgcactccagc

SEQ ID NO: 714820 - DNA, 20 bp, Artificial
  CRISPR gRNA sequence
ctgcactccagcctgggtga

SEQ ID NO: 714821 - DNA, 20 bp, Artificial
  CRISPR gRNA sequence
tgtctcaaaaaaaaaaaaaa

SEQ ID NO: 714822 - DNA, 20 bp, Artificial
  CRISPR gRNA sequence
gagcggtaaggtaacatgca

SEQ ID NO: 714823 - DNA, 20 bp, Artificial
  CRISPR gRNA sequence
tatgataacaatgccttctt

SEQ ID NO: 714824 - DNA, 20 bp, Artificial
  CRISPR gRNA sequence
taacttttgttttaataagt

SEQ ID NO: 714825 - DNA, 20 bp, Artificial
  CRISPR gRNA sequence
acttagggaggccaggctgg

SEQ ID NO: 714826 - DNA, 20 bp, Artificial
  CRISPR gRNA sequence
tgggagaatcacttgaggcc

SEQ ID NO: 714827 - DNA, 20 bp, Artificial
  CRISPR gRNA sequence
cacaagataaaatacattag

SEQ ID NO: 714828 - DNA, 20 bp, Artificial
  CRISPR gRNA sequence
tactcaggaggctgaggtgg

SEQ ID NO: 714829 - DNA, 20 bp, Artificial
  CRISPR gRNA sequence
accaacatctccacaaacat

SEQ ID NO: 714830 - DNA, 20 bp, Artificial
  CRISPR gRNA sequence
ctatgacatcactaggcaat

SEQ ID NO: 714831 - DNA, 20 bp, Artificial
  CRISPR gRNA sequence
attgttttttttgtttgaga

SEQ ID NO: 714832 - DNA, 20 bp, Artificial
  CRISPR gRNA sequence
tcctgctctgttgcccaggc

SEQ ID NO: 714833 - DNA, 20 bp, Artificial
  CRISPR gRNA sequence
caatctcggctcactgcaac

SEQ ID NO: 714834 - DNA, 20 bp, Artificial
  CRISPR gRNA sequence
gtcttagcctctcaagtagc

SEQ ID NO: 714835 - DNA, 20 bp, Artificial
  CRISPR gRNA sequence
tgtattttttttaggagagg

SEQ ID NO: 714836 - DNA, 20 bp, Artificial
  CRISPR gRNA sequence
tcctcggcctcccaaagtgc

SEQ ID NO: 714837 - DNA, 20 bp, Artificial
  CRISPR gRNA sequence
tttccctcttttctgcctcc

SEQ ID NO: 714838 - DNA, 20 bp, Artificial
  CRISPR gRNA sequence
tctcatgatgccggtggtct

SEQ ID NO: 714839 - DNA, 20 bp, Artificial
  CRISPR gRNA sequence
gtggcctctggctctgtggc

SEQ ID NO: 714840 - DNA, 20 bp, Artificial
  CRISPR gRNA sequence
gagcctttcccccttcttca

SEQ ID NO: 714841 - DNA, 20 bp, Artificial
  CRISPR gRNA sequence
cctctgccttccgtatttcg

SEQ ID NO: 714842 - DNA, 20 bp, Artificial
  CRISPR gRNA sequence
ttgttttgttttgtttgaga

SEQ ID NO: 714843 - DNA, 20 bp, Artificial
  CRISPR gRNA sequence
tctcgctcttttgcccaggc

SEQ ID NO: 714844 - DNA, 20 bp, Artificial
  CRISPR gRNA sequence
ctcactgcaacctccacttc

SEQ ID NO: 714845 - DNA, 20 bp, Artificial
  CRISPR gRNA sequence
gtctcagcctccccagtagc

SEQ ID NO: 714846 - DNA, 20 bp, Artificial
  CRISPR gRNA sequence
ttttgtatttttagtagaga

SEQ ID NO: 714847 - DNA, 20 bp, Artificial
  CRISPR gRNA sequence
acctcggcctcccaaagtgc

SEQ ID NO: 714848 - DNA, 20 bp, Artificial
  CRISPR gRNA sequence
ttattatctgtctttttgat

SEQ ID NO: 714849 - DNA, 20 bp, Artificial
  CRISPR gRNA sequence
aattaataaactatttctgg

SEQ ID NO: 714850 - DNA, 20 bp, Artificial
  CRISPR gRNA sequence
cagcactttgggaggccgag

SEQ ID NO: 714851 - DNA, 20 bp, Artificial
  CRISPR gRNA sequence
actttgggaggccgaggcgg

SEQ ID NO: 714852 - DNA, 20 bp, Artificial
  CRISPR gRNA sequence
cgggtggatcacctgaggtc

SEQ ID NO: 714853 - DNA, 20 bp, Artificial
  CRISPR gRNA sequence
tactcaggaggctgaggcag

SEQ ID NO: 714854 - DNA, 20 bp, Artificial
  CRISPR gRNA sequence
ttgcgccattgcactccaac

SEQ ID NO: 714855 - DNA, 20 bp, Artificial
  CRISPR gRNA sequence
ttgcactccaacctgggtga

SEQ ID NO: 714856 - DNA, 20 bp, Artificial
  CRISPR gRNA sequence
ggaaaattgaacagaaaata

SEQ ID NO: 714857 - DNA, 20 bp, Artificial
  CRISPR gRNA sequence
cccctattttttgtttgaaa

SEQ ID NO: 714858 - DNA, 20 bp, Artificial
  CRISPR gRNA sequence
tatcactcttttgcccaggc

SEQ ID NO: 714859 - DNA, 20 bp, Artificial
  CRISPR gRNA sequence
gtattttttttttgtagaga

SEQ ID NO: 714860 - DNA, 20 bp, Artificial
  CRISPR gRNA sequence
ttgcccatgttttatagaga

SEQ ID NO: 714861 - DNA, 20 bp, Artificial
  CRISPR gRNA sequence
gcctcggcctcccaaagtgc

SEQ ID NO: 714862 - DNA, 20 bp, Artificial
  CRISPR gRNA sequence
ctgaagtccatagtttacag

SEQ ID NO: 714863 - DNA, 20 bp, Artificial
  CRISPR gRNA sequence
cattctagggctttagacaa

SEQ ID NO: 714864 - DNA, 20 bp, Artificial
  CRISPR gRNA sequence
cccaccatcaccgtggcatc

SEQ ID NO: 714865 - DNA, 20 bp, Artificial
  CRISPR gRNA sequence
ttccagaaatgtcatgtagt

SEQ ID NO: 714866 - DNA, 20 bp, Artificial
  CRISPR gRNA sequence
tccaattttagtggtcacca

SEQ ID NO: 714867 - DNA, 20 bp, Artificial
  CRISPR gRNA sequence
atggaactcctcccgtgtct

SEQ ID NO: 714868 - DNA, 20 bp, Artificial
  CRISPR gRNA sequence
ttccattctgtctgtccggc

SEQ ID NO: 714869 - DNA, 20 bp, Artificial
  CRISPR gRNA sequence
gtctcctttggcgatgggcc

SEQ ID NO: 714870 - DNA, 20 bp, Artificial
  CRISPR gRNA sequence
gaacctcaagtctctgtcct

SEQ ID NO: 714871 - DNA, 20 bp, Artificial
  CRISPR gRNA sequence
ctgggagtttcctagaagat

SEQ ID NO: 714872 - DNA, 20 bp, Artificial
  CRISPR gRNA sequence
cctttcaggttcagggcatt

SEQ ID NO: 714873 - DNA, 20 bp, Artificial
  CRISPR gRNA sequence
aggctcaagacttgagaaac

SEQ ID NO: 714874 - DNA, 20 bp, Artificial
  CRISPR gRNA sequence
gggctgcttttaaccagaga

SEQ ID NO: 714875 - DNA, 20 bp, Artificial
  CRISPR gRNA sequence
gtatgggccacagaacctgt

SEQ ID NO: 714876 - DNA, 20 bp, Artificial
  CRISPR gRNA sequence
ggccacagaacctgtctggg

SEQ ID NO: 714877 - DNA, 20 bp, Artificial
  CRISPR gRNA sequence
tcttccagaagggaggcatg

SEQ ID NO: 714878 - DNA, 20 bp, Artificial
  CRISPR gRNA sequence
ccagaagggaggcatgagga

SEQ ID NO: 714879 - DNA, 20 bp, Artificial
  CRISPR gRNA sequence
gtgggctttggagcacagca

SEQ ID NO: 714880 - DNA, 20 bp, Artificial
  CRISPR gRNA sequence
cccccaaccaggtccttctc

SEQ ID NO: 714881 - DNA, 20 bp, Artificial
  CRISPR gRNA sequence
atgccctgttgtgcaaacct

SEQ ID NO: 714882 - DNA, 20 bp, Artificial
  CRISPR gRNA sequence
ccttcacagccagcccatcc

SEQ ID NO: 714883 - DNA, 20 bp, Artificial
  CRISPR gRNA sequence
atcttccccaccttctcacc

SEQ ID NO: 714884 - DNA, 20 bp, Artificial
  CRISPR gRNA sequence
cagcccccatggcagacagc

SEQ ID NO: 714885 - DNA, 20 bp, Artificial
  CRISPR gRNA sequence
tgacccttgcaagaccaaat

SEQ ID NO: 714886 - DNA, 20 bp, Artificial
  CRISPR gRNA sequence
acacacacacacacacacac

SEQ ID NO: 714887 - DNA, 20 bp, Artificial
  CRISPR gRNA sequence
caggcagatcacttgaggtc

SEQ ID NO: 714888 - DNA, 20 bp, Artificial
  CRISPR gRNA sequence
ttgagccattgcactccagc

SEQ ID NO: 714889 - DNA, 20 bp, Artificial
  CRISPR gRNA sequence
cttttagcggttcttggcgg

SEQ ID NO: 714890 - DNA, 20 bp, Artificial
  CRISPR gRNA sequence
acgtgtctaagccatcttcc

SEQ ID NO: 714891 - DNA, 20 bp, Artificial
  CRISPR gRNA sequence
ctaagccatcttcccagaat

SEQ ID NO: 714892 - DNA, 20 bp, Artificial
  CRISPR gRNA sequence
tcttcccagaatcagagtct

SEQ ID NO: 714893 - DNA, 20 bp, Artificial
  CRISPR gRNA sequence
gcactgtgtcctttgcaaat

SEQ ID NO: 714894 - DNA, 20 bp, Artificial
  CRISPR gRNA sequence
ctgctccccatagagattca

SEQ ID NO: 714895 - DNA, 20 bp, Artificial
  CRISPR gRNA sequence
agggagctccgagctggtgg

SEQ ID NO: 714896 - DNA, 20 bp, Artificial
  CRISPR gRNA sequence
gctccgagctggtggggggg

SEQ ID NO: 714897 - DNA, 20 bp, Artificial
  CRISPR gRNA sequence
gttcaaatctggtcaaattc

SEQ ID NO: 714898 - DNA, 20 bp, Artificial
  CRISPR gRNA sequence
cgggggagagcgctctgcta

SEQ ID NO: 714899 - DNA, 20 bp, Artificial
  CRISPR gRNA sequence
gcctccacccataagcaggg

SEQ ID NO: 714900 - DNA, 20 bp, Artificial
  CRISPR gRNA sequence
ccataagcaggggagagtgc

SEQ ID NO: 714901 - DNA, 20 bp, Artificial
  CRISPR gRNA sequence
tggactgggcagcagatacc

SEQ ID NO: 714902 - DNA, 20 bp, Artificial
  CRISPR gRNA sequence
gcatctttgtgaaaaacatc

SEQ ID NO: 714903 - DNA, 20 bp, Artificial
  CRISPR gRNA sequence
acttaaaatgcagctagggg

SEQ ID NO: 714904 - DNA, 20 bp, Artificial
  CRISPR gRNA sequence
attttgggaggctgaggcag

SEQ ID NO: 714905 - DNA, 20 bp, Artificial
  CRISPR gRNA sequence
caggcggatcacttgaagtc

SEQ ID NO: 714906 - DNA, 20 bp, Artificial
  CRISPR gRNA sequence
aaagttggccaggtgtggtg

SEQ ID NO: 714907 - DNA, 20 bp, Artificial
  CRISPR gRNA sequence
tacttgggaggctgaggcat

SEQ ID NO: 714908 - DNA, 20 bp, Artificial
  CRISPR gRNA sequence
ggctgaggcatgagaattgc

SEQ ID NO: 714909 - DNA, 20 bp, Artificial
  CRISPR gRNA sequence
ctgcactccaacctgggcga

SEQ ID NO: 714910 - DNA, 20 bp, Artificial
  CRISPR gRNA sequence
tgctgtgtgtacaatatgca

SEQ ID NO: 714911 - DNA, 20 bp, Artificial
  CRISPR gRNA sequence
ttcgaaaacttagtataaac

SEQ ID NO: 714912 - DNA, 20 bp, Artificial
  CRISPR gRNA sequence
atggtaatattttagatata

SEQ ID NO: 714913 - DNA, 20 bp, Artificial
  CRISPR gRNA sequence
accttttaaagtgtggctcc

SEQ ID NO: 714914 - DNA, 20 bp, Artificial
  CRISPR gRNA sequence
gccaaaccctggttaatctc

SEQ ID NO: 714915 - DNA, 20 bp, Artificial
  CRISPR gRNA sequence
tcacccatggggcagctctc

SEQ ID NO: 714916 - DNA, 20 bp, Artificial
  CRISPR gRNA sequence
cctcgatctgtcacccagac

SEQ ID NO: 714917 - DNA, 20 bp, Artificial
  CRISPR gRNA sequence
ctcactgcaacctctgcctc

SEQ ID NO: 714918 - DNA, 20 bp, Artificial
  CRISPR gRNA sequence
gattctcctgcctcagcctc

SEQ ID NO: 714919 - DNA, 20 bp, Artificial
  CRISPR gRNA sequence
gcctcagcctcctgagtagc

SEQ ID NO: 714920 - DNA, 20 bp, Artificial
  CRISPR gRNA sequence
ttttgtaattttagtagaga

SEQ ID NO: 714921 - DNA, 20 bp, Artificial
  CRISPR gRNA sequence
acctcggcctcccaaagtgt

SEQ ID NO: 714922 - DNA, 20 bp, Artificial
  CRISPR gRNA sequence
gccaccgtgcctggcgacat

SEQ ID NO: 714923 - DNA, 20 bp, Artificial
  CRISPR gRNA sequence
acgggtcaccttctaagtgt

SEQ ID NO: 714924 - DNA, 20 bp, Artificial
  CRISPR gRNA sequence
caccttctaagtgttgggat

SEQ ID NO: 714925 - DNA, 20 bp, Artificial
  CRISPR gRNA sequence
gtgttgggatgggagtccag

SEQ ID NO: 714926 - DNA, 20 bp, Artificial
  CRISPR gRNA sequence
atcctgacgacagcctggtg

SEQ ID NO: 714927 - DNA, 20 bp, Artificial
  CRISPR gRNA sequence
cagcactttgggaggctgag

SEQ ID NO: 714928 - DNA, 20 bp, Artificial
  CRISPR gRNA sequence
actttgggaggctgaggagg

SEQ ID NO: 714929 - DNA, 20 bp, Artificial
  CRISPR gRNA sequence
agggtggatcacctgaggtc

SEQ ID NO: 714930 - DNA, 20 bp, Artificial
  CRISPR gRNA sequence
tactcaggaggctgaggcag

SEQ ID NO: 714931 - DNA, 20 bp, Artificial
  CRISPR gRNA sequence
ctgcactccagcctgggcga

SEQ ID NO: 714932 - DNA, 20 bp, Artificial
  CRISPR gRNA sequence
ccagcattcttcaggactcc

SEQ ID NO: 714933 - DNA, 20 bp, Artificial
  CRISPR gRNA sequence
cacatgtagcttaaaagtct

SEQ ID NO: 714934 - DNA, 20 bp, Artificial
  CRISPR gRNA sequence
ctgagaagcttcaggcatgg

SEQ ID NO: 714935 - DNA, 20 bp, Artificial
  CRISPR gRNA sequence
aaaacctttaaatcccaaac

SEQ ID NO: 714936 - DNA, 20 bp, Artificial
  CRISPR gRNA sequence
ttaaattctacctcacaggc

SEQ ID NO: 714937 - DNA, 20 bp, Artificial
  CRISPR gRNA sequence
aactggctcatcgtggccag

SEQ ID NO: 714938 - DNA, 20 bp, Artificial
  CRISPR gRNA sequence
atcgtggccagaggaatgca

SEQ ID NO: 714939 - DNA, 20 bp, Artificial
  CRISPR gRNA sequence
tctcatggccactcgggaaa

SEQ ID NO: 714940 - DNA, 20 bp, Artificial
  CRISPR gRNA sequence
acagatgctgagatcagagg

SEQ ID NO: 714941 - DNA, 20 bp, Artificial
  CRISPR gRNA sequence
ctgctttactctgaagggga

SEQ ID NO: 714942 - DNA, 20 bp, Artificial
  CRISPR gRNA sequence
tgaaggggaacgggtgccag

SEQ ID NO: 714943 - DNA, 20 bp, Artificial
  CRISPR gRNA sequence
gactctggcctgtggtagtg

SEQ ID NO: 714944 - DNA, 20 bp, Artificial
  CRISPR gRNA sequence
agggtgtattccgggagact

SEQ ID NO: 714945 - DNA, 20 bp, Artificial
  CRISPR gRNA sequence
gtctgtgagccggcttcccc

SEQ ID NO: 714946 - DNA, 20 bp, Artificial
  CRISPR gRNA sequence
gcccatggtacaactgggct

SEQ ID NO: 714947 - DNA, 20 bp, Artificial
  CRISPR gRNA sequence
aactgggctgggggtgtaag

SEQ ID NO: 714948 - DNA, 20 bp, Artificial
  CRISPR gRNA sequence
agcccatggtgtcagcactt

SEQ ID NO: 714949 - DNA, 20 bp, Artificial
  CRISPR gRNA sequence
cctcagatcatttgaggccc

SEQ ID NO: 714950 - DNA, 20 bp, Artificial
  CRISPR gRNA sequence
ggcctcccttgccccattgg

SEQ ID NO: 714951 - DNA, 20 bp, Artificial
  CRISPR gRNA sequence
ggtaatttccccatgaagct

SEQ ID NO: 714952 - DNA, 20 bp, Artificial
  CRISPR gRNA sequence
gaagctgtgggtcgtctccc

SEQ ID NO: 714953 - DNA, 20 bp, Artificial
  CRISPR gRNA sequence
ctccctggggtgctcgattg

SEQ ID NO: 714954 - DNA, 20 bp, Artificial
  CRISPR gRNA sequence
gctcgattggtggatggccc

SEQ ID NO: 714955 - DNA, 20 bp, Artificial
  CRISPR gRNA sequence
ttggtggatggcccatgagt

SEQ ID NO: 714956 - DNA, 20 bp, Artificial
  CRISPR gRNA sequence
cgttggtttgtcagagggaa

SEQ ID NO: 714957 - DNA, 20 bp, Artificial
  CRISPR gRNA sequence
ccctcctggtctccatggcg

SEQ ID NO: 714958 - DNA, 20 bp, Artificial
  CRISPR gRNA sequence
tctttttcttttttttgaga

SEQ ID NO: 714959 - DNA, 20 bp, Artificial
  CRISPR gRNA sequence
ttcgctcatgttgcccaggc

SEQ ID NO: 714960 - DNA, 20 bp, Artificial
  CRISPR gRNA sequence
ctcactgccacctccacctc

SEQ ID NO: 714961 - DNA, 20 bp, Artificial
  CRISPR gRNA sequence
gattctcctgcctcagcctc

SEQ ID NO: 714962 - DNA, 20 bp, Artificial
  CRISPR gRNA sequence
gcctcagcctcctgagtagc

SEQ ID NO: 714963 - DNA, 20 bp, Artificial
  CRISPR gRNA sequence
ctttgtatttttagtagaga

SEQ ID NO: 714964 - DNA, 20 bp, Artificial
  CRISPR gRNA sequence
tcggcctcccaaagtgctgg

SEQ ID NO: 714965 - DNA, 20 bp, Artificial
  CRISPR gRNA sequence
aacctagtcccattttatta

SEQ ID NO: 714966 - DNA, 20 bp, Artificial
  CRISPR gRNA sequence
gagctctgtttatccagttt

SEQ ID NO: 714967 - DNA, 20 bp, Artificial
  CRISPR gRNA sequence
tttatccagtttttgaatat

SEQ ID NO: 714968 - DNA, 20 bp, Artificial
  CRISPR gRNA sequence
tgtatgtgctttcctttctc

SEQ ID NO: 714969 - DNA, 20 bp, Artificial
  CRISPR gRNA sequence
gggttggttttgtaaaaaaa

SEQ ID NO: 714970 - DNA, 20 bp, Artificial
  CRISPR gRNA sequence
ttgtgggacttctaacaatt

SEQ ID NO: 714971 - DNA, 20 bp, Artificial
  CRISPR gRNA sequence
ttgtggtttgtttttttgag

SEQ ID NO: 714972 - DNA, 20 bp, Artificial
  CRISPR gRNA sequence
tcttgctctgtcgcccagac

SEQ ID NO: 714973 - DNA, 20 bp, Artificial
  CRISPR gRNA sequence
ctcactgcaacctccgcctc

SEQ ID NO: 714974 - DNA, 20 bp, Artificial
  CRISPR gRNA sequence
aattctcctgcctcagcctc

SEQ ID NO: 714975 - DNA, 20 bp, Artificial
  CRISPR gRNA sequence
gcctcagcctcccgagtagc

SEQ ID NO: 714976 - DNA, 20 bp, Artificial
  CRISPR gRNA sequence
tttcttttttttagtagaga

SEQ ID NO: 714977 - DNA, 20 bp, Artificial
  CRISPR gRNA sequence
gcctcagcctcccaaagtgc

SEQ ID NO: 714978 - DNA, 20 bp, Artificial
  CRISPR gRNA sequence
tgcccaataccattctgaac

SEQ ID NO: 714979 - DNA, 20 bp, Artificial
  CRISPR gRNA sequence
gttcccaaagttttgagcag

SEQ ID NO: 714980 - DNA, 20 bp, Artificial
  CRISPR gRNA sequence
ggagtgacagagccatgaga

SEQ ID NO: 714981 - DNA, 20 bp, Artificial
  CRISPR gRNA sequence
caggggctggttggggggca

SEQ ID NO: 714982 - DNA, 20 bp, Artificial
  CRISPR gRNA sequence
atgagtaccctcctctcgtg

SEQ ID NO: 714983 - DNA, 20 bp, Artificial
  CRISPR gRNA sequence
ggctggactgagctgacatg

SEQ ID NO: 714984 - DNA, 20 bp, Artificial
  CRISPR gRNA sequence
tttgggagctggccacggtg

SEQ ID NO: 714985 - DNA, 20 bp, Artificial
  CRISPR gRNA sequence
cggtgagggatggggggctt

SEQ ID NO: 714986 - DNA, 20 bp, Artificial
  CRISPR gRNA sequence
agggatggggggcttcaggg

SEQ ID NO: 714987 - DNA, 20 bp, Artificial
  CRISPR gRNA sequence
gggggcttcagggttgggtg

SEQ ID NO: 714988 - DNA, 20 bp, Artificial
  CRISPR gRNA sequence
cccaacacagccatgcccag

SEQ ID NO: 714989 - DNA, 20 bp, Artificial
  CRISPR gRNA sequence
aactactcccccttatgttt

SEQ ID NO: 714990 - DNA, 20 bp, Artificial
  CRISPR gRNA sequence
tatgtttgtgggtttttgat

SEQ ID NO: 714991 - DNA, 20 bp, Artificial
  CRISPR gRNA sequence
tttccttccaggaagcgttt

SEQ ID NO: 714992 - DNA, 20 bp, Artificial
  CRISPR gRNA sequence
aacttccaagggctgtgggc

SEQ ID NO: 714993 - DNA, 20 bp, Artificial
  CRISPR gRNA sequence
ctttttttttttttcccaga

SEQ ID NO: 714994 - DNA, 20 bp, Artificial
  CRISPR gRNA sequence
cccaagctgcagtacggtgg

SEQ ID NO: 714995 - DNA, 20 bp, Artificial
  CRISPR gRNA sequence
tccctgcagctgtgacctcc

SEQ ID NO: 714996 - DNA, 20 bp, Artificial
  CRISPR gRNA sequence
aaattttttttcatacagat

SEQ ID NO: 714997 - DNA, 20 bp, Artificial
  CRISPR gRNA sequence
accttggcttcctaaattgc

SEQ ID NO: 714998 - DNA, 20 bp, Artificial
  CRISPR gRNA sequence
gctgttttgacaagcactta

SEQ ID NO: 714999 - DNA, 20 bp, Artificial
  CRISPR gRNA sequence
ccccgaggggcatgtgggca

SEQ ID NO: 715000 - DNA, 20 bp, Artificial
  CRISPR gRNA sequence
ggctattcacggaggccact

SEQ ID NO: 715001 - DNA, 20 bp, Artificial
  CRISPR gRNA sequence
gctgcttttgggcagcaaag

SEQ ID NO: 715002 - DNA, 20 bp, Artificial
  CRISPR gRNA sequence
ttgggcagcaaagcagagtg

SEQ ID NO: 715003 - DNA, 20 bp, Artificial
  CRISPR gRNA sequence
tctttgtactcacagattct

SEQ ID NO: 715004 - DNA, 20 bp, Artificial
  CRISPR gRNA sequence
tactcacagattctgtgagt

SEQ ID NO: 715005 - DNA, 20 bp, Artificial
  CRISPR gRNA sequence
cttcattcattcacctgcct

SEQ ID NO: 715006 - DNA, 20 bp, Artificial
  CRISPR gRNA sequence
ttttgtatttttagtagaga

SEQ ID NO: 715007 - DNA, 20 bp, Artificial
  CRISPR gRNA sequence
gccttggcctcccaaagtgt

SEQ ID NO: 715008 - DNA, 20 bp, Artificial
  CRISPR gRNA sequence
gagagagacagacagaaaga

SEQ ID NO: 715009 - DNA, 20 bp, Artificial
  CRISPR gRNA sequence
gagacagaaagagggagaga

SEQ ID NO: 715010 - DNA, 20 bp, Artificial
  CRISPR gRNA sequence
gagagacagagagaaagaga

SEQ ID NO: 715011 - DNA, 20 bp, Artificial
  CRISPR gRNA sequence
gacagaatgagagggagaga

SEQ ID NO: 715012 - DNA, 20 bp, Artificial
  CRISPR gRNA sequence
gagacagaaagagaaagaga

SEQ ID NO: 715013 - DNA, 20 bp, Artificial
  CRISPR gRNA sequence
gagacagagagagacagaga

SEQ ID NO: 715014 - DNA, 20 bp, Artificial
  CRISPR gRNA sequence
actgaaaccccacgaggcag

SEQ ID NO: 715015 - DNA, 20 bp, Artificial
  CRISPR gRNA sequence
aaaggcatgagctctagaac

SEQ ID NO: 715016 - DNA, 20 bp, Artificial
  CRISPR gRNA sequence
tgagctctagaacccgagtg

SEQ ID NO: 715017 - DNA, 20 bp, Artificial
  CRISPR gRNA sequence
tctatctcagagaaccatgt

SEQ ID NO: 715018 - DNA, 20 bp, Artificial
  CRISPR gRNA sequence
ctcagagaaccatgtgagaa

SEQ ID NO: 715019 - DNA, 20 bp, Artificial
  CRISPR gRNA sequence
atacatgattgtaggttaat

SEQ ID NO: 715020 - DNA, 20 bp, Artificial
  CRISPR gRNA sequence
tgattgtaggttaatctggg

SEQ ID NO: 715021 - DNA, 20 bp, Artificial
  CRISPR gRNA sequence
tcctgcccagttcccttgct

SEQ ID NO: 715022 - DNA, 20 bp, Artificial
  CRISPR gRNA sequence
cagcccttatcattatcatg

SEQ ID NO: 715023 - DNA, 20 bp, Artificial
  CRISPR gRNA sequence
tggagcgttgcaaaatattc

SEQ ID NO: 715024 - DNA, 20 bp, Artificial
  CRISPR gRNA sequence
tttttttttttttaaataga

SEQ ID NO: 715025 - DNA, 20 bp, Artificial
  CRISPR gRNA sequence
tcttgttctgtcgcccaggc

SEQ ID NO: 715026 - DNA, 20 bp, Artificial
  CRISPR gRNA sequence
gattctcctgcctcagcctc

SEQ ID NO: 715027 - DNA, 20 bp, Artificial
  CRISPR gRNA sequence
gcctcagcctcctgagtagc

SEQ ID NO: 715028 - DNA, 20 bp, Artificial
  CRISPR gRNA sequence
ttttgtatttttagtagaga

SEQ ID NO: 715029 - DNA, 20 bp, Artificial
  CRISPR gRNA sequence
gcctcggcctcccaaagtgc

SEQ ID NO: 715030 - DNA, 20 bp, Artificial
  CRISPR gRNA sequence
atttcaaacatattcagatg

SEQ ID NO: 715031 - DNA, 20 bp, Artificial
  CRISPR gRNA sequence
caaacatattcagatgtaga

SEQ ID NO: 715032 - DNA, 20 bp, Artificial
  CRISPR gRNA sequence
cacccagctttaaacggtta

SEQ ID NO: 715033 - DNA, 20 bp, Artificial
  CRISPR gRNA sequence
atggtaaagtgcatagatta

SEQ ID NO: 715034 - DNA, 20 bp, Artificial
  CRISPR gRNA sequence
atccccctctaaaagttacc

SEQ ID NO: 715035 - DNA, 20 bp, Artificial
  CRISPR gRNA sequence
ttgcatgtaaatgcgacata

SEQ ID NO: 715036 - DNA, 20 bp, Artificial
  CRISPR gRNA sequence
gcctgccttctttcaccctg

SEQ ID NO: 715037 - DNA, 20 bp, Artificial
  CRISPR gRNA sequence
gacgagcatttattttcttg

SEQ ID NO: 715038 - DNA, 20 bp, Artificial
  CRISPR gRNA sequence
atggaactcctcccgcacct

SEQ ID NO: 715039 - DNA, 20 bp, Artificial
  CRISPR gRNA sequence
cagagacggtcaccaagccc

SEQ ID NO: 715040 - DNA, 20 bp, Artificial
  CRISPR gRNA sequence
cccaccccaggcctcgacca

SEQ ID NO: 715041 - DNA, 20 bp, Artificial
  CRISPR gRNA sequence
cccaggcctcgaccacaggg

SEQ ID NO: 715042 - DNA, 20 bp, Artificial
  CRISPR gRNA sequence
gcctctccccaccaacagcc

SEQ ID NO: 715043 - DNA, 20 bp, Artificial
  CRISPR gRNA sequence
ggctgttcattaggtcaggt

SEQ ID NO: 715044 - DNA, 20 bp, Artificial
  CRISPR gRNA sequence
gtttgggttctggttatcct

SEQ ID NO: 715045 - DNA, 20 bp, Artificial
  CRISPR gRNA sequence
cctttgagtagtcagactca

SEQ ID NO: 715046 - DNA, 20 bp, Artificial
  CRISPR gRNA sequence
gagtagtcagactcagtgaa

SEQ ID NO: 715047 - DNA, 20 bp, Artificial
  CRISPR gRNA sequence
aaatctttatatttttgaga

SEQ ID NO: 715048 - DNA, 20 bp, Artificial
  CRISPR gRNA sequence
ttcgctcatgttgcccaggc

SEQ ID NO: 715049 - DNA, 20 bp, Artificial
  CRISPR gRNA sequence
ctcaccgcaacctgcacctc

SEQ ID NO: 715050 - DNA, 20 bp, Artificial
  CRISPR gRNA sequence
aattctcctgcctcagcctt

SEQ ID NO: 715051 - DNA, 20 bp, Artificial
  CRISPR gRNA sequence
gcctcagccttctgagtagc

SEQ ID NO: 715052 - DNA, 20 bp, Artificial
  CRISPR gRNA sequence
accttggcctctcaaagtgc

SEQ ID NO: 715053 - DNA, 20 bp, Artificial
  CRISPR gRNA sequence
tgttttattgacttagagag

SEQ ID NO: 715054 - DNA, 20 bp, Artificial
  CRISPR gRNA sequence
aggtggtttaaaacagatgg

SEQ ID NO: 715055 - DNA, 20 bp, Artificial
  CRISPR gRNA sequence
agagtggtgacaaaaccaag

SEQ ID NO: 715056 - DNA, 20 bp, Artificial
  CRISPR gRNA sequence
actttgggaggctgaggcag

SEQ ID NO: 715057 - DNA, 20 bp, Artificial
  CRISPR gRNA sequence
caggtggatcacttgaggtc

SEQ ID NO: 715058 - DNA, 20 bp, Artificial
  CRISPR gRNA sequence
actaaaaatacacaaattag

SEQ ID NO: 715059 - DNA, 20 bp, Artificial
  CRISPR gRNA sequence
tactcaggaggttgaggcag

SEQ ID NO: 715060 - DNA, 20 bp, Artificial
  CRISPR gRNA sequence
tgagggctgccagagaagtg

SEQ ID NO: 715061 - DNA, 20 bp, Artificial
  CRISPR gRNA sequence
ccagtttgcacagatgatgc

SEQ ID NO: 715062 - DNA, 20 bp, Artificial
  CRISPR gRNA sequence
ttttcctctttttttagaga

SEQ ID NO: 715063 - DNA, 20 bp, Artificial
  CRISPR gRNA sequence
ctcactgcaacctccgtctc

SEQ ID NO: 715064 - DNA, 20 bp, Artificial
  CRISPR gRNA sequence
aattctcctgcctcagcctc

SEQ ID NO: 715065 - DNA, 20 bp, Artificial
  CRISPR gRNA sequence
gcctcagcctcccgagtagc

SEQ ID NO: 715066 - DNA, 20 bp, Artificial
  CRISPR gRNA sequence
tttcatatttttagtagaga

SEQ ID NO: 715067 - DNA, 20 bp, Artificial
  CRISPR gRNA sequence
gcctccacctcccaaagtgc

SEQ ID NO: 715068 - DNA, 20 bp, Artificial
  CRISPR gRNA sequence
cctggccaacaattgtcttc

SEQ ID NO: 715069 - DNA, 20 bp, Artificial
  CRISPR gRNA sequence
ttcttgagtcagaacattga

SEQ ID NO: 715070 - DNA, 20 bp, Artificial
  CRISPR gRNA sequence
gggaaagttcgggccactag

SEQ ID NO: 715071 - DNA, 20 bp, Artificial
  CRISPR gRNA sequence
gtttgtaaagccctctttac

SEQ ID NO: 715072 - DNA, 20 bp, Artificial
  CRISPR gRNA sequence
acactctccgcccatgggcc

SEQ ID NO: 715073 - DNA, 20 bp, Artificial
  CRISPR gRNA sequence
aactgtccccgctcagtgac

SEQ ID NO: 715074 - DNA, 20 bp, Artificial
  CRISPR gRNA sequence
tcagtgactggaatattcag

SEQ ID NO: 715075 - DNA, 20 bp, Artificial
  CRISPR gRNA sequence
ggaatattcagtagagtcct

SEQ ID NO: 715076 - DNA, 20 bp, Artificial
  CRISPR gRNA sequence
attttgtttgcataaatgta

SEQ ID NO: 715077 - DNA, 20 bp, Artificial
  CRISPR gRNA sequence
aattttattacatgcttaga

SEQ ID NO: 715078 - DNA, 20 bp, Artificial
  CRISPR gRNA sequence
ggtggtgaactcaggacgtt

SEQ ID NO: 715079 - DNA, 20 bp, Artificial
  CRISPR gRNA sequence
cagtatttgtctttctgtgt

SEQ ID NO: 715080 - DNA, 20 bp, Artificial
  CRISPR gRNA sequence
gtgtctgaatgtctgcactt

SEQ ID NO: 715081 - DNA, 20 bp, Artificial
  CRISPR gRNA sequence
gatttctttccttatgatgg

SEQ ID NO: 715082 - DNA, 20 bp, Artificial
  CRISPR gRNA sequence
gatgccacatttatctattg

SEQ ID NO: 715083 - DNA, 20 bp, Artificial
  CRISPR gRNA sequence
tctcgctctgttgcccaggc

SEQ ID NO: 715084 - DNA, 20 bp, Artificial
  CRISPR gRNA sequence
ctcacggcaacctctgcctc

SEQ ID NO: 715085 - DNA, 20 bp, Artificial
  CRISPR gRNA sequence
gcctcagcctcccaagtagc

SEQ ID NO: 715086 - DNA, 20 bp, Artificial
  CRISPR gRNA sequence
ttttgtatttttagtagaga

SEQ ID NO: 715087 - DNA, 20 bp, Artificial
  CRISPR gRNA sequence
gcctcagcctcccaaagtgc

SEQ ID NO: 715088 - DNA, 20 bp, Artificial
  CRISPR gRNA sequence
ataacccttttaaaataaat

SEQ ID NO: 715089 - DNA, 20 bp, Artificial
  CRISPR gRNA sequence
gaaaaaccagccctacaaag

SEQ ID NO: 715090 - DNA, 20 bp, Artificial
  CRISPR gRNA sequence
catgaagctttgataaatcc

SEQ ID NO: 715091 - DNA, 20 bp, Artificial
  CRISPR gRNA sequence
tttgataaatccaggaatag

SEQ ID NO: 715092 - DNA, 20 bp, Artificial
  CRISPR gRNA sequence
ttacatccataaggtgggca

SEQ ID NO: 715093 - DNA, 20 bp, Artificial
  CRISPR gRNA sequence
tgctatgaaaaggaacaata

SEQ ID NO: 715094 - DNA, 20 bp, Artificial
  CRISPR gRNA sequence
tttcttttctttttttgaga

SEQ ID NO: 715095 - DNA, 20 bp, Artificial
  CRISPR gRNA sequence
tctcactctgtcgcccaggc

SEQ ID NO: 715096 - DNA, 20 bp, Artificial
  CRISPR gRNA sequence
cccaccacaacctccacctc

SEQ ID NO: 715097 - DNA, 20 bp, Artificial
  CRISPR gRNA sequence
agttttcctgcctcagcctc

SEQ ID NO: 715098 - DNA, 20 bp, Artificial
  CRISPR gRNA sequence
gcctcagcctcctgagtagc

SEQ ID NO: 715099 - DNA, 20 bp, Artificial
  CRISPR gRNA sequence
ttttgtatttttagtagaga

SEQ ID NO: 715100 - DNA, 20 bp, Artificial
  CRISPR gRNA sequence
cctcggcctcgcaaaagtgc

SEQ ID NO: 715101 - DNA, 20 bp, Artificial
  CRISPR gRNA sequence
aggacctaccaagagcaaag

SEQ ID NO: 715102 - DNA, 20 bp, Artificial
  CRISPR gRNA sequence
tacctgccggttgatggcat

SEQ ID NO: 715103 - DNA, 20 bp, Artificial
  CRISPR gRNA sequence
gtttccagtttagggctatt

SEQ ID NO: 715104 - DNA, 20 bp, Artificial
  CRISPR gRNA sequence
tattatgaatgaaaacagct

SEQ ID NO: 715105 - DNA, 20 bp, Artificial
  CRISPR gRNA sequence
tttttttttttttaacatgt

SEQ ID NO: 715106 - DNA, 20 bp, Artificial
  CRISPR gRNA sequence
atttttattatttttagaga

SEQ ID NO: 715107 - DNA, 20 bp, Artificial
  CRISPR gRNA sequence
tctcactctgtgttccaggc

SEQ ID NO: 715108 - DNA, 20 bp, Artificial
  CRISPR gRNA sequence
gccgattcttgtacaagtct

SEQ ID NO: 715109 - DNA, 20 bp, Artificial
  CRISPR gRNA sequence
attcttgtacaagtctttgg

SEQ ID NO: 715110 - DNA, 20 bp, Artificial
  CRISPR gRNA sequence
gatgtatattttcatttttc

SEQ ID NO: 715111 - DNA, 20 bp, Artificial
  CRISPR gRNA sequence
ttcatgggtaaatacctagg

SEQ ID NO: 715112 - DNA, 20 bp, Artificial
  CRISPR gRNA sequence
cattgtgctggtcacatagt

SEQ ID NO: 715113 - DNA, 20 bp, Artificial
  CRISPR gRNA sequence
tttttgaggactagtcaaag

SEQ ID NO: 715114 - DNA, 20 bp, Artificial
  CRISPR gRNA sequence
cacagggccgaagctagaac

SEQ ID NO: 715115 - DNA, 20 bp, Artificial
  CRISPR gRNA sequence
cgaagctagaaccagaatgc

SEQ ID NO: 715116 - DNA, 20 bp, Artificial
  CRISPR gRNA sequence
aaccagaatgcagggatccc

SEQ ID NO: 715117 - DNA, 20 bp, Artificial
  CRISPR gRNA sequence
agggatcccaagggtcagcc

SEQ ID NO: 715118 - DNA, 20 bp, Artificial
  CRISPR gRNA sequence
ctccttcttagttctgaacc

SEQ ID NO: 715119 - DNA, 20 bp, Artificial
  CRISPR gRNA sequence
agaaaaacaacaggaagcca

SEQ ID NO: 715120 - DNA, 20 bp, Artificial
  CRISPR gRNA sequence
agagcaaggaagggaagtcc

SEQ ID NO: 715121 - DNA, 20 bp, Artificial
  CRISPR gRNA sequence
ggctccgaggaagtgttccc

SEQ ID NO: 715122 - DNA, 20 bp, Artificial
  CRISPR gRNA sequence
gtgttcccaggaatagaaga

SEQ ID NO: 715123 - DNA, 20 bp, Artificial
  CRISPR gRNA sequence
gtagtaaatttcatgattag

SEQ ID NO: 715124 - DNA, 20 bp, Artificial
  CRISPR gRNA sequence
ttagtagagttgaaaagcct

SEQ ID NO: 715125 - DNA, 20 bp, Artificial
  CRISPR gRNA sequence
cacctgattttaagcgattg

SEQ ID NO: 715126 - DNA, 20 bp, Artificial
  CRISPR gRNA sequence
gattgctggatgtacaaaaa

SEQ ID NO: 715127 - DNA, 20 bp, Artificial
  CRISPR gRNA sequence
ttctttaaatggcccaagga

SEQ ID NO: 715128 - DNA, 20 bp, Artificial
  CRISPR gRNA sequence
atggcccaaggactgggtgt

SEQ ID NO: 715129 - DNA, 20 bp, Artificial
  CRISPR gRNA sequence
ttttagttcttaaatggagg

SEQ ID NO: 715130 - DNA, 20 bp, Artificial
  CRISPR gRNA sequence
tccaaagaggaggaaaaggg

SEQ ID NO: 715131 - DNA, 20 bp, Artificial
  CRISPR gRNA sequence
aggtatagtatattcagaga

SEQ ID NO: 715132 - DNA, 20 bp, Artificial
  CRISPR gRNA sequence
gaggggatgagaggcaccca

SEQ ID NO: 715133 - DNA, 20 bp, Artificial
  CRISPR gRNA sequence
gagggacagcagatctgtcg

SEQ ID NO: 715134 - DNA, 20 bp, Artificial
  CRISPR gRNA sequence
ctctcctcatgatgctgact

SEQ ID NO: 715135 - DNA, 20 bp, Artificial
  CRISPR gRNA sequence
actgggaatagccacagtta

SEQ ID NO: 715136 - DNA, 20 bp, Artificial
  CRISPR gRNA sequence
aggctccagctaattcaggt

SEQ ID NO: 715137 - DNA, 20 bp, Artificial
  CRISPR gRNA sequence
cagtgaccttccccaaagag

SEQ ID NO: 715138 - DNA, 20 bp, Artificial
  CRISPR gRNA sequence
acactttgtagaggggagat

SEQ ID NO: 715139 - DNA, 20 bp, Artificial
  CRISPR gRNA sequence
gggagatgtgggtatgtgtg

SEQ ID NO: 715140 - DNA, 20 bp, Artificial
  CRISPR gRNA sequence
tgctttgtaccacatcaaaa

SEQ ID NO: 715141 - DNA, 20 bp, Artificial
  CRISPR gRNA sequence
ggtgcctccaccagggctct

SEQ ID NO: 715142 - DNA, 20 bp, Artificial
  CRISPR gRNA sequence
ggaggcagtgccatccagag

SEQ ID NO: 715143 - DNA, 20 bp, Artificial
  CRISPR gRNA sequence
ccatctgtaaaacaaggtag

SEQ ID NO: 715144 - DNA, 20 bp, Artificial
  CRISPR gRNA sequence
acccttcctaggcactcaag

SEQ ID NO: 715145 - DNA, 20 bp, Artificial
  CRISPR gRNA sequence
gttcacacagaggcacgcac

SEQ ID NO: 715146 - DNA, 20 bp, Artificial
  CRISPR gRNA sequence
aaatgtccatcaactagcga

SEQ ID NO: 715147 - DNA, 20 bp, Artificial
  CRISPR gRNA sequence
aacgccatttggcaacagaa

SEQ ID NO: 715148 - DNA, 20 bp, Artificial
  CRISPR gRNA sequence
ggcaacagaaaggaatgaag

SEQ ID NO: 715149 - DNA, 20 bp, Artificial
  CRISPR gRNA sequence
acagaaaggaatgaagctga

SEQ ID NO: 715150 - DNA, 20 bp, Artificial
  CRISPR gRNA sequence
tgaatatcaaaaacattatg

SEQ ID NO: 715151 - DNA, 20 bp, Artificial
  CRISPR gRNA sequence
gtggaagaagccagacccca

SEQ ID NO: 715152 - DNA, 20 bp, Artificial
  CRISPR gRNA sequence
taaagcagatcggtggttgc

SEQ ID NO: 715153 - DNA, 20 bp, Artificial
  CRISPR gRNA sequence
cctggatctggaggtggggg

SEQ ID NO: 715154 - DNA, 20 bp, Artificial
  CRISPR gRNA sequence
gatctggaggtgggggcaga

SEQ ID NO: 715155 - DNA, 20 bp, Artificial
  CRISPR gRNA sequence
ggcactagggaaccttctgg

SEQ ID NO: 715156 - DNA, 20 bp, Artificial
  CRISPR gRNA sequence
agggaaccttctggagggat

SEQ ID NO: 715157 - DNA, 20 bp, Artificial
  CRISPR gRNA sequence
agaatgttctgtattttgat

SEQ ID NO: 715158 - DNA, 20 bp, Artificial
  CRISPR gRNA sequence
ttacttattaaaaatagaga

SEQ ID NO: 715159 - DNA, 20 bp, Artificial
  CRISPR gRNA sequence
gcttcagcctcccaaagtgc

SEQ ID NO: 715160 - DNA, 20 bp, Artificial
  CRISPR gRNA sequence
ggagccaccctaccctgcca

SEQ ID NO: 715161 - DNA, 20 bp, Artificial
  CRISPR gRNA sequence
actttgggaggctgaggtgg

SEQ ID NO: 715162 - DNA, 20 bp, Artificial
  CRISPR gRNA sequence
tgggcggatcacttgaggtc

SEQ ID NO: 715163 - DNA, 20 bp, Artificial
  CRISPR gRNA sequence
tactcaggaggctgaggcag

SEQ ID NO: 715164 - DNA, 20 bp, Artificial
  CRISPR gRNA sequence
ggctgaggcaggagaatcac

SEQ ID NO: 715165 - DNA, 20 bp, Artificial
  CRISPR gRNA sequence
agcgtcactgtttcaccttc

SEQ ID NO: 715166 - DNA, 20 bp, Artificial
  CRISPR gRNA sequence
tccactttgttttatttatt

SEQ ID NO: 715167 - DNA, 20 bp, Artificial
  CRISPR gRNA sequence
tctttctctgtcgcccaggc

SEQ ID NO: 715168 - DNA, 20 bp, Artificial
  CRISPR gRNA sequence
ctcactgcagcctccacctc

SEQ ID NO: 715169 - DNA, 20 bp, Artificial
  CRISPR gRNA sequence
gattctcctgcctcagcctc

SEQ ID NO: 715170 - DNA, 20 bp, Artificial
  CRISPR gRNA sequence
gcctcagcctcctgagtagc

SEQ ID NO: 715171 - DNA, 20 bp, Artificial
  CRISPR gRNA sequence
ttttgtgtttttagtagaga

SEQ ID NO: 715172 - DNA, 20 bp, Artificial
  CRISPR gRNA sequence
cggactgcaaccccacccca

SEQ ID NO: 715173 - DNA, 20 bp, Artificial
  CRISPR gRNA sequence
agctgtccctgccatgccca

SEQ ID NO: 715174 - DNA, 20 bp, Artificial
  CRISPR gRNA sequence
gcctgggaggcagctgggct

SEQ ID NO: 715175 - DNA, 20 bp, Artificial
  CRISPR gRNA sequence
cctggcagagactcggggca

SEQ ID NO: 715176 - DNA, 20 bp, Artificial
  CRISPR gRNA sequence
ttgcgcagtctccagagaaa

SEQ ID NO: 715177 - DNA, 20 bp, Artificial
  CRISPR gRNA sequence
cctccacggggaagcccgtt

SEQ ID NO: 715178 - DNA, 20 bp, Artificial
  CRISPR gRNA sequence
gggcttcctcctggggaagt

SEQ ID NO: 715179 - DNA, 20 bp, Artificial
  CRISPR gRNA sequence
caggagggagcttctccttt

SEQ ID NO: 715180 - DNA, 20 bp, Artificial
  CRISPR gRNA sequence
tgtgggtatggtctgagaag

SEQ ID NO: 715181 - DNA, 20 bp, Artificial
  CRISPR gRNA sequence
gaccccaggtttctggcttc

SEQ ID NO: 715182 - DNA, 20 bp, Artificial
  CRISPR gRNA sequence
gattctcctgtctcagcctc

SEQ ID NO: 715183 - DNA, 20 bp, Artificial
  CRISPR gRNA sequence
tgtctcagcctcccgagtag

SEQ ID NO: 715184 - DNA, 20 bp, Artificial
  CRISPR gRNA sequence
tttttaatttttagtagaga

SEQ ID NO: 715185 - DNA, 20 bp, Artificial
  CRISPR gRNA sequence
gcttcagcctcccaaagtgc

SEQ ID NO: 715186 - DNA, 20 bp, Artificial
  CRISPR gRNA sequence
attctttaattcttgtaggc

SEQ ID NO: 715187 - DNA, 20 bp, Artificial
  CRISPR gRNA sequence
tggtaatggcagagaccgtg

SEQ ID NO: 715188 - DNA, 20 bp, Artificial
  CRISPR gRNA sequence
gcattgtagacggcctctgt

SEQ ID NO: 715189 - DNA, 20 bp, Artificial
  CRISPR gRNA sequence
cagcactttgggaggccaag

SEQ ID NO: 715190 - DNA, 20 bp, Artificial
  CRISPR gRNA sequence
actttgggaggccaaggtgg

SEQ ID NO: 715191 - DNA, 20 bp, Artificial
  CRISPR gRNA sequence
ggtgggtggatcacgaggtc

SEQ ID NO: 715192 - DNA, 20 bp, Artificial
  CRISPR gRNA sequence
tactcaggaggctgaggcag

SEQ ID NO: 715193 - DNA, 20 bp, Artificial
  CRISPR gRNA sequence
ctgcactccagcctgagcag

SEQ ID NO: 715194 - DNA, 20 bp, Artificial
  CRISPR gRNA sequence
tccagcctgagcagcagaat

SEQ ID NO: 715195 - DNA, 20 bp, Artificial
  CRISPR gRNA sequence
acaaaacaaacaaaaccccc

SEQ ID NO: 715196 - DNA, 20 bp, Artificial
  CRISPR gRNA sequence
ggtggcagtagtgctccggc

SEQ ID NO: 715197 - DNA, 20 bp, Artificial
  CRISPR gRNA sequence
tgggccccatcccagaccta

SEQ ID NO: 715198 - DNA, 20 bp, Artificial
  CRISPR gRNA sequence
tgacaaaagggaaaaacgaa

SEQ ID NO: 715199 - DNA, 20 bp, Artificial
  CRISPR gRNA sequence
gtgaagaagtagatctagat

SEQ ID NO: 715200 - DNA, 20 bp, Artificial
  CRISPR gRNA sequence
ggggctctgccacttactct

SEQ ID NO: 715201 - DNA, 20 bp, Artificial
  CRISPR gRNA sequence
tagtgacggtgcctagggca

SEQ ID NO: 715202 - DNA, 20 bp, Artificial
  CRISPR gRNA sequence
ggtgcctagggcatagggtt

SEQ ID NO: 715203 - DNA, 20 bp, Artificial
  CRISPR gRNA sequence
attcattcagggaacgcttg

SEQ ID NO: 715204 - DNA, 20 bp, Artificial
  CRISPR gRNA sequence
gccctcatcaagcaggtcta

SEQ ID NO: 715205 - DNA, 20 bp, Artificial
  CRISPR gRNA sequence
gagggttggccgggagggga

SEQ ID NO: 715206 - DNA, 20 bp, Artificial
  CRISPR gRNA sequence
tggagccaggcgagggaggg

SEQ ID NO: 715207 - DNA, 20 bp, Artificial
  CRISPR gRNA sequence
tgtgtggttgcagcaaggca

SEQ ID NO: 715208 - DNA, 20 bp, Artificial
  CRISPR gRNA sequence
gttccagggccagtgctctt

SEQ ID NO: 715209 - DNA, 20 bp, Artificial
  CRISPR gRNA sequence
caccggagggcctgcaggaa

SEQ ID NO: 715210 - DNA, 20 bp, Artificial
  CRISPR gRNA sequence
cctgcaggaagcgaattcgg

SEQ ID NO: 715211 - DNA, 20 bp, Artificial
  CRISPR gRNA sequence
ttgctctctgccagcctggc

SEQ ID NO: 715212 - DNA, 20 bp, Artificial
  CRISPR gRNA sequence
cccagcccaagctagagctt

SEQ ID NO: 715213 - DNA, 20 bp, Artificial
  CRISPR gRNA sequence
gcccaagctagagcttgtgg

SEQ ID NO: 715214 - DNA, 20 bp, Artificial
  CRISPR gRNA sequence
gtcgcattctgtacatctgt

SEQ ID NO: 715215 - DNA, 20 bp, Artificial
  CRISPR gRNA sequence
tacatctgtagggatgcaat

SEQ ID NO: 715216 - DNA, 20 bp, Artificial
  CRISPR gRNA sequence
ggtgaaaactcatgcgtgtg

SEQ ID NO: 715217 - DNA, 20 bp, Artificial
  CRISPR gRNA sequence
gcaatgaggtgaagactgta

SEQ ID NO: 715218 - DNA, 20 bp, Artificial
  CRISPR gRNA sequence
tggcttgcccagagcagcac

SEQ ID NO: 715219 - DNA, 20 bp, Artificial
  CRISPR gRNA sequence
ttgcccagagcagcacctgg

SEQ ID NO: 715220 - DNA, 20 bp, Artificial
  CRISPR gRNA sequence
cacttacaagctgtgtgacc

SEQ ID NO: 715221 - DNA, 20 bp, Artificial
  CRISPR gRNA sequence
tacaagctgtgtgaccctgg

SEQ ID NO: 715222 - DNA, 20 bp, Artificial
  CRISPR gRNA sequence
gtgtgaccctgggtgagtta

SEQ ID NO: 715223 - DNA, 20 bp, Artificial
  CRISPR gRNA sequence
catccggaaaatgcagatgg

SEQ ID NO: 715224 - DNA, 20 bp, Artificial
  CRISPR gRNA sequence
ctacttcagaggcttggcct

SEQ ID NO: 715225 - DNA, 20 bp, Artificial
  CRISPR gRNA sequence
tcgggctgttaagcgcatcg

SEQ ID NO: 715226 - DNA, 20 bp, Artificial
  CRISPR gRNA sequence
cctggaagcttcaggccttc

SEQ ID NO: 715227 - DNA, 20 bp, Artificial
  CRISPR gRNA sequence
gcttcaggccttcctgagtc

SEQ ID NO: 715228 - DNA, 20 bp, Artificial
  CRISPR gRNA sequence
accctcctcacctgtccagg

SEQ ID NO: 715229 - DNA, 20 bp, Artificial
  CRISPR gRNA sequence
gcagccccttcaaggcaggc

SEQ ID NO: 715230 - DNA, 20 bp, Artificial
  CRISPR gRNA sequence
cttcctcagcactgcatggc

SEQ ID NO: 715231 - DNA, 20 bp, Artificial
  CRISPR gRNA sequence
tcagcactgcatggcatgga

SEQ ID NO: 715232 - DNA, 20 bp, Artificial
  CRISPR gRNA sequence
tctgtgctgggctctgatgg

SEQ ID NO: 715233 - DNA, 20 bp, Artificial
  CRISPR gRNA sequence
cagcctcaggcactggtcct

SEQ ID NO: 715234 - DNA, 20 bp, Artificial
  CRISPR gRNA sequence
acagtccactgaggcatgtt

SEQ ID NO: 715235 - DNA, 20 bp, Artificial
  CRISPR gRNA sequence
tgaggcatgttttgaatttg

SEQ ID NO: 715236 - DNA, 20 bp, Artificial
  CRISPR gRNA sequence
cactgtggtccctgtgcaag

SEQ ID NO: 715237 - DNA, 20 bp, Artificial
  CRISPR gRNA sequence
tgtttccatgacctgtcagg

SEQ ID NO: 715238 - DNA, 20 bp, Artificial
  CRISPR gRNA sequence
tcttgacatttttctagtat

SEQ ID NO: 715239 - DNA, 20 bp, Artificial
  CRISPR gRNA sequence
tctagcttctggtgggacct

SEQ ID NO: 715240 - DNA, 20 bp, Artificial
  CRISPR gRNA sequence
ttctggtgggaccttggggt

SEQ ID NO: 715241 - DNA, 20 bp, Artificial
  CRISPR gRNA sequence
acaggcaagctcacagagca

SEQ ID NO: 715242 - DNA, 20 bp, Artificial
  CRISPR gRNA sequence
aagctcacagagcaccgggt

SEQ ID NO: 715243 - DNA, 20 bp, Artificial
  CRISPR gRNA sequence
gtgagaatggaccgagctgg

SEQ ID NO: 715244 - DNA, 20 bp, Artificial
  CRISPR gRNA sequence
gcccctttccctcctgagcc

SEQ ID NO: 715245 - DNA, 20 bp, Artificial
  CRISPR gRNA sequence
aggccaaaggcagacgggag

SEQ ID NO: 715246 - DNA, 20 bp, Artificial
  CRISPR gRNA sequence
cacatcccagacctggggca

SEQ ID NO: 715247 - DNA, 20 bp, Artificial
  CRISPR gRNA sequence
ctttgagcagtgagcacatc

SEQ ID NO: 715248 - DNA, 20 bp, Artificial
  CRISPR gRNA sequence
agaggcccaccaaccagccc

SEQ ID NO: 715249 - DNA, 20 bp, Artificial
  CRISPR gRNA sequence
gcccaccaaccagccctcga

SEQ ID NO: 715250 - DNA, 20 bp, Artificial
  CRISPR gRNA sequence
cagattagcagcctaaggca

SEQ ID NO: 715251 - DNA, 20 bp, Artificial
  CRISPR gRNA sequence
aattcgtttaaggccacgtg

SEQ ID NO: 715252 - DNA, 20 bp, Artificial
  CRISPR gRNA sequence
tgctgggtgagccgtaggac

SEQ ID NO: 715253 - DNA, 20 bp, Artificial
  CRISPR gRNA sequence
ccttggcaccattgacattt

SEQ ID NO: 715254 - DNA, 20 bp, Artificial
  CRISPR gRNA sequence
ggcaccattgacatttggga

SEQ ID NO: 715255 - DNA, 20 bp, Artificial
  CRISPR gRNA sequence
ttttttttttttttttgaga

SEQ ID NO: 715256 - DNA, 20 bp, Artificial
  CRISPR gRNA sequence
tctcgctctgtcacccaggc

SEQ ID NO: 715257 - DNA, 20 bp, Artificial
  CRISPR gRNA sequence
ctggagtgcactggtgccat

SEQ ID NO: 715258 - DNA, 20 bp, Artificial
  CRISPR gRNA sequence
ttcactgcaacctccgcctc

SEQ ID NO: 715259 - DNA, 20 bp, Artificial
  CRISPR gRNA sequence
gattctcctgcctcagcctc

SEQ ID NO: 715260 - DNA, 20 bp, Artificial
  CRISPR gRNA sequence
gcctcagcctcctgagtagc

SEQ ID NO: 715261 - DNA, 20 bp, Artificial
  CRISPR gRNA sequence
tttggtatttttagtagaga

SEQ ID NO: 715262 - DNA, 20 bp, Artificial
  CRISPR gRNA sequence
tgcctcggcctcccaaagtg

SEQ ID NO: 715263 - DNA, 20 bp, Artificial
  CRISPR gRNA sequence
tccttcatttttatgagcac

SEQ ID NO: 715264 - DNA, 20 bp, Artificial
  CRISPR gRNA sequence
atagaaatggtataagtatg

SEQ ID NO: 715265 - DNA, 20 bp, Artificial
  CRISPR gRNA sequence
cattttgacctgaaccattt

SEQ ID NO: 715266 - DNA, 20 bp, Artificial
  CRISPR gRNA sequence
atttgagagtaactgactga

SEQ ID NO: 715267 - DNA, 20 bp, Artificial
  CRISPR gRNA sequence
agtgtgtgtttcagacagac

SEQ ID NO: 715268 - DNA, 20 bp, Artificial
  CRISPR gRNA sequence
tgtattttacacgatgtggt

SEQ ID NO: 715269 - DNA, 20 bp, Artificial
  CRISPR gRNA sequence
cacgatgtggtaaggatcgt

SEQ ID NO: 715270 - DNA, 20 bp, Artificial
  CRISPR gRNA sequence
gtggtaaggatcgtcagaat

SEQ ID NO: 715271 - DNA, 20 bp, Artificial
  CRISPR gRNA sequence
acactgatacatgacccaca

SEQ ID NO: 715272 - DNA, 20 bp, Artificial
  CRISPR gRNA sequence
acatttgcttgtctggtttc

SEQ ID NO: 715273 - DNA, 20 bp, Artificial
  CRISPR gRNA sequence
tttctcgagtctccttctgt

SEQ ID NO: 715274 - DNA, 20 bp, Artificial
  CRISPR gRNA sequence
gagcgcaggctggtgatttc

SEQ ID NO: 715275 - DNA, 20 bp, Artificial
  CRISPR gRNA sequence
tttcatggatgctccttgct

SEQ ID NO: 715276 - DNA, 20 bp, Artificial
  CRISPR gRNA sequence
ggtttgtctggtgttttctc

SEQ ID NO: 715277 - DNA, 20 bp, Artificial
  CRISPR gRNA sequence
tgtctggtgttttctcccga

SEQ ID NO: 715278 - DNA, 20 bp, Artificial
  CRISPR gRNA sequence
atcttgggctggaaggtccc

SEQ ID NO: 715279 - DNA, 20 bp, Artificial
  CRISPR gRNA sequence
atttgtttatttttttgaga

SEQ ID NO: 715280 - DNA, 20 bp, Artificial
  CRISPR gRNA sequence
tctggctctgtcacccaggc

SEQ ID NO: 715281 - DNA, 20 bp, Artificial
  CRISPR gRNA sequence
cttactgcaacccccgcctc

SEQ ID NO: 715282 - DNA, 20 bp, Artificial
  CRISPR gRNA sequence
gcttcagcctcccaagtggc

SEQ ID NO: 715283 - DNA, 20 bp, Artificial
  CRISPR gRNA sequence
ttttgtattttcagtagaga

SEQ ID NO: 715284 - DNA, 20 bp, Artificial
  CRISPR gRNA sequence
gcctcggcctcccaaagttc

SEQ ID NO: 715285 - DNA, 20 bp, Artificial
  CRISPR gRNA sequence
acttacatatttatatctgt

SEQ ID NO: 715286 - DNA, 20 bp, Artificial
  CRISPR gRNA sequence
atggggccctgttctgttca

SEQ ID NO: 715287 - DNA, 20 bp, Artificial
  CRISPR gRNA sequence
gtgtgctcctgccccggccc

SEQ ID NO: 715288 - DNA, 20 bp, Artificial
  CRISPR gRNA sequence
agctgcctctccaaggagcc

SEQ ID NO: 715289 - DNA, 20 bp, Artificial
  CRISPR gRNA sequence
ggagcccggggtttgcatct

SEQ ID NO: 715290 - DNA, 20 bp, Artificial
  CRISPR gRNA sequence
ttctgcttcccacagcactg

SEQ ID NO: 715291 - DNA, 20 bp, Artificial
  CRISPR gRNA sequence
aggggaggggactaaaagtg

SEQ ID NO: 715292 - DNA, 20 bp, Artificial
  CRISPR gRNA sequence
gactaaaagtggagaataac

SEQ ID NO: 715293 - DNA, 20 bp, Artificial
  CRISPR gRNA sequence
ggtcctggacttgtgtccct

SEQ ID NO: 715294 - DNA, 20 bp, Artificial
  CRISPR gRNA sequence
caacaaataagactagcaga

SEQ ID NO: 715295 - DNA, 20 bp, Artificial
  CRISPR gRNA sequence
tgtacttggcaagatttgtt

SEQ ID NO: 715296 - DNA, 20 bp, Artificial
  CRISPR gRNA sequence
gggtctttatcaaaatcctc

SEQ ID NO: 715297 - DNA, 20 bp, Artificial
  CRISPR gRNA sequence
gtgattttacacttgtttgg

SEQ ID NO: 715298 - DNA, 20 bp, Artificial
  CRISPR gRNA sequence
tgactttccattcagtgtga

SEQ ID NO: 715299 - DNA, 20 bp, Artificial
  CRISPR gRNA sequence
cagcactttgggaggccaag

SEQ ID NO: 715300 - DNA, 20 bp, Artificial
  CRISPR gRNA sequence
actttgggaggccaaggtgg

SEQ ID NO: 715301 - DNA, 20 bp, Artificial
  CRISPR gRNA sequence
tgggtggatcacctgaggtc

SEQ ID NO: 715302 - DNA, 20 bp, Artificial
  CRISPR gRNA sequence
tactcgggaggctgaggcag

SEQ ID NO: 715303 - DNA, 20 bp, Artificial
  CRISPR gRNA sequence
tttgttttttgttttggaga

SEQ ID NO: 715304 - DNA, 20 bp, Artificial
  CRISPR gRNA sequence
ttggagacagggtgtcactc

SEQ ID NO: 715305 - DNA, 20 bp, Artificial
  CRISPR gRNA sequence
ctcactgcagccttgacctc

SEQ ID NO: 715306 - DNA, 20 bp, Artificial
  CRISPR gRNA sequence
acctcggcctcccaaagtgc

SEQ ID NO: 715307 - DNA, 20 bp, Artificial
  CRISPR gRNA sequence
tcctcattttttttttgagg

SEQ ID NO: 715308 - DNA, 20 bp, Artificial
  CRISPR gRNA sequence
tctcgctctgttgcccaggt

SEQ ID NO: 715309 - DNA, 20 bp, Artificial
  CRISPR gRNA sequence
ctcactgcaacctctgcttc

SEQ ID NO: 715310 - DNA, 20 bp, Artificial
  CRISPR gRNA sequence
aattctcctgcctcagcctc

SEQ ID NO: 715311 - DNA, 20 bp, Artificial
  CRISPR gRNA sequence
gcctcagcctcccgagtagc

SEQ ID NO: 715312 - DNA, 20 bp, Artificial
  CRISPR gRNA sequence
ttttgtatttttagtagaga

SEQ ID NO: 715313 - DNA, 20 bp, Artificial
  CRISPR gRNA sequence
acctcagcctcccaaaatac

SEQ ID NO: 715314 - DNA, 20 bp, Artificial
  CRISPR gRNA sequence
aaaattggagaagacagcac

SEQ ID NO: 715315 - DNA, 20 bp, Artificial
  CRISPR gRNA sequence
tatgtgaaccattattgaca

SEQ ID NO: 715316 - DNA, 20 bp, Artificial
  CRISPR gRNA sequence
acgaaagcccacactgtgtt

SEQ ID NO: 715317 - DNA, 20 bp, Artificial
  CRISPR gRNA sequence
ccttgcattgcctaaggttc

SEQ ID NO: 715318 - DNA, 20 bp, Artificial
  CRISPR gRNA sequence
cctgatggccttggcagttt

SEQ ID NO: 715319 - DNA, 20 bp, Artificial
  CRISPR gRNA sequence
tttgcgggacgcctgtctcc

SEQ ID NO: 715320 - DNA, 20 bp, Artificial
  CRISPR gRNA sequence
tgtcttccccatgattagac

SEQ ID NO: 715321 - DNA, 20 bp, Artificial
  CRISPR gRNA sequence
ctggcagatcacctgaggtc

SEQ ID NO: 715322 - DNA, 20 bp, Artificial
  CRISPR gRNA sequence
accgaaaatacaaaaattag

SEQ ID NO: 715323 - DNA, 20 bp, Artificial
  CRISPR gRNA sequence
tacttgggaggctgaggcag

SEQ ID NO: 715324 - DNA, 20 bp, Artificial
  CRISPR gRNA sequence
agaagggaagtaatattgtg

SEQ ID NO: 715325 - DNA, 20 bp, Artificial
  CRISPR gRNA sequence
cgccaaggaggcccctgctc

SEQ ID NO: 715326 - DNA, 20 bp, Artificial
  CRISPR gRNA sequence
atttggctggttttcaattt

SEQ ID NO: 715327 - DNA, 20 bp, Artificial
  CRISPR gRNA sequence
ctcggcctttttgttttctt

SEQ ID NO: 715328 - DNA, 20 bp, Artificial
  CRISPR gRNA sequence
tttctttcgggttatttcct

SEQ ID NO: 715329 - DNA, 20 bp, Artificial
  CRISPR gRNA sequence
tgagggtgtgttccctcaag

SEQ ID NO: 715330 - DNA, 20 bp, Artificial
  CRISPR gRNA sequence
tgttccctcaagagggatga

SEQ ID NO: 715331 - DNA, 20 bp, Artificial
  CRISPR gRNA sequence
tcaagagggatgactgggta

SEQ ID NO: 715332 - DNA, 20 bp, Artificial
  CRISPR gRNA sequence
agaaaaatggaaccagcctg

SEQ ID NO: 715333 - DNA, 20 bp, Artificial
  CRISPR gRNA sequence
cacccacttccccttcaagg

SEQ ID NO: 715334 - DNA, 20 bp, Artificial
  CRISPR gRNA sequence
gtttcactgacgtcattgaa

SEQ ID NO: 715335 - DNA, 20 bp, Artificial
  CRISPR gRNA sequence
ttgaaaagaatgtgcctcgg

SEQ ID NO: 715336 - DNA, 20 bp, Artificial
  CRISPR gRNA sequence
cagcactttgggaggccgag

SEQ ID NO: 715337 - DNA, 20 bp, Artificial
  CRISPR gRNA sequence
actttgggaggccgaggcgg

SEQ ID NO: 715338 - DNA, 20 bp, Artificial
  CRISPR gRNA sequence
tactcgggaggctgaggcag

SEQ ID NO: 715339 - DNA, 20 bp, Artificial
  CRISPR gRNA sequence
gctgcacttcaccctggcga

SEQ ID NO: 715340 - DNA, 20 bp, Artificial
  CRISPR gRNA sequence
cgggcagatcacctgaggtc

SEQ ID NO: 715341 - DNA, 20 bp, Artificial
  CRISPR gRNA sequence
cggtaatcccagctacttgt

SEQ ID NO: 715342 - DNA, 20 bp, Artificial
  CRISPR gRNA sequence
tcgtgccactgcactccagc

SEQ ID NO: 715343 - DNA, 20 bp, Artificial
  CRISPR gRNA sequence
ctgcactccagcctgggtga

SEQ ID NO: 715344 - DNA, 20 bp, Artificial
  CRISPR gRNA sequence
aaaaagaaaaaattacccct

SEQ ID NO: 715345 - DNA, 20 bp, Artificial
  CRISPR gRNA sequence
ggtggcagatttgtctagcc

SEQ ID NO: 715346 - DNA, 20 bp, Artificial
  CRISPR gRNA sequence
tctccgtaggtagcgttctc

SEQ ID NO: 715347 - DNA, 20 bp, Artificial
  CRISPR gRNA sequence
ttaaaagctgggcatccctg

SEQ ID NO: 715348 - DNA, 20 bp, Artificial
  CRISPR gRNA sequence
ctctgggaactgacttgctc

SEQ ID NO: 715349 - DNA, 20 bp, Artificial
  CRISPR gRNA sequence
gggaactgacttgctccagg

SEQ ID NO: 715350 - DNA, 20 bp, Artificial
  CRISPR gRNA sequence
ctccaggatgagttagatgc

SEQ ID NO: 715351 - DNA, 20 bp, Artificial
  CRISPR gRNA sequence
gtttaatatgggagaacaat

SEQ ID NO: 715352 - DNA, 20 bp, Artificial
  CRISPR gRNA sequence
atgggagaacaatgggagtg

SEQ ID NO: 715353 - DNA, 20 bp, Artificial
  CRISPR gRNA sequence
gaagatagaggttgtgcgtt

SEQ ID NO: 715354 - DNA, 20 bp, Artificial
  CRISPR gRNA sequence
agcacctcctgagcctacaa

SEQ ID NO: 715355 - DNA, 20 bp, Artificial
  CRISPR gRNA sequence
ctcctgagcctacaaaagga

SEQ ID NO: 715356 - DNA, 20 bp, Artificial
  CRISPR gRNA sequence
tcctcctcgaaggctgccac

SEQ ID NO: 715357 - DNA, 20 bp, Artificial
  CRISPR gRNA sequence
agagaaaatcgaagtccagc

SEQ ID NO: 715358 - DNA, 20 bp, Artificial
  CRISPR gRNA sequence
ggcttcgggcgtgtcccagg

SEQ ID NO: 715359 - DNA, 20 bp, Artificial
  CRISPR gRNA sequence
cagggtccaggtggcatctg

SEQ ID NO: 715360 - DNA, 20 bp, Artificial
  CRISPR gRNA sequence
cctgccttgaggtcctccat

SEQ ID NO: 715361 - DNA, 20 bp, Artificial
  CRISPR gRNA sequence
gggttttgcctggtattcca

SEQ ID NO: 715362 - DNA, 20 bp, Artificial
  CRISPR gRNA sequence
accaatccttgcatgtgcgc

SEQ ID NO: 715363 - DNA, 20 bp, Artificial
  CRISPR gRNA sequence
ccttgcatgtgcgcgggggt

SEQ ID NO: 715364 - DNA, 20 bp, Artificial
  CRISPR gRNA sequence
tgcgcgggggtgggggttgg

SEQ ID NO: 715365 - DNA, 20 bp, Artificial
  CRISPR gRNA sequence
tgttcattggtttagtcatt

SEQ ID NO: 715366 - DNA, 20 bp, Artificial
  CRISPR gRNA sequence
ttggtttagtcattaggaat

SEQ ID NO: 715367 - DNA, 20 bp, Artificial
  CRISPR gRNA sequence
ggcgggcaggtcaggaggtc

SEQ ID NO: 715368 - DNA, 20 bp, Artificial
  CRISPR gRNA sequence
gaaaatacaaaaaaattagc

SEQ ID NO: 715369 - DNA, 20 bp, Artificial
  CRISPR gRNA sequence
tattcgggaggctgaggcat

SEQ ID NO: 715370 - DNA, 20 bp, Artificial
  CRISPR gRNA sequence
tcatgccactgcactctagc

SEQ ID NO: 715371 - DNA, 20 bp, Artificial
  CRISPR gRNA sequence
ctgcactctagcctgggtga

SEQ ID NO: 715372 - DNA, 20 bp, Artificial
  CRISPR gRNA sequence
ctcaaaaaaaaaaaaaaaaa

SEQ ID NO: 715373 - DNA, 20 bp, Artificial
  CRISPR gRNA sequence
aaaaaaaaaaaaaaaggaat

SEQ ID NO: 715374 - DNA, 20 bp, Artificial
  CRISPR gRNA sequence
aaaaggaatgagagtggcca

SEQ ID NO: 715375 - DNA, 20 bp, Artificial
  CRISPR gRNA sequence
tgagcctccttgccttgagc

SEQ ID NO: 715376 - DNA, 20 bp, Artificial
  CRISPR gRNA sequence
ctgaggacctgacccctggg

SEQ ID NO: 715377 - DNA, 20 bp, Artificial
  CRISPR gRNA sequence
accatttgccaatagttggg

SEQ ID NO: 715378 - DNA, 20 bp, Artificial
  CRISPR gRNA sequence
cattcccctcccacagtgcc

SEQ ID NO: 715379 - DNA, 20 bp, Artificial
  CRISPR gRNA sequence
gcccgtcctgcaagttcagg

SEQ ID NO: 715380 - DNA, 20 bp, Artificial
  CRISPR gRNA sequence
gcctcagccaggccttggct

SEQ ID NO: 715381 - DNA, 20 bp, Artificial
  CRISPR gRNA sequence
agctcctggctcagcctgcc

SEQ ID NO: 715382 - DNA, 20 bp, Artificial
  CRISPR gRNA sequence
tccagaagggcctgcacaca

SEQ ID NO: 715383 - DNA, 20 bp, Artificial
  CRISPR gRNA sequence
ggatttggtttgggccactt

SEQ ID NO: 715384 - DNA, 20 bp, Artificial
  CRISPR gRNA sequence
ccccttttctttactcttcc

SEQ ID NO: 715385 - DNA, 20 bp, Artificial
  CRISPR gRNA sequence
catgaatctcatcctccaag

SEQ ID NO: 715386 - DNA, 20 bp, Artificial
  CRISPR gRNA sequence
tcaagcattcatacattaag

SEQ ID NO: 715387 - DNA, 20 bp, Artificial
  CRISPR gRNA sequence
tagttcagtttcaaattatg

SEQ ID NO: 715388 - DNA, 20 bp, Artificial
  CRISPR gRNA sequence
caaattatgggggatcacat

SEQ ID NO: 715389 - DNA, 20 bp, Artificial
  CRISPR gRNA sequence
gggatcacattcgaatatgc

SEQ ID NO: 715390 - DNA, 20 bp, Artificial
  CRISPR gRNA sequence
tttaaaatgcagtcttttgg

SEQ ID NO: 715391 - DNA, 20 bp, Artificial
  CRISPR gRNA sequence
attttgggaggctgaggcag

SEQ ID NO: 715392 - DNA, 20 bp, Artificial
  CRISPR gRNA sequence
caggcggatcacctgaggtc

SEQ ID NO: 715393 - DNA, 20 bp, Artificial
  CRISPR gRNA sequence
tactcaggaggctgaggcag

SEQ ID NO: 715394 - DNA, 20 bp, Artificial
  CRISPR gRNA sequence
tgcaccactgctctcccagc

SEQ ID NO: 715395 - DNA, 20 bp, Artificial
  CRISPR gRNA sequence
tgctctcccagcccgggtaa

SEQ ID NO: 715396 - DNA, 20 bp, Artificial
  CRISPR gRNA sequence
tagccttcatattattatga

SEQ ID NO: 715397 - DNA, 20 bp, Artificial
  CRISPR gRNA sequence
attattatgaaagagtattc

SEQ ID NO: 715398 - DNA, 20 bp, Artificial
  CRISPR gRNA sequence
aacccttctgataggtagtt

SEQ ID NO: 715399 - DNA, 20 bp, Artificial
  CRISPR gRNA sequence
tgataggtagttgtggatgt

SEQ ID NO: 715400 - DNA, 20 bp, Artificial
  CRISPR gRNA sequence
gtggatgttggggttgagaa

SEQ ID NO: 715401 - DNA, 20 bp, Artificial
  CRISPR gRNA sequence
agaacagaataatctttgtc

SEQ ID NO: 715402 - DNA, 20 bp, Artificial
  CRISPR gRNA sequence
tctggagtgacaccacactc

SEQ ID NO: 715403 - DNA, 20 bp, Artificial
  CRISPR gRNA sequence
ttagtatttattgatcattc

SEQ ID NO: 715404 - DNA, 20 bp, Artificial
  CRISPR gRNA sequence
cttgggtgtttctcagagag

SEQ ID NO: 715405 - DNA, 20 bp, Artificial
  CRISPR gRNA sequence
tctcagagagggggatttgg

SEQ ID NO: 715406 - DNA, 20 bp, Artificial
  CRISPR gRNA sequence
cttccgcagtgtttgtgtcc

SEQ ID NO: 715407 - DNA, 20 bp, Artificial
  CRISPR gRNA sequence
tccctgggtacttgagatta

SEQ ID NO: 715408 - DNA, 20 bp, Artificial
  CRISPR gRNA sequence
gggagtggtgatgactctta

SEQ ID NO: 715409 - DNA, 20 bp, Artificial
  CRISPR gRNA sequence
gtgatgactcttagcgagtg

SEQ ID NO: 715410 - DNA, 20 bp, Artificial
  CRISPR gRNA sequence
cagcagtgatctggaagctg

SEQ ID NO: 715411 - DNA, 20 bp, Artificial
  CRISPR gRNA sequence
aagctcctgttttgggaaag

SEQ ID NO: 715412 - DNA, 20 bp, Artificial
  CRISPR gRNA sequence
gttttgggaaagtagaattt

SEQ ID NO: 715413 - DNA, 20 bp, Artificial
  CRISPR gRNA sequence
agatacgccctctgtgcctt

SEQ ID NO: 715414 - DNA, 20 bp, Artificial
  CRISPR gRNA sequence
cacgggcatccctgcctcct

SEQ ID NO: 715415 - DNA, 20 bp, Artificial
  CRISPR gRNA sequence
aatatttattaataatatac

SEQ ID NO: 715416 - DNA, 20 bp, Artificial
  CRISPR gRNA sequence
aactaacagtagtctgtttt

SEQ ID NO: 715417 - DNA, 20 bp, Artificial
  CRISPR gRNA sequence
gtagtctgtttttagaatgc

SEQ ID NO: 715418 - DNA, 20 bp, Artificial
  CRISPR gRNA sequence
gatcataaaagactactttc

SEQ ID NO: 715419 - DNA, 20 bp, Artificial
  CRISPR gRNA sequence
tggagctggtacttacagac

SEQ ID NO: 715420 - DNA, 20 bp, Artificial
  CRISPR gRNA sequence
acttacagacttgggtgctt

SEQ ID NO: 715421 - DNA, 20 bp, Artificial
  CRISPR gRNA sequence
agacttgggtgcttatgagt

SEQ ID NO: 715422 - DNA, 20 bp, Artificial
  CRISPR gRNA sequence
gtgggttatggaccagatgc

SEQ ID NO: 715423 - DNA, 20 bp, Artificial
  CRISPR gRNA sequence
gtttcctcatctgtaaaatg

SEQ ID NO: 715424 - DNA, 20 bp, Artificial
  CRISPR gRNA sequence
ccacctcatacagtggttgt

SEQ ID NO: 715425 - DNA, 20 bp, Artificial
  CRISPR gRNA sequence
acggacgtggcgagcaccct

SEQ ID NO: 715426 - DNA, 20 bp, Artificial
  CRISPR gRNA sequence
aagcagaaagggggactcac

SEQ ID NO: 715427 - DNA, 20 bp, Artificial
  CRISPR gRNA sequence
cagagactggtggggaggtt

SEQ ID NO: 715428 - DNA, 20 bp, Artificial
  CRISPR gRNA sequence
ttcccgtcccacagcagctg

SEQ ID NO: 715429 - DNA, 20 bp, Artificial
  CRISPR gRNA sequence
agaacccgtcgcggaagagc

SEQ ID NO: 715430 - DNA, 20 bp, Artificial
  CRISPR gRNA sequence
acctggagagcctgccgctg

SEQ ID NO: 715431 - DNA, 20 bp, Artificial
  CRISPR gRNA sequence
cccagggaccttcctgagcc

SEQ ID NO: 715432 - DNA, 20 bp, Artificial
  CRISPR gRNA sequence
gcacaccaataacaagattg

SEQ ID NO: 715433 - DNA, 20 bp, Artificial
  CRISPR gRNA sequence
agcccaggggcagatgggag

SEQ ID NO: 715434 - DNA, 20 bp, Artificial
  CRISPR gRNA sequence
tggaagggacctggagaccc

SEQ ID NO: 715435 - DNA, 20 bp, Artificial
  CRISPR gRNA sequence
tttctgtaagtagggacagc

SEQ ID NO: 715436 - DNA, 20 bp, Artificial
  CRISPR gRNA sequence
cttacctcgtaggccattgt

SEQ ID NO: 715437 - DNA, 20 bp, Artificial
  CRISPR gRNA sequence
tgatggtctcaccaccttct

SEQ ID NO: 715438 - DNA, 20 bp, Artificial
  CRISPR gRNA sequence
gttggggagaccgtggctca

SEQ ID NO: 715439 - DNA, 20 bp, Artificial
  CRISPR gRNA sequence
cagcagcttcccattcccta

SEQ ID NO: 715440 - DNA, 20 bp, Artificial
  CRISPR gRNA sequence
agcttcccattccctatggg

SEQ ID NO: 715441 - DNA, 20 bp, Artificial
  CRISPR gRNA sequence
aaatagccaactccactgcc

SEQ ID NO: 715442 - DNA, 20 bp, Artificial
  CRISPR gRNA sequence
tgccttgaatccagttaatt

SEQ ID NO: 715443 - DNA, 20 bp, Artificial
  CRISPR gRNA sequence
cccacctctgtcgcttctgg

SEQ ID NO: 715444 - DNA, 20 bp, Artificial
  CRISPR gRNA sequence
tctggaagggtaactggcac

SEQ ID NO: 715445 - DNA, 20 bp, Artificial
  CRISPR gRNA sequence
ctggcactgggataatactg

SEQ ID NO: 715446 - DNA, 20 bp, Artificial
  CRISPR gRNA sequence
ctttttattttttcagcctc

SEQ ID NO: 715447 - DNA, 20 bp, Artificial
  CRISPR gRNA sequence
ttttcagcctcctgagtagc

SEQ ID NO: 715448 - DNA, 20 bp, Artificial
  CRISPR gRNA sequence
ctgagtagctgggattatgg

SEQ ID NO: 715449 - DNA, 20 bp, Artificial
  CRISPR gRNA sequence
ttttgtatttttagtagaga

SEQ ID NO: 715450 - DNA, 20 bp, Artificial
  CRISPR gRNA sequence
gccttggcctcccaaagtac

SEQ ID NO: 715451 - DNA, 20 bp, Artificial
  CRISPR gRNA sequence
aataccatcaaaggcttctt

SEQ ID NO: 715452 - DNA, 20 bp, Artificial
  CRISPR gRNA sequence
agaagtcctaactggaactt

SEQ ID NO: 715453 - DNA, 20 bp, Artificial
  CRISPR gRNA sequence
ctggaacttctgagtccaca

SEQ ID NO: 715454 - DNA, 20 bp, Artificial
  CRISPR gRNA sequence
tccacactgagtacagtgcc

SEQ ID NO: 715455 - DNA, 20 bp, Artificial
  CRISPR gRNA sequence
agtacagtgcctggaatccc

SEQ ID NO: 715456 - DNA, 20 bp, Artificial
  CRISPR gRNA sequence
agtgcctggaatcccagggg

SEQ ID NO: 715457 - DNA, 20 bp, Artificial
  CRISPR gRNA sequence
aatcccaggggtggggttca

SEQ ID NO: 715458 - DNA, 20 bp, Artificial
  CRISPR gRNA sequence
atggcctgcaggccttgctg

SEQ ID NO: 715459 - DNA, 20 bp, Artificial
  CRISPR gRNA sequence
cctgcaggccttgctggtga

SEQ ID NO: 715460 - DNA, 20 bp, Artificial
  CRISPR gRNA sequence
ttgtcctcctaatgccagcc

SEQ ID NO: 715461 - DNA, 20 bp, Artificial
  CRISPR gRNA sequence
cttcccatccagttcccaag

SEQ ID NO: 715462 - DNA, 20 bp, Artificial
  CRISPR gRNA sequence
gttcccaagaggggtcacac

SEQ ID NO: 715463 - DNA, 20 bp, Artificial
  CRISPR gRNA sequence
gccctccccacatagccaag

SEQ ID NO: 715464 - DNA, 20 bp, Artificial
  CRISPR gRNA sequence
gaagccacccccacagcctg

SEQ ID NO: 715465 - DNA, 20 bp, Artificial
  CRISPR gRNA sequence
gagcagccaattccaccgct

SEQ ID NO: 715466 - DNA, 20 bp, Artificial
  CRISPR gRNA sequence
gactcctgcccatttccctg

SEQ ID NO: 715467 - DNA, 20 bp, Artificial
  CRISPR gRNA sequence
ctgggccttctctcccctcc

SEQ ID NO: 715468 - DNA, 20 bp, Artificial
  CRISPR gRNA sequence
acaagcctgatggaggtgtg

SEQ ID NO: 715469 - DNA, 20 bp, Artificial
  CRISPR gRNA sequence
gctgaggccctgctctgttt

SEQ ID NO: 715470 - DNA, 20 bp, Artificial
  CRISPR gRNA sequence
ggcgcacttctctctttcct

SEQ ID NO: 715471 - DNA, 20 bp, Artificial
  CRISPR gRNA sequence
ttcctgggggtgttcaaaac

SEQ ID NO: 715472 - DNA, 20 bp, Artificial
  CRISPR gRNA sequence
gaagaaccagcgtcatgcaa

SEQ ID NO: 715473 - DNA, 20 bp, Artificial
  CRISPR gRNA sequence
cagcgtcatgcaatagggtt

SEQ ID NO: 715474 - DNA, 20 bp, Artificial
  CRISPR gRNA sequence
gggggactcgagaacctttt

SEQ ID NO: 715475 - DNA, 20 bp, Artificial
  CRISPR gRNA sequence
cgagaacctttttggggttc

SEQ ID NO: 715476 - DNA, 20 bp, Artificial
  CRISPR gRNA sequence
ttttggggttcctgaatccg

SEQ ID NO: 715477 - DNA, 20 bp, Artificial
  CRISPR gRNA sequence
actgcattacccagaaaggc

SEQ ID NO: 715478 - DNA, 20 bp, Artificial
  CRISPR gRNA sequence
agcttccccattctggcctc

SEQ ID NO: 715479 - DNA, 20 bp, Artificial
  CRISPR gRNA sequence
gccgagacctattgaggggg

SEQ ID NO: 715480 - DNA, 20 bp, Artificial
  CRISPR gRNA sequence
tgagggggccgggttttctg

SEQ ID NO: 715481 - DNA, 20 bp, Artificial
  CRISPR gRNA sequence
tgcaggatgtgacaggctgg

SEQ ID NO: 715482 - DNA, 20 bp, Artificial
  CRISPR gRNA sequence
ggacttgcagtagtagaacc

SEQ ID NO: 715483 - DNA, 20 bp, Artificial
  CRISPR gRNA sequence
agctggacaagttggtcacc

SEQ ID NO: 715484 - DNA, 20 bp, Artificial
  CRISPR gRNA sequence
gagcagaaagggccaccagg

SEQ ID NO: 715485 - DNA, 20 bp, Artificial
  CRISPR gRNA sequence
agaaagggccaccaggcgga

SEQ ID NO: 715486 - DNA, 20 bp, Artificial
  CRISPR gRNA sequence
gagtgggtggtttttttttg

SEQ ID NO: 715487 - DNA, 20 bp, Artificial
  CRISPR gRNA sequence
tcagattcttacctgtaaat

SEQ ID NO: 715488 - DNA, 20 bp, Artificial
  CRISPR gRNA sequence
cctgtaaatgggaatcttga

SEQ ID NO: 715489 - DNA, 20 bp, Artificial
  CRISPR gRNA sequence
tgcaggagggctggggaccc

SEQ ID NO: 715490 - DNA, 20 bp, Artificial
  CRISPR gRNA sequence
agggctggggacccaggagt

SEQ ID NO: 715491 - DNA, 20 bp, Artificial
  CRISPR gRNA sequence
ttctatttcctctgagcccc

SEQ ID NO: 715492 - DNA, 20 bp, Artificial
  CRISPR gRNA sequence
cctggcggggccagcagagc

SEQ ID NO: 715493 - DNA, 20 bp, Artificial
  CRISPR gRNA sequence
ggctggggctaggagggcag

SEQ ID NO: 715494 - DNA, 20 bp, Artificial
  CRISPR gRNA sequence
cagggtggcctctgggaggc

SEQ ID NO: 715495 - DNA, 20 bp, Artificial
  CRISPR gRNA sequence
gtggaccggccggtcactgc

SEQ ID NO: 715496 - DNA, 20 bp, Artificial
  CRISPR gRNA sequence
gtcccctgacccagagccta

SEQ ID NO: 715497 - DNA, 20 bp, Artificial
  CRISPR gRNA sequence
gaagagacagtccaagggga

SEQ ID NO: 715498 - DNA, 20 bp, Artificial
  CRISPR gRNA sequence
ttgaggcagcaaacagatgg

SEQ ID NO: 715499 - DNA, 20 bp, Artificial
  CRISPR gRNA sequence
agtgcctgtggttgtttctc

SEQ ID NO: 715500 - DNA, 20 bp, Artificial
  CRISPR gRNA sequence
cagagtcaaaagggaagtcg

SEQ ID NO: 715501 - DNA, 20 bp, Artificial
  CRISPR gRNA sequence
tgggcccagggcctagggcc

SEQ ID NO: 715502 - DNA, 20 bp, Artificial
  CRISPR gRNA sequence
caggatcaagtcactcatct

SEQ ID NO: 715503 - DNA, 20 bp, Artificial
  CRISPR gRNA sequence
tccccgccacagcaggcgcc

SEQ ID NO: 715504 - DNA, 20 bp, Artificial
  CRISPR gRNA sequence
ggggaacttcgggccctgcc

SEQ ID NO: 715505 - DNA, 20 bp, Artificial
  CRISPR gRNA sequence
ggttccggctctgcacgctt

SEQ ID NO: 715506 - DNA, 20 bp, Artificial
  CRISPR gRNA sequence
ggctctgcacgctttggggt

SEQ ID NO: 715507 - DNA, 20 bp, Artificial
  CRISPR gRNA sequence
agaccgtttggaggtttcat

SEQ ID NO: 715508 - DNA, 20 bp, Artificial
  CRISPR gRNA sequence
ttggaggtttcatcaggatt

SEQ ID NO: 715509 - DNA, 20 bp, Artificial
  CRISPR gRNA sequence
gtttttcacatttcacgcta

SEQ ID NO: 715510 - DNA, 20 bp, Artificial
  CRISPR gRNA sequence
gccttcagacgtgtatgcaa

SEQ ID NO: 715511 - DNA, 20 bp, Artificial
  CRISPR gRNA sequence
gacgtgtatgcaaatgagtg

SEQ ID NO: 715512 - DNA, 20 bp, Artificial
  CRISPR gRNA sequence
tatgcaaatgagtgatggat

SEQ ID NO: 715513 - DNA, 20 bp, Artificial
  CRISPR gRNA sequence
caaatgagtgatggataagg

SEQ ID NO: 715514 - DNA, 20 bp, Artificial
  CRISPR gRNA sequence
tgatggataaggatgagtct

SEQ ID NO: 715515 - DNA, 20 bp, Artificial
  CRISPR gRNA sequence
tgtttgcccagtgtttgtgc

SEQ ID NO: 715516 - DNA, 20 bp, Artificial
  CRISPR gRNA sequence
gcccagtgtttgtgcaagga

SEQ ID NO: 715517 - DNA, 20 bp, Artificial
  CRISPR gRNA sequence
agtgtttgtgcaaggatgga

SEQ ID NO: 715518 - DNA, 20 bp, Artificial
  CRISPR gRNA sequence
agtctggcgcccatgatggg

SEQ ID NO: 715519 - DNA, 20 bp, Artificial
  CRISPR gRNA sequence
agtggcccttcacacaactt

SEQ ID NO: 715520 - DNA, 20 bp, Artificial
  CRISPR gRNA sequence
aggacatgatcatcgaaatt

SEQ ID NO: 715521 - DNA, 20 bp, Artificial
  CRISPR gRNA sequence
ccctgagcagaagtggcttt

SEQ ID NO: 715522 - DNA, 20 bp, Artificial
  CRISPR gRNA sequence
tgggagtctcccagcagggc

SEQ ID NO: 715523 - DNA, 20 bp, Artificial
  CRISPR gRNA sequence
tcccaaagccacttctgctc

SEQ ID NO: 715524 - DNA, 20 bp, Artificial
  CRISPR gRNA sequence
cctcagccttacagttcttt

SEQ ID NO: 715525 - DNA, 20 bp, Artificial
  CRISPR gRNA sequence
tacagttctttaaggatttt

SEQ ID NO: 715526 - DNA, 20 bp, Artificial
  CRISPR gRNA sequence
cgtgccttacagctgcggct

SEQ ID NO: 715527 - DNA, 20 bp, Artificial
  CRISPR gRNA sequence
agagagcacgtggctgcccg

SEQ ID NO: 715528 - DNA, 20 bp, Artificial
  CRISPR gRNA sequence
tgcctccaggcggtaagtcc

SEQ ID NO: 715529 - DNA, 20 bp, Artificial
  CRISPR gRNA sequence
atacacgtctgaaggcccta

SEQ ID NO: 715530 - DNA, 20 bp, Artificial
  CRISPR gRNA sequence
cggtcttgtttcctatggtc

SEQ ID NO: 715531 - DNA, 20 bp, Artificial
  CRISPR gRNA sequence
gtccagagtaaagcagatgc

SEQ ID NO: 715532 - DNA, 20 bp, Artificial
  CRISPR gRNA sequence
gcagagccggaaccaggtgg

SEQ ID NO: 715533 - DNA, 20 bp, Artificial
  CRISPR gRNA sequence
aggtggtggggtcggtgcta

SEQ ID NO: 715534 - DNA, 20 bp, Artificial
  CRISPR gRNA sequence
tgcttcttcatttcccagga

SEQ ID NO: 715535 - DNA, 20 bp, Artificial
  CRISPR gRNA sequence
tcttcatttcccaggacaga

SEQ ID NO: 715536 - DNA, 20 bp, Artificial
  CRISPR gRNA sequence
ggcaaagtaaagcaggttct

SEQ ID NO: 715537 - DNA, 20 bp, Artificial
  CRISPR gRNA sequence
cccgaggcgcctgctgtggc

SEQ ID NO: 715538 - DNA, 20 bp, Artificial
  CRISPR gRNA sequence
attggtggggacattctgag

SEQ ID NO: 715539 - DNA, 20 bp, Artificial
  CRISPR gRNA sequence
gggaaggtgggcagcaccag

SEQ ID NO: 715540 - DNA, 20 bp, Artificial
  CRISPR gRNA sequence
caggggccctcacaccagtg

SEQ ID NO: 715541 - DNA, 20 bp, Artificial
  CRISPR gRNA sequence
gggcatgccggaagggccca

SEQ ID NO: 715542 - DNA, 20 bp, Artificial
  CRISPR gRNA sequence
tctgaggtccagggagagag

SEQ ID NO: 715543 - DNA, 20 bp, Artificial
  CRISPR gRNA sequence
ggtccagggagagaggagag

SEQ ID NO: 715544 - DNA, 20 bp, Artificial
  CRISPR gRNA sequence
gcctcaaccaacatcactgc

SEQ ID NO: 715545 - DNA, 20 bp, Artificial
  CRISPR gRNA sequence
ctgtctcttctgtacaagcc

SEQ ID NO: 715546 - DNA, 20 bp, Artificial
  CRISPR gRNA sequence
agccccggatcccctaggct

SEQ ID NO: 715547 - DNA, 20 bp, Artificial
  CRISPR gRNA sequence
ggtcaggggacagctaagtt

SEQ ID NO: 715548 - DNA, 20 bp, Artificial
  CRISPR gRNA sequence
tccagaggcagctgtgggca

SEQ ID NO: 715549 - DNA, 20 bp, Artificial
  CRISPR gRNA sequence
aggcggttctgtctcctgct

SEQ ID NO: 715550 - DNA, 20 bp, Artificial
  CRISPR gRNA sequence
gtctcctgctcggggtagtg

SEQ ID NO: 715551 - DNA, 20 bp, Artificial
  CRISPR gRNA sequence
agattttctctgcaaggcaa

SEQ ID NO: 715552 - DNA, 20 bp, Artificial
  CRISPR gRNA sequence
tttctctgcaaggcaaaagg

SEQ ID NO: 715553 - DNA, 20 bp, Artificial
  CRISPR gRNA sequence
agggaggccagagcaccagc

SEQ ID NO: 715554 - DNA, 20 bp, Artificial
  CRISPR gRNA sequence
gcccagtgctggtacacctg

SEQ ID NO: 715555 - DNA, 20 bp, Artificial
  CRISPR gRNA sequence
cagctaggagctgggccttg

SEQ ID NO: 715556 - DNA, 20 bp, Artificial
  CRISPR gRNA sequence
agaaccagcccacttgtact

SEQ ID NO: 715557 - DNA, 20 bp, Artificial
  CRISPR gRNA sequence
gattttctcagcacatctct

SEQ ID NO: 715558 - DNA, 20 bp, Artificial
  CRISPR gRNA sequence
ttctcagcacatctctgcgg

SEQ ID NO: 715559 - DNA, 20 bp, Artificial
  CRISPR gRNA sequence
atgggtagggaagaagagga

SEQ ID NO: 715560 - DNA, 20 bp, Artificial
  CRISPR gRNA sequence
ggacaaaaacaggcaaagcc

SEQ ID NO: 715561 - DNA, 20 bp, Artificial
  CRISPR gRNA sequence
cagtttccacacccccactc

SEQ ID NO: 715562 - DNA, 20 bp, Artificial
  CRISPR gRNA sequence
caagattcccatttacaggt

SEQ ID NO: 715563 - DNA, 20 bp, Artificial
  CRISPR gRNA sequence
gtgtgcctgcagccaaaacc

SEQ ID NO: 715564 - DNA, 20 bp, Artificial
  CRISPR gRNA sequence
tactgcaagtcccgtgtcct

SEQ ID NO: 715565 - DNA, 20 bp, Artificial
  CRISPR gRNA sequence
gagacagcctggctcaggcc

SEQ ID NO: 715566 - DNA, 20 bp, Artificial
  CRISPR gRNA sequence
ttcagtggcccgaggagctg

SEQ ID NO: 715567 - DNA, 20 bp, Artificial
  CRISPR gRNA sequence
ccagctgatggtgtctggct

SEQ ID NO: 715568 - DNA, 20 bp, Artificial
  CRISPR gRNA sequence
ctgcgctggactctggaggc

SEQ ID NO: 715569 - DNA, 20 bp, Artificial
  CRISPR gRNA sequence
tcaagagggaacttgagagc

SEQ ID NO: 715570 - DNA, 20 bp, Artificial
  CRISPR gRNA sequence
agggaacttgagagctgggg

SEQ ID NO: 715571 - DNA, 20 bp, Artificial
  CRISPR gRNA sequence
cttgagagctggggtggggt

SEQ ID NO: 715572 - DNA, 20 bp, Artificial
  CRISPR gRNA sequence
gtgcagggacccctgccttt

SEQ ID NO: 715573 - DNA, 20 bp, Artificial
  CRISPR gRNA sequence
gggtaatgcagttatacccc

SEQ ID NO: 715574 - DNA, 20 bp, Artificial
  CRISPR gRNA sequence
caggaaccccaaaaaggttc

SEQ ID NO: 715575 - DNA, 20 bp, Artificial
  CRISPR gRNA sequence
ggcagcaagaggagaaggcc

SEQ ID NO: 715576 - DNA, 20 bp, Artificial
  CRISPR gRNA sequence
ctgggcaaaagatgggggcc

SEQ ID NO: 715577 - DNA, 20 bp, Artificial
  CRISPR gRNA sequence
aggggagagaaggcccagag

SEQ ID NO: 715578 - DNA, 20 bp, Artificial
  CRISPR gRNA sequence
atgggcagagaagatgagag

SEQ ID NO: 715579 - DNA, 20 bp, Artificial
  CRISPR gRNA sequence
cagagaagatgagaggcggg

SEQ ID NO: 715580 - DNA, 20 bp, Artificial
  CRISPR gRNA sequence
gggtcaggtgggagggaagt

SEQ ID NO: 715581 - DNA, 20 bp, Artificial
  CRISPR gRNA sequence
ggtgggagggaagtgagggt

SEQ ID NO: 715582 - DNA, 20 bp, Artificial
  CRISPR gRNA sequence
gggaagtgagggtgggggtg

SEQ ID NO: 715583 - DNA, 20 bp, Artificial
  CRISPR gRNA sequence
cattcctcagggaaatgggc

SEQ ID NO: 715584 - DNA, 20 bp, Artificial
  CRISPR gRNA sequence
gcaggagtccccaggaaatc

SEQ ID NO: 715585 - DNA, 20 bp, Artificial
  CRISPR gRNA sequence
cccaggaaatctggaattaa

SEQ ID NO: 715586 - DNA, 20 bp, Artificial
  CRISPR gRNA sequence
attaactggattcaaagcgg

SEQ ID NO: 715587 - DNA, 20 bp, Artificial
  CRISPR gRNA sequence
aagcggtggaattggctgct

SEQ ID NO: 715588 - DNA, 20 bp, Artificial
  CRISPR gRNA sequence
actgagctcggaagtgaaag

SEQ ID NO: 715589 - DNA, 20 bp, Artificial
  CRISPR gRNA sequence
aaacttcagagccggccatg

SEQ ID NO: 715590 - DNA, 20 bp, Artificial
  CRISPR gRNA sequence
ctgcctactccccaggctgt

SEQ ID NO: 715591 - DNA, 20 bp, Artificial
  CRISPR gRNA sequence
gggtggcttccaagggctgc

SEQ ID NO: 715592 - DNA, 20 bp, Artificial
  CRISPR gRNA sequence
ctgccccctccccagagctc

SEQ ID NO: 715593 - DNA, 20 bp, Artificial
  CRISPR gRNA sequence
ccccagagctccagagtcca

SEQ ID NO: 715594 - DNA, 20 bp, Artificial
  CRISPR gRNA sequence
ggtgaggaagttggggggaa

SEQ ID NO: 715595 - DNA, 20 bp, Artificial
  CRISPR gRNA sequence
agtgtgacccctcttgggaa

SEQ ID NO: 715596 - DNA, 20 bp, Artificial
  CRISPR gRNA sequence
ggctggcattaggaggacaa

SEQ ID NO: 715597 - DNA, 20 bp, Artificial
  CRISPR gRNA sequence
acaagggggttgcctgtgtc

SEQ ID NO: 715598 - DNA, 20 bp, Artificial
  CRISPR gRNA sequence
caccctctgaaccccacccc

SEQ ID NO: 715599 - DNA, 20 bp, Artificial
  CRISPR gRNA sequence
agttccagttaggacttctt

SEQ ID NO: 715600 - DNA, 20 bp, Artificial
  CRISPR gRNA sequence
aggcagatcaccttgaggcc

SEQ ID NO: 715601 - DNA, 20 bp, Artificial
  CRISPR gRNA sequence
ttccagaccagcctggccaa

SEQ ID NO: 715602 - DNA, 20 bp, Artificial
  CRISPR gRNA sequence
aagagaagatgactgccctg

SEQ ID NO: 715603 - DNA, 20 bp, Artificial
  CRISPR gRNA sequence
ccttccagaagcgacagagg

SEQ ID NO: 715604 - DNA, 20 bp, Artificial
  CRISPR gRNA sequence
ataaacacgcagtcacacca

SEQ ID NO: 715605 - DNA, 20 bp, Artificial
  CRISPR gRNA sequence
caccactgggtgctaggaca

SEQ ID NO: 715606 - DNA, 20 bp, Artificial
  CRISPR gRNA sequence
ggacaccgggtaggggaggc

SEQ ID NO: 715607 - DNA, 20 bp, Artificial
  CRISPR gRNA sequence
tggaggaaggggcaaataag

SEQ ID NO: 715608 - DNA, 20 bp, Artificial
  CRISPR gRNA sequence
gggcaaataagcagggtccc

SEQ ID NO: 715609 - DNA, 20 bp, Artificial
  CRISPR gRNA sequence
agcagggtccccaggatatc

SEQ ID NO: 715610 - DNA, 20 bp, Artificial
  CRISPR gRNA sequence
cccaggatatccagaattaa

SEQ ID NO: 715611 - DNA, 20 bp, Artificial
  CRISPR gRNA sequence
attaactggattcaaggcag

SEQ ID NO: 715612 - DNA, 20 bp, Artificial
  CRISPR gRNA sequence
gagttggctatttcaggcga

SEQ ID NO: 715613 - DNA, 20 bp, Artificial
  CRISPR gRNA sequence
gagaagctcagaagtgacag

SEQ ID NO: 715614 - DNA, 20 bp, Artificial
  CRISPR gRNA sequence
tgagggggagggacagactg

SEQ ID NO: 715615 - DNA, 20 bp, Artificial
  CRISPR gRNA sequence
actgtggggtcagaaggtag

SEQ ID NO: 715616 - DNA, 20 bp, Artificial
  CRISPR gRNA sequence
gctacaacttgctgtcagcc

SEQ ID NO: 715617 - DNA, 20 bp, Artificial
  CRISPR gRNA sequence
ttgctgtcagccttgagtgc

SEQ ID NO: 715618 - DNA, 20 bp, Artificial
  CRISPR gRNA sequence
tcagccttgagtgctggaat

SEQ ID NO: 715619 - DNA, 20 bp, Artificial
  CRISPR gRNA sequence
gagtgctggaataagaatgc

SEQ ID NO: 715620 - DNA, 20 bp, Artificial
  CRISPR gRNA sequence
atgctggaattcatcccata

SEQ ID NO: 715621 - DNA, 20 bp, Artificial
  CRISPR gRNA sequence
gctgctggaggcttctcggc

SEQ ID NO: 715622 - DNA, 20 bp, Artificial
  CRISPR gRNA sequence
gcttctcggcaggagtgcaa

SEQ ID NO: 715623 - DNA, 20 bp, Artificial
  CRISPR gRNA sequence
tctgtcctcctgcttctgca

SEQ ID NO: 715624 - DNA, 20 bp, Artificial
  CRISPR gRNA sequence
tcctcctgcttctgcagagg

SEQ ID NO: 715625 - DNA, 20 bp, Artificial
  CRISPR gRNA sequence
caaggcccagcagatgcggg

SEQ ID NO: 715626 - DNA, 20 bp, Artificial
  CRISPR gRNA sequence
gatggcacctacacagtgcc

SEQ ID NO: 715627 - DNA, 20 bp, Artificial
  CRISPR gRNA sequence
cacgtcttcctcctgtcccc

SEQ ID NO: 715628 - DNA, 20 bp, Artificial
  CRISPR gRNA sequence
gggtgctcggtgttgggggc

SEQ ID NO: 715629 - DNA, 20 bp, Artificial
  CRISPR gRNA sequence
tggggtggtgttcgtttttt

SEQ ID NO: 715630 - DNA, 20 bp, Artificial
  CRISPR gRNA sequence
catctcatgcacactggctc

SEQ ID NO: 715631 - DNA, 20 bp, Artificial
  CRISPR gRNA sequence
ctacttacagaaacttcaat

SEQ ID NO: 715632 - DNA, 20 bp, Artificial
  CRISPR gRNA sequence
cagaaacttcaattggggtg

SEQ ID NO: 715633 - DNA, 20 bp, Artificial
  CRISPR gRNA sequence
tttcctgggcctttcaactc

SEQ ID NO: 715634 - DNA, 20 bp, Artificial
  CRISPR gRNA sequence
ttaaccctcgctcttccgcg

SEQ ID NO: 715635 - DNA, 20 bp, Artificial
  CRISPR gRNA sequence
ctcctcagctgctgtgggac

SEQ ID NO: 715636 - DNA, 20 bp, Artificial
  CRISPR gRNA sequence
tcagctgctgtgggacggga

SEQ ID NO: 715637 - DNA, 20 bp, Artificial
  CRISPR gRNA sequence
gacgggaatgggtgctgctg

SEQ ID NO: 715638 - DNA, 20 bp, Artificial
  CRISPR gRNA sequence
tttcatctctacagacccca

SEQ ID NO: 715639 - DNA, 20 bp, Artificial
  CRISPR gRNA sequence
gccccgggcttctcagcttt

SEQ ID NO: 715640 - DNA, 20 bp, Artificial
  CRISPR gRNA sequence
tttaatttgtactaaatagt

SEQ ID NO: 715641 - DNA, 20 bp, Artificial
  CRISPR gRNA sequence
gggtaacagtcagcgactca

SEQ ID NO: 715642 - DNA, 20 bp, Artificial
  CRISPR gRNA sequence
cctcacaaccactgtatgag

SEQ ID NO: 715643 - DNA, 20 bp, Artificial
  CRISPR gRNA sequence
atgaggaaactgaggcacag

SEQ ID NO: 715644 - DNA, 20 bp, Artificial
  CRISPR gRNA sequence
gaaactgaggcacagaggag

SEQ ID NO: 715645 - DNA, 20 bp, Artificial
  CRISPR gRNA sequence
gaggagtcgagtaattggcc

SEQ ID NO: 715646 - DNA, 20 bp, Artificial
  CRISPR gRNA sequence
ccatcaataagtatctgagc

SEQ ID NO: 715647 - DNA, 20 bp, Artificial
  CRISPR gRNA sequence
atgtcctgatgccttcaaaa

SEQ ID NO: 715648 - DNA, 20 bp, Artificial
  CRISPR gRNA sequence
cctgatgccttcaaaatgga

SEQ ID NO: 715649 - DNA, 20 bp, Artificial
  CRISPR gRNA sequence
gccttcaaaatggagtgagt

SEQ ID NO: 715650 - DNA, 20 bp, Artificial
  CRISPR gRNA sequence
gtgagtaattcagaggaggc

SEQ ID NO: 715651 - DNA, 20 bp, Artificial
  CRISPR gRNA sequence
ccaggaaccacagcttagaa

SEQ ID NO: 715652 - DNA, 20 bp, Artificial
  CRISPR gRNA sequence
ctgagtattcttcactcgct

SEQ ID NO: 715653 - DNA, 20 bp, Artificial
  CRISPR gRNA sequence
cccctctctgagaaacaccc

SEQ ID NO: 715654 - DNA, 20 bp, Artificial
  CRISPR gRNA sequence
aaaaaaaaaaaaaaaaagaa

SEQ ID NO: 715655 - DNA, 20 bp, Artificial
  CRISPR gRNA sequence
atttttcaaagtggaaattc

SEQ ID NO: 715656 - DNA, 20 bp, Artificial
  CRISPR gRNA sequence
catccacaactacctatcag

SEQ ID NO: 715657 - DNA, 20 bp, Artificial
  CRISPR gRNA sequence
accaaccttaatacatactc

SEQ ID NO: 715658 - DNA, 20 bp, Artificial
  CRISPR gRNA sequence
ttttttttttttttttcaga

SEQ ID NO: 715659 - DNA, 20 bp, Artificial
  CRISPR gRNA sequence
gattctcctgcctcagcctc

SEQ ID NO: 715660 - DNA, 20 bp, Artificial
  CRISPR gRNA sequence
acaggcgtgtgccactacac

SEQ ID NO: 715661 - DNA, 20 bp, Artificial
  CRISPR gRNA sequence
ttttgtagttttagtagaga

SEQ ID NO: 715662 - DNA, 20 bp, Artificial
  CRISPR gRNA sequence
gcctcagcctcccaaaatgc

SEQ ID NO: 715663 - DNA, 20 bp, Artificial
  CRISPR gRNA sequence
tttgattaccttacaaattg

SEQ ID NO: 715664 - DNA, 20 bp, Artificial
  CRISPR gRNA sequence
cttgtcacatccaagcatat

SEQ ID NO: 715665 - DNA, 20 bp, Artificial
  CRISPR gRNA sequence
tatattatattgaaaaatga

SEQ ID NO: 715666 - DNA, 20 bp, Artificial
  CRISPR gRNA sequence
atagaaacccttcttaatgt

SEQ ID NO: 715667 - DNA, 20 bp, Artificial
  CRISPR gRNA sequence
ccttcttaatgtatgaatgc

SEQ ID NO: 715668 - DNA, 20 bp, Artificial
  CRISPR gRNA sequence
agatggggaaaaaaaaaaaa

SEQ ID NO: 715669 - DNA, 20 bp, Artificial
  CRISPR gRNA sequence
ctgctctgtcatccagcttg

SEQ ID NO: 715670 - DNA, 20 bp, Artificial
  CRISPR gRNA sequence
ttggaggatgagattcatgg

SEQ ID NO: 715671 - DNA, 20 bp, Artificial
  CRISPR gRNA sequence
caggagctggaggctgctat

SEQ ID NO: 715672 - DNA, 20 bp, Artificial
  CRISPR gRNA sequence
tgtgcacagaggtccctgtg

SEQ ID NO: 715673 - DNA, 20 bp, Artificial
  CRISPR gRNA sequence
caccctgggcactgtgggag

SEQ ID NO: 715674 - DNA, 20 bp, Artificial
  CRISPR gRNA sequence
aacttcagatctgttaggga

SEQ ID NO: 715675 - DNA, 20 bp, Artificial
  CRISPR gRNA sequence
agctgaggtgggggcaaggg

SEQ ID NO: 715676 - DNA, 20 bp, Artificial
  CRISPR gRNA sequence
tacttaccgttgagctcctc

SEQ ID NO: 715677 - DNA, 20 bp, Artificial
  CRISPR gRNA sequence
cgttgagctcctcctgggtc

SEQ ID NO: 715678 - DNA, 20 bp, Artificial
  CRISPR gRNA sequence
caagagcagcaacttcacca

SEQ ID NO: 715679 - DNA, 20 bp, Artificial
  CRISPR gRNA sequence
actattggcaaatggtcctc

SEQ ID NO: 715680 - DNA, 20 bp, Artificial
  CRISPR gRNA sequence
ggtggtgctgaactcagccc

SEQ ID NO: 715681 - DNA, 20 bp, Artificial
  CRISPR gRNA sequence
ctcagtctggagagccctcg

SEQ ID NO: 715682 - DNA, 20 bp, Artificial
  CRISPR gRNA sequence
ggagagccctcgatgggttt

SEQ ID NO: 715683 - DNA, 20 bp, Artificial
  CRISPR gRNA sequence
ttttttttttttttttgaga

SEQ ID NO: 715684 - DNA, 20 bp, Artificial
  CRISPR gRNA sequence
tctcactctgtcacccaggc

SEQ ID NO: 715685 - DNA, 20 bp, Artificial
  CRISPR gRNA sequence
ctcaatgtaacctccgcctc

SEQ ID NO: 715686 - DNA, 20 bp, Artificial
  CRISPR gRNA sequence
gattctcatgcctcagcctc

SEQ ID NO: 715687 - DNA, 20 bp, Artificial
  CRISPR gRNA sequence
gcctcagcctcccgaatagc

SEQ ID NO: 715688 - DNA, 20 bp, Artificial
  CRISPR gRNA sequence
ttttgtattttcagtagaga

SEQ ID NO: 715689 - DNA, 20 bp, Artificial
  CRISPR gRNA sequence
gccttggccttgcaaagtgc

SEQ ID NO: 715690 - DNA, 20 bp, Artificial
  CRISPR gRNA sequence
ccccacccccgcgcacatgc

SEQ ID NO: 715691 - DNA, 20 bp, Artificial
  CRISPR gRNA sequence
cagagcccaggaggcttcca

SEQ ID NO: 715692 - DNA, 20 bp, Artificial
  CRISPR gRNA sequence
tgcgcccaccttactgtctc

SEQ ID NO: 715693 - DNA, 20 bp, Artificial
  CRISPR gRNA sequence
tctccagggtgtggagagcc

SEQ ID NO: 715694 - DNA, 20 bp, Artificial
  CRISPR gRNA sequence
gtggagagccccgaattctc

SEQ ID NO: 715695 - DNA, 20 bp, Artificial
  CRISPR gRNA sequence
ctcaaggcaggtcatggaga

SEQ ID NO: 715696 - DNA, 20 bp, Artificial
  CRISPR gRNA sequence
caggtcatggagacaggatg

SEQ ID NO: 715697 - DNA, 20 bp, Artificial
  CRISPR gRNA sequence
cccagagcagaccatcctcc

SEQ ID NO: 715698 - DNA, 20 bp, Artificial
  CRISPR gRNA sequence
gaacgctacctacggagatc

SEQ ID NO: 715699 - DNA, 20 bp, Artificial
  CRISPR gRNA sequence
gctctggagagccaccagcc

SEQ ID NO: 715700 - DNA, 20 bp, Artificial
  CRISPR gRNA sequence
accagtgctcagtcaacaag

SEQ ID NO: 715701 - DNA, 20 bp, Artificial
  CRISPR gRNA sequence
acacgctgtgtggacactag

SEQ ID NO: 715702 - DNA, 20 bp, Artificial
  CRISPR gRNA sequence
tgagtttgggaaacactctt

SEQ ID NO: 715703 - DNA, 20 bp, Artificial
  CRISPR gRNA sequence
aattttttctttttttgaga

SEQ ID NO: 715704 - DNA, 20 bp, Artificial
  CRISPR gRNA sequence
tctcactctgtcacccaggc

SEQ ID NO: 715705 - DNA, 20 bp, Artificial
  CRISPR gRNA sequence
aagcaattctcacaagtagc

SEQ ID NO: 715706 - DNA, 20 bp, Artificial
  CRISPR gRNA sequence
gcctcggcctctcgaagtgc

SEQ ID NO: 715707 - DNA, 20 bp, Artificial
  CRISPR gRNA sequence
atgagccaccttgcccggcc

SEQ ID NO: 715708 - DNA, 20 bp, Artificial
  CRISPR gRNA sequence
ttttttttttttttttgaga

SEQ ID NO: 715709 - DNA, 20 bp, Artificial
  CRISPR gRNA sequence
atggagtctaactctgtcgc

SEQ ID NO: 715710 - DNA, 20 bp, Artificial
  CRISPR gRNA sequence
ctcactgcaacctccgcctc

SEQ ID NO: 715711 - DNA, 20 bp, Artificial
  CRISPR gRNA sequence
gattctcctgcctcagcctc

SEQ ID NO: 715712 - DNA, 20 bp, Artificial
  CRISPR gRNA sequence
gcctcagcctcccgagtagc

SEQ ID NO: 715713 - DNA, 20 bp, Artificial
  CRISPR gRNA sequence
ttttgtatttttagtagaga

SEQ ID NO: 715714 - DNA, 20 bp, Artificial
  CRISPR gRNA sequence
gcctcggcctcccaaagtgc

SEQ ID NO: 715715 - DNA, 20 bp, Artificial
  CRISPR gRNA sequence
aaactaaatcatggtccctc

SEQ ID NO: 715716 - DNA, 20 bp, Artificial
  CRISPR gRNA sequence
atggtccctccagagtgatt

SEQ ID NO: 715717 - DNA, 20 bp, Artificial
  CRISPR gRNA sequence
ttctttggtaccaagtcact

SEQ ID NO: 715718 - DNA, 20 bp, Artificial
  CRISPR gRNA sequence
aagtcactgggggtggccaa

SEQ ID NO: 715719 - DNA, 20 bp, Artificial
  CRISPR gRNA sequence
aactcggccttgaaggggaa

SEQ ID NO: 715720 - DNA, 20 bp, Artificial
  CRISPR gRNA sequence
ttgaaggggaagtgggtgaa

SEQ ID NO: 715721 - DNA, 20 bp, Artificial
  CRISPR gRNA sequence
caaaaaggccgagcacagca

SEQ ID NO: 715722 - DNA, 20 bp, Artificial
  CRISPR gRNA sequence
ctgtcctcccagctggaaaa

SEQ ID NO: 715723 - DNA, 20 bp, Artificial
  CRISPR gRNA sequence
cctcccagctggaaaatggg

SEQ ID NO: 715724 - DNA, 20 bp, Artificial
  CRISPR gRNA sequence
ttttttttttttttttgaga

SEQ ID NO: 715725 - DNA, 20 bp, Artificial
  CRISPR gRNA sequence
tctcgctctgtcaccgaggc

SEQ ID NO: 715726 - DNA, 20 bp, Artificial
  CRISPR gRNA sequence
ctcaatgcaacctctgcctc

SEQ ID NO: 715727 - DNA, 20 bp, Artificial
  CRISPR gRNA sequence
ttttgtattttcggtagaga

SEQ ID NO: 715728 - DNA, 20 bp, Artificial
  CRISPR gRNA sequence
ggcttggcctcccaaagtgc

SEQ ID NO: 715729 - DNA, 20 bp, Artificial
  CRISPR gRNA sequence
tctgagaaacggccacaggc

SEQ ID NO: 715730 - DNA, 20 bp, Artificial
  CRISPR gRNA sequence
agcctaaggcgacatgatga

SEQ ID NO: 715731 - DNA, 20 bp, Artificial
  CRISPR gRNA sequence
gactgaatgtgacgtggctc

SEQ ID NO: 715732 - DNA, 20 bp, Artificial
  CRISPR gRNA sequence
aatgtgacgtggctcctgga

SEQ ID NO: 715733 - DNA, 20 bp, Artificial
  CRISPR gRNA sequence
gatgctaatcacagaggaaa

SEQ ID NO: 715734 - DNA, 20 bp, Artificial
  CRISPR gRNA sequence
ggtgggcaaatcacgatgcc

SEQ ID NO: 715735 - DNA, 20 bp, Artificial
  CRISPR gRNA sequence
tactcgggaggctgaggcag

SEQ ID NO: 715736 - DNA, 20 bp, Artificial
  CRISPR gRNA sequence
tgggcagatcacttgagctc

SEQ ID NO: 715737 - DNA, 20 bp, Artificial
  CRISPR gRNA sequence
cccagctactggggaggctg

SEQ ID NO: 715738 - DNA, 20 bp, Artificial
  CRISPR gRNA sequence
atgattgtaccatggcactc

SEQ ID NO: 715739 - DNA, 20 bp, Artificial
  CRISPR gRNA sequence
acttaaaaatgaaggccact

SEQ ID NO: 715740 - DNA, 20 bp, Artificial
  CRISPR gRNA sequence
gctcgctctgttgctcagcc

SEQ ID NO: 715741 - DNA, 20 bp, Artificial
  CRISPR gRNA sequence
aattctcctgcctcagcctc

SEQ ID NO: 715742 - DNA, 20 bp, Artificial
  CRISPR gRNA sequence
gcctcagcctcccgagtagc

SEQ ID NO: 715743 - DNA, 20 bp, Artificial
  CRISPR gRNA sequence
ttttttatttttagtagaga

SEQ ID NO: 715744 - DNA, 20 bp, Artificial
  CRISPR gRNA sequence
accttggcctcccaaagtgc

SEQ ID NO: 715745 - DNA, 20 bp, Artificial
  CRISPR gRNA sequence
gccactacacctggcctact

SEQ ID NO: 715746 - DNA, 20 bp, Artificial
  CRISPR gRNA sequence
tattttaaaaagaaggtgtc

SEQ ID NO: 715747 - DNA, 20 bp, Artificial
  CRISPR gRNA sequence
cagcaggttcaggaaaagcc

SEQ ID NO: 715748 - DNA, 20 bp, Artificial
  CRISPR gRNA sequence
tggctctgcactccgtcaca

SEQ ID NO: 715749 - DNA, 20 bp, Artificial
  CRISPR gRNA sequence
cgtcacactgaatggaaagt

SEQ ID NO: 715750 - DNA, 20 bp, Artificial
  CRISPR gRNA sequence
aaatcacagaggtaaaaagg

SEQ ID NO: 715751 - DNA, 20 bp, Artificial
  CRISPR gRNA sequence
agagccgtgttacaacccat

SEQ ID NO: 715752 - DNA, 20 bp, Artificial
  CRISPR gRNA sequence
ttgttggtttccttgccttt

SEQ ID NO: 715753 - DNA, 20 bp, Artificial
  CRISPR gRNA sequence
aagcagaacaggcccaaggg

SEQ ID NO: 715754 - DNA, 20 bp, Artificial
  CRISPR gRNA sequence
aagttaagctgggaacatct

SEQ ID NO: 715755 - DNA, 20 bp, Artificial
  CRISPR gRNA sequence
taagggacgtgctcaaagca

SEQ ID NO: 715756 - DNA, 20 bp, Artificial
  CRISPR gRNA sequence
acgtgctcaaagcacaggat

SEQ ID NO: 715757 - DNA, 20 bp, Artificial
  CRISPR gRNA sequence
attgaacagaacagggcccc

SEQ ID NO: 715758 - DNA, 20 bp, Artificial
  CRISPR gRNA sequence
cgggaggaccacttgaggcc

SEQ ID NO: 715759 - DNA, 20 bp, Artificial
  CRISPR gRNA sequence
cacttgggaggctgaagcag

SEQ ID NO: 715760 - DNA, 20 bp, Artificial
  CRISPR gRNA sequence
attgcttgaacccaggaggc

SEQ ID NO: 715761 - DNA, 20 bp, Artificial
  CRISPR gRNA sequence
tcacactactgcactccagc

SEQ ID NO: 715762 - DNA, 20 bp, Artificial
  CRISPR gRNA sequence
gagaaaatgaaggtctgctg

SEQ ID NO: 715763 - DNA, 20 bp, Artificial
  CRISPR gRNA sequence
tccagcccaagatgcatgac

SEQ ID NO: 715764 - DNA, 20 bp, Artificial
  CRISPR gRNA sequence
gtgaaagaaacgcctgggga

SEQ ID NO: 715765 - DNA, 20 bp, Artificial
  CRISPR gRNA sequence
tgtaacacgtggccctgagc

SEQ ID NO: 715766 - DNA, 20 bp, Artificial
  CRISPR gRNA sequence
aagaaacttcaacagggcct

SEQ ID NO: 715767 - DNA, 20 bp, Artificial
  CRISPR gRNA sequence
acagggcctgagaattcatt

SEQ ID NO: 715768 - DNA, 20 bp, Artificial
  CRISPR gRNA sequence
attgtgggtcatgtatcagt

SEQ ID NO: 715769 - DNA, 20 bp, Artificial
  CRISPR gRNA sequence
gaaacacacactgaagtttt

SEQ ID NO: 715770 - DNA, 20 bp, Artificial
  CRISPR gRNA sequence
ctcaaatggttcaggtcaaa

SEQ ID NO: 715771 - DNA, 20 bp, Artificial
  CRISPR gRNA sequence
aaactgtttcaaaacaaaaa

SEQ ID NO: 715772 - DNA, 20 bp, Artificial
  CRISPR gRNA sequence
tctttcaacctaaatctccc

SEQ ID NO: 715773 - DNA, 20 bp, Artificial
  CRISPR gRNA sequence
ctcaagtgctcataaaaatg

SEQ ID NO: 715774 - DNA, 20 bp, Artificial
  CRISPR gRNA sequence
tcataaaaatgaaggattaa

SEQ ID NO: 715775 - DNA, 20 bp, Artificial
  CRISPR gRNA sequence
actttgggaggccgaggcag

SEQ ID NO: 715776 - DNA, 20 bp, Artificial
  CRISPR gRNA sequence
ggcaggcggatcatgaggtc

SEQ ID NO: 715777 - DNA, 20 bp, Artificial
  CRISPR gRNA sequence
tactcaggaggctgaggcag

SEQ ID NO: 715778 - DNA, 20 bp, Artificial
  CRISPR gRNA sequence
tggcaccagtgcactccagc

SEQ ID NO: 715779 - DNA, 20 bp, Artificial
  CRISPR gRNA sequence
ctcaaaaaaaaaaaaaaaaa

SEQ ID NO: 715780 - DNA, 20 bp, Artificial
  CRISPR gRNA sequence
aggggctgtacaacgtccta

SEQ ID NO: 715781 - DNA, 20 bp, Artificial
  CRISPR gRNA sequence
tcccaaatgtcaatggtgcc

SEQ ID NO: 715782 - DNA, 20 bp, Artificial
  CRISPR gRNA sequence
cacccagcacgtggccttaa

SEQ ID NO: 715783 - DNA, 20 bp, Artificial
  CRISPR gRNA sequence
aggctgctaatctgtgcaac

SEQ ID NO: 715784 - DNA, 20 bp, Artificial
  CRISPR gRNA sequence
agtacctcacaggccaccgg

SEQ ID NO: 715785 - DNA, 20 bp, Artificial
  CRISPR gRNA sequence
cctcacaggccaccggagga

SEQ ID NO: 715786 - DNA, 20 bp, Artificial
  CRISPR gRNA sequence
agcaccctctgccccaggtc

SEQ ID NO: 715787 - DNA, 20 bp, Artificial
  CRISPR gRNA sequence
ctttggcctctgcgggcagt

SEQ ID NO: 715788 - DNA, 20 bp, Artificial
  CRISPR gRNA sequence
aagtgctccgtgaagaccat

SEQ ID NO: 715789 - DNA, 20 bp, Artificial
  CRISPR gRNA sequence
cgtgaagaccatgtgaatag

SEQ ID NO: 715790 - DNA, 20 bp, Artificial
  CRISPR gRNA sequence
caaggtcccaccagaagcta

SEQ ID NO: 715791 - DNA, 20 bp, Artificial
  CRISPR gRNA sequence
ctgagataagatgtccacca

SEQ ID NO: 715792 - DNA, 20 bp, Artificial
  CRISPR gRNA sequence
gcctatgcaagggcctctgc

SEQ ID NO: 715793 - DNA, 20 bp, Artificial
  CRISPR gRNA sequence
ttaggctgagcacgtggctc

SEQ ID NO: 715794 - DNA, 20 bp, Artificial
  CRISPR gRNA sequence
agaacaaaggtcatcactgg

SEQ ID NO: 715795 - DNA, 20 bp, Artificial
  CRISPR gRNA sequence
accctgcctggacaggtgag

SEQ ID NO: 715796 - DNA, 20 bp, Artificial
  CRISPR gRNA sequence
agctggcccagaggctgggc

SEQ ID NO: 715797 - DNA, 20 bp, Artificial
  CRISPR gRNA sequence
cccagaggctgggcagggat

SEQ ID NO: 715798 - DNA, 20 bp, Artificial
  CRISPR gRNA sequence
cagagtgcagggaccaggga

SEQ ID NO: 715799 - DNA, 20 bp, Artificial
  CRISPR gRNA sequence
cgcttaacagcccgacctcg

SEQ ID NO: 715800 - DNA, 20 bp, Artificial
  CRISPR gRNA sequence
gattctaccatctgcatttt

SEQ ID NO: 715801 - DNA, 20 bp, Artificial
  CRISPR gRNA sequence
ggacaattcagtaactcacc

SEQ ID NO: 715802 - DNA, 20 bp, Artificial
  CRISPR gRNA sequence
cagcttgtaagtggcagaac

SEQ ID NO: 715803 - DNA, 20 bp, Artificial
  CRISPR gRNA sequence
aggagggagagggagaaagg

SEQ ID NO: 715804 - DNA, 20 bp, Artificial
  CRISPR gRNA sequence
ggagagggagaaagggaggg

SEQ ID NO: 715805 - DNA, 20 bp, Artificial
  CRISPR gRNA sequence
gagaggaaggcaaggctggc

SEQ ID NO: 715806 - DNA, 20 bp, Artificial
  CRISPR gRNA sequence
ggctggcaggaatgccccct

SEQ ID NO: 715807 - DNA, 20 bp, Artificial
  CRISPR gRNA sequence
tcattgcattctccacacgc

SEQ ID NO: 715808 - DNA, 20 bp, Artificial
  CRISPR gRNA sequence
attgcatccctacagatgta

SEQ ID NO: 715809 - DNA, 20 bp, Artificial
  CRISPR gRNA sequence
cagacagggagcttcgaggc

SEQ ID NO: 715810 - DNA, 20 bp, Artificial
  CRISPR gRNA sequence
cttgggctgggaggtctgga

SEQ ID NO: 715811 - DNA, 20 bp, Artificial
  CRISPR gRNA sequence
acgacaccaggaggaaggct

SEQ ID NO: 715812 - DNA, 20 bp, Artificial
  CRISPR gRNA sequence
ggacacagccacttactctg

SEQ ID NO: 715813 - DNA, 20 bp, Artificial
  CRISPR gRNA sequence
ccgaccaccacaaccaacac

SEQ ID NO: 715814 - DNA, 20 bp, Artificial
  CRISPR gRNA sequence
agaagggcaaactgtgtcta

SEQ ID NO: 715815 - DNA, 20 bp, Artificial
  CRISPR gRNA sequence
gcgtctaggagccagaacaa

SEQ ID NO: 715816 - DNA, 20 bp, Artificial
  CRISPR gRNA sequence
ggcagcactgctggtgtggc

SEQ ID NO: 715817 - DNA, 20 bp, Artificial
  CRISPR gRNA sequence
actgctggtgtggccggagt

SEQ ID NO: 715818 - DNA, 20 bp, Artificial
  CRISPR gRNA sequence
ctgcttgatgagggcaggca

SEQ ID NO: 715819 - DNA, 20 bp, Artificial
  CRISPR gRNA sequence
acacaccccacaagcgttcc

SEQ ID NO: 715820 - DNA, 20 bp, Artificial
  CRISPR gRNA sequence
accccacaagcgttccctga

SEQ ID NO: 715821 - DNA, 20 bp, Artificial
  CRISPR gRNA sequence
aagttgcccaaggtcaccct

SEQ ID NO: 715822 - DNA, 20 bp, Artificial
  CRISPR gRNA sequence
tctcaaacgttaatgtgcac

SEQ ID NO: 715823 - DNA, 20 bp, Artificial
  CRISPR gRNA sequence
agtttctgattctctaggtc

SEQ ID NO: 715824 - DNA, 20 bp, Artificial
  CRISPR gRNA sequence
ctagaactgcaagtcctaaa

SEQ ID NO: 715825 - DNA, 20 bp, Artificial
  CRISPR gRNA sequence
ttccctaagagctaactctt

SEQ ID NO: 715826 - DNA, 20 bp, Artificial
  CRISPR gRNA sequence
tctcattctgctgctcaggc

SEQ ID NO: 715827 - DNA, 20 bp, Artificial
  CRISPR gRNA sequence
aaccttgcaacctccgcctc

SEQ ID NO: 715828 - DNA, 20 bp, Artificial
  CRISPR gRNA sequence
gattctcctgcctcagcctc

SEQ ID NO: 715829 - DNA, 20 bp, Artificial
  CRISPR gRNA sequence
gcctcagcctcctgagtagc

SEQ ID NO: 715830 - DNA, 20 bp, Artificial
  CRISPR gRNA sequence
accttggcctcccaaagtgc

SEQ ID NO: 715831 - DNA, 20 bp, Artificial
  CRISPR gRNA sequence
aatcaacaaagacctatttt

SEQ ID NO: 715832 - DNA, 20 bp, Artificial
  CRISPR gRNA sequence
gagtagcaattataagccac

SEQ ID NO: 715833 - DNA, 20 bp, Artificial
  CRISPR gRNA sequence
tgaaaaaaattcctgcctac

SEQ ID NO: 715834 - DNA, 20 bp, Artificial
  CRISPR gRNA sequence
attcctgcctacaagaatta

SEQ ID NO: 715835 - DNA, 20 bp, Artificial
  CRISPR gRNA sequence
actttgggaggctgaagcag

SEQ ID NO: 715836 - DNA, 20 bp, Artificial
  CRISPR gRNA sequence
caggtggatcacctgaggtc

SEQ ID NO: 715837 - DNA, 20 bp, Artificial
  CRISPR gRNA sequence
tactcgggaggctgagacag

SEQ ID NO: 715838 - DNA, 20 bp, Artificial
  CRISPR gRNA sequence
ggaggttgcagtgagccaag

SEQ ID NO: 715839 - DNA, 20 bp, Artificial
  CRISPR gRNA sequence
ctgccctccagcctgagcaa

SEQ ID NO: 715840 - DNA, 20 bp, Artificial
  CRISPR gRNA sequence
tgagactgtttcaaaaagaa

SEQ ID NO: 715841 - DNA, 20 bp, Artificial
  CRISPR gRNA sequence
aactcaagaagccagaaacc

SEQ ID NO: 715842 - DNA, 20 bp, Artificial
  CRISPR gRNA sequence
cccaggaggaagcccctgct

SEQ ID NO: 715843 - DNA, 20 bp, Artificial
  CRISPR gRNA sequence
aggaagcccctgctgggagt

SEQ ID NO: 715844 - DNA, 20 bp, Artificial
  CRISPR gRNA sequence
agcccctgctgggagtaggg

SEQ ID NO: 715845 - DNA, 20 bp, Artificial
  CRISPR gRNA sequence
agagcgacgggagcgctggt

SEQ ID NO: 715846 - DNA, 20 bp, Artificial
  CRISPR gRNA sequence
gggcagcgtcttactggcct

SEQ ID NO: 715847 - DNA, 20 bp, Artificial
  CRISPR gRNA sequence
tgggagtccaccagcaagct

SEQ ID NO: 715848 - DNA, 20 bp, Artificial
  CRISPR gRNA sequence
tgcggggagaagcccaaggc

SEQ ID NO: 715849 - DNA, 20 bp, Artificial
  CRISPR gRNA sequence
atgaagatgggaagagggaa

SEQ ID NO: 715850 - DNA, 20 bp, Artificial
  CRISPR gRNA sequence
gaagagggaagtgggtcttc

SEQ ID NO: 715851 - DNA, 20 bp, Artificial
  CRISPR gRNA sequence
gggcccctagatcctctgcc

SEQ ID NO: 715852 - DNA, 20 bp, Artificial
  CRISPR gRNA sequence
aggcattttgagggcaggga

SEQ ID NO: 715853 - DNA, 20 bp, Artificial
  CRISPR gRNA sequence
gcagcagccaaacagagaga

SEQ ID NO: 715854 - DNA, 20 bp, Artificial
  CRISPR gRNA sequence
caaacagagagaaggggtgg

SEQ ID NO: 715855 - DNA, 20 bp, Artificial
  CRISPR gRNA sequence
gcaggcgcctcgccattctc

SEQ ID NO: 715856 - DNA, 20 bp, Artificial
  CRISPR gRNA sequence
cgcctcgccattctctgggg

SEQ ID NO: 715857 - DNA, 20 bp, Artificial
  CRISPR gRNA sequence
ggggtggggttgcagtccgg

SEQ ID NO: 715858 - DNA, 20 bp, Artificial
  CRISPR gRNA sequence
tgcagtccggctgggtcccc

SEQ ID NO: 715859 - DNA, 20 bp, Artificial
  CRISPR gRNA sequence
ggaggctggtgtctccagga

SEQ ID NO: 715860 - DNA, 20 bp, Artificial
  CRISPR gRNA sequence
caggaggaccacttgaggtc

SEQ ID NO: 715861 - DNA, 20 bp, Artificial
  CRISPR gRNA sequence
tactcaggaggctgaggcag

SEQ ID NO: 715862 - DNA, 20 bp, Artificial
  CRISPR gRNA sequence
cttttaaatcaactttatta

SEQ ID NO: 715863 - DNA, 20 bp, Artificial
  CRISPR gRNA sequence
ttatgtttaattttttgaga

SEQ ID NO: 715864 - DNA, 20 bp, Artificial
  CRISPR gRNA sequence
tcttcctctgctgcccagac

SEQ ID NO: 715865 - DNA, 20 bp, Artificial
  CRISPR gRNA sequence
ctcattgcaacttctgcctc

SEQ ID NO: 715866 - DNA, 20 bp, Artificial
  CRISPR gRNA sequence
gattctcctgcctcagcctc

SEQ ID NO: 715867 - DNA, 20 bp, Artificial
  CRISPR gRNA sequence
gcctcagcctcctgagtagc

SEQ ID NO: 715868 - DNA, 20 bp, Artificial
  CRISPR gRNA sequence
ttttgtatttttagtagaaa

SEQ ID NO: 715869 - DNA, 20 bp, Artificial
  CRISPR gRNA sequence
acctcagcctcccaaagtgc

SEQ ID NO: 715870 - DNA, 20 bp, Artificial
  CRISPR gRNA sequence
tacaagaaagtatcccctgg

SEQ ID NO: 715871 - DNA, 20 bp, Artificial
  CRISPR gRNA sequence
gaaagtatcccctggcaggg

SEQ ID NO: 715872 - DNA, 20 bp, Artificial
  CRISPR gRNA sequence
caggcagatcacttgagctc

SEQ ID NO: 715873 - DNA, 20 bp, Artificial
  CRISPR gRNA sequence
ccctaagtgtgtacagcctg

SEQ ID NO: 715874 - DNA, 20 bp, Artificial
  CRISPR gRNA sequence
tctgctttatgtcactatag

SEQ ID NO: 715875 - DNA, 20 bp, Artificial
  CRISPR gRNA sequence
atagaggagtgtatctgttc

SEQ ID NO: 715876 - DNA, 20 bp, Artificial
  CRISPR gRNA sequence
gttccagaatttcatgtcga

SEQ ID NO: 715877 - DNA, 20 bp, Artificial
  CRISPR gRNA sequence
atcatgcagtatgtactctt

SEQ ID NO: 715878 - DNA, 20 bp, Artificial
  CRISPR gRNA sequence
gttcgctagttgatggacat

SEQ ID NO: 715879 - DNA, 20 bp, Artificial
  CRISPR gRNA sequence
ctatgacgaacaaggcagct

SEQ ID NO: 715880 - DNA, 20 bp, Artificial
  CRISPR gRNA sequence
aacgtataatttcattcctc

SEQ ID NO: 715881 - DNA, 20 bp, Artificial
  CRISPR gRNA sequence
attcctcttgagtgcctagg

SEQ ID NO: 715882 - DNA, 20 bp, Artificial
  CRISPR gRNA sequence
tgagtgcctaggaagggtgg

SEQ ID NO: 715883 - DNA, 20 bp, Artificial
  CRISPR gRNA sequence
ggattgctatgctggccaga

SEQ ID NO: 715884 - DNA, 20 bp, Artificial
  CRISPR gRNA sequence
acagccaggaaacagagatg

SEQ ID NO: 715885 - DNA, 20 bp, Artificial
  CRISPR gRNA sequence
ccagcccagagcactctcct

SEQ ID NO: 715886 - DNA, 20 bp, Artificial
  CRISPR gRNA sequence
agcttcctgcttttctgggg

SEQ ID NO: 715887 - DNA, 20 bp, Artificial
  CRISPR gRNA sequence
taatttggcccacattagaa

SEQ ID NO: 715888 - DNA, 20 bp, Artificial
  CRISPR gRNA sequence
aatagacaaaaaagtaaagc

SEQ ID NO: 715889 - DNA, 20 bp, Artificial
  CRISPR gRNA sequence
ttaatttatttcttgcattg

SEQ ID NO: 715890 - DNA, 20 bp, Artificial
  CRISPR gRNA sequence
gaaggtcactggactcttac

SEQ ID NO: 715891 - DNA, 20 bp, Artificial
  CRISPR gRNA sequence
acatgctcgttaatcagtat

SEQ ID NO: 715892 - DNA, 20 bp, Artificial
  CRISPR gRNA sequence
aatcagtgtttgaaaggtca

SEQ ID NO: 715893 - DNA, 20 bp, Artificial
  CRISPR gRNA sequence
ggtttcagtgaacacttact

SEQ ID NO: 715894 - DNA, 20 bp, Artificial
  CRISPR gRNA sequence
aggggggaacctagtatccc

SEQ ID NO: 715895 - DNA, 20 bp, Artificial
  CRISPR gRNA sequence
gggtgcctctcatcccctct

SEQ ID NO: 715896 - DNA, 20 bp, Artificial
  CRISPR gRNA sequence
gtaactttccttcttcctcc

SEQ ID NO: 715897 - DNA, 20 bp, Artificial
  CRISPR gRNA sequence
tcctccccttttcctcctct

SEQ ID NO: 715898 - DNA, 20 bp, Artificial
  CRISPR gRNA sequence
aaaaaaatattatttaccag

SEQ ID NO: 715899 - DNA, 20 bp, Artificial
  CRISPR gRNA sequence
cccagtccttgggccattta

SEQ ID NO: 715900 - DNA, 20 bp, Artificial
  CRISPR gRNA sequence
tgtcatctttttcttttccc

SEQ ID NO: 715901 - DNA, 20 bp, Artificial
  CRISPR gRNA sequence
acttcccttccttgctctgc

SEQ ID NO: 715902 - DNA, 20 bp, Artificial
  CRISPR gRNA sequence
ccttccttgctctgctagga

SEQ ID NO: 715903 - DNA, 20 bp, Artificial
  CRISPR gRNA sequence
ttttttgccccctcacttag

SEQ ID NO: 715904 - DNA, 20 bp, Artificial
  CRISPR gRNA sequence
cttcaaatatcttcctagga

SEQ ID NO: 715905 - DNA, 20 bp, Artificial
  CRISPR gRNA sequence
ctgaagtgactgtaatttag

SEQ ID NO: 715906 - DNA, 20 bp, Artificial
  CRISPR gRNA sequence
ggttcagaactaagaaggag

SEQ ID NO: 715907 - DNA, 20 bp, Artificial
  CRISPR gRNA sequence
cagaactaagaaggaggtgg

SEQ ID NO: 715908 - DNA, 20 bp, Artificial
  CRISPR gRNA sequence
aagtactctgggctgaccct

SEQ ID NO: 715909 - DNA, 20 bp, Artificial
  CRISPR gRNA sequence
cttcggccctgtgcttctct

SEQ ID NO: 715910 - DNA, 20 bp, Artificial
  CRISPR gRNA sequence
tctctctgggtgtaaaacga

SEQ ID NO: 715911 - DNA, 20 bp, Artificial
  CRISPR gRNA sequence
atccacccaaagacttgtac

SEQ ID NO: 715912 - DNA, 20 bp, Artificial
  CRISPR gRNA sequence
actgtgggaggctgaggtgg

SEQ ID NO: 715913 - DNA, 20 bp, Artificial
  CRISPR gRNA sequence
tgggaggatcgcccgagccc

SEQ ID NO: 715914 - DNA, 20 bp, Artificial
  CRISPR gRNA sequence
ctgcactccagcctggaaca

SEQ ID NO: 715915 - DNA, 20 bp, Artificial
  CRISPR gRNA sequence
atacatgttaaaaaaaaaaa

SEQ ID NO: 715916 - DNA, 20 bp, Artificial
  CRISPR gRNA sequence
gtgcatctattacatgtagc

SEQ ID NO: 715917 - DNA, 20 bp, Artificial
  CRISPR gRNA sequence
gggagacgcctggagcactt

SEQ ID NO: 715918 - DNA, 20 bp, Artificial
  CRISPR gRNA sequence
ccaaagacctgtggctggtg

SEQ ID NO: 715919 - DNA, 20 bp, Artificial
  CRISPR gRNA sequence
gctggtgggggatgcacaga

SEQ ID NO: 715920 - DNA, 20 bp, Artificial
  CRISPR gRNA sequence
gggatgcacagagggaatca

SEQ ID NO: 715921 - DNA, 20 bp, Artificial
  CRISPR gRNA sequence
cttttgcgaggccgaggcag

SEQ ID NO: 715922 - DNA, 20 bp, Artificial
  CRISPR gRNA sequence
ggcaggcggatcaccaggtc

SEQ ID NO: 715923 - DNA, 20 bp, Artificial
  CRISPR gRNA sequence
ctgcactccagcctgggcga

SEQ ID NO: 715924 - DNA, 20 bp, Artificial
  CRISPR gRNA sequence
gccatcgttgatggcagggc

SEQ ID NO: 715925 - DNA, 20 bp, Artificial
  CRISPR gRNA sequence
ggcagggcagggatggaaag

SEQ ID NO: 715926 - DNA, 20 bp, Artificial
  CRISPR gRNA sequence
tagcattctgtgcccacctt

SEQ ID NO: 715927 - DNA, 20 bp, Artificial
  CRISPR gRNA sequence
cttatggatgtaacgacttc

SEQ ID NO: 715928 - DNA, 20 bp, Artificial
  CRISPR gRNA sequence
tcgtgaatttttctgcagac

SEQ ID NO: 715929 - DNA, 20 bp, Artificial
  CRISPR gRNA sequence
tgctaagtactcttctattc

SEQ ID NO: 715930 - DNA, 20 bp, Artificial
  CRISPR gRNA sequence
atcaaagcttcatgtgtggt

SEQ ID NO: 715931 - DNA, 20 bp, Artificial
  CRISPR gRNA sequence
ctcattcatatttattttaa

SEQ ID NO: 715932 - DNA, 20 bp, Artificial
  CRISPR gRNA sequence
tttaaaagggttatgcttgg

SEQ ID NO: 715933 - DNA, 20 bp, Artificial
  CRISPR gRNA sequence
gctgaggcaggcagatcacc

SEQ ID NO: 715934 - DNA, 20 bp, Artificial
  CRISPR gRNA sequence
caggcagatcacctggggtc

SEQ ID NO: 715935 - DNA, 20 bp, Artificial
  CRISPR gRNA sequence
actaaaaatacaaaaattag

SEQ ID NO: 715936 - DNA, 20 bp, Artificial
  CRISPR gRNA sequence
tacttgggaggctgaggcac

SEQ ID NO: 715937 - DNA, 20 bp, Artificial
  CRISPR gRNA sequence
agactttgtctcaaaaagaa

SEQ ID NO: 715938 - DNA, 20 bp, Artificial
  CRISPR gRNA sequence
aaaagaaaagggtggggggg

SEQ ID NO: 715939 - DNA, 20 bp, Artificial
  CRISPR gRNA sequence
aatgtggcatctatacacaa

SEQ ID NO: 715940 - DNA, 20 bp, Artificial
  CRISPR gRNA sequence
atcaagtctttcgcagcaac

SEQ ID NO: 715941 - DNA, 20 bp, Artificial
  CRISPR gRNA sequence
gcctgttctcacttctaagt

SEQ ID NO: 715942 - DNA, 20 bp, Artificial
  CRISPR gRNA sequence
actgtgtccacacggagctg

SEQ ID NO: 715943 - DNA, 20 bp, Artificial
  CRISPR gRNA sequence
gtccacacggagctggagag

SEQ ID NO: 715944 - DNA, 20 bp, Artificial
  CRISPR gRNA sequence
aaaaggcaacagagacttag

SEQ ID NO: 715945 - DNA, 20 bp, Artificial
  CRISPR gRNA sequence
acagagacttagaagggtga

SEQ ID NO: 715946 - DNA, 20 bp, Artificial
  CRISPR gRNA sequence
ggaccatgagaaattattta

SEQ ID NO: 715947 - DNA, 20 bp, Artificial
  CRISPR gRNA sequence
aggggtacaatgtatgctat

SEQ ID NO: 715948 - DNA, 20 bp, Artificial
  CRISPR gRNA sequence
caatgtatgctatttgggtg

SEQ ID NO: 715949 - DNA, 20 bp, Artificial
  CRISPR gRNA sequence
tgagggataccctaaacgtc

SEQ ID NO: 715950 - DNA, 20 bp, Artificial
  CRISPR gRNA sequence
ataaaatcctaaggactcta

SEQ ID NO: 715951 - DNA, 20 bp, Artificial
  CRISPR gRNA sequence
gttagtatgtcctgttcaca

SEQ ID NO: 715952 - DNA, 20 bp, Artificial
  CRISPR gRNA sequence
gttcacaatgggtctcttcc

SEQ ID NO: 715953 - DNA, 20 bp, Artificial
  CRISPR gRNA sequence
gaaccctgggcccatgggcg

SEQ ID NO: 715954 - DNA, 20 bp, Artificial
  CRISPR gRNA sequence
tgagctggcagcctccattt

SEQ ID NO: 715955 - DNA, 20 bp, Artificial
  CRISPR gRNA sequence
cagcctccatttcagggtga

SEQ ID NO: 715956 - DNA, 20 bp, Artificial
  CRISPR gRNA sequence
agtaaagagggctttacaaa

SEQ ID NO: 715957 - DNA, 20 bp, Artificial
  CRISPR gRNA sequence
actagtggcccgaactttcc

SEQ ID NO: 715958 - DNA, 20 bp, Artificial
  CRISPR gRNA sequence
cgggcagatcacttgaggtc

SEQ ID NO: 715959 - DNA, 20 bp, Artificial
  CRISPR gRNA sequence
actaaaaatatgaaaattag

SEQ ID NO: 715960 - DNA, 20 bp, Artificial
  CRISPR gRNA sequence
tactcgggaggctgaggcag

SEQ ID NO: 715961 - DNA, 20 bp, Artificial
  CRISPR gRNA sequence
ggaaaaaaaaagacaatact

SEQ ID NO: 715962 - DNA, 20 bp, Artificial
  CRISPR gRNA sequence
tccaagcccagagcctctct

SEQ ID NO: 715963 - DNA, 20 bp, Artificial
  CRISPR gRNA sequence
cacttctctggcagccctca

SEQ ID NO: 715964 - DNA, 20 bp, Artificial
  CRISPR gRNA sequence
gcagccctcacagagtcaca

SEQ ID NO: 715965 - DNA, 20 bp, Artificial
  CRISPR gRNA sequence
ggttttttttcttttttagg

SEQ ID NO: 715966 - DNA, 20 bp, Artificial
  CRISPR gRNA sequence
tttcgccctgttgcccaggc

SEQ ID NO: 715967 - DNA, 20 bp, Artificial
  CRISPR gRNA sequence
ctcactgcaacctatgcctc

SEQ ID NO: 715968 - DNA, 20 bp, Artificial
  CRISPR gRNA sequence
gattctcctgcctcaacctc

SEQ ID NO: 715969 - DNA, 20 bp, Artificial
  CRISPR gRNA sequence
ttgtgtatttttagtagaga

SEQ ID NO: 715970 - DNA, 20 bp, Artificial
  CRISPR gRNA sequence
gcctcagcctcccaaagtgc

SEQ ID NO: 715971 - DNA, 20 bp, Artificial
  CRISPR gRNA sequence
caacaacaacaaaaaactgt

SEQ ID NO: 715972 - DNA, 20 bp, Artificial
  CRISPR gRNA sequence
cagcactttgagaggccaag

SEQ ID NO: 715973 - DNA, 20 bp, Artificial
  CRISPR gRNA sequence
actttgagaggccaaggtgg

SEQ ID NO: 715974 - DNA, 20 bp, Artificial
  CRISPR gRNA sequence
tgggtggatcacctgaggtc

SEQ ID NO: 715975 - DNA, 20 bp, Artificial
  CRISPR gRNA sequence
aacattagccggctgtggtg

SEQ ID NO: 715976 - DNA, 20 bp, Artificial
  CRISPR gRNA sequence
tactcagaaggctgaggcag

SEQ ID NO: 715977 - DNA, 20 bp, Artificial
  CRISPR gRNA sequence
accagcccaataatttcagg

SEQ ID NO: 715978 - DNA, 20 bp, Artificial
  CRISPR gRNA sequence
aagaatttttttttaatcaa

SEQ ID NO: 715979 - DNA, 20 bp, Artificial
  CRISPR gRNA sequence
ctcttgccaaaatgctaaaa

SEQ ID NO: 715980 - DNA, 20 bp, Artificial
  CRISPR gRNA sequence
ggattttatcattccattca

SEQ ID NO: 715981 - DNA, 20 bp, Artificial
  CRISPR gRNA sequence
tcactgagtctgactactca

SEQ ID NO: 715982 - DNA, 20 bp, Artificial
  CRISPR gRNA sequence
acctgacctaatgaacagcc

SEQ ID NO: 715983 - DNA, 20 bp, Artificial
  CRISPR gRNA sequence
tccaccctgtggtcgaggcc

SEQ ID NO: 715984 - DNA, 20 bp, Artificial
  CRISPR gRNA sequence
gaccgtctctgctgcacaga

SEQ ID NO: 715985 - DNA, 20 bp, Artificial
  CRISPR gRNA sequence
gtaggggacacagcgggcac

SEQ ID NO: 715986 - DNA, 20 bp, Artificial
  CRISPR gRNA sequence
tcgacattcgcaggtgcggg

SEQ ID NO: 715987 - DNA, 20 bp, Artificial
  CRISPR gRNA sequence
gtcatctaagggacacagat

SEQ ID NO: 715988 - DNA, 20 bp, Artificial
  CRISPR gRNA sequence
agatcagtatggcaagggca

SEQ ID NO: 715989 - DNA, 20 bp, Artificial
  CRISPR gRNA sequence
agacagagaagcagttgtcc

SEQ ID NO: 715990 - DNA, 20 bp, Artificial
  CRISPR gRNA sequence
gcatgctcaaaataattctg

SEQ ID NO: 715991 - DNA, 20 bp, Artificial
  CRISPR gRNA sequence
aaagaaggcaggcaaaaagc

SEQ ID NO: 715992 - DNA, 20 bp, Artificial
  CRISPR gRNA sequence
ttgcatggtgaccataagca

SEQ ID NO: 715993 - DNA, 20 bp, Artificial
  CRISPR gRNA sequence
acccgaggtaacttttagag

SEQ ID NO: 715994 - DNA, 20 bp, Artificial
  CRISPR gRNA sequence
aaagaaagtcctccagggga

SEQ ID NO: 715995 - DNA, 20 bp, Artificial
  CRISPR gRNA sequence
aggggacggggtgagcgggc

SEQ ID NO: 715996 - DNA, 20 bp, Artificial
  CRISPR gRNA sequence
gactccataaccgtttaaag

SEQ ID NO: 715997 - DNA, 20 bp, Artificial
  CRISPR gRNA sequence
atctctgactcactctacat

SEQ ID NO: 715998 - DNA, 20 bp, Artificial
  CRISPR gRNA sequence
ggcaggcagatcacaaggtc

SEQ ID NO: 715999 - DNA, 20 bp, Artificial
  CRISPR gRNA sequence
tactcaggaggctgaggcag

SEQ ID NO: 716000 - DNA, 20 bp, Artificial
  CRISPR gRNA sequence
taatgcatttgtacgtattc

SEQ ID NO: 716001 - DNA, 20 bp, Artificial
  CRISPR gRNA sequence
ggcaaatgggacctctccgc

SEQ ID NO: 716002 - DNA, 20 bp, Artificial
  CRISPR gRNA sequence
cgagggtagatctcaatcag

SEQ ID NO: 716003 - DNA, 20 bp, Artificial
  CRISPR gRNA sequence
tccagagcaagggaactggg

SEQ ID NO: 716004 - DNA, 20 bp, Artificial
  CRISPR gRNA sequence
agggaactgggcaggatttg

SEQ ID NO: 716005 - DNA, 20 bp, Artificial
  CRISPR gRNA sequence
ggatttggggaatttgtgca

SEQ ID NO: 716006 - DNA, 20 bp, Artificial
  CRISPR gRNA sequence
gggtgtgtgtgagctcagca

SEQ ID NO: 716007 - DNA, 20 bp, Artificial
  CRISPR gRNA sequence
tattatagctcttaagataa

SEQ ID NO: 716008 - DNA, 20 bp, Artificial
  CRISPR gRNA sequence
aggctatcaagtgggagagg

SEQ ID NO: 716009 - DNA, 20 bp, Artificial
  CRISPR gRNA sequence
gcgggatctgaacccggcac

SEQ ID NO: 716010 - DNA, 20 bp, Artificial
  CRISPR gRNA sequence
tacaccactccactgcctcg

SEQ ID NO: 716011 - DNA, 20 bp, Artificial
  CRISPR gRNA sequence
gtttcagttaggagagctga

SEQ ID NO: 716012 - DNA, 20 bp, Artificial
  CRISPR gRNA sequence
caaggccaggtcataaaagg

SEQ ID NO: 716013 - DNA, 20 bp, Artificial
  CRISPR gRNA sequence
actttgggaggccaaggccg

SEQ ID NO: 716014 - DNA, 20 bp, Artificial
  CRISPR gRNA sequence
ccggcggatcacttgaggcc

SEQ ID NO: 716015 - DNA, 20 bp, Artificial
  CRISPR gRNA sequence
caacatcaaccccaaggcag

SEQ ID NO: 716016 - DNA, 20 bp, Artificial
  CRISPR gRNA sequence
atcaaccccaaggcaggtga

SEQ ID NO: 716017 - DNA, 20 bp, Artificial
  CRISPR gRNA sequence
ctgtccccgcagtgccctgt

SEQ ID NO: 716018 - DNA, 20 bp, Artificial
  CRISPR gRNA sequence
cctgtctgaattctgactca

SEQ ID NO: 716019 - DNA, 20 bp, Artificial
  CRISPR gRNA sequence
aattctgactcacagaatct

SEQ ID NO: 716020 - DNA, 20 bp, Artificial
  CRISPR gRNA sequence
tcacagaatctgtgagtaca

SEQ ID NO: 716021 - DNA, 20 bp, Artificial
  CRISPR gRNA sequence
acacattcccagtggcctcc

SEQ ID NO: 716022 - DNA, 20 bp, Artificial
  CRISPR gRNA sequence
ccccctgcccacatgcccct

SEQ ID NO: 716023 - DNA, 20 bp, Artificial
  CRISPR gRNA sequence
agccaaggtgggaggaccat

SEQ ID NO: 716024 - DNA, 20 bp, Artificial
  CRISPR gRNA sequence
tgggaggaccatttgagtcc

SEQ ID NO: 716025 - DNA, 20 bp, Artificial
  CRISPR gRNA sequence
cacttgaaaggctgaggcaa

SEQ ID NO: 716026 - DNA, 20 bp, Artificial
  CRISPR gRNA sequence
tcccaccaccgtactgcagc

SEQ ID NO: 716027 - DNA, 20 bp, Artificial
  CRISPR gRNA sequence
ccgtactgcagcttgggtga

SEQ ID NO: 716028 - DNA, 20 bp, Artificial
  CRISPR gRNA sequence
ctgtctgggaaaaaaaaaaa

SEQ ID NO: 716029 - DNA, 20 bp, Artificial
  CRISPR gRNA sequence
ataagtggctcataggggca

SEQ ID NO: 716030 - DNA, 20 bp, Artificial
  CRISPR gRNA sequence
tggctcataggggcagcgag

SEQ ID NO: 716031 - DNA, 20 bp, Artificial
  CRISPR gRNA sequence
tggaacctggtggcacctgt

SEQ ID NO: 716032 - DNA, 20 bp, Artificial
  CRISPR gRNA sequence
cgtttcctcctctgtaaaag

SEQ ID NO: 716033 - DNA, 20 bp, Artificial
  CRISPR gRNA sequence
aaggggaatgatcacaatgc

SEQ ID NO: 716034 - DNA, 20 bp, Artificial
  CRISPR gRNA sequence
tgatcacaatgcttgaatca

SEQ ID NO: 716035 - DNA, 20 bp, Artificial
  CRISPR gRNA sequence
tagttacaaacattgatgag

SEQ ID NO: 716036 - DNA, 20 bp, Artificial
  CRISPR gRNA sequence
atgagccgagtttggaacag

SEQ ID NO: 716037 - DNA, 20 bp, Artificial
  CRISPR gRNA sequence
aaaaacccacaaacataagg

SEQ ID NO: 716038 - DNA, 20 bp, Artificial
  CRISPR gRNA sequence
gctcagtccagcctttcaga

SEQ ID NO: 716039 - DNA, 20 bp, Artificial
  CRISPR gRNA sequence
tcctgaggctcagagaggac

SEQ ID NO: 716040 - DNA, 20 bp, Artificial
  CRISPR gRNA sequence
gcgtgcattccacacgagag

SEQ ID NO: 716041 - DNA, 20 bp, Artificial
  CRISPR gRNA sequence
acactagcgtaactcctgtt

SEQ ID NO: 716042 - DNA, 20 bp, Artificial
  CRISPR gRNA sequence
tggtattgggcagggagggg

SEQ ID NO: 716043 - DNA, 20 bp, Artificial
  CRISPR gRNA sequence
cagcactttgggaggctgag

SEQ ID NO: 716044 - DNA, 20 bp, Artificial
  CRISPR gRNA sequence
actttgggaggctgaggcgg

SEQ ID NO: 716045 - DNA, 20 bp, Artificial
  CRISPR gRNA sequence
cgggtggattacttgaggcc

SEQ ID NO: 716046 - DNA, 20 bp, Artificial
  CRISPR gRNA sequence
tactcgggaggctgaggcag

SEQ ID NO: 716047 - DNA, 20 bp, Artificial
  CRISPR gRNA sequence
caaacaaaagacatcataga

SEQ ID NO: 716048 - DNA, 20 bp, Artificial
  CRISPR gRNA sequence
acaacccaaatattcaaaaa

SEQ ID NO: 716049 - DNA, 20 bp, Artificial
  CRISPR gRNA sequence
actttgggaggccgaggtgg

SEQ ID NO: 716050 - DNA, 20 bp, Artificial
  CRISPR gRNA sequence
tgggcggatcacctgaggtc

SEQ ID NO: 716051 - DNA, 20 bp, Artificial
  CRISPR gRNA sequence
tactcaggaggctgaggcag

SEQ ID NO: 716052 - DNA, 20 bp, Artificial
  CRISPR gRNA sequence
aaagaaaaagaaaaatgact

SEQ ID NO: 716053 - DNA, 20 bp, Artificial
  CRISPR gRNA sequence
cacgtgcagaggctggccag

SEQ ID NO: 716054 - DNA, 20 bp, Artificial
  CRISPR gRNA sequence
agtcgcaagtgtcacaacag

SEQ ID NO: 716055 - DNA, 20 bp, Artificial
  CRISPR gRNA sequence
aatagagggagagatggggc

SEQ ID NO: 716056 - DNA, 20 bp, Artificial
  CRISPR gRNA sequence
gccctctgcactgctggcaa

SEQ ID NO: 716057 - DNA, 20 bp, Artificial
  CRISPR gRNA sequence
cagcttcatggggaaattac

SEQ ID NO: 716058 - DNA, 20 bp, Artificial
  CRISPR gRNA sequence
aggccttcccacagaggagg

SEQ ID NO: 716059 - DNA, 20 bp, Artificial
  CRISPR gRNA sequence
gaagcagcttcctgggcgag

SEQ ID NO: 716060 - DNA, 20 bp, Artificial
  CRISPR gRNA sequence
ctggaggttgctggggacac

SEQ ID NO: 716061 - DNA, 20 bp, Artificial
  CRISPR gRNA sequence
accggggtgggcttggcctg

SEQ ID NO: 716062 - DNA, 20 bp, Artificial
  CRISPR gRNA sequence
ggcaagggaggcctgtgctc

SEQ ID NO: 716063 - DNA, 20 bp, Artificial
  CRISPR gRNA sequence
agtaacagtttccacagaga

SEQ ID NO: 716064 - DNA, 20 bp, Artificial
  CRISPR gRNA sequence
gcctgtgttttctaagccct

SEQ ID NO: 716065 - DNA, 20 bp, Artificial
  CRISPR gRNA sequence
caaagtgctgacaccatggg

SEQ ID NO: 716066 - DNA, 20 bp, Artificial
  CRISPR gRNA sequence
gttgtaccatgggcgtcctg

SEQ ID NO: 716067 - DNA, 20 bp, Artificial
  CRISPR gRNA sequence
aagaggaggaggcaaagcca

SEQ ID NO: 716068 - DNA, 20 bp, Artificial
  CRISPR gRNA sequence
caaagccagggagtcacctg

SEQ ID NO: 716069 - DNA, 20 bp, Artificial
  CRISPR gRNA sequence
aggggggacagcagtgcctt

SEQ ID NO: 716070 - DNA, 20 bp, Artificial
  CRISPR gRNA sequence
gttggggacccaaagtctcc

SEQ ID NO: 716071 - DNA, 20 bp, Artificial
  CRISPR gRNA sequence
cacccttcactaccacaggc

SEQ ID NO: 716072 - DNA, 20 bp, Artificial
  CRISPR gRNA sequence
gcctggcacccgttcccctt

SEQ ID NO: 716073 - DNA, 20 bp, Artificial
  CRISPR gRNA sequence
aagcagcctatctttccctg

SEQ ID NO: 716074 - DNA, 20 bp, Artificial
  CRISPR gRNA sequence
tgatctcagcatctgtggtt

SEQ ID NO: 716075 - DNA, 20 bp, Artificial
  CRISPR gRNA sequence
gaccgactgaaccccctttc

SEQ ID NO: 716076 - DNA, 20 bp, Artificial
  CRISPR gRNA sequence
tgtgacccaagcctgtgagg

SEQ ID NO: 716077 - DNA, 20 bp, Artificial
  CRISPR gRNA sequence
agaatttaaagattctggtt

SEQ ID NO: 716078 - DNA, 20 bp, Artificial
  CRISPR gRNA sequence
gggatttaaaggttttggtt

SEQ ID NO: 716079 - DNA, 20 bp, Artificial
  CRISPR gRNA sequence
agatggggcaagatggagcc

SEQ ID NO: 716080 - DNA, 20 bp, Artificial
  CRISPR gRNA sequence
gctacatgtgctaaaaaatt

SEQ ID NO: 716081 - DNA, 20 bp, Artificial
  CRISPR gRNA sequence
attttgctacatgcaatcca

SEQ ID NO: 716082 - DNA, 20 bp, Artificial
  CRISPR gRNA sequence
atgcaatccaaggagtcctg

SEQ ID NO: 716083 - DNA, 20 bp, Artificial
  CRISPR gRNA sequence
tgaagaatgctggacagaag

SEQ ID NO: 716084 - DNA, 20 bp, Artificial
  CRISPR gRNA sequence
gtttatttatttatttgaga

SEQ ID NO: 716085 - DNA, 20 bp, Artificial
  CRISPR gRNA sequence
tcttactctgtcgcccaggc

SEQ ID NO: 716086 - DNA, 20 bp, Artificial
  CRISPR gRNA sequence
aattctcctgcctcagcctc

SEQ ID NO: 716087 - DNA, 20 bp, Artificial
  CRISPR gRNA sequence
gcctcagcctcctgagtagc

SEQ ID NO: 716088 - DNA, 20 bp, Artificial
  CRISPR gRNA sequence
cggctaatttttagtagaga

SEQ ID NO: 716089 - DNA, 20 bp, Artificial
  CRISPR gRNA sequence
tcctcagcctcccaaagtgc

SEQ ID NO: 716090 - DNA, 20 bp, Artificial
  CRISPR gRNA sequence
actcttcaccaggctgtcgt

SEQ ID NO: 716091 - DNA, 20 bp, Artificial
  CRISPR gRNA sequence
gctgtcgtcaggataaacag

SEQ ID NO: 716092 - DNA, 20 bp, Artificial
  CRISPR gRNA sequence
actttgggaggccgaggtgg

SEQ ID NO: 716093 - DNA, 20 bp, Artificial
  CRISPR gRNA sequence
ggtgggcggatcatgaggtc

SEQ ID NO: 716094 - DNA, 20 bp, Artificial
  CRISPR gRNA sequence
tactcaggaggctgaggcag

SEQ ID NO: 716095 - DNA, 20 bp, Artificial
  CRISPR gRNA sequence
ggctgaggcaggagaatcac

SEQ ID NO: 716096 - DNA, 20 bp, Artificial
  CRISPR gRNA sequence
tcacaccattgcactctagt

SEQ ID NO: 716097 - DNA, 20 bp, Artificial
  CRISPR gRNA sequence
tctcgtgttctgtggcatgg

SEQ ID NO: 716098 - DNA, 20 bp, Artificial
  CRISPR gRNA sequence
tgtctgtcttatggagacgt

SEQ ID NO: 716099 - DNA, 20 bp, Artificial
  CRISPR gRNA sequence
caaccccggagagctgcccc

SEQ ID NO: 716100 - DNA, 20 bp, Artificial
  CRISPR gRNA sequence
cccggagagctgccccatgg

SEQ ID NO: 716101 - DNA, 20 bp, Artificial
  CRISPR gRNA sequence
aggggaccccagagattaac

SEQ ID NO: 716102 - DNA, 20 bp, Artificial
  CRISPR gRNA sequence
gtgctgtccaacagagatat

SEQ ID NO: 716103 - DNA, 20 bp, Artificial
  CRISPR gRNA sequence
tgcattttttttatttttta

SEQ ID NO: 716104 - DNA, 20 bp, Artificial
  CRISPR gRNA sequence
atcggattttttttttgaaa

SEQ ID NO: 716105 - DNA, 20 bp, Artificial
  CRISPR gRNA sequence
tctaactctgtcgcccaggt

SEQ ID NO: 716106 - DNA, 20 bp, Artificial
  CRISPR gRNA sequence
ctcactacaacctccacctc

SEQ ID NO: 716107 - DNA, 20 bp, Artificial
  CRISPR gRNA sequence
gcctcagcctcccaaaatgc

SEQ ID NO: 716108 - DNA, 20 bp, Artificial
  CRISPR gRNA sequence
ggggcactgcattgggcagc

SEQ ID NO: 716109 - DNA, 20 bp, Artificial
  CRISPR gRNA sequence
ggggagaccgaggtccagag

SEQ ID NO: 716110 - DNA, 20 bp, Artificial
  CRISPR gRNA sequence
tccagcactctcccctgctt

SEQ ID NO: 716111 - DNA, 20 bp, Artificial
  CRISPR gRNA sequence
agagcgctctcccccgaccc

SEQ ID NO: 716112 - DNA, 20 bp, Artificial
  CRISPR gRNA sequence
tgtccccatatcttaattca

SEQ ID NO: 716113 - DNA, 20 bp, Artificial
  CRISPR gRNA sequence
gggaaggcctcttgaggaag

SEQ ID NO: 716114 - DNA, 20 bp, Artificial
  CRISPR gRNA sequence
gtggggtggagagctcaggg

SEQ ID NO: 716115 - DNA, 20 bp, Artificial
  CRISPR gRNA sequence
gtggagagctcagggctgag

SEQ ID NO: 716116 - DNA, 20 bp, Artificial
  CRISPR gRNA sequence
gctgagtaggatttgactaa

SEQ ID NO: 716117 - DNA, 20 bp, Artificial
  CRISPR gRNA sequence
gactaagtgaatggggaggg

SEQ ID NO: 716118 - DNA, 20 bp, Artificial
  CRISPR gRNA sequence
gagaacagcacgtgcagagg

SEQ ID NO: 716119 - DNA, 20 bp, Artificial
  CRISPR gRNA sequence
ggcagcgcaggtggagccca

SEQ ID NO: 716120 - DNA, 20 bp, Artificial
  CRISPR gRNA sequence
gagaaaggagggggctgtgt

SEQ ID NO: 716121 - DNA, 20 bp, Artificial
  CRISPR gRNA sequence
gggacctgaaggacaccgtg

SEQ ID NO: 716122 - DNA, 20 bp, Artificial
  CRISPR gRNA sequence
aggacaccgtggtgagtccc

SEQ ID NO: 716123 - DNA, 20 bp, Artificial
  CRISPR gRNA sequence
ttttttttttttttttgaga

SEQ ID NO: 716124 - DNA, 20 bp, Artificial
  CRISPR gRNA sequence
cttgctcttgtcacccaggc

SEQ ID NO: 716125 - DNA, 20 bp, Artificial
  CRISPR gRNA sequence
ggttctcctgcctcagcctc

SEQ ID NO: 716126 - DNA, 20 bp, Artificial
  CRISPR gRNA sequence
gcctcagcctcctgagtaaa

SEQ ID NO: 716127 - DNA, 20 bp, Artificial
  CRISPR gRNA sequence
gccttggcctcccaaagtgc

SEQ ID NO: 716128 - DNA, 20 bp, Artificial
  CRISPR gRNA sequence
tggccttgtgtccttatctt

SEQ ID NO: 716129 - DNA, 20 bp, Artificial
  CRISPR gRNA sequence
gtgtgtgtgtgagacagaga

SEQ ID NO: 716130 - DNA, 20 bp, Artificial
  CRISPR gRNA sequence
gtgtgtgagacagagagaga

SEQ ID NO: 716131 - DNA, 20 bp, Artificial
  CRISPR gRNA sequence
gtgagacagagagagagtga

SEQ ID NO: 716132 - DNA, 20 bp, Artificial
  CRISPR gRNA sequence
gagagagagagagagagaga

SEQ ID NO: 716133 - DNA, 20 bp, Artificial
  CRISPR gRNA sequence
agattcagatttggtcttgc

SEQ ID NO: 716134 - DNA, 20 bp, Artificial
  CRISPR gRNA sequence
gctgtataagagaaggtatt

SEQ ID NO: 716135 - DNA, 20 bp, Artificial
  CRISPR gRNA sequence
aggccaaatctacaggactc

SEQ ID NO: 716136 - DNA, 20 bp, Artificial
  CRISPR gRNA sequence
tcgaggatgggctggctgtg

SEQ ID NO: 716137 - DNA, 20 bp, Artificial
  CRISPR gRNA sequence
gaaggatgagggaacgaggg

SEQ ID NO: 716138 - DNA, 20 bp, Artificial
  CRISPR gRNA sequence
gggcaggcagtggtagcgat

SEQ ID NO: 716139 - DNA, 20 bp, Artificial
  CRISPR gRNA sequence
aggtctatgccaggggacag

SEQ ID NO: 716140 - DNA, 20 bp, Artificial
  CRISPR gRNA sequence
gggggagggcagcagaaggg

SEQ ID NO: 716141 - DNA, 20 bp, Artificial
  CRISPR gRNA sequence
ggcagcagaagggctgggtg

SEQ ID NO: 716142 - DNA, 20 bp, Artificial
  CRISPR gRNA sequence
gtcggaagtcaacagtgcac

SEQ ID NO: 716143 - DNA, 20 bp, Artificial
  CRISPR gRNA sequence
caacagcatagatctctgtc

SEQ ID NO: 716144 - DNA, 20 bp, Artificial
  CRISPR gRNA sequence
atagatctctgtcctgagtt

SEQ ID NO: 716145 - DNA, 20 bp, Artificial
  CRISPR gRNA sequence
aatcatccctgccggacaga

SEQ ID NO: 716146 - DNA, 20 bp, Artificial
  CRISPR gRNA sequence
atggaagaagcagcgggcac

SEQ ID NO: 716147 - DNA, 20 bp, Artificial
  CRISPR gRNA sequence
cagacgtggaacagaacatg

SEQ ID NO: 716148 - DNA, 20 bp, Artificial
  CRISPR gRNA sequence
tcgacattcgcagacacggg

SEQ ID NO: 716149 - DNA, 20 bp, Artificial
  CRISPR gRNA sequence
gtcgtctaagggacacagac

SEQ ID NO: 716150 - DNA, 20 bp, Artificial
  CRISPR gRNA sequence
ccccctggtgaccactaaaa

SEQ ID NO: 716151 - DNA, 20 bp, Artificial
  CRISPR gRNA sequence
tttagggcagtgaaaatatt

SEQ ID NO: 716152 - DNA, 20 bp, Artificial
  CRISPR gRNA sequence
catccgtttgtctaaagccc

SEQ ID NO: 716153 - DNA, 20 bp, Artificial
  CRISPR gRNA sequence
gccctagaatgggcaacaca

SEQ ID NO: 716154 - DNA, 20 bp, Artificial
  CRISPR gRNA sequence
ggtgttcgtgacaggggagg

SEQ ID NO: 716155 - DNA, 20 bp, Artificial
  CRISPR gRNA sequence
actttgggaggccgaggcag

SEQ ID NO: 716156 - DNA, 20 bp, Artificial
  CRISPR gRNA sequence
tacttgggaggctgaggcgg

SEQ ID NO: 716157 - DNA, 20 bp, Artificial
  CRISPR gRNA sequence
ctgcactccagcctgggcaa

SEQ ID NO: 716158 - DNA, 20 bp, Artificial
  CRISPR gRNA sequence
aaactgtgggagattgggaa

SEQ ID NO: 716159 - DNA, 20 bp, Artificial
  CRISPR gRNA sequence
gggagattgggaagggggtt

SEQ ID NO: 716160 - DNA, 20 bp, Artificial
  CRISPR gRNA sequence
taatttttttttttttaaga

SEQ ID NO: 716161 - DNA, 20 bp, Artificial
  CRISPR gRNA sequence
tctcactctgtcacccaggt

SEQ ID NO: 716162 - DNA, 20 bp, Artificial
  CRISPR gRNA sequence
caatctcggctcactgcaac

SEQ ID NO: 716163 - DNA, 20 bp, Artificial
  CRISPR gRNA sequence
gattctcctgcctcagcctc

SEQ ID NO: 716164 - DNA, 20 bp, Artificial
  CRISPR gRNA sequence
gcctcagcctcctgagtagc

SEQ ID NO: 716165 - DNA, 20 bp, Artificial
  CRISPR gRNA sequence
tttttgtatttttatagaga

SEQ ID NO: 716166 - DNA, 20 bp, Artificial
  CRISPR gRNA sequence
cggggtttcaccacgttggc

SEQ ID NO: 716167 - DNA, 20 bp, Artificial
  CRISPR gRNA sequence
ttttttaatggacaaaggac

SEQ ID NO: 716168 - DNA, 20 bp, Artificial
  CRISPR gRNA sequence
agataccacttcacaaccac

SEQ ID NO: 716169 - DNA, 20 bp, Artificial
  CRISPR gRNA sequence
ttcacaaccactagaatgac

SEQ ID NO: 716170 - DNA, 20 bp, Artificial
  CRISPR gRNA sequence
ataaaaagtacagctaggcg

SEQ ID NO: 716171 - DNA, 20 bp, Artificial
  CRISPR gRNA sequence
tgggcagatcacctgaggtc

SEQ ID NO: 716172 - DNA, 20 bp, Artificial
  CRISPR gRNA sequence
cccgagaagtggaggttgca

SEQ ID NO: 716173 - DNA, 20 bp, Artificial
  CRISPR gRNA sequence
aggcagaggacagataagat

SEQ ID NO: 716174 - DNA, 20 bp, Artificial
  CRISPR gRNA sequence
gagtgaaggagaccacagcc

SEQ ID NO: 716175 - DNA, 20 bp, Artificial
  CRISPR gRNA sequence
ctgaagaagggggaaaggct

SEQ ID NO: 716176 - DNA, 20 bp, Artificial
  CRISPR gRNA sequence
gagccccattgccctcagag

SEQ ID NO: 716177 - DNA, 20 bp, Artificial
  CRISPR gRNA sequence
agcgccaaggaagaggagct

SEQ ID NO: 716178 - DNA, 20 bp, Artificial
  CRISPR gRNA sequence
gagcaacatttcagtcaaca

SEQ ID NO: 716179 - DNA, 20 bp, Artificial
  CRISPR gRNA sequence
actttgggaggccgaggagg

SEQ ID NO: 716180 - DNA, 20 bp, Artificial
  CRISPR gRNA sequence
agggcggataacctgaggtc

SEQ ID NO: 716181 - DNA, 20 bp, Artificial
  CRISPR gRNA sequence
tacttgagaggctaagacag

SEQ ID NO: 716182 - DNA, 20 bp, Artificial
  CRISPR gRNA sequence
gctgcatagcacatgcaatt

SEQ ID NO: 716183 - DNA, 20 bp, Artificial
  CRISPR gRNA sequence
atcattttttttttttgaaa

SEQ ID NO: 716184 - DNA, 20 bp, Artificial
  CRISPR gRNA sequence
tcttgctctgttgcccaggc

SEQ ID NO: 716185 - DNA, 20 bp, Artificial
  CRISPR gRNA sequence
catcctcccacctcagcctc

SEQ ID NO: 716186 - DNA, 20 bp, Artificial
  CRISPR gRNA sequence
attttatcttgtgtagagat

SEQ ID NO: 716187 - DNA, 20 bp, Artificial
  CRISPR gRNA sequence
agccggccttatcattattt

SEQ ID NO: 716188 - DNA, 20 bp, Artificial
  CRISPR gRNA sequence
ctgaagaccttccaatggga

SEQ ID NO: 716189 - DNA, 20 bp, Artificial
  CRISPR gRNA sequence
ttttttttttttttttgaga

SEQ ID NO: 716190 - DNA, 20 bp, Artificial
  CRISPR gRNA sequence
tctcattctgtcacccaggc

SEQ ID NO: 716191 - DNA, 20 bp, Artificial
  CRISPR gRNA sequence
ctcactgcaacctccgcctc

SEQ ID NO: 716192 - DNA, 20 bp, Artificial
  CRISPR gRNA sequence
aattctcctgcctcagccac

SEQ ID NO: 716193 - DNA, 20 bp, Artificial
  CRISPR gRNA sequence
gcctcagccacctgagtagc

SEQ ID NO: 716194 - DNA, 20 bp, Artificial
  CRISPR gRNA sequence
ttttatatttttagtagaga

SEQ ID NO: 716195 - DNA, 20 bp, Artificial
  CRISPR gRNA sequence
acctcggcttcccaaagtgc

SEQ ID NO: 716196 - DNA, 20 bp, Artificial
  CRISPR gRNA sequence
aaagtgctgggattacaggt

SEQ ID NO: 716197 - DNA, 20 bp, Artificial
  CRISPR gRNA sequence
atcctgactctgtgtaggcc

SEQ ID NO: 716198 - DNA, 20 bp, Artificial
  CRISPR gRNA sequence
ttaaagtagaaaaaagtgta

SEQ ID NO: 716199 - DNA, 20 bp, Artificial
  CRISPR gRNA sequence
tctcactctatcacccaggc

SEQ ID NO: 716200 - DNA, 20 bp, Artificial
  CRISPR gRNA sequence
aattcttctgcttcagcctc

SEQ ID NO: 716201 - DNA, 20 bp, Artificial
  CRISPR gRNA sequence
ttttgtatttttagtagaga

SEQ ID NO: 716202 - DNA, 20 bp, Artificial
  CRISPR gRNA sequence
aaagtgctggcattacaggt

SEQ ID NO: 716203 - DNA, 20 bp, Artificial
  CRISPR gRNA sequence
caggacagtcacatgctgtg

SEQ ID NO: 716204 - DNA, 20 bp, Artificial
  CRISPR gRNA sequence
gagttgtagcttaggagcaa

SEQ ID NO: 716205 - DNA, 20 bp, Artificial
  CRISPR gRNA sequence
tgtgtgtaagtacactaatc

SEQ ID NO: 716206 - DNA, 20 bp, Artificial
  CRISPR gRNA sequence
ttgcctaatgacacgtttgt

SEQ ID NO: 716207 - DNA, 20 bp, Artificial
  CRISPR gRNA sequence
acacacaaaaaaattgtaag

SEQ ID NO: 716208 - DNA, 20 bp, Artificial
  CRISPR gRNA sequence
caggaggaacacttaagccc

SEQ ID NO: 716209 - DNA, 20 bp, Artificial
  CRISPR gRNA sequence
taaagataagaaattgggcc

SEQ ID NO: 716210 - DNA, 20 bp, Artificial
  CRISPR gRNA sequence
actttaggaggccaaggcgg

SEQ ID NO: 716211 - DNA, 20 bp, Artificial
  CRISPR gRNA sequence
cggctggatcacttgaggtc

SEQ ID NO: 716212 - DNA, 20 bp, Artificial
  CRISPR gRNA sequence
ctcagctactcaggaggcag

SEQ ID NO: 716213 - DNA, 20 bp, Artificial
  CRISPR gRNA sequence
tcaggaggcaggagaatcgc

SEQ ID NO: 716214 - DNA, 20 bp, Artificial
  CRISPR gRNA sequence
ctgcactccagcctgggcga

SEQ ID NO: 716215 - DNA, 20 bp, Artificial
  CRISPR gRNA sequence
tcctcaaacatgaaataaca

SEQ ID NO: 716216 - DNA, 20 bp, Artificial
  CRISPR gRNA sequence
gtaatccaatcactcaaatg

SEQ ID NO: 716217 - DNA, 20 bp, Artificial
  CRISPR gRNA sequence
ctgtgccaaataaactcatc

SEQ ID NO: 716218 - DNA, 20 bp, Artificial
  CRISPR gRNA sequence
agggacttatggttgcagat

SEQ ID NO: 716219 - DNA, 20 bp, Artificial
  CRISPR gRNA sequence
gacaaagtaaaatttgtgta

SEQ ID NO: 716220 - DNA, 20 bp, Artificial
  CRISPR gRNA sequence
taaggaataaaagtcaggaa

SEQ ID NO: 716221 - DNA, 20 bp, Artificial
  CRISPR gRNA sequence
ttactttgttcttcattaca

SEQ ID NO: 716222 - DNA, 20 bp, Artificial
  CRISPR gRNA sequence
aacctcctttcttaatttta

SEQ ID NO: 716223 - DNA, 20 bp, Artificial
  CRISPR gRNA sequence
tagagggtttttttttttaa

SEQ ID NO: 716224 - DNA, 20 bp, Artificial
  CRISPR gRNA sequence
ccttacactctttgtattgc

SEQ ID NO: 716225 - DNA, 20 bp, Artificial
  CRISPR gRNA sequence
ctttgctacttcttccagga

SEQ ID NO: 716226 - DNA, 20 bp, Artificial
  CRISPR gRNA sequence
ttaagggaaaaggcattaca

SEQ ID NO: 716227 - DNA, 20 bp, Artificial
  CRISPR gRNA sequence
gaatggagaggtatattcat

SEQ ID NO: 716228 - DNA, 20 bp, Artificial
  CRISPR gRNA sequence
taaaggtgataaaagtaaat

SEQ ID NO: 716229 - DNA, 20 bp, Artificial
  CRISPR gRNA sequence
agaactttatacgcaacaaa

SEQ ID NO: 716230 - DNA, 20 bp, Artificial
  CRISPR gRNA sequence
actccagttctgccacttac

SEQ ID NO: 716231 - DNA, 20 bp, Artificial
  CRISPR gRNA sequence
caaattcctcattgtaaagt

SEQ ID NO: 716232 - DNA, 20 bp, Artificial
  CRISPR gRNA sequence
tcctcccctagggctgtggt

SEQ ID NO: 716233 - DNA, 20 bp, Artificial
  CRISPR gRNA sequence
aggattaaactcaaaaaaat

SEQ ID NO: 716234 - DNA, 20 bp, Artificial
  CRISPR gRNA sequence
tgttaagtctctgtgaaagt

SEQ ID NO: 716235 - DNA, 20 bp, Artificial
  CRISPR gRNA sequence
gtcagtccaattcttgtgtt

SEQ ID NO: 716236 - DNA, 20 bp, Artificial
  CRISPR gRNA sequence
ttatagagaagagctgggcc

SEQ ID NO: 716237 - DNA, 20 bp, Artificial
  CRISPR gRNA sequence
atttgtgtgtgtgtgtgtgt

SEQ ID NO: 716238 - DNA, 20 bp, Artificial
  CRISPR gRNA sequence
tcctagtgttcttgaaagga

SEQ ID NO: 716239 - DNA, 20 bp, Artificial
  CRISPR gRNA sequence
cggttgtcatcattctctgc

SEQ ID NO: 716240 - DNA, 20 bp, Artificial
  CRISPR gRNA sequence
caggggtcttatctcactgc

SEQ ID NO: 716241 - DNA, 20 bp, Artificial
  CRISPR gRNA sequence
gcattcggcccaggacagct

SEQ ID NO: 716242 - DNA, 20 bp, Artificial
  CRISPR gRNA sequence
atcgctgcctaccttgcttc

SEQ ID NO: 716243 - DNA, 20 bp, Artificial
  CRISPR gRNA sequence
catgacccaagcaggccaat

SEQ ID NO: 716244 - DNA, 20 bp, Artificial
  CRISPR gRNA sequence
tcccatcaatataattggct

SEQ ID NO: 716245 - DNA, 20 bp, Artificial
  CRISPR gRNA sequence
tatattgatgggaagaagta

SEQ ID NO: 716246 - DNA, 20 bp, Artificial
  CRISPR gRNA sequence
gggaagaagtattctgattg

SEQ ID NO: 716247 - DNA, 20 bp, Artificial
  CRISPR gRNA sequence
catcctggaagcaaggtagg

SEQ ID NO: 716248 - DNA, 20 bp, Artificial
  CRISPR gRNA sequence
taggcagcgattgctgggtg

SEQ ID NO: 716249 - DNA, 20 bp, Artificial
  CRISPR gRNA sequence
cttgtttatctcgaaatcag

SEQ ID NO: 716250 - DNA, 20 bp, Artificial
  CRISPR gRNA sequence
gtggcaggagtgtccaatct

SEQ ID NO: 716251 - DNA, 20 bp, Artificial
  CRISPR gRNA sequence
atttagtctaacactaagga

SEQ ID NO: 716252 - DNA, 20 bp, Artificial
  CRISPR gRNA sequence
tctaacactaaggatagtgt

SEQ ID NO: 716253 - DNA, 20 bp, Artificial
  CRISPR gRNA sequence
tcacacacacgcaaatctca

SEQ ID NO: 716254 - DNA, 20 bp, Artificial
  CRISPR gRNA sequence
caaatctcataatgttttaa

SEQ ID NO: 716255 - DNA, 20 bp, Artificial
  CRISPR gRNA sequence
ataatgttttaagaaagttt

SEQ ID NO: 716256 - DNA, 20 bp, Artificial
  CRISPR gRNA sequence
tgcggctagtcgtgggttgg

SEQ ID NO: 716257 - DNA, 20 bp, Artificial
  CRISPR gRNA sequence
gatgacaaccggtgctcata

SEQ ID NO: 716258 - DNA, 20 bp, Artificial
  CRISPR gRNA sequence
ccagctcttctctataacta

SEQ ID NO: 716259 - DNA, 20 bp, Artificial
  CRISPR gRNA sequence
gggttgcccctcctgggtgt

SEQ ID NO: 716260 - DNA, 20 bp, Artificial
  CRISPR gRNA sequence
cataacacaagaattggact

SEQ ID NO: 716261 - DNA, 20 bp, Artificial
  CRISPR gRNA sequence
taaggcctttgctaagtcag

SEQ ID NO: 716262 - DNA, 20 bp, Artificial
  CRISPR gRNA sequence
tttgctaagtcagcctggct

SEQ ID NO: 716263 - DNA, 20 bp, Artificial
  CRISPR gRNA sequence
gtcagcctggcttggagctt

SEQ ID NO: 716264 - DNA, 20 bp, Artificial
  CRISPR gRNA sequence
aatctggaaggtggagagca

SEQ ID NO: 716265 - DNA, 20 bp, Artificial
  CRISPR gRNA sequence
ctgaattgtcctcctggtgc

SEQ ID NO: 716266 - DNA, 20 bp, Artificial
  CRISPR gRNA sequence
ctcagtttacctctctgcat

SEQ ID NO: 716267 - DNA, 20 bp, Artificial
  CRISPR gRNA sequence
catactttcacagagactta

SEQ ID NO: 716268 - DNA, 20 bp, Artificial
  CRISPR gRNA sequence
aggagaggactcacattttt

SEQ ID NO: 716269 - DNA, 20 bp, Artificial
  CRISPR gRNA sequence
atcctcaccacagccctagg

SEQ ID NO: 716270 - DNA, 20 bp, Artificial
  CRISPR gRNA sequence
cacagccctaggggaggatt

SEQ ID NO: 716271 - DNA, 20 bp, Artificial
  CRISPR gRNA sequence
actctggtaagtggcagaac

SEQ ID NO: 716272 - DNA, 20 bp, Artificial
  CRISPR gRNA sequence
gatcacaggacttccaggaa

SEQ ID NO: 716273 - DNA, 20 bp, Artificial
  CRISPR gRNA sequence
aatgcagtctgtgtgctatc

SEQ ID NO: 716274 - DNA, 20 bp, Artificial
  CRISPR gRNA sequence
ctatctagtgtttatttttg

SEQ ID NO: 716275 - DNA, 20 bp, Artificial
  CRISPR gRNA sequence
tttcagagtgttcagtgtat

SEQ ID NO: 716276 - DNA, 20 bp, Artificial
  CRISPR gRNA sequence
tgggtgttttaaaatgtgta

SEQ ID NO: 716277 - DNA, 20 bp, Artificial
  CRISPR gRNA sequence
ttctctacatatctattaag

SEQ ID NO: 716278 - DNA, 20 bp, Artificial
  CRISPR gRNA sequence
cccagtatacttgttcatct

SEQ ID NO: 716279 - DNA, 20 bp, Artificial
  CRISPR gRNA sequence
tttcattgtgttctttctat

SEQ ID NO: 716280 - DNA, 20 bp, Artificial
  CRISPR gRNA sequence
tacataaatgttcatgaatg

SEQ ID NO: 716281 - DNA, 20 bp, Artificial
  CRISPR gRNA sequence
tgttatgtttttttggtggg

SEQ ID NO: 716282 - DNA, 20 bp, Artificial
  CRISPR gRNA sequence
gccttttcccttaatttcac

SEQ ID NO: 716283 - DNA, 20 bp, Artificial
  CRISPR gRNA sequence
cagaagaatgccaaacctca

SEQ ID NO: 716284 - DNA, 20 bp, Artificial
  CRISPR gRNA sequence
tctcttgcagtaaaggcaaa

SEQ ID NO: 716285 - DNA, 20 bp, Artificial
  CRISPR gRNA sequence
tgcagtaaaggcaaaatctg

SEQ ID NO: 716286 - DNA, 20 bp, Artificial
  CRISPR gRNA sequence
aaaggcaaaatctgcttagt

SEQ ID NO: 716287 - DNA, 20 bp, Artificial
  CRISPR gRNA sequence
ttgagttttggacagtagag

SEQ ID NO: 716288 - DNA, 20 bp, Artificial
  CRISPR gRNA sequence
ttttactttgtcataatcta

SEQ ID NO: 716289 - DNA, 20 bp, Artificial
  CRISPR gRNA sequence
aacattttttattattcatg

SEQ ID NO: 716290 - DNA, 20 bp, Artificial
  CRISPR gRNA sequence
ttcatgatgagtttatttgg

SEQ ID NO: 716291 - DNA, 20 bp, Artificial
  CRISPR gRNA sequence
ttggcacagcttctctgttc

SEQ ID NO: 716292 - DNA, 20 bp, Artificial
  CRISPR gRNA sequence
ctctgttcctgagtttttca

SEQ ID NO: 716293 - DNA, 20 bp, Artificial
  CRISPR gRNA sequence
ttcactttgattcatcattt

SEQ ID NO: 716294 - DNA, 20 bp, Artificial
  CRISPR gRNA sequence
tttgattcatcatttgagtg

SEQ ID NO: 716295 - DNA, 20 bp, Artificial
  CRISPR gRNA sequence
gtgattggattacactgtca

SEQ ID NO: 716296 - DNA, 20 bp, Artificial
  CRISPR gRNA sequence
ttgcaatattctctgttatt

SEQ ID NO: 716297 - DNA, 20 bp, Artificial
  CRISPR gRNA sequence
ctctgttatttcatgtttga

SEQ ID NO: 716298 - DNA, 20 bp, Artificial
  CRISPR gRNA sequence
tgcttgtctgttgcctatat

SEQ ID NO: 716299 - DNA, 20 bp, Artificial
  CRISPR gRNA sequence
gctcactacaacctctacct

SEQ ID NO: 716300 - DNA, 20 bp, Artificial
  CRISPR gRNA sequence
aacctctacctcctggattc

SEQ ID NO: 716301 - DNA, 20 bp, Artificial
  CRISPR gRNA sequence
ttctcctgcctcctgagtag

SEQ ID NO: 716302 - DNA, 20 bp, Artificial
  CRISPR gRNA sequence
ttttgtatttttagaagaga

SEQ ID NO: 716303 - DNA, 20 bp, Artificial
  CRISPR gRNA sequence
cgccttggcctcctaaagtg

SEQ ID NO: 716304 - DNA, 20 bp, Artificial
  CRISPR gRNA sequence
tccaggctggccttaaactc

SEQ ID NO: 716305 - DNA, 20 bp, Artificial
  CRISPR gRNA sequence
ggatataaattatagtcatg

SEQ ID NO: 716306 - DNA, 20 bp, Artificial
  CRISPR gRNA sequence
ttttgtcgttgtgcaagcat

SEQ ID NO: 716307 - DNA, 20 bp, Artificial
  CRISPR gRNA sequence
cactttgggaggccgaggag

SEQ ID NO: 716308 - DNA, 20 bp, Artificial
  CRISPR gRNA sequence
tcaagaggctgaagcagaag

SEQ ID NO: 716309 - DNA, 20 bp, Artificial
  CRISPR gRNA sequence
tacagggcacttaccgtgaa

SEQ ID NO: 716310 - DNA, 20 bp, Artificial
  CRISPR gRNA sequence
ttggctcttttgtaataaca

SEQ ID NO: 716311 - DNA, 20 bp, Artificial
  CRISPR gRNA sequence
cttgaggtcaagagttcaag

SEQ ID NO: 716312 - DNA, 20 bp, Artificial
  CRISPR gRNA sequence
tcaggtggctgaggcaggag

SEQ ID NO: 716313 - DNA, 20 bp, Artificial
  CRISPR gRNA sequence
gaggcggaggttgcagtgag

SEQ ID NO: 716314 - DNA, 20 bp, Artificial
  CRISPR gRNA sequence
gaggctgtattacagttaac

SEQ ID NO: 716315 - DNA, 20 bp, Artificial
  CRISPR gRNA sequence
cactctaaaataatgataag

SEQ ID NO: 716316 - DNA, 20 bp, Artificial
  CRISPR gRNA sequence
tgggagaatcacttgaggcc

SEQ ID NO: 716317 - DNA, 20 bp, Artificial
  CRISPR gRNA sequence
tcaggaggctgaggtgggag

SEQ ID NO: 716318 - DNA, 20 bp, Artificial
  CRISPR gRNA sequence
gcctgggcaacagagcaaga

SEQ ID NO: 716319 - DNA, 20 bp, Artificial
  CRISPR gRNA sequence
gtaagtacgtaaaccagcaa

SEQ ID NO: 716320 - DNA, 20 bp, Artificial
  CRISPR gRNA sequence
tttatacaactggcagggca

SEQ ID NO: 716321 - DNA, 20 bp, Artificial
  CRISPR gRNA sequence
tacaactggcagggcagtag

SEQ ID NO: 716322 - DNA, 20 bp, Artificial
  CRISPR gRNA sequence
agctccattataatctcttt

SEQ ID NO: 716323 - DNA, 20 bp, Artificial
  CRISPR gRNA sequence
ataatctcttttattgtttt

SEQ ID NO: 716324 - DNA, 20 bp, Artificial
  CRISPR gRNA sequence
gctcactgcaacctgggttc

SEQ ID NO: 716325 - DNA, 20 bp, Artificial
  CRISPR gRNA sequence
tgtcttagcctctcaagtag

SEQ ID NO: 716326 - DNA, 20 bp, Artificial
  CRISPR gRNA sequence
ttgtattttttttaggagag

SEQ ID NO: 716327 - DNA, 20 bp, Artificial
  CRISPR gRNA sequence
gatttcaccatgttggccag

SEQ ID NO: 716328 - DNA, 20 bp, Artificial
  CRISPR gRNA sequence
ctcctcggcctcccaaagtg

SEQ ID NO: 716329 - DNA, 20 bp, Artificial
  CRISPR gRNA sequence
tacaggcgtgagccaccgcg

SEQ ID NO: 716330 - DNA, 20 bp, Artificial
  CRISPR gRNA sequence
gtgcgtgaaggtatcatttc

SEQ ID NO: 716331 - DNA, 20 bp, Artificial
  CRISPR gRNA sequence
gtatcatttctaatgttttg

SEQ ID NO: 716332 - DNA, 20 bp, Artificial
  CRISPR gRNA sequence
cagagctcctcttccttggc

SEQ ID NO: 716333 - DNA, 20 bp, Artificial
  CRISPR gRNA sequence
ccttggcgctggttttcctc

SEQ ID NO: 716334 - DNA, 20 bp, Artificial
  CRISPR gRNA sequence
tgatgccggtggtctgcgaa

SEQ ID NO: 716335 - DNA, 20 bp, Artificial
  CRISPR gRNA sequence
tccgtatttcggggagttgt

SEQ ID NO: 716336 - DNA, 20 bp, Artificial
  CRISPR gRNA sequence
ttgtcttcgtttctgatctg

SEQ ID NO: 716337 - DNA, 20 bp, Artificial
  CRISPR gRNA sequence
aggcctgttacacattaatt

SEQ ID NO: 716338 - DNA, 20 bp, Artificial
  CRISPR gRNA sequence
attagttttaccagtgctat

SEQ ID NO: 716339 - DNA, 20 bp, Artificial
  CRISPR gRNA sequence
ttttaccagtgctatttttg

SEQ ID NO: 716340 - DNA, 20 bp, Artificial
  CRISPR gRNA sequence
ccagtgctatttttgttttg

SEQ ID NO: 716341 - DNA, 20 bp, Artificial
  CRISPR gRNA sequence
gctatttttgttttgttttg

SEQ ID NO: 716342 - DNA, 20 bp, Artificial
  CRISPR gRNA sequence
aacctccacttctcgggttc

SEQ ID NO: 716343 - DNA, 20 bp, Artificial
  CRISPR gRNA sequence
tttcctgtctcagcctcccc

SEQ ID NO: 716344 - DNA, 20 bp, Artificial
  CRISPR gRNA sequence
tgtctcagcctccccagtag

SEQ ID NO: 716345 - DNA, 20 bp, Artificial
  CRISPR gRNA sequence
ttttgtatttttagtagaga

SEQ ID NO: 716346 - DNA, 20 bp, Artificial
  CRISPR gRNA sequence
cacctcggcctcccaaagtg

SEQ ID NO: 716347 - DNA, 20 bp, Artificial
  CRISPR gRNA sequence
ttttatgtctgttaaccaac

SEQ ID NO: 716348 - DNA, 20 bp, Artificial
  CRISPR gRNA sequence
ctgttaaccaacctgtgatt

SEQ ID NO: 716349 - DNA, 20 bp, Artificial
  CRISPR gRNA sequence
gcagttgttattatctgtct

SEQ ID NO: 716350 - DNA, 20 bp, Artificial
  CRISPR gRNA sequence
ggttgtgaagtggtatctca

SEQ ID NO: 716351 - DNA, 20 bp, Artificial
  CRISPR gRNA sequence
aacggtgtgggacatttttc

SEQ ID NO: 716352 - DNA, 20 bp, Artificial
  CRISPR gRNA sequence
cgggtggatcacctgaggtc

SEQ ID NO: 716353 - DNA, 20 bp, Artificial
  CRISPR gRNA sequence
tgaacccaggttgcagtgag

SEQ ID NO: 716354 - DNA, 20 bp, Artificial
  CRISPR gRNA sequence
attaataaactatttcttag

SEQ ID NO: 716355 - DNA, 20 bp, Artificial
  CRISPR gRNA sequence
aactatttcttagagcagtt

SEQ ID NO: 716356 - DNA, 20 bp, Artificial
  CRISPR gRNA sequence
caacccccttcccaatctcc

SEQ ID NO: 716357 - DNA, 20 bp, Artificial
  CRISPR gRNA sequence
ctcccacagtttcccctatt

SEQ ID NO: 716358 - DNA, 20 bp, Artificial
  CRISPR gRNA sequence
tgtattttttttttgtagag

SEQ ID NO: 716359 - DNA, 20 bp, Artificial
  CRISPR gRNA sequence
acgggatttcaccatgttgc

SEQ ID NO: 716360 - DNA, 20 bp, Artificial
  CRISPR gRNA sequence
gttgcccatgttttatagag

SEQ ID NO: 716361 - DNA, 20 bp, Artificial
  CRISPR gRNA sequence
tgcctcggcctcccaaagtg

SEQ ID NO: 716362 - DNA, 20 bp, Artificial
  CRISPR gRNA sequence
tattattactaactgaagtc

SEQ ID NO: 716363 - DNA, 20 bp, Artificial
  CRISPR gRNA sequence
actctttgtgttgcccattc

SEQ ID NO: 716364 - DNA, 20 bp, Artificial
  CRISPR gRNA sequence
actgatctttttactgtctc

SEQ ID NO: 716365 - DNA, 20 bp, Artificial
  CRISPR gRNA sequence
tttcatttagcaatatgtat

SEQ ID NO: 716366 - DNA, 20 bp, Artificial
  CRISPR gRNA sequence
ctgccgtcaactcctgtgcc

SEQ ID NO: 716367 - DNA, 20 bp, Artificial
  CRISPR gRNA sequence
ccattctgtctgtccggcag

SEQ ID NO: 716368 - DNA, 20 bp, Artificial
  CRISPR gRNA sequence
tgcactgttgacttccgacc

SEQ ID NO: 716369 - DNA, 20 bp, Artificial
  CRISPR gRNA sequence
atagacctggctggaggagg

SEQ ID NO: 716370 - DNA, 20 bp, Artificial
  CRISPR gRNA sequence
ctggctggaggaggtcttgc

SEQ ID NO: 716371 - DNA, 20 bp, Artificial
  CRISPR gRNA sequence
gaacctcaagtctctgtcct

SEQ ID NO: 716372 - DNA, 20 bp, Artificial
  CRISPR gRNA sequence
ctctgtcctgggagtttcct

SEQ ID NO: 716373 - DNA, 20 bp, Artificial
  CRISPR gRNA sequence
gagtttcctagaagattggg

SEQ ID NO: 716374 - DNA, 20 bp, Artificial
  CRISPR gRNA sequence
aggctcaagacttgagaaac

SEQ ID NO: 716375 - DNA, 20 bp, Artificial
  CRISPR gRNA sequence
aacttatcgtgtgacctcag

SEQ ID NO: 716376 - DNA, 20 bp, Artificial
  CRISPR gRNA sequence
ctgatagtacaaggtgtcag

SEQ ID NO: 716377 - DNA, 20 bp, Artificial
  CRISPR gRNA sequence
aagggaggcatgaggagtgg

SEQ ID NO: 716378 - DNA, 20 bp, Artificial
  CRISPR gRNA sequence
catgccctgttgtgcaaacc

SEQ ID NO: 716379 - DNA, 20 bp, Artificial
  CRISPR gRNA sequence
gccagcccatcctcgagtcc

SEQ ID NO: 716380 - DNA, 20 bp, Artificial
  CRISPR gRNA sequence
cacacacggatatatacctg

SEQ ID NO: 716381 - DNA, 20 bp, Artificial
  CRISPR gRNA sequence
aaggacacaaggccaggtgt

SEQ ID NO: 716382 - DNA, 20 bp, Artificial
  CRISPR gRNA sequence
gaggcggtggttgcagtgag

SEQ ID NO: 716383 - DNA, 20 bp, Artificial
  CRISPR gRNA sequence
gttgacctgccttcttctct

SEQ ID NO: 716384 - DNA, 20 bp, Artificial
  CRISPR gRNA sequence
tttattttgtacataatgtc

SEQ ID NO: 716385 - DNA, 20 bp, Artificial
  CRISPR gRNA sequence
aacacagccccctcctttct

SEQ ID NO: 716386 - DNA, 20 bp, Artificial
  CRISPR gRNA sequence
tcttccaggttggaggacgt

SEQ ID NO: 716387 - DNA, 20 bp, Artificial
  CRISPR gRNA sequence
atacatacctctctctgtct

SEQ ID NO: 716388 - DNA, 20 bp, Artificial
  CRISPR gRNA sequence
gtctgtctccctccctggct

SEQ ID NO: 716389 - DNA, 20 bp, Artificial
  CRISPR gRNA sequence
ggcatggcacctgctcccca

SEQ ID NO: 716390 - DNA, 20 bp, Artificial
  CRISPR gRNA sequence
gtggactgggcagcagatac

SEQ ID NO: 716391 - DNA, 20 bp, Artificial
  CRISPR gRNA sequence
agcagatacctaggattttg

SEQ ID NO: 716392 - DNA, 20 bp, Artificial
  CRISPR gRNA sequence
ccaaaaaggccaaacttccc

SEQ ID NO: 716393 - DNA, 20 bp, Artificial
  CRISPR gRNA sequence
ttgagttcagttgttccagc

SEQ ID NO: 716394 - DNA, 20 bp, Artificial
  CRISPR gRNA sequence
caggcggatcacttgaagtc

SEQ ID NO: 716395 - DNA, 20 bp, Artificial
  CRISPR gRNA sequence
agttggccaggtgtggtggc

SEQ ID NO: 716396 - DNA, 20 bp, Artificial
  CRISPR gRNA sequence
ttgggaggctgaggcatgag

SEQ ID NO: 716397 - DNA, 20 bp, Artificial
  CRISPR gRNA sequence
gaggtggaggttgtagtgag

SEQ ID NO: 716398 - DNA, 20 bp, Artificial
  CRISPR gRNA sequence
acctgggcgacagagttaga

SEQ ID NO: 716399 - DNA, 20 bp, Artificial
  CRISPR gRNA sequence
gtgctgtgtgtacaatatgc

SEQ ID NO: 716400 - DNA, 20 bp, Artificial
  CRISPR gRNA sequence
atataattaattatttttta

SEQ ID NO: 716401 - DNA, 20 bp, Artificial
  CRISPR gRNA sequence
taaataatgaaaattaattg

SEQ ID NO: 716402 - DNA, 20 bp, Artificial
  CRISPR gRNA sequence
cgcatatctctgttggacag

SEQ ID NO: 716403 - DNA, 20 bp, Artificial
  CRISPR gRNA sequence
atggggcagctctccggggt

SEQ ID NO: 716404 - DNA, 20 bp, Artificial
  CRISPR gRNA sequence
tttccagctgtaaaatagaa

SEQ ID NO: 716405 - DNA, 20 bp, Artificial
  CRISPR gRNA sequence
ggagacagagcaggaaatgt

SEQ ID NO: 716406 - DNA, 20 bp, Artificial
  CRISPR gRNA sequence
tgctcgcgctcacctccacg

SEQ ID NO: 716407 - DNA, 20 bp, Artificial
  CRISPR gRNA sequence
gctcactgcaacctctgcct

SEQ ID NO: 716408 - DNA, 20 bp, Artificial
  CRISPR gRNA sequence
aacctctgcctcccggattc

SEQ ID NO: 716409 - DNA, 20 bp, Artificial
  CRISPR gRNA sequence
tgcctcagcctcctgagtag

SEQ ID NO: 716410 - DNA, 20 bp, Artificial
  CRISPR gRNA sequence
ttttgtaattttagtagaga

SEQ ID NO: 716411 - DNA, 20 bp, Artificial
  CRISPR gRNA sequence
cacctcggcctcccaaagtg

SEQ ID NO: 716412 - DNA, 20 bp, Artificial
  CRISPR gRNA sequence
tgggcacctcacgtgcactc

SEQ ID NO: 716413 - DNA, 20 bp, Artificial
  CRISPR gRNA sequence
acgacagcctggtgaagagt

SEQ ID NO: 716414 - DNA, 20 bp, Artificial
  CRISPR gRNA sequence
catttgactgggctgggcac

SEQ ID NO: 716415 - DNA, 20 bp, Artificial
  CRISPR gRNA sequence
tcaggaggctgaggcaggag

SEQ ID NO: 716416 - DNA, 20 bp, Artificial
  CRISPR gRNA sequence
gaggcagaggttgcagtgag

SEQ ID NO: 716417 - DNA, 20 bp, Artificial
  CRISPR gRNA sequence
gggcactggctagacgatgt

SEQ ID NO: 716418 - DNA, 20 bp, Artificial
  CRISPR gRNA sequence
tgtgtgtgttttcttctcca

SEQ ID NO: 716419 - DNA, 20 bp, Artificial
  CRISPR gRNA sequence
tccagcattcttcaggactc

SEQ ID NO: 716420 - DNA, 20 bp, Artificial
  CRISPR gRNA sequence
atccccaattttttagcaca

SEQ ID NO: 716421 - DNA, 20 bp, Artificial
  CRISPR gRNA sequence
aaagtctggggatagctctg

SEQ ID NO: 716422 - DNA, 20 bp, Artificial
  CRISPR gRNA sequence
ctgcccagcgccagtgggaa

SEQ ID NO: 716423 - DNA, 20 bp, Artificial
  CRISPR gRNA sequence
gaatctttaaattctacctc

SEQ ID NO: 716424 - DNA, 20 bp, Artificial
  CRISPR gRNA sequence
catcgtggccagaggaatgc

SEQ ID NO: 716425 - DNA, 20 bp, Artificial
  CRISPR gRNA sequence
gtggccagaggaatgcaacg

SEQ ID NO: 716426 - DNA, 20 bp, Artificial
  CRISPR gRNA sequence
taattccccagggaaagata

SEQ ID NO: 716427 - DNA, 20 bp, Artificial
  CRISPR gRNA sequence
gtgccacctccagatgactg

SEQ ID NO: 716428 - DNA, 20 bp, Artificial
  CRISPR gRNA sequence
gggagactttgggtccccaa

SEQ ID NO: 716429 - DNA, 20 bp, Artificial
  CRISPR gRNA sequence
cagaagaacacggtctgtga

SEQ ID NO: 716430 - DNA, 20 bp, Artificial
  CRISPR gRNA sequence
aggaaccctccaggtgactc

SEQ ID NO: 716431 - DNA, 20 bp, Artificial
  CRISPR gRNA sequence
gcctcctcctcttcccccaa

SEQ ID NO: 716432 - DNA, 20 bp, Artificial
  CRISPR gRNA sequence
caactgggctgggggtgtaa

SEQ ID NO: 716433 - DNA, 20 bp, Artificial
  CRISPR gRNA sequence
ctgagcacatgggagaccca

SEQ ID NO: 716434 - DNA, 20 bp, Artificial
  CRISPR gRNA sequence
aaaacacaggccttgctccc

SEQ ID NO: 716435 - DNA, 20 bp, Artificial
  CRISPR gRNA sequence
gcagaattatcagtcccatc

SEQ ID NO: 716436 - DNA, 20 bp, Artificial
  CRISPR gRNA sequence
ggcacccgcctcgcccagga

SEQ ID NO: 716437 - DNA, 20 bp, Artificial
  CRISPR gRNA sequence
gtgggtcgtctccctggggt

SEQ ID NO: 716438 - DNA, 20 bp, Artificial
  CRISPR gRNA sequence
ggtggatggcccatgagtgg

SEQ ID NO: 716439 - DNA, 20 bp, Artificial
  CRISPR gRNA sequence
ctccctctatttccctctac

SEQ ID NO: 716440 - DNA, 20 bp, Artificial
  CRISPR gRNA sequence
tctttttcttttttttgaga

SEQ ID NO: 716441 - DNA, 20 bp, Artificial
  CRISPR gRNA sequence
cacctccacctcctgggttc

SEQ ID NO: 716442 - DNA, 20 bp, Artificial
  CRISPR gRNA sequence
tgcctcagcctcctgagtag

SEQ ID NO: 716443 - DNA, 20 bp, Artificial
  CRISPR gRNA sequence
actttgtatttttagtagag

SEQ ID NO: 716444 - DNA, 20 bp, Artificial
  CRISPR gRNA sequence
ctcggcctcccaaagtgctg

SEQ ID NO: 716445 - DNA, 20 bp, Artificial
  CRISPR gRNA sequence
catggcgtagatatgccgag

SEQ ID NO: 716446 - DNA, 20 bp, Artificial
  CRISPR gRNA sequence
gatatgccgagctctgttta

SEQ ID NO: 716447 - DNA, 20 bp, Artificial
  CRISPR gRNA sequence
atccagtttttgaatatttg

SEQ ID NO: 716448 - DNA, 20 bp, Artificial
  CRISPR gRNA sequence
aaaaatacatctttgcgtgt

SEQ ID NO: 716449 - DNA, 20 bp, Artificial
  CRISPR gRNA sequence
tgtgctttcctttctcttgg

SEQ ID NO: 716450 - DNA, 20 bp, Artificial
  CRISPR gRNA sequence
tgggttggttttgtaaaaaa

SEQ ID NO: 716451 - DNA, 20 bp, Artificial
  CRISPR gRNA sequence
agttgtaccttctcccgctc

SEQ ID NO: 716452 - DNA, 20 bp, Artificial
  CRISPR gRNA sequence
taccttctcccgctccatgg

SEQ ID NO: 716453 - DNA, 20 bp, Artificial
  CRISPR gRNA sequence
cttattctctctatgatgtc

SEQ ID NO: 716454 - DNA, 20 bp, Artificial
  CRISPR gRNA sequence
ttctctctatgatgtctttt

SEQ ID NO: 716455 - DNA, 20 bp, Artificial
  CRISPR gRNA sequence
ctctatgatgtcttttgttt

SEQ ID NO: 716456 - DNA, 20 bp, Artificial
  CRISPR gRNA sequence
atgtcttttgtttgtttgtt

SEQ ID NO: 716457 - DNA, 20 bp, Artificial
  CRISPR gRNA sequence
cttttgtttgtttgtttgtg

SEQ ID NO: 716458 - DNA, 20 bp, Artificial
  CRISPR gRNA sequence
tgcctcagcctcccgagtag

SEQ ID NO: 716459 - DNA, 20 bp, Artificial
  CRISPR gRNA sequence
tttcttttttttagtagaga

SEQ ID NO: 716460 - DNA, 20 bp, Artificial
  CRISPR gRNA sequence
cgcctcagcctcccaaagtg

SEQ ID NO: 716461 - DNA, 20 bp, Artificial
  CRISPR gRNA sequence
gctctcagggaagctgttcc

SEQ ID NO: 716462 - DNA, 20 bp, Artificial
  CRISPR gRNA sequence
ggctggactgagctgacatg

SEQ ID NO: 716463 - DNA, 20 bp, Artificial
  CRISPR gRNA sequence
gctggccacggtgagggatg

SEQ ID NO: 716464 - DNA, 20 bp, Artificial
  CRISPR gRNA sequence
tttgccaaggcggcctggcc

SEQ ID NO: 716465 - DNA, 20 bp, Artificial
  CRISPR gRNA sequence
ggcggcctggcctgcagctt

SEQ ID NO: 716466 - DNA, 20 bp, Artificial
  CRISPR gRNA sequence
cagccatgcccagaggggtc

SEQ ID NO: 716467 - DNA, 20 bp, Artificial
  CRISPR gRNA sequence
ggcctcgtccctccccgggc

SEQ ID NO: 716468 - DNA, 20 bp, Artificial
  CRISPR gRNA sequence
cttccagtaactactccccc

SEQ ID NO: 716469 - DNA, 20 bp, Artificial
  CRISPR gRNA sequence
aactactcccccttatgttt

SEQ ID NO: 716470 - DNA, 20 bp, Artificial
  CRISPR gRNA sequence
atgggggtcgcctcttttca

SEQ ID NO: 716471 - DNA, 20 bp, Artificial
  CRISPR gRNA sequence
gcatattatttccttccagg

SEQ ID NO: 716472 - DNA, 20 bp, Artificial
  CRISPR gRNA sequence
ctgttccaaactcggctcat

SEQ ID NO: 716473 - DNA, 20 bp, Artificial
  CRISPR gRNA sequence
catcaatgtttgtaactact

SEQ ID NO: 716474 - DNA, 20 bp, Artificial
  CRISPR gRNA sequence
ccttttacagaggaggaaac

SEQ ID NO: 716475 - DNA, 20 bp, Artificial
  CRISPR gRNA sequence
aacttccaagggctgtgggc

SEQ ID NO: 716476 - DNA, 20 bp, Artificial
  CRISPR gRNA sequence
gactcaaatggtcctcccac

SEQ ID NO: 716477 - DNA, 20 bp, Artificial
  CRISPR gRNA sequence
caccttggcttcctaaattg

SEQ ID NO: 716478 - DNA, 20 bp, Artificial
  CRISPR gRNA sequence
gccaccatgcccggcctgcg

SEQ ID NO: 716479 - DNA, 20 bp, Artificial
  CRISPR gRNA sequence
gacacagcacgatgcaggtg

SEQ ID NO: 716480 - DNA, 20 bp, Artificial
  CRISPR gRNA sequence
gtgtctgtctccttgtccag

SEQ ID NO: 716481 - DNA, 20 bp, Artificial
  CRISPR gRNA sequence
aggccaaaaagaaccacaga

SEQ ID NO: 716482 - DNA, 20 bp, Artificial
  CRISPR gRNA sequence
aacaaatcattctttgtact

SEQ ID NO: 716483 - DNA, 20 bp, Artificial
  CRISPR gRNA sequence
ttcagacagggcactgcggg

SEQ ID NO: 716484 - DNA, 20 bp, Artificial
  CRISPR gRNA sequence
agctgcagatcaggaacttc

SEQ ID NO: 716485 - DNA, 20 bp, Artificial
  CRISPR gRNA sequence
cggcctcttcgtgtcttacc

SEQ ID NO: 716486 - DNA, 20 bp, Artificial
  CRISPR gRNA sequence
ttttgtatttttagtagaga

SEQ ID NO: 716487 - DNA, 20 bp, Artificial
  CRISPR gRNA sequence
cacacagaacttctaccact

SEQ ID NO: 716488 - DNA, 20 bp, Artificial
  CRISPR gRNA sequence
gggccagaacatcactgcag

SEQ ID NO: 716489 - DNA, 20 bp, Artificial
  CRISPR gRNA sequence
ttgatagcctataacctcaa

SEQ ID NO: 716490 - DNA, 20 bp, Artificial
  CRISPR gRNA sequence
gtttcctaacctctctgtgc

SEQ ID NO: 716491 - DNA, 20 bp, Artificial
  CRISPR gRNA sequence
gaaccatgtgagaattgaat

SEQ ID NO: 716492 - DNA, 20 bp, Artificial
  CRISPR gRNA sequence
taatagctgccattgtccca

SEQ ID NO: 716493 - DNA, 20 bp, Artificial
  CRISPR gRNA sequence
tgctgggtctctaagtatcc

SEQ ID NO: 716494 - DNA, 20 bp, Artificial
  CRISPR gRNA sequence
attaaaaataatacctctaa

SEQ ID NO: 716495 - DNA, 20 bp, Artificial
  CRISPR gRNA sequence
atacctctaacatggttttt

SEQ ID NO: 716496 - DNA, 20 bp, Artificial
  CRISPR gRNA sequence
aacctctgcctcccaggttc

SEQ ID NO: 716497 - DNA, 20 bp, Artificial
  CRISPR gRNA sequence
tgcctcagcctcctgagtag

SEQ ID NO: 716498 - DNA, 20 bp, Artificial
  CRISPR gRNA sequence
ttttgtatttttagtagaga

SEQ ID NO: 716499 - DNA, 20 bp, Artificial
  CRISPR gRNA sequence
tgcctcggcctcccaaagtg

SEQ ID NO: 716500 - DNA, 20 bp, Artificial
  CRISPR gRNA sequence
gagatggctgcgtactatca

SEQ ID NO: 716501 - DNA, 20 bp, Artificial
  CRISPR gRNA sequence
cccctggaggactttctttt

SEQ ID NO: 716502 - DNA, 20 bp, Artificial
  CRISPR gRNA sequence
agtgggcatatggtaaagtg

SEQ ID NO: 716503 - DNA, 20 bp, Artificial
  CRISPR gRNA sequence
agattaaaggatgcaatctg

SEQ ID NO: 716504 - DNA, 20 bp, Artificial
  CRISPR gRNA sequence
cccctctaaaagttacctcg

SEQ ID NO: 716505 - DNA, 20 bp, Artificial
  CRISPR gRNA sequence
gcttgtcaccatttcccatc

SEQ ID NO: 716506 - DNA, 20 bp, Artificial
  CRISPR gRNA sequence
cctgcttatggtcaccatgc

SEQ ID NO: 716507 - DNA, 20 bp, Artificial
  CRISPR gRNA sequence
aaatgcgacatacagaatac

SEQ ID NO: 716508 - DNA, 20 bp, Artificial
  CRISPR gRNA sequence
ttgttggatgacccttggac

SEQ ID NO: 716509 - DNA, 20 bp, Artificial
  CRISPR gRNA sequence
accctcggctgttcattagg

SEQ ID NO: 716510 - DNA, 20 bp, Artificial
  CRISPR gRNA sequence
cagtgaatggaatgataaaa

SEQ ID NO: 716511 - DNA, 20 bp, Artificial
  CRISPR gRNA sequence
tccagttttagcattttggc

SEQ ID NO: 716512 - DNA, 20 bp, Artificial
  CRISPR gRNA sequence
agcattttggcaagagattc

SEQ ID NO: 716513 - DNA, 20 bp, Artificial
  CRISPR gRNA sequence
aaatctttatatttttgaga

SEQ ID NO: 716514 - DNA, 20 bp, Artificial
  CRISPR gRNA sequence
tgttgtatttttagaagaga

SEQ ID NO: 716515 - DNA, 20 bp, Artificial
  CRISPR gRNA sequence
caccttggcctctcaaagtg

SEQ ID NO: 716516 - DNA, 20 bp, Artificial
  CRISPR gRNA sequence
cccgggctggtaaaatcttg

SEQ ID NO: 716517 - DNA, 20 bp, Artificial
  CRISPR gRNA sequence
aaatcttgacctgtttgcaa

SEQ ID NO: 716518 - DNA, 20 bp, Artificial
  CRISPR gRNA sequence
ttgacttagagagatgaata

SEQ ID NO: 716519 - DNA, 20 bp, Artificial
  CRISPR gRNA sequence
agatgaatatcaagtttctg

SEQ ID NO: 716520 - DNA, 20 bp, Artificial
  CRISPR gRNA sequence
aagagatttctaacaggacg

SEQ ID NO: 716521 - DNA, 20 bp, Artificial
  CRISPR gRNA sequence
gtgcaggaaactaaaaccct

SEQ ID NO: 716522 - DNA, 20 bp, Artificial
  CRISPR gRNA sequence
ccctgacagttttttgttgt

SEQ ID NO: 716523 - DNA, 20 bp, Artificial
  CRISPR gRNA sequence
agttttttgttgttgttgtt

SEQ ID NO: 716524 - DNA, 20 bp, Artificial
  CRISPR gRNA sequence
gttgttgttttttgtttttt

SEQ ID NO: 716525 - DNA, 20 bp, Artificial
  CRISPR gRNA sequence
ttttgttttttaagggcttt

SEQ ID NO: 716526 - DNA, 20 bp, Artificial
  CRISPR gRNA sequence
gagattttaacaaatctcca

SEQ ID NO: 716527 - DNA, 20 bp, Artificial
  CRISPR gRNA sequence
tcaggaggttgaggcaggag

SEQ ID NO: 716528 - DNA, 20 bp, Artificial
  CRISPR gRNA sequence
gaggcataggttgcagtgag

SEQ ID NO: 716529 - DNA, 20 bp, Artificial
  CRISPR gRNA sequence
tgccagagaagtgaggggtg

SEQ ID NO: 716530 - DNA, 20 bp, Artificial
  CRISPR gRNA sequence
ctaggacccccagagaggct

SEQ ID NO: 716531 - DNA, 20 bp, Artificial
  CRISPR gRNA sequence
atggcatggcatggccactg

SEQ ID NO: 716532 - DNA, 20 bp, Artificial
  CRISPR gRNA sequence
ccagtttgcacagatgatgc

SEQ ID NO: 716533 - DNA, 20 bp, Artificial
  CRISPR gRNA sequence
tgcctcagcctcccgagtag

SEQ ID NO: 716534 - DNA, 20 bp, Artificial
  CRISPR gRNA sequence
tttcatatttttagtagaga

SEQ ID NO: 716535 - DNA, 20 bp, Artificial
  CRISPR gRNA sequence
cgcctccacctcccaaagtg

SEQ ID NO: 716536 - DNA, 20 bp, Artificial
  CRISPR gRNA sequence
ccactagtggggtgctgtca

SEQ ID NO: 716537 - DNA, 20 bp, Artificial
  CRISPR gRNA sequence
tggaatattcagtagagtcc

SEQ ID NO: 716538 - DNA, 20 bp, Artificial
  CRISPR gRNA sequence
gtagagtccttaggatttta

SEQ ID NO: 716539 - DNA, 20 bp, Artificial
  CRISPR gRNA sequence
ggtacaagtgtaattttatt

SEQ ID NO: 716540 - DNA, 20 bp, Artificial
  CRISPR gRNA sequence
aagtgtaattttattacatg

SEQ ID NO: 716541 - DNA, 20 bp, Artificial
  CRISPR gRNA sequence
tagattgggtggtgaactca

SEQ ID NO: 716542 - DNA, 20 bp, Artificial
  CRISPR gRNA sequence
catccatgttgctgcgaaag

SEQ ID NO: 716543 - DNA, 20 bp, Artificial
  CRISPR gRNA sequence
ctcacggcaacctctgcctc

SEQ ID NO: 716544 - DNA, 20 bp, Artificial
  CRISPR gRNA sequence
tgcctcagcctcccaagtag

SEQ ID NO: 716545 - DNA, 20 bp, Artificial
  CRISPR gRNA sequence
ttttgtatttttagtagaga

SEQ ID NO: 716546 - DNA, 20 bp, Artificial
  CRISPR gRNA sequence
tgcctcagcctcccaaagtg

SEQ ID NO: 716547 - DNA, 20 bp, Artificial
  CRISPR gRNA sequence
ttaaaataaatatgaatgag

SEQ ID NO: 716548 - DNA, 20 bp, Artificial
  CRISPR gRNA sequence
ccagaaattcttaccacaca

SEQ ID NO: 716549 - DNA, 20 bp, Artificial
  CRISPR gRNA sequence
tatgggatcagagggcaaga

SEQ ID NO: 716550 - DNA, 20 bp, Artificial
  CRISPR gRNA sequence
aagaaaaggctttttagaaa

SEQ ID NO: 716551 - DNA, 20 bp, Artificial
  CRISPR gRNA sequence
gagggccatcgcaggaggaa

SEQ ID NO: 716552 - DNA, 20 bp, Artificial
  CRISPR gRNA sequence
ggaaggaggcttctggttgc

SEQ ID NO: 716553 - DNA, 20 bp, Artificial
  CRISPR gRNA sequence
gcttctggttgcatttgttt

SEQ ID NO: 716554 - DNA, 20 bp, Artificial
  CRISPR gRNA sequence
ctggttgcatttgttttttt

SEQ ID NO: 716555 - DNA, 20 bp, Artificial
  CRISPR gRNA sequence
ttgcatttgtttttttgttt

SEQ ID NO: 716556 - DNA, 20 bp, Artificial
  CRISPR gRNA sequence
atttgtttttttgtttgttt

SEQ ID NO: 716557 - DNA, 20 bp, Artificial
  CRISPR gRNA sequence
acctccacctcccgggttca

SEQ ID NO: 716558 - DNA, 20 bp, Artificial
  CRISPR gRNA sequence
tgcctcagcctcctgagtag

SEQ ID NO: 716559 - DNA, 20 bp, Artificial
  CRISPR gRNA sequence
ttttgtatttttagtagaga

SEQ ID NO: 716560 - DNA, 20 bp, Artificial
  CRISPR gRNA sequence
gcctcggcctcgcaaaagtg

SEQ ID NO: 716561 - DNA, 20 bp, Artificial
  CRISPR gRNA sequence
gtgagccactgcgcccggcc

SEQ ID NO: 716562 - DNA, 20 bp, Artificial
  CRISPR gRNA sequence
tctgcaaaagtgtcctgact

SEQ ID NO: 716563 - DNA, 20 bp, Artificial
  CRISPR gRNA sequence
aaggacctaccaagagcaaa

SEQ ID NO: 716564 - DNA, 20 bp, Artificial
  CRISPR gRNA sequence
tacatgtaatagatgcacca

SEQ ID NO: 716565 - DNA, 20 bp, Artificial
  CRISPR gRNA sequence
ctgccggttgatggcatttg

SEQ ID NO: 716566 - DNA, 20 bp, Artificial
  CRISPR gRNA sequence
ttgatggcatttgggttgtt

SEQ ID NO: 716567 - DNA, 20 bp, Artificial
  CRISPR gRNA sequence
cacctcagcctcccacagtg

SEQ ID NO: 716568 - DNA, 20 bp, Artificial
  CRISPR gRNA sequence
tggcatgagccaccatgact

SEQ ID NO: 716569 - DNA, 20 bp, Artificial
  CRISPR gRNA sequence
ttgtgctggtcacatagtca

SEQ ID NO: 716570 - DNA, 20 bp, Artificial
  CRISPR gRNA sequence
cctctggtctgatacaaccc

SEQ ID NO: 716571 - DNA, 20 bp, Artificial
  CRISPR gRNA sequence
tcacttcagctaaattacaa

SEQ ID NO: 716572 - DNA, 20 bp, Artificial
  CRISPR gRNA sequence
tttcagacataaaaggtcca

SEQ ID NO: 716573 - DNA, 20 bp, Artificial
  CRISPR gRNA sequence
agagagaattgtagtaaatt

SEQ ID NO: 716574 - DNA, 20 bp, Artificial
  CRISPR gRNA sequence
aaatatgaagatgaaatttc

SEQ ID NO: 716575 - DNA, 20 bp, Artificial
  CRISPR gRNA sequence
atgaaatttcacctgatttt

SEQ ID NO: 716576 - DNA, 20 bp, Artificial
  CRISPR gRNA sequence
gctggatgtacaaaaagaga

SEQ ID NO: 716577 - DNA, 20 bp, Artificial
  CRISPR gRNA sequence
ctttaaatggcccaaggact

SEQ ID NO: 716578 - DNA, 20 bp, Artificial
  CRISPR gRNA sequence
aatggcccaaggactgggtg

SEQ ID NO: 716579 - DNA, 20 bp, Artificial
  CRISPR gRNA sequence
ggagggacagcagatctgtc

SEQ ID NO: 716580 - DNA, 20 bp, Artificial
  CRISPR gRNA sequence
atctgtcgctggatttcagc

SEQ ID NO: 716581 - DNA, 20 bp, Artificial
  CRISPR gRNA sequence
actgggaatagccacagtta

SEQ ID NO: 716582 - DNA, 20 bp, Artificial
  CRISPR gRNA sequence
aaacccaatgacctttcaaa

SEQ ID NO: 716583 - DNA, 20 bp, Artificial
  CRISPR gRNA sequence
ctttcaaacactgattcaaa

SEQ ID NO: 716584 - DNA, 20 bp, Artificial
  CRISPR gRNA sequence
aatgcaagaaataaattaat

SEQ ID NO: 716585 - DNA, 20 bp, Artificial
  CRISPR gRNA sequence
agatgtgggtatgtgtgtgg

SEQ ID NO: 716586 - DNA, 20 bp, Artificial
  CRISPR gRNA sequence
tatcctgccccagaaaagca

SEQ ID NO: 716587 - DNA, 20 bp, Artificial
  CRISPR gRNA sequence
tctgggctggaactcgccat

SEQ ID NO: 716588 - DNA, 20 bp, Artificial
  CRISPR gRNA sequence
gaccccaaagagtacatact

SEQ ID NO: 716589 - DNA, 20 bp, Artificial
  CRISPR gRNA sequence
agggatgagaatgttctgta

SEQ ID NO: 716590 - DNA, 20 bp, Artificial
  CRISPR gRNA sequence
atagagacagggtcttgcta

SEQ ID NO: 716591 - DNA, 20 bp, Artificial
  CRISPR gRNA sequence
ggtcttgctatgttgcttag

SEQ ID NO: 716592 - DNA, 20 bp, Artificial
  CRISPR gRNA sequence
ctcctgagctcaagtgatct

SEQ ID NO: 716593 - DNA, 20 bp, Artificial
  CRISPR gRNA sequence
tgcttcagcctcccaaagtg

SEQ ID NO: 716594 - DNA, 20 bp, Artificial
  CRISPR gRNA sequence
gcctggtcaacatggtgaaa

SEQ ID NO: 716595 - DNA, 20 bp, Artificial
  CRISPR gRNA sequence
aataaataattccttaataa

SEQ ID NO: 716596 - DNA, 20 bp, Artificial
  CRISPR gRNA sequence
tgaggctgtatttaaacatt

SEQ ID NO: 716597 - DNA, 20 bp, Artificial
  CRISPR gRNA sequence
gtatttaaacattaggcgat

SEQ ID NO: 716598 - DNA, 20 bp, Artificial
  CRISPR gRNA sequence
aaaagcaaaaggtctagcgt

SEQ ID NO: 716599 - DNA, 20 bp, Artificial
  CRISPR gRNA sequence
gacaagtagcaacttctcca

SEQ ID NO: 716600 - DNA, 20 bp, Artificial
  CRISPR gRNA sequence
agcctccacctcccgggttc

SEQ ID NO: 716601 - DNA, 20 bp, Artificial
  CRISPR gRNA sequence
tgcctcagcctcctgagtag

SEQ ID NO: 716602 - DNA, 20 bp, Artificial
  CRISPR gRNA sequence
ccatcacacctggctaattt

SEQ ID NO: 716603 - DNA, 20 bp, Artificial
  CRISPR gRNA sequence
ttttgtgtttttagtagaga

SEQ ID NO: 716604 - DNA, 20 bp, Artificial
  CRISPR gRNA sequence
tgcctcagcctcccaaaatg

SEQ ID NO: 716605 - DNA, 20 bp, Artificial
  CRISPR gRNA sequence
ggtgtgagccaatgtgcctg

SEQ ID NO: 716606 - DNA, 20 bp, Artificial
  CRISPR gRNA sequence
gtgactcccccaccccttct

SEQ ID NO: 716607 - DNA, 20 bp, Artificial
  CRISPR gRNA sequence
ccatcttcatcactcctgcc

SEQ ID NO: 716608 - DNA, 20 bp, Artificial
  CRISPR gRNA sequence
cccgcagcaccagccccact

SEQ ID NO: 716609 - DNA, 20 bp, Artificial
  CRISPR gRNA sequence
cactcacccctactcccagc

SEQ ID NO: 716610 - DNA, 20 bp, Artificial
  CRISPR gRNA sequence
ggggcttcctcctggggaag

SEQ ID NO: 716611 - DNA, 20 bp, Artificial
  CRISPR gRNA sequence
gtggattgggggagccagga

SEQ ID NO: 716612 - DNA, 20 bp, Artificial
  CRISPR gRNA sequence
ttgtgggtatggtctgagaa

SEQ ID NO: 716613 - DNA, 20 bp, Artificial
  CRISPR gRNA sequence
aagggggattaaggttgacc

SEQ ID NO: 716614 - DNA, 20 bp, Artificial
  CRISPR gRNA sequence
attaaggttgaccccaggtt

SEQ ID NO: 716615 - DNA, 20 bp, Artificial
  CRISPR gRNA sequence
aacctccacctcccaggttc

SEQ ID NO: 716616 - DNA, 20 bp, Artificial
  CRISPR gRNA sequence
tgtctcagcctcccgagtag

SEQ ID NO: 716617 - DNA, 20 bp, Artificial
  CRISPR gRNA sequence
tcccgagtagctgggtttac

SEQ ID NO: 716618 - DNA, 20 bp, Artificial
  CRISPR gRNA sequence
tttttaatttttagtagaga

SEQ ID NO: 716619 - DNA, 20 bp, Artificial
  CRISPR gRNA sequence
ctcctgacctcaggtgatcc

SEQ ID NO: 716620 - DNA, 20 bp, Artificial
  CRISPR gRNA sequence
tgcttcagcctcccaaagtg

SEQ ID NO: 716621 - DNA, 20 bp, Artificial
  CRISPR gRNA sequence
ttgtaggcaggaattttttt

SEQ ID NO: 716622 - DNA, 20 bp, Artificial
  CRISPR gRNA sequence
ttttttcacagcttcatcct

SEQ ID NO: 716623 - DNA, 20 bp, Artificial
  CRISPR gRNA sequence
ctactcagaaaataggtctt

SEQ ID NO: 716624 - DNA, 20 bp, Artificial
  CRISPR gRNA sequence
tcagaaaataggtctttgtt

SEQ ID NO: 716625 - DNA, 20 bp, Artificial
  CRISPR gRNA sequence
ggtgggtggatcacgaggtc

SEQ ID NO: 716626 - DNA, 20 bp, Artificial
  CRISPR gRNA sequence
tcaggaggctgaggcaggag

SEQ ID NO: 716627 - DNA, 20 bp, Artificial
  CRISPR gRNA sequence
ggttgcaaggttgcagtgag

SEQ ID NO: 716628 - DNA, 20 bp, Artificial
  CRISPR gRNA sequence
ggtggcagtagtgctccggc

SEQ ID NO: 716629 - DNA, 20 bp, Artificial
  CRISPR gRNA sequence
cagggcactcatgtgcacat

SEQ ID NO: 716630 - DNA, 20 bp, Artificial
  CRISPR gRNA sequence
tgacaaaagggaaaaacgaa

SEQ ID NO: 716631 - DNA, 20 bp, Artificial
  CRISPR gRNA sequence
ttggggatcattcattcagg

SEQ ID NO: 716632 - DNA, 20 bp, Artificial
  CRISPR gRNA sequence
attcagggaacgcttgtggg

SEQ ID NO: 716633 - DNA, 20 bp, Artificial
  CRISPR gRNA sequence
ttcaacctcttccttcccct

SEQ ID NO: 716634 - DNA, 20 bp, Artificial
  CRISPR gRNA sequence
tcaatttctcactctctaga

SEQ ID NO: 716635 - DNA, 20 bp, Artificial
  CRISPR gRNA sequence
ctctcagccttcaatagttg

SEQ ID NO: 716636 - DNA, 20 bp, Artificial
  CRISPR gRNA sequence
gggctggatgagataagagc

SEQ ID NO: 716637 - DNA, 20 bp, Artificial
  CRISPR gRNA sequence
acccccagccttcctcctgg

SEQ ID NO: 716638 - DNA, 20 bp, Artificial
  CRISPR gRNA sequence
ccagacctcccagcccaagc

SEQ ID NO: 716639 - DNA, 20 bp, Artificial
  CRISPR gRNA sequence
tgtactgggtgtgacgactg

SEQ ID NO: 716640 - DNA, 20 bp, Artificial
  CRISPR gRNA sequence
acctggatggatgctggcat

SEQ ID NO: 716641 - DNA, 20 bp, Artificial
  CRISPR gRNA sequence
gttactgaattgtcctgtgt

SEQ ID NO: 716642 - DNA, 20 bp, Artificial
  CRISPR gRNA sequence
cagatggtagaatctacttc

SEQ ID NO: 716643 - DNA, 20 bp, Artificial
  CRISPR gRNA sequence
tctacttcagaggcttggcc

SEQ ID NO: 716644 - DNA, 20 bp, Artificial
  CRISPR gRNA sequence
ttgacaggctggcctgtgcc

SEQ ID NO: 716645 - DNA, 20 bp, Artificial
  CRISPR gRNA sequence
cctggggctttttccttcct

SEQ ID NO: 716646 - DNA, 20 bp, Artificial
  CRISPR gRNA sequence
ttcaggccttcctgagtcct

SEQ ID NO: 716647 - DNA, 20 bp, Artificial
  CRISPR gRNA sequence
tcttcctcagcactgcatgg

SEQ ID NO: 716648 - DNA, 20 bp, Artificial
  CRISPR gRNA sequence
gatgggggaatcgtctgagc

SEQ ID NO: 716649 - DNA, 20 bp, Artificial
  CRISPR gRNA sequence
ggaatcgtctgagccttcgt

SEQ ID NO: 716650 - DNA, 20 bp, Artificial
  CRISPR gRNA sequence
tttgcaaggtgggctcccat

SEQ ID NO: 716651 - DNA, 20 bp, Artificial
  CRISPR gRNA sequence
cagcctcaggcactggtcct

SEQ ID NO: 716652 - DNA, 20 bp, Artificial
  CRISPR gRNA sequence
caggcactggtcctaggggt

SEQ ID NO: 716653 - DNA, 20 bp, Artificial
  CRISPR gRNA sequence
caaaaacacagtccactgag

SEQ ID NO: 716654 - DNA, 20 bp, Artificial
  CRISPR gRNA sequence
tgaggcatgttttgaatttg

SEQ ID NO: 716655 - DNA, 20 bp, Artificial
  CRISPR gRNA sequence
cactgtggtccctgtgcaag

SEQ ID NO: 716656 - DNA, 20 bp, Artificial
  CRISPR gRNA sequence
tccctgtgcaaggggggttt

SEQ ID NO: 716657 - DNA, 20 bp, Artificial
  CRISPR gRNA sequence
aaggggggtttttgtgtttt

SEQ ID NO: 716658 - DNA, 20 bp, Artificial
  CRISPR gRNA sequence
ttgtgttttgatagtttcaa

SEQ ID NO: 716659 - DNA, 20 bp, Artificial
  CRISPR gRNA sequence
gctgagtgtctcattgaaac

SEQ ID NO: 716660 - DNA, 20 bp, Artificial
  CRISPR gRNA sequence
agtgtctcattgaaaccggc

SEQ ID NO: 716661 - DNA, 20 bp, Artificial
  CRISPR gRNA sequence
gtattagaatttccattgcc

SEQ ID NO: 716662 - DNA, 20 bp, Artificial
  CRISPR gRNA sequence
tttcttcaaacctctgtgag

SEQ ID NO: 716663 - DNA, 20 bp, Artificial
  CRISPR gRNA sequence
atggtggacatcttatctca

SEQ ID NO: 716664 - DNA, 20 bp, Artificial
  CRISPR gRNA sequence
tctcaggtcgtttttgaccc

SEQ ID NO: 716665 - DNA, 20 bp, Artificial
  CRISPR gRNA sequence
tggtgaaggagggaaggagc

SEQ ID NO: 716666 - DNA, 20 bp, Artificial
  CRISPR gRNA sequence
aggagcactggtttattggc

SEQ ID NO: 716667 - DNA, 20 bp, Artificial
  CRISPR gRNA sequence
agaagctgttctagctccct

SEQ ID NO: 716668 - DNA, 20 bp, Artificial
  CRISPR gRNA sequence
acttactgttatccccgttg

SEQ ID NO: 716669 - DNA, 20 bp, Artificial
  CRISPR gRNA sequence
aggcacaggatggtgaagta

SEQ ID NO: 716670 - DNA, 20 bp, Artificial
  CRISPR gRNA sequence
gtgctgggtgagccgtagga

SEQ ID NO: 716671 - DNA, 20 bp, Artificial
  CRISPR gRNA sequence
ggattttatcgtggttgttg

SEQ ID NO: 716672 - DNA, 20 bp, Artificial
  CRISPR gRNA sequence
tggttgttgagatgtttgta

SEQ ID NO: 716673 - DNA, 20 bp, Artificial
  CRISPR gRNA sequence
aacctccgcctcacgggttc

SEQ ID NO: 716674 - DNA, 20 bp, Artificial
  CRISPR gRNA sequence
tgcctcagcctcctgagtag

SEQ ID NO: 716675 - DNA, 20 bp, Artificial
  CRISPR gRNA sequence
tttggtatttttagtagaga

SEQ ID NO: 716676 - DNA, 20 bp, Artificial
  CRISPR gRNA sequence
tgcctcggcctcccaaagtg

SEQ ID NO: 716677 - DNA, 20 bp, Artificial
  CRISPR gRNA sequence
agtcattttctattattcca

SEQ ID NO: 716678 - DNA, 20 bp, Artificial
  CRISPR gRNA sequence
taggttgaaagaaattcttt

SEQ ID NO: 716679 - DNA, 20 bp, Artificial
  CRISPR gRNA sequence
aaattctttttttgttttga

SEQ ID NO: 716680 - DNA, 20 bp, Artificial
  CRISPR gRNA sequence
ctcaccccgaaaacttcagt

SEQ ID NO: 716681 - DNA, 20 bp, Artificial
  CRISPR gRNA sequence
aatgaattctcaggccctgt

SEQ ID NO: 716682 - DNA, 20 bp, Artificial
  CRISPR gRNA sequence
agctcagggccacgtgttac

SEQ ID NO: 716683 - DNA, 20 bp, Artificial
  CRISPR gRNA sequence
ccacgtgttacatttgcttg

SEQ ID NO: 716684 - DNA, 20 bp, Artificial
  CRISPR gRNA sequence
tctgtccggatccgttcccc

SEQ ID NO: 716685 - DNA, 20 bp, Artificial
  CRISPR gRNA sequence
ttactgggaagagcgcaggc

SEQ ID NO: 716686 - DNA, 20 bp, Artificial
  CRISPR gRNA sequence
ctggtgatttcatggatgct

SEQ ID NO: 716687 - DNA, 20 bp, Artificial
  CRISPR gRNA sequence
tttcatggatgctccttgct

SEQ ID NO: 716688 - DNA, 20 bp, Artificial
  CRISPR gRNA sequence
ctccttgctttgggtttgtc

SEQ ID NO: 716689 - DNA, 20 bp, Artificial
  CRISPR gRNA sequence
ttgtctggtgttttctcccg

SEQ ID NO: 716690 - DNA, 20 bp, Artificial
  CRISPR gRNA sequence
ttctctctcagggcgtcctg

SEQ ID NO: 716691 - DNA, 20 bp, Artificial
  CRISPR gRNA sequence
gaccttcattttctctattt

SEQ ID NO: 716692 - DNA, 20 bp, Artificial
  CRISPR gRNA sequence
ctggagtgcagtagtgtgat

SEQ ID NO: 716693 - DNA, 20 bp, Artificial
  CRISPR gRNA sequence
ctcctgggttcaagcaattc

SEQ ID NO: 716694 - DNA, 20 bp, Artificial
  CRISPR gRNA sequence
tgcttcagcctcccaagtgg

SEQ ID NO: 716695 - DNA, 20 bp, Artificial
  CRISPR gRNA sequence
ttttgtattttcagtagaga

SEQ ID NO: 716696 - DNA, 20 bp, Artificial
  CRISPR gRNA sequence
cacttacatatttatatctg

SEQ ID NO: 716697 - DNA, 20 bp, Artificial
  CRISPR gRNA sequence
gcccctttaagctggctctt

SEQ ID NO: 716698 - DNA, 20 bp, Artificial
  CRISPR gRNA sequence
tgctttggtgtatcctcatc

SEQ ID NO: 716699 - DNA, 20 bp, Artificial
  CRISPR gRNA sequence
gtcccttattctgagatgtt

SEQ ID NO: 716700 - DNA, 20 bp, Artificial
  CRISPR gRNA sequence
agctgcctctccaaggagcc

SEQ ID NO: 716701 - DNA, 20 bp, Artificial
  CRISPR gRNA sequence
aaattccccccttgggcctg

SEQ ID NO: 716702 - DNA, 20 bp, Artificial
  CRISPR gRNA sequence
taacagggatggaagggacc

SEQ ID NO: 716703 - DNA, 20 bp, Artificial
  CRISPR gRNA sequence
aacgcacgtgctccgtgagc

SEQ ID NO: 716704 - DNA, 20 bp, Artificial
  CRISPR gRNA sequence
tgtgtccctgggggtaccag

SEQ ID NO: 716705 - DNA, 20 bp, Artificial
  CRISPR gRNA sequence
aaatctgacctctgtacttg

SEQ ID NO: 716706 - DNA, 20 bp, Artificial
  CRISPR gRNA sequence
tcttgtcaatgtcagagcct

SEQ ID NO: 716707 - DNA, 20 bp, Artificial
  CRISPR gRNA sequence
cagattccgcctttttacct

SEQ ID NO: 716708 - DNA, 20 bp, Artificial
  CRISPR gRNA sequence
ttttacctctgtgattttac

SEQ ID NO: 716709 - DNA, 20 bp, Artificial
  CRISPR gRNA sequence
gagccatgttacttaccatc

SEQ ID NO: 716710 - DNA, 20 bp, Artificial
  CRISPR gRNA sequence
cctggacaccttctttttaa

SEQ ID NO: 716711 - DNA, 20 bp, Artificial
  CRISPR gRNA sequence
gaggtggaggttgcagtgag

SEQ ID NO: 716712 - DNA, 20 bp, Artificial
  CRISPR gRNA sequence
attctaagtggccttcattt

SEQ ID NO: 716713 - DNA, 20 bp, Artificial
  CRISPR gRNA sequence
gtggccttcatttttaagtt

SEQ ID NO: 716714 - DNA, 20 bp, Artificial
  CRISPR gRNA sequence
tcatttttaagttttttgtt

SEQ ID NO: 716715 - DNA, 20 bp, Artificial
  CRISPR gRNA sequence
taagttttttgttttttgtt

SEQ ID NO: 716716 - DNA, 20 bp, Artificial
  CRISPR gRNA sequence
ctgcccacctcggcctccca

SEQ ID NO: 716717 - DNA, 20 bp, Artificial
  CRISPR gRNA sequence
cacctcggcctcccaaagtg

SEQ ID NO: 716718 - DNA, 20 bp, Artificial
  CRISPR gRNA sequence
caatctcagctcactgcaac

SEQ ID NO: 716719 - DNA, 20 bp, Artificial
  CRISPR gRNA sequence
tgcctcagcctcccgagtag

SEQ ID NO: 716720 - DNA, 20 bp, Artificial
  CRISPR gRNA sequence
ttttgtatttttagtagaga

SEQ ID NO: 716721 - DNA, 20 bp, Artificial
  CRISPR gRNA sequence
ctggtctggaactcctggca

SEQ ID NO: 716722 - DNA, 20 bp, Artificial
  CRISPR gRNA sequence
cacctcagcctcccaaaata

SEQ ID NO: 716723 - DNA, 20 bp, Artificial
  CRISPR gRNA sequence
cgcccagtctcatttttaaa

SEQ ID NO: 716724 - DNA, 20 bp, Artificial
  CRISPR gRNA sequence
gagttcccacatgccccaca

SEQ ID NO: 716725 - DNA, 20 bp, Artificial
  CRISPR gRNA sequence
tgccccacacccagtttcct

SEQ ID NO: 716726 - DNA, 20 bp, Artificial
  CRISPR gRNA sequence
atatgtgaaccattattgac

SEQ ID NO: 716727 - DNA, 20 bp, Artificial
  CRISPR gRNA sequence
cttaggctactctggcctgt

SEQ ID NO: 716728 - DNA, 20 bp, Artificial
  CRISPR gRNA sequence
gcctgtggccgtttctcaga

SEQ ID NO: 716729 - DNA, 20 bp, Artificial
  CRISPR gRNA sequence
ctcagatcttgtttctcaag

SEQ ID NO: 716730 - DNA, 20 bp, Artificial
  CRISPR gRNA sequence
ccagtttccctgatggcctt

SEQ ID NO: 716731 - DNA, 20 bp, Artificial
  CRISPR gRNA sequence
gcagtttttgagtattgatc

SEQ ID NO: 716732 - DNA, 20 bp, Artificial
  CRISPR gRNA sequence
ggatctgtctgatgtcttcc

SEQ ID NO: 716733 - DNA, 20 bp, Artificial
  CRISPR gRNA sequence
ctggcagatcacctgaggtc

SEQ ID NO: 716734 - DNA, 20 bp, Artificial
  CRISPR gRNA sequence
ttgggaggctgaggcaggag

SEQ ID NO: 716735 - DNA, 20 bp, Artificial
  CRISPR gRNA sequence
aaaaaaaaaaaaaaaaatca

SEQ ID NO: 716736 - DNA, 20 bp, Artificial
  CRISPR gRNA sequence
ctcaacaagccccaaagttg

SEQ ID NO: 716737 - DNA, 20 bp, Artificial
  CRISPR gRNA sequence
agaagggaagtaatattgtg

SEQ ID NO: 716738 - DNA, 20 bp, Artificial
  CRISPR gRNA sequence
ccagggtggctaagcggcct

SEQ ID NO: 716739 - DNA, 20 bp, Artificial
  CRISPR gRNA sequence
ctcattgtttttgacatttg

SEQ ID NO: 716740 - DNA, 20 bp, Artificial
  CRISPR gRNA sequence
cccgctgctgtgctcggcct

SEQ ID NO: 716741 - DNA, 20 bp, Artificial
  CRISPR gRNA sequence
ggatgactgggtaaagagtg

SEQ ID NO: 716742 - DNA, 20 bp, Artificial
  CRISPR gRNA sequence
agttgtgtcatttttattta

SEQ ID NO: 716743 - DNA, 20 bp, Artificial
  CRISPR gRNA sequence
cttggtaccaaagaacagtt

SEQ ID NO: 716744 - DNA, 20 bp, Artificial
  CRISPR gRNA sequence
tcaaaatcactctggaggga

SEQ ID NO: 716745 - DNA, 20 bp, Artificial
  CRISPR gRNA sequence
tcactctggagggaccatga

SEQ ID NO: 716746 - DNA, 20 bp, Artificial
  CRISPR gRNA sequence
tcgggaggctgaggcaggag

SEQ ID NO: 716747 - DNA, 20 bp, Artificial
  CRISPR gRNA sequence
acctggccaacatggtgaaa

SEQ ID NO: 716748 - DNA, 20 bp, Artificial
  CRISPR gRNA sequence
taatcccagctacttgtgag

SEQ ID NO: 716749 - DNA, 20 bp, Artificial
  CRISPR gRNA sequence
aaagaaaaaattacccctaa

SEQ ID NO: 716750 - DNA, 20 bp, Artificial
  CRISPR gRNA sequence
tgacatacgggcatcttggt

SEQ ID NO: 716751 - DNA, 20 bp, Artificial
  CRISPR gRNA sequence
gttaaatgttaaatgtcaat

SEQ ID NO: 716752 - DNA, 20 bp, Artificial
  CRISPR gRNA sequence
gtgcttgggcgtgacctggc

SEQ ID NO: 716753 - DNA, 20 bp, Artificial
  CRISPR gRNA sequence
gaacaatgggagtggagggt

SEQ ID NO: 716754 - DNA, 20 bp, Artificial
  CRISPR gRNA sequence
cctcctgagcctacaaaagg

SEQ ID NO: 716755 - DNA, 20 bp, Artificial
  CRISPR gRNA sequence
ctcctcgaaggctgccacct

SEQ ID NO: 716756 - DNA, 20 bp, Artificial
  CRISPR gRNA sequence
tcagaagggctccacagcag

SEQ ID NO: 716757 - DNA, 20 bp, Artificial
  CRISPR gRNA sequence
cctgccttgaggtcctccat

SEQ ID NO: 716758 - DNA, 20 bp, Artificial
  CRISPR gRNA sequence
ctcctgggctctggttgggc

SEQ ID NO: 716759 - DNA, 20 bp, Artificial
  CRISPR gRNA sequence
gagagtggttcagtgtgttc

SEQ ID NO: 716760 - DNA, 20 bp, Artificial
  CRISPR gRNA sequence
ggcgggcaggtcaggaggtc

SEQ ID NO: 716761 - DNA, 20 bp, Artificial
  CRISPR gRNA sequence
ctccttggtgaagttgctgc

SEQ ID NO: 716762 - DNA, 20 bp, Artificial
  CRISPR gRNA sequence
aagttgctgctcttgctttt

SEQ ID NO: 716763 - DNA, 20 bp, Artificial
  CRISPR gRNA sequence
tacccctcccttgcccccac

SEQ ID NO: 716764 - DNA, 20 bp, Artificial
  CRISPR gRNA sequence
gactccttccctaacagatc

SEQ ID NO: 716765 - DNA, 20 bp, Artificial
  CRISPR gRNA sequence
ttccagaagggcctgcacac

SEQ ID NO: 716766 - DNA, 20 bp, Artificial
  CRISPR gRNA sequence
aagggcctgcacacagtgga

SEQ ID NO: 716767 - DNA, 20 bp, Artificial
  CRISPR gRNA sequence
tcaagcattcatacattaag

SEQ ID NO: 716768 - DNA, 20 bp, Artificial
  CRISPR gRNA sequence
atacacaaccataatgctag

SEQ ID NO: 716769 - DNA, 20 bp, Artificial
  CRISPR gRNA sequence
ttatgggggatcacattcga

SEQ ID NO: 716770 - DNA, 20 bp, Artificial
  CRISPR gRNA sequence
acaatttgtaaggtaatcaa

SEQ ID NO: 716771 - DNA, 20 bp, Artificial
  CRISPR gRNA sequence
aggccaatgcattaatagta

SEQ ID NO: 716772 - DNA, 20 bp, Artificial
  CRISPR gRNA sequence
tcaggaggctgaggcaggag

SEQ ID NO: 716773 - DNA, 20 bp, Artificial
  CRISPR gRNA sequence
gggacagaggttgcagggag

SEQ ID NO: 716774 - DNA, 20 bp, Artificial
  CRISPR gRNA sequence
ccattaaaagtaatggcaaa

SEQ ID NO: 716775 - DNA, 20 bp, Artificial
  CRISPR gRNA sequence
agtatttattgatcattctt

SEQ ID NO: 716776 - DNA, 20 bp, Artificial
  CRISPR gRNA sequence
tcttgggtgtttctcagaga

SEQ ID NO: 716777 - DNA, 20 bp, Artificial
  CRISPR gRNA sequence
taaacatgtgaacaaaggtc

SEQ ID NO: 716778 - DNA, 20 bp, Artificial
  CRISPR gRNA sequence
gagggccctgccgccttccg

SEQ ID NO: 716779 - DNA, 20 bp, Artificial
  CRISPR gRNA sequence
gtgtttgtgtccctgggtac

SEQ ID NO: 716780 - DNA, 20 bp, Artificial
  CRISPR gRNA sequence
gcgccttttaaaagttatta

SEQ ID NO: 716781 - DNA, 20 bp, Artificial
  CRISPR gRNA sequence
ttttaaaagttattatgtgg

SEQ ID NO: 716782 - DNA, 20 bp, Artificial
  CRISPR gRNA sequence
gtggttttgttttaaaaagc

SEQ ID NO: 716783 - DNA, 20 bp, Artificial
  CRISPR gRNA sequence
taataataataatggcaaag

SEQ ID NO: 716784 - DNA, 20 bp, Artificial
  CRISPR gRNA sequence
tgacactttcctcatgacat

SEQ ID NO: 716785 - DNA, 20 bp, Artificial
  CRISPR gRNA sequence
tcctcatgacatagctgttt

SEQ ID NO: 716786 - DNA, 20 bp, Artificial
  CRISPR gRNA sequence
atagctgtttttttgttttt

SEQ ID NO: 716787 - DNA, 20 bp, Artificial
  CRISPR gRNA sequence
tttgtttttttttgtttttt

SEQ ID NO: 716788 - DNA, 20 bp, Artificial
  CRISPR gRNA sequence
ttattaataatatacatgaa

SEQ ID NO: 716789 - DNA, 20 bp, Artificial
  CRISPR gRNA sequence
attatatagtatagaggtca

SEQ ID NO: 716790 - DNA, 20 bp, Artificial
  CRISPR gRNA sequence
tgtcacttgaactaacagta

SEQ ID NO: 716791 - DNA, 20 bp, Artificial
  CRISPR gRNA sequence
ctaacagtagtctgttttta

SEQ ID NO: 716792 - DNA, 20 bp, Artificial
  CRISPR gRNA sequence
gagctggtacttacagactt

SEQ ID NO: 716793 - DNA, 20 bp, Artificial
  CRISPR gRNA sequence
attactcgactcctctgtgc

SEQ ID NO: 716794 - DNA, 20 bp, Artificial
  CRISPR gRNA sequence
cccacctcatacagtggttg

SEQ ID NO: 716795 - DNA, 20 bp, Artificial
  CRISPR gRNA sequence
agaagcccggggcagctcat

SEQ ID NO: 716796 - DNA, 20 bp, Artificial
  CRISPR gRNA sequence
gtccacggagcacaccaata

SEQ ID NO: 716797 - DNA, 20 bp, Artificial
  CRISPR gRNA sequence
ataacaagattggtgagtca

SEQ ID NO: 716798 - DNA, 20 bp, Artificial
  CRISPR gRNA sequence
aaggcccaggaaaggagagg

SEQ ID NO: 716799 - DNA, 20 bp, Artificial
  CRISPR gRNA sequence
catagattcttcaccccaat

SEQ ID NO: 716800 - DNA, 20 bp, Artificial
  CRISPR gRNA sequence
acttacctcgtaggccattg

SEQ ID NO: 716801 - DNA, 20 bp, Artificial
  CRISPR gRNA sequence
agaccgtggctcagagggtg

SEQ ID NO: 716802 - DNA, 20 bp, Artificial
  CRISPR gRNA sequence
atctgctgggccttgaagcc

SEQ ID NO: 716803 - DNA, 20 bp, Artificial
  CRISPR gRNA sequence
acagatggggcccagatgtt

SEQ ID NO: 716804 - DNA, 20 bp, Artificial
  CRISPR gRNA sequence
tgctgccagcctggacagac

SEQ ID NO: 716805 - DNA, 20 bp, Artificial
  CRISPR gRNA sequence
gtgggcctccctgcctcctc

SEQ ID NO: 716806 - DNA, 20 bp, Artificial
  CRISPR gRNA sequence
actcctgccgagaagcctcc

SEQ ID NO: 716807 - DNA, 20 bp, Artificial
  CRISPR gRNA sequence
tacagacccctctgtcactt

SEQ ID NO: 716808 - DNA, 20 bp, Artificial
  CRISPR gRNA sequence
aattctggatatcctgggga

SEQ ID NO: 716809 - DNA, 20 bp, Artificial
  CRISPR gRNA sequence
tagcacccagtggtgtgact

SEQ ID NO: 716810 - DNA, 20 bp, Artificial
  CRISPR gRNA sequence
atagccttcctccacctcca

SEQ ID NO: 716811 - DNA, 20 bp, Artificial
  CRISPR gRNA sequence
gccttggtggaccccacctc

SEQ ID NO: 716812 - DNA, 20 bp, Artificial
  CRISPR gRNA sequence
tttttcagcctcctgagtag

SEQ ID NO: 716813 - DNA, 20 bp, Artificial
  CRISPR gRNA sequence
ttttgtatttttagtagaga

SEQ ID NO: 716814 - DNA, 20 bp, Artificial
  CRISPR gRNA sequence
tgccttggcctcccaaagta

SEQ ID NO: 716815 - DNA, 20 bp, Artificial
  CRISPR gRNA sequence
ggcagtcttttgtaacaaac

SEQ ID NO: 716816 - DNA, 20 bp, Artificial
  CRISPR gRNA sequence
caaactgaagcttttgaaat

SEQ ID NO: 716817 - DNA, 20 bp, Artificial
  CRISPR gRNA sequence
ttttgaaatggtagctttta

SEQ ID NO: 716818 - DNA, 20 bp, Artificial
  CRISPR gRNA sequence
gtattttgggaaataccatc

SEQ ID NO: 716819 - DNA, 20 bp, Artificial
  CRISPR gRNA sequence
tcccaggggtggggttcaga

SEQ ID NO: 716820 - DNA, 20 bp, Artificial
  CRISPR gRNA sequence
agacccctcatggccggctc

SEQ ID NO: 716821 - DNA, 20 bp, Artificial
  CRISPR gRNA sequence
tcacttccgagctcagtggg

SEQ ID NO: 716822 - DNA, 20 bp, Artificial
  CRISPR gRNA sequence
tcacccagagcagccaattc

SEQ ID NO: 716823 - DNA, 20 bp, Artificial
  CRISPR gRNA sequence
ccgctttgaatccagttaat

SEQ ID NO: 716824 - DNA, 20 bp, Artificial
  CRISPR gRNA sequence
tggggagtgctgaggccctg

SEQ ID NO: 716825 - DNA, 20 bp, Artificial
  CRISPR gRNA sequence
tctgggccttctcctcttgc

SEQ ID NO: 716826 - DNA, 20 bp, Artificial
  CRISPR gRNA sequence
cccagctctcaagttccctc

SEQ ID NO: 716827 - DNA, 20 bp, Artificial
  CRISPR gRNA sequence
caccatcagctgggcggagg

SEQ ID NO: 716828 - DNA, 20 bp, Artificial
  CRISPR gRNA sequence
gccgagacctattgaggggg

SEQ ID NO: 716829 - DNA, 20 bp, Artificial
  CRISPR gRNA sequence
tgcaggatgtgacaggctgg

SEQ ID NO: 716830 - DNA, 20 bp, Artificial
  CRISPR gRNA sequence
agctggacaagttggtcacc

SEQ ID NO: 716831 - DNA, 20 bp, Artificial
  CRISPR gRNA sequence
aagggccaccaggcggagtg

SEQ ID NO: 716832 - DNA, 20 bp, Artificial
  CRISPR gRNA sequence
ggagtgggtggttttttttt

SEQ ID NO: 716833 - DNA, 20 bp, Artificial
  CRISPR gRNA sequence
gggcaggtcatttaacctct

SEQ ID NO: 716834 - DNA, 20 bp, Artificial
  CRISPR gRNA sequence
gtcatttaacctctccaggc

SEQ ID NO: 716835 - DNA, 20 bp, Artificial
  CRISPR gRNA sequence
gtgtggaaactgctcagctc

SEQ ID NO: 716836 - DNA, 20 bp, Artificial
  CRISPR gRNA sequence
ctgctcgtgctctggttacc

SEQ ID NO: 716837 - DNA, 20 bp, Artificial
  CRISPR gRNA sequence
ctctggttacccacggcttt

SEQ ID NO: 716838 - DNA, 20 bp, Artificial
  CRISPR gRNA sequence
cggctttgcctgtttttgtc

SEQ ID NO: 716839 - DNA, 20 bp, Artificial
  CRISPR gRNA sequence
tttgcctgtttttgtccaca

SEQ ID NO: 716840 - DNA, 20 bp, Artificial
  CRISPR gRNA sequence
cactgcaggggtctggtggt

SEQ ID NO: 716841 - DNA, 20 bp, Artificial
  CRISPR gRNA sequence
gacccagagcctaggggatc

SEQ ID NO: 716842 - DNA, 20 bp, Artificial
  CRISPR gRNA sequence
ggcatggagccagtgcctgt

SEQ ID NO: 716843 - DNA, 20 bp, Artificial
  CRISPR gRNA sequence
gcccctcaccaacccagaga

SEQ ID NO: 716844 - DNA, 20 bp, Artificial
  CRISPR gRNA sequence
aagcatcttccttaggtctg

SEQ ID NO: 716845 - DNA, 20 bp, Artificial
  CRISPR gRNA sequence
caccacctggttccggctct

SEQ ID NO: 716846 - DNA, 20 bp, Artificial
  CRISPR gRNA sequence
caccacggcctcacccaggc

SEQ ID NO: 716847 - DNA, 20 bp, Artificial
  CRISPR gRNA sequence
ctctggaccataggaaacaa

SEQ ID NO: 716848 - DNA, 20 bp, Artificial
  CRISPR gRNA sequence
cataggaaacaagaccgttt

SEQ ID NO: 716849 - DNA, 20 bp, Artificial
  CRISPR gRNA sequence
aagaccgtttggaggtttca

SEQ ID NO: 716850 - DNA, 20 bp, Artificial
  CRISPR gRNA sequence
ttggaggtttcatcaggatt

SEQ ID NO: 716851 - DNA, 20 bp, Artificial
  CRISPR gRNA sequence
ggaggcaggcccgggaaggc

SEQ ID NO: 716852 - DNA, 20 bp, Artificial
  CRISPR gRNA sequence
acgtgctctctggaggaagt

SEQ ID NO: 716853 - DNA, 20 bp, Artificial
  CRISPR gRNA sequence
gatagtttctgaaaccgctc

SEQ ID NO: 716854 - DNA, 20 bp, Artificial
  CRISPR gRNA sequence
gaacctggacattggccaga

SEQ ID NO: 716855 - DNA, 20 bp, Artificial
  CRISPR gRNA sequence
aagaagcttaagtgggcaga

SEQ ID NO: 716856 - DNA, 20 bp, Artificial
  CRISPR gRNA sequence
gtgggcagacactgtttgcc

SEQ ID NO: 716857 - DNA, 20 bp, Artificial
  CRISPR gRNA sequence
cagtctggcgcccatgatgg

SEQ ID NO: 716858 - DNA, 20 bp, Artificial
  CRISPR gRNA sequence
gcccatgatgggagggattg

SEQ ID NO: 716859 - DNA, 20 bp, Artificial
  CRISPR gRNA sequence
taatagaacccctgagcaga

SEQ ID NO: 716860 - DNA, 20 bp, Artificial
  CRISPR gRNA sequence
tcctcagccttacagttctt

SEQ ID NO: 716861 - DNA, 20 bp, Artificial
  CRISPR gRNA sequence
ttacagttctttaaggattt

SEQ ID NO: 716862 - DNA, 20 bp, Artificial
  CRISPR gRNA sequence
ttaaggattttatggatttt

SEQ ID NO: 716863 - DNA, 20 bp, Artificial
  CRISPR gRNA sequence
ggcaaacagtgtctgcccac

SEQ ID NO: 716864 - DNA, 20 bp, Artificial
  CRISPR gRNA sequence
gtaaccacctctcgcaaggc

SEQ ID NO: 716865 - DNA, 20 bp, Artificial
  CRISPR gRNA sequence
aactttccccaaaacatctg

SEQ ID NO: 716866 - DNA, 20 bp, Artificial
  CRISPR gRNA sequence
ctgatgaaacctccaaacgg

SEQ ID NO: 716867 - DNA, 20 bp, Artificial
  CRISPR gRNA sequence
caggtggtggggtcggtgct

SEQ ID NO: 716868 - DNA, 20 bp, Artificial
  CRISPR gRNA sequence
aagcagggcagacctaagga

SEQ ID NO: 716869 - DNA, 20 bp, Artificial
  CRISPR gRNA sequence
acccgaggcgcctgctgtgg

SEQ ID NO: 716870 - DNA, 20 bp, Artificial
  CRISPR gRNA sequence
tcggcagtgcccatcctgcc

SEQ ID NO: 716871 - DNA, 20 bp, Artificial
  CRISPR gRNA sequence
cacggtgtcagccttcatga

SEQ ID NO: 716872 - DNA, 20 bp, Artificial
  CRISPR gRNA sequence
cagtgctggtacacctgccg

SEQ ID NO: 716873 - DNA, 20 bp, Artificial
  CRISPR gRNA sequence
aagaaccagcccacttgtac

SEQ ID NO: 716874 - DNA, 20 bp, Artificial
  CRISPR gRNA sequence
gagcagaaacagcagagctg

SEQ ID NO: 716875 - DNA, 20 bp, Artificial
  CRISPR gRNA sequence
ctcctgcaaggcggacccca

SEQ ID NO: 716876 - DNA, 20 bp, Artificial
  CRISPR gRNA sequence
aacccggggtgaccaacttg

SEQ ID NO: 716877 - DNA, 20 bp, Artificial
  CRISPR gRNA sequence
cctcaataggtctcggcagc

SEQ ID NO: 716878 - DNA, 20 bp, Artificial
  CRISPR gRNA sequence
ctggctcaggccgtgaattt

SEQ ID NO: 716879 - DNA, 20 bp, Artificial
  CRISPR gRNA sequence
ctgtgctgtgagcacatggt

SEQ ID NO: 716880 - DNA, 20 bp, Artificial
  CRISPR gRNA sequence
tcctcgccacagtctgatgt

SEQ ID NO: 716881 - DNA, 20 bp, Artificial
  CRISPR gRNA sequence
tgggtaatgcagttataccc

SEQ ID NO: 716882 - DNA, 20 bp, Artificial
  CRISPR gRNA sequence
catgacgctggttcttctat

SEQ ID NO: 716883 - DNA, 20 bp, Artificial
  CRISPR gRNA sequence
cagcactccccacacctcca

SEQ ID NO: 716884 - DNA, 20 bp, Artificial
  CRISPR gRNA sequence
agggaagtgagggtgggggt

SEQ ID NO: 716885 - DNA, 20 bp, Artificial
  CRISPR gRNA sequence
ccccaggaaatctggaatta

SEQ ID NO: 716886 - DNA, 20 bp, Artificial
  CRISPR gRNA sequence
cctactccccaggctgtggg

SEQ ID NO: 716887 - DNA, 20 bp, Artificial
  CRISPR gRNA sequence
ggggtggcttccaagggctg

SEQ ID NO: 716888 - DNA, 20 bp, Artificial
  CRISPR gRNA sequence
acaccctctgaaccccaccc

SEQ ID NO: 716889 - DNA, 20 bp, Artificial
  CRISPR gRNA sequence
ttactaaaagctaccatttc

SEQ ID NO: 716890 - DNA, 20 bp, Artificial
  CRISPR gRNA sequence
aaagctaccatttcaaaagc

SEQ ID NO: 716891 - DNA, 20 bp, Artificial
  CRISPR gRNA sequence
agcatggtggagagggcaca

SEQ ID NO: 716892 - DNA, 20 bp, Artificial
  CRISPR gRNA sequence
ccccaggatatccagaatta

SEQ ID NO: 716893 - DNA, 20 bp, Artificial
  CRISPR gRNA sequence
atagggaatgggaagctgct

SEQ ID NO: 716894 - DNA, 20 bp, Artificial
  CRISPR gRNA sequence
catctgggccccatctgtcc

SEQ ID NO: 716895 - DNA, 20 bp, Artificial
  CRISPR gRNA sequence
ggtggtaacgtggacaaacc

SEQ ID NO: 716896 - DNA, 20 bp, Artificial
  CRISPR gRNA sequence
gtgttgggggctggggtggt

SEQ ID NO: 716897 - DNA, 20 bp, Artificial
  CRISPR gRNA sequence
agaccccagtgagtccccct

SEQ ID NO: 716898 - DNA, 20 bp, Artificial
  CRISPR gRNA sequence
aaaagctgccatgagctgcc

SEQ ID NO: 716899 - DNA, 20 bp, Artificial
  CRISPR gRNA sequence
ccatgagctgccccgggctt

SEQ ID NO: 716900 - DNA, 20 bp, Artificial
  CRISPR gRNA sequence
tcagctttctgggtgaagtc

SEQ ID NO: 716901 - DNA, 20 bp, Artificial
  CRISPR gRNA sequence
accatcaataagtatctgag

SEQ ID NO: 716902 - DNA, 20 bp, Artificial
  CRISPR gRNA sequence
agctatgtcatgaggaaagt

SEQ ID NO: 716903 - DNA, 20 bp, Artificial
  CRISPR gRNA sequence
tgtcatgaggaaagtgtcag

SEQ ID NO: 716904 - DNA, 20 bp, Artificial
  CRISPR gRNA sequence
gaggaaagtgtcagtttagt

SEQ ID NO: 716905 - DNA, 20 bp, Artificial
  CRISPR gRNA sequence
cagggatgcccgtgctgacg

SEQ ID NO: 716906 - DNA, 20 bp, Artificial
  CRISPR gRNA sequence
aaggcacagagggcgtatct

SEQ ID NO: 716907 - DNA, 20 bp, Artificial
  CRISPR gRNA sequence
ttattattttttacttttta

SEQ ID NO: 716908 - DNA, 20 bp, Artificial
  CRISPR gRNA sequence
aaattctactttcccaaaac

SEQ ID NO: 716909 - DNA, 20 bp, Artificial
  CRISPR gRNA sequence
ataataacttttaaaaggcg

SEQ ID NO: 716910 - DNA, 20 bp, Artificial
  CRISPR gRNA sequence
tttaaaaggcgctgagattc

SEQ ID NO: 716911 - DNA, 20 bp, Artificial
  CRISPR gRNA sequence
tcactgctgagctagaaaaa

SEQ ID NO: 716912 - DNA, 20 bp, Artificial
  CRISPR gRNA sequence
aagtttgttctaccaggaac

SEQ ID NO: 716913 - DNA, 20 bp, Artificial
  CRISPR gRNA sequence
aaaaccagagacctttgttc

SEQ ID NO: 716914 - DNA, 20 bp, Artificial
  CRISPR gRNA sequence
gagtgtggtgtcactccaga

SEQ ID NO: 716915 - DNA, 20 bp, Artificial
  CRISPR gRNA sequence
tacctatcagaagggttaaa

SEQ ID NO: 716916 - DNA, 20 bp, Artificial
  CRISPR gRNA sequence
aacctctgtcccccaggctc

SEQ ID NO: 716917 - DNA, 20 bp, Artificial
  CRISPR gRNA sequence
cactacacctggatactttt

SEQ ID NO: 716918 - DNA, 20 bp, Artificial
  CRISPR gRNA sequence
ttttgtagttttagtagaga

SEQ ID NO: 716919 - DNA, 20 bp, Artificial
  CRISPR gRNA sequence
tgcctcagcctcccaaaatg

SEQ ID NO: 716920 - DNA, 20 bp, Artificial
  CRISPR gRNA sequence
ggcctatgcagcaaaaacat

SEQ ID NO: 716921 - DNA, 20 bp, Artificial
  CRISPR gRNA sequence
agaaacccttcttaatgtat

SEQ ID NO: 716922 - DNA, 20 bp, Artificial
  CRISPR gRNA sequence
catagccacctgctctgtca

SEQ ID NO: 716923 - DNA, 20 bp, Artificial
  CRISPR gRNA sequence
tctgtcatccagcttggagg

SEQ ID NO: 716924 - DNA, 20 bp, Artificial
  CRISPR gRNA sequence
tcagatctgttagggaagga

SEQ ID NO: 716925 - DNA, 20 bp, Artificial
  CRISPR gRNA sequence
ctcagtctggagagccctcg

SEQ ID NO: 716926 - DNA, 20 bp, Artificial
  CRISPR gRNA sequence
aacctccgcctcctgggttc

SEQ ID NO: 716927 - DNA, 20 bp, Artificial
  CRISPR gRNA sequence
tgcctcagcctcccgaatag

SEQ ID NO: 716928 - DNA, 20 bp, Artificial
  CRISPR gRNA sequence
ttttgtattttcagtagaga

SEQ ID NO: 716929 - DNA, 20 bp, Artificial
  CRISPR gRNA sequence
cgccttggccttgcaaagtg

SEQ ID NO: 716930 - DNA, 20 bp, Artificial
  CRISPR gRNA sequence
cccccacccccgcgcacatg

SEQ ID NO: 716931 - DNA, 20 bp, Artificial
  CRISPR gRNA sequence
acaggcccaaccagagccca

SEQ ID NO: 716932 - DNA, 20 bp, Artificial
  CRISPR gRNA sequence
cccttctgactccagctgga

SEQ ID NO: 716933 - DNA, 20 bp, Artificial
  CRISPR gRNA sequence
aggctcaggaggtgctgata

SEQ ID NO: 716934 - DNA, 20 bp, Artificial
  CRISPR gRNA sequence
cagaccatcctccagggatg

SEQ ID NO: 716935 - DNA, 20 bp, Artificial
  CRISPR gRNA sequence
acacgctgtgtggacactag

SEQ ID NO: 716936 - DNA, 20 bp, Artificial
  CRISPR gRNA sequence
ctcactgcaacctctgcctc

SEQ ID NO: 716937 - DNA, 20 bp, Artificial
  CRISPR gRNA sequence
taagcaattctcacaagtag

SEQ ID NO: 716938 - DNA, 20 bp, Artificial
  CRISPR gRNA sequence
ttttgtatttttagtagaaa

SEQ ID NO: 716939 - DNA, 20 bp, Artificial
  CRISPR gRNA sequence
cgcctcggcctctcgaagtg

SEQ ID NO: 716940 - DNA, 20 bp, Artificial
  CRISPR gRNA sequence
aacctccgcctcctgggttc

SEQ ID NO: 716941 - DNA, 20 bp, Artificial
  CRISPR gRNA sequence
tgcctcagcctcccgagtag

SEQ ID NO: 716942 - DNA, 20 bp, Artificial
  CRISPR gRNA sequence
ttttgtatttttagtagaga

SEQ ID NO: 716943 - DNA, 20 bp, Artificial
  CRISPR gRNA sequence
cgcctcggcctcccaaagtg

SEQ ID NO: 716944 - DNA, 20 bp, Artificial
  CRISPR gRNA sequence
actaaatcatggtccctcca

SEQ ID NO: 716945 - DNA, 20 bp, Artificial
  CRISPR gRNA sequence
atggtccctccagagtgatt

SEQ ID NO: 716946 - DNA, 20 bp, Artificial
  CRISPR gRNA sequence
caaaaaggccgagcacagca

SEQ ID NO: 716947 - DNA, 20 bp, Artificial
  CRISPR gRNA sequence
ccaaatgtcaaaaacaatga

SEQ ID NO: 716948 - DNA, 20 bp, Artificial
  CRISPR gRNA sequence
gggatgaatcacatcaactt

SEQ ID NO: 716949 - DNA, 20 bp, Artificial
  CRISPR gRNA sequence
atcaactttggggcttgttg

SEQ ID NO: 716950 - DNA, 20 bp, Artificial
  CRISPR gRNA sequence
aggtgcccagtggtaaatca

SEQ ID NO: 716951 - DNA, 20 bp, Artificial
  CRISPR gRNA sequence
ctcaatgcaacctctgcctc

SEQ ID NO: 716952 - DNA, 20 bp, Artificial
  CRISPR gRNA sequence
ttttgtattttcggtagaga

SEQ ID NO: 716953 - DNA, 20 bp, Artificial
  CRISPR gRNA sequence
tcctgacctcaggtgatctg

SEQ ID NO: 716954 - DNA, 20 bp, Artificial
  CRISPR gRNA sequence
aggcttggcctcccaaagtg

SEQ ID NO: 716955 - DNA, 20 bp, Artificial
  CRISPR gRNA sequence
gcatgagctactgcgcccag

SEQ ID NO: 716956 - DNA, 20 bp, Artificial
  CRISPR gRNA sequence
aagatttgatgtgatgagca

SEQ ID NO: 716957 - DNA, 20 bp, Artificial
  CRISPR gRNA sequence
aagggaaccctgaacacagt

SEQ ID NO: 716958 - DNA, 20 bp, Artificial
  CRISPR gRNA sequence
accctgaacacagtgtgggc

SEQ ID NO: 716959 - DNA, 20 bp, Artificial
  CRISPR gRNA sequence
tattttgacaaatgaacgat

SEQ ID NO: 716960 - DNA, 20 bp, Artificial
  CRISPR gRNA sequence
gaagcagaggttgcagtgag

SEQ ID NO: 716961 - DNA, 20 bp, Artificial
  CRISPR gRNA sequence
gaggtcaaggctgcagtgag

SEQ ID NO: 716962 - DNA, 20 bp, Artificial
  CRISPR gRNA sequence
ttaaaaatgaaggccactta

SEQ ID NO: 716963 - DNA, 20 bp, Artificial
  CRISPR gRNA sequence
gaaggccacttagaatgttt

SEQ ID NO: 716964 - DNA, 20 bp, Artificial
  CRISPR gRNA sequence
gccacttagaatgttttttt

SEQ ID NO: 716965 - DNA, 20 bp, Artificial
  CRISPR gRNA sequence
cttagaatgtttttttgttt

SEQ ID NO: 716966 - DNA, 20 bp, Artificial
  CRISPR gRNA sequence
gaatgtttttttgtttgttt

SEQ ID NO: 716967 - DNA, 20 bp, Artificial
  CRISPR gRNA sequence
gtttttttgtttgtttgttt

SEQ ID NO: 716968 - DNA, 20 bp, Artificial
  CRISPR gRNA sequence
tgcctcagcctcccgagtag

SEQ ID NO: 716969 - DNA, 20 bp, Artificial
  CRISPR gRNA sequence
ttttttatttttagtagaga

SEQ ID NO: 716970 - DNA, 20 bp, Artificial
  CRISPR gRNA sequence
caccttggcctcccaaagtg

SEQ ID NO: 716971 - DNA, 20 bp, Artificial
  CRISPR gRNA sequence
aagagccgtgttacaaccca

SEQ ID NO: 716972 - DNA, 20 bp, Artificial
  CRISPR gRNA sequence
aaatcttgccaagtacagag

SEQ ID NO: 716973 - DNA, 20 bp, Artificial
  CRISPR gRNA sequence
aactgctcttcccctaaaaa

SEQ ID NO: 716974 - DNA, 20 bp, Artificial
  CRISPR gRNA sequence
tctatctgctagtcttattt

SEQ ID NO: 716975 - DNA, 20 bp, Artificial
  CRISPR gRNA sequence
agtcccctcccctctctggc

SEQ ID NO: 716976 - DNA, 20 bp, Artificial
  CRISPR gRNA sequence
aatttggcacagaggttcag

SEQ ID NO: 716977 - DNA, 20 bp, Artificial
  CRISPR gRNA sequence
cccgggctccttggagaggc

SEQ ID NO: 716978 - DNA, 20 bp, Artificial
  CRISPR gRNA sequence
atacaccaaagcacacaaga

SEQ ID NO: 716979 - DNA, 20 bp, Artificial
  CRISPR gRNA sequence
ccaaaataaaaaatgatggt

SEQ ID NO: 716980 - DNA, 20 bp, Artificial
  CRISPR gRNA sequence
ttgggaggctgaagcaggag

SEQ ID NO: 716981 - DNA, 20 bp, Artificial
  CRISPR gRNA sequence
tgtctgtctgaaacacacac

SEQ ID NO: 716982 - DNA, 20 bp, Artificial
  CRISPR gRNA sequence
ttcatacttataccatttct

SEQ ID NO: 716983 - DNA, 20 bp, Artificial
  CRISPR gRNA sequence
taccatttctataagtttga

SEQ ID NO: 716984 - DNA, 20 bp, Artificial
  CRISPR gRNA sequence
actcaagtgctcataaaaat

SEQ ID NO: 716985 - DNA, 20 bp, Artificial
  CRISPR gRNA sequence
ggcaggcggatcatgaggtc

SEQ ID NO: 716986 - DNA, 20 bp, Artificial
  CRISPR gRNA sequence
agaccagtggttctcaacca

SEQ ID NO: 716987 - DNA, 20 bp, Artificial
  CRISPR gRNA sequence
aggagtggatgagatcacgt

SEQ ID NO: 716988 - DNA, 20 bp, Artificial
  CRISPR gRNA sequence
cgggcagtcggaattagtct

SEQ ID NO: 716989 - DNA, 20 bp, Artificial
  CRISPR gRNA sequence
aaaagcttggagggagctag

SEQ ID NO: 716990 - DNA, 20 bp, Artificial
  CRISPR gRNA sequence
ccattctcacccggtgctct

SEQ ID NO: 716991 - DNA, 20 bp, Artificial
  CRISPR gRNA sequence
tgctctgtgagcttgcctgt

SEQ ID NO: 716992 - DNA, 20 bp, Artificial
  CRISPR gRNA sequence
agggctcagttctttgtaga

SEQ ID NO: 716993 - DNA, 20 bp, Artificial
  CRISPR gRNA sequence
agacctggcttcttagggga

SEQ ID NO: 716994 - DNA, 20 bp, Artificial
  CRISPR gRNA sequence
tgtaacaaaactgctctcac

SEQ ID NO: 716995 - DNA, 20 bp, Artificial
  CRISPR gRNA sequence
aaaatgtcaagaaagcaaac

SEQ ID NO: 716996 - DNA, 20 bp, Artificial
  CRISPR gRNA sequence
cagcctgacaggtcatggaa

SEQ ID NO: 716997 - DNA, 20 bp, Artificial
  CRISPR gRNA sequence
ccccccttgcacagggacca

SEQ ID NO: 716998 - DNA, 20 bp, Artificial
  CRISPR gRNA sequence
ccttgcacagggaccacagt

SEQ ID NO: 716999 - DNA, 20 bp, Artificial
  CRISPR gRNA sequence
tcaaaacatgcctcagtgga

SEQ ID NO: 717000 - DNA, 20 bp, Artificial
  CRISPR gRNA sequence
caaatcagaaacgaaggctc

SEQ ID NO: 717001 - DNA, 20 bp, Artificial
  CRISPR gRNA sequence
ggggctgcccaggagagaga

SEQ ID NO: 717002 - DNA, 20 bp, Artificial
  CRISPR gRNA sequence
acccaggactcaggaaggcc

SEQ ID NO: 717003 - DNA, 20 bp, Artificial
  CRISPR gRNA sequence
gcctgtcaataggcagcagc

SEQ ID NO: 717004 - DNA, 20 bp, Artificial
  CRISPR gRNA sequence
ttgcaggcaggtactccacg

SEQ ID NO: 717005 - DNA, 20 bp, Artificial
  CRISPR gRNA sequence
tccacaggccaagcctctga

SEQ ID NO: 717006 - DNA, 20 bp, Artificial
  CRISPR gRNA sequence
cagtaactcacccagggtca

SEQ ID NO: 717007 - DNA, 20 bp, Artificial
  CRISPR gRNA sequence
tcattgcattctccacacgc

SEQ ID NO: 717008 - DNA, 20 bp, Artificial
  CRISPR gRNA sequence
tgcgacaggagccacagaca

SEQ ID NO: 717009 - DNA, 20 bp, Artificial
  CRISPR gRNA sequence
ctggacactcacccacaagc

SEQ ID NO: 717010 - DNA, 20 bp, Artificial
  CRISPR gRNA sequence
acagccacttactctgccga

SEQ ID NO: 717011 - DNA, 20 bp, Artificial
  CRISPR gRNA sequence
acttcctccttctcctggga

SEQ ID NO: 717012 - DNA, 20 bp, Artificial
  CRISPR gRNA sequence
cctcccggccaaccctctag

SEQ ID NO: 717013 - DNA, 20 bp, Artificial
  CRISPR gRNA sequence
ccctaggcaccgtcactacc

SEQ ID NO: 717014 - DNA, 20 bp, Artificial
  CRISPR gRNA sequence
tcttcacacctcggtactaa

SEQ ID NO: 717015 - DNA, 20 bp, Artificial
  CRISPR gRNA sequence
acacctcggtactaaactcg

SEQ ID NO: 717016 - DNA, 20 bp, Artificial
  CRISPR gRNA sequence
acttacagagatcatagagc

SEQ ID NO: 717017 - DNA, 20 bp, Artificial
  CRISPR gRNA sequence
tgattgcactttattgaagt

SEQ ID NO: 717018 - DNA, 20 bp, Artificial
  CRISPR gRNA sequence
ctttattgaagtccatgttt

SEQ ID NO: 717019 - DNA, 20 bp, Artificial
  CRISPR gRNA sequence
aaaagtagtatatgccagtt

SEQ ID NO: 717020 - DNA, 20 bp, Artificial
  CRISPR gRNA sequence
ccctggagatcttgttaaag

SEQ ID NO: 717021 - DNA, 20 bp, Artificial
  CRISPR gRNA sequence
agatcttgttaaagtgcagt

SEQ ID NO: 717022 - DNA, 20 bp, Artificial
  CRISPR gRNA sequence
ggtctgggatggggcccata

SEQ ID NO: 717023 - DNA, 20 bp, Artificial
  CRISPR gRNA sequence
ttccctaagagctaactctt

SEQ ID NO: 717024 - DNA, 20 bp, Artificial
  CRISPR gRNA sequence
taagagctaactcttggggg

SEQ ID NO: 717025 - DNA, 20 bp, Artificial
  CRISPR gRNA sequence
agctaactcttgggggtttt

SEQ ID NO: 717026 - DNA, 20 bp, Artificial
  CRISPR gRNA sequence
actcttgggggttttgtttg

SEQ ID NO: 717027 - DNA, 20 bp, Artificial
  CRISPR gRNA sequence
tgggggttttgtttgttttg

SEQ ID NO: 717028 - DNA, 20 bp, Artificial
  CRISPR gRNA sequence
gttttgtttgttttgttttg

SEQ ID NO: 717029 - DNA, 20 bp, Artificial
  CRISPR gRNA sequence
gtttgttttgttttgttttg

SEQ ID NO: 717030 - DNA, 20 bp, Artificial
  CRISPR gRNA sequence
ttttgttttgttttgttttg

SEQ ID NO: 717031 - DNA, 20 bp, Artificial
  CRISPR gRNA sequence
ttttgttttgttttgttttg

SEQ ID NO: 717032 - DNA, 20 bp, Artificial
  CRISPR gRNA sequence
ttttgttttgttttgttttg

SEQ ID NO: 717033 - DNA, 20 bp, Artificial
  CRISPR gRNA sequence
ttttgttttgttttgttttg

SEQ ID NO: 717034 - DNA, 20 bp, Artificial
  CRISPR gRNA sequence
ttttgttttgttttgttttg

SEQ ID NO: 717035 - DNA, 20 bp, Artificial
  CRISPR gRNA sequence
ttttgttttgttttgtttga

SEQ ID NO: 717036 - DNA, 20 bp, Artificial
  CRISPR gRNA sequence
aacctccgcctcccgggttc

SEQ ID NO: 717037 - DNA, 20 bp, Artificial
  CRISPR gRNA sequence
tgcctcagcctcctgagtag

SEQ ID NO: 717038 - DNA, 20 bp, Artificial
  CRISPR gRNA sequence
ttttgtatttttagtagaga

SEQ ID NO: 717039 - DNA, 20 bp, Artificial
  CRISPR gRNA sequence
caccttggcctcccaaagtg

SEQ ID NO: 717040 - DNA, 20 bp, Artificial
  CRISPR gRNA sequence
agaggccgtctacaatgcta

SEQ ID NO: 717041 - DNA, 20 bp, Artificial
  CRISPR gRNA sequence
caggtggatcacctgaggtc

SEQ ID NO: 717042 - DNA, 20 bp, Artificial
  CRISPR gRNA sequence
cagcctgagcaacagagtga

SEQ ID NO: 717043 - DNA, 20 bp, Artificial
  CRISPR gRNA sequence
gaccattacctgcatccaga

SEQ ID NO: 717044 - DNA, 20 bp, Artificial
  CRISPR gRNA sequence
aggcattttgagggcaggga

SEQ ID NO: 717045 - DNA, 20 bp, Artificial
  CRISPR gRNA sequence
gggactgggtttcaaggcct

SEQ ID NO: 717046 - DNA, 20 bp, Artificial
  CRISPR gRNA sequence
agagttaaccagcagggact

SEQ ID NO: 717047 - DNA, 20 bp, Artificial
  CRISPR gRNA sequence
acaccgtgggagctaagaca

SEQ ID NO: 717048 - DNA, 20 bp, Artificial
  CRISPR gRNA sequence
gggagctaagacagtcagat

SEQ ID NO: 717049 - DNA, 20 bp, Artificial
  CRISPR gRNA sequence
tcaggaggctgaggcaggag

SEQ ID NO: 717050 - DNA, 20 bp, Artificial
  CRISPR gRNA sequence
tgaaacagtgacgctagacc

SEQ ID NO: 717051 - DNA, 20 bp, Artificial
  CRISPR gRNA sequence
aagagaaaactgaaatcgcc

SEQ ID NO: 717052 - DNA, 20 bp, Artificial
  CRISPR gRNA sequence
ttaaatacagcctcaatttt

SEQ ID NO: 717053 - DNA, 20 bp, Artificial
  CRISPR gRNA sequence
ttaaggaattatttatttat

SEQ ID NO: 717054 - DNA, 20 bp, Artificial
  CRISPR gRNA sequence
atttatttatgtttaatttt

SEQ ID NO: 717055 - DNA, 20 bp, Artificial
  CRISPR gRNA sequence
gctcattgcaacttctgcct

SEQ ID NO: 717056 - DNA, 20 bp, Artificial
  CRISPR gRNA sequence
aacttctgcctcccggattc

SEQ ID NO: 717057 - DNA, 20 bp, Artificial
  CRISPR gRNA sequence
tgcctcagcctcctgagtag

SEQ ID NO: 717058 - DNA, 20 bp, Artificial
  CRISPR gRNA sequence
ttttgtatttttagtagaaa

SEQ ID NO: 717059 - DNA, 20 bp, Artificial
  CRISPR gRNA sequence
ccagatccaggcaaccaccg

SEQ ID NO: 717060 - DNA, 20 bp, Artificial
  CRISPR gRNA sequence
gcagtatgtactctttgggg

SEQ ID NO: 717061 - DNA, 20 bp, Artificial
  CRISPR gRNA sequence
ctggcttcttccactctgca

SEQ ID NO: 717062 - DNA, 20 bp, Artificial
  CRISPR gRNA sequence
cataatgtttttgatattca

SEQ ID NO: 717063 - DNA, 20 bp, Artificial
  CRISPR gRNA sequence
gttctgttgtacagatgaac

SEQ ID NO: 717064 - DNA, 20 bp, Artificial
  CRISPR gRNA sequence
cgctagttgatggacatttg

SEQ ID NO: 717065 - DNA, 20 bp, Artificial
  CRISPR gRNA sequence
tgatggacatttgggttgtt

SEQ ID NO: 717066 - DNA, 20 bp, Artificial
  CRISPR gRNA sequence
ttgagtgcctaggaagggtg

SEQ ID NO: 717067 - DNA, 20 bp, Artificial
  CRISPR gRNA sequence
ccactggtctgacccagcta

SEQ ID NO: 717068 - DNA, 20 bp, Artificial
  CRISPR gRNA sequence
tggggactgggcaccttctt

SEQ ID NO: 717069 - DNA, 20 bp, Artificial
  CRISPR gRNA sequence
tgggcaccttcttcaaagct

SEQ ID NO: 717070 - DNA, 20 bp, Artificial
  CRISPR gRNA sequence
acaaagtgttcgtgacgcct

SEQ ID NO: 717071 - DNA, 20 bp, Artificial
  CRISPR gRNA sequence
aaatagacaaaaaagtaaag

SEQ ID NO: 717072 - DNA, 20 bp, Artificial
  CRISPR gRNA sequence
tcgttaatcagtatttgaat

SEQ ID NO: 717073 - DNA, 20 bp, Artificial
  CRISPR gRNA sequence
aatcagtgtttgaaaggtca

SEQ ID NO: 717074 - DNA, 20 bp, Artificial
  CRISPR gRNA sequence
atcctccccttttcctcctc

SEQ ID NO: 717075 - DNA, 20 bp, Artificial
  CRISPR gRNA sequence
ttgtctcagcatcaaggcca

SEQ ID NO: 717076 - DNA, 20 bp, Artificial
  CRISPR gRNA sequence
tctctttttgtacatccagc

SEQ ID NO: 717077 - DNA, 20 bp, Artificial
  CRISPR gRNA sequence
tgtcatctttttcttttccc

SEQ ID NO: 717078 - DNA, 20 bp, Artificial
  CRISPR gRNA sequence
agtgtgccctcaccatatcc

SEQ ID NO: 717079 - DNA, 20 bp, Artificial
  CRISPR gRNA sequence
gctaggatggagtgctggtc

SEQ ID NO: 717080 - DNA, 20 bp, Artificial
  CRISPR gRNA sequence
gagtgctggtctctagattc

SEQ ID NO: 717081 - DNA, 20 bp, Artificial
  CRISPR gRNA sequence
ctctagattccatggcttcc

SEQ ID NO: 717082 - DNA, 20 bp, Artificial
  CRISPR gRNA sequence
tctggaccttttatgtctga

SEQ ID NO: 717083 - DNA, 20 bp, Artificial
  CRISPR gRNA sequence
tgtttttatgctgccttcaa

SEQ ID NO: 717084 - DNA, 20 bp, Artificial
  CRISPR gRNA sequence
tgggatccctgcattctggt

SEQ ID NO: 717085 - DNA, 20 bp, Artificial
  CRISPR gRNA sequence
ttctggttctagcttcggcc

SEQ ID NO: 717086 - DNA, 20 bp, Artificial
  CRISPR gRNA sequence
gttgtatcagaccagaggta

SEQ ID NO: 717087 - DNA, 20 bp, Artificial
  CRISPR gRNA sequence
aaaaaaaaaagaatattcac

SEQ ID NO: 717088 - DNA, 20 bp, Artificial
  CRISPR gRNA sequence
gcgtgggtaatttccattaa

SEQ ID NO: 717089 - DNA, 20 bp, Artificial
  CRISPR gRNA sequence
aggtccttttgacctgaagt

SEQ ID NO: 717090 - DNA, 20 bp, Artificial
  CRISPR gRNA sequence
tcaggaggctgaggcaggaa

SEQ ID NO: 717091 - DNA, 20 bp, Artificial
  CRISPR gRNA sequence
cctctagcgccctctgctgg

SEQ ID NO: 717092 - DNA, 20 bp, Artificial
  CRISPR gRNA sequence
ttgctaagtactcttctatt

SEQ ID NO: 717093 - DNA, 20 bp, Artificial
  CRISPR gRNA sequence
tcttctattcctggatttat

SEQ ID NO: 717094 - DNA, 20 bp, Artificial
  CRISPR gRNA sequence
cttcatgtgtggtaagaatt

SEQ ID NO: 717095 - DNA, 20 bp, Artificial
  CRISPR gRNA sequence
tttttattctcctttgtagg

SEQ ID NO: 717096 - DNA, 20 bp, Artificial
  CRISPR gRNA sequence
tcatatttattttaaaaggg

SEQ ID NO: 717097 - DNA, 20 bp, Artificial
  CRISPR gRNA sequence
tattccagtcactgagcggg

SEQ ID NO: 717098 - DNA, 20 bp, Artificial
  CRISPR gRNA sequence
cttccaaatacccaagtaaa

SEQ ID NO: 717099 - DNA, 20 bp, Artificial
  CRISPR gRNA sequence
gagacggaggttgcagtgag

SEQ ID NO: 717100 - DNA, 20 bp, Artificial
  CRISPR gRNA sequence
aggaaaaaaaaagacaatac

SEQ ID NO: 717101 - DNA, 20 bp, Artificial
  CRISPR gRNA sequence
cattgtaatacattttgaag

SEQ ID NO: 717102 - DNA, 20 bp, Artificial
  CRISPR gRNA sequence
atacattttgaagttgtgtt

SEQ ID NO: 717103 - DNA, 20 bp, Artificial
  CRISPR gRNA sequence
attgggtgaccttccctcca

SEQ ID NO: 717104 - DNA, 20 bp, Artificial
  CRISPR gRNA sequence
ggttttttttcttttttagg

SEQ ID NO: 717105 - DNA, 20 bp, Artificial
  CRISPR gRNA sequence
aacctatgcctcccgggttc

SEQ ID NO: 717106 - DNA, 20 bp, Artificial
  CRISPR gRNA sequence
ttgtgtatttttagtagaga

SEQ ID NO: 717107 - DNA, 20 bp, Artificial
  CRISPR gRNA sequence
caccacgcctggccattccc

SEQ ID NO: 717108 - DNA, 20 bp, Artificial
  CRISPR gRNA sequence
ggttttgtcaccactcttcc

SEQ ID NO: 717109 - DNA, 20 bp, Artificial
  CRISPR gRNA sequence
tccatctgttttaaaccacc

SEQ ID NO: 717110 - DNA, 20 bp, Artificial
  CRISPR gRNA sequence
caacaacaacaaaaaactgt

SEQ ID NO: 717111 - DNA, 20 bp, Artificial
  CRISPR gRNA sequence
caacaaaaaactgtcagggt

SEQ ID NO: 717112 - DNA, 20 bp, Artificial
  CRISPR gRNA sequence
aaaacagccttgcaaacagg

SEQ ID NO: 717113 - DNA, 20 bp, Artificial
  CRISPR gRNA sequence
cattagccggctgtggtggc

SEQ ID NO: 717114 - DNA, 20 bp, Artificial
  CRISPR gRNA sequence
tcagaaggctgaggcaggag

SEQ ID NO: 717115 - DNA, 20 bp, Artificial
  CRISPR gRNA sequence
gaggtgcaggttgcggtgag

SEQ ID NO: 717116 - DNA, 20 bp, Artificial
  CRISPR gRNA sequence
gaaactccatctcaaaaata

SEQ ID NO: 717117 - DNA, 20 bp, Artificial
  CRISPR gRNA sequence
tctcttgccaaaatgctaaa

SEQ ID NO: 717118 - DNA, 20 bp, Artificial
  CRISPR gRNA sequence
tggtcgaggcctggggtggg

SEQ ID NO: 717119 - DNA, 20 bp, Artificial
  CRISPR gRNA sequence
ggggtgggaactgcttaccc

SEQ ID NO: 717120 - DNA, 20 bp, Artificial
  CRISPR gRNA sequence
cttggtgaccgtctctgctg

SEQ ID NO: 717121 - DNA, 20 bp, Artificial
  CRISPR gRNA sequence
gcatgcatttgttaaaactt

SEQ ID NO: 717122 - DNA, 20 bp, Artificial
  CRISPR gRNA sequence
aagactggccatgactccat

SEQ ID NO: 717123 - DNA, 20 bp, Artificial
  CRISPR gRNA sequence
ctgactcactctacatctga

SEQ ID NO: 717124 - DNA, 20 bp, Artificial
  CRISPR gRNA sequence
gtttgaaatttttaataata

SEQ ID NO: 717125 - DNA, 20 bp, Artificial
  CRISPR gRNA sequence
aaaaaaaaaaaaaaaaaaaa

SEQ ID NO: 717126 - DNA, 20 bp, Artificial
  CRISPR gRNA sequence
aaatacagaacgactgcatc

SEQ ID NO: 717127 - DNA, 20 bp, Artificial
  CRISPR gRNA sequence
atccagagcaagggaactgg

SEQ ID NO: 717128 - DNA, 20 bp, Artificial
  CRISPR gRNA sequence
acagtagtctcagcactcta

SEQ ID NO: 717129 - DNA, 20 bp, Artificial
  CRISPR gRNA sequence
aggcacagagaggttaggaa

SEQ ID NO: 717130 - DNA, 20 bp, Artificial
  CRISPR gRNA sequence
tacaccactccactgcctcg

SEQ ID NO: 717131 - DNA, 20 bp, Artificial
  CRISPR gRNA sequence
acctacctgtcaagaagtac

SEQ ID NO: 717132 - DNA, 20 bp, Artificial
  CRISPR gRNA sequence
ttatggccgggggcaatggc

SEQ ID NO: 717133 - DNA, 20 bp, Artificial
  CRISPR gRNA sequence
ccggcggatcacttgaggcc

SEQ ID NO: 717134 - DNA, 20 bp, Artificial
  CRISPR gRNA sequence
ccccaaggcaggtgaatgaa

SEQ ID NO: 717135 - DNA, 20 bp, Artificial
  CRISPR gRNA sequence
agcttcagaagttcctgatc

SEQ ID NO: 717136 - DNA, 20 bp, Artificial
  CRISPR gRNA sequence
aagttcctgatctgcagctt

SEQ ID NO: 717137 - DNA, 20 bp, Artificial
  CRISPR gRNA sequence
acagaatctgtgagtacaaa

SEQ ID NO: 717138 - DNA, 20 bp, Artificial
  CRISPR gRNA sequence
atctgtgagtacaaagaatg

SEQ ID NO: 717139 - DNA, 20 bp, Artificial
  CRISPR gRNA sequence
agaatgatttgttttcacaa

SEQ ID NO: 717140 - DNA, 20 bp, Artificial
  CRISPR gRNA sequence
tggcctcccctgacccttca

SEQ ID NO: 717141 - DNA, 20 bp, Artificial
  CRISPR gRNA sequence
gctgtgtctgtgcactcagt

SEQ ID NO: 717142 - DNA, 20 bp, Artificial
  CRISPR gRNA sequence
ctatgatcccaccaccgtac

SEQ ID NO: 717143 - DNA, 20 bp, Artificial
  CRISPR gRNA sequence
gttccctgacttcccaaagc

SEQ ID NO: 717144 - DNA, 20 bp, Artificial
  CRISPR gRNA sequence
ctgtaaaaggggaatgatca

SEQ ID NO: 717145 - DNA, 20 bp, Artificial
  CRISPR gRNA sequence
tagttacaaacattgatgag

SEQ ID NO: 717146 - DNA, 20 bp, Artificial
  CRISPR gRNA sequence
gagccgagtttggaacaggt

SEQ ID NO: 717147 - DNA, 20 bp, Artificial
  CRISPR gRNA sequence
ggaacaggtgggtgattcac

SEQ ID NO: 717148 - DNA, 20 bp, Artificial
  CRISPR gRNA sequence
ccaggtagtagtcgggctca

SEQ ID NO: 717149 - DNA, 20 bp, Artificial
  CRISPR gRNA sequence
tcctcctgaggccaccatgc

SEQ ID NO: 717150 - DNA, 20 bp, Artificial
  CRISPR gRNA sequence
cccctgctcaaaactttggg

SEQ ID NO: 717151 - DNA, 20 bp, Artificial
  CRISPR gRNA sequence
cactttgggaggctgaggcg

SEQ ID NO: 717152 - DNA, 20 bp, Artificial
  CRISPR gRNA sequence
cgggtggattacttgaggcc

SEQ ID NO: 717153 - DNA, 20 bp, Artificial
  CRISPR gRNA sequence
tcgggaggctgaggcaggag

SEQ ID NO: 717154 - DNA, 20 bp, Artificial
  CRISPR gRNA sequence
tcaggaggctgaggcaggag

SEQ ID NO: 717155 - DNA, 20 bp, Artificial
  CRISPR gRNA sequence
gaggtggaggtggcagtgag

SEQ ID NO: 717156 - DNA, 20 bp, Artificial
  CRISPR gRNA sequence
tggtgtctacctctgcccct

SEQ ID NO: 717157 - DNA, 20 bp, Artificial
  CRISPR gRNA sequence
agcaccccagggagacgacc

SEQ ID NO: 717158 - DNA, 20 bp, Artificial
  CRISPR gRNA sequence
agggagagtcgggagccctc

SEQ ID NO: 717159 - DNA, 20 bp, Artificial
  CRISPR gRNA sequence
ggagccctcgtcagtttaga

SEQ ID NO: 717160 - DNA, 20 bp, Artificial
  CRISPR gRNA sequence
aggttgctggggacaccggg

SEQ ID NO: 717161 - DNA, 20 bp, Artificial
  CRISPR gRNA sequence
ggaggcctgtgctcacgagt

SEQ ID NO: 717162 - DNA, 20 bp, Artificial
  CRISPR gRNA sequence
taagctcctgggagcaaggc

SEQ ID NO: 717163 - DNA, 20 bp, Artificial
  CRISPR gRNA sequence
ctagggcctcaaatgatctg

SEQ ID NO: 717164 - DNA, 20 bp, Artificial
  CRISPR gRNA sequence
tgctgacaccatgggctgaa

SEQ ID NO: 717165 - DNA, 20 bp, Artificial
  CRISPR gRNA sequence
tggggcagcctcatctgaaa

SEQ ID NO: 717166 - DNA, 20 bp, Artificial
  CRISPR gRNA sequence
caagcctgtgaggtagaatt

SEQ ID NO: 717167 - DNA, 20 bp, Artificial
  CRISPR gRNA sequence
gtgaggtagaatttaaagat

SEQ ID NO: 717168 - DNA, 20 bp, Artificial
  CRISPR gRNA sequence
tagaatttaaagattctggt

SEQ ID NO: 717169 - DNA, 20 bp, Artificial
  CRISPR gRNA sequence
aagattctggtttgggattt

SEQ ID NO: 717170 - DNA, 20 bp, Artificial
  CRISPR gRNA sequence
ctggtttgggatttaaaggt

SEQ ID NO: 717171 - DNA, 20 bp, Artificial
  CRISPR gRNA sequence
ttcccactggcgctgggcag

SEQ ID NO: 717172 - DNA, 20 bp, Artificial
  CRISPR gRNA sequence
gccctggatccagccatgcc

SEQ ID NO: 717173 - DNA, 20 bp, Artificial
  CRISPR gRNA sequence
agctacatgtgctaaaaaat

SEQ ID NO: 717174 - DNA, 20 bp, Artificial
  CRISPR gRNA sequence
acatcgtctagccagtgccc

SEQ ID NO: 717175 - DNA, 20 bp, Artificial
  CRISPR gRNA sequence
caggaaagtccattttattt

SEQ ID NO: 717176 - DNA, 20 bp, Artificial
  CRISPR gRNA sequence
tgcctcagcctcctgagtag

SEQ ID NO: 717177 - DNA, 20 bp, Artificial
  CRISPR gRNA sequence
cggctaatttttagtagaga

SEQ ID NO: 717178 - DNA, 20 bp, Artificial
  CRISPR gRNA sequence
ctcctcagcctcccaaagtg

SEQ ID NO: 717179 - DNA, 20 bp, Artificial
  CRISPR gRNA sequence
gtatgtgtgggacttcgctc

SEQ ID NO: 717180 - DNA, 20 bp, Artificial
  CRISPR gRNA sequence
gcatggtggagtgatgacac

SEQ ID NO: 717181 - DNA, 20 bp, Artificial
  CRISPR gRNA sequence
atttacctcccatctccgga

SEQ ID NO: 717182 - DNA, 20 bp, Artificial
  CRISPR gRNA sequence
gccagtgaaggctcttagcg

SEQ ID NO: 717183 - DNA, 20 bp, Artificial
  CRISPR gRNA sequence
cttggctgactggaggcaga

SEQ ID NO: 717184 - DNA, 20 bp, Artificial
  CRISPR gRNA sequence
ggtgagtccacaggggaccc

SEQ ID NO: 717185 - DNA, 20 bp, Artificial
  CRISPR gRNA sequence
aggggaccccagagattaac

SEQ ID NO: 717186 - DNA, 20 bp, Artificial
  CRISPR gRNA sequence
gattaaccagggtttggcag

SEQ ID NO: 717187 - DNA, 20 bp, Artificial
  CRISPR gRNA sequence
ccagtatatctaaaatatta

SEQ ID NO: 717188 - DNA, 20 bp, Artificial
  CRISPR gRNA sequence
taaaaaataattaattatat

SEQ ID NO: 717189 - DNA, 20 bp, Artificial
  CRISPR gRNA sequence
taattatattcttgtttata

SEQ ID NO: 717190 - DNA, 20 bp, Artificial
  CRISPR gRNA sequence
ctgcattttttttatttttt

SEQ ID NO: 717191 - DNA, 20 bp, Artificial
  CRISPR gRNA sequence
gctcactacaacctccacct

SEQ ID NO: 717192 - DNA, 20 bp, Artificial
  CRISPR gRNA sequence
tgcctcagcctcccaagtag

SEQ ID NO: 717193 - DNA, 20 bp, Artificial
  CRISPR gRNA sequence
ttttgtatttttagtagaga

SEQ ID NO: 717194 - DNA, 20 bp, Artificial
  CRISPR gRNA sequence
ggctggaacaactgaactca

SEQ ID NO: 717195 - DNA, 20 bp, Artificial
  CRISPR gRNA sequence
gatgtttttcacaaagatgc

SEQ ID NO: 717196 - DNA, 20 bp, Artificial
  CRISPR gRNA sequence
ttctgagctggaaacttttg

SEQ ID NO: 717197 - DNA, 20 bp, Artificial
  CRISPR gRNA sequence
cagtccactccagcactctc

SEQ ID NO: 717198 - DNA, 20 bp, Artificial
  CRISPR gRNA sequence
tcccccgaccctggaatttg

SEQ ID NO: 717199 - DNA, 20 bp, Artificial
  CRISPR gRNA sequence
gggcatggtctttgccctca

SEQ ID NO: 717200 - DNA, 20 bp, Artificial
  CRISPR gRNA sequence
tttgcaaaggacacagtgct

SEQ ID NO: 717201 - DNA, 20 bp, Artificial
  CRISPR gRNA sequence
ggtggagagctcagggctga

SEQ ID NO: 717202 - DNA, 20 bp, Artificial
  CRISPR gRNA sequence
gcaggtggagcccagagagt

SEQ ID NO: 717203 - DNA, 20 bp, Artificial
  CRISPR gRNA sequence
gttgggatcacatcctgaga

SEQ ID NO: 717204 - DNA, 20 bp, Artificial
  CRISPR gRNA sequence
tgagactctgattctgggaa

SEQ ID NO: 717205 - DNA, 20 bp, Artificial
  CRISPR gRNA sequence
attctgggaagatggcttag

SEQ ID NO: 717206 - DNA, 20 bp, Artificial
  CRISPR gRNA sequence
aggacaccgtggtgagtccc

SEQ ID NO: 717207 - DNA, 20 bp, Artificial
  CRISPR gRNA sequence
ttttgtatttttagtagaga

SEQ ID NO: 717208 - DNA, 20 bp, Artificial
  CRISPR gRNA sequence
tgccttggcctcccaaagtg

SEQ ID NO: 717209 - DNA, 20 bp, Artificial
  CRISPR gRNA sequence
gagagagagagagagagagg

SEQ ID NO: 717210 - DNA, 20 bp, Artificial
  CRISPR gRNA sequence
gagagagagagaggatcaga

SEQ ID NO: 717211 - DNA, 20 bp, Artificial
  CRISPR gRNA sequence
atgggggtgactgccaatcc

SEQ ID NO: 717212 - DNA, 20 bp, Artificial
  CRISPR gRNA sequence
cgataagttggaaaagaaac

SEQ ID NO: 717213 - DNA, 20 bp, Artificial
  CRISPR gRNA sequence
acagagacttgaggttccct

SEQ ID NO: 717214 - DNA, 20 bp, Artificial
  CRISPR gRNA sequence
accccctggtgaccactaaa

SEQ ID NO: 717215 - DNA, 20 bp, Artificial
  CRISPR gRNA sequence
atggtgggcacgtggtcatc

SEQ ID NO: 717216 - DNA, 20 bp, Artificial
  CRISPR gRNA sequence
ttgggaggctgaggcgggag

SEQ ID NO: 717217 - DNA, 20 bp, Artificial
  CRISPR gRNA sequence
gaggttgaggctgtagtgag

SEQ ID NO: 717218 - DNA, 20 bp, Artificial
  CRISPR gRNA sequence
gcctgggcaaaagagtgata

SEQ ID NO: 717219 - DNA, 20 bp, Artificial
  CRISPR gRNA sequence
caaaaaataggggaaactgt

SEQ ID NO: 717220 - DNA, 20 bp, Artificial
  CRISPR gRNA sequence
aacctaaaactgctctaaga

SEQ ID NO: 717221 - DNA, 20 bp, Artificial
  CRISPR gRNA sequence
gctcactgcaacctgggttc

SEQ ID NO: 717222 - DNA, 20 bp, Artificial
  CRISPR gRNA sequence
tgcctcagcctcctgagtag

SEQ ID NO: 717223 - DNA, 20 bp, Artificial
  CRISPR gRNA sequence
tttttgtatttttatagaga

SEQ ID NO: 717224 - DNA, 20 bp, Artificial
  CRISPR gRNA sequence
cgcctcggcctcccaaagtg

SEQ ID NO: 717225 - DNA, 20 bp, Artificial
  CRISPR gRNA sequence
agccactgcacccagccaga

SEQ ID NO: 717226 - DNA, 20 bp, Artificial
  CRISPR gRNA sequence
tgggcagatcacctgaggtc

SEQ ID NO: 717227 - DNA, 20 bp, Artificial
  CRISPR gRNA sequence
ggcctggagaccaagaaggg

SEQ ID NO: 717228 - DNA, 20 bp, Artificial
  CRISPR gRNA sequence
gagccccattgccctcagag

SEQ ID NO: 717229 - DNA, 20 bp, Artificial
  CRISPR gRNA sequence
ttgagaggctaagacaggag

SEQ ID NO: 717230 - DNA, 20 bp, Artificial
  CRISPR gRNA sequence
tgaacccaggttgcagtgag

SEQ ID NO: 717231 - DNA, 20 bp, Artificial
  CRISPR gRNA sequence
tcaaacaaaaaaaacaataa

SEQ ID NO: 717232 - DNA, 20 bp, Artificial
  CRISPR gRNA sequence
tcgtagcacgtgcgttactc

SEQ ID NO: 717233 - DNA, 20 bp, Artificial
  CRISPR gRNA sequence
tgatcatagaaagctatatt

SEQ ID NO: 717234 - DNA, 20 bp, Artificial
  CRISPR gRNA sequence
ggtctcaaactcctggcctc

SEQ ID NO: 717235 - DNA, 20 bp, Artificial
  CRISPR gRNA sequence
cctgaagaccttccaatggg

SEQ ID NO: 717236 - DNA, 20 bp, Artificial
  CRISPR gRNA sequence
tgcctcagccacctgagtag

SEQ ID NO: 717237 - DNA, 20 bp, Artificial
  CRISPR gRNA sequence
ttttatatttttagtagaga

SEQ ID NO: 717238 - DNA, 20 bp, Artificial
  CRISPR gRNA sequence
acctcaagtgatctgcccac

SEQ ID NO: 717239 - DNA, 20 bp, Artificial
  CRISPR gRNA sequence
cacctcggcttcccaaagtg

SEQ ID NO: 717240 - DNA, 20 bp, Artificial
  CRISPR gRNA sequence
cactgcacgctgccaatggg

SEQ ID NO: 717241 - DNA, 20 bp, Artificial
  CRISPR gRNA sequence
caagatttggaggaggaaga

SEQ ID NO: 717242 - DNA, 20 bp, Artificial
  CRISPR gRNA sequence
gtgtaggcctcggataatgt

SEQ ID NO: 717243 - DNA, 20 bp, Artificial
  CRISPR gRNA sequence
gataatgtaggtgtttgcgt

SEQ ID NO: 717244 - DNA, 20 bp, Artificial
  CRISPR gRNA sequence
tatttttgtacagctgtacg

SEQ ID NO: 717245 - DNA, 20 bp, Artificial
  CRISPR gRNA sequence
tgtacagctgtacgatgtgt

SEQ ID NO: 717246 - DNA, 20 bp, Artificial
  CRISPR gRNA sequence
agtgttattacaaaagagcc

SEQ ID NO: 717247 - DNA, 20 bp, Artificial
  CRISPR gRNA sequence
gagccaaaagtttaaaaagt

SEQ ID NO: 717248 - DNA, 20 bp, Artificial
  CRISPR gRNA sequence
taaagtttataaagtgaaaa

SEQ ID NO: 717249 - DNA, 20 bp, Artificial
  CRISPR gRNA sequence
ctcccaggttcaagcaattc

SEQ ID NO: 717250 - DNA, 20 bp, Artificial
  CRISPR gRNA sequence
ttttgtatttttagtagaga

SEQ ID NO: 717251 - DNA, 20 bp, Artificial
  CRISPR gRNA sequence
gtatttttattgcacctttt

SEQ ID NO: 717252 - DNA, 20 bp, Artificial
  CRISPR gRNA sequence
agtcacatgctgtgcagagt

SEQ ID NO: 717253 - DNA, 20 bp, Artificial
  CRISPR gRNA sequence
tgtgtaagtacactaatcta

SEQ ID NO: 717254 - DNA, 20 bp, Artificial
  CRISPR gRNA sequence
aacgacaaaattgcctaatg

SEQ ID NO: 717255 - DNA, 20 bp, Artificial
  CRISPR gRNA sequence
caggaggaacacttaagccc

SEQ ID NO: 717256 - DNA, 20 bp, Artificial
  CRISPR gRNA sequence
cggctggatcacttgaggtc

SEQ ID NO: 717257 - DNA, 20 bp, Artificial
  CRISPR gRNA sequence
gaggtagaggttgtagtgag

SEQ ID NO: 717258 - DNA, 20 bp, Artificial
  CRISPR gRNA sequence
gcagatgagaatataaacat

SEQ ID NO: 717259 - DNA, 20 bp, Artificial
  CRISPR gRNA sequence
actgtccaaaactcaaacta

SEQ ID NO: 717260 - DNA, 20 bp, Artificial
  CRISPR gRNA sequence
ttgcctttactgcaagagat

SEQ ID NO: 717261 - DNA, 20 bp, Artificial
  CRISPR gRNA sequence
gcaagagatagtagattctg

SEQ ID NO: 717262 - DNA, 20 bp, Artificial
  CRISPR gRNA sequence
tgaaatgattattaaccact

SEQ ID NO: 717263 - DNA, 20 bp, Artificial
  CRISPR gRNA sequence
aacctcctttcttaatttta

SEQ ID NO: 717264 - DNA, 20 bp, Artificial
  CRISPR gRNA sequence
tgaagatacattaatctgac

SEQ ID NO: 717265 - DNA, 20 bp, Artificial
  CRISPR gRNA sequence
ctgactgaggtttggcattc

SEQ ID NO: 717266 - DNA, 20 bp, Artificial
  CRISPR gRNA sequence
tttggcattcttctgtttca

SEQ ID NO: 717267 - DNA, 20 bp, Artificial
  CRISPR gRNA sequence
agatggagggctggggaggg

SEQ ID NO: 717268 - DNA, 20 bp, Artificial
  CRISPR gRNA sequence
ggagggctggggagggcaat

SEQ ID NO: 717269 - DNA, 20 bp, Artificial
  CRISPR gRNA sequence
tttcttccttacactctttg

SEQ ID NO: 717270 - DNA, 20 bp, Artificial
  CRISPR gRNA sequence
ttgcttgaattttaaataat

SEQ ID NO: 717271 - DNA, 20 bp, Artificial
  CRISPR gRNA sequence
aacatttatgtacctaataa

SEQ ID NO: 717272 - DNA, 20 bp, Artificial
  CRISPR gRNA sequence
atgaacaagtatactgggag

SEQ ID NO: 717273 - DNA, 20 bp, Artificial
  CRISPR gRNA sequence
ttatttaaataacacaatta

SEQ ID NO: 717274 - DNA, 20 bp, Artificial
  CRISPR gRNA sequence
acaataaaaggtcatactga

SEQ ID NO: 717275 - DNA, 20 bp, Artificial
  CRISPR gRNA sequence
actccagttctgccacttac

SEQ ID NO: 717276 - DNA, 20 bp, Artificial
  CRISPR gRNA sequence
atcctcccctagggctgtgg

SEQ ID NO: 717277 - DNA, 20 bp, Artificial
  CRISPR gRNA sequence
aatcatgatgctctccacct

SEQ ID NO: 717278 - DNA, 20 bp, Artificial
  CRISPR gRNA sequence
ccaggtagtagtcaggctca

SEQ ID NO: 717279 - DNA, 20 bp, Artificial
  CRISPR gRNA sequence
gttatagagaagagctgggc

SEQ ID NO: 717280 - DNA, 20 bp, Artificial
  CRISPR gRNA sequence
ttagaccatgaaagtctaga

SEQ ID NO: 717281 - DNA, 20 bp, Artificial
  CRISPR gRNA sequence
ataaactttcttaaaacatt

SEQ ID NO: 717282 - DNA, 20 bp, Artificial
  CRISPR gRNA sequence
acattatgagatttgcgtgt

SEQ ID NO: 717283 - DNA, 20 bp, Artificial
  CRISPR gRNA sequence
caatgtggcccagggaagcc

SEQ ID NO: 717284 - DNA, 20 bp, Artificial
  CRISPR gRNA sequence
gccactaagaccctaatcca

SEQ ID NO: 717285 - DNA, 20 bp, Artificial
  CRISPR gRNA sequence
cacccagcaatcgctgccta

SEQ ID NO: 717286 - DNA, 20 bp, Artificial
  CRISPR gRNA sequence
ttcccatcaatataattggc

SEQ ID NO: 717287 - DNA, 20 bp, Artificial
  CRISPR gRNA sequence
acgcaaatctcataatgttt

SEQ ID NO: 717288 - DNA, 20 bp, Artificial
  CRISPR gRNA sequence
cagtgagataagacccctgc

SEQ ID NO: 717289 - DNA, 20 bp, Artificial
  CRISPR gRNA sequence
gcaattggcaaatggcagcc

SEQ ID NO: 717290 - DNA, 20 bp, Artificial
  CRISPR gRNA sequence
cagtgcttccatccataaca

SEQ ID NO: 717291 - DNA, 20 bp, Artificial
  CRISPR gRNA sequence
ggggtcctcagaggagaggt

SEQ ID NO: 717292 - DNA, 20 bp, Artificial
  CRISPR gRNA sequence
gttagtctcttattatggtt

SEQ ID NO: 717293 - DNA, 20 bp, Artificial
  CRISPR gRNA sequence
gaagaagtagcaaaggttaa

SEQ ID NO: 717294 - DNA, 20 bp, Artificial
  CRISPR gRNA sequence
aagtagcaaaggttaaaaag

SEQ ID NO: 717295 - DNA, 20 bp, Artificial
  CRISPR gRNA sequence
agcaatacaaagagtgtaag

SEQ ID NO: 717296 - DNA, 20 bp, Artificial
  CRISPR gRNA sequence
cttacaaagaaggaatttta

SEQ ID NO: 717297 - DNA, 20 bp, Artificial
  CRISPR gRNA sequence
tttaattttagtcaaaagta

SEQ ID NO: 717298 - DNA, 20 bp, Artificial
  CRISPR gRNA sequence
tttagtcaaaagtatcagaa

SEQ ID NO: 717299 - DNA, 20 bp, Artificial
  CRISPR gRNA sequence
aaagaaagcgaagtgaaaca

SEQ ID NO: 717300 - DNA, 20 bp, Artificial
  CRISPR gRNA sequence
aaaaaaaaaccctctaaaat

SEQ ID NO: 717301 - DNA, 20 bp, Artificial
  CRISPR gRNA sequence
gtaagtggttaataatcatt

SEQ ID NO: 717302 - DNA, 20 bp, Artificial
  CRISPR gRNA sequence
tagtttgagttttggacagt

SEQ ID NO: 717303 - DNA, 20 bp, Artificial
  CRISPR gRNA sequence
gagtatttgtgtatctaaac

SEQ ID NO: 717304 - DNA, 20 bp, Artificial
  CRISPR gRNA sequence
ctactcaagaggctgaagca

SEQ ID NO: 717305 - DNA, 20 bp, Artificial
  CRISPR gRNA sequence
cctacacagagtcaggatca

SEQ ID NO: 717306 - DNA, 20 bp, Artificial
  CRISPR gRNA sequence
ctactcaggtggctgaggca

SEQ ID NO: 717307 - DNA, 20 bp, Artificial
  CRISPR gRNA sequence
actgcactccagcctgggtg

SEQ ID NO: 717308 - DNA, 20 bp, Artificial
  CRISPR gRNA sequence
ctgtctcaaaaaaaaaaaaa

SEQ ID NO: 717309 - DNA, 20 bp, Artificial
  CRISPR gRNA sequence
cacttagggaggccaggctg

SEQ ID NO: 717310 - DNA, 20 bp, Artificial
  CRISPR gRNA sequence
gccagctgtgtatcttcttt

SEQ ID NO: 717311 - DNA, 20 bp, Artificial
  CRISPR gRNA sequence
ctactcaggaggctgaggca

SEQ ID NO: 717312 - DNA, 20 bp, Artificial
  CRISPR gRNA sequence
taggtttacaggaaaattga

SEQ ID NO: 717313 - DNA, 20 bp, Artificial
  CRISPR gRNA sequence
gcccaccatcaccgtggcat

SEQ ID NO: 717314 - DNA, 20 bp, Artificial
  CRISPR gRNA sequence
tctcgatagtttcatctttt

SEQ ID NO: 717315 - DNA, 20 bp, Artificial
  CRISPR gRNA sequence
ctggccccaggctcaagact

SEQ ID NO: 717316 - DNA, 20 bp, Artificial
  CRISPR gRNA sequence
ctgtgtccactgtccactga

SEQ ID NO: 717317 - DNA, 20 bp, Artificial
  CRISPR gRNA sequence
acagcccccatggcagacag

SEQ ID NO: 717318 - DNA, 20 bp, Artificial
  CRISPR gRNA sequence
tctcaaaaaaaaaaaaaaaa

SEQ ID NO: 717319 - DNA, 20 bp, Artificial
  CRISPR gRNA sequence
aacgtgtctaagccatcttc

SEQ ID NO: 717320 - DNA, 20 bp, Artificial
  CRISPR gRNA sequence
acttcccaaaagtttccagc

SEQ ID NO: 717321 - DNA, 20 bp, Artificial
  CRISPR gRNA sequence
ctacttgggaggctgaggca

SEQ ID NO: 717322 - DNA, 20 bp, Artificial
  CRISPR gRNA sequence
tttcgaaaacttagtataaa

SEQ ID NO: 717323 - DNA, 20 bp, Artificial
  CRISPR gRNA sequence
taccttttaaagtgtggctc

SEQ ID NO: 717324 - DNA, 20 bp, Artificial
  CRISPR gRNA sequence
gttttttttccagctgtaaa

SEQ ID NO: 717325 - DNA, 20 bp, Artificial
  CRISPR gRNA sequence
ctactcaggaggctgaggca

SEQ ID NO: 717326 - DNA, 20 bp, Artificial
  CRISPR gRNA sequence
caaaacctttaaatcccaaa

SEQ ID NO: 717327 - DNA, 20 bp, Artificial
  CRISPR gRNA sequence
acatgggagacccacagggc

SEQ ID NO: 717328 - DNA, 20 bp, Artificial
  CRISPR gRNA sequence
aggcctcccttgccccattg

SEQ ID NO: 717329 - DNA, 20 bp, Artificial
  CRISPR gRNA sequence
ttctgccttttgactataat

SEQ ID NO: 717330 - DNA, 20 bp, Artificial
  CRISPR gRNA sequence
gccttttgactataatgaag

SEQ ID NO: 717331 - DNA, 20 bp, Artificial
  CRISPR gRNA sequence
cccagaggggtctggtgatt

SEQ ID NO: 717332 - DNA, 20 bp, Artificial
  CRISPR gRNA sequence
gtactcacagattctgtgag

SEQ ID NO: 717333 - DNA, 20 bp, Artificial
  CRISPR gRNA sequence
gtcttgagagagagagacag

SEQ ID NO: 717334 - DNA, 20 bp, Artificial
  CRISPR gRNA sequence
aaagagagagtgagagagag

SEQ ID NO: 717335 - DNA, 20 bp, Artificial
  CRISPR gRNA sequence
agagagagacagaaagaggg

SEQ ID NO: 717336 - DNA, 20 bp, Artificial
  CRISPR gRNA sequence
agggagagaaagagtgagag

SEQ ID NO: 717337 - DNA, 20 bp, Artificial
  CRISPR gRNA sequence
agagagaaagagagagacag

SEQ ID NO: 717338 - DNA, 20 bp, Artificial
  CRISPR gRNA sequence
agagagacagagagaaagag

SEQ ID NO: 717339 - DNA, 20 bp, Artificial
  CRISPR gRNA sequence
agagagagagtgagagagag

SEQ ID NO: 717340 - DNA, 20 bp, Artificial
  CRISPR gRNA sequence
agaaagagggagagagagag

SEQ ID NO: 717341 - DNA, 20 bp, Artificial
  CRISPR gRNA sequence
agggagagagagagacagaa

SEQ ID NO: 717342 - DNA, 20 bp, Artificial
  CRISPR gRNA sequence
agtgagcgagagagagagag

SEQ ID NO: 717343 - DNA, 20 bp, Artificial
  CRISPR gRNA sequence
agagagagagagacagaaag

SEQ ID NO: 717344 - DNA, 20 bp, Artificial
  CRISPR gRNA sequence
acagagatagagtgtgacag

SEQ ID NO: 717345 - DNA, 20 bp, Artificial
  CRISPR gRNA sequence
agtgtgacagagagaaagac

SEQ ID NO: 717346 - DNA, 20 bp, Artificial
  CRISPR gRNA sequence
agagaaagagagagagagag

SEQ ID NO: 717347 - DNA, 20 bp, Artificial
  CRISPR gRNA sequence
caaccaccatgtggacatat

SEQ ID NO: 717348 - DNA, 20 bp, Artificial
  CRISPR gRNA sequence
atctatctcagagaaccatg

SEQ ID NO: 717349 - DNA, 20 bp, Artificial
  CRISPR gRNA sequence
cttgcatgtaaatgcgacat

SEQ ID NO: 717350 - DNA, 20 bp, Artificial
  CRISPR gRNA sequence
tgcctgccttctttcaccct

SEQ ID NO: 717351 - DNA, 20 bp, Artificial
  CRISPR gRNA sequence
ctactcaggaggttgaggca

SEQ ID NO: 717352 - DNA, 20 bp, Artificial
  CRISPR gRNA sequence
agggcgaaactctgcctaaa

SEQ ID NO: 717353 - DNA, 20 bp, Artificial
  CRISPR gRNA sequence
caggacatactaacacagca

SEQ ID NO: 717354 - DNA, 20 bp, Artificial
  CRISPR gRNA sequence
tgtgtctgaatgtctgcact

SEQ ID NO: 717355 - DNA, 20 bp, Artificial
  CRISPR gRNA sequence
tatgaatgagcaaagatttg

SEQ ID NO: 717356 - DNA, 20 bp, Artificial
  CRISPR gRNA sequence
agaaaaaccagccctacaaa

SEQ ID NO: 717357 - DNA, 20 bp, Artificial
  CRISPR gRNA sequence
gagaataaaaagatacgaaa

SEQ ID NO: 717358 - DNA, 20 bp, Artificial
  CRISPR gRNA sequence
gcaacattaaattcgtgtct

SEQ ID NO: 717359 - DNA, 20 bp, Artificial
  CRISPR gRNA sequence
gttacatccataaggtgggc

SEQ ID NO: 717360 - DNA, 20 bp, Artificial
  CRISPR gRNA sequence
aacaatatgggatcagaggg

SEQ ID NO: 717361 - DNA, 20 bp, Artificial
  CRISPR gRNA sequence
agagggcaagaaaaggcttt

SEQ ID NO: 717362 - DNA, 20 bp, Artificial
  CRISPR gRNA sequence
tcattgtgctggtcacatag

SEQ ID NO: 717363 - DNA, 20 bp, Artificial
  CRISPR gRNA sequence
gcacagggccgaagctagaa

SEQ ID NO: 717364 - DNA, 20 bp, Artificial
  CRISPR gRNA sequence
cctccttcttagttctgaac

SEQ ID NO: 717365 - DNA, 20 bp, Artificial
  CRISPR gRNA sequence
cagctaagtgagggggcaaa

SEQ ID NO: 717366 - DNA, 20 bp, Artificial
  CRISPR gRNA sequence
cagagcaaggaagggaagtc

SEQ ID NO: 717367 - DNA, 20 bp, Artificial
  CRISPR gRNA sequence
agtgttcccaggaatagaag

SEQ ID NO: 717368 - DNA, 20 bp, Artificial
  CRISPR gRNA sequence
gcacactgtccttttatcaa

SEQ ID NO: 717369 - DNA, 20 bp, Artificial
  CRISPR gRNA sequence
tgtccttttatcaacaagaa

SEQ ID NO: 717370 - DNA, 20 bp, Artificial
  CRISPR gRNA sequence
gcaattgaaaactcccggga

SEQ ID NO: 717371 - DNA, 20 bp, Artificial
  CRISPR gRNA sequence
ccgggaaaagaaaaagatga

SEQ ID NO: 717372 - DNA, 20 bp, Artificial
  CRISPR gRNA sequence
cgattgctggatgtacaaaa

SEQ ID NO: 717373 - DNA, 20 bp, Artificial
  CRISPR gRNA sequence
ttcctcagaaccctacaatg

SEQ ID NO: 717374 - DNA, 20 bp, Artificial
  CRISPR gRNA sequence
gtgggccaaattatcctgcc

SEQ ID NO: 717375 - DNA, 20 bp, Artificial
  CRISPR gRNA sequence
cgttcacacagaggcacgca

SEQ ID NO: 717376 - DNA, 20 bp, Artificial
  CRISPR gRNA sequence
caacagaacgccatttggca

SEQ ID NO: 717377 - DNA, 20 bp, Artificial
  CRISPR gRNA sequence
tagggaaccttctggaggga

SEQ ID NO: 717378 - DNA, 20 bp, Artificial
  CRISPR gRNA sequence
ctactcaggaggctgaggca

SEQ ID NO: 717379 - DNA, 20 bp, Artificial
  CRISPR gRNA sequence
tccttaataaagttgattta

SEQ ID NO: 717380 - DNA, 20 bp, Artificial
  CRISPR gRNA sequence
ccggactgcaaccccacccc

SEQ ID NO: 717381 - DNA, 20 bp, Artificial
  CRISPR gRNA sequence
gctctggttgcgcagtctcc

SEQ ID NO: 717382 - DNA, 20 bp, Artificial
  CRISPR gRNA sequence
tcgtggcttataattgctac

SEQ ID NO: 717383 - DNA, 20 bp, Artificial
  CRISPR gRNA sequence
ctactcaggaggctgaggca

SEQ ID NO: 717384 - DNA, 20 bp, Artificial
  CRISPR gRNA sequence
gctgcactccagcctgagca

SEQ ID NO: 717385 - DNA, 20 bp, Artificial
  CRISPR gRNA sequence
ctccagcctgagcagcagaa

SEQ ID NO: 717386 - DNA, 20 bp, Artificial
  CRISPR gRNA sequence
atgggccccatcccagacct

SEQ ID NO: 717387 - DNA, 20 bp, Artificial
  CRISPR gRNA sequence
cccatcccagacctagagaa

SEQ ID NO: 717388 - DNA, 20 bp, Artificial
  CRISPR gRNA sequence
gggtgaaaactcatgcgtgt

SEQ ID NO: 717389 - DNA, 20 bp, Artificial
  CRISPR gRNA sequence
tcatccggaaaatgcagatg

SEQ ID NO: 717390 - DNA, 20 bp, Artificial
  CRISPR gRNA sequence
ttcttgacatttttctagta

SEQ ID NO: 717391 - DNA, 20 bp, Artificial
  CRISPR gRNA sequence
gtgagagcagttttgttaca

SEQ ID NO: 717392 - DNA, 20 bp, Artificial
  CRISPR gRNA sequence
agttttgttacagaagaaaa

SEQ ID NO: 717393 - DNA, 20 bp, Artificial
  CRISPR gRNA sequence
ttgttacagaagaaaaaaag

SEQ ID NO: 717394 - DNA, 20 bp, Artificial
  CRISPR gRNA sequence
tacagaagaaaaaaagaaag

SEQ ID NO: 717395 - DNA, 20 bp, Artificial
  CRISPR gRNA sequence
gaagaaaaaaagaaagaaag

SEQ ID NO: 717396 - DNA, 20 bp, Artificial
  CRISPR gRNA sequence
ggttccgaggctcaagatgg

SEQ ID NO: 717397 - DNA, 20 bp, Artificial
  CRISPR gRNA sequence
caagctcacagagcaccggg

SEQ ID NO: 717398 - DNA, 20 bp, Artificial
  CRISPR gRNA sequence
ttccagggagatttaggttg

SEQ ID NO: 717399 - DNA, 20 bp, Artificial
  CRISPR gRNA sequence
tttgaaacagtttcaaactt

SEQ ID NO: 717400 - DNA, 20 bp, Artificial
  CRISPR gRNA sequence
tatagaaatggtataagtat

SEQ ID NO: 717401 - DNA, 20 bp, Artificial
  CRISPR gRNA sequence
acacgatgtggtaaggatcg

SEQ ID NO: 717402 - DNA, 20 bp, Artificial
  CRISPR gRNA sequence
gaggggaggggactaaaagt

SEQ ID NO: 717403 - DNA, 20 bp, Artificial
  CRISPR gRNA sequence
ccaacaaataagactagcag

SEQ ID NO: 717404 - DNA, 20 bp, Artificial
  CRISPR gRNA sequence
ctactcgggaggctgaggca

SEQ ID NO: 717405 - DNA, 20 bp, Artificial
  CRISPR gRNA sequence
ttaaaaatagttttagatgt

SEQ ID NO: 717406 - DNA, 20 bp, Artificial
  CRISPR gRNA sequence
ttttgttgccagatggctct

SEQ ID NO: 717407 - DNA, 20 bp, Artificial
  CRISPR gRNA sequence
agtttcactgacgtcattga

SEQ ID NO: 717408 - DNA, 20 bp, Artificial
  CRISPR gRNA sequence
ctactcgggaggctgaggca

SEQ ID NO: 717409 - DNA, 20 bp, Artificial
  CRISPR gRNA sequence
tcggtaatcccagctacttg

SEQ ID NO: 717410 - DNA, 20 bp, Artificial
  CRISPR gRNA sequence
agtgagactctgtctcaaaa

SEQ ID NO: 717411 - DNA, 20 bp, Artificial
  CRISPR gRNA sequence
agaagatagaggttgtgcgt

SEQ ID NO: 717412 - DNA, 20 bp, Artificial
  CRISPR gRNA sequence
cacctgggtgctttcaggca

SEQ ID NO: 717413 - DNA, 20 bp, Artificial
  CRISPR gRNA sequence
ggtgctttcaggcacaagaa

SEQ ID NO: 717414 - DNA, 20 bp, Artificial
  CRISPR gRNA sequence
tgggttttgcctggtattcc

SEQ ID NO: 717415 - DNA, 20 bp, Artificial
  CRISPR gRNA sequence
ctattcgggaggctgaggca

SEQ ID NO: 717416 - DNA, 20 bp, Artificial
  CRISPR gRNA sequence
acaagtggctgttacaatac

SEQ ID NO: 717417 - DNA, 20 bp, Artificial
  CRISPR gRNA sequence
ctactcaggaggctgaggca

SEQ ID NO: 717418 - DNA, 20 bp, Artificial
  CRISPR gRNA sequence
tgtggatgttggggttgaga

SEQ ID NO: 717419 - DNA, 20 bp, Artificial
  CRISPR gRNA sequence
gtctggagtgacaccacact

SEQ ID NO: 717420 - DNA, 20 bp, Artificial
  CRISPR gRNA sequence
ggtgatgactcttagcgagt

SEQ ID NO: 717421 - DNA, 20 bp, Artificial
  CRISPR gRNA sequence
aaagctcctgttttgggaaa

SEQ ID NO: 717422 - DNA, 20 bp, Artificial
  CRISPR gRNA sequence
aagatacgccctctgtgcct

SEQ ID NO: 717423 - DNA, 20 bp, Artificial
  CRISPR gRNA sequence
ttttgttttttttttagcat

SEQ ID NO: 717424 - DNA, 20 bp, Artificial
  CRISPR gRNA sequence
gaactaacagtagtctgttt

SEQ ID NO: 717425 - DNA, 20 bp, Artificial
  CRISPR gRNA sequence
ttaaaagcaacagacttcac

SEQ ID NO: 717426 - DNA, 20 bp, Artificial
  CRISPR gRNA sequence
agctcatggcagcttttaaa

SEQ ID NO: 717427 - DNA, 20 bp, Artificial
  CRISPR gRNA sequence
aaataccatcaaaggcttct

SEQ ID NO: 717428 - DNA, 20 bp, Artificial
  CRISPR gRNA sequence
tttcctgggggtgttcaaaa

SEQ ID NO: 717429 - DNA, 20 bp, Artificial
  CRISPR gRNA sequence
gaggggtataactgcattac

SEQ ID NO: 717430 - DNA, 20 bp, Artificial
  CRISPR gRNA sequence
ctgcaggcacacagatagga

SEQ ID NO: 717431 - DNA, 20 bp, Artificial
  CRISPR gRNA sequence
acccatccgcagagatgtgc

SEQ ID NO: 717432 - DNA, 20 bp, Artificial
  CRISPR gRNA sequence
cacccatccttttgccttgc

SEQ ID NO: 717433 - DNA, 20 bp, Artificial
  CRISPR gRNA sequence
ccaggatcaagtcactcatc

SEQ ID NO: 717434 - DNA, 20 bp, Artificial
  CRISPR gRNA sequence
cccaaaacatctgagcggtt

SEQ ID NO: 717435 - DNA, 20 bp, Artificial
  CRISPR gRNA sequence
tcgacttcccttttgactct

SEQ ID NO: 717436 - DNA, 20 bp, Artificial
  CRISPR gRNA sequence
gaagaagaggacagggtggg

SEQ ID NO: 717437 - DNA, 20 bp, Artificial
  CRISPR gRNA sequence
cgtgggtaaccagagcacga

SEQ ID NO: 717438 - DNA, 20 bp, Artificial
  CRISPR gRNA sequence
tcaagattcccatttacagg

SEQ ID NO: 717439 - DNA, 20 bp, Artificial
  CRISPR gRNA sequence
ccaaggtcgccacgtagtta

SEQ ID NO: 717440 - DNA, 20 bp, Artificial
  CRISPR gRNA sequence
cagccagcctgtcacatcct

SEQ ID NO: 717441 - DNA, 20 bp, Artificial
  CRISPR gRNA sequence
tctgcgctggactctggagg

SEQ ID NO: 717442 - DNA, 20 bp, Artificial
  CRISPR gRNA sequence
tctggccaccactgtctgcc

SEQ ID NO: 717443 - DNA, 20 bp, Artificial
  CRISPR gRNA sequence
aagcagggtccccaggatat

SEQ ID NO: 717444 - DNA, 20 bp, Artificial
  CRISPR gRNA sequence
gtcagccttgagtgctggaa

SEQ ID NO: 717445 - DNA, 20 bp, Artificial
  CRISPR gRNA sequence
tctccccaactgtaaaatgg

SEQ ID NO: 717446 - DNA, 20 bp, Artificial
  CRISPR gRNA sequence
taccctcgctgtccctactt

SEQ ID NO: 717447 - DNA, 20 bp, Artificial
  CRISPR gRNA sequence
acagaaacttcaattggggt

SEQ ID NO: 717448 - DNA, 20 bp, Artificial
  CRISPR gRNA sequence
gcttccagatcactgctgag

SEQ ID NO: 717449 - DNA, 20 bp, Artificial
  CRISPR gRNA sequence
ccctgccaaatccccctctc

SEQ ID NO: 717450 - DNA, 20 bp, Artificial
  CRISPR gRNA sequence
ccccctctctgagaaacacc

SEQ ID NO: 717451 - DNA, 20 bp, Artificial
  CRISPR gRNA sequence
ttatattgaaaaatgaaagg

SEQ ID NO: 717452 - DNA, 20 bp, Artificial
  CRISPR gRNA sequence
atgtatgaatgcttgaatta

SEQ ID NO: 717453 - DNA, 20 bp, Artificial
  CRISPR gRNA sequence
gatgagattcatggaagagt

SEQ ID NO: 717454 - DNA, 20 bp, Artificial
  CRISPR gRNA sequence
accttggctcactggccatc

SEQ ID NO: 717455 - DNA, 20 bp, Artificial
  CRISPR gRNA sequence
ggctaatttttgtattttta

SEQ ID NO: 717456 - DNA, 20 bp, Artificial
  CRISPR gRNA sequence
caagtcactgggggtggcca

SEQ ID NO: 717457 - DNA, 20 bp, Artificial
  CRISPR gRNA sequence
caccctcaggaaataacccg

SEQ ID NO: 717458 - DNA, 20 bp, Artificial
  CRISPR gRNA sequence
gccatcagggaaactggtct

SEQ ID NO: 717459 - DNA, 20 bp, Artificial
  CRISPR gRNA sequence
tggtcttgagaaacaagatc

SEQ ID NO: 717460 - DNA, 20 bp, Artificial
  CRISPR gRNA sequence
ctactcgggaggctgaggca

SEQ ID NO: 717461 - DNA, 20 bp, Artificial
  CRISPR gRNA sequence
agacctggtctctacaaaaa

SEQ ID NO: 717462 - DNA, 20 bp, Artificial
  CRISPR gRNA sequence
aacttaaaaatgaaggccac

SEQ ID NO: 717463 - DNA, 20 bp, Artificial
  CRISPR gRNA sequence
caacctccacctcccaggtt

SEQ ID NO: 717464 - DNA, 20 bp, Artificial
  CRISPR gRNA sequence
agccactacacctggcctac

SEQ ID NO: 717465 - DNA, 20 bp, Artificial
  CRISPR gRNA sequence
caagttaagctgggaacatc

SEQ ID NO: 717466 - DNA, 20 bp, Artificial
  CRISPR gRNA sequence
acagatataaatatgtaagt

SEQ ID NO: 717467 - DNA, 20 bp, Artificial
  CRISPR gRNA sequence
ccacttgggaggctgaagca

SEQ ID NO: 717468 - DNA, 20 bp, Artificial
  CRISPR gRNA sequence
aaaaaaataaacaaataaat

SEQ ID NO: 717469 - DNA, 20 bp, Artificial
  CRISPR gRNA sequence
agagaaaatgaaggtctgct

SEQ ID NO: 717470 - DNA, 20 bp, Artificial
  CRISPR gRNA sequence
gcatgacctgaatccactcg

SEQ ID NO: 717471 - DNA, 20 bp, Artificial
  CRISPR gRNA sequence
tgcgctcttcccagtaagtg

SEQ ID NO: 717472 - DNA, 20 bp, Artificial
  CRISPR gRNA sequence
gatccggacagaaggagact

SEQ ID NO: 717473 - DNA, 20 bp, Artificial
  CRISPR gRNA sequence
aggacattattgggacaaat

SEQ ID NO: 717474 - DNA, 20 bp, Artificial
  CRISPR gRNA sequence
aaagaaacttcaacagggcc

SEQ ID NO: 717475 - DNA, 20 bp, Artificial
  CRISPR gRNA sequence
gaaactgtttcaaaacaaaa

SEQ ID NO: 717476 - DNA, 20 bp, Artificial
  CRISPR gRNA sequence
acctaaatctccctggaata

SEQ ID NO: 717477 - DNA, 20 bp, Artificial
  CRISPR gRNA sequence
ctcataaaaatgaaggatta

SEQ ID NO: 717478 - DNA, 20 bp, Artificial
  CRISPR gRNA sequence
ctactcaggaggctgaggca

SEQ ID NO: 717479 - DNA, 20 bp, Artificial
  CRISPR gRNA sequence
tctcaaaaaaaaaaaaaaaa

SEQ ID NO: 717480 - DNA, 20 bp, Artificial
  CRISPR gRNA sequence
aactgctctcacagaggttt

SEQ ID NO: 717481 - DNA, 20 bp, Artificial
  CRISPR gRNA sequence
cggcaatggaaattctaata

SEQ ID NO: 717482 - DNA, 20 bp, Artificial
  CRISPR gRNA sequence
ttctaatactagaaaaatgt

SEQ ID NO: 717483 - DNA, 20 bp, Artificial
  CRISPR gRNA sequence
atgggagcccaccttgcaaa

SEQ ID NO: 717484 - DNA, 20 bp, Artificial
  CRISPR gRNA sequence
aagagggggagagaggggaa

SEQ ID NO: 717485 - DNA, 20 bp, Artificial
  CRISPR gRNA sequence
agaaagagaaggagggagag

SEQ ID NO: 717486 - DNA, 20 bp, Artificial
  CRISPR gRNA sequence
gggagagggagaaagggagg

SEQ ID NO: 717487 - DNA, 20 bp, Artificial
  CRISPR gRNA sequence
cattgcatccctacagatgt

SEQ ID NO: 717488 - DNA, 20 bp, Artificial
  CRISPR gRNA sequence
ggcaaactgtgtctagagag

SEQ ID NO: 717489 - DNA, 20 bp, Artificial
  CRISPR gRNA sequence
tgccagacgggaccgcactt

SEQ ID NO: 717490 - DNA, 20 bp, Artificial
  CRISPR gRNA sequence
gtgaaaaaaattcctgccta

SEQ ID NO: 717491 - DNA, 20 bp, Artificial
  CRISPR gRNA sequence
aattcctgcctacaagaatt

SEQ ID NO: 717492 - DNA, 20 bp, Artificial
  CRISPR gRNA sequence
ctactcgggaggctgagaca

SEQ ID NO: 717493 - DNA, 20 bp, Artificial
  CRISPR gRNA sequence
acagagtgagactgtttcaa

SEQ ID NO: 717494 - DNA, 20 bp, Artificial
  CRISPR gRNA sequence
gtgagactgtttcaaaaaga

SEQ ID NO: 717495 - DNA, 20 bp, Artificial
  CRISPR gRNA sequence
cacagcaccaactcaagaag

SEQ ID NO: 717496 - DNA, 20 bp, Artificial
  CRISPR gRNA sequence
ctactcaggaggctgaggca

SEQ ID NO: 717497 - DNA, 20 bp, Artificial
  CRISPR gRNA sequence
tgcactccagcctgggcgac

SEQ ID NO: 717498 - DNA, 20 bp, Artificial
  CRISPR gRNA sequence
cgctagaccttttgctttta

SEQ ID NO: 717499 - DNA, 20 bp, Artificial
  CRISPR gRNA sequence
agctaatttttgtattttta

SEQ ID NO: 717500 - DNA, 20 bp, Artificial
  CRISPR gRNA sequence
cctaaggcaacatttatata

SEQ ID NO: 717501 - DNA, 20 bp, Artificial
  CRISPR gRNA sequence
tttaataagtaaaaataaaa

SEQ ID NO: 717502 - DNA, 20 bp, Artificial
  CRISPR gRNA sequence
tatagaggagtgtatctgtt

SEQ ID NO: 717503 - DNA, 20 bp, Artificial
  CRISPR gRNA sequence
tgttccagaatttcatgtcg

SEQ ID NO: 717504 - DNA, 20 bp, Artificial
  CRISPR gRNA sequence
ggtaatggcctactggaaga

SEQ ID NO: 717505 - DNA, 20 bp, Artificial
  CRISPR gRNA sequence
acccagtccttgggccattt

SEQ ID NO: 717506 - DNA, 20 bp, Artificial
  CRISPR gRNA sequence
cttcctaggagaggatatag

SEQ ID NO: 717507 - DNA, 20 bp, Artificial
  CRISPR gRNA sequence
catccacccaaagacttgta

SEQ ID NO: 717508 - DNA, 20 bp, Artificial
  CRISPR gRNA sequence
catacatgttaaaaaaaaaa

SEQ ID NO: 717509 - DNA, 20 bp, Artificial
  CRISPR gRNA sequence
atgcttctggtcaggtgcac

SEQ ID NO: 717510 - DNA, 20 bp, Artificial
  CRISPR gRNA sequence
aggccaggcagcaggagcaa

SEQ ID NO: 717511 - DNA, 20 bp, Artificial
  CRISPR gRNA sequence
agtgagactctgtctcaaaa

SEQ ID NO: 717512 - DNA, 20 bp, Artificial
  CRISPR gRNA sequence
gactctgtctcaaaaaaaga

SEQ ID NO: 717513 - DNA, 20 bp, Artificial
  CRISPR gRNA sequence
aactgcatgctccctacaga

SEQ ID NO: 717514 - DNA, 20 bp, Artificial
  CRISPR gRNA sequence
tatcaaagcttcatgtgtgg

SEQ ID NO: 717515 - DNA, 20 bp, Artificial
  CRISPR gRNA sequence
ctacttgggaggctgaggca

SEQ ID NO: 717516 - DNA, 20 bp, Artificial
  CRISPR gRNA sequence
agagcgagactttgtctcaa

SEQ ID NO: 717517 - DNA, 20 bp, Artificial
  CRISPR gRNA sequence
actactcagccatcataagg

SEQ ID NO: 717518 - DNA, 20 bp, Artificial
  CRISPR gRNA sequence
ttaagtgcagacattcagac

SEQ ID NO: 717519 - DNA, 20 bp, Artificial
  CRISPR gRNA sequence
aggtataggtaggtggacca

SEQ ID NO: 717520 - DNA, 20 bp, Artificial
  CRISPR gRNA sequence
ctactcgggaggctgaggca

SEQ ID NO: 717521 - DNA, 20 bp, Artificial
  CRISPR gRNA sequence
tggtaaagccaaccgtcctg

SEQ ID NO: 717522 - DNA, 20 bp, Artificial
  CRISPR gRNA sequence
ccgtcctgttagaaatctct

SEQ ID NO: 717523 - DNA, 20 bp, Artificial
  CRISPR gRNA sequence
gagaccagcctgaccaacat

SEQ ID NO: 717524 - DNA, 20 bp, Artificial
  CRISPR gRNA sequence
ctactcagaaggctgaggca

SEQ ID NO: 717525 - DNA, 20 bp, Artificial
  CRISPR gRNA sequence
taccagcccaataatttcag

SEQ ID NO: 717526 - DNA, 20 bp, Artificial
  CRISPR gRNA sequence
gaagaatttttttttaatca

SEQ ID NO: 717527 - DNA, 20 bp, Artificial
  CRISPR gRNA sequence
gggacacagatgaggatcac

SEQ ID NO: 717528 - DNA, 20 bp, Artificial
  CRISPR gRNA sequence
gttgtccaagggtcatccaa

SEQ ID NO: 717529 - DNA, 20 bp, Artificial
  CRISPR gRNA sequence
atctctccctaaagctgtta

SEQ ID NO: 717530 - DNA, 20 bp, Artificial
  CRISPR gRNA sequence
ctactcaggaggctgaggca

SEQ ID NO: 717531 - DNA, 20 bp, Artificial
  CRISPR gRNA sequence
atttgtggttgcctcaacaa

SEQ ID NO: 717532 - DNA, 20 bp, Artificial
  CRISPR gRNA sequence
tctctactaaaaatacaaaa

SEQ ID NO: 717533 - DNA, 20 bp, Artificial
  CRISPR gRNA sequence
aaatacaaaaaaagaaaaaa

SEQ ID NO: 717534 - DNA, 20 bp, Artificial
  CRISPR gRNA sequence
ccctgtctgaattctgactc

SEQ ID NO: 717535 - DNA, 20 bp, Artificial
  CRISPR gRNA sequence
ctcacagaatctgtgagtac

SEQ ID NO: 717536 - DNA, 20 bp, Artificial
  CRISPR gRNA sequence
ttgttttcacaattaagttt

SEQ ID NO: 717537 - DNA, 20 bp, Artificial
  CRISPR gRNA sequence
cctgtctgggaaaaaaaaaa

SEQ ID NO: 717538 - DNA, 20 bp, Artificial
  CRISPR gRNA sequence
cacactagcgtaactcctgt

SEQ ID NO: 717539 - DNA, 20 bp, Artificial
  CRISPR gRNA sequence
aaccccgtctctactaaaaa

SEQ ID NO: 717540 - DNA, 20 bp, Artificial
  CRISPR gRNA sequence
ctactcgggaggctgaggca

SEQ ID NO: 717541 - DNA, 20 bp, Artificial
  CRISPR gRNA sequence
acaaacaaaagacatcatag

SEQ ID NO: 717542 - DNA, 20 bp, Artificial
  CRISPR gRNA sequence
ttttttacaaaaccaaccca

SEQ ID NO: 717543 - DNA, 20 bp, Artificial
  CRISPR gRNA sequence
ttcttcattatagtcaaaag

SEQ ID NO: 717544 - DNA, 20 bp, Artificial
  CRISPR gRNA sequence
ctactcaggaggctgaggca

SEQ ID NO: 717545 - DNA, 20 bp, Artificial
  CRISPR gRNA sequence
gcgaaactccgtctcaaaaa

SEQ ID NO: 717546 - DNA, 20 bp, Artificial
  CRISPR gRNA sequence
ctccgtctcaaaaaaaagaa

SEQ ID NO: 717547 - DNA, 20 bp, Artificial
  CRISPR gRNA sequence
caggggggacagcagtgcct

SEQ ID NO: 717548 - DNA, 20 bp, Artificial
  CRISPR gRNA sequence
atgtgacccaagcctgtgag

SEQ ID NO: 717549 - DNA, 20 bp, Artificial
  CRISPR gRNA sequence
ggttttggatattaaaaatg

SEQ ID NO: 717550 - DNA, 20 bp, Artificial
  CRISPR gRNA sequence
catgcaatccaaggagtcct

SEQ ID NO: 717551 - DNA, 20 bp, Artificial
  CRISPR gRNA sequence
ctggacagaagcagagtgga

SEQ ID NO: 717552 - DNA, 20 bp, Artificial
  CRISPR gRNA sequence
ctactcaggaggctgaggca

SEQ ID NO: 717553 - DNA, 20 bp, Artificial
  CRISPR gRNA sequence
ctgtctgtcttatggagacg

SEQ ID NO: 717554 - DNA, 20 bp, Artificial
  CRISPR gRNA sequence
tggggcttggctgactggag

SEQ ID NO: 717555 - DNA, 20 bp, Artificial
  CRISPR gRNA sequence
agccacactttaaaaggtaa

SEQ ID NO: 717556 - DNA, 20 bp, Artificial
  CRISPR gRNA sequence
ggtgctgagagctgaagctg

SEQ ID NO: 717557 - DNA, 20 bp, Artificial
  CRISPR gRNA sequence
agaagtagaagtcagagagg

SEQ ID NO: 717558 - DNA, 20 bp, Artificial
  CRISPR gRNA sequence
aggtcacacgataagttgga

SEQ ID NO: 717559 - DNA, 20 bp, Artificial
  CRISPR gRNA sequence
caatcatccctgccggacag

SEQ ID NO: 717560 - DNA, 20 bp, Artificial
  CRISPR gRNA sequence
tcatccgtttgtctaaagcc

SEQ ID NO: 717561 - DNA, 20 bp, Artificial
  CRISPR gRNA sequence
ctgtaaacctaaaactgctc

SEQ ID NO: 717562 - DNA, 20 bp, Artificial
  CRISPR gRNA sequence
gcgtgagccactgcacccag

SEQ ID NO: 717563 - DNA, 20 bp, Artificial
  CRISPR gRNA sequence
gagataccacttcacaacca

SEQ ID NO: 717564 - DNA, 20 bp, Artificial
  CRISPR gRNA sequence
gaaggggcaagcttggcaga

SEQ ID NO: 717565 - DNA, 20 bp, Artificial
  CRISPR gRNA sequence
agagtgaaggagaccacagc

SEQ ID NO: 717566 - DNA, 20 bp, Artificial
  CRISPR gRNA sequence
gagcactaacactcaaggag

SEQ ID NO: 717567 - DNA, 20 bp, Artificial
  CRISPR gRNA sequence
agggaaaacagaacaaaaca

SEQ ID NO: 717568 - DNA, 20 bp, Artificial
  CRISPR gRNA sequence
ctacttgagaggctaagaca

SEQ ID NO: 717569 - DNA, 20 bp, Artificial
  CRISPR gRNA sequence
tgtaatacttgataatgatc

SEQ ID NO: 717570 - DNA, 20 bp, Artificial
  CRISPR gRNA sequence
taaaataataaaattttaaa

SEQ ID NO: 717571 - DNA, 20 bp, Artificial
  CRISPR gRNA sequence
agtgtaatgaataaggctat

SEQ ID NO: 717572 - DNA, 20 bp, Artificial
  CRISPR gRNA sequence
aagttgtttaatttattatt

SEQ ID NO: 717573 - DNA, 20 bp, Artificial
  CRISPR gRNA sequence
tgtttaatttattattgaag

SEQ ID NO: 717574 - DNA, 20 bp, Artificial
  CRISPR gRNA sequence
attgcctaatgacacgtttg

SEQ ID NO: 717575 - DNA, 20 bp, Artificial
  CRISPR gRNA sequence
cctgtcttaaaatttaaaga

SEQ ID NO: 717576 - DNA, 20 bp, Artificial
  CRISPR gRNA sequence
tctcagctactcaggaggca

SEQ ID NO: 717577 - DNA, 20 bp, Artificial
  CRISPR gRNA sequence
agagtcagactctgtctcaa

SEQ ID NO: 717578 - DNA, 20 bp, Artificial
  CRISPR gRNA sequence
ctctgtctcaaaaagaaaaa

SEQ ID NO: 717579 - DNA, 20 bp, Artificial
  CRISPR gRNA sequence
atcctcaaacatgaaataac

SEQ ID NO: 717580 - DNA, 20 bp, Artificial
  CRISPR gRNA sequence
aagggacttatggttgcaga

SEQ ID NO: 717581 - DNA, 20 bp, Artificial
  CRISPR gRNA sequence
ataaaatgcagtcattactt

SEQ ID NO: 717582 - DNA, 20 bp, Artificial
  CRISPR gRNA sequence
caccagataaatgctaataa

SEQ ID NO: 717583 - DNA, 20 bp, Artificial
  CRISPR gRNA sequence
taaatgctaataaaaagaaa

SEQ ID NO: 717584 - DNA, 20 bp, Artificial
  CRISPR gRNA sequence
ttgacatatatgaagcaaaa

SEQ ID NO: 717585 - DNA, 20 bp, Artificial
  CRISPR gRNA sequence
ataagattttaacacatctc

SEQ ID NO: 717586 - DNA, 20 bp, Artificial
  CRISPR gRNA sequence
gagaactttatacgcaacaa

SEQ ID NO: 717587 - DNA, 20 bp, Artificial
  CRISPR gRNA sequence
cattgtaaagtaaggataag

SEQ ID NO: 717588 - DNA, 20 bp, Artificial
  CRISPR gRNA sequence
tgtcgggaacagccctggga

SEQ ID NO: 717589 - DNA, 20 bp, Artificial
  CRISPR gRNA sequence
acatgacccaagcaggccaa

SEQ ID NO: 717590 - DNA, 20 bp, Artificial
  CRISPR gRNA sequence
taagggcctttccaaagtta

SEQ ID NO: 717591 - DNA, 20 bp, Artificial
  CRISPR gRNA sequence
taagatcacaggacttccag

SEQ ID NO: 717592 - DNA, 20 bp, Artificial
  CRISPR gRNA sequence
aatacaaagagtgtaaggaa

SEQ ID NO: 717593 - DNA, 20 bp, Artificial
  CRISPR gRNA sequence
actgcaattcctttaaaaaa

SEQ ID NO: 717594 - DNA, 20 bp, Artificial
  CRISPR gRNA sequence
caaaaaaaaaaaaaaaaaaa

SEQ ID NO: 717595 - DNA, 20 bp, Artificial
  CRISPR gRNA sequence
tcttggcgggaggatgaggg

SEQ ID NO: 717596 - DNA, 20 bp, Artificial
  CRISPR gRNA sequence
gaaacttctgcatctttgtg

SEQ ID NO: 717597 - DNA, 20 bp, Artificial
  CRISPR gRNA sequence
tacaatatgcactggatttc

SEQ ID NO: 717598 - DNA, 20 bp, Artificial
  CRISPR gRNA sequence
tttcttacatttttaatatc

SEQ ID NO: 717599 - DNA, 20 bp, Artificial
  CRISPR gRNA sequence
acatttttaatatccaaaac

SEQ ID NO: 717600 - DNA, 20 bp, Artificial
  CRISPR gRNA sequence
tgggagacccacagggctta

SEQ ID NO: 717601 - DNA, 20 bp, Artificial
  CRISPR gRNA sequence
ggctgcatagcaaattttct

SEQ ID NO: 717602 - DNA, 20 bp, Artificial
  CRISPR gRNA sequence
ttttcttaaaacttaattgt

SEQ ID NO: 717603 - DNA, 20 bp, Artificial
  CRISPR gRNA sequence
tcacttgagaccaagggaag

SEQ ID NO: 717604 - DNA, 20 bp, Artificial
  CRISPR gRNA sequence
tttaccagtgtgcaggaaac

SEQ ID NO: 717605 - DNA, 20 bp, Artificial
  CRISPR gRNA sequence
taacaaatctccaggtggtt

SEQ ID NO: 717606 - DNA, 20 bp, Artificial
  CRISPR gRNA sequence
aacagatggaagagtggtga

SEQ ID NO: 717607 - DNA, 20 bp, Artificial
  CRISPR gRNA sequence
gaccagcctgaccaacatgg

SEQ ID NO: 717608 - DNA, 20 bp, Artificial
  CRISPR gRNA sequence
aactctgcctaaaaaagaaa

SEQ ID NO: 717609 - DNA, 20 bp, Artificial
  CRISPR gRNA sequence
aatgagcaaagatttgtaag

SEQ ID NO: 717610 - DNA, 20 bp, Artificial
  CRISPR gRNA sequence
agtttagggctattatgaat

SEQ ID NO: 717611 - DNA, 20 bp, Artificial
  CRISPR gRNA sequence
atcaagtttgaaggcagcat

SEQ ID NO: 717612 - DNA, 20 bp, Artificial
  CRISPR gRNA sequence
taagtgagggggcaaaaaag

SEQ ID NO: 717613 - DNA, 20 bp, Artificial
  CRISPR gRNA sequence
caagaaaaagaaaggcaatt

SEQ ID NO: 717614 - DNA, 20 bp, Artificial
  CRISPR gRNA sequence
cctgcggctctctccatctg

SEQ ID NO: 717615 - DNA, 20 bp, Artificial
  CRISPR gRNA sequence
aatgaagctgaatgaatatc

SEQ ID NO: 717616 - DNA, 20 bp, Artificial
  CRISPR gRNA sequence
ataaagttgatttaaaagaa

SEQ ID NO: 717617 - DNA, 20 bp, Artificial
  CRISPR gRNA sequence
gaatgagaatcagtctcaaa

SEQ ID NO: 717618 - DNA, 20 bp, Artificial
  CRISPR gRNA sequence
agaatcagtctcaaacaaaa

SEQ ID NO: 717619 - DNA, 20 bp, Artificial
  CRISPR gRNA sequence
cagtctcaaacaaaacaaaa

SEQ ID NO: 717620 - DNA, 20 bp, Artificial
  CRISPR gRNA sequence
tcaaacaaaacaaaacaaaa

SEQ ID NO: 717621 - DNA, 20 bp, Artificial
  CRISPR gRNA sequence
caaaacaaaacaaaacaaaa

SEQ ID NO: 717622 - DNA, 20 bp, Artificial
  CRISPR gRNA sequence
caaaacaaaacaaaacaaaa

SEQ ID NO: 717623 - DNA, 20 bp, Artificial
  CRISPR gRNA sequence
caaaacaaaacaaaacaaaa

SEQ ID NO: 717624 - DNA, 20 bp, Artificial
  CRISPR gRNA sequence
caaaacaaaacaaaacaaaa

SEQ ID NO: 717625 - DNA, 20 bp, Artificial
  CRISPR gRNA sequence
caaaacaaaacaaaacaaaa

SEQ ID NO: 717626 - DNA, 20 bp, Artificial
  CRISPR gRNA sequence
acaaaacaaaacaaaacaaa

SEQ ID NO: 717627 - DNA, 20 bp, Artificial
  CRISPR gRNA sequence
ctctgtaagtgacaaaaggg

SEQ ID NO: 717628 - DNA, 20 bp, Artificial
  CRISPR gRNA sequence
tgtagggatgcaatgtgggt

SEQ ID NO: 717629 - DNA, 20 bp, Artificial
  CRISPR gRNA sequence
ctgactgttgacttgggcac

SEQ ID NO: 717630 - DNA, 20 bp, Artificial
  CRISPR gRNA sequence
gaaaaaaagaaagaaagaaa

SEQ ID NO: 717631 - DNA, 20 bp, Artificial
  CRISPR gRNA sequence
attgccatgtggcccctggg

SEQ ID NO: 717632 - DNA, 20 bp, Artificial
  CRISPR gRNA sequence
gactggatgtctctcacccc

SEQ ID NO: 717633 - DNA, 20 bp, Artificial
  CRISPR gRNA sequence
gaccagcctggccaacaaga

SEQ ID NO: 717634 - DNA, 20 bp, Artificial
  CRISPR gRNA sequence
aacagagcgagcctccgtct

SEQ ID NO: 717635 - DNA, 20 bp, Artificial
  CRISPR gRNA sequence
acaaacaaacaaacaaacaa

SEQ ID NO: 717636 - DNA, 20 bp, Artificial
  CRISPR gRNA sequence
aaagaacagttggctgcttg

SEQ ID NO: 717637 - DNA, 20 bp, Artificial
  CRISPR gRNA sequence
tagtgaaaccccgtctctac

SEQ ID NO: 717638 - DNA, 20 bp, Artificial
  CRISPR gRNA sequence
ttcattatttgtacataaaa

SEQ ID NO: 717639 - DNA, 20 bp, Artificial
  CRISPR gRNA sequence
tgcccttacctgtaaaaatc

SEQ ID NO: 717640 - DNA, 20 bp, Artificial
  CRISPR gRNA sequence
gatgcctgctgttactcata

SEQ ID NO: 717641 - DNA, 20 bp, Artificial
  CRISPR gRNA sequence
ctctctttcctgggggtgtt

SEQ ID NO: 717642 - DNA, 20 bp, Artificial
  CRISPR gRNA sequence
acggcttctccaactttccc

SEQ ID NO: 717643 - DNA, 20 bp, Artificial
  CRISPR gRNA sequence
actccttagcgtgaaatgtg

SEQ ID NO: 717644 - DNA, 20 bp, Artificial
  CRISPR gRNA sequence
acagaaagcaaactgtggac

SEQ ID NO: 717645 - DNA, 20 bp, Artificial
  CRISPR gRNA sequence
ttaggagaaatcccccaaaa

SEQ ID NO: 717646 - DNA, 20 bp, Artificial
  CRISPR gRNA sequence
cctatctgtgtgcctgcagc

SEQ ID NO: 717647 - DNA, 20 bp, Artificial
  CRISPR gRNA sequence
ccagcctgtcacatcctgca

SEQ ID NO: 717648 - DNA, 20 bp, Artificial
  CRISPR gRNA sequence
ctgggcgcccccacagaccc

SEQ ID NO: 717649 - DNA, 20 bp, Artificial
  CRISPR gRNA sequence
caaaatacatacttttcaaa

SEQ ID NO: 717650 - DNA, 20 bp, Artificial
  CRISPR gRNA sequence
ctgggctgcaggggacctcc

SEQ ID NO: 717651 - DNA, 20 bp, Artificial
  CRISPR gRNA sequence
tgatcacactcaagcattct

SEQ ID NO: 717652 - DNA, 20 bp, Artificial
  CRISPR gRNA sequence
tattttctaaatgctaaaaa

SEQ ID NO: 717653 - DNA, 20 bp, Artificial
  CRISPR gRNA sequence
tgctaaaaaaaaaacaaaaa

SEQ ID NO: 717654 - DNA, 20 bp, Artificial
  CRISPR gRNA sequence
aaaacaaaaaaaaaacaaaa

SEQ ID NO: 717655 - DNA, 20 bp, Artificial
  CRISPR gRNA sequence
aaaaaaacaaaaaaaaacaa

SEQ ID NO: 717656 - DNA, 20 bp, Artificial
  CRISPR gRNA sequence
acccataaattctactttcc

SEQ ID NO: 717657 - DNA, 20 bp, Artificial
  CRISPR gRNA sequence
ttcccaaaacaggagctttt

SEQ ID NO: 717658 - DNA, 20 bp, Artificial
  CRISPR gRNA sequence
aaaacaggagctttttaaaa

SEQ ID NO: 717659 - DNA, 20 bp, Artificial
  CRISPR gRNA sequence
cggcagggccctctgcctag

SEQ ID NO: 717660 - DNA, 20 bp, Artificial
  CRISPR gRNA sequence
ccggccaaaagactgcattt

SEQ ID NO: 717661 - DNA, 20 bp, Artificial
  CRISPR gRNA sequence
aatgcattggcctatgcagc

SEQ ID NO: 717662 - DNA, 20 bp, Artificial
  CRISPR gRNA sequence
tcccttcccccagcagctct

SEQ ID NO: 717663 - DNA, 20 bp, Artificial
  CRISPR gRNA sequence
gaattctctggaataccagg

SEQ ID NO: 717664 - DNA, 20 bp, Artificial
  CRISPR gRNA sequence
aaaaaagtgtgacaaagtaa

SEQ ID NO: 717665 - DNA, 20 bp, Artificial
  CRISPR gRNA sequence
ctaaagagccatctggcaac

SEQ ID NO: 717666 - DNA, 20 bp, Artificial
  CRISPR gRNA sequence
cctcaggaaataacccgaaa

SEQ ID NO: 717667 - DNA, 20 bp, Artificial
  CRISPR gRNA sequence
tttataataaccctcaaatt

SEQ ID NO: 717668 - DNA, 20 bp, Artificial
  CRISPR gRNA sequence
ttgaaaaccagccaaatgtc

SEQ ID NO: 717669 - DNA, 20 bp, Artificial
  CRISPR gRNA sequence
cccaggagacaggcgtcccg

SEQ ID NO: 717670 - DNA, 20 bp, Artificial
  CRISPR gRNA sequence
aaaacacctgatcaatactc

SEQ ID NO: 717671 - DNA, 20 bp, Artificial
  CRISPR gRNA sequence
tctccaattttctgtacatc

SEQ ID NO: 717672 - DNA, 20 bp, Artificial
  CRISPR gRNA sequence
ccagagtgacaccctgtctc

SEQ ID NO: 717673 - DNA, 20 bp, Artificial
  CRISPR gRNA sequence
gacaccctgtctccaaaaca

SEQ ID NO: 717674 - DNA, 20 bp, Artificial
  CRISPR gRNA sequence
tgtctccaaaacaaaaaaca

SEQ ID NO: 717675 - DNA, 20 bp, Artificial
  CRISPR gRNA sequence
aaaacaaaaaacaaaaaaca

SEQ ID NO: 717676 - DNA, 20 bp, Artificial
  CRISPR gRNA sequence
tgacctgaatccactcggga

SEQ ID NO: 717677 - DNA, 20 bp, Artificial
  CRISPR gRNA sequence
ctataagtttgaaactgttt

SEQ ID NO: 717678 - DNA, 20 bp, Artificial
  CRISPR gRNA sequence
ccaccagaagctagagggtc

SEQ ID NO: 717679 - DNA, 20 bp, Artificial
  CRISPR gRNA sequence
tttctttttttcttctgtaa

SEQ ID NO: 717680 - DNA, 20 bp, Artificial
  CRISPR gRNA sequence
ggaaacaggcttgaaactat

SEQ ID NO: 717681 - DNA, 20 bp, Artificial
  CRISPR gRNA sequence
gcttgaaactatcaaaacac

SEQ ID NO: 717682 - DNA, 20 bp, Artificial
  CRISPR gRNA sequence
cttgtgaaactcgtcaaatt

SEQ ID NO: 717683 - DNA, 20 bp, Artificial
  CRISPR gRNA sequence
gggctgagccctttacaaac

SEQ ID NO: 717684 - DNA, 20 bp, Artificial
  CRISPR gRNA sequence
gaccaacctggacaacatgg

SEQ ID NO: 717685 - DNA, 20 bp, Artificial
  CRISPR gRNA sequence
ggtgaaaccccatctctact

SEQ ID NO: 717686 - DNA, 20 bp, Artificial
  CRISPR gRNA sequence
agagaaagactcaaaataaa

SEQ ID NO: 717687 - DNA, 20 bp, Artificial
  CRISPR gRNA sequence
tagaccttttgcttttaaga

SEQ ID NO: 717688 - DNA, 20 bp, Artificial
  CRISPR gRNA sequence
cctgtgcttctctctgggtg

SEQ ID NO: 717689 - DNA, 20 bp, Artificial
  CRISPR gRNA sequence
tccagctttgactagtcctc

SEQ ID NO: 717690 - DNA, 20 bp, Artificial
  CRISPR gRNA sequence
tactcaggaggctgaggcag

SEQ ID NO: 717691 - DNA, 20 bp, Artificial
  CRISPR gRNA sequence
agaaacaaacaaacaaacaa

SEQ ID NO: 717692 - DNA, 20 bp, Artificial
  CRISPR gRNA sequence
gaccagcctggccaacatgg

SEQ ID NO: 717693 - DNA, 20 bp, Artificial
  CRISPR gRNA sequence
aaaagacaatactggggatt

SEQ ID NO: 717694 - DNA, 20 bp, Artificial
  CRISPR gRNA sequence
aaaatctctcaaagccctta

SEQ ID NO: 717695 - DNA, 20 bp, Artificial
  CRISPR gRNA sequence
ctcaaagcccttaaaaaaca

SEQ ID NO: 717696 - DNA, 20 bp, Artificial
  CRISPR gRNA sequence
aacaaaaaacaacaacaaca

SEQ ID NO: 717697 - DNA, 20 bp, Artificial
  CRISPR gRNA sequence
tattcatctctctaagtcaa

SEQ ID NO: 717698 - DNA, 20 bp, Artificial
  CRISPR gRNA sequence
agaatctcttgccaaaatgc

SEQ ID NO: 717699 - DNA, 20 bp, Artificial
  CRISPR gRNA sequence
gctcagctgcatgcatttgt

SEQ ID NO: 717700 - DNA, 20 bp, Artificial
  CRISPR gRNA sequence
tttttcctccaaaagcaaaa

SEQ ID NO: 717701 - DNA, 20 bp, Artificial
  CRISPR gRNA sequence
tgtggcagactgtatttccc

SEQ ID NO: 717702 - DNA, 20 bp, Artificial
  CRISPR gRNA sequence
tgcactcagtaagtgcttgt

SEQ ID NO: 717703 - DNA, 20 bp, Artificial
  CRISPR gRNA sequence
gaaaagaggcgacccccatc

SEQ ID NO: 717704 - DNA, 20 bp, Artificial
  CRISPR gRNA sequence
ggctctgtcactcccctgct

SEQ ID NO: 717705 - DNA, 20 bp, Artificial
  CRISPR gRNA sequence
cagagcaagactcacctcaa

SEQ ID NO: 717706 - DNA, 20 bp, Artificial
  CRISPR gRNA sequence
ccacaaatccatttttttta

SEQ ID NO: 717707 - DNA, 20 bp, Artificial
  CRISPR gRNA sequence
cagaaacaacccaaatattc

SEQ ID NO: 717708 - DNA, 20 bp, Artificial
  CRISPR gRNA sequence
agtcggagatggggcccttg

SEQ ID NO: 717709 - DNA, 20 bp, Artificial
  CRISPR gRNA sequence
gacagaagcagagtggagaa

SEQ ID NO: 717710 - DNA, 20 bp, Artificial
  CRISPR gRNA sequence
ttctattttacagctggaaa

SEQ ID NO: 717711 - DNA, 20 bp, Artificial
  CRISPR gRNA sequence
agctgagattagaacacttc

SEQ ID NO: 717712 - DNA, 20 bp, Artificial
  CRISPR gRNA sequence
atagtgaaatcccatctcta

SEQ ID NO: 717713 - DNA, 20 bp, Artificial
  CRISPR gRNA sequence
gttcaattttcctgtaaacc

SEQ ID NO: 717714 - DNA, 20 bp, Artificial
  CRISPR gRNA sequence
gagcgagactccgtctcaaa

SEQ ID NO: 717715 - DNA, 20 bp, Artificial
  CRISPR gRNA sequence
agactccgtctcaaacaaaa

SEQ ID NO: 717716 - DNA, 20 bp, Artificial
  CRISPR gRNA sequence
ccgtctcaaacaaaacaaaa

SEQ ID NO: 717717 - DNA, 20 bp, Artificial
  CRISPR gRNA sequence
caaaacaaaaatagcactgg

SEQ ID NO: 717718 - DNA, 20 bp, Artificial
  CRISPR gRNA sequence
gaagtcgccaaacatcagag

SEQ ID NO: 717719 - DNA, 20 bp, Artificial
  CRISPR gRNA sequence
tcaaggaggcagaaaagagg

SEQ ID NO: 717720 - DNA, 20 bp, Artificial
  CRISPR gRNA sequence
agaaaagagggaaaacagaa

SEQ ID NO: 717721 - DNA, 20 bp, Artificial
  CRISPR gRNA sequence
ataacctgaggtcaggagtt

SEQ ID NO: 717722 - DNA, 20 bp, Artificial
  CRISPR gRNA sequence
aggactccatctcaaacaaa

SEQ ID NO: 717723 - DNA, 20 bp, Artificial
  CRISPR gRNA sequence
tagagtgtactcctacttat

SEQ ID NO: 717724 - DNA, 20 bp, Artificial
  CRISPR gRNA sequence
tgtctcaaaaagaaaaaaaa

SEQ ID NO: 717725 - DNA, 20 bp, Artificial
  CRISPR gRNA sequence
tcaaatgatgaatcaaagtg

SEQ ID NO: 717726 - DNA, 20 bp, Artificial
  CRISPR gRNA sequence
tcaatctattctctactgtc

SEQ ID NO: 717727 - DNA, 20 bp, Artificial
  CRISPR gRNA sequence
taaaaagcccaacccaccaa

SEQ ID NO: 717728 - DNA, 20 bp, Artificial
  CRISPR gRNA sequence
aacaaacagaatacacattt

SEQ ID NO: 717729 - DNA, 20 bp, Artificial
  CRISPR gRNA sequence
cagctccacctccaaccccc

SEQ ID NO: 717730 - DNA, 20 bp, Artificial
  CRISPR gRNA sequence
cgcaaactcataaactttct

SEQ ID NO: 717731 - DNA, 20 bp, Artificial
  CRISPR gRNA sequence
ttagctcatcagctataagc

SEQ ID NO: 717732 - DNA, 20 bp, Artificial
  CRISPR gRNA sequence
agccaattatattgatggga

SEQ ID NO: 717733 - DNA, 20 bp, Artificial
  CRISPR gRNA sequence
tattgatgggaagaagtatt

SEQ ID NO: 717734 - DNA, 20 bp, Artificial
  CRISPR gRNA sequence
atgggaagaagtattctgat

SEQ ID NO: 717735 - DNA, 20 bp, Artificial
  CRISPR gRNA sequence
tgattggcctgcttgggtca

SEQ ID NO: 717736 - DNA, 20 bp, Artificial
  CRISPR gRNA sequence
attggcctgcttgggtcatg

SEQ ID NO: 717737 - DNA, 20 bp, Artificial
  CRISPR gRNA sequence
gcctgcttgggtcatgtgct

SEQ ID NO: 717738 - DNA, 20 bp, Artificial
  CRISPR gRNA sequence
cttgggtcatgtgctcatcc

SEQ ID NO: 717739 - DNA, 20 bp, Artificial
  CRISPR gRNA sequence
gggtcatgtgctcatcctgg

SEQ ID NO: 717740 - DNA, 20 bp, Artificial
  CRISPR gRNA sequence
ggtcatgtgctcatcctgga

SEQ ID NO: 717741 - DNA, 20 bp, Artificial
  CRISPR gRNA sequence
atcctggaagcaaggtaggc

SEQ ID NO: 717742 - DNA, 20 bp, Artificial
  CRISPR gRNA sequence
gaagcaaggtaggcagcgat

SEQ ID NO: 717743 - DNA, 20 bp, Artificial
  CRISPR gRNA sequence
ctgggtgacttgtttatctc

SEQ ID NO: 717744 - DNA, 20 bp, Artificial
  CRISPR gRNA sequence
ggtgacttgtttatctcgaa

SEQ ID NO: 717745 - DNA, 20 bp, Artificial
  CRISPR gRNA sequence
gtttatctcgaaatcaggct

SEQ ID NO: 717746 - DNA, 20 bp, Artificial
  CRISPR gRNA sequence
tttatctcgaaatcaggctg

SEQ ID NO: 717747 - DNA, 20 bp, Artificial
  CRISPR gRNA sequence
atctcgaaatcaggctggat

SEQ ID NO: 717748 - DNA, 20 bp, Artificial
  CRISPR gRNA sequence
tctcgaaatcaggctggatt

SEQ ID NO: 717749 - DNA, 20 bp, Artificial
  CRISPR gRNA sequence
gaaatcaggctggattaggg

SEQ ID NO: 717750 - DNA, 20 bp, Artificial
  CRISPR gRNA sequence
gattagggtcttagtggcag

SEQ ID NO: 717751 - DNA, 20 bp, Artificial
  CRISPR gRNA sequence
gggtcttagtggcaggagtg

SEQ ID NO: 717752 - DNA, 20 bp, Artificial
  CRISPR gRNA sequence
agtggcaggagtgtccaatc

SEQ ID NO: 717753 - DNA, 20 bp, Artificial
  CRISPR gRNA sequence
gtggcaggagtgtccaatct

SEQ ID NO: 717754 - DNA, 20 bp, Artificial
  CRISPR gRNA sequence
tcggcttccctgggccacat

SEQ ID NO: 717755 - DNA, 20 bp, Artificial
  CRISPR gRNA sequence
cggcttccctgggccacatt

SEQ ID NO: 717756 - DNA, 20 bp, Artificial
  CRISPR gRNA sequence
ggcttccctgggccacattg

SEQ ID NO: 717757 - DNA, 20 bp, Artificial
  CRISPR gRNA sequence
ccctgggccacattggaaga

SEQ ID NO: 717758 - DNA, 20 bp, Artificial
  CRISPR gRNA sequence
cctgggccacattggaagaa

SEQ ID NO: 717759 - DNA, 20 bp, Artificial
  CRISPR gRNA sequence
ggccacattggaagaagaag

SEQ ID NO: 717760 - DNA, 20 bp, Artificial
  CRISPR gRNA sequence
gaagaagaagtgttagtgtg

SEQ ID NO: 717761 - DNA, 20 bp, Artificial
  CRISPR gRNA sequence
gtgtggaagaagtgaattta

SEQ ID NO: 717762 - DNA, 20 bp, Artificial
  CRISPR gRNA sequence
agtctaacactaaggatagt

SEQ ID NO: 717763 - DNA, 20 bp, Artificial
  CRISPR gRNA sequence
gtctaacactaaggatagtg

SEQ ID NO: 717764 - DNA, 20 bp, Artificial
  CRISPR gRNA sequence
acactaaggatagtgtttta

SEQ ID NO: 717765 - DNA, 20 bp, Artificial
  CRISPR gRNA sequence
aggatagtgttttagcttat

SEQ ID NO: 717766 - DNA, 20 bp, Artificial
  CRISPR gRNA sequence
tagcttatagctgatgagct

SEQ ID NO: 717767 - DNA, 20 bp, Artificial
  CRISPR gRNA sequence
agcttatagctgatgagcta

SEQ ID NO: 717768 - DNA, 20 bp, Artificial
  CRISPR gRNA sequence
gcttatagctgatgagctaa

SEQ ID NO: 717769 - DNA, 20 bp, Artificial
  CRISPR gRNA sequence
atagctgatgagctaaaaaa

SEQ ID NO: 717770 - DNA, 20 bp, Artificial
  CRISPR gRNA sequence
tagctgatgagctaaaaaaa

SEQ ID NO: 717771 - DNA, 20 bp, Artificial
  CRISPR gRNA sequence
atgagctaaaaaaaaaaaaa

SEQ ID NO: 717772 - DNA, 20 bp, Artificial
  CRISPR gRNA sequence
aaaaaaaaaaaaaaaaaaat

SEQ ID NO: 717773 - DNA, 20 bp, Artificial
  CRISPR gRNA sequence
ataatgttttaagaaagttt

SEQ ID NO: 717774 - DNA, 20 bp, Artificial
  CRISPR gRNA sequence
taagaaagtttatgagtttg

SEQ ID NO: 717775 - DNA, 20 bp, Artificial
  CRISPR gRNA sequence
aagaaagtttatgagtttgc

SEQ ID NO: 717776 - DNA, 20 bp, Artificial
  CRISPR gRNA sequence
agaaagtttatgagtttgcg

SEQ ID NO: 717777 - DNA, 20 bp, Artificial
  CRISPR gRNA sequence
atgagtttgcgttgggcctc

SEQ ID NO: 717778 - DNA, 20 bp, Artificial
  CRISPR gRNA sequence
tgagtttgcgttgggcctca

SEQ ID NO: 717779 - DNA, 20 bp, Artificial
  CRISPR gRNA sequence
gcgttgggcctcattcagag

SEQ ID NO: 717780 - DNA, 20 bp, Artificial
  CRISPR gRNA sequence
cgttgggcctcattcagagc

SEQ ID NO: 717781 - DNA, 20 bp, Artificial
  CRISPR gRNA sequence
ggcctcattcagagctgtcc

SEQ ID NO: 717782 - DNA, 20 bp, Artificial
  CRISPR gRNA sequence
attcagagctgtcctgggcc

SEQ ID NO: 717783 - DNA, 20 bp, Artificial
  CRISPR gRNA sequence
agagctgtcctgggccgaat

SEQ ID NO: 717784 - DNA, 20 bp, Artificial
  CRISPR gRNA sequence
tcctgggccgaatgcggcta

SEQ ID NO: 717785 - DNA, 20 bp, Artificial
  CRISPR gRNA sequence
ggccgaatgcggctagtcgt

SEQ ID NO: 717786 - DNA, 20 bp, Artificial
  CRISPR gRNA sequence
gtcgtgggttggacaagctt

SEQ ID NO: 717787 - DNA, 20 bp, Artificial
  CRISPR gRNA sequence
gacaagcttggtctagactt

SEQ ID NO: 717788 - DNA, 20 bp, Artificial
  CRISPR gRNA sequence
ggtctagactttcatggtct

SEQ ID NO: 717789 - DNA, 20 bp, Artificial
  CRISPR gRNA sequence
gtctagactttcatggtcta

SEQ ID NO: 717790 - DNA, 20 bp, Artificial
  CRISPR gRNA sequence
gactttcatggtctaaagtt

SEQ ID NO: 717791 - DNA, 20 bp, Artificial
  CRISPR gRNA sequence
tcatggtctaaagttatggc

SEQ ID NO: 717792 - DNA, 20 bp, Artificial
  CRISPR gRNA sequence
catggtctaaagttatggct

SEQ ID NO: 717793 - DNA, 20 bp, Artificial
  CRISPR gRNA sequence
atggtctaaagttatggctc

SEQ ID NO: 717794 - DNA, 20 bp, Artificial
  CRISPR gRNA sequence
aagttatggctctcctaatt

SEQ ID NO: 717795 - DNA, 20 bp, Artificial
  CRISPR gRNA sequence
tggctctcctaattcctgca

SEQ ID NO: 717796 - DNA, 20 bp, Artificial
  CRISPR gRNA sequence
tcctaattcctgcagtgaga

SEQ ID NO: 717797 - DNA, 20 bp, Artificial
  CRISPR gRNA sequence
ctaattcctgcagtgagata

SEQ ID NO: 717798 - DNA, 20 bp, Artificial
  CRISPR gRNA sequence
attcctgcagtgagataaga

SEQ ID NO: 717799 - DNA, 20 bp, Artificial
  CRISPR gRNA sequence
ctgcagtgagataagacccc

SEQ ID NO: 717800 - DNA, 20 bp, Artificial
  CRISPR gRNA sequence
cagtgagataagacccctgc

SEQ ID NO: 717801 - DNA, 20 bp, Artificial
  CRISPR gRNA sequence
cagagaatgatgacaaccgg

SEQ ID NO: 717802 - DNA, 20 bp, Artificial
  CRISPR gRNA sequence
atatagtgcttgttgggtgc

SEQ ID NO: 717803 - DNA, 20 bp, Artificial
  CRISPR gRNA sequence
gttgggtgccagggactgct

SEQ ID NO: 717804 - DNA, 20 bp, Artificial
  CRISPR gRNA sequence
ttgggtgccagggactgctg

SEQ ID NO: 717805 - DNA, 20 bp, Artificial
  CRISPR gRNA sequence
ggtgccagggactgctgtag

SEQ ID NO: 717806 - DNA, 20 bp, Artificial
  CRISPR gRNA sequence
ctgtagtactttatacatat

SEQ ID NO: 717807 - DNA, 20 bp, Artificial
  CRISPR gRNA sequence
tagtactttatacatattta

SEQ ID NO: 717808 - DNA, 20 bp, Artificial
  CRISPR gRNA sequence
tatacatatttatcttcaca

SEQ ID NO: 717809 - DNA, 20 bp, Artificial
  CRISPR gRNA sequence
atacatatttatcttcacag

SEQ ID NO: 717810 - DNA, 20 bp, Artificial
  CRISPR gRNA sequence
tacatatttatcttcacagt

SEQ ID NO: 717811 - DNA, 20 bp, Artificial
  CRISPR gRNA sequence
atcttcacagtccattcagt

SEQ ID NO: 717812 - DNA, 20 bp, Artificial
  CRISPR gRNA sequence
tcttcacagtccattcagtc

SEQ ID NO: 717813 - DNA, 20 bp, Artificial
  CRISPR gRNA sequence
cacagtccattcagtccttt

SEQ ID NO: 717814 - DNA, 20 bp, Artificial
  CRISPR gRNA sequence
acagtccattcagtcctttc

SEQ ID NO: 717815 - DNA, 20 bp, Artificial
  CRISPR gRNA sequence
agtcctttcaagaacactag

SEQ ID NO: 717816 - DNA, 20 bp, Artificial
  CRISPR gRNA sequence
tcaagaacactaggaggtgg

SEQ ID NO: 717817 - DNA, 20 bp, Artificial
  CRISPR gRNA sequence
caagaacactaggaggtggg

SEQ ID NO: 717818 - DNA, 20 bp, Artificial
  CRISPR gRNA sequence
aagaacactaggaggtgggt

SEQ ID NO: 717819 - DNA, 20 bp, Artificial
  CRISPR gRNA sequence
ggaggtgggtcctattacta

SEQ ID NO: 717820 - DNA, 20 bp, Artificial
  CRISPR gRNA sequence
ttactaacttaatagtgcta

SEQ ID NO: 717821 - DNA, 20 bp, Artificial
  CRISPR gRNA sequence
ctaacttaatagtgctaaat

SEQ ID NO: 717822 - DNA, 20 bp, Artificial
  CRISPR gRNA sequence
acttaatagtgctaaatata

SEQ ID NO: 717823 - DNA, 20 bp, Artificial
  CRISPR gRNA sequence
aatagtgctaaatatataca

SEQ ID NO: 717824 - DNA, 20 bp, Artificial
  CRISPR gRNA sequence
atagtgctaaatatatacac

SEQ ID NO: 717825 - DNA, 20 bp, Artificial
  CRISPR gRNA sequence
aatatatacacgtactatgt

SEQ ID NO: 717826 - DNA, 20 bp, Artificial
  CRISPR gRNA sequence
tgtaccctcacacacacaca

SEQ ID NO: 717827 - DNA, 20 bp, Artificial
  CRISPR gRNA sequence
acacacacacacacacaaat

SEQ ID NO: 717828 - DNA, 20 bp, Artificial
  CRISPR gRNA sequence
acaaggtcattatcacgcaa

SEQ ID NO: 717829 - DNA, 20 bp, Artificial
  CRISPR gRNA sequence
tcacgcaattggcaaatggc

SEQ ID NO: 717830 - DNA, 20 bp, Artificial
  CRISPR gRNA sequence
gcaaatggcagccctagaat

SEQ ID NO: 717831 - DNA, 20 bp, Artificial
  CRISPR gRNA sequence
gaatcccaggcccagctctt

SEQ ID NO: 717832 - DNA, 20 bp, Artificial
  CRISPR gRNA sequence
ttctctataactatgttgct

SEQ ID NO: 717833 - DNA, 20 bp, Artificial
  CRISPR gRNA sequence
ctctataactatgttgcttt

SEQ ID NO: 717834 - DNA, 20 bp, Artificial
  CRISPR gRNA sequence
tctataactatgttgctttt

SEQ ID NO: 717835 - DNA, 20 bp, Artificial
  CRISPR gRNA sequence
tataactatgttgcttttcc

SEQ ID NO: 717836 - DNA, 20 bp, Artificial
  CRISPR gRNA sequence
taactatgttgcttttcctt

SEQ ID NO: 717837 - DNA, 20 bp, Artificial
  CRISPR gRNA sequence
tgttgcttttccttgcctgc

SEQ ID NO: 717838 - DNA, 20 bp, Artificial
  CRISPR gRNA sequence
cttttccttgcctgctaggg

SEQ ID NO: 717839 - DNA, 20 bp, Artificial
  CRISPR gRNA sequence
ttccttgcctgctaggggac

SEQ ID NO: 717840 - DNA, 20 bp, Artificial
  CRISPR gRNA sequence
tccttgcctgctaggggacc

SEQ ID NO: 717841 - DNA, 20 bp, Artificial
  CRISPR gRNA sequence
ccttgcctgctaggggacct

SEQ ID NO: 717842 - DNA, 20 bp, Artificial
  CRISPR gRNA sequence
cttgcctgctaggggacctt

SEQ ID NO: 717843 - DNA, 20 bp, Artificial
  CRISPR gRNA sequence
gcctgctaggggaccttagg

SEQ ID NO: 717844 - DNA, 20 bp, Artificial
  CRISPR gRNA sequence
cctgctaggggaccttaggc

SEQ ID NO: 717845 - DNA, 20 bp, Artificial
  CRISPR gRNA sequence
ctaggggaccttaggcgagg

SEQ ID NO: 717846 - DNA, 20 bp, Artificial
  CRISPR gRNA sequence
ggggaccttaggcgagggtt

SEQ ID NO: 717847 - DNA, 20 bp, Artificial
  CRISPR gRNA sequence
aggcgagggttgcccctcct

SEQ ID NO: 717848 - DNA, 20 bp, Artificial
  CRISPR gRNA sequence
ggcgagggttgcccctcctg

SEQ ID NO: 717849 - DNA, 20 bp, Artificial
  CRISPR gRNA sequence
cccctcctgggtgtcagtgc

SEQ ID NO: 717850 - DNA, 20 bp, Artificial
  CRISPR gRNA sequence
ctgggtgtcagtgcttccat

SEQ ID NO: 717851 - DNA, 20 bp, Artificial
  CRISPR gRNA sequence
ggtgtcagtgcttccatcca

SEQ ID NO: 717852 - DNA, 20 bp, Artificial
  CRISPR gRNA sequence
ccatccataacacaagaatt

SEQ ID NO: 717853 - DNA, 20 bp, Artificial
  CRISPR gRNA sequence
catccataacacaagaattg

SEQ ID NO: 717854 - DNA, 20 bp, Artificial
  CRISPR gRNA sequence
gactgacagttttcgggggt

SEQ ID NO: 717855 - DNA, 20 bp, Artificial
  CRISPR gRNA sequence
acagttttcgggggttggag

SEQ ID NO: 717856 - DNA, 20 bp, Artificial
  CRISPR gRNA sequence
tcgggggttggaggtggagc

SEQ ID NO: 717857 - DNA, 20 bp, Artificial
  CRISPR gRNA sequence
cgggggttggaggtggagct

SEQ ID NO: 717858 - DNA, 20 bp, Artificial
  CRISPR gRNA sequence
gggggttggaggtggagctg

SEQ ID NO: 717859 - DNA, 20 bp, Artificial
  CRISPR gRNA sequence
gaggtggagctgggaggggc

SEQ ID NO: 717860 - DNA, 20 bp, Artificial
  CRISPR gRNA sequence
ggaggggcgtcagggatgag

SEQ ID NO: 717861 - DNA, 20 bp, Artificial
  CRISPR gRNA sequence
ggtcataaggcctttgctaa

SEQ ID NO: 717862 - DNA, 20 bp, Artificial
  CRISPR gRNA sequence
tgctaagtcagcctggcttg

SEQ ID NO: 717863 - DNA, 20 bp, Artificial
  CRISPR gRNA sequence
gctaagtcagcctggcttgg

SEQ ID NO: 717864 - DNA, 20 bp, Artificial
  CRISPR gRNA sequence
ctaagtcagcctggcttgga

SEQ ID NO: 717865 - DNA, 20 bp, Artificial
  CRISPR gRNA sequence
agtcagcctggcttggagct

SEQ ID NO: 717866 - DNA, 20 bp, Artificial
  CRISPR gRNA sequence
gcttggagcttctctgtttc

SEQ ID NO: 717867 - DNA, 20 bp, Artificial
  CRISPR gRNA sequence
ggagcttctctgtttctttt

SEQ ID NO: 717868 - DNA, 20 bp, Artificial
  CRISPR gRNA sequence
gagcttctctgtttcttttc

SEQ ID NO: 717869 - DNA, 20 bp, Artificial
  CRISPR gRNA sequence
ctctgtttcttttcccaggg

SEQ ID NO: 717870 - DNA, 20 bp, Artificial
  CRISPR gRNA sequence
tctgtttcttttcccagggc

SEQ ID NO: 717871 - DNA, 20 bp, Artificial
  CRISPR gRNA sequence
tgtttcttttcccagggctg

SEQ ID NO: 717872 - DNA, 20 bp, Artificial
  CRISPR gRNA sequence
tttcttttcccagggctgtt

SEQ ID NO: 717873 - DNA, 20 bp, Artificial
  CRISPR gRNA sequence
cttttcccagggctgttccc

SEQ ID NO: 717874 - DNA, 20 bp, Artificial
  CRISPR gRNA sequence
ttttcccagggctgttcccg

SEQ ID NO: 717875 - DNA, 20 bp, Artificial
  CRISPR gRNA sequence
ttcccagggctgttcccgac

SEQ ID NO: 717876 - DNA, 20 bp, Artificial
  CRISPR gRNA sequence
tcccagggctgttcccgaca

SEQ ID NO: 717877 - DNA, 20 bp, Artificial
  CRISPR gRNA sequence
cccagggctgttcccgacac

SEQ ID NO: 717878 - DNA, 20 bp, Artificial
  CRISPR gRNA sequence
ccagggctgttcccgacaca

SEQ ID NO: 717879 - DNA, 20 bp, Artificial
  CRISPR gRNA sequence
ttcccgacacagcagtgccc

SEQ ID NO: 717880 - DNA, 20 bp, Artificial
  CRISPR gRNA sequence
ccgacacagcagtgcccaca

SEQ ID NO: 717881 - DNA, 20 bp, Artificial
  CRISPR gRNA sequence
ctgactgcaggaagcagtgt

SEQ ID NO: 717882 - DNA, 20 bp, Artificial
  CRISPR gRNA sequence
actgcaggaagcagtgtgag

SEQ ID NO: 717883 - DNA, 20 bp, Artificial
  CRISPR gRNA sequence
caggaagcagtgtgagcctg

SEQ ID NO: 717884 - DNA, 20 bp, Artificial
  CRISPR gRNA sequence
actactacctggatgaggcc

SEQ ID NO: 717885 - DNA, 20 bp, Artificial
  CRISPR gRNA sequence
ctacctggatgaggccgacc

SEQ ID NO: 717886 - DNA, 20 bp, Artificial
  CRISPR gRNA sequence
cctggatgaggccgaccgct

SEQ ID NO: 717887 - DNA, 20 bp, Artificial
  CRISPR gRNA sequence
gatgaggccgaccgctgtac

SEQ ID NO: 717888 - DNA, 20 bp, Artificial
  CRISPR gRNA sequence
tacagcctgcgtgacttgtt

SEQ ID NO: 717889 - DNA, 20 bp, Artificial
  CRISPR gRNA sequence
cgtgacttgttctcgaggta

SEQ ID NO: 717890 - DNA, 20 bp, Artificial
  CRISPR gRNA sequence
gttctcgaggtaagggcctt

SEQ ID NO: 717891 - DNA, 20 bp, Artificial
  CRISPR gRNA sequence
ttctcgaggtaagggccttg

SEQ ID NO: 717892 - DNA, 20 bp, Artificial
  CRISPR gRNA sequence
tcgaggtaagggccttgttc

SEQ ID NO: 717893 - DNA, 20 bp, Artificial
  CRISPR gRNA sequence
gaggtaagggccttgttctc

SEQ ID NO: 717894 - DNA, 20 bp, Artificial
  CRISPR gRNA sequence
gttctctctccagggcctcc

SEQ ID NO: 717895 - DNA, 20 bp, Artificial
  CRISPR gRNA sequence
ttctctctccagggcctcct

SEQ ID NO: 717896 - DNA, 20 bp, Artificial
  CRISPR gRNA sequence
tctctccagggcctccttct

SEQ ID NO: 717897 - DNA, 20 bp, Artificial
  CRISPR gRNA sequence
tctccagggcctccttctag

SEQ ID NO: 717898 - DNA, 20 bp, Artificial
  CRISPR gRNA sequence
tccagggcctccttctaggg

SEQ ID NO: 717899 - DNA, 20 bp, Artificial
  CRISPR gRNA sequence
cagggcctccttctagggag

SEQ ID NO: 717900 - DNA, 20 bp, Artificial
  CRISPR gRNA sequence
cttctagggagcatgagggg

SEQ ID NO: 717901 - DNA, 20 bp, Artificial
  CRISPR gRNA sequence
ctagggagcatgaggggtcc

SEQ ID NO: 717902 - DNA, 20 bp, Artificial
  CRISPR gRNA sequence
tagggagcatgaggggtcct

SEQ ID NO: 717903 - DNA, 20 bp, Artificial
  CRISPR gRNA sequence
gggagcatgaggggtcctca

SEQ ID NO: 717904 - DNA, 20 bp, Artificial
  CRISPR gRNA sequence
agaggagaggtgaagaatct

SEQ ID NO: 717905 - DNA, 20 bp, Artificial
  CRISPR gRNA sequence
gaaggtggagagcatcatga

SEQ ID NO: 717906 - DNA, 20 bp, Artificial
  CRISPR gRNA sequence
gatgtctgttctctgaattg

SEQ ID NO: 717907 - DNA, 20 bp, Artificial
  CRISPR gRNA sequence
atgtctgttctctgaattgt

SEQ ID NO: 717908 - DNA, 20 bp, Artificial
  CRISPR gRNA sequence
ttctctgaattgtcctcctg

SEQ ID NO: 717909 - DNA, 20 bp, Artificial
  CRISPR gRNA sequence
tctgaattgtcctcctggtg

SEQ ID NO: 717910 - DNA, 20 bp, Artificial
  CRISPR gRNA sequence
tgaattgtcctcctggtgcc

SEQ ID NO: 717911 - DNA, 20 bp, Artificial
  CRISPR gRNA sequence
aattgtcctcctggtgcctc

SEQ ID NO: 717912 - DNA, 20 bp, Artificial
  CRISPR gRNA sequence
tcctcctggtgcctcagttt

SEQ ID NO: 717913 - DNA, 20 bp, Artificial
  CRISPR gRNA sequence
ctggtgcctcagtttacctc

SEQ ID NO: 717914 - DNA, 20 bp, Artificial
  CRISPR gRNA sequence
gtgcctcagtttacctctct

SEQ ID NO: 717915 - DNA, 20 bp, Artificial
  CRISPR gRNA sequence
agtttacctctctgcatttg

SEQ ID NO: 717916 - DNA, 20 bp, Artificial
  CRISPR gRNA sequence
acctctctgcatttgtgatt

SEQ ID NO: 717917 - DNA, 20 bp, Artificial
  CRISPR gRNA sequence
cctctctgcatttgtgattt

SEQ ID NO: 717918 - DNA, 20 bp, Artificial
  CRISPR gRNA sequence
tctgcatttgtgatttgata

SEQ ID NO: 717919 - DNA, 20 bp, Artificial
  CRISPR gRNA sequence
tgcatttgtgatttgatatc

SEQ ID NO: 717920 - DNA, 20 bp, Artificial
  CRISPR gRNA sequence
catttgtgatttgatatcag

SEQ ID NO: 717921 - DNA, 20 bp, Artificial
  CRISPR gRNA sequence
gtgatttgatatcagccatg

SEQ ID NO: 717922 - DNA, 20 bp, Artificial
  CRISPR gRNA sequence
tgatttgatatcagccatga

SEQ ID NO: 717923 - DNA, 20 bp, Artificial
  CRISPR gRNA sequence
gatatcagccatgacctttt

SEQ ID NO: 717924 - DNA, 20 bp, Artificial
  CRISPR gRNA sequence
atatcagccatgaccttttg

SEQ ID NO: 717925 - DNA, 20 bp, Artificial
  CRISPR gRNA sequence
ttgcatccatactttcacag

SEQ ID NO: 717926 - DNA, 20 bp, Artificial
  CRISPR gRNA sequence
tgcatccatactttcacaga

SEQ ID NO: 717927 - DNA, 20 bp, Artificial
  CRISPR gRNA sequence
gcatccatactttcacagag

SEQ ID NO: 717928 - DNA, 20 bp, Artificial
  CRISPR gRNA sequence
catccatactttcacagaga

SEQ ID NO: 717929 - DNA, 20 bp, Artificial
  CRISPR gRNA sequence
tcacagagacttaacatgtt

SEQ ID NO: 717930 - DNA, 20 bp, Artificial
  CRISPR gRNA sequence
cacagagacttaacatgttt

SEQ ID NO: 717931 - DNA, 20 bp, Artificial
  CRISPR gRNA sequence
acagagacttaacatgtttc

SEQ ID NO: 717932 - DNA, 20 bp, Artificial
  CRISPR gRNA sequence
aacatgtttcctgaaggaga

SEQ ID NO: 717933 - DNA, 20 bp, Artificial
  CRISPR gRNA sequence
acatgtttcctgaaggagag

SEQ ID NO: 717934 - DNA, 20 bp, Artificial
  CRISPR gRNA sequence
cctgaaggagaggactcaca

SEQ ID NO: 717935 - DNA, 20 bp, Artificial
  CRISPR gRNA sequence
ctgaaggagaggactcacat

SEQ ID NO: 717936 - DNA, 20 bp, Artificial
  CRISPR gRNA sequence
aaggagaggactcacatttt

SEQ ID NO: 717937 - DNA, 20 bp, Artificial
  CRISPR gRNA sequence
acatttttttgagtttaatc

SEQ ID NO: 717938 - DNA, 20 bp, Artificial
  CRISPR gRNA sequence
ttttgagtttaatcctcacc

SEQ ID NO: 717939 - DNA, 20 bp, Artificial
  CRISPR gRNA sequence
tttgagtttaatcctcacca

SEQ ID NO: 717940 - DNA, 20 bp, Artificial
  CRISPR gRNA sequence
ttgagtttaatcctcaccac

SEQ ID NO: 717941 - DNA, 20 bp, Artificial
  CRISPR gRNA sequence
tgagtttaatcctcaccaca

SEQ ID NO: 717942 - DNA, 20 bp, Artificial
  CRISPR gRNA sequence
gagtttaatcctcaccacag

SEQ ID NO: 717943 - DNA, 20 bp, Artificial
  CRISPR gRNA sequence
agtttaatcctcaccacagc

SEQ ID NO: 717944 - DNA, 20 bp, Artificial
  CRISPR gRNA sequence
aatcctcaccacagccctag

SEQ ID NO: 717945 - DNA, 20 bp, Artificial
  CRISPR gRNA sequence
atcctcaccacagccctagg

SEQ ID NO: 717946 - DNA, 20 bp, Artificial
  CRISPR gRNA sequence
accacagccctaggggagga

SEQ ID NO: 717947 - DNA, 20 bp, Artificial
  CRISPR gRNA sequence
ggggaggatttcttgcttat

SEQ ID NO: 717948 - DNA, 20 bp, Artificial
  CRISPR gRNA sequence
cttgcttatccttactttac

SEQ ID NO: 717949 - DNA, 20 bp, Artificial
  CRISPR gRNA sequence
ttgcttatccttactttaca

SEQ ID NO: 717950 - DNA, 20 bp, Artificial
  CRISPR gRNA sequence
gcttatccttactttacaat

SEQ ID NO: 717951 - DNA, 20 bp, Artificial
  CRISPR gRNA sequence
cttatccttactttacaatg

SEQ ID NO: 717952 - DNA, 20 bp, Artificial
  CRISPR gRNA sequence
atccttactttacaatgagg

SEQ ID NO: 717953 - DNA, 20 bp, Artificial
  CRISPR gRNA sequence
tccttactttacaatgagga

SEQ ID NO: 717954 - DNA, 20 bp, Artificial
  CRISPR gRNA sequence
actttacaatgaggaatttg

SEQ ID NO: 717955 - DNA, 20 bp, Artificial
  CRISPR gRNA sequence
ctttacaatgaggaatttga

SEQ ID NO: 717956 - DNA, 20 bp, Artificial
  CRISPR gRNA sequence
tacaatgaggaatttgagga

SEQ ID NO: 717957 - DNA, 20 bp, Artificial
  CRISPR gRNA sequence
acaatgaggaatttgaggat

SEQ ID NO: 717958 - DNA, 20 bp, Artificial
  CRISPR gRNA sequence
caatgaggaatttgaggata

SEQ ID NO: 717959 - DNA, 20 bp, Artificial
  CRISPR gRNA sequence
gaggatagggaggttaaggg

SEQ ID NO: 717960 - DNA, 20 bp, Artificial
  CRISPR gRNA sequence
aggatagggaggttaagggc

SEQ ID NO: 717961 - DNA, 20 bp, Artificial
  CRISPR gRNA sequence
agggcctttccaaagttaca

SEQ ID NO: 717962 - DNA, 20 bp, Artificial
  CRISPR gRNA sequence
tccaaagttacaaaactctg

SEQ ID NO: 717963 - DNA, 20 bp, Artificial
  CRISPR gRNA sequence
ccaaagttacaaaactctgg

SEQ ID NO: 717964 - DNA, 20 bp, Artificial
  CRISPR gRNA sequence
caaagttacaaaactctggt

SEQ ID NO: 717965 - DNA, 20 bp, Artificial
  CRISPR gRNA sequence
caaaactctggtaagtggca

SEQ ID NO: 717966 - DNA, 20 bp, Artificial
  CRISPR gRNA sequence
tggtaagtggcagaactgga

SEQ ID NO: 717967 - DNA, 20 bp, Artificial
  CRISPR gRNA sequence
gtaagtggcagaactggagt

SEQ ID NO: 717968 - DNA, 20 bp, Artificial
  CRISPR gRNA sequence
gagtttgagttgtggcctga

SEQ ID NO: 717969 - DNA, 20 bp, Artificial
  CRISPR gRNA sequence
gagttgtggcctgacaccaa

SEQ ID NO: 717970 - DNA, 20 bp, Artificial
  CRISPR gRNA sequence
agttgtggcctgacaccaag

SEQ ID NO: 717971 - DNA, 20 bp, Artificial
  CRISPR gRNA sequence
tggcctgacaccaagagctg

SEQ ID NO: 717972 - DNA, 20 bp, Artificial
  CRISPR gRNA sequence
acaccaagagctgtgttctt

SEQ ID NO: 717973 - DNA, 20 bp, Artificial
  CRISPR gRNA sequence
tgttcttttcctaagatcac

SEQ ID NO: 717974 - DNA, 20 bp, Artificial
  CRISPR gRNA sequence
ttttcctaagatcacaggac

SEQ ID NO: 717975 - DNA, 20 bp, Artificial
  CRISPR gRNA sequence
ttcctaagatcacaggactt

SEQ ID NO: 717976 - DNA, 20 bp, Artificial
  CRISPR gRNA sequence
tcctaagatcacaggacttc

SEQ ID NO: 717977 - DNA, 20 bp, Artificial
  CRISPR gRNA sequence
cctaagatcacaggacttcc

SEQ ID NO: 717978 - DNA, 20 bp, Artificial
  CRISPR gRNA sequence
ctaagatcacaggacttcca

SEQ ID NO: 717979 - DNA, 20 bp, Artificial
  CRISPR gRNA sequence
agatcacaggacttccagga

SEQ ID NO: 717980 - DNA, 20 bp, Artificial
  CRISPR gRNA sequence
ccaggaaaactgtttcagta

SEQ ID NO: 717981 - DNA, 20 bp, Artificial
  CRISPR gRNA sequence
caggaaaactgtttcagtat

SEQ ID NO: 717982 - DNA, 20 bp, Artificial
  CRISPR gRNA sequence
tttcagtatgaccttttatt

SEQ ID NO: 717983 - DNA, 20 bp, Artificial
  CRISPR gRNA sequence
cagtatgaccttttattgtt

SEQ ID NO: 717984 - DNA, 20 bp, Artificial
  CRISPR gRNA sequence
agtatgaccttttattgtta

SEQ ID NO: 717985 - DNA, 20 bp, Artificial
  CRISPR gRNA sequence
ttattgttagtctcttatta

SEQ ID NO: 717986 - DNA, 20 bp, Artificial
  CRISPR gRNA sequence
tattgttagtctcttattat

SEQ ID NO: 717987 - DNA, 20 bp, Artificial
  CRISPR gRNA sequence
attgttagtctcttattatg

SEQ ID NO: 717988 - DNA, 20 bp, Artificial
  CRISPR gRNA sequence
ttgttagtctcttattatgg

SEQ ID NO: 717989 - DNA, 20 bp, Artificial
  CRISPR gRNA sequence
ttagtctcttattatggtta

SEQ ID NO: 717990 - DNA, 20 bp, Artificial
  CRISPR gRNA sequence
gtctcttattatggttagag

SEQ ID NO: 717991 - DNA, 20 bp, Artificial
  CRISPR gRNA sequence
ttattatggttagagaatgc

SEQ ID NO: 717992 - DNA, 20 bp, Artificial
  CRISPR gRNA sequence
attatggttagagaatgcag

SEQ ID NO: 717993 - DNA, 20 bp, Artificial
  CRISPR gRNA sequence
ttatggttagagaatgcagt

SEQ ID NO: 717994 - DNA, 20 bp, Artificial
  CRISPR gRNA sequence
tggttagagaatgcagtctg

SEQ ID NO: 717995 - DNA, 20 bp, Artificial
  CRISPR gRNA sequence
gagaatgcagtctgtgtgct

SEQ ID NO: 717996 - DNA, 20 bp, Artificial
  CRISPR gRNA sequence
tgtgctatctagtgtttatt

SEQ ID NO: 717997 - DNA, 20 bp, Artificial
  CRISPR gRNA sequence
tctagtgtttatttttgtgt

SEQ ID NO: 717998 - DNA, 20 bp, Artificial
  CRISPR gRNA sequence
gtgtttatttttgtgtggat

SEQ ID NO: 717999 - DNA, 20 bp, Artificial
  CRISPR gRNA sequence
atttttgtgtggattttttt

SEQ ID NO: 718000 - DNA, 20 bp, Artificial
  CRISPR gRNA sequence
tttttgtgtggatttttttg

SEQ ID NO: 718001 - DNA, 20 bp, Artificial
  CRISPR gRNA sequence
ttgtgtggatttttttgggg

SEQ ID NO: 718002 - DNA, 20 bp, Artificial
  CRISPR gRNA sequence
tgtgtggatttttttggggg

SEQ ID NO: 718003 - DNA, 20 bp, Artificial
  CRISPR gRNA sequence
gtgtggatttttttgggggg

SEQ ID NO: 718004 - DNA, 20 bp, Artificial
  CRISPR gRNA sequence
tgtggatttttttggggggt

SEQ ID NO: 718005 - DNA, 20 bp, Artificial
  CRISPR gRNA sequence
ttttggggggtagggtgggg

SEQ ID NO: 718006 - DNA, 20 bp, Artificial
  CRISPR gRNA sequence
tttggggggtagggtggggg

SEQ ID NO: 718007 - DNA, 20 bp, Artificial
  CRISPR gRNA sequence
ttggggggtagggtggggga

SEQ ID NO: 718008 - DNA, 20 bp, Artificial
  CRISPR gRNA sequence
tggggggtagggtgggggaa

SEQ ID NO: 718009 - DNA, 20 bp, Artificial
  CRISPR gRNA sequence
ggggggtagggtgggggaaa

SEQ ID NO: 718010 - DNA, 20 bp, Artificial
  CRISPR gRNA sequence
gggggtagggtgggggaaat

SEQ ID NO: 718011 - DNA, 20 bp, Artificial
  CRISPR gRNA sequence
gttgagatctttttgtggtc

SEQ ID NO: 718012 - DNA, 20 bp, Artificial
  CRISPR gRNA sequence
ttgagatctttttgtggtct

SEQ ID NO: 718013 - DNA, 20 bp, Artificial
  CRISPR gRNA sequence
agatctttttgtggtctaat

SEQ ID NO: 718014 - DNA, 20 bp, Artificial
  CRISPR gRNA sequence
tttgtggtctaataaataat

SEQ ID NO: 718015 - DNA, 20 bp, Artificial
  CRISPR gRNA sequence
ttgtggtctaataaataata

SEQ ID NO: 718016 - DNA, 20 bp, Artificial
  CRISPR gRNA sequence
tgtggtctaataaataataa

SEQ ID NO: 718017 - DNA, 20 bp, Artificial
  CRISPR gRNA sequence
gtggtctaataaataataaa

SEQ ID NO: 718018 - DNA, 20 bp, Artificial
  CRISPR gRNA sequence
tggtctaataaataataaat

SEQ ID NO: 718019 - DNA, 20 bp, Artificial
  CRISPR gRNA sequence
ataaataataaatgatcatg

SEQ ID NO: 718020 - DNA, 20 bp, Artificial
  CRISPR gRNA sequence
tcagagtgttcagtgtatgg

SEQ ID NO: 718021 - DNA, 20 bp, Artificial
  CRISPR gRNA sequence
cagagtgttcagtgtatggg

SEQ ID NO: 718022 - DNA, 20 bp, Artificial
  CRISPR gRNA sequence
agagtgttcagtgtatgggt

SEQ ID NO: 718023 - DNA, 20 bp, Artificial
  CRISPR gRNA sequence
agtgtatgggtgttttaaaa

SEQ ID NO: 718024 - DNA, 20 bp, Artificial
  CRISPR gRNA sequence
taaaatgtgtattctgtttg

SEQ ID NO: 718025 - DNA, 20 bp, Artificial
  CRISPR gRNA sequence
aaaatgtgtattctgtttgt

SEQ ID NO: 718026 - DNA, 20 bp, Artificial
  CRISPR gRNA sequence
aaatgtgtattctgtttgtt

SEQ ID NO: 718027 - DNA, 20 bp, Artificial
  CRISPR gRNA sequence
tgtttgttgcgtataaagtt

SEQ ID NO: 718028 - DNA, 20 bp, Artificial
  CRISPR gRNA sequence
tttgttgcgtataaagttct

SEQ ID NO: 718029 - DNA, 20 bp, Artificial
  CRISPR gRNA sequence
gttgcgtataaagttctcta

SEQ ID NO: 718030 - DNA, 20 bp, Artificial
  CRISPR gRNA sequence
ttgcgtataaagttctctac

SEQ ID NO: 718031 - DNA, 20 bp, Artificial
  CRISPR gRNA sequence
cgtataaagttctctacata

SEQ ID NO: 718032 - DNA, 20 bp, Artificial
  CRISPR gRNA sequence
tctacatatctattaagtta

SEQ ID NO: 718033 - DNA, 20 bp, Artificial
  CRISPR gRNA sequence
tacatatctattaagttaag

SEQ ID NO: 718034 - DNA, 20 bp, Artificial
  CRISPR gRNA sequence
catatctattaagttaagct

SEQ ID NO: 718035 - DNA, 20 bp, Artificial
  CRISPR gRNA sequence
ttaagttaagcttgttaatt

SEQ ID NO: 718036 - DNA, 20 bp, Artificial
  CRISPR gRNA sequence
agttaagcttgttaattgtg

SEQ ID NO: 718037 - DNA, 20 bp, Artificial
  CRISPR gRNA sequence
agcttgttaattgtgttatt

SEQ ID NO: 718038 - DNA, 20 bp, Artificial
  CRISPR gRNA sequence
gttaattgtgttatttaaat

SEQ ID NO: 718039 - DNA, 20 bp, Artificial
  CRISPR gRNA sequence
ttaattgtgttatttaaata

SEQ ID NO: 718040 - DNA, 20 bp, Artificial
  CRISPR gRNA sequence
attgtgttatttaaataatg

SEQ ID NO: 718041 - DNA, 20 bp, Artificial
  CRISPR gRNA sequence
tgttatttaaataatgtgta

SEQ ID NO: 718042 - DNA, 20 bp, Artificial
  CRISPR gRNA sequence
tttaaataatgtgtaccctt

SEQ ID NO: 718043 - DNA, 20 bp, Artificial
  CRISPR gRNA sequence
aaataatgtgtacccttatt

SEQ ID NO: 718044 - DNA, 20 bp, Artificial
  CRISPR gRNA sequence
aataatgtgtacccttattt

SEQ ID NO: 718045 - DNA, 20 bp, Artificial
  CRISPR gRNA sequence
atttacttttatcaccttta

SEQ ID NO: 718046 - DNA, 20 bp, Artificial
  CRISPR gRNA sequence
tttacttttatcacctttat

SEQ ID NO: 718047 - DNA, 20 bp, Artificial
  CRISPR gRNA sequence
acttttatcacctttatttc

SEQ ID NO: 718048 - DNA, 20 bp, Artificial
  CRISPR gRNA sequence
cttttatcacctttatttct

SEQ ID NO: 718049 - DNA, 20 bp, Artificial
  CRISPR gRNA sequence
ttatcacctttatttctgag

SEQ ID NO: 718050 - DNA, 20 bp, Artificial
  CRISPR gRNA sequence
tatcacctttatttctgaga

SEQ ID NO: 718051 - DNA, 20 bp, Artificial
  CRISPR gRNA sequence
atcacctttatttctgagag

SEQ ID NO: 718052 - DNA, 20 bp, Artificial
  CRISPR gRNA sequence
tcacctttatttctgagaga

SEQ ID NO: 718053 - DNA, 20 bp, Artificial
  CRISPR gRNA sequence
tatttctgagagatgtgtta

SEQ ID NO: 718054 - DNA, 20 bp, Artificial
  CRISPR gRNA sequence
atttctgagagatgtgttaa

SEQ ID NO: 718055 - DNA, 20 bp, Artificial
  CRISPR gRNA sequence
tttctgagagatgtgttaaa

SEQ ID NO: 718056 - DNA, 20 bp, Artificial
  CRISPR gRNA sequence
ctgagagatgtgttaaaatc

SEQ ID NO: 718057 - DNA, 20 bp, Artificial
  CRISPR gRNA sequence
tgagagatgtgttaaaatct

SEQ ID NO: 718058 - DNA, 20 bp, Artificial
  CRISPR gRNA sequence
agagatgtgttaaaatctta

SEQ ID NO: 718059 - DNA, 20 bp, Artificial
  CRISPR gRNA sequence
aaatcttatctcccagtata

SEQ ID NO: 718060 - DNA, 20 bp, Artificial
  CRISPR gRNA sequence
atctcccagtatacttgttc

SEQ ID NO: 718061 - DNA, 20 bp, Artificial
  CRISPR gRNA sequence
tctcccagtatacttgttca

SEQ ID NO: 718062 - DNA, 20 bp, Artificial
  CRISPR gRNA sequence
ccagtatacttgttcatcta

SEQ ID NO: 718063 - DNA, 20 bp, Artificial
  CRISPR gRNA sequence
gttcatctattagattttca

SEQ ID NO: 718064 - DNA, 20 bp, Artificial
  CRISPR gRNA sequence
ttcatctattagattttcat

SEQ ID NO: 718065 - DNA, 20 bp, Artificial
  CRISPR gRNA sequence
atctattagattttcattgt

SEQ ID NO: 718066 - DNA, 20 bp, Artificial
  CRISPR gRNA sequence
ttagattttcattgtgttct

SEQ ID NO: 718067 - DNA, 20 bp, Artificial
  CRISPR gRNA sequence
gattttcattgtgttctttc

SEQ ID NO: 718068 - DNA, 20 bp, Artificial
  CRISPR gRNA sequence
tcattgtgttctttctattt

SEQ ID NO: 718069 - DNA, 20 bp, Artificial
  CRISPR gRNA sequence
cattgtgttctttctatttt

SEQ ID NO: 718070 - DNA, 20 bp, Artificial
  CRISPR gRNA sequence
attgtgttctttctattttt

SEQ ID NO: 718071 - DNA, 20 bp, Artificial
  CRISPR gRNA sequence
tgttctttctatttttgctt

SEQ ID NO: 718072 - DNA, 20 bp, Artificial
  CRISPR gRNA sequence
tttctatttttgcttcatat

SEQ ID NO: 718073 - DNA, 20 bp, Artificial
  CRISPR gRNA sequence
tctatttttgcttcatatat

SEQ ID NO: 718074 - DNA, 20 bp, Artificial
  CRISPR gRNA sequence
ctatttttgcttcatatatg

SEQ ID NO: 718075 - DNA, 20 bp, Artificial
  CRISPR gRNA sequence
tatttttgcttcatatatgt

SEQ ID NO: 718076 - DNA, 20 bp, Artificial
  CRISPR gRNA sequence
tttttgcttcatatatgtca

SEQ ID NO: 718077 - DNA, 20 bp, Artificial
  CRISPR gRNA sequence
ttgcttcatatatgtcaaag

SEQ ID NO: 718078 - DNA, 20 bp, Artificial
  CRISPR gRNA sequence
tgcttcatatatgtcaaagc

SEQ ID NO: 718079 - DNA, 20 bp, Artificial
  CRISPR gRNA sequence
gcttcatatatgtcaaagct

SEQ ID NO: 718080 - DNA, 20 bp, Artificial
  CRISPR gRNA sequence
cttcatatatgtcaaagcta

SEQ ID NO: 718081 - DNA, 20 bp, Artificial
  CRISPR gRNA sequence
catatatgtcaaagctatgt

SEQ ID NO: 718082 - DNA, 20 bp, Artificial
  CRISPR gRNA sequence
atatatgtcaaagctatgtt

SEQ ID NO: 718083 - DNA, 20 bp, Artificial
  CRISPR gRNA sequence
tgttattaggtacataaatg

SEQ ID NO: 718084 - DNA, 20 bp, Artificial
  CRISPR gRNA sequence
ttaggtacataaatgttcat

SEQ ID NO: 718085 - DNA, 20 bp, Artificial
  CRISPR gRNA sequence
ggtacataaatgttcatgaa

SEQ ID NO: 718086 - DNA, 20 bp, Artificial
  CRISPR gRNA sequence
atgaatgttatgtttttttg

SEQ ID NO: 718087 - DNA, 20 bp, Artificial
  CRISPR gRNA sequence
tgtttttttggtgggttggg

SEQ ID NO: 718088 - DNA, 20 bp, Artificial
  CRISPR gRNA sequence
ttttggtgggttgggctttt

SEQ ID NO: 718089 - DNA, 20 bp, Artificial
  CRISPR gRNA sequence
tttggtgggttgggcttttt

SEQ ID NO: 718090 - DNA, 20 bp, Artificial
  CRISPR gRNA sequence
ttggtgggttgggcttttta

SEQ ID NO: 718091 - DNA, 20 bp, Artificial
  CRISPR gRNA sequence
tggtgggttgggctttttat

SEQ ID NO: 718092 - DNA, 20 bp, Artificial
  CRISPR gRNA sequence
ggtgggttgggctttttatc

SEQ ID NO: 718093 - DNA, 20 bp, Artificial
  CRISPR gRNA sequence
gtgggttgggctttttatcc

SEQ ID NO: 718094 - DNA, 20 bp, Artificial
  CRISPR gRNA sequence
ggctttttatccacatgaat

SEQ ID NO: 718095 - DNA, 20 bp, Artificial
  CRISPR gRNA sequence
tttatccacatgaatatacc

SEQ ID NO: 718096 - DNA, 20 bp, Artificial
  CRISPR gRNA sequence
ttatccacatgaatatacct

SEQ ID NO: 718097 - DNA, 20 bp, Artificial
  CRISPR gRNA sequence
tatccacatgaatatacctc

SEQ ID NO: 718098 - DNA, 20 bp, Artificial
  CRISPR gRNA sequence
atccacatgaatatacctct

SEQ ID NO: 718099 - DNA, 20 bp, Artificial
  CRISPR gRNA sequence
tccacatgaatatacctctc

SEQ ID NO: 718100 - DNA, 20 bp, Artificial
  CRISPR gRNA sequence
tccattccttgtaatgcctt

SEQ ID NO: 718101 - DNA, 20 bp, Artificial
  CRISPR gRNA sequence
cattccttgtaatgcctttt

SEQ ID NO: 718102 - DNA, 20 bp, Artificial
  CRISPR gRNA sequence
cttgtaatgccttttccctt

SEQ ID NO: 718103 - DNA, 20 bp, Artificial
  CRISPR gRNA sequence
gtaatgccttttcccttaat

SEQ ID NO: 718104 - DNA, 20 bp, Artificial
  CRISPR gRNA sequence
taatgccttttcccttaatt

SEQ ID NO: 718105 - DNA, 20 bp, Artificial
  CRISPR gRNA sequence
ttcccttaatttcacatttg

SEQ ID NO: 718106 - DNA, 20 bp, Artificial
  CRISPR gRNA sequence
tcccttaatttcacatttgt

SEQ ID NO: 718107 - DNA, 20 bp, Artificial
  CRISPR gRNA sequence
cccttaatttcacatttgtt

SEQ ID NO: 718108 - DNA, 20 bp, Artificial
  CRISPR gRNA sequence
ccttaatttcacatttgttt

SEQ ID NO: 718109 - DNA, 20 bp, Artificial
  CRISPR gRNA sequence
aatttcacatttgtttggca

SEQ ID NO: 718110 - DNA, 20 bp, Artificial
  CRISPR gRNA sequence
atttcacatttgtttggcat

SEQ ID NO: 718111 - DNA, 20 bp, Artificial
  CRISPR gRNA sequence
cacatttgtttggcattaat

SEQ ID NO: 718112 - DNA, 20 bp, Artificial
  CRISPR gRNA sequence
acatttgtttggcattaata

SEQ ID NO: 718113 - DNA, 20 bp, Artificial
  CRISPR gRNA sequence
gtttggcattaatattgcta

SEQ ID NO: 718114 - DNA, 20 bp, Artificial
  CRISPR gRNA sequence
tttggcattaatattgctat

SEQ ID NO: 718115 - DNA, 20 bp, Artificial
  CRISPR gRNA sequence
ggcattaatattgctattcc

SEQ ID NO: 718116 - DNA, 20 bp, Artificial
  CRISPR gRNA sequence
gcattaatattgctattcct

SEQ ID NO: 718117 - DNA, 20 bp, Artificial
  CRISPR gRNA sequence
atattgctattccttcctgg

SEQ ID NO: 718118 - DNA, 20 bp, Artificial
  CRISPR gRNA sequence
ctattccttcctggaagaag

SEQ ID NO: 718119 - DNA, 20 bp, Artificial
  CRISPR gRNA sequence
ttccttcctggaagaagtag

SEQ ID NO: 718120 - DNA, 20 bp, Artificial
  CRISPR gRNA sequence
cttcctggaagaagtagcaa

SEQ ID NO: 718121 - DNA, 20 bp, Artificial
  CRISPR gRNA sequence
cctggaagaagtagcaaagg

SEQ ID NO: 718122 - DNA, 20 bp, Artificial
  CRISPR gRNA sequence
ctggaagaagtagcaaaggt

SEQ ID NO: 718123 - DNA, 20 bp, Artificial
  CRISPR gRNA sequence
gaagaagtagcaaaggttaa

SEQ ID NO: 718124 - DNA, 20 bp, Artificial
  CRISPR gRNA sequence
aaaagaaagaaaagtaataa

SEQ ID NO: 718125 - DNA, 20 bp, Artificial
  CRISPR gRNA sequence
ccatttcttctttcttttta

SEQ ID NO: 718126 - DNA, 20 bp, Artificial
  CRISPR gRNA sequence
cttctttctttttattagca

SEQ ID NO: 718127 - DNA, 20 bp, Artificial
  CRISPR gRNA sequence
ttctttctttttattagcat

SEQ ID NO: 718128 - DNA, 20 bp, Artificial
  CRISPR gRNA sequence
ctttctttttattagcattt

SEQ ID NO: 718129 - DNA, 20 bp, Artificial
  CRISPR gRNA sequence
tttctttttattagcattta

SEQ ID NO: 718130 - DNA, 20 bp, Artificial
  CRISPR gRNA sequence
tctttttattagcatttatc

SEQ ID NO: 718131 - DNA, 20 bp, Artificial
  CRISPR gRNA sequence
ctttttattagcatttatct

SEQ ID NO: 718132 - DNA, 20 bp, Artificial
  CRISPR gRNA sequence
tttttattagcatttatctg

SEQ ID NO: 718133 - DNA, 20 bp, Artificial
  CRISPR gRNA sequence
tttattagcatttatctggt

SEQ ID NO: 718134 - DNA, 20 bp, Artificial
  CRISPR gRNA sequence
ttattagcatttatctggtg

SEQ ID NO: 718135 - DNA, 20 bp, Artificial
  CRISPR gRNA sequence
tattagcatttatctggtgt

SEQ ID NO: 718136 - DNA, 20 bp, Artificial
  CRISPR gRNA sequence
attagcatttatctggtgta

SEQ ID NO: 718137 - DNA, 20 bp, Artificial
  CRISPR gRNA sequence
ttagcatttatctggtgtat

SEQ ID NO: 718138 - DNA, 20 bp, Artificial
  CRISPR gRNA sequence
gcatttatctggtgtatctt

SEQ ID NO: 718139 - DNA, 20 bp, Artificial
  CRISPR gRNA sequence
atctggtgtatctttgaatt

SEQ ID NO: 718140 - DNA, 20 bp, Artificial
  CRISPR gRNA sequence
tctggtgtatctttgaattt

SEQ ID NO: 718141 - DNA, 20 bp, Artificial
  CRISPR gRNA sequence
gtgtatctttgaatttctaa

SEQ ID NO: 718142 - DNA, 20 bp, Artificial
  CRISPR gRNA sequence
tgaatttctaaaagtaatga

SEQ ID NO: 718143 - DNA, 20 bp, Artificial
  CRISPR gRNA sequence
gaatttctaaaagtaatgac

SEQ ID NO: 718144 - DNA, 20 bp, Artificial
  CRISPR gRNA sequence
aatttctaaaagtaatgact

SEQ ID NO: 718145 - DNA, 20 bp, Artificial
  CRISPR gRNA sequence
ctaaaagtaatgactgcatt

SEQ ID NO: 718146 - DNA, 20 bp, Artificial
  CRISPR gRNA sequence
taaaagtaatgactgcattt

SEQ ID NO: 718147 - DNA, 20 bp, Artificial
  CRISPR gRNA sequence
aaagtaatgactgcatttta

SEQ ID NO: 718148 - DNA, 20 bp, Artificial
  CRISPR gRNA sequence
cattttatgaaatgaaaatt

SEQ ID NO: 718149 - DNA, 20 bp, Artificial
  CRISPR gRNA sequence
tatgaaatgaaaattataaa

SEQ ID NO: 718150 - DNA, 20 bp, Artificial
  CRISPR gRNA sequence
atgaaatgaaaattataaac

SEQ ID NO: 718151 - DNA, 20 bp, Artificial
  CRISPR gRNA sequence
tgaaatgaaaattataaaca

SEQ ID NO: 718152 - DNA, 20 bp, Artificial
  CRISPR gRNA sequence
taaacatttattatttaaaa

SEQ ID NO: 718153 - DNA, 20 bp, Artificial
  CRISPR gRNA sequence
attatttaaaattcaagcaa

SEQ ID NO: 718154 - DNA, 20 bp, Artificial
  CRISPR gRNA sequence
ttatttaaaattcaagcaat

SEQ ID NO: 718155 - DNA, 20 bp, Artificial
  CRISPR gRNA sequence
tttaaaattcaagcaataca

SEQ ID NO: 718156 - DNA, 20 bp, Artificial
  CRISPR gRNA sequence
aaaattcaagcaatacaaag

SEQ ID NO: 718157 - DNA, 20 bp, Artificial
  CRISPR gRNA sequence
aaattcaagcaatacaaaga

SEQ ID NO: 718158 - DNA, 20 bp, Artificial
  CRISPR gRNA sequence
aagcaatacaaagagtgtaa

SEQ ID NO: 718159 - DNA, 20 bp, Artificial
  CRISPR gRNA sequence
ccctccccagccctccatct

SEQ ID NO: 718160 - DNA, 20 bp, Artificial
  CRISPR gRNA sequence
cccagccctccatctataga

SEQ ID NO: 718161 - DNA, 20 bp, Artificial
  CRISPR gRNA sequence
catctatagataactactat

SEQ ID NO: 718162 - DNA, 20 bp, Artificial
  CRISPR gRNA sequence
tagataactactattatcat

SEQ ID NO: 718163 - DNA, 20 bp, Artificial
  CRISPR gRNA sequence
ctattatcattagatggctg

SEQ ID NO: 718164 - DNA, 20 bp, Artificial
  CRISPR gRNA sequence
ttatcattagatggctgaca

SEQ ID NO: 718165 - DNA, 20 bp, Artificial
  CRISPR gRNA sequence
tcattagatggctgacacgc

SEQ ID NO: 718166 - DNA, 20 bp, Artificial
  CRISPR gRNA sequence
gatggctgacacgcctctac

SEQ ID NO: 718167 - DNA, 20 bp, Artificial
  CRISPR gRNA sequence
acacgcctctacctctctgt

SEQ ID NO: 718168 - DNA, 20 bp, Artificial
  CRISPR gRNA sequence
tacctctctgtataaagatg

SEQ ID NO: 718169 - DNA, 20 bp, Artificial
  CRISPR gRNA sequence
cctctctgtataaagatggg

SEQ ID NO: 718170 - DNA, 20 bp, Artificial
  CRISPR gRNA sequence
tctgtataaagatgggtagg

SEQ ID NO: 718171 - DNA, 20 bp, Artificial
  CRISPR gRNA sequence
tgtataaagatgggtaggtt

SEQ ID NO: 718172 - DNA, 20 bp, Artificial
  CRISPR gRNA sequence
tataaagatgggtaggttag

SEQ ID NO: 718173 - DNA, 20 bp, Artificial
  CRISPR gRNA sequence
gtaaccagacagcctgtaca

SEQ ID NO: 718174 - DNA, 20 bp, Artificial
  CRISPR gRNA sequence
tacacacttacaaagaagga

SEQ ID NO: 718175 - DNA, 20 bp, Artificial
  CRISPR gRNA sequence
acaaagaaggaattttaaga

SEQ ID NO: 718176 - DNA, 20 bp, Artificial
  CRISPR gRNA sequence
caaagaaggaattttaagag

SEQ ID NO: 718177 - DNA, 20 bp, Artificial
  CRISPR gRNA sequence
taagagaatggcaacatatt

SEQ ID NO: 718178 - DNA, 20 bp, Artificial
  CRISPR gRNA sequence
aagagaatggcaacatattt

SEQ ID NO: 718179 - DNA, 20 bp, Artificial
  CRISPR gRNA sequence
agagaatggcaacatattta

SEQ ID NO: 718180 - DNA, 20 bp, Artificial
  CRISPR gRNA sequence
atggcattaaaatgataata

SEQ ID NO: 718181 - DNA, 20 bp, Artificial
  CRISPR gRNA sequence
tggcattaaaatgataatat

SEQ ID NO: 718182 - DNA, 20 bp, Artificial
  CRISPR gRNA sequence
aaatgataatatttaatttt

SEQ ID NO: 718183 - DNA, 20 bp, Artificial
  CRISPR gRNA sequence
aattttagtcaaaagtatca

SEQ ID NO: 718184 - DNA, 20 bp, Artificial
  CRISPR gRNA sequence
attttagtcaaaagtatcag

SEQ ID NO: 718185 - DNA, 20 bp, Artificial
  CRISPR gRNA sequence
tagtcaaaagtatcagaaaa

SEQ ID NO: 718186 - DNA, 20 bp, Artificial
  CRISPR gRNA sequence
agtcaaaagtatcagaaaaa

SEQ ID NO: 718187 - DNA, 20 bp, Artificial
  CRISPR gRNA sequence
gtcaaaagtatcagaaaaag

SEQ ID NO: 718188 - DNA, 20 bp, Artificial
  CRISPR gRNA sequence
agtcagattaatgtatcttc

SEQ ID NO: 718189 - DNA, 20 bp, Artificial
  CRISPR gRNA sequence
atgtatcttcagcaaaagat

SEQ ID NO: 718190 - DNA, 20 bp, Artificial
  CRISPR gRNA sequence
cagcaaaagatactgcaatt

SEQ ID NO: 718191 - DNA, 20 bp, Artificial
  CRISPR gRNA sequence
agcaaaagatactgcaattc

SEQ ID NO: 718192 - DNA, 20 bp, Artificial
  CRISPR gRNA sequence
caattcctttaaaaaaaaaa

SEQ ID NO: 718193 - DNA, 20 bp, Artificial
  CRISPR gRNA sequence
ctttaaaaaaaaaaaccctc

SEQ ID NO: 718194 - DNA, 20 bp, Artificial
  CRISPR gRNA sequence
taaaaaaaaaaaccctctaa

SEQ ID NO: 718195 - DNA, 20 bp, Artificial
  CRISPR gRNA sequence
aaaaaaaaaaaccctctaaa

SEQ ID NO: 718196 - DNA, 20 bp, Artificial
  CRISPR gRNA sequence
aaaaaaaaaaccctctaaaa

SEQ ID NO: 718197 - DNA, 20 bp, Artificial
  CRISPR gRNA sequence
taaaattaagaaaggaggtt

SEQ ID NO: 718198 - DNA, 20 bp, Artificial
  CRISPR gRNA sequence
aaattaagaaaggaggttat

SEQ ID NO: 718199 - DNA, 20 bp, Artificial
  CRISPR gRNA sequence
agaaaggaggttatgaaaat

SEQ ID NO: 718200 - DNA, 20 bp, Artificial
  CRISPR gRNA sequence
tgaaaatcagtaagtggtta

SEQ ID NO: 718201 - DNA, 20 bp, Artificial
  CRISPR gRNA sequence
ataatcatttcagaatctac

SEQ ID NO: 718202 - DNA, 20 bp, Artificial
  CRISPR gRNA sequence
cagaatctactatctcttgc

SEQ ID NO: 718203 - DNA, 20 bp, Artificial
  CRISPR gRNA sequence
agaatctactatctcttgca

SEQ ID NO: 718204 - DNA, 20 bp, Artificial
  CRISPR gRNA sequence
ctatctcttgcagtaaaggc

SEQ ID NO: 718205 - DNA, 20 bp, Artificial
  CRISPR gRNA sequence
tctcttgcagtaaaggcaaa

SEQ ID NO: 718206 - DNA, 20 bp, Artificial
  CRISPR gRNA sequence
ttgcagtaaaggcaaaatct

SEQ ID NO: 718207 - DNA, 20 bp, Artificial
  CRISPR gRNA sequence
gcagtaaaggcaaaatctgc

SEQ ID NO: 718208 - DNA, 20 bp, Artificial
  CRISPR gRNA sequence
cagtaaaggcaaaatctgct

SEQ ID NO: 718209 - DNA, 20 bp, Artificial
  CRISPR gRNA sequence
cttagtttgagttttggaca

SEQ ID NO: 718210 - DNA, 20 bp, Artificial
  CRISPR gRNA sequence
agtttgagttttggacagta

SEQ ID NO: 718211 - DNA, 20 bp, Artificial
  CRISPR gRNA sequence
gtttgagttttggacagtag

SEQ ID NO: 718212 - DNA, 20 bp, Artificial
  CRISPR gRNA sequence
gagttttggacagtagagaa

SEQ ID NO: 718213 - DNA, 20 bp, Artificial
  CRISPR gRNA sequence
agttttggacagtagagaat

SEQ ID NO: 718214 - DNA, 20 bp, Artificial
  CRISPR gRNA sequence
tggacagtagagaatagatt

SEQ ID NO: 718215 - DNA, 20 bp, Artificial
  CRISPR gRNA sequence
ggacagtagagaatagattg

SEQ ID NO: 718216 - DNA, 20 bp, Artificial
  CRISPR gRNA sequence
gacagtagagaatagattga

SEQ ID NO: 718217 - DNA, 20 bp, Artificial
  CRISPR gRNA sequence
actccctgtaatgaagaaca

SEQ ID NO: 718218 - DNA, 20 bp, Artificial
  CRISPR gRNA sequence
cctgtaatgaagaacaaagt

SEQ ID NO: 718219 - DNA, 20 bp, Artificial
  CRISPR gRNA sequence
taatgaagaacaaagtaatt

SEQ ID NO: 718220 - DNA, 20 bp, Artificial
  CRISPR gRNA sequence
tttttcccacctcctcatcc

SEQ ID NO: 718221 - DNA, 20 bp, Artificial
  CRISPR gRNA sequence
ttcccacctcctcatcctct

SEQ ID NO: 718222 - DNA, 20 bp, Artificial
  CRISPR gRNA sequence
tcccacctcctcatcctctt

SEQ ID NO: 718223 - DNA, 20 bp, Artificial
  CRISPR gRNA sequence
cccacctcctcatcctcttc

SEQ ID NO: 718224 - DNA, 20 bp, Artificial
  CRISPR gRNA sequence
ccacctcctcatcctcttcc

SEQ ID NO: 718225 - DNA, 20 bp, Artificial
  CRISPR gRNA sequence
ctcatcctcttcctgacttt

SEQ ID NO: 718226 - DNA, 20 bp, Artificial
  CRISPR gRNA sequence
atcctcttcctgacttttat

SEQ ID NO: 718227 - DNA, 20 bp, Artificial
  CRISPR gRNA sequence
ttcctgacttttattcctta

SEQ ID NO: 718228 - DNA, 20 bp, Artificial
  CRISPR gRNA sequence
cctgacttttattccttaca

SEQ ID NO: 718229 - DNA, 20 bp, Artificial
  CRISPR gRNA sequence
ctgacttttattccttacac

SEQ ID NO: 718230 - DNA, 20 bp, Artificial
  CRISPR gRNA sequence
acttttattccttacacaaa

SEQ ID NO: 718231 - DNA, 20 bp, Artificial
  CRISPR gRNA sequence
ttattccttacacaaatttt

SEQ ID NO: 718232 - DNA, 20 bp, Artificial
  CRISPR gRNA sequence
tattccttacacaaatttta

SEQ ID NO: 718233 - DNA, 20 bp, Artificial
  CRISPR gRNA sequence
attccttacacaaattttac

SEQ ID NO: 718234 - DNA, 20 bp, Artificial
  CRISPR gRNA sequence
ttccttacacaaattttact

SEQ ID NO: 718235 - DNA, 20 bp, Artificial
  CRISPR gRNA sequence
cttacacaaattttactttg

SEQ ID NO: 718236 - DNA, 20 bp, Artificial
  CRISPR gRNA sequence
acacaaattttactttgtca

SEQ ID NO: 718237 - DNA, 20 bp, Artificial
  CRISPR gRNA sequence
cacaaattttactttgtcat

SEQ ID NO: 718238 - DNA, 20 bp, Artificial
  CRISPR gRNA sequence
tactttgtcataatctataa

SEQ ID NO: 718239 - DNA, 20 bp, Artificial
  CRISPR gRNA sequence
actttgtcataatctataat

SEQ ID NO: 718240 - DNA, 20 bp, Artificial
  CRISPR gRNA sequence
ctttgtcataatctataatg

SEQ ID NO: 718241 - DNA, 20 bp, Artificial
  CRISPR gRNA sequence
tgtcataatctataatgttt

SEQ ID NO: 718242 - DNA, 20 bp, Artificial
  CRISPR gRNA sequence
gtcataatctataatgttta

SEQ ID NO: 718243 - DNA, 20 bp, Artificial
  CRISPR gRNA sequence
tcataatctataatgtttat

SEQ ID NO: 718244 - DNA, 20 bp, Artificial
  CRISPR gRNA sequence
taatgtttatattctcatct

SEQ ID NO: 718245 - DNA, 20 bp, Artificial
  CRISPR gRNA sequence
atattctcatctgcaaccat

SEQ ID NO: 718246 - DNA, 20 bp, Artificial
  CRISPR gRNA sequence
tattctcatctgcaaccata

SEQ ID NO: 718247 - DNA, 20 bp, Artificial
  CRISPR gRNA sequence
tcatctgcaaccataagtcc

SEQ ID NO: 718248 - DNA, 20 bp, Artificial
  CRISPR gRNA sequence
atctgcaaccataagtccct

SEQ ID NO: 718249 - DNA, 20 bp, Artificial
  CRISPR gRNA sequence
caaccataagtcccttggca

SEQ ID NO: 718250 - DNA, 20 bp, Artificial
  CRISPR gRNA sequence
ggcatgttagccttaacatt

SEQ ID NO: 718251 - DNA, 20 bp, Artificial
  CRISPR gRNA sequence
gcatgttagccttaacattt

SEQ ID NO: 718252 - DNA, 20 bp, Artificial
  CRISPR gRNA sequence
gccttaacattttttattat

SEQ ID NO: 718253 - DNA, 20 bp, Artificial
  CRISPR gRNA sequence
aacattttttattattcatg

SEQ ID NO: 718254 - DNA, 20 bp, Artificial
  CRISPR gRNA sequence
acattttttattattcatga

SEQ ID NO: 718255 - DNA, 20 bp, Artificial
  CRISPR gRNA sequence
tttattattcatgatgagtt

SEQ ID NO: 718256 - DNA, 20 bp, Artificial
  CRISPR gRNA sequence
ttattattcatgatgagttt

SEQ ID NO: 718257 - DNA, 20 bp, Artificial
  CRISPR gRNA sequence
tattattcatgatgagttta

SEQ ID NO: 718258 - DNA, 20 bp, Artificial
  CRISPR gRNA sequence
attattcatgatgagtttat

SEQ ID NO: 718259 - DNA, 20 bp, Artificial
  CRISPR gRNA sequence
ttattcatgatgagtttatt

SEQ ID NO: 718260 - DNA, 20 bp, Artificial
  CRISPR gRNA sequence
ttcatgatgagtttatttgg

SEQ ID NO: 718261 - DNA, 20 bp, Artificial
  CRISPR gRNA sequence
atgatgagtttatttggcac

SEQ ID NO: 718262 - DNA, 20 bp, Artificial
  CRISPR gRNA sequence
atttggcacagcttctctgt

SEQ ID NO: 718263 - DNA, 20 bp, Artificial
  CRISPR gRNA sequence
tttggcacagcttctctgtt

SEQ ID NO: 718264 - DNA, 20 bp, Artificial
  CRISPR gRNA sequence
ggcacagcttctctgttcct

SEQ ID NO: 718265 - DNA, 20 bp, Artificial
  CRISPR gRNA sequence
gcacagcttctctgttcctg

SEQ ID NO: 718266 - DNA, 20 bp, Artificial
  CRISPR gRNA sequence
ctctgttcctgagtttttca

SEQ ID NO: 718267 - DNA, 20 bp, Artificial
  CRISPR gRNA sequence
tctgttcctgagtttttcac

SEQ ID NO: 718268 - DNA, 20 bp, Artificial
  CRISPR gRNA sequence
tgttcctgagtttttcactt

SEQ ID NO: 718269 - DNA, 20 bp, Artificial
  CRISPR gRNA sequence
ttcctgagtttttcactttg

SEQ ID NO: 718270 - DNA, 20 bp, Artificial
  CRISPR gRNA sequence
ctgagtttttcactttgatt

SEQ ID NO: 718271 - DNA, 20 bp, Artificial
  CRISPR gRNA sequence
agtttttcactttgattcat

SEQ ID NO: 718272 - DNA, 20 bp, Artificial
  CRISPR gRNA sequence
ttcactttgattcatcattt

SEQ ID NO: 718273 - DNA, 20 bp, Artificial
  CRISPR gRNA sequence
tcactttgattcatcatttg

SEQ ID NO: 718274 - DNA, 20 bp, Artificial
  CRISPR gRNA sequence
cactttgattcatcatttga

SEQ ID NO: 718275 - DNA, 20 bp, Artificial
  CRISPR gRNA sequence
actttgattcatcatttgag

SEQ ID NO: 718276 - DNA, 20 bp, Artificial
  CRISPR gRNA sequence
tgattcatcatttgagtgat

SEQ ID NO: 718277 - DNA, 20 bp, Artificial
  CRISPR gRNA sequence
gattcatcatttgagtgatt

SEQ ID NO: 718278 - DNA, 20 bp, Artificial
  CRISPR gRNA sequence
attcatcatttgagtgattg

SEQ ID NO: 718279 - DNA, 20 bp, Artificial
  CRISPR gRNA sequence
atcatttgagtgattggatt

SEQ ID NO: 718280 - DNA, 20 bp, Artificial
  CRISPR gRNA sequence
gagtgattggattacactgt

SEQ ID NO: 718281 - DNA, 20 bp, Artificial
  CRISPR gRNA sequence
agtgattggattacactgtc

SEQ ID NO: 718282 - DNA, 20 bp, Artificial
  CRISPR gRNA sequence
gattacactgtcaggtggat

SEQ ID NO: 718283 - DNA, 20 bp, Artificial
  CRISPR gRNA sequence
cactgtcaggtggatttttc

SEQ ID NO: 718284 - DNA, 20 bp, Artificial
  CRISPR gRNA sequence
tcaggtggatttttcaagaa

SEQ ID NO: 718285 - DNA, 20 bp, Artificial
  CRISPR gRNA sequence
ttcaagaagggctcgtcttt

SEQ ID NO: 718286 - DNA, 20 bp, Artificial
  CRISPR gRNA sequence
tcaagaagggctcgtctttg

SEQ ID NO: 718287 - DNA, 20 bp, Artificial
  CRISPR gRNA sequence
caagaagggctcgtctttgc

SEQ ID NO: 718288 - DNA, 20 bp, Artificial
  CRISPR gRNA sequence
aagaagggctcgtctttgca

SEQ ID NO: 718289 - DNA, 20 bp, Artificial
  CRISPR gRNA sequence
gtctttgcaatattctctgt

SEQ ID NO: 718290 - DNA, 20 bp, Artificial
  CRISPR gRNA sequence
tgcaatattctctgttattt

SEQ ID NO: 718291 - DNA, 20 bp, Artificial
  CRISPR gRNA sequence
gcaatattctctgttatttc

SEQ ID NO: 718292 - DNA, 20 bp, Artificial
  CRISPR gRNA sequence
caatattctctgttatttca

SEQ ID NO: 718293 - DNA, 20 bp, Artificial
  CRISPR gRNA sequence
tctgttatttcatgtttgag

SEQ ID NO: 718294 - DNA, 20 bp, Artificial
  CRISPR gRNA sequence
tgttatttcatgtttgagga

SEQ ID NO: 718295 - DNA, 20 bp, Artificial
  CRISPR gRNA sequence
ttatttcatgtttgaggatg

SEQ ID NO: 718296 - DNA, 20 bp, Artificial
  CRISPR gRNA sequence
tttcatgtttgaggatgctt

SEQ ID NO: 718297 - DNA, 20 bp, Artificial
  CRISPR gRNA sequence
catgtttgaggatgcttgtc

SEQ ID NO: 718298 - DNA, 20 bp, Artificial
  CRISPR gRNA sequence
atgtttgaggatgcttgtct

SEQ ID NO: 718299 - DNA, 20 bp, Artificial
  CRISPR gRNA sequence
gaggatgcttgtctgttgcc

SEQ ID NO: 718300 - DNA, 20 bp, Artificial
  CRISPR gRNA sequence
aggatgcttgtctgttgcct

SEQ ID NO: 718301 - DNA, 20 bp, Artificial
  CRISPR gRNA sequence
gtctgttgcctatatttttg

SEQ ID NO: 718302 - DNA, 20 bp, Artificial
  CRISPR gRNA sequence
tctgttgcctatatttttgt

SEQ ID NO: 718303 - DNA, 20 bp, Artificial
  CRISPR gRNA sequence
ttgcctatatttttgttttc

SEQ ID NO: 718304 - DNA, 20 bp, Artificial
  CRISPR gRNA sequence
cctatatttttgttttcttt

SEQ ID NO: 718305 - DNA, 20 bp, Artificial
  CRISPR gRNA sequence
tatttttgttttcttttttt

SEQ ID NO: 718306 - DNA, 20 bp, Artificial
  CRISPR gRNA sequence
ttgttttcttttttttcttt

SEQ ID NO: 718307 - DNA, 20 bp, Artificial
  CRISPR gRNA sequence
tgttttcttttttttctttt

SEQ ID NO: 718308 - DNA, 20 bp, Artificial
  CRISPR gRNA sequence
gttttcttttttttcttttt

SEQ ID NO: 718309 - DNA, 20 bp, Artificial
  CRISPR gRNA sequence
ttttcttttttttctttttg

SEQ ID NO: 718310 - DNA, 20 bp, Artificial
  CRISPR gRNA sequence
tcttttttttctttttgaga

SEQ ID NO: 718311 - DNA, 20 bp, Artificial
  CRISPR gRNA sequence
cttttttttctttttgagac

SEQ ID NO: 718312 - DNA, 20 bp, Artificial
  CRISPR gRNA sequence
ttttttttctttttgagaca

SEQ ID NO: 718313 - DNA, 20 bp, Artificial
  CRISPR gRNA sequence
ttttttctttttgagacaga

SEQ ID NO: 718314 - DNA, 20 bp, Artificial
  CRISPR gRNA sequence
tttttctttttgagacagag

SEQ ID NO: 718315 - DNA, 20 bp, Artificial
  CRISPR gRNA sequence
ttttctttttgagacagagt

SEQ ID NO: 718316 - DNA, 20 bp, Artificial
  CRISPR gRNA sequence
tttctttttgagacagagtc

SEQ ID NO: 718317 - DNA, 20 bp, Artificial
  CRISPR gRNA sequence
ttctttttgagacagagtct

SEQ ID NO: 718318 - DNA, 20 bp, Artificial
  CRISPR gRNA sequence
tctttttgagacagagtctg

SEQ ID NO: 718319 - DNA, 20 bp, Artificial
  CRISPR gRNA sequence
ctttttgagacagagtctga

SEQ ID NO: 718320 - DNA, 20 bp, Artificial
  CRISPR gRNA sequence
tttttgagacagagtctgac

SEQ ID NO: 718321 - DNA, 20 bp, Artificial
  CRISPR gRNA sequence
tttgagacagagtctgactc

SEQ ID NO: 718322 - DNA, 20 bp, Artificial
  CRISPR gRNA sequence
ttgagacagagtctgactct

SEQ ID NO: 718323 - DNA, 20 bp, Artificial
  CRISPR gRNA sequence
tgagacagagtctgactctg

SEQ ID NO: 718324 - DNA, 20 bp, Artificial
  CRISPR gRNA sequence
gagacagagtctgactctgt

SEQ ID NO: 718325 - DNA, 20 bp, Artificial
  CRISPR gRNA sequence
agacagagtctgactctgtc

SEQ ID NO: 718326 - DNA, 20 bp, Artificial
  CRISPR gRNA sequence
actctgtcgcccaggctgga

SEQ ID NO: 718327 - DNA, 20 bp, Artificial
  CRISPR gRNA sequence
tgtcgcccaggctggagtgc

SEQ ID NO: 718328 - DNA, 20 bp, Artificial
  CRISPR gRNA sequence
tcgcccaggctggagtgcag

SEQ ID NO: 718329 - DNA, 20 bp, Artificial
  CRISPR gRNA sequence
gagtgcagtggtgcaatctc

SEQ ID NO: 718330 - DNA, 20 bp, Artificial
  CRISPR gRNA sequence
ggctcactacaacctctacc

SEQ ID NO: 718331 - DNA, 20 bp, Artificial
  CRISPR gRNA sequence
actacaacctctacctcctg

SEQ ID NO: 718332 - DNA, 20 bp, Artificial
  CRISPR gRNA sequence
caacctctacctcctggatt

SEQ ID NO: 718333 - DNA, 20 bp, Artificial
  CRISPR gRNA sequence
tacctcctggattcgagcga

SEQ ID NO: 718334 - DNA, 20 bp, Artificial
  CRISPR gRNA sequence
cctcctggattcgagcgatt

SEQ ID NO: 718335 - DNA, 20 bp, Artificial
  CRISPR gRNA sequence
ctggattcgagcgattctcc

SEQ ID NO: 718336 - DNA, 20 bp, Artificial
  CRISPR gRNA sequence
gattcgagcgattctcctgc

SEQ ID NO: 718337 - DNA, 20 bp, Artificial
  CRISPR gRNA sequence
gagcgattctcctgcctcct

SEQ ID NO: 718338 - DNA, 20 bp, Artificial
  CRISPR gRNA sequence
tcctgcctcctgagtagctg

SEQ ID NO: 718339 - DNA, 20 bp, Artificial
  CRISPR gRNA sequence
ctgcctcctgagtagctgag

SEQ ID NO: 718340 - DNA, 20 bp, Artificial
  CRISPR gRNA sequence
cctcctgagtagctgagatt

SEQ ID NO: 718341 - DNA, 20 bp, Artificial
  CRISPR gRNA sequence
ctgagtagctgagattacag

SEQ ID NO: 718342 - DNA, 20 bp, Artificial
  CRISPR gRNA sequence
agtagctgagattacaggga

SEQ ID NO: 718343 - DNA, 20 bp, Artificial
  CRISPR gRNA sequence
agattacagggatgcaccac

SEQ ID NO: 718344 - DNA, 20 bp, Artificial
  CRISPR gRNA sequence
cagggatgcaccaccacgcc

SEQ ID NO: 718345 - DNA, 20 bp, Artificial
  CRISPR gRNA sequence
gctaatttttgtatttttag

SEQ ID NO: 718346 - DNA, 20 bp, Artificial
  CRISPR gRNA sequence
atttttgtatttttagaaga

SEQ ID NO: 718347 - DNA, 20 bp, Artificial
  CRISPR gRNA sequence
ttgtatttttagaagagatg

SEQ ID NO: 718348 - DNA, 20 bp, Artificial
  CRISPR gRNA sequence
tgtatttttagaagagatgg

SEQ ID NO: 718349 - DNA, 20 bp, Artificial
  CRISPR gRNA sequence
gtatttttagaagagatggg

SEQ ID NO: 718350 - DNA, 20 bp, Artificial
  CRISPR gRNA sequence
tatttttagaagagatgggg

SEQ ID NO: 718351 - DNA, 20 bp, Artificial
  CRISPR gRNA sequence
ttagaagagatggggtttca

SEQ ID NO: 718352 - DNA, 20 bp, Artificial
  CRISPR gRNA sequence
tagaagagatggggtttcat

SEQ ID NO: 718353 - DNA, 20 bp, Artificial
  CRISPR gRNA sequence
agaagagatggggtttcatc

SEQ ID NO: 718354 - DNA, 20 bp, Artificial
  CRISPR gRNA sequence
gaagagatggggtttcatca

SEQ ID NO: 718355 - DNA, 20 bp, Artificial
  CRISPR gRNA sequence
catcatgttgcccaggctgg

SEQ ID NO: 718356 - DNA, 20 bp, Artificial
  CRISPR gRNA sequence
atcatgttgcccaggctggt

SEQ ID NO: 718357 - DNA, 20 bp, Artificial
  CRISPR gRNA sequence
cccaggctggtctcaaactc

SEQ ID NO: 718358 - DNA, 20 bp, Artificial
  CRISPR gRNA sequence
gtctcaaactcctgacctca

SEQ ID NO: 718359 - DNA, 20 bp, Artificial
  CRISPR gRNA sequence
aaactcctgacctcaagtga

SEQ ID NO: 718360 - DNA, 20 bp, Artificial
  CRISPR gRNA sequence
ctgacctcaagtgatccagc

SEQ ID NO: 718361 - DNA, 20 bp, Artificial
  CRISPR gRNA sequence
acctcaagtgatccagccgc

SEQ ID NO: 718362 - DNA, 20 bp, Artificial
  CRISPR gRNA sequence
aagtgatccagccgccttgg

SEQ ID NO: 718363 - DNA, 20 bp, Artificial
  CRISPR gRNA sequence
ggcctcctaaagtgttggga

SEQ ID NO: 718364 - DNA, 20 bp, Artificial
  CRISPR gRNA sequence
gcctcctaaagtgttgggat

SEQ ID NO: 718365 - DNA, 20 bp, Artificial
  CRISPR gRNA sequence
ctaaagtgttgggattacag

SEQ ID NO: 718366 - DNA, 20 bp, Artificial
  CRISPR gRNA sequence
aagtgttgggattacaggtg

SEQ ID NO: 718367 - DNA, 20 bp, Artificial
  CRISPR gRNA sequence
ggattacaggtgtgagtcac

SEQ ID NO: 718368 - DNA, 20 bp, Artificial
  CRISPR gRNA sequence
caggtgtgagtcaccattcc

SEQ ID NO: 718369 - DNA, 20 bp, Artificial
  CRISPR gRNA sequence
ccggcccaatttcttatctt

SEQ ID NO: 718370 - DNA, 20 bp, Artificial
  CRISPR gRNA sequence
cttatctttaaattttaaga

SEQ ID NO: 718371 - DNA, 20 bp, Artificial
  CRISPR gRNA sequence
ttatctttaaattttaagac

SEQ ID NO: 718372 - DNA, 20 bp, Artificial
  CRISPR gRNA sequence
atctttaaattttaagacag

SEQ ID NO: 718373 - DNA, 20 bp, Artificial
  CRISPR gRNA sequence
tctttaaattttaagacagg

SEQ ID NO: 718374 - DNA, 20 bp, Artificial
  CRISPR gRNA sequence
taaattttaagacagggtct

SEQ ID NO: 718375 - DNA, 20 bp, Artificial
  CRISPR gRNA sequence
aaattttaagacagggtctc

SEQ ID NO: 718376 - DNA, 20 bp, Artificial
  CRISPR gRNA sequence
aattttaagacagggtctca

SEQ ID NO: 718377 - DNA, 20 bp, Artificial
  CRISPR gRNA sequence
taagacagggtctcactttg

SEQ ID NO: 718378 - DNA, 20 bp, Artificial
  CRISPR gRNA sequence
aagacagggtctcactttgt

SEQ ID NO: 718379 - DNA, 20 bp, Artificial
  CRISPR gRNA sequence
agacagggtctcactttgtt

SEQ ID NO: 718380 - DNA, 20 bp, Artificial
  CRISPR gRNA sequence
actttgttgtccaggctggc

SEQ ID NO: 718381 - DNA, 20 bp, Artificial
  CRISPR gRNA sequence
tgttgtccaggctggcctta

SEQ ID NO: 718382 - DNA, 20 bp, Artificial
  CRISPR gRNA sequence
gttgtccaggctggccttaa

SEQ ID NO: 718383 - DNA, 20 bp, Artificial
  CRISPR gRNA sequence
ttgtccaggctggccttaaa

SEQ ID NO: 718384 - DNA, 20 bp, Artificial
  CRISPR gRNA sequence
tccaggctggccttaaactc

SEQ ID NO: 718385 - DNA, 20 bp, Artificial
  CRISPR gRNA sequence
gccttaaactccagggctta

SEQ ID NO: 718386 - DNA, 20 bp, Artificial
  CRISPR gRNA sequence
aaactccagggcttaagtgt

SEQ ID NO: 718387 - DNA, 20 bp, Artificial
  CRISPR gRNA sequence
aactccagggcttaagtgtt

SEQ ID NO: 718388 - DNA, 20 bp, Artificial
  CRISPR gRNA sequence
cagggcttaagtgttcctcc

SEQ ID NO: 718389 - DNA, 20 bp, Artificial
  CRISPR gRNA sequence
aagtgttcctcctgcctcag

SEQ ID NO: 718390 - DNA, 20 bp, Artificial
  CRISPR gRNA sequence
agtgttcctcctgcctcagc

SEQ ID NO: 718391 - DNA, 20 bp, Artificial
  CRISPR gRNA sequence
ctcctgcctcagcctcccga

SEQ ID NO: 718392 - DNA, 20 bp, Artificial
  CRISPR gRNA sequence
ctgcctcagcctcccgagta

SEQ ID NO: 718393 - DNA, 20 bp, Artificial
  CRISPR gRNA sequence
cctcagcctcccgagtagct

SEQ ID NO: 718394 - DNA, 20 bp, Artificial
  CRISPR gRNA sequence
agcctcccgagtagctgggg

SEQ ID NO: 718395 - DNA, 20 bp, Artificial
  CRISPR gRNA sequence
ccgagtagctggggctgcac

SEQ ID NO: 718396 - DNA, 20 bp, Artificial
  CRISPR gRNA sequence
gggctgcacttgcatgttac

SEQ ID NO: 718397 - DNA, 20 bp, Artificial
  CRISPR gRNA sequence
cacttgcatgttactgcacc

SEQ ID NO: 718398 - DNA, 20 bp, Artificial
  CRISPR gRNA sequence
gcatgttactgcacccaact

SEQ ID NO: 718399 - DNA, 20 bp, Artificial
  CRISPR gRNA sequence
catgttactgcacccaactt

SEQ ID NO: 718400 - DNA, 20 bp, Artificial
  CRISPR gRNA sequence
ctgcacccaacttacaattt

SEQ ID NO: 718401 - DNA, 20 bp, Artificial
  CRISPR gRNA sequence
cacccaacttacaatttttt

SEQ ID NO: 718402 - DNA, 20 bp, Artificial
  CRISPR gRNA sequence
acaatttttttgtgtgtctc

SEQ ID NO: 718403 - DNA, 20 bp, Artificial
  CRISPR gRNA sequence
caatttttttgtgtgtctct

SEQ ID NO: 718404 - DNA, 20 bp, Artificial
  CRISPR gRNA sequence
ttttgtgtgtctctgaggat

SEQ ID NO: 718405 - DNA, 20 bp, Artificial
  CRISPR gRNA sequence
tttgtgtgtctctgaggata

SEQ ID NO: 718406 - DNA, 20 bp, Artificial
  CRISPR gRNA sequence
ttgtgtgtctctgaggatat

SEQ ID NO: 718407 - DNA, 20 bp, Artificial
  CRISPR gRNA sequence
tgtgtgtctctgaggatata

SEQ ID NO: 718408 - DNA, 20 bp, Artificial
  CRISPR gRNA sequence
gtgtgtctctgaggatataa

SEQ ID NO: 718409 - DNA, 20 bp, Artificial
  CRISPR gRNA sequence
tgtgtctctgaggatataaa

SEQ ID NO: 718410 - DNA, 20 bp, Artificial
  CRISPR gRNA sequence
tgaggatataaattatagtc

SEQ ID NO: 718411 - DNA, 20 bp, Artificial
  CRISPR gRNA sequence
aggatataaattatagtcat

SEQ ID NO: 718412 - DNA, 20 bp, Artificial
  CRISPR gRNA sequence
tagtcatgtattgcttattg

SEQ ID NO: 718413 - DNA, 20 bp, Artificial
  CRISPR gRNA sequence
cttattgacaggaatacatt

SEQ ID NO: 718414 - DNA, 20 bp, Artificial
  CRISPR gRNA sequence
attgacaggaatacattctg

SEQ ID NO: 718415 - DNA, 20 bp, Artificial
  CRISPR gRNA sequence
ttgacaggaatacattctga

SEQ ID NO: 718416 - DNA, 20 bp, Artificial
  CRISPR gRNA sequence
acaggaatacattctgacaa

SEQ ID NO: 718417 - DNA, 20 bp, Artificial
  CRISPR gRNA sequence
tgacaaacgtgtcattaggc

SEQ ID NO: 718418 - DNA, 20 bp, Artificial
  CRISPR gRNA sequence
acaaacgtgtcattaggcaa

SEQ ID NO: 718419 - DNA, 20 bp, Artificial
  CRISPR gRNA sequence
ggcaattttgtcgttgtgca

SEQ ID NO: 718420 - DNA, 20 bp, Artificial
  CRISPR gRNA sequence
tgtcgttgtgcaagcatcct

SEQ ID NO: 718421 - DNA, 20 bp, Artificial
  CRISPR gRNA sequence
gtcgttgtgcaagcatccta

SEQ ID NO: 718422 - DNA, 20 bp, Artificial
  CRISPR gRNA sequence
tcgttgtgcaagcatcctag

SEQ ID NO: 718423 - DNA, 20 bp, Artificial
  CRISPR gRNA sequence
tgcaagcatcctagattagt

SEQ ID NO: 718424 - DNA, 20 bp, Artificial
  CRISPR gRNA sequence
gattagtgtacttacacaca

SEQ ID NO: 718425 - DNA, 20 bp, Artificial
  CRISPR gRNA sequence
gtgtacttacacacacctac

SEQ ID NO: 718426 - DNA, 20 bp, Artificial
  CRISPR gRNA sequence
acacacacctacatgatgta

SEQ ID NO: 718427 - DNA, 20 bp, Artificial
  CRISPR gRNA sequence
cacacacctacatgatgtag

SEQ ID NO: 718428 - DNA, 20 bp, Artificial
  CRISPR gRNA sequence
catgatgtagcctactgcac

SEQ ID NO: 718429 - DNA, 20 bp, Artificial
  CRISPR gRNA sequence
ctgcacacctaggttctatg

SEQ ID NO: 718430 - DNA, 20 bp, Artificial
  CRISPR gRNA sequence
cacacctaggttctatggca

SEQ ID NO: 718431 - DNA, 20 bp, Artificial
  CRISPR gRNA sequence
ggttctatggcagatccttt

SEQ ID NO: 718432 - DNA, 20 bp, Artificial
  CRISPR gRNA sequence
tatggcagatccttttgctc

SEQ ID NO: 718433 - DNA, 20 bp, Artificial
  CRISPR gRNA sequence
tggcagatccttttgctcct

SEQ ID NO: 718434 - DNA, 20 bp, Artificial
  CRISPR gRNA sequence
ttgctcctaagctacaactc

SEQ ID NO: 718435 - DNA, 20 bp, Artificial
  CRISPR gRNA sequence
tgctcctaagctacaactct

SEQ ID NO: 718436 - DNA, 20 bp, Artificial
  CRISPR gRNA sequence
gctcctaagctacaactctg

SEQ ID NO: 718437 - DNA, 20 bp, Artificial
  CRISPR gRNA sequence
ctcctaagctacaactctgc

SEQ ID NO: 718438 - DNA, 20 bp, Artificial
  CRISPR gRNA sequence
ctaagctacaactctgcaca

SEQ ID NO: 718439 - DNA, 20 bp, Artificial
  CRISPR gRNA sequence
agctacaactctgcacagca

SEQ ID NO: 718440 - DNA, 20 bp, Artificial
  CRISPR gRNA sequence
caactctgcacagcatgtga

SEQ ID NO: 718441 - DNA, 20 bp, Artificial
  CRISPR gRNA sequence
tgcacagcatgtgactgtcc

SEQ ID NO: 718442 - DNA, 20 bp, Artificial
  CRISPR gRNA sequence
cacagcatgtgactgtcctg

SEQ ID NO: 718443 - DNA, 20 bp, Artificial
  CRISPR gRNA sequence
tcctgaatactgtaggcagc

SEQ ID NO: 718444 - DNA, 20 bp, Artificial
  CRISPR gRNA sequence
aatactgtaggcagctgtga

SEQ ID NO: 718445 - DNA, 20 bp, Artificial
  CRISPR gRNA sequence
taggcagctgtgacacaatg

SEQ ID NO: 718446 - DNA, 20 bp, Artificial
  CRISPR gRNA sequence
tgacacaatgtgagtatttg

SEQ ID NO: 718447 - DNA, 20 bp, Artificial
  CRISPR gRNA sequence
gtgtatctaaacatagaaaa

SEQ ID NO: 718448 - DNA, 20 bp, Artificial
  CRISPR gRNA sequence
tgtatctaaacatagaaaag

SEQ ID NO: 718449 - DNA, 20 bp, Artificial
  CRISPR gRNA sequence
aacatagaaaaggtgcaata

SEQ ID NO: 718450 - DNA, 20 bp, Artificial
  CRISPR gRNA sequence
acacctgtaatgccagcact

SEQ ID NO: 718451 - DNA, 20 bp, Artificial
  CRISPR gRNA sequence
taatgccagcactttgggag

SEQ ID NO: 718452 - DNA, 20 bp, Artificial
  CRISPR gRNA sequence
tgggaggccgaggagggtgg

SEQ ID NO: 718453 - DNA, 20 bp, Artificial
  CRISPR gRNA sequence
gggaggccgaggagggtgga

SEQ ID NO: 718454 - DNA, 20 bp, Artificial
  CRISPR gRNA sequence
ggaggccgaggagggtggat

SEQ ID NO: 718455 - DNA, 20 bp, Artificial
  CRISPR gRNA sequence
cctgaggtcaggagttcgag

SEQ ID NO: 718456 - DNA, 20 bp, Artificial
  CRISPR gRNA sequence
aggtcaggagttcgagacca

SEQ ID NO: 718457 - DNA, 20 bp, Artificial
  CRISPR gRNA sequence
gagaccagcctggctaacat

SEQ ID NO: 718458 - DNA, 20 bp, Artificial
  CRISPR gRNA sequence
gctaacatggcgaaacccca

SEQ ID NO: 718459 - DNA, 20 bp, Artificial
  CRISPR gRNA sequence
acatggcgaaaccccatctc

SEQ ID NO: 718460 - DNA, 20 bp, Artificial
  CRISPR gRNA sequence
tactaaaaatacaaaaatta

SEQ ID NO: 718461 - DNA, 20 bp, Artificial
  CRISPR gRNA sequence
ctaaaaatacaaaaattagc

SEQ ID NO: 718462 - DNA, 20 bp, Artificial
  CRISPR gRNA sequence
aaaatacaaaaattagctgg

SEQ ID NO: 718463 - DNA, 20 bp, Artificial
  CRISPR gRNA sequence
gctgggcgtggtggcacgtg

SEQ ID NO: 718464 - DNA, 20 bp, Artificial
  CRISPR gRNA sequence
ggcgtggtggcacgtgtctg

SEQ ID NO: 718465 - DNA, 20 bp, Artificial
  CRISPR gRNA sequence
tagtcccagctactcaagag

SEQ ID NO: 718466 - DNA, 20 bp, Artificial
  CRISPR gRNA sequence
ctcaagaggctgaagcagaa

SEQ ID NO: 718467 - DNA, 20 bp, Artificial
  CRISPR gRNA sequence
aagaggctgaagcagaagaa

SEQ ID NO: 718468 - DNA, 20 bp, Artificial
  CRISPR gRNA sequence
aagcagaagaattgcttgaa

SEQ ID NO: 718469 - DNA, 20 bp, Artificial
  CRISPR gRNA sequence
cttgaacctgggaggcggag

SEQ ID NO: 718470 - DNA, 20 bp, Artificial
  CRISPR gRNA sequence
gaacctgggaggcggaggtt

SEQ ID NO: 718471 - DNA, 20 bp, Artificial
  CRISPR gRNA sequence
aacctgggaggcggaggttg

SEQ ID NO: 718472 - DNA, 20 bp, Artificial
  CRISPR gRNA sequence
ggaggcggaggttgcagtgc

SEQ ID NO: 718473 - DNA, 20 bp, Artificial
  CRISPR gRNA sequence
cagtgcgccgagatcatgcc

SEQ ID NO: 718474 - DNA, 20 bp, Artificial
  CRISPR gRNA sequence
cactccagcctgggtgatag

SEQ ID NO: 718475 - DNA, 20 bp, Artificial
  CRISPR gRNA sequence
cagcctgggtgatagagtga

SEQ ID NO: 718476 - DNA, 20 bp, Artificial
  CRISPR gRNA sequence
ggtgatagagtgagacacca

SEQ ID NO: 718477 - DNA, 20 bp, Artificial
  CRISPR gRNA sequence
aaaaaaaaatatgatatgaa

SEQ ID NO: 718478 - DNA, 20 bp, Artificial
  CRISPR gRNA sequence
gtacagggcacttaccgtga

SEQ ID NO: 718479 - DNA, 20 bp, Artificial
  CRISPR gRNA sequence
tacagggcacttaccgtgaa

SEQ ID NO: 718480 - DNA, 20 bp, Artificial
  CRISPR gRNA sequence
accgtgaatggagcttgcag

SEQ ID NO: 718481 - DNA, 20 bp, Artificial
  CRISPR gRNA sequence
ccgtgaatggagcttgcagg

SEQ ID NO: 718482 - DNA, 20 bp, Artificial
  CRISPR gRNA sequence
gcaggacacgaagttgttct

SEQ ID NO: 718483 - DNA, 20 bp, Artificial
  CRISPR gRNA sequence
caggacacgaagttgttctg

SEQ ID NO: 718484 - DNA, 20 bp, Artificial
  CRISPR gRNA sequence
ttctgggtgagtcaatgagt

SEQ ID NO: 718485 - DNA, 20 bp, Artificial
  CRISPR gRNA sequence
tgggtgagtcaatgagtaag

SEQ ID NO: 718486 - DNA, 20 bp, Artificial
  CRISPR gRNA sequence
ggtgagtcaatgagtaagtg

SEQ ID NO: 718487 - DNA, 20 bp, Artificial
  CRISPR gRNA sequence
gggcattactatgcactact

SEQ ID NO: 718488 - DNA, 20 bp, Artificial
  CRISPR gRNA sequence
ctatgcactactgtggactt

SEQ ID NO: 718489 - DNA, 20 bp, Artificial
  CRISPR gRNA sequence
tgcactactgtggactttat

SEQ ID NO: 718490 - DNA, 20 bp, Artificial
  CRISPR gRNA sequence
ctgtggactttatcaacact

SEQ ID NO: 718491 - DNA, 20 bp, Artificial
  CRISPR gRNA sequence
tggactttatcaacactgta

SEQ ID NO: 718492 - DNA, 20 bp, Artificial
  CRISPR gRNA sequence
tatcaacactgtacacttag

SEQ ID NO: 718493 - DNA, 20 bp, Artificial
  CRISPR gRNA sequence
atcaacactgtacacttagg

SEQ ID NO: 718494 - DNA, 20 bp, Artificial
  CRISPR gRNA sequence
tcaacactgtacacttaggc

SEQ ID NO: 718495 - DNA, 20 bp, Artificial
  CRISPR gRNA sequence
tacacttaggctatactaaa

SEQ ID NO: 718496 - DNA, 20 bp, Artificial
  CRISPR gRNA sequence
aggctatactaaatttataa

SEQ ID NO: 718497 - DNA, 20 bp, Artificial
  CRISPR gRNA sequence
ggctatactaaatttataag

SEQ ID NO: 718498 - DNA, 20 bp, Artificial
  CRISPR gRNA sequence
tactaaatttataagacaca

SEQ ID NO: 718499 - DNA, 20 bp, Artificial
  CRISPR gRNA sequence
aatttataagacacattttt

SEQ ID NO: 718500 - DNA, 20 bp, Artificial
  CRISPR gRNA sequence
ataagacacatttttctttc

SEQ ID NO: 718501 - DNA, 20 bp, Artificial
  CRISPR gRNA sequence
taagacacatttttctttct

SEQ ID NO: 718502 - DNA, 20 bp, Artificial
  CRISPR gRNA sequence
ttctttcttcaataataaat

SEQ ID NO: 718503 - DNA, 20 bp, Artificial
  CRISPR gRNA sequence
tctttcttcaataataaatt

SEQ ID NO: 718504 - DNA, 20 bp, Artificial
  CRISPR gRNA sequence
ctttcttcaataataaatta

SEQ ID NO: 718505 - DNA, 20 bp, Artificial
  CRISPR gRNA sequence
tttcttcaataataaattaa

SEQ ID NO: 718506 - DNA, 20 bp, Artificial
  CRISPR gRNA sequence
tcttcaataataaattaaac

SEQ ID NO: 718507 - DNA, 20 bp, Artificial
  CRISPR gRNA sequence
cttcaataataaattaaaca

SEQ ID NO: 718508 - DNA, 20 bp, Artificial
  CRISPR gRNA sequence
ttcaataataaattaaacaa

SEQ ID NO: 718509 - DNA, 20 bp, Artificial
  CRISPR gRNA sequence
caataataaattaaacaact

SEQ ID NO: 718510 - DNA, 20 bp, Artificial
  CRISPR gRNA sequence
aataataaattaaacaactt

SEQ ID NO: 718511 - DNA, 20 bp, Artificial
  CRISPR gRNA sequence
aacaactttttcactttata

SEQ ID NO: 718512 - DNA, 20 bp, Artificial
  CRISPR gRNA sequence
tttcactttataaactttaa

SEQ ID NO: 718513 - DNA, 20 bp, Artificial
  CRISPR gRNA sequence
ttcactttataaactttaac

SEQ ID NO: 718514 - DNA, 20 bp, Artificial
  CRISPR gRNA sequence
tcactttataaactttaact

SEQ ID NO: 718515 - DNA, 20 bp, Artificial
  CRISPR gRNA sequence
cactttataaactttaactt

SEQ ID NO: 718516 - DNA, 20 bp, Artificial
  CRISPR gRNA sequence
actttataaactttaacttt

SEQ ID NO: 718517 - DNA, 20 bp, Artificial
  CRISPR gRNA sequence
tataaactttaactttttaa

SEQ ID NO: 718518 - DNA, 20 bp, Artificial
  CRISPR gRNA sequence
ataaactttaactttttaaa

SEQ ID NO: 718519 - DNA, 20 bp, Artificial
  CRISPR gRNA sequence
taaactttaactttttaaac

SEQ ID NO: 718520 - DNA, 20 bp, Artificial
  CRISPR gRNA sequence
taactttttaaacttttggc

SEQ ID NO: 718521 - DNA, 20 bp, Artificial
  CRISPR gRNA sequence
aactttttaaacttttggct

SEQ ID NO: 718522 - DNA, 20 bp, Artificial
  CRISPR gRNA sequence
actttttaaacttttggctc

SEQ ID NO: 718523 - DNA, 20 bp, Artificial
  CRISPR gRNA sequence
tttaaacttttggctctttt

SEQ ID NO: 718524 - DNA, 20 bp, Artificial
  CRISPR gRNA sequence
ttaaacttttggctcttttg

SEQ ID NO: 718525 - DNA, 20 bp, Artificial
  CRISPR gRNA sequence
taaacttttggctcttttgt

SEQ ID NO: 718526 - DNA, 20 bp, Artificial
  CRISPR gRNA sequence
aaacttttggctcttttgta

SEQ ID NO: 718527 - DNA, 20 bp, Artificial
  CRISPR gRNA sequence
aacttttggctcttttgtaa

SEQ ID NO: 718528 - DNA, 20 bp, Artificial
  CRISPR gRNA sequence
ttggctcttttgtaataaca

SEQ ID NO: 718529 - DNA, 20 bp, Artificial
  CRISPR gRNA sequence
tggctcttttgtaataacac

SEQ ID NO: 718530 - DNA, 20 bp, Artificial
  CRISPR gRNA sequence
ggctcttttgtaataacact

SEQ ID NO: 718531 - DNA, 20 bp, Artificial
  CRISPR gRNA sequence
gctcttttgtaataacactt

SEQ ID NO: 718532 - DNA, 20 bp, Artificial
  CRISPR gRNA sequence
ttttgtaataacacttagct

SEQ ID NO: 718533 - DNA, 20 bp, Artificial
  CRISPR gRNA sequence
ttgtaataacacttagctta

SEQ ID NO: 718534 - DNA, 20 bp, Artificial
  CRISPR gRNA sequence
tgtaataacacttagcttaa

SEQ ID NO: 718535 - DNA, 20 bp, Artificial
  CRISPR gRNA sequence
gtaataacacttagcttaaa

SEQ ID NO: 718536 - DNA, 20 bp, Artificial
  CRISPR gRNA sequence
taataacacttagcttaaag

SEQ ID NO: 718537 - DNA, 20 bp, Artificial
  CRISPR gRNA sequence
agcttaaagcacaaacacat

SEQ ID NO: 718538 - DNA, 20 bp, Artificial
  CRISPR gRNA sequence
gcttaaagcacaaacacatc

SEQ ID NO: 718539 - DNA, 20 bp, Artificial
  CRISPR gRNA sequence
aaagcacaaacacatcgtac

SEQ ID NO: 718540 - DNA, 20 bp, Artificial
  CRISPR gRNA sequence
aagcacaaacacatcgtaca

SEQ ID NO: 718541 - DNA, 20 bp, Artificial
  CRISPR gRNA sequence
tacaaaaatattttctttat

SEQ ID NO: 718542 - DNA, 20 bp, Artificial
  CRISPR gRNA sequence
tctttatagccttattcatt

SEQ ID NO: 718543 - DNA, 20 bp, Artificial
  CRISPR gRNA sequence
ctttatagccttattcatta

SEQ ID NO: 718544 - DNA, 20 bp, Artificial
  CRISPR gRNA sequence
tttatagccttattcattac

SEQ ID NO: 718545 - DNA, 20 bp, Artificial
  CRISPR gRNA sequence
tatagccttattcattacac

SEQ ID NO: 718546 - DNA, 20 bp, Artificial
  CRISPR gRNA sequence
atagccttattcattacact

SEQ ID NO: 718547 - DNA, 20 bp, Artificial
  CRISPR gRNA sequence
tagccttattcattacactt

SEQ ID NO: 718548 - DNA, 20 bp, Artificial
  CRISPR gRNA sequence
attcattacacttttttcta

SEQ ID NO: 718549 - DNA, 20 bp, Artificial
  CRISPR gRNA sequence
ttcattacacttttttctac

SEQ ID NO: 718550 - DNA, 20 bp, Artificial
  CRISPR gRNA sequence
attacacttttttctacttt

SEQ ID NO: 718551 - DNA, 20 bp, Artificial
  CRISPR gRNA sequence
cacttttttctactttaaaa

SEQ ID NO: 718552 - DNA, 20 bp, Artificial
  CRISPR gRNA sequence
ttttctactttaaaatttta

SEQ ID NO: 718553 - DNA, 20 bp, Artificial
  CRISPR gRNA sequence
tttctactttaaaattttat

SEQ ID NO: 718554 - DNA, 20 bp, Artificial
  CRISPR gRNA sequence
ttctactttaaaattttatt

SEQ ID NO: 718555 - DNA, 20 bp, Artificial
  CRISPR gRNA sequence
tctactttaaaattttatta

SEQ ID NO: 718556 - DNA, 20 bp, Artificial
  CRISPR gRNA sequence
ctactttaaaattttattat

SEQ ID NO: 718557 - DNA, 20 bp, Artificial
  CRISPR gRNA sequence
tactttaaaattttattatt

SEQ ID NO: 718558 - DNA, 20 bp, Artificial
  CRISPR gRNA sequence
ctttaaaattttattatttt

SEQ ID NO: 718559 - DNA, 20 bp, Artificial
  CRISPR gRNA sequence
taaaattttattattttatt

SEQ ID NO: 718560 - DNA, 20 bp, Artificial
  CRISPR gRNA sequence
aaaattttattattttatta

SEQ ID NO: 718561 - DNA, 20 bp, Artificial
  CRISPR gRNA sequence
aaattttattattttattat

SEQ ID NO: 718562 - DNA, 20 bp, Artificial
  CRISPR gRNA sequence
tattattttattatttttaa

SEQ ID NO: 718563 - DNA, 20 bp, Artificial
  CRISPR gRNA sequence
attattttattatttttaac

SEQ ID NO: 718564 - DNA, 20 bp, Artificial
  CRISPR gRNA sequence
ttattttattatttttaaca

SEQ ID NO: 718565 - DNA, 20 bp, Artificial
  CRISPR gRNA sequence
ttttattatttttaacattt

SEQ ID NO: 718566 - DNA, 20 bp, Artificial
  CRISPR gRNA sequence
tattatttttaacattttta

SEQ ID NO: 718567 - DNA, 20 bp, Artificial
  CRISPR gRNA sequence
attatttttaacatttttaa

SEQ ID NO: 718568 - DNA, 20 bp, Artificial
  CRISPR gRNA sequence
ttatttttaacatttttaaa

SEQ ID NO: 718569 - DNA, 20 bp, Artificial
  CRISPR gRNA sequence
tttttaacatttttaaatta

SEQ ID NO: 718570 - DNA, 20 bp, Artificial
  CRISPR gRNA sequence
ttaacatttttaaattaaaa

SEQ ID NO: 718571 - DNA, 20 bp, Artificial
  CRISPR gRNA sequence
taacatttttaaattaaaag

SEQ ID NO: 718572 - DNA, 20 bp, Artificial
  CRISPR gRNA sequence
aacatttttaaattaaaagc

SEQ ID NO: 718573 - DNA, 20 bp, Artificial
  CRISPR gRNA sequence
acatttttaaattaaaagct

SEQ ID NO: 718574 - DNA, 20 bp, Artificial
  CRISPR gRNA sequence
ttaaattaaaagctgagacg

SEQ ID NO: 718575 - DNA, 20 bp, Artificial
  CRISPR gRNA sequence
taaattaaaagctgagacgc

SEQ ID NO: 718576 - DNA, 20 bp, Artificial
  CRISPR gRNA sequence
aaattaaaagctgagacgca

SEQ ID NO: 718577 - DNA, 20 bp, Artificial
  CRISPR gRNA sequence
aattaaaagctgagacgcaa

SEQ ID NO: 718578 - DNA, 20 bp, Artificial
  CRISPR gRNA sequence
aaagctgagacgcaaacacc

SEQ ID NO: 718579 - DNA, 20 bp, Artificial
  CRISPR gRNA sequence
agacgcaaacacctacatta

SEQ ID NO: 718580 - DNA, 20 bp, Artificial
  CRISPR gRNA sequence
cattatccgaggcctacaca

SEQ ID NO: 718581 - DNA, 20 bp, Artificial
  CRISPR gRNA sequence
tccgaggcctacacagagtc

SEQ ID NO: 718582 - DNA, 20 bp, Artificial
  CRISPR gRNA sequence
cacagagtcaggatcatcag

SEQ ID NO: 718583 - DNA, 20 bp, Artificial
  CRISPR gRNA sequence
cctcctccaaatcttgtccc

SEQ ID NO: 718584 - DNA, 20 bp, Artificial
  CRISPR gRNA sequence
ctcctccaaatcttgtccca

SEQ ID NO: 718585 - DNA, 20 bp, Artificial
  CRISPR gRNA sequence
ctccaaatcttgtcccattg

SEQ ID NO: 718586 - DNA, 20 bp, Artificial
  CRISPR gRNA sequence
caaatcttgtcccattggca

SEQ ID NO: 718587 - DNA, 20 bp, Artificial
  CRISPR gRNA sequence
gtcccattggcagcgtgcag

SEQ ID NO: 718588 - DNA, 20 bp, Artificial
  CRISPR gRNA sequence
tcccattggcagcgtgcagt

SEQ ID NO: 718589 - DNA, 20 bp, Artificial
  CRISPR gRNA sequence
gcagcgtgcagtgactcaca

SEQ ID NO: 718590 - DNA, 20 bp, Artificial
  CRISPR gRNA sequence
acacctgtaatcccagcact

SEQ ID NO: 718591 - DNA, 20 bp, Artificial
  CRISPR gRNA sequence
taatcccagcactttgggaa

SEQ ID NO: 718592 - DNA, 20 bp, Artificial
  CRISPR gRNA sequence
tgggaagccgaggtgggcag

SEQ ID NO: 718593 - DNA, 20 bp, Artificial
  CRISPR gRNA sequence
gggaagccgaggtgggcaga

SEQ ID NO: 718594 - DNA, 20 bp, Artificial
  CRISPR gRNA sequence
ggaagccgaggtgggcagat

SEQ ID NO: 718595 - DNA, 20 bp, Artificial
  CRISPR gRNA sequence
gaggtcaagagttcaagacc

SEQ ID NO: 718596 - DNA, 20 bp, Artificial
  CRISPR gRNA sequence
aggtcaagagttcaagacca

SEQ ID NO: 718597 - DNA, 20 bp, Artificial
  CRISPR gRNA sequence
aagaccagcttggccaacat

SEQ ID NO: 718598 - DNA, 20 bp, Artificial
  CRISPR gRNA sequence
ggccaacatggtgaaacccc

SEQ ID NO: 718599 - DNA, 20 bp, Artificial
  CRISPR gRNA sequence
gccaacatggtgaaacccca

SEQ ID NO: 718600 - DNA, 20 bp, Artificial
  CRISPR gRNA sequence
tactaaaaatataaaaatta

SEQ ID NO: 718601 - DNA, 20 bp, Artificial
  CRISPR gRNA sequence
ctaaaaatataaaaattagc

SEQ ID NO: 718602 - DNA, 20 bp, Artificial
  CRISPR gRNA sequence
aaaatataaaaattagccgg

SEQ ID NO: 718603 - DNA, 20 bp, Artificial
  CRISPR gRNA sequence
gccgggcacgttggcatgcg

SEQ ID NO: 718604 - DNA, 20 bp, Artificial
  CRISPR gRNA sequence
gcatgcgcctgtaatcccag

SEQ ID NO: 718605 - DNA, 20 bp, Artificial
  CRISPR gRNA sequence
taatcccagctactcaggtg

SEQ ID NO: 718606 - DNA, 20 bp, Artificial
  CRISPR gRNA sequence
ctcaggtggctgaggcagga

SEQ ID NO: 718607 - DNA, 20 bp, Artificial
  CRISPR gRNA sequence
aggtggctgaggcaggagaa

SEQ ID NO: 718608 - DNA, 20 bp, Artificial
  CRISPR gRNA sequence
aggcaggagaattgcttgaa

SEQ ID NO: 718609 - DNA, 20 bp, Artificial
  CRISPR gRNA sequence
cttgaacccgggaggcggag

SEQ ID NO: 718610 - DNA, 20 bp, Artificial
  CRISPR gRNA sequence
gaacccgggaggcggaggtt

SEQ ID NO: 718611 - DNA, 20 bp, Artificial
  CRISPR gRNA sequence
aacccgggaggcggaggttg

SEQ ID NO: 718612 - DNA, 20 bp, Artificial
  CRISPR gRNA sequence
cagtgagctgagattgtgct

SEQ ID NO: 718613 - DNA, 20 bp, Artificial
  CRISPR gRNA sequence
agattgtgctactgcactcc

SEQ ID NO: 718614 - DNA, 20 bp, Artificial
  CRISPR gRNA sequence
tgctactgcactccagcctg

SEQ ID NO: 718615 - DNA, 20 bp, Artificial
  CRISPR gRNA sequence
ctgcactccagcctgggtga

SEQ ID NO: 718616 - DNA, 20 bp, Artificial
  CRISPR gRNA sequence
cactccagcctgggtgacag

SEQ ID NO: 718617 - DNA, 20 bp, Artificial
  CRISPR gRNA sequence
cagcctgggtgacagaatga

SEQ ID NO: 718618 - DNA, 20 bp, Artificial
  CRISPR gRNA sequence
ggtgacagaatgagactctg

SEQ ID NO: 718619 - DNA, 20 bp, Artificial
  CRISPR gRNA sequence
tgtctcaaaaaaaaaaaaaa

SEQ ID NO: 718620 - DNA, 20 bp, Artificial
  CRISPR gRNA sequence
tctcaaaaaaaaaaaaaaaa

SEQ ID NO: 718621 - DNA, 20 bp, Artificial
  CRISPR gRNA sequence
aaaaaaaaaaaaaaaagaat

SEQ ID NO: 718622 - DNA, 20 bp, Artificial
  CRISPR gRNA sequence
tcccattggaaggtcttcag

SEQ ID NO: 718623 - DNA, 20 bp, Artificial
  CRISPR gRNA sequence
gaaggtcttcaggagcggta

SEQ ID NO: 718624 - DNA, 20 bp, Artificial
  CRISPR gRNA sequence
caggagcggtaaggtaacat

SEQ ID NO: 718625 - DNA, 20 bp, Artificial
  CRISPR gRNA sequence
aggagcggtaaggtaacatg

SEQ ID NO: 718626 - DNA, 20 bp, Artificial
  CRISPR gRNA sequence
ctatgataacaatgccttct

SEQ ID NO: 718627 - DNA, 20 bp, Artificial
  CRISPR gRNA sequence
tgataacaatgccttcttct

SEQ ID NO: 718628 - DNA, 20 bp, Artificial
  CRISPR gRNA sequence
cttctggatacctgcagaag

SEQ ID NO: 718629 - DNA, 20 bp, Artificial
  CRISPR gRNA sequence
ttctggatacctgcagaagg

SEQ ID NO: 718630 - DNA, 20 bp, Artificial
  CRISPR gRNA sequence
ctggatacctgcagaaggac

SEQ ID NO: 718631 - DNA, 20 bp, Artificial
  CRISPR gRNA sequence
tggatacctgcagaaggacc

SEQ ID NO: 718632 - DNA, 20 bp, Artificial
  CRISPR gRNA sequence
gatacctgcagaaggaccta

SEQ ID NO: 718633 - DNA, 20 bp, Artificial
  CRISPR gRNA sequence
cagaaggacctacctgaggc

SEQ ID NO: 718634 - DNA, 20 bp, Artificial
  CRISPR gRNA sequence
cctgaggctgtattacagtt

SEQ ID NO: 718635 - DNA, 20 bp, Artificial
  CRISPR gRNA sequence
aggctgtattacagttaact

SEQ ID NO: 718636 - DNA, 20 bp, Artificial
  CRISPR gRNA sequence
tattacagttaacttttgtt

SEQ ID NO: 718637 - DNA, 20 bp, Artificial
  CRISPR gRNA sequence
cagttaacttttgttttaat

SEQ ID NO: 718638 - DNA, 20 bp, Artificial
  CRISPR gRNA sequence
acttttgttttaataagtag

SEQ ID NO: 718639 - DNA, 20 bp, Artificial
  CRISPR gRNA sequence
ttgttttaataagtaggagt

SEQ ID NO: 718640 - DNA, 20 bp, Artificial
  CRISPR gRNA sequence
tgttttaataagtaggagta

SEQ ID NO: 718641 - DNA, 20 bp, Artificial
  CRISPR gRNA sequence
gttttaataagtaggagtac

SEQ ID NO: 718642 - DNA, 20 bp, Artificial
  CRISPR gRNA sequence
ttttaataagtaggagtaca

SEQ ID NO: 718643 - DNA, 20 bp, Artificial
  CRISPR gRNA sequence
taataagtaggagtacactc

SEQ ID NO: 718644 - DNA, 20 bp, Artificial
  CRISPR gRNA sequence
aataagtaggagtacactct

SEQ ID NO: 718645 - DNA, 20 bp, Artificial
  CRISPR gRNA sequence
ataagtaggagtacactcta

SEQ ID NO: 718646 - DNA, 20 bp, Artificial
  CRISPR gRNA sequence
taaaataatgataaggccgg

SEQ ID NO: 718647 - DNA, 20 bp, Artificial
  CRISPR gRNA sequence
aaataatgataaggccggct

SEQ ID NO: 718648 - DNA, 20 bp, Artificial
  CRISPR gRNA sequence
ggtggctgatgcctgcagtc

SEQ ID NO: 718649 - DNA, 20 bp, Artificial
  CRISPR gRNA sequence
gtggctgatgcctgcagtct

SEQ ID NO: 718650 - DNA, 20 bp, Artificial
  CRISPR gRNA sequence
atgcctgcagtctcagcact

SEQ ID NO: 718651 - DNA, 20 bp, Artificial
  CRISPR gRNA sequence
cagtctcagcacttagggag

SEQ ID NO: 718652 - DNA, 20 bp, Artificial
  CRISPR gRNA sequence
agcacttagggaggccaggc

SEQ ID NO: 718653 - DNA, 20 bp, Artificial
  CRISPR gRNA sequence
agggaggccaggctgggaga

SEQ ID NO: 718654 - DNA, 20 bp, Artificial
  CRISPR gRNA sequence
gggaggccaggctgggagaa

SEQ ID NO: 718655 - DNA, 20 bp, Artificial
  CRISPR gRNA sequence
ggagaatcacttgaggccag

SEQ ID NO: 718656 - DNA, 20 bp, Artificial
  CRISPR gRNA sequence
gaggccaggagtttgagacc

SEQ ID NO: 718657 - DNA, 20 bp, Artificial
  CRISPR gRNA sequence
aggccaggagtttgagacca

SEQ ID NO: 718658 - DNA, 20 bp, Artificial
  CRISPR gRNA sequence
gagaccagcctgggcaacac

SEQ ID NO: 718659 - DNA, 20 bp, Artificial
  CRISPR gRNA sequence
agaccagcctgggcaacaca

SEQ ID NO: 718660 - DNA, 20 bp, Artificial
  CRISPR gRNA sequence
ggcaacacagtgagatcccc

SEQ ID NO: 718661 - DNA, 20 bp, Artificial
  CRISPR gRNA sequence
tacacaagataaaatacatt

SEQ ID NO: 718662 - DNA, 20 bp, Artificial
  CRISPR gRNA sequence
cacaagataaaatacattag

SEQ ID NO: 718663 - DNA, 20 bp, Artificial
  CRISPR gRNA sequence
gctgggtgtggtggcatgcg

SEQ ID NO: 718664 - DNA, 20 bp, Artificial
  CRISPR gRNA sequence
ggtgtggtggcatgcgcctg

SEQ ID NO: 718665 - DNA, 20 bp, Artificial
  CRISPR gRNA sequence
tagtcccagctactcaggag

SEQ ID NO: 718666 - DNA, 20 bp, Artificial
  CRISPR gRNA sequence
ctcaggaggctgaggtggga

SEQ ID NO: 718667 - DNA, 20 bp, Artificial
  CRISPR gRNA sequence
aggaggctgaggtgggagga

SEQ ID NO: 718668 - DNA, 20 bp, Artificial
  CRISPR gRNA sequence
aggtgggaggatggcttgag

SEQ ID NO: 718669 - DNA, 20 bp, Artificial
  CRISPR gRNA sequence
gagcccaggaagttgaggtt

SEQ ID NO: 718670 - DNA, 20 bp, Artificial
  CRISPR gRNA sequence
agcccaggaagttgaggtta

SEQ ID NO: 718671 - DNA, 20 bp, Artificial
  CRISPR gRNA sequence
aggttacagtgagctgtgat

SEQ ID NO: 718672 - DNA, 20 bp, Artificial
  CRISPR gRNA sequence
cagtgagctgtgatcatgcc

SEQ ID NO: 718673 - DNA, 20 bp, Artificial
  CRISPR gRNA sequence
tgatcatgccactgcactcc

SEQ ID NO: 718674 - DNA, 20 bp, Artificial
  CRISPR gRNA sequence
cactccagcctgggcaacag

SEQ ID NO: 718675 - DNA, 20 bp, Artificial
  CRISPR gRNA sequence
cagcctgggcaacagagcaa

SEQ ID NO: 718676 - DNA, 20 bp, Artificial
  CRISPR gRNA sequence
ggcaacagagcaagaccctg

SEQ ID NO: 718677 - DNA, 20 bp, Artificial
  CRISPR gRNA sequence
tttcaaaaaaaaaaaatgat

SEQ ID NO: 718678 - DNA, 20 bp, Artificial
  CRISPR gRNA sequence
caaaaaaaaaaaatgataaa

SEQ ID NO: 718679 - DNA, 20 bp, Artificial
  CRISPR gRNA sequence
aaaaaaaaaaaatgataaaa

SEQ ID NO: 718680 - DNA, 20 bp, Artificial
  CRISPR gRNA sequence
tctatgatcattatcaagta

SEQ ID NO: 718681 - DNA, 20 bp, Artificial
  CRISPR gRNA sequence
ctatgatcattatcaagtat

SEQ ID NO: 718682 - DNA, 20 bp, Artificial
  CRISPR gRNA sequence
tatgatcattatcaagtatt

SEQ ID NO: 718683 - DNA, 20 bp, Artificial
  CRISPR gRNA sequence
tgatcattatcaagtattac

SEQ ID NO: 718684 - DNA, 20 bp, Artificial
  CRISPR gRNA sequence
tcaagtattacatactatcc

SEQ ID NO: 718685 - DNA, 20 bp, Artificial
  CRISPR gRNA sequence
catactatccataattgcat

SEQ ID NO: 718686 - DNA, 20 bp, Artificial
  CRISPR gRNA sequence
tccataattgcatgtgctat

SEQ ID NO: 718687 - DNA, 20 bp, Artificial
  CRISPR gRNA sequence
catgtgctatgcagcacttt

SEQ ID NO: 718688 - DNA, 20 bp, Artificial
  CRISPR gRNA sequence
tgcagcacttttatacaact

SEQ ID NO: 718689 - DNA, 20 bp, Artificial
  CRISPR gRNA sequence
ttatacaactggcagggcag

SEQ ID NO: 718690 - DNA, 20 bp, Artificial
  CRISPR gRNA sequence
tatacaactggcagggcagt

SEQ ID NO: 718691 - DNA, 20 bp, Artificial
  CRISPR gRNA sequence
atacaactggcagggcagta

SEQ ID NO: 718692 - DNA, 20 bp, Artificial
  CRISPR gRNA sequence
tacaactggcagggcagtag

SEQ ID NO: 718693 - DNA, 20 bp, Artificial
  CRISPR gRNA sequence
gcagggcagtaggtttgttt

SEQ ID NO: 718694 - DNA, 20 bp, Artificial
  CRISPR gRNA sequence
gtttataccaacatctccac

SEQ ID NO: 718695 - DNA, 20 bp, Artificial
  CRISPR gRNA sequence
tttataccaacatctccaca

SEQ ID NO: 718696 - DNA, 20 bp, Artificial
  CRISPR gRNA sequence
ataccaacatctccacaaac

SEQ ID NO: 718697 - DNA, 20 bp, Artificial
  CRISPR gRNA sequence
taccaacatctccacaaaca

SEQ ID NO: 718698 - DNA, 20 bp, Artificial
  CRISPR gRNA sequence
cacaaacatgggagtaacgc

SEQ ID NO: 718699 - DNA, 20 bp, Artificial
  CRISPR gRNA sequence
cgacattgccgtggctatga

SEQ ID NO: 718700 - DNA, 20 bp, Artificial
  CRISPR gRNA sequence
ccgtggctatgacatcacta

SEQ ID NO: 718701 - DNA, 20 bp, Artificial
  CRISPR gRNA sequence
tgacatcactaggcaatagg

SEQ ID NO: 718702 - DNA, 20 bp, Artificial
  CRISPR gRNA sequence
ggcaataggaatttttcagc

SEQ ID NO: 718703 - DNA, 20 bp, Artificial
  CRISPR gRNA sequence
ttcagctccattataatctc

SEQ ID NO: 718704 - DNA, 20 bp, Artificial
  CRISPR gRNA sequence
tcagctccattataatctct

SEQ ID NO: 718705 - DNA, 20 bp, Artificial
  CRISPR gRNA sequence
cagctccattataatctctt

SEQ ID NO: 718706 - DNA, 20 bp, Artificial
  CRISPR gRNA sequence
agctccattataatctcttt

SEQ ID NO: 718707 - DNA, 20 bp, Artificial
  CRISPR gRNA sequence
cattataatctcttttattg

SEQ ID NO: 718708 - DNA, 20 bp, Artificial
  CRISPR gRNA sequence
taatctcttttattgttttt

SEQ ID NO: 718709 - DNA, 20 bp, Artificial
  CRISPR gRNA sequence
ttttattgttttttttgttt

SEQ ID NO: 718710 - DNA, 20 bp, Artificial
  CRISPR gRNA sequence
ttattgttttttttgtttga

SEQ ID NO: 718711 - DNA, 20 bp, Artificial
  CRISPR gRNA sequence
tattgttttttttgtttgag

SEQ ID NO: 718712 - DNA, 20 bp, Artificial
  CRISPR gRNA sequence
attgttttttttgtttgaga

SEQ ID NO: 718713 - DNA, 20 bp, Artificial
  CRISPR gRNA sequence
ttgttttttttgtttgagat

SEQ ID NO: 718714 - DNA, 20 bp, Artificial
  CRISPR gRNA sequence
ttttttttgtttgagatgga

SEQ ID NO: 718715 - DNA, 20 bp, Artificial
  CRISPR gRNA sequence
tttttgtttgagatggagtc

SEQ ID NO: 718716 - DNA, 20 bp, Artificial
  CRISPR gRNA sequence
ttttgtttgagatggagtcc

SEQ ID NO: 718717 - DNA, 20 bp, Artificial
  CRISPR gRNA sequence
tttgtttgagatggagtcct

SEQ ID NO: 718718 - DNA, 20 bp, Artificial
  CRISPR gRNA sequence
ttgtttgagatggagtcctg

SEQ ID NO: 718719 - DNA, 20 bp, Artificial
  CRISPR gRNA sequence
tgtttgagatggagtcctgc

SEQ ID NO: 718720 - DNA, 20 bp, Artificial
  CRISPR gRNA sequence
gtttgagatggagtcctgct

SEQ ID NO: 718721 - DNA, 20 bp, Artificial
  CRISPR gRNA sequence
tttgagatggagtcctgctc

SEQ ID NO: 718722 - DNA, 20 bp, Artificial
  CRISPR gRNA sequence
gagatggagtcctgctctgt

SEQ ID NO: 718723 - DNA, 20 bp, Artificial
  CRISPR gRNA sequence
agatggagtcctgctctgtt

SEQ ID NO: 718724 - DNA, 20 bp, Artificial
  CRISPR gRNA sequence
ctctgttgcccaggctggag

SEQ ID NO: 718725 - DNA, 20 bp, Artificial
  CRISPR gRNA sequence
tgttgcccaggctggagtgc

SEQ ID NO: 718726 - DNA, 20 bp, Artificial
  CRISPR gRNA sequence
ttgcccaggctggagtgcaa

SEQ ID NO: 718727 - DNA, 20 bp, Artificial
  CRISPR gRNA sequence
cccaggctggagtgcaatgg

SEQ ID NO: 718728 - DNA, 20 bp, Artificial
  CRISPR gRNA sequence
gagtgcaatggcgcaatctc

SEQ ID NO: 718729 - DNA, 20 bp, Artificial
  CRISPR gRNA sequence
ggctcactgcaacctgggtt

SEQ ID NO: 718730 - DNA, 20 bp, Artificial
  CRISPR gRNA sequence
actgcaacctgggttcaagc

SEQ ID NO: 718731 - DNA, 20 bp, Artificial
  CRISPR gRNA sequence
caacctgggttcaagcgatt

SEQ ID NO: 718732 - DNA, 20 bp, Artificial
  CRISPR gRNA sequence
ggttcaagcgattctcctgt

SEQ ID NO: 718733 - DNA, 20 bp, Artificial
  CRISPR gRNA sequence
aagcgattctcctgtcttag

SEQ ID NO: 718734 - DNA, 20 bp, Artificial
  CRISPR gRNA sequence
tcctgtcttagcctctcaag

SEQ ID NO: 718735 - DNA, 20 bp, Artificial
  CRISPR gRNA sequence
ctgtcttagcctctcaagta

SEQ ID NO: 718736 - DNA, 20 bp, Artificial
  CRISPR gRNA sequence
tcttagcctctcaagtagct

SEQ ID NO: 718737 - DNA, 20 bp, Artificial
  CRISPR gRNA sequence
agcctctcaagtagctggga

SEQ ID NO: 718738 - DNA, 20 bp, Artificial
  CRISPR gRNA sequence
gcctctcaagtagctgggat

SEQ ID NO: 718739 - DNA, 20 bp, Artificial
  CRISPR gRNA sequence
tcaagtagctgggattacag

SEQ ID NO: 718740 - DNA, 20 bp, Artificial
  CRISPR gRNA sequence
aagtagctgggattacaggc

SEQ ID NO: 718741 - DNA, 20 bp, Artificial
  CRISPR gRNA sequence
ggattacaggcatgcgccac

SEQ ID NO: 718742 - DNA, 20 bp, Artificial
  CRISPR gRNA sequence
caggcatgcgccaccatgcc

SEQ ID NO: 718743 - DNA, 20 bp, Artificial
  CRISPR gRNA sequence
gctaatttttgtattttttt

SEQ ID NO: 718744 - DNA, 20 bp, Artificial
  CRISPR gRNA sequence
atttttgtattttttttagg

SEQ ID NO: 718745 - DNA, 20 bp, Artificial
  CRISPR gRNA sequence
ttgtattttttttaggagag

SEQ ID NO: 718746 - DNA, 20 bp, Artificial
  CRISPR gRNA sequence
tgtattttttttaggagagg

SEQ ID NO: 718747 - DNA, 20 bp, Artificial
  CRISPR gRNA sequence
gtattttttttaggagaggc

SEQ ID NO: 718748 - DNA, 20 bp, Artificial
  CRISPR gRNA sequence
tattttttttaggagaggcg

SEQ ID NO: 718749 - DNA, 20 bp, Artificial
  CRISPR gRNA sequence
tttttaggagaggcgggatt

SEQ ID NO: 718750 - DNA, 20 bp, Artificial
  CRISPR gRNA sequence
ttttaggagaggcgggattt

SEQ ID NO: 718751 - DNA, 20 bp, Artificial
  CRISPR gRNA sequence
tttaggagaggcgggatttc

SEQ ID NO: 718752 - DNA, 20 bp, Artificial
  CRISPR gRNA sequence
ttaggagaggcgggatttca

SEQ ID NO: 718753 - DNA, 20 bp, Artificial
  CRISPR gRNA sequence
taggagaggcgggatttcac

SEQ ID NO: 718754 - DNA, 20 bp, Artificial
  CRISPR gRNA sequence
aggagaggcgggatttcacc

SEQ ID NO: 718755 - DNA, 20 bp, Artificial
  CRISPR gRNA sequence
ggagaggcgggatttcacca

SEQ ID NO: 718756 - DNA, 20 bp, Artificial
  CRISPR gRNA sequence
caccatgttggccaggctgg

SEQ ID NO: 718757 - DNA, 20 bp, Artificial
  CRISPR gRNA sequence
accatgttggccaggctggt

SEQ ID NO: 718758 - DNA, 20 bp, Artificial
  CRISPR gRNA sequence
gccaggctggttttgaactc

SEQ ID NO: 718759 - DNA, 20 bp, Artificial
  CRISPR gRNA sequence
gttttgaactcctgacctca

SEQ ID NO: 718760 - DNA, 20 bp, Artificial
  CRISPR gRNA sequence
tgaactcctgacctcaggtt

SEQ ID NO: 718761 - DNA, 20 bp, Artificial
  CRISPR gRNA sequence
gaactcctgacctcaggtta

SEQ ID NO: 718762 - DNA, 20 bp, Artificial
  CRISPR gRNA sequence
aactcctgacctcaggttat

SEQ ID NO: 718763 - DNA, 20 bp, Artificial
  CRISPR gRNA sequence
ctgacctcaggttatccgcc

SEQ ID NO: 718764 - DNA, 20 bp, Artificial
  CRISPR gRNA sequence
acctcaggttatccgccctc

SEQ ID NO: 718765 - DNA, 20 bp, Artificial
  CRISPR gRNA sequence
aggttatccgccctcctcgg

SEQ ID NO: 718766 - DNA, 20 bp, Artificial
  CRISPR gRNA sequence
tccgccctcctcggcctccc

SEQ ID NO: 718767 - DNA, 20 bp, Artificial
  CRISPR gRNA sequence
ctcggcctcccaaagtgctg

SEQ ID NO: 718768 - DNA, 20 bp, Artificial
  CRISPR gRNA sequence
ggcctcccaaagtgctggga

SEQ ID NO: 718769 - DNA, 20 bp, Artificial
  CRISPR gRNA sequence
ccaaagtgctgggattacag

SEQ ID NO: 718770 - DNA, 20 bp, Artificial
  CRISPR gRNA sequence
ggattacaggcgtgagccac

SEQ ID NO: 718771 - DNA, 20 bp, Artificial
  CRISPR gRNA sequence
caggcgtgagccaccgcgcc

SEQ ID NO: 718772 - DNA, 20 bp, Artificial
  CRISPR gRNA sequence
ccattatgatcttgtgggac

SEQ ID NO: 718773 - DNA, 20 bp, Artificial
  CRISPR gRNA sequence
cattatgatcttgtgggacc

SEQ ID NO: 718774 - DNA, 20 bp, Artificial
  CRISPR gRNA sequence
tgatcttgtgggaccatcat

SEQ ID NO: 718775 - DNA, 20 bp, Artificial
  CRISPR gRNA sequence
gtgggaccatcatcatgtac

SEQ ID NO: 718776 - DNA, 20 bp, Artificial
  CRISPR gRNA sequence
tgggaccatcatcatgtacg

SEQ ID NO: 718777 - DNA, 20 bp, Artificial
  CRISPR gRNA sequence
ttgactgaaatgttgctctg

SEQ ID NO: 718778 - DNA, 20 bp, Artificial
  CRISPR gRNA sequence
actgaaatgttgctctgtgg

SEQ ID NO: 718779 - DNA, 20 bp, Artificial
  CRISPR gRNA sequence
aaatgttgctctgtggtgcg

SEQ ID NO: 718780 - DNA, 20 bp, Artificial
  CRISPR gRNA sequence
ctctgtggtgcgtgaaggta

SEQ ID NO: 718781 - DNA, 20 bp, Artificial
  CRISPR gRNA sequence
tgtggtgcgtgaaggtatca

SEQ ID NO: 718782 - DNA, 20 bp, Artificial
  CRISPR gRNA sequence
tggtgcgtgaaggtatcatt

SEQ ID NO: 718783 - DNA, 20 bp, Artificial
  CRISPR gRNA sequence
ctaatgttttgttctgtttt

SEQ ID NO: 718784 - DNA, 20 bp, Artificial
  CRISPR gRNA sequence
taatgttttgttctgttttc

SEQ ID NO: 718785 - DNA, 20 bp, Artificial
  CRISPR gRNA sequence
atgttttgttctgttttccc

SEQ ID NO: 718786 - DNA, 20 bp, Artificial
  CRISPR gRNA sequence
tgttctgttttccctctttt

SEQ ID NO: 718787 - DNA, 20 bp, Artificial
  CRISPR gRNA sequence
gttctgttttccctcttttc

SEQ ID NO: 718788 - DNA, 20 bp, Artificial
  CRISPR gRNA sequence
ttctgttttccctcttttct

SEQ ID NO: 718789 - DNA, 20 bp, Artificial
  CRISPR gRNA sequence
tgttttccctcttttctgcc

SEQ ID NO: 718790 - DNA, 20 bp, Artificial
  CRISPR gRNA sequence
ttttccctcttttctgcctc

SEQ ID NO: 718791 - DNA, 20 bp, Artificial
  CRISPR gRNA sequence
tccctcttttctgcctcctt

SEQ ID NO: 718792 - DNA, 20 bp, Artificial
  CRISPR gRNA sequence
ccctcttttctgcctccttg

SEQ ID NO: 718793 - DNA, 20 bp, Artificial
  CRISPR gRNA sequence
cctcttttctgcctccttga

SEQ ID NO: 718794 - DNA, 20 bp, Artificial
  CRISPR gRNA sequence
ttttctgcctccttgagtgt

SEQ ID NO: 718795 - DNA, 20 bp, Artificial
  CRISPR gRNA sequence
ttctgcctccttgagtgtta

SEQ ID NO: 718796 - DNA, 20 bp, Artificial
  CRISPR gRNA sequence
tctgcctccttgagtgttag

SEQ ID NO: 718797 - DNA, 20 bp, Artificial
  CRISPR gRNA sequence
ctgcctccttgagtgttagt

SEQ ID NO: 718798 - DNA, 20 bp, Artificial
  CRISPR gRNA sequence
tgcctccttgagtgttagtg

SEQ ID NO: 718799 - DNA, 20 bp, Artificial
  CRISPR gRNA sequence
cctccttgagtgttagtgct

SEQ ID NO: 718800 - DNA, 20 bp, Artificial
  CRISPR gRNA sequence
cttgagtgttagtgctcttt

SEQ ID NO: 718801 - DNA, 20 bp, Artificial
  CRISPR gRNA sequence
gagtgttagtgctctttgca

SEQ ID NO: 718802 - DNA, 20 bp, Artificial
  CRISPR gRNA sequence
agtgttagtgctctttgcat

SEQ ID NO: 718803 - DNA, 20 bp, Artificial
  CRISPR gRNA sequence
gtgctctttgcattcagagc

SEQ ID NO: 718804 - DNA, 20 bp, Artificial
  CRISPR gRNA sequence
tttgcattcagagctcctct

SEQ ID NO: 718805 - DNA, 20 bp, Artificial
  CRISPR gRNA sequence
tgcattcagagctcctcttc

SEQ ID NO: 718806 - DNA, 20 bp, Artificial
  CRISPR gRNA sequence
gcattcagagctcctcttcc

SEQ ID NO: 718807 - DNA, 20 bp, Artificial
  CRISPR gRNA sequence
cattcagagctcctcttcct

SEQ ID NO: 718808 - DNA, 20 bp, Artificial
  CRISPR gRNA sequence
agagctcctcttccttggcg

SEQ ID NO: 718809 - DNA, 20 bp, Artificial
  CRISPR gRNA sequence
ctcttccttggcgctggttt

SEQ ID NO: 718810 - DNA, 20 bp, Artificial
  CRISPR gRNA sequence
ttccttggcgctggttttcc

SEQ ID NO: 718811 - DNA, 20 bp, Artificial
  CRISPR gRNA sequence
ccttggcgctggttttcctc

SEQ ID NO: 718812 - DNA, 20 bp, Artificial
  CRISPR gRNA sequence
cttggcgctggttttcctct

SEQ ID NO: 718813 - DNA, 20 bp, Artificial
  CRISPR gRNA sequence
ggcgctggttttcctctgat

SEQ ID NO: 718814 - DNA, 20 bp, Artificial
  CRISPR gRNA sequence
gcgctggttttcctctgatg

SEQ ID NO: 718815 - DNA, 20 bp, Artificial
  CRISPR gRNA sequence
gttttcctctgatgtttggc

SEQ ID NO: 718816 - DNA, 20 bp, Artificial
  CRISPR gRNA sequence
tcctctgatgtttggcgact

SEQ ID NO: 718817 - DNA, 20 bp, Artificial
  CRISPR gRNA sequence
cctctgatgtttggcgactt

SEQ ID NO: 718818 - DNA, 20 bp, Artificial
  CRISPR gRNA sequence
ctctgatgtttggcgacttc

SEQ ID NO: 718819 - DNA, 20 bp, Artificial
  CRISPR gRNA sequence
tgatgtttggcgacttctag

SEQ ID NO: 718820 - DNA, 20 bp, Artificial
  CRISPR gRNA sequence
atgtttggcgacttctagtt

SEQ ID NO: 718821 - DNA, 20 bp, Artificial
  CRISPR gRNA sequence
ggcgacttctagttctgtgc

SEQ ID NO: 718822 - DNA, 20 bp, Artificial
  CRISPR gRNA sequence
gcgacttctagttctgtgca

SEQ ID NO: 718823 - DNA, 20 bp, Artificial
  CRISPR gRNA sequence
ctagttctgtgcacatcata

SEQ ID NO: 718824 - DNA, 20 bp, Artificial
  CRISPR gRNA sequence
tagttctgtgcacatcatat

SEQ ID NO: 718825 - DNA, 20 bp, Artificial
  CRISPR gRNA sequence
gttctgtgcacatcatatct

SEQ ID NO: 718826 - DNA, 20 bp, Artificial
  CRISPR gRNA sequence
tgtgcacatcatatctcatg

SEQ ID NO: 718827 - DNA, 20 bp, Artificial
  CRISPR gRNA sequence
tgcacatcatatctcatgat

SEQ ID NO: 718828 - DNA, 20 bp, Artificial
  CRISPR gRNA sequence
atgatgccggtggtctgcga

SEQ ID NO: 718829 - DNA, 20 bp, Artificial
  CRISPR gRNA sequence
cgaatggggcttctgaaacc

SEQ ID NO: 718830 - DNA, 20 bp, Artificial
  CRISPR gRNA sequence
ctgaaacccacctctgaggg

SEQ ID NO: 718831 - DNA, 20 bp, Artificial
  CRISPR gRNA sequence
tgaaacccacctctgagggc

SEQ ID NO: 718832 - DNA, 20 bp, Artificial
  CRISPR gRNA sequence
aaacccacctctgagggcaa

SEQ ID NO: 718833 - DNA, 20 bp, Artificial
  CRISPR gRNA sequence
tgagggcaatggggctcagg

SEQ ID NO: 718834 - DNA, 20 bp, Artificial
  CRISPR gRNA sequence
agggcaatggggctcaggtg

SEQ ID NO: 718835 - DNA, 20 bp, Artificial
  CRISPR gRNA sequence
aggtggggctgcaacagtct

SEQ ID NO: 718836 - DNA, 20 bp, Artificial
  CRISPR gRNA sequence
caacagtctctttgcgggaa

SEQ ID NO: 718837 - DNA, 20 bp, Artificial
  CRISPR gRNA sequence
tttgcgggaagacgcgtggc

SEQ ID NO: 718838 - DNA, 20 bp, Artificial
  CRISPR gRNA sequence
tgcgggaagacgcgtggcct

SEQ ID NO: 718839 - DNA, 20 bp, Artificial
  CRISPR gRNA sequence
gcgggaagacgcgtggcctc

SEQ ID NO: 718840 - DNA, 20 bp, Artificial
  CRISPR gRNA sequence
cgggaagacgcgtggcctct

SEQ ID NO: 718841 - DNA, 20 bp, Artificial
  CRISPR gRNA sequence
tggctctgtggcatgagtga

SEQ ID NO: 718842 - DNA, 20 bp, Artificial
  CRISPR gRNA sequence
gctctgtggcatgagtgatg

SEQ ID NO: 718843 - DNA, 20 bp, Artificial
  CRISPR gRNA sequence
tgtggcatgagtgatgagga

SEQ ID NO: 718844 - DNA, 20 bp, Artificial
  CRISPR gRNA sequence
tggcatgagtgatgaggagc

SEQ ID NO: 718845 - DNA, 20 bp, Artificial
  CRISPR gRNA sequence
tccagagcctttcccccttc

SEQ ID NO: 718846 - DNA, 20 bp, Artificial
  CRISPR gRNA sequence
tcccccttcttcagagagtc

SEQ ID NO: 718847 - DNA, 20 bp, Artificial
  CRISPR gRNA sequence
cccccttcttcagagagtcc

SEQ ID NO: 718848 - DNA, 20 bp, Artificial
  CRISPR gRNA sequence
ccccttcttcagagagtccc

SEQ ID NO: 718849 - DNA, 20 bp, Artificial
  CRISPR gRNA sequence
cttcagagagtcccccttgg

SEQ ID NO: 718850 - DNA, 20 bp, Artificial
  CRISPR gRNA sequence
ttcagagagtcccccttggc

SEQ ID NO: 718851 - DNA, 20 bp, Artificial
  CRISPR gRNA sequence
cagagagtcccccttggctg

SEQ ID NO: 718852 - DNA, 20 bp, Artificial
  CRISPR gRNA sequence
agagagtcccccttggctgc

SEQ ID NO: 718853 - DNA, 20 bp, Artificial
  CRISPR gRNA sequence
ggctgcattctgggctgtgg

SEQ ID NO: 718854 - DNA, 20 bp, Artificial
  CRISPR gRNA sequence
gctgcattctgggctgtggt

SEQ ID NO: 718855 - DNA, 20 bp, Artificial
  CRISPR gRNA sequence
cattctgggctgtggtctcc

SEQ ID NO: 718856 - DNA, 20 bp, Artificial
  CRISPR gRNA sequence
tgggctgtggtctccttcac

SEQ ID NO: 718857 - DNA, 20 bp, Artificial
  CRISPR gRNA sequence
ggctgtggtctccttcactc

SEQ ID NO: 718858 - DNA, 20 bp, Artificial
  CRISPR gRNA sequence
tggtctccttcactctgatc

SEQ ID NO: 718859 - DNA, 20 bp, Artificial
  CRISPR gRNA sequence
cttcactctgatcttatctg

SEQ ID NO: 718860 - DNA, 20 bp, Artificial
  CRISPR gRNA sequence
cactctgatcttatctgtcc

SEQ ID NO: 718861 - DNA, 20 bp, Artificial
  CRISPR gRNA sequence
actctgatcttatctgtcct

SEQ ID NO: 718862 - DNA, 20 bp, Artificial
  CRISPR gRNA sequence
tgatcttatctgtcctctgc

SEQ ID NO: 718863 - DNA, 20 bp, Artificial
  CRISPR gRNA sequence
atcttatctgtcctctgcct

SEQ ID NO: 718864 - DNA, 20 bp, Artificial
  CRISPR gRNA sequence
atctgtcctctgccttccgt

SEQ ID NO: 718865 - DNA, 20 bp, Artificial
  CRISPR gRNA sequence
tctgtcctctgccttccgta

SEQ ID NO: 718866 - DNA, 20 bp, Artificial
  CRISPR gRNA sequence
tcctctgccttccgtatttc

SEQ ID NO: 718867 - DNA, 20 bp, Artificial
  CRISPR gRNA sequence
tgccttccgtatttcgggga

SEQ ID NO: 718868 - DNA, 20 bp, Artificial
  CRISPR gRNA sequence
ccttccgtatttcggggagt

SEQ ID NO: 718869 - DNA, 20 bp, Artificial
  CRISPR gRNA sequence
ccgtatttcggggagttgtc

SEQ ID NO: 718870 - DNA, 20 bp, Artificial
  CRISPR gRNA sequence
cgtatttcggggagttgtct

SEQ ID NO: 718871 - DNA, 20 bp, Artificial
  CRISPR gRNA sequence
cggggagttgtcttcgtttc

SEQ ID NO: 718872 - DNA, 20 bp, Artificial
  CRISPR gRNA sequence
ggggagttgtcttcgtttct

SEQ ID NO: 718873 - DNA, 20 bp, Artificial
  CRISPR gRNA sequence
tcttcgtttctgatctgcca

SEQ ID NO: 718874 - DNA, 20 bp, Artificial
  CRISPR gRNA sequence
cgtttctgatctgccaagct

SEQ ID NO: 718875 - DNA, 20 bp, Artificial
  CRISPR gRNA sequence
gtttctgatctgccaagctt

SEQ ID NO: 718876 - DNA, 20 bp, Artificial
  CRISPR gRNA sequence
ctgatctgccaagcttgccc

SEQ ID NO: 718877 - DNA, 20 bp, Artificial
  CRISPR gRNA sequence
tgatctgccaagcttgcccc

SEQ ID NO: 718878 - DNA, 20 bp, Artificial
  CRISPR gRNA sequence
atctgccaagcttgcccctt

SEQ ID NO: 718879 - DNA, 20 bp, Artificial
  CRISPR gRNA sequence
ccaagcttgccccttcttgg

SEQ ID NO: 718880 - DNA, 20 bp, Artificial
  CRISPR gRNA sequence
gccccttcttggtctccagg

SEQ ID NO: 718881 - DNA, 20 bp, Artificial
  CRISPR gRNA sequence
ccccttcttggtctccaggc

SEQ ID NO: 718882 - DNA, 20 bp, Artificial
  CRISPR gRNA sequence
cttggtctccaggcctgtta

SEQ ID NO: 718883 - DNA, 20 bp, Artificial
  CRISPR gRNA sequence
ttggtctccaggcctgttac

SEQ ID NO: 718884 - DNA, 20 bp, Artificial
  CRISPR gRNA sequence
ggtctccaggcctgttacac

SEQ ID NO: 718885 - DNA, 20 bp, Artificial
  CRISPR gRNA sequence
gtctccaggcctgttacaca

SEQ ID NO: 718886 - DNA, 20 bp, Artificial
  CRISPR gRNA sequence
caggcctgttacacattaat

SEQ ID NO: 718887 - DNA, 20 bp, Artificial
  CRISPR gRNA sequence
ttacacattaattattagtt

SEQ ID NO: 718888 - DNA, 20 bp, Artificial
  CRISPR gRNA sequence
cacattaattattagtttta

SEQ ID NO: 718889 - DNA, 20 bp, Artificial
  CRISPR gRNA sequence
attattagttttaccagtgc

SEQ ID NO: 718890 - DNA, 20 bp, Artificial
  CRISPR gRNA sequence
ttagttttaccagtgctatt

SEQ ID NO: 718891 - DNA, 20 bp, Artificial
  CRISPR gRNA sequence
gttttaccagtgctattttt

SEQ ID NO: 718892 - DNA, 20 bp, Artificial
  CRISPR gRNA sequence
taccagtgctatttttgttt

SEQ ID NO: 718893 - DNA, 20 bp, Artificial
  CRISPR gRNA sequence
accagtgctatttttgtttt

SEQ ID NO: 718894 - DNA, 20 bp, Artificial
  CRISPR gRNA sequence
ccagtgctatttttgttttg

SEQ ID NO: 718895 - DNA, 20 bp, Artificial
  CRISPR gRNA sequence
tttttgttttgttttgtttt

SEQ ID NO: 718896 - DNA, 20 bp, Artificial
  CRISPR gRNA sequence
ttgttttgttttgttttgtt

SEQ ID NO: 718897 - DNA, 20 bp, Artificial
  CRISPR gRNA sequence
tgttttgttttgttttgttt

SEQ ID NO: 718898 - DNA, 20 bp, Artificial
  CRISPR gRNA sequence
gttttgttttgttttgtttg

SEQ ID NO: 718899 - DNA, 20 bp, Artificial
  CRISPR gRNA sequence
ttttgttttgttttgtttga

SEQ ID NO: 718900 - DNA, 20 bp, Artificial
  CRISPR gRNA sequence
tgttttgttttgtttgagac

SEQ ID NO: 718901 - DNA, 20 bp, Artificial
  CRISPR gRNA sequence
gttttgttttgtttgagacg

SEQ ID NO: 718902 - DNA, 20 bp, Artificial
  CRISPR gRNA sequence
ttttgttttgtttgagacgg

SEQ ID NO: 718903 - DNA, 20 bp, Artificial
  CRISPR gRNA sequence
tgttttgtttgagacggagt

SEQ ID NO: 718904 - DNA, 20 bp, Artificial
  CRISPR gRNA sequence
gttttgtttgagacggagtc

SEQ ID NO: 718905 - DNA, 20 bp, Artificial
  CRISPR gRNA sequence
ttttgtttgagacggagtct

SEQ ID NO: 718906 - DNA, 20 bp, Artificial
  CRISPR gRNA sequence
tgtttgagacggagtctcgc

SEQ ID NO: 718907 - DNA, 20 bp, Artificial
  CRISPR gRNA sequence
gtttgagacggagtctcgct

SEQ ID NO: 718908 - DNA, 20 bp, Artificial
  CRISPR gRNA sequence
tttgagacggagtctcgctc

SEQ ID NO: 718909 - DNA, 20 bp, Artificial
  CRISPR gRNA sequence
gagacggagtctcgctcttt

SEQ ID NO: 718910 - DNA, 20 bp, Artificial
  CRISPR gRNA sequence
agacggagtctcgctctttt

SEQ ID NO: 718911 - DNA, 20 bp, Artificial
  CRISPR gRNA sequence
gctcttttgcccaggctgga

SEQ ID NO: 718912 - DNA, 20 bp, Artificial
  CRISPR gRNA sequence
ttttgcccaggctggagtga

SEQ ID NO: 718913 - DNA, 20 bp, Artificial
  CRISPR gRNA sequence
ttgcccaggctggagtgaag

SEQ ID NO: 718914 - DNA, 20 bp, Artificial
  CRISPR gRNA sequence
tgcccaggctggagtgaagt

SEQ ID NO: 718915 - DNA, 20 bp, Artificial
  CRISPR gRNA sequence
gcccaggctggagtgaagtg

SEQ ID NO: 718916 - DNA, 20 bp, Artificial
  CRISPR gRNA sequence
cccaggctggagtgaagtgg

SEQ ID NO: 718917 - DNA, 20 bp, Artificial
  CRISPR gRNA sequence
gagtgaagtggggccatctc

SEQ ID NO: 718918 - DNA, 20 bp, Artificial
  CRISPR gRNA sequence
aactcactgcaacctccact

SEQ ID NO: 718919 - DNA, 20 bp, Artificial
  CRISPR gRNA sequence
actgcaacctccacttctcg

SEQ ID NO: 718920 - DNA, 20 bp, Artificial
  CRISPR gRNA sequence
caacctccacttctcgggtt

SEQ ID NO: 718921 - DNA, 20 bp, Artificial
  CRISPR gRNA sequence
cacttctcgggttcaagtga

SEQ ID NO: 718922 - DNA, 20 bp, Artificial
  CRISPR gRNA sequence
ctcgggttcaagtgattttc

SEQ ID NO: 718923 - DNA, 20 bp, Artificial
  CRISPR gRNA sequence
tcgggttcaagtgattttcc

SEQ ID NO: 718924 - DNA, 20 bp, Artificial
  CRISPR gRNA sequence
gggttcaagtgattttcctg

SEQ ID NO: 718925 - DNA, 20 bp, Artificial
  CRISPR gRNA sequence
aagtgattttcctgtctcag

SEQ ID NO: 718926 - DNA, 20 bp, Artificial
  CRISPR gRNA sequence
tcctgtctcagcctccccag

SEQ ID NO: 718927 - DNA, 20 bp, Artificial
  CRISPR gRNA sequence
cctgtctcagcctccccagt

SEQ ID NO: 718928 - DNA, 20 bp, Artificial
  CRISPR gRNA sequence
ctgtctcagcctccccagta

SEQ ID NO: 718929 - DNA, 20 bp, Artificial
  CRISPR gRNA sequence
tctcagcctccccagtagct

SEQ ID NO: 718930 - DNA, 20 bp, Artificial
  CRISPR gRNA sequence
agcctccccagtagcttgga

SEQ ID NO: 718931 - DNA, 20 bp, Artificial
  CRISPR gRNA sequence
cccagtagcttggattacag

SEQ ID NO: 718932 - DNA, 20 bp, Artificial
  CRISPR gRNA sequence
ggattacaggtgtgcaccac

SEQ ID NO: 718933 - DNA, 20 bp, Artificial
  CRISPR gRNA sequence
gattacaggtgtgcaccacc

SEQ ID NO: 718934 - DNA, 20 bp, Artificial
  CRISPR gRNA sequence
caggtgtgcaccaccacacc

SEQ ID NO: 718935 - DNA, 20 bp, Artificial
  CRISPR gRNA sequence
gctaatttttgtatttttag

SEQ ID NO: 718936 - DNA, 20 bp, Artificial
  CRISPR gRNA sequence
atttttgtatttttagtaga

SEQ ID NO: 718937 - DNA, 20 bp, Artificial
  CRISPR gRNA sequence
ttgtatttttagtagagaca

SEQ ID NO: 718938 - DNA, 20 bp, Artificial
  CRISPR gRNA sequence
tgtatttttagtagagacag

SEQ ID NO: 718939 - DNA, 20 bp, Artificial
  CRISPR gRNA sequence
gtatttttagtagagacagg

SEQ ID NO: 718940 - DNA, 20 bp, Artificial
  CRISPR gRNA sequence
tatttttagtagagacaggg

SEQ ID NO: 718941 - DNA, 20 bp, Artificial
  CRISPR gRNA sequence
ttagtagagacagggtttca

SEQ ID NO: 718942 - DNA, 20 bp, Artificial
  CRISPR gRNA sequence
tagtagagacagggtttcac

SEQ ID NO: 718943 - DNA, 20 bp, Artificial
  CRISPR gRNA sequence
agtagagacagggtttcact

SEQ ID NO: 718944 - DNA, 20 bp, Artificial
  CRISPR gRNA sequence
gtagagacagggtttcacta

SEQ ID NO: 718945 - DNA, 20 bp, Artificial
  CRISPR gRNA sequence
cactatgttggccgggctgg

SEQ ID NO: 718946 - DNA, 20 bp, Artificial
  CRISPR gRNA sequence
actatgttggccgggctggt

SEQ ID NO: 718947 - DNA, 20 bp, Artificial
  CRISPR gRNA sequence
tgttggccgggctggtctca

SEQ ID NO: 718948 - DNA, 20 bp, Artificial
  CRISPR gRNA sequence
gccgggctggtctcaaactc

SEQ ID NO: 718949 - DNA, 20 bp, Artificial
  CRISPR gRNA sequence
gtctcaaactcctgacctca

SEQ ID NO: 718950 - DNA, 20 bp, Artificial
  CRISPR gRNA sequence
aaactcctgacctcaggtga

SEQ ID NO: 718951 - DNA, 20 bp, Artificial
  CRISPR gRNA sequence
ctgacctcaggtgatctgcc

SEQ ID NO: 718952 - DNA, 20 bp, Artificial
  CRISPR gRNA sequence
acctcaggtgatctgcccac

SEQ ID NO: 718953 - DNA, 20 bp, Artificial
  CRISPR gRNA sequence
aggtgatctgcccacctcgg

SEQ ID NO: 718954 - DNA, 20 bp, Artificial
  CRISPR gRNA sequence
cccacctcggcctcccaaag

SEQ ID NO: 718955 - DNA, 20 bp, Artificial
  CRISPR gRNA sequence
ggcctcccaaagtgctggga

SEQ ID NO: 718956 - DNA, 20 bp, Artificial
  CRISPR gRNA sequence
ccaaagtgctgggattacaa

SEQ ID NO: 718957 - DNA, 20 bp, Artificial
  CRISPR gRNA sequence
ggattacaagtgtgaaccac

SEQ ID NO: 718958 - DNA, 20 bp, Artificial
  CRISPR gRNA sequence
caagtgtgaaccaccactcc

SEQ ID NO: 718959 - DNA, 20 bp, Artificial
  CRISPR gRNA sequence
cccgcctagctgtacttttt

SEQ ID NO: 718960 - DNA, 20 bp, Artificial
  CRISPR gRNA sequence
gctgtactttttatgtctgt

SEQ ID NO: 718961 - DNA, 20 bp, Artificial
  CRISPR gRNA sequence
tactttttatgtctgttaac

SEQ ID NO: 718962 - DNA, 20 bp, Artificial
  CRISPR gRNA sequence
tttatgtctgttaaccaacc

SEQ ID NO: 718963 - DNA, 20 bp, Artificial
  CRISPR gRNA sequence
ttatgtctgttaaccaacct

SEQ ID NO: 718964 - DNA, 20 bp, Artificial
  CRISPR gRNA sequence
tatgtctgttaaccaacctg

SEQ ID NO: 718965 - DNA, 20 bp, Artificial
  CRISPR gRNA sequence
atgtctgttaaccaacctgt

SEQ ID NO: 718966 - DNA, 20 bp, Artificial
  CRISPR gRNA sequence
tgtctgttaaccaacctgtg

SEQ ID NO: 718967 - DNA, 20 bp, Artificial
  CRISPR gRNA sequence
ttaaccaacctgtgatttcc

SEQ ID NO: 718968 - DNA, 20 bp, Artificial
  CRISPR gRNA sequence
accaacctgtgatttcctgc

SEQ ID NO: 718969 - DNA, 20 bp, Artificial
  CRISPR gRNA sequence
tgatttcctgcttttcctgc

SEQ ID NO: 718970 - DNA, 20 bp, Artificial
  CRISPR gRNA sequence
cctgcttttcctgccagcag

SEQ ID NO: 718971 - DNA, 20 bp, Artificial
  CRISPR gRNA sequence
ctgcttttcctgccagcagt

SEQ ID NO: 718972 - DNA, 20 bp, Artificial
  CRISPR gRNA sequence
cttttcctgccagcagttgt

SEQ ID NO: 718973 - DNA, 20 bp, Artificial
  CRISPR gRNA sequence
ttcctgccagcagttgttat

SEQ ID NO: 718974 - DNA, 20 bp, Artificial
  CRISPR gRNA sequence
tcctgccagcagttgttatt

SEQ ID NO: 718975 - DNA, 20 bp, Artificial
  CRISPR gRNA sequence
cctgccagcagttgttatta

SEQ ID NO: 718976 - DNA, 20 bp, Artificial
  CRISPR gRNA sequence
ctgccagcagttgttattat

SEQ ID NO: 718977 - DNA, 20 bp, Artificial
  CRISPR gRNA sequence
ccagcagttgttattatctg

SEQ ID NO: 718978 - DNA, 20 bp, Artificial
  CRISPR gRNA sequence
ttattatctgtctttttgat

SEQ ID NO: 718979 - DNA, 20 bp, Artificial
  CRISPR gRNA sequence
ttatctgtctttttgattcg

SEQ ID NO: 718980 - DNA, 20 bp, Artificial
  CRISPR gRNA sequence
tctgtctttttgattcgagt

SEQ ID NO: 718981 - DNA, 20 bp, Artificial
  CRISPR gRNA sequence
tctttttgattcgagtcatt

SEQ ID NO: 718982 - DNA, 20 bp, Artificial
  CRISPR gRNA sequence
tttgattcgagtcattctag

SEQ ID NO: 718983 - DNA, 20 bp, Artificial
  CRISPR gRNA sequence
ttgattcgagtcattctagt

SEQ ID NO: 718984 - DNA, 20 bp, Artificial
  CRISPR gRNA sequence
tgattcgagtcattctagtg

SEQ ID NO: 718985 - DNA, 20 bp, Artificial
  CRISPR gRNA sequence
gattcgagtcattctagtgg

SEQ ID NO: 718986 - DNA, 20 bp, Artificial
  CRISPR gRNA sequence
attcgagtcattctagtggt

SEQ ID NO: 718987 - DNA, 20 bp, Artificial
  CRISPR gRNA sequence
gagtcattctagtggttgtg

SEQ ID NO: 718988 - DNA, 20 bp, Artificial
  CRISPR gRNA sequence
tagtggttgtgaagtggtat

SEQ ID NO: 718989 - DNA, 20 bp, Artificial
  CRISPR gRNA sequence
gtggttgtgaagtggtatct

SEQ ID NO: 718990 - DNA, 20 bp, Artificial
  CRISPR gRNA sequence
tgaagtggtatctcactgtg

SEQ ID NO: 718991 - DNA, 20 bp, Artificial
  CRISPR gRNA sequence
actgtgattttgacttgcat

SEQ ID NO: 718992 - DNA, 20 bp, Artificial
  CRISPR gRNA sequence
tgattttgacttgcatttcc

SEQ ID NO: 718993 - DNA, 20 bp, Artificial
  CRISPR gRNA sequence
tgacttgcatttccctaatg

SEQ ID NO: 718994 - DNA, 20 bp, Artificial
  CRISPR gRNA sequence
gacttgcatttccctaatgg

SEQ ID NO: 718995 - DNA, 20 bp, Artificial
  CRISPR gRNA sequence
acttgcatttccctaatggc

SEQ ID NO: 718996 - DNA, 20 bp, Artificial
  CRISPR gRNA sequence
gcatttccctaatggctaac

SEQ ID NO: 718997 - DNA, 20 bp, Artificial
  CRISPR gRNA sequence
catttccctaatggctaacg

SEQ ID NO: 718998 - DNA, 20 bp, Artificial
  CRISPR gRNA sequence
ccctaatggctaacggtgtg

SEQ ID NO: 718999 - DNA, 20 bp, Artificial
  CRISPR gRNA sequence
cctaatggctaacggtgtgg

SEQ ID NO: 719000 - DNA, 20 bp, Artificial
  CRISPR gRNA sequence
atggctaacggtgtgggaca

SEQ ID NO: 719001 - DNA, 20 bp, Artificial
  CRISPR gRNA sequence
acggtgtgggacatttttca

SEQ ID NO: 719002 - DNA, 20 bp, Artificial
  CRISPR gRNA sequence
ttcatgtgtttattggccag

SEQ ID NO: 719003 - DNA, 20 bp, Artificial
  CRISPR gRNA sequence
tcatgtgtttattggccagc

SEQ ID NO: 719004 - DNA, 20 bp, Artificial
  CRISPR gRNA sequence
catgtgtttattggccagct

SEQ ID NO: 719005 - DNA, 20 bp, Artificial
  CRISPR gRNA sequence
atgtgtttattggccagctg

SEQ ID NO: 719006 - DNA, 20 bp, Artificial
  CRISPR gRNA sequence
attggccagctgtgtatctt

SEQ ID NO: 719007 - DNA, 20 bp, Artificial
  CRISPR gRNA sequence
ttggccagctgtgtatcttc

SEQ ID NO: 719008 - DNA, 20 bp, Artificial
  CRISPR gRNA sequence
gccagctgtgtatcttcttt

SEQ ID NO: 719009 - DNA, 20 bp, Artificial
  CRISPR gRNA sequence
tgtatcttctttagagaaat

SEQ ID NO: 719010 - DNA, 20 bp, Artificial
  CRISPR gRNA sequence
ctttagagaaatgtctattc

SEQ ID NO: 719011 - DNA, 20 bp, Artificial
  CRISPR gRNA sequence
tttagagaaatgtctattcc

SEQ ID NO: 719012 - DNA, 20 bp, Artificial
  CRISPR gRNA sequence
tagagaaatgtctattccag

SEQ ID NO: 719013 - DNA, 20 bp, Artificial
  CRISPR gRNA sequence
agagaaatgtctattccagt

SEQ ID NO: 719014 - DNA, 20 bp, Artificial
  CRISPR gRNA sequence
gagaaatgtctattccagtc

SEQ ID NO: 719015 - DNA, 20 bp, Artificial
  CRISPR gRNA sequence
ttccagtcctttgtccatta

SEQ ID NO: 719016 - DNA, 20 bp, Artificial
  CRISPR gRNA sequence
cagtcctttgtccattaaaa

SEQ ID NO: 719017 - DNA, 20 bp, Artificial
  CRISPR gRNA sequence
tgtccattaaaaaaattaat

SEQ ID NO: 719018 - DNA, 20 bp, Artificial
  CRISPR gRNA sequence
gtccattaaaaaaattaata

SEQ ID NO: 719019 - DNA, 20 bp, Artificial
  CRISPR gRNA sequence
tccattaaaaaaattaataa

SEQ ID NO: 719020 - DNA, 20 bp, Artificial
  CRISPR gRNA sequence
aaaaaattaataaactattt

SEQ ID NO: 719021 - DNA, 20 bp, Artificial
  CRISPR gRNA sequence
ataaactatttctggctggg

SEQ ID NO: 719022 - DNA, 20 bp, Artificial
  CRISPR gRNA sequence
tttctggctgggtgcagtgg

SEQ ID NO: 719023 - DNA, 20 bp, Artificial
  CRISPR gRNA sequence
ctggctgggtgcagtggctc

SEQ ID NO: 719024 - DNA, 20 bp, Artificial
  CRISPR gRNA sequence
tggctgggtgcagtggctca

SEQ ID NO: 719025 - DNA, 20 bp, Artificial
  CRISPR gRNA sequence
gctgggtgcagtggctcacg

SEQ ID NO: 719026 - DNA, 20 bp, Artificial
  CRISPR gRNA sequence
ggtgcagtggctcacgcctg

SEQ ID NO: 719027 - DNA, 20 bp, Artificial
  CRISPR gRNA sequence
acgcctgtaatctcagcact

SEQ ID NO: 719028 - DNA, 20 bp, Artificial
  CRISPR gRNA sequence
taatctcagcactttgggag

SEQ ID NO: 719029 - DNA, 20 bp, Artificial
  CRISPR gRNA sequence
agcactttgggaggccgagg

SEQ ID NO: 719030 - DNA, 20 bp, Artificial
  CRISPR gRNA sequence
tgggaggccgaggcgggtgg

SEQ ID NO: 719031 - DNA, 20 bp, Artificial
  CRISPR gRNA sequence
gggaggccgaggcgggtgga

SEQ ID NO: 719032 - DNA, 20 bp, Artificial
  CRISPR gRNA sequence
ggaggccgaggcgggtggat

SEQ ID NO: 719033 - DNA, 20 bp, Artificial
  CRISPR gRNA sequence
aggtcaggagtttgagacca

SEQ ID NO: 719034 - DNA, 20 bp, Artificial
  CRISPR gRNA sequence
gagaccatcctggccaacgt

SEQ ID NO: 719035 - DNA, 20 bp, Artificial
  CRISPR gRNA sequence
agaccatcctggccaacgtg

SEQ ID NO: 719036 - DNA, 20 bp, Artificial
  CRISPR gRNA sequence
gccaacgtggtgaaaccccg

SEQ ID NO: 719037 - DNA, 20 bp, Artificial
  CRISPR gRNA sequence
tataaaaatacaaaaaatta

SEQ ID NO: 719038 - DNA, 20 bp, Artificial
  CRISPR gRNA sequence
taaaaatacaaaaaattagt

SEQ ID NO: 719039 - DNA, 20 bp, Artificial
  CRISPR gRNA sequence
gttgggcgtggtggtgtgtg

SEQ ID NO: 719040 - DNA, 20 bp, Artificial
  CRISPR gRNA sequence
ggcgtggtggtgtgtgcctg

SEQ ID NO: 719041 - DNA, 20 bp, Artificial
  CRISPR gRNA sequence
taatcccagctactcaggag

SEQ ID NO: 719042 - DNA, 20 bp, Artificial
  CRISPR gRNA sequence
ctcaggaggctgaggcagga

SEQ ID NO: 719043 - DNA, 20 bp, Artificial
  CRISPR gRNA sequence
aggaggctgaggcaggagaa

SEQ ID NO: 719044 - DNA, 20 bp, Artificial
  CRISPR gRNA sequence
aggcaggagaatcacttgaa

SEQ ID NO: 719045 - DNA, 20 bp, Artificial
  CRISPR gRNA sequence
gaacccaggttgcagtgagc

SEQ ID NO: 719046 - DNA, 20 bp, Artificial
  CRISPR gRNA sequence
aacccaggttgcagtgagcc

SEQ ID NO: 719047 - DNA, 20 bp, Artificial
  CRISPR gRNA sequence
cagtgagccgagattgcgcc

SEQ ID NO: 719048 - DNA, 20 bp, Artificial
  CRISPR gRNA sequence
cgccattgcactccaacctg

SEQ ID NO: 719049 - DNA, 20 bp, Artificial
  CRISPR gRNA sequence
cactccaacctgggtgacag

SEQ ID NO: 719050 - DNA, 20 bp, Artificial
  CRISPR gRNA sequence
caacctgggtgacagagtga

SEQ ID NO: 719051 - DNA, 20 bp, Artificial
  CRISPR gRNA sequence
ggtgacagagtgagactctg

SEQ ID NO: 719052 - DNA, 20 bp, Artificial
  CRISPR gRNA sequence
tgtcttaaaaaaaaaaaaat

SEQ ID NO: 719053 - DNA, 20 bp, Artificial
  CRISPR gRNA sequence
tcttaaaaaaaaaaaaatta

SEQ ID NO: 719054 - DNA, 20 bp, Artificial
  CRISPR gRNA sequence
aaaaaaaaaaaaattaataa

SEQ ID NO: 719055 - DNA, 20 bp, Artificial
  CRISPR gRNA sequence
aaaaaaaaaaaattaataaa

SEQ ID NO: 719056 - DNA, 20 bp, Artificial
  CRISPR gRNA sequence
ataaactatttcttagagca

SEQ ID NO: 719057 - DNA, 20 bp, Artificial
  CRISPR gRNA sequence
tttcttagagcagttttagg

SEQ ID NO: 719058 - DNA, 20 bp, Artificial
  CRISPR gRNA sequence
cttagagcagttttaggttt

SEQ ID NO: 719059 - DNA, 20 bp, Artificial
  CRISPR gRNA sequence
ttagagcagttttaggttta

SEQ ID NO: 719060 - DNA, 20 bp, Artificial
  CRISPR gRNA sequence
agagcagttttaggtttaca

SEQ ID NO: 719061 - DNA, 20 bp, Artificial
  CRISPR gRNA sequence
gagcagttttaggtttacag

SEQ ID NO: 719062 - DNA, 20 bp, Artificial
  CRISPR gRNA sequence
taggtttacaggaaaattga

SEQ ID NO: 719063 - DNA, 20 bp, Artificial
  CRISPR gRNA sequence
aggtttacaggaaaattgaa

SEQ ID NO: 719064 - DNA, 20 bp, Artificial
  CRISPR gRNA sequence
ggtttacaggaaaattgaac

SEQ ID NO: 719065 - DNA, 20 bp, Artificial
  CRISPR gRNA sequence
acaggaaaattgaacagaaa

SEQ ID NO: 719066 - DNA, 20 bp, Artificial
  CRISPR gRNA sequence
caggaaaattgaacagaaaa

SEQ ID NO: 719067 - DNA, 20 bp, Artificial
  CRISPR gRNA sequence
aacagaaaatacagagttcc

SEQ ID NO: 719068 - DNA, 20 bp, Artificial
  CRISPR gRNA sequence
ctatataccctcaaccccct

SEQ ID NO: 719069 - DNA, 20 bp, Artificial
  CRISPR gRNA sequence
tataccctcaacccccttcc

SEQ ID NO: 719070 - DNA, 20 bp, Artificial
  CRISPR gRNA sequence
aacccccttcccaatctccc

SEQ ID NO: 719071 - DNA, 20 bp, Artificial
  CRISPR gRNA sequence
cccaatctcccacagtttcc

SEQ ID NO: 719072 - DNA, 20 bp, Artificial
  CRISPR gRNA sequence
ccaatctcccacagtttccc

SEQ ID NO: 719073 - DNA, 20 bp, Artificial
  CRISPR gRNA sequence
ccacagtttcccctattttt

SEQ ID NO: 719074 - DNA, 20 bp, Artificial
  CRISPR gRNA sequence
cccctattttttgtttgaaa

SEQ ID NO: 719075 - DNA, 20 bp, Artificial
  CRISPR gRNA sequence
ccctattttttgtttgaaac

SEQ ID NO: 719076 - DNA, 20 bp, Artificial
  CRISPR gRNA sequence
ttttttgtttgaaacagggt

SEQ ID NO: 719077 - DNA, 20 bp, Artificial
  CRISPR gRNA sequence
tttgtttgaaacagggtatc

SEQ ID NO: 719078 - DNA, 20 bp, Artificial
  CRISPR gRNA sequence
ttgtttgaaacagggtatca

SEQ ID NO: 719079 - DNA, 20 bp, Artificial
  CRISPR gRNA sequence
tgtttgaaacagggtatcac

SEQ ID NO: 719080 - DNA, 20 bp, Artificial
  CRISPR gRNA sequence
gtttgaaacagggtatcact

SEQ ID NO: 719081 - DNA, 20 bp, Artificial
  CRISPR gRNA sequence
tttgaaacagggtatcactc

SEQ ID NO: 719082 - DNA, 20 bp, Artificial
  CRISPR gRNA sequence
gaaacagggtatcactcttt

SEQ ID NO: 719083 - DNA, 20 bp, Artificial
  CRISPR gRNA sequence
aaacagggtatcactctttt

SEQ ID NO: 719084 - DNA, 20 bp, Artificial
  CRISPR gRNA sequence
ttttgcccaggctggagtgc

SEQ ID NO: 719085 - DNA, 20 bp, Artificial
  CRISPR gRNA sequence
ttgcccaggctggagtgcag

SEQ ID NO: 719086 - DNA, 20 bp, Artificial
  CRISPR gRNA sequence
tgcccaggctggagtgcagt

SEQ ID NO: 719087 - DNA, 20 bp, Artificial
  CRISPR gRNA sequence
gcccaggctggagtgcagtg

SEQ ID NO: 719088 - DNA, 20 bp, Artificial
  CRISPR gRNA sequence
cccaggctggagtgcagtgg

SEQ ID NO: 719089 - DNA, 20 bp, Artificial
  CRISPR gRNA sequence
gagtgcagtggtgcaatcac

SEQ ID NO: 719090 - DNA, 20 bp, Artificial
  CRISPR gRNA sequence
actacagcctcaacctcctg

SEQ ID NO: 719091 - DNA, 20 bp, Artificial
  CRISPR gRNA sequence
cagcctcaacctcctgggct

SEQ ID NO: 719092 - DNA, 20 bp, Artificial
  CRISPR gRNA sequence
aacctcctgggctcaagcga

SEQ ID NO: 719093 - DNA, 20 bp, Artificial
  CRISPR gRNA sequence
ctgggctcaagcgatcctcc

SEQ ID NO: 719094 - DNA, 20 bp, Artificial
  CRISPR gRNA sequence
ggctcaagcgatcctcccgc

SEQ ID NO: 719095 - DNA, 20 bp, Artificial
  CRISPR gRNA sequence
aagcgatcctcccgcctcag

SEQ ID NO: 719096 - DNA, 20 bp, Artificial
  CRISPR gRNA sequence
ccgcctcagcctcccaagta

SEQ ID NO: 719097 - DNA, 20 bp, Artificial
  CRISPR gRNA sequence
agcctcccaagtagctggga

SEQ ID NO: 719098 - DNA, 20 bp, Artificial
  CRISPR gRNA sequence
ccaagtagctgggactacag

SEQ ID NO: 719099 - DNA, 20 bp, Artificial
  CRISPR gRNA sequence
ggactacaggcatgtgctac

SEQ ID NO: 719100 - DNA, 20 bp, Artificial
  CRISPR gRNA sequence
caggcatgtgctaccatgcc

SEQ ID NO: 719101 - DNA, 20 bp, Artificial
  CRISPR gRNA sequence
ccatgcctggctaatttttg

SEQ ID NO: 719102 - DNA, 20 bp, Artificial
  CRISPR gRNA sequence
gctaatttttgtattttttt

SEQ ID NO: 719103 - DNA, 20 bp, Artificial
  CRISPR gRNA sequence
atttttgtattttttttttg

SEQ ID NO: 719104 - DNA, 20 bp, Artificial
  CRISPR gRNA sequence
ttgtattttttttttgtaga

SEQ ID NO: 719105 - DNA, 20 bp, Artificial
  CRISPR gRNA sequence
tgtattttttttttgtagag

SEQ ID NO: 719106 - DNA, 20 bp, Artificial
  CRISPR gRNA sequence
gtattttttttttgtagaga

SEQ ID NO: 719107 - DNA, 20 bp, Artificial
  CRISPR gRNA sequence
tattttttttttgtagagac

SEQ ID NO: 719108 - DNA, 20 bp, Artificial
  CRISPR gRNA sequence
tttttttgtagagacgggat

SEQ ID NO: 719109 - DNA, 20 bp, Artificial
  CRISPR gRNA sequence
ttttttgtagagacgggatt

SEQ ID NO: 719110 - DNA, 20 bp, Artificial
  CRISPR gRNA sequence
tttttgtagagacgggattt

SEQ ID NO: 719111 - DNA, 20 bp, Artificial
  CRISPR gRNA sequence
ttttgtagagacgggatttc

SEQ ID NO: 719112 - DNA, 20 bp, Artificial
  CRISPR gRNA sequence
tttgtagagacgggatttca

SEQ ID NO: 719113 - DNA, 20 bp, Artificial
  CRISPR gRNA sequence
ttgtagagacgggatttcac

SEQ ID NO: 719114 - DNA, 20 bp, Artificial
  CRISPR gRNA sequence
tgtagagacgggatttcacc

SEQ ID NO: 719115 - DNA, 20 bp, Artificial
  CRISPR gRNA sequence
gtagagacgggatttcacca

SEQ ID NO: 719116 - DNA, 20 bp, Artificial
  CRISPR gRNA sequence
tagagacgggatttcaccat

SEQ ID NO: 719117 - DNA, 20 bp, Artificial
  CRISPR gRNA sequence
caccatgttgcccatgtttt

SEQ ID NO: 719118 - DNA, 20 bp, Artificial
  CRISPR gRNA sequence
accatgttgcccatgtttta

SEQ ID NO: 719119 - DNA, 20 bp, Artificial
  CRISPR gRNA sequence
cccatgttttatagagatgg

SEQ ID NO: 719120 - DNA, 20 bp, Artificial
  CRISPR gRNA sequence
tatagagatgggatttcact

SEQ ID NO: 719121 - DNA, 20 bp, Artificial
  CRISPR gRNA sequence
atagagatgggatttcacta

SEQ ID NO: 719122 - DNA, 20 bp, Artificial
  CRISPR gRNA sequence
tagagatgggatttcactat

SEQ ID NO: 719123 - DNA, 20 bp, Artificial
  CRISPR gRNA sequence
cactatgtcgccatatgagg

SEQ ID NO: 719124 - DNA, 20 bp, Artificial
  CRISPR gRNA sequence
actatgtcgccatatgaggg

SEQ ID NO: 719125 - DNA, 20 bp, Artificial
  CRISPR gRNA sequence
tgtcgccatatgagggcaaa

SEQ ID NO: 719126 - DNA, 20 bp, Artificial
  CRISPR gRNA sequence
ctgcctcggcctcccaaagt

SEQ ID NO: 719127 - DNA, 20 bp, Artificial
  CRISPR gRNA sequence
cctcggcctcccaaagtgct

SEQ ID NO: 719128 - DNA, 20 bp, Artificial
  CRISPR gRNA sequence
ggcctcccaaagtgctggga

SEQ ID NO: 719129 - DNA, 20 bp, Artificial
  CRISPR gRNA sequence
ccaaagtgctgggattaaag

SEQ ID NO: 719130 - DNA, 20 bp, Artificial
  CRISPR gRNA sequence
ggattaaaggcgtgagccac

SEQ ID NO: 719131 - DNA, 20 bp, Artificial
  CRISPR gRNA sequence
aaggcgtgagccactgcacc

SEQ ID NO: 719132 - DNA, 20 bp, Artificial
  CRISPR gRNA sequence
cacccagcctcccctgtcac

SEQ ID NO: 719133 - DNA, 20 bp, Artificial
  CRISPR gRNA sequence
ccctgtcacgaacaccttgc

SEQ ID NO: 719134 - DNA, 20 bp, Artificial
  CRISPR gRNA sequence
tcacgaacaccttgcattag

SEQ ID NO: 719135 - DNA, 20 bp, Artificial
  CRISPR gRNA sequence
gcattagtgtggcacaattg

SEQ ID NO: 719136 - DNA, 20 bp, Artificial
  CRISPR gRNA sequence
cattagtgtggcacaattgt

SEQ ID NO: 719137 - DNA, 20 bp, Artificial
  CRISPR gRNA sequence
gtgtggcacaattgttagca

SEQ ID NO: 719138 - DNA, 20 bp, Artificial
  CRISPR gRNA sequence
ttagcattgatgacctgata

SEQ ID NO: 719139 - DNA, 20 bp, Artificial
  CRISPR gRNA sequence
gcattgatgacctgataatg

SEQ ID NO: 719140 - DNA, 20 bp, Artificial
  CRISPR gRNA sequence
atgacctgataatgatgcat

SEQ ID NO: 719141 - DNA, 20 bp, Artificial
  CRISPR gRNA sequence
ataatgatgcattattatta

SEQ ID NO: 719142 - DNA, 20 bp, Artificial
  CRISPR gRNA sequence
ttattactaactgaagtcca

SEQ ID NO: 719143 - DNA, 20 bp, Artificial
  CRISPR gRNA sequence
ttactaactgaagtccatag

SEQ ID NO: 719144 - DNA, 20 bp, Artificial
  CRISPR gRNA sequence
ctaactgaagtccatagttt

SEQ ID NO: 719145 - DNA, 20 bp, Artificial
  CRISPR gRNA sequence
actgaagtccatagtttaca

SEQ ID NO: 719146 - DNA, 20 bp, Artificial
  CRISPR gRNA sequence
aagtccatagtttacagcag

SEQ ID NO: 719147 - DNA, 20 bp, Artificial
  CRISPR gRNA sequence
acagcagggttcactctttg

SEQ ID NO: 719148 - DNA, 20 bp, Artificial
  CRISPR gRNA sequence
cagcagggttcactctttgt

SEQ ID NO: 719149 - DNA, 20 bp, Artificial
  CRISPR gRNA sequence
actctttgtgttgcccattc

SEQ ID NO: 719150 - DNA, 20 bp, Artificial
  CRISPR gRNA sequence
tttgtgttgcccattctagg

SEQ ID NO: 719151 - DNA, 20 bp, Artificial
  CRISPR gRNA sequence
tgtgttgcccattctagggc

SEQ ID NO: 719152 - DNA, 20 bp, Artificial
  CRISPR gRNA sequence
gtgttgcccattctagggct

SEQ ID NO: 719153 - DNA, 20 bp, Artificial
  CRISPR gRNA sequence
tgttgcccattctagggctt

SEQ ID NO: 719154 - DNA, 20 bp, Artificial
  CRISPR gRNA sequence
cccattctagggctttagac

SEQ ID NO: 719155 - DNA, 20 bp, Artificial
  CRISPR gRNA sequence
tagggctttagacaaacgga

SEQ ID NO: 719156 - DNA, 20 bp, Artificial
  CRISPR gRNA sequence
gggctttagacaaacggatg

SEQ ID NO: 719157 - DNA, 20 bp, Artificial
  CRISPR gRNA sequence
tagacaaacggatgatgacc

SEQ ID NO: 719158 - DNA, 20 bp, Artificial
  CRISPR gRNA sequence
agacaaacggatgatgacca

SEQ ID NO: 719159 - DNA, 20 bp, Artificial
  CRISPR gRNA sequence
gacaaacggatgatgaccac

SEQ ID NO: 719160 - DNA, 20 bp, Artificial
  CRISPR gRNA sequence
tcactgccctaaatgtgtcc

SEQ ID NO: 719161 - DNA, 20 bp, Artificial
  CRISPR gRNA sequence
cactgccctaaatgtgtcct

SEQ ID NO: 719162 - DNA, 20 bp, Artificial
  CRISPR gRNA sequence
actgccctaaatgtgtcctg

SEQ ID NO: 719163 - DNA, 20 bp, Artificial
  CRISPR gRNA sequence
ccctaaatgtgtcctgagct

SEQ ID NO: 719164 - DNA, 20 bp, Artificial
  CRISPR gRNA sequence
aatgtgtcctgagctcgttg

SEQ ID NO: 719165 - DNA, 20 bp, Artificial
  CRISPR gRNA sequence
agctcgttggttcacctctc

SEQ ID NO: 719166 - DNA, 20 bp, Artificial
  CRISPR gRNA sequence
gttggttcacctctccctcc

SEQ ID NO: 719167 - DNA, 20 bp, Artificial
  CRISPR gRNA sequence
gttcacctctccctccccct

SEQ ID NO: 719168 - DNA, 20 bp, Artificial
  CRISPR gRNA sequence
acctctccctccccctgaac

SEQ ID NO: 719169 - DNA, 20 bp, Artificial
  CRISPR gRNA sequence
tccctccccctgaacctctg

SEQ ID NO: 719170 - DNA, 20 bp, Artificial
  CRISPR gRNA sequence
cctccccctgaacctctggc

SEQ ID NO: 719171 - DNA, 20 bp, Artificial
  CRISPR gRNA sequence
cccctgaacctctggcagct

SEQ ID NO: 719172 - DNA, 20 bp, Artificial
  CRISPR gRNA sequence
aacctctggcagctactgat

SEQ ID NO: 719173 - DNA, 20 bp, Artificial
  CRISPR gRNA sequence
tggcagctactgatcttttt

SEQ ID NO: 719174 - DNA, 20 bp, Artificial
  CRISPR gRNA sequence
gcagctactgatctttttac

SEQ ID NO: 719175 - DNA, 20 bp, Artificial
  CRISPR gRNA sequence
ctgatctttttactgtctcg

SEQ ID NO: 719176 - DNA, 20 bp, Artificial
  CRISPR gRNA sequence
atctttttactgtctcgata

SEQ ID NO: 719177 - DNA, 20 bp, Artificial
  CRISPR gRNA sequence
tttactgtctcgatagtttc

SEQ ID NO: 719178 - DNA, 20 bp, Artificial
  CRISPR gRNA sequence
ttactgtctcgatagtttca

SEQ ID NO: 719179 - DNA, 20 bp, Artificial
  CRISPR gRNA sequence
tactgtctcgatagtttcat

SEQ ID NO: 719180 - DNA, 20 bp, Artificial
  CRISPR gRNA sequence
actgtctcgatagtttcatc

SEQ ID NO: 719181 - DNA, 20 bp, Artificial
  CRISPR gRNA sequence
ctgtctcgatagtttcatct

SEQ ID NO: 719182 - DNA, 20 bp, Artificial
  CRISPR gRNA sequence
tctcgatagtttcatctttt

SEQ ID NO: 719183 - DNA, 20 bp, Artificial
  CRISPR gRNA sequence
gatagtttcatcttttccag

SEQ ID NO: 719184 - DNA, 20 bp, Artificial
  CRISPR gRNA sequence
catcttttccagaaatgtca

SEQ ID NO: 719185 - DNA, 20 bp, Artificial
  CRISPR gRNA sequence
atcttttccagaaatgtcat

SEQ ID NO: 719186 - DNA, 20 bp, Artificial
  CRISPR gRNA sequence
ttccagaaatgtcatgtagt

SEQ ID NO: 719187 - DNA, 20 bp, Artificial
  CRISPR gRNA sequence
tccagaaatgtcatgtagtt

SEQ ID NO: 719188 - DNA, 20 bp, Artificial
  CRISPR gRNA sequence
ccagaaatgtcatgtagttg

SEQ ID NO: 719189 - DNA, 20 bp, Artificial
  CRISPR gRNA sequence
cagaaatgtcatgtagttgg

SEQ ID NO: 719190 - DNA, 20 bp, Artificial
  CRISPR gRNA sequence
gaatgacagtgtgtggcctt

SEQ ID NO: 719191 - DNA, 20 bp, Artificial
  CRISPR gRNA sequence
ttcagactggtgtctttcat

SEQ ID NO: 719192 - DNA, 20 bp, Artificial
  CRISPR gRNA sequence
tcagactggtgtctttcatt

SEQ ID NO: 719193 - DNA, 20 bp, Artificial
  CRISPR gRNA sequence
cagactggtgtctttcattt

SEQ ID NO: 719194 - DNA, 20 bp, Artificial
  CRISPR gRNA sequence
agactggtgtctttcattta

SEQ ID NO: 719195 - DNA, 20 bp, Artificial
  CRISPR gRNA sequence
gtgtctttcatttagcaata

SEQ ID NO: 719196 - DNA, 20 bp, Artificial
  CRISPR gRNA sequence
tcatttagcaatatgtatct

SEQ ID NO: 719197 - DNA, 20 bp, Artificial
  CRISPR gRNA sequence
catttagcaatatgtatcta

SEQ ID NO: 719198 - DNA, 20 bp, Artificial
  CRISPR gRNA sequence
atttagcaatatgtatctaa

SEQ ID NO: 719199 - DNA, 20 bp, Artificial
  CRISPR gRNA sequence
agcaatatgtatctaagttt

SEQ ID NO: 719200 - DNA, 20 bp, Artificial
  CRISPR gRNA sequence
gcaatatgtatctaagtttc

SEQ ID NO: 719201 - DNA, 20 bp, Artificial
  CRISPR gRNA sequence
agtttcctccatgtcttttt

SEQ ID NO: 719202 - DNA, 20 bp, Artificial
  CRISPR gRNA sequence
cctccatgtcttttttttat

SEQ ID NO: 719203 - DNA, 20 bp, Artificial
  CRISPR gRNA sequence
ctccatgtcttttttttatt

SEQ ID NO: 719204 - DNA, 20 bp, Artificial
  CRISPR gRNA sequence
catgtcttttttttattttt

SEQ ID NO: 719205 - DNA, 20 bp, Artificial
  CRISPR gRNA sequence
ttttttatttttttgcattt

SEQ ID NO: 719206 - DNA, 20 bp, Artificial
  CRISPR gRNA sequence
tttttatttttttgcatttt

SEQ ID NO: 719207 - DNA, 20 bp, Artificial
  CRISPR gRNA sequence
ttttatttttttgcatttta

SEQ ID NO: 719208 - DNA, 20 bp, Artificial
  CRISPR gRNA sequence
tttatttttttgcattttaa

SEQ ID NO: 719209 - DNA, 20 bp, Artificial
  CRISPR gRNA sequence
ttatttttttgcattttaaa

SEQ ID NO: 719210 - DNA, 20 bp, Artificial
  CRISPR gRNA sequence
tatttttttgcattttaaaa

SEQ ID NO: 719211 - DNA, 20 bp, Artificial
  CRISPR gRNA sequence
atttttttgcattttaaaaa

SEQ ID NO: 719212 - DNA, 20 bp, Artificial
  CRISPR gRNA sequence
tttttttgcattttaaaaaa

SEQ ID NO: 719213 - DNA, 20 bp, Artificial
  CRISPR gRNA sequence
ttttgcattttaaaaaattg

SEQ ID NO: 719214 - DNA, 20 bp, Artificial
  CRISPR gRNA sequence
tttgcattttaaaaaattgg

SEQ ID NO: 719215 - DNA, 20 bp, Artificial
  CRISPR gRNA sequence
ttgcattttaaaaaattggt

SEQ ID NO: 719216 - DNA, 20 bp, Artificial
  CRISPR gRNA sequence
tgcattttaaaaaattggta

SEQ ID NO: 719217 - DNA, 20 bp, Artificial
  CRISPR gRNA sequence
gcattttaaaaaattggtac

SEQ ID NO: 719218 - DNA, 20 bp, Artificial
  CRISPR gRNA sequence
cattttaaaaaattggtaca

SEQ ID NO: 719219 - DNA, 20 bp, Artificial
  CRISPR gRNA sequence
taaaaaattggtacattaat

SEQ ID NO: 719220 - DNA, 20 bp, Artificial
  CRISPR gRNA sequence
aaaaaattggtacattaatt

SEQ ID NO: 719221 - DNA, 20 bp, Artificial
  CRISPR gRNA sequence
aaaaattggtacattaattt

SEQ ID NO: 719222 - DNA, 20 bp, Artificial
  CRISPR gRNA sequence
gtacattaatttaattttta

SEQ ID NO: 719223 - DNA, 20 bp, Artificial
  CRISPR gRNA sequence
atttaatttttaatccaatt

SEQ ID NO: 719224 - DNA, 20 bp, Artificial
  CRISPR gRNA sequence
aatttttaatccaattttag

SEQ ID NO: 719225 - DNA, 20 bp, Artificial
  CRISPR gRNA sequence
atttttaatccaattttagt

SEQ ID NO: 719226 - DNA, 20 bp, Artificial
  CRISPR gRNA sequence
ttaatccaattttagtggtc

SEQ ID NO: 719227 - DNA, 20 bp, Artificial
  CRISPR gRNA sequence
taatccaattttagtggtca

SEQ ID NO: 719228 - DNA, 20 bp, Artificial
  CRISPR gRNA sequence
aatccaattttagtggtcac

SEQ ID NO: 719229 - DNA, 20 bp, Artificial
  CRISPR gRNA sequence
atccaattttagtggtcacc

SEQ ID NO: 719230 - DNA, 20 bp, Artificial
  CRISPR gRNA sequence
tagtggtcaccagggggttg

SEQ ID NO: 719231 - DNA, 20 bp, Artificial
  CRISPR gRNA sequence
agtggtcaccagggggttga

SEQ ID NO: 719232 - DNA, 20 bp, Artificial
  CRISPR gRNA sequence
gtggtcaccagggggttgag

SEQ ID NO: 719233 - DNA, 20 bp, Artificial
  CRISPR gRNA sequence
agctgggaggcggaggctgc

SEQ ID NO: 719234 - DNA, 20 bp, Artificial
  CRISPR gRNA sequence
ggaggcggaggctgcgttgc

SEQ ID NO: 719235 - DNA, 20 bp, Artificial
  CRISPR gRNA sequence
cgttgcggactgcacctgcc

SEQ ID NO: 719236 - DNA, 20 bp, Artificial
  CRISPR gRNA sequence
cggactgcacctgccctctc

SEQ ID NO: 719237 - DNA, 20 bp, Artificial
  CRISPR gRNA sequence
cacctgccctctccccctca

SEQ ID NO: 719238 - DNA, 20 bp, Artificial
  CRISPR gRNA sequence
ccctctccccctcatctcaa

SEQ ID NO: 719239 - DNA, 20 bp, Artificial
  CRISPR gRNA sequence
tccccctcatctcaagagct

SEQ ID NO: 719240 - DNA, 20 bp, Artificial
  CRISPR gRNA sequence
cccctcatctcaagagctat

SEQ ID NO: 719241 - DNA, 20 bp, Artificial
  CRISPR gRNA sequence
atctcaagagctatctggag

SEQ ID NO: 719242 - DNA, 20 bp, Artificial
  CRISPR gRNA sequence
aagagctatctggagagacg

SEQ ID NO: 719243 - DNA, 20 bp, Artificial
  CRISPR gRNA sequence
tctggagagacgccttcctt

SEQ ID NO: 719244 - DNA, 20 bp, Artificial
  CRISPR gRNA sequence
gagagacgccttccttctgt

SEQ ID NO: 719245 - DNA, 20 bp, Artificial
  CRISPR gRNA sequence
ccttctgttcccctctgtga

SEQ ID NO: 719246 - DNA, 20 bp, Artificial
  CRISPR gRNA sequence
cttctgttcccctctgtgac

SEQ ID NO: 719247 - DNA, 20 bp, Artificial
  CRISPR gRNA sequence
ctgttcccctctgtgacccc

SEQ ID NO: 719248 - DNA, 20 bp, Artificial
  CRISPR gRNA sequence
tgttcccctctgtgacccct

SEQ ID NO: 719249 - DNA, 20 bp, Artificial
  CRISPR gRNA sequence
ttcccctctgtgacccctgt

SEQ ID NO: 719250 - DNA, 20 bp, Artificial
  CRISPR gRNA sequence
ccctctgtgacccctgtctg

SEQ ID NO: 719251 - DNA, 20 bp, Artificial
  CRISPR gRNA sequence
tgtgacccctgtctgtgtcc

SEQ ID NO: 719252 - DNA, 20 bp, Artificial
  CRISPR gRNA sequence
tgacccctgtctgtgtccct

SEQ ID NO: 719253 - DNA, 20 bp, Artificial
  CRISPR gRNA sequence
tctgtgtcccttagacgacc

SEQ ID NO: 719254 - DNA, 20 bp, Artificial
  CRISPR gRNA sequence
tgtcccttagacgacctcgt

SEQ ID NO: 719255 - DNA, 20 bp, Artificial
  CRISPR gRNA sequence
agacgacctcgtggagaaga

SEQ ID NO: 719256 - DNA, 20 bp, Artificial
  CRISPR gRNA sequence
gacgacctcgtggagaagac

SEQ ID NO: 719257 - DNA, 20 bp, Artificial
  CRISPR gRNA sequence
gtggagaagacgccgtgtgc

SEQ ID NO: 719258 - DNA, 20 bp, Artificial
  CRISPR gRNA sequence
ctcccgtgtctgcgaatgtc

SEQ ID NO: 719259 - DNA, 20 bp, Artificial
  CRISPR gRNA sequence
ccgtgtctgcgaatgtcgac

SEQ ID NO: 719260 - DNA, 20 bp, Artificial
  CRISPR gRNA sequence
cgaatgtcgacccggcatgt

SEQ ID NO: 719261 - DNA, 20 bp, Artificial
  CRISPR gRNA sequence
tgttccacgtctgccgtcaa

SEQ ID NO: 719262 - DNA, 20 bp, Artificial
  CRISPR gRNA sequence
ttccacgtctgccgtcaact

SEQ ID NO: 719263 - DNA, 20 bp, Artificial
  CRISPR gRNA sequence
cacgtctgccgtcaactcct

SEQ ID NO: 719264 - DNA, 20 bp, Artificial
  CRISPR gRNA sequence
ccgtcaactcctgtgcccgc

SEQ ID NO: 719265 - DNA, 20 bp, Artificial
  CRISPR gRNA sequence
ctgtgcccgctgcttcttcc

SEQ ID NO: 719266 - DNA, 20 bp, Artificial
  CRISPR gRNA sequence
tgcccgctgcttcttccatt

SEQ ID NO: 719267 - DNA, 20 bp, Artificial
  CRISPR gRNA sequence
cttcttccattctgtctgtc

SEQ ID NO: 719268 - DNA, 20 bp, Artificial
  CRISPR gRNA sequence
cttccattctgtctgtccgg

SEQ ID NO: 719269 - DNA, 20 bp, Artificial
  CRISPR gRNA sequence
ttccattctgtctgtccggc

SEQ ID NO: 719270 - DNA, 20 bp, Artificial
  CRISPR gRNA sequence
ccattctgtctgtccggcag

SEQ ID NO: 719271 - DNA, 20 bp, Artificial
  CRISPR gRNA sequence
cattctgtctgtccggcagg

SEQ ID NO: 719272 - DNA, 20 bp, Artificial
  CRISPR gRNA sequence
tgtctgtccggcagggatga

SEQ ID NO: 719273 - DNA, 20 bp, Artificial
  CRISPR gRNA sequence
tctgtccggcagggatgatt

SEQ ID NO: 719274 - DNA, 20 bp, Artificial
  CRISPR gRNA sequence
tccggcagggatgattgtca

SEQ ID NO: 719275 - DNA, 20 bp, Artificial
  CRISPR gRNA sequence
tcaagttcccaggtcagtgt

SEQ ID NO: 719276 - DNA, 20 bp, Artificial
  CRISPR gRNA sequence
ccaggtcagtgtccccaccc

SEQ ID NO: 719277 - DNA, 20 bp, Artificial
  CRISPR gRNA sequence
aactcaggacagagatctat

SEQ ID NO: 719278 - DNA, 20 bp, Artificial
  CRISPR gRNA sequence
actcaggacagagatctatg

SEQ ID NO: 719279 - DNA, 20 bp, Artificial
  CRISPR gRNA sequence
aggacagagatctatgctgt

SEQ ID NO: 719280 - DNA, 20 bp, Artificial
  CRISPR gRNA sequence
tgctgttgctgctgcacctt

SEQ ID NO: 719281 - DNA, 20 bp, Artificial
  CRISPR gRNA sequence
ttgctgctgcaccttccgcc

SEQ ID NO: 719282 - DNA, 20 bp, Artificial
  CRISPR gRNA sequence
ctgctgcaccttccgcccac

SEQ ID NO: 719283 - DNA, 20 bp, Artificial
  CRISPR gRNA sequence
ctgcaccttccgcccacccc

SEQ ID NO: 719284 - DNA, 20 bp, Artificial
  CRISPR gRNA sequence
caccttccgcccaccccagt

SEQ ID NO: 719285 - DNA, 20 bp, Artificial
  CRISPR gRNA sequence
ccgcccaccccagtgcactg

SEQ ID NO: 719286 - DNA, 20 bp, Artificial
  CRISPR gRNA sequence
cgcccaccccagtgcactgt

SEQ ID NO: 719287 - DNA, 20 bp, Artificial
  CRISPR gRNA sequence
ttgacttccgacctcccgct

SEQ ID NO: 719288 - DNA, 20 bp, Artificial
  CRISPR gRNA sequence
acttccgacctcccgcttcc

SEQ ID NO: 719289 - DNA, 20 bp, Artificial
  CRISPR gRNA sequence
ccgacctcccgcttcccgga

SEQ ID NO: 719290 - DNA, 20 bp, Artificial
  CRISPR gRNA sequence
cgacctcccgcttcccggag

SEQ ID NO: 719291 - DNA, 20 bp, Artificial
  CRISPR gRNA sequence
ccgcttcccggagactgttg

SEQ ID NO: 719292 - DNA, 20 bp, Artificial
  CRISPR gRNA sequence
cccggagactgttggacaga

SEQ ID NO: 719293 - DNA, 20 bp, Artificial
  CRISPR gRNA sequence
ccggagactgttggacagat

SEQ ID NO: 719294 - DNA, 20 bp, Artificial
  CRISPR gRNA sequence
ttggacagatcatgtctcct

SEQ ID NO: 719295 - DNA, 20 bp, Artificial
  CRISPR gRNA sequence
gacagatcatgtctcctttg

SEQ ID NO: 719296 - DNA, 20 bp, Artificial
  CRISPR gRNA sequence
ctttggcgatgggccaggga

SEQ ID NO: 719297 - DNA, 20 bp, Artificial
  CRISPR gRNA sequence
tggcgatgggccagggatgt

SEQ ID NO: 719298 - DNA, 20 bp, Artificial
  CRISPR gRNA sequence
ggcgatgggccagggatgta

SEQ ID NO: 719299 - DNA, 20 bp, Artificial
  CRISPR gRNA sequence
gcgatgggccagggatgtac

SEQ ID NO: 719300 - DNA, 20 bp, Artificial
  CRISPR gRNA sequence
ctgctgccctcccccacctt

SEQ ID NO: 719301 - DNA, 20 bp, Artificial
  CRISPR gRNA sequence
tgctgccctcccccaccttg

SEQ ID NO: 719302 - DNA, 20 bp, Artificial
  CRISPR gRNA sequence
ctgccctcccccaccttgtg

SEQ ID NO: 719303 - DNA, 20 bp, Artificial
  CRISPR gRNA sequence
ccctcccccaccttgtgttc

SEQ ID NO: 719304 - DNA, 20 bp, Artificial
  CRISPR gRNA sequence
ccccaccttgtgttccaggt

SEQ ID NO: 719305 - DNA, 20 bp, Artificial
  CRISPR gRNA sequence
gtgttccaggtgcagagaga

SEQ ID NO: 719306 - DNA, 20 bp, Artificial
  CRISPR gRNA sequence
tgttccaggtgcagagagac

SEQ ID NO: 719307 - DNA, 20 bp, Artificial
  CRISPR gRNA sequence
caggtgcagagagaccctgc

SEQ ID NO: 719308 - DNA, 20 bp, Artificial
  CRISPR gRNA sequence
ctgtcccctggcatagacct

SEQ ID NO: 719309 - DNA, 20 bp, Artificial
  CRISPR gRNA sequence
tcccctggcatagacctggc

SEQ ID NO: 719310 - DNA, 20 bp, Artificial
  CRISPR gRNA sequence
gcatagacctggctggagga

SEQ ID NO: 719311 - DNA, 20 bp, Artificial
  CRISPR gRNA sequence
gctggaggaggtcttgcttt

SEQ ID NO: 719312 - DNA, 20 bp, Artificial
  CRISPR gRNA sequence
gaggaggtcttgctttggtt

SEQ ID NO: 719313 - DNA, 20 bp, Artificial
  CRISPR gRNA sequence
gctttggtttgaggctcaag

SEQ ID NO: 719314 - DNA, 20 bp, Artificial
  CRISPR gRNA sequence
ctttggtttgaggctcaagg

SEQ ID NO: 719315 - DNA, 20 bp, Artificial
  CRISPR gRNA sequence
tggtttgaggctcaaggcag

SEQ ID NO: 719316 - DNA, 20 bp, Artificial
  CRISPR gRNA sequence
ggtttgaggctcaaggcaga

SEQ ID NO: 719317 - DNA, 20 bp, Artificial
  CRISPR gRNA sequence
gtttgaggctcaaggcagaa

SEQ ID NO: 719318 - DNA, 20 bp, Artificial
  CRISPR gRNA sequence
gaggctcaaggcagaagtta

SEQ ID NO: 719319 - DNA, 20 bp, Artificial
  CRISPR gRNA sequence
aggctcaaggcagaagttat

SEQ ID NO: 719320 - DNA, 20 bp, Artificial
  CRISPR gRNA sequence
aaggcagaagttatctgatg

SEQ ID NO: 719321 - DNA, 20 bp, Artificial
  CRISPR gRNA sequence
tctgatgccccataaacaag

SEQ ID NO: 719322 - DNA, 20 bp, Artificial
  CRISPR gRNA sequence
atgccccataaacaagaagg

SEQ ID NO: 719323 - DNA, 20 bp, Artificial
  CRISPR gRNA sequence
aagtctctgtcctgggagtt

SEQ ID NO: 719324 - DNA, 20 bp, Artificial
  CRISPR gRNA sequence
tgtcctgggagtttcctaga

SEQ ID NO: 719325 - DNA, 20 bp, Artificial
  CRISPR gRNA sequence
tcctgggagtttcctagaag

SEQ ID NO: 719326 - DNA, 20 bp, Artificial
  CRISPR gRNA sequence
ggagtttcctagaagattgg

SEQ ID NO: 719327 - DNA, 20 bp, Artificial
  CRISPR gRNA sequence
cctagaagattggggttggc

SEQ ID NO: 719328 - DNA, 20 bp, Artificial
  CRISPR gRNA sequence
ctagaagattggggttggct

SEQ ID NO: 719329 - DNA, 20 bp, Artificial
  CRISPR gRNA sequence
gaagattggggttggcttcc

SEQ ID NO: 719330 - DNA, 20 bp, Artificial
  CRISPR gRNA sequence
gggttggcttccccctttca

SEQ ID NO: 719331 - DNA, 20 bp, Artificial
  CRISPR gRNA sequence
gcttccccctttcaggttca

SEQ ID NO: 719332 - DNA, 20 bp, Artificial
  CRISPR gRNA sequence
ccccctttcaggttcagggc

SEQ ID NO: 719333 - DNA, 20 bp, Artificial
  CRISPR gRNA sequence
cccctttcaggttcagggca

SEQ ID NO: 719334 - DNA, 20 bp, Artificial
  CRISPR gRNA sequence
tcaggttcagggcattggga

SEQ ID NO: 719335 - DNA, 20 bp, Artificial
  CRISPR gRNA sequence
caggttcagggcattgggag

SEQ ID NO: 719336 - DNA, 20 bp, Artificial
  CRISPR gRNA sequence
aggttcagggcattgggagt

SEQ ID NO: 719337 - DNA, 20 bp, Artificial
  CRISPR gRNA sequence
agggcattgggagttagagg

SEQ ID NO: 719338 - DNA, 20 bp, Artificial
  CRISPR gRNA sequence
ggagttagaggtgctgagag

SEQ ID NO: 719339 - DNA, 20 bp, Artificial
  CRISPR gRNA sequence
gaggtgctgagagatctggc

SEQ ID NO: 719340 - DNA, 20 bp, Artificial
  CRISPR gRNA sequence
agagatctggccccaggctc

SEQ ID NO: 719341 - DNA, 20 bp, Artificial
  CRISPR gRNA sequence
gccccaggctcaagacttga

SEQ ID NO: 719342 - DNA, 20 bp, Artificial
  CRISPR gRNA sequence
aagacttgagaaacttgggt

SEQ ID NO: 719343 - DNA, 20 bp, Artificial
  CRISPR gRNA sequence
gagaaacttgggtttctttt

SEQ ID NO: 719344 - DNA, 20 bp, Artificial
  CRISPR gRNA sequence
agaaacttgggtttcttttc

SEQ ID NO: 719345 - DNA, 20 bp, Artificial
  CRISPR gRNA sequence
gggtttcttttccaacttat

SEQ ID NO: 719346 - DNA, 20 bp, Artificial
  CRISPR gRNA sequence
ggtttcttttccaacttatc

SEQ ID NO: 719347 - DNA, 20 bp, Artificial
  CRISPR gRNA sequence
cttttccaacttatcgtgtg

SEQ ID NO: 719348 - DNA, 20 bp, Artificial
  CRISPR gRNA sequence
ttttccaacttatcgtgtga

SEQ ID NO: 719349 - DNA, 20 bp, Artificial
  CRISPR gRNA sequence
ttccaacttatcgtgtgacc

SEQ ID NO: 719350 - DNA, 20 bp, Artificial
  CRISPR gRNA sequence
tccaacttatcgtgtgacct

SEQ ID NO: 719351 - DNA, 20 bp, Artificial
  CRISPR gRNA sequence
ccaacttatcgtgtgacctc

SEQ ID NO: 719352 - DNA, 20 bp, Artificial
  CRISPR gRNA sequence
caacttatcgtgtgacctca

SEQ ID NO: 719353 - DNA, 20 bp, Artificial
  CRISPR gRNA sequence
atcgtgtgacctcagacaag

SEQ ID NO: 719354 - DNA, 20 bp, Artificial
  CRISPR gRNA sequence
tcgtgtgacctcagacaagt

SEQ ID NO: 719355 - DNA, 20 bp, Artificial
  CRISPR gRNA sequence
agacaagtttcttacctctc

SEQ ID NO: 719356 - DNA, 20 bp, Artificial
  CRISPR gRNA sequence
cttacctctctgacttctac

SEQ ID NO: 719357 - DNA, 20 bp, Artificial
  CRISPR gRNA sequence
ttacctctctgacttctact

SEQ ID NO: 719358 - DNA, 20 bp, Artificial
  CRISPR gRNA sequence
acctctctgacttctacttc

SEQ ID NO: 719359 - DNA, 20 bp, Artificial
  CRISPR gRNA sequence
cctctctgacttctacttct

SEQ ID NO: 719360 - DNA, 20 bp, Artificial
  CRISPR gRNA sequence
tctgacttctacttctctga

SEQ ID NO: 719361 - DNA, 20 bp, Artificial
  CRISPR gRNA sequence
tgacttctacttctctgata

SEQ ID NO: 719362 - DNA, 20 bp, Artificial
  CRISPR gRNA sequence
acttctacttctctgatagt

SEQ ID NO: 719363 - DNA, 20 bp, Artificial
  CRISPR gRNA sequence
ctacttctctgatagtacaa

SEQ ID NO: 719364 - DNA, 20 bp, Artificial
  CRISPR gRNA sequence
tacttctctgatagtacaag

SEQ ID NO: 719365 - DNA, 20 bp, Artificial
  CRISPR gRNA sequence
cttctctgatagtacaaggt

SEQ ID NO: 719366 - DNA, 20 bp, Artificial
  CRISPR gRNA sequence
ctctgatagtacaaggtgtc

SEQ ID NO: 719367 - DNA, 20 bp, Artificial
  CRISPR gRNA sequence
tctgatagtacaaggtgtca

SEQ ID NO: 719368 - DNA, 20 bp, Artificial
  CRISPR gRNA sequence
tgatagtacaaggtgtcagg

SEQ ID NO: 719369 - DNA, 20 bp, Artificial
  CRISPR gRNA sequence
atagtacaaggtgtcagggc

SEQ ID NO: 719370 - DNA, 20 bp, Artificial
  CRISPR gRNA sequence
cttttaaccagagaaggggt

SEQ ID NO: 719371 - DNA, 20 bp, Artificial
  CRISPR gRNA sequence
ttaaccagagaaggggtatg

SEQ ID NO: 719372 - DNA, 20 bp, Artificial
  CRISPR gRNA sequence
taaccagagaaggggtatgg

SEQ ID NO: 719373 - DNA, 20 bp, Artificial
  CRISPR gRNA sequence
aaccagagaaggggtatggg

SEQ ID NO: 719374 - DNA, 20 bp, Artificial
  CRISPR gRNA sequence
accagagaaggggtatgggc

SEQ ID NO: 719375 - DNA, 20 bp, Artificial
  CRISPR gRNA sequence
tctgggtggagttgggacca

SEQ ID NO: 719376 - DNA, 20 bp, Artificial
  CRISPR gRNA sequence
ggtggagttgggaccatctt

SEQ ID NO: 719377 - DNA, 20 bp, Artificial
  CRISPR gRNA sequence
ggaccatcttccagaaggga

SEQ ID NO: 719378 - DNA, 20 bp, Artificial
  CRISPR gRNA sequence
ccagaagggaggcatgagga

SEQ ID NO: 719379 - DNA, 20 bp, Artificial
  CRISPR gRNA sequence
cagaagggaggcatgaggag

SEQ ID NO: 719380 - DNA, 20 bp, Artificial
  CRISPR gRNA sequence
tggagcacagcacagagtgg

SEQ ID NO: 719381 - DNA, 20 bp, Artificial
  CRISPR gRNA sequence
ggagcacagcacagagtggc

SEQ ID NO: 719382 - DNA, 20 bp, Artificial
  CRISPR gRNA sequence
gagcacagcacagagtggct

SEQ ID NO: 719383 - DNA, 20 bp, Artificial
  CRISPR gRNA sequence
ccgcagttgcagactgtatg

SEQ ID NO: 719384 - DNA, 20 bp, Artificial
  CRISPR gRNA sequence
cagactgtatggagccgggg

SEQ ID NO: 719385 - DNA, 20 bp, Artificial
  CRISPR gRNA sequence
tatggagccggggagatggg

SEQ ID NO: 719386 - DNA, 20 bp, Artificial
  CRISPR gRNA sequence
agaggcagccctgtgtccac

SEQ ID NO: 719387 - DNA, 20 bp, Artificial
  CRISPR gRNA sequence
tgtccactgtccactgagga

SEQ ID NO: 719388 - DNA, 20 bp, Artificial
  CRISPR gRNA sequence
tccactgaggagaaaagtgc

SEQ ID NO: 719389 - DNA, 20 bp, Artificial
  CRISPR gRNA sequence
aggagaaaagtgccacaaag

SEQ ID NO: 719390 - DNA, 20 bp, Artificial
  CRISPR gRNA sequence
tggtccctcccccaaccagg

SEQ ID NO: 719391 - DNA, 20 bp, Artificial
  CRISPR gRNA sequence
ccccaaccaggtccttctct

SEQ ID NO: 719392 - DNA, 20 bp, Artificial
  CRISPR gRNA sequence
ctctggagtcccatgccctg

SEQ ID NO: 719393 - DNA, 20 bp, Artificial
  CRISPR gRNA sequence
tctggagtcccatgccctgt

SEQ ID NO: 719394 - DNA, 20 bp, Artificial
  CRISPR gRNA sequence
tggagtcccatgccctgttg

SEQ ID NO: 719395 - DNA, 20 bp, Artificial
  CRISPR gRNA sequence
gagtcccatgccctgttgtg

SEQ ID NO: 719396 - DNA, 20 bp, Artificial
  CRISPR gRNA sequence
ttgtgcaaacctggggattg

SEQ ID NO: 719397 - DNA, 20 bp, Artificial
  CRISPR gRNA sequence
tgcaaacctggggattggca

SEQ ID NO: 719398 - DNA, 20 bp, Artificial
  CRISPR gRNA sequence
gggattggcagtcaccccca

SEQ ID NO: 719399 - DNA, 20 bp, Artificial
  CRISPR gRNA sequence
gcagtcacccccatcgctac

SEQ ID NO: 719400 - DNA, 20 bp, Artificial
  CRISPR gRNA sequence
ccactgcctgccccttttat

SEQ ID NO: 719401 - DNA, 20 bp, Artificial
  CRISPR gRNA sequence
cctgccccttttatccttcc

SEQ ID NO: 719402 - DNA, 20 bp, Artificial
  CRISPR gRNA sequence
ccccttttatccttccctcg

SEQ ID NO: 719403 - DNA, 20 bp, Artificial
  CRISPR gRNA sequence
ttatccttccctcgttccct

SEQ ID NO: 719404 - DNA, 20 bp, Artificial
  CRISPR gRNA sequence
tatccttccctcgttccctc

SEQ ID NO: 719405 - DNA, 20 bp, Artificial
  CRISPR gRNA sequence
atccttccctcgttccctca

SEQ ID NO: 719406 - DNA, 20 bp, Artificial
  CRISPR gRNA sequence
tccttccctcgttccctcat

SEQ ID NO: 719407 - DNA, 20 bp, Artificial
  CRISPR gRNA sequence
ccctcgttccctcatccttc

SEQ ID NO: 719408 - DNA, 20 bp, Artificial
  CRISPR gRNA sequence
cctcgttccctcatccttca

SEQ ID NO: 719409 - DNA, 20 bp, Artificial
  CRISPR gRNA sequence
gttccctcatccttcacagc

SEQ ID NO: 719410 - DNA, 20 bp, Artificial
  CRISPR gRNA sequence
cctcatccttcacagccagc

SEQ ID NO: 719411 - DNA, 20 bp, Artificial
  CRISPR gRNA sequence
atccttcacagccagcccat

SEQ ID NO: 719412 - DNA, 20 bp, Artificial
  CRISPR gRNA sequence
cacagccagcccatcctcga

SEQ ID NO: 719413 - DNA, 20 bp, Artificial
  CRISPR gRNA sequence
acagccagcccatcctcgag

SEQ ID NO: 719414 - DNA, 20 bp, Artificial
  CRISPR gRNA sequence
gagtcctgtagatttggcct

SEQ ID NO: 719415 - DNA, 20 bp, Artificial
  CRISPR gRNA sequence
tagatttggcctccaattat

SEQ ID NO: 719416 - DNA, 20 bp, Artificial
  CRISPR gRNA sequence
ggcctccaattatcttcccc

SEQ ID NO: 719417 - DNA, 20 bp, Artificial
  CRISPR gRNA sequence
gcctccaattatcttcccca

SEQ ID NO: 719418 - DNA, 20 bp, Artificial
  CRISPR gRNA sequence
caattatcttccccaccttc

SEQ ID NO: 719419 - DNA, 20 bp, Artificial
  CRISPR gRNA sequence
tcttccccaccttctcaccc

SEQ ID NO: 719420 - DNA, 20 bp, Artificial
  CRISPR gRNA sequence
ccccaccttctcaccccgaa

SEQ ID NO: 719421 - DNA, 20 bp, Artificial
  CRISPR gRNA sequence
cccaccttctcaccccgaat

SEQ ID NO: 719422 - DNA, 20 bp, Artificial
  CRISPR gRNA sequence
ctcaccccgaataccttctc

SEQ ID NO: 719423 - DNA, 20 bp, Artificial
  CRISPR gRNA sequence
tcaccccgaataccttctct

SEQ ID NO: 719424 - DNA, 20 bp, Artificial
  CRISPR gRNA sequence
accccgaataccttctctta

SEQ ID NO: 719425 - DNA, 20 bp, Artificial
  CRISPR gRNA sequence
ctcttatacagcccccatgg

SEQ ID NO: 719426 - DNA, 20 bp, Artificial
  CRISPR gRNA sequence
tcttatacagcccccatggc

SEQ ID NO: 719427 - DNA, 20 bp, Artificial
  CRISPR gRNA sequence
ttatacagcccccatggcag

SEQ ID NO: 719428 - DNA, 20 bp, Artificial
  CRISPR gRNA sequence
atacagcccccatggcagac

SEQ ID NO: 719429 - DNA, 20 bp, Artificial
  CRISPR gRNA sequence
tacagcccccatggcagaca

SEQ ID NO: 719430 - DNA, 20 bp, Artificial
  CRISPR gRNA sequence
gcaagaccaaatctgaatct

SEQ ID NO: 719431 - DNA, 20 bp, Artificial
  CRISPR gRNA sequence
caagaccaaatctgaatctg

SEQ ID NO: 719432 - DNA, 20 bp, Artificial
  CRISPR gRNA sequence
aatctgatcctctctctctc

SEQ ID NO: 719433 - DNA, 20 bp, Artificial
  CRISPR gRNA sequence
atcctctctctctctctctc

SEQ ID NO: 719434 - DNA, 20 bp, Artificial
  CRISPR gRNA sequence
tctctctctctctctctctc

SEQ ID NO: 719435 - DNA, 20 bp, Artificial
  CRISPR gRNA sequence
tctctctctctctctctcac

SEQ ID NO: 719436 - DNA, 20 bp, Artificial
  CRISPR gRNA sequence
tctctctctctctctcactc

SEQ ID NO: 719437 - DNA, 20 bp, Artificial
  CRISPR gRNA sequence
tctctctctctctcactcac

SEQ ID NO: 719438 - DNA, 20 bp, Artificial
  CRISPR gRNA sequence
tctctctctctcactcactc

SEQ ID NO: 719439 - DNA, 20 bp, Artificial
  CRISPR gRNA sequence
tctctctctcactcactcac

SEQ ID NO: 719440 - DNA, 20 bp, Artificial
  CRISPR gRNA sequence
tctctctcactcactcactc

SEQ ID NO: 719441 - DNA, 20 bp, Artificial
  CRISPR gRNA sequence
tctctcactcactcactctc

SEQ ID NO: 719442 - DNA, 20 bp, Artificial
  CRISPR gRNA sequence
tctcactcactcactctctc

SEQ ID NO: 719443 - DNA, 20 bp, Artificial
  CRISPR gRNA sequence
tcactcactcactctctctc

SEQ ID NO: 719444 - DNA, 20 bp, Artificial
  CRISPR gRNA sequence
actcactcactctctctctg

SEQ ID NO: 719445 - DNA, 20 bp, Artificial
  CRISPR gRNA sequence
actcactctctctctgtctc

SEQ ID NO: 719446 - DNA, 20 bp, Artificial
  CRISPR gRNA sequence
actctctctctgtctcacac

SEQ ID NO: 719447 - DNA, 20 bp, Artificial
  CRISPR gRNA sequence
tctctctgtctcacacacac

SEQ ID NO: 719448 - DNA, 20 bp, Artificial
  CRISPR gRNA sequence
tctctgtctcacacacacac

SEQ ID NO: 719449 - DNA, 20 bp, Artificial
  CRISPR gRNA sequence
tctgtctcacacacacacac

SEQ ID NO: 719450 - DNA, 20 bp, Artificial
  CRISPR gRNA sequence
tgtctcacacacacacacac

SEQ ID NO: 719451 - DNA, 20 bp, Artificial
  CRISPR gRNA sequence
tctcacacacacacacacac

SEQ ID NO: 719452 - DNA, 20 bp, Artificial
  CRISPR gRNA sequence
acacacacacacacacacac

SEQ ID NO: 719453 - DNA, 20 bp, Artificial
  CRISPR gRNA sequence
aaatgcttcagtatcttcct

SEQ ID NO: 719454 - DNA, 20 bp, Artificial
  CRISPR gRNA sequence
cagtatcttcctgttactct

SEQ ID NO: 719455 - DNA, 20 bp, Artificial
  CRISPR gRNA sequence
agtatcttcctgttactcta

SEQ ID NO: 719456 - DNA, 20 bp, Artificial
  CRISPR gRNA sequence
cctgttactctaaagataag

SEQ ID NO: 719457 - DNA, 20 bp, Artificial
  CRISPR gRNA sequence
ctgttactctaaagataagg

SEQ ID NO: 719458 - DNA, 20 bp, Artificial
  CRISPR gRNA sequence
ttactctaaagataaggaca

SEQ ID NO: 719459 - DNA, 20 bp, Artificial
  CRISPR gRNA sequence
ctctaaagataaggacacaa

SEQ ID NO: 719460 - DNA, 20 bp, Artificial
  CRISPR gRNA sequence
taaagataaggacacaaggc

SEQ ID NO: 719461 - DNA, 20 bp, Artificial
  CRISPR gRNA sequence
aagataaggacacaaggcca

SEQ ID NO: 719462 - DNA, 20 bp, Artificial
  CRISPR gRNA sequence
acgcctgtaatcccagcact

SEQ ID NO: 719463 - DNA, 20 bp, Artificial
  CRISPR gRNA sequence
cgcctgtaatcccagcactt

SEQ ID NO: 719464 - DNA, 20 bp, Artificial
  CRISPR gRNA sequence
taatcccagcactttgggag

SEQ ID NO: 719465 - DNA, 20 bp, Artificial
  CRISPR gRNA sequence
tgggaggccaaggcaggcag

SEQ ID NO: 719466 - DNA, 20 bp, Artificial
  CRISPR gRNA sequence
gggaggccaaggcaggcaga

SEQ ID NO: 719467 - DNA, 20 bp, Artificial
  CRISPR gRNA sequence
ggaggccaaggcaggcagat

SEQ ID NO: 719468 - DNA, 20 bp, Artificial
  CRISPR gRNA sequence
gaggtcaggagttcaagacc

SEQ ID NO: 719469 - DNA, 20 bp, Artificial
  CRISPR gRNA sequence
aggtcaggagttcaagacca

SEQ ID NO: 719470 - DNA, 20 bp, Artificial
  CRISPR gRNA sequence
aagaccagcctggccaacat

SEQ ID NO: 719471 - DNA, 20 bp, Artificial
  CRISPR gRNA sequence
gccaacatggtgaaacctca

SEQ ID NO: 719472 - DNA, 20 bp, Artificial
  CRISPR gRNA sequence
atctctactaaaaatacaaa

SEQ ID NO: 719473 - DNA, 20 bp, Artificial
  CRISPR gRNA sequence
tactaaaaatacaaaaatta

SEQ ID NO: 719474 - DNA, 20 bp, Artificial
  CRISPR gRNA sequence
ctaaaaatacaaaaattagc

SEQ ID NO: 719475 - DNA, 20 bp, Artificial
  CRISPR gRNA sequence
aaaatacaaaaattagccag

SEQ ID NO: 719476 - DNA, 20 bp, Artificial
  CRISPR gRNA sequence
gccagccctggcagcaggtg

SEQ ID NO: 719477 - DNA, 20 bp, Artificial
  CRISPR gRNA sequence
gcagcaggtgccctgtaatt

SEQ ID NO: 719478 - DNA, 20 bp, Artificial
  CRISPR gRNA sequence
taattccatttactcaggag

SEQ ID NO: 719479 - DNA, 20 bp, Artificial
  CRISPR gRNA sequence
catttactcaggaggctgag

SEQ ID NO: 719480 - DNA, 20 bp, Artificial
  CRISPR gRNA sequence
actcaggaggctgaggcagg

SEQ ID NO: 719481 - DNA, 20 bp, Artificial
  CRISPR gRNA sequence
ctcaggaggctgaggcagga

SEQ ID NO: 719482 - DNA, 20 bp, Artificial
  CRISPR gRNA sequence
aggaggctgaggcaggagaa

SEQ ID NO: 719483 - DNA, 20 bp, Artificial
  CRISPR gRNA sequence
aggcaggagaaccacttgaa

SEQ ID NO: 719484 - DNA, 20 bp, Artificial
  CRISPR gRNA sequence
gaacctgggaggcggtggtt

SEQ ID NO: 719485 - DNA, 20 bp, Artificial
  CRISPR gRNA sequence
aacctgggaggcggtggttg

SEQ ID NO: 719486 - DNA, 20 bp, Artificial
  CRISPR gRNA sequence
ggaggcggtggttgcagtga

SEQ ID NO: 719487 - DNA, 20 bp, Artificial
  CRISPR gRNA sequence
cagtgagctgagattgagcc

SEQ ID NO: 719488 - DNA, 20 bp, Artificial
  CRISPR gRNA sequence
agattgagccattgcactcc

SEQ ID NO: 719489 - DNA, 20 bp, Artificial
  CRISPR gRNA sequence
agccattgcactccagcctg

SEQ ID NO: 719490 - DNA, 20 bp, Artificial
  CRISPR gRNA sequence
cactccagcctgggtgacaa

SEQ ID NO: 719491 - DNA, 20 bp, Artificial
  CRISPR gRNA sequence
cagcctgggtgacaagagca

SEQ ID NO: 719492 - DNA, 20 bp, Artificial
  CRISPR gRNA sequence
ggtgacaagagcaagactcc

SEQ ID NO: 719493 - DNA, 20 bp, Artificial
  CRISPR gRNA sequence
cgtctcaaaaaaaaaaaaaa

SEQ ID NO: 719494 - DNA, 20 bp, Artificial
  CRISPR gRNA sequence
aaaaaaaaaaaaaaaaaaag

SEQ ID NO: 719495 - DNA, 20 bp, Artificial
  CRISPR gRNA sequence
cagggactcaccacggtgtc

SEQ ID NO: 719496 - DNA, 20 bp, Artificial
  CRISPR gRNA sequence
accacggtgtccttcaggtc

SEQ ID NO: 719497 - DNA, 20 bp, Artificial
  CRISPR gRNA sequence
caggtcccaaggcccccagt

SEQ ID NO: 719498 - DNA, 20 bp, Artificial
  CRISPR gRNA sequence
aggtcccaaggcccccagtt

SEQ ID NO: 719499 - DNA, 20 bp, Artificial
  CRISPR gRNA sequence
acctgccttcttctcttcat

SEQ ID NO: 719500 - DNA, 20 bp, Artificial
  CRISPR gRNA sequence
ccttcttctcttcatgtttc

SEQ ID NO: 719501 - DNA, 20 bp, Artificial
  CRISPR gRNA sequence
cttctcttcatgtttcagag

SEQ ID NO: 719502 - DNA, 20 bp, Artificial
  CRISPR gRNA sequence
ttctcttcatgtttcagagc

SEQ ID NO: 719503 - DNA, 20 bp, Artificial
  CRISPR gRNA sequence
ctcttcatgtttcagagcct

SEQ ID NO: 719504 - DNA, 20 bp, Artificial
  CRISPR gRNA sequence
tcttcatgtttcagagcctt

SEQ ID NO: 719505 - DNA, 20 bp, Artificial
  CRISPR gRNA sequence
ttcatgtttcagagccttct

SEQ ID NO: 719506 - DNA, 20 bp, Artificial
  CRISPR gRNA sequence
catgtttcagagccttctta

SEQ ID NO: 719507 - DNA, 20 bp, Artificial
  CRISPR gRNA sequence
atgtttcagagccttcttac

SEQ ID NO: 719508 - DNA, 20 bp, Artificial
  CRISPR gRNA sequence
cagagccttcttacatttat

SEQ ID NO: 719509 - DNA, 20 bp, Artificial
  CRISPR gRNA sequence
agagccttcttacatttatt

SEQ ID NO: 719510 - DNA, 20 bp, Artificial
  CRISPR gRNA sequence
cttacatttattttgtacat

SEQ ID NO: 719511 - DNA, 20 bp, Artificial
  CRISPR gRNA sequence
ttacatttattttgtacata

SEQ ID NO: 719512 - DNA, 20 bp, Artificial
  CRISPR gRNA sequence
acatttattttgtacataat

SEQ ID NO: 719513 - DNA, 20 bp, Artificial
  CRISPR gRNA sequence
catttattttgtacataatg

SEQ ID NO: 719514 - DNA, 20 bp, Artificial
  CRISPR gRNA sequence
attttgtacataatgtccag

SEQ ID NO: 719515 - DNA, 20 bp, Artificial
  CRISPR gRNA sequence
ttttgtacataatgtccagg

SEQ ID NO: 719516 - DNA, 20 bp, Artificial
  CRISPR gRNA sequence
tgtacataatgtccagggct

SEQ ID NO: 719517 - DNA, 20 bp, Artificial
  CRISPR gRNA sequence
gtacataatgtccagggctt

SEQ ID NO: 719518 - DNA, 20 bp, Artificial
  CRISPR gRNA sequence
tacataatgtccagggcttt

SEQ ID NO: 719519 - DNA, 20 bp, Artificial
  CRISPR gRNA sequence
ttagcggttcttggcgggag

SEQ ID NO: 719520 - DNA, 20 bp, Artificial
  CRISPR gRNA sequence
tagcggttcttggcgggagg

SEQ ID NO: 719521 - DNA, 20 bp, Artificial
  CRISPR gRNA sequence
agcggttcttggcgggagga

SEQ ID NO: 719522 - DNA, 20 bp, Artificial
  CRISPR gRNA sequence
gcggttcttggcgggaggat

SEQ ID NO: 719523 - DNA, 20 bp, Artificial
  CRISPR gRNA sequence
ttggcgggaggatgagggga

SEQ ID NO: 719524 - DNA, 20 bp, Artificial
  CRISPR gRNA sequence
ggcgggaggatgaggggaaa

SEQ ID NO: 719525 - DNA, 20 bp, Artificial
  CRISPR gRNA sequence
gcgggaggatgaggggaaaa

SEQ ID NO: 719526 - DNA, 20 bp, Artificial
  CRISPR gRNA sequence
agccatcttcccagaatcag

SEQ ID NO: 719527 - DNA, 20 bp, Artificial
  CRISPR gRNA sequence
cccagaatcagagtctcagg

SEQ ID NO: 719528 - DNA, 20 bp, Artificial
  CRISPR gRNA sequence
ccagaatcagagtctcagga

SEQ ID NO: 719529 - DNA, 20 bp, Artificial
  CRISPR gRNA sequence
aggatgtgatcccaacacag

SEQ ID NO: 719530 - DNA, 20 bp, Artificial
  CRISPR gRNA sequence
ctttctcccagcttcagctc

SEQ ID NO: 719531 - DNA, 20 bp, Artificial
  CRISPR gRNA sequence
tctcccagcttcagctctca

SEQ ID NO: 719532 - DNA, 20 bp, Artificial
  CRISPR gRNA sequence
ctcccagcttcagctctcag

SEQ ID NO: 719533 - DNA, 20 bp, Artificial
  CRISPR gRNA sequence
tcccagcttcagctctcagc

SEQ ID NO: 719534 - DNA, 20 bp, Artificial
  CRISPR gRNA sequence
ccagcttcagctctcagcac

SEQ ID NO: 719535 - DNA, 20 bp, Artificial
  CRISPR gRNA sequence
cagctctcagcaccaagccc

SEQ ID NO: 719536 - DNA, 20 bp, Artificial
  CRISPR gRNA sequence
agctctcagcaccaagccct

SEQ ID NO: 719537 - DNA, 20 bp, Artificial
  CRISPR gRNA sequence
tcagcaccaagccctcactc

SEQ ID NO: 719538 - DNA, 20 bp, Artificial
  CRISPR gRNA sequence
agcaccaagccctcactctc

SEQ ID NO: 719539 - DNA, 20 bp, Artificial
  CRISPR gRNA sequence
actctctgggctccacctgc

SEQ ID NO: 719540 - DNA, 20 bp, Artificial
  CRISPR gRNA sequence
tctgggctccacctgcgctg

SEQ ID NO: 719541 - DNA, 20 bp, Artificial
  CRISPR gRNA sequence
tgggctccacctgcgctgcc

SEQ ID NO: 719542 - DNA, 20 bp, Artificial
  CRISPR gRNA sequence
ggctccacctgcgctgccct

SEQ ID NO: 719543 - DNA, 20 bp, Artificial
  CRISPR gRNA sequence
cacctgcgctgcccttcttc

SEQ ID NO: 719544 - DNA, 20 bp, Artificial
  CRISPR gRNA sequence
cgctgcccttcttccaggtt

SEQ ID NO: 719545 - DNA, 20 bp, Artificial
  CRISPR gRNA sequence
cccttcttccaggttggagg

SEQ ID NO: 719546 - DNA, 20 bp, Artificial
  CRISPR gRNA sequence
cttccaggttggaggacgtg

SEQ ID NO: 719547 - DNA, 20 bp, Artificial
  CRISPR gRNA sequence
ttccaggttggaggacgtgt

SEQ ID NO: 719548 - DNA, 20 bp, Artificial
  CRISPR gRNA sequence
ccaggttggaggacgtgtgt

SEQ ID NO: 719549 - DNA, 20 bp, Artificial
  CRISPR gRNA sequence
caggttggaggacgtgtgtg

SEQ ID NO: 719550 - DNA, 20 bp, Artificial
  CRISPR gRNA sequence
gaggacgtgtgtgcttctct

SEQ ID NO: 719551 - DNA, 20 bp, Artificial
  CRISPR gRNA sequence
ctctgtcccacccgccctct

SEQ ID NO: 719552 - DNA, 20 bp, Artificial
  CRISPR gRNA sequence
tctgtcccacccgccctctg

SEQ ID NO: 719553 - DNA, 20 bp, Artificial
  CRISPR gRNA sequence
tgtcccacccgccctctgca

SEQ ID NO: 719554 - DNA, 20 bp, Artificial
  CRISPR gRNA sequence
tcccacccgccctctgcacg

SEQ ID NO: 719555 - DNA, 20 bp, Artificial
  CRISPR gRNA sequence
tgcacgtgctgttctctctg

SEQ ID NO: 719556 - DNA, 20 bp, Artificial
  CRISPR gRNA sequence
cacgtgctgttctctctgtc

SEQ ID NO: 719557 - DNA, 20 bp, Artificial
  CRISPR gRNA sequence
ttctctctgtcggagacacc

SEQ ID NO: 719558 - DNA, 20 bp, Artificial
  CRISPR gRNA sequence
tctctgtcggagacaccctt

SEQ ID NO: 719559 - DNA, 20 bp, Artificial
  CRISPR gRNA sequence
tctgtcggagacacccttcc

SEQ ID NO: 719560 - DNA, 20 bp, Artificial
  CRISPR gRNA sequence
tgtcggagacacccttccct

SEQ ID NO: 719561 - DNA, 20 bp, Artificial
  CRISPR gRNA sequence
tcggagacacccttccctcc

SEQ ID NO: 719562 - DNA, 20 bp, Artificial
  CRISPR gRNA sequence
ccctccccattcacttagtc

SEQ ID NO: 719563 - DNA, 20 bp, Artificial
  CRISPR gRNA sequence
cctccccattcacttagtca

SEQ ID NO: 719564 - DNA, 20 bp, Artificial
  CRISPR gRNA sequence
cccattcacttagtcaaatc

SEQ ID NO: 719565 - DNA, 20 bp, Artificial
  CRISPR gRNA sequence
acttagtcaaatcctactca

SEQ ID NO: 719566 - DNA, 20 bp, Artificial
  CRISPR gRNA sequence
agtcaaatcctactcagccc

SEQ ID NO: 719567 - DNA, 20 bp, Artificial
  CRISPR gRNA sequence
gtcaaatcctactcagccct

SEQ ID NO: 719568 - DNA, 20 bp, Artificial
  CRISPR gRNA sequence
ctcagccctgagctctccac

SEQ ID NO: 719569 - DNA, 20 bp, Artificial
  CRISPR gRNA sequence
agccctgagctctccacccc

SEQ ID NO: 719570 - DNA, 20 bp, Artificial
  CRISPR gRNA sequence
agctctccaccccacttcct

SEQ ID NO: 719571 - DNA, 20 bp, Artificial
  CRISPR gRNA sequence
tccaccccacttcctcaaga

SEQ ID NO: 719572 - DNA, 20 bp, Artificial
  CRISPR gRNA sequence
caccccacttcctcaagagg

SEQ ID NO: 719573 - DNA, 20 bp, Artificial
  CRISPR gRNA sequence
cctcaagaggccttccctgg

SEQ ID NO: 719574 - DNA, 20 bp, Artificial
  CRISPR gRNA sequence
ctcaagaggccttccctggc

SEQ ID NO: 719575 - DNA, 20 bp, Artificial
  CRISPR gRNA sequence
aagaggccttccctggcctc

SEQ ID NO: 719576 - DNA, 20 bp, Artificial
  CRISPR gRNA sequence
ccctggcctctcactaggga

SEQ ID NO: 719577 - DNA, 20 bp, Artificial
  CRISPR gRNA sequence
cctggcctctcactagggaa

SEQ ID NO: 719578 - DNA, 20 bp, Artificial
  CRISPR gRNA sequence
gcctctcactagggaagctg

SEQ ID NO: 719579 - DNA, 20 bp, Artificial
  CRISPR gRNA sequence
tcactagggaagctggtagc

SEQ ID NO: 719580 - DNA, 20 bp, Artificial
  CRISPR gRNA sequence
actagggaagctggtagcac

SEQ ID NO: 719581 - DNA, 20 bp, Artificial
  CRISPR gRNA sequence
gggaagctggtagcactgtg

SEQ ID NO: 719582 - DNA, 20 bp, Artificial
  CRISPR gRNA sequence
gtagcactgtgtcctttgca

SEQ ID NO: 719583 - DNA, 20 bp, Artificial
  CRISPR gRNA sequence
tgtcctttgcaaatgtggat

SEQ ID NO: 719584 - DNA, 20 bp, Artificial
  CRISPR gRNA sequence
tgcaaatgtggatacatacc

SEQ ID NO: 719585 - DNA, 20 bp, Artificial
  CRISPR gRNA sequence
gcaaatgtggatacatacct

SEQ ID NO: 719586 - DNA, 20 bp, Artificial
  CRISPR gRNA sequence
caaatgtggatacatacctc

SEQ ID NO: 719587 - DNA, 20 bp, Artificial
  CRISPR gRNA sequence
tctctgtctcttggcttgat

SEQ ID NO: 719588 - DNA, 20 bp, Artificial
  CRISPR gRNA sequence
tctgtctcttggcttgatca

SEQ ID NO: 719589 - DNA, 20 bp, Artificial
  CRISPR gRNA sequence
tgtctcttggcttgatcaat

SEQ ID NO: 719590 - DNA, 20 bp, Artificial
  CRISPR gRNA sequence
tctcttggcttgatcaatgt

SEQ ID NO: 719591 - DNA, 20 bp, Artificial
  CRISPR gRNA sequence
ttggcttgatcaatgtctgt

SEQ ID NO: 719592 - DNA, 20 bp, Artificial
  CRISPR gRNA sequence
ggcttgatcaatgtctgtct

SEQ ID NO: 719593 - DNA, 20 bp, Artificial
  CRISPR gRNA sequence
gcttgatcaatgtctgtctc

SEQ ID NO: 719594 - DNA, 20 bp, Artificial
  CRISPR gRNA sequence
gatcaatgtctgtctccctc

SEQ ID NO: 719595 - DNA, 20 bp, Artificial
  CRISPR gRNA sequence
atcaatgtctgtctccctcc

SEQ ID NO: 719596 - DNA, 20 bp, Artificial
  CRISPR gRNA sequence
tctccctccctggctggaag

SEQ ID NO: 719597 - DNA, 20 bp, Artificial
  CRISPR gRNA sequence
cctccctggctggaagcttc

SEQ ID NO: 719598 - DNA, 20 bp, Artificial
  CRISPR gRNA sequence
cctggctggaagcttcctga

SEQ ID NO: 719599 - DNA, 20 bp, Artificial
  CRISPR gRNA sequence
gctggaagcttcctgagggc

SEQ ID NO: 719600 - DNA, 20 bp, Artificial
  CRISPR gRNA sequence
gaagcttcctgagggcaaag

SEQ ID NO: 719601 - DNA, 20 bp, Artificial
  CRISPR gRNA sequence
cctgagggcaaagaccatgc

SEQ ID NO: 719602 - DNA, 20 bp, Artificial
  CRISPR gRNA sequence
ctgagggcaaagaccatgcc

SEQ ID NO: 719603 - DNA, 20 bp, Artificial
  CRISPR gRNA sequence
agggcaaagaccatgcccct

SEQ ID NO: 719604 - DNA, 20 bp, Artificial
  CRISPR gRNA sequence
gtgtccatcaacatctcccc

SEQ ID NO: 719605 - DNA, 20 bp, Artificial
  CRISPR gRNA sequence
cccactgcctgatcaaatgc

SEQ ID NO: 719606 - DNA, 20 bp, Artificial
  CRISPR gRNA sequence
cctgatcaaatgctaggcat

SEQ ID NO: 719607 - DNA, 20 bp, Artificial
  CRISPR gRNA sequence
atcaaatgctaggcatggca

SEQ ID NO: 719608 - DNA, 20 bp, Artificial
  CRISPR gRNA sequence
ggcatggcacctgctcccca

SEQ ID NO: 719609 - DNA, 20 bp, Artificial
  CRISPR gRNA sequence
ctccccatagagattcattg

SEQ ID NO: 719610 - DNA, 20 bp, Artificial
  CRISPR gRNA sequence
cccatagagattcattgaat

SEQ ID NO: 719611 - DNA, 20 bp, Artificial
  CRISPR gRNA sequence
attgaattaagatatgggga

SEQ ID NO: 719612 - DNA, 20 bp, Artificial
  CRISPR gRNA sequence
aattaagatatggggacacc

SEQ ID NO: 719613 - DNA, 20 bp, Artificial
  CRISPR gRNA sequence
agatatggggacacctgaca

SEQ ID NO: 719614 - DNA, 20 bp, Artificial
  CRISPR gRNA sequence
acagggagctccgagctggt

SEQ ID NO: 719615 - DNA, 20 bp, Artificial
  CRISPR gRNA sequence
cgagctggtgggggggtgga

SEQ ID NO: 719616 - DNA, 20 bp, Artificial
  CRISPR gRNA sequence
gtgggggggtggagttcaaa

SEQ ID NO: 719617 - DNA, 20 bp, Artificial
  CRISPR gRNA sequence
aaatctggtcaaattccagg

SEQ ID NO: 719618 - DNA, 20 bp, Artificial
  CRISPR gRNA sequence
gtcaaattccagggtcgggg

SEQ ID NO: 719619 - DNA, 20 bp, Artificial
  CRISPR gRNA sequence
cagggtcgggggagagcgct

SEQ ID NO: 719620 - DNA, 20 bp, Artificial
  CRISPR gRNA sequence
tgctaaggaatgatggaggc

SEQ ID NO: 719621 - DNA, 20 bp, Artificial
  CRISPR gRNA sequence
ctaaggaatgatggaggcct

SEQ ID NO: 719622 - DNA, 20 bp, Artificial
  CRISPR gRNA sequence
aggaatgatggaggcctcca

SEQ ID NO: 719623 - DNA, 20 bp, Artificial
  CRISPR gRNA sequence
cacccataagcaggggagag

SEQ ID NO: 719624 - DNA, 20 bp, Artificial
  CRISPR gRNA sequence
gagtggactgggcagcagat

SEQ ID NO: 719625 - DNA, 20 bp, Artificial
  CRISPR gRNA sequence
ggcagcagatacctaggatt

SEQ ID NO: 719626 - DNA, 20 bp, Artificial
  CRISPR gRNA sequence
ggattttgcaaagatttgca

SEQ ID NO: 719627 - DNA, 20 bp, Artificial
  CRISPR gRNA sequence
tgcaaagatttgcaactgtg

SEQ ID NO: 719628 - DNA, 20 bp, Artificial
  CRISPR gRNA sequence
gcaaagatttgcaactgtgg

SEQ ID NO: 719629 - DNA, 20 bp, Artificial
  CRISPR gRNA sequence
caaagatttgcaactgtggg

SEQ ID NO: 719630 - DNA, 20 bp, Artificial
  CRISPR gRNA sequence
gcaactgtggggcatgttcc

SEQ ID NO: 719631 - DNA, 20 bp, Artificial
  CRISPR gRNA sequence
caactgtggggcatgttccc

SEQ ID NO: 719632 - DNA, 20 bp, Artificial
  CRISPR gRNA sequence
tggggcatgttcccacccgc

SEQ ID NO: 719633 - DNA, 20 bp, Artificial
  CRISPR gRNA sequence
ccacccgcctctggacctcg

SEQ ID NO: 719634 - DNA, 20 bp, Artificial
  CRISPR gRNA sequence
tggacctcggtctccccatc

SEQ ID NO: 719635 - DNA, 20 bp, Artificial
  CRISPR gRNA sequence
gacctcggtctccccatctc

SEQ ID NO: 719636 - DNA, 20 bp, Artificial
  CRISPR gRNA sequence
ggtctccccatctctcaaat

SEQ ID NO: 719637 - DNA, 20 bp, Artificial
  CRISPR gRNA sequence
cccatctctcaaatgaggag

SEQ ID NO: 719638 - DNA, 20 bp, Artificial
  CRISPR gRNA sequence
tcaaatgaggaggtataact

SEQ ID NO: 719639 - DNA, 20 bp, Artificial
  CRISPR gRNA sequence
aaatgaggaggtataactga

SEQ ID NO: 719640 - DNA, 20 bp, Artificial
  CRISPR gRNA sequence
aaggccttgggggcctctcc

SEQ ID NO: 719641 - DNA, 20 bp, Artificial
  CRISPR gRNA sequence
gggggcctctccaaaaaggc

SEQ ID NO: 719642 - DNA, 20 bp, Artificial
  CRISPR gRNA sequence
ggggcctctccaaaaaggcc

SEQ ID NO: 719643 - DNA, 20 bp, Artificial
  CRISPR gRNA sequence
tccaaaaaggccaaacttcc

SEQ ID NO: 719644 - DNA, 20 bp, Artificial
  CRISPR gRNA sequence
caaaaaggccaaacttccca

SEQ ID NO: 719645 - DNA, 20 bp, Artificial
  CRISPR gRNA sequence
cccaaaagtttccagctcag

SEQ ID NO: 719646 - DNA, 20 bp, Artificial
  CRISPR gRNA sequence
ccaaaagtttccagctcaga

SEQ ID NO: 719647 - DNA, 20 bp, Artificial
  CRISPR gRNA sequence
ccagctcagaaacttctgca

SEQ ID NO: 719648 - DNA, 20 bp, Artificial
  CRISPR gRNA sequence
cagctcagaaacttctgcat

SEQ ID NO: 719649 - DNA, 20 bp, Artificial
  CRISPR gRNA sequence
agaaacttctgcatctttgt

SEQ ID NO: 719650 - DNA, 20 bp, Artificial
  CRISPR gRNA sequence
ctgcatctttgtgaaaaaca

SEQ ID NO: 719651 - DNA, 20 bp, Artificial
  CRISPR gRNA sequence
tgcatctttgtgaaaaacat

SEQ ID NO: 719652 - DNA, 20 bp, Artificial
  CRISPR gRNA sequence
catctttgtgaaaaacatct

SEQ ID NO: 719653 - DNA, 20 bp, Artificial
  CRISPR gRNA sequence
tgtgaaaaacatcttgagtt

SEQ ID NO: 719654 - DNA, 20 bp, Artificial
  CRISPR gRNA sequence
gtgaaaaacatcttgagttc

SEQ ID NO: 719655 - DNA, 20 bp, Artificial
  CRISPR gRNA sequence
tgaaaaacatcttgagttca

SEQ ID NO: 719656 - DNA, 20 bp, Artificial
  CRISPR gRNA sequence
gagttcagttgttccagcca

SEQ ID NO: 719657 - DNA, 20 bp, Artificial
  CRISPR gRNA sequence
agttcagttgttccagccaa

SEQ ID NO: 719658 - DNA, 20 bp, Artificial
  CRISPR gRNA sequence
agttgttccagccaaggctt

SEQ ID NO: 719659 - DNA, 20 bp, Artificial
  CRISPR gRNA sequence
ttccagccaaggcttcctgc

SEQ ID NO: 719660 - DNA, 20 bp, Artificial
  CRISPR gRNA sequence
cagccaaggcttcctgctgg

SEQ ID NO: 719661 - DNA, 20 bp, Artificial
  CRISPR gRNA sequence
cctgctggagggactgtctg

SEQ ID NO: 719662 - DNA, 20 bp, Artificial
  CRISPR gRNA sequence
ctgctggagggactgtctgg

SEQ ID NO: 719663 - DNA, 20 bp, Artificial
  CRISPR gRNA sequence
ctggagggactgtctgggca

SEQ ID NO: 719664 - DNA, 20 bp, Artificial
  CRISPR gRNA sequence
gagggactgtctgggcagtg

SEQ ID NO: 719665 - DNA, 20 bp, Artificial
  CRISPR gRNA sequence
tctgggcagtgttcctgaga

SEQ ID NO: 719666 - DNA, 20 bp, Artificial
  CRISPR gRNA sequence
ggcagtgttcctgagactgc

SEQ ID NO: 719667 - DNA, 20 bp, Artificial
  CRISPR gRNA sequence
ctgagactgccacacagcgg

SEQ ID NO: 719668 - DNA, 20 bp, Artificial
  CRISPR gRNA sequence
agactgccacacagcggcgc

SEQ ID NO: 719669 - DNA, 20 bp, Artificial
  CRISPR gRNA sequence
ccacacagcggcgccagagg

SEQ ID NO: 719670 - DNA, 20 bp, Artificial
  CRISPR gRNA sequence
cctttgctgcccctggaccc

SEQ ID NO: 719671 - DNA, 20 bp, Artificial
  CRISPR gRNA sequence
tgctgcccctggaccccagc

SEQ ID NO: 719672 - DNA, 20 bp, Artificial
  CRISPR gRNA sequence
gctgcccctggaccccagct

SEQ ID NO: 719673 - DNA, 20 bp, Artificial
  CRISPR gRNA sequence
ctgcccctggaccccagctg

SEQ ID NO: 719674 - DNA, 20 bp, Artificial
  CRISPR gRNA sequence
cccctggaccccagctgccc

SEQ ID NO: 719675 - DNA, 20 bp, Artificial
  CRISPR gRNA sequence
gaccccagctgcccaatgca

SEQ ID NO: 719676 - DNA, 20 bp, Artificial
  CRISPR gRNA sequence
cccaatgcagtgcccctggc

SEQ ID NO: 719677 - DNA, 20 bp, Artificial
  CRISPR gRNA sequence
gcccgtggcacgtggccacg

SEQ ID NO: 719678 - DNA, 20 bp, Artificial
  CRISPR gRNA sequence
aaaatgcagctaggggccgg

SEQ ID NO: 719679 - DNA, 20 bp, Artificial
  CRISPR gRNA sequence
aaatgcagctaggggccggg

SEQ ID NO: 719680 - DNA, 20 bp, Artificial
  CRISPR gRNA sequence
ggggccgggtgcggtggctc

SEQ ID NO: 719681 - DNA, 20 bp, Artificial
  CRISPR gRNA sequence
acacctgtaattccagcatt

SEQ ID NO: 719682 - DNA, 20 bp, Artificial
  CRISPR gRNA sequence
taattccagcattttgggag

SEQ ID NO: 719683 - DNA, 20 bp, Artificial
  CRISPR gRNA sequence
cagcattttgggaggctgag

SEQ ID NO: 719684 - DNA, 20 bp, Artificial
  CRISPR gRNA sequence
tgggaggctgaggcaggcgg

SEQ ID NO: 719685 - DNA, 20 bp, Artificial
  CRISPR gRNA sequence
gggaggctgaggcaggcgga

SEQ ID NO: 719686 - DNA, 20 bp, Artificial
  CRISPR gRNA sequence
ggaggctgaggcaggcggat

SEQ ID NO: 719687 - DNA, 20 bp, Artificial
  CRISPR gRNA sequence
aggcaggcggatcacttgaa

SEQ ID NO: 719688 - DNA, 20 bp, Artificial
  CRISPR gRNA sequence
gaagtcaggagtttgagacc

SEQ ID NO: 719689 - DNA, 20 bp, Artificial
  CRISPR gRNA sequence
aagtcaggagtttgagacca

SEQ ID NO: 719690 - DNA, 20 bp, Artificial
  CRISPR gRNA sequence
gagaccagcctggccaatgt

SEQ ID NO: 719691 - DNA, 20 bp, Artificial
  CRISPR gRNA sequence
agaccagcctggccaatgtg

SEQ ID NO: 719692 - DNA, 20 bp, Artificial
  CRISPR gRNA sequence
gccaatgtggtgaaacctcg

SEQ ID NO: 719693 - DNA, 20 bp, Artificial
  CRISPR gRNA sequence
gtctctactaaaaatacaaa

SEQ ID NO: 719694 - DNA, 20 bp, Artificial
  CRISPR gRNA sequence
tactaaaaatacaaaagttg

SEQ ID NO: 719695 - DNA, 20 bp, Artificial
  CRISPR gRNA sequence
ctaaaaatacaaaagttggc

SEQ ID NO: 719696 - DNA, 20 bp, Artificial
  CRISPR gRNA sequence
aaaatacaaaagttggccag

SEQ ID NO: 719697 - DNA, 20 bp, Artificial
  CRISPR gRNA sequence
gccaggtgtggtggcgggtg

SEQ ID NO: 719698 - DNA, 20 bp, Artificial
  CRISPR gRNA sequence
gaaatctcaactacttggga

SEQ ID NO: 719699 - DNA, 20 bp, Artificial
  CRISPR gRNA sequence
aaatctcaactacttgggag

SEQ ID NO: 719700 - DNA, 20 bp, Artificial
  CRISPR gRNA sequence
aactacttgggaggctgagg

SEQ ID NO: 719701 - DNA, 20 bp, Artificial
  CRISPR gRNA sequence
cttgggaggctgaggcatga

SEQ ID NO: 719702 - DNA, 20 bp, Artificial
  CRISPR gRNA sequence
gggaggctgaggcatgagaa

SEQ ID NO: 719703 - DNA, 20 bp, Artificial
  CRISPR gRNA sequence
ggaggctgaggcatgagaat

SEQ ID NO: 719704 - DNA, 20 bp, Artificial
  CRISPR gRNA sequence
aggcatgagaattgcttgaa

SEQ ID NO: 719705 - DNA, 20 bp, Artificial
  CRISPR gRNA sequence
cttgaatccgggaggtggag

SEQ ID NO: 719706 - DNA, 20 bp, Artificial
  CRISPR gRNA sequence
gaatccgggaggtggaggtt

SEQ ID NO: 719707 - DNA, 20 bp, Artificial
  CRISPR gRNA sequence
aatccgggaggtggaggttg

SEQ ID NO: 719708 - DNA, 20 bp, Artificial
  CRISPR gRNA sequence
tagtgagctgagattgtgcc

SEQ ID NO: 719709 - DNA, 20 bp, Artificial
  CRISPR gRNA sequence
agattgtgccactgcactcc

SEQ ID NO: 719710 - DNA, 20 bp, Artificial
  CRISPR gRNA sequence
tgccactgcactccaacctg

SEQ ID NO: 719711 - DNA, 20 bp, Artificial
  CRISPR gRNA sequence
cactccaacctgggcgacag

SEQ ID NO: 719712 - DNA, 20 bp, Artificial
  CRISPR gRNA sequence
caacctgggcgacagagtta

SEQ ID NO: 719713 - DNA, 20 bp, Artificial
  CRISPR gRNA sequence
ggcgacagagttagactctg

SEQ ID NO: 719714 - DNA, 20 bp, Artificial
  CRISPR gRNA sequence
gactctgtttcaaaaaaaaa

SEQ ID NO: 719715 - DNA, 20 bp, Artificial
  CRISPR gRNA sequence
tgtttcaaaaaaaaaatccg

SEQ ID NO: 719716 - DNA, 20 bp, Artificial
  CRISPR gRNA sequence
tttcaaaaaaaaaatccgat

SEQ ID NO: 719717 - DNA, 20 bp, Artificial
  CRISPR gRNA sequence
caaaaaaaaaatccgataaa

SEQ ID NO: 719718 - DNA, 20 bp, Artificial
  CRISPR gRNA sequence
aaaaaaaaaatccgataaaa

SEQ ID NO: 719719 - DNA, 20 bp, Artificial
  CRISPR gRNA sequence
cattgagaagtgctgtgtgt

SEQ ID NO: 719720 - DNA, 20 bp, Artificial
  CRISPR gRNA sequence
agaagtgctgtgtgtacaat

SEQ ID NO: 719721 - DNA, 20 bp, Artificial
  CRISPR gRNA sequence
tgtgtacaatatgcactgga

SEQ ID NO: 719722 - DNA, 20 bp, Artificial
  CRISPR gRNA sequence
gatttcgaaaacttagtata

SEQ ID NO: 719723 - DNA, 20 bp, Artificial
  CRISPR gRNA sequence
cgaaaacttagtataaacaa

SEQ ID NO: 719724 - DNA, 20 bp, Artificial
  CRISPR gRNA sequence
gaaaacttagtataaacaag

SEQ ID NO: 719725 - DNA, 20 bp, Artificial
  CRISPR gRNA sequence
agtataaacaagaatataat

SEQ ID NO: 719726 - DNA, 20 bp, Artificial
  CRISPR gRNA sequence
gtataaacaagaatataatt

SEQ ID NO: 719727 - DNA, 20 bp, Artificial
  CRISPR gRNA sequence
attattttttatattgattg

SEQ ID NO: 719728 - DNA, 20 bp, Artificial
  CRISPR gRNA sequence
ttttttatattgattgcctg

SEQ ID NO: 719729 - DNA, 20 bp, Artificial
  CRISPR gRNA sequence
tttatattgattgcctgcaa

SEQ ID NO: 719730 - DNA, 20 bp, Artificial
  CRISPR gRNA sequence
ttatattgattgcctgcaaa

SEQ ID NO: 719731 - DNA, 20 bp, Artificial
  CRISPR gRNA sequence
tatattgattgcctgcaaac

SEQ ID NO: 719732 - DNA, 20 bp, Artificial
  CRISPR gRNA sequence
atattgattgcctgcaaaca

SEQ ID NO: 719733 - DNA, 20 bp, Artificial
  CRISPR gRNA sequence
tattgattgcctgcaaacat

SEQ ID NO: 719734 - DNA, 20 bp, Artificial
  CRISPR gRNA sequence
attgcctgcaaacatggtaa

SEQ ID NO: 719735 - DNA, 20 bp, Artificial
  CRISPR gRNA sequence
cctgcaaacatggtaatatt

SEQ ID NO: 719736 - DNA, 20 bp, Artificial
  CRISPR gRNA sequence
caaacatggtaatattttag

SEQ ID NO: 719737 - DNA, 20 bp, Artificial
  CRISPR gRNA sequence
tagatatactgggttaaata

SEQ ID NO: 719738 - DNA, 20 bp, Artificial
  CRISPR gRNA sequence
agatatactgggttaaataa

SEQ ID NO: 719739 - DNA, 20 bp, Artificial
  CRISPR gRNA sequence
gatatactgggttaaataat

SEQ ID NO: 719740 - DNA, 20 bp, Artificial
  CRISPR gRNA sequence
ggttaaataatgaaaattaa

SEQ ID NO: 719741 - DNA, 20 bp, Artificial
  CRISPR gRNA sequence
aataatgaaaattaattgca

SEQ ID NO: 719742 - DNA, 20 bp, Artificial
  CRISPR gRNA sequence
attgcactgatttcttttta

SEQ ID NO: 719743 - DNA, 20 bp, Artificial
  CRISPR gRNA sequence
cactgatttctttttacctt

SEQ ID NO: 719744 - DNA, 20 bp, Artificial
  CRISPR gRNA sequence
atttctttttaccttttaaa

SEQ ID NO: 719745 - DNA, 20 bp, Artificial
  CRISPR gRNA sequence
ctttttaccttttaaagtgt

SEQ ID NO: 719746 - DNA, 20 bp, Artificial
  CRISPR gRNA sequence
tttttaccttttaaagtgtg

SEQ ID NO: 719747 - DNA, 20 bp, Artificial
  CRISPR gRNA sequence
tttaccttttaaagtgtggc

SEQ ID NO: 719748 - DNA, 20 bp, Artificial
  CRISPR gRNA sequence
ttaccttttaaagtgtggct

SEQ ID NO: 719749 - DNA, 20 bp, Artificial
  CRISPR gRNA sequence
taccttttaaagtgtggctc

SEQ ID NO: 719750 - DNA, 20 bp, Artificial
  CRISPR gRNA sequence
accttttaaagtgtggctcc

SEQ ID NO: 719751 - DNA, 20 bp, Artificial
  CRISPR gRNA sequence
ccttttaaagtgtggctccc

SEQ ID NO: 719752 - DNA, 20 bp, Artificial
  CRISPR gRNA sequence
ttaaagtgtggctcccagaa

SEQ ID NO: 719753 - DNA, 20 bp, Artificial
  CRISPR gRNA sequence
taaagtgtggctcccagaat

SEQ ID NO: 719754 - DNA, 20 bp, Artificial
  CRISPR gRNA sequence
aaagtgtggctcccagaata

SEQ ID NO: 719755 - DNA, 20 bp, Artificial
  CRISPR gRNA sequence
aagtgtggctcccagaatat

SEQ ID NO: 719756 - DNA, 20 bp, Artificial
  CRISPR gRNA sequence
ccagaatatttgagctggcc

SEQ ID NO: 719757 - DNA, 20 bp, Artificial
  CRISPR gRNA sequence
gagctggcctgtgtgactcg

SEQ ID NO: 719758 - DNA, 20 bp, Artificial
  CRISPR gRNA sequence
agctggcctgtgtgactcgc

SEQ ID NO: 719759 - DNA, 20 bp, Artificial
  CRISPR gRNA sequence
gcctgtgtgactcgcatatc

SEQ ID NO: 719760 - DNA, 20 bp, Artificial
  CRISPR gRNA sequence
tgtgactcgcatatctctgt

SEQ ID NO: 719761 - DNA, 20 bp, Artificial
  CRISPR gRNA sequence
gcatatctctgttggacagc

SEQ ID NO: 719762 - DNA, 20 bp, Artificial
  CRISPR gRNA sequence
tgttggacagcactgtttta

SEQ ID NO: 719763 - DNA, 20 bp, Artificial
  CRISPR gRNA sequence
ttggacagcactgttttaga

SEQ ID NO: 719764 - DNA, 20 bp, Artificial
  CRISPR gRNA sequence
gacagcactgttttagaagt

SEQ ID NO: 719765 - DNA, 20 bp, Artificial
  CRISPR gRNA sequence
ttttagaagtgttctaatct

SEQ ID NO: 719766 - DNA, 20 bp, Artificial
  CRISPR gRNA sequence
tagaagtgttctaatctcag

SEQ ID NO: 719767 - DNA, 20 bp, Artificial
  CRISPR gRNA sequence
agaagtgttctaatctcagc

SEQ ID NO: 719768 - DNA, 20 bp, Artificial
  CRISPR gRNA sequence
gaagtgttctaatctcagct

SEQ ID NO: 719769 - DNA, 20 bp, Artificial
  CRISPR gRNA sequence
taatctcagctgccaaaccc

SEQ ID NO: 719770 - DNA, 20 bp, Artificial
  CRISPR gRNA sequence
atctcagctgccaaaccctg

SEQ ID NO: 719771 - DNA, 20 bp, Artificial
  CRISPR gRNA sequence
agctgccaaaccctggttaa

SEQ ID NO: 719772 - DNA, 20 bp, Artificial
  CRISPR gRNA sequence
ccaaaccctggttaatctct

SEQ ID NO: 719773 - DNA, 20 bp, Artificial
  CRISPR gRNA sequence
gttaatctctggggtcccct

SEQ ID NO: 719774 - DNA, 20 bp, Artificial
  CRISPR gRNA sequence
atctctggggtcccctgtgg

SEQ ID NO: 719775 - DNA, 20 bp, Artificial
  CRISPR gRNA sequence
tggggtcccctgtggactca

SEQ ID NO: 719776 - DNA, 20 bp, Artificial
  CRISPR gRNA sequence
gggtcccctgtggactcacc

SEQ ID NO: 719777 - DNA, 20 bp, Artificial
  CRISPR gRNA sequence
tggactcacccatggggcag

SEQ ID NO: 719778 - DNA, 20 bp, Artificial
  CRISPR gRNA sequence
acccatggggcagctctccg

SEQ ID NO: 719779 - DNA, 20 bp, Artificial
  CRISPR gRNA sequence
tccggggttgttgttttttt

SEQ ID NO: 719780 - DNA, 20 bp, Artificial
  CRISPR gRNA sequence
cggggttgttgttttttttc

SEQ ID NO: 719781 - DNA, 20 bp, Artificial
  CRISPR gRNA sequence
ttgttttttttccagctgta

SEQ ID NO: 719782 - DNA, 20 bp, Artificial
  CRISPR gRNA sequence
ttttttttccagctgtaaaa

SEQ ID NO: 719783 - DNA, 20 bp, Artificial
  CRISPR gRNA sequence
tttttccagctgtaaaatag

SEQ ID NO: 719784 - DNA, 20 bp, Artificial
  CRISPR gRNA sequence
ttttccagctgtaaaataga

SEQ ID NO: 719785 - DNA, 20 bp, Artificial
  CRISPR gRNA sequence
tttccagctgtaaaatagaa

SEQ ID NO: 719786 - DNA, 20 bp, Artificial
  CRISPR gRNA sequence
ttccagctgtaaaatagaaa

SEQ ID NO: 719787 - DNA, 20 bp, Artificial
  CRISPR gRNA sequence
tccagctgtaaaatagaaag

SEQ ID NO: 719788 - DNA, 20 bp, Artificial
  CRISPR gRNA sequence
ccagctgtaaaatagaaagc

SEQ ID NO: 719789 - DNA, 20 bp, Artificial
  CRISPR gRNA sequence
cagctgtaaaatagaaagca

SEQ ID NO: 719790 - DNA, 20 bp, Artificial
  CRISPR gRNA sequence
taaaatagaaagcagtttct

SEQ ID NO: 719791 - DNA, 20 bp, Artificial
  CRISPR gRNA sequence
ctgcctccagtcagccaagc

SEQ ID NO: 719792 - DNA, 20 bp, Artificial
  CRISPR gRNA sequence
tgcctccagtcagccaagcc

SEQ ID NO: 719793 - DNA, 20 bp, Artificial
  CRISPR gRNA sequence
cctccagtcagccaagcccc

SEQ ID NO: 719794 - DNA, 20 bp, Artificial
  CRISPR gRNA sequence
cagtcagccaagccccacgc

SEQ ID NO: 719795 - DNA, 20 bp, Artificial
  CRISPR gRNA sequence
agagccttcactggctgtct

SEQ ID NO: 719796 - DNA, 20 bp, Artificial
  CRISPR gRNA sequence
cactggctgtctctcctgaa

SEQ ID NO: 719797 - DNA, 20 bp, Artificial
  CRISPR gRNA sequence
actggctgtctctcctgaaa

SEQ ID NO: 719798 - DNA, 20 bp, Artificial
  CRISPR gRNA sequence
gctgtctctcctgaaattct

SEQ ID NO: 719799 - DNA, 20 bp, Artificial
  CRISPR gRNA sequence
tctctcctgaaattctcacg

SEQ ID NO: 719800 - DNA, 20 bp, Artificial
  CRISPR gRNA sequence
tcctgaaattctcacgtctc

SEQ ID NO: 719801 - DNA, 20 bp, Artificial
  CRISPR gRNA sequence
ctgaaattctcacgtctcca

SEQ ID NO: 719802 - DNA, 20 bp, Artificial
  CRISPR gRNA sequence
aaattctcacgtctccataa

SEQ ID NO: 719803 - DNA, 20 bp, Artificial
  CRISPR gRNA sequence
tcacgtctccataagacaga

SEQ ID NO: 719804 - DNA, 20 bp, Artificial
  CRISPR gRNA sequence
acgtctccataagacagaca

SEQ ID NO: 719805 - DNA, 20 bp, Artificial
  CRISPR gRNA sequence
cataagacagacagtattag

SEQ ID NO: 719806 - DNA, 20 bp, Artificial
  CRISPR gRNA sequence
gccccattttccaggtgtgg

SEQ ID NO: 719807 - DNA, 20 bp, Artificial
  CRISPR gRNA sequence
tccaggtgtggaaatcgagg

SEQ ID NO: 719808 - DNA, 20 bp, Artificial
  CRISPR gRNA sequence
ccaggtgtggaaatcgaggt

SEQ ID NO: 719809 - DNA, 20 bp, Artificial
  CRISPR gRNA sequence
caggtgtggaaatcgaggtc

SEQ ID NO: 719810 - DNA, 20 bp, Artificial
  CRISPR gRNA sequence
cccgcggagacagagcagga

SEQ ID NO: 719811 - DNA, 20 bp, Artificial
  CRISPR gRNA sequence
agcttaggtgtcatcactcc

SEQ ID NO: 719812 - DNA, 20 bp, Artificial
  CRISPR gRNA sequence
aggtgtcatcactccaccat

SEQ ID NO: 719813 - DNA, 20 bp, Artificial
  CRISPR gRNA sequence
ggtgtcatcactccaccatg

SEQ ID NO: 719814 - DNA, 20 bp, Artificial
  CRISPR gRNA sequence
caccatgccacagaacacga

SEQ ID NO: 719815 - DNA, 20 bp, Artificial
  CRISPR gRNA sequence
ctcgcgctcacctccacgga

SEQ ID NO: 719816 - DNA, 20 bp, Artificial
  CRISPR gRNA sequence
gcgctcacctccacggaaag

SEQ ID NO: 719817 - DNA, 20 bp, Artificial
  CRISPR gRNA sequence
acctccacggaaagcttcag

SEQ ID NO: 719818 - DNA, 20 bp, Artificial
  CRISPR gRNA sequence
cacggaaagcttcagagcga

SEQ ID NO: 719819 - DNA, 20 bp, Artificial
  CRISPR gRNA sequence
cagagcgaagtcccacacat

SEQ ID NO: 719820 - DNA, 20 bp, Artificial
  CRISPR gRNA sequence
agagcgaagtcccacacata

SEQ ID NO: 719821 - DNA, 20 bp, Artificial
  CRISPR gRNA sequence
ttttattttttttttttttg

SEQ ID NO: 719822 - DNA, 20 bp, Artificial
  CRISPR gRNA sequence
tttattttttttttttttgt

SEQ ID NO: 719823 - DNA, 20 bp, Artificial
  CRISPR gRNA sequence
ttattttttttttttttgtg

SEQ ID NO: 719824 - DNA, 20 bp, Artificial
  CRISPR gRNA sequence
tattttttttttttttgtga

SEQ ID NO: 719825 - DNA, 20 bp, Artificial
  CRISPR gRNA sequence
attttttttttttttgtgat

SEQ ID NO: 719826 - DNA, 20 bp, Artificial
  CRISPR gRNA sequence
ttttttttttttttgtgatg

SEQ ID NO: 719827 - DNA, 20 bp, Artificial
  CRISPR gRNA sequence
tttttttttttgtgatggag

SEQ ID NO: 719828 - DNA, 20 bp, Artificial
  CRISPR gRNA sequence
ttttttttttgtgatggagc

SEQ ID NO: 719829 - DNA, 20 bp, Artificial
  CRISPR gRNA sequence
tttttttttgtgatggagcc

SEQ ID NO: 719830 - DNA, 20 bp, Artificial
  CRISPR gRNA sequence
ttttttttgtgatggagcct

SEQ ID NO: 719831 - DNA, 20 bp, Artificial
  CRISPR gRNA sequence
tttttttgtgatggagcctc

SEQ ID NO: 719832 - DNA, 20 bp, Artificial
  CRISPR gRNA sequence
ttttttgtgatggagcctcg

SEQ ID NO: 719833 - DNA, 20 bp, Artificial
  CRISPR gRNA sequence
tttttgtgatggagcctcga

SEQ ID NO: 719834 - DNA, 20 bp, Artificial
  CRISPR gRNA sequence
ttttgtgatggagcctcgat

SEQ ID NO: 719835 - DNA, 20 bp, Artificial
  CRISPR gRNA sequence
tttgtgatggagcctcgatc

SEQ ID NO: 719836 - DNA, 20 bp, Artificial
  CRISPR gRNA sequence
ttgtgatggagcctcgatct

SEQ ID NO: 719837 - DNA, 20 bp, Artificial
  CRISPR gRNA sequence
tgtgatggagcctcgatctg

SEQ ID NO: 719838 - DNA, 20 bp, Artificial
  CRISPR gRNA sequence
gtgatggagcctcgatctgt

SEQ ID NO: 719839 - DNA, 20 bp, Artificial
  CRISPR gRNA sequence
tgatggagcctcgatctgtc

SEQ ID NO: 719840 - DNA, 20 bp, Artificial
  CRISPR gRNA sequence
gatctgtcacccagactaga

SEQ ID NO: 719841 - DNA, 20 bp, Artificial
  CRISPR gRNA sequence
tcacccagactagagtgcaa

SEQ ID NO: 719842 - DNA, 20 bp, Artificial
  CRISPR gRNA sequence
gagtgcaatggtgtgatctc

SEQ ID NO: 719843 - DNA, 20 bp, Artificial
  CRISPR gRNA sequence
agctcactgcaacctctgcc

SEQ ID NO: 719844 - DNA, 20 bp, Artificial
  CRISPR gRNA sequence
actgcaacctctgcctcccg

SEQ ID NO: 719845 - DNA, 20 bp, Artificial
  CRISPR gRNA sequence
caacctctgcctcccggatt

SEQ ID NO: 719846 - DNA, 20 bp, Artificial
  CRISPR gRNA sequence
tgcctcccggattcaagtga

SEQ ID NO: 719847 - DNA, 20 bp, Artificial
  CRISPR gRNA sequence
cctcccggattcaagtgatt

SEQ ID NO: 719848 - DNA, 20 bp, Artificial
  CRISPR gRNA sequence
ccggattcaagtgattctcc

SEQ ID NO: 719849 - DNA, 20 bp, Artificial
  CRISPR gRNA sequence
aagtgattctcctgcctcag

SEQ ID NO: 719850 - DNA, 20 bp, Artificial
  CRISPR gRNA sequence
tcctgcctcagcctcctgag

SEQ ID NO: 719851 - DNA, 20 bp, Artificial
  CRISPR gRNA sequence
ctgcctcagcctcctgagta

SEQ ID NO: 719852 - DNA, 20 bp, Artificial
  CRISPR gRNA sequence
cctcagcctcctgagtagct

SEQ ID NO: 719853 - DNA, 20 bp, Artificial
  CRISPR gRNA sequence
agcctcctgagtagctggga

SEQ ID NO: 719854 - DNA, 20 bp, Artificial
  CRISPR gRNA sequence
ctgagtagctgggattacag

SEQ ID NO: 719855 - DNA, 20 bp, Artificial
  CRISPR gRNA sequence
agtagctgggattacaggta

SEQ ID NO: 719856 - DNA, 20 bp, Artificial
  CRISPR gRNA sequence
ggattacaggtacctgccac

SEQ ID NO: 719857 - DNA, 20 bp, Artificial
  CRISPR gRNA sequence
caggtacctgccaccatgcc

SEQ ID NO: 719858 - DNA, 20 bp, Artificial
  CRISPR gRNA sequence
ccaccatgcccggctaattt

SEQ ID NO: 719859 - DNA, 20 bp, Artificial
  CRISPR gRNA sequence
attttttgtaattttagtag

SEQ ID NO: 719860 - DNA, 20 bp, Artificial
  CRISPR gRNA sequence
tttgtaattttagtagagat

SEQ ID NO: 719861 - DNA, 20 bp, Artificial
  CRISPR gRNA sequence
ttgtaattttagtagagatg

SEQ ID NO: 719862 - DNA, 20 bp, Artificial
  CRISPR gRNA sequence
tgtaattttagtagagatgg

SEQ ID NO: 719863 - DNA, 20 bp, Artificial
  CRISPR gRNA sequence
gtaattttagtagagatggg

SEQ ID NO: 719864 - DNA, 20 bp, Artificial
  CRISPR gRNA sequence
taattttagtagagatgggg

SEQ ID NO: 719865 - DNA, 20 bp, Artificial
  CRISPR gRNA sequence
tagtagagatggggtttcac

SEQ ID NO: 719866 - DNA, 20 bp, Artificial
  CRISPR gRNA sequence
agtagagatggggtttcact

SEQ ID NO: 719867 - DNA, 20 bp, Artificial
  CRISPR gRNA sequence
gtagagatggggtttcacta

SEQ ID NO: 719868 - DNA, 20 bp, Artificial
  CRISPR gRNA sequence
cactatgttgtccaggctgg

SEQ ID NO: 719869 - DNA, 20 bp, Artificial
  CRISPR gRNA sequence
actatgttgtccaggctggt

SEQ ID NO: 719870 - DNA, 20 bp, Artificial
  CRISPR gRNA sequence
tgttgtccaggctggtctcg

SEQ ID NO: 719871 - DNA, 20 bp, Artificial
  CRISPR gRNA sequence
tccaggctggtctcgaactc

SEQ ID NO: 719872 - DNA, 20 bp, Artificial
  CRISPR gRNA sequence
gtctcgaactcctgacctca

SEQ ID NO: 719873 - DNA, 20 bp, Artificial
  CRISPR gRNA sequence
gaactcctgacctcatgatc

SEQ ID NO: 719874 - DNA, 20 bp, Artificial
  CRISPR gRNA sequence
ctgacctcatgatccgccca

SEQ ID NO: 719875 - DNA, 20 bp, Artificial
  CRISPR gRNA sequence
acctcatgatccgcccacct

SEQ ID NO: 719876 - DNA, 20 bp, Artificial
  CRISPR gRNA sequence
atgatccgcccacctcggcc

SEQ ID NO: 719877 - DNA, 20 bp, Artificial
  CRISPR gRNA sequence
ggcctcccaaagtgttggga

SEQ ID NO: 719878 - DNA, 20 bp, Artificial
  CRISPR gRNA sequence
ccaaagtgttgggattacag

SEQ ID NO: 719879 - DNA, 20 bp, Artificial
  CRISPR gRNA sequence
ggattacaggtgtgagccac

SEQ ID NO: 719880 - DNA, 20 bp, Artificial
  CRISPR gRNA sequence
caggtgtgagccaccgtgcc

SEQ ID NO: 719881 - DNA, 20 bp, Artificial
  CRISPR gRNA sequence
gcgacatacgggtcaccttc

SEQ ID NO: 719882 - DNA, 20 bp, Artificial
  CRISPR gRNA sequence
ctaagtgttgggatgggagt

SEQ ID NO: 719883 - DNA, 20 bp, Artificial
  CRISPR gRNA sequence
taagtgttgggatgggagtc

SEQ ID NO: 719884 - DNA, 20 bp, Artificial
  CRISPR gRNA sequence
agtgttgggatgggagtcca

SEQ ID NO: 719885 - DNA, 20 bp, Artificial
  CRISPR gRNA sequence
ggatgggagtccagatgggt

SEQ ID NO: 719886 - DNA, 20 bp, Artificial
  CRISPR gRNA sequence
accatatgtcatgcaatgtg

SEQ ID NO: 719887 - DNA, 20 bp, Artificial
  CRISPR gRNA sequence
ccatatgtcatgcaatgtga

SEQ ID NO: 719888 - DNA, 20 bp, Artificial
  CRISPR gRNA sequence
acgtgcactcttctgtttat

SEQ ID NO: 719889 - DNA, 20 bp, Artificial
  CRISPR gRNA sequence
ttctgtttatcctgacgaca

SEQ ID NO: 719890 - DNA, 20 bp, Artificial
  CRISPR gRNA sequence
ctgtttatcctgacgacagc

SEQ ID NO: 719891 - DNA, 20 bp, Artificial
  CRISPR gRNA sequence
tgtttatcctgacgacagcc

SEQ ID NO: 719892 - DNA, 20 bp, Artificial
  CRISPR gRNA sequence
tttatcctgacgacagcctg

SEQ ID NO: 719893 - DNA, 20 bp, Artificial
  CRISPR gRNA sequence
atcctgacgacagcctggtg

SEQ ID NO: 719894 - DNA, 20 bp, Artificial
  CRISPR gRNA sequence
tcctgacgacagcctggtga

SEQ ID NO: 719895 - DNA, 20 bp, Artificial
  CRISPR gRNA sequence
acgacagcctggtgaagagt

SEQ ID NO: 719896 - DNA, 20 bp, Artificial
  CRISPR gRNA sequence
gtgaagagtgtatgattata

SEQ ID NO: 719897 - DNA, 20 bp, Artificial
  CRISPR gRNA sequence
tagtcatttgactgggctgg

SEQ ID NO: 719898 - DNA, 20 bp, Artificial
  CRISPR gRNA sequence
gactgggctgggcacggcag

SEQ ID NO: 719899 - DNA, 20 bp, Artificial
  CRISPR gRNA sequence
actgggctgggcacggcagc

SEQ ID NO: 719900 - DNA, 20 bp, Artificial
  CRISPR gRNA sequence
ggctgggcacggcagcttat

SEQ ID NO: 719901 - DNA, 20 bp, Artificial
  CRISPR gRNA sequence
ggcacggcagcttatgcctg

SEQ ID NO: 719902 - DNA, 20 bp, Artificial
  CRISPR gRNA sequence
atgcctgaaatcccagcact

SEQ ID NO: 719903 - DNA, 20 bp, Artificial
  CRISPR gRNA sequence
tgcctgaaatcccagcactt

SEQ ID NO: 719904 - DNA, 20 bp, Artificial
  CRISPR gRNA sequence
aaatcccagcactttgggag

SEQ ID NO: 719905 - DNA, 20 bp, Artificial
  CRISPR gRNA sequence
tgggaggctgaggagggtgg

SEQ ID NO: 719906 - DNA, 20 bp, Artificial
  CRISPR gRNA sequence
gggaggctgaggagggtgga

SEQ ID NO: 719907 - DNA, 20 bp, Artificial
  CRISPR gRNA sequence
ggaggctgaggagggtggat

SEQ ID NO: 719908 - DNA, 20 bp, Artificial
  CRISPR gRNA sequence
aggagggtggatcacctgag

SEQ ID NO: 719909 - DNA, 20 bp, Artificial
  CRISPR gRNA sequence
aggtcaggagttcgagacca

SEQ ID NO: 719910 - DNA, 20 bp, Artificial
  CRISPR gRNA sequence
gagaccagcctggccaacat

SEQ ID NO: 719911 - DNA, 20 bp, Artificial
  CRISPR gRNA sequence
gccaacatggcgaaaccctg

SEQ ID NO: 719912 - DNA, 20 bp, Artificial
  CRISPR gRNA sequence
tctctactaaaaattagccg

SEQ ID NO: 719913 - DNA, 20 bp, Artificial
  CRISPR gRNA sequence
tactaaaaattagccgggcg

SEQ ID NO: 719914 - DNA, 20 bp, Artificial
  CRISPR gRNA sequence
ctaaaaattagccgggcgtg

SEQ ID NO: 719915 - DNA, 20 bp, Artificial
  CRISPR gRNA sequence
aaaattagccgggcgtggtt

SEQ ID NO: 719916 - DNA, 20 bp, Artificial
  CRISPR gRNA sequence
gccgggcgtggttgcaggca

SEQ ID NO: 719917 - DNA, 20 bp, Artificial
  CRISPR gRNA sequence
caggcacctgtaatcccagc

SEQ ID NO: 719918 - DNA, 20 bp, Artificial
  CRISPR gRNA sequence
taatcccagctactcaggag

SEQ ID NO: 719919 - DNA, 20 bp, Artificial
  CRISPR gRNA sequence
ctcaggaggctgaggcagga

SEQ ID NO: 719920 - DNA, 20 bp, Artificial
  CRISPR gRNA sequence
aggaggctgaggcaggagaa

SEQ ID NO: 719921 - DNA, 20 bp, Artificial
  CRISPR gRNA sequence
aggcaggagaattgcttgaa

SEQ ID NO: 719922 - DNA, 20 bp, Artificial
  CRISPR gRNA sequence
cttgaacctgggaggcagag

SEQ ID NO: 719923 - DNA, 20 bp, Artificial
  CRISPR gRNA sequence
gaacctgggaggcagaggtt

SEQ ID NO: 719924 - DNA, 20 bp, Artificial
  CRISPR gRNA sequence
aacctgggaggcagaggttg

SEQ ID NO: 719925 - DNA, 20 bp, Artificial
  CRISPR gRNA sequence
ggaggcagaggttgcagtga

SEQ ID NO: 719926 - DNA, 20 bp, Artificial
  CRISPR gRNA sequence
cagtgagctgagattgcatc

SEQ ID NO: 719927 - DNA, 20 bp, Artificial
  CRISPR gRNA sequence
agattgcatcactgcactcc

SEQ ID NO: 719928 - DNA, 20 bp, Artificial
  CRISPR gRNA sequence
catcactgcactccagcctg

SEQ ID NO: 719929 - DNA, 20 bp, Artificial
  CRISPR gRNA sequence
cactccagcctgggcgacag

SEQ ID NO: 719930 - DNA, 20 bp, Artificial
  CRISPR gRNA sequence
cagcctgggcgacagagtaa

SEQ ID NO: 719931 - DNA, 20 bp, Artificial
  CRISPR gRNA sequence
ggcgacagagtaagactctg

SEQ ID NO: 719932 - DNA, 20 bp, Artificial
  CRISPR gRNA sequence
tgtctcaaataaataaataa

SEQ ID NO: 719933 - DNA, 20 bp, Artificial
  CRISPR gRNA sequence
tctcaaataaataaataaac

SEQ ID NO: 719934 - DNA, 20 bp, Artificial
  CRISPR gRNA sequence
aaataaataaataaacaagt

SEQ ID NO: 719935 - DNA, 20 bp, Artificial
  CRISPR gRNA sequence
tcctggcacagttaggacat

SEQ ID NO: 719936 - DNA, 20 bp, Artificial
  CRISPR gRNA sequence
cctggcacagttaggacata

SEQ ID NO: 719937 - DNA, 20 bp, Artificial
  CRISPR gRNA sequence
ctggcacagttaggacatag

SEQ ID NO: 719938 - DNA, 20 bp, Artificial
  CRISPR gRNA sequence
gcacagttaggacatagcag

SEQ ID NO: 719939 - DNA, 20 bp, Artificial
  CRISPR gRNA sequence
ggacatagcaggcaaactga

SEQ ID NO: 719940 - DNA, 20 bp, Artificial
  CRISPR gRNA sequence
aggggcactggctagacgat

SEQ ID NO: 719941 - DNA, 20 bp, Artificial
  CRISPR gRNA sequence
gctagacgatgtgtgtgttt

SEQ ID NO: 719942 - DNA, 20 bp, Artificial
  CRISPR gRNA sequence
gacgatgtgtgtgttttctt

SEQ ID NO: 719943 - DNA, 20 bp, Artificial
  CRISPR gRNA sequence
tcttctccactctgcttctg

SEQ ID NO: 719944 - DNA, 20 bp, Artificial
  CRISPR gRNA sequence
cttctccactctgcttctgt

SEQ ID NO: 719945 - DNA, 20 bp, Artificial
  CRISPR gRNA sequence
ttctccactctgcttctgtc

SEQ ID NO: 719946 - DNA, 20 bp, Artificial
  CRISPR gRNA sequence
ctccactctgcttctgtcca

SEQ ID NO: 719947 - DNA, 20 bp, Artificial
  CRISPR gRNA sequence
tccactctgcttctgtccag

SEQ ID NO: 719948 - DNA, 20 bp, Artificial
  CRISPR gRNA sequence
cactctgcttctgtccagca

SEQ ID NO: 719949 - DNA, 20 bp, Artificial
  CRISPR gRNA sequence
tgcttctgtccagcattctt

SEQ ID NO: 719950 - DNA, 20 bp, Artificial
  CRISPR gRNA sequence
cttctgtccagcattcttca

SEQ ID NO: 719951 - DNA, 20 bp, Artificial
  CRISPR gRNA sequence
ctgtccagcattcttcagga

SEQ ID NO: 719952 - DNA, 20 bp, Artificial
  CRISPR gRNA sequence
tgtccagcattcttcaggac

SEQ ID NO: 719953 - DNA, 20 bp, Artificial
  CRISPR gRNA sequence
tccagcattcttcaggactc

SEQ ID NO: 719954 - DNA, 20 bp, Artificial
  CRISPR gRNA sequence
ttcaggactccttggattgc

SEQ ID NO: 719955 - DNA, 20 bp, Artificial
  CRISPR gRNA sequence
caggactccttggattgcat

SEQ ID NO: 719956 - DNA, 20 bp, Artificial
  CRISPR gRNA sequence
aggactccttggattgcatg

SEQ ID NO: 719957 - DNA, 20 bp, Artificial
  CRISPR gRNA sequence
cttggattgcatgtagcaaa

SEQ ID NO: 719958 - DNA, 20 bp, Artificial
  CRISPR gRNA sequence
ggattgcatgtagcaaaatc

SEQ ID NO: 719959 - DNA, 20 bp, Artificial
  CRISPR gRNA sequence
gattgcatgtagcaaaatcc

SEQ ID NO: 719960 - DNA, 20 bp, Artificial
  CRISPR gRNA sequence
catgtagcaaaatccccaat

SEQ ID NO: 719961 - DNA, 20 bp, Artificial
  CRISPR gRNA sequence
tttagcacatgtagcttaaa

SEQ ID NO: 719962 - DNA, 20 bp, Artificial
  CRISPR gRNA sequence
ttagcacatgtagcttaaaa

SEQ ID NO: 719963 - DNA, 20 bp, Artificial
  CRISPR gRNA sequence
tagcacatgtagcttaaaag

SEQ ID NO: 719964 - DNA, 20 bp, Artificial
  CRISPR gRNA sequence
agcacatgtagcttaaaagt

SEQ ID NO: 719965 - DNA, 20 bp, Artificial
  CRISPR gRNA sequence
gcacatgtagcttaaaagtc

SEQ ID NO: 719966 - DNA, 20 bp, Artificial
  CRISPR gRNA sequence
aaaagtctggggatagctct

SEQ ID NO: 719967 - DNA, 20 bp, Artificial
  CRISPR gRNA sequence
aaagtctggggatagctctg

SEQ ID NO: 719968 - DNA, 20 bp, Artificial
  CRISPR gRNA sequence
gggatagctctgagaagctt

SEQ ID NO: 719969 - DNA, 20 bp, Artificial
  CRISPR gRNA sequence
tgagaagcttcaggcatggc

SEQ ID NO: 719970 - DNA, 20 bp, Artificial
  CRISPR gRNA sequence
agaagcttcaggcatggctg

SEQ ID NO: 719971 - DNA, 20 bp, Artificial
  CRISPR gRNA sequence
caggcatggctggatccagg

SEQ ID NO: 719972 - DNA, 20 bp, Artificial
  CRISPR gRNA sequence
aggcatggctggatccaggg

SEQ ID NO: 719973 - DNA, 20 bp, Artificial
  CRISPR gRNA sequence
gatccagggctccatcttgc

SEQ ID NO: 719974 - DNA, 20 bp, Artificial
  CRISPR gRNA sequence
catcttgccccatctctcac

SEQ ID NO: 719975 - DNA, 20 bp, Artificial
  CRISPR gRNA sequence
gccccatctctcacctctat

SEQ ID NO: 719976 - DNA, 20 bp, Artificial
  CRISPR gRNA sequence
ccccatctctcacctctatt

SEQ ID NO: 719977 - DNA, 20 bp, Artificial
  CRISPR gRNA sequence
tcacctctatttccctctct

SEQ ID NO: 719978 - DNA, 20 bp, Artificial
  CRISPR gRNA sequence
acctctatttccctctctgt

SEQ ID NO: 719979 - DNA, 20 bp, Artificial
  CRISPR gRNA sequence
tatttccctctctgttggtt

SEQ ID NO: 719980 - DNA, 20 bp, Artificial
  CRISPR gRNA sequence
tttccctctctgttggttca

SEQ ID NO: 719981 - DNA, 20 bp, Artificial
  CRISPR gRNA sequence
ccctctctgttggttcatcg

SEQ ID NO: 719982 - DNA, 20 bp, Artificial
  CRISPR gRNA sequence
cctctctgttggttcatcgg

SEQ ID NO: 719983 - DNA, 20 bp, Artificial
  CRISPR gRNA sequence
tctgttggttcatcggcaag

SEQ ID NO: 719984 - DNA, 20 bp, Artificial
  CRISPR gRNA sequence
tgttggttcatcggcaagat

SEQ ID NO: 719985 - DNA, 20 bp, Artificial
  CRISPR gRNA sequence
ttggttcatcggcaagatac

SEQ ID NO: 719986 - DNA, 20 bp, Artificial
  CRISPR gRNA sequence
gttcatcggcaagatactta

SEQ ID NO: 719987 - DNA, 20 bp, Artificial
  CRISPR gRNA sequence
atcggcaagatacttacaag

SEQ ID NO: 719988 - DNA, 20 bp, Artificial
  CRISPR gRNA sequence
acaagcagctctgcccagcg

SEQ ID NO: 719989 - DNA, 20 bp, Artificial
  CRISPR gRNA sequence
caagcagctctgcccagcgc

SEQ ID NO: 719990 - DNA, 20 bp, Artificial
  CRISPR gRNA sequence
tgcccagcgccagtgggaag

SEQ ID NO: 719991 - DNA, 20 bp, Artificial
  CRISPR gRNA sequence
cccagcgccagtgggaagac

SEQ ID NO: 719992 - DNA, 20 bp, Artificial
  CRISPR gRNA sequence
ccctttcttacatttttaat

SEQ ID NO: 719993 - DNA, 20 bp, Artificial
  CRISPR gRNA sequence
cctttcttacatttttaata

SEQ ID NO: 719994 - DNA, 20 bp, Artificial
  CRISPR gRNA sequence
tcttacatttttaatatcca

SEQ ID NO: 719995 - DNA, 20 bp, Artificial
  CRISPR gRNA sequence
cttacatttttaatatccaa

SEQ ID NO: 719996 - DNA, 20 bp, Artificial
  CRISPR gRNA sequence
ttacatttttaatatccaaa

SEQ ID NO: 719997 - DNA, 20 bp, Artificial
  CRISPR gRNA sequence
acatttttaatatccaaaac

SEQ ID NO: 719998 - DNA, 20 bp, Artificial
  CRISPR gRNA sequence
catttttaatatccaaaacc

SEQ ID NO: 719999 - DNA, 20 bp, Artificial
  CRISPR gRNA sequence
ttaatatccaaaaccaaaac

SEQ ID NO: 720000 - DNA, 20 bp, Artificial
  CRISPR gRNA sequence
taatatccaaaaccaaaacc

SEQ ID NO: 720001 - DNA, 20 bp, Artificial
  CRISPR gRNA sequence
aatatccaaaaccaaaacct

SEQ ID NO: 720002 - DNA, 20 bp, Artificial
  CRISPR gRNA sequence
atatccaaaaccaaaacctt

SEQ ID NO: 720003 - DNA, 20 bp, Artificial
  CRISPR gRNA sequence
taaatcccaaaccagaatct

SEQ ID NO: 720004 - DNA, 20 bp, Artificial
  CRISPR gRNA sequence
aaatcccaaaccagaatctt

SEQ ID NO: 720005 - DNA, 20 bp, Artificial
  CRISPR gRNA sequence
aatcccaaaccagaatcttt

SEQ ID NO: 720006 - DNA, 20 bp, Artificial
  CRISPR gRNA sequence
taaattctacctcacaggct

SEQ ID NO: 720007 - DNA, 20 bp, Artificial
  CRISPR gRNA sequence
aaattctacctcacaggctt

SEQ ID NO: 720008 - DNA, 20 bp, Artificial
  CRISPR gRNA sequence
aattctacctcacaggcttg

SEQ ID NO: 720009 - DNA, 20 bp, Artificial
  CRISPR gRNA sequence
tacctcacaggcttgggtca

SEQ ID NO: 720010 - DNA, 20 bp, Artificial
  CRISPR gRNA sequence
cctcacaggcttgggtcaca

SEQ ID NO: 720011 - DNA, 20 bp, Artificial
  CRISPR gRNA sequence
acaggcttgggtcacatgtc

SEQ ID NO: 720012 - DNA, 20 bp, Artificial
  CRISPR gRNA sequence
gggtcacatgtccgtccctg

SEQ ID NO: 720013 - DNA, 20 bp, Artificial
  CRISPR gRNA sequence
ggtcacatgtccgtccctga

SEQ ID NO: 720014 - DNA, 20 bp, Artificial
  CRISPR gRNA sequence
aactggctcatcgtggccag

SEQ ID NO: 720015 - DNA, 20 bp, Artificial
  CRISPR gRNA sequence
gctcatcgtggccagaggaa

SEQ ID NO: 720016 - DNA, 20 bp, Artificial
  CRISPR gRNA sequence
atcgtggccagaggaatgca

SEQ ID NO: 720017 - DNA, 20 bp, Artificial
  CRISPR gRNA sequence
attggtccagcctggtctca

SEQ ID NO: 720018 - DNA, 20 bp, Artificial
  CRISPR gRNA sequence
gtccagcctggtctcatggc

SEQ ID NO: 720019 - DNA, 20 bp, Artificial
  CRISPR gRNA sequence
gtctcatggccactcgggaa

SEQ ID NO: 720020 - DNA, 20 bp, Artificial
  CRISPR gRNA sequence
atggccactcgggaaagggg

SEQ ID NO: 720021 - DNA, 20 bp, Artificial
  CRISPR gRNA sequence
gggaaagggggttcagtcgg

SEQ ID NO: 720022 - DNA, 20 bp, Artificial
  CRISPR gRNA sequence
agtcggtcccaacccctaac

SEQ ID NO: 720023 - DNA, 20 bp, Artificial
  CRISPR gRNA sequence
accacagatgctgagatcag

SEQ ID NO: 720024 - DNA, 20 bp, Artificial
  CRISPR gRNA sequence
agatcagagggagagtaatt

SEQ ID NO: 720025 - DNA, 20 bp, Artificial
  CRISPR gRNA sequence
cccagggaaagataggctgc

SEQ ID NO: 720026 - DNA, 20 bp, Artificial
  CRISPR gRNA sequence
ctttactctgaaggggaacg

SEQ ID NO: 720027 - DNA, 20 bp, Artificial
  CRISPR gRNA sequence
tactctgaaggggaacgggt

SEQ ID NO: 720028 - DNA, 20 bp, Artificial
  CRISPR gRNA sequence
actctgaaggggaacgggtg

SEQ ID NO: 720029 - DNA, 20 bp, Artificial
  CRISPR gRNA sequence
ctctgaaggggaacgggtgc

SEQ ID NO: 720030 - DNA, 20 bp, Artificial
  CRISPR gRNA sequence
tgaaggggaacgggtgccag

SEQ ID NO: 720031 - DNA, 20 bp, Artificial
  CRISPR gRNA sequence
aaggggaacgggtgccaggc

SEQ ID NO: 720032 - DNA, 20 bp, Artificial
  CRISPR gRNA sequence
cagatgactgctgtgttttc

SEQ ID NO: 720033 - DNA, 20 bp, Artificial
  CRISPR gRNA sequence
ctgtgttttccaagggcccc

SEQ ID NO: 720034 - DNA, 20 bp, Artificial
  CRISPR gRNA sequence
tgttttccaagggccccatc

SEQ ID NO: 720035 - DNA, 20 bp, Artificial
  CRISPR gRNA sequence
tccaagggccccatctccga

SEQ ID NO: 720036 - DNA, 20 bp, Artificial
  CRISPR gRNA sequence
ccaagggccccatctccgac

SEQ ID NO: 720037 - DNA, 20 bp, Artificial
  CRISPR gRNA sequence
caagggccccatctccgact

SEQ ID NO: 720038 - DNA, 20 bp, Artificial
  CRISPR gRNA sequence
cgactctggcctgtggtagt

SEQ ID NO: 720039 - DNA, 20 bp, Artificial
  CRISPR gRNA sequence
tggcctgtggtagtgaaggg

SEQ ID NO: 720040 - DNA, 20 bp, Artificial
  CRISPR gRNA sequence
gcctgtggtagtgaagggtg

SEQ ID NO: 720041 - DNA, 20 bp, Artificial
  CRISPR gRNA sequence
tggtagtgaagggtgtattc

SEQ ID NO: 720042 - DNA, 20 bp, Artificial
  CRISPR gRNA sequence
cgggagactttgggtcccca

SEQ ID NO: 720043 - DNA, 20 bp, Artificial
  CRISPR gRNA sequence
tgggtccccaacactgattc

SEQ ID NO: 720044 - DNA, 20 bp, Artificial
  CRISPR gRNA sequence
gggtccccaacactgattct

SEQ ID NO: 720045 - DNA, 20 bp, Artificial
  CRISPR gRNA sequence
ggtccccaacactgattctg

SEQ ID NO: 720046 - DNA, 20 bp, Artificial
  CRISPR gRNA sequence
attctgaaggcactgctgtc

SEQ ID NO: 720047 - DNA, 20 bp, Artificial
  CRISPR gRNA sequence
tgaaggcactgctgtccccc

SEQ ID NO: 720048 - DNA, 20 bp, Artificial
  CRISPR gRNA sequence
aaggcactgctgtcccccct

SEQ ID NO: 720049 - DNA, 20 bp, Artificial
  CRISPR gRNA sequence
ctgtcccccctgcaggcacg

SEQ ID NO: 720050 - DNA, 20 bp, Artificial
  CRISPR gRNA sequence
tcccccctgcaggcacggcg

SEQ ID NO: 720051 - DNA, 20 bp, Artificial
  CRISPR gRNA sequence
caggcacggcgcagaagaac

SEQ ID NO: 720052 - DNA, 20 bp, Artificial
  CRISPR gRNA sequence
tgagccggcttccccagggg

SEQ ID NO: 720053 - DNA, 20 bp, Artificial
  CRISPR gRNA sequence
ccccaggggtcagccctgcc

SEQ ID NO: 720054 - DNA, 20 bp, Artificial
  CRISPR gRNA sequence
cccaggggtcagccctgcct

SEQ ID NO: 720055 - DNA, 20 bp, Artificial
  CRISPR gRNA sequence
cctgtgccagcccagagaac

SEQ ID NO: 720056 - DNA, 20 bp, Artificial
  CRISPR gRNA sequence
tgccagcccagagaactgca

SEQ ID NO: 720057 - DNA, 20 bp, Artificial
  CRISPR gRNA sequence
caaggaaccctccaggtgac

SEQ ID NO: 720058 - DNA, 20 bp, Artificial
  CRISPR gRNA sequence
caggtgactccctggctttg

SEQ ID NO: 720059 - DNA, 20 bp, Artificial
  CRISPR gRNA sequence
cctggctttgcctcctcctc

SEQ ID NO: 720060 - DNA, 20 bp, Artificial
  CRISPR gRNA sequence
gctttgcctcctcctcttcc

SEQ ID NO: 720061 - DNA, 20 bp, Artificial
  CRISPR gRNA sequence
tgcctcctcctcttccccca

SEQ ID NO: 720062 - DNA, 20 bp, Artificial
  CRISPR gRNA sequence
gcctcctcctcttcccccaa

SEQ ID NO: 720063 - DNA, 20 bp, Artificial
  CRISPR gRNA sequence
cctcctcctcttcccccaag

SEQ ID NO: 720064 - DNA, 20 bp, Artificial
  CRISPR gRNA sequence
ctcctcttcccccaagctgg

SEQ ID NO: 720065 - DNA, 20 bp, Artificial
  CRISPR gRNA sequence
ctcttcccccaagctggctt

SEQ ID NO: 720066 - DNA, 20 bp, Artificial
  CRISPR gRNA sequence
ttcccccaagctggctttca

SEQ ID NO: 720067 - DNA, 20 bp, Artificial
  CRISPR gRNA sequence
cccccaagctggctttcaga

SEQ ID NO: 720068 - DNA, 20 bp, Artificial
  CRISPR gRNA sequence
ccccaagctggctttcagat

SEQ ID NO: 720069 - DNA, 20 bp, Artificial
  CRISPR gRNA sequence
gctttcagatgaggctgccc

SEQ ID NO: 720070 - DNA, 20 bp, Artificial
  CRISPR gRNA sequence
tcagatgaggctgccccacc

SEQ ID NO: 720071 - DNA, 20 bp, Artificial
  CRISPR gRNA sequence
cagatgaggctgccccaccc

SEQ ID NO: 720072 - DNA, 20 bp, Artificial
  CRISPR gRNA sequence
agatgaggctgccccacccc

SEQ ID NO: 720073 - DNA, 20 bp, Artificial
  CRISPR gRNA sequence
ccccaccccacaggacgccc

SEQ ID NO: 720074 - DNA, 20 bp, Artificial
  CRISPR gRNA sequence
ggctgggggtgtaagcggga

SEQ ID NO: 720075 - DNA, 20 bp, Artificial
  CRISPR gRNA sequence
ggggtgtaagcgggattcag

SEQ ID NO: 720076 - DNA, 20 bp, Artificial
  CRISPR gRNA sequence
agcccatggtgtcagcactt

SEQ ID NO: 720077 - DNA, 20 bp, Artificial
  CRISPR gRNA sequence
tggggtgcctctctgccaag

SEQ ID NO: 720078 - DNA, 20 bp, Artificial
  CRISPR gRNA sequence
ggggtgcctctctgccaagc

SEQ ID NO: 720079 - DNA, 20 bp, Artificial
  CRISPR gRNA sequence
gggtgcctctctgccaagcc

SEQ ID NO: 720080 - DNA, 20 bp, Artificial
  CRISPR gRNA sequence
tctgccaagcccctcagatc

SEQ ID NO: 720081 - DNA, 20 bp, Artificial
  CRISPR gRNA sequence
tgccaagcccctcagatcat

SEQ ID NO: 720082 - DNA, 20 bp, Artificial
  CRISPR gRNA sequence
ccaagcccctcagatcattt

SEQ ID NO: 720083 - DNA, 20 bp, Artificial
  CRISPR gRNA sequence
agatcatttgaggccctagg

SEQ ID NO: 720084 - DNA, 20 bp, Artificial
  CRISPR gRNA sequence
gaggccctagggtgtgccca

SEQ ID NO: 720085 - DNA, 20 bp, Artificial
  CRISPR gRNA sequence
aggccctagggtgtgcccag

SEQ ID NO: 720086 - DNA, 20 bp, Artificial
  CRISPR gRNA sequence
gggtgtgcccagccctgccc

SEQ ID NO: 720087 - DNA, 20 bp, Artificial
  CRISPR gRNA sequence
ccctgagcacatgggagacc

SEQ ID NO: 720088 - DNA, 20 bp, Artificial
  CRISPR gRNA sequence
agcacatgggagacccacag

SEQ ID NO: 720089 - DNA, 20 bp, Artificial
  CRISPR gRNA sequence
agaaaacacaggccttgctc

SEQ ID NO: 720090 - DNA, 20 bp, Artificial
  CRISPR gRNA sequence
gaaaacacaggccttgctcc

SEQ ID NO: 720091 - DNA, 20 bp, Artificial
  CRISPR gRNA sequence
gctcccaggagcttacagtg

SEQ ID NO: 720092 - DNA, 20 bp, Artificial
  CRISPR gRNA sequence
ctcccaggagcttacagtgg

SEQ ID NO: 720093 - DNA, 20 bp, Artificial
  CRISPR gRNA sequence
ccaggagcttacagtgggcc

SEQ ID NO: 720094 - DNA, 20 bp, Artificial
  CRISPR gRNA sequence
acagtgggcccgccagaggc

SEQ ID NO: 720095 - DNA, 20 bp, Artificial
  CRISPR gRNA sequence
cagtgggcccgccagaggca

SEQ ID NO: 720096 - DNA, 20 bp, Artificial
  CRISPR gRNA sequence
ggaccccatctctgtggaaa

SEQ ID NO: 720097 - DNA, 20 bp, Artificial
  CRISPR gRNA sequence
tgtggaaactgttactcgtg

SEQ ID NO: 720098 - DNA, 20 bp, Artificial
  CRISPR gRNA sequence
tggaaactgttactcgtgag

SEQ ID NO: 720099 - DNA, 20 bp, Artificial
  CRISPR gRNA sequence
ttactcgtgagcacaggcct

SEQ ID NO: 720100 - DNA, 20 bp, Artificial
  CRISPR gRNA sequence
ctcgtgagcacaggcctccc

SEQ ID NO: 720101 - DNA, 20 bp, Artificial
  CRISPR gRNA sequence
gtgagcacaggcctcccttg

SEQ ID NO: 720102 - DNA, 20 bp, Artificial
  CRISPR gRNA sequence
ccttgccccattggcagaat

SEQ ID NO: 720103 - DNA, 20 bp, Artificial
  CRISPR gRNA sequence
gccccattggcagaattatc

SEQ ID NO: 720104 - DNA, 20 bp, Artificial
  CRISPR gRNA sequence
ccccattggcagaattatca

SEQ ID NO: 720105 - DNA, 20 bp, Artificial
  CRISPR gRNA sequence
gcagaattatcagtcccatc

SEQ ID NO: 720106 - DNA, 20 bp, Artificial
  CRISPR gRNA sequence
tcagtcccatctctggcttc

SEQ ID NO: 720107 - DNA, 20 bp, Artificial
  CRISPR gRNA sequence
tggcttcttccccagtggca

SEQ ID NO: 720108 - DNA, 20 bp, Artificial
  CRISPR gRNA sequence
gcttcttccccagtggcacc

SEQ ID NO: 720109 - DNA, 20 bp, Artificial
  CRISPR gRNA sequence
cttccccagtggcaccatcc

SEQ ID NO: 720110 - DNA, 20 bp, Artificial
  CRISPR gRNA sequence
ttccccagtggcaccatccc

SEQ ID NO: 720111 - DNA, 20 bp, Artificial
  CRISPR gRNA sequence
ccccagtggcaccatccccc

SEQ ID NO: 720112 - DNA, 20 bp, Artificial
  CRISPR gRNA sequence
cccagtggcaccatccccca

SEQ ID NO: 720113 - DNA, 20 bp, Artificial
  CRISPR gRNA sequence
cagtgccagcaccatgcctg

SEQ ID NO: 720114 - DNA, 20 bp, Artificial
  CRISPR gRNA sequence
taagagggggcacccgcctc

SEQ ID NO: 720115 - DNA, 20 bp, Artificial
  CRISPR gRNA sequence
gcccaggaagctgcttctaa

SEQ ID NO: 720116 - DNA, 20 bp, Artificial
  CRISPR gRNA sequence
cttctaaactgacgagggct

SEQ ID NO: 720117 - DNA, 20 bp, Artificial
  CRISPR gRNA sequence
ctaaactgacgagggctccc

SEQ ID NO: 720118 - DNA, 20 bp, Artificial
  CRISPR gRNA sequence
taaactgacgagggctcccg

SEQ ID NO: 720119 - DNA, 20 bp, Artificial
  CRISPR gRNA sequence
aactgacgagggctcccgac

SEQ ID NO: 720120 - DNA, 20 bp, Artificial
  CRISPR gRNA sequence
acgagggctcccgactctcc

SEQ ID NO: 720121 - DNA, 20 bp, Artificial
  CRISPR gRNA sequence
ccgactctccctcctctgtg

SEQ ID NO: 720122 - DNA, 20 bp, Artificial
  CRISPR gRNA sequence
tccctcctctgtgggaaggc

SEQ ID NO: 720123 - DNA, 20 bp, Artificial
  CRISPR gRNA sequence
cctcctctgtgggaaggcct

SEQ ID NO: 720124 - DNA, 20 bp, Artificial
  CRISPR gRNA sequence
ctctgtgggaaggcctagtt

SEQ ID NO: 720125 - DNA, 20 bp, Artificial
  CRISPR gRNA sequence
tgtgggaaggcctagttcag

SEQ ID NO: 720126 - DNA, 20 bp, Artificial
  CRISPR gRNA sequence
tgggaaggcctagttcagat

SEQ ID NO: 720127 - DNA, 20 bp, Artificial
  CRISPR gRNA sequence
gttcagatccaggtaatttc

SEQ ID NO: 720128 - DNA, 20 bp, Artificial
  CRISPR gRNA sequence
agatccaggtaatttcccca

SEQ ID NO: 720129 - DNA, 20 bp, Artificial
  CRISPR gRNA sequence
ccccatgaagctgtgggtcg

SEQ ID NO: 720130 - DNA, 20 bp, Artificial
  CRISPR gRNA sequence
cccatgaagctgtgggtcgt

SEQ ID NO: 720131 - DNA, 20 bp, Artificial
  CRISPR gRNA sequence
tgggtcgtctccctggggtg

SEQ ID NO: 720132 - DNA, 20 bp, Artificial
  CRISPR gRNA sequence
cctggggtgctcgattggtg

SEQ ID NO: 720133 - DNA, 20 bp, Artificial
  CRISPR gRNA sequence
gggtgctcgattggtggatg

SEQ ID NO: 720134 - DNA, 20 bp, Artificial
  CRISPR gRNA sequence
gattggtggatggcccatga

SEQ ID NO: 720135 - DNA, 20 bp, Artificial
  CRISPR gRNA sequence
gtggatggcccatgagtggg

SEQ ID NO: 720136 - DNA, 20 bp, Artificial
  CRISPR gRNA sequence
ggagcaggcgggcagtgatc

SEQ ID NO: 720137 - DNA, 20 bp, Artificial
  CRISPR gRNA sequence
gagcaggcgggcagtgatct

SEQ ID NO: 720138 - DNA, 20 bp, Artificial
  CRISPR gRNA sequence
tggtcttttcctggtgggga

SEQ ID NO: 720139 - DNA, 20 bp, Artificial
  CRISPR gRNA sequence
ttcctggtggggagagaaga

SEQ ID NO: 720140 - DNA, 20 bp, Artificial
  CRISPR gRNA sequence
tcctggtggggagagaagac

SEQ ID NO: 720141 - DNA, 20 bp, Artificial
  CRISPR gRNA sequence
cctggtggggagagaagacg

SEQ ID NO: 720142 - DNA, 20 bp, Artificial
  CRISPR gRNA sequence
ctggtggggagagaagacgg

SEQ ID NO: 720143 - DNA, 20 bp, Artificial
  CRISPR gRNA sequence
gtggggagagaagacggtgg

SEQ ID NO: 720144 - DNA, 20 bp, Artificial
  CRISPR gRNA sequence
gggctgaaagcattgagggg

SEQ ID NO: 720145 - DNA, 20 bp, Artificial
  CRISPR gRNA sequence
aaagcattgaggggcagagg

SEQ ID NO: 720146 - DNA, 20 bp, Artificial
  CRISPR gRNA sequence
aggggcagaggtagacacca

SEQ ID NO: 720147 - DNA, 20 bp, Artificial
  CRISPR gRNA sequence
attcatttgccagcagtgca

SEQ ID NO: 720148 - DNA, 20 bp, Artificial
  CRISPR gRNA sequence
atttgccagcagtgcagagg

SEQ ID NO: 720149 - DNA, 20 bp, Artificial
  CRISPR gRNA sequence
gccagcagtgcagagggcct

SEQ ID NO: 720150 - DNA, 20 bp, Artificial
  CRISPR gRNA sequence
ccagcagtgcagagggcctg

SEQ ID NO: 720151 - DNA, 20 bp, Artificial
  CRISPR gRNA sequence
ccttgtgccggacacccgtg

SEQ ID NO: 720152 - DNA, 20 bp, Artificial
  CRISPR gRNA sequence
gtgccggacacccgtgcccc

SEQ ID NO: 720153 - DNA, 20 bp, Artificial
  CRISPR gRNA sequence
tgccggacacccgtgcccca

SEQ ID NO: 720154 - DNA, 20 bp, Artificial
  CRISPR gRNA sequence
tccctctatttccctctacg

SEQ ID NO: 720155 - DNA, 20 bp, Artificial
  CRISPR gRNA sequence
cctctatttccctctacgtt

SEQ ID NO: 720156 - DNA, 20 bp, Artificial
  CRISPR gRNA sequence
tatttccctctacgttggtt

SEQ ID NO: 720157 - DNA, 20 bp, Artificial
  CRISPR gRNA sequence
tttccctctacgttggtttg

SEQ ID NO: 720158 - DNA, 20 bp, Artificial
  CRISPR gRNA sequence
ccctctacgttggtttgtca

SEQ ID NO: 720159 - DNA, 20 bp, Artificial
  CRISPR gRNA sequence
cctctacgttggtttgtcag

SEQ ID NO: 720160 - DNA, 20 bp, Artificial
  CRISPR gRNA sequence
tacgttggtttgtcagaggg

SEQ ID NO: 720161 - DNA, 20 bp, Artificial
  CRISPR gRNA sequence
cgttggtttgtcagagggaa

SEQ ID NO: 720162 - DNA, 20 bp, Artificial
  CRISPR gRNA sequence
gtttgtcagagggaaatggg

SEQ ID NO: 720163 - DNA, 20 bp, Artificial
  CRISPR gRNA sequence
gtcagagggaaatgggtccc

SEQ ID NO: 720164 - DNA, 20 bp, Artificial
  CRISPR gRNA sequence
tcagagggaaatgggtccca

SEQ ID NO: 720165 - DNA, 20 bp, Artificial
  CRISPR gRNA sequence
tgctgttgtgacacttgcga

SEQ ID NO: 720166 - DNA, 20 bp, Artificial
  CRISPR gRNA sequence
ctgttgtgacacttgcgact

SEQ ID NO: 720167 - DNA, 20 bp, Artificial
  CRISPR gRNA sequence
ttgtgacacttgcgactcag

SEQ ID NO: 720168 - DNA, 20 bp, Artificial
  CRISPR gRNA sequence
tgacacttgcgactcagctg

SEQ ID NO: 720169 - DNA, 20 bp, Artificial
  CRISPR gRNA sequence
gcgactcagctggccagcct

SEQ ID NO: 720170 - DNA, 20 bp, Artificial
  CRISPR gRNA sequence
cgactcagctggccagcctc

SEQ ID NO: 720171 - DNA, 20 bp, Artificial
  CRISPR gRNA sequence
agctggccagcctctgcacg

SEQ ID NO: 720172 - DNA, 20 bp, Artificial
  CRISPR gRNA sequence
gccagcctctgcacgtgtcc

SEQ ID NO: 720173 - DNA, 20 bp, Artificial
  CRISPR gRNA sequence
tgcacgtgtccatctgatgc

SEQ ID NO: 720174 - DNA, 20 bp, Artificial
  CRISPR gRNA sequence
cacgtgtccatctgatgccc

SEQ ID NO: 720175 - DNA, 20 bp, Artificial
  CRISPR gRNA sequence
atgccctcctggtctccatg

SEQ ID NO: 720176 - DNA, 20 bp, Artificial
  CRISPR gRNA sequence
ctggtctccatggcgaaggg

SEQ ID NO: 720177 - DNA, 20 bp, Artificial
  CRISPR gRNA sequence
gtctccatggcgaagggtcg

SEQ ID NO: 720178 - DNA, 20 bp, Artificial
  CRISPR gRNA sequence
catggcgaagggtcgaccct

SEQ ID NO: 720179 - DNA, 20 bp, Artificial
  CRISPR gRNA sequence
agtcatttttctttttcttt

SEQ ID NO: 720180 - DNA, 20 bp, Artificial
  CRISPR gRNA sequence
ttctttttcttttttttgag

SEQ ID NO: 720181 - DNA, 20 bp, Artificial
  CRISPR gRNA sequence
tctttttcttttttttgaga

SEQ ID NO: 720182 - DNA, 20 bp, Artificial
  CRISPR gRNA sequence
ctttttcttttttttgagac

SEQ ID NO: 720183 - DNA, 20 bp, Artificial
  CRISPR gRNA sequence
tttttcttttttttgagacg

SEQ ID NO: 720184 - DNA, 20 bp, Artificial
  CRISPR gRNA sequence
tttcttttttttgagacgga

SEQ ID NO: 720185 - DNA, 20 bp, Artificial
  CRISPR gRNA sequence
ttcttttttttgagacggag

SEQ ID NO: 720186 - DNA, 20 bp, Artificial
  CRISPR gRNA sequence
tcttttttttgagacggagt

SEQ ID NO: 720187 - DNA, 20 bp, Artificial
  CRISPR gRNA sequence
cttttttttgagacggagtt

SEQ ID NO: 720188 - DNA, 20 bp, Artificial
  CRISPR gRNA sequence
ttttttttgagacggagttt

SEQ ID NO: 720189 - DNA, 20 bp, Artificial
  CRISPR gRNA sequence
ttttttgagacggagtttcg

SEQ ID NO: 720190 - DNA, 20 bp, Artificial
  CRISPR gRNA sequence
tttttgagacggagtttcgc

SEQ ID NO: 720191 - DNA, 20 bp, Artificial
  CRISPR gRNA sequence
ttttgagacggagtttcgct

SEQ ID NO: 720192 - DNA, 20 bp, Artificial
  CRISPR gRNA sequence
tttgagacggagtttcgctc

SEQ ID NO: 720193 - DNA, 20 bp, Artificial
  CRISPR gRNA sequence
ttgagacggagtttcgctca

SEQ ID NO: 720194 - DNA, 20 bp, Artificial
  CRISPR gRNA sequence
tgagacggagtttcgctcat

SEQ ID NO: 720195 - DNA, 20 bp, Artificial
  CRISPR gRNA sequence
gagacggagtttcgctcatg

SEQ ID NO: 720196 - DNA, 20 bp, Artificial
  CRISPR gRNA sequence
agacggagtttcgctcatgt

SEQ ID NO: 720197 - DNA, 20 bp, Artificial
  CRISPR gRNA sequence
cgctcatgttgcccaggctg

SEQ ID NO: 720198 - DNA, 20 bp, Artificial
  CRISPR gRNA sequence
gctcatgttgcccaggctgg

SEQ ID NO: 720199 - DNA, 20 bp, Artificial
  CRISPR gRNA sequence
atgttgcccaggctggagtg

SEQ ID NO: 720200 - DNA, 20 bp, Artificial
  CRISPR gRNA sequence
cccaggctggagtgcagtgg

SEQ ID NO: 720201 - DNA, 20 bp, Artificial
  CRISPR gRNA sequence
gagtgcagtggcgcaatctc

SEQ ID NO: 720202 - DNA, 20 bp, Artificial
  CRISPR gRNA sequence
ggctcactgccacctccacc

SEQ ID NO: 720203 - DNA, 20 bp, Artificial
  CRISPR gRNA sequence
actgccacctccacctcctg

SEQ ID NO: 720204 - DNA, 20 bp, Artificial
  CRISPR gRNA sequence
ccacctccacctcctgggtt

SEQ ID NO: 720205 - DNA, 20 bp, Artificial
  CRISPR gRNA sequence
cacctcctgggttcaagcga

SEQ ID NO: 720206 - DNA, 20 bp, Artificial
  CRISPR gRNA sequence
ctgggttcaagcgattctcc

SEQ ID NO: 720207 - DNA, 20 bp, Artificial
  CRISPR gRNA sequence
ggttcaagcgattctcctgc

SEQ ID NO: 720208 - DNA, 20 bp, Artificial
  CRISPR gRNA sequence
aagcgattctcctgcctcag

SEQ ID NO: 720209 - DNA, 20 bp, Artificial
  CRISPR gRNA sequence
tcctgcctcagcctcctgag

SEQ ID NO: 720210 - DNA, 20 bp, Artificial
  CRISPR gRNA sequence
ctgcctcagcctcctgagta

SEQ ID NO: 720211 - DNA, 20 bp, Artificial
  CRISPR gRNA sequence
cctcagcctcctgagtagct

SEQ ID NO: 720212 - DNA, 20 bp, Artificial
  CRISPR gRNA sequence
agcctcctgagtagctggga

SEQ ID NO: 720213 - DNA, 20 bp, Artificial
  CRISPR gRNA sequence
ctgagtagctgggattacag

SEQ ID NO: 720214 - DNA, 20 bp, Artificial
  CRISPR gRNA sequence
agtagctgggattacaggtg

SEQ ID NO: 720215 - DNA, 20 bp, Artificial
  CRISPR gRNA sequence
ggattacaggtgcccaccac

SEQ ID NO: 720216 - DNA, 20 bp, Artificial
  CRISPR gRNA sequence
caggtgcccaccaccacgcc

SEQ ID NO: 720217 - DNA, 20 bp, Artificial
  CRISPR gRNA sequence
gctaactttgtatttttagt

SEQ ID NO: 720218 - DNA, 20 bp, Artificial
  CRISPR gRNA sequence
actttgtatttttagtagag

SEQ ID NO: 720219 - DNA, 20 bp, Artificial
  CRISPR gRNA sequence
tgtatttttagtagagatgg

SEQ ID NO: 720220 - DNA, 20 bp, Artificial
  CRISPR gRNA sequence
gtatttttagtagagatggg

SEQ ID NO: 720221 - DNA, 20 bp, Artificial
  CRISPR gRNA sequence
tatttttagtagagatggga

SEQ ID NO: 720222 - DNA, 20 bp, Artificial
  CRISPR gRNA sequence
ttagtagagatgggatttca

SEQ ID NO: 720223 - DNA, 20 bp, Artificial
  CRISPR gRNA sequence
tagtagagatgggatttcac

SEQ ID NO: 720224 - DNA, 20 bp, Artificial
  CRISPR gRNA sequence
agtagagatgggatttcacc

SEQ ID NO: 720225 - DNA, 20 bp, Artificial
  CRISPR gRNA sequence
gtagagatgggatttcacca

SEQ ID NO: 720226 - DNA, 20 bp, Artificial
  CRISPR gRNA sequence
caccatgttggtcaggctgg

SEQ ID NO: 720227 - DNA, 20 bp, Artificial
  CRISPR gRNA sequence
accatgttggtcaggctggt

SEQ ID NO: 720228 - DNA, 20 bp, Artificial
  CRISPR gRNA sequence
gtcaggctggtctcgaactc

SEQ ID NO: 720229 - DNA, 20 bp, Artificial
  CRISPR gRNA sequence
gtctcgaactcccgacctca

SEQ ID NO: 720230 - DNA, 20 bp, Artificial
  CRISPR gRNA sequence
gaactcccgacctcaggtga

SEQ ID NO: 720231 - DNA, 20 bp, Artificial
  CRISPR gRNA sequence
ccgacctcaggtgatccgcc

SEQ ID NO: 720232 - DNA, 20 bp, Artificial
  CRISPR gRNA sequence
aggtgatccgcccacctcgg

SEQ ID NO: 720233 - DNA, 20 bp, Artificial
  CRISPR gRNA sequence
ggcctcccaaagtgctggga

SEQ ID NO: 720234 - DNA, 20 bp, Artificial
  CRISPR gRNA sequence
ccaaagtgctgggaggatta

SEQ ID NO: 720235 - DNA, 20 bp, Artificial
  CRISPR gRNA sequence
ggaggattacaggcgtgagc

SEQ ID NO: 720236 - DNA, 20 bp, Artificial
  CRISPR gRNA sequence
caggcgtgagccaccgcgcc

SEQ ID NO: 720237 - DNA, 20 bp, Artificial
  CRISPR gRNA sequence
gtcccattttattactgaat

SEQ ID NO: 720238 - DNA, 20 bp, Artificial
  CRISPR gRNA sequence
tattactgaatagccctcca

SEQ ID NO: 720239 - DNA, 20 bp, Artificial
  CRISPR gRNA sequence
attactgaatagccctccat

SEQ ID NO: 720240 - DNA, 20 bp, Artificial
  CRISPR gRNA sequence
ttactgaatagccctccatg

SEQ ID NO: 720241 - DNA, 20 bp, Artificial
  CRISPR gRNA sequence
ctgaatagccctccatggcg

SEQ ID NO: 720242 - DNA, 20 bp, Artificial
  CRISPR gRNA sequence
aatagccctccatggcgtag

SEQ ID NO: 720243 - DNA, 20 bp, Artificial
  CRISPR gRNA sequence
catggcgtagatatgccgag

SEQ ID NO: 720244 - DNA, 20 bp, Artificial
  CRISPR gRNA sequence
tgtttatccagtttttgaat

SEQ ID NO: 720245 - DNA, 20 bp, Artificial
  CRISPR gRNA sequence
tttatccagtttttgaatat

SEQ ID NO: 720246 - DNA, 20 bp, Artificial
  CRISPR gRNA sequence
atccagtttttgaatatttg

SEQ ID NO: 720247 - DNA, 20 bp, Artificial
  CRISPR gRNA sequence
tccagtttttgaatatttgg

SEQ ID NO: 720248 - DNA, 20 bp, Artificial
  CRISPR gRNA sequence
ttgaatatttgggttgtttc

SEQ ID NO: 720249 - DNA, 20 bp, Artificial
  CRISPR gRNA sequence
tgaatatttgggttgtttct

SEQ ID NO: 720250 - DNA, 20 bp, Artificial
  CRISPR gRNA sequence
gaatatttgggttgtttctg

SEQ ID NO: 720251 - DNA, 20 bp, Artificial
  CRISPR gRNA sequence
aatatttgggttgtttctgc

SEQ ID NO: 720252 - DNA, 20 bp, Artificial
  CRISPR gRNA sequence
gggttgtttctgccttttga

SEQ ID NO: 720253 - DNA, 20 bp, Artificial
  CRISPR gRNA sequence
ggttgtttctgccttttgac

SEQ ID NO: 720254 - DNA, 20 bp, Artificial
  CRISPR gRNA sequence
tttctgccttttgactataa

SEQ ID NO: 720255 - DNA, 20 bp, Artificial
  CRISPR gRNA sequence
ctgccttttgactataatga

SEQ ID NO: 720256 - DNA, 20 bp, Artificial
  CRISPR gRNA sequence
tgccttttgactataatgaa

SEQ ID NO: 720257 - DNA, 20 bp, Artificial
  CRISPR gRNA sequence
ccttttgactataatgaaga

SEQ ID NO: 720258 - DNA, 20 bp, Artificial
  CRISPR gRNA sequence
ttgactataatgaagaaaga

SEQ ID NO: 720259 - DNA, 20 bp, Artificial
  CRISPR gRNA sequence
tgactataatgaagaaagaa

SEQ ID NO: 720260 - DNA, 20 bp, Artificial
  CRISPR gRNA sequence
gactataatgaagaaagaaa

SEQ ID NO: 720261 - DNA, 20 bp, Artificial
  CRISPR gRNA sequence
actataatgaagaaagaaaa

SEQ ID NO: 720262 - DNA, 20 bp, Artificial
  CRISPR gRNA sequence
taatgaagaaagaaaaatac

SEQ ID NO: 720263 - DNA, 20 bp, Artificial
  CRISPR gRNA sequence
tgcgtgtatgtgctttcctt

SEQ ID NO: 720264 - DNA, 20 bp, Artificial
  CRISPR gRNA sequence
gcgtgtatgtgctttccttt

SEQ ID NO: 720265 - DNA, 20 bp, Artificial
  CRISPR gRNA sequence
cgtgtatgtgctttcctttc

SEQ ID NO: 720266 - DNA, 20 bp, Artificial
  CRISPR gRNA sequence
tcctttctcttgggttggtt

SEQ ID NO: 720267 - DNA, 20 bp, Artificial
  CRISPR gRNA sequence
cctttctcttgggttggttt

SEQ ID NO: 720268 - DNA, 20 bp, Artificial
  CRISPR gRNA sequence
ctttctcttgggttggtttt

SEQ ID NO: 720269 - DNA, 20 bp, Artificial
  CRISPR gRNA sequence
tctcttgggttggttttgta

SEQ ID NO: 720270 - DNA, 20 bp, Artificial
  CRISPR gRNA sequence
ctcttgggttggttttgtaa

SEQ ID NO: 720271 - DNA, 20 bp, Artificial
  CRISPR gRNA sequence
tcttgggttggttttgtaaa

SEQ ID NO: 720272 - DNA, 20 bp, Artificial
  CRISPR gRNA sequence
ttgggttggttttgtaaaaa

SEQ ID NO: 720273 - DNA, 20 bp, Artificial
  CRISPR gRNA sequence
gggttggttttgtaaaaaaa

SEQ ID NO: 720274 - DNA, 20 bp, Artificial
  CRISPR gRNA sequence
ggttggttttgtaaaaaaaa

SEQ ID NO: 720275 - DNA, 20 bp, Artificial
  CRISPR gRNA sequence
gttttgtaaaaaaaatggat

SEQ ID NO: 720276 - DNA, 20 bp, Artificial
  CRISPR gRNA sequence
tgtaaaaaaaatggatttgt

SEQ ID NO: 720277 - DNA, 20 bp, Artificial
  CRISPR gRNA sequence
gtaaaaaaaatggatttgtg

SEQ ID NO: 720278 - DNA, 20 bp, Artificial
  CRISPR gRNA sequence
taaaaaaaatggatttgtgg

SEQ ID NO: 720279 - DNA, 20 bp, Artificial
  CRISPR gRNA sequence
gtgggacttctaacaatttt

SEQ ID NO: 720280 - DNA, 20 bp, Artificial
  CRISPR gRNA sequence
tgggacttctaacaattttg

SEQ ID NO: 720281 - DNA, 20 bp, Artificial
  CRISPR gRNA sequence
ctaacaattttgggttggag

SEQ ID NO: 720282 - DNA, 20 bp, Artificial
  CRISPR gRNA sequence
taacaattttgggttggagc

SEQ ID NO: 720283 - DNA, 20 bp, Artificial
  CRISPR gRNA sequence
acaattttgggttggagctc

SEQ ID NO: 720284 - DNA, 20 bp, Artificial
  CRISPR gRNA sequence
tgggttggagctcttttcct

SEQ ID NO: 720285 - DNA, 20 bp, Artificial
  CRISPR gRNA sequence
gggttggagctcttttccta

SEQ ID NO: 720286 - DNA, 20 bp, Artificial
  CRISPR gRNA sequence
ggttggagctcttttcctat

SEQ ID NO: 720287 - DNA, 20 bp, Artificial
  CRISPR gRNA sequence
gagctcttttcctatagttg

SEQ ID NO: 720288 - DNA, 20 bp, Artificial
  CRISPR gRNA sequence
ttttcctatagttgtacctt

SEQ ID NO: 720289 - DNA, 20 bp, Artificial
  CRISPR gRNA sequence
ttcctatagttgtaccttct

SEQ ID NO: 720290 - DNA, 20 bp, Artificial
  CRISPR gRNA sequence
tcctatagttgtaccttctc

SEQ ID NO: 720291 - DNA, 20 bp, Artificial
  CRISPR gRNA sequence
cctatagttgtaccttctcc

SEQ ID NO: 720292 - DNA, 20 bp, Artificial
  CRISPR gRNA sequence
ctatagttgtaccttctccc

SEQ ID NO: 720293 - DNA, 20 bp, Artificial
  CRISPR gRNA sequence
tagttgtaccttctcccgct

SEQ ID NO: 720294 - DNA, 20 bp, Artificial
  CRISPR gRNA sequence
taccttctcccgctccatgg

SEQ ID NO: 720295 - DNA, 20 bp, Artificial
  CRISPR gRNA sequence
ctcccgctccatggctttgc

SEQ ID NO: 720296 - DNA, 20 bp, Artificial
  CRISPR gRNA sequence
tcccgctccatggctttgct

SEQ ID NO: 720297 - DNA, 20 bp, Artificial
  CRISPR gRNA sequence
ccgctccatggctttgctta

SEQ ID NO: 720298 - DNA, 20 bp, Artificial
  CRISPR gRNA sequence
catggctttgcttattctct

SEQ ID NO: 720299 - DNA, 20 bp, Artificial
  CRISPR gRNA sequence
tgcttattctctctatgatg

SEQ ID NO: 720300 - DNA, 20 bp, Artificial
  CRISPR gRNA sequence
gcttattctctctatgatgt

SEQ ID NO: 720301 - DNA, 20 bp, Artificial
  CRISPR gRNA sequence
cttattctctctatgatgtc

SEQ ID NO: 720302 - DNA, 20 bp, Artificial
  CRISPR gRNA sequence
attctctctatgatgtcttt

SEQ ID NO: 720303 - DNA, 20 bp, Artificial
  CRISPR gRNA sequence
ttctctctatgatgtctttt

SEQ ID NO: 720304 - DNA, 20 bp, Artificial
  CRISPR gRNA sequence
tctctatgatgtcttttgtt

SEQ ID NO: 720305 - DNA, 20 bp, Artificial
  CRISPR gRNA sequence
tctatgatgtcttttgtttg

SEQ ID NO: 720306 - DNA, 20 bp, Artificial
  CRISPR gRNA sequence
tatgatgtcttttgtttgtt

SEQ ID NO: 720307 - DNA, 20 bp, Artificial
  CRISPR gRNA sequence
tgatgtcttttgtttgtttg

SEQ ID NO: 720308 - DNA, 20 bp, Artificial
  CRISPR gRNA sequence
ttgtttgtttgtttgtggtt

SEQ ID NO: 720309 - DNA, 20 bp, Artificial
  CRISPR gRNA sequence
tgtttgtttgtttgtggttt

SEQ ID NO: 720310 - DNA, 20 bp, Artificial
  CRISPR gRNA sequence
gtttgtttgtttgtggtttg

SEQ ID NO: 720311 - DNA, 20 bp, Artificial
  CRISPR gRNA sequence
tttgtttgtttgtggtttgt

SEQ ID NO: 720312 - DNA, 20 bp, Artificial
  CRISPR gRNA sequence
gtttgtttgtggtttgtttt

SEQ ID NO: 720313 - DNA, 20 bp, Artificial
  CRISPR gRNA sequence
tttgtttgtggtttgttttt

SEQ ID NO: 720314 - DNA, 20 bp, Artificial
  CRISPR gRNA sequence
gtttgtggtttgtttttttg

SEQ ID NO: 720315 - DNA, 20 bp, Artificial
  CRISPR gRNA sequence
tttgtggtttgtttttttga

SEQ ID NO: 720316 - DNA, 20 bp, Artificial
  CRISPR gRNA sequence
gtggtttgtttttttgaggt

SEQ ID NO: 720317 - DNA, 20 bp, Artificial
  CRISPR gRNA sequence
tggtttgtttttttgaggtg

SEQ ID NO: 720318 - DNA, 20 bp, Artificial
  CRISPR gRNA sequence
gtttttttgaggtgagtctt

SEQ ID NO: 720319 - DNA, 20 bp, Artificial
  CRISPR gRNA sequence
tttttttgaggtgagtcttg

SEQ ID NO: 720320 - DNA, 20 bp, Artificial
  CRISPR gRNA sequence
ttttgaggtgagtcttgctc

SEQ ID NO: 720321 - DNA, 20 bp, Artificial
  CRISPR gRNA sequence
tttgaggtgagtcttgctct

SEQ ID NO: 720322 - DNA, 20 bp, Artificial
  CRISPR gRNA sequence
ttgaggtgagtcttgctctg

SEQ ID NO: 720323 - DNA, 20 bp, Artificial
  CRISPR gRNA sequence
tgaggtgagtcttgctctgt

SEQ ID NO: 720324 - DNA, 20 bp, Artificial
  CRISPR gRNA sequence
gaggtgagtcttgctctgtc

SEQ ID NO: 720325 - DNA, 20 bp, Artificial
  CRISPR gRNA sequence
aggtgagtcttgctctgtcg

SEQ ID NO: 720326 - DNA, 20 bp, Artificial
  CRISPR gRNA sequence
gctctgtcgcccagactgga

SEQ ID NO: 720327 - DNA, 20 bp, Artificial
  CRISPR gRNA sequence
ctctgtcgcccagactggag

SEQ ID NO: 720328 - DNA, 20 bp, Artificial
  CRISPR gRNA sequence
tgtcgcccagactggagtgc

SEQ ID NO: 720329 - DNA, 20 bp, Artificial
  CRISPR gRNA sequence
tcgcccagactggagtgcag

SEQ ID NO: 720330 - DNA, 20 bp, Artificial
  CRISPR gRNA sequence
gagtgcagtggcgtgatctc

SEQ ID NO: 720331 - DNA, 20 bp, Artificial
  CRISPR gRNA sequence
ggctcactgcaacctccgcc

SEQ ID NO: 720332 - DNA, 20 bp, Artificial
  CRISPR gRNA sequence
actgcaacctccgcctcctg

SEQ ID NO: 720333 - DNA, 20 bp, Artificial
  CRISPR gRNA sequence
caacctccgcctcctgggtt

SEQ ID NO: 720334 - DNA, 20 bp, Artificial
  CRISPR gRNA sequence
cgcctcctgggttcaagcaa

SEQ ID NO: 720335 - DNA, 20 bp, Artificial
  CRISPR gRNA sequence
ctgggttcaagcaattctcc

SEQ ID NO: 720336 - DNA, 20 bp, Artificial
  CRISPR gRNA sequence
ggttcaagcaattctcctgc

SEQ ID NO: 720337 - DNA, 20 bp, Artificial
  CRISPR gRNA sequence
aagcaattctcctgcctcag

SEQ ID NO: 720338 - DNA, 20 bp, Artificial
  CRISPR gRNA sequence
tcctgcctcagcctcccgag

SEQ ID NO: 720339 - DNA, 20 bp, Artificial
  CRISPR gRNA sequence
ctgcctcagcctcccgagta

SEQ ID NO: 720340 - DNA, 20 bp, Artificial
  CRISPR gRNA sequence
cctcagcctcccgagtagct

SEQ ID NO: 720341 - DNA, 20 bp, Artificial
  CRISPR gRNA sequence
agcctcccgagtagctggga

SEQ ID NO: 720342 - DNA, 20 bp, Artificial
  CRISPR gRNA sequence
ccgagtagctgggattacag

SEQ ID NO: 720343 - DNA, 20 bp, Artificial
  CRISPR gRNA sequence
ggattacaggcgcctgccac

SEQ ID NO: 720344 - DNA, 20 bp, Artificial
  CRISPR gRNA sequence
caggcgcctgccaccacatt

SEQ ID NO: 720345 - DNA, 20 bp, Artificial
  CRISPR gRNA sequence
ccaccacatttggctacttt

SEQ ID NO: 720346 - DNA, 20 bp, Artificial
  CRISPR gRNA sequence
ggctacttttctttttttta

SEQ ID NO: 720347 - DNA, 20 bp, Artificial
  CRISPR gRNA sequence
gctacttttcttttttttag

SEQ ID NO: 720348 - DNA, 20 bp, Artificial
  CRISPR gRNA sequence
cttttcttttttttagtaga

SEQ ID NO: 720349 - DNA, 20 bp, Artificial
  CRISPR gRNA sequence
ttcttttttttagtagagac

SEQ ID NO: 720350 - DNA, 20 bp, Artificial
  CRISPR gRNA sequence
tcttttttttagtagagacg

SEQ ID NO: 720351 - DNA, 20 bp, Artificial
  CRISPR gRNA sequence
cttttttttagtagagacgg

SEQ ID NO: 720352 - DNA, 20 bp, Artificial
  CRISPR gRNA sequence
ttttttttagtagagacggg

SEQ ID NO: 720353 - DNA, 20 bp, Artificial
  CRISPR gRNA sequence
ttttttagtagagacggggt

SEQ ID NO: 720354 - DNA, 20 bp, Artificial
  CRISPR gRNA sequence
tttttagtagagacggggtt

SEQ ID NO: 720355 - DNA, 20 bp, Artificial
  CRISPR gRNA sequence
ttttagtagagacggggttt

SEQ ID NO: 720356 - DNA, 20 bp, Artificial
  CRISPR gRNA sequence
tttagtagagacggggtttc

SEQ ID NO: 720357 - DNA, 20 bp, Artificial
  CRISPR gRNA sequence
ttagtagagacggggtttca

SEQ ID NO: 720358 - DNA, 20 bp, Artificial
  CRISPR gRNA sequence
tagtagagacggggtttcac

SEQ ID NO: 720359 - DNA, 20 bp, Artificial
  CRISPR gRNA sequence
agtagagacggggtttcacc

SEQ ID NO: 720360 - DNA, 20 bp, Artificial
  CRISPR gRNA sequence
gtagagacggggtttcacca

SEQ ID NO: 720361 - DNA, 20 bp, Artificial
  CRISPR gRNA sequence
caccatgttggccaggctgg

SEQ ID NO: 720362 - DNA, 20 bp, Artificial
  CRISPR gRNA sequence
accatgttggccaggctggt

SEQ ID NO: 720363 - DNA, 20 bp, Artificial
  CRISPR gRNA sequence
gccaggctggtcacaaactc

SEQ ID NO: 720364 - DNA, 20 bp, Artificial
  CRISPR gRNA sequence
gtcacaaactcctggcctca

SEQ ID NO: 720365 - DNA, 20 bp, Artificial
  CRISPR gRNA sequence
ctggcctcaagtaatccacc

SEQ ID NO: 720366 - DNA, 20 bp, Artificial
  CRISPR gRNA sequence
gcctcaagtaatccacccgc

SEQ ID NO: 720367 - DNA, 20 bp, Artificial
  CRISPR gRNA sequence
aagtaatccacccgcctcag

SEQ ID NO: 720368 - DNA, 20 bp, Artificial
  CRISPR gRNA sequence
agcctcccaaagtgctggga

SEQ ID NO: 720369 - DNA, 20 bp, Artificial
  CRISPR gRNA sequence
ccaaagtgctgggattacag

SEQ ID NO: 720370 - DNA, 20 bp, Artificial
  CRISPR gRNA sequence
ggattacagacgtgagccac

SEQ ID NO: 720371 - DNA, 20 bp, Artificial
  CRISPR gRNA sequence
cagacgtgagccaccgcgcc

SEQ ID NO: 720372 - DNA, 20 bp, Artificial
  CRISPR gRNA sequence
taaaagagggaggcaggagg

SEQ ID NO: 720373 - DNA, 20 bp, Artificial
  CRISPR gRNA sequence
aaaagagggaggcaggaggc

SEQ ID NO: 720374 - DNA, 20 bp, Artificial
  CRISPR gRNA sequence
aaagagggaggcaggaggca

SEQ ID NO: 720375 - DNA, 20 bp, Artificial
  CRISPR gRNA sequence
cctgcccaataccattctga

SEQ ID NO: 720376 - DNA, 20 bp, Artificial
  CRISPR gRNA sequence
cccaataccattctgaacag

SEQ ID NO: 720377 - DNA, 20 bp, Artificial
  CRISPR gRNA sequence
tgaacaggagttacgctagt

SEQ ID NO: 720378 - DNA, 20 bp, Artificial
  CRISPR gRNA sequence
aacaggagttacgctagtgt

SEQ ID NO: 720379 - DNA, 20 bp, Artificial
  CRISPR gRNA sequence
cgctagtgtgctgagctctc

SEQ ID NO: 720380 - DNA, 20 bp, Artificial
  CRISPR gRNA sequence
gtgtgctgagctctcaggga

SEQ ID NO: 720381 - DNA, 20 bp, Artificial
  CRISPR gRNA sequence
agctctcagggaagctgttc

SEQ ID NO: 720382 - DNA, 20 bp, Artificial
  CRISPR gRNA sequence
tcagggaagctgttcccaaa

SEQ ID NO: 720383 - DNA, 20 bp, Artificial
  CRISPR gRNA sequence
agggaagctgttcccaaagt

SEQ ID NO: 720384 - DNA, 20 bp, Artificial
  CRISPR gRNA sequence
ttcccaaagttttgagcagg

SEQ ID NO: 720385 - DNA, 20 bp, Artificial
  CRISPR gRNA sequence
ccaaagttttgagcagggga

SEQ ID NO: 720386 - DNA, 20 bp, Artificial
  CRISPR gRNA sequence
tgagcaggggagtgacagag

SEQ ID NO: 720387 - DNA, 20 bp, Artificial
  CRISPR gRNA sequence
gagcaggggagtgacagagc

SEQ ID NO: 720388 - DNA, 20 bp, Artificial
  CRISPR gRNA sequence
agcaggggagtgacagagcc

SEQ ID NO: 720389 - DNA, 20 bp, Artificial
  CRISPR gRNA sequence
ggggaagctgtggcatggtg

SEQ ID NO: 720390 - DNA, 20 bp, Artificial
  CRISPR gRNA sequence
tggcatggtggcctcaggag

SEQ ID NO: 720391 - DNA, 20 bp, Artificial
  CRISPR gRNA sequence
aggaggaacagtgggcaggg

SEQ ID NO: 720392 - DNA, 20 bp, Artificial
  CRISPR gRNA sequence
gttggggggcaatgagtacc

SEQ ID NO: 720393 - DNA, 20 bp, Artificial
  CRISPR gRNA sequence
gggggcaatgagtaccctcc

SEQ ID NO: 720394 - DNA, 20 bp, Artificial
  CRISPR gRNA sequence
ctctcgtgtggaatgcacgc

SEQ ID NO: 720395 - DNA, 20 bp, Artificial
  CRISPR gRNA sequence
tcgtgtggaatgcacgcagc

SEQ ID NO: 720396 - DNA, 20 bp, Artificial
  CRISPR gRNA sequence
gtgtggaatgcacgcagcat

SEQ ID NO: 720397 - DNA, 20 bp, Artificial
  CRISPR gRNA sequence
ctgtcctctctgagcctcag

SEQ ID NO: 720398 - DNA, 20 bp, Artificial
  CRISPR gRNA sequence
tcctctctgagcctcaggac

SEQ ID NO: 720399 - DNA, 20 bp, Artificial
  CRISPR gRNA sequence
tctgagcctcaggactccct

SEQ ID NO: 720400 - DNA, 20 bp, Artificial
  CRISPR gRNA sequence
tgagcctcaggactccctct

SEQ ID NO: 720401 - DNA, 20 bp, Artificial
  CRISPR gRNA sequence
agcctcaggactccctctga

SEQ ID NO: 720402 - DNA, 20 bp, Artificial
  CRISPR gRNA sequence
aggactccctctgaaaggct

SEQ ID NO: 720403 - DNA, 20 bp, Artificial
  CRISPR gRNA sequence
cctctgaaaggctggactga

SEQ ID NO: 720404 - DNA, 20 bp, Artificial
  CRISPR gRNA sequence
tgaaaggctggactgagctg

SEQ ID NO: 720405 - DNA, 20 bp, Artificial
  CRISPR gRNA sequence
aaaggctggactgagctgac

SEQ ID NO: 720406 - DNA, 20 bp, Artificial
  CRISPR gRNA sequence
gactgagctgacatgcggag

SEQ ID NO: 720407 - DNA, 20 bp, Artificial
  CRISPR gRNA sequence
agctgacatgcggagtttgg

SEQ ID NO: 720408 - DNA, 20 bp, Artificial
  CRISPR gRNA sequence
acatgcggagtttgggagct

SEQ ID NO: 720409 - DNA, 20 bp, Artificial
  CRISPR gRNA sequence
gggagctggccacggtgagg

SEQ ID NO: 720410 - DNA, 20 bp, Artificial
  CRISPR gRNA sequence
ggagctggccacggtgaggg

SEQ ID NO: 720411 - DNA, 20 bp, Artificial
  CRISPR gRNA sequence
gccacggtgagggatggggg

SEQ ID NO: 720412 - DNA, 20 bp, Artificial
  CRISPR gRNA sequence
cagggttgggtggggagtga

SEQ ID NO: 720413 - DNA, 20 bp, Artificial
  CRISPR gRNA sequence
agggttgggtggggagtgag

SEQ ID NO: 720414 - DNA, 20 bp, Artificial
  CRISPR gRNA sequence
ggtggggagtgaggcctttg

SEQ ID NO: 720415 - DNA, 20 bp, Artificial
  CRISPR gRNA sequence
tgccaaggcggcctggcctg

SEQ ID NO: 720416 - DNA, 20 bp, Artificial
  CRISPR gRNA sequence
gccaaggcggcctggcctgc

SEQ ID NO: 720417 - DNA, 20 bp, Artificial
  CRISPR gRNA sequence
ccaaggcggcctggcctgca

SEQ ID NO: 720418 - DNA, 20 bp, Artificial
  CRISPR gRNA sequence
gcctgcagcttctctgcttc

SEQ ID NO: 720419 - DNA, 20 bp, Artificial
  CRISPR gRNA sequence
cagcttctctgcttctttcc

SEQ ID NO: 720420 - DNA, 20 bp, Artificial
  CRISPR gRNA sequence
ctctgcttctttccccaggt

SEQ ID NO: 720421 - DNA, 20 bp, Artificial
  CRISPR gRNA sequence
tctgcttctttccccaggtc

SEQ ID NO: 720422 - DNA, 20 bp, Artificial
  CRISPR gRNA sequence
tgcttctttccccaggtctg

SEQ ID NO: 720423 - DNA, 20 bp, Artificial
  CRISPR gRNA sequence
cttctttccccaggtctgtc

SEQ ID NO: 720424 - DNA, 20 bp, Artificial
  CRISPR gRNA sequence
ctttccccaggtctgtcccc

SEQ ID NO: 720425 - DNA, 20 bp, Artificial
  CRISPR gRNA sequence
tttccccaggtctgtcccca

SEQ ID NO: 720426 - DNA, 20 bp, Artificial
  CRISPR gRNA sequence
tccccaggtctgtccccaac

SEQ ID NO: 720427 - DNA, 20 bp, Artificial
  CRISPR gRNA sequence
ccccaggtctgtccccaaca

SEQ ID NO: 720428 - DNA, 20 bp, Artificial
  CRISPR gRNA sequence
cccaggtctgtccccaacac

SEQ ID NO: 720429 - DNA, 20 bp, Artificial
  CRISPR gRNA sequence
tccccaacacagccatgccc

SEQ ID NO: 720430 - DNA, 20 bp, Artificial
  CRISPR gRNA sequence
gtgattgcagaaagcagtgt

SEQ ID NO: 720431 - DNA, 20 bp, Artificial
  CRISPR gRNA sequence
cagaaagcagtgtgagcccg

SEQ ID NO: 720432 - DNA, 20 bp, Artificial
  CRISPR gRNA sequence
ctacctggacgaggccggcc

SEQ ID NO: 720433 - DNA, 20 bp, Artificial
  CRISPR gRNA sequence
cctggacgaggccggccgct

SEQ ID NO: 720434 - DNA, 20 bp, Artificial
  CRISPR gRNA sequence
gacgaggccggccgctgcac

SEQ ID NO: 720435 - DNA, 20 bp, Artificial
  CRISPR gRNA sequence
cacggcctgcgtgagctgtt

SEQ ID NO: 720436 - DNA, 20 bp, Artificial
  CRISPR gRNA sequence
cgtgagctgttctcgaggta

SEQ ID NO: 720437 - DNA, 20 bp, Artificial
  CRISPR gRNA sequence
ttctcgaggtaagggcctcg

SEQ ID NO: 720438 - DNA, 20 bp, Artificial
  CRISPR gRNA sequence
tcgaggtaagggcctcgtcc

SEQ ID NO: 720439 - DNA, 20 bp, Artificial
  CRISPR gRNA sequence
gaggtaagggcctcgtccct

SEQ ID NO: 720440 - DNA, 20 bp, Artificial
  CRISPR gRNA sequence
gtccctccccgggcctcagt

SEQ ID NO: 720441 - DNA, 20 bp, Artificial
  CRISPR gRNA sequence
cccgggcctcagtttacctc

SEQ ID NO: 720442 - DNA, 20 bp, Artificial
  CRISPR gRNA sequence
agtttacctctctgcatttt

SEQ ID NO: 720443 - DNA, 20 bp, Artificial
  CRISPR gRNA sequence
acctctctgcatttttgaac

SEQ ID NO: 720444 - DNA, 20 bp, Artificial
  CRISPR gRNA sequence
cctctctgcatttttgaacc

SEQ ID NO: 720445 - DNA, 20 bp, Artificial
  CRISPR gRNA sequence
tctgcatttttgaaccgtga

SEQ ID NO: 720446 - DNA, 20 bp, Artificial
  CRISPR gRNA sequence
tgcatttttgaaccgtgaac

SEQ ID NO: 720447 - DNA, 20 bp, Artificial
  CRISPR gRNA sequence
catttttgaaccgtgaactt

SEQ ID NO: 720448 - DNA, 20 bp, Artificial
  CRISPR gRNA sequence
ttgaaccgtgaacttccagt

SEQ ID NO: 720449 - DNA, 20 bp, Artificial
  CRISPR gRNA sequence
tgaaccgtgaacttccagta

SEQ ID NO: 720450 - DNA, 20 bp, Artificial
  CRISPR gRNA sequence
gaaccgtgaacttccagtaa

SEQ ID NO: 720451 - DNA, 20 bp, Artificial
  CRISPR gRNA sequence
aaccgtgaacttccagtaac

SEQ ID NO: 720452 - DNA, 20 bp, Artificial
  CRISPR gRNA sequence
ccagtaactactccccctta

SEQ ID NO: 720453 - DNA, 20 bp, Artificial
  CRISPR gRNA sequence
cagtaactactcccccttat

SEQ ID NO: 720454 - DNA, 20 bp, Artificial
  CRISPR gRNA sequence
ctcccccttatgtttgtggg

SEQ ID NO: 720455 - DNA, 20 bp, Artificial
  CRISPR gRNA sequence
ccccttatgtttgtgggttt

SEQ ID NO: 720456 - DNA, 20 bp, Artificial
  CRISPR gRNA sequence
atgtttgtgggtttttgatg

SEQ ID NO: 720457 - DNA, 20 bp, Artificial
  CRISPR gRNA sequence
tgtttgtgggtttttgatgg

SEQ ID NO: 720458 - DNA, 20 bp, Artificial
  CRISPR gRNA sequence
gtgggtttttgatgggggtc

SEQ ID NO: 720459 - DNA, 20 bp, Artificial
  CRISPR gRNA sequence
tgggtttttgatgggggtcg

SEQ ID NO: 720460 - DNA, 20 bp, Artificial
  CRISPR gRNA sequence
ttgatgggggtcgcctcttt

SEQ ID NO: 720461 - DNA, 20 bp, Artificial
  CRISPR gRNA sequence
tgatgggggtcgcctctttt

SEQ ID NO: 720462 - DNA, 20 bp, Artificial
  CRISPR gRNA sequence
gatgggggtcgcctcttttc

SEQ ID NO: 720463 - DNA, 20 bp, Artificial
  CRISPR gRNA sequence
atgggggtcgcctcttttca

SEQ ID NO: 720464 - DNA, 20 bp, Artificial
  CRISPR gRNA sequence
ttttcagagggcttccattg

SEQ ID NO: 720465 - DNA, 20 bp, Artificial
  CRISPR gRNA sequence
ttcagagggcttccattggc

SEQ ID NO: 720466 - DNA, 20 bp, Artificial
  CRISPR gRNA sequence
tcagagggcttccattggca

SEQ ID NO: 720467 - DNA, 20 bp, Artificial
  CRISPR gRNA sequence
cagagggcttccattggcat

SEQ ID NO: 720468 - DNA, 20 bp, Artificial
  CRISPR gRNA sequence
agagggcttccattggcata

SEQ ID NO: 720469 - DNA, 20 bp, Artificial
  CRISPR gRNA sequence
ccattggcatattatttcct

SEQ ID NO: 720470 - DNA, 20 bp, Artificial
  CRISPR gRNA sequence
cattggcatattatttcctt

SEQ ID NO: 720471 - DNA, 20 bp, Artificial
  CRISPR gRNA sequence
gcatattatttccttccagg

SEQ ID NO: 720472 - DNA, 20 bp, Artificial
  CRISPR gRNA sequence
tttccttccaggaagcgttt

SEQ ID NO: 720473 - DNA, 20 bp, Artificial
  CRISPR gRNA sequence
ccttccaggaagcgtttgtg

SEQ ID NO: 720474 - DNA, 20 bp, Artificial
  CRISPR gRNA sequence
cttccaggaagcgtttgtga

SEQ ID NO: 720475 - DNA, 20 bp, Artificial
  CRISPR gRNA sequence
ccaggaagcgtttgtgaatc

SEQ ID NO: 720476 - DNA, 20 bp, Artificial
  CRISPR gRNA sequence
caggaagcgtttgtgaatca

SEQ ID NO: 720477 - DNA, 20 bp, Artificial
  CRISPR gRNA sequence
gtgaatcacccacctgttcc

SEQ ID NO: 720478 - DNA, 20 bp, Artificial
  CRISPR gRNA sequence
tgaatcacccacctgttcca

SEQ ID NO: 720479 - DNA, 20 bp, Artificial
  CRISPR gRNA sequence
ttccaaactcggctcatcaa

SEQ ID NO: 720480 - DNA, 20 bp, Artificial
  CRISPR gRNA sequence
caaactcggctcatcaatgt

SEQ ID NO: 720481 - DNA, 20 bp, Artificial
  CRISPR gRNA sequence
ggctcatcaatgtttgtaac

SEQ ID NO: 720482 - DNA, 20 bp, Artificial
  CRISPR gRNA sequence
atcaatgtttgtaactactc

SEQ ID NO: 720483 - DNA, 20 bp, Artificial
  CRISPR gRNA sequence
gtaactactctgtgattcaa

SEQ ID NO: 720484 - DNA, 20 bp, Artificial
  CRISPR gRNA sequence
taactactctgtgattcaag

SEQ ID NO: 720485 - DNA, 20 bp, Artificial
  CRISPR gRNA sequence
ctctgtgattcaagcattgt

SEQ ID NO: 720486 - DNA, 20 bp, Artificial
  CRISPR gRNA sequence
tgtgattcaagcattgtgat

SEQ ID NO: 720487 - DNA, 20 bp, Artificial
  CRISPR gRNA sequence
tgattcaagcattgtgatca

SEQ ID NO: 720488 - DNA, 20 bp, Artificial
  CRISPR gRNA sequence
aagcattgtgatcattcccc

SEQ ID NO: 720489 - DNA, 20 bp, Artificial
  CRISPR gRNA sequence
tgatcattccccttttacag

SEQ ID NO: 720490 - DNA, 20 bp, Artificial
  CRISPR gRNA sequence
cccttttacagaggaggaaa

SEQ ID NO: 720491 - DNA, 20 bp, Artificial
  CRISPR gRNA sequence
ttacagaggaggaaacggag

SEQ ID NO: 720492 - DNA, 20 bp, Artificial
  CRISPR gRNA sequence
tacagaggaggaaacggagg

SEQ ID NO: 720493 - DNA, 20 bp, Artificial
  CRISPR gRNA sequence
acagaggaggaaacggaggc

SEQ ID NO: 720494 - DNA, 20 bp, Artificial
  CRISPR gRNA sequence
cagaggaggaaacggaggct

SEQ ID NO: 720495 - DNA, 20 bp, Artificial
  CRISPR gRNA sequence
tgggaagtcagggaacttcc

SEQ ID NO: 720496 - DNA, 20 bp, Artificial
  CRISPR gRNA sequence
gggaagtcagggaacttcca

SEQ ID NO: 720497 - DNA, 20 bp, Artificial
  CRISPR gRNA sequence
ggaagtcagggaacttccaa

SEQ ID NO: 720498 - DNA, 20 bp, Artificial
  CRISPR gRNA sequence
ccaagggctgtgggctggag

SEQ ID NO: 720499 - DNA, 20 bp, Artificial
  CRISPR gRNA sequence
caagggctgtgggctggagt

SEQ ID NO: 720500 - DNA, 20 bp, Artificial
  CRISPR gRNA sequence
tgggctggagtttgaaccca

SEQ ID NO: 720501 - DNA, 20 bp, Artificial
  CRISPR gRNA sequence
gagtttgaacccagacaggt

SEQ ID NO: 720502 - DNA, 20 bp, Artificial
  CRISPR gRNA sequence
gaacccagacaggtgccacc

SEQ ID NO: 720503 - DNA, 20 bp, Artificial
  CRISPR gRNA sequence
aacccagacaggtgccacca

SEQ ID NO: 720504 - DNA, 20 bp, Artificial
  CRISPR gRNA sequence
caggttctcgtccactccac

SEQ ID NO: 720505 - DNA, 20 bp, Artificial
  CRISPR gRNA sequence
tcgtccactccactcgctgc

SEQ ID NO: 720506 - DNA, 20 bp, Artificial
  CRISPR gRNA sequence
gtccactccactcgctgccc

SEQ ID NO: 720507 - DNA, 20 bp, Artificial
  CRISPR gRNA sequence
cactcgctgcccctatgagc

SEQ ID NO: 720508 - DNA, 20 bp, Artificial
  CRISPR gRNA sequence
gctgcccctatgagccactt

SEQ ID NO: 720509 - DNA, 20 bp, Artificial
  CRISPR gRNA sequence
cccctatgagccacttattc

SEQ ID NO: 720510 - DNA, 20 bp, Artificial
  CRISPR gRNA sequence
tgagccacttattctttttt

SEQ ID NO: 720511 - DNA, 20 bp, Artificial
  CRISPR gRNA sequence
attctttttttttttttccc

SEQ ID NO: 720512 - DNA, 20 bp, Artificial
  CRISPR gRNA sequence
ttctttttttttttttccca

SEQ ID NO: 720513 - DNA, 20 bp, Artificial
  CRISPR gRNA sequence
tttttttttttttcccagac

SEQ ID NO: 720514 - DNA, 20 bp, Artificial
  CRISPR gRNA sequence
tttttttttttcccagacag

SEQ ID NO: 720515 - DNA, 20 bp, Artificial
  CRISPR gRNA sequence
ttttttttttcccagacagg

SEQ ID NO: 720516 - DNA, 20 bp, Artificial
  CRISPR gRNA sequence
tttttttttcccagacaggg

SEQ ID NO: 720517 - DNA, 20 bp, Artificial
  CRISPR gRNA sequence
ttttttttcccagacagggt

SEQ ID NO: 720518 - DNA, 20 bp, Artificial
  CRISPR gRNA sequence
tttttttcccagacagggtc

SEQ ID NO: 720519 - DNA, 20 bp, Artificial
  CRISPR gRNA sequence
ttttttcccagacagggtct

SEQ ID NO: 720520 - DNA, 20 bp, Artificial
  CRISPR gRNA sequence
tttttcccagacagggtctc

SEQ ID NO: 720521 - DNA, 20 bp, Artificial
  CRISPR gRNA sequence
ttttcccagacagggtctca

SEQ ID NO: 720522 - DNA, 20 bp, Artificial
  CRISPR gRNA sequence
tttcccagacagggtctcac

SEQ ID NO: 720523 - DNA, 20 bp, Artificial
  CRISPR gRNA sequence
ttcccagacagggtctcact

SEQ ID NO: 720524 - DNA, 20 bp, Artificial
  CRISPR gRNA sequence
tcccagacagggtctcactc

SEQ ID NO: 720525 - DNA, 20 bp, Artificial
  CRISPR gRNA sequence
cccagacagggtctcactcc

SEQ ID NO: 720526 - DNA, 20 bp, Artificial
  CRISPR gRNA sequence
ccagacagggtctcactcct

SEQ ID NO: 720527 - DNA, 20 bp, Artificial
  CRISPR gRNA sequence
actccttcacccaagctgca

SEQ ID NO: 720528 - DNA, 20 bp, Artificial
  CRISPR gRNA sequence
cttcacccaagctgcagtac

SEQ ID NO: 720529 - DNA, 20 bp, Artificial
  CRISPR gRNA sequence
cacccaagctgcagtacggt

SEQ ID NO: 720530 - DNA, 20 bp, Artificial
  CRISPR gRNA sequence
acccaagctgcagtacggtg

SEQ ID NO: 720531 - DNA, 20 bp, Artificial
  CRISPR gRNA sequence
cagtacggtggtgggatcat

SEQ ID NO: 720532 - DNA, 20 bp, Artificial
  CRISPR gRNA sequence
cctgcagctgtgacctccca

SEQ ID NO: 720533 - DNA, 20 bp, Artificial
  CRISPR gRNA sequence
cagctgtgacctcccaggat

SEQ ID NO: 720534 - DNA, 20 bp, Artificial
  CRISPR gRNA sequence
tgacctcccaggatcacatg

SEQ ID NO: 720535 - DNA, 20 bp, Artificial
  CRISPR gRNA sequence
ccaggatcacatgatccttt

SEQ ID NO: 720536 - DNA, 20 bp, Artificial
  CRISPR gRNA sequence
ttgcctcagcctttcaagtg

SEQ ID NO: 720537 - DNA, 20 bp, Artificial
  CRISPR gRNA sequence
tgcctcagcctttcaagtgg

SEQ ID NO: 720538 - DNA, 20 bp, Artificial
  CRISPR gRNA sequence
gcctcagcctttcaagtggc

SEQ ID NO: 720539 - DNA, 20 bp, Artificial
  CRISPR gRNA sequence
cctcagcctttcaagtggct

SEQ ID NO: 720540 - DNA, 20 bp, Artificial
  CRISPR gRNA sequence
agcctttcaagtggctggga

SEQ ID NO: 720541 - DNA, 20 bp, Artificial
  CRISPR gRNA sequence
tcaagtggctgggactatag

SEQ ID NO: 720542 - DNA, 20 bp, Artificial
  CRISPR gRNA sequence
caagtggctgggactatagg

SEQ ID NO: 720543 - DNA, 20 bp, Artificial
  CRISPR gRNA sequence
aagtggctgggactataggt

SEQ ID NO: 720544 - DNA, 20 bp, Artificial
  CRISPR gRNA sequence
ggactataggtgcacactac

SEQ ID NO: 720545 - DNA, 20 bp, Artificial
  CRISPR gRNA sequence
taggtgcacactaccatgcc

SEQ ID NO: 720546 - DNA, 20 bp, Artificial
  CRISPR gRNA sequence
ccatgcctggctaattaaaa

SEQ ID NO: 720547 - DNA, 20 bp, Artificial
  CRISPR gRNA sequence
gctaattaaaaaaaattttt

SEQ ID NO: 720548 - DNA, 20 bp, Artificial
  CRISPR gRNA sequence
attaaaaaaaattttttttc

SEQ ID NO: 720549 - DNA, 20 bp, Artificial
  CRISPR gRNA sequence
aaaaaaattttttttcatac

SEQ ID NO: 720550 - DNA, 20 bp, Artificial
  CRISPR gRNA sequence
tttttcatacagatgggggt

SEQ ID NO: 720551 - DNA, 20 bp, Artificial
  CRISPR gRNA sequence
ttttcatacagatgggggtc

SEQ ID NO: 720552 - DNA, 20 bp, Artificial
  CRISPR gRNA sequence
tttcatacagatgggggtct

SEQ ID NO: 720553 - DNA, 20 bp, Artificial
  CRISPR gRNA sequence
ttcatacagatgggggtctc

SEQ ID NO: 720554 - DNA, 20 bp, Artificial
  CRISPR gRNA sequence
tcatacagatgggggtctca

SEQ ID NO: 720555 - DNA, 20 bp, Artificial
  CRISPR gRNA sequence
catacagatgggggtctcac

SEQ ID NO: 720556 - DNA, 20 bp, Artificial
  CRISPR gRNA sequence
atacagatgggggtctcact

SEQ ID NO: 720557 - DNA, 20 bp, Artificial
  CRISPR gRNA sequence
actatgttgcccaggctgct

SEQ ID NO: 720558 - DNA, 20 bp, Artificial
  CRISPR gRNA sequence
tgttgcccaggctgctctcg

SEQ ID NO: 720559 - DNA, 20 bp, Artificial
  CRISPR gRNA sequence
cccaggctgctctcgaactc

SEQ ID NO: 720560 - DNA, 20 bp, Artificial
  CRISPR gRNA sequence
ctctcgaactcctggactca

SEQ ID NO: 720561 - DNA, 20 bp, Artificial
  CRISPR gRNA sequence
tcgaactcctggactcaaat

SEQ ID NO: 720562 - DNA, 20 bp, Artificial
  CRISPR gRNA sequence
gaactcctggactcaaatgg

SEQ ID NO: 720563 - DNA, 20 bp, Artificial
  CRISPR gRNA sequence
ctggactcaaatggtcctcc

SEQ ID NO: 720564 - DNA, 20 bp, Artificial
  CRISPR gRNA sequence
gactcaaatggtcctcccac

SEQ ID NO: 720565 - DNA, 20 bp, Artificial
  CRISPR gRNA sequence
aaatggtcctcccaccttgg

SEQ ID NO: 720566 - DNA, 20 bp, Artificial
  CRISPR gRNA sequence
ccaccttggcttcctaaatt

SEQ ID NO: 720567 - DNA, 20 bp, Artificial
  CRISPR gRNA sequence
ggcttcctaaattgctggga

SEQ ID NO: 720568 - DNA, 20 bp, Artificial
  CRISPR gRNA sequence
gcttcctaaattgctgggat

SEQ ID NO: 720569 - DNA, 20 bp, Artificial
  CRISPR gRNA sequence
cctaaattgctgggattata

SEQ ID NO: 720570 - DNA, 20 bp, Artificial
  CRISPR gRNA sequence
ctaaattgctgggattatag

SEQ ID NO: 720571 - DNA, 20 bp, Artificial
  CRISPR gRNA sequence
aattgctgggattataggca

SEQ ID NO: 720572 - DNA, 20 bp, Artificial
  CRISPR gRNA sequence
ctgggattataggcatgagc

SEQ ID NO: 720573 - DNA, 20 bp, Artificial
  CRISPR gRNA sequence
ggattataggcatgagccac

SEQ ID NO: 720574 - DNA, 20 bp, Artificial
  CRISPR gRNA sequence
taggcatgagccaccatgcc

SEQ ID NO: 720575 - DNA, 20 bp, Artificial
  CRISPR gRNA sequence
cgagctgttttgacaagcac

SEQ ID NO: 720576 - DNA, 20 bp, Artificial
  CRISPR gRNA sequence
ttttgacaagcacttactga

SEQ ID NO: 720577 - DNA, 20 bp, Artificial
  CRISPR gRNA sequence
tgacaagcacttactgagtg

SEQ ID NO: 720578 - DNA, 20 bp, Artificial
  CRISPR gRNA sequence
gacaagcacttactgagtgc

SEQ ID NO: 720579 - DNA, 20 bp, Artificial
  CRISPR gRNA sequence
acaagcacttactgagtgca

SEQ ID NO: 720580 - DNA, 20 bp, Artificial
  CRISPR gRNA sequence
actgagtgcacagacacagc

SEQ ID NO: 720581 - DNA, 20 bp, Artificial
  CRISPR gRNA sequence
ctgagtgcacagacacagca

SEQ ID NO: 720582 - DNA, 20 bp, Artificial
  CRISPR gRNA sequence
agtgcacagacacagcacga

SEQ ID NO: 720583 - DNA, 20 bp, Artificial
  CRISPR gRNA sequence
ccctgtgcccagcccatcac

SEQ ID NO: 720584 - DNA, 20 bp, Artificial
  CRISPR gRNA sequence
cctgtgcccagcccatcaca

SEQ ID NO: 720585 - DNA, 20 bp, Artificial
  CRISPR gRNA sequence
tgcccagcccatcacaacct

SEQ ID NO: 720586 - DNA, 20 bp, Artificial
  CRISPR gRNA sequence
ccagcgccagcagcaccccg

SEQ ID NO: 720587 - DNA, 20 bp, Artificial
  CRISPR gRNA sequence
ctcaggccacaggctgctgt

SEQ ID NO: 720588 - DNA, 20 bp, Artificial
  CRISPR gRNA sequence
aggccacaggctgctgtgac

SEQ ID NO: 720589 - DNA, 20 bp, Artificial
  CRISPR gRNA sequence
ctgtgactgttagaggccct

SEQ ID NO: 720590 - DNA, 20 bp, Artificial
  CRISPR gRNA sequence
tgactgttagaggccctggc

SEQ ID NO: 720591 - DNA, 20 bp, Artificial
  CRISPR gRNA sequence
ttagaggccctggctattca

SEQ ID NO: 720592 - DNA, 20 bp, Artificial
  CRISPR gRNA sequence
gaggccctggctattcacgg

SEQ ID NO: 720593 - DNA, 20 bp, Artificial
  CRISPR gRNA sequence
gctattcacggaggccactg

SEQ ID NO: 720594 - DNA, 20 bp, Artificial
  CRISPR gRNA sequence
ttcacggaggccactgggaa

SEQ ID NO: 720595 - DNA, 20 bp, Artificial
  CRISPR gRNA sequence
acggaggccactgggaatgt

SEQ ID NO: 720596 - DNA, 20 bp, Artificial
  CRISPR gRNA sequence
ggaatgtgtgtctgtctcct

SEQ ID NO: 720597 - DNA, 20 bp, Artificial
  CRISPR gRNA sequence
tctccttgtccagagctgct

SEQ ID NO: 720598 - DNA, 20 bp, Artificial
  CRISPR gRNA sequence
cttgtccagagctgcttttg

SEQ ID NO: 720599 - DNA, 20 bp, Artificial
  CRISPR gRNA sequence
gtccagagctgcttttgggc

SEQ ID NO: 720600 - DNA, 20 bp, Artificial
  CRISPR gRNA sequence
tccagagctgcttttgggca

SEQ ID NO: 720601 - DNA, 20 bp, Artificial
  CRISPR gRNA sequence
cttttgggcagcaaagcaga

SEQ ID NO: 720602 - DNA, 20 bp, Artificial
  CRISPR gRNA sequence
ttgggcagcaaagcagagtg

SEQ ID NO: 720603 - DNA, 20 bp, Artificial
  CRISPR gRNA sequence
tgggcagcaaagcagagtga

SEQ ID NO: 720604 - DNA, 20 bp, Artificial
  CRISPR gRNA sequence
gggcagcaaagcagagtgaa

SEQ ID NO: 720605 - DNA, 20 bp, Artificial
  CRISPR gRNA sequence
ggcagcaaagcagagtgaag

SEQ ID NO: 720606 - DNA, 20 bp, Artificial
  CRISPR gRNA sequence
tttgttgtcattggaggtct

SEQ ID NO: 720607 - DNA, 20 bp, Artificial
  CRISPR gRNA sequence
gttgtcattggaggtctctg

SEQ ID NO: 720608 - DNA, 20 bp, Artificial
  CRISPR gRNA sequence
ttgtcattggaggtctctgt

SEQ ID NO: 720609 - DNA, 20 bp, Artificial
  CRISPR gRNA sequence
tcattggaggtctctgtcct

SEQ ID NO: 720610 - DNA, 20 bp, Artificial
  CRISPR gRNA sequence
gaggtctctgtcctagttac

SEQ ID NO: 720611 - DNA, 20 bp, Artificial
  CRISPR gRNA sequence
tgtcctagttactaaggctg

SEQ ID NO: 720612 - DNA, 20 bp, Artificial
  CRISPR gRNA sequence
tcctagttactaaggctgca

SEQ ID NO: 720613 - DNA, 20 bp, Artificial
  CRISPR gRNA sequence
gttactaaggctgcatagca

SEQ ID NO: 720614 - DNA, 20 bp, Artificial
  CRISPR gRNA sequence
ctaaggctgcatagcaaatt

SEQ ID NO: 720615 - DNA, 20 bp, Artificial
  CRISPR gRNA sequence
aggctgcatagcaaattttc

SEQ ID NO: 720616 - DNA, 20 bp, Artificial
  CRISPR gRNA sequence
catagcaaattttcttaaaa

SEQ ID NO: 720617 - DNA, 20 bp, Artificial
  CRISPR gRNA sequence
tcttaaaacttaattgtgaa

SEQ ID NO: 720618 - DNA, 20 bp, Artificial
  CRISPR gRNA sequence
cttaaaacttaattgtgaaa

SEQ ID NO: 720619 - DNA, 20 bp, Artificial
  CRISPR gRNA sequence
ttaaaacttaattgtgaaaa

SEQ ID NO: 720620 - DNA, 20 bp, Artificial
  CRISPR gRNA sequence
aaaacttaattgtgaaaaca

SEQ ID NO: 720621 - DNA, 20 bp, Artificial
  CRISPR gRNA sequence
aaacttaattgtgaaaacaa

SEQ ID NO: 720622 - DNA, 20 bp, Artificial
  CRISPR gRNA sequence
aattgtgaaaacaaatcatt

SEQ ID NO: 720623 - DNA, 20 bp, Artificial
  CRISPR gRNA sequence
attgtgaaaacaaatcattc

SEQ ID NO: 720624 - DNA, 20 bp, Artificial
  CRISPR gRNA sequence
tgaaaacaaatcattctttg

SEQ ID NO: 720625 - DNA, 20 bp, Artificial
  CRISPR gRNA sequence
tttgtactcacagattctgt

SEQ ID NO: 720626 - DNA, 20 bp, Artificial
  CRISPR gRNA sequence
tgtactcacagattctgtga

SEQ ID NO: 720627 - DNA, 20 bp, Artificial
  CRISPR gRNA sequence
gtactcacagattctgtgag

SEQ ID NO: 720628 - DNA, 20 bp, Artificial
  CRISPR gRNA sequence
tactcacagattctgtgagt

SEQ ID NO: 720629 - DNA, 20 bp, Artificial
  CRISPR gRNA sequence
acagattctgtgagtcagaa

SEQ ID NO: 720630 - DNA, 20 bp, Artificial
  CRISPR gRNA sequence
tgtgagtcagaattcagaca

SEQ ID NO: 720631 - DNA, 20 bp, Artificial
  CRISPR gRNA sequence
tgagtcagaattcagacagg

SEQ ID NO: 720632 - DNA, 20 bp, Artificial
  CRISPR gRNA sequence
agacagggcactgcggggac

SEQ ID NO: 720633 - DNA, 20 bp, Artificial
  CRISPR gRNA sequence
cggggacagcttgtctctgc

SEQ ID NO: 720634 - DNA, 20 bp, Artificial
  CRISPR gRNA sequence
gtctctgctccacaatgtct

SEQ ID NO: 720635 - DNA, 20 bp, Artificial
  CRISPR gRNA sequence
tctctgctccacaatgtctg

SEQ ID NO: 720636 - DNA, 20 bp, Artificial
  CRISPR gRNA sequence
tgctccacaatgtctgaggt

SEQ ID NO: 720637 - DNA, 20 bp, Artificial
  CRISPR gRNA sequence
ctccacaatgtctgaggtct

SEQ ID NO: 720638 - DNA, 20 bp, Artificial
  CRISPR gRNA sequence
cacaatgtctgaggtcttag

SEQ ID NO: 720639 - DNA, 20 bp, Artificial
  CRISPR gRNA sequence
aggtcttagctggaaagccc

SEQ ID NO: 720640 - DNA, 20 bp, Artificial
  CRISPR gRNA sequence
agctggaaagcccaaaagct

SEQ ID NO: 720641 - DNA, 20 bp, Artificial
  CRISPR gRNA sequence
gctggaaagcccaaaagctg

SEQ ID NO: 720642 - DNA, 20 bp, Artificial
  CRISPR gRNA sequence
gaaagcccaaaagctgcaga

SEQ ID NO: 720643 - DNA, 20 bp, Artificial
  CRISPR gRNA sequence
cagatcaggaacttctgaag

SEQ ID NO: 720644 - DNA, 20 bp, Artificial
  CRISPR gRNA sequence
ctgaagcttcattcattcac

SEQ ID NO: 720645 - DNA, 20 bp, Artificial
  CRISPR gRNA sequence
tgaagcttcattcattcacc

SEQ ID NO: 720646 - DNA, 20 bp, Artificial
  CRISPR gRNA sequence
aagcttcattcattcacctg

SEQ ID NO: 720647 - DNA, 20 bp, Artificial
  CRISPR gRNA sequence
cattcattcacctgccttgg

SEQ ID NO: 720648 - DNA, 20 bp, Artificial
  CRISPR gRNA sequence
attcattcacctgccttggg

SEQ ID NO: 720649 - DNA, 20 bp, Artificial
  CRISPR gRNA sequence
attcacctgccttggggttg

SEQ ID NO: 720650 - DNA, 20 bp, Artificial
  CRISPR gRNA sequence
acctgccttggggttgatgt

SEQ ID NO: 720651 - DNA, 20 bp, Artificial
  CRISPR gRNA sequence
ccttggggttgatgttggct

SEQ ID NO: 720652 - DNA, 20 bp, Artificial
  CRISPR gRNA sequence
ggggttgatgttggctcctg

SEQ ID NO: 720653 - DNA, 20 bp, Artificial
  CRISPR gRNA sequence
gggttgatgttggctcctgg

SEQ ID NO: 720654 - DNA, 20 bp, Artificial
  CRISPR gRNA sequence
atgttggctcctggctgcag

SEQ ID NO: 720655 - DNA, 20 bp, Artificial
  CRISPR gRNA sequence
gctcctggctgcagccttgg

SEQ ID NO: 720656 - DNA, 20 bp, Artificial
  CRISPR gRNA sequence
ctggctgcagccttggttcc

SEQ ID NO: 720657 - DNA, 20 bp, Artificial
  CRISPR gRNA sequence
gctgcagccttggttccctt

SEQ ID NO: 720658 - DNA, 20 bp, Artificial
  CRISPR gRNA sequence
cagccttggttcccttccat

SEQ ID NO: 720659 - DNA, 20 bp, Artificial
  CRISPR gRNA sequence
ggttcccttccatgtcggcc

SEQ ID NO: 720660 - DNA, 20 bp, Artificial
  CRISPR gRNA sequence
gttcccttccatgtcggcct

SEQ ID NO: 720661 - DNA, 20 bp, Artificial
  CRISPR gRNA sequence
ccttccatgtcggcctcttc

SEQ ID NO: 720662 - DNA, 20 bp, Artificial
  CRISPR gRNA sequence
ccatgtcggcctcttcgtgt

SEQ ID NO: 720663 - DNA, 20 bp, Artificial
  CRISPR gRNA sequence
catgtcggcctcttcgtgtc

SEQ ID NO: 720664 - DNA, 20 bp, Artificial
  CRISPR gRNA sequence
ttcgtgtcttacctggggct

SEQ ID NO: 720665 - DNA, 20 bp, Artificial
  CRISPR gRNA sequence
cgtgtcttacctggggcttc

SEQ ID NO: 720666 - DNA, 20 bp, Artificial
  CRISPR gRNA sequence
gtgtcttacctggggcttcc

SEQ ID NO: 720667 - DNA, 20 bp, Artificial
  CRISPR gRNA sequence
acctggggcttcctcatggt

SEQ ID NO: 720668 - DNA, 20 bp, Artificial
  CRISPR gRNA sequence
cctggggcttcctcatggtc

SEQ ID NO: 720669 - DNA, 20 bp, Artificial
  CRISPR gRNA sequence
gggcttcctcatggtctggt

SEQ ID NO: 720670 - DNA, 20 bp, Artificial
  CRISPR gRNA sequence
cctcatggtctggtggttag

SEQ ID NO: 720671 - DNA, 20 bp, Artificial
  CRISPR gRNA sequence
ctcatggtctggtggttagg

SEQ ID NO: 720672 - DNA, 20 bp, Artificial
  CRISPR gRNA sequence
atggtctggtggttaggttc

SEQ ID NO: 720673 - DNA, 20 bp, Artificial
  CRISPR gRNA sequence
gtggttaggttctaaaggcg

SEQ ID NO: 720674 - DNA, 20 bp, Artificial
  CRISPR gRNA sequence
ggttctaaaggcgaagtctt

SEQ ID NO: 720675 - DNA, 20 bp, Artificial
  CRISPR gRNA sequence
taaaggcgaagtctttttct

SEQ ID NO: 720676 - DNA, 20 bp, Artificial
  CRISPR gRNA sequence
aaggcgaagtctttttctct

SEQ ID NO: 720677 - DNA, 20 bp, Artificial
  CRISPR gRNA sequence
tttctctttttttctttttt

SEQ ID NO: 720678 - DNA, 20 bp, Artificial
  CRISPR gRNA sequence
ttctctttttttcttttttt

SEQ ID NO: 720679 - DNA, 20 bp, Artificial
  CRISPR gRNA sequence
tctctttttttctttttttg

SEQ ID NO: 720680 - DNA, 20 bp, Artificial
  CRISPR gRNA sequence
ctctttttttctttttttgt

SEQ ID NO: 720681 - DNA, 20 bp, Artificial
  CRISPR gRNA sequence
tctttttttctttttttgta

SEQ ID NO: 720682 - DNA, 20 bp, Artificial
  CRISPR gRNA sequence
tttttttctttttttgtatt

SEQ ID NO: 720683 - DNA, 20 bp, Artificial
  CRISPR gRNA sequence
tttttctttttttgtatttt

SEQ ID NO: 720684 - DNA, 20 bp, Artificial
  CRISPR gRNA sequence
ttttctttttttgtattttt

SEQ ID NO: 720685 - DNA, 20 bp, Artificial
  CRISPR gRNA sequence
tttctttttttgtattttta

SEQ ID NO: 720686 - DNA, 20 bp, Artificial
  CRISPR gRNA sequence
ttctttttttgtatttttag

SEQ ID NO: 720687 - DNA, 20 bp, Artificial
  CRISPR gRNA sequence
tctttttttgtatttttagt

SEQ ID NO: 720688 - DNA, 20 bp, Artificial
  CRISPR gRNA sequence
ctttttttgtatttttagta

SEQ ID NO: 720689 - DNA, 20 bp, Artificial
  CRISPR gRNA sequence
tttttttgtatttttagtag

SEQ ID NO: 720690 - DNA, 20 bp, Artificial
  CRISPR gRNA sequence
tttttgtatttttagtagag

SEQ ID NO: 720691 - DNA, 20 bp, Artificial
  CRISPR gRNA sequence
ttttgtatttttagtagaga

SEQ ID NO: 720692 - DNA, 20 bp, Artificial
  CRISPR gRNA sequence
tttgtatttttagtagagac

SEQ ID NO: 720693 - DNA, 20 bp, Artificial
  CRISPR gRNA sequence
ttgtatttttagtagagacg

SEQ ID NO: 720694 - DNA, 20 bp, Artificial
  CRISPR gRNA sequence
tgtatttttagtagagacgg

SEQ ID NO: 720695 - DNA, 20 bp, Artificial
  CRISPR gRNA sequence
gtatttttagtagagacggg

SEQ ID NO: 720696 - DNA, 20 bp, Artificial
  CRISPR gRNA sequence
tatttttagtagagacgggg

SEQ ID NO: 720697 - DNA, 20 bp, Artificial
  CRISPR gRNA sequence
ttagtagagacggggtttca

SEQ ID NO: 720698 - DNA, 20 bp, Artificial
  CRISPR gRNA sequence
tagtagagacggggtttcac

SEQ ID NO: 720699 - DNA, 20 bp, Artificial
  CRISPR gRNA sequence
agtagagacggggtttcacc

SEQ ID NO: 720700 - DNA, 20 bp, Artificial
  CRISPR gRNA sequence
gtagagacggggtttcacca

SEQ ID NO: 720701 - DNA, 20 bp, Artificial
  CRISPR gRNA sequence
caccatgttggccaggctgg

SEQ ID NO: 720702 - DNA, 20 bp, Artificial
  CRISPR gRNA sequence
accatgttggccaggctggt

SEQ ID NO: 720703 - DNA, 20 bp, Artificial
  CRISPR gRNA sequence
gccaggctggtcccaaactc

SEQ ID NO: 720704 - DNA, 20 bp, Artificial
  CRISPR gRNA sequence
gtcccaaactcctggcctca

SEQ ID NO: 720705 - DNA, 20 bp, Artificial
  CRISPR gRNA sequence
ctggcctcaagtgatccgcc

SEQ ID NO: 720706 - DNA, 20 bp, Artificial
  CRISPR gRNA sequence
gcctcaagtgatccgccggc

SEQ ID NO: 720707 - DNA, 20 bp, Artificial
  CRISPR gRNA sequence
aagtgatccgccggccttgg

SEQ ID NO: 720708 - DNA, 20 bp, Artificial
  CRISPR gRNA sequence
ggcctcccaaagtgttggaa

SEQ ID NO: 720709 - DNA, 20 bp, Artificial
  CRISPR gRNA sequence
gcctcccaaagtgttggaat

SEQ ID NO: 720710 - DNA, 20 bp, Artificial
  CRISPR gRNA sequence
ccaaagtgttggaattacaa

SEQ ID NO: 720711 - DNA, 20 bp, Artificial
  CRISPR gRNA sequence
gaattacaagcatgagccat

SEQ ID NO: 720712 - DNA, 20 bp, Artificial
  CRISPR gRNA sequence
caagcatgagccattgcccc

SEQ ID NO: 720713 - DNA, 20 bp, Artificial
  CRISPR gRNA sequence
cccccggccataaaagtctt

SEQ ID NO: 720714 - DNA, 20 bp, Artificial
  CRISPR gRNA sequence
gagagagagagacagacaga

SEQ ID NO: 720715 - DNA, 20 bp, Artificial
  CRISPR gRNA sequence
agagagagagacagacagaa

SEQ ID NO: 720716 - DNA, 20 bp, Artificial
  CRISPR gRNA sequence
agagacagagagagacagag

SEQ ID NO: 720717 - DNA, 20 bp, Artificial
  CRISPR gRNA sequence
cttttatgacctggccttgg

SEQ ID NO: 720718 - DNA, 20 bp, Artificial
  CRISPR gRNA sequence
ttatgacctggccttggaag

SEQ ID NO: 720719 - DNA, 20 bp, Artificial
  CRISPR gRNA sequence
tatgacctggccttggaagt

SEQ ID NO: 720720 - DNA, 20 bp, Artificial
  CRISPR gRNA sequence
atgacctggccttggaagtc

SEQ ID NO: 720721 - DNA, 20 bp, Artificial
  CRISPR gRNA sequence
tgacctggccttggaagtca

SEQ ID NO: 720722 - DNA, 20 bp, Artificial
  CRISPR gRNA sequence
gccttggaagtcacacagaa

SEQ ID NO: 720723 - DNA, 20 bp, Artificial
  CRISPR gRNA sequence
ggaagtcacacagaacttct

SEQ ID NO: 720724 - DNA, 20 bp, Artificial
  CRISPR gRNA sequence
gaagtcacacagaacttcta

SEQ ID NO: 720725 - DNA, 20 bp, Artificial
  CRISPR gRNA sequence
ctaccactttctgtttgttg

SEQ ID NO: 720726 - DNA, 20 bp, Artificial
  CRISPR gRNA sequence
taccactttctgtttgttga

SEQ ID NO: 720727 - DNA, 20 bp, Artificial
  CRISPR gRNA sequence
ccactttctgtttgttgagg

SEQ ID NO: 720728 - DNA, 20 bp, Artificial
  CRISPR gRNA sequence
tctgtttgttgaggcaacca

SEQ ID NO: 720729 - DNA, 20 bp, Artificial
  CRISPR gRNA sequence
ctgtttgttgaggcaaccac

SEQ ID NO: 720730 - DNA, 20 bp, Artificial
  CRISPR gRNA sequence
tgtttgttgaggcaaccaca

SEQ ID NO: 720731 - DNA, 20 bp, Artificial
  CRISPR gRNA sequence
tttgttgaggcaaccacaaa

SEQ ID NO: 720732 - DNA, 20 bp, Artificial
  CRISPR gRNA sequence
gttgaggcaaccacaaatgt

SEQ ID NO: 720733 - DNA, 20 bp, Artificial
  CRISPR gRNA sequence
ttgaggcaaccacaaatgtc

SEQ ID NO: 720734 - DNA, 20 bp, Artificial
  CRISPR gRNA sequence
aggcaaccacaaatgtcact

SEQ ID NO: 720735 - DNA, 20 bp, Artificial
  CRISPR gRNA sequence
gagaccaagggaaggaaaac

SEQ ID NO: 720736 - DNA, 20 bp, Artificial
  CRISPR gRNA sequence
agaccaagggaaggaaaaca

SEQ ID NO: 720737 - DNA, 20 bp, Artificial
  CRISPR gRNA sequence
tacttcttgacaggtaggtg

SEQ ID NO: 720738 - DNA, 20 bp, Artificial
  CRISPR gRNA sequence
cttgacaggtaggtggcaaa

SEQ ID NO: 720739 - DNA, 20 bp, Artificial
  CRISPR gRNA sequence
ttgacaggtaggtggcaaag

SEQ ID NO: 720740 - DNA, 20 bp, Artificial
  CRISPR gRNA sequence
gacaggtaggtggcaaaggc

SEQ ID NO: 720741 - DNA, 20 bp, Artificial
  CRISPR gRNA sequence
acaggtaggtggcaaaggct

SEQ ID NO: 720742 - DNA, 20 bp, Artificial
  CRISPR gRNA sequence
tggaagggccagaacatcac

SEQ ID NO: 720743 - DNA, 20 bp, Artificial
  CRISPR gRNA sequence
gaagggccagaacatcactg

SEQ ID NO: 720744 - DNA, 20 bp, Artificial
  CRISPR gRNA sequence
cagccatgttttggggaaat

SEQ ID NO: 720745 - DNA, 20 bp, Artificial
  CRISPR gRNA sequence
tggggaaatacagtctgcca

SEQ ID NO: 720746 - DNA, 20 bp, Artificial
  CRISPR gRNA sequence
ggggaaatacagtctgccac

SEQ ID NO: 720747 - DNA, 20 bp, Artificial
  CRISPR gRNA sequence
gggaaatacagtctgccaca

SEQ ID NO: 720748 - DNA, 20 bp, Artificial
  CRISPR gRNA sequence
ccacaaccaccatgtggaca

SEQ ID NO: 720749 - DNA, 20 bp, Artificial
  CRISPR gRNA sequence
gctctgggcccagtaattcc

SEQ ID NO: 720750 - DNA, 20 bp, Artificial
  CRISPR gRNA sequence
tgggcccagtaattccttca

SEQ ID NO: 720751 - DNA, 20 bp, Artificial
  CRISPR gRNA sequence
ggcccagtaattccttcagc

SEQ ID NO: 720752 - DNA, 20 bp, Artificial
  CRISPR gRNA sequence
cttcagctctcctaactgaa

SEQ ID NO: 720753 - DNA, 20 bp, Artificial
  CRISPR gRNA sequence
cagctctcctaactgaaacc

SEQ ID NO: 720754 - DNA, 20 bp, Artificial
  CRISPR gRNA sequence
agctctcctaactgaaaccc

SEQ ID NO: 720755 - DNA, 20 bp, Artificial
  CRISPR gRNA sequence
tcctaactgaaaccccacga

SEQ ID NO: 720756 - DNA, 20 bp, Artificial
  CRISPR gRNA sequence
ctaactgaaaccccacgagg

SEQ ID NO: 720757 - DNA, 20 bp, Artificial
  CRISPR gRNA sequence
actgaaaccccacgaggcag

SEQ ID NO: 720758 - DNA, 20 bp, Artificial
  CRISPR gRNA sequence
aaaccccacgaggcagtgga

SEQ ID NO: 720759 - DNA, 20 bp, Artificial
  CRISPR gRNA sequence
gtagctaaaggcatgagctc

SEQ ID NO: 720760 - DNA, 20 bp, Artificial
  CRISPR gRNA sequence
aaggcatgagctctagaacc

SEQ ID NO: 720761 - DNA, 20 bp, Artificial
  CRISPR gRNA sequence
tagaacccgagtgccgggtt

SEQ ID NO: 720762 - DNA, 20 bp, Artificial
  CRISPR gRNA sequence
gaacccgagtgccgggttca

SEQ ID NO: 720763 - DNA, 20 bp, Artificial
  CRISPR gRNA sequence
agatcccgcctctcccactt

SEQ ID NO: 720764 - DNA, 20 bp, Artificial
  CRISPR gRNA sequence
tcccacttgatagcctataa

SEQ ID NO: 720765 - DNA, 20 bp, Artificial
  CRISPR gRNA sequence
ccacttgatagcctataacc

SEQ ID NO: 720766 - DNA, 20 bp, Artificial
  CRISPR gRNA sequence
gatagcctataacctcaagc

SEQ ID NO: 720767 - DNA, 20 bp, Artificial
  CRISPR gRNA sequence
atagcctataacctcaagca

SEQ ID NO: 720768 - DNA, 20 bp, Artificial
  CRISPR gRNA sequence
taacctcaagcaggtttcct

SEQ ID NO: 720769 - DNA, 20 bp, Artificial
  CRISPR gRNA sequence
aagcaggtttcctaacctct

SEQ ID NO: 720770 - DNA, 20 bp, Artificial
  CRISPR gRNA sequence
cctaacctctctgtgcctca

SEQ ID NO: 720771 - DNA, 20 bp, Artificial
  CRISPR gRNA sequence
ctaacctctctgtgcctcag

SEQ ID NO: 720772 - DNA, 20 bp, Artificial
  CRISPR gRNA sequence
acctctctgtgcctcagttt

SEQ ID NO: 720773 - DNA, 20 bp, Artificial
  CRISPR gRNA sequence
tctgtgcctcagtttcctct

SEQ ID NO: 720774 - DNA, 20 bp, Artificial
  CRISPR gRNA sequence
tgtgcctcagtttcctctgc

SEQ ID NO: 720775 - DNA, 20 bp, Artificial
  CRISPR gRNA sequence
tgcctcagtttcctctgctg

SEQ ID NO: 720776 - DNA, 20 bp, Artificial
  CRISPR gRNA sequence
agtttcctctgctgcaaaat

SEQ ID NO: 720777 - DNA, 20 bp, Artificial
  CRISPR gRNA sequence
cctctgctgcaaaatgggca

SEQ ID NO: 720778 - DNA, 20 bp, Artificial
  CRISPR gRNA sequence
ctctgctgcaaaatgggcat

SEQ ID NO: 720779 - DNA, 20 bp, Artificial
  CRISPR gRNA sequence
tgctgcaaaatgggcatagt

SEQ ID NO: 720780 - DNA, 20 bp, Artificial
  CRISPR gRNA sequence
ctgcaaaatgggcatagtat

SEQ ID NO: 720781 - DNA, 20 bp, Artificial
  CRISPR gRNA sequence
caaaatgggcatagtattat

SEQ ID NO: 720782 - DNA, 20 bp, Artificial
  CRISPR gRNA sequence
tctatctcagagaaccatgt

SEQ ID NO: 720783 - DNA, 20 bp, Artificial
  CRISPR gRNA sequence
tctcagagaaccatgtgaga

SEQ ID NO: 720784 - DNA, 20 bp, Artificial
  CRISPR gRNA sequence
agagaaccatgtgagaattg

SEQ ID NO: 720785 - DNA, 20 bp, Artificial
  CRISPR gRNA sequence
aatacatgattgtaggttaa

SEQ ID NO: 720786 - DNA, 20 bp, Artificial
  CRISPR gRNA sequence
taggttaatctgggtagagt

SEQ ID NO: 720787 - DNA, 20 bp, Artificial
  CRISPR gRNA sequence
atctgggtagagtgctgaga

SEQ ID NO: 720788 - DNA, 20 bp, Artificial
  CRISPR gRNA sequence
ggtagagtgctgagactact

SEQ ID NO: 720789 - DNA, 20 bp, Artificial
  CRISPR gRNA sequence
agactactgtctcacacata

SEQ ID NO: 720790 - DNA, 20 bp, Artificial
  CRISPR gRNA sequence
ctgtctcacacatactcagt

SEQ ID NO: 720791 - DNA, 20 bp, Artificial
  CRISPR gRNA sequence
tctcacacatactcagttat

SEQ ID NO: 720792 - DNA, 20 bp, Artificial
  CRISPR gRNA sequence
acacatactcagttatctta

SEQ ID NO: 720793 - DNA, 20 bp, Artificial
  CRISPR gRNA sequence
agttatcttaagagctataa

SEQ ID NO: 720794 - DNA, 20 bp, Artificial
  CRISPR gRNA sequence
tcttaagagctataataata

SEQ ID NO: 720795 - DNA, 20 bp, Artificial
  CRISPR gRNA sequence
aagagctataataataatga

SEQ ID NO: 720796 - DNA, 20 bp, Artificial
  CRISPR gRNA sequence
agagctataataataatgat

SEQ ID NO: 720797 - DNA, 20 bp, Artificial
  CRISPR gRNA sequence
taataataatgataatagct

SEQ ID NO: 720798 - DNA, 20 bp, Artificial
  CRISPR gRNA sequence
ccattgtcccaaatggtttc

SEQ ID NO: 720799 - DNA, 20 bp, Artificial
  CRISPR gRNA sequence
tcccaaatggtttcattcat

SEQ ID NO: 720800 - DNA, 20 bp, Artificial
  CRISPR gRNA sequence
cattcattgctgagctcaca

SEQ ID NO: 720801 - DNA, 20 bp, Artificial
  CRISPR gRNA sequence
attcattgctgagctcacac

SEQ ID NO: 720802 - DNA, 20 bp, Artificial
  CRISPR gRNA sequence
attgctgagctcacacacac

SEQ ID NO: 720803 - DNA, 20 bp, Artificial
  CRISPR gRNA sequence
ctgagctcacacacaccctt

SEQ ID NO: 720804 - DNA, 20 bp, Artificial
  CRISPR gRNA sequence
agctcacacacaccctttgc

SEQ ID NO: 720805 - DNA, 20 bp, Artificial
  CRISPR gRNA sequence
acacacaccctttgcacaaa

SEQ ID NO: 720806 - DNA, 20 bp, Artificial
  CRISPR gRNA sequence
tgcacaaattccccaaatcc

SEQ ID NO: 720807 - DNA, 20 bp, Artificial
  CRISPR gRNA sequence
gcacaaattccccaaatcct

SEQ ID NO: 720808 - DNA, 20 bp, Artificial
  CRISPR gRNA sequence
cacaaattccccaaatcctg

SEQ ID NO: 720809 - DNA, 20 bp, Artificial
  CRISPR gRNA sequence
cccaaatcctgcccagttcc

SEQ ID NO: 720810 - DNA, 20 bp, Artificial
  CRISPR gRNA sequence
cccagttcccttgctctgga

SEQ ID NO: 720811 - DNA, 20 bp, Artificial
  CRISPR gRNA sequence
ccttgctctggatgttgtaa

SEQ ID NO: 720812 - DNA, 20 bp, Artificial
  CRISPR gRNA sequence
gctctggatgttgtaagaag

SEQ ID NO: 720813 - DNA, 20 bp, Artificial
  CRISPR gRNA sequence
ctctggatgttgtaagaaga

SEQ ID NO: 720814 - DNA, 20 bp, Artificial
  CRISPR gRNA sequence
tggatgttgtaagaagagac

SEQ ID NO: 720815 - DNA, 20 bp, Artificial
  CRISPR gRNA sequence
gatgttgtaagaagagactg

SEQ ID NO: 720816 - DNA, 20 bp, Artificial
  CRISPR gRNA sequence
taagaagagactgtccagcc

SEQ ID NO: 720817 - DNA, 20 bp, Artificial
  CRISPR gRNA sequence
tccagcccttatcattatca

SEQ ID NO: 720818 - DNA, 20 bp, Artificial
  CRISPR gRNA sequence
atcattatcatgctgggtct

SEQ ID NO: 720819 - DNA, 20 bp, Artificial
  CRISPR gRNA sequence
tcattatcatgctgggtctc

SEQ ID NO: 720820 - DNA, 20 bp, Artificial
  CRISPR gRNA sequence
tcatgctgggtctctaagta

SEQ ID NO: 720821 - DNA, 20 bp, Artificial
  CRISPR gRNA sequence
ggtctctaagtatcctgctg

SEQ ID NO: 720822 - DNA, 20 bp, Artificial
  CRISPR gRNA sequence
taagtatcctgctgattgag

SEQ ID NO: 720823 - DNA, 20 bp, Artificial
  CRISPR gRNA sequence
agtatcctgctgattgagat

SEQ ID NO: 720824 - DNA, 20 bp, Artificial
  CRISPR gRNA sequence
ctgattgagatctaccctcg

SEQ ID NO: 720825 - DNA, 20 bp, Artificial
  CRISPR gRNA sequence
attgagatctaccctcgcgg

SEQ ID NO: 720826 - DNA, 20 bp, Artificial
  CRISPR gRNA sequence
agatctaccctcgcggagag

SEQ ID NO: 720827 - DNA, 20 bp, Artificial
  CRISPR gRNA sequence
ccctcgcggagaggtcccat

SEQ ID NO: 720828 - DNA, 20 bp, Artificial
  CRISPR gRNA sequence
gcggagaggtcccatttgcc

SEQ ID NO: 720829 - DNA, 20 bp, Artificial
  CRISPR gRNA sequence
gcctaatctactgatgcagt

SEQ ID NO: 720830 - DNA, 20 bp, Artificial
  CRISPR gRNA sequence
cctaatctactgatgcagtc

SEQ ID NO: 720831 - DNA, 20 bp, Artificial
  CRISPR gRNA sequence
atctactgatgcagtcgttc

SEQ ID NO: 720832 - DNA, 20 bp, Artificial
  CRISPR gRNA sequence
ctgatgcagtcgttctgtat

SEQ ID NO: 720833 - DNA, 20 bp, Artificial
  CRISPR gRNA sequence
atgcagtcgttctgtattta

SEQ ID NO: 720834 - DNA, 20 bp, Artificial
  CRISPR gRNA sequence
tgtatttacctctaagtgga

SEQ ID NO: 720835 - DNA, 20 bp, Artificial
  CRISPR gRNA sequence
tatttacctctaagtggagc

SEQ ID NO: 720836 - DNA, 20 bp, Artificial
  CRISPR gRNA sequence
acctctaagtggagcgttgc

SEQ ID NO: 720837 - DNA, 20 bp, Artificial
  CRISPR gRNA sequence
cctctaagtggagcgttgca

SEQ ID NO: 720838 - DNA, 20 bp, Artificial
  CRISPR gRNA sequence
taagtggagcgttgcaaaat

SEQ ID NO: 720839 - DNA, 20 bp, Artificial
  CRISPR gRNA sequence
agtggagcgttgcaaaatat

SEQ ID NO: 720840 - DNA, 20 bp, Artificial
  CRISPR gRNA sequence
caaaatattcccgaatacgt

SEQ ID NO: 720841 - DNA, 20 bp, Artificial
  CRISPR gRNA sequence
ccgaatacgtacaaatgcat

SEQ ID NO: 720842 - DNA, 20 bp, Artificial
  CRISPR gRNA sequence
ttacacttattaaaaataat

SEQ ID NO: 720843 - DNA, 20 bp, Artificial
  CRISPR gRNA sequence
cacttattaaaaataatacc

SEQ ID NO: 720844 - DNA, 20 bp, Artificial
  CRISPR gRNA sequence
attaaaaataatacctctaa

SEQ ID NO: 720845 - DNA, 20 bp, Artificial
  CRISPR gRNA sequence
ttaaaaataatacctctaac

SEQ ID NO: 720846 - DNA, 20 bp, Artificial
  CRISPR gRNA sequence
aaaataatacctctaacatg

SEQ ID NO: 720847 - DNA, 20 bp, Artificial
  CRISPR gRNA sequence
taacatggtttttttttgct

SEQ ID NO: 720848 - DNA, 20 bp, Artificial
  CRISPR gRNA sequence
acatggtttttttttgcttt

SEQ ID NO: 720849 - DNA, 20 bp, Artificial
  CRISPR gRNA sequence
ttttttgcttttggaggaaa

SEQ ID NO: 720850 - DNA, 20 bp, Artificial
  CRISPR gRNA sequence
tttttgcttttggaggaaaa

SEQ ID NO: 720851 - DNA, 20 bp, Artificial
  CRISPR gRNA sequence
ttttgcttttggaggaaaaa

SEQ ID NO: 720852 - DNA, 20 bp, Artificial
  CRISPR gRNA sequence
tttgcttttggaggaaaaaa

SEQ ID NO: 720853 - DNA, 20 bp, Artificial
  CRISPR gRNA sequence
ttgcttttggaggaaaaaaa

SEQ ID NO: 720854 - DNA, 20 bp, Artificial
  CRISPR gRNA sequence
tgcttttggaggaaaaaaaa

SEQ ID NO: 720855 - DNA, 20 bp, Artificial
  CRISPR gRNA sequence
gcttttggaggaaaaaaaat

SEQ ID NO: 720856 - DNA, 20 bp, Artificial
  CRISPR gRNA sequence
cttttggaggaaaaaaaatc

SEQ ID NO: 720857 - DNA, 20 bp, Artificial
  CRISPR gRNA sequence
ttggaggaaaaaaaatcttt

SEQ ID NO: 720858 - DNA, 20 bp, Artificial
  CRISPR gRNA sequence
tggaggaaaaaaaatctttt

SEQ ID NO: 720859 - DNA, 20 bp, Artificial
  CRISPR gRNA sequence
ggaggaaaaaaaatcttttt

SEQ ID NO: 720860 - DNA, 20 bp, Artificial
  CRISPR gRNA sequence
gaggaaaaaaaatctttttt

SEQ ID NO: 720861 - DNA, 20 bp, Artificial
  CRISPR gRNA sequence
tttttttttttttttttttt

SEQ ID NO: 720862 - DNA, 20 bp, Artificial
  CRISPR gRNA sequence
tttttttttttttttttttt

SEQ ID NO: 720863 - DNA, 20 bp, Artificial
  CRISPR gRNA sequence
tttttttttttttttttttt

SEQ ID NO: 720864 - DNA, 20 bp, Artificial
  CRISPR gRNA sequence
tttttttttttttttttttt

SEQ ID NO: 720865 - DNA, 20 bp, Artificial
  CRISPR gRNA sequence
tttttttttttttttttttt

SEQ ID NO: 720866 - DNA, 20 bp, Artificial
  CRISPR gRNA sequence
tttttttttttttttttttt

SEQ ID NO: 720867 - DNA, 20 bp, Artificial
  CRISPR gRNA sequence
tttttttttttttttttttt

SEQ ID NO: 720868 - DNA, 20 bp, Artificial
  CRISPR gRNA sequence
tttttttttttttttttttt

SEQ ID NO: 720869 - DNA, 20 bp, Artificial
  CRISPR gRNA sequence
ttttttttttttttttttta

SEQ ID NO: 720870 - DNA, 20 bp, Artificial
  CRISPR gRNA sequence
ttttttttttttttttttaa

SEQ ID NO: 720871 - DNA, 20 bp, Artificial
  CRISPR gRNA sequence
tttttttttttttttttaaa

SEQ ID NO: 720872 - DNA, 20 bp, Artificial
  CRISPR gRNA sequence
ttttttttttttttttaaat

SEQ ID NO: 720873 - DNA, 20 bp, Artificial
  CRISPR gRNA sequence
tttttttttttttttaaata

SEQ ID NO: 720874 - DNA, 20 bp, Artificial
  CRISPR gRNA sequence
ttttttttttttttaaatag

SEQ ID NO: 720875 - DNA, 20 bp, Artificial
  CRISPR gRNA sequence
tttttttttttttaaataga

SEQ ID NO: 720876 - DNA, 20 bp, Artificial
  CRISPR gRNA sequence
ttttttttttttaaatagac

SEQ ID NO: 720877 - DNA, 20 bp, Artificial
  CRISPR gRNA sequence
tttttttttttaaatagaca

SEQ ID NO: 720878 - DNA, 20 bp, Artificial
  CRISPR gRNA sequence
ttttttttttaaatagacag

SEQ ID NO: 720879 - DNA, 20 bp, Artificial
  CRISPR gRNA sequence
tttttttttaaatagacaga

SEQ ID NO: 720880 - DNA, 20 bp, Artificial
  CRISPR gRNA sequence
ttttttttaaatagacagag

SEQ ID NO: 720881 - DNA, 20 bp, Artificial
  CRISPR gRNA sequence
tttttttaaatagacagagt

SEQ ID NO: 720882 - DNA, 20 bp, Artificial
  CRISPR gRNA sequence
ttttttaaatagacagagtc

SEQ ID NO: 720883 - DNA, 20 bp, Artificial
  CRISPR gRNA sequence
tttttaaatagacagagtct

SEQ ID NO: 720884 - DNA, 20 bp, Artificial
  CRISPR gRNA sequence
ttttaaatagacagagtctt

SEQ ID NO: 720885 - DNA, 20 bp, Artificial
  CRISPR gRNA sequence
tttaaatagacagagtcttg

SEQ ID NO: 720886 - DNA, 20 bp, Artificial
  CRISPR gRNA sequence
ttaaatagacagagtcttgt

SEQ ID NO: 720887 - DNA, 20 bp, Artificial
  CRISPR gRNA sequence
taaatagacagagtcttgtt

SEQ ID NO: 720888 - DNA, 20 bp, Artificial
  CRISPR gRNA sequence
aaatagacagagtcttgttc

SEQ ID NO: 720889 - DNA, 20 bp, Artificial
  CRISPR gRNA sequence
aatagacagagtcttgttct

SEQ ID NO: 720890 - DNA, 20 bp, Artificial
  CRISPR gRNA sequence
gttctgtcgcccaggctgga

SEQ ID NO: 720891 - DNA, 20 bp, Artificial
  CRISPR gRNA sequence
ttctgtcgcccaggctggag

SEQ ID NO: 720892 - DNA, 20 bp, Artificial
  CRISPR gRNA sequence
tgtcgcccaggctggagtgc

SEQ ID NO: 720893 - DNA, 20 bp, Artificial
  CRISPR gRNA sequence
tcgcccaggctggagtgcag

SEQ ID NO: 720894 - DNA, 20 bp, Artificial
  CRISPR gRNA sequence
gagtgcagtggcactatctt

SEQ ID NO: 720895 - DNA, 20 bp, Artificial
  CRISPR gRNA sequence
tcttggctcactgcaacctc

SEQ ID NO: 720896 - DNA, 20 bp, Artificial
  CRISPR gRNA sequence
ggctcactgcaacctctgcc

SEQ ID NO: 720897 - DNA, 20 bp, Artificial
  CRISPR gRNA sequence
gctcactgcaacctctgcct

SEQ ID NO: 720898 - DNA, 20 bp, Artificial
  CRISPR gRNA sequence
actgcaacctctgcctccca

SEQ ID NO: 720899 - DNA, 20 bp, Artificial
  CRISPR gRNA sequence
caacctctgcctcccaggtt

SEQ ID NO: 720900 - DNA, 20 bp, Artificial
  CRISPR gRNA sequence
tgcctcccaggttcaagtga

SEQ ID NO: 720901 - DNA, 20 bp, Artificial
  CRISPR gRNA sequence
cctcccaggttcaagtgatt

SEQ ID NO: 720902 - DNA, 20 bp, Artificial
  CRISPR gRNA sequence
ccaggttcaagtgattctcc

SEQ ID NO: 720903 - DNA, 20 bp, Artificial
  CRISPR gRNA sequence
aagtgattctcctgcctcag

SEQ ID NO: 720904 - DNA, 20 bp, Artificial
  CRISPR gRNA sequence
tcctgcctcagcctcctgag

SEQ ID NO: 720905 - DNA, 20 bp, Artificial
  CRISPR gRNA sequence
ctgcctcagcctcctgagta

SEQ ID NO: 720906 - DNA, 20 bp, Artificial
  CRISPR gRNA sequence
cctcagcctcctgagtagct

SEQ ID NO: 720907 - DNA, 20 bp, Artificial
  CRISPR gRNA sequence
agcctcctgagtagctggga

SEQ ID NO: 720908 - DNA, 20 bp, Artificial
  CRISPR gRNA sequence
ctgagtagctgggattacag

SEQ ID NO: 720909 - DNA, 20 bp, Artificial
  CRISPR gRNA sequence
agtagctgggattacaggca

SEQ ID NO: 720910 - DNA, 20 bp, Artificial
  CRISPR gRNA sequence
ggattacaggcacgtgccac

SEQ ID NO: 720911 - DNA, 20 bp, Artificial
  CRISPR gRNA sequence
caggcacgtgccaccaggca

SEQ ID NO: 720912 - DNA, 20 bp, Artificial
  CRISPR gRNA sequence
atttttgtatttttagtaga

SEQ ID NO: 720913 - DNA, 20 bp, Artificial
  CRISPR gRNA sequence
ttgtatttttagtagagacg

SEQ ID NO: 720914 - DNA, 20 bp, Artificial
  CRISPR gRNA sequence
tgtatttttagtagagacgg

SEQ ID NO: 720915 - DNA, 20 bp, Artificial
  CRISPR gRNA sequence
gtatttttagtagagacggg

SEQ ID NO: 720916 - DNA, 20 bp, Artificial
  CRISPR gRNA sequence
tatttttagtagagacgggg

SEQ ID NO: 720917 - DNA, 20 bp, Artificial
  CRISPR gRNA sequence
ttagtagagacggggtttca

SEQ ID NO: 720918 - DNA, 20 bp, Artificial
  CRISPR gRNA sequence
tagtagagacggggtttcac

SEQ ID NO: 720919 - DNA, 20 bp, Artificial
  CRISPR gRNA sequence
agtagagacggggtttcacc

SEQ ID NO: 720920 - DNA, 20 bp, Artificial
  CRISPR gRNA sequence
gtagagacggggtttcacca

SEQ ID NO: 720921 - DNA, 20 bp, Artificial
  CRISPR gRNA sequence
caccatgttggtcaggctgg

SEQ ID NO: 720922 - DNA, 20 bp, Artificial
  CRISPR gRNA sequence
accatgttggtcaggctgga

SEQ ID NO: 720923 - DNA, 20 bp, Artificial
  CRISPR gRNA sequence
gtcaggctggacttgaactc

SEQ ID NO: 720924 - DNA, 20 bp, Artificial
  CRISPR gRNA sequence
gacttgaactcctgaccttg

SEQ ID NO: 720925 - DNA, 20 bp, Artificial
  CRISPR gRNA sequence
gaactcctgaccttgtgatc

SEQ ID NO: 720926 - DNA, 20 bp, Artificial
  CRISPR gRNA sequence
aactcctgaccttgtgatct

SEQ ID NO: 720927 - DNA, 20 bp, Artificial
  CRISPR gRNA sequence
ctgaccttgtgatctgcctg

SEQ ID NO: 720928 - DNA, 20 bp, Artificial
  CRISPR gRNA sequence
accttgtgatctgcctgcct

SEQ ID NO: 720929 - DNA, 20 bp, Artificial
  CRISPR gRNA sequence
gtgatctgcctgcctcggcc

SEQ ID NO: 720930 - DNA, 20 bp, Artificial
  CRISPR gRNA sequence
tgatctgcctgcctcggcct

SEQ ID NO: 720931 - DNA, 20 bp, Artificial
  CRISPR gRNA sequence
cctgcctcggcctcccaaag

SEQ ID NO: 720932 - DNA, 20 bp, Artificial
  CRISPR gRNA sequence
cctcggcctcccaaagtgcc

SEQ ID NO: 720933 - DNA, 20 bp, Artificial
  CRISPR gRNA sequence
ggcctcccaaagtgccggga

SEQ ID NO: 720934 - DNA, 20 bp, Artificial
  CRISPR gRNA sequence
ccaaagtgccgggattacag

SEQ ID NO: 720935 - DNA, 20 bp, Artificial
  CRISPR gRNA sequence
cagtcgtgagccaccgtgtc

SEQ ID NO: 720936 - DNA, 20 bp, Artificial
  CRISPR gRNA sequence
gccaaaaaatctttttatta

SEQ ID NO: 720937 - DNA, 20 bp, Artificial
  CRISPR gRNA sequence
tttattattaaaaatttcaa

SEQ ID NO: 720938 - DNA, 20 bp, Artificial
  CRISPR gRNA sequence
ttattattaaaaatttcaaa

SEQ ID NO: 720939 - DNA, 20 bp, Artificial
  CRISPR gRNA sequence
tattattaaaaatttcaaac

SEQ ID NO: 720940 - DNA, 20 bp, Artificial
  CRISPR gRNA sequence
attattaaaaatttcaaaca

SEQ ID NO: 720941 - DNA, 20 bp, Artificial
  CRISPR gRNA sequence
ttattaaaaatttcaaacat

SEQ ID NO: 720942 - DNA, 20 bp, Artificial
  CRISPR gRNA sequence
ttaaaaatttcaaacatatt

SEQ ID NO: 720943 - DNA, 20 bp, Artificial
  CRISPR gRNA sequence
aaaatttcaaacatattcag

SEQ ID NO: 720944 - DNA, 20 bp, Artificial
  CRISPR gRNA sequence
caaacatattcagatgtaga

SEQ ID NO: 720945 - DNA, 20 bp, Artificial
  CRISPR gRNA sequence
aaacatattcagatgtagag

SEQ ID NO: 720946 - DNA, 20 bp, Artificial
  CRISPR gRNA sequence
agatgtagagtgagtcagag

SEQ ID NO: 720947 - DNA, 20 bp, Artificial
  CRISPR gRNA sequence
cgtactatcacccagcttta

SEQ ID NO: 720948 - DNA, 20 bp, Artificial
  CRISPR gRNA sequence
tcacccagctttaaacggtt

SEQ ID NO: 720949 - DNA, 20 bp, Artificial
  CRISPR gRNA sequence
taaacggttatggagtcatg

SEQ ID NO: 720950 - DNA, 20 bp, Artificial
  CRISPR gRNA sequence
aaacggttatggagtcatgg

SEQ ID NO: 720951 - DNA, 20 bp, Artificial
  CRISPR gRNA sequence
aacggttatggagtcatggc

SEQ ID NO: 720952 - DNA, 20 bp, Artificial
  CRISPR gRNA sequence
tggagtcatggccagtcttg

SEQ ID NO: 720953 - DNA, 20 bp, Artificial
  CRISPR gRNA sequence
ggctcctctgcacccatgcc

SEQ ID NO: 720954 - DNA, 20 bp, Artificial
  CRISPR gRNA sequence
gctcctctgcacccatgccc

SEQ ID NO: 720955 - DNA, 20 bp, Artificial
  CRISPR gRNA sequence
ctctgcacccatgcccgctc

SEQ ID NO: 720956 - DNA, 20 bp, Artificial
  CRISPR gRNA sequence
tgcacccatgcccgctcacc

SEQ ID NO: 720957 - DNA, 20 bp, Artificial
  CRISPR gRNA sequence
cacccatgcccgctcacccc

SEQ ID NO: 720958 - DNA, 20 bp, Artificial
  CRISPR gRNA sequence
accccgtcccctggaggact

SEQ ID NO: 720959 - DNA, 20 bp, Artificial
  CRISPR gRNA sequence
gaggactttcttttaacagc

SEQ ID NO: 720960 - DNA, 20 bp, Artificial
  CRISPR gRNA sequence
tcttttaacagctttaggga

SEQ ID NO: 720961 - DNA, 20 bp, Artificial
  CRISPR gRNA sequence
cttttaacagctttagggag

SEQ ID NO: 720962 - DNA, 20 bp, Artificial
  CRISPR gRNA sequence
ttttaacagctttagggaga

SEQ ID NO: 720963 - DNA, 20 bp, Artificial
  CRISPR gRNA sequence
ttaacagctttagggagaga

SEQ ID NO: 720964 - DNA, 20 bp, Artificial
  CRISPR gRNA sequence
taacagctttagggagagat

SEQ ID NO: 720965 - DNA, 20 bp, Artificial
  CRISPR gRNA sequence
aacagctttagggagagata

SEQ ID NO: 720966 - DNA, 20 bp, Artificial
  CRISPR gRNA sequence
acagctttagggagagatag

SEQ ID NO: 720967 - DNA, 20 bp, Artificial
  CRISPR gRNA sequence
tagggagagatagtgggcat

SEQ ID NO: 720968 - DNA, 20 bp, Artificial
  CRISPR gRNA sequence
agggagagatagtgggcata

SEQ ID NO: 720969 - DNA, 20 bp, Artificial
  CRISPR gRNA sequence
gggagagatagtgggcatat

SEQ ID NO: 720970 - DNA, 20 bp, Artificial
  CRISPR gRNA sequence
aaggatgcaatctgataagt

SEQ ID NO: 720971 - DNA, 20 bp, Artificial
  CRISPR gRNA sequence
ataagttttaacaaatgcat

SEQ ID NO: 720972 - DNA, 20 bp, Artificial
  CRISPR gRNA sequence
taacaaatgcatgcagctga

SEQ ID NO: 720973 - DNA, 20 bp, Artificial
  CRISPR gRNA sequence
aacaaatgcatgcagctgag

SEQ ID NO: 720974 - DNA, 20 bp, Artificial
  CRISPR gRNA sequence
acaaatgcatgcagctgagc

SEQ ID NO: 720975 - DNA, 20 bp, Artificial
  CRISPR gRNA sequence
agcaaccagccatccccctc

SEQ ID NO: 720976 - DNA, 20 bp, Artificial
  CRISPR gRNA sequence
taaaagttacctcgggttgc

SEQ ID NO: 720977 - DNA, 20 bp, Artificial
  CRISPR gRNA sequence
aaagttacctcgggttgctt

SEQ ID NO: 720978 - DNA, 20 bp, Artificial
  CRISPR gRNA sequence
cctcgggttgcttgtcacca

SEQ ID NO: 720979 - DNA, 20 bp, Artificial
  CRISPR gRNA sequence
gggttgcttgtcaccatttc

SEQ ID NO: 720980 - DNA, 20 bp, Artificial
  CRISPR gRNA sequence
cttgtcaccatttcccatcc

SEQ ID NO: 720981 - DNA, 20 bp, Artificial
  CRISPR gRNA sequence
gtcaccatttcccatcccct

SEQ ID NO: 720982 - DNA, 20 bp, Artificial
  CRISPR gRNA sequence
tcaccatttcccatcccctg

SEQ ID NO: 720983 - DNA, 20 bp, Artificial
  CRISPR gRNA sequence
cccatcccctgcttatggtc

SEQ ID NO: 720984 - DNA, 20 bp, Artificial
  CRISPR gRNA sequence
ccatcccctgcttatggtca

SEQ ID NO: 720985 - DNA, 20 bp, Artificial
  CRISPR gRNA sequence
cttatggtcaccatgcaata

SEQ ID NO: 720986 - DNA, 20 bp, Artificial
  CRISPR gRNA sequence
atggtcaccatgcaatagct

SEQ ID NO: 720987 - DNA, 20 bp, Artificial
  CRISPR gRNA sequence
tggtcaccatgcaatagctt

SEQ ID NO: 720988 - DNA, 20 bp, Artificial
  CRISPR gRNA sequence
gcatgtaaatgcgacataca

SEQ ID NO: 720989 - DNA, 20 bp, Artificial
  CRISPR gRNA sequence
catgtaaatgcgacatacag

SEQ ID NO: 720990 - DNA, 20 bp, Artificial
  CRISPR gRNA sequence
gctttttgcctgccttcttt

SEQ ID NO: 720991 - DNA, 20 bp, Artificial
  CRISPR gRNA sequence
tttgcctgccttctttcacc

SEQ ID NO: 720992 - DNA, 20 bp, Artificial
  CRISPR gRNA sequence
ttgcctgccttctttcaccc

SEQ ID NO: 720993 - DNA, 20 bp, Artificial
  CRISPR gRNA sequence
tgcctgccttctttcaccct

SEQ ID NO: 720994 - DNA, 20 bp, Artificial
  CRISPR gRNA sequence
gcctgccttctttcaccctg

SEQ ID NO: 720995 - DNA, 20 bp, Artificial
  CRISPR gRNA sequence
cctgccttctttcaccctgc

SEQ ID NO: 720996 - DNA, 20 bp, Artificial
  CRISPR gRNA sequence
ccttctttcaccctgcagaa

SEQ ID NO: 720997 - DNA, 20 bp, Artificial
  CRISPR gRNA sequence
ctttcaccctgcagaattat

SEQ ID NO: 720998 - DNA, 20 bp, Artificial
  CRISPR gRNA sequence
tttcaccctgcagaattatt

SEQ ID NO: 720999 - DNA, 20 bp, Artificial
  CRISPR gRNA sequence
tcaccctgcagaattatttt

SEQ ID NO: 721000 - DNA, 20 bp, Artificial
  CRISPR gRNA sequence
caccctgcagaattattttg

SEQ ID NO: 721001 - DNA, 20 bp, Artificial
  CRISPR gRNA sequence
accctgcagaattattttga

SEQ ID NO: 721002 - DNA, 20 bp, Artificial
  CRISPR gRNA sequence
cagaattattttgagcatgc

SEQ ID NO: 721003 - DNA, 20 bp, Artificial
  CRISPR gRNA sequence
ttttgagcatgctgggagag

SEQ ID NO: 721004 - DNA, 20 bp, Artificial
  CRISPR gRNA sequence
tgagcatgctgggagagctg

SEQ ID NO: 721005 - DNA, 20 bp, Artificial
  CRISPR gRNA sequence
gagcatgctgggagagctgc

SEQ ID NO: 721006 - DNA, 20 bp, Artificial
  CRISPR gRNA sequence
agcatgctgggagagctgct

SEQ ID NO: 721007 - DNA, 20 bp, Artificial
  CRISPR gRNA sequence
ggagagctgctcaacggcat

SEQ ID NO: 721008 - DNA, 20 bp, Artificial
  CRISPR gRNA sequence
ctcaacggcatagtcagacg

SEQ ID NO: 721009 - DNA, 20 bp, Artificial
  CRISPR gRNA sequence
aacggcatagtcagacgagc

SEQ ID NO: 721010 - DNA, 20 bp, Artificial
  CRISPR gRNA sequence
attttcttgttggatgaccc

SEQ ID NO: 721011 - DNA, 20 bp, Artificial
  CRISPR gRNA sequence
ttttcttgttggatgaccct

SEQ ID NO: 721012 - DNA, 20 bp, Artificial
  CRISPR gRNA sequence
tcttgttggatgacccttgg

SEQ ID NO: 721013 - DNA, 20 bp, Artificial
  CRISPR gRNA sequence
cttgttggatgacccttgga

SEQ ID NO: 721014 - DNA, 20 bp, Artificial
  CRISPR gRNA sequence
ttgttggatgacccttggac

SEQ ID NO: 721015 - DNA, 20 bp, Artificial
  CRISPR gRNA sequence
gttggatgacccttggacaa

SEQ ID NO: 721016 - DNA, 20 bp, Artificial
  CRISPR gRNA sequence
ttggatgacccttggacaac

SEQ ID NO: 721017 - DNA, 20 bp, Artificial
  CRISPR gRNA sequence
gatgacccttggacaactgc

SEQ ID NO: 721018 - DNA, 20 bp, Artificial
  CRISPR gRNA sequence
ggacaactgcttctctgtct

SEQ ID NO: 721019 - DNA, 20 bp, Artificial
  CRISPR gRNA sequence
gacaactgcttctctgtctt

SEQ ID NO: 721020 - DNA, 20 bp, Artificial
  CRISPR gRNA sequence
cttctctgtcttcctggggg

SEQ ID NO: 721021 - DNA, 20 bp, Artificial
  CRISPR gRNA sequence
ctctgtcttcctgggggctc

SEQ ID NO: 721022 - DNA, 20 bp, Artificial
  CRISPR gRNA sequence
tctgtcttcctgggggctct

SEQ ID NO: 721023 - DNA, 20 bp, Artificial
  CRISPR gRNA sequence
tgtcttcctgggggctctct

SEQ ID NO: 721024 - DNA, 20 bp, Artificial
  CRISPR gRNA sequence
tcttcctgggggctctctgg

SEQ ID NO: 721025 - DNA, 20 bp, Artificial
  CRISPR gRNA sequence
cctgggggctctctggaccc

SEQ ID NO: 721026 - DNA, 20 bp, Artificial
  CRISPR gRNA sequence
ctgggggctctctggacccc

SEQ ID NO: 721027 - DNA, 20 bp, Artificial
  CRISPR gRNA sequence
ggggctctctggaccccctg

SEQ ID NO: 721028 - DNA, 20 bp, Artificial
  CRISPR gRNA sequence
tctggaccccctgcccttgc

SEQ ID NO: 721029 - DNA, 20 bp, Artificial
  CRISPR gRNA sequence
tggaccccctgcccttgcca

SEQ ID NO: 721030 - DNA, 20 bp, Artificial
  CRISPR gRNA sequence
gaccccctgcccttgccata

SEQ ID NO: 721031 - DNA, 20 bp, Artificial
  CRISPR gRNA sequence
cccttgccatactgatcttt

SEQ ID NO: 721032 - DNA, 20 bp, Artificial
  CRISPR gRNA sequence
gccatactgatctttctccg

SEQ ID NO: 721033 - DNA, 20 bp, Artificial
  CRISPR gRNA sequence
ccatactgatctttctccgt

SEQ ID NO: 721034 - DNA, 20 bp, Artificial
  CRISPR gRNA sequence
atctttctccgtgatcctca

SEQ ID NO: 721035 - DNA, 20 bp, Artificial
  CRISPR gRNA sequence
tctccgtgatcctcatctgt

SEQ ID NO: 721036 - DNA, 20 bp, Artificial
  CRISPR gRNA sequence
ctccgtgatcctcatctgtg

SEQ ID NO: 721037 - DNA, 20 bp, Artificial
  CRISPR gRNA sequence
tccgtgatcctcatctgtgt

SEQ ID NO: 721038 - DNA, 20 bp, Artificial
  CRISPR gRNA sequence
cgtgatcctcatctgtgtcc

SEQ ID NO: 721039 - DNA, 20 bp, Artificial
  CRISPR gRNA sequence
atctgtgtcccttagatgac

SEQ ID NO: 721040 - DNA, 20 bp, Artificial
  CRISPR gRNA sequence
tgtcccttagatgaccttgt

SEQ ID NO: 721041 - DNA, 20 bp, Artificial
  CRISPR gRNA sequence
agatgaccttgtggagaaga

SEQ ID NO: 721042 - DNA, 20 bp, Artificial
  CRISPR gRNA sequence
gatgaccttgtggagaagac

SEQ ID NO: 721043 - DNA, 20 bp, Artificial
  CRISPR gRNA sequence
gtggagaagacgccatgtgc

SEQ ID NO: 721044 - DNA, 20 bp, Artificial
  CRISPR gRNA sequence
tggagaagacgccatgtgca

SEQ ID NO: 721045 - DNA, 20 bp, Artificial
  CRISPR gRNA sequence
ctcccgcacctgcgaatgtc

SEQ ID NO: 721046 - DNA, 20 bp, Artificial
  CRISPR gRNA sequence
ccgcacctgcgaatgtcgac

SEQ ID NO: 721047 - DNA, 20 bp, Artificial
  CRISPR gRNA sequence
cgaatgtcgacctggcatga

SEQ ID NO: 721048 - DNA, 20 bp, Artificial
  CRISPR gRNA sequence
gcatgatctgtgccacatca

SEQ ID NO: 721049 - DNA, 20 bp, Artificial
  CRISPR gRNA sequence
tgccacatcagccaccaact

SEQ ID NO: 721050 - DNA, 20 bp, Artificial
  CRISPR gRNA sequence
ctgtgcccgctgtgtcccct

SEQ ID NO: 721051 - DNA, 20 bp, Artificial
  CRISPR gRNA sequence
tgcccgctgtgtcccctacc

SEQ ID NO: 721052 - DNA, 20 bp, Artificial
  CRISPR gRNA sequence
tgtcccctacccaatctgtg

SEQ ID NO: 721053 - DNA, 20 bp, Artificial
  CRISPR gRNA sequence
cccaatctgtgcagcagaga

SEQ ID NO: 721054 - DNA, 20 bp, Artificial
  CRISPR gRNA sequence
tgcagcagagacggtcacca

SEQ ID NO: 721055 - DNA, 20 bp, Artificial
  CRISPR gRNA sequence
ccaccccaggcctcgaccac

SEQ ID NO: 721056 - DNA, 20 bp, Artificial
  CRISPR gRNA sequence
gaccacagggtggagtctgt

SEQ ID NO: 721057 - DNA, 20 bp, Artificial
  CRISPR gRNA sequence
tgcccccactgttgtgcctc

SEQ ID NO: 721058 - DNA, 20 bp, Artificial
  CRISPR gRNA sequence
ttgtgcctctccccaccaac

SEQ ID NO: 721059 - DNA, 20 bp, Artificial
  CRISPR gRNA sequence
tgcctctccccaccaacagc

SEQ ID NO: 721060 - DNA, 20 bp, Artificial
  CRISPR gRNA sequence
tccccaccaacagccagggg

SEQ ID NO: 721061 - DNA, 20 bp, Artificial
  CRISPR gRNA sequence
cccaccaacagccaggggtg

SEQ ID NO: 721062 - DNA, 20 bp, Artificial
  CRISPR gRNA sequence
caccctcggctgttcattag

SEQ ID NO: 721063 - DNA, 20 bp, Artificial
  CRISPR gRNA sequence
ggctgttcattaggtcaggt

SEQ ID NO: 721064 - DNA, 20 bp, Artificial
  CRISPR gRNA sequence
ttcattaggtcaggtttggg

SEQ ID NO: 721065 - DNA, 20 bp, Artificial
  CRISPR gRNA sequence
attaggtcaggtttgggttc

SEQ ID NO: 721066 - DNA, 20 bp, Artificial
  CRISPR gRNA sequence
ggtcaggtttgggttctggt

SEQ ID NO: 721067 - DNA, 20 bp, Artificial
  CRISPR gRNA sequence
gggttctggttatcctttga

SEQ ID NO: 721068 - DNA, 20 bp, Artificial
  CRISPR gRNA sequence
ggttctggttatcctttgag

SEQ ID NO: 721069 - DNA, 20 bp, Artificial
  CRISPR gRNA sequence
tggttatcctttgagtagtc

SEQ ID NO: 721070 - DNA, 20 bp, Artificial
  CRISPR gRNA sequence
gttatcctttgagtagtcag

SEQ ID NO: 721071 - DNA, 20 bp, Artificial
  CRISPR gRNA sequence
tcctttgagtagtcagactc

SEQ ID NO: 721072 - DNA, 20 bp, Artificial
  CRISPR gRNA sequence
tgagtagtcagactcagtga

SEQ ID NO: 721073 - DNA, 20 bp, Artificial
  CRISPR gRNA sequence
gagtagtcagactcagtgaa

SEQ ID NO: 721074 - DNA, 20 bp, Artificial
  CRISPR gRNA sequence
agtagtcagactcagtgaat

SEQ ID NO: 721075 - DNA, 20 bp, Artificial
  CRISPR gRNA sequence
agtgaatggaatgataaaat

SEQ ID NO: 721076 - DNA, 20 bp, Artificial
  CRISPR gRNA sequence
tagcattttggcaagagatt

SEQ ID NO: 721077 - DNA, 20 bp, Artificial
  CRISPR gRNA sequence
agcattttggcaagagattc

SEQ ID NO: 721078 - DNA, 20 bp, Artificial
  CRISPR gRNA sequence
gcattttggcaagagattct

SEQ ID NO: 721079 - DNA, 20 bp, Artificial
  CRISPR gRNA sequence
tggcaagagattctgttgat

SEQ ID NO: 721080 - DNA, 20 bp, Artificial
  CRISPR gRNA sequence
ggcaagagattctgttgatt

SEQ ID NO: 721081 - DNA, 20 bp, Artificial
  CRISPR gRNA sequence
gcaagagattctgttgatta

SEQ ID NO: 721082 - DNA, 20 bp, Artificial
  CRISPR gRNA sequence
tgttgattaaaaaaaaattc

SEQ ID NO: 721083 - DNA, 20 bp, Artificial
  CRISPR gRNA sequence
ttgattaaaaaaaaattctt

SEQ ID NO: 721084 - DNA, 20 bp, Artificial
  CRISPR gRNA sequence
attaaaaaaaaattcttcct

SEQ ID NO: 721085 - DNA, 20 bp, Artificial
  CRISPR gRNA sequence
aaaaaaaattcttcctgaaa

SEQ ID NO: 721086 - DNA, 20 bp, Artificial
  CRISPR gRNA sequence
ttcctgaaattattgggctg

SEQ ID NO: 721087 - DNA, 20 bp, Artificial
  CRISPR gRNA sequence
cctgaaattattgggctggt

SEQ ID NO: 721088 - DNA, 20 bp, Artificial
  CRISPR gRNA sequence
ctgaaattattgggctggta

SEQ ID NO: 721089 - DNA, 20 bp, Artificial
  CRISPR gRNA sequence
aaattattgggctggtaaaa

SEQ ID NO: 721090 - DNA, 20 bp, Artificial
  CRISPR gRNA sequence
ttgggctggtaaaatcttta

SEQ ID NO: 721091 - DNA, 20 bp, Artificial
  CRISPR gRNA sequence
ggctggtaaaatctttatat

SEQ ID NO: 721092 - DNA, 20 bp, Artificial
  CRISPR gRNA sequence
gtaaaatctttatatttttg

SEQ ID NO: 721093 - DNA, 20 bp, Artificial
  CRISPR gRNA sequence
tatatttttgagatggagtt

SEQ ID NO: 721094 - DNA, 20 bp, Artificial
  CRISPR gRNA sequence
atatttttgagatggagttt

SEQ ID NO: 721095 - DNA, 20 bp, Artificial
  CRISPR gRNA sequence
tatttttgagatggagtttc

SEQ ID NO: 721096 - DNA, 20 bp, Artificial
  CRISPR gRNA sequence
ttgagatggagtttcgctca

SEQ ID NO: 721097 - DNA, 20 bp, Artificial
  CRISPR gRNA sequence
tgagatggagtttcgctcat

SEQ ID NO: 721098 - DNA, 20 bp, Artificial
  CRISPR gRNA sequence
gagatggagtttcgctcatg

SEQ ID NO: 721099 - DNA, 20 bp, Artificial
  CRISPR gRNA sequence
agatggagtttcgctcatgt

SEQ ID NO: 721100 - DNA, 20 bp, Artificial
  CRISPR gRNA sequence
cgctcatgttgcccaggctg

SEQ ID NO: 721101 - DNA, 20 bp, Artificial
  CRISPR gRNA sequence
gctcatgttgcccaggctgg

SEQ ID NO: 721102 - DNA, 20 bp, Artificial
  CRISPR gRNA sequence
atgttgcccaggctggagta

SEQ ID NO: 721103 - DNA, 20 bp, Artificial
  CRISPR gRNA sequence
cccaggctggagtacaatgg

SEQ ID NO: 721104 - DNA, 20 bp, Artificial
  CRISPR gRNA sequence
gagtacaatggctcaatctc

SEQ ID NO: 721105 - DNA, 20 bp, Artificial
  CRISPR gRNA sequence
aatctcggctcaccgcaacc

SEQ ID NO: 721106 - DNA, 20 bp, Artificial
  CRISPR gRNA sequence
ggctcaccgcaacctgcacc

SEQ ID NO: 721107 - DNA, 20 bp, Artificial
  CRISPR gRNA sequence
accgcaacctgcacctcctg

SEQ ID NO: 721108 - DNA, 20 bp, Artificial
  CRISPR gRNA sequence
cacctcctgggttcaagcaa

SEQ ID NO: 721109 - DNA, 20 bp, Artificial
  CRISPR gRNA sequence
ctgggttcaagcaattctcc

SEQ ID NO: 721110 - DNA, 20 bp, Artificial
  CRISPR gRNA sequence
ggttcaagcaattctcctgc

SEQ ID NO: 721111 - DNA, 20 bp, Artificial
  CRISPR gRNA sequence
aagcaattctcctgcctcag

SEQ ID NO: 721112 - DNA, 20 bp, Artificial
  CRISPR gRNA sequence
tcctgcctcagccttctgag

SEQ ID NO: 721113 - DNA, 20 bp, Artificial
  CRISPR gRNA sequence
ctgcctcagccttctgagta

SEQ ID NO: 721114 - DNA, 20 bp, Artificial
  CRISPR gRNA sequence
cctcagccttctgagtagct

SEQ ID NO: 721115 - DNA, 20 bp, Artificial
  CRISPR gRNA sequence
agccttctgagtagctgggg

SEQ ID NO: 721116 - DNA, 20 bp, Artificial
  CRISPR gRNA sequence
ctgagtagctggggttacaa

SEQ ID NO: 721117 - DNA, 20 bp, Artificial
  CRISPR gRNA sequence
tgagtagctggggttacaag

SEQ ID NO: 721118 - DNA, 20 bp, Artificial
  CRISPR gRNA sequence
agtagctggggttacaagca

SEQ ID NO: 721119 - DNA, 20 bp, Artificial
  CRISPR gRNA sequence
gggttacaagcattcgccac

SEQ ID NO: 721120 - DNA, 20 bp, Artificial
  CRISPR gRNA sequence
caagcattcgccaccacagc

SEQ ID NO: 721121 - DNA, 20 bp, Artificial
  CRISPR gRNA sequence
gccaccacagccggctaatg

SEQ ID NO: 721122 - DNA, 20 bp, Artificial
  CRISPR gRNA sequence
atgttgtatttttagaagag

SEQ ID NO: 721123 - DNA, 20 bp, Artificial
  CRISPR gRNA sequence
tatttttagaagagatgcgg

SEQ ID NO: 721124 - DNA, 20 bp, Artificial
  CRISPR gRNA sequence
ttagaagagatgcggtttct

SEQ ID NO: 721125 - DNA, 20 bp, Artificial
  CRISPR gRNA sequence
tagaagagatgcggtttctc

SEQ ID NO: 721126 - DNA, 20 bp, Artificial
  CRISPR gRNA sequence
agaagagatgcggtttctcc

SEQ ID NO: 721127 - DNA, 20 bp, Artificial
  CRISPR gRNA sequence
gaagagatgcggtttctcca

SEQ ID NO: 721128 - DNA, 20 bp, Artificial
  CRISPR gRNA sequence
ctccatgttggtcaggctgg

SEQ ID NO: 721129 - DNA, 20 bp, Artificial
  CRISPR gRNA sequence
tccatgttggtcaggctggt

SEQ ID NO: 721130 - DNA, 20 bp, Artificial
  CRISPR gRNA sequence
catgttggtcaggctggtct

SEQ ID NO: 721131 - DNA, 20 bp, Artificial
  CRISPR gRNA sequence
gtcaggctggtctcgaactc

SEQ ID NO: 721132 - DNA, 20 bp, Artificial
  CRISPR gRNA sequence
gtctcgaactcccgacctca

SEQ ID NO: 721133 - DNA, 20 bp, Artificial
  CRISPR gRNA sequence
gaactcccgacctcaggtga

SEQ ID NO: 721134 - DNA, 20 bp, Artificial
  CRISPR gRNA sequence
ccgacctcaggtgatccacc

SEQ ID NO: 721135 - DNA, 20 bp, Artificial
  CRISPR gRNA sequence
aggtgatccacccaccttgg

SEQ ID NO: 721136 - DNA, 20 bp, Artificial
  CRISPR gRNA sequence
ggcctctcaaagtgctggga

SEQ ID NO: 721137 - DNA, 20 bp, Artificial
  CRISPR gRNA sequence
gcctctcaaagtgctgggat

SEQ ID NO: 721138 - DNA, 20 bp, Artificial
  CRISPR gRNA sequence
tcaaagtgctgggattacag

SEQ ID NO: 721139 - DNA, 20 bp, Artificial
  CRISPR gRNA sequence
aaagtgctgggattacaggc

SEQ ID NO: 721140 - DNA, 20 bp, Artificial
  CRISPR gRNA sequence
ggattacaggcctgagccac

SEQ ID NO: 721141 - DNA, 20 bp, Artificial
  CRISPR gRNA sequence
caggcctgagccaccatgcc

SEQ ID NO: 721142 - DNA, 20 bp, Artificial
  CRISPR gRNA sequence
agccaccatgcccagccccg

SEQ ID NO: 721143 - DNA, 20 bp, Artificial
  CRISPR gRNA sequence
gtaaaatcttgacctgtttg

SEQ ID NO: 721144 - DNA, 20 bp, Artificial
  CRISPR gRNA sequence
gacctgtttgcaaggctgtt

SEQ ID NO: 721145 - DNA, 20 bp, Artificial
  CRISPR gRNA sequence
acctgtttgcaaggctgttt

SEQ ID NO: 721146 - DNA, 20 bp, Artificial
  CRISPR gRNA sequence
tttgcaaggctgttttattg

SEQ ID NO: 721147 - DNA, 20 bp, Artificial
  CRISPR gRNA sequence
gcaaggctgttttattgact

SEQ ID NO: 721148 - DNA, 20 bp, Artificial
  CRISPR gRNA sequence
caaggctgttttattgactt

SEQ ID NO: 721149 - DNA, 20 bp, Artificial
  CRISPR gRNA sequence
ttttattgacttagagagat

SEQ ID NO: 721150 - DNA, 20 bp, Artificial
  CRISPR gRNA sequence
tattgacttagagagatgaa

SEQ ID NO: 721151 - DNA, 20 bp, Artificial
  CRISPR gRNA sequence
attgacttagagagatgaat

SEQ ID NO: 721152 - DNA, 20 bp, Artificial
  CRISPR gRNA sequence
ttgacttagagagatgaata

SEQ ID NO: 721153 - DNA, 20 bp, Artificial
  CRISPR gRNA sequence
acttagagagatgaatatca

SEQ ID NO: 721154 - DNA, 20 bp, Artificial
  CRISPR gRNA sequence
agagagatgaatatcaagtt

SEQ ID NO: 721155 - DNA, 20 bp, Artificial
  CRISPR gRNA sequence
gagagatgaatatcaagttt

SEQ ID NO: 721156 - DNA, 20 bp, Artificial
  CRISPR gRNA sequence
ctgaagagatttctaacagg

SEQ ID NO: 721157 - DNA, 20 bp, Artificial
  CRISPR gRNA sequence
tgaagagatttctaacagga

SEQ ID NO: 721158 - DNA, 20 bp, Artificial
  CRISPR gRNA sequence
aagagatttctaacaggacg

SEQ ID NO: 721159 - DNA, 20 bp, Artificial
  CRISPR gRNA sequence
ctaacaggacggttggcttt

SEQ ID NO: 721160 - DNA, 20 bp, Artificial
  CRISPR gRNA sequence
taacaggacggttggcttta

SEQ ID NO: 721161 - DNA, 20 bp, Artificial
  CRISPR gRNA sequence
acaggacggttggctttacc

SEQ ID NO: 721162 - DNA, 20 bp, Artificial
  CRISPR gRNA sequence
gctttaccagtgtgcaggaa

SEQ ID NO: 721163 - DNA, 20 bp, Artificial
  CRISPR gRNA sequence
taccagtgtgcaggaaacta

SEQ ID NO: 721164 - DNA, 20 bp, Artificial
  CRISPR gRNA sequence
accagtgtgcaggaaactaa

SEQ ID NO: 721165 - DNA, 20 bp, Artificial
  CRISPR gRNA sequence
ccagtgtgcaggaaactaaa

SEQ ID NO: 721166 - DNA, 20 bp, Artificial
  CRISPR gRNA sequence
aaaccctgacagttttttgt

SEQ ID NO: 721167 - DNA, 20 bp, Artificial
  CRISPR gRNA sequence
acagttttttgttgttgttg

SEQ ID NO: 721168 - DNA, 20 bp, Artificial
  CRISPR gRNA sequence
tttgttgttgttgttttttg

SEQ ID NO: 721169 - DNA, 20 bp, Artificial
  CRISPR gRNA sequence
ttgttgttgttgttttttgt

SEQ ID NO: 721170 - DNA, 20 bp, Artificial
  CRISPR gRNA sequence
tgttgttgttgttttttgtt

SEQ ID NO: 721171 - DNA, 20 bp, Artificial
  CRISPR gRNA sequence
gttgttgttgttttttgttt

SEQ ID NO: 721172 - DNA, 20 bp, Artificial
  CRISPR gRNA sequence
ttgttgttgttttttgtttt

SEQ ID NO: 721173 - DNA, 20 bp, Artificial
  CRISPR gRNA sequence
ttgttgttttttgtttttta

SEQ ID NO: 721174 - DNA, 20 bp, Artificial
  CRISPR gRNA sequence
ttgttttttgttttttaagg

SEQ ID NO: 721175 - DNA, 20 bp, Artificial
  CRISPR gRNA sequence
ttttttgttttttaagggct

SEQ ID NO: 721176 - DNA, 20 bp, Artificial
  CRISPR gRNA sequence
tttgttttttaagggctttg

SEQ ID NO: 721177 - DNA, 20 bp, Artificial
  CRISPR gRNA sequence
ttgttttttaagggctttga

SEQ ID NO: 721178 - DNA, 20 bp, Artificial
  CRISPR gRNA sequence
tgttttttaagggctttgag

SEQ ID NO: 721179 - DNA, 20 bp, Artificial
  CRISPR gRNA sequence
gttttttaagggctttgaga

SEQ ID NO: 721180 - DNA, 20 bp, Artificial
  CRISPR gRNA sequence
ttttttaagggctttgagag

SEQ ID NO: 721181 - DNA, 20 bp, Artificial
  CRISPR gRNA sequence
tttaagggctttgagagatt

SEQ ID NO: 721182 - DNA, 20 bp, Artificial
  CRISPR gRNA sequence
ttaagggctttgagagattt

SEQ ID NO: 721183 - DNA, 20 bp, Artificial
  CRISPR gRNA sequence
taagggctttgagagatttt

SEQ ID NO: 721184 - DNA, 20 bp, Artificial
  CRISPR gRNA sequence
aagggctttgagagatttta

SEQ ID NO: 721185 - DNA, 20 bp, Artificial
  CRISPR gRNA sequence
agggctttgagagattttaa

SEQ ID NO: 721186 - DNA, 20 bp, Artificial
  CRISPR gRNA sequence
tgagagattttaacaaatct

SEQ ID NO: 721187 - DNA, 20 bp, Artificial
  CRISPR gRNA sequence
gagagattttaacaaatctc

SEQ ID NO: 721188 - DNA, 20 bp, Artificial
  CRISPR gRNA sequence
agagattttaacaaatctcc

SEQ ID NO: 721189 - DNA, 20 bp, Artificial
  CRISPR gRNA sequence
taacaaatctccaggtggtt

SEQ ID NO: 721190 - DNA, 20 bp, Artificial
  CRISPR gRNA sequence
aacaaatctccaggtggttt

SEQ ID NO: 721191 - DNA, 20 bp, Artificial
  CRISPR gRNA sequence
acaaatctccaggtggttta

SEQ ID NO: 721192 - DNA, 20 bp, Artificial
  CRISPR gRNA sequence
caggtggtttaaaacagatg

SEQ ID NO: 721193 - DNA, 20 bp, Artificial
  CRISPR gRNA sequence
aaaacagatggaagagtggt

SEQ ID NO: 721194 - DNA, 20 bp, Artificial
  CRISPR gRNA sequence
aaacagatggaagagtggtg

SEQ ID NO: 721195 - DNA, 20 bp, Artificial
  CRISPR gRNA sequence
acgcctgtgatcccagcact

SEQ ID NO: 721196 - DNA, 20 bp, Artificial
  CRISPR gRNA sequence
tgatcccagcactttgggag

SEQ ID NO: 721197 - DNA, 20 bp, Artificial
  CRISPR gRNA sequence
tgggaggctgaggcaggtgg

SEQ ID NO: 721198 - DNA, 20 bp, Artificial
  CRISPR gRNA sequence
gggaggctgaggcaggtgga

SEQ ID NO: 721199 - DNA, 20 bp, Artificial
  CRISPR gRNA sequence
ggaggctgaggcaggtggat

SEQ ID NO: 721200 - DNA, 20 bp, Artificial
  CRISPR gRNA sequence
aggcaggtggatcacttgag

SEQ ID NO: 721201 - DNA, 20 bp, Artificial
  CRISPR gRNA sequence
gaggtcaggagttcaagacc

SEQ ID NO: 721202 - DNA, 20 bp, Artificial
  CRISPR gRNA sequence
aggtcaggagttcaagacca

SEQ ID NO: 721203 - DNA, 20 bp, Artificial
  CRISPR gRNA sequence
aagaccagcctgaccaacat

SEQ ID NO: 721204 - DNA, 20 bp, Artificial
  CRISPR gRNA sequence
accaacatggcaaaaccccg

SEQ ID NO: 721205 - DNA, 20 bp, Artificial
  CRISPR gRNA sequence
tactaaaaatacacaaatta

SEQ ID NO: 721206 - DNA, 20 bp, Artificial
  CRISPR gRNA sequence
ctaaaaatacacaaattagc

SEQ ID NO: 721207 - DNA, 20 bp, Artificial
  CRISPR gRNA sequence
aaaatacacaaattagctgg

SEQ ID NO: 721208 - DNA, 20 bp, Artificial
  CRISPR gRNA sequence
gctgggtgtggtggtgggca

SEQ ID NO: 721209 - DNA, 20 bp, Artificial
  CRISPR gRNA sequence
ggtgtggtggtgggcaccgt

SEQ ID NO: 721210 - DNA, 20 bp, Artificial
  CRISPR gRNA sequence
ctcaggaggttgaggcagga

SEQ ID NO: 721211 - DNA, 20 bp, Artificial
  CRISPR gRNA sequence
aggaggttgaggcaggagaa

SEQ ID NO: 721212 - DNA, 20 bp, Artificial
  CRISPR gRNA sequence
aggcaggagaatcgcttgaa

SEQ ID NO: 721213 - DNA, 20 bp, Artificial
  CRISPR gRNA sequence
gaacccgggaggcataggtt

SEQ ID NO: 721214 - DNA, 20 bp, Artificial
  CRISPR gRNA sequence
aacccgggaggcataggttg

SEQ ID NO: 721215 - DNA, 20 bp, Artificial
  CRISPR gRNA sequence
cagtgagccgagattgcacc

SEQ ID NO: 721216 - DNA, 20 bp, Artificial
  CRISPR gRNA sequence
caccactgaactccagcctg

SEQ ID NO: 721217 - DNA, 20 bp, Artificial
  CRISPR gRNA sequence
aactccagcctgggcaacag

SEQ ID NO: 721218 - DNA, 20 bp, Artificial
  CRISPR gRNA sequence
cagcctgggcaacagggcga

SEQ ID NO: 721219 - DNA, 20 bp, Artificial
  CRISPR gRNA sequence
ggcaacagggcgaaactctg

SEQ ID NO: 721220 - DNA, 20 bp, Artificial
  CRISPR gRNA sequence
tgcctaaaaaagaaaaaaaa

SEQ ID NO: 721221 - DNA, 20 bp, Artificial
  CRISPR gRNA sequence
cctaaaaaagaaaaaaaacc

SEQ ID NO: 721222 - DNA, 20 bp, Artificial
  CRISPR gRNA sequence
aaaaagaaaaaaaaccaagt

SEQ ID NO: 721223 - DNA, 20 bp, Artificial
  CRISPR gRNA sequence
tgtgagggctgccagagaag

SEQ ID NO: 721224 - DNA, 20 bp, Artificial
  CRISPR gRNA sequence
tgagggctgccagagaagtg

SEQ ID NO: 721225 - DNA, 20 bp, Artificial
  CRISPR gRNA sequence
ccagagaagtgaggggtgac

SEQ ID NO: 721226 - DNA, 20 bp, Artificial
  CRISPR gRNA sequence
gcttctaggacccccagaga

SEQ ID NO: 721227 - DNA, 20 bp, Artificial
  CRISPR gRNA sequence
cttctaggacccccagagag

SEQ ID NO: 721228 - DNA, 20 bp, Artificial
  CRISPR gRNA sequence
ctaggacccccagagaggct

SEQ ID NO: 721229 - DNA, 20 bp, Artificial
  CRISPR gRNA sequence
taggacccccagagaggctc

SEQ ID NO: 721230 - DNA, 20 bp, Artificial
  CRISPR gRNA sequence
ggacccccagagaggctctg

SEQ ID NO: 721231 - DNA, 20 bp, Artificial
  CRISPR gRNA sequence
tgggcttggaagaggcaggc

SEQ ID NO: 721232 - DNA, 20 bp, Artificial
  CRISPR gRNA sequence
ggcttggaagaggcaggcag

SEQ ID NO: 721233 - DNA, 20 bp, Artificial
  CRISPR gRNA sequence
ggaagaggcaggcagatgaa

SEQ ID NO: 721234 - DNA, 20 bp, Artificial
  CRISPR gRNA sequence
gaagaggcaggcagatgaag

SEQ ID NO: 721235 - DNA, 20 bp, Artificial
  CRISPR gRNA sequence
agaggtgtgaggtgtagtgg

SEQ ID NO: 721236 - DNA, 20 bp, Artificial
  CRISPR gRNA sequence
ggactactaaatcttcaaac

SEQ ID NO: 721237 - DNA, 20 bp, Artificial
  CRISPR gRNA sequence
ctaaatcttcaaacacaact

SEQ ID NO: 721238 - DNA, 20 bp, Artificial
  CRISPR gRNA sequence
aatcttcaaacacaacttca

SEQ ID NO: 721239 - DNA, 20 bp, Artificial
  CRISPR gRNA sequence
caaacacaacttcaaaatgt

SEQ ID NO: 721240 - DNA, 20 bp, Artificial
  CRISPR gRNA sequence
aaacacaacttcaaaatgta

SEQ ID NO: 721241 - DNA, 20 bp, Artificial
  CRISPR gRNA sequence
caaaatgtattacaatggca

SEQ ID NO: 721242 - DNA, 20 bp, Artificial
  CRISPR gRNA sequence
aaaatgtattacaatggcat

SEQ ID NO: 721243 - DNA, 20 bp, Artificial
  CRISPR gRNA sequence
caatggcatggcatggccac

SEQ ID NO: 721244 - DNA, 20 bp, Artificial
  CRISPR gRNA sequence
accagtttgcacagatgatg

SEQ ID NO: 721245 - DNA, 20 bp, Artificial
  CRISPR gRNA sequence
gcacagatgatgcctgagtt

SEQ ID NO: 721246 - DNA, 20 bp, Artificial
  CRISPR gRNA sequence
cacagatgatgcctgagttt

SEQ ID NO: 721247 - DNA, 20 bp, Artificial
  CRISPR gRNA sequence
agtttttaatccccagtatt

SEQ ID NO: 721248 - DNA, 20 bp, Artificial
  CRISPR gRNA sequence
ttaatccccagtattgtctt

SEQ ID NO: 721249 - DNA, 20 bp, Artificial
  CRISPR gRNA sequence
taatccccagtattgtcttt

SEQ ID NO: 721250 - DNA, 20 bp, Artificial
  CRISPR gRNA sequence
aatccccagtattgtctttt

SEQ ID NO: 721251 - DNA, 20 bp, Artificial
  CRISPR gRNA sequence
atccccagtattgtcttttt

SEQ ID NO: 721252 - DNA, 20 bp, Artificial
  CRISPR gRNA sequence
tctttttttttcctcttttt

SEQ ID NO: 721253 - DNA, 20 bp, Artificial
  CRISPR gRNA sequence
tttttttcctctttttttag

SEQ ID NO: 721254 - DNA, 20 bp, Artificial
  CRISPR gRNA sequence
ttttttcctctttttttaga

SEQ ID NO: 721255 - DNA, 20 bp, Artificial
  CRISPR gRNA sequence
tttttcctctttttttagag

SEQ ID NO: 721256 - DNA, 20 bp, Artificial
  CRISPR gRNA sequence
ttttcctctttttttagaga

SEQ ID NO: 721257 - DNA, 20 bp, Artificial
  CRISPR gRNA sequence
tttcctctttttttagagat

SEQ ID NO: 721258 - DNA, 20 bp, Artificial
  CRISPR gRNA sequence
ttcctctttttttagagatg

SEQ ID NO: 721259 - DNA, 20 bp, Artificial
  CRISPR gRNA sequence
tcctctttttttagagatgg

SEQ ID NO: 721260 - DNA, 20 bp, Artificial
  CRISPR gRNA sequence
cctctttttttagagatgga

SEQ ID NO: 721261 - DNA, 20 bp, Artificial
  CRISPR gRNA sequence
ctctttttttagagatggag

SEQ ID NO: 721262 - DNA, 20 bp, Artificial
  CRISPR gRNA sequence
tttttttagagatggagtct

SEQ ID NO: 721263 - DNA, 20 bp, Artificial
  CRISPR gRNA sequence
tttttagagatggagtctcg

SEQ ID NO: 721264 - DNA, 20 bp, Artificial
  CRISPR gRNA sequence
ttttagagatggagtctcgc

SEQ ID NO: 721265 - DNA, 20 bp, Artificial
  CRISPR gRNA sequence
tttagagatggagtctcgct

SEQ ID NO: 721266 - DNA, 20 bp, Artificial
  CRISPR gRNA sequence
ttagagatggagtctcgctg

SEQ ID NO: 721267 - DNA, 20 bp, Artificial
  CRISPR gRNA sequence
tagagatggagtctcgctgt

SEQ ID NO: 721268 - DNA, 20 bp, Artificial
  CRISPR gRNA sequence
agagatggagtctcgctgtc

SEQ ID NO: 721269 - DNA, 20 bp, Artificial
  CRISPR gRNA sequence
gagatggagtctcgctgtct

SEQ ID NO: 721270 - DNA, 20 bp, Artificial
  CRISPR gRNA sequence
gctgtcttgcccaggccgat

SEQ ID NO: 721271 - DNA, 20 bp, Artificial
  CRISPR gRNA sequence
tcttgcccaggccgatgtgc

SEQ ID NO: 721272 - DNA, 20 bp, Artificial
  CRISPR gRNA sequence
gcccaggccgatgtgcagtg

SEQ ID NO: 721273 - DNA, 20 bp, Artificial
  CRISPR gRNA sequence
cccaggccgatgtgcagtgg

SEQ ID NO: 721274 - DNA, 20 bp, Artificial
  CRISPR gRNA sequence
agctcactgcaacctccgtc

SEQ ID NO: 721275 - DNA, 20 bp, Artificial
  CRISPR gRNA sequence
actgcaacctccgtctcccg

SEQ ID NO: 721276 - DNA, 20 bp, Artificial
  CRISPR gRNA sequence
caacctccgtctcccgggtt

SEQ ID NO: 721277 - DNA, 20 bp, Artificial
  CRISPR gRNA sequence
cgtctcccgggttcaggcaa

SEQ ID NO: 721278 - DNA, 20 bp, Artificial
  CRISPR gRNA sequence
ccgggttcaggcaattctcc

SEQ ID NO: 721279 - DNA, 20 bp, Artificial
  CRISPR gRNA sequence
aggcaattctcctgcctcag

SEQ ID NO: 721280 - DNA, 20 bp, Artificial
  CRISPR gRNA sequence
tcctgcctcagcctcccgag

SEQ ID NO: 721281 - DNA, 20 bp, Artificial
  CRISPR gRNA sequence
ctgcctcagcctcccgagta

SEQ ID NO: 721282 - DNA, 20 bp, Artificial
  CRISPR gRNA sequence
cctcagcctcccgagtagct

SEQ ID NO: 721283 - DNA, 20 bp, Artificial
  CRISPR gRNA sequence
agcctcccgagtagctggga

SEQ ID NO: 721284 - DNA, 20 bp, Artificial
  CRISPR gRNA sequence
ccgagtagctgggattacag

SEQ ID NO: 721285 - DNA, 20 bp, Artificial
  CRISPR gRNA sequence
ggattacaggtgcccgccac

SEQ ID NO: 721286 - DNA, 20 bp, Artificial
  CRISPR gRNA sequence
caggtgcccgccaccacacc

SEQ ID NO: 721287 - DNA, 20 bp, Artificial
  CRISPR gRNA sequence
attttcatatttttagtaga

SEQ ID NO: 721288 - DNA, 20 bp, Artificial
  CRISPR gRNA sequence
tcatatttttagtagagacg

SEQ ID NO: 721289 - DNA, 20 bp, Artificial
  CRISPR gRNA sequence
catatttttagtagagacgg

SEQ ID NO: 721290 - DNA, 20 bp, Artificial
  CRISPR gRNA sequence
atatttttagtagagacggg

SEQ ID NO: 721291 - DNA, 20 bp, Artificial
  CRISPR gRNA sequence
ttagtagagacggggttttg

SEQ ID NO: 721292 - DNA, 20 bp, Artificial
  CRISPR gRNA sequence
tagtagagacggggttttgc

SEQ ID NO: 721293 - DNA, 20 bp, Artificial
  CRISPR gRNA sequence
agtagagacggggttttgcc

SEQ ID NO: 721294 - DNA, 20 bp, Artificial
  CRISPR gRNA sequence
gtagagacggggttttgcca

SEQ ID NO: 721295 - DNA, 20 bp, Artificial
  CRISPR gRNA sequence
tgccatgttggccaggctgg

SEQ ID NO: 721296 - DNA, 20 bp, Artificial
  CRISPR gRNA sequence
gccatgttggccaggctggt

SEQ ID NO: 721297 - DNA, 20 bp, Artificial
  CRISPR gRNA sequence
ccatgttggccaggctggtc

SEQ ID NO: 721298 - DNA, 20 bp, Artificial
  CRISPR gRNA sequence
gccaggctggtctggaactc

SEQ ID NO: 721299 - DNA, 20 bp, Artificial
  CRISPR gRNA sequence
gtctggaactcctgacctca

SEQ ID NO: 721300 - DNA, 20 bp, Artificial
  CRISPR gRNA sequence
gaactcctgacctcaagtga

SEQ ID NO: 721301 - DNA, 20 bp, Artificial
  CRISPR gRNA sequence
ctgacctcaagtgatctgcc

SEQ ID NO: 721302 - DNA, 20 bp, Artificial
  CRISPR gRNA sequence
acctcaagtgatctgcccgc

SEQ ID NO: 721303 - DNA, 20 bp, Artificial
  CRISPR gRNA sequence
aagtgatctgcccgcctcca

SEQ ID NO: 721304 - DNA, 20 bp, Artificial
  CRISPR gRNA sequence
cccgcctccacctcccaaag

SEQ ID NO: 721305 - DNA, 20 bp, Artificial
  CRISPR gRNA sequence
cacctcccaaagtgctggga

SEQ ID NO: 721306 - DNA, 20 bp, Artificial
  CRISPR gRNA sequence
ccaaagtgctgggattacag

SEQ ID NO: 721307 - DNA, 20 bp, Artificial
  CRISPR gRNA sequence
ggattacaggtgtgagccac

SEQ ID NO: 721308 - DNA, 20 bp, Artificial
  CRISPR gRNA sequence
caggtgtgagccaccgtgcc

SEQ ID NO: 721309 - DNA, 20 bp, Artificial
  CRISPR gRNA sequence
gccaacaattgtcttcttga

SEQ ID NO: 721310 - DNA, 20 bp, Artificial
  CRISPR gRNA sequence
tcttcttgagtcagaacatt

SEQ ID NO: 721311 - DNA, 20 bp, Artificial
  CRISPR gRNA sequence
cttgagtcagaacattgaag

SEQ ID NO: 721312 - DNA, 20 bp, Artificial
  CRISPR gRNA sequence
ttgagtcagaacattgaagg

SEQ ID NO: 721313 - DNA, 20 bp, Artificial
  CRISPR gRNA sequence
gagtcagaacattgaaggaa

SEQ ID NO: 721314 - DNA, 20 bp, Artificial
  CRISPR gRNA sequence
agtcagaacattgaaggaat

SEQ ID NO: 721315 - DNA, 20 bp, Artificial
  CRISPR gRNA sequence
aaggaatatccggggaaagt

SEQ ID NO: 721316 - DNA, 20 bp, Artificial
  CRISPR gRNA sequence
gggccactagtggggtgctg

SEQ ID NO: 721317 - DNA, 20 bp, Artificial
  CRISPR gRNA sequence
gtggggtgctgtcactctgt

SEQ ID NO: 721318 - DNA, 20 bp, Artificial
  CRISPR gRNA sequence
tcactctgtttgtaaagccc

SEQ ID NO: 721319 - DNA, 20 bp, Artificial
  CRISPR gRNA sequence
tgtttgtaaagccctcttta

SEQ ID NO: 721320 - DNA, 20 bp, Artificial
  CRISPR gRNA sequence
tttgtaaagccctctttact

SEQ ID NO: 721321 - DNA, 20 bp, Artificial
  CRISPR gRNA sequence
gtaaagccctctttacttgg

SEQ ID NO: 721322 - DNA, 20 bp, Artificial
  CRISPR gRNA sequence
taaagccctctttacttggg

SEQ ID NO: 721323 - DNA, 20 bp, Artificial
  CRISPR gRNA sequence
tttacttgggtatttggaag

SEQ ID NO: 721324 - DNA, 20 bp, Artificial
  CRISPR gRNA sequence
tacttgggtatttggaagtg

SEQ ID NO: 721325 - DNA, 20 bp, Artificial
  CRISPR gRNA sequence
acttgggtatttggaagtgc

SEQ ID NO: 721326 - DNA, 20 bp, Artificial
  CRISPR gRNA sequence
cttgggtatttggaagtgca

SEQ ID NO: 721327 - DNA, 20 bp, Artificial
  CRISPR gRNA sequence
gggtatttggaagtgcacct

SEQ ID NO: 721328 - DNA, 20 bp, Artificial
  CRISPR gRNA sequence
ggtatttggaagtgcacctg

SEQ ID NO: 721329 - DNA, 20 bp, Artificial
  CRISPR gRNA sequence
ggaagtgcacctgtcaacag

SEQ ID NO: 721330 - DNA, 20 bp, Artificial
  CRISPR gRNA sequence
gaagtgcacctgtcaacagg

SEQ ID NO: 721331 - DNA, 20 bp, Artificial
  CRISPR gRNA sequence
tcaacaggctagccacaccc

SEQ ID NO: 721332 - DNA, 20 bp, Artificial
  CRISPR gRNA sequence
gccacaccccatcaccctga

SEQ ID NO: 721333 - DNA, 20 bp, Artificial
  CRISPR gRNA sequence
aaatggaggctgccagctca

SEQ ID NO: 721334 - DNA, 20 bp, Artificial
  CRISPR gRNA sequence
ccagctcacactctccgccc

SEQ ID NO: 721335 - DNA, 20 bp, Artificial
  CRISPR gRNA sequence
acactctccgcccatgggcc

SEQ ID NO: 721336 - DNA, 20 bp, Artificial
  CRISPR gRNA sequence
tccgcccatgggcccagggt

SEQ ID NO: 721337 - DNA, 20 bp, Artificial
  CRISPR gRNA sequence
cgcccatgggcccagggttc

SEQ ID NO: 721338 - DNA, 20 bp, Artificial
  CRISPR gRNA sequence
cctggccaacttcctactca

SEQ ID NO: 721339 - DNA, 20 bp, Artificial
  CRISPR gRNA sequence
gccaacttcctactcaggga

SEQ ID NO: 721340 - DNA, 20 bp, Artificial
  CRISPR gRNA sequence
cctactcagggaagagaccc

SEQ ID NO: 721341 - DNA, 20 bp, Artificial
  CRISPR gRNA sequence
ctactcagggaagagaccca

SEQ ID NO: 721342 - DNA, 20 bp, Artificial
  CRISPR gRNA sequence
ctcagggaagagacccattg

SEQ ID NO: 721343 - DNA, 20 bp, Artificial
  CRISPR gRNA sequence
agggaagagacccattgtga

SEQ ID NO: 721344 - DNA, 20 bp, Artificial
  CRISPR gRNA sequence
tgaacaggacatactaacac

SEQ ID NO: 721345 - DNA, 20 bp, Artificial
  CRISPR gRNA sequence
acacagcagaagaaactgtc

SEQ ID NO: 721346 - DNA, 20 bp, Artificial
  CRISPR gRNA sequence
tccccgctcagtgactggaa

SEQ ID NO: 721347 - DNA, 20 bp, Artificial
  CRISPR gRNA sequence
agtgactggaatattcagta

SEQ ID NO: 721348 - DNA, 20 bp, Artificial
  CRISPR gRNA sequence
gaatattcagtagagtcctt

SEQ ID NO: 721349 - DNA, 20 bp, Artificial
  CRISPR gRNA sequence
agtagagtccttaggatttt

SEQ ID NO: 721350 - DNA, 20 bp, Artificial
  CRISPR gRNA sequence
aggattttattttgtttgca

SEQ ID NO: 721351 - DNA, 20 bp, Artificial
  CRISPR gRNA sequence
ggattttattttgtttgcat

SEQ ID NO: 721352 - DNA, 20 bp, Artificial
  CRISPR gRNA sequence
tattttgtttgcataaatgt

SEQ ID NO: 721353 - DNA, 20 bp, Artificial
  CRISPR gRNA sequence
attttgtttgcataaatgta

SEQ ID NO: 721354 - DNA, 20 bp, Artificial
  CRISPR gRNA sequence
ttttgtttgcataaatgtat

SEQ ID NO: 721355 - DNA, 20 bp, Artificial
  CRISPR gRNA sequence
tgtttgcataaatgtatggg

SEQ ID NO: 721356 - DNA, 20 bp, Artificial
  CRISPR gRNA sequence
gtttgcataaatgtatgggg

SEQ ID NO: 721357 - DNA, 20 bp, Artificial
  CRISPR gRNA sequence
tttgcataaatgtatggggt

SEQ ID NO: 721358 - DNA, 20 bp, Artificial
  CRISPR gRNA sequence
gcataaatgtatggggtaca

SEQ ID NO: 721359 - DNA, 20 bp, Artificial
  CRISPR gRNA sequence
cataaatgtatggggtacaa

SEQ ID NO: 721360 - DNA, 20 bp, Artificial
  CRISPR gRNA sequence
tattacatgcttagattggg

SEQ ID NO: 721361 - DNA, 20 bp, Artificial
  CRISPR gRNA sequence
attacatgcttagattgggt

SEQ ID NO: 721362 - DNA, 20 bp, Artificial
  CRISPR gRNA sequence
ttacatgcttagattgggtg

SEQ ID NO: 721363 - DNA, 20 bp, Artificial
  CRISPR gRNA sequence
catgcttagattgggtggtg

SEQ ID NO: 721364 - DNA, 20 bp, Artificial
  CRISPR gRNA sequence
agattgggtggtgaactcag

SEQ ID NO: 721365 - DNA, 20 bp, Artificial
  CRISPR gRNA sequence
gattgggtggtgaactcagg

SEQ ID NO: 721366 - DNA, 20 bp, Artificial
  CRISPR gRNA sequence
ggtggtgaactcaggacgtt

SEQ ID NO: 721367 - DNA, 20 bp, Artificial
  CRISPR gRNA sequence
aggacgtttagggtatccct

SEQ ID NO: 721368 - DNA, 20 bp, Artificial
  CRISPR gRNA sequence
agggtatccctcacccaaat

SEQ ID NO: 721369 - DNA, 20 bp, Artificial
  CRISPR gRNA sequence
gggtatccctcacccaaata

SEQ ID NO: 721370 - DNA, 20 bp, Artificial
  CRISPR gRNA sequence
acccaaatagcatacattgt

SEQ ID NO: 721371 - DNA, 20 bp, Artificial
  CRISPR gRNA sequence
taccccttaaataatttctc

SEQ ID NO: 721372 - DNA, 20 bp, Artificial
  CRISPR gRNA sequence
aaataatttctcatggtcca

SEQ ID NO: 721373 - DNA, 20 bp, Artificial
  CRISPR gRNA sequence
aataatttctcatggtccac

SEQ ID NO: 721374 - DNA, 20 bp, Artificial
  CRISPR gRNA sequence
ctcatggtccacctacctat

SEQ ID NO: 721375 - DNA, 20 bp, Artificial
  CRISPR gRNA sequence
tcatggtccacctacctata

SEQ ID NO: 721376 - DNA, 20 bp, Artificial
  CRISPR gRNA sequence
atggtccacctacctatacc

SEQ ID NO: 721377 - DNA, 20 bp, Artificial
  CRISPR gRNA sequence
cctatacctcccaccccctc

SEQ ID NO: 721378 - DNA, 20 bp, Artificial
  CRISPR gRNA sequence
tacctcccaccccctcaccc

SEQ ID NO: 721379 - DNA, 20 bp, Artificial
  CRISPR gRNA sequence
ccaccccctcacccttctaa

SEQ ID NO: 721380 - DNA, 20 bp, Artificial
  CRISPR gRNA sequence
acccttctaagtctctgttg

SEQ ID NO: 721381 - DNA, 20 bp, Artificial
  CRISPR gRNA sequence
ctaagtctctgttgcctttt

SEQ ID NO: 721382 - DNA, 20 bp, Artificial
  CRISPR gRNA sequence
taagtctctgttgcctttta

SEQ ID NO: 721383 - DNA, 20 bp, Artificial
  CRISPR gRNA sequence
agtctctgttgccttttatt

SEQ ID NO: 721384 - DNA, 20 bp, Artificial
  CRISPR gRNA sequence
tgttgccttttattccactc

SEQ ID NO: 721385 - DNA, 20 bp, Artificial
  CRISPR gRNA sequence
ttgccttttattccactctc

SEQ ID NO: 721386 - DNA, 20 bp, Artificial
  CRISPR gRNA sequence
ccttttattccactctccag

SEQ ID NO: 721387 - DNA, 20 bp, Artificial
  CRISPR gRNA sequence
ttattccactctccagctcc

SEQ ID NO: 721388 - DNA, 20 bp, Artificial
  CRISPR gRNA sequence
tattccactctccagctccg

SEQ ID NO: 721389 - DNA, 20 bp, Artificial
  CRISPR gRNA sequence
attccactctccagctccgt

SEQ ID NO: 721390 - DNA, 20 bp, Artificial
  CRISPR gRNA sequence
ttccactctccagctccgtg

SEQ ID NO: 721391 - DNA, 20 bp, Artificial
  CRISPR gRNA sequence
cactctccagctccgtgtgg

SEQ ID NO: 721392 - DNA, 20 bp, Artificial
  CRISPR gRNA sequence
tccagctccgtgtggacaca

SEQ ID NO: 721393 - DNA, 20 bp, Artificial
  CRISPR gRNA sequence
cagctccgtgtggacacagt

SEQ ID NO: 721394 - DNA, 20 bp, Artificial
  CRISPR gRNA sequence
cgtgtggacacagtatttca

SEQ ID NO: 721395 - DNA, 20 bp, Artificial
  CRISPR gRNA sequence
cactcccacttagaagtgag

SEQ ID NO: 721396 - DNA, 20 bp, Artificial
  CRISPR gRNA sequence
actcccacttagaagtgaga

SEQ ID NO: 721397 - DNA, 20 bp, Artificial
  CRISPR gRNA sequence
ccacttagaagtgagaacag

SEQ ID NO: 721398 - DNA, 20 bp, Artificial
  CRISPR gRNA sequence
agaagtgagaacaggcagta

SEQ ID NO: 721399 - DNA, 20 bp, Artificial
  CRISPR gRNA sequence
gaagtgagaacaggcagtat

SEQ ID NO: 721400 - DNA, 20 bp, Artificial
  CRISPR gRNA sequence
gtctttctgtgtctgaatgt

SEQ ID NO: 721401 - DNA, 20 bp, Artificial
  CRISPR gRNA sequence
tctttctgtgtctgaatgtc

SEQ ID NO: 721402 - DNA, 20 bp, Artificial
  CRISPR gRNA sequence
tctgtgtctgaatgtctgca

SEQ ID NO: 721403 - DNA, 20 bp, Artificial
  CRISPR gRNA sequence
ctgtgtctgaatgtctgcac

SEQ ID NO: 721404 - DNA, 20 bp, Artificial
  CRISPR gRNA sequence
tgtgtctgaatgtctgcact

SEQ ID NO: 721405 - DNA, 20 bp, Artificial
  CRISPR gRNA sequence
tgtctgaatgtctgcactta

SEQ ID NO: 721406 - DNA, 20 bp, Artificial
  CRISPR gRNA sequence
aatgtctgcacttaagaata

SEQ ID NO: 721407 - DNA, 20 bp, Artificial
  CRISPR gRNA sequence
cacttaagaatatggccttc

SEQ ID NO: 721408 - DNA, 20 bp, Artificial
  CRISPR gRNA sequence
aagaatatggccttcagttc

SEQ ID NO: 721409 - DNA, 20 bp, Artificial
  CRISPR gRNA sequence
agaatatggccttcagttcc

SEQ ID NO: 721410 - DNA, 20 bp, Artificial
  CRISPR gRNA sequence
cagttccatccatgttgctg

SEQ ID NO: 721411 - DNA, 20 bp, Artificial
  CRISPR gRNA sequence
agttccatccatgttgctgc

SEQ ID NO: 721412 - DNA, 20 bp, Artificial
  CRISPR gRNA sequence
catccatgttgctgcgaaag

SEQ ID NO: 721413 - DNA, 20 bp, Artificial
  CRISPR gRNA sequence
ctgcgaaagacttgatttct

SEQ ID NO: 721414 - DNA, 20 bp, Artificial
  CRISPR gRNA sequence
cgaaagacttgatttctttc

SEQ ID NO: 721415 - DNA, 20 bp, Artificial
  CRISPR gRNA sequence
gatttctttccttatgatgg

SEQ ID NO: 721416 - DNA, 20 bp, Artificial
  CRISPR gRNA sequence
atttctttccttatgatggc

SEQ ID NO: 721417 - DNA, 20 bp, Artificial
  CRISPR gRNA sequence
ctttccttatgatggctgag

SEQ ID NO: 721418 - DNA, 20 bp, Artificial
  CRISPR gRNA sequence
tttccttatgatggctgagt

SEQ ID NO: 721419 - DNA, 20 bp, Artificial
  CRISPR gRNA sequence
tccttatgatggctgagtag

SEQ ID NO: 721420 - DNA, 20 bp, Artificial
  CRISPR gRNA sequence
ccttatgatggctgagtagt

SEQ ID NO: 721421 - DNA, 20 bp, Artificial
  CRISPR gRNA sequence
cttatgatggctgagtagta

SEQ ID NO: 721422 - DNA, 20 bp, Artificial
  CRISPR gRNA sequence
atgatggctgagtagtattc

SEQ ID NO: 721423 - DNA, 20 bp, Artificial
  CRISPR gRNA sequence
tgatggctgagtagtattcc

SEQ ID NO: 721424 - DNA, 20 bp, Artificial
  CRISPR gRNA sequence
agtagtattccattgtgtat

SEQ ID NO: 721425 - DNA, 20 bp, Artificial
  CRISPR gRNA sequence
cattgtgtatagatgccaca

SEQ ID NO: 721426 - DNA, 20 bp, Artificial
  CRISPR gRNA sequence
tgtatagatgccacatttat

SEQ ID NO: 721427 - DNA, 20 bp, Artificial
  CRISPR gRNA sequence
atctattggtggatgcagca

SEQ ID NO: 721428 - DNA, 20 bp, Artificial
  CRISPR gRNA sequence
tctattggtggatgcagcat

SEQ ID NO: 721429 - DNA, 20 bp, Artificial
  CRISPR gRNA sequence
ttggtggatgcagcataacc

SEQ ID NO: 721430 - DNA, 20 bp, Artificial
  CRISPR gRNA sequence
gtggatgcagcataaccctc

SEQ ID NO: 721431 - DNA, 20 bp, Artificial
  CRISPR gRNA sequence
cccccccacccttttctttt

SEQ ID NO: 721432 - DNA, 20 bp, Artificial
  CRISPR gRNA sequence
ttctttttgagacaaagtct

SEQ ID NO: 721433 - DNA, 20 bp, Artificial
  CRISPR gRNA sequence
tctttttgagacaaagtctc

SEQ ID NO: 721434 - DNA, 20 bp, Artificial
  CRISPR gRNA sequence
ctttttgagacaaagtctcg

SEQ ID NO: 721435 - DNA, 20 bp, Artificial
  CRISPR gRNA sequence
tttttgagacaaagtctcgc

SEQ ID NO: 721436 - DNA, 20 bp, Artificial
  CRISPR gRNA sequence
tttgagacaaagtctcgctc

SEQ ID NO: 721437 - DNA, 20 bp, Artificial
  CRISPR gRNA sequence
ttgagacaaagtctcgctct

SEQ ID NO: 721438 - DNA, 20 bp, Artificial
  CRISPR gRNA sequence
tgagacaaagtctcgctctg

SEQ ID NO: 721439 - DNA, 20 bp, Artificial
  CRISPR gRNA sequence
gagacaaagtctcgctctgt

SEQ ID NO: 721440 - DNA, 20 bp, Artificial
  CRISPR gRNA sequence
agacaaagtctcgctctgtt

SEQ ID NO: 721441 - DNA, 20 bp, Artificial
  CRISPR gRNA sequence
gctctgttgcccaggctgga

SEQ ID NO: 721442 - DNA, 20 bp, Artificial
  CRISPR gRNA sequence
tgttgcccaggctggagtgc

SEQ ID NO: 721443 - DNA, 20 bp, Artificial
  CRISPR gRNA sequence
ttgcccaggctggagtgcag

SEQ ID NO: 721444 - DNA, 20 bp, Artificial
  CRISPR gRNA sequence
cccaggctggagtgcagtgg

SEQ ID NO: 721445 - DNA, 20 bp, Artificial
  CRISPR gRNA sequence
gagtgcagtggtatggtctc

SEQ ID NO: 721446 - DNA, 20 bp, Artificial
  CRISPR gRNA sequence
ggctcacggcaacctctgcc

SEQ ID NO: 721447 - DNA, 20 bp, Artificial
  CRISPR gRNA sequence
acggcaacctctgcctcctg

SEQ ID NO: 721448 - DNA, 20 bp, Artificial
  CRISPR gRNA sequence
tgcctcctgggtttgagcta

SEQ ID NO: 721449 - DNA, 20 bp, Artificial
  CRISPR gRNA sequence
cctcctgggtttgagctatt

SEQ ID NO: 721450 - DNA, 20 bp, Artificial
  CRISPR gRNA sequence
ctgggtttgagctattcttg

SEQ ID NO: 721451 - DNA, 20 bp, Artificial
  CRISPR gRNA sequence
ggtttgagctattcttgtgc

SEQ ID NO: 721452 - DNA, 20 bp, Artificial
  CRISPR gRNA sequence
gagctattcttgtgcctcag

SEQ ID NO: 721453 - DNA, 20 bp, Artificial
  CRISPR gRNA sequence
agctattcttgtgcctcagc

SEQ ID NO: 721454 - DNA, 20 bp, Artificial
  CRISPR gRNA sequence
ttcttgtgcctcagcctccc

SEQ ID NO: 721455 - DNA, 20 bp, Artificial
  CRISPR gRNA sequence
ttgtgcctcagcctcccaag

SEQ ID NO: 721456 - DNA, 20 bp, Artificial
  CRISPR gRNA sequence
gtgcctcagcctcccaagta

SEQ ID NO: 721457 - DNA, 20 bp, Artificial
  CRISPR gRNA sequence
tgcctcagcctcccaagtag

SEQ ID NO: 721458 - DNA, 20 bp, Artificial
  CRISPR gRNA sequence
agcctcccaagtagctggga

SEQ ID NO: 721459 - DNA, 20 bp, Artificial
  CRISPR gRNA sequence
ccaagtagctgggattacag

SEQ ID NO: 721460 - DNA, 20 bp, Artificial
  CRISPR gRNA sequence
ggattacaggcgtgcaccac

SEQ ID NO: 721461 - DNA, 20 bp, Artificial
  CRISPR gRNA sequence
caggcgtgcaccaccacacc

SEQ ID NO: 721462 - DNA, 20 bp, Artificial
  CRISPR gRNA sequence
atttttgtatttttagtaga

SEQ ID NO: 721463 - DNA, 20 bp, Artificial
  CRISPR gRNA sequence
ttgtatttttagtagagacg

SEQ ID NO: 721464 - DNA, 20 bp, Artificial
  CRISPR gRNA sequence
tgtatttttagtagagacgg

SEQ ID NO: 721465 - DNA, 20 bp, Artificial
  CRISPR gRNA sequence
gtatttttagtagagacggg

SEQ ID NO: 721466 - DNA, 20 bp, Artificial
  CRISPR gRNA sequence
tatttttagtagagacgggg

SEQ ID NO: 721467 - DNA, 20 bp, Artificial
  CRISPR gRNA sequence
ttagtagagacggggtttca

SEQ ID NO: 721468 - DNA, 20 bp, Artificial
  CRISPR gRNA sequence
tagtagagacggggtttcac

SEQ ID NO: 721469 - DNA, 20 bp, Artificial
  CRISPR gRNA sequence
agtagagacggggtttcacc

SEQ ID NO: 721470 - DNA, 20 bp, Artificial
  CRISPR gRNA sequence
gtagagacggggtttcacca

SEQ ID NO: 721471 - DNA, 20 bp, Artificial
  CRISPR gRNA sequence
caccacattggtcaggctgg

SEQ ID NO: 721472 - DNA, 20 bp, Artificial
  CRISPR gRNA sequence
accacattggtcaggctggt

SEQ ID NO: 721473 - DNA, 20 bp, Artificial
  CRISPR gRNA sequence
gtcaggctggtctcgaactc

SEQ ID NO: 721474 - DNA, 20 bp, Artificial
  CRISPR gRNA sequence
gtctcgaactcctgacccca

SEQ ID NO: 721475 - DNA, 20 bp, Artificial
  CRISPR gRNA sequence
gaactcctgaccccaggtga

SEQ ID NO: 721476 - DNA, 20 bp, Artificial
  CRISPR gRNA sequence
ctgaccccaggtgatctgcc

SEQ ID NO: 721477 - DNA, 20 bp, Artificial
  CRISPR gRNA sequence
accccaggtgatctgcctgc

SEQ ID NO: 721478 - DNA, 20 bp, Artificial
  CRISPR gRNA sequence
cctgcctcagcctcccaaag

SEQ ID NO: 721479 - DNA, 20 bp, Artificial
  CRISPR gRNA sequence
cctcagcctcccaaagtgct

SEQ ID NO: 721480 - DNA, 20 bp, Artificial
  CRISPR gRNA sequence
agcctcccaaagtgctggga

SEQ ID NO: 721481 - DNA, 20 bp, Artificial
  CRISPR gRNA sequence
ccaaagtgctgggattacag

SEQ ID NO: 721482 - DNA, 20 bp, Artificial
  CRISPR gRNA sequence
ggattacaggcgtgagccac

SEQ ID NO: 721483 - DNA, 20 bp, Artificial
  CRISPR gRNA sequence
caggcgtgagccaccgcacc

SEQ ID NO: 721484 - DNA, 20 bp, Artificial
  CRISPR gRNA sequence
ttaaaataaatatgaatgag

SEQ ID NO: 721485 - DNA, 20 bp, Artificial
  CRISPR gRNA sequence
taaaataaatatgaatgagc

SEQ ID NO: 721486 - DNA, 20 bp, Artificial
  CRISPR gRNA sequence
aaaataaatatgaatgagca

SEQ ID NO: 721487 - DNA, 20 bp, Artificial
  CRISPR gRNA sequence
aaataaatatgaatgagcaa

SEQ ID NO: 721488 - DNA, 20 bp, Artificial
  CRISPR gRNA sequence
gtaagaaaaaccagccctac

SEQ ID NO: 721489 - DNA, 20 bp, Artificial
  CRISPR gRNA sequence
taagaaaaaccagccctaca

SEQ ID NO: 721490 - DNA, 20 bp, Artificial
  CRISPR gRNA sequence
caaaggagaataaaaagata

SEQ ID NO: 721491 - DNA, 20 bp, Artificial
  CRISPR gRNA sequence
ttaccacacatgaagctttg

SEQ ID NO: 721492 - DNA, 20 bp, Artificial
  CRISPR gRNA sequence
accacacatgaagctttgat

SEQ ID NO: 721493 - DNA, 20 bp, Artificial
  CRISPR gRNA sequence
ccacacatgaagctttgata

SEQ ID NO: 721494 - DNA, 20 bp, Artificial
  CRISPR gRNA sequence
tgataaatccaggaatagaa

SEQ ID NO: 721495 - DNA, 20 bp, Artificial
  CRISPR gRNA sequence
gataaatccaggaatagaag

SEQ ID NO: 721496 - DNA, 20 bp, Artificial
  CRISPR gRNA sequence
ataaatccaggaatagaaga

SEQ ID NO: 721497 - DNA, 20 bp, Artificial
  CRISPR gRNA sequence
agcaacattaaattcgtgtc

SEQ ID NO: 721498 - DNA, 20 bp, Artificial
  CRISPR gRNA sequence
gcaacattaaattcgtgtct

SEQ ID NO: 721499 - DNA, 20 bp, Artificial
  CRISPR gRNA sequence
aattcgtgtctgcagaaaaa

SEQ ID NO: 721500 - DNA, 20 bp, Artificial
  CRISPR gRNA sequence
gtgtctgcagaaaaattcac

SEQ ID NO: 721501 - DNA, 20 bp, Artificial
  CRISPR gRNA sequence
cagaaaaattcacgaagtcg

SEQ ID NO: 721502 - DNA, 20 bp, Artificial
  CRISPR gRNA sequence
acgaagtcgttacatccata

SEQ ID NO: 721503 - DNA, 20 bp, Artificial
  CRISPR gRNA sequence
catccataaggtgggcacag

SEQ ID NO: 721504 - DNA, 20 bp, Artificial
  CRISPR gRNA sequence
tgaaaaggaacaatatggga

SEQ ID NO: 721505 - DNA, 20 bp, Artificial
  CRISPR gRNA sequence
tttagaaagtgtgcttgtga

SEQ ID NO: 721506 - DNA, 20 bp, Artificial
  CRISPR gRNA sequence
ttagaaagtgtgcttgtgat

SEQ ID NO: 721507 - DNA, 20 bp, Artificial
  CRISPR gRNA sequence
tagaaagtgtgcttgtgatc

SEQ ID NO: 721508 - DNA, 20 bp, Artificial
  CRISPR gRNA sequence
agaaagtgtgcttgtgatca

SEQ ID NO: 721509 - DNA, 20 bp, Artificial
  CRISPR gRNA sequence
gaaagtgtgcttgtgatcag

SEQ ID NO: 721510 - DNA, 20 bp, Artificial
  CRISPR gRNA sequence
gtgatcagcccatcatctct

SEQ ID NO: 721511 - DNA, 20 bp, Artificial
  CRISPR gRNA sequence
tgatcagcccatcatctcta

SEQ ID NO: 721512 - DNA, 20 bp, Artificial
  CRISPR gRNA sequence
taggttctccattcaccttt

SEQ ID NO: 721513 - DNA, 20 bp, Artificial
  CRISPR gRNA sequence
ggttctccattcacctttcc

SEQ ID NO: 721514 - DNA, 20 bp, Artificial
  CRISPR gRNA sequence
tccattcacctttccatccc

SEQ ID NO: 721515 - DNA, 20 bp, Artificial
  CRISPR gRNA sequence
cattcacctttccatccctg

SEQ ID NO: 721516 - DNA, 20 bp, Artificial
  CRISPR gRNA sequence
acctttccatccctgccctg

SEQ ID NO: 721517 - DNA, 20 bp, Artificial
  CRISPR gRNA sequence
tccatccctgccctgccatc

SEQ ID NO: 721518 - DNA, 20 bp, Artificial
  CRISPR gRNA sequence
ccatccctgccctgccatca

SEQ ID NO: 721519 - DNA, 20 bp, Artificial
  CRISPR gRNA sequence
catccctgccctgccatcaa

SEQ ID NO: 721520 - DNA, 20 bp, Artificial
  CRISPR gRNA sequence
ccctgccatcaacgatggct

SEQ ID NO: 721521 - DNA, 20 bp, Artificial
  CRISPR gRNA sequence
ccatcaacgatggctccgcc

SEQ ID NO: 721522 - DNA, 20 bp, Artificial
  CRISPR gRNA sequence
cgcctttctcctctgtaggg

SEQ ID NO: 721523 - DNA, 20 bp, Artificial
  CRISPR gRNA sequence
tctcctctgtagggagcatg

SEQ ID NO: 721524 - DNA, 20 bp, Artificial
  CRISPR gRNA sequence
ctcctctgtagggagcatgc

SEQ ID NO: 721525 - DNA, 20 bp, Artificial
  CRISPR gRNA sequence
tcctctgtagggagcatgca

SEQ ID NO: 721526 - DNA, 20 bp, Artificial
  CRISPR gRNA sequence
ctctgtagggagcatgcagt

SEQ ID NO: 721527 - DNA, 20 bp, Artificial
  CRISPR gRNA sequence
tgtagggagcatgcagttaa

SEQ ID NO: 721528 - DNA, 20 bp, Artificial
  CRISPR gRNA sequence
tagggagcatgcagttaagc

SEQ ID NO: 721529 - DNA, 20 bp, Artificial
  CRISPR gRNA sequence
agccttgccagcagagggcg

SEQ ID NO: 721530 - DNA, 20 bp, Artificial
  CRISPR gRNA sequence
gccagcagagggcgctagag

SEQ ID NO: 721531 - DNA, 20 bp, Artificial
  CRISPR gRNA sequence
ccagcagagggcgctagagg

SEQ ID NO: 721532 - DNA, 20 bp, Artificial
  CRISPR gRNA sequence
gagggccatcgcaggaggaa

SEQ ID NO: 721533 - DNA, 20 bp, Artificial
  CRISPR gRNA sequence
ctggttgcatttgttttttt

SEQ ID NO: 721534 - DNA, 20 bp, Artificial
  CRISPR gRNA sequence
tggttgcatttgtttttttg

SEQ ID NO: 721535 - DNA, 20 bp, Artificial
  CRISPR gRNA sequence
gttgcatttgtttttttgtt

SEQ ID NO: 721536 - DNA, 20 bp, Artificial
  CRISPR gRNA sequence
catttgtttttttgtttgtt

SEQ ID NO: 721537 - DNA, 20 bp, Artificial
  CRISPR gRNA sequence
gtttttttgtttgtttgttt

SEQ ID NO: 721538 - DNA, 20 bp, Artificial
  CRISPR gRNA sequence
tttttttgtttgtttgtttg

SEQ ID NO: 721539 - DNA, 20 bp, Artificial
  CRISPR gRNA sequence
ttttgtttgtttgtttgttt

SEQ ID NO: 721540 - DNA, 20 bp, Artificial
  CRISPR gRNA sequence
tttgtttgtttgtttgtttc

SEQ ID NO: 721541 - DNA, 20 bp, Artificial
  CRISPR gRNA sequence
ttgtttgtttgtttgtttct

SEQ ID NO: 721542 - DNA, 20 bp, Artificial
  CRISPR gRNA sequence
tgtttgtttgtttgtttctt

SEQ ID NO: 721543 - DNA, 20 bp, Artificial
  CRISPR gRNA sequence
gtttgtttgtttgtttcttt

SEQ ID NO: 721544 - DNA, 20 bp, Artificial
  CRISPR gRNA sequence
tttgtttgtttgtttctttt

SEQ ID NO: 721545 - DNA, 20 bp, Artificial
  CRISPR gRNA sequence
gtttgtttgtttcttttctt

SEQ ID NO: 721546 - DNA, 20 bp, Artificial
  CRISPR gRNA sequence
tttgtttgtttcttttcttt

SEQ ID NO: 721547 - DNA, 20 bp, Artificial
  CRISPR gRNA sequence
gtttgtttcttttctttttt

SEQ ID NO: 721548 - DNA, 20 bp, Artificial
  CRISPR gRNA sequence
tttgtttcttttcttttttt

SEQ ID NO: 721549 - DNA, 20 bp, Artificial
  CRISPR gRNA sequence
gtttcttttctttttttgag

SEQ ID NO: 721550 - DNA, 20 bp, Artificial
  CRISPR gRNA sequence
tttcttttctttttttgaga

SEQ ID NO: 721551 - DNA, 20 bp, Artificial
  CRISPR gRNA sequence
cttttctttttttgagacag

SEQ ID NO: 721552 - DNA, 20 bp, Artificial
  CRISPR gRNA sequence
ttttctttttttgagacaga

SEQ ID NO: 721553 - DNA, 20 bp, Artificial
  CRISPR gRNA sequence
ttctttttttgagacagagt

SEQ ID NO: 721554 - DNA, 20 bp, Artificial
  CRISPR gRNA sequence
tctttttttgagacagagtc

SEQ ID NO: 721555 - DNA, 20 bp, Artificial
  CRISPR gRNA sequence
ctttttttgagacagagtct

SEQ ID NO: 721556 - DNA, 20 bp, Artificial
  CRISPR gRNA sequence
tttttttgagacagagtctc

SEQ ID NO: 721557 - DNA, 20 bp, Artificial
  CRISPR gRNA sequence
tttttgagacagagtctcac

SEQ ID NO: 721558 - DNA, 20 bp, Artificial
  CRISPR gRNA sequence
ttttgagacagagtctcact

SEQ ID NO: 721559 - DNA, 20 bp, Artificial
  CRISPR gRNA sequence
tttgagacagagtctcactc

SEQ ID NO: 721560 - DNA, 20 bp, Artificial
  CRISPR gRNA sequence
ttgagacagagtctcactct

SEQ ID NO: 721561 - DNA, 20 bp, Artificial
  CRISPR gRNA sequence
tgagacagagtctcactctg

SEQ ID NO: 721562 - DNA, 20 bp, Artificial
  CRISPR gRNA sequence
gagacagagtctcactctgt

SEQ ID NO: 721563 - DNA, 20 bp, Artificial
  CRISPR gRNA sequence
agacagagtctcactctgtc

SEQ ID NO: 721564 - DNA, 20 bp, Artificial
  CRISPR gRNA sequence
actctgtcgcccaggctgga

SEQ ID NO: 721565 - DNA, 20 bp, Artificial
  CRISPR gRNA sequence
tgtcgcccaggctggagtgc

SEQ ID NO: 721566 - DNA, 20 bp, Artificial
  CRISPR gRNA sequence
tcgcccaggctggagtgcag

SEQ ID NO: 721567 - DNA, 20 bp, Artificial
  CRISPR gRNA sequence
gagtgcagtgacgcgatctt

SEQ ID NO: 721568 - DNA, 20 bp, Artificial
  CRISPR gRNA sequence
ggcccaccacaacctccacc

SEQ ID NO: 721569 - DNA, 20 bp, Artificial
  CRISPR gRNA sequence
gcccaccacaacctccacct

SEQ ID NO: 721570 - DNA, 20 bp, Artificial
  CRISPR gRNA sequence
cacctcccgggttcaagcag

SEQ ID NO: 721571 - DNA, 20 bp, Artificial
  CRISPR gRNA sequence
ccgggttcaagcagttttcc

SEQ ID NO: 721572 - DNA, 20 bp, Artificial
  CRISPR gRNA sequence
aagcagttttcctgcctcag

SEQ ID NO: 721573 - DNA, 20 bp, Artificial
  CRISPR gRNA sequence
tcctgcctcagcctcctgag

SEQ ID NO: 721574 - DNA, 20 bp, Artificial
  CRISPR gRNA sequence
cctgcctcagcctcctgagt

SEQ ID NO: 721575 - DNA, 20 bp, Artificial
  CRISPR gRNA sequence
ctgcctcagcctcctgagta

SEQ ID NO: 721576 - DNA, 20 bp, Artificial
  CRISPR gRNA sequence
cctcagcctcctgagtagct

SEQ ID NO: 721577 - DNA, 20 bp, Artificial
  CRISPR gRNA sequence
agcctcctgagtagctggga

SEQ ID NO: 721578 - DNA, 20 bp, Artificial
  CRISPR gRNA sequence
ctgagtagctgggattacag

SEQ ID NO: 721579 - DNA, 20 bp, Artificial
  CRISPR gRNA sequence
agtagctgggattacaggca

SEQ ID NO: 721580 - DNA, 20 bp, Artificial
  CRISPR gRNA sequence
ggattacaggcacgcgccac

SEQ ID NO: 721581 - DNA, 20 bp, Artificial
  CRISPR gRNA sequence
caggcacgcgccaccacgcc

SEQ ID NO: 721582 - DNA, 20 bp, Artificial
  CRISPR gRNA sequence
gctaatttttgtatttttag

SEQ ID NO: 721583 - DNA, 20 bp, Artificial
  CRISPR gRNA sequence
atttttgtatttttagtaga

SEQ ID NO: 721584 - DNA, 20 bp, Artificial
  CRISPR gRNA sequence
ttgtatttttagtagagaca

SEQ ID NO: 721585 - DNA, 20 bp, Artificial
  CRISPR gRNA sequence
tgtatttttagtagagacag

SEQ ID NO: 721586 - DNA, 20 bp, Artificial
  CRISPR gRNA sequence
gtatttttagtagagacagg

SEQ ID NO: 721587 - DNA, 20 bp, Artificial
  CRISPR gRNA sequence
tatttttagtagagacaggg

SEQ ID NO: 721588 - DNA, 20 bp, Artificial
  CRISPR gRNA sequence
ttagtagagacagggtttca

SEQ ID NO: 721589 - DNA, 20 bp, Artificial
  CRISPR gRNA sequence
tagtagagacagggtttcac

SEQ ID NO: 721590 - DNA, 20 bp, Artificial
  CRISPR gRNA sequence
agtagagacagggtttcacc

SEQ ID NO: 721591 - DNA, 20 bp, Artificial
  CRISPR gRNA sequence
gtagagacagggtttcacca

SEQ ID NO: 721592 - DNA, 20 bp, Artificial
  CRISPR gRNA sequence
caccatgatggtcaggctgg

SEQ ID NO: 721593 - DNA, 20 bp, Artificial
  CRISPR gRNA sequence
accatgatggtcaggctggt

SEQ ID NO: 721594 - DNA, 20 bp, Artificial
  CRISPR gRNA sequence
gtctcgaactcctgacctgg

SEQ ID NO: 721595 - DNA, 20 bp, Artificial
  CRISPR gRNA sequence
gaactcctgacctggtgatc

SEQ ID NO: 721596 - DNA, 20 bp, Artificial
  CRISPR gRNA sequence
ctgacctggtgatccgcctg

SEQ ID NO: 721597 - DNA, 20 bp, Artificial
  CRISPR gRNA sequence
acctggtgatccgcctgcct

SEQ ID NO: 721598 - DNA, 20 bp, Artificial
  CRISPR gRNA sequence
gtgatccgcctgcctcggcc

SEQ ID NO: 721599 - DNA, 20 bp, Artificial
  CRISPR gRNA sequence
cctcggcctcgcaaaagtgc

SEQ ID NO: 721600 - DNA, 20 bp, Artificial
  CRISPR gRNA sequence
ggcctcgcaaaagtgctggg

SEQ ID NO: 721601 - DNA, 20 bp, Artificial
  CRISPR gRNA sequence
gcaaaagtgctgggattacc

SEQ ID NO: 721602 - DNA, 20 bp, Artificial
  CRISPR gRNA sequence
ggattaccggcgtgagccac

SEQ ID NO: 721603 - DNA, 20 bp, Artificial
  CRISPR gRNA sequence
ccggcgtgagccactgcgcc

SEQ ID NO: 721604 - DNA, 20 bp, Artificial
  CRISPR gRNA sequence
cgcccggccatttgtttctt

SEQ ID NO: 721605 - DNA, 20 bp, Artificial
  CRISPR gRNA sequence
gtttcttcttgctcctgctg

SEQ ID NO: 721606 - DNA, 20 bp, Artificial
  CRISPR gRNA sequence
tttcttcttgctcctgctgc

SEQ ID NO: 721607 - DNA, 20 bp, Artificial
  CRISPR gRNA sequence
cttcttgctcctgctgcctg

SEQ ID NO: 721608 - DNA, 20 bp, Artificial
  CRISPR gRNA sequence
ttcttgctcctgctgcctgg

SEQ ID NO: 721609 - DNA, 20 bp, Artificial
  CRISPR gRNA sequence
cttgctcctgctgcctggcc

SEQ ID NO: 721610 - DNA, 20 bp, Artificial
  CRISPR gRNA sequence
ttgctcctgctgcctggcct

SEQ ID NO: 721611 - DNA, 20 bp, Artificial
  CRISPR gRNA sequence
gctcctgctgcctggcctgg

SEQ ID NO: 721612 - DNA, 20 bp, Artificial
  CRISPR gRNA sequence
ctcctgctgcctggcctggt

SEQ ID NO: 721613 - DNA, 20 bp, Artificial
  CRISPR gRNA sequence
ctgctgcctggcctggtgac

SEQ ID NO: 721614 - DNA, 20 bp, Artificial
  CRISPR gRNA sequence
ctgcctggcctggtgaccac

SEQ ID NO: 721615 - DNA, 20 bp, Artificial
  CRISPR gRNA sequence
cctggcctggtgaccacctt

SEQ ID NO: 721616 - DNA, 20 bp, Artificial
  CRISPR gRNA sequence
gcctggtgaccaccttgatg

SEQ ID NO: 721617 - DNA, 20 bp, Artificial
  CRISPR gRNA sequence
gtgaccaccttgatgtggct

SEQ ID NO: 721618 - DNA, 20 bp, Artificial
  CRISPR gRNA sequence
gatgtggctctcccaatgca

SEQ ID NO: 721619 - DNA, 20 bp, Artificial
  CRISPR gRNA sequence
atgtggctctcccaatgcag

SEQ ID NO: 721620 - DNA, 20 bp, Artificial
  CRISPR gRNA sequence
tcccaatgcagacattggca

SEQ ID NO: 721621 - DNA, 20 bp, Artificial
  CRISPR gRNA sequence
ccaatgcagacattggcacg

SEQ ID NO: 721622 - DNA, 20 bp, Artificial
  CRISPR gRNA sequence
gcacgtgccaggcctcatgt

SEQ ID NO: 721623 - DNA, 20 bp, Artificial
  CRISPR gRNA sequence
atgtctgcaaaagtgtcctg

SEQ ID NO: 721624 - DNA, 20 bp, Artificial
  CRISPR gRNA sequence
caaaagtgtcctgactccct

SEQ ID NO: 721625 - DNA, 20 bp, Artificial
  CRISPR gRNA sequence
actccctgattccctctgtg

SEQ ID NO: 721626 - DNA, 20 bp, Artificial
  CRISPR gRNA sequence
cctgattccctctgtgcatc

SEQ ID NO: 721627 - DNA, 20 bp, Artificial
  CRISPR gRNA sequence
attccctctgtgcatccccc

SEQ ID NO: 721628 - DNA, 20 bp, Artificial
  CRISPR gRNA sequence
cctctgtgcatcccccacca

SEQ ID NO: 721629 - DNA, 20 bp, Artificial
  CRISPR gRNA sequence
tgtgcatcccccaccagcca

SEQ ID NO: 721630 - DNA, 20 bp, Artificial
  CRISPR gRNA sequence
tgcatcccccaccagccaca

SEQ ID NO: 721631 - DNA, 20 bp, Artificial
  CRISPR gRNA sequence
tggcaccccaaagtgctcca

SEQ ID NO: 721632 - DNA, 20 bp, Artificial
  CRISPR gRNA sequence
ggcaccccaaagtgctccag

SEQ ID NO: 721633 - DNA, 20 bp, Artificial
  CRISPR gRNA sequence
gcaccccaaagtgctccagg

SEQ ID NO: 721634 - DNA, 20 bp, Artificial
  CRISPR gRNA sequence
caggcgtctcccccacagtg

SEQ ID NO: 721635 - DNA, 20 bp, Artificial
  CRISPR gRNA sequence
ccccacagtggcagcctcaa

SEQ ID NO: 721636 - DNA, 20 bp, Artificial
  CRISPR gRNA sequence
aatttctctgtgcacctgac

SEQ ID NO: 721637 - DNA, 20 bp, Artificial
  CRISPR gRNA sequence
ctctgtgcacctgaccagaa

SEQ ID NO: 721638 - DNA, 20 bp, Artificial
  CRISPR gRNA sequence
tctgtgcacctgaccagaag

SEQ ID NO: 721639 - DNA, 20 bp, Artificial
  CRISPR gRNA sequence
tgtgcacctgaccagaagca

SEQ ID NO: 721640 - DNA, 20 bp, Artificial
  CRISPR gRNA sequence
tgcacctgaccagaagcata

SEQ ID NO: 721641 - DNA, 20 bp, Artificial
  CRISPR gRNA sequence
accagaagcatagacttcag

SEQ ID NO: 721642 - DNA, 20 bp, Artificial
  CRISPR gRNA sequence
caggtcaaaaggacctacca

SEQ ID NO: 721643 - DNA, 20 bp, Artificial
  CRISPR gRNA sequence
aggtcaaaaggacctaccaa

SEQ ID NO: 721644 - DNA, 20 bp, Artificial
  CRISPR gRNA sequence
ccaagagcaaagcaggatta

SEQ ID NO: 721645 - DNA, 20 bp, Artificial
  CRISPR gRNA sequence
atggaaattacccacgctac

SEQ ID NO: 721646 - DNA, 20 bp, Artificial
  CRISPR gRNA sequence
cccacgctacatgtaataga

SEQ ID NO: 721647 - DNA, 20 bp, Artificial
  CRISPR gRNA sequence
catgtaatagatgcaccacc

SEQ ID NO: 721648 - DNA, 20 bp, Artificial
  CRISPR gRNA sequence
tatctacctgccggttgatg

SEQ ID NO: 721649 - DNA, 20 bp, Artificial
  CRISPR gRNA sequence
atctacctgccggttgatgg

SEQ ID NO: 721650 - DNA, 20 bp, Artificial
  CRISPR gRNA sequence
tctacctgccggttgatggc

SEQ ID NO: 721651 - DNA, 20 bp, Artificial
  CRISPR gRNA sequence
cctgccggttgatggcattt

SEQ ID NO: 721652 - DNA, 20 bp, Artificial
  CRISPR gRNA sequence
ccggttgatggcatttgggt

SEQ ID NO: 721653 - DNA, 20 bp, Artificial
  CRISPR gRNA sequence
atggcatttgggttgtttcc

SEQ ID NO: 721654 - DNA, 20 bp, Artificial
  CRISPR gRNA sequence
gggttgtttccagtttaggg

SEQ ID NO: 721655 - DNA, 20 bp, Artificial
  CRISPR gRNA sequence
ggttgtttccagtttagggc

SEQ ID NO: 721656 - DNA, 20 bp, Artificial
  CRISPR gRNA sequence
tttccagtttagggctatta

SEQ ID NO: 721657 - DNA, 20 bp, Artificial
  CRISPR gRNA sequence
ccagtttagggctattatga

SEQ ID NO: 721658 - DNA, 20 bp, Artificial
  CRISPR gRNA sequence
cagtttagggctattatgaa

SEQ ID NO: 721659 - DNA, 20 bp, Artificial
  CRISPR gRNA sequence
agggctattatgaatgaaaa

SEQ ID NO: 721660 - DNA, 20 bp, Artificial
  CRISPR gRNA sequence
gggctattatgaatgaaaac

SEQ ID NO: 721661 - DNA, 20 bp, Artificial
  CRISPR gRNA sequence
ttatgaatgaaaacagctgt

SEQ ID NO: 721662 - DNA, 20 bp, Artificial
  CRISPR gRNA sequence
tgaatgaaaacagctgtgaa

SEQ ID NO: 721663 - DNA, 20 bp, Artificial
  CRISPR gRNA sequence
tgaatattcttttttttttt

SEQ ID NO: 721664 - DNA, 20 bp, Artificial
  CRISPR gRNA sequence
tttttttttttttaacatgt

SEQ ID NO: 721665 - DNA, 20 bp, Artificial
  CRISPR gRNA sequence
tttttttttttaacatgtat

SEQ ID NO: 721666 - DNA, 20 bp, Artificial
  CRISPR gRNA sequence
ttttttttttaacatgtatg

SEQ ID NO: 721667 - DNA, 20 bp, Artificial
  CRISPR gRNA sequence
tttttttttaacatgtatga

SEQ ID NO: 721668 - DNA, 20 bp, Artificial
  CRISPR gRNA sequence
ttttttttaacatgtatgaa

SEQ ID NO: 721669 - DNA, 20 bp, Artificial
  CRISPR gRNA sequence
tttttttaacatgtatgaat

SEQ ID NO: 721670 - DNA, 20 bp, Artificial
  CRISPR gRNA sequence
ttttttaacatgtatgaatt

SEQ ID NO: 721671 - DNA, 20 bp, Artificial
  CRISPR gRNA sequence
tttttaacatgtatgaattt

SEQ ID NO: 721672 - DNA, 20 bp, Artificial
  CRISPR gRNA sequence
ttttaacatgtatgaattta

SEQ ID NO: 721673 - DNA, 20 bp, Artificial
  CRISPR gRNA sequence
tttaacatgtatgaatttat

SEQ ID NO: 721674 - DNA, 20 bp, Artificial
  CRISPR gRNA sequence
ttaacatgtatgaatttatc

SEQ ID NO: 721675 - DNA, 20 bp, Artificial
  CRISPR gRNA sequence
taacatgtatgaatttatct

SEQ ID NO: 721676 - DNA, 20 bp, Artificial
  CRISPR gRNA sequence
aacatgtatgaatttatctt

SEQ ID NO: 721677 - DNA, 20 bp, Artificial
  CRISPR gRNA sequence
acatgtatgaatttatctta

SEQ ID NO: 721678 - DNA, 20 bp, Artificial
  CRISPR gRNA sequence
atcttatatcttttattatt

SEQ ID NO: 721679 - DNA, 20 bp, Artificial
  CRISPR gRNA sequence
tcttatatcttttattatta

SEQ ID NO: 721680 - DNA, 20 bp, Artificial
  CRISPR gRNA sequence
atatcttttattattatttt

SEQ ID NO: 721681 - DNA, 20 bp, Artificial
  CRISPR gRNA sequence
tatcttttattattattttt

SEQ ID NO: 721682 - DNA, 20 bp, Artificial
  CRISPR gRNA sequence
ttattattatttttattatt

SEQ ID NO: 721683 - DNA, 20 bp, Artificial
  CRISPR gRNA sequence
tattattatttttattattt

SEQ ID NO: 721684 - DNA, 20 bp, Artificial
  CRISPR gRNA sequence
attattatttttattatttt

SEQ ID NO: 721685 - DNA, 20 bp, Artificial
  CRISPR gRNA sequence
ttattatttttattattttt

SEQ ID NO: 721686 - DNA, 20 bp, Artificial
  CRISPR gRNA sequence
ttatttttattatttttaga

SEQ ID NO: 721687 - DNA, 20 bp, Artificial
  CRISPR gRNA sequence
tttttattatttttagagac

SEQ ID NO: 721688 - DNA, 20 bp, Artificial
  CRISPR gRNA sequence
ttattatttttagagacagg

SEQ ID NO: 721689 - DNA, 20 bp, Artificial
  CRISPR gRNA sequence
tattatttttagagacaggg

SEQ ID NO: 721690 - DNA, 20 bp, Artificial
  CRISPR gRNA sequence
attatttttagagacagggt

SEQ ID NO: 721691 - DNA, 20 bp, Artificial
  CRISPR gRNA sequence
ttatttttagagacagggtc

SEQ ID NO: 721692 - DNA, 20 bp, Artificial
  CRISPR gRNA sequence
tttttagagacagggtctca

SEQ ID NO: 721693 - DNA, 20 bp, Artificial
  CRISPR gRNA sequence
ttagagacagggtctcactc

SEQ ID NO: 721694 - DNA, 20 bp, Artificial
  CRISPR gRNA sequence
tagagacagggtctcactct

SEQ ID NO: 721695 - DNA, 20 bp, Artificial
  CRISPR gRNA sequence
agagacagggtctcactctg

SEQ ID NO: 721696 - DNA, 20 bp, Artificial
  CRISPR gRNA sequence
gagacagggtctcactctgt

SEQ ID NO: 721697 - DNA, 20 bp, Artificial
  CRISPR gRNA sequence
actctgtgttccaggctgga

SEQ ID NO: 721698 - DNA, 20 bp, Artificial
  CRISPR gRNA sequence
tgtgttccaggctggagtgc

SEQ ID NO: 721699 - DNA, 20 bp, Artificial
  CRISPR gRNA sequence
tgttccaggctggagtgcag

SEQ ID NO: 721700 - DNA, 20 bp, Artificial
  CRISPR gRNA sequence
caggctggagtgcagtggca

SEQ ID NO: 721701 - DNA, 20 bp, Artificial
  CRISPR gRNA sequence
gagtgcagtggcatgatctt

SEQ ID NO: 721702 - DNA, 20 bp, Artificial
  CRISPR gRNA sequence
ggctcactgcagcattgaac

SEQ ID NO: 721703 - DNA, 20 bp, Artificial
  CRISPR gRNA sequence
gctcactgcagcattgaact

SEQ ID NO: 721704 - DNA, 20 bp, Artificial
  CRISPR gRNA sequence
actgcagcattgaactcctg

SEQ ID NO: 721705 - DNA, 20 bp, Artificial
  CRISPR gRNA sequence
cagcattgaactcctgggct

SEQ ID NO: 721706 - DNA, 20 bp, Artificial
  CRISPR gRNA sequence
aactcctgggctcgggcgat

SEQ ID NO: 721707 - DNA, 20 bp, Artificial
  CRISPR gRNA sequence
ctgggctcgggcgatcctcc

SEQ ID NO: 721708 - DNA, 20 bp, Artificial
  CRISPR gRNA sequence
ggctcgggcgatcctcccac

SEQ ID NO: 721709 - DNA, 20 bp, Artificial
  CRISPR gRNA sequence
gggcgatcctcccacctcag

SEQ ID NO: 721710 - DNA, 20 bp, Artificial
  CRISPR gRNA sequence
ccacctcagcctcccacagt

SEQ ID NO: 721711 - DNA, 20 bp, Artificial
  CRISPR gRNA sequence
agcctcccacagtgctgaga

SEQ ID NO: 721712 - DNA, 20 bp, Artificial
  CRISPR gRNA sequence
ccacagtgctgagattactg

SEQ ID NO: 721713 - DNA, 20 bp, Artificial
  CRISPR gRNA sequence
agattactggcatgagccac

SEQ ID NO: 721714 - DNA, 20 bp, Artificial
  CRISPR gRNA sequence
ctggcatgagccaccatgac

SEQ ID NO: 721715 - DNA, 20 bp, Artificial
  CRISPR gRNA sequence
gcatgagccaccatgactgg

SEQ ID NO: 721716 - DNA, 20 bp, Artificial
  CRISPR gRNA sequence
gccgattcttgtacaagtct

SEQ ID NO: 721717 - DNA, 20 bp, Artificial
  CRISPR gRNA sequence
ttgtacaagtctttgggtgg

SEQ ID NO: 721718 - DNA, 20 bp, Artificial
  CRISPR gRNA sequence
gtacaagtctttgggtggat

SEQ ID NO: 721719 - DNA, 20 bp, Artificial
  CRISPR gRNA sequence
tacaagtctttgggtggatg

SEQ ID NO: 721720 - DNA, 20 bp, Artificial
  CRISPR gRNA sequence
tgggtggatgtatattttca

SEQ ID NO: 721721 - DNA, 20 bp, Artificial
  CRISPR gRNA sequence
gggtggatgtatattttcat

SEQ ID NO: 721722 - DNA, 20 bp, Artificial
  CRISPR gRNA sequence
ggtggatgtatattttcatt

SEQ ID NO: 721723 - DNA, 20 bp, Artificial
  CRISPR gRNA sequence
tcatttttcatgggtaaata

SEQ ID NO: 721724 - DNA, 20 bp, Artificial
  CRISPR gRNA sequence
catttttcatgggtaaatac

SEQ ID NO: 721725 - DNA, 20 bp, Artificial
  CRISPR gRNA sequence
atttttcatgggtaaatacc

SEQ ID NO: 721726 - DNA, 20 bp, Artificial
  CRISPR gRNA sequence
ttcatgggtaaatacctagg

SEQ ID NO: 721727 - DNA, 20 bp, Artificial
  CRISPR gRNA sequence
tcatgggtaaatacctagga

SEQ ID NO: 721728 - DNA, 20 bp, Artificial
  CRISPR gRNA sequence
catgggtaaatacctaggag

SEQ ID NO: 721729 - DNA, 20 bp, Artificial
  CRISPR gRNA sequence
atgggtaaatacctaggagg

SEQ ID NO: 721730 - DNA, 20 bp, Artificial
  CRISPR gRNA sequence
ggaggagtggctaggtcatt

SEQ ID NO: 721731 - DNA, 20 bp, Artificial
  CRISPR gRNA sequence
ggtcattgtgctggtcacat

SEQ ID NO: 721732 - DNA, 20 bp, Artificial
  CRISPR gRNA sequence
tgctggtcacatagtcagaa

SEQ ID NO: 721733 - DNA, 20 bp, Artificial
  CRISPR gRNA sequence
gtcacatagtcagaatgttt

SEQ ID NO: 721734 - DNA, 20 bp, Artificial
  CRISPR gRNA sequence
ttgaggactagtcaaagctg

SEQ ID NO: 721735 - DNA, 20 bp, Artificial
  CRISPR gRNA sequence
tgaggactagtcaaagctgg

SEQ ID NO: 721736 - DNA, 20 bp, Artificial
  CRISPR gRNA sequence
gaggactagtcaaagctgga

SEQ ID NO: 721737 - DNA, 20 bp, Artificial
  CRISPR gRNA sequence
aggactagtcaaagctggat

SEQ ID NO: 721738 - DNA, 20 bp, Artificial
  CRISPR gRNA sequence
gtcaaagctggatacctctg

SEQ ID NO: 721739 - DNA, 20 bp, Artificial
  CRISPR gRNA sequence
gatacctctggtctgataca

SEQ ID NO: 721740 - DNA, 20 bp, Artificial
  CRISPR gRNA sequence
tggtctgatacaaccccttc

SEQ ID NO: 721741 - DNA, 20 bp, Artificial
  CRISPR gRNA sequence
gtctgatacaaccccttcgt

SEQ ID NO: 721742 - DNA, 20 bp, Artificial
  CRISPR gRNA sequence
atacaaccccttcgttttac

SEQ ID NO: 721743 - DNA, 20 bp, Artificial
  CRISPR gRNA sequence
cgttttacacccagagagaa

SEQ ID NO: 721744 - DNA, 20 bp, Artificial
  CRISPR gRNA sequence
gttttacacccagagagaag

SEQ ID NO: 721745 - DNA, 20 bp, Artificial
  CRISPR gRNA sequence
tacacccagagagaagcaca

SEQ ID NO: 721746 - DNA, 20 bp, Artificial
  CRISPR gRNA sequence
acacccagagagaagcacag

SEQ ID NO: 721747 - DNA, 20 bp, Artificial
  CRISPR gRNA sequence
cacccagagagaagcacagg

SEQ ID NO: 721748 - DNA, 20 bp, Artificial
  CRISPR gRNA sequence
gaaccagaatgcagggatcc

SEQ ID NO: 721749 - DNA, 20 bp, Artificial
  CRISPR gRNA sequence
ccactggaagacaccaccca

SEQ ID NO: 721750 - DNA, 20 bp, Artificial
  CRISPR gRNA sequence
cactggaagacaccacccac

SEQ ID NO: 721751 - DNA, 20 bp, Artificial
  CRISPR gRNA sequence
gaagacaccacccacccacc

SEQ ID NO: 721752 - DNA, 20 bp, Artificial
  CRISPR gRNA sequence
cttcttagttctgaacctag

SEQ ID NO: 721753 - DNA, 20 bp, Artificial
  CRISPR gRNA sequence
cttagttctgaacctagaat

SEQ ID NO: 721754 - DNA, 20 bp, Artificial
  CRISPR gRNA sequence
ttagttctgaacctagaatt

SEQ ID NO: 721755 - DNA, 20 bp, Artificial
  CRISPR gRNA sequence
agttctgaacctagaattta

SEQ ID NO: 721756 - DNA, 20 bp, Artificial
  CRISPR gRNA sequence
gttctgaacctagaatttac

SEQ ID NO: 721757 - DNA, 20 bp, Artificial
  CRISPR gRNA sequence
tgaacctagaatttacccag

SEQ ID NO: 721758 - DNA, 20 bp, Artificial
  CRISPR gRNA sequence
aacctagaatttacccagct

SEQ ID NO: 721759 - DNA, 20 bp, Artificial
  CRISPR gRNA sequence
gaatttacccagctaaatta

SEQ ID NO: 721760 - DNA, 20 bp, Artificial
  CRISPR gRNA sequence
acccagctaaattacagtca

SEQ ID NO: 721761 - DNA, 20 bp, Artificial
  CRISPR gRNA sequence
cccagctaaattacagtcac

SEQ ID NO: 721762 - DNA, 20 bp, Artificial
  CRISPR gRNA sequence
aattacagtcacttcagcta

SEQ ID NO: 721763 - DNA, 20 bp, Artificial
  CRISPR gRNA sequence
cagtcacttcagctaaatta

SEQ ID NO: 721764 - DNA, 20 bp, Artificial
  CRISPR gRNA sequence
cagctaaattacaatcaagt

SEQ ID NO: 721765 - DNA, 20 bp, Artificial
  CRISPR gRNA sequence
agctaaattacaatcaagtt

SEQ ID NO: 721766 - DNA, 20 bp, Artificial
  CRISPR gRNA sequence
aattacaatcaagtttgaag

SEQ ID NO: 721767 - DNA, 20 bp, Artificial
  CRISPR gRNA sequence
caatcaagtttgaaggcagc

SEQ ID NO: 721768 - DNA, 20 bp, Artificial
  CRISPR gRNA sequence
gaaggcagcataaaaacatt

SEQ ID NO: 721769 - DNA, 20 bp, Artificial
  CRISPR gRNA sequence
aaggcagcataaaaacattt

SEQ ID NO: 721770 - DNA, 20 bp, Artificial
  CRISPR gRNA sequence
tcagacataaaaggtccaga

SEQ ID NO: 721771 - DNA, 20 bp, Artificial
  CRISPR gRNA sequence
cagacataaaaggtccagaa

SEQ ID NO: 721772 - DNA, 20 bp, Artificial
  CRISPR gRNA sequence
agacataaaaggtccagaag

SEQ ID NO: 721773 - DNA, 20 bp, Artificial
  CRISPR gRNA sequence
ttcttcctatatcctctcct

SEQ ID NO: 721774 - DNA, 20 bp, Artificial
  CRISPR gRNA sequence
tcttcctatatcctctccta

SEQ ID NO: 721775 - DNA, 20 bp, Artificial
  CRISPR gRNA sequence
cttcctatatcctctcctag

SEQ ID NO: 721776 - DNA, 20 bp, Artificial
  CRISPR gRNA sequence
ttcctatatcctctcctagg

SEQ ID NO: 721777 - DNA, 20 bp, Artificial
  CRISPR gRNA sequence
cctatatcctctcctaggaa

SEQ ID NO: 721778 - DNA, 20 bp, Artificial
  CRISPR gRNA sequence
ctatatcctctcctaggaag

SEQ ID NO: 721779 - DNA, 20 bp, Artificial
  CRISPR gRNA sequence
tatcctctcctaggaagata

SEQ ID NO: 721780 - DNA, 20 bp, Artificial
  CRISPR gRNA sequence
tcctaggaagatatttgaag

SEQ ID NO: 721781 - DNA, 20 bp, Artificial
  CRISPR gRNA sequence
ctaggaagatatttgaagat

SEQ ID NO: 721782 - DNA, 20 bp, Artificial
  CRISPR gRNA sequence
ggaagatatttgaagatgta

SEQ ID NO: 721783 - DNA, 20 bp, Artificial
  CRISPR gRNA sequence
gaagatgtaattcagctaag

SEQ ID NO: 721784 - DNA, 20 bp, Artificial
  CRISPR gRNA sequence
aagatgtaattcagctaagt

SEQ ID NO: 721785 - DNA, 20 bp, Artificial
  CRISPR gRNA sequence
agctaagtgagggggcaaaa

SEQ ID NO: 721786 - DNA, 20 bp, Artificial
  CRISPR gRNA sequence
agtgagggggcaaaaaagaa

SEQ ID NO: 721787 - DNA, 20 bp, Artificial
  CRISPR gRNA sequence
gagaccagcactccatccta

SEQ ID NO: 721788 - DNA, 20 bp, Artificial
  CRISPR gRNA sequence
catcctagcagagcaaggaa

SEQ ID NO: 721789 - DNA, 20 bp, Artificial
  CRISPR gRNA sequence
gcagagcaaggaagggaagt

SEQ ID NO: 721790 - DNA, 20 bp, Artificial
  CRISPR gRNA sequence
agccagatcagagcaggaaa

SEQ ID NO: 721791 - DNA, 20 bp, Artificial
  CRISPR gRNA sequence
cgaggaagtgttcccaggaa

SEQ ID NO: 721792 - DNA, 20 bp, Artificial
  CRISPR gRNA sequence
ccaggaatagaagagagaat

SEQ ID NO: 721793 - DNA, 20 bp, Artificial
  CRISPR gRNA sequence
tagtaaatttcatgattagt

SEQ ID NO: 721794 - DNA, 20 bp, Artificial
  CRISPR gRNA sequence
catgattagtagagttgaaa

SEQ ID NO: 721795 - DNA, 20 bp, Artificial
  CRISPR gRNA sequence
atgattagtagagttgaaaa

SEQ ID NO: 721796 - DNA, 20 bp, Artificial
  CRISPR gRNA sequence
gtagagttgaaaagcctgag

SEQ ID NO: 721797 - DNA, 20 bp, Artificial
  CRISPR gRNA sequence
aaaagcctgaggatatggtg

SEQ ID NO: 721798 - DNA, 20 bp, Artificial
  CRISPR gRNA sequence
aggatatggtgagggcacac

SEQ ID NO: 721799 - DNA, 20 bp, Artificial
  CRISPR gRNA sequence
tccttttatcaacaagaaaa

SEQ ID NO: 721800 - DNA, 20 bp, Artificial
  CRISPR gRNA sequence
ttatcaacaagaaaaagaaa

SEQ ID NO: 721801 - DNA, 20 bp, Artificial
  CRISPR gRNA sequence
tatcaacaagaaaaagaaag

SEQ ID NO: 721802 - DNA, 20 bp, Artificial
  CRISPR gRNA sequence
atcaacaagaaaaagaaagg

SEQ ID NO: 721803 - DNA, 20 bp, Artificial
  CRISPR gRNA sequence
tcaacaagaaaaagaaaggc

SEQ ID NO: 721804 - DNA, 20 bp, Artificial
  CRISPR gRNA sequence
aaaactcccgggaaaagaaa

SEQ ID NO: 721805 - DNA, 20 bp, Artificial
  CRISPR gRNA sequence
ccgggaaaagaaaaagatga

SEQ ID NO: 721806 - DNA, 20 bp, Artificial
  CRISPR gRNA sequence
cacctgattttaagcgattg

SEQ ID NO: 721807 - DNA, 20 bp, Artificial
  CRISPR gRNA sequence
acctgattttaagcgattgc

SEQ ID NO: 721808 - DNA, 20 bp, Artificial
  CRISPR gRNA sequence
attttaagcgattgctggat

SEQ ID NO: 721809 - DNA, 20 bp, Artificial
  CRISPR gRNA sequence
taagcgattgctggatgtac

SEQ ID NO: 721810 - DNA, 20 bp, Artificial
  CRISPR gRNA sequence
aagcgattgctggatgtaca

SEQ ID NO: 721811 - DNA, 20 bp, Artificial
  CRISPR gRNA sequence
agcgattgctggatgtacaa

SEQ ID NO: 721812 - DNA, 20 bp, Artificial
  CRISPR gRNA sequence
ctggatgtacaaaaagagaa

SEQ ID NO: 721813 - DNA, 20 bp, Artificial
  CRISPR gRNA sequence
gatgtacaaaaagagaatct

SEQ ID NO: 721814 - DNA, 20 bp, Artificial
  CRISPR gRNA sequence
tttggccttgatgctgagac

SEQ ID NO: 721815 - DNA, 20 bp, Artificial
  CRISPR gRNA sequence
ggccttgatgctgagacaat

SEQ ID NO: 721816 - DNA, 20 bp, Artificial
  CRISPR gRNA sequence
gccttgatgctgagacaatt

SEQ ID NO: 721817 - DNA, 20 bp, Artificial
  CRISPR gRNA sequence
gatgctgagacaattcttta

SEQ ID NO: 721818 - DNA, 20 bp, Artificial
  CRISPR gRNA sequence
atgctgagacaattctttaa

SEQ ID NO: 721819 - DNA, 20 bp, Artificial
  CRISPR gRNA sequence
agacaattctttaaatggcc

SEQ ID NO: 721820 - DNA, 20 bp, Artificial
  CRISPR gRNA sequence
tttaaatggcccaaggactg

SEQ ID NO: 721821 - DNA, 20 bp, Artificial
  CRISPR gRNA sequence
taaatggcccaaggactggg

SEQ ID NO: 721822 - DNA, 20 bp, Artificial
  CRISPR gRNA sequence
aaatggcccaaggactgggt

SEQ ID NO: 721823 - DNA, 20 bp, Artificial
  CRISPR gRNA sequence
aatggcccaaggactgggtg

SEQ ID NO: 721824 - DNA, 20 bp, Artificial
  CRISPR gRNA sequence
ggtgtttggatttaaagaga

SEQ ID NO: 721825 - DNA, 20 bp, Artificial
  CRISPR gRNA sequence
ggatttaaagagaagtatat

SEQ ID NO: 721826 - DNA, 20 bp, Artificial
  CRISPR gRNA sequence
gatttaaagagaagtatatc

SEQ ID NO: 721827 - DNA, 20 bp, Artificial
  CRISPR gRNA sequence
aaagagaagtatatccatct

SEQ ID NO: 721828 - DNA, 20 bp, Artificial
  CRISPR gRNA sequence
aagagaagtatatccatctg

SEQ ID NO: 721829 - DNA, 20 bp, Artificial
  CRISPR gRNA sequence
gtaaataatattttttttag

SEQ ID NO: 721830 - DNA, 20 bp, Artificial
  CRISPR gRNA sequence
tttttagttcttaaatggag

SEQ ID NO: 721831 - DNA, 20 bp, Artificial
  CRISPR gRNA sequence
ttttagttcttaaatggagg

SEQ ID NO: 721832 - DNA, 20 bp, Artificial
  CRISPR gRNA sequence
tttagttcttaaatggaggc

SEQ ID NO: 721833 - DNA, 20 bp, Artificial
  CRISPR gRNA sequence
ttagttcttaaatggaggct

SEQ ID NO: 721834 - DNA, 20 bp, Artificial
  CRISPR gRNA sequence
tagttcttaaatggaggctg

SEQ ID NO: 721835 - DNA, 20 bp, Artificial
  CRISPR gRNA sequence
agttcttaaatggaggctga

SEQ ID NO: 721836 - DNA, 20 bp, Artificial
  CRISPR gRNA sequence
gttcttaaatggaggctgag

SEQ ID NO: 721837 - DNA, 20 bp, Artificial
  CRISPR gRNA sequence
ttaaatggaggctgagtagg

SEQ ID NO: 721838 - DNA, 20 bp, Artificial
  CRISPR gRNA sequence
aaatggaggctgagtaggca

SEQ ID NO: 721839 - DNA, 20 bp, Artificial
  CRISPR gRNA sequence
aatggaggctgagtaggcag

SEQ ID NO: 721840 - DNA, 20 bp, Artificial
  CRISPR gRNA sequence
agtaggcaggttcttttctt

SEQ ID NO: 721841 - DNA, 20 bp, Artificial
  CRISPR gRNA sequence
ttttcttctcttccagtagg

SEQ ID NO: 721842 - DNA, 20 bp, Artificial
  CRISPR gRNA sequence
ttcttctcttccagtaggcc

SEQ ID NO: 721843 - DNA, 20 bp, Artificial
  CRISPR gRNA sequence
tcttctcttccagtaggcca

SEQ ID NO: 721844 - DNA, 20 bp, Artificial
  CRISPR gRNA sequence
cttctcttccagtaggccat

SEQ ID NO: 721845 - DNA, 20 bp, Artificial
  CRISPR gRNA sequence
ttctcttccagtaggccatt

SEQ ID NO: 721846 - DNA, 20 bp, Artificial
  CRISPR gRNA sequence
ctcttccagtaggccattac

SEQ ID NO: 721847 - DNA, 20 bp, Artificial
  CRISPR gRNA sequence
tcttccagtaggccattacc

SEQ ID NO: 721848 - DNA, 20 bp, Artificial
  CRISPR gRNA sequence
ttccagtaggccattaccag

SEQ ID NO: 721849 - DNA, 20 bp, Artificial
  CRISPR gRNA sequence
ccagtaggccattaccagag

SEQ ID NO: 721850 - DNA, 20 bp, Artificial
  CRISPR gRNA sequence
cagtaggccattaccagaga

SEQ ID NO: 721851 - DNA, 20 bp, Artificial
  CRISPR gRNA sequence
ccagagaacacaggcagacc

SEQ ID NO: 721852 - DNA, 20 bp, Artificial
  CRISPR gRNA sequence
ggggctagacaatgccttct

SEQ ID NO: 721853 - DNA, 20 bp, Artificial
  CRISPR gRNA sequence
gacaatgccttctcctcacc

SEQ ID NO: 721854 - DNA, 20 bp, Artificial
  CRISPR gRNA sequence
ctcctcaccttcaaatccaa

SEQ ID NO: 721855 - DNA, 20 bp, Artificial
  CRISPR gRNA sequence
tcctcaccttcaaatccaaa

SEQ ID NO: 721856 - DNA, 20 bp, Artificial
  CRISPR gRNA sequence
ctcaccttcaaatccaaaga

SEQ ID NO: 721857 - DNA, 20 bp, Artificial
  CRISPR gRNA sequence
accttcaaatccaaagagga

SEQ ID NO: 721858 - DNA, 20 bp, Artificial
  CRISPR gRNA sequence
caaatccaaagaggaggaaa

SEQ ID NO: 721859 - DNA, 20 bp, Artificial
  CRISPR gRNA sequence
aaatccaaagaggaggaaaa

SEQ ID NO: 721860 - DNA, 20 bp, Artificial
  CRISPR gRNA sequence
actcagggaggaagaaggaa

SEQ ID NO: 721861 - DNA, 20 bp, Artificial
  CRISPR gRNA sequence
agggaggaagaaggaaagtt

SEQ ID NO: 721862 - DNA, 20 bp, Artificial
  CRISPR gRNA sequence
caagttaggtatagtatatt

SEQ ID NO: 721863 - DNA, 20 bp, Artificial
  CRISPR gRNA sequence
ggtatagtatattcagagag

SEQ ID NO: 721864 - DNA, 20 bp, Artificial
  CRISPR gRNA sequence
agagaggggatgagaggcac

SEQ ID NO: 721865 - DNA, 20 bp, Artificial
  CRISPR gRNA sequence
ggttccccccttctgcacat

SEQ ID NO: 721866 - DNA, 20 bp, Artificial
  CRISPR gRNA sequence
cccccttctgcacatacagg

SEQ ID NO: 721867 - DNA, 20 bp, Artificial
  CRISPR gRNA sequence
ctgcacatacaggagggaca

SEQ ID NO: 721868 - DNA, 20 bp, Artificial
  CRISPR gRNA sequence
tgcacatacaggagggacag

SEQ ID NO: 721869 - DNA, 20 bp, Artificial
  CRISPR gRNA sequence
cacatacaggagggacagca

SEQ ID NO: 721870 - DNA, 20 bp, Artificial
  CRISPR gRNA sequence
tcgctggatttcagcaggtg

SEQ ID NO: 721871 - DNA, 20 bp, Artificial
  CRISPR gRNA sequence
gatttcagcaggtgtttcag

SEQ ID NO: 721872 - DNA, 20 bp, Artificial
  CRISPR gRNA sequence
cagcaggtgtttcagcagca

SEQ ID NO: 721873 - DNA, 20 bp, Artificial
  CRISPR gRNA sequence
agcaggtgtttcagcagcag

SEQ ID NO: 721874 - DNA, 20 bp, Artificial
  CRISPR gRNA sequence
cagcagcagctgagaccatg

SEQ ID NO: 721875 - DNA, 20 bp, Artificial
  CRISPR gRNA sequence
agcagcagctgagaccatgg

SEQ ID NO: 721876 - DNA, 20 bp, Artificial
  CRISPR gRNA sequence
agaccatgggcctgtctagt

SEQ ID NO: 721877 - DNA, 20 bp, Artificial
  CRISPR gRNA sequence
tctagttacatcaggctgcc

SEQ ID NO: 721878 - DNA, 20 bp, Artificial
  CRISPR gRNA sequence
gttacatcaggctgccttgg

SEQ ID NO: 721879 - DNA, 20 bp, Artificial
  CRISPR gRNA sequence
catcaggctgccttggagag

SEQ ID NO: 721880 - DNA, 20 bp, Artificial
  CRISPR gRNA sequence
ccttggagagcaggcagggg

SEQ ID NO: 721881 - DNA, 20 bp, Artificial
  CRISPR gRNA sequence
ggagagcaggcagggggctc

SEQ ID NO: 721882 - DNA, 20 bp, Artificial
  CRISPR gRNA sequence
gagagcaggcagggggctct

SEQ ID NO: 721883 - DNA, 20 bp, Artificial
  CRISPR gRNA sequence
tctcctcatgatgctgactg

SEQ ID NO: 721884 - DNA, 20 bp, Artificial
  CRISPR gRNA sequence
tcctcatgatgctgactggg

SEQ ID NO: 721885 - DNA, 20 bp, Artificial
  CRISPR gRNA sequence
ctcatgatgctgactgggaa

SEQ ID NO: 721886 - DNA, 20 bp, Artificial
  CRISPR gRNA sequence
atgatgctgactgggaatag

SEQ ID NO: 721887 - DNA, 20 bp, Artificial
  CRISPR gRNA sequence
actgggaatagccacagtta

SEQ ID NO: 721888 - DNA, 20 bp, Artificial
  CRISPR gRNA sequence
ggaatagccacagttaatgg

SEQ ID NO: 721889 - DNA, 20 bp, Artificial
  CRISPR gRNA sequence
atgggtttgagcatcagagc

SEQ ID NO: 721890 - DNA, 20 bp, Artificial
  CRISPR gRNA sequence
gagcatcagagctccagtcc

SEQ ID NO: 721891 - DNA, 20 bp, Artificial
  CRISPR gRNA sequence
agcatcagagctccagtcca

SEQ ID NO: 721892 - DNA, 20 bp, Artificial
  CRISPR gRNA sequence
cagtccactcaaagtaagtg

SEQ ID NO: 721893 - DNA, 20 bp, Artificial
  CRISPR gRNA sequence
aaagtaagtgttcactgaaa

SEQ ID NO: 721894 - DNA, 20 bp, Artificial
  CRISPR gRNA sequence
actgaaacccaatgaccttt

SEQ ID NO: 721895 - DNA, 20 bp, Artificial
  CRISPR gRNA sequence
aaacccaatgacctttcaaa

SEQ ID NO: 721896 - DNA, 20 bp, Artificial
  CRISPR gRNA sequence
tcaaacactgattcaaatac

SEQ ID NO: 721897 - DNA, 20 bp, Artificial
  CRISPR gRNA sequence
caaacactgattcaaatact

SEQ ID NO: 721898 - DNA, 20 bp, Artificial
  CRISPR gRNA sequence
aaacactgattcaaatactg

SEQ ID NO: 721899 - DNA, 20 bp, Artificial
  CRISPR gRNA sequence
attcaaatactgattaacga

SEQ ID NO: 721900 - DNA, 20 bp, Artificial
  CRISPR gRNA sequence
aaatactgattaacgagcat

SEQ ID NO: 721901 - DNA, 20 bp, Artificial
  CRISPR gRNA sequence
attaacgagcatgtaggaac

SEQ ID NO: 721902 - DNA, 20 bp, Artificial
  CRISPR gRNA sequence
acgagcatgtaggaaccatc

SEQ ID NO: 721903 - DNA, 20 bp, Artificial
  CRISPR gRNA sequence
ccccatagtctccaggctcc

SEQ ID NO: 721904 - DNA, 20 bp, Artificial
  CRISPR gRNA sequence
cccatagtctccaggctcca

SEQ ID NO: 721905 - DNA, 20 bp, Artificial
  CRISPR gRNA sequence
caggctccagctaattcagg

SEQ ID NO: 721906 - DNA, 20 bp, Artificial
  CRISPR gRNA sequence
cagctaattcaggtaagagt

SEQ ID NO: 721907 - DNA, 20 bp, Artificial
  CRISPR gRNA sequence
attcaggtaagagtccagtg

SEQ ID NO: 721908 - DNA, 20 bp, Artificial
  CRISPR gRNA sequence
aggtaagagtccagtgacct

SEQ ID NO: 721909 - DNA, 20 bp, Artificial
  CRISPR gRNA sequence
ccccaaagaggggggttcct

SEQ ID NO: 721910 - DNA, 20 bp, Artificial
  CRISPR gRNA sequence
cccaaagaggggggttcctc

SEQ ID NO: 721911 - DNA, 20 bp, Artificial
  CRISPR gRNA sequence
ctcagaaccctacaatgcaa

SEQ ID NO: 721912 - DNA, 20 bp, Artificial
  CRISPR gRNA sequence
agaaccctacaatgcaagaa

SEQ ID NO: 721913 - DNA, 20 bp, Artificial
  CRISPR gRNA sequence
caatgcaagaaataaattaa

SEQ ID NO: 721914 - DNA, 20 bp, Artificial
  CRISPR gRNA sequence
atcctggctttacttttttg

SEQ ID NO: 721915 - DNA, 20 bp, Artificial
  CRISPR gRNA sequence
gctttacttttttgtctatt

SEQ ID NO: 721916 - DNA, 20 bp, Artificial
  CRISPR gRNA sequence
tacttttttgtctatttgag

SEQ ID NO: 721917 - DNA, 20 bp, Artificial
  CRISPR gRNA sequence
acttttttgtctatttgagg

SEQ ID NO: 721918 - DNA, 20 bp, Artificial
  CRISPR gRNA sequence
cttttttgtctatttgagga

SEQ ID NO: 721919 - DNA, 20 bp, Artificial
  CRISPR gRNA sequence
ttttgtctatttgaggaaaa

SEQ ID NO: 721920 - DNA, 20 bp, Artificial
  CRISPR gRNA sequence
tttgtctatttgaggaaaaa

SEQ ID NO: 721921 - DNA, 20 bp, Artificial
  CRISPR gRNA sequence
ttgtctatttgaggaaaaat

SEQ ID NO: 721922 - DNA, 20 bp, Artificial
  CRISPR gRNA sequence
tgtctatttgaggaaaaatc

SEQ ID NO: 721923 - DNA, 20 bp, Artificial
  CRISPR gRNA sequence
gtctatttgaggaaaaatct

SEQ ID NO: 721924 - DNA, 20 bp, Artificial
  CRISPR gRNA sequence
tctatttgaggaaaaatctg

SEQ ID NO: 721925 - DNA, 20 bp, Artificial
  CRISPR gRNA sequence
tttgaggaaaaatctgagag

SEQ ID NO: 721926 - DNA, 20 bp, Artificial
  CRISPR gRNA sequence
gaggaaaaatctgagaggcg

SEQ ID NO: 721927 - DNA, 20 bp, Artificial
  CRISPR gRNA sequence
aggaaaaatctgagaggcgt

SEQ ID NO: 721928 - DNA, 20 bp, Artificial
  CRISPR gRNA sequence
agaggcgtcacgaacacttt

SEQ ID NO: 721929 - DNA, 20 bp, Artificial
  CRISPR gRNA sequence
tgtagaggggagatgtgggt

SEQ ID NO: 721930 - DNA, 20 bp, Artificial
  CRISPR gRNA sequence
gtagaggggagatgtgggta

SEQ ID NO: 721931 - DNA, 20 bp, Artificial
  CRISPR gRNA sequence
tagaggggagatgtgggtat

SEQ ID NO: 721932 - DNA, 20 bp, Artificial
  CRISPR gRNA sequence
ctttgtaccacatcaaaaag

SEQ ID NO: 721933 - DNA, 20 bp, Artificial
  CRISPR gRNA sequence
tgtaccacatcaaaaagggg

SEQ ID NO: 721934 - DNA, 20 bp, Artificial
  CRISPR gRNA sequence
gtaccacatcaaaaaggggt

SEQ ID NO: 721935 - DNA, 20 bp, Artificial
  CRISPR gRNA sequence
taccacatcaaaaaggggtg

SEQ ID NO: 721936 - DNA, 20 bp, Artificial
  CRISPR gRNA sequence
caccagggctctgggggtgg

SEQ ID NO: 721937 - DNA, 20 bp, Artificial
  CRISPR gRNA sequence
tgggggtggagaggtgtagt

SEQ ID NO: 721938 - DNA, 20 bp, Artificial
  CRISPR gRNA sequence
ggggtggagaggtgtagtga

SEQ ID NO: 721939 - DNA, 20 bp, Artificial
  CRISPR gRNA sequence
agcataacccacttctaatg

SEQ ID NO: 721940 - DNA, 20 bp, Artificial
  CRISPR gRNA sequence
ctaatgtgggccaaattatc

SEQ ID NO: 721941 - DNA, 20 bp, Artificial
  CRISPR gRNA sequence
taatgtgggccaaattatcc

SEQ ID NO: 721942 - DNA, 20 bp, Artificial
  CRISPR gRNA sequence
atgtgggccaaattatcctg

SEQ ID NO: 721943 - DNA, 20 bp, Artificial
  CRISPR gRNA sequence
tcctgccccagaaaagcagg

SEQ ID NO: 721944 - DNA, 20 bp, Artificial
  CRISPR gRNA sequence
ccccagaaaagcaggaagct

SEQ ID NO: 721945 - DNA, 20 bp, Artificial
  CRISPR gRNA sequence
tgaagaaggtgcccagtccc

SEQ ID NO: 721946 - DNA, 20 bp, Artificial
  CRISPR gRNA sequence
gaagaaggtgcccagtcccc

SEQ ID NO: 721947 - DNA, 20 bp, Artificial
  CRISPR gRNA sequence
aagaaggtgcccagtcccca

SEQ ID NO: 721948 - DNA, 20 bp, Artificial
  CRISPR gRNA sequence
tgggctggaactcgccatct

SEQ ID NO: 721949 - DNA, 20 bp, Artificial
  CRISPR gRNA sequence
ggctggaactcgccatctct

SEQ ID NO: 721950 - DNA, 20 bp, Artificial
  CRISPR gRNA sequence
gaactcgccatctctgtttc

SEQ ID NO: 721951 - DNA, 20 bp, Artificial
  CRISPR gRNA sequence
gccatctctgtttcctggct

SEQ ID NO: 721952 - DNA, 20 bp, Artificial
  CRISPR gRNA sequence
tgtttcctggctgtagctcc

SEQ ID NO: 721953 - DNA, 20 bp, Artificial
  CRISPR gRNA sequence
tttcctggctgtagctccag

SEQ ID NO: 721954 - DNA, 20 bp, Artificial
  CRISPR gRNA sequence
cctggctgtagctccagccc

SEQ ID NO: 721955 - DNA, 20 bp, Artificial
  CRISPR gRNA sequence
ctggctgtagctccagccct

SEQ ID NO: 721956 - DNA, 20 bp, Artificial
  CRISPR gRNA sequence
gctgtagctccagccctgcg

SEQ ID NO: 721957 - DNA, 20 bp, Artificial
  CRISPR gRNA sequence
tagctccagccctgcggctc

SEQ ID NO: 721958 - DNA, 20 bp, Artificial
  CRISPR gRNA sequence
cagccctgcggctctctcca

SEQ ID NO: 721959 - DNA, 20 bp, Artificial
  CRISPR gRNA sequence
cggctctctccatctgtaaa

SEQ ID NO: 721960 - DNA, 20 bp, Artificial
  CRISPR gRNA sequence
tctccatctgtaaaacaagg

SEQ ID NO: 721961 - DNA, 20 bp, Artificial
  CRISPR gRNA sequence
tccatctgtaaaacaaggta

SEQ ID NO: 721962 - DNA, 20 bp, Artificial
  CRISPR gRNA sequence
catctgtaaaacaaggtagc

SEQ ID NO: 721963 - DNA, 20 bp, Artificial
  CRISPR gRNA sequence
taaaacaaggtagctgggtc

SEQ ID NO: 721964 - DNA, 20 bp, Artificial
  CRISPR gRNA sequence
ggtcagaccagtggtggcca

SEQ ID NO: 721965 - DNA, 20 bp, Artificial
  CRISPR gRNA sequence
tgaactggccttcagagaca

SEQ ID NO: 721966 - DNA, 20 bp, Artificial
  CRISPR gRNA sequence
gccttcagagacattccgtc

SEQ ID NO: 721967 - DNA, 20 bp, Artificial
  CRISPR gRNA sequence
cagagacattccgtctggcc

SEQ ID NO: 721968 - DNA, 20 bp, Artificial
  CRISPR gRNA sequence
agagacattccgtctggcca

SEQ ID NO: 721969 - DNA, 20 bp, Artificial
  CRISPR gRNA sequence
cgtctggccagcatagcaat

SEQ ID NO: 721970 - DNA, 20 bp, Artificial
  CRISPR gRNA sequence
gccagcatagcaatccagcc

SEQ ID NO: 721971 - DNA, 20 bp, Artificial
  CRISPR gRNA sequence
cctaggcactcaagaggaat

SEQ ID NO: 721972 - DNA, 20 bp, Artificial
  CRISPR gRNA sequence
ctaggcactcaagaggaatg

SEQ ID NO: 721973 - DNA, 20 bp, Artificial
  CRISPR gRNA sequence
ggcactcaagaggaatgaaa

SEQ ID NO: 721974 - DNA, 20 bp, Artificial
  CRISPR gRNA sequence
aagaggaatgaaattatacg

SEQ ID NO: 721975 - DNA, 20 bp, Artificial
  CRISPR gRNA sequence
tacgttcacacagaggcacg

SEQ ID NO: 721976 - DNA, 20 bp, Artificial
  CRISPR gRNA sequence
acacagaggcacgcacaaga

SEQ ID NO: 721977 - DNA, 20 bp, Artificial
  CRISPR gRNA sequence
acagctgccttgttcgtcat

SEQ ID NO: 721978 - DNA, 20 bp, Artificial
  CRISPR gRNA sequence
ccttgttcgtcatagttcaa

SEQ ID NO: 721979 - DNA, 20 bp, Artificial
  CRISPR gRNA sequence
gttcgtcatagttcaaactg

SEQ ID NO: 721980 - DNA, 20 bp, Artificial
  CRISPR gRNA sequence
ttcgtcatagttcaaactgg

SEQ ID NO: 721981 - DNA, 20 bp, Artificial
  CRISPR gRNA sequence
gtcatagttcaaactggaaa

SEQ ID NO: 721982 - DNA, 20 bp, Artificial
  CRISPR gRNA sequence
aaactggaaacaacccaaat

SEQ ID NO: 721983 - DNA, 20 bp, Artificial
  CRISPR gRNA sequence
gaaacaacccaaatgtccat

SEQ ID NO: 721984 - DNA, 20 bp, Artificial
  CRISPR gRNA sequence
gcgaacgggtatgtaaacag

SEQ ID NO: 721985 - DNA, 20 bp, Artificial
  CRISPR gRNA sequence
atctgtacaacagaacgcca

SEQ ID NO: 721986 - DNA, 20 bp, Artificial
  CRISPR gRNA sequence
tacaacagaacgccatttgg

SEQ ID NO: 721987 - DNA, 20 bp, Artificial
  CRISPR gRNA sequence
ggcaacagaaaggaatgaag

SEQ ID NO: 721988 - DNA, 20 bp, Artificial
  CRISPR gRNA sequence
gcaacagaaaggaatgaagc

SEQ ID NO: 721989 - DNA, 20 bp, Artificial
  CRISPR gRNA sequence
aatgaatatcaaaaacatta

SEQ ID NO: 721990 - DNA, 20 bp, Artificial
  CRISPR gRNA sequence
tgcagagtggaagaagccag

SEQ ID NO: 721991 - DNA, 20 bp, Artificial
  CRISPR gRNA sequence
catgattctgtcgacatgaa

SEQ ID NO: 721992 - DNA, 20 bp, Artificial
  CRISPR gRNA sequence
tgtcgacatgaaattctgga

SEQ ID NO: 721993 - DNA, 20 bp, Artificial
  CRISPR gRNA sequence
tcgacatgaaattctggaac

SEQ ID NO: 721994 - DNA, 20 bp, Artificial
  CRISPR gRNA sequence
tggaacagatacactcctct

SEQ ID NO: 721995 - DNA, 20 bp, Artificial
  CRISPR gRNA sequence
gaacagatacactcctctat

SEQ ID NO: 721996 - DNA, 20 bp, Artificial
  CRISPR gRNA sequence
ctctatagtgacataaagca

SEQ ID NO: 721997 - DNA, 20 bp, Artificial
  CRISPR gRNA sequence
tatagtgacataaagcagat

SEQ ID NO: 721998 - DNA, 20 bp, Artificial
  CRISPR gRNA sequence
tagtgacataaagcagatcg

SEQ ID NO: 721999 - DNA, 20 bp, Artificial
  CRISPR gRNA sequence
cctggatctggaggtggggg

SEQ ID NO: 722000 - DNA, 20 bp, Artificial
  CRISPR gRNA sequence
gatctggaggtgggggcaga

SEQ ID NO: 722001 - DNA, 20 bp, Artificial
  CRISPR gRNA sequence
gaggtgggggcagagtgagt

SEQ ID NO: 722002 - DNA, 20 bp, Artificial
  CRISPR gRNA sequence
gggaaccttctggagggatg

SEQ ID NO: 722003 - DNA, 20 bp, Artificial
  CRISPR gRNA sequence
ctggagggatgagaatgttc

SEQ ID NO: 722004 - DNA, 20 bp, Artificial
  CRISPR gRNA sequence
tggagggatgagaatgttct

SEQ ID NO: 722005 - DNA, 20 bp, Artificial
  CRISPR gRNA sequence
gagggatgagaatgttctgt

SEQ ID NO: 722006 - DNA, 20 bp, Artificial
  CRISPR gRNA sequence
tgtattttgattggagttag

SEQ ID NO: 722007 - DNA, 20 bp, Artificial
  CRISPR gRNA sequence
tattttgattggagttagtt

SEQ ID NO: 722008 - DNA, 20 bp, Artificial
  CRISPR gRNA sequence
tgattggagttagttacctt

SEQ ID NO: 722009 - DNA, 20 bp, Artificial
  CRISPR gRNA sequence
gattggagttagttaccttt

SEQ ID NO: 722010 - DNA, 20 bp, Artificial
  CRISPR gRNA sequence
attggagttagttacctttg

SEQ ID NO: 722011 - DNA, 20 bp, Artificial
  CRISPR gRNA sequence
gagttagttacctttgtcag

SEQ ID NO: 722012 - DNA, 20 bp, Artificial
  CRISPR gRNA sequence
gttacctttgtcagaactca

SEQ ID NO: 722013 - DNA, 20 bp, Artificial
  CRISPR gRNA sequence
cctttgtcagaactcatcag

SEQ ID NO: 722014 - DNA, 20 bp, Artificial
  CRISPR gRNA sequence
tgtcagaactcatcaggctg

SEQ ID NO: 722015 - DNA, 20 bp, Artificial
  CRISPR gRNA sequence
gtcagaactcatcaggctgt

SEQ ID NO: 722016 - DNA, 20 bp, Artificial
  CRISPR gRNA sequence
tcagaactcatcaggctgta

SEQ ID NO: 722017 - DNA, 20 bp, Artificial
  CRISPR gRNA sequence
atcaggctgtacacacttag

SEQ ID NO: 722018 - DNA, 20 bp, Artificial
  CRISPR gRNA sequence
tacacacttagggacatttt

SEQ ID NO: 722019 - DNA, 20 bp, Artificial
  CRISPR gRNA sequence
agggacattttcttttttta

SEQ ID NO: 722020 - DNA, 20 bp, Artificial
  CRISPR gRNA sequence
gggacattttctttttttat

SEQ ID NO: 722021 - DNA, 20 bp, Artificial
  CRISPR gRNA sequence
tctttttttatttttactta

SEQ ID NO: 722022 - DNA, 20 bp, Artificial
  CRISPR gRNA sequence
ctttttttatttttacttat

SEQ ID NO: 722023 - DNA, 20 bp, Artificial
  CRISPR gRNA sequence
tttttttatttttacttatt

SEQ ID NO: 722024 - DNA, 20 bp, Artificial
  CRISPR gRNA sequence
tttttatttttacttattaa

SEQ ID NO: 722025 - DNA, 20 bp, Artificial
  CRISPR gRNA sequence
ttttatttttacttattaaa

SEQ ID NO: 722026 - DNA, 20 bp, Artificial
  CRISPR gRNA sequence
tttatttttacttattaaaa

SEQ ID NO: 722027 - DNA, 20 bp, Artificial
  CRISPR gRNA sequence
ttatttttacttattaaaaa

SEQ ID NO: 722028 - DNA, 20 bp, Artificial
  CRISPR gRNA sequence
tatttttacttattaaaaat

SEQ ID NO: 722029 - DNA, 20 bp, Artificial
  CRISPR gRNA sequence
atttttacttattaaaaata

SEQ ID NO: 722030 - DNA, 20 bp, Artificial
  CRISPR gRNA sequence
tttttacttattaaaaatag

SEQ ID NO: 722031 - DNA, 20 bp, Artificial
  CRISPR gRNA sequence
ttacttattaaaaatagaga

SEQ ID NO: 722032 - DNA, 20 bp, Artificial
  CRISPR gRNA sequence
tacttattaaaaatagagac

SEQ ID NO: 722033 - DNA, 20 bp, Artificial
  CRISPR gRNA sequence
acttattaaaaatagagaca

SEQ ID NO: 722034 - DNA, 20 bp, Artificial
  CRISPR gRNA sequence
cttattaaaaatagagacag

SEQ ID NO: 722035 - DNA, 20 bp, Artificial
  CRISPR gRNA sequence
attaaaaatagagacagggt

SEQ ID NO: 722036 - DNA, 20 bp, Artificial
  CRISPR gRNA sequence
ttaaaaatagagacagggtc

SEQ ID NO: 722037 - DNA, 20 bp, Artificial
  CRISPR gRNA sequence
aaaatagagacagggtcttg

SEQ ID NO: 722038 - DNA, 20 bp, Artificial
  CRISPR gRNA sequence
gctatgttgcttaggctggt

SEQ ID NO: 722039 - DNA, 20 bp, Artificial
  CRISPR gRNA sequence
ctatgttgcttaggctggtt

SEQ ID NO: 722040 - DNA, 20 bp, Artificial
  CRISPR gRNA sequence
tgttgcttaggctggtttcg

SEQ ID NO: 722041 - DNA, 20 bp, Artificial
  CRISPR gRNA sequence
cttaggctggtttcgaactc

SEQ ID NO: 722042 - DNA, 20 bp, Artificial
  CRISPR gRNA sequence
aggctggtttcgaactcctg

SEQ ID NO: 722043 - DNA, 20 bp, Artificial
  CRISPR gRNA sequence
ggctggtttcgaactcctga

SEQ ID NO: 722044 - DNA, 20 bp, Artificial
  CRISPR gRNA sequence
gtttcgaactcctgagctca

SEQ ID NO: 722045 - DNA, 20 bp, Artificial
  CRISPR gRNA sequence
cgaactcctgagctcaagtg

SEQ ID NO: 722046 - DNA, 20 bp, Artificial
  CRISPR gRNA sequence
gaactcctgagctcaagtga

SEQ ID NO: 722047 - DNA, 20 bp, Artificial
  CRISPR gRNA sequence
ctgagctcaagtgatctgcc

SEQ ID NO: 722048 - DNA, 20 bp, Artificial
  CRISPR gRNA sequence
agctcaagtgatctgcctgc

SEQ ID NO: 722049 - DNA, 20 bp, Artificial
  CRISPR gRNA sequence
aagtgatctgcctgcttcag

SEQ ID NO: 722050 - DNA, 20 bp, Artificial
  CRISPR gRNA sequence
cctgcttcagcctcccaaag

SEQ ID NO: 722051 - DNA, 20 bp, Artificial
  CRISPR gRNA sequence
cttcagcctcccaaagtgct

SEQ ID NO: 722052 - DNA, 20 bp, Artificial
  CRISPR gRNA sequence
cagcctcccaaagtgctggg

SEQ ID NO: 722053 - DNA, 20 bp, Artificial
  CRISPR gRNA sequence
agcctcccaaagtgctggga

SEQ ID NO: 722054 - DNA, 20 bp, Artificial
  CRISPR gRNA sequence
ccaaagtgctgggattacag

SEQ ID NO: 722055 - DNA, 20 bp, Artificial
  CRISPR gRNA sequence
ggattacaggcgggagccac

SEQ ID NO: 722056 - DNA, 20 bp, Artificial
  CRISPR gRNA sequence
caggcgggagccaccctacc

SEQ ID NO: 722057 - DNA, 20 bp, Artificial
  CRISPR gRNA sequence
ccctgccaggggatactttc

SEQ ID NO: 722058 - DNA, 20 bp, Artificial
  CRISPR gRNA sequence
ccaggggatactttcttgta

SEQ ID NO: 722059 - DNA, 20 bp, Artificial
  CRISPR gRNA sequence
tcttgtatataaatgttgcc

SEQ ID NO: 722060 - DNA, 20 bp, Artificial
  CRISPR gRNA sequence
cttgtatataaatgttgcct

SEQ ID NO: 722061 - DNA, 20 bp, Artificial
  CRISPR gRNA sequence
ttgtatataaatgttgcctt

SEQ ID NO: 722062 - DNA, 20 bp, Artificial
  CRISPR gRNA sequence
gtatataaatgttgccttag

SEQ ID NO: 722063 - DNA, 20 bp, Artificial
  CRISPR gRNA sequence
tatataaatgttgccttagg

SEQ ID NO: 722064 - DNA, 20 bp, Artificial
  CRISPR gRNA sequence
ccttaggctgggcatggtgg

SEQ ID NO: 722065 - DNA, 20 bp, Artificial
  CRISPR gRNA sequence
aggctgggcatggtggctca

SEQ ID NO: 722066 - DNA, 20 bp, Artificial
  CRISPR gRNA sequence
ggctgggcatggtggctcac

SEQ ID NO: 722067 - DNA, 20 bp, Artificial
  CRISPR gRNA sequence
ggcatggtggctcacgccta

SEQ ID NO: 722068 - DNA, 20 bp, Artificial
  CRISPR gRNA sequence
acgcctacgatcccagcact

SEQ ID NO: 722069 - DNA, 20 bp, Artificial
  CRISPR gRNA sequence
cgatcccagcactttgggag

SEQ ID NO: 722070 - DNA, 20 bp, Artificial
  CRISPR gRNA sequence
tgggaggctgaggtgggcgg

SEQ ID NO: 722071 - DNA, 20 bp, Artificial
  CRISPR gRNA sequence
gggaggctgaggtgggcgga

SEQ ID NO: 722072 - DNA, 20 bp, Artificial
  CRISPR gRNA sequence
ggaggctgaggtgggcggat

SEQ ID NO: 722073 - DNA, 20 bp, Artificial
  CRISPR gRNA sequence
aggtgggcggatcacttgag

SEQ ID NO: 722074 - DNA, 20 bp, Artificial
  CRISPR gRNA sequence
gaggtcaggagttcgagacc

SEQ ID NO: 722075 - DNA, 20 bp, Artificial
  CRISPR gRNA sequence
aggtcaggagttcgagacca

SEQ ID NO: 722076 - DNA, 20 bp, Artificial
  CRISPR gRNA sequence
gagaccagcctggtcaacat

SEQ ID NO: 722077 - DNA, 20 bp, Artificial
  CRISPR gRNA sequence
gtcaacatggtgaaaccctg

SEQ ID NO: 722078 - DNA, 20 bp, Artificial
  CRISPR gRNA sequence
tttctactaaaaatacaaaa

SEQ ID NO: 722079 - DNA, 20 bp, Artificial
  CRISPR gRNA sequence
ctactaaaaatacaaaaatt

SEQ ID NO: 722080 - DNA, 20 bp, Artificial
  CRISPR gRNA sequence
tactaaaaatacaaaaatta

SEQ ID NO: 722081 - DNA, 20 bp, Artificial
  CRISPR gRNA sequence
ctaaaaatacaaaaattagc

SEQ ID NO: 722082 - DNA, 20 bp, Artificial
  CRISPR gRNA sequence
aaaatacaaaaattagctgg

SEQ ID NO: 722083 - DNA, 20 bp, Artificial
  CRISPR gRNA sequence
gctgggcatgttggcaggca

SEQ ID NO: 722084 - DNA, 20 bp, Artificial
  CRISPR gRNA sequence
ggcatgttggcaggcacctg

SEQ ID NO: 722085 - DNA, 20 bp, Artificial
  CRISPR gRNA sequence
gcaggcacctgtaatcccag

SEQ ID NO: 722086 - DNA, 20 bp, Artificial
  CRISPR gRNA sequence
taatcccagctactcaggag

SEQ ID NO: 722087 - DNA, 20 bp, Artificial
  CRISPR gRNA sequence
ctcaggaggctgaggcagga

SEQ ID NO: 722088 - DNA, 20 bp, Artificial
  CRISPR gRNA sequence
aggaggctgaggcaggagaa

SEQ ID NO: 722089 - DNA, 20 bp, Artificial
  CRISPR gRNA sequence
aggcaggagaatcacttgaa

SEQ ID NO: 722090 - DNA, 20 bp, Artificial
  CRISPR gRNA sequence
gaatccgggaggcagaagtt

SEQ ID NO: 722091 - DNA, 20 bp, Artificial
  CRISPR gRNA sequence
aatccgggaggcagaagttg

SEQ ID NO: 722092 - DNA, 20 bp, Artificial
  CRISPR gRNA sequence
caatgagctgagatcgtgcc

SEQ ID NO: 722093 - DNA, 20 bp, Artificial
  CRISPR gRNA sequence
agatcgtgccactgcactcc

SEQ ID NO: 722094 - DNA, 20 bp, Artificial
  CRISPR gRNA sequence
cactccagtctgggcagcag

SEQ ID NO: 722095 - DNA, 20 bp, Artificial
  CRISPR gRNA sequence
cagtctgggcagcagaggaa

SEQ ID NO: 722096 - DNA, 20 bp, Artificial
  CRISPR gRNA sequence
ggcagcagaggaagactcaa

SEQ ID NO: 722097 - DNA, 20 bp, Artificial
  CRISPR gRNA sequence
aatctcaaaaaattaaacat

SEQ ID NO: 722098 - DNA, 20 bp, Artificial
  CRISPR gRNA sequence
aaaaaattaaacataaataa

SEQ ID NO: 722099 - DNA, 20 bp, Artificial
  CRISPR gRNA sequence
aacataaataaataaataat

SEQ ID NO: 722100 - DNA, 20 bp, Artificial
  CRISPR gRNA sequence
cttaataaagttgatttaaa

SEQ ID NO: 722101 - DNA, 20 bp, Artificial
  CRISPR gRNA sequence
aataaagttgatttaaaaga

SEQ ID NO: 722102 - DNA, 20 bp, Artificial
  CRISPR gRNA sequence
ataaagttgatttaaaagaa

SEQ ID NO: 722103 - DNA, 20 bp, Artificial
  CRISPR gRNA sequence
atttaaaagaaaaaaacttt

SEQ ID NO: 722104 - DNA, 20 bp, Artificial
  CRISPR gRNA sequence
aaaagaaaaaaactttaaaa

SEQ ID NO: 722105 - DNA, 20 bp, Artificial
  CRISPR gRNA sequence
aaagaaaaaaactttaaaaa

SEQ ID NO: 722106 - DNA, 20 bp, Artificial
  CRISPR gRNA sequence
taaaaattgaggctgtattt

SEQ ID NO: 722107 - DNA, 20 bp, Artificial
  CRISPR gRNA sequence
aaaaattgaggctgtattta

SEQ ID NO: 722108 - DNA, 20 bp, Artificial
  CRISPR gRNA sequence
aaaattgaggctgtatttaa

SEQ ID NO: 722109 - DNA, 20 bp, Artificial
  CRISPR gRNA sequence
aggctgtatttaaacattag

SEQ ID NO: 722110 - DNA, 20 bp, Artificial
  CRISPR gRNA sequence
tatttaaacattaggcgatt

SEQ ID NO: 722111 - DNA, 20 bp, Artificial
  CRISPR gRNA sequence
aaacattaggcgatttcagt

SEQ ID NO: 722112 - DNA, 20 bp, Artificial
  CRISPR gRNA sequence
aacattaggcgatttcagtt

SEQ ID NO: 722113 - DNA, 20 bp, Artificial
  CRISPR gRNA sequence
ggcgatttcagttttctctt

SEQ ID NO: 722114 - DNA, 20 bp, Artificial
  CRISPR gRNA sequence
cagttttctcttaaaagcaa

SEQ ID NO: 722115 - DNA, 20 bp, Artificial
  CRISPR gRNA sequence
agttttctcttaaaagcaaa

SEQ ID NO: 722116 - DNA, 20 bp, Artificial
  CRISPR gRNA sequence
tctcttaaaagcaaaaggtc

SEQ ID NO: 722117 - DNA, 20 bp, Artificial
  CRISPR gRNA sequence
ctcttaaaagcaaaaggtct

SEQ ID NO: 722118 - DNA, 20 bp, Artificial
  CRISPR gRNA sequence
tcttaaaagcaaaaggtcta

SEQ ID NO: 722119 - DNA, 20 bp, Artificial
  CRISPR gRNA sequence
ttaaaagcaaaaggtctagc

SEQ ID NO: 722120 - DNA, 20 bp, Artificial
  CRISPR gRNA sequence
aaaagcaaaaggtctagcgt

SEQ ID NO: 722121 - DNA, 20 bp, Artificial
  CRISPR gRNA sequence
aaagcaaaaggtctagcgtc

SEQ ID NO: 722122 - DNA, 20 bp, Artificial
  CRISPR gRNA sequence
gcgtcactgtttcaccttcc

SEQ ID NO: 722123 - DNA, 20 bp, Artificial
  CRISPR gRNA sequence
tttcaccttcctgggtgacc

SEQ ID NO: 722124 - DNA, 20 bp, Artificial
  CRISPR gRNA sequence
caccttcctgggtgaccaca

SEQ ID NO: 722125 - DNA, 20 bp, Artificial
  CRISPR gRNA sequence
accttcctgggtgaccacag

SEQ ID NO: 722126 - DNA, 20 bp, Artificial
  CRISPR gRNA sequence
cctgggtgaccacagctgtt

SEQ ID NO: 722127 - DNA, 20 bp, Artificial
  CRISPR gRNA sequence
ctgggtgaccacagctgtta

SEQ ID NO: 722128 - DNA, 20 bp, Artificial
  CRISPR gRNA sequence
ggtgaccacagctgttagag

SEQ ID NO: 722129 - DNA, 20 bp, Artificial
  CRISPR gRNA sequence
ttagagacaagtagcaactt

SEQ ID NO: 722130 - DNA, 20 bp, Artificial
  CRISPR gRNA sequence
gagacaagtagcaacttctc

SEQ ID NO: 722131 - DNA, 20 bp, Artificial
  CRISPR gRNA sequence
ctccactttgttttatttat

SEQ ID NO: 722132 - DNA, 20 bp, Artificial
  CRISPR gRNA sequence
tccactttgttttatttatt

SEQ ID NO: 722133 - DNA, 20 bp, Artificial
  CRISPR gRNA sequence
cactttgttttatttatttt

SEQ ID NO: 722134 - DNA, 20 bp, Artificial
  CRISPR gRNA sequence
tgttttatttattttgagtc

SEQ ID NO: 722135 - DNA, 20 bp, Artificial
  CRISPR gRNA sequence
gttttatttattttgagtct

SEQ ID NO: 722136 - DNA, 20 bp, Artificial
  CRISPR gRNA sequence
ttttatttattttgagtctt

SEQ ID NO: 722137 - DNA, 20 bp, Artificial
  CRISPR gRNA sequence
tatttattttgagtctttct

SEQ ID NO: 722138 - DNA, 20 bp, Artificial
  CRISPR gRNA sequence
atttattttgagtctttctc

SEQ ID NO: 722139 - DNA, 20 bp, Artificial
  CRISPR gRNA sequence
tttattttgagtctttctct

SEQ ID NO: 722140 - DNA, 20 bp, Artificial
  CRISPR gRNA sequence
attttgagtctttctctgtc

SEQ ID NO: 722141 - DNA, 20 bp, Artificial
  CRISPR gRNA sequence
ttttgagtctttctctgtcg

SEQ ID NO: 722142 - DNA, 20 bp, Artificial
  CRISPR gRNA sequence
tgagtctttctctgtcgccc

SEQ ID NO: 722143 - DNA, 20 bp, Artificial
  CRISPR gRNA sequence
gagtctttctctgtcgccca

SEQ ID NO: 722144 - DNA, 20 bp, Artificial
  CRISPR gRNA sequence
agtctttctctgtcgcccag

SEQ ID NO: 722145 - DNA, 20 bp, Artificial
  CRISPR gRNA sequence
tctctgtcgcccaggctgga

SEQ ID NO: 722146 - DNA, 20 bp, Artificial
  CRISPR gRNA sequence
ctctgtcgcccaggctggag

SEQ ID NO: 722147 - DNA, 20 bp, Artificial
  CRISPR gRNA sequence
tctgtcgcccaggctggagt

SEQ ID NO: 722148 - DNA, 20 bp, Artificial
  CRISPR gRNA sequence
tgtcgcccaggctggagtgc

SEQ ID NO: 722149 - DNA, 20 bp, Artificial
  CRISPR gRNA sequence
tcgcccaggctggagtgcag

SEQ ID NO: 722150 - DNA, 20 bp, Artificial
  CRISPR gRNA sequence
gagtgcagtggcatgatctc

SEQ ID NO: 722151 - DNA, 20 bp, Artificial
  CRISPR gRNA sequence
agctcactgcagcctccacc

SEQ ID NO: 722152 - DNA, 20 bp, Artificial
  CRISPR gRNA sequence
actgcagcctccacctcccg

SEQ ID NO: 722153 - DNA, 20 bp, Artificial
  CRISPR gRNA sequence
cagcctccacctcccgggtt

SEQ ID NO: 722154 - DNA, 20 bp, Artificial
  CRISPR gRNA sequence
cacctcccgggttcaaacga

SEQ ID NO: 722155 - DNA, 20 bp, Artificial
  CRISPR gRNA sequence
ccgggttcaaacgattctcc

SEQ ID NO: 722156 - DNA, 20 bp, Artificial
  CRISPR gRNA sequence
aaacgattctcctgcctcag

SEQ ID NO: 722157 - DNA, 20 bp, Artificial
  CRISPR gRNA sequence
tcctgcctcagcctcctgag

SEQ ID NO: 722158 - DNA, 20 bp, Artificial
  CRISPR gRNA sequence
ctgcctcagcctcctgagta

SEQ ID NO: 722159 - DNA, 20 bp, Artificial
  CRISPR gRNA sequence
cctcagcctcctgagtagct

SEQ ID NO: 722160 - DNA, 20 bp, Artificial
  CRISPR gRNA sequence
agcctcctgagtagctagga

SEQ ID NO: 722161 - DNA, 20 bp, Artificial
  CRISPR gRNA sequence
ctgagtagctaggattacag

SEQ ID NO: 722162 - DNA, 20 bp, Artificial
  CRISPR gRNA sequence
agtagctaggattacaggtg

SEQ ID NO: 722163 - DNA, 20 bp, Artificial
  CRISPR gRNA sequence
ggattacaggtgtgtgccat

SEQ ID NO: 722164 - DNA, 20 bp, Artificial
  CRISPR gRNA sequence
caggtgtgtgccatcacacc

SEQ ID NO: 722165 - DNA, 20 bp, Artificial
  CRISPR gRNA sequence
gctaatttttgtgtttttag

SEQ ID NO: 722166 - DNA, 20 bp, Artificial
  CRISPR gRNA sequence
atttttgtgtttttagtaga

SEQ ID NO: 722167 - DNA, 20 bp, Artificial
  CRISPR gRNA sequence
ttgtgtttttagtagagatg

SEQ ID NO: 722168 - DNA, 20 bp, Artificial
  CRISPR gRNA sequence
tgtgtttttagtagagatgg

SEQ ID NO: 722169 - DNA, 20 bp, Artificial
  CRISPR gRNA sequence
gtgtttttagtagagatggg

SEQ ID NO: 722170 - DNA, 20 bp, Artificial
  CRISPR gRNA sequence
tgtttttagtagagatgggg

SEQ ID NO: 722171 - DNA, 20 bp, Artificial
  CRISPR gRNA sequence
ttagtagagatggggtttca

SEQ ID NO: 722172 - DNA, 20 bp, Artificial
  CRISPR gRNA sequence
tagtagagatggggtttcac

SEQ ID NO: 722173 - DNA, 20 bp, Artificial
  CRISPR gRNA sequence
agtagagatggggtttcacc

SEQ ID NO: 722174 - DNA, 20 bp, Artificial
  CRISPR gRNA sequence
gtagagatggggtttcaccg

SEQ ID NO: 722175 - DNA, 20 bp, Artificial
  CRISPR gRNA sequence
caccgtgttggtcaggctgg

SEQ ID NO: 722176 - DNA, 20 bp, Artificial
  CRISPR gRNA sequence
accgtgttggtcaggctggt

SEQ ID NO: 722177 - DNA, 20 bp, Artificial
  CRISPR gRNA sequence
gtcaggctggtctcgaactc

SEQ ID NO: 722178 - DNA, 20 bp, Artificial
  CRISPR gRNA sequence
gtctcgaactcctgacctca

SEQ ID NO: 722179 - DNA, 20 bp, Artificial
  CRISPR gRNA sequence
gaactcctgacctcaagtgg

SEQ ID NO: 722180 - DNA, 20 bp, Artificial
  CRISPR gRNA sequence
ctgacctcaagtggtcctcc

SEQ ID NO: 722181 - DNA, 20 bp, Artificial
  CRISPR gRNA sequence
acctcaagtggtcctcctgc

SEQ ID NO: 722182 - DNA, 20 bp, Artificial
  CRISPR gRNA sequence
aagtggtcctcctgcctcag

SEQ ID NO: 722183 - DNA, 20 bp, Artificial
  CRISPR gRNA sequence
ctgcctcagcctcccaaaat

SEQ ID NO: 722184 - DNA, 20 bp, Artificial
  CRISPR gRNA sequence
cctcagcctcccaaaatgct

SEQ ID NO: 722185 - DNA, 20 bp, Artificial
  CRISPR gRNA sequence
agcctcccaaaatgctgtga

SEQ ID NO: 722186 - DNA, 20 bp, Artificial
  CRISPR gRNA sequence
ccaaaatgctgtgattacag

SEQ ID NO: 722187 - DNA, 20 bp, Artificial
  CRISPR gRNA sequence
tgattacaggtgtgagccaa

SEQ ID NO: 722188 - DNA, 20 bp, Artificial
  CRISPR gRNA sequence
caggtgtgagccaatgtgcc

SEQ ID NO: 722189 - DNA, 20 bp, Artificial
  CRISPR gRNA sequence
gccagcttttccactttgat

SEQ ID NO: 722190 - DNA, 20 bp, Artificial
  CRISPR gRNA sequence
ttccactttgatcttttgaa

SEQ ID NO: 722191 - DNA, 20 bp, Artificial
  CRISPR gRNA sequence
tccactttgatcttttgaaa

SEQ ID NO: 722192 - DNA, 20 bp, Artificial
  CRISPR gRNA sequence
ccactttgatcttttgaaac

SEQ ID NO: 722193 - DNA, 20 bp, Artificial
  CRISPR gRNA sequence
cactttgatcttttgaaaca

SEQ ID NO: 722194 - DNA, 20 bp, Artificial
  CRISPR gRNA sequence
tgatcttttgaaacacaaat

SEQ ID NO: 722195 - DNA, 20 bp, Artificial
  CRISPR gRNA sequence
gatcttttgaaacacaaatc

SEQ ID NO: 722196 - DNA, 20 bp, Artificial
  CRISPR gRNA sequence
atcttttgaaacacaaatct

SEQ ID NO: 722197 - DNA, 20 bp, Artificial
  CRISPR gRNA sequence
ttgaaacacaaatctgactg

SEQ ID NO: 722198 - DNA, 20 bp, Artificial
  CRISPR gRNA sequence
tgaaacacaaatctgactgt

SEQ ID NO: 722199 - DNA, 20 bp, Artificial
  CRISPR gRNA sequence
gaaacacaaatctgactgtc

SEQ ID NO: 722200 - DNA, 20 bp, Artificial
  CRISPR gRNA sequence
aaacacaaatctgactgtct

SEQ ID NO: 722201 - DNA, 20 bp, Artificial
  CRISPR gRNA sequence
actgtcttagctcccacggt

SEQ ID NO: 722202 - DNA, 20 bp, Artificial
  CRISPR gRNA sequence
tcttagctcccacggtgttg

SEQ ID NO: 722203 - DNA, 20 bp, Artificial
  CRISPR gRNA sequence
agctcccacggtgttgcctc

SEQ ID NO: 722204 - DNA, 20 bp, Artificial
  CRISPR gRNA sequence
gctcccacggtgttgcctcg

SEQ ID NO: 722205 - DNA, 20 bp, Artificial
  CRISPR gRNA sequence
ccacggtgttgcctcgctgg

SEQ ID NO: 722206 - DNA, 20 bp, Artificial
  CRISPR gRNA sequence
cctcgctggaagccaccagt

SEQ ID NO: 722207 - DNA, 20 bp, Artificial
  CRISPR gRNA sequence
gctggaagccaccagtccct

SEQ ID NO: 722208 - DNA, 20 bp, Artificial
  CRISPR gRNA sequence
gaagccaccagtccctgctg

SEQ ID NO: 722209 - DNA, 20 bp, Artificial
  CRISPR gRNA sequence
ctggttaactctttcctgga

SEQ ID NO: 722210 - DNA, 20 bp, Artificial
  CRISPR gRNA sequence
gttaactctttcctggagac

SEQ ID NO: 722211 - DNA, 20 bp, Artificial
  CRISPR gRNA sequence
actctttcctggagacacca

SEQ ID NO: 722212 - DNA, 20 bp, Artificial
  CRISPR gRNA sequence
tttcctggagacaccagcct

SEQ ID NO: 722213 - DNA, 20 bp, Artificial
  CRISPR gRNA sequence
tcctggagacaccagcctcc

SEQ ID NO: 722214 - DNA, 20 bp, Artificial
  CRISPR gRNA sequence
cctggagacaccagcctcct

SEQ ID NO: 722215 - DNA, 20 bp, Artificial
  CRISPR gRNA sequence
ctggagacaccagcctcctt

SEQ ID NO: 722216 - DNA, 20 bp, Artificial
  CRISPR gRNA sequence
gagacaccagcctccttggc

SEQ ID NO: 722217 - DNA, 20 bp, Artificial
  CRISPR gRNA sequence
cttggcgctggttctcagat

SEQ ID NO: 722218 - DNA, 20 bp, Artificial
  CRISPR gRNA sequence
ggcgctggttctcagatgtt

SEQ ID NO: 722219 - DNA, 20 bp, Artificial
  CRISPR gRNA sequence
gcgctggttctcagatgtta

SEQ ID NO: 722220 - DNA, 20 bp, Artificial
  CRISPR gRNA sequence
gttctcagatgttacgtccc

SEQ ID NO: 722221 - DNA, 20 bp, Artificial
  CRISPR gRNA sequence
tcagatgttacgtcccctct

SEQ ID NO: 722222 - DNA, 20 bp, Artificial
  CRISPR gRNA sequence
agatgttacgtcccctctgc

SEQ ID NO: 722223 - DNA, 20 bp, Artificial
  CRISPR gRNA sequence
cgtcccctctgcagatatgg

SEQ ID NO: 722224 - DNA, 20 bp, Artificial
  CRISPR gRNA sequence
tgcagatatggctgagaagg

SEQ ID NO: 722225 - DNA, 20 bp, Artificial
  CRISPR gRNA sequence
cagatatggctgagaaggac

SEQ ID NO: 722226 - DNA, 20 bp, Artificial
  CRISPR gRNA sequence
agaaggacaccacctttgag

SEQ ID NO: 722227 - DNA, 20 bp, Artificial
  CRISPR gRNA sequence
tgaggcgccacccctgggga

SEQ ID NO: 722228 - DNA, 20 bp, Artificial
  CRISPR gRNA sequence
gaggcgccacccctggggac

SEQ ID NO: 722229 - DNA, 20 bp, Artificial
  CRISPR gRNA sequence
aggcgccacccctggggacc

SEQ ID NO: 722230 - DNA, 20 bp, Artificial
  CRISPR gRNA sequence
gggacccagccggactgcaa

SEQ ID NO: 722231 - DNA, 20 bp, Artificial
  CRISPR gRNA sequence
caaccccaccccagagaatg

SEQ ID NO: 722232 - DNA, 20 bp, Artificial
  CRISPR gRNA sequence
ccaggtgactcccccacccc

SEQ ID NO: 722233 - DNA, 20 bp, Artificial
  CRISPR gRNA sequence
ccccaccccttctctctgtt

SEQ ID NO: 722234 - DNA, 20 bp, Artificial
  CRISPR gRNA sequence
ctctctgtttggctgctgca

SEQ ID NO: 722235 - DNA, 20 bp, Artificial
  CRISPR gRNA sequence
tctctgtttggctgctgcag

SEQ ID NO: 722236 - DNA, 20 bp, Artificial
  CRISPR gRNA sequence
tctgtttggctgctgcagga

SEQ ID NO: 722237 - DNA, 20 bp, Artificial
  CRISPR gRNA sequence
tgtttggctgctgcaggagg

SEQ ID NO: 722238 - DNA, 20 bp, Artificial
  CRISPR gRNA sequence
tttggctgctgcaggaggga

SEQ ID NO: 722239 - DNA, 20 bp, Artificial
  CRISPR gRNA sequence
ggctgctgcaggagggagct

SEQ ID NO: 722240 - DNA, 20 bp, Artificial
  CRISPR gRNA sequence
gctgctgcaggagggagctg

SEQ ID NO: 722241 - DNA, 20 bp, Artificial
  CRISPR gRNA sequence
ctgcaggagggagctgtccc

SEQ ID NO: 722242 - DNA, 20 bp, Artificial
  CRISPR gRNA sequence
caggagggagctgtccctgc

SEQ ID NO: 722243 - DNA, 20 bp, Artificial
  CRISPR gRNA sequence
tccctgccatgcccagggga

SEQ ID NO: 722244 - DNA, 20 bp, Artificial
  CRISPR gRNA sequence
ccatgcccaggggatgcctg

SEQ ID NO: 722245 - DNA, 20 bp, Artificial
  CRISPR gRNA sequence
ggaggcagctgggctggggg

SEQ ID NO: 722246 - DNA, 20 bp, Artificial
  CRISPR gRNA sequence
ggctgggggtggaggtgggg

SEQ ID NO: 722247 - DNA, 20 bp, Artificial
  CRISPR gRNA sequence
ggggtggaggtggggcctgg

SEQ ID NO: 722248 - DNA, 20 bp, Artificial
  CRISPR gRNA sequence
ggctgctcttttgttaaatg

SEQ ID NO: 722249 - DNA, 20 bp, Artificial
  CRISPR gRNA sequence
ctcttttgttaaatgtgtgc

SEQ ID NO: 722250 - DNA, 20 bp, Artificial
  CRISPR gRNA sequence
ttttgttaaatgtgtgccca

SEQ ID NO: 722251 - DNA, 20 bp, Artificial
  CRISPR gRNA sequence
ttgttaaatgtgtgcccatc

SEQ ID NO: 722252 - DNA, 20 bp, Artificial
  CRISPR gRNA sequence
tgttaaatgtgtgcccatct

SEQ ID NO: 722253 - DNA, 20 bp, Artificial
  CRISPR gRNA sequence
gttaaatgtgtgcccatctc

SEQ ID NO: 722254 - DNA, 20 bp, Artificial
  CRISPR gRNA sequence
ttaaatgtgtgcccatctct

SEQ ID NO: 722255 - DNA, 20 bp, Artificial
  CRISPR gRNA sequence
aatgtgtgcccatctctttg

SEQ ID NO: 722256 - DNA, 20 bp, Artificial
  CRISPR gRNA sequence
tttgctgacaccattggaaa

SEQ ID NO: 722257 - DNA, 20 bp, Artificial
  CRISPR gRNA sequence
tgctgacaccattggaaagc

SEQ ID NO: 722258 - DNA, 20 bp, Artificial
  CRISPR gRNA sequence
gctgacaccattggaaagcc

SEQ ID NO: 722259 - DNA, 20 bp, Artificial
  CRISPR gRNA sequence
ctgacaccattggaaagcca

SEQ ID NO: 722260 - DNA, 20 bp, Artificial
  CRISPR gRNA sequence
acaccattggaaagccagaa

SEQ ID NO: 722261 - DNA, 20 bp, Artificial
  CRISPR gRNA sequence
gaaagccagaaggccttgaa

SEQ ID NO: 722262 - DNA, 20 bp, Artificial
  CRISPR gRNA sequence
gaaacccagtccctgccctc

SEQ ID NO: 722263 - DNA, 20 bp, Artificial
  CRISPR gRNA sequence
aaacccagtccctgccctca

SEQ ID NO: 722264 - DNA, 20 bp, Artificial
  CRISPR gRNA sequence
ccctcaaaatgcctggcaga

SEQ ID NO: 722265 - DNA, 20 bp, Artificial
  CRISPR gRNA sequence
aaaatgcctggcagagactc

SEQ ID NO: 722266 - DNA, 20 bp, Artificial
  CRISPR gRNA sequence
gcagagactcggggcagagg

SEQ ID NO: 722267 - DNA, 20 bp, Artificial
  CRISPR gRNA sequence
ggggcagaggatctaggggc

SEQ ID NO: 722268 - DNA, 20 bp, Artificial
  CRISPR gRNA sequence
ggggcccaggctctggttgc

SEQ ID NO: 722269 - DNA, 20 bp, Artificial
  CRISPR gRNA sequence
tggttgcgcagtctccagag

SEQ ID NO: 722270 - DNA, 20 bp, Artificial
  CRISPR gRNA sequence
gttgcgcagtctccagagaa

SEQ ID NO: 722271 - DNA, 20 bp, Artificial
  CRISPR gRNA sequence
cgcagtctccagagaaaggg

SEQ ID NO: 722272 - DNA, 20 bp, Artificial
  CRISPR gRNA sequence
cagagaaagggaattattcc

SEQ ID NO: 722273 - DNA, 20 bp, Artificial
  CRISPR gRNA sequence
ttcctgaagacccacttccc

SEQ ID NO: 722274 - DNA, 20 bp, Artificial
  CRISPR gRNA sequence
ctgaagacccacttccctct

SEQ ID NO: 722275 - DNA, 20 bp, Artificial
  CRISPR gRNA sequence
aagacccacttccctcttcc

SEQ ID NO: 722276 - DNA, 20 bp, Artificial
  CRISPR gRNA sequence
ccctcttcccatcttcatca

SEQ ID NO: 722277 - DNA, 20 bp, Artificial
  CRISPR gRNA sequence
cctcttcccatcttcatcac

SEQ ID NO: 722278 - DNA, 20 bp, Artificial
  CRISPR gRNA sequence
ttcccatcttcatcactcct

SEQ ID NO: 722279 - DNA, 20 bp, Artificial
  CRISPR gRNA sequence
cccatcttcatcactcctgc

SEQ ID NO: 722280 - DNA, 20 bp, Artificial
  CRISPR gRNA sequence
ccatcttcatcactcctgcc

SEQ ID NO: 722281 - DNA, 20 bp, Artificial
  CRISPR gRNA sequence
catcactcctgccttgggct

SEQ ID NO: 722282 - DNA, 20 bp, Artificial
  CRISPR gRNA sequence
atcactcctgccttgggctt

SEQ ID NO: 722283 - DNA, 20 bp, Artificial
  CRISPR gRNA sequence
ctgccttgggcttctccccg

SEQ ID NO: 722284 - DNA, 20 bp, Artificial
  CRISPR gRNA sequence
ccttgggcttctccccgcag

SEQ ID NO: 722285 - DNA, 20 bp, Artificial
  CRISPR gRNA sequence
gggcttctccccgcagcacc

SEQ ID NO: 722286 - DNA, 20 bp, Artificial
  CRISPR gRNA sequence
ggcttctccccgcagcacca

SEQ ID NO: 722287 - DNA, 20 bp, Artificial
  CRISPR gRNA sequence
ctccccgcagcaccagcccc

SEQ ID NO: 722288 - DNA, 20 bp, Artificial
  CRISPR gRNA sequence
tccccgcagcaccagcccca

SEQ ID NO: 722289 - DNA, 20 bp, Artificial
  CRISPR gRNA sequence
cccgcagcaccagccccact

SEQ ID NO: 722290 - DNA, 20 bp, Artificial
  CRISPR gRNA sequence
agagcttgctggtggactcc

SEQ ID NO: 722291 - DNA, 20 bp, Artificial
  CRISPR gRNA sequence
gctggtggactcccaggcca

SEQ ID NO: 722292 - DNA, 20 bp, Artificial
  CRISPR gRNA sequence
ctggtggactcccaggccag

SEQ ID NO: 722293 - DNA, 20 bp, Artificial
  CRISPR gRNA sequence
gtggactcccaggccagtaa

SEQ ID NO: 722294 - DNA, 20 bp, Artificial
  CRISPR gRNA sequence
ccaggccagtaagacgctgc

SEQ ID NO: 722295 - DNA, 20 bp, Artificial
  CRISPR gRNA sequence
cccatcccaaccagcgctcc

SEQ ID NO: 722296 - DNA, 20 bp, Artificial
  CRISPR gRNA sequence
ccgtcgctctctcctccacg

SEQ ID NO: 722297 - DNA, 20 bp, Artificial
  CRISPR gRNA sequence
tctcctccacggggaagccc

SEQ ID NO: 722298 - DNA, 20 bp, Artificial
  CRISPR gRNA sequence
tcctccacggggaagcccgt

SEQ ID NO: 722299 - DNA, 20 bp, Artificial
  CRISPR gRNA sequence
ctccacggggaagcccgttc

SEQ ID NO: 722300 - DNA, 20 bp, Artificial
  CRISPR gRNA sequence
cacggggaagcccgttctgg

SEQ ID NO: 722301 - DNA, 20 bp, Artificial
  CRISPR gRNA sequence
tggatgcaggtaatggtccc

SEQ ID NO: 722302 - DNA, 20 bp, Artificial
  CRISPR gRNA sequence
gatgcaggtaatggtcccag

SEQ ID NO: 722303 - DNA, 20 bp, Artificial
  CRISPR gRNA sequence
acccctactcccagcagggg

SEQ ID NO: 722304 - DNA, 20 bp, Artificial
  CRISPR gRNA sequence
ctcccagcaggggcttcctc

SEQ ID NO: 722305 - DNA, 20 bp, Artificial
  CRISPR gRNA sequence
ccagcaggggcttcctcctg

SEQ ID NO: 722306 - DNA, 20 bp, Artificial
  CRISPR gRNA sequence
cctcctggggaagtgtggat

SEQ ID NO: 722307 - DNA, 20 bp, Artificial
  CRISPR gRNA sequence
ctcctggggaagtgtggatt

SEQ ID NO: 722308 - DNA, 20 bp, Artificial
  CRISPR gRNA sequence
ctggggaagtgtggattggg

SEQ ID NO: 722309 - DNA, 20 bp, Artificial
  CRISPR gRNA sequence
gggaagtgtggattggggga

SEQ ID NO: 722310 - DNA, 20 bp, Artificial
  CRISPR gRNA sequence
ggggagccaggagggagctt

SEQ ID NO: 722311 - DNA, 20 bp, Artificial
  CRISPR gRNA sequence
ctcctttgtgggtatggtct

SEQ ID NO: 722312 - DNA, 20 bp, Artificial
  CRISPR gRNA sequence
tcctttgtgggtatggtctg

SEQ ID NO: 722313 - DNA, 20 bp, Artificial
  CRISPR gRNA sequence
ctttgtgggtatggtctgag

SEQ ID NO: 722314 - DNA, 20 bp, Artificial
  CRISPR gRNA sequence
tgtgggtatggtctgagaag

SEQ ID NO: 722315 - DNA, 20 bp, Artificial
  CRISPR gRNA sequence
gtgggtatggtctgagaagg

SEQ ID NO: 722316 - DNA, 20 bp, Artificial
  CRISPR gRNA sequence
tgggtatggtctgagaaggg

SEQ ID NO: 722317 - DNA, 20 bp, Artificial
  CRISPR gRNA sequence
agaagggggattaaggttga

SEQ ID NO: 722318 - DNA, 20 bp, Artificial
  CRISPR gRNA sequence
aggttgaccccaggtttctg

SEQ ID NO: 722319 - DNA, 20 bp, Artificial
  CRISPR gRNA sequence
accccaggtttctggcttct

SEQ ID NO: 722320 - DNA, 20 bp, Artificial
  CRISPR gRNA sequence
ctggcttcttgagttggtgc

SEQ ID NO: 722321 - DNA, 20 bp, Artificial
  CRISPR gRNA sequence
tggcttcttgagttggtgct

SEQ ID NO: 722322 - DNA, 20 bp, Artificial
  CRISPR gRNA sequence
gcttcttgagttggtgctgt

SEQ ID NO: 722323 - DNA, 20 bp, Artificial
  CRISPR gRNA sequence
cttgagttggtgctgtggct

SEQ ID NO: 722324 - DNA, 20 bp, Artificial
  CRISPR gRNA sequence
ttgagttggtgctgtggctc

SEQ ID NO: 722325 - DNA, 20 bp, Artificial
  CRISPR gRNA sequence
gagttggtgctgtggctctg

SEQ ID NO: 722326 - DNA, 20 bp, Artificial
  CRISPR gRNA sequence
agttggtgctgtggctctgg

SEQ ID NO: 722327 - DNA, 20 bp, Artificial
  CRISPR gRNA sequence
gtgctgtggctctggcactt

SEQ ID NO: 722328 - DNA, 20 bp, Artificial
  CRISPR gRNA sequence
tggctctggcacttgctagt

SEQ ID NO: 722329 - DNA, 20 bp, Artificial
  CRISPR gRNA sequence
tggcacttgctagtgactat

SEQ ID NO: 722330 - DNA, 20 bp, Artificial
  CRISPR gRNA sequence
gcacttgctagtgactattc

SEQ ID NO: 722331 - DNA, 20 bp, Artificial
  CRISPR gRNA sequence
gctagtgactattcttttct

SEQ ID NO: 722332 - DNA, 20 bp, Artificial
  CRISPR gRNA sequence
ctagtgactattcttttctt

SEQ ID NO: 722333 - DNA, 20 bp, Artificial
  CRISPR gRNA sequence
gtgactattcttttcttttt

SEQ ID NO: 722334 - DNA, 20 bp, Artificial
  CRISPR gRNA sequence
ttcttttctttttgaaacag

SEQ ID NO: 722335 - DNA, 20 bp, Artificial
  CRISPR gRNA sequence
ttttctttttgaaacagtct

SEQ ID NO: 722336 - DNA, 20 bp, Artificial
  CRISPR gRNA sequence
ttctttttgaaacagtctca

SEQ ID NO: 722337 - DNA, 20 bp, Artificial
  CRISPR gRNA sequence
tctttttgaaacagtctcac

SEQ ID NO: 722338 - DNA, 20 bp, Artificial
  CRISPR gRNA sequence
ctttttgaaacagtctcact

SEQ ID NO: 722339 - DNA, 20 bp, Artificial
  CRISPR gRNA sequence
tttttgaaacagtctcactc

SEQ ID NO: 722340 - DNA, 20 bp, Artificial
  CRISPR gRNA sequence
tttgaaacagtctcactctg

SEQ ID NO: 722341 - DNA, 20 bp, Artificial
  CRISPR gRNA sequence
ttgaaacagtctcactctgt

SEQ ID NO: 722342 - DNA, 20 bp, Artificial
  CRISPR gRNA sequence
tgaaacagtctcactctgtt

SEQ ID NO: 722343 - DNA, 20 bp, Artificial
  CRISPR gRNA sequence
gaaacagtctcactctgttg

SEQ ID NO: 722344 - DNA, 20 bp, Artificial
  CRISPR gRNA sequence
aaacagtctcactctgttgc

SEQ ID NO: 722345 - DNA, 20 bp, Artificial
  CRISPR gRNA sequence
actctgttgctcaggctgga

SEQ ID NO: 722346 - DNA, 20 bp, Artificial
  CRISPR gRNA sequence
tgttgctcaggctggagggc

SEQ ID NO: 722347 - DNA, 20 bp, Artificial
  CRISPR gRNA sequence
ttgctcaggctggagggcag

SEQ ID NO: 722348 - DNA, 20 bp, Artificial
  CRISPR gRNA sequence
ctcaggctggagggcagtgg

SEQ ID NO: 722349 - DNA, 20 bp, Artificial
  CRISPR gRNA sequence
aggctggagggcagtggcac

SEQ ID NO: 722350 - DNA, 20 bp, Artificial
  CRISPR gRNA sequence
gagggcagtggcacccatct

SEQ ID NO: 722351 - DNA, 20 bp, Artificial
  CRISPR gRNA sequence
ggctcactgcaacctccacc

SEQ ID NO: 722352 - DNA, 20 bp, Artificial
  CRISPR gRNA sequence
gctcactgcaacctccacct

SEQ ID NO: 722353 - DNA, 20 bp, Artificial
  CRISPR gRNA sequence
actgcaacctccacctccca

SEQ ID NO: 722354 - DNA, 20 bp, Artificial
  CRISPR gRNA sequence
caacctccacctcccaggtt

SEQ ID NO: 722355 - DNA, 20 bp, Artificial
  CRISPR gRNA sequence
cacctcccaggttcaagaga

SEQ ID NO: 722356 - DNA, 20 bp, Artificial
  CRISPR gRNA sequence
ccaggttcaagagattctcc

SEQ ID NO: 722357 - DNA, 20 bp, Artificial
  CRISPR gRNA sequence
aagagattctcctgtctcag

SEQ ID NO: 722358 - DNA, 20 bp, Artificial
  CRISPR gRNA sequence
tcctgtctcagcctcccgag

SEQ ID NO: 722359 - DNA, 20 bp, Artificial
  CRISPR gRNA sequence
ctgtctcagcctcccgagta

SEQ ID NO: 722360 - DNA, 20 bp, Artificial
  CRISPR gRNA sequence
tctcagcctcccgagtagct

SEQ ID NO: 722361 - DNA, 20 bp, Artificial
  CRISPR gRNA sequence
agcctcccgagtagctgggt

SEQ ID NO: 722362 - DNA, 20 bp, Artificial
  CRISPR gRNA sequence
ccgagtagctgggtttacag

SEQ ID NO: 722363 - DNA, 20 bp, Artificial
  CRISPR gRNA sequence
ggtttacaggcgcttgccac

SEQ ID NO: 722364 - DNA, 20 bp, Artificial
  CRISPR gRNA sequence
acaggcgcttgccaccacgc

SEQ ID NO: 722365 - DNA, 20 bp, Artificial
  CRISPR gRNA sequence
caggcgcttgccaccacgcc

SEQ ID NO: 722366 - DNA, 20 bp, Artificial
  CRISPR gRNA sequence
gccaccacgcctggctaaat

SEQ ID NO: 722367 - DNA, 20 bp, Artificial
  CRISPR gRNA sequence
ccaccacgcctggctaaatt

SEQ ID NO: 722368 - DNA, 20 bp, Artificial
  CRISPR gRNA sequence
gctaaatttttttttaattt

SEQ ID NO: 722369 - DNA, 20 bp, Artificial
  CRISPR gRNA sequence
aatttttttttaatttttag

SEQ ID NO: 722370 - DNA, 20 bp, Artificial
  CRISPR gRNA sequence
ttttttaatttttagtagag

SEQ ID NO: 722371 - DNA, 20 bp, Artificial
  CRISPR gRNA sequence
tttttaatttttagtagaga

SEQ ID NO: 722372 - DNA, 20 bp, Artificial
  CRISPR gRNA sequence
ttttaatttttagtagagac

SEQ ID NO: 722373 - DNA, 20 bp, Artificial
  CRISPR gRNA sequence
tttaatttttagtagagacg

SEQ ID NO: 722374 - DNA, 20 bp, Artificial
  CRISPR gRNA sequence
ttaatttttagtagagacgg

SEQ ID NO: 722375 - DNA, 20 bp, Artificial
  CRISPR gRNA sequence
taatttttagtagagacggg

SEQ ID NO: 722376 - DNA, 20 bp, Artificial
  CRISPR gRNA sequence
aatttttagtagagacgggg

SEQ ID NO: 722377 - DNA, 20 bp, Artificial
  CRISPR gRNA sequence
atttttagtagagacggggt

SEQ ID NO: 722378 - DNA, 20 bp, Artificial
  CRISPR gRNA sequence
ttagtagagacggggttttg

SEQ ID NO: 722379 - DNA, 20 bp, Artificial
  CRISPR gRNA sequence
tagtagagacggggttttgc

SEQ ID NO: 722380 - DNA, 20 bp, Artificial
  CRISPR gRNA sequence
agtagagacggggttttgcc

SEQ ID NO: 722381 - DNA, 20 bp, Artificial
  CRISPR gRNA sequence
gtagagacggggttttgcca

SEQ ID NO: 722382 - DNA, 20 bp, Artificial
  CRISPR gRNA sequence
tgccatgttgtccaggttgg

SEQ ID NO: 722383 - DNA, 20 bp, Artificial
  CRISPR gRNA sequence
gccatgttgtccaggttggt

SEQ ID NO: 722384 - DNA, 20 bp, Artificial
  CRISPR gRNA sequence
ccatgttgtccaggttggtc

SEQ ID NO: 722385 - DNA, 20 bp, Artificial
  CRISPR gRNA sequence
tccaggttggtctcaaactc

SEQ ID NO: 722386 - DNA, 20 bp, Artificial
  CRISPR gRNA sequence
gtctcaaactcctgacctca

SEQ ID NO: 722387 - DNA, 20 bp, Artificial
  CRISPR gRNA sequence
aaactcctgacctcaggtga

SEQ ID NO: 722388 - DNA, 20 bp, Artificial
  CRISPR gRNA sequence
ctgacctcaggtgatccacc

SEQ ID NO: 722389 - DNA, 20 bp, Artificial
  CRISPR gRNA sequence
acctcaggtgatccacctgc

SEQ ID NO: 722390 - DNA, 20 bp, Artificial
  CRISPR gRNA sequence
aggtgatccacctgcttcag

SEQ ID NO: 722391 - DNA, 20 bp, Artificial
  CRISPR gRNA sequence
cttcagcctcccaaagtgct

SEQ ID NO: 722392 - DNA, 20 bp, Artificial
  CRISPR gRNA sequence
cagcctcccaaagtgctagg

SEQ ID NO: 722393 - DNA, 20 bp, Artificial
  CRISPR gRNA sequence
agcctcccaaagtgctagga

SEQ ID NO: 722394 - DNA, 20 bp, Artificial
  CRISPR gRNA sequence
ccaaagtgctaggattatag

SEQ ID NO: 722395 - DNA, 20 bp, Artificial
  CRISPR gRNA sequence
ggattataggtgtgaaccac

SEQ ID NO: 722396 - DNA, 20 bp, Artificial
  CRISPR gRNA sequence
taggtgtgaaccactgcgcc

SEQ ID NO: 722397 - DNA, 20 bp, Artificial
  CRISPR gRNA sequence
cgcctggctgctagtgacta

SEQ ID NO: 722398 - DNA, 20 bp, Artificial
  CRISPR gRNA sequence
gctgctagtgactattcttt

SEQ ID NO: 722399 - DNA, 20 bp, Artificial
  CRISPR gRNA sequence
ctagtgactattctttaatt

SEQ ID NO: 722400 - DNA, 20 bp, Artificial
  CRISPR gRNA sequence
gtgactattctttaattctt

SEQ ID NO: 722401 - DNA, 20 bp, Artificial
  CRISPR gRNA sequence
ttctttaattcttgtaggca

SEQ ID NO: 722402 - DNA, 20 bp, Artificial
  CRISPR gRNA sequence
tttaattcttgtaggcagga

SEQ ID NO: 722403 - DNA, 20 bp, Artificial
  CRISPR gRNA sequence
taattcttgtaggcaggaat

SEQ ID NO: 722404 - DNA, 20 bp, Artificial
  CRISPR gRNA sequence
aattcttgtaggcaggaatt

SEQ ID NO: 722405 - DNA, 20 bp, Artificial
  CRISPR gRNA sequence
attcttgtaggcaggaattt

SEQ ID NO: 722406 - DNA, 20 bp, Artificial
  CRISPR gRNA sequence
ttgtaggcaggaattttttt

SEQ ID NO: 722407 - DNA, 20 bp, Artificial
  CRISPR gRNA sequence
gtaggcaggaatttttttca

SEQ ID NO: 722408 - DNA, 20 bp, Artificial
  CRISPR gRNA sequence
taggcaggaatttttttcac

SEQ ID NO: 722409 - DNA, 20 bp, Artificial
  CRISPR gRNA sequence
ttttcacagcttcatcctcg

SEQ ID NO: 722410 - DNA, 20 bp, Artificial
  CRISPR gRNA sequence
tttcacagcttcatcctcgt

SEQ ID NO: 722411 - DNA, 20 bp, Artificial
  CRISPR gRNA sequence
ttcacagcttcatcctcgtg

SEQ ID NO: 722412 - DNA, 20 bp, Artificial
  CRISPR gRNA sequence
tcacagcttcatcctcgtgg

SEQ ID NO: 722413 - DNA, 20 bp, Artificial
  CRISPR gRNA sequence
cacagcttcatcctcgtggc

SEQ ID NO: 722414 - DNA, 20 bp, Artificial
  CRISPR gRNA sequence
acagcttcatcctcgtggct

SEQ ID NO: 722415 - DNA, 20 bp, Artificial
  CRISPR gRNA sequence
catcctcgtggcttataatt

SEQ ID NO: 722416 - DNA, 20 bp, Artificial
  CRISPR gRNA sequence
atcctcgtggcttataattg

SEQ ID NO: 722417 - DNA, 20 bp, Artificial
  CRISPR gRNA sequence
gtggcttataattgctactc

SEQ ID NO: 722418 - DNA, 20 bp, Artificial
  CRISPR gRNA sequence
ataattgctactcagaaaat

SEQ ID NO: 722419 - DNA, 20 bp, Artificial
  CRISPR gRNA sequence
taattgctactcagaaaata

SEQ ID NO: 722420 - DNA, 20 bp, Artificial
  CRISPR gRNA sequence
ctactcagaaaataggtctt

SEQ ID NO: 722421 - DNA, 20 bp, Artificial
  CRISPR gRNA sequence
ctcagaaaataggtctttgt

SEQ ID NO: 722422 - DNA, 20 bp, Artificial
  CRISPR gRNA sequence
agaaaataggtctttgttga

SEQ ID NO: 722423 - DNA, 20 bp, Artificial
  CRISPR gRNA sequence
tgttgattgatttcatgact

SEQ ID NO: 722424 - DNA, 20 bp, Artificial
  CRISPR gRNA sequence
gttgattgatttcatgactt

SEQ ID NO: 722425 - DNA, 20 bp, Artificial
  CRISPR gRNA sequence
ttgattgatttcatgacttt

SEQ ID NO: 722426 - DNA, 20 bp, Artificial
  CRISPR gRNA sequence
attgatttcatgactttgac

SEQ ID NO: 722427 - DNA, 20 bp, Artificial
  CRISPR gRNA sequence
atttcatgactttgactagt

SEQ ID NO: 722428 - DNA, 20 bp, Artificial
  CRISPR gRNA sequence
catgactttgactagttgtt

SEQ ID NO: 722429 - DNA, 20 bp, Artificial
  CRISPR gRNA sequence
atgactttgactagttgttc

SEQ ID NO: 722430 - DNA, 20 bp, Artificial
  CRISPR gRNA sequence
tgactagttgttcgagcctt

SEQ ID NO: 722431 - DNA, 20 bp, Artificial
  CRISPR gRNA sequence
gactagttgttcgagccttt

SEQ ID NO: 722432 - DNA, 20 bp, Artificial
  CRISPR gRNA sequence
actagttgttcgagcctttg

SEQ ID NO: 722433 - DNA, 20 bp, Artificial
  CRISPR gRNA sequence
gttgttcgagcctttgagcc

SEQ ID NO: 722434 - DNA, 20 bp, Artificial
  CRISPR gRNA sequence
ttcgagcctttgagcctcag

SEQ ID NO: 722435 - DNA, 20 bp, Artificial
  CRISPR gRNA sequence
gagcctttgagcctcagttg

SEQ ID NO: 722436 - DNA, 20 bp, Artificial
  CRISPR gRNA sequence
tgagcctcagttgtctcatc

SEQ ID NO: 722437 - DNA, 20 bp, Artificial
  CRISPR gRNA sequence
gagcctcagttgtctcatct

SEQ ID NO: 722438 - DNA, 20 bp, Artificial
  CRISPR gRNA sequence
agcctcagttgtctcatcta

SEQ ID NO: 722439 - DNA, 20 bp, Artificial
  CRISPR gRNA sequence
agttgtctcatctatacaat

SEQ ID NO: 722440 - DNA, 20 bp, Artificial
  CRISPR gRNA sequence
tctcatctatacaatggtaa

SEQ ID NO: 722441 - DNA, 20 bp, Artificial
  CRISPR gRNA sequence
atctatacaatggtaatggc

SEQ ID NO: 722442 - DNA, 20 bp, Artificial
  CRISPR gRNA sequence
tacaatggtaatggcagaga

SEQ ID NO: 722443 - DNA, 20 bp, Artificial
  CRISPR gRNA sequence
taagcagtgtagcattgtag

SEQ ID NO: 722444 - DNA, 20 bp, Artificial
  CRISPR gRNA sequence
tagacggcctctgtcagagt

SEQ ID NO: 722445 - DNA, 20 bp, Artificial
  CRISPR gRNA sequence
tgtcagagttagctcttagg

SEQ ID NO: 722446 - DNA, 20 bp, Artificial
  CRISPR gRNA sequence
tcagagttagctcttaggct

SEQ ID NO: 722447 - DNA, 20 bp, Artificial
  CRISPR gRNA sequence
gctcttaggctggacgcggt

SEQ ID NO: 722448 - DNA, 20 bp, Artificial
  CRISPR gRNA sequence
ttaggctggacgcggtggct

SEQ ID NO: 722449 - DNA, 20 bp, Artificial
  CRISPR gRNA sequence
aggctggacgcggtggctca

SEQ ID NO: 722450 - DNA, 20 bp, Artificial
  CRISPR gRNA sequence
ggctggacgcggtggctcac

SEQ ID NO: 722451 - DNA, 20 bp, Artificial
  CRISPR gRNA sequence
gacgcggtggctcacgcctg

SEQ ID NO: 722452 - DNA, 20 bp, Artificial
  CRISPR gRNA sequence
acgcctgtaatcccagcact

SEQ ID NO: 722453 - DNA, 20 bp, Artificial
  CRISPR gRNA sequence
taatcccagcactttgggag

SEQ ID NO: 722454 - DNA, 20 bp, Artificial
  CRISPR gRNA sequence
tgggaggccaaggtgggtgg

SEQ ID NO: 722455 - DNA, 20 bp, Artificial
  CRISPR gRNA sequence
gggaggccaaggtgggtgga

SEQ ID NO: 722456 - DNA, 20 bp, Artificial
  CRISPR gRNA sequence
ggaggccaaggtgggtggat

SEQ ID NO: 722457 - DNA, 20 bp, Artificial
  CRISPR gRNA sequence
gagaccagcctggccaacac

SEQ ID NO: 722458 - DNA, 20 bp, Artificial
  CRISPR gRNA sequence
agaccagcctggccaacacg

SEQ ID NO: 722459 - DNA, 20 bp, Artificial
  CRISPR gRNA sequence
gccaacacgatgaaaccaca

SEQ ID NO: 722460 - DNA, 20 bp, Artificial
  CRISPR gRNA sequence
tactaaaaatacaaaaatta

SEQ ID NO: 722461 - DNA, 20 bp, Artificial
  CRISPR gRNA sequence
ctaaaaatacaaaaattagc

SEQ ID NO: 722462 - DNA, 20 bp, Artificial
  CRISPR gRNA sequence
aaaatacaaaaattagccag

SEQ ID NO: 722463 - DNA, 20 bp, Artificial
  CRISPR gRNA sequence
gccaggcgtggtggcgcgcg

SEQ ID NO: 722464 - DNA, 20 bp, Artificial
  CRISPR gRNA sequence
taatcccagctactcaggag

SEQ ID NO: 722465 - DNA, 20 bp, Artificial
  CRISPR gRNA sequence
ctcaggaggctgaggcagga

SEQ ID NO: 722466 - DNA, 20 bp, Artificial
  CRISPR gRNA sequence
aggaggctgaggcaggagaa

SEQ ID NO: 722467 - DNA, 20 bp, Artificial
  CRISPR gRNA sequence
aggcaggagaatcgcttgaa

SEQ ID NO: 722468 - DNA, 20 bp, Artificial
  CRISPR gRNA sequence
gaacccgggaggcggaggtt

SEQ ID NO: 722469 - DNA, 20 bp, Artificial
  CRISPR gRNA sequence
aacccgggaggcggaggttg

SEQ ID NO: 722470 - DNA, 20 bp, Artificial
  CRISPR gRNA sequence
caaggttgcagtgagccgag

SEQ ID NO: 722471 - DNA, 20 bp, Artificial
  CRISPR gRNA sequence
cagtgagccgagattgcacc

SEQ ID NO: 722472 - DNA, 20 bp, Artificial
  CRISPR gRNA sequence
caccgctgcactccagcctg

SEQ ID NO: 722473 - DNA, 20 bp, Artificial
  CRISPR gRNA sequence
cactccagcctgagcagcag

SEQ ID NO: 722474 - DNA, 20 bp, Artificial
  CRISPR gRNA sequence
cagcctgagcagcagaatga

SEQ ID NO: 722475 - DNA, 20 bp, Artificial
  CRISPR gRNA sequence
agcagcagaatgagaatcag

SEQ ID NO: 722476 - DNA, 20 bp, Artificial
  CRISPR gRNA sequence
aaacaaaacaaaacaaaaca

SEQ ID NO: 722477 - DNA, 20 bp, Artificial
  CRISPR gRNA sequence
gctcttagggaaagatgcca

SEQ ID NO: 722478 - DNA, 20 bp, Artificial
  CRISPR gRNA sequence
ttagggaaagatgccaggtt

SEQ ID NO: 722479 - DNA, 20 bp, Artificial
  CRISPR gRNA sequence
agggaaagatgccaggttac

SEQ ID NO: 722480 - DNA, 20 bp, Artificial
  CRISPR gRNA sequence
gggaaagatgccaggttact

SEQ ID NO: 722481 - DNA, 20 bp, Artificial
  CRISPR gRNA sequence
ctcattttaggacttgcagt

SEQ ID NO: 722482 - DNA, 20 bp, Artificial
  CRISPR gRNA sequence
attttaggacttgcagttct

SEQ ID NO: 722483 - DNA, 20 bp, Artificial
  CRISPR gRNA sequence
taggacttgcagttctagtg

SEQ ID NO: 722484 - DNA, 20 bp, Artificial
  CRISPR gRNA sequence
aggacttgcagttctagtgg

SEQ ID NO: 722485 - DNA, 20 bp, Artificial
  CRISPR gRNA sequence
ggacttgcagttctagtggc

SEQ ID NO: 722486 - DNA, 20 bp, Artificial
  CRISPR gRNA sequence
gcagttctagtggctgacac

SEQ ID NO: 722487 - DNA, 20 bp, Artificial
  CRISPR gRNA sequence
cagttctagtggctgacacg

SEQ ID NO: 722488 - DNA, 20 bp, Artificial
  CRISPR gRNA sequence
tagtggctgacacgaggtgg

SEQ ID NO: 722489 - DNA, 20 bp, Artificial
  CRISPR gRNA sequence
gtggctgacacgaggtggca

SEQ ID NO: 722490 - DNA, 20 bp, Artificial
  CRISPR gRNA sequence
acacgaggtggcagtagtgc

SEQ ID NO: 722491 - DNA, 20 bp, Artificial
  CRISPR gRNA sequence
cggccagagtttctgaaagt

SEQ ID NO: 722492 - DNA, 20 bp, Artificial
  CRISPR gRNA sequence
ctgaaagtgcggtcccgtct

SEQ ID NO: 722493 - DNA, 20 bp, Artificial
  CRISPR gRNA sequence
tgaaagtgcggtcccgtctg

SEQ ID NO: 722494 - DNA, 20 bp, Artificial
  CRISPR gRNA sequence
aaagtgcggtcccgtctggc

SEQ ID NO: 722495 - DNA, 20 bp, Artificial
  CRISPR gRNA sequence
gcagcattggcaccggctgg

SEQ ID NO: 722496 - DNA, 20 bp, Artificial
  CRISPR gRNA sequence
gcaccggctgggaacttgtt

SEQ ID NO: 722497 - DNA, 20 bp, Artificial
  CRISPR gRNA sequence
ggaacttgttaggaaagcaa

SEQ ID NO: 722498 - DNA, 20 bp, Artificial
  CRISPR gRNA sequence
gttaggaaagcaaattatgg

SEQ ID NO: 722499 - DNA, 20 bp, Artificial
  CRISPR gRNA sequence
ttaggaaagcaaattatggg

SEQ ID NO: 722500 - DNA, 20 bp, Artificial
  CRISPR gRNA sequence
ggaaagcaaattatgggccc

SEQ ID NO: 722501 - DNA, 20 bp, Artificial
  CRISPR gRNA sequence
tgggccccatcccagaccta

SEQ ID NO: 722502 - DNA, 20 bp, Artificial
  CRISPR gRNA sequence
gagaatcagaaactgcactt

SEQ ID NO: 722503 - DNA, 20 bp, Artificial
  CRISPR gRNA sequence
cactttaacaagatctccag

SEQ ID NO: 722504 - DNA, 20 bp, Artificial
  CRISPR gRNA sequence
taacaagatctccagggcac

SEQ ID NO: 722505 - DNA, 20 bp, Artificial
  CRISPR gRNA sequence
aacaagatctccagggcact

SEQ ID NO: 722506 - DNA, 20 bp, Artificial
  CRISPR gRNA sequence
acaagatctccagggcactc

SEQ ID NO: 722507 - DNA, 20 bp, Artificial
  CRISPR gRNA sequence
cagggcactcatgtgcacat

SEQ ID NO: 722508 - DNA, 20 bp, Artificial
  CRISPR gRNA sequence
atgtgcacattaacgtttga

SEQ ID NO: 722509 - DNA, 20 bp, Artificial
  CRISPR gRNA sequence
acgtttgagaagcacttaac

SEQ ID NO: 722510 - DNA, 20 bp, Artificial
  CRISPR gRNA sequence
gagaagcacttaactggcat

SEQ ID NO: 722511 - DNA, 20 bp, Artificial
  CRISPR gRNA sequence
agaagcacttaactggcata

SEQ ID NO: 722512 - DNA, 20 bp, Artificial
  CRISPR gRNA sequence
aactggcatatactactttt

SEQ ID NO: 722513 - DNA, 20 bp, Artificial
  CRISPR gRNA sequence
actggcatatactacttttt

SEQ ID NO: 722514 - DNA, 20 bp, Artificial
  CRISPR gRNA sequence
gcatatactactttttaaac

SEQ ID NO: 722515 - DNA, 20 bp, Artificial
  CRISPR gRNA sequence
ctttttaaacatctaaacat

SEQ ID NO: 722516 - DNA, 20 bp, Artificial
  CRISPR gRNA sequence
tttaaacatctaaacatgga

SEQ ID NO: 722517 - DNA, 20 bp, Artificial
  CRISPR gRNA sequence
ttaaacatctaaacatggac

SEQ ID NO: 722518 - DNA, 20 bp, Artificial
  CRISPR gRNA sequence
taaacatctaaacatggact

SEQ ID NO: 722519 - DNA, 20 bp, Artificial
  CRISPR gRNA sequence
aaacatctaaacatggactt

SEQ ID NO: 722520 - DNA, 20 bp, Artificial
  CRISPR gRNA sequence
aacatctaaacatggacttc

SEQ ID NO: 722521 - DNA, 20 bp, Artificial
  CRISPR gRNA sequence
aacatggacttcaataaagt

SEQ ID NO: 722522 - DNA, 20 bp, Artificial
  CRISPR gRNA sequence
caataaagtgcaatcactag

SEQ ID NO: 722523 - DNA, 20 bp, Artificial
  CRISPR gRNA sequence
aataaagtgcaatcactagc

SEQ ID NO: 722524 - DNA, 20 bp, Artificial
  CRISPR gRNA sequence
gctctatgatctctgtaagt

SEQ ID NO: 722525 - DNA, 20 bp, Artificial
  CRISPR gRNA sequence
tatgatctctgtaagtgaca

SEQ ID NO: 722526 - DNA, 20 bp, Artificial
  CRISPR gRNA sequence
tgatctctgtaagtgacaaa

SEQ ID NO: 722527 - DNA, 20 bp, Artificial
  CRISPR gRNA sequence
tgtaagtgacaaaagggaaa

SEQ ID NO: 722528 - DNA, 20 bp, Artificial
  CRISPR gRNA sequence
taagtgacaaaagggaaaaa

SEQ ID NO: 722529 - DNA, 20 bp, Artificial
  CRISPR gRNA sequence
agtaccgaggtgtgaagaag

SEQ ID NO: 722530 - DNA, 20 bp, Artificial
  CRISPR gRNA sequence
gtaccgaggtgtgaagaagt

SEQ ID NO: 722531 - DNA, 20 bp, Artificial
  CRISPR gRNA sequence
gataggggttaagagcgtgg

SEQ ID NO: 722532 - DNA, 20 bp, Artificial
  CRISPR gRNA sequence
agagcgtggccctgcagtcc

SEQ ID NO: 722533 - DNA, 20 bp, Artificial
  CRISPR gRNA sequence
cagtccccccggcctggcct

SEQ ID NO: 722534 - DNA, 20 bp, Artificial
  CRISPR gRNA sequence
gcctggcctgggctggggct

SEQ ID NO: 722535 - DNA, 20 bp, Artificial
  CRISPR gRNA sequence
gcctgggctggggctctgcc

SEQ ID NO: 722536 - DNA, 20 bp, Artificial
  CRISPR gRNA sequence
ggctggggctctgccactta

SEQ ID NO: 722537 - DNA, 20 bp, Artificial
  CRISPR gRNA sequence
gggctctgccacttactctc

SEQ ID NO: 722538 - DNA, 20 bp, Artificial
  CRISPR gRNA sequence
tgccacttactctcagggtg

SEQ ID NO: 722539 - DNA, 20 bp, Artificial
  CRISPR gRNA sequence
ccacttactctcagggtgac

SEQ ID NO: 722540 - DNA, 20 bp, Artificial
  CRISPR gRNA sequence
actctcagggtgaccttggg

SEQ ID NO: 722541 - DNA, 20 bp, Artificial
  CRISPR gRNA sequence
ctctcagggtgaccttgggc

SEQ ID NO: 722542 - DNA, 20 bp, Artificial
  CRISPR gRNA sequence
tcagggtgaccttgggcaac

SEQ ID NO: 722543 - DNA, 20 bp, Artificial
  CRISPR gRNA sequence
agggtgaccttgggcaactt

SEQ ID NO: 722544 - DNA, 20 bp, Artificial
  CRISPR gRNA sequence
gggcaacttaacgaactttc

SEQ ID NO: 722545 - DNA, 20 bp, Artificial
  CRISPR gRNA sequence
ggcaacttaacgaactttcg

SEQ ID NO: 722546 - DNA, 20 bp, Artificial
  CRISPR gRNA sequence
aacgaactttcgtgagcctc

SEQ ID NO: 722547 - DNA, 20 bp, Artificial
  CRISPR gRNA sequence
acgaactttcgtgagcctca

SEQ ID NO: 722548 - DNA, 20 bp, Artificial
  CRISPR gRNA sequence
tcgtgagcctcagctcccct

SEQ ID NO: 722549 - DNA, 20 bp, Artificial
  CRISPR gRNA sequence
cgtgagcctcagctcccctc

SEQ ID NO: 722550 - DNA, 20 bp, Artificial
  CRISPR gRNA sequence
gtgagcctcagctcccctca

SEQ ID NO: 722551 - DNA, 20 bp, Artificial
  CRISPR gRNA sequence
agctcccctcatttttaaac

SEQ ID NO: 722552 - DNA, 20 bp, Artificial
  CRISPR gRNA sequence
ccctcatttttaaactgaag

SEQ ID NO: 722553 - DNA, 20 bp, Artificial
  CRISPR gRNA sequence
atttttaaactgaaggtagt

SEQ ID NO: 722554 - DNA, 20 bp, Artificial
  CRISPR gRNA sequence
ttaaactgaaggtagtgacg

SEQ ID NO: 722555 - DNA, 20 bp, Artificial
  CRISPR gRNA sequence
taaactgaaggtagtgacgg

SEQ ID NO: 722556 - DNA, 20 bp, Artificial
  CRISPR gRNA sequence
aaactgaaggtagtgacggt

SEQ ID NO: 722557 - DNA, 20 bp, Artificial
  CRISPR gRNA sequence
aactgaaggtagtgacggtg

SEQ ID NO: 722558 - DNA, 20 bp, Artificial
  CRISPR gRNA sequence
aaggtagtgacggtgcctag

SEQ ID NO: 722559 - DNA, 20 bp, Artificial
  CRISPR gRNA sequence
gggcatagggttggggatca

SEQ ID NO: 722560 - DNA, 20 bp, Artificial
  CRISPR gRNA sequence
gggatcattcattcagggaa

SEQ ID NO: 722561 - DNA, 20 bp, Artificial
  CRISPR gRNA sequence
attcagggaacgcttgtggg

SEQ ID NO: 722562 - DNA, 20 bp, Artificial
  CRISPR gRNA sequence
agggaacgcttgtggggtgt

SEQ ID NO: 722563 - DNA, 20 bp, Artificial
  CRISPR gRNA sequence
gtggggtgtgtttatgtgca

SEQ ID NO: 722564 - DNA, 20 bp, Artificial
  CRISPR gRNA sequence
tggggtgtgtttatgtgcag

SEQ ID NO: 722565 - DNA, 20 bp, Artificial
  CRISPR gRNA sequence
atgtgcagtggggactccat

SEQ ID NO: 722566 - DNA, 20 bp, Artificial
  CRISPR gRNA sequence
tgtgcagtggggactccatg

SEQ ID NO: 722567 - DNA, 20 bp, Artificial
  CRISPR gRNA sequence
catgcctgccctcatcaagc

SEQ ID NO: 722568 - DNA, 20 bp, Artificial
  CRISPR gRNA sequence
ccctcatcaagcaggtctag

SEQ ID NO: 722569 - DNA, 20 bp, Artificial
  CRISPR gRNA sequence
atcaagcaggtctagagggt

SEQ ID NO: 722570 - DNA, 20 bp, Artificial
  CRISPR gRNA sequence
gagggttggccgggagggga

SEQ ID NO: 722571 - DNA, 20 bp, Artificial
  CRISPR gRNA sequence
gccgggaggggactgggttc

SEQ ID NO: 722572 - DNA, 20 bp, Artificial
  CRISPR gRNA sequence
ggttcaacctcttccttccc

SEQ ID NO: 722573 - DNA, 20 bp, Artificial
  CRISPR gRNA sequence
aacctcttccttcccctcac

SEQ ID NO: 722574 - DNA, 20 bp, Artificial
  CRISPR gRNA sequence
ttccttcccctcactgcttg

SEQ ID NO: 722575 - DNA, 20 bp, Artificial
  CRISPR gRNA sequence
ccttcccctcactgcttggc

SEQ ID NO: 722576 - DNA, 20 bp, Artificial
  CRISPR gRNA sequence
cttcccctcactgcttggcc

SEQ ID NO: 722577 - DNA, 20 bp, Artificial
  CRISPR gRNA sequence
cccctcactgcttggccctc

SEQ ID NO: 722578 - DNA, 20 bp, Artificial
  CRISPR gRNA sequence
ccctcactgcttggccctcc

SEQ ID NO: 722579 - DNA, 20 bp, Artificial
  CRISPR gRNA sequence
actgcttggccctccccacc

SEQ ID NO: 722580 - DNA, 20 bp, Artificial
  CRISPR gRNA sequence
cttggccctccccaccctga

SEQ ID NO: 722581 - DNA, 20 bp, Artificial
  CRISPR gRNA sequence
ggccctccccaccctgactc

SEQ ID NO: 722582 - DNA, 20 bp, Artificial
  CRISPR gRNA sequence
gccctccccaccctgactcc

SEQ ID NO: 722583 - DNA, 20 bp, Artificial
  CRISPR gRNA sequence
cccaccctgactccggccac

SEQ ID NO: 722584 - DNA, 20 bp, Artificial
  CRISPR gRNA sequence
actccggccacaccagcagt

SEQ ID NO: 722585 - DNA, 20 bp, Artificial
  CRISPR gRNA sequence
cggccacaccagcagtgctg

SEQ ID NO: 722586 - DNA, 20 bp, Artificial
  CRISPR gRNA sequence
ccagatgccggtcacaccgg

SEQ ID NO: 722587 - DNA, 20 bp, Artificial
  CRISPR gRNA sequence
gtccacagtccccaaatttt

SEQ ID NO: 722588 - DNA, 20 bp, Artificial
  CRISPR gRNA sequence
tggtctattggacctcaatt

SEQ ID NO: 722589 - DNA, 20 bp, Artificial
  CRISPR gRNA sequence
ggtctattggacctcaattc

SEQ ID NO: 722590 - DNA, 20 bp, Artificial
  CRISPR gRNA sequence
gtctattggacctcaattcc

SEQ ID NO: 722591 - DNA, 20 bp, Artificial
  CRISPR gRNA sequence
ttggacctcaattcctttgt

SEQ ID NO: 722592 - DNA, 20 bp, Artificial
  CRISPR gRNA sequence
gacctcaattcctttgttct

SEQ ID NO: 722593 - DNA, 20 bp, Artificial
  CRISPR gRNA sequence
aattcctttgttctggctcc

SEQ ID NO: 722594 - DNA, 20 bp, Artificial
  CRISPR gRNA sequence
ctttgttctggctcctagac

SEQ ID NO: 722595 - DNA, 20 bp, Artificial
  CRISPR gRNA sequence
tgttctggctcctagacgcc

SEQ ID NO: 722596 - DNA, 20 bp, Artificial
  CRISPR gRNA sequence
gttctggctcctagacgcct

SEQ ID NO: 722597 - DNA, 20 bp, Artificial
  CRISPR gRNA sequence
ttctggctcctagacgcctc

SEQ ID NO: 722598 - DNA, 20 bp, Artificial
  CRISPR gRNA sequence
tggctcctagacgcctcaat

SEQ ID NO: 722599 - DNA, 20 bp, Artificial
  CRISPR gRNA sequence
gctcctagacgcctcaattt

SEQ ID NO: 722600 - DNA, 20 bp, Artificial
  CRISPR gRNA sequence
ctagacgcctcaatttctca

SEQ ID NO: 722601 - DNA, 20 bp, Artificial
  CRISPR gRNA sequence
gacgcctcaatttctcactc

SEQ ID NO: 722602 - DNA, 20 bp, Artificial
  CRISPR gRNA sequence
aatttctcactctctagaca

SEQ ID NO: 722603 - DNA, 20 bp, Artificial
  CRISPR gRNA sequence
ctcactctctagacacagtt

SEQ ID NO: 722604 - DNA, 20 bp, Artificial
  CRISPR gRNA sequence
tcactctctagacacagttt

SEQ ID NO: 722605 - DNA, 20 bp, Artificial
  CRISPR gRNA sequence
actctctagacacagtttgc

SEQ ID NO: 722606 - DNA, 20 bp, Artificial
  CRISPR gRNA sequence
tctagacacagtttgccctt

SEQ ID NO: 722607 - DNA, 20 bp, Artificial
  CRISPR gRNA sequence
tagacacagtttgcccttct

SEQ ID NO: 722608 - DNA, 20 bp, Artificial
  CRISPR gRNA sequence
gacacagtttgcccttctct

SEQ ID NO: 722609 - DNA, 20 bp, Artificial
  CRISPR gRNA sequence
gcccttctctcagccttcaa

SEQ ID NO: 722610 - DNA, 20 bp, Artificial
  CRISPR gRNA sequence
cccttctctcagccttcaat

SEQ ID NO: 722611 - DNA, 20 bp, Artificial
  CRISPR gRNA sequence
ctctcagccttcaatagttg

SEQ ID NO: 722612 - DNA, 20 bp, Artificial
  CRISPR gRNA sequence
tctcagccttcaatagttga

SEQ ID NO: 722613 - DNA, 20 bp, Artificial
  CRISPR gRNA sequence
tcagccttcaatagttgatc

SEQ ID NO: 722614 - DNA, 20 bp, Artificial
  CRISPR gRNA sequence
agccttcaatagttgatcag

SEQ ID NO: 722615 - DNA, 20 bp, Artificial
  CRISPR gRNA sequence
caatagttgatcagcttcct

SEQ ID NO: 722616 - DNA, 20 bp, Artificial
  CRISPR gRNA sequence
aatagttgatcagcttcctg

SEQ ID NO: 722617 - DNA, 20 bp, Artificial
  CRISPR gRNA sequence
atcagcttcctggagccagg

SEQ ID NO: 722618 - DNA, 20 bp, Artificial
  CRISPR gRNA sequence
cctggagccaggcgagggag

SEQ ID NO: 722619 - DNA, 20 bp, Artificial
  CRISPR gRNA sequence
ctggagccaggcgagggagg

SEQ ID NO: 722620 - DNA, 20 bp, Artificial
  CRISPR gRNA sequence
gagccaggcgagggagggct

SEQ ID NO: 722621 - DNA, 20 bp, Artificial
  CRISPR gRNA sequence
gatgagataagagccttggc

SEQ ID NO: 722622 - DNA, 20 bp, Artificial
  CRISPR gRNA sequence
ggcttggaaaggacctgttg

SEQ ID NO: 722623 - DNA, 20 bp, Artificial
  CRISPR gRNA sequence
gcttggaaaggacctgttgt

SEQ ID NO: 722624 - DNA, 20 bp, Artificial
  CRISPR gRNA sequence
ggaaaggacctgttgttgtt

SEQ ID NO: 722625 - DNA, 20 bp, Artificial
  CRISPR gRNA sequence
gaaaggacctgttgttgtta

SEQ ID NO: 722626 - DNA, 20 bp, Artificial
  CRISPR gRNA sequence
ttgttgttagccatgatgga

SEQ ID NO: 722627 - DNA, 20 bp, Artificial
  CRISPR gRNA sequence
ttgttagccatgatggaagc

SEQ ID NO: 722628 - DNA, 20 bp, Artificial
  CRISPR gRNA sequence
ttagccatgatggaagctgt

SEQ ID NO: 722629 - DNA, 20 bp, Artificial
  CRISPR gRNA sequence
gccatgatggaagctgtgtc

SEQ ID NO: 722630 - DNA, 20 bp, Artificial
  CRISPR gRNA sequence
tgtcccaggagaaggaggaa

SEQ ID NO: 722631 - DNA, 20 bp, Artificial
  CRISPR gRNA sequence
gggctggggctgtcttgtgt

SEQ ID NO: 722632 - DNA, 20 bp, Artificial
  CRISPR gRNA sequence
gggctgtcttgtgtggttgc

SEQ ID NO: 722633 - DNA, 20 bp, Artificial
  CRISPR gRNA sequence
tcttgtgtggttgcagcaag

SEQ ID NO: 722634 - DNA, 20 bp, Artificial
  CRISPR gRNA sequence
gtgtggttgcagcaaggcaa

SEQ ID NO: 722635 - DNA, 20 bp, Artificial
  CRISPR gRNA sequence
tgtggttgcagcaaggcaaa

SEQ ID NO: 722636 - DNA, 20 bp, Artificial
  CRISPR gRNA sequence
cagcaaggcaaagagtgtgg

SEQ ID NO: 722637 - DNA, 20 bp, Artificial
  CRISPR gRNA sequence
tgtgttccagggccagtgct

SEQ ID NO: 722638 - DNA, 20 bp, Artificial
  CRISPR gRNA sequence
tgttccagggccagtgctct

SEQ ID NO: 722639 - DNA, 20 bp, Artificial
  CRISPR gRNA sequence
cagggccagtgctcttctgg

SEQ ID NO: 722640 - DNA, 20 bp, Artificial
  CRISPR gRNA sequence
ttctgggtgatcctggtgtt

SEQ ID NO: 722641 - DNA, 20 bp, Artificial
  CRISPR gRNA sequence
ctgggtgatcctggtgttgg

SEQ ID NO: 722642 - DNA, 20 bp, Artificial
  CRISPR gRNA sequence
tgggtgatcctggtgttggt

SEQ ID NO: 722643 - DNA, 20 bp, Artificial
  CRISPR gRNA sequence
ggtgatcctggtgttggttg

SEQ ID NO: 722644 - DNA, 20 bp, Artificial
  CRISPR gRNA sequence
gtgttggttgtggtggtcgg

SEQ ID NO: 722645 - DNA, 20 bp, Artificial
  CRISPR gRNA sequence
gttgtggtggtcggctccag

SEQ ID NO: 722646 - DNA, 20 bp, Artificial
  CRISPR gRNA sequence
tggtggtcggctccagcgcc

SEQ ID NO: 722647 - DNA, 20 bp, Artificial
  CRISPR gRNA sequence
cagcgccttcctcctgtgcc

SEQ ID NO: 722648 - DNA, 20 bp, Artificial
  CRISPR gRNA sequence
cctcctgtgccaccggaggg

SEQ ID NO: 722649 - DNA, 20 bp, Artificial
  CRISPR gRNA sequence
ctcctgtgccaccggagggc

SEQ ID NO: 722650 - DNA, 20 bp, Artificial
  CRISPR gRNA sequence
ctgtgccaccggagggcctg

SEQ ID NO: 722651 - DNA, 20 bp, Artificial
  CRISPR gRNA sequence
tgccaccggagggcctgcag

SEQ ID NO: 722652 - DNA, 20 bp, Artificial
  CRISPR gRNA sequence
caggaagcgaattcggcaga

SEQ ID NO: 722653 - DNA, 20 bp, Artificial
  CRISPR gRNA sequence
ggcagagtaagtggctgtgt

SEQ ID NO: 722654 - DNA, 20 bp, Artificial
  CRISPR gRNA sequence
tgtccttggggccttgggga

SEQ ID NO: 722655 - DNA, 20 bp, Artificial
  CRISPR gRNA sequence
ggggccttggggaggacagg

SEQ ID NO: 722656 - DNA, 20 bp, Artificial
  CRISPR gRNA sequence
gggccttggggaggacaggt

SEQ ID NO: 722657 - DNA, 20 bp, Artificial
  CRISPR gRNA sequence
ggggaggacaggttgctctc

SEQ ID NO: 722658 - DNA, 20 bp, Artificial
  CRISPR gRNA sequence
gggaggacaggttgctctct

SEQ ID NO: 722659 - DNA, 20 bp, Artificial
  CRISPR gRNA sequence
ctctctgccagcctggcctg

SEQ ID NO: 722660 - DNA, 20 bp, Artificial
  CRISPR gRNA sequence
tctgccagcctggcctgggt

SEQ ID NO: 722661 - DNA, 20 bp, Artificial
  CRISPR gRNA sequence
tgccagcctggcctgggttc

SEQ ID NO: 722662 - DNA, 20 bp, Artificial
  CRISPR gRNA sequence
ccagcctggcctgggttctt

SEQ ID NO: 722663 - DNA, 20 bp, Artificial
  CRISPR gRNA sequence
gcctgggttctttccctgcc

SEQ ID NO: 722664 - DNA, 20 bp, Artificial
  CRISPR gRNA sequence
ggttctttccctgcctgctc

SEQ ID NO: 722665 - DNA, 20 bp, Artificial
  CRISPR gRNA sequence
tttccctgcctgctcctgct

SEQ ID NO: 722666 - DNA, 20 bp, Artificial
  CRISPR gRNA sequence
tccctgcctgctcctgctct

SEQ ID NO: 722667 - DNA, 20 bp, Artificial
  CRISPR gRNA sequence
ccctgcctgctcctgctctc

SEQ ID NO: 722668 - DNA, 20 bp, Artificial
  CRISPR gRNA sequence
cctgcctgctcctgctctct

SEQ ID NO: 722669 - DNA, 20 bp, Artificial
  CRISPR gRNA sequence
cctgctcctgctctctgagg

SEQ ID NO: 722670 - DNA, 20 bp, Artificial
  CRISPR gRNA sequence
ctcctgctctctgaggccgc

SEQ ID NO: 722671 - DNA, 20 bp, Artificial
  CRISPR gRNA sequence
ctgctctctgaggccgccac

SEQ ID NO: 722672 - DNA, 20 bp, Artificial
  CRISPR gRNA sequence
ctctctgaggccgccacccc

SEQ ID NO: 722673 - DNA, 20 bp, Artificial
  CRISPR gRNA sequence
tctgaggccgccacccccag

SEQ ID NO: 722674 - DNA, 20 bp, Artificial
  CRISPR gRNA sequence
tgaggccgccacccccagcc

SEQ ID NO: 722675 - DNA, 20 bp, Artificial
  CRISPR gRNA sequence
aggccgccacccccagcctt

SEQ ID NO: 722676 - DNA, 20 bp, Artificial
  CRISPR gRNA sequence
cctcctggtgtcgtttcaga

SEQ ID NO: 722677 - DNA, 20 bp, Artificial
  CRISPR gRNA sequence
ctcctggtgtcgtttcagag

SEQ ID NO: 722678 - DNA, 20 bp, Artificial
  CRISPR gRNA sequence
ctggtgtcgtttcagagctc

SEQ ID NO: 722679 - DNA, 20 bp, Artificial
  CRISPR gRNA sequence
gtgtcgtttcagagctccac

SEQ ID NO: 722680 - DNA, 20 bp, Artificial
  CRISPR gRNA sequence
cagagctccacctgtgctac

SEQ ID NO: 722681 - DNA, 20 bp, Artificial
  CRISPR gRNA sequence
agagctccacctgtgctacc

SEQ ID NO: 722682 - DNA, 20 bp, Artificial
  CRISPR gRNA sequence
cacctgtgctacccggtcca

SEQ ID NO: 722683 - DNA, 20 bp, Artificial
  CRISPR gRNA sequence
tgctacccggtccagacctc

SEQ ID NO: 722684 - DNA, 20 bp, Artificial
  CRISPR gRNA sequence
cccggtccagacctcccagc

SEQ ID NO: 722685 - DNA, 20 bp, Artificial
  CRISPR gRNA sequence
ccagcccaagctagagcttg

SEQ ID NO: 722686 - DNA, 20 bp, Artificial
  CRISPR gRNA sequence
gagcttgtgggtgagtgtcc

SEQ ID NO: 722687 - DNA, 20 bp, Artificial
  CRISPR gRNA sequence
gtgggtgagtgtccagccgt

SEQ ID NO: 722688 - DNA, 20 bp, Artificial
  CRISPR gRNA sequence
tgggtgagtgtccagccgtc

SEQ ID NO: 722689 - DNA, 20 bp, Artificial
  CRISPR gRNA sequence
cccgagccagaggaacacag

SEQ ID NO: 722690 - DNA, 20 bp, Artificial
  CRISPR gRNA sequence
tgggcccggggcgtgggctc

SEQ ID NO: 722691 - DNA, 20 bp, Artificial
  CRISPR gRNA sequence
ggcccggggcgtgggctcca

SEQ ID NO: 722692 - DNA, 20 bp, Artificial
  CRISPR gRNA sequence
cagagactgaacttctaccc

SEQ ID NO: 722693 - DNA, 20 bp, Artificial
  CRISPR gRNA sequence
aacttctaccccagcctcga

SEQ ID NO: 722694 - DNA, 20 bp, Artificial
  CRISPR gRNA sequence
ctaccccagcctcgaagctc

SEQ ID NO: 722695 - DNA, 20 bp, Artificial
  CRISPR gRNA sequence
taccccagcctcgaagctcc

SEQ ID NO: 722696 - DNA, 20 bp, Artificial
  CRISPR gRNA sequence
ccccagcctcgaagctccct

SEQ ID NO: 722697 - DNA, 20 bp, Artificial
  CRISPR gRNA sequence
gaagctccctgtctgtggct

SEQ ID NO: 722698 - DNA, 20 bp, Artificial
  CRISPR gRNA sequence
cctgtctgtggctcctgtcg

SEQ ID NO: 722699 - DNA, 20 bp, Artificial
  CRISPR gRNA sequence
tctgtggctcctgtcgcatt

SEQ ID NO: 722700 - DNA, 20 bp, Artificial
  CRISPR gRNA sequence
tggctcctgtcgcattctgt

SEQ ID NO: 722701 - DNA, 20 bp, Artificial
  CRISPR gRNA sequence
ctgtcgcattctgtacatct

SEQ ID NO: 722702 - DNA, 20 bp, Artificial
  CRISPR gRNA sequence
tcgcattctgtacatctgta

SEQ ID NO: 722703 - DNA, 20 bp, Artificial
  CRISPR gRNA sequence
tgtacatctgtagggatgca

SEQ ID NO: 722704 - DNA, 20 bp, Artificial
  CRISPR gRNA sequence
tacatctgtagggatgcaat

SEQ ID NO: 722705 - DNA, 20 bp, Artificial
  CRISPR gRNA sequence
tagggatgcaatgtgggtga

SEQ ID NO: 722706 - DNA, 20 bp, Artificial
  CRISPR gRNA sequence
atgcgtgtggagaatgcaat

SEQ ID NO: 722707 - DNA, 20 bp, Artificial
  CRISPR gRNA sequence
tactgggtgtgacgactgtg

SEQ ID NO: 722708 - DNA, 20 bp, Artificial
  CRISPR gRNA sequence
ggtgtgacgactgtgtggct

SEQ ID NO: 722709 - DNA, 20 bp, Artificial
  CRISPR gRNA sequence
tgtggcttgcccagagcagc

SEQ ID NO: 722710 - DNA, 20 bp, Artificial
  CRISPR gRNA sequence
gcccagagcagcacctggat

SEQ ID NO: 722711 - DNA, 20 bp, Artificial
  CRISPR gRNA sequence
cccagagcagcacctggatg

SEQ ID NO: 722712 - DNA, 20 bp, Artificial
  CRISPR gRNA sequence
gatggatgctggcatgaacg

SEQ ID NO: 722713 - DNA, 20 bp, Artificial
  CRISPR gRNA sequence
gcatgaacgtttaaaagtct

SEQ ID NO: 722714 - DNA, 20 bp, Artificial
  CRISPR gRNA sequence
aaaagtctatcttgtctgtc

SEQ ID NO: 722715 - DNA, 20 bp, Artificial
  CRISPR gRNA sequence
aaagtctatcttgtctgtca

SEQ ID NO: 722716 - DNA, 20 bp, Artificial
  CRISPR gRNA sequence
tcttgtctgtcactttttcc

SEQ ID NO: 722717 - DNA, 20 bp, Artificial
  CRISPR gRNA sequence
gtctgtcactttttcctcca

SEQ ID NO: 722718 - DNA, 20 bp, Artificial
  CRISPR gRNA sequence
tctgtcactttttcctccag

SEQ ID NO: 722719 - DNA, 20 bp, Artificial
  CRISPR gRNA sequence
tcactttttcctccagtacc

SEQ ID NO: 722720 - DNA, 20 bp, Artificial
  CRISPR gRNA sequence
tttcctccagtacccccagg

SEQ ID NO: 722721 - DNA, 20 bp, Artificial
  CRISPR gRNA sequence
ttcctccagtacccccaggg

SEQ ID NO: 722722 - DNA, 20 bp, Artificial
  CRISPR gRNA sequence
tcctccagtacccccagggg

SEQ ID NO: 722723 - DNA, 20 bp, Artificial
  CRISPR gRNA sequence
cctccagtacccccaggggg

SEQ ID NO: 722724 - DNA, 20 bp, Artificial
  CRISPR gRNA sequence
ctccagtacccccagggggc

SEQ ID NO: 722725 - DNA, 20 bp, Artificial
  CRISPR gRNA sequence
cagtacccccagggggcatt

SEQ ID NO: 722726 - DNA, 20 bp, Artificial
  CRISPR gRNA sequence
ctgccagccttgccttcctc

SEQ ID NO: 722727 - DNA, 20 bp, Artificial
  CRISPR gRNA sequence
ccagccttgccttcctctct

SEQ ID NO: 722728 - DNA, 20 bp, Artificial
  CRISPR gRNA sequence
gccttcctctctacattcta

SEQ ID NO: 722729 - DNA, 20 bp, Artificial
  CRISPR gRNA sequence
ccttcctctctacattctac

SEQ ID NO: 722730 - DNA, 20 bp, Artificial
  CRISPR gRNA sequence
cctctctacattctaccctc

SEQ ID NO: 722731 - DNA, 20 bp, Artificial
  CRISPR gRNA sequence
ctctctacattctaccctcc

SEQ ID NO: 722732 - DNA, 20 bp, Artificial
  CRISPR gRNA sequence
tctacattctaccctccctt

SEQ ID NO: 722733 - DNA, 20 bp, Artificial
  CRISPR gRNA sequence
tacattctaccctccctttc

SEQ ID NO: 722734 - DNA, 20 bp, Artificial
  CRISPR gRNA sequence
cattctaccctccctttctc

SEQ ID NO: 722735 - DNA, 20 bp, Artificial
  CRISPR gRNA sequence
taccctccctttctccctct

SEQ ID NO: 722736 - DNA, 20 bp, Artificial
  CRISPR gRNA sequence
ccctccctttctccctctcc

SEQ ID NO: 722737 - DNA, 20 bp, Artificial
  CRISPR gRNA sequence
cctttctccctctccctcct

SEQ ID NO: 722738 - DNA, 20 bp, Artificial
  CRISPR gRNA sequence
tctccctctccctccttctc

SEQ ID NO: 722739 - DNA, 20 bp, Artificial
  CRISPR gRNA sequence
ctccctctccctccttctct

SEQ ID NO: 722740 - DNA, 20 bp, Artificial
  CRISPR gRNA sequence
tccctctccctccttctctt

SEQ ID NO: 722741 - DNA, 20 bp, Artificial
  CRISPR gRNA sequence
cctctccctccttctctttc

SEQ ID NO: 722742 - DNA, 20 bp, Artificial
  CRISPR gRNA sequence
tccctccttctctttctctt

SEQ ID NO: 722743 - DNA, 20 bp, Artificial
  CRISPR gRNA sequence
cctccttctctttctctttc

SEQ ID NO: 722744 - DNA, 20 bp, Artificial
  CRISPR gRNA sequence
cttctctttctctttcccct

SEQ ID NO: 722745 - DNA, 20 bp, Artificial
  CRISPR gRNA sequence
ctctttctctttcccctctc

SEQ ID NO: 722746 - DNA, 20 bp, Artificial
  CRISPR gRNA sequence
tctttctctttcccctctct

SEQ ID NO: 722747 - DNA, 20 bp, Artificial
  CRISPR gRNA sequence
tttctctttcccctctctcc

SEQ ID NO: 722748 - DNA, 20 bp, Artificial
  CRISPR gRNA sequence
tctctttcccctctctcccc

SEQ ID NO: 722749 - DNA, 20 bp, Artificial
  CRISPR gRNA sequence
ctctttcccctctctccccc

SEQ ID NO: 722750 - DNA, 20 bp, Artificial
  CRISPR gRNA sequence
tctttcccctctctccccct

SEQ ID NO: 722751 - DNA, 20 bp, Artificial
  CRISPR gRNA sequence
tttcccctctctccccctct

SEQ ID NO: 722752 - DNA, 20 bp, Artificial
  CRISPR gRNA sequence
tcccctctctccccctcttc

SEQ ID NO: 722753 - DNA, 20 bp, Artificial
  CRISPR gRNA sequence
cccctctctccccctcttct

SEQ ID NO: 722754 - DNA, 20 bp, Artificial
  CRISPR gRNA sequence
ccctctctccccctcttcta

SEQ ID NO: 722755 - DNA, 20 bp, Artificial
  CRISPR gRNA sequence
tctccccctcttctaccacc

SEQ ID NO: 722756 - DNA, 20 bp, Artificial
  CRISPR gRNA sequence
tccccctcttctaccacctg

SEQ ID NO: 722757 - DNA, 20 bp, Artificial
  CRISPR gRNA sequence
cccctcttctaccacctggc

SEQ ID NO: 722758 - DNA, 20 bp, Artificial
  CRISPR gRNA sequence
ttctaccacctggcaagtca

SEQ ID NO: 722759 - DNA, 20 bp, Artificial
  CRISPR gRNA sequence
ctaccacctggcaagtcagc

SEQ ID NO: 722760 - DNA, 20 bp, Artificial
  CRISPR gRNA sequence
taccacctggcaagtcagcc

SEQ ID NO: 722761 - DNA, 20 bp, Artificial
  CRISPR gRNA sequence
ccacctggcaagtcagccca

SEQ ID NO: 722762 - DNA, 20 bp, Artificial
  CRISPR gRNA sequence
gcaagtcagcccaggggcag

SEQ ID NO: 722763 - DNA, 20 bp, Artificial
  CRISPR gRNA sequence
gttctgccacttacaagctg

SEQ ID NO: 722764 - DNA, 20 bp, Artificial
  CRISPR gRNA sequence
tgccacttacaagctgtgtg

SEQ ID NO: 722765 - DNA, 20 bp, Artificial
  CRISPR gRNA sequence
ccacttacaagctgtgtgac

SEQ ID NO: 722766 - DNA, 20 bp, Artificial
  CRISPR gRNA sequence
acaagctgtgtgaccctggg

SEQ ID NO: 722767 - DNA, 20 bp, Artificial
  CRISPR gRNA sequence
caagctgtgtgaccctgggt

SEQ ID NO: 722768 - DNA, 20 bp, Artificial
  CRISPR gRNA sequence
tgtgaccctgggtgagttac

SEQ ID NO: 722769 - DNA, 20 bp, Artificial
  CRISPR gRNA sequence
ggtgagttactgaattgtcc

SEQ ID NO: 722770 - DNA, 20 bp, Artificial
  CRISPR gRNA sequence
ctgaattgtcctgtgtctca

SEQ ID NO: 722771 - DNA, 20 bp, Artificial
  CRISPR gRNA sequence
aattgtcctgtgtctcagtt

SEQ ID NO: 722772 - DNA, 20 bp, Artificial
  CRISPR gRNA sequence
tcctgtgtctcagtttcctc

SEQ ID NO: 722773 - DNA, 20 bp, Artificial
  CRISPR gRNA sequence
tgtctcagtttcctcatccg

SEQ ID NO: 722774 - DNA, 20 bp, Artificial
  CRISPR gRNA sequence
agtttcctcatccggaaaat

SEQ ID NO: 722775 - DNA, 20 bp, Artificial
  CRISPR gRNA sequence
cctcatccggaaaatgcaga

SEQ ID NO: 722776 - DNA, 20 bp, Artificial
  CRISPR gRNA sequence
ctcatccggaaaatgcagat

SEQ ID NO: 722777 - DNA, 20 bp, Artificial
  CRISPR gRNA sequence
atccggaaaatgcagatggt

SEQ ID NO: 722778 - DNA, 20 bp, Artificial
  CRISPR gRNA sequence
cttcagaggcttggcctgtg

SEQ ID NO: 722779 - DNA, 20 bp, Artificial
  CRISPR gRNA sequence
cagaggcttggcctgtggat

SEQ ID NO: 722780 - DNA, 20 bp, Artificial
  CRISPR gRNA sequence
agaggcttggcctgtggatt

SEQ ID NO: 722781 - DNA, 20 bp, Artificial
  CRISPR gRNA sequence
ggcctgtggattcgtcgagg

SEQ ID NO: 722782 - DNA, 20 bp, Artificial
  CRISPR gRNA sequence
gcctgtggattcgtcgaggt

SEQ ID NO: 722783 - DNA, 20 bp, Artificial
  CRISPR gRNA sequence
tggattcgtcgaggtcgggc

SEQ ID NO: 722784 - DNA, 20 bp, Artificial
  CRISPR gRNA sequence
gtcgaggtcgggctgttaag

SEQ ID NO: 722785 - DNA, 20 bp, Artificial
  CRISPR gRNA sequence
ttaagcgcatcgtggagtac

SEQ ID NO: 722786 - DNA, 20 bp, Artificial
  CRISPR gRNA sequence
agcgcatcgtggagtacctg

SEQ ID NO: 722787 - DNA, 20 bp, Artificial
  CRISPR gRNA sequence
cctgcaatcggtggctgctg

SEQ ID NO: 722788 - DNA, 20 bp, Artificial
  CRISPR gRNA sequence
caatcggtggctgctgccta

SEQ ID NO: 722789 - DNA, 20 bp, Artificial
  CRISPR gRNA sequence
ctgcctattgacaggctggc

SEQ ID NO: 722790 - DNA, 20 bp, Artificial
  CRISPR gRNA sequence
cctattgacaggctggcctg

SEQ ID NO: 722791 - DNA, 20 bp, Artificial
  CRISPR gRNA sequence
ttgacaggctggcctgtgcc

SEQ ID NO: 722792 - DNA, 20 bp, Artificial
  CRISPR gRNA sequence
acaggctggcctgtgcctgg

SEQ ID NO: 722793 - DNA, 20 bp, Artificial
  CRISPR gRNA sequence
gcctgtgcctggggcttttt

SEQ ID NO: 722794 - DNA, 20 bp, Artificial
  CRISPR gRNA sequence
tgcctggggctttttccttc

SEQ ID NO: 722795 - DNA, 20 bp, Artificial
  CRISPR gRNA sequence
gggctttttccttcctggaa

SEQ ID NO: 722796 - DNA, 20 bp, Artificial
  CRISPR gRNA sequence
tttccttcctggaagcttca

SEQ ID NO: 722797 - DNA, 20 bp, Artificial
  CRISPR gRNA sequence
ttccttcctggaagcttcag

SEQ ID NO: 722798 - DNA, 20 bp, Artificial
  CRISPR gRNA sequence
tccttcctggaagcttcagg

SEQ ID NO: 722799 - DNA, 20 bp, Artificial
  CRISPR gRNA sequence
ccttcctggaagcttcaggc

SEQ ID NO: 722800 - DNA, 20 bp, Artificial
  CRISPR gRNA sequence
cttcctggaagcttcaggcc

SEQ ID NO: 722801 - DNA, 20 bp, Artificial
  CRISPR gRNA sequence
cctggaagcttcaggccttc

SEQ ID NO: 722802 - DNA, 20 bp, Artificial
  CRISPR gRNA sequence
ctggaagcttcaggccttcc

SEQ ID NO: 722803 - DNA, 20 bp, Artificial
  CRISPR gRNA sequence
gaagcttcaggccttcctga

SEQ ID NO: 722804 - DNA, 20 bp, Artificial
  CRISPR gRNA sequence
caggccttcctgagtcctgg

SEQ ID NO: 722805 - DNA, 20 bp, Artificial
  CRISPR gRNA sequence
aggccttcctgagtcctggg

SEQ ID NO: 722806 - DNA, 20 bp, Artificial
  CRISPR gRNA sequence
cctgagtcctgggtgcttct

SEQ ID NO: 722807 - DNA, 20 bp, Artificial
  CRISPR gRNA sequence
ctgagtcctgggtgcttctg

SEQ ID NO: 722808 - DNA, 20 bp, Artificial
  CRISPR gRNA sequence
agtcctgggtgcttctgacc

SEQ ID NO: 722809 - DNA, 20 bp, Artificial
  CRISPR gRNA sequence
ggtgcttctgaccccctccc

SEQ ID NO: 722810 - DNA, 20 bp, Artificial
  CRISPR gRNA sequence
ctgaccccctccctggtccc

SEQ ID NO: 722811 - DNA, 20 bp, Artificial
  CRISPR gRNA sequence
tgaccccctccctggtccct

SEQ ID NO: 722812 - DNA, 20 bp, Artificial
  CRISPR gRNA sequence
accccctccctggtccctgc

SEQ ID NO: 722813 - DNA, 20 bp, Artificial
  CRISPR gRNA sequence
cctggtccctgcactctgat

SEQ ID NO: 722814 - DNA, 20 bp, Artificial
  CRISPR gRNA sequence
gtccctgcactctgatccct

SEQ ID NO: 722815 - DNA, 20 bp, Artificial
  CRISPR gRNA sequence
cactctgatccctgcccagc

SEQ ID NO: 722816 - DNA, 20 bp, Artificial
  CRISPR gRNA sequence
tgatccctgcccagcctctg

SEQ ID NO: 722817 - DNA, 20 bp, Artificial
  CRISPR gRNA sequence
atccctgcccagcctctggg

SEQ ID NO: 722818 - DNA, 20 bp, Artificial
  CRISPR gRNA sequence
cccagcctctgggccagctc

SEQ ID NO: 722819 - DNA, 20 bp, Artificial
  CRISPR gRNA sequence
tgggccagctcttccaggca

SEQ ID NO: 722820 - DNA, 20 bp, Artificial
  CRISPR gRNA sequence
ggccagctcttccaggcagc

SEQ ID NO: 722821 - DNA, 20 bp, Artificial
  CRISPR gRNA sequence
ttccaggcagcccttgggag

SEQ ID NO: 722822 - DNA, 20 bp, Artificial
  CRISPR gRNA sequence
ccaggcagcccttgggagct

SEQ ID NO: 722823 - DNA, 20 bp, Artificial
  CRISPR gRNA sequence
caggcagcccttgggagctg

SEQ ID NO: 722824 - DNA, 20 bp, Artificial
  CRISPR gRNA sequence
gggagctggaaccctcctca

SEQ ID NO: 722825 - DNA, 20 bp, Artificial
  CRISPR gRNA sequence
ggagctggaaccctcctcac

SEQ ID NO: 722826 - DNA, 20 bp, Artificial
  CRISPR gRNA sequence
gaaccctcctcacctgtcca

SEQ ID NO: 722827 - DNA, 20 bp, Artificial
  CRISPR gRNA sequence
ctcacctgtccaggcagggt

SEQ ID NO: 722828 - DNA, 20 bp, Artificial
  CRISPR gRNA sequence
acctgtccaggcagggtcgt

SEQ ID NO: 722829 - DNA, 20 bp, Artificial
  CRISPR gRNA sequence
tccaggcagggtcgtctata

SEQ ID NO: 722830 - DNA, 20 bp, Artificial
  CRISPR gRNA sequence
tacagcgtgtgtcttctagc

SEQ ID NO: 722831 - DNA, 20 bp, Artificial
  CRISPR gRNA sequence
ctagctctcacctggggcag

SEQ ID NO: 722832 - DNA, 20 bp, Artificial
  CRISPR gRNA sequence
tagctctcacctggggcagg

SEQ ID NO: 722833 - DNA, 20 bp, Artificial
  CRISPR gRNA sequence
gctctcacctggggcagggg

SEQ ID NO: 722834 - DNA, 20 bp, Artificial
  CRISPR gRNA sequence
tcacctggggcagggggctc

SEQ ID NO: 722835 - DNA, 20 bp, Artificial
  CRISPR gRNA sequence
acctggggcagggggctccc

SEQ ID NO: 722836 - DNA, 20 bp, Artificial
  CRISPR gRNA sequence
gggcagggggctcccagcta

SEQ ID NO: 722837 - DNA, 20 bp, Artificial
  CRISPR gRNA sequence
ccagctatcttgtgccaagc

SEQ ID NO: 722838 - DNA, 20 bp, Artificial
  CRISPR gRNA sequence
tcttgtgccaagcaccttct

SEQ ID NO: 722839 - DNA, 20 bp, Artificial
  CRISPR gRNA sequence
gtgccaagcaccttctctct

SEQ ID NO: 722840 - DNA, 20 bp, Artificial
  CRISPR gRNA sequence
tgccaagcaccttctctctc

SEQ ID NO: 722841 - DNA, 20 bp, Artificial
  CRISPR gRNA sequence
ctctctcctgggcagcccct

SEQ ID NO: 722842 - DNA, 20 bp, Artificial
  CRISPR gRNA sequence
tctctcctgggcagcccctt

SEQ ID NO: 722843 - DNA, 20 bp, Artificial
  CRISPR gRNA sequence
tctcctgggcagccccttca

SEQ ID NO: 722844 - DNA, 20 bp, Artificial
  CRISPR gRNA sequence
tcctgggcagccccttcaag

SEQ ID NO: 722845 - DNA, 20 bp, Artificial
  CRISPR gRNA sequence
ctgggcagccccttcaaggc

SEQ ID NO: 722846 - DNA, 20 bp, Artificial
  CRISPR gRNA sequence
ggcagccccttcaaggcagg

SEQ ID NO: 722847 - DNA, 20 bp, Artificial
  CRISPR gRNA sequence
caaggcaggccagggtcttc

SEQ ID NO: 722848 - DNA, 20 bp, Artificial
  CRISPR gRNA sequence
aaggcaggccagggtcttcc

SEQ ID NO: 722849 - DNA, 20 bp, Artificial
  CRISPR gRNA sequence
cctcagcactgcatggcatg

SEQ ID NO: 722850 - DNA, 20 bp, Artificial
  CRISPR gRNA sequence
ctcagcactgcatggcatgg

SEQ ID NO: 722851 - DNA, 20 bp, Artificial
  CRISPR gRNA sequence
agcactgcatggcatggatt

SEQ ID NO: 722852 - DNA, 20 bp, Artificial
  CRISPR gRNA sequence
catggcatggattgggtgcc

SEQ ID NO: 722853 - DNA, 20 bp, Artificial
  CRISPR gRNA sequence
ggtgcctgctctgtgctggg

SEQ ID NO: 722854 - DNA, 20 bp, Artificial
  CRISPR gRNA sequence
ctctgtgctgggctctgatg

SEQ ID NO: 722855 - DNA, 20 bp, Artificial
  CRISPR gRNA sequence
tgtgctgggctctgatgggg

SEQ ID NO: 722856 - DNA, 20 bp, Artificial
  CRISPR gRNA sequence
tgctgggctctgatggggga

SEQ ID NO: 722857 - DNA, 20 bp, Artificial
  CRISPR gRNA sequence
ggctctgatgggggaatcgt

SEQ ID NO: 722858 - DNA, 20 bp, Artificial
  CRISPR gRNA sequence
tgatgggggaatcgtctgag

SEQ ID NO: 722859 - DNA, 20 bp, Artificial
  CRISPR gRNA sequence
atgggggaatcgtctgagcc

SEQ ID NO: 722860 - DNA, 20 bp, Artificial
  CRISPR gRNA sequence
agccttcgtttctgatttgc

SEQ ID NO: 722861 - DNA, 20 bp, Artificial
  CRISPR gRNA sequence
cgtttctgatttgcaaggtg

SEQ ID NO: 722862 - DNA, 20 bp, Artificial
  CRISPR gRNA sequence
gtttctgatttgcaaggtgg

SEQ ID NO: 722863 - DNA, 20 bp, Artificial
  CRISPR gRNA sequence
ctgatttgcaaggtgggctc

SEQ ID NO: 722864 - DNA, 20 bp, Artificial
  CRISPR gRNA sequence
tgatttgcaaggtgggctcc

SEQ ID NO: 722865 - DNA, 20 bp, Artificial
  CRISPR gRNA sequence
atttgcaaggtgggctccca

SEQ ID NO: 722866 - DNA, 20 bp, Artificial
  CRISPR gRNA sequence
gcaaggtgggctcccataca

SEQ ID NO: 722867 - DNA, 20 bp, Artificial
  CRISPR gRNA sequence
caaggtgggctcccatacag

SEQ ID NO: 722868 - DNA, 20 bp, Artificial
  CRISPR gRNA sequence
ccatacaggcttcctgtact

SEQ ID NO: 722869 - DNA, 20 bp, Artificial
  CRISPR gRNA sequence
cctgtactcccccagtgatg

SEQ ID NO: 722870 - DNA, 20 bp, Artificial
  CRISPR gRNA sequence
ctgtactcccccagtgatga

SEQ ID NO: 722871 - DNA, 20 bp, Artificial
  CRISPR gRNA sequence
tactcccccagtgatgacct

SEQ ID NO: 722872 - DNA, 20 bp, Artificial
  CRISPR gRNA sequence
ccccagtgatgacctttgtt

SEQ ID NO: 722873 - DNA, 20 bp, Artificial
  CRISPR gRNA sequence
tgttctgcaaggaggaggca

SEQ ID NO: 722874 - DNA, 20 bp, Artificial
  CRISPR gRNA sequence
gttctgcaaggaggaggcag

SEQ ID NO: 722875 - DNA, 20 bp, Artificial
  CRISPR gRNA sequence
ttctgcaaggaggaggcagg

SEQ ID NO: 722876 - DNA, 20 bp, Artificial
  CRISPR gRNA sequence
tgcaaggaggaggcagggct

SEQ ID NO: 722877 - DNA, 20 bp, Artificial
  CRISPR gRNA sequence
caaggaggaggcagggctca

SEQ ID NO: 722878 - DNA, 20 bp, Artificial
  CRISPR gRNA sequence
agcaaggtggacggctggcc

SEQ ID NO: 722879 - DNA, 20 bp, Artificial
  CRISPR gRNA sequence
gcccagggccacacagcctg

SEQ ID NO: 722880 - DNA, 20 bp, Artificial
  CRISPR gRNA sequence
gcagtggcacagccagcctc

SEQ ID NO: 722881 - DNA, 20 bp, Artificial
  CRISPR gRNA sequence
aggcactggtcctaggggtt

SEQ ID NO: 722882 - DNA, 20 bp, Artificial
  CRISPR gRNA sequence
gtcctaggggttttggtttg

SEQ ID NO: 722883 - DNA, 20 bp, Artificial
  CRISPR gRNA sequence
ggggttttggtttgtaaagg

SEQ ID NO: 722884 - DNA, 20 bp, Artificial
  CRISPR gRNA sequence
tggtttgtaaagggctcagc

SEQ ID NO: 722885 - DNA, 20 bp, Artificial
  CRISPR gRNA sequence
ggtttgtaaagggctcagcc

SEQ ID NO: 722886 - DNA, 20 bp, Artificial
  CRISPR gRNA sequence
gtttgtaaagggctcagccc

SEQ ID NO: 722887 - DNA, 20 bp, Artificial
  CRISPR gRNA sequence
gtaaagggctcagccctgtc

SEQ ID NO: 722888 - DNA, 20 bp, Artificial
  CRISPR gRNA sequence
taaagggctcagccctgtcc

SEQ ID NO: 722889 - DNA, 20 bp, Artificial
  CRISPR gRNA sequence
agccctgtcccctcttcctt

SEQ ID NO: 722890 - DNA, 20 bp, Artificial
  CRISPR gRNA sequence
tcccctcttccttccccctg

SEQ ID NO: 722891 - DNA, 20 bp, Artificial
  CRISPR gRNA sequence
ttccttccccctgccagctc

SEQ ID NO: 722892 - DNA, 20 bp, Artificial
  CRISPR gRNA sequence
ccttccccctgccagctctg

SEQ ID NO: 722893 - DNA, 20 bp, Artificial
  CRISPR gRNA sequence
cttccccctgccagctctgt

SEQ ID NO: 722894 - DNA, 20 bp, Artificial
  CRISPR gRNA sequence
ccccctgccagctctgtcca

SEQ ID NO: 722895 - DNA, 20 bp, Artificial
  CRISPR gRNA sequence
cccctgccagctctgtccac

SEQ ID NO: 722896 - DNA, 20 bp, Artificial
  CRISPR gRNA sequence
ccagctctgtccaccatcgc

SEQ ID NO: 722897 - DNA, 20 bp, Artificial
  CRISPR gRNA sequence
tgtccaccatcgcaatgcct

SEQ ID NO: 722898 - DNA, 20 bp, Artificial
  CRISPR gRNA sequence
tccaccatcgcaatgcctac

SEQ ID NO: 722899 - DNA, 20 bp, Artificial
  CRISPR gRNA sequence
cccaagagccacgtgctcag

SEQ ID NO: 722900 - DNA, 20 bp, Artificial
  CRISPR gRNA sequence
agcctaaggccaggccctgg

SEQ ID NO: 722901 - DNA, 20 bp, Artificial
  CRISPR gRNA sequence
aggccaggccctggcccgtc

SEQ ID NO: 722902 - DNA, 20 bp, Artificial
  CRISPR gRNA sequence
gcccgtcccctgatctcccc

SEQ ID NO: 722903 - DNA, 20 bp, Artificial
  CRISPR gRNA sequence
atctccccaggacccttgca

SEQ ID NO: 722904 - DNA, 20 bp, Artificial
  CRISPR gRNA sequence
cccaggacccttgcagaggc

SEQ ID NO: 722905 - DNA, 20 bp, Artificial
  CRISPR gRNA sequence
gcagaggcccttgcataggc

SEQ ID NO: 722906 - DNA, 20 bp, Artificial
  CRISPR gRNA sequence
cagaggcccttgcataggct

SEQ ID NO: 722907 - DNA, 20 bp, Artificial
  CRISPR gRNA sequence
gcataggctgactgttgact

SEQ ID NO: 722908 - DNA, 20 bp, Artificial
  CRISPR gRNA sequence
cataggctgactgttgactt

SEQ ID NO: 722909 - DNA, 20 bp, Artificial
  CRISPR gRNA sequence
actgttgacttgggcacaaa

SEQ ID NO: 722910 - DNA, 20 bp, Artificial
  CRISPR gRNA sequence
ttgacttgggcacaaaaaca

SEQ ID NO: 722911 - DNA, 20 bp, Artificial
  CRISPR gRNA sequence
acttgggcacaaaaacacag

SEQ ID NO: 722912 - DNA, 20 bp, Artificial
  CRISPR gRNA sequence
gggcacaaaaacacagtcca

SEQ ID NO: 722913 - DNA, 20 bp, Artificial
  CRISPR gRNA sequence
ggcacaaaaacacagtccac

SEQ ID NO: 722914 - DNA, 20 bp, Artificial
  CRISPR gRNA sequence
aggcatgttttgaatttgac

SEQ ID NO: 722915 - DNA, 20 bp, Artificial
  CRISPR gRNA sequence
tgaatttgacgagtttcaca

SEQ ID NO: 722916 - DNA, 20 bp, Artificial
  CRISPR gRNA sequence
gaatttgacgagtttcacaa

SEQ ID NO: 722917 - DNA, 20 bp, Artificial
  CRISPR gRNA sequence
aatttgacgagtttcacaag

SEQ ID NO: 722918 - DNA, 20 bp, Artificial
  CRISPR gRNA sequence
gacgagtttcacaagcaagc

SEQ ID NO: 722919 - DNA, 20 bp, Artificial
  CRISPR gRNA sequence
acgagtttcacaagcaagca

SEQ ID NO: 722920 - DNA, 20 bp, Artificial
  CRISPR gRNA sequence
cacaagcaagcactgtggtc

SEQ ID NO: 722921 - DNA, 20 bp, Artificial
  CRISPR gRNA sequence
acaagcaagcactgtggtcc

SEQ ID NO: 722922 - DNA, 20 bp, Artificial
  CRISPR gRNA sequence
tggtccctgtgcaagggggg

SEQ ID NO: 722923 - DNA, 20 bp, Artificial
  CRISPR gRNA sequence
tgcaaggggggtttttgtgt

SEQ ID NO: 722924 - DNA, 20 bp, Artificial
  CRISPR gRNA sequence
ttgtgttttgatagtttcaa

SEQ ID NO: 722925 - DNA, 20 bp, Artificial
  CRISPR gRNA sequence
tgtgttttgatagtttcaag

SEQ ID NO: 722926 - DNA, 20 bp, Artificial
  CRISPR gRNA sequence
gtgttttgatagtttcaagc

SEQ ID NO: 722927 - DNA, 20 bp, Artificial
  CRISPR gRNA sequence
tgttttgatagtttcaagcc

SEQ ID NO: 722928 - DNA, 20 bp, Artificial
  CRISPR gRNA sequence
tgatagtttcaagcctgttt

SEQ ID NO: 722929 - DNA, 20 bp, Artificial
  CRISPR gRNA sequence
gatagtttcaagcctgtttc

SEQ ID NO: 722930 - DNA, 20 bp, Artificial
  CRISPR gRNA sequence
atagtttcaagcctgtttcc

SEQ ID NO: 722931 - DNA, 20 bp, Artificial
  CRISPR gRNA sequence
caagcctgtttccatgacct

SEQ ID NO: 722932 - DNA, 20 bp, Artificial
  CRISPR gRNA sequence
aagcctgtttccatgacctg

SEQ ID NO: 722933 - DNA, 20 bp, Artificial
  CRISPR gRNA sequence
tttccatgacctgtcaggct

SEQ ID NO: 722934 - DNA, 20 bp, Artificial
  CRISPR gRNA sequence
ccatgacctgtcaggctgag

SEQ ID NO: 722935 - DNA, 20 bp, Artificial
  CRISPR gRNA sequence
catgacctgtcaggctgagt

SEQ ID NO: 722936 - DNA, 20 bp, Artificial
  CRISPR gRNA sequence
tcaggctgagtgtctcattg

SEQ ID NO: 722937 - DNA, 20 bp, Artificial
  CRISPR gRNA sequence
agtgtctcattgaaaccggc

SEQ ID NO: 722938 - DNA, 20 bp, Artificial
  CRISPR gRNA sequence
attgaaaccggcgtttgctt

SEQ ID NO: 722939 - DNA, 20 bp, Artificial
  CRISPR gRNA sequence
aaaccggcgtttgctttctt

SEQ ID NO: 722940 - DNA, 20 bp, Artificial
  CRISPR gRNA sequence
gctttcttgacatttttcta

SEQ ID NO: 722941 - DNA, 20 bp, Artificial
  CRISPR gRNA sequence
ctttcttgacatttttctag

SEQ ID NO: 722942 - DNA, 20 bp, Artificial
  CRISPR gRNA sequence
tcttgacatttttctagtat

SEQ ID NO: 722943 - DNA, 20 bp, Artificial
  CRISPR gRNA sequence
cttgacatttttctagtatt

SEQ ID NO: 722944 - DNA, 20 bp, Artificial
  CRISPR gRNA sequence
ttgacatttttctagtatta

SEQ ID NO: 722945 - DNA, 20 bp, Artificial
  CRISPR gRNA sequence
gacatttttctagtattaga

SEQ ID NO: 722946 - DNA, 20 bp, Artificial
  CRISPR gRNA sequence
acatttttctagtattagaa

SEQ ID NO: 722947 - DNA, 20 bp, Artificial
  CRISPR gRNA sequence
ttctagtattagaatttcca

SEQ ID NO: 722948 - DNA, 20 bp, Artificial
  CRISPR gRNA sequence
tctagtattagaatttccat

SEQ ID NO: 722949 - DNA, 20 bp, Artificial
  CRISPR gRNA sequence
ctagtattagaatttccatt

SEQ ID NO: 722950 - DNA, 20 bp, Artificial
  CRISPR gRNA sequence
tagtattagaatttccattg

SEQ ID NO: 722951 - DNA, 20 bp, Artificial
  CRISPR gRNA sequence
gtattagaatttccattgcc

SEQ ID NO: 722952 - DNA, 20 bp, Artificial
  CRISPR gRNA sequence
gaatttccattgccgtcagt

SEQ ID NO: 722953 - DNA, 20 bp, Artificial
  CRISPR gRNA sequence
ccattgccgtcagtttattt

SEQ ID NO: 722954 - DNA, 20 bp, Artificial
  CRISPR gRNA sequence
cattgccgtcagtttatttt

SEQ ID NO: 722955 - DNA, 20 bp, Artificial
  CRISPR gRNA sequence
ccgtcagtttattttttttc

SEQ ID NO: 722956 - DNA, 20 bp, Artificial
  CRISPR gRNA sequence
attttttttcttcaaacctc

SEQ ID NO: 722957 - DNA, 20 bp, Artificial
  CRISPR gRNA sequence
ttttttttcttcaaacctct

SEQ ID NO: 722958 - DNA, 20 bp, Artificial
  CRISPR gRNA sequence
tttttcttcaaacctctgtg

SEQ ID NO: 722959 - DNA, 20 bp, Artificial
  CRISPR gRNA sequence
ttttcttcaaacctctgtga

SEQ ID NO: 722960 - DNA, 20 bp, Artificial
  CRISPR gRNA sequence
tttcttcaaacctctgtgag

SEQ ID NO: 722961 - DNA, 20 bp, Artificial
  CRISPR gRNA sequence
ttcttcaaacctctgtgaga

SEQ ID NO: 722962 - DNA, 20 bp, Artificial
  CRISPR gRNA sequence
tcttcaaacctctgtgagag

SEQ ID NO: 722963 - DNA, 20 bp, Artificial
  CRISPR gRNA sequence
cttcaaacctctgtgagagc

SEQ ID NO: 722964 - DNA, 20 bp, Artificial
  CRISPR gRNA sequence
ttcaaacctctgtgagagca

SEQ ID NO: 722965 - DNA, 20 bp, Artificial
  CRISPR gRNA sequence
caaacctctgtgagagcagt

SEQ ID NO: 722966 - DNA, 20 bp, Artificial
  CRISPR gRNA sequence
aaacctctgtgagagcagtt

SEQ ID NO: 722967 - DNA, 20 bp, Artificial
  CRISPR gRNA sequence
tgtgagagcagttttgttac

SEQ ID NO: 722968 - DNA, 20 bp, Artificial
  CRISPR gRNA sequence
tgagagcagttttgttacag

SEQ ID NO: 722969 - DNA, 20 bp, Artificial
  CRISPR gRNA sequence
tgttacagaagaaaaaaaga

SEQ ID NO: 722970 - DNA, 20 bp, Artificial
  CRISPR gRNA sequence
gttacagaagaaaaaaagaa

SEQ ID NO: 722971 - DNA, 20 bp, Artificial
  CRISPR gRNA sequence
ttacagaagaaaaaaagaaa

SEQ ID NO: 722972 - DNA, 20 bp, Artificial
  CRISPR gRNA sequence
cagaagaaaaaaagaaagaa

SEQ ID NO: 722973 - DNA, 20 bp, Artificial
  CRISPR gRNA sequence
cccctaagaagccaggtcta

SEQ ID NO: 722974 - DNA, 20 bp, Artificial
  CRISPR gRNA sequence
ccctaagaagccaggtctac

SEQ ID NO: 722975 - DNA, 20 bp, Artificial
  CRISPR gRNA sequence
agaagccaggtctacaaaga

SEQ ID NO: 722976 - DNA, 20 bp, Artificial
  CRISPR gRNA sequence
caaagaactgagccctgaga

SEQ ID NO: 722977 - DNA, 20 bp, Artificial
  CRISPR gRNA sequence
agccctgagactcaatggtg

SEQ ID NO: 722978 - DNA, 20 bp, Artificial
  CRISPR gRNA sequence
agactcaatggtggacatct

SEQ ID NO: 722979 - DNA, 20 bp, Artificial
  CRISPR gRNA sequence
aatggtggacatcttatctc

SEQ ID NO: 722980 - DNA, 20 bp, Artificial
  CRISPR gRNA sequence
atctcaggtcgtttttgacc

SEQ ID NO: 722981 - DNA, 20 bp, Artificial
  CRISPR gRNA sequence
tctcaggtcgtttttgaccc

SEQ ID NO: 722982 - DNA, 20 bp, Artificial
  CRISPR gRNA sequence
aggtcgtttttgaccctcta

SEQ ID NO: 722983 - DNA, 20 bp, Artificial
  CRISPR gRNA sequence
ttgaccctctagcttctggt

SEQ ID NO: 722984 - DNA, 20 bp, Artificial
  CRISPR gRNA sequence
tgaccctctagcttctggtg

SEQ ID NO: 722985 - DNA, 20 bp, Artificial
  CRISPR gRNA sequence
gaccctctagcttctggtgg

SEQ ID NO: 722986 - DNA, 20 bp, Artificial
  CRISPR gRNA sequence
accctctagcttctggtggg

SEQ ID NO: 722987 - DNA, 20 bp, Artificial
  CRISPR gRNA sequence
tagcttctggtgggaccttg

SEQ ID NO: 722988 - DNA, 20 bp, Artificial
  CRISPR gRNA sequence
gcttctggtgggaccttggg

SEQ ID NO: 722989 - DNA, 20 bp, Artificial
  CRISPR gRNA sequence
ctggtgggaccttggggtct

SEQ ID NO: 722990 - DNA, 20 bp, Artificial
  CRISPR gRNA sequence
tggtgggaccttggggtctg

SEQ ID NO: 722991 - DNA, 20 bp, Artificial
  CRISPR gRNA sequence
gtgggaccttggggtctggg

SEQ ID NO: 722992 - DNA, 20 bp, Artificial
  CRISPR gRNA sequence
ggggtctgggttccgaggct

SEQ ID NO: 722993 - DNA, 20 bp, Artificial
  CRISPR gRNA sequence
gggtctgggttccgaggctc

SEQ ID NO: 722994 - DNA, 20 bp, Artificial
  CRISPR gRNA sequence
ggttccgaggctcaagatgg

SEQ ID NO: 722995 - DNA, 20 bp, Artificial
  CRISPR gRNA sequence
cgaggctcaagatggacaga

SEQ ID NO: 722996 - DNA, 20 bp, Artificial
  CRISPR gRNA sequence
aagatggacagaaagtgaag

SEQ ID NO: 722997 - DNA, 20 bp, Artificial
  CRISPR gRNA sequence
acagagcaccgggtgagaat

SEQ ID NO: 722998 - DNA, 20 bp, Artificial
  CRISPR gRNA sequence
gccggatgcccctttccctc

SEQ ID NO: 722999 - DNA, 20 bp, Artificial
  CRISPR gRNA sequence
tccctcctgagccgtgggtg

SEQ ID NO: 723000 - DNA, 20 bp, Artificial
  CRISPR gRNA sequence
ccctcctgagccgtgggtgg

SEQ ID NO: 723001 - DNA, 20 bp, Artificial
  CRISPR gRNA sequence
cctcctgagccgtgggtggt

SEQ ID NO: 723002 - DNA, 20 bp, Artificial
  CRISPR gRNA sequence
ctgagccgtgggtggtgaag

SEQ ID NO: 723003 - DNA, 20 bp, Artificial
  CRISPR gRNA sequence
agccgtgggtggtgaaggag

SEQ ID NO: 723004 - DNA, 20 bp, Artificial
  CRISPR gRNA sequence
gtttattggcactggtttat

SEQ ID NO: 723005 - DNA, 20 bp, Artificial
  CRISPR gRNA sequence
attggcactggtttattggt

SEQ ID NO: 723006 - DNA, 20 bp, Artificial
  CRISPR gRNA sequence
ttggcactggtttattggtt

SEQ ID NO: 723007 - DNA, 20 bp, Artificial
  CRISPR gRNA sequence
gcactggtttattggttcgt

SEQ ID NO: 723008 - DNA, 20 bp, Artificial
  CRISPR gRNA sequence
gtttattggttcgttcattc

SEQ ID NO: 723009 - DNA, 20 bp, Artificial
  CRISPR gRNA sequence
attggttcgttcattcatct

SEQ ID NO: 723010 - DNA, 20 bp, Artificial
  CRISPR gRNA sequence
ttggttcgttcattcatcta

SEQ ID NO: 723011 - DNA, 20 bp, Artificial
  CRISPR gRNA sequence
gttcgttcattcatctattc

SEQ ID NO: 723012 - DNA, 20 bp, Artificial
  CRISPR gRNA sequence
gttcattcatctattcacat

SEQ ID NO: 723013 - DNA, 20 bp, Artificial
  CRISPR gRNA sequence
attcatctattcacatggtc

SEQ ID NO: 723014 - DNA, 20 bp, Artificial
  CRISPR gRNA sequence
atctattcacatggtcttca

SEQ ID NO: 723015 - DNA, 20 bp, Artificial
  CRISPR gRNA sequence
ttcacatggtcttcacggag

SEQ ID NO: 723016 - DNA, 20 bp, Artificial
  CRISPR gRNA sequence
acatggtcttcacggagcac

SEQ ID NO: 723017 - DNA, 20 bp, Artificial
  CRISPR gRNA sequence
cacggagcacttcctccttg

SEQ ID NO: 723018 - DNA, 20 bp, Artificial
  CRISPR gRNA sequence
acggagcacttcctccttgc

SEQ ID NO: 723019 - DNA, 20 bp, Artificial
  CRISPR gRNA sequence
cctccttgcaggctctgtgc

SEQ ID NO: 723020 - DNA, 20 bp, Artificial
  CRISPR gRNA sequence
ctccttgcaggctctgtgcc

SEQ ID NO: 723021 - DNA, 20 bp, Artificial
  CRISPR gRNA sequence
cttgcaggctctgtgccggg

SEQ ID NO: 723022 - DNA, 20 bp, Artificial
  CRISPR gRNA sequence
gcaggctctgtgccgggccc

SEQ ID NO: 723023 - DNA, 20 bp, Artificial
  CRISPR gRNA sequence
caggctctgtgccgggccca

SEQ ID NO: 723024 - DNA, 20 bp, Artificial
  CRISPR gRNA sequence
tgtgccgggcccagaagctg

SEQ ID NO: 723025 - DNA, 20 bp, Artificial
  CRISPR gRNA sequence
tgccgggcccagaagctgtt

SEQ ID NO: 723026 - DNA, 20 bp, Artificial
  CRISPR gRNA sequence
ttctagctccctccaagctt

SEQ ID NO: 723027 - DNA, 20 bp, Artificial
  CRISPR gRNA sequence
tagctccctccaagctttta

SEQ ID NO: 723028 - DNA, 20 bp, Artificial
  CRISPR gRNA sequence
gctccctccaagcttttaga

SEQ ID NO: 723029 - DNA, 20 bp, Artificial
  CRISPR gRNA sequence
cctccaagcttttagactaa

SEQ ID NO: 723030 - DNA, 20 bp, Artificial
  CRISPR gRNA sequence
caagcttttagactaattcc

SEQ ID NO: 723031 - DNA, 20 bp, Artificial
  CRISPR gRNA sequence
ttagactaattccgactgcc

SEQ ID NO: 723032 - DNA, 20 bp, Artificial
  CRISPR gRNA sequence
tagactaattccgactgccc

SEQ ID NO: 723033 - DNA, 20 bp, Artificial
  CRISPR gRNA sequence
agactaattccgactgcccg

SEQ ID NO: 723034 - DNA, 20 bp, Artificial
  CRISPR gRNA sequence
gactaattccgactgcccgc

SEQ ID NO: 723035 - DNA, 20 bp, Artificial
  CRISPR gRNA sequence
attccgactgcccgcagagg

SEQ ID NO: 723036 - DNA, 20 bp, Artificial
  CRISPR gRNA sequence
cgactgcccgcagaggccaa

SEQ ID NO: 723037 - DNA, 20 bp, Artificial
  CRISPR gRNA sequence
cccgcagaggccaaaggcag

SEQ ID NO: 723038 - DNA, 20 bp, Artificial
  CRISPR gRNA sequence
ggcctcccacatcccagacc

SEQ ID NO: 723039 - DNA, 20 bp, Artificial
  CRISPR gRNA sequence
gcctcccacatcccagacct

SEQ ID NO: 723040 - DNA, 20 bp, Artificial
  CRISPR gRNA sequence
ccacatcccagacctggggc

SEQ ID NO: 723041 - DNA, 20 bp, Artificial
  CRISPR gRNA sequence
gggcagagggtgctcttggt

SEQ ID NO: 723042 - DNA, 20 bp, Artificial
  CRISPR gRNA sequence
ttggttcctttgagcagtga

SEQ ID NO: 723043 - DNA, 20 bp, Artificial
  CRISPR gRNA sequence
ggttcctttgagcagtgagc

SEQ ID NO: 723044 - DNA, 20 bp, Artificial
  CRISPR gRNA sequence
gttcctttgagcagtgagca

SEQ ID NO: 723045 - DNA, 20 bp, Artificial
  CRISPR gRNA sequence
ctttgagcagtgagcacatc

SEQ ID NO: 723046 - DNA, 20 bp, Artificial
  CRISPR gRNA sequence
tgagcagtgagcacatcagg

SEQ ID NO: 723047 - DNA, 20 bp, Artificial
  CRISPR gRNA sequence
gagcagtgagcacatcaggg

SEQ ID NO: 723048 - DNA, 20 bp, Artificial
  CRISPR gRNA sequence
agcagtgagcacatcaggga

SEQ ID NO: 723049 - DNA, 20 bp, Artificial
  CRISPR gRNA sequence
tggtccgtgcaggtgcgatg

SEQ ID NO: 723050 - DNA, 20 bp, Artificial
  CRISPR gRNA sequence
gagtggatcgaccttcccgt

SEQ ID NO: 723051 - DNA, 20 bp, Artificial
  CRISPR gRNA sequence
cccgtgtgtgtcctcggtga

SEQ ID NO: 723052 - DNA, 20 bp, Artificial
  CRISPR gRNA sequence
ccgtgtgtgtcctcggtgac

SEQ ID NO: 723053 - DNA, 20 bp, Artificial
  CRISPR gRNA sequence
ggtgacaggcatttgcaaag

SEQ ID NO: 723054 - DNA, 20 bp, Artificial
  CRISPR gRNA sequence
gcaaagcacacacgtgatct

SEQ ID NO: 723055 - DNA, 20 bp, Artificial
  CRISPR gRNA sequence
caaagcacacacgtgatctc

SEQ ID NO: 723056 - DNA, 20 bp, Artificial
  CRISPR gRNA sequence
atccactcctccggtggcct

SEQ ID NO: 723057 - DNA, 20 bp, Artificial
  CRISPR gRNA sequence
ctccggtggcctgtgaggta

SEQ ID NO: 723058 - DNA, 20 bp, Artificial
  CRISPR gRNA sequence
cggtggcctgtgaggtactt

SEQ ID NO: 723059 - DNA, 20 bp, Artificial
  CRISPR gRNA sequence
tgaggtacttactgttatcc

SEQ ID NO: 723060 - DNA, 20 bp, Artificial
  CRISPR gRNA sequence
actgttatccccgttgcaca

SEQ ID NO: 723061 - DNA, 20 bp, Artificial
  CRISPR gRNA sequence
ctgttatccccgttgcacag

SEQ ID NO: 723062 - DNA, 20 bp, Artificial
  CRISPR gRNA sequence
ttatccccgttgcacagatt

SEQ ID NO: 723063 - DNA, 20 bp, Artificial
  CRISPR gRNA sequence
tccccgttgcacagattagc

SEQ ID NO: 723064 - DNA, 20 bp, Artificial
  CRISPR gRNA sequence
cacagattagcagcctaagg

SEQ ID NO: 723065 - DNA, 20 bp, Artificial
  CRISPR gRNA sequence
gcagcctaaggcacaggatg

SEQ ID NO: 723066 - DNA, 20 bp, Artificial
  CRISPR gRNA sequence
aggcacaggatggtgaagta

SEQ ID NO: 723067 - DNA, 20 bp, Artificial
  CRISPR gRNA sequence
gtttaaggccacgtgctggg

SEQ ID NO: 723068 - DNA, 20 bp, Artificial
  CRISPR gRNA sequence
aaggccacgtgctgggtgag

SEQ ID NO: 723069 - DNA, 20 bp, Artificial
  CRISPR gRNA sequence
aggccacgtgctgggtgagc

SEQ ID NO: 723070 - DNA, 20 bp, Artificial
  CRISPR gRNA sequence
ggtgagccgtaggacgggga

SEQ ID NO: 723071 - DNA, 20 bp, Artificial
  CRISPR gRNA sequence
tatcgtggttgttgagatgt

SEQ ID NO: 723072 - DNA, 20 bp, Artificial
  CRISPR gRNA sequence
atcgtggttgttgagatgtt

SEQ ID NO: 723073 - DNA, 20 bp, Artificial
  CRISPR gRNA sequence
tcgtggttgttgagatgttt

SEQ ID NO: 723074 - DNA, 20 bp, Artificial
  CRISPR gRNA sequence
ttgagatgtttgtaaaaaga

SEQ ID NO: 723075 - DNA, 20 bp, Artificial
  CRISPR gRNA sequence
agatgtttgtaaaaagattt

SEQ ID NO: 723076 - DNA, 20 bp, Artificial
  CRISPR gRNA sequence
gtaaaaagatttttcaccct

SEQ ID NO: 723077 - DNA, 20 bp, Artificial
  CRISPR gRNA sequence
taaaaagatttttcaccctt

SEQ ID NO: 723078 - DNA, 20 bp, Artificial
  CRISPR gRNA sequence
ttcacccttggcaccattga

SEQ ID NO: 723079 - DNA, 20 bp, Artificial
  CRISPR gRNA sequence
tcacccttggcaccattgac

SEQ ID NO: 723080 - DNA, 20 bp, Artificial
  CRISPR gRNA sequence
cacccttggcaccattgaca

SEQ ID NO: 723081 - DNA, 20 bp, Artificial
  CRISPR gRNA sequence
acccttggcaccattgacat

SEQ ID NO: 723082 - DNA, 20 bp, Artificial
  CRISPR gRNA sequence
ggcaccattgacatttggga

SEQ ID NO: 723083 - DNA, 20 bp, Artificial
  CRISPR gRNA sequence
gcaccattgacatttgggaa

SEQ ID NO: 723084 - DNA, 20 bp, Artificial
  CRISPR gRNA sequence
acatttgggaatggatggtt

SEQ ID NO: 723085 - DNA, 20 bp, Artificial
  CRISPR gRNA sequence
gggaatggatggttctttgc

SEQ ID NO: 723086 - DNA, 20 bp, Artificial
  CRISPR gRNA sequence
ggaatggatggttctttgct

SEQ ID NO: 723087 - DNA, 20 bp, Artificial
  CRISPR gRNA sequence
tttgctgtggagcgctatcc

SEQ ID NO: 723088 - DNA, 20 bp, Artificial
  CRISPR gRNA sequence
tgctgtggagcgctatccta

SEQ ID NO: 723089 - DNA, 20 bp, Artificial
  CRISPR gRNA sequence
gctgtggagcgctatcctat

SEQ ID NO: 723090 - DNA, 20 bp, Artificial
  CRISPR gRNA sequence
ctgtggagcgctatcctata

SEQ ID NO: 723091 - DNA, 20 bp, Artificial
  CRISPR gRNA sequence
tggagcgctatcctatagga

SEQ ID NO: 723092 - DNA, 20 bp, Artificial
  CRISPR gRNA sequence
tcctataggacgttgtacag

SEQ ID NO: 723093 - DNA, 20 bp, Artificial
  CRISPR gRNA sequence
taggacgttgtacagcccct

SEQ ID NO: 723094 - DNA, 20 bp, Artificial
  CRISPR gRNA sequence
tacagcccctctagatgcca

SEQ ID NO: 723095 - DNA, 20 bp, Artificial
  CRISPR gRNA sequence
tagatgccagtaaccttccc

SEQ ID NO: 723096 - DNA, 20 bp, Artificial
  CRISPR gRNA sequence
gatgccagtaaccttcccta

SEQ ID NO: 723097 - DNA, 20 bp, Artificial
  CRISPR gRNA sequence
ccctacttgggacaaccaaa

SEQ ID NO: 723098 - DNA, 20 bp, Artificial
  CRISPR gRNA sequence
cctacttgggacaaccaaaa

SEQ ID NO: 723099 - DNA, 20 bp, Artificial
  CRISPR gRNA sequence
cttgggacaaccaaaaatgt

SEQ ID NO: 723100 - DNA, 20 bp, Artificial
  CRISPR gRNA sequence
gggacaaccaaaaatgtctc

SEQ ID NO: 723101 - DNA, 20 bp, Artificial
  CRISPR gRNA sequence
ggacaaccaaaaatgtctct

SEQ ID NO: 723102 - DNA, 20 bp, Artificial
  CRISPR gRNA sequence
tagacattgccatgtggccc

SEQ ID NO: 723103 - DNA, 20 bp, Artificial
  CRISPR gRNA sequence
gacattgccatgtggcccct

SEQ ID NO: 723104 - DNA, 20 bp, Artificial
  CRISPR gRNA sequence
ccatgtggcccctggggaaa

SEQ ID NO: 723105 - DNA, 20 bp, Artificial
  CRISPR gRNA sequence
gggaaaacctcctggttgag

SEQ ID NO: 723106 - DNA, 20 bp, Artificial
  CRISPR gRNA sequence
ctggttgagaaccactggtc

SEQ ID NO: 723107 - DNA, 20 bp, Artificial
  CRISPR gRNA sequence
gttgagaaccactggtctaa

SEQ ID NO: 723108 - DNA, 20 bp, Artificial
  CRISPR gRNA sequence
agaaccactggtctaaaatt

SEQ ID NO: 723109 - DNA, 20 bp, Artificial
  CRISPR gRNA sequence
gtctaaaattcttttttttt

SEQ ID NO: 723110 - DNA, 20 bp, Artificial
  CRISPR gRNA sequence
aaattctttttttttttttt

SEQ ID NO: 723111 - DNA, 20 bp, Artificial
  CRISPR gRNA sequence
tttttttttttttttttttg

SEQ ID NO: 723112 - DNA, 20 bp, Artificial
  CRISPR gRNA sequence
tttttttttttttttttgag

SEQ ID NO: 723113 - DNA, 20 bp, Artificial
  CRISPR gRNA sequence
ttttttttttttttttgaga

SEQ ID NO: 723114 - DNA, 20 bp, Artificial
  CRISPR gRNA sequence
tttttttttttttttgagac

SEQ ID NO: 723115 - DNA, 20 bp, Artificial
  CRISPR gRNA sequence
ttttttttttttttgagaca

SEQ ID NO: 723116 - DNA, 20 bp, Artificial
  CRISPR gRNA sequence
tttttttttttttgagacag

SEQ ID NO: 723117 - DNA, 20 bp, Artificial
  CRISPR gRNA sequence
ttttttttttttgagacaga

SEQ ID NO: 723118 - DNA, 20 bp, Artificial
  CRISPR gRNA sequence
tttttttttttgagacagag

SEQ ID NO: 723119 - DNA, 20 bp, Artificial
  CRISPR gRNA sequence
ttttttttttgagacagagt

SEQ ID NO: 723120 - DNA, 20 bp, Artificial
  CRISPR gRNA sequence
tttttttttgagacagagtc

SEQ ID NO: 723121 - DNA, 20 bp, Artificial
  CRISPR gRNA sequence
ttttttttgagacagagtct

SEQ ID NO: 723122 - DNA, 20 bp, Artificial
  CRISPR gRNA sequence
tttttttgagacagagtctc

SEQ ID NO: 723123 - DNA, 20 bp, Artificial
  CRISPR gRNA sequence
ttttttgagacagagtctcg

SEQ ID NO: 723124 - DNA, 20 bp, Artificial
  CRISPR gRNA sequence
tttttgagacagagtctcgc

SEQ ID NO: 723125 - DNA, 20 bp, Artificial
  CRISPR gRNA sequence
ttttgagacagagtctcgct

SEQ ID NO: 723126 - DNA, 20 bp, Artificial
  CRISPR gRNA sequence
tttgagacagagtctcgctc

SEQ ID NO: 723127 - DNA, 20 bp, Artificial
  CRISPR gRNA sequence
ttgagacagagtctcgctct

SEQ ID NO: 723128 - DNA, 20 bp, Artificial
  CRISPR gRNA sequence
tgagacagagtctcgctctg

SEQ ID NO: 723129 - DNA, 20 bp, Artificial
  CRISPR gRNA sequence
gagacagagtctcgctctgt

SEQ ID NO: 723130 - DNA, 20 bp, Artificial
  CRISPR gRNA sequence
agacagagtctcgctctgtc

SEQ ID NO: 723131 - DNA, 20 bp, Artificial
  CRISPR gRNA sequence
gctctgtcacccaggctgga

SEQ ID NO: 723132 - DNA, 20 bp, Artificial
  CRISPR gRNA sequence
tgtcacccaggctggagtgc

SEQ ID NO: 723133 - DNA, 20 bp, Artificial
  CRISPR gRNA sequence
tcacccaggctggagtgcac

SEQ ID NO: 723134 - DNA, 20 bp, Artificial
  CRISPR gRNA sequence
gagtgcactggtgccatctg

SEQ ID NO: 723135 - DNA, 20 bp, Artificial
  CRISPR gRNA sequence
gtgccatctgggttcactgc

SEQ ID NO: 723136 - DNA, 20 bp, Artificial
  CRISPR gRNA sequence
ggttcactgcaacctccgcc

SEQ ID NO: 723137 - DNA, 20 bp, Artificial
  CRISPR gRNA sequence
actgcaacctccgcctcacg

SEQ ID NO: 723138 - DNA, 20 bp, Artificial
  CRISPR gRNA sequence
caacctccgcctcacgggtt

SEQ ID NO: 723139 - DNA, 20 bp, Artificial
  CRISPR gRNA sequence
cgcctcacgggttcaagtga

SEQ ID NO: 723140 - DNA, 20 bp, Artificial
  CRISPR gRNA sequence
acgggttcaagtgattctcc

SEQ ID NO: 723141 - DNA, 20 bp, Artificial
  CRISPR gRNA sequence
aagtgattctcctgcctcag

SEQ ID NO: 723142 - DNA, 20 bp, Artificial
  CRISPR gRNA sequence
tcctgcctcagcctcctgag

SEQ ID NO: 723143 - DNA, 20 bp, Artificial
  CRISPR gRNA sequence
ctgcctcagcctcctgagta

SEQ ID NO: 723144 - DNA, 20 bp, Artificial
  CRISPR gRNA sequence
cctcagcctcctgagtagct

SEQ ID NO: 723145 - DNA, 20 bp, Artificial
  CRISPR gRNA sequence
agcctcctgagtagctggga

SEQ ID NO: 723146 - DNA, 20 bp, Artificial
  CRISPR gRNA sequence
ctgagtagctgggattacag

SEQ ID NO: 723147 - DNA, 20 bp, Artificial
  CRISPR gRNA sequence
agtagctgggattacaggct

SEQ ID NO: 723148 - DNA, 20 bp, Artificial
  CRISPR gRNA sequence
ggattacaggctcctgccac

SEQ ID NO: 723149 - DNA, 20 bp, Artificial
  CRISPR gRNA sequence
caggctcctgccaccatgcc

SEQ ID NO: 723150 - DNA, 20 bp, Artificial
  CRISPR gRNA sequence
ctgccaccatgcctggctaa

SEQ ID NO: 723151 - DNA, 20 bp, Artificial
  CRISPR gRNA sequence
ccaccatgcctggctaattt

SEQ ID NO: 723152 - DNA, 20 bp, Artificial
  CRISPR gRNA sequence
gctaattttggtatttttag

SEQ ID NO: 723153 - DNA, 20 bp, Artificial
  CRISPR gRNA sequence
attttggtatttttagtaga

SEQ ID NO: 723154 - DNA, 20 bp, Artificial
  CRISPR gRNA sequence
tggtatttttagtagagacg

SEQ ID NO: 723155 - DNA, 20 bp, Artificial
  CRISPR gRNA sequence
ggtatttttagtagagacgg

SEQ ID NO: 723156 - DNA, 20 bp, Artificial
  CRISPR gRNA sequence
gtatttttagtagagacggg

SEQ ID NO: 723157 - DNA, 20 bp, Artificial
  CRISPR gRNA sequence
ttagtagagacggggtttca

SEQ ID NO: 723158 - DNA, 20 bp, Artificial
  CRISPR gRNA sequence
tagtagagacggggtttcac

SEQ ID NO: 723159 - DNA, 20 bp, Artificial
  CRISPR gRNA sequence
agtagagacggggtttcacc

SEQ ID NO: 723160 - DNA, 20 bp, Artificial
  CRISPR gRNA sequence
gtagagacggggtttcaccg

SEQ ID NO: 723161 - DNA, 20 bp, Artificial
  CRISPR gRNA sequence
caccgtgttggccaggctgg

SEQ ID NO: 723162 - DNA, 20 bp, Artificial
  CRISPR gRNA sequence
accgtgttggccaggctggt

SEQ ID NO: 723163 - DNA, 20 bp, Artificial
  CRISPR gRNA sequence
gccaggctggtctcaaactc

SEQ ID NO: 723164 - DNA, 20 bp, Artificial
  CRISPR gRNA sequence
gtctcaaactcctgacctca

SEQ ID NO: 723165 - DNA, 20 bp, Artificial
  CRISPR gRNA sequence
aaactcctgacctcatgatc

SEQ ID NO: 723166 - DNA, 20 bp, Artificial
  CRISPR gRNA sequence
ctgacctcatgatccgcctg

SEQ ID NO: 723167 - DNA, 20 bp, Artificial
  CRISPR gRNA sequence
acctcatgatccgcctgcct

SEQ ID NO: 723168 - DNA, 20 bp, Artificial
  CRISPR gRNA sequence
atgatccgcctgcctcggcc

SEQ ID NO: 723169 - DNA, 20 bp, Artificial
  CRISPR gRNA sequence
cctcggcctcccaaagtgct

SEQ ID NO: 723170 - DNA, 20 bp, Artificial
  CRISPR gRNA sequence
ggcctcccaaagtgctgggt

SEQ ID NO: 723171 - DNA, 20 bp, Artificial
  CRISPR gRNA sequence
ccaaagtgctgggtttgcag

SEQ ID NO: 723172 - DNA, 20 bp, Artificial
  CRISPR gRNA sequence
ggtttgcaggcatgagccac

SEQ ID NO: 723173 - DNA, 20 bp, Artificial
  CRISPR gRNA sequence
gcaggcatgagccaccatgc

SEQ ID NO: 723174 - DNA, 20 bp, Artificial
  CRISPR gRNA sequence
caggcatgagccaccatgcc

SEQ ID NO: 723175 - DNA, 20 bp, Artificial
  CRISPR gRNA sequence
gccttaaaattcttttaatc

SEQ ID NO: 723176 - DNA, 20 bp, Artificial
  CRISPR gRNA sequence
aaaattcttttaatccttca

SEQ ID NO: 723177 - DNA, 20 bp, Artificial
  CRISPR gRNA sequence
aaattcttttaatccttcat

SEQ ID NO: 723178 - DNA, 20 bp, Artificial
  CRISPR gRNA sequence
ttttaatccttcatttttat

SEQ ID NO: 723179 - DNA, 20 bp, Artificial
  CRISPR gRNA sequence
ttaatccttcatttttatga

SEQ ID NO: 723180 - DNA, 20 bp, Artificial
  CRISPR gRNA sequence
taatccttcatttttatgag

SEQ ID NO: 723181 - DNA, 20 bp, Artificial
  CRISPR gRNA sequence
aatccttcatttttatgagc

SEQ ID NO: 723182 - DNA, 20 bp, Artificial
  CRISPR gRNA sequence
atccttcatttttatgagca

SEQ ID NO: 723183 - DNA, 20 bp, Artificial
  CRISPR gRNA sequence
catttttatgagcacttgag

SEQ ID NO: 723184 - DNA, 20 bp, Artificial
  CRISPR gRNA sequence
atttttatgagcacttgagt

SEQ ID NO: 723185 - DNA, 20 bp, Artificial
  CRISPR gRNA sequence
ttatgagcacttgagtcatt

SEQ ID NO: 723186 - DNA, 20 bp, Artificial
  CRISPR gRNA sequence
tatgagcacttgagtcattt

SEQ ID NO: 723187 - DNA, 20 bp, Artificial
  CRISPR gRNA sequence
atgagcacttgagtcatttt

SEQ ID NO: 723188 - DNA, 20 bp, Artificial
  CRISPR gRNA sequence
tgagcacttgagtcattttc

SEQ ID NO: 723189 - DNA, 20 bp, Artificial
  CRISPR gRNA sequence
gagtcattttctattattcc

SEQ ID NO: 723190 - DNA, 20 bp, Artificial
  CRISPR gRNA sequence
agtcattttctattattcca

SEQ ID NO: 723191 - DNA, 20 bp, Artificial
  CRISPR gRNA sequence
tctattattccagggagatt

SEQ ID NO: 723192 - DNA, 20 bp, Artificial
  CRISPR gRNA sequence
ctattattccagggagattt

SEQ ID NO: 723193 - DNA, 20 bp, Artificial
  CRISPR gRNA sequence
tattattccagggagattta

SEQ ID NO: 723194 - DNA, 20 bp, Artificial
  CRISPR gRNA sequence
ttattccagggagatttagg

SEQ ID NO: 723195 - DNA, 20 bp, Artificial
  CRISPR gRNA sequence
ttccagggagatttaggttg

SEQ ID NO: 723196 - DNA, 20 bp, Artificial
  CRISPR gRNA sequence
cagggagatttaggttgaaa

SEQ ID NO: 723197 - DNA, 20 bp, Artificial
  CRISPR gRNA sequence
aggttgaaagaaattctttt

SEQ ID NO: 723198 - DNA, 20 bp, Artificial
  CRISPR gRNA sequence
ggttgaaagaaattcttttt

SEQ ID NO: 723199 - DNA, 20 bp, Artificial
  CRISPR gRNA sequence
aaagaaattctttttttgtt

SEQ ID NO: 723200 - DNA, 20 bp, Artificial
  CRISPR gRNA sequence
tttttttgttttgaaacagt

SEQ ID NO: 723201 - DNA, 20 bp, Artificial
  CRISPR gRNA sequence
tttttgttttgaaacagttt

SEQ ID NO: 723202 - DNA, 20 bp, Artificial
  CRISPR gRNA sequence
ttttgttttgaaacagtttc

SEQ ID NO: 723203 - DNA, 20 bp, Artificial
  CRISPR gRNA sequence
tttgttttgaaacagtttca

SEQ ID NO: 723204 - DNA, 20 bp, Artificial
  CRISPR gRNA sequence
ttgttttgaaacagtttcaa

SEQ ID NO: 723205 - DNA, 20 bp, Artificial
  CRISPR gRNA sequence
tgttttgaaacagtttcaaa

SEQ ID NO: 723206 - DNA, 20 bp, Artificial
  CRISPR gRNA sequence
gttttgaaacagtttcaaac

SEQ ID NO: 723207 - DNA, 20 bp, Artificial
  CRISPR gRNA sequence
ttttgaaacagtttcaaact

SEQ ID NO: 723208 - DNA, 20 bp, Artificial
  CRISPR gRNA sequence
tgaaacagtttcaaacttat

SEQ ID NO: 723209 - DNA, 20 bp, Artificial
  CRISPR gRNA sequence
gaaacagtttcaaacttata

SEQ ID NO: 723210 - DNA, 20 bp, Artificial
  CRISPR gRNA sequence
aaacagtttcaaacttatag

SEQ ID NO: 723211 - DNA, 20 bp, Artificial
  CRISPR gRNA sequence
caaacttatagaaatggtat

SEQ ID NO: 723212 - DNA, 20 bp, Artificial
  CRISPR gRNA sequence
aaacttatagaaatggtata

SEQ ID NO: 723213 - DNA, 20 bp, Artificial
  CRISPR gRNA sequence
atagaaatggtataagtatg

SEQ ID NO: 723214 - DNA, 20 bp, Artificial
  CRISPR gRNA sequence
tagaaatggtataagtatga

SEQ ID NO: 723215 - DNA, 20 bp, Artificial
  CRISPR gRNA sequence
attttgacctgaaccatttg

SEQ ID NO: 723216 - DNA, 20 bp, Artificial
  CRISPR gRNA sequence
tgacctgaaccatttgagag

SEQ ID NO: 723217 - DNA, 20 bp, Artificial
  CRISPR gRNA sequence
gacctgaaccatttgagagt

SEQ ID NO: 723218 - DNA, 20 bp, Artificial
  CRISPR gRNA sequence
acctgaaccatttgagagta

SEQ ID NO: 723219 - DNA, 20 bp, Artificial
  CRISPR gRNA sequence
aaccatttgagagtaactga

SEQ ID NO: 723220 - DNA, 20 bp, Artificial
  CRISPR gRNA sequence
gagagtaactgactgactgg

SEQ ID NO: 723221 - DNA, 20 bp, Artificial
  CRISPR gRNA sequence
agagtaactgactgactgga

SEQ ID NO: 723222 - DNA, 20 bp, Artificial
  CRISPR gRNA sequence
actgactggatgtctctcac

SEQ ID NO: 723223 - DNA, 20 bp, Artificial
  CRISPR gRNA sequence
actggatgtctctcaccccg

SEQ ID NO: 723224 - DNA, 20 bp, Artificial
  CRISPR gRNA sequence
gatgtctctcaccccgaaaa

SEQ ID NO: 723225 - DNA, 20 bp, Artificial
  CRISPR gRNA sequence
tcaccccgaaaacttcagtg

SEQ ID NO: 723226 - DNA, 20 bp, Artificial
  CRISPR gRNA sequence
accccgaaaacttcagtgtg

SEQ ID NO: 723227 - DNA, 20 bp, Artificial
  CRISPR gRNA sequence
cagtgtgtgtttcagacaga

SEQ ID NO: 723228 - DNA, 20 bp, Artificial
  CRISPR gRNA sequence
agtgtgtgtttcagacagac

SEQ ID NO: 723229 - DNA, 20 bp, Artificial
  CRISPR gRNA sequence
cagacagacaagggtgtatt

SEQ ID NO: 723230 - DNA, 20 bp, Artificial
  CRISPR gRNA sequence
agacagacaagggtgtattt

SEQ ID NO: 723231 - DNA, 20 bp, Artificial
  CRISPR gRNA sequence
tacacgatgtggtaaggatc

SEQ ID NO: 723232 - DNA, 20 bp, Artificial
  CRISPR gRNA sequence
acacgatgtggtaaggatcg

SEQ ID NO: 723233 - DNA, 20 bp, Artificial
  CRISPR gRNA sequence
cacgatgtggtaaggatcgt

SEQ ID NO: 723234 - DNA, 20 bp, Artificial
  CRISPR gRNA sequence
gaattcacactgatacatga

SEQ ID NO: 723235 - DNA, 20 bp, Artificial
  CRISPR gRNA sequence
acactgatacatgacccaca

SEQ ID NO: 723236 - DNA, 20 bp, Artificial
  CRISPR gRNA sequence
atacatgacccacaatgaat

SEQ ID NO: 723237 - DNA, 20 bp, Artificial
  CRISPR gRNA sequence
tcaggccctgttgaagtttc

SEQ ID NO: 723238 - DNA, 20 bp, Artificial
  CRISPR gRNA sequence
aggccctgttgaagtttctt

SEQ ID NO: 723239 - DNA, 20 bp, Artificial
  CRISPR gRNA sequence
ttgaagtttctttatttgtc

SEQ ID NO: 723240 - DNA, 20 bp, Artificial
  CRISPR gRNA sequence
aagtttctttatttgtccca

SEQ ID NO: 723241 - DNA, 20 bp, Artificial
  CRISPR gRNA sequence
ctttatttgtcccaataatg

SEQ ID NO: 723242 - DNA, 20 bp, Artificial
  CRISPR gRNA sequence
tttatttgtcccaataatgt

SEQ ID NO: 723243 - DNA, 20 bp, Artificial
  CRISPR gRNA sequence
tatttgtcccaataatgtcc

SEQ ID NO: 723244 - DNA, 20 bp, Artificial
  CRISPR gRNA sequence
atttgtcccaataatgtcct

SEQ ID NO: 723245 - DNA, 20 bp, Artificial
  CRISPR gRNA sequence
tttgtcccaataatgtcctt

SEQ ID NO: 723246 - DNA, 20 bp, Artificial
  CRISPR gRNA sequence
gtcccaataatgtcctttat

SEQ ID NO: 723247 - DNA, 20 bp, Artificial
  CRISPR gRNA sequence
tcccaataatgtcctttata

SEQ ID NO: 723248 - DNA, 20 bp, Artificial
  CRISPR gRNA sequence
tatagcagaggactccagct

SEQ ID NO: 723249 - DNA, 20 bp, Artificial
  CRISPR gRNA sequence
atagcagaggactccagctc

SEQ ID NO: 723250 - DNA, 20 bp, Artificial
  CRISPR gRNA sequence
tagcagaggactccagctca

SEQ ID NO: 723251 - DNA, 20 bp, Artificial
  CRISPR gRNA sequence
cagctcagggccacgtgtta

SEQ ID NO: 723252 - DNA, 20 bp, Artificial
  CRISPR gRNA sequence
agggccacgtgttacatttg

SEQ ID NO: 723253 - DNA, 20 bp, Artificial
  CRISPR gRNA sequence
catttgcttgtctggtttct

SEQ ID NO: 723254 - DNA, 20 bp, Artificial
  CRISPR gRNA sequence
gcttgtctggtttctcgagt

SEQ ID NO: 723255 - DNA, 20 bp, Artificial
  CRISPR gRNA sequence
cttgtctggtttctcgagtc

SEQ ID NO: 723256 - DNA, 20 bp, Artificial
  CRISPR gRNA sequence
gtctggtttctcgagtctcc

SEQ ID NO: 723257 - DNA, 20 bp, Artificial
  CRISPR gRNA sequence
tctggtttctcgagtctcct

SEQ ID NO: 723258 - DNA, 20 bp, Artificial
  CRISPR gRNA sequence
gtttctcgagtctccttctg

SEQ ID NO: 723259 - DNA, 20 bp, Artificial
  CRISPR gRNA sequence
ctcgagtctccttctgtccg

SEQ ID NO: 723260 - DNA, 20 bp, Artificial
  CRISPR gRNA sequence
tcgagtctccttctgtccgg

SEQ ID NO: 723261 - DNA, 20 bp, Artificial
  CRISPR gRNA sequence
gagtctccttctgtccggat

SEQ ID NO: 723262 - DNA, 20 bp, Artificial
  CRISPR gRNA sequence
cttctgtccggatccgttcc

SEQ ID NO: 723263 - DNA, 20 bp, Artificial
  CRISPR gRNA sequence
ctgtccggatccgttcccca

SEQ ID NO: 723264 - DNA, 20 bp, Artificial
  CRISPR gRNA sequence
tgtccggatccgttccccag

SEQ ID NO: 723265 - DNA, 20 bp, Artificial
  CRISPR gRNA sequence
tccggatccgttccccaggc

SEQ ID NO: 723266 - DNA, 20 bp, Artificial
  CRISPR gRNA sequence
cccaggcgtttctttcactt

SEQ ID NO: 723267 - DNA, 20 bp, Artificial
  CRISPR gRNA sequence
ctttcacttactgggaagag

SEQ ID NO: 723268 - DNA, 20 bp, Artificial
  CRISPR gRNA sequence
tttcacttactgggaagagc

SEQ ID NO: 723269 - DNA, 20 bp, Artificial
  CRISPR gRNA sequence
tcacttactgggaagagcgc

SEQ ID NO: 723270 - DNA, 20 bp, Artificial
  CRISPR gRNA sequence
cacttactgggaagagcgca

SEQ ID NO: 723271 - DNA, 20 bp, Artificial
  CRISPR gRNA sequence
acttactgggaagagcgcag

SEQ ID NO: 723272 - DNA, 20 bp, Artificial
  CRISPR gRNA sequence
actgggaagagcgcaggctg

SEQ ID NO: 723273 - DNA, 20 bp, Artificial
  CRISPR gRNA sequence
ctgggaagagcgcaggctgg

SEQ ID NO: 723274 - DNA, 20 bp, Artificial
  CRISPR gRNA sequence
ggaagagcgcaggctggtga

SEQ ID NO: 723275 - DNA, 20 bp, Artificial
  CRISPR gRNA sequence
gtgatttcatggatgctcct

SEQ ID NO: 723276 - DNA, 20 bp, Artificial
  CRISPR gRNA sequence
catggatgctccttgctttg

SEQ ID NO: 723277 - DNA, 20 bp, Artificial
  CRISPR gRNA sequence
atggatgctccttgctttgg

SEQ ID NO: 723278 - DNA, 20 bp, Artificial
  CRISPR gRNA sequence
cttgctttgggtttgtctgg

SEQ ID NO: 723279 - DNA, 20 bp, Artificial
  CRISPR gRNA sequence
gctttgggtttgtctggtgt

SEQ ID NO: 723280 - DNA, 20 bp, Artificial
  CRISPR gRNA sequence
ctttgggtttgtctggtgtt

SEQ ID NO: 723281 - DNA, 20 bp, Artificial
  CRISPR gRNA sequence
tgggtttgtctggtgttttc

SEQ ID NO: 723282 - DNA, 20 bp, Artificial
  CRISPR gRNA sequence
gggtttgtctggtgttttct

SEQ ID NO: 723283 - DNA, 20 bp, Artificial
  CRISPR gRNA sequence
ggtttgtctggtgttttctc

SEQ ID NO: 723284 - DNA, 20 bp, Artificial
  CRISPR gRNA sequence
gtctggtgttttctcccgag

SEQ ID NO: 723285 - DNA, 20 bp, Artificial
  CRISPR gRNA sequence
tctggtgttttctcccgagt

SEQ ID NO: 723286 - DNA, 20 bp, Artificial
  CRISPR gRNA sequence
gtgttttctcccgagtggat

SEQ ID NO: 723287 - DNA, 20 bp, Artificial
  CRISPR gRNA sequence
tctcccgagtggattcaggt

SEQ ID NO: 723288 - DNA, 20 bp, Artificial
  CRISPR gRNA sequence
ctcccgagtggattcaggtc

SEQ ID NO: 723289 - DNA, 20 bp, Artificial
  CRISPR gRNA sequence
tcccgagtggattcaggtca

SEQ ID NO: 723290 - DNA, 20 bp, Artificial
  CRISPR gRNA sequence
ccgagtggattcaggtcatg

SEQ ID NO: 723291 - DNA, 20 bp, Artificial
  CRISPR gRNA sequence
aggtcatgcatcttgggctg

SEQ ID NO: 723292 - DNA, 20 bp, Artificial
  CRISPR gRNA sequence
gggctggaaggtcccaggaa

SEQ ID NO: 723293 - DNA, 20 bp, Artificial
  CRISPR gRNA sequence
ggctggaaggtcccaggaat

SEQ ID NO: 723294 - DNA, 20 bp, Artificial
  CRISPR gRNA sequence
gaaggtcccaggaatgatgc

SEQ ID NO: 723295 - DNA, 20 bp, Artificial
  CRISPR gRNA sequence
gcctcttctctctcagggcg

SEQ ID NO: 723296 - DNA, 20 bp, Artificial
  CRISPR gRNA sequence
ttctctctcagggcgtcctg

SEQ ID NO: 723297 - DNA, 20 bp, Artificial
  CRISPR gRNA sequence
ctctctcagggcgtcctgcc

SEQ ID NO: 723298 - DNA, 20 bp, Artificial
  CRISPR gRNA sequence
tctctcagggcgtcctgcca

SEQ ID NO: 723299 - DNA, 20 bp, Artificial
  CRISPR gRNA sequence
tctcagggcgtcctgccagg

SEQ ID NO: 723300 - DNA, 20 bp, Artificial
  CRISPR gRNA sequence
tcagggcgtcctgccaggtt

SEQ ID NO: 723301 - DNA, 20 bp, Artificial
  CRISPR gRNA sequence
agggcgtcctgccaggtttc

SEQ ID NO: 723302 - DNA, 20 bp, Artificial
  CRISPR gRNA sequence
ccaggtttcgatgtctccct

SEQ ID NO: 723303 - DNA, 20 bp, Artificial
  CRISPR gRNA sequence
cgatgtctccctttcctggt

SEQ ID NO: 723304 - DNA, 20 bp, Artificial
  CRISPR gRNA sequence
gatgtctccctttcctggtg

SEQ ID NO: 723305 - DNA, 20 bp, Artificial
  CRISPR gRNA sequence
cctttcctggtgctgtgtac

SEQ ID NO: 723306 - DNA, 20 bp, Artificial
  CRISPR gRNA sequence
tcctggtgctgtgtactttg

SEQ ID NO: 723307 - DNA, 20 bp, Artificial
  CRISPR gRNA sequence
cctggtgctgtgtactttga

SEQ ID NO: 723308 - DNA, 20 bp, Artificial
  CRISPR gRNA sequence
ctggtgctgtgtactttgag

SEQ ID NO: 723309 - DNA, 20 bp, Artificial
  CRISPR gRNA sequence
gtgctgtgtactttgagcgc

SEQ ID NO: 723310 - DNA, 20 bp, Artificial
  CRISPR gRNA sequence
tgtactttgagcgctcgacg

SEQ ID NO: 723311 - DNA, 20 bp, Artificial
  CRISPR gRNA sequence
tgagcgctcgacggaggtga

SEQ ID NO: 723312 - DNA, 20 bp, Artificial
  CRISPR gRNA sequence
gagcgctcgacggaggtgat

SEQ ID NO: 723313 - DNA, 20 bp, Artificial
  CRISPR gRNA sequence
agcgctcgacggaggtgatg

SEQ ID NO: 723314 - DNA, 20 bp, Artificial
  CRISPR gRNA sequence
gacggaggtgatgtcctgcc

SEQ ID NO: 723315 - DNA, 20 bp, Artificial
  CRISPR gRNA sequence
ccgggcctctccactgtgac

SEQ ID NO: 723316 - DNA, 20 bp, Artificial
  CRISPR gRNA sequence
tccactgtgacgtctccatt

SEQ ID NO: 723317 - DNA, 20 bp, Artificial
  CRISPR gRNA sequence
cactgtgacgtctccatttg

SEQ ID NO: 723318 - DNA, 20 bp, Artificial
  CRISPR gRNA sequence
tgacgtctccatttgctcct

SEQ ID NO: 723319 - DNA, 20 bp, Artificial
  CRISPR gRNA sequence
catttgctcctcggtcatta

SEQ ID NO: 723320 - DNA, 20 bp, Artificial
  CRISPR gRNA sequence
gctcctcggtcattactaag

SEQ ID NO: 723321 - DNA, 20 bp, Artificial
  CRISPR gRNA sequence
ctcctcggtcattactaagt

SEQ ID NO: 723322 - DNA, 20 bp, Artificial
  CRISPR gRNA sequence
ctcggtcattactaagtctt

SEQ ID NO: 723323 - DNA, 20 bp, Artificial
  CRISPR gRNA sequence
ggtcattactaagtctttag

SEQ ID NO: 723324 - DNA, 20 bp, Artificial
  CRISPR gRNA sequence
ctaagtctttaggggcgtta

SEQ ID NO: 723325 - DNA, 20 bp, Artificial
  CRISPR gRNA sequence
agtctttaggggcgttactt

SEQ ID NO: 723326 - DNA, 20 bp, Artificial
  CRISPR gRNA sequence
taggggcgttacttgagact

SEQ ID NO: 723327 - DNA, 20 bp, Artificial
  CRISPR gRNA sequence
aggggcgttacttgagacta

SEQ ID NO: 723328 - DNA, 20 bp, Artificial
  CRISPR gRNA sequence
ggggcgttacttgagactat

SEQ ID NO: 723329 - DNA, 20 bp, Artificial
  CRISPR gRNA sequence
cttgagactatgtcaatagc

SEQ ID NO: 723330 - DNA, 20 bp, Artificial
  CRISPR gRNA sequence
gagactatgtcaatagccca

SEQ ID NO: 723331 - DNA, 20 bp, Artificial
  CRISPR gRNA sequence
agactatgtcaatagcccat

SEQ ID NO: 723332 - DNA, 20 bp, Artificial
  CRISPR gRNA sequence
tgtcaatagcccattcttca

SEQ ID NO: 723333 - DNA, 20 bp, Artificial
  CRISPR gRNA sequence
ttcagcagaccttcattttc

SEQ ID NO: 723334 - DNA, 20 bp, Artificial
  CRISPR gRNA sequence
cagcagaccttcattttctc

SEQ ID NO: 723335 - DNA, 20 bp, Artificial
  CRISPR gRNA sequence
agcagaccttcattttctct

SEQ ID NO: 723336 - DNA, 20 bp, Artificial
  CRISPR gRNA sequence
cattttctctatttatttgt

SEQ ID NO: 723337 - DNA, 20 bp, Artificial
  CRISPR gRNA sequence
attttctctatttatttgtt

SEQ ID NO: 723338 - DNA, 20 bp, Artificial
  CRISPR gRNA sequence
tctctatttatttgtttatt

SEQ ID NO: 723339 - DNA, 20 bp, Artificial
  CRISPR gRNA sequence
ctctatttatttgtttattt

SEQ ID NO: 723340 - DNA, 20 bp, Artificial
  CRISPR gRNA sequence
tctatttatttgtttatttt

SEQ ID NO: 723341 - DNA, 20 bp, Artificial
  CRISPR gRNA sequence
tatttatttgtttatttttt

SEQ ID NO: 723342 - DNA, 20 bp, Artificial
  CRISPR gRNA sequence
tttatttgtttatttttttg

SEQ ID NO: 723343 - DNA, 20 bp, Artificial
  CRISPR gRNA sequence
atttgtttatttttttgaga

SEQ ID NO: 723344 - DNA, 20 bp, Artificial
  CRISPR gRNA sequence
tttgtttatttttttgagac

SEQ ID NO: 723345 - DNA, 20 bp, Artificial
  CRISPR gRNA sequence
gtttatttttttgagacagg

SEQ ID NO: 723346 - DNA, 20 bp, Artificial
  CRISPR gRNA sequence
tttatttttttgagacaggg

SEQ ID NO: 723347 - DNA, 20 bp, Artificial
  CRISPR gRNA sequence
atttttttgagacagggtct

SEQ ID NO: 723348 - DNA, 20 bp, Artificial
  CRISPR gRNA sequence
tttttttgagacagggtctg

SEQ ID NO: 723349 - DNA, 20 bp, Artificial
  CRISPR gRNA sequence
ttttgagacagggtctggct

SEQ ID NO: 723350 - DNA, 20 bp, Artificial
  CRISPR gRNA sequence
tttgagacagggtctggctc

SEQ ID NO: 723351 - DNA, 20 bp, Artificial
  CRISPR gRNA sequence
ttgagacagggtctggctct

SEQ ID NO: 723352 - DNA, 20 bp, Artificial
  CRISPR gRNA sequence
tgagacagggtctggctctg

SEQ ID NO: 723353 - DNA, 20 bp, Artificial
  CRISPR gRNA sequence
gagacagggtctggctctgt

SEQ ID NO: 723354 - DNA, 20 bp, Artificial
  CRISPR gRNA sequence
agacagggtctggctctgtc

SEQ ID NO: 723355 - DNA, 20 bp, Artificial
  CRISPR gRNA sequence
gctctgtcacccaggctgga

SEQ ID NO: 723356 - DNA, 20 bp, Artificial
  CRISPR gRNA sequence
tgtcacccaggctggagtgc

SEQ ID NO: 723357 - DNA, 20 bp, Artificial
  CRISPR gRNA sequence
tcacccaggctggagtgcag

SEQ ID NO: 723358 - DNA, 20 bp, Artificial
  CRISPR gRNA sequence
gagtgcagtagtgtgatctc

SEQ ID NO: 723359 - DNA, 20 bp, Artificial
  CRISPR gRNA sequence
ggcttactgcaacccccgcc

SEQ ID NO: 723360 - DNA, 20 bp, Artificial
  CRISPR gRNA sequence
actgcaacccccgcctcctg

SEQ ID NO: 723361 - DNA, 20 bp, Artificial
  CRISPR gRNA sequence
ctgcaacccccgcctcctgg

SEQ ID NO: 723362 - DNA, 20 bp, Artificial
  CRISPR gRNA sequence
caacccccgcctcctgggtt

SEQ ID NO: 723363 - DNA, 20 bp, Artificial
  CRISPR gRNA sequence
ctgggttcaagcaattctcc

SEQ ID NO: 723364 - DNA, 20 bp, Artificial
  CRISPR gRNA sequence
ggttcaagcaattctcctgc

SEQ ID NO: 723365 - DNA, 20 bp, Artificial
  CRISPR gRNA sequence
aagcaattctcctgcttcag

SEQ ID NO: 723366 - DNA, 20 bp, Artificial
  CRISPR gRNA sequence
tcctgcttcagcctcccaag

SEQ ID NO: 723367 - DNA, 20 bp, Artificial
  CRISPR gRNA sequence
ctgcttcagcctcccaagtg

SEQ ID NO: 723368 - DNA, 20 bp, Artificial
  CRISPR gRNA sequence
cttcagcctcccaagtggct

SEQ ID NO: 723369 - DNA, 20 bp, Artificial
  CRISPR gRNA sequence
cagcctcccaagtggctggg

SEQ ID NO: 723370 - DNA, 20 bp, Artificial
  CRISPR gRNA sequence
agcctcccaagtggctggga

SEQ ID NO: 723371 - DNA, 20 bp, Artificial
  CRISPR gRNA sequence
ccaagtggctgggattacag

SEQ ID NO: 723372 - DNA, 20 bp, Artificial
  CRISPR gRNA sequence
ggattacaggcgtgtgccac

SEQ ID NO: 723373 - DNA, 20 bp, Artificial
  CRISPR gRNA sequence
caggcgtgtgccacacaatg

SEQ ID NO: 723374 - DNA, 20 bp, Artificial
  CRISPR gRNA sequence
gctcattttttgtattttca

SEQ ID NO: 723375 - DNA, 20 bp, Artificial
  CRISPR gRNA sequence
attttttgtattttcagtag

SEQ ID NO: 723376 - DNA, 20 bp, Artificial
  CRISPR gRNA sequence
tttgtattttcagtagagac

SEQ ID NO: 723377 - DNA, 20 bp, Artificial
  CRISPR gRNA sequence
ttgtattttcagtagagaca

SEQ ID NO: 723378 - DNA, 20 bp, Artificial
  CRISPR gRNA sequence
tgtattttcagtagagacag

SEQ ID NO: 723379 - DNA, 20 bp, Artificial
  CRISPR gRNA sequence
gtattttcagtagagacaga

SEQ ID NO: 723380 - DNA, 20 bp, Artificial
  CRISPR gRNA sequence
tattttcagtagagacagag

SEQ ID NO: 723381 - DNA, 20 bp, Artificial
  CRISPR gRNA sequence
tcagtagagacagagtttca

SEQ ID NO: 723382 - DNA, 20 bp, Artificial
  CRISPR gRNA sequence
cagtagagacagagtttcac

SEQ ID NO: 723383 - DNA, 20 bp, Artificial
  CRISPR gRNA sequence
agtagagacagagtttcacc

SEQ ID NO: 723384 - DNA, 20 bp, Artificial
  CRISPR gRNA sequence
caccatgttggccaggctgg

SEQ ID NO: 723385 - DNA, 20 bp, Artificial
  CRISPR gRNA sequence
accatgttggccaggctggt

SEQ ID NO: 723386 - DNA, 20 bp, Artificial
  CRISPR gRNA sequence
gccaggctggtctcgaactc

SEQ ID NO: 723387 - DNA, 20 bp, Artificial
  CRISPR gRNA sequence
gtctcgaactcctggcctca

SEQ ID NO: 723388 - DNA, 20 bp, Artificial
  CRISPR gRNA sequence
gaactcctggcctcaagtgg

SEQ ID NO: 723389 - DNA, 20 bp, Artificial
  CRISPR gRNA sequence
ctggcctcaagtggtcctcc

SEQ ID NO: 723390 - DNA, 20 bp, Artificial
  CRISPR gRNA sequence
gcctcaagtggtcctcccgc

SEQ ID NO: 723391 - DNA, 20 bp, Artificial
  CRISPR gRNA sequence
aagtggtcctcccgcctcgg

SEQ ID NO: 723392 - DNA, 20 bp, Artificial
  CRISPR gRNA sequence
ccgcctcggcctcccaaagt

SEQ ID NO: 723393 - DNA, 20 bp, Artificial
  CRISPR gRNA sequence
ggcctcccaaagttcaggga

SEQ ID NO: 723394 - DNA, 20 bp, Artificial
  CRISPR gRNA sequence
ccaaagttcagggatgacag

SEQ ID NO: 723395 - DNA, 20 bp, Artificial
  CRISPR gRNA sequence
agggatgacaggcgtgagct

SEQ ID NO: 723396 - DNA, 20 bp, Artificial
  CRISPR gRNA sequence
ccaccgcgcccagcccagaa

SEQ ID NO: 723397 - DNA, 20 bp, Artificial
  CRISPR gRNA sequence
aattttcttcacttacatat

SEQ ID NO: 723398 - DNA, 20 bp, Artificial
  CRISPR gRNA sequence
attttcttcacttacatatt

SEQ ID NO: 723399 - DNA, 20 bp, Artificial
  CRISPR gRNA sequence
tcttcacttacatatttata

SEQ ID NO: 723400 - DNA, 20 bp, Artificial
  CRISPR gRNA sequence
cttcacttacatatttatat

SEQ ID NO: 723401 - DNA, 20 bp, Artificial
  CRISPR gRNA sequence
ttcacttacatatttatatc

SEQ ID NO: 723402 - DNA, 20 bp, Artificial
  CRISPR gRNA sequence
cacttacatatttatatctg

SEQ ID NO: 723403 - DNA, 20 bp, Artificial
  CRISPR gRNA sequence
acttacatatttatatctgt

SEQ ID NO: 723404 - DNA, 20 bp, Artificial
  CRISPR gRNA sequence
acatatttatatctgtatgg

SEQ ID NO: 723405 - DNA, 20 bp, Artificial
  CRISPR gRNA sequence
catatttatatctgtatgga

SEQ ID NO: 723406 - DNA, 20 bp, Artificial
  CRISPR gRNA sequence
atatctgtatggattcatgg

SEQ ID NO: 723407 - DNA, 20 bp, Artificial
  CRISPR gRNA sequence
tatctgtatggattcatggg

SEQ ID NO: 723408 - DNA, 20 bp, Artificial
  CRISPR gRNA sequence
tatggattcatggggccctg

SEQ ID NO: 723409 - DNA, 20 bp, Artificial
  CRISPR gRNA sequence
atggggccctgttctgttca

SEQ ID NO: 723410 - DNA, 20 bp, Artificial
  CRISPR gRNA sequence
ttctgttcaatgggttgtaa

SEQ ID NO: 723411 - DNA, 20 bp, Artificial
  CRISPR gRNA sequence
tgttcaatgggttgtaatct

SEQ ID NO: 723412 - DNA, 20 bp, Artificial
  CRISPR gRNA sequence
ttcaatgggttgtaatctct

SEQ ID NO: 723413 - DNA, 20 bp, Artificial
  CRISPR gRNA sequence
aatgggttgtaatctcttac

SEQ ID NO: 723414 - DNA, 20 bp, Artificial
  CRISPR gRNA sequence
taatctcttaccatcatttt

SEQ ID NO: 723415 - DNA, 20 bp, Artificial
  CRISPR gRNA sequence
ttaccatcattttttatttt

SEQ ID NO: 723416 - DNA, 20 bp, Artificial
  CRISPR gRNA sequence
accatcattttttattttgg

SEQ ID NO: 723417 - DNA, 20 bp, Artificial
  CRISPR gRNA sequence
ccatcattttttattttggt

SEQ ID NO: 723418 - DNA, 20 bp, Artificial
  CRISPR gRNA sequence
tttattttggtgctcaaatg

SEQ ID NO: 723419 - DNA, 20 bp, Artificial
  CRISPR gRNA sequence
ttattttggtgctcaaatgg

SEQ ID NO: 723420 - DNA, 20 bp, Artificial
  CRISPR gRNA sequence
tattttggtgctcaaatggt

SEQ ID NO: 723421 - DNA, 20 bp, Artificial
  CRISPR gRNA sequence
attttggtgctcaaatggtc

SEQ ID NO: 723422 - DNA, 20 bp, Artificial
  CRISPR gRNA sequence
ttttggtgctcaaatggtcc

SEQ ID NO: 723423 - DNA, 20 bp, Artificial
  CRISPR gRNA sequence
tggtgctcaaatggtcccag

SEQ ID NO: 723424 - DNA, 20 bp, Artificial
  CRISPR gRNA sequence
ggtgctcaaatggtcccaga

SEQ ID NO: 723425 - DNA, 20 bp, Artificial
  CRISPR gRNA sequence
gtgctcaaatggtcccagat

SEQ ID NO: 723426 - DNA, 20 bp, Artificial
  CRISPR gRNA sequence
aaatggtcccagatgaggtc

SEQ ID NO: 723427 - DNA, 20 bp, Artificial
  CRISPR gRNA sequence
taagctggctcttgtgtgct

SEQ ID NO: 723428 - DNA, 20 bp, Artificial
  CRISPR gRNA sequence
aagctggctcttgtgtgctt

SEQ ID NO: 723429 - DNA, 20 bp, Artificial
  CRISPR gRNA sequence
agctggctcttgtgtgcttt

SEQ ID NO: 723430 - DNA, 20 bp, Artificial
  CRISPR gRNA sequence
gctcttgtgtgctttggtgt

SEQ ID NO: 723431 - DNA, 20 bp, Artificial
  CRISPR gRNA sequence
ttgtgtgctttggtgtatcc

SEQ ID NO: 723432 - DNA, 20 bp, Artificial
  CRISPR gRNA sequence
gtgtgctttggtgtatcctc

SEQ ID NO: 723433 - DNA, 20 bp, Artificial
  CRISPR gRNA sequence
tgtgctttggtgtatcctca

SEQ ID NO: 723434 - DNA, 20 bp, Artificial
  CRISPR gRNA sequence
tggtgtatcctcatcctgtg

SEQ ID NO: 723435 - DNA, 20 bp, Artificial
  CRISPR gRNA sequence
ggtgtatcctcatcctgtgc

SEQ ID NO: 723436 - DNA, 20 bp, Artificial
  CRISPR gRNA sequence
gtgtatcctcatcctgtgct

SEQ ID NO: 723437 - DNA, 20 bp, Artificial
  CRISPR gRNA sequence
atcctgtgctttgagcacgt

SEQ ID NO: 723438 - DNA, 20 bp, Artificial
  CRISPR gRNA sequence
tgctttgagcacgtccctta

SEQ ID NO: 723439 - DNA, 20 bp, Artificial
  CRISPR gRNA sequence
tgagcacgtcccttattctg

SEQ ID NO: 723440 - DNA, 20 bp, Artificial
  CRISPR gRNA sequence
gagcacgtcccttattctga

SEQ ID NO: 723441 - DNA, 20 bp, Artificial
  CRISPR gRNA sequence
agcacgtcccttattctgag

SEQ ID NO: 723442 - DNA, 20 bp, Artificial
  CRISPR gRNA sequence
attctgagatgttcccagct

SEQ ID NO: 723443 - DNA, 20 bp, Artificial
  CRISPR gRNA sequence
ttctgagatgttcccagctt

SEQ ID NO: 723444 - DNA, 20 bp, Artificial
  CRISPR gRNA sequence
tgagatgttcccagcttaac

SEQ ID NO: 723445 - DNA, 20 bp, Artificial
  CRISPR gRNA sequence
agatgttcccagcttaactt

SEQ ID NO: 723446 - DNA, 20 bp, Artificial
  CRISPR gRNA sequence
ccagcttaacttgtgtgctc

SEQ ID NO: 723447 - DNA, 20 bp, Artificial
  CRISPR gRNA sequence
aacttgtgtgctcctgcccc

SEQ ID NO: 723448 - DNA, 20 bp, Artificial
  CRISPR gRNA sequence
acttgtgtgctcctgccccg

SEQ ID NO: 723449 - DNA, 20 bp, Artificial
  CRISPR gRNA sequence
gtgtgctcctgccccggccc

SEQ ID NO: 723450 - DNA, 20 bp, Artificial
  CRISPR gRNA sequence
tgtgctcctgccccggccct

SEQ ID NO: 723451 - DNA, 20 bp, Artificial
  CRISPR gRNA sequence
ctgccccggccctggaatca

SEQ ID NO: 723452 - DNA, 20 bp, Artificial
  CRISPR gRNA sequence
ccccggccctggaatcagct

SEQ ID NO: 723453 - DNA, 20 bp, Artificial
  CRISPR gRNA sequence
gaatcagctgcctctccaag

SEQ ID NO: 723454 - DNA, 20 bp, Artificial
  CRISPR gRNA sequence
cctctccaaggagcccgggg

SEQ ID NO: 723455 - DNA, 20 bp, Artificial
  CRISPR gRNA sequence
tccaaggagcccggggtttg

SEQ ID NO: 723456 - DNA, 20 bp, Artificial
  CRISPR gRNA sequence
caaggagcccggggtttgca

SEQ ID NO: 723457 - DNA, 20 bp, Artificial
  CRISPR gRNA sequence
gcatctcggggtacctgttg

SEQ ID NO: 723458 - DNA, 20 bp, Artificial
  CRISPR gRNA sequence
catctcggggtacctgttgc

SEQ ID NO: 723459 - DNA, 20 bp, Artificial
  CRISPR gRNA sequence
ggggtacctgttgccaaagc

SEQ ID NO: 723460 - DNA, 20 bp, Artificial
  CRISPR gRNA sequence
ttgccaaagcctagctgaac

SEQ ID NO: 723461 - DNA, 20 bp, Artificial
  CRISPR gRNA sequence
ccaaagcctagctgaacctc

SEQ ID NO: 723462 - DNA, 20 bp, Artificial
  CRISPR gRNA sequence
gctgaacctctgtgccaaat

SEQ ID NO: 723463 - DNA, 20 bp, Artificial
  CRISPR gRNA sequence
aacctctgtgccaaattccc

SEQ ID NO: 723464 - DNA, 20 bp, Artificial
  CRISPR gRNA sequence
tgtgccaaattccccccttg

SEQ ID NO: 723465 - DNA, 20 bp, Artificial
  CRISPR gRNA sequence
tgccaaattccccccttggg

SEQ ID NO: 723466 - DNA, 20 bp, Artificial
  CRISPR gRNA sequence
cccccttgggcctgttctgc

SEQ ID NO: 723467 - DNA, 20 bp, Artificial
  CRISPR gRNA sequence
gggcctgttctgcttcccac

SEQ ID NO: 723468 - DNA, 20 bp, Artificial
  CRISPR gRNA sequence
ggcctgttctgcttcccaca

SEQ ID NO: 723469 - DNA, 20 bp, Artificial
  CRISPR gRNA sequence
ttctgcttcccacagcactg

SEQ ID NO: 723470 - DNA, 20 bp, Artificial
  CRISPR gRNA sequence
tgcttcccacagcactgggg

SEQ ID NO: 723471 - DNA, 20 bp, Artificial
  CRISPR gRNA sequence
cttcccacagcactggggaa

SEQ ID NO: 723472 - DNA, 20 bp, Artificial
  CRISPR gRNA sequence
cccacagcactggggaatca

SEQ ID NO: 723473 - DNA, 20 bp, Artificial
  CRISPR gRNA sequence
ccacagcactggggaatcac

SEQ ID NO: 723474 - DNA, 20 bp, Artificial
  CRISPR gRNA sequence
gggaatcacaggccagagag

SEQ ID NO: 723475 - DNA, 20 bp, Artificial
  CRISPR gRNA sequence
aaagtggagaataacaggga

SEQ ID NO: 723476 - DNA, 20 bp, Artificial
  CRISPR gRNA sequence
tacatcgcatgtgagaacgc

SEQ ID NO: 723477 - DNA, 20 bp, Artificial
  CRISPR gRNA sequence
acatcgcatgtgagaacgca

SEQ ID NO: 723478 - DNA, 20 bp, Artificial
  CRISPR gRNA sequence
catcgcatgtgagaacgcac

SEQ ID NO: 723479 - DNA, 20 bp, Artificial
  CRISPR gRNA sequence
cgtgagcgtgggcttcagag

SEQ ID NO: 723480 - DNA, 20 bp, Artificial
  CRISPR gRNA sequence
cagagcagcctgtgacaccg

SEQ ID NO: 723481 - DNA, 20 bp, Artificial
  CRISPR gRNA sequence
agagcagcctgtgacaccgt

SEQ ID NO: 723482 - DNA, 20 bp, Artificial
  CRISPR gRNA sequence
tgacaccgtgcacttgtgca

SEQ ID NO: 723483 - DNA, 20 bp, Artificial
  CRISPR gRNA sequence
gtgcaagggggcctgctgct

SEQ ID NO: 723484 - DNA, 20 bp, Artificial
  CRISPR gRNA sequence
tgcaagggggcctgctgctg

SEQ ID NO: 723485 - DNA, 20 bp, Artificial
  CRISPR gRNA sequence
ctgctgcccagcatggtcct

SEQ ID NO: 723486 - DNA, 20 bp, Artificial
  CRISPR gRNA sequence
ctgcccagcatggtcctgga

SEQ ID NO: 723487 - DNA, 20 bp, Artificial
  CRISPR gRNA sequence
cccagcatggtcctggactt

SEQ ID NO: 723488 - DNA, 20 bp, Artificial
  CRISPR gRNA sequence
gacttgtgtccctgggggta

SEQ ID NO: 723489 - DNA, 20 bp, Artificial
  CRISPR gRNA sequence
gtgtccctgggggtaccaga

SEQ ID NO: 723490 - DNA, 20 bp, Artificial
  CRISPR gRNA sequence
tgtccctgggggtaccagac

SEQ ID NO: 723491 - DNA, 20 bp, Artificial
  CRISPR gRNA sequence
ggggtaccagacaggcttac

SEQ ID NO: 723492 - DNA, 20 bp, Artificial
  CRISPR gRNA sequence
acaagaagacagtggttatt

SEQ ID NO: 723493 - DNA, 20 bp, Artificial
  CRISPR gRNA sequence
caagaagacagtggttattc

SEQ ID NO: 723494 - DNA, 20 bp, Artificial
  CRISPR gRNA sequence
ttccaaaaggcaaggaaacc

SEQ ID NO: 723495 - DNA, 20 bp, Artificial
  CRISPR gRNA sequence
caaaaggcaaggaaaccaac

SEQ ID NO: 723496 - DNA, 20 bp, Artificial
  CRISPR gRNA sequence
gcagatagaatcaacatttt

SEQ ID NO: 723497 - DNA, 20 bp, Artificial
  CRISPR gRNA sequence
ttaggggaagagcagttatg

SEQ ID NO: 723498 - DNA, 20 bp, Artificial
  CRISPR gRNA sequence
taggggaagagcagttatga

SEQ ID NO: 723499 - DNA, 20 bp, Artificial
  CRISPR gRNA sequence
aggggaagagcagttatgaa

SEQ ID NO: 723500 - DNA, 20 bp, Artificial
  CRISPR gRNA sequence
ggggaagagcagttatgaaa

SEQ ID NO: 723501 - DNA, 20 bp, Artificial
  CRISPR gRNA sequence
tgaaatctgacctctgtact

SEQ ID NO: 723502 - DNA, 20 bp, Artificial
  CRISPR gRNA sequence
acctctgtacttggcaagat

SEQ ID NO: 723503 - DNA, 20 bp, Artificial
  CRISPR gRNA sequence
tgtacttggcaagatttgtt

SEQ ID NO: 723504 - DNA, 20 bp, Artificial
  CRISPR gRNA sequence
tacttggcaagatttgttct

SEQ ID NO: 723505 - DNA, 20 bp, Artificial
  CRISPR gRNA sequence
ggcaagatttgttctgggtc

SEQ ID NO: 723506 - DNA, 20 bp, Artificial
  CRISPR gRNA sequence
gcaagatttgttctgggtct

SEQ ID NO: 723507 - DNA, 20 bp, Artificial
  CRISPR gRNA sequence
gttctgggtctttatcaaaa

SEQ ID NO: 723508 - DNA, 20 bp, Artificial
  CRISPR gRNA sequence
ttctgggtctttatcaaaat

SEQ ID NO: 723509 - DNA, 20 bp, Artificial
  CRISPR gRNA sequence
tgggtctttatcaaaatcct

SEQ ID NO: 723510 - DNA, 20 bp, Artificial
  CRISPR gRNA sequence
ggtctttatcaaaatcctca

SEQ ID NO: 723511 - DNA, 20 bp, Artificial
  CRISPR gRNA sequence
tatcaaaatcctcatgggtt

SEQ ID NO: 723512 - DNA, 20 bp, Artificial
  CRISPR gRNA sequence
atcaaaatcctcatgggttg

SEQ ID NO: 723513 - DNA, 20 bp, Artificial
  CRISPR gRNA sequence
tcaaaatcctcatgggttgt

SEQ ID NO: 723514 - DNA, 20 bp, Artificial
  CRISPR gRNA sequence
atgggttgtaacacggctct

SEQ ID NO: 723515 - DNA, 20 bp, Artificial
  CRISPR gRNA sequence
taacacggctcttgtcaatg

SEQ ID NO: 723516 - DNA, 20 bp, Artificial
  CRISPR gRNA sequence
ttgtcaatgtcagagccttc

SEQ ID NO: 723517 - DNA, 20 bp, Artificial
  CRISPR gRNA sequence
gtcaatgtcagagccttcca

SEQ ID NO: 723518 - DNA, 20 bp, Artificial
  CRISPR gRNA sequence
tcaatgtcagagccttccag

SEQ ID NO: 723519 - DNA, 20 bp, Artificial
  CRISPR gRNA sequence
ccagattccgcctttttacc

SEQ ID NO: 723520 - DNA, 20 bp, Artificial
  CRISPR gRNA sequence
cagattccgcctttttacct

SEQ ID NO: 723521 - DNA, 20 bp, Artificial
  CRISPR gRNA sequence
cgcctttttacctctgtgat

SEQ ID NO: 723522 - DNA, 20 bp, Artificial
  CRISPR gRNA sequence
tttacctctgtgattttaca

SEQ ID NO: 723523 - DNA, 20 bp, Artificial
  CRISPR gRNA sequence
ttacctctgtgattttacac

SEQ ID NO: 723524 - DNA, 20 bp, Artificial
  CRISPR gRNA sequence
tacctctgtgattttacact

SEQ ID NO: 723525 - DNA, 20 bp, Artificial
  CRISPR gRNA sequence
acctctgtgattttacactt

SEQ ID NO: 723526 - DNA, 20 bp, Artificial
  CRISPR gRNA sequence
cctctgtgattttacacttg

SEQ ID NO: 723527 - DNA, 20 bp, Artificial
  CRISPR gRNA sequence
tgtgattttacacttgtttg

SEQ ID NO: 723528 - DNA, 20 bp, Artificial
  CRISPR gRNA sequence
tgattttacacttgtttggg

SEQ ID NO: 723529 - DNA, 20 bp, Artificial
  CRISPR gRNA sequence
tacacttgtttgggagagtc

SEQ ID NO: 723530 - DNA, 20 bp, Artificial
  CRISPR gRNA sequence
acacttgtttgggagagtcg

SEQ ID NO: 723531 - DNA, 20 bp, Artificial
  CRISPR gRNA sequence
cacttgtttgggagagtcgg

SEQ ID NO: 723532 - DNA, 20 bp, Artificial
  CRISPR gRNA sequence
gtttgggagagtcggtattg

SEQ ID NO: 723533 - DNA, 20 bp, Artificial
  CRISPR gRNA sequence
tttgggagagtcggtattga

SEQ ID NO: 723534 - DNA, 20 bp, Artificial
  CRISPR gRNA sequence
gggagagtcggtattgaact

SEQ ID NO: 723535 - DNA, 20 bp, Artificial
  CRISPR gRNA sequence
ggagagtcggtattgaactc

SEQ ID NO: 723536 - DNA, 20 bp, Artificial
  CRISPR gRNA sequence
aactctgactttccattcag

SEQ ID NO: 723537 - DNA, 20 bp, Artificial
  CRISPR gRNA sequence
tgactttccattcagtgtga

SEQ ID NO: 723538 - DNA, 20 bp, Artificial
  CRISPR gRNA sequence
actttccattcagtgtgacg

SEQ ID NO: 723539 - DNA, 20 bp, Artificial
  CRISPR gRNA sequence
tccattcagtgtgacggagt

SEQ ID NO: 723540 - DNA, 20 bp, Artificial
  CRISPR gRNA sequence
ccattcagtgtgacggagtg

SEQ ID NO: 723541 - DNA, 20 bp, Artificial
  CRISPR gRNA sequence
cattcagtgtgacggagtgc

SEQ ID NO: 723542 - DNA, 20 bp, Artificial
  CRISPR gRNA sequence
agtgtgacggagtgcagagc

SEQ ID NO: 723543 - DNA, 20 bp, Artificial
  CRISPR gRNA sequence
cttaccatcctgggcttttc

SEQ ID NO: 723544 - DNA, 20 bp, Artificial
  CRISPR gRNA sequence
accatcctgggcttttcctg

SEQ ID NO: 723545 - DNA, 20 bp, Artificial
  CRISPR gRNA sequence
ccatcctgggcttttcctga

SEQ ID NO: 723546 - DNA, 20 bp, Artificial
  CRISPR gRNA sequence
ggcttttcctgaacctgctg

SEQ ID NO: 723547 - DNA, 20 bp, Artificial
  CRISPR gRNA sequence
ttcctgaacctgctgtgtgc

SEQ ID NO: 723548 - DNA, 20 bp, Artificial
  CRISPR gRNA sequence
tcctgaacctgctgtgtgct

SEQ ID NO: 723549 - DNA, 20 bp, Artificial
  CRISPR gRNA sequence
cctgaacctgctgtgtgctc

SEQ ID NO: 723550 - DNA, 20 bp, Artificial
  CRISPR gRNA sequence
ctgaacctgctgtgtgctca

SEQ ID NO: 723551 - DNA, 20 bp, Artificial
  CRISPR gRNA sequence
aacctgctgtgtgctcaaca

SEQ ID NO: 723552 - DNA, 20 bp, Artificial
  CRISPR gRNA sequence
ctgtgtgctcaacagcatcc

SEQ ID NO: 723553 - DNA, 20 bp, Artificial
  CRISPR gRNA sequence
tgtgctcaacagcatcctgg

SEQ ID NO: 723554 - DNA, 20 bp, Artificial
  CRISPR gRNA sequence
aacagcatcctggacacctt

SEQ ID NO: 723555 - DNA, 20 bp, Artificial
  CRISPR gRNA sequence
gacaccttctttttaaaata

SEQ ID NO: 723556 - DNA, 20 bp, Artificial
  CRISPR gRNA sequence
ctttttaaaatagtttaatt

SEQ ID NO: 723557 - DNA, 20 bp, Artificial
  CRISPR gRNA sequence
tttttaaaatagtttaattt

SEQ ID NO: 723558 - DNA, 20 bp, Artificial
  CRISPR gRNA sequence
tttaaaatagtttaattttt

SEQ ID NO: 723559 - DNA, 20 bp, Artificial
  CRISPR gRNA sequence
ttaaaatagtttaattttta

SEQ ID NO: 723560 - DNA, 20 bp, Artificial
  CRISPR gRNA sequence
taaaatagtttaatttttaa

SEQ ID NO: 723561 - DNA, 20 bp, Artificial
  CRISPR gRNA sequence
aaaatagtttaatttttaaa

SEQ ID NO: 723562 - DNA, 20 bp, Artificial
  CRISPR gRNA sequence
aaatagtttaatttttaaaa

SEQ ID NO: 723563 - DNA, 20 bp, Artificial
  CRISPR gRNA sequence
aatttttaaaaattctaagt

SEQ ID NO: 723564 - DNA, 20 bp, Artificial
  CRISPR gRNA sequence
atttttaaaaattctaagta

SEQ ID NO: 723565 - DNA, 20 bp, Artificial
  CRISPR gRNA sequence
ttaaaaattctaagtaggcc

SEQ ID NO: 723566 - DNA, 20 bp, Artificial
  CRISPR gRNA sequence
taaaaattctaagtaggcca

SEQ ID NO: 723567 - DNA, 20 bp, Artificial
  CRISPR gRNA sequence
aaaaattctaagtaggccag

SEQ ID NO: 723568 - DNA, 20 bp, Artificial
  CRISPR gRNA sequence
aaaattctaagtaggccagg

SEQ ID NO: 723569 - DNA, 20 bp, Artificial
  CRISPR gRNA sequence
taagtaggccaggtgtagtg

SEQ ID NO: 723570 - DNA, 20 bp, Artificial
  CRISPR gRNA sequence
agtaggccaggtgtagtggc

SEQ ID NO: 723571 - DNA, 20 bp, Artificial
  CRISPR gRNA sequence
acacctgtaatcccagcact

SEQ ID NO: 723572 - DNA, 20 bp, Artificial
  CRISPR gRNA sequence
taatcccagcactttgggag

SEQ ID NO: 723573 - DNA, 20 bp, Artificial
  CRISPR gRNA sequence
tgggaggccaaggtgggtgg

SEQ ID NO: 723574 - DNA, 20 bp, Artificial
  CRISPR gRNA sequence
gggaggccaaggtgggtgga

SEQ ID NO: 723575 - DNA, 20 bp, Artificial
  CRISPR gRNA sequence
ggaggccaaggtgggtggat

SEQ ID NO: 723576 - DNA, 20 bp, Artificial
  CRISPR gRNA sequence
aggtcgagagttcaagacca

SEQ ID NO: 723577 - DNA, 20 bp, Artificial
  CRISPR gRNA sequence
aagaccagcctggccaacaa

SEQ ID NO: 723578 - DNA, 20 bp, Artificial
  CRISPR gRNA sequence
gccaacaagacaaaacccca

SEQ ID NO: 723579 - DNA, 20 bp, Artificial
  CRISPR gRNA sequence
tactaaaaataaaaaaatta

SEQ ID NO: 723580 - DNA, 20 bp, Artificial
  CRISPR gRNA sequence
ctaaaaataaaaaaattagc

SEQ ID NO: 723581 - DNA, 20 bp, Artificial
  CRISPR gRNA sequence
aaaataaaaaaattagccag

SEQ ID NO: 723582 - DNA, 20 bp, Artificial
  CRISPR gRNA sequence
gccaggcatggtggcacaca

SEQ ID NO: 723583 - DNA, 20 bp, Artificial
  CRISPR gRNA sequence
taatcccagctactcgggag

SEQ ID NO: 723584 - DNA, 20 bp, Artificial
  CRISPR gRNA sequence
ctcgggaggctgaggcagga

SEQ ID NO: 723585 - DNA, 20 bp, Artificial
  CRISPR gRNA sequence
gggaggctgaggcaggagaa

SEQ ID NO: 723586 - DNA, 20 bp, Artificial
  CRISPR gRNA sequence
aggcaggagaatttcttgaa

SEQ ID NO: 723587 - DNA, 20 bp, Artificial
  CRISPR gRNA sequence
cttgaacctgggaggtggag

SEQ ID NO: 723588 - DNA, 20 bp, Artificial
  CRISPR gRNA sequence
ttgaacctgggaggtggagg

SEQ ID NO: 723589 - DNA, 20 bp, Artificial
  CRISPR gRNA sequence
gaacctgggaggtggaggtt

SEQ ID NO: 723590 - DNA, 20 bp, Artificial
  CRISPR gRNA sequence
aacctgggaggtggaggttg

SEQ ID NO: 723591 - DNA, 20 bp, Artificial
  CRISPR gRNA sequence
ggaggtggaggttgcagtga

SEQ ID NO: 723592 - DNA, 20 bp, Artificial
  CRISPR gRNA sequence
cagtgagctgagattgcacc

SEQ ID NO: 723593 - DNA, 20 bp, Artificial
  CRISPR gRNA sequence
agattgcaccactgcactcc

SEQ ID NO: 723594 - DNA, 20 bp, Artificial
  CRISPR gRNA sequence
caccactgcactccaggctg

SEQ ID NO: 723595 - DNA, 20 bp, Artificial
  CRISPR gRNA sequence
cactccaggctgagcaacag

SEQ ID NO: 723596 - DNA, 20 bp, Artificial
  CRISPR gRNA sequence
caggctgagcaacagagcga

SEQ ID NO: 723597 - DNA, 20 bp, Artificial
  CRISPR gRNA sequence
agcaacagagcgagcctccg

SEQ ID NO: 723598 - DNA, 20 bp, Artificial
  CRISPR gRNA sequence
cgtctcaaaacaaacaaaca

SEQ ID NO: 723599 - DNA, 20 bp, Artificial
  CRISPR gRNA sequence
aaaacaaacaaacaaacaaa

SEQ ID NO: 723600 - DNA, 20 bp, Artificial
  CRISPR gRNA sequence
taagtggccttcatttttaa

SEQ ID NO: 723601 - DNA, 20 bp, Artificial
  CRISPR gRNA sequence
agtggccttcatttttaagt

SEQ ID NO: 723602 - DNA, 20 bp, Artificial
  CRISPR gRNA sequence
catttttaagttttttgttt

SEQ ID NO: 723603 - DNA, 20 bp, Artificial
  CRISPR gRNA sequence
atttttaagttttttgtttt

SEQ ID NO: 723604 - DNA, 20 bp, Artificial
  CRISPR gRNA sequence
ttaagttttttgttttttgt

SEQ ID NO: 723605 - DNA, 20 bp, Artificial
  CRISPR gRNA sequence
taagttttttgttttttgtt

SEQ ID NO: 723606 - DNA, 20 bp, Artificial
  CRISPR gRNA sequence
aagttttttgttttttgttt

SEQ ID NO: 723607 - DNA, 20 bp, Artificial
  CRISPR gRNA sequence
agttttttgttttttgtttt

SEQ ID NO: 723608 - DNA, 20 bp, Artificial
  CRISPR gRNA sequence
tttgttttttgttttttgtt

SEQ ID NO: 723609 - DNA, 20 bp, Artificial
  CRISPR gRNA sequence
ttgttttttgttttttgttt

SEQ ID NO: 723610 - DNA, 20 bp, Artificial
  CRISPR gRNA sequence
tgttttttgttttttgtttt

SEQ ID NO: 723611 - DNA, 20 bp, Artificial
  CRISPR gRNA sequence
gttttttgttttttgttttg

SEQ ID NO: 723612 - DNA, 20 bp, Artificial
  CRISPR gRNA sequence
ttttttgttttttgttttgg

SEQ ID NO: 723613 - DNA, 20 bp, Artificial
  CRISPR gRNA sequence
tttgttttttgttttggaga

SEQ ID NO: 723614 - DNA, 20 bp, Artificial
  CRISPR gRNA sequence
ttgttttttgttttggagac

SEQ ID NO: 723615 - DNA, 20 bp, Artificial
  CRISPR gRNA sequence
tgttttttgttttggagaca

SEQ ID NO: 723616 - DNA, 20 bp, Artificial
  CRISPR gRNA sequence
gttttttgttttggagacag

SEQ ID NO: 723617 - DNA, 20 bp, Artificial
  CRISPR gRNA sequence
ttttttgttttggagacagg

SEQ ID NO: 723618 - DNA, 20 bp, Artificial
  CRISPR gRNA sequence
tttgttttggagacagggtg

SEQ ID NO: 723619 - DNA, 20 bp, Artificial
  CRISPR gRNA sequence
ttgttttggagacagggtgt

SEQ ID NO: 723620 - DNA, 20 bp, Artificial
  CRISPR gRNA sequence
tgttttggagacagggtgtc

SEQ ID NO: 723621 - DNA, 20 bp, Artificial
  CRISPR gRNA sequence
gttttggagacagggtgtca

SEQ ID NO: 723622 - DNA, 20 bp, Artificial
  CRISPR gRNA sequence
ttttggagacagggtgtcac

SEQ ID NO: 723623 - DNA, 20 bp, Artificial
  CRISPR gRNA sequence
tggagacagggtgtcactct

SEQ ID NO: 723624 - DNA, 20 bp, Artificial
  CRISPR gRNA sequence
ggagacagggtgtcactctg

SEQ ID NO: 723625 - DNA, 20 bp, Artificial
  CRISPR gRNA sequence
gagacagggtgtcactctgg

SEQ ID NO: 723626 - DNA, 20 bp, Artificial
  CRISPR gRNA sequence
tggagtgccatggtacaatc

SEQ ID NO: 723627 - DNA, 20 bp, Artificial
  CRISPR gRNA sequence
gagtgccatggtacaatcat

SEQ ID NO: 723628 - DNA, 20 bp, Artificial
  CRISPR gRNA sequence
actgcagccttgacctcctg

SEQ ID NO: 723629 - DNA, 20 bp, Artificial
  CRISPR gRNA sequence
cagccttgacctcctgggtt

SEQ ID NO: 723630 - DNA, 20 bp, Artificial
  CRISPR gRNA sequence
gacctcctgggttcaagtga

SEQ ID NO: 723631 - DNA, 20 bp, Artificial
  CRISPR gRNA sequence
acctcctgggttcaagtgat

SEQ ID NO: 723632 - DNA, 20 bp, Artificial
  CRISPR gRNA sequence
ctgggttcaagtgatccctc

SEQ ID NO: 723633 - DNA, 20 bp, Artificial
  CRISPR gRNA sequence
ggttcaagtgatccctcagc

SEQ ID NO: 723634 - DNA, 20 bp, Artificial
  CRISPR gRNA sequence
aagtgatccctcagcctccc

SEQ ID NO: 723635 - DNA, 20 bp, Artificial
  CRISPR gRNA sequence
agcctccccagtagctggga

SEQ ID NO: 723636 - DNA, 20 bp, Artificial
  CRISPR gRNA sequence
cccagtagctgggactacag

SEQ ID NO: 723637 - DNA, 20 bp, Artificial
  CRISPR gRNA sequence
ggactacagatacacaccac

SEQ ID NO: 723638 - DNA, 20 bp, Artificial
  CRISPR gRNA sequence
cagatacacaccaccacgcc

SEQ ID NO: 723639 - DNA, 20 bp, Artificial
  CRISPR gRNA sequence
acttttctattttttgtaga

SEQ ID NO: 723640 - DNA, 20 bp, Artificial
  CRISPR gRNA sequence
ttctattttttgtagagacc

SEQ ID NO: 723641 - DNA, 20 bp, Artificial
  CRISPR gRNA sequence
tctattttttgtagagacca

SEQ ID NO: 723642 - DNA, 20 bp, Artificial
  CRISPR gRNA sequence
ctattttttgtagagaccag

SEQ ID NO: 723643 - DNA, 20 bp, Artificial
  CRISPR gRNA sequence
tattttttgtagagaccagg

SEQ ID NO: 723644 - DNA, 20 bp, Artificial
  CRISPR gRNA sequence
ttttttgtagagaccaggtc

SEQ ID NO: 723645 - DNA, 20 bp, Artificial
  CRISPR gRNA sequence
tttgtagagaccaggtctcc

SEQ ID NO: 723646 - DNA, 20 bp, Artificial
  CRISPR gRNA sequence
ttgtagagaccaggtctccc

SEQ ID NO: 723647 - DNA, 20 bp, Artificial
  CRISPR gRNA sequence
tgtagagaccaggtctccct

SEQ ID NO: 723648 - DNA, 20 bp, Artificial
  CRISPR gRNA sequence
gtagagaccaggtctccctt

SEQ ID NO: 723649 - DNA, 20 bp, Artificial
  CRISPR gRNA sequence
tagagaccaggtctcccttt

SEQ ID NO: 723650 - DNA, 20 bp, Artificial
  CRISPR gRNA sequence
cctttgttgtgcaggctggt

SEQ ID NO: 723651 - DNA, 20 bp, Artificial
  CRISPR gRNA sequence
tgttgtgcaggctggtctct

SEQ ID NO: 723652 - DNA, 20 bp, Artificial
  CRISPR gRNA sequence
gttgtgcaggctggtctcta

SEQ ID NO: 723653 - DNA, 20 bp, Artificial
  CRISPR gRNA sequence
ttgtgcaggctggtctctaa

SEQ ID NO: 723654 - DNA, 20 bp, Artificial
  CRISPR gRNA sequence
tgcaggctggtctctaactc

SEQ ID NO: 723655 - DNA, 20 bp, Artificial
  CRISPR gRNA sequence
gtctctaactcctgagctca

SEQ ID NO: 723656 - DNA, 20 bp, Artificial
  CRISPR gRNA sequence
taactcctgagctcaagtga

SEQ ID NO: 723657 - DNA, 20 bp, Artificial
  CRISPR gRNA sequence
actcctgagctcaagtgatc

SEQ ID NO: 723658 - DNA, 20 bp, Artificial
  CRISPR gRNA sequence
ctgagctcaagtgatctgcc

SEQ ID NO: 723659 - DNA, 20 bp, Artificial
  CRISPR gRNA sequence
agctcaagtgatctgcccac

SEQ ID NO: 723660 - DNA, 20 bp, Artificial
  CRISPR gRNA sequence
aagtgatctgcccacctcgg

SEQ ID NO: 723661 - DNA, 20 bp, Artificial
  CRISPR gRNA sequence
cccacctcggcctcccaaag

SEQ ID NO: 723662 - DNA, 20 bp, Artificial
  CRISPR gRNA sequence
ggcctcccaaagtgcttgga

SEQ ID NO: 723663 - DNA, 20 bp, Artificial
  CRISPR gRNA sequence
ccaaagtgcttggattatag

SEQ ID NO: 723664 - DNA, 20 bp, Artificial
  CRISPR gRNA sequence
ggattataggcgagagccac

SEQ ID NO: 723665 - DNA, 20 bp, Artificial
  CRISPR gRNA sequence
gattataggcgagagccact

SEQ ID NO: 723666 - DNA, 20 bp, Artificial
  CRISPR gRNA sequence
taggcgagagccactgtgcc

SEQ ID NO: 723667 - DNA, 20 bp, Artificial
  CRISPR gRNA sequence
tgcccagctagtcctcattt

SEQ ID NO: 723668 - DNA, 20 bp, Artificial
  CRISPR gRNA sequence
gtcctcattttttttttgag

SEQ ID NO: 723669 - DNA, 20 bp, Artificial
  CRISPR gRNA sequence
attttttttttgaggcagag

SEQ ID NO: 723670 - DNA, 20 bp, Artificial
  CRISPR gRNA sequence
tttttttgaggcagagtctc

SEQ ID NO: 723671 - DNA, 20 bp, Artificial
  CRISPR gRNA sequence
ttttttgaggcagagtctcg

SEQ ID NO: 723672 - DNA, 20 bp, Artificial
  CRISPR gRNA sequence
tttttgaggcagagtctcgc

SEQ ID NO: 723673 - DNA, 20 bp, Artificial
  CRISPR gRNA sequence
ttttgaggcagagtctcgct

SEQ ID NO: 723674 - DNA, 20 bp, Artificial
  CRISPR gRNA sequence
tttgaggcagagtctcgctc

SEQ ID NO: 723675 - DNA, 20 bp, Artificial
  CRISPR gRNA sequence
ttgaggcagagtctcgctct

SEQ ID NO: 723676 - DNA, 20 bp, Artificial
  CRISPR gRNA sequence
tgaggcagagtctcgctctg

SEQ ID NO: 723677 - DNA, 20 bp, Artificial
  CRISPR gRNA sequence
gaggcagagtctcgctctgt

SEQ ID NO: 723678 - DNA, 20 bp, Artificial
  CRISPR gRNA sequence
aggcagagtctcgctctgtt

SEQ ID NO: 723679 - DNA, 20 bp, Artificial
  CRISPR gRNA sequence
gctctgttgcccaggttgga

SEQ ID NO: 723680 - DNA, 20 bp, Artificial
  CRISPR gRNA sequence
tgttgcccaggttggagtgc

SEQ ID NO: 723681 - DNA, 20 bp, Artificial
  CRISPR gRNA sequence
ttgcccaggttggagtgcaa

SEQ ID NO: 723682 - DNA, 20 bp, Artificial
  CRISPR gRNA sequence
cccaggttggagtgcaatgg

SEQ ID NO: 723683 - DNA, 20 bp, Artificial
  CRISPR gRNA sequence
gagtgcaatggcgcaatctc

SEQ ID NO: 723684 - DNA, 20 bp, Artificial
  CRISPR gRNA sequence
agctcactgcaacctctgct

SEQ ID NO: 723685 - DNA, 20 bp, Artificial
  CRISPR gRNA sequence
actgcaacctctgcttcccg

SEQ ID NO: 723686 - DNA, 20 bp, Artificial
  CRISPR gRNA sequence
caacctctgcttcccgggtt

SEQ ID NO: 723687 - DNA, 20 bp, Artificial
  CRISPR gRNA sequence
tgcttcccgggttccagcaa

SEQ ID NO: 723688 - DNA, 20 bp, Artificial
  CRISPR gRNA sequence
cttcccgggttccagcaatt

SEQ ID NO: 723689 - DNA, 20 bp, Artificial
  CRISPR gRNA sequence
cccgggttccagcaattctc

SEQ ID NO: 723690 - DNA, 20 bp, Artificial
  CRISPR gRNA sequence
ccgggttccagcaattctcc

SEQ ID NO: 723691 - DNA, 20 bp, Artificial
  CRISPR gRNA sequence
cagcaattctcctgcctcag

SEQ ID NO: 723692 - DNA, 20 bp, Artificial
  CRISPR gRNA sequence
tcctgcctcagcctcccgag

SEQ ID NO: 723693 - DNA, 20 bp, Artificial
  CRISPR gRNA sequence
ctgcctcagcctcccgagta

SEQ ID NO: 723694 - DNA, 20 bp, Artificial
  CRISPR gRNA sequence
cctcagcctcccgagtagct

SEQ ID NO: 723695 - DNA, 20 bp, Artificial
  CRISPR gRNA sequence
agcctcccgagtagctggga

SEQ ID NO: 723696 - DNA, 20 bp, Artificial
  CRISPR gRNA sequence
ccgagtagctgggattatag

SEQ ID NO: 723697 - DNA, 20 bp, Artificial
  CRISPR gRNA sequence
ggattataggcgcgcgccac

SEQ ID NO: 723698 - DNA, 20 bp, Artificial
  CRISPR gRNA sequence
taggcgcgcgccaccatgcc

SEQ ID NO: 723699 - DNA, 20 bp, Artificial
  CRISPR gRNA sequence
atttttgtatttttagtaga

SEQ ID NO: 723700 - DNA, 20 bp, Artificial
  CRISPR gRNA sequence
ttgtatttttagtagagatg

SEQ ID NO: 723701 - DNA, 20 bp, Artificial
  CRISPR gRNA sequence
tgtatttttagtagagatgg

SEQ ID NO: 723702 - DNA, 20 bp, Artificial
  CRISPR gRNA sequence
gtatttttagtagagatggg

SEQ ID NO: 723703 - DNA, 20 bp, Artificial
  CRISPR gRNA sequence
tatttttagtagagatgggg

SEQ ID NO: 723704 - DNA, 20 bp, Artificial
  CRISPR gRNA sequence
ttagtagagatggggtttca

SEQ ID NO: 723705 - DNA, 20 bp, Artificial
  CRISPR gRNA sequence
tagtagagatggggtttcac

SEQ ID NO: 723706 - DNA, 20 bp, Artificial
  CRISPR gRNA sequence
agtagagatggggtttcacc

SEQ ID NO: 723707 - DNA, 20 bp, Artificial
  CRISPR gRNA sequence
gtagagatggggtttcacca

SEQ ID NO: 723708 - DNA, 20 bp, Artificial
  CRISPR gRNA sequence
caccaggttggccaggctgg

SEQ ID NO: 723709 - DNA, 20 bp, Artificial
  CRISPR gRNA sequence
accaggttggccaggctggt

SEQ ID NO: 723710 - DNA, 20 bp, Artificial
  CRISPR gRNA sequence
gccaggctggtctggaactc

SEQ ID NO: 723711 - DNA, 20 bp, Artificial
  CRISPR gRNA sequence
gtctggaactcctggcatcg

SEQ ID NO: 723712 - DNA, 20 bp, Artificial
  CRISPR gRNA sequence
gaactcctggcatcgtgatt

SEQ ID NO: 723713 - DNA, 20 bp, Artificial
  CRISPR gRNA sequence
ctggcatcgtgatttgccca

SEQ ID NO: 723714 - DNA, 20 bp, Artificial
  CRISPR gRNA sequence
gcatcgtgatttgcccacct

SEQ ID NO: 723715 - DNA, 20 bp, Artificial
  CRISPR gRNA sequence
gcccacctcagcctcccaaa

SEQ ID NO: 723716 - DNA, 20 bp, Artificial
  CRISPR gRNA sequence
cccacctcagcctcccaaaa

SEQ ID NO: 723717 - DNA, 20 bp, Artificial
  CRISPR gRNA sequence
agcctcccaaaatactggga

SEQ ID NO: 723718 - DNA, 20 bp, Artificial
  CRISPR gRNA sequence
ccaaaatactgggattacag

SEQ ID NO: 723719 - DNA, 20 bp, Artificial
  CRISPR gRNA sequence
ggattacaggcatgagccac

SEQ ID NO: 723720 - DNA, 20 bp, Artificial
  CRISPR gRNA sequence
caggcatgagccaccacgcc

SEQ ID NO: 723721 - DNA, 20 bp, Artificial
  CRISPR gRNA sequence
atttttaaaaatagttttag

SEQ ID NO: 723722 - DNA, 20 bp, Artificial
  CRISPR gRNA sequence
ttaaaaatagttttagatgt

SEQ ID NO: 723723 - DNA, 20 bp, Artificial
  CRISPR gRNA sequence
taaaaatagttttagatgta

SEQ ID NO: 723724 - DNA, 20 bp, Artificial
  CRISPR gRNA sequence
aaaaatagttttagatgtac

SEQ ID NO: 723725 - DNA, 20 bp, Artificial
  CRISPR gRNA sequence
aaaatagttttagatgtaca

SEQ ID NO: 723726 - DNA, 20 bp, Artificial
  CRISPR gRNA sequence
tagatgtacagaaaattgga

SEQ ID NO: 723727 - DNA, 20 bp, Artificial
  CRISPR gRNA sequence
agatgtacagaaaattggag

SEQ ID NO: 723728 - DNA, 20 bp, Artificial
  CRISPR gRNA sequence
gatgtacagaaaattggaga

SEQ ID NO: 723729 - DNA, 20 bp, Artificial
  CRISPR gRNA sequence
gagaagacagcacaggagtt

SEQ ID NO: 723730 - DNA, 20 bp, Artificial
  CRISPR gRNA sequence
ccacatgccccacacccagt

SEQ ID NO: 723731 - DNA, 20 bp, Artificial
  CRISPR gRNA sequence
cctctgtgattagcatctta

SEQ ID NO: 723732 - DNA, 20 bp, Artificial
  CRISPR gRNA sequence
ctctgtgattagcatcttaa

SEQ ID NO: 723733 - DNA, 20 bp, Artificial
  CRISPR gRNA sequence
tgtgattagcatcttaagcc

SEQ ID NO: 723734 - DNA, 20 bp, Artificial
  CRISPR gRNA sequence
tgattagcatcttaagccag

SEQ ID NO: 723735 - DNA, 20 bp, Artificial
  CRISPR gRNA sequence
gcatcttaagccagcatcgt

SEQ ID NO: 723736 - DNA, 20 bp, Artificial
  CRISPR gRNA sequence
aagccagcatcgttcatttg

SEQ ID NO: 723737 - DNA, 20 bp, Artificial
  CRISPR gRNA sequence
agccagcatcgttcatttgt

SEQ ID NO: 723738 - DNA, 20 bp, Artificial
  CRISPR gRNA sequence
atttgtcaaaatatgtgaac

SEQ ID NO: 723739 - DNA, 20 bp, Artificial
  CRISPR gRNA sequence
gtcaaaatatgtgaaccatt

SEQ ID NO: 723740 - DNA, 20 bp, Artificial
  CRISPR gRNA sequence
tcaaaatatgtgaaccatta

SEQ ID NO: 723741 - DNA, 20 bp, Artificial
  CRISPR gRNA sequence
ttgacacaggattacaaacg

SEQ ID NO: 723742 - DNA, 20 bp, Artificial
  CRISPR gRNA sequence
acacaggattacaaacgaaa

SEQ ID NO: 723743 - DNA, 20 bp, Artificial
  CRISPR gRNA sequence
caaacgaaagcccacactgt

SEQ ID NO: 723744 - DNA, 20 bp, Artificial
  CRISPR gRNA sequence
tgttcagggttcccttgcat

SEQ ID NO: 723745 - DNA, 20 bp, Artificial
  CRISPR gRNA sequence
agggttcccttgcattgcct

SEQ ID NO: 723746 - DNA, 20 bp, Artificial
  CRISPR gRNA sequence
ccttgcattgcctaaggttc

SEQ ID NO: 723747 - DNA, 20 bp, Artificial
  CRISPR gRNA sequence
gcattgcctaaggttccagg

SEQ ID NO: 723748 - DNA, 20 bp, Artificial
  CRISPR gRNA sequence
cattgcctaaggttccagga

SEQ ID NO: 723749 - DNA, 20 bp, Artificial
  CRISPR gRNA sequence
cctaaggttccaggatccca

SEQ ID NO: 723750 - DNA, 20 bp, Artificial
  CRISPR gRNA sequence
aggttccaggatcccatcca

SEQ ID NO: 723751 - DNA, 20 bp, Artificial
  CRISPR gRNA sequence
caggatcccatccaggagcc

SEQ ID NO: 723752 - DNA, 20 bp, Artificial
  CRISPR gRNA sequence
agtcatcatgtcgccttagg

SEQ ID NO: 723753 - DNA, 20 bp, Artificial
  CRISPR gRNA sequence
aggctactctggcctgtggc

SEQ ID NO: 723754 - DNA, 20 bp, Artificial
  CRISPR gRNA sequence
ggctactctggcctgtggcc

SEQ ID NO: 723755 - DNA, 20 bp, Artificial
  CRISPR gRNA sequence
ctctggcctgtggccgtttc

SEQ ID NO: 723756 - DNA, 20 bp, Artificial
  CRISPR gRNA sequence
tggcctgtggccgtttctca

SEQ ID NO: 723757 - DNA, 20 bp, Artificial
  CRISPR gRNA sequence
gcctgtggccgtttctcaga

SEQ ID NO: 723758 - DNA, 20 bp, Artificial
  CRISPR gRNA sequence
tggccgtttctcagatcttg

SEQ ID NO: 723759 - DNA, 20 bp, Artificial
  CRISPR gRNA sequence
ctcagatcttgtttctcaag

SEQ ID NO: 723760 - DNA, 20 bp, Artificial
  CRISPR gRNA sequence
tcagatcttgtttctcaaga

SEQ ID NO: 723761 - DNA, 20 bp, Artificial
  CRISPR gRNA sequence
agatcttgtttctcaagacc

SEQ ID NO: 723762 - DNA, 20 bp, Artificial
  CRISPR gRNA sequence
gtttctcaagaccagtttcc

SEQ ID NO: 723763 - DNA, 20 bp, Artificial
  CRISPR gRNA sequence
tttctcaagaccagtttccc

SEQ ID NO: 723764 - DNA, 20 bp, Artificial
  CRISPR gRNA sequence
ctcaagaccagtttccctga

SEQ ID NO: 723765 - DNA, 20 bp, Artificial
  CRISPR gRNA sequence
tcaagaccagtttccctgat

SEQ ID NO: 723766 - DNA, 20 bp, Artificial
  CRISPR gRNA sequence
aagaccagtttccctgatgg

SEQ ID NO: 723767 - DNA, 20 bp, Artificial
  CRISPR gRNA sequence
ccctgatggccttggcagtt

SEQ ID NO: 723768 - DNA, 20 bp, Artificial
  CRISPR gRNA sequence
cctgatggccttggcagttt

SEQ ID NO: 723769 - DNA, 20 bp, Artificial
  CRISPR gRNA sequence
atggccttggcagtttttga

SEQ ID NO: 723770 - DNA, 20 bp, Artificial
  CRISPR gRNA sequence
ggcagtttttgagtattgat

SEQ ID NO: 723771 - DNA, 20 bp, Artificial
  CRISPR gRNA sequence
gcagtttttgagtattgatc

SEQ ID NO: 723772 - DNA, 20 bp, Artificial
  CRISPR gRNA sequence
ttgagtattgatcaggtgtt

SEQ ID NO: 723773 - DNA, 20 bp, Artificial
  CRISPR gRNA sequence
tgagtattgatcaggtgttt

SEQ ID NO: 723774 - DNA, 20 bp, Artificial
  CRISPR gRNA sequence
gagtattgatcaggtgtttt

SEQ ID NO: 723775 - DNA, 20 bp, Artificial
  CRISPR gRNA sequence
agtattgatcaggtgttttg

SEQ ID NO: 723776 - DNA, 20 bp, Artificial
  CRISPR gRNA sequence
atcaggtgttttgcgggacg

SEQ ID NO: 723777 - DNA, 20 bp, Artificial
  CRISPR gRNA sequence
tgcgggacgcctgtctcctg

SEQ ID NO: 723778 - DNA, 20 bp, Artificial
  CRISPR gRNA sequence
gcgggacgcctgtctcctgg

SEQ ID NO: 723779 - DNA, 20 bp, Artificial
  CRISPR gRNA sequence
cgggacgcctgtctcctggg

SEQ ID NO: 723780 - DNA, 20 bp, Artificial
  CRISPR gRNA sequence
tctcctgggatctgtctgat

SEQ ID NO: 723781 - DNA, 20 bp, Artificial
  CRISPR gRNA sequence
ctgggatctgtctgatgtct

SEQ ID NO: 723782 - DNA, 20 bp, Artificial
  CRISPR gRNA sequence
ggatctgtctgatgtcttcc

SEQ ID NO: 723783 - DNA, 20 bp, Artificial
  CRISPR gRNA sequence
tctgatgtcttccccatgat

SEQ ID NO: 723784 - DNA, 20 bp, Artificial
  CRISPR gRNA sequence
atgtcttccccatgattaga

SEQ ID NO: 723785 - DNA, 20 bp, Artificial
  CRISPR gRNA sequence
ccccatgattagactggagt

SEQ ID NO: 723786 - DNA, 20 bp, Artificial
  CRISPR gRNA sequence
cccatgattagactggagtt

SEQ ID NO: 723787 - DNA, 20 bp, Artificial
  CRISPR gRNA sequence
gactggagttatgcattggg

SEQ ID NO: 723788 - DNA, 20 bp, Artificial
  CRISPR gRNA sequence
gagttatgcattgggggaag

SEQ ID NO: 723789 - DNA, 20 bp, Artificial
  CRISPR gRNA sequence
tgcattgggggaagaagacc

SEQ ID NO: 723790 - DNA, 20 bp, Artificial
  CRISPR gRNA sequence
ggggaagaagaccacagagg

SEQ ID NO: 723791 - DNA, 20 bp, Artificial
  CRISPR gRNA sequence
atcacatcaaatcttggctg

SEQ ID NO: 723792 - DNA, 20 bp, Artificial
  CRISPR gRNA sequence
ggctgggcgcagtagctcat

SEQ ID NO: 723793 - DNA, 20 bp, Artificial
  CRISPR gRNA sequence
gctgggcgcagtagctcatg

SEQ ID NO: 723794 - DNA, 20 bp, Artificial
  CRISPR gRNA sequence
ggcgcagtagctcatgcctg

SEQ ID NO: 723795 - DNA, 20 bp, Artificial
  CRISPR gRNA sequence
atgcctgtaatcccagcact

SEQ ID NO: 723796 - DNA, 20 bp, Artificial
  CRISPR gRNA sequence
taatcccagcactttgggag

SEQ ID NO: 723797 - DNA, 20 bp, Artificial
  CRISPR gRNA sequence
tgggaggccaagcctggcag

SEQ ID NO: 723798 - DNA, 20 bp, Artificial
  CRISPR gRNA sequence
gggaggccaagcctggcaga

SEQ ID NO: 723799 - DNA, 20 bp, Artificial
  CRISPR gRNA sequence
ggaggccaagcctggcagat

SEQ ID NO: 723800 - DNA, 20 bp, Artificial
  CRISPR gRNA sequence
gcagatcacctgaggtcagg

SEQ ID NO: 723801 - DNA, 20 bp, Artificial
  CRISPR gRNA sequence
aggtcaggagtttgagacca

SEQ ID NO: 723802 - DNA, 20 bp, Artificial
  CRISPR gRNA sequence
gagaccagcctggccaacat

SEQ ID NO: 723803 - DNA, 20 bp, Artificial
  CRISPR gRNA sequence
agaccagcctggccaacatg

SEQ ID NO: 723804 - DNA, 20 bp, Artificial
  CRISPR gRNA sequence
gccaacatggtgaaaccctg

SEQ ID NO: 723805 - DNA, 20 bp, Artificial
  CRISPR gRNA sequence
tctctaccgaaaatacaaaa

SEQ ID NO: 723806 - DNA, 20 bp, Artificial
  CRISPR gRNA sequence
taccgaaaatacaaaaatta

SEQ ID NO: 723807 - DNA, 20 bp, Artificial
  CRISPR gRNA sequence
ccgaaaatacaaaaattagc

SEQ ID NO: 723808 - DNA, 20 bp, Artificial
  CRISPR gRNA sequence
gccgggtgtcatgacacgca

SEQ ID NO: 723809 - DNA, 20 bp, Artificial
  CRISPR gRNA sequence
tagtcccagctacttgggag

SEQ ID NO: 723810 - DNA, 20 bp, Artificial
  CRISPR gRNA sequence
cttgggaggctgaggcagga

SEQ ID NO: 723811 - DNA, 20 bp, Artificial
  CRISPR gRNA sequence
gggaggctgaggcaggagga

SEQ ID NO: 723812 - DNA, 20 bp, Artificial
  CRISPR gRNA sequence
ggaggctgaggcaggaggat

SEQ ID NO: 723813 - DNA, 20 bp, Artificial
  CRISPR gRNA sequence
aggcaggaggatcgcttaaa

SEQ ID NO: 723814 - DNA, 20 bp, Artificial
  CRISPR gRNA sequence
aaaccccagaggcagaggtt

SEQ ID NO: 723815 - DNA, 20 bp, Artificial
  CRISPR gRNA sequence
aaccccagaggcagaggttg

SEQ ID NO: 723816 - DNA, 20 bp, Artificial
  CRISPR gRNA sequence
cattgagctgagaacgtgcc

SEQ ID NO: 723817 - DNA, 20 bp, Artificial
  CRISPR gRNA sequence
agctgagaacgtgccactac

SEQ ID NO: 723818 - DNA, 20 bp, Artificial
  CRISPR gRNA sequence
agaacgtgccactacactcc

SEQ ID NO: 723819 - DNA, 20 bp, Artificial
  CRISPR gRNA sequence
cactccagcctcggtgacag

SEQ ID NO: 723820 - DNA, 20 bp, Artificial
  CRISPR gRNA sequence
cagcctcggtgacagagcga

SEQ ID NO: 723821 - DNA, 20 bp, Artificial
  CRISPR gRNA sequence
ggtgacagagcgagactcca

SEQ ID NO: 723822 - DNA, 20 bp, Artificial
  CRISPR gRNA sequence
catctcaaaaaaaaaaaaaa

SEQ ID NO: 723823 - DNA, 20 bp, Artificial
  CRISPR gRNA sequence
aaaaaaaaaaaaaaaaaaaa

SEQ ID NO: 723824 - DNA, 20 bp, Artificial
  CRISPR gRNA sequence
atttaccactgggcaccttc

SEQ ID NO: 723825 - DNA, 20 bp, Artificial
  CRISPR gRNA sequence
accactgggcaccttcactt

SEQ ID NO: 723826 - DNA, 20 bp, Artificial
  CRISPR gRNA sequence
ccactgggcaccttcacttt

SEQ ID NO: 723827 - DNA, 20 bp, Artificial
  CRISPR gRNA sequence
ggcaccttcacttttgatat

SEQ ID NO: 723828 - DNA, 20 bp, Artificial
  CRISPR gRNA sequence
cacttttgatatctctttta

SEQ ID NO: 723829 - DNA, 20 bp, Artificial
  CRISPR gRNA sequence
acttttgatatctcttttaa

SEQ ID NO: 723830 - DNA, 20 bp, Artificial
  CRISPR gRNA sequence
ttgatatctcttttaatctt

SEQ ID NO: 723831 - DNA, 20 bp, Artificial
  CRISPR gRNA sequence
tgatatctcttttaatcttc

SEQ ID NO: 723832 - DNA, 20 bp, Artificial
  CRISPR gRNA sequence
gatatctcttttaatcttct

SEQ ID NO: 723833 - DNA, 20 bp, Artificial
  CRISPR gRNA sequence
atatctcttttaatcttctc

SEQ ID NO: 723834 - DNA, 20 bp, Artificial
  CRISPR gRNA sequence
ttttaatcttctcaacaagc

SEQ ID NO: 723835 - DNA, 20 bp, Artificial
  CRISPR gRNA sequence
ttaatcttctcaacaagccc

SEQ ID NO: 723836 - DNA, 20 bp, Artificial
  CRISPR gRNA sequence
taatcttctcaacaagcccc

SEQ ID NO: 723837 - DNA, 20 bp, Artificial
  CRISPR gRNA sequence
aatcttctcaacaagcccca

SEQ ID NO: 723838 - DNA, 20 bp, Artificial
  CRISPR gRNA sequence
atcttctcaacaagccccaa

SEQ ID NO: 723839 - DNA, 20 bp, Artificial
  CRISPR gRNA sequence
ctcaacaagccccaaagttg

SEQ ID NO: 723840 - DNA, 20 bp, Artificial
  CRISPR gRNA sequence
tcaacaagccccaaagttga

SEQ ID NO: 723841 - DNA, 20 bp, Artificial
  CRISPR gRNA sequence
aacaagccccaaagttgatg

SEQ ID NO: 723842 - DNA, 20 bp, Artificial
  CRISPR gRNA sequence
atgtgattcatcccattttc

SEQ ID NO: 723843 - DNA, 20 bp, Artificial
  CRISPR gRNA sequence
atcccattttccagctggga

SEQ ID NO: 723844 - DNA, 20 bp, Artificial
  CRISPR gRNA sequence
tccagctgggaggacagagg

SEQ ID NO: 723845 - DNA, 20 bp, Artificial
  CRISPR gRNA sequence
ccagctgggaggacagaggc

SEQ ID NO: 723846 - DNA, 20 bp, Artificial
  CRISPR gRNA sequence
cagctgggaggacagaggct

SEQ ID NO: 723847 - DNA, 20 bp, Artificial
  CRISPR gRNA sequence
ggaggacagaggctcggaga

SEQ ID NO: 723848 - DNA, 20 bp, Artificial
  CRISPR gRNA sequence
ggagaagggaagtaatattg

SEQ ID NO: 723849 - DNA, 20 bp, Artificial
  CRISPR gRNA sequence
tgctgagtttcaccgccaag

SEQ ID NO: 723850 - DNA, 20 bp, Artificial
  CRISPR gRNA sequence
agtttcaccgccaaggaggc

SEQ ID NO: 723851 - DNA, 20 bp, Artificial
  CRISPR gRNA sequence
caccgccaaggaggcccctg

SEQ ID NO: 723852 - DNA, 20 bp, Artificial
  CRISPR gRNA sequence
accgccaaggaggcccctgc

SEQ ID NO: 723853 - DNA, 20 bp, Artificial
  CRISPR gRNA sequence
ctccagggtggctaagcggc

SEQ ID NO: 723854 - DNA, 20 bp, Artificial
  CRISPR gRNA sequence
cagggtggctaagcggcctc

SEQ ID NO: 723855 - DNA, 20 bp, Artificial
  CRISPR gRNA sequence
agcggcctcattgtttttga

SEQ ID NO: 723856 - DNA, 20 bp, Artificial
  CRISPR gRNA sequence
attgtttttgacatttggct

SEQ ID NO: 723857 - DNA, 20 bp, Artificial
  CRISPR gRNA sequence
tttttgacatttggctggtt

SEQ ID NO: 723858 - DNA, 20 bp, Artificial
  CRISPR gRNA sequence
ttgacatttggctggttttc

SEQ ID NO: 723859 - DNA, 20 bp, Artificial
  CRISPR gRNA sequence
tgacatttggctggttttca

SEQ ID NO: 723860 - DNA, 20 bp, Artificial
  CRISPR gRNA sequence
gacatttggctggttttcaa

SEQ ID NO: 723861 - DNA, 20 bp, Artificial
  CRISPR gRNA sequence
acatttggctggttttcaat

SEQ ID NO: 723862 - DNA, 20 bp, Artificial
  CRISPR gRNA sequence
ggctggttttcaatttgagg

SEQ ID NO: 723863 - DNA, 20 bp, Artificial
  CRISPR gRNA sequence
gctggttttcaatttgaggg

SEQ ID NO: 723864 - DNA, 20 bp, Artificial
  CRISPR gRNA sequence
gttttcaatttgagggttat

SEQ ID NO: 723865 - DNA, 20 bp, Artificial
  CRISPR gRNA sequence
tcaatttgagggttattata

SEQ ID NO: 723866 - DNA, 20 bp, Artificial
  CRISPR gRNA sequence
caatttgagggttattataa

SEQ ID NO: 723867 - DNA, 20 bp, Artificial
  CRISPR gRNA sequence
aatttgagggttattataaa

SEQ ID NO: 723868 - DNA, 20 bp, Artificial
  CRISPR gRNA sequence
gagggttattataaacccgc

SEQ ID NO: 723869 - DNA, 20 bp, Artificial
  CRISPR gRNA sequence
agggttattataaacccgct

SEQ ID NO: 723870 - DNA, 20 bp, Artificial
  CRISPR gRNA sequence
ttataaacccgctgctgtgc

SEQ ID NO: 723871 - DNA, 20 bp, Artificial
  CRISPR gRNA sequence
taaacccgctgctgtgctcg

SEQ ID NO: 723872 - DNA, 20 bp, Artificial
  CRISPR gRNA sequence
ctgtgctcggcctttttgtt

SEQ ID NO: 723873 - DNA, 20 bp, Artificial
  CRISPR gRNA sequence
tgctcggcctttttgttttc

SEQ ID NO: 723874 - DNA, 20 bp, Artificial
  CRISPR gRNA sequence
ggcctttttgttttctttcg

SEQ ID NO: 723875 - DNA, 20 bp, Artificial
  CRISPR gRNA sequence
tttgttttctttcgggttat

SEQ ID NO: 723876 - DNA, 20 bp, Artificial
  CRISPR gRNA sequence
ttgttttctttcgggttatt

SEQ ID NO: 723877 - DNA, 20 bp, Artificial
  CRISPR gRNA sequence
tgttttctttcgggttattt

SEQ ID NO: 723878 - DNA, 20 bp, Artificial
  CRISPR gRNA sequence
gttttctttcgggttatttc

SEQ ID NO: 723879 - DNA, 20 bp, Artificial
  CRISPR gRNA sequence
ttttctttcgggttatttcc

SEQ ID NO: 723880 - DNA, 20 bp, Artificial
  CRISPR gRNA sequence
tctttcgggttatttcctga

SEQ ID NO: 723881 - DNA, 20 bp, Artificial
  CRISPR gRNA sequence
ctttcgggttatttcctgag

SEQ ID NO: 723882 - DNA, 20 bp, Artificial
  CRISPR gRNA sequence
tttcgggttatttcctgagg

SEQ ID NO: 723883 - DNA, 20 bp, Artificial
  CRISPR gRNA sequence
tcgggttatttcctgagggt

SEQ ID NO: 723884 - DNA, 20 bp, Artificial
  CRISPR gRNA sequence
cgggttatttcctgagggtg

SEQ ID NO: 723885 - DNA, 20 bp, Artificial
  CRISPR gRNA sequence
gggttatttcctgagggtgt

SEQ ID NO: 723886 - DNA, 20 bp, Artificial
  CRISPR gRNA sequence
tttcctgagggtgtgttccc

SEQ ID NO: 723887 - DNA, 20 bp, Artificial
  CRISPR gRNA sequence
cctgagggtgtgttccctca

SEQ ID NO: 723888 - DNA, 20 bp, Artificial
  CRISPR gRNA sequence
ctgagggtgtgttccctcaa

SEQ ID NO: 723889 - DNA, 20 bp, Artificial
  CRISPR gRNA sequence
agggtgtgttccctcaagag

SEQ ID NO: 723890 - DNA, 20 bp, Artificial
  CRISPR gRNA sequence
cctcaagagggatgactggg

SEQ ID NO: 723891 - DNA, 20 bp, Artificial
  CRISPR gRNA sequence
aagagggatgactgggtaaa

SEQ ID NO: 723892 - DNA, 20 bp, Artificial
  CRISPR gRNA sequence
ggtaaagagtgtgaggtttt

SEQ ID NO: 723893 - DNA, 20 bp, Artificial
  CRISPR gRNA sequence
ttgttgccagatggctcttt

SEQ ID NO: 723894 - DNA, 20 bp, Artificial
  CRISPR gRNA sequence
tgttgccagatggctcttta

SEQ ID NO: 723895 - DNA, 20 bp, Artificial
  CRISPR gRNA sequence
gttgccagatggctctttag

SEQ ID NO: 723896 - DNA, 20 bp, Artificial
  CRISPR gRNA sequence
ttgccagatggctctttaga

SEQ ID NO: 723897 - DNA, 20 bp, Artificial
  CRISPR gRNA sequence
ccagatggctctttagaaaa

SEQ ID NO: 723898 - DNA, 20 bp, Artificial
  CRISPR gRNA sequence
tttagaaaaatggaaccagc

SEQ ID NO: 723899 - DNA, 20 bp, Artificial
  CRISPR gRNA sequence
tagaaaaatggaaccagcct

SEQ ID NO: 723900 - DNA, 20 bp, Artificial
  CRISPR gRNA sequence
agaaaaatggaaccagcctg

SEQ ID NO: 723901 - DNA, 20 bp, Artificial
  CRISPR gRNA sequence
gaaaaatggaaccagcctgc

SEQ ID NO: 723902 - DNA, 20 bp, Artificial
  CRISPR gRNA sequence
cagggtatgggcagctctgc

SEQ ID NO: 723903 - DNA, 20 bp, Artificial
  CRISPR gRNA sequence
tgcgatcccgttcacccact

SEQ ID NO: 723904 - DNA, 20 bp, Artificial
  CRISPR gRNA sequence
cgatcccgttcacccacttc

SEQ ID NO: 723905 - DNA, 20 bp, Artificial
  CRISPR gRNA sequence
acccacttccccttcaaggc

SEQ ID NO: 723906 - DNA, 20 bp, Artificial
  CRISPR gRNA sequence
ccccttcaaggccgagttgt

SEQ ID NO: 723907 - DNA, 20 bp, Artificial
  CRISPR gRNA sequence
cccttcaaggccgagttgtg

SEQ ID NO: 723908 - DNA, 20 bp, Artificial
  CRISPR gRNA sequence
caaggccgagttgtgtcatt

SEQ ID NO: 723909 - DNA, 20 bp, Artificial
  CRISPR gRNA sequence
aaggccgagttgtgtcattt

SEQ ID NO: 723910 - DNA, 20 bp, Artificial
  CRISPR gRNA sequence
tgtcatttttatttattttg

SEQ ID NO: 723911 - DNA, 20 bp, Artificial
  CRISPR gRNA sequence
ttatttattttgttttgtta

SEQ ID NO: 723912 - DNA, 20 bp, Artificial
  CRISPR gRNA sequence
tatttattttgttttgttac

SEQ ID NO: 723913 - DNA, 20 bp, Artificial
  CRISPR gRNA sequence
atttattttgttttgttact

SEQ ID NO: 723914 - DNA, 20 bp, Artificial
  CRISPR gRNA sequence
tttattttgttttgttactt

SEQ ID NO: 723915 - DNA, 20 bp, Artificial
  CRISPR gRNA sequence
attttgttttgttactttgt

SEQ ID NO: 723916 - DNA, 20 bp, Artificial
  CRISPR gRNA sequence
ttttgttttgttactttgtc

SEQ ID NO: 723917 - DNA, 20 bp, Artificial
  CRISPR gRNA sequence
tgttttgttactttgtcaca

SEQ ID NO: 723918 - DNA, 20 bp, Artificial
  CRISPR gRNA sequence
gttttgttactttgtcacac

SEQ ID NO: 723919 - DNA, 20 bp, Artificial
  CRISPR gRNA sequence
ttttgttactttgtcacact

SEQ ID NO: 723920 - DNA, 20 bp, Artificial
  CRISPR gRNA sequence
tgttactttgtcacactttt

SEQ ID NO: 723921 - DNA, 20 bp, Artificial
  CRISPR gRNA sequence
gttactttgtcacacttttt

SEQ ID NO: 723922 - DNA, 20 bp, Artificial
  CRISPR gRNA sequence
ttactttgtcacactttttt

SEQ ID NO: 723923 - DNA, 20 bp, Artificial
  CRISPR gRNA sequence
ctttgtcacacttttttttt

SEQ ID NO: 723924 - DNA, 20 bp, Artificial
  CRISPR gRNA sequence
tgtcacactttttttttttt

SEQ ID NO: 723925 - DNA, 20 bp, Artificial
  CRISPR gRNA sequence
gtcacactttttttttttta

SEQ ID NO: 723926 - DNA, 20 bp, Artificial
  CRISPR gRNA sequence
tcacacttttttttttttat

SEQ ID NO: 723927 - DNA, 20 bp, Artificial
  CRISPR gRNA sequence
ttttttttttattctgttgg

SEQ ID NO: 723928 - DNA, 20 bp, Artificial
  CRISPR gRNA sequence
tttttttttattctgttggc

SEQ ID NO: 723929 - DNA, 20 bp, Artificial
  CRISPR gRNA sequence
ttttttttattctgttggcc

SEQ ID NO: 723930 - DNA, 20 bp, Artificial
  CRISPR gRNA sequence
tttttttattctgttggcca

SEQ ID NO: 723931 - DNA, 20 bp, Artificial
  CRISPR gRNA sequence
ttttttattctgttggccac

SEQ ID NO: 723932 - DNA, 20 bp, Artificial
  CRISPR gRNA sequence
tttttattctgttggccacc

SEQ ID NO: 723933 - DNA, 20 bp, Artificial
  CRISPR gRNA sequence
ttttattctgttggccaccc

SEQ ID NO: 723934 - DNA, 20 bp, Artificial
  CRISPR gRNA sequence
tttattctgttggccacccc

SEQ ID NO: 723935 - DNA, 20 bp, Artificial
  CRISPR gRNA sequence
ttattctgttggccaccccc

SEQ ID NO: 723936 - DNA, 20 bp, Artificial
  CRISPR gRNA sequence
tattctgttggccaccccca

SEQ ID NO: 723937 - DNA, 20 bp, Artificial
  CRISPR gRNA sequence
attctgttggccacccccag

SEQ ID NO: 723938 - DNA, 20 bp, Artificial
  CRISPR gRNA sequence
ttctgttggccacccccagt

SEQ ID NO: 723939 - DNA, 20 bp, Artificial
  CRISPR gRNA sequence
tgttggccacccccagtgac

SEQ ID NO: 723940 - DNA, 20 bp, Artificial
  CRISPR gRNA sequence
ttggccacccccagtgactt

SEQ ID NO: 723941 - DNA, 20 bp, Artificial
  CRISPR gRNA sequence
gccacccccagtgacttggt

SEQ ID NO: 723942 - DNA, 20 bp, Artificial
  CRISPR gRNA sequence
ggtaccaaagaacagttggc

SEQ ID NO: 723943 - DNA, 20 bp, Artificial
  CRISPR gRNA sequence
gtaccaaagaacagttggct

SEQ ID NO: 723944 - DNA, 20 bp, Artificial
  CRISPR gRNA sequence
gctgcttgtaaaactcaaaa

SEQ ID NO: 723945 - DNA, 20 bp, Artificial
  CRISPR gRNA sequence
cttgtaaaactcaaaatcac

SEQ ID NO: 723946 - DNA, 20 bp, Artificial
  CRISPR gRNA sequence
gtaaaactcaaaatcactct

SEQ ID NO: 723947 - DNA, 20 bp, Artificial
  CRISPR gRNA sequence
taaaactcaaaatcactctg

SEQ ID NO: 723948 - DNA, 20 bp, Artificial
  CRISPR gRNA sequence
aaaatcactctggagggacc

SEQ ID NO: 723949 - DNA, 20 bp, Artificial
  CRISPR gRNA sequence
tggagggaccatgatttagt

SEQ ID NO: 723950 - DNA, 20 bp, Artificial
  CRISPR gRNA sequence
gagggaccatgatttagttt

SEQ ID NO: 723951 - DNA, 20 bp, Artificial
  CRISPR gRNA sequence
agtttcactgacgtcattga

SEQ ID NO: 723952 - DNA, 20 bp, Artificial
  CRISPR gRNA sequence
gtttcactgacgtcattgaa

SEQ ID NO: 723953 - DNA, 20 bp, Artificial
  CRISPR gRNA sequence
cactgacgtcattgaaaaga

SEQ ID NO: 723954 - DNA, 20 bp, Artificial
  CRISPR gRNA sequence
actgacgtcattgaaaagaa

SEQ ID NO: 723955 - DNA, 20 bp, Artificial
  CRISPR gRNA sequence
acgtcattgaaaagaatgtg

SEQ ID NO: 723956 - DNA, 20 bp, Artificial
  CRISPR gRNA sequence
aaaagaatgtgcctcggccg

SEQ ID NO: 723957 - DNA, 20 bp, Artificial
  CRISPR gRNA sequence
ggccgggtgccgtggctcac

SEQ ID NO: 723958 - DNA, 20 bp, Artificial
  CRISPR gRNA sequence
acgcctgtaatcccagcact

SEQ ID NO: 723959 - DNA, 20 bp, Artificial
  CRISPR gRNA sequence
taatcccagcactttgggag

SEQ ID NO: 723960 - DNA, 20 bp, Artificial
  CRISPR gRNA sequence
tgggaggccgaggcgggtgg

SEQ ID NO: 723961 - DNA, 20 bp, Artificial
  CRISPR gRNA sequence
gggaggccgaggcgggtgga

SEQ ID NO: 723962 - DNA, 20 bp, Artificial
  CRISPR gRNA sequence
ggaggccgaggcgggtggat

SEQ ID NO: 723963 - DNA, 20 bp, Artificial
  CRISPR gRNA sequence
gccaacatggtgaaaccccg

SEQ ID NO: 723964 - DNA, 20 bp, Artificial
  CRISPR gRNA sequence
tactaaaaatacaaaaatta

SEQ ID NO: 723965 - DNA, 20 bp, Artificial
  CRISPR gRNA sequence
ctaaaaatacaaaaattagc

SEQ ID NO: 723966 - DNA, 20 bp, Artificial
  CRISPR gRNA sequence
aaaatacaaaaattagctga

SEQ ID NO: 723967 - DNA, 20 bp, Artificial
  CRISPR gRNA sequence
gctgagcatggtggtgcgtg

SEQ ID NO: 723968 - DNA, 20 bp, Artificial
  CRISPR gRNA sequence
agcatggtggtgcgtgcctg

SEQ ID NO: 723969 - DNA, 20 bp, Artificial
  CRISPR gRNA sequence
taatcccagctactcgggag

SEQ ID NO: 723970 - DNA, 20 bp, Artificial
  CRISPR gRNA sequence
ctcgggaggctgaggcagga

SEQ ID NO: 723971 - DNA, 20 bp, Artificial
  CRISPR gRNA sequence
gggaggctgaggcaggagaa

SEQ ID NO: 723972 - DNA, 20 bp, Artificial
  CRISPR gRNA sequence
aggcaggagaatcgcttgaa

SEQ ID NO: 723973 - DNA, 20 bp, Artificial
  CRISPR gRNA sequence
gaacccaggaggcggaggtt

SEQ ID NO: 723974 - DNA, 20 bp, Artificial
  CRISPR gRNA sequence
aacccaggaggcggaggttg

SEQ ID NO: 723975 - DNA, 20 bp, Artificial
  CRISPR gRNA sequence
cagtgagccgagatcgcgct

SEQ ID NO: 723976 - DNA, 20 bp, Artificial
  CRISPR gRNA sequence
ctgcacttcaccctggcgac

SEQ ID NO: 723977 - DNA, 20 bp, Artificial
  CRISPR gRNA sequence
cacttcaccctggcgacaga

SEQ ID NO: 723978 - DNA, 20 bp, Artificial
  CRISPR gRNA sequence
caccctggcgacagagttag

SEQ ID NO: 723979 - DNA, 20 bp, Artificial
  CRISPR gRNA sequence
accctggcgacagagttaga

SEQ ID NO: 723980 - DNA, 20 bp, Artificial
  CRISPR gRNA sequence
gcgacagagttagactccat

SEQ ID NO: 723981 - DNA, 20 bp, Artificial
  CRISPR gRNA sequence
gactccatctcaaaaaaaaa

SEQ ID NO: 723982 - DNA, 20 bp, Artificial
  CRISPR gRNA sequence
catctcaaaaaaaaaaaaaa

SEQ ID NO: 723983 - DNA, 20 bp, Artificial
  CRISPR gRNA sequence
aaaaaaaaaaaaaaaaaaaa

SEQ ID NO: 723984 - DNA, 20 bp, Artificial
  CRISPR gRNA sequence
cccctggccgggcaaggtgg

SEQ ID NO: 723985 - DNA, 20 bp, Artificial
  CRISPR gRNA sequence
gccgggcaaggtggctcatg

SEQ ID NO: 723986 - DNA, 20 bp, Artificial
  CRISPR gRNA sequence
atgcctgtaatcccagcact

SEQ ID NO: 723987 - DNA, 20 bp, Artificial
  CRISPR gRNA sequence
taatcccagcacttcgagag

SEQ ID NO: 723988 - DNA, 20 bp, Artificial
  CRISPR gRNA sequence
cgagaggccgaggcgggcag

SEQ ID NO: 723989 - DNA, 20 bp, Artificial
  CRISPR gRNA sequence
gagaggccgaggcgggcaga

SEQ ID NO: 723990 - DNA, 20 bp, Artificial
  CRISPR gRNA sequence
aggtcaggagttggagacca

SEQ ID NO: 723991 - DNA, 20 bp, Artificial
  CRISPR gRNA sequence
gagaccaacctggccaacat

SEQ ID NO: 723992 - DNA, 20 bp, Artificial
  CRISPR gRNA sequence
gccaacatggtgaaaccttg

SEQ ID NO: 723993 - DNA, 20 bp, Artificial
  CRISPR gRNA sequence
gtttctactaaaaatacaaa

SEQ ID NO: 723994 - DNA, 20 bp, Artificial
  CRISPR gRNA sequence
tttctactaaaaatacaaaa

SEQ ID NO: 723995 - DNA, 20 bp, Artificial
  CRISPR gRNA sequence
ctactaaaaatacaaaaatt

SEQ ID NO: 723996 - DNA, 20 bp, Artificial
  CRISPR gRNA sequence
tactaaaaatacaaaaatta

SEQ ID NO: 723997 - DNA, 20 bp, Artificial
  CRISPR gRNA sequence
ctaaaaatacaaaaattagc

SEQ ID NO: 723998 - DNA, 20 bp, Artificial
  CRISPR gRNA sequence
aaaatacaaaaattagccgg

SEQ ID NO: 723999 - DNA, 20 bp, Artificial
  CRISPR gRNA sequence
gccgggcgtggtggcacatg

SEQ ID NO: 724000 - DNA, 20 bp, Artificial
  CRISPR gRNA sequence
cttgtgagaattgcttaaac

SEQ ID NO: 724001 - DNA, 20 bp, Artificial
  CRISPR gRNA sequence
gtgagaattgcttaaacctg

SEQ ID NO: 724002 - DNA, 20 bp, Artificial
  CRISPR gRNA sequence
tgagaattgcttaaacctgt

SEQ ID NO: 724003 - DNA, 20 bp, Artificial
  CRISPR gRNA sequence
cttaaacctgtgaggcagag

SEQ ID NO: 724004 - DNA, 20 bp, Artificial
  CRISPR gRNA sequence
aaacctgtgaggcagaggtt

SEQ ID NO: 724005 - DNA, 20 bp, Artificial
  CRISPR gRNA sequence
aacctgtgaggcagaggttg

SEQ ID NO: 724006 - DNA, 20 bp, Artificial
  CRISPR gRNA sequence
tgaggcagaggttgcagtga

SEQ ID NO: 724007 - DNA, 20 bp, Artificial
  CRISPR gRNA sequence
cagtgagccaagatcgtgcc

SEQ ID NO: 724008 - DNA, 20 bp, Artificial
  CRISPR gRNA sequence
cactccagcctgggtgacag

SEQ ID NO: 724009 - DNA, 20 bp, Artificial
  CRISPR gRNA sequence
cagcctgggtgacagagtga

SEQ ID NO: 724010 - DNA, 20 bp, Artificial
  CRISPR gRNA sequence
ggtgacagagtgagactctg

SEQ ID NO: 724011 - DNA, 20 bp, Artificial
  CRISPR gRNA sequence
tgtctcaaaaaaagaaaaaa

SEQ ID NO: 724012 - DNA, 20 bp, Artificial
  CRISPR gRNA sequence
tctcaaaaaaagaaaaaatt

SEQ ID NO: 724013 - DNA, 20 bp, Artificial
  CRISPR gRNA sequence
aaaaaaagaaaaaattaccc

SEQ ID NO: 724014 - DNA, 20 bp, Artificial
  CRISPR gRNA sequence
cccctaagagtgtttcccaa

SEQ ID NO: 724015 - DNA, 20 bp, Artificial
  CRISPR gRNA sequence
agagtgtttcccaaactcac

SEQ ID NO: 724016 - DNA, 20 bp, Artificial
  CRISPR gRNA sequence
cccaaactcacctagtgtcc

SEQ ID NO: 724017 - DNA, 20 bp, Artificial
  CRISPR gRNA sequence
ccaaactcacctagtgtcca

SEQ ID NO: 724018 - DNA, 20 bp, Artificial
  CRISPR gRNA sequence
acctagtgtccacacagcgt

SEQ ID NO: 724019 - DNA, 20 bp, Artificial
  CRISPR gRNA sequence
gtgtccacacagcgtgttca

SEQ ID NO: 724020 - DNA, 20 bp, Artificial
  CRISPR gRNA sequence
aaatggtcagtcttgcgtat

SEQ ID NO: 724021 - DNA, 20 bp, Artificial
  CRISPR gRNA sequence
gcgtatactttatcctactt

SEQ ID NO: 724022 - DNA, 20 bp, Artificial
  CRISPR gRNA sequence
cgtatactttatcctacttg

SEQ ID NO: 724023 - DNA, 20 bp, Artificial
  CRISPR gRNA sequence
tatcctacttgttgactgag

SEQ ID NO: 724024 - DNA, 20 bp, Artificial
  CRISPR gRNA sequence
atcctacttgttgactgagc

SEQ ID NO: 724025 - DNA, 20 bp, Artificial
  CRISPR gRNA sequence
tcctacttgttgactgagca

SEQ ID NO: 724026 - DNA, 20 bp, Artificial
  CRISPR gRNA sequence
cttgttgactgagcactggt

SEQ ID NO: 724027 - DNA, 20 bp, Artificial
  CRISPR gRNA sequence
gttgactgagcactggtgag

SEQ ID NO: 724028 - DNA, 20 bp, Artificial
  CRISPR gRNA sequence
ttgactgagcactggtgagc

SEQ ID NO: 724029 - DNA, 20 bp, Artificial
  CRISPR gRNA sequence
actgagcactggtgagcata

SEQ ID NO: 724030 - DNA, 20 bp, Artificial
  CRISPR gRNA sequence
agcactggtgagcatatctg

SEQ ID NO: 724031 - DNA, 20 bp, Artificial
  CRISPR gRNA sequence
gtgagcatatctgtgaggac

SEQ ID NO: 724032 - DNA, 20 bp, Artificial
  CRISPR gRNA sequence
tgaggactcagggctggtgg

SEQ ID NO: 724033 - DNA, 20 bp, Artificial
  CRISPR gRNA sequence
agggctggtggctctccaga

SEQ ID NO: 724034 - DNA, 20 bp, Artificial
  CRISPR gRNA sequence
gtggctctccagagctgctg

SEQ ID NO: 724035 - DNA, 20 bp, Artificial
  CRISPR gRNA sequence
tccagagctgctgaagtcag

SEQ ID NO: 724036 - DNA, 20 bp, Artificial
  CRISPR gRNA sequence
cagagctgctgaagtcagag

SEQ ID NO: 724037 - DNA, 20 bp, Artificial
  CRISPR gRNA sequence
ctgaagtcagagatgtgtgc

SEQ ID NO: 724038 - DNA, 20 bp, Artificial
  CRISPR gRNA sequence
aagtcagagatgtgtgcagg

SEQ ID NO: 724039 - DNA, 20 bp, Artificial
  CRISPR gRNA sequence
acatacgggcatcttggtgg

SEQ ID NO: 724040 - DNA, 20 bp, Artificial
  CRISPR gRNA sequence
ggtggcagatttgtctagcc

SEQ ID NO: 724041 - DNA, 20 bp, Artificial
  CRISPR gRNA sequence
gtggcagatttgtctagcca

SEQ ID NO: 724042 - DNA, 20 bp, Artificial
  CRISPR gRNA sequence
gtctagccagggatgtgtgc

SEQ ID NO: 724043 - DNA, 20 bp, Artificial
  CRISPR gRNA sequence
tctagccagggatgtgtgcc

SEQ ID NO: 724044 - DNA, 20 bp, Artificial
  CRISPR gRNA sequence
gccagggatgtgtgcctgac

SEQ ID NO: 724045 - DNA, 20 bp, Artificial
  CRISPR gRNA sequence
acaacagcatattccagatc

SEQ ID NO: 724046 - DNA, 20 bp, Artificial
  CRISPR gRNA sequence
cagatctccgtaggtagcgt

SEQ ID NO: 724047 - DNA, 20 bp, Artificial
  CRISPR gRNA sequence
cgtaggtagcgttctcagga

SEQ ID NO: 724048 - DNA, 20 bp, Artificial
  CRISPR gRNA sequence
tcaggagtggttaaaagctg

SEQ ID NO: 724049 - DNA, 20 bp, Artificial
  CRISPR gRNA sequence
aggagtggttaaaagctggg

SEQ ID NO: 724050 - DNA, 20 bp, Artificial
  CRISPR gRNA sequence
aaagctgggcatccctggag

SEQ ID NO: 724051 - DNA, 20 bp, Artificial
  CRISPR gRNA sequence
ggcatccctggaggatggtc

SEQ ID NO: 724052 - DNA, 20 bp, Artificial
  CRISPR gRNA sequence
gaggatggtctgctctggga

SEQ ID NO: 724053 - DNA, 20 bp, Artificial
  CRISPR gRNA sequence
ctctgggaactgacttgctc

SEQ ID NO: 724054 - DNA, 20 bp, Artificial
  CRISPR gRNA sequence
tgggaactgacttgctccag

SEQ ID NO: 724055 - DNA, 20 bp, Artificial
  CRISPR gRNA sequence
ggaactgacttgctccagga

SEQ ID NO: 724056 - DNA, 20 bp, Artificial
  CRISPR gRNA sequence
acttgctccaggatgagtta

SEQ ID NO: 724057 - DNA, 20 bp, Artificial
  CRISPR gRNA sequence
gctccaggatgagttagatg

SEQ ID NO: 724058 - DNA, 20 bp, Artificial
  CRISPR gRNA sequence
ctccaggatgagttagatgc

SEQ ID NO: 724059 - DNA, 20 bp, Artificial
  CRISPR gRNA sequence
caggatgagttagatgcccg

SEQ ID NO: 724060 - DNA, 20 bp, Artificial
  CRISPR gRNA sequence
gatgcccggatgccctctca

SEQ ID NO: 724061 - DNA, 20 bp, Artificial
  CRISPR gRNA sequence
tcacctttctcagatggcca

SEQ ID NO: 724062 - DNA, 20 bp, Artificial
  CRISPR gRNA sequence
acctttctcagatggccagt

SEQ ID NO: 724063 - DNA, 20 bp, Artificial
  CRISPR gRNA sequence
tctcagatggccagtgagcc

SEQ ID NO: 724064 - DNA, 20 bp, Artificial
  CRISPR gRNA sequence
ctcagatggccagtgagcca

SEQ ID NO: 724065 - DNA, 20 bp, Artificial
  CRISPR gRNA sequence
tcagatggccagtgagccaa

SEQ ID NO: 724066 - DNA, 20 bp, Artificial
  CRISPR gRNA sequence
agatggccagtgagccaagg

SEQ ID NO: 724067 - DNA, 20 bp, Artificial
  CRISPR gRNA sequence
aatgttaaatgtcaatatgt

SEQ ID NO: 724068 - DNA, 20 bp, Artificial
  CRISPR gRNA sequence
aatgtcaatatgtgcttggg

SEQ ID NO: 724069 - DNA, 20 bp, Artificial
  CRISPR gRNA sequence
gggcgtgacctggcccctgt

SEQ ID NO: 724070 - DNA, 20 bp, Artificial
  CRISPR gRNA sequence
ggcgtgacctggcccctgtt

SEQ ID NO: 724071 - DNA, 20 bp, Artificial
  CRISPR gRNA sequence
gcccctgtttaatatgggag

SEQ ID NO: 724072 - DNA, 20 bp, Artificial
  CRISPR gRNA sequence
tttaatatgggagaacaatg

SEQ ID NO: 724073 - DNA, 20 bp, Artificial
  CRISPR gRNA sequence
aatatgggagaacaatggga

SEQ ID NO: 724074 - DNA, 20 bp, Artificial
  CRISPR gRNA sequence
atatgggagaacaatgggag

SEQ ID NO: 724075 - DNA, 20 bp, Artificial
  CRISPR gRNA sequence
gagatgagaagatagaggtt

SEQ ID NO: 724076 - DNA, 20 bp, Artificial
  CRISPR gRNA sequence
agatgagaagatagaggttg

SEQ ID NO: 724077 - DNA, 20 bp, Artificial
  CRISPR gRNA sequence
tgcgttgagaatcattgtat

SEQ ID NO: 724078 - DNA, 20 bp, Artificial
  CRISPR gRNA sequence
agaatcattgtatcagcacc

SEQ ID NO: 724079 - DNA, 20 bp, Artificial
  CRISPR gRNA sequence
tatcagcacctcctgagcct

SEQ ID NO: 724080 - DNA, 20 bp, Artificial
  CRISPR gRNA sequence
ctgagcctacaaaaggatgg

SEQ ID NO: 724081 - DNA, 20 bp, Artificial
  CRISPR gRNA sequence
agcctacaaaaggatgggat

SEQ ID NO: 724082 - DNA, 20 bp, Artificial
  CRISPR gRNA sequence
caaaaggatgggattgaagg

SEQ ID NO: 724083 - DNA, 20 bp, Artificial
  CRISPR gRNA sequence
aaggaaatgagatggcccga

SEQ ID NO: 724084 - DNA, 20 bp, Artificial
  CRISPR gRNA sequence
tcctcctcgaaggctgccac

SEQ ID NO: 724085 - DNA, 20 bp, Artificial
  CRISPR gRNA sequence
ctcgaaggctgccacctggg

SEQ ID NO: 724086 - DNA, 20 bp, Artificial
  CRISPR gRNA sequence
gaaggctgccacctgggtgc

SEQ ID NO: 724087 - DNA, 20 bp, Artificial
  CRISPR gRNA sequence
ccacctgggtgctttcaggc

SEQ ID NO: 724088 - DNA, 20 bp, Artificial
  CRISPR gRNA sequence
ggtgctttcaggcacaagaa

SEQ ID NO: 724089 - DNA, 20 bp, Artificial
  CRISPR gRNA sequence
tcaggcacaagaaagagaaa

SEQ ID NO: 724090 - DNA, 20 bp, Artificial
  CRISPR gRNA sequence
caggcacaagaaagagaaaa

SEQ ID NO: 724091 - DNA, 20 bp, Artificial
  CRISPR gRNA sequence
aggcacaagaaagagaaaat

SEQ ID NO: 724092 - DNA, 20 bp, Artificial
  CRISPR gRNA sequence
gagtcagaagggctccacag

SEQ ID NO: 724093 - DNA, 20 bp, Artificial
  CRISPR gRNA sequence
cacagcagactggcttcggg

SEQ ID NO: 724094 - DNA, 20 bp, Artificial
  CRISPR gRNA sequence
gcttcgggcgtgtcccaggc

SEQ ID NO: 724095 - DNA, 20 bp, Artificial
  CRISPR gRNA sequence
cgggcgtgtcccaggcaggg

SEQ ID NO: 724096 - DNA, 20 bp, Artificial
  CRISPR gRNA sequence
gggcgtgtcccaggcagggt

SEQ ID NO: 724097 - DNA, 20 bp, Artificial
  CRISPR gRNA sequence
caggatccatcatcctgtct

SEQ ID NO: 724098 - DNA, 20 bp, Artificial
  CRISPR gRNA sequence
tctccatgacctgccttgag

SEQ ID NO: 724099 - DNA, 20 bp, Artificial
  CRISPR gRNA sequence
catgacctgccttgaggtcc

SEQ ID NO: 724100 - DNA, 20 bp, Artificial
  CRISPR gRNA sequence
ccttgaggtcctccatgtgg

SEQ ID NO: 724101 - DNA, 20 bp, Artificial
  CRISPR gRNA sequence
gaggtcctccatgtgggttt

SEQ ID NO: 724102 - DNA, 20 bp, Artificial
  CRISPR gRNA sequence
aggtcctccatgtgggtttt

SEQ ID NO: 724103 - DNA, 20 bp, Artificial
  CRISPR gRNA sequence
catgtgggttttgcctggta

SEQ ID NO: 724104 - DNA, 20 bp, Artificial
  CRISPR gRNA sequence
tgcctggtattccagagaat

SEQ ID NO: 724105 - DNA, 20 bp, Artificial
  CRISPR gRNA sequence
gcctggtattccagagaatt

SEQ ID NO: 724106 - DNA, 20 bp, Artificial
  CRISPR gRNA sequence
cctggtattccagagaattc

SEQ ID NO: 724107 - DNA, 20 bp, Artificial
  CRISPR gRNA sequence
gtattccagagaattcgggg

SEQ ID NO: 724108 - DNA, 20 bp, Artificial
  CRISPR gRNA sequence
cagagaattcggggctctcc

SEQ ID NO: 724109 - DNA, 20 bp, Artificial
  CRISPR gRNA sequence
ggggctctccacaccctgga

SEQ ID NO: 724110 - DNA, 20 bp, Artificial
  CRISPR gRNA sequence
tccacaccctggagacagta

SEQ ID NO: 724111 - DNA, 20 bp, Artificial
  CRISPR gRNA sequence
cacaccctggagacagtaag

SEQ ID NO: 724112 - DNA, 20 bp, Artificial
  CRISPR gRNA sequence
gagacagtaaggtgggcgca

SEQ ID NO: 724113 - DNA, 20 bp, Artificial
  CRISPR gRNA sequence
tgacccagtggaagcctcct

SEQ ID NO: 724114 - DNA, 20 bp, Artificial
  CRISPR gRNA sequence
acccagtggaagcctcctgg

SEQ ID NO: 724115 - DNA, 20 bp, Artificial
  CRISPR gRNA sequence
ctgggctctggttgggcctg

SEQ ID NO: 724116 - DNA, 20 bp, Artificial
  CRISPR gRNA sequence
ggctctggttgggcctgtgc

SEQ ID NO: 724117 - DNA, 20 bp, Artificial
  CRISPR gRNA sequence
tggttgggcctgtgcttctc

SEQ ID NO: 724118 - DNA, 20 bp, Artificial
  CRISPR gRNA sequence
gttgggcctgtgcttctcgt

SEQ ID NO: 724119 - DNA, 20 bp, Artificial
  CRISPR gRNA sequence
ggcctgtgcttctcgtgaac

SEQ ID NO: 724120 - DNA, 20 bp, Artificial
  CRISPR gRNA sequence
tgcttctcgtgaaccaatcc

SEQ ID NO: 724121 - DNA, 20 bp, Artificial
  CRISPR gRNA sequence
ctcgtgaaccaatccttgca

SEQ ID NO: 724122 - DNA, 20 bp, Artificial
  CRISPR gRNA sequence
tcgtgaaccaatccttgcat

SEQ ID NO: 724123 - DNA, 20 bp, Artificial
  CRISPR gRNA sequence
gtgaaccaatccttgcatgt

SEQ ID NO: 724124 - DNA, 20 bp, Artificial
  CRISPR gRNA sequence
gcatgtgcgcgggggtgggg

SEQ ID NO: 724125 - DNA, 20 bp, Artificial
  CRISPR gRNA sequence
catgtgcgcgggggtggggg

SEQ ID NO: 724126 - DNA, 20 bp, Artificial
  CRISPR gRNA sequence
ggagagtggttcagtgtgtt

SEQ ID NO: 724127 - DNA, 20 bp, Artificial
  CRISPR gRNA sequence
agtgtgttcattggtttagt

SEQ ID NO: 724128 - DNA, 20 bp, Artificial
  CRISPR gRNA sequence
attggtttagtcattaggaa

SEQ ID NO: 724129 - DNA, 20 bp, Artificial
  CRISPR gRNA sequence
gtttagtcattaggaatgag

SEQ ID NO: 724130 - DNA, 20 bp, Artificial
  CRISPR gRNA sequence
agtcattaggaatgagagtg

SEQ ID NO: 724131 - DNA, 20 bp, Artificial
  CRISPR gRNA sequence
gtcattaggaatgagagtgg

SEQ ID NO: 724132 - DNA, 20 bp, Artificial
  CRISPR gRNA sequence
ggaatgagagtggcagccag

SEQ ID NO: 724133 - DNA, 20 bp, Artificial
  CRISPR gRNA sequence
acgcctgtaatcccagcact

SEQ ID NO: 724134 - DNA, 20 bp, Artificial
  CRISPR gRNA sequence
taatcccagcactttgcaag

SEQ ID NO: 724135 - DNA, 20 bp, Artificial
  CRISPR gRNA sequence
tgcaaggccaaggcgggcag

SEQ ID NO: 724136 - DNA, 20 bp, Artificial
  CRISPR gRNA sequence
gcaaggccaaggcgggcagg

SEQ ID NO: 724137 - DNA, 20 bp, Artificial
  CRISPR gRNA sequence
caaggccaaggcgggcaggt

SEQ ID NO: 724138 - DNA, 20 bp, Artificial
  CRISPR gRNA sequence
gagaccggcctggccaacgt

SEQ ID NO: 724139 - DNA, 20 bp, Artificial
  CRISPR gRNA sequence
agaccggcctggccaacgtg

SEQ ID NO: 724140 - DNA, 20 bp, Artificial
  CRISPR gRNA sequence
gccaacgtggtgaaaccccg

SEQ ID NO: 724141 - DNA, 20 bp, Artificial
  CRISPR gRNA sequence
tactgaaaatacaaaaaaat

SEQ ID NO: 724142 - DNA, 20 bp, Artificial
  CRISPR gRNA sequence
ctgaaaatacaaaaaaatta

SEQ ID NO: 724143 - DNA, 20 bp, Artificial
  CRISPR gRNA sequence
aaaatacaaaaaaattagct

SEQ ID NO: 724144 - DNA, 20 bp, Artificial
  CRISPR gRNA sequence
gctggggttggtggcacgag

SEQ ID NO: 724145 - DNA, 20 bp, Artificial
  CRISPR gRNA sequence
gggttggtggcacgagccta

SEQ ID NO: 724146 - DNA, 20 bp, Artificial
  CRISPR gRNA sequence
gtggcacgagcctataatcc

SEQ ID NO: 724147 - DNA, 20 bp, Artificial
  CRISPR gRNA sequence
taatcccagctattcgggag

SEQ ID NO: 724148 - DNA, 20 bp, Artificial
  CRISPR gRNA sequence
ttcgggaggctgaggcatga

SEQ ID NO: 724149 - DNA, 20 bp, Artificial
  CRISPR gRNA sequence
gggaggctgaggcatgagaa

SEQ ID NO: 724150 - DNA, 20 bp, Artificial
  CRISPR gRNA sequence
aggcatgagaatcacttgaa

SEQ ID NO: 724151 - DNA, 20 bp, Artificial
  CRISPR gRNA sequence
gaacccaggaggcggaggtt

SEQ ID NO: 724152 - DNA, 20 bp, Artificial
  CRISPR gRNA sequence
aacccaggaggcggaggtta

SEQ ID NO: 724153 - DNA, 20 bp, Artificial
  CRISPR gRNA sequence
cattgagccgagatcatgcc

SEQ ID NO: 724154 - DNA, 20 bp, Artificial
  CRISPR gRNA sequence
agccgagatcatgccactgc

SEQ ID NO: 724155 - DNA, 20 bp, Artificial
  CRISPR gRNA sequence
cactctagcctgggtgacag

SEQ ID NO: 724156 - DNA, 20 bp, Artificial
  CRISPR gRNA sequence
tagcctgggtgacagagtga

SEQ ID NO: 724157 - DNA, 20 bp, Artificial
  CRISPR gRNA sequence
gcctgggtgacagagtgaga

SEQ ID NO: 724158 - DNA, 20 bp, Artificial
  CRISPR gRNA sequence
ggtgacagagtgagactcca

SEQ ID NO: 724159 - DNA, 20 bp, Artificial
  CRISPR gRNA sequence
catctcaaaaaaaaaaaaaa

SEQ ID NO: 724160 - DNA, 20 bp, Artificial
  CRISPR gRNA sequence
aaaaaaaaaaaaaaaaaagg

SEQ ID NO: 724161 - DNA, 20 bp, Artificial
  CRISPR gRNA sequence
tcctccatctgccactggag

SEQ ID NO: 724162 - DNA, 20 bp, Artificial
  CRISPR gRNA sequence
catctgccactggagaagtg

SEQ ID NO: 724163 - DNA, 20 bp, Artificial
  CRISPR gRNA sequence
ccactggagaagtgagcctc

SEQ ID NO: 724164 - DNA, 20 bp, Artificial
  CRISPR gRNA sequence
gagaagtgagcctccttgcc

SEQ ID NO: 724165 - DNA, 20 bp, Artificial
  CRISPR gRNA sequence
cttgccttgagctggggtgg

SEQ ID NO: 724166 - DNA, 20 bp, Artificial
  CRISPR gRNA sequence
gccttgagctggggtgggca

SEQ ID NO: 724167 - DNA, 20 bp, Artificial
  CRISPR gRNA sequence
ccttgagctggggtgggcac

SEQ ID NO: 724168 - DNA, 20 bp, Artificial
  CRISPR gRNA sequence
gagctggggtgggcactgac

SEQ ID NO: 724169 - DNA, 20 bp, Artificial
  CRISPR gRNA sequence
agctggggtgggcactgact

SEQ ID NO: 724170 - DNA, 20 bp, Artificial
  CRISPR gRNA sequence
gggtgggcactgactctgaa

SEQ ID NO: 724171 - DNA, 20 bp, Artificial
  CRISPR gRNA sequence
actctgaaacccatcgaggg

SEQ ID NO: 724172 - DNA, 20 bp, Artificial
  CRISPR gRNA sequence
tgaaacccatcgagggctct

SEQ ID NO: 724173 - DNA, 20 bp, Artificial
  CRISPR gRNA sequence
aaacccatcgagggctctcc

SEQ ID NO: 724174 - DNA, 20 bp, Artificial
  CRISPR gRNA sequence
tccagactgaggacctgacc

SEQ ID NO: 724175 - DNA, 20 bp, Artificial
  CRISPR gRNA sequence
cagactgaggacctgacccc

SEQ ID NO: 724176 - DNA, 20 bp, Artificial
  CRISPR gRNA sequence
aggacctgacccctgggctg

SEQ ID NO: 724177 - DNA, 20 bp, Artificial
  CRISPR gRNA sequence
acccctgggctgagttcagc

SEQ ID NO: 724178 - DNA, 20 bp, Artificial
  CRISPR gRNA sequence
ggctgagttcagcaccacct

SEQ ID NO: 724179 - DNA, 20 bp, Artificial
  CRISPR gRNA sequence
agttcagcaccacctgtgat

SEQ ID NO: 724180 - DNA, 20 bp, Artificial
  CRISPR gRNA sequence
agcaccacctgtgatccagg

SEQ ID NO: 724181 - DNA, 20 bp, Artificial
  CRISPR gRNA sequence
tgatccaggaggaccatttg

SEQ ID NO: 724182 - DNA, 20 bp, Artificial
  CRISPR gRNA sequence
gccaatagttggggcgggtg

SEQ ID NO: 724183 - DNA, 20 bp, Artificial
  CRISPR gRNA sequence
ccaatagttggggcgggtgg

SEQ ID NO: 724184 - DNA, 20 bp, Artificial
  CRISPR gRNA sequence
gggcgggtggggccgggggc

SEQ ID NO: 724185 - DNA, 20 bp, Artificial
  CRISPR gRNA sequence
ccagactccttggtgaagtt

SEQ ID NO: 724186 - DNA, 20 bp, Artificial
  CRISPR gRNA sequence
cttggtgaagttgctgctct

SEQ ID NO: 724187 - DNA, 20 bp, Artificial
  CRISPR gRNA sequence
ggtgaagttgctgctcttgc

SEQ ID NO: 724188 - DNA, 20 bp, Artificial
  CRISPR gRNA sequence
gtgaagttgctgctcttgct

SEQ ID NO: 724189 - DNA, 20 bp, Artificial
  CRISPR gRNA sequence
ctgctcttgctttttgcaga

SEQ ID NO: 724190 - DNA, 20 bp, Artificial
  CRISPR gRNA sequence
ctcttgctttttgcagattc

SEQ ID NO: 724191 - DNA, 20 bp, Artificial
  CRISPR gRNA sequence
ttgctttttgcagattccag

SEQ ID NO: 724192 - DNA, 20 bp, Artificial
  CRISPR gRNA sequence
gctttttgcagattccagac

SEQ ID NO: 724193 - DNA, 20 bp, Artificial
  CRISPR gRNA sequence
ctttttgcagattccagacc

SEQ ID NO: 724194 - DNA, 20 bp, Artificial
  CRISPR gRNA sequence
tttgcagattccagacccag

SEQ ID NO: 724195 - DNA, 20 bp, Artificial
  CRISPR gRNA sequence
ttgcagattccagacccagg

SEQ ID NO: 724196 - DNA, 20 bp, Artificial
  CRISPR gRNA sequence
tgcagattccagacccagga

SEQ ID NO: 724197 - DNA, 20 bp, Artificial
  CRISPR gRNA sequence
gcagattccagacccaggag

SEQ ID NO: 724198 - DNA, 20 bp, Artificial
  CRISPR gRNA sequence
cagattccagacccaggagg

SEQ ID NO: 724199 - DNA, 20 bp, Artificial
  CRISPR gRNA sequence
cagacccaggaggagctcaa

SEQ ID NO: 724200 - DNA, 20 bp, Artificial
  CRISPR gRNA sequence
aacggtaagtacccctccct

SEQ ID NO: 724201 - DNA, 20 bp, Artificial
  CRISPR gRNA sequence
ccttgcccccacctcagctt

SEQ ID NO: 724202 - DNA, 20 bp, Artificial
  CRISPR gRNA sequence
gcccccacctcagcttcgtg

SEQ ID NO: 724203 - DNA, 20 bp, Artificial
  CRISPR gRNA sequence
cccccacctcagcttcgtgc

SEQ ID NO: 724204 - DNA, 20 bp, Artificial
  CRISPR gRNA sequence
agcttcgtgcccctaaatct

SEQ ID NO: 724205 - DNA, 20 bp, Artificial
  CRISPR gRNA sequence
cgtgcccctaaatctgactc

SEQ ID NO: 724206 - DNA, 20 bp, Artificial
  CRISPR gRNA sequence
gtgcccctaaatctgactcc

SEQ ID NO: 724207 - DNA, 20 bp, Artificial
  CRISPR gRNA sequence
aatctgactccttccctaac

SEQ ID NO: 724208 - DNA, 20 bp, Artificial
  CRISPR gRNA sequence
actccttccctaacagatct

SEQ ID NO: 724209 - DNA, 20 bp, Artificial
  CRISPR gRNA sequence
cttccctaacagatctgaag

SEQ ID NO: 724210 - DNA, 20 bp, Artificial
  CRISPR gRNA sequence
ccctaacagatctgaagttt

SEQ ID NO: 724211 - DNA, 20 bp, Artificial
  CRISPR gRNA sequence
cctaacagatctgaagtttt

SEQ ID NO: 724212 - DNA, 20 bp, Artificial
  CRISPR gRNA sequence
acagatctgaagttttgaga

SEQ ID NO: 724213 - DNA, 20 bp, Artificial
  CRISPR gRNA sequence
aagttttgagagctgctggg

SEQ ID NO: 724214 - DNA, 20 bp, Artificial
  CRISPR gRNA sequence
tgagagctgctgggggaagg

SEQ ID NO: 724215 - DNA, 20 bp, Artificial
  CRISPR gRNA sequence
gagagctgctgggggaaggg

SEQ ID NO: 724216 - DNA, 20 bp, Artificial
  CRISPR gRNA sequence
agagctgctgggggaaggga

SEQ ID NO: 724217 - DNA, 20 bp, Artificial
  CRISPR gRNA sequence
ctgggggaagggagagggag

SEQ ID NO: 724218 - DNA, 20 bp, Artificial
  CRISPR gRNA sequence
ggggaagggagagggagggg

SEQ ID NO: 724219 - DNA, 20 bp, Artificial
  CRISPR gRNA sequence
gccattcccctcccacagtg

SEQ ID NO: 724220 - DNA, 20 bp, Artificial
  CRISPR gRNA sequence
ccctcccacagtgcccaggg

SEQ ID NO: 724221 - DNA, 20 bp, Artificial
  CRISPR gRNA sequence
ccacagtgcccagggtgcag

SEQ ID NO: 724222 - DNA, 20 bp, Artificial
  CRISPR gRNA sequence
caagttcaggctgagtctga

SEQ ID NO: 724223 - DNA, 20 bp, Artificial
  CRISPR gRNA sequence
aggctgagtctgacccacca

SEQ ID NO: 724224 - DNA, 20 bp, Artificial
  CRISPR gRNA sequence
agtctgacccaccacaggga

SEQ ID NO: 724225 - DNA, 20 bp, Artificial
  CRISPR gRNA sequence
acccaccacagggacctctg

SEQ ID NO: 724226 - DNA, 20 bp, Artificial
  CRISPR gRNA sequence
tgtgcacagaggcctcgcct

SEQ ID NO: 724227 - DNA, 20 bp, Artificial
  CRISPR gRNA sequence
tgcacagaggcctcgcctgg

SEQ ID NO: 724228 - DNA, 20 bp, Artificial
  CRISPR gRNA sequence
gcctggggcctcagccaggc

SEQ ID NO: 724229 - DNA, 20 bp, Artificial
  CRISPR gRNA sequence
gggcctcagccaggccttgg

SEQ ID NO: 724230 - DNA, 20 bp, Artificial
  CRISPR gRNA sequence
agccaggccttggctaagga

SEQ ID NO: 724231 - DNA, 20 bp, Artificial
  CRISPR gRNA sequence
ggctaaggatggagagcccc

SEQ ID NO: 724232 - DNA, 20 bp, Artificial
  CRISPR gRNA sequence
gctaaggatggagagcccca

SEQ ID NO: 724233 - DNA, 20 bp, Artificial
  CRISPR gRNA sequence
aggatggagagccccaccct

SEQ ID NO: 724234 - DNA, 20 bp, Artificial
  CRISPR gRNA sequence
atagcagcctccagctcctg

SEQ ID NO: 724235 - DNA, 20 bp, Artificial
  CRISPR gRNA sequence
cagctcctggctcagcctgc

SEQ ID NO: 724236 - DNA, 20 bp, Artificial
  CRISPR gRNA sequence
ctggctcagcctgccgggaa

SEQ ID NO: 724237 - DNA, 20 bp, Artificial
  CRISPR gRNA sequence
gctcagcctgccgggaattt

SEQ ID NO: 724238 - DNA, 20 bp, Artificial
  CRISPR gRNA sequence
agcctgccgggaatttccag

SEQ ID NO: 724239 - DNA, 20 bp, Artificial
  CRISPR gRNA sequence
ccgggaatttccagaagggc

SEQ ID NO: 724240 - DNA, 20 bp, Artificial
  CRISPR gRNA sequence
ccagaagggcctgcacacag

SEQ ID NO: 724241 - DNA, 20 bp, Artificial
  CRISPR gRNA sequence
cagaagggcctgcacacagt

SEQ ID NO: 724242 - DNA, 20 bp, Artificial
  CRISPR gRNA sequence
cacacagtggatttggtttg

SEQ ID NO: 724243 - DNA, 20 bp, Artificial
  CRISPR gRNA sequence
ggtttgggccacttttgggt

SEQ ID NO: 724244 - DNA, 20 bp, Artificial
  CRISPR gRNA sequence
gtttgggccacttttgggta

SEQ ID NO: 724245 - DNA, 20 bp, Artificial
  CRISPR gRNA sequence
gggccacttttgggtaccag

SEQ ID NO: 724246 - DNA, 20 bp, Artificial
  CRISPR gRNA sequence
ggccacttttgggtaccagg

SEQ ID NO: 724247 - DNA, 20 bp, Artificial
  CRISPR gRNA sequence
ttgggtaccaggtctggtca

SEQ ID NO: 724248 - DNA, 20 bp, Artificial
  CRISPR gRNA sequence
tgggtaccaggtctggtcag

SEQ ID NO: 724249 - DNA, 20 bp, Artificial
  CRISPR gRNA sequence
gggtaccaggtctggtcagg

SEQ ID NO: 724250 - DNA, 20 bp, Artificial
  CRISPR gRNA sequence
ggtaccaggtctggtcagga

SEQ ID NO: 724251 - DNA, 20 bp, Artificial
  CRISPR gRNA sequence
gtcaggaggaagactgtgtt

SEQ ID NO: 724252 - DNA, 20 bp, Artificial
  CRISPR gRNA sequence
tgttcattttccccttttct

SEQ ID NO: 724253 - DNA, 20 bp, Artificial
  CRISPR gRNA sequence
attttccccttttctttact

SEQ ID NO: 724254 - DNA, 20 bp, Artificial
  CRISPR gRNA sequence
tccccttttctttactcttc

SEQ ID NO: 724255 - DNA, 20 bp, Artificial
  CRISPR gRNA sequence
ccccttttctttactcttcc

SEQ ID NO: 724256 - DNA, 20 bp, Artificial
  CRISPR gRNA sequence
cccttttctttactcttcca

SEQ ID NO: 724257 - DNA, 20 bp, Artificial
  CRISPR gRNA sequence
ttctttactcttccatgaat

SEQ ID NO: 724258 - DNA, 20 bp, Artificial
  CRISPR gRNA sequence
tctttactcttccatgaatc

SEQ ID NO: 724259 - DNA, 20 bp, Artificial
  CRISPR gRNA sequence
ctttactcttccatgaatct

SEQ ID NO: 724260 - DNA, 20 bp, Artificial
  CRISPR gRNA sequence
tttactcttccatgaatctc

SEQ ID NO: 724261 - DNA, 20 bp, Artificial
  CRISPR gRNA sequence
tactcttccatgaatctcat

SEQ ID NO: 724262 - DNA, 20 bp, Artificial
  CRISPR gRNA sequence
actcttccatgaatctcatc

SEQ ID NO: 724263 - DNA, 20 bp, Artificial
  CRISPR gRNA sequence
ctcttccatgaatctcatcc

SEQ ID NO: 724264 - DNA, 20 bp, Artificial
  CRISPR gRNA sequence
ttccatgaatctcatcctcc

SEQ ID NO: 724265 - DNA, 20 bp, Artificial
  CRISPR gRNA sequence
ccatgaatctcatcctccaa

SEQ ID NO: 724266 - DNA, 20 bp, Artificial
  CRISPR gRNA sequence
catgaatctcatcctccaag

SEQ ID NO: 724267 - DNA, 20 bp, Artificial
  CRISPR gRNA sequence
atcctccaagctggatgaca

SEQ ID NO: 724268 - DNA, 20 bp, Artificial
  CRISPR gRNA sequence
caagctggatgacagagcag

SEQ ID NO: 724269 - DNA, 20 bp, Artificial
  CRISPR gRNA sequence
gatgacagagcaggtggcta

SEQ ID NO: 724270 - DNA, 20 bp, Artificial
  CRISPR gRNA sequence
tggtccattccttttttttt

SEQ ID NO: 724271 - DNA, 20 bp, Artificial
  CRISPR gRNA sequence
ctttttttttttttccccat

SEQ ID NO: 724272 - DNA, 20 bp, Artificial
  CRISPR gRNA sequence
tttttttttttccccatctg

SEQ ID NO: 724273 - DNA, 20 bp, Artificial
  CRISPR gRNA sequence
ttttttttttccccatctgt

SEQ ID NO: 724274 - DNA, 20 bp, Artificial
  CRISPR gRNA sequence
tttttttttccccatctgtc

SEQ ID NO: 724275 - DNA, 20 bp, Artificial
  CRISPR gRNA sequence
ttttttttccccatctgtca

SEQ ID NO: 724276 - DNA, 20 bp, Artificial
  CRISPR gRNA sequence
tttttttccccatctgtcag

SEQ ID NO: 724277 - DNA, 20 bp, Artificial
  CRISPR gRNA sequence
ttttttccccatctgtcagt

SEQ ID NO: 724278 - DNA, 20 bp, Artificial
  CRISPR gRNA sequence
tttttccccatctgtcagtt

SEQ ID NO: 724279 - DNA, 20 bp, Artificial
  CRISPR gRNA sequence
ttttccccatctgtcagttc

SEQ ID NO: 724280 - DNA, 20 bp, Artificial
  CRISPR gRNA sequence
tttccccatctgtcagttct

SEQ ID NO: 724281 - DNA, 20 bp, Artificial
  CRISPR gRNA sequence
ttccccatctgtcagttctt

SEQ ID NO: 724282 - DNA, 20 bp, Artificial
  CRISPR gRNA sequence
tccccatctgtcagttcttc

SEQ ID NO: 724283 - DNA, 20 bp, Artificial
  CRISPR gRNA sequence
ccccatctgtcagttcttcc

SEQ ID NO: 724284 - DNA, 20 bp, Artificial
  CRISPR gRNA sequence
cccatctgtcagttcttcca

SEQ ID NO: 724285 - DNA, 20 bp, Artificial
  CRISPR gRNA sequence
tcagttcttccattactttc

SEQ ID NO: 724286 - DNA, 20 bp, Artificial
  CRISPR gRNA sequence
ttccattactttcttttaat

SEQ ID NO: 724287 - DNA, 20 bp, Artificial
  CRISPR gRNA sequence
ccattactttcttttaattc

SEQ ID NO: 724288 - DNA, 20 bp, Artificial
  CRISPR gRNA sequence
cattactttcttttaattca

SEQ ID NO: 724289 - DNA, 20 bp, Artificial
  CRISPR gRNA sequence
ctttcttttaattcaagcat

SEQ ID NO: 724290 - DNA, 20 bp, Artificial
  CRISPR gRNA sequence
tcttttaattcaagcattca

SEQ ID NO: 724291 - DNA, 20 bp, Artificial
  CRISPR gRNA sequence
cttttaattcaagcattcat

SEQ ID NO: 724292 - DNA, 20 bp, Artificial
  CRISPR gRNA sequence
ttttaattcaagcattcata

SEQ ID NO: 724293 - DNA, 20 bp, Artificial
  CRISPR gRNA sequence
ttaattcaagcattcataca

SEQ ID NO: 724294 - DNA, 20 bp, Artificial
  CRISPR gRNA sequence
taattcaagcattcatacat

SEQ ID NO: 724295 - DNA, 20 bp, Artificial
  CRISPR gRNA sequence
aattcaagcattcatacatt

SEQ ID NO: 724296 - DNA, 20 bp, Artificial
  CRISPR gRNA sequence
attcaagcattcatacatta

SEQ ID NO: 724297 - DNA, 20 bp, Artificial
  CRISPR gRNA sequence
aagcattcatacattaagaa

SEQ ID NO: 724298 - DNA, 20 bp, Artificial
  CRISPR gRNA sequence
atacattaagaagggtttct

SEQ ID NO: 724299 - DNA, 20 bp, Artificial
  CRISPR gRNA sequence
agaagggtttctatcctttc

SEQ ID NO: 724300 - DNA, 20 bp, Artificial
  CRISPR gRNA sequence
ctatcctttcatttttcaat

SEQ ID NO: 724301 - DNA, 20 bp, Artificial
  CRISPR gRNA sequence
tatcctttcatttttcaata

SEQ ID NO: 724302 - DNA, 20 bp, Artificial
  CRISPR gRNA sequence
tcctttcatttttcaatata

SEQ ID NO: 724303 - DNA, 20 bp, Artificial
  CRISPR gRNA sequence
tcatttttcaatataatata

SEQ ID NO: 724304 - DNA, 20 bp, Artificial
  CRISPR gRNA sequence
catttttcaatataatatac

SEQ ID NO: 724305 - DNA, 20 bp, Artificial
  CRISPR gRNA sequence
atttttcaatataatataca

SEQ ID NO: 724306 - DNA, 20 bp, Artificial
  CRISPR gRNA sequence
ttcaatataatatacacaac

SEQ ID NO: 724307 - DNA, 20 bp, Artificial
  CRISPR gRNA sequence
tcaatataatatacacaacc

SEQ ID NO: 724308 - DNA, 20 bp, Artificial
  CRISPR gRNA sequence
caatataatatacacaacca

SEQ ID NO: 724309 - DNA, 20 bp, Artificial
  CRISPR gRNA sequence
aatataatatacacaaccat

SEQ ID NO: 724310 - DNA, 20 bp, Artificial
  CRISPR gRNA sequence
gttcagtttcaaattatggg

SEQ ID NO: 724311 - DNA, 20 bp, Artificial
  CRISPR gRNA sequence
agtttcaaattatgggggat

SEQ ID NO: 724312 - DNA, 20 bp, Artificial
  CRISPR gRNA sequence
caaattatgggggatcacat

SEQ ID NO: 724313 - DNA, 20 bp, Artificial
  CRISPR gRNA sequence
aaattatgggggatcacatt

SEQ ID NO: 724314 - DNA, 20 bp, Artificial
  CRISPR gRNA sequence
tgggggatcacattcgaata

SEQ ID NO: 724315 - DNA, 20 bp, Artificial
  CRISPR gRNA sequence
gaatatgcttggatgtgaca

SEQ ID NO: 724316 - DNA, 20 bp, Artificial
  CRISPR gRNA sequence
ggatgtgacaagtggctgtt

SEQ ID NO: 724317 - DNA, 20 bp, Artificial
  CRISPR gRNA sequence
gatgtgacaagtggctgtta

SEQ ID NO: 724318 - DNA, 20 bp, Artificial
  CRISPR gRNA sequence
ttacaatactgagaaatttc

SEQ ID NO: 724319 - DNA, 20 bp, Artificial
  CRISPR gRNA sequence
caatactgagaaatttcatg

SEQ ID NO: 724320 - DNA, 20 bp, Artificial
  CRISPR gRNA sequence
agaaatttcatgaaagaggt

SEQ ID NO: 724321 - DNA, 20 bp, Artificial
  CRISPR gRNA sequence
catgaaagaggtattcaaca

SEQ ID NO: 724322 - DNA, 20 bp, Artificial
  CRISPR gRNA sequence
atgaaagaggtattcaacaa

SEQ ID NO: 724323 - DNA, 20 bp, Artificial
  CRISPR gRNA sequence
aacaatttgtaaggtaatca

SEQ ID NO: 724324 - DNA, 20 bp, Artificial
  CRISPR gRNA sequence
gtaaggtaatcaaatatgtt

SEQ ID NO: 724325 - DNA, 20 bp, Artificial
  CRISPR gRNA sequence
taaggtaatcaaatatgttt

SEQ ID NO: 724326 - DNA, 20 bp, Artificial
  CRISPR gRNA sequence
ttgctgcataggccaatgca

SEQ ID NO: 724327 - DNA, 20 bp, Artificial
  CRISPR gRNA sequence
tgctgcataggccaatgcat

SEQ ID NO: 724328 - DNA, 20 bp, Artificial
  CRISPR gRNA sequence
gctgcataggccaatgcatt

SEQ ID NO: 724329 - DNA, 20 bp, Artificial
  CRISPR gRNA sequence
ctgcataggccaatgcatta

SEQ ID NO: 724330 - DNA, 20 bp, Artificial
  CRISPR gRNA sequence
cataggccaatgcattaata

SEQ ID NO: 724331 - DNA, 20 bp, Artificial
  CRISPR gRNA sequence
atagtaacttgttttaaaat

SEQ ID NO: 724332 - DNA, 20 bp, Artificial
  CRISPR gRNA sequence
gttttaaaatgcagtctttt

SEQ ID NO: 724333 - DNA, 20 bp, Artificial
  CRISPR gRNA sequence
ttttaaaatgcagtcttttg

SEQ ID NO: 724334 - DNA, 20 bp, Artificial
  CRISPR gRNA sequence
taaaatgcagtcttttggcc

SEQ ID NO: 724335 - DNA, 20 bp, Artificial
  CRISPR gRNA sequence
aaaatgcagtcttttggccg

SEQ ID NO: 724336 - DNA, 20 bp, Artificial
  CRISPR gRNA sequence
aaatgcagtcttttggccgg

SEQ ID NO: 724337 - DNA, 20 bp, Artificial
  CRISPR gRNA sequence
ttggccggatatgatggctc

SEQ ID NO: 724338 - DNA, 20 bp, Artificial
  CRISPR gRNA sequence
tggccggatatgatggctca

SEQ ID NO: 724339 - DNA, 20 bp, Artificial
  CRISPR gRNA sequence
ggccggatatgatggctcac

SEQ ID NO: 724340 - DNA, 20 bp, Artificial
  CRISPR gRNA sequence
gccggatatgatggctcaca

SEQ ID NO: 724341 - DNA, 20 bp, Artificial
  CRISPR gRNA sequence
acacttaaaatcccagcatt

SEQ ID NO: 724342 - DNA, 20 bp, Artificial
  CRISPR gRNA sequence
aaaatcccagcattttggga

SEQ ID NO: 724343 - DNA, 20 bp, Artificial
  CRISPR gRNA sequence
aaatcccagcattttgggag

SEQ ID NO: 724344 - DNA, 20 bp, Artificial
  CRISPR gRNA sequence
tgggaggctgaggcaggcgg

SEQ ID NO: 724345 - DNA, 20 bp, Artificial
  CRISPR gRNA sequence
gggaggctgaggcaggcgga

SEQ ID NO: 724346 - DNA, 20 bp, Artificial
  CRISPR gRNA sequence
ggaggctgaggcaggcggat

SEQ ID NO: 724347 - DNA, 20 bp, Artificial
  CRISPR gRNA sequence
aggcaggcggatcacctgag

SEQ ID NO: 724348 - DNA, 20 bp, Artificial
  CRISPR gRNA sequence
aggtcaggagttcgagacca

SEQ ID NO: 724349 - DNA, 20 bp, Artificial
  CRISPR gRNA sequence
gagaccagccttgccaacat

SEQ ID NO: 724350 - DNA, 20 bp, Artificial
  CRISPR gRNA sequence
gccaacatagtgaaaccccg

SEQ ID NO: 724351 - DNA, 20 bp, Artificial
  CRISPR gRNA sequence
ccaacatagtgaaaccccgt

SEQ ID NO: 724352 - DNA, 20 bp, Artificial
  CRISPR gRNA sequence
tactaaaactacaaaaagta

SEQ ID NO: 724353 - DNA, 20 bp, Artificial
  CRISPR gRNA sequence
ctaaaactacaaaaagtatc

SEQ ID NO: 724354 - DNA, 20 bp, Artificial
  CRISPR gRNA sequence
aaactacaaaaagtatccag

SEQ ID NO: 724355 - DNA, 20 bp, Artificial
  CRISPR gRNA sequence
caaaaagtatccaggtgtag

SEQ ID NO: 724356 - DNA, 20 bp, Artificial
  CRISPR gRNA sequence
tagtcccagctactcaggag

SEQ ID NO: 724357 - DNA, 20 bp, Artificial
  CRISPR gRNA sequence
ctcaggaggctgaggcagga

SEQ ID NO: 724358 - DNA, 20 bp, Artificial
  CRISPR gRNA sequence
aggaggctgaggcaggagaa

SEQ ID NO: 724359 - DNA, 20 bp, Artificial
  CRISPR gRNA sequence
aggcaggagaatcgcttgag

SEQ ID NO: 724360 - DNA, 20 bp, Artificial
  CRISPR gRNA sequence
gagcctgggggacagaggtt

SEQ ID NO: 724361 - DNA, 20 bp, Artificial
  CRISPR gRNA sequence
agcctgggggacagaggttg

SEQ ID NO: 724362 - DNA, 20 bp, Artificial
  CRISPR gRNA sequence
ggggacagaggttgcaggga

SEQ ID NO: 724363 - DNA, 20 bp, Artificial
  CRISPR gRNA sequence
cagggagccgagattgcacc

SEQ ID NO: 724364 - DNA, 20 bp, Artificial
  CRISPR gRNA sequence
caccactgctctcccagccc

SEQ ID NO: 724365 - DNA, 20 bp, Artificial
  CRISPR gRNA sequence
ctctcccagcccgggtaaca

SEQ ID NO: 724366 - DNA, 20 bp, Artificial
  CRISPR gRNA sequence
tcccagcccgggtaacagag

SEQ ID NO: 724367 - DNA, 20 bp, Artificial
  CRISPR gRNA sequence
ccagcccgggtaacagagtg

SEQ ID NO: 724368 - DNA, 20 bp, Artificial
  CRISPR gRNA sequence
catctgaaaaaaaaaaaaaa

SEQ ID NO: 724369 - DNA, 20 bp, Artificial
  CRISPR gRNA sequence
aaaaaaaaaaaaaaaaaagg

SEQ ID NO: 724370 - DNA, 20 bp, Artificial
  CRISPR gRNA sequence
ttagccttcatattattatg

SEQ ID NO: 724371 - DNA, 20 bp, Artificial
  CRISPR gRNA sequence
tagccttcatattattatga

SEQ ID NO: 724372 - DNA, 20 bp, Artificial
  CRISPR gRNA sequence
agccttcatattattatgaa

SEQ ID NO: 724373 - DNA, 20 bp, Artificial
  CRISPR gRNA sequence
gccttcatattattatgaaa

SEQ ID NO: 724374 - DNA, 20 bp, Artificial
  CRISPR gRNA sequence
catattattatgaaagagta

SEQ ID NO: 724375 - DNA, 20 bp, Artificial
  CRISPR gRNA sequence
atattattatgaaagagtat

SEQ ID NO: 724376 - DNA, 20 bp, Artificial
  CRISPR gRNA sequence
ttatgaaagagtattcaaga

SEQ ID NO: 724377 - DNA, 20 bp, Artificial
  CRISPR gRNA sequence
tgaaagagtattcaagagta

SEQ ID NO: 724378 - DNA, 20 bp, Artificial
  CRISPR gRNA sequence
aagagtatgtattaaggttg

SEQ ID NO: 724379 - DNA, 20 bp, Artificial
  CRISPR gRNA sequence
aggttggtgccatttgccat

SEQ ID NO: 724380 - DNA, 20 bp, Artificial
  CRISPR gRNA sequence
gtgccatttgccattaaaag

SEQ ID NO: 724381 - DNA, 20 bp, Artificial
  CRISPR gRNA sequence
gccattaaaagtaatggcaa

SEQ ID NO: 724382 - DNA, 20 bp, Artificial
  CRISPR gRNA sequence
ccattaaaagtaatggcaaa

SEQ ID NO: 724383 - DNA, 20 bp, Artificial
  CRISPR gRNA sequence
aaagtaatggcaaacctggt

SEQ ID NO: 724384 - DNA, 20 bp, Artificial
  CRISPR gRNA sequence
gtttaacccttctgataggt

SEQ ID NO: 724385 - DNA, 20 bp, Artificial
  CRISPR gRNA sequence
aacccttctgataggtagtt

SEQ ID NO: 724386 - DNA, 20 bp, Artificial
  CRISPR gRNA sequence
acccttctgataggtagttg

SEQ ID NO: 724387 - DNA, 20 bp, Artificial
  CRISPR gRNA sequence
ctgataggtagttgtggatg

SEQ ID NO: 724388 - DNA, 20 bp, Artificial
  CRISPR gRNA sequence
tgataggtagttgtggatgt

SEQ ID NO: 724389 - DNA, 20 bp, Artificial
  CRISPR gRNA sequence
ataggtagttgtggatgttg

SEQ ID NO: 724390 - DNA, 20 bp, Artificial
  CRISPR gRNA sequence
tggatgttggggttgagaac

SEQ ID NO: 724391 - DNA, 20 bp, Artificial
  CRISPR gRNA sequence
gggttgagaacagaataatc

SEQ ID NO: 724392 - DNA, 20 bp, Artificial
  CRISPR gRNA sequence
agaacagaataatctttgtc

SEQ ID NO: 724393 - DNA, 20 bp, Artificial
  CRISPR gRNA sequence
tgtctggagtgacaccacac

SEQ ID NO: 724394 - DNA, 20 bp, Artificial
  CRISPR gRNA sequence
gtctggagtgacaccacact

SEQ ID NO: 724395 - DNA, 20 bp, Artificial
  CRISPR gRNA sequence
tctggagtgacaccacactc

SEQ ID NO: 724396 - DNA, 20 bp, Artificial
  CRISPR gRNA sequence
gagtgacaccacactctaga

SEQ ID NO: 724397 - DNA, 20 bp, Artificial
  CRISPR gRNA sequence
tagaatttccactttgaaaa

SEQ ID NO: 724398 - DNA, 20 bp, Artificial
  CRISPR gRNA sequence
gaatttccactttgaaaaat

SEQ ID NO: 724399 - DNA, 20 bp, Artificial
  CRISPR gRNA sequence
ccactttgaaaaatactcag

SEQ ID NO: 724400 - DNA, 20 bp, Artificial
  CRISPR gRNA sequence
cactttgaaaaatactcagt

SEQ ID NO: 724401 - DNA, 20 bp, Artificial
  CRISPR gRNA sequence
tgaaaaatactcagttcttt

SEQ ID NO: 724402 - DNA, 20 bp, Artificial
  CRISPR gRNA sequence
gaaaaatactcagttctttt

SEQ ID NO: 724403 - DNA, 20 bp, Artificial
  CRISPR gRNA sequence
aaaaatactcagttcttttt

SEQ ID NO: 724404 - DNA, 20 bp, Artificial
  CRISPR gRNA sequence
agttcttttttttttttttt

SEQ ID NO: 724405 - DNA, 20 bp, Artificial
  CRISPR gRNA sequence
tttttttttttttttttttt

SEQ ID NO: 724406 - DNA, 20 bp, Artificial
  CRISPR gRNA sequence
tttttttttttttttttttt

SEQ ID NO: 724407 - DNA, 20 bp, Artificial
  CRISPR gRNA sequence
tttttttttttttttttttt

SEQ ID NO: 724408 - DNA, 20 bp, Artificial
  CRISPR gRNA sequence
tttttttttttttttttttt

SEQ ID NO: 724409 - DNA, 20 bp, Artificial
  CRISPR gRNA sequence
tttttttttttttttttttt

SEQ ID NO: 724410 - DNA, 20 bp, Artificial
  CRISPR gRNA sequence
ttttttttttttttttttta

SEQ ID NO: 724411 - DNA, 20 bp, Artificial
  CRISPR gRNA sequence
ttttttttttttttttttaa

SEQ ID NO: 724412 - DNA, 20 bp, Artificial
  CRISPR gRNA sequence
tttttttttttttttttaat

SEQ ID NO: 724413 - DNA, 20 bp, Artificial
  CRISPR gRNA sequence
ttttttttttttttttaatt

SEQ ID NO: 724414 - DNA, 20 bp, Artificial
  CRISPR gRNA sequence
tttttttttttttttaattt

SEQ ID NO: 724415 - DNA, 20 bp, Artificial
  CRISPR gRNA sequence
ttttttttttttttaatttt

SEQ ID NO: 724416 - DNA, 20 bp, Artificial
  CRISPR gRNA sequence
tttttttttttttaattttt

SEQ ID NO: 724417 - DNA, 20 bp, Artificial
  CRISPR gRNA sequence
ttttttttttttaatttttt

SEQ ID NO: 724418 - DNA, 20 bp, Artificial
  CRISPR gRNA sequence
tttttttttttaattttttt

SEQ ID NO: 724419 - DNA, 20 bp, Artificial
  CRISPR gRNA sequence
ttttttttttaattttttta

SEQ ID NO: 724420 - DNA, 20 bp, Artificial
  CRISPR gRNA sequence
tttttttttaatttttttag

SEQ ID NO: 724421 - DNA, 20 bp, Artificial
  CRISPR gRNA sequence
ttttttttaatttttttagt

SEQ ID NO: 724422 - DNA, 20 bp, Artificial
  CRISPR gRNA sequence
tttttttaatttttttagta

SEQ ID NO: 724423 - DNA, 20 bp, Artificial
  CRISPR gRNA sequence
ttttttaatttttttagtat

SEQ ID NO: 724424 - DNA, 20 bp, Artificial
  CRISPR gRNA sequence
tttttaatttttttagtatt

SEQ ID NO: 724425 - DNA, 20 bp, Artificial
  CRISPR gRNA sequence
ttttaatttttttagtattt

SEQ ID NO: 724426 - DNA, 20 bp, Artificial
  CRISPR gRNA sequence
tttaatttttttagtattta

SEQ ID NO: 724427 - DNA, 20 bp, Artificial
  CRISPR gRNA sequence
ttaatttttttagtatttat

SEQ ID NO: 724428 - DNA, 20 bp, Artificial
  CRISPR gRNA sequence
taatttttttagtatttatt

SEQ ID NO: 724429 - DNA, 20 bp, Artificial
  CRISPR gRNA sequence
aatttttttagtatttattg

SEQ ID NO: 724430 - DNA, 20 bp, Artificial
  CRISPR gRNA sequence
atttttttagtatttattga

SEQ ID NO: 724431 - DNA, 20 bp, Artificial
  CRISPR gRNA sequence
ttttagtatttattgatcat

SEQ ID NO: 724432 - DNA, 20 bp, Artificial
  CRISPR gRNA sequence
tttagtatttattgatcatt

SEQ ID NO: 724433 - DNA, 20 bp, Artificial
  CRISPR gRNA sequence
ttagtatttattgatcattc

SEQ ID NO: 724434 - DNA, 20 bp, Artificial
  CRISPR gRNA sequence
tagtatttattgatcattct

SEQ ID NO: 724435 - DNA, 20 bp, Artificial
  CRISPR gRNA sequence
agtatttattgatcattctt

SEQ ID NO: 724436 - DNA, 20 bp, Artificial
  CRISPR gRNA sequence
gtatttattgatcattcttg

SEQ ID NO: 724437 - DNA, 20 bp, Artificial
  CRISPR gRNA sequence
attgatcattcttgggtgtt

SEQ ID NO: 724438 - DNA, 20 bp, Artificial
  CRISPR gRNA sequence
ttgatcattcttgggtgttt

SEQ ID NO: 724439 - DNA, 20 bp, Artificial
  CRISPR gRNA sequence
atcattcttgggtgtttctc

SEQ ID NO: 724440 - DNA, 20 bp, Artificial
  CRISPR gRNA sequence
ttgggtgtttctcagagagg

SEQ ID NO: 724441 - DNA, 20 bp, Artificial
  CRISPR gRNA sequence
gggtgtttctcagagagggg

SEQ ID NO: 724442 - DNA, 20 bp, Artificial
  CRISPR gRNA sequence
ggtgtttctcagagaggggg

SEQ ID NO: 724443 - DNA, 20 bp, Artificial
  CRISPR gRNA sequence
ctcagagagggggatttggc

SEQ ID NO: 724444 - DNA, 20 bp, Artificial
  CRISPR gRNA sequence
tcagagagggggatttggca

SEQ ID NO: 724445 - DNA, 20 bp, Artificial
  CRISPR gRNA sequence
agagagggggatttggcagg

SEQ ID NO: 724446 - DNA, 20 bp, Artificial
  CRISPR gRNA sequence
ggcagggtcataggacaata

SEQ ID NO: 724447 - DNA, 20 bp, Artificial
  CRISPR gRNA sequence
gcagggtcataggacaatag

SEQ ID NO: 724448 - DNA, 20 bp, Artificial
  CRISPR gRNA sequence
tggttttcctaggcagaggg

SEQ ID NO: 724449 - DNA, 20 bp, Artificial
  CRISPR gRNA sequence
gttttcctaggcagagggcc

SEQ ID NO: 724450 - DNA, 20 bp, Artificial
  CRISPR gRNA sequence
tcctaggcagagggccctgc

SEQ ID NO: 724451 - DNA, 20 bp, Artificial
  CRISPR gRNA sequence
cctaggcagagggccctgcc

SEQ ID NO: 724452 - DNA, 20 bp, Artificial
  CRISPR gRNA sequence
ctaggcagagggccctgccg

SEQ ID NO: 724453 - DNA, 20 bp, Artificial
  CRISPR gRNA sequence
ggcagagggccctgccgcct

SEQ ID NO: 724454 - DNA, 20 bp, Artificial
  CRISPR gRNA sequence
ccgccttccgcagtgtttgt

SEQ ID NO: 724455 - DNA, 20 bp, Artificial
  CRISPR gRNA sequence
ccgcagtgtttgtgtccctg

SEQ ID NO: 724456 - DNA, 20 bp, Artificial
  CRISPR gRNA sequence
cgcagtgtttgtgtccctgg

SEQ ID NO: 724457 - DNA, 20 bp, Artificial
  CRISPR gRNA sequence
gtgtccctgggtacttgaga

SEQ ID NO: 724458 - DNA, 20 bp, Artificial
  CRISPR gRNA sequence
tgtccctgggtacttgagat

SEQ ID NO: 724459 - DNA, 20 bp, Artificial
  CRISPR gRNA sequence
ggtacttgagattagggagt

SEQ ID NO: 724460 - DNA, 20 bp, Artificial
  CRISPR gRNA sequence
gagattagggagtggtgatg

SEQ ID NO: 724461 - DNA, 20 bp, Artificial
  CRISPR gRNA sequence
agattagggagtggtgatga

SEQ ID NO: 724462 - DNA, 20 bp, Artificial
  CRISPR gRNA sequence
gggagtggtgatgactctta

SEQ ID NO: 724463 - DNA, 20 bp, Artificial
  CRISPR gRNA sequence
ttagcgagtgaagaatactc

SEQ ID NO: 724464 - DNA, 20 bp, Artificial
  CRISPR gRNA sequence
agcgagtgaagaatactcag

SEQ ID NO: 724465 - DNA, 20 bp, Artificial
  CRISPR gRNA sequence
gcgagtgaagaatactcagt

SEQ ID NO: 724466 - DNA, 20 bp, Artificial
  CRISPR gRNA sequence
agttctaagctgtggttcct

SEQ ID NO: 724467 - DNA, 20 bp, Artificial
  CRISPR gRNA sequence
taagctgtggttcctggtag

SEQ ID NO: 724468 - DNA, 20 bp, Artificial
  CRISPR gRNA sequence
agctgtggttcctggtagaa

SEQ ID NO: 724469 - DNA, 20 bp, Artificial
  CRISPR gRNA sequence
tggttcctggtagaacaaac

SEQ ID NO: 724470 - DNA, 20 bp, Artificial
  CRISPR gRNA sequence
ctggtagaacaaactttatt

SEQ ID NO: 724471 - DNA, 20 bp, Artificial
  CRISPR gRNA sequence
gtagaacaaactttattttt

SEQ ID NO: 724472 - DNA, 20 bp, Artificial
  CRISPR gRNA sequence
tatttttctagctcagcagt

SEQ ID NO: 724473 - DNA, 20 bp, Artificial
  CRISPR gRNA sequence
atttttctagctcagcagtg

SEQ ID NO: 724474 - DNA, 20 bp, Artificial
  CRISPR gRNA sequence
tttttctagctcagcagtga

SEQ ID NO: 724475 - DNA, 20 bp, Artificial
  CRISPR gRNA sequence
ttctagctcagcagtgatct

SEQ ID NO: 724476 - DNA, 20 bp, Artificial
  CRISPR gRNA sequence
tctagctcagcagtgatctg

SEQ ID NO: 724477 - DNA, 20 bp, Artificial
  CRISPR gRNA sequence
ctagctcagcagtgatctgg

SEQ ID NO: 724478 - DNA, 20 bp, Artificial
  CRISPR gRNA sequence
tagctcagcagtgatctgga

SEQ ID NO: 724479 - DNA, 20 bp, Artificial
  CRISPR gRNA sequence
gctcagcagtgatctggaag

SEQ ID NO: 724480 - DNA, 20 bp, Artificial
  CRISPR gRNA sequence
agcagtgatctggaagctga

SEQ ID NO: 724481 - DNA, 20 bp, Artificial
  CRISPR gRNA sequence
gaagctgaggaatctcagcg

SEQ ID NO: 724482 - DNA, 20 bp, Artificial
  CRISPR gRNA sequence
aggaatctcagcgcctttta

SEQ ID NO: 724483 - DNA, 20 bp, Artificial
  CRISPR gRNA sequence
agcgccttttaaaagttatt

SEQ ID NO: 724484 - DNA, 20 bp, Artificial
  CRISPR gRNA sequence
ttaaaagttattatgtggtt

SEQ ID NO: 724485 - DNA, 20 bp, Artificial
  CRISPR gRNA sequence
taaaagttattatgtggttt

SEQ ID NO: 724486 - DNA, 20 bp, Artificial
  CRISPR gRNA sequence
aaaagttattatgtggtttt

SEQ ID NO: 724487 - DNA, 20 bp, Artificial
  CRISPR gRNA sequence
aaagttattatgtggttttg

SEQ ID NO: 724488 - DNA, 20 bp, Artificial
  CRISPR gRNA sequence
ttatgtggttttgttttaaa

SEQ ID NO: 724489 - DNA, 20 bp, Artificial
  CRISPR gRNA sequence
tgtggttttgttttaaaaag

SEQ ID NO: 724490 - DNA, 20 bp, Artificial
  CRISPR gRNA sequence
tgttttaaaaagctcctgtt

SEQ ID NO: 724491 - DNA, 20 bp, Artificial
  CRISPR gRNA sequence
gttttaaaaagctcctgttt

SEQ ID NO: 724492 - DNA, 20 bp, Artificial
  CRISPR gRNA sequence
ttttaaaaagctcctgtttt

SEQ ID NO: 724493 - DNA, 20 bp, Artificial
  CRISPR gRNA sequence
taaaaagctcctgttttggg

SEQ ID NO: 724494 - DNA, 20 bp, Artificial
  CRISPR gRNA sequence
aaaaagctcctgttttggga

SEQ ID NO: 724495 - DNA, 20 bp, Artificial
  CRISPR gRNA sequence
aaaagctcctgttttgggaa

SEQ ID NO: 724496 - DNA, 20 bp, Artificial
  CRISPR gRNA sequence
ctgttttgggaaagtagaat

SEQ ID NO: 724497 - DNA, 20 bp, Artificial
  CRISPR gRNA sequence
ttttgggaaagtagaattta

SEQ ID NO: 724498 - DNA, 20 bp, Artificial
  CRISPR gRNA sequence
tgggaaagtagaatttatgg

SEQ ID NO: 724499 - DNA, 20 bp, Artificial
  CRISPR gRNA sequence
gggaaagtagaatttatggg

SEQ ID NO: 724500 - DNA, 20 bp, Artificial
  CRISPR gRNA sequence
ggaaagtagaatttatgggt

SEQ ID NO: 724501 - DNA, 20 bp, Artificial
  CRISPR gRNA sequence
atgggtataacatatgttca

SEQ ID NO: 724502 - DNA, 20 bp, Artificial
  CRISPR gRNA sequence
tgggtataacatatgttcat

SEQ ID NO: 724503 - DNA, 20 bp, Artificial
  CRISPR gRNA sequence
attatttgtacataaaataa

SEQ ID NO: 724504 - DNA, 20 bp, Artificial
  CRISPR gRNA sequence
tttgtacataaaataaaacc

SEQ ID NO: 724505 - DNA, 20 bp, Artificial
  CRISPR gRNA sequence
gtacataaaataaaaccatt

SEQ ID NO: 724506 - DNA, 20 bp, Artificial
  CRISPR gRNA sequence
tacataaaataaaaccattt

SEQ ID NO: 724507 - DNA, 20 bp, Artificial
  CRISPR gRNA sequence
aaaaagtaaaaaataataat

SEQ ID NO: 724508 - DNA, 20 bp, Artificial
  CRISPR gRNA sequence
aaaagtaaaaaataataata

SEQ ID NO: 724509 - DNA, 20 bp, Artificial
  CRISPR gRNA sequence
cttttgcaccaatctaaaag

SEQ ID NO: 724510 - DNA, 20 bp, Artificial
  CRISPR gRNA sequence
ttgcaccaatctaaaagata

SEQ ID NO: 724511 - DNA, 20 bp, Artificial
  CRISPR gRNA sequence
tgcaccaatctaaaagatac

SEQ ID NO: 724512 - DNA, 20 bp, Artificial
  CRISPR gRNA sequence
gcaccaatctaaaagatacg

SEQ ID NO: 724513 - DNA, 20 bp, Artificial
  CRISPR gRNA sequence
caccaatctaaaagatacgc

SEQ ID NO: 724514 - DNA, 20 bp, Artificial
  CRISPR gRNA sequence
aaagatacgccctctgtgcc

SEQ ID NO: 724515 - DNA, 20 bp, Artificial
  CRISPR gRNA sequence
tgtgccttgagaatcattgc

SEQ ID NO: 724516 - DNA, 20 bp, Artificial
  CRISPR gRNA sequence
tgccttgagaatcattgcgt

SEQ ID NO: 724517 - DNA, 20 bp, Artificial
  CRISPR gRNA sequence
gagaatcattgcgtcagcac

SEQ ID NO: 724518 - DNA, 20 bp, Artificial
  CRISPR gRNA sequence
agaatcattgcgtcagcacg

SEQ ID NO: 724519 - DNA, 20 bp, Artificial
  CRISPR gRNA sequence
cgtcagcacgggcatccctg

SEQ ID NO: 724520 - DNA, 20 bp, Artificial
  CRISPR gRNA sequence
cctcctctgaattactcaca

SEQ ID NO: 724521 - DNA, 20 bp, Artificial
  CRISPR gRNA sequence
ctctgaattactcacactca

SEQ ID NO: 724522 - DNA, 20 bp, Artificial
  CRISPR gRNA sequence
tgaattactcacactcactc

SEQ ID NO: 724523 - DNA, 20 bp, Artificial
  CRISPR gRNA sequence
aattactcacactcactcca

SEQ ID NO: 724524 - DNA, 20 bp, Artificial
  CRISPR gRNA sequence
ctcacactcactccattttg

SEQ ID NO: 724525 - DNA, 20 bp, Artificial
  CRISPR gRNA sequence
acactcactccattttgaag

SEQ ID NO: 724526 - DNA, 20 bp, Artificial
  CRISPR gRNA sequence
actccattttgaaggcatca

SEQ ID NO: 724527 - DNA, 20 bp, Artificial
  CRISPR gRNA sequence
cattttgaaggcatcaggac

SEQ ID NO: 724528 - DNA, 20 bp, Artificial
  CRISPR gRNA sequence
tgaaggcatcaggacatttc

SEQ ID NO: 724529 - DNA, 20 bp, Artificial
  CRISPR gRNA sequence
gaaggcatcaggacatttca

SEQ ID NO: 724530 - DNA, 20 bp, Artificial
  CRISPR gRNA sequence
aaggcatcaggacatttcat

SEQ ID NO: 724531 - DNA, 20 bp, Artificial
  CRISPR gRNA sequence
catgaggccacttctttgcc

SEQ ID NO: 724532 - DNA, 20 bp, Artificial
  CRISPR gRNA sequence
atgaggccacttctttgccc

SEQ ID NO: 724533 - DNA, 20 bp, Artificial
  CRISPR gRNA sequence
ctttgcccttacctgtaaaa

SEQ ID NO: 724534 - DNA, 20 bp, Artificial
  CRISPR gRNA sequence
tttgcccttacctgtaaaaa

SEQ ID NO: 724535 - DNA, 20 bp, Artificial
  CRISPR gRNA sequence
tgcccttacctgtaaaaatc

SEQ ID NO: 724536 - DNA, 20 bp, Artificial
  CRISPR gRNA sequence
gcccttacctgtaaaaatca

SEQ ID NO: 724537 - DNA, 20 bp, Artificial
  CRISPR gRNA sequence
cccttacctgtaaaaatcaa

SEQ ID NO: 724538 - DNA, 20 bp, Artificial
  CRISPR gRNA sequence
acctgtaaaaatcaaaaact

SEQ ID NO: 724539 - DNA, 20 bp, Artificial
  CRISPR gRNA sequence
cctgtaaaaatcaaaaacta

SEQ ID NO: 724540 - DNA, 20 bp, Artificial
  CRISPR gRNA sequence
taaaaatcaaaaactaaact

SEQ ID NO: 724541 - DNA, 20 bp, Artificial
  CRISPR gRNA sequence
aactgacactttcctcatga

SEQ ID NO: 724542 - DNA, 20 bp, Artificial
  CRISPR gRNA sequence
acactttcctcatgacatag

SEQ ID NO: 724543 - DNA, 20 bp, Artificial
  CRISPR gRNA sequence
tcctcatgacatagctgttt

SEQ ID NO: 724544 - DNA, 20 bp, Artificial
  CRISPR gRNA sequence
cctcatgacatagctgtttt

SEQ ID NO: 724545 - DNA, 20 bp, Artificial
  CRISPR gRNA sequence
ctcatgacatagctgttttt

SEQ ID NO: 724546 - DNA, 20 bp, Artificial
  CRISPR gRNA sequence
atgacatagctgtttttttg

SEQ ID NO: 724547 - DNA, 20 bp, Artificial
  CRISPR gRNA sequence
tttttttgtttttttttgtt

SEQ ID NO: 724548 - DNA, 20 bp, Artificial
  CRISPR gRNA sequence
ttttgtttttttttgttttt

SEQ ID NO: 724549 - DNA, 20 bp, Artificial
  CRISPR gRNA sequence
tttgtttttttttgtttttt

SEQ ID NO: 724550 - DNA, 20 bp, Artificial
  CRISPR gRNA sequence
ttgtttttttttgttttttt

SEQ ID NO: 724551 - DNA, 20 bp, Artificial
  CRISPR gRNA sequence
tgtttttttttgtttttttt

SEQ ID NO: 724552 - DNA, 20 bp, Artificial
  CRISPR gRNA sequence
gtttttttttgttttttttt

SEQ ID NO: 724553 - DNA, 20 bp, Artificial
  CRISPR gRNA sequence
tttttttttgtttttttttt

SEQ ID NO: 724554 - DNA, 20 bp, Artificial
  CRISPR gRNA sequence
ttttttgttttttttttgtt

SEQ ID NO: 724555 - DNA, 20 bp, Artificial
  CRISPR gRNA sequence
tttttgttttttttttgttt

SEQ ID NO: 724556 - DNA, 20 bp, Artificial
  CRISPR gRNA sequence
ttttgttttttttttgtttt

SEQ ID NO: 724557 - DNA, 20 bp, Artificial
  CRISPR gRNA sequence
tttgttttttttttgttttt

SEQ ID NO: 724558 - DNA, 20 bp, Artificial
  CRISPR gRNA sequence
ttgttttttttttgtttttt

SEQ ID NO: 724559 - DNA, 20 bp, Artificial
  CRISPR gRNA sequence
tgttttttttttgttttttt

SEQ ID NO: 724560 - DNA, 20 bp, Artificial
  CRISPR gRNA sequence
gttttttttttgtttttttt

SEQ ID NO: 724561 - DNA, 20 bp, Artificial
  CRISPR gRNA sequence
ttttttttttgttttttttt

SEQ ID NO: 724562 - DNA, 20 bp, Artificial
  CRISPR gRNA sequence
tttttttgttttttttttag

SEQ ID NO: 724563 - DNA, 20 bp, Artificial
  CRISPR gRNA sequence
ttttttgttttttttttagc

SEQ ID NO: 724564 - DNA, 20 bp, Artificial
  CRISPR gRNA sequence
tttttgttttttttttagca

SEQ ID NO: 724565 - DNA, 20 bp, Artificial
  CRISPR gRNA sequence
ttttgttttttttttagcat

SEQ ID NO: 724566 - DNA, 20 bp, Artificial
  CRISPR gRNA sequence
tttgttttttttttagcatt

SEQ ID NO: 724567 - DNA, 20 bp, Artificial
  CRISPR gRNA sequence
ttgttttttttttagcattt

SEQ ID NO: 724568 - DNA, 20 bp, Artificial
  CRISPR gRNA sequence
tgttttttttttagcattta

SEQ ID NO: 724569 - DNA, 20 bp, Artificial
  CRISPR gRNA sequence
gttttttttttagcatttag

SEQ ID NO: 724570 - DNA, 20 bp, Artificial
  CRISPR gRNA sequence
ttttttttttagcatttaga

SEQ ID NO: 724571 - DNA, 20 bp, Artificial
  CRISPR gRNA sequence
tttttttagcatttagaaaa

SEQ ID NO: 724572 - DNA, 20 bp, Artificial
  CRISPR gRNA sequence
ttttttagcatttagaaaat

SEQ ID NO: 724573 - DNA, 20 bp, Artificial
  CRISPR gRNA sequence
tttttagcatttagaaaata

SEQ ID NO: 724574 - DNA, 20 bp, Artificial
  CRISPR gRNA sequence
ttttagcatttagaaaatat

SEQ ID NO: 724575 - DNA, 20 bp, Artificial
  CRISPR gRNA sequence
tttagcatttagaaaatatt

SEQ ID NO: 724576 - DNA, 20 bp, Artificial
  CRISPR gRNA sequence
ttagcatttagaaaatattt

SEQ ID NO: 724577 - DNA, 20 bp, Artificial
  CRISPR gRNA sequence
tagcatttagaaaatattta

SEQ ID NO: 724578 - DNA, 20 bp, Artificial
  CRISPR gRNA sequence
agcatttagaaaatatttat

SEQ ID NO: 724579 - DNA, 20 bp, Artificial
  CRISPR gRNA sequence
gcatttagaaaatatttatt

SEQ ID NO: 724580 - DNA, 20 bp, Artificial
  CRISPR gRNA sequence
agaaaatatttattaataat

SEQ ID NO: 724581 - DNA, 20 bp, Artificial
  CRISPR gRNA sequence
gaaaatatttattaataata

SEQ ID NO: 724582 - DNA, 20 bp, Artificial
  CRISPR gRNA sequence
attaataatatacatgaatt

SEQ ID NO: 724583 - DNA, 20 bp, Artificial
  CRISPR gRNA sequence
ttaataatatacatgaattt

SEQ ID NO: 724584 - DNA, 20 bp, Artificial
  CRISPR gRNA sequence
ataatatacatgaatttaga

SEQ ID NO: 724585 - DNA, 20 bp, Artificial
  CRISPR gRNA sequence
agattatatagtatagaggt

SEQ ID NO: 724586 - DNA, 20 bp, Artificial
  CRISPR gRNA sequence
gattatatagtatagaggtc

SEQ ID NO: 724587 - DNA, 20 bp, Artificial
  CRISPR gRNA sequence
tatagtatagaggtcaccgg

SEQ ID NO: 724588 - DNA, 20 bp, Artificial
  CRISPR gRNA sequence
gtcacttgaactaacagtag

SEQ ID NO: 724589 - DNA, 20 bp, Artificial
  CRISPR gRNA sequence
tcacttgaactaacagtagt

SEQ ID NO: 724590 - DNA, 20 bp, Artificial
  CRISPR gRNA sequence
gaactaacagtagtctgttt

SEQ ID NO: 724591 - DNA, 20 bp, Artificial
  CRISPR gRNA sequence
aactaacagtagtctgtttt

SEQ ID NO: 724592 - DNA, 20 bp, Artificial
  CRISPR gRNA sequence
acagtagtctgtttttagaa

SEQ ID NO: 724593 - DNA, 20 bp, Artificial
  CRISPR gRNA sequence
tttttagaatgcttgagtgt

SEQ ID NO: 724594 - DNA, 20 bp, Artificial
  CRISPR gRNA sequence
ttagaatgcttgagtgtgat

SEQ ID NO: 724595 - DNA, 20 bp, Artificial
  CRISPR gRNA sequence
tagaatgcttgagtgtgatc

SEQ ID NO: 724596 - DNA, 20 bp, Artificial
  CRISPR gRNA sequence
agaatgcttgagtgtgatca

SEQ ID NO: 724597 - DNA, 20 bp, Artificial
  CRISPR gRNA sequence
gaatgcttgagtgtgatcat

SEQ ID NO: 724598 - DNA, 20 bp, Artificial
  CRISPR gRNA sequence
gagtgtgatcataaaagact

SEQ ID NO: 724599 - DNA, 20 bp, Artificial
  CRISPR gRNA sequence
agtgtgatcataaaagacta

SEQ ID NO: 724600 - DNA, 20 bp, Artificial
  CRISPR gRNA sequence
ctttccaggatgtcggggct

SEQ ID NO: 724601 - DNA, 20 bp, Artificial
  CRISPR gRNA sequence
tccaggatgtcggggctggg

SEQ ID NO: 724602 - DNA, 20 bp, Artificial
  CRISPR gRNA sequence
ccaggatgtcggggctgggg

SEQ ID NO: 724603 - DNA, 20 bp, Artificial
  CRISPR gRNA sequence
caggatgtcggggctgggga

SEQ ID NO: 724604 - DNA, 20 bp, Artificial
  CRISPR gRNA sequence
gggagctggaggggctgctc

SEQ ID NO: 724605 - DNA, 20 bp, Artificial
  CRISPR gRNA sequence
gaggggctgctccaggaggt

SEQ ID NO: 724606 - DNA, 20 bp, Artificial
  CRISPR gRNA sequence
ctccaggaggtgggggacct

SEQ ID NO: 724607 - DNA, 20 bp, Artificial
  CRISPR gRNA sequence
caggaggtgggggacctgga

SEQ ID NO: 724608 - DNA, 20 bp, Artificial
  CRISPR gRNA sequence
gagctggtacttacagactt

SEQ ID NO: 724609 - DNA, 20 bp, Artificial
  CRISPR gRNA sequence
gtacttacagacttgggtgc

SEQ ID NO: 724610 - DNA, 20 bp, Artificial
  CRISPR gRNA sequence
acagacttgggtgcttatga

SEQ ID NO: 724611 - DNA, 20 bp, Artificial
  CRISPR gRNA sequence
cagacttgggtgcttatgag

SEQ ID NO: 724612 - DNA, 20 bp, Artificial
  CRISPR gRNA sequence
gggtgcttatgagtgtgggt

SEQ ID NO: 724613 - DNA, 20 bp, Artificial
  CRISPR gRNA sequence
ggtgcttatgagtgtgggtt

SEQ ID NO: 724614 - DNA, 20 bp, Artificial
  CRISPR gRNA sequence
atgagtgtgggttatggacc

SEQ ID NO: 724615 - DNA, 20 bp, Artificial
  CRISPR gRNA sequence
tgagtgtgggttatggacca

SEQ ID NO: 724616 - DNA, 20 bp, Artificial
  CRISPR gRNA sequence
tggaccagatgccagggttc

SEQ ID NO: 724617 - DNA, 20 bp, Artificial
  CRISPR gRNA sequence
aaatcctagctcagatactt

SEQ ID NO: 724618 - DNA, 20 bp, Artificial
  CRISPR gRNA sequence
gctcagatacttattgatgg

SEQ ID NO: 724619 - DNA, 20 bp, Artificial
  CRISPR gRNA sequence
agatacttattgatggtata

SEQ ID NO: 724620 - DNA, 20 bp, Artificial
  CRISPR gRNA sequence
attgatggtataaccctggg

SEQ ID NO: 724621 - DNA, 20 bp, Artificial
  CRISPR gRNA sequence
ttgatggtataaccctgggc

SEQ ID NO: 724622 - DNA, 20 bp, Artificial
  CRISPR gRNA sequence
atggtataaccctgggccaa

SEQ ID NO: 724623 - DNA, 20 bp, Artificial
  CRISPR gRNA sequence
ggccaattactcgactcctc

SEQ ID NO: 724624 - DNA, 20 bp, Artificial
  CRISPR gRNA sequence
ctcgactcctctgtgcctca

SEQ ID NO: 724625 - DNA, 20 bp, Artificial
  CRISPR gRNA sequence
gactcctctgtgcctcagtt

SEQ ID NO: 724626 - DNA, 20 bp, Artificial
  CRISPR gRNA sequence
ctctgtgcctcagtttcctc

SEQ ID NO: 724627 - DNA, 20 bp, Artificial
  CRISPR gRNA sequence
tgtgcctcagtttcctcatc

SEQ ID NO: 724628 - DNA, 20 bp, Artificial
  CRISPR gRNA sequence
tgcctcagtttcctcatctg

SEQ ID NO: 724629 - DNA, 20 bp, Artificial
  CRISPR gRNA sequence
agtttcctcatctgtaaaat

SEQ ID NO: 724630 - DNA, 20 bp, Artificial
  CRISPR gRNA sequence
cctcatctgtaaaatgggga

SEQ ID NO: 724631 - DNA, 20 bp, Artificial
  CRISPR gRNA sequence
ctcatctgtaaaatggggag

SEQ ID NO: 724632 - DNA, 20 bp, Artificial
  CRISPR gRNA sequence
atctgtaaaatggggagtgg

SEQ ID NO: 724633 - DNA, 20 bp, Artificial
  CRISPR gRNA sequence
taaaatggggagtgggctgt

SEQ ID NO: 724634 - DNA, 20 bp, Artificial
  CRISPR gRNA sequence
ttacccacctcatacagtgg

SEQ ID NO: 724635 - DNA, 20 bp, Artificial
  CRISPR gRNA sequence
cccacctcatacagtggttg

SEQ ID NO: 724636 - DNA, 20 bp, Artificial
  CRISPR gRNA sequence
atacagtggttgtgaggatt

SEQ ID NO: 724637 - DNA, 20 bp, Artificial
  CRISPR gRNA sequence
tgaggattaacatatgtcaa

SEQ ID NO: 724638 - DNA, 20 bp, Artificial
  CRISPR gRNA sequence
acatatgtcaaggactttag

SEQ ID NO: 724639 - DNA, 20 bp, Artificial
  CRISPR gRNA sequence
taggacagggccaacggacg

SEQ ID NO: 724640 - DNA, 20 bp, Artificial
  CRISPR gRNA sequence
aggacagggccaacggacgt

SEQ ID NO: 724641 - DNA, 20 bp, Artificial
  CRISPR gRNA sequence
ggacagggccaacggacgtg

SEQ ID NO: 724642 - DNA, 20 bp, Artificial
  CRISPR gRNA sequence
tgagtcgctgactgttaccc

SEQ ID NO: 724643 - DNA, 20 bp, Artificial
  CRISPR gRNA sequence
actgttacccctactattta

SEQ ID NO: 724644 - DNA, 20 bp, Artificial
  CRISPR gRNA sequence
ttacccctactatttagtac

SEQ ID NO: 724645 - DNA, 20 bp, Artificial
  CRISPR gRNA sequence
cccctactatttagtacaaa

SEQ ID NO: 724646 - DNA, 20 bp, Artificial
  CRISPR gRNA sequence
ctatttagtacaaattaaaa

SEQ ID NO: 724647 - DNA, 20 bp, Artificial
  CRISPR gRNA sequence
tttagtacaaattaaaagca

SEQ ID NO: 724648 - DNA, 20 bp, Artificial
  CRISPR gRNA sequence
agtacaaattaaaagcaaca

SEQ ID NO: 724649 - DNA, 20 bp, Artificial
  CRISPR gRNA sequence
gtacaaattaaaagcaacag

SEQ ID NO: 724650 - DNA, 20 bp, Artificial
  CRISPR gRNA sequence
aaagcaacagacttcaccca

SEQ ID NO: 724651 - DNA, 20 bp, Artificial
  CRISPR gRNA sequence
cacccagaaagctgagaagc

SEQ ID NO: 724652 - DNA, 20 bp, Artificial
  CRISPR gRNA sequence
acccagaaagctgagaagcc

SEQ ID NO: 724653 - DNA, 20 bp, Artificial
  CRISPR gRNA sequence
agaagcccggggcagctcat

SEQ ID NO: 724654 - DNA, 20 bp, Artificial
  CRISPR gRNA sequence
atggcagcttttaaagcaga

SEQ ID NO: 724655 - DNA, 20 bp, Artificial
  CRISPR gRNA sequence
ttaaagcagaaagggggact

SEQ ID NO: 724656 - DNA, 20 bp, Artificial
  CRISPR gRNA sequence
taaagcagaaagggggactc

SEQ ID NO: 724657 - DNA, 20 bp, Artificial
  CRISPR gRNA sequence
aaagcagaaagggggactca

SEQ ID NO: 724658 - DNA, 20 bp, Artificial
  CRISPR gRNA sequence
aagcagaaagggggactcac

SEQ ID NO: 724659 - DNA, 20 bp, Artificial
  CRISPR gRNA sequence
actggggtctgtagagatga

SEQ ID NO: 724660 - DNA, 20 bp, Artificial
  CRISPR gRNA sequence
gggtctgtagagatgaaaaa

SEQ ID NO: 724661 - DNA, 20 bp, Artificial
  CRISPR gRNA sequence
tagagatgaaaaaaaaaagg

SEQ ID NO: 724662 - DNA, 20 bp, Artificial
  CRISPR gRNA sequence
ccagttcagagactggtggg

SEQ ID NO: 724663 - DNA, 20 bp, Artificial
  CRISPR gRNA sequence
agagactggtggggaggttg

SEQ ID NO: 724664 - DNA, 20 bp, Artificial
  CRISPR gRNA sequence
gtggggaggttgggggtacc

SEQ ID NO: 724665 - DNA, 20 bp, Artificial
  CRISPR gRNA sequence
ggggtaccctgcagcagcac

SEQ ID NO: 724666 - DNA, 20 bp, Artificial
  CRISPR gRNA sequence
cagcagcacccattcccgtc

SEQ ID NO: 724667 - DNA, 20 bp, Artificial
  CRISPR gRNA sequence
ccgtcccacagcagctgagg

SEQ ID NO: 724668 - DNA, 20 bp, Artificial
  CRISPR gRNA sequence
aggagtggtgcgtcggtgac

SEQ ID NO: 724669 - DNA, 20 bp, Artificial
  CRISPR gRNA sequence
atgagccagccactgatgga

SEQ ID NO: 724670 - DNA, 20 bp, Artificial
  CRISPR gRNA sequence
atggagacctgccacagcgt

SEQ ID NO: 724671 - DNA, 20 bp, Artificial
  CRISPR gRNA sequence
ccacagcgtgggggcagcct

SEQ ID NO: 724672 - DNA, 20 bp, Artificial
  CRISPR gRNA sequence
cctggagagcctgccgctgc

SEQ ID NO: 724673 - DNA, 20 bp, Artificial
  CRISPR gRNA sequence
gagagcctgccgctgcagga

SEQ ID NO: 724674 - DNA, 20 bp, Artificial
  CRISPR gRNA sequence
ccgctgcaggatgccagccc

SEQ ID NO: 724675 - DNA, 20 bp, Artificial
  CRISPR gRNA sequence
caggatgccagcccggccgg

SEQ ID NO: 724676 - DNA, 20 bp, Artificial
  CRISPR gRNA sequence
gtcccccagggaccttcctg

SEQ ID NO: 724677 - DNA, 20 bp, Artificial
  CRISPR gRNA sequence
cctgagccccgggtgtccac

SEQ ID NO: 724678 - DNA, 20 bp, Artificial
  CRISPR gRNA sequence
ctgagccccgggtgtccacg

SEQ ID NO: 724679 - DNA, 20 bp, Artificial
  CRISPR gRNA sequence
agccccgggtgtccacggag

SEQ ID NO: 724680 - DNA, 20 bp, Artificial
  CRISPR gRNA sequence
gtgagtcagcctgttttggg

SEQ ID NO: 724681 - DNA, 20 bp, Artificial
  CRISPR gRNA sequence
ttttgggaggtcccctgcag

SEQ ID NO: 724682 - DNA, 20 bp, Artificial
  CRISPR gRNA sequence
tgggaggtcccctgcagccc

SEQ ID NO: 724683 - DNA, 20 bp, Artificial
  CRISPR gRNA sequence
gggaggtcccctgcagccca

SEQ ID NO: 724684 - DNA, 20 bp, Artificial
  CRISPR gRNA sequence
ggaggtcccctgcagcccag

SEQ ID NO: 724685 - DNA, 20 bp, Artificial
  CRISPR gRNA sequence
cagcccaggggcagatggga

SEQ ID NO: 724686 - DNA, 20 bp, Artificial
  CRISPR gRNA sequence
ggccctggaagggacctgga

SEQ ID NO: 724687 - DNA, 20 bp, Artificial
  CRISPR gRNA sequence
gaagggacctggagaccctg

SEQ ID NO: 724688 - DNA, 20 bp, Artificial
  CRISPR gRNA sequence
gagaccctggagttgaaagg

SEQ ID NO: 724689 - DNA, 20 bp, Artificial
  CRISPR gRNA sequence
gagttgaaaggcccaggaaa

SEQ ID NO: 724690 - DNA, 20 bp, Artificial
  CRISPR gRNA sequence
aaaggcccaggaaaggagag

SEQ ID NO: 724691 - DNA, 20 bp, Artificial
  CRISPR gRNA sequence
ttcaccccaattgaagtttc

SEQ ID NO: 724692 - DNA, 20 bp, Artificial
  CRISPR gRNA sequence
caccccaattgaagtttctg

SEQ ID NO: 724693 - DNA, 20 bp, Artificial
  CRISPR gRNA sequence
accccaattgaagtttctgt

SEQ ID NO: 724694 - DNA, 20 bp, Artificial
  CRISPR gRNA sequence
aagtttctgtaagtagggac

SEQ ID NO: 724695 - DNA, 20 bp, Artificial
  CRISPR gRNA sequence
ctgtaagtagggacagcgag

SEQ ID NO: 724696 - DNA, 20 bp, Artificial
  CRISPR gRNA sequence
tgtaagtagggacagcgagg

SEQ ID NO: 724697 - DNA, 20 bp, Artificial
  CRISPR gRNA sequence
taagtagggacagcgagggt

SEQ ID NO: 724698 - DNA, 20 bp, Artificial
  CRISPR gRNA sequence
acctcgtaggccattgtgcg

SEQ ID NO: 724699 - DNA, 20 bp, Artificial
  CRISPR gRNA sequence
cctcgtaggccattgtgcgg

SEQ ID NO: 724700 - DNA, 20 bp, Artificial
  CRISPR gRNA sequence
gtaggccattgtgcggattc

SEQ ID NO: 724701 - DNA, 20 bp, Artificial
  CRISPR gRNA sequence
tgcggattcatgagccagtg

SEQ ID NO: 724702 - DNA, 20 bp, Artificial
  CRISPR gRNA sequence
atgagccagtgtgcatgaga

SEQ ID NO: 724703 - DNA, 20 bp, Artificial
  CRISPR gRNA sequence
ctgttactcataaaaaacga

SEQ ID NO: 724704 - DNA, 20 bp, Artificial
  CRISPR gRNA sequence
ttactcataaaaaacgaaca

SEQ ID NO: 724705 - DNA, 20 bp, Artificial
  CRISPR gRNA sequence
ctcataaaaaacgaacacca

SEQ ID NO: 724706 - DNA, 20 bp, Artificial
  CRISPR gRNA sequence
ataaaaaacgaacaccaccc

SEQ ID NO: 724707 - DNA, 20 bp, Artificial
  CRISPR gRNA sequence
ccacttgtctggcgcattcc

SEQ ID NO: 724708 - DNA, 20 bp, Artificial
  CRISPR gRNA sequence
gtctggcgcattccgggcac

SEQ ID NO: 724709 - DNA, 20 bp, Artificial
  CRISPR gRNA sequence
tctggcgcattccgggcact

SEQ ID NO: 724710 - DNA, 20 bp, Artificial
  CRISPR gRNA sequence
gcgcattccgggcactgtgt

SEQ ID NO: 724711 - DNA, 20 bp, Artificial
  CRISPR gRNA sequence
cgggcactgtgtaggtgcca

SEQ ID NO: 724712 - DNA, 20 bp, Artificial
  CRISPR gRNA sequence
tgtaggtgccatctcttcat

SEQ ID NO: 724713 - DNA, 20 bp, Artificial
  CRISPR gRNA sequence
ttcatctctgatggtctcac

SEQ ID NO: 724714 - DNA, 20 bp, Artificial
  CRISPR gRNA sequence
catctctgatggtctcacca

SEQ ID NO: 724715 - DNA, 20 bp, Artificial
  CRISPR gRNA sequence
atctctgatggtctcaccac

SEQ ID NO: 724716 - DNA, 20 bp, Artificial
  CRISPR gRNA sequence
tgatggtctcaccaccttct

SEQ ID NO: 724717 - DNA, 20 bp, Artificial
  CRISPR gRNA sequence
atggtctcaccaccttcttt

SEQ ID NO: 724718 - DNA, 20 bp, Artificial
  CRISPR gRNA sequence
accaccttctttggatggtg

SEQ ID NO: 724719 - DNA, 20 bp, Artificial
  CRISPR gRNA sequence
ctttggatggtgtctttctc

SEQ ID NO: 724720 - DNA, 20 bp, Artificial
  CRISPR gRNA sequence
tttggatggtgtctttctcc

SEQ ID NO: 724721 - DNA, 20 bp, Artificial
  CRISPR gRNA sequence
tggatggtgtctttctcccc

SEQ ID NO: 724722 - DNA, 20 bp, Artificial
  CRISPR gRNA sequence
ggatggtgtctttctcccca

SEQ ID NO: 724723 - DNA, 20 bp, Artificial
  CRISPR gRNA sequence
gatggtgtctttctccccat

SEQ ID NO: 724724 - DNA, 20 bp, Artificial
  CRISPR gRNA sequence
tctccccattttacagttgg

SEQ ID NO: 724725 - DNA, 20 bp, Artificial
  CRISPR gRNA sequence
ctccccattttacagttggg

SEQ ID NO: 724726 - DNA, 20 bp, Artificial
  CRISPR gRNA sequence
tccccattttacagttgggg

SEQ ID NO: 724727 - DNA, 20 bp, Artificial
  CRISPR gRNA sequence
cccattttacagttggggag

SEQ ID NO: 724728 - DNA, 20 bp, Artificial
  CRISPR gRNA sequence
tacagttggggagaccgtgg

SEQ ID NO: 724729 - DNA, 20 bp, Artificial
  CRISPR gRNA sequence
acagttggggagaccgtggc

SEQ ID NO: 724730 - DNA, 20 bp, Artificial
  CRISPR gRNA sequence
cagttggggagaccgtggct

SEQ ID NO: 724731 - DNA, 20 bp, Artificial
  CRISPR gRNA sequence
gggagaccgtggctcagagg

SEQ ID NO: 724732 - DNA, 20 bp, Artificial
  CRISPR gRNA sequence
agagggtgaagtgattttcc

SEQ ID NO: 724733 - DNA, 20 bp, Artificial
  CRISPR gRNA sequence
tccccattgcatggctacta

SEQ ID NO: 724734 - DNA, 20 bp, Artificial
  CRISPR gRNA sequence
ccccattgcatggctactaa

SEQ ID NO: 724735 - DNA, 20 bp, Artificial
  CRISPR gRNA sequence
cccattgcatggctactaag

SEQ ID NO: 724736 - DNA, 20 bp, Artificial
  CRISPR gRNA sequence
catggctactaagtggcaca

SEQ ID NO: 724737 - DNA, 20 bp, Artificial
  CRISPR gRNA sequence
ctaagtggcacagctggaac

SEQ ID NO: 724738 - DNA, 20 bp, Artificial
  CRISPR gRNA sequence
agtggcacagctggaactcg

SEQ ID NO: 724739 - DNA, 20 bp, Artificial
  CRISPR gRNA sequence
gaactcgtcccgcatctgct

SEQ ID NO: 724740 - DNA, 20 bp, Artificial
  CRISPR gRNA sequence
gtcccgcatctgctgggcct

SEQ ID NO: 724741 - DNA, 20 bp, Artificial
  CRISPR gRNA sequence
ctgggccttgaagcccgtgg

SEQ ID NO: 724742 - DNA, 20 bp, Artificial
  CRISPR gRNA sequence
ggccttgaagcccgtggttt

SEQ ID NO: 724743 - DNA, 20 bp, Artificial
  CRISPR gRNA sequence
gaagcccgtggtttgtccac

SEQ ID NO: 724744 - DNA, 20 bp, Artificial
  CRISPR gRNA sequence
aagcccgtggtttgtccacg

SEQ ID NO: 724745 - DNA, 20 bp, Artificial
  CRISPR gRNA sequence
gtccacgttaccacccaccc

SEQ ID NO: 724746 - DNA, 20 bp, Artificial
  CRISPR gRNA sequence
tccacgttaccacccaccct

SEQ ID NO: 724747 - DNA, 20 bp, Artificial
  CRISPR gRNA sequence
ccacccaccctctgcagaag

SEQ ID NO: 724748 - DNA, 20 bp, Artificial
  CRISPR gRNA sequence
tgcagaagcaggaggacaga

SEQ ID NO: 724749 - DNA, 20 bp, Artificial
  CRISPR gRNA sequence
cagaagcaggaggacagatg

SEQ ID NO: 724750 - DNA, 20 bp, Artificial
  CRISPR gRNA sequence
agagcttcccaacggcagct

SEQ ID NO: 724751 - DNA, 20 bp, Artificial
  CRISPR gRNA sequence
cccaacggcagctgctgcca

SEQ ID NO: 724752 - DNA, 20 bp, Artificial
  CRISPR gRNA sequence
ccaacggcagctgctgccag

SEQ ID NO: 724753 - DNA, 20 bp, Artificial
  CRISPR gRNA sequence
ctgccagcctggacagacat

SEQ ID NO: 724754 - DNA, 20 bp, Artificial
  CRISPR gRNA sequence
ccagcctggacagacattgg

SEQ ID NO: 724755 - DNA, 20 bp, Artificial
  CRISPR gRNA sequence
gacagacattggctttggcc

SEQ ID NO: 724756 - DNA, 20 bp, Artificial
  CRISPR gRNA sequence
gctttggcctcctgtgggcc

SEQ ID NO: 724757 - DNA, 20 bp, Artificial
  CRISPR gRNA sequence
tggcctcctgtgggcctccc

SEQ ID NO: 724758 - DNA, 20 bp, Artificial
  CRISPR gRNA sequence
ggcctcctgtgggcctccct

SEQ ID NO: 724759 - DNA, 20 bp, Artificial
  CRISPR gRNA sequence
gcctcctgtgggcctccctg

SEQ ID NO: 724760 - DNA, 20 bp, Artificial
  CRISPR gRNA sequence
ctgtgggcctccctgcctcc

SEQ ID NO: 724761 - DNA, 20 bp, Artificial
  CRISPR gRNA sequence
tgggcctccctgcctcctct

SEQ ID NO: 724762 - DNA, 20 bp, Artificial
  CRISPR gRNA sequence
cctgcctcctctcttgcttc

SEQ ID NO: 724763 - DNA, 20 bp, Artificial
  CRISPR gRNA sequence
cctcctctcttgcttctcat

SEQ ID NO: 724764 - DNA, 20 bp, Artificial
  CRISPR gRNA sequence
ctctcttgcttctcatcacc

SEQ ID NO: 724765 - DNA, 20 bp, Artificial
  CRISPR gRNA sequence
tcttgcttctcatcaccttg

SEQ ID NO: 724766 - DNA, 20 bp, Artificial
  CRISPR gRNA sequence
ttgcttctcatcaccttggt

SEQ ID NO: 724767 - DNA, 20 bp, Artificial
  CRISPR gRNA sequence
gcttctcatcaccttggtac

SEQ ID NO: 724768 - DNA, 20 bp, Artificial
  CRISPR gRNA sequence
cttctcatcaccttggtacg

SEQ ID NO: 724769 - DNA, 20 bp, Artificial
  CRISPR gRNA sequence
ctcatcaccttggtacggca

SEQ ID NO: 724770 - DNA, 20 bp, Artificial
  CRISPR gRNA sequence
tcatcaccttggtacggcat

SEQ ID NO: 724771 - DNA, 20 bp, Artificial
  CRISPR gRNA sequence
atcaccttggtacggcattt

SEQ ID NO: 724772 - DNA, 20 bp, Artificial
  CRISPR gRNA sequence
ggtacggcattttccccaaa

SEQ ID NO: 724773 - DNA, 20 bp, Artificial
  CRISPR gRNA sequence
gtacggcattttccccaaaa

SEQ ID NO: 724774 - DNA, 20 bp, Artificial
  CRISPR gRNA sequence
tccccaaaatgtatacctga

SEQ ID NO: 724775 - DNA, 20 bp, Artificial
  CRISPR gRNA sequence
ccccaaaatgtatacctgac

SEQ ID NO: 724776 - DNA, 20 bp, Artificial
  CRISPR gRNA sequence
cccaaaatgtatacctgacc

SEQ ID NO: 724777 - DNA, 20 bp, Artificial
  CRISPR gRNA sequence
accctattgcactcctgccg

SEQ ID NO: 724778 - DNA, 20 bp, Artificial
  CRISPR gRNA sequence
ttgcactcctgccgagaagc

SEQ ID NO: 724779 - DNA, 20 bp, Artificial
  CRISPR gRNA sequence
cactcctgccgagaagcctc

SEQ ID NO: 724780 - DNA, 20 bp, Artificial
  CRISPR gRNA sequence
ctgccgagaagcctccagca

SEQ ID NO: 724781 - DNA, 20 bp, Artificial
  CRISPR gRNA sequence
ccgagaagcctccagcagct

SEQ ID NO: 724782 - DNA, 20 bp, Artificial
  CRISPR gRNA sequence
cagcagcttcccattcccta

SEQ ID NO: 724783 - DNA, 20 bp, Artificial
  CRISPR gRNA sequence
cccattccctatgggatgaa

SEQ ID NO: 724784 - DNA, 20 bp, Artificial
  CRISPR gRNA sequence
ccattccctatgggatgaat

SEQ ID NO: 724785 - DNA, 20 bp, Artificial
  CRISPR gRNA sequence
cctatgggatgaattccagc

SEQ ID NO: 724786 - DNA, 20 bp, Artificial
  CRISPR gRNA sequence
tgggatgaattccagcattc

SEQ ID NO: 724787 - DNA, 20 bp, Artificial
  CRISPR gRNA sequence
cagcattcttattccagcac

SEQ ID NO: 724788 - DNA, 20 bp, Artificial
  CRISPR gRNA sequence
ttattccagcactcaaggct

SEQ ID NO: 724789 - DNA, 20 bp, Artificial
  CRISPR gRNA sequence
attccagcactcaaggctga

SEQ ID NO: 724790 - DNA, 20 bp, Artificial
  CRISPR gRNA sequence
ttccagcactcaaggctgac

SEQ ID NO: 724791 - DNA, 20 bp, Artificial
  CRISPR gRNA sequence
cagcactcaaggctgacagc

SEQ ID NO: 724792 - DNA, 20 bp, Artificial
  CRISPR gRNA sequence
aaggctgacagcaagttgta

SEQ ID NO: 724793 - DNA, 20 bp, Artificial
  CRISPR gRNA sequence
acagcaagttgtagctcccc

SEQ ID NO: 724794 - DNA, 20 bp, Artificial
  CRISPR gRNA sequence
tagctccccgaccagactca

SEQ ID NO: 724795 - DNA, 20 bp, Artificial
  CRISPR gRNA sequence
cccgaccagactcacctacc

SEQ ID NO: 724796 - DNA, 20 bp, Artificial
  CRISPR gRNA sequence
acctaccttctgaccccaca

SEQ ID NO: 724797 - DNA, 20 bp, Artificial
  CRISPR gRNA sequence
ccttctgaccccacagtctg

SEQ ID NO: 724798 - DNA, 20 bp, Artificial
  CRISPR gRNA sequence
ctgaccccacagtctgtccc

SEQ ID NO: 724799 - DNA, 20 bp, Artificial
  CRISPR gRNA sequence
tgaccccacagtctgtccct

SEQ ID NO: 724800 - DNA, 20 bp, Artificial
  CRISPR gRNA sequence
accccacagtctgtccctcc

SEQ ID NO: 724801 - DNA, 20 bp, Artificial
  CRISPR gRNA sequence
tccctccccctcatggcagt

SEQ ID NO: 724802 - DNA, 20 bp, Artificial
  CRISPR gRNA sequence
cccctcatggcagtctccca

SEQ ID NO: 724803 - DNA, 20 bp, Artificial
  CRISPR gRNA sequence
atggcagtctcccaaattta

SEQ ID NO: 724804 - DNA, 20 bp, Artificial
  CRISPR gRNA sequence
ccaaatttacagacccctct

SEQ ID NO: 724805 - DNA, 20 bp, Artificial
  CRISPR gRNA sequence
acagacccctctgtcacttc

SEQ ID NO: 724806 - DNA, 20 bp, Artificial
  CRISPR gRNA sequence
cagacccctctgtcacttct

SEQ ID NO: 724807 - DNA, 20 bp, Artificial
  CRISPR gRNA sequence
tgtcacttctgagcttctca

SEQ ID NO: 724808 - DNA, 20 bp, Artificial
  CRISPR gRNA sequence
tcacttctgagcttctcaat

SEQ ID NO: 724809 - DNA, 20 bp, Artificial
  CRISPR gRNA sequence
ctgagcttctcaatgggagc

SEQ ID NO: 724810 - DNA, 20 bp, Artificial
  CRISPR gRNA sequence
tgagcttctcaatgggagct

SEQ ID NO: 724811 - DNA, 20 bp, Artificial
  CRISPR gRNA sequence
agcttctcaatgggagctac

SEQ ID NO: 724812 - DNA, 20 bp, Artificial
  CRISPR gRNA sequence
ctcaatgggagctaccccct

SEQ ID NO: 724813 - DNA, 20 bp, Artificial
  CRISPR gRNA sequence
tcaatgggagctaccccctc

SEQ ID NO: 724814 - DNA, 20 bp, Artificial
  CRISPR gRNA sequence
aatgggagctaccccctcgc

SEQ ID NO: 724815 - DNA, 20 bp, Artificial
  CRISPR gRNA sequence
ccccctcgcctgaaatagcc

SEQ ID NO: 724816 - DNA, 20 bp, Artificial
  CRISPR gRNA sequence
gcctgaaatagccaactcca

SEQ ID NO: 724817 - DNA, 20 bp, Artificial
  CRISPR gRNA sequence
aaatagccaactccactgcc

SEQ ID NO: 724818 - DNA, 20 bp, Artificial
  CRISPR gRNA sequence
cactgccttgaatccagtta

SEQ ID NO: 724819 - DNA, 20 bp, Artificial
  CRISPR gRNA sequence
ccttgaatccagttaattct

SEQ ID NO: 724820 - DNA, 20 bp, Artificial
  CRISPR gRNA sequence
gaatccagttaattctggat

SEQ ID NO: 724821 - DNA, 20 bp, Artificial
  CRISPR gRNA sequence
aatccagttaattctggata

SEQ ID NO: 724822 - DNA, 20 bp, Artificial
  CRISPR gRNA sequence
attctggatatcctggggac

SEQ ID NO: 724823 - DNA, 20 bp, Artificial
  CRISPR gRNA sequence
tggatatcctggggaccctg

SEQ ID NO: 724824 - DNA, 20 bp, Artificial
  CRISPR gRNA sequence
gatatcctggggaccctgct

SEQ ID NO: 724825 - DNA, 20 bp, Artificial
  CRISPR gRNA sequence
gggaccctgcttatttgccc

SEQ ID NO: 724826 - DNA, 20 bp, Artificial
  CRISPR gRNA sequence
cttatttgccccttcctcca

SEQ ID NO: 724827 - DNA, 20 bp, Artificial
  CRISPR gRNA sequence
atttgccccttcctccagga

SEQ ID NO: 724828 - DNA, 20 bp, Artificial
  CRISPR gRNA sequence
tttgccccttcctccaggaa

SEQ ID NO: 724829 - DNA, 20 bp, Artificial
  CRISPR gRNA sequence
gccccttcctccaggaagcc

SEQ ID NO: 724830 - DNA, 20 bp, Artificial
  CRISPR gRNA sequence
ccccttcctccaggaagcct

SEQ ID NO: 724831 - DNA, 20 bp, Artificial
  CRISPR gRNA sequence
cctccaggaagccttctgtg

SEQ ID NO: 724832 - DNA, 20 bp, Artificial
  CRISPR gRNA sequence
ctccaggaagccttctgtgc

SEQ ID NO: 724833 - DNA, 20 bp, Artificial
  CRISPR gRNA sequence
caggaagccttctgtgccct

SEQ ID NO: 724834 - DNA, 20 bp, Artificial
  CRISPR gRNA sequence
ctgtgccctctccaccatgc

SEQ ID NO: 724835 - DNA, 20 bp, Artificial
  CRISPR gRNA sequence
tgtgccctctccaccatgct

SEQ ID NO: 724836 - DNA, 20 bp, Artificial
  CRISPR gRNA sequence
tgccctctccaccatgctat

SEQ ID NO: 724837 - DNA, 20 bp, Artificial
  CRISPR gRNA sequence
tccaccatgctatgctccct

SEQ ID NO: 724838 - DNA, 20 bp, Artificial
  CRISPR gRNA sequence
caccatgctatgctccctaa

SEQ ID NO: 724839 - DNA, 20 bp, Artificial
  CRISPR gRNA sequence
tgctccctaagaacccaggc

SEQ ID NO: 724840 - DNA, 20 bp, Artificial
  CRISPR gRNA sequence
cctaagaacccaggcctccc

SEQ ID NO: 724841 - DNA, 20 bp, Artificial
  CRISPR gRNA sequence
agaacccaggcctcccctac

SEQ ID NO: 724842 - DNA, 20 bp, Artificial
  CRISPR gRNA sequence
ccctacccggtgtcctagca

SEQ ID NO: 724843 - DNA, 20 bp, Artificial
  CRISPR gRNA sequence
cccggtgtcctagcacccag

SEQ ID NO: 724844 - DNA, 20 bp, Artificial
  CRISPR gRNA sequence
gcacccagtggtgtgactgc

SEQ ID NO: 724845 - DNA, 20 bp, Artificial
  CRISPR gRNA sequence
cgtgtttatagccttcctcc

SEQ ID NO: 724846 - DNA, 20 bp, Artificial
  CRISPR gRNA sequence
atagccttcctccacctcca

SEQ ID NO: 724847 - DNA, 20 bp, Artificial
  CRISPR gRNA sequence
tagccttcctccacctccac

SEQ ID NO: 724848 - DNA, 20 bp, Artificial
  CRISPR gRNA sequence
cctccacctccacctggctt

SEQ ID NO: 724849 - DNA, 20 bp, Artificial
  CRISPR gRNA sequence
ctccacctccacctggcttt

SEQ ID NO: 724850 - DNA, 20 bp, Artificial
  CRISPR gRNA sequence
cacctccacctggctttgtg

SEQ ID NO: 724851 - DNA, 20 bp, Artificial
  CRISPR gRNA sequence
cacctggctttgtgctccct

SEQ ID NO: 724852 - DNA, 20 bp, Artificial
  CRISPR gRNA sequence
gctttgtgctccctgtgggc

SEQ ID NO: 724853 - DNA, 20 bp, Artificial
  CRISPR gRNA sequence
tgtgctccctgtgggcaggg

SEQ ID NO: 724854 - DNA, 20 bp, Artificial
  CRISPR gRNA sequence
gtgctccctgtgggcagggc

SEQ ID NO: 724855 - DNA, 20 bp, Artificial
  CRISPR gRNA sequence
tgctccctgtgggcagggcc

SEQ ID NO: 724856 - DNA, 20 bp, Artificial
  CRISPR gRNA sequence
cctgtgggcagggccttggt

SEQ ID NO: 724857 - DNA, 20 bp, Artificial
  CRISPR gRNA sequence
tgggcagggccttggtggac

SEQ ID NO: 724858 - DNA, 20 bp, Artificial
  CRISPR gRNA sequence
ggtggaccccacctctgtcg

SEQ ID NO: 724859 - DNA, 20 bp, Artificial
  CRISPR gRNA sequence
gtggaccccacctctgtcgc

SEQ ID NO: 724860 - DNA, 20 bp, Artificial
  CRISPR gRNA sequence
tgtcgcttctggaagggtaa

SEQ ID NO: 724861 - DNA, 20 bp, Artificial
  CRISPR gRNA sequence
tcgcttctggaagggtaact

SEQ ID NO: 724862 - DNA, 20 bp, Artificial
  CRISPR gRNA sequence
ctggaagggtaactggcact

SEQ ID NO: 724863 - DNA, 20 bp, Artificial
  CRISPR gRNA sequence
tggaagggtaactggcactg

SEQ ID NO: 724864 - DNA, 20 bp, Artificial
  CRISPR gRNA sequence
gaagggtaactggcactggg

SEQ ID NO: 724865 - DNA, 20 bp, Artificial
  CRISPR gRNA sequence
gcactgggataatactgaag

SEQ ID NO: 724866 - DNA, 20 bp, Artificial
  CRISPR gRNA sequence
ggataatactgaagagtcat

SEQ ID NO: 724867 - DNA, 20 bp, Artificial
  CRISPR gRNA sequence
aagagtcatttgtaattgtc

SEQ ID NO: 724868 - DNA, 20 bp, Artificial
  CRISPR gRNA sequence
gtaattgtcctgtgcatttc

SEQ ID NO: 724869 - DNA, 20 bp, Artificial
  CRISPR gRNA sequence
taattgtcctgtgcatttct

SEQ ID NO: 724870 - DNA, 20 bp, Artificial
  CRISPR gRNA sequence
tcctgtgcatttctatggca

SEQ ID NO: 724871 - DNA, 20 bp, Artificial
  CRISPR gRNA sequence
tgcatttctatggcagacag

SEQ ID NO: 724872 - DNA, 20 bp, Artificial
  CRISPR gRNA sequence
ctatggcagacagtggtggc

SEQ ID NO: 724873 - DNA, 20 bp, Artificial
  CRISPR gRNA sequence
tatggcagacagtggtggcc

SEQ ID NO: 724874 - DNA, 20 bp, Artificial
  CRISPR gRNA sequence
tggcagacagtggtggccag

SEQ ID NO: 724875 - DNA, 20 bp, Artificial
  CRISPR gRNA sequence
ttcagggcagtcatcttctc

SEQ ID NO: 724876 - DNA, 20 bp, Artificial
  CRISPR gRNA sequence
cagggcagtcatcttctctt

SEQ ID NO: 724877 - DNA, 20 bp, Artificial
  CRISPR gRNA sequence
agggcagtcatcttctcttt

SEQ ID NO: 724878 - DNA, 20 bp, Artificial
  CRISPR gRNA sequence
ctctttttattttttcagcc

SEQ ID NO: 724879 - DNA, 20 bp, Artificial
  CRISPR gRNA sequence
tctttttattttttcagcct

SEQ ID NO: 724880 - DNA, 20 bp, Artificial
  CRISPR gRNA sequence
tttttattttttcagcctcc

SEQ ID NO: 724881 - DNA, 20 bp, Artificial
  CRISPR gRNA sequence
tttattttttcagcctcctg

SEQ ID NO: 724882 - DNA, 20 bp, Artificial
  CRISPR gRNA sequence
ttattttttcagcctcctga

SEQ ID NO: 724883 - DNA, 20 bp, Artificial
  CRISPR gRNA sequence
tattttttcagcctcctgag

SEQ ID NO: 724884 - DNA, 20 bp, Artificial
  CRISPR gRNA sequence
attttttcagcctcctgagt

SEQ ID NO: 724885 - DNA, 20 bp, Artificial
  CRISPR gRNA sequence
ttttttcagcctcctgagta

SEQ ID NO: 724886 - DNA, 20 bp, Artificial
  CRISPR gRNA sequence
tttcagcctcctgagtagct

SEQ ID NO: 724887 - DNA, 20 bp, Artificial
  CRISPR gRNA sequence
ttcagcctcctgagtagctg

SEQ ID NO: 724888 - DNA, 20 bp, Artificial
  CRISPR gRNA sequence
tcagcctcctgagtagctgg

SEQ ID NO: 724889 - DNA, 20 bp, Artificial
  CRISPR gRNA sequence
cagcctcctgagtagctggg

SEQ ID NO: 724890 - DNA, 20 bp, Artificial
  CRISPR gRNA sequence
agcctcctgagtagctggga

SEQ ID NO: 724891 - DNA, 20 bp, Artificial
  CRISPR gRNA sequence
ctgagtagctgggattatgg

SEQ ID NO: 724892 - DNA, 20 bp, Artificial
  CRISPR gRNA sequence
agtagctgggattatgggcg

SEQ ID NO: 724893 - DNA, 20 bp, Artificial
  CRISPR gRNA sequence
ggattatgggcgagtgtcat

SEQ ID NO: 724894 - DNA, 20 bp, Artificial
  CRISPR gRNA sequence
tgggcgagtgtcatcatgcc

SEQ ID NO: 724895 - DNA, 20 bp, Artificial
  CRISPR gRNA sequence
gctaattttttgtattttta

SEQ ID NO: 724896 - DNA, 20 bp, Artificial
  CRISPR gRNA sequence
attttttgtatttttagtag

SEQ ID NO: 724897 - DNA, 20 bp, Artificial
  CRISPR gRNA sequence
tttgtatttttagtagagat

SEQ ID NO: 724898 - DNA, 20 bp, Artificial
  CRISPR gRNA sequence
ttgtatttttagtagagatg

SEQ ID NO: 724899 - DNA, 20 bp, Artificial
  CRISPR gRNA sequence
tgtatttttagtagagatgg

SEQ ID NO: 724900 - DNA, 20 bp, Artificial
  CRISPR gRNA sequence
gtatttttagtagagatggg

SEQ ID NO: 724901 - DNA, 20 bp, Artificial
  CRISPR gRNA sequence
tatttttagtagagatgggg

SEQ ID NO: 724902 - DNA, 20 bp, Artificial
  CRISPR gRNA sequence
ttagtagagatggggtttca

SEQ ID NO: 724903 - DNA, 20 bp, Artificial
  CRISPR gRNA sequence
tagtagagatggggtttcac

SEQ ID NO: 724904 - DNA, 20 bp, Artificial
  CRISPR gRNA sequence
agtagagatggggtttcact

SEQ ID NO: 724905 - DNA, 20 bp, Artificial
  CRISPR gRNA sequence
gtagagatggggtttcactc

SEQ ID NO: 724906 - DNA, 20 bp, Artificial
  CRISPR gRNA sequence
cactctgttggccaggctgg

SEQ ID NO: 724907 - DNA, 20 bp, Artificial
  CRISPR gRNA sequence
actctgttggccaggctggt

SEQ ID NO: 724908 - DNA, 20 bp, Artificial
  CRISPR gRNA sequence
tgttggccaggctggtctgg

SEQ ID NO: 724909 - DNA, 20 bp, Artificial
  CRISPR gRNA sequence
ttggccaggctggtctggaa

SEQ ID NO: 724910 - DNA, 20 bp, Artificial
  CRISPR gRNA sequence
gccaggctggtctggaactc

SEQ ID NO: 724911 - DNA, 20 bp, Artificial
  CRISPR gRNA sequence
gtctggaactcctggcctca

SEQ ID NO: 724912 - DNA, 20 bp, Artificial
  CRISPR gRNA sequence
gaactcctggcctcaaggtg

SEQ ID NO: 724913 - DNA, 20 bp, Artificial
  CRISPR gRNA sequence
ctggcctcaaggtgatctgc

SEQ ID NO: 724914 - DNA, 20 bp, Artificial
  CRISPR gRNA sequence
gcctcaaggtgatctgcctg

SEQ ID NO: 724915 - DNA, 20 bp, Artificial
  CRISPR gRNA sequence
aaggtgatctgcctgccttg

SEQ ID NO: 724916 - DNA, 20 bp, Artificial
  CRISPR gRNA sequence
cctgccttggcctcccaaag

SEQ ID NO: 724917 - DNA, 20 bp, Artificial
  CRISPR gRNA sequence
ccttggcctcccaaagtact

SEQ ID NO: 724918 - DNA, 20 bp, Artificial
  CRISPR gRNA sequence
ggcctcccaaagtactggga

SEQ ID NO: 724919 - DNA, 20 bp, Artificial
  CRISPR gRNA sequence
gcctcccaaagtactgggat

SEQ ID NO: 724920 - DNA, 20 bp, Artificial
  CRISPR gRNA sequence
ccaaagtactgggattatag

SEQ ID NO: 724921 - DNA, 20 bp, Artificial
  CRISPR gRNA sequence
ggattataggcatgagccac

SEQ ID NO: 724922 - DNA, 20 bp, Artificial
  CRISPR gRNA sequence
taggcatgagccaccatgcc

SEQ ID NO: 724923 - DNA, 20 bp, Artificial
  CRISPR gRNA sequence
ggcagtcttttgtaacaaac

SEQ ID NO: 724924 - DNA, 20 bp, Artificial
  CRISPR gRNA sequence
ttgtaacaaactgaagcttt

SEQ ID NO: 724925 - DNA, 20 bp, Artificial
  CRISPR gRNA sequence
tgtaacaaactgaagctttt

SEQ ID NO: 724926 - DNA, 20 bp, Artificial
  CRISPR gRNA sequence
gtaacaaactgaagcttttg

SEQ ID NO: 724927 - DNA, 20 bp, Artificial
  CRISPR gRNA sequence
taacaaactgaagcttttga

SEQ ID NO: 724928 - DNA, 20 bp, Artificial
  CRISPR gRNA sequence
aagcttttgaaatggtagct

SEQ ID NO: 724929 - DNA, 20 bp, Artificial
  CRISPR gRNA sequence
ttgaaatggtagcttttagt

SEQ ID NO: 724930 - DNA, 20 bp, Artificial
  CRISPR gRNA sequence
tgaaatggtagcttttagta

SEQ ID NO: 724931 - DNA, 20 bp, Artificial
  CRISPR gRNA sequence
gaaatggtagcttttagtaa

SEQ ID NO: 724932 - DNA, 20 bp, Artificial
  CRISPR gRNA sequence
aaatggtagcttttagtaag

SEQ ID NO: 724933 - DNA, 20 bp, Artificial
  CRISPR gRNA sequence
ttagtaagttttatttgaaa

SEQ ID NO: 724934 - DNA, 20 bp, Artificial
  CRISPR gRNA sequence
tagtaagttttatttgaaaa

SEQ ID NO: 724935 - DNA, 20 bp, Artificial
  CRISPR gRNA sequence
agtaagttttatttgaaaag

SEQ ID NO: 724936 - DNA, 20 bp, Artificial
  CRISPR gRNA sequence
gtaagttttatttgaaaagt

SEQ ID NO: 724937 - DNA, 20 bp, Artificial
  CRISPR gRNA sequence
tatttgaaaagtatgtattt

SEQ ID NO: 724938 - DNA, 20 bp, Artificial
  CRISPR gRNA sequence
atttgaaaagtatgtatttt

SEQ ID NO: 724939 - DNA, 20 bp, Artificial
  CRISPR gRNA sequence
tttgaaaagtatgtattttg

SEQ ID NO: 724940 - DNA, 20 bp, Artificial
  CRISPR gRNA sequence
gaaaagtatgtattttggga

SEQ ID NO: 724941 - DNA, 20 bp, Artificial
  CRISPR gRNA sequence
aaaagtatgtattttgggaa

SEQ ID NO: 724942 - DNA, 20 bp, Artificial
  CRISPR gRNA sequence
tgggaaataccatcaaaggc

SEQ ID NO: 724943 - DNA, 20 bp, Artificial
  CRISPR gRNA sequence
gggaaataccatcaaaggct

SEQ ID NO: 724944 - DNA, 20 bp, Artificial
  CRISPR gRNA sequence
ggaaataccatcaaaggctt

SEQ ID NO: 724945 - DNA, 20 bp, Artificial
  CRISPR gRNA sequence
cttcagaattcctaagaagt

SEQ ID NO: 724946 - DNA, 20 bp, Artificial
  CRISPR gRNA sequence
ttcagaattcctaagaagtc

SEQ ID NO: 724947 - DNA, 20 bp, Artificial
  CRISPR gRNA sequence
cagaattcctaagaagtcct

SEQ ID NO: 724948 - DNA, 20 bp, Artificial
  CRISPR gRNA sequence
agaattcctaagaagtccta

SEQ ID NO: 724949 - DNA, 20 bp, Artificial
  CRISPR gRNA sequence
ctaagaagtcctaactggaa

SEQ ID NO: 724950 - DNA, 20 bp, Artificial
  CRISPR gRNA sequence
agaagtcctaactggaactt

SEQ ID NO: 724951 - DNA, 20 bp, Artificial
  CRISPR gRNA sequence
actggaacttctgagtccac

SEQ ID NO: 724952 - DNA, 20 bp, Artificial
  CRISPR gRNA sequence
gaacttctgagtccacactg

SEQ ID NO: 724953 - DNA, 20 bp, Artificial
  CRISPR gRNA sequence
ctgagtccacactgagtaca

SEQ ID NO: 724954 - DNA, 20 bp, Artificial
  CRISPR gRNA sequence
tgagtccacactgagtacag

SEQ ID NO: 724955 - DNA, 20 bp, Artificial
  CRISPR gRNA sequence
agtccacactgagtacagtg

SEQ ID NO: 724956 - DNA, 20 bp, Artificial
  CRISPR gRNA sequence
agtacagtgcctggaatccc

SEQ ID NO: 724957 - DNA, 20 bp, Artificial
  CRISPR gRNA sequence
gaatcccaggggtggggttc

SEQ ID NO: 724958 - DNA, 20 bp, Artificial
  CRISPR gRNA sequence
agagggtgtttgatggggag

SEQ ID NO: 724959 - DNA, 20 bp, Artificial
  CRISPR gRNA sequence
gatggggaggagaaggaagt

SEQ ID NO: 724960 - DNA, 20 bp, Artificial
  CRISPR gRNA sequence
atggggaggagaaggaagta

SEQ ID NO: 724961 - DNA, 20 bp, Artificial
  CRISPR gRNA sequence
ccaggcagctggctcaggtg

SEQ ID NO: 724962 - DNA, 20 bp, Artificial
  CRISPR gRNA sequence
gctcaggtgtgggctgccct

SEQ ID NO: 724963 - DNA, 20 bp, Artificial
  CRISPR gRNA sequence
aggtgtgggctgccctcccc

SEQ ID NO: 724964 - DNA, 20 bp, Artificial
  CRISPR gRNA sequence
ccctcccctggcatggcctg

SEQ ID NO: 724965 - DNA, 20 bp, Artificial
  CRISPR gRNA sequence
ccctggcatggcctgcaggc

SEQ ID NO: 724966 - DNA, 20 bp, Artificial
  CRISPR gRNA sequence
gcatggcctgcaggccttgc

SEQ ID NO: 724967 - DNA, 20 bp, Artificial
  CRISPR gRNA sequence
caggccttgctggtgagtgg

SEQ ID NO: 724968 - DNA, 20 bp, Artificial
  CRISPR gRNA sequence
gctggtgagtggatcggggg

SEQ ID NO: 724969 - DNA, 20 bp, Artificial
  CRISPR gRNA sequence
ctggtgagtggatcgggggc

SEQ ID NO: 724970 - DNA, 20 bp, Artificial
  CRISPR gRNA sequence
gtgagtggatcgggggccac

SEQ ID NO: 724971 - DNA, 20 bp, Artificial
  CRISPR gRNA sequence
cgccatggtggaaagggaag

SEQ ID NO: 724972 - DNA, 20 bp, Artificial
  CRISPR gRNA sequence
ggaggttctcttgggcaccc

SEQ ID NO: 724973 - DNA, 20 bp, Artificial
  CRISPR gRNA sequence
gaggttctcttgggcaccca

SEQ ID NO: 724974 - DNA, 20 bp, Artificial
  CRISPR gRNA sequence
tcttgggcacccaagacaca

SEQ ID NO: 724975 - DNA, 20 bp, Artificial
  CRISPR gRNA sequence
ttgggcacccaagacacagg

SEQ ID NO: 724976 - DNA, 20 bp, Artificial
  CRISPR gRNA sequence
gggcacccaagacacaggca

SEQ ID NO: 724977 - DNA, 20 bp, Artificial
  CRISPR gRNA sequence
ggcacccaagacacaggcaa

SEQ ID NO: 724978 - DNA, 20 bp, Artificial
  CRISPR gRNA sequence
gtcctcctaatgccagccca

SEQ ID NO: 724979 - DNA, 20 bp, Artificial
  CRISPR gRNA sequence
tcctcctaatgccagcccag

SEQ ID NO: 724980 - DNA, 20 bp, Artificial
  CRISPR gRNA sequence
ctaatgccagcccagggtag

SEQ ID NO: 724981 - DNA, 20 bp, Artificial
  CRISPR gRNA sequence
atgccagcccagggtagcgt

SEQ ID NO: 724982 - DNA, 20 bp, Artificial
  CRISPR gRNA sequence
ccccttcccatccagttccc

SEQ ID NO: 724983 - DNA, 20 bp, Artificial
  CRISPR gRNA sequence
cccatccagttcccaagagg

SEQ ID NO: 724984 - DNA, 20 bp, Artificial
  CRISPR gRNA sequence
ccatccagttcccaagaggg

SEQ ID NO: 724985 - DNA, 20 bp, Artificial
  CRISPR gRNA sequence
ccaagaggggtcacactggg

SEQ ID NO: 724986 - DNA, 20 bp, Artificial
  CRISPR gRNA sequence
gggtctgtacatcgtccctc

SEQ ID NO: 724987 - DNA, 20 bp, Artificial
  CRISPR gRNA sequence
tacatcgtccctcttcccct

SEQ ID NO: 724988 - DNA, 20 bp, Artificial
  CRISPR gRNA sequence
ttcccctgggaaccaggcaa

SEQ ID NO: 724989 - DNA, 20 bp, Artificial
  CRISPR gRNA sequence
cccctgggaaccaggcaagg

SEQ ID NO: 724990 - DNA, 20 bp, Artificial
  CRISPR gRNA sequence
ccctgggaaccaggcaaggg

SEQ ID NO: 724991 - DNA, 20 bp, Artificial
  CRISPR gRNA sequence
ggaaccaggcaagggaagaa

SEQ ID NO: 724992 - DNA, 20 bp, Artificial
  CRISPR gRNA sequence
tccccccaacttcctcacct

SEQ ID NO: 724993 - DNA, 20 bp, Artificial
  CRISPR gRNA sequence
ccccccaacttcctcacctg

SEQ ID NO: 724994 - DNA, 20 bp, Artificial
  CRISPR gRNA sequence
cccccaacttcctcacctgc

SEQ ID NO: 724995 - DNA, 20 bp, Artificial
  CRISPR gRNA sequence
cctcacctgccctccccaca

SEQ ID NO: 724996 - DNA, 20 bp, Artificial
  CRISPR gRNA sequence
ctcacctgccctccccacat

SEQ ID NO: 724997 - DNA, 20 bp, Artificial
  CRISPR gRNA sequence
acctgccctccccacatagc

SEQ ID NO: 724998 - DNA, 20 bp, Artificial
  CRISPR gRNA sequence
ccctccccacatagccaaga

SEQ ID NO: 724999 - DNA, 20 bp, Artificial
  CRISPR gRNA sequence
cccacatagccaagatgaat

SEQ ID NO: 725000 - DNA, 20 bp, Artificial
  CRISPR gRNA sequence
cctggactctggagctctgg

SEQ ID NO: 725001 - DNA, 20 bp, Artificial
  CRISPR gRNA sequence
gactctggagctctggggag

SEQ ID NO: 725002 - DNA, 20 bp, Artificial
  CRISPR gRNA sequence
tggagctctggggagggggc

SEQ ID NO: 725003 - DNA, 20 bp, Artificial
  CRISPR gRNA sequence
gagctctggggagggggcag

SEQ ID NO: 725004 - DNA, 20 bp, Artificial
  CRISPR gRNA sequence
tggggagggggcaggaaatc

SEQ ID NO: 725005 - DNA, 20 bp, Artificial
  CRISPR gRNA sequence
gggagggggcaggaaatcca

SEQ ID NO: 725006 - DNA, 20 bp, Artificial
  CRISPR gRNA sequence
ggaagccacccccacagcct

SEQ ID NO: 725007 - DNA, 20 bp, Artificial
  CRISPR gRNA sequence
gaagccacccccacagcctg

SEQ ID NO: 725008 - DNA, 20 bp, Artificial
  CRISPR gRNA sequence
gggagtaggcagcctgtgat

SEQ ID NO: 725009 - DNA, 20 bp, Artificial
  CRISPR gRNA sequence
tgatgggggcagagccagag

SEQ ID NO: 725010 - DNA, 20 bp, Artificial
  CRISPR gRNA sequence
atggccggctctgaagtttc

SEQ ID NO: 725011 - DNA, 20 bp, Artificial
  CRISPR gRNA sequence
tgaagtttccagacccctct

SEQ ID NO: 725012 - DNA, 20 bp, Artificial
  CRISPR gRNA sequence
aagtttccagacccctcttt

SEQ ID NO: 725013 - DNA, 20 bp, Artificial
  CRISPR gRNA sequence
ccagacccctctttcacttc

SEQ ID NO: 725014 - DNA, 20 bp, Artificial
  CRISPR gRNA sequence
cagacccctctttcacttcc

SEQ ID NO: 725015 - DNA, 20 bp, Artificial
  CRISPR gRNA sequence
tttcacttccgagctcagtg

SEQ ID NO: 725016 - DNA, 20 bp, Artificial
  CRISPR gRNA sequence
tcacttccgagctcagtggg

SEQ ID NO: 725017 - DNA, 20 bp, Artificial
  CRISPR gRNA sequence
cacttccgagctcagtggga

SEQ ID NO: 725018 - DNA, 20 bp, Artificial
  CRISPR gRNA sequence
acttccgagctcagtgggag

SEQ ID NO: 725019 - DNA, 20 bp, Artificial
  CRISPR gRNA sequence
ccgagctcagtgggagctgc

SEQ ID NO: 725020 - DNA, 20 bp, Artificial
  CRISPR gRNA sequence
cgagctcagtgggagctgct

SEQ ID NO: 725021 - DNA, 20 bp, Artificial
  CRISPR gRNA sequence
agtgggagctgcttcctcac

SEQ ID NO: 725022 - DNA, 20 bp, Artificial
  CRISPR gRNA sequence
cttcctcacccagagcagcc

SEQ ID NO: 725023 - DNA, 20 bp, Artificial
  CRISPR gRNA sequence
cctcacccagagcagccaat

SEQ ID NO: 725024 - DNA, 20 bp, Artificial
  CRISPR gRNA sequence
ctcacccagagcagccaatt

SEQ ID NO: 725025 - DNA, 20 bp, Artificial
  CRISPR gRNA sequence
acccagagcagccaattcca

SEQ ID NO: 725026 - DNA, 20 bp, Artificial
  CRISPR gRNA sequence
caccgctttgaatccagtta

SEQ ID NO: 725027 - DNA, 20 bp, Artificial
  CRISPR gRNA sequence
tgaatccagttaattccaga

SEQ ID NO: 725028 - DNA, 20 bp, Artificial
  CRISPR gRNA sequence
gaatccagttaattccagat

SEQ ID NO: 725029 - DNA, 20 bp, Artificial
  CRISPR gRNA sequence
aatccagttaattccagatt

SEQ ID NO: 725030 - DNA, 20 bp, Artificial
  CRISPR gRNA sequence
attccagatttcctggggac

SEQ ID NO: 725031 - DNA, 20 bp, Artificial
  CRISPR gRNA sequence
cagatttcctggggactcct

SEQ ID NO: 725032 - DNA, 20 bp, Artificial
  CRISPR gRNA sequence
cctggggactcctgcccatt

SEQ ID NO: 725033 - DNA, 20 bp, Artificial
  CRISPR gRNA sequence
ctggggactcctgcccattt

SEQ ID NO: 725034 - DNA, 20 bp, Artificial
  CRISPR gRNA sequence
gggactcctgcccatttccc

SEQ ID NO: 725035 - DNA, 20 bp, Artificial
  CRISPR gRNA sequence
ctgcccatttccctgaggaa

SEQ ID NO: 725036 - DNA, 20 bp, Artificial
  CRISPR gRNA sequence
cccatttccctgaggaatgt

SEQ ID NO: 725037 - DNA, 20 bp, Artificial
  CRISPR gRNA sequence
ccctgaggaatgtgagggga

SEQ ID NO: 725038 - DNA, 20 bp, Artificial
  CRISPR gRNA sequence
cctgaggaatgtgaggggac

SEQ ID NO: 725039 - DNA, 20 bp, Artificial
  CRISPR gRNA sequence
aggaatgtgaggggaccagc

SEQ ID NO: 725040 - DNA, 20 bp, Artificial
  CRISPR gRNA sequence
tccccagctgtggctccttc

SEQ ID NO: 725041 - DNA, 20 bp, Artificial
  CRISPR gRNA sequence
tggctccttctccctaatcc

SEQ ID NO: 725042 - DNA, 20 bp, Artificial
  CRISPR gRNA sequence
cttctccctaatccagcacc

SEQ ID NO: 725043 - DNA, 20 bp, Artificial
  CRISPR gRNA sequence
ctccctaatccagcaccccc

SEQ ID NO: 725044 - DNA, 20 bp, Artificial
  CRISPR gRNA sequence
tccctaatccagcaccccca

SEQ ID NO: 725045 - DNA, 20 bp, Artificial
  CRISPR gRNA sequence
cctaatccagcacccccacc

SEQ ID NO: 725046 - DNA, 20 bp, Artificial
  CRISPR gRNA sequence
atccagcacccccaccctca

SEQ ID NO: 725047 - DNA, 20 bp, Artificial
  CRISPR gRNA sequence
acttccctcccacctgaccc

SEQ ID NO: 725048 - DNA, 20 bp, Artificial
  CRISPR gRNA sequence
ccctcccacctgaccccacc

SEQ ID NO: 725049 - DNA, 20 bp, Artificial
  CRISPR gRNA sequence
cctcccacctgaccccaccc

SEQ ID NO: 725050 - DNA, 20 bp, Artificial
  CRISPR gRNA sequence
ccacctgaccccacccgcct

SEQ ID NO: 725051 - DNA, 20 bp, Artificial
  CRISPR gRNA sequence
accccacccgcctctcatct

SEQ ID NO: 725052 - DNA, 20 bp, Artificial
  CRISPR gRNA sequence
tcatcttctctgcccatccc

SEQ ID NO: 725053 - DNA, 20 bp, Artificial
  CRISPR gRNA sequence
atcttctctgcccatccccc

SEQ ID NO: 725054 - DNA, 20 bp, Artificial
  CRISPR gRNA sequence
ctctgcccatccccctctgg

SEQ ID NO: 725055 - DNA, 20 bp, Artificial
  CRISPR gRNA sequence
tctgcccatccccctctggg

SEQ ID NO: 725056 - DNA, 20 bp, Artificial
  CRISPR gRNA sequence
tgcccatccccctctgggcc

SEQ ID NO: 725057 - DNA, 20 bp, Artificial
  CRISPR gRNA sequence
cccatccccctctgggcctt

SEQ ID NO: 725058 - DNA, 20 bp, Artificial
  CRISPR gRNA sequence
tgggccttctctcccctcct

SEQ ID NO: 725059 - DNA, 20 bp, Artificial
  CRISPR gRNA sequence
ggccttctctcccctcctgg

SEQ ID NO: 725060 - DNA, 20 bp, Artificial
  CRISPR gRNA sequence
ctctcccctcctggggtctc

SEQ ID NO: 725061 - DNA, 20 bp, Artificial
  CRISPR gRNA sequence
tctcccctcctggggtctcc

SEQ ID NO: 725062 - DNA, 20 bp, Artificial
  CRISPR gRNA sequence
tcccctcctggggtctcctc

SEQ ID NO: 725063 - DNA, 20 bp, Artificial
  CRISPR gRNA sequence
ccctcctggggtctcctctc

SEQ ID NO: 725064 - DNA, 20 bp, Artificial
  CRISPR gRNA sequence
ctggggtctcctctctcacc

SEQ ID NO: 725065 - DNA, 20 bp, Artificial
  CRISPR gRNA sequence
gggtctcctctctcaccacc

SEQ ID NO: 725066 - DNA, 20 bp, Artificial
  CRISPR gRNA sequence
ctctctcaccacccccggcc

SEQ ID NO: 725067 - DNA, 20 bp, Artificial
  CRISPR gRNA sequence
tctcaccacccccggccccc

SEQ ID NO: 725068 - DNA, 20 bp, Artificial
  CRISPR gRNA sequence
tcaccacccccggcccccat

SEQ ID NO: 725069 - DNA, 20 bp, Artificial
  CRISPR gRNA sequence
accacccccggcccccatct

SEQ ID NO: 725070 - DNA, 20 bp, Artificial
  CRISPR gRNA sequence
ttgcccagccctctataggg

SEQ ID NO: 725071 - DNA, 20 bp, Artificial
  CRISPR gRNA sequence
tgcccagccctctatagggc

SEQ ID NO: 725072 - DNA, 20 bp, Artificial
  CRISPR gRNA sequence
gcccagccctctatagggct

SEQ ID NO: 725073 - DNA, 20 bp, Artificial
  CRISPR gRNA sequence
cccagccctctatagggctc

SEQ ID NO: 725074 - DNA, 20 bp, Artificial
  CRISPR gRNA sequence
tatagggctcctagggctgg

SEQ ID NO: 725075 - DNA, 20 bp, Artificial
  CRISPR gRNA sequence
tagggctcctagggctggga

SEQ ID NO: 725076 - DNA, 20 bp, Artificial
  CRISPR gRNA sequence
ctagggctgggagcccacaa

SEQ ID NO: 725077 - DNA, 20 bp, Artificial
  CRISPR gRNA sequence
gggctgggagcccacaagcc

SEQ ID NO: 725078 - DNA, 20 bp, Artificial
  CRISPR gRNA sequence
ggagcccacaagcctgatgg

SEQ ID NO: 725079 - DNA, 20 bp, Artificial
  CRISPR gRNA sequence
atggaggtgtggggagtgct

SEQ ID NO: 725080 - DNA, 20 bp, Artificial
  CRISPR gRNA sequence
aggccctgctctgttttggg

SEQ ID NO: 725081 - DNA, 20 bp, Artificial
  CRISPR gRNA sequence
ctctgttttggggtctgtgg

SEQ ID NO: 725082 - DNA, 20 bp, Artificial
  CRISPR gRNA sequence
tgttttggggtctgtggggg

SEQ ID NO: 725083 - DNA, 20 bp, Artificial
  CRISPR gRNA sequence
ttttggggtctgtgggggcg

SEQ ID NO: 725084 - DNA, 20 bp, Artificial
  CRISPR gRNA sequence
tggggtctgtgggggcgccc

SEQ ID NO: 725085 - DNA, 20 bp, Artificial
  CRISPR gRNA sequence
ggggtctgtgggggcgccca

SEQ ID NO: 725086 - DNA, 20 bp, Artificial
  CRISPR gRNA sequence
gggtctgtgggggcgcccag

SEQ ID NO: 725087 - DNA, 20 bp, Artificial
  CRISPR gRNA sequence
tgggggcgcccagcccatag

SEQ ID NO: 725088 - DNA, 20 bp, Artificial
  CRISPR gRNA sequence
tcccgcactctgggccttct

SEQ ID NO: 725089 - DNA, 20 bp, Artificial
  CRISPR gRNA sequence
tgggccttctcctcttgctg

SEQ ID NO: 725090 - DNA, 20 bp, Artificial
  CRISPR gRNA sequence
ggccttctcctcttgctgcc

SEQ ID NO: 725091 - DNA, 20 bp, Artificial
  CRISPR gRNA sequence
ctcctcttgctgccgtttgg

SEQ ID NO: 725092 - DNA, 20 bp, Artificial
  CRISPR gRNA sequence
tcctcttgctgccgtttggc

SEQ ID NO: 725093 - DNA, 20 bp, Artificial
  CRISPR gRNA sequence
ctcttgctgccgtttggcgc

SEQ ID NO: 725094 - DNA, 20 bp, Artificial
  CRISPR gRNA sequence
ttgctgccgtttggcgcact

SEQ ID NO: 725095 - DNA, 20 bp, Artificial
  CRISPR gRNA sequence
gctgccgtttggcgcacttc

SEQ ID NO: 725096 - DNA, 20 bp, Artificial
  CRISPR gRNA sequence
ctgccgtttggcgcacttct

SEQ ID NO: 725097 - DNA, 20 bp, Artificial
  CRISPR gRNA sequence
ccgtttggcgcacttctctc

SEQ ID NO: 725098 - DNA, 20 bp, Artificial
  CRISPR gRNA sequence
ggcgcacttctctctttcct

SEQ ID NO: 725099 - DNA, 20 bp, Artificial
  CRISPR gRNA sequence
gcgcacttctctctttcctg

SEQ ID NO: 725100 - DNA, 20 bp, Artificial
  CRISPR gRNA sequence
ctctctttcctgggggtgtt

SEQ ID NO: 725101 - DNA, 20 bp, Artificial
  CRISPR gRNA sequence
tctctttcctgggggtgttc

SEQ ID NO: 725102 - DNA, 20 bp, Artificial
  CRISPR gRNA sequence
tctttcctgggggtgttcaa

SEQ ID NO: 725103 - DNA, 20 bp, Artificial
  CRISPR gRNA sequence
tttcctgggggtgttcaaaa

SEQ ID NO: 725104 - DNA, 20 bp, Artificial
  CRISPR gRNA sequence
tcctgggggtgttcaaaacc

SEQ ID NO: 725105 - DNA, 20 bp, Artificial
  CRISPR gRNA sequence
cctgggggtgttcaaaacca

SEQ ID NO: 725106 - DNA, 20 bp, Artificial
  CRISPR gRNA sequence
ctgggggtgttcaaaaccag

SEQ ID NO: 725107 - DNA, 20 bp, Artificial
  CRISPR gRNA sequence
ggggtgttcaaaaccagaat

SEQ ID NO: 725108 - DNA, 20 bp, Artificial
  CRISPR gRNA sequence
aaaaccagaatagaagaacc

SEQ ID NO: 725109 - DNA, 20 bp, Artificial
  CRISPR gRNA sequence
agggtgtgggggactcgaga

SEQ ID NO: 725110 - DNA, 20 bp, Artificial
  CRISPR gRNA sequence
gagaacctttttggggttcc

SEQ ID NO: 725111 - DNA, 20 bp, Artificial
  CRISPR gRNA sequence
tttggggttcctgaatccga

SEQ ID NO: 725112 - DNA, 20 bp, Artificial
  CRISPR gRNA sequence
ttggggttcctgaatccgag

SEQ ID NO: 725113 - DNA, 20 bp, Artificial
  CRISPR gRNA sequence
tggggttcctgaatccgagg

SEQ ID NO: 725114 - DNA, 20 bp, Artificial
  CRISPR gRNA sequence
ggggttcctgaatccgaggg

SEQ ID NO: 725115 - DNA, 20 bp, Artificial
  CRISPR gRNA sequence
gggttcctgaatccgagggg

SEQ ID NO: 725116 - DNA, 20 bp, Artificial
  CRISPR gRNA sequence
ctgaatccgaggggtataac

SEQ ID NO: 725117 - DNA, 20 bp, Artificial
  CRISPR gRNA sequence
aatccgaggggtataactgc

SEQ ID NO: 725118 - DNA, 20 bp, Artificial
  CRISPR gRNA sequence
cattacccagaaaggcaggg

SEQ ID NO: 725119 - DNA, 20 bp, Artificial
  CRISPR gRNA sequence
cccagaaaggcaggggtccc

SEQ ID NO: 725120 - DNA, 20 bp, Artificial
  CRISPR gRNA sequence
cacccccaccccaccccagc

SEQ ID NO: 725121 - DNA, 20 bp, Artificial
  CRISPR gRNA sequence
tcaagttccctcttgagctt

SEQ ID NO: 725122 - DNA, 20 bp, Artificial
  CRISPR gRNA sequence
aagttccctcttgagcttcc

SEQ ID NO: 725123 - DNA, 20 bp, Artificial
  CRISPR gRNA sequence
cctcttgagcttccccattc

SEQ ID NO: 725124 - DNA, 20 bp, Artificial
  CRISPR gRNA sequence
ttgagcttccccattctggc

SEQ ID NO: 725125 - DNA, 20 bp, Artificial
  CRISPR gRNA sequence
gagcttccccattctggcct

SEQ ID NO: 725126 - DNA, 20 bp, Artificial
  CRISPR gRNA sequence
agcttccccattctggcctc

SEQ ID NO: 725127 - DNA, 20 bp, Artificial
  CRISPR gRNA sequence
ccccattctggcctccagag

SEQ ID NO: 725128 - DNA, 20 bp, Artificial
  CRISPR gRNA sequence
cccattctggcctccagagt

SEQ ID NO: 725129 - DNA, 20 bp, Artificial
  CRISPR gRNA sequence
tggcctccagagtccagcgc

SEQ ID NO: 725130 - DNA, 20 bp, Artificial
  CRISPR gRNA sequence
gcctccagagtccagcgcag

SEQ ID NO: 725131 - DNA, 20 bp, Artificial
  CRISPR gRNA sequence
cagagtccagcgcagaacag

SEQ ID NO: 725132 - DNA, 20 bp, Artificial
  CRISPR gRNA sequence
ggagccagcccaccctgagc

SEQ ID NO: 725133 - DNA, 20 bp, Artificial
  CRISPR gRNA sequence
agccagacaccatcagctgg

SEQ ID NO: 725134 - DNA, 20 bp, Artificial
  CRISPR gRNA sequence
ggcggaggccaggcttcccc

SEQ ID NO: 725135 - DNA, 20 bp, Artificial
  CRISPR gRNA sequence
ccccactccccagctcctcg

SEQ ID NO: 725136 - DNA, 20 bp, Artificial
  CRISPR gRNA sequence
cccactccccagctcctcgg

SEQ ID NO: 725137 - DNA, 20 bp, Artificial
  CRISPR gRNA sequence
cccagctcctcgggccactg

SEQ ID NO: 725138 - DNA, 20 bp, Artificial
  CRISPR gRNA sequence
ctcgggccactgaacctgag

SEQ ID NO: 725139 - DNA, 20 bp, Artificial
  CRISPR gRNA sequence
gggccactgaacctgagccc

SEQ ID NO: 725140 - DNA, 20 bp, Artificial
  CRISPR gRNA sequence
aacctgagcccccatgtccc

SEQ ID NO: 725141 - DNA, 20 bp, Artificial
  CRISPR gRNA sequence
agcccccatgtcccctctat

SEQ ID NO: 725142 - DNA, 20 bp, Artificial
  CRISPR gRNA sequence
tatcagaaggccacaccaga

SEQ ID NO: 725143 - DNA, 20 bp, Artificial
  CRISPR gRNA sequence
tcagaaggccacaccagaag

SEQ ID NO: 725144 - DNA, 20 bp, Artificial
  CRISPR gRNA sequence
tggcgaggaccggccctccg

SEQ ID NO: 725145 - DNA, 20 bp, Artificial
  CRISPR gRNA sequence
cgtccaagctcccaccatgt

SEQ ID NO: 725146 - DNA, 20 bp, Artificial
  CRISPR gRNA sequence
ccaccatgtgctcacagcac

SEQ ID NO: 725147 - DNA, 20 bp, Artificial
  CRISPR gRNA sequence
acagcacagccatgcacgct

SEQ ID NO: 725148 - DNA, 20 bp, Artificial
  CRISPR gRNA sequence
caggcaggagaccggctgtg

SEQ ID NO: 725149 - DNA, 20 bp, Artificial
  CRISPR gRNA sequence
tgagcagtaagccccgaaat

SEQ ID NO: 725150 - DNA, 20 bp, Artificial
  CRISPR gRNA sequence
acggcctgagccaggctgtc

SEQ ID NO: 725151 - DNA, 20 bp, Artificial
  CRISPR gRNA sequence
agccaggctgtctcaatcat

SEQ ID NO: 725152 - DNA, 20 bp, Artificial
  CRISPR gRNA sequence
tctcaatcatgggctgccga

SEQ ID NO: 725153 - DNA, 20 bp, Artificial
  CRISPR gRNA sequence
aatcatgggctgccgagacc

SEQ ID NO: 725154 - DNA, 20 bp, Artificial
  CRISPR gRNA sequence
ccgagacctattgagggggc

SEQ ID NO: 725155 - DNA, 20 bp, Artificial
  CRISPR gRNA sequence
ttgagggggccgggttttct

SEQ ID NO: 725156 - DNA, 20 bp, Artificial
  CRISPR gRNA sequence
agggggccgggttttctgca

SEQ ID NO: 725157 - DNA, 20 bp, Artificial
  CRISPR gRNA sequence
tctgcaggatgtgacaggct

SEQ ID NO: 725158 - DNA, 20 bp, Artificial
  CRISPR gRNA sequence
ctgcaggatgtgacaggctg

SEQ ID NO: 725159 - DNA, 20 bp, Artificial
  CRISPR gRNA sequence
tgcaggatgtgacaggctgg

SEQ ID NO: 725160 - DNA, 20 bp, Artificial
  CRISPR gRNA sequence
caggatgtgacaggctggct

SEQ ID NO: 725161 - DNA, 20 bp, Artificial
  CRISPR gRNA sequence
gctgagtttgcccggaccga

SEQ ID NO: 725162 - DNA, 20 bp, Artificial
  CRISPR gRNA sequence
agtttgcccggaccgagggg

SEQ ID NO: 725163 - DNA, 20 bp, Artificial
  CRISPR gRNA sequence
gcccggaccgaggggactcc

SEQ ID NO: 725164 - DNA, 20 bp, Artificial
  CRISPR gRNA sequence
cccggaccgaggggactccc

SEQ ID NO: 725165 - DNA, 20 bp, Artificial
  CRISPR gRNA sequence
ccaggacacgggacttgcag

SEQ ID NO: 725166 - DNA, 20 bp, Artificial
  CRISPR gRNA sequence
gcagtagtagaaccaggaat

SEQ ID NO: 725167 - DNA, 20 bp, Artificial
  CRISPR gRNA sequence
cagtagtagaaccaggaatg

SEQ ID NO: 725168 - DNA, 20 bp, Artificial
  CRISPR gRNA sequence
ccgggcaagctggacaagtt

SEQ ID NO: 725169 - DNA, 20 bp, Artificial
  CRISPR gRNA sequence
gacaagttggtcaccccggg

SEQ ID NO: 725170 - DNA, 20 bp, Artificial
  CRISPR gRNA sequence
gtcaccccgggttttggctg

SEQ ID NO: 725171 - DNA, 20 bp, Artificial
  CRISPR gRNA sequence
tggctgcaggcacacagata

SEQ ID NO: 725172 - DNA, 20 bp, Artificial
  CRISPR gRNA sequence
ggctgcaggcacacagatag

SEQ ID NO: 725173 - DNA, 20 bp, Artificial
  CRISPR gRNA sequence
gctgcaggcacacagatagg

SEQ ID NO: 725174 - DNA, 20 bp, Artificial
  CRISPR gRNA sequence
caggcacacagataggagca

SEQ ID NO: 725175 - DNA, 20 bp, Artificial
  CRISPR gRNA sequence
ttttttgggggatttctcct

SEQ ID NO: 725176 - DNA, 20 bp, Artificial
  CRISPR gRNA sequence
tttttgggggatttctccta

SEQ ID NO: 725177 - DNA, 20 bp, Artificial
  CRISPR gRNA sequence
ttttgggggatttctcctaa

SEQ ID NO: 725178 - DNA, 20 bp, Artificial
  CRISPR gRNA sequence
tttgggggatttctcctaac

SEQ ID NO: 725179 - DNA, 20 bp, Artificial
  CRISPR gRNA sequence
ttgggggatttctcctaact

SEQ ID NO: 725180 - DNA, 20 bp, Artificial
  CRISPR gRNA sequence
tgggggatttctcctaacta

SEQ ID NO: 725181 - DNA, 20 bp, Artificial
  CRISPR gRNA sequence
gggggatttctcctaactac

SEQ ID NO: 725182 - DNA, 20 bp, Artificial
  CRISPR gRNA sequence
ggggatttctcctaactacg

SEQ ID NO: 725183 - DNA, 20 bp, Artificial
  CRISPR gRNA sequence
ctcctaactacgtggcgacc

SEQ ID NO: 725184 - DNA, 20 bp, Artificial
  CRISPR gRNA sequence
tcctaactacgtggcgacct

SEQ ID NO: 725185 - DNA, 20 bp, Artificial
  CRISPR gRNA sequence
ctaactacgtggcgaccttg

SEQ ID NO: 725186 - DNA, 20 bp, Artificial
  CRISPR gRNA sequence
actacgtggcgaccttgggc

SEQ ID NO: 725187 - DNA, 20 bp, Artificial
  CRISPR gRNA sequence
cgtggcgaccttgggcaggt

SEQ ID NO: 725188 - DNA, 20 bp, Artificial
  CRISPR gRNA sequence
gggcaggtcatttaacctct

SEQ ID NO: 725189 - DNA, 20 bp, Artificial
  CRISPR gRNA sequence
ggcaggtcatttaacctctc

SEQ ID NO: 725190 - DNA, 20 bp, Artificial
  CRISPR gRNA sequence
aacctctccaggcttcagat

SEQ ID NO: 725191 - DNA, 20 bp, Artificial
  CRISPR gRNA sequence
acctctccaggcttcagatt

SEQ ID NO: 725192 - DNA, 20 bp, Artificial
  CRISPR gRNA sequence
tccaggcttcagattcttac

SEQ ID NO: 725193 - DNA, 20 bp, Artificial
  CRISPR gRNA sequence
caggcttcagattcttacct

SEQ ID NO: 725194 - DNA, 20 bp, Artificial
  CRISPR gRNA sequence
cagattcttacctgtaaatg

SEQ ID NO: 725195 - DNA, 20 bp, Artificial
  CRISPR gRNA sequence
agattcttacctgtaaatgg

SEQ ID NO: 725196 - DNA, 20 bp, Artificial
  CRISPR gRNA sequence
ttacctgtaaatgggaatct

SEQ ID NO: 725197 - DNA, 20 bp, Artificial
  CRISPR gRNA sequence
acctgtaaatgggaatcttg

SEQ ID NO: 725198 - DNA, 20 bp, Artificial
  CRISPR gRNA sequence
cctgtaaatgggaatcttga

SEQ ID NO: 725199 - DNA, 20 bp, Artificial
  CRISPR gRNA sequence
taaatgggaatcttgatggg

SEQ ID NO: 725200 - DNA, 20 bp, Artificial
  CRISPR gRNA sequence
gatggggtccgccttgcagg

SEQ ID NO: 725201 - DNA, 20 bp, Artificial
  CRISPR gRNA sequence
atggggtccgccttgcagga

SEQ ID NO: 725202 - DNA, 20 bp, Artificial
  CRISPR gRNA sequence
gcaggagggctggggaccca

SEQ ID NO: 725203 - DNA, 20 bp, Artificial
  CRISPR gRNA sequence
caggagggctggggacccag

SEQ ID NO: 725204 - DNA, 20 bp, Artificial
  CRISPR gRNA sequence
gggacccaggagtgggggtg

SEQ ID NO: 725205 - DNA, 20 bp, Artificial
  CRISPR gRNA sequence
ctcagctctgctgtttctgc

SEQ ID NO: 725206 - DNA, 20 bp, Artificial
  CRISPR gRNA sequence
agctctgctgtttctgctcg

SEQ ID NO: 725207 - DNA, 20 bp, Artificial
  CRISPR gRNA sequence
tgctgtttctgctcgtgctc

SEQ ID NO: 725208 - DNA, 20 bp, Artificial
  CRISPR gRNA sequence
ctgtttctgctcgtgctctg

SEQ ID NO: 725209 - DNA, 20 bp, Artificial
  CRISPR gRNA sequence
tttctgctcgtgctctggtt

SEQ ID NO: 725210 - DNA, 20 bp, Artificial
  CRISPR gRNA sequence
ctgctcgtgctctggttacc

SEQ ID NO: 725211 - DNA, 20 bp, Artificial
  CRISPR gRNA sequence
tgctcgtgctctggttaccc

SEQ ID NO: 725212 - DNA, 20 bp, Artificial
  CRISPR gRNA sequence
ctcgtgctctggttacccac

SEQ ID NO: 725213 - DNA, 20 bp, Artificial
  CRISPR gRNA sequence
gtgctctggttacccacggc

SEQ ID NO: 725214 - DNA, 20 bp, Artificial
  CRISPR gRNA sequence
tggttacccacggctttgcc

SEQ ID NO: 725215 - DNA, 20 bp, Artificial
  CRISPR gRNA sequence
gttacccacggctttgcctg

SEQ ID NO: 725216 - DNA, 20 bp, Artificial
  CRISPR gRNA sequence
cccacggctttgcctgtttt

SEQ ID NO: 725217 - DNA, 20 bp, Artificial
  CRISPR gRNA sequence
tgcctgtttttgtccacagt

SEQ ID NO: 725218 - DNA, 20 bp, Artificial
  CRISPR gRNA sequence
gcctgtttttgtccacagtt

SEQ ID NO: 725219 - DNA, 20 bp, Artificial
  CRISPR gRNA sequence
cctgtttttgtccacagttt

SEQ ID NO: 725220 - DNA, 20 bp, Artificial
  CRISPR gRNA sequence
tttttgtccacagtttgctt

SEQ ID NO: 725221 - DNA, 20 bp, Artificial
  CRISPR gRNA sequence
ttgtccacagtttgctttct

SEQ ID NO: 725222 - DNA, 20 bp, Artificial
  CRISPR gRNA sequence
tgtccacagtttgctttctg

SEQ ID NO: 725223 - DNA, 20 bp, Artificial
  CRISPR gRNA sequence
gtccacagtttgctttctgt

SEQ ID NO: 725224 - DNA, 20 bp, Artificial
  CRISPR gRNA sequence
tccacagtttgctttctgtc

SEQ ID NO: 725225 - DNA, 20 bp, Artificial
  CRISPR gRNA sequence
gctttctgtcccaccctgtc

SEQ ID NO: 725226 - DNA, 20 bp, Artificial
  CRISPR gRNA sequence
ctttctgtcccaccctgtcc

SEQ ID NO: 725227 - DNA, 20 bp, Artificial
  CRISPR gRNA sequence
tctgtcccaccctgtcctct

SEQ ID NO: 725228 - DNA, 20 bp, Artificial
  CRISPR gRNA sequence
ctgtcccaccctgtcctctt

SEQ ID NO: 725229 - DNA, 20 bp, Artificial
  CRISPR gRNA sequence
tgtcccaccctgtcctcttc

SEQ ID NO: 725230 - DNA, 20 bp, Artificial
  CRISPR gRNA sequence
tcccaccctgtcctcttctt

SEQ ID NO: 725231 - DNA, 20 bp, Artificial
  CRISPR gRNA sequence
tcctcttcttccctacccat

SEQ ID NO: 725232 - DNA, 20 bp, Artificial
  CRISPR gRNA sequence
ttcttccctacccatccgca

SEQ ID NO: 725233 - DNA, 20 bp, Artificial
  CRISPR gRNA sequence
cttccctacccatccgcaga

SEQ ID NO: 725234 - DNA, 20 bp, Artificial
  CRISPR gRNA sequence
ttccctacccatccgcagag

SEQ ID NO: 725235 - DNA, 20 bp, Artificial
  CRISPR gRNA sequence
ccctacccatccgcagagat

SEQ ID NO: 725236 - DNA, 20 bp, Artificial
  CRISPR gRNA sequence
cctacccatccgcagagatg

SEQ ID NO: 725237 - DNA, 20 bp, Artificial
  CRISPR gRNA sequence
cccatccgcagagatgtgct

SEQ ID NO: 725238 - DNA, 20 bp, Artificial
  CRISPR gRNA sequence
agaaaatcctaagtacaagt

SEQ ID NO: 725239 - DNA, 20 bp, Artificial
  CRISPR gRNA sequence
agtacaagtgggctggttct

SEQ ID NO: 725240 - DNA, 20 bp, Artificial
  CRISPR gRNA sequence
gttcttaactcctcaaggcc

SEQ ID NO: 725241 - DNA, 20 bp, Artificial
  CRISPR gRNA sequence
ttaactcctcaaggcccagc

SEQ ID NO: 725242 - DNA, 20 bp, Artificial
  CRISPR gRNA sequence
aactcctcaaggcccagctc

SEQ ID NO: 725243 - DNA, 20 bp, Artificial
  CRISPR gRNA sequence
actcctcaaggcccagctcc

SEQ ID NO: 725244 - DNA, 20 bp, Artificial
  CRISPR gRNA sequence
ctcaaggcccagctcctagc

SEQ ID NO: 725245 - DNA, 20 bp, Artificial
  CRISPR gRNA sequence
aaggcccagctcctagctgt

SEQ ID NO: 725246 - DNA, 20 bp, Artificial
  CRISPR gRNA sequence
ctagctgttctatttcctct

SEQ ID NO: 725247 - DNA, 20 bp, Artificial
  CRISPR gRNA sequence
gctgttctatttcctctgag

SEQ ID NO: 725248 - DNA, 20 bp, Artificial
  CRISPR gRNA sequence
ttctatttcctctgagcccc

SEQ ID NO: 725249 - DNA, 20 bp, Artificial
  CRISPR gRNA sequence
tatttcctctgagcccccag

SEQ ID NO: 725250 - DNA, 20 bp, Artificial
  CRISPR gRNA sequence
tttcctctgagcccccagga

SEQ ID NO: 725251 - DNA, 20 bp, Artificial
  CRISPR gRNA sequence
cctctgagcccccaggatgc

SEQ ID NO: 725252 - DNA, 20 bp, Artificial
  CRISPR gRNA sequence
ctctgagcccccaggatgcc

SEQ ID NO: 725253 - DNA, 20 bp, Artificial
  CRISPR gRNA sequence
tgagcccccaggatgcctgt

SEQ ID NO: 725254 - DNA, 20 bp, Artificial
  CRISPR gRNA sequence
agcccccaggatgcctgtaa

SEQ ID NO: 725255 - DNA, 20 bp, Artificial
  CRISPR gRNA sequence
taaggtacatcagagaggct

SEQ ID NO: 725256 - DNA, 20 bp, Artificial
  CRISPR gRNA sequence
tgccatcagcctgaagccac

SEQ ID NO: 725257 - DNA, 20 bp, Artificial
  CRISPR gRNA sequence
aagccacccggcaggtgtac

SEQ ID NO: 725258 - DNA, 20 bp, Artificial
  CRISPR gRNA sequence
ggcctcggcccttctctgcc

SEQ ID NO: 725259 - DNA, 20 bp, Artificial
  CRISPR gRNA sequence
ggcccttctctgcctctttg

SEQ ID NO: 725260 - DNA, 20 bp, Artificial
  CRISPR gRNA sequence
ctctgcctctttgctcccat

SEQ ID NO: 725261 - DNA, 20 bp, Artificial
  CRISPR gRNA sequence
tctgcctctttgctcccatc

SEQ ID NO: 725262 - DNA, 20 bp, Artificial
  CRISPR gRNA sequence
tgcctctttgctcccatcct

SEQ ID NO: 725263 - DNA, 20 bp, Artificial
  CRISPR gRNA sequence
cctctttgctcccatcctgg

SEQ ID NO: 725264 - DNA, 20 bp, Artificial
  CRISPR gRNA sequence
tttgctcccatcctggctgg

SEQ ID NO: 725265 - DNA, 20 bp, Artificial
  CRISPR gRNA sequence
tgctcccatcctggctggtg

SEQ ID NO: 725266 - DNA, 20 bp, Artificial
  CRISPR gRNA sequence
gctcccatcctggctggtgc

SEQ ID NO: 725267 - DNA, 20 bp, Artificial
  CRISPR gRNA sequence
ctcccatcctggctggtgct

SEQ ID NO: 725268 - DNA, 20 bp, Artificial
  CRISPR gRNA sequence
ccatcctggctggtgctctg

SEQ ID NO: 725269 - DNA, 20 bp, Artificial
  CRISPR gRNA sequence
gctggtgctctggcctccct

SEQ ID NO: 725270 - DNA, 20 bp, Artificial
  CRISPR gRNA sequence
gtgctctggcctccctcgct

SEQ ID NO: 725271 - DNA, 20 bp, Artificial
  CRISPR gRNA sequence
tggcctccctcgctcaccca

SEQ ID NO: 725272 - DNA, 20 bp, Artificial
  CRISPR gRNA sequence
gcctccctcgctcacccatc

SEQ ID NO: 725273 - DNA, 20 bp, Artificial
  CRISPR gRNA sequence
cctcgctcacccatcctttt

SEQ ID NO: 725274 - DNA, 20 bp, Artificial
  CRISPR gRNA sequence
gctcacccatccttttgcct

SEQ ID NO: 725275 - DNA, 20 bp, Artificial
  CRISPR gRNA sequence
acccatccttttgccttgca

SEQ ID NO: 725276 - DNA, 20 bp, Artificial
  CRISPR gRNA sequence
ttgccttgcagagaaaatct

SEQ ID NO: 725277 - DNA, 20 bp, Artificial
  CRISPR gRNA sequence
tgccttgcagagaaaatcta

SEQ ID NO: 725278 - DNA, 20 bp, Artificial
  CRISPR gRNA sequence
gccttgcagagaaaatctac

SEQ ID NO: 725279 - DNA, 20 bp, Artificial
  CRISPR gRNA sequence
ccttgcagagaaaatctaca

SEQ ID NO: 725280 - DNA, 20 bp, Artificial
  CRISPR gRNA sequence
gcagagaaaatctacatcat

SEQ ID NO: 725281 - DNA, 20 bp, Artificial
  CRISPR gRNA sequence
cagagaaaatctacatcatg

SEQ ID NO: 725282 - DNA, 20 bp, Artificial
  CRISPR gRNA sequence
catcatgaaggctgacaccg

SEQ ID NO: 725283 - DNA, 20 bp, Artificial
  CRISPR gRNA sequence
acaccgtgatcgtggggacc

SEQ ID NO: 725284 - DNA, 20 bp, Artificial
  CRISPR gRNA sequence
agctgccggagggccggggc

SEQ ID NO: 725285 - DNA, 20 bp, Artificial
  CRISPR gRNA sequence
ccggagggccggggcctggc

SEQ ID NO: 725286 - DNA, 20 bp, Artificial
  CRISPR gRNA sequence
gcggggccagcagagcccga

SEQ ID NO: 725287 - DNA, 20 bp, Artificial
  CRISPR gRNA sequence
gaggaggagctggaggcgga

SEQ ID NO: 725288 - DNA, 20 bp, Artificial
  CRISPR gRNA sequence
gaggcggaccatacccccca

SEQ ID NO: 725289 - DNA, 20 bp, Artificial
  CRISPR gRNA sequence
ccccgagcaggagacagaac

SEQ ID NO: 725290 - DNA, 20 bp, Artificial
  CRISPR gRNA sequence
tgggcagctgcagcgatgtc

SEQ ID NO: 725291 - DNA, 20 bp, Artificial
  CRISPR gRNA sequence
ggcagctgcagcgatgtcat

SEQ ID NO: 725292 - DNA, 20 bp, Artificial
  CRISPR gRNA sequence
cagcgatgtcatgctctcag

SEQ ID NO: 725293 - DNA, 20 bp, Artificial
  CRISPR gRNA sequence
tcagtggaagaggaagggaa

SEQ ID NO: 725294 - DNA, 20 bp, Artificial
  CRISPR gRNA sequence
agtggaagaggaagggaaag

SEQ ID NO: 725295 - DNA, 20 bp, Artificial
  CRISPR gRNA sequence
gcccacagctgcctctggaa

SEQ ID NO: 725296 - DNA, 20 bp, Artificial
  CRISPR gRNA sequence
cccacagctgcctctggaaa

SEQ ID NO: 725297 - DNA, 20 bp, Artificial
  CRISPR gRNA sequence
cctctggaaagtgaggcctg

SEQ ID NO: 725298 - DNA, 20 bp, Artificial
  CRISPR gRNA sequence
tggaaagtgaggcctgggct

SEQ ID NO: 725299 - DNA, 20 bp, Artificial
  CRISPR gRNA sequence
gaaagtgaggcctgggctgg

SEQ ID NO: 725300 - DNA, 20 bp, Artificial
  CRISPR gRNA sequence
ggctgggctggggctaggag

SEQ ID NO: 725301 - DNA, 20 bp, Artificial
  CRISPR gRNA sequence
ggctggggctaggagggcag

SEQ ID NO: 725302 - DNA, 20 bp, Artificial
  CRISPR gRNA sequence
gggctaggagggcagcaggg

SEQ ID NO: 725303 - DNA, 20 bp, Artificial
  CRISPR gRNA sequence
ggagggcagcagggtggcct

SEQ ID NO: 725304 - DNA, 20 bp, Artificial
  CRISPR gRNA sequence
tgggaggccaggatggcact

SEQ ID NO: 725305 - DNA, 20 bp, Artificial
  CRISPR gRNA sequence
ggaggccaggatggcactgt

SEQ ID NO: 725306 - DNA, 20 bp, Artificial
  CRISPR gRNA sequence
ttggcaccgaggttgggggc

SEQ ID NO: 725307 - DNA, 20 bp, Artificial
  CRISPR gRNA sequence
gcaccgaggttgggggcaga

SEQ ID NO: 725308 - DNA, 20 bp, Artificial
  CRISPR gRNA sequence
ggggcagaggcccatctggc

SEQ ID NO: 725309 - DNA, 20 bp, Artificial
  CRISPR gRNA sequence
gcctgaactgaggctccagc

SEQ ID NO: 725310 - DNA, 20 bp, Artificial
  CRISPR gRNA sequence
aactgaggctccagcatcta

SEQ ID NO: 725311 - DNA, 20 bp, Artificial
  CRISPR gRNA sequence
aggctccagcatctagtggt

SEQ ID NO: 725312 - DNA, 20 bp, Artificial
  CRISPR gRNA sequence
cagcatctagtggtggaccg

SEQ ID NO: 725313 - DNA, 20 bp, Artificial
  CRISPR gRNA sequence
gtggtggaccggccggtcac

SEQ ID NO: 725314 - DNA, 20 bp, Artificial
  CRISPR gRNA sequence
caggggtctggtggtctctg

SEQ ID NO: 725315 - DNA, 20 bp, Artificial
  CRISPR gRNA sequence
gtggtctctgcttgcatccc

SEQ ID NO: 725316 - DNA, 20 bp, Artificial
  CRISPR gRNA sequence
tgcttgcatccccaacttag

SEQ ID NO: 725317 - DNA, 20 bp, Artificial
  CRISPR gRNA sequence
cttgcatccccaacttagct

SEQ ID NO: 725318 - DNA, 20 bp, Artificial
  CRISPR gRNA sequence
gcatccccaacttagctgtc

SEQ ID NO: 725319 - DNA, 20 bp, Artificial
  CRISPR gRNA sequence
catccccaacttagctgtcc

SEQ ID NO: 725320 - DNA, 20 bp, Artificial
  CRISPR gRNA sequence
agctgtcccctgacccagag

SEQ ID NO: 725321 - DNA, 20 bp, Artificial
  CRISPR gRNA sequence
gctgtcccctgacccagagc

SEQ ID NO: 725322 - DNA, 20 bp, Artificial
  CRISPR gRNA sequence
tcccctgacccagagcctag

SEQ ID NO: 725323 - DNA, 20 bp, Artificial
  CRISPR gRNA sequence
acccagagcctaggggatcc

SEQ ID NO: 725324 - DNA, 20 bp, Artificial
  CRISPR gRNA sequence
ggggatccggggcttgtaca

SEQ ID NO: 725325 - DNA, 20 bp, Artificial
  CRISPR gRNA sequence
gtacagaagagacagtccaa

SEQ ID NO: 725326 - DNA, 20 bp, Artificial
  CRISPR gRNA sequence
tacagaagagacagtccaag

SEQ ID NO: 725327 - DNA, 20 bp, Artificial
  CRISPR gRNA sequence
gatcccagcagtgatgttgg

SEQ ID NO: 725328 - DNA, 20 bp, Artificial
  CRISPR gRNA sequence
gttgaggcagcaaacagatg

SEQ ID NO: 725329 - DNA, 20 bp, Artificial
  CRISPR gRNA sequence
aggcagcaaacagatggcag

SEQ ID NO: 725330 - DNA, 20 bp, Artificial
  CRISPR gRNA sequence
ccgagaacagcattggtccc

SEQ ID NO: 725331 - DNA, 20 bp, Artificial
  CRISPR gRNA sequence
gtcccagagccctgggcatc

SEQ ID NO: 725332 - DNA, 20 bp, Artificial
  CRISPR gRNA sequence
ggcatcagaccttaaccacc

SEQ ID NO: 725333 - DNA, 20 bp, Artificial
  CRISPR gRNA sequence
aaccaccaggcccacagccc

SEQ ID NO: 725334 - DNA, 20 bp, Artificial
  CRISPR gRNA sequence
accaccaggcccacagccca

SEQ ID NO: 725335 - DNA, 20 bp, Artificial
  CRISPR gRNA sequence
ccggggcccctgtaacccta

SEQ ID NO: 725336 - DNA, 20 bp, Artificial
  CRISPR gRNA sequence
taaccctactctcctctctc

SEQ ID NO: 725337 - DNA, 20 bp, Artificial
  CRISPR gRNA sequence
ctctcctctctccctggacc

SEQ ID NO: 725338 - DNA, 20 bp, Artificial
  CRISPR gRNA sequence
tcctctctccctggacctca

SEQ ID NO: 725339 - DNA, 20 bp, Artificial
  CRISPR gRNA sequence
ctctctccctggacctcaga

SEQ ID NO: 725340 - DNA, 20 bp, Artificial
  CRISPR gRNA sequence
tctccctggacctcagaggt

SEQ ID NO: 725341 - DNA, 20 bp, Artificial
  CRISPR gRNA sequence
tccctggacctcagaggtga

SEQ ID NO: 725342 - DNA, 20 bp, Artificial
  CRISPR gRNA sequence
cctggacctcagaggtgaca

SEQ ID NO: 725343 - DNA, 20 bp, Artificial
  CRISPR gRNA sequence
gacctcagaggtgacaccca

SEQ ID NO: 725344 - DNA, 20 bp, Artificial
  CRISPR gRNA sequence
agaggtgacacccattgggc

SEQ ID NO: 725345 - DNA, 20 bp, Artificial
  CRISPR gRNA sequence
ggcccttccggcatgccccc

SEQ ID NO: 725346 - DNA, 20 bp, Artificial
  CRISPR gRNA sequence
ccggcatgcccccagttact

SEQ ID NO: 725347 - DNA, 20 bp, Artificial
  CRISPR gRNA sequence
cggcatgcccccagttactg

SEQ ID NO: 725348 - DNA, 20 bp, Artificial
  CRISPR gRNA sequence
ctgtaaatgtggcccccagt

SEQ ID NO: 725349 - DNA, 20 bp, Artificial
  CRISPR gRNA sequence
taaatgtggcccccagtggg

SEQ ID NO: 725350 - DNA, 20 bp, Artificial
  CRISPR gRNA sequence
tggttgtttctccagagtca

SEQ ID NO: 725351 - DNA, 20 bp, Artificial
  CRISPR gRNA sequence
tttctccagagtcaaaaggg

SEQ ID NO: 725352 - DNA, 20 bp, Artificial
  CRISPR gRNA sequence
ctccagagtcaaaagggaag

SEQ ID NO: 725353 - DNA, 20 bp, Artificial
  CRISPR gRNA sequence
tccagagtcaaaagggaagt

SEQ ID NO: 725354 - DNA, 20 bp, Artificial
  CRISPR gRNA sequence
cagagtcaaaagggaagtcg

SEQ ID NO: 725355 - DNA, 20 bp, Artificial
  CRISPR gRNA sequence
gcactgtctctgctgcagcg

SEQ ID NO: 725356 - DNA, 20 bp, Artificial
  CRISPR gRNA sequence
tctctgctgcagcggccaca

SEQ ID NO: 725357 - DNA, 20 bp, Artificial
  CRISPR gRNA sequence
tgctgcagcggccacactgt

SEQ ID NO: 725358 - DNA, 20 bp, Artificial
  CRISPR gRNA sequence
ctgcagcggccacactgtac

SEQ ID NO: 725359 - DNA, 20 bp, Artificial
  CRISPR gRNA sequence
cagcggccacactgtactct

SEQ ID NO: 725360 - DNA, 20 bp, Artificial
  CRISPR gRNA sequence
tactctgcactggtgtgagg

SEQ ID NO: 725361 - DNA, 20 bp, Artificial
  CRISPR gRNA sequence
tgcactggtgtgagggcccc

SEQ ID NO: 725362 - DNA, 20 bp, Artificial
  CRISPR gRNA sequence
cactggtgtgagggcccctg

SEQ ID NO: 725363 - DNA, 20 bp, Artificial
  CRISPR gRNA sequence
gtgtgagggcccctgcctgg

SEQ ID NO: 725364 - DNA, 20 bp, Artificial
  CRISPR gRNA sequence
cctggactgtgggaccctcc

SEQ ID NO: 725365 - DNA, 20 bp, Artificial
  CRISPR gRNA sequence
gactgtgggaccctcctggt

SEQ ID NO: 725366 - DNA, 20 bp, Artificial
  CRISPR gRNA sequence
tgggaccctcctggtgctgc

SEQ ID NO: 725367 - DNA, 20 bp, Artificial
  CRISPR gRNA sequence
ctggtgctgcccaccttccc

SEQ ID NO: 725368 - DNA, 20 bp, Artificial
  CRISPR gRNA sequence
gtgctgcccaccttccctgt

SEQ ID NO: 725369 - DNA, 20 bp, Artificial
  CRISPR gRNA sequence
cccaccttccctgtcctgta

SEQ ID NO: 725370 - DNA, 20 bp, Artificial
  CRISPR gRNA sequence
ccctgtcctgtagccccctc

SEQ ID NO: 725371 - DNA, 20 bp, Artificial
  CRISPR gRNA sequence
cctgtcctgtagccccctcg

SEQ ID NO: 725372 - DNA, 20 bp, Artificial
  CRISPR gRNA sequence
tcctgtagccccctcggtgg

SEQ ID NO: 725373 - DNA, 20 bp, Artificial
  CRISPR gRNA sequence
tagccccctcggtgggccca

SEQ ID NO: 725374 - DNA, 20 bp, Artificial
  CRISPR gRNA sequence
ggtgggcccagggcctaggg

SEQ ID NO: 725375 - DNA, 20 bp, Artificial
  CRISPR gRNA sequence
gggcccaggatcaagtcact

SEQ ID NO: 725376 - DNA, 20 bp, Artificial
  CRISPR gRNA sequence
atctcagaatgtccccacca

SEQ ID NO: 725377 - DNA, 20 bp, Artificial
  CRISPR gRNA sequence
agaatgtccccaccaatccc

SEQ ID NO: 725378 - DNA, 20 bp, Artificial
  CRISPR gRNA sequence
gggtcccagatgtctgcagc

SEQ ID NO: 725379 - DNA, 20 bp, Artificial
  CRISPR gRNA sequence
cagccctcagcagctgcaga

SEQ ID NO: 725380 - DNA, 20 bp, Artificial
  CRISPR gRNA sequence
agcagctgcagaccgcccct

SEQ ID NO: 725381 - DNA, 20 bp, Artificial
  CRISPR gRNA sequence
cagaccgcccctcaccaacc

SEQ ID NO: 725382 - DNA, 20 bp, Artificial
  CRISPR gRNA sequence
accaacccagagaacctgct

SEQ ID NO: 725383 - DNA, 20 bp, Artificial
  CRISPR gRNA sequence
ctttactttgcccagggact

SEQ ID NO: 725384 - DNA, 20 bp, Artificial
  CRISPR gRNA sequence
tactttgcccagggacttcc

SEQ ID NO: 725385 - DNA, 20 bp, Artificial
  CRISPR gRNA sequence
actttgcccagggacttcct

SEQ ID NO: 725386 - DNA, 20 bp, Artificial
  CRISPR gRNA sequence
ctttgcccagggacttcctc

SEQ ID NO: 725387 - DNA, 20 bp, Artificial
  CRISPR gRNA sequence
tgcccagggacttcctcccc

SEQ ID NO: 725388 - DNA, 20 bp, Artificial
  CRISPR gRNA sequence
gcccagggacttcctcccca

SEQ ID NO: 725389 - DNA, 20 bp, Artificial
  CRISPR gRNA sequence
cccagggacttcctccccat

SEQ ID NO: 725390 - DNA, 20 bp, Artificial
  CRISPR gRNA sequence
cctccccatgtgaacatggg

SEQ ID NO: 725391 - DNA, 20 bp, Artificial
  CRISPR gRNA sequence
ctccccatgtgaacatgggg

SEQ ID NO: 725392 - DNA, 20 bp, Artificial
  CRISPR gRNA sequence
cccatgtgaacatggggaac

SEQ ID NO: 725393 - DNA, 20 bp, Artificial
  CRISPR gRNA sequence
cgggccctgcctggagtcct

SEQ ID NO: 725394 - DNA, 20 bp, Artificial
  CRISPR gRNA sequence
gggccctgcctggagtcctt

SEQ ID NO: 725395 - DNA, 20 bp, Artificial
  CRISPR gRNA sequence
cctggagtccttgaccgctc

SEQ ID NO: 725396 - DNA, 20 bp, Artificial
  CRISPR gRNA sequence
gagtccttgaccgctctctg

SEQ ID NO: 725397 - DNA, 20 bp, Artificial
  CRISPR gRNA sequence
gaccgctctctgtgggcccc

SEQ ID NO: 725398 - DNA, 20 bp, Artificial
  CRISPR gRNA sequence
accgctctctgtgggcccca

SEQ ID NO: 725399 - DNA, 20 bp, Artificial
  CRISPR gRNA sequence
tctgtgggccccacccactc

SEQ ID NO: 725400 - DNA, 20 bp, Artificial
  CRISPR gRNA sequence
tgtgggccccacccactctg

SEQ ID NO: 725401 - DNA, 20 bp, Artificial
  CRISPR gRNA sequence
tgggccccacccactctgtc

SEQ ID NO: 725402 - DNA, 20 bp, Artificial
  CRISPR gRNA sequence
tgtcctgggaaatgaagaag

SEQ ID NO: 725403 - DNA, 20 bp, Artificial
  CRISPR gRNA sequence
tcctgggaaatgaagaagca

SEQ ID NO: 725404 - DNA, 20 bp, Artificial
  CRISPR gRNA sequence
ggaaatgaagaagcatcttc

SEQ ID NO: 725405 - DNA, 20 bp, Artificial
  CRISPR gRNA sequence
ccttaggtctgccctgcttg

SEQ ID NO: 725406 - DNA, 20 bp, Artificial
  CRISPR gRNA sequence
cttaggtctgccctgcttgc

SEQ ID NO: 725407 - DNA, 20 bp, Artificial
  CRISPR gRNA sequence
aggtctgccctgcttgcaaa

SEQ ID NO: 725408 - DNA, 20 bp, Artificial
  CRISPR gRNA sequence
ggtctgccctgcttgcaaat

SEQ ID NO: 725409 - DNA, 20 bp, Artificial
  CRISPR gRNA sequence
ccctgcttgcaaatccacta

SEQ ID NO: 725410 - DNA, 20 bp, Artificial
  CRISPR gRNA sequence
cttgcaaatccactagcacc

SEQ ID NO: 725411 - DNA, 20 bp, Artificial
  CRISPR gRNA sequence
gcaaatccactagcaccgac

SEQ ID NO: 725412 - DNA, 20 bp, Artificial
  CRISPR gRNA sequence
caaatccactagcaccgacc

SEQ ID NO: 725413 - DNA, 20 bp, Artificial
  CRISPR gRNA sequence
gcaccgaccccaccacctgg

SEQ ID NO: 725414 - DNA, 20 bp, Artificial
  CRISPR gRNA sequence
gttccggctctgcacgcttt

SEQ ID NO: 725415 - DNA, 20 bp, Artificial
  CRISPR gRNA sequence
cggctctgcacgctttgggg

SEQ ID NO: 725416 - DNA, 20 bp, Artificial
  CRISPR gRNA sequence
tgcacgctttggggtgtgga

SEQ ID NO: 725417 - DNA, 20 bp, Artificial
  CRISPR gRNA sequence
cacgctttggggtgtggatg

SEQ ID NO: 725418 - DNA, 20 bp, Artificial
  CRISPR gRNA sequence
tggggtgtggatgtcgagag

SEQ ID NO: 725419 - DNA, 20 bp, Artificial
  CRISPR gRNA sequence
ggggtgtggatgtcgagagg

SEQ ID NO: 725420 - DNA, 20 bp, Artificial
  CRISPR gRNA sequence
gggtgtggatgtcgagaggc

SEQ ID NO: 725421 - DNA, 20 bp, Artificial
  CRISPR gRNA sequence
acccaggcatctgctttact

SEQ ID NO: 725422 - DNA, 20 bp, Artificial
  CRISPR gRNA sequence
ctttactctggaccatagga

SEQ ID NO: 725423 - DNA, 20 bp, Artificial
  CRISPR gRNA sequence
tactctggaccataggaaac

SEQ ID NO: 725424 - DNA, 20 bp, Artificial
  CRISPR gRNA sequence
actctggaccataggaaaca

SEQ ID NO: 725425 - DNA, 20 bp, Artificial
  CRISPR gRNA sequence
ctctggaccataggaaacaa

SEQ ID NO: 725426 - DNA, 20 bp, Artificial
  CRISPR gRNA sequence
tggaccataggaaacaagac

SEQ ID NO: 725427 - DNA, 20 bp, Artificial
  CRISPR gRNA sequence
gaccataggaaacaagaccg

SEQ ID NO: 725428 - DNA, 20 bp, Artificial
  CRISPR gRNA sequence
ggaggtttcatcaggatttt

SEQ ID NO: 725429 - DNA, 20 bp, Artificial
  CRISPR gRNA sequence
gaggtttcatcaggattttg

SEQ ID NO: 725430 - DNA, 20 bp, Artificial
  CRISPR gRNA sequence
catcaggattttgggttttt

SEQ ID NO: 725431 - DNA, 20 bp, Artificial
  CRISPR gRNA sequence
atcaggattttgggtttttc

SEQ ID NO: 725432 - DNA, 20 bp, Artificial
  CRISPR gRNA sequence
tgggtttttcacatttcacg

SEQ ID NO: 725433 - DNA, 20 bp, Artificial
  CRISPR gRNA sequence
gggtttttcacatttcacgc

SEQ ID NO: 725434 - DNA, 20 bp, Artificial
  CRISPR gRNA sequence
ggtttttcacatttcacgct

SEQ ID NO: 725435 - DNA, 20 bp, Artificial
  CRISPR gRNA sequence
ttcacatttcacgctaagga

SEQ ID NO: 725436 - DNA, 20 bp, Artificial
  CRISPR gRNA sequence
tcacatttcacgctaaggag

SEQ ID NO: 725437 - DNA, 20 bp, Artificial
  CRISPR gRNA sequence
cacatttcacgctaaggagt

SEQ ID NO: 725438 - DNA, 20 bp, Artificial
  CRISPR gRNA sequence
acatttcacgctaaggagta

SEQ ID NO: 725439 - DNA, 20 bp, Artificial
  CRISPR gRNA sequence
cacgctaaggagtagtggcc

SEQ ID NO: 725440 - DNA, 20 bp, Artificial
  CRISPR gRNA sequence
acgctaaggagtagtggccc

SEQ ID NO: 725441 - DNA, 20 bp, Artificial
  CRISPR gRNA sequence
aggagtagtggccctgactt

SEQ ID NO: 725442 - DNA, 20 bp, Artificial
  CRISPR gRNA sequence
acttccggtcggctggccag

SEQ ID NO: 725443 - DNA, 20 bp, Artificial
  CRISPR gRNA sequence
ccggtcggctggccagctga

SEQ ID NO: 725444 - DNA, 20 bp, Artificial
  CRISPR gRNA sequence
cggtcggctggccagctgac

SEQ ID NO: 725445 - DNA, 20 bp, Artificial
  CRISPR gRNA sequence
gccagctgactccctagggc

SEQ ID NO: 725446 - DNA, 20 bp, Artificial
  CRISPR gRNA sequence
actccctagggccttcagac

SEQ ID NO: 725447 - DNA, 20 bp, Artificial
  CRISPR gRNA sequence
cctagggccttcagacgtgt

SEQ ID NO: 725448 - DNA, 20 bp, Artificial
  CRISPR gRNA sequence
gggccttcagacgtgtatgc

SEQ ID NO: 725449 - DNA, 20 bp, Artificial
  CRISPR gRNA sequence
cagacgtgtatgcaaatgag

SEQ ID NO: 725450 - DNA, 20 bp, Artificial
  CRISPR gRNA sequence
agacgtgtatgcaaatgagt

SEQ ID NO: 725451 - DNA, 20 bp, Artificial
  CRISPR gRNA sequence
ggagttgcgggcagcctgga

SEQ ID NO: 725452 - DNA, 20 bp, Artificial
  CRISPR gRNA sequence
gagttgcgggcagcctggag

SEQ ID NO: 725453 - DNA, 20 bp, Artificial
  CRISPR gRNA sequence
cgggcagcctggagactcgt

SEQ ID NO: 725454 - DNA, 20 bp, Artificial
  CRISPR gRNA sequence
gagactcgtggacttaccgc

SEQ ID NO: 725455 - DNA, 20 bp, Artificial
  CRISPR gRNA sequence
gtggacttaccgcctggagg

SEQ ID NO: 725456 - DNA, 20 bp, Artificial
  CRISPR gRNA sequence
accgcctggaggcaggcccg

SEQ ID NO: 725457 - DNA, 20 bp, Artificial
  CRISPR gRNA sequence
ccgcctggaggcaggcccgg

SEQ ID NO: 725458 - DNA, 20 bp, Artificial
  CRISPR gRNA sequence
gaggcaggcccgggaaggct

SEQ ID NO: 725459 - DNA, 20 bp, Artificial
  CRISPR gRNA sequence
ctgtttactcatcgggcagc

SEQ ID NO: 725460 - DNA, 20 bp, Artificial
  CRISPR gRNA sequence
tttactcatcgggcagccac

SEQ ID NO: 725461 - DNA, 20 bp, Artificial
  CRISPR gRNA sequence
actcatcgggcagccacgtg

SEQ ID NO: 725462 - DNA, 20 bp, Artificial
  CRISPR gRNA sequence
ctcatcgggcagccacgtgc

SEQ ID NO: 725463 - DNA, 20 bp, Artificial
  CRISPR gRNA sequence
atcgggcagccacgtgctct

SEQ ID NO: 725464 - DNA, 20 bp, Artificial
  CRISPR gRNA sequence
tctggaggaagtgatagttt

SEQ ID NO: 725465 - DNA, 20 bp, Artificial
  CRISPR gRNA sequence
tggaggaagtgatagtttct

SEQ ID NO: 725466 - DNA, 20 bp, Artificial
  CRISPR gRNA sequence
gaggaagtgatagtttctga

SEQ ID NO: 725467 - DNA, 20 bp, Artificial
  CRISPR gRNA sequence
ctgaaaccgctcagatgttt

SEQ ID NO: 725468 - DNA, 20 bp, Artificial
  CRISPR gRNA sequence
tgaaaccgctcagatgtttt

SEQ ID NO: 725469 - DNA, 20 bp, Artificial
  CRISPR gRNA sequence
aaaccgctcagatgttttgg

SEQ ID NO: 725470 - DNA, 20 bp, Artificial
  CRISPR gRNA sequence
agatgttttggggaaagttg

SEQ ID NO: 725471 - DNA, 20 bp, Artificial
  CRISPR gRNA sequence
tggggaaagttggagaagcc

SEQ ID NO: 725472 - DNA, 20 bp, Artificial
  CRISPR gRNA sequence
ggggaaagttggagaagccg

SEQ ID NO: 725473 - DNA, 20 bp, Artificial
  CRISPR gRNA sequence
gggaaagttggagaagccgt

SEQ ID NO: 725474 - DNA, 20 bp, Artificial
  CRISPR gRNA sequence
gagaagccgtggccttgcga

SEQ ID NO: 725475 - DNA, 20 bp, Artificial
  CRISPR gRNA sequence
gcgagaggtggttacaccag

SEQ ID NO: 725476 - DNA, 20 bp, Artificial
  CRISPR gRNA sequence
cgagaggtggttacaccaga

SEQ ID NO: 725477 - DNA, 20 bp, Artificial
  CRISPR gRNA sequence
caccagaacctggacattgg

SEQ ID NO: 725478 - DNA, 20 bp, Artificial
  CRISPR gRNA sequence
gacattggccagaagaagct

SEQ ID NO: 725479 - DNA, 20 bp, Artificial
  CRISPR gRNA sequence
gccagaagaagcttaagtgg

SEQ ID NO: 725480 - DNA, 20 bp, Artificial
  CRISPR gRNA sequence
aagtgggcagacactgtttg

SEQ ID NO: 725481 - DNA, 20 bp, Artificial
  CRISPR gRNA sequence
agtgggcagacactgtttgc

SEQ ID NO: 725482 - DNA, 20 bp, Artificial
  CRISPR gRNA sequence
tttgcccagtgtttgtgcaa

SEQ ID NO: 725483 - DNA, 20 bp, Artificial
  CRISPR gRNA sequence
gcccagtgtttgtgcaagga

SEQ ID NO: 725484 - DNA, 20 bp, Artificial
  CRISPR gRNA sequence
cccagtgtttgtgcaaggat

SEQ ID NO: 725485 - DNA, 20 bp, Artificial
  CRISPR gRNA sequence
gtgcaaggatggagtgggtg

SEQ ID NO: 725486 - DNA, 20 bp, Artificial
  CRISPR gRNA sequence
tgcaaggatggagtgggtgt

SEQ ID NO: 725487 - DNA, 20 bp, Artificial
  CRISPR gRNA sequence
tgcatcacccacagccgcag

SEQ ID NO: 725488 - DNA, 20 bp, Artificial
  CRISPR gRNA sequence
catcacccacagccgcagct

SEQ ID NO: 725489 - DNA, 20 bp, Artificial
  CRISPR gRNA sequence
taaggcacgctggaaggcac

SEQ ID NO: 725490 - DNA, 20 bp, Artificial
  CRISPR gRNA sequence
gaaggcacacgcctgccagg

SEQ ID NO: 725491 - DNA, 20 bp, Artificial
  CRISPR gRNA sequence
ccaggcagggcagtctggcg

SEQ ID NO: 725492 - DNA, 20 bp, Artificial
  CRISPR gRNA sequence
gcgcccatgatgggagggat

SEQ ID NO: 725493 - DNA, 20 bp, Artificial
  CRISPR gRNA sequence
acatgtttcaacaaaataat

SEQ ID NO: 725494 - DNA, 20 bp, Artificial
  CRISPR gRNA sequence
caacaaaataatgcacttcc

SEQ ID NO: 725495 - DNA, 20 bp, Artificial
  CRISPR gRNA sequence
aacaaaataatgcacttcct

SEQ ID NO: 725496 - DNA, 20 bp, Artificial
  CRISPR gRNA sequence
ccttacctagtggcccttca

SEQ ID NO: 725497 - DNA, 20 bp, Artificial
  CRISPR gRNA sequence
cttacctagtggcccttcac

SEQ ID NO: 725498 - DNA, 20 bp, Artificial
  CRISPR gRNA sequence
acctagtggcccttcacaca

SEQ ID NO: 725499 - DNA, 20 bp, Artificial
  CRISPR gRNA sequence
cctagtggcccttcacacaa

SEQ ID NO: 725500 - DNA, 20 bp, Artificial
  CRISPR gRNA sequence
gtggcccttcacacaacttt

SEQ ID NO: 725501 - DNA, 20 bp, Artificial
  CRISPR gRNA sequence
cacacaacttttgaatctct

SEQ ID NO: 725502 - DNA, 20 bp, Artificial
  CRISPR gRNA sequence
acacaacttttgaatctcta

SEQ ID NO: 725503 - DNA, 20 bp, Artificial
  CRISPR gRNA sequence
ttgaatctctaaaaatccat

SEQ ID NO: 725504 - DNA, 20 bp, Artificial
  CRISPR gRNA sequence
tgaatctctaaaaatccata

SEQ ID NO: 725505 - DNA, 20 bp, Artificial
  CRISPR gRNA sequence
gaatctctaaaaatccataa

SEQ ID NO: 725506 - DNA, 20 bp, Artificial
  CRISPR gRNA sequence
aatctctaaaaatccataaa

SEQ ID NO: 725507 - DNA, 20 bp, Artificial
  CRISPR gRNA sequence
taaaaatccataaaatcctt

SEQ ID NO: 725508 - DNA, 20 bp, Artificial
  CRISPR gRNA sequence
aaaatccataaaatccttaa

SEQ ID NO: 725509 - DNA, 20 bp, Artificial
  CRISPR gRNA sequence
aaagaactgtaaggctgagg

SEQ ID NO: 725510 - DNA, 20 bp, Artificial
  CRISPR gRNA sequence
aagaactgtaaggctgagga

SEQ ID NO: 725511 - DNA, 20 bp, Artificial
  CRISPR gRNA sequence
taaggctgaggacatgatca

SEQ ID NO: 725512 - DNA, 20 bp, Artificial
  CRISPR gRNA sequence
aggacatgatcatcgaaatt

SEQ ID NO: 725513 - DNA, 20 bp, Artificial
  CRISPR gRNA sequence
agagtatgttattaatagaa

SEQ ID NO: 725514 - DNA, 20 bp, Artificial
  CRISPR gRNA sequence
ttaatagaacccctgagcag

SEQ ID NO: 725515 - DNA, 20 bp, Artificial
  CRISPR gRNA sequence
atagaacccctgagcagaag

SEQ ID NO: 725516 - DNA, 20 bp, Artificial
  CRISPR gRNA sequence
agcagaagtggctttgggag

SEQ ID NO: 725517 - DNA, 20 bp, Artificial
  CRISPR gRNA sequence
tgggagtctcccagcagggc

SEQ ID NO: 725518 - DNA, 20 bp, Artificial
  CRISPR gRNA sequence
gggagtctcccagcagggca

SEQ ID NO: 725519 - DNA, 20 bp, Artificial
  CRISPR gRNA sequence
ggagtctcccagcagggcag

SEQ ID NO: 725520 - DNA, 20 bp, Artificial
  CRISPR gRNA sequence
ccagcagggcaggaattccc

SEQ ID NO: 725521 - DNA, 20 bp, Artificial
  CRISPR gRNA sequence
ctgccctgctgggagactcc

SEQ ID NO: 725522 - DNA, 20 bp, Artificial
  CRISPR gRNA sequence
ccctgctgggagactcccaa

SEQ ID NO: 725523 - DNA, 20 bp, Artificial
  CRISPR gRNA sequence
ctgggagactcccaaagcca

SEQ ID NO: 725524 - DNA, 20 bp, Artificial
  CRISPR gRNA sequence
ggagactcccaaagccactt

SEQ ID NO: 725525 - DNA, 20 bp, Artificial
  CRISPR gRNA sequence
ccaaagccacttctgctcag

SEQ ID NO: 725526 - DNA, 20 bp, Artificial
  CRISPR gRNA sequence
ctgctcaggggttctattaa

SEQ ID NO: 725527 - DNA, 20 bp, Artificial
  CRISPR gRNA sequence
tgctcaggggttctattaat

SEQ ID NO: 725528 - DNA, 20 bp, Artificial
  CRISPR gRNA sequence
ctcaggggttctattaataa

SEQ ID NO: 725529 - DNA, 20 bp, Artificial
  CRISPR gRNA sequence
aggggttctattaataacat

SEQ ID NO: 725530 - DNA, 20 bp, Artificial
  CRISPR gRNA sequence
tattaataacatactctcaa

SEQ ID NO: 725531 - DNA, 20 bp, Artificial
  CRISPR gRNA sequence
ttaataacatactctcaatt

SEQ ID NO: 725532 - DNA, 20 bp, Artificial
  CRISPR gRNA sequence
ataacatactctcaatttcg

SEQ ID NO: 725533 - DNA, 20 bp, Artificial
  CRISPR gRNA sequence
tcaatttcgatgatcatgtc

SEQ ID NO: 725534 - DNA, 20 bp, Artificial
  CRISPR gRNA sequence
aatttcgatgatcatgtcct

SEQ ID NO: 725535 - DNA, 20 bp, Artificial
  CRISPR gRNA sequence
cgatgatcatgtcctcagcc

SEQ ID NO: 725536 - DNA, 20 bp, Artificial
  CRISPR gRNA sequence
gatgatcatgtcctcagcct

SEQ ID NO: 725537 - DNA, 20 bp, Artificial
  CRISPR gRNA sequence
agccttacagttctttaagg

SEQ ID NO: 725538 - DNA, 20 bp, Artificial
  CRISPR gRNA sequence
acagttctttaaggatttta

SEQ ID NO: 725539 - DNA, 20 bp, Artificial
  CRISPR gRNA sequence
cagttctttaaggattttat

SEQ ID NO: 725540 - DNA, 20 bp, Artificial
  CRISPR gRNA sequence
tttaaggattttatggattt

SEQ ID NO: 725541 - DNA, 20 bp, Artificial
  CRISPR gRNA sequence
taaggattttatggattttt

SEQ ID NO: 725542 - DNA, 20 bp, Artificial
  CRISPR gRNA sequence
aaggattttatggattttta

SEQ ID NO: 725543 - DNA, 20 bp, Artificial
  CRISPR gRNA sequence
aggattttatggatttttag

SEQ ID NO: 725544 - DNA, 20 bp, Artificial
  CRISPR gRNA sequence
tatggatttttagagattca

SEQ ID NO: 725545 - DNA, 20 bp, Artificial
  CRISPR gRNA sequence
atggatttttagagattcaa

SEQ ID NO: 725546 - DNA, 20 bp, Artificial
  CRISPR gRNA sequence
tggatttttagagattcaaa

SEQ ID NO: 725547 - DNA, 20 bp, Artificial
  CRISPR gRNA sequence
ttagagattcaaaagttgtg

SEQ ID NO: 725548 - DNA, 20 bp, Artificial
  CRISPR gRNA sequence
tagagattcaaaagttgtgt

SEQ ID NO: 725549 - DNA, 20 bp, Artificial
  CRISPR gRNA sequence
agagattcaaaagttgtgtg

SEQ ID NO: 725550 - DNA, 20 bp, Artificial
  CRISPR gRNA sequence
gagattcaaaagttgtgtga

SEQ ID NO: 725551 - DNA, 20 bp, Artificial
  CRISPR gRNA sequence
aaaagttgtgtgaagggcca

SEQ ID NO: 725552 - DNA, 20 bp, Artificial
  CRISPR gRNA sequence
tgtgaagggccactaggtaa

SEQ ID NO: 725553 - DNA, 20 bp, Artificial
  CRISPR gRNA sequence
ggtaaggaagtgcattattt

SEQ ID NO: 725554 - DNA, 20 bp, Artificial
  CRISPR gRNA sequence
ttttgttgaaacatgtcaat

SEQ ID NO: 725555 - DNA, 20 bp, Artificial
  CRISPR gRNA sequence
tgttgaaacatgtcaatccc

SEQ ID NO: 725556 - DNA, 20 bp, Artificial
  CRISPR gRNA sequence
gttgaaacatgtcaatccct

SEQ ID NO: 725557 - DNA, 20 bp, Artificial
  CRISPR gRNA sequence
ttgaaacatgtcaatccctc

SEQ ID NO: 725558 - DNA, 20 bp, Artificial
  CRISPR gRNA sequence
aaacatgtcaatccctccca

SEQ ID NO: 725559 - DNA, 20 bp, Artificial
  CRISPR gRNA sequence
ccatcatgggcgccagactg

SEQ ID NO: 725560 - DNA, 20 bp, Artificial
  CRISPR gRNA sequence
ccctgcctggcaggcgtgtg

SEQ ID NO: 725561 - DNA, 20 bp, Artificial
  CRISPR gRNA sequence
cctggcaggcgtgtgccttc

SEQ ID NO: 725562 - DNA, 20 bp, Artificial
  CRISPR gRNA sequence
gcaggcgtgtgccttccagc

SEQ ID NO: 725563 - DNA, 20 bp, Artificial
  CRISPR gRNA sequence
ccagcgtgccttacagctgc

SEQ ID NO: 725564 - DNA, 20 bp, Artificial
  CRISPR gRNA sequence
cagcgtgccttacagctgcg

SEQ ID NO: 725565 - DNA, 20 bp, Artificial
  CRISPR gRNA sequence
acagctgcggctgtgggtga

SEQ ID NO: 725566 - DNA, 20 bp, Artificial
  CRISPR gRNA sequence
cagctgcggctgtgggtgat

SEQ ID NO: 725567 - DNA, 20 bp, Artificial
  CRISPR gRNA sequence
cggctgtgggtgatgcagag

SEQ ID NO: 725568 - DNA, 20 bp, Artificial
  CRISPR gRNA sequence
tgggtgatgcagagacaccc

SEQ ID NO: 725569 - DNA, 20 bp, Artificial
  CRISPR gRNA sequence
catccttgcacaaacactgg

SEQ ID NO: 725570 - DNA, 20 bp, Artificial
  CRISPR gRNA sequence
gcacaaacactgggcaaaca

SEQ ID NO: 725571 - DNA, 20 bp, Artificial
  CRISPR gRNA sequence
cacaaacactgggcaaacag

SEQ ID NO: 725572 - DNA, 20 bp, Artificial
  CRISPR gRNA sequence
ggcaaacagtgtctgcccac

SEQ ID NO: 725573 - DNA, 20 bp, Artificial
  CRISPR gRNA sequence
cccacttaagcttcttctgg

SEQ ID NO: 725574 - DNA, 20 bp, Artificial
  CRISPR gRNA sequence
aagcttcttctggccaatgt

SEQ ID NO: 725575 - DNA, 20 bp, Artificial
  CRISPR gRNA sequence
agcttcttctggccaatgtc

SEQ ID NO: 725576 - DNA, 20 bp, Artificial
  CRISPR gRNA sequence
cttctggccaatgtccaggt

SEQ ID NO: 725577 - DNA, 20 bp, Artificial
  CRISPR gRNA sequence
ttctggccaatgtccaggtt

SEQ ID NO: 725578 - DNA, 20 bp, Artificial
  CRISPR gRNA sequence
ctggccaatgtccaggttct

SEQ ID NO: 725579 - DNA, 20 bp, Artificial
  CRISPR gRNA sequence
tggccaatgtccaggttctg

SEQ ID NO: 725580 - DNA, 20 bp, Artificial
  CRISPR gRNA sequence
gccaatgtccaggttctggt

SEQ ID NO: 725581 - DNA, 20 bp, Artificial
  CRISPR gRNA sequence
tggtgtaaccacctctcgca

SEQ ID NO: 725582 - DNA, 20 bp, Artificial
  CRISPR gRNA sequence
gtgtaaccacctctcgcaag

SEQ ID NO: 725583 - DNA, 20 bp, Artificial
  CRISPR gRNA sequence
tcgcaaggccacggcttctc

SEQ ID NO: 725584 - DNA, 20 bp, Artificial
  CRISPR gRNA sequence
gcaaggccacggcttctcca

SEQ ID NO: 725585 - DNA, 20 bp, Artificial
  CRISPR gRNA sequence
ctccaactttccccaaaaca

SEQ ID NO: 725586 - DNA, 20 bp, Artificial
  CRISPR gRNA sequence
tccaactttccccaaaacat

SEQ ID NO: 725587 - DNA, 20 bp, Artificial
  CRISPR gRNA sequence
caactttccccaaaacatct

SEQ ID NO: 725588 - DNA, 20 bp, Artificial
  CRISPR gRNA sequence
tccccaaaacatctgagcgg

SEQ ID NO: 725589 - DNA, 20 bp, Artificial
  CRISPR gRNA sequence
ccccaaaacatctgagcggt

SEQ ID NO: 725590 - DNA, 20 bp, Artificial
  CRISPR gRNA sequence
cccaaaacatctgagcggtt

SEQ ID NO: 725591 - DNA, 20 bp, Artificial
  CRISPR gRNA sequence
agcggtttcagaaactatca

SEQ ID NO: 725592 - DNA, 20 bp, Artificial
  CRISPR gRNA sequence
cagaaactatcacttcctcc

SEQ ID NO: 725593 - DNA, 20 bp, Artificial
  CRISPR gRNA sequence
agaaactatcacttcctcca

SEQ ID NO: 725594 - DNA, 20 bp, Artificial
  CRISPR gRNA sequence
tcacttcctccagagagcac

SEQ ID NO: 725595 - DNA, 20 bp, Artificial
  CRISPR gRNA sequence
cctccagagagcacgtggct

SEQ ID NO: 725596 - DNA, 20 bp, Artificial
  CRISPR gRNA sequence
ctccagagagcacgtggctg

SEQ ID NO: 725597 - DNA, 20 bp, Artificial
  CRISPR gRNA sequence
cagagagcacgtggctgccc

SEQ ID NO: 725598 - DNA, 20 bp, Artificial
  CRISPR gRNA sequence
cccgatgagtaaacagcagc

SEQ ID NO: 725599 - DNA, 20 bp, Artificial
  CRISPR gRNA sequence
cccgggcctgcctccaggcg

SEQ ID NO: 725600 - DNA, 20 bp, Artificial
  CRISPR gRNA sequence
ccgggcctgcctccaggcgg

SEQ ID NO: 725601 - DNA, 20 bp, Artificial
  CRISPR gRNA sequence
cctccaggcggtaagtccac

SEQ ID NO: 725602 - DNA, 20 bp, Artificial
  CRISPR gRNA sequence
caggcggtaagtccacgagt

SEQ ID NO: 725603 - DNA, 20 bp, Artificial
  CRISPR gRNA sequence
caggctgcccgcaactccaa

SEQ ID NO: 725604 - DNA, 20 bp, Artificial
  CRISPR gRNA sequence
cccgcaactccaagactcat

SEQ ID NO: 725605 - DNA, 20 bp, Artificial
  CRISPR gRNA sequence
caagactcatccttatccat

SEQ ID NO: 725606 - DNA, 20 bp, Artificial
  CRISPR gRNA sequence
atccttatccatcactcatt

SEQ ID NO: 725607 - DNA, 20 bp, Artificial
  CRISPR gRNA sequence
atccatcactcatttgcata

SEQ ID NO: 725608 - DNA, 20 bp, Artificial
  CRISPR gRNA sequence
tccatcactcatttgcatac

SEQ ID NO: 725609 - DNA, 20 bp, Artificial
  CRISPR gRNA sequence
atttgcatacacgtctgaag

SEQ ID NO: 725610 - DNA, 20 bp, Artificial
  CRISPR gRNA sequence
gcatacacgtctgaaggccc

SEQ ID NO: 725611 - DNA, 20 bp, Artificial
  CRISPR gRNA sequence
catacacgtctgaaggccct

SEQ ID NO: 725612 - DNA, 20 bp, Artificial
  CRISPR gRNA sequence
aaggccctagggagtcagct

SEQ ID NO: 725613 - DNA, 20 bp, Artificial
  CRISPR gRNA sequence
gggagtcagctggccagccg

SEQ ID NO: 725614 - DNA, 20 bp, Artificial
  CRISPR gRNA sequence
gccagccgaccggaagtcag

SEQ ID NO: 725615 - DNA, 20 bp, Artificial
  CRISPR gRNA sequence
ctccttagcgtgaaatgtga

SEQ ID NO: 725616 - DNA, 20 bp, Artificial
  CRISPR gRNA sequence
cttagcgtgaaatgtgaaaa

SEQ ID NO: 725617 - DNA, 20 bp, Artificial
  CRISPR gRNA sequence
agcgtgaaatgtgaaaaacc

SEQ ID NO: 725618 - DNA, 20 bp, Artificial
  CRISPR gRNA sequence
gcgtgaaatgtgaaaaaccc

SEQ ID NO: 725619 - DNA, 20 bp, Artificial
  CRISPR gRNA sequence
atgaaacctccaaacggtct

SEQ ID NO: 725620 - DNA, 20 bp, Artificial
  CRISPR gRNA sequence
caaacggtcttgtttcctat

SEQ ID NO: 725621 - DNA, 20 bp, Artificial
  CRISPR gRNA sequence
gtttcctatggtccagagta

SEQ ID NO: 725622 - DNA, 20 bp, Artificial
  CRISPR gRNA sequence
tttcctatggtccagagtaa

SEQ ID NO: 725623 - DNA, 20 bp, Artificial
  CRISPR gRNA sequence
cctatggtccagagtaaagc

SEQ ID NO: 725624 - DNA, 20 bp, Artificial
  CRISPR gRNA sequence
ctatggtccagagtaaagca

SEQ ID NO: 725625 - DNA, 20 bp, Artificial
  CRISPR gRNA sequence
tggtccagagtaaagcagat

SEQ ID NO: 725626 - DNA, 20 bp, Artificial
  CRISPR gRNA sequence
ggtgaggccgtggtgcctct

SEQ ID NO: 725627 - DNA, 20 bp, Artificial
  CRISPR gRNA sequence
tcgacatccacaccccaaag

SEQ ID NO: 725628 - DNA, 20 bp, Artificial
  CRISPR gRNA sequence
gacatccacaccccaaagcg

SEQ ID NO: 725629 - DNA, 20 bp, Artificial
  CRISPR gRNA sequence
gtggatttgcaagcagggca

SEQ ID NO: 725630 - DNA, 20 bp, Artificial
  CRISPR gRNA sequence
gcaagcagggcagacctaag

SEQ ID NO: 725631 - DNA, 20 bp, Artificial
  CRISPR gRNA sequence
caagcagggcagacctaagg

SEQ ID NO: 725632 - DNA, 20 bp, Artificial
  CRISPR gRNA sequence
aggaagatgcttcttcattt

SEQ ID NO: 725633 - DNA, 20 bp, Artificial
  CRISPR gRNA sequence
cttcatttcccaggacagag

SEQ ID NO: 725634 - DNA, 20 bp, Artificial
  CRISPR gRNA sequence
ttcatttcccaggacagagt

SEQ ID NO: 725635 - DNA, 20 bp, Artificial
  CRISPR gRNA sequence
catttcccaggacagagtgg

SEQ ID NO: 725636 - DNA, 20 bp, Artificial
  CRISPR gRNA sequence
atttcccaggacagagtggg

SEQ ID NO: 725637 - DNA, 20 bp, Artificial
  CRISPR gRNA sequence
cccaggacagagtgggtggg

SEQ ID NO: 725638 - DNA, 20 bp, Artificial
  CRISPR gRNA sequence
ccaggacagagtgggtgggg

SEQ ID NO: 725639 - DNA, 20 bp, Artificial
  CRISPR gRNA sequence
caggcagggcccgaagttcc

SEQ ID NO: 725640 - DNA, 20 bp, Artificial
  CRISPR gRNA sequence
cccatgttcacatggggagg

SEQ ID NO: 725641 - DNA, 20 bp, Artificial
  CRISPR gRNA sequence
acatggggaggaagtccctg

SEQ ID NO: 725642 - DNA, 20 bp, Artificial
  CRISPR gRNA sequence
ggcaaagtaaagcaggttct

SEQ ID NO: 725643 - DNA, 20 bp, Artificial
  CRISPR gRNA sequence
tctgggttggtgaggggcgg

SEQ ID NO: 725644 - DNA, 20 bp, Artificial
  CRISPR gRNA sequence
tgggttggtgaggggcggtc

SEQ ID NO: 725645 - DNA, 20 bp, Artificial
  CRISPR gRNA sequence
ggttggtgaggggcggtctg

SEQ ID NO: 725646 - DNA, 20 bp, Artificial
  CRISPR gRNA sequence
gtgaggggcggtctgcagct

SEQ ID NO: 725647 - DNA, 20 bp, Artificial
  CRISPR gRNA sequence
cagctgctgagggctgcaga

SEQ ID NO: 725648 - DNA, 20 bp, Artificial
  CRISPR gRNA sequence
ctgagggctgcagacatctg

SEQ ID NO: 725649 - DNA, 20 bp, Artificial
  CRISPR gRNA sequence
agggctgcagacatctggga

SEQ ID NO: 725650 - DNA, 20 bp, Artificial
  CRISPR gRNA sequence
cagacatctgggacccgagg

SEQ ID NO: 725651 - DNA, 20 bp, Artificial
  CRISPR gRNA sequence
ggacccgaggcgcctgctgt

SEQ ID NO: 725652 - DNA, 20 bp, Artificial
  CRISPR gRNA sequence
ctgtggcggggattggtggg

SEQ ID NO: 725653 - DNA, 20 bp, Artificial
  CRISPR gRNA sequence
tggcggggattggtggggac

SEQ ID NO: 725654 - DNA, 20 bp, Artificial
  CRISPR gRNA sequence
gtggggacattctgagatga

SEQ ID NO: 725655 - DNA, 20 bp, Artificial
  CRISPR gRNA sequence
tgagatgagtgacttgatcc

SEQ ID NO: 725656 - DNA, 20 bp, Artificial
  CRISPR gRNA sequence
agatgagtgacttgatcctg

SEQ ID NO: 725657 - DNA, 20 bp, Artificial
  CRISPR gRNA sequence
gatcctgggccctaggccct

SEQ ID NO: 725658 - DNA, 20 bp, Artificial
  CRISPR gRNA sequence
atcctgggccctaggccctg

SEQ ID NO: 725659 - DNA, 20 bp, Artificial
  CRISPR gRNA sequence
ggccctaggccctgggccca

SEQ ID NO: 725660 - DNA, 20 bp, Artificial
  CRISPR gRNA sequence
ggccctgggcccaccgaggg

SEQ ID NO: 725661 - DNA, 20 bp, Artificial
  CRISPR gRNA sequence
ggcccaccgagggggctaca

SEQ ID NO: 725662 - DNA, 20 bp, Artificial
  CRISPR gRNA sequence
caggacagggaaggtgggca

SEQ ID NO: 725663 - DNA, 20 bp, Artificial
  CRISPR gRNA sequence
acaccagtgcagagtacagt

SEQ ID NO: 725664 - DNA, 20 bp, Artificial
  CRISPR gRNA sequence
cagcagagacagtgccagct

SEQ ID NO: 725665 - DNA, 20 bp, Artificial
  CRISPR gRNA sequence
acgacgccccatccctcgac

SEQ ID NO: 725666 - DNA, 20 bp, Artificial
  CRISPR gRNA sequence
gacttcccttttgactctgg

SEQ ID NO: 725667 - DNA, 20 bp, Artificial
  CRISPR gRNA sequence
cccttttgactctggagaaa

SEQ ID NO: 725668 - DNA, 20 bp, Artificial
  CRISPR gRNA sequence
ccttttgactctggagaaac

SEQ ID NO: 725669 - DNA, 20 bp, Artificial
  CRISPR gRNA sequence
ttgactctggagaaacaacc

SEQ ID NO: 725670 - DNA, 20 bp, Artificial
  CRISPR gRNA sequence
tgactctggagaaacaacca

SEQ ID NO: 725671 - DNA, 20 bp, Artificial
  CRISPR gRNA sequence
gactctggagaaacaaccac

SEQ ID NO: 725672 - DNA, 20 bp, Artificial
  CRISPR gRNA sequence
actctggagaaacaaccaca

SEQ ID NO: 725673 - DNA, 20 bp, Artificial
  CRISPR gRNA sequence
tggagaaacaaccacaggca

SEQ ID NO: 725674 - DNA, 20 bp, Artificial
  CRISPR gRNA sequence
gagaaacaaccacaggcact

SEQ ID NO: 725675 - DNA, 20 bp, Artificial
  CRISPR gRNA sequence
gctccatgcccactgggggc

SEQ ID NO: 725676 - DNA, 20 bp, Artificial
  CRISPR gRNA sequence
catgcccactgggggccaca

SEQ ID NO: 725677 - DNA, 20 bp, Artificial
  CRISPR gRNA sequence
ggggccacatttacagtaac

SEQ ID NO: 725678 - DNA, 20 bp, Artificial
  CRISPR gRNA sequence
acagtaactgggggcatgcc

SEQ ID NO: 725679 - DNA, 20 bp, Artificial
  CRISPR gRNA sequence
cagtaactgggggcatgccg

SEQ ID NO: 725680 - DNA, 20 bp, Artificial
  CRISPR gRNA sequence
ggggcatgccggaagggccc

SEQ ID NO: 725681 - DNA, 20 bp, Artificial
  CRISPR gRNA sequence
tgaggtccagggagagagga

SEQ ID NO: 725682 - DNA, 20 bp, Artificial
  CRISPR gRNA sequence
aggtccagggagagaggaga

SEQ ID NO: 725683 - DNA, 20 bp, Artificial
  CRISPR gRNA sequence
caggggccccgggagctggc

SEQ ID NO: 725684 - DNA, 20 bp, Artificial
  CRISPR gRNA sequence
gcctcacgacctctccctcg

SEQ ID NO: 725685 - DNA, 20 bp, Artificial
  CRISPR gRNA sequence
acgacctctccctcgctggg

SEQ ID NO: 725686 - DNA, 20 bp, Artificial
  CRISPR gRNA sequence
tccctcgctgggctgtgggc

SEQ ID NO: 725687 - DNA, 20 bp, Artificial
  CRISPR gRNA sequence
cctcgctgggctgtgggcct

SEQ ID NO: 725688 - DNA, 20 bp, Artificial
  CRISPR gRNA sequence
gctgggctgtgggcctggtg

SEQ ID NO: 725689 - DNA, 20 bp, Artificial
  CRISPR gRNA sequence
ggctgtgggcctggtggtta

SEQ ID NO: 725690 - DNA, 20 bp, Artificial
  CRISPR gRNA sequence
tgggcctggtggttaaggtc

SEQ ID NO: 725691 - DNA, 20 bp, Artificial
  CRISPR gRNA sequence
gtggttaaggtctgatgccc

SEQ ID NO: 725692 - DNA, 20 bp, Artificial
  CRISPR gRNA sequence
aggtctgatgcccagggctc

SEQ ID NO: 725693 - DNA, 20 bp, Artificial
  CRISPR gRNA sequence
atgcccagggctctgggacc

SEQ ID NO: 725694 - DNA, 20 bp, Artificial
  CRISPR gRNA sequence
tgggaccaatgctgttctcg

SEQ ID NO: 725695 - DNA, 20 bp, Artificial
  CRISPR gRNA sequence
ggaccaatgctgttctcggc

SEQ ID NO: 725696 - DNA, 20 bp, Artificial
  CRISPR gRNA sequence
ttctcggcagtgcccatcct

SEQ ID NO: 725697 - DNA, 20 bp, Artificial
  CRISPR gRNA sequence
tcggcagtgcccatcctgcc

SEQ ID NO: 725698 - DNA, 20 bp, Artificial
  CRISPR gRNA sequence
ggcagtgcccatcctgccat

SEQ ID NO: 725699 - DNA, 20 bp, Artificial
  CRISPR gRNA sequence
ccatctgtttgctgcctcaa

SEQ ID NO: 725700 - DNA, 20 bp, Artificial
  CRISPR gRNA sequence
tttgctgcctcaaccaacat

SEQ ID NO: 725701 - DNA, 20 bp, Artificial
  CRISPR gRNA sequence
gctgcctcaaccaacatcac

SEQ ID NO: 725702 - DNA, 20 bp, Artificial
  CRISPR gRNA sequence
ctgcctcaaccaacatcact

SEQ ID NO: 725703 - DNA, 20 bp, Artificial
  CRISPR gRNA sequence
cctcaaccaacatcactgct

SEQ ID NO: 725704 - DNA, 20 bp, Artificial
  CRISPR gRNA sequence
aaccaacatcactgctggga

SEQ ID NO: 725705 - DNA, 20 bp, Artificial
  CRISPR gRNA sequence
ctgggatccagtccccttgg

SEQ ID NO: 725706 - DNA, 20 bp, Artificial
  CRISPR gRNA sequence
ggatccagtccccttggact

SEQ ID NO: 725707 - DNA, 20 bp, Artificial
  CRISPR gRNA sequence
ggactgtctcttctgtacaa

SEQ ID NO: 725708 - DNA, 20 bp, Artificial
  CRISPR gRNA sequence
gactgtctcttctgtacaag

SEQ ID NO: 725709 - DNA, 20 bp, Artificial
  CRISPR gRNA sequence
tctcttctgtacaagccccg

SEQ ID NO: 725710 - DNA, 20 bp, Artificial
  CRISPR gRNA sequence
ttctgtacaagccccggatc

SEQ ID NO: 725711 - DNA, 20 bp, Artificial
  CRISPR gRNA sequence
ctgtacaagccccggatccc

SEQ ID NO: 725712 - DNA, 20 bp, Artificial
  CRISPR gRNA sequence
tgtacaagccccggatcccc

SEQ ID NO: 725713 - DNA, 20 bp, Artificial
  CRISPR gRNA sequence
tacaagccccggatccccta

SEQ ID NO: 725714 - DNA, 20 bp, Artificial
  CRISPR gRNA sequence
ggctctgggtcaggggacag

SEQ ID NO: 725715 - DNA, 20 bp, Artificial
  CRISPR gRNA sequence
tgggtcaggggacagctaag

SEQ ID NO: 725716 - DNA, 20 bp, Artificial
  CRISPR gRNA sequence
ggtcaggggacagctaagtt

SEQ ID NO: 725717 - DNA, 20 bp, Artificial
  CRISPR gRNA sequence
agttggggatgcaagcagag

SEQ ID NO: 725718 - DNA, 20 bp, Artificial
  CRISPR gRNA sequence
gggatgcaagcagagaccac

SEQ ID NO: 725719 - DNA, 20 bp, Artificial
  CRISPR gRNA sequence
cagtgaccggccggtccacc

SEQ ID NO: 725720 - DNA, 20 bp, Artificial
  CRISPR gRNA sequence
gatgctggagcctcagttca

SEQ ID NO: 725721 - DNA, 20 bp, Artificial
  CRISPR gRNA sequence
gagcctcagttcaggccaga

SEQ ID NO: 725722 - DNA, 20 bp, Artificial
  CRISPR gRNA sequence
agttcaggccagatgggcct

SEQ ID NO: 725723 - DNA, 20 bp, Artificial
  CRISPR gRNA sequence
aggccagatgggcctctgcc

SEQ ID NO: 725724 - DNA, 20 bp, Artificial
  CRISPR gRNA sequence
tgcccccaacctcggtgcca

SEQ ID NO: 725725 - DNA, 20 bp, Artificial
  CRISPR gRNA sequence
cccccaacctcggtgccaac

SEQ ID NO: 725726 - DNA, 20 bp, Artificial
  CRISPR gRNA sequence
ggtgccaacagtgccatcct

SEQ ID NO: 725727 - DNA, 20 bp, Artificial
  CRISPR gRNA sequence
gcctcccagaggccaccctg

SEQ ID NO: 725728 - DNA, 20 bp, Artificial
  CRISPR gRNA sequence
ccagaggccaccctgctgcc

SEQ ID NO: 725729 - DNA, 20 bp, Artificial
  CRISPR gRNA sequence
ctgccctcctagccccagcc

SEQ ID NO: 725730 - DNA, 20 bp, Artificial
  CRISPR gRNA sequence
ccctcctagccccagcccag

SEQ ID NO: 725731 - DNA, 20 bp, Artificial
  CRISPR gRNA sequence
ctagccccagcccagcccag

SEQ ID NO: 725732 - DNA, 20 bp, Artificial
  CRISPR gRNA sequence
gccccagcccagcccaggcc

SEQ ID NO: 725733 - DNA, 20 bp, Artificial
  CRISPR gRNA sequence
actttccagaggcagctgtg

SEQ ID NO: 725734 - DNA, 20 bp, Artificial
  CRISPR gRNA sequence
tccagaggcagctgtgggca

SEQ ID NO: 725735 - DNA, 20 bp, Artificial
  CRISPR gRNA sequence
ccagaggcagctgtgggcaa

SEQ ID NO: 725736 - DNA, 20 bp, Artificial
  CRISPR gRNA sequence
cagaggcagctgtgggcaag

SEQ ID NO: 725737 - DNA, 20 bp, Artificial
  CRISPR gRNA sequence
tgggcaaggggtcttctttc

SEQ ID NO: 725738 - DNA, 20 bp, Artificial
  CRISPR gRNA sequence
ctttcccttcctcttccact

SEQ ID NO: 725739 - DNA, 20 bp, Artificial
  CRISPR gRNA sequence
tttcccttcctcttccactg

SEQ ID NO: 725740 - DNA, 20 bp, Artificial
  CRISPR gRNA sequence
tcccttcctcttccactgag

SEQ ID NO: 725741 - DNA, 20 bp, Artificial
  CRISPR gRNA sequence
cccttcctcttccactgaga

SEQ ID NO: 725742 - DNA, 20 bp, Artificial
  CRISPR gRNA sequence
ccttcctcttccactgagag

SEQ ID NO: 725743 - DNA, 20 bp, Artificial
  CRISPR gRNA sequence
cctcttccactgagagcatg

SEQ ID NO: 725744 - DNA, 20 bp, Artificial
  CRISPR gRNA sequence
ctcttccactgagagcatga

SEQ ID NO: 725745 - DNA, 20 bp, Artificial
  CRISPR gRNA sequence
ttccactgagagcatgacat

SEQ ID NO: 725746 - DNA, 20 bp, Artificial
  CRISPR gRNA sequence
ccactgagagcatgacatcg

SEQ ID NO: 725747 - DNA, 20 bp, Artificial
  CRISPR gRNA sequence
cactgagagcatgacatcgc

SEQ ID NO: 725748 - DNA, 20 bp, Artificial
  CRISPR gRNA sequence
agagcatgacatcgctgcag

SEQ ID NO: 725749 - DNA, 20 bp, Artificial
  CRISPR gRNA sequence
cagctgcccagaggcggttc

SEQ ID NO: 725750 - DNA, 20 bp, Artificial
  CRISPR gRNA sequence
cccagaggcggttctgtctc

SEQ ID NO: 725751 - DNA, 20 bp, Artificial
  CRISPR gRNA sequence
tgtctcctgctcggggtagt

SEQ ID NO: 725752 - DNA, 20 bp, Artificial
  CRISPR gRNA sequence
tctcctgctcggggtagtgg

SEQ ID NO: 725753 - DNA, 20 bp, Artificial
  CRISPR gRNA sequence
ctgctcggggtagtgggggg

SEQ ID NO: 725754 - DNA, 20 bp, Artificial
  CRISPR gRNA sequence
ctcggggtagtggggggtat

SEQ ID NO: 725755 - DNA, 20 bp, Artificial
  CRISPR gRNA sequence
ggggtagtggggggtatggt

SEQ ID NO: 725756 - DNA, 20 bp, Artificial
  CRISPR gRNA sequence
cagctcctcctccaactcgg

SEQ ID NO: 725757 - DNA, 20 bp, Artificial
  CRISPR gRNA sequence
ctcctccaactcgggctctg

SEQ ID NO: 725758 - DNA, 20 bp, Artificial
  CRISPR gRNA sequence
ctccaactcgggctctgctg

SEQ ID NO: 725759 - DNA, 20 bp, Artificial
  CRISPR gRNA sequence
caactcgggctctgctggcc

SEQ ID NO: 725760 - DNA, 20 bp, Artificial
  CRISPR gRNA sequence
gggctctgctggccccgcca

SEQ ID NO: 725761 - DNA, 20 bp, Artificial
  CRISPR gRNA sequence
tgctggccccgccaggcccc

SEQ ID NO: 725762 - DNA, 20 bp, Artificial
  CRISPR gRNA sequence
ctggccccgccaggccccgg

SEQ ID NO: 725763 - DNA, 20 bp, Artificial
  CRISPR gRNA sequence
gccccgccaggccccggccc

SEQ ID NO: 725764 - DNA, 20 bp, Artificial
  CRISPR gRNA sequence
cggcagctcagccttcacgg

SEQ ID NO: 725765 - DNA, 20 bp, Artificial
  CRISPR gRNA sequence
agccttcacggtccccacga

SEQ ID NO: 725766 - DNA, 20 bp, Artificial
  CRISPR gRNA sequence
cacggtccccacgatcacgg

SEQ ID NO: 725767 - DNA, 20 bp, Artificial
  CRISPR gRNA sequence
acggtccccacgatcacggt

SEQ ID NO: 725768 - DNA, 20 bp, Artificial
  CRISPR gRNA sequence
catgatgtagattttctctg

SEQ ID NO: 725769 - DNA, 20 bp, Artificial
  CRISPR gRNA sequence
atgatgtagattttctctgc

SEQ ID NO: 725770 - DNA, 20 bp, Artificial
  CRISPR gRNA sequence
tctctgcaaggcaaaaggat

SEQ ID NO: 725771 - DNA, 20 bp, Artificial
  CRISPR gRNA sequence
ctctgcaaggcaaaaggatg

SEQ ID NO: 725772 - DNA, 20 bp, Artificial
  CRISPR gRNA sequence
tctgcaaggcaaaaggatgg

SEQ ID NO: 725773 - DNA, 20 bp, Artificial
  CRISPR gRNA sequence
tgcaaggcaaaaggatgggt

SEQ ID NO: 725774 - DNA, 20 bp, Artificial
  CRISPR gRNA sequence
caaggcaaaaggatgggtga

SEQ ID NO: 725775 - DNA, 20 bp, Artificial
  CRISPR gRNA sequence
gtacacctgccgggtggctt

SEQ ID NO: 725776 - DNA, 20 bp, Artificial
  CRISPR gRNA sequence
ccgggtggcttcaggctgat

SEQ ID NO: 725777 - DNA, 20 bp, Artificial
  CRISPR gRNA sequence
caggctgatggcacagcctc

SEQ ID NO: 725778 - DNA, 20 bp, Artificial
  CRISPR gRNA sequence
aggctgatggcacagcctct

SEQ ID NO: 725779 - DNA, 20 bp, Artificial
  CRISPR gRNA sequence
atggcacagcctctctgatg

SEQ ID NO: 725780 - DNA, 20 bp, Artificial
  CRISPR gRNA sequence
tctgatgtaccttacaggca

SEQ ID NO: 725781 - DNA, 20 bp, Artificial
  CRISPR gRNA sequence
tgatgtaccttacaggcatc

SEQ ID NO: 725782 - DNA, 20 bp, Artificial
  CRISPR gRNA sequence
atgtaccttacaggcatcct

SEQ ID NO: 725783 - DNA, 20 bp, Artificial
  CRISPR gRNA sequence
acaggcatcctgggggctca

SEQ ID NO: 725784 - DNA, 20 bp, Artificial
  CRISPR gRNA sequence
caggcatcctgggggctcag

SEQ ID NO: 725785 - DNA, 20 bp, Artificial
  CRISPR gRNA sequence
ggggctcagaggaaatagaa

SEQ ID NO: 725786 - DNA, 20 bp, Artificial
  CRISPR gRNA sequence
agaggaaatagaacagctag

SEQ ID NO: 725787 - DNA, 20 bp, Artificial
  CRISPR gRNA sequence
ggagctgggccttgaggagt

SEQ ID NO: 725788 - DNA, 20 bp, Artificial
  CRISPR gRNA sequence
ggccttgaggagttaagaac

SEQ ID NO: 725789 - DNA, 20 bp, Artificial
  CRISPR gRNA sequence
gaggagttaagaaccagccc

SEQ ID NO: 725790 - DNA, 20 bp, Artificial
  CRISPR gRNA sequence
aggagttaagaaccagccca

SEQ ID NO: 725791 - DNA, 20 bp, Artificial
  CRISPR gRNA sequence
agaaccagcccacttgtact

SEQ ID NO: 725792 - DNA, 20 bp, Artificial
  CRISPR gRNA sequence
gtacttaggattttctcagc

SEQ ID NO: 725793 - DNA, 20 bp, Artificial
  CRISPR gRNA sequence
tacttaggattttctcagca

SEQ ID NO: 725794 - DNA, 20 bp, Artificial
  CRISPR gRNA sequence
aggattttctcagcacatct

SEQ ID NO: 725795 - DNA, 20 bp, Artificial
  CRISPR gRNA sequence
ggattttctcagcacatctc

SEQ ID NO: 725796 - DNA, 20 bp, Artificial
  CRISPR gRNA sequence
tctcagcacatctctgcgga

SEQ ID NO: 725797 - DNA, 20 bp, Artificial
  CRISPR gRNA sequence
ctcagcacatctctgcggat

SEQ ID NO: 725798 - DNA, 20 bp, Artificial
  CRISPR gRNA sequence
tcagcacatctctgcggatg

SEQ ID NO: 725799 - DNA, 20 bp, Artificial
  CRISPR gRNA sequence
agcacatctctgcggatggg

SEQ ID NO: 725800 - DNA, 20 bp, Artificial
  CRISPR gRNA sequence
tgcggatgggtagggaagaa

SEQ ID NO: 725801 - DNA, 20 bp, Artificial
  CRISPR gRNA sequence
cggatgggtagggaagaaga

SEQ ID NO: 725802 - DNA, 20 bp, Artificial
  CRISPR gRNA sequence
tggacaaaaacaggcaaagc

SEQ ID NO: 725803 - DNA, 20 bp, Artificial
  CRISPR gRNA sequence
agcagtttccacacccccac

SEQ ID NO: 725804 - DNA, 20 bp, Artificial
  CRISPR gRNA sequence
ccacacccccactcctgggt

SEQ ID NO: 725805 - DNA, 20 bp, Artificial
  CRISPR gRNA sequence
cacacccccactcctgggtc

SEQ ID NO: 725806 - DNA, 20 bp, Artificial
  CRISPR gRNA sequence
ctgggtccccagccctcctg

SEQ ID NO: 725807 - DNA, 20 bp, Artificial
  CRISPR gRNA sequence
ggtccccagccctcctgcaa

SEQ ID NO: 725808 - DNA, 20 bp, Artificial
  CRISPR gRNA sequence
ctgcaaggcggaccccatca

SEQ ID NO: 725809 - DNA, 20 bp, Artificial
  CRISPR gRNA sequence
caaggcggaccccatcaaga

SEQ ID NO: 725810 - DNA, 20 bp, Artificial
  CRISPR gRNA sequence
ccatttacaggtaagaatct

SEQ ID NO: 725811 - DNA, 20 bp, Artificial
  CRISPR gRNA sequence
acaggtaagaatctgaagcc

SEQ ID NO: 725812 - DNA, 20 bp, Artificial
  CRISPR gRNA sequence
caggtaagaatctgaagcct

SEQ ID NO: 725813 - DNA, 20 bp, Artificial
  CRISPR gRNA sequence
aagcctggagaggttaaatg

SEQ ID NO: 725814 - DNA, 20 bp, Artificial
  CRISPR gRNA sequence
gagaggttaaatgacctgcc

SEQ ID NO: 725815 - DNA, 20 bp, Artificial
  CRISPR gRNA sequence
aatgacctgcccaaggtcgc

SEQ ID NO: 725816 - DNA, 20 bp, Artificial
  CRISPR gRNA sequence
cccaaggtcgccacgtagtt

SEQ ID NO: 725817 - DNA, 20 bp, Artificial
  CRISPR gRNA sequence
ggagaaatcccccaaaaaaa

SEQ ID NO: 725818 - DNA, 20 bp, Artificial
  CRISPR gRNA sequence
cgcctggtggccctttctgc

SEQ ID NO: 725819 - DNA, 20 bp, Artificial
  CRISPR gRNA sequence
gtggccctttctgctcctat

SEQ ID NO: 725820 - DNA, 20 bp, Artificial
  CRISPR gRNA sequence
tctgctcctatctgtgtgcc

SEQ ID NO: 725821 - DNA, 20 bp, Artificial
  CRISPR gRNA sequence
ctgctcctatctgtgtgcct

SEQ ID NO: 725822 - DNA, 20 bp, Artificial
  CRISPR gRNA sequence
tgctcctatctgtgtgcctg

SEQ ID NO: 725823 - DNA, 20 bp, Artificial
  CRISPR gRNA sequence
ctcctatctgtgtgcctgca

SEQ ID NO: 725824 - DNA, 20 bp, Artificial
  CRISPR gRNA sequence
ctatctgtgtgcctgcagcc

SEQ ID NO: 725825 - DNA, 20 bp, Artificial
  CRISPR gRNA sequence
tctgtgtgcctgcagccaaa

SEQ ID NO: 725826 - DNA, 20 bp, Artificial
  CRISPR gRNA sequence
tgtgcctgcagccaaaaccc

SEQ ID NO: 725827 - DNA, 20 bp, Artificial
  CRISPR gRNA sequence
cagccaaaacccggggtgac

SEQ ID NO: 725828 - DNA, 20 bp, Artificial
  CRISPR gRNA sequence
gtccagcttgcccgggaaca

SEQ ID NO: 725829 - DNA, 20 bp, Artificial
  CRISPR gRNA sequence
tccagcttgcccgggaacat

SEQ ID NO: 725830 - DNA, 20 bp, Artificial
  CRISPR gRNA sequence
gcccgggaacattcctggtt

SEQ ID NO: 725831 - DNA, 20 bp, Artificial
  CRISPR gRNA sequence
cccgggaacattcctggttc

SEQ ID NO: 725832 - DNA, 20 bp, Artificial
  CRISPR gRNA sequence
ctggttctactactgcaagt

SEQ ID NO: 725833 - DNA, 20 bp, Artificial
  CRISPR gRNA sequence
gttctactactgcaagtccc

SEQ ID NO: 725834 - DNA, 20 bp, Artificial
  CRISPR gRNA sequence
tactactgcaagtcccgtgt

SEQ ID NO: 725835 - DNA, 20 bp, Artificial
  CRISPR gRNA sequence
ctactgcaagtcccgtgtcc

SEQ ID NO: 725836 - DNA, 20 bp, Artificial
  CRISPR gRNA sequence
ctgcaagtcccgtgtcctgg

SEQ ID NO: 725837 - DNA, 20 bp, Artificial
  CRISPR gRNA sequence
caagtcccgtgtcctgggag

SEQ ID NO: 725838 - DNA, 20 bp, Artificial
  CRISPR gRNA sequence
ggagtcccctcggtccgggc

SEQ ID NO: 725839 - DNA, 20 bp, Artificial
  CRISPR gRNA sequence
ggtccgggcaaactcagcca

SEQ ID NO: 725840 - DNA, 20 bp, Artificial
  CRISPR gRNA sequence
agccagcctgtcacatcctg

SEQ ID NO: 725841 - DNA, 20 bp, Artificial
  CRISPR gRNA sequence
tcacatcctgcagaaaaccc

SEQ ID NO: 725842 - DNA, 20 bp, Artificial
  CRISPR gRNA sequence
cagaaaacccggccccctca

SEQ ID NO: 725843 - DNA, 20 bp, Artificial
  CRISPR gRNA sequence
aataggtctcggcagcccat

SEQ ID NO: 725844 - DNA, 20 bp, Artificial
  CRISPR gRNA sequence
ggcagcccatgattgagaca

SEQ ID NO: 725845 - DNA, 20 bp, Artificial
  CRISPR gRNA sequence
agacagcctggctcaggccg

SEQ ID NO: 725846 - DNA, 20 bp, Artificial
  CRISPR gRNA sequence
gctcaggccgtgaatttcgg

SEQ ID NO: 725847 - DNA, 20 bp, Artificial
  CRISPR gRNA sequence
aggccgtgaatttcggggct

SEQ ID NO: 725848 - DNA, 20 bp, Artificial
  CRISPR gRNA sequence
cggggcttactgctcacagc

SEQ ID NO: 725849 - DNA, 20 bp, Artificial
  CRISPR gRNA sequence
ggggcttactgctcacagcc

SEQ ID NO: 725850 - DNA, 20 bp, Artificial
  CRISPR gRNA sequence
actgctcacagccggtctcc

SEQ ID NO: 725851 - DNA, 20 bp, Artificial
  CRISPR gRNA sequence
ctgctcacagccggtctcct

SEQ ID NO: 725852 - DNA, 20 bp, Artificial
  CRISPR gRNA sequence
ctcacagccggtctcctgcc

SEQ ID NO: 725853 - DNA, 20 bp, Artificial
  CRISPR gRNA sequence
acagccggtctcctgcctgc

SEQ ID NO: 725854 - DNA, 20 bp, Artificial
  CRISPR gRNA sequence
ctgcctgcagcgtgcatggc

SEQ ID NO: 725855 - DNA, 20 bp, Artificial
  CRISPR gRNA sequence
cctgcagcgtgcatggctgt

SEQ ID NO: 725856 - DNA, 20 bp, Artificial
  CRISPR gRNA sequence
cagcgtgcatggctgtgctg

SEQ ID NO: 725857 - DNA, 20 bp, Artificial
  CRISPR gRNA sequence
tgctgtgagcacatggtggg

SEQ ID NO: 725858 - DNA, 20 bp, Artificial
  CRISPR gRNA sequence
tgagcacatggtgggagctt

SEQ ID NO: 725859 - DNA, 20 bp, Artificial
  CRISPR gRNA sequence
ggacggagggccggtcctcg

SEQ ID NO: 725860 - DNA, 20 bp, Artificial
  CRISPR gRNA sequence
gacggagggccggtcctcgc

SEQ ID NO: 725861 - DNA, 20 bp, Artificial
  CRISPR gRNA sequence
gccacagtctgatgtggggg

SEQ ID NO: 725862 - DNA, 20 bp, Artificial
  CRISPR gRNA sequence
atgtgggggcttctggtgtg

SEQ ID NO: 725863 - DNA, 20 bp, Artificial
  CRISPR gRNA sequence
ctggtgtggccttctgatag

SEQ ID NO: 725864 - DNA, 20 bp, Artificial
  CRISPR gRNA sequence
tggtgtggccttctgataga

SEQ ID NO: 725865 - DNA, 20 bp, Artificial
  CRISPR gRNA sequence
gtgtggccttctgatagagg

SEQ ID NO: 725866 - DNA, 20 bp, Artificial
  CRISPR gRNA sequence
ctgatagaggggacatgggg

SEQ ID NO: 725867 - DNA, 20 bp, Artificial
  CRISPR gRNA sequence
tgatagaggggacatggggg

SEQ ID NO: 725868 - DNA, 20 bp, Artificial
  CRISPR gRNA sequence
atagaggggacatgggggct

SEQ ID NO: 725869 - DNA, 20 bp, Artificial
  CRISPR gRNA sequence
aggttcagtggcccgaggag

SEQ ID NO: 725870 - DNA, 20 bp, Artificial
  CRISPR gRNA sequence
agtggcccgaggagctgggg

SEQ ID NO: 725871 - DNA, 20 bp, Artificial
  CRISPR gRNA sequence
gggagtggggaagcctggcc

SEQ ID NO: 725872 - DNA, 20 bp, Artificial
  CRISPR gRNA sequence
gcctccgcccagctgatggt

SEQ ID NO: 725873 - DNA, 20 bp, Artificial
  CRISPR gRNA sequence
cgcccagctgatggtgtctg

SEQ ID NO: 725874 - DNA, 20 bp, Artificial
  CRISPR gRNA sequence
atggtgtctggctcagggtg

SEQ ID NO: 725875 - DNA, 20 bp, Artificial
  CRISPR gRNA sequence
gctcagggtgggctggctcc

SEQ ID NO: 725876 - DNA, 20 bp, Artificial
  CRISPR gRNA sequence
agggtgggctggctcccagc

SEQ ID NO: 725877 - DNA, 20 bp, Artificial
  CRISPR gRNA sequence
gctcccagctgttctgcgct

SEQ ID NO: 725878 - DNA, 20 bp, Artificial
  CRISPR gRNA sequence
ccagctgttctgcgctggac

SEQ ID NO: 725879 - DNA, 20 bp, Artificial
  CRISPR gRNA sequence
ttctgcgctggactctggag

SEQ ID NO: 725880 - DNA, 20 bp, Artificial
  CRISPR gRNA sequence
tgcgctggactctggaggcc

SEQ ID NO: 725881 - DNA, 20 bp, Artificial
  CRISPR gRNA sequence
cgctggactctggaggccag

SEQ ID NO: 725882 - DNA, 20 bp, Artificial
  CRISPR gRNA sequence
gactctggaggccagaatgg

SEQ ID NO: 725883 - DNA, 20 bp, Artificial
  CRISPR gRNA sequence
tggaggccagaatggggaag

SEQ ID NO: 725884 - DNA, 20 bp, Artificial
  CRISPR gRNA sequence
gaggccagaatggggaagct

SEQ ID NO: 725885 - DNA, 20 bp, Artificial
  CRISPR gRNA sequence
aagagggaacttgagagctg

SEQ ID NO: 725886 - DNA, 20 bp, Artificial
  CRISPR gRNA sequence
gagagctggggtggggtggg

SEQ ID NO: 725887 - DNA, 20 bp, Artificial
  CRISPR gRNA sequence
agagctggggtggggtgggg

SEQ ID NO: 725888 - DNA, 20 bp, Artificial
  CRISPR gRNA sequence
gggtggggtgggggtgcagg

SEQ ID NO: 725889 - DNA, 20 bp, Artificial
  CRISPR gRNA sequence
cctttctgggtaatgcagtt

SEQ ID NO: 725890 - DNA, 20 bp, Artificial
  CRISPR gRNA sequence
tctgggtaatgcagttatac

SEQ ID NO: 725891 - DNA, 20 bp, Artificial
  CRISPR gRNA sequence
ctgggtaatgcagttatacc

SEQ ID NO: 725892 - DNA, 20 bp, Artificial
  CRISPR gRNA sequence
tgggtaatgcagttataccc

SEQ ID NO: 725893 - DNA, 20 bp, Artificial
  CRISPR gRNA sequence
ggtaatgcagttatacccct

SEQ ID NO: 725894 - DNA, 20 bp, Artificial
  CRISPR gRNA sequence
tacccctcggattcaggaac

SEQ ID NO: 725895 - DNA, 20 bp, Artificial
  CRISPR gRNA sequence
ggattcaggaaccccaaaaa

SEQ ID NO: 725896 - DNA, 20 bp, Artificial
  CRISPR gRNA sequence
aggaaccccaaaaaggttct

SEQ ID NO: 725897 - DNA, 20 bp, Artificial
  CRISPR gRNA sequence
tcgagtcccccacaccctca

SEQ ID NO: 725898 - DNA, 20 bp, Artificial
  CRISPR gRNA sequence
gagtcccccacaccctcaac

SEQ ID NO: 725899 - DNA, 20 bp, Artificial
  CRISPR gRNA sequence
aaccctattgcatgacgctg

SEQ ID NO: 725900 - DNA, 20 bp, Artificial
  CRISPR gRNA sequence
ttgcatgacgctggttcttc

SEQ ID NO: 725901 - DNA, 20 bp, Artificial
  CRISPR gRNA sequence
catgacgctggttcttctat

SEQ ID NO: 725902 - DNA, 20 bp, Artificial
  CRISPR gRNA sequence
gttcttctattctggttttg

SEQ ID NO: 725903 - DNA, 20 bp, Artificial
  CRISPR gRNA sequence
ttctattctggttttgaaca

SEQ ID NO: 725904 - DNA, 20 bp, Artificial
  CRISPR gRNA sequence
ctattctggttttgaacacc

SEQ ID NO: 725905 - DNA, 20 bp, Artificial
  CRISPR gRNA sequence
tattctggttttgaacaccc

SEQ ID NO: 725906 - DNA, 20 bp, Artificial
  CRISPR gRNA sequence
ttctggttttgaacaccccc

SEQ ID NO: 725907 - DNA, 20 bp, Artificial
  CRISPR gRNA sequence
tggttttgaacacccccagg

SEQ ID NO: 725908 - DNA, 20 bp, Artificial
  CRISPR gRNA sequence
gttttgaacacccccaggaa

SEQ ID NO: 725909 - DNA, 20 bp, Artificial
  CRISPR gRNA sequence
tgaacacccccaggaaagag

SEQ ID NO: 725910 - DNA, 20 bp, Artificial
  CRISPR gRNA sequence
gaacacccccaggaaagaga

SEQ ID NO: 725911 - DNA, 20 bp, Artificial
  CRISPR gRNA sequence
aacacccccaggaaagagag

SEQ ID NO: 725912 - DNA, 20 bp, Artificial
  CRISPR gRNA sequence
tgggctgggcgcccccacag

SEQ ID NO: 725913 - DNA, 20 bp, Artificial
  CRISPR gRNA sequence
ggcgcccccacagaccccaa

SEQ ID NO: 725914 - DNA, 20 bp, Artificial
  CRISPR gRNA sequence
agcactccccacacctccat

SEQ ID NO: 725915 - DNA, 20 bp, Artificial
  CRISPR gRNA sequence
cccacacctccatcaggctt

SEQ ID NO: 725916 - DNA, 20 bp, Artificial
  CRISPR gRNA sequence
catcaggcttgtgggctccc

SEQ ID NO: 725917 - DNA, 20 bp, Artificial
  CRISPR gRNA sequence
gtgggctcccagccctagga

SEQ ID NO: 725918 - DNA, 20 bp, Artificial
  CRISPR gRNA sequence
tgggctcccagccctaggag

SEQ ID NO: 725919 - DNA, 20 bp, Artificial
  CRISPR gRNA sequence
ccagccctaggagccctata

SEQ ID NO: 725920 - DNA, 20 bp, Artificial
  CRISPR gRNA sequence
ggagccctatagagggctgg

SEQ ID NO: 725921 - DNA, 20 bp, Artificial
  CRISPR gRNA sequence
tagagggctgggcaaaagat

SEQ ID NO: 725922 - DNA, 20 bp, Artificial
  CRISPR gRNA sequence
ggcaaaagatgggggccggg

SEQ ID NO: 725923 - DNA, 20 bp, Artificial
  CRISPR gRNA sequence
gattagggagaaggagccac

SEQ ID NO: 725924 - DNA, 20 bp, Artificial
  CRISPR gRNA sequence
gggagaaggagccacagctg

SEQ ID NO: 725925 - DNA, 20 bp, Artificial
  CRISPR gRNA sequence
gggacaggctggtcccctca

SEQ ID NO: 725926 - DNA, 20 bp, Artificial
  CRISPR gRNA sequence
gtcccctcacattcctcagg

SEQ ID NO: 725927 - DNA, 20 bp, Artificial
  CRISPR gRNA sequence
acattcctcagggaaatggg

SEQ ID NO: 725928 - DNA, 20 bp, Artificial
  CRISPR gRNA sequence
ctcagggaaatgggcaggag

SEQ ID NO: 725929 - DNA, 20 bp, Artificial
  CRISPR gRNA sequence
agggaaatgggcaggagtcc

SEQ ID NO: 725930 - DNA, 20 bp, Artificial
  CRISPR gRNA sequence
gaattaactggattcaaagc

SEQ ID NO: 725931 - DNA, 20 bp, Artificial
  CRISPR gRNA sequence
actggattcaaagcggtgga

SEQ ID NO: 725932 - DNA, 20 bp, Artificial
  CRISPR gRNA sequence
gattcaaagcggtggaattg

SEQ ID NO: 725933 - DNA, 20 bp, Artificial
  CRISPR gRNA sequence
aaagcggtggaattggctgc

SEQ ID NO: 725934 - DNA, 20 bp, Artificial
  CRISPR gRNA sequence
gctgctctgggtgaggaagc

SEQ ID NO: 725935 - DNA, 20 bp, Artificial
  CRISPR gRNA sequence
ctctgggtgaggaagcagct

SEQ ID NO: 725936 - DNA, 20 bp, Artificial
  CRISPR gRNA sequence
tgggtgaggaagcagctccc

SEQ ID NO: 725937 - DNA, 20 bp, Artificial
  CRISPR gRNA sequence
ggtgaggaagcagctcccac

SEQ ID NO: 725938 - DNA, 20 bp, Artificial
  CRISPR gRNA sequence
ccactgagctcggaagtgaa

SEQ ID NO: 725939 - DNA, 20 bp, Artificial
  CRISPR gRNA sequence
agctcggaagtgaaagaggg

SEQ ID NO: 725940 - DNA, 20 bp, Artificial
  CRISPR gRNA sequence
ggaagtgaaagaggggtctg

SEQ ID NO: 725941 - DNA, 20 bp, Artificial
  CRISPR gRNA sequence
gaaacttcagagccggccat

SEQ ID NO: 725942 - DNA, 20 bp, Artificial
  CRISPR gRNA sequence
cagagccggccatgaggggt

SEQ ID NO: 725943 - DNA, 20 bp, Artificial
  CRISPR gRNA sequence
agagccggccatgaggggtc

SEQ ID NO: 725944 - DNA, 20 bp, Artificial
  CRISPR gRNA sequence
ccccgctctggctctgcccc

SEQ ID NO: 725945 - DNA, 20 bp, Artificial
  CRISPR gRNA sequence
tggctctgcccccatcacag

SEQ ID NO: 725946 - DNA, 20 bp, Artificial
  CRISPR gRNA sequence
gctctgcccccatcacaggc

SEQ ID NO: 725947 - DNA, 20 bp, Artificial
  CRISPR gRNA sequence
tgcccccatcacaggctgcc

SEQ ID NO: 725948 - DNA, 20 bp, Artificial
  CRISPR gRNA sequence
cccccatcacaggctgccta

SEQ ID NO: 725949 - DNA, 20 bp, Artificial
  CRISPR gRNA sequence
cctactccccaggctgtggg

SEQ ID NO: 725950 - DNA, 20 bp, Artificial
  CRISPR gRNA sequence
ctccccaggctgtgggggtg

SEQ ID NO: 725951 - DNA, 20 bp, Artificial
  CRISPR gRNA sequence
cccaggctgtgggggtggct

SEQ ID NO: 725952 - DNA, 20 bp, Artificial
  CRISPR gRNA sequence
tgggggtggcttccaagggc

SEQ ID NO: 725953 - DNA, 20 bp, Artificial
  CRISPR gRNA sequence
ccaagggctgcatggatttc

SEQ ID NO: 725954 - DNA, 20 bp, Artificial
  CRISPR gRNA sequence
caagggctgcatggatttcc

SEQ ID NO: 725955 - DNA, 20 bp, Artificial
  CRISPR gRNA sequence
catggatttcctgccccctc

SEQ ID NO: 725956 - DNA, 20 bp, Artificial
  CRISPR gRNA sequence
cctgccccctccccagagct

SEQ ID NO: 725957 - DNA, 20 bp, Artificial
  CRISPR gRNA sequence
ctgccccctccccagagctc

SEQ ID NO: 725958 - DNA, 20 bp, Artificial
  CRISPR gRNA sequence
ccccctccccagagctccag

SEQ ID NO: 725959 - DNA, 20 bp, Artificial
  CRISPR gRNA sequence
cccagagctccagagtccag

SEQ ID NO: 725960 - DNA, 20 bp, Artificial
  CRISPR gRNA sequence
cagagtccagggaattcatc

SEQ ID NO: 725961 - DNA, 20 bp, Artificial
  CRISPR gRNA sequence
atcttggctatgtggggagg

SEQ ID NO: 725962 - DNA, 20 bp, Artificial
  CRISPR gRNA sequence
ggctatgtggggagggcagg

SEQ ID NO: 725963 - DNA, 20 bp, Artificial
  CRISPR gRNA sequence
gctatgtggggagggcaggt

SEQ ID NO: 725964 - DNA, 20 bp, Artificial
  CRISPR gRNA sequence
tgtggggagggcaggtgagg

SEQ ID NO: 725965 - DNA, 20 bp, Artificial
  CRISPR gRNA sequence
gggggaaaggggttcttccc

SEQ ID NO: 725966 - DNA, 20 bp, Artificial
  CRISPR gRNA sequence
ttcccttgcctggttcccag

SEQ ID NO: 725967 - DNA, 20 bp, Artificial
  CRISPR gRNA sequence
cccttgcctggttcccaggg

SEQ ID NO: 725968 - DNA, 20 bp, Artificial
  CRISPR gRNA sequence
ccttgcctggttcccagggg

SEQ ID NO: 725969 - DNA, 20 bp, Artificial
  CRISPR gRNA sequence
gcctggttcccaggggaaga

SEQ ID NO: 725970 - DNA, 20 bp, Artificial
  CRISPR gRNA sequence
cctggttcccaggggaagag

SEQ ID NO: 725971 - DNA, 20 bp, Artificial
  CRISPR gRNA sequence
gttcccaggggaagagggac

SEQ ID NO: 725972 - DNA, 20 bp, Artificial
  CRISPR gRNA sequence
ccaggggaagagggacgatg

SEQ ID NO: 725973 - DNA, 20 bp, Artificial
  CRISPR gRNA sequence
ttgggaactggatgggaagg

SEQ ID NO: 725974 - DNA, 20 bp, Artificial
  CRISPR gRNA sequence
gggaactggatgggaagggg

SEQ ID NO: 725975 - DNA, 20 bp, Artificial
  CRISPR gRNA sequence
ggaactggatgggaaggggg

SEQ ID NO: 725976 - DNA, 20 bp, Artificial
  CRISPR gRNA sequence
gatgggaagggggaacgcta

SEQ ID NO: 725977 - DNA, 20 bp, Artificial
  CRISPR gRNA sequence
ccctgggctggcattaggag

SEQ ID NO: 725978 - DNA, 20 bp, Artificial
  CRISPR gRNA sequence
ggctggcattaggaggacaa

SEQ ID NO: 725979 - DNA, 20 bp, Artificial
  CRISPR gRNA sequence
gcattaggaggacaaggggg

SEQ ID NO: 725980 - DNA, 20 bp, Artificial
  CRISPR gRNA sequence
ggaggacaagggggttgcct

SEQ ID NO: 725981 - DNA, 20 bp, Artificial
  CRISPR gRNA sequence
cctgtgtcttgggtgcccaa

SEQ ID NO: 725982 - DNA, 20 bp, Artificial
  CRISPR gRNA sequence
tgtcttgggtgcccaagaga

SEQ ID NO: 725983 - DNA, 20 bp, Artificial
  CRISPR gRNA sequence
gggtgcccaagagaacctcc

SEQ ID NO: 725984 - DNA, 20 bp, Artificial
  CRISPR gRNA sequence
ggtgcccaagagaacctcca

SEQ ID NO: 725985 - DNA, 20 bp, Artificial
  CRISPR gRNA sequence
caaggccttccctttccacc

SEQ ID NO: 725986 - DNA, 20 bp, Artificial
  CRISPR gRNA sequence
ccctttccaccatggcggag

SEQ ID NO: 725987 - DNA, 20 bp, Artificial
  CRISPR gRNA sequence
cctttccaccatggcggagg

SEQ ID NO: 725988 - DNA, 20 bp, Artificial
  CRISPR gRNA sequence
tccaccatggcggaggtggc

SEQ ID NO: 725989 - DNA, 20 bp, Artificial
  CRISPR gRNA sequence
ccaccatggcggaggtggcc

SEQ ID NO: 725990 - DNA, 20 bp, Artificial
  CRISPR gRNA sequence
caccatggcggaggtggccc

SEQ ID NO: 725991 - DNA, 20 bp, Artificial
  CRISPR gRNA sequence
accagcaaggcctgcaggcc

SEQ ID NO: 725992 - DNA, 20 bp, Artificial
  CRISPR gRNA sequence
caggccatgccaggggaggg

SEQ ID NO: 725993 - DNA, 20 bp, Artificial
  CRISPR gRNA sequence
agccagctgcctgggagcct

SEQ ID NO: 725994 - DNA, 20 bp, Artificial
  CRISPR gRNA sequence
cctgggagcctggtacttcc

SEQ ID NO: 725995 - DNA, 20 bp, Artificial
  CRISPR gRNA sequence
ggagcctggtacttccttct

SEQ ID NO: 725996 - DNA, 20 bp, Artificial
  CRISPR gRNA sequence
gtacttccttctcctcccca

SEQ ID NO: 725997 - DNA, 20 bp, Artificial
  CRISPR gRNA sequence
ccttctcctccccatcaaac

SEQ ID NO: 725998 - DNA, 20 bp, Artificial
  CRISPR gRNA sequence
cttctcctccccatcaaaca

SEQ ID NO: 725999 - DNA, 20 bp, Artificial
  CRISPR gRNA sequence
ctcctccccatcaaacaccc

SEQ ID NO: 726000 - DNA, 20 bp, Artificial
  CRISPR gRNA sequence
tcctccccatcaaacaccct

SEQ ID NO: 726001 - DNA, 20 bp, Artificial
  CRISPR gRNA sequence
ctccccatcaaacaccctct

SEQ ID NO: 726002 - DNA, 20 bp, Artificial
  CRISPR gRNA sequence
cccatcaaacaccctctgaa

SEQ ID NO: 726003 - DNA, 20 bp, Artificial
  CRISPR gRNA sequence
tgaaccccacccctgggatt

SEQ ID NO: 726004 - DNA, 20 bp, Artificial
  CRISPR gRNA sequence
aaccccacccctgggattcc

SEQ ID NO: 726005 - DNA, 20 bp, Artificial
  CRISPR gRNA sequence
ggattccaggcactgtactc

SEQ ID NO: 726006 - DNA, 20 bp, Artificial
  CRISPR gRNA sequence
caggcactgtactcagtgtg

SEQ ID NO: 726007 - DNA, 20 bp, Artificial
  CRISPR gRNA sequence
tactcagtgtggactcagaa

SEQ ID NO: 726008 - DNA, 20 bp, Artificial
  CRISPR gRNA sequence
agtgtggactcagaagttcc

SEQ ID NO: 726009 - DNA, 20 bp, Artificial
  CRISPR gRNA sequence
agaagttccagttaggactt

SEQ ID NO: 726010 - DNA, 20 bp, Artificial
  CRISPR gRNA sequence
cagttaggacttcttaggaa

SEQ ID NO: 726011 - DNA, 20 bp, Artificial
  CRISPR gRNA sequence
ggacttcttaggaattctga

SEQ ID NO: 726012 - DNA, 20 bp, Artificial
  CRISPR gRNA sequence
cttaggaattctgaagaagc

SEQ ID NO: 726013 - DNA, 20 bp, Artificial
  CRISPR gRNA sequence
ttaggaattctgaagaagcc

SEQ ID NO: 726014 - DNA, 20 bp, Artificial
  CRISPR gRNA sequence
aggaattctgaagaagcctt

SEQ ID NO: 726015 - DNA, 20 bp, Artificial
  CRISPR gRNA sequence
ggaattctgaagaagccttt

SEQ ID NO: 726016 - DNA, 20 bp, Artificial
  CRISPR gRNA sequence
tgaagaagcctttgatggta

SEQ ID NO: 726017 - DNA, 20 bp, Artificial
  CRISPR gRNA sequence
aagaagcctttgatggtatt

SEQ ID NO: 726018 - DNA, 20 bp, Artificial
  CRISPR gRNA sequence
tgatggtatttcccaaaata

SEQ ID NO: 726019 - DNA, 20 bp, Artificial
  CRISPR gRNA sequence
gatggtatttcccaaaatac

SEQ ID NO: 726020 - DNA, 20 bp, Artificial
  CRISPR gRNA sequence
atggtatttcccaaaataca

SEQ ID NO: 726021 - DNA, 20 bp, Artificial
  CRISPR gRNA sequence
cccaaaatacatacttttca

SEQ ID NO: 726022 - DNA, 20 bp, Artificial
  CRISPR gRNA sequence
ccaaaatacatacttttcaa

SEQ ID NO: 726023 - DNA, 20 bp, Artificial
  CRISPR gRNA sequence
ttcaaataaaacttactaaa

SEQ ID NO: 726024 - DNA, 20 bp, Artificial
  CRISPR gRNA sequence
tcaaataaaacttactaaaa

SEQ ID NO: 726025 - DNA, 20 bp, Artificial
  CRISPR gRNA sequence
caaataaaacttactaaaag

SEQ ID NO: 726026 - DNA, 20 bp, Artificial
  CRISPR gRNA sequence
aaataaaacttactaaaagc

SEQ ID NO: 726027 - DNA, 20 bp, Artificial
  CRISPR gRNA sequence
actaaaagctaccatttcaa

SEQ ID NO: 726028 - DNA, 20 bp, Artificial
  CRISPR gRNA sequence
ctaaaagctaccatttcaaa

SEQ ID NO: 726029 - DNA, 20 bp, Artificial
  CRISPR gRNA sequence
aaagctaccatttcaaaagc

SEQ ID NO: 726030 - DNA, 20 bp, Artificial
  CRISPR gRNA sequence
ccatttcaaaagcttcagtt

SEQ ID NO: 726031 - DNA, 20 bp, Artificial
  CRISPR gRNA sequence
caaaagcttcagtttgttac

SEQ ID NO: 726032 - DNA, 20 bp, Artificial
  CRISPR gRNA sequence
aaaagcttcagtttgttaca

SEQ ID NO: 726033 - DNA, 20 bp, Artificial
  CRISPR gRNA sequence
cagtttgttacaaaagactg

SEQ ID NO: 726034 - DNA, 20 bp, Artificial
  CRISPR gRNA sequence
agtttgttacaaaagactgc

SEQ ID NO: 726035 - DNA, 20 bp, Artificial
  CRISPR gRNA sequence
gttacaaaagactgcccagg

SEQ ID NO: 726036 - DNA, 20 bp, Artificial
  CRISPR gRNA sequence
ttacaaaagactgcccaggc

SEQ ID NO: 726037 - DNA, 20 bp, Artificial
  CRISPR gRNA sequence
caaaagactgcccaggctgg

SEQ ID NO: 726038 - DNA, 20 bp, Artificial
  CRISPR gRNA sequence
cccaggctgggcatggtggc

SEQ ID NO: 726039 - DNA, 20 bp, Artificial
  CRISPR gRNA sequence
ggcatggtggctcatgccta

SEQ ID NO: 726040 - DNA, 20 bp, Artificial
  CRISPR gRNA sequence
atgcctataatcccagtact

SEQ ID NO: 726041 - DNA, 20 bp, Artificial
  CRISPR gRNA sequence
taatcccagtactttgggag

SEQ ID NO: 726042 - DNA, 20 bp, Artificial
  CRISPR gRNA sequence
tgggaggccaaggcaggcag

SEQ ID NO: 726043 - DNA, 20 bp, Artificial
  CRISPR gRNA sequence
gggaggccaaggcaggcaga

SEQ ID NO: 726044 - DNA, 20 bp, Artificial
  CRISPR gRNA sequence
ggaggccaaggcaggcagat

SEQ ID NO: 726045 - DNA, 20 bp, Artificial
  CRISPR gRNA sequence
gaggccaggagttccagacc

SEQ ID NO: 726046 - DNA, 20 bp, Artificial
  CRISPR gRNA sequence
aggccaggagttccagacca

SEQ ID NO: 726047 - DNA, 20 bp, Artificial
  CRISPR gRNA sequence
cagaccagcctggccaacag

SEQ ID NO: 726048 - DNA, 20 bp, Artificial
  CRISPR gRNA sequence
gccaacagagtgaaacccca

SEQ ID NO: 726049 - DNA, 20 bp, Artificial
  CRISPR gRNA sequence
tactaaaaatacaaaaaatt

SEQ ID NO: 726050 - DNA, 20 bp, Artificial
  CRISPR gRNA sequence
ctaaaaatacaaaaaattag

SEQ ID NO: 726051 - DNA, 20 bp, Artificial
  CRISPR gRNA sequence
aaaatacaaaaaattagcca

SEQ ID NO: 726052 - DNA, 20 bp, Artificial
  CRISPR gRNA sequence
gccaggcatgatgacactcg

SEQ ID NO: 726053 - DNA, 20 bp, Artificial
  CRISPR gRNA sequence
gcccataatcccagctactc

SEQ ID NO: 726054 - DNA, 20 bp, Artificial
  CRISPR gRNA sequence
ctcaggaggctgaaaaaata

SEQ ID NO: 726055 - DNA, 20 bp, Artificial
  CRISPR gRNA sequence
aggaggctgaaaaaataaaa

SEQ ID NO: 726056 - DNA, 20 bp, Artificial
  CRISPR gRNA sequence
aaaaaataaaaagagaagat

SEQ ID NO: 726057 - DNA, 20 bp, Artificial
  CRISPR gRNA sequence
ccctgaagagttctggccac

SEQ ID NO: 726058 - DNA, 20 bp, Artificial
  CRISPR gRNA sequence
aagagttctggccaccactg

SEQ ID NO: 726059 - DNA, 20 bp, Artificial
  CRISPR gRNA sequence
tggccaccactgtctgccat

SEQ ID NO: 726060 - DNA, 20 bp, Artificial
  CRISPR gRNA sequence
gccaccactgtctgccatag

SEQ ID NO: 726061 - DNA, 20 bp, Artificial
  CRISPR gRNA sequence
tctgccatagaaatgcacag

SEQ ID NO: 726062 - DNA, 20 bp, Artificial
  CRISPR gRNA sequence
ccatagaaatgcacaggaca

SEQ ID NO: 726063 - DNA, 20 bp, Artificial
  CRISPR gRNA sequence
caaatgactcttcagtatta

SEQ ID NO: 726064 - DNA, 20 bp, Artificial
  CRISPR gRNA sequence
ttcagtattatcccagtgcc

SEQ ID NO: 726065 - DNA, 20 bp, Artificial
  CRISPR gRNA sequence
cagtattatcccagtgccag

SEQ ID NO: 726066 - DNA, 20 bp, Artificial
  CRISPR gRNA sequence
agtattatcccagtgccagt

SEQ ID NO: 726067 - DNA, 20 bp, Artificial
  CRISPR gRNA sequence
tcccagtgccagttaccctt

SEQ ID NO: 726068 - DNA, 20 bp, Artificial
  CRISPR gRNA sequence
cccttccagaagcgacagag

SEQ ID NO: 726069 - DNA, 20 bp, Artificial
  CRISPR gRNA sequence
ccagaagcgacagaggtggg

SEQ ID NO: 726070 - DNA, 20 bp, Artificial
  CRISPR gRNA sequence
cagaagcgacagaggtgggg

SEQ ID NO: 726071 - DNA, 20 bp, Artificial
  CRISPR gRNA sequence
cccacagggagcacaaagcc

SEQ ID NO: 726072 - DNA, 20 bp, Artificial
  CRISPR gRNA sequence
taaacacgcagtcacaccac

SEQ ID NO: 726073 - DNA, 20 bp, Artificial
  CRISPR gRNA sequence
ggtgctaggacaccgggtag

SEQ ID NO: 726074 - DNA, 20 bp, Artificial
  CRISPR gRNA sequence
ggacaccgggtaggggaggc

SEQ ID NO: 726075 - DNA, 20 bp, Artificial
  CRISPR gRNA sequence
ggttcttagggagcatagca

SEQ ID NO: 726076 - DNA, 20 bp, Artificial
  CRISPR gRNA sequence
ttagggagcatagcatggtg

SEQ ID NO: 726077 - DNA, 20 bp, Artificial
  CRISPR gRNA sequence
agggagcatagcatggtgga

SEQ ID NO: 726078 - DNA, 20 bp, Artificial
  CRISPR gRNA sequence
gggagcatagcatggtggag

SEQ ID NO: 726079 - DNA, 20 bp, Artificial
  CRISPR gRNA sequence
cctggaggaaggggcaaata

SEQ ID NO: 726080 - DNA, 20 bp, Artificial
  CRISPR gRNA sequence
ctggaggaaggggcaaataa

SEQ ID NO: 726081 - DNA, 20 bp, Artificial
  CRISPR gRNA sequence
gaggaaggggcaaataagca

SEQ ID NO: 726082 - DNA, 20 bp, Artificial
  CRISPR gRNA sequence
actggattcaaggcagtgga

SEQ ID NO: 726083 - DNA, 20 bp, Artificial
  CRISPR gRNA sequence
gattcaaggcagtggagttg

SEQ ID NO: 726084 - DNA, 20 bp, Artificial
  CRISPR gRNA sequence
aaggcagtggagttggctat

SEQ ID NO: 726085 - DNA, 20 bp, Artificial
  CRISPR gRNA sequence
gctatttcaggcgagggggt

SEQ ID NO: 726086 - DNA, 20 bp, Artificial
  CRISPR gRNA sequence
tttcaggcgagggggtagct

SEQ ID NO: 726087 - DNA, 20 bp, Artificial
  CRISPR gRNA sequence
caggcgagggggtagctccc

SEQ ID NO: 726088 - DNA, 20 bp, Artificial
  CRISPR gRNA sequence
aggcgagggggtagctccca

SEQ ID NO: 726089 - DNA, 20 bp, Artificial
  CRISPR gRNA sequence
ccattgagaagctcagaagt

SEQ ID NO: 726090 - DNA, 20 bp, Artificial
  CRISPR gRNA sequence
agaagctcagaagtgacaga

SEQ ID NO: 726091 - DNA, 20 bp, Artificial
  CRISPR gRNA sequence
agaagtgacagaggggtctg

SEQ ID NO: 726092 - DNA, 20 bp, Artificial
  CRISPR gRNA sequence
taaatttgggagactgccat

SEQ ID NO: 726093 - DNA, 20 bp, Artificial
  CRISPR gRNA sequence
gggagactgccatgaggggg

SEQ ID NO: 726094 - DNA, 20 bp, Artificial
  CRISPR gRNA sequence
ggagactgccatgaggggga

SEQ ID NO: 726095 - DNA, 20 bp, Artificial
  CRISPR gRNA sequence
ccatgagggggagggacaga

SEQ ID NO: 726096 - DNA, 20 bp, Artificial
  CRISPR gRNA sequence
tggggtcagaaggtaggtga

SEQ ID NO: 726097 - DNA, 20 bp, Artificial
  CRISPR gRNA sequence
gtcggggagctacaacttgc

SEQ ID NO: 726098 - DNA, 20 bp, Artificial
  CRISPR gRNA sequence
caacttgctgtcagccttga

SEQ ID NO: 726099 - DNA, 20 bp, Artificial
  CRISPR gRNA sequence
gctgtcagccttgagtgctg

SEQ ID NO: 726100 - DNA, 20 bp, Artificial
  CRISPR gRNA sequence
ctgtcagccttgagtgctgg

SEQ ID NO: 726101 - DNA, 20 bp, Artificial
  CRISPR gRNA sequence
tcagccttgagtgctggaat

SEQ ID NO: 726102 - DNA, 20 bp, Artificial
  CRISPR gRNA sequence
gagtgctggaataagaatgc

SEQ ID NO: 726103 - DNA, 20 bp, Artificial
  CRISPR gRNA sequence
agtgctggaataagaatgct

SEQ ID NO: 726104 - DNA, 20 bp, Artificial
  CRISPR gRNA sequence
gaataagaatgctggaattc

SEQ ID NO: 726105 - DNA, 20 bp, Artificial
  CRISPR gRNA sequence
gaattcatcccatagggaat

SEQ ID NO: 726106 - DNA, 20 bp, Artificial
  CRISPR gRNA sequence
atcccatagggaatgggaag

SEQ ID NO: 726107 - DNA, 20 bp, Artificial
  CRISPR gRNA sequence
ctggaggcttctcggcagga

SEQ ID NO: 726108 - DNA, 20 bp, Artificial
  CRISPR gRNA sequence
gaggcttctcggcaggagtg

SEQ ID NO: 726109 - DNA, 20 bp, Artificial
  CRISPR gRNA sequence
ctcggcaggagtgcaatagg

SEQ ID NO: 726110 - DNA, 20 bp, Artificial
  CRISPR gRNA sequence
tcggcaggagtgcaataggg

SEQ ID NO: 726111 - DNA, 20 bp, Artificial
  CRISPR gRNA sequence
ggcaggagtgcaatagggtc

SEQ ID NO: 726112 - DNA, 20 bp, Artificial
  CRISPR gRNA sequence
tggggaaaatgccgtaccaa

SEQ ID NO: 726113 - DNA, 20 bp, Artificial
  CRISPR gRNA sequence
ggggaaaatgccgtaccaag

SEQ ID NO: 726114 - DNA, 20 bp, Artificial
  CRISPR gRNA sequence
gggaaaatgccgtaccaagg

SEQ ID NO: 726115 - DNA, 20 bp, Artificial
  CRISPR gRNA sequence
tccaggctggcagcagctgc

SEQ ID NO: 726116 - DNA, 20 bp, Artificial
  CRISPR gRNA sequence
gcagcagctgccgttgggaa

SEQ ID NO: 726117 - DNA, 20 bp, Artificial
  CRISPR gRNA sequence
ccgttgggaagctctgaaca

SEQ ID NO: 726118 - DNA, 20 bp, Artificial
  CRISPR gRNA sequence
ggaagctctgaacatctggg

SEQ ID NO: 726119 - DNA, 20 bp, Artificial
  CRISPR gRNA sequence
tgaacatctgggccccatct

SEQ ID NO: 726120 - DNA, 20 bp, Artificial
  CRISPR gRNA sequence
aacatctgggccccatctgt

SEQ ID NO: 726121 - DNA, 20 bp, Artificial
  CRISPR gRNA sequence
ggccccatctgtcctcctgc

SEQ ID NO: 726122 - DNA, 20 bp, Artificial
  CRISPR gRNA sequence
tcctcctgcttctgcagagg

SEQ ID NO: 726123 - DNA, 20 bp, Artificial
  CRISPR gRNA sequence
ctgcttctgcagagggtggg

SEQ ID NO: 726124 - DNA, 20 bp, Artificial
  CRISPR gRNA sequence
cttctgcagagggtgggtgg

SEQ ID NO: 726125 - DNA, 20 bp, Artificial
  CRISPR gRNA sequence
ctgcagagggtgggtggtaa

SEQ ID NO: 726126 - DNA, 20 bp, Artificial
  CRISPR gRNA sequence
tgcagagggtgggtggtaac

SEQ ID NO: 726127 - DNA, 20 bp, Artificial
  CRISPR gRNA sequence
cagagggtgggtggtaacgt

SEQ ID NO: 726128 - DNA, 20 bp, Artificial
  CRISPR gRNA sequence
caaggcccagcagatgcggg

SEQ ID NO: 726129 - DNA, 20 bp, Artificial
  CRISPR gRNA sequence
aaggcccagcagatgcggga

SEQ ID NO: 726130 - DNA, 20 bp, Artificial
  CRISPR gRNA sequence
cagctgtgccacttagtagc

SEQ ID NO: 726131 - DNA, 20 bp, Artificial
  CRISPR gRNA sequence
tgccacttagtagccatgca

SEQ ID NO: 726132 - DNA, 20 bp, Artificial
  CRISPR gRNA sequence
agtagccatgcaatggggaa

SEQ ID NO: 726133 - DNA, 20 bp, Artificial
  CRISPR gRNA sequence
gtagccatgcaatggggaaa

SEQ ID NO: 726134 - DNA, 20 bp, Artificial
  CRISPR gRNA sequence
caccctctgagccacggtct

SEQ ID NO: 726135 - DNA, 20 bp, Artificial
  CRISPR gRNA sequence
accctctgagccacggtctc

SEQ ID NO: 726136 - DNA, 20 bp, Artificial
  CRISPR gRNA sequence
tgagccacggtctccccaac

SEQ ID NO: 726137 - DNA, 20 bp, Artificial
  CRISPR gRNA sequence
agccacggtctccccaactg

SEQ ID NO: 726138 - DNA, 20 bp, Artificial
  CRISPR gRNA sequence
cccaactgtaaaatggggag

SEQ ID NO: 726139 - DNA, 20 bp, Artificial
  CRISPR gRNA sequence
taaaatggggagaaagacac

SEQ ID NO: 726140 - DNA, 20 bp, Artificial
  CRISPR gRNA sequence
cacagtgcccggaatgcgcc

SEQ ID NO: 726141 - DNA, 20 bp, Artificial
  CRISPR gRNA sequence
tgaccactggcacgtcttcc

SEQ ID NO: 726142 - DNA, 20 bp, Artificial
  CRISPR gRNA sequence
gcacgtcttcctcctgtccc

SEQ ID NO: 726143 - DNA, 20 bp, Artificial
  CRISPR gRNA sequence
cctcctgtcccctcgggtgc

SEQ ID NO: 726144 - DNA, 20 bp, Artificial
  CRISPR gRNA sequence
ctcctgtcccctcgggtgct

SEQ ID NO: 726145 - DNA, 20 bp, Artificial
  CRISPR gRNA sequence
ctgtcccctcgggtgctcgg

SEQ ID NO: 726146 - DNA, 20 bp, Artificial
  CRISPR gRNA sequence
tcccctcgggtgctcggtgt

SEQ ID NO: 726147 - DNA, 20 bp, Artificial
  CRISPR gRNA sequence
gggtgctcggtgttgggggc

SEQ ID NO: 726148 - DNA, 20 bp, Artificial
  CRISPR gRNA sequence
ggtgttgggggctggggtgg

SEQ ID NO: 726149 - DNA, 20 bp, Artificial
  CRISPR gRNA sequence
ggggctggggtggtgttcgt

SEQ ID NO: 726150 - DNA, 20 bp, Artificial
  CRISPR gRNA sequence
gggtggtgttcgttttttat

SEQ ID NO: 726151 - DNA, 20 bp, Artificial
  CRISPR gRNA sequence
gttttttatgagtaacagca

SEQ ID NO: 726152 - DNA, 20 bp, Artificial
  CRISPR gRNA sequence
tttatgagtaacagcaggca

SEQ ID NO: 726153 - DNA, 20 bp, Artificial
  CRISPR gRNA sequence
ttatgagtaacagcaggcat

SEQ ID NO: 726154 - DNA, 20 bp, Artificial
  CRISPR gRNA sequence
tatgagtaacagcaggcatc

SEQ ID NO: 726155 - DNA, 20 bp, Artificial
  CRISPR gRNA sequence
atgagtaacagcaggcatct

SEQ ID NO: 726156 - DNA, 20 bp, Artificial
  CRISPR gRNA sequence
tgagtaacagcaggcatctc

SEQ ID NO: 726157 - DNA, 20 bp, Artificial
  CRISPR gRNA sequence
atgcacactggctcatgaat

SEQ ID NO: 726158 - DNA, 20 bp, Artificial
  CRISPR gRNA sequence
gctcatgaatccgcacaatg

SEQ ID NO: 726159 - DNA, 20 bp, Artificial
  CRISPR gRNA sequence
atgaatccgcacaatggcct

SEQ ID NO: 726160 - DNA, 20 bp, Artificial
  CRISPR gRNA sequence
cgaggtaagtaccctcgctg

SEQ ID NO: 726161 - DNA, 20 bp, Artificial
  CRISPR gRNA sequence
gctgtccctacttacagaaa

SEQ ID NO: 726162 - DNA, 20 bp, Artificial
  CRISPR gRNA sequence
tccctacttacagaaacttc

SEQ ID NO: 726163 - DNA, 20 bp, Artificial
  CRISPR gRNA sequence
cttacagaaacttcaattgg

SEQ ID NO: 726164 - DNA, 20 bp, Artificial
  CRISPR gRNA sequence
acagaaacttcaattggggt

SEQ ID NO: 726165 - DNA, 20 bp, Artificial
  CRISPR gRNA sequence
cagaaacttcaattggggtg

SEQ ID NO: 726166 - DNA, 20 bp, Artificial
  CRISPR gRNA sequence
caattggggtgaagaatcta

SEQ ID NO: 726167 - DNA, 20 bp, Artificial
  CRISPR gRNA sequence
aattggggtgaagaatctat

SEQ ID NO: 726168 - DNA, 20 bp, Artificial
  CRISPR gRNA sequence
gggtgaagaatctatgcctc

SEQ ID NO: 726169 - DNA, 20 bp, Artificial
  CRISPR gRNA sequence
tgcctctcctttcctgggcc

SEQ ID NO: 726170 - DNA, 20 bp, Artificial
  CRISPR gRNA sequence
tcctttcctgggcctttcaa

SEQ ID NO: 726171 - DNA, 20 bp, Artificial
  CRISPR gRNA sequence
ctttcctgggcctttcaact

SEQ ID NO: 726172 - DNA, 20 bp, Artificial
  CRISPR gRNA sequence
tcctgggcctttcaactcca

SEQ ID NO: 726173 - DNA, 20 bp, Artificial
  CRISPR gRNA sequence
cctgggcctttcaactccag

SEQ ID NO: 726174 - DNA, 20 bp, Artificial
  CRISPR gRNA sequence
ctgggcctttcaactccagg

SEQ ID NO: 726175 - DNA, 20 bp, Artificial
  CRISPR gRNA sequence
ggcctttcaactccagggtc

SEQ ID NO: 726176 - DNA, 20 bp, Artificial
  CRISPR gRNA sequence
tcaactccagggtctccagg

SEQ ID NO: 726177 - DNA, 20 bp, Artificial
  CRISPR gRNA sequence
caactccagggtctccaggt

SEQ ID NO: 726178 - DNA, 20 bp, Artificial
  CRISPR gRNA sequence
aactccagggtctccaggtc

SEQ ID NO: 726179 - DNA, 20 bp, Artificial
  CRISPR gRNA sequence
cagggtctccaggtcccttc

SEQ ID NO: 726180 - DNA, 20 bp, Artificial
  CRISPR gRNA sequence
caggtcccttccagggccca

SEQ ID NO: 726181 - DNA, 20 bp, Artificial
  CRISPR gRNA sequence
ccagggcccagggccccgta

SEQ ID NO: 726182 - DNA, 20 bp, Artificial
  CRISPR gRNA sequence
cagggcccagggccccgtat

SEQ ID NO: 726183 - DNA, 20 bp, Artificial
  CRISPR gRNA sequence
atctcccatctgcccctggg

SEQ ID NO: 726184 - DNA, 20 bp, Artificial
  CRISPR gRNA sequence
ccatctgcccctgggctgca

SEQ ID NO: 726185 - DNA, 20 bp, Artificial
  CRISPR gRNA sequence
cccctgggctgcaggggacc

SEQ ID NO: 726186 - DNA, 20 bp, Artificial
  CRISPR gRNA sequence
ggctgcaggggacctcccaa

SEQ ID NO: 726187 - DNA, 20 bp, Artificial
  CRISPR gRNA sequence
caggggacctcccaaaacag

SEQ ID NO: 726188 - DNA, 20 bp, Artificial
  CRISPR gRNA sequence
ccaaaacaggctgactcacc

SEQ ID NO: 726189 - DNA, 20 bp, Artificial
  CRISPR gRNA sequence
actcaccaatcttgttattg

SEQ ID NO: 726190 - DNA, 20 bp, Artificial
  CRISPR gRNA sequence
accaatcttgttattggtgt

SEQ ID NO: 726191 - DNA, 20 bp, Artificial
  CRISPR gRNA sequence
gttattggtgtgctccgtgg

SEQ ID NO: 726192 - DNA, 20 bp, Artificial
  CRISPR gRNA sequence
ttattggtgtgctccgtgga

SEQ ID NO: 726193 - DNA, 20 bp, Artificial
  CRISPR gRNA sequence
ttggtgtgctccgtggacac

SEQ ID NO: 726194 - DNA, 20 bp, Artificial
  CRISPR gRNA sequence
gtgtgctccgtggacacccg

SEQ ID NO: 726195 - DNA, 20 bp, Artificial
  CRISPR gRNA sequence
cgtggacacccggggctcag

SEQ ID NO: 726196 - DNA, 20 bp, Artificial
  CRISPR gRNA sequence
aggaaggtccctgggggacg

SEQ ID NO: 726197 - DNA, 20 bp, Artificial
  CRISPR gRNA sequence
ggggacgaggggcccccggc

SEQ ID NO: 726198 - DNA, 20 bp, Artificial
  CRISPR gRNA sequence
gcatcctgcagcggcaggct

SEQ ID NO: 726199 - DNA, 20 bp, Artificial
  CRISPR gRNA sequence
cagcggcaggctctccaggt

SEQ ID NO: 726200 - DNA, 20 bp, Artificial
  CRISPR gRNA sequence
tccaggtaggctgcccccac

SEQ ID NO: 726201 - DNA, 20 bp, Artificial
  CRISPR gRNA sequence
caggtaggctgcccccacgc

SEQ ID NO: 726202 - DNA, 20 bp, Artificial
  CRISPR gRNA sequence
cccccacgctgtggcaggtc

SEQ ID NO: 726203 - DNA, 20 bp, Artificial
  CRISPR gRNA sequence
tggcaggtctccatcagtgg

SEQ ID NO: 726204 - DNA, 20 bp, Artificial
  CRISPR gRNA sequence
catcagtggctggctcatta

SEQ ID NO: 726205 - DNA, 20 bp, Artificial
  CRISPR gRNA sequence
gctcattaaccctcgctctt

SEQ ID NO: 726206 - DNA, 20 bp, Artificial
  CRISPR gRNA sequence
attaaccctcgctcttccgc

SEQ ID NO: 726207 - DNA, 20 bp, Artificial
  CRISPR gRNA sequence
accctcgctcttccgcgacg

SEQ ID NO: 726208 - DNA, 20 bp, Artificial
  CRISPR gRNA sequence
gctcttccgcgacgggttct

SEQ ID NO: 726209 - DNA, 20 bp, Artificial
  CRISPR gRNA sequence
ttccgcgacgggttctgtca

SEQ ID NO: 726210 - DNA, 20 bp, Artificial
  CRISPR gRNA sequence
ccgcgacgggttctgtcacc

SEQ ID NO: 726211 - DNA, 20 bp, Artificial
  CRISPR gRNA sequence
cgcgacgggttctgtcaccg

SEQ ID NO: 726212 - DNA, 20 bp, Artificial
  CRISPR gRNA sequence
tgtcaccgacgcaccactcc

SEQ ID NO: 726213 - DNA, 20 bp, Artificial
  CRISPR gRNA sequence
tcaccgacgcaccactcctc

SEQ ID NO: 726214 - DNA, 20 bp, Artificial
  CRISPR gRNA sequence
ctcagctgctgtgggacggg

SEQ ID NO: 726215 - DNA, 20 bp, Artificial
  CRISPR gRNA sequence
agctgctgtgggacgggaat

SEQ ID NO: 726216 - DNA, 20 bp, Artificial
  CRISPR gRNA sequence
ctgtgggacgggaatgggtg

SEQ ID NO: 726217 - DNA, 20 bp, Artificial
  CRISPR gRNA sequence
tgggacgggaatgggtgctg

SEQ ID NO: 726218 - DNA, 20 bp, Artificial
  CRISPR gRNA sequence
ctgcagggtacccccaacct

SEQ ID NO: 726219 - DNA, 20 bp, Artificial
  CRISPR gRNA sequence
cagggtacccccaacctccc

SEQ ID NO: 726220 - DNA, 20 bp, Artificial
  CRISPR gRNA sequence
cccaccagtctctgaactgg

SEQ ID NO: 726221 - DNA, 20 bp, Artificial
  CRISPR gRNA sequence
tgaactgggaggcccctttt

SEQ ID NO: 726222 - DNA, 20 bp, Artificial
  CRISPR gRNA sequence
aactgggaggcccctttttt

SEQ ID NO: 726223 - DNA, 20 bp, Artificial
  CRISPR gRNA sequence
ggaggccccttttttttttc

SEQ ID NO: 726224 - DNA, 20 bp, Artificial
  CRISPR gRNA sequence
ttttttttcatctctacaga

SEQ ID NO: 726225 - DNA, 20 bp, Artificial
  CRISPR gRNA sequence
tttttttcatctctacagac

SEQ ID NO: 726226 - DNA, 20 bp, Artificial
  CRISPR gRNA sequence
ttttttcatctctacagacc

SEQ ID NO: 726227 - DNA, 20 bp, Artificial
  CRISPR gRNA sequence
tttttcatctctacagaccc

SEQ ID NO: 726228 - DNA, 20 bp, Artificial
  CRISPR gRNA sequence
ttttcatctctacagacccc

SEQ ID NO: 726229 - DNA, 20 bp, Artificial
  CRISPR gRNA sequence
tttcatctctacagacccca

SEQ ID NO: 726230 - DNA, 20 bp, Artificial
  CRISPR gRNA sequence
ttcatctctacagaccccag

SEQ ID NO: 726231 - DNA, 20 bp, Artificial
  CRISPR gRNA sequence
tcatctctacagaccccagt

SEQ ID NO: 726232 - DNA, 20 bp, Artificial
  CRISPR gRNA sequence
catctctacagaccccagtg

SEQ ID NO: 726233 - DNA, 20 bp, Artificial
  CRISPR gRNA sequence
atctctacagaccccagtga

SEQ ID NO: 726234 - DNA, 20 bp, Artificial
  CRISPR gRNA sequence
tacagaccccagtgagtccc

SEQ ID NO: 726235 - DNA, 20 bp, Artificial
  CRISPR gRNA sequence
cagaccccagtgagtccccc

SEQ ID NO: 726236 - DNA, 20 bp, Artificial
  CRISPR gRNA sequence
tctgctttaaaagctgccat

SEQ ID NO: 726237 - DNA, 20 bp, Artificial
  CRISPR gRNA sequence
ctgctttaaaagctgccatg

SEQ ID NO: 726238 - DNA, 20 bp, Artificial
  CRISPR gRNA sequence
tgctttaaaagctgccatga

SEQ ID NO: 726239 - DNA, 20 bp, Artificial
  CRISPR gRNA sequence
ctttaaaagctgccatgagc

SEQ ID NO: 726240 - DNA, 20 bp, Artificial
  CRISPR gRNA sequence
taaaagctgccatgagctgc

SEQ ID NO: 726241 - DNA, 20 bp, Artificial
  CRISPR gRNA sequence
aaaagctgccatgagctgcc

SEQ ID NO: 726242 - DNA, 20 bp, Artificial
  CRISPR gRNA sequence
aaagctgccatgagctgccc

SEQ ID NO: 726243 - DNA, 20 bp, Artificial
  CRISPR gRNA sequence
ccatgagctgccccgggctt

SEQ ID NO: 726244 - DNA, 20 bp, Artificial
  CRISPR gRNA sequence
ccccgggcttctcagctttc

SEQ ID NO: 726245 - DNA, 20 bp, Artificial
  CRISPR gRNA sequence
ctcagctttctgggtgaagt

SEQ ID NO: 726246 - DNA, 20 bp, Artificial
  CRISPR gRNA sequence
tcagctttctgggtgaagtc

SEQ ID NO: 726247 - DNA, 20 bp, Artificial
  CRISPR gRNA sequence
agctttctgggtgaagtctg

SEQ ID NO: 726248 - DNA, 20 bp, Artificial
  CRISPR gRNA sequence
tctgggtgaagtctgttgct

SEQ ID NO: 726249 - DNA, 20 bp, Artificial
  CRISPR gRNA sequence
ctgggtgaagtctgttgctt

SEQ ID NO: 726250 - DNA, 20 bp, Artificial
  CRISPR gRNA sequence
tgggtgaagtctgttgcttt

SEQ ID NO: 726251 - DNA, 20 bp, Artificial
  CRISPR gRNA sequence
ggtgaagtctgttgctttta

SEQ ID NO: 726252 - DNA, 20 bp, Artificial
  CRISPR gRNA sequence
ttgcttttaatttgtactaa

SEQ ID NO: 726253 - DNA, 20 bp, Artificial
  CRISPR gRNA sequence
cttttaatttgtactaaata

SEQ ID NO: 726254 - DNA, 20 bp, Artificial
  CRISPR gRNA sequence
ttaatttgtactaaatagta

SEQ ID NO: 726255 - DNA, 20 bp, Artificial
  CRISPR gRNA sequence
taatttgtactaaatagtag

SEQ ID NO: 726256 - DNA, 20 bp, Artificial
  CRISPR gRNA sequence
aatttgtactaaatagtagg

SEQ ID NO: 726257 - DNA, 20 bp, Artificial
  CRISPR gRNA sequence
atttgtactaaatagtaggg

SEQ ID NO: 726258 - DNA, 20 bp, Artificial
  CRISPR gRNA sequence
gtactaaatagtaggggtaa

SEQ ID NO: 726259 - DNA, 20 bp, Artificial
  CRISPR gRNA sequence
tactaaatagtaggggtaac

SEQ ID NO: 726260 - DNA, 20 bp, Artificial
  CRISPR gRNA sequence
aatagtaggggtaacagtca

SEQ ID NO: 726261 - DNA, 20 bp, Artificial
  CRISPR gRNA sequence
acagggtgctcgccacgtcc

SEQ ID NO: 726262 - DNA, 20 bp, Artificial
  CRISPR gRNA sequence
gccacgtccgttggccctgt

SEQ ID NO: 726263 - DNA, 20 bp, Artificial
  CRISPR gRNA sequence
gccctgtcctaaagtccttg

SEQ ID NO: 726264 - DNA, 20 bp, Artificial
  CRISPR gRNA sequence
tcctaaagtccttgacatat

SEQ ID NO: 726265 - DNA, 20 bp, Artificial
  CRISPR gRNA sequence
aagtccttgacatatgttaa

SEQ ID NO: 726266 - DNA, 20 bp, Artificial
  CRISPR gRNA sequence
gacatatgttaatcctcaca

SEQ ID NO: 726267 - DNA, 20 bp, Artificial
  CRISPR gRNA sequence
acatatgttaatcctcacaa

SEQ ID NO: 726268 - DNA, 20 bp, Artificial
  CRISPR gRNA sequence
atcctcacaaccactgtatg

SEQ ID NO: 726269 - DNA, 20 bp, Artificial
  CRISPR gRNA sequence
acaaccactgtatgaggtgg

SEQ ID NO: 726270 - DNA, 20 bp, Artificial
  CRISPR gRNA sequence
tatgaggtgggtaacagccc

SEQ ID NO: 726271 - DNA, 20 bp, Artificial
  CRISPR gRNA sequence
cccattttacagatgaggaa

SEQ ID NO: 726272 - DNA, 20 bp, Artificial
  CRISPR gRNA sequence
tacagatgaggaaactgagg

SEQ ID NO: 726273 - DNA, 20 bp, Artificial
  CRISPR gRNA sequence
acagatgaggaaactgaggc

SEQ ID NO: 726274 - DNA, 20 bp, Artificial
  CRISPR gRNA sequence
cagatgaggaaactgaggca

SEQ ID NO: 726275 - DNA, 20 bp, Artificial
  CRISPR gRNA sequence
aggcacagaggagtcgagta

SEQ ID NO: 726276 - DNA, 20 bp, Artificial
  CRISPR gRNA sequence
gcccagggttataccatcaa

SEQ ID NO: 726277 - DNA, 20 bp, Artificial
  CRISPR gRNA sequence
taccatcaataagtatctga

SEQ ID NO: 726278 - DNA, 20 bp, Artificial
  CRISPR gRNA sequence
agctaggatttgaaccctgg

SEQ ID NO: 726279 - DNA, 20 bp, Artificial
  CRISPR gRNA sequence
ggatttgaaccctggcatct

SEQ ID NO: 726280 - DNA, 20 bp, Artificial
  CRISPR gRNA sequence
gaaccctggcatctggtcca

SEQ ID NO: 726281 - DNA, 20 bp, Artificial
  CRISPR gRNA sequence
aaccctggcatctggtccat

SEQ ID NO: 726282 - DNA, 20 bp, Artificial
  CRISPR gRNA sequence
gcatctggtccataacccac

SEQ ID NO: 726283 - DNA, 20 bp, Artificial
  CRISPR gRNA sequence
gtccataacccacactcata

SEQ ID NO: 726284 - DNA, 20 bp, Artificial
  CRISPR gRNA sequence
ataagcacccaagtctgtaa

SEQ ID NO: 726285 - DNA, 20 bp, Artificial
  CRISPR gRNA sequence
taagtaccagctccaggtcc

SEQ ID NO: 726286 - DNA, 20 bp, Artificial
  CRISPR gRNA sequence
caggtcccccacctcctgga

SEQ ID NO: 726287 - DNA, 20 bp, Artificial
  CRISPR gRNA sequence
ctggagcagcccctccagct

SEQ ID NO: 726288 - DNA, 20 bp, Artificial
  CRISPR gRNA sequence
gagcagcccctccagctccc

SEQ ID NO: 726289 - DNA, 20 bp, Artificial
  CRISPR gRNA sequence
cagctccccagccccgacat

SEQ ID NO: 726290 - DNA, 20 bp, Artificial
  CRISPR gRNA sequence
cccagccccgacatcctgga

SEQ ID NO: 726291 - DNA, 20 bp, Artificial
  CRISPR gRNA sequence
gaaagtagtcttttatgatc

SEQ ID NO: 726292 - DNA, 20 bp, Artificial
  CRISPR gRNA sequence
ttatgatcacactcaagcat

SEQ ID NO: 726293 - DNA, 20 bp, Artificial
  CRISPR gRNA sequence
tatgatcacactcaagcatt

SEQ ID NO: 726294 - DNA, 20 bp, Artificial
  CRISPR gRNA sequence
atgatcacactcaagcattc

SEQ ID NO: 726295 - DNA, 20 bp, Artificial
  CRISPR gRNA sequence
tgatcacactcaagcattct

SEQ ID NO: 726296 - DNA, 20 bp, Artificial
  CRISPR gRNA sequence
aagcattctaaaaacagact

SEQ ID NO: 726297 - DNA, 20 bp, Artificial
  CRISPR gRNA sequence
taaaaacagactactgttag

SEQ ID NO: 726298 - DNA, 20 bp, Artificial
  CRISPR gRNA sequence
aaaacagactactgttagtt

SEQ ID NO: 726299 - DNA, 20 bp, Artificial
  CRISPR gRNA sequence
ctgttagttcaagtgacaag

SEQ ID NO: 726300 - DNA, 20 bp, Artificial
  CRISPR gRNA sequence
ttagttcaagtgacaagccc

SEQ ID NO: 726301 - DNA, 20 bp, Artificial
  CRISPR gRNA sequence
gttcaagtgacaagcccggt

SEQ ID NO: 726302 - DNA, 20 bp, Artificial
  CRISPR gRNA sequence
aagtgacaagcccggtgacc

SEQ ID NO: 726303 - DNA, 20 bp, Artificial
  CRISPR gRNA sequence
tatactatataatctaaatt

SEQ ID NO: 726304 - DNA, 20 bp, Artificial
  CRISPR gRNA sequence
tactatataatctaaattca

SEQ ID NO: 726305 - DNA, 20 bp, Artificial
  CRISPR gRNA sequence
tataatctaaattcatgtat

SEQ ID NO: 726306 - DNA, 20 bp, Artificial
  CRISPR gRNA sequence
aattcatgtatattattaat

SEQ ID NO: 726307 - DNA, 20 bp, Artificial
  CRISPR gRNA sequence
atgtatattattaataaata

SEQ ID NO: 726308 - DNA, 20 bp, Artificial
  CRISPR gRNA sequence
ttaataaatattttctaaat

SEQ ID NO: 726309 - DNA, 20 bp, Artificial
  CRISPR gRNA sequence
ataaatattttctaaatgct

SEQ ID NO: 726310 - DNA, 20 bp, Artificial
  CRISPR gRNA sequence
tctaaatgctaaaaaaaaaa

SEQ ID NO: 726311 - DNA, 20 bp, Artificial
  CRISPR gRNA sequence
ctaaatgctaaaaaaaaaac

SEQ ID NO: 726312 - DNA, 20 bp, Artificial
  CRISPR gRNA sequence
taaatgctaaaaaaaaaaca

SEQ ID NO: 726313 - DNA, 20 bp, Artificial
  CRISPR gRNA sequence
aatgctaaaaaaaaaacaaa

SEQ ID NO: 726314 - DNA, 20 bp, Artificial
  CRISPR gRNA sequence
aaaaaaaaacaaaaaaaaaa

SEQ ID NO: 726315 - DNA, 20 bp, Artificial
  CRISPR gRNA sequence
tgtcatgaggaaagtgtcag

SEQ ID NO: 726316 - DNA, 20 bp, Artificial
  CRISPR gRNA sequence
agtttttgatttttacaggt

SEQ ID NO: 726317 - DNA, 20 bp, Artificial
  CRISPR gRNA sequence
gtttttgatttttacaggta

SEQ ID NO: 726318 - DNA, 20 bp, Artificial
  CRISPR gRNA sequence
ttgatttttacaggtaaggg

SEQ ID NO: 726319 - DNA, 20 bp, Artificial
  CRISPR gRNA sequence
tgatttttacaggtaagggc

SEQ ID NO: 726320 - DNA, 20 bp, Artificial
  CRISPR gRNA sequence
gatttttacaggtaagggca

SEQ ID NO: 726321 - DNA, 20 bp, Artificial
  CRISPR gRNA sequence
atttttacaggtaagggcaa

SEQ ID NO: 726322 - DNA, 20 bp, Artificial
  CRISPR gRNA sequence
ttacaggtaagggcaaagaa

SEQ ID NO: 726323 - DNA, 20 bp, Artificial
  CRISPR gRNA sequence
tacaggtaagggcaaagaag

SEQ ID NO: 726324 - DNA, 20 bp, Artificial
  CRISPR gRNA sequence
acaggtaagggcaaagaagt

SEQ ID NO: 726325 - DNA, 20 bp, Artificial
  CRISPR gRNA sequence
caggtaagggcaaagaagtg

SEQ ID NO: 726326 - DNA, 20 bp, Artificial
  CRISPR gRNA sequence
atgaaatgtcctgatgcctt

SEQ ID NO: 726327 - DNA, 20 bp, Artificial
  CRISPR gRNA sequence
atgccttcaaaatggagtga

SEQ ID NO: 726328 - DNA, 20 bp, Artificial
  CRISPR gRNA sequence
caaaatggagtgagtgtgag

SEQ ID NO: 726329 - DNA, 20 bp, Artificial
  CRISPR gRNA sequence
aaaatggagtgagtgtgagt

SEQ ID NO: 726330 - DNA, 20 bp, Artificial
  CRISPR gRNA sequence
agaggaggcagggatgcccg

SEQ ID NO: 726331 - DNA, 20 bp, Artificial
  CRISPR gRNA sequence
acgcaatgattctcaaggca

SEQ ID NO: 726332 - DNA, 20 bp, Artificial
  CRISPR gRNA sequence
tcaaggcacagagggcgtat

SEQ ID NO: 726333 - DNA, 20 bp, Artificial
  CRISPR gRNA sequence
aaggcacagagggcgtatct

SEQ ID NO: 726334 - DNA, 20 bp, Artificial
  CRISPR gRNA sequence
ttagattggtgcaaaagtaa

SEQ ID NO: 726335 - DNA, 20 bp, Artificial
  CRISPR gRNA sequence
tagattggtgcaaaagtaat

SEQ ID NO: 726336 - DNA, 20 bp, Artificial
  CRISPR gRNA sequence
agattggtgcaaaagtaatc

SEQ ID NO: 726337 - DNA, 20 bp, Artificial
  CRISPR gRNA sequence
gattggtgcaaaagtaatca

SEQ ID NO: 726338 - DNA, 20 bp, Artificial
  CRISPR gRNA sequence
gtgcaaaagtaatcacgtct

SEQ ID NO: 726339 - DNA, 20 bp, Artificial
  CRISPR gRNA sequence
tgccattattattattatta

SEQ ID NO: 726340 - DNA, 20 bp, Artificial
  CRISPR gRNA sequence
gccattattattattattat

SEQ ID NO: 726341 - DNA, 20 bp, Artificial
  CRISPR gRNA sequence
ccattattattattattatt

SEQ ID NO: 726342 - DNA, 20 bp, Artificial
  CRISPR gRNA sequence
ttattattattattttttac

SEQ ID NO: 726343 - DNA, 20 bp, Artificial
  CRISPR gRNA sequence
ttattattattttttacttt

SEQ ID NO: 726344 - DNA, 20 bp, Artificial
  CRISPR gRNA sequence
ttattattttttacttttta

SEQ ID NO: 726345 - DNA, 20 bp, Artificial
  CRISPR gRNA sequence
ttattttttactttttaaat

SEQ ID NO: 726346 - DNA, 20 bp, Artificial
  CRISPR gRNA sequence
ttttttactttttaaatggt

SEQ ID NO: 726347 - DNA, 20 bp, Artificial
  CRISPR gRNA sequence
tttactttttaaatggtttt

SEQ ID NO: 726348 - DNA, 20 bp, Artificial
  CRISPR gRNA sequence
ttactttttaaatggtttta

SEQ ID NO: 726349 - DNA, 20 bp, Artificial
  CRISPR gRNA sequence
tactttttaaatggttttat

SEQ ID NO: 726350 - DNA, 20 bp, Artificial
  CRISPR gRNA sequence
actttttaaatggttttatt

SEQ ID NO: 726351 - DNA, 20 bp, Artificial
  CRISPR gRNA sequence
ctttttaaatggttttattt

SEQ ID NO: 726352 - DNA, 20 bp, Artificial
  CRISPR gRNA sequence
tttaaatggttttattttat

SEQ ID NO: 726353 - DNA, 20 bp, Artificial
  CRISPR gRNA sequence
ttaaatggttttattttatg

SEQ ID NO: 726354 - DNA, 20 bp, Artificial
  CRISPR gRNA sequence
taaatggttttattttatgt

SEQ ID NO: 726355 - DNA, 20 bp, Artificial
  CRISPR gRNA sequence
aaatggttttattttatgta

SEQ ID NO: 726356 - DNA, 20 bp, Artificial
  CRISPR gRNA sequence
aatggttttattttatgtac

SEQ ID NO: 726357 - DNA, 20 bp, Artificial
  CRISPR gRNA sequence
tattttatgtacaaataatg

SEQ ID NO: 726358 - DNA, 20 bp, Artificial
  CRISPR gRNA sequence
attttatgtacaaataatga

SEQ ID NO: 726359 - DNA, 20 bp, Artificial
  CRISPR gRNA sequence
ttttatgtacaaataatgaa

SEQ ID NO: 726360 - DNA, 20 bp, Artificial
  CRISPR gRNA sequence
tatgtacaaataatgaacat

SEQ ID NO: 726361 - DNA, 20 bp, Artificial
  CRISPR gRNA sequence
atgtacaaataatgaacata

SEQ ID NO: 726362 - DNA, 20 bp, Artificial
  CRISPR gRNA sequence
tgtacaaataatgaacatat

SEQ ID NO: 726363 - DNA, 20 bp, Artificial
  CRISPR gRNA sequence
tacccataaattctactttc

SEQ ID NO: 726364 - DNA, 20 bp, Artificial
  CRISPR gRNA sequence
tactttcccaaaacaggagc

SEQ ID NO: 726365 - DNA, 20 bp, Artificial
  CRISPR gRNA sequence
ctttcccaaaacaggagctt

SEQ ID NO: 726366 - DNA, 20 bp, Artificial
  CRISPR gRNA sequence
tcccaaaacaggagcttttt

SEQ ID NO: 726367 - DNA, 20 bp, Artificial
  CRISPR gRNA sequence
cccaaaacaggagcttttta

SEQ ID NO: 726368 - DNA, 20 bp, Artificial
  CRISPR gRNA sequence
ccaaaacaggagctttttaa

SEQ ID NO: 726369 - DNA, 20 bp, Artificial
  CRISPR gRNA sequence
tttaaaacaaaaccacataa

SEQ ID NO: 726370 - DNA, 20 bp, Artificial
  CRISPR gRNA sequence
ttaaaacaaaaccacataat

SEQ ID NO: 726371 - DNA, 20 bp, Artificial
  CRISPR gRNA sequence
taaaacaaaaccacataata

SEQ ID NO: 726372 - DNA, 20 bp, Artificial
  CRISPR gRNA sequence
aaaacaaaaccacataataa

SEQ ID NO: 726373 - DNA, 20 bp, Artificial
  CRISPR gRNA sequence
aaacaaaaccacataataac

SEQ ID NO: 726374 - DNA, 20 bp, Artificial
  CRISPR gRNA sequence
ttaaaaggcgctgagattcc

SEQ ID NO: 726375 - DNA, 20 bp, Artificial
  CRISPR gRNA sequence
taaaaggcgctgagattcct

SEQ ID NO: 726376 - DNA, 20 bp, Artificial
  CRISPR gRNA sequence
aaaaggcgctgagattcctc

SEQ ID NO: 726377 - DNA, 20 bp, Artificial
  CRISPR gRNA sequence
aaaggcgctgagattcctca

SEQ ID NO: 726378 - DNA, 20 bp, Artificial
  CRISPR gRNA sequence
agattcctcagcttccagat

SEQ ID NO: 726379 - DNA, 20 bp, Artificial
  CRISPR gRNA sequence
ctcagcttccagatcactgc

SEQ ID NO: 726380 - DNA, 20 bp, Artificial
  CRISPR gRNA sequence
agcttccagatcactgctga

SEQ ID NO: 726381 - DNA, 20 bp, Artificial
  CRISPR gRNA sequence
ccagatcactgctgagctag

SEQ ID NO: 726382 - DNA, 20 bp, Artificial
  CRISPR gRNA sequence
cagatcactgctgagctaga

SEQ ID NO: 726383 - DNA, 20 bp, Artificial
  CRISPR gRNA sequence
ctgagctagaaaaataaagt

SEQ ID NO: 726384 - DNA, 20 bp, Artificial
  CRISPR gRNA sequence
agctagaaaaataaagtttg

SEQ ID NO: 726385 - DNA, 20 bp, Artificial
  CRISPR gRNA sequence
gaaaaataaagtttgttcta

SEQ ID NO: 726386 - DNA, 20 bp, Artificial
  CRISPR gRNA sequence
gttctaccaggaaccacagc

SEQ ID NO: 726387 - DNA, 20 bp, Artificial
  CRISPR gRNA sequence
ttctaccaggaaccacagct

SEQ ID NO: 726388 - DNA, 20 bp, Artificial
  CRISPR gRNA sequence
taccaggaaccacagcttag

SEQ ID NO: 726389 - DNA, 20 bp, Artificial
  CRISPR gRNA sequence
ccaggaaccacagcttagaa

SEQ ID NO: 726390 - DNA, 20 bp, Artificial
  CRISPR gRNA sequence
agaactgagtattcttcact

SEQ ID NO: 726391 - DNA, 20 bp, Artificial
  CRISPR gRNA sequence
gaactgagtattcttcactc

SEQ ID NO: 726392 - DNA, 20 bp, Artificial
  CRISPR gRNA sequence
agtattcttcactcgctaag

SEQ ID NO: 726393 - DNA, 20 bp, Artificial
  CRISPR gRNA sequence
ttcactcgctaagagtcatc

SEQ ID NO: 726394 - DNA, 20 bp, Artificial
  CRISPR gRNA sequence
cactcgctaagagtcatcac

SEQ ID NO: 726395 - DNA, 20 bp, Artificial
  CRISPR gRNA sequence
actcgctaagagtcatcacc

SEQ ID NO: 726396 - DNA, 20 bp, Artificial
  CRISPR gRNA sequence
gctaagagtcatcaccactc

SEQ ID NO: 726397 - DNA, 20 bp, Artificial
  CRISPR gRNA sequence
agagtcatcaccactcccta

SEQ ID NO: 726398 - DNA, 20 bp, Artificial
  CRISPR gRNA sequence
cctaatctcaagtacccagg

SEQ ID NO: 726399 - DNA, 20 bp, Artificial
  CRISPR gRNA sequence
atctcaagtacccagggaca

SEQ ID NO: 726400 - DNA, 20 bp, Artificial
  CRISPR gRNA sequence
aagtacccagggacacaaac

SEQ ID NO: 726401 - DNA, 20 bp, Artificial
  CRISPR gRNA sequence
cggaaggcggcagggccctc

SEQ ID NO: 726402 - DNA, 20 bp, Artificial
  CRISPR gRNA sequence
tgcctaggaaaaccagagac

SEQ ID NO: 726403 - DNA, 20 bp, Artificial
  CRISPR gRNA sequence
cctaggaaaaccagagacct

SEQ ID NO: 726404 - DNA, 20 bp, Artificial
  CRISPR gRNA sequence
ggaaaaccagagacctttgt

SEQ ID NO: 726405 - DNA, 20 bp, Artificial
  CRISPR gRNA sequence
tgttcacatgtttatctgct

SEQ ID NO: 726406 - DNA, 20 bp, Artificial
  CRISPR gRNA sequence
gttcacatgtttatctgctg

SEQ ID NO: 726407 - DNA, 20 bp, Artificial
  CRISPR gRNA sequence
ttcacatgtttatctgctga

SEQ ID NO: 726408 - DNA, 20 bp, Artificial
  CRISPR gRNA sequence
acatgtttatctgctgacct

SEQ ID NO: 726409 - DNA, 20 bp, Artificial
  CRISPR gRNA sequence
atctgctgaccttccctcca

SEQ ID NO: 726410 - DNA, 20 bp, Artificial
  CRISPR gRNA sequence
tctgctgaccttccctccac

SEQ ID NO: 726411 - DNA, 20 bp, Artificial
  CRISPR gRNA sequence
ctgaccttccctccactatt

SEQ ID NO: 726412 - DNA, 20 bp, Artificial
  CRISPR gRNA sequence
accttccctccactattgtc

SEQ ID NO: 726413 - DNA, 20 bp, Artificial
  CRISPR gRNA sequence
ccctccactattgtcctatg

SEQ ID NO: 726414 - DNA, 20 bp, Artificial
  CRISPR gRNA sequence
cctccactattgtcctatga

SEQ ID NO: 726415 - DNA, 20 bp, Artificial
  CRISPR gRNA sequence
cactattgtcctatgaccct

SEQ ID NO: 726416 - DNA, 20 bp, Artificial
  CRISPR gRNA sequence
ttgtcctatgaccctgccaa

SEQ ID NO: 726417 - DNA, 20 bp, Artificial
  CRISPR gRNA sequence
tcctatgaccctgccaaatc

SEQ ID NO: 726418 - DNA, 20 bp, Artificial
  CRISPR gRNA sequence
tgaccctgccaaatccccct

SEQ ID NO: 726419 - DNA, 20 bp, Artificial
  CRISPR gRNA sequence
ccaaatccccctctctgaga

SEQ ID NO: 726420 - DNA, 20 bp, Artificial
  CRISPR gRNA sequence
tctgagaaacacccaagaat

SEQ ID NO: 726421 - DNA, 20 bp, Artificial
  CRISPR gRNA sequence
tgagaaacacccaagaatga

SEQ ID NO: 726422 - DNA, 20 bp, Artificial
  CRISPR gRNA sequence
agaaacacccaagaatgatc

SEQ ID NO: 726423 - DNA, 20 bp, Artificial
  CRISPR gRNA sequence
aaaaaattaaaaaaaaaaaa

SEQ ID NO: 726424 - DNA, 20 bp, Artificial
  CRISPR gRNA sequence
aaaaaaaaaaaaaaaaaaaa

SEQ ID NO: 726425 - DNA, 20 bp, Artificial
  CRISPR gRNA sequence
agtatttttcaaagtggaaa

SEQ ID NO: 726426 - DNA, 20 bp, Artificial
  CRISPR gRNA sequence
ttcaaagtggaaattctaga

SEQ ID NO: 726427 - DNA, 20 bp, Artificial
  CRISPR gRNA sequence
tcaaagtggaaattctagag

SEQ ID NO: 726428 - DNA, 20 bp, Artificial
  CRISPR gRNA sequence
caaagtggaaattctagagt

SEQ ID NO: 726429 - DNA, 20 bp, Artificial
  CRISPR gRNA sequence
aaagtggaaattctagagtg

SEQ ID NO: 726430 - DNA, 20 bp, Artificial
  CRISPR gRNA sequence
tagagtgtggtgtcactcca

SEQ ID NO: 726431 - DNA, 20 bp, Artificial
  CRISPR gRNA sequence
gagtgtggtgtcactccaga

SEQ ID NO: 726432 - DNA, 20 bp, Artificial
  CRISPR gRNA sequence
cagacaaagattattctgtt

SEQ ID NO: 726433 - DNA, 20 bp, Artificial
  CRISPR gRNA sequence
ttctgttctcaaccccaaca

SEQ ID NO: 726434 - DNA, 20 bp, Artificial
  CRISPR gRNA sequence
tgttctcaaccccaacatcc

SEQ ID NO: 726435 - DNA, 20 bp, Artificial
  CRISPR gRNA sequence
ttctcaaccccaacatccac

SEQ ID NO: 726436 - DNA, 20 bp, Artificial
  CRISPR gRNA sequence
tcaaccccaacatccacaac

SEQ ID NO: 726437 - DNA, 20 bp, Artificial
  CRISPR gRNA sequence
aaccccaacatccacaacta

SEQ ID NO: 726438 - DNA, 20 bp, Artificial
  CRISPR gRNA sequence
cctatcagaagggttaaacc

SEQ ID NO: 726439 - DNA, 20 bp, Artificial
  CRISPR gRNA sequence
tcagaagggttaaaccaggt

SEQ ID NO: 726440 - DNA, 20 bp, Artificial
  CRISPR gRNA sequence
aaccaggtttgccattactt

SEQ ID NO: 726441 - DNA, 20 bp, Artificial
  CRISPR gRNA sequence
gccattacttttaatggcaa

SEQ ID NO: 726442 - DNA, 20 bp, Artificial
  CRISPR gRNA sequence
ccattacttttaatggcaaa

SEQ ID NO: 726443 - DNA, 20 bp, Artificial
  CRISPR gRNA sequence
cttttaatggcaaatggcac

SEQ ID NO: 726444 - DNA, 20 bp, Artificial
  CRISPR gRNA sequence
ttaatggcaaatggcaccaa

SEQ ID NO: 726445 - DNA, 20 bp, Artificial
  CRISPR gRNA sequence
taatggcaaatggcaccaac

SEQ ID NO: 726446 - DNA, 20 bp, Artificial
  CRISPR gRNA sequence
aatggcaaatggcaccaacc

SEQ ID NO: 726447 - DNA, 20 bp, Artificial
  CRISPR gRNA sequence
atggcaaatggcaccaacct

SEQ ID NO: 726448 - DNA, 20 bp, Artificial
  CRISPR gRNA sequence
aatacatactcttgaatact

SEQ ID NO: 726449 - DNA, 20 bp, Artificial
  CRISPR gRNA sequence
atacatactcttgaatactc

SEQ ID NO: 726450 - DNA, 20 bp, Artificial
  CRISPR gRNA sequence
ttgaatactctttcataata

SEQ ID NO: 726451 - DNA, 20 bp, Artificial
  CRISPR gRNA sequence
gaatactctttcataataat

SEQ ID NO: 726452 - DNA, 20 bp, Artificial
  CRISPR gRNA sequence
aatactctttcataataata

SEQ ID NO: 726453 - DNA, 20 bp, Artificial
  CRISPR gRNA sequence
tttcataataatatgaaggc

SEQ ID NO: 726454 - DNA, 20 bp, Artificial
  CRISPR gRNA sequence
tcataataatatgaaggcta

SEQ ID NO: 726455 - DNA, 20 bp, Artificial
  CRISPR gRNA sequence
cataataatatgaaggctaa

SEQ ID NO: 726456 - DNA, 20 bp, Artificial
  CRISPR gRNA sequence
ataataatatgaaggctaaa

SEQ ID NO: 726457 - DNA, 20 bp, Artificial
  CRISPR gRNA sequence
aaagactgcctttttttttt

SEQ ID NO: 726458 - DNA, 20 bp, Artificial
  CRISPR gRNA sequence
cctttttttttttttttttt

SEQ ID NO: 726459 - DNA, 20 bp, Artificial
  CRISPR gRNA sequence
ttttttttttttttttcaga

SEQ ID NO: 726460 - DNA, 20 bp, Artificial
  CRISPR gRNA sequence
tttttttttttttttcagat

SEQ ID NO: 726461 - DNA, 20 bp, Artificial
  CRISPR gRNA sequence
ttttttttttttttcagatg

SEQ ID NO: 726462 - DNA, 20 bp, Artificial
  CRISPR gRNA sequence
tttttttttttttcagatgg

SEQ ID NO: 726463 - DNA, 20 bp, Artificial
  CRISPR gRNA sequence
ttttttttttttcagatgga

SEQ ID NO: 726464 - DNA, 20 bp, Artificial
  CRISPR gRNA sequence
tttttttttttcagatggag

SEQ ID NO: 726465 - DNA, 20 bp, Artificial
  CRISPR gRNA sequence
ttttttttttcagatggagt

SEQ ID NO: 726466 - DNA, 20 bp, Artificial
  CRISPR gRNA sequence
tttttttttcagatggagtc

SEQ ID NO: 726467 - DNA, 20 bp, Artificial
  CRISPR gRNA sequence
ttttttttcagatggagtct

SEQ ID NO: 726468 - DNA, 20 bp, Artificial
  CRISPR gRNA sequence
tttttttcagatggagtctc

SEQ ID NO: 726469 - DNA, 20 bp, Artificial
  CRISPR gRNA sequence
ttttttcagatggagtctca

SEQ ID NO: 726470 - DNA, 20 bp, Artificial
  CRISPR gRNA sequence
tttttcagatggagtctcac

SEQ ID NO: 726471 - DNA, 20 bp, Artificial
  CRISPR gRNA sequence
ttttcagatggagtctcact

SEQ ID NO: 726472 - DNA, 20 bp, Artificial
  CRISPR gRNA sequence
tttcagatggagtctcactc

SEQ ID NO: 726473 - DNA, 20 bp, Artificial
  CRISPR gRNA sequence
ttcagatggagtctcactct

SEQ ID NO: 726474 - DNA, 20 bp, Artificial
  CRISPR gRNA sequence
tcagatggagtctcactctg

SEQ ID NO: 726475 - DNA, 20 bp, Artificial
  CRISPR gRNA sequence
cagatggagtctcactctgt

SEQ ID NO: 726476 - DNA, 20 bp, Artificial
  CRISPR gRNA sequence
agatggagtctcactctgtt

SEQ ID NO: 726477 - DNA, 20 bp, Artificial
  CRISPR gRNA sequence
actctgttacccgggctggg

SEQ ID NO: 726478 - DNA, 20 bp, Artificial
  CRISPR gRNA sequence
tgttacccgggctgggagag

SEQ ID NO: 726479 - DNA, 20 bp, Artificial
  CRISPR gRNA sequence
ttacccgggctgggagagca

SEQ ID NO: 726480 - DNA, 20 bp, Artificial
  CRISPR gRNA sequence
cccgggctgggagagcagtg

SEQ ID NO: 726481 - DNA, 20 bp, Artificial
  CRISPR gRNA sequence
ggagagcagtggtgcaatct

SEQ ID NO: 726482 - DNA, 20 bp, Artificial
  CRISPR gRNA sequence
ggctccctgcaacctctgtc

SEQ ID NO: 726483 - DNA, 20 bp, Artificial
  CRISPR gRNA sequence
cctgcaacctctgtccccca

SEQ ID NO: 726484 - DNA, 20 bp, Artificial
  CRISPR gRNA sequence
caacctctgtcccccaggct

SEQ ID NO: 726485 - DNA, 20 bp, Artificial
  CRISPR gRNA sequence
tgtcccccaggctcaagcga

SEQ ID NO: 726486 - DNA, 20 bp, Artificial
  CRISPR gRNA sequence
tcccccaggctcaagcgatt

SEQ ID NO: 726487 - DNA, 20 bp, Artificial
  CRISPR gRNA sequence
aagcgattctcctgcctcag

SEQ ID NO: 726488 - DNA, 20 bp, Artificial
  CRISPR gRNA sequence
tcctgcctcagcctcctgag

SEQ ID NO: 726489 - DNA, 20 bp, Artificial
  CRISPR gRNA sequence
ctgcctcagcctcctgagta

SEQ ID NO: 726490 - DNA, 20 bp, Artificial
  CRISPR gRNA sequence
cctcagcctcctgagtagct

SEQ ID NO: 726491 - DNA, 20 bp, Artificial
  CRISPR gRNA sequence
agcctcctgagtagctggga

SEQ ID NO: 726492 - DNA, 20 bp, Artificial
  CRISPR gRNA sequence
ctgagtagctgggactacag

SEQ ID NO: 726493 - DNA, 20 bp, Artificial
  CRISPR gRNA sequence
agtagctgggactacaggcg

SEQ ID NO: 726494 - DNA, 20 bp, Artificial
  CRISPR gRNA sequence
ggactacaggcgtgtgccac

SEQ ID NO: 726495 - DNA, 20 bp, Artificial
  CRISPR gRNA sequence
caggcgtgtgccactacacc

SEQ ID NO: 726496 - DNA, 20 bp, Artificial
  CRISPR gRNA sequence
cacctggatactttttgtag

SEQ ID NO: 726497 - DNA, 20 bp, Artificial
  CRISPR gRNA sequence
gatactttttgtagttttag

SEQ ID NO: 726498 - DNA, 20 bp, Artificial
  CRISPR gRNA sequence
tttgtagttttagtagagac

SEQ ID NO: 726499 - DNA, 20 bp, Artificial
  CRISPR gRNA sequence
ttgtagttttagtagagacg

SEQ ID NO: 726500 - DNA, 20 bp, Artificial
  CRISPR gRNA sequence
tgtagttttagtagagacgg

SEQ ID NO: 726501 - DNA, 20 bp, Artificial
  CRISPR gRNA sequence
gtagttttagtagagacggg

SEQ ID NO: 726502 - DNA, 20 bp, Artificial
  CRISPR gRNA sequence
tagttttagtagagacgggg

SEQ ID NO: 726503 - DNA, 20 bp, Artificial
  CRISPR gRNA sequence
tagtagagacggggtttcac

SEQ ID NO: 726504 - DNA, 20 bp, Artificial
  CRISPR gRNA sequence
agtagagacggggtttcact

SEQ ID NO: 726505 - DNA, 20 bp, Artificial
  CRISPR gRNA sequence
gtagagacggggtttcacta

SEQ ID NO: 726506 - DNA, 20 bp, Artificial
  CRISPR gRNA sequence
cactatgttggcaaggctgg

SEQ ID NO: 726507 - DNA, 20 bp, Artificial
  CRISPR gRNA sequence
actatgttggcaaggctggt

SEQ ID NO: 726508 - DNA, 20 bp, Artificial
  CRISPR gRNA sequence
tgttggcaaggctggtctcg

SEQ ID NO: 726509 - DNA, 20 bp, Artificial
  CRISPR gRNA sequence
gcaaggctggtctcgaactc

SEQ ID NO: 726510 - DNA, 20 bp, Artificial
  CRISPR gRNA sequence
gtctcgaactcctgacctca

SEQ ID NO: 726511 - DNA, 20 bp, Artificial
  CRISPR gRNA sequence
gaactcctgacctcaggtga

SEQ ID NO: 726512 - DNA, 20 bp, Artificial
  CRISPR gRNA sequence
ctgacctcaggtgatccgcc

SEQ ID NO: 726513 - DNA, 20 bp, Artificial
  CRISPR gRNA sequence
acctcaggtgatccgcctgc

SEQ ID NO: 726514 - DNA, 20 bp, Artificial
  CRISPR gRNA sequence
aggtgatccgcctgcctcag

SEQ ID NO: 726515 - DNA, 20 bp, Artificial
  CRISPR gRNA sequence
cctcagcctcccaaaatgct

SEQ ID NO: 726516 - DNA, 20 bp, Artificial
  CRISPR gRNA sequence
agcctcccaaaatgctggga

SEQ ID NO: 726517 - DNA, 20 bp, Artificial
  CRISPR gRNA sequence
ccaaaatgctgggattttaa

SEQ ID NO: 726518 - DNA, 20 bp, Artificial
  CRISPR gRNA sequence
ggattttaagtgtgagccat

SEQ ID NO: 726519 - DNA, 20 bp, Artificial
  CRISPR gRNA sequence
taagtgtgagccatcatatc

SEQ ID NO: 726520 - DNA, 20 bp, Artificial
  CRISPR gRNA sequence
aagtgtgagccatcatatcc

SEQ ID NO: 726521 - DNA, 20 bp, Artificial
  CRISPR gRNA sequence
agtgtgagccatcatatccg

SEQ ID NO: 726522 - DNA, 20 bp, Artificial
  CRISPR gRNA sequence
cattttaaaacaagttacta

SEQ ID NO: 726523 - DNA, 20 bp, Artificial
  CRISPR gRNA sequence
taaaacaagttactattaat

SEQ ID NO: 726524 - DNA, 20 bp, Artificial
  CRISPR gRNA sequence
aaaacaagttactattaatg

SEQ ID NO: 726525 - DNA, 20 bp, Artificial
  CRISPR gRNA sequence
aaacaagttactattaatgc

SEQ ID NO: 726526 - DNA, 20 bp, Artificial
  CRISPR gRNA sequence
ctattaatgcattggcctat

SEQ ID NO: 726527 - DNA, 20 bp, Artificial
  CRISPR gRNA sequence
ttaatgcattggcctatgca

SEQ ID NO: 726528 - DNA, 20 bp, Artificial
  CRISPR gRNA sequence
atgcattggcctatgcagca

SEQ ID NO: 726529 - DNA, 20 bp, Artificial
  CRISPR gRNA sequence
gcctatgcagcaaaaacata

SEQ ID NO: 726530 - DNA, 20 bp, Artificial
  CRISPR gRNA sequence
tgcagcaaaaacatatttga

SEQ ID NO: 726531 - DNA, 20 bp, Artificial
  CRISPR gRNA sequence
gattaccttacaaattgttg

SEQ ID NO: 726532 - DNA, 20 bp, Artificial
  CRISPR gRNA sequence
attaccttacaaattgttga

SEQ ID NO: 726533 - DNA, 20 bp, Artificial
  CRISPR gRNA sequence
ccttacaaattgttgaatac

SEQ ID NO: 726534 - DNA, 20 bp, Artificial
  CRISPR gRNA sequence
acaaattgttgaatacctct

SEQ ID NO: 726535 - DNA, 20 bp, Artificial
  CRISPR gRNA sequence
caaattgttgaatacctctt

SEQ ID NO: 726536 - DNA, 20 bp, Artificial
  CRISPR gRNA sequence
ttgaatacctctttcatgaa

SEQ ID NO: 726537 - DNA, 20 bp, Artificial
  CRISPR gRNA sequence
aatacctctttcatgaaatt

SEQ ID NO: 726538 - DNA, 20 bp, Artificial
  CRISPR gRNA sequence
tttcatgaaatttctcagta

SEQ ID NO: 726539 - DNA, 20 bp, Artificial
  CRISPR gRNA sequence
tcatgaaatttctcagtatt

SEQ ID NO: 726540 - DNA, 20 bp, Artificial
  CRISPR gRNA sequence
catgaaatttctcagtattg

SEQ ID NO: 726541 - DNA, 20 bp, Artificial
  CRISPR gRNA sequence
atgaaatttctcagtattgt

SEQ ID NO: 726542 - DNA, 20 bp, Artificial
  CRISPR gRNA sequence
ctcagtattgtaacagccac

SEQ ID NO: 726543 - DNA, 20 bp, Artificial
  CRISPR gRNA sequence
tcagtattgtaacagccact

SEQ ID NO: 726544 - DNA, 20 bp, Artificial
  CRISPR gRNA sequence
agtattgtaacagccacttg

SEQ ID NO: 726545 - DNA, 20 bp, Artificial
  CRISPR gRNA sequence
taacagccacttgtcacatc

SEQ ID NO: 726546 - DNA, 20 bp, Artificial
  CRISPR gRNA sequence
gtcacatccaagcatattcg

SEQ ID NO: 726547 - DNA, 20 bp, Artificial
  CRISPR gRNA sequence
tcacatccaagcatattcga

SEQ ID NO: 726548 - DNA, 20 bp, Artificial
  CRISPR gRNA sequence
gaatgtgatcccccataatt

SEQ ID NO: 726549 - DNA, 20 bp, Artificial
  CRISPR gRNA sequence
gaaactgaactagcattatg

SEQ ID NO: 726550 - DNA, 20 bp, Artificial
  CRISPR gRNA sequence
aaactgaactagcattatgg

SEQ ID NO: 726551 - DNA, 20 bp, Artificial
  CRISPR gRNA sequence
aactagcattatggttgtgt

SEQ ID NO: 726552 - DNA, 20 bp, Artificial
  CRISPR gRNA sequence
gcattatggttgtgtatatt

SEQ ID NO: 726553 - DNA, 20 bp, Artificial
  CRISPR gRNA sequence
tggttgtgtatattatattg

SEQ ID NO: 726554 - DNA, 20 bp, Artificial
  CRISPR gRNA sequence
tgtatattatattgaaaaat

SEQ ID NO: 726555 - DNA, 20 bp, Artificial
  CRISPR gRNA sequence
tattgaaaaatgaaaggata

SEQ ID NO: 726556 - DNA, 20 bp, Artificial
  CRISPR gRNA sequence
aaaaatgaaaggatagaaac

SEQ ID NO: 726557 - DNA, 20 bp, Artificial
  CRISPR gRNA sequence
cttaatgtatgaatgcttga

SEQ ID NO: 726558 - DNA, 20 bp, Artificial
  CRISPR gRNA sequence
ttaatgtatgaatgcttgaa

SEQ ID NO: 726559 - DNA, 20 bp, Artificial
  CRISPR gRNA sequence
aatgtatgaatgcttgaatt

SEQ ID NO: 726560 - DNA, 20 bp, Artificial
  CRISPR gRNA sequence
atgtatgaatgcttgaatta

SEQ ID NO: 726561 - DNA, 20 bp, Artificial
  CRISPR gRNA sequence
gaattaaaagaaagtaatgg

SEQ ID NO: 726562 - DNA, 20 bp, Artificial
  CRISPR gRNA sequence
aattaaaagaaagtaatgga

SEQ ID NO: 726563 - DNA, 20 bp, Artificial
  CRISPR gRNA sequence
aaagaaagtaatggaagaac

SEQ ID NO: 726564 - DNA, 20 bp, Artificial
  CRISPR gRNA sequence
acagatggggaaaaaaaaaa

SEQ ID NO: 726565 - DNA, 20 bp, Artificial
  CRISPR gRNA sequence
ctctgtcatccagcttggag

SEQ ID NO: 726566 - DNA, 20 bp, Artificial
  CRISPR gRNA sequence
tgtcatccagcttggaggat

SEQ ID NO: 726567 - DNA, 20 bp, Artificial
  CRISPR gRNA sequence
tcatccagcttggaggatga

SEQ ID NO: 726568 - DNA, 20 bp, Artificial
  CRISPR gRNA sequence
ggaggatgagattcatggaa

SEQ ID NO: 726569 - DNA, 20 bp, Artificial
  CRISPR gRNA sequence
gaggatgagattcatggaag

SEQ ID NO: 726570 - DNA, 20 bp, Artificial
  CRISPR gRNA sequence
atggaagagtaaagaaaagg

SEQ ID NO: 726571 - DNA, 20 bp, Artificial
  CRISPR gRNA sequence
cctcctgaccagacctggta

SEQ ID NO: 726572 - DNA, 20 bp, Artificial
  CRISPR gRNA sequence
ctcctgaccagacctggtac

SEQ ID NO: 726573 - DNA, 20 bp, Artificial
  CRISPR gRNA sequence
ctgaccagacctggtaccca

SEQ ID NO: 726574 - DNA, 20 bp, Artificial
  CRISPR gRNA sequence
accagacctggtacccaaaa

SEQ ID NO: 726575 - DNA, 20 bp, Artificial
  CRISPR gRNA sequence
gtacccaaaagtggcccaaa

SEQ ID NO: 726576 - DNA, 20 bp, Artificial
  CRISPR gRNA sequence
tgtgcaggcccttctggaaa

SEQ ID NO: 726577 - DNA, 20 bp, Artificial
  CRISPR gRNA sequence
ctggaaattcccggcaggct

SEQ ID NO: 726578 - DNA, 20 bp, Artificial
  CRISPR gRNA sequence
tggaaattcccggcaggctg

SEQ ID NO: 726579 - DNA, 20 bp, Artificial
  CRISPR gRNA sequence
gaaattcccggcaggctgag

SEQ ID NO: 726580 - DNA, 20 bp, Artificial
  CRISPR gRNA sequence
ccggcaggctgagccaggag

SEQ ID NO: 726581 - DNA, 20 bp, Artificial
  CRISPR gRNA sequence
agccaggagctggaggctgc

SEQ ID NO: 726582 - DNA, 20 bp, Artificial
  CRISPR gRNA sequence
gaggctgctatgagggtggg

SEQ ID NO: 726583 - DNA, 20 bp, Artificial
  CRISPR gRNA sequence
ctatgagggtggggctctcc

SEQ ID NO: 726584 - DNA, 20 bp, Artificial
  CRISPR gRNA sequence
tgagggtggggctctccatc

SEQ ID NO: 726585 - DNA, 20 bp, Artificial
  CRISPR gRNA sequence
tccatccttagccaaggcct

SEQ ID NO: 726586 - DNA, 20 bp, Artificial
  CRISPR gRNA sequence
catccttagccaaggcctgg

SEQ ID NO: 726587 - DNA, 20 bp, Artificial
  CRISPR gRNA sequence
agccaaggcctggctgaggc

SEQ ID NO: 726588 - DNA, 20 bp, Artificial
  CRISPR gRNA sequence
gccaaggcctggctgaggcc

SEQ ID NO: 726589 - DNA, 20 bp, Artificial
  CRISPR gRNA sequence
gctgaggccccaggcgaggc

SEQ ID NO: 726590 - DNA, 20 bp, Artificial
  CRISPR gRNA sequence
aggccccaggcgaggcctct

SEQ ID NO: 726591 - DNA, 20 bp, Artificial
  CRISPR gRNA sequence
tgtgcacagaggtccctgtg

SEQ ID NO: 726592 - DNA, 20 bp, Artificial
  CRISPR gRNA sequence
tgcacagaggtccctgtggt

SEQ ID NO: 726593 - DNA, 20 bp, Artificial
  CRISPR gRNA sequence
tggtgggtcagactcagcct

SEQ ID NO: 726594 - DNA, 20 bp, Artificial
  CRISPR gRNA sequence
agcctgaacttgcaggacgg

SEQ ID NO: 726595 - DNA, 20 bp, Artificial
  CRISPR gRNA sequence
aacttgcaggacgggcctgc

SEQ ID NO: 726596 - DNA, 20 bp, Artificial
  CRISPR gRNA sequence
gcaggacgggcctgcaccct

SEQ ID NO: 726597 - DNA, 20 bp, Artificial
  CRISPR gRNA sequence
caggacgggcctgcaccctg

SEQ ID NO: 726598 - DNA, 20 bp, Artificial
  CRISPR gRNA sequence
caccctgggcactgtgggag

SEQ ID NO: 726599 - DNA, 20 bp, Artificial
  CRISPR gRNA sequence
ggcactgtgggaggggaatg

SEQ ID NO: 726600 - DNA, 20 bp, Artificial
  CRISPR gRNA sequence
tgggaggggaatggccagtc

SEQ ID NO: 726601 - DNA, 20 bp, Artificial
  CRISPR gRNA sequence
cctctcccttcccccagcag

SEQ ID NO: 726602 - DNA, 20 bp, Artificial
  CRISPR gRNA sequence
tcccttcccccagcagctct

SEQ ID NO: 726603 - DNA, 20 bp, Artificial
  CRISPR gRNA sequence
ccttcccccagcagctctca

SEQ ID NO: 726604 - DNA, 20 bp, Artificial
  CRISPR gRNA sequence
cccccagcagctctcaaaac

SEQ ID NO: 726605 - DNA, 20 bp, Artificial
  CRISPR gRNA sequence
ccccagcagctctcaaaact

SEQ ID NO: 726606 - DNA, 20 bp, Artificial
  CRISPR gRNA sequence
tcaaaacttcagatctgtta

SEQ ID NO: 726607 - DNA, 20 bp, Artificial
  CRISPR gRNA sequence
aaaacttcagatctgttagg

SEQ ID NO: 726608 - DNA, 20 bp, Artificial
  CRISPR gRNA sequence
cagatctgttagggaaggag

SEQ ID NO: 726609 - DNA, 20 bp, Artificial
  CRISPR gRNA sequence
agatctgttagggaaggagt

SEQ ID NO: 726610 - DNA, 20 bp, Artificial
  CRISPR gRNA sequence
ttagggaaggagtcagattt

SEQ ID NO: 726611 - DNA, 20 bp, Artificial
  CRISPR gRNA sequence
gggaaggagtcagatttagg

SEQ ID NO: 726612 - DNA, 20 bp, Artificial
  CRISPR gRNA sequence
aggggcacgaagctgaggtg

SEQ ID NO: 726613 - DNA, 20 bp, Artificial
  CRISPR gRNA sequence
ggggcacgaagctgaggtgg

SEQ ID NO: 726614 - DNA, 20 bp, Artificial
  CRISPR gRNA sequence
aggtgggggcaagggagggg

SEQ ID NO: 726615 - DNA, 20 bp, Artificial
  CRISPR gRNA sequence
accgttgagctcctcctggg

SEQ ID NO: 726616 - DNA, 20 bp, Artificial
  CRISPR gRNA sequence
ccgttgagctcctcctgggt

SEQ ID NO: 726617 - DNA, 20 bp, Artificial
  CRISPR gRNA sequence
agctcctcctgggtctggaa

SEQ ID NO: 726618 - DNA, 20 bp, Artificial
  CRISPR gRNA sequence
ctcctgggtctggaatctgc

SEQ ID NO: 726619 - DNA, 20 bp, Artificial
  CRISPR gRNA sequence
ctgggtctggaatctgcaaa

SEQ ID NO: 726620 - DNA, 20 bp, Artificial
  CRISPR gRNA sequence
ggtctggaatctgcaaaaag

SEQ ID NO: 726621 - DNA, 20 bp, Artificial
  CRISPR gRNA sequence
gaatctgcaaaaagcaagag

SEQ ID NO: 726622 - DNA, 20 bp, Artificial
  CRISPR gRNA sequence
caaaaagcaagagcagcaac

SEQ ID NO: 726623 - DNA, 20 bp, Artificial
  CRISPR gRNA sequence
caccaaggagtctggcagcc

SEQ ID NO: 726624 - DNA, 20 bp, Artificial
  CRISPR gRNA sequence
accaaggagtctggcagccc

SEQ ID NO: 726625 - DNA, 20 bp, Artificial
  CRISPR gRNA sequence
gcagcccccggccccacccg

SEQ ID NO: 726626 - DNA, 20 bp, Artificial
  CRISPR gRNA sequence
ttggcaaatggtcctcctgg

SEQ ID NO: 726627 - DNA, 20 bp, Artificial
  CRISPR gRNA sequence
gcaaatggtcctcctggatc

SEQ ID NO: 726628 - DNA, 20 bp, Artificial
  CRISPR gRNA sequence
ctggatcacaggtggtgctg

SEQ ID NO: 726629 - DNA, 20 bp, Artificial
  CRISPR gRNA sequence
gatcacaggtggtgctgaac

SEQ ID NO: 726630 - DNA, 20 bp, Artificial
  CRISPR gRNA sequence
aactcagcccaggggtcagg

SEQ ID NO: 726631 - DNA, 20 bp, Artificial
  CRISPR gRNA sequence
agcccaggggtcaggtcctc

SEQ ID NO: 726632 - DNA, 20 bp, Artificial
  CRISPR gRNA sequence
agtctggagagccctcgatg

SEQ ID NO: 726633 - DNA, 20 bp, Artificial
  CRISPR gRNA sequence
gagagccctcgatgggtttc

SEQ ID NO: 726634 - DNA, 20 bp, Artificial
  CRISPR gRNA sequence
gatgggtttcagagtcagtg

SEQ ID NO: 726635 - DNA, 20 bp, Artificial
  CRISPR gRNA sequence
cagagtcagtgcccacccca

SEQ ID NO: 726636 - DNA, 20 bp, Artificial
  CRISPR gRNA sequence
agagtcagtgcccaccccag

SEQ ID NO: 726637 - DNA, 20 bp, Artificial
  CRISPR gRNA sequence
aaggcaaggaggctcacttc

SEQ ID NO: 726638 - DNA, 20 bp, Artificial
  CRISPR gRNA sequence
acttctccagtggcagatgg

SEQ ID NO: 726639 - DNA, 20 bp, Artificial
  CRISPR gRNA sequence
ctccagtggcagatggagga

SEQ ID NO: 726640 - DNA, 20 bp, Artificial
  CRISPR gRNA sequence
tccagtggcagatggaggac

SEQ ID NO: 726641 - DNA, 20 bp, Artificial
  CRISPR gRNA sequence
cagtggcagatggaggacag

SEQ ID NO: 726642 - DNA, 20 bp, Artificial
  CRISPR gRNA sequence
tatcccctggccactctcat

SEQ ID NO: 726643 - DNA, 20 bp, Artificial
  CRISPR gRNA sequence
tcccctggccactctcattc

SEQ ID NO: 726644 - DNA, 20 bp, Artificial
  CRISPR gRNA sequence
gccactctcattcctttttt

SEQ ID NO: 726645 - DNA, 20 bp, Artificial
  CRISPR gRNA sequence
tcattccttttttttttttt

SEQ ID NO: 726646 - DNA, 20 bp, Artificial
  CRISPR gRNA sequence
attccttttttttttttttt

SEQ ID NO: 726647 - DNA, 20 bp, Artificial
  CRISPR gRNA sequence
cttttttttttttttttttg

SEQ ID NO: 726648 - DNA, 20 bp, Artificial
  CRISPR gRNA sequence
ttttttttttttttttgaga

SEQ ID NO: 726649 - DNA, 20 bp, Artificial
  CRISPR gRNA sequence
tttttttttttttttgagat

SEQ ID NO: 726650 - DNA, 20 bp, Artificial
  CRISPR gRNA sequence
ttttttttttttttgagatg

SEQ ID NO: 726651 - DNA, 20 bp, Artificial
  CRISPR gRNA sequence
tttttttttttttgagatgg

SEQ ID NO: 726652 - DNA, 20 bp, Artificial
  CRISPR gRNA sequence
ttttttttttttgagatgga

SEQ ID NO: 726653 - DNA, 20 bp, Artificial
  CRISPR gRNA sequence
tttttttttttgagatggag

SEQ ID NO: 726654 - DNA, 20 bp, Artificial
  CRISPR gRNA sequence
ttttttttttgagatggagt

SEQ ID NO: 726655 - DNA, 20 bp, Artificial
  CRISPR gRNA sequence
tttttttttgagatggagtc

SEQ ID NO: 726656 - DNA, 20 bp, Artificial
  CRISPR gRNA sequence
ttttttttgagatggagtct

SEQ ID NO: 726657 - DNA, 20 bp, Artificial
  CRISPR gRNA sequence
tttttttgagatggagtctc

SEQ ID NO: 726658 - DNA, 20 bp, Artificial
  CRISPR gRNA sequence
ttttttgagatggagtctca

SEQ ID NO: 726659 - DNA, 20 bp, Artificial
  CRISPR gRNA sequence
tttttgagatggagtctcac

SEQ ID NO: 726660 - DNA, 20 bp, Artificial
  CRISPR gRNA sequence
ttttgagatggagtctcact

SEQ ID NO: 726661 - DNA, 20 bp, Artificial
  CRISPR gRNA sequence
tttgagatggagtctcactc

SEQ ID NO: 726662 - DNA, 20 bp, Artificial
  CRISPR gRNA sequence
ttgagatggagtctcactct

SEQ ID NO: 726663 - DNA, 20 bp, Artificial
  CRISPR gRNA sequence
tgagatggagtctcactctg

SEQ ID NO: 726664 - DNA, 20 bp, Artificial
  CRISPR gRNA sequence
gagatggagtctcactctgt

SEQ ID NO: 726665 - DNA, 20 bp, Artificial
  CRISPR gRNA sequence
agatggagtctcactctgtc

SEQ ID NO: 726666 - DNA, 20 bp, Artificial
  CRISPR gRNA sequence
actctgtcacccaggctaga

SEQ ID NO: 726667 - DNA, 20 bp, Artificial
  CRISPR gRNA sequence
tgtcacccaggctagagtgc

SEQ ID NO: 726668 - DNA, 20 bp, Artificial
  CRISPR gRNA sequence
tcacccaggctagagtgcag

SEQ ID NO: 726669 - DNA, 20 bp, Artificial
  CRISPR gRNA sequence
gagtgcagtggcatgatctc

SEQ ID NO: 726670 - DNA, 20 bp, Artificial
  CRISPR gRNA sequence
ggctcaatgtaacctccgcc

SEQ ID NO: 726671 - DNA, 20 bp, Artificial
  CRISPR gRNA sequence
aatgtaacctccgcctcctg

SEQ ID NO: 726672 - DNA, 20 bp, Artificial
  CRISPR gRNA sequence
cgcctcctgggttcaagtga

SEQ ID NO: 726673 - DNA, 20 bp, Artificial
  CRISPR gRNA sequence
ctgggttcaagtgattctca

SEQ ID NO: 726674 - DNA, 20 bp, Artificial
  CRISPR gRNA sequence
ggttcaagtgattctcatgc

SEQ ID NO: 726675 - DNA, 20 bp, Artificial
  CRISPR gRNA sequence
aagtgattctcatgcctcag

SEQ ID NO: 726676 - DNA, 20 bp, Artificial
  CRISPR gRNA sequence
tcatgcctcagcctcccgaa

SEQ ID NO: 726677 - DNA, 20 bp, Artificial
  CRISPR gRNA sequence
atgcctcagcctcccgaata

SEQ ID NO: 726678 - DNA, 20 bp, Artificial
  CRISPR gRNA sequence
agcctcccgaatagctggga

SEQ ID NO: 726679 - DNA, 20 bp, Artificial
  CRISPR gRNA sequence
ccgaatagctgggattatag

SEQ ID NO: 726680 - DNA, 20 bp, Artificial
  CRISPR gRNA sequence
ggattataggctcgtgccac

SEQ ID NO: 726681 - DNA, 20 bp, Artificial
  CRISPR gRNA sequence
taggctcgtgccaccaaccc

SEQ ID NO: 726682 - DNA, 20 bp, Artificial
  CRISPR gRNA sequence
gtgccaccaaccccagctaa

SEQ ID NO: 726683 - DNA, 20 bp, Artificial
  CRISPR gRNA sequence
atttttttgtattttcagta

SEQ ID NO: 726684 - DNA, 20 bp, Artificial
  CRISPR gRNA sequence
ttttgtattttcagtagaga

SEQ ID NO: 726685 - DNA, 20 bp, Artificial
  CRISPR gRNA sequence
tttgtattttcagtagagac

SEQ ID NO: 726686 - DNA, 20 bp, Artificial
  CRISPR gRNA sequence
ttgtattttcagtagagacg

SEQ ID NO: 726687 - DNA, 20 bp, Artificial
  CRISPR gRNA sequence
tgtattttcagtagagacgg

SEQ ID NO: 726688 - DNA, 20 bp, Artificial
  CRISPR gRNA sequence
gtattttcagtagagacggg

SEQ ID NO: 726689 - DNA, 20 bp, Artificial
  CRISPR gRNA sequence
tattttcagtagagacgggg

SEQ ID NO: 726690 - DNA, 20 bp, Artificial
  CRISPR gRNA sequence
tcagtagagacggggtttca

SEQ ID NO: 726691 - DNA, 20 bp, Artificial
  CRISPR gRNA sequence
cagtagagacggggtttcac

SEQ ID NO: 726692 - DNA, 20 bp, Artificial
  CRISPR gRNA sequence
agtagagacggggtttcacc

SEQ ID NO: 726693 - DNA, 20 bp, Artificial
  CRISPR gRNA sequence
caccacgttggccaggccgg

SEQ ID NO: 726694 - DNA, 20 bp, Artificial
  CRISPR gRNA sequence
accacgttggccaggccggt

SEQ ID NO: 726695 - DNA, 20 bp, Artificial
  CRISPR gRNA sequence
gccaggccggtctcaaactc

SEQ ID NO: 726696 - DNA, 20 bp, Artificial
  CRISPR gRNA sequence
aaactcctgacctcctgacc

SEQ ID NO: 726697 - DNA, 20 bp, Artificial
  CRISPR gRNA sequence
ctgacctcctgacctgcccg

SEQ ID NO: 726698 - DNA, 20 bp, Artificial
  CRISPR gRNA sequence
acctcctgacctgcccgcct

SEQ ID NO: 726699 - DNA, 20 bp, Artificial
  CRISPR gRNA sequence
ctgacctgcccgccttggcc

SEQ ID NO: 726700 - DNA, 20 bp, Artificial
  CRISPR gRNA sequence
acctgcccgccttggccttg

SEQ ID NO: 726701 - DNA, 20 bp, Artificial
  CRISPR gRNA sequence
cccgccttggccttgcaaag

SEQ ID NO: 726702 - DNA, 20 bp, Artificial
  CRISPR gRNA sequence
ggccttgcaaagtgctggga

SEQ ID NO: 726703 - DNA, 20 bp, Artificial
  CRISPR gRNA sequence
gccttgcaaagtgctgggat

SEQ ID NO: 726704 - DNA, 20 bp, Artificial
  CRISPR gRNA sequence
gcaaagtgctgggattacag

SEQ ID NO: 726705 - DNA, 20 bp, Artificial
  CRISPR gRNA sequence
caaagtgctgggattacagg

SEQ ID NO: 726706 - DNA, 20 bp, Artificial
  CRISPR gRNA sequence
ggattacaggcgtgagccac

SEQ ID NO: 726707 - DNA, 20 bp, Artificial
  CRISPR gRNA sequence
caggcgtgagccaccacacc

SEQ ID NO: 726708 - DNA, 20 bp, Artificial
  CRISPR gRNA sequence
gctgccactctcattcctaa

SEQ ID NO: 726709 - DNA, 20 bp, Artificial
  CRISPR gRNA sequence
ccactctcattcctaatgac

SEQ ID NO: 726710 - DNA, 20 bp, Artificial
  CRISPR gRNA sequence
tcattcctaatgactaaacc

SEQ ID NO: 726711 - DNA, 20 bp, Artificial
  CRISPR gRNA sequence
attcctaatgactaaaccaa

SEQ ID NO: 726712 - DNA, 20 bp, Artificial
  CRISPR gRNA sequence
ctaatgactaaaccaatgaa

SEQ ID NO: 726713 - DNA, 20 bp, Artificial
  CRISPR gRNA sequence
atgactaaaccaatgaacac

SEQ ID NO: 726714 - DNA, 20 bp, Artificial
  CRISPR gRNA sequence
aaccaatgaacacactgaac

SEQ ID NO: 726715 - DNA, 20 bp, Artificial
  CRISPR gRNA sequence
aaccactctcccaaccccca

SEQ ID NO: 726716 - DNA, 20 bp, Artificial
  CRISPR gRNA sequence
tcccaacccccacccccgcg

SEQ ID NO: 726717 - DNA, 20 bp, Artificial
  CRISPR gRNA sequence
ccaacccccacccccgcgca

SEQ ID NO: 726718 - DNA, 20 bp, Artificial
  CRISPR gRNA sequence
gttcacgagaagcacaggcc

SEQ ID NO: 726719 - DNA, 20 bp, Artificial
  CRISPR gRNA sequence
acgagaagcacaggcccaac

SEQ ID NO: 726720 - DNA, 20 bp, Artificial
  CRISPR gRNA sequence
ccactgggtcagaggctcgt

SEQ ID NO: 726721 - DNA, 20 bp, Artificial
  CRISPR gRNA sequence
cactgggtcagaggctcgtc

SEQ ID NO: 726722 - DNA, 20 bp, Artificial
  CRISPR gRNA sequence
ggtcagaggctcgtctgtgg

SEQ ID NO: 726723 - DNA, 20 bp, Artificial
  CRISPR gRNA sequence
gtctgtggctgctgcgccca

SEQ ID NO: 726724 - DNA, 20 bp, Artificial
  CRISPR gRNA sequence
tggctgctgcgcccacctta

SEQ ID NO: 726725 - DNA, 20 bp, Artificial
  CRISPR gRNA sequence
ctgcgcccaccttactgtct

SEQ ID NO: 726726 - DNA, 20 bp, Artificial
  CRISPR gRNA sequence
cgcccaccttactgtctcca

SEQ ID NO: 726727 - DNA, 20 bp, Artificial
  CRISPR gRNA sequence
actgtctccagggtgtggag

SEQ ID NO: 726728 - DNA, 20 bp, Artificial
  CRISPR gRNA sequence
ctgtctccagggtgtggaga

SEQ ID NO: 726729 - DNA, 20 bp, Artificial
  CRISPR gRNA sequence
tctccagggtgtggagagcc

SEQ ID NO: 726730 - DNA, 20 bp, Artificial
  CRISPR gRNA sequence
cagggtgtggagagccccga

SEQ ID NO: 726731 - DNA, 20 bp, Artificial
  CRISPR gRNA sequence
tctggaataccaggcaaaac

SEQ ID NO: 726732 - DNA, 20 bp, Artificial
  CRISPR gRNA sequence
tggaataccaggcaaaaccc

SEQ ID NO: 726733 - DNA, 20 bp, Artificial
  CRISPR gRNA sequence
gaataccaggcaaaacccac

SEQ ID NO: 726734 - DNA, 20 bp, Artificial
  CRISPR gRNA sequence
aaggcaggtcatggagacag

SEQ ID NO: 726735 - DNA, 20 bp, Artificial
  CRISPR gRNA sequence
cagatgccacctggaccctg

SEQ ID NO: 726736 - DNA, 20 bp, Artificial
  CRISPR gRNA sequence
gaccctgcctgggacacgcc

SEQ ID NO: 726737 - DNA, 20 bp, Artificial
  CRISPR gRNA sequence
cctgggacacgcccgaagcc

SEQ ID NO: 726738 - DNA, 20 bp, Artificial
  CRISPR gRNA sequence
ggacacgcccgaagccagtc

SEQ ID NO: 726739 - DNA, 20 bp, Artificial
  CRISPR gRNA sequence
ctgtggagcccttctgactc

SEQ ID NO: 726740 - DNA, 20 bp, Artificial
  CRISPR gRNA sequence
tggagcccttctgactccag

SEQ ID NO: 726741 - DNA, 20 bp, Artificial
  CRISPR gRNA sequence
ctgactccagctggacttcg

SEQ ID NO: 726742 - DNA, 20 bp, Artificial
  CRISPR gRNA sequence
tgactccagctggacttcga

SEQ ID NO: 726743 - DNA, 20 bp, Artificial
  CRISPR gRNA sequence
actccagctggacttcgatt

SEQ ID NO: 726744 - DNA, 20 bp, Artificial
  CRISPR gRNA sequence
cagctggacttcgattttct

SEQ ID NO: 726745 - DNA, 20 bp, Artificial
  CRISPR gRNA sequence
gacttcgattttctctttct

SEQ ID NO: 726746 - DNA, 20 bp, Artificial
  CRISPR gRNA sequence
cgattttctctttcttgtgc

SEQ ID NO: 726747 - DNA, 20 bp, Artificial
  CRISPR gRNA sequence
gattttctctttcttgtgcc

SEQ ID NO: 726748 - DNA, 20 bp, Artificial
  CRISPR gRNA sequence
tctctttcttgtgcctgaaa

SEQ ID NO: 726749 - DNA, 20 bp, Artificial
  CRISPR gRNA sequence
ctctttcttgtgcctgaaag

SEQ ID NO: 726750 - DNA, 20 bp, Artificial
  CRISPR gRNA sequence
tctttcttgtgcctgaaagc

SEQ ID NO: 726751 - DNA, 20 bp, Artificial
  CRISPR gRNA sequence
tttcttgtgcctgaaagcac

SEQ ID NO: 726752 - DNA, 20 bp, Artificial
  CRISPR gRNA sequence
tcttgtgcctgaaagcaccc

SEQ ID NO: 726753 - DNA, 20 bp, Artificial
  CRISPR gRNA sequence
cttgtgcctgaaagcaccca

SEQ ID NO: 726754 - DNA, 20 bp, Artificial
  CRISPR gRNA sequence
ttgtgcctgaaagcacccag

SEQ ID NO: 726755 - DNA, 20 bp, Artificial
  CRISPR gRNA sequence
gtgcctgaaagcacccaggt

SEQ ID NO: 726756 - DNA, 20 bp, Artificial
  CRISPR gRNA sequence
tgcctgaaagcacccaggtg

SEQ ID NO: 726757 - DNA, 20 bp, Artificial
  CRISPR gRNA sequence
aaagcacccaggtggcagcc

SEQ ID NO: 726758 - DNA, 20 bp, Artificial
  CRISPR gRNA sequence
cgaggaggacaactgctctc

SEQ ID NO: 726759 - DNA, 20 bp, Artificial
  CRISPR gRNA sequence
gaggaggacaactgctctcg

SEQ ID NO: 726760 - DNA, 20 bp, Artificial
  CRISPR gRNA sequence
ctctcgggccatctcatttc

SEQ ID NO: 726761 - DNA, 20 bp, Artificial
  CRISPR gRNA sequence
tcgggccatctcatttcctt

SEQ ID NO: 726762 - DNA, 20 bp, Artificial
  CRISPR gRNA sequence
gggccatctcatttccttca

SEQ ID NO: 726763 - DNA, 20 bp, Artificial
  CRISPR gRNA sequence
atttccttcaatcccatcct

SEQ ID NO: 726764 - DNA, 20 bp, Artificial
  CRISPR gRNA sequence
ccttcaatcccatccttttg

SEQ ID NO: 726765 - DNA, 20 bp, Artificial
  CRISPR gRNA sequence
cttcaatcccatccttttgt

SEQ ID NO: 726766 - DNA, 20 bp, Artificial
  CRISPR gRNA sequence
caatcccatccttttgtagg

SEQ ID NO: 726767 - DNA, 20 bp, Artificial
  CRISPR gRNA sequence
aatcccatccttttgtaggc

SEQ ID NO: 726768 - DNA, 20 bp, Artificial
  CRISPR gRNA sequence
ttgtaggctcaggaggtgct

SEQ ID NO: 726769 - DNA, 20 bp, Artificial
  CRISPR gRNA sequence
tgtaggctcaggaggtgctg

SEQ ID NO: 726770 - DNA, 20 bp, Artificial
  CRISPR gRNA sequence
gtaggctcaggaggtgctga

SEQ ID NO: 726771 - DNA, 20 bp, Artificial
  CRISPR gRNA sequence
taggctcaggaggtgctgat

SEQ ID NO: 726772 - DNA, 20 bp, Artificial
  CRISPR gRNA sequence
aggaggtgctgatacaatga

SEQ ID NO: 726773 - DNA, 20 bp, Artificial
  CRISPR gRNA sequence
atacaatgattctcaacgca

SEQ ID NO: 726774 - DNA, 20 bp, Artificial
  CRISPR gRNA sequence
tcaacgcacaacctctatct

SEQ ID NO: 726775 - DNA, 20 bp, Artificial
  CRISPR gRNA sequence
aacgcacaacctctatcttc

SEQ ID NO: 726776 - DNA, 20 bp, Artificial
  CRISPR gRNA sequence
tatcttctcatctcaaacct

SEQ ID NO: 726777 - DNA, 20 bp, Artificial
  CRISPR gRNA sequence
tcttctcatctcaaacctct

SEQ ID NO: 726778 - DNA, 20 bp, Artificial
  CRISPR gRNA sequence
ctcatctcaaacctctaccc

SEQ ID NO: 726779 - DNA, 20 bp, Artificial
  CRISPR gRNA sequence
tcatctcaaacctctaccct

SEQ ID NO: 726780 - DNA, 20 bp, Artificial
  CRISPR gRNA sequence
atctcaaacctctaccctcc

SEQ ID NO: 726781 - DNA, 20 bp, Artificial
  CRISPR gRNA sequence
aaacctctaccctccactcc

SEQ ID NO: 726782 - DNA, 20 bp, Artificial
  CRISPR gRNA sequence
taccctccactcccattgtt

SEQ ID NO: 726783 - DNA, 20 bp, Artificial
  CRISPR gRNA sequence
ccctccactcccattgttct

SEQ ID NO: 726784 - DNA, 20 bp, Artificial
  CRISPR gRNA sequence
cactcccattgttctcccat

SEQ ID NO: 726785 - DNA, 20 bp, Artificial
  CRISPR gRNA sequence
ccattgttctcccatattaa

SEQ ID NO: 726786 - DNA, 20 bp, Artificial
  CRISPR gRNA sequence
ttctcccatattaaacaggg

SEQ ID NO: 726787 - DNA, 20 bp, Artificial
  CRISPR gRNA sequence
tcccatattaaacaggggcc

SEQ ID NO: 726788 - DNA, 20 bp, Artificial
  CRISPR gRNA sequence
ccatattaaacaggggccag

SEQ ID NO: 726789 - DNA, 20 bp, Artificial
  CRISPR gRNA sequence
aacaggggccaggtcacgcc

SEQ ID NO: 726790 - DNA, 20 bp, Artificial
  CRISPR gRNA sequence
acatttaacatttaaccttg

SEQ ID NO: 726791 - DNA, 20 bp, Artificial
  CRISPR gRNA sequence
aacatttaaccttggctcac

SEQ ID NO: 726792 - DNA, 20 bp, Artificial
  CRISPR gRNA sequence
acatttaaccttggctcact

SEQ ID NO: 726793 - DNA, 20 bp, Artificial
  CRISPR gRNA sequence
aaccttggctcactggccat

SEQ ID NO: 726794 - DNA, 20 bp, Artificial
  CRISPR gRNA sequence
accttggctcactggccatc

SEQ ID NO: 726795 - DNA, 20 bp, Artificial
  CRISPR gRNA sequence
ggctcactggccatctgaga

SEQ ID NO: 726796 - DNA, 20 bp, Artificial
  CRISPR gRNA sequence
gctcactggccatctgagaa

SEQ ID NO: 726797 - DNA, 20 bp, Artificial
  CRISPR gRNA sequence
actggccatctgagaaaggt

SEQ ID NO: 726798 - DNA, 20 bp, Artificial
  CRISPR gRNA sequence
gccatctgagaaaggtgaga

SEQ ID NO: 726799 - DNA, 20 bp, Artificial
  CRISPR gRNA sequence
agaaaggtgagagggcatcc

SEQ ID NO: 726800 - DNA, 20 bp, Artificial
  CRISPR gRNA sequence
actcatcctggagcaagtca

SEQ ID NO: 726801 - DNA, 20 bp, Artificial
  CRISPR gRNA sequence
atcctggagcaagtcagttc

SEQ ID NO: 726802 - DNA, 20 bp, Artificial
  CRISPR gRNA sequence
gagcaagtcagttcccagag

SEQ ID NO: 726803 - DNA, 20 bp, Artificial
  CRISPR gRNA sequence
ccagagcagaccatcctcca

SEQ ID NO: 726804 - DNA, 20 bp, Artificial
  CRISPR gRNA sequence
cagggatgcccagcttttaa

SEQ ID NO: 726805 - DNA, 20 bp, Artificial
  CRISPR gRNA sequence
ttaaccactcctgagaacgc

SEQ ID NO: 726806 - DNA, 20 bp, Artificial
  CRISPR gRNA sequence
taaccactcctgagaacgct

SEQ ID NO: 726807 - DNA, 20 bp, Artificial
  CRISPR gRNA sequence
aaccactcctgagaacgcta

SEQ ID NO: 726808 - DNA, 20 bp, Artificial
  CRISPR gRNA sequence
accactcctgagaacgctac

SEQ ID NO: 726809 - DNA, 20 bp, Artificial
  CRISPR gRNA sequence
ctgagaacgctacctacgga

SEQ ID NO: 726810 - DNA, 20 bp, Artificial
  CRISPR gRNA sequence
agaacgctacctacggagat

SEQ ID NO: 726811 - DNA, 20 bp, Artificial
  CRISPR gRNA sequence
cctacggagatctggaatat

SEQ ID NO: 726812 - DNA, 20 bp, Artificial
  CRISPR gRNA sequence
cggagatctggaatatgctg

SEQ ID NO: 726813 - DNA, 20 bp, Artificial
  CRISPR gRNA sequence
gaatatgctgttgtcaggca

SEQ ID NO: 726814 - DNA, 20 bp, Artificial
  CRISPR gRNA sequence
ttgtcaggcacacatccctg

SEQ ID NO: 726815 - DNA, 20 bp, Artificial
  CRISPR gRNA sequence
tcaggcacacatccctggct

SEQ ID NO: 726816 - DNA, 20 bp, Artificial
  CRISPR gRNA sequence
gctagacaaatctgccacca

SEQ ID NO: 726817 - DNA, 20 bp, Artificial
  CRISPR gRNA sequence
gacaaatctgccaccaagat

SEQ ID NO: 726818 - DNA, 20 bp, Artificial
  CRISPR gRNA sequence
ccaccaagatgcccgtatgt

SEQ ID NO: 726819 - DNA, 20 bp, Artificial
  CRISPR gRNA sequence
ctgcacacatctctgacttc

SEQ ID NO: 726820 - DNA, 20 bp, Artificial
  CRISPR gRNA sequence
cacacatctctgacttcagc

SEQ ID NO: 726821 - DNA, 20 bp, Artificial
  CRISPR gRNA sequence
tgacttcagcagctctggag

SEQ ID NO: 726822 - DNA, 20 bp, Artificial
  CRISPR gRNA sequence
acttcagcagctctggagag

SEQ ID NO: 726823 - DNA, 20 bp, Artificial
  CRISPR gRNA sequence
cagcagctctggagagccac

SEQ ID NO: 726824 - DNA, 20 bp, Artificial
  CRISPR gRNA sequence
agcagctctggagagccacc

SEQ ID NO: 726825 - DNA, 20 bp, Artificial
  CRISPR gRNA sequence
tggagagccaccagccctga

SEQ ID NO: 726826 - DNA, 20 bp, Artificial
  CRISPR gRNA sequence
gagagccaccagccctgagt

SEQ ID NO: 726827 - DNA, 20 bp, Artificial
  CRISPR gRNA sequence
agtcctcacagatatgctca

SEQ ID NO: 726828 - DNA, 20 bp, Artificial
  CRISPR gRNA sequence
acagatatgctcaccagtgc

SEQ ID NO: 726829 - DNA, 20 bp, Artificial
  CRISPR gRNA sequence
accagtgctcagtcaacaag

SEQ ID NO: 726830 - DNA, 20 bp, Artificial
  CRISPR gRNA sequence
agtcaacaagtaggataaag

SEQ ID NO: 726831 - DNA, 20 bp, Artificial
  CRISPR gRNA sequence
accatttgaacacgctgtgt

SEQ ID NO: 726832 - DNA, 20 bp, Artificial
  CRISPR gRNA sequence
gaacacgctgtgtggacact

SEQ ID NO: 726833 - DNA, 20 bp, Artificial
  CRISPR gRNA sequence
aacacgctgtgtggacacta

SEQ ID NO: 726834 - DNA, 20 bp, Artificial
  CRISPR gRNA sequence
tgtggacactaggtgagttt

SEQ ID NO: 726835 - DNA, 20 bp, Artificial
  CRISPR gRNA sequence
ggtgagtttgggaaacactc

SEQ ID NO: 726836 - DNA, 20 bp, Artificial
  CRISPR gRNA sequence
gggaaacactcttaggggta

SEQ ID NO: 726837 - DNA, 20 bp, Artificial
  CRISPR gRNA sequence
ggaaacactcttaggggtaa

SEQ ID NO: 726838 - DNA, 20 bp, Artificial
  CRISPR gRNA sequence
ttaggggtaattttttcttt

SEQ ID NO: 726839 - DNA, 20 bp, Artificial
  CRISPR gRNA sequence
aggggtaattttttcttttt

SEQ ID NO: 726840 - DNA, 20 bp, Artificial
  CRISPR gRNA sequence
ggggtaattttttctttttt

SEQ ID NO: 726841 - DNA, 20 bp, Artificial
  CRISPR gRNA sequence
tttctttttttgagacagag

SEQ ID NO: 726842 - DNA, 20 bp, Artificial
  CRISPR gRNA sequence
ttctttttttgagacagagt

SEQ ID NO: 726843 - DNA, 20 bp, Artificial
  CRISPR gRNA sequence
tctttttttgagacagagtc

SEQ ID NO: 726844 - DNA, 20 bp, Artificial
  CRISPR gRNA sequence
ctttttttgagacagagtct

SEQ ID NO: 726845 - DNA, 20 bp, Artificial
  CRISPR gRNA sequence
tttttttgagacagagtctc

SEQ ID NO: 726846 - DNA, 20 bp, Artificial
  CRISPR gRNA sequence
tttttgagacagagtctcac

SEQ ID NO: 726847 - DNA, 20 bp, Artificial
  CRISPR gRNA sequence
ttttgagacagagtctcact

SEQ ID NO: 726848 - DNA, 20 bp, Artificial
  CRISPR gRNA sequence
tttgagacagagtctcactc

SEQ ID NO: 726849 - DNA, 20 bp, Artificial
  CRISPR gRNA sequence
ttgagacagagtctcactct

SEQ ID NO: 726850 - DNA, 20 bp, Artificial
  CRISPR gRNA sequence
tgagacagagtctcactctg

SEQ ID NO: 726851 - DNA, 20 bp, Artificial
  CRISPR gRNA sequence
gagacagagtctcactctgt

SEQ ID NO: 726852 - DNA, 20 bp, Artificial
  CRISPR gRNA sequence
agacagagtctcactctgtc

SEQ ID NO: 726853 - DNA, 20 bp, Artificial
  CRISPR gRNA sequence
actctgtcacccaggctgga

SEQ ID NO: 726854 - DNA, 20 bp, Artificial
  CRISPR gRNA sequence
tgtcacccaggctggagtgc

SEQ ID NO: 726855 - DNA, 20 bp, Artificial
  CRISPR gRNA sequence
tcacccaggctggagtgcag

SEQ ID NO: 726856 - DNA, 20 bp, Artificial
  CRISPR gRNA sequence
gagtgcagtggcacgatctt

SEQ ID NO: 726857 - DNA, 20 bp, Artificial
  CRISPR gRNA sequence
ggctcactgcaacctctgcc

SEQ ID NO: 726858 - DNA, 20 bp, Artificial
  CRISPR gRNA sequence
gctcactgcaacctctgcct

SEQ ID NO: 726859 - DNA, 20 bp, Artificial
  CRISPR gRNA sequence
actgcaacctctgcctcaca

SEQ ID NO: 726860 - DNA, 20 bp, Artificial
  CRISPR gRNA sequence
caacctctgcctcacaggtt

SEQ ID NO: 726861 - DNA, 20 bp, Artificial
  CRISPR gRNA sequence
tgcctcacaggtttaagcaa

SEQ ID NO: 726862 - DNA, 20 bp, Artificial
  CRISPR gRNA sequence
cctcacaggtttaagcaatt

SEQ ID NO: 726863 - DNA, 20 bp, Artificial
  CRISPR gRNA sequence
acaggtttaagcaattctca

SEQ ID NO: 726864 - DNA, 20 bp, Artificial
  CRISPR gRNA sequence
aagcaattctcacaagtagc

SEQ ID NO: 726865 - DNA, 20 bp, Artificial
  CRISPR gRNA sequence
agcaattctcacaagtagct

SEQ ID NO: 726866 - DNA, 20 bp, Artificial
  CRISPR gRNA sequence
tcacaagtagctgggattac

SEQ ID NO: 726867 - DNA, 20 bp, Artificial
  CRISPR gRNA sequence
acaagtagctgggattaccg

SEQ ID NO: 726868 - DNA, 20 bp, Artificial
  CRISPR gRNA sequence
ggattaccgacatgtgccac

SEQ ID NO: 726869 - DNA, 20 bp, Artificial
  CRISPR gRNA sequence
ccgacatgtgccaccacgcc

SEQ ID NO: 726870 - DNA, 20 bp, Artificial
  CRISPR gRNA sequence
atttttgtatttttagtaga

SEQ ID NO: 726871 - DNA, 20 bp, Artificial
  CRISPR gRNA sequence
ttgtatttttagtagaaaca

SEQ ID NO: 726872 - DNA, 20 bp, Artificial
  CRISPR gRNA sequence
tgtatttttagtagaaacaa

SEQ ID NO: 726873 - DNA, 20 bp, Artificial
  CRISPR gRNA sequence
gtatttttagtagaaacaag

SEQ ID NO: 726874 - DNA, 20 bp, Artificial
  CRISPR gRNA sequence
tatttttagtagaaacaagg

SEQ ID NO: 726875 - DNA, 20 bp, Artificial
  CRISPR gRNA sequence
ttagtagaaacaaggtttca

SEQ ID NO: 726876 - DNA, 20 bp, Artificial
  CRISPR gRNA sequence
tagtagaaacaaggtttcac

SEQ ID NO: 726877 - DNA, 20 bp, Artificial
  CRISPR gRNA sequence
agtagaaacaaggtttcacc

SEQ ID NO: 726878 - DNA, 20 bp, Artificial
  CRISPR gRNA sequence
gtagaaacaaggtttcacca

SEQ ID NO: 726879 - DNA, 20 bp, Artificial
  CRISPR gRNA sequence
caccatgttggccaggttgg

SEQ ID NO: 726880 - DNA, 20 bp, Artificial
  CRISPR gRNA sequence
accatgttggccaggttggt

SEQ ID NO: 726881 - DNA, 20 bp, Artificial
  CRISPR gRNA sequence
gccaggttggtctccaactc

SEQ ID NO: 726882 - DNA, 20 bp, Artificial
  CRISPR gRNA sequence
gtctccaactcctgacctca

SEQ ID NO: 726883 - DNA, 20 bp, Artificial
  CRISPR gRNA sequence
caactcctgacctcaggtga

SEQ ID NO: 726884 - DNA, 20 bp, Artificial
  CRISPR gRNA sequence
ctgacctcaggtgatctgcc

SEQ ID NO: 726885 - DNA, 20 bp, Artificial
  CRISPR gRNA sequence
acctcaggtgatctgcccgc

SEQ ID NO: 726886 - DNA, 20 bp, Artificial
  CRISPR gRNA sequence
aggtgatctgcccgcctcgg

SEQ ID NO: 726887 - DNA, 20 bp, Artificial
  CRISPR gRNA sequence
cccgcctcggcctctcgaag

SEQ ID NO: 726888 - DNA, 20 bp, Artificial
  CRISPR gRNA sequence
ggcctctcgaagtgctggga

SEQ ID NO: 726889 - DNA, 20 bp, Artificial
  CRISPR gRNA sequence
tcgaagtgctgggattacag

SEQ ID NO: 726890 - DNA, 20 bp, Artificial
  CRISPR gRNA sequence
gaagtgctgggattacaggc

SEQ ID NO: 726891 - DNA, 20 bp, Artificial
  CRISPR gRNA sequence
ggattacaggcatgagccac

SEQ ID NO: 726892 - DNA, 20 bp, Artificial
  CRISPR gRNA sequence
caggcatgagccaccttgcc

SEQ ID NO: 726893 - DNA, 20 bp, Artificial
  CRISPR gRNA sequence
gcccggccaggggtaatttt

SEQ ID NO: 726894 - DNA, 20 bp, Artificial
  CRISPR gRNA sequence
cccggccaggggtaattttt

SEQ ID NO: 726895 - DNA, 20 bp, Artificial
  CRISPR gRNA sequence
tttttttttttttttttttt

SEQ ID NO: 726896 - DNA, 20 bp, Artificial
  CRISPR gRNA sequence
tttttttttttttttttttt

SEQ ID NO: 726897 - DNA, 20 bp, Artificial
  CRISPR gRNA sequence
tttttttttttttttttttg

SEQ ID NO: 726898 - DNA, 20 bp, Artificial
  CRISPR gRNA sequence
ttttttttttttttttttga

SEQ ID NO: 726899 - DNA, 20 bp, Artificial
  CRISPR gRNA sequence
tttttttttttttttttgag

SEQ ID NO: 726900 - DNA, 20 bp, Artificial
  CRISPR gRNA sequence
ttttttttttttttttgaga

SEQ ID NO: 726901 - DNA, 20 bp, Artificial
  CRISPR gRNA sequence
tttttttttttttttgagat

SEQ ID NO: 726902 - DNA, 20 bp, Artificial
  CRISPR gRNA sequence
ttttttttttttttgagatg

SEQ ID NO: 726903 - DNA, 20 bp, Artificial
  CRISPR gRNA sequence
tttttttttttttgagatgg

SEQ ID NO: 726904 - DNA, 20 bp, Artificial
  CRISPR gRNA sequence
ttttttttttttgagatgga

SEQ ID NO: 726905 - DNA, 20 bp, Artificial
  CRISPR gRNA sequence
tttttttttttgagatggag

SEQ ID NO: 726906 - DNA, 20 bp, Artificial
  CRISPR gRNA sequence
ttttttttttgagatggagt

SEQ ID NO: 726907 - DNA, 20 bp, Artificial
  CRISPR gRNA sequence
tttttttttgagatggagtc

SEQ ID NO: 726908 - DNA, 20 bp, Artificial
  CRISPR gRNA sequence
ttttttttgagatggagtct

SEQ ID NO: 726909 - DNA, 20 bp, Artificial
  CRISPR gRNA sequence
tttttttgagatggagtcta

SEQ ID NO: 726910 - DNA, 20 bp, Artificial
  CRISPR gRNA sequence
ttttttgagatggagtctaa

SEQ ID NO: 726911 - DNA, 20 bp, Artificial
  CRISPR gRNA sequence
tttttgagatggagtctaac

SEQ ID NO: 726912 - DNA, 20 bp, Artificial
  CRISPR gRNA sequence
ttttgagatggagtctaact

SEQ ID NO: 726913 - DNA, 20 bp, Artificial
  CRISPR gRNA sequence
tttgagatggagtctaactc

SEQ ID NO: 726914 - DNA, 20 bp, Artificial
  CRISPR gRNA sequence
ttgagatggagtctaactct

SEQ ID NO: 726915 - DNA, 20 bp, Artificial
  CRISPR gRNA sequence
tgagatggagtctaactctg

SEQ ID NO: 726916 - DNA, 20 bp, Artificial
  CRISPR gRNA sequence
gagatggagtctaactctgt

SEQ ID NO: 726917 - DNA, 20 bp, Artificial
  CRISPR gRNA sequence
agatggagtctaactctgtc

SEQ ID NO: 726918 - DNA, 20 bp, Artificial
  CRISPR gRNA sequence
actctgtcgccagggtgaag

SEQ ID NO: 726919 - DNA, 20 bp, Artificial
  CRISPR gRNA sequence
tgtcgccagggtgaagtgca

SEQ ID NO: 726920 - DNA, 20 bp, Artificial
  CRISPR gRNA sequence
tcgccagggtgaagtgcagc

SEQ ID NO: 726921 - DNA, 20 bp, Artificial
  CRISPR gRNA sequence
ggctcactgcaacctccgcc

SEQ ID NO: 726922 - DNA, 20 bp, Artificial
  CRISPR gRNA sequence
actgcaacctccgcctcctg

SEQ ID NO: 726923 - DNA, 20 bp, Artificial
  CRISPR gRNA sequence
caacctccgcctcctgggtt

SEQ ID NO: 726924 - DNA, 20 bp, Artificial
  CRISPR gRNA sequence
cgcctcctgggttcaagcga

SEQ ID NO: 726925 - DNA, 20 bp, Artificial
  CRISPR gRNA sequence
ctgggttcaagcgattctcc

SEQ ID NO: 726926 - DNA, 20 bp, Artificial
  CRISPR gRNA sequence
ggttcaagcgattctcctgc

SEQ ID NO: 726927 - DNA, 20 bp, Artificial
  CRISPR gRNA sequence
aagcgattctcctgcctcag

SEQ ID NO: 726928 - DNA, 20 bp, Artificial
  CRISPR gRNA sequence
tcctgcctcagcctcccgag

SEQ ID NO: 726929 - DNA, 20 bp, Artificial
  CRISPR gRNA sequence
ctgcctcagcctcccgagta

SEQ ID NO: 726930 - DNA, 20 bp, Artificial
  CRISPR gRNA sequence
cctcagcctcccgagtagct

SEQ ID NO: 726931 - DNA, 20 bp, Artificial
  CRISPR gRNA sequence
agcctcccgagtagctggga

SEQ ID NO: 726932 - DNA, 20 bp, Artificial
  CRISPR gRNA sequence
ccgagtagctgggattacag

SEQ ID NO: 726933 - DNA, 20 bp, Artificial
  CRISPR gRNA sequence
ggattacaggcacgcaccac

SEQ ID NO: 726934 - DNA, 20 bp, Artificial
  CRISPR gRNA sequence
caggcacgcaccaccatgct

SEQ ID NO: 726935 - DNA, 20 bp, Artificial
  CRISPR gRNA sequence
agctaatttttgtattttta

SEQ ID NO: 726936 - DNA, 20 bp, Artificial
  CRISPR gRNA sequence
atttttgtatttttagtaga

SEQ ID NO: 726937 - DNA, 20 bp, Artificial
  CRISPR gRNA sequence
ttgtatttttagtagagacg

SEQ ID NO: 726938 - DNA, 20 bp, Artificial
  CRISPR gRNA sequence
tgtatttttagtagagacgg

SEQ ID NO: 726939 - DNA, 20 bp, Artificial
  CRISPR gRNA sequence
gtatttttagtagagacggg

SEQ ID NO: 726940 - DNA, 20 bp, Artificial
  CRISPR gRNA sequence
tatttttagtagagacgggg

SEQ ID NO: 726941 - DNA, 20 bp, Artificial
  CRISPR gRNA sequence
ttagtagagacggggtttca

SEQ ID NO: 726942 - DNA, 20 bp, Artificial
  CRISPR gRNA sequence
tagtagagacggggtttcac

SEQ ID NO: 726943 - DNA, 20 bp, Artificial
  CRISPR gRNA sequence
agtagagacggggtttcacc

SEQ ID NO: 726944 - DNA, 20 bp, Artificial
  CRISPR gRNA sequence
gtagagacggggtttcacca

SEQ ID NO: 726945 - DNA, 20 bp, Artificial
  CRISPR gRNA sequence
caccatgttggccaggctgg

SEQ ID NO: 726946 - DNA, 20 bp, Artificial
  CRISPR gRNA sequence
accatgttggccaggctggt

SEQ ID NO: 726947 - DNA, 20 bp, Artificial
  CRISPR gRNA sequence
gccaggctggtctcgatctc

SEQ ID NO: 726948 - DNA, 20 bp, Artificial
  CRISPR gRNA sequence
gtctcgatctcttgacctcg

SEQ ID NO: 726949 - DNA, 20 bp, Artificial
  CRISPR gRNA sequence
gatctcttgacctcgtgatc

SEQ ID NO: 726950 - DNA, 20 bp, Artificial
  CRISPR gRNA sequence
ttgacctcgtgatccacccg

SEQ ID NO: 726951 - DNA, 20 bp, Artificial
  CRISPR gRNA sequence
gacctcgtgatccacccgcc

SEQ ID NO: 726952 - DNA, 20 bp, Artificial
  CRISPR gRNA sequence
acctcgtgatccacccgcct

SEQ ID NO: 726953 - DNA, 20 bp, Artificial
  CRISPR gRNA sequence
gtgatccacccgcctcggcc

SEQ ID NO: 726954 - DNA, 20 bp, Artificial
  CRISPR gRNA sequence
ggcctcccaaagtgctggga

SEQ ID NO: 726955 - DNA, 20 bp, Artificial
  CRISPR gRNA sequence
ccaaagtgctgggattacag

SEQ ID NO: 726956 - DNA, 20 bp, Artificial
  CRISPR gRNA sequence
ggattacaggcgtgagccac

SEQ ID NO: 726957 - DNA, 20 bp, Artificial
  CRISPR gRNA sequence
caggcgtgagccacggcacc

SEQ ID NO: 726958 - DNA, 20 bp, Artificial
  CRISPR gRNA sequence
ttttcaatgacgtcagtgaa

SEQ ID NO: 726959 - DNA, 20 bp, Artificial
  CRISPR gRNA sequence
ttcaatgacgtcagtgaaac

SEQ ID NO: 726960 - DNA, 20 bp, Artificial
  CRISPR gRNA sequence
tcaatgacgtcagtgaaact

SEQ ID NO: 726961 - DNA, 20 bp, Artificial
  CRISPR gRNA sequence
caatgacgtcagtgaaacta

SEQ ID NO: 726962 - DNA, 20 bp, Artificial
  CRISPR gRNA sequence
aatgacgtcagtgaaactaa

SEQ ID NO: 726963 - DNA, 20 bp, Artificial
  CRISPR gRNA sequence
aatcatggtccctccagagt

SEQ ID NO: 726964 - DNA, 20 bp, Artificial
  CRISPR gRNA sequence
cagagtgattttgagtttta

SEQ ID NO: 726965 - DNA, 20 bp, Artificial
  CRISPR gRNA sequence
tgagttttacaagcagccaa

SEQ ID NO: 726966 - DNA, 20 bp, Artificial
  CRISPR gRNA sequence
gagttttacaagcagccaac

SEQ ID NO: 726967 - DNA, 20 bp, Artificial
  CRISPR gRNA sequence
agttttacaagcagccaact

SEQ ID NO: 726968 - DNA, 20 bp, Artificial
  CRISPR gRNA sequence
tacaagcagccaactgttct

SEQ ID NO: 726969 - DNA, 20 bp, Artificial
  CRISPR gRNA sequence
acaagcagccaactgttctt

SEQ ID NO: 726970 - DNA, 20 bp, Artificial
  CRISPR gRNA sequence
caagcagccaactgttcttt

SEQ ID NO: 726971 - DNA, 20 bp, Artificial
  CRISPR gRNA sequence
ttctttggtaccaagtcact

SEQ ID NO: 726972 - DNA, 20 bp, Artificial
  CRISPR gRNA sequence
tttggtaccaagtcactggg

SEQ ID NO: 726973 - DNA, 20 bp, Artificial
  CRISPR gRNA sequence
tggtaccaagtcactggggg

SEQ ID NO: 726974 - DNA, 20 bp, Artificial
  CRISPR gRNA sequence
ggtaccaagtcactgggggt

SEQ ID NO: 726975 - DNA, 20 bp, Artificial
  CRISPR gRNA sequence
gtaccaagtcactgggggtg

SEQ ID NO: 726976 - DNA, 20 bp, Artificial
  CRISPR gRNA sequence
ggggtggccaacagaataaa

SEQ ID NO: 726977 - DNA, 20 bp, Artificial
  CRISPR gRNA sequence
ggccttgaaggggaagtggg

SEQ ID NO: 726978 - DNA, 20 bp, Artificial
  CRISPR gRNA sequence
gaaggggaagtgggtgaacg

SEQ ID NO: 726979 - DNA, 20 bp, Artificial
  CRISPR gRNA sequence
aaggggaagtgggtgaacgg

SEQ ID NO: 726980 - DNA, 20 bp, Artificial
  CRISPR gRNA sequence
cccataccctgcaggctggt

SEQ ID NO: 726981 - DNA, 20 bp, Artificial
  CRISPR gRNA sequence
caggctggttccatttttct

SEQ ID NO: 726982 - DNA, 20 bp, Artificial
  CRISPR gRNA sequence
gttccatttttctaaagagc

SEQ ID NO: 726983 - DNA, 20 bp, Artificial
  CRISPR gRNA sequence
catttttctaaagagccatc

SEQ ID NO: 726984 - DNA, 20 bp, Artificial
  CRISPR gRNA sequence
ttctaaagagccatctggca

SEQ ID NO: 726985 - DNA, 20 bp, Artificial
  CRISPR gRNA sequence
tctaaagagccatctggcaa

SEQ ID NO: 726986 - DNA, 20 bp, Artificial
  CRISPR gRNA sequence
ctaaagagccatctggcaac

SEQ ID NO: 726987 - DNA, 20 bp, Artificial
  CRISPR gRNA sequence
taaagagccatctggcaaca

SEQ ID NO: 726988 - DNA, 20 bp, Artificial
  CRISPR gRNA sequence
aagagccatctggcaacaaa

SEQ ID NO: 726989 - DNA, 20 bp, Artificial
  CRISPR gRNA sequence
gcaacaaaaacctcacactc

SEQ ID NO: 726990 - DNA, 20 bp, Artificial
  CRISPR gRNA sequence
acactctttacccagtcatc

SEQ ID NO: 726991 - DNA, 20 bp, Artificial
  CRISPR gRNA sequence
tttacccagtcatccctctt

SEQ ID NO: 726992 - DNA, 20 bp, Artificial
  CRISPR gRNA sequence
tacccagtcatccctcttga

SEQ ID NO: 726993 - DNA, 20 bp, Artificial
  CRISPR gRNA sequence
acccagtcatccctcttgag

SEQ ID NO: 726994 - DNA, 20 bp, Artificial
  CRISPR gRNA sequence
cccagtcatccctcttgagg

SEQ ID NO: 726995 - DNA, 20 bp, Artificial
  CRISPR gRNA sequence
ttgagggaacacaccctcag

SEQ ID NO: 726996 - DNA, 20 bp, Artificial
  CRISPR gRNA sequence
gagggaacacaccctcagga

SEQ ID NO: 726997 - DNA, 20 bp, Artificial
  CRISPR gRNA sequence
agggaacacaccctcaggaa

SEQ ID NO: 726998 - DNA, 20 bp, Artificial
  CRISPR gRNA sequence
aggaaataacccgaaagaaa

SEQ ID NO: 726999 - DNA, 20 bp, Artificial
  CRISPR gRNA sequence
ataataaccctcaaattgaa

SEQ ID NO: 727000 - DNA, 20 bp, Artificial
  CRISPR gRNA sequence
taataaccctcaaattgaaa

SEQ ID NO: 727001 - DNA, 20 bp, Artificial
  CRISPR gRNA sequence
aaattgaaaaccagccaaat

SEQ ID NO: 727002 - DNA, 20 bp, Artificial
  CRISPR gRNA sequence
aaaaccagccaaatgtcaaa

SEQ ID NO: 727003 - DNA, 20 bp, Artificial
  CRISPR gRNA sequence
agccaccctggagcaggggc

SEQ ID NO: 727004 - DNA, 20 bp, Artificial
  CRISPR gRNA sequence
gccaccctggagcaggggcc

SEQ ID NO: 727005 - DNA, 20 bp, Artificial
  CRISPR gRNA sequence
gagcaggggcctccttggcg

SEQ ID NO: 727006 - DNA, 20 bp, Artificial
  CRISPR gRNA sequence
cttggcggtgaaactcagca

SEQ ID NO: 727007 - DNA, 20 bp, Artificial
  CRISPR gRNA sequence
ggcggtgaaactcagcacaa

SEQ ID NO: 727008 - DNA, 20 bp, Artificial
  CRISPR gRNA sequence
gcggtgaaactcagcacaat

SEQ ID NO: 727009 - DNA, 20 bp, Artificial
  CRISPR gRNA sequence
agcacaatattacttccctt

SEQ ID NO: 727010 - DNA, 20 bp, Artificial
  CRISPR gRNA sequence
cttcccttctccgagcctct

SEQ ID NO: 727011 - DNA, 20 bp, Artificial
  CRISPR gRNA sequence
cccttctccgagcctctgtc

SEQ ID NO: 727012 - DNA, 20 bp, Artificial
  CRISPR gRNA sequence
ccttctccgagcctctgtcc

SEQ ID NO: 727013 - DNA, 20 bp, Artificial
  CRISPR gRNA sequence
ctccgagcctctgtcctccc

SEQ ID NO: 727014 - DNA, 20 bp, Artificial
  CRISPR gRNA sequence
tccgagcctctgtcctccca

SEQ ID NO: 727015 - DNA, 20 bp, Artificial
  CRISPR gRNA sequence
cgagcctctgtcctcccagc

SEQ ID NO: 727016 - DNA, 20 bp, Artificial
  CRISPR gRNA sequence
tgtcctcccagctggaaaat

SEQ ID NO: 727017 - DNA, 20 bp, Artificial
  CRISPR gRNA sequence
tcctcccagctggaaaatgg

SEQ ID NO: 727018 - DNA, 20 bp, Artificial
  CRISPR gRNA sequence
ccagctggaaaatgggatga

SEQ ID NO: 727019 - DNA, 20 bp, Artificial
  CRISPR gRNA sequence
gaaaatgggatgaatcacat

SEQ ID NO: 727020 - DNA, 20 bp, Artificial
  CRISPR gRNA sequence
tggggcttgttgagaagatt

SEQ ID NO: 727021 - DNA, 20 bp, Artificial
  CRISPR gRNA sequence
ggggcttgttgagaagatta

SEQ ID NO: 727022 - DNA, 20 bp, Artificial
  CRISPR gRNA sequence
gggcttgttgagaagattaa

SEQ ID NO: 727023 - DNA, 20 bp, Artificial
  CRISPR gRNA sequence
gttgagaagattaaaagaga

SEQ ID NO: 727024 - DNA, 20 bp, Artificial
  CRISPR gRNA sequence
ttgagaagattaaaagagat

SEQ ID NO: 727025 - DNA, 20 bp, Artificial
  CRISPR gRNA sequence
agaagattaaaagagatatc

SEQ ID NO: 727026 - DNA, 20 bp, Artificial
  CRISPR gRNA sequence
aaagagatatcaaaagtgaa

SEQ ID NO: 727027 - DNA, 20 bp, Artificial
  CRISPR gRNA sequence
attttttttttttttttttt

SEQ ID NO: 727028 - DNA, 20 bp, Artificial
  CRISPR gRNA sequence
tttttttttttttttttttt

SEQ ID NO: 727029 - DNA, 20 bp, Artificial
  CRISPR gRNA sequence
tttttttttttttttttttt

SEQ ID NO: 727030 - DNA, 20 bp, Artificial
  CRISPR gRNA sequence
tttttttttttttttttttt

SEQ ID NO: 727031 - DNA, 20 bp, Artificial
  CRISPR gRNA sequence
tttttttttttttttttttg

SEQ ID NO: 727032 - DNA, 20 bp, Artificial
  CRISPR gRNA sequence
ttttttttttttttttttga

SEQ ID NO: 727033 - DNA, 20 bp, Artificial
  CRISPR gRNA sequence
tttttttttttttttttgag

SEQ ID NO: 727034 - DNA, 20 bp, Artificial
  CRISPR gRNA sequence
ttttttttttttttttgaga

SEQ ID NO: 727035 - DNA, 20 bp, Artificial
  CRISPR gRNA sequence
tttttttttttttttgagat

SEQ ID NO: 727036 - DNA, 20 bp, Artificial
  CRISPR gRNA sequence
ttttttttttttttgagatg

SEQ ID NO: 727037 - DNA, 20 bp, Artificial
  CRISPR gRNA sequence
tttttttttttttgagatgg

SEQ ID NO: 727038 - DNA, 20 bp, Artificial
  CRISPR gRNA sequence
ttttttttttttgagatgga

SEQ ID NO: 727039 - DNA, 20 bp, Artificial
  CRISPR gRNA sequence
tttttttttttgagatggag

SEQ ID NO: 727040 - DNA, 20 bp, Artificial
  CRISPR gRNA sequence
ttttttttttgagatggagt

SEQ ID NO: 727041 - DNA, 20 bp, Artificial
  CRISPR gRNA sequence
tttttttttgagatggagtc

SEQ ID NO: 727042 - DNA, 20 bp, Artificial
  CRISPR gRNA sequence
ttttttttgagatggagtct

SEQ ID NO: 727043 - DNA, 20 bp, Artificial
  CRISPR gRNA sequence
tttttttgagatggagtctc

SEQ ID NO: 727044 - DNA, 20 bp, Artificial
  CRISPR gRNA sequence
ttttttgagatggagtctcg

SEQ ID NO: 727045 - DNA, 20 bp, Artificial
  CRISPR gRNA sequence
tttttgagatggagtctcgc

SEQ ID NO: 727046 - DNA, 20 bp, Artificial
  CRISPR gRNA sequence
ttttgagatggagtctcgct

SEQ ID NO: 727047 - DNA, 20 bp, Artificial
  CRISPR gRNA sequence
tttgagatggagtctcgctc

SEQ ID NO: 727048 - DNA, 20 bp, Artificial
  CRISPR gRNA sequence
ttgagatggagtctcgctct

SEQ ID NO: 727049 - DNA, 20 bp, Artificial
  CRISPR gRNA sequence
tgagatggagtctcgctctg

SEQ ID NO: 727050 - DNA, 20 bp, Artificial
  CRISPR gRNA sequence
gagatggagtctcgctctgt

SEQ ID NO: 727051 - DNA, 20 bp, Artificial
  CRISPR gRNA sequence
agatggagtctcgctctgtc

SEQ ID NO: 727052 - DNA, 20 bp, Artificial
  CRISPR gRNA sequence
gctctgtcaccgaggctgga

SEQ ID NO: 727053 - DNA, 20 bp, Artificial
  CRISPR gRNA sequence
tgtcaccgaggctggagtgt

SEQ ID NO: 727054 - DNA, 20 bp, Artificial
  CRISPR gRNA sequence
tcaccgaggctggagtgtag

SEQ ID NO: 727055 - DNA, 20 bp, Artificial
  CRISPR gRNA sequence
gagtgtagtggcacgttctc

SEQ ID NO: 727056 - DNA, 20 bp, Artificial
  CRISPR gRNA sequence
tcagctcaatgcaacctctg

SEQ ID NO: 727057 - DNA, 20 bp, Artificial
  CRISPR gRNA sequence
agctcaatgcaacctctgcc

SEQ ID NO: 727058 - DNA, 20 bp, Artificial
  CRISPR gRNA sequence
aatgcaacctctgcctctgg

SEQ ID NO: 727059 - DNA, 20 bp, Artificial
  CRISPR gRNA sequence
tgcctctggggtttaagcga

SEQ ID NO: 727060 - DNA, 20 bp, Artificial
  CRISPR gRNA sequence
cctctggggtttaagcgatc

SEQ ID NO: 727061 - DNA, 20 bp, Artificial
  CRISPR gRNA sequence
tggggtttaagcgatcctcc

SEQ ID NO: 727062 - DNA, 20 bp, Artificial
  CRISPR gRNA sequence
gggtttaagcgatcctcctg

SEQ ID NO: 727063 - DNA, 20 bp, Artificial
  CRISPR gRNA sequence
aagcgatcctcctgcctcag

SEQ ID NO: 727064 - DNA, 20 bp, Artificial
  CRISPR gRNA sequence
agcgatcctcctgcctcagc

SEQ ID NO: 727065 - DNA, 20 bp, Artificial
  CRISPR gRNA sequence
ctgcctcagcctcccaagta

SEQ ID NO: 727066 - DNA, 20 bp, Artificial
  CRISPR gRNA sequence
cctcagcctcccaagtagct

SEQ ID NO: 727067 - DNA, 20 bp, Artificial
  CRISPR gRNA sequence
agcctcccaagtagctggga

SEQ ID NO: 727068 - DNA, 20 bp, Artificial
  CRISPR gRNA sequence
ccaagtagctgggactacag

SEQ ID NO: 727069 - DNA, 20 bp, Artificial
  CRISPR gRNA sequence
ggactacaggtgcgtgtcat

SEQ ID NO: 727070 - DNA, 20 bp, Artificial
  CRISPR gRNA sequence
caggtgcgtgtcatgacacc

SEQ ID NO: 727071 - DNA, 20 bp, Artificial
  CRISPR gRNA sequence
atttttgtattttcggtaga

SEQ ID NO: 727072 - DNA, 20 bp, Artificial
  CRISPR gRNA sequence
ttgtattttcggtagagaca

SEQ ID NO: 727073 - DNA, 20 bp, Artificial
  CRISPR gRNA sequence
tgtattttcggtagagacag

SEQ ID NO: 727074 - DNA, 20 bp, Artificial
  CRISPR gRNA sequence
gtattttcggtagagacagg

SEQ ID NO: 727075 - DNA, 20 bp, Artificial
  CRISPR gRNA sequence
tattttcggtagagacaggg

SEQ ID NO: 727076 - DNA, 20 bp, Artificial
  CRISPR gRNA sequence
tcggtagagacagggtttca

SEQ ID NO: 727077 - DNA, 20 bp, Artificial
  CRISPR gRNA sequence
cggtagagacagggtttcac

SEQ ID NO: 727078 - DNA, 20 bp, Artificial
  CRISPR gRNA sequence
ggtagagacagggtttcacc

SEQ ID NO: 727079 - DNA, 20 bp, Artificial
  CRISPR gRNA sequence
caccatgttggccaggctgg

SEQ ID NO: 727080 - DNA, 20 bp, Artificial
  CRISPR gRNA sequence
accatgttggccaggctggt

SEQ ID NO: 727081 - DNA, 20 bp, Artificial
  CRISPR gRNA sequence
gccaggctggtctcaaactc

SEQ ID NO: 727082 - DNA, 20 bp, Artificial
  CRISPR gRNA sequence
gtctcaaactcctgacctca

SEQ ID NO: 727083 - DNA, 20 bp, Artificial
  CRISPR gRNA sequence
aaactcctgacctcaggtga

SEQ ID NO: 727084 - DNA, 20 bp, Artificial
  CRISPR gRNA sequence
ctgacctcaggtgatctgcc

SEQ ID NO: 727085 - DNA, 20 bp, Artificial
  CRISPR gRNA sequence
acctcaggtgatctgccagg

SEQ ID NO: 727086 - DNA, 20 bp, Artificial
  CRISPR gRNA sequence
aggtgatctgccaggcttgg

SEQ ID NO: 727087 - DNA, 20 bp, Artificial
  CRISPR gRNA sequence
ccaggcttggcctcccaaag

SEQ ID NO: 727088 - DNA, 20 bp, Artificial
  CRISPR gRNA sequence
ggcctcccaaagtgctggga

SEQ ID NO: 727089 - DNA, 20 bp, Artificial
  CRISPR gRNA sequence
gcctcccaaagtgctgggat

SEQ ID NO: 727090 - DNA, 20 bp, Artificial
  CRISPR gRNA sequence
ccaaagtgctgggattacag

SEQ ID NO: 727091 - DNA, 20 bp, Artificial
  CRISPR gRNA sequence
ggattacaggcatgagctac

SEQ ID NO: 727092 - DNA, 20 bp, Artificial
  CRISPR gRNA sequence
caggcatgagctactgcgcc

SEQ ID NO: 727093 - DNA, 20 bp, Artificial
  CRISPR gRNA sequence
ctgcgcccagccaagatttg

SEQ ID NO: 727094 - DNA, 20 bp, Artificial
  CRISPR gRNA sequence
cgcccagccaagatttgatg

SEQ ID NO: 727095 - DNA, 20 bp, Artificial
  CRISPR gRNA sequence
gatgtgatgagcatgacgtt

SEQ ID NO: 727096 - DNA, 20 bp, Artificial
  CRISPR gRNA sequence
atgtgatgagcatgacgttt

SEQ ID NO: 727097 - DNA, 20 bp, Artificial
  CRISPR gRNA sequence
cacctctgtggtcttcttcc

SEQ ID NO: 727098 - DNA, 20 bp, Artificial
  CRISPR gRNA sequence
acctctgtggtcttcttccc

SEQ ID NO: 727099 - DNA, 20 bp, Artificial
  CRISPR gRNA sequence
tgtggtcttcttcccccaat

SEQ ID NO: 727100 - DNA, 20 bp, Artificial
  CRISPR gRNA sequence
tggtcttcttcccccaatgc

SEQ ID NO: 727101 - DNA, 20 bp, Artificial
  CRISPR gRNA sequence
cttcccccaatgcataactc

SEQ ID NO: 727102 - DNA, 20 bp, Artificial
  CRISPR gRNA sequence
ttcccccaatgcataactcc

SEQ ID NO: 727103 - DNA, 20 bp, Artificial
  CRISPR gRNA sequence
cccccaatgcataactccag

SEQ ID NO: 727104 - DNA, 20 bp, Artificial
  CRISPR gRNA sequence
ccccaatgcataactccagt

SEQ ID NO: 727105 - DNA, 20 bp, Artificial
  CRISPR gRNA sequence
cagtctaatcatggggaaga

SEQ ID NO: 727106 - DNA, 20 bp, Artificial
  CRISPR gRNA sequence
atcatggggaagacatcaga

SEQ ID NO: 727107 - DNA, 20 bp, Artificial
  CRISPR gRNA sequence
atcaatactcaaaaactgcc

SEQ ID NO: 727108 - DNA, 20 bp, Artificial
  CRISPR gRNA sequence
aaaaactgccaaggccatca

SEQ ID NO: 727109 - DNA, 20 bp, Artificial
  CRISPR gRNA sequence
ccaaggccatcagggaaact

SEQ ID NO: 727110 - DNA, 20 bp, Artificial
  CRISPR gRNA sequence
gtcttgagaaacaagatctg

SEQ ID NO: 727111 - DNA, 20 bp, Artificial
  CRISPR gRNA sequence
gagaaacaagatctgagaaa

SEQ ID NO: 727112 - DNA, 20 bp, Artificial
  CRISPR gRNA sequence
agaaacaagatctgagaaac

SEQ ID NO: 727113 - DNA, 20 bp, Artificial
  CRISPR gRNA sequence
agaaacggccacaggccaga

SEQ ID NO: 727114 - DNA, 20 bp, Artificial
  CRISPR gRNA sequence
aggcgacatgatgactgaat

SEQ ID NO: 727115 - DNA, 20 bp, Artificial
  CRISPR gRNA sequence
aatgtgacgtggctcctgga

SEQ ID NO: 727116 - DNA, 20 bp, Artificial
  CRISPR gRNA sequence
ctggatgggatcctggaacc

SEQ ID NO: 727117 - DNA, 20 bp, Artificial
  CRISPR gRNA sequence
gatgggatcctggaacctta

SEQ ID NO: 727118 - DNA, 20 bp, Artificial
  CRISPR gRNA sequence
gaaccttaggcaatgcaagg

SEQ ID NO: 727119 - DNA, 20 bp, Artificial
  CRISPR gRNA sequence
aggcaatgcaagggaaccct

SEQ ID NO: 727120 - DNA, 20 bp, Artificial
  CRISPR gRNA sequence
ggcaatgcaagggaaccctg

SEQ ID NO: 727121 - DNA, 20 bp, Artificial
  CRISPR gRNA sequence
aacacagtgtgggctttcgt

SEQ ID NO: 727122 - DNA, 20 bp, Artificial
  CRISPR gRNA sequence
tcgtttgtaatcctgtgtca

SEQ ID NO: 727123 - DNA, 20 bp, Artificial
  CRISPR gRNA sequence
cgtttgtaatcctgtgtcaa

SEQ ID NO: 727124 - DNA, 20 bp, Artificial
  CRISPR gRNA sequence
gtttgtaatcctgtgtcaat

SEQ ID NO: 727125 - DNA, 20 bp, Artificial
  CRISPR gRNA sequence
gtaatcctgtgtcaataatg

SEQ ID NO: 727126 - DNA, 20 bp, Artificial
  CRISPR gRNA sequence
taatcctgtgtcaataatgg

SEQ ID NO: 727127 - DNA, 20 bp, Artificial
  CRISPR gRNA sequence
tgtcaataatggttcacata

SEQ ID NO: 727128 - DNA, 20 bp, Artificial
  CRISPR gRNA sequence
acatattttgacaaatgaac

SEQ ID NO: 727129 - DNA, 20 bp, Artificial
  CRISPR gRNA sequence
tgacaaatgaacgatgctgg

SEQ ID NO: 727130 - DNA, 20 bp, Artificial
  CRISPR gRNA sequence
gacaaatgaacgatgctggc

SEQ ID NO: 727131 - DNA, 20 bp, Artificial
  CRISPR gRNA sequence
acaaatgaacgatgctggct

SEQ ID NO: 727132 - DNA, 20 bp, Artificial
  CRISPR gRNA sequence
gcttaagatgctaatcacag

SEQ ID NO: 727133 - DNA, 20 bp, Artificial
  CRISPR gRNA sequence
aagatgctaatcacagagga

SEQ ID NO: 727134 - DNA, 20 bp, Artificial
  CRISPR gRNA sequence
agatgctaatcacagaggaa

SEQ ID NO: 727135 - DNA, 20 bp, Artificial
  CRISPR gRNA sequence
atcacagaggaaactgggtg

SEQ ID NO: 727136 - DNA, 20 bp, Artificial
  CRISPR gRNA sequence
ggtgtggggcatgtgggaac

SEQ ID NO: 727137 - DNA, 20 bp, Artificial
  CRISPR gRNA sequence
ctgtgctgtcttctccaatt

SEQ ID NO: 727138 - DNA, 20 bp, Artificial
  CRISPR gRNA sequence
tgctgtcttctccaattttc

SEQ ID NO: 727139 - DNA, 20 bp, Artificial
  CRISPR gRNA sequence
tcttctccaattttctgtac

SEQ ID NO: 727140 - DNA, 20 bp, Artificial
  CRISPR gRNA sequence
ctccaattttctgtacatct

SEQ ID NO: 727141 - DNA, 20 bp, Artificial
  CRISPR gRNA sequence
tccaattttctgtacatcta

SEQ ID NO: 727142 - DNA, 20 bp, Artificial
  CRISPR gRNA sequence
caattttctgtacatctaaa

SEQ ID NO: 727143 - DNA, 20 bp, Artificial
  CRISPR gRNA sequence
tctgtacatctaaaactatt

SEQ ID NO: 727144 - DNA, 20 bp, Artificial
  CRISPR gRNA sequence
ctgtacatctaaaactattt

SEQ ID NO: 727145 - DNA, 20 bp, Artificial
  CRISPR gRNA sequence
tgtacatctaaaactatttt

SEQ ID NO: 727146 - DNA, 20 bp, Artificial
  CRISPR gRNA sequence
tacatctaaaactattttta

SEQ ID NO: 727147 - DNA, 20 bp, Artificial
  CRISPR gRNA sequence
aaactatttttaaaaatgag

SEQ ID NO: 727148 - DNA, 20 bp, Artificial
  CRISPR gRNA sequence
tttttaaaaatgagactggg

SEQ ID NO: 727149 - DNA, 20 bp, Artificial
  CRISPR gRNA sequence
ttaaaaatgagactgggcgt

SEQ ID NO: 727150 - DNA, 20 bp, Artificial
  CRISPR gRNA sequence
taaaaatgagactgggcgtg

SEQ ID NO: 727151 - DNA, 20 bp, Artificial
  CRISPR gRNA sequence
aaaaatgagactgggcgtgg

SEQ ID NO: 727152 - DNA, 20 bp, Artificial
  CRISPR gRNA sequence
aaaatgagactgggcgtggt

SEQ ID NO: 727153 - DNA, 20 bp, Artificial
  CRISPR gRNA sequence
ggcgtggtggctcatgcctg

SEQ ID NO: 727154 - DNA, 20 bp, Artificial
  CRISPR gRNA sequence
atgcctgtaatcccagtatt

SEQ ID NO: 727155 - DNA, 20 bp, Artificial
  CRISPR gRNA sequence
taatcccagtattttgggag

SEQ ID NO: 727156 - DNA, 20 bp, Artificial
  CRISPR gRNA sequence
tgggaggctgaggtgggcaa

SEQ ID NO: 727157 - DNA, 20 bp, Artificial
  CRISPR gRNA sequence
gggaggctgaggtgggcaaa

SEQ ID NO: 727158 - DNA, 20 bp, Artificial
  CRISPR gRNA sequence
ggaggctgaggtgggcaaat

SEQ ID NO: 727159 - DNA, 20 bp, Artificial
  CRISPR gRNA sequence
aggtgggcaaatcacgatgc

SEQ ID NO: 727160 - DNA, 20 bp, Artificial
  CRISPR gRNA sequence
cagaccagcctggccaacct

SEQ ID NO: 727161 - DNA, 20 bp, Artificial
  CRISPR gRNA sequence
gccaacctggtgaaacccca

SEQ ID NO: 727162 - DNA, 20 bp, Artificial
  CRISPR gRNA sequence
gtgaaaccccatctctacta

SEQ ID NO: 727163 - DNA, 20 bp, Artificial
  CRISPR gRNA sequence
tactaaaaatacaaaaatta

SEQ ID NO: 727164 - DNA, 20 bp, Artificial
  CRISPR gRNA sequence
ctaaaaatacaaaaattagc

SEQ ID NO: 727165 - DNA, 20 bp, Artificial
  CRISPR gRNA sequence
aaaatacaaaaattagctgg

SEQ ID NO: 727166 - DNA, 20 bp, Artificial
  CRISPR gRNA sequence
gctgggcatggtggcgcgcg

SEQ ID NO: 727167 - DNA, 20 bp, Artificial
  CRISPR gRNA sequence
ggcatggtggcgcgcgccta

SEQ ID NO: 727168 - DNA, 20 bp, Artificial
  CRISPR gRNA sequence
taatcccagctactcgggag

SEQ ID NO: 727169 - DNA, 20 bp, Artificial
  CRISPR gRNA sequence
ctcgggaggctgaggcagga

SEQ ID NO: 727170 - DNA, 20 bp, Artificial
  CRISPR gRNA sequence
gggaggctgaggcaggagaa

SEQ ID NO: 727171 - DNA, 20 bp, Artificial
  CRISPR gRNA sequence
aggcaggagaattgctggaa

SEQ ID NO: 727172 - DNA, 20 bp, Artificial
  CRISPR gRNA sequence
ctggaacccgggaagcagag

SEQ ID NO: 727173 - DNA, 20 bp, Artificial
  CRISPR gRNA sequence
gaacccgggaagcagaggtt

SEQ ID NO: 727174 - DNA, 20 bp, Artificial
  CRISPR gRNA sequence
cagtgagctgagattgcgcc

SEQ ID NO: 727175 - DNA, 20 bp, Artificial
  CRISPR gRNA sequence
agattgcgccattgcactcc

SEQ ID NO: 727176 - DNA, 20 bp, Artificial
  CRISPR gRNA sequence
cgccattgcactccaacctg

SEQ ID NO: 727177 - DNA, 20 bp, Artificial
  CRISPR gRNA sequence
cactccaacctgggcaacag

SEQ ID NO: 727178 - DNA, 20 bp, Artificial
  CRISPR gRNA sequence
caacctgggcaacagagcga

SEQ ID NO: 727179 - DNA, 20 bp, Artificial
  CRISPR gRNA sequence
ggcaacagagcgagactctg

SEQ ID NO: 727180 - DNA, 20 bp, Artificial
  CRISPR gRNA sequence
tgcctcaaaaaaaaaatgag

SEQ ID NO: 727181 - DNA, 20 bp, Artificial
  CRISPR gRNA sequence
cctcaaaaaaaaaatgagga

SEQ ID NO: 727182 - DNA, 20 bp, Artificial
  CRISPR gRNA sequence
aaaaaaaaaatgaggactag

SEQ ID NO: 727183 - DNA, 20 bp, Artificial
  CRISPR gRNA sequence
gctgggcacagtggctctcg

SEQ ID NO: 727184 - DNA, 20 bp, Artificial
  CRISPR gRNA sequence
ggcacagtggctctcgccta

SEQ ID NO: 727185 - DNA, 20 bp, Artificial
  CRISPR gRNA sequence
tcgcctataatccaagcact

SEQ ID NO: 727186 - DNA, 20 bp, Artificial
  CRISPR gRNA sequence
gcctataatccaagcacttt

SEQ ID NO: 727187 - DNA, 20 bp, Artificial
  CRISPR gRNA sequence
taatccaagcactttgggag

SEQ ID NO: 727188 - DNA, 20 bp, Artificial
  CRISPR gRNA sequence
tgggaggccgaggtgggcag

SEQ ID NO: 727189 - DNA, 20 bp, Artificial
  CRISPR gRNA sequence
gggaggccgaggtgggcaga

SEQ ID NO: 727190 - DNA, 20 bp, Artificial
  CRISPR gRNA sequence
ggaggccgaggtgggcagat

SEQ ID NO: 727191 - DNA, 20 bp, Artificial
  CRISPR gRNA sequence
gagctcaggagttagagacc

SEQ ID NO: 727192 - DNA, 20 bp, Artificial
  CRISPR gRNA sequence
agctcaggagttagagacca

SEQ ID NO: 727193 - DNA, 20 bp, Artificial
  CRISPR gRNA sequence
aggagttagagaccagcctg

SEQ ID NO: 727194 - DNA, 20 bp, Artificial
  CRISPR gRNA sequence
gagaccagcctgcacaacaa

SEQ ID NO: 727195 - DNA, 20 bp, Artificial
  CRISPR gRNA sequence
cacaacaaagggagacctgg

SEQ ID NO: 727196 - DNA, 20 bp, Artificial
  CRISPR gRNA sequence
gtctctacaaaaaatagaaa

SEQ ID NO: 727197 - DNA, 20 bp, Artificial
  CRISPR gRNA sequence
tacaaaaaatagaaaagtta

SEQ ID NO: 727198 - DNA, 20 bp, Artificial
  CRISPR gRNA sequence
caaaaaatagaaaagttagc

SEQ ID NO: 727199 - DNA, 20 bp, Artificial
  CRISPR gRNA sequence
gctgggcgtggtggtgtgta

SEQ ID NO: 727200 - DNA, 20 bp, Artificial
  CRISPR gRNA sequence
ggcgtggtggtgtgtatctg

SEQ ID NO: 727201 - DNA, 20 bp, Artificial
  CRISPR gRNA sequence
tagtcccagctactggggag

SEQ ID NO: 727202 - DNA, 20 bp, Artificial
  CRISPR gRNA sequence
ctggggaggctgagggatca

SEQ ID NO: 727203 - DNA, 20 bp, Artificial
  CRISPR gRNA sequence
gggaggctgagggatcactt

SEQ ID NO: 727204 - DNA, 20 bp, Artificial
  CRISPR gRNA sequence
agggatcacttgaacccagg

SEQ ID NO: 727205 - DNA, 20 bp, Artificial
  CRISPR gRNA sequence
gaacccaggaggtcaaggct

SEQ ID NO: 727206 - DNA, 20 bp, Artificial
  CRISPR gRNA sequence
aacccaggaggtcaaggctg

SEQ ID NO: 727207 - DNA, 20 bp, Artificial
  CRISPR gRNA sequence
cagtgagccatgattgtacc

SEQ ID NO: 727208 - DNA, 20 bp, Artificial
  CRISPR gRNA sequence
taccatggcactccagagtg

SEQ ID NO: 727209 - DNA, 20 bp, Artificial
  CRISPR gRNA sequence
cagagtgacaccctgtctcc

SEQ ID NO: 727210 - DNA, 20 bp, Artificial
  CRISPR gRNA sequence
tctccaaaacaaaaaacaaa

SEQ ID NO: 727211 - DNA, 20 bp, Artificial
  CRISPR gRNA sequence
caaaacaaaaaacaaaaaac

SEQ ID NO: 727212 - DNA, 20 bp, Artificial
  CRISPR gRNA sequence
aaaaatgaaggccacttaga

SEQ ID NO: 727213 - DNA, 20 bp, Artificial
  CRISPR gRNA sequence
aaaatgaaggccacttagaa

SEQ ID NO: 727214 - DNA, 20 bp, Artificial
  CRISPR gRNA sequence
agaatgtttttttgtttgtt

SEQ ID NO: 727215 - DNA, 20 bp, Artificial
  CRISPR gRNA sequence
gaatgtttttttgtttgttt

SEQ ID NO: 727216 - DNA, 20 bp, Artificial
  CRISPR gRNA sequence
ttttgtttgtttgtttgttt

SEQ ID NO: 727217 - DNA, 20 bp, Artificial
  CRISPR gRNA sequence
tttgtttgtttgtttgtttg

SEQ ID NO: 727218 - DNA, 20 bp, Artificial
  CRISPR gRNA sequence
ttgtttgtttgtttgtttgt

SEQ ID NO: 727219 - DNA, 20 bp, Artificial
  CRISPR gRNA sequence
tgtttgtttgtttgtttgtt

SEQ ID NO: 727220 - DNA, 20 bp, Artificial
  CRISPR gRNA sequence
gtttgtttgtttgtttgttt

SEQ ID NO: 727221 - DNA, 20 bp, Artificial
  CRISPR gRNA sequence
tttgtttgtttgtttgtttt

SEQ ID NO: 727222 - DNA, 20 bp, Artificial
  CRISPR gRNA sequence
gtttgtttgtttgttttgag

SEQ ID NO: 727223 - DNA, 20 bp, Artificial
  CRISPR gRNA sequence
tttgtttgtttgttttgaga

SEQ ID NO: 727224 - DNA, 20 bp, Artificial
  CRISPR gRNA sequence
gtttgtttgttttgagacgg

SEQ ID NO: 727225 - DNA, 20 bp, Artificial
  CRISPR gRNA sequence
tttgtttgttttgagacgga

SEQ ID NO: 727226 - DNA, 20 bp, Artificial
  CRISPR gRNA sequence
gtttgttttgagacggaggc

SEQ ID NO: 727227 - DNA, 20 bp, Artificial
  CRISPR gRNA sequence
tttgttttgagacggaggct

SEQ ID NO: 727228 - DNA, 20 bp, Artificial
  CRISPR gRNA sequence
gttttgagacggaggctcgc

SEQ ID NO: 727229 - DNA, 20 bp, Artificial
  CRISPR gRNA sequence
ttttgagacggaggctcgct

SEQ ID NO: 727230 - DNA, 20 bp, Artificial
  CRISPR gRNA sequence
tgagacggaggctcgctctg

SEQ ID NO: 727231 - DNA, 20 bp, Artificial
  CRISPR gRNA sequence
gagacggaggctcgctctgt

SEQ ID NO: 727232 - DNA, 20 bp, Artificial
  CRISPR gRNA sequence
agacggaggctcgctctgtt

SEQ ID NO: 727233 - DNA, 20 bp, Artificial
  CRISPR gRNA sequence
gctctgttgctcagcctgga

SEQ ID NO: 727234 - DNA, 20 bp, Artificial
  CRISPR gRNA sequence
tgttgctcagcctggagtgc

SEQ ID NO: 727235 - DNA, 20 bp, Artificial
  CRISPR gRNA sequence
ttgctcagcctggagtgcag

SEQ ID NO: 727236 - DNA, 20 bp, Artificial
  CRISPR gRNA sequence
ctcagcctggagtgcagtgg

SEQ ID NO: 727237 - DNA, 20 bp, Artificial
  CRISPR gRNA sequence
agcctggagtgcagtggtgc

SEQ ID NO: 727238 - DNA, 20 bp, Artificial
  CRISPR gRNA sequence
gagtgcagtggtgcaatctc

SEQ ID NO: 727239 - DNA, 20 bp, Artificial
  CRISPR gRNA sequence
agctcactgcaacctccacc

SEQ ID NO: 727240 - DNA, 20 bp, Artificial
  CRISPR gRNA sequence
actgcaacctccacctccca

SEQ ID NO: 727241 - DNA, 20 bp, Artificial
  CRISPR gRNA sequence
caacctccacctcccaggtt

SEQ ID NO: 727242 - DNA, 20 bp, Artificial
  CRISPR gRNA sequence
cacctcccaggttcaagaaa

SEQ ID NO: 727243 - DNA, 20 bp, Artificial
  CRISPR gRNA sequence
ccaggttcaagaaattctcc

SEQ ID NO: 727244 - DNA, 20 bp, Artificial
  CRISPR gRNA sequence
aagaaattctcctgcctcag

SEQ ID NO: 727245 - DNA, 20 bp, Artificial
  CRISPR gRNA sequence
tcctgcctcagcctcccgag

SEQ ID NO: 727246 - DNA, 20 bp, Artificial
  CRISPR gRNA sequence
ctgcctcagcctcccgagta

SEQ ID NO: 727247 - DNA, 20 bp, Artificial
  CRISPR gRNA sequence
cctcagcctcccgagtagct

SEQ ID NO: 727248 - DNA, 20 bp, Artificial
  CRISPR gRNA sequence
agcctcccgagtagctggga

SEQ ID NO: 727249 - DNA, 20 bp, Artificial
  CRISPR gRNA sequence
ccgagtagctgggattacag

SEQ ID NO: 727250 - DNA, 20 bp, Artificial
  CRISPR gRNA sequence
ggattacaggtgtgtgccac

SEQ ID NO: 727251 - DNA, 20 bp, Artificial
  CRISPR gRNA sequence
caggtgtgtgccaccatgcc

SEQ ID NO: 727252 - DNA, 20 bp, Artificial
  CRISPR gRNA sequence
gctaatttttttatttttag

SEQ ID NO: 727253 - DNA, 20 bp, Artificial
  CRISPR gRNA sequence
atttttttatttttagtaga

SEQ ID NO: 727254 - DNA, 20 bp, Artificial
  CRISPR gRNA sequence
ttttatttttagtagagatg

SEQ ID NO: 727255 - DNA, 20 bp, Artificial
  CRISPR gRNA sequence
tttatttttagtagagatgg

SEQ ID NO: 727256 - DNA, 20 bp, Artificial
  CRISPR gRNA sequence
ttatttttagtagagatggg

SEQ ID NO: 727257 - DNA, 20 bp, Artificial
  CRISPR gRNA sequence
tatttttagtagagatgggg

SEQ ID NO: 727258 - DNA, 20 bp, Artificial
  CRISPR gRNA sequence
atttttagtagagatggggt

SEQ ID NO: 727259 - DNA, 20 bp, Artificial
  CRISPR gRNA sequence
tttttagtagagatggggtt

SEQ ID NO: 727260 - DNA, 20 bp, Artificial
  CRISPR gRNA sequence
ttagtagagatggggttttg

SEQ ID NO: 727261 - DNA, 20 bp, Artificial
  CRISPR gRNA sequence
tagtagagatggggttttgt

SEQ ID NO: 727262 - DNA, 20 bp, Artificial
  CRISPR gRNA sequence
agtagagatggggttttgtc

SEQ ID NO: 727263 - DNA, 20 bp, Artificial
  CRISPR gRNA sequence
gtagagatggggttttgtct

SEQ ID NO: 727264 - DNA, 20 bp, Artificial
  CRISPR gRNA sequence
tgtcttgttggccaggctgg

SEQ ID NO: 727265 - DNA, 20 bp, Artificial
  CRISPR gRNA sequence
gtcttgttggccaggctggt

SEQ ID NO: 727266 - DNA, 20 bp, Artificial
  CRISPR gRNA sequence
tcttgttggccaggctggtc

SEQ ID NO: 727267 - DNA, 20 bp, Artificial
  CRISPR gRNA sequence
gttggccaggctggtcttga

SEQ ID NO: 727268 - DNA, 20 bp, Artificial
  CRISPR gRNA sequence
ttggccaggctggtcttgaa

SEQ ID NO: 727269 - DNA, 20 bp, Artificial
  CRISPR gRNA sequence
gccaggctggtcttgaactc

SEQ ID NO: 727270 - DNA, 20 bp, Artificial
  CRISPR gRNA sequence
gtcttgaactctcgacctca

SEQ ID NO: 727271 - DNA, 20 bp, Artificial
  CRISPR gRNA sequence
gaactctcgacctcaggtga

SEQ ID NO: 727272 - DNA, 20 bp, Artificial
  CRISPR gRNA sequence
aactctcgacctcaggtgat

SEQ ID NO: 727273 - DNA, 20 bp, Artificial
  CRISPR gRNA sequence
tcgacctcaggtgatccacc

SEQ ID NO: 727274 - DNA, 20 bp, Artificial
  CRISPR gRNA sequence
gacctcaggtgatccaccca

SEQ ID NO: 727275 - DNA, 20 bp, Artificial
  CRISPR gRNA sequence
aggtgatccacccaccttgg

SEQ ID NO: 727276 - DNA, 20 bp, Artificial
  CRISPR gRNA sequence
ggcctcccaaagtgctggga

SEQ ID NO: 727277 - DNA, 20 bp, Artificial
  CRISPR gRNA sequence
gcctcccaaagtgctgggat

SEQ ID NO: 727278 - DNA, 20 bp, Artificial
  CRISPR gRNA sequence
ccaaagtgctgggattacag

SEQ ID NO: 727279 - DNA, 20 bp, Artificial
  CRISPR gRNA sequence
ggattacaggtgtgagccac

SEQ ID NO: 727280 - DNA, 20 bp, Artificial
  CRISPR gRNA sequence
caggtgtgagccactacacc

SEQ ID NO: 727281 - DNA, 20 bp, Artificial
  CRISPR gRNA sequence
cacctggcctacttagaatt

SEQ ID NO: 727282 - DNA, 20 bp, Artificial
  CRISPR gRNA sequence
gcctacttagaatttttaaa

SEQ ID NO: 727283 - DNA, 20 bp, Artificial
  CRISPR gRNA sequence
cttagaatttttaaaaatta

SEQ ID NO: 727284 - DNA, 20 bp, Artificial
  CRISPR gRNA sequence
agaatttttaaaaattaaac

SEQ ID NO: 727285 - DNA, 20 bp, Artificial
  CRISPR gRNA sequence
gaatttttaaaaattaaact

SEQ ID NO: 727286 - DNA, 20 bp, Artificial
  CRISPR gRNA sequence
ttaaaaattaaactatttta

SEQ ID NO: 727287 - DNA, 20 bp, Artificial
  CRISPR gRNA sequence
taaaaattaaactattttaa

SEQ ID NO: 727288 - DNA, 20 bp, Artificial
  CRISPR gRNA sequence
aaaaattaaactattttaaa

SEQ ID NO: 727289 - DNA, 20 bp, Artificial
  CRISPR gRNA sequence
aaaattaaactattttaaaa

SEQ ID NO: 727290 - DNA, 20 bp, Artificial
  CRISPR gRNA sequence
aactattttaaaaagaaggt

SEQ ID NO: 727291 - DNA, 20 bp, Artificial
  CRISPR gRNA sequence
ttttaaaaagaaggtgtcca

SEQ ID NO: 727292 - DNA, 20 bp, Artificial
  CRISPR gRNA sequence
taaaaagaaggtgtccagga

SEQ ID NO: 727293 - DNA, 20 bp, Artificial
  CRISPR gRNA sequence
aaaaagaaggtgtccaggat

SEQ ID NO: 727294 - DNA, 20 bp, Artificial
  CRISPR gRNA sequence
aaaagaaggtgtccaggatg

SEQ ID NO: 727295 - DNA, 20 bp, Artificial
  CRISPR gRNA sequence
ttgagcacacagcaggttca

SEQ ID NO: 727296 - DNA, 20 bp, Artificial
  CRISPR gRNA sequence
agcacacagcaggttcagga

SEQ ID NO: 727297 - DNA, 20 bp, Artificial
  CRISPR gRNA sequence
aggaaaagcccaggatggta

SEQ ID NO: 727298 - DNA, 20 bp, Artificial
  CRISPR gRNA sequence
tgcactccgtcacactgaat

SEQ ID NO: 727299 - DNA, 20 bp, Artificial
  CRISPR gRNA sequence
cactccgtcacactgaatgg

SEQ ID NO: 727300 - DNA, 20 bp, Artificial
  CRISPR gRNA sequence
cgtcacactgaatggaaagt

SEQ ID NO: 727301 - DNA, 20 bp, Artificial
  CRISPR gRNA sequence
aatggaaagtcagagttcaa

SEQ ID NO: 727302 - DNA, 20 bp, Artificial
  CRISPR gRNA sequence
aataccgactctcccaaaca

SEQ ID NO: 727303 - DNA, 20 bp, Artificial
  CRISPR gRNA sequence
tcccaaacaagtgtaaaatc

SEQ ID NO: 727304 - DNA, 20 bp, Artificial
  CRISPR gRNA sequence
ccaaacaagtgtaaaatcac

SEQ ID NO: 727305 - DNA, 20 bp, Artificial
  CRISPR gRNA sequence
gaaggctctgacattgacaa

SEQ ID NO: 727306 - DNA, 20 bp, Artificial
  CRISPR gRNA sequence
tgacattgacaagagccgtg

SEQ ID NO: 727307 - DNA, 20 bp, Artificial
  CRISPR gRNA sequence
acattgacaagagccgtgtt

SEQ ID NO: 727308 - DNA, 20 bp, Artificial
  CRISPR gRNA sequence
acaagagccgtgttacaacc

SEQ ID NO: 727309 - DNA, 20 bp, Artificial
  CRISPR gRNA sequence
caacccatgaggattttgat

SEQ ID NO: 727310 - DNA, 20 bp, Artificial
  CRISPR gRNA sequence
tgataaagacccagaacaaa

SEQ ID NO: 727311 - DNA, 20 bp, Artificial
  CRISPR gRNA sequence
gataaagacccagaacaaat

SEQ ID NO: 727312 - DNA, 20 bp, Artificial
  CRISPR gRNA sequence
ataaagacccagaacaaatc

SEQ ID NO: 727313 - DNA, 20 bp, Artificial
  CRISPR gRNA sequence
gccaagtacagaggtcagat

SEQ ID NO: 727314 - DNA, 20 bp, Artificial
  CRISPR gRNA sequence
ccaagtacagaggtcagatt

SEQ ID NO: 727315 - DNA, 20 bp, Artificial
  CRISPR gRNA sequence
cataactgctcttcccctaa

SEQ ID NO: 727316 - DNA, 20 bp, Artificial
  CRISPR gRNA sequence
ataactgctcttcccctaaa

SEQ ID NO: 727317 - DNA, 20 bp, Artificial
  CRISPR gRNA sequence
ctcttcccctaaaaatgttg

SEQ ID NO: 727318 - DNA, 20 bp, Artificial
  CRISPR gRNA sequence
ttcccctaaaaatgttgatt

SEQ ID NO: 727319 - DNA, 20 bp, Artificial
  CRISPR gRNA sequence
cccctaaaaatgttgattct

SEQ ID NO: 727320 - DNA, 20 bp, Artificial
  CRISPR gRNA sequence
ccctaaaaatgttgattcta

SEQ ID NO: 727321 - DNA, 20 bp, Artificial
  CRISPR gRNA sequence
aaaatgttgattctatctgc

SEQ ID NO: 727322 - DNA, 20 bp, Artificial
  CRISPR gRNA sequence
attctatctgctagtcttat

SEQ ID NO: 727323 - DNA, 20 bp, Artificial
  CRISPR gRNA sequence
tatctgctagtcttatttgt

SEQ ID NO: 727324 - DNA, 20 bp, Artificial
  CRISPR gRNA sequence
tctgctagtcttatttgttg

SEQ ID NO: 727325 - DNA, 20 bp, Artificial
  CRISPR gRNA sequence
ctagtcttatttgttggttt

SEQ ID NO: 727326 - DNA, 20 bp, Artificial
  CRISPR gRNA sequence
gtcttatttgttggtttcct

SEQ ID NO: 727327 - DNA, 20 bp, Artificial
  CRISPR gRNA sequence
atttgttggtttccttgcct

SEQ ID NO: 727328 - DNA, 20 bp, Artificial
  CRISPR gRNA sequence
tttgttggtttccttgcctt

SEQ ID NO: 727329 - DNA, 20 bp, Artificial
  CRISPR gRNA sequence
gttggtttccttgccttttg

SEQ ID NO: 727330 - DNA, 20 bp, Artificial
  CRISPR gRNA sequence
ttggtttccttgccttttgg

SEQ ID NO: 727331 - DNA, 20 bp, Artificial
  CRISPR gRNA sequence
gtttccttgccttttggaat

SEQ ID NO: 727332 - DNA, 20 bp, Artificial
  CRISPR gRNA sequence
ccttgccttttggaataacc

SEQ ID NO: 727333 - DNA, 20 bp, Artificial
  CRISPR gRNA sequence
cttgccttttggaataacca

SEQ ID NO: 727334 - DNA, 20 bp, Artificial
  CRISPR gRNA sequence
gccttttggaataaccactg

SEQ ID NO: 727335 - DNA, 20 bp, Artificial
  CRISPR gRNA sequence
ccttttggaataaccactgt

SEQ ID NO: 727336 - DNA, 20 bp, Artificial
  CRISPR gRNA sequence
ttggaataaccactgtcttc

SEQ ID NO: 727337 - DNA, 20 bp, Artificial
  CRISPR gRNA sequence
tggaataaccactgtcttct

SEQ ID NO: 727338 - DNA, 20 bp, Artificial
  CRISPR gRNA sequence
ggaataaccactgtcttctt

SEQ ID NO: 727339 - DNA, 20 bp, Artificial
  CRISPR gRNA sequence
gaataaccactgtcttcttg

SEQ ID NO: 727340 - DNA, 20 bp, Artificial
  CRISPR gRNA sequence
tcttcttgtaagcctgtctg

SEQ ID NO: 727341 - DNA, 20 bp, Artificial
  CRISPR gRNA sequence
cttgtaagcctgtctggtac

SEQ ID NO: 727342 - DNA, 20 bp, Artificial
  CRISPR gRNA sequence
ttgtaagcctgtctggtacc

SEQ ID NO: 727343 - DNA, 20 bp, Artificial
  CRISPR gRNA sequence
gtaagcctgtctggtacccc

SEQ ID NO: 727344 - DNA, 20 bp, Artificial
  CRISPR gRNA sequence
taagcctgtctggtaccccc

SEQ ID NO: 727345 - DNA, 20 bp, Artificial
  CRISPR gRNA sequence
tctggtacccccagggacac

SEQ ID NO: 727346 - DNA, 20 bp, Artificial
  CRISPR gRNA sequence
gtacccccagggacacaagt

SEQ ID NO: 727347 - DNA, 20 bp, Artificial
  CRISPR gRNA sequence
ggcagcagcaggcccccttg

SEQ ID NO: 727348 - DNA, 20 bp, Artificial
  CRISPR gRNA sequence
gcacaagtgcacggtgtcac

SEQ ID NO: 727349 - DNA, 20 bp, Artificial
  CRISPR gRNA sequence
cacaagtgcacggtgtcaca

SEQ ID NO: 727350 - DNA, 20 bp, Artificial
  CRISPR gRNA sequence
ctctgaagcccacgctcacg

SEQ ID NO: 727351 - DNA, 20 bp, Artificial
  CRISPR gRNA sequence
tgaagcccacgctcacggag

SEQ ID NO: 727352 - DNA, 20 bp, Artificial
  CRISPR gRNA sequence
aagcccacgctcacggagca

SEQ ID NO: 727353 - DNA, 20 bp, Artificial
  CRISPR gRNA sequence
acggagcacgtgcgttctca

SEQ ID NO: 727354 - DNA, 20 bp, Artificial
  CRISPR gRNA sequence
tcacatgcgatgtaaagctc

SEQ ID NO: 727355 - DNA, 20 bp, Artificial
  CRISPR gRNA sequence
acatgcgatgtaaagctctc

SEQ ID NO: 727356 - DNA, 20 bp, Artificial
  CRISPR gRNA sequence
tcggtcccttccatccctgt

SEQ ID NO: 727357 - DNA, 20 bp, Artificial
  CRISPR gRNA sequence
ggtcccttccatccctgtta

SEQ ID NO: 727358 - DNA, 20 bp, Artificial
  CRISPR gRNA sequence
ccatccctgttattctccac

SEQ ID NO: 727359 - DNA, 20 bp, Artificial
  CRISPR gRNA sequence
catccctgttattctccact

SEQ ID NO: 727360 - DNA, 20 bp, Artificial
  CRISPR gRNA sequence
ttattctccacttttagtcc

SEQ ID NO: 727361 - DNA, 20 bp, Artificial
  CRISPR gRNA sequence
ttctccacttttagtcccct

SEQ ID NO: 727362 - DNA, 20 bp, Artificial
  CRISPR gRNA sequence
tccacttttagtcccctccc

SEQ ID NO: 727363 - DNA, 20 bp, Artificial
  CRISPR gRNA sequence
cacttttagtcccctcccct

SEQ ID NO: 727364 - DNA, 20 bp, Artificial
  CRISPR gRNA sequence
ttagtcccctcccctctctg

SEQ ID NO: 727365 - DNA, 20 bp, Artificial
  CRISPR gRNA sequence
tagtcccctcccctctctgg

SEQ ID NO: 727366 - DNA, 20 bp, Artificial
  CRISPR gRNA sequence
agtcccctcccctctctggc

SEQ ID NO: 727367 - DNA, 20 bp, Artificial
  CRISPR gRNA sequence
gtcccctcccctctctggcc

SEQ ID NO: 727368 - DNA, 20 bp, Artificial
  CRISPR gRNA sequence
ccctctctggcctgtgattc

SEQ ID NO: 727369 - DNA, 20 bp, Artificial
  CRISPR gRNA sequence
tctggcctgtgattccccag

SEQ ID NO: 727370 - DNA, 20 bp, Artificial
  CRISPR gRNA sequence
tggcctgtgattccccagtg

SEQ ID NO: 727371 - DNA, 20 bp, Artificial
  CRISPR gRNA sequence
gcctgtgattccccagtgct

SEQ ID NO: 727372 - DNA, 20 bp, Artificial
  CRISPR gRNA sequence
tgattccccagtgctgtggg

SEQ ID NO: 727373 - DNA, 20 bp, Artificial
  CRISPR gRNA sequence
cccagtgctgtgggaagcag

SEQ ID NO: 727374 - DNA, 20 bp, Artificial
  CRISPR gRNA sequence
tgggaagcagaacaggccca

SEQ ID NO: 727375 - DNA, 20 bp, Artificial
  CRISPR gRNA sequence
ggcacagaggttcagctagg

SEQ ID NO: 727376 - DNA, 20 bp, Artificial
  CRISPR gRNA sequence
gcacagaggttcagctaggc

SEQ ID NO: 727377 - DNA, 20 bp, Artificial
  CRISPR gRNA sequence
agctaggctttggcaacagg

SEQ ID NO: 727378 - DNA, 20 bp, Artificial
  CRISPR gRNA sequence
ggctttggcaacaggtaccc

SEQ ID NO: 727379 - DNA, 20 bp, Artificial
  CRISPR gRNA sequence
tggcaacaggtaccccgaga

SEQ ID NO: 727380 - DNA, 20 bp, Artificial
  CRISPR gRNA sequence
ggcaacaggtaccccgagat

SEQ ID NO: 727381 - DNA, 20 bp, Artificial
  CRISPR gRNA sequence
gcaacaggtaccccgagatg

SEQ ID NO: 727382 - DNA, 20 bp, Artificial
  CRISPR gRNA sequence
cttggagaggcagctgattc

SEQ ID NO: 727383 - DNA, 20 bp, Artificial
  CRISPR gRNA sequence
ggagaggcagctgattccag

SEQ ID NO: 727384 - DNA, 20 bp, Artificial
  CRISPR gRNA sequence
gagaggcagctgattccagg

SEQ ID NO: 727385 - DNA, 20 bp, Artificial
  CRISPR gRNA sequence
attccagggccggggcagga

SEQ ID NO: 727386 - DNA, 20 bp, Artificial
  CRISPR gRNA sequence
cagggccggggcaggagcac

SEQ ID NO: 727387 - DNA, 20 bp, Artificial
  CRISPR gRNA sequence
agctgggaacatctcagaat

SEQ ID NO: 727388 - DNA, 20 bp, Artificial
  CRISPR gRNA sequence
ggaacatctcagaataaggg

SEQ ID NO: 727389 - DNA, 20 bp, Artificial
  CRISPR gRNA sequence
agaataagggacgtgctcaa

SEQ ID NO: 727390 - DNA, 20 bp, Artificial
  CRISPR gRNA sequence
aaagcacaggatgaggatac

SEQ ID NO: 727391 - DNA, 20 bp, Artificial
  CRISPR gRNA sequence
aaaggggctctccctgacct

SEQ ID NO: 727392 - DNA, 20 bp, Artificial
  CRISPR gRNA sequence
aaggggctctccctgacctc

SEQ ID NO: 727393 - DNA, 20 bp, Artificial
  CRISPR gRNA sequence
tccctgacctcatctgggac

SEQ ID NO: 727394 - DNA, 20 bp, Artificial
  CRISPR gRNA sequence
cctgacctcatctgggacca

SEQ ID NO: 727395 - DNA, 20 bp, Artificial
  CRISPR gRNA sequence
acctcatctgggaccatttg

SEQ ID NO: 727396 - DNA, 20 bp, Artificial
  CRISPR gRNA sequence
atctgggaccatttgagcac

SEQ ID NO: 727397 - DNA, 20 bp, Artificial
  CRISPR gRNA sequence
ggaccatttgagcaccaaaa

SEQ ID NO: 727398 - DNA, 20 bp, Artificial
  CRISPR gRNA sequence
gagcaccaaaataaaaaatg

SEQ ID NO: 727399 - DNA, 20 bp, Artificial
  CRISPR gRNA sequence
agcaccaaaataaaaaatga

SEQ ID NO: 727400 - DNA, 20 bp, Artificial
  CRISPR gRNA sequence
caacccattgaacagaacag

SEQ ID NO: 727401 - DNA, 20 bp, Artificial
  CRISPR gRNA sequence
aacagaacagggccccatga

SEQ ID NO: 727402 - DNA, 20 bp, Artificial
  CRISPR gRNA sequence
agttctgggctgggcgcggt

SEQ ID NO: 727403 - DNA, 20 bp, Artificial
  CRISPR gRNA sequence
tgggctgggcgcggtggcag

SEQ ID NO: 727404 - DNA, 20 bp, Artificial
  CRISPR gRNA sequence
ggctgggcgcggtggcagct

SEQ ID NO: 727405 - DNA, 20 bp, Artificial
  CRISPR gRNA sequence
ggcgcggtggcagctcacgc

SEQ ID NO: 727406 - DNA, 20 bp, Artificial
  CRISPR gRNA sequence
acgcctgtcatccctgaact

SEQ ID NO: 727407 - DNA, 20 bp, Artificial
  CRISPR gRNA sequence
tcatccctgaactttgggag

SEQ ID NO: 727408 - DNA, 20 bp, Artificial
  CRISPR gRNA sequence
aactttgggaggccgaggcg

SEQ ID NO: 727409 - DNA, 20 bp, Artificial
  CRISPR gRNA sequence
tgggaggccgaggcgggagg

SEQ ID NO: 727410 - DNA, 20 bp, Artificial
  CRISPR gRNA sequence
gggaggccgaggcgggagga

SEQ ID NO: 727411 - DNA, 20 bp, Artificial
  CRISPR gRNA sequence
ggaggccgaggcgggaggac

SEQ ID NO: 727412 - DNA, 20 bp, Artificial
  CRISPR gRNA sequence
gaggccaggagttcgagacc

SEQ ID NO: 727413 - DNA, 20 bp, Artificial
  CRISPR gRNA sequence
aggccaggagttcgagacca

SEQ ID NO: 727414 - DNA, 20 bp, Artificial
  CRISPR gRNA sequence
gagaccagcctggccaacat

SEQ ID NO: 727415 - DNA, 20 bp, Artificial
  CRISPR gRNA sequence
gccaacatggtgaaactctg

SEQ ID NO: 727416 - DNA, 20 bp, Artificial
  CRISPR gRNA sequence
tgtctctactgaaaatacaa

SEQ ID NO: 727417 - DNA, 20 bp, Artificial
  CRISPR gRNA sequence
tctctactgaaaatacaaaa

SEQ ID NO: 727418 - DNA, 20 bp, Artificial
  CRISPR gRNA sequence
tactgaaaatacaaaaaatg

SEQ ID NO: 727419 - DNA, 20 bp, Artificial
  CRISPR gRNA sequence
ctgaaaatacaaaaaatgag

SEQ ID NO: 727420 - DNA, 20 bp, Artificial
  CRISPR gRNA sequence
aaaatacaaaaaatgagcca

SEQ ID NO: 727421 - DNA, 20 bp, Artificial
  CRISPR gRNA sequence
tgtggcacacgcctgtaatc

SEQ ID NO: 727422 - DNA, 20 bp, Artificial
  CRISPR gRNA sequence
taatcccagccacttgggag

SEQ ID NO: 727423 - DNA, 20 bp, Artificial
  CRISPR gRNA sequence
gggaggctgaagcaggagaa

SEQ ID NO: 727424 - DNA, 20 bp, Artificial
  CRISPR gRNA sequence
ggaggctgaagcaggagaat

SEQ ID NO: 727425 - DNA, 20 bp, Artificial
  CRISPR gRNA sequence
aagcaggagaattgcttgaa

SEQ ID NO: 727426 - DNA, 20 bp, Artificial
  CRISPR gRNA sequence
cttgaacccaggaggcgggg

SEQ ID NO: 727427 - DNA, 20 bp, Artificial
  CRISPR gRNA sequence
gaacccaggaggcgggggtt

SEQ ID NO: 727428 - DNA, 20 bp, Artificial
  CRISPR gRNA sequence
aacccaggaggcgggggttg

SEQ ID NO: 727429 - DNA, 20 bp, Artificial
  CRISPR gRNA sequence
cagtaagccgagatcacact

SEQ ID NO: 727430 - DNA, 20 bp, Artificial
  CRISPR gRNA sequence
ctgcactccagcctgggtga

SEQ ID NO: 727431 - DNA, 20 bp, Artificial
  CRISPR gRNA sequence
cactccagcctgggtgacag

SEQ ID NO: 727432 - DNA, 20 bp, Artificial
  CRISPR gRNA sequence
cagcctgggtgacagagcca

SEQ ID NO: 727433 - DNA, 20 bp, Artificial
  CRISPR gRNA sequence
ggtgacagagccagaccctg

SEQ ID NO: 727434 - DNA, 20 bp, Artificial
  CRISPR gRNA sequence
tctcaaaaaaataaacaaat

SEQ ID NO: 727435 - DNA, 20 bp, Artificial
  CRISPR gRNA sequence
aaaaaaataaacaaataaat

SEQ ID NO: 727436 - DNA, 20 bp, Artificial
  CRISPR gRNA sequence
ctgaagaatgggctattgac

SEQ ID NO: 727437 - DNA, 20 bp, Artificial
  CRISPR gRNA sequence
aagaatgggctattgacata

SEQ ID NO: 727438 - DNA, 20 bp, Artificial
  CRISPR gRNA sequence
ttgacatagtctcaagtaac

SEQ ID NO: 727439 - DNA, 20 bp, Artificial
  CRISPR gRNA sequence
acatagtctcaagtaacgcc

SEQ ID NO: 727440 - DNA, 20 bp, Artificial
  CRISPR gRNA sequence
aagtaacgcccctaaagact

SEQ ID NO: 727441 - DNA, 20 bp, Artificial
  CRISPR gRNA sequence
aagacttagtaatgaccgag

SEQ ID NO: 727442 - DNA, 20 bp, Artificial
  CRISPR gRNA sequence
agtaatgaccgaggagcaaa

SEQ ID NO: 727443 - DNA, 20 bp, Artificial
  CRISPR gRNA sequence
gtaatgaccgaggagcaaat

SEQ ID NO: 727444 - DNA, 20 bp, Artificial
  CRISPR gRNA sequence
cgtcgagcgctcaaagtaca

SEQ ID NO: 727445 - DNA, 20 bp, Artificial
  CRISPR gRNA sequence
aaagtacacagcaccaggaa

SEQ ID NO: 727446 - DNA, 20 bp, Artificial
  CRISPR gRNA sequence
gcaggacgccctgagagaga

SEQ ID NO: 727447 - DNA, 20 bp, Artificial
  CRISPR gRNA sequence
agagagaagaggccagcatc

SEQ ID NO: 727448 - DNA, 20 bp, Artificial
  CRISPR gRNA sequence
ctgggaccttccagcccaag

SEQ ID NO: 727449 - DNA, 20 bp, Artificial
  CRISPR gRNA sequence
ggaccttccagcccaagatg

SEQ ID NO: 727450 - DNA, 20 bp, Artificial
  CRISPR gRNA sequence
ccagcccaagatgcatgacc

SEQ ID NO: 727451 - DNA, 20 bp, Artificial
  CRISPR gRNA sequence
cagcccaagatgcatgacct

SEQ ID NO: 727452 - DNA, 20 bp, Artificial
  CRISPR gRNA sequence
aatccactcgggagaaaaca

SEQ ID NO: 727453 - DNA, 20 bp, Artificial
  CRISPR gRNA sequence
gggagaaaacaccagacaaa

SEQ ID NO: 727454 - DNA, 20 bp, Artificial
  CRISPR gRNA sequence
cgctcttcccagtaagtgaa

SEQ ID NO: 727455 - DNA, 20 bp, Artificial
  CRISPR gRNA sequence
ttcccagtaagtgaaagaaa

SEQ ID NO: 727456 - DNA, 20 bp, Artificial
  CRISPR gRNA sequence
cccagtaagtgaaagaaacg

SEQ ID NO: 727457 - DNA, 20 bp, Artificial
  CRISPR gRNA sequence
ccagtaagtgaaagaaacgc

SEQ ID NO: 727458 - DNA, 20 bp, Artificial
  CRISPR gRNA sequence
gggaacggatccggacagaa

SEQ ID NO: 727459 - DNA, 20 bp, Artificial
  CRISPR gRNA sequence
gagaaaccagacaagcaaat

SEQ ID NO: 727460 - DNA, 20 bp, Artificial
  CRISPR gRNA sequence
agctggagtcctctgctata

SEQ ID NO: 727461 - DNA, 20 bp, Artificial
  CRISPR gRNA sequence
gagtcctctgctataaagga

SEQ ID NO: 727462 - DNA, 20 bp, Artificial
  CRISPR gRNA sequence
tgctataaaggacattattg

SEQ ID NO: 727463 - DNA, 20 bp, Artificial
  CRISPR gRNA sequence
ctataaaggacattattggg

SEQ ID NO: 727464 - DNA, 20 bp, Artificial
  CRISPR gRNA sequence
taaaggacattattgggaca

SEQ ID NO: 727465 - DNA, 20 bp, Artificial
  CRISPR gRNA sequence
ttgggacaaataaagaaact

SEQ ID NO: 727466 - DNA, 20 bp, Artificial
  CRISPR gRNA sequence
ggacaaataaagaaacttca

SEQ ID NO: 727467 - DNA, 20 bp, Artificial
  CRISPR gRNA sequence
caacagggcctgagaattca

SEQ ID NO: 727468 - DNA, 20 bp, Artificial
  CRISPR gRNA sequence
aacagggcctgagaattcat

SEQ ID NO: 727469 - DNA, 20 bp, Artificial
  CRISPR gRNA sequence
agaattcattgtgggtcatg

SEQ ID NO: 727470 - DNA, 20 bp, Artificial
  CRISPR gRNA sequence
attgtgggtcatgtatcagt

SEQ ID NO: 727471 - DNA, 20 bp, Artificial
  CRISPR gRNA sequence
tgggtcatgtatcagtgtga

SEQ ID NO: 727472 - DNA, 20 bp, Artificial
  CRISPR gRNA sequence
caattctgacgatccttacc

SEQ ID NO: 727473 - DNA, 20 bp, Artificial
  CRISPR gRNA sequence
tgacgatccttaccacatcg

SEQ ID NO: 727474 - DNA, 20 bp, Artificial
  CRISPR gRNA sequence
acgatccttaccacatcgtg

SEQ ID NO: 727475 - DNA, 20 bp, Artificial
  CRISPR gRNA sequence
accacatcgtgtaaaataca

SEQ ID NO: 727476 - DNA, 20 bp, Artificial
  CRISPR gRNA sequence
ccacatcgtgtaaaatacac

SEQ ID NO: 727477 - DNA, 20 bp, Artificial
  CRISPR gRNA sequence
gtctgtctgaaacacacact

SEQ ID NO: 727478 - DNA, 20 bp, Artificial
  CRISPR gRNA sequence
tctgtctgaaacacacactg

SEQ ID NO: 727479 - DNA, 20 bp, Artificial
  CRISPR gRNA sequence
tctgaaacacacactgaagt

SEQ ID NO: 727480 - DNA, 20 bp, Artificial
  CRISPR gRNA sequence
aaacacacactgaagttttc

SEQ ID NO: 727481 - DNA, 20 bp, Artificial
  CRISPR gRNA sequence
aagttttcggggtgagagac

SEQ ID NO: 727482 - DNA, 20 bp, Artificial
  CRISPR gRNA sequence
tcggggtgagagacatccag

SEQ ID NO: 727483 - DNA, 20 bp, Artificial
  CRISPR gRNA sequence
cggggtgagagacatccagt

SEQ ID NO: 727484 - DNA, 20 bp, Artificial
  CRISPR gRNA sequence
ggggtgagagacatccagtc

SEQ ID NO: 727485 - DNA, 20 bp, Artificial
  CRISPR gRNA sequence
ctctcaaatggttcaggtca

SEQ ID NO: 727486 - DNA, 20 bp, Artificial
  CRISPR gRNA sequence
tcaaatggttcaggtcaaaa

SEQ ID NO: 727487 - DNA, 20 bp, Artificial
  CRISPR gRNA sequence
aaatggttcaggtcaaaatg

SEQ ID NO: 727488 - DNA, 20 bp, Artificial
  CRISPR gRNA sequence
aggtcaaaatgaattcttca

SEQ ID NO: 727489 - DNA, 20 bp, Artificial
  CRISPR gRNA sequence
ttcatacttataccatttct

SEQ ID NO: 727490 - DNA, 20 bp, Artificial
  CRISPR gRNA sequence
catacttataccatttctat

SEQ ID NO: 727491 - DNA, 20 bp, Artificial
  CRISPR gRNA sequence
atacttataccatttctata

SEQ ID NO: 727492 - DNA, 20 bp, Artificial
  CRISPR gRNA sequence
ataccatttctataagtttg

SEQ ID NO: 727493 - DNA, 20 bp, Artificial
  CRISPR gRNA sequence
taccatttctataagtttga

SEQ ID NO: 727494 - DNA, 20 bp, Artificial
  CRISPR gRNA sequence
ctataagtttgaaactgttt

SEQ ID NO: 727495 - DNA, 20 bp, Artificial
  CRISPR gRNA sequence
tataagtttgaaactgtttc

SEQ ID NO: 727496 - DNA, 20 bp, Artificial
  CRISPR gRNA sequence
taagtttgaaactgtttcaa

SEQ ID NO: 727497 - DNA, 20 bp, Artificial
  CRISPR gRNA sequence
gaaactgtttcaaaacaaaa

SEQ ID NO: 727498 - DNA, 20 bp, Artificial
  CRISPR gRNA sequence
aaactgtttcaaaacaaaaa

SEQ ID NO: 727499 - DNA, 20 bp, Artificial
  CRISPR gRNA sequence
tttcaaaacaaaaaaagaat

SEQ ID NO: 727500 - DNA, 20 bp, Artificial
  CRISPR gRNA sequence
caaaacaaaaaaagaatttc

SEQ ID NO: 727501 - DNA, 20 bp, Artificial
  CRISPR gRNA sequence
aaaacaaaaaaagaatttct

SEQ ID NO: 727502 - DNA, 20 bp, Artificial
  CRISPR gRNA sequence
ctttcaacctaaatctccct

SEQ ID NO: 727503 - DNA, 20 bp, Artificial
  CRISPR gRNA sequence
tttcaacctaaatctccctg

SEQ ID NO: 727504 - DNA, 20 bp, Artificial
  CRISPR gRNA sequence
tcaacctaaatctccctgga

SEQ ID NO: 727505 - DNA, 20 bp, Artificial
  CRISPR gRNA sequence
caacctaaatctccctggaa

SEQ ID NO: 727506 - DNA, 20 bp, Artificial
  CRISPR gRNA sequence
aacctaaatctccctggaat

SEQ ID NO: 727507 - DNA, 20 bp, Artificial
  CRISPR gRNA sequence
aatctccctggaataataga

SEQ ID NO: 727508 - DNA, 20 bp, Artificial
  CRISPR gRNA sequence
cctggaataatagaaaatga

SEQ ID NO: 727509 - DNA, 20 bp, Artificial
  CRISPR gRNA sequence
gaataatagaaaatgactca

SEQ ID NO: 727510 - DNA, 20 bp, Artificial
  CRISPR gRNA sequence
aagtgctcataaaaatgaag

SEQ ID NO: 727511 - DNA, 20 bp, Artificial
  CRISPR gRNA sequence
ataaaaatgaaggattaaaa

SEQ ID NO: 727512 - DNA, 20 bp, Artificial
  CRISPR gRNA sequence
aaagaattttaaggccaggc

SEQ ID NO: 727513 - DNA, 20 bp, Artificial
  CRISPR gRNA sequence
taaggccaggcatggtggct

SEQ ID NO: 727514 - DNA, 20 bp, Artificial
  CRISPR gRNA sequence
aaggccaggcatggtggctc

SEQ ID NO: 727515 - DNA, 20 bp, Artificial
  CRISPR gRNA sequence
aggccaggcatggtggctca

SEQ ID NO: 727516 - DNA, 20 bp, Artificial
  CRISPR gRNA sequence
atgcctgcaaacccagcact

SEQ ID NO: 727517 - DNA, 20 bp, Artificial
  CRISPR gRNA sequence
caaacccagcactttgggag

SEQ ID NO: 727518 - DNA, 20 bp, Artificial
  CRISPR gRNA sequence
tgggaggccgaggcaggcgg

SEQ ID NO: 727519 - DNA, 20 bp, Artificial
  CRISPR gRNA sequence
gggaggccgaggcaggcgga

SEQ ID NO: 727520 - DNA, 20 bp, Artificial
  CRISPR gRNA sequence
ggaggccgaggcaggcggat

SEQ ID NO: 727521 - DNA, 20 bp, Artificial
  CRISPR gRNA sequence
gagaccagcctggccaacac

SEQ ID NO: 727522 - DNA, 20 bp, Artificial
  CRISPR gRNA sequence
agaccagcctggccaacacg

SEQ ID NO: 727523 - DNA, 20 bp, Artificial
  CRISPR gRNA sequence
gccaacacggtgaaaccccg

SEQ ID NO: 727524 - DNA, 20 bp, Artificial
  CRISPR gRNA sequence
tactaaaaataccaaaatta

SEQ ID NO: 727525 - DNA, 20 bp, Artificial
  CRISPR gRNA sequence
ctaaaaataccaaaattagc

SEQ ID NO: 727526 - DNA, 20 bp, Artificial
  CRISPR gRNA sequence
aaaataccaaaattagccag

SEQ ID NO: 727527 - DNA, 20 bp, Artificial
  CRISPR gRNA sequence
gccaggcatggtggcaggag

SEQ ID NO: 727528 - DNA, 20 bp, Artificial
  CRISPR gRNA sequence
taatcccagctactcaggag

SEQ ID NO: 727529 - DNA, 20 bp, Artificial
  CRISPR gRNA sequence
ctcaggaggctgaggcagga

SEQ ID NO: 727530 - DNA, 20 bp, Artificial
  CRISPR gRNA sequence
aggaggctgaggcaggagaa

SEQ ID NO: 727531 - DNA, 20 bp, Artificial
  CRISPR gRNA sequence
aggcaggagaatcacttgaa

SEQ ID NO: 727532 - DNA, 20 bp, Artificial
  CRISPR gRNA sequence
gaacccgtgaggcggaggtt

SEQ ID NO: 727533 - DNA, 20 bp, Artificial
  CRISPR gRNA sequence
aacccgtgaggcggaggttg

SEQ ID NO: 727534 - DNA, 20 bp, Artificial
  CRISPR gRNA sequence
cagtgaacccagatggcacc

SEQ ID NO: 727535 - DNA, 20 bp, Artificial
  CRISPR gRNA sequence
cagcctgggtgacagagcga

SEQ ID NO: 727536 - DNA, 20 bp, Artificial
  CRISPR gRNA sequence
ggtgacagagcgagactctg

SEQ ID NO: 727537 - DNA, 20 bp, Artificial
  CRISPR gRNA sequence
tgtctcaaaaaaaaaaaaaa

SEQ ID NO: 727538 - DNA, 20 bp, Artificial
  CRISPR gRNA sequence
tctcaaaaaaaaaaaaaaaa

SEQ ID NO: 727539 - DNA, 20 bp, Artificial
  CRISPR gRNA sequence
aaaaaaaaaaaaaaaaaaag

SEQ ID NO: 727540 - DNA, 20 bp, Artificial
  CRISPR gRNA sequence
tagaccagtggttctcaacc

SEQ ID NO: 727541 - DNA, 20 bp, Artificial
  CRISPR gRNA sequence
agaccagtggttctcaacca

SEQ ID NO: 727542 - DNA, 20 bp, Artificial
  CRISPR gRNA sequence
gaccagtggttctcaaccag

SEQ ID NO: 727543 - DNA, 20 bp, Artificial
  CRISPR gRNA sequence
tcaaccaggaggttttcccc

SEQ ID NO: 727544 - DNA, 20 bp, Artificial
  CRISPR gRNA sequence
aaccaggaggttttccccag

SEQ ID NO: 727545 - DNA, 20 bp, Artificial
  CRISPR gRNA sequence
tccccaggggccacatggca

SEQ ID NO: 727546 - DNA, 20 bp, Artificial
  CRISPR gRNA sequence
ccccaggggccacatggcaa

SEQ ID NO: 727547 - DNA, 20 bp, Artificial
  CRISPR gRNA sequence
cccaggggccacatggcaat

SEQ ID NO: 727548 - DNA, 20 bp, Artificial
  CRISPR gRNA sequence
gagacatttttggttgtccc

SEQ ID NO: 727549 - DNA, 20 bp, Artificial
  CRISPR gRNA sequence
ttggttgtcccaagtaggga

SEQ ID NO: 727550 - DNA, 20 bp, Artificial
  CRISPR gRNA sequence
tggttgtcccaagtagggaa

SEQ ID NO: 727551 - DNA, 20 bp, Artificial
  CRISPR gRNA sequence
ggttgtcccaagtagggaag

SEQ ID NO: 727552 - DNA, 20 bp, Artificial
  CRISPR gRNA sequence
gttgtcccaagtagggaagg

SEQ ID NO: 727553 - DNA, 20 bp, Artificial
  CRISPR gRNA sequence
tcccaagtagggaaggttac

SEQ ID NO: 727554 - DNA, 20 bp, Artificial
  CRISPR gRNA sequence
ctggcatctagaggggctgt

SEQ ID NO: 727555 - DNA, 20 bp, Artificial
  CRISPR gRNA sequence
gcatctagaggggctgtaca

SEQ ID NO: 727556 - DNA, 20 bp, Artificial
  CRISPR gRNA sequence
gaggggctgtacaacgtcct

SEQ ID NO: 727557 - DNA, 20 bp, Artificial
  CRISPR gRNA sequence
tacaacgtcctataggatag

SEQ ID NO: 727558 - DNA, 20 bp, Artificial
  CRISPR gRNA sequence
taggatagcgctccacagca

SEQ ID NO: 727559 - DNA, 20 bp, Artificial
  CRISPR gRNA sequence
cacagcaaagaaccatccat

SEQ ID NO: 727560 - DNA, 20 bp, Artificial
  CRISPR gRNA sequence
ccaaatgtcaatggtgccaa

SEQ ID NO: 727561 - DNA, 20 bp, Artificial
  CRISPR gRNA sequence
tttacaaacatctcaacaac

SEQ ID NO: 727562 - DNA, 20 bp, Artificial
  CRISPR gRNA sequence
ttacaaacatctcaacaacc

SEQ ID NO: 727563 - DNA, 20 bp, Artificial
  CRISPR gRNA sequence
tacaaacatctcaacaacca

SEQ ID NO: 727564 - DNA, 20 bp, Artificial
  CRISPR gRNA sequence
acaaacatctcaacaaccac

SEQ ID NO: 727565 - DNA, 20 bp, Artificial
  CRISPR gRNA sequence
caaacatctcaacaaccacg

SEQ ID NO: 727566 - DNA, 20 bp, Artificial
  CRISPR gRNA sequence
aacaaccacgataaaatccc

SEQ ID NO: 727567 - DNA, 20 bp, Artificial
  CRISPR gRNA sequence
cggctcacccagcacgtggc

SEQ ID NO: 727568 - DNA, 20 bp, Artificial
  CRISPR gRNA sequence
acccagcacgtggccttaaa

SEQ ID NO: 727569 - DNA, 20 bp, Artificial
  CRISPR gRNA sequence
aaacgaattacttcaccatc

SEQ ID NO: 727570 - DNA, 20 bp, Artificial
  CRISPR gRNA sequence
aacgaattacttcaccatcc

SEQ ID NO: 727571 - DNA, 20 bp, Artificial
  CRISPR gRNA sequence
cttcaccatcctgtgcctta

SEQ ID NO: 727572 - DNA, 20 bp, Artificial
  CRISPR gRNA sequence
caccatcctgtgccttaggc

SEQ ID NO: 727573 - DNA, 20 bp, Artificial
  CRISPR gRNA sequence
accatcctgtgccttaggct

SEQ ID NO: 727574 - DNA, 20 bp, Artificial
  CRISPR gRNA sequence
tgccttaggctgctaatctg

SEQ ID NO: 727575 - DNA, 20 bp, Artificial
  CRISPR gRNA sequence
aggctgctaatctgtgcaac

SEQ ID NO: 727576 - DNA, 20 bp, Artificial
  CRISPR gRNA sequence
ggctgctaatctgtgcaacg

SEQ ID NO: 727577 - DNA, 20 bp, Artificial
  CRISPR gRNA sequence
ctaatctgtgcaacggggat

SEQ ID NO: 727578 - DNA, 20 bp, Artificial
  CRISPR gRNA sequence
atctgtgcaacggggataac

SEQ ID NO: 727579 - DNA, 20 bp, Artificial
  CRISPR gRNA sequence
tgcaacggggataacagtaa

SEQ ID NO: 727580 - DNA, 20 bp, Artificial
  CRISPR gRNA sequence
acaggccaccggaggagtgg

SEQ ID NO: 727581 - DNA, 20 bp, Artificial
  CRISPR gRNA sequence
tgcaaatgcctgtcaccgag

SEQ ID NO: 727582 - DNA, 20 bp, Artificial
  CRISPR gRNA sequence
gcaaatgcctgtcaccgagg

SEQ ID NO: 727583 - DNA, 20 bp, Artificial
  CRISPR gRNA sequence
caaatgcctgtcaccgagga

SEQ ID NO: 727584 - DNA, 20 bp, Artificial
  CRISPR gRNA sequence
tcaccgaggacacacacggg

SEQ ID NO: 727585 - DNA, 20 bp, Artificial
  CRISPR gRNA sequence
gagggctggttggtgggcct

SEQ ID NO: 727586 - DNA, 20 bp, Artificial
  CRISPR gRNA sequence
gttggtgggcctctcatcgc

SEQ ID NO: 727587 - DNA, 20 bp, Artificial
  CRISPR gRNA sequence
gtgggcctctcatcgcacct

SEQ ID NO: 727588 - DNA, 20 bp, Artificial
  CRISPR gRNA sequence
tcatcgcacctgcacggacc

SEQ ID NO: 727589 - DNA, 20 bp, Artificial
  CRISPR gRNA sequence
atcgcacctgcacggaccac

SEQ ID NO: 727590 - DNA, 20 bp, Artificial
  CRISPR gRNA sequence
cacggaccacagatccctga

SEQ ID NO: 727591 - DNA, 20 bp, Artificial
  CRISPR gRNA sequence
atgtgctcactgctcaaagg

SEQ ID NO: 727592 - DNA, 20 bp, Artificial
  CRISPR gRNA sequence
actgctcaaaggaaccaaga

SEQ ID NO: 727593 - DNA, 20 bp, Artificial
  CRISPR gRNA sequence
ctcaaaggaaccaagagcac

SEQ ID NO: 727594 - DNA, 20 bp, Artificial
  CRISPR gRNA sequence
aaaggaaccaagagcaccct

SEQ ID NO: 727595 - DNA, 20 bp, Artificial
  CRISPR gRNA sequence
tgccccaggtctgggatgtg

SEQ ID NO: 727596 - DNA, 20 bp, Artificial
  CRISPR gRNA sequence
ccccaggtctgggatgtggg

SEQ ID NO: 727597 - DNA, 20 bp, Artificial
  CRISPR gRNA sequence
ggatgtgggaggccaagggg

SEQ ID NO: 727598 - DNA, 20 bp, Artificial
  CRISPR gRNA sequence
ccctcccgtctgcctttggc

SEQ ID NO: 727599 - DNA, 20 bp, Artificial
  CRISPR gRNA sequence
ccgtctgcctttggcctctg

SEQ ID NO: 727600 - DNA, 20 bp, Artificial
  CRISPR gRNA sequence
cctttggcctctgcgggcag

SEQ ID NO: 727601 - DNA, 20 bp, Artificial
  CRISPR gRNA sequence
tggcctctgcgggcagtcgg

SEQ ID NO: 727602 - DNA, 20 bp, Artificial
  CRISPR gRNA sequence
ggcctctgcgggcagtcgga

SEQ ID NO: 727603 - DNA, 20 bp, Artificial
  CRISPR gRNA sequence
gcctctgcgggcagtcggaa

SEQ ID NO: 727604 - DNA, 20 bp, Artificial
  CRISPR gRNA sequence
tgcgggcagtcggaattagt

SEQ ID NO: 727605 - DNA, 20 bp, Artificial
  CRISPR gRNA sequence
cgggcagtcggaattagtct

SEQ ID NO: 727606 - DNA, 20 bp, Artificial
  CRISPR gRNA sequence
gtctaaaagcttggagggag

SEQ ID NO: 727607 - DNA, 20 bp, Artificial
  CRISPR gRNA sequence
aaagcttggagggagctaga

SEQ ID NO: 727608 - DNA, 20 bp, Artificial
  CRISPR gRNA sequence
ggagggagctagaacagctt

SEQ ID NO: 727609 - DNA, 20 bp, Artificial
  CRISPR gRNA sequence
gagggagctagaacagcttc

SEQ ID NO: 727610 - DNA, 20 bp, Artificial
  CRISPR gRNA sequence
gaacagcttctgggcccggc

SEQ ID NO: 727611 - DNA, 20 bp, Artificial
  CRISPR gRNA sequence
ctgggcccggcacagagcct

SEQ ID NO: 727612 - DNA, 20 bp, Artificial
  CRISPR gRNA sequence
tgggcccggcacagagcctg

SEQ ID NO: 727613 - DNA, 20 bp, Artificial
  CRISPR gRNA sequence
ggcccggcacagagcctgca

SEQ ID NO: 727614 - DNA, 20 bp, Artificial
  CRISPR gRNA sequence
caaggaggaagtgctccgtg

SEQ ID NO: 727615 - DNA, 20 bp, Artificial
  CRISPR gRNA sequence
cgtgaagaccatgtgaatag

SEQ ID NO: 727616 - DNA, 20 bp, Artificial
  CRISPR gRNA sequence
cttccctccttcaccaccca

SEQ ID NO: 727617 - DNA, 20 bp, Artificial
  CRISPR gRNA sequence
ccctccttcaccacccacgg

SEQ ID NO: 727618 - DNA, 20 bp, Artificial
  CRISPR gRNA sequence
cctccttcaccacccacggc

SEQ ID NO: 727619 - DNA, 20 bp, Artificial
  CRISPR gRNA sequence
cttcaccacccacggctcag

SEQ ID NO: 727620 - DNA, 20 bp, Artificial
  CRISPR gRNA sequence
caccacccacggctcaggag

SEQ ID NO: 727621 - DNA, 20 bp, Artificial
  CRISPR gRNA sequence
accacccacggctcaggagg

SEQ ID NO: 727622 - DNA, 20 bp, Artificial
  CRISPR gRNA sequence
aggagggaaaggggcatccg

SEQ ID NO: 727623 - DNA, 20 bp, Artificial
  CRISPR gRNA sequence
ggtccattctcacccggtgc

SEQ ID NO: 727624 - DNA, 20 bp, Artificial
  CRISPR gRNA sequence
tcacccggtgctctgtgagc

SEQ ID NO: 727625 - DNA, 20 bp, Artificial
  CRISPR gRNA sequence
acccggtgctctgtgagctt

SEQ ID NO: 727626 - DNA, 20 bp, Artificial
  CRISPR gRNA sequence
tgtgagcttgcctgtcttgg

SEQ ID NO: 727627 - DNA, 20 bp, Artificial
  CRISPR gRNA sequence
tgagcttgcctgtcttggct

SEQ ID NO: 727628 - DNA, 20 bp, Artificial
  CRISPR gRNA sequence
gcctgtcttggcttcacttt

SEQ ID NO: 727629 - DNA, 20 bp, Artificial
  CRISPR gRNA sequence
cctgtcttggcttcactttc

SEQ ID NO: 727630 - DNA, 20 bp, Artificial
  CRISPR gRNA sequence
tcttggcttcactttctgtc

SEQ ID NO: 727631 - DNA, 20 bp, Artificial
  CRISPR gRNA sequence
ggcttcactttctgtccatc

SEQ ID NO: 727632 - DNA, 20 bp, Artificial
  CRISPR gRNA sequence
gcttcactttctgtccatct

SEQ ID NO: 727633 - DNA, 20 bp, Artificial
  CRISPR gRNA sequence
cactttctgtccatcttgag

SEQ ID NO: 727634 - DNA, 20 bp, Artificial
  CRISPR gRNA sequence
actttctgtccatcttgagc

SEQ ID NO: 727635 - DNA, 20 bp, Artificial
  CRISPR gRNA sequence
tctgtccatcttgagcctcg

SEQ ID NO: 727636 - DNA, 20 bp, Artificial
  CRISPR gRNA sequence
ctgtccatcttgagcctcgg

SEQ ID NO: 727637 - DNA, 20 bp, Artificial
  CRISPR gRNA sequence
tgtccatcttgagcctcgga

SEQ ID NO: 727638 - DNA, 20 bp, Artificial
  CRISPR gRNA sequence
tccatcttgagcctcggaac

SEQ ID NO: 727639 - DNA, 20 bp, Artificial
  CRISPR gRNA sequence
gagcctcggaacccagaccc

SEQ ID NO: 727640 - DNA, 20 bp, Artificial
  CRISPR gRNA sequence
agcctcggaacccagacccc

SEQ ID NO: 727641 - DNA, 20 bp, Artificial
  CRISPR gRNA sequence
ggaacccagaccccaaggtc

SEQ ID NO: 727642 - DNA, 20 bp, Artificial
  CRISPR gRNA sequence
gagggtcaaaaacgacctga

SEQ ID NO: 727643 - DNA, 20 bp, Artificial
  CRISPR gRNA sequence
agataagatgtccaccattg

SEQ ID NO: 727644 - DNA, 20 bp, Artificial
  CRISPR gRNA sequence
agtctcagggctcagttctt

SEQ ID NO: 727645 - DNA, 20 bp, Artificial
  CRISPR gRNA sequence
agggctcagttctttgtaga

SEQ ID NO: 727646 - DNA, 20 bp, Artificial
  CRISPR gRNA sequence
agttctttgtagacctggct

SEQ ID NO: 727647 - DNA, 20 bp, Artificial
  CRISPR gRNA sequence
tttgtagacctggcttctta

SEQ ID NO: 727648 - DNA, 20 bp, Artificial
  CRISPR gRNA sequence
tgtagacctggcttcttagg

SEQ ID NO: 727649 - DNA, 20 bp, Artificial
  CRISPR gRNA sequence
gtagacctggcttcttaggg

SEQ ID NO: 727650 - DNA, 20 bp, Artificial
  CRISPR gRNA sequence
tagacctggcttcttagggg

SEQ ID NO: 727651 - DNA, 20 bp, Artificial
  CRISPR gRNA sequence
gcttcttaggggaaggtgtt

SEQ ID NO: 727652 - DNA, 20 bp, Artificial
  CRISPR gRNA sequence
cttaggggaaggtgttttct

SEQ ID NO: 727653 - DNA, 20 bp, Artificial
  CRISPR gRNA sequence
ttaggggaaggtgttttctt

SEQ ID NO: 727654 - DNA, 20 bp, Artificial
  CRISPR gRNA sequence
aggggaaggtgttttctttc

SEQ ID NO: 727655 - DNA, 20 bp, Artificial
  CRISPR gRNA sequence
ggggaaggtgttttctttct

SEQ ID NO: 727656 - DNA, 20 bp, Artificial
  CRISPR gRNA sequence
tctttctttctttctttttt

SEQ ID NO: 727657 - DNA, 20 bp, Artificial
  CRISPR gRNA sequence
ctttctttctttcttttttt

SEQ ID NO: 727658 - DNA, 20 bp, Artificial
  CRISPR gRNA sequence
tttctttctttctttttttc

SEQ ID NO: 727659 - DNA, 20 bp, Artificial
  CRISPR gRNA sequence
tctttctttctttttttctt

SEQ ID NO: 727660 - DNA, 20 bp, Artificial
  CRISPR gRNA sequence
ctttctttctttttttcttc

SEQ ID NO: 727661 - DNA, 20 bp, Artificial
  CRISPR gRNA sequence
tttctttctttttttcttct

SEQ ID NO: 727662 - DNA, 20 bp, Artificial
  CRISPR gRNA sequence
tctttctttttttcttctgt

SEQ ID NO: 727663 - DNA, 20 bp, Artificial
  CRISPR gRNA sequence
ctttctttttttcttctgta

SEQ ID NO: 727664 - DNA, 20 bp, Artificial
  CRISPR gRNA sequence
tttctttttttcttctgtaa

SEQ ID NO: 727665 - DNA, 20 bp, Artificial
  CRISPR gRNA sequence
tctttttttcttctgtaaca

SEQ ID NO: 727666 - DNA, 20 bp, Artificial
  CRISPR gRNA sequence
ctttttttcttctgtaacaa

SEQ ID NO: 727667 - DNA, 20 bp, Artificial
  CRISPR gRNA sequence
tttttttcttctgtaacaaa

SEQ ID NO: 727668 - DNA, 20 bp, Artificial
  CRISPR gRNA sequence
tttttcttctgtaacaaaac

SEQ ID NO: 727669 - DNA, 20 bp, Artificial
  CRISPR gRNA sequence
ttttcttctgtaacaaaact

SEQ ID NO: 727670 - DNA, 20 bp, Artificial
  CRISPR gRNA sequence
tttcttctgtaacaaaactg

SEQ ID NO: 727671 - DNA, 20 bp, Artificial
  CRISPR gRNA sequence
ttcttctgtaacaaaactgc

SEQ ID NO: 727672 - DNA, 20 bp, Artificial
  CRISPR gRNA sequence
tcttctgtaacaaaactgct

SEQ ID NO: 727673 - DNA, 20 bp, Artificial
  CRISPR gRNA sequence
cttctgtaacaaaactgctc

SEQ ID NO: 727674 - DNA, 20 bp, Artificial
  CRISPR gRNA sequence
ttctgtaacaaaactgctct

SEQ ID NO: 727675 - DNA, 20 bp, Artificial
  CRISPR gRNA sequence
ctgtaacaaaactgctctca

SEQ ID NO: 727676 - DNA, 20 bp, Artificial
  CRISPR gRNA sequence
tgtaacaaaactgctctcac

SEQ ID NO: 727677 - DNA, 20 bp, Artificial
  CRISPR gRNA sequence
taacaaaactgctctcacag

SEQ ID NO: 727678 - DNA, 20 bp, Artificial
  CRISPR gRNA sequence
ctctcacagaggtttgaaga

SEQ ID NO: 727679 - DNA, 20 bp, Artificial
  CRISPR gRNA sequence
tcacagaggtttgaagaaaa

SEQ ID NO: 727680 - DNA, 20 bp, Artificial
  CRISPR gRNA sequence
acagaggtttgaagaaaaaa

SEQ ID NO: 727681 - DNA, 20 bp, Artificial
  CRISPR gRNA sequence
gaagaaaaaaaataaactga

SEQ ID NO: 727682 - DNA, 20 bp, Artificial
  CRISPR gRNA sequence
aagaaaaaaaataaactgac

SEQ ID NO: 727683 - DNA, 20 bp, Artificial
  CRISPR gRNA sequence
acggcaatggaaattctaat

SEQ ID NO: 727684 - DNA, 20 bp, Artificial
  CRISPR gRNA sequence
taatactagaaaaatgtcaa

SEQ ID NO: 727685 - DNA, 20 bp, Artificial
  CRISPR gRNA sequence
atactagaaaaatgtcaaga

SEQ ID NO: 727686 - DNA, 20 bp, Artificial
  CRISPR gRNA sequence
gaaaaatgtcaagaaagcaa

SEQ ID NO: 727687 - DNA, 20 bp, Artificial
  CRISPR gRNA sequence
caatgagacactcagcctga

SEQ ID NO: 727688 - DNA, 20 bp, Artificial
  CRISPR gRNA sequence
aatgagacactcagcctgac

SEQ ID NO: 727689 - DNA, 20 bp, Artificial
  CRISPR gRNA sequence
agcctgacaggtcatggaaa

SEQ ID NO: 727690 - DNA, 20 bp, Artificial
  CRISPR gRNA sequence
acaggtcatggaaacaggct

SEQ ID NO: 727691 - DNA, 20 bp, Artificial
  CRISPR gRNA sequence
gaaactatcaaaacacaaaa

SEQ ID NO: 727692 - DNA, 20 bp, Artificial
  CRISPR gRNA sequence
aaactatcaaaacacaaaaa

SEQ ID NO: 727693 - DNA, 20 bp, Artificial
  CRISPR gRNA sequence
tcaaaacacaaaaacccccc

SEQ ID NO: 727694 - DNA, 20 bp, Artificial
  CRISPR gRNA sequence
gcacagggaccacagtgctt

SEQ ID NO: 727695 - DNA, 20 bp, Artificial
  CRISPR gRNA sequence
cacagggaccacagtgcttg

SEQ ID NO: 727696 - DNA, 20 bp, Artificial
  CRISPR gRNA sequence
gcttgtgaaactcgtcaaat

SEQ ID NO: 727697 - DNA, 20 bp, Artificial
  CRISPR gRNA sequence
cttgtgaaactcgtcaaatt

SEQ ID NO: 727698 - DNA, 20 bp, Artificial
  CRISPR gRNA sequence
gtgaaactcgtcaaattcaa

SEQ ID NO: 727699 - DNA, 20 bp, Artificial
  CRISPR gRNA sequence
tgaaactcgtcaaattcaaa

SEQ ID NO: 727700 - DNA, 20 bp, Artificial
  CRISPR gRNA sequence
gtcaaattcaaaacatgcct

SEQ ID NO: 727701 - DNA, 20 bp, Artificial
  CRISPR gRNA sequence
aaaacatgcctcagtggact

SEQ ID NO: 727702 - DNA, 20 bp, Artificial
  CRISPR gRNA sequence
agtggactgtgtttttgtgc

SEQ ID NO: 727703 - DNA, 20 bp, Artificial
  CRISPR gRNA sequence
tgtttttgtgcccaagtcaa

SEQ ID NO: 727704 - DNA, 20 bp, Artificial
  CRISPR gRNA sequence
ttgtgcccaagtcaacagtc

SEQ ID NO: 727705 - DNA, 20 bp, Artificial
  CRISPR gRNA sequence
tgtgcccaagtcaacagtca

SEQ ID NO: 727706 - DNA, 20 bp, Artificial
  CRISPR gRNA sequence
gtgcccaagtcaacagtcag

SEQ ID NO: 727707 - DNA, 20 bp, Artificial
  CRISPR gRNA sequence
tgcccaagtcaacagtcagc

SEQ ID NO: 727708 - DNA, 20 bp, Artificial
  CRISPR gRNA sequence
tgcaagggcctctgcaaggg

SEQ ID NO: 727709 - DNA, 20 bp, Artificial
  CRISPR gRNA sequence
tgcaagggtcctggggagat

SEQ ID NO: 727710 - DNA, 20 bp, Artificial
  CRISPR gRNA sequence
caagggtcctggggagatca

SEQ ID NO: 727711 - DNA, 20 bp, Artificial
  CRISPR gRNA sequence
gggagatcaggggacgggcc

SEQ ID NO: 727712 - DNA, 20 bp, Artificial
  CRISPR gRNA sequence
gccttaggctgagcacgtgg

SEQ ID NO: 727713 - DNA, 20 bp, Artificial
  CRISPR gRNA sequence
aggctgagcacgtggctctt

SEQ ID NO: 727714 - DNA, 20 bp, Artificial
  CRISPR gRNA sequence
ggctgagcacgtggctcttg

SEQ ID NO: 727715 - DNA, 20 bp, Artificial
  CRISPR gRNA sequence
agcacgtggctcttgggtag

SEQ ID NO: 727716 - DNA, 20 bp, Artificial
  CRISPR gRNA sequence
ttgggtaggcattgcgatgg

SEQ ID NO: 727717 - DNA, 20 bp, Artificial
  CRISPR gRNA sequence
gggtaggcattgcgatggtg

SEQ ID NO: 727718 - DNA, 20 bp, Artificial
  CRISPR gRNA sequence
ggtaggcattgcgatggtgg

SEQ ID NO: 727719 - DNA, 20 bp, Artificial
  CRISPR gRNA sequence
cgatggtggacagagctggc

SEQ ID NO: 727720 - DNA, 20 bp, Artificial
  CRISPR gRNA sequence
gcagggggaaggaagagggg

SEQ ID NO: 727721 - DNA, 20 bp, Artificial
  CRISPR gRNA sequence
agccctttacaaaccaaaac

SEQ ID NO: 727722 - DNA, 20 bp, Artificial
  CRISPR gRNA sequence
tacaaaccaaaacccctagg

SEQ ID NO: 727723 - DNA, 20 bp, Artificial
  CRISPR gRNA sequence
acaaaccaaaacccctagga

SEQ ID NO: 727724 - DNA, 20 bp, Artificial
  CRISPR gRNA sequence
caaaccaaaacccctaggac

SEQ ID NO: 727725 - DNA, 20 bp, Artificial
  CRISPR gRNA sequence
ggaccagtgcctgaggctgg

SEQ ID NO: 727726 - DNA, 20 bp, Artificial
  CRISPR gRNA sequence
aggctggctgtgccactgcc

SEQ ID NO: 727727 - DNA, 20 bp, Artificial
  CRISPR gRNA sequence
gctgtgccactgccaggctg

SEQ ID NO: 727728 - DNA, 20 bp, Artificial
  CRISPR gRNA sequence
tgccactgccaggctgtgtg

SEQ ID NO: 727729 - DNA, 20 bp, Artificial
  CRISPR gRNA sequence
ccaggctgtgtggccctggg

SEQ ID NO: 727730 - DNA, 20 bp, Artificial
  CRISPR gRNA sequence
tgtggccctgggccagccgt

SEQ ID NO: 727731 - DNA, 20 bp, Artificial
  CRISPR gRNA sequence
ggccagccgtccaccttgct

SEQ ID NO: 727732 - DNA, 20 bp, Artificial
  CRISPR gRNA sequence
gctgagccctgcctcctcct

SEQ ID NO: 727733 - DNA, 20 bp, Artificial
  CRISPR gRNA sequence
ctgagccctgcctcctcctt

SEQ ID NO: 727734 - DNA, 20 bp, Artificial
  CRISPR gRNA sequence
agccctgcctcctccttgca

SEQ ID NO: 727735 - DNA, 20 bp, Artificial
  CRISPR gRNA sequence
cctcctccttgcagaacaaa

SEQ ID NO: 727736 - DNA, 20 bp, Artificial
  CRISPR gRNA sequence
ctccttgcagaacaaaggtc

SEQ ID NO: 727737 - DNA, 20 bp, Artificial
  CRISPR gRNA sequence
cttgcagaacaaaggtcatc

SEQ ID NO: 727738 - DNA, 20 bp, Artificial
  CRISPR gRNA sequence
gcagaacaaaggtcatcact

SEQ ID NO: 727739 - DNA, 20 bp, Artificial
  CRISPR gRNA sequence
cagaacaaaggtcatcactg

SEQ ID NO: 727740 - DNA, 20 bp, Artificial
  CRISPR gRNA sequence
ggggagtacaggaagcctgt

SEQ ID NO: 727741 - DNA, 20 bp, Artificial
  CRISPR gRNA sequence
tatgggagcccaccttgcaa

SEQ ID NO: 727742 - DNA, 20 bp, Artificial
  CRISPR gRNA sequence
gcaaatcagaaacgaaggct

SEQ ID NO: 727743 - DNA, 20 bp, Artificial
  CRISPR gRNA sequence
caaatcagaaacgaaggctc

SEQ ID NO: 727744 - DNA, 20 bp, Artificial
  CRISPR gRNA sequence
agacgattcccccatcagag

SEQ ID NO: 727745 - DNA, 20 bp, Artificial
  CRISPR gRNA sequence
ccccatcagagcccagcaca

SEQ ID NO: 727746 - DNA, 20 bp, Artificial
  CRISPR gRNA sequence
aggaagaccctggcctgcct

SEQ ID NO: 727747 - DNA, 20 bp, Artificial
  CRISPR gRNA sequence
gcctgccttgaaggggctgc

SEQ ID NO: 727748 - DNA, 20 bp, Artificial
  CRISPR gRNA sequence
ccttgaaggggctgcccagg

SEQ ID NO: 727749 - DNA, 20 bp, Artificial
  CRISPR gRNA sequence
gaaggggctgcccaggagag

SEQ ID NO: 727750 - DNA, 20 bp, Artificial
  CRISPR gRNA sequence
aaggggctgcccaggagaga

SEQ ID NO: 727751 - DNA, 20 bp, Artificial
  CRISPR gRNA sequence
cccaggagagagaaggtgct

SEQ ID NO: 727752 - DNA, 20 bp, Artificial
  CRISPR gRNA sequence
ggcacaagatagctgggagc

SEQ ID NO: 727753 - DNA, 20 bp, Artificial
  CRISPR gRNA sequence
gcacaagatagctgggagcc

SEQ ID NO: 727754 - DNA, 20 bp, Artificial
  CRISPR gRNA sequence
ggagccccctgccccaggtg

SEQ ID NO: 727755 - DNA, 20 bp, Artificial
  CRISPR gRNA sequence
ccccaggtgagagctagaag

SEQ ID NO: 727756 - DNA, 20 bp, Artificial
  CRISPR gRNA sequence
gaagacacacgctgtataga

SEQ ID NO: 727757 - DNA, 20 bp, Artificial
  CRISPR gRNA sequence
tatagacgaccctgcctgga

SEQ ID NO: 727758 - DNA, 20 bp, Artificial
  CRISPR gRNA sequence
cctggacaggtgaggagggt

SEQ ID NO: 727759 - DNA, 20 bp, Artificial
  CRISPR gRNA sequence
gacaggtgaggagggttcca

SEQ ID NO: 727760 - DNA, 20 bp, Artificial
  CRISPR gRNA sequence
cagctcccaagggctgcctg

SEQ ID NO: 727761 - DNA, 20 bp, Artificial
  CRISPR gRNA sequence
ccaagggctgcctggaagag

SEQ ID NO: 727762 - DNA, 20 bp, Artificial
  CRISPR gRNA sequence
cctggaagagctggcccaga

SEQ ID NO: 727763 - DNA, 20 bp, Artificial
  CRISPR gRNA sequence
gaagagctggcccagaggct

SEQ ID NO: 727764 - DNA, 20 bp, Artificial
  CRISPR gRNA sequence
gcccagaggctgggcaggga

SEQ ID NO: 727765 - DNA, 20 bp, Artificial
  CRISPR gRNA sequence
ggcagggatcagagtgcagg

SEQ ID NO: 727766 - DNA, 20 bp, Artificial
  CRISPR gRNA sequence
aggaaggcctgaagcttcca

SEQ ID NO: 727767 - DNA, 20 bp, Artificial
  CRISPR gRNA sequence
aagcttccaggaaggaaaaa

SEQ ID NO: 727768 - DNA, 20 bp, Artificial
  CRISPR gRNA sequence
ccaggaaggaaaaagcccca

SEQ ID NO: 727769 - DNA, 20 bp, Artificial
  CRISPR gRNA sequence
caggaaggaaaaagccccag

SEQ ID NO: 727770 - DNA, 20 bp, Artificial
  CRISPR gRNA sequence
tcaataggcagcagccaccg

SEQ ID NO: 727771 - DNA, 20 bp, Artificial
  CRISPR gRNA sequence
caggcaggtactccacgatg

SEQ ID NO: 727772 - DNA, 20 bp, Artificial
  CRISPR gRNA sequence
cacgatgcgcttaacagccc

SEQ ID NO: 727773 - DNA, 20 bp, Artificial
  CRISPR gRNA sequence
aacagcccgacctcgacgaa

SEQ ID NO: 727774 - DNA, 20 bp, Artificial
  CRISPR gRNA sequence
acagcccgacctcgacgaat

SEQ ID NO: 727775 - DNA, 20 bp, Artificial
  CRISPR gRNA sequence
gacgaatccacaggccaagc

SEQ ID NO: 727776 - DNA, 20 bp, Artificial
  CRISPR gRNA sequence
tgaagtagattctaccatct

SEQ ID NO: 727777 - DNA, 20 bp, Artificial
  CRISPR gRNA sequence
aagtagattctaccatctgc

SEQ ID NO: 727778 - DNA, 20 bp, Artificial
  CRISPR gRNA sequence
taccatctgcattttccgga

SEQ ID NO: 727779 - DNA, 20 bp, Artificial
  CRISPR gRNA sequence
ccatctgcattttccggatg

SEQ ID NO: 727780 - DNA, 20 bp, Artificial
  CRISPR gRNA sequence
cattttccggatgaggaaac

SEQ ID NO: 727781 - DNA, 20 bp, Artificial
  CRISPR gRNA sequence
tccggatgaggaaactgaga

SEQ ID NO: 727782 - DNA, 20 bp, Artificial
  CRISPR gRNA sequence
ccggatgaggaaactgagac

SEQ ID NO: 727783 - DNA, 20 bp, Artificial
  CRISPR gRNA sequence
cggatgaggaaactgagaca

SEQ ID NO: 727784 - DNA, 20 bp, Artificial
  CRISPR gRNA sequence
agacacaggacaattcagta

SEQ ID NO: 727785 - DNA, 20 bp, Artificial
  CRISPR gRNA sequence
agtaactcacccagggtcac

SEQ ID NO: 727786 - DNA, 20 bp, Artificial
  CRISPR gRNA sequence
acccagggtcacacagcttg

SEQ ID NO: 727787 - DNA, 20 bp, Artificial
  CRISPR gRNA sequence
gtaagtggcagaaccagggt

SEQ ID NO: 727788 - DNA, 20 bp, Artificial
  CRISPR gRNA sequence
taagtggcagaaccagggtc

SEQ ID NO: 727789 - DNA, 20 bp, Artificial
  CRISPR gRNA sequence
ttgccccatgtgctcctttc

SEQ ID NO: 727790 - DNA, 20 bp, Artificial
  CRISPR gRNA sequence
gccccatgtgctcctttccc

SEQ ID NO: 727791 - DNA, 20 bp, Artificial
  CRISPR gRNA sequence
ccccatgtgctcctttcccc

SEQ ID NO: 727792 - DNA, 20 bp, Artificial
  CRISPR gRNA sequence
ctttcccctcctgcccctgg

SEQ ID NO: 727793 - DNA, 20 bp, Artificial
  CRISPR gRNA sequence
tcccctcctgcccctgggct

SEQ ID NO: 727794 - DNA, 20 bp, Artificial
  CRISPR gRNA sequence
cccctcctgcccctgggctg

SEQ ID NO: 727795 - DNA, 20 bp, Artificial
  CRISPR gRNA sequence
ccctcctgcccctgggctga

SEQ ID NO: 727796 - DNA, 20 bp, Artificial
  CRISPR gRNA sequence
ctgcccctgggctgacttgc

SEQ ID NO: 727797 - DNA, 20 bp, Artificial
  CRISPR gRNA sequence
cccctgggctgacttgccag

SEQ ID NO: 727798 - DNA, 20 bp, Artificial
  CRISPR gRNA sequence
ggctgacttgccaggtggta

SEQ ID NO: 727799 - DNA, 20 bp, Artificial
  CRISPR gRNA sequence
acttgccaggtggtagaaga

SEQ ID NO: 727800 - DNA, 20 bp, Artificial
  CRISPR gRNA sequence
gccaggtggtagaagagggg

SEQ ID NO: 727801 - DNA, 20 bp, Artificial
  CRISPR gRNA sequence
ccaggtggtagaagaggggg

SEQ ID NO: 727802 - DNA, 20 bp, Artificial
  CRISPR gRNA sequence
gcaggaatgccccctggggg

SEQ ID NO: 727803 - DNA, 20 bp, Artificial
  CRISPR gRNA sequence
ggggtactggaggaaaaagt

SEQ ID NO: 727804 - DNA, 20 bp, Artificial
  CRISPR gRNA sequence
gaggaaaaagtgacagacaa

SEQ ID NO: 727805 - DNA, 20 bp, Artificial
  CRISPR gRNA sequence
ttaaacgttcatgccagcat

SEQ ID NO: 727806 - DNA, 20 bp, Artificial
  CRISPR gRNA sequence
taaacgttcatgccagcatc

SEQ ID NO: 727807 - DNA, 20 bp, Artificial
  CRISPR gRNA sequence
aaacgttcatgccagcatcc

SEQ ID NO: 727808 - DNA, 20 bp, Artificial
  CRISPR gRNA sequence
aacgttcatgccagcatcca

SEQ ID NO: 727809 - DNA, 20 bp, Artificial
  CRISPR gRNA sequence
atgccagcatccatccaggt

SEQ ID NO: 727810 - DNA, 20 bp, Artificial
  CRISPR gRNA sequence
ctctgggcaagccacacagt

SEQ ID NO: 727811 - DNA, 20 bp, Artificial
  CRISPR gRNA sequence
tgggcaagccacacagtcgt

SEQ ID NO: 727812 - DNA, 20 bp, Artificial
  CRISPR gRNA sequence
ggcaagccacacagtcgtca

SEQ ID NO: 727813 - DNA, 20 bp, Artificial
  CRISPR gRNA sequence
cacctcattgcattctccac

SEQ ID NO: 727814 - DNA, 20 bp, Artificial
  CRISPR gRNA sequence
acctcattgcattctccaca

SEQ ID NO: 727815 - DNA, 20 bp, Artificial
  CRISPR gRNA sequence
attgcattctccacacgcat

SEQ ID NO: 727816 - DNA, 20 bp, Artificial
  CRISPR gRNA sequence
cattctccacacgcatgagt

SEQ ID NO: 727817 - DNA, 20 bp, Artificial
  CRISPR gRNA sequence
tccacacgcatgagttttca

SEQ ID NO: 727818 - DNA, 20 bp, Artificial
  CRISPR gRNA sequence
cacacgcatgagttttcacc

SEQ ID NO: 727819 - DNA, 20 bp, Artificial
  CRISPR gRNA sequence
tcacccacattgcatcccta

SEQ ID NO: 727820 - DNA, 20 bp, Artificial
  CRISPR gRNA sequence
cacccacattgcatccctac

SEQ ID NO: 727821 - DNA, 20 bp, Artificial
  CRISPR gRNA sequence
acccacattgcatccctaca

SEQ ID NO: 727822 - DNA, 20 bp, Artificial
  CRISPR gRNA sequence
catccctacagatgtacaga

SEQ ID NO: 727823 - DNA, 20 bp, Artificial
  CRISPR gRNA sequence
cagatgtacagaatgcgaca

SEQ ID NO: 727824 - DNA, 20 bp, Artificial
  CRISPR gRNA sequence
cgaggctggggtagaagttc

SEQ ID NO: 727825 - DNA, 20 bp, Artificial
  CRISPR gRNA sequence
gaggctggggtagaagttca

SEQ ID NO: 727826 - DNA, 20 bp, Artificial
  CRISPR gRNA sequence
gggtagaagttcagtctctg

SEQ ID NO: 727827 - DNA, 20 bp, Artificial
  CRISPR gRNA sequence
agtctctggagcccacgccc

SEQ ID NO: 727828 - DNA, 20 bp, Artificial
  CRISPR gRNA sequence
tggagcccacgccccgggcc

SEQ ID NO: 727829 - DNA, 20 bp, Artificial
  CRISPR gRNA sequence
gagcccacgccccgggccca

SEQ ID NO: 727830 - DNA, 20 bp, Artificial
  CRISPR gRNA sequence
ccctgtgttcctctggctcg

SEQ ID NO: 727831 - DNA, 20 bp, Artificial
  CRISPR gRNA sequence
tgttcctctggctcgggcag

SEQ ID NO: 727832 - DNA, 20 bp, Artificial
  CRISPR gRNA sequence
ctctggctcgggcagcccct

SEQ ID NO: 727833 - DNA, 20 bp, Artificial
  CRISPR gRNA sequence
tggctcgggcagcccctttg

SEQ ID NO: 727834 - DNA, 20 bp, Artificial
  CRISPR gRNA sequence
gctcgggcagcccctttgga

SEQ ID NO: 727835 - DNA, 20 bp, Artificial
  CRISPR gRNA sequence
gggcagcccctttggacggc

SEQ ID NO: 727836 - DNA, 20 bp, Artificial
  CRISPR gRNA sequence
tggacggctggacactcacc

SEQ ID NO: 727837 - DNA, 20 bp, Artificial
  CRISPR gRNA sequence
ggacggctggacactcaccc

SEQ ID NO: 727838 - DNA, 20 bp, Artificial
  CRISPR gRNA sequence
gacggctggacactcaccca

SEQ ID NO: 727839 - DNA, 20 bp, Artificial
  CRISPR gRNA sequence
gacactcacccacaagctct

SEQ ID NO: 727840 - DNA, 20 bp, Artificial
  CRISPR gRNA sequence
acccacaagctctagcttgg

SEQ ID NO: 727841 - DNA, 20 bp, Artificial
  CRISPR gRNA sequence
tagcttgggctgggaggtct

SEQ ID NO: 727842 - DNA, 20 bp, Artificial
  CRISPR gRNA sequence
gcttgggctgggaggtctgg

SEQ ID NO: 727843 - DNA, 20 bp, Artificial
  CRISPR gRNA sequence
gggctgggaggtctggaccg

SEQ ID NO: 727844 - DNA, 20 bp, Artificial
  CRISPR gRNA sequence
ggctgggaggtctggaccgg

SEQ ID NO: 727845 - DNA, 20 bp, Artificial
  CRISPR gRNA sequence
ggaggtctggaccgggtagc

SEQ ID NO: 727846 - DNA, 20 bp, Artificial
  CRISPR gRNA sequence
gaccgggtagcacaggtgga

SEQ ID NO: 727847 - DNA, 20 bp, Artificial
  CRISPR gRNA sequence
tgaaacgacaccaggaggaa

SEQ ID NO: 727848 - DNA, 20 bp, Artificial
  CRISPR gRNA sequence
aaacgacaccaggaggaagg

SEQ ID NO: 727849 - DNA, 20 bp, Artificial
  CRISPR gRNA sequence
ggggtggcggcctcagagag

SEQ ID NO: 727850 - DNA, 20 bp, Artificial
  CRISPR gRNA sequence
agagagcaggagcaggcagg

SEQ ID NO: 727851 - DNA, 20 bp, Artificial
  CRISPR gRNA sequence
gcagagagcaacctgtcctc

SEQ ID NO: 727852 - DNA, 20 bp, Artificial
  CRISPR gRNA sequence
tcctccccaaggccccaagg

SEQ ID NO: 727853 - DNA, 20 bp, Artificial
  CRISPR gRNA sequence
cccaaggccccaaggacaca

SEQ ID NO: 727854 - DNA, 20 bp, Artificial
  CRISPR gRNA sequence
actctgccgaattcgcttcc

SEQ ID NO: 727855 - DNA, 20 bp, Artificial
  CRISPR gRNA sequence
ctctgccgaattcgcttcct

SEQ ID NO: 727856 - DNA, 20 bp, Artificial
  CRISPR gRNA sequence
tgccgaattcgcttcctgca

SEQ ID NO: 727857 - DNA, 20 bp, Artificial
  CRISPR gRNA sequence
ccgaattcgcttcctgcagg

SEQ ID NO: 727858 - DNA, 20 bp, Artificial
  CRISPR gRNA sequence
gcttcctgcaggccctccgg

SEQ ID NO: 727859 - DNA, 20 bp, Artificial
  CRISPR gRNA sequence
cctgcaggccctccggtggc

SEQ ID NO: 727860 - DNA, 20 bp, Artificial
  CRISPR gRNA sequence
ctgcaggccctccggtggca

SEQ ID NO: 727861 - DNA, 20 bp, Artificial
  CRISPR gRNA sequence
caggccctccggtggcacag

SEQ ID NO: 727862 - DNA, 20 bp, Artificial
  CRISPR gRNA sequence
cggtggcacaggaggaaggc

SEQ ID NO: 727863 - DNA, 20 bp, Artificial
  CRISPR gRNA sequence
gagccgaccaccacaaccaa

SEQ ID NO: 727864 - DNA, 20 bp, Artificial
  CRISPR gRNA sequence
gccctggaacacagagacgc

SEQ ID NO: 727865 - DNA, 20 bp, Artificial
  CRISPR gRNA sequence
gaacacagagacgccccaca

SEQ ID NO: 727866 - DNA, 20 bp, Artificial
  CRISPR gRNA sequence
tttgccttgctgcaaccaca

SEQ ID NO: 727867 - DNA, 20 bp, Artificial
  CRISPR gRNA sequence
tgccttgctgcaaccacaca

SEQ ID NO: 727868 - DNA, 20 bp, Artificial
  CRISPR gRNA sequence
gccttgctgcaaccacacaa

SEQ ID NO: 727869 - DNA, 20 bp, Artificial
  CRISPR gRNA sequence
ccttgctgcaaccacacaag

SEQ ID NO: 727870 - DNA, 20 bp, Artificial
  CRISPR gRNA sequence
gctgcaaccacacaagacag

SEQ ID NO: 727871 - DNA, 20 bp, Artificial
  CRISPR gRNA sequence
ctgcaaccacacaagacagc

SEQ ID NO: 727872 - DNA, 20 bp, Artificial
  CRISPR gRNA sequence
caaccacacaagacagcccc

SEQ ID NO: 727873 - DNA, 20 bp, Artificial
  CRISPR gRNA sequence
cctccttctcctgggacaca

SEQ ID NO: 727874 - DNA, 20 bp, Artificial
  CRISPR gRNA sequence
ctccttctcctgggacacag

SEQ ID NO: 727875 - DNA, 20 bp, Artificial
  CRISPR gRNA sequence
cttctcctgggacacagctt

SEQ ID NO: 727876 - DNA, 20 bp, Artificial
  CRISPR gRNA sequence
ctcctgggacacagcttcca

SEQ ID NO: 727877 - DNA, 20 bp, Artificial
  CRISPR gRNA sequence
tcctgggacacagcttccat

SEQ ID NO: 727878 - DNA, 20 bp, Artificial
  CRISPR gRNA sequence
ctgggacacagcttccatca

SEQ ID NO: 727879 - DNA, 20 bp, Artificial
  CRISPR gRNA sequence
ggacacagcttccatcatgg

SEQ ID NO: 727880 - DNA, 20 bp, Artificial
  CRISPR gRNA sequence
ccatcatggctaacaacaac

SEQ ID NO: 727881 - DNA, 20 bp, Artificial
  CRISPR gRNA sequence
catcatggctaacaacaaca

SEQ ID NO: 727882 - DNA, 20 bp, Artificial
  CRISPR gRNA sequence
acaacaacaggtcctttcca

SEQ ID NO: 727883 - DNA, 20 bp, Artificial
  CRISPR gRNA sequence
tccaagccaaggctcttatc

SEQ ID NO: 727884 - DNA, 20 bp, Artificial
  CRISPR gRNA sequence
ccaagccaaggctcttatct

SEQ ID NO: 727885 - DNA, 20 bp, Artificial
  CRISPR gRNA sequence
caagccaaggctcttatctc

SEQ ID NO: 727886 - DNA, 20 bp, Artificial
  CRISPR gRNA sequence
ttatctcatccagccctccc

SEQ ID NO: 727887 - DNA, 20 bp, Artificial
  CRISPR gRNA sequence
atctcatccagccctccctc

SEQ ID NO: 727888 - DNA, 20 bp, Artificial
  CRISPR gRNA sequence
tctcatccagccctccctcg

SEQ ID NO: 727889 - DNA, 20 bp, Artificial
  CRISPR gRNA sequence
atccagccctccctcgcctg

SEQ ID NO: 727890 - DNA, 20 bp, Artificial
  CRISPR gRNA sequence
cctcgcctggctccaggaag

SEQ ID NO: 727891 - DNA, 20 bp, Artificial
  CRISPR gRNA sequence
gcctggctccaggaagctga

SEQ ID NO: 727892 - DNA, 20 bp, Artificial
  CRISPR gRNA sequence
gctccaggaagctgatcaac

SEQ ID NO: 727893 - DNA, 20 bp, Artificial
  CRISPR gRNA sequence
caggaagctgatcaactatt

SEQ ID NO: 727894 - DNA, 20 bp, Artificial
  CRISPR gRNA sequence
atcaactattgaaggctgag

SEQ ID NO: 727895 - DNA, 20 bp, Artificial
  CRISPR gRNA sequence
ttgaaggctgagagaagggc

SEQ ID NO: 727896 - DNA, 20 bp, Artificial
  CRISPR gRNA sequence
aaggctgagagaagggcaaa

SEQ ID NO: 727897 - DNA, 20 bp, Artificial
  CRISPR gRNA sequence
agagaagggcaaactgtgtc

SEQ ID NO: 727898 - DNA, 20 bp, Artificial
  CRISPR gRNA sequence
tgtctagagagtgagaaatt

SEQ ID NO: 727899 - DNA, 20 bp, Artificial
  CRISPR gRNA sequence
gagagtgagaaattgaggcg

SEQ ID NO: 727900 - DNA, 20 bp, Artificial
  CRISPR gRNA sequence
aggcgtctaggagccagaac

SEQ ID NO: 727901 - DNA, 20 bp, Artificial
  CRISPR gRNA sequence
ggagccagaacaaaggaatt

SEQ ID NO: 727902 - DNA, 20 bp, Artificial
  CRISPR gRNA sequence
aggtccaatagaccaaaatt

SEQ ID NO: 727903 - DNA, 20 bp, Artificial
  CRISPR gRNA sequence
ggggactgtggacgagggcc

SEQ ID NO: 727904 - DNA, 20 bp, Artificial
  CRISPR gRNA sequence
gggactgtggacgagggccc

SEQ ID NO: 727905 - DNA, 20 bp, Artificial
  CRISPR gRNA sequence
tggacgagggcccggtgtga

SEQ ID NO: 727906 - DNA, 20 bp, Artificial
  CRISPR gRNA sequence
gcagcactgctggtgtggcc

SEQ ID NO: 727907 - DNA, 20 bp, Artificial
  CRISPR gRNA sequence
ctggtgtggccggagtcagg

SEQ ID NO: 727908 - DNA, 20 bp, Artificial
  CRISPR gRNA sequence
gtgtggccggagtcagggtg

SEQ ID NO: 727909 - DNA, 20 bp, Artificial
  CRISPR gRNA sequence
aacccagtcccctcccggcc

SEQ ID NO: 727910 - DNA, 20 bp, Artificial
  CRISPR gRNA sequence
ccggccaaccctctagacct

SEQ ID NO: 727911 - DNA, 20 bp, Artificial
  CRISPR gRNA sequence
tagacctgcttgatgagggc

SEQ ID NO: 727912 - DNA, 20 bp, Artificial
  CRISPR gRNA sequence
gacctgcttgatgagggcag

SEQ ID NO: 727913 - DNA, 20 bp, Artificial
  CRISPR gRNA sequence
cttgatgagggcaggcatgg

SEQ ID NO: 727914 - DNA, 20 bp, Artificial
  CRISPR gRNA sequence
gatgagggcaggcatggagt

SEQ ID NO: 727915 - DNA, 20 bp, Artificial
  CRISPR gRNA sequence
atgagggcaggcatggagtc

SEQ ID NO: 727916 - DNA, 20 bp, Artificial
  CRISPR gRNA sequence
cacataaacacaccccacaa

SEQ ID NO: 727917 - DNA, 20 bp, Artificial
  CRISPR gRNA sequence
cctgaatgaatgatccccaa

SEQ ID NO: 727918 - DNA, 20 bp, Artificial
  CRISPR gRNA sequence
aatgaatgatccccaaccct

SEQ ID NO: 727919 - DNA, 20 bp, Artificial
  CRISPR gRNA sequence
tgccctaggcaccgtcacta

SEQ ID NO: 727920 - DNA, 20 bp, Artificial
  CRISPR gRNA sequence
ggcaccgtcactaccttcag

SEQ ID NO: 727921 - DNA, 20 bp, Artificial
  CRISPR gRNA sequence
ccttcagtttaaaaatgagg

SEQ ID NO: 727922 - DNA, 20 bp, Artificial
  CRISPR gRNA sequence
cagtttaaaaatgaggggag

SEQ ID NO: 727923 - DNA, 20 bp, Artificial
  CRISPR gRNA sequence
agtttaaaaatgaggggagc

SEQ ID NO: 727924 - DNA, 20 bp, Artificial
  CRISPR gRNA sequence
aaaaatgaggggagctgagg

SEQ ID NO: 727925 - DNA, 20 bp, Artificial
  CRISPR gRNA sequence
aaaatgaggggagctgaggc

SEQ ID NO: 727926 - DNA, 20 bp, Artificial
  CRISPR gRNA sequence
aggctcacgaaagttcgtta

SEQ ID NO: 727927 - DNA, 20 bp, Artificial
  CRISPR gRNA sequence
acgaaagttcgttaagttgc

SEQ ID NO: 727928 - DNA, 20 bp, Artificial
  CRISPR gRNA sequence
gttaagttgcccaaggtcac

SEQ ID NO: 727929 - DNA, 20 bp, Artificial
  CRISPR gRNA sequence
agttgcccaaggtcaccctg

SEQ ID NO: 727930 - DNA, 20 bp, Artificial
  CRISPR gRNA sequence
cccaaggtcaccctgagagt

SEQ ID NO: 727931 - DNA, 20 bp, Artificial
  CRISPR gRNA sequence
agagtaagtggcagagcccc

SEQ ID NO: 727932 - DNA, 20 bp, Artificial
  CRISPR gRNA sequence
cagggccacgctcttaaccc

SEQ ID NO: 727933 - DNA, 20 bp, Artificial
  CRISPR gRNA sequence
ttaacccctatctagatcta

SEQ ID NO: 727934 - DNA, 20 bp, Artificial
  CRISPR gRNA sequence
aacccctatctagatctact

SEQ ID NO: 727935 - DNA, 20 bp, Artificial
  CRISPR gRNA sequence
acccctatctagatctactt

SEQ ID NO: 727936 - DNA, 20 bp, Artificial
  CRISPR gRNA sequence
tctagatctacttcttcaca

SEQ ID NO: 727937 - DNA, 20 bp, Artificial
  CRISPR gRNA sequence
gatctacttcttcacacctc

SEQ ID NO: 727938 - DNA, 20 bp, Artificial
  CRISPR gRNA sequence
cttcttcacacctcggtact

SEQ ID NO: 727939 - DNA, 20 bp, Artificial
  CRISPR gRNA sequence
cttcacacctcggtactaaa

SEQ ID NO: 727940 - DNA, 20 bp, Artificial
  CRISPR gRNA sequence
ttcacacctcggtactaaac

SEQ ID NO: 727941 - DNA, 20 bp, Artificial
  CRISPR gRNA sequence
cacacctcggtactaaactc

SEQ ID NO: 727942 - DNA, 20 bp, Artificial
  CRISPR gRNA sequence
acacctcggtactaaactcg

SEQ ID NO: 727943 - DNA, 20 bp, Artificial
  CRISPR gRNA sequence
ggtactaaactcgcttcgtt

SEQ ID NO: 727944 - DNA, 20 bp, Artificial
  CRISPR gRNA sequence
aactcgcttcgtttttccct

SEQ ID NO: 727945 - DNA, 20 bp, Artificial
  CRISPR gRNA sequence
gcttcgtttttcccttttgt

SEQ ID NO: 727946 - DNA, 20 bp, Artificial
  CRISPR gRNA sequence
cgtttttcccttttgtcact

SEQ ID NO: 727947 - DNA, 20 bp, Artificial
  CRISPR gRNA sequence
gtttttcccttttgtcactt

SEQ ID NO: 727948 - DNA, 20 bp, Artificial
  CRISPR gRNA sequence
ttcccttttgtcacttacag

SEQ ID NO: 727949 - DNA, 20 bp, Artificial
  CRISPR gRNA sequence
tcccttttgtcacttacaga

SEQ ID NO: 727950 - DNA, 20 bp, Artificial
  CRISPR gRNA sequence
cccttttgtcacttacagag

SEQ ID NO: 727951 - DNA, 20 bp, Artificial
  CRISPR gRNA sequence
ccttttgtcacttacagaga

SEQ ID NO: 727952 - DNA, 20 bp, Artificial
  CRISPR gRNA sequence
ttgtcacttacagagatcat

SEQ ID NO: 727953 - DNA, 20 bp, Artificial
  CRISPR gRNA sequence
tgtcacttacagagatcata

SEQ ID NO: 727954 - DNA, 20 bp, Artificial
  CRISPR gRNA sequence
gtcacttacagagatcatag

SEQ ID NO: 727955 - DNA, 20 bp, Artificial
  CRISPR gRNA sequence
tcacttacagagatcataga

SEQ ID NO: 727956 - DNA, 20 bp, Artificial
  CRISPR gRNA sequence
acagagatcatagagctagt

SEQ ID NO: 727957 - DNA, 20 bp, Artificial
  CRISPR gRNA sequence
cagagatcatagagctagtg

SEQ ID NO: 727958 - DNA, 20 bp, Artificial
  CRISPR gRNA sequence
gtgattgcactttattgaag

SEQ ID NO: 727959 - DNA, 20 bp, Artificial
  CRISPR gRNA sequence
cactttattgaagtccatgt

SEQ ID NO: 727960 - DNA, 20 bp, Artificial
  CRISPR gRNA sequence
tattgaagtccatgtttaga

SEQ ID NO: 727961 - DNA, 20 bp, Artificial
  CRISPR gRNA sequence
attgaagtccatgtttagat

SEQ ID NO: 727962 - DNA, 20 bp, Artificial
  CRISPR gRNA sequence
ttgaagtccatgtttagatg

SEQ ID NO: 727963 - DNA, 20 bp, Artificial
  CRISPR gRNA sequence
aagtccatgtttagatgttt

SEQ ID NO: 727964 - DNA, 20 bp, Artificial
  CRISPR gRNA sequence
agatgtttaaaaagtagtat

SEQ ID NO: 727965 - DNA, 20 bp, Artificial
  CRISPR gRNA sequence
gatgtttaaaaagtagtata

SEQ ID NO: 727966 - DNA, 20 bp, Artificial
  CRISPR gRNA sequence
aaaaagtagtatatgccagt

SEQ ID NO: 727967 - DNA, 20 bp, Artificial
  CRISPR gRNA sequence
aaaagtagtatatgccagtt

SEQ ID NO: 727968 - DNA, 20 bp, Artificial
  CRISPR gRNA sequence
agtgcttctcaaacgttaat

SEQ ID NO: 727969 - DNA, 20 bp, Artificial
  CRISPR gRNA sequence
ctcaaacgttaatgtgcaca

SEQ ID NO: 727970 - DNA, 20 bp, Artificial
  CRISPR gRNA sequence
tcaaacgttaatgtgcacat

SEQ ID NO: 727971 - DNA, 20 bp, Artificial
  CRISPR gRNA sequence
aaacgttaatgtgcacatga

SEQ ID NO: 727972 - DNA, 20 bp, Artificial
  CRISPR gRNA sequence
atgtgcacatgagtgccctg

SEQ ID NO: 727973 - DNA, 20 bp, Artificial
  CRISPR gRNA sequence
gagatcttgttaaagtgcag

SEQ ID NO: 727974 - DNA, 20 bp, Artificial
  CRISPR gRNA sequence
gttaaagtgcagtttctgat

SEQ ID NO: 727975 - DNA, 20 bp, Artificial
  CRISPR gRNA sequence
ttaaagtgcagtttctgatt

SEQ ID NO: 727976 - DNA, 20 bp, Artificial
  CRISPR gRNA sequence
aagtgcagtttctgattctc

SEQ ID NO: 727977 - DNA, 20 bp, Artificial
  CRISPR gRNA sequence
ctgattctctaggtctggga

SEQ ID NO: 727978 - DNA, 20 bp, Artificial
  CRISPR gRNA sequence
tgattctctaggtctgggat

SEQ ID NO: 727979 - DNA, 20 bp, Artificial
  CRISPR gRNA sequence
attctctaggtctgggatgg

SEQ ID NO: 727980 - DNA, 20 bp, Artificial
  CRISPR gRNA sequence
tctaggtctgggatggggcc

SEQ ID NO: 727981 - DNA, 20 bp, Artificial
  CRISPR gRNA sequence
taggtctgggatggggccca

SEQ ID NO: 727982 - DNA, 20 bp, Artificial
  CRISPR gRNA sequence
ggtctgggatggggcccata

SEQ ID NO: 727983 - DNA, 20 bp, Artificial
  CRISPR gRNA sequence
ggatggggcccataatttgc

SEQ ID NO: 727984 - DNA, 20 bp, Artificial
  CRISPR gRNA sequence
gctttcctaacaagttccca

SEQ ID NO: 727985 - DNA, 20 bp, Artificial
  CRISPR gRNA sequence
ctttcctaacaagttcccag

SEQ ID NO: 727986 - DNA, 20 bp, Artificial
  CRISPR gRNA sequence
tcctaacaagttcccagccg

SEQ ID NO: 727987 - DNA, 20 bp, Artificial
  CRISPR gRNA sequence
cctaacaagttcccagccgg

SEQ ID NO: 727988 - DNA, 20 bp, Artificial
  CRISPR gRNA sequence
ctaacaagttcccagccggt

SEQ ID NO: 727989 - DNA, 20 bp, Artificial
  CRISPR gRNA sequence
acaagttcccagccggtgcc

SEQ ID NO: 727990 - DNA, 20 bp, Artificial
  CRISPR gRNA sequence
ccagccggtgccaatgctgc

SEQ ID NO: 727991 - DNA, 20 bp, Artificial
  CRISPR gRNA sequence
ccagacgggaccgcactttc

SEQ ID NO: 727992 - DNA, 20 bp, Artificial
  CRISPR gRNA sequence
tcagaaactctggccggagc

SEQ ID NO: 727993 - DNA, 20 bp, Artificial
  CRISPR gRNA sequence
cagaaactctggccggagca

SEQ ID NO: 727994 - DNA, 20 bp, Artificial
  CRISPR gRNA sequence
agaaactctggccggagcac

SEQ ID NO: 727995 - DNA, 20 bp, Artificial
  CRISPR gRNA sequence
tggccggagcactactgcca

SEQ ID NO: 727996 - DNA, 20 bp, Artificial
  CRISPR gRNA sequence
gccggagcactactgccacc

SEQ ID NO: 727997 - DNA, 20 bp, Artificial
  CRISPR gRNA sequence
ctgccacctcgtgtcagcca

SEQ ID NO: 727998 - DNA, 20 bp, Artificial
  CRISPR gRNA sequence
ccacctcgtgtcagccacta

SEQ ID NO: 727999 - DNA, 20 bp, Artificial
  CRISPR gRNA sequence
gtgtcagccactagaactgc

SEQ ID NO: 728000 - DNA, 20 bp, Artificial
  CRISPR gRNA sequence
gaactgcaagtcctaaaatg

SEQ ID NO: 728001 - DNA, 20 bp, Artificial
  CRISPR gRNA sequence
caagtcctaaaatgagtaac

SEQ ID NO: 728002 - DNA, 20 bp, Artificial
  CRISPR gRNA sequence
aaatgagtaacctggcatct

SEQ ID NO: 728003 - DNA, 20 bp, Artificial
  CRISPR gRNA sequence
gcatctttccctaagagcta

SEQ ID NO: 728004 - DNA, 20 bp, Artificial
  CRISPR gRNA sequence
tccctaagagctaactcttg

SEQ ID NO: 728005 - DNA, 20 bp, Artificial
  CRISPR gRNA sequence
ccctaagagctaactcttgg

SEQ ID NO: 728006 - DNA, 20 bp, Artificial
  CRISPR gRNA sequence
cctaagagctaactcttggg

SEQ ID NO: 728007 - DNA, 20 bp, Artificial
  CRISPR gRNA sequence
agagctaactcttgggggtt

SEQ ID NO: 728008 - DNA, 20 bp, Artificial
  CRISPR gRNA sequence
actcttgggggttttgtttg

SEQ ID NO: 728009 - DNA, 20 bp, Artificial
  CRISPR gRNA sequence
ttgggggttttgtttgtttt

SEQ ID NO: 728010 - DNA, 20 bp, Artificial
  CRISPR gRNA sequence
gggggttttgtttgttttgt

SEQ ID NO: 728011 - DNA, 20 bp, Artificial
  CRISPR gRNA sequence
ggggttttgtttgttttgtt

SEQ ID NO: 728012 - DNA, 20 bp, Artificial
  CRISPR gRNA sequence
tgtttgttttgttttgtttt

SEQ ID NO: 728013 - DNA, 20 bp, Artificial
  CRISPR gRNA sequence
gtttgttttgttttgttttg

SEQ ID NO: 728014 - DNA, 20 bp, Artificial
  CRISPR gRNA sequence
tttgttttgttttgttttgt

SEQ ID NO: 728015 - DNA, 20 bp, Artificial
  CRISPR gRNA sequence
gttttgttttgttttgtttt

SEQ ID NO: 728016 - DNA, 20 bp, Artificial
  CRISPR gRNA sequence
ttttgttttgttttgttttg

SEQ ID NO: 728017 - DNA, 20 bp, Artificial
  CRISPR gRNA sequence
tgttttgttttgttttgttt

SEQ ID NO: 728018 - DNA, 20 bp, Artificial
  CRISPR gRNA sequence
gttttgttttgttttgtttt

SEQ ID NO: 728019 - DNA, 20 bp, Artificial
  CRISPR gRNA sequence
ttttgttttgttttgttttg

SEQ ID NO: 728020 - DNA, 20 bp, Artificial
  CRISPR gRNA sequence
tgttttgttttgttttgttt

SEQ ID NO: 728021 - DNA, 20 bp, Artificial
  CRISPR gRNA sequence
gttttgttttgttttgtttt

SEQ ID NO: 728022 - DNA, 20 bp, Artificial
  CRISPR gRNA sequence
ttttgttttgttttgttttg

SEQ ID NO: 728023 - DNA, 20 bp, Artificial
  CRISPR gRNA sequence
tgttttgttttgttttgttt

SEQ ID NO: 728024 - DNA, 20 bp, Artificial
  CRISPR gRNA sequence
gttttgttttgttttgtttt

SEQ ID NO: 728025 - DNA, 20 bp, Artificial
  CRISPR gRNA sequence
ttttgttttgttttgttttg

SEQ ID NO: 728026 - DNA, 20 bp, Artificial
  CRISPR gRNA sequence
tgttttgttttgttttgttt

SEQ ID NO: 728027 - DNA, 20 bp, Artificial
  CRISPR gRNA sequence
gttttgttttgttttgtttt

SEQ ID NO: 728028 - DNA, 20 bp, Artificial
  CRISPR gRNA sequence
ttttgttttgttttgttttg

SEQ ID NO: 728029 - DNA, 20 bp, Artificial
  CRISPR gRNA sequence
tgttttgttttgttttgttt

SEQ ID NO: 728030 - DNA, 20 bp, Artificial
  CRISPR gRNA sequence
gttttgttttgttttgtttt

SEQ ID NO: 728031 - DNA, 20 bp, Artificial
  CRISPR gRNA sequence
ttttgttttgttttgttttg

SEQ ID NO: 728032 - DNA, 20 bp, Artificial
  CRISPR gRNA sequence
tgttttgttttgttttgttt

SEQ ID NO: 728033 - DNA, 20 bp, Artificial
  CRISPR gRNA sequence
gttttgttttgttttgtttg

SEQ ID NO: 728034 - DNA, 20 bp, Artificial
  CRISPR gRNA sequence
ttttgttttgttttgtttga

SEQ ID NO: 728035 - DNA, 20 bp, Artificial
  CRISPR gRNA sequence
tgttttgttttgtttgagac

SEQ ID NO: 728036 - DNA, 20 bp, Artificial
  CRISPR gRNA sequence
gttttgttttgtttgagact

SEQ ID NO: 728037 - DNA, 20 bp, Artificial
  CRISPR gRNA sequence
ttttgttttgtttgagactg

SEQ ID NO: 728038 - DNA, 20 bp, Artificial
  CRISPR gRNA sequence
tgttttgtttgagactgatt

SEQ ID NO: 728039 - DNA, 20 bp, Artificial
  CRISPR gRNA sequence
gttttgtttgagactgattc

SEQ ID NO: 728040 - DNA, 20 bp, Artificial
  CRISPR gRNA sequence
ttttgtttgagactgattct

SEQ ID NO: 728041 - DNA, 20 bp, Artificial
  CRISPR gRNA sequence
tgtttgagactgattctcat

SEQ ID NO: 728042 - DNA, 20 bp, Artificial
  CRISPR gRNA sequence
gtttgagactgattctcatt

SEQ ID NO: 728043 - DNA, 20 bp, Artificial
  CRISPR gRNA sequence
tttgagactgattctcattc

SEQ ID NO: 728044 - DNA, 20 bp, Artificial
  CRISPR gRNA sequence
gagactgattctcattctgc

SEQ ID NO: 728045 - DNA, 20 bp, Artificial
  CRISPR gRNA sequence
agactgattctcattctgct

SEQ ID NO: 728046 - DNA, 20 bp, Artificial
  CRISPR gRNA sequence
attctcattctgctgctcag

SEQ ID NO: 728047 - DNA, 20 bp, Artificial
  CRISPR gRNA sequence
tcattctgctgctcaggctg

SEQ ID NO: 728048 - DNA, 20 bp, Artificial
  CRISPR gRNA sequence
attctgctgctcaggctgga

SEQ ID NO: 728049 - DNA, 20 bp, Artificial
  CRISPR gRNA sequence
tgctgctcaggctggagtgc

SEQ ID NO: 728050 - DNA, 20 bp, Artificial
  CRISPR gRNA sequence
ctgctcaggctggagtgcag

SEQ ID NO: 728051 - DNA, 20 bp, Artificial
  CRISPR gRNA sequence
ctcaggctggagtgcagcgg

SEQ ID NO: 728052 - DNA, 20 bp, Artificial
  CRISPR gRNA sequence
aggctggagtgcagcggtgc

SEQ ID NO: 728053 - DNA, 20 bp, Artificial
  CRISPR gRNA sequence
gagtgcagcggtgcaatctc

SEQ ID NO: 728054 - DNA, 20 bp, Artificial
  CRISPR gRNA sequence
ggctcactgcaaccttgcaa

SEQ ID NO: 728055 - DNA, 20 bp, Artificial
  CRISPR gRNA sequence
actgcaaccttgcaacctcc

SEQ ID NO: 728056 - DNA, 20 bp, Artificial
  CRISPR gRNA sequence
caaccttgcaacctccgcct

SEQ ID NO: 728057 - DNA, 20 bp, Artificial
  CRISPR gRNA sequence
gcaacctccgcctcccgggt

SEQ ID NO: 728058 - DNA, 20 bp, Artificial
  CRISPR gRNA sequence
caacctccgcctcccgggtt

SEQ ID NO: 728059 - DNA, 20 bp, Artificial
  CRISPR gRNA sequence
cgcctcccgggttcaagcga

SEQ ID NO: 728060 - DNA, 20 bp, Artificial
  CRISPR gRNA sequence
ccgggttcaagcgattctcc

SEQ ID NO: 728061 - DNA, 20 bp, Artificial
  CRISPR gRNA sequence
aagcgattctcctgcctcag

SEQ ID NO: 728062 - DNA, 20 bp, Artificial
  CRISPR gRNA sequence
tcctgcctcagcctcctgag

SEQ ID NO: 728063 - DNA, 20 bp, Artificial
  CRISPR gRNA sequence
ctgcctcagcctcctgagta

SEQ ID NO: 728064 - DNA, 20 bp, Artificial
  CRISPR gRNA sequence
cctcagcctcctgagtagct

SEQ ID NO: 728065 - DNA, 20 bp, Artificial
  CRISPR gRNA sequence
agcctcctgagtagctggga

SEQ ID NO: 728066 - DNA, 20 bp, Artificial
  CRISPR gRNA sequence
ctgagtagctgggattacag

SEQ ID NO: 728067 - DNA, 20 bp, Artificial
  CRISPR gRNA sequence
agtagctgggattacaggcg

SEQ ID NO: 728068 - DNA, 20 bp, Artificial
  CRISPR gRNA sequence
ggattacaggcgcgcgccac

SEQ ID NO: 728069 - DNA, 20 bp, Artificial
  CRISPR gRNA sequence
caggcgcgcgccaccacgcc

SEQ ID NO: 728070 - DNA, 20 bp, Artificial
  CRISPR gRNA sequence
gctaatttttgtatttttag

SEQ ID NO: 728071 - DNA, 20 bp, Artificial
  CRISPR gRNA sequence
atttttgtatttttagtaga

SEQ ID NO: 728072 - DNA, 20 bp, Artificial
  CRISPR gRNA sequence
ttgtatttttagtagagatg

SEQ ID NO: 728073 - DNA, 20 bp, Artificial
  CRISPR gRNA sequence
tgtatttttagtagagatgt

SEQ ID NO: 728074 - DNA, 20 bp, Artificial
  CRISPR gRNA sequence
gtatttttagtagagatgtg

SEQ ID NO: 728075 - DNA, 20 bp, Artificial
  CRISPR gRNA sequence
tatttttagtagagatgtgg

SEQ ID NO: 728076 - DNA, 20 bp, Artificial
  CRISPR gRNA sequence
ttagtagagatgtggtttca

SEQ ID NO: 728077 - DNA, 20 bp, Artificial
  CRISPR gRNA sequence
tagtagagatgtggtttcat

SEQ ID NO: 728078 - DNA, 20 bp, Artificial
  CRISPR gRNA sequence
agtagagatgtggtttcatc

SEQ ID NO: 728079 - DNA, 20 bp, Artificial
  CRISPR gRNA sequence
gtagagatgtggtttcatcg

SEQ ID NO: 728080 - DNA, 20 bp, Artificial
  CRISPR gRNA sequence
catcgtgttggccaggctgg

SEQ ID NO: 728081 - DNA, 20 bp, Artificial
  CRISPR gRNA sequence
atcgtgttggccaggctggt

SEQ ID NO: 728082 - DNA, 20 bp, Artificial
  CRISPR gRNA sequence
gccaggctggtctcaaactc

SEQ ID NO: 728083 - DNA, 20 bp, Artificial
  CRISPR gRNA sequence
gtctcaaactcctgacctcg

SEQ ID NO: 728084 - DNA, 20 bp, Artificial
  CRISPR gRNA sequence
aaactcctgacctcgtgatc

SEQ ID NO: 728085 - DNA, 20 bp, Artificial
  CRISPR gRNA sequence
ctgacctcgtgatccaccca

SEQ ID NO: 728086 - DNA, 20 bp, Artificial
  CRISPR gRNA sequence
acctcgtgatccacccacct

SEQ ID NO: 728087 - DNA, 20 bp, Artificial
  CRISPR gRNA sequence
gtgatccacccaccttggcc

SEQ ID NO: 728088 - DNA, 20 bp, Artificial
  CRISPR gRNA sequence
ggcctcccaaagtgctggga

SEQ ID NO: 728089 - DNA, 20 bp, Artificial
  CRISPR gRNA sequence
gcctcccaaagtgctgggat

SEQ ID NO: 728090 - DNA, 20 bp, Artificial
  CRISPR gRNA sequence
ccaaagtgctgggattacag

SEQ ID NO: 728091 - DNA, 20 bp, Artificial
  CRISPR gRNA sequence
ggattacaggcgtgagccac

SEQ ID NO: 728092 - DNA, 20 bp, Artificial
  CRISPR gRNA sequence
caggcgtgagccaccgcgtc

SEQ ID NO: 728093 - DNA, 20 bp, Artificial
  CRISPR gRNA sequence
agagctaactctgacagagg

SEQ ID NO: 728094 - DNA, 20 bp, Artificial
  CRISPR gRNA sequence
actctgacagaggccgtcta

SEQ ID NO: 728095 - DNA, 20 bp, Artificial
  CRISPR gRNA sequence
tgacagaggccgtctacaat

SEQ ID NO: 728096 - DNA, 20 bp, Artificial
  CRISPR gRNA sequence
acagaggccgtctacaatgc

SEQ ID NO: 728097 - DNA, 20 bp, Artificial
  CRISPR gRNA sequence
caatgctacactgcttataa

SEQ ID NO: 728098 - DNA, 20 bp, Artificial
  CRISPR gRNA sequence
cactgcttataaccctgcac

SEQ ID NO: 728099 - DNA, 20 bp, Artificial
  CRISPR gRNA sequence
cttataaccctgcacggtct

SEQ ID NO: 728100 - DNA, 20 bp, Artificial
  CRISPR gRNA sequence
ataaccctgcacggtctctg

SEQ ID NO: 728101 - DNA, 20 bp, Artificial
  CRISPR gRNA sequence
taaccctgcacggtctctgc

SEQ ID NO: 728102 - DNA, 20 bp, Artificial
  CRISPR gRNA sequence
cacggtctctgccattacca

SEQ ID NO: 728103 - DNA, 20 bp, Artificial
  CRISPR gRNA sequence
tgccattaccattgtataga

SEQ ID NO: 728104 - DNA, 20 bp, Artificial
  CRISPR gRNA sequence
ccattaccattgtatagatg

SEQ ID NO: 728105 - DNA, 20 bp, Artificial
  CRISPR gRNA sequence
ccattgtatagatgagacaa

SEQ ID NO: 728106 - DNA, 20 bp, Artificial
  CRISPR gRNA sequence
tatagatgagacaactgagg

SEQ ID NO: 728107 - DNA, 20 bp, Artificial
  CRISPR gRNA sequence
aggctcaaaggctcgaacaa

SEQ ID NO: 728108 - DNA, 20 bp, Artificial
  CRISPR gRNA sequence
aaaggctcgaacaactagtc

SEQ ID NO: 728109 - DNA, 20 bp, Artificial
  CRISPR gRNA sequence
gaacaactagtcaaagtcat

SEQ ID NO: 728110 - DNA, 20 bp, Artificial
  CRISPR gRNA sequence
gtcaaagtcatgaaatcaat

SEQ ID NO: 728111 - DNA, 20 bp, Artificial
  CRISPR gRNA sequence
ttttctgagtagcaattata

SEQ ID NO: 728112 - DNA, 20 bp, Artificial
  CRISPR gRNA sequence
tctgagtagcaattataagc

SEQ ID NO: 728113 - DNA, 20 bp, Artificial
  CRISPR gRNA sequence
ctgagtagcaattataagcc

SEQ ID NO: 728114 - DNA, 20 bp, Artificial
  CRISPR gRNA sequence
tgagtagcaattataagcca

SEQ ID NO: 728115 - DNA, 20 bp, Artificial
  CRISPR gRNA sequence
agtagcaattataagccacg

SEQ ID NO: 728116 - DNA, 20 bp, Artificial
  CRISPR gRNA sequence
taagccacgaggatgaagct

SEQ ID NO: 728117 - DNA, 20 bp, Artificial
  CRISPR gRNA sequence
tgaaaaaaattcctgcctac

SEQ ID NO: 728118 - DNA, 20 bp, Artificial
  CRISPR gRNA sequence
ctgcctacaagaattaaaga

SEQ ID NO: 728119 - DNA, 20 bp, Artificial
  CRISPR gRNA sequence
cctacaagaattaaagaata

SEQ ID NO: 728120 - DNA, 20 bp, Artificial
  CRISPR gRNA sequence
caagaattaaagaatagtca

SEQ ID NO: 728121 - DNA, 20 bp, Artificial
  CRISPR gRNA sequence
aagaatagtcactagcagcc

SEQ ID NO: 728122 - DNA, 20 bp, Artificial
  CRISPR gRNA sequence
gcagccaggcgcagtggttc

SEQ ID NO: 728123 - DNA, 20 bp, Artificial
  CRISPR gRNA sequence
acacctataatcctagcact

SEQ ID NO: 728124 - DNA, 20 bp, Artificial
  CRISPR gRNA sequence
taatcctagcactttgggag

SEQ ID NO: 728125 - DNA, 20 bp, Artificial
  CRISPR gRNA sequence
gcactttgggaggctgaagc

SEQ ID NO: 728126 - DNA, 20 bp, Artificial
  CRISPR gRNA sequence
tgggaggctgaagcaggtgg

SEQ ID NO: 728127 - DNA, 20 bp, Artificial
  CRISPR gRNA sequence
gggaggctgaagcaggtgga

SEQ ID NO: 728128 - DNA, 20 bp, Artificial
  CRISPR gRNA sequence
ggaggctgaagcaggtggat

SEQ ID NO: 728129 - DNA, 20 bp, Artificial
  CRISPR gRNA sequence
aagcaggtggatcacctgag

SEQ ID NO: 728130 - DNA, 20 bp, Artificial
  CRISPR gRNA sequence
aggtcaggagtttgagacca

SEQ ID NO: 728131 - DNA, 20 bp, Artificial
  CRISPR gRNA sequence
gagaccaacctggacaacat

SEQ ID NO: 728132 - DNA, 20 bp, Artificial
  CRISPR gRNA sequence
agaccaacctggacaacatg

SEQ ID NO: 728133 - DNA, 20 bp, Artificial
  CRISPR gRNA sequence
gacaacatggcaaaaccccg

SEQ ID NO: 728134 - DNA, 20 bp, Artificial
  CRISPR gRNA sequence
tactaaaaattaaaaaaaaa

SEQ ID NO: 728135 - DNA, 20 bp, Artificial
  CRISPR gRNA sequence
ctaaaaattaaaaaaaaatt

SEQ ID NO: 728136 - DNA, 20 bp, Artificial
  CRISPR gRNA sequence
aaaattaaaaaaaaatttag

SEQ ID NO: 728137 - DNA, 20 bp, Artificial
  CRISPR gRNA sequence
aaaaaaaatttagccaggcg

SEQ ID NO: 728138 - DNA, 20 bp, Artificial
  CRISPR gRNA sequence
agccaggcgtggtggcaagc

SEQ ID NO: 728139 - DNA, 20 bp, Artificial
  CRISPR gRNA sequence
gccaggcgtggtggcaagcg

SEQ ID NO: 728140 - DNA, 20 bp, Artificial
  CRISPR gRNA sequence
taaacccagctactcgggag

SEQ ID NO: 728141 - DNA, 20 bp, Artificial
  CRISPR gRNA sequence
ctcgggaggctgagacagga

SEQ ID NO: 728142 - DNA, 20 bp, Artificial
  CRISPR gRNA sequence
gggaggctgagacaggagaa

SEQ ID NO: 728143 - DNA, 20 bp, Artificial
  CRISPR gRNA sequence
agacaggagaatctcttgaa

SEQ ID NO: 728144 - DNA, 20 bp, Artificial
  CRISPR gRNA sequence
ttgaacctgggaggtggagg

SEQ ID NO: 728145 - DNA, 20 bp, Artificial
  CRISPR gRNA sequence
gaacctgggaggtggaggtt

SEQ ID NO: 728146 - DNA, 20 bp, Artificial
  CRISPR gRNA sequence
aacctgggaggtggaggttg

SEQ ID NO: 728147 - DNA, 20 bp, Artificial
  CRISPR gRNA sequence
ggaggtggaggttgcagtga

SEQ ID NO: 728148 - DNA, 20 bp, Artificial
  CRISPR gRNA sequence
cagtgagccaagatgggtgc

SEQ ID NO: 728149 - DNA, 20 bp, Artificial
  CRISPR gRNA sequence
ccctccagcctgagcaacag

SEQ ID NO: 728150 - DNA, 20 bp, Artificial
  CRISPR gRNA sequence
cagcctgagcaacagagtga

SEQ ID NO: 728151 - DNA, 20 bp, Artificial
  CRISPR gRNA sequence
agcaacagagtgagactgtt

SEQ ID NO: 728152 - DNA, 20 bp, Artificial
  CRISPR gRNA sequence
tttcaaaaagaaaagaatag

SEQ ID NO: 728153 - DNA, 20 bp, Artificial
  CRISPR gRNA sequence
caaaaagaaaagaatagtca

SEQ ID NO: 728154 - DNA, 20 bp, Artificial
  CRISPR gRNA sequence
aaaaagaaaagaatagtcac

SEQ ID NO: 728155 - DNA, 20 bp, Artificial
  CRISPR gRNA sequence
gcaagtgccagagccacagc

SEQ ID NO: 728156 - DNA, 20 bp, Artificial
  CRISPR gRNA sequence
aagaagccagaaacctgggg

SEQ ID NO: 728157 - DNA, 20 bp, Artificial
  CRISPR gRNA sequence
gggtcaaccttaatccccct

SEQ ID NO: 728158 - DNA, 20 bp, Artificial
  CRISPR gRNA sequence
aatcccccttctcagaccat

SEQ ID NO: 728159 - DNA, 20 bp, Artificial
  CRISPR gRNA sequence
atcccccttctcagaccata

SEQ ID NO: 728160 - DNA, 20 bp, Artificial
  CRISPR gRNA sequence
ctcagaccatacccacaaag

SEQ ID NO: 728161 - DNA, 20 bp, Artificial
  CRISPR gRNA sequence
tcagaccatacccacaaagg

SEQ ID NO: 728162 - DNA, 20 bp, Artificial
  CRISPR gRNA sequence
agaccatacccacaaaggag

SEQ ID NO: 728163 - DNA, 20 bp, Artificial
  CRISPR gRNA sequence
cctcctggctcccccaatcc

SEQ ID NO: 728164 - DNA, 20 bp, Artificial
  CRISPR gRNA sequence
ctggctcccccaatccacac

SEQ ID NO: 728165 - DNA, 20 bp, Artificial
  CRISPR gRNA sequence
gctcccccaatccacacttc

SEQ ID NO: 728166 - DNA, 20 bp, Artificial
  CRISPR gRNA sequence
ccccaatccacacttcccca

SEQ ID NO: 728167 - DNA, 20 bp, Artificial
  CRISPR gRNA sequence
ccccaggaggaagcccctgc

SEQ ID NO: 728168 - DNA, 20 bp, Artificial
  CRISPR gRNA sequence
cccaggaggaagcccctgct

SEQ ID NO: 728169 - DNA, 20 bp, Artificial
  CRISPR gRNA sequence
ctgggagtaggggtgagtgg

SEQ ID NO: 728170 - DNA, 20 bp, Artificial
  CRISPR gRNA sequence
ggagtaggggtgagtgggct

SEQ ID NO: 728171 - DNA, 20 bp, Artificial
  CRISPR gRNA sequence
ggaccattacctgcatccag

SEQ ID NO: 728172 - DNA, 20 bp, Artificial
  CRISPR gRNA sequence
cctgcatccagaacgggctt

SEQ ID NO: 728173 - DNA, 20 bp, Artificial
  CRISPR gRNA sequence
catccagaacgggcttcccc

SEQ ID NO: 728174 - DNA, 20 bp, Artificial
  CRISPR gRNA sequence
ccccgtggaggagagagcga

SEQ ID NO: 728175 - DNA, 20 bp, Artificial
  CRISPR gRNA sequence
cccgtggaggagagagcgac

SEQ ID NO: 728176 - DNA, 20 bp, Artificial
  CRISPR gRNA sequence
gttgggatgggcagcgtctt

SEQ ID NO: 728177 - DNA, 20 bp, Artificial
  CRISPR gRNA sequence
ggatgggcagcgtcttactg

SEQ ID NO: 728178 - DNA, 20 bp, Artificial
  CRISPR gRNA sequence
actggcctgggagtccacca

SEQ ID NO: 728179 - DNA, 20 bp, Artificial
  CRISPR gRNA sequence
ctggcctgggagtccaccag

SEQ ID NO: 728180 - DNA, 20 bp, Artificial
  CRISPR gRNA sequence
gcctgggagtccaccagcaa

SEQ ID NO: 728181 - DNA, 20 bp, Artificial
  CRISPR gRNA sequence
ggagtccaccagcaagctct

SEQ ID NO: 728182 - DNA, 20 bp, Artificial
  CRISPR gRNA sequence
tgagtggggctggtgctgcg

SEQ ID NO: 728183 - DNA, 20 bp, Artificial
  CRISPR gRNA sequence
agtggggctggtgctgcggg

SEQ ID NO: 728184 - DNA, 20 bp, Artificial
  CRISPR gRNA sequence
gtgctgcggggagaagccca

SEQ ID NO: 728185 - DNA, 20 bp, Artificial
  CRISPR gRNA sequence
cggggagaagcccaaggcag

SEQ ID NO: 728186 - DNA, 20 bp, Artificial
  CRISPR gRNA sequence
caggaataattccctttctc

SEQ ID NO: 728187 - DNA, 20 bp, Artificial
  CRISPR gRNA sequence
aggaataattccctttctct

SEQ ID NO: 728188 - DNA, 20 bp, Artificial
  CRISPR gRNA sequence
cctttctctggagactgcgc

SEQ ID NO: 728189 - DNA, 20 bp, Artificial
  CRISPR gRNA sequence
tctctggagactgcgcaacc

SEQ ID NO: 728190 - DNA, 20 bp, Artificial
  CRISPR gRNA sequence
ctctggagactgcgcaacca

SEQ ID NO: 728191 - DNA, 20 bp, Artificial
  CRISPR gRNA sequence
tctggagactgcgcaaccag

SEQ ID NO: 728192 - DNA, 20 bp, Artificial
  CRISPR gRNA sequence
tggagactgcgcaaccagag

SEQ ID NO: 728193 - DNA, 20 bp, Artificial
  CRISPR gRNA sequence
gagactgcgcaaccagagcc

SEQ ID NO: 728194 - DNA, 20 bp, Artificial
  CRISPR gRNA sequence
cgcaaccagagcctgggccc

SEQ ID NO: 728195 - DNA, 20 bp, Artificial
  CRISPR gRNA sequence
ggcccctagatcctctgccc

SEQ ID NO: 728196 - DNA, 20 bp, Artificial
  CRISPR gRNA sequence
gatcctctgccccgagtctc

SEQ ID NO: 728197 - DNA, 20 bp, Artificial
  CRISPR gRNA sequence
tgccccgagtctctgccagg

SEQ ID NO: 728198 - DNA, 20 bp, Artificial
  CRISPR gRNA sequence
ccccgagtctctgccaggca

SEQ ID NO: 728199 - DNA, 20 bp, Artificial
  CRISPR gRNA sequence
tgccaggcattttgagggca

SEQ ID NO: 728200 - DNA, 20 bp, Artificial
  CRISPR gRNA sequence
ccaggcattttgagggcagg

SEQ ID NO: 728201 - DNA, 20 bp, Artificial
  CRISPR gRNA sequence
tgagggcagggactgggttt

SEQ ID NO: 728202 - DNA, 20 bp, Artificial
  CRISPR gRNA sequence
gagggcagggactgggtttc

SEQ ID NO: 728203 - DNA, 20 bp, Artificial
  CRISPR gRNA sequence
agggcagggactgggtttca

SEQ ID NO: 728204 - DNA, 20 bp, Artificial
  CRISPR gRNA sequence
ggtttcaaggccttctggct

SEQ ID NO: 728205 - DNA, 20 bp, Artificial
  CRISPR gRNA sequence
caaggccttctggctttcca

SEQ ID NO: 728206 - DNA, 20 bp, Artificial
  CRISPR gRNA sequence
aaggccttctggctttccaa

SEQ ID NO: 728207 - DNA, 20 bp, Artificial
  CRISPR gRNA sequence
ctggctttccaatggtgtca

SEQ ID NO: 728208 - DNA, 20 bp, Artificial
  CRISPR gRNA sequence
tggctttccaatggtgtcag

SEQ ID NO: 728209 - DNA, 20 bp, Artificial
  CRISPR gRNA sequence
gctttccaatggtgtcagca

SEQ ID NO: 728210 - DNA, 20 bp, Artificial
  CRISPR gRNA sequence
tccaatggtgtcagcaaaga

SEQ ID NO: 728211 - DNA, 20 bp, Artificial
  CRISPR gRNA sequence
ccaatggtgtcagcaaagag

SEQ ID NO: 728212 - DNA, 20 bp, Artificial
  CRISPR gRNA sequence
caatggtgtcagcaaagaga

SEQ ID NO: 728213 - DNA, 20 bp, Artificial
  CRISPR gRNA sequence
aacaaaagagcagcccaggc

SEQ ID NO: 728214 - DNA, 20 bp, Artificial
  CRISPR gRNA sequence
acaaaagagcagcccaggcc

SEQ ID NO: 728215 - DNA, 20 bp, Artificial
  CRISPR gRNA sequence
cacccccagcccagctgcct

SEQ ID NO: 728216 - DNA, 20 bp, Artificial
  CRISPR gRNA sequence
cctcccaggcatcccctggg

SEQ ID NO: 728217 - DNA, 20 bp, Artificial
  CRISPR gRNA sequence
ccaggcatcccctgggcatg

SEQ ID NO: 728218 - DNA, 20 bp, Artificial
  CRISPR gRNA sequence
ggcatggcagggacagctcc

SEQ ID NO: 728219 - DNA, 20 bp, Artificial
  CRISPR gRNA sequence
cctcctgcagcagccaaaca

SEQ ID NO: 728220 - DNA, 20 bp, Artificial
  CRISPR gRNA sequence
ctgcagcagccaaacagaga

SEQ ID NO: 728221 - DNA, 20 bp, Artificial
  CRISPR gRNA sequence
cagcagccaaacagagagaa

SEQ ID NO: 728222 - DNA, 20 bp, Artificial
  CRISPR gRNA sequence
gcaggcgcctcgccattctc

SEQ ID NO: 728223 - DNA, 20 bp, Artificial
  CRISPR gRNA sequence
gccattctctggggtggggt

SEQ ID NO: 728224 - DNA, 20 bp, Artificial
  CRISPR gRNA sequence
tctggggtggggttgcagtc

SEQ ID NO: 728225 - DNA, 20 bp, Artificial
  CRISPR gRNA sequence
tggggtggggttgcagtccg

SEQ ID NO: 728226 - DNA, 20 bp, Artificial
  CRISPR gRNA sequence
gggtggggttgcagtccggc

SEQ ID NO: 728227 - DNA, 20 bp, Artificial
  CRISPR gRNA sequence
cagtccggctgggtccccag

SEQ ID NO: 728228 - DNA, 20 bp, Artificial
  CRISPR gRNA sequence
ggtccccaggggtggcgcct

SEQ ID NO: 728229 - DNA, 20 bp, Artificial
  CRISPR gRNA sequence
aaaggtggtgtccttctcag

SEQ ID NO: 728230 - DNA, 20 bp, Artificial
  CRISPR gRNA sequence
ctcagccatatctgcagagg

SEQ ID NO: 728231 - DNA, 20 bp, Artificial
  CRISPR gRNA sequence
tcagccatatctgcagaggg

SEQ ID NO: 728232 - DNA, 20 bp, Artificial
  CRISPR gRNA sequence
agccatatctgcagagggga

SEQ ID NO: 728233 - DNA, 20 bp, Artificial
  CRISPR gRNA sequence
cagaggggacgtaacatctg

SEQ ID NO: 728234 - DNA, 20 bp, Artificial
  CRISPR gRNA sequence
agaaccagcgccaaggaggc

SEQ ID NO: 728235 - DNA, 20 bp, Artificial
  CRISPR gRNA sequence
gtgtctccaggaaagagtta

SEQ ID NO: 728236 - DNA, 20 bp, Artificial
  CRISPR gRNA sequence
caggaaagagttaaccagca

SEQ ID NO: 728237 - DNA, 20 bp, Artificial
  CRISPR gRNA sequence
accagcagggactggtggct

SEQ ID NO: 728238 - DNA, 20 bp, Artificial
  CRISPR gRNA sequence
gtggcttccagcgaggcaac

SEQ ID NO: 728239 - DNA, 20 bp, Artificial
  CRISPR gRNA sequence
ccagcgaggcaacaccgtgg

SEQ ID NO: 728240 - DNA, 20 bp, Artificial
  CRISPR gRNA sequence
cagcgaggcaacaccgtggg

SEQ ID NO: 728241 - DNA, 20 bp, Artificial
  CRISPR gRNA sequence
agacagtcagatttgtgttt

SEQ ID NO: 728242 - DNA, 20 bp, Artificial
  CRISPR gRNA sequence
gtgtttcaaaagatcaaagt

SEQ ID NO: 728243 - DNA, 20 bp, Artificial
  CRISPR gRNA sequence
tgtttcaaaagatcaaagtg

SEQ ID NO: 728244 - DNA, 20 bp, Artificial
  CRISPR gRNA sequence
caaaagatcaaagtggaaaa

SEQ ID NO: 728245 - DNA, 20 bp, Artificial
  CRISPR gRNA sequence
aaaagatcaaagtggaaaag

SEQ ID NO: 728246 - DNA, 20 bp, Artificial
  CRISPR gRNA sequence
gccaggcacattggctcaca

SEQ ID NO: 728247 - DNA, 20 bp, Artificial
  CRISPR gRNA sequence
gctcacacctgtaatcacag

SEQ ID NO: 728248 - DNA, 20 bp, Artificial
  CRISPR gRNA sequence
acacctgtaatcacagcatt

SEQ ID NO: 728249 - DNA, 20 bp, Artificial
  CRISPR gRNA sequence
taatcacagcattttgggag

SEQ ID NO: 728250 - DNA, 20 bp, Artificial
  CRISPR gRNA sequence
tgggaggctgaggcaggagg

SEQ ID NO: 728251 - DNA, 20 bp, Artificial
  CRISPR gRNA sequence
gggaggctgaggcaggagga

SEQ ID NO: 728252 - DNA, 20 bp, Artificial
  CRISPR gRNA sequence
ggaggctgaggcaggaggac

SEQ ID NO: 728253 - DNA, 20 bp, Artificial
  CRISPR gRNA sequence
aggcaggaggaccacttgag

SEQ ID NO: 728254 - DNA, 20 bp, Artificial
  CRISPR gRNA sequence
gaggtcaggagttcgagacc

SEQ ID NO: 728255 - DNA, 20 bp, Artificial
  CRISPR gRNA sequence
aggtcaggagttcgagacca

SEQ ID NO: 728256 - DNA, 20 bp, Artificial
  CRISPR gRNA sequence
gagaccagcctgaccaacac

SEQ ID NO: 728257 - DNA, 20 bp, Artificial
  CRISPR gRNA sequence
accaacacggtgaaacccca

SEQ ID NO: 728258 - DNA, 20 bp, Artificial
  CRISPR gRNA sequence
tactaaaaacacaaaaatta

SEQ ID NO: 728259 - DNA, 20 bp, Artificial
  CRISPR gRNA sequence
ctaaaaacacaaaaattagc

SEQ ID NO: 728260 - DNA, 20 bp, Artificial
  CRISPR gRNA sequence
aaaacacaaaaattagccag

SEQ ID NO: 728261 - DNA, 20 bp, Artificial
  CRISPR gRNA sequence
gccaggtgtgatggcacaca

SEQ ID NO: 728262 - DNA, 20 bp, Artificial
  CRISPR gRNA sequence
taatcctagctactcaggag

SEQ ID NO: 728263 - DNA, 20 bp, Artificial
  CRISPR gRNA sequence
gctactcaggaggctgaggc

SEQ ID NO: 728264 - DNA, 20 bp, Artificial
  CRISPR gRNA sequence
ctcaggaggctgaggcagga

SEQ ID NO: 728265 - DNA, 20 bp, Artificial
  CRISPR gRNA sequence
aggaggctgaggcaggagaa

SEQ ID NO: 728266 - DNA, 20 bp, Artificial
  CRISPR gRNA sequence
aggcaggagaatcgtttgaa

SEQ ID NO: 728267 - DNA, 20 bp, Artificial
  CRISPR gRNA sequence
gaacccgggaggtggaggct

SEQ ID NO: 728268 - DNA, 20 bp, Artificial
  CRISPR gRNA sequence
aacccgggaggtggaggctg

SEQ ID NO: 728269 - DNA, 20 bp, Artificial
  CRISPR gRNA sequence
cagtgagctgagatcatgcc

SEQ ID NO: 728270 - DNA, 20 bp, Artificial
  CRISPR gRNA sequence
agatcatgccactgcactcc

SEQ ID NO: 728271 - DNA, 20 bp, Artificial
  CRISPR gRNA sequence
cactccagcctgggcgacag

SEQ ID NO: 728272 - DNA, 20 bp, Artificial
  CRISPR gRNA sequence
cagcctgggcgacagagaaa

SEQ ID NO: 728273 - DNA, 20 bp, Artificial
  CRISPR gRNA sequence
ggcgacagagaaagactcaa

SEQ ID NO: 728274 - DNA, 20 bp, Artificial
  CRISPR gRNA sequence
aaaataaataaaacaaagtg

SEQ ID NO: 728275 - DNA, 20 bp, Artificial
  CRISPR gRNA sequence
ctacttgtctctaacagctg

SEQ ID NO: 728276 - DNA, 20 bp, Artificial
  CRISPR gRNA sequence
cttgtctctaacagctgtgg

SEQ ID NO: 728277 - DNA, 20 bp, Artificial
  CRISPR gRNA sequence
gtctctaacagctgtggtca

SEQ ID NO: 728278 - DNA, 20 bp, Artificial
  CRISPR gRNA sequence
tctctaacagctgtggtcac

SEQ ID NO: 728279 - DNA, 20 bp, Artificial
  CRISPR gRNA sequence
taacagctgtggtcacccag

SEQ ID NO: 728280 - DNA, 20 bp, Artificial
  CRISPR gRNA sequence
acagctgtggtcacccagga

SEQ ID NO: 728281 - DNA, 20 bp, Artificial
  CRISPR gRNA sequence
tggtcacccaggaaggtgaa

SEQ ID NO: 728282 - DNA, 20 bp, Artificial
  CRISPR gRNA sequence
gaccttttgcttttaagaga

SEQ ID NO: 728283 - DNA, 20 bp, Artificial
  CRISPR gRNA sequence
ttgcttttaagagaaaactg

SEQ ID NO: 728284 - DNA, 20 bp, Artificial
  CRISPR gRNA sequence
tgcttttaagagaaaactga

SEQ ID NO: 728285 - DNA, 20 bp, Artificial
  CRISPR gRNA sequence
gcttttaagagaaaactgaa

SEQ ID NO: 728286 - DNA, 20 bp, Artificial
  CRISPR gRNA sequence
cttttaagagaaaactgaaa

SEQ ID NO: 728287 - DNA, 20 bp, Artificial
  CRISPR gRNA sequence
ttaagagaaaactgaaatcg

SEQ ID NO: 728288 - DNA, 20 bp, Artificial
  CRISPR gRNA sequence
taagagaaaactgaaatcgc

SEQ ID NO: 728289 - DNA, 20 bp, Artificial
  CRISPR gRNA sequence
aagagaaaactgaaatcgcc

SEQ ID NO: 728290 - DNA, 20 bp, Artificial
  CRISPR gRNA sequence
agagaaaactgaaatcgcct

SEQ ID NO: 728291 - DNA, 20 bp, Artificial
  CRISPR gRNA sequence
aaatcgcctaatgtttaaat

SEQ ID NO: 728292 - DNA, 20 bp, Artificial
  CRISPR gRNA sequence
atgtttaaatacagcctcaa

SEQ ID NO: 728293 - DNA, 20 bp, Artificial
  CRISPR gRNA sequence
aaatacagcctcaattttta

SEQ ID NO: 728294 - DNA, 20 bp, Artificial
  CRISPR gRNA sequence
aatacagcctcaatttttaa

SEQ ID NO: 728295 - DNA, 20 bp, Artificial
  CRISPR gRNA sequence
aatttttaaagtttttttct

SEQ ID NO: 728296 - DNA, 20 bp, Artificial
  CRISPR gRNA sequence
ttaaagtttttttcttttaa

SEQ ID NO: 728297 - DNA, 20 bp, Artificial
  CRISPR gRNA sequence
taaagtttttttcttttaaa

SEQ ID NO: 728298 - DNA, 20 bp, Artificial
  CRISPR gRNA sequence
aaagtttttttcttttaaat

SEQ ID NO: 728299 - DNA, 20 bp, Artificial
  CRISPR gRNA sequence
aagtttttttcttttaaatc

SEQ ID NO: 728300 - DNA, 20 bp, Artificial
  CRISPR gRNA sequence
ttttcttttaaatcaacttt

SEQ ID NO: 728301 - DNA, 20 bp, Artificial
  CRISPR gRNA sequence
tttcttttaaatcaacttta

SEQ ID NO: 728302 - DNA, 20 bp, Artificial
  CRISPR gRNA sequence
ttcttttaaatcaactttat

SEQ ID NO: 728303 - DNA, 20 bp, Artificial
  CRISPR gRNA sequence
tcttttaaatcaactttatt

SEQ ID NO: 728304 - DNA, 20 bp, Artificial
  CRISPR gRNA sequence
cttttaaatcaactttatta

SEQ ID NO: 728305 - DNA, 20 bp, Artificial
  CRISPR gRNA sequence
ttttaaatcaactttattaa

SEQ ID NO: 728306 - DNA, 20 bp, Artificial
  CRISPR gRNA sequence
ttaaatcaactttattaagg

SEQ ID NO: 728307 - DNA, 20 bp, Artificial
  CRISPR gRNA sequence
taaatcaactttattaagga

SEQ ID NO: 728308 - DNA, 20 bp, Artificial
  CRISPR gRNA sequence
aaatcaactttattaaggaa

SEQ ID NO: 728309 - DNA, 20 bp, Artificial
  CRISPR gRNA sequence
aatcaactttattaaggaat

SEQ ID NO: 728310 - DNA, 20 bp, Artificial
  CRISPR gRNA sequence
tattaaggaattatttattt

SEQ ID NO: 728311 - DNA, 20 bp, Artificial
  CRISPR gRNA sequence
attaaggaattatttattta

SEQ ID NO: 728312 - DNA, 20 bp, Artificial
  CRISPR gRNA sequence
ttaaggaattatttatttat

SEQ ID NO: 728313 - DNA, 20 bp, Artificial
  CRISPR gRNA sequence
aggaattatttatttattta

SEQ ID NO: 728314 - DNA, 20 bp, Artificial
  CRISPR gRNA sequence
tttatttatttatgtttaat

SEQ ID NO: 728315 - DNA, 20 bp, Artificial
  CRISPR gRNA sequence
atttatttatgtttaatttt

SEQ ID NO: 728316 - DNA, 20 bp, Artificial
  CRISPR gRNA sequence
tttatttatgtttaattttt

SEQ ID NO: 728317 - DNA, 20 bp, Artificial
  CRISPR gRNA sequence
atttatgtttaattttttga

SEQ ID NO: 728318 - DNA, 20 bp, Artificial
  CRISPR gRNA sequence
tttatgtttaattttttgag

SEQ ID NO: 728319 - DNA, 20 bp, Artificial
  CRISPR gRNA sequence
atgtttaattttttgagatt

SEQ ID NO: 728320 - DNA, 20 bp, Artificial
  CRISPR gRNA sequence
tgtttaattttttgagattg

SEQ ID NO: 728321 - DNA, 20 bp, Artificial
  CRISPR gRNA sequence
aattttttgagattgagtct

SEQ ID NO: 728322 - DNA, 20 bp, Artificial
  CRISPR gRNA sequence
attttttgagattgagtctt

SEQ ID NO: 728323 - DNA, 20 bp, Artificial
  CRISPR gRNA sequence
tttgagattgagtcttcctc

SEQ ID NO: 728324 - DNA, 20 bp, Artificial
  CRISPR gRNA sequence
ttgagattgagtcttcctct

SEQ ID NO: 728325 - DNA, 20 bp, Artificial
  CRISPR gRNA sequence
tgagattgagtcttcctctg

SEQ ID NO: 728326 - DNA, 20 bp, Artificial
  CRISPR gRNA sequence
gagattgagtcttcctctgc

SEQ ID NO: 728327 - DNA, 20 bp, Artificial
  CRISPR gRNA sequence
agattgagtcttcctctgct

SEQ ID NO: 728328 - DNA, 20 bp, Artificial
  CRISPR gRNA sequence
agtcttcctctgctgcccag

SEQ ID NO: 728329 - DNA, 20 bp, Artificial
  CRISPR gRNA sequence
cctctgctgcccagactgga

SEQ ID NO: 728330 - DNA, 20 bp, Artificial
  CRISPR gRNA sequence
ctctgctgcccagactggag

SEQ ID NO: 728331 - DNA, 20 bp, Artificial
  CRISPR gRNA sequence
tgctgcccagactggagtgc

SEQ ID NO: 728332 - DNA, 20 bp, Artificial
  CRISPR gRNA sequence
ctgcccagactggagtgcag

SEQ ID NO: 728333 - DNA, 20 bp, Artificial
  CRISPR gRNA sequence
cccagactggagtgcagtgg

SEQ ID NO: 728334 - DNA, 20 bp, Artificial
  CRISPR gRNA sequence
gagtgcagtggcacgatctc

SEQ ID NO: 728335 - DNA, 20 bp, Artificial
  CRISPR gRNA sequence
agctcattgcaacttctgcc

SEQ ID NO: 728336 - DNA, 20 bp, Artificial
  CRISPR gRNA sequence
attgcaacttctgcctcccg

SEQ ID NO: 728337 - DNA, 20 bp, Artificial
  CRISPR gRNA sequence
caacttctgcctcccggatt

SEQ ID NO: 728338 - DNA, 20 bp, Artificial
  CRISPR gRNA sequence
ctgcctcccggattcaagtg

SEQ ID NO: 728339 - DNA, 20 bp, Artificial
  CRISPR gRNA sequence
tgcctcccggattcaagtga

SEQ ID NO: 728340 - DNA, 20 bp, Artificial
  CRISPR gRNA sequence
cctcccggattcaagtgatt

SEQ ID NO: 728341 - DNA, 20 bp, Artificial
  CRISPR gRNA sequence
ccggattcaagtgattctcc

SEQ ID NO: 728342 - DNA, 20 bp, Artificial
  CRISPR gRNA sequence
aagtgattctcctgcctcag

SEQ ID NO: 728343 - DNA, 20 bp, Artificial
  CRISPR gRNA sequence
tcctgcctcagcctcctgag

SEQ ID NO: 728344 - DNA, 20 bp, Artificial
  CRISPR gRNA sequence
ctgcctcagcctcctgagta

SEQ ID NO: 728345 - DNA, 20 bp, Artificial
  CRISPR gRNA sequence
cctcagcctcctgagtagct

SEQ ID NO: 728346 - DNA, 20 bp, Artificial
  CRISPR gRNA sequence
agcctcctgagtagctggga

SEQ ID NO: 728347 - DNA, 20 bp, Artificial
  CRISPR gRNA sequence
ctgagtagctgggattacag

SEQ ID NO: 728348 - DNA, 20 bp, Artificial
  CRISPR gRNA sequence
agtagctgggattacaggtg

SEQ ID NO: 728349 - DNA, 20 bp, Artificial
  CRISPR gRNA sequence
ggattacaggtgcctgccaa

SEQ ID NO: 728350 - DNA, 20 bp, Artificial
  CRISPR gRNA sequence
caggtgcctgccaacatgcc

SEQ ID NO: 728351 - DNA, 20 bp, Artificial
  CRISPR gRNA sequence
ccaacatgcccagctaattt

SEQ ID NO: 728352 - DNA, 20 bp, Artificial
  CRISPR gRNA sequence
atttttgtatttttagtaga

SEQ ID NO: 728353 - DNA, 20 bp, Artificial
  CRISPR gRNA sequence
ttgtatttttagtagaaaca

SEQ ID NO: 728354 - DNA, 20 bp, Artificial
  CRISPR gRNA sequence
tgtatttttagtagaaacag

SEQ ID NO: 728355 - DNA, 20 bp, Artificial
  CRISPR gRNA sequence
gtatttttagtagaaacagg

SEQ ID NO: 728356 - DNA, 20 bp, Artificial
  CRISPR gRNA sequence
tatttttagtagaaacaggg

SEQ ID NO: 728357 - DNA, 20 bp, Artificial
  CRISPR gRNA sequence
ttagtagaaacagggtttca

SEQ ID NO: 728358 - DNA, 20 bp, Artificial
  CRISPR gRNA sequence
tagtagaaacagggtttcac

SEQ ID NO: 728359 - DNA, 20 bp, Artificial
  CRISPR gRNA sequence
agtagaaacagggtttcacc

SEQ ID NO: 728360 - DNA, 20 bp, Artificial
  CRISPR gRNA sequence
gtagaaacagggtttcacca

SEQ ID NO: 728361 - DNA, 20 bp, Artificial
  CRISPR gRNA sequence
caccatgttgaccaggctgg

SEQ ID NO: 728362 - DNA, 20 bp, Artificial
  CRISPR gRNA sequence
accatgttgaccaggctggt

SEQ ID NO: 728363 - DNA, 20 bp, Artificial
  CRISPR gRNA sequence
accaggctggtctcgaactc

SEQ ID NO: 728364 - DNA, 20 bp, Artificial
  CRISPR gRNA sequence
gtctcgaactcctgacctca

SEQ ID NO: 728365 - DNA, 20 bp, Artificial
  CRISPR gRNA sequence
gaactcctgacctcaagtga

SEQ ID NO: 728366 - DNA, 20 bp, Artificial
  CRISPR gRNA sequence
ctgacctcaagtgatccgcc

SEQ ID NO: 728367 - DNA, 20 bp, Artificial
  CRISPR gRNA sequence
acctcaagtgatccgcccac

SEQ ID NO: 728368 - DNA, 20 bp, Artificial
  CRISPR gRNA sequence
aagtgatccgcccacctcag

SEQ ID NO: 728369 - DNA, 20 bp, Artificial
  CRISPR gRNA sequence
agcctcccaaagtgctggga

SEQ ID NO: 728370 - DNA, 20 bp, Artificial
  CRISPR gRNA sequence
ccaaagtgctgggatcgtag

SEQ ID NO: 728371 - DNA, 20 bp, Artificial
  CRISPR gRNA sequence
ggatcgtaggcgtgagccac

SEQ ID NO: 728372 - DNA, 20 bp, Artificial
  CRISPR gRNA sequence
aggcaacatttatatacaag

SEQ ID NO: 728373 - DNA, 20 bp, Artificial
  CRISPR gRNA sequence
atatacaagaaagtatcccc

SEQ ID NO: 728374 - DNA, 20 bp, Artificial
  CRISPR gRNA sequence
tatacaagaaagtatcccct

SEQ ID NO: 728375 - DNA, 20 bp, Artificial
  CRISPR gRNA sequence
gcagggtagggtggctcccg

SEQ ID NO: 728376 - DNA, 20 bp, Artificial
  CRISPR gRNA sequence
ccgcctgtaatcccagcact

SEQ ID NO: 728377 - DNA, 20 bp, Artificial
  CRISPR gRNA sequence
taatcccagcactttgggag

SEQ ID NO: 728378 - DNA, 20 bp, Artificial
  CRISPR gRNA sequence
tgggaggctgaagcaggcag

SEQ ID NO: 728379 - DNA, 20 bp, Artificial
  CRISPR gRNA sequence
gggaggctgaagcaggcaga

SEQ ID NO: 728380 - DNA, 20 bp, Artificial
  CRISPR gRNA sequence
ggaggctgaagcaggcagat

SEQ ID NO: 728381 - DNA, 20 bp, Artificial
  CRISPR gRNA sequence
aagcaggcagatcacttgag

SEQ ID NO: 728382 - DNA, 20 bp, Artificial
  CRISPR gRNA sequence
gagctcaggagttcgaaacc

SEQ ID NO: 728383 - DNA, 20 bp, Artificial
  CRISPR gRNA sequence
agctcaggagttcgaaacca

SEQ ID NO: 728384 - DNA, 20 bp, Artificial
  CRISPR gRNA sequence
aggagttcgaaaccagccta

SEQ ID NO: 728385 - DNA, 20 bp, Artificial
  CRISPR gRNA sequence
gaaaccagcctaagcaacat

SEQ ID NO: 728386 - DNA, 20 bp, Artificial
  CRISPR gRNA sequence
agcaacatagcaagaccctg

SEQ ID NO: 728387 - DNA, 20 bp, Artificial
  CRISPR gRNA sequence
tctctatttttaataagtaa

SEQ ID NO: 728388 - DNA, 20 bp, Artificial
  CRISPR gRNA sequence
tatttttaataagtaaaaat

SEQ ID NO: 728389 - DNA, 20 bp, Artificial
  CRISPR gRNA sequence
tttttaataagtaaaaataa

SEQ ID NO: 728390 - DNA, 20 bp, Artificial
  CRISPR gRNA sequence
ttaataagtaaaaataaaaa

SEQ ID NO: 728391 - DNA, 20 bp, Artificial
  CRISPR gRNA sequence
taataagtaaaaataaaaaa

SEQ ID NO: 728392 - DNA, 20 bp, Artificial
  CRISPR gRNA sequence
aataagtaaaaataaaaaaa

SEQ ID NO: 728393 - DNA, 20 bp, Artificial
  CRISPR gRNA sequence
ataagtaaaaataaaaaaag

SEQ ID NO: 728394 - DNA, 20 bp, Artificial
  CRISPR gRNA sequence
agtgtgtacagcctgatgag

SEQ ID NO: 728395 - DNA, 20 bp, Artificial
  CRISPR gRNA sequence
atgagttctgacaaaggtaa

SEQ ID NO: 728396 - DNA, 20 bp, Artificial
  CRISPR gRNA sequence
tgacaaaggtaactaactcc

SEQ ID NO: 728397 - DNA, 20 bp, Artificial
  CRISPR gRNA sequence
acaaaggtaactaactccaa

SEQ ID NO: 728398 - DNA, 20 bp, Artificial
  CRISPR gRNA sequence
actccaatcaaaatacagaa

SEQ ID NO: 728399 - DNA, 20 bp, Artificial
  CRISPR gRNA sequence
caatcaaaatacagaacatt

SEQ ID NO: 728400 - DNA, 20 bp, Artificial
  CRISPR gRNA sequence
tcatccctccagaaggttcc

SEQ ID NO: 728401 - DNA, 20 bp, Artificial
  CRISPR gRNA sequence
atccctccagaaggttccct

SEQ ID NO: 728402 - DNA, 20 bp, Artificial
  CRISPR gRNA sequence
cagaaggttccctagtgccc

SEQ ID NO: 728403 - DNA, 20 bp, Artificial
  CRISPR gRNA sequence
cctagtgcccctcctcactc

SEQ ID NO: 728404 - DNA, 20 bp, Artificial
  CRISPR gRNA sequence
gtgcccctcctcactcactc

SEQ ID NO: 728405 - DNA, 20 bp, Artificial
  CRISPR gRNA sequence
ctcactcactctgcccccac

SEQ ID NO: 728406 - DNA, 20 bp, Artificial
  CRISPR gRNA sequence
actcactctgcccccacctc

SEQ ID NO: 728407 - DNA, 20 bp, Artificial
  CRISPR gRNA sequence
actctgcccccacctccaga

SEQ ID NO: 728408 - DNA, 20 bp, Artificial
  CRISPR gRNA sequence
tgcccccacctccagatcca

SEQ ID NO: 728409 - DNA, 20 bp, Artificial
  CRISPR gRNA sequence
cccccacctccagatccagg

SEQ ID NO: 728410 - DNA, 20 bp, Artificial
  CRISPR gRNA sequence
cagatccaggcaaccaccga

SEQ ID NO: 728411 - DNA, 20 bp, Artificial
  CRISPR gRNA sequence
ctttatgtcactatagagga

SEQ ID NO: 728412 - DNA, 20 bp, Artificial
  CRISPR gRNA sequence
tatgtcactatagaggagtg

SEQ ID NO: 728413 - DNA, 20 bp, Artificial
  CRISPR gRNA sequence
atgtcactatagaggagtgt

SEQ ID NO: 728414 - DNA, 20 bp, Artificial
  CRISPR gRNA sequence
tgtcactatagaggagtgta

SEQ ID NO: 728415 - DNA, 20 bp, Artificial
  CRISPR gRNA sequence
tagaggagtgtatctgttcc

SEQ ID NO: 728416 - DNA, 20 bp, Artificial
  CRISPR gRNA sequence
ttccagaatttcatgtcgac

SEQ ID NO: 728417 - DNA, 20 bp, Artificial
  CRISPR gRNA sequence
cagaatttcatgtcgacaga

SEQ ID NO: 728418 - DNA, 20 bp, Artificial
  CRISPR gRNA sequence
catgtcgacagaatcatgca

SEQ ID NO: 728419 - DNA, 20 bp, Artificial
  CRISPR gRNA sequence
atgtcgacagaatcatgcag

SEQ ID NO: 728420 - DNA, 20 bp, Artificial
  CRISPR gRNA sequence
tttggggtctggcttcttcc

SEQ ID NO: 728421 - DNA, 20 bp, Artificial
  CRISPR gRNA sequence
tggggtctggcttcttccac

SEQ ID NO: 728422 - DNA, 20 bp, Artificial
  CRISPR gRNA sequence
ggggtctggcttcttccact

SEQ ID NO: 728423 - DNA, 20 bp, Artificial
  CRISPR gRNA sequence
gggtctggcttcttccactc

SEQ ID NO: 728424 - DNA, 20 bp, Artificial
  CRISPR gRNA sequence
gcttcttccactctgcataa

SEQ ID NO: 728425 - DNA, 20 bp, Artificial
  CRISPR gRNA sequence
cttccactctgcataatgtt

SEQ ID NO: 728426 - DNA, 20 bp, Artificial
  CRISPR gRNA sequence
ttccactctgcataatgttt

SEQ ID NO: 728427 - DNA, 20 bp, Artificial
  CRISPR gRNA sequence
ccactctgcataatgttttt

SEQ ID NO: 728428 - DNA, 20 bp, Artificial
  CRISPR gRNA sequence
cactctgcataatgtttttg

SEQ ID NO: 728429 - DNA, 20 bp, Artificial
  CRISPR gRNA sequence
tgcataatgtttttgatatt

SEQ ID NO: 728430 - DNA, 20 bp, Artificial
  CRISPR gRNA sequence
cataatgtttttgatattca

SEQ ID NO: 728431 - DNA, 20 bp, Artificial
  CRISPR gRNA sequence
ttgatattcattcagcttca

SEQ ID NO: 728432 - DNA, 20 bp, Artificial
  CRISPR gRNA sequence
tgatattcattcagcttcat

SEQ ID NO: 728433 - DNA, 20 bp, Artificial
  CRISPR gRNA sequence
gatattcattcagcttcatt

SEQ ID NO: 728434 - DNA, 20 bp, Artificial
  CRISPR gRNA sequence
atattcattcagcttcattc

SEQ ID NO: 728435 - DNA, 20 bp, Artificial
  CRISPR gRNA sequence
attcagcttcattcctttct

SEQ ID NO: 728436 - DNA, 20 bp, Artificial
  CRISPR gRNA sequence
agcttcattcctttctgttg

SEQ ID NO: 728437 - DNA, 20 bp, Artificial
  CRISPR gRNA sequence
cattcctttctgttgccaaa

SEQ ID NO: 728438 - DNA, 20 bp, Artificial
  CRISPR gRNA sequence
attcctttctgttgccaaat

SEQ ID NO: 728439 - DNA, 20 bp, Artificial
  CRISPR gRNA sequence
ctttctgttgccaaatggcg

SEQ ID NO: 728440 - DNA, 20 bp, Artificial
  CRISPR gRNA sequence
tctgttgccaaatggcgttc

SEQ ID NO: 728441 - DNA, 20 bp, Artificial
  CRISPR gRNA sequence
ctgttgccaaatggcgttct

SEQ ID NO: 728442 - DNA, 20 bp, Artificial
  CRISPR gRNA sequence
tgttgccaaatggcgttctg

SEQ ID NO: 728443 - DNA, 20 bp, Artificial
  CRISPR gRNA sequence
ttgccaaatggcgttctgtt

SEQ ID NO: 728444 - DNA, 20 bp, Artificial
  CRISPR gRNA sequence
ccaaatggcgttctgttgta

SEQ ID NO: 728445 - DNA, 20 bp, Artificial
  CRISPR gRNA sequence
tgttgtacagatgaaccact

SEQ ID NO: 728446 - DNA, 20 bp, Artificial
  CRISPR gRNA sequence
ttgtacagatgaaccactgt

SEQ ID NO: 728447 - DNA, 20 bp, Artificial
  CRISPR gRNA sequence
tacagatgaaccactgttta

SEQ ID NO: 728448 - DNA, 20 bp, Artificial
  CRISPR gRNA sequence
tttacatacccgttcgctag

SEQ ID NO: 728449 - DNA, 20 bp, Artificial
  CRISPR gRNA sequence
acatacccgttcgctagttg

SEQ ID NO: 728450 - DNA, 20 bp, Artificial
  CRISPR gRNA sequence
catacccgttcgctagttga

SEQ ID NO: 728451 - DNA, 20 bp, Artificial
  CRISPR gRNA sequence
gctagttgatggacatttgg

SEQ ID NO: 728452 - DNA, 20 bp, Artificial
  CRISPR gRNA sequence
gttgatggacatttgggttg

SEQ ID NO: 728453 - DNA, 20 bp, Artificial
  CRISPR gRNA sequence
atggacatttgggttgtttc

SEQ ID NO: 728454 - DNA, 20 bp, Artificial
  CRISPR gRNA sequence
gggttgtttccagtttgaac

SEQ ID NO: 728455 - DNA, 20 bp, Artificial
  CRISPR gRNA sequence
ggttgtttccagtttgaact

SEQ ID NO: 728456 - DNA, 20 bp, Artificial
  CRISPR gRNA sequence
tttccagtttgaactatgac

SEQ ID NO: 728457 - DNA, 20 bp, Artificial
  CRISPR gRNA sequence
ccagtttgaactatgacgaa

SEQ ID NO: 728458 - DNA, 20 bp, Artificial
  CRISPR gRNA sequence
cagtttgaactatgacgaac

SEQ ID NO: 728459 - DNA, 20 bp, Artificial
  CRISPR gRNA sequence
gaactatgacgaacaaggca

SEQ ID NO: 728460 - DNA, 20 bp, Artificial
  CRISPR gRNA sequence
aactatgacgaacaaggcag

SEQ ID NO: 728461 - DNA, 20 bp, Artificial
  CRISPR gRNA sequence
tgacgaacaaggcagctgtg

SEQ ID NO: 728462 - DNA, 20 bp, Artificial
  CRISPR gRNA sequence
tgagtattcttgtgcgtgcc

SEQ ID NO: 728463 - DNA, 20 bp, Artificial
  CRISPR gRNA sequence
ttgtgcgtgcctctgtgtga

SEQ ID NO: 728464 - DNA, 20 bp, Artificial
  CRISPR gRNA sequence
gtgcgtgcctctgtgtgaac

SEQ ID NO: 728465 - DNA, 20 bp, Artificial
  CRISPR gRNA sequence
tgcgtgcctctgtgtgaacg

SEQ ID NO: 728466 - DNA, 20 bp, Artificial
  CRISPR gRNA sequence
tgtgtgaacgtataatttca

SEQ ID NO: 728467 - DNA, 20 bp, Artificial
  CRISPR gRNA sequence
tgtgaacgtataatttcatt

SEQ ID NO: 728468 - DNA, 20 bp, Artificial
  CRISPR gRNA sequence
cattcctcttgagtgcctag

SEQ ID NO: 728469 - DNA, 20 bp, Artificial
  CRISPR gRNA sequence
attcctcttgagtgcctagg

SEQ ID NO: 728470 - DNA, 20 bp, Artificial
  CRISPR gRNA sequence
ctcttgagtgcctaggaagg

SEQ ID NO: 728471 - DNA, 20 bp, Artificial
  CRISPR gRNA sequence
ttgagtgcctaggaagggtg

SEQ ID NO: 728472 - DNA, 20 bp, Artificial
  CRISPR gRNA sequence
gagtgcctaggaagggtggc

SEQ ID NO: 728473 - DNA, 20 bp, Artificial
  CRISPR gRNA sequence
agtgcctaggaagggtggct

SEQ ID NO: 728474 - DNA, 20 bp, Artificial
  CRISPR gRNA sequence
ggaagggtggctggattgct

SEQ ID NO: 728475 - DNA, 20 bp, Artificial
  CRISPR gRNA sequence
gattgctatgctggccagac

SEQ ID NO: 728476 - DNA, 20 bp, Artificial
  CRISPR gRNA sequence
ctatgctggccagacggaat

SEQ ID NO: 728477 - DNA, 20 bp, Artificial
  CRISPR gRNA sequence
tgctggccagacggaatgtc

SEQ ID NO: 728478 - DNA, 20 bp, Artificial
  CRISPR gRNA sequence
gccagacggaatgtctctga

SEQ ID NO: 728479 - DNA, 20 bp, Artificial
  CRISPR gRNA sequence
tgaaggccagttcatagctg

SEQ ID NO: 728480 - DNA, 20 bp, Artificial
  CRISPR gRNA sequence
aaggccagttcatagctggc

SEQ ID NO: 728481 - DNA, 20 bp, Artificial
  CRISPR gRNA sequence
atagctggccaccactggtc

SEQ ID NO: 728482 - DNA, 20 bp, Artificial
  CRISPR gRNA sequence
gccaccactggtctgaccca

SEQ ID NO: 728483 - DNA, 20 bp, Artificial
  CRISPR gRNA sequence
gtctgacccagctaccttgt

SEQ ID NO: 728484 - DNA, 20 bp, Artificial
  CRISPR gRNA sequence
acccagctaccttgttttac

SEQ ID NO: 728485 - DNA, 20 bp, Artificial
  CRISPR gRNA sequence
ccttgttttacagatggaga

SEQ ID NO: 728486 - DNA, 20 bp, Artificial
  CRISPR gRNA sequence
gttttacagatggagagagc

SEQ ID NO: 728487 - DNA, 20 bp, Artificial
  CRISPR gRNA sequence
ttttacagatggagagagcc

SEQ ID NO: 728488 - DNA, 20 bp, Artificial
  CRISPR gRNA sequence
tacagatggagagagccgca

SEQ ID NO: 728489 - DNA, 20 bp, Artificial
  CRISPR gRNA sequence
acagatggagagagccgcag

SEQ ID NO: 728490 - DNA, 20 bp, Artificial
  CRISPR gRNA sequence
cagatggagagagccgcagg

SEQ ID NO: 728491 - DNA, 20 bp, Artificial
  CRISPR gRNA sequence
gagctacagccaggaaacag

SEQ ID NO: 728492 - DNA, 20 bp, Artificial
  CRISPR gRNA sequence
cagccaggaaacagagatgg

SEQ ID NO: 728493 - DNA, 20 bp, Artificial
  CRISPR gRNA sequence
cagcccagagcactctcctc

SEQ ID NO: 728494 - DNA, 20 bp, Artificial
  CRISPR gRNA sequence
tcctctggatggcactgcct

SEQ ID NO: 728495 - DNA, 20 bp, Artificial
  CRISPR gRNA sequence
ctctggatggcactgcctcc

SEQ ID NO: 728496 - DNA, 20 bp, Artificial
  CRISPR gRNA sequence
tggatggcactgcctcctgc

SEQ ID NO: 728497 - DNA, 20 bp, Artificial
  CRISPR gRNA sequence
gatggcactgcctcctgcct

SEQ ID NO: 728498 - DNA, 20 bp, Artificial
  CRISPR gRNA sequence
cctcctgcctggggactggg

SEQ ID NO: 728499 - DNA, 20 bp, Artificial
  CRISPR gRNA sequence
ctgcctggggactgggcacc

SEQ ID NO: 728500 - DNA, 20 bp, Artificial
  CRISPR gRNA sequence
cctggggactgggcaccttc

SEQ ID NO: 728501 - DNA, 20 bp, Artificial
  CRISPR gRNA sequence
gggactgggcaccttcttca

SEQ ID NO: 728502 - DNA, 20 bp, Artificial
  CRISPR gRNA sequence
ggcaccttcttcaaagcttc

SEQ ID NO: 728503 - DNA, 20 bp, Artificial
  CRISPR gRNA sequence
cttcaaagcttcctgctttt

SEQ ID NO: 728504 - DNA, 20 bp, Artificial
  CRISPR gRNA sequence
ttcaaagcttcctgcttttc

SEQ ID NO: 728505 - DNA, 20 bp, Artificial
  CRISPR gRNA sequence
caaagcttcctgcttttctg

SEQ ID NO: 728506 - DNA, 20 bp, Artificial
  CRISPR gRNA sequence
aaagcttcctgcttttctgg

SEQ ID NO: 728507 - DNA, 20 bp, Artificial
  CRISPR gRNA sequence
cctgcttttctggggcagga

SEQ ID NO: 728508 - DNA, 20 bp, Artificial
  CRISPR gRNA sequence
ctgcttttctggggcaggat

SEQ ID NO: 728509 - DNA, 20 bp, Artificial
  CRISPR gRNA sequence
cttttctggggcaggataat

SEQ ID NO: 728510 - DNA, 20 bp, Artificial
  CRISPR gRNA sequence
ttctggggcaggataatttg

SEQ ID NO: 728511 - DNA, 20 bp, Artificial
  CRISPR gRNA sequence
tctggggcaggataatttgg

SEQ ID NO: 728512 - DNA, 20 bp, Artificial
  CRISPR gRNA sequence
ctggggcaggataatttggc

SEQ ID NO: 728513 - DNA, 20 bp, Artificial
  CRISPR gRNA sequence
tggggcaggataatttggcc

SEQ ID NO: 728514 - DNA, 20 bp, Artificial
  CRISPR gRNA sequence
gggcaggataatttggccca

SEQ ID NO: 728515 - DNA, 20 bp, Artificial
  CRISPR gRNA sequence
ggcccacattagaagtgggt

SEQ ID NO: 728516 - DNA, 20 bp, Artificial
  CRISPR gRNA sequence
gcccacattagaagtgggtt

SEQ ID NO: 728517 - DNA, 20 bp, Artificial
  CRISPR gRNA sequence
gaagtgggttatgctcagtc

SEQ ID NO: 728518 - DNA, 20 bp, Artificial
  CRISPR gRNA sequence
tgctcagtcactacacctct

SEQ ID NO: 728519 - DNA, 20 bp, Artificial
  CRISPR gRNA sequence
agtcactacacctctccacc

SEQ ID NO: 728520 - DNA, 20 bp, Artificial
  CRISPR gRNA sequence
cacctctccacccccagagc

SEQ ID NO: 728521 - DNA, 20 bp, Artificial
  CRISPR gRNA sequence
tccacccccagagccctggt

SEQ ID NO: 728522 - DNA, 20 bp, Artificial
  CRISPR gRNA sequence
cacccccagagccctggtgg

SEQ ID NO: 728523 - DNA, 20 bp, Artificial
  CRISPR gRNA sequence
gtggaggcacccctttttga

SEQ ID NO: 728524 - DNA, 20 bp, Artificial
  CRISPR gRNA sequence
tttgatgtggtacaaagcaa

SEQ ID NO: 728525 - DNA, 20 bp, Artificial
  CRISPR gRNA sequence
ttgatgtggtacaaagcaac

SEQ ID NO: 728526 - DNA, 20 bp, Artificial
  CRISPR gRNA sequence
tgatgtggtacaaagcaacc

SEQ ID NO: 728527 - DNA, 20 bp, Artificial
  CRISPR gRNA sequence
gatgtggtacaaagcaaccc

SEQ ID NO: 728528 - DNA, 20 bp, Artificial
  CRISPR gRNA sequence
atgtggtacaaagcaacccc

SEQ ID NO: 728529 - DNA, 20 bp, Artificial
  CRISPR gRNA sequence
ccctctacaaagtgttcgtg

SEQ ID NO: 728530 - DNA, 20 bp, Artificial
  CRISPR gRNA sequence
tacaaagtgttcgtgacgcc

SEQ ID NO: 728531 - DNA, 20 bp, Artificial
  CRISPR gRNA sequence
caaagtgttcgtgacgcctc

SEQ ID NO: 728532 - DNA, 20 bp, Artificial
  CRISPR gRNA sequence
gtgacgcctctcagattttt

SEQ ID NO: 728533 - DNA, 20 bp, Artificial
  CRISPR gRNA sequence
tcagatttttcctcaaatag

SEQ ID NO: 728534 - DNA, 20 bp, Artificial
  CRISPR gRNA sequence
agatttttcctcaaatagac

SEQ ID NO: 728535 - DNA, 20 bp, Artificial
  CRISPR gRNA sequence
ttcctcaaatagacaaaaaa

SEQ ID NO: 728536 - DNA, 20 bp, Artificial
  CRISPR gRNA sequence
tcctcaaatagacaaaaaag

SEQ ID NO: 728537 - DNA, 20 bp, Artificial
  CRISPR gRNA sequence
cctcaaatagacaaaaaagt

SEQ ID NO: 728538 - DNA, 20 bp, Artificial
  CRISPR gRNA sequence
ctcaaatagacaaaaaagta

SEQ ID NO: 728539 - DNA, 20 bp, Artificial
  CRISPR gRNA sequence
aaatagacaaaaaagtaaag

SEQ ID NO: 728540 - DNA, 20 bp, Artificial
  CRISPR gRNA sequence
atttatttcttgcattgtag

SEQ ID NO: 728541 - DNA, 20 bp, Artificial
  CRISPR gRNA sequence
atttcttgcattgtagggtt

SEQ ID NO: 728542 - DNA, 20 bp, Artificial
  CRISPR gRNA sequence
tttcttgcattgtagggttc

SEQ ID NO: 728543 - DNA, 20 bp, Artificial
  CRISPR gRNA sequence
cttgcattgtagggttctga

SEQ ID NO: 728544 - DNA, 20 bp, Artificial
  CRISPR gRNA sequence
ttgcattgtagggttctgag

SEQ ID NO: 728545 - DNA, 20 bp, Artificial
  CRISPR gRNA sequence
gcattgtagggttctgagga

SEQ ID NO: 728546 - DNA, 20 bp, Artificial
  CRISPR gRNA sequence
cattgtagggttctgaggaa

SEQ ID NO: 728547 - DNA, 20 bp, Artificial
  CRISPR gRNA sequence
tagggttctgaggaaccccc

SEQ ID NO: 728548 - DNA, 20 bp, Artificial
  CRISPR gRNA sequence
tgaggaacccccctctttgg

SEQ ID NO: 728549 - DNA, 20 bp, Artificial
  CRISPR gRNA sequence
aggaacccccctctttgggg

SEQ ID NO: 728550 - DNA, 20 bp, Artificial
  CRISPR gRNA sequence
tttggggaaggtcactggac

SEQ ID NO: 728551 - DNA, 20 bp, Artificial
  CRISPR gRNA sequence
tggggaaggtcactggactc

SEQ ID NO: 728552 - DNA, 20 bp, Artificial
  CRISPR gRNA sequence
ggggaaggtcactggactct

SEQ ID NO: 728553 - DNA, 20 bp, Artificial
  CRISPR gRNA sequence
gggaaggtcactggactctt

SEQ ID NO: 728554 - DNA, 20 bp, Artificial
  CRISPR gRNA sequence
gactcttacctgaattagct

SEQ ID NO: 728555 - DNA, 20 bp, Artificial
  CRISPR gRNA sequence
ttacctgaattagctggagc

SEQ ID NO: 728556 - DNA, 20 bp, Artificial
  CRISPR gRNA sequence
acctgaattagctggagcct

SEQ ID NO: 728557 - DNA, 20 bp, Artificial
  CRISPR gRNA sequence
cctgaattagctggagcctg

SEQ ID NO: 728558 - DNA, 20 bp, Artificial
  CRISPR gRNA sequence
aattagctggagcctggaga

SEQ ID NO: 728559 - DNA, 20 bp, Artificial
  CRISPR gRNA sequence
gctggagcctggagactatg

SEQ ID NO: 728560 - DNA, 20 bp, Artificial
  CRISPR gRNA sequence
gagcctggagactatgggga

SEQ ID NO: 728561 - DNA, 20 bp, Artificial
  CRISPR gRNA sequence
gagactatggggaagatgat

SEQ ID NO: 728562 - DNA, 20 bp, Artificial
  CRISPR gRNA sequence
tggggaagatgatgcgatgt

SEQ ID NO: 728563 - DNA, 20 bp, Artificial
  CRISPR gRNA sequence
tgatggttcctacatgctcg

SEQ ID NO: 728564 - DNA, 20 bp, Artificial
  CRISPR gRNA sequence
ctacatgctcgttaatcagt

SEQ ID NO: 728565 - DNA, 20 bp, Artificial
  CRISPR gRNA sequence
catgctcgttaatcagtatt

SEQ ID NO: 728566 - DNA, 20 bp, Artificial
  CRISPR gRNA sequence
gttaatcagtatttgaatca

SEQ ID NO: 728567 - DNA, 20 bp, Artificial
  CRISPR gRNA sequence
atcagtatttgaatcagtgt

SEQ ID NO: 728568 - DNA, 20 bp, Artificial
  CRISPR gRNA sequence
gaatcagtgtttgaaaggtc

SEQ ID NO: 728569 - DNA, 20 bp, Artificial
  CRISPR gRNA sequence
aatcagtgtttgaaaggtca

SEQ ID NO: 728570 - DNA, 20 bp, Artificial
  CRISPR gRNA sequence
gaaaggtcattgggtttcag

SEQ ID NO: 728571 - DNA, 20 bp, Artificial
  CRISPR gRNA sequence
aaaggtcattgggtttcagt

SEQ ID NO: 728572 - DNA, 20 bp, Artificial
  CRISPR gRNA sequence
ggtttcagtgaacacttact

SEQ ID NO: 728573 - DNA, 20 bp, Artificial
  CRISPR gRNA sequence
cagtgaacacttactttgag

SEQ ID NO: 728574 - DNA, 20 bp, Artificial
  CRISPR gRNA sequence
agtgaacacttactttgagt

SEQ ID NO: 728575 - DNA, 20 bp, Artificial
  CRISPR gRNA sequence
actttgagtggactggagct

SEQ ID NO: 728576 - DNA, 20 bp, Artificial
  CRISPR gRNA sequence
ctttgagtggactggagctc

SEQ ID NO: 728577 - DNA, 20 bp, Artificial
  CRISPR gRNA sequence
tgagtggactggagctctga

SEQ ID NO: 728578 - DNA, 20 bp, Artificial
  CRISPR gRNA sequence
gagtggactggagctctgat

SEQ ID NO: 728579 - DNA, 20 bp, Artificial
  CRISPR gRNA sequence
agtggactggagctctgatg

SEQ ID NO: 728580 - DNA, 20 bp, Artificial
  CRISPR gRNA sequence
gagctctgatgctcaaaccc

SEQ ID NO: 728581 - DNA, 20 bp, Artificial
  CRISPR gRNA sequence
tgatgctcaaacccattaac

SEQ ID NO: 728582 - DNA, 20 bp, Artificial
  CRISPR gRNA sequence
atgctcaaacccattaactg

SEQ ID NO: 728583 - DNA, 20 bp, Artificial
  CRISPR gRNA sequence
aaacccattaactgtggcta

SEQ ID NO: 728584 - DNA, 20 bp, Artificial
  CRISPR gRNA sequence
actgtggctattcccagtca

SEQ ID NO: 728585 - DNA, 20 bp, Artificial
  CRISPR gRNA sequence
tggctattcccagtcagcat

SEQ ID NO: 728586 - DNA, 20 bp, Artificial
  CRISPR gRNA sequence
ttcccagtcagcatcatgag

SEQ ID NO: 728587 - DNA, 20 bp, Artificial
  CRISPR gRNA sequence
ccagtcagcatcatgaggag

SEQ ID NO: 728588 - DNA, 20 bp, Artificial
  CRISPR gRNA sequence
cctgctctccaaggcagcct

SEQ ID NO: 728589 - DNA, 20 bp, Artificial
  CRISPR gRNA sequence
ctctccaaggcagcctgatg

SEQ ID NO: 728590 - DNA, 20 bp, Artificial
  CRISPR gRNA sequence
tccaaggcagcctgatgtaa

SEQ ID NO: 728591 - DNA, 20 bp, Artificial
  CRISPR gRNA sequence
caaggcagcctgatgtaact

SEQ ID NO: 728592 - DNA, 20 bp, Artificial
  CRISPR gRNA sequence
atgtaactagacaggcccat

SEQ ID NO: 728593 - DNA, 20 bp, Artificial
  CRISPR gRNA sequence
gacaggcccatggtctcagc

SEQ ID NO: 728594 - DNA, 20 bp, Artificial
  CRISPR gRNA sequence
agctgctgctgaaacacctg

SEQ ID NO: 728595 - DNA, 20 bp, Artificial
  CRISPR gRNA sequence
ctgctgaaacacctgctgaa

SEQ ID NO: 728596 - DNA, 20 bp, Artificial
  CRISPR gRNA sequence
ctgaaacacctgctgaaatc

SEQ ID NO: 728597 - DNA, 20 bp, Artificial
  CRISPR gRNA sequence
aaacacctgctgaaatccag

SEQ ID NO: 728598 - DNA, 20 bp, Artificial
  CRISPR gRNA sequence
ctgaaatccagcgacagatc

SEQ ID NO: 728599 - DNA, 20 bp, Artificial
  CRISPR gRNA sequence
aaatccagcgacagatctgc

SEQ ID NO: 728600 - DNA, 20 bp, Artificial
  CRISPR gRNA sequence
ctgtccctcctgtatgtgca

SEQ ID NO: 728601 - DNA, 20 bp, Artificial
  CRISPR gRNA sequence
tccctcctgtatgtgcagaa

SEQ ID NO: 728602 - DNA, 20 bp, Artificial
  CRISPR gRNA sequence
ctgtatgtgcagaagggggg

SEQ ID NO: 728603 - DNA, 20 bp, Artificial
  CRISPR gRNA sequence
tatgtgcagaaggggggaac

SEQ ID NO: 728604 - DNA, 20 bp, Artificial
  CRISPR gRNA sequence
gtatcccttgggtgcctctc

SEQ ID NO: 728605 - DNA, 20 bp, Artificial
  CRISPR gRNA sequence
gggtgcctctcatcccctct

SEQ ID NO: 728606 - DNA, 20 bp, Artificial
  CRISPR gRNA sequence
ggtgcctctcatcccctctc

SEQ ID NO: 728607 - DNA, 20 bp, Artificial
  CRISPR gRNA sequence
tcatcccctctctgaatata

SEQ ID NO: 728608 - DNA, 20 bp, Artificial
  CRISPR gRNA sequence
atcccctctctgaatatact

SEQ ID NO: 728609 - DNA, 20 bp, Artificial
  CRISPR gRNA sequence
tctgaatatactatacctaa

SEQ ID NO: 728610 - DNA, 20 bp, Artificial
  CRISPR gRNA sequence
tgaatatactatacctaact

SEQ ID NO: 728611 - DNA, 20 bp, Artificial
  CRISPR gRNA sequence
aatatactatacctaacttg

SEQ ID NO: 728612 - DNA, 20 bp, Artificial
  CRISPR gRNA sequence
tacctaacttgtaactttcc

SEQ ID NO: 728613 - DNA, 20 bp, Artificial
  CRISPR gRNA sequence
acttgtaactttccttcttc

SEQ ID NO: 728614 - DNA, 20 bp, Artificial
  CRISPR gRNA sequence
gtaactttccttcttcctcc

SEQ ID NO: 728615 - DNA, 20 bp, Artificial
  CRISPR gRNA sequence
taactttccttcttcctccc

SEQ ID NO: 728616 - DNA, 20 bp, Artificial
  CRISPR gRNA sequence
tccttcttcctccctgagtc

SEQ ID NO: 728617 - DNA, 20 bp, Artificial
  CRISPR gRNA sequence
ccttcttcctccctgagtca

SEQ ID NO: 728618 - DNA, 20 bp, Artificial
  CRISPR gRNA sequence
cttcttcctccctgagtcag

SEQ ID NO: 728619 - DNA, 20 bp, Artificial
  CRISPR gRNA sequence
cttcctccctgagtcagtga

SEQ ID NO: 728620 - DNA, 20 bp, Artificial
  CRISPR gRNA sequence
ttcctccctgagtcagtgat

SEQ ID NO: 728621 - DNA, 20 bp, Artificial
  CRISPR gRNA sequence
cctccctgagtcagtgatcc

SEQ ID NO: 728622 - DNA, 20 bp, Artificial
  CRISPR gRNA sequence
ctccctgagtcagtgatcct

SEQ ID NO: 728623 - DNA, 20 bp, Artificial
  CRISPR gRNA sequence
cctgagtcagtgatcctccc

SEQ ID NO: 728624 - DNA, 20 bp, Artificial
  CRISPR gRNA sequence
agtcagtgatcctccccttt

SEQ ID NO: 728625 - DNA, 20 bp, Artificial
  CRISPR gRNA sequence
cccttttcctcctctttgga

SEQ ID NO: 728626 - DNA, 20 bp, Artificial
  CRISPR gRNA sequence
ttcctcctctttggatttga

SEQ ID NO: 728627 - DNA, 20 bp, Artificial
  CRISPR gRNA sequence
tcctcctctttggatttgaa

SEQ ID NO: 728628 - DNA, 20 bp, Artificial
  CRISPR gRNA sequence
cctcctctttggatttgaag

SEQ ID NO: 728629 - DNA, 20 bp, Artificial
  CRISPR gRNA sequence
ctcctctttggatttgaagg

SEQ ID NO: 728630 - DNA, 20 bp, Artificial
  CRISPR gRNA sequence
ctctttggatttgaaggtga

SEQ ID NO: 728631 - DNA, 20 bp, Artificial
  CRISPR gRNA sequence
tttggatttgaaggtgagga

SEQ ID NO: 728632 - DNA, 20 bp, Artificial
  CRISPR gRNA sequence
tggatttgaaggtgaggaga

SEQ ID NO: 728633 - DNA, 20 bp, Artificial
  CRISPR gRNA sequence
ggatttgaaggtgaggagaa

SEQ ID NO: 728634 - DNA, 20 bp, Artificial
  CRISPR gRNA sequence
gatttgaaggtgaggagaag

SEQ ID NO: 728635 - DNA, 20 bp, Artificial
  CRISPR gRNA sequence
gaaggtgaggagaaggcatt

SEQ ID NO: 728636 - DNA, 20 bp, Artificial
  CRISPR gRNA sequence
aaggtgaggagaaggcattg

SEQ ID NO: 728637 - DNA, 20 bp, Artificial
  CRISPR gRNA sequence
tctagcccctagttggtctg

SEQ ID NO: 728638 - DNA, 20 bp, Artificial
  CRISPR gRNA sequence
gcccctagttggtctgcctg

SEQ ID NO: 728639 - DNA, 20 bp, Artificial
  CRISPR gRNA sequence
gttggtctgcctgtgttctc

SEQ ID NO: 728640 - DNA, 20 bp, Artificial
  CRISPR gRNA sequence
gtctgcctgtgttctctggt

SEQ ID NO: 728641 - DNA, 20 bp, Artificial
  CRISPR gRNA sequence
cctgtgttctctggtaatgg

SEQ ID NO: 728642 - DNA, 20 bp, Artificial
  CRISPR gRNA sequence
tgttctctggtaatggccta

SEQ ID NO: 728643 - DNA, 20 bp, Artificial
  CRISPR gRNA sequence
tctggtaatggcctactgga

SEQ ID NO: 728644 - DNA, 20 bp, Artificial
  CRISPR gRNA sequence
tggtaatggcctactggaag

SEQ ID NO: 728645 - DNA, 20 bp, Artificial
  CRISPR gRNA sequence
gtaatggcctactggaagag

SEQ ID NO: 728646 - DNA, 20 bp, Artificial
  CRISPR gRNA sequence
ctggaagagaagaaaagaac

SEQ ID NO: 728647 - DNA, 20 bp, Artificial
  CRISPR gRNA sequence
gaagagaagaaaagaacctg

SEQ ID NO: 728648 - DNA, 20 bp, Artificial
  CRISPR gRNA sequence
cctactcagcctccatttaa

SEQ ID NO: 728649 - DNA, 20 bp, Artificial
  CRISPR gRNA sequence
ctcagcctccatttaagaac

SEQ ID NO: 728650 - DNA, 20 bp, Artificial
  CRISPR gRNA sequence
agcctccatttaagaactaa

SEQ ID NO: 728651 - DNA, 20 bp, Artificial
  CRISPR gRNA sequence
catttaagaactaaaaaaaa

SEQ ID NO: 728652 - DNA, 20 bp, Artificial
  CRISPR gRNA sequence
aagaactaaaaaaaatatta

SEQ ID NO: 728653 - DNA, 20 bp, Artificial
  CRISPR gRNA sequence
agaactaaaaaaaatattat

SEQ ID NO: 728654 - DNA, 20 bp, Artificial
  CRISPR gRNA sequence
aaaaaaatattatttaccag

SEQ ID NO: 728655 - DNA, 20 bp, Artificial
  CRISPR gRNA sequence
tttaccagatggatatactt

SEQ ID NO: 728656 - DNA, 20 bp, Artificial
  CRISPR gRNA sequence
accagatggatatacttctc

SEQ ID NO: 728657 - DNA, 20 bp, Artificial
  CRISPR gRNA sequence
ccagatggatatacttctct

SEQ ID NO: 728658 - DNA, 20 bp, Artificial
  CRISPR gRNA sequence
ctctttaaatccaaacaccc

SEQ ID NO: 728659 - DNA, 20 bp, Artificial
  CRISPR gRNA sequence
tctttaaatccaaacaccca

SEQ ID NO: 728660 - DNA, 20 bp, Artificial
  CRISPR gRNA sequence
tttaaatccaaacacccagt

SEQ ID NO: 728661 - DNA, 20 bp, Artificial
  CRISPR gRNA sequence
taaatccaaacacccagtcc

SEQ ID NO: 728662 - DNA, 20 bp, Artificial
  CRISPR gRNA sequence
aaatccaaacacccagtcct

SEQ ID NO: 728663 - DNA, 20 bp, Artificial
  CRISPR gRNA sequence
aatccaaacacccagtcctt

SEQ ID NO: 728664 - DNA, 20 bp, Artificial
  CRISPR gRNA sequence
gggccatttaaagaattgtc

SEQ ID NO: 728665 - DNA, 20 bp, Artificial
  CRISPR gRNA sequence
ggccatttaaagaattgtct

SEQ ID NO: 728666 - DNA, 20 bp, Artificial
  CRISPR gRNA sequence
aaagaattgtctcagcatca

SEQ ID NO: 728667 - DNA, 20 bp, Artificial
  CRISPR gRNA sequence
aagaattgtctcagcatcaa

SEQ ID NO: 728668 - DNA, 20 bp, Artificial
  CRISPR gRNA sequence
tctcagcatcaaggccaaac

SEQ ID NO: 728669 - DNA, 20 bp, Artificial
  CRISPR gRNA sequence
agcatcaaggccaaacagat

SEQ ID NO: 728670 - DNA, 20 bp, Artificial
  CRISPR gRNA sequence
tctttttgtacatccagcaa

SEQ ID NO: 728671 - DNA, 20 bp, Artificial
  CRISPR gRNA sequence
tttttgtacatccagcaatc

SEQ ID NO: 728672 - DNA, 20 bp, Artificial
  CRISPR gRNA sequence
tttgtacatccagcaatcgc

SEQ ID NO: 728673 - DNA, 20 bp, Artificial
  CRISPR gRNA sequence
ttgtacatccagcaatcgct

SEQ ID NO: 728674 - DNA, 20 bp, Artificial
  CRISPR gRNA sequence
tgtacatccagcaatcgctt

SEQ ID NO: 728675 - DNA, 20 bp, Artificial
  CRISPR gRNA sequence
gtacatccagcaatcgctta

SEQ ID NO: 728676 - DNA, 20 bp, Artificial
  CRISPR gRNA sequence
tacatccagcaatcgcttaa

SEQ ID NO: 728677 - DNA, 20 bp, Artificial
  CRISPR gRNA sequence
aaaatcaggtgaaatttcat

SEQ ID NO: 728678 - DNA, 20 bp, Artificial
  CRISPR gRNA sequence
aaatcaggtgaaatttcatc

SEQ ID NO: 728679 - DNA, 20 bp, Artificial
  CRISPR gRNA sequence
catcttcatatttggactgt

SEQ ID NO: 728680 - DNA, 20 bp, Artificial
  CRISPR gRNA sequence
atcttcatatttggactgta

SEQ ID NO: 728681 - DNA, 20 bp, Artificial
  CRISPR gRNA sequence
catatttggactgtatattt

SEQ ID NO: 728682 - DNA, 20 bp, Artificial
  CRISPR gRNA sequence
atatttggactgtatatttc

SEQ ID NO: 728683 - DNA, 20 bp, Artificial
  CRISPR gRNA sequence
ggactgtatatttcttgtca

SEQ ID NO: 728684 - DNA, 20 bp, Artificial
  CRISPR gRNA sequence
gactgtatatttcttgtcat

SEQ ID NO: 728685 - DNA, 20 bp, Artificial
  CRISPR gRNA sequence
tatatttcttgtcatctttt

SEQ ID NO: 728686 - DNA, 20 bp, Artificial
  CRISPR gRNA sequence
cttgtcatctttttcttttc

SEQ ID NO: 728687 - DNA, 20 bp, Artificial
  CRISPR gRNA sequence
ttgtcatctttttcttttcc

SEQ ID NO: 728688 - DNA, 20 bp, Artificial
  CRISPR gRNA sequence
gtcatctttttcttttcccg

SEQ ID NO: 728689 - DNA, 20 bp, Artificial
  CRISPR gRNA sequence
tcatctttttcttttcccgg

SEQ ID NO: 728690 - DNA, 20 bp, Artificial
  CRISPR gRNA sequence
tttcttttcccgggagtttt

SEQ ID NO: 728691 - DNA, 20 bp, Artificial
  CRISPR gRNA sequence
ttcttttcccgggagttttc

SEQ ID NO: 728692 - DNA, 20 bp, Artificial
  CRISPR gRNA sequence
tcttttcccgggagttttca

SEQ ID NO: 728693 - DNA, 20 bp, Artificial
  CRISPR gRNA sequence
cttttcccgggagttttcaa

SEQ ID NO: 728694 - DNA, 20 bp, Artificial
  CRISPR gRNA sequence
ttttcccgggagttttcaat

SEQ ID NO: 728695 - DNA, 20 bp, Artificial
  CRISPR gRNA sequence
ttcccgggagttttcaattg

SEQ ID NO: 728696 - DNA, 20 bp, Artificial
  CRISPR gRNA sequence
tcccgggagttttcaattgc

SEQ ID NO: 728697 - DNA, 20 bp, Artificial
  CRISPR gRNA sequence
cccgggagttttcaattgcc

SEQ ID NO: 728698 - DNA, 20 bp, Artificial
  CRISPR gRNA sequence
ccgggagttttcaattgcct

SEQ ID NO: 728699 - DNA, 20 bp, Artificial
  CRISPR gRNA sequence
tcaattgcctttctttttct

SEQ ID NO: 728700 - DNA, 20 bp, Artificial
  CRISPR gRNA sequence
caattgcctttctttttctt

SEQ ID NO: 728701 - DNA, 20 bp, Artificial
  CRISPR gRNA sequence
aattgcctttctttttcttg

SEQ ID NO: 728702 - DNA, 20 bp, Artificial
  CRISPR gRNA sequence
cctttctttttcttgttgat

SEQ ID NO: 728703 - DNA, 20 bp, Artificial
  CRISPR gRNA sequence
tctttttcttgttgataaaa

SEQ ID NO: 728704 - DNA, 20 bp, Artificial
  CRISPR gRNA sequence
ctttttcttgttgataaaag

SEQ ID NO: 728705 - DNA, 20 bp, Artificial
  CRISPR gRNA sequence
tttttcttgttgataaaagg

SEQ ID NO: 728706 - DNA, 20 bp, Artificial
  CRISPR gRNA sequence
tttcttgttgataaaaggac

SEQ ID NO: 728707 - DNA, 20 bp, Artificial
  CRISPR gRNA sequence
ttcttgttgataaaaggaca

SEQ ID NO: 728708 - DNA, 20 bp, Artificial
  CRISPR gRNA sequence
tcttgttgataaaaggacag

SEQ ID NO: 728709 - DNA, 20 bp, Artificial
  CRISPR gRNA sequence
cttgttgataaaaggacagt

SEQ ID NO: 728710 - DNA, 20 bp, Artificial
  CRISPR gRNA sequence
ttgttgataaaaggacagtg

SEQ ID NO: 728711 - DNA, 20 bp, Artificial
  CRISPR gRNA sequence
gttgataaaaggacagtgtg

SEQ ID NO: 728712 - DNA, 20 bp, Artificial
  CRISPR gRNA sequence
ttgataaaaggacagtgtgc

SEQ ID NO: 728713 - DNA, 20 bp, Artificial
  CRISPR gRNA sequence
ataaaaggacagtgtgccct

SEQ ID NO: 728714 - DNA, 20 bp, Artificial
  CRISPR gRNA sequence
accatatcctcaggcttttc

SEQ ID NO: 728715 - DNA, 20 bp, Artificial
  CRISPR gRNA sequence
aggcttttcaactctactaa

SEQ ID NO: 728716 - DNA, 20 bp, Artificial
  CRISPR gRNA sequence
ttcaactctactaatcatga

SEQ ID NO: 728717 - DNA, 20 bp, Artificial
  CRISPR gRNA sequence
tcaactctactaatcatgaa

SEQ ID NO: 728718 - DNA, 20 bp, Artificial
  CRISPR gRNA sequence
caactctactaatcatgaaa

SEQ ID NO: 728719 - DNA, 20 bp, Artificial
  CRISPR gRNA sequence
aactctactaatcatgaaat

SEQ ID NO: 728720 - DNA, 20 bp, Artificial
  CRISPR gRNA sequence
tactaatcatgaaatttact

SEQ ID NO: 728721 - DNA, 20 bp, Artificial
  CRISPR gRNA sequence
ctaatcatgaaatttactac

SEQ ID NO: 728722 - DNA, 20 bp, Artificial
  CRISPR gRNA sequence
atcatgaaatttactacaat

SEQ ID NO: 728723 - DNA, 20 bp, Artificial
  CRISPR gRNA sequence
actacaattctctcttctat

SEQ ID NO: 728724 - DNA, 20 bp, Artificial
  CRISPR gRNA sequence
ctacaattctctcttctatt

SEQ ID NO: 728725 - DNA, 20 bp, Artificial
  CRISPR gRNA sequence
caattctctcttctattcct

SEQ ID NO: 728726 - DNA, 20 bp, Artificial
  CRISPR gRNA sequence
tctcttctattcctgggaac

SEQ ID NO: 728727 - DNA, 20 bp, Artificial
  CRISPR gRNA sequence
tcttctattcctgggaacac

SEQ ID NO: 728728 - DNA, 20 bp, Artificial
  CRISPR gRNA sequence
ttctattcctgggaacactt

SEQ ID NO: 728729 - DNA, 20 bp, Artificial
  CRISPR gRNA sequence
ctattcctgggaacacttcc

SEQ ID NO: 728730 - DNA, 20 bp, Artificial
  CRISPR gRNA sequence
tattcctgggaacacttcct

SEQ ID NO: 728731 - DNA, 20 bp, Artificial
  CRISPR gRNA sequence
ttcctgggaacacttcctcg

SEQ ID NO: 728732 - DNA, 20 bp, Artificial
  CRISPR gRNA sequence
ctgggaacacttcctcggag

SEQ ID NO: 728733 - DNA, 20 bp, Artificial
  CRISPR gRNA sequence
ggaacacttcctcggagcct

SEQ ID NO: 728734 - DNA, 20 bp, Artificial
  CRISPR gRNA sequence
cctcggagccttccttccat

SEQ ID NO: 728735 - DNA, 20 bp, Artificial
  CRISPR gRNA sequence
ctcggagccttccttccatt

SEQ ID NO: 728736 - DNA, 20 bp, Artificial
  CRISPR gRNA sequence
ggagccttccttccattttc

SEQ ID NO: 728737 - DNA, 20 bp, Artificial
  CRISPR gRNA sequence
ccttccattttcctgctctg

SEQ ID NO: 728738 - DNA, 20 bp, Artificial
  CRISPR gRNA sequence
cttccattttcctgctctga

SEQ ID NO: 728739 - DNA, 20 bp, Artificial
  CRISPR gRNA sequence
ccattttcctgctctgatct

SEQ ID NO: 728740 - DNA, 20 bp, Artificial
  CRISPR gRNA sequence
cattttcctgctctgatctg

SEQ ID NO: 728741 - DNA, 20 bp, Artificial
  CRISPR gRNA sequence
tcctgctctgatctggctca

SEQ ID NO: 728742 - DNA, 20 bp, Artificial
  CRISPR gRNA sequence
cctgctctgatctggctcaa

SEQ ID NO: 728743 - DNA, 20 bp, Artificial
  CRISPR gRNA sequence
ctgctctgatctggctcaac

SEQ ID NO: 728744 - DNA, 20 bp, Artificial
  CRISPR gRNA sequence
ctctgatctggctcaactgg

SEQ ID NO: 728745 - DNA, 20 bp, Artificial
  CRISPR gRNA sequence
tgatctggctcaactggtct

SEQ ID NO: 728746 - DNA, 20 bp, Artificial
  CRISPR gRNA sequence
atctggctcaactggtctat

SEQ ID NO: 728747 - DNA, 20 bp, Artificial
  CRISPR gRNA sequence
gctcaactggtctataccac

SEQ ID NO: 728748 - DNA, 20 bp, Artificial
  CRISPR gRNA sequence
aactggtctataccacatca

SEQ ID NO: 728749 - DNA, 20 bp, Artificial
  CRISPR gRNA sequence
gtctataccacatcattctg

SEQ ID NO: 728750 - DNA, 20 bp, Artificial
  CRISPR gRNA sequence
taccacatcattctgggact

SEQ ID NO: 728751 - DNA, 20 bp, Artificial
  CRISPR gRNA sequence
tgggacttcccttccttgct

SEQ ID NO: 728752 - DNA, 20 bp, Artificial
  CRISPR gRNA sequence
ggacttcccttccttgctct

SEQ ID NO: 728753 - DNA, 20 bp, Artificial
  CRISPR gRNA sequence
cccttccttgctctgctagg

SEQ ID NO: 728754 - DNA, 20 bp, Artificial
  CRISPR gRNA sequence
ccttccttgctctgctagga

SEQ ID NO: 728755 - DNA, 20 bp, Artificial
  CRISPR gRNA sequence
ccttgctctgctaggatgga

SEQ ID NO: 728756 - DNA, 20 bp, Artificial
  CRISPR gRNA sequence
cttgctctgctaggatggag

SEQ ID NO: 728757 - DNA, 20 bp, Artificial
  CRISPR gRNA sequence
gctctgctaggatggagtgc

SEQ ID NO: 728758 - DNA, 20 bp, Artificial
  CRISPR gRNA sequence
ctctgctaggatggagtgct

SEQ ID NO: 728759 - DNA, 20 bp, Artificial
  CRISPR gRNA sequence
tgctaggatggagtgctggt

SEQ ID NO: 728760 - DNA, 20 bp, Artificial
  CRISPR gRNA sequence
ctaggatggagtgctggtct

SEQ ID NO: 728761 - DNA, 20 bp, Artificial
  CRISPR gRNA sequence
ggatggagtgctggtctcta

SEQ ID NO: 728762 - DNA, 20 bp, Artificial
  CRISPR gRNA sequence
gtctctagattccatggctt

SEQ ID NO: 728763 - DNA, 20 bp, Artificial
  CRISPR gRNA sequence
tagattccatggcttcctgt

SEQ ID NO: 728764 - DNA, 20 bp, Artificial
  CRISPR gRNA sequence
gattccatggcttcctgttg

SEQ ID NO: 728765 - DNA, 20 bp, Artificial
  CRISPR gRNA sequence
catggcttcctgttgttttt

SEQ ID NO: 728766 - DNA, 20 bp, Artificial
  CRISPR gRNA sequence
cctgttgtttttcttttttg

SEQ ID NO: 728767 - DNA, 20 bp, Artificial
  CRISPR gRNA sequence
ctgttgtttttcttttttgc

SEQ ID NO: 728768 - DNA, 20 bp, Artificial
  CRISPR gRNA sequence
ttgtttttcttttttgcccc

SEQ ID NO: 728769 - DNA, 20 bp, Artificial
  CRISPR gRNA sequence
tttttcttttttgccccctc

SEQ ID NO: 728770 - DNA, 20 bp, Artificial
  CRISPR gRNA sequence
ttcttttttgccccctcact

SEQ ID NO: 728771 - DNA, 20 bp, Artificial
  CRISPR gRNA sequence
tcttttttgccccctcactt

SEQ ID NO: 728772 - DNA, 20 bp, Artificial
  CRISPR gRNA sequence
cttttttgccccctcactta

SEQ ID NO: 728773 - DNA, 20 bp, Artificial
  CRISPR gRNA sequence
ttttttgccccctcacttag

SEQ ID NO: 728774 - DNA, 20 bp, Artificial
  CRISPR gRNA sequence
ttttgccccctcacttagct

SEQ ID NO: 728775 - DNA, 20 bp, Artificial
  CRISPR gRNA sequence
tttgccccctcacttagctg

SEQ ID NO: 728776 - DNA, 20 bp, Artificial
  CRISPR gRNA sequence
ttgccccctcacttagctga

SEQ ID NO: 728777 - DNA, 20 bp, Artificial
  CRISPR gRNA sequence
tgccccctcacttagctgaa

SEQ ID NO: 728778 - DNA, 20 bp, Artificial
  CRISPR gRNA sequence
gccccctcacttagctgaat

SEQ ID NO: 728779 - DNA, 20 bp, Artificial
  CRISPR gRNA sequence
ccccctcacttagctgaatt

SEQ ID NO: 728780 - DNA, 20 bp, Artificial
  CRISPR gRNA sequence
acttagctgaattacatctt

SEQ ID NO: 728781 - DNA, 20 bp, Artificial
  CRISPR gRNA sequence
agctgaattacatcttcaaa

SEQ ID NO: 728782 - DNA, 20 bp, Artificial
  CRISPR gRNA sequence
gctgaattacatcttcaaat

SEQ ID NO: 728783 - DNA, 20 bp, Artificial
  CRISPR gRNA sequence
aattacatcttcaaatatct

SEQ ID NO: 728784 - DNA, 20 bp, Artificial
  CRISPR gRNA sequence
catcttcaaatatcttccta

SEQ ID NO: 728785 - DNA, 20 bp, Artificial
  CRISPR gRNA sequence
caaatatcttcctaggagag

SEQ ID NO: 728786 - DNA, 20 bp, Artificial
  CRISPR gRNA sequence
aaatatcttcctaggagagg

SEQ ID NO: 728787 - DNA, 20 bp, Artificial
  CRISPR gRNA sequence
cctaggagaggatataggaa

SEQ ID NO: 728788 - DNA, 20 bp, Artificial
  CRISPR gRNA sequence
ctaggagaggatataggaag

SEQ ID NO: 728789 - DNA, 20 bp, Artificial
  CRISPR gRNA sequence
ggagaggatataggaagaaa

SEQ ID NO: 728790 - DNA, 20 bp, Artificial
  CRISPR gRNA sequence
ctggaccttttatgtctgaa

SEQ ID NO: 728791 - DNA, 20 bp, Artificial
  CRISPR gRNA sequence
tggaccttttatgtctgaaa

SEQ ID NO: 728792 - DNA, 20 bp, Artificial
  CRISPR gRNA sequence
gaccttttatgtctgaaaat

SEQ ID NO: 728793 - DNA, 20 bp, Artificial
  CRISPR gRNA sequence
ttatgtctgaaaatgttttt

SEQ ID NO: 728794 - DNA, 20 bp, Artificial
  CRISPR gRNA sequence
tatgtctgaaaatgttttta

SEQ ID NO: 728795 - DNA, 20 bp, Artificial
  CRISPR gRNA sequence
atgtctgaaaatgtttttat

SEQ ID NO: 728796 - DNA, 20 bp, Artificial
  CRISPR gRNA sequence
tgtctgaaaatgtttttatg

SEQ ID NO: 728797 - DNA, 20 bp, Artificial
  CRISPR gRNA sequence
aaaatgtttttatgctgcct

SEQ ID NO: 728798 - DNA, 20 bp, Artificial
  CRISPR gRNA sequence
ttatgctgccttcaaacttg

SEQ ID NO: 728799 - DNA, 20 bp, Artificial
  CRISPR gRNA sequence
tatgctgccttcaaacttga

SEQ ID NO: 728800 - DNA, 20 bp, Artificial
  CRISPR gRNA sequence
atgctgccttcaaacttgat

SEQ ID NO: 728801 - DNA, 20 bp, Artificial
  CRISPR gRNA sequence
tgctgccttcaaacttgatt

SEQ ID NO: 728802 - DNA, 20 bp, Artificial
  CRISPR gRNA sequence
ccttcaaacttgattgtaat

SEQ ID NO: 728803 - DNA, 20 bp, Artificial
  CRISPR gRNA sequence
caaacttgattgtaatttag

SEQ ID NO: 728804 - DNA, 20 bp, Artificial
  CRISPR gRNA sequence
aaacttgattgtaatttagc

SEQ ID NO: 728805 - DNA, 20 bp, Artificial
  CRISPR gRNA sequence
gattgtaatttagctgaagt

SEQ ID NO: 728806 - DNA, 20 bp, Artificial
  CRISPR gRNA sequence
attgtaatttagctgaagtg

SEQ ID NO: 728807 - DNA, 20 bp, Artificial
  CRISPR gRNA sequence
taatttagctgaagtgactg

SEQ ID NO: 728808 - DNA, 20 bp, Artificial
  CRISPR gRNA sequence
agctgaagtgactgtaattt

SEQ ID NO: 728809 - DNA, 20 bp, Artificial
  CRISPR gRNA sequence
gctgaagtgactgtaattta

SEQ ID NO: 728810 - DNA, 20 bp, Artificial
  CRISPR gRNA sequence
aagtgactgtaatttagctg

SEQ ID NO: 728811 - DNA, 20 bp, Artificial
  CRISPR gRNA sequence
taatttagctgggtaaattc

SEQ ID NO: 728812 - DNA, 20 bp, Artificial
  CRISPR gRNA sequence
agctgggtaaattctaggtt

SEQ ID NO: 728813 - DNA, 20 bp, Artificial
  CRISPR gRNA sequence
gctgggtaaattctaggttc

SEQ ID NO: 728814 - DNA, 20 bp, Artificial
  CRISPR gRNA sequence
ggtaaattctaggttcagaa

SEQ ID NO: 728815 - DNA, 20 bp, Artificial
  CRISPR gRNA sequence
taggttcagaactaagaagg

SEQ ID NO: 728816 - DNA, 20 bp, Artificial
  CRISPR gRNA sequence
ggttcagaactaagaaggag

SEQ ID NO: 728817 - DNA, 20 bp, Artificial
  CRISPR gRNA sequence
agaactaagaaggaggtggg

SEQ ID NO: 728818 - DNA, 20 bp, Artificial
  CRISPR gRNA sequence
agaaggaggtgggtgggtgg

SEQ ID NO: 728819 - DNA, 20 bp, Artificial
  CRISPR gRNA sequence
ccagtggaagtactctgggc

SEQ ID NO: 728820 - DNA, 20 bp, Artificial
  CRISPR gRNA sequence
cagtggaagtactctgggct

SEQ ID NO: 728821 - DNA, 20 bp, Artificial
  CRISPR gRNA sequence
tgggctgacccttgggatcc

SEQ ID NO: 728822 - DNA, 20 bp, Artificial
  CRISPR gRNA sequence
ggctgacccttgggatccct

SEQ ID NO: 728823 - DNA, 20 bp, Artificial
  CRISPR gRNA sequence
acccttgggatccctgcatt

SEQ ID NO: 728824 - DNA, 20 bp, Artificial
  CRISPR gRNA sequence
gggatccctgcattctggtt

SEQ ID NO: 728825 - DNA, 20 bp, Artificial
  CRISPR gRNA sequence
ggatccctgcattctggttc

SEQ ID NO: 728826 - DNA, 20 bp, Artificial
  CRISPR gRNA sequence
cattctggttctagcttcgg

SEQ ID NO: 728827 - DNA, 20 bp, Artificial
  CRISPR gRNA sequence
tggttctagcttcggccctg

SEQ ID NO: 728828 - DNA, 20 bp, Artificial
  CRISPR gRNA sequence
gttctagcttcggccctgtg

SEQ ID NO: 728829 - DNA, 20 bp, Artificial
  CRISPR gRNA sequence
tagcttcggccctgtgcttc

SEQ ID NO: 728830 - DNA, 20 bp, Artificial
  CRISPR gRNA sequence
gcttcggccctgtgcttctc

SEQ ID NO: 728831 - DNA, 20 bp, Artificial
  CRISPR gRNA sequence
cggccctgtgcttctctctg

SEQ ID NO: 728832 - DNA, 20 bp, Artificial
  CRISPR gRNA sequence
ggccctgtgcttctctctgg

SEQ ID NO: 728833 - DNA, 20 bp, Artificial
  CRISPR gRNA sequence
tgcttctctctgggtgtaaa

SEQ ID NO: 728834 - DNA, 20 bp, Artificial
  CRISPR gRNA sequence
ctctctgggtgtaaaacgaa

SEQ ID NO: 728835 - DNA, 20 bp, Artificial
  CRISPR gRNA sequence
tctctgggtgtaaaacgaag

SEQ ID NO: 728836 - DNA, 20 bp, Artificial
  CRISPR gRNA sequence
tctgggtgtaaaacgaaggg

SEQ ID NO: 728837 - DNA, 20 bp, Artificial
  CRISPR gRNA sequence
tgggtgtaaaacgaaggggt

SEQ ID NO: 728838 - DNA, 20 bp, Artificial
  CRISPR gRNA sequence
ggtgtaaaacgaaggggttg

SEQ ID NO: 728839 - DNA, 20 bp, Artificial
  CRISPR gRNA sequence
tatcagaccagaggtatcca

SEQ ID NO: 728840 - DNA, 20 bp, Artificial
  CRISPR gRNA sequence
tgactagtcctcaaaaacat

SEQ ID NO: 728841 - DNA, 20 bp, Artificial
  CRISPR gRNA sequence
gactagtcctcaaaaacatt

SEQ ID NO: 728842 - DNA, 20 bp, Artificial
  CRISPR gRNA sequence
actagtcctcaaaaacattc

SEQ ID NO: 728843 - DNA, 20 bp, Artificial
  CRISPR gRNA sequence
gtcctcaaaaacattctgac

SEQ ID NO: 728844 - DNA, 20 bp, Artificial
  CRISPR gRNA sequence
aaaaacattctgactatgtg

SEQ ID NO: 728845 - DNA, 20 bp, Artificial
  CRISPR gRNA sequence
tgactatgtgaccagcacaa

SEQ ID NO: 728846 - DNA, 20 bp, Artificial
  CRISPR gRNA sequence
actatgtgaccagcacaatg

SEQ ID NO: 728847 - DNA, 20 bp, Artificial
  CRISPR gRNA sequence
tgtgaccagcacaatgacct

SEQ ID NO: 728848 - DNA, 20 bp, Artificial
  CRISPR gRNA sequence
gccactcctcctaggtattt

SEQ ID NO: 728849 - DNA, 20 bp, Artificial
  CRISPR gRNA sequence
ctcctaggtatttacccatg

SEQ ID NO: 728850 - DNA, 20 bp, Artificial
  CRISPR gRNA sequence
ctaggtatttacccatgaaa

SEQ ID NO: 728851 - DNA, 20 bp, Artificial
  CRISPR gRNA sequence
ggtatttacccatgaaaaat

SEQ ID NO: 728852 - DNA, 20 bp, Artificial
  CRISPR gRNA sequence
acccatgaaaaatgaaaata

SEQ ID NO: 728853 - DNA, 20 bp, Artificial
  CRISPR gRNA sequence
cccatgaaaaatgaaaatat

SEQ ID NO: 728854 - DNA, 20 bp, Artificial
  CRISPR gRNA sequence
gtacaagaatcggccagtca

SEQ ID NO: 728855 - DNA, 20 bp, Artificial
  CRISPR gRNA sequence
tacaagaatcggccagtcat

SEQ ID NO: 728856 - DNA, 20 bp, Artificial
  CRISPR gRNA sequence
atgccagtaatctcagcact

SEQ ID NO: 728857 - DNA, 20 bp, Artificial
  CRISPR gRNA sequence
agcactgtgggaggctgagg

SEQ ID NO: 728858 - DNA, 20 bp, Artificial
  CRISPR gRNA sequence
tgggaggctgaggtgggagg

SEQ ID NO: 728859 - DNA, 20 bp, Artificial
  CRISPR gRNA sequence
aggtgggaggatcgcccgag

SEQ ID NO: 728860 - DNA, 20 bp, Artificial
  CRISPR gRNA sequence
aatgctgcagtgagccaaga

SEQ ID NO: 728861 - DNA, 20 bp, Artificial
  CRISPR gRNA sequence
cagtgagccaagatcatgcc

SEQ ID NO: 728862 - DNA, 20 bp, Artificial
  CRISPR gRNA sequence
cactccagcctggaacacag

SEQ ID NO: 728863 - DNA, 20 bp, Artificial
  CRISPR gRNA sequence
cagcctggaacacagagtga

SEQ ID NO: 728864 - DNA, 20 bp, Artificial
  CRISPR gRNA sequence
gaacacagagtgagaccctg

SEQ ID NO: 728865 - DNA, 20 bp, Artificial
  CRISPR gRNA sequence
tctctaaaaataataaaaat

SEQ ID NO: 728866 - DNA, 20 bp, Artificial
  CRISPR gRNA sequence
taaaaataataaaaataata

SEQ ID NO: 728867 - DNA, 20 bp, Artificial
  CRISPR gRNA sequence
aaaataataaaaataataat

SEQ ID NO: 728868 - DNA, 20 bp, Artificial
  CRISPR gRNA sequence
atacatgttaaaaaaaaaaa

SEQ ID NO: 728869 - DNA, 20 bp, Artificial
  CRISPR gRNA sequence
aaaaaaaaaaaagaatattc

SEQ ID NO: 728870 - DNA, 20 bp, Artificial
  CRISPR gRNA sequence
acagctgttttcattcataa

SEQ ID NO: 728871 - DNA, 20 bp, Artificial
  CRISPR gRNA sequence
ttttcattcataatagccct

SEQ ID NO: 728872 - DNA, 20 bp, Artificial
  CRISPR gRNA sequence
tcattcataatagccctaaa

SEQ ID NO: 728873 - DNA, 20 bp, Artificial
  CRISPR gRNA sequence
cattcataatagccctaaac

SEQ ID NO: 728874 - DNA, 20 bp, Artificial
  CRISPR gRNA sequence
attcataatagccctaaact

SEQ ID NO: 728875 - DNA, 20 bp, Artificial
  CRISPR gRNA sequence
ataatagccctaaactggaa

SEQ ID NO: 728876 - DNA, 20 bp, Artificial
  CRISPR gRNA sequence
aactggaaacaacccaaatg

SEQ ID NO: 728877 - DNA, 20 bp, Artificial
  CRISPR gRNA sequence
gaaacaacccaaatgccatc

SEQ ID NO: 728878 - DNA, 20 bp, Artificial
  CRISPR gRNA sequence
ttacatgtagcgtgggtaat

SEQ ID NO: 728879 - DNA, 20 bp, Artificial
  CRISPR gRNA sequence
catgtagcgtgggtaatttc

SEQ ID NO: 728880 - DNA, 20 bp, Artificial
  CRISPR gRNA sequence
ccattaatcctgctttgctc

SEQ ID NO: 728881 - DNA, 20 bp, Artificial
  CRISPR gRNA sequence
cattaatcctgctttgctct

SEQ ID NO: 728882 - DNA, 20 bp, Artificial
  CRISPR gRNA sequence
atcctgctttgctcttggta

SEQ ID NO: 728883 - DNA, 20 bp, Artificial
  CRISPR gRNA sequence
ctttgctcttggtaggtcct

SEQ ID NO: 728884 - DNA, 20 bp, Artificial
  CRISPR gRNA sequence
tgctcttggtaggtcctttt

SEQ ID NO: 728885 - DNA, 20 bp, Artificial
  CRISPR gRNA sequence
gctcttggtaggtccttttg

SEQ ID NO: 728886 - DNA, 20 bp, Artificial
  CRISPR gRNA sequence
ctcttggtaggtccttttga

SEQ ID NO: 728887 - DNA, 20 bp, Artificial
  CRISPR gRNA sequence
ttggtaggtccttttgacct

SEQ ID NO: 728888 - DNA, 20 bp, Artificial
  CRISPR gRNA sequence
ggtaggtccttttgacctga

SEQ ID NO: 728889 - DNA, 20 bp, Artificial
  CRISPR gRNA sequence
gtaggtccttttgacctgaa

SEQ ID NO: 728890 - DNA, 20 bp, Artificial
  CRISPR gRNA sequence
ttgacctgaagtctatgctt

SEQ ID NO: 728891 - DNA, 20 bp, Artificial
  CRISPR gRNA sequence
tgacctgaagtctatgcttc

SEQ ID NO: 728892 - DNA, 20 bp, Artificial
  CRISPR gRNA sequence
gacctgaagtctatgcttct

SEQ ID NO: 728893 - DNA, 20 bp, Artificial
  CRISPR gRNA sequence
acctgaagtctatgcttctg

SEQ ID NO: 728894 - DNA, 20 bp, Artificial
  CRISPR gRNA sequence
aagtctatgcttctggtcag

SEQ ID NO: 728895 - DNA, 20 bp, Artificial
  CRISPR gRNA sequence
tgcttctggtcaggtgcaca

SEQ ID NO: 728896 - DNA, 20 bp, Artificial
  CRISPR gRNA sequence
ctggtcaggtgcacagagaa

SEQ ID NO: 728897 - DNA, 20 bp, Artificial
  CRISPR gRNA sequence
tggtcaggtgcacagagaaa

SEQ ID NO: 728898 - DNA, 20 bp, Artificial
  CRISPR gRNA sequence
gtcaggtgcacagagaaatt

SEQ ID NO: 728899 - DNA, 20 bp, Artificial
  CRISPR gRNA sequence
aggctgccactgtgggggag

SEQ ID NO: 728900 - DNA, 20 bp, Artificial
  CRISPR gRNA sequence
ccactgtgggggagacgcct

SEQ ID NO: 728901 - DNA, 20 bp, Artificial
  CRISPR gRNA sequence
tgggggagacgcctggagca

SEQ ID NO: 728902 - DNA, 20 bp, Artificial
  CRISPR gRNA sequence
gagcactttggggtgccaaa

SEQ ID NO: 728903 - DNA, 20 bp, Artificial
  CRISPR gRNA sequence
tggggtgccaaagacctgtg

SEQ ID NO: 728904 - DNA, 20 bp, Artificial
  CRISPR gRNA sequence
ggggtgccaaagacctgtgg

SEQ ID NO: 728905 - DNA, 20 bp, Artificial
  CRISPR gRNA sequence
gggtgccaaagacctgtggc

SEQ ID NO: 728906 - DNA, 20 bp, Artificial
  CRISPR gRNA sequence
tggctggtgggggatgcaca

SEQ ID NO: 728907 - DNA, 20 bp, Artificial
  CRISPR gRNA sequence
gtgggggatgcacagaggga

SEQ ID NO: 728908 - DNA, 20 bp, Artificial
  CRISPR gRNA sequence
ttgcagacatgaggcctggc

SEQ ID NO: 728909 - DNA, 20 bp, Artificial
  CRISPR gRNA sequence
tgcagacatgaggcctggca

SEQ ID NO: 728910 - DNA, 20 bp, Artificial
  CRISPR gRNA sequence
gcagacatgaggcctggcac

SEQ ID NO: 728911 - DNA, 20 bp, Artificial
  CRISPR gRNA sequence
cagacatgaggcctggcacg

SEQ ID NO: 728912 - DNA, 20 bp, Artificial
  CRISPR gRNA sequence
gcacgtgccaatgtctgcat

SEQ ID NO: 728913 - DNA, 20 bp, Artificial
  CRISPR gRNA sequence
cattgggagagccacatcaa

SEQ ID NO: 728914 - DNA, 20 bp, Artificial
  CRISPR gRNA sequence
ggagagccacatcaaggtgg

SEQ ID NO: 728915 - DNA, 20 bp, Artificial
  CRISPR gRNA sequence
acgccggtaatcccagcact

SEQ ID NO: 728916 - DNA, 20 bp, Artificial
  CRISPR gRNA sequence
ttgcgaggccgaggcaggcg

SEQ ID NO: 728917 - DNA, 20 bp, Artificial
  CRISPR gRNA sequence
tgcgaggccgaggcaggcgg

SEQ ID NO: 728918 - DNA, 20 bp, Artificial
  CRISPR gRNA sequence
gcgaggccgaggcaggcgga

SEQ ID NO: 728919 - DNA, 20 bp, Artificial
  CRISPR gRNA sequence
cgaggccgaggcaggcggat

SEQ ID NO: 728920 - DNA, 20 bp, Artificial
  CRISPR gRNA sequence
gagaccagcctgaccatcat

SEQ ID NO: 728921 - DNA, 20 bp, Artificial
  CRISPR gRNA sequence
accatcatggtgaaaccctg

SEQ ID NO: 728922 - DNA, 20 bp, Artificial
  CRISPR gRNA sequence
tctctactaaaaatacaaaa

SEQ ID NO: 728923 - DNA, 20 bp, Artificial
  CRISPR gRNA sequence
tactaaaaatacaaaaatta

SEQ ID NO: 728924 - DNA, 20 bp, Artificial
  CRISPR gRNA sequence
ctaaaaatacaaaaattagc

SEQ ID NO: 728925 - DNA, 20 bp, Artificial
  CRISPR gRNA sequence
aaaatacaaaaattagccag

SEQ ID NO: 728926 - DNA, 20 bp, Artificial
  CRISPR gRNA sequence
gccaggcgtggtggcgcgtg

SEQ ID NO: 728927 - DNA, 20 bp, Artificial
  CRISPR gRNA sequence
taatcccagctactcaggag

SEQ ID NO: 728928 - DNA, 20 bp, Artificial
  CRISPR gRNA sequence
ctcaggaggctgaggcagga

SEQ ID NO: 728929 - DNA, 20 bp, Artificial
  CRISPR gRNA sequence
aggaggctgaggcaggaaaa

SEQ ID NO: 728930 - DNA, 20 bp, Artificial
  CRISPR gRNA sequence
aggcaggaaaactgcttgaa

SEQ ID NO: 728931 - DNA, 20 bp, Artificial
  CRISPR gRNA sequence
cttgaacccgggaggtggag

SEQ ID NO: 728932 - DNA, 20 bp, Artificial
  CRISPR gRNA sequence
gaacccgggaggtggaggtt

SEQ ID NO: 728933 - DNA, 20 bp, Artificial
  CRISPR gRNA sequence
aacccgggaggtggaggttg

SEQ ID NO: 728934 - DNA, 20 bp, Artificial
  CRISPR gRNA sequence
tggtgggccaagatcgcgtc

SEQ ID NO: 728935 - DNA, 20 bp, Artificial
  CRISPR gRNA sequence
cactccagcctgggcgacag

SEQ ID NO: 728936 - DNA, 20 bp, Artificial
  CRISPR gRNA sequence
cagcctgggcgacagagtga

SEQ ID NO: 728937 - DNA, 20 bp, Artificial
  CRISPR gRNA sequence
ggcgacagagtgagactctg

SEQ ID NO: 728938 - DNA, 20 bp, Artificial
  CRISPR gRNA sequence
tgtctcaaaaaaagaaaaga

SEQ ID NO: 728939 - DNA, 20 bp, Artificial
  CRISPR gRNA sequence
tctcaaaaaaagaaaagaaa

SEQ ID NO: 728940 - DNA, 20 bp, Artificial
  CRISPR gRNA sequence
aaaaaaagaaaagaaacaaa

SEQ ID NO: 728941 - DNA, 20 bp, Artificial
  CRISPR gRNA sequence
cttcctcctgcgatggccct

SEQ ID NO: 728942 - DNA, 20 bp, Artificial
  CRISPR gRNA sequence
cctcctgcgatggccctcta

SEQ ID NO: 728943 - DNA, 20 bp, Artificial
  CRISPR gRNA sequence
ctcctgcgatggccctctag

SEQ ID NO: 728944 - DNA, 20 bp, Artificial
  CRISPR gRNA sequence
ctgcgatggccctctagcgc

SEQ ID NO: 728945 - DNA, 20 bp, Artificial
  CRISPR gRNA sequence
cgatggccctctagcgccct

SEQ ID NO: 728946 - DNA, 20 bp, Artificial
  CRISPR gRNA sequence
tagcgccctctgctggcaag

SEQ ID NO: 728947 - DNA, 20 bp, Artificial
  CRISPR gRNA sequence
gcgccctctgctggcaaggc

SEQ ID NO: 728948 - DNA, 20 bp, Artificial
  CRISPR gRNA sequence
tgctggcaaggcttaactgc

SEQ ID NO: 728949 - DNA, 20 bp, Artificial
  CRISPR gRNA sequence
ctggcaaggcttaactgcat

SEQ ID NO: 728950 - DNA, 20 bp, Artificial
  CRISPR gRNA sequence
gcaaggcttaactgcatgct

SEQ ID NO: 728951 - DNA, 20 bp, Artificial
  CRISPR gRNA sequence
aactgcatgctccctacaga

SEQ ID NO: 728952 - DNA, 20 bp, Artificial
  CRISPR gRNA sequence
actgcatgctccctacagag

SEQ ID NO: 728953 - DNA, 20 bp, Artificial
  CRISPR gRNA sequence
catgctccctacagaggaga

SEQ ID NO: 728954 - DNA, 20 bp, Artificial
  CRISPR gRNA sequence
cctacagaggagaaaggcgg

SEQ ID NO: 728955 - DNA, 20 bp, Artificial
  CRISPR gRNA sequence
cagaggagaaaggcggagcc

SEQ ID NO: 728956 - DNA, 20 bp, Artificial
  CRISPR gRNA sequence
atggcagggcagggatggaa

SEQ ID NO: 728957 - DNA, 20 bp, Artificial
  CRISPR gRNA sequence
gagatgatgggctgatcaca

SEQ ID NO: 728958 - DNA, 20 bp, Artificial
  CRISPR gRNA sequence
atcacaagcacactttctaa

SEQ ID NO: 728959 - DNA, 20 bp, Artificial
  CRISPR gRNA sequence
tctaaaaagccttttcttgc

SEQ ID NO: 728960 - DNA, 20 bp, Artificial
  CRISPR gRNA sequence
ctaaaaagccttttcttgcc

SEQ ID NO: 728961 - DNA, 20 bp, Artificial
  CRISPR gRNA sequence
taaaaagccttttcttgccc

SEQ ID NO: 728962 - DNA, 20 bp, Artificial
  CRISPR gRNA sequence
aaaagccttttcttgccctc

SEQ ID NO: 728963 - DNA, 20 bp, Artificial
  CRISPR gRNA sequence
ttcttgccctctgatcccat

SEQ ID NO: 728964 - DNA, 20 bp, Artificial
  CRISPR gRNA sequence
tcttgccctctgatcccata

SEQ ID NO: 728965 - DNA, 20 bp, Artificial
  CRISPR gRNA sequence
cttgccctctgatcccatat

SEQ ID NO: 728966 - DNA, 20 bp, Artificial
  CRISPR gRNA sequence
ttgccctctgatcccatatt

SEQ ID NO: 728967 - DNA, 20 bp, Artificial
  CRISPR gRNA sequence
gccctctgatcccatattgt

SEQ ID NO: 728968 - DNA, 20 bp, Artificial
  CRISPR gRNA sequence
ccctctgatcccatattgtt

SEQ ID NO: 728969 - DNA, 20 bp, Artificial
  CRISPR gRNA sequence
tgatcccatattgttccttt

SEQ ID NO: 728970 - DNA, 20 bp, Artificial
  CRISPR gRNA sequence
atcccatattgttccttttc

SEQ ID NO: 728971 - DNA, 20 bp, Artificial
  CRISPR gRNA sequence
ttccttttcatagcattctg

SEQ ID NO: 728972 - DNA, 20 bp, Artificial
  CRISPR gRNA sequence
cttttcatagcattctgtgc

SEQ ID NO: 728973 - DNA, 20 bp, Artificial
  CRISPR gRNA sequence
ttcatagcattctgtgccca

SEQ ID NO: 728974 - DNA, 20 bp, Artificial
  CRISPR gRNA sequence
tcatagcattctgtgcccac

SEQ ID NO: 728975 - DNA, 20 bp, Artificial
  CRISPR gRNA sequence
catagcattctgtgcccacc

SEQ ID NO: 728976 - DNA, 20 bp, Artificial
  CRISPR gRNA sequence
atagcattctgtgcccacct

SEQ ID NO: 728977 - DNA, 20 bp, Artificial
  CRISPR gRNA sequence
tgtgcccaccttatggatgt

SEQ ID NO: 728978 - DNA, 20 bp, Artificial
  CRISPR gRNA sequence
tgcccaccttatggatgtaa

SEQ ID NO: 728979 - DNA, 20 bp, Artificial
  CRISPR gRNA sequence
atggatgtaacgacttcgtg

SEQ ID NO: 728980 - DNA, 20 bp, Artificial
  CRISPR gRNA sequence
tggatgtaacgacttcgtga

SEQ ID NO: 728981 - DNA, 20 bp, Artificial
  CRISPR gRNA sequence
cgtgaatttttctgcagaca

SEQ ID NO: 728982 - DNA, 20 bp, Artificial
  CRISPR gRNA sequence
gtgaatttttctgcagacac

SEQ ID NO: 728983 - DNA, 20 bp, Artificial
  CRISPR gRNA sequence
ttctgcagacacgaatttaa

SEQ ID NO: 728984 - DNA, 20 bp, Artificial
  CRISPR gRNA sequence
tctgcagacacgaatttaat

SEQ ID NO: 728985 - DNA, 20 bp, Artificial
  CRISPR gRNA sequence
ctgcagacacgaatttaatg

SEQ ID NO: 728986 - DNA, 20 bp, Artificial
  CRISPR gRNA sequence
tgcagacacgaatttaatgt

SEQ ID NO: 728987 - DNA, 20 bp, Artificial
  CRISPR gRNA sequence
cagacacgaatttaatgttg

SEQ ID NO: 728988 - DNA, 20 bp, Artificial
  CRISPR gRNA sequence
aatgttgctaagtactcttc

SEQ ID NO: 728989 - DNA, 20 bp, Artificial
  CRISPR gRNA sequence
atgttgctaagtactcttct

SEQ ID NO: 728990 - DNA, 20 bp, Artificial
  CRISPR gRNA sequence
ctaagtactcttctattcct

SEQ ID NO: 728991 - DNA, 20 bp, Artificial
  CRISPR gRNA sequence
agtactcttctattcctgga

SEQ ID NO: 728992 - DNA, 20 bp, Artificial
  CRISPR gRNA sequence
ttctattcctggatttatca

SEQ ID NO: 728993 - DNA, 20 bp, Artificial
  CRISPR gRNA sequence
ctattcctggatttatcaaa

SEQ ID NO: 728994 - DNA, 20 bp, Artificial
  CRISPR gRNA sequence
tattcctggatttatcaaag

SEQ ID NO: 728995 - DNA, 20 bp, Artificial
  CRISPR gRNA sequence
ttcctggatttatcaaagct

SEQ ID NO: 728996 - DNA, 20 bp, Artificial
  CRISPR gRNA sequence
ctggatttatcaaagcttca

SEQ ID NO: 728997 - DNA, 20 bp, Artificial
  CRISPR gRNA sequence
gatttatcaaagcttcatgt

SEQ ID NO: 728998 - DNA, 20 bp, Artificial
  CRISPR gRNA sequence
atcaaagcttcatgtgtggt

SEQ ID NO: 728999 - DNA, 20 bp, Artificial
  CRISPR gRNA sequence
tcaaagcttcatgtgtggta

SEQ ID NO: 729000 - DNA, 20 bp, Artificial
  CRISPR gRNA sequence
catgtgtggtaagaatttct

SEQ ID NO: 729001 - DNA, 20 bp, Artificial
  CRISPR gRNA sequence
atgtgtggtaagaatttctg

SEQ ID NO: 729002 - DNA, 20 bp, Artificial
  CRISPR gRNA sequence
ctggtttcgtatctttttat

SEQ ID NO: 729003 - DNA, 20 bp, Artificial
  CRISPR gRNA sequence
tggtttcgtatctttttatt

SEQ ID NO: 729004 - DNA, 20 bp, Artificial
  CRISPR gRNA sequence
gtttcgtatctttttattct

SEQ ID NO: 729005 - DNA, 20 bp, Artificial
  CRISPR gRNA sequence
cgtatctttttattctcctt

SEQ ID NO: 729006 - DNA, 20 bp, Artificial
  CRISPR gRNA sequence
gtatctttttattctccttt

SEQ ID NO: 729007 - DNA, 20 bp, Artificial
  CRISPR gRNA sequence
tttattctcctttgtagggc

SEQ ID NO: 729008 - DNA, 20 bp, Artificial
  CRISPR gRNA sequence
ttattctcctttgtagggct

SEQ ID NO: 729009 - DNA, 20 bp, Artificial
  CRISPR gRNA sequence
tattctcctttgtagggctg

SEQ ID NO: 729010 - DNA, 20 bp, Artificial
  CRISPR gRNA sequence
attctcctttgtagggctgg

SEQ ID NO: 729011 - DNA, 20 bp, Artificial
  CRISPR gRNA sequence
ttctcctttgtagggctggt

SEQ ID NO: 729012 - DNA, 20 bp, Artificial
  CRISPR gRNA sequence
tcctttgtagggctggtttt

SEQ ID NO: 729013 - DNA, 20 bp, Artificial
  CRISPR gRNA sequence
ctttgtagggctggtttttc

SEQ ID NO: 729014 - DNA, 20 bp, Artificial
  CRISPR gRNA sequence
tgtagggctggtttttctta

SEQ ID NO: 729015 - DNA, 20 bp, Artificial
  CRISPR gRNA sequence
gtagggctggtttttcttac

SEQ ID NO: 729016 - DNA, 20 bp, Artificial
  CRISPR gRNA sequence
tagggctggtttttcttaca

SEQ ID NO: 729017 - DNA, 20 bp, Artificial
  CRISPR gRNA sequence
gtttttcttacaaatctttg

SEQ ID NO: 729018 - DNA, 20 bp, Artificial
  CRISPR gRNA sequence
ttcttacaaatctttgctca

SEQ ID NO: 729019 - DNA, 20 bp, Artificial
  CRISPR gRNA sequence
tcttacaaatctttgctcat

SEQ ID NO: 729020 - DNA, 20 bp, Artificial
  CRISPR gRNA sequence
cttacaaatctttgctcatt

SEQ ID NO: 729021 - DNA, 20 bp, Artificial
  CRISPR gRNA sequence
ttacaaatctttgctcattc

SEQ ID NO: 729022 - DNA, 20 bp, Artificial
  CRISPR gRNA sequence
acaaatctttgctcattcat

SEQ ID NO: 729023 - DNA, 20 bp, Artificial
  CRISPR gRNA sequence
caaatctttgctcattcata

SEQ ID NO: 729024 - DNA, 20 bp, Artificial
  CRISPR gRNA sequence
tgctcattcatatttatttt

SEQ ID NO: 729025 - DNA, 20 bp, Artificial
  CRISPR gRNA sequence
gctcattcatatttatttta

SEQ ID NO: 729026 - DNA, 20 bp, Artificial
  CRISPR gRNA sequence
ctcattcatatttattttaa

SEQ ID NO: 729027 - DNA, 20 bp, Artificial
  CRISPR gRNA sequence
attcatatttattttaaaag

SEQ ID NO: 729028 - DNA, 20 bp, Artificial
  CRISPR gRNA sequence
atatttattttaaaagggtt

SEQ ID NO: 729029 - DNA, 20 bp, Artificial
  CRISPR gRNA sequence
attttaaaagggttatgctt

SEQ ID NO: 729030 - DNA, 20 bp, Artificial
  CRISPR gRNA sequence
ttttaaaagggttatgcttg

SEQ ID NO: 729031 - DNA, 20 bp, Artificial
  CRISPR gRNA sequence
taaaagggttatgcttggcc

SEQ ID NO: 729032 - DNA, 20 bp, Artificial
  CRISPR gRNA sequence
aaaagggttatgcttggccg

SEQ ID NO: 729033 - DNA, 20 bp, Artificial
  CRISPR gRNA sequence
aaagggttatgcttggccgg

SEQ ID NO: 729034 - DNA, 20 bp, Artificial
  CRISPR gRNA sequence
tgcttggccgggtgcggtgg

SEQ ID NO: 729035 - DNA, 20 bp, Artificial
  CRISPR gRNA sequence
ggccgggtgcggtggctcac

SEQ ID NO: 729036 - DNA, 20 bp, Artificial
  CRISPR gRNA sequence
gccgggtgcggtggctcacg

SEQ ID NO: 729037 - DNA, 20 bp, Artificial
  CRISPR gRNA sequence
acgcctgtaatcccagcact

SEQ ID NO: 729038 - DNA, 20 bp, Artificial
  CRISPR gRNA sequence
taatcccagcactttgggag

SEQ ID NO: 729039 - DNA, 20 bp, Artificial
  CRISPR gRNA sequence
tgggaggctgaggcaggcag

SEQ ID NO: 729040 - DNA, 20 bp, Artificial
  CRISPR gRNA sequence
gggaggctgaggcaggcaga

SEQ ID NO: 729041 - DNA, 20 bp, Artificial
  CRISPR gRNA sequence
ggaggctgaggcaggcagat

SEQ ID NO: 729042 - DNA, 20 bp, Artificial
  CRISPR gRNA sequence
aggcaggcagatcacctggg

SEQ ID NO: 729043 - DNA, 20 bp, Artificial
  CRISPR gRNA sequence
gggtcaggagttcgagacca

SEQ ID NO: 729044 - DNA, 20 bp, Artificial
  CRISPR gRNA sequence
gagaccagcctgaccaatgt

SEQ ID NO: 729045 - DNA, 20 bp, Artificial
  CRISPR gRNA sequence
accaatgtggtgaaaccccg

SEQ ID NO: 729046 - DNA, 20 bp, Artificial
  CRISPR gRNA sequence
tactaaaaatacaaaaatta

SEQ ID NO: 729047 - DNA, 20 bp, Artificial
  CRISPR gRNA sequence
ctaaaaatacaaaaattagc

SEQ ID NO: 729048 - DNA, 20 bp, Artificial
  CRISPR gRNA sequence
aaaatacaaaaattagccgg

SEQ ID NO: 729049 - DNA, 20 bp, Artificial
  CRISPR gRNA sequence
gccgggtgtggtggtgcacg

SEQ ID NO: 729050 - DNA, 20 bp, Artificial
  CRISPR gRNA sequence
taatcccagctacttgggag

SEQ ID NO: 729051 - DNA, 20 bp, Artificial
  CRISPR gRNA sequence
cttgggaggctgaggcacaa

SEQ ID NO: 729052 - DNA, 20 bp, Artificial
  CRISPR gRNA sequence
gggaggctgaggcacaagaa

SEQ ID NO: 729053 - DNA, 20 bp, Artificial
  CRISPR gRNA sequence
ggaggctgaggcacaagaat

SEQ ID NO: 729054 - DNA, 20 bp, Artificial
  CRISPR gRNA sequence
aggcacaagaatagctcaaa

SEQ ID NO: 729055 - DNA, 20 bp, Artificial
  CRISPR gRNA sequence
aaacccaggaggcagaggtt

SEQ ID NO: 729056 - DNA, 20 bp, Artificial
  CRISPR gRNA sequence
ccgtgagccgagaccatacc

SEQ ID NO: 729057 - DNA, 20 bp, Artificial
  CRISPR gRNA sequence
cactccagcctgggcaacag

SEQ ID NO: 729058 - DNA, 20 bp, Artificial
  CRISPR gRNA sequence
cagcctgggcaacagagcga

SEQ ID NO: 729059 - DNA, 20 bp, Artificial
  CRISPR gRNA sequence
ggcaacagagcgagactttg

SEQ ID NO: 729060 - DNA, 20 bp, Artificial
  CRISPR gRNA sequence
tgtctcaaaaagaaaagggt

SEQ ID NO: 729061 - DNA, 20 bp, Artificial
  CRISPR gRNA sequence
gtctcaaaaagaaaagggtg

SEQ ID NO: 729062 - DNA, 20 bp, Artificial
  CRISPR gRNA sequence
tctcaaaaagaaaagggtgg

SEQ ID NO: 729063 - DNA, 20 bp, Artificial
  CRISPR gRNA sequence
aaaaagaaaagggtgggggg

SEQ ID NO: 729064 - DNA, 20 bp, Artificial
  CRISPR gRNA sequence
tgctgcatccaccaatagat

SEQ ID NO: 729065 - DNA, 20 bp, Artificial
  CRISPR gRNA sequence
catccaccaatagataaatg

SEQ ID NO: 729066 - DNA, 20 bp, Artificial
  CRISPR gRNA sequence
tacacaatggaatactactc

SEQ ID NO: 729067 - DNA, 20 bp, Artificial
  CRISPR gRNA sequence
ctcagccatcataaggaaag

SEQ ID NO: 729068 - DNA, 20 bp, Artificial
  CRISPR gRNA sequence
agccatcataaggaaagaaa

SEQ ID NO: 729069 - DNA, 20 bp, Artificial
  CRISPR gRNA sequence
tcgcagcaacatggatggaa

SEQ ID NO: 729070 - DNA, 20 bp, Artificial
  CRISPR gRNA sequence
cgcagcaacatggatggaac

SEQ ID NO: 729071 - DNA, 20 bp, Artificial
  CRISPR gRNA sequence
gcagcaacatggatggaact

SEQ ID NO: 729072 - DNA, 20 bp, Artificial
  CRISPR gRNA sequence
aaggccatattcttaagtgc

SEQ ID NO: 729073 - DNA, 20 bp, Artificial
  CRISPR gRNA sequence
ttaagtgcagacattcagac

SEQ ID NO: 729074 - DNA, 20 bp, Artificial
  CRISPR gRNA sequence
aagtgcagacattcagacac

SEQ ID NO: 729075 - DNA, 20 bp, Artificial
  CRISPR gRNA sequence
agtgcagacattcagacaca

SEQ ID NO: 729076 - DNA, 20 bp, Artificial
  CRISPR gRNA sequence
agacacagaaagacaaatac

SEQ ID NO: 729077 - DNA, 20 bp, Artificial
  CRISPR gRNA sequence
cctgttctcacttctaagtg

SEQ ID NO: 729078 - DNA, 20 bp, Artificial
  CRISPR gRNA sequence
ttctcacttctaagtgggag

SEQ ID NO: 729079 - DNA, 20 bp, Artificial
  CRISPR gRNA sequence
tcacttctaagtgggagtga

SEQ ID NO: 729080 - DNA, 20 bp, Artificial
  CRISPR gRNA sequence
acttctaagtgggagtgaaa

SEQ ID NO: 729081 - DNA, 20 bp, Artificial
  CRISPR gRNA sequence
ctaagtgggagtgaaatact

SEQ ID NO: 729082 - DNA, 20 bp, Artificial
  CRISPR gRNA sequence
taagtgggagtgaaatactg

SEQ ID NO: 729083 - DNA, 20 bp, Artificial
  CRISPR gRNA sequence
agtgggagtgaaatactgtg

SEQ ID NO: 729084 - DNA, 20 bp, Artificial
  CRISPR gRNA sequence
tgtccacacggagctggaga

SEQ ID NO: 729085 - DNA, 20 bp, Artificial
  CRISPR gRNA sequence
gagagtggaataaaaggcaa

SEQ ID NO: 729086 - DNA, 20 bp, Artificial
  CRISPR gRNA sequence
agaagggtgagggggtggga

SEQ ID NO: 729087 - DNA, 20 bp, Artificial
  CRISPR gRNA sequence
gaagggtgagggggtgggag

SEQ ID NO: 729088 - DNA, 20 bp, Artificial
  CRISPR gRNA sequence
tttaaggggtacaatgtatg

SEQ ID NO: 729089 - DNA, 20 bp, Artificial
  CRISPR gRNA sequence
aaggggtacaatgtatgcta

SEQ ID NO: 729090 - DNA, 20 bp, Artificial
  CRISPR gRNA sequence
aggggtacaatgtatgctat

SEQ ID NO: 729091 - DNA, 20 bp, Artificial
  CRISPR gRNA sequence
tttgggtgagggatacccta

SEQ ID NO: 729092 - DNA, 20 bp, Artificial
  CRISPR gRNA sequence
gggtgagggataccctaaac

SEQ ID NO: 729093 - DNA, 20 bp, Artificial
  CRISPR gRNA sequence
ggtgagggataccctaaacg

SEQ ID NO: 729094 - DNA, 20 bp, Artificial
  CRISPR gRNA sequence
aacgtcctgagttcaccacc

SEQ ID NO: 729095 - DNA, 20 bp, Artificial
  CRISPR gRNA sequence
agttcaccacccaatctaag

SEQ ID NO: 729096 - DNA, 20 bp, Artificial
  CRISPR gRNA sequence
accacccaatctaagcatgt

SEQ ID NO: 729097 - DNA, 20 bp, Artificial
  CRISPR gRNA sequence
agcatgtaataaaattacac

SEQ ID NO: 729098 - DNA, 20 bp, Artificial
  CRISPR gRNA sequence
cacttgtaccccatacattt

SEQ ID NO: 729099 - DNA, 20 bp, Artificial
  CRISPR gRNA sequence
gtaccccatacatttatgca

SEQ ID NO: 729100 - DNA, 20 bp, Artificial
  CRISPR gRNA sequence
taccccatacatttatgcaa

SEQ ID NO: 729101 - DNA, 20 bp, Artificial
  CRISPR gRNA sequence
atgcaaacaaaataaaatcc

SEQ ID NO: 729102 - DNA, 20 bp, Artificial
  CRISPR gRNA sequence
tgcaaacaaaataaaatcct

SEQ ID NO: 729103 - DNA, 20 bp, Artificial
  CRISPR gRNA sequence
aggactctactgaatattcc

SEQ ID NO: 729104 - DNA, 20 bp, Artificial
  CRISPR gRNA sequence
tactgaatattccagtcact

SEQ ID NO: 729105 - DNA, 20 bp, Artificial
  CRISPR gRNA sequence
ctgaatattccagtcactga

SEQ ID NO: 729106 - DNA, 20 bp, Artificial
  CRISPR gRNA sequence
aatattccagtcactgagcg

SEQ ID NO: 729107 - DNA, 20 bp, Artificial
  CRISPR gRNA sequence
cagtcactgagcggggacag

SEQ ID NO: 729108 - DNA, 20 bp, Artificial
  CRISPR gRNA sequence
agcggggacagtttcttctg

SEQ ID NO: 729109 - DNA, 20 bp, Artificial
  CRISPR gRNA sequence
cttctgctgtgttagtatgt

SEQ ID NO: 729110 - DNA, 20 bp, Artificial
  CRISPR gRNA sequence
ttctgctgtgttagtatgtc

SEQ ID NO: 729111 - DNA, 20 bp, Artificial
  CRISPR gRNA sequence
ctgctgtgttagtatgtcct

SEQ ID NO: 729112 - DNA, 20 bp, Artificial
  CRISPR gRNA sequence
tgctgtgttagtatgtcctg

SEQ ID NO: 729113 - DNA, 20 bp, Artificial
  CRISPR gRNA sequence
ctgtgttagtatgtcctgtt

SEQ ID NO: 729114 - DNA, 20 bp, Artificial
  CRISPR gRNA sequence
tgttagtatgtcctgttcac

SEQ ID NO: 729115 - DNA, 20 bp, Artificial
  CRISPR gRNA sequence
gtatgtcctgttcacaatgg

SEQ ID NO: 729116 - DNA, 20 bp, Artificial
  CRISPR gRNA sequence
ttcacaatgggtctcttccc

SEQ ID NO: 729117 - DNA, 20 bp, Artificial
  CRISPR gRNA sequence
acaatgggtctcttccctga

SEQ ID NO: 729118 - DNA, 20 bp, Artificial
  CRISPR gRNA sequence
ttccctgagtaggaagttgg

SEQ ID NO: 729119 - DNA, 20 bp, Artificial
  CRISPR gRNA sequence
ccctgagtaggaagttggcc

SEQ ID NO: 729120 - DNA, 20 bp, Artificial
  CRISPR gRNA sequence
cctgagtaggaagttggcca

SEQ ID NO: 729121 - DNA, 20 bp, Artificial
  CRISPR gRNA sequence
agtaggaagttggccaggga

SEQ ID NO: 729122 - DNA, 20 bp, Artificial
  CRISPR gRNA sequence
gccagggaaccctgggccca

SEQ ID NO: 729123 - DNA, 20 bp, Artificial
  CRISPR gRNA sequence
ggcccatgggcggagagtgt

SEQ ID NO: 729124 - DNA, 20 bp, Artificial
  CRISPR gRNA sequence
gcagcctccatttcagggtg

SEQ ID NO: 729125 - DNA, 20 bp, Artificial
  CRISPR gRNA sequence
catttcagggtgatggggtg

SEQ ID NO: 729126 - DNA, 20 bp, Artificial
  CRISPR gRNA sequence
cagggtgatggggtgtggct

SEQ ID NO: 729127 - DNA, 20 bp, Artificial
  CRISPR gRNA sequence
agggtgatggggtgtggcta

SEQ ID NO: 729128 - DNA, 20 bp, Artificial
  CRISPR gRNA sequence
gcctgttgacaggtgcactt

SEQ ID NO: 729129 - DNA, 20 bp, Artificial
  CRISPR gRNA sequence
ttgacaggtgcacttccaaa

SEQ ID NO: 729130 - DNA, 20 bp, Artificial
  CRISPR gRNA sequence
acaggtgcacttccaaatac

SEQ ID NO: 729131 - DNA, 20 bp, Artificial
  CRISPR gRNA sequence
ccaaatacccaagtaaagag

SEQ ID NO: 729132 - DNA, 20 bp, Artificial
  CRISPR gRNA sequence
caaatacccaagtaaagagg

SEQ ID NO: 729133 - DNA, 20 bp, Artificial
  CRISPR gRNA sequence
tacaaacagagtgacagcac

SEQ ID NO: 729134 - DNA, 20 bp, Artificial
  CRISPR gRNA sequence
acaaacagagtgacagcacc

SEQ ID NO: 729135 - DNA, 20 bp, Artificial
  CRISPR gRNA sequence
caaacagagtgacagcaccc

SEQ ID NO: 729136 - DNA, 20 bp, Artificial
  CRISPR gRNA sequence
gtggcccgaactttccccgg

SEQ ID NO: 729137 - DNA, 20 bp, Artificial
  CRISPR gRNA sequence
tccccggatattccttcaat

SEQ ID NO: 729138 - DNA, 20 bp, Artificial
  CRISPR gRNA sequence
ccccggatattccttcaatg

SEQ ID NO: 729139 - DNA, 20 bp, Artificial
  CRISPR gRNA sequence
cccggatattccttcaatgt

SEQ ID NO: 729140 - DNA, 20 bp, Artificial
  CRISPR gRNA sequence
cttcaatgttctgactcaag

SEQ ID NO: 729141 - DNA, 20 bp, Artificial
  CRISPR gRNA sequence
caatgttctgactcaagaag

SEQ ID NO: 729142 - DNA, 20 bp, Artificial
  CRISPR gRNA sequence
aatgttctgactcaagaaga

SEQ ID NO: 729143 - DNA, 20 bp, Artificial
  CRISPR gRNA sequence
tgactcaagaagacaattgt

SEQ ID NO: 729144 - DNA, 20 bp, Artificial
  CRISPR gRNA sequence
actcaagaagacaattgttg

SEQ ID NO: 729145 - DNA, 20 bp, Artificial
  CRISPR gRNA sequence
aagaagacaattgttggcca

SEQ ID NO: 729146 - DNA, 20 bp, Artificial
  CRISPR gRNA sequence
ttggccaggcacggtggctc

SEQ ID NO: 729147 - DNA, 20 bp, Artificial
  CRISPR gRNA sequence
gccaggcacggtggctcaca

SEQ ID NO: 729148 - DNA, 20 bp, Artificial
  CRISPR gRNA sequence
acacctgtaatcccagcact

SEQ ID NO: 729149 - DNA, 20 bp, Artificial
  CRISPR gRNA sequence
taatcccagcactttgggag

SEQ ID NO: 729150 - DNA, 20 bp, Artificial
  CRISPR gRNA sequence
tgggaggtggaggcgggcag

SEQ ID NO: 729151 - DNA, 20 bp, Artificial
  CRISPR gRNA sequence
gggaggtggaggcgggcaga

SEQ ID NO: 729152 - DNA, 20 bp, Artificial
  CRISPR gRNA sequence
ggaggtggaggcgggcagat

SEQ ID NO: 729153 - DNA, 20 bp, Artificial
  CRISPR gRNA sequence
gaggtcaggagttccagacc

SEQ ID NO: 729154 - DNA, 20 bp, Artificial
  CRISPR gRNA sequence
aggtcaggagttccagacca

SEQ ID NO: 729155 - DNA, 20 bp, Artificial
  CRISPR gRNA sequence
cagaccagcctggccaacat

SEQ ID NO: 729156 - DNA, 20 bp, Artificial
  CRISPR gRNA sequence
gccaacatggcaaaaccccg

SEQ ID NO: 729157 - DNA, 20 bp, Artificial
  CRISPR gRNA sequence
tactaaaaatatgaaaatta

SEQ ID NO: 729158 - DNA, 20 bp, Artificial
  CRISPR gRNA sequence
ctaaaaatatgaaaattagc

SEQ ID NO: 729159 - DNA, 20 bp, Artificial
  CRISPR gRNA sequence
aaaatatgaaaattagctgg

SEQ ID NO: 729160 - DNA, 20 bp, Artificial
  CRISPR gRNA sequence
gctgggtgtggtggcgggca

SEQ ID NO: 729161 - DNA, 20 bp, Artificial
  CRISPR gRNA sequence
ggtgtggtggcgggcacctg

SEQ ID NO: 729162 - DNA, 20 bp, Artificial
  CRISPR gRNA sequence
taatcccagctactcgggag

SEQ ID NO: 729163 - DNA, 20 bp, Artificial
  CRISPR gRNA sequence
ctcgggaggctgaggcagga

SEQ ID NO: 729164 - DNA, 20 bp, Artificial
  CRISPR gRNA sequence
gggaggctgaggcaggagaa

SEQ ID NO: 729165 - DNA, 20 bp, Artificial
  CRISPR gRNA sequence
aggcaggagaattgcctgaa

SEQ ID NO: 729166 - DNA, 20 bp, Artificial
  CRISPR gRNA sequence
cctgaacccgggagacggag

SEQ ID NO: 729167 - DNA, 20 bp, Artificial
  CRISPR gRNA sequence
aacccgggagacggaggttg

SEQ ID NO: 729168 - DNA, 20 bp, Artificial
  CRISPR gRNA sequence
cagtgagctgagattacacc

SEQ ID NO: 729169 - DNA, 20 bp, Artificial
  CRISPR gRNA sequence
agattacaccactgcacatc

SEQ ID NO: 729170 - DNA, 20 bp, Artificial
  CRISPR gRNA sequence
caccactgcacatcggcctg

SEQ ID NO: 729171 - DNA, 20 bp, Artificial
  CRISPR gRNA sequence
cacatcggcctgggcaagac

SEQ ID NO: 729172 - DNA, 20 bp, Artificial
  CRISPR gRNA sequence
ggcaagacagcgagactcca

SEQ ID NO: 729173 - DNA, 20 bp, Artificial
  CRISPR gRNA sequence
catctctaaaaaaagaggaa

SEQ ID NO: 729174 - DNA, 20 bp, Artificial
  CRISPR gRNA sequence
taaaaaaagaggaaaaaaaa

SEQ ID NO: 729175 - DNA, 20 bp, Artificial
  CRISPR gRNA sequence
aaaaaagaggaaaaaaaaag

SEQ ID NO: 729176 - DNA, 20 bp, Artificial
  CRISPR gRNA sequence
gggattaaaaactcaggcat

SEQ ID NO: 729177 - DNA, 20 bp, Artificial
  CRISPR gRNA sequence
aaaactcaggcatcatctgt

SEQ ID NO: 729178 - DNA, 20 bp, Artificial
  CRISPR gRNA sequence
aggcatcatctgtgcaaact

SEQ ID NO: 729179 - DNA, 20 bp, Artificial
  CRISPR gRNA sequence
tgcaaactggtcagtggcca

SEQ ID NO: 729180 - DNA, 20 bp, Artificial
  CRISPR gRNA sequence
gtcagtggccatgccatgcc

SEQ ID NO: 729181 - DNA, 20 bp, Artificial
  CRISPR gRNA sequence
taatacattttgaagttgtg

SEQ ID NO: 729182 - DNA, 20 bp, Artificial
  CRISPR gRNA sequence
tgaagttgtgtttgaagatt

SEQ ID NO: 729183 - DNA, 20 bp, Artificial
  CRISPR gRNA sequence
gaagttgtgtttgaagattt

SEQ ID NO: 729184 - DNA, 20 bp, Artificial
  CRISPR gRNA sequence
aagttgtgtttgaagattta

SEQ ID NO: 729185 - DNA, 20 bp, Artificial
  CRISPR gRNA sequence
tgtttgaagatttagtagtc

SEQ ID NO: 729186 - DNA, 20 bp, Artificial
  CRISPR gRNA sequence
gaagatttagtagtcccagg

SEQ ID NO: 729187 - DNA, 20 bp, Artificial
  CRISPR gRNA sequence
aagatttagtagtcccaggc

SEQ ID NO: 729188 - DNA, 20 bp, Artificial
  CRISPR gRNA sequence
agtagtcccaggccactaca

SEQ ID NO: 729189 - DNA, 20 bp, Artificial
  CRISPR gRNA sequence
gtagtcccaggccactacac

SEQ ID NO: 729190 - DNA, 20 bp, Artificial
  CRISPR gRNA sequence
cacctcacacctctcaactt

SEQ ID NO: 729191 - DNA, 20 bp, Artificial
  CRISPR gRNA sequence
acacctctcaacttccctcc

SEQ ID NO: 729192 - DNA, 20 bp, Artificial
  CRISPR gRNA sequence
tcaacttccctcccgctctt

SEQ ID NO: 729193 - DNA, 20 bp, Artificial
  CRISPR gRNA sequence
aacttccctcccgctcttca

SEQ ID NO: 729194 - DNA, 20 bp, Artificial
  CRISPR gRNA sequence
ccctcccgctcttcatctgc

SEQ ID NO: 729195 - DNA, 20 bp, Artificial
  CRISPR gRNA sequence
cctcccgctcttcatctgcc

SEQ ID NO: 729196 - DNA, 20 bp, Artificial
  CRISPR gRNA sequence
ccgctcttcatctgcctgcc

SEQ ID NO: 729197 - DNA, 20 bp, Artificial
  CRISPR gRNA sequence
ttcatctgcctgcctcttcc

SEQ ID NO: 729198 - DNA, 20 bp, Artificial
  CRISPR gRNA sequence
catctgcctgcctcttccaa

SEQ ID NO: 729199 - DNA, 20 bp, Artificial
  CRISPR gRNA sequence
atctgcctgcctcttccaag

SEQ ID NO: 729200 - DNA, 20 bp, Artificial
  CRISPR gRNA sequence
cctgcctcttccaagcccag

SEQ ID NO: 729201 - DNA, 20 bp, Artificial
  CRISPR gRNA sequence
cctcttccaagcccagagcc

SEQ ID NO: 729202 - DNA, 20 bp, Artificial
  CRISPR gRNA sequence
ttccaagcccagagcctctc

SEQ ID NO: 729203 - DNA, 20 bp, Artificial
  CRISPR gRNA sequence
ccaagcccagagcctctctg

SEQ ID NO: 729204 - DNA, 20 bp, Artificial
  CRISPR gRNA sequence
caagcccagagcctctctgg

SEQ ID NO: 729205 - DNA, 20 bp, Artificial
  CRISPR gRNA sequence
tctgggggtcctagaagcaa

SEQ ID NO: 729206 - DNA, 20 bp, Artificial
  CRISPR gRNA sequence
tgggggtcctagaagcaagt

SEQ ID NO: 729207 - DNA, 20 bp, Artificial
  CRISPR gRNA sequence
ggggtcctagaagcaagtca

SEQ ID NO: 729208 - DNA, 20 bp, Artificial
  CRISPR gRNA sequence
gaagcaagtcacccctcact

SEQ ID NO: 729209 - DNA, 20 bp, Artificial
  CRISPR gRNA sequence
acttctctggcagccctcac

SEQ ID NO: 729210 - DNA, 20 bp, Artificial
  CRISPR gRNA sequence
ctctggcagccctcacagag

SEQ ID NO: 729211 - DNA, 20 bp, Artificial
  CRISPR gRNA sequence
tctggcagccctcacagagt

SEQ ID NO: 729212 - DNA, 20 bp, Artificial
  CRISPR gRNA sequence
tggcagccctcacagagtca

SEQ ID NO: 729213 - DNA, 20 bp, Artificial
  CRISPR gRNA sequence
gcagccctcacagagtcaca

SEQ ID NO: 729214 - DNA, 20 bp, Artificial
  CRISPR gRNA sequence
acagagtcacattgggtgac

SEQ ID NO: 729215 - DNA, 20 bp, Artificial
  CRISPR gRNA sequence
ggtgaccttccctccacttg

SEQ ID NO: 729216 - DNA, 20 bp, Artificial
  CRISPR gRNA sequence
ccctccacttggtttttttt

SEQ ID NO: 729217 - DNA, 20 bp, Artificial
  CRISPR gRNA sequence
cctccacttggttttttttc

SEQ ID NO: 729218 - DNA, 20 bp, Artificial
  CRISPR gRNA sequence
cacttggttttttttctttt

SEQ ID NO: 729219 - DNA, 20 bp, Artificial
  CRISPR gRNA sequence
ggttttttttcttttttagg

SEQ ID NO: 729220 - DNA, 20 bp, Artificial
  CRISPR gRNA sequence
gttttttttcttttttaggc

SEQ ID NO: 729221 - DNA, 20 bp, Artificial
  CRISPR gRNA sequence
tttttcttttttaggcagag

SEQ ID NO: 729222 - DNA, 20 bp, Artificial
  CRISPR gRNA sequence
ttttcttttttaggcagagt

SEQ ID NO: 729223 - DNA, 20 bp, Artificial
  CRISPR gRNA sequence
tttcttttttaggcagagtt

SEQ ID NO: 729224 - DNA, 20 bp, Artificial
  CRISPR gRNA sequence
ttcttttttaggcagagttt

SEQ ID NO: 729225 - DNA, 20 bp, Artificial
  CRISPR gRNA sequence
tcttttttaggcagagtttc

SEQ ID NO: 729226 - DNA, 20 bp, Artificial
  CRISPR gRNA sequence
cttttttaggcagagtttcg

SEQ ID NO: 729227 - DNA, 20 bp, Artificial
  CRISPR gRNA sequence
ttttttaggcagagtttcgc

SEQ ID NO: 729228 - DNA, 20 bp, Artificial
  CRISPR gRNA sequence
ttttaggcagagtttcgccc

SEQ ID NO: 729229 - DNA, 20 bp, Artificial
  CRISPR gRNA sequence
tttaggcagagtttcgccct

SEQ ID NO: 729230 - DNA, 20 bp, Artificial
  CRISPR gRNA sequence
ttaggcagagtttcgccctg

SEQ ID NO: 729231 - DNA, 20 bp, Artificial
  CRISPR gRNA sequence
taggcagagtttcgccctgt

SEQ ID NO: 729232 - DNA, 20 bp, Artificial
  CRISPR gRNA sequence
aggcagagtttcgccctgtt

SEQ ID NO: 729233 - DNA, 20 bp, Artificial
  CRISPR gRNA sequence
ggcagagtttcgccctgttg

SEQ ID NO: 729234 - DNA, 20 bp, Artificial
  CRISPR gRNA sequence
cgccctgttgcccaggctgg

SEQ ID NO: 729235 - DNA, 20 bp, Artificial
  CRISPR gRNA sequence
gccctgttgcccaggctgga

SEQ ID NO: 729236 - DNA, 20 bp, Artificial
  CRISPR gRNA sequence
ttgcccaggctggagttcag

SEQ ID NO: 729237 - DNA, 20 bp, Artificial
  CRISPR gRNA sequence
cccaggctggagttcagtgg

SEQ ID NO: 729238 - DNA, 20 bp, Artificial
  CRISPR gRNA sequence
gagttcagtggtgcaatctc

SEQ ID NO: 729239 - DNA, 20 bp, Artificial
  CRISPR gRNA sequence
agtggtgcaatctcggctca

SEQ ID NO: 729240 - DNA, 20 bp, Artificial
  CRISPR gRNA sequence
ggctcactgcaacctatgcc

SEQ ID NO: 729241 - DNA, 20 bp, Artificial
  CRISPR gRNA sequence
actgcaacctatgcctcccg

SEQ ID NO: 729242 - DNA, 20 bp, Artificial
  CRISPR gRNA sequence
caacctatgcctcccgggtt

SEQ ID NO: 729243 - DNA, 20 bp, Artificial
  CRISPR gRNA sequence
tgcctcccgggttcaagcga

SEQ ID NO: 729244 - DNA, 20 bp, Artificial
  CRISPR gRNA sequence
ccgggttcaagcgattctcc

SEQ ID NO: 729245 - DNA, 20 bp, Artificial
  CRISPR gRNA sequence
aagcgattctcctgcctcaa

SEQ ID NO: 729246 - DNA, 20 bp, Artificial
  CRISPR gRNA sequence
tcctgcctcaacctcctgag

SEQ ID NO: 729247 - DNA, 20 bp, Artificial
  CRISPR gRNA sequence
ctgcctcaacctcctgagta

SEQ ID NO: 729248 - DNA, 20 bp, Artificial
  CRISPR gRNA sequence
cctcaacctcctgagtagct

SEQ ID NO: 729249 - DNA, 20 bp, Artificial
  CRISPR gRNA sequence
aacctcctgagtagctggga

SEQ ID NO: 729250 - DNA, 20 bp, Artificial
  CRISPR gRNA sequence
ctgagtagctgggactacgg

SEQ ID NO: 729251 - DNA, 20 bp, Artificial
  CRISPR gRNA sequence
agtagctgggactacggtgc

SEQ ID NO: 729252 - DNA, 20 bp, Artificial
  CRISPR gRNA sequence
ggactacggtgcccaccacc

SEQ ID NO: 729253 - DNA, 20 bp, Artificial
  CRISPR gRNA sequence
cggtgcccaccaccacaccc

SEQ ID NO: 729254 - DNA, 20 bp, Artificial
  CRISPR gRNA sequence
atttgtgtatttttagtaga

SEQ ID NO: 729255 - DNA, 20 bp, Artificial
  CRISPR gRNA sequence
gtgtatttttagtagagacg

SEQ ID NO: 729256 - DNA, 20 bp, Artificial
  CRISPR gRNA sequence
tgtatttttagtagagacgg

SEQ ID NO: 729257 - DNA, 20 bp, Artificial
  CRISPR gRNA sequence
ttagtagagacggggttttg

SEQ ID NO: 729258 - DNA, 20 bp, Artificial
  CRISPR gRNA sequence
tagtagagacggggttttgc

SEQ ID NO: 729259 - DNA, 20 bp, Artificial
  CRISPR gRNA sequence
agtagagacggggttttgcc

SEQ ID NO: 729260 - DNA, 20 bp, Artificial
  CRISPR gRNA sequence
gtagagacggggttttgcca

SEQ ID NO: 729261 - DNA, 20 bp, Artificial
  CRISPR gRNA sequence
tgccatgttggtcaggctgg

SEQ ID NO: 729262 - DNA, 20 bp, Artificial
  CRISPR gRNA sequence
gccatgttggtcaggctggt

SEQ ID NO: 729263 - DNA, 20 bp, Artificial
  CRISPR gRNA sequence
ccatgttggtcaggctggtc

SEQ ID NO: 729264 - DNA, 20 bp, Artificial
  CRISPR gRNA sequence
gtcaggctggtcttgaactc

SEQ ID NO: 729265 - DNA, 20 bp, Artificial
  CRISPR gRNA sequence
gtcttgaactcctgacctca

SEQ ID NO: 729266 - DNA, 20 bp, Artificial
  CRISPR gRNA sequence
gaactcctgacctcaagtga

SEQ ID NO: 729267 - DNA, 20 bp, Artificial
  CRISPR gRNA sequence
aactcctgacctcaagtgat

SEQ ID NO: 729268 - DNA, 20 bp, Artificial
  CRISPR gRNA sequence
ctgacctcaagtgatccacc

SEQ ID NO: 729269 - DNA, 20 bp, Artificial
  CRISPR gRNA sequence
acctcaagtgatccacctgc

SEQ ID NO: 729270 - DNA, 20 bp, Artificial
  CRISPR gRNA sequence
aagtgatccacctgcctcag

SEQ ID NO: 729271 - DNA, 20 bp, Artificial
  CRISPR gRNA sequence
cctcagcctcccaaagtgct

SEQ ID NO: 729272 - DNA, 20 bp, Artificial
  CRISPR gRNA sequence
agcctcccaaagtgctggga

SEQ ID NO: 729273 - DNA, 20 bp, Artificial
  CRISPR gRNA sequence
ccaaagtgctgggatcacag

SEQ ID NO: 729274 - DNA, 20 bp, Artificial
  CRISPR gRNA sequence
ggatcacaggcgtgagccac

SEQ ID NO: 729275 - DNA, 20 bp, Artificial
  CRISPR gRNA sequence
gccattccccttggttttgt

SEQ ID NO: 729276 - DNA, 20 bp, Artificial
  CRISPR gRNA sequence
cccttggttttgtcaccact

SEQ ID NO: 729277 - DNA, 20 bp, Artificial
  CRISPR gRNA sequence
ggttttgtcaccactcttcc

SEQ ID NO: 729278 - DNA, 20 bp, Artificial
  CRISPR gRNA sequence
gttttgtcaccactcttcca

SEQ ID NO: 729279 - DNA, 20 bp, Artificial
  CRISPR gRNA sequence
tgtcaccactcttccatctg

SEQ ID NO: 729280 - DNA, 20 bp, Artificial
  CRISPR gRNA sequence
gtcaccactcttccatctgt

SEQ ID NO: 729281 - DNA, 20 bp, Artificial
  CRISPR gRNA sequence
tcaccactcttccatctgtt

SEQ ID NO: 729282 - DNA, 20 bp, Artificial
  CRISPR gRNA sequence
ttccatctgttttaaaccac

SEQ ID NO: 729283 - DNA, 20 bp, Artificial
  CRISPR gRNA sequence
ccatctgttttaaaccacct

SEQ ID NO: 729284 - DNA, 20 bp, Artificial
  CRISPR gRNA sequence
catctgttttaaaccacctg

SEQ ID NO: 729285 - DNA, 20 bp, Artificial
  CRISPR gRNA sequence
ttttaaaccacctggagatt

SEQ ID NO: 729286 - DNA, 20 bp, Artificial
  CRISPR gRNA sequence
taaaccacctggagatttgt

SEQ ID NO: 729287 - DNA, 20 bp, Artificial
  CRISPR gRNA sequence
aaaccacctggagatttgtt

SEQ ID NO: 729288 - DNA, 20 bp, Artificial
  CRISPR gRNA sequence
aaccacctggagatttgtta

SEQ ID NO: 729289 - DNA, 20 bp, Artificial
  CRISPR gRNA sequence
gagatttgttaaaatctctc

SEQ ID NO: 729290 - DNA, 20 bp, Artificial
  CRISPR gRNA sequence
gttaaaatctctcaaagccc

SEQ ID NO: 729291 - DNA, 20 bp, Artificial
  CRISPR gRNA sequence
ttaaaatctctcaaagccct

SEQ ID NO: 729292 - DNA, 20 bp, Artificial
  CRISPR gRNA sequence
aaatctctcaaagcccttaa

SEQ ID NO: 729293 - DNA, 20 bp, Artificial
  CRISPR gRNA sequence
tcaaagcccttaaaaaacaa

SEQ ID NO: 729294 - DNA, 20 bp, Artificial
  CRISPR gRNA sequence
aaagcccttaaaaaacaaaa

SEQ ID NO: 729295 - DNA, 20 bp, Artificial
  CRISPR gRNA sequence
aaaaaacaaaaaacaacaac

SEQ ID NO: 729296 - DNA, 20 bp, Artificial
  CRISPR gRNA sequence
aaaaacaaaaaacaacaaca

SEQ ID NO: 729297 - DNA, 20 bp, Artificial
  CRISPR gRNA sequence
tcagggttttagtttcctgc

SEQ ID NO: 729298 - DNA, 20 bp, Artificial
  CRISPR gRNA sequence
tagtttcctgcacactggta

SEQ ID NO: 729299 - DNA, 20 bp, Artificial
  CRISPR gRNA sequence
agtttcctgcacactggtaa

SEQ ID NO: 729300 - DNA, 20 bp, Artificial
  CRISPR gRNA sequence
gtttcctgcacactggtaaa

SEQ ID NO: 729301 - DNA, 20 bp, Artificial
  CRISPR gRNA sequence
cctgcacactggtaaagcca

SEQ ID NO: 729302 - DNA, 20 bp, Artificial
  CRISPR gRNA sequence
ctgcacactggtaaagccaa

SEQ ID NO: 729303 - DNA, 20 bp, Artificial
  CRISPR gRNA sequence
cacactggtaaagccaaccg

SEQ ID NO: 729304 - DNA, 20 bp, Artificial
  CRISPR gRNA sequence
gtaaagccaaccgtcctgtt

SEQ ID NO: 729305 - DNA, 20 bp, Artificial
  CRISPR gRNA sequence
ttagaaatctcttcagaaac

SEQ ID NO: 729306 - DNA, 20 bp, Artificial
  CRISPR gRNA sequence
gaaatctcttcagaaacttg

SEQ ID NO: 729307 - DNA, 20 bp, Artificial
  CRISPR gRNA sequence
ttcagaaacttgatattcat

SEQ ID NO: 729308 - DNA, 20 bp, Artificial
  CRISPR gRNA sequence
cagaaacttgatattcatct

SEQ ID NO: 729309 - DNA, 20 bp, Artificial
  CRISPR gRNA sequence
agaaacttgatattcatctc

SEQ ID NO: 729310 - DNA, 20 bp, Artificial
  CRISPR gRNA sequence
gatattcatctctctaagtc

SEQ ID NO: 729311 - DNA, 20 bp, Artificial
  CRISPR gRNA sequence
atattcatctctctaagtca

SEQ ID NO: 729312 - DNA, 20 bp, Artificial
  CRISPR gRNA sequence
atctctctaagtcaataaaa

SEQ ID NO: 729313 - DNA, 20 bp, Artificial
  CRISPR gRNA sequence
tctaagtcaataaaacagcc

SEQ ID NO: 729314 - DNA, 20 bp, Artificial
  CRISPR gRNA sequence
taagtcaataaaacagcctt

SEQ ID NO: 729315 - DNA, 20 bp, Artificial
  CRISPR gRNA sequence
agtcaataaaacagccttgc

SEQ ID NO: 729316 - DNA, 20 bp, Artificial
  CRISPR gRNA sequence
gcaaacaggtcaagatttta

SEQ ID NO: 729317 - DNA, 20 bp, Artificial
  CRISPR gRNA sequence
caaacaggtcaagattttac

SEQ ID NO: 729318 - DNA, 20 bp, Artificial
  CRISPR gRNA sequence
taccagcccggggctgggca

SEQ ID NO: 729319 - DNA, 20 bp, Artificial
  CRISPR gRNA sequence
accagcccggggctgggcat

SEQ ID NO: 729320 - DNA, 20 bp, Artificial
  CRISPR gRNA sequence
ccagcccggggctgggcatg

SEQ ID NO: 729321 - DNA, 20 bp, Artificial
  CRISPR gRNA sequence
ggcatggtggctcaggcctg

SEQ ID NO: 729322 - DNA, 20 bp, Artificial
  CRISPR gRNA sequence
aggcctgtaatcccagcact

SEQ ID NO: 729323 - DNA, 20 bp, Artificial
  CRISPR gRNA sequence
taatcccagcactttgagag

SEQ ID NO: 729324 - DNA, 20 bp, Artificial
  CRISPR gRNA sequence
tgagaggccaaggtgggtgg

SEQ ID NO: 729325 - DNA, 20 bp, Artificial
  CRISPR gRNA sequence
gagaggccaaggtgggtgga

SEQ ID NO: 729326 - DNA, 20 bp, Artificial
  CRISPR gRNA sequence
agaggccaaggtgggtggat

SEQ ID NO: 729327 - DNA, 20 bp, Artificial
  CRISPR gRNA sequence
aggtcgggagttcgagacca

SEQ ID NO: 729328 - DNA, 20 bp, Artificial
  CRISPR gRNA sequence
gagaccagcctgaccaacat

SEQ ID NO: 729329 - DNA, 20 bp, Artificial
  CRISPR gRNA sequence
accaacatggagaaaccgca

SEQ ID NO: 729330 - DNA, 20 bp, Artificial
  CRISPR gRNA sequence
ttctaaaaatacaacattag

SEQ ID NO: 729331 - DNA, 20 bp, Artificial
  CRISPR gRNA sequence
ctaaaaatacaacattagcc

SEQ ID NO: 729332 - DNA, 20 bp, Artificial
  CRISPR gRNA sequence
taaaaatacaacattagccg

SEQ ID NO: 729333 - DNA, 20 bp, Artificial
  CRISPR gRNA sequence
aaaatacaacattagccggc

SEQ ID NO: 729334 - DNA, 20 bp, Artificial
  CRISPR gRNA sequence
gccggctgtggtggcgaatg

SEQ ID NO: 729335 - DNA, 20 bp, Artificial
  CRISPR gRNA sequence
tggtggcgaatgcttgtaac

SEQ ID NO: 729336 - DNA, 20 bp, Artificial
  CRISPR gRNA sequence
gtaaccccagctactcagaa

SEQ ID NO: 729337 - DNA, 20 bp, Artificial
  CRISPR gRNA sequence
taaccccagctactcagaag

SEQ ID NO: 729338 - DNA, 20 bp, Artificial
  CRISPR gRNA sequence
ctcagaaggctgaggcagga

SEQ ID NO: 729339 - DNA, 20 bp, Artificial
  CRISPR gRNA sequence
agaaggctgaggcaggagaa

SEQ ID NO: 729340 - DNA, 20 bp, Artificial
  CRISPR gRNA sequence
aggcaggagaattgcttgaa

SEQ ID NO: 729341 - DNA, 20 bp, Artificial
  CRISPR gRNA sequence
cttgaacccaggaggtgcag

SEQ ID NO: 729342 - DNA, 20 bp, Artificial
  CRISPR gRNA sequence
gaacccaggaggtgcaggtt

SEQ ID NO: 729343 - DNA, 20 bp, Artificial
  CRISPR gRNA sequence
aacccaggaggtgcaggttg

SEQ ID NO: 729344 - DNA, 20 bp, Artificial
  CRISPR gRNA sequence
cggtgagccgagattgagcc

SEQ ID NO: 729345 - DNA, 20 bp, Artificial
  CRISPR gRNA sequence
agccattgtactccagcctg

SEQ ID NO: 729346 - DNA, 20 bp, Artificial
  CRISPR gRNA sequence
tactccagcctgggcaacat

SEQ ID NO: 729347 - DNA, 20 bp, Artificial
  CRISPR gRNA sequence
cagcctgggcaacatgagcg

SEQ ID NO: 729348 - DNA, 20 bp, Artificial
  CRISPR gRNA sequence
ggcaacatgagcgaaactcc

SEQ ID NO: 729349 - DNA, 20 bp, Artificial
  CRISPR gRNA sequence
catctcaaaaatataaagat

SEQ ID NO: 729350 - DNA, 20 bp, Artificial
  CRISPR gRNA sequence
aaaaatataaagattttacc

SEQ ID NO: 729351 - DNA, 20 bp, Artificial
  CRISPR gRNA sequence
taccagcccaataatttcag

SEQ ID NO: 729352 - DNA, 20 bp, Artificial
  CRISPR gRNA sequence
accagcccaataatttcagg

SEQ ID NO: 729353 - DNA, 20 bp, Artificial
  CRISPR gRNA sequence
ccagcccaataatttcagga

SEQ ID NO: 729354 - DNA, 20 bp, Artificial
  CRISPR gRNA sequence
caggaagaatttttttttaa

SEQ ID NO: 729355 - DNA, 20 bp, Artificial
  CRISPR gRNA sequence
aggaagaatttttttttaat

SEQ ID NO: 729356 - DNA, 20 bp, Artificial
  CRISPR gRNA sequence
ttttttaatcaacagaatct

SEQ ID NO: 729357 - DNA, 20 bp, Artificial
  CRISPR gRNA sequence
tttttaatcaacagaatctc

SEQ ID NO: 729358 - DNA, 20 bp, Artificial
  CRISPR gRNA sequence
ttttaatcaacagaatctct

SEQ ID NO: 729359 - DNA, 20 bp, Artificial
  CRISPR gRNA sequence
tttaatcaacagaatctctt

SEQ ID NO: 729360 - DNA, 20 bp, Artificial
  CRISPR gRNA sequence
ttaatcaacagaatctcttg

SEQ ID NO: 729361 - DNA, 20 bp, Artificial
  CRISPR gRNA sequence
taatcaacagaatctcttgc

SEQ ID NO: 729362 - DNA, 20 bp, Artificial
  CRISPR gRNA sequence
aatcaacagaatctcttgcc

SEQ ID NO: 729363 - DNA, 20 bp, Artificial
  CRISPR gRNA sequence
atcaacagaatctcttgcca

SEQ ID NO: 729364 - DNA, 20 bp, Artificial
  CRISPR gRNA sequence
ttgccaaaatgctaaaactg

SEQ ID NO: 729365 - DNA, 20 bp, Artificial
  CRISPR gRNA sequence
gccaaaatgctaaaactgga

SEQ ID NO: 729366 - DNA, 20 bp, Artificial
  CRISPR gRNA sequence
ccaaaatgctaaaactggat

SEQ ID NO: 729367 - DNA, 20 bp, Artificial
  CRISPR gRNA sequence
aaactggattttatcattcc

SEQ ID NO: 729368 - DNA, 20 bp, Artificial
  CRISPR gRNA sequence
gattttatcattccattcac

SEQ ID NO: 729369 - DNA, 20 bp, Artificial
  CRISPR gRNA sequence
tatcattccattcactgagt

SEQ ID NO: 729370 - DNA, 20 bp, Artificial
  CRISPR gRNA sequence
atcattccattcactgagtc

SEQ ID NO: 729371 - DNA, 20 bp, Artificial
  CRISPR gRNA sequence
tcattccattcactgagtct

SEQ ID NO: 729372 - DNA, 20 bp, Artificial
  CRISPR gRNA sequence
cattcactgagtctgactac

SEQ ID NO: 729373 - DNA, 20 bp, Artificial
  CRISPR gRNA sequence
actgagtctgactactcaaa

SEQ ID NO: 729374 - DNA, 20 bp, Artificial
  CRISPR gRNA sequence
agtctgactactcaaaggat

SEQ ID NO: 729375 - DNA, 20 bp, Artificial
  CRISPR gRNA sequence
actactcaaaggataaccag

SEQ ID NO: 729376 - DNA, 20 bp, Artificial
  CRISPR gRNA sequence
ctcaaaggataaccagaacc

SEQ ID NO: 729377 - DNA, 20 bp, Artificial
  CRISPR gRNA sequence
aaaggataaccagaacccaa

SEQ ID NO: 729378 - DNA, 20 bp, Artificial
  CRISPR gRNA sequence
acctaatgaacagccgaggg

SEQ ID NO: 729379 - DNA, 20 bp, Artificial
  CRISPR gRNA sequence
atgaacagccgagggtgtag

SEQ ID NO: 729380 - DNA, 20 bp, Artificial
  CRISPR gRNA sequence
gcctccacccctggctgttg

SEQ ID NO: 729381 - DNA, 20 bp, Artificial
  CRISPR gRNA sequence
cctccacccctggctgttgg

SEQ ID NO: 729382 - DNA, 20 bp, Artificial
  CRISPR gRNA sequence
cacccctggctgttggtggg

SEQ ID NO: 729383 - DNA, 20 bp, Artificial
  CRISPR gRNA sequence
gctgttggtggggagaggca

SEQ ID NO: 729384 - DNA, 20 bp, Artificial
  CRISPR gRNA sequence
ttggtggggagaggcacaac

SEQ ID NO: 729385 - DNA, 20 bp, Artificial
  CRISPR gRNA sequence
gtggggagaggcacaacagt

SEQ ID NO: 729386 - DNA, 20 bp, Artificial
  CRISPR gRNA sequence
caccctgtggtcgaggcctg

SEQ ID NO: 729387 - DNA, 20 bp, Artificial
  CRISPR gRNA sequence
tggtcgaggcctggggtggg

SEQ ID NO: 729388 - DNA, 20 bp, Artificial
  CRISPR gRNA sequence
gggtgggaactgcttaccct

SEQ ID NO: 729389 - DNA, 20 bp, Artificial
  CRISPR gRNA sequence
cttaccctggggcttggtga

SEQ ID NO: 729390 - DNA, 20 bp, Artificial
  CRISPR gRNA sequence
accctggggcttggtgaccg

SEQ ID NO: 729391 - DNA, 20 bp, Artificial
  CRISPR gRNA sequence
ccctggggcttggtgaccgt

SEQ ID NO: 729392 - DNA, 20 bp, Artificial
  CRISPR gRNA sequence
gggcttggtgaccgtctctg

SEQ ID NO: 729393 - DNA, 20 bp, Artificial
  CRISPR gRNA sequence
ggtgaccgtctctgctgcac

SEQ ID NO: 729394 - DNA, 20 bp, Artificial
  CRISPR gRNA sequence
gtgaccgtctctgctgcaca

SEQ ID NO: 729395 - DNA, 20 bp, Artificial
  CRISPR gRNA sequence
tgctgcacagattgggtagg

SEQ ID NO: 729396 - DNA, 20 bp, Artificial
  CRISPR gRNA sequence
ctgcacagattgggtagggg

SEQ ID NO: 729397 - DNA, 20 bp, Artificial
  CRISPR gRNA sequence
cacagattgggtaggggaca

SEQ ID NO: 729398 - DNA, 20 bp, Artificial
  CRISPR gRNA sequence
ggtaggggacacagcgggca

SEQ ID NO: 729399 - DNA, 20 bp, Artificial
  CRISPR gRNA sequence
gtggctgatgtggcacagat

SEQ ID NO: 729400 - DNA, 20 bp, Artificial
  CRISPR gRNA sequence
atgtggcacagatcatgcca

SEQ ID NO: 729401 - DNA, 20 bp, Artificial
  CRISPR gRNA sequence
gcaggtgcgggaggagttcc

SEQ ID NO: 729402 - DNA, 20 bp, Artificial
  CRISPR gRNA sequence
catgcacatggcgtcttctc

SEQ ID NO: 729403 - DNA, 20 bp, Artificial
  CRISPR gRNA sequence
ctccacaaggtcatctaagg

SEQ ID NO: 729404 - DNA, 20 bp, Artificial
  CRISPR gRNA sequence
tccacaaggtcatctaaggg

SEQ ID NO: 729405 - DNA, 20 bp, Artificial
  CRISPR gRNA sequence
cacaaggtcatctaagggac

SEQ ID NO: 729406 - DNA, 20 bp, Artificial
  CRISPR gRNA sequence
agggacacagatgaggatca

SEQ ID NO: 729407 - DNA, 20 bp, Artificial
  CRISPR gRNA sequence
tccaagggtcatccaacaag

SEQ ID NO: 729408 - DNA, 20 bp, Artificial
  CRISPR gRNA sequence
gtctgactatgccgttgagc

SEQ ID NO: 729409 - DNA, 20 bp, Artificial
  CRISPR gRNA sequence
actatgccgttgagcagctc

SEQ ID NO: 729410 - DNA, 20 bp, Artificial
  CRISPR gRNA sequence
tgccgttgagcagctctccc

SEQ ID NO: 729411 - DNA, 20 bp, Artificial
  CRISPR gRNA sequence
agcagctctcccagcatgct

SEQ ID NO: 729412 - DNA, 20 bp, Artificial
  CRISPR gRNA sequence
tcccagcatgctcaaaataa

SEQ ID NO: 729413 - DNA, 20 bp, Artificial
  CRISPR gRNA sequence
ccagcatgctcaaaataatt

SEQ ID NO: 729414 - DNA, 20 bp, Artificial
  CRISPR gRNA sequence
aaaataattctgcagggtga

SEQ ID NO: 729415 - DNA, 20 bp, Artificial
  CRISPR gRNA sequence
tgcagggtgaaagaaggcag

SEQ ID NO: 729416 - DNA, 20 bp, Artificial
  CRISPR gRNA sequence
cagggtgaaagaaggcaggc

SEQ ID NO: 729417 - DNA, 20 bp, Artificial
  CRISPR gRNA sequence
tgtatgtcgcatttacatgc

SEQ ID NO: 729418 - DNA, 20 bp, Artificial
  CRISPR gRNA sequence
tatgtcgcatttacatgcaa

SEQ ID NO: 729419 - DNA, 20 bp, Artificial
  CRISPR gRNA sequence
acatgcaagctattgcatgg

SEQ ID NO: 729420 - DNA, 20 bp, Artificial
  CRISPR gRNA sequence
catgcaagctattgcatggt

SEQ ID NO: 729421 - DNA, 20 bp, Artificial
  CRISPR gRNA sequence
ttgcatggtgaccataagca

SEQ ID NO: 729422 - DNA, 20 bp, Artificial
  CRISPR gRNA sequence
catggtgaccataagcaggg

SEQ ID NO: 729423 - DNA, 20 bp, Artificial
  CRISPR gRNA sequence
ttagagggggatggctggtt

SEQ ID NO: 729424 - DNA, 20 bp, Artificial
  CRISPR gRNA sequence
tagagggggatggctggttg

SEQ ID NO: 729425 - DNA, 20 bp, Artificial
  CRISPR gRNA sequence
agagggggatggctggttgc

SEQ ID NO: 729426 - DNA, 20 bp, Artificial
  CRISPR gRNA sequence
gagggggatggctggttgct

SEQ ID NO: 729427 - DNA, 20 bp, Artificial
  CRISPR gRNA sequence
gttgctcagctgcatgcatt

SEQ ID NO: 729428 - DNA, 20 bp, Artificial
  CRISPR gRNA sequence
ctcagctgcatgcatttgtt

SEQ ID NO: 729429 - DNA, 20 bp, Artificial
  CRISPR gRNA sequence
agctgcatgcatttgttaaa

SEQ ID NO: 729430 - DNA, 20 bp, Artificial
  CRISPR gRNA sequence
catgcatttgttaaaactta

SEQ ID NO: 729431 - DNA, 20 bp, Artificial
  CRISPR gRNA sequence
gttaaaacttatcagattgc

SEQ ID NO: 729432 - DNA, 20 bp, Artificial
  CRISPR gRNA sequence
ttaaaacttatcagattgca

SEQ ID NO: 729433 - DNA, 20 bp, Artificial
  CRISPR gRNA sequence
aaacttatcagattgcatcc

SEQ ID NO: 729434 - DNA, 20 bp, Artificial
  CRISPR gRNA sequence
atcagattgcatcctttaat

SEQ ID NO: 729435 - DNA, 20 bp, Artificial
  CRISPR gRNA sequence
tcagattgcatcctttaatc

SEQ ID NO: 729436 - DNA, 20 bp, Artificial
  CRISPR gRNA sequence
catcctttaatctatgcact

SEQ ID NO: 729437 - DNA, 20 bp, Artificial
  CRISPR gRNA sequence
taatctatgcactttaccat

SEQ ID NO: 729438 - DNA, 20 bp, Artificial
  CRISPR gRNA sequence
aatctatgcactttaccata

SEQ ID NO: 729439 - DNA, 20 bp, Artificial
  CRISPR gRNA sequence
atctatgcactttaccatat

SEQ ID NO: 729440 - DNA, 20 bp, Artificial
  CRISPR gRNA sequence
tgcactttaccatatgccca

SEQ ID NO: 729441 - DNA, 20 bp, Artificial
  CRISPR gRNA sequence
taccatatgcccactatctc

SEQ ID NO: 729442 - DNA, 20 bp, Artificial
  CRISPR gRNA sequence
accatatgcccactatctct

SEQ ID NO: 729443 - DNA, 20 bp, Artificial
  CRISPR gRNA sequence
ccatatgcccactatctctc

SEQ ID NO: 729444 - DNA, 20 bp, Artificial
  CRISPR gRNA sequence
tctctccctaaagctgttaa

SEQ ID NO: 729445 - DNA, 20 bp, Artificial
  CRISPR gRNA sequence
tccctaaagctgttaaaaga

SEQ ID NO: 729446 - DNA, 20 bp, Artificial
  CRISPR gRNA sequence
cctaaagctgttaaaagaaa

SEQ ID NO: 729447 - DNA, 20 bp, Artificial
  CRISPR gRNA sequence
aagctgttaaaagaaagtcc

SEQ ID NO: 729448 - DNA, 20 bp, Artificial
  CRISPR gRNA sequence
ttaaaagaaagtcctccagg

SEQ ID NO: 729449 - DNA, 20 bp, Artificial
  CRISPR gRNA sequence
aaagaaagtcctccagggga

SEQ ID NO: 729450 - DNA, 20 bp, Artificial
  CRISPR gRNA sequence
caggggacggggtgagcggg

SEQ ID NO: 729451 - DNA, 20 bp, Artificial
  CRISPR gRNA sequence
gccatgactccataaccgtt

SEQ ID NO: 729452 - DNA, 20 bp, Artificial
  CRISPR gRNA sequence
cataaccgtttaaagctggg

SEQ ID NO: 729453 - DNA, 20 bp, Artificial
  CRISPR gRNA sequence
aaagctgggtgatagtacgc

SEQ ID NO: 729454 - DNA, 20 bp, Artificial
  CRISPR gRNA sequence
aagctgggtgatagtacgca

SEQ ID NO: 729455 - DNA, 20 bp, Artificial
  CRISPR gRNA sequence
ggtgatagtacgcagccatc

SEQ ID NO: 729456 - DNA, 20 bp, Artificial
  CRISPR gRNA sequence
tgactcactctacatctgaa

SEQ ID NO: 729457 - DNA, 20 bp, Artificial
  CRISPR gRNA sequence
actcactctacatctgaata

SEQ ID NO: 729458 - DNA, 20 bp, Artificial
  CRISPR gRNA sequence
actctacatctgaatatgtt

SEQ ID NO: 729459 - DNA, 20 bp, Artificial
  CRISPR gRNA sequence
tacatctgaatatgtttgaa

SEQ ID NO: 729460 - DNA, 20 bp, Artificial
  CRISPR gRNA sequence
catctgaatatgtttgaaat

SEQ ID NO: 729461 - DNA, 20 bp, Artificial
  CRISPR gRNA sequence
aatatgtttgaaatttttaa

SEQ ID NO: 729462 - DNA, 20 bp, Artificial
  CRISPR gRNA sequence
gaaatttttaataataaaaa

SEQ ID NO: 729463 - DNA, 20 bp, Artificial
  CRISPR gRNA sequence
aaatttttaataataaaaag

SEQ ID NO: 729464 - DNA, 20 bp, Artificial
  CRISPR gRNA sequence
ttaataataaaaagattttt

SEQ ID NO: 729465 - DNA, 20 bp, Artificial
  CRISPR gRNA sequence
taataataaaaagatttttt

SEQ ID NO: 729466 - DNA, 20 bp, Artificial
  CRISPR gRNA sequence
aataataaaaagattttttg

SEQ ID NO: 729467 - DNA, 20 bp, Artificial
  CRISPR gRNA sequence
ataataaaaagattttttgg

SEQ ID NO: 729468 - DNA, 20 bp, Artificial
  CRISPR gRNA sequence
tttggccagacacggtggct

SEQ ID NO: 729469 - DNA, 20 bp, Artificial
  CRISPR gRNA sequence
ttggccagacacggtggctc

SEQ ID NO: 729470 - DNA, 20 bp, Artificial
  CRISPR gRNA sequence
tggccagacacggtggctca

SEQ ID NO: 729471 - DNA, 20 bp, Artificial
  CRISPR gRNA sequence
ggccagacacggtggctcac

SEQ ID NO: 729472 - DNA, 20 bp, Artificial
  CRISPR gRNA sequence
gccagacacggtggctcacg

SEQ ID NO: 729473 - DNA, 20 bp, Artificial
  CRISPR gRNA sequence
acgactgtaatcccggcact

SEQ ID NO: 729474 - DNA, 20 bp, Artificial
  CRISPR gRNA sequence
taatcccggcactttgggag

SEQ ID NO: 729475 - DNA, 20 bp, Artificial
  CRISPR gRNA sequence
tgggaggccgaggcaggcag

SEQ ID NO: 729476 - DNA, 20 bp, Artificial
  CRISPR gRNA sequence
gggaggccgaggcaggcaga

SEQ ID NO: 729477 - DNA, 20 bp, Artificial
  CRISPR gRNA sequence
ggaggccgaggcaggcagat

SEQ ID NO: 729478 - DNA, 20 bp, Artificial
  CRISPR gRNA sequence
aagtccagcctgaccaacat

SEQ ID NO: 729479 - DNA, 20 bp, Artificial
  CRISPR gRNA sequence
accaacatggtgaaaccccg

SEQ ID NO: 729480 - DNA, 20 bp, Artificial
  CRISPR gRNA sequence
tactaaaaatacaaaaatta

SEQ ID NO: 729481 - DNA, 20 bp, Artificial
  CRISPR gRNA sequence
ctaaaaatacaaaaattagc

SEQ ID NO: 729482 - DNA, 20 bp, Artificial
  CRISPR gRNA sequence
aaaatacaaaaattagccat

SEQ ID NO: 729483 - DNA, 20 bp, Artificial
  CRISPR gRNA sequence
gccatgcctggtggcacgtg

SEQ ID NO: 729484 - DNA, 20 bp, Artificial
  CRISPR gRNA sequence
gtggcacgtgcctgtaatcc

SEQ ID NO: 729485 - DNA, 20 bp, Artificial
  CRISPR gRNA sequence
taatcccagctactcaggag

SEQ ID NO: 729486 - DNA, 20 bp, Artificial
  CRISPR gRNA sequence
ctcaggaggctgaggcagga

SEQ ID NO: 729487 - DNA, 20 bp, Artificial
  CRISPR gRNA sequence
aggaggctgaggcaggagaa

SEQ ID NO: 729488 - DNA, 20 bp, Artificial
  CRISPR gRNA sequence
aggcaggagaatcacttgaa

SEQ ID NO: 729489 - DNA, 20 bp, Artificial
  CRISPR gRNA sequence
gaacctgggaggcagaggtt

SEQ ID NO: 729490 - DNA, 20 bp, Artificial
  CRISPR gRNA sequence
aacctgggaggcagaggttg

SEQ ID NO: 729491 - DNA, 20 bp, Artificial
  CRISPR gRNA sequence
ggaggcagaggttgcagtga

SEQ ID NO: 729492 - DNA, 20 bp, Artificial
  CRISPR gRNA sequence
cagtgagccaagatagtgcc

SEQ ID NO: 729493 - DNA, 20 bp, Artificial
  CRISPR gRNA sequence
cactccagcctgggcgacag

SEQ ID NO: 729494 - DNA, 20 bp, Artificial
  CRISPR gRNA sequence
cagcctgggcgacagaacaa

SEQ ID NO: 729495 - DNA, 20 bp, Artificial
  CRISPR gRNA sequence
ggcgacagaacaagactctg

SEQ ID NO: 729496 - DNA, 20 bp, Artificial
  CRISPR gRNA sequence
tgtctatttaaaaaaaaaaa

SEQ ID NO: 729497 - DNA, 20 bp, Artificial
  CRISPR gRNA sequence
tctatttaaaaaaaaaaaaa

SEQ ID NO: 729498 - DNA, 20 bp, Artificial
  CRISPR gRNA sequence
tttaaaaaaaaaaaaaaaaa

SEQ ID NO: 729499 - DNA, 20 bp, Artificial
  CRISPR gRNA sequence
aaaaaaaaaaaaaaaaaaaa

SEQ ID NO: 729500 - DNA, 20 bp, Artificial
  CRISPR gRNA sequence
aaaaaaaaaaaaaaaaaaaa

SEQ ID NO: 729501 - DNA, 20 bp, Artificial
  CRISPR gRNA sequence
tttttcctccaaaagcaaaa

SEQ ID NO: 729502 - DNA, 20 bp, Artificial
  CRISPR gRNA sequence
ttttcctccaaaagcaaaaa

SEQ ID NO: 729503 - DNA, 20 bp, Artificial
  CRISPR gRNA sequence
tttcctccaaaagcaaaaaa

SEQ ID NO: 729504 - DNA, 20 bp, Artificial
  CRISPR gRNA sequence
ttcctccaaaagcaaaaaaa

SEQ ID NO: 729505 - DNA, 20 bp, Artificial
  CRISPR gRNA sequence
tcctccaaaagcaaaaaaaa

SEQ ID NO: 729506 - DNA, 20 bp, Artificial
  CRISPR gRNA sequence
cctccaaaagcaaaaaaaaa

SEQ ID NO: 729507 - DNA, 20 bp, Artificial
  CRISPR gRNA sequence
ctccaaaagcaaaaaaaaac

SEQ ID NO: 729508 - DNA, 20 bp, Artificial
  CRISPR gRNA sequence
caaaagcaaaaaaaaaccat

SEQ ID NO: 729509 - DNA, 20 bp, Artificial
  CRISPR gRNA sequence
gaggtattatttttaataag

SEQ ID NO: 729510 - DNA, 20 bp, Artificial
  CRISPR gRNA sequence
tttttaataagtgtaataat

SEQ ID NO: 729511 - DNA, 20 bp, Artificial
  CRISPR gRNA sequence
ttaataagtgtaataatgca

SEQ ID NO: 729512 - DNA, 20 bp, Artificial
  CRISPR gRNA sequence
taataagtgtaataatgcat

SEQ ID NO: 729513 - DNA, 20 bp, Artificial
  CRISPR gRNA sequence
aataagtgtaataatgcatt

SEQ ID NO: 729514 - DNA, 20 bp, Artificial
  CRISPR gRNA sequence
ataagtgtaataatgcattt

SEQ ID NO: 729515 - DNA, 20 bp, Artificial
  CRISPR gRNA sequence
gtacgtattcgggaatattt

SEQ ID NO: 729516 - DNA, 20 bp, Artificial
  CRISPR gRNA sequence
tacgtattcgggaatatttt

SEQ ID NO: 729517 - DNA, 20 bp, Artificial
  CRISPR gRNA sequence
gggaatattttgcaacgctc

SEQ ID NO: 729518 - DNA, 20 bp, Artificial
  CRISPR gRNA sequence
tgcaacgctccacttagagg

SEQ ID NO: 729519 - DNA, 20 bp, Artificial
  CRISPR gRNA sequence
gcaacgctccacttagaggt

SEQ ID NO: 729520 - DNA, 20 bp, Artificial
  CRISPR gRNA sequence
caacgctccacttagaggta

SEQ ID NO: 729521 - DNA, 20 bp, Artificial
  CRISPR gRNA sequence
cacttagaggtaaatacaga

SEQ ID NO: 729522 - DNA, 20 bp, Artificial
  CRISPR gRNA sequence
agaggtaaatacagaacgac

SEQ ID NO: 729523 - DNA, 20 bp, Artificial
  CRISPR gRNA sequence
gaggtaaatacagaacgact

SEQ ID NO: 729524 - DNA, 20 bp, Artificial
  CRISPR gRNA sequence
catcagtagattaggcaaat

SEQ ID NO: 729525 - DNA, 20 bp, Artificial
  CRISPR gRNA sequence
ggcaaatgggacctctccgc

SEQ ID NO: 729526 - DNA, 20 bp, Artificial
  CRISPR gRNA sequence
tccgcgagggtagatctcaa

SEQ ID NO: 729527 - DNA, 20 bp, Artificial
  CRISPR gRNA sequence
cgcgagggtagatctcaatc

SEQ ID NO: 729528 - DNA, 20 bp, Artificial
  CRISPR gRNA sequence
aatcagcaggatacttagag

SEQ ID NO: 729529 - DNA, 20 bp, Artificial
  CRISPR gRNA sequence
agagacccagcatgataatg

SEQ ID NO: 729530 - DNA, 20 bp, Artificial
  CRISPR gRNA sequence
gagacccagcatgataatga

SEQ ID NO: 729531 - DNA, 20 bp, Artificial
  CRISPR gRNA sequence
gacagtctcttcttacaaca

SEQ ID NO: 729532 - DNA, 20 bp, Artificial
  CRISPR gRNA sequence
ttcttacaacatccagagca

SEQ ID NO: 729533 - DNA, 20 bp, Artificial
  CRISPR gRNA sequence
cttacaacatccagagcaag

SEQ ID NO: 729534 - DNA, 20 bp, Artificial
  CRISPR gRNA sequence
ttacaacatccagagcaagg

SEQ ID NO: 729535 - DNA, 20 bp, Artificial
  CRISPR gRNA sequence
acaacatccagagcaaggga

SEQ ID NO: 729536 - DNA, 20 bp, Artificial
  CRISPR gRNA sequence
caacatccagagcaagggaa

SEQ ID NO: 729537 - DNA, 20 bp, Artificial
  CRISPR gRNA sequence
ggcaggatttggggaatttg

SEQ ID NO: 729538 - DNA, 20 bp, Artificial
  CRISPR gRNA sequence
ggggaatttgtgcaaagggt

SEQ ID NO: 729539 - DNA, 20 bp, Artificial
  CRISPR gRNA sequence
gggaatttgtgcaaagggtg

SEQ ID NO: 729540 - DNA, 20 bp, Artificial
  CRISPR gRNA sequence
gtgcaaagggtgtgtgtgag

SEQ ID NO: 729541 - DNA, 20 bp, Artificial
  CRISPR gRNA sequence
tgcaaagggtgtgtgtgagc

SEQ ID NO: 729542 - DNA, 20 bp, Artificial
  CRISPR gRNA sequence
agcaatgaatgaaaccattt

SEQ ID NO: 729543 - DNA, 20 bp, Artificial
  CRISPR gRNA sequence
gggacaatggcagctattat

SEQ ID NO: 729544 - DNA, 20 bp, Artificial
  CRISPR gRNA sequence
ggacaatggcagctattatc

SEQ ID NO: 729545 - DNA, 20 bp, Artificial
  CRISPR gRNA sequence
ttatcattattattatagct

SEQ ID NO: 729546 - DNA, 20 bp, Artificial
  CRISPR gRNA sequence
tcattattattatagctctt

SEQ ID NO: 729547 - DNA, 20 bp, Artificial
  CRISPR gRNA sequence
ttattatagctcttaagata

SEQ ID NO: 729548 - DNA, 20 bp, Artificial
  CRISPR gRNA sequence
ttatagctcttaagataact

SEQ ID NO: 729549 - DNA, 20 bp, Artificial
  CRISPR gRNA sequence
tagctcttaagataactgag

SEQ ID NO: 729550 - DNA, 20 bp, Artificial
  CRISPR gRNA sequence
ttaagataactgagtatgtg

SEQ ID NO: 729551 - DNA, 20 bp, Artificial
  CRISPR gRNA sequence
aagataactgagtatgtgtg

SEQ ID NO: 729552 - DNA, 20 bp, Artificial
  CRISPR gRNA sequence
agataactgagtatgtgtga

SEQ ID NO: 729553 - DNA, 20 bp, Artificial
  CRISPR gRNA sequence
agtatgtgtgagacagtagt

SEQ ID NO: 729554 - DNA, 20 bp, Artificial
  CRISPR gRNA sequence
agcactctacccagattaac

SEQ ID NO: 729555 - DNA, 20 bp, Artificial
  CRISPR gRNA sequence
tacccagattaacctacaat

SEQ ID NO: 729556 - DNA, 20 bp, Artificial
  CRISPR gRNA sequence
cccagattaacctacaatca

SEQ ID NO: 729557 - DNA, 20 bp, Artificial
  CRISPR gRNA sequence
acctacaatcatgtattcaa

SEQ ID NO: 729558 - DNA, 20 bp, Artificial
  CRISPR gRNA sequence
caatcatgtattcaattctc

SEQ ID NO: 729559 - DNA, 20 bp, Artificial
  CRISPR gRNA sequence
aattctcacatggttctctg

SEQ ID NO: 729560 - DNA, 20 bp, Artificial
  CRISPR gRNA sequence
tcacatggttctctgagata

SEQ ID NO: 729561 - DNA, 20 bp, Artificial
  CRISPR gRNA sequence
acatggttctctgagataga

SEQ ID NO: 729562 - DNA, 20 bp, Artificial
  CRISPR gRNA sequence
tctgagatagataatactat

SEQ ID NO: 729563 - DNA, 20 bp, Artificial
  CRISPR gRNA sequence
tgagatagataatactatgc

SEQ ID NO: 729564 - DNA, 20 bp, Artificial
  CRISPR gRNA sequence
agatagataatactatgccc

SEQ ID NO: 729565 - DNA, 20 bp, Artificial
  CRISPR gRNA sequence
tgcccattttgcagcagagg

SEQ ID NO: 729566 - DNA, 20 bp, Artificial
  CRISPR gRNA sequence
tgcagcagaggaaactgagg

SEQ ID NO: 729567 - DNA, 20 bp, Artificial
  CRISPR gRNA sequence
gcagcagaggaaactgaggc

SEQ ID NO: 729568 - DNA, 20 bp, Artificial
  CRISPR gRNA sequence
cagcagaggaaactgaggca

SEQ ID NO: 729569 - DNA, 20 bp, Artificial
  CRISPR gRNA sequence
aggcacagagaggttaggaa

SEQ ID NO: 729570 - DNA, 20 bp, Artificial
  CRISPR gRNA sequence
ggaaacctgcttgaggttat

SEQ ID NO: 729571 - DNA, 20 bp, Artificial
  CRISPR gRNA sequence
cttgaggttataggctatca

SEQ ID NO: 729572 - DNA, 20 bp, Artificial
  CRISPR gRNA sequence
gaggttataggctatcaagt

SEQ ID NO: 729573 - DNA, 20 bp, Artificial
  CRISPR gRNA sequence
aggttataggctatcaagtg

SEQ ID NO: 729574 - DNA, 20 bp, Artificial
  CRISPR gRNA sequence
taggctatcaagtgggagag

SEQ ID NO: 729575 - DNA, 20 bp, Artificial
  CRISPR gRNA sequence
tcaagtgggagaggcgggat

SEQ ID NO: 729576 - DNA, 20 bp, Artificial
  CRISPR gRNA sequence
aacccggcactcgggttcta

SEQ ID NO: 729577 - DNA, 20 bp, Artificial
  CRISPR gRNA sequence
gggttctagagctcatgcct

SEQ ID NO: 729578 - DNA, 20 bp, Artificial
  CRISPR gRNA sequence
tagagctcatgcctttagct

SEQ ID NO: 729579 - DNA, 20 bp, Artificial
  CRISPR gRNA sequence
gagctcatgcctttagctac

SEQ ID NO: 729580 - DNA, 20 bp, Artificial
  CRISPR gRNA sequence
atgcctttagctactaatac

SEQ ID NO: 729581 - DNA, 20 bp, Artificial
  CRISPR gRNA sequence
tagctactaatacaccactc

SEQ ID NO: 729582 - DNA, 20 bp, Artificial
  CRISPR gRNA sequence
agctactaatacaccactcc

SEQ ID NO: 729583 - DNA, 20 bp, Artificial
  CRISPR gRNA sequence
gctactaatacaccactcca

SEQ ID NO: 729584 - DNA, 20 bp, Artificial
  CRISPR gRNA sequence
ctaatacaccactccactgc

SEQ ID NO: 729585 - DNA, 20 bp, Artificial
  CRISPR gRNA sequence
atacaccactccactgcctc

SEQ ID NO: 729586 - DNA, 20 bp, Artificial
  CRISPR gRNA sequence
cactgcctcgtggggtttca

SEQ ID NO: 729587 - DNA, 20 bp, Artificial
  CRISPR gRNA sequence
cctcgtggggtttcagttag

SEQ ID NO: 729588 - DNA, 20 bp, Artificial
  CRISPR gRNA sequence
gtggggtttcagttaggaga

SEQ ID NO: 729589 - DNA, 20 bp, Artificial
  CRISPR gRNA sequence
cagttaggagagctgaagga

SEQ ID NO: 729590 - DNA, 20 bp, Artificial
  CRISPR gRNA sequence
agttaggagagctgaaggaa

SEQ ID NO: 729591 - DNA, 20 bp, Artificial
  CRISPR gRNA sequence
ggagagctgaaggaattact

SEQ ID NO: 729592 - DNA, 20 bp, Artificial
  CRISPR gRNA sequence
aaggaattactgggcccaga

SEQ ID NO: 729593 - DNA, 20 bp, Artificial
  CRISPR gRNA sequence
ctgggcccagagccaacacc

SEQ ID NO: 729594 - DNA, 20 bp, Artificial
  CRISPR gRNA sequence
ggcccagagccaacacctct

SEQ ID NO: 729595 - DNA, 20 bp, Artificial
  CRISPR gRNA sequence
tttctccatatgtccacatg

SEQ ID NO: 729596 - DNA, 20 bp, Artificial
  CRISPR gRNA sequence
tctccatatgtccacatggt

SEQ ID NO: 729597 - DNA, 20 bp, Artificial
  CRISPR gRNA sequence
ctccatatgtccacatggtg

SEQ ID NO: 729598 - DNA, 20 bp, Artificial
  CRISPR gRNA sequence
tccatatgtccacatggtgg

SEQ ID NO: 729599 - DNA, 20 bp, Artificial
  CRISPR gRNA sequence
catatgtccacatggtggtt

SEQ ID NO: 729600 - DNA, 20 bp, Artificial
  CRISPR gRNA sequence
tggcagactgtatttcccca

SEQ ID NO: 729601 - DNA, 20 bp, Artificial
  CRISPR gRNA sequence
tatttccccaaaacatggct

SEQ ID NO: 729602 - DNA, 20 bp, Artificial
  CRISPR gRNA sequence
ccccaaaacatggctgcagt

SEQ ID NO: 729603 - DNA, 20 bp, Artificial
  CRISPR gRNA sequence
cccaaaacatggctgcagtg

SEQ ID NO: 729604 - DNA, 20 bp, Artificial
  CRISPR gRNA sequence
cagtgatgttctggcccttc

SEQ ID NO: 729605 - DNA, 20 bp, Artificial
  CRISPR gRNA sequence
tggcccttccagagcctttg

SEQ ID NO: 729606 - DNA, 20 bp, Artificial
  CRISPR gRNA sequence
gcccttccagagcctttgcc

SEQ ID NO: 729607 - DNA, 20 bp, Artificial
  CRISPR gRNA sequence
ccagagcctttgccacctac

SEQ ID NO: 729608 - DNA, 20 bp, Artificial
  CRISPR gRNA sequence
cagagcctttgccacctacc

SEQ ID NO: 729609 - DNA, 20 bp, Artificial
  CRISPR gRNA sequence
tgccacctacctgtcaagaa

SEQ ID NO: 729610 - DNA, 20 bp, Artificial
  CRISPR gRNA sequence
gccacctacctgtcaagaag

SEQ ID NO: 729611 - DNA, 20 bp, Artificial
  CRISPR gRNA sequence
ccacctacctgtcaagaagt

SEQ ID NO: 729612 - DNA, 20 bp, Artificial
  CRISPR gRNA sequence
cctgtcaagaagtacaactg

SEQ ID NO: 729613 - DNA, 20 bp, Artificial
  CRISPR gRNA sequence
tcaagaagtacaactgtttt

SEQ ID NO: 729614 - DNA, 20 bp, Artificial
  CRISPR gRNA sequence
ttttccttcccttggtctca

SEQ ID NO: 729615 - DNA, 20 bp, Artificial
  CRISPR gRNA sequence
tccttcccttggtctcaagt

SEQ ID NO: 729616 - DNA, 20 bp, Artificial
  CRISPR gRNA sequence
ccttcccttggtctcaagtg

SEQ ID NO: 729617 - DNA, 20 bp, Artificial
  CRISPR gRNA sequence
cttcccttggtctcaagtga

SEQ ID NO: 729618 - DNA, 20 bp, Artificial
  CRISPR gRNA sequence
cccttggtctcaagtgacat

SEQ ID NO: 729619 - DNA, 20 bp, Artificial
  CRISPR gRNA sequence
ccttggtctcaagtgacatt

SEQ ID NO: 729620 - DNA, 20 bp, Artificial
  CRISPR gRNA sequence
ggtctcaagtgacatttgtg

SEQ ID NO: 729621 - DNA, 20 bp, Artificial
  CRISPR gRNA sequence
gtctcaagtgacatttgtgg

SEQ ID NO: 729622 - DNA, 20 bp, Artificial
  CRISPR gRNA sequence
aagtgacatttgtggttgcc

SEQ ID NO: 729623 - DNA, 20 bp, Artificial
  CRISPR gRNA sequence
gtggttgcctcaacaaacag

SEQ ID NO: 729624 - DNA, 20 bp, Artificial
  CRISPR gRNA sequence
tggttgcctcaacaaacaga

SEQ ID NO: 729625 - DNA, 20 bp, Artificial
  CRISPR gRNA sequence
cctcaacaaacagaaagtgg

SEQ ID NO: 729626 - DNA, 20 bp, Artificial
  CRISPR gRNA sequence
aacaaacagaaagtggtaga

SEQ ID NO: 729627 - DNA, 20 bp, Artificial
  CRISPR gRNA sequence
tgtgtgacttccaaggccag

SEQ ID NO: 729628 - DNA, 20 bp, Artificial
  CRISPR gRNA sequence
tgtgacttccaaggccaggt

SEQ ID NO: 729629 - DNA, 20 bp, Artificial
  CRISPR gRNA sequence
ccaaggccaggtcataaaag

SEQ ID NO: 729630 - DNA, 20 bp, Artificial
  CRISPR gRNA sequence
caaggccaggtcataaaagg

SEQ ID NO: 729631 - DNA, 20 bp, Artificial
  CRISPR gRNA sequence
ctgcctctgtctgtctctct

SEQ ID NO: 729632 - DNA, 20 bp, Artificial
  CRISPR gRNA sequence
cctctgtctgtctctctctc

SEQ ID NO: 729633 - DNA, 20 bp, Artificial
  CRISPR gRNA sequence
tgtctgtctctctctctctc

SEQ ID NO: 729634 - DNA, 20 bp, Artificial
  CRISPR gRNA sequence
tctgtctctctctctctctt

SEQ ID NO: 729635 - DNA, 20 bp, Artificial
  CRISPR gRNA sequence
tctctctctctctctttctg

SEQ ID NO: 729636 - DNA, 20 bp, Artificial
  CRISPR gRNA sequence
tctctctctctttctgtctc

SEQ ID NO: 729637 - DNA, 20 bp, Artificial
  CRISPR gRNA sequence
tctctctctttctgtctctc

SEQ ID NO: 729638 - DNA, 20 bp, Artificial
  CRISPR gRNA sequence
tctctctttctgtctctctc

SEQ ID NO: 729639 - DNA, 20 bp, Artificial
  CRISPR gRNA sequence
tctctttctgtctctctctc

SEQ ID NO: 729640 - DNA, 20 bp, Artificial
  CRISPR gRNA sequence
tctttctgtctctctctctc

SEQ ID NO: 729641 - DNA, 20 bp, Artificial
  CRISPR gRNA sequence
tttctgtctctctctctctc

SEQ ID NO: 729642 - DNA, 20 bp, Artificial
  CRISPR gRNA sequence
tctgtctctctctctctctt

SEQ ID NO: 729643 - DNA, 20 bp, Artificial
  CRISPR gRNA sequence
ctgtctctctctctctcttt

SEQ ID NO: 729644 - DNA, 20 bp, Artificial
  CRISPR gRNA sequence
tgtctctctctctctctttc

SEQ ID NO: 729645 - DNA, 20 bp, Artificial
  CRISPR gRNA sequence
tctctctctctctctttctc

SEQ ID NO: 729646 - DNA, 20 bp, Artificial
  CRISPR gRNA sequence
tctctctctctttctctgtc

SEQ ID NO: 729647 - DNA, 20 bp, Artificial
  CRISPR gRNA sequence
tctctctctttctctgtctt

SEQ ID NO: 729648 - DNA, 20 bp, Artificial
  CRISPR gRNA sequence
tctctctttctctgtctttc

SEQ ID NO: 729649 - DNA, 20 bp, Artificial
  CRISPR gRNA sequence
tctctttctctgtctttctc

SEQ ID NO: 729650 - DNA, 20 bp, Artificial
  CRISPR gRNA sequence
tctttctctgtctttctctc

SEQ ID NO: 729651 - DNA, 20 bp, Artificial
  CRISPR gRNA sequence
tttctctgtctttctctctg

SEQ ID NO: 729652 - DNA, 20 bp, Artificial
  CRISPR gRNA sequence
tctctgtctttctctctgtc

SEQ ID NO: 729653 - DNA, 20 bp, Artificial
  CRISPR gRNA sequence
ctctgtctttctctctgtca

SEQ ID NO: 729654 - DNA, 20 bp, Artificial
  CRISPR gRNA sequence
tctgtctttctctctgtcac

SEQ ID NO: 729655 - DNA, 20 bp, Artificial
  CRISPR gRNA sequence
tgtctttctctctgtcacac

SEQ ID NO: 729656 - DNA, 20 bp, Artificial
  CRISPR gRNA sequence
tctttctctctgtcacactc

SEQ ID NO: 729657 - DNA, 20 bp, Artificial
  CRISPR gRNA sequence
tctctctgtcacactctatc

SEQ ID NO: 729658 - DNA, 20 bp, Artificial
  CRISPR gRNA sequence
ctctctgtcacactctatct

SEQ ID NO: 729659 - DNA, 20 bp, Artificial
  CRISPR gRNA sequence
tctctgtcacactctatctc

SEQ ID NO: 729660 - DNA, 20 bp, Artificial
  CRISPR gRNA sequence
tctgtcacactctatctctg

SEQ ID NO: 729661 - DNA, 20 bp, Artificial
  CRISPR gRNA sequence
tgtcacactctatctctgtc

SEQ ID NO: 729662 - DNA, 20 bp, Artificial
  CRISPR gRNA sequence
tcacactctatctctgtctc

SEQ ID NO: 729663 - DNA, 20 bp, Artificial
  CRISPR gRNA sequence
tatctctgtctctctctgtc

SEQ ID NO: 729664 - DNA, 20 bp, Artificial
  CRISPR gRNA sequence
tctctgtctctctctgtctc

SEQ ID NO: 729665 - DNA, 20 bp, Artificial
  CRISPR gRNA sequence
tgtctctctctgtctctcag

SEQ ID NO: 729666 - DNA, 20 bp, Artificial
  CRISPR gRNA sequence
tctctctctgtctctcagtc

SEQ ID NO: 729667 - DNA, 20 bp, Artificial
  CRISPR gRNA sequence
tctctgtctctcagtctctc

SEQ ID NO: 729668 - DNA, 20 bp, Artificial
  CRISPR gRNA sequence
tctgtctctcagtctctctt

SEQ ID NO: 729669 - DNA, 20 bp, Artificial
  CRISPR gRNA sequence
tgtctctcagtctctctttc

SEQ ID NO: 729670 - DNA, 20 bp, Artificial
  CRISPR gRNA sequence
tctctcagtctctctttctg

SEQ ID NO: 729671 - DNA, 20 bp, Artificial
  CRISPR gRNA sequence
tcagtctctctttctgtctt

SEQ ID NO: 729672 - DNA, 20 bp, Artificial
  CRISPR gRNA sequence
agtctctctttctgtctttc

SEQ ID NO: 729673 - DNA, 20 bp, Artificial
  CRISPR gRNA sequence
tctttctgtctttctgtctc

SEQ ID NO: 729674 - DNA, 20 bp, Artificial
  CRISPR gRNA sequence
tttctgtctttctgtctctc

SEQ ID NO: 729675 - DNA, 20 bp, Artificial
  CRISPR gRNA sequence
tctgtctttctgtctctctc

SEQ ID NO: 729676 - DNA, 20 bp, Artificial
  CRISPR gRNA sequence
ctgtctttctgtctctctct

SEQ ID NO: 729677 - DNA, 20 bp, Artificial
  CRISPR gRNA sequence
tgtctttctgtctctctctc

SEQ ID NO: 729678 - DNA, 20 bp, Artificial
  CRISPR gRNA sequence
tctttctgtctctctctctc

SEQ ID NO: 729679 - DNA, 20 bp, Artificial
  CRISPR gRNA sequence
tctgtctctctctctctcgc

SEQ ID NO: 729680 - DNA, 20 bp, Artificial
  CRISPR gRNA sequence
ctgtctctctctctctcgct

SEQ ID NO: 729681 - DNA, 20 bp, Artificial
  CRISPR gRNA sequence
tgtctctctctctctcgctc

SEQ ID NO: 729682 - DNA, 20 bp, Artificial
  CRISPR gRNA sequence
tctctctctctctcgctcac

SEQ ID NO: 729683 - DNA, 20 bp, Artificial
  CRISPR gRNA sequence
tctctctctcgctcactccg

SEQ ID NO: 729684 - DNA, 20 bp, Artificial
  CRISPR gRNA sequence
tctctctcgctcactccgtc

SEQ ID NO: 729685 - DNA, 20 bp, Artificial
  CRISPR gRNA sequence
tctctcgctcactccgtctc

SEQ ID NO: 729686 - DNA, 20 bp, Artificial
  CRISPR gRNA sequence
tctcgctcactccgtctctt

SEQ ID NO: 729687 - DNA, 20 bp, Artificial
  CRISPR gRNA sequence
tcgctcactccgtctctttc

SEQ ID NO: 729688 - DNA, 20 bp, Artificial
  CRISPR gRNA sequence
gctcactccgtctctttctc

SEQ ID NO: 729689 - DNA, 20 bp, Artificial
  CRISPR gRNA sequence
actccgtctctttctctttc

SEQ ID NO: 729690 - DNA, 20 bp, Artificial
  CRISPR gRNA sequence
cgtctctttctctttctgtc

SEQ ID NO: 729691 - DNA, 20 bp, Artificial
  CRISPR gRNA sequence
tttctctttctgtctctctc

SEQ ID NO: 729692 - DNA, 20 bp, Artificial
  CRISPR gRNA sequence
tctctttctgtctctctctc

SEQ ID NO: 729693 - DNA, 20 bp, Artificial
  CRISPR gRNA sequence
ctctttctgtctctctctct

SEQ ID NO: 729694 - DNA, 20 bp, Artificial
  CRISPR gRNA sequence
tctttctgtctctctctctc

SEQ ID NO: 729695 - DNA, 20 bp, Artificial
  CRISPR gRNA sequence
tttctgtctctctctctccc

SEQ ID NO: 729696 - DNA, 20 bp, Artificial
  CRISPR gRNA sequence
tctgtctctctctctccctc

SEQ ID NO: 729697 - DNA, 20 bp, Artificial
  CRISPR gRNA sequence
ctgtctctctctctccctct

SEQ ID NO: 729698 - DNA, 20 bp, Artificial
  CRISPR gRNA sequence
tgtctctctctctccctctt

SEQ ID NO: 729699 - DNA, 20 bp, Artificial
  CRISPR gRNA sequence
tctctctctctccctctttc

SEQ ID NO: 729700 - DNA, 20 bp, Artificial
  CRISPR gRNA sequence
tctctctccctctttctgtc

SEQ ID NO: 729701 - DNA, 20 bp, Artificial
  CRISPR gRNA sequence
tctctccctctttctgtctc

SEQ ID NO: 729702 - DNA, 20 bp, Artificial
  CRISPR gRNA sequence
tctccctctttctgtctctc

SEQ ID NO: 729703 - DNA, 20 bp, Artificial
  CRISPR gRNA sequence
tccctctttctgtctctctc

SEQ ID NO: 729704 - DNA, 20 bp, Artificial
  CRISPR gRNA sequence
cctctttctgtctctctctc

SEQ ID NO: 729705 - DNA, 20 bp, Artificial
  CRISPR gRNA sequence
tttctgtctctctctcactc

SEQ ID NO: 729706 - DNA, 20 bp, Artificial
  CRISPR gRNA sequence
tctgtctctctctcactctc

SEQ ID NO: 729707 - DNA, 20 bp, Artificial
  CRISPR gRNA sequence
ctgtctctctctcactctct

SEQ ID NO: 729708 - DNA, 20 bp, Artificial
  CRISPR gRNA sequence
tgtctctctctcactctctc

SEQ ID NO: 729709 - DNA, 20 bp, Artificial
  CRISPR gRNA sequence
tctctctctcactctctctc

SEQ ID NO: 729710 - DNA, 20 bp, Artificial
  CRISPR gRNA sequence
tctctcactctctctctccc

SEQ ID NO: 729711 - DNA, 20 bp, Artificial
  CRISPR gRNA sequence
tctcactctctctctccctc

SEQ ID NO: 729712 - DNA, 20 bp, Artificial
  CRISPR gRNA sequence
tcactctctctctccctctc

SEQ ID NO: 729713 - DNA, 20 bp, Artificial
  CRISPR gRNA sequence
actctctctctccctctcat

SEQ ID NO: 729714 - DNA, 20 bp, Artificial
  CRISPR gRNA sequence
tctctctccctctcattctg

SEQ ID NO: 729715 - DNA, 20 bp, Artificial
  CRISPR gRNA sequence
tctctccctctcattctgtc

SEQ ID NO: 729716 - DNA, 20 bp, Artificial
  CRISPR gRNA sequence
tctccctctcattctgtctc

SEQ ID NO: 729717 - DNA, 20 bp, Artificial
  CRISPR gRNA sequence
tccctctcattctgtctctt

SEQ ID NO: 729718 - DNA, 20 bp, Artificial
  CRISPR gRNA sequence
cctctcattctgtctctttc

SEQ ID NO: 729719 - DNA, 20 bp, Artificial
  CRISPR gRNA sequence
tcattctgtctctttctctc

SEQ ID NO: 729720 - DNA, 20 bp, Artificial
  CRISPR gRNA sequence
attctgtctctttctctctg

SEQ ID NO: 729721 - DNA, 20 bp, Artificial
  CRISPR gRNA sequence
tgtctctttctctctgtctc

SEQ ID NO: 729722 - DNA, 20 bp, Artificial
  CRISPR gRNA sequence
tctctttctctctgtctctc

SEQ ID NO: 729723 - DNA, 20 bp, Artificial
  CRISPR gRNA sequence
tttctctctgtctctctctt

SEQ ID NO: 729724 - DNA, 20 bp, Artificial
  CRISPR gRNA sequence
tctctctgtctctctctttc

SEQ ID NO: 729725 - DNA, 20 bp, Artificial
  CRISPR gRNA sequence
ctctctgtctctctctttct

SEQ ID NO: 729726 - DNA, 20 bp, Artificial
  CRISPR gRNA sequence
tctctgtctctctctttctc

SEQ ID NO: 729727 - DNA, 20 bp, Artificial
  CRISPR gRNA sequence
tctgtctctctctttctctc

SEQ ID NO: 729728 - DNA, 20 bp, Artificial
  CRISPR gRNA sequence
tgtctctctctttctctctc

SEQ ID NO: 729729 - DNA, 20 bp, Artificial
  CRISPR gRNA sequence
tctctctctttctctctctc

SEQ ID NO: 729730 - DNA, 20 bp, Artificial
  CRISPR gRNA sequence
tctctttctctctctcactc

SEQ ID NO: 729731 - DNA, 20 bp, Artificial
  CRISPR gRNA sequence
tctttctctctctcactctt

SEQ ID NO: 729732 - DNA, 20 bp, Artificial
  CRISPR gRNA sequence
tttctctctctcactctttc

SEQ ID NO: 729733 - DNA, 20 bp, Artificial
  CRISPR gRNA sequence
tctctctctcactctttctc

SEQ ID NO: 729734 - DNA, 20 bp, Artificial
  CRISPR gRNA sequence
ctctctctcactctttctct

SEQ ID NO: 729735 - DNA, 20 bp, Artificial
  CRISPR gRNA sequence
tctctctcactctttctctc

SEQ ID NO: 729736 - DNA, 20 bp, Artificial
  CRISPR gRNA sequence
tctctcactctttctctccc

SEQ ID NO: 729737 - DNA, 20 bp, Artificial
  CRISPR gRNA sequence
tctcactctttctctccctc

SEQ ID NO: 729738 - DNA, 20 bp, Artificial
  CRISPR gRNA sequence
tcactctttctctccctctt

SEQ ID NO: 729739 - DNA, 20 bp, Artificial
  CRISPR gRNA sequence
actctttctctccctctttc

SEQ ID NO: 729740 - DNA, 20 bp, Artificial
  CRISPR gRNA sequence
tttctctccctctttctgtc

SEQ ID NO: 729741 - DNA, 20 bp, Artificial
  CRISPR gRNA sequence
tctctccctctttctgtctc

SEQ ID NO: 729742 - DNA, 20 bp, Artificial
  CRISPR gRNA sequence
ctctccctctttctgtctct

SEQ ID NO: 729743 - DNA, 20 bp, Artificial
  CRISPR gRNA sequence
tctccctctttctgtctctc

SEQ ID NO: 729744 - DNA, 20 bp, Artificial
  CRISPR gRNA sequence
tccctctttctgtctctctc

SEQ ID NO: 729745 - DNA, 20 bp, Artificial
  CRISPR gRNA sequence
cctctttctgtctctctctc

SEQ ID NO: 729746 - DNA, 20 bp, Artificial
  CRISPR gRNA sequence
tttctgtctctctctcactc

SEQ ID NO: 729747 - DNA, 20 bp, Artificial
  CRISPR gRNA sequence
tctgtctctctctcactctc

SEQ ID NO: 729748 - DNA, 20 bp, Artificial
  CRISPR gRNA sequence
ctgtctctctctcactctct

SEQ ID NO: 729749 - DNA, 20 bp, Artificial
  CRISPR gRNA sequence
tgtctctctctcactctctc

SEQ ID NO: 729750 - DNA, 20 bp, Artificial
  CRISPR gRNA sequence
tctctctctcactctctctt

SEQ ID NO: 729751 - DNA, 20 bp, Artificial
  CRISPR gRNA sequence
tctctcactctctctttctg

SEQ ID NO: 729752 - DNA, 20 bp, Artificial
  CRISPR gRNA sequence
tctcactctctctttctgtc

SEQ ID NO: 729753 - DNA, 20 bp, Artificial
  CRISPR gRNA sequence
tcactctctctttctgtctg

SEQ ID NO: 729754 - DNA, 20 bp, Artificial
  CRISPR gRNA sequence
actctctctttctgtctgtc

SEQ ID NO: 729755 - DNA, 20 bp, Artificial
  CRISPR gRNA sequence
tctctttctgtctgtctctc

SEQ ID NO: 729756 - DNA, 20 bp, Artificial
  CRISPR gRNA sequence
tctttctgtctgtctctctc

SEQ ID NO: 729757 - DNA, 20 bp, Artificial
  CRISPR gRNA sequence
tttctgtctgtctctctctc

SEQ ID NO: 729758 - DNA, 20 bp, Artificial
  CRISPR gRNA sequence
tctgtctgtctctctctctc

SEQ ID NO: 729759 - DNA, 20 bp, Artificial
  CRISPR gRNA sequence
ctgtctgtctctctctctca

SEQ ID NO: 729760 - DNA, 20 bp, Artificial
  CRISPR gRNA sequence
tgtctgtctctctctctcaa

SEQ ID NO: 729761 - DNA, 20 bp, Artificial
  CRISPR gRNA sequence
tctgtctctctctctcaaga

SEQ ID NO: 729762 - DNA, 20 bp, Artificial
  CRISPR gRNA sequence
tctctctctctcaagacttt

SEQ ID NO: 729763 - DNA, 20 bp, Artificial
  CRISPR gRNA sequence
tctctctcaagacttttatg

SEQ ID NO: 729764 - DNA, 20 bp, Artificial
  CRISPR gRNA sequence
tctctcaagacttttatggc

SEQ ID NO: 729765 - DNA, 20 bp, Artificial
  CRISPR gRNA sequence
tctcaagacttttatggccg

SEQ ID NO: 729766 - DNA, 20 bp, Artificial
  CRISPR gRNA sequence
tcaagacttttatggccggg

SEQ ID NO: 729767 - DNA, 20 bp, Artificial
  CRISPR gRNA sequence
aagacttttatggccggggg

SEQ ID NO: 729768 - DNA, 20 bp, Artificial
  CRISPR gRNA sequence
ttatggccgggggcaatggc

SEQ ID NO: 729769 - DNA, 20 bp, Artificial
  CRISPR gRNA sequence
tatggccgggggcaatggct

SEQ ID NO: 729770 - DNA, 20 bp, Artificial
  CRISPR gRNA sequence
atggccgggggcaatggctc

SEQ ID NO: 729771 - DNA, 20 bp, Artificial
  CRISPR gRNA sequence
tggccgggggcaatggctca

SEQ ID NO: 729772 - DNA, 20 bp, Artificial
  CRISPR gRNA sequence
atgcttgtaattccaacact

SEQ ID NO: 729773 - DNA, 20 bp, Artificial
  CRISPR gRNA sequence
gtaattccaacactttggga

SEQ ID NO: 729774 - DNA, 20 bp, Artificial
  CRISPR gRNA sequence
taattccaacactttgggag

SEQ ID NO: 729775 - DNA, 20 bp, Artificial
  CRISPR gRNA sequence
caacactttgggaggccaag

SEQ ID NO: 729776 - DNA, 20 bp, Artificial
  CRISPR gRNA sequence
tgggaggccaaggccggcgg

SEQ ID NO: 729777 - DNA, 20 bp, Artificial
  CRISPR gRNA sequence
gggaggccaaggccggcgga

SEQ ID NO: 729778 - DNA, 20 bp, Artificial
  CRISPR gRNA sequence
ggaggccaaggccggcggat

SEQ ID NO: 729779 - DNA, 20 bp, Artificial
  CRISPR gRNA sequence
gaggccaggagtttgggacc

SEQ ID NO: 729780 - DNA, 20 bp, Artificial
  CRISPR gRNA sequence
aggccaggagtttgggacca

SEQ ID NO: 729781 - DNA, 20 bp, Artificial
  CRISPR gRNA sequence
gggaccagcctggccaacat

SEQ ID NO: 729782 - DNA, 20 bp, Artificial
  CRISPR gRNA sequence
ggaccagcctggccaacatg

SEQ ID NO: 729783 - DNA, 20 bp, Artificial
  CRISPR gRNA sequence
gccaacatggtgaaaccccg

SEQ ID NO: 729784 - DNA, 20 bp, Artificial
  CRISPR gRNA sequence
tactaaaaatacaaaaaaag

SEQ ID NO: 729785 - DNA, 20 bp, Artificial
  CRISPR gRNA sequence
ctaaaaatacaaaaaaagaa

SEQ ID NO: 729786 - DNA, 20 bp, Artificial
  CRISPR gRNA sequence
aaaatacaaaaaaagaaaaa

SEQ ID NO: 729787 - DNA, 20 bp, Artificial
  CRISPR gRNA sequence
cgcctttagaacctaaccac

SEQ ID NO: 729788 - DNA, 20 bp, Artificial
  CRISPR gRNA sequence
gcctttagaacctaaccacc

SEQ ID NO: 729789 - DNA, 20 bp, Artificial
  CRISPR gRNA sequence
tagaacctaaccaccagacc

SEQ ID NO: 729790 - DNA, 20 bp, Artificial
  CRISPR gRNA sequence
agaacctaaccaccagacca

SEQ ID NO: 729791 - DNA, 20 bp, Artificial
  CRISPR gRNA sequence
gaacctaaccaccagaccat

SEQ ID NO: 729792 - DNA, 20 bp, Artificial
  CRISPR gRNA sequence
accaccagaccatgaggaag

SEQ ID NO: 729793 - DNA, 20 bp, Artificial
  CRISPR gRNA sequence
cagccaggagccaacatcaa

SEQ ID NO: 729794 - DNA, 20 bp, Artificial
  CRISPR gRNA sequence
cagaagttcctgatctgcag

SEQ ID NO: 729795 - DNA, 20 bp, Artificial
  CRISPR gRNA sequence
agaagttcctgatctgcagc

SEQ ID NO: 729796 - DNA, 20 bp, Artificial
  CRISPR gRNA sequence
ctgatctgcagcttttgggc

SEQ ID NO: 729797 - DNA, 20 bp, Artificial
  CRISPR gRNA sequence
atctgcagcttttgggcttt

SEQ ID NO: 729798 - DNA, 20 bp, Artificial
  CRISPR gRNA sequence
cagcttttgggctttccagc

SEQ ID NO: 729799 - DNA, 20 bp, Artificial
  CRISPR gRNA sequence
ttgggctttccagctaagac

SEQ ID NO: 729800 - DNA, 20 bp, Artificial
  CRISPR gRNA sequence
tgggctttccagctaagacc

SEQ ID NO: 729801 - DNA, 20 bp, Artificial
  CRISPR gRNA sequence
gggctttccagctaagacct

SEQ ID NO: 729802 - DNA, 20 bp, Artificial
  CRISPR gRNA sequence
ggctttccagctaagacctc

SEQ ID NO: 729803 - DNA, 20 bp, Artificial
  CRISPR gRNA sequence
tccagctaagacctcagaca

SEQ ID NO: 729804 - DNA, 20 bp, Artificial
  CRISPR gRNA sequence
ccagctaagacctcagacat

SEQ ID NO: 729805 - DNA, 20 bp, Artificial
  CRISPR gRNA sequence
cagctaagacctcagacatt

SEQ ID NO: 729806 - DNA, 20 bp, Artificial
  CRISPR gRNA sequence
agacctcagacattgtggag

SEQ ID NO: 729807 - DNA, 20 bp, Artificial
  CRISPR gRNA sequence
agacattgtggagcagagac

SEQ ID NO: 729808 - DNA, 20 bp, Artificial
  CRISPR gRNA sequence
tggagcagagacaagctgtc

SEQ ID NO: 729809 - DNA, 20 bp, Artificial
  CRISPR gRNA sequence
tccccgcagtgccctgtctg

SEQ ID NO: 729810 - DNA, 20 bp, Artificial
  CRISPR gRNA sequence
tctgaattctgactcacaga

SEQ ID NO: 729811 - DNA, 20 bp, Artificial
  CRISPR gRNA sequence
aattctgactcacagaatct

SEQ ID NO: 729812 - DNA, 20 bp, Artificial
  CRISPR gRNA sequence
tgactcacagaatctgtgag

SEQ ID NO: 729813 - DNA, 20 bp, Artificial
  CRISPR gRNA sequence
actcacagaatctgtgagta

SEQ ID NO: 729814 - DNA, 20 bp, Artificial
  CRISPR gRNA sequence
acagaatctgtgagtacaaa

SEQ ID NO: 729815 - DNA, 20 bp, Artificial
  CRISPR gRNA sequence
tgagtacaaagaatgatttg

SEQ ID NO: 729816 - DNA, 20 bp, Artificial
  CRISPR gRNA sequence
gttttcacaattaagtttta

SEQ ID NO: 729817 - DNA, 20 bp, Artificial
  CRISPR gRNA sequence
ttttcacaattaagttttaa

SEQ ID NO: 729818 - DNA, 20 bp, Artificial
  CRISPR gRNA sequence
tcacaattaagttttaagaa

SEQ ID NO: 729819 - DNA, 20 bp, Artificial
  CRISPR gRNA sequence
cacaattaagttttaagaaa

SEQ ID NO: 729820 - DNA, 20 bp, Artificial
  CRISPR gRNA sequence
acaattaagttttaagaaaa

SEQ ID NO: 729821 - DNA, 20 bp, Artificial
  CRISPR gRNA sequence
agttttaagaaaatttgcta

SEQ ID NO: 729822 - DNA, 20 bp, Artificial
  CRISPR gRNA sequence
taagaaaatttgctatgcag

SEQ ID NO: 729823 - DNA, 20 bp, Artificial
  CRISPR gRNA sequence
aagaaaatttgctatgcagc

SEQ ID NO: 729824 - DNA, 20 bp, Artificial
  CRISPR gRNA sequence
agaaaatttgctatgcagcc

SEQ ID NO: 729825 - DNA, 20 bp, Artificial
  CRISPR gRNA sequence
gctatgcagccttagtaact

SEQ ID NO: 729826 - DNA, 20 bp, Artificial
  CRISPR gRNA sequence
ctatgcagccttagtaacta

SEQ ID NO: 729827 - DNA, 20 bp, Artificial
  CRISPR gRNA sequence
tgcagccttagtaactagga

SEQ ID NO: 729828 - DNA, 20 bp, Artificial
  CRISPR gRNA sequence
agtaactaggacagagacct

SEQ ID NO: 729829 - DNA, 20 bp, Artificial
  CRISPR gRNA sequence
gtaactaggacagagacctc

SEQ ID NO: 729830 - DNA, 20 bp, Artificial
  CRISPR gRNA sequence
ggacagagacctccaatgac

SEQ ID NO: 729831 - DNA, 20 bp, Artificial
  CRISPR gRNA sequence
caatgacaacaaacagtgtc

SEQ ID NO: 729832 - DNA, 20 bp, Artificial
  CRISPR gRNA sequence
tggttctttttggcctcccc

SEQ ID NO: 729833 - DNA, 20 bp, Artificial
  CRISPR gRNA sequence
tttttggcctcccctgaccc

SEQ ID NO: 729834 - DNA, 20 bp, Artificial
  CRISPR gRNA sequence
tttggcctcccctgaccctt

SEQ ID NO: 729835 - DNA, 20 bp, Artificial
  CRISPR gRNA sequence
ttggcctcccctgacccttc

SEQ ID NO: 729836 - DNA, 20 bp, Artificial
  CRISPR gRNA sequence
tggcctcccctgacccttca

SEQ ID NO: 729837 - DNA, 20 bp, Artificial
  CRISPR gRNA sequence
ggcctcccctgacccttcac

SEQ ID NO: 729838 - DNA, 20 bp, Artificial
  CRISPR gRNA sequence
gcctcccctgacccttcact

SEQ ID NO: 729839 - DNA, 20 bp, Artificial
  CRISPR gRNA sequence
ccctgacccttcactctgct

SEQ ID NO: 729840 - DNA, 20 bp, Artificial
  CRISPR gRNA sequence
acccttcactctgctttgct

SEQ ID NO: 729841 - DNA, 20 bp, Artificial
  CRISPR gRNA sequence
cactctgctttgctgcccaa

SEQ ID NO: 729842 - DNA, 20 bp, Artificial
  CRISPR gRNA sequence
actctgctttgctgcccaaa

SEQ ID NO: 729843 - DNA, 20 bp, Artificial
  CRISPR gRNA sequence
tgctttgctgcccaaaagca

SEQ ID NO: 729844 - DNA, 20 bp, Artificial
  CRISPR gRNA sequence
ctttgctgcccaaaagcagc

SEQ ID NO: 729845 - DNA, 20 bp, Artificial
  CRISPR gRNA sequence
tgctgcccaaaagcagctct

SEQ ID NO: 729846 - DNA, 20 bp, Artificial
  CRISPR gRNA sequence
gctgcccaaaagcagctctg

SEQ ID NO: 729847 - DNA, 20 bp, Artificial
  CRISPR gRNA sequence
ctgcccaaaagcagctctgg

SEQ ID NO: 729848 - DNA, 20 bp, Artificial
  CRISPR gRNA sequence
cccaaaagcagctctggaca

SEQ ID NO: 729849 - DNA, 20 bp, Artificial
  CRISPR gRNA sequence
tggacaaggagacagacaca

SEQ ID NO: 729850 - DNA, 20 bp, Artificial
  CRISPR gRNA sequence
gacaaggagacagacacaca

SEQ ID NO: 729851 - DNA, 20 bp, Artificial
  CRISPR gRNA sequence
ccagtggcctccgtgaatag

SEQ ID NO: 729852 - DNA, 20 bp, Artificial
  CRISPR gRNA sequence
cgtgaatagccagggcctct

SEQ ID NO: 729853 - DNA, 20 bp, Artificial
  CRISPR gRNA sequence
taacagtcacagcagcctgt

SEQ ID NO: 729854 - DNA, 20 bp, Artificial
  CRISPR gRNA sequence
acagtcacagcagcctgtgg

SEQ ID NO: 729855 - DNA, 20 bp, Artificial
  CRISPR gRNA sequence
tggcctgagcaacaccccct

SEQ ID NO: 729856 - DNA, 20 bp, Artificial
  CRISPR gRNA sequence
agcaacaccccctgcccaca

SEQ ID NO: 729857 - DNA, 20 bp, Artificial
  CRISPR gRNA sequence
cccacatgcccctcggggtg

SEQ ID NO: 729858 - DNA, 20 bp, Artificial
  CRISPR gRNA sequence
ggggtgctgctggcgctggg

SEQ ID NO: 729859 - DNA, 20 bp, Artificial
  CRISPR gRNA sequence
ctggcgctgggaggttgtga

SEQ ID NO: 729860 - DNA, 20 bp, Artificial
  CRISPR gRNA sequence
gcgctgggaggttgtgatgg

SEQ ID NO: 729861 - DNA, 20 bp, Artificial
  CRISPR gRNA sequence
ggaggttgtgatgggctggg

SEQ ID NO: 729862 - DNA, 20 bp, Artificial
  CRISPR gRNA sequence
tgatgggctgggcacaggga

SEQ ID NO: 729863 - DNA, 20 bp, Artificial
  CRISPR gRNA sequence
ggcacagggaagccccacac

SEQ ID NO: 729864 - DNA, 20 bp, Artificial
  CRISPR gRNA sequence
catcgtgctgtgtctgtgca

SEQ ID NO: 729865 - DNA, 20 bp, Artificial
  CRISPR gRNA sequence
tgtctgtgcactcagtaagt

SEQ ID NO: 729866 - DNA, 20 bp, Artificial
  CRISPR gRNA sequence
tgcactcagtaagtgcttgt

SEQ ID NO: 729867 - DNA, 20 bp, Artificial
  CRISPR gRNA sequence
agtaagtgcttgtcaaaaca

SEQ ID NO: 729868 - DNA, 20 bp, Artificial
  CRISPR gRNA sequence
gtcaaaacagctcgcaggcc

SEQ ID NO: 729869 - DNA, 20 bp, Artificial
  CRISPR gRNA sequence
tcaaaacagctcgcaggccg

SEQ ID NO: 729870 - DNA, 20 bp, Artificial
  CRISPR gRNA sequence
gcaggccgggcatggtggct

SEQ ID NO: 729871 - DNA, 20 bp, Artificial
  CRISPR gRNA sequence
atgcctataatcccagcaat

SEQ ID NO: 729872 - DNA, 20 bp, Artificial
  CRISPR gRNA sequence
taatcccagcaatttaggaa

SEQ ID NO: 729873 - DNA, 20 bp, Artificial
  CRISPR gRNA sequence
aggaagccaaggtgggagga

SEQ ID NO: 729874 - DNA, 20 bp, Artificial
  CRISPR gRNA sequence
ggaagccaaggtgggaggac

SEQ ID NO: 729875 - DNA, 20 bp, Artificial
  CRISPR gRNA sequence
gagtccaggagttcgagagc

SEQ ID NO: 729876 - DNA, 20 bp, Artificial
  CRISPR gRNA sequence
agtccaggagttcgagagca

SEQ ID NO: 729877 - DNA, 20 bp, Artificial
  CRISPR gRNA sequence
gagagcagcctgggcaacat

SEQ ID NO: 729878 - DNA, 20 bp, Artificial
  CRISPR gRNA sequence
ggcaacatagtgagaccccc

SEQ ID NO: 729879 - DNA, 20 bp, Artificial
  CRISPR gRNA sequence
tatgaaaaaaaatttttttt

SEQ ID NO: 729880 - DNA, 20 bp, Artificial
  CRISPR gRNA sequence
tttttaattagccaggcatg

SEQ ID NO: 729881 - DNA, 20 bp, Artificial
  CRISPR gRNA sequence
ttttaattagccaggcatgg

SEQ ID NO: 729882 - DNA, 20 bp, Artificial
  CRISPR gRNA sequence
tttaattagccaggcatggt

SEQ ID NO: 729883 - DNA, 20 bp, Artificial
  CRISPR gRNA sequence
ttaattagccaggcatggta

SEQ ID NO: 729884 - DNA, 20 bp, Artificial
  CRISPR gRNA sequence
taattagccaggcatggtag

SEQ ID NO: 729885 - DNA, 20 bp, Artificial
  CRISPR gRNA sequence
aattagccaggcatggtagt

SEQ ID NO: 729886 - DNA, 20 bp, Artificial
  CRISPR gRNA sequence
attagccaggcatggtagtg

SEQ ID NO: 729887 - DNA, 20 bp, Artificial
  CRISPR gRNA sequence
gccaggcatggtagtgtgca

SEQ ID NO: 729888 - DNA, 20 bp, Artificial
  CRISPR gRNA sequence
tagtcccagccacttgaaag

SEQ ID NO: 729889 - DNA, 20 bp, Artificial
  CRISPR gRNA sequence
gaaaggctgaggcaaaagga

SEQ ID NO: 729890 - DNA, 20 bp, Artificial
  CRISPR gRNA sequence
aaaggctgaggcaaaaggat

SEQ ID NO: 729891 - DNA, 20 bp, Artificial
  CRISPR gRNA sequence
aggcaaaaggatcatgtgat

SEQ ID NO: 729892 - DNA, 20 bp, Artificial
  CRISPR gRNA sequence
ggaggtcacagctgcaggga

SEQ ID NO: 729893 - DNA, 20 bp, Artificial
  CRISPR gRNA sequence
cagggagctatgatcccacc

SEQ ID NO: 729894 - DNA, 20 bp, Artificial
  CRISPR gRNA sequence
tgatcccaccaccgtactgc

SEQ ID NO: 729895 - DNA, 20 bp, Artificial
  CRISPR gRNA sequence
cagcttgggtgaaggagtga

SEQ ID NO: 729896 - DNA, 20 bp, Artificial
  CRISPR gRNA sequence
gggtgaaggagtgagaccct

SEQ ID NO: 729897 - DNA, 20 bp, Artificial
  CRISPR gRNA sequence
ggtgaaggagtgagaccctg

SEQ ID NO: 729898 - DNA, 20 bp, Artificial
  CRISPR gRNA sequence
tctgggaaaaaaaaaaaaag

SEQ ID NO: 729899 - DNA, 20 bp, Artificial
  CRISPR gRNA sequence
ggaaaaaaaaaaaaagaata

SEQ ID NO: 729900 - DNA, 20 bp, Artificial
  CRISPR gRNA sequence
ataggggcagcgagtggagt

SEQ ID NO: 729901 - DNA, 20 bp, Artificial
  CRISPR gRNA sequence
gaacctggtggcacctgtct

SEQ ID NO: 729902 - DNA, 20 bp, Artificial
  CRISPR gRNA sequence
gtggcacctgtctgggttca

SEQ ID NO: 729903 - DNA, 20 bp, Artificial
  CRISPR gRNA sequence
tctgggttcaaactccagcc

SEQ ID NO: 729904 - DNA, 20 bp, Artificial
  CRISPR gRNA sequence
ggttcaaactccagcccaca

SEQ ID NO: 729905 - DNA, 20 bp, Artificial
  CRISPR gRNA sequence
aaactccagcccacagccct

SEQ ID NO: 729906 - DNA, 20 bp, Artificial
  CRISPR gRNA sequence
cagcccacagcccttggaag

SEQ ID NO: 729907 - DNA, 20 bp, Artificial
  CRISPR gRNA sequence
ggaagttccctgacttccca

SEQ ID NO: 729908 - DNA, 20 bp, Artificial
  CRISPR gRNA sequence
gaagttccctgacttcccaa

SEQ ID NO: 729909 - DNA, 20 bp, Artificial
  CRISPR gRNA sequence
cctgacttcccaaagcctcc

SEQ ID NO: 729910 - DNA, 20 bp, Artificial
  CRISPR gRNA sequence
acttcccaaagcctccgttt

SEQ ID NO: 729911 - DNA, 20 bp, Artificial
  CRISPR gRNA sequence
cccaaagcctccgtttcctc

SEQ ID NO: 729912 - DNA, 20 bp, Artificial
  CRISPR gRNA sequence
ccaaagcctccgtttcctcc

SEQ ID NO: 729913 - DNA, 20 bp, Artificial
  CRISPR gRNA sequence
cgtttcctcctctgtaaaag

SEQ ID NO: 729914 - DNA, 20 bp, Artificial
  CRISPR gRNA sequence
cctcctctgtaaaaggggaa

SEQ ID NO: 729915 - DNA, 20 bp, Artificial
  CRISPR gRNA sequence
ctcctctgtaaaaggggaat

SEQ ID NO: 729916 - DNA, 20 bp, Artificial
  CRISPR gRNA sequence
ctctgtaaaaggggaatgat

SEQ ID NO: 729917 - DNA, 20 bp, Artificial
  CRISPR gRNA sequence
tgtaaaaggggaatgatcac

SEQ ID NO: 729918 - DNA, 20 bp, Artificial
  CRISPR gRNA sequence
taaaaggggaatgatcacaa

SEQ ID NO: 729919 - DNA, 20 bp, Artificial
  CRISPR gRNA sequence
gaatcacagagtagttacaa

SEQ ID NO: 729920 - DNA, 20 bp, Artificial
  CRISPR gRNA sequence
aatcacagagtagttacaaa

SEQ ID NO: 729921 - DNA, 20 bp, Artificial
  CRISPR gRNA sequence
caaacattgatgagccgagt

SEQ ID NO: 729922 - DNA, 20 bp, Artificial
  CRISPR gRNA sequence
atgagccgagtttggaacag

SEQ ID NO: 729923 - DNA, 20 bp, Artificial
  CRISPR gRNA sequence
ggaacaggtgggtgattcac

SEQ ID NO: 729924 - DNA, 20 bp, Artificial
  CRISPR gRNA sequence
gaacaggtgggtgattcaca

SEQ ID NO: 729925 - DNA, 20 bp, Artificial
  CRISPR gRNA sequence
acaaacgcttcctggaagga

SEQ ID NO: 729926 - DNA, 20 bp, Artificial
  CRISPR gRNA sequence
cctggaaggaaataatatgc

SEQ ID NO: 729927 - DNA, 20 bp, Artificial
  CRISPR gRNA sequence
ctggaaggaaataatatgcc

SEQ ID NO: 729928 - DNA, 20 bp, Artificial
  CRISPR gRNA sequence
gaaggaaataatatgccaat

SEQ ID NO: 729929 - DNA, 20 bp, Artificial
  CRISPR gRNA sequence
tgaaaagaggcgacccccat

SEQ ID NO: 729930 - DNA, 20 bp, Artificial
  CRISPR gRNA sequence
aaaagaggcgacccccatca

SEQ ID NO: 729931 - DNA, 20 bp, Artificial
  CRISPR gRNA sequence
ctggaagttcacggttcaaa

SEQ ID NO: 729932 - DNA, 20 bp, Artificial
  CRISPR gRNA sequence
gaagttcacggttcaaaaat

SEQ ID NO: 729933 - DNA, 20 bp, Artificial
  CRISPR gRNA sequence
acggttcaaaaatgcagaga

SEQ ID NO: 729934 - DNA, 20 bp, Artificial
  CRISPR gRNA sequence
aaaaatgcagagaggtaaac

SEQ ID NO: 729935 - DNA, 20 bp, Artificial
  CRISPR gRNA sequence
aggcccggggagggacgagg

SEQ ID NO: 729936 - DNA, 20 bp, Artificial
  CRISPR gRNA sequence
acctcgagaacagctcacgc

SEQ ID NO: 729937 - DNA, 20 bp, Artificial
  CRISPR gRNA sequence
cctcgagaacagctcacgca

SEQ ID NO: 729938 - DNA, 20 bp, Artificial
  CRISPR gRNA sequence
gagaacagctcacgcaggcc

SEQ ID NO: 729939 - DNA, 20 bp, Artificial
  CRISPR gRNA sequence
acgcaggccgtgcagcggcc

SEQ ID NO: 729940 - DNA, 20 bp, Artificial
  CRISPR gRNA sequence
gtccaggtagtagtcgggct

SEQ ID NO: 729941 - DNA, 20 bp, Artificial
  CRISPR gRNA sequence
acactgctttctgcaatcac

SEQ ID NO: 729942 - DNA, 20 bp, Artificial
  CRISPR gRNA sequence
ctttctgcaatcaccagacc

SEQ ID NO: 729943 - DNA, 20 bp, Artificial
  CRISPR gRNA sequence
tctgcaatcaccagacccct

SEQ ID NO: 729944 - DNA, 20 bp, Artificial
  CRISPR gRNA sequence
ctgcaatcaccagacccctc

SEQ ID NO: 729945 - DNA, 20 bp, Artificial
  CRISPR gRNA sequence
tgcaatcaccagacccctct

SEQ ID NO: 729946 - DNA, 20 bp, Artificial
  CRISPR gRNA sequence
caatcaccagacccctctgg

SEQ ID NO: 729947 - DNA, 20 bp, Artificial
  CRISPR gRNA sequence
tgggcatggctgtgttgggg

SEQ ID NO: 729948 - DNA, 20 bp, Artificial
  CRISPR gRNA sequence
ggcatggctgtgttggggac

SEQ ID NO: 729949 - DNA, 20 bp, Artificial
  CRISPR gRNA sequence
tgttggggacagacctgggg

SEQ ID NO: 729950 - DNA, 20 bp, Artificial
  CRISPR gRNA sequence
gggacagacctggggaaaga

SEQ ID NO: 729951 - DNA, 20 bp, Artificial
  CRISPR gRNA sequence
gggaaagaagcagagaagct

SEQ ID NO: 729952 - DNA, 20 bp, Artificial
  CRISPR gRNA sequence
caggccaggccgccttggca

SEQ ID NO: 729953 - DNA, 20 bp, Artificial
  CRISPR gRNA sequence
ggcaaaggcctcactcccca

SEQ ID NO: 729954 - DNA, 20 bp, Artificial
  CRISPR gRNA sequence
gcaaaggcctcactccccac

SEQ ID NO: 729955 - DNA, 20 bp, Artificial
  CRISPR gRNA sequence
actccccacccaaccctgaa

SEQ ID NO: 729956 - DNA, 20 bp, Artificial
  CRISPR gRNA sequence
cccacccaaccctgaagccc

SEQ ID NO: 729957 - DNA, 20 bp, Artificial
  CRISPR gRNA sequence
aagccccccatccctcaccg

SEQ ID NO: 729958 - DNA, 20 bp, Artificial
  CRISPR gRNA sequence
accgtggccagctcccaaac

SEQ ID NO: 729959 - DNA, 20 bp, Artificial
  CRISPR gRNA sequence
ccaaactccgcatgtcagct

SEQ ID NO: 729960 - DNA, 20 bp, Artificial
  CRISPR gRNA sequence
cgcatgtcagctcagtccag

SEQ ID NO: 729961 - DNA, 20 bp, Artificial
  CRISPR gRNA sequence
agtccagcctttcagaggga

SEQ ID NO: 729962 - DNA, 20 bp, Artificial
  CRISPR gRNA sequence
tcagagggagtcctgaggct

SEQ ID NO: 729963 - DNA, 20 bp, Artificial
  CRISPR gRNA sequence
cagagggagtcctgaggctc

SEQ ID NO: 729964 - DNA, 20 bp, Artificial
  CRISPR gRNA sequence
agagggagtcctgaggctca

SEQ ID NO: 729965 - DNA, 20 bp, Artificial
  CRISPR gRNA sequence
aggctcagagaggacaggaa

SEQ ID NO: 729966 - DNA, 20 bp, Artificial
  CRISPR gRNA sequence
agagaggacaggaatgctgc

SEQ ID NO: 729967 - DNA, 20 bp, Artificial
  CRISPR gRNA sequence
cgtgcattccacacgagagg

SEQ ID NO: 729968 - DNA, 20 bp, Artificial
  CRISPR gRNA sequence
cacacgagaggagggtactc

SEQ ID NO: 729969 - DNA, 20 bp, Artificial
  CRISPR gRNA sequence
attgccccccaaccagcccc

SEQ ID NO: 729970 - DNA, 20 bp, Artificial
  CRISPR gRNA sequence
ccccccaaccagcccctgcc

SEQ ID NO: 729971 - DNA, 20 bp, Artificial
  CRISPR gRNA sequence
cccactgttcctcctgaggc

SEQ ID NO: 729972 - DNA, 20 bp, Artificial
  CRISPR gRNA sequence
ttcctcctgaggccaccatg

SEQ ID NO: 729973 - DNA, 20 bp, Artificial
  CRISPR gRNA sequence
ctcctgaggccaccatgcca

SEQ ID NO: 729974 - DNA, 20 bp, Artificial
  CRISPR gRNA sequence
ctgaggccaccatgccacag

SEQ ID NO: 729975 - DNA, 20 bp, Artificial
  CRISPR gRNA sequence
aggccaccatgccacagctt

SEQ ID NO: 729976 - DNA, 20 bp, Artificial
  CRISPR gRNA sequence
cccccaaccctgtctcatgg

SEQ ID NO: 729977 - DNA, 20 bp, Artificial
  CRISPR gRNA sequence
ccccaaccctgtctcatggc

SEQ ID NO: 729978 - DNA, 20 bp, Artificial
  CRISPR gRNA sequence
tctcatggctctgtcactcc

SEQ ID NO: 729979 - DNA, 20 bp, Artificial
  CRISPR gRNA sequence
atggctctgtcactcccctg

SEQ ID NO: 729980 - DNA, 20 bp, Artificial
  CRISPR gRNA sequence
tgtcactcccctgctcaaaa

SEQ ID NO: 729981 - DNA, 20 bp, Artificial
  CRISPR gRNA sequence
tcactcccctgctcaaaact

SEQ ID NO: 729982 - DNA, 20 bp, Artificial
  CRISPR gRNA sequence
ccctgctcaaaactttggga

SEQ ID NO: 729983 - DNA, 20 bp, Artificial
  CRISPR gRNA sequence
ctcaaaactttgggaacagc

SEQ ID NO: 729984 - DNA, 20 bp, Artificial
  CRISPR gRNA sequence
aaaactttgggaacagcttc

SEQ ID NO: 729985 - DNA, 20 bp, Artificial
  CRISPR gRNA sequence
tgggaacagcttccctgaga

SEQ ID NO: 729986 - DNA, 20 bp, Artificial
  CRISPR gRNA sequence
gggaacagcttccctgagag

SEQ ID NO: 729987 - DNA, 20 bp, Artificial
  CRISPR gRNA sequence
ggaacagcttccctgagagc

SEQ ID NO: 729988 - DNA, 20 bp, Artificial
  CRISPR gRNA sequence
ccctgagagctcagcacact

SEQ ID NO: 729989 - DNA, 20 bp, Artificial
  CRISPR gRNA sequence
cctgagagctcagcacacta

SEQ ID NO: 729990 - DNA, 20 bp, Artificial
  CRISPR gRNA sequence
agagctcagcacactagcgt

SEQ ID NO: 729991 - DNA, 20 bp, Artificial
  CRISPR gRNA sequence
agcacactagcgtaactcct

SEQ ID NO: 729992 - DNA, 20 bp, Artificial
  CRISPR gRNA sequence
gcgtaactcctgttcagaat

SEQ ID NO: 729993 - DNA, 20 bp, Artificial
  CRISPR gRNA sequence
ctgttcagaatggtattggg

SEQ ID NO: 729994 - DNA, 20 bp, Artificial
  CRISPR gRNA sequence
ttcagaatggtattgggcag

SEQ ID NO: 729995 - DNA, 20 bp, Artificial
  CRISPR gRNA sequence
agaatggtattgggcaggga

SEQ ID NO: 729996 - DNA, 20 bp, Artificial
  CRISPR gRNA sequence
ggcagggaggggctgggtgc

SEQ ID NO: 729997 - DNA, 20 bp, Artificial
  CRISPR gRNA sequence
ggtgcctcctgcctccctct

SEQ ID NO: 729998 - DNA, 20 bp, Artificial
  CRISPR gRNA sequence
ctgcctccctcttttaaaga

SEQ ID NO: 729999 - DNA, 20 bp, Artificial
  CRISPR gRNA sequence
cctccctcttttaaagactg

SEQ ID NO: 730000 - DNA, 20 bp, Artificial
  CRISPR gRNA sequence
cctcttttaaagactggtgt

SEQ ID NO: 730001 - DNA, 20 bp, Artificial
  CRISPR gRNA sequence
ttttaaagactggtgtgggc

SEQ ID NO: 730002 - DNA, 20 bp, Artificial
  CRISPR gRNA sequence
ttaaagactggtgtgggccg

SEQ ID NO: 730003 - DNA, 20 bp, Artificial
  CRISPR gRNA sequence
taaagactggtgtgggccgg

SEQ ID NO: 730004 - DNA, 20 bp, Artificial
  CRISPR gRNA sequence
aaagactggtgtgggccggg

SEQ ID NO: 730005 - DNA, 20 bp, Artificial
  CRISPR gRNA sequence
aagactggtgtgggccgggc

SEQ ID NO: 730006 - DNA, 20 bp, Artificial
  CRISPR gRNA sequence
gtgtgggccgggcgcggtgg

SEQ ID NO: 730007 - DNA, 20 bp, Artificial
  CRISPR gRNA sequence
acgtctgtaatcccagcact

SEQ ID NO: 730008 - DNA, 20 bp, Artificial
  CRISPR gRNA sequence
taatcccagcactttgggag

SEQ ID NO: 730009 - DNA, 20 bp, Artificial
  CRISPR gRNA sequence
tgggaggctgaggcgggtgg

SEQ ID NO: 730010 - DNA, 20 bp, Artificial
  CRISPR gRNA sequence
gggaggctgaggcgggtgga

SEQ ID NO: 730011 - DNA, 20 bp, Artificial
  CRISPR gRNA sequence
ggaggctgaggcgggtggat

SEQ ID NO: 730012 - DNA, 20 bp, Artificial
  CRISPR gRNA sequence
aggcgggtggattacttgag

SEQ ID NO: 730013 - DNA, 20 bp, Artificial
  CRISPR gRNA sequence
cttgaggccaggagtttgtg

SEQ ID NO: 730014 - DNA, 20 bp, Artificial
  CRISPR gRNA sequence
gaggccaggagtttgtgacc

SEQ ID NO: 730015 - DNA, 20 bp, Artificial
  CRISPR gRNA sequence
aggccaggagtttgtgacca

SEQ ID NO: 730016 - DNA, 20 bp, Artificial
  CRISPR gRNA sequence
gtgaccagcctggccaacat

SEQ ID NO: 730017 - DNA, 20 bp, Artificial
  CRISPR gRNA sequence
tgaccagcctggccaacatg

SEQ ID NO: 730018 - DNA, 20 bp, Artificial
  CRISPR gRNA sequence
gccaacatggtgaaaccccg

SEQ ID NO: 730019 - DNA, 20 bp, Artificial
  CRISPR gRNA sequence
tactaaaaaaaagaaaagta

SEQ ID NO: 730020 - DNA, 20 bp, Artificial
  CRISPR gRNA sequence
ctaaaaaaaagaaaagtagc

SEQ ID NO: 730021 - DNA, 20 bp, Artificial
  CRISPR gRNA sequence
aaaaaaagaaaagtagccaa

SEQ ID NO: 730022 - DNA, 20 bp, Artificial
  CRISPR gRNA sequence
taatcccagctactcgggag

SEQ ID NO: 730023 - DNA, 20 bp, Artificial
  CRISPR gRNA sequence
ctcgggaggctgaggcagga

SEQ ID NO: 730024 - DNA, 20 bp, Artificial
  CRISPR gRNA sequence
gggaggctgaggcaggagaa

SEQ ID NO: 730025 - DNA, 20 bp, Artificial
  CRISPR gRNA sequence
aggcaggagaattgcttgaa

SEQ ID NO: 730026 - DNA, 20 bp, Artificial
  CRISPR gRNA sequence
cttgaacccaggaggcggag

SEQ ID NO: 730027 - DNA, 20 bp, Artificial
  CRISPR gRNA sequence
gaacccaggaggcggaggtt

SEQ ID NO: 730028 - DNA, 20 bp, Artificial
  CRISPR gRNA sequence
aacccaggaggcggaggttg

SEQ ID NO: 730029 - DNA, 20 bp, Artificial
  CRISPR gRNA sequence
cagtgagccgagatcacgcc

SEQ ID NO: 730030 - DNA, 20 bp, Artificial
  CRISPR gRNA sequence
cactccagtctgggcgacag

SEQ ID NO: 730031 - DNA, 20 bp, Artificial
  CRISPR gRNA sequence
cagtctgggcgacagagcaa

SEQ ID NO: 730032 - DNA, 20 bp, Artificial
  CRISPR gRNA sequence
ggcgacagagcaagactcac

SEQ ID NO: 730033 - DNA, 20 bp, Artificial
  CRISPR gRNA sequence
acctcaaaaaaacaaaccac

SEQ ID NO: 730034 - DNA, 20 bp, Artificial
  CRISPR gRNA sequence
aaaaaaacaaaccacaaaca

SEQ ID NO: 730035 - DNA, 20 bp, Artificial
  CRISPR gRNA sequence
taggaaaagagctccaaccc

SEQ ID NO: 730036 - DNA, 20 bp, Artificial
  CRISPR gRNA sequence
caacccaaaattgttagaag

SEQ ID NO: 730037 - DNA, 20 bp, Artificial
  CRISPR gRNA sequence
ttagaagtcccacaaatcca

SEQ ID NO: 730038 - DNA, 20 bp, Artificial
  CRISPR gRNA sequence
gaagtcccacaaatccattt

SEQ ID NO: 730039 - DNA, 20 bp, Artificial
  CRISPR gRNA sequence
tttttacaaaaccaacccaa

SEQ ID NO: 730040 - DNA, 20 bp, Artificial
  CRISPR gRNA sequence
ttttacaaaaccaacccaag

SEQ ID NO: 730041 - DNA, 20 bp, Artificial
  CRISPR gRNA sequence
tttacaaaaccaacccaaga

SEQ ID NO: 730042 - DNA, 20 bp, Artificial
  CRISPR gRNA sequence
ttacaaaaccaacccaagag

SEQ ID NO: 730043 - DNA, 20 bp, Artificial
  CRISPR gRNA sequence
tacaaaaccaacccaagaga

SEQ ID NO: 730044 - DNA, 20 bp, Artificial
  CRISPR gRNA sequence
acaaaaccaacccaagagaa

SEQ ID NO: 730045 - DNA, 20 bp, Artificial
  CRISPR gRNA sequence
caaaaccaacccaagagaaa

SEQ ID NO: 730046 - DNA, 20 bp, Artificial
  CRISPR gRNA sequence
ttctttcttcattatagtca

SEQ ID NO: 730047 - DNA, 20 bp, Artificial
  CRISPR gRNA sequence
tctttcttcattatagtcaa

SEQ ID NO: 730048 - DNA, 20 bp, Artificial
  CRISPR gRNA sequence
ctttcttcattatagtcaaa

SEQ ID NO: 730049 - DNA, 20 bp, Artificial
  CRISPR gRNA sequence
tttcttcattatagtcaaaa

SEQ ID NO: 730050 - DNA, 20 bp, Artificial
  CRISPR gRNA sequence
tcttcattatagtcaaaagg

SEQ ID NO: 730051 - DNA, 20 bp, Artificial
  CRISPR gRNA sequence
cttcattatagtcaaaaggc

SEQ ID NO: 730052 - DNA, 20 bp, Artificial
  CRISPR gRNA sequence
ttcattatagtcaaaaggca

SEQ ID NO: 730053 - DNA, 20 bp, Artificial
  CRISPR gRNA sequence
cattatagtcaaaaggcaga

SEQ ID NO: 730054 - DNA, 20 bp, Artificial
  CRISPR gRNA sequence
attatagtcaaaaggcagaa

SEQ ID NO: 730055 - DNA, 20 bp, Artificial
  CRISPR gRNA sequence
tagtcaaaaggcagaaacaa

SEQ ID NO: 730056 - DNA, 20 bp, Artificial
  CRISPR gRNA sequence
aaaaactggataaacagagc

SEQ ID NO: 730057 - DNA, 20 bp, Artificial
  CRISPR gRNA sequence
gataaacagagctcggcata

SEQ ID NO: 730058 - DNA, 20 bp, Artificial
  CRISPR gRNA sequence
ggcatatctacgccatggag

SEQ ID NO: 730059 - DNA, 20 bp, Artificial
  CRISPR gRNA sequence
cgccatggagggctattcag

SEQ ID NO: 730060 - DNA, 20 bp, Artificial
  CRISPR gRNA sequence
ttcagtaataaaatgggact

SEQ ID NO: 730061 - DNA, 20 bp, Artificial
  CRISPR gRNA sequence
agtaataaaatgggactagg

SEQ ID NO: 730062 - DNA, 20 bp, Artificial
  CRISPR gRNA sequence
ggttgggcgcggtggctcac

SEQ ID NO: 730063 - DNA, 20 bp, Artificial
  CRISPR gRNA sequence
ggcgcggtggctcacgcctg

SEQ ID NO: 730064 - DNA, 20 bp, Artificial
  CRISPR gRNA sequence
acgcctgtaatcctcccagc

SEQ ID NO: 730065 - DNA, 20 bp, Artificial
  CRISPR gRNA sequence
taatcctcccagcactttgg

SEQ ID NO: 730066 - DNA, 20 bp, Artificial
  CRISPR gRNA sequence
ccagcactttgggaggccga

SEQ ID NO: 730067 - DNA, 20 bp, Artificial
  CRISPR gRNA sequence
tgggaggccgaggtgggcgg

SEQ ID NO: 730068 - DNA, 20 bp, Artificial
  CRISPR gRNA sequence
gggaggccgaggtgggcgga

SEQ ID NO: 730069 - DNA, 20 bp, Artificial
  CRISPR gRNA sequence
ggaggccgaggtgggcggat

SEQ ID NO: 730070 - DNA, 20 bp, Artificial
  CRISPR gRNA sequence
aggtcgggagttcgagacca

SEQ ID NO: 730071 - DNA, 20 bp, Artificial
  CRISPR gRNA sequence
gagaccagcctgaccaacat

SEQ ID NO: 730072 - DNA, 20 bp, Artificial
  CRISPR gRNA sequence
accaacatggtgaaatccca

SEQ ID NO: 730073 - DNA, 20 bp, Artificial
  CRISPR gRNA sequence
tactaaaaatacaaagttag

SEQ ID NO: 730074 - DNA, 20 bp, Artificial
  CRISPR gRNA sequence
ctaaaaatacaaagttagcc

SEQ ID NO: 730075 - DNA, 20 bp, Artificial
  CRISPR gRNA sequence
aaaatacaaagttagccagg

SEQ ID NO: 730076 - DNA, 20 bp, Artificial
  CRISPR gRNA sequence
gccaggcgtggtggtgggca

SEQ ID NO: 730077 - DNA, 20 bp, Artificial
  CRISPR gRNA sequence
taatcccagctactcaggag

SEQ ID NO: 730078 - DNA, 20 bp, Artificial
  CRISPR gRNA sequence
ctcaggaggctgaggcagga

SEQ ID NO: 730079 - DNA, 20 bp, Artificial
  CRISPR gRNA sequence
aggaggctgaggcaggagaa

SEQ ID NO: 730080 - DNA, 20 bp, Artificial
  CRISPR gRNA sequence
aggcaggagaatcgcttgaa

SEQ ID NO: 730081 - DNA, 20 bp, Artificial
  CRISPR gRNA sequence
gaacccaggaggtggaggtg

SEQ ID NO: 730082 - DNA, 20 bp, Artificial
  CRISPR gRNA sequence
aacccaggaggtggaggtgg

SEQ ID NO: 730083 - DNA, 20 bp, Artificial
  CRISPR gRNA sequence
cgccactgcactccagcctg

SEQ ID NO: 730084 - DNA, 20 bp, Artificial
  CRISPR gRNA sequence
cactccagcctgggcaacat

SEQ ID NO: 730085 - DNA, 20 bp, Artificial
  CRISPR gRNA sequence
cagcctgggcaacatgagcg

SEQ ID NO: 730086 - DNA, 20 bp, Artificial
  CRISPR gRNA sequence
ggcaacatgagcgaaactcc

SEQ ID NO: 730087 - DNA, 20 bp, Artificial
  CRISPR gRNA sequence
cgtctcaaaaaaaagaaaaa

SEQ ID NO: 730088 - DNA, 20 bp, Artificial
  CRISPR gRNA sequence
aaaaaaaagaaaaagaaaaa

SEQ ID NO: 730089 - DNA, 20 bp, Artificial
  CRISPR gRNA sequence
agggtcgacccttcgccatg

SEQ ID NO: 730090 - DNA, 20 bp, Artificial
  CRISPR gRNA sequence
cgccatggagaccaggaggg

SEQ ID NO: 730091 - DNA, 20 bp, Artificial
  CRISPR gRNA sequence
gccatggagaccaggagggc

SEQ ID NO: 730092 - DNA, 20 bp, Artificial
  CRISPR gRNA sequence
gccagctgagtcgcaagtgt

SEQ ID NO: 730093 - DNA, 20 bp, Artificial
  CRISPR gRNA sequence
agtcgcaagtgtcacaacag

SEQ ID NO: 730094 - DNA, 20 bp, Artificial
  CRISPR gRNA sequence
ccctctgacaaaccaacgta

SEQ ID NO: 730095 - DNA, 20 bp, Artificial
  CRISPR gRNA sequence
cctctgacaaaccaacgtag

SEQ ID NO: 730096 - DNA, 20 bp, Artificial
  CRISPR gRNA sequence
tgacaaaccaacgtagaggg

SEQ ID NO: 730097 - DNA, 20 bp, Artificial
  CRISPR gRNA sequence
acaaaccaacgtagagggaa

SEQ ID NO: 730098 - DNA, 20 bp, Artificial
  CRISPR gRNA sequence
tgcactgctggcaaatgaat

SEQ ID NO: 730099 - DNA, 20 bp, Artificial
  CRISPR gRNA sequence
cactgctggcaaatgaatga

SEQ ID NO: 730100 - DNA, 20 bp, Artificial
  CRISPR gRNA sequence
ctggcaaatgaatgagccct

SEQ ID NO: 730101 - DNA, 20 bp, Artificial
  CRISPR gRNA sequence
gcaaatgaatgagccctctg

SEQ ID NO: 730102 - DNA, 20 bp, Artificial
  CRISPR gRNA sequence
tggtgtctacctctgcccct

SEQ ID NO: 730103 - DNA, 20 bp, Artificial
  CRISPR gRNA sequence
gtgtctacctctgcccctca

SEQ ID NO: 730104 - DNA, 20 bp, Artificial
  CRISPR gRNA sequence
cctctgcccctcaatgcttt

SEQ ID NO: 730105 - DNA, 20 bp, Artificial
  CRISPR gRNA sequence
tgcccctcaatgctttcagc

SEQ ID NO: 730106 - DNA, 20 bp, Artificial
  CRISPR gRNA sequence
cccctcaatgctttcagccc

SEQ ID NO: 730107 - DNA, 20 bp, Artificial
  CRISPR gRNA sequence
aatgctttcagccctagatc

SEQ ID NO: 730108 - DNA, 20 bp, Artificial
  CRISPR gRNA sequence
tcagccctagatcatacctt

SEQ ID NO: 730109 - DNA, 20 bp, Artificial
  CRISPR gRNA sequence
cagccctagatcatacctta

SEQ ID NO: 730110 - DNA, 20 bp, Artificial
  CRISPR gRNA sequence
agccctagatcataccttac

SEQ ID NO: 730111 - DNA, 20 bp, Artificial
  CRISPR gRNA sequence
gatcataccttaccaccgtc

SEQ ID NO: 730112 - DNA, 20 bp, Artificial
  CRISPR gRNA sequence
accaccgtcttctctcccca

SEQ ID NO: 730113 - DNA, 20 bp, Artificial
  CRISPR gRNA sequence
ccaccgtcttctctccccac

SEQ ID NO: 730114 - DNA, 20 bp, Artificial
  CRISPR gRNA sequence
ctctccccaccaggaaaaga

SEQ ID NO: 730115 - DNA, 20 bp, Artificial
  CRISPR gRNA sequence
tctccccaccaggaaaagac

SEQ ID NO: 730116 - DNA, 20 bp, Artificial
  CRISPR gRNA sequence
tccccaccaggaaaagacca

SEQ ID NO: 730117 - DNA, 20 bp, Artificial
  CRISPR gRNA sequence
cccaccaggaaaagaccaca

SEQ ID NO: 730118 - DNA, 20 bp, Artificial
  CRISPR gRNA sequence
cccgcctgctccaaacaccc

SEQ ID NO: 730119 - DNA, 20 bp, Artificial
  CRISPR gRNA sequence
ctccaaacacccccactcat

SEQ ID NO: 730120 - DNA, 20 bp, Artificial
  CRISPR gRNA sequence
caaacacccccactcatggg

SEQ ID NO: 730121 - DNA, 20 bp, Artificial
  CRISPR gRNA sequence
atgggccatccaccaatcga

SEQ ID NO: 730122 - DNA, 20 bp, Artificial
  CRISPR gRNA sequence
catggggaaattacctggat

SEQ ID NO: 730123 - DNA, 20 bp, Artificial
  CRISPR gRNA sequence
atggggaaattacctggatc

SEQ ID NO: 730124 - DNA, 20 bp, Artificial
  CRISPR gRNA sequence
cctggatctgaactaggcct

SEQ ID NO: 730125 - DNA, 20 bp, Artificial
  CRISPR gRNA sequence
gatctgaactaggccttccc

SEQ ID NO: 730126 - DNA, 20 bp, Artificial
  CRISPR gRNA sequence
aactaggccttcccacagag

SEQ ID NO: 730127 - DNA, 20 bp, Artificial
  CRISPR gRNA sequence
ggccttcccacagaggaggg

SEQ ID NO: 730128 - DNA, 20 bp, Artificial
  CRISPR gRNA sequence
cccacagaggagggagagtc

SEQ ID NO: 730129 - DNA, 20 bp, Artificial
  CRISPR gRNA sequence
ccacagaggagggagagtcg

SEQ ID NO: 730130 - DNA, 20 bp, Artificial
  CRISPR gRNA sequence
gtcagtttagaagcagcttc

SEQ ID NO: 730131 - DNA, 20 bp, Artificial
  CRISPR gRNA sequence
agaagcagcttcctgggcga

SEQ ID NO: 730132 - DNA, 20 bp, Artificial
  CRISPR gRNA sequence
gaagcagcttcctgggcgag

SEQ ID NO: 730133 - DNA, 20 bp, Artificial
  CRISPR gRNA sequence
cctgggcgaggcgggtgccc

SEQ ID NO: 730134 - DNA, 20 bp, Artificial
  CRISPR gRNA sequence
ctgggcgaggcgggtgcccc

SEQ ID NO: 730135 - DNA, 20 bp, Artificial
  CRISPR gRNA sequence
ggcgaggcgggtgccccctc

SEQ ID NO: 730136 - DNA, 20 bp, Artificial
  CRISPR gRNA sequence
ttacaggcatggtgctggca

SEQ ID NO: 730137 - DNA, 20 bp, Artificial
  CRISPR gRNA sequence
acaggcatggtgctggcact

SEQ ID NO: 730138 - DNA, 20 bp, Artificial
  CRISPR gRNA sequence
caggcatggtgctggcactg

SEQ ID NO: 730139 - DNA, 20 bp, Artificial
  CRISPR gRNA sequence
gcactggaggttgctgggga

SEQ ID NO: 730140 - DNA, 20 bp, Artificial
  CRISPR gRNA sequence
gaggttgctggggacaccgg

SEQ ID NO: 730141 - DNA, 20 bp, Artificial
  CRISPR gRNA sequence
ctggggacaccggggtgggc

SEQ ID NO: 730142 - DNA, 20 bp, Artificial
  CRISPR gRNA sequence
gggacaccggggtgggcttg

SEQ ID NO: 730143 - DNA, 20 bp, Artificial
  CRISPR gRNA sequence
ggcctgggggatggtgccac

SEQ ID NO: 730144 - DNA, 20 bp, Artificial
  CRISPR gRNA sequence
gcctgggggatggtgccact

SEQ ID NO: 730145 - DNA, 20 bp, Artificial
  CRISPR gRNA sequence
ggggatggtgccactgggga

SEQ ID NO: 730146 - DNA, 20 bp, Artificial
  CRISPR gRNA sequence
gggaagaagccagagatggg

SEQ ID NO: 730147 - DNA, 20 bp, Artificial
  CRISPR gRNA sequence
ataattctgccaatggggca

SEQ ID NO: 730148 - DNA, 20 bp, Artificial
  CRISPR gRNA sequence
tgccaatggggcaagggagg

SEQ ID NO: 730149 - DNA, 20 bp, Artificial
  CRISPR gRNA sequence
ccaatggggcaagggaggcc

SEQ ID NO: 730150 - DNA, 20 bp, Artificial
  CRISPR gRNA sequence
tgctcacgagtaacagtttc

SEQ ID NO: 730151 - DNA, 20 bp, Artificial
  CRISPR gRNA sequence
acgagtaacagtttccacag

SEQ ID NO: 730152 - DNA, 20 bp, Artificial
  CRISPR gRNA sequence
ccacagagatggggtcccag

SEQ ID NO: 730153 - DNA, 20 bp, Artificial
  CRISPR gRNA sequence
cacagagatggggtcccagg

SEQ ID NO: 730154 - DNA, 20 bp, Artificial
  CRISPR gRNA sequence
ggcccactgcctctggcggg

SEQ ID NO: 730155 - DNA, 20 bp, Artificial
  CRISPR gRNA sequence
gcccactgcctctggcgggc

SEQ ID NO: 730156 - DNA, 20 bp, Artificial
  CRISPR gRNA sequence
cctctggcgggcccactgta

SEQ ID NO: 730157 - DNA, 20 bp, Artificial
  CRISPR gRNA sequence
tggcgggcccactgtaagct

SEQ ID NO: 730158 - DNA, 20 bp, Artificial
  CRISPR gRNA sequence
gcgggcccactgtaagctcc

SEQ ID NO: 730159 - DNA, 20 bp, Artificial
  CRISPR gRNA sequence
taagctcctgggagcaaggc

SEQ ID NO: 730160 - DNA, 20 bp, Artificial
  CRISPR gRNA sequence
ctgggagcaaggcctgtgtt

SEQ ID NO: 730161 - DNA, 20 bp, Artificial
  CRISPR gRNA sequence
ggagcaaggcctgtgttttc

SEQ ID NO: 730162 - DNA, 20 bp, Artificial
  CRISPR gRNA sequence
tgttttctaagccctgtggg

SEQ ID NO: 730163 - DNA, 20 bp, Artificial
  CRISPR gRNA sequence
tctaagccctgtgggtctcc

SEQ ID NO: 730164 - DNA, 20 bp, Artificial
  CRISPR gRNA sequence
ctaagccctgtgggtctccc

SEQ ID NO: 730165 - DNA, 20 bp, Artificial
  CRISPR gRNA sequence
taagccctgtgggtctccca

SEQ ID NO: 730166 - DNA, 20 bp, Artificial
  CRISPR gRNA sequence
agccctgtgggtctcccatg

SEQ ID NO: 730167 - DNA, 20 bp, Artificial
  CRISPR gRNA sequence
tgggtctcccatgtgctcag

SEQ ID NO: 730168 - DNA, 20 bp, Artificial
  CRISPR gRNA sequence
ccatgtgctcagggcagggc

SEQ ID NO: 730169 - DNA, 20 bp, Artificial
  CRISPR gRNA sequence
agggcagggctgggcacacc

SEQ ID NO: 730170 - DNA, 20 bp, Artificial
  CRISPR gRNA sequence
ggcacaccctagggcctcaa

SEQ ID NO: 730171 - DNA, 20 bp, Artificial
  CRISPR gRNA sequence
gggcctcaaatgatctgagg

SEQ ID NO: 730172 - DNA, 20 bp, Artificial
  CRISPR gRNA sequence
aaatgatctgaggggcttgg

SEQ ID NO: 730173 - DNA, 20 bp, Artificial
  CRISPR gRNA sequence
aggggcttggcagagaggca

SEQ ID NO: 730174 - DNA, 20 bp, Artificial
  CRISPR gRNA sequence
ggcagagaggcaccccaaag

SEQ ID NO: 730175 - DNA, 20 bp, Artificial
  CRISPR gRNA sequence
gcagagaggcaccccaaagt

SEQ ID NO: 730176 - DNA, 20 bp, Artificial
  CRISPR gRNA sequence
acaccatgggctgaatcccg

SEQ ID NO: 730177 - DNA, 20 bp, Artificial
  CRISPR gRNA sequence
aatcccgcttacacccccag

SEQ ID NO: 730178 - DNA, 20 bp, Artificial
  CRISPR gRNA sequence
acacccccagcccagttgta

SEQ ID NO: 730179 - DNA, 20 bp, Artificial
  CRISPR gRNA sequence
cacccccagcccagttgtac

SEQ ID NO: 730180 - DNA, 20 bp, Artificial
  CRISPR gRNA sequence
taccatgggcgtcctgtggg

SEQ ID NO: 730181 - DNA, 20 bp, Artificial
  CRISPR gRNA sequence
tggggtggggcagcctcatc

SEQ ID NO: 730182 - DNA, 20 bp, Artificial
  CRISPR gRNA sequence
atctgaaagccagcttgggg

SEQ ID NO: 730183 - DNA, 20 bp, Artificial
  CRISPR gRNA sequence
aaagccagcttgggggaaga

SEQ ID NO: 730184 - DNA, 20 bp, Artificial
  CRISPR gRNA sequence
gggggaagaggaggaggcaa

SEQ ID NO: 730185 - DNA, 20 bp, Artificial
  CRISPR gRNA sequence
ggggaagaggaggaggcaaa

SEQ ID NO: 730186 - DNA, 20 bp, Artificial
  CRISPR gRNA sequence
gagggttccttgcagttctc

SEQ ID NO: 730187 - DNA, 20 bp, Artificial
  CRISPR gRNA sequence
cttgcagttctctgggctgg

SEQ ID NO: 730188 - DNA, 20 bp, Artificial
  CRISPR gRNA sequence
gcagttctctgggctggcac

SEQ ID NO: 730189 - DNA, 20 bp, Artificial
  CRISPR gRNA sequence
cagttctctgggctggcaca

SEQ ID NO: 730190 - DNA, 20 bp, Artificial
  CRISPR gRNA sequence
tctgggctggcacaggcagg

SEQ ID NO: 730191 - DNA, 20 bp, Artificial
  CRISPR gRNA sequence
tgggctggcacaggcagggc

SEQ ID NO: 730192 - DNA, 20 bp, Artificial
  CRISPR gRNA sequence
ggctggcacaggcagggctg

SEQ ID NO: 730193 - DNA, 20 bp, Artificial
  CRISPR gRNA sequence
gcacaggcagggctgacccc

SEQ ID NO: 730194 - DNA, 20 bp, Artificial
  CRISPR gRNA sequence
acccctggggaagccggctc

SEQ ID NO: 730195 - DNA, 20 bp, Artificial
  CRISPR gRNA sequence
gggaagccggctcacagacc

SEQ ID NO: 730196 - DNA, 20 bp, Artificial
  CRISPR gRNA sequence
acagaccgtgttcttctgcg

SEQ ID NO: 730197 - DNA, 20 bp, Artificial
  CRISPR gRNA sequence
ttctgcgccgtgcctgcagg

SEQ ID NO: 730198 - DNA, 20 bp, Artificial
  CRISPR gRNA sequence
ctgcgccgtgcctgcagggg

SEQ ID NO: 730199 - DNA, 20 bp, Artificial
  CRISPR gRNA sequence
tgcgccgtgcctgcaggggg

SEQ ID NO: 730200 - DNA, 20 bp, Artificial
  CRISPR gRNA sequence
cgccgtgcctgcagggggga

SEQ ID NO: 730201 - DNA, 20 bp, Artificial
  CRISPR gRNA sequence
caggggggacagcagtgcct

SEQ ID NO: 730202 - DNA, 20 bp, Artificial
  CRISPR gRNA sequence
cagaatcagtgttggggacc

SEQ ID NO: 730203 - DNA, 20 bp, Artificial
  CRISPR gRNA sequence
agaatcagtgttggggaccc

SEQ ID NO: 730204 - DNA, 20 bp, Artificial
  CRISPR gRNA sequence
gggacccaaagtctcccgga

SEQ ID NO: 730205 - DNA, 20 bp, Artificial
  CRISPR gRNA sequence
ccggaatacacccttcacta

SEQ ID NO: 730206 - DNA, 20 bp, Artificial
  CRISPR gRNA sequence
cactaccacaggccagagtc

SEQ ID NO: 730207 - DNA, 20 bp, Artificial
  CRISPR gRNA sequence
actaccacaggccagagtcg

SEQ ID NO: 730208 - DNA, 20 bp, Artificial
  CRISPR gRNA sequence
ccacaggccagagtcggaga

SEQ ID NO: 730209 - DNA, 20 bp, Artificial
  CRISPR gRNA sequence
ggaaaacacagcagtcatct

SEQ ID NO: 730210 - DNA, 20 bp, Artificial
  CRISPR gRNA sequence
gaaaacacagcagtcatctg

SEQ ID NO: 730211 - DNA, 20 bp, Artificial
  CRISPR gRNA sequence
gaggtggcacccgcctggca

SEQ ID NO: 730212 - DNA, 20 bp, Artificial
  CRISPR gRNA sequence
gcacccgttccccttcagag

SEQ ID NO: 730213 - DNA, 20 bp, Artificial
  CRISPR gRNA sequence
cccttcagagtaaagcagcc

SEQ ID NO: 730214 - DNA, 20 bp, Artificial
  CRISPR gRNA sequence
cagagtaaagcagcctatct

SEQ ID NO: 730215 - DNA, 20 bp, Artificial
  CRISPR gRNA sequence
agagtaaagcagcctatctt

SEQ ID NO: 730216 - DNA, 20 bp, Artificial
  CRISPR gRNA sequence
tctttccctggggaattact

SEQ ID NO: 730217 - DNA, 20 bp, Artificial
  CRISPR gRNA sequence
tccctggggaattactctcc

SEQ ID NO: 730218 - DNA, 20 bp, Artificial
  CRISPR gRNA sequence
ccctggggaattactctccc

SEQ ID NO: 730219 - DNA, 20 bp, Artificial
  CRISPR gRNA sequence
cctggggaattactctccct

SEQ ID NO: 730220 - DNA, 20 bp, Artificial
  CRISPR gRNA sequence
gggaattactctccctctga

SEQ ID NO: 730221 - DNA, 20 bp, Artificial
  CRISPR gRNA sequence
ctctccctctgatctcagca

SEQ ID NO: 730222 - DNA, 20 bp, Artificial
  CRISPR gRNA sequence
tccctctgatctcagcatct

SEQ ID NO: 730223 - DNA, 20 bp, Artificial
  CRISPR gRNA sequence
cctctgatctcagcatctgt

SEQ ID NO: 730224 - DNA, 20 bp, Artificial
  CRISPR gRNA sequence
tgatctcagcatctgtggtt

SEQ ID NO: 730225 - DNA, 20 bp, Artificial
  CRISPR gRNA sequence
atctcagcatctgtggttag

SEQ ID NO: 730226 - DNA, 20 bp, Artificial
  CRISPR gRNA sequence
agcatctgtggttaggggtt

SEQ ID NO: 730227 - DNA, 20 bp, Artificial
  CRISPR gRNA sequence
tggttaggggttgggaccga

SEQ ID NO: 730228 - DNA, 20 bp, Artificial
  CRISPR gRNA sequence
ggggttgggaccgactgaac

SEQ ID NO: 730229 - DNA, 20 bp, Artificial
  CRISPR gRNA sequence
ggaccgactgaacccccttt

SEQ ID NO: 730230 - DNA, 20 bp, Artificial
  CRISPR gRNA sequence
aaccccctttcccgagtggc

SEQ ID NO: 730231 - DNA, 20 bp, Artificial
  CRISPR gRNA sequence
tcccgagtggccatgagacc

SEQ ID NO: 730232 - DNA, 20 bp, Artificial
  CRISPR gRNA sequence
cccgagtggccatgagacca

SEQ ID NO: 730233 - DNA, 20 bp, Artificial
  CRISPR gRNA sequence
ccgagtggccatgagaccag

SEQ ID NO: 730234 - DNA, 20 bp, Artificial
  CRISPR gRNA sequence
gaccaatcaatccgttgcat

SEQ ID NO: 730235 - DNA, 20 bp, Artificial
  CRISPR gRNA sequence
cattcctctggccacgatga

SEQ ID NO: 730236 - DNA, 20 bp, Artificial
  CRISPR gRNA sequence
ctctggccacgatgagccag

SEQ ID NO: 730237 - DNA, 20 bp, Artificial
  CRISPR gRNA sequence
tggccacgatgagccagttc

SEQ ID NO: 730238 - DNA, 20 bp, Artificial
  CRISPR gRNA sequence
gccacgatgagccagttcag

SEQ ID NO: 730239 - DNA, 20 bp, Artificial
  CRISPR gRNA sequence
agggacggacatgtgaccca

SEQ ID NO: 730240 - DNA, 20 bp, Artificial
  CRISPR gRNA sequence
tgaggtagaatttaaagatt

SEQ ID NO: 730241 - DNA, 20 bp, Artificial
  CRISPR gRNA sequence
aaagattctggtttgggatt

SEQ ID NO: 730242 - DNA, 20 bp, Artificial
  CRISPR gRNA sequence
aagattctggtttgggattt

SEQ ID NO: 730243 - DNA, 20 bp, Artificial
  CRISPR gRNA sequence
tggtttgggatttaaaggtt

SEQ ID NO: 730244 - DNA, 20 bp, Artificial
  CRISPR gRNA sequence
gtttgggatttaaaggtttt

SEQ ID NO: 730245 - DNA, 20 bp, Artificial
  CRISPR gRNA sequence
gggatttaaaggttttggtt

SEQ ID NO: 730246 - DNA, 20 bp, Artificial
  CRISPR gRNA sequence
ggatttaaaggttttggttt

SEQ ID NO: 730247 - DNA, 20 bp, Artificial
  CRISPR gRNA sequence
aaaggttttggttttggata

SEQ ID NO: 730248 - DNA, 20 bp, Artificial
  CRISPR gRNA sequence
aaggttttggttttggatat

SEQ ID NO: 730249 - DNA, 20 bp, Artificial
  CRISPR gRNA sequence
tggttttggatattaaaaat

SEQ ID NO: 730250 - DNA, 20 bp, Artificial
  CRISPR gRNA sequence
ggttttggatattaaaaatg

SEQ ID NO: 730251 - DNA, 20 bp, Artificial
  CRISPR gRNA sequence
gttttggatattaaaaatgt

SEQ ID NO: 730252 - DNA, 20 bp, Artificial
  CRISPR gRNA sequence
tggatattaaaaatgtaaga

SEQ ID NO: 730253 - DNA, 20 bp, Artificial
  CRISPR gRNA sequence
ggatattaaaaatgtaagaa

SEQ ID NO: 730254 - DNA, 20 bp, Artificial
  CRISPR gRNA sequence
gatattaaaaatgtaagaaa

SEQ ID NO: 730255 - DNA, 20 bp, Artificial
  CRISPR gRNA sequence
aaaatgtaagaaagggaagc

SEQ ID NO: 730256 - DNA, 20 bp, Artificial
  CRISPR gRNA sequence
tcttcccactggcgctgggc

SEQ ID NO: 730257 - DNA, 20 bp, Artificial
  CRISPR gRNA sequence
cccactggcgctgggcagag

SEQ ID NO: 730258 - DNA, 20 bp, Artificial
  CRISPR gRNA sequence
ccactggcgctgggcagagc

SEQ ID NO: 730259 - DNA, 20 bp, Artificial
  CRISPR gRNA sequence
gcgctgggcagagctgcttg

SEQ ID NO: 730260 - DNA, 20 bp, Artificial
  CRISPR gRNA sequence
ggcagagctgcttgtaagta

SEQ ID NO: 730261 - DNA, 20 bp, Artificial
  CRISPR gRNA sequence
cttgtaagtatcttgccgat

SEQ ID NO: 730262 - DNA, 20 bp, Artificial
  CRISPR gRNA sequence
gtaagtatcttgccgatgaa

SEQ ID NO: 730263 - DNA, 20 bp, Artificial
  CRISPR gRNA sequence
taagtatcttgccgatgaac

SEQ ID NO: 730264 - DNA, 20 bp, Artificial
  CRISPR gRNA sequence
gccgatgaaccaacagagag

SEQ ID NO: 730265 - DNA, 20 bp, Artificial
  CRISPR gRNA sequence
ccgatgaaccaacagagagg

SEQ ID NO: 730266 - DNA, 20 bp, Artificial
  CRISPR gRNA sequence
gatccagccatgcctgaagc

SEQ ID NO: 730267 - DNA, 20 bp, Artificial
  CRISPR gRNA sequence
aagcttctcagagctatccc

SEQ ID NO: 730268 - DNA, 20 bp, Artificial
  CRISPR gRNA sequence
ctcagagctatccccagact

SEQ ID NO: 730269 - DNA, 20 bp, Artificial
  CRISPR gRNA sequence
tcagagctatccccagactt

SEQ ID NO: 730270 - DNA, 20 bp, Artificial
  CRISPR gRNA sequence
agagctatccccagactttt

SEQ ID NO: 730271 - DNA, 20 bp, Artificial
  CRISPR gRNA sequence
tccccagacttttaagctac

SEQ ID NO: 730272 - DNA, 20 bp, Artificial
  CRISPR gRNA sequence
ttaagctacatgtgctaaaa

SEQ ID NO: 730273 - DNA, 20 bp, Artificial
  CRISPR gRNA sequence
taagctacatgtgctaaaaa

SEQ ID NO: 730274 - DNA, 20 bp, Artificial
  CRISPR gRNA sequence
aagctacatgtgctaaaaaa

SEQ ID NO: 730275 - DNA, 20 bp, Artificial
  CRISPR gRNA sequence
agctacatgtgctaaaaaat

SEQ ID NO: 730276 - DNA, 20 bp, Artificial
  CRISPR gRNA sequence
catgtgctaaaaaattgggg

SEQ ID NO: 730277 - DNA, 20 bp, Artificial
  CRISPR gRNA sequence
aaaaattggggattttgcta

SEQ ID NO: 730278 - DNA, 20 bp, Artificial
  CRISPR gRNA sequence
gggattttgctacatgcaat

SEQ ID NO: 730279 - DNA, 20 bp, Artificial
  CRISPR gRNA sequence
tgctacatgcaatccaagga

SEQ ID NO: 730280 - DNA, 20 bp, Artificial
  CRISPR gRNA sequence
gctacatgcaatccaaggag

SEQ ID NO: 730281 - DNA, 20 bp, Artificial
  CRISPR gRNA sequence
ctacatgcaatccaaggagt

SEQ ID NO: 730282 - DNA, 20 bp, Artificial
  CRISPR gRNA sequence
catgcaatccaaggagtcct

SEQ ID NO: 730283 - DNA, 20 bp, Artificial
  CRISPR gRNA sequence
aagaatgctggacagaagca

SEQ ID NO: 730284 - DNA, 20 bp, Artificial
  CRISPR gRNA sequence
gacagaagcagagtggagaa

SEQ ID NO: 730285 - DNA, 20 bp, Artificial
  CRISPR gRNA sequence
gccagtgcccctcagtttgc

SEQ ID NO: 730286 - DNA, 20 bp, Artificial
  CRISPR gRNA sequence
agtttgcctgctatgtccta

SEQ ID NO: 730287 - DNA, 20 bp, Artificial
  CRISPR gRNA sequence
gcctgctatgtcctaactgt

SEQ ID NO: 730288 - DNA, 20 bp, Artificial
  CRISPR gRNA sequence
cctgctatgtcctaactgtg

SEQ ID NO: 730289 - DNA, 20 bp, Artificial
  CRISPR gRNA sequence
ctatgtcctaactgtgccag

SEQ ID NO: 730290 - DNA, 20 bp, Artificial
  CRISPR gRNA sequence
tgtcctaactgtgccaggaa

SEQ ID NO: 730291 - DNA, 20 bp, Artificial
  CRISPR gRNA sequence
actgtgccaggaaagtccat

SEQ ID NO: 730292 - DNA, 20 bp, Artificial
  CRISPR gRNA sequence
tgccaggaaagtccatttta

SEQ ID NO: 730293 - DNA, 20 bp, Artificial
  CRISPR gRNA sequence
tatttacttgtttatttatt

SEQ ID NO: 730294 - DNA, 20 bp, Artificial
  CRISPR gRNA sequence
atttacttgtttatttattt

SEQ ID NO: 730295 - DNA, 20 bp, Artificial
  CRISPR gRNA sequence
tttacttgtttatttattta

SEQ ID NO: 730296 - DNA, 20 bp, Artificial
  CRISPR gRNA sequence
acttgtttatttatttattt

SEQ ID NO: 730297 - DNA, 20 bp, Artificial
  CRISPR gRNA sequence
cttgtttatttatttatttg

SEQ ID NO: 730298 - DNA, 20 bp, Artificial
  CRISPR gRNA sequence
gtttatttatttatttgaga

SEQ ID NO: 730299 - DNA, 20 bp, Artificial
  CRISPR gRNA sequence
tttatttatttatttgagac

SEQ ID NO: 730300 - DNA, 20 bp, Artificial
  CRISPR gRNA sequence
atttatttatttgagacaga

SEQ ID NO: 730301 - DNA, 20 bp, Artificial
  CRISPR gRNA sequence
tttatttatttgagacagag

SEQ ID NO: 730302 - DNA, 20 bp, Artificial
  CRISPR gRNA sequence
atttatttgagacagagtct

SEQ ID NO: 730303 - DNA, 20 bp, Artificial
  CRISPR gRNA sequence
tttatttgagacagagtctt

SEQ ID NO: 730304 - DNA, 20 bp, Artificial
  CRISPR gRNA sequence
atttgagacagagtcttact

SEQ ID NO: 730305 - DNA, 20 bp, Artificial
  CRISPR gRNA sequence
tttgagacagagtcttactc

SEQ ID NO: 730306 - DNA, 20 bp, Artificial
  CRISPR gRNA sequence
gagacagagtcttactctgt

SEQ ID NO: 730307 - DNA, 20 bp, Artificial
  CRISPR gRNA sequence
agacagagtcttactctgtc

SEQ ID NO: 730308 - DNA, 20 bp, Artificial
  CRISPR gRNA sequence
actctgtcgcccaggctgga

SEQ ID NO: 730309 - DNA, 20 bp, Artificial
  CRISPR gRNA sequence
ctctgtcgcccaggctggag

SEQ ID NO: 730310 - DNA, 20 bp, Artificial
  CRISPR gRNA sequence
tgtcgcccaggctggagtgc

SEQ ID NO: 730311 - DNA, 20 bp, Artificial
  CRISPR gRNA sequence
tcgcccaggctggagtgcag

SEQ ID NO: 730312 - DNA, 20 bp, Artificial
  CRISPR gRNA sequence
gagtgcagtgatgcaatctc

SEQ ID NO: 730313 - DNA, 20 bp, Artificial
  CRISPR gRNA sequence
agctcactgcaacctctgcc

SEQ ID NO: 730314 - DNA, 20 bp, Artificial
  CRISPR gRNA sequence
actgcaacctctgcctccca

SEQ ID NO: 730315 - DNA, 20 bp, Artificial
  CRISPR gRNA sequence
caacctctgcctcccaggtt

SEQ ID NO: 730316 - DNA, 20 bp, Artificial
  CRISPR gRNA sequence
tgcctcccaggttcaagcaa

SEQ ID NO: 730317 - DNA, 20 bp, Artificial
  CRISPR gRNA sequence
cctcccaggttcaagcaatt

SEQ ID NO: 730318 - DNA, 20 bp, Artificial
  CRISPR gRNA sequence
ccaggttcaagcaattctcc

SEQ ID NO: 730319 - DNA, 20 bp, Artificial
  CRISPR gRNA sequence
aagcaattctcctgcctcag

SEQ ID NO: 730320 - DNA, 20 bp, Artificial
  CRISPR gRNA sequence
tcctgcctcagcctcctgag

SEQ ID NO: 730321 - DNA, 20 bp, Artificial
  CRISPR gRNA sequence
ctgcctcagcctcctgagta

SEQ ID NO: 730322 - DNA, 20 bp, Artificial
  CRISPR gRNA sequence
cctcagcctcctgagtagct

SEQ ID NO: 730323 - DNA, 20 bp, Artificial
  CRISPR gRNA sequence
agcctcctgagtagctggga

SEQ ID NO: 730324 - DNA, 20 bp, Artificial
  CRISPR gRNA sequence
ctgagtagctgggattacag

SEQ ID NO: 730325 - DNA, 20 bp, Artificial
  CRISPR gRNA sequence
agtagctgggattacaggtg

SEQ ID NO: 730326 - DNA, 20 bp, Artificial
  CRISPR gRNA sequence
ggattacaggtgcctgcaac

SEQ ID NO: 730327 - DNA, 20 bp, Artificial
  CRISPR gRNA sequence
caggtgcctgcaaccacgcc

SEQ ID NO: 730328 - DNA, 20 bp, Artificial
  CRISPR gRNA sequence
caaccacgcccggctaattt

SEQ ID NO: 730329 - DNA, 20 bp, Artificial
  CRISPR gRNA sequence
atttttagtagagacagggt

SEQ ID NO: 730330 - DNA, 20 bp, Artificial
  CRISPR gRNA sequence
ttagtagagacagggtttcg

SEQ ID NO: 730331 - DNA, 20 bp, Artificial
  CRISPR gRNA sequence
tagtagagacagggtttcgc

SEQ ID NO: 730332 - DNA, 20 bp, Artificial
  CRISPR gRNA sequence
agtagagacagggtttcgcc

SEQ ID NO: 730333 - DNA, 20 bp, Artificial
  CRISPR gRNA sequence
gtagagacagggtttcgcca

SEQ ID NO: 730334 - DNA, 20 bp, Artificial
  CRISPR gRNA sequence
cgccatgttggccaggctgg

SEQ ID NO: 730335 - DNA, 20 bp, Artificial
  CRISPR gRNA sequence
gccatgttggccaggctggt

SEQ ID NO: 730336 - DNA, 20 bp, Artificial
  CRISPR gRNA sequence
gccaggctggtctcgaactc

SEQ ID NO: 730337 - DNA, 20 bp, Artificial
  CRISPR gRNA sequence
gtctcgaactcctgacctca

SEQ ID NO: 730338 - DNA, 20 bp, Artificial
  CRISPR gRNA sequence
gaactcctgacctcaggtga

SEQ ID NO: 730339 - DNA, 20 bp, Artificial
  CRISPR gRNA sequence
ctgacctcaggtgatccacc

SEQ ID NO: 730340 - DNA, 20 bp, Artificial
  CRISPR gRNA sequence
acctcaggtgatccaccctc

SEQ ID NO: 730341 - DNA, 20 bp, Artificial
  CRISPR gRNA sequence
aggtgatccaccctcctcag

SEQ ID NO: 730342 - DNA, 20 bp, Artificial
  CRISPR gRNA sequence
ctcagcctcccaaagtgctg

SEQ ID NO: 730343 - DNA, 20 bp, Artificial
  CRISPR gRNA sequence
agcctcccaaagtgctggga

SEQ ID NO: 730344 - DNA, 20 bp, Artificial
  CRISPR gRNA sequence
ccaaagtgctgggatttcag

SEQ ID NO: 730345 - DNA, 20 bp, Artificial
  CRISPR gRNA sequence
ggatttcaggcataagctgc

SEQ ID NO: 730346 - DNA, 20 bp, Artificial
  CRISPR gRNA sequence
caggcataagctgccgtgcc

SEQ ID NO: 730347 - DNA, 20 bp, Artificial
  CRISPR gRNA sequence
aggcataagctgccgtgccc

SEQ ID NO: 730348 - DNA, 20 bp, Artificial
  CRISPR gRNA sequence
ccgtgcccagcccagtcaaa

SEQ ID NO: 730349 - DNA, 20 bp, Artificial
  CRISPR gRNA sequence
taatcatacactcttcacca

SEQ ID NO: 730350 - DNA, 20 bp, Artificial
  CRISPR gRNA sequence
ttcaccaggctgtcgtcagg

SEQ ID NO: 730351 - DNA, 20 bp, Artificial
  CRISPR gRNA sequence
caccaggctgtcgtcaggat

SEQ ID NO: 730352 - DNA, 20 bp, Artificial
  CRISPR gRNA sequence
accaggctgtcgtcaggata

SEQ ID NO: 730353 - DNA, 20 bp, Artificial
  CRISPR gRNA sequence
tcgtcaggataaacagaaga

SEQ ID NO: 730354 - DNA, 20 bp, Artificial
  CRISPR gRNA sequence
catgacatatggtaaatgct

SEQ ID NO: 730355 - DNA, 20 bp, Artificial
  CRISPR gRNA sequence
tgtccttacacccatctgga

SEQ ID NO: 730356 - DNA, 20 bp, Artificial
  CRISPR gRNA sequence
acacccatctggactcccat

SEQ ID NO: 730357 - DNA, 20 bp, Artificial
  CRISPR gRNA sequence
cacccatctggactcccatc

SEQ ID NO: 730358 - DNA, 20 bp, Artificial
  CRISPR gRNA sequence
gactcccatcccaacactta

SEQ ID NO: 730359 - DNA, 20 bp, Artificial
  CRISPR gRNA sequence
ccatcccaacacttagaagg

SEQ ID NO: 730360 - DNA, 20 bp, Artificial
  CRISPR gRNA sequence
agaaggtgacccgtatgtcg

SEQ ID NO: 730361 - DNA, 20 bp, Artificial
  CRISPR gRNA sequence
gaaggtgacccgtatgtcgc

SEQ ID NO: 730362 - DNA, 20 bp, Artificial
  CRISPR gRNA sequence
acacctgtaatcccaacact

SEQ ID NO: 730363 - DNA, 20 bp, Artificial
  CRISPR gRNA sequence
taatcccaacactttgggag

SEQ ID NO: 730364 - DNA, 20 bp, Artificial
  CRISPR gRNA sequence
tgggaggccgaggtgggcgg

SEQ ID NO: 730365 - DNA, 20 bp, Artificial
  CRISPR gRNA sequence
gggaggccgaggtgggcgga

SEQ ID NO: 730366 - DNA, 20 bp, Artificial
  CRISPR gRNA sequence
ggaggccgaggtgggcggat

SEQ ID NO: 730367 - DNA, 20 bp, Artificial
  CRISPR gRNA sequence
gagaccagcctggacaacat

SEQ ID NO: 730368 - DNA, 20 bp, Artificial
  CRISPR gRNA sequence
gacaacatagtgaaacccca

SEQ ID NO: 730369 - DNA, 20 bp, Artificial
  CRISPR gRNA sequence
tactaaaattacaaaaaatt

SEQ ID NO: 730370 - DNA, 20 bp, Artificial
  CRISPR gRNA sequence
ctaaaattacaaaaaattag

SEQ ID NO: 730371 - DNA, 20 bp, Artificial
  CRISPR gRNA sequence
aaattacaaaaaattagccg

SEQ ID NO: 730372 - DNA, 20 bp, Artificial
  CRISPR gRNA sequence
caaaaaattagccgggcatg

SEQ ID NO: 730373 - DNA, 20 bp, Artificial
  CRISPR gRNA sequence
gccgggcatggtggcaggta

SEQ ID NO: 730374 - DNA, 20 bp, Artificial
  CRISPR gRNA sequence
taatcccagctactcaggag

SEQ ID NO: 730375 - DNA, 20 bp, Artificial
  CRISPR gRNA sequence
ctcaggaggctgaggcagga

SEQ ID NO: 730376 - DNA, 20 bp, Artificial
  CRISPR gRNA sequence
aggaggctgaggcaggagaa

SEQ ID NO: 730377 - DNA, 20 bp, Artificial
  CRISPR gRNA sequence
aggcaggagaatcacttgaa

SEQ ID NO: 730378 - DNA, 20 bp, Artificial
  CRISPR gRNA sequence
gaatccgggaggcagaggtt

SEQ ID NO: 730379 - DNA, 20 bp, Artificial
  CRISPR gRNA sequence
aatccgggaggcagaggttg

SEQ ID NO: 730380 - DNA, 20 bp, Artificial
  CRISPR gRNA sequence
cagtgagctgagatcacacc

SEQ ID NO: 730381 - DNA, 20 bp, Artificial
  CRISPR gRNA sequence
agatcacaccattgcactct

SEQ ID NO: 730382 - DNA, 20 bp, Artificial
  CRISPR gRNA sequence
cactctagtctgggtgacag

SEQ ID NO: 730383 - DNA, 20 bp, Artificial
  CRISPR gRNA sequence
tagtctgggtgacagatcga

SEQ ID NO: 730384 - DNA, 20 bp, Artificial
  CRISPR gRNA sequence
gtctgggtgacagatcgagg

SEQ ID NO: 730385 - DNA, 20 bp, Artificial
  CRISPR gRNA sequence
ggtgacagatcgaggctcca

SEQ ID NO: 730386 - DNA, 20 bp, Artificial
  CRISPR gRNA sequence
catcacaaaaaaaaaaaaaa

SEQ ID NO: 730387 - DNA, 20 bp, Artificial
  CRISPR gRNA sequence
tatgtgtgggacttcgctct

SEQ ID NO: 730388 - DNA, 20 bp, Artificial
  CRISPR gRNA sequence
cgctctgaagctttccgtgg

SEQ ID NO: 730389 - DNA, 20 bp, Artificial
  CRISPR gRNA sequence
gctctgaagctttccgtgga

SEQ ID NO: 730390 - DNA, 20 bp, Artificial
  CRISPR gRNA sequence
tgaagctttccgtggaggtg

SEQ ID NO: 730391 - DNA, 20 bp, Artificial
  CRISPR gRNA sequence
aagctttccgtggaggtgag

SEQ ID NO: 730392 - DNA, 20 bp, Artificial
  CRISPR gRNA sequence
tccgtggaggtgagcgcgag

SEQ ID NO: 730393 - DNA, 20 bp, Artificial
  CRISPR gRNA sequence
ccgtggaggtgagcgcgagc

SEQ ID NO: 730394 - DNA, 20 bp, Artificial
  CRISPR gRNA sequence
cgtggaggtgagcgcgagca

SEQ ID NO: 730395 - DNA, 20 bp, Artificial
  CRISPR gRNA sequence
acctctcgtgttctgtggca

SEQ ID NO: 730396 - DNA, 20 bp, Artificial
  CRISPR gRNA sequence
tcgtgttctgtggcatggtg

SEQ ID NO: 730397 - DNA, 20 bp, Artificial
  CRISPR gRNA sequence
gtgttctgtggcatggtgga

SEQ ID NO: 730398 - DNA, 20 bp, Artificial
  CRISPR gRNA sequence
tgtggcatggtggagtgatg

SEQ ID NO: 730399 - DNA, 20 bp, Artificial
  CRISPR gRNA sequence
tggcatggtggagtgatgac

SEQ ID NO: 730400 - DNA, 20 bp, Artificial
  CRISPR gRNA sequence
agcttagacatttcctgctc

SEQ ID NO: 730401 - DNA, 20 bp, Artificial
  CRISPR gRNA sequence
agacatttcctgctctgtct

SEQ ID NO: 730402 - DNA, 20 bp, Artificial
  CRISPR gRNA sequence
gacatttcctgctctgtctc

SEQ ID NO: 730403 - DNA, 20 bp, Artificial
  CRISPR gRNA sequence
cctgctctgtctccgcgggc

SEQ ID NO: 730404 - DNA, 20 bp, Artificial
  CRISPR gRNA sequence
ctgctctgtctccgcgggca

SEQ ID NO: 730405 - DNA, 20 bp, Artificial
  CRISPR gRNA sequence
ctctgtctccgcgggcaatt

SEQ ID NO: 730406 - DNA, 20 bp, Artificial
  CRISPR gRNA sequence
tgtctccgcgggcaatttac

SEQ ID NO: 730407 - DNA, 20 bp, Artificial
  CRISPR gRNA sequence
tctccgcgggcaatttacct

SEQ ID NO: 730408 - DNA, 20 bp, Artificial
  CRISPR gRNA sequence
cgcgggcaatttacctccca

SEQ ID NO: 730409 - DNA, 20 bp, Artificial
  CRISPR gRNA sequence
acctcccatctccggacctc

SEQ ID NO: 730410 - DNA, 20 bp, Artificial
  CRISPR gRNA sequence
cctcccatctccggacctcg

SEQ ID NO: 730411 - DNA, 20 bp, Artificial
  CRISPR gRNA sequence
ccatctccggacctcgattt

SEQ ID NO: 730412 - DNA, 20 bp, Artificial
  CRISPR gRNA sequence
cggacctcgatttccacacc

SEQ ID NO: 730413 - DNA, 20 bp, Artificial
  CRISPR gRNA sequence
gatttccacacctggaaaat

SEQ ID NO: 730414 - DNA, 20 bp, Artificial
  CRISPR gRNA sequence
ccacacctggaaaatggggc

SEQ ID NO: 730415 - DNA, 20 bp, Artificial
  CRISPR gRNA sequence
cacacctggaaaatggggct

SEQ ID NO: 730416 - DNA, 20 bp, Artificial
  CRISPR gRNA sequence
gaaaatggggctaatactgt

SEQ ID NO: 730417 - DNA, 20 bp, Artificial
  CRISPR gRNA sequence
atactgtctgtcttatggag

SEQ ID NO: 730418 - DNA, 20 bp, Artificial
  CRISPR gRNA sequence
tctgtcttatggagacgtga

SEQ ID NO: 730419 - DNA, 20 bp, Artificial
  CRISPR gRNA sequence
tcttatggagacgtgagaat

SEQ ID NO: 730420 - DNA, 20 bp, Artificial
  CRISPR gRNA sequence
atggagacgtgagaatttca

SEQ ID NO: 730421 - DNA, 20 bp, Artificial
  CRISPR gRNA sequence
tggagacgtgagaatttcag

SEQ ID NO: 730422 - DNA, 20 bp, Artificial
  CRISPR gRNA sequence
caggagagacagccagtgaa

SEQ ID NO: 730423 - DNA, 20 bp, Artificial
  CRISPR gRNA sequence
aggagagacagccagtgaag

SEQ ID NO: 730424 - DNA, 20 bp, Artificial
  CRISPR gRNA sequence
ttagcgtggggcttggctga

SEQ ID NO: 730425 - DNA, 20 bp, Artificial
  CRISPR gRNA sequence
agcgtggggcttggctgact

SEQ ID NO: 730426 - DNA, 20 bp, Artificial
  CRISPR gRNA sequence
gcgtggggcttggctgactg

SEQ ID NO: 730427 - DNA, 20 bp, Artificial
  CRISPR gRNA sequence
ggctgactggaggcagaaac

SEQ ID NO: 730428 - DNA, 20 bp, Artificial
  CRISPR gRNA sequence
gctgactggaggcagaaact

SEQ ID NO: 730429 - DNA, 20 bp, Artificial
  CRISPR gRNA sequence
actggaggcagaaactgctt

SEQ ID NO: 730430 - DNA, 20 bp, Artificial
  CRISPR gRNA sequence
gaggcagaaactgctttcta

SEQ ID NO: 730431 - DNA, 20 bp, Artificial
  CRISPR gRNA sequence
ctttctattttacagctgga

SEQ ID NO: 730432 - DNA, 20 bp, Artificial
  CRISPR gRNA sequence
tctattttacagctggaaaa

SEQ ID NO: 730433 - DNA, 20 bp, Artificial
  CRISPR gRNA sequence
ctattttacagctggaaaaa

SEQ ID NO: 730434 - DNA, 20 bp, Artificial
  CRISPR gRNA sequence
tattttacagctggaaaaaa

SEQ ID NO: 730435 - DNA, 20 bp, Artificial
  CRISPR gRNA sequence
ttttacagctggaaaaaaaa

SEQ ID NO: 730436 - DNA, 20 bp, Artificial
  CRISPR gRNA sequence
tacagctggaaaaaaaacaa

SEQ ID NO: 730437 - DNA, 20 bp, Artificial
  CRISPR gRNA sequence
acagctggaaaaaaaacaac

SEQ ID NO: 730438 - DNA, 20 bp, Artificial
  CRISPR gRNA sequence
cagctggaaaaaaaacaaca

SEQ ID NO: 730439 - DNA, 20 bp, Artificial
  CRISPR gRNA sequence
gaaaaaaaacaacaaccccg

SEQ ID NO: 730440 - DNA, 20 bp, Artificial
  CRISPR gRNA sequence
ccccatgggtgagtccacag

SEQ ID NO: 730441 - DNA, 20 bp, Artificial
  CRISPR gRNA sequence
accagggtttggcagctgag

SEQ ID NO: 730442 - DNA, 20 bp, Artificial
  CRISPR gRNA sequence
ggcagctgagattagaacac

SEQ ID NO: 730443 - DNA, 20 bp, Artificial
  CRISPR gRNA sequence
gcagctgagattagaacact

SEQ ID NO: 730444 - DNA, 20 bp, Artificial
  CRISPR gRNA sequence
agattagaacacttctaaaa

SEQ ID NO: 730445 - DNA, 20 bp, Artificial
  CRISPR gRNA sequence
gaacacttctaaaacagtgc

SEQ ID NO: 730446 - DNA, 20 bp, Artificial
  CRISPR gRNA sequence
ctaaaacagtgctgtccaac

SEQ ID NO: 730447 - DNA, 20 bp, Artificial
  CRISPR gRNA sequence
taaaacagtgctgtccaaca

SEQ ID NO: 730448 - DNA, 20 bp, Artificial
  CRISPR gRNA sequence
aaacagtgctgtccaacaga

SEQ ID NO: 730449 - DNA, 20 bp, Artificial
  CRISPR gRNA sequence
tccaacagagatatgcgagt

SEQ ID NO: 730450 - DNA, 20 bp, Artificial
  CRISPR gRNA sequence
aaatattctgggagccacac

SEQ ID NO: 730451 - DNA, 20 bp, Artificial
  CRISPR gRNA sequence
tgggagccacactttaaaag

SEQ ID NO: 730452 - DNA, 20 bp, Artificial
  CRISPR gRNA sequence
ggagccacactttaaaaggt

SEQ ID NO: 730453 - DNA, 20 bp, Artificial
  CRISPR gRNA sequence
taaaaggtaaaaagaaatca

SEQ ID NO: 730454 - DNA, 20 bp, Artificial
  CRISPR gRNA sequence
aaaaggtaaaaagaaatcag

SEQ ID NO: 730455 - DNA, 20 bp, Artificial
  CRISPR gRNA sequence
aaaggtaaaaagaaatcagt

SEQ ID NO: 730456 - DNA, 20 bp, Artificial
  CRISPR gRNA sequence
attttcattatttaacccag

SEQ ID NO: 730457 - DNA, 20 bp, Artificial
  CRISPR gRNA sequence
tcattatttaacccagtata

SEQ ID NO: 730458 - DNA, 20 bp, Artificial
  CRISPR gRNA sequence
cattatttaacccagtatat

SEQ ID NO: 730459 - DNA, 20 bp, Artificial
  CRISPR gRNA sequence
attatttaacccagtatatc

SEQ ID NO: 730460 - DNA, 20 bp, Artificial
  CRISPR gRNA sequence
tttaacccagtatatctaaa

SEQ ID NO: 730461 - DNA, 20 bp, Artificial
  CRISPR gRNA sequence
aacccagtatatctaaaata

SEQ ID NO: 730462 - DNA, 20 bp, Artificial
  CRISPR gRNA sequence
acccagtatatctaaaatat

SEQ ID NO: 730463 - DNA, 20 bp, Artificial
  CRISPR gRNA sequence
aaatattaccatgtttgcag

SEQ ID NO: 730464 - DNA, 20 bp, Artificial
  CRISPR gRNA sequence
ccatgtttgcaggcaatcaa

SEQ ID NO: 730465 - DNA, 20 bp, Artificial
  CRISPR gRNA sequence
gcaggcaatcaatataaaaa

SEQ ID NO: 730466 - DNA, 20 bp, Artificial
  CRISPR gRNA sequence
caggcaatcaatataaaaaa

SEQ ID NO: 730467 - DNA, 20 bp, Artificial
  CRISPR gRNA sequence
attatattcttgtttatact

SEQ ID NO: 730468 - DNA, 20 bp, Artificial
  CRISPR gRNA sequence
tattcttgtttatactaagt

SEQ ID NO: 730469 - DNA, 20 bp, Artificial
  CRISPR gRNA sequence
ttgtttatactaagttttcg

SEQ ID NO: 730470 - DNA, 20 bp, Artificial
  CRISPR gRNA sequence
gtttatactaagttttcgaa

SEQ ID NO: 730471 - DNA, 20 bp, Artificial
  CRISPR gRNA sequence
tttatactaagttttcgaaa

SEQ ID NO: 730472 - DNA, 20 bp, Artificial
  CRISPR gRNA sequence
atactaagttttcgaaatcc

SEQ ID NO: 730473 - DNA, 20 bp, Artificial
  CRISPR gRNA sequence
tactaagttttcgaaatcca

SEQ ID NO: 730474 - DNA, 20 bp, Artificial
  CRISPR gRNA sequence
agttttcgaaatccagtgca

SEQ ID NO: 730475 - DNA, 20 bp, Artificial
  CRISPR gRNA sequence
tcgaaatccagtgcatattg

SEQ ID NO: 730476 - DNA, 20 bp, Artificial
  CRISPR gRNA sequence
cgaaatccagtgcatattgt

SEQ ID NO: 730477 - DNA, 20 bp, Artificial
  CRISPR gRNA sequence
gaaatccagtgcatattgta

SEQ ID NO: 730478 - DNA, 20 bp, Artificial
  CRISPR gRNA sequence
tacacacagcacttctcaat

SEQ ID NO: 730479 - DNA, 20 bp, Artificial
  CRISPR gRNA sequence
ctcaatgcagacgtatctgc

SEQ ID NO: 730480 - DNA, 20 bp, Artificial
  CRISPR gRNA sequence
tcaatgcagacgtatctgca

SEQ ID NO: 730481 - DNA, 20 bp, Artificial
  CRISPR gRNA sequence
aatgcagacgtatctgcatt

SEQ ID NO: 730482 - DNA, 20 bp, Artificial
  CRISPR gRNA sequence
cattttttttattttttatc

SEQ ID NO: 730483 - DNA, 20 bp, Artificial
  CRISPR gRNA sequence
tttttattttttatcggatt

SEQ ID NO: 730484 - DNA, 20 bp, Artificial
  CRISPR gRNA sequence
ttttattttttatcggattt

SEQ ID NO: 730485 - DNA, 20 bp, Artificial
  CRISPR gRNA sequence
tttattttttatcggatttt

SEQ ID NO: 730486 - DNA, 20 bp, Artificial
  CRISPR gRNA sequence
ttattttttatcggattttt

SEQ ID NO: 730487 - DNA, 20 bp, Artificial
  CRISPR gRNA sequence
tattttttatcggatttttt

SEQ ID NO: 730488 - DNA, 20 bp, Artificial
  CRISPR gRNA sequence
attttttatcggattttttt

SEQ ID NO: 730489 - DNA, 20 bp, Artificial
  CRISPR gRNA sequence
ttttttatcggatttttttt

SEQ ID NO: 730490 - DNA, 20 bp, Artificial
  CRISPR gRNA sequence
tttatcggattttttttttg

SEQ ID NO: 730491 - DNA, 20 bp, Artificial
  CRISPR gRNA sequence
ttatcggattttttttttga

SEQ ID NO: 730492 - DNA, 20 bp, Artificial
  CRISPR gRNA sequence
tatcggattttttttttgaa

SEQ ID NO: 730493 - DNA, 20 bp, Artificial
  CRISPR gRNA sequence
atcggattttttttttgaaa

SEQ ID NO: 730494 - DNA, 20 bp, Artificial
  CRISPR gRNA sequence
tcggattttttttttgaaac

SEQ ID NO: 730495 - DNA, 20 bp, Artificial
  CRISPR gRNA sequence
tttttttgaaacagagtcta

SEQ ID NO: 730496 - DNA, 20 bp, Artificial
  CRISPR gRNA sequence
ttttttgaaacagagtctaa

SEQ ID NO: 730497 - DNA, 20 bp, Artificial
  CRISPR gRNA sequence
tttttgaaacagagtctaac

SEQ ID NO: 730498 - DNA, 20 bp, Artificial
  CRISPR gRNA sequence
ttttgaaacagagtctaact

SEQ ID NO: 730499 - DNA, 20 bp, Artificial
  CRISPR gRNA sequence
tttgaaacagagtctaactc

SEQ ID NO: 730500 - DNA, 20 bp, Artificial
  CRISPR gRNA sequence
ttgaaacagagtctaactct

SEQ ID NO: 730501 - DNA, 20 bp, Artificial
  CRISPR gRNA sequence
tgaaacagagtctaactctg

SEQ ID NO: 730502 - DNA, 20 bp, Artificial
  CRISPR gRNA sequence
gaaacagagtctaactctgt

SEQ ID NO: 730503 - DNA, 20 bp, Artificial
  CRISPR gRNA sequence
aaacagagtctaactctgtc

SEQ ID NO: 730504 - DNA, 20 bp, Artificial
  CRISPR gRNA sequence
actctgtcgcccaggttgga

SEQ ID NO: 730505 - DNA, 20 bp, Artificial
  CRISPR gRNA sequence
tgtcgcccaggttggagtgc

SEQ ID NO: 730506 - DNA, 20 bp, Artificial
  CRISPR gRNA sequence
tcgcccaggttggagtgcag

SEQ ID NO: 730507 - DNA, 20 bp, Artificial
  CRISPR gRNA sequence
gagtgcagtggcacaatctc

SEQ ID NO: 730508 - DNA, 20 bp, Artificial
  CRISPR gRNA sequence
agctcactacaacctccacc

SEQ ID NO: 730509 - DNA, 20 bp, Artificial
  CRISPR gRNA sequence
actacaacctccacctcccg

SEQ ID NO: 730510 - DNA, 20 bp, Artificial
  CRISPR gRNA sequence
caacctccacctcccggatt

SEQ ID NO: 730511 - DNA, 20 bp, Artificial
  CRISPR gRNA sequence
cacctcccggattcaagcaa

SEQ ID NO: 730512 - DNA, 20 bp, Artificial
  CRISPR gRNA sequence
ccggattcaagcaattctca

SEQ ID NO: 730513 - DNA, 20 bp, Artificial
  CRISPR gRNA sequence
aagcaattctcatgcctcag

SEQ ID NO: 730514 - DNA, 20 bp, Artificial
  CRISPR gRNA sequence
tcatgcctcagcctcccaag

SEQ ID NO: 730515 - DNA, 20 bp, Artificial
  CRISPR gRNA sequence
atgcctcagcctcccaagta

SEQ ID NO: 730516 - DNA, 20 bp, Artificial
  CRISPR gRNA sequence
agcctcccaagtagttgaga

SEQ ID NO: 730517 - DNA, 20 bp, Artificial
  CRISPR gRNA sequence
ccaagtagttgagatttcaa

SEQ ID NO: 730518 - DNA, 20 bp, Artificial
  CRISPR gRNA sequence
agatttcaagcacccgccac

SEQ ID NO: 730519 - DNA, 20 bp, Artificial
  CRISPR gRNA sequence
caagcacccgccaccacacc

SEQ ID NO: 730520 - DNA, 20 bp, Artificial
  CRISPR gRNA sequence
aagcacccgccaccacacct

SEQ ID NO: 730521 - DNA, 20 bp, Artificial
  CRISPR gRNA sequence
gccaacttttgtatttttag

SEQ ID NO: 730522 - DNA, 20 bp, Artificial
  CRISPR gRNA sequence
ttgtatttttagtagagacg

SEQ ID NO: 730523 - DNA, 20 bp, Artificial
  CRISPR gRNA sequence
tgtatttttagtagagacga

SEQ ID NO: 730524 - DNA, 20 bp, Artificial
  CRISPR gRNA sequence
gtatttttagtagagacgag

SEQ ID NO: 730525 - DNA, 20 bp, Artificial
  CRISPR gRNA sequence
tatttttagtagagacgagg

SEQ ID NO: 730526 - DNA, 20 bp, Artificial
  CRISPR gRNA sequence
ttagtagagacgaggtttca

SEQ ID NO: 730527 - DNA, 20 bp, Artificial
  CRISPR gRNA sequence
tagtagagacgaggtttcac

SEQ ID NO: 730528 - DNA, 20 bp, Artificial
  CRISPR gRNA sequence
agtagagacgaggtttcacc

SEQ ID NO: 730529 - DNA, 20 bp, Artificial
  CRISPR gRNA sequence
gtagagacgaggtttcacca

SEQ ID NO: 730530 - DNA, 20 bp, Artificial
  CRISPR gRNA sequence
caccacattggccaggctgg

SEQ ID NO: 730531 - DNA, 20 bp, Artificial
  CRISPR gRNA sequence
accacattggccaggctggt

SEQ ID NO: 730532 - DNA, 20 bp, Artificial
  CRISPR gRNA sequence
gccaggctggtctcaaactc

SEQ ID NO: 730533 - DNA, 20 bp, Artificial
  CRISPR gRNA sequence
gtctcaaactcctgacttca

SEQ ID NO: 730534 - DNA, 20 bp, Artificial
  CRISPR gRNA sequence
aaactcctgacttcaagtga

SEQ ID NO: 730535 - DNA, 20 bp, Artificial
  CRISPR gRNA sequence
ctgacttcaagtgatccgcc

SEQ ID NO: 730536 - DNA, 20 bp, Artificial
  CRISPR gRNA sequence
acttcaagtgatccgcctgc

SEQ ID NO: 730537 - DNA, 20 bp, Artificial
  CRISPR gRNA sequence
caagtgatccgcctgcctca

SEQ ID NO: 730538 - DNA, 20 bp, Artificial
  CRISPR gRNA sequence
aagtgatccgcctgcctcag

SEQ ID NO: 730539 - DNA, 20 bp, Artificial
  CRISPR gRNA sequence
cctcagcctcccaaaatgct

SEQ ID NO: 730540 - DNA, 20 bp, Artificial
  CRISPR gRNA sequence
agcctcccaaaatgctggaa

SEQ ID NO: 730541 - DNA, 20 bp, Artificial
  CRISPR gRNA sequence
ccaaaatgctggaattacag

SEQ ID NO: 730542 - DNA, 20 bp, Artificial
  CRISPR gRNA sequence
gaattacaggtgtgagccac

SEQ ID NO: 730543 - DNA, 20 bp, Artificial
  CRISPR gRNA sequence
caggtgtgagccaccgcacc

SEQ ID NO: 730544 - DNA, 20 bp, Artificial
  CRISPR gRNA sequence
gctgcattttaagtgcgtgg

SEQ ID NO: 730545 - DNA, 20 bp, Artificial
  CRISPR gRNA sequence
cattttaagtgcgtggccac

SEQ ID NO: 730546 - DNA, 20 bp, Artificial
  CRISPR gRNA sequence
taagtgcgtggccacgtgcc

SEQ ID NO: 730547 - DNA, 20 bp, Artificial
  CRISPR gRNA sequence
aagtgcgtggccacgtgcca

SEQ ID NO: 730548 - DNA, 20 bp, Artificial
  CRISPR gRNA sequence
agtgcgtggccacgtgccac

SEQ ID NO: 730549 - DNA, 20 bp, Artificial
  CRISPR gRNA sequence
cattgggcagctggggtcca

SEQ ID NO: 730550 - DNA, 20 bp, Artificial
  CRISPR gRNA sequence
ggcagctggggtccaggggc

SEQ ID NO: 730551 - DNA, 20 bp, Artificial
  CRISPR gRNA sequence
gggtccaggggcagcaaagg

SEQ ID NO: 730552 - DNA, 20 bp, Artificial
  CRISPR gRNA sequence
tggcgccgctgtgtggcagt

SEQ ID NO: 730553 - DNA, 20 bp, Artificial
  CRISPR gRNA sequence
gcgccgctgtgtggcagtct

SEQ ID NO: 730554 - DNA, 20 bp, Artificial
  CRISPR gRNA sequence
tgtggcagtctcaggaacac

SEQ ID NO: 730555 - DNA, 20 bp, Artificial
  CRISPR gRNA sequence
aggaacactgcccagacagt

SEQ ID NO: 730556 - DNA, 20 bp, Artificial
  CRISPR gRNA sequence
cccagacagtccctccagca

SEQ ID NO: 730557 - DNA, 20 bp, Artificial
  CRISPR gRNA sequence
cagcaggaagccttggctgg

SEQ ID NO: 730558 - DNA, 20 bp, Artificial
  CRISPR gRNA sequence
ggctggaacaactgaactca

SEQ ID NO: 730559 - DNA, 20 bp, Artificial
  CRISPR gRNA sequence
gctggaacaactgaactcaa

SEQ ID NO: 730560 - DNA, 20 bp, Artificial
  CRISPR gRNA sequence
gaacaactgaactcaagatg

SEQ ID NO: 730561 - DNA, 20 bp, Artificial
  CRISPR gRNA sequence
aactcaagatgtttttcaca

SEQ ID NO: 730562 - DNA, 20 bp, Artificial
  CRISPR gRNA sequence
aagatgtttttcacaaagat

SEQ ID NO: 730563 - DNA, 20 bp, Artificial
  CRISPR gRNA sequence
ttcacaaagatgcagaagtt

SEQ ID NO: 730564 - DNA, 20 bp, Artificial
  CRISPR gRNA sequence
tcacaaagatgcagaagttt

SEQ ID NO: 730565 - DNA, 20 bp, Artificial
  CRISPR gRNA sequence
cacaaagatgcagaagtttc

SEQ ID NO: 730566 - DNA, 20 bp, Artificial
  CRISPR gRNA sequence
acaaagatgcagaagtttct

SEQ ID NO: 730567 - DNA, 20 bp, Artificial
  CRISPR gRNA sequence
ctgagctggaaacttttggg

SEQ ID NO: 730568 - DNA, 20 bp, Artificial
  CRISPR gRNA sequence
tgagctggaaacttttggga

SEQ ID NO: 730569 - DNA, 20 bp, Artificial
  CRISPR gRNA sequence
agctggaaacttttgggaag

SEQ ID NO: 730570 - DNA, 20 bp, Artificial
  CRISPR gRNA sequence
gaaacttttgggaagtttgg

SEQ ID NO: 730571 - DNA, 20 bp, Artificial
  CRISPR gRNA sequence
ttgggaagtttggccttttt

SEQ ID NO: 730572 - DNA, 20 bp, Artificial
  CRISPR gRNA sequence
tgggaagtttggcctttttg

SEQ ID NO: 730573 - DNA, 20 bp, Artificial
  CRISPR gRNA sequence
gggaagtttggcctttttgg

SEQ ID NO: 730574 - DNA, 20 bp, Artificial
  CRISPR gRNA sequence
ggaagtttggcctttttgga

SEQ ID NO: 730575 - DNA, 20 bp, Artificial
  CRISPR gRNA sequence
ggcctttttggagaggcccc

SEQ ID NO: 730576 - DNA, 20 bp, Artificial
  CRISPR gRNA sequence
gcctttttggagaggccccc

SEQ ID NO: 730577 - DNA, 20 bp, Artificial
  CRISPR gRNA sequence
tttggagaggcccccaaggc

SEQ ID NO: 730578 - DNA, 20 bp, Artificial
  CRISPR gRNA sequence
ttggagaggcccccaaggcc

SEQ ID NO: 730579 - DNA, 20 bp, Artificial
  CRISPR gRNA sequence
tggagaggcccccaaggcct

SEQ ID NO: 730580 - DNA, 20 bp, Artificial
  CRISPR gRNA sequence
ggagaggcccccaaggcctt

SEQ ID NO: 730581 - DNA, 20 bp, Artificial
  CRISPR gRNA sequence
gagaggcccccaaggccttc

SEQ ID NO: 730582 - DNA, 20 bp, Artificial
  CRISPR gRNA sequence
cagttatacctcctcatttg

SEQ ID NO: 730583 - DNA, 20 bp, Artificial
  CRISPR gRNA sequence
agttatacctcctcatttga

SEQ ID NO: 730584 - DNA, 20 bp, Artificial
  CRISPR gRNA sequence
tacctcctcatttgagagat

SEQ ID NO: 730585 - DNA, 20 bp, Artificial
  CRISPR gRNA sequence
ctcatttgagagatggggag

SEQ ID NO: 730586 - DNA, 20 bp, Artificial
  CRISPR gRNA sequence
atttgagagatggggagacc

SEQ ID NO: 730587 - DNA, 20 bp, Artificial
  CRISPR gRNA sequence
gagagatggggagaccgagg

SEQ ID NO: 730588 - DNA, 20 bp, Artificial
  CRISPR gRNA sequence
agagatggggagaccgaggt

SEQ ID NO: 730589 - DNA, 20 bp, Artificial
  CRISPR gRNA sequence
caaatctttgcaaaatccta

SEQ ID NO: 730590 - DNA, 20 bp, Artificial
  CRISPR gRNA sequence
tgcaaaatcctaggtatctg

SEQ ID NO: 730591 - DNA, 20 bp, Artificial
  CRISPR gRNA sequence
gcaaaatcctaggtatctgc

SEQ ID NO: 730592 - DNA, 20 bp, Artificial
  CRISPR gRNA sequence
caaaatcctaggtatctgct

SEQ ID NO: 730593 - DNA, 20 bp, Artificial
  CRISPR gRNA sequence
ggtatctgctgcccagtcca

SEQ ID NO: 730594 - DNA, 20 bp, Artificial
  CRISPR gRNA sequence
ctgcccagtccactccagca

SEQ ID NO: 730595 - DNA, 20 bp, Artificial
  CRISPR gRNA sequence
cccagtccactccagcactc

SEQ ID NO: 730596 - DNA, 20 bp, Artificial
  CRISPR gRNA sequence
cagcactctcccctgcttat

SEQ ID NO: 730597 - DNA, 20 bp, Artificial
  CRISPR gRNA sequence
tcccctgcttatgggtggag

SEQ ID NO: 730598 - DNA, 20 bp, Artificial
  CRISPR gRNA sequence
ccctgcttatgggtggaggc

SEQ ID NO: 730599 - DNA, 20 bp, Artificial
  CRISPR gRNA sequence
cttatgggtggaggcctcca

SEQ ID NO: 730600 - DNA, 20 bp, Artificial
  CRISPR gRNA sequence
atgggtggaggcctccatca

SEQ ID NO: 730601 - DNA, 20 bp, Artificial
  CRISPR gRNA sequence
tgggtggaggcctccatcat

SEQ ID NO: 730602 - DNA, 20 bp, Artificial
  CRISPR gRNA sequence
catcattccttagcagagcg

SEQ ID NO: 730603 - DNA, 20 bp, Artificial
  CRISPR gRNA sequence
cttagcagagcgctctcccc

SEQ ID NO: 730604 - DNA, 20 bp, Artificial
  CRISPR gRNA sequence
agcagagcgctctcccccga

SEQ ID NO: 730605 - DNA, 20 bp, Artificial
  CRISPR gRNA sequence
gcagagcgctctcccccgac

SEQ ID NO: 730606 - DNA, 20 bp, Artificial
  CRISPR gRNA sequence
tcccccgaccctggaatttg

SEQ ID NO: 730607 - DNA, 20 bp, Artificial
  CRISPR gRNA sequence
ccccgaccctggaatttgac

SEQ ID NO: 730608 - DNA, 20 bp, Artificial
  CRISPR gRNA sequence
gaatttgaccagatttgaac

SEQ ID NO: 730609 - DNA, 20 bp, Artificial
  CRISPR gRNA sequence
gaccagatttgaactccacc

SEQ ID NO: 730610 - DNA, 20 bp, Artificial
  CRISPR gRNA sequence
accagatttgaactccaccc

SEQ ID NO: 730611 - DNA, 20 bp, Artificial
  CRISPR gRNA sequence
gaactccacccccccaccag

SEQ ID NO: 730612 - DNA, 20 bp, Artificial
  CRISPR gRNA sequence
aactccacccccccaccagc

SEQ ID NO: 730613 - DNA, 20 bp, Artificial
  CRISPR gRNA sequence
cacccccccaccagctcgga

SEQ ID NO: 730614 - DNA, 20 bp, Artificial
  CRISPR gRNA sequence
ggagctccctgtcaggtgtc

SEQ ID NO: 730615 - DNA, 20 bp, Artificial
  CRISPR gRNA sequence
cctgtcaggtgtccccatat

SEQ ID NO: 730616 - DNA, 20 bp, Artificial
  CRISPR gRNA sequence
tcaggtgtccccatatctta

SEQ ID NO: 730617 - DNA, 20 bp, Artificial
  CRISPR gRNA sequence
aattcaatgaatctctatgg

SEQ ID NO: 730618 - DNA, 20 bp, Artificial
  CRISPR gRNA sequence
attcaatgaatctctatggg

SEQ ID NO: 730619 - DNA, 20 bp, Artificial
  CRISPR gRNA sequence
aatgaatctctatggggagc

SEQ ID NO: 730620 - DNA, 20 bp, Artificial
  CRISPR gRNA sequence
tatggggagcaggtgccatg

SEQ ID NO: 730621 - DNA, 20 bp, Artificial
  CRISPR gRNA sequence
tggggagcaggtgccatgcc

SEQ ID NO: 730622 - DNA, 20 bp, Artificial
  CRISPR gRNA sequence
gcatttgatcaggcagtggg

SEQ ID NO: 730623 - DNA, 20 bp, Artificial
  CRISPR gRNA sequence
gatcaggcagtggggagatg

SEQ ID NO: 730624 - DNA, 20 bp, Artificial
  CRISPR gRNA sequence
atcaggcagtggggagatgt

SEQ ID NO: 730625 - DNA, 20 bp, Artificial
  CRISPR gRNA sequence
atggacaccaggggcatggt

SEQ ID NO: 730626 - DNA, 20 bp, Artificial
  CRISPR gRNA sequence
tgccctcaggaagcttccag

SEQ ID NO: 730627 - DNA, 20 bp, Artificial
  CRISPR gRNA sequence
gccctcaggaagcttccagc

SEQ ID NO: 730628 - DNA, 20 bp, Artificial
  CRISPR gRNA sequence
ccctcaggaagcttccagcc

SEQ ID NO: 730629 - DNA, 20 bp, Artificial
  CRISPR gRNA sequence
aggaagcttccagccaggga

SEQ ID NO: 730630 - DNA, 20 bp, Artificial
  CRISPR gRNA sequence
ccagccagggagggagacag

SEQ ID NO: 730631 - DNA, 20 bp, Artificial
  CRISPR gRNA sequence
cagccagggagggagacaga

SEQ ID NO: 730632 - DNA, 20 bp, Artificial
  CRISPR gRNA sequence
atcaagccaagagacagaga

SEQ ID NO: 730633 - DNA, 20 bp, Artificial
  CRISPR gRNA sequence
gcaaaggacacagtgctacc

SEQ ID NO: 730634 - DNA, 20 bp, Artificial
  CRISPR gRNA sequence
caaaggacacagtgctacca

SEQ ID NO: 730635 - DNA, 20 bp, Artificial
  CRISPR gRNA sequence
ccagcttccctagtgagagg

SEQ ID NO: 730636 - DNA, 20 bp, Artificial
  CRISPR gRNA sequence
ccctagtgagaggccaggga

SEQ ID NO: 730637 - DNA, 20 bp, Artificial
  CRISPR gRNA sequence
cctagtgagaggccagggaa

SEQ ID NO: 730638 - DNA, 20 bp, Artificial
  CRISPR gRNA sequence
gtgagaggccagggaaggcc

SEQ ID NO: 730639 - DNA, 20 bp, Artificial
  CRISPR gRNA sequence
ttgaggaagtggggtggaga

SEQ ID NO: 730640 - DNA, 20 bp, Artificial
  CRISPR gRNA sequence
gaggaagtggggtggagagc

SEQ ID NO: 730641 - DNA, 20 bp, Artificial
  CRISPR gRNA sequence
aggaagtggggtggagagct

SEQ ID NO: 730642 - DNA, 20 bp, Artificial
  CRISPR gRNA sequence
agggctgagtaggatttgac

SEQ ID NO: 730643 - DNA, 20 bp, Artificial
  CRISPR gRNA sequence
agtaggatttgactaagtga

SEQ ID NO: 730644 - DNA, 20 bp, Artificial
  CRISPR gRNA sequence
gactaagtgaatggggaggg

SEQ ID NO: 730645 - DNA, 20 bp, Artificial
  CRISPR gRNA sequence
actaagtgaatggggaggga

SEQ ID NO: 730646 - DNA, 20 bp, Artificial
  CRISPR gRNA sequence
agtgaatggggagggaaggg

SEQ ID NO: 730647 - DNA, 20 bp, Artificial
  CRISPR gRNA sequence
cgacagagagaacagcacgt

SEQ ID NO: 730648 - DNA, 20 bp, Artificial
  CRISPR gRNA sequence
caacctggaagaagggcagc

SEQ ID NO: 730649 - DNA, 20 bp, Artificial
  CRISPR gRNA sequence
gaagaagggcagcgcaggtg

SEQ ID NO: 730650 - DNA, 20 bp, Artificial
  CRISPR gRNA sequence
ggtgctgagagctgaagctg

SEQ ID NO: 730651 - DNA, 20 bp, Artificial
  CRISPR gRNA sequence
gtgctgagagctgaagctgg

SEQ ID NO: 730652 - DNA, 20 bp, Artificial
  CRISPR gRNA sequence
agagctgaagctgggagaaa

SEQ ID NO: 730653 - DNA, 20 bp, Artificial
  CRISPR gRNA sequence
aagctgggagaaaggagggg

SEQ ID NO: 730654 - DNA, 20 bp, Artificial
  CRISPR gRNA sequence
ggagaaaggagggggctgtg

SEQ ID NO: 730655 - DNA, 20 bp, Artificial
  CRISPR gRNA sequence
tgttgggatcacatcctgag

SEQ ID NO: 730656 - DNA, 20 bp, Artificial
  CRISPR gRNA sequence
ggatcacatcctgagactct

SEQ ID NO: 730657 - DNA, 20 bp, Artificial
  CRISPR gRNA sequence
agactctgattctgggaaga

SEQ ID NO: 730658 - DNA, 20 bp, Artificial
  CRISPR gRNA sequence
tgattctgggaagatggctt

SEQ ID NO: 730659 - DNA, 20 bp, Artificial
  CRISPR gRNA sequence
attctgggaagatggcttag

SEQ ID NO: 730660 - DNA, 20 bp, Artificial
  CRISPR gRNA sequence
tgggaagatggcttagacac

SEQ ID NO: 730661 - DNA, 20 bp, Artificial
  CRISPR gRNA sequence
ggaagatggcttagacacgt

SEQ ID NO: 730662 - DNA, 20 bp, Artificial
  CRISPR gRNA sequence
agacacgttttcccctcatc

SEQ ID NO: 730663 - DNA, 20 bp, Artificial
  CRISPR gRNA sequence
gacacgttttcccctcatcc

SEQ ID NO: 730664 - DNA, 20 bp, Artificial
  CRISPR gRNA sequence
tcccctcatcctcccgccaa

SEQ ID NO: 730665 - DNA, 20 bp, Artificial
  CRISPR gRNA sequence
cccctcatcctcccgccaag

SEQ ID NO: 730666 - DNA, 20 bp, Artificial
  CRISPR gRNA sequence
ccctcatcctcccgccaaga

SEQ ID NO: 730667 - DNA, 20 bp, Artificial
  CRISPR gRNA sequence
atcctcccgccaagaaccgc

SEQ ID NO: 730668 - DNA, 20 bp, Artificial
  CRISPR gRNA sequence
ccgccaagaaccgctaaaag

SEQ ID NO: 730669 - DNA, 20 bp, Artificial
  CRISPR gRNA sequence
aaagccctggacattatgta

SEQ ID NO: 730670 - DNA, 20 bp, Artificial
  CRISPR gRNA sequence
gacattatgtacaaaataaa

SEQ ID NO: 730671 - DNA, 20 bp, Artificial
  CRISPR gRNA sequence
tgtacaaaataaatgtaaga

SEQ ID NO: 730672 - DNA, 20 bp, Artificial
  CRISPR gRNA sequence
tgaaacatgaagagaagaag

SEQ ID NO: 730673 - DNA, 20 bp, Artificial
  CRISPR gRNA sequence
aaacatgaagagaagaaggc

SEQ ID NO: 730674 - DNA, 20 bp, Artificial
  CRISPR gRNA sequence
ggggccttgggacctgaagg

SEQ ID NO: 730675 - DNA, 20 bp, Artificial
  CRISPR gRNA sequence
gggacctgaaggacaccgtg

SEQ ID NO: 730676 - DNA, 20 bp, Artificial
  CRISPR gRNA sequence
ggacctgaaggacaccgtgg

SEQ ID NO: 730677 - DNA, 20 bp, Artificial
  CRISPR gRNA sequence
aaggacaccgtggtgagtcc

SEQ ID NO: 730678 - DNA, 20 bp, Artificial
  CRISPR gRNA sequence
gagttttctttttttttttt

SEQ ID NO: 730679 - DNA, 20 bp, Artificial
  CRISPR gRNA sequence
tctttttttttttttttttt

SEQ ID NO: 730680 - DNA, 20 bp, Artificial
  CRISPR gRNA sequence
cttttttttttttttttttt

SEQ ID NO: 730681 - DNA, 20 bp, Artificial
  CRISPR gRNA sequence
tttttttttttttttttttg

SEQ ID NO: 730682 - DNA, 20 bp, Artificial
  CRISPR gRNA sequence
tttttttttttttttttgag

SEQ ID NO: 730683 - DNA, 20 bp, Artificial
  CRISPR gRNA sequence
ttttttttttttttttgaga

SEQ ID NO: 730684 - DNA, 20 bp, Artificial
  CRISPR gRNA sequence
tttttttttttttttgagac

SEQ ID NO: 730685 - DNA, 20 bp, Artificial
  CRISPR gRNA sequence
ttttttttttttttgagacg

SEQ ID NO: 730686 - DNA, 20 bp, Artificial
  CRISPR gRNA sequence
tttttttttttttgagacgg

SEQ ID NO: 730687 - DNA, 20 bp, Artificial
  CRISPR gRNA sequence
ttttttttttttgagacgga

SEQ ID NO: 730688 - DNA, 20 bp, Artificial
  CRISPR gRNA sequence
tttttttttttgagacggag

SEQ ID NO: 730689 - DNA, 20 bp, Artificial
  CRISPR gRNA sequence
ttttttttttgagacggagt

SEQ ID NO: 730690 - DNA, 20 bp, Artificial
  CRISPR gRNA sequence
tttttttttgagacggagtc

SEQ ID NO: 730691 - DNA, 20 bp, Artificial
  CRISPR gRNA sequence
ttttttttgagacggagtct

SEQ ID NO: 730692 - DNA, 20 bp, Artificial
  CRISPR gRNA sequence
tttttttgagacggagtctt

SEQ ID NO: 730693 - DNA, 20 bp, Artificial
  CRISPR gRNA sequence
ttttttgagacggagtcttg

SEQ ID NO: 730694 - DNA, 20 bp, Artificial
  CRISPR gRNA sequence
tttttgagacggagtcttgc

SEQ ID NO: 730695 - DNA, 20 bp, Artificial
  CRISPR gRNA sequence
ttttgagacggagtcttgct

SEQ ID NO: 730696 - DNA, 20 bp, Artificial
  CRISPR gRNA sequence
tttgagacggagtcttgctc

SEQ ID NO: 730697 - DNA, 20 bp, Artificial
  CRISPR gRNA sequence
ttgagacggagtcttgctct

SEQ ID NO: 730698 - DNA, 20 bp, Artificial
  CRISPR gRNA sequence
tgagacggagtcttgctctt

SEQ ID NO: 730699 - DNA, 20 bp, Artificial
  CRISPR gRNA sequence
gagacggagtcttgctcttg

SEQ ID NO: 730700 - DNA, 20 bp, Artificial
  CRISPR gRNA sequence
agacggagtcttgctcttgt

SEQ ID NO: 730701 - DNA, 20 bp, Artificial
  CRISPR gRNA sequence
gctcttgtcacccaggctgg

SEQ ID NO: 730702 - DNA, 20 bp, Artificial
  CRISPR gRNA sequence
ctcttgtcacccaggctgga

SEQ ID NO: 730703 - DNA, 20 bp, Artificial
  CRISPR gRNA sequence
ttgtcacccaggctggagtg

SEQ ID NO: 730704 - DNA, 20 bp, Artificial
  CRISPR gRNA sequence
gtcacccaggctggagtgca

SEQ ID NO: 730705 - DNA, 20 bp, Artificial
  CRISPR gRNA sequence
tcacccaggctggagtgcaa

SEQ ID NO: 730706 - DNA, 20 bp, Artificial
  CRISPR gRNA sequence
gagtgcaatggctcaatctc

SEQ ID NO: 730707 - DNA, 20 bp, Artificial
  CRISPR gRNA sequence
aatctcagctcactgcaacc

SEQ ID NO: 730708 - DNA, 20 bp, Artificial
  CRISPR gRNA sequence
agctcactgcaaccaccgcc

SEQ ID NO: 730709 - DNA, 20 bp, Artificial
  CRISPR gRNA sequence
actgcaaccaccgcctccca

SEQ ID NO: 730710 - DNA, 20 bp, Artificial
  CRISPR gRNA sequence
caaccaccgcctcccaggtt

SEQ ID NO: 730711 - DNA, 20 bp, Artificial
  CRISPR gRNA sequence
ccaggttcaagtggttctcc

SEQ ID NO: 730712 - DNA, 20 bp, Artificial
  CRISPR gRNA sequence
aagtggttctcctgcctcag

SEQ ID NO: 730713 - DNA, 20 bp, Artificial
  CRISPR gRNA sequence
tcctgcctcagcctcctgag

SEQ ID NO: 730714 - DNA, 20 bp, Artificial
  CRISPR gRNA sequence
ctgcctcagcctcctgagta

SEQ ID NO: 730715 - DNA, 20 bp, Artificial
  CRISPR gRNA sequence
cctcagcctcctgagtaaat

SEQ ID NO: 730716 - DNA, 20 bp, Artificial
  CRISPR gRNA sequence
agcctcctgagtaaatggaa

SEQ ID NO: 730717 - DNA, 20 bp, Artificial
  CRISPR gRNA sequence
ctgagtaaatggaattacag

SEQ ID NO: 730718 - DNA, 20 bp, Artificial
  CRISPR gRNA sequence
agtaaatggaattacagggc

SEQ ID NO: 730719 - DNA, 20 bp, Artificial
  CRISPR gRNA sequence
cagggcacctgctgccaggg

SEQ ID NO: 730720 - DNA, 20 bp, Artificial
  CRISPR gRNA sequence
ctgccagggctggctaattt

SEQ ID NO: 730721 - DNA, 20 bp, Artificial
  CRISPR gRNA sequence
ccagggctggctaatttttg

SEQ ID NO: 730722 - DNA, 20 bp, Artificial
  CRISPR gRNA sequence
gctaatttttgtatttttag

SEQ ID NO: 730723 - DNA, 20 bp, Artificial
  CRISPR gRNA sequence
atttttgtatttttagtaga

SEQ ID NO: 730724 - DNA, 20 bp, Artificial
  CRISPR gRNA sequence
ttgtatttttagtagagatg

SEQ ID NO: 730725 - DNA, 20 bp, Artificial
  CRISPR gRNA sequence
tgtatttttagtagagatga

SEQ ID NO: 730726 - DNA, 20 bp, Artificial
  CRISPR gRNA sequence
gtatttttagtagagatgag

SEQ ID NO: 730727 - DNA, 20 bp, Artificial
  CRISPR gRNA sequence
tatttttagtagagatgagg

SEQ ID NO: 730728 - DNA, 20 bp, Artificial
  CRISPR gRNA sequence
ttagtagagatgaggtttca

SEQ ID NO: 730729 - DNA, 20 bp, Artificial
  CRISPR gRNA sequence
tagtagagatgaggtttcac

SEQ ID NO: 730730 - DNA, 20 bp, Artificial
  CRISPR gRNA sequence
agtagagatgaggtttcacc

SEQ ID NO: 730731 - DNA, 20 bp, Artificial
  CRISPR gRNA sequence
gtagagatgaggtttcacca

SEQ ID NO: 730732 - DNA, 20 bp, Artificial
  CRISPR gRNA sequence
caccatgttggccaggctgg

SEQ ID NO: 730733 - DNA, 20 bp, Artificial
  CRISPR gRNA sequence
accatgttggccaggctggt

SEQ ID NO: 730734 - DNA, 20 bp, Artificial
  CRISPR gRNA sequence
gccaggctggtcttgaactc

SEQ ID NO: 730735 - DNA, 20 bp, Artificial
  CRISPR gRNA sequence
gtcttgaactcctgacctca

SEQ ID NO: 730736 - DNA, 20 bp, Artificial
  CRISPR gRNA sequence
gaactcctgacctcaagtga

SEQ ID NO: 730737 - DNA, 20 bp, Artificial
  CRISPR gRNA sequence
aactcctgacctcaagtgat

SEQ ID NO: 730738 - DNA, 20 bp, Artificial
  CRISPR gRNA sequence
ctgacctcaagtgatctgcc

SEQ ID NO: 730739 - DNA, 20 bp, Artificial
  CRISPR gRNA sequence
acctcaagtgatctgcctgc

SEQ ID NO: 730740 - DNA, 20 bp, Artificial
  CRISPR gRNA sequence
aagtgatctgcctgccttgg

SEQ ID NO: 730741 - DNA, 20 bp, Artificial
  CRISPR gRNA sequence
cctgccttggcctcccaaag

SEQ ID NO: 730742 - DNA, 20 bp, Artificial
  CRISPR gRNA sequence
ccttggcctcccaaagtgct

SEQ ID NO: 730743 - DNA, 20 bp, Artificial
  CRISPR gRNA sequence
ggcctcccaaagtgctggga

SEQ ID NO: 730744 - DNA, 20 bp, Artificial
  CRISPR gRNA sequence
gcctcccaaagtgctgggat

SEQ ID NO: 730745 - DNA, 20 bp, Artificial
  CRISPR gRNA sequence
ccaaagtgctgggattacag

SEQ ID NO: 730746 - DNA, 20 bp, Artificial
  CRISPR gRNA sequence
ggattacaggcgtaagccac

SEQ ID NO: 730747 - DNA, 20 bp, Artificial
  CRISPR gRNA sequence
caggcgtaagccaccacacc

SEQ ID NO: 730748 - DNA, 20 bp, Artificial
  CRISPR gRNA sequence
gccttgtgtccttatcttta

SEQ ID NO: 730749 - DNA, 20 bp, Artificial
  CRISPR gRNA sequence
gtgtccttatctttagagta

SEQ ID NO: 730750 - DNA, 20 bp, Artificial
  CRISPR gRNA sequence
tgtccttatctttagagtaa

SEQ ID NO: 730751 - DNA, 20 bp, Artificial
  CRISPR gRNA sequence
atctttagagtaacaggaag

SEQ ID NO: 730752 - DNA, 20 bp, Artificial
  CRISPR gRNA sequence
tctttagagtaacaggaaga

SEQ ID NO: 730753 - DNA, 20 bp, Artificial
  CRISPR gRNA sequence
tagagtaacaggaagatact

SEQ ID NO: 730754 - DNA, 20 bp, Artificial
  CRISPR gRNA sequence
agagtaacaggaagatactg

SEQ ID NO: 730755 - DNA, 20 bp, Artificial
  CRISPR gRNA sequence
gagtaacaggaagatactga

SEQ ID NO: 730756 - DNA, 20 bp, Artificial
  CRISPR gRNA sequence
aagcatttcaggtatatatc

SEQ ID NO: 730757 - DNA, 20 bp, Artificial
  CRISPR gRNA sequence
caggtatatatccgtgtgtg

SEQ ID NO: 730758 - DNA, 20 bp, Artificial
  CRISPR gRNA sequence
aggtatatatccgtgtgtgt

SEQ ID NO: 730759 - DNA, 20 bp, Artificial
  CRISPR gRNA sequence
agatttggtcttgcaagggt

SEQ ID NO: 730760 - DNA, 20 bp, Artificial
  CRISPR gRNA sequence
ggtcttgcaagggtcattct

SEQ ID NO: 730761 - DNA, 20 bp, Artificial
  CRISPR gRNA sequence
gtcttgcaagggtcattctg

SEQ ID NO: 730762 - DNA, 20 bp, Artificial
  CRISPR gRNA sequence
gcaagggtcattctggctgt

SEQ ID NO: 730763 - DNA, 20 bp, Artificial
  CRISPR gRNA sequence
caagggtcattctggctgtc

SEQ ID NO: 730764 - DNA, 20 bp, Artificial
  CRISPR gRNA sequence
tggctgtctgccatgggggc

SEQ ID NO: 730765 - DNA, 20 bp, Artificial
  CRISPR gRNA sequence
gctgtctgccatgggggctg

SEQ ID NO: 730766 - DNA, 20 bp, Artificial
  CRISPR gRNA sequence
tctgccatgggggctgtata

SEQ ID NO: 730767 - DNA, 20 bp, Artificial
  CRISPR gRNA sequence
ccatgggggctgtataagag

SEQ ID NO: 730768 - DNA, 20 bp, Artificial
  CRISPR gRNA sequence
tataagagaaggtattcggg

SEQ ID NO: 730769 - DNA, 20 bp, Artificial
  CRISPR gRNA sequence
ggggtgagaaggtggggaag

SEQ ID NO: 730770 - DNA, 20 bp, Artificial
  CRISPR gRNA sequence
gaggccaaatctacaggact

SEQ ID NO: 730771 - DNA, 20 bp, Artificial
  CRISPR gRNA sequence
caggactcgaggatgggctg

SEQ ID NO: 730772 - DNA, 20 bp, Artificial
  CRISPR gRNA sequence
gaggatgggctggctgtgaa

SEQ ID NO: 730773 - DNA, 20 bp, Artificial
  CRISPR gRNA sequence
gctgtgaaggatgagggaac

SEQ ID NO: 730774 - DNA, 20 bp, Artificial
  CRISPR gRNA sequence
tgaaggatgagggaacgagg

SEQ ID NO: 730775 - DNA, 20 bp, Artificial
  CRISPR gRNA sequence
ccaatccccaggtttgcaca

SEQ ID NO: 730776 - DNA, 20 bp, Artificial
  CRISPR gRNA sequence
gcacaacagggcatgggact

SEQ ID NO: 730777 - DNA, 20 bp, Artificial
  CRISPR gRNA sequence
cacaacagggcatgggactc

SEQ ID NO: 730778 - DNA, 20 bp, Artificial
  CRISPR gRNA sequence
cagagaaggacctggttggg

SEQ ID NO: 730779 - DNA, 20 bp, Artificial
  CRISPR gRNA sequence
gttgggggagggaccacagg

SEQ ID NO: 730780 - DNA, 20 bp, Artificial
  CRISPR gRNA sequence
ggggagggaccacaggcact

SEQ ID NO: 730781 - DNA, 20 bp, Artificial
  CRISPR gRNA sequence
tgtggcacttttctcctcag

SEQ ID NO: 730782 - DNA, 20 bp, Artificial
  CRISPR gRNA sequence
gtggcacttttctcctcagt

SEQ ID NO: 730783 - DNA, 20 bp, Artificial
  CRISPR gRNA sequence
tggcacttttctcctcagtg

SEQ ID NO: 730784 - DNA, 20 bp, Artificial
  CRISPR gRNA sequence
ttctcctcagtggacagtgg

SEQ ID NO: 730785 - DNA, 20 bp, Artificial
  CRISPR gRNA sequence
tctcctcagtggacagtgga

SEQ ID NO: 730786 - DNA, 20 bp, Artificial
  CRISPR gRNA sequence
ctcctcagtggacagtggac

SEQ ID NO: 730787 - DNA, 20 bp, Artificial
  CRISPR gRNA sequence
tcctcagtggacagtggaca

SEQ ID NO: 730788 - DNA, 20 bp, Artificial
  CRISPR gRNA sequence
ctcagtggacagtggacaca

SEQ ID NO: 730789 - DNA, 20 bp, Artificial
  CRISPR gRNA sequence
agtggacagtggacacaggg

SEQ ID NO: 730790 - DNA, 20 bp, Artificial
  CRISPR gRNA sequence
cctctgagcccatctccccg

SEQ ID NO: 730791 - DNA, 20 bp, Artificial
  CRISPR gRNA sequence
tgagcccatctccccggctc

SEQ ID NO: 730792 - DNA, 20 bp, Artificial
  CRISPR gRNA sequence
agcccatctccccggctcca

SEQ ID NO: 730793 - DNA, 20 bp, Artificial
  CRISPR gRNA sequence
cccggctccatacagtctgc

SEQ ID NO: 730794 - DNA, 20 bp, Artificial
  CRISPR gRNA sequence
catacagtctgcaactgcgg

SEQ ID NO: 730795 - DNA, 20 bp, Artificial
  CRISPR gRNA sequence
caactgcggcagccactctg

SEQ ID NO: 730796 - DNA, 20 bp, Artificial
  CRISPR gRNA sequence
cggcagccactctgtgctgt

SEQ ID NO: 730797 - DNA, 20 bp, Artificial
  CRISPR gRNA sequence
tgtgctgtgctccaaagccc

SEQ ID NO: 730798 - DNA, 20 bp, Artificial
  CRISPR gRNA sequence
tgctgtgctccaaagcccac

SEQ ID NO: 730799 - DNA, 20 bp, Artificial
  CRISPR gRNA sequence
tgctccaaagcccacccact

SEQ ID NO: 730800 - DNA, 20 bp, Artificial
  CRISPR gRNA sequence
caaagcccacccactcctca

SEQ ID NO: 730801 - DNA, 20 bp, Artificial
  CRISPR gRNA sequence
ctcatgcctcccttctggaa

SEQ ID NO: 730802 - DNA, 20 bp, Artificial
  CRISPR gRNA sequence
atgcctcccttctggaagat

SEQ ID NO: 730803 - DNA, 20 bp, Artificial
  CRISPR gRNA sequence
ccttctggaagatggtccca

SEQ ID NO: 730804 - DNA, 20 bp, Artificial
  CRISPR gRNA sequence
ctggaagatggtcccaactc

SEQ ID NO: 730805 - DNA, 20 bp, Artificial
  CRISPR gRNA sequence
tggaagatggtcccaactcc

SEQ ID NO: 730806 - DNA, 20 bp, Artificial
  CRISPR gRNA sequence
gaagatggtcccaactccac

SEQ ID NO: 730807 - DNA, 20 bp, Artificial
  CRISPR gRNA sequence
cacccagacaggttctgtgg

SEQ ID NO: 730808 - DNA, 20 bp, Artificial
  CRISPR gRNA sequence
tgtggcccataccccttctc

SEQ ID NO: 730809 - DNA, 20 bp, Artificial
  CRISPR gRNA sequence
tggcccataccccttctctg

SEQ ID NO: 730810 - DNA, 20 bp, Artificial
  CRISPR gRNA sequence
ctctggttaaaagcagccct

SEQ ID NO: 730811 - DNA, 20 bp, Artificial
  CRISPR gRNA sequence
tctggttaaaagcagccctg

SEQ ID NO: 730812 - DNA, 20 bp, Artificial
  CRISPR gRNA sequence
tggttaaaagcagccctgac

SEQ ID NO: 730813 - DNA, 20 bp, Artificial
  CRISPR gRNA sequence
gttaaaagcagccctgacac

SEQ ID NO: 730814 - DNA, 20 bp, Artificial
  CRISPR gRNA sequence
aaagcagccctgacaccttg

SEQ ID NO: 730815 - DNA, 20 bp, Artificial
  CRISPR gRNA sequence
acaccttgtactatcagaga

SEQ ID NO: 730816 - DNA, 20 bp, Artificial
  CRISPR gRNA sequence
gtactatcagagaagtagaa

SEQ ID NO: 730817 - DNA, 20 bp, Artificial
  CRISPR gRNA sequence
tactatcagagaagtagaag

SEQ ID NO: 730818 - DNA, 20 bp, Artificial
  CRISPR gRNA sequence
tcagagaagtagaagtcaga

SEQ ID NO: 730819 - DNA, 20 bp, Artificial
  CRISPR gRNA sequence
gtctgaggtcacacgataag

SEQ ID NO: 730820 - DNA, 20 bp, Artificial
  CRISPR gRNA sequence
tctgaggtcacacgataagt

SEQ ID NO: 730821 - DNA, 20 bp, Artificial
  CRISPR gRNA sequence
aggtcacacgataagttgga

SEQ ID NO: 730822 - DNA, 20 bp, Artificial
  CRISPR gRNA sequence
gaaaagaaacccaagtttct

SEQ ID NO: 730823 - DNA, 20 bp, Artificial
  CRISPR gRNA sequence
ctcaagtcttgagcctgggg

SEQ ID NO: 730824 - DNA, 20 bp, Artificial
  CRISPR gRNA sequence
tcaagtcttgagcctggggc

SEQ ID NO: 730825 - DNA, 20 bp, Artificial
  CRISPR gRNA sequence
aagtcttgagcctggggcca

SEQ ID NO: 730826 - DNA, 20 bp, Artificial
  CRISPR gRNA sequence
gagcctggggccagatctct

SEQ ID NO: 730827 - DNA, 20 bp, Artificial
  CRISPR gRNA sequence
agcctggggccagatctctc

SEQ ID NO: 730828 - DNA, 20 bp, Artificial
  CRISPR gRNA sequence
gggccagatctctcagcacc

SEQ ID NO: 730829 - DNA, 20 bp, Artificial
  CRISPR gRNA sequence
tcagcacctctaactcccaa

SEQ ID NO: 730830 - DNA, 20 bp, Artificial
  CRISPR gRNA sequence
agcacctctaactcccaatg

SEQ ID NO: 730831 - DNA, 20 bp, Artificial
  CRISPR gRNA sequence
taactcccaatgccctgaac

SEQ ID NO: 730832 - DNA, 20 bp, Artificial
  CRISPR gRNA sequence
actcccaatgccctgaacct

SEQ ID NO: 730833 - DNA, 20 bp, Artificial
  CRISPR gRNA sequence
ccaatgccctgaacctgaaa

SEQ ID NO: 730834 - DNA, 20 bp, Artificial
  CRISPR gRNA sequence
aacctgaaagggggaagcca

SEQ ID NO: 730835 - DNA, 20 bp, Artificial
  CRISPR gRNA sequence
aaagggggaagccaacccca

SEQ ID NO: 730836 - DNA, 20 bp, Artificial
  CRISPR gRNA sequence
ctaggaaactcccaggacag

SEQ ID NO: 730837 - DNA, 20 bp, Artificial
  CRISPR gRNA sequence
taggaaactcccaggacaga

SEQ ID NO: 730838 - DNA, 20 bp, Artificial
  CRISPR gRNA sequence
ggaaactcccaggacagaga

SEQ ID NO: 730839 - DNA, 20 bp, Artificial
  CRISPR gRNA sequence
ccaggacagagacttgaggt

SEQ ID NO: 730840 - DNA, 20 bp, Artificial
  CRISPR gRNA sequence
gaggttcccttcttgtttat

SEQ ID NO: 730841 - DNA, 20 bp, Artificial
  CRISPR gRNA sequence
aggttcccttcttgtttatg

SEQ ID NO: 730842 - DNA, 20 bp, Artificial
  CRISPR gRNA sequence
ccttcttgtttatggggcat

SEQ ID NO: 730843 - DNA, 20 bp, Artificial
  CRISPR gRNA sequence
cttgtttatggggcatcaga

SEQ ID NO: 730844 - DNA, 20 bp, Artificial
  CRISPR gRNA sequence
ttgtttatggggcatcagat

SEQ ID NO: 730845 - DNA, 20 bp, Artificial
  CRISPR gRNA sequence
gtttatggggcatcagataa

SEQ ID NO: 730846 - DNA, 20 bp, Artificial
  CRISPR gRNA sequence
tttatggggcatcagataac

SEQ ID NO: 730847 - DNA, 20 bp, Artificial
  CRISPR gRNA sequence
atggggcatcagataacttc

SEQ ID NO: 730848 - DNA, 20 bp, Artificial
  CRISPR gRNA sequence
tggggcatcagataacttct

SEQ ID NO: 730849 - DNA, 20 bp, Artificial
  CRISPR gRNA sequence
ctgccttgagcctcaaacca

SEQ ID NO: 730850 - DNA, 20 bp, Artificial
  CRISPR gRNA sequence
tgccttgagcctcaaaccaa

SEQ ID NO: 730851 - DNA, 20 bp, Artificial
  CRISPR gRNA sequence
ccttgagcctcaaaccaaag

SEQ ID NO: 730852 - DNA, 20 bp, Artificial
  CRISPR gRNA sequence
gagcctcaaaccaaagcaag

SEQ ID NO: 730853 - DNA, 20 bp, Artificial
  CRISPR gRNA sequence
agcctcaaaccaaagcaaga

SEQ ID NO: 730854 - DNA, 20 bp, Artificial
  CRISPR gRNA sequence
aaaccaaagcaagacctcct

SEQ ID NO: 730855 - DNA, 20 bp, Artificial
  CRISPR gRNA sequence
ctccagccaggtctatgcca

SEQ ID NO: 730856 - DNA, 20 bp, Artificial
  CRISPR gRNA sequence
cagccaggtctatgccaggg

SEQ ID NO: 730857 - DNA, 20 bp, Artificial
  CRISPR gRNA sequence
tgccaggggacagcagggtc

SEQ ID NO: 730858 - DNA, 20 bp, Artificial
  CRISPR gRNA sequence
tctgcacctggaacacaagg

SEQ ID NO: 730859 - DNA, 20 bp, Artificial
  CRISPR gRNA sequence
tgcacctggaacacaaggtg

SEQ ID NO: 730860 - DNA, 20 bp, Artificial
  CRISPR gRNA sequence
cacctggaacacaaggtggg

SEQ ID NO: 730861 - DNA, 20 bp, Artificial
  CRISPR gRNA sequence
gaacacaaggtgggggaggg

SEQ ID NO: 730862 - DNA, 20 bp, Artificial
  CRISPR gRNA sequence
ggtgctgggtacatccctgg

SEQ ID NO: 730863 - DNA, 20 bp, Artificial
  CRISPR gRNA sequence
ggtacatccctggcccatcg

SEQ ID NO: 730864 - DNA, 20 bp, Artificial
  CRISPR gRNA sequence
gcccatcgccaaaggagaca

SEQ ID NO: 730865 - DNA, 20 bp, Artificial
  CRISPR gRNA sequence
tccaacagtctccgggaagc

SEQ ID NO: 730866 - DNA, 20 bp, Artificial
  CRISPR gRNA sequence
cgggaagcgggaggtcggaa

SEQ ID NO: 730867 - DNA, 20 bp, Artificial
  CRISPR gRNA sequence
gggtgggcggaaggtgcagc

SEQ ID NO: 730868 - DNA, 20 bp, Artificial
  CRISPR gRNA sequence
tgtcctgagttaagggtggg

SEQ ID NO: 730869 - DNA, 20 bp, Artificial
  CRISPR gRNA sequence
tcctgagttaagggtgggga

SEQ ID NO: 730870 - DNA, 20 bp, Artificial
  CRISPR gRNA sequence
agttaagggtggggacactg

SEQ ID NO: 730871 - DNA, 20 bp, Artificial
  CRISPR gRNA sequence
agggtggggacactgacctg

SEQ ID NO: 730872 - DNA, 20 bp, Artificial
  CRISPR gRNA sequence
acctgggaacttgacaatca

SEQ ID NO: 730873 - DNA, 20 bp, Artificial
  CRISPR gRNA sequence
ggaacttgacaatcatccct

SEQ ID NO: 730874 - DNA, 20 bp, Artificial
  CRISPR gRNA sequence
gacaatcatccctgccggac

SEQ ID NO: 730875 - DNA, 20 bp, Artificial
  CRISPR gRNA sequence
acaatcatccctgccggaca

SEQ ID NO: 730876 - DNA, 20 bp, Artificial
  CRISPR gRNA sequence
ccggacagacagaatggaag

SEQ ID NO: 730877 - DNA, 20 bp, Artificial
  CRISPR gRNA sequence
acggcagacgtggaacagaa

SEQ ID NO: 730878 - DNA, 20 bp, Artificial
  CRISPR gRNA sequence
gcagacacgggaggagttcc

SEQ ID NO: 730879 - DNA, 20 bp, Artificial
  CRISPR gRNA sequence
catgcacacggcgtcttctc

SEQ ID NO: 730880 - DNA, 20 bp, Artificial
  CRISPR gRNA sequence
ctccacgaggtcgtctaagg

SEQ ID NO: 730881 - DNA, 20 bp, Artificial
  CRISPR gRNA sequence
tccacgaggtcgtctaaggg

SEQ ID NO: 730882 - DNA, 20 bp, Artificial
  CRISPR gRNA sequence
cacgaggtcgtctaagggac

SEQ ID NO: 730883 - DNA, 20 bp, Artificial
  CRISPR gRNA sequence
agggacacagacaggggtca

SEQ ID NO: 730884 - DNA, 20 bp, Artificial
  CRISPR gRNA sequence
tccagatagctcttgagatg

SEQ ID NO: 730885 - DNA, 20 bp, Artificial
  CRISPR gRNA sequence
cagatagctcttgagatgag

SEQ ID NO: 730886 - DNA, 20 bp, Artificial
  CRISPR gRNA sequence
ttgagatgagggggagaggg

SEQ ID NO: 730887 - DNA, 20 bp, Artificial
  CRISPR gRNA sequence
gagatgagggggagagggca

SEQ ID NO: 730888 - DNA, 20 bp, Artificial
  CRISPR gRNA sequence
agatgagggggagagggcag

SEQ ID NO: 730889 - DNA, 20 bp, Artificial
  CRISPR gRNA sequence
cgcctcccagctcaaccccc

SEQ ID NO: 730890 - DNA, 20 bp, Artificial
  CRISPR gRNA sequence
ccagctcaaccccctggtga

SEQ ID NO: 730891 - DNA, 20 bp, Artificial
  CRISPR gRNA sequence
aaccccctggtgaccactaa

SEQ ID NO: 730892 - DNA, 20 bp, Artificial
  CRISPR gRNA sequence
gtgaccactaaaattggatt

SEQ ID NO: 730893 - DNA, 20 bp, Artificial
  CRISPR gRNA sequence
aaattggattaaaaattaaa

SEQ ID NO: 730894 - DNA, 20 bp, Artificial
  CRISPR gRNA sequence
gattaaaaattaaattaatg

SEQ ID NO: 730895 - DNA, 20 bp, Artificial
  CRISPR gRNA sequence
aaaattaaattaatgtacca

SEQ ID NO: 730896 - DNA, 20 bp, Artificial
  CRISPR gRNA sequence
aattaatgtaccaatttttt

SEQ ID NO: 730897 - DNA, 20 bp, Artificial
  CRISPR gRNA sequence
atgtaccaattttttaaaat

SEQ ID NO: 730898 - DNA, 20 bp, Artificial
  CRISPR gRNA sequence
tttaaaatgcaaaaaaataa

SEQ ID NO: 730899 - DNA, 20 bp, Artificial
  CRISPR gRNA sequence
ttaaaatgcaaaaaaataaa

SEQ ID NO: 730900 - DNA, 20 bp, Artificial
  CRISPR gRNA sequence
taaaatgcaaaaaaataaaa

SEQ ID NO: 730901 - DNA, 20 bp, Artificial
  CRISPR gRNA sequence
aaaatgcaaaaaaataaaaa

SEQ ID NO: 730902 - DNA, 20 bp, Artificial
  CRISPR gRNA sequence
aaatgcaaaaaaataaaaaa

SEQ ID NO: 730903 - DNA, 20 bp, Artificial
  CRISPR gRNA sequence
agatacatattgctaaatga

SEQ ID NO: 730904 - DNA, 20 bp, Artificial
  CRISPR gRNA sequence
gatacatattgctaaatgaa

SEQ ID NO: 730905 - DNA, 20 bp, Artificial
  CRISPR gRNA sequence
ctaaatgaaagacaccagtc

SEQ ID NO: 730906 - DNA, 20 bp, Artificial
  CRISPR gRNA sequence
aatgaaagacaccagtctga

SEQ ID NO: 730907 - DNA, 20 bp, Artificial
  CRISPR gRNA sequence
aaaaggccacacactgtcat

SEQ ID NO: 730908 - DNA, 20 bp, Artificial
  CRISPR gRNA sequence
tcattccaactacatgacat

SEQ ID NO: 730909 - DNA, 20 bp, Artificial
  CRISPR gRNA sequence
caactacatgacatttctgg

SEQ ID NO: 730910 - DNA, 20 bp, Artificial
  CRISPR gRNA sequence
catgacatttctggaaaaga

SEQ ID NO: 730911 - DNA, 20 bp, Artificial
  CRISPR gRNA sequence
ctggaaaagatgaaactatc

SEQ ID NO: 730912 - DNA, 20 bp, Artificial
  CRISPR gRNA sequence
tggaaaagatgaaactatcg

SEQ ID NO: 730913 - DNA, 20 bp, Artificial
  CRISPR gRNA sequence
gaaaagatgaaactatcgag

SEQ ID NO: 730914 - DNA, 20 bp, Artificial
  CRISPR gRNA sequence
tcgagacagtaaaaagatca

SEQ ID NO: 730915 - DNA, 20 bp, Artificial
  CRISPR gRNA sequence
ccagaggttcagggggaggg

SEQ ID NO: 730916 - DNA, 20 bp, Artificial
  CRISPR gRNA sequence
agggggagggagaggtgaac

SEQ ID NO: 730917 - DNA, 20 bp, Artificial
  CRISPR gRNA sequence
aggacacatttagggcagtg

SEQ ID NO: 730918 - DNA, 20 bp, Artificial
  CRISPR gRNA sequence
agggcagtgaaaatattctg

SEQ ID NO: 730919 - DNA, 20 bp, Artificial
  CRISPR gRNA sequence
gggcagtgaaaatattctgg

SEQ ID NO: 730920 - DNA, 20 bp, Artificial
  CRISPR gRNA sequence
tggatgccacggtgatggtg

SEQ ID NO: 730921 - DNA, 20 bp, Artificial
  CRISPR gRNA sequence
gatgccacggtgatggtggg

SEQ ID NO: 730922 - DNA, 20 bp, Artificial
  CRISPR gRNA sequence
gtctaaagccctagaatggg

SEQ ID NO: 730923 - DNA, 20 bp, Artificial
  CRISPR gRNA sequence
tctaaagccctagaatgggc

SEQ ID NO: 730924 - DNA, 20 bp, Artificial
  CRISPR gRNA sequence
aagccctagaatgggcaaca

SEQ ID NO: 730925 - DNA, 20 bp, Artificial
  CRISPR gRNA sequence
gaatgggcaacacaaagagt

SEQ ID NO: 730926 - DNA, 20 bp, Artificial
  CRISPR gRNA sequence
ctgtaaactatggacttcag

SEQ ID NO: 730927 - DNA, 20 bp, Artificial
  CRISPR gRNA sequence
taaactatggacttcagtta

SEQ ID NO: 730928 - DNA, 20 bp, Artificial
  CRISPR gRNA sequence
tggacttcagttagtaataa

SEQ ID NO: 730929 - DNA, 20 bp, Artificial
  CRISPR gRNA sequence
cagttagtaataataatgca

SEQ ID NO: 730930 - DNA, 20 bp, Artificial
  CRISPR gRNA sequence
agttagtaataataatgcat

SEQ ID NO: 730931 - DNA, 20 bp, Artificial
  CRISPR gRNA sequence
gtaataataatgcatcatta

SEQ ID NO: 730932 - DNA, 20 bp, Artificial
  CRISPR gRNA sequence
tcaggtcatcaatgctaaca

SEQ ID NO: 730933 - DNA, 20 bp, Artificial
  CRISPR gRNA sequence
acaattgtgccacactaatg

SEQ ID NO: 730934 - DNA, 20 bp, Artificial
  CRISPR gRNA sequence
tgccacactaatgcaaggtg

SEQ ID NO: 730935 - DNA, 20 bp, Artificial
  CRISPR gRNA sequence
atgcaaggtgttcgtgacag

SEQ ID NO: 730936 - DNA, 20 bp, Artificial
  CRISPR gRNA sequence
gtgacaggggaggctgggtg

SEQ ID NO: 730937 - DNA, 20 bp, Artificial
  CRISPR gRNA sequence
ggtgcagtggctcacgcctt

SEQ ID NO: 730938 - DNA, 20 bp, Artificial
  CRISPR gRNA sequence
acgcctttaatcccagcact

SEQ ID NO: 730939 - DNA, 20 bp, Artificial
  CRISPR gRNA sequence
taatcccagcactttgggag

SEQ ID NO: 730940 - DNA, 20 bp, Artificial
  CRISPR gRNA sequence
aatcccagcactttgggagg

SEQ ID NO: 730941 - DNA, 20 bp, Artificial
  CRISPR gRNA sequence
atcccagcactttgggaggc

SEQ ID NO: 730942 - DNA, 20 bp, Artificial
  CRISPR gRNA sequence
tgggaggccgaggcaggagg

SEQ ID NO: 730943 - DNA, 20 bp, Artificial
  CRISPR gRNA sequence
gggaggccgaggcaggagga

SEQ ID NO: 730944 - DNA, 20 bp, Artificial
  CRISPR gRNA sequence
ggaggccgaggcaggaggat

SEQ ID NO: 730945 - DNA, 20 bp, Artificial
  CRISPR gRNA sequence
gccctcatatggcgacatag

SEQ ID NO: 730946 - DNA, 20 bp, Artificial
  CRISPR gRNA sequence
ccctcatatggcgacatagt

SEQ ID NO: 730947 - DNA, 20 bp, Artificial
  CRISPR gRNA sequence
atatggcgacatagtgaaat

SEQ ID NO: 730948 - DNA, 20 bp, Artificial
  CRISPR gRNA sequence
tataaaacatgggcaacatg

SEQ ID NO: 730949 - DNA, 20 bp, Artificial
  CRISPR gRNA sequence
taaaacatgggcaacatggt

SEQ ID NO: 730950 - DNA, 20 bp, Artificial
  CRISPR gRNA sequence
tacaaaaaaaaaatacaaaa

SEQ ID NO: 730951 - DNA, 20 bp, Artificial
  CRISPR gRNA sequence
caaaaaaaaaatacaaaaat

SEQ ID NO: 730952 - DNA, 20 bp, Artificial
  CRISPR gRNA sequence
gccaggcatggtagcacatg

SEQ ID NO: 730953 - DNA, 20 bp, Artificial
  CRISPR gRNA sequence
tagtcccagctacttgggag

SEQ ID NO: 730954 - DNA, 20 bp, Artificial
  CRISPR gRNA sequence
cttgggaggctgaggcggga

SEQ ID NO: 730955 - DNA, 20 bp, Artificial
  CRISPR gRNA sequence
gggaggctgaggcgggagga

SEQ ID NO: 730956 - DNA, 20 bp, Artificial
  CRISPR gRNA sequence
ggaggctgaggcgggaggat

SEQ ID NO: 730957 - DNA, 20 bp, Artificial
  CRISPR gRNA sequence
aggcgggaggatcgcttgag

SEQ ID NO: 730958 - DNA, 20 bp, Artificial
  CRISPR gRNA sequence
gagcccaggaggttgaggct

SEQ ID NO: 730959 - DNA, 20 bp, Artificial
  CRISPR gRNA sequence
agcccaggaggttgaggctg

SEQ ID NO: 730960 - DNA, 20 bp, Artificial
  CRISPR gRNA sequence
aggctgtagtgagctgtgat

SEQ ID NO: 730961 - DNA, 20 bp, Artificial
  CRISPR gRNA sequence
tagtgagctgtgattgcacc

SEQ ID NO: 730962 - DNA, 20 bp, Artificial
  CRISPR gRNA sequence
tgattgcaccactgcactcc

SEQ ID NO: 730963 - DNA, 20 bp, Artificial
  CRISPR gRNA sequence
caccactgcactccagcctg

SEQ ID NO: 730964 - DNA, 20 bp, Artificial
  CRISPR gRNA sequence
cactccagcctgggcaaaag

SEQ ID NO: 730965 - DNA, 20 bp, Artificial
  CRISPR gRNA sequence
cagcctgggcaaaagagtga

SEQ ID NO: 730966 - DNA, 20 bp, Artificial
  CRISPR gRNA sequence
ggcaaaagagtgataccctg

SEQ ID NO: 730967 - DNA, 20 bp, Artificial
  CRISPR gRNA sequence
tttcaaacaaaaaatagggg

SEQ ID NO: 730968 - DNA, 20 bp, Artificial
  CRISPR gRNA sequence
caaacaaaaaataggggaaa

SEQ ID NO: 730969 - DNA, 20 bp, Artificial
  CRISPR gRNA sequence
aaacaaaaaataggggaaac

SEQ ID NO: 730970 - DNA, 20 bp, Artificial
  CRISPR gRNA sequence
tgggagattgggaagggggt

SEQ ID NO: 730971 - DNA, 20 bp, Artificial
  CRISPR gRNA sequence
ggaagggggttgagggtata

SEQ ID NO: 730972 - DNA, 20 bp, Artificial
  CRISPR gRNA sequence
agggtatataggaactctgt

SEQ ID NO: 730973 - DNA, 20 bp, Artificial
  CRISPR gRNA sequence
tgtattttctgttcaatttt

SEQ ID NO: 730974 - DNA, 20 bp, Artificial
  CRISPR gRNA sequence
tattttctgttcaattttcc

SEQ ID NO: 730975 - DNA, 20 bp, Artificial
  CRISPR gRNA sequence
tctgttcaattttcctgtaa

SEQ ID NO: 730976 - DNA, 20 bp, Artificial
  CRISPR gRNA sequence
ctgttcaattttcctgtaaa

SEQ ID NO: 730977 - DNA, 20 bp, Artificial
  CRISPR gRNA sequence
tgttcaattttcctgtaaac

SEQ ID NO: 730978 - DNA, 20 bp, Artificial
  CRISPR gRNA sequence
ttcaattttcctgtaaacct

SEQ ID NO: 730979 - DNA, 20 bp, Artificial
  CRISPR gRNA sequence
aattttcctgtaaacctaaa

SEQ ID NO: 730980 - DNA, 20 bp, Artificial
  CRISPR gRNA sequence
tcctgtaaacctaaaactgc

SEQ ID NO: 730981 - DNA, 20 bp, Artificial
  CRISPR gRNA sequence
cctgtaaacctaaaactgct

SEQ ID NO: 730982 - DNA, 20 bp, Artificial
  CRISPR gRNA sequence
ctgtaaacctaaaactgctc

SEQ ID NO: 730983 - DNA, 20 bp, Artificial
  CRISPR gRNA sequence
taaacctaaaactgctctaa

SEQ ID NO: 730984 - DNA, 20 bp, Artificial
  CRISPR gRNA sequence
aaactgctctaagaaatagt

SEQ ID NO: 730985 - DNA, 20 bp, Artificial
  CRISPR gRNA sequence
ctctaagaaatagtttatta

SEQ ID NO: 730986 - DNA, 20 bp, Artificial
  CRISPR gRNA sequence
taagaaatagtttattaatt

SEQ ID NO: 730987 - DNA, 20 bp, Artificial
  CRISPR gRNA sequence
agaaatagtttattaatttt

SEQ ID NO: 730988 - DNA, 20 bp, Artificial
  CRISPR gRNA sequence
attaatttttttttttttaa

SEQ ID NO: 730989 - DNA, 20 bp, Artificial
  CRISPR gRNA sequence
ttaatttttttttttttaag

SEQ ID NO: 730990 - DNA, 20 bp, Artificial
  CRISPR gRNA sequence
atttttttttttttaagaca

SEQ ID NO: 730991 - DNA, 20 bp, Artificial
  CRISPR gRNA sequence
ttttttttttaagacagagt

SEQ ID NO: 730992 - DNA, 20 bp, Artificial
  CRISPR gRNA sequence
tttttttttaagacagagtc

SEQ ID NO: 730993 - DNA, 20 bp, Artificial
  CRISPR gRNA sequence
ttttttttaagacagagtct

SEQ ID NO: 730994 - DNA, 20 bp, Artificial
  CRISPR gRNA sequence
tttttttaagacagagtctc

SEQ ID NO: 730995 - DNA, 20 bp, Artificial
  CRISPR gRNA sequence
ttttttaagacagagtctca

SEQ ID NO: 730996 - DNA, 20 bp, Artificial
  CRISPR gRNA sequence
tttttaagacagagtctcac

SEQ ID NO: 730997 - DNA, 20 bp, Artificial
  CRISPR gRNA sequence
ttttaagacagagtctcact

SEQ ID NO: 730998 - DNA, 20 bp, Artificial
  CRISPR gRNA sequence
tttaagacagagtctcactc

SEQ ID NO: 730999 - DNA, 20 bp, Artificial
  CRISPR gRNA sequence
ttaagacagagtctcactct

SEQ ID NO: 731000 - DNA, 20 bp, Artificial
  CRISPR gRNA sequence
taagacagagtctcactctg

SEQ ID NO: 731001 - DNA, 20 bp, Artificial
  CRISPR gRNA sequence
aagacagagtctcactctgt

SEQ ID NO: 731002 - DNA, 20 bp, Artificial
  CRISPR gRNA sequence
agacagagtctcactctgtc

SEQ ID NO: 731003 - DNA, 20 bp, Artificial
  CRISPR gRNA sequence
actctgtcacccaggttgga

SEQ ID NO: 731004 - DNA, 20 bp, Artificial
  CRISPR gRNA sequence
tgtcacccaggttggagtgc

SEQ ID NO: 731005 - DNA, 20 bp, Artificial
  CRISPR gRNA sequence
tcacccaggttggagtgcaa

SEQ ID NO: 731006 - DNA, 20 bp, Artificial
  CRISPR gRNA sequence
gagtgcaatggcgcaatctc

SEQ ID NO: 731007 - DNA, 20 bp, Artificial
  CRISPR gRNA sequence
ggctcactgcaacctgggtt

SEQ ID NO: 731008 - DNA, 20 bp, Artificial
  CRISPR gRNA sequence
actgcaacctgggttcaagt

SEQ ID NO: 731009 - DNA, 20 bp, Artificial
  CRISPR gRNA sequence
caacctgggttcaagtgatt

SEQ ID NO: 731010 - DNA, 20 bp, Artificial
  CRISPR gRNA sequence
ggttcaagtgattctcctgc

SEQ ID NO: 731011 - DNA, 20 bp, Artificial
  CRISPR gRNA sequence
aagtgattctcctgcctcag

SEQ ID NO: 731012 - DNA, 20 bp, Artificial
  CRISPR gRNA sequence
tcctgcctcagcctcctgag

SEQ ID NO: 731013 - DNA, 20 bp, Artificial
  CRISPR gRNA sequence
ctgcctcagcctcctgagta

SEQ ID NO: 731014 - DNA, 20 bp, Artificial
  CRISPR gRNA sequence
cctcagcctcctgagtagct

SEQ ID NO: 731015 - DNA, 20 bp, Artificial
  CRISPR gRNA sequence
agcctcctgagtagctggga

SEQ ID NO: 731016 - DNA, 20 bp, Artificial
  CRISPR gRNA sequence
ctgagtagctgggattacag

SEQ ID NO: 731017 - DNA, 20 bp, Artificial
  CRISPR gRNA sequence
agtagctgggattacaggca

SEQ ID NO: 731018 - DNA, 20 bp, Artificial
  CRISPR gRNA sequence
ggattacaggcacacaccac

SEQ ID NO: 731019 - DNA, 20 bp, Artificial
  CRISPR gRNA sequence
caggcacacaccaccacgcc

SEQ ID NO: 731020 - DNA, 20 bp, Artificial
  CRISPR gRNA sequence
attttttgtatttttataga

SEQ ID NO: 731021 - DNA, 20 bp, Artificial
  CRISPR gRNA sequence
tttgtatttttatagagacg

SEQ ID NO: 731022 - DNA, 20 bp, Artificial
  CRISPR gRNA sequence
ttgtatttttatagagacgg

SEQ ID NO: 731023 - DNA, 20 bp, Artificial
  CRISPR gRNA sequence
tgtatttttatagagacggg

SEQ ID NO: 731024 - DNA, 20 bp, Artificial
  CRISPR gRNA sequence
gtatttttatagagacgggg

SEQ ID NO: 731025 - DNA, 20 bp, Artificial
  CRISPR gRNA sequence
tatttttatagagacggggt

SEQ ID NO: 731026 - DNA, 20 bp, Artificial
  CRISPR gRNA sequence
ttatagagacggggtttcac

SEQ ID NO: 731027 - DNA, 20 bp, Artificial
  CRISPR gRNA sequence
tatagagacggggtttcacc

SEQ ID NO: 731028 - DNA, 20 bp, Artificial
  CRISPR gRNA sequence
atagagacggggtttcacca

SEQ ID NO: 731029 - DNA, 20 bp, Artificial
  CRISPR gRNA sequence
tagagacggggtttcaccac

SEQ ID NO: 731030 - DNA, 20 bp, Artificial
  CRISPR gRNA sequence
caccacgttggccaggatgg

SEQ ID NO: 731031 - DNA, 20 bp, Artificial
  CRISPR gRNA sequence
accacgttggccaggatggt

SEQ ID NO: 731032 - DNA, 20 bp, Artificial
  CRISPR gRNA sequence
gccaggatggtctcaaactc

SEQ ID NO: 731033 - DNA, 20 bp, Artificial
  CRISPR gRNA sequence
aaactcctgacctcaggtga

SEQ ID NO: 731034 - DNA, 20 bp, Artificial
  CRISPR gRNA sequence
ctgacctcaggtgatccacc

SEQ ID NO: 731035 - DNA, 20 bp, Artificial
  CRISPR gRNA sequence
acctcaggtgatccacccgc

SEQ ID NO: 731036 - DNA, 20 bp, Artificial
  CRISPR gRNA sequence
aggtgatccacccgcctcgg

SEQ ID NO: 731037 - DNA, 20 bp, Artificial
  CRISPR gRNA sequence
ggcctcccaaagtgctgaga

SEQ ID NO: 731038 - DNA, 20 bp, Artificial
  CRISPR gRNA sequence
ccaaagtgctgagattacag

SEQ ID NO: 731039 - DNA, 20 bp, Artificial
  CRISPR gRNA sequence
agattacaggcgtgagccac

SEQ ID NO: 731040 - DNA, 20 bp, Artificial
  CRISPR gRNA sequence
caggcgtgagccactgcacc

SEQ ID NO: 731041 - DNA, 20 bp, Artificial
  CRISPR gRNA sequence
cacccagccagaaatagttt

SEQ ID NO: 731042 - DNA, 20 bp, Artificial
  CRISPR gRNA sequence
attaatttttttaatggaca

SEQ ID NO: 731043 - DNA, 20 bp, Artificial
  CRISPR gRNA sequence
ttaatttttttaatggacaa

SEQ ID NO: 731044 - DNA, 20 bp, Artificial
  CRISPR gRNA sequence
atttttttaatggacaaagg

SEQ ID NO: 731045 - DNA, 20 bp, Artificial
  CRISPR gRNA sequence
ttttaatggacaaaggactg

SEQ ID NO: 731046 - DNA, 20 bp, Artificial
  CRISPR gRNA sequence
tttaatggacaaaggactgg

SEQ ID NO: 731047 - DNA, 20 bp, Artificial
  CRISPR gRNA sequence
ttaatggacaaaggactgga

SEQ ID NO: 731048 - DNA, 20 bp, Artificial
  CRISPR gRNA sequence
taatggacaaaggactggaa

SEQ ID NO: 731049 - DNA, 20 bp, Artificial
  CRISPR gRNA sequence
aatggacaaaggactggaat

SEQ ID NO: 731050 - DNA, 20 bp, Artificial
  CRISPR gRNA sequence
atggacaaaggactggaata

SEQ ID NO: 731051 - DNA, 20 bp, Artificial
  CRISPR gRNA sequence
gaatagacatttctctaaag

SEQ ID NO: 731052 - DNA, 20 bp, Artificial
  CRISPR gRNA sequence
ctctaaagaagatacacagc

SEQ ID NO: 731053 - DNA, 20 bp, Artificial
  CRISPR gRNA sequence
tctaaagaagatacacagct

SEQ ID NO: 731054 - DNA, 20 bp, Artificial
  CRISPR gRNA sequence
taaagaagatacacagctgg

SEQ ID NO: 731055 - DNA, 20 bp, Artificial
  CRISPR gRNA sequence
aagaagatacacagctggcc

SEQ ID NO: 731056 - DNA, 20 bp, Artificial
  CRISPR gRNA sequence
gccaataaacacatgaaaaa

SEQ ID NO: 731057 - DNA, 20 bp, Artificial
  CRISPR gRNA sequence
gccattagggaaatgcaagt

SEQ ID NO: 731058 - DNA, 20 bp, Artificial
  CRISPR gRNA sequence
gggaaatgcaagtcaaaatc

SEQ ID NO: 731059 - DNA, 20 bp, Artificial
  CRISPR gRNA sequence
cacaaccactagaatgactc

SEQ ID NO: 731060 - DNA, 20 bp, Artificial
  CRISPR gRNA sequence
acaaccactagaatgactcg

SEQ ID NO: 731061 - DNA, 20 bp, Artificial
  CRISPR gRNA sequence
gaatgactcgaatcaaaaag

SEQ ID NO: 731062 - DNA, 20 bp, Artificial
  CRISPR gRNA sequence
gaatcaaaaagacagataat

SEQ ID NO: 731063 - DNA, 20 bp, Artificial
  CRISPR gRNA sequence
ctggcaggaaaagcaggaaa

SEQ ID NO: 731064 - DNA, 20 bp, Artificial
  CRISPR gRNA sequence
gcaggaaaagcaggaaatca

SEQ ID NO: 731065 - DNA, 20 bp, Artificial
  CRISPR gRNA sequence
gttaacagacataaaaagta

SEQ ID NO: 731066 - DNA, 20 bp, Artificial
  CRISPR gRNA sequence
acagacataaaaagtacagc

SEQ ID NO: 731067 - DNA, 20 bp, Artificial
  CRISPR gRNA sequence
ggcggggagtggtggttcac

SEQ ID NO: 731068 - DNA, 20 bp, Artificial
  CRISPR gRNA sequence
acacttgtaatcccagcact

SEQ ID NO: 731069 - DNA, 20 bp, Artificial
  CRISPR gRNA sequence
gtaatcccagcactttggga

SEQ ID NO: 731070 - DNA, 20 bp, Artificial
  CRISPR gRNA sequence
taatcccagcactttgggag

SEQ ID NO: 731071 - DNA, 20 bp, Artificial
  CRISPR gRNA sequence
tgggaggccgaggtgggcag

SEQ ID NO: 731072 - DNA, 20 bp, Artificial
  CRISPR gRNA sequence
gggaggccgaggtgggcaga

SEQ ID NO: 731073 - DNA, 20 bp, Artificial
  CRISPR gRNA sequence
ggaggccgaggtgggcagat

SEQ ID NO: 731074 - DNA, 20 bp, Artificial
  CRISPR gRNA sequence
aggtcaggagtttgagacca

SEQ ID NO: 731075 - DNA, 20 bp, Artificial
  CRISPR gRNA sequence
gagaccagcccggccaacat

SEQ ID NO: 731076 - DNA, 20 bp, Artificial
  CRISPR gRNA sequence
agaccagcccggccaacata

SEQ ID NO: 731077 - DNA, 20 bp, Artificial
  CRISPR gRNA sequence
tctctactaaaaatacaaaa

SEQ ID NO: 731078 - DNA, 20 bp, Artificial
  CRISPR gRNA sequence
tactaaaaatacaaaaatta

SEQ ID NO: 731079 - DNA, 20 bp, Artificial
  CRISPR gRNA sequence
ctaaaaatacaaaaattagc

SEQ ID NO: 731080 - DNA, 20 bp, Artificial
  CRISPR gRNA sequence
aaaatacaaaaattagccag

SEQ ID NO: 731081 - DNA, 20 bp, Artificial
  CRISPR gRNA sequence
gccaggtgtggtggtgcaca

SEQ ID NO: 731082 - DNA, 20 bp, Artificial
  CRISPR gRNA sequence
taatccaagctactggggag

SEQ ID NO: 731083 - DNA, 20 bp, Artificial
  CRISPR gRNA sequence
ctggggaggctgagacagga

SEQ ID NO: 731084 - DNA, 20 bp, Artificial
  CRISPR gRNA sequence
gggaggctgagacaggaaaa

SEQ ID NO: 731085 - DNA, 20 bp, Artificial
  CRISPR gRNA sequence
agacaggaaaatcacttgaa

SEQ ID NO: 731086 - DNA, 20 bp, Artificial
  CRISPR gRNA sequence
gaacccgagaagtggaggtt

SEQ ID NO: 731087 - DNA, 20 bp, Artificial
  CRISPR gRNA sequence
aacccgagaagtggaggttg

SEQ ID NO: 731088 - DNA, 20 bp, Artificial
  CRISPR gRNA sequence
cagtgagttgagatggcccc

SEQ ID NO: 731089 - DNA, 20 bp, Artificial
  CRISPR gRNA sequence
agatggccccacttcactcc

SEQ ID NO: 731090 - DNA, 20 bp, Artificial
  CRISPR gRNA sequence
cactccagcctgggcaaaag

SEQ ID NO: 731091 - DNA, 20 bp, Artificial
  CRISPR gRNA sequence
actccagcctgggcaaaaga

SEQ ID NO: 731092 - DNA, 20 bp, Artificial
  CRISPR gRNA sequence
cagcctgggcaaaagagcga

SEQ ID NO: 731093 - DNA, 20 bp, Artificial
  CRISPR gRNA sequence
ggcaaaagagcgagactccg

SEQ ID NO: 731094 - DNA, 20 bp, Artificial
  CRISPR gRNA sequence
cgtctcaaacaaaacaaaac

SEQ ID NO: 731095 - DNA, 20 bp, Artificial
  CRISPR gRNA sequence
aaacaaaacaaaacaaaaca

SEQ ID NO: 731096 - DNA, 20 bp, Artificial
  CRISPR gRNA sequence
gtaaaactaataattaatgt

SEQ ID NO: 731097 - DNA, 20 bp, Artificial
  CRISPR gRNA sequence
ataattaatgtgtaacaggc

SEQ ID NO: 731098 - DNA, 20 bp, Artificial
  CRISPR gRNA sequence
atgtgtaacaggcctggaga

SEQ ID NO: 731099 - DNA, 20 bp, Artificial
  CRISPR gRNA sequence
gagaccaagaaggggcaagc

SEQ ID NO: 731100 - DNA, 20 bp, Artificial
  CRISPR gRNA sequence
ggcagatcagaaacgaagac

SEQ ID NO: 731101 - DNA, 20 bp, Artificial
  CRISPR gRNA sequence
gcagatcagaaacgaagaca

SEQ ID NO: 731102 - DNA, 20 bp, Artificial
  CRISPR gRNA sequence
cccgaaatacggaaggcaga

SEQ ID NO: 731103 - DNA, 20 bp, Artificial
  CRISPR gRNA sequence
tctgaagaagggggaaaggc

SEQ ID NO: 731104 - DNA, 20 bp, Artificial
  CRISPR gRNA sequence
tgaagaagggggaaaggctc

SEQ ID NO: 731105 - DNA, 20 bp, Artificial
  CRISPR gRNA sequence
aagaagggggaaaggctctg

SEQ ID NO: 731106 - DNA, 20 bp, Artificial
  CRISPR gRNA sequence
tggatagctcctcatcactc

SEQ ID NO: 731107 - DNA, 20 bp, Artificial
  CRISPR gRNA sequence
gatagctcctcatcactcat

SEQ ID NO: 731108 - DNA, 20 bp, Artificial
  CRISPR gRNA sequence
ctcatcactcatgccacaga

SEQ ID NO: 731109 - DNA, 20 bp, Artificial
  CRISPR gRNA sequence
atcactcatgccacagagcc

SEQ ID NO: 731110 - DNA, 20 bp, Artificial
  CRISPR gRNA sequence
atgccacagagccagaggcc

SEQ ID NO: 731111 - DNA, 20 bp, Artificial
  CRISPR gRNA sequence
cccgcaaagagactgttgca

SEQ ID NO: 731112 - DNA, 20 bp, Artificial
  CRISPR gRNA sequence
ccgcaaagagactgttgcag

SEQ ID NO: 731113 - DNA, 20 bp, Artificial
  CRISPR gRNA sequence
ttgcagccccacctgagccc

SEQ ID NO: 731114 - DNA, 20 bp, Artificial
  CRISPR gRNA sequence
cagccccacctgagccccat

SEQ ID NO: 731115 - DNA, 20 bp, Artificial
  CRISPR gRNA sequence
agccccattgccctcagagg

SEQ ID NO: 731116 - DNA, 20 bp, Artificial
  CRISPR gRNA sequence
ccctcagaggtgggtttcag

SEQ ID NO: 731117 - DNA, 20 bp, Artificial
  CRISPR gRNA sequence
agaggtgggtttcagaagcc

SEQ ID NO: 731118 - DNA, 20 bp, Artificial
  CRISPR gRNA sequence
cagaagccccattcgcagac

SEQ ID NO: 731119 - DNA, 20 bp, Artificial
  CRISPR gRNA sequence
agaagccccattcgcagacc

SEQ ID NO: 731120 - DNA, 20 bp, Artificial
  CRISPR gRNA sequence
gcagaccaccggcatcatga

SEQ ID NO: 731121 - DNA, 20 bp, Artificial
  CRISPR gRNA sequence
gaagtcgccaaacatcagag

SEQ ID NO: 731122 - DNA, 20 bp, Artificial
  CRISPR gRNA sequence
tgaatgcaaagagcactaac

SEQ ID NO: 731123 - DNA, 20 bp, Artificial
  CRISPR gRNA sequence
aatgcaaagagcactaacac

SEQ ID NO: 731124 - DNA, 20 bp, Artificial
  CRISPR gRNA sequence
acactcaaggaggcagaaaa

SEQ ID NO: 731125 - DNA, 20 bp, Artificial
  CRISPR gRNA sequence
aaggaggcagaaaagaggga

SEQ ID NO: 731126 - DNA, 20 bp, Artificial
  CRISPR gRNA sequence
gaaatgataccttcacgcac

SEQ ID NO: 731127 - DNA, 20 bp, Artificial
  CRISPR gRNA sequence
cacgcaccacagagcaacat

SEQ ID NO: 731128 - DNA, 20 bp, Artificial
  CRISPR gRNA sequence
acgcaccacagagcaacatt

SEQ ID NO: 731129 - DNA, 20 bp, Artificial
  CRISPR gRNA sequence
cagtcaacaatggatggcgt

SEQ ID NO: 731130 - DNA, 20 bp, Artificial
  CRISPR gRNA sequence
agtcaacaatggatggcgta

SEQ ID NO: 731131 - DNA, 20 bp, Artificial
  CRISPR gRNA sequence
acgcctgtaatcccagcact

SEQ ID NO: 731132 - DNA, 20 bp, Artificial
  CRISPR gRNA sequence
taatcccagcactttgggag

SEQ ID NO: 731133 - DNA, 20 bp, Artificial
  CRISPR gRNA sequence
tgggaggccgaggagggcgg

SEQ ID NO: 731134 - DNA, 20 bp, Artificial
  CRISPR gRNA sequence
gggaggccgaggagggcgga

SEQ ID NO: 731135 - DNA, 20 bp, Artificial
  CRISPR gRNA sequence
ggaggccgaggagggcggat

SEQ ID NO: 731136 - DNA, 20 bp, Artificial
  CRISPR gRNA sequence
aggtcaggagttcaaaacca

SEQ ID NO: 731137 - DNA, 20 bp, Artificial
  CRISPR gRNA sequence
aaaaccagcctggccaacat

SEQ ID NO: 731138 - DNA, 20 bp, Artificial
  CRISPR gRNA sequence
gccaacatggtgaaatcccg

SEQ ID NO: 731139 - DNA, 20 bp, Artificial
  CRISPR gRNA sequence
tcctaaaaaaaatacaaaaa

SEQ ID NO: 731140 - DNA, 20 bp, Artificial
  CRISPR gRNA sequence
ctaaaaaaaatacaaaaatt

SEQ ID NO: 731141 - DNA, 20 bp, Artificial
  CRISPR gRNA sequence
aaaaaaatacaaaaattagc

SEQ ID NO: 731142 - DNA, 20 bp, Artificial
  CRISPR gRNA sequence
gccaggcatggtggcgcatg

SEQ ID NO: 731143 - DNA, 20 bp, Artificial
  CRISPR gRNA sequence
taatcccagctacttgagag

SEQ ID NO: 731144 - DNA, 20 bp, Artificial
  CRISPR gRNA sequence
cttgagaggctaagacagga

SEQ ID NO: 731145 - DNA, 20 bp, Artificial
  CRISPR gRNA sequence
gagaggctaagacaggagaa

SEQ ID NO: 731146 - DNA, 20 bp, Artificial
  CRISPR gRNA sequence
agaggctaagacaggagaat

SEQ ID NO: 731147 - DNA, 20 bp, Artificial
  CRISPR gRNA sequence
agacaggagaatcgcttgaa

SEQ ID NO: 731148 - DNA, 20 bp, Artificial
  CRISPR gRNA sequence
gaacccaggttgcagtgagc

SEQ ID NO: 731149 - DNA, 20 bp, Artificial
  CRISPR gRNA sequence
aacccaggttgcagtgagcc

SEQ ID NO: 731150 - DNA, 20 bp, Artificial
  CRISPR gRNA sequence
cagtgagccgagattgcgcc

SEQ ID NO: 731151 - DNA, 20 bp, Artificial
  CRISPR gRNA sequence
cgccattgcactccagcctg

SEQ ID NO: 731152 - DNA, 20 bp, Artificial
  CRISPR gRNA sequence
cactccagcctgggcaacag

SEQ ID NO: 731153 - DNA, 20 bp, Artificial
  CRISPR gRNA sequence
cagcctgggcaacagagcag

SEQ ID NO: 731154 - DNA, 20 bp, Artificial
  CRISPR gRNA sequence
ggcaacagagcaggactcca

SEQ ID NO: 731155 - DNA, 20 bp, Artificial
  CRISPR gRNA sequence
catctcaaacaaaaaaaaca

SEQ ID NO: 731156 - DNA, 20 bp, Artificial
  CRISPR gRNA sequence
aaacaaaaaaaacaataaaa

SEQ ID NO: 731157 - DNA, 20 bp, Artificial
  CRISPR gRNA sequence
taatggagctgaaaaattcc

SEQ ID NO: 731158 - DNA, 20 bp, Artificial
  CRISPR gRNA sequence
aaaaattcctattgcctagt

SEQ ID NO: 731159 - DNA, 20 bp, Artificial
  CRISPR gRNA sequence
ctattgcctagtgatgtcat

SEQ ID NO: 731160 - DNA, 20 bp, Artificial
  CRISPR gRNA sequence
ttgcctagtgatgtcatagc

SEQ ID NO: 731161 - DNA, 20 bp, Artificial
  CRISPR gRNA sequence
cctagtgatgtcatagccac

SEQ ID NO: 731162 - DNA, 20 bp, Artificial
  CRISPR gRNA sequence
gtgatgtcatagccacggca

SEQ ID NO: 731163 - DNA, 20 bp, Artificial
  CRISPR gRNA sequence
ctcccatgtttgtggagatg

SEQ ID NO: 731164 - DNA, 20 bp, Artificial
  CRISPR gRNA sequence
ccatgtttgtggagatgttg

SEQ ID NO: 731165 - DNA, 20 bp, Artificial
  CRISPR gRNA sequence
gtggagatgttggtataaac

SEQ ID NO: 731166 - DNA, 20 bp, Artificial
  CRISPR gRNA sequence
tggagatgttggtataaaca

SEQ ID NO: 731167 - DNA, 20 bp, Artificial
  CRISPR gRNA sequence
gtataaacaaacctactgcc

SEQ ID NO: 731168 - DNA, 20 bp, Artificial
  CRISPR gRNA sequence
ctgccctgccagttgtataa

SEQ ID NO: 731169 - DNA, 20 bp, Artificial
  CRISPR gRNA sequence
ccctgccagttgtataaaag

SEQ ID NO: 731170 - DNA, 20 bp, Artificial
  CRISPR gRNA sequence
ccagttgtataaaagtgctg

SEQ ID NO: 731171 - DNA, 20 bp, Artificial
  CRISPR gRNA sequence
tataaaagtgctgcatagca

SEQ ID NO: 731172 - DNA, 20 bp, Artificial
  CRISPR gRNA sequence
catagcacatgcaattatgg

SEQ ID NO: 731173 - DNA, 20 bp, Artificial
  CRISPR gRNA sequence
tggatagtatgtaatacttg

SEQ ID NO: 731174 - DNA, 20 bp, Artificial
  CRISPR gRNA sequence
gataatgatcatagaaagct

SEQ ID NO: 731175 - DNA, 20 bp, Artificial
  CRISPR gRNA sequence
ataatgatcatagaaagcta

SEQ ID NO: 731176 - DNA, 20 bp, Artificial
  CRISPR gRNA sequence
tattgctggtttacgtactt

SEQ ID NO: 731177 - DNA, 20 bp, Artificial
  CRISPR gRNA sequence
ctggtttacgtacttactgt

SEQ ID NO: 731178 - DNA, 20 bp, Artificial
  CRISPR gRNA sequence
gtttacgtacttactgtact

SEQ ID NO: 731179 - DNA, 20 bp, Artificial
  CRISPR gRNA sequence
acgtacttactgtactatac

SEQ ID NO: 731180 - DNA, 20 bp, Artificial
  CRISPR gRNA sequence
cgtacttactgtactatact

SEQ ID NO: 731181 - DNA, 20 bp, Artificial
  CRISPR gRNA sequence
actgtactatactttttatc

SEQ ID NO: 731182 - DNA, 20 bp, Artificial
  CRISPR gRNA sequence
ctgtactatactttttatca

SEQ ID NO: 731183 - DNA, 20 bp, Artificial
  CRISPR gRNA sequence
tactatactttttatcattt

SEQ ID NO: 731184 - DNA, 20 bp, Artificial
  CRISPR gRNA sequence
tactttttatcatttttttt

SEQ ID NO: 731185 - DNA, 20 bp, Artificial
  CRISPR gRNA sequence
tttatcattttttttttttg

SEQ ID NO: 731186 - DNA, 20 bp, Artificial
  CRISPR gRNA sequence
ttatcattttttttttttga

SEQ ID NO: 731187 - DNA, 20 bp, Artificial
  CRISPR gRNA sequence
tatcattttttttttttgaa

SEQ ID NO: 731188 - DNA, 20 bp, Artificial
  CRISPR gRNA sequence
atcattttttttttttgaaa

SEQ ID NO: 731189 - DNA, 20 bp, Artificial
  CRISPR gRNA sequence
tcattttttttttttgaaac

SEQ ID NO: 731190 - DNA, 20 bp, Artificial
  CRISPR gRNA sequence
tttttttttgaaacagggtc

SEQ ID NO: 731191 - DNA, 20 bp, Artificial
  CRISPR gRNA sequence
ttttttttgaaacagggtct

SEQ ID NO: 731192 - DNA, 20 bp, Artificial
  CRISPR gRNA sequence
tttttttgaaacagggtctt

SEQ ID NO: 731193 - DNA, 20 bp, Artificial
  CRISPR gRNA sequence
ttttttgaaacagggtcttg

SEQ ID NO: 731194 - DNA, 20 bp, Artificial
  CRISPR gRNA sequence
tttttgaaacagggtcttgc

SEQ ID NO: 731195 - DNA, 20 bp, Artificial
  CRISPR gRNA sequence
ttttgaaacagggtcttgct

SEQ ID NO: 731196 - DNA, 20 bp, Artificial
  CRISPR gRNA sequence
tttgaaacagggtcttgctc

SEQ ID NO: 731197 - DNA, 20 bp, Artificial
  CRISPR gRNA sequence
ttgaaacagggtcttgctct

SEQ ID NO: 731198 - DNA, 20 bp, Artificial
  CRISPR gRNA sequence
tgaaacagggtcttgctctg

SEQ ID NO: 731199 - DNA, 20 bp, Artificial
  CRISPR gRNA sequence
gaaacagggtcttgctctgt

SEQ ID NO: 731200 - DNA, 20 bp, Artificial
  CRISPR gRNA sequence
aaacagggtcttgctctgtt

SEQ ID NO: 731201 - DNA, 20 bp, Artificial
  CRISPR gRNA sequence
gctctgttgcccaggctgga

SEQ ID NO: 731202 - DNA, 20 bp, Artificial
  CRISPR gRNA sequence
ctctgttgcccaggctggag

SEQ ID NO: 731203 - DNA, 20 bp, Artificial
  CRISPR gRNA sequence
tgttgcccaggctggagtgc

SEQ ID NO: 731204 - DNA, 20 bp, Artificial
  CRISPR gRNA sequence
ttgcccaggctggagtgcag

SEQ ID NO: 731205 - DNA, 20 bp, Artificial
  CRISPR gRNA sequence
cccaggctggagtgcagtgg

SEQ ID NO: 731206 - DNA, 20 bp, Artificial
  CRISPR gRNA sequence
gagtgcagtggcatgatcac

SEQ ID NO: 731207 - DNA, 20 bp, Artificial
  CRISPR gRNA sequence
actgtaacctcaacttcctg

SEQ ID NO: 731208 - DNA, 20 bp, Artificial
  CRISPR gRNA sequence
taacctcaacttcctgggct

SEQ ID NO: 731209 - DNA, 20 bp, Artificial
  CRISPR gRNA sequence
aacttcctgggctcaagcca

SEQ ID NO: 731210 - DNA, 20 bp, Artificial
  CRISPR gRNA sequence
cctgggctcaagccatcctc

SEQ ID NO: 731211 - DNA, 20 bp, Artificial
  CRISPR gRNA sequence
ctgggctcaagccatcctcc

SEQ ID NO: 731212 - DNA, 20 bp, Artificial
  CRISPR gRNA sequence
ggctcaagccatcctcccac

SEQ ID NO: 731213 - DNA, 20 bp, Artificial
  CRISPR gRNA sequence
aagccatcctcccacctcag

SEQ ID NO: 731214 - DNA, 20 bp, Artificial
  CRISPR gRNA sequence
ccacctcagcctcctgagta

SEQ ID NO: 731215 - DNA, 20 bp, Artificial
  CRISPR gRNA sequence
agcctcctgagtagctggga

SEQ ID NO: 731216 - DNA, 20 bp, Artificial
  CRISPR gRNA sequence
ctgagtagctgggactacag

SEQ ID NO: 731217 - DNA, 20 bp, Artificial
  CRISPR gRNA sequence
agtagctgggactacaggcg

SEQ ID NO: 731218 - DNA, 20 bp, Artificial
  CRISPR gRNA sequence
ggactacaggcgcatgccac

SEQ ID NO: 731219 - DNA, 20 bp, Artificial
  CRISPR gRNA sequence
caggcgcatgccaccacacc

SEQ ID NO: 731220 - DNA, 20 bp, Artificial
  CRISPR gRNA sequence
atgtattttatcttgtgtag

SEQ ID NO: 731221 - DNA, 20 bp, Artificial
  CRISPR gRNA sequence
tatcttgtgtagagatgggg

SEQ ID NO: 731222 - DNA, 20 bp, Artificial
  CRISPR gRNA sequence
atcttgtgtagagatgggga

SEQ ID NO: 731223 - DNA, 20 bp, Artificial
  CRISPR gRNA sequence
tcttgtgtagagatggggat

SEQ ID NO: 731224 - DNA, 20 bp, Artificial
  CRISPR gRNA sequence
gtgtagagatggggatctca

SEQ ID NO: 731225 - DNA, 20 bp, Artificial
  CRISPR gRNA sequence
tgtagagatggggatctcac

SEQ ID NO: 731226 - DNA, 20 bp, Artificial
  CRISPR gRNA sequence
actgtgttgcccaggctggt

SEQ ID NO: 731227 - DNA, 20 bp, Artificial
  CRISPR gRNA sequence
tgttgcccaggctggtctca

SEQ ID NO: 731228 - DNA, 20 bp, Artificial
  CRISPR gRNA sequence
cccaggctggtctcaaactc

SEQ ID NO: 731229 - DNA, 20 bp, Artificial
  CRISPR gRNA sequence
gtctcaaactcctggcctca

SEQ ID NO: 731230 - DNA, 20 bp, Artificial
  CRISPR gRNA sequence
aaactcctggcctcaagtga

SEQ ID NO: 731231 - DNA, 20 bp, Artificial
  CRISPR gRNA sequence
ctggcctcaagtgattctcc

SEQ ID NO: 731232 - DNA, 20 bp, Artificial
  CRISPR gRNA sequence
gcctcaagtgattctcccag

SEQ ID NO: 731233 - DNA, 20 bp, Artificial
  CRISPR gRNA sequence
aagtgattctcccagcctgg

SEQ ID NO: 731234 - DNA, 20 bp, Artificial
  CRISPR gRNA sequence
tcccagcctggcctccctaa

SEQ ID NO: 731235 - DNA, 20 bp, Artificial
  CRISPR gRNA sequence
ccagcctggcctccctaagt

SEQ ID NO: 731236 - DNA, 20 bp, Artificial
  CRISPR gRNA sequence
gcctccctaagtgctgagac

SEQ ID NO: 731237 - DNA, 20 bp, Artificial
  CRISPR gRNA sequence
cctaagtgctgagactgcag

SEQ ID NO: 731238 - DNA, 20 bp, Artificial
  CRISPR gRNA sequence
agtgctgagactgcaggcat

SEQ ID NO: 731239 - DNA, 20 bp, Artificial
  CRISPR gRNA sequence
agactgcaggcatcagccac

SEQ ID NO: 731240 - DNA, 20 bp, Artificial
  CRISPR gRNA sequence
caggcatcagccaccaagcc

SEQ ID NO: 731241 - DNA, 20 bp, Artificial
  CRISPR gRNA sequence
atcattattttagagtgtac

SEQ ID NO: 731242 - DNA, 20 bp, Artificial
  CRISPR gRNA sequence
tcattattttagagtgtact

SEQ ID NO: 731243 - DNA, 20 bp, Artificial
  CRISPR gRNA sequence
ttttagagtgtactcctact

SEQ ID NO: 731244 - DNA, 20 bp, Artificial
  CRISPR gRNA sequence
tagagtgtactcctacttat

SEQ ID NO: 731245 - DNA, 20 bp, Artificial
  CRISPR gRNA sequence
agagtgtactcctacttatt

SEQ ID NO: 731246 - DNA, 20 bp, Artificial
  CRISPR gRNA sequence
gagtgtactcctacttatta

SEQ ID NO: 731247 - DNA, 20 bp, Artificial
  CRISPR gRNA sequence
ctacttattaaaacaaaagt

SEQ ID NO: 731248 - DNA, 20 bp, Artificial
  CRISPR gRNA sequence
cttattaaaacaaaagttaa

SEQ ID NO: 731249 - DNA, 20 bp, Artificial
  CRISPR gRNA sequence
attaaaacaaaagttaactg

SEQ ID NO: 731250 - DNA, 20 bp, Artificial
  CRISPR gRNA sequence
ttaaaacaaaagttaactgt

SEQ ID NO: 731251 - DNA, 20 bp, Artificial
  CRISPR gRNA sequence
aaacaaaagttaactgtaat

SEQ ID NO: 731252 - DNA, 20 bp, Artificial
  CRISPR gRNA sequence
actgtaatacagcctcaggt

SEQ ID NO: 731253 - DNA, 20 bp, Artificial
  CRISPR gRNA sequence
taatacagcctcaggtaggt

SEQ ID NO: 731254 - DNA, 20 bp, Artificial
  CRISPR gRNA sequence
aggtaggtccttctgcaggt

SEQ ID NO: 731255 - DNA, 20 bp, Artificial
  CRISPR gRNA sequence
ctgcaggtatccagaagaag

SEQ ID NO: 731256 - DNA, 20 bp, Artificial
  CRISPR gRNA sequence
tgcaggtatccagaagaagg

SEQ ID NO: 731257 - DNA, 20 bp, Artificial
  CRISPR gRNA sequence
caggtatccagaagaaggca

SEQ ID NO: 731258 - DNA, 20 bp, Artificial
  CRISPR gRNA sequence
ttatcataggagacgatact

SEQ ID NO: 731259 - DNA, 20 bp, Artificial
  CRISPR gRNA sequence
tcataggagacgatactcca

SEQ ID NO: 731260 - DNA, 20 bp, Artificial
  CRISPR gRNA sequence
catgcatgttaccttaccgc

SEQ ID NO: 731261 - DNA, 20 bp, Artificial
  CRISPR gRNA sequence
ccttaccgctcctgaagacc

SEQ ID NO: 731262 - DNA, 20 bp, Artificial
  CRISPR gRNA sequence
accgctcctgaagaccttcc

SEQ ID NO: 731263 - DNA, 20 bp, Artificial
  CRISPR gRNA sequence
ccgctcctgaagaccttcca

SEQ ID NO: 731264 - DNA, 20 bp, Artificial
  CRISPR gRNA sequence
ctgaagaccttccaatggga

SEQ ID NO: 731265 - DNA, 20 bp, Artificial
  CRISPR gRNA sequence
aagaccttccaatgggacag

SEQ ID NO: 731266 - DNA, 20 bp, Artificial
  CRISPR gRNA sequence
ccaatgggacaggattcttt

SEQ ID NO: 731267 - DNA, 20 bp, Artificial
  CRISPR gRNA sequence
caatgggacaggattctttt

SEQ ID NO: 731268 - DNA, 20 bp, Artificial
  CRISPR gRNA sequence
ttttttttttttttttgaga

SEQ ID NO: 731269 - DNA, 20 bp, Artificial
  CRISPR gRNA sequence
ttttttttttttttgagaca

SEQ ID NO: 731270 - DNA, 20 bp, Artificial
  CRISPR gRNA sequence
tttttttttttttgagacag

SEQ ID NO: 731271 - DNA, 20 bp, Artificial
  CRISPR gRNA sequence
ttttttttttttgagacaga

SEQ ID NO: 731272 - DNA, 20 bp, Artificial
  CRISPR gRNA sequence
tttttttttttgagacagag

SEQ ID NO: 731273 - DNA, 20 bp, Artificial
  CRISPR gRNA sequence
ttttttttttgagacagagt

SEQ ID NO: 731274 - DNA, 20 bp, Artificial
  CRISPR gRNA sequence
tttttttttgagacagagtc

SEQ ID NO: 731275 - DNA, 20 bp, Artificial
  CRISPR gRNA sequence
ttttttttgagacagagtct

SEQ ID NO: 731276 - DNA, 20 bp, Artificial
  CRISPR gRNA sequence
tttttttgagacagagtctc

SEQ ID NO: 731277 - DNA, 20 bp, Artificial
  CRISPR gRNA sequence
ttttttgagacagagtctca

SEQ ID NO: 731278 - DNA, 20 bp, Artificial
  CRISPR gRNA sequence
tttttgagacagagtctcat

SEQ ID NO: 731279 - DNA, 20 bp, Artificial
  CRISPR gRNA sequence
ttttgagacagagtctcatt

SEQ ID NO: 731280 - DNA, 20 bp, Artificial
  CRISPR gRNA sequence
tttgagacagagtctcattc

SEQ ID NO: 731281 - DNA, 20 bp, Artificial
  CRISPR gRNA sequence
ttgagacagagtctcattct

SEQ ID NO: 731282 - DNA, 20 bp, Artificial
  CRISPR gRNA sequence
tgagacagagtctcattctg

SEQ ID NO: 731283 - DNA, 20 bp, Artificial
  CRISPR gRNA sequence
gagacagagtctcattctgt

SEQ ID NO: 731284 - DNA, 20 bp, Artificial
  CRISPR gRNA sequence
agacagagtctcattctgtc

SEQ ID NO: 731285 - DNA, 20 bp, Artificial
  CRISPR gRNA sequence
attctgtcacccaggctgga

SEQ ID NO: 731286 - DNA, 20 bp, Artificial
  CRISPR gRNA sequence
tgtcacccaggctggagtgc

SEQ ID NO: 731287 - DNA, 20 bp, Artificial
  CRISPR gRNA sequence
tcacccaggctggagtgcag

SEQ ID NO: 731288 - DNA, 20 bp, Artificial
  CRISPR gRNA sequence
gagtgcagtagcacaatctc

SEQ ID NO: 731289 - DNA, 20 bp, Artificial
  CRISPR gRNA sequence
agctcactgcaacctccgcc

SEQ ID NO: 731290 - DNA, 20 bp, Artificial
  CRISPR gRNA sequence
actgcaacctccgcctcccg

SEQ ID NO: 731291 - DNA, 20 bp, Artificial
  CRISPR gRNA sequence
caacctccgcctcccgggtt

SEQ ID NO: 731292 - DNA, 20 bp, Artificial
  CRISPR gRNA sequence
cgcctcccgggttcaagcaa

SEQ ID NO: 731293 - DNA, 20 bp, Artificial
  CRISPR gRNA sequence
ccgggttcaagcaattctcc

SEQ ID NO: 731294 - DNA, 20 bp, Artificial
  CRISPR gRNA sequence
aagcaattctcctgcctcag

SEQ ID NO: 731295 - DNA, 20 bp, Artificial
  CRISPR gRNA sequence
tcctgcctcagccacctgag

SEQ ID NO: 731296 - DNA, 20 bp, Artificial
  CRISPR gRNA sequence
ctgcctcagccacctgagta

SEQ ID NO: 731297 - DNA, 20 bp, Artificial
  CRISPR gRNA sequence
cctcagccacctgagtagct

SEQ ID NO: 731298 - DNA, 20 bp, Artificial
  CRISPR gRNA sequence
agccacctgagtagctggga

SEQ ID NO: 731299 - DNA, 20 bp, Artificial
  CRISPR gRNA sequence
agtagctgggattacaggcg

SEQ ID NO: 731300 - DNA, 20 bp, Artificial
  CRISPR gRNA sequence
ggattacaggcgcatgccaa

SEQ ID NO: 731301 - DNA, 20 bp, Artificial
  CRISPR gRNA sequence
caggcgcatgccaacgtgcc

SEQ ID NO: 731302 - DNA, 20 bp, Artificial
  CRISPR gRNA sequence
atttttatatttttagtaga

SEQ ID NO: 731303 - DNA, 20 bp, Artificial
  CRISPR gRNA sequence
ttatatttttagtagagatg

SEQ ID NO: 731304 - DNA, 20 bp, Artificial
  CRISPR gRNA sequence
tatatttttagtagagatgg

SEQ ID NO: 731305 - DNA, 20 bp, Artificial
  CRISPR gRNA sequence
atatttttagtagagatggg

SEQ ID NO: 731306 - DNA, 20 bp, Artificial
  CRISPR gRNA sequence
tatttttagtagagatgggg

SEQ ID NO: 731307 - DNA, 20 bp, Artificial
  CRISPR gRNA sequence
ttagtagagatggggtttca

SEQ ID NO: 731308 - DNA, 20 bp, Artificial
  CRISPR gRNA sequence
tagtagagatggggtttcac

SEQ ID NO: 731309 - DNA, 20 bp, Artificial
  CRISPR gRNA sequence
agtagagatggggtttcacc

SEQ ID NO: 731310 - DNA, 20 bp, Artificial
  CRISPR gRNA sequence
gtagagatggggtttcacca

SEQ ID NO: 731311 - DNA, 20 bp, Artificial
  CRISPR gRNA sequence
caccatgttggccaagctgg

SEQ ID NO: 731312 - DNA, 20 bp, Artificial
  CRISPR gRNA sequence
accatgttggccaagctggt

SEQ ID NO: 731313 - DNA, 20 bp, Artificial
  CRISPR gRNA sequence
gccaagctggtcttgaactc

SEQ ID NO: 731314 - DNA, 20 bp, Artificial
  CRISPR gRNA sequence
gtcttgaactcttgacctca

SEQ ID NO: 731315 - DNA, 20 bp, Artificial
  CRISPR gRNA sequence
gaactcttgacctcaagtga

SEQ ID NO: 731316 - DNA, 20 bp, Artificial
  CRISPR gRNA sequence
aactcttgacctcaagtgat

SEQ ID NO: 731317 - DNA, 20 bp, Artificial
  CRISPR gRNA sequence
ttgacctcaagtgatctgcc

SEQ ID NO: 731318 - DNA, 20 bp, Artificial
  CRISPR gRNA sequence
gacctcaagtgatctgccca

SEQ ID NO: 731319 - DNA, 20 bp, Artificial
  CRISPR gRNA sequence
acctcaagtgatctgcccac

SEQ ID NO: 731320 - DNA, 20 bp, Artificial
  CRISPR gRNA sequence
aagtgatctgcccacctcgg

SEQ ID NO: 731321 - DNA, 20 bp, Artificial
  CRISPR gRNA sequence
cccacctcggcttcccaaag

SEQ ID NO: 731322 - DNA, 20 bp, Artificial
  CRISPR gRNA sequence
ggcttcccaaagtgctggga

SEQ ID NO: 731323 - DNA, 20 bp, Artificial
  CRISPR gRNA sequence
cccaaagtgctgggattaca

SEQ ID NO: 731324 - DNA, 20 bp, Artificial
  CRISPR gRNA sequence
ccaaagtgctgggattacag

SEQ ID NO: 731325 - DNA, 20 bp, Artificial
  CRISPR gRNA sequence
ggattacaggtgtgagtcac

SEQ ID NO: 731326 - DNA, 20 bp, Artificial
  CRISPR gRNA sequence
caggtgtgagtcactgcacg

SEQ ID NO: 731327 - DNA, 20 bp, Artificial
  CRISPR gRNA sequence
cacgctgccaatgggacaag

SEQ ID NO: 731328 - DNA, 20 bp, Artificial
  CRISPR gRNA sequence
ccaatgggacaagatttgga

SEQ ID NO: 731329 - DNA, 20 bp, Artificial
  CRISPR gRNA sequence
ggaggaggaagacggtgatt

SEQ ID NO: 731330 - DNA, 20 bp, Artificial
  CRISPR gRNA sequence
gaggaggaagacggtgattc

SEQ ID NO: 731331 - DNA, 20 bp, Artificial
  CRISPR gRNA sequence
tgatgatcctgactctgtgt

SEQ ID NO: 731332 - DNA, 20 bp, Artificial
  CRISPR gRNA sequence
atgatcctgactctgtgtag

SEQ ID NO: 731333 - DNA, 20 bp, Artificial
  CRISPR gRNA sequence
actctgtgtaggcctcggat

SEQ ID NO: 731334 - DNA, 20 bp, Artificial
  CRISPR gRNA sequence
tgtgtaggcctcggataatg

SEQ ID NO: 731335 - DNA, 20 bp, Artificial
  CRISPR gRNA sequence
tgtaggcctcggataatgta

SEQ ID NO: 731336 - DNA, 20 bp, Artificial
  CRISPR gRNA sequence
ggataatgtaggtgtttgcg

SEQ ID NO: 731337 - DNA, 20 bp, Artificial
  CRISPR gRNA sequence
gcgtctcagcttttaattta

SEQ ID NO: 731338 - DNA, 20 bp, Artificial
  CRISPR gRNA sequence
cgtctcagcttttaatttaa

SEQ ID NO: 731339 - DNA, 20 bp, Artificial
  CRISPR gRNA sequence
agcttttaatttaaaaatgt

SEQ ID NO: 731340 - DNA, 20 bp, Artificial
  CRISPR gRNA sequence
ttaatttaaaaatgttaaaa

SEQ ID NO: 731341 - DNA, 20 bp, Artificial
  CRISPR gRNA sequence
taatttaaaaatgttaaaaa

SEQ ID NO: 731342 - DNA, 20 bp, Artificial
  CRISPR gRNA sequence
aatttaaaaatgttaaaaat

SEQ ID NO: 731343 - DNA, 20 bp, Artificial
  CRISPR gRNA sequence
atttaaaaatgttaaaaata

SEQ ID NO: 731344 - DNA, 20 bp, Artificial
  CRISPR gRNA sequence
aaaaatgttaaaaataataa

SEQ ID NO: 731345 - DNA, 20 bp, Artificial
  CRISPR gRNA sequence
aaaatgttaaaaataataaa

SEQ ID NO: 731346 - DNA, 20 bp, Artificial
  CRISPR gRNA sequence
aaaataataaaataataaaa

SEQ ID NO: 731347 - DNA, 20 bp, Artificial
  CRISPR gRNA sequence
taaagtagaaaaaagtgtaa

SEQ ID NO: 731348 - DNA, 20 bp, Artificial
  CRISPR gRNA sequence
aaagtagaaaaaagtgtaat

SEQ ID NO: 731349 - DNA, 20 bp, Artificial
  CRISPR gRNA sequence
aagtagaaaaaagtgtaatg

SEQ ID NO: 731350 - DNA, 20 bp, Artificial
  CRISPR gRNA sequence
taaagaaaatatttttgtac

SEQ ID NO: 731351 - DNA, 20 bp, Artificial
  CRISPR gRNA sequence
ttgtacagctgtacgatgtg

SEQ ID NO: 731352 - DNA, 20 bp, Artificial
  CRISPR gRNA sequence
tgtacagctgtacgatgtgt

SEQ ID NO: 731353 - DNA, 20 bp, Artificial
  CRISPR gRNA sequence
gtacagctgtacgatgtgtt

SEQ ID NO: 731354 - DNA, 20 bp, Artificial
  CRISPR gRNA sequence
tacagctgtacgatgtgttt

SEQ ID NO: 731355 - DNA, 20 bp, Artificial
  CRISPR gRNA sequence
tacgatgtgtttgtgcttta

SEQ ID NO: 731356 - DNA, 20 bp, Artificial
  CRISPR gRNA sequence
gtgctttaagctaagtgtta

SEQ ID NO: 731357 - DNA, 20 bp, Artificial
  CRISPR gRNA sequence
tgctttaagctaagtgttat

SEQ ID NO: 731358 - DNA, 20 bp, Artificial
  CRISPR gRNA sequence
taagctaagtgttattacaa

SEQ ID NO: 731359 - DNA, 20 bp, Artificial
  CRISPR gRNA sequence
aagctaagtgttattacaaa

SEQ ID NO: 731360 - DNA, 20 bp, Artificial
  CRISPR gRNA sequence
agctaagtgttattacaaaa

SEQ ID NO: 731361 - DNA, 20 bp, Artificial
  CRISPR gRNA sequence
agtgttattacaaaagagcc

SEQ ID NO: 731362 - DNA, 20 bp, Artificial
  CRISPR gRNA sequence
ttacaaaagagccaaaagtt

SEQ ID NO: 731363 - DNA, 20 bp, Artificial
  CRISPR gRNA sequence
caaaagagccaaaagtttaa

SEQ ID NO: 731364 - DNA, 20 bp, Artificial
  CRISPR gRNA sequence
aaaaagttaaagtttataaa

SEQ ID NO: 731365 - DNA, 20 bp, Artificial
  CRISPR gRNA sequence
aaaagttaaagtttataaag

SEQ ID NO: 731366 - DNA, 20 bp, Artificial
  CRISPR gRNA sequence
aagtttataaagtgaaaaag

SEQ ID NO: 731367 - DNA, 20 bp, Artificial
  CRISPR gRNA sequence
ataaagtgaaaaagttgttt

SEQ ID NO: 731368 - DNA, 20 bp, Artificial
  CRISPR gRNA sequence
taaagtgaaaaagttgttta

SEQ ID NO: 731369 - DNA, 20 bp, Artificial
  CRISPR gRNA sequence
tttaatttattattgaagaa

SEQ ID NO: 731370 - DNA, 20 bp, Artificial
  CRISPR gRNA sequence
aatttattattgaagaaaga

SEQ ID NO: 731371 - DNA, 20 bp, Artificial
  CRISPR gRNA sequence
atttattattgaagaaagaa

SEQ ID NO: 731372 - DNA, 20 bp, Artificial
  CRISPR gRNA sequence
attattgaagaaagaaaaat

SEQ ID NO: 731373 - DNA, 20 bp, Artificial
  CRISPR gRNA sequence
ttattgaagaaagaaaaatg

SEQ ID NO: 731374 - DNA, 20 bp, Artificial
  CRISPR gRNA sequence
ttgaagaaagaaaaatgtgt

SEQ ID NO: 731375 - DNA, 20 bp, Artificial
  CRISPR gRNA sequence
aagaaagaaaaatgtgtctt

SEQ ID NO: 731376 - DNA, 20 bp, Artificial
  CRISPR gRNA sequence
ataaatttagtatagcctaa

SEQ ID NO: 731377 - DNA, 20 bp, Artificial
  CRISPR gRNA sequence
taaatttagtatagcctaag

SEQ ID NO: 731378 - DNA, 20 bp, Artificial
  CRISPR gRNA sequence
agtatagcctaagtgtacag

SEQ ID NO: 731379 - DNA, 20 bp, Artificial
  CRISPR gRNA sequence
gtatagcctaagtgtacagt

SEQ ID NO: 731380 - DNA, 20 bp, Artificial
  CRISPR gRNA sequence
agtgtacagtgttgataaag

SEQ ID NO: 731381 - DNA, 20 bp, Artificial
  CRISPR gRNA sequence
ataaagtccacagtagtgca

SEQ ID NO: 731382 - DNA, 20 bp, Artificial
  CRISPR gRNA sequence
cgcactcacccaccacttac

SEQ ID NO: 731383 - DNA, 20 bp, Artificial
  CRISPR gRNA sequence
gcactcacccaccacttact

SEQ ID NO: 731384 - DNA, 20 bp, Artificial
  CRISPR gRNA sequence
acccaccacttactcattga

SEQ ID NO: 731385 - DNA, 20 bp, Artificial
  CRISPR gRNA sequence
actcattgactcacccagaa

SEQ ID NO: 731386 - DNA, 20 bp, Artificial
  CRISPR gRNA sequence
ctcattgactcacccagaac

SEQ ID NO: 731387 - DNA, 20 bp, Artificial
  CRISPR gRNA sequence
attgactcacccagaacaac

SEQ ID NO: 731388 - DNA, 20 bp, Artificial
  CRISPR gRNA sequence
actcacccagaacaacttcg

SEQ ID NO: 731389 - DNA, 20 bp, Artificial
  CRISPR gRNA sequence
acccagaacaacttcgtgtc

SEQ ID NO: 731390 - DNA, 20 bp, Artificial
  CRISPR gRNA sequence
cgtgtcctgcaagctccatt

SEQ ID NO: 731391 - DNA, 20 bp, Artificial
  CRISPR gRNA sequence
gtgtcctgcaagctccattc

SEQ ID NO: 731392 - DNA, 20 bp, Artificial
  CRISPR gRNA sequence
caagctccattcacggtaag

SEQ ID NO: 731393 - DNA, 20 bp, Artificial
  CRISPR gRNA sequence
cattcacggtaagtgccctg

SEQ ID NO: 731394 - DNA, 20 bp, Artificial
  CRISPR gRNA sequence
acggtaagtgccctgtacaa

SEQ ID NO: 731395 - DNA, 20 bp, Artificial
  CRISPR gRNA sequence
tacaagtgtgccattttttt

SEQ ID NO: 731396 - DNA, 20 bp, Artificial
  CRISPR gRNA sequence
tttttatctttcatatcata

SEQ ID NO: 731397 - DNA, 20 bp, Artificial
  CRISPR gRNA sequence
ttttatctttcatatcatat

SEQ ID NO: 731398 - DNA, 20 bp, Artificial
  CRISPR gRNA sequence
tttatctttcatatcatatt

SEQ ID NO: 731399 - DNA, 20 bp, Artificial
  CRISPR gRNA sequence
ttatctttcatatcatattt

SEQ ID NO: 731400 - DNA, 20 bp, Artificial
  CRISPR gRNA sequence
tatctttcatatcatatttt

SEQ ID NO: 731401 - DNA, 20 bp, Artificial
  CRISPR gRNA sequence
atctttcatatcatattttt

SEQ ID NO: 731402 - DNA, 20 bp, Artificial
  CRISPR gRNA sequence
tctttcatatcatatttttt

SEQ ID NO: 731403 - DNA, 20 bp, Artificial
  CRISPR gRNA sequence
tcatatcatatttttttttt

SEQ ID NO: 731404 - DNA, 20 bp, Artificial
  CRISPR gRNA sequence
catatcatatttttttttta

SEQ ID NO: 731405 - DNA, 20 bp, Artificial
  CRISPR gRNA sequence
atatcatattttttttttag

SEQ ID NO: 731406 - DNA, 20 bp, Artificial
  CRISPR gRNA sequence
tttttttagatggtgtctca

SEQ ID NO: 731407 - DNA, 20 bp, Artificial
  CRISPR gRNA sequence
ttttttagatggtgtctcac

SEQ ID NO: 731408 - DNA, 20 bp, Artificial
  CRISPR gRNA sequence
tttttagatggtgtctcact

SEQ ID NO: 731409 - DNA, 20 bp, Artificial
  CRISPR gRNA sequence
ttttagatggtgtctcactc

SEQ ID NO: 731410 - DNA, 20 bp, Artificial
  CRISPR gRNA sequence
tttagatggtgtctcactct

SEQ ID NO: 731411 - DNA, 20 bp, Artificial
  CRISPR gRNA sequence
ttagatggtgtctcactcta

SEQ ID NO: 731412 - DNA, 20 bp, Artificial
  CRISPR gRNA sequence
tagatggtgtctcactctat

SEQ ID NO: 731413 - DNA, 20 bp, Artificial
  CRISPR gRNA sequence
agatggtgtctcactctatc

SEQ ID NO: 731414 - DNA, 20 bp, Artificial
  CRISPR gRNA sequence
gatggtgtctcactctatca

SEQ ID NO: 731415 - DNA, 20 bp, Artificial
  CRISPR gRNA sequence
actctatcacccaggctgga

SEQ ID NO: 731416 - DNA, 20 bp, Artificial
  CRISPR gRNA sequence
tatcacccaggctggagtgc

SEQ ID NO: 731417 - DNA, 20 bp, Artificial
  CRISPR gRNA sequence
tcacccaggctggagtgcag

SEQ ID NO: 731418 - DNA, 20 bp, Artificial
  CRISPR gRNA sequence
gagtgcagtggcatgatctc

SEQ ID NO: 731419 - DNA, 20 bp, Artificial
  CRISPR gRNA sequence
ggcgcactgcaacctccgcc

SEQ ID NO: 731420 - DNA, 20 bp, Artificial
  CRISPR gRNA sequence
caacctccgcctcccaggtt

SEQ ID NO: 731421 - DNA, 20 bp, Artificial
  CRISPR gRNA sequence
cgcctcccaggttcaagcaa

SEQ ID NO: 731422 - DNA, 20 bp, Artificial
  CRISPR gRNA sequence
ccaggttcaagcaattcttc

SEQ ID NO: 731423 - DNA, 20 bp, Artificial
  CRISPR gRNA sequence
aagcaattcttctgcttcag

SEQ ID NO: 731424 - DNA, 20 bp, Artificial
  CRISPR gRNA sequence
ttctgcttcagcctcttgag

SEQ ID NO: 731425 - DNA, 20 bp, Artificial
  CRISPR gRNA sequence
ctgcttcagcctcttgagta

SEQ ID NO: 731426 - DNA, 20 bp, Artificial
  CRISPR gRNA sequence
tgcttcagcctcttgagtag

SEQ ID NO: 731427 - DNA, 20 bp, Artificial
  CRISPR gRNA sequence
cttcagcctcttgagtagct

SEQ ID NO: 731428 - DNA, 20 bp, Artificial
  CRISPR gRNA sequence
cagcctcttgagtagctggg

SEQ ID NO: 731429 - DNA, 20 bp, Artificial
  CRISPR gRNA sequence
agcctcttgagtagctggga

SEQ ID NO: 731430 - DNA, 20 bp, Artificial
  CRISPR gRNA sequence
ttgagtagctgggactacag

SEQ ID NO: 731431 - DNA, 20 bp, Artificial
  CRISPR gRNA sequence
gagtagctgggactacagac

SEQ ID NO: 731432 - DNA, 20 bp, Artificial
  CRISPR gRNA sequence
agtagctgggactacagaca

SEQ ID NO: 731433 - DNA, 20 bp, Artificial
  CRISPR gRNA sequence
ggactacagacacgtgccac

SEQ ID NO: 731434 - DNA, 20 bp, Artificial
  CRISPR gRNA sequence
cagacacgtgccaccacgcc

SEQ ID NO: 731435 - DNA, 20 bp, Artificial
  CRISPR gRNA sequence
atttttgtatttttagtaga

SEQ ID NO: 731436 - DNA, 20 bp, Artificial
  CRISPR gRNA sequence
ttgtatttttagtagagatg

SEQ ID NO: 731437 - DNA, 20 bp, Artificial
  CRISPR gRNA sequence
tgtatttttagtagagatgg

SEQ ID NO: 731438 - DNA, 20 bp, Artificial
  CRISPR gRNA sequence
gtatttttagtagagatggg

SEQ ID NO: 731439 - DNA, 20 bp, Artificial
  CRISPR gRNA sequence
tatttttagtagagatgggg

SEQ ID NO: 731440 - DNA, 20 bp, Artificial
  CRISPR gRNA sequence
ttagtagagatggggtttcg

SEQ ID NO: 731441 - DNA, 20 bp, Artificial
  CRISPR gRNA sequence
tagtagagatggggtttcgc

SEQ ID NO: 731442 - DNA, 20 bp, Artificial
  CRISPR gRNA sequence
agtagagatggggtttcgcc

SEQ ID NO: 731443 - DNA, 20 bp, Artificial
  CRISPR gRNA sequence
gtagagatggggtttcgcca

SEQ ID NO: 731444 - DNA, 20 bp, Artificial
  CRISPR gRNA sequence
cgccatgttagccaggctgg

SEQ ID NO: 731445 - DNA, 20 bp, Artificial
  CRISPR gRNA sequence
gccatgttagccaggctggt

SEQ ID NO: 731446 - DNA, 20 bp, Artificial
  CRISPR gRNA sequence
gccaggctggtctcgaactc

SEQ ID NO: 731447 - DNA, 20 bp, Artificial
  CRISPR gRNA sequence
gtctcgaactcctgacctca

SEQ ID NO: 731448 - DNA, 20 bp, Artificial
  CRISPR gRNA sequence
gaactcctgacctcaggtaa

SEQ ID NO: 731449 - DNA, 20 bp, Artificial
  CRISPR gRNA sequence
ctgacctcaggtaatccacc

SEQ ID NO: 731450 - DNA, 20 bp, Artificial
  CRISPR gRNA sequence
acctcaggtaatccaccctc

SEQ ID NO: 731451 - DNA, 20 bp, Artificial
  CRISPR gRNA sequence
aggtaatccaccctcctcgg

SEQ ID NO: 731452 - DNA, 20 bp, Artificial
  CRISPR gRNA sequence
ctcggcctcccaaagtgctg

SEQ ID NO: 731453 - DNA, 20 bp, Artificial
  CRISPR gRNA sequence
ggcctcccaaagtgctggca

SEQ ID NO: 731454 - DNA, 20 bp, Artificial
  CRISPR gRNA sequence
ccaaagtgctggcattacag

SEQ ID NO: 731455 - DNA, 20 bp, Artificial
  CRISPR gRNA sequence
gcattacaggtgtgagtcac

SEQ ID NO: 731456 - DNA, 20 bp, Artificial
  CRISPR gRNA sequence
caggtgtgagtcactgtgcc

SEQ ID NO: 731457 - DNA, 20 bp, Artificial
  CRISPR gRNA sequence
tgcccggcctatgtcgtatt

SEQ ID NO: 731458 - DNA, 20 bp, Artificial
  CRISPR gRNA sequence
tgtcgtatttttattgcacc

SEQ ID NO: 731459 - DNA, 20 bp, Artificial
  CRISPR gRNA sequence
ttattgcaccttttctatgt

SEQ ID NO: 731460 - DNA, 20 bp, Artificial
  CRISPR gRNA sequence
tattgcaccttttctatgtt

SEQ ID NO: 731461 - DNA, 20 bp, Artificial
  CRISPR gRNA sequence
attgcaccttttctatgttt

SEQ ID NO: 731462 - DNA, 20 bp, Artificial
  CRISPR gRNA sequence
ttgcaccttttctatgttta

SEQ ID NO: 731463 - DNA, 20 bp, Artificial
  CRISPR gRNA sequence
caccttttctatgtttagat

SEQ ID NO: 731464 - DNA, 20 bp, Artificial
  CRISPR gRNA sequence
ttctatgtttagatacacaa

SEQ ID NO: 731465 - DNA, 20 bp, Artificial
  CRISPR gRNA sequence
tctatgtttagatacacaaa

SEQ ID NO: 731466 - DNA, 20 bp, Artificial
  CRISPR gRNA sequence
ctatgtttagatacacaaat

SEQ ID NO: 731467 - DNA, 20 bp, Artificial
  CRISPR gRNA sequence
tatgtttagatacacaaata

SEQ ID NO: 731468 - DNA, 20 bp, Artificial
  CRISPR gRNA sequence
tgtttagatacacaaatact

SEQ ID NO: 731469 - DNA, 20 bp, Artificial
  CRISPR gRNA sequence
agatacacaaatactcacat

SEQ ID NO: 731470 - DNA, 20 bp, Artificial
  CRISPR gRNA sequence
gatacacaaatactcacatt

SEQ ID NO: 731471 - DNA, 20 bp, Artificial
  CRISPR gRNA sequence
acattgtgtcacagctgcct

SEQ ID NO: 731472 - DNA, 20 bp, Artificial
  CRISPR gRNA sequence
tgtcacagctgcctacagta

SEQ ID NO: 731473 - DNA, 20 bp, Artificial
  CRISPR gRNA sequence
cctacagtattcaggacagt

SEQ ID NO: 731474 - DNA, 20 bp, Artificial
  CRISPR gRNA sequence
cagtattcaggacagtcaca

SEQ ID NO: 731475 - DNA, 20 bp, Artificial
  CRISPR gRNA sequence
aggacagtcacatgctgtgc

SEQ ID NO: 731476 - DNA, 20 bp, Artificial
  CRISPR gRNA sequence
tgcagagttgtagcttagga

SEQ ID NO: 731477 - DNA, 20 bp, Artificial
  CRISPR gRNA sequence
tagcttaggagcaaaaggat

SEQ ID NO: 731478 - DNA, 20 bp, Artificial
  CRISPR gRNA sequence
aggagcaaaaggatctgcca

SEQ ID NO: 731479 - DNA, 20 bp, Artificial
  CRISPR gRNA sequence
ggagcaaaaggatctgccat

SEQ ID NO: 731480 - DNA, 20 bp, Artificial
  CRISPR gRNA sequence
ccatagaacctaggtgtgca

SEQ ID NO: 731481 - DNA, 20 bp, Artificial
  CRISPR gRNA sequence
ggtgtgcagtaggctacatc

SEQ ID NO: 731482 - DNA, 20 bp, Artificial
  CRISPR gRNA sequence
catcatgtaggtgtgtgtaa

SEQ ID NO: 731483 - DNA, 20 bp, Artificial
  CRISPR gRNA sequence
atctaggatgcttgcacaac

SEQ ID NO: 731484 - DNA, 20 bp, Artificial
  CRISPR gRNA sequence
ggatgcttgcacaacgacaa

SEQ ID NO: 731485 - DNA, 20 bp, Artificial
  CRISPR gRNA sequence
gcacaacgacaaaattgcct

SEQ ID NO: 731486 - DNA, 20 bp, Artificial
  CRISPR gRNA sequence
cacaacgacaaaattgccta

SEQ ID NO: 731487 - DNA, 20 bp, Artificial
  CRISPR gRNA sequence
cctaatgacacgtttgtcag

SEQ ID NO: 731488 - DNA, 20 bp, Artificial
  CRISPR gRNA sequence
atgacacgtttgtcagaatg

SEQ ID NO: 731489 - DNA, 20 bp, Artificial
  CRISPR gRNA sequence
gtcagaatgtattcctgtca

SEQ ID NO: 731490 - DNA, 20 bp, Artificial
  CRISPR gRNA sequence
tcagaatgtattcctgtcaa

SEQ ID NO: 731491 - DNA, 20 bp, Artificial
  CRISPR gRNA sequence
ctgtcaataagcaatacatg

SEQ ID NO: 731492 - DNA, 20 bp, Artificial
  CRISPR gRNA sequence
tcaataagcaatacatgact

SEQ ID NO: 731493 - DNA, 20 bp, Artificial
  CRISPR gRNA sequence
taatttatatcctcagagac

SEQ ID NO: 731494 - DNA, 20 bp, Artificial
  CRISPR gRNA sequence
atatcctcagagacacacaa

SEQ ID NO: 731495 - DNA, 20 bp, Artificial
  CRISPR gRNA sequence
tatcctcagagacacacaaa

SEQ ID NO: 731496 - DNA, 20 bp, Artificial
  CRISPR gRNA sequence
agagacacacaaaaaaattg

SEQ ID NO: 731497 - DNA, 20 bp, Artificial
  CRISPR gRNA sequence
taagttgggtgcagtaacat

SEQ ID NO: 731498 - DNA, 20 bp, Artificial
  CRISPR gRNA sequence
ggtgcagtaacatgcaagtg

SEQ ID NO: 731499 - DNA, 20 bp, Artificial
  CRISPR gRNA sequence
ctcgggaggctgaggcagga

SEQ ID NO: 731500 - DNA, 20 bp, Artificial
  CRISPR gRNA sequence
gggaggctgaggcaggagga

SEQ ID NO: 731501 - DNA, 20 bp, Artificial
  CRISPR gRNA sequence
aggcaggaggaacacttaag

SEQ ID NO: 731502 - DNA, 20 bp, Artificial
  CRISPR gRNA sequence
aagccctggagtttaaggcc

SEQ ID NO: 731503 - DNA, 20 bp, Artificial
  CRISPR gRNA sequence
agccctggagtttaaggcca

SEQ ID NO: 731504 - DNA, 20 bp, Artificial
  CRISPR gRNA sequence
gagtttaaggccagcctgga

SEQ ID NO: 731505 - DNA, 20 bp, Artificial
  CRISPR gRNA sequence
aaggccagcctggacaacaa

SEQ ID NO: 731506 - DNA, 20 bp, Artificial
  CRISPR gRNA sequence
aggccagcctggacaacaaa

SEQ ID NO: 731507 - DNA, 20 bp, Artificial
  CRISPR gRNA sequence
gacaacaaagtgagaccctg

SEQ ID NO: 731508 - DNA, 20 bp, Artificial
  CRISPR gRNA sequence
tcttaaaatttaaagataag

SEQ ID NO: 731509 - DNA, 20 bp, Artificial
  CRISPR gRNA sequence
aaaatttaaagataagaaat

SEQ ID NO: 731510 - DNA, 20 bp, Artificial
  CRISPR gRNA sequence
aaatttaaagataagaaatt

SEQ ID NO: 731511 - DNA, 20 bp, Artificial
  CRISPR gRNA sequence
aaagataagaaattgggccg

SEQ ID NO: 731512 - DNA, 20 bp, Artificial
  CRISPR gRNA sequence
aagataagaaattgggccgg

SEQ ID NO: 731513 - DNA, 20 bp, Artificial
  CRISPR gRNA sequence
ggccgggaatggtgactcac

SEQ ID NO: 731514 - DNA, 20 bp, Artificial
  CRISPR gRNA sequence
acacctgtaatcccaacact

SEQ ID NO: 731515 - DNA, 20 bp, Artificial
  CRISPR gRNA sequence
taatcccaacactttaggag

SEQ ID NO: 731516 - DNA, 20 bp, Artificial
  CRISPR gRNA sequence
taggaggccaaggcggctgg

SEQ ID NO: 731517 - DNA, 20 bp, Artificial
  CRISPR gRNA sequence
aggaggccaaggcggctgga

SEQ ID NO: 731518 - DNA, 20 bp, Artificial
  CRISPR gRNA sequence
ggaggccaaggcggctggat

SEQ ID NO: 731519 - DNA, 20 bp, Artificial
  CRISPR gRNA sequence
gatcacttgaggtcaggagt

SEQ ID NO: 731520 - DNA, 20 bp, Artificial
  CRISPR gRNA sequence
gaggtcaggagtttgagacc

SEQ ID NO: 731521 - DNA, 20 bp, Artificial
  CRISPR gRNA sequence
aggtcaggagtttgagacca

SEQ ID NO: 731522 - DNA, 20 bp, Artificial
  CRISPR gRNA sequence
gagaccagcctgggcaacat

SEQ ID NO: 731523 - DNA, 20 bp, Artificial
  CRISPR gRNA sequence
agaccagcctgggcaacatg

SEQ ID NO: 731524 - DNA, 20 bp, Artificial
  CRISPR gRNA sequence
ggcaacatgatgaaacccca

SEQ ID NO: 731525 - DNA, 20 bp, Artificial
  CRISPR gRNA sequence
ttctaaaaatacaaaaatta

SEQ ID NO: 731526 - DNA, 20 bp, Artificial
  CRISPR gRNA sequence
ctaaaaatacaaaaattagc

SEQ ID NO: 731527 - DNA, 20 bp, Artificial
  CRISPR gRNA sequence
taaaaatacaaaaattagcc

SEQ ID NO: 731528 - DNA, 20 bp, Artificial
  CRISPR gRNA sequence
aaaatacaaaaattagccag

SEQ ID NO: 731529 - DNA, 20 bp, Artificial
  CRISPR gRNA sequence
gccaggcgtggtggtgcatc

SEQ ID NO: 731530 - DNA, 20 bp, Artificial
  CRISPR gRNA sequence
taatctcagctactcaggag

SEQ ID NO: 731531 - DNA, 20 bp, Artificial
  CRISPR gRNA sequence
agctactcaggaggcaggag

SEQ ID NO: 731532 - DNA, 20 bp, Artificial
  CRISPR gRNA sequence
ctcaggaggcaggagaatcg

SEQ ID NO: 731533 - DNA, 20 bp, Artificial
  CRISPR gRNA sequence
aggaggcaggagaatcgctc

SEQ ID NO: 731534 - DNA, 20 bp, Artificial
  CRISPR gRNA sequence
gaatccaggaggtagaggtt

SEQ ID NO: 731535 - DNA, 20 bp, Artificial
  CRISPR gRNA sequence
tagtgagccgagattgcacc

SEQ ID NO: 731536 - DNA, 20 bp, Artificial
  CRISPR gRNA sequence
caccactgcactccagcctg

SEQ ID NO: 731537 - DNA, 20 bp, Artificial
  CRISPR gRNA sequence
cactccagcctgggcgacag

SEQ ID NO: 731538 - DNA, 20 bp, Artificial
  CRISPR gRNA sequence
cagcctgggcgacagagtca

SEQ ID NO: 731539 - DNA, 20 bp, Artificial
  CRISPR gRNA sequence
ggcgacagagtcagactctg

SEQ ID NO: 731540 - DNA, 20 bp, Artificial
  CRISPR gRNA sequence
tgtctcaaaaagaaaaaaaa

SEQ ID NO: 731541 - DNA, 20 bp, Artificial
  CRISPR gRNA sequence
tctcaaaaagaaaaaaaaga

SEQ ID NO: 731542 - DNA, 20 bp, Artificial
  CRISPR gRNA sequence
aaaaagaaaaaaaagaaaac

SEQ ID NO: 731543 - DNA, 20 bp, Artificial
  CRISPR gRNA sequence
aaacatgaaataacagagaa

SEQ ID NO: 731544 - DNA, 20 bp, Artificial
  CRISPR gRNA sequence
caaagacgagcccttcttga

SEQ ID NO: 731545 - DNA, 20 bp, Artificial
  CRISPR gRNA sequence
cttgaaaaatccacctgaca

SEQ ID NO: 731546 - DNA, 20 bp, Artificial
  CRISPR gRNA sequence
ttgaaaaatccacctgacag

SEQ ID NO: 731547 - DNA, 20 bp, Artificial
  CRISPR gRNA sequence
gaaaaatccacctgacagtg

SEQ ID NO: 731548 - DNA, 20 bp, Artificial
  CRISPR gRNA sequence
aaaaatccacctgacagtgt

SEQ ID NO: 731549 - DNA, 20 bp, Artificial
  CRISPR gRNA sequence
acagtgtaatccaatcactc

SEQ ID NO: 731550 - DNA, 20 bp, Artificial
  CRISPR gRNA sequence
aaatgatgaatcaaagtgaa

SEQ ID NO: 731551 - DNA, 20 bp, Artificial
  CRISPR gRNA sequence
aggaacagagaagctgtgcc

SEQ ID NO: 731552 - DNA, 20 bp, Artificial
  CRISPR gRNA sequence
tgccaaataaactcatcatg

SEQ ID NO: 731553 - DNA, 20 bp, Artificial
  CRISPR gRNA sequence
atcatgaataataaaaaatg

SEQ ID NO: 731554 - DNA, 20 bp, Artificial
  CRISPR gRNA sequence
aggctaacatgccaagggac

SEQ ID NO: 731555 - DNA, 20 bp, Artificial
  CRISPR gRNA sequence
acatgccaagggacttatgg

SEQ ID NO: 731556 - DNA, 20 bp, Artificial
  CRISPR gRNA sequence
atggttgcagatgagaatat

SEQ ID NO: 731557 - DNA, 20 bp, Artificial
  CRISPR gRNA sequence
tggttgcagatgagaatata

SEQ ID NO: 731558 - DNA, 20 bp, Artificial
  CRISPR gRNA sequence
cagatgagaatataaacatt

SEQ ID NO: 731559 - DNA, 20 bp, Artificial
  CRISPR gRNA sequence
tagattatgacaaagtaaaa

SEQ ID NO: 731560 - DNA, 20 bp, Artificial
  CRISPR gRNA sequence
tgacaaagtaaaatttgtgt

SEQ ID NO: 731561 - DNA, 20 bp, Artificial
  CRISPR gRNA sequence
gtgtaaggaataaaagtcag

SEQ ID NO: 731562 - DNA, 20 bp, Artificial
  CRISPR gRNA sequence
tgtaaggaataaaagtcagg

SEQ ID NO: 731563 - DNA, 20 bp, Artificial
  CRISPR gRNA sequence
ctttgttcttcattacaggg

SEQ ID NO: 731564 - DNA, 20 bp, Artificial
  CRISPR gRNA sequence
tgttcttcattacagggagt

SEQ ID NO: 731565 - DNA, 20 bp, Artificial
  CRISPR gRNA sequence
gttcttcattacagggagtc

SEQ ID NO: 731566 - DNA, 20 bp, Artificial
  CRISPR gRNA sequence
ttcttcattacagggagtca

SEQ ID NO: 731567 - DNA, 20 bp, Artificial
  CRISPR gRNA sequence
ttcattacagggagtcaatc

SEQ ID NO: 731568 - DNA, 20 bp, Artificial
  CRISPR gRNA sequence
cattacagggagtcaatcta

SEQ ID NO: 731569 - DNA, 20 bp, Artificial
  CRISPR gRNA sequence
attacagggagtcaatctat

SEQ ID NO: 731570 - DNA, 20 bp, Artificial
  CRISPR gRNA sequence
cagggagtcaatctattctc

SEQ ID NO: 731571 - DNA, 20 bp, Artificial
  CRISPR gRNA sequence
ttctctactgtccaaaactc

SEQ ID NO: 731572 - DNA, 20 bp, Artificial
  CRISPR gRNA sequence
tctactgtccaaaactcaaa

SEQ ID NO: 731573 - DNA, 20 bp, Artificial
  CRISPR gRNA sequence
tactgtccaaaactcaaact

SEQ ID NO: 731574 - DNA, 20 bp, Artificial
  CRISPR gRNA sequence
ctgtccaaaactcaaactaa

SEQ ID NO: 731575 - DNA, 20 bp, Artificial
  CRISPR gRNA sequence
tccaaaactcaaactaagca

SEQ ID NO: 731576 - DNA, 20 bp, Artificial
  CRISPR gRNA sequence
aaactaagcagattttgcct

SEQ ID NO: 731577 - DNA, 20 bp, Artificial
  CRISPR gRNA sequence
agcagattttgcctttactg

SEQ ID NO: 731578 - DNA, 20 bp, Artificial
  CRISPR gRNA sequence
tgcctttactgcaagagata

SEQ ID NO: 731579 - DNA, 20 bp, Artificial
  CRISPR gRNA sequence
gcctttactgcaagagatag

SEQ ID NO: 731580 - DNA, 20 bp, Artificial
  CRISPR gRNA sequence
cctttactgcaagagatagt

SEQ ID NO: 731581 - DNA, 20 bp, Artificial
  CRISPR gRNA sequence
tactgcaagagatagtagat

SEQ ID NO: 731582 - DNA, 20 bp, Artificial
  CRISPR gRNA sequence
actgcaagagatagtagatt

SEQ ID NO: 731583 - DNA, 20 bp, Artificial
  CRISPR gRNA sequence
ctgcaagagatagtagattc

SEQ ID NO: 731584 - DNA, 20 bp, Artificial
  CRISPR gRNA sequence
caagagatagtagattctga

SEQ ID NO: 731585 - DNA, 20 bp, Artificial
  CRISPR gRNA sequence
tgaaatgattattaaccact

SEQ ID NO: 731586 - DNA, 20 bp, Artificial
  CRISPR gRNA sequence
aaatgattattaaccactta

SEQ ID NO: 731587 - DNA, 20 bp, Artificial
  CRISPR gRNA sequence
ttaaccacttactgattttc

SEQ ID NO: 731588 - DNA, 20 bp, Artificial
  CRISPR gRNA sequence
accacttactgattttcata

SEQ ID NO: 731589 - DNA, 20 bp, Artificial
  CRISPR gRNA sequence
actgattttcataacctcct

SEQ ID NO: 731590 - DNA, 20 bp, Artificial
  CRISPR gRNA sequence
ctgattttcataacctcctt

SEQ ID NO: 731591 - DNA, 20 bp, Artificial
  CRISPR gRNA sequence
attttcataacctcctttct

SEQ ID NO: 731592 - DNA, 20 bp, Artificial
  CRISPR gRNA sequence
tcataacctcctttcttaat

SEQ ID NO: 731593 - DNA, 20 bp, Artificial
  CRISPR gRNA sequence
cataacctcctttcttaatt

SEQ ID NO: 731594 - DNA, 20 bp, Artificial
  CRISPR gRNA sequence
ataacctcctttcttaattt

SEQ ID NO: 731595 - DNA, 20 bp, Artificial
  CRISPR gRNA sequence
ctttcttaattttagagggt

SEQ ID NO: 731596 - DNA, 20 bp, Artificial
  CRISPR gRNA sequence
tcttaattttagagggtttt

SEQ ID NO: 731597 - DNA, 20 bp, Artificial
  CRISPR gRNA sequence
cttaattttagagggttttt

SEQ ID NO: 731598 - DNA, 20 bp, Artificial
  CRISPR gRNA sequence
ttaattttagagggtttttt

SEQ ID NO: 731599 - DNA, 20 bp, Artificial
  CRISPR gRNA sequence
aattttagagggtttttttt

SEQ ID NO: 731600 - DNA, 20 bp, Artificial
  CRISPR gRNA sequence
attttagagggttttttttt

SEQ ID NO: 731601 - DNA, 20 bp, Artificial
  CRISPR gRNA sequence
tagagggtttttttttttaa

SEQ ID NO: 731602 - DNA, 20 bp, Artificial
  CRISPR gRNA sequence
agagggtttttttttttaaa

SEQ ID NO: 731603 - DNA, 20 bp, Artificial
  CRISPR gRNA sequence
gagggtttttttttttaaag

SEQ ID NO: 731604 - DNA, 20 bp, Artificial
  CRISPR gRNA sequence
ttttttttaaaggaattgca

SEQ ID NO: 731605 - DNA, 20 bp, Artificial
  CRISPR gRNA sequence
tttttttaaaggaattgcag

SEQ ID NO: 731606 - DNA, 20 bp, Artificial
  CRISPR gRNA sequence
ttttttaaaggaattgcagt

SEQ ID NO: 731607 - DNA, 20 bp, Artificial
  CRISPR gRNA sequence
tttttaaaggaattgcagta

SEQ ID NO: 731608 - DNA, 20 bp, Artificial
  CRISPR gRNA sequence
ttttaaaggaattgcagtat

SEQ ID NO: 731609 - DNA, 20 bp, Artificial
  CRISPR gRNA sequence
tttaaaggaattgcagtatc

SEQ ID NO: 731610 - DNA, 20 bp, Artificial
  CRISPR gRNA sequence
ttaaaggaattgcagtatct

SEQ ID NO: 731611 - DNA, 20 bp, Artificial
  CRISPR gRNA sequence
taaaggaattgcagtatctt

SEQ ID NO: 731612 - DNA, 20 bp, Artificial
  CRISPR gRNA sequence
aaaggaattgcagtatcttt

SEQ ID NO: 731613 - DNA, 20 bp, Artificial
  CRISPR gRNA sequence
aaggaattgcagtatctttt

SEQ ID NO: 731614 - DNA, 20 bp, Artificial
  CRISPR gRNA sequence
cagtatcttttgctgaagat

SEQ ID NO: 731615 - DNA, 20 bp, Artificial
  CRISPR gRNA sequence
ttgctgaagatacattaatc

SEQ ID NO: 731616 - DNA, 20 bp, Artificial
  CRISPR gRNA sequence
tgctgaagatacattaatct

SEQ ID NO: 731617 - DNA, 20 bp, Artificial
  CRISPR gRNA sequence
gctgaagatacattaatctg

SEQ ID NO: 731618 - DNA, 20 bp, Artificial
  CRISPR gRNA sequence
ctgaagatacattaatctga

SEQ ID NO: 731619 - DNA, 20 bp, Artificial
  CRISPR gRNA sequence
aagatacattaatctgactg

SEQ ID NO: 731620 - DNA, 20 bp, Artificial
  CRISPR gRNA sequence
atctgactgaggtttggcat

SEQ ID NO: 731621 - DNA, 20 bp, Artificial
  CRISPR gRNA sequence
actgaggtttggcattcttc

SEQ ID NO: 731622 - DNA, 20 bp, Artificial
  CRISPR gRNA sequence
aggtttggcattcttctgtt

SEQ ID NO: 731623 - DNA, 20 bp, Artificial
  CRISPR gRNA sequence
ggcattcttctgtttcactt

SEQ ID NO: 731624 - DNA, 20 bp, Artificial
  CRISPR gRNA sequence
gcattcttctgtttcacttc

SEQ ID NO: 731625 - DNA, 20 bp, Artificial
  CRISPR gRNA sequence
ttctgtttcacttcgctttc

SEQ ID NO: 731626 - DNA, 20 bp, Artificial
  CRISPR gRNA sequence
ctgtttcacttcgctttctt

SEQ ID NO: 731627 - DNA, 20 bp, Artificial
  CRISPR gRNA sequence
tgtttcacttcgctttcttt

SEQ ID NO: 731628 - DNA, 20 bp, Artificial
  CRISPR gRNA sequence
tttcacttcgctttcttttt

SEQ ID NO: 731629 - DNA, 20 bp, Artificial
  CRISPR gRNA sequence
cacttcgctttctttttctg

SEQ ID NO: 731630 - DNA, 20 bp, Artificial
  CRISPR gRNA sequence
acttcgctttctttttctga

SEQ ID NO: 731631 - DNA, 20 bp, Artificial
  CRISPR gRNA sequence
cgctttctttttctgatact

SEQ ID NO: 731632 - DNA, 20 bp, Artificial
  CRISPR gRNA sequence
gctttctttttctgatactt

SEQ ID NO: 731633 - DNA, 20 bp, Artificial
  CRISPR gRNA sequence
tctttttctgatacttttga

SEQ ID NO: 731634 - DNA, 20 bp, Artificial
  CRISPR gRNA sequence
ctttttctgatacttttgac

SEQ ID NO: 731635 - DNA, 20 bp, Artificial
  CRISPR gRNA sequence
tttttctgatacttttgact

SEQ ID NO: 731636 - DNA, 20 bp, Artificial
  CRISPR gRNA sequence
tttctgatacttttgactaa

SEQ ID NO: 731637 - DNA, 20 bp, Artificial
  CRISPR gRNA sequence
ttctgatacttttgactaaa

SEQ ID NO: 731638 - DNA, 20 bp, Artificial
  CRISPR gRNA sequence
tctgatacttttgactaaaa

SEQ ID NO: 731639 - DNA, 20 bp, Artificial
  CRISPR gRNA sequence
ctgatacttttgactaaaat

SEQ ID NO: 731640 - DNA, 20 bp, Artificial
  CRISPR gRNA sequence
tgatacttttgactaaaatt

SEQ ID NO: 731641 - DNA, 20 bp, Artificial
  CRISPR gRNA sequence
atacttttgactaaaattaa

SEQ ID NO: 731642 - DNA, 20 bp, Artificial
  CRISPR gRNA sequence
ttgactaaaattaaatatta

SEQ ID NO: 731643 - DNA, 20 bp, Artificial
  CRISPR gRNA sequence
tgactaaaattaaatattat

SEQ ID NO: 731644 - DNA, 20 bp, Artificial
  CRISPR gRNA sequence
gactaaaattaaatattatc

SEQ ID NO: 731645 - DNA, 20 bp, Artificial
  CRISPR gRNA sequence
actaaaattaaatattatca

SEQ ID NO: 731646 - DNA, 20 bp, Artificial
  CRISPR gRNA sequence
aaattaaatattatcatttt

SEQ ID NO: 731647 - DNA, 20 bp, Artificial
  CRISPR gRNA sequence
aatattatcattttaatgcc

SEQ ID NO: 731648 - DNA, 20 bp, Artificial
  CRISPR gRNA sequence
tcattttaatgccataaata

SEQ ID NO: 731649 - DNA, 20 bp, Artificial
  CRISPR gRNA sequence
taatgccataaatatgttgc

SEQ ID NO: 731650 - DNA, 20 bp, Artificial
  CRISPR gRNA sequence
aatgccataaatatgttgcc

SEQ ID NO: 731651 - DNA, 20 bp, Artificial
  CRISPR gRNA sequence
atgccataaatatgttgcca

SEQ ID NO: 731652 - DNA, 20 bp, Artificial
  CRISPR gRNA sequence
ccattctcttaaaattcctt

SEQ ID NO: 731653 - DNA, 20 bp, Artificial
  CRISPR gRNA sequence
tcttaaaattccttctttgt

SEQ ID NO: 731654 - DNA, 20 bp, Artificial
  CRISPR gRNA sequence
ttaaaattccttctttgtaa

SEQ ID NO: 731655 - DNA, 20 bp, Artificial
  CRISPR gRNA sequence
aaaattccttctttgtaagt

SEQ ID NO: 731656 - DNA, 20 bp, Artificial
  CRISPR gRNA sequence
aaattccttctttgtaagtg

SEQ ID NO: 731657 - DNA, 20 bp, Artificial
  CRISPR gRNA sequence
cttctttgtaagtgtgtaca

SEQ ID NO: 731658 - DNA, 20 bp, Artificial
  CRISPR gRNA sequence
ctttgtaagtgtgtacaggc

SEQ ID NO: 731659 - DNA, 20 bp, Artificial
  CRISPR gRNA sequence
tttgtaagtgtgtacaggct

SEQ ID NO: 731660 - DNA, 20 bp, Artificial
  CRISPR gRNA sequence
tgtaagtgtgtacaggctgt

SEQ ID NO: 731661 - DNA, 20 bp, Artificial
  CRISPR gRNA sequence
gtaagtgtgtacaggctgtc

SEQ ID NO: 731662 - DNA, 20 bp, Artificial
  CRISPR gRNA sequence
taagtgtgtacaggctgtct

SEQ ID NO: 731663 - DNA, 20 bp, Artificial
  CRISPR gRNA sequence
tctggttactaacctaccca

SEQ ID NO: 731664 - DNA, 20 bp, Artificial
  CRISPR gRNA sequence
gttactaacctacccatctt

SEQ ID NO: 731665 - DNA, 20 bp, Artificial
  CRISPR gRNA sequence
ctaacctacccatctttata

SEQ ID NO: 731666 - DNA, 20 bp, Artificial
  CRISPR gRNA sequence
acctacccatctttatacag

SEQ ID NO: 731667 - DNA, 20 bp, Artificial
  CRISPR gRNA sequence
cccatctttatacagagagg

SEQ ID NO: 731668 - DNA, 20 bp, Artificial
  CRISPR gRNA sequence
tatacagagaggtagaggcg

SEQ ID NO: 731669 - DNA, 20 bp, Artificial
  CRISPR gRNA sequence
atacagagaggtagaggcgt

SEQ ID NO: 731670 - DNA, 20 bp, Artificial
  CRISPR gRNA sequence
tacagagaggtagaggcgtg

SEQ ID NO: 731671 - DNA, 20 bp, Artificial
  CRISPR gRNA sequence
atgataatagtagttatcta

SEQ ID NO: 731672 - DNA, 20 bp, Artificial
  CRISPR gRNA sequence
tctatagatggagggctggg

SEQ ID NO: 731673 - DNA, 20 bp, Artificial
  CRISPR gRNA sequence
tagatggagggctggggagg

SEQ ID NO: 731674 - DNA, 20 bp, Artificial
  CRISPR gRNA sequence
gggagggcaatgtttgtttt

SEQ ID NO: 731675 - DNA, 20 bp, Artificial
  CRISPR gRNA sequence
gttttcttccttacactctt

SEQ ID NO: 731676 - DNA, 20 bp, Artificial
  CRISPR gRNA sequence
ttttcttccttacactcttt

SEQ ID NO: 731677 - DNA, 20 bp, Artificial
  CRISPR gRNA sequence
tcttccttacactctttgta

SEQ ID NO: 731678 - DNA, 20 bp, Artificial
  CRISPR gRNA sequence
cttccttacactctttgtat

SEQ ID NO: 731679 - DNA, 20 bp, Artificial
  CRISPR gRNA sequence
ttccttacactctttgtatt

SEQ ID NO: 731680 - DNA, 20 bp, Artificial
  CRISPR gRNA sequence
ccttacactctttgtattgc

SEQ ID NO: 731681 - DNA, 20 bp, Artificial
  CRISPR gRNA sequence
cttacactctttgtattgct

SEQ ID NO: 731682 - DNA, 20 bp, Artificial
  CRISPR gRNA sequence
acactctttgtattgcttga

SEQ ID NO: 731683 - DNA, 20 bp, Artificial
  CRISPR gRNA sequence
cactctttgtattgcttgaa

SEQ ID NO: 731684 - DNA, 20 bp, Artificial
  CRISPR gRNA sequence
tttgtattgcttgaatttta

SEQ ID NO: 731685 - DNA, 20 bp, Artificial
  CRISPR gRNA sequence
tgtattgcttgaattttaaa

SEQ ID NO: 731686 - DNA, 20 bp, Artificial
  CRISPR gRNA sequence
gtattgcttgaattttaaat

SEQ ID NO: 731687 - DNA, 20 bp, Artificial
  CRISPR gRNA sequence
tattgcttgaattttaaata

SEQ ID NO: 731688 - DNA, 20 bp, Artificial
  CRISPR gRNA sequence
cttgaattttaaataataaa

SEQ ID NO: 731689 - DNA, 20 bp, Artificial
  CRISPR gRNA sequence
gaattttaaataataaatgt

SEQ ID NO: 731690 - DNA, 20 bp, Artificial
  CRISPR gRNA sequence
aattttaaataataaatgtt

SEQ ID NO: 731691 - DNA, 20 bp, Artificial
  CRISPR gRNA sequence
taaataataaatgtttataa

SEQ ID NO: 731692 - DNA, 20 bp, Artificial
  CRISPR gRNA sequence
aaataataaatgtttataat

SEQ ID NO: 731693 - DNA, 20 bp, Artificial
  CRISPR gRNA sequence
aataataaatgtttataatt

SEQ ID NO: 731694 - DNA, 20 bp, Artificial
  CRISPR gRNA sequence
ataattttcatttcataaaa

SEQ ID NO: 731695 - DNA, 20 bp, Artificial
  CRISPR gRNA sequence
taattttcatttcataaaat

SEQ ID NO: 731696 - DNA, 20 bp, Artificial
  CRISPR gRNA sequence
tcatttcataaaatgcagtc

SEQ ID NO: 731697 - DNA, 20 bp, Artificial
  CRISPR gRNA sequence
catttcataaaatgcagtca

SEQ ID NO: 731698 - DNA, 20 bp, Artificial
  CRISPR gRNA sequence
atttcataaaatgcagtcat

SEQ ID NO: 731699 - DNA, 20 bp, Artificial
  CRISPR gRNA sequence
cataaaatgcagtcattact

SEQ ID NO: 731700 - DNA, 20 bp, Artificial
  CRISPR gRNA sequence
ataaaatgcagtcattactt

SEQ ID NO: 731701 - DNA, 20 bp, Artificial
  CRISPR gRNA sequence
cttttagaaattcaaagata

SEQ ID NO: 731702 - DNA, 20 bp, Artificial
  CRISPR gRNA sequence
ttagaaattcaaagatacac

SEQ ID NO: 731703 - DNA, 20 bp, Artificial
  CRISPR gRNA sequence
tagaaattcaaagatacacc

SEQ ID NO: 731704 - DNA, 20 bp, Artificial
  CRISPR gRNA sequence
agaaattcaaagatacacca

SEQ ID NO: 731705 - DNA, 20 bp, Artificial
  CRISPR gRNA sequence
gaaattcaaagatacaccag

SEQ ID NO: 731706 - DNA, 20 bp, Artificial
  CRISPR gRNA sequence
aaagatacaccagataaatg

SEQ ID NO: 731707 - DNA, 20 bp, Artificial
  CRISPR gRNA sequence
ataaaaagaaagaagaaatg

SEQ ID NO: 731708 - DNA, 20 bp, Artificial
  CRISPR gRNA sequence
ttattacttttctttctttt

SEQ ID NO: 731709 - DNA, 20 bp, Artificial
  CRISPR gRNA sequence
ttacttttctttctttttaa

SEQ ID NO: 731710 - DNA, 20 bp, Artificial
  CRISPR gRNA sequence
cttttctttctttttaacct

SEQ ID NO: 731711 - DNA, 20 bp, Artificial
  CRISPR gRNA sequence
ttctttctttttaacctttg

SEQ ID NO: 731712 - DNA, 20 bp, Artificial
  CRISPR gRNA sequence
tctttctttttaacctttgc

SEQ ID NO: 731713 - DNA, 20 bp, Artificial
  CRISPR gRNA sequence
ctttctttttaacctttgct

SEQ ID NO: 731714 - DNA, 20 bp, Artificial
  CRISPR gRNA sequence
tttctttttaacctttgcta

SEQ ID NO: 731715 - DNA, 20 bp, Artificial
  CRISPR gRNA sequence
tctttttaacctttgctact

SEQ ID NO: 731716 - DNA, 20 bp, Artificial
  CRISPR gRNA sequence
ctttttaacctttgctactt

SEQ ID NO: 731717 - DNA, 20 bp, Artificial
  CRISPR gRNA sequence
tttttaacctttgctacttc

SEQ ID NO: 731718 - DNA, 20 bp, Artificial
  CRISPR gRNA sequence
tttaacctttgctacttctt

SEQ ID NO: 731719 - DNA, 20 bp, Artificial
  CRISPR gRNA sequence
ttaacctttgctacttcttc

SEQ ID NO: 731720 - DNA, 20 bp, Artificial
  CRISPR gRNA sequence
taacctttgctacttcttcc

SEQ ID NO: 731721 - DNA, 20 bp, Artificial
  CRISPR gRNA sequence
aacctttgctacttcttcca

SEQ ID NO: 731722 - DNA, 20 bp, Artificial
  CRISPR gRNA sequence
acctttgctacttcttccag

SEQ ID NO: 731723 - DNA, 20 bp, Artificial
  CRISPR gRNA sequence
tgctacttcttccaggaagg

SEQ ID NO: 731724 - DNA, 20 bp, Artificial
  CRISPR gRNA sequence
gctacttcttccaggaagga

SEQ ID NO: 731725 - DNA, 20 bp, Artificial
  CRISPR gRNA sequence
ctacttcttccaggaaggaa

SEQ ID NO: 731726 - DNA, 20 bp, Artificial
  CRISPR gRNA sequence
cttcttccaggaaggaatag

SEQ ID NO: 731727 - DNA, 20 bp, Artificial
  CRISPR gRNA sequence
cttccaggaaggaatagcaa

SEQ ID NO: 731728 - DNA, 20 bp, Artificial
  CRISPR gRNA sequence
ttccaggaaggaatagcaat

SEQ ID NO: 731729 - DNA, 20 bp, Artificial
  CRISPR gRNA sequence
ccaggaaggaatagcaatat

SEQ ID NO: 731730 - DNA, 20 bp, Artificial
  CRISPR gRNA sequence
caggaaggaatagcaatatt

SEQ ID NO: 731731 - DNA, 20 bp, Artificial
  CRISPR gRNA sequence
atgccaaacaaatgtgaaat

SEQ ID NO: 731732 - DNA, 20 bp, Artificial
  CRISPR gRNA sequence
agggaaaaggcattacaagg

SEQ ID NO: 731733 - DNA, 20 bp, Artificial
  CRISPR gRNA sequence
caaggaatggagaggtatat

SEQ ID NO: 731734 - DNA, 20 bp, Artificial
  CRISPR gRNA sequence
atgtggataaaaagcccaac

SEQ ID NO: 731735 - DNA, 20 bp, Artificial
  CRISPR gRNA sequence
atgaacatttatgtacctaa

SEQ ID NO: 731736 - DNA, 20 bp, Artificial
  CRISPR gRNA sequence
atgtacctaataacatagct

SEQ ID NO: 731737 - DNA, 20 bp, Artificial
  CRISPR gRNA sequence
tgtacctaataacatagctt

SEQ ID NO: 731738 - DNA, 20 bp, Artificial
  CRISPR gRNA sequence
ataacatagctttgacatat

SEQ ID NO: 731739 - DNA, 20 bp, Artificial
  CRISPR gRNA sequence
tgacatatatgaagcaaaaa

SEQ ID NO: 731740 - DNA, 20 bp, Artificial
  CRISPR gRNA sequence
gacatatatgaagcaaaaat

SEQ ID NO: 731741 - DNA, 20 bp, Artificial
  CRISPR gRNA sequence
acatatatgaagcaaaaata

SEQ ID NO: 731742 - DNA, 20 bp, Artificial
  CRISPR gRNA sequence
atagatgaacaagtatactg

SEQ ID NO: 731743 - DNA, 20 bp, Artificial
  CRISPR gRNA sequence
ggagataagattttaacaca

SEQ ID NO: 731744 - DNA, 20 bp, Artificial
  CRISPR gRNA sequence
taacacatctctcagaaata

SEQ ID NO: 731745 - DNA, 20 bp, Artificial
  CRISPR gRNA sequence
aacacatctctcagaaataa

SEQ ID NO: 731746 - DNA, 20 bp, Artificial
  CRISPR gRNA sequence
acacatctctcagaaataaa

SEQ ID NO: 731747 - DNA, 20 bp, Artificial
  CRISPR gRNA sequence
tcagaaataaaggtgataaa

SEQ ID NO: 731748 - DNA, 20 bp, Artificial
  CRISPR gRNA sequence
agaaataaaggtgataaaag

SEQ ID NO: 731749 - DNA, 20 bp, Artificial
  CRISPR gRNA sequence
tttaaataacacaattaaca

SEQ ID NO: 731750 - DNA, 20 bp, Artificial
  CRISPR gRNA sequence
aaataacacaattaacaagc

SEQ ID NO: 731751 - DNA, 20 bp, Artificial
  CRISPR gRNA sequence
aataacacaattaacaagct

SEQ ID NO: 731752 - DNA, 20 bp, Artificial
  CRISPR gRNA sequence
acaagcttaacttaatagat

SEQ ID NO: 731753 - DNA, 20 bp, Artificial
  CRISPR gRNA sequence
aacttaatagatatgtagag

SEQ ID NO: 731754 - DNA, 20 bp, Artificial
  CRISPR gRNA sequence
acttaatagatatgtagaga

SEQ ID NO: 731755 - DNA, 20 bp, Artificial
  CRISPR gRNA sequence
aatagatatgtagagaactt

SEQ ID NO: 731756 - DNA, 20 bp, Artificial
  CRISPR gRNA sequence
atagatatgtagagaacttt

SEQ ID NO: 731757 - DNA, 20 bp, Artificial
  CRISPR gRNA sequence
tatacgcaacaaacagaata

SEQ ID NO: 731758 - DNA, 20 bp, Artificial
  CRISPR gRNA sequence
atacgcaacaaacagaatac

SEQ ID NO: 731759 - DNA, 20 bp, Artificial
  CRISPR gRNA sequence
tacgcaacaaacagaataca

SEQ ID NO: 731760 - DNA, 20 bp, Artificial
  CRISPR gRNA sequence
taaaacacccatacactgaa

SEQ ID NO: 731761 - DNA, 20 bp, Artificial
  CRISPR gRNA sequence
aaaacacccatacactgaac

SEQ ID NO: 731762 - DNA, 20 bp, Artificial
  CRISPR gRNA sequence
aaacacccatacactgaaca

SEQ ID NO: 731763 - DNA, 20 bp, Artificial
  CRISPR gRNA sequence
aacactctgaaaatacatga

SEQ ID NO: 731764 - DNA, 20 bp, Artificial
  CRISPR gRNA sequence
tgaaaatacatgatcattta

SEQ ID NO: 731765 - DNA, 20 bp, Artificial
  CRISPR gRNA sequence
aaaatacatgatcatttatt

SEQ ID NO: 731766 - DNA, 20 bp, Artificial
  CRISPR gRNA sequence
attatttattagaccacaaa

SEQ ID NO: 731767 - DNA, 20 bp, Artificial
  CRISPR gRNA sequence
ttatttattagaccacaaaa

SEQ ID NO: 731768 - DNA, 20 bp, Artificial
  CRISPR gRNA sequence
tttattagaccacaaaaaga

SEQ ID NO: 731769 - DNA, 20 bp, Artificial
  CRISPR gRNA sequence
attagaccacaaaaagatct

SEQ ID NO: 731770 - DNA, 20 bp, Artificial
  CRISPR gRNA sequence
ttagaccacaaaaagatctc

SEQ ID NO: 731771 - DNA, 20 bp, Artificial
  CRISPR gRNA sequence
gaccacaaaaagatctcaac

SEQ ID NO: 731772 - DNA, 20 bp, Artificial
  CRISPR gRNA sequence
aacaaatttcccccacccta

SEQ ID NO: 731773 - DNA, 20 bp, Artificial
  CRISPR gRNA sequence
cccccaccctaccccccaaa

SEQ ID NO: 731774 - DNA, 20 bp, Artificial
  CRISPR gRNA sequence
ccccaccctaccccccaaaa

SEQ ID NO: 731775 - DNA, 20 bp, Artificial
  CRISPR gRNA sequence
ccccccaaaaaaatccacac

SEQ ID NO: 731776 - DNA, 20 bp, Artificial
  CRISPR gRNA sequence
gatagcacacagactgcatt

SEQ ID NO: 731777 - DNA, 20 bp, Artificial
  CRISPR gRNA sequence
cattctctaaccataataag

SEQ ID NO: 731778 - DNA, 20 bp, Artificial
  CRISPR gRNA sequence
tctaaccataataagagact

SEQ ID NO: 731779 - DNA, 20 bp, Artificial
  CRISPR gRNA sequence
taaccataataagagactaa

SEQ ID NO: 731780 - DNA, 20 bp, Artificial
  CRISPR gRNA sequence
accataataagagactaaca

SEQ ID NO: 731781 - DNA, 20 bp, Artificial
  CRISPR gRNA sequence
acaataaaaggtcatactga

SEQ ID NO: 731782 - DNA, 20 bp, Artificial
  CRISPR gRNA sequence
aaacagttttcctggaagtc

SEQ ID NO: 731783 - DNA, 20 bp, Artificial
  CRISPR gRNA sequence
tcctggaagtcctgtgatct

SEQ ID NO: 731784 - DNA, 20 bp, Artificial
  CRISPR gRNA sequence
cctggaagtcctgtgatctt

SEQ ID NO: 731785 - DNA, 20 bp, Artificial
  CRISPR gRNA sequence
ctggaagtcctgtgatctta

SEQ ID NO: 731786 - DNA, 20 bp, Artificial
  CRISPR gRNA sequence
gaagtcctgtgatcttagga

SEQ ID NO: 731787 - DNA, 20 bp, Artificial
  CRISPR gRNA sequence
tgatcttaggaaaagaacac

SEQ ID NO: 731788 - DNA, 20 bp, Artificial
  CRISPR gRNA sequence
aggaaaagaacacagctctt

SEQ ID NO: 731789 - DNA, 20 bp, Artificial
  CRISPR gRNA sequence
ggaaaagaacacagctcttg

SEQ ID NO: 731790 - DNA, 20 bp, Artificial
  CRISPR gRNA sequence
ttggtgtcaggccacaactc

SEQ ID NO: 731791 - DNA, 20 bp, Artificial
  CRISPR gRNA sequence
ggtgtcaggccacaactcaa

SEQ ID NO: 731792 - DNA, 20 bp, Artificial
  CRISPR gRNA sequence
gtgtcaggccacaactcaaa

SEQ ID NO: 731793 - DNA, 20 bp, Artificial
  CRISPR gRNA sequence
aaactccagttctgccactt

SEQ ID NO: 731794 - DNA, 20 bp, Artificial
  CRISPR gRNA sequence
cagttctgccacttaccaga

SEQ ID NO: 731795 - DNA, 20 bp, Artificial
  CRISPR gRNA sequence
tgccacttaccagagttttg

SEQ ID NO: 731796 - DNA, 20 bp, Artificial
  CRISPR gRNA sequence
ccacttaccagagttttgta

SEQ ID NO: 731797 - DNA, 20 bp, Artificial
  CRISPR gRNA sequence
accagagttttgtaactttg

SEQ ID NO: 731798 - DNA, 20 bp, Artificial
  CRISPR gRNA sequence
ccagagttttgtaactttgg

SEQ ID NO: 731799 - DNA, 20 bp, Artificial
  CRISPR gRNA sequence
tgtaactttggaaaggccct

SEQ ID NO: 731800 - DNA, 20 bp, Artificial
  CRISPR gRNA sequence
gtaactttggaaaggccctt

SEQ ID NO: 731801 - DNA, 20 bp, Artificial
  CRISPR gRNA sequence
taactttggaaaggccctta

SEQ ID NO: 731802 - DNA, 20 bp, Artificial
  CRISPR gRNA sequence
tggaaaggcccttaacctcc

SEQ ID NO: 731803 - DNA, 20 bp, Artificial
  CRISPR gRNA sequence
ggaaaggcccttaacctccc

SEQ ID NO: 731804 - DNA, 20 bp, Artificial
  CRISPR gRNA sequence
gaaaggcccttaacctccct

SEQ ID NO: 731805 - DNA, 20 bp, Artificial
  CRISPR gRNA sequence
aacctccctatcctcaaatt

SEQ ID NO: 731806 - DNA, 20 bp, Artificial
  CRISPR gRNA sequence
acctccctatcctcaaattc

SEQ ID NO: 731807 - DNA, 20 bp, Artificial
  CRISPR gRNA sequence
cctatcctcaaattcctcat

SEQ ID NO: 731808 - DNA, 20 bp, Artificial
  CRISPR gRNA sequence
tcctcaaattcctcattgta

SEQ ID NO: 731809 - DNA, 20 bp, Artificial
  CRISPR gRNA sequence
aaattcctcattgtaaagta

SEQ ID NO: 731810 - DNA, 20 bp, Artificial
  CRISPR gRNA sequence
ctcattgtaaagtaaggata

SEQ ID NO: 731811 - DNA, 20 bp, Artificial
  CRISPR gRNA sequence
attgtaaagtaaggataagc

SEQ ID NO: 731812 - DNA, 20 bp, Artificial
  CRISPR gRNA sequence
taaagtaaggataagcaaga

SEQ ID NO: 731813 - DNA, 20 bp, Artificial
  CRISPR gRNA sequence
ccctagggctgtggtgagga

SEQ ID NO: 731814 - DNA, 20 bp, Artificial
  CRISPR gRNA sequence
gggctgtggtgaggattaaa

SEQ ID NO: 731815 - DNA, 20 bp, Artificial
  CRISPR gRNA sequence
tggtgaggattaaactcaaa

SEQ ID NO: 731816 - DNA, 20 bp, Artificial
  CRISPR gRNA sequence
aactcaaaaaaatgtgagtc

SEQ ID NO: 731817 - DNA, 20 bp, Artificial
  CRISPR gRNA sequence
aaaaaaatgtgagtcctctc

SEQ ID NO: 731818 - DNA, 20 bp, Artificial
  CRISPR gRNA sequence
tccttcaggaaacatgttaa

SEQ ID NO: 731819 - DNA, 20 bp, Artificial
  CRISPR gRNA sequence
cttcaggaaacatgttaagt

SEQ ID NO: 731820 - DNA, 20 bp, Artificial
  CRISPR gRNA sequence
caggaaacatgttaagtctc

SEQ ID NO: 731821 - DNA, 20 bp, Artificial
  CRISPR gRNA sequence
aggaaacatgttaagtctct

SEQ ID NO: 731822 - DNA, 20 bp, Artificial
  CRISPR gRNA sequence
agtctctgtgaaagtatgga

SEQ ID NO: 731823 - DNA, 20 bp, Artificial
  CRISPR gRNA sequence
tgtgaaagtatggatgcaaa

SEQ ID NO: 731824 - DNA, 20 bp, Artificial
  CRISPR gRNA sequence
tgaaagtatggatgcaaaag

SEQ ID NO: 731825 - DNA, 20 bp, Artificial
  CRISPR gRNA sequence
atatcaaatcacaaatgcag

SEQ ID NO: 731826 - DNA, 20 bp, Artificial
  CRISPR gRNA sequence
aggcaccaggaggacaattc

SEQ ID NO: 731827 - DNA, 20 bp, Artificial
  CRISPR gRNA sequence
agagaacagacatcaaatca

SEQ ID NO: 731828 - DNA, 20 bp, Artificial
  CRISPR gRNA sequence
tccaccttccagattcttca

SEQ ID NO: 731829 - DNA, 20 bp, Artificial
  CRISPR gRNA sequence
caccttccagattcttcacc

SEQ ID NO: 731830 - DNA, 20 bp, Artificial
  CRISPR gRNA sequence
ccagattcttcacctctcct

SEQ ID NO: 731831 - DNA, 20 bp, Artificial
  CRISPR gRNA sequence
cagattcttcacctctcctc

SEQ ID NO: 731832 - DNA, 20 bp, Artificial
  CRISPR gRNA sequence
ttcacctctcctctgaggac

SEQ ID NO: 731833 - DNA, 20 bp, Artificial
  CRISPR gRNA sequence
cacctctcctctgaggaccc

SEQ ID NO: 731834 - DNA, 20 bp, Artificial
  CRISPR gRNA sequence
acctctcctctgaggacccc

SEQ ID NO: 731835 - DNA, 20 bp, Artificial
  CRISPR gRNA sequence
tcctctgaggacccctcatg

SEQ ID NO: 731836 - DNA, 20 bp, Artificial
  CRISPR gRNA sequence
ctctgaggacccctcatgct

SEQ ID NO: 731837 - DNA, 20 bp, Artificial
  CRISPR gRNA sequence
tgaggacccctcatgctccc

SEQ ID NO: 731838 - DNA, 20 bp, Artificial
  CRISPR gRNA sequence
aggacccctcatgctcccta

SEQ ID NO: 731839 - DNA, 20 bp, Artificial
  CRISPR gRNA sequence
atgctccctagaaggaggcc

SEQ ID NO: 731840 - DNA, 20 bp, Artificial
  CRISPR gRNA sequence
cctagaaggaggccctggag

SEQ ID NO: 731841 - DNA, 20 bp, Artificial
  CRISPR gRNA sequence
gaaggaggccctggagagag

SEQ ID NO: 731842 - DNA, 20 bp, Artificial
  CRISPR gRNA sequence
gagagagaacaaggccctta

SEQ ID NO: 731843 - DNA, 20 bp, Artificial
  CRISPR gRNA sequence
acctcgagaacaagtcacgc

SEQ ID NO: 731844 - DNA, 20 bp, Artificial
  CRISPR gRNA sequence
cctcgagaacaagtcacgca

SEQ ID NO: 731845 - DNA, 20 bp, Artificial
  CRISPR gRNA sequence
gagaacaagtcacgcaggct

SEQ ID NO: 731846 - DNA, 20 bp, Artificial
  CRISPR gRNA sequence
tacagcggtcggcctcatcc

SEQ ID NO: 731847 - DNA, 20 bp, Artificial
  CRISPR gRNA sequence
atccaggtagtagtcaggct

SEQ ID NO: 731848 - DNA, 20 bp, Artificial
  CRISPR gRNA sequence
acactgcttcctgcagtcag

SEQ ID NO: 731849 - DNA, 20 bp, Artificial
  CRISPR gRNA sequence
cttcctgcagtcagtaggcc

SEQ ID NO: 731850 - DNA, 20 bp, Artificial
  CRISPR gRNA sequence
cctgcagtcagtaggcctct

SEQ ID NO: 731851 - DNA, 20 bp, Artificial
  CRISPR gRNA sequence
ctgcagtcagtaggcctctg

SEQ ID NO: 731852 - DNA, 20 bp, Artificial
  CRISPR gRNA sequence
cagtcagtaggcctctgtgg

SEQ ID NO: 731853 - DNA, 20 bp, Artificial
  CRISPR gRNA sequence
tgtgggcactgctgtgtcgg

SEQ ID NO: 731854 - DNA, 20 bp, Artificial
  CRISPR gRNA sequence
tgggcactgctgtgtcggga

SEQ ID NO: 731855 - DNA, 20 bp, Artificial
  CRISPR gRNA sequence
ctgtgtcgggaacagccctg

SEQ ID NO: 731856 - DNA, 20 bp, Artificial
  CRISPR gRNA sequence
tgtcgggaacagccctggga

SEQ ID NO: 731857 - DNA, 20 bp, Artificial
  CRISPR gRNA sequence
ggaaaagaaacagagaagct

SEQ ID NO: 731858 - DNA, 20 bp, Artificial
  CRISPR gRNA sequence
caagccaggctgacttagca

SEQ ID NO: 731859 - DNA, 20 bp, Artificial
  CRISPR gRNA sequence
acttagcaaaggccttatga

SEQ ID NO: 731860 - DNA, 20 bp, Artificial
  CRISPR gRNA sequence
agcaaaggccttatgaccca

SEQ ID NO: 731861 - DNA, 20 bp, Artificial
  CRISPR gRNA sequence
gcaaaggccttatgacccaa

SEQ ID NO: 731862 - DNA, 20 bp, Artificial
  CRISPR gRNA sequence
atgacccaatgccccacacc

SEQ ID NO: 731863 - DNA, 20 bp, Artificial
  CRISPR gRNA sequence
tgacccaatgccccacacct

SEQ ID NO: 731864 - DNA, 20 bp, Artificial
  CRISPR gRNA sequence
tcatccctgacgcccctccc

SEQ ID NO: 731865 - DNA, 20 bp, Artificial
  CRISPR gRNA sequence
atccctgacgcccctcccag

SEQ ID NO: 731866 - DNA, 20 bp, Artificial
  CRISPR gRNA sequence
acgcccctcccagctccacc

SEQ ID NO: 731867 - DNA, 20 bp, Artificial
  CRISPR gRNA sequence
ccagctccacctccaacccc

SEQ ID NO: 731868 - DNA, 20 bp, Artificial
  CRISPR gRNA sequence
cacctccaacccccgaaaac

SEQ ID NO: 731869 - DNA, 20 bp, Artificial
  CRISPR gRNA sequence
caacccccgaaaactgtcag

SEQ ID NO: 731870 - DNA, 20 bp, Artificial
  CRISPR gRNA sequence
tcagtccaattcttgtgtta

SEQ ID NO: 731871 - DNA, 20 bp, Artificial
  CRISPR gRNA sequence
ttgtgttatggatggaagca

SEQ ID NO: 731872 - DNA, 20 bp, Artificial
  CRISPR gRNA sequence
gtgttatggatggaagcact

SEQ ID NO: 731873 - DNA, 20 bp, Artificial
  CRISPR gRNA sequence
tgttatggatggaagcactg

SEQ ID NO: 731874 - DNA, 20 bp, Artificial
  CRISPR gRNA sequence
tggatggaagcactgacacc

SEQ ID NO: 731875 - DNA, 20 bp, Artificial
  CRISPR gRNA sequence
acacccaggaggggcaaccc

SEQ ID NO: 731876 - DNA, 20 bp, Artificial
  CRISPR gRNA sequence
gcctaaggtcccctagcagg

SEQ ID NO: 731877 - DNA, 20 bp, Artificial
  CRISPR gRNA sequence
aggtcccctagcaggcaagg

SEQ ID NO: 731878 - DNA, 20 bp, Artificial
  CRISPR gRNA sequence
gcaggcaaggaaaagcaaca

SEQ ID NO: 731879 - DNA, 20 bp, Artificial
  CRISPR gRNA sequence
tagagaagagctgggcctgg

SEQ ID NO: 731880 - DNA, 20 bp, Artificial
  CRISPR gRNA sequence
ggcctgggattctagggctg

SEQ ID NO: 731881 - DNA, 20 bp, Artificial
  CRISPR gRNA sequence
ggattctagggctgccattt

SEQ ID NO: 731882 - DNA, 20 bp, Artificial
  CRISPR gRNA sequence
tagggctgccatttgccaat

SEQ ID NO: 731883 - DNA, 20 bp, Artificial
  CRISPR gRNA sequence
gggctgccatttgccaattg

SEQ ID NO: 731884 - DNA, 20 bp, Artificial
  CRISPR gRNA sequence
ccatttgccaattgcgtgat

SEQ ID NO: 731885 - DNA, 20 bp, Artificial
  CRISPR gRNA sequence
gccaattgcgtgataatgac

SEQ ID NO: 731886 - DNA, 20 bp, Artificial
  CRISPR gRNA sequence
ccaattgcgtgataatgacc

SEQ ID NO: 731887 - DNA, 20 bp, Artificial
  CRISPR gRNA sequence
cgtgataatgaccttgtcag

SEQ ID NO: 731888 - DNA, 20 bp, Artificial
  CRISPR gRNA sequence
gtcagcactatttgtgtgtg

SEQ ID NO: 731889 - DNA, 20 bp, Artificial
  CRISPR gRNA sequence
tcagcactatttgtgtgtgt

SEQ ID NO: 731890 - DNA, 20 bp, Artificial
  CRISPR gRNA sequence
tttgtgtgtgtgtgtgtgtg

SEQ ID NO: 731891 - DNA, 20 bp, Artificial
  CRISPR gRNA sequence
gtgtgtgtgtgtgtgtgagg

SEQ ID NO: 731892 - DNA, 20 bp, Artificial
  CRISPR gRNA sequence
tgtgtgtgtgtgtgtgaggg

SEQ ID NO: 731893 - DNA, 20 bp, Artificial
  CRISPR gRNA sequence
agcactattaagttagtaat

SEQ ID NO: 731894 - DNA, 20 bp, Artificial
  CRISPR gRNA sequence
gcactattaagttagtaata

SEQ ID NO: 731895 - DNA, 20 bp, Artificial
  CRISPR gRNA sequence
ttaagttagtaataggaccc

SEQ ID NO: 731896 - DNA, 20 bp, Artificial
  CRISPR gRNA sequence
agttagtaataggacccacc

SEQ ID NO: 731897 - DNA, 20 bp, Artificial
  CRISPR gRNA sequence
gtaataggacccacctccta

SEQ ID NO: 731898 - DNA, 20 bp, Artificial
  CRISPR gRNA sequence
ctagtgttcttgaaaggact

SEQ ID NO: 731899 - DNA, 20 bp, Artificial
  CRISPR gRNA sequence
gtgttcttgaaaggactgaa

SEQ ID NO: 731900 - DNA, 20 bp, Artificial
  CRISPR gRNA sequence
ttgaaaggactgaatggact

SEQ ID NO: 731901 - DNA, 20 bp, Artificial
  CRISPR gRNA sequence
gaaaggactgaatggactgt

SEQ ID NO: 731902 - DNA, 20 bp, Artificial
  CRISPR gRNA sequence
aaaggactgaatggactgtg

SEQ ID NO: 731903 - DNA, 20 bp, Artificial
  CRISPR gRNA sequence
aatggactgtgaagataaat

SEQ ID NO: 731904 - DNA, 20 bp, Artificial
  CRISPR gRNA sequence
tgaagataaatatgtataaa

SEQ ID NO: 731905 - DNA, 20 bp, Artificial
  CRISPR gRNA sequence
cagcagtccctggcacccaa

SEQ ID NO: 731906 - DNA, 20 bp, Artificial
  CRISPR gRNA sequence
gcacccaacaagcactatat

SEQ ID NO: 731907 - DNA, 20 bp, Artificial
  CRISPR gRNA sequence
tatgagcaccggttgtcatc

SEQ ID NO: 731908 - DNA, 20 bp, Artificial
  CRISPR gRNA sequence
tcatcattctctgcaggggt

SEQ ID NO: 731909 - DNA, 20 bp, Artificial
  CRISPR gRNA sequence
tctgcaggggtcttatctca

SEQ ID NO: 731910 - DNA, 20 bp, Artificial
  CRISPR gRNA sequence
tgcaggggtcttatctcact

SEQ ID NO: 731911 - DNA, 20 bp, Artificial
  CRISPR gRNA sequence
caggggtcttatctcactgc

SEQ ID NO: 731912 - DNA, 20 bp, Artificial
  CRISPR gRNA sequence
atctcactgcaggaattagg

SEQ ID NO: 731913 - DNA, 20 bp, Artificial
  CRISPR gRNA sequence
tctcactgcaggaattagga

SEQ ID NO: 731914 - DNA, 20 bp, Artificial
  CRISPR gRNA sequence
actgcaggaattaggagagc

SEQ ID NO: 731915 - DNA, 20 bp, Artificial
  CRISPR gRNA sequence
caggaattaggagagccata

SEQ ID NO: 731916 - DNA, 20 bp, Artificial
  CRISPR gRNA sequence
ggagagccataactttagac

SEQ ID NO: 731917 - DNA, 20 bp, Artificial
  CRISPR gRNA sequence
tagaccatgaaagtctagac

SEQ ID NO: 731918 - DNA, 20 bp, Artificial
  CRISPR gRNA sequence
agaccatgaaagtctagacc

SEQ ID NO: 731919 - DNA, 20 bp, Artificial
  CRISPR gRNA sequence
gaccatgaaagtctagacca

SEQ ID NO: 731920 - DNA, 20 bp, Artificial
  CRISPR gRNA sequence
gaccaagcttgtccaaccca

SEQ ID NO: 731921 - DNA, 20 bp, Artificial
  CRISPR gRNA sequence
gtccaacccacgactagccg

SEQ ID NO: 731922 - DNA, 20 bp, Artificial
  CRISPR gRNA sequence
tccaacccacgactagccgc

SEQ ID NO: 731923 - DNA, 20 bp, Artificial
  CRISPR gRNA sequence
gccgcattcggcccaggaca

SEQ ID NO: 731924 - DNA, 20 bp, Artificial
  CRISPR gRNA sequence
ggcccaggacagctctgaat

SEQ ID NO: 731925 - DNA, 20 bp, Artificial
  CRISPR gRNA sequence
tgaatgaggcccaacgcaaa

SEQ ID NO: 731926 - DNA, 20 bp, Artificial
  CRISPR gRNA sequence
aatgaggcccaacgcaaact

SEQ ID NO: 731927 - DNA, 20 bp, Artificial
  CRISPR gRNA sequence
ataaactttcttaaaacatt

SEQ ID NO: 731928 - DNA, 20 bp, Artificial
  CRISPR gRNA sequence
tcttaaaacattatgagatt

SEQ ID NO: 731929 - DNA, 20 bp, Artificial
  CRISPR gRNA sequence
cttaaaacattatgagattt

SEQ ID NO: 731930 - DNA, 20 bp, Artificial
  CRISPR gRNA sequence
ttaaaacattatgagatttg

SEQ ID NO: 731931 - DNA, 20 bp, Artificial
  CRISPR gRNA sequence
aaaacattatgagatttgcg

SEQ ID NO: 731932 - DNA, 20 bp, Artificial
  CRISPR gRNA sequence
aaacattatgagatttgcgt

SEQ ID NO: 731933 - DNA, 20 bp, Artificial
  CRISPR gRNA sequence
tgagatttgcgtgtgtgtga

SEQ ID NO: 731934 - DNA, 20 bp, Artificial
  CRISPR gRNA sequence
gcgtgtgtgtgatttttttt

SEQ ID NO: 731935 - DNA, 20 bp, Artificial
  CRISPR gRNA sequence
cgtgtgtgtgattttttttt

SEQ ID NO: 731936 - DNA, 20 bp, Artificial
  CRISPR gRNA sequence
tttttttttttttttttagc

SEQ ID NO: 731937 - DNA, 20 bp, Artificial
  CRISPR gRNA sequence
ttttttttttttttttagct

SEQ ID NO: 731938 - DNA, 20 bp, Artificial
  CRISPR gRNA sequence
tttttttttttttttagctc

SEQ ID NO: 731939 - DNA, 20 bp, Artificial
  CRISPR gRNA sequence
ttttttttttttttagctca

SEQ ID NO: 731940 - DNA, 20 bp, Artificial
  CRISPR gRNA sequence
tttttttttttttagctcat

SEQ ID NO: 731941 - DNA, 20 bp, Artificial
  CRISPR gRNA sequence
ttttttttttttagctcatc

SEQ ID NO: 731942 - DNA, 20 bp, Artificial
  CRISPR gRNA sequence
tttttttttttagctcatca

SEQ ID NO: 731943 - DNA, 20 bp, Artificial
  CRISPR gRNA sequence
ttttttttttagctcatcag

SEQ ID NO: 731944 - DNA, 20 bp, Artificial
  CRISPR gRNA sequence
tttttttttagctcatcagc

SEQ ID NO: 731945 - DNA, 20 bp, Artificial
  CRISPR gRNA sequence
ttttttttagctcatcagct

SEQ ID NO: 731946 - DNA, 20 bp, Artificial
  CRISPR gRNA sequence
tttttttagctcatcagcta

SEQ ID NO: 731947 - DNA, 20 bp, Artificial
  CRISPR gRNA sequence
ttttttagctcatcagctat

SEQ ID NO: 731948 - DNA, 20 bp, Artificial
  CRISPR gRNA sequence
tttttagctcatcagctata

SEQ ID NO: 731949 - DNA, 20 bp, Artificial
  CRISPR gRNA sequence
ttttagctcatcagctataa

SEQ ID NO: 731950 - DNA, 20 bp, Artificial
  CRISPR gRNA sequence
tttagctcatcagctataag

SEQ ID NO: 731951 - DNA, 20 bp, Artificial
  CRISPR gRNA sequence
ttagctcatcagctataagc

SEQ ID NO: 731952 - DNA, 20 bp, Artificial
  CRISPR gRNA sequence
tagctcatcagctataagct

SEQ ID NO: 731953 - DNA, 20 bp, Artificial
  CRISPR gRNA sequence
agctcatcagctataagcta

SEQ ID NO: 731954 - DNA, 20 bp, Artificial
  CRISPR gRNA sequence
gctcatcagctataagctaa

SEQ ID NO: 731955 - DNA, 20 bp, Artificial
  CRISPR gRNA sequence
atcagctataagctaaaaca

SEQ ID NO: 731956 - DNA, 20 bp, Artificial
  CRISPR gRNA sequence
taagctaaaacactatcctt

SEQ ID NO: 731957 - DNA, 20 bp, Artificial
  CRISPR gRNA sequence
aaacactatccttagtgtta

SEQ ID NO: 731958 - DNA, 20 bp, Artificial
  CRISPR gRNA sequence
tccttagtgttagactaaat

SEQ ID NO: 731959 - DNA, 20 bp, Artificial
  CRISPR gRNA sequence
agtgttagactaaattcact

SEQ ID NO: 731960 - DNA, 20 bp, Artificial
  CRISPR gRNA sequence
gtgttagactaaattcactt

SEQ ID NO: 731961 - DNA, 20 bp, Artificial
  CRISPR gRNA sequence
gactaaattcacttcttcca

SEQ ID NO: 731962 - DNA, 20 bp, Artificial
  CRISPR gRNA sequence
aattcacttcttccacacta

SEQ ID NO: 731963 - DNA, 20 bp, Artificial
  CRISPR gRNA sequence
acttcttccacactaacact

SEQ ID NO: 731964 - DNA, 20 bp, Artificial
  CRISPR gRNA sequence
cttccacactaacacttctt

SEQ ID NO: 731965 - DNA, 20 bp, Artificial
  CRISPR gRNA sequence
ttccacactaacacttcttc

SEQ ID NO: 731966 - DNA, 20 bp, Artificial
  CRISPR gRNA sequence
ccacactaacacttcttctt

SEQ ID NO: 731967 - DNA, 20 bp, Artificial
  CRISPR gRNA sequence
cacactaacacttcttcttc

SEQ ID NO: 731968 - DNA, 20 bp, Artificial
  CRISPR gRNA sequence
acacttcttcttccaatgtg

SEQ ID NO: 731969 - DNA, 20 bp, Artificial
  CRISPR gRNA sequence
cttcttccaatgtggcccag

SEQ ID NO: 731970 - DNA, 20 bp, Artificial
  CRISPR gRNA sequence
ttcttccaatgtggcccagg

SEQ ID NO: 731971 - DNA, 20 bp, Artificial
  CRISPR gRNA sequence
cttccaatgtggcccaggga

SEQ ID NO: 731972 - DNA, 20 bp, Artificial
  CRISPR gRNA sequence
ttccaatgtggcccagggaa

SEQ ID NO: 731973 - DNA, 20 bp, Artificial
  CRISPR gRNA sequence
ccaatgtggcccagggaagc

SEQ ID NO: 731974 - DNA, 20 bp, Artificial
  CRISPR gRNA sequence
caatgtggcccagggaagcc

SEQ ID NO: 731975 - DNA, 20 bp, Artificial
  CRISPR gRNA sequence
gacactcctgccactaagac

SEQ ID NO: 731976 - DNA, 20 bp, Artificial
  CRISPR gRNA sequence
ctgccactaagaccctaatc

SEQ ID NO: 731977 - DNA, 20 bp, Artificial
  CRISPR gRNA sequence
ccactaagaccctaatccag

SEQ ID NO: 731978 - DNA, 20 bp, Artificial
  CRISPR gRNA sequence
agaccctaatccagcctgat

SEQ ID NO: 731979 - DNA, 20 bp, Artificial
  CRISPR gRNA sequence
atccagcctgatttcgagat

SEQ ID NO: 731980 - DNA, 20 bp, Artificial
  CRISPR gRNA sequence
atttcgagataaacaagtca

SEQ ID NO: 731981 - DNA, 20 bp, Artificial
  CRISPR gRNA sequence
cgagataaacaagtcaccca

SEQ ID NO: 731982 - DNA, 20 bp, Artificial
  CRISPR gRNA sequence
gagataaacaagtcacccag

SEQ ID NO: 731983 - DNA, 20 bp, Artificial
  CRISPR gRNA sequence
cctaccttgcttccaggatg

SEQ ID NO: 731984 - DNA, 20 bp, Artificial
  CRISPR gRNA sequence
ccttgcttccaggatgagca

SEQ ID NO: 731985 - DNA, 20 bp, Artificial
  CRISPR gRNA sequence
gcttccaggatgagcacatg

SEQ ID NO: 731986 - DNA, 20 bp, Artificial
  CRISPR gRNA sequence
cttccaggatgagcacatga

SEQ ID NO: 731987 - DNA, 20 bp, Artificial
  CRISPR gRNA sequence
ccaggatgagcacatgaccc

SEQ ID NO: 731988 - DNA, 20 bp, Artificial
  CRISPR gRNA sequence
caggatgagcacatgaccca

SEQ ID NO: 731989 - DNA, 20 bp, Artificial
  CRISPR gRNA sequence
cttcccatcaatataattgg

SEQ ID NO: 731990 - DNA, 20 bp, Artificial
  CRISPR gRNA sequence
ttcccatcaatataattggc

SEQ ID NO: 731991 - DNA, 20 bp, Artificial
  CRISPR gRNA sequence
cccatcaatataattggctc

SEQ ID NO: 731992 - DNA, 20 bp, Artificial
  CRISPR gRNA sequence
ccatcaatataattggctca

SEQ ID NO: 731993 - DNA, 20 bp, Artificial
  CRISPR gRNA sequence
gctcaggattgccacatgac

SEQ ID NO: 731994 - DNA, 20 bp, Artificial
  CRISPR gRNA sequence
accagtgcaccacaatgtag

SEQ ID NO: 731995 - DNA, 20 bp, Artificial
  CRISPR gRNA sequence
gtagcagtctctcattgttt

SEQ ID NO: 731996 - DNA, 20 bp, Artificial
  CRISPR gRNA sequence
tagcagtctctcattgtttg

SEQ ID NO: 731997 - DNA, 20 bp, Artificial
  CRISPR gRNA sequence
ctcattgtttgaggtatcac

SEQ ID NO: 731998 - DNA, 20 bp, Artificial
  CRISPR gRNA sequence
cattgtttgaggtatcactg

SEQ ID NO: 731999 - DNA, 20 bp, Artificial
  CRISPR gRNA sequence
gtctcacaacaatgaaaatt

SEQ ID NO: 732000 - DNA, 20 bp, Artificial
  CRISPR gRNA sequence
tctcacaacaatgaaaatta

SEQ ID NO: 732001 - DNA, 20 bp, Artificial
  CRISPR gRNA sequence
tcacaacaatgaaaattaag

SEQ ID NO: 732002 - DNA, 20 bp, Artificial
  CRISPR gRNA sequence
acaatgaaaattaaggagcg

SEQ ID NO: 732003 - DNA, 20 bp, Artificial
  CRISPR gRNA sequence
aattaaggagcgtggacacc

SEQ ID NO: 732004 - DNA, 20 bp, Artificial
  CRISPR gRNA sequence
attaaggagcgtggacacca

SEQ ID NO: 732005 - DNA, 20 bp, Artificial
  CRISPR gRNA sequence
ggagcgtggacaccaaggat

SEQ ID NO: 732006 - DNA, 20 bp, Artificial
  CRISPR gRNA sequence
gagcgtggacaccaaggatg

SEQ ID NO: 732007 - DNA, 20 bp, Artificial
  CRISPR gRNA sequence
gtggacaccaaggatgaggt

SEQ ID NO: 732008 - DNA, 20 bp, Artificial
  CRISPR gRNA sequence
ggacaccaaggatgaggttg

SEQ ID NO: 732009 - DNA, 20 bp, Artificial
  CRISPR gRNA sequence
caaggatgaggttggagtga

SEQ ID NO: 732010 - DNA, 20 bp, Artificial
  CRISPR gRNA sequence
ggttggagtgaaagtttaat

SEQ ID NO: 732011 - DNA, 20 bp, Artificial
  CRISPR gRNA sequence
ggagtgaaagtttaatgagt

SEQ ID NO: 732012 - DNA, 20 bp, Artificial
  CRISPR gRNA sequence
agtgaaagtttaatgagtga

SEQ ID NO: 732013 - DNA, 20 bp, Artificial
  CRISPR gRNA sequence
gaaagtttaatgagtgagag

SEQ ID NO: 732014 - DNA, 20 bp, Artificial
  CRISPR gRNA sequence
gtttaatgagtgagagaaga

SEQ ID NO: 732015 - DNA, 20 bp, Artificial
  CRISPR gRNA sequence
gagaagaaagctctctgctg

SEQ ID NO: 732016 - DNA, 20 bp, Artificial
  CRISPR gRNA sequence
gaagaaagctctctgctgtg

SEQ ID NO: 732017 - DNA, 20 bp, Artificial
  CRISPR gRNA sequence
agaaagctctctgctgtgga

SEQ ID NO: 732018 - DNA, 20 bp, Artificial
  CRISPR gRNA sequence
gaaagctctctgctgtggag

SEQ ID NO: 732019 - DNA, 20 bp, Artificial
  CRISPR gRNA sequence
aagctctctgctgtggagag

SEQ ID NO: 732020 - DNA, 20 bp, Artificial
  CRISPR gRNA sequence
agctctctgctgtggagagg

SEQ ID NO: 732021 - DNA, 20 bp, Artificial
  CRISPR gRNA sequence
gctgtggagaggaggcctga

SEQ ID NO: 732022 - DNA, 20 bp, Artificial
  CRISPR gRNA sequence
tgtggagaggaggcctgaaa

SEQ ID NO: 732023 - DNA, 20 bp, Artificial
  CRISPR gRNA sequence
gtggagaggaggcctgaaag

SEQ ID NO: 732024 - DNA, 20 bp, Artificial
  CRISPR gRNA sequence
tggagaggaggcctgaaaga

SEQ ID NO: 732025 - DNA, 20 bp, Artificial
  CRISPR gRNA sequence
aaagagggttgccattttta

SEQ ID NO: 732026 - DNA, 20 bp, Artificial
  CRISPR gRNA sequence
catttttacagttgaatgta

SEQ ID NO: 732027 - DNA, 20 bp, Artificial
  CRISPR gRNA sequence
atttttacagttgaatgtaa

SEQ ID NO: 732028 - DNA, 20 bp, Artificial
  CRISPR gRNA sequence
ttgaatgtaaaggcttttat

SEQ ID NO: 732029 - DNA, 20 bp, Artificial
  CRISPR gRNA sequence
ggcttttataagaaaccgat

SEQ ID NO: 732030 - DNA, 20 bp, Artificial
  CRISPR gRNA sequence
gcttttataagaaaccgatg

SEQ ID NO: 732031 - DNA, 20 bp, Artificial
  CRISPR gRNA sequence
tataagaaaccgatgaggac

SEQ ID NO: 732032 - DNA, 20 bp, Artificial
  CRISPR gRNA sequence
ataagaaaccgatgaggact

SEQ ID NO: 732033 - DNA, 20 bp, Artificial
  CRISPR gRNA sequence
agaaaccgatgaggactggg

SEQ ID NO: 732034 - DNA, 20 bp, Artificial
  CRISPR gRNA sequence
actgggcagctcatctgcat

SEQ ID NO: 732035 - DNA, 20 bp, Artificial
  CRISPR gRNA sequence
ctgggcagctcatctgcata

SEQ ID NO: 732036 - DNA, 20 bp, Artificial
  CRISPR gRNA sequence
ctgcataaggcatgaatttc

SEQ ID NO: 732037 - DNA, 20 bp, Artificial
  CRISPR gRNA sequence
cataaggcatgaatttctgg

SEQ ID NO: 732038 - DNA, 20 bp, Artificial
  CRISPR gRNA sequence
ctgtccttctaatgtacatg

SEQ ID NO: 732039 - DNA, 20 bp, Artificial
  CRISPR gRNA sequence
tgtccttctaatgtacatgt

SEQ ID NO: 732040 - DNA, 20 bp, Artificial
  CRISPR gRNA sequence
ctaatgtacatgtgggccct

SEQ ID NO: 732041 - DNA, 20 bp, Artificial
  CRISPR gRNA sequence
tacatgtgggcccttggctt

SEQ ID NO: 732042 - DNA, 20 bp, Artificial
  CRISPR gRNA sequence
gttccccttactgcacatgt

SEQ ID NO: 732043 - DNA, 20 bp, Artificial
  CRISPR gRNA sequence
ttccccttactgcacatgtc

SEQ ID NO: 732044 - DNA, 20 bp, Artificial
  CRISPR gRNA sequence
tccccttactgcacatgtca

SEQ ID NO: 732045 - DNA, 20 bp, Artificial
  CRISPR gRNA sequence
ccccttactgcacatgtcag

SEQ ID NO: 732046 - DNA, 20 bp, Artificial
  CRISPR gRNA sequence
ggggatgaaattttccattg

SEQ ID NO: 732047 - DNA, 20 bp, Artificial
  CRISPR gRNA sequence
gggatgaaattttccattgc

SEQ ID NO: 732048 - DNA, 20 bp, Artificial
  CRISPR gRNA sequence
ttttccattgcaggcatgtt

SEQ ID NO: 732049 - DNA, 20 bp, Artificial
  CRISPR gRNA sequence
tttccattgcaggcatgttt

SEQ ID NO: 732050 - DNA, 20 bp, Artificial
  CRISPR gRNA sequence
cattgcaggcatgtttgggc

SEQ ID NO: 732051 - DNA, 20 bp, Artificial
  CRISPR gRNA sequence
gtttgggcaagtcacctgtg

SEQ ID NO: 732052 - DNA, 20 bp, Artificial
  CRISPR gRNA sequence
gtgtagtctgtcttatctat

SEQ ID NO: 732053 - DNA, 20 bp, Artificial
  CRISPR gRNA sequence
tgtagtctgtcttatctatg

SEQ ID NO: 732054 - DNA, 20 bp, Artificial
  CRISPR gRNA sequence
ctgtcttatctatgaggctg

SEQ ID NO: 732055 - DNA, 20 bp, Artificial
  CRISPR gRNA sequence
tgtcttatctatgaggctgt

SEQ ID NO: 732056 - DNA, 20 bp, Artificial
  CRISPR gRNA sequence
atgaggctgtgggcatgtct

SEQ ID NO: 732057 - DNA, 20 bp, Artificial
  CRISPR gRNA sequence
tgaggctgtgggcatgtctt

SEQ ID NO: 732058 - DNA, 20 bp, Artificial
  CRISPR gRNA sequence
gctgtgggcatgtcttaggc

SEQ ID NO: 732059 - DNA, 20 bp, Artificial
  CRISPR gRNA sequence
ttaggcaagcccccctgtgc

SEQ ID NO: 732060 - DNA, 20 bp, Artificial
  CRISPR gRNA sequence
agttcccatatctgtgcctg

SEQ ID NO: 732061 - DNA, 20 bp, Artificial
  CRISPR gRNA sequence
gtgcctgcagcttgattttt

SEQ ID NO: 732062 - DNA, 20 bp, Artificial
  CRISPR gRNA sequence
tgcctgcagcttgatttttc

SEQ ID NO: 732063 - DNA, 20 bp, Artificial
  CRISPR gRNA sequence
caggctgttcttttgtttaa

SEQ ID NO: 732064 - DNA, 20 bp, Artificial
  CRISPR gRNA sequence
ttgtttaaaagaattctacc

SEQ ID NO: 732065 - DNA, 20 bp, Artificial
  CRISPR gRNA sequence
accctaactgcctgcctgac

SEQ ID NO: 732066 - DNA, 20 bp, Artificial
  CRISPR gRNA sequence
ctcctctctcactccttctc

SEQ ID NO: 732067 - DNA, 20 bp, Artificial
  CRISPR gRNA sequence
ctctcactccttctccagat

SEQ ID NO: 732068 - DNA, 20 bp, Artificial
  CRISPR gRNA sequence
tctcactccttctccagatg

SEQ ID NO: 732069 - DNA, 20 bp, Artificial
  CRISPR gRNA sequence
ccttctccagatgaggaaac

SEQ ID NO: 732070 - DNA, 20 bp, Artificial
  CRISPR gRNA sequence
tccagatgaggaaacaagat

SEQ ID NO: 732071 - DNA, 20 bp, Artificial
  CRISPR gRNA sequence
cagatgaggaaacaagatca

SEQ ID NO: 732072 - DNA, 20 bp, Artificial
  CRISPR gRNA sequence
gatgaggaaacaagatcaga

SEQ ID NO: 732073 - DNA, 20 bp, Artificial
  CRISPR gRNA sequence
atgaggaaacaagatcagag

SEQ ID NO: 732074 - DNA, 20 bp, Artificial
  CRISPR gRNA sequence
tgaggaaacaagatcagaga

SEQ ID NO: 732075 - DNA, 20 bp, Artificial
  CRISPR gRNA sequence
gaaacaagatcagagaggga

SEQ ID NO: 732076 - DNA, 20 bp, Artificial
  CRISPR gRNA sequence
gagagggacagtgacttgcc

SEQ ID NO: 732077 - DNA, 20 bp, Artificial
  CRISPR gRNA sequence
tgacttgccaagttcacact

SEQ ID NO: 732078 - DNA, 20 bp, Artificial
  CRISPR gRNA sequence
tgccaagttcacactgagat

SEQ ID NO: 732079 - DNA, 20 bp, Artificial
  CRISPR gRNA sequence
ctgtaccctcccctcctcaa

SEQ ID NO: 732080 - DNA, 20 bp, Artificial
  CRISPR gRNA sequence
gtaccctcccctcctcaaaa

SEQ ID NO: 732081 - DNA, 20 bp, Artificial
  CRISPR gRNA sequence
taccctcccctcctcaaaag

SEQ ID NO: 732082 - DNA, 20 bp, Artificial
  CRISPR gRNA sequence
ctcaaaagaggaccttacca

SEQ ID NO: 732083 - DNA, 20 bp, Artificial
  CRISPR gRNA sequence
tcaaaagaggaccttaccaa

SEQ ID NO: 732084 - DNA, 20 bp, Artificial
  CRISPR gRNA sequence
caaaagaggaccttaccaaa

SEQ ID NO: 732085 - DNA, 20 bp, Artificial
  CRISPR gRNA sequence
cttaccaaagggactgtcat

SEQ ID NO: 732086 - DNA, 20 bp, Artificial
  CRISPR gRNA sequence
ttaccaaagggactgtcatc

SEQ ID NO: 732087 - DNA, 20 bp, Artificial
  CRISPR gRNA sequence
taccaaagggactgtcatcg

SEQ ID NO: 732088 - DNA, 20 bp, Artificial
  CRISPR gRNA sequence
accaaagggactgtcatcgg

SEQ ID NO: 732089 - DNA, 20 bp, Artificial
  CRISPR gRNA sequence
gggggccctcaacatccata

SEQ ID NO: 732090 - DNA, 20 bp, Artificial
  CRISPR gRNA sequence
atccatatagtgatgacact

SEQ ID NO: 732091 - DNA, 20 bp, Artificial
  CRISPR gRNA sequence
tccatatagtgatgacactt

SEQ ID NO: 732092 - DNA, 20 bp, Artificial
  CRISPR gRNA sequence
atatagtgatgacacttggg

SEQ ID NO: 732093 - DNA, 20 bp, Artificial
  CRISPR gRNA sequence
atagtgatgacacttgggaa

SEQ ID NO: 732094 - DNA, 20 bp, Artificial
  CRISPR gRNA sequence
cttgggaagagatatgacaa

SEQ ID NO: 732095 - DNA, 20 bp, Artificial
  CRISPR gRNA sequence
ggaagagatatgacaaaagc

SEQ ID NO: 732096 - DNA, 20 bp, Artificial
  CRISPR gRNA sequence
gatatgacaaaagcaagaaa

SEQ ID NO: 732097 - DNA, 20 bp, Artificial
  CRISPR gRNA sequence
aaagcaagaaacagaatcct

SEQ ID NO: 732098 - DNA, 20 bp, Artificial
  CRISPR gRNA sequence
aagcaagaaacagaatccta

SEQ ID NO: 732099 - DNA, 20 bp, Artificial
  CRISPR gRNA sequence
taaggtcttaaatgtaatgt

SEQ ID NO: 732100 - DNA, 20 bp, Artificial
  CRISPR gRNA sequence
tgtaatgttggaaacaacat

SEQ ID NO: 732101 - DNA, 20 bp, Artificial
  CRISPR gRNA sequence
taatgttggaaacaacatta

SEQ ID NO: 732102 - DNA, 20 bp, Artificial
  CRISPR gRNA sequence
gttggaaacaacattagagc

SEQ ID NO: 732103 - DNA, 20 bp, Artificial
  CRISPR gRNA sequence
ttagagctggaaaacaactt

SEQ ID NO: 732104 - DNA, 20 bp, Artificial
  CRISPR gRNA sequence
tagagctggaaaacaactta

SEQ ID NO: 732105 - DNA, 20 bp, Artificial
  CRISPR gRNA sequence
gaaaacaacttaaggaataa

SEQ ID NO: 732106 - DNA, 20 bp, Artificial
  CRISPR gRNA sequence
acttaaggaataatggtaat

SEQ ID NO: 732107 - DNA, 20 bp, Artificial
  CRISPR gRNA sequence
cttaaggaataatggtaatg

SEQ ID NO: 732108 - DNA, 20 bp, Artificial
  CRISPR gRNA sequence
tttatcttgaaaacaatctt

SEQ ID NO: 732109 - DNA, 20 bp, Artificial
  CRISPR gRNA sequence
atcttgaaaacaatcttgag

SEQ ID NO: 732110 - DNA, 20 bp, Artificial
  CRISPR gRNA sequence
ttgaaaacaatcttgagaag

SEQ ID NO: 732111 - DNA, 20 bp, Artificial
  CRISPR gRNA sequence
tgaaaacaatcttgagaagt

SEQ ID NO: 732112 - DNA, 20 bp, Artificial
  CRISPR gRNA sequence
gaattattgtcctctttcac

SEQ ID NO: 732113 - DNA, 20 bp, Artificial
  CRISPR gRNA sequence
tattgtcctctttcacaaga

SEQ ID NO: 732114 - DNA, 20 bp, Artificial
  CRISPR gRNA sequence
attgtcctctttcacaagac

SEQ ID NO: 732115 - DNA, 20 bp, Artificial
  CRISPR gRNA sequence
tttcacaagacaggaaaaat

SEQ ID NO: 732116 - DNA, 20 bp, Artificial
  CRISPR gRNA sequence
ttcacaagacaggaaaaatg

SEQ ID NO: 732117 - DNA, 20 bp, Artificial
  CRISPR gRNA sequence
aagacaggaaaaatgaggcc

SEQ ID NO: 732118 - DNA, 20 bp, Artificial
  CRISPR gRNA sequence
agacaggaaaaatgaggcca

SEQ ID NO: 732119 - DNA, 20 bp, Artificial
  CRISPR gRNA sequence
gacaggaaaaatgaggccaa

SEQ ID NO: 732120 - DNA, 20 bp, Artificial
  CRISPR gRNA sequence
ggaaaaatgaggccaagggt

SEQ ID NO: 732121 - DNA, 20 bp, Artificial
  CRISPR gRNA sequence
ccaagggttagtgacttgct

SEQ ID NO: 732122 - DNA, 20 bp, Artificial
  CRISPR gRNA sequence
caagggttagtgacttgctg

SEQ ID NO: 732123 - DNA, 20 bp, Artificial
  CRISPR gRNA sequence
aagggttagtgacttgctga

SEQ ID NO: 732124 - DNA, 20 bp, Artificial
  CRISPR gRNA sequence
gtgacttgctgagggtcaca

SEQ ID NO: 732125 - DNA, 20 bp, Artificial
  CRISPR gRNA sequence
tgctgagggtcacacagtga

SEQ ID NO: 732126 - DNA, 20 bp, Artificial
  CRISPR gRNA sequence
ctgagggtcacacagtgaca

SEQ ID NO: 732127 - DNA, 20 bp, Artificial
  CRISPR gRNA sequence
agggtcacacagtgacagag

SEQ ID NO: 732128 - DNA, 20 bp, Artificial
  CRISPR gRNA sequence
acagtgacagagtggtatcc

SEQ ID NO: 732129 - DNA, 20 bp, Artificial
  CRISPR gRNA sequence
cctgtccctgacttcttccc

SEQ ID NO: 732130 - DNA, 20 bp, Artificial
  CRISPR gRNA sequence
ctgtccctgacttcttccct

SEQ ID NO: 732131 - DNA, 20 bp, Artificial
  CRISPR gRNA sequence
tgtccctgacttcttcccta

SEQ ID NO: 732132 - DNA, 20 bp, Artificial
  CRISPR gRNA sequence
ttccctagggctcctcctcc

SEQ ID NO: 732133 - DNA, 20 bp, Artificial
  CRISPR gRNA sequence
tccctagggctcctcctcct

SEQ ID NO: 732134 - DNA, 20 bp, Artificial
  CRISPR gRNA sequence
ctcctcctgggcatctcact

SEQ ID NO: 732135 - DNA, 20 bp, Artificial
  CRISPR gRNA sequence
cctcctgggcatctcactca

SEQ ID NO: 732136 - DNA, 20 bp, Artificial
  CRISPR gRNA sequence
ctcctgggcatctcactcag

SEQ ID NO: 732137 - DNA, 20 bp, Artificial
  CRISPR gRNA sequence
ctgggcatctcactcagagg

SEQ ID NO: 732138 - DNA, 20 bp, Artificial
  CRISPR gRNA sequence
ggcatctcactcagaggaag

SEQ ID NO: 732139 - DNA, 20 bp, Artificial
  CRISPR gRNA sequence
gcatctcactcagaggaagc

SEQ ID NO: 732140 - DNA, 20 bp, Artificial
  CRISPR gRNA sequence
catctcactcagaggaagca

SEQ ID NO: 732141 - DNA, 20 bp, Artificial
  CRISPR gRNA sequence
ctcagaggaagcagggccat

SEQ ID NO: 732142 - DNA, 20 bp, Artificial
  CRISPR gRNA sequence
agaggaagcagggccatcag

SEQ ID NO: 732143 - DNA, 20 bp, Artificial
  CRISPR gRNA sequence
agcagggccatcagtggtac

SEQ ID NO: 732144 - DNA, 20 bp, Artificial
  CRISPR gRNA sequence
gccatcagtggtactggtgc

SEQ ID NO: 732145 - DNA, 20 bp, Artificial
  CRISPR gRNA sequence
gtggtactggtgccagctct

SEQ ID NO: 732146 - DNA, 20 bp, Artificial
  CRISPR gRNA sequence
tggtactggtgccagctctt

SEQ ID NO: 732147 - DNA, 20 bp, Artificial
  CRISPR gRNA sequence
ggtactggtgccagctcttg

SEQ ID NO: 732148 - DNA, 20 bp, Artificial
  CRISPR gRNA sequence
tactggtgccagctcttggg

SEQ ID NO: 732149 - DNA, 20 bp, Artificial
  CRISPR gRNA sequence
cttggggagctattttcccc

SEQ ID NO: 732150 - DNA, 20 bp, Artificial
  CRISPR gRNA sequence
ttggggagctattttccccc

SEQ ID NO: 732151 - DNA, 20 bp, Artificial
  CRISPR gRNA sequence
gggagctattttcccccagg

SEQ ID NO: 732152 - DNA, 20 bp, Artificial
  CRISPR gRNA sequence
ggagctattttcccccaggt

SEQ ID NO: 732153 - DNA, 20 bp, Artificial
  CRISPR gRNA sequence
tattttcccccaggtgggtt

SEQ ID NO: 732154 - DNA, 20 bp, Artificial
  CRISPR gRNA sequence
aggtgggttaagttctctcc

SEQ ID NO: 732155 - DNA, 20 bp, Artificial
  CRISPR gRNA sequence
agttctctcctagtatacaa

SEQ ID NO: 732156 - DNA, 20 bp, Artificial
  CRISPR gRNA sequence
gttctctcctagtatacaac

SEQ ID NO: 732157 - DNA, 20 bp, Artificial
  CRISPR gRNA sequence
tctcctagtatacaacagga

SEQ ID NO: 732158 - DNA, 20 bp, Artificial
  CRISPR gRNA sequence
cctagtatacaacaggatgg

SEQ ID NO: 732159 - DNA, 20 bp, Artificial
  CRISPR gRNA sequence
tggtggctacaccgtcatga

SEQ ID NO: 732160 - DNA, 20 bp, Artificial
  CRISPR gRNA sequence
ggtggctacaccgtcatgat

SEQ ID NO: 732161 - DNA, 20 bp, Artificial
  CRISPR gRNA sequence
gtggctacaccgtcatgata

SEQ ID NO: 732162 - DNA, 20 bp, Artificial
  CRISPR gRNA sequence
ggctacaccgtcatgatagg

SEQ ID NO: 732163 - DNA, 20 bp, Artificial
  CRISPR gRNA sequence
caccgtcatgatagggagaa

SEQ ID NO: 732164 - DNA, 20 bp, Artificial
  CRISPR gRNA sequence
gatagggagaacagctatct

SEQ ID NO: 732165 - DNA, 20 bp, Artificial
  CRISPR gRNA sequence
atagggagaacagctatctt

SEQ ID NO: 732166 - DNA, 20 bp, Artificial
  CRISPR gRNA sequence
agggagaacagctatcttag

SEQ ID NO: 732167 - DNA, 20 bp, Artificial
  CRISPR gRNA sequence
gggagaacagctatcttagg

SEQ ID NO: 732168 - DNA, 20 bp, Artificial
  CRISPR gRNA sequence
tatcttaggaggctgcttgc

SEQ ID NO: 732169 - DNA, 20 bp, Artificial
  CRISPR gRNA sequence
ttaggaggctgcttgctaga

SEQ ID NO: 732170 - DNA, 20 bp, Artificial
  CRISPR gRNA sequence
aggaggctgcttgctagaca

SEQ ID NO: 732171 - DNA, 20 bp, Artificial
  CRISPR gRNA sequence
ggctgcttgctagacagaga

SEQ ID NO: 732172 - DNA, 20 bp, Artificial
  CRISPR gRNA sequence
gctgcttgctagacagagat

SEQ ID NO: 732173 - DNA, 20 bp, Artificial
  CRISPR gRNA sequence
gtctgtctgtctgtctgtcc

SEQ ID NO: 732174 - DNA, 20 bp, Artificial
  CRISPR gRNA sequence
tctgtctgtctgtctgtcct

SEQ ID NO: 732175 - DNA, 20 bp, Artificial
  CRISPR gRNA sequence
ctgtctgtctgtcctgggtc

SEQ ID NO: 732176 - DNA, 20 bp, Artificial
  CRISPR gRNA sequence
gtctgtctgtcctgggtcca

SEQ ID NO: 732177 - DNA, 20 bp, Artificial
  CRISPR gRNA sequence
gtccagagccgtcaattctt

SEQ ID NO: 732178 - DNA, 20 bp, Artificial
  CRISPR gRNA sequence
agccgtcaattcttcagcct

SEQ ID NO: 732179 - DNA, 20 bp, Artificial
  CRISPR gRNA sequence
ttccctctattgccctctcc

SEQ ID NO: 732180 - DNA, 20 bp, Artificial
  CRISPR gRNA sequence
ctattgccctctcctggaca

SEQ ID NO: 732181 - DNA, 20 bp, Artificial
  CRISPR gRNA sequence
tattgccctctcctggacat

SEQ ID NO: 732182 - DNA, 20 bp, Artificial
  CRISPR gRNA sequence
attgccctctcctggacata

SEQ ID NO: 732183 - DNA, 20 bp, Artificial
  CRISPR gRNA sequence
gccctctcctggacataggg

SEQ ID NO: 732184 - DNA, 20 bp, Artificial
  CRISPR gRNA sequence
ctctcctggacatagggaag

SEQ ID NO: 732185 - DNA, 20 bp, Artificial
  CRISPR gRNA sequence
gcctcctccctgctgtcccc

SEQ ID NO: 732186 - DNA, 20 bp, Artificial
  CRISPR gRNA sequence
cctcctccctgctgtccccc

SEQ ID NO: 732187 - DNA, 20 bp, Artificial
  CRISPR gRNA sequence
ctctccccacatccatcctg

SEQ ID NO: 732188 - DNA, 20 bp, Artificial
  CRISPR gRNA sequence
tccccacatccatcctgaag

SEQ ID NO: 732189 - DNA, 20 bp, Artificial
  CRISPR gRNA sequence
ccatcctgaagtggcccctc

SEQ ID NO: 732190 - DNA, 20 bp, Artificial
  CRISPR gRNA sequence
tggcccctctggctgtccac

SEQ ID NO: 732191 - DNA, 20 bp, Artificial
  CRISPR gRNA sequence
ggcccctctggctgtccacc

SEQ ID NO: 732192 - DNA, 20 bp, Artificial
  CRISPR gRNA sequence
gcccctctggctgtccacca

SEQ ID NO: 732193 - DNA, 20 bp, Artificial
  CRISPR gRNA sequence
ctggctgtccaccagggtcc

SEQ ID NO: 732194 - DNA, 20 bp, Artificial
  CRISPR gRNA sequence
tcctggctgtgtcactctct

SEQ ID NO: 732195 - DNA, 20 bp, Artificial
  CRISPR gRNA sequence
tgtgtcactctcttggccat

SEQ ID NO: 732196 - DNA, 20 bp, Artificial
  CRISPR gRNA sequence
ccattggaacgtccctgacc

SEQ ID NO: 732197 - DNA, 20 bp, Artificial
  CRISPR gRNA sequence
cattggaacgtccctgaccc

SEQ ID NO: 732198 - DNA, 20 bp, Artificial
  CRISPR gRNA sequence
attggaacgtccctgaccca

SEQ ID NO: 732199 - DNA, 20 bp, Artificial
  CRISPR gRNA sequence
ctgacccagggttcaatgca

SEQ ID NO: 732200 - DNA, 20 bp, Artificial
  CRISPR gRNA sequence
acagttgtcacatttatccc

SEQ ID NO: 732201 - DNA, 20 bp, Artificial
  CRISPR gRNA sequence
cagttgtcacatttatcccc

SEQ ID NO: 732202 - DNA, 20 bp, Artificial
  CRISPR gRNA sequence
tttatccccaggtgctattc

SEQ ID NO: 732203 - DNA, 20 bp, Artificial
  CRISPR gRNA sequence
aggtgctattccagtcactc

SEQ ID NO: 732204 - DNA, 20 bp, Artificial
  CRISPR gRNA sequence
ggtgctattccagtcactcc

SEQ ID NO: 732205 - DNA, 20 bp, Artificial
  CRISPR gRNA sequence
ctattccagtcactccaggt

SEQ ID NO: 732206 - DNA, 20 bp, Artificial
  CRISPR gRNA sequence
ttccagtcactccaggtcag

SEQ ID NO: 732207 - DNA, 20 bp, Artificial
  CRISPR gRNA sequence
tgtgtgtgtgtgtgtgtgtg

SEQ ID NO: 732208 - DNA, 20 bp, Artificial
  CRISPR gRNA sequence
gtgtgtgtgtgtgtgtgtgt

SEQ ID NO: 732209 - DNA, 20 bp, Artificial
  CRISPR gRNA sequence
tgtgtgtgtgtgtgtgtgta

SEQ ID NO: 732210 - DNA, 20 bp, Artificial
  CRISPR gRNA sequence
gtgtgtgtgtgtgtgtgtag

SEQ ID NO: 732211 - DNA, 20 bp, Artificial
  CRISPR gRNA sequence
tgtgtgtgtgtaggggaatc

SEQ ID NO: 732212 - DNA, 20 bp, Artificial
  CRISPR gRNA sequence
gtgtgtgtgtaggggaatcc

SEQ ID NO: 732213 - DNA, 20 bp, Artificial
  CRISPR gRNA sequence
ggaatccaggctgcattctc

SEQ ID NO: 732214 - DNA, 20 bp, Artificial
  CRISPR gRNA sequence
cattctccagccttcattgc

SEQ ID NO: 732215 - DNA, 20 bp, Artificial
  CRISPR gRNA sequence
agccttcattgctggacgcc

SEQ ID NO: 732216 - DNA, 20 bp, Artificial
  CRISPR gRNA sequence
ttcattgctggacgccaagc

SEQ ID NO: 732217 - DNA, 20 bp, Artificial
  CRISPR gRNA sequence
tggacgccaagccagtgctc

SEQ ID NO: 732218 - DNA, 20 bp, Artificial
  CRISPR gRNA sequence
caagccagtgctctggacaa

SEQ ID NO: 732219 - DNA, 20 bp, Artificial
  CRISPR gRNA sequence
agccagtgctctggacaata

SEQ ID NO: 732220 - DNA, 20 bp, Artificial
  CRISPR gRNA sequence
gccagtgctctggacaatag

SEQ ID NO: 732221 - DNA, 20 bp, Artificial
  CRISPR gRNA sequence
tgctctggacaatagaggct

SEQ ID NO: 732222 - DNA, 20 bp, Artificial
  CRISPR gRNA sequence
ggacaatagaggctgagtct

SEQ ID NO: 732223 - DNA, 20 bp, Artificial
  CRISPR gRNA sequence
agaggctgagtctgagccct

SEQ ID NO: 732224 - DNA, 20 bp, Artificial
  CRISPR gRNA sequence
gctgagtctgagccctgagt

SEQ ID NO: 732225 - DNA, 20 bp, Artificial
  CRISPR gRNA sequence
gagtctgagccctgagtcag

SEQ ID NO: 732226 - DNA, 20 bp, Artificial
  CRISPR gRNA sequence
agtctgagccctgagtcagt

SEQ ID NO: 732227 - DNA, 20 bp, Artificial
  CRISPR gRNA sequence
ctgagccctgagtcagtggg

SEQ ID NO: 732228 - DNA, 20 bp, Artificial
  CRISPR gRNA sequence
tgagccctgagtcagtgggt

SEQ ID NO: 732229 - DNA, 20 bp, Artificial
  CRISPR gRNA sequence
agccctgagtcagtgggtgg

SEQ ID NO: 732230 - DNA, 20 bp, Artificial
  CRISPR gRNA sequence
gccctgagtcagtgggtggg

SEQ ID NO: 732231 - DNA, 20 bp, Artificial
  CRISPR gRNA sequence
ctgagtcagtgggtgggagg

SEQ ID NO: 732232 - DNA, 20 bp, Artificial
  CRISPR gRNA sequence
tgggtgggaggcagattcct

SEQ ID NO: 732233 - DNA, 20 bp, Artificial
  CRISPR gRNA sequence
gggtgggaggcagattcctc

SEQ ID NO: 732234 - DNA, 20 bp, Artificial
  CRISPR gRNA sequence
aggcagattcctcgggacat

SEQ ID NO: 732235 - DNA, 20 bp, Artificial
  CRISPR gRNA sequence
ggcagattcctcgggacatt

SEQ ID NO: 732236 - DNA, 20 bp, Artificial
  CRISPR gRNA sequence
tcctcgggacattgggtccc

SEQ ID NO: 732237 - DNA, 20 bp, Artificial
  CRISPR gRNA sequence
cgggacattgggtccctggc

SEQ ID NO: 732238 - DNA, 20 bp, Artificial
  CRISPR gRNA sequence
ggacattgggtccctggcca

SEQ ID NO: 732239 - DNA, 20 bp, Artificial
  CRISPR gRNA sequence
gacattgggtccctggccag

SEQ ID NO: 732240 - DNA, 20 bp, Artificial
  CRISPR gRNA sequence
gtccctggccagaggctact

SEQ ID NO: 732241 - DNA, 20 bp, Artificial
  CRISPR gRNA sequence
tccctggccagaggctactt

SEQ ID NO: 732242 - DNA, 20 bp, Artificial
  CRISPR gRNA sequence
attttccctgtccccctgcc

SEQ ID NO: 732243 - DNA, 20 bp, Artificial
  CRISPR gRNA sequence
ttttccctgtccccctgcct

SEQ ID NO: 732244 - DNA, 20 bp, Artificial
  CRISPR gRNA sequence
ccctgtccccctgcctgggc

SEQ ID NO: 732245 - DNA, 20 bp, Artificial
  CRISPR gRNA sequence
ccctgcctgggccagtcctc

SEQ ID NO: 732246 - DNA, 20 bp, Artificial
  CRISPR gRNA sequence
cctgcctgggccagtcctcc

SEQ ID NO: 732247 - DNA, 20 bp, Artificial
  CRISPR gRNA sequence
tgggccagtcctccaggccg

SEQ ID NO: 732248 - DNA, 20 bp, Artificial
  CRISPR gRNA sequence
ccagtcctccaggccgtggt

SEQ ID NO: 732249 - DNA, 20 bp, Artificial
  CRISPR gRNA sequence
tccaggccgtggtcagttcc

SEQ ID NO: 732250 - DNA, 20 bp, Artificial
  CRISPR gRNA sequence
tactgtcttcactgtgtccc

SEQ ID NO: 732251 - DNA, 20 bp, Artificial
  CRISPR gRNA sequence
gtgtcttctctctctatcct

SEQ ID NO: 732252 - DNA, 20 bp, Artificial
  CRISPR gRNA sequence
tgtcttctctctctatcctg

SEQ ID NO: 732253 - DNA, 20 bp, Artificial
  CRISPR gRNA sequence
gtcttctctctctatcctga

SEQ ID NO: 732254 - DNA, 20 bp, Artificial
  CRISPR gRNA sequence
tcttctctctctatcctgag

SEQ ID NO: 732255 - DNA, 20 bp, Artificial
  CRISPR gRNA sequence
tctctctctatcctgagggg

SEQ ID NO: 732256 - DNA, 20 bp, Artificial
  CRISPR gRNA sequence
ctctctctatcctgaggggt

SEQ ID NO: 732257 - DNA, 20 bp, Artificial
  CRISPR gRNA sequence
ctctctatcctgaggggtag

SEQ ID NO: 732258 - DNA, 20 bp, Artificial
  CRISPR gRNA sequence
tctctatcctgaggggtagg

SEQ ID NO: 732259 - DNA, 20 bp, Artificial
  CRISPR gRNA sequence
tctatcctgaggggtaggag

SEQ ID NO: 732260 - DNA, 20 bp, Artificial
  CRISPR gRNA sequence
ctatcctgaggggtaggagg

SEQ ID NO: 732261 - DNA, 20 bp, Artificial
  CRISPR gRNA sequence
tatcctgaggggtaggagga

SEQ ID NO: 732262 - DNA, 20 bp, Artificial
  CRISPR gRNA sequence
ggttgctccacccttcctct

SEQ ID NO: 732263 - DNA, 20 bp, Artificial
  CRISPR gRNA sequence
tccacccttcctctgagcca

SEQ ID NO: 732264 - DNA, 20 bp, Artificial
  CRISPR gRNA sequence
ctgagccatggtctccccac

SEQ ID NO: 732265 - DNA, 20 bp, Artificial
  CRISPR gRNA sequence
ggtctccccaccagtgtctg

SEQ ID NO: 732266 - DNA, 20 bp, Artificial
  CRISPR gRNA sequence
gtctccccaccagtgtctgt

SEQ ID NO: 732267 - DNA, 20 bp, Artificial
  CRISPR gRNA sequence
tctccccaccagtgtctgtg

SEQ ID NO: 732268 - DNA, 20 bp, Artificial
  CRISPR gRNA sequence
cccaccagtgtctgtggggt

SEQ ID NO: 732269 - DNA, 20 bp, Artificial
  CRISPR gRNA sequence
accagtgtctgtggggtgag

SEQ ID NO: 732270 - DNA, 20 bp, Artificial
  CRISPR gRNA sequence
tggggtgagcagcctccata

SEQ ID NO: 732271 - DNA, 20 bp, Artificial
  CRISPR gRNA sequence
gggtgagcagcctccataca

SEQ ID NO: 732272 - DNA, 20 bp, Artificial
  CRISPR gRNA sequence
agcagcctccatacagagcc

SEQ ID NO: 732273 - DNA, 20 bp, Artificial
  CRISPR gRNA sequence
gcagcctccatacagagcca

SEQ ID NO: 732274 - DNA, 20 bp, Artificial
  CRISPR gRNA sequence
tccatacagagccaaggtct

SEQ ID NO: 732275 - DNA, 20 bp, Artificial
  CRISPR gRNA sequence
agccaaggtctcagccaccc

SEQ ID NO: 732276 - DNA, 20 bp, Artificial
  CRISPR gRNA sequence
gccaaggtctcagccacccc

SEQ ID NO: 732277 - DNA, 20 bp, Artificial
  CRISPR gRNA sequence
ccaaggtctcagccacccca

SEQ ID NO: 732278 - DNA, 20 bp, Artificial
  CRISPR gRNA sequence
gtctcagccaccccagggta

SEQ ID NO: 732279 - DNA, 20 bp, Artificial
  CRISPR gRNA sequence
accccagggtatggacttcc

SEQ ID NO: 732280 - DNA, 20 bp, Artificial
  CRISPR gRNA sequence
cccagggtatggacttcctg

SEQ ID NO: 732281 - DNA, 20 bp, Artificial
  CRISPR gRNA sequence
ccagggtatggacttcctgg

SEQ ID NO: 732282 - DNA, 20 bp, Artificial
  CRISPR gRNA sequence
atggacttcctggaggctgc

SEQ ID NO: 732283 - DNA, 20 bp, Artificial
  CRISPR gRNA sequence
tggacttcctggaggctgct

SEQ ID NO: 732284 - DNA, 20 bp, Artificial
  CRISPR gRNA sequence
ggaggctgctgggtcccctg

SEQ ID NO: 732285 - DNA, 20 bp, Artificial
  CRISPR gRNA sequence
gaggctgctgggtcccctgt

SEQ ID NO: 732286 - DNA, 20 bp, Artificial
  CRISPR gRNA sequence
ctgggtcccctgtgggaact

SEQ ID NO: 732287 - DNA, 20 bp, Artificial
  CRISPR gRNA sequence
cccctgtgggaactcagact

SEQ ID NO: 732288 - DNA, 20 bp, Artificial
  CRISPR gRNA sequence
cctgtgggaactcagacttg

SEQ ID NO: 732289 - DNA, 20 bp, Artificial
  CRISPR gRNA sequence
gggaactcagacttggagcc

SEQ ID NO: 732290 - DNA, 20 bp, Artificial
  CRISPR gRNA sequence
ggaactcagacttggagccc

SEQ ID NO: 732291 - DNA, 20 bp, Artificial
  CRISPR gRNA sequence
tcagacttggagcccaggtg

SEQ ID NO: 732292 - DNA, 20 bp, Artificial
  CRISPR gRNA sequence
gacttggagcccaggtgtag

SEQ ID NO: 732293 - DNA, 20 bp, Artificial
  CRISPR gRNA sequence
tggagcccaggtgtagaagc

SEQ ID NO: 732294 - DNA, 20 bp, Artificial
  CRISPR gRNA sequence
ggagcccaggtgtagaagct

SEQ ID NO: 732295 - DNA, 20 bp, Artificial
  CRISPR gRNA sequence
gagcccaggtgtagaagctg

SEQ ID NO: 732296 - DNA, 20 bp, Artificial
  CRISPR gRNA sequence
agcccaggtgtagaagctgg

SEQ ID NO: 732297 - DNA, 20 bp, Artificial
  CRISPR gRNA sequence
cccaggtgtagaagctgggg

SEQ ID NO: 732298 - DNA, 20 bp, Artificial
  CRISPR gRNA sequence
caggtgtagaagctggggga

SEQ ID NO: 732299 - DNA, 20 bp, Artificial
  CRISPR gRNA sequence
ggtgtagaagctgggggaga

SEQ ID NO: 732300 - DNA, 20 bp, Artificial
  CRISPR gRNA sequence
aagctgggggagagagcccc

SEQ ID NO: 732301 - DNA, 20 bp, Artificial
  CRISPR gRNA sequence
gggggagagagccccaagtc

SEQ ID NO: 732302 - DNA, 20 bp, Artificial
  CRISPR gRNA sequence
caagtccagcctctgcactt

SEQ ID NO: 732303 - DNA, 20 bp, Artificial
  CRISPR gRNA sequence
cagcctctgcacttcagtct

SEQ ID NO: 732304 - DNA, 20 bp, Artificial
  CRISPR gRNA sequence
agcctctgcacttcagtctt

SEQ ID NO: 732305 - DNA, 20 bp, Artificial
  CRISPR gRNA sequence
cctctgcacttcagtcttgg

SEQ ID NO: 732306 - DNA, 20 bp, Artificial
  CRISPR gRNA sequence
tctgcacttcagtcttggga

SEQ ID NO: 732307 - DNA, 20 bp, Artificial
  CRISPR gRNA sequence
ctgcacttcagtcttgggag

SEQ ID NO: 732308 - DNA, 20 bp, Artificial
  CRISPR gRNA sequence
cttgggagaggctgaccctg

SEQ ID NO: 732309 - DNA, 20 bp, Artificial
  CRISPR gRNA sequence
gagaggctgaccctgcagcc

SEQ ID NO: 732310 - DNA, 20 bp, Artificial
  CRISPR gRNA sequence
gaggctgaccctgcagccca

SEQ ID NO: 732311 - DNA, 20 bp, Artificial
  CRISPR gRNA sequence
aggctgaccctgcagcccag

SEQ ID NO: 732312 - DNA, 20 bp, Artificial
  CRISPR gRNA sequence
ccctgcagcccagaggctct

SEQ ID NO: 732313 - DNA, 20 bp, Artificial
  CRISPR gRNA sequence
cccagaggctcttagctgcc

SEQ ID NO: 732314 - DNA, 20 bp, Artificial
  CRISPR gRNA sequence
ggctcttagctgcctggtca

SEQ ID NO: 732315 - DNA, 20 bp, Artificial
  CRISPR gRNA sequence
ctgcctggtcacagctttct

SEQ ID NO: 732316 - DNA, 20 bp, Artificial
  CRISPR gRNA sequence
tgcctggtcacagctttcta

SEQ ID NO: 732317 - DNA, 20 bp, Artificial
  CRISPR gRNA sequence
cctggtcacagctttctaag

SEQ ID NO: 732318 - DNA, 20 bp, Artificial
  CRISPR gRNA sequence
ctggtcacagctttctaagg

SEQ ID NO: 732319 - DNA, 20 bp, Artificial
  CRISPR gRNA sequence
gtcacagctttctaaggagg

SEQ ID NO: 732320 - DNA, 20 bp, Artificial
  CRISPR gRNA sequence
acagctttctaaggaggcag

SEQ ID NO: 732321 - DNA, 20 bp, Artificial
  CRISPR gRNA sequence
ctttctaaggaggcagcggc

SEQ ID NO: 732322 - DNA, 20 bp, Artificial
  CRISPR gRNA sequence
tctaaggaggcagcggccag

SEQ ID NO: 732323 - DNA, 20 bp, Artificial
  CRISPR gRNA sequence
ctaaggaggcagcggccagc

SEQ ID NO: 732324 - DNA, 20 bp, Artificial
  CRISPR gRNA sequence
aaggaggcagcggccagcag

SEQ ID NO: 732325 - DNA, 20 bp, Artificial
  CRISPR gRNA sequence
aggaggcagcggccagcagg

SEQ ID NO: 732326 - DNA, 20 bp, Artificial
  CRISPR gRNA sequence
aggcagcggccagcaggagg

SEQ ID NO: 732327 - DNA, 20 bp, Artificial
  CRISPR gRNA sequence
cagcggccagcaggaggcag

SEQ ID NO: 732328 - DNA, 20 bp, Artificial
  CRISPR gRNA sequence
ggccagcaggaggcagcagt

SEQ ID NO: 732329 - DNA, 20 bp, Artificial
  CRISPR gRNA sequence
ccagcaggaggcagcagtga

SEQ ID NO: 732330 - DNA, 20 bp, Artificial
  CRISPR gRNA sequence
aggaggcagcagtgagagcg

SEQ ID NO: 732331 - DNA, 20 bp, Artificial
  CRISPR gRNA sequence
ggaggcagcagtgagagcgt

SEQ ID NO: 732332 - DNA, 20 bp, Artificial
  CRISPR gRNA sequence
gtgagagcgtgggctctgcg

SEQ ID NO: 732333 - DNA, 20 bp, Artificial
  CRISPR gRNA sequence
gcgtgggctctgcgcggtcc

SEQ ID NO: 732334 - DNA, 20 bp, Artificial
  CRISPR gRNA sequence
cgtgggctctgcgcggtccc

SEQ ID NO: 732335 - DNA, 20 bp, Artificial
  CRISPR gRNA sequence
ggctctgcgcggtcccagga

SEQ ID NO: 732336 - DNA, 20 bp, Artificial
  CRISPR gRNA sequence
gctctgcgcggtcccaggac

SEQ ID NO: 732337 - DNA, 20 bp, Artificial
  CRISPR gRNA sequence
tctgcgcggtcccaggacag

SEQ ID NO: 732338 - DNA, 20 bp, Artificial
  CRISPR gRNA sequence
ctgcgcggtcccaggacagg

SEQ ID NO: 732339 - DNA, 20 bp, Artificial
  CRISPR gRNA sequence
tgcgcggtcccaggacagga

SEQ ID NO: 732340 - DNA, 20 bp, Artificial
  CRISPR gRNA sequence
cgcggtcccaggacaggagg

SEQ ID NO: 732341 - DNA, 20 bp, Artificial
  CRISPR gRNA sequence
gcggtcccaggacaggaggg

SEQ ID NO: 732342 - DNA, 20 bp, Artificial
  CRISPR gRNA sequence
ggtcccaggacaggagggag

SEQ ID NO: 732343 - DNA, 20 bp, Artificial
  CRISPR gRNA sequence
cccaggacaggagggaggag

SEQ ID NO: 732344 - DNA, 20 bp, Artificial
  CRISPR gRNA sequence
acaggagggaggagcagccc

SEQ ID NO: 732345 - DNA, 20 bp, Artificial
  CRISPR gRNA sequence
gagggaggagcagccccagt

SEQ ID NO: 732346 - DNA, 20 bp, Artificial
  CRISPR gRNA sequence
agggaggagcagccccagtc

SEQ ID NO: 732347 - DNA, 20 bp, Artificial
  CRISPR gRNA sequence
gggaggagcagccccagtca

SEQ ID NO: 732348 - DNA, 20 bp, Artificial
  CRISPR gRNA sequence
aggagcagccccagtcaggg

SEQ ID NO: 732349 - DNA, 20 bp, Artificial
  CRISPR gRNA sequence
ggagcagccccagtcagggc

SEQ ID NO: 732350 - DNA, 20 bp, Artificial
  CRISPR gRNA sequence
gagcagccccagtcagggca

SEQ ID NO: 732351 - DNA, 20 bp, Artificial
  CRISPR gRNA sequence
ccagtcagggcagggccatc

SEQ ID NO: 732352 - DNA, 20 bp, Artificial
  CRISPR gRNA sequence
agtcagggcagggccatcca

SEQ ID NO: 732353 - DNA, 20 bp, Artificial
  CRISPR gRNA sequence
gtcagggcagggccatccag

SEQ ID NO: 732354 - DNA, 20 bp, Artificial
  CRISPR gRNA sequence
ggcagggccatccagaggcc

SEQ ID NO: 732355 - DNA, 20 bp, Artificial
  CRISPR gRNA sequence
ggccatccagaggcccagca

SEQ ID NO: 732356 - DNA, 20 bp, Artificial
  CRISPR gRNA sequence
gccatccagaggcccagcaa

SEQ ID NO: 732357 - DNA, 20 bp, Artificial
  CRISPR gRNA sequence
caaaggacacctgtcccgac

SEQ ID NO: 732358 - DNA, 20 bp, Artificial
  CRISPR gRNA sequence
aaggacacctgtcccgacaa

SEQ ID NO: 732359 - DNA, 20 bp, Artificial
  CRISPR gRNA sequence
gacacctgtcccgacaagag

SEQ ID NO: 732360 - DNA, 20 bp, Artificial
  CRISPR gRNA sequence
agaagctgccaacccctctg

SEQ ID NO: 732361 - DNA, 20 bp, Artificial
  CRISPR gRNA sequence
gaagctgccaacccctctgt

SEQ ID NO: 732362 - DNA, 20 bp, Artificial
  CRISPR gRNA sequence
ccaacccctctgtgggtccc

SEQ ID NO: 732363 - DNA, 20 bp, Artificial
  CRISPR gRNA sequence
ctctgtgggtccccagcttt

SEQ ID NO: 732364 - DNA, 20 bp, Artificial
  CRISPR gRNA sequence
agtcactgtttcctctcctc

SEQ ID NO: 732365 - DNA, 20 bp, Artificial
  CRISPR gRNA sequence
gtcactgtttcctctcctcc

SEQ ID NO: 732366 - DNA, 20 bp, Artificial
  CRISPR gRNA sequence
ctgtttcctctcctccagga

SEQ ID NO: 732367 - DNA, 20 bp, Artificial
  CRISPR gRNA sequence
tgtttcctctcctccaggat

SEQ ID NO: 732368 - DNA, 20 bp, Artificial
  CRISPR gRNA sequence
ggatgggacatcactgcctc

SEQ ID NO: 732369 - DNA, 20 bp, Artificial
  CRISPR gRNA sequence
tcactgcctctggcattcgt

SEQ ID NO: 732370 - DNA, 20 bp, Artificial
  CRISPR gRNA sequence
gattctttcttccctaacct

SEQ ID NO: 732371 - DNA, 20 bp, Artificial
  CRISPR gRNA sequence
attctttcttccctaacctt

SEQ ID NO: 732372 - DNA, 20 bp, Artificial
  CRISPR gRNA sequence
ttctttcttccctaacctta

SEQ ID NO: 732373 - DNA, 20 bp, Artificial
  CRISPR gRNA sequence
tctttcttccctaaccttag

SEQ ID NO: 732374 - DNA, 20 bp, Artificial
  CRISPR gRNA sequence
ttcttccctaaccttagggg

SEQ ID NO: 732375 - DNA, 20 bp, Artificial
  CRISPR gRNA sequence
cctaaccttaggggaagctg

SEQ ID NO: 732376 - DNA, 20 bp, Artificial
  CRISPR gRNA sequence
aaccttaggggaagctgaag

SEQ ID NO: 732377 - DNA, 20 bp, Artificial
  CRISPR gRNA sequence
taggggaagctgaagcagaa

SEQ ID NO: 732378 - DNA, 20 bp, Artificial
  CRISPR gRNA sequence
ggggaagctgaagcagaacg

SEQ ID NO: 732379 - DNA, 20 bp, Artificial
  CRISPR gRNA sequence
gggaagctgaagcagaacgg

SEQ ID NO: 732380 - DNA, 20 bp, Artificial
  CRISPR gRNA sequence
ggaagctgaagcagaacgga

SEQ ID NO: 732381 - DNA, 20 bp, Artificial
  CRISPR gRNA sequence
agctgaagcagaacggaggg

SEQ ID NO: 732382 - DNA, 20 bp, Artificial
  CRISPR gRNA sequence
tgaagcagaacggagggaag

SEQ ID NO: 732383 - DNA, 20 bp, Artificial
  CRISPR gRNA sequence
aagcagaacggagggaagca

SEQ ID NO: 732384 - DNA, 20 bp, Artificial
  CRISPR gRNA sequence
agcagaacggagggaagcag

SEQ ID NO: 732385 - DNA, 20 bp, Artificial
  CRISPR gRNA sequence
acggagggaagcagaggaca

SEQ ID NO: 732386 - DNA, 20 bp, Artificial
  CRISPR gRNA sequence
gagggaagcagaggacacag

SEQ ID NO: 732387 - DNA, 20 bp, Artificial
  CRISPR gRNA sequence
agcagaggacacagtggccc

SEQ ID NO: 732388 - DNA, 20 bp, Artificial
  CRISPR gRNA sequence
agaggacacagtggccctgg

SEQ ID NO: 732389 - DNA, 20 bp, Artificial
  CRISPR gRNA sequence
gaggacacagtggccctggt

SEQ ID NO: 732390 - DNA, 20 bp, Artificial
  CRISPR gRNA sequence
aggacacagtggccctggtg

SEQ ID NO: 732391 - DNA, 20 bp, Artificial
  CRISPR gRNA sequence
gacacagtggccctggtggg

SEQ ID NO: 732392 - DNA, 20 bp, Artificial
  CRISPR gRNA sequence
acacagtggccctggtgggg

SEQ ID NO: 732393 - DNA, 20 bp, Artificial
  CRISPR gRNA sequence
cacagtggccctggtgggga

SEQ ID NO: 732394 - DNA, 20 bp, Artificial
  CRISPR gRNA sequence
agtggccctggtggggaggg

SEQ ID NO: 732395 - DNA, 20 bp, Artificial
  CRISPR gRNA sequence
ccctggtggggagggcagct

SEQ ID NO: 732396 - DNA, 20 bp, Artificial
  CRISPR gRNA sequence
gggagggcagctcagcccaa

SEQ ID NO: 732397 - DNA, 20 bp, Artificial
  CRISPR gRNA sequence
ggagggcagctcagcccaat

SEQ ID NO: 732398 - DNA, 20 bp, Artificial
  CRISPR gRNA sequence
gagggcagctcagcccaata

SEQ ID NO: 732399 - DNA, 20 bp, Artificial
  CRISPR gRNA sequence
ctcagcccaatagggtttct

SEQ ID NO: 732400 - DNA, 20 bp, Artificial
  CRISPR gRNA sequence
tcagcccaatagggtttctg

SEQ ID NO: 732401 - DNA, 20 bp, Artificial
  CRISPR gRNA sequence
gcccaatagggtttctgagg

SEQ ID NO: 732402 - DNA, 20 bp, Artificial
  CRISPR gRNA sequence
aatagggtttctgaggcaga

SEQ ID NO: 732403 - DNA, 20 bp, Artificial
  CRISPR gRNA sequence
atagggtttctgaggcagac

SEQ ID NO: 732404 - DNA, 20 bp, Artificial
  CRISPR gRNA sequence
agggtttctgaggcagacgg

SEQ ID NO: 732405 - DNA, 20 bp, Artificial
  CRISPR gRNA sequence
ttctgaggcagacgggagct

SEQ ID NO: 732406 - DNA, 20 bp, Artificial
  CRISPR gRNA sequence
tctgaggcagacgggagctg

SEQ ID NO: 732407 - DNA, 20 bp, Artificial
  CRISPR gRNA sequence
gagctgaggttctctgtaaa

SEQ ID NO: 732408 - DNA, 20 bp, Artificial
  CRISPR gRNA sequence
ttctctgtaaacagcactct

SEQ ID NO: 732409 - DNA, 20 bp, Artificial
  CRISPR gRNA sequence
tctctgtaaacagcactctc

SEQ ID NO: 732410 - DNA, 20 bp, Artificial
  CRISPR gRNA sequence
ctctgtaaacagcactctca

SEQ ID NO: 732411 - DNA, 20 bp, Artificial
  CRISPR gRNA sequence
agggttcccctgcctccacc

SEQ ID NO: 732412 - DNA, 20 bp, Artificial
  CRISPR gRNA sequence
ggttcccctgcctccaccaa

SEQ ID NO: 732413 - DNA, 20 bp, Artificial
  CRISPR gRNA sequence
cctgcctccaccaagagccc

SEQ ID NO: 732414 - DNA, 20 bp, Artificial
  CRISPR gRNA sequence
ctgcctccaccaagagccct

SEQ ID NO: 732415 - DNA, 20 bp, Artificial
  CRISPR gRNA sequence
tgcctccaccaagagccctg

SEQ ID NO: 732416 - DNA, 20 bp, Artificial
  CRISPR gRNA sequence
accaagagccctggggtctg

SEQ ID NO: 732417 - DNA, 20 bp, Artificial
  CRISPR gRNA sequence
gccctggggtctgcagctcc

SEQ ID NO: 732418 - DNA, 20 bp, Artificial
  CRISPR gRNA sequence
ctggggtctgcagctccgag

SEQ ID NO: 732419 - DNA, 20 bp, Artificial
  CRISPR gRNA sequence
cagctccgagcagaaaccac

SEQ ID NO: 732420 - DNA, 20 bp, Artificial
  CRISPR gRNA sequence
aaccactggtcacatttcct

SEQ ID NO: 732421 - DNA, 20 bp, Artificial
  CRISPR gRNA sequence
accactggtcacatttcctc

SEQ ID NO: 732422 - DNA, 20 bp, Artificial
  CRISPR gRNA sequence
ctccctgatgccctttgctc

SEQ ID NO: 732423 - DNA, 20 bp, Artificial
  CRISPR gRNA sequence
tccctgatgccctttgctct

SEQ ID NO: 732424 - DNA, 20 bp, Artificial
  CRISPR gRNA sequence
ctttgctctgggcccctccc

SEQ ID NO: 732425 - DNA, 20 bp, Artificial
  CRISPR gRNA sequence
tttgctctgggcccctcccc

SEQ ID NO: 732426 - DNA, 20 bp, Artificial
  CRISPR gRNA sequence
ctccccaggttcctgccccc

SEQ ID NO: 732427 - DNA, 20 bp, Artificial
  CRISPR gRNA sequence
tccccaggttcctgccccca

SEQ ID NO: 732428 - DNA, 20 bp, Artificial
  CRISPR gRNA sequence
cccaggttcctgcccccaag

SEQ ID NO: 732429 - DNA, 20 bp, Artificial
  CRISPR gRNA sequence
cctgcccccaaggagaacac

SEQ ID NO: 732430 - DNA, 20 bp, Artificial
  CRISPR gRNA sequence
ctgcccccaaggagaacact

SEQ ID NO: 732431 - DNA, 20 bp, Artificial
  CRISPR gRNA sequence
ccaaggagaacactgggctg

SEQ ID NO: 732432 - DNA, 20 bp, Artificial
  CRISPR gRNA sequence
caaggagaacactgggctgt

SEQ ID NO: 732433 - DNA, 20 bp, Artificial
  CRISPR gRNA sequence
aaggagaacactgggctgtg

SEQ ID NO: 732434 - DNA, 20 bp, Artificial
  CRISPR gRNA sequence
cactgggctgtggggctgct

SEQ ID NO: 732435 - DNA, 20 bp, Artificial
  CRISPR gRNA sequence
actgggctgtggggctgctt

SEQ ID NO: 732436 - DNA, 20 bp, Artificial
  CRISPR gRNA sequence
ggctgtggggctgcttagga

SEQ ID NO: 732437 - DNA, 20 bp, Artificial
  CRISPR gRNA sequence
tgtggggctgcttaggatgg

SEQ ID NO: 732438 - DNA, 20 bp, Artificial
  CRISPR gRNA sequence
ctgcttaggatggcagcctc

SEQ ID NO: 732439 - DNA, 20 bp, Artificial
  CRISPR gRNA sequence
tgcttaggatggcagcctct

SEQ ID NO: 732440 - DNA, 20 bp, Artificial
  CRISPR gRNA sequence
aggatggcagcctctgggtt

SEQ ID NO: 732441 - DNA, 20 bp, Artificial
  CRISPR gRNA sequence
ggatggcagcctctgggttt

SEQ ID NO: 732442 - DNA, 20 bp, Artificial
  CRISPR gRNA sequence
tggcagcctctgggtttggg

SEQ ID NO: 732443 - DNA, 20 bp, Artificial
  CRISPR gRNA sequence
cctctgggtttgggaagtcc

SEQ ID NO: 732444 - DNA, 20 bp, Artificial
  CRISPR gRNA sequence
ctctgggtttgggaagtcct

SEQ ID NO: 732445 - DNA, 20 bp, Artificial
  CRISPR gRNA sequence
gggtttgggaagtcctgggt

SEQ ID NO: 732446 - DNA, 20 bp, Artificial
  CRISPR gRNA sequence
tgggaagtcctgggtgagtc

SEQ ID NO: 732447 - DNA, 20 bp, Artificial
  CRISPR gRNA sequence
gggtgagtccagcactgcac

SEQ ID NO: 732448 - DNA, 20 bp, Artificial
  CRISPR gRNA sequence
ccagcactgcacaagtcctc

SEQ ID NO: 732449 - DNA, 20 bp, Artificial
  CRISPR gRNA sequence
cacaagtcctccagcttcat

SEQ ID NO: 732450 - DNA, 20 bp, Artificial
  CRISPR gRNA sequence
cagcttcataagatcgatac

SEQ ID NO: 732451 - DNA, 20 bp, Artificial
  CRISPR gRNA sequence
tcacccctcctctaaccccc

SEQ ID NO: 732452 - DNA, 20 bp, Artificial
  CRISPR gRNA sequence
cacccctcctctaaccccct

SEQ ID NO: 732453 - DNA, 20 bp, Artificial
  CRISPR gRNA sequence
acccctcctctaaccccctg

SEQ ID NO: 732454 - DNA, 20 bp, Artificial
  CRISPR gRNA sequence
ctaaccccctggggccactc

SEQ ID NO: 732455 - DNA, 20 bp, Artificial
  CRISPR gRNA sequence
taaccccctggggccactct

SEQ ID NO: 732456 - DNA, 20 bp, Artificial
  CRISPR gRNA sequence
accccctggggccactctgg

SEQ ID NO: 732457 - DNA, 20 bp, Artificial
  CRISPR gRNA sequence
ccctggggccactctgggag

SEQ ID NO: 732458 - DNA, 20 bp, Artificial
  CRISPR gRNA sequence
aagctccccaccccatgctt

SEQ ID NO: 732459 - DNA, 20 bp, Artificial
  CRISPR gRNA sequence
ctccccaccccatgcttaag

SEQ ID NO: 732460 - DNA, 20 bp, Artificial
  CRISPR gRNA sequence
accccatgcttaagtggcct

SEQ ID NO: 732461 - DNA, 20 bp, Artificial
  CRISPR gRNA sequence
tgcttaagtggcctcagatc

SEQ ID NO: 732462 - DNA, 20 bp, Artificial
  CRISPR gRNA sequence
ttaagtggcctcagatcaag

SEQ ID NO: 732463 - DNA, 20 bp, Artificial
  CRISPR gRNA sequence
agatcaagtagacttccaca

SEQ ID NO: 732464 - DNA, 20 bp, Artificial
  CRISPR gRNA sequence
gatcaagtagacttccacat

SEQ ID NO: 732465 - DNA, 20 bp, Artificial
  CRISPR gRNA sequence
atcaagtagacttccacata

SEQ ID NO: 732466 - DNA, 20 bp, Artificial
  CRISPR gRNA sequence
tagacttccacatagggctc

SEQ ID NO: 732467 - DNA, 20 bp, Artificial
  CRISPR gRNA sequence
cacatagggctctggtcttc

SEQ ID NO: 732468 - DNA, 20 bp, Artificial
  CRISPR gRNA sequence
acatagggctctggtcttcc

SEQ ID NO: 732469 - DNA, 20 bp, Artificial
  CRISPR gRNA sequence
tagggctctggtcttccagg

SEQ ID NO: 732470 - DNA, 20 bp, Artificial
  CRISPR gRNA sequence
agggctctggtcttccaggt

SEQ ID NO: 732471 - DNA, 20 bp, Artificial
  CRISPR gRNA sequence
tcttccaggtgggtcacgtg

SEQ ID NO: 732472 - DNA, 20 bp, Artificial
  CRISPR gRNA sequence
tccaggtgggtcacgtgtag

SEQ ID NO: 732473 - DNA, 20 bp, Artificial
  CRISPR gRNA sequence
ccaggtgggtcacgtgtaga

SEQ ID NO: 732474 - DNA, 20 bp, Artificial
  CRISPR gRNA sequence
aaggatcgctgcacatgctg

SEQ ID NO: 732475 - DNA, 20 bp, Artificial
  CRISPR gRNA sequence
ctgcacatgctgtagcctgc

SEQ ID NO: 732476 - DNA, 20 bp, Artificial
  CRISPR gRNA sequence
atgctgtagcctgcaagaaa

SEQ ID NO: 732477 - DNA, 20 bp, Artificial
  CRISPR gRNA sequence
tgctgtagcctgcaagaaac

SEQ ID NO: 732478 - DNA, 20 bp, Artificial
  CRISPR gRNA sequence
gctgtagcctgcaagaaaca

SEQ ID NO: 732479 - DNA, 20 bp, Artificial
  CRISPR gRNA sequence
tgtagcctgcaagaaacagg

SEQ ID NO: 732480 - DNA, 20 bp, Artificial
  CRISPR gRNA sequence
tagcctgcaagaaacaggga

SEQ ID NO: 732481 - DNA, 20 bp, Artificial
  CRISPR gRNA sequence
tgcaagaaacagggagagct

SEQ ID NO: 732482 - DNA, 20 bp, Artificial
  CRISPR gRNA sequence
gcaagaaacagggagagctg

SEQ ID NO: 732483 - DNA, 20 bp, Artificial
  CRISPR gRNA sequence
agaaacagggagagctgagg

SEQ ID NO: 732484 - DNA, 20 bp, Artificial
  CRISPR gRNA sequence
gaagtgtcctgccctgccca

SEQ ID NO: 732485 - DNA, 20 bp, Artificial
  CRISPR gRNA sequence
gtgccccgatgctcctccac

SEQ ID NO: 732486 - DNA, 20 bp, Artificial
  CRISPR gRNA sequence
cgatgctcctccaccagccc

SEQ ID NO: 732487 - DNA, 20 bp, Artificial
  CRISPR gRNA sequence
caccagccccagcccctttc

SEQ ID NO: 732488 - DNA, 20 bp, Artificial
  CRISPR gRNA sequence
cccctttctggctctgcctc

SEQ ID NO: 732489 - DNA, 20 bp, Artificial
  CRISPR gRNA sequence
gctctgcctctggttccttc

SEQ ID NO: 732490 - DNA, 20 bp, Artificial
  CRISPR gRNA sequence
ctctgcctctggttccttcc

SEQ ID NO: 732491 - DNA, 20 bp, Artificial
  CRISPR gRNA sequence
ttccttccaggtcatcccct

SEQ ID NO: 732492 - DNA, 20 bp, Artificial
  CRISPR gRNA sequence
tccttccaggtcatcccctt

SEQ ID NO: 732493 - DNA, 20 bp, Artificial
  CRISPR gRNA sequence
ccttccaggtcatcccctta

SEQ ID NO: 732494 - DNA, 20 bp, Artificial
  CRISPR gRNA sequence
tcatccccttagggttgtgc

SEQ ID NO: 732495 - DNA, 20 bp, Artificial
  CRISPR gRNA sequence
catccccttagggttgtgct

SEQ ID NO: 732496 - DNA, 20 bp, Artificial
  CRISPR gRNA sequence
ccccttagggttgtgctggg

SEQ ID NO: 732497 - DNA, 20 bp, Artificial
  CRISPR gRNA sequence
tgtgctgggtggtctccgcc

SEQ ID NO: 732498 - DNA, 20 bp, Artificial
  CRISPR gRNA sequence
cgcctggccgccctcctccc

SEQ ID NO: 732499 - DNA, 20 bp, Artificial
  CRISPR gRNA sequence
gcctggccgccctcctcccc

SEQ ID NO: 732500 - DNA, 20 bp, Artificial
  CRISPR gRNA sequence
tggccgccctcctccccagg

SEQ ID NO: 732501 - DNA, 20 bp, Artificial
  CRISPR gRNA sequence
ccgccctcctccccaggtgg

SEQ ID NO: 732502 - DNA, 20 bp, Artificial
  CRISPR gRNA sequence
ctccccaggtggaagcgtca

SEQ ID NO: 732503 - DNA, 20 bp, Artificial
  CRISPR gRNA sequence
agcgtcatagtccttttgac

SEQ ID NO: 732504 - DNA, 20 bp, Artificial
  CRISPR gRNA sequence
atagtccttttgactggaca

SEQ ID NO: 732505 - DNA, 20 bp, Artificial
  CRISPR gRNA sequence
tagtccttttgactggacac

SEQ ID NO: 732506 - DNA, 20 bp, Artificial
  CRISPR gRNA sequence
cttttgactggacacaggcc

SEQ ID NO: 732507 - DNA, 20 bp, Artificial
  CRISPR gRNA sequence
ttttgactggacacaggcca

SEQ ID NO: 732508 - DNA, 20 bp, Artificial
  CRISPR gRNA sequence
tttgactggacacaggccaa

SEQ ID NO: 732509 - DNA, 20 bp, Artificial
  CRISPR gRNA sequence
aggccaagggccataccacg

SEQ ID NO: 732510 - DNA, 20 bp, Artificial
  CRISPR gRNA sequence
ggccaagggccataccacgt

SEQ ID NO: 732511 - DNA, 20 bp, Artificial
  CRISPR gRNA sequence
gccaagggccataccacgtg

SEQ ID NO: 732512 - DNA, 20 bp, Artificial
  CRISPR gRNA sequence
gccataccacgtggggactc

SEQ ID NO: 732513 - DNA, 20 bp, Artificial
  CRISPR gRNA sequence
ccataccacgtggggactcg

SEQ ID NO: 732514 - DNA, 20 bp, Artificial
  CRISPR gRNA sequence
ggactcgaggtcataaccct

SEQ ID NO: 732515 - DNA, 20 bp, Artificial
  CRISPR gRNA sequence
cgaggtcataacccttagtg

SEQ ID NO: 732516 - DNA, 20 bp, Artificial
  CRISPR gRNA sequence
taacccttagtgcagttacc

SEQ ID NO: 732517 - DNA, 20 bp, Artificial
  CRISPR gRNA sequence
acccttagtgcagttaccca

SEQ ID NO: 732518 - DNA, 20 bp, Artificial
  CRISPR gRNA sequence
gttacccagagctctgccct

SEQ ID NO: 732519 - DNA, 20 bp, Artificial
  CRISPR gRNA sequence
ttacccagagctctgccctc

SEQ ID NO: 732520 - DNA, 20 bp, Artificial
  CRISPR gRNA sequence
acccagagctctgccctcag

SEQ ID NO: 732521 - DNA, 20 bp, Artificial
  CRISPR gRNA sequence
cccagagctctgccctcagg

SEQ ID NO: 732522 - DNA, 20 bp, Artificial
  CRISPR gRNA sequence
gagctctgccctcaggaggc

SEQ ID NO: 732523 - DNA, 20 bp, Artificial
  CRISPR gRNA sequence
agctctgccctcaggaggct

SEQ ID NO: 732524 - DNA, 20 bp, Artificial
  CRISPR gRNA sequence
ctctgccctcaggaggctgg

SEQ ID NO: 732525 - DNA, 20 bp, Artificial
  CRISPR gRNA sequence
tctgccctcaggaggctggg

SEQ ID NO: 732526 - DNA, 20 bp, Artificial
  CRISPR gRNA sequence
gccctcaggaggctgggagg

SEQ ID NO: 732527 - DNA, 20 bp, Artificial
  CRISPR gRNA sequence
ccctcaggaggctgggaggt

SEQ ID NO: 732528 - DNA, 20 bp, Artificial
  CRISPR gRNA sequence
gtctcttcttccaaaaccca

SEQ ID NO: 732529 - DNA, 20 bp, Artificial
  CRISPR gRNA sequence
caaaacccatagaccatgat

SEQ ID NO: 732530 - DNA, 20 bp, Artificial
  CRISPR gRNA sequence
ccatagaccatgatcagcat

SEQ ID NO: 732531 - DNA, 20 bp, Artificial
  CRISPR gRNA sequence
accatgatcagcatcagcac

SEQ ID NO: 732532 - DNA, 20 bp, Artificial
  CRISPR gRNA sequence
ccatgatcagcatcagcacc

SEQ ID NO: 732533 - DNA, 20 bp, Artificial
  CRISPR gRNA sequence
atgatcagcatcagcaccag

SEQ ID NO: 732534 - DNA, 20 bp, Artificial
  CRISPR gRNA sequence
tgatcagcatcagcaccagg

SEQ ID NO: 732535 - DNA, 20 bp, Artificial
  CRISPR gRNA sequence
gatcagcatcagcaccagga

SEQ ID NO: 732536 - DNA, 20 bp, Artificial
  CRISPR gRNA sequence
agcatcagcaccaggagggt

SEQ ID NO: 732537 - DNA, 20 bp, Artificial
  CRISPR gRNA sequence
aggagggtcagcaccacccc

SEQ ID NO: 732538 - DNA, 20 bp, Artificial
  CRISPR gRNA sequence
ggtcagcaccaccccaagca

SEQ ID NO: 732539 - DNA, 20 bp, Artificial
  CRISPR gRNA sequence
cagcaccaccccaagcacag

SEQ ID NO: 732540 - DNA, 20 bp, Artificial
  CRISPR gRNA sequence
gcaccaccccaagcacagtg

SEQ ID NO: 732541 - DNA, 20 bp, Artificial
  CRISPR gRNA sequence
gcacagtggagtaaacatcc

SEQ ID NO: 732542 - DNA, 20 bp, Artificial
  CRISPR gRNA sequence
gagtaaacatcctggtgcct

SEQ ID NO: 732543 - DNA, 20 bp, Artificial
  CRISPR gRNA sequence
taaacatcctggtgcctgag

SEQ ID NO: 732544 - DNA, 20 bp, Artificial
  CRISPR gRNA sequence
acatcctggtgcctgagaag

SEQ ID NO: 732545 - DNA, 20 bp, Artificial
  CRISPR gRNA sequence
catcctggtgcctgagaaga

SEQ ID NO: 732546 - DNA, 20 bp, Artificial
  CRISPR gRNA sequence
atcctggtgcctgagaagaa

SEQ ID NO: 732547 - DNA, 20 bp, Artificial
  CRISPR gRNA sequence
tggtgcctgagaagaaggga

SEQ ID NO: 732548 - DNA, 20 bp, Artificial
  CRISPR gRNA sequence
ggtgcctgagaagaagggac

SEQ ID NO: 732549 - DNA, 20 bp, Artificial
  CRISPR gRNA sequence
gtgcctgagaagaagggaca

SEQ ID NO: 732550 - DNA, 20 bp, Artificial
  CRISPR gRNA sequence
cctgagaagaagggacaggg

SEQ ID NO: 732551 - DNA, 20 bp, Artificial
  CRISPR gRNA sequence
gagaagaagggacagggtgg

SEQ ID NO: 732552 - DNA, 20 bp, Artificial
  CRISPR gRNA sequence
aagaagggacagggtggaag

SEQ ID NO: 732553 - DNA, 20 bp, Artificial
  CRISPR gRNA sequence
agaagggacagggtggaagc

SEQ ID NO: 732554 - DNA, 20 bp, Artificial
  CRISPR gRNA sequence
gggacagggtggaagcgggt

SEQ ID NO: 732555 - DNA, 20 bp, Artificial
  CRISPR gRNA sequence
ggtggaagcgggtgagcacc

SEQ ID NO: 732556 - DNA, 20 bp, Artificial
  CRISPR gRNA sequence
gtggaagcgggtgagcacca

SEQ ID NO: 732557 - DNA, 20 bp, Artificial
  CRISPR gRNA sequence
tcccccatcctaacccacgt

SEQ ID NO: 732558 - DNA, 20 bp, Artificial
  CRISPR gRNA sequence
cccccatcctaacccacgtt

SEQ ID NO: 732559 - DNA, 20 bp, Artificial
  CRISPR gRNA sequence
atcctaacccacgttgggat

SEQ ID NO: 732560 - DNA, 20 bp, Artificial
  CRISPR gRNA sequence
aacccacgttgggatcggac

SEQ ID NO: 732561 - DNA, 20 bp, Artificial
  CRISPR gRNA sequence
ccacgttgggatcggaccag

SEQ ID NO: 732562 - DNA, 20 bp, Artificial
  CRISPR gRNA sequence
cgttgggatcggaccagcag

SEQ ID NO: 732563 - DNA, 20 bp, Artificial
  CRISPR gRNA sequence
ggaccagcagcagaaaccct

SEQ ID NO: 732564 - DNA, 20 bp, Artificial
  CRISPR gRNA sequence
accagcagcagaaaccctga

SEQ ID NO: 732565 - DNA, 20 bp, Artificial
  CRISPR gRNA sequence
ccctgagagcgtgcccttcc

SEQ ID NO: 732566 - DNA, 20 bp, Artificial
  CRISPR gRNA sequence
cctgagagcgtgcccttccc

SEQ ID NO: 732567 - DNA, 20 bp, Artificial
  CRISPR gRNA sequence
ctgagagcgtgcccttcccg

SEQ ID NO: 732568 - DNA, 20 bp, Artificial
  CRISPR gRNA sequence
agagcgtgcccttcccgggg

SEQ ID NO: 732569 - DNA, 20 bp, Artificial
  CRISPR gRNA sequence
cgtgcccttcccggggtaga

SEQ ID NO: 732570 - DNA, 20 bp, Artificial
  CRISPR gRNA sequence
gacggccaccctcttcctta

SEQ ID NO: 732571 - DNA, 20 bp, Artificial
  CRISPR gRNA sequence
caccctcttccttacagacc

SEQ ID NO: 732572 - DNA, 20 bp, Artificial
  CRISPR gRNA sequence
cttccttacagacccggcca

SEQ ID NO: 732573 - DNA, 20 bp, Artificial
  CRISPR gRNA sequence
ccttacagacccggccacag

SEQ ID NO: 732574 - DNA, 20 bp, Artificial
  CRISPR gRNA sequence
acagacccggccacagaagc

SEQ ID NO: 732575 - DNA, 20 bp, Artificial
  CRISPR gRNA sequence
acagaagcaagtgtgacatc

SEQ ID NO: 732576 - DNA, 20 bp, Artificial
  CRISPR gRNA sequence
agaagcaagtgtgacatccg

SEQ ID NO: 732577 - DNA, 20 bp, Artificial
  CRISPR gRNA sequence
caagtgtgacatccggagtt

SEQ ID NO: 732578 - DNA, 20 bp, Artificial
  CRISPR gRNA sequence
agtgtgacatccggagttaa

SEQ ID NO: 732579 - DNA, 20 bp, Artificial
  CRISPR gRNA sequence
gtgtgacatccggagttaag

SEQ ID NO: 732580 - DNA, 20 bp, Artificial
  CRISPR gRNA sequence
gtgacatccggagttaagag

SEQ ID NO: 732581 - DNA, 20 bp, Artificial
  CRISPR gRNA sequence
tgacatccggagttaagagg

SEQ ID NO: 732582 - DNA, 20 bp, Artificial
  CRISPR gRNA sequence
agttaagaggaggacgtccc

SEQ ID NO: 732583 - DNA, 20 bp, Artificial
  CRISPR gRNA sequence
gttaagaggaggacgtcccc

SEQ ID NO: 732584 - DNA, 20 bp, Artificial
  CRISPR gRNA sequence
aagaggaggacgtccccagg

SEQ ID NO: 732585 - DNA, 20 bp, Artificial
  CRISPR gRNA sequence
gaggaggacgtccccaggta

SEQ ID NO: 732586 - DNA, 20 bp, Artificial
  CRISPR gRNA sequence
aggaggacgtccccaggtag

SEQ ID NO: 732587 - DNA, 20 bp, Artificial
  CRISPR gRNA sequence
ggaggacgtccccaggtaga

SEQ ID NO: 732588 - DNA, 20 bp, Artificial
  CRISPR gRNA sequence
gaggacgtccccaggtagag

SEQ ID NO: 732589 - DNA, 20 bp, Artificial
  CRISPR gRNA sequence
aggggaacatctctctactt

SEQ ID NO: 732590 - DNA, 20 bp, Artificial
  CRISPR gRNA sequence
atgcccccaaatctgttcat

SEQ ID NO: 732591 - DNA, 20 bp, Artificial
  CRISPR gRNA sequence
ccccaaatctgttcatcagt

SEQ ID NO: 732592 - DNA, 20 bp, Artificial
  CRISPR gRNA sequence
cccaaatctgttcatcagtg

SEQ ID NO: 732593 - DNA, 20 bp, Artificial
  CRISPR gRNA sequence
atctgttcatcagtgaggat

SEQ ID NO: 732594 - DNA, 20 bp, Artificial
  CRISPR gRNA sequence
tctgttcatcagtgaggatg

SEQ ID NO: 732595 - DNA, 20 bp, Artificial
  CRISPR gRNA sequence
atcagtgaggatgaggattc

SEQ ID NO: 732596 - DNA, 20 bp, Artificial
  CRISPR gRNA sequence
tcagtgaggatgaggattct

SEQ ID NO: 732597 - DNA, 20 bp, Artificial
  CRISPR gRNA sequence
agtgaggatgaggattctag

SEQ ID NO: 732598 - DNA, 20 bp, Artificial
  CRISPR gRNA sequence
ttctaggagactcccatttg

SEQ ID NO: 732599 - DNA, 20 bp, Artificial
  CRISPR gRNA sequence
gagactcccatttgtggcta

SEQ ID NO: 732600 - DNA, 20 bp, Artificial
  CRISPR gRNA sequence
gactcccatttgtggctaaa

SEQ ID NO: 732601 - DNA, 20 bp, Artificial
  CRISPR gRNA sequence
catttgtggctaaagagatc

SEQ ID NO: 732602 - DNA, 20 bp, Artificial
  CRISPR gRNA sequence
tcaagatgcttgctctcctc

SEQ ID NO: 732603 - DNA, 20 bp, Artificial
  CRISPR gRNA sequence
caagatgcttgctctcctca

SEQ ID NO: 732604 - DNA, 20 bp, Artificial
  CRISPR gRNA sequence
aagatgcttgctctcctcaa

SEQ ID NO: 732605 - DNA, 20 bp, Artificial
  CRISPR gRNA sequence
agatgcttgctctcctcaag

SEQ ID NO: 732606 - DNA, 20 bp, Artificial
  CRISPR gRNA sequence
ttgctctcctcaaggggtct

SEQ ID NO: 732607 - DNA, 20 bp, Artificial
  CRISPR gRNA sequence
tgctctcctcaaggggtctg

SEQ ID NO: 732608 - DNA, 20 bp, Artificial
  CRISPR gRNA sequence
ttcccccactctatcctctg

SEQ ID NO: 732609 - DNA, 20 bp, Artificial
  CRISPR gRNA sequence
ccccactctatcctctgtag

SEQ ID NO: 732610 - DNA, 20 bp, Artificial
  CRISPR gRNA sequence
tcctctgtagcagatgctgt

SEQ ID NO: 732611 - DNA, 20 bp, Artificial
  CRISPR gRNA sequence
cctctgtagcagatgctgtc

SEQ ID NO: 732612 - DNA, 20 bp, Artificial
  CRISPR gRNA sequence
tttccacctgcacacatcat

SEQ ID NO: 732613 - DNA, 20 bp, Artificial
  CRISPR gRNA sequence
catcagcacctccttttctg

SEQ ID NO: 732614 - DNA, 20 bp, Artificial
  CRISPR gRNA sequence
atcagcacctccttttctgt

SEQ ID NO: 732615 - DNA, 20 bp, Artificial
  CRISPR gRNA sequence
agcacctccttttctgtggg

SEQ ID NO: 732616 - DNA, 20 bp, Artificial
  CRISPR gRNA sequence
gcacctccttttctgtgggt

SEQ ID NO: 732617 - DNA, 20 bp, Artificial
  CRISPR gRNA sequence
acctccttttctgtgggtgg

SEQ ID NO: 732618 - DNA, 20 bp, Artificial
  CRISPR gRNA sequence
cctccttttctgtgggtggg

SEQ ID NO: 732619 - DNA, 20 bp, Artificial
  CRISPR gRNA sequence
ttttctgtgggtgggaggct

SEQ ID NO: 732620 - DNA, 20 bp, Artificial
  CRISPR gRNA sequence
tttctgtgggtgggaggctg

SEQ ID NO: 732621 - DNA, 20 bp, Artificial
  CRISPR gRNA sequence
tgaggcctttctcttgtcac

SEQ ID NO: 732622 - DNA, 20 bp, Artificial
  CRISPR gRNA sequence
aggcctttctcttgtcacta

SEQ ID NO: 732623 - DNA, 20 bp, Artificial
  CRISPR gRNA sequence
agagccctctatgccacaca

SEQ ID NO: 732624 - DNA, 20 bp, Artificial
  CRISPR gRNA sequence
gccctctatgccacacacag

SEQ ID NO: 732625 - DNA, 20 bp, Artificial
  CRISPR gRNA sequence
ccctctatgccacacacagc

SEQ ID NO: 732626 - DNA, 20 bp, Artificial
  CRISPR gRNA sequence
tctatgccacacacagcagg

SEQ ID NO: 732627 - DNA, 20 bp, Artificial
  CRISPR gRNA sequence
gccctctactgataaccaat

SEQ ID NO: 732628 - DNA, 20 bp, Artificial
  CRISPR gRNA sequence
cctctactgataaccaattg

SEQ ID NO: 732629 - DNA, 20 bp, Artificial
  CRISPR gRNA sequence
tactgataaccaattggagt

SEQ ID NO: 732630 - DNA, 20 bp, Artificial
  CRISPR gRNA sequence
ggagttggtgtgtaactatg

SEQ ID NO: 732631 - DNA, 20 bp, Artificial
  CRISPR gRNA sequence
gagttggtgtgtaactatgc

SEQ ID NO: 732632 - DNA, 20 bp, Artificial
  CRISPR gRNA sequence
atgcgggctcctttgccctt

SEQ ID NO: 732633 - DNA, 20 bp, Artificial
  CRISPR gRNA sequence
ttcagatgtgtgttttatgc

SEQ ID NO: 732634 - DNA, 20 bp, Artificial
  CRISPR gRNA sequence
ctagatctgactctccccgt

SEQ ID NO: 732635 - DNA, 20 bp, Artificial
  CRISPR gRNA sequence
tagatctgactctccccgtt

SEQ ID NO: 732636 - DNA, 20 bp, Artificial
  CRISPR gRNA sequence
ctgactctccccgttgggat

SEQ ID NO: 732637 - DNA, 20 bp, Artificial
  CRISPR gRNA sequence
tgactctccccgttgggatt

SEQ ID NO: 732638 - DNA, 20 bp, Artificial
  CRISPR gRNA sequence
gattaggctcttgttgtgca

SEQ ID NO: 732639 - DNA, 20 bp, Artificial
  CRISPR gRNA sequence
taggctcttgttgtgcacag

SEQ ID NO: 732640 - DNA, 20 bp, Artificial
  CRISPR gRNA sequence
tgttgtgcacagcagctgct

SEQ ID NO: 732641 - DNA, 20 bp, Artificial
  CRISPR gRNA sequence
tgcacagcagctgcttggtt

SEQ ID NO: 732642 - DNA, 20 bp, Artificial
  CRISPR gRNA sequence
cttggttaagtactctttat

SEQ ID NO: 732643 - DNA, 20 bp, Artificial
  CRISPR gRNA sequence
tggttaagtactctttatta

SEQ ID NO: 732644 - DNA, 20 bp, Artificial
  CRISPR gRNA sequence
ggttaagtactctttattag

SEQ ID NO: 732645 - DNA, 20 bp, Artificial
  CRISPR gRNA sequence
ccactcccccaccttttttc

SEQ ID NO: 732646 - DNA, 20 bp, Artificial
  CRISPR gRNA sequence
cttttttccagtgttcatat

SEQ ID NO: 732647 - DNA, 20 bp, Artificial
  CRISPR gRNA sequence
taagacgcaaatccctgact

SEQ ID NO: 732648 - DNA, 20 bp, Artificial
  CRISPR gRNA sequence
agacgcaaatccctgactca

SEQ ID NO: 732649 - DNA, 20 bp, Artificial
  CRISPR gRNA sequence
gcaaatccctgactcagagt

SEQ ID NO: 732650 - DNA, 20 bp, Artificial
  CRISPR gRNA sequence
tgactcagagtcagtttctc

SEQ ID NO: 732651 - DNA, 20 bp, Artificial
  CRISPR gRNA sequence
actcagagtcagtttctcta

SEQ ID NO: 732652 - DNA, 20 bp, Artificial
  CRISPR gRNA sequence
ctcagagtcagtttctctag

SEQ ID NO: 732653 - DNA, 20 bp, Artificial
  CRISPR gRNA sequence
ctctagaggaatccaaatta

SEQ ID NO: 732654 - DNA, 20 bp, Artificial
  CRISPR gRNA sequence
ttttccacttcctactccat

SEQ ID NO: 732655 - DNA, 20 bp, Artificial
  CRISPR gRNA sequence
tttccacttcctactccatg

SEQ ID NO: 732656 - DNA, 20 bp, Artificial
  CRISPR gRNA sequence
caccctctcctctccatcca

SEQ ID NO: 732657 - DNA, 20 bp, Artificial
  CRISPR gRNA sequence
ctctccatccacagacactt

SEQ ID NO: 732658 - DNA, 20 bp, Artificial
  CRISPR gRNA sequence
tctccatccacagacacttc

SEQ ID NO: 732659 - DNA, 20 bp, Artificial
  CRISPR gRNA sequence
tctctgactctcatcccccc

SEQ ID NO: 732660 - DNA, 20 bp, Artificial
  CRISPR gRNA sequence
gccccctaccctcatctctg

SEQ ID NO: 732661 - DNA, 20 bp, Artificial
  CRISPR gRNA sequence
cctaatgcccccgactctca

SEQ ID NO: 732662 - DNA, 20 bp, Artificial
  CRISPR gRNA sequence
gccatcctttatgtcacttc

SEQ ID NO: 732663 - DNA, 20 bp, Artificial
  CRISPR gRNA sequence
ccagtcccccacctcacatt

SEQ ID NO: 732664 - DNA, 20 bp, Artificial
  CRISPR gRNA sequence
gtcccccacctcacattcag

SEQ ID NO: 732665 - DNA, 20 bp, Artificial
  CRISPR gRNA sequence
ccccacctcacattcagaag

SEQ ID NO: 732666 - DNA, 20 bp, Artificial
  CRISPR gRNA sequence
cccacctcacattcagaagc

SEQ ID NO: 732667 - DNA, 20 bp, Artificial
  CRISPR gRNA sequence
cattcagaagcaggccacat

SEQ ID NO: 732668 - DNA, 20 bp, Artificial
  CRISPR gRNA sequence
attcagaagcaggccacatt

SEQ ID NO: 732669 - DNA, 20 bp, Artificial
  CRISPR gRNA sequence
agcaggccacattgggttcc

SEQ ID NO: 732670 - DNA, 20 bp, Artificial
  CRISPR gRNA sequence
gcaggccacattgggttcct

SEQ ID NO: 732671 - DNA, 20 bp, Artificial
  CRISPR gRNA sequence
caggccacattgggttcctg

SEQ ID NO: 732672 - DNA, 20 bp, Artificial
  CRISPR gRNA sequence
ggccacattgggttcctggg

SEQ ID NO: 732673 - DNA, 20 bp, Artificial
  CRISPR gRNA sequence
attgggttcctggggagcaa

SEQ ID NO: 732674 - DNA, 20 bp, Artificial
  CRISPR gRNA sequence
ttgggttcctggggagcaaa

SEQ ID NO: 732675 - DNA, 20 bp, Artificial
  CRISPR gRNA sequence
tgggttcctggggagcaaaa

SEQ ID NO: 732676 - DNA, 20 bp, Artificial
  CRISPR gRNA sequence
gggttcctggggagcaaaag

SEQ ID NO: 732677 - DNA, 20 bp, Artificial
  CRISPR gRNA sequence
ttcctggggagcaaaagggg

SEQ ID NO: 732678 - DNA, 20 bp, Artificial
  CRISPR gRNA sequence
tcctggggagcaaaagggga

SEQ ID NO: 732679 - DNA, 20 bp, Artificial
  CRISPR gRNA sequence
ggggagcaaaaggggaaggt

SEQ ID NO: 732680 - DNA, 20 bp, Artificial
  CRISPR gRNA sequence
aaaaggggaaggtcagatat

SEQ ID NO: 732681 - DNA, 20 bp, Artificial
  CRISPR gRNA sequence
agatataagacttgcacctc

SEQ ID NO: 732682 - DNA, 20 bp, Artificial
  CRISPR gRNA sequence
gatataagacttgcacctcc

SEQ ID NO: 732683 - DNA, 20 bp, Artificial
  CRISPR gRNA sequence
cttgcacctccaggtctgtt

SEQ ID NO: 732684 - DNA, 20 bp, Artificial
  CRISPR gRNA sequence
ttgcacctccaggtctgttt

SEQ ID NO: 732685 - DNA, 20 bp, Artificial
  CRISPR gRNA sequence
tccaggtctgtttgggcact

SEQ ID NO: 732686 - DNA, 20 bp, Artificial
  CRISPR gRNA sequence
tctgtttgggcactaagtgc

SEQ ID NO: 732687 - DNA, 20 bp, Artificial
  CRISPR gRNA sequence
gtgctggtgccactcaaccc

SEQ ID NO: 732688 - DNA, 20 bp, Artificial
  CRISPR gRNA sequence
tgctggtgccactcaacccc

SEQ ID NO: 732689 - DNA, 20 bp, Artificial
  CRISPR gRNA sequence
ccactcaaccccaggcccca

SEQ ID NO: 732690 - DNA, 20 bp, Artificial
  CRISPR gRNA sequence
cactcaaccccaggccccac

SEQ ID NO: 732691 - DNA, 20 bp, Artificial
  CRISPR gRNA sequence
caggccccacaggtacctga

SEQ ID NO: 732692 - DNA, 20 bp, Artificial
  CRISPR gRNA sequence
ggccccacaggtacctgatg

SEQ ID NO: 732693 - DNA, 20 bp, Artificial
  CRISPR gRNA sequence
gccccacaggtacctgatgg

SEQ ID NO: 732694 - DNA, 20 bp, Artificial
  CRISPR gRNA sequence
ccccacaggtacctgatgga

SEQ ID NO: 732695 - DNA, 20 bp, Artificial
  CRISPR gRNA sequence
caggtacctgatggagggca

SEQ ID NO: 732696 - DNA, 20 bp, Artificial
  CRISPR gRNA sequence
ggtacctgatggagggcatg

SEQ ID NO: 732697 - DNA, 20 bp, Artificial
  CRISPR gRNA sequence
gtacctgatggagggcatgg

SEQ ID NO: 732698 - DNA, 20 bp, Artificial
  CRISPR gRNA sequence
tacctgatggagggcatgga

SEQ ID NO: 732699 - DNA, 20 bp, Artificial
  CRISPR gRNA sequence
ctgatggagggcatggaggg

SEQ ID NO: 732700 - DNA, 20 bp, Artificial
  CRISPR gRNA sequence
ggcatggagggtagtctgtt

SEQ ID NO: 732701 - DNA, 20 bp, Artificial
  CRISPR gRNA sequence
gcatggagggtagtctgttg

SEQ ID NO: 732702 - DNA, 20 bp, Artificial
  CRISPR gRNA sequence
atggagggtagtctgttgag

SEQ ID NO: 732703 - DNA, 20 bp, Artificial
  CRISPR gRNA sequence
ggagggtagtctgttgagga

SEQ ID NO: 732704 - DNA, 20 bp, Artificial
  CRISPR gRNA sequence
tctgttgaggagagatctgc

SEQ ID NO: 732705 - DNA, 20 bp, Artificial
  CRISPR gRNA sequence
ttgaggagagatctgctggt

SEQ ID NO: 732706 - DNA, 20 bp, Artificial
  CRISPR gRNA sequence
tgaggagagatctgctggtg

SEQ ID NO: 732707 - DNA, 20 bp, Artificial
  CRISPR gRNA sequence
ggagagatctgctggtgagg

SEQ ID NO: 732708 - DNA, 20 bp, Artificial
  CRISPR gRNA sequence
agagatctgctggtgaggca

SEQ ID NO: 732709 - DNA, 20 bp, Artificial
  CRISPR gRNA sequence
gctggtgaggcagagccctg

SEQ ID NO: 732710 - DNA, 20 bp, Artificial
  CRISPR gRNA sequence
ggtgaggcagagccctgtgg

SEQ ID NO: 732711 - DNA, 20 bp, Artificial
  CRISPR gRNA sequence
gtgaggcagagccctgtggt

SEQ ID NO: 732712 - DNA, 20 bp, Artificial
  CRISPR gRNA sequence
gagccctgtggtgggcgatc

SEQ ID NO: 732713 - DNA, 20 bp, Artificial
  CRISPR gRNA sequence
gtggtgggcgatctggtgct

SEQ ID NO: 732714 - DNA, 20 bp, Artificial
  CRISPR gRNA sequence
tggtgggcgatctggtgctg

SEQ ID NO: 732715 - DNA, 20 bp, Artificial
  CRISPR gRNA sequence
cgatctggtgctgaggtccc

SEQ ID NO: 732716 - DNA, 20 bp, Artificial
  CRISPR gRNA sequence
ggtgctgaggtccccagact

SEQ ID NO: 732717 - DNA, 20 bp, Artificial
  CRISPR gRNA sequence
gctgaggtccccagacttag

SEQ ID NO: 732718 - DNA, 20 bp, Artificial
  CRISPR gRNA sequence
tgaggtccccagacttagtg

SEQ ID NO: 732719 - DNA, 20 bp, Artificial
  CRISPR gRNA sequence
gtccccagacttagtggaga

SEQ ID NO: 732720 - DNA, 20 bp, Artificial
  CRISPR gRNA sequence
gacttagtggagatggattc

SEQ ID NO: 732721 - DNA, 20 bp, Artificial
  CRISPR gRNA sequence
acttagtggagatggattct

SEQ ID NO: 732722 - DNA, 20 bp, Artificial
  CRISPR gRNA sequence
agtggagatggattctgggc

SEQ ID NO: 732723 - DNA, 20 bp, Artificial
  CRISPR gRNA sequence
ggagatggattctgggccag

SEQ ID NO: 732724 - DNA, 20 bp, Artificial
  CRISPR gRNA sequence
agatggattctgggccagca

SEQ ID NO: 732725 - DNA, 20 bp, Artificial
  CRISPR gRNA sequence
gatggattctgggccagcag

SEQ ID NO: 732726 - DNA, 20 bp, Artificial
  CRISPR gRNA sequence
tggattctgggccagcagag

SEQ ID NO: 732727 - DNA, 20 bp, Artificial
  CRISPR gRNA sequence
tgggccagcagaggagtccc

SEQ ID NO: 732728 - DNA, 20 bp, Artificial
  CRISPR gRNA sequence
agaggagtccctggcattgc

SEQ ID NO: 732729 - DNA, 20 bp, Artificial
  CRISPR gRNA sequence
gaggagtccctggcattgct

SEQ ID NO: 732730 - DNA, 20 bp, Artificial
  CRISPR gRNA sequence
ggagtccctggcattgctgg

SEQ ID NO: 732731 - DNA, 20 bp, Artificial
  CRISPR gRNA sequence
cctggcattgctgggagacg

SEQ ID NO: 732732 - DNA, 20 bp, Artificial
  CRISPR gRNA sequence
tgggagacgcggtcactgtc

SEQ ID NO: 732733 - DNA, 20 bp, Artificial
  CRISPR gRNA sequence
gggagacgcggtcactgtct

SEQ ID NO: 732734 - DNA, 20 bp, Artificial
  CRISPR gRNA sequence
ggtcactgtctgggacccca

SEQ ID NO: 732735 - DNA, 20 bp, Artificial
  CRISPR gRNA sequence
ctgggaccccatggtcctcc

SEQ ID NO: 732736 - DNA, 20 bp, Artificial
  CRISPR gRNA sequence
tgggaccccatggtcctcct

SEQ ID NO: 732737 - DNA, 20 bp, Artificial
  CRISPR gRNA sequence
ccatggtcctcctgggtccc

SEQ ID NO: 732738 - DNA, 20 bp, Artificial
  CRISPR gRNA sequence
ggtcctcctgggtccctggc

SEQ ID NO: 732739 - DNA, 20 bp, Artificial
  CRISPR gRNA sequence
cctcctgggtccctggctgg

SEQ ID NO: 732740 - DNA, 20 bp, Artificial
  CRISPR gRNA sequence
gggtccctggctggtggtgc

SEQ ID NO: 732741 - DNA, 20 bp, Artificial
  CRISPR gRNA sequence
tccctggctggtggtgctgg

SEQ ID NO: 732742 - DNA, 20 bp, Artificial
  CRISPR gRNA sequence
ctggctggtggtgctggtag

SEQ ID NO: 732743 - DNA, 20 bp, Artificial
  CRISPR gRNA sequence
tggtggtgctggtagcagtg

SEQ ID NO: 732744 - DNA, 20 bp, Artificial
  CRISPR gRNA sequence
tgctggtagcagtgaagctg

SEQ ID NO: 732745 - DNA, 20 bp, Artificial
  CRISPR gRNA sequence
agtgaagctgtagcctgtct

SEQ ID NO: 732746 - DNA, 20 bp, Artificial
  CRISPR gRNA sequence
tgaagctgtagcctgtcttg

SEQ ID NO: 732747 - DNA, 20 bp, Artificial
  CRISPR gRNA sequence
gaagctgtagcctgtcttgg

SEQ ID NO: 732748 - DNA, 20 bp, Artificial
  CRISPR gRNA sequence
gctgtagcctgtcttggagg

SEQ ID NO: 732749 - DNA, 20 bp, Artificial
  CRISPR gRNA sequence
ctgtagcctgtcttggaggc

SEQ ID NO: 732750 - DNA, 20 bp, Artificial
  CRISPR gRNA sequence
gcctgtcttggaggcaggtc

SEQ ID NO: 732751 - DNA, 20 bp, Artificial
  CRISPR gRNA sequence
tgtcttggaggcaggtctgg

SEQ ID NO: 732752 - DNA, 20 bp, Artificial
  CRISPR gRNA sequence
tcttggaggcaggtctggtg

SEQ ID NO: 732753 - DNA, 20 bp, Artificial
  CRISPR gRNA sequence
cttggaggcaggtctggtgg

SEQ ID NO: 732754 - DNA, 20 bp, Artificial
  CRISPR gRNA sequence
aggcaggtctggtggaggct

SEQ ID NO: 732755 - DNA, 20 bp, Artificial
  CRISPR gRNA sequence
gcaggtctggtggaggctaa

SEQ ID NO: 732756 - DNA, 20 bp, Artificial
  CRISPR gRNA sequence
tctggtggaggctaagagcc

SEQ ID NO: 732757 - DNA, 20 bp, Artificial
  CRISPR gRNA sequence
ctggtggaggctaagagcct

SEQ ID NO: 732758 - DNA, 20 bp, Artificial
  CRISPR gRNA sequence
tggaggctaagagcctaggc

SEQ ID NO: 732759 - DNA, 20 bp, Artificial
  CRISPR gRNA sequence
ggaggctaagagcctaggca

SEQ ID NO: 732760 - DNA, 20 bp, Artificial
  CRISPR gRNA sequence
aagagcctaggcaaggtgat

SEQ ID NO: 732761 - DNA, 20 bp, Artificial
  CRISPR gRNA sequence
ctaggcaaggtgatgagtcc

SEQ ID NO: 732762 - DNA, 20 bp, Artificial
  CRISPR gRNA sequence
taggcaaggtgatgagtcct

SEQ ID NO: 732763 - DNA, 20 bp, Artificial
  CRISPR gRNA sequence
aggcaaggtgatgagtcctg

SEQ ID NO: 732764 - DNA, 20 bp, Artificial
  CRISPR gRNA sequence
tggggtgaacaccatcacac

SEQ ID NO: 732765 - DNA, 20 bp, Artificial
  CRISPR gRNA sequence
ggtgaacaccatcacaccag

SEQ ID NO: 732766 - DNA, 20 bp, Artificial
  CRISPR gRNA sequence
caccatcacaccagtggtaa

SEQ ID NO: 732767 - DNA, 20 bp, Artificial
  CRISPR gRNA sequence
accatcacaccagtggtaaa

SEQ ID NO: 732768 - DNA, 20 bp, Artificial
  CRISPR gRNA sequence
ccatcacaccagtggtaaaa

SEQ ID NO: 732769 - DNA, 20 bp, Artificial
  CRISPR gRNA sequence
catcacaccagtggtaaaag

SEQ ID NO: 732770 - DNA, 20 bp, Artificial
  CRISPR gRNA sequence
accagtggtaaaaggggcat

SEQ ID NO: 732771 - DNA, 20 bp, Artificial
  CRISPR gRNA sequence
ccagtggtaaaaggggcatc

SEQ ID NO: 732772 - DNA, 20 bp, Artificial
  CRISPR gRNA sequence
cagtggtaaaaggggcatca

SEQ ID NO: 732773 - DNA, 20 bp, Artificial
  CRISPR gRNA sequence
taaaaggggcatcagggcct

SEQ ID NO: 732774 - DNA, 20 bp, Artificial
  CRISPR gRNA sequence
aaaaggggcatcagggcctg

SEQ ID NO: 732775 - DNA, 20 bp, Artificial
  CRISPR gRNA sequence
aggggcatcagggcctgagg

SEQ ID NO: 732776 - DNA, 20 bp, Artificial
  CRISPR gRNA sequence
ggggcatcagggcctgaggt

SEQ ID NO: 732777 - DNA, 20 bp, Artificial
  CRISPR gRNA sequence
gggcatcagggcctgaggta

SEQ ID NO: 732778 - DNA, 20 bp, Artificial
  CRISPR gRNA sequence
ggcatcagggcctgaggtag

SEQ ID NO: 732779 - DNA, 20 bp, Artificial
  CRISPR gRNA sequence
cagggcctgaggtaggggct

SEQ ID NO: 732780 - DNA, 20 bp, Artificial
  CRISPR gRNA sequence
gcctgaggtaggggcttggc

SEQ ID NO: 732781 - DNA, 20 bp, Artificial
  CRISPR gRNA sequence
aggggcttggccagttgtga

SEQ ID NO: 732782 - DNA, 20 bp, Artificial
  CRISPR gRNA sequence
gttgtgacagttccactctt

SEQ ID NO: 732783 - DNA, 20 bp, Artificial
  CRISPR gRNA sequence
ttgtgacagttccactcttg

SEQ ID NO: 732784 - DNA, 20 bp, Artificial
  CRISPR gRNA sequence
ccactcttgaggatgttgtc

SEQ ID NO: 732785 - DNA, 20 bp, Artificial
  CRISPR gRNA sequence
gatgttgtccagatgtgtga

SEQ ID NO: 732786 - DNA, 20 bp, Artificial
  CRISPR gRNA sequence
atgttgtccagatgtgtgaa

SEQ ID NO: 732787 - DNA, 20 bp, Artificial
  CRISPR gRNA sequence
tgtgaaaggaatgttcctct

SEQ ID NO: 732788 - DNA, 20 bp, Artificial
  CRISPR gRNA sequence
aaggaatgttcctctcagtt

SEQ ID NO: 732789 - DNA, 20 bp, Artificial
  CRISPR gRNA sequence
aggaatgttcctctcagttt

SEQ ID NO: 732790 - DNA, 20 bp, Artificial
  CRISPR gRNA sequence
ggaatgttcctctcagtttg

SEQ ID NO: 732791 - DNA, 20 bp, Artificial
  CRISPR gRNA sequence
aatgttcctctcagtttggg

SEQ ID NO: 732792 - DNA, 20 bp, Artificial
  CRISPR gRNA sequence
ctctcagtttggggagctga

SEQ ID NO: 732793 - DNA, 20 bp, Artificial
  CRISPR gRNA sequence
cagtttggggagctgaaaga

SEQ ID NO: 732794 - DNA, 20 bp, Artificial
  CRISPR gRNA sequence
ttggggagctgaaagacaga

SEQ ID NO: 732795 - DNA, 20 bp, Artificial
  CRISPR gRNA sequence
tggggagctgaaagacagaa

SEQ ID NO: 732796 - DNA, 20 bp, Artificial
  CRISPR gRNA sequence
ggggagctgaaagacagaaa

SEQ ID NO: 732797 - DNA, 20 bp, Artificial
  CRISPR gRNA sequence
ggagctgaaagacagaaagg

SEQ ID NO: 732798 - DNA, 20 bp, Artificial
  CRISPR gRNA sequence
gagctgaaagacagaaaggg

SEQ ID NO: 732799 - DNA, 20 bp, Artificial
  CRISPR gRNA sequence
agacagaaagggaggaacgt

SEQ ID NO: 732800 - DNA, 20 bp, Artificial
  CRISPR gRNA sequence
ggaggaacgttagattgact

SEQ ID NO: 732801 - DNA, 20 bp, Artificial
  CRISPR gRNA sequence
gaggaacgttagattgactt

SEQ ID NO: 732802 - DNA, 20 bp, Artificial
  CRISPR gRNA sequence
ttagattgacttgggtgcct

SEQ ID NO: 732803 - DNA, 20 bp, Artificial
  CRISPR gRNA sequence
tgacttgggtgcctcagtgc

SEQ ID NO: 732804 - DNA, 20 bp, Artificial
  CRISPR gRNA sequence
gacttgggtgcctcagtgct

SEQ ID NO: 732805 - DNA, 20 bp, Artificial
  CRISPR gRNA sequence
cttgggtgcctcagtgctgg

SEQ ID NO: 732806 - DNA, 20 bp, Artificial
  CRISPR gRNA sequence
gggtgcctcagtgctgggag

SEQ ID NO: 732807 - DNA, 20 bp, Artificial
  CRISPR gRNA sequence
tcagtgctgggagcagatcc

SEQ ID NO: 732808 - DNA, 20 bp, Artificial
  CRISPR gRNA sequence
gcagatcctggcaacccaca

SEQ ID NO: 732809 - DNA, 20 bp, Artificial
  CRISPR gRNA sequence
tggcaacccacacagttgcc

SEQ ID NO: 732810 - DNA, 20 bp, Artificial
  CRISPR gRNA sequence
caacccacacagttgcctgg

SEQ ID NO: 732811 - DNA, 20 bp, Artificial
  CRISPR gRNA sequence
cacacagttgcctggaagcc

SEQ ID NO: 732812 - DNA, 20 bp, Artificial
  CRISPR gRNA sequence
cagttgcctggaagcctgga

SEQ ID NO: 732813 - DNA, 20 bp, Artificial
  CRISPR gRNA sequence
agttgcctggaagcctggat

SEQ ID NO: 732814 - DNA, 20 bp, Artificial
  CRISPR gRNA sequence
gttgcctggaagcctggatg

SEQ ID NO: 732815 - DNA, 20 bp, Artificial
  CRISPR gRNA sequence
ttgcctggaagcctggatgg

SEQ ID NO: 732816 - DNA, 20 bp, Artificial
  CRISPR gRNA sequence
tcttctcttctccttgacct

SEQ ID NO: 732817 - DNA, 20 bp, Artificial
  CRISPR gRNA sequence
cttctcttctccttgacctt

SEQ ID NO: 732818 - DNA, 20 bp, Artificial
  CRISPR gRNA sequence
cttctccttgaccttgggcc

SEQ ID NO: 732819 - DNA, 20 bp, Artificial
  CRISPR gRNA sequence
ttctccttgaccttgggcct

SEQ ID NO: 732820 - DNA, 20 bp, Artificial
  CRISPR gRNA sequence
tgaccttgggcctaggattc

SEQ ID NO: 732821 - DNA, 20 bp, Artificial
  CRISPR gRNA sequence
ggcctaggattctggctgct

SEQ ID NO: 732822 - DNA, 20 bp, Artificial
  CRISPR gRNA sequence
gattctggctgctgagtgat

SEQ ID NO: 732823 - DNA, 20 bp, Artificial
  CRISPR gRNA sequence
tgatcagatgtgtatttgtt

SEQ ID NO: 732824 - DNA, 20 bp, Artificial
  CRISPR gRNA sequence
cagatgtgtatttgttcaga

SEQ ID NO: 732825 - DNA, 20 bp, Artificial
  CRISPR gRNA sequence
atttgttcagaaagtgatat

SEQ ID NO: 732826 - DNA, 20 bp, Artificial
  CRISPR gRNA sequence
tttgttcagaaagtgatatc

SEQ ID NO: 732827 - DNA, 20 bp, Artificial
  CRISPR gRNA sequence
tgttcagaaagtgatatcag

SEQ ID NO: 732828 - DNA, 20 bp, Artificial
  CRISPR gRNA sequence
gttcagaaagtgatatcagg

SEQ ID NO: 732829 - DNA, 20 bp, Artificial
  CRISPR gRNA sequence
cagaaagtgatatcaggagg

SEQ ID NO: 732830 - DNA, 20 bp, Artificial
  CRISPR gRNA sequence
agaaagtgatatcaggagga

SEQ ID NO: 732831 - DNA, 20 bp, Artificial
  CRISPR gRNA sequence
aagtgatatcaggaggaagg

SEQ ID NO: 732832 - DNA, 20 bp, Artificial
  CRISPR gRNA sequence
tgatatcaggaggaaggaag

SEQ ID NO: 732833 - DNA, 20 bp, Artificial
  CRISPR gRNA sequence
gatatcaggaggaaggaagt

SEQ ID NO: 732834 - DNA, 20 bp, Artificial
  CRISPR gRNA sequence
ggaaggaagtaggtgtactg

SEQ ID NO: 732835 - DNA, 20 bp, Artificial
  CRISPR gRNA sequence
aggaagtaggtgtactgaag

SEQ ID NO: 732836 - DNA, 20 bp, Artificial
  CRISPR gRNA sequence
ggaagtaggtgtactgaaga

SEQ ID NO: 732837 - DNA, 20 bp, Artificial
  CRISPR gRNA sequence
gaagtaggtgtactgaagaa

SEQ ID NO: 732838 - DNA, 20 bp, Artificial
  CRISPR gRNA sequence
agtaggtgtactgaagaagg

SEQ ID NO: 732839 - DNA, 20 bp, Artificial
  CRISPR gRNA sequence
taggtgtactgaagaaggga

SEQ ID NO: 732840 - DNA, 20 bp, Artificial
  CRISPR gRNA sequence
tttctttttccctcccgtgt

SEQ ID NO: 732841 - DNA, 20 bp, Artificial
  CRISPR gRNA sequence
ttctttttccctcccgtgtc

SEQ ID NO: 732842 - DNA, 20 bp, Artificial
  CRISPR gRNA sequence
atctctctcttttcactttc

SEQ ID NO: 732843 - DNA, 20 bp, Artificial
  CRISPR gRNA sequence
tctctctcttttcactttcc

SEQ ID NO: 732844 - DNA, 20 bp, Artificial
  CRISPR gRNA sequence
ccaggccctcttcgttccta

SEQ ID NO: 732845 - DNA, 20 bp, Artificial
  CRISPR gRNA sequence
caggccctcttcgttcctat

SEQ ID NO: 732846 - DNA, 20 bp, Artificial
  CRISPR gRNA sequence
cttcgttcctatgggccaaa

SEQ ID NO: 732847 - DNA, 20 bp, Artificial
  CRISPR gRNA sequence
tccataaaataatgtcaaac

SEQ ID NO: 732848 - DNA, 20 bp, Artificial
  CRISPR gRNA sequence
atgtcaaacaagaacttttc

SEQ ID NO: 732849 - DNA, 20 bp, Artificial
  CRISPR gRNA sequence
ccagctattccataattgac

SEQ ID NO: 732850 - DNA, 20 bp, Artificial
  CRISPR gRNA sequence
gctattccataattgacaag

SEQ ID NO: 732851 - DNA, 20 bp, Artificial
  CRISPR gRNA sequence
ctattccataattgacaagt

SEQ ID NO: 732852 - DNA, 20 bp, Artificial
  CRISPR gRNA sequence
tattccataattgacaagta

SEQ ID NO: 732853 - DNA, 20 bp, Artificial
  CRISPR gRNA sequence
cataattgacaagtagggtc

SEQ ID NO: 732854 - DNA, 20 bp, Artificial
  CRISPR gRNA sequence
taattgacaagtagggtcca

SEQ ID NO: 732855 - DNA, 20 bp, Artificial
  CRISPR gRNA sequence
gacaagtagggtccagagat

SEQ ID NO: 732856 - DNA, 20 bp, Artificial
  CRISPR gRNA sequence
acaagtagggtccagagatg

SEQ ID NO: 732857 - DNA, 20 bp, Artificial
  CRISPR gRNA sequence
tagggtccagagatgaggac

SEQ ID NO: 732858 - DNA, 20 bp, Artificial
  CRISPR gRNA sequence
agggtccagagatgaggaca

SEQ ID NO: 732859 - DNA, 20 bp, Artificial
  CRISPR gRNA sequence
ggtccagagatgaggacaag

SEQ ID NO: 732860 - DNA, 20 bp, Artificial
  CRISPR gRNA sequence
gtccagagatgaggacaagg

SEQ ID NO: 732861 - DNA, 20 bp, Artificial
  CRISPR gRNA sequence
gatgaggacaaggaggcatc

SEQ ID NO: 732862 - DNA, 20 bp, Artificial
  CRISPR gRNA sequence
atgaggacaaggaggcatca

SEQ ID NO: 732863 - DNA, 20 bp, Artificial
  CRISPR gRNA sequence
atcaaggtcctcaaattcca

SEQ ID NO: 732864 - DNA, 20 bp, Artificial
  CRISPR gRNA sequence
aggtcctcaaattccaaaga

SEQ ID NO: 732865 - DNA, 20 bp, Artificial
  CRISPR gRNA sequence
tcaaattccaaagaaagctg

SEQ ID NO: 732866 - DNA, 20 bp, Artificial
  CRISPR gRNA sequence
attccaaagaaagctgcagt

SEQ ID NO: 732867 - DNA, 20 bp, Artificial
  CRISPR gRNA sequence
caaagaaagctgcagtcagt

SEQ ID NO: 732868 - DNA, 20 bp, Artificial
  CRISPR gRNA sequence
aaagaaagctgcagtcagtt

SEQ ID NO: 732869 - DNA, 20 bp, Artificial
  CRISPR gRNA sequence
aagaaagctgcagtcagttg

SEQ ID NO: 732870 - DNA, 20 bp, Artificial
  CRISPR gRNA sequence
aagctgcagtcagttggggt

SEQ ID NO: 732871 - DNA, 20 bp, Artificial
  CRISPR gRNA sequence
ttggggtcagacactttcct

SEQ ID NO: 732872 - DNA, 20 bp, Artificial
  CRISPR gRNA sequence
tggggtcagacactttcctt

SEQ ID NO: 732873 - DNA, 20 bp, Artificial
  CRISPR gRNA sequence
ggggtcagacactttccttg

SEQ ID NO: 732874 - DNA, 20 bp, Artificial
  CRISPR gRNA sequence
gggtcagacactttccttgg

SEQ ID NO: 732875 - DNA, 20 bp, Artificial
  CRISPR gRNA sequence
actttccttgggggctcact

SEQ ID NO: 732876 - DNA, 20 bp, Artificial
  CRISPR gRNA sequence
tttccttgggggctcactaa

SEQ ID NO: 732877 - DNA, 20 bp, Artificial
  CRISPR gRNA sequence
ctcactaagagatatcaaac

SEQ ID NO: 732878 - DNA, 20 bp, Artificial
  CRISPR gRNA sequence
gctacactcacccatcaacc

SEQ ID NO: 732879 - DNA, 20 bp, Artificial
  CRISPR gRNA sequence
cccttttccatcccattttc

SEQ ID NO: 732880 - DNA, 20 bp, Artificial
  CRISPR gRNA sequence
ttttccatcccattttctag

SEQ ID NO: 732881 - DNA, 20 bp, Artificial
  CRISPR gRNA sequence
tccatcccattttctagaag

SEQ ID NO: 732882 - DNA, 20 bp, Artificial
  CRISPR gRNA sequence
cccattttctagaagaagcc

SEQ ID NO: 732883 - DNA, 20 bp, Artificial
  CRISPR gRNA sequence
ccattttctagaagaagcct

SEQ ID NO: 732884 - DNA, 20 bp, Artificial
  CRISPR gRNA sequence
tctagaagaagcctgggttt

SEQ ID NO: 732885 - DNA, 20 bp, Artificial
  CRISPR gRNA sequence
gaagaagcctgggttttgga

SEQ ID NO: 732886 - DNA, 20 bp, Artificial
  CRISPR gRNA sequence
gaagcctgggttttggacag

SEQ ID NO: 732887 - DNA, 20 bp, Artificial
  CRISPR gRNA sequence
ctgggttttggacagtggat

SEQ ID NO: 732888 - DNA, 20 bp, Artificial
  CRISPR gRNA sequence
tgggttttggacagtggatg

SEQ ID NO: 732889 - DNA, 20 bp, Artificial
  CRISPR gRNA sequence
ggttttggacagtggatgag

SEQ ID NO: 732890 - DNA, 20 bp, Artificial
  CRISPR gRNA sequence
gttttggacagtggatgagg

SEQ ID NO: 732891 - DNA, 20 bp, Artificial
  CRISPR gRNA sequence
ttttggacagtggatgagga

SEQ ID NO: 732892 - DNA, 20 bp, Artificial
  CRISPR gRNA sequence
ttggacagtggatgaggagg

SEQ ID NO: 732893 - DNA, 20 bp, Artificial
  CRISPR gRNA sequence
tggacagtggatgaggaggg

SEQ ID NO: 732894 - DNA, 20 bp, Artificial
  CRISPR gRNA sequence
acagtggatgaggagggagg

SEQ ID NO: 732895 - DNA, 20 bp, Artificial
  CRISPR gRNA sequence
agtggatgaggagggaggtg

SEQ ID NO: 732896 - DNA, 20 bp, Artificial
  CRISPR gRNA sequence
gtggatgaggagggaggtgg

SEQ ID NO: 732897 - DNA, 20 bp, Artificial
  CRISPR gRNA sequence
ggatgaggagggaggtggag

SEQ ID NO: 732898 - DNA, 20 bp, Artificial
  CRISPR gRNA sequence
gagggaggtggaggagctgt

SEQ ID NO: 732899 - DNA, 20 bp, Artificial
  CRISPR gRNA sequence
agggaggtggaggagctgtg

SEQ ID NO: 732900 - DNA, 20 bp, Artificial
  CRISPR gRNA sequence
ggagctgtgaggcatcaacc

SEQ ID NO: 732901 - DNA, 20 bp, Artificial
  CRISPR gRNA sequence
gctgtgaggcatcaacctag

SEQ ID NO: 732902 - DNA, 20 bp, Artificial
  CRISPR gRNA sequence
tgaggcatcaacctagcagt

SEQ ID NO: 732903 - DNA, 20 bp, Artificial
  CRISPR gRNA sequence
atcaacctagcagtgagtga

SEQ ID NO: 732904 - DNA, 20 bp, Artificial
  CRISPR gRNA sequence
agtgagtgatggttttatct

SEQ ID NO: 732905 - DNA, 20 bp, Artificial
  CRISPR gRNA sequence
gtgatggttttatctcagca

SEQ ID NO: 732906 - DNA, 20 bp, Artificial
  CRISPR gRNA sequence
tcagcatggaatgtgaaaat

SEQ ID NO: 732907 - DNA, 20 bp, Artificial
  CRISPR gRNA sequence
agcatggaatgtgaaaattg

SEQ ID NO: 732908 - DNA, 20 bp, Artificial
  CRISPR gRNA sequence
tggaatgtgaaaattggaga

SEQ ID NO: 732909 - DNA, 20 bp, Artificial
  CRISPR gRNA sequence
gaatgtgaaaattggagaca

SEQ ID NO: 732910 - DNA, 20 bp, Artificial
  CRISPR gRNA sequence
aatgtgaaaattggagacag

SEQ ID NO: 732911 - DNA, 20 bp, Artificial
  CRISPR gRNA sequence
ctacatcccactactgtgca

SEQ ID NO: 732912 - DNA, 20 bp, Artificial
  CRISPR gRNA sequence
atcccactactgtgcatgga

SEQ ID NO: 732913 - DNA, 20 bp, Artificial
  CRISPR gRNA sequence
tcccactactgtgcatggaa

SEQ ID NO: 732914 - DNA, 20 bp, Artificial
  CRISPR gRNA sequence
cccactactgtgcatggaaa

SEQ ID NO: 732915 - DNA, 20 bp, Artificial
  CRISPR gRNA sequence
catggaaagggcaatttcct

SEQ ID NO: 732916 - DNA, 20 bp, Artificial
  CRISPR gRNA sequence
atggaaagggcaatttccta

SEQ ID NO: 732917 - DNA, 20 bp, Artificial
  CRISPR gRNA sequence
tggaaagggcaatttcctaa

SEQ ID NO: 732918 - DNA, 20 bp, Artificial
  CRISPR gRNA sequence
taagggccaaattgtcatca

SEQ ID NO: 732919 - DNA, 20 bp, Artificial
  CRISPR gRNA sequence
gggccaaattgtcatcatgg

SEQ ID NO: 732920 - DNA, 20 bp, Artificial
  CRISPR gRNA sequence
ggccaaattgtcatcatgga

SEQ ID NO: 732921 - DNA, 20 bp, Artificial
  CRISPR gRNA sequence
caaattgtcatcatggaagg

SEQ ID NO: 732922 - DNA, 20 bp, Artificial
  CRISPR gRNA sequence
tgtcatcatggaaggtggct

SEQ ID NO: 732923 - DNA, 20 bp, Artificial
  CRISPR gRNA sequence
catggaaggtggctgagctt

SEQ ID NO: 732924 - DNA, 20 bp, Artificial
  CRISPR gRNA sequence
ctgagcttgagccatttttc

SEQ ID NO: 732925 - DNA, 20 bp, Artificial
  CRISPR gRNA sequence
gagcttgagccatttttctg

SEQ ID NO: 732926 - DNA, 20 bp, Artificial
  CRISPR gRNA sequence
cttgagccatttttctggag

SEQ ID NO: 732927 - DNA, 20 bp, Artificial
  CRISPR gRNA sequence
ttgagccatttttctggaga

SEQ ID NO: 732928 - DNA, 20 bp, Artificial
  CRISPR gRNA sequence
tgagccatttttctggagaa

SEQ ID NO: 732929 - DNA, 20 bp, Artificial
  CRISPR gRNA sequence
gagccatttttctggagaag

SEQ ID NO: 732930 - DNA, 20 bp, Artificial
  CRISPR gRNA sequence
tttttctggagaaggggacc

SEQ ID NO: 732931 - DNA, 20 bp, Artificial
  CRISPR gRNA sequence
tggagaaggggacccagaac

SEQ ID NO: 732932 - DNA, 20 bp, Artificial
  CRISPR gRNA sequence
agaaggggacccagaacaag

SEQ ID NO: 732933 - DNA, 20 bp, Artificial
  CRISPR gRNA sequence
ggacccagaacaagcagcat

SEQ ID NO: 732934 - DNA, 20 bp, Artificial
  CRISPR gRNA sequence
ccagaacaagcagcattggt

SEQ ID NO: 732935 - DNA, 20 bp, Artificial
  CRISPR gRNA sequence
cagaacaagcagcattggtg

SEQ ID NO: 732936 - DNA, 20 bp, Artificial
  CRISPR gRNA sequence
acaagcagcattggtgagga

SEQ ID NO: 732937 - DNA, 20 bp, Artificial
  CRISPR gRNA sequence
caagcagcattggtgaggat

SEQ ID NO: 732938 - DNA, 20 bp, Artificial
  CRISPR gRNA sequence
agcattggtgaggatgggaa

SEQ ID NO: 732939 - DNA, 20 bp, Artificial
  CRISPR gRNA sequence
cattggtgaggatgggaata

SEQ ID NO: 732940 - DNA, 20 bp, Artificial
  CRISPR gRNA sequence
attggtgaggatgggaatag

SEQ ID NO: 732941 - DNA, 20 bp, Artificial
  CRISPR gRNA sequence
ggtgaggatgggaatagagg

SEQ ID NO: 732942 - DNA, 20 bp, Artificial
  CRISPR gRNA sequence
aatagaggaagacgctcacc

SEQ ID NO: 732943 - DNA, 20 bp, Artificial
  CRISPR gRNA sequence
tagaggaagacgctcacctg

SEQ ID NO: 732944 - DNA, 20 bp, Artificial
  CRISPR gRNA sequence
ggaagacgctcacctggagt

SEQ ID NO: 732945 - DNA, 20 bp, Artificial
  CRISPR gRNA sequence
aagacgctcacctggagtca

SEQ ID NO: 732946 - DNA, 20 bp, Artificial
  CRISPR gRNA sequence
agctcccacaacatcatact

SEQ ID NO: 732947 - DNA, 20 bp, Artificial
  CRISPR gRNA sequence
tcccacaacatcatactcag

SEQ ID NO: 732948 - DNA, 20 bp, Artificial
  CRISPR gRNA sequence
cacaacatcatactcagcag

SEQ ID NO: 732949 - DNA, 20 bp, Artificial
  CRISPR gRNA sequence
acaacatcatactcagcagt

SEQ ID NO: 732950 - DNA, 20 bp, Artificial
  CRISPR gRNA sequence
caacatcatactcagcagtg

SEQ ID NO: 732951 - DNA, 20 bp, Artificial
  CRISPR gRNA sequence
cagcagtggggacaccccca

SEQ ID NO: 732952 - DNA, 20 bp, Artificial
  CRISPR gRNA sequence
gacacccccaaagaactctt

SEQ ID NO: 732953 - DNA, 20 bp, Artificial
  CRISPR gRNA sequence
cacccccaaagaactcttca

SEQ ID NO: 732954 - DNA, 20 bp, Artificial
  CRISPR gRNA sequence
tcttcagagaattcacacat

SEQ ID NO: 732955 - DNA, 20 bp, Artificial
  CRISPR gRNA sequence
gaattcacacatcagtgcct

SEQ ID NO: 732956 - DNA, 20 bp, Artificial
  CRISPR gRNA sequence
aattcacacatcagtgcctt

SEQ ID NO: 732957 - DNA, 20 bp, Artificial
  CRISPR gRNA sequence
ttcacacatcagtgccttgg

SEQ ID NO: 732958 - DNA, 20 bp, Artificial
  CRISPR gRNA sequence
cacacatcagtgccttggga

SEQ ID NO: 732959 - DNA, 20 bp, Artificial
  CRISPR gRNA sequence
cagtgccttgggagagtata

SEQ ID NO: 732960 - DNA, 20 bp, Artificial
  CRISPR gRNA sequence
tgggagagtatatggacact

SEQ ID NO: 732961 - DNA, 20 bp, Artificial
  CRISPR gRNA sequence
ggagagtatatggacactca

SEQ ID NO: 732962 - DNA, 20 bp, Artificial
  CRISPR gRNA sequence
agagtatatggacactcaga

SEQ ID NO: 732963 - DNA, 20 bp, Artificial
  CRISPR gRNA sequence
gagtatatggacactcagag

SEQ ID NO: 732964 - DNA, 20 bp, Artificial
  CRISPR gRNA sequence
gacactcagagaggatctca

SEQ ID NO: 732965 - DNA, 20 bp, Artificial
  CRISPR gRNA sequence
acactcagagaggatctcaa

SEQ ID NO: 732966 - DNA, 20 bp, Artificial
  CRISPR gRNA sequence
cactcagagaggatctcaaa

SEQ ID NO: 732967 - DNA, 20 bp, Artificial
  CRISPR gRNA sequence
cagagaggatctcaaagggc

SEQ ID NO: 732968 - DNA, 20 bp, Artificial
  CRISPR gRNA sequence
agaggatctcaaagggctgg

SEQ ID NO: 732969 - DNA, 20 bp, Artificial
  CRISPR gRNA sequence
atctcaaagggctggcagac

SEQ ID NO: 732970 - DNA, 20 bp, Artificial
  CRISPR gRNA sequence
agacaagcaatgacatccaa

SEQ ID NO: 732971 - DNA, 20 bp, Artificial
  CRISPR gRNA sequence
gacaagcaatgacatccaac

SEQ ID NO: 732972 - DNA, 20 bp, Artificial
  CRISPR gRNA sequence
acaagcaatgacatccaaca

SEQ ID NO: 732973 - DNA, 20 bp, Artificial
  CRISPR gRNA sequence
gcaatgacatccaacaggga

SEQ ID NO: 732974 - DNA, 20 bp, Artificial
  CRISPR gRNA sequence
gaaagcattcctacaacact

SEQ ID NO: 732975 - DNA, 20 bp, Artificial
  CRISPR gRNA sequence
cattcctacaacactcagtt

SEQ ID NO: 732976 - DNA, 20 bp, Artificial
  CRISPR gRNA sequence
cattcctgcatcaacacact

SEQ ID NO: 732977 - DNA, 20 bp, Artificial
  CRISPR gRNA sequence
ttcctgcatcaacacactaa

SEQ ID NO: 732978 - DNA, 20 bp, Artificial
  CRISPR gRNA sequence
tcctgcatcaacacactaag

SEQ ID NO: 732979 - DNA, 20 bp, Artificial
  CRISPR gRNA sequence
cctgcatcaacacactaaga

SEQ ID NO: 732980 - DNA, 20 bp, Artificial
  CRISPR gRNA sequence
atcaacacactaagagggcc

SEQ ID NO: 732981 - DNA, 20 bp, Artificial
  CRISPR gRNA sequence
aacacactaagagggccaag

SEQ ID NO: 732982 - DNA, 20 bp, Artificial
  CRISPR gRNA sequence
cacactaagagggccaagaa

SEQ ID NO: 732983 - DNA, 20 bp, Artificial
  CRISPR gRNA sequence
acactaagagggccaagaag

SEQ ID NO: 732984 - DNA, 20 bp, Artificial
  CRISPR gRNA sequence
agggccaagaagaggtaacc

SEQ ID NO: 732985 - DNA, 20 bp, Artificial
  CRISPR gRNA sequence
ggccaagaagaggtaaccaa

SEQ ID NO: 732986 - DNA, 20 bp, Artificial
  CRISPR gRNA sequence
gccaagaagaggtaaccaag

SEQ ID NO: 732987 - DNA, 20 bp, Artificial
  CRISPR gRNA sequence
gaggaaccccgccttcttca

SEQ ID NO: 732988 - DNA, 20 bp, Artificial
  CRISPR gRNA sequence
ccccgccttcttcacagccc

SEQ ID NO: 732989 - DNA, 20 bp, Artificial
  CRISPR gRNA sequence
cttcttcacagcccaagatg

SEQ ID NO: 732990 - DNA, 20 bp, Artificial
  CRISPR gRNA sequence
ttcttcacagcccaagatgc

SEQ ID NO: 732991 - DNA, 20 bp, Artificial
  CRISPR gRNA sequence
tcacagcccaagatgcagga

SEQ ID NO: 732992 - DNA, 20 bp, Artificial
  CRISPR gRNA sequence
cacagcccaagatgcaggat

SEQ ID NO: 732993 - DNA, 20 bp, Artificial
  CRISPR gRNA sequence
acagcccaagatgcaggatg

SEQ ID NO: 732994 - DNA, 20 bp, Artificial
  CRISPR gRNA sequence
agcccaagatgcaggatggg

SEQ ID NO: 732995 - DNA, 20 bp, Artificial
  CRISPR gRNA sequence
caagatgcaggatggggagc

SEQ ID NO: 732996 - DNA, 20 bp, Artificial
  CRISPR gRNA sequence
aagatgcaggatggggagct

SEQ ID NO: 732997 - DNA, 20 bp, Artificial
  CRISPR gRNA sequence
atgcaggatggggagctggg

SEQ ID NO: 732998 - DNA, 20 bp, Artificial
  CRISPR gRNA sequence
aggatggggagctgggcagc

SEQ ID NO: 732999 - DNA, 20 bp, Artificial
  CRISPR gRNA sequence
gtaactttccttctccactt

SEQ ID NO: 733000 - DNA, 20 bp, Artificial
  CRISPR gRNA sequence
cttctccactttagatgcct

SEQ ID NO: 733001 - DNA, 20 bp, Artificial
  CRISPR gRNA sequence
atgccttggaccataaaacc

SEQ ID NO: 733002 - DNA, 20 bp, Artificial
  CRISPR gRNA sequence
ggaccataaaacctggtctt

SEQ ID NO: 733003 - DNA, 20 bp, Artificial
  CRISPR gRNA sequence
gaccataaaacctggtcttc

SEQ ID NO: 733004 - DNA, 20 bp, Artificial
  CRISPR gRNA sequence
accataaaacctggtcttca

SEQ ID NO: 733005 - DNA, 20 bp, Artificial
  CRISPR gRNA sequence
ccataaaacctggtcttcag

SEQ ID NO: 733006 - DNA, 20 bp, Artificial
  CRISPR gRNA sequence
cataaaacctggtcttcagg

SEQ ID NO: 733007 - DNA, 20 bp, Artificial
  CRISPR gRNA sequence
aaaacctggtcttcaggggg

SEQ ID NO: 733008 - DNA, 20 bp, Artificial
  CRISPR gRNA sequence
acctggtcttcagggggcag

SEQ ID NO: 733009 - DNA, 20 bp, Artificial
  CRISPR gRNA sequence
agtggaatatcctatactgc

SEQ ID NO: 733010 - DNA, 20 bp, Artificial
  CRISPR gRNA sequence
atcctatactgctagatgac

SEQ ID NO: 733011 - DNA, 20 bp, Artificial
  CRISPR gRNA sequence
cctatactgctagatgacca

SEQ ID NO: 733012 - DNA, 20 bp, Artificial
  CRISPR gRNA sequence
tgctagatgaccagagtttg

SEQ ID NO: 733013 - DNA, 20 bp, Artificial
  CRISPR gRNA sequence
agatgaccagagtttgtagt

SEQ ID NO: 733014 - DNA, 20 bp, Artificial
  CRISPR gRNA sequence
ccagagtttgtagttggaat

SEQ ID NO: 733015 - DNA, 20 bp, Artificial
  CRISPR gRNA sequence
cagagtttgtagttggaata

SEQ ID NO: 733016 - DNA, 20 bp, Artificial
  CRISPR gRNA sequence
ttttttttatttcctaataa

SEQ ID NO: 733017 - DNA, 20 bp, Artificial
  CRISPR gRNA sequence
tttatttcctaataacagaa

SEQ ID NO: 733018 - DNA, 20 bp, Artificial
  CRISPR gRNA sequence
ttatttcctaataacagaaa

SEQ ID NO: 733019 - DNA, 20 bp, Artificial
  CRISPR gRNA sequence
aataacagaaaaggtctgca

SEQ ID NO: 733020 - DNA, 20 bp, Artificial
  CRISPR gRNA sequence
aatcttcacaaattgtcctt

SEQ ID NO: 733021 - DNA, 20 bp, Artificial
  CRISPR gRNA sequence
tcttcacaaattgtccttaa

SEQ ID NO: 733022 - DNA, 20 bp, Artificial
  CRISPR gRNA sequence
cttcacaaattgtccttaag

SEQ ID NO: 733023 - DNA, 20 bp, Artificial
  CRISPR gRNA sequence
cacaaattgtccttaagagg

SEQ ID NO: 733024 - DNA, 20 bp, Artificial
  CRISPR gRNA sequence
aattgtccttaagaggtgga

SEQ ID NO: 733025 - DNA, 20 bp, Artificial
  CRISPR gRNA sequence
gtccttaagaggtggaaagt

SEQ ID NO: 733026 - DNA, 20 bp, Artificial
  CRISPR gRNA sequence
gagatgtgacataacatgat

SEQ ID NO: 733027 - DNA, 20 bp, Artificial
  CRISPR gRNA sequence
gatgtgacataacatgatta

SEQ ID NO: 733028 - DNA, 20 bp, Artificial
  CRISPR gRNA sequence
atgtgacataacatgattag

SEQ ID NO: 733029 - DNA, 20 bp, Artificial
  CRISPR gRNA sequence
acatgattagaggaaatgat

SEQ ID NO: 733030 - DNA, 20 bp, Artificial
  CRISPR gRNA sequence
gaaatgatgagaaaaaataa

SEQ ID NO: 733031 - DNA, 20 bp, Artificial
  CRISPR gRNA sequence
tgtttctatccctaaatatt

SEQ ID NO: 733032 - DNA, 20 bp, Artificial
  CRISPR gRNA sequence
atccctaaatattaagactt

SEQ ID NO: 733033 - DNA, 20 bp, Artificial
  CRISPR gRNA sequence
atattaagacttcagtgaac

SEQ ID NO: 733034 - DNA, 20 bp, Artificial
  CRISPR gRNA sequence
tgaaccagtttcgacttccc

SEQ ID NO: 733035 - DNA, 20 bp, Artificial
  CRISPR gRNA sequence
gaaccagtttcgacttccct

SEQ ID NO: 733036 - DNA, 20 bp, Artificial
  CRISPR gRNA sequence
cgacttccctgggtctcact

SEQ ID NO: 733037 - DNA, 20 bp, Artificial
  CRISPR gRNA sequence
ccctgggtctcactcagaac

SEQ ID NO: 733038 - DNA, 20 bp, Artificial
  CRISPR gRNA sequence
ctgggtctcactcagaactg

SEQ ID NO: 733039 - DNA, 20 bp, Artificial
  CRISPR gRNA sequence
gggtctcactcagaactgga

SEQ ID NO: 733040 - DNA, 20 bp, Artificial
  CRISPR gRNA sequence
ggtctcactcagaactggag

SEQ ID NO: 733041 - DNA, 20 bp, Artificial
  CRISPR gRNA sequence
gtctcactcagaactggaga

SEQ ID NO: 733042 - DNA, 20 bp, Artificial
  CRISPR gRNA sequence
tctcactcagaactggagag

SEQ ID NO: 733043 - DNA, 20 bp, Artificial
  CRISPR gRNA sequence
tcactcagaactggagaggg

SEQ ID NO: 733044 - DNA, 20 bp, Artificial
  CRISPR gRNA sequence
gaactggagaggggagcaat

SEQ ID NO: 733045 - DNA, 20 bp, Artificial
  CRISPR gRNA sequence
gagaggggagcaatgagatt

SEQ ID NO: 733046 - DNA, 20 bp, Artificial
  CRISPR gRNA sequence
tgagatttggctccacattt

SEQ ID NO: 733047 - DNA, 20 bp, Artificial
  CRISPR gRNA sequence
ttggctccacattttagcga

SEQ ID NO: 733048 - DNA, 20 bp, Artificial
  CRISPR gRNA sequence
tttagcgacagcattttccc

SEQ ID NO: 733049 - DNA, 20 bp, Artificial
  CRISPR gRNA sequence
cgacagcattttccctagtt

SEQ ID NO: 733050 - DNA, 20 bp, Artificial
  CRISPR gRNA sequence
tttccctagttcagaccctg

SEQ ID NO: 733051 - DNA, 20 bp, Artificial
  CRISPR gRNA sequence
ccctagttcagaccctgtgg

SEQ ID NO: 733052 - DNA, 20 bp, Artificial
  CRISPR gRNA sequence
agttcagaccctgtggaaga

SEQ ID NO: 733053 - DNA, 20 bp, Artificial
  CRISPR gRNA sequence
ttcagaccctgtggaagatg

SEQ ID NO: 733054 - DNA, 20 bp, Artificial
  CRISPR gRNA sequence
gtggaagatggagatgcaat

SEQ ID NO: 733055 - DNA, 20 bp, Artificial
  CRISPR gRNA sequence
tggaagatggagatgcaatt

SEQ ID NO: 733056 - DNA, 20 bp, Artificial
  CRISPR gRNA sequence
agatggagatgcaattgggt

SEQ ID NO: 733057 - DNA, 20 bp, Artificial
  CRISPR gRNA sequence
gatggagatgcaattgggtt

SEQ ID NO: 733058 - DNA, 20 bp, Artificial
  CRISPR gRNA sequence
atgcaattgggttaggtgaa

SEQ ID NO: 733059 - DNA, 20 bp, Artificial
  CRISPR gRNA sequence
tgcaattgggttaggtgaac

SEQ ID NO: 733060 - DNA, 20 bp, Artificial
  CRISPR gRNA sequence
gcaattgggttaggtgaacg

SEQ ID NO: 733061 - DNA, 20 bp, Artificial
  CRISPR gRNA sequence
attgggttaggtgaacgggg

SEQ ID NO: 733062 - DNA, 20 bp, Artificial
  CRISPR gRNA sequence
ttgggttaggtgaacgggga

SEQ ID NO: 733063 - DNA, 20 bp, Artificial
  CRISPR gRNA sequence
gttaggtgaacggggaagga

SEQ ID NO: 733064 - DNA, 20 bp, Artificial
  CRISPR gRNA sequence
ggtgaacggggaaggatgga

SEQ ID NO: 733065 - DNA, 20 bp, Artificial
  CRISPR gRNA sequence
atagtaaattgcataataac

SEQ ID NO: 733066 - DNA, 20 bp, Artificial
  CRISPR gRNA sequence
taataactggctgccttttc

SEQ ID NO: 733067 - DNA, 20 bp, Artificial
  CRISPR gRNA sequence
aataactggctgccttttcc

SEQ ID NO: 733068 - DNA, 20 bp, Artificial
  CRISPR gRNA sequence
ataactggctgccttttccg

SEQ ID NO: 733069 - DNA, 20 bp, Artificial
  CRISPR gRNA sequence
gctgccttttccggggtctt

SEQ ID NO: 733070 - DNA, 20 bp, Artificial
  CRISPR gRNA sequence
cttttccggggtctttagct

SEQ ID NO: 733071 - DNA, 20 bp, Artificial
  CRISPR gRNA sequence
ccttttctatctaataaatg

SEQ ID NO: 733072 - DNA, 20 bp, Artificial
  CRISPR gRNA sequence
tttctatctaataaatgtgg

SEQ ID NO: 733073 - DNA, 20 bp, Artificial
  CRISPR gRNA sequence
ttctatctaataaatgtgga

SEQ ID NO: 733074 - DNA, 20 bp, Artificial
  CRISPR gRNA sequence
ataaatgtggaaggacccca

SEQ ID NO: 733075 - DNA, 20 bp, Artificial
  CRISPR gRNA sequence
tgtggaaggaccccacggct

SEQ ID NO: 733076 - DNA, 20 bp, Artificial
  CRISPR gRNA sequence
actcttttttgcctacactc

SEQ ID NO: 733077 - DNA, 20 bp, Artificial
  CRISPR gRNA sequence
ctcttttttgcctacactca

SEQ ID NO: 733078 - DNA, 20 bp, Artificial
  CRISPR gRNA sequence
tcttttttgcctacactcaa

SEQ ID NO: 733079 - DNA, 20 bp, Artificial
  CRISPR gRNA sequence
ttttttgcctacactcaagg

SEQ ID NO: 733080 - DNA, 20 bp, Artificial
  CRISPR gRNA sequence
ttttgcctacactcaaggga

SEQ ID NO: 733081 - DNA, 20 bp, Artificial
  CRISPR gRNA sequence
tacactcaagggagagcttt

SEQ ID NO: 733082 - DNA, 20 bp, Artificial
  CRISPR gRNA sequence
ttttagatcttgatattttt

SEQ ID NO: 733083 - DNA, 20 bp, Artificial
  CRISPR gRNA sequence
atatttttaagaactttatt

SEQ ID NO: 733084 - DNA, 20 bp, Artificial
  CRISPR gRNA sequence
tataactcacatcccattta

SEQ ID NO: 733085 - DNA, 20 bp, Artificial
  CRISPR gRNA sequence
cacatcccatttatagtata

SEQ ID NO: 733086 - DNA, 20 bp, Artificial
  CRISPR gRNA sequence
cccatttatagtataaagct

SEQ ID NO: 733087 - DNA, 20 bp, Artificial
  CRISPR gRNA sequence
atttatagtataaagctcag

SEQ ID NO: 733088 - DNA, 20 bp, Artificial
  CRISPR gRNA sequence
ggttctttattatgcttaca

SEQ ID NO: 733089 - DNA, 20 bp, Artificial
  CRISPR gRNA sequence
aagttatgcaaccatcatca

SEQ ID NO: 733090 - DNA, 20 bp, Artificial
  CRISPR gRNA sequence
tatgcaaccatcatcacagt

SEQ ID NO: 733091 - DNA, 20 bp, Artificial
  CRISPR gRNA sequence
accatcatcacagtgagttt

SEQ ID NO: 733092 - DNA, 20 bp, Artificial
  CRISPR gRNA sequence
aacaccttcatcatctccaa

SEQ ID NO: 733093 - DNA, 20 bp, Artificial
  CRISPR gRNA sequence
gtatccccttttccttcccc

SEQ ID NO: 733094 - DNA, 20 bp, Artificial
  CRISPR gRNA sequence
cttttccttcccccagccct

SEQ ID NO: 733095 - DNA, 20 bp, Artificial
  CRISPR gRNA sequence
taatctactttctgtgtctg

SEQ ID NO: 733096 - DNA, 20 bp, Artificial
  CRISPR gRNA sequence
tgtagatttctctaattccc

SEQ ID NO: 733097 - DNA, 20 bp, Artificial
  CRISPR gRNA sequence
gactttaaacactatcttta

SEQ ID NO: 733098 - DNA, 20 bp, Artificial
  CRISPR gRNA sequence
ctttaaacactatctttata

SEQ ID NO: 733099 - DNA, 20 bp, Artificial
  CRISPR gRNA sequence
atactttcaaatacataccc

SEQ ID NO: 733100 - DNA, 20 bp, Artificial
  CRISPR gRNA sequence
ccagctctgacctctcaccc

SEQ ID NO: 733101 - DNA, 20 bp, Artificial
  CRISPR gRNA sequence
ctgacctctcaccctagctc

SEQ ID NO: 733102 - DNA, 20 bp, Artificial
  CRISPR gRNA sequence
tgacctctcaccctagctcc

SEQ ID NO: 733103 - DNA, 20 bp, Artificial
  CRISPR gRNA sequence
cctctcaccctagctccagg

SEQ ID NO: 733104 - DNA, 20 bp, Artificial
  CRISPR gRNA sequence
ctctcaccctagctccaggc

SEQ ID NO: 733105 - DNA, 20 bp, Artificial
  CRISPR gRNA sequence
ccaggcaggtatatcactgc

SEQ ID NO: 733106 - DNA, 20 bp, Artificial
  CRISPR gRNA sequence
gctggctgcatttccccact

SEQ ID NO: 733107 - DNA, 20 bp, Artificial
  CRISPR gRNA sequence
ctggctgcatttccccactt

SEQ ID NO: 733108 - DNA, 20 bp, Artificial
  CRISPR gRNA sequence
tggctgcatttccccacttg

SEQ ID NO: 733109 - DNA, 20 bp, Artificial
  CRISPR gRNA sequence
catttccccacttggggttc

SEQ ID NO: 733110 - DNA, 20 bp, Artificial
  CRISPR gRNA sequence
atttccccacttggggttct

SEQ ID NO: 733111 - DNA, 20 bp, Artificial
  CRISPR gRNA sequence
ttccccacttggggttctag

SEQ ID NO: 733112 - DNA, 20 bp, Artificial
  CRISPR gRNA sequence
tccccacttggggttctagg

SEQ ID NO: 733113 - DNA, 20 bp, Artificial
  CRISPR gRNA sequence
tcttaaacttaacatgacaa

SEQ ID NO: 733114 - DNA, 20 bp, Artificial
  CRISPR gRNA sequence
ttaaacttaacatgacaaaa

SEQ ID NO: 733115 - DNA, 20 bp, Artificial
  CRISPR gRNA sequence
aaacttaacatgacaaaaga

SEQ ID NO: 733116 - DNA, 20 bp, Artificial
  CRISPR gRNA sequence
ttgatttttctcctccaaat

SEQ ID NO: 733117 - DNA, 20 bp, Artificial
  CRISPR gRNA sequence
ctccaaattagctcctcttt

SEQ ID NO: 733118 - DNA, 20 bp, Artificial
  CRISPR gRNA sequence
gatttaccctacgctatcaa

SEQ ID NO: 733119 - DNA, 20 bp, Artificial
  CRISPR gRNA sequence
tcatccacctgctgatcaaa

SEQ ID NO: 733120 - DNA, 20 bp, Artificial
  CRISPR gRNA sequence
gctgatcaaatagaaaacct

SEQ ID NO: 733121 - DNA, 20 bp, Artificial
  CRISPR gRNA sequence
tcatccatgattcctccttt

SEQ ID NO: 733122 - DNA, 20 bp, Artificial
  CRISPR gRNA sequence
ttttggctcacccctcaact

SEQ ID NO: 733123 - DNA, 20 bp, Artificial
  CRISPR gRNA sequence
gtcctaccttcaaaacatat

SEQ ID NO: 733124 - DNA, 20 bp, Artificial
  CRISPR gRNA sequence
ttcaaaacatatgagctgaa

SEQ ID NO: 733125 - DNA, 20 bp, Artificial
  CRISPR gRNA sequence
aaacatatgagctgaacaga

SEQ ID NO: 733126 - DNA, 20 bp, Artificial
  CRISPR gRNA sequence
aacagaaagtctgaaaaaca

SEQ ID NO: 733127 - DNA, 20 bp, Artificial
  CRISPR gRNA sequence
agtctgaaaaacatagattt

SEQ ID NO: 733128 - DNA, 20 bp, Artificial
  CRISPR gRNA sequence
cattcacatctctctgccac

SEQ ID NO: 733129 - DNA, 20 bp, Artificial
  CRISPR gRNA sequence
ctagtgcctacattgtactc

SEQ ID NO: 733130 - DNA, 20 bp, Artificial
  CRISPR gRNA sequence
tagtgcctacattgtactcc

SEQ ID NO: 733131 - DNA, 20 bp, Artificial
  CRISPR gRNA sequence
ctccaggccactgttgtttc

SEQ ID NO: 733132 - DNA, 20 bp, Artificial
  CRISPR gRNA sequence
aggccactgttgtttccagc

SEQ ID NO: 733133 - DNA, 20 bp, Artificial
  CRISPR gRNA sequence
ttccagccagatgcccacaa

SEQ ID NO: 733134 - DNA, 20 bp, Artificial
  CRISPR gRNA sequence
attcacaatccatcctcaac

SEQ ID NO: 733135 - DNA, 20 bp, Artificial
  CRISPR gRNA sequence
cacaatccatcctcaacaag

SEQ ID NO: 733136 - DNA, 20 bp, Artificial
  CRISPR gRNA sequence
gccactacattcttaaaaac

SEQ ID NO: 733137 - DNA, 20 bp, Artificial
  CRISPR gRNA sequence
ttcttaaaaacaagtcatga

SEQ ID NO: 733138 - DNA, 20 bp, Artificial
  CRISPR gRNA sequence
acaagtcatgacagctctct

SEQ ID NO: 733139 - DNA, 20 bp, Artificial
  CRISPR gRNA sequence
tgacagctctctgagctctc

SEQ ID NO: 733140 - DNA, 20 bp, Artificial
  CRISPR gRNA sequence
cagctctctgagctctctag

SEQ ID NO: 733141 - DNA, 20 bp, Artificial
  CRISPR gRNA sequence
tatacctaaattccaactta

SEQ ID NO: 733142 - DNA, 20 bp, Artificial
  CRISPR gRNA sequence
aaattccaacttatggtctt

SEQ ID NO: 733143 - DNA, 20 bp, Artificial
  CRISPR gRNA sequence
aattccaacttatggtcttc

SEQ ID NO: 733144 - DNA, 20 bp, Artificial
  CRISPR gRNA sequence
attccaacttatggtcttca

SEQ ID NO: 733145 - DNA, 20 bp, Artificial
  CRISPR gRNA sequence
tcattgcctcacactccata

SEQ ID NO: 733146 - DNA, 20 bp, Artificial
  CRISPR gRNA sequence
attgcctcacactccatata

SEQ ID NO: 733147 - DNA, 20 bp, Artificial
  CRISPR gRNA sequence
tccatatagagtgactaaat

SEQ ID NO: 733148 - DNA, 20 bp, Artificial
  CRISPR gRNA sequence
tgactaaataagccttatac

SEQ ID NO: 733149 - DNA, 20 bp, Artificial
  CRISPR gRNA sequence
aaataagccttatacaagcc

SEQ ID NO: 733150 - DNA, 20 bp, Artificial
  CRISPR gRNA sequence
agccaagctccttctgacct

SEQ ID NO: 733151 - DNA, 20 bp, Artificial
  CRISPR gRNA sequence
gccaagctccttctgacctc

SEQ ID NO: 733152 - DNA, 20 bp, Artificial
  CRISPR gRNA sequence
cctcaggacctttgcatatt

SEQ ID NO: 733153 - DNA, 20 bp, Artificial
  CRISPR gRNA sequence
catattcagctcttgcgaca

SEQ ID NO: 733154 - DNA, 20 bp, Artificial
  CRISPR gRNA sequence
ttgcgacaaagtgctcttca

SEQ ID NO: 733155 - DNA, 20 bp, Artificial
  CRISPR gRNA sequence
aaagtgctcttcaaagcacc

SEQ ID NO: 733156 - DNA, 20 bp, Artificial
  CRISPR gRNA sequence
tcaaagcacccagatttcaa

SEQ ID NO: 733157 - DNA, 20 bp, Artificial
  CRISPR gRNA sequence
caaagcacccagatttcaac

SEQ ID NO: 733158 - DNA, 20 bp, Artificial
  CRISPR gRNA sequence
aaagcacccagatttcaaca

SEQ ID NO: 733159 - DNA, 20 bp, Artificial
  CRISPR gRNA sequence
cacccagatttcaacagggc

SEQ ID NO: 733160 - DNA, 20 bp, Artificial
  CRISPR gRNA sequence
gctggaaaatgctcaccatt

SEQ ID NO: 733161 - DNA, 20 bp, Artificial
  CRISPR gRNA sequence
ctggaaaatgctcaccattc

SEQ ID NO: 733162 - DNA, 20 bp, Artificial
  CRISPR gRNA sequence
tggaaaatgctcaccattca

SEQ ID NO: 733163 - DNA, 20 bp, Artificial
  CRISPR gRNA sequence
tcaccattcagggctctgct

SEQ ID NO: 733164 - DNA, 20 bp, Artificial
  CRISPR gRNA sequence
tctgcttggtgttgtctgct

SEQ ID NO: 733165 - DNA, 20 bp, Artificial
  CRISPR gRNA sequence
ctgcttggtgttgtctgcta

SEQ ID NO: 733166 - DNA, 20 bp, Artificial
  CRISPR gRNA sequence
tgcttggtgttgtctgctaa

SEQ ID NO: 733167 - DNA, 20 bp, Artificial
  CRISPR gRNA sequence
cttggtgttgtctgctaagg

SEQ ID NO: 733168 - DNA, 20 bp, Artificial
  CRISPR gRNA sequence
ttggtgttgtctgctaaggg

SEQ ID NO: 733169 - DNA, 20 bp, Artificial
  CRISPR gRNA sequence
gggaggtgttctctgacccc

SEQ ID NO: 733170 - DNA, 20 bp, Artificial
  CRISPR gRNA sequence
ttctctgacccccagtactt

SEQ ID NO: 733171 - DNA, 20 bp, Artificial
  CRISPR gRNA sequence
tctgacccccagtacttcag

SEQ ID NO: 733172 - DNA, 20 bp, Artificial
  CRISPR gRNA sequence
tcagtagctcccccaccacc

SEQ ID NO: 733173 - DNA, 20 bp, Artificial
  CRISPR gRNA sequence
cccaccaccgagtcgcttac

SEQ ID NO: 733174 - DNA, 20 bp, Artificial
  CRISPR gRNA sequence
tactagttcatgaacacctc

SEQ ID NO: 733175 - DNA, 20 bp, Artificial
  CRISPR gRNA sequence
ttatttgcaattatttgaaa

SEQ ID NO: 733176 - DNA, 20 bp, Artificial
  CRISPR gRNA sequence
caattatttgaaacagttcc

SEQ ID NO: 733177 - DNA, 20 bp, Artificial
  CRISPR gRNA sequence
gttttctgcaattatttgtc

SEQ ID NO: 733178 - DNA, 20 bp, Artificial
  CRISPR gRNA sequence
caattatttgtctggataat

SEQ ID NO: 733179 - DNA, 20 bp, Artificial
  CRISPR gRNA sequence
agtgtgcctgtcatctccca

SEQ ID NO: 733180 - DNA, 20 bp, Artificial
  CRISPR gRNA sequence
gcctgtcatctcccatagtg

SEQ ID NO: 733181 - DNA, 20 bp, Artificial
  CRISPR gRNA sequence
cctgtcatctcccatagtgc

SEQ ID NO: 733182 - DNA, 20 bp, Artificial
  CRISPR gRNA sequence
ctcccatagtgcaggattgt

SEQ ID NO: 733183 - DNA, 20 bp, Artificial
  CRISPR gRNA sequence
gtttttgctcactgtctcct

SEQ ID NO: 733184 - DNA, 20 bp, Artificial
  CRISPR gRNA sequence
ttttgctcactgtctcctta

SEQ ID NO: 733185 - DNA, 20 bp, Artificial
  CRISPR gRNA sequence
ctcactgtctccttagagcc

SEQ ID NO: 733186 - DNA, 20 bp, Artificial
  CRISPR gRNA sequence
tgtctccttagagcctagaa

SEQ ID NO: 733187 - DNA, 20 bp, Artificial
  CRISPR gRNA sequence
gaatagtgcctgccccataa

SEQ ID NO: 733188 - DNA, 20 bp, Artificial
  CRISPR gRNA sequence
aatagtgcctgccccataat

SEQ ID NO: 733189 - DNA, 20 bp, Artificial
  CRISPR gRNA sequence
atagtgcctgccccataata

SEQ ID NO: 733190 - DNA, 20 bp, Artificial
  CRISPR gRNA sequence
tagtgcctgccccataatag

SEQ ID NO: 733191 - DNA, 20 bp, Artificial
  CRISPR gRNA sequence
gggctcaatgaattatgttg

SEQ ID NO: 733192 - DNA, 20 bp, Artificial
  CRISPR gRNA sequence
atgaattatgttgaagcaat

SEQ ID NO: 733193 - DNA, 20 bp, Artificial
  CRISPR gRNA sequence
agcaatgagtgaataaaaca

SEQ ID NO: 733194 - DNA, 20 bp, Artificial
  CRISPR gRNA sequence
tgagtgaataaaacacagca

SEQ ID NO: 733195 - DNA, 20 bp, Artificial
  CRISPR gRNA sequence
tgaataaaacacagcacaga

SEQ ID NO: 733196 - DNA, 20 bp, Artificial
  CRISPR gRNA sequence
aacacagcacagacagtgcc

SEQ ID NO: 733197 - DNA, 20 bp, Artificial
  CRISPR gRNA sequence
gccaagtttgaaccttatct

SEQ ID NO: 733198 - DNA, 20 bp, Artificial
  CRISPR gRNA sequence
accttatctcagccacctgc

SEQ ID NO: 733199 - DNA, 20 bp, Artificial
  CRISPR gRNA sequence
tctcagccacctgctagctc

SEQ ID NO: 733200 - DNA, 20 bp, Artificial
  CRISPR gRNA sequence
ctcagccacctgctagctct

SEQ ID NO: 733201 - DNA, 20 bp, Artificial
  CRISPR gRNA sequence
acctgctagctctgggaccc

SEQ ID NO: 733202 - DNA, 20 bp, Artificial
  CRISPR gRNA sequence
ctagctctgggaccccggac

SEQ ID NO: 733203 - DNA, 20 bp, Artificial
  CRISPR gRNA sequence
tctgggaccccggacaagct

SEQ ID NO: 733204 - DNA, 20 bp, Artificial
  CRISPR gRNA sequence
tgggaccccggacaagctca

SEQ ID NO: 733205 - DNA, 20 bp, Artificial
  CRISPR gRNA sequence
ggacaagctcagagtcacac

SEQ ID NO: 733206 - DNA, 20 bp, Artificial
  CRISPR gRNA sequence
gacaagctcagagtcacact

SEQ ID NO: 733207 - DNA, 20 bp, Artificial
  CRISPR gRNA sequence
tcagagtcacactgggtttt

SEQ ID NO: 733208 - DNA, 20 bp, Artificial
  CRISPR gRNA sequence
cagagtcacactgggttttc

SEQ ID NO: 733209 - DNA, 20 bp, Artificial
  CRISPR gRNA sequence
cattatcttcatctgtaaaa

SEQ ID NO: 733210 - DNA, 20 bp, Artificial
  CRISPR gRNA sequence
catctgtaaaatggtgacaa

SEQ ID NO: 733211 - DNA, 20 bp, Artificial
  CRISPR gRNA sequence
ggtgacaatagtgccacgaa

SEQ ID NO: 733212 - DNA, 20 bp, Artificial
  CRISPR gRNA sequence
gtgccacgaatagtgccata

SEQ ID NO: 733213 - DNA, 20 bp, Artificial
  CRISPR gRNA sequence
tgccacgaatagtgccataa

SEQ ID NO: 733214 - DNA, 20 bp, Artificial
  CRISPR gRNA sequence
aaggcactctgaaaacacta

SEQ ID NO: 733215 - DNA, 20 bp, Artificial
  CRISPR gRNA sequence
cagtgcaacatgaccactga

SEQ ID NO: 733216 - DNA, 20 bp, Artificial
  CRISPR gRNA sequence
atccttattatctctgatgt

SEQ ID NO: 733217 - DNA, 20 bp, Artificial
  CRISPR gRNA sequence
cttattatctctgatgttag

SEQ ID NO: 733218 - DNA, 20 bp, Artificial
  CRISPR gRNA sequence
tattatctctgatgttagtg

SEQ ID NO: 733219 - DNA, 20 bp, Artificial
  CRISPR gRNA sequence
tctctgatgttagtggagtg

SEQ ID NO: 733220 - DNA, 20 bp, Artificial
  CRISPR gRNA sequence
ctctgatgttagtggagtgt

SEQ ID NO: 733221 - DNA, 20 bp, Artificial
  CRISPR gRNA sequence
tctgatgttagtggagtgtg

SEQ ID NO: 733222 - DNA, 20 bp, Artificial
  CRISPR gRNA sequence
gatgttagtggagtgtgggg

SEQ ID NO: 733223 - DNA, 20 bp, Artificial
  CRISPR gRNA sequence
atgttagtggagtgtggggc

SEQ ID NO: 733224 - DNA, 20 bp, Artificial
  CRISPR gRNA sequence
gttagtggagtgtggggcag

SEQ ID NO: 733225 - DNA, 20 bp, Artificial
  CRISPR gRNA sequence
ttagtggagtgtggggcagg

SEQ ID NO: 733226 - DNA, 20 bp, Artificial
  CRISPR gRNA sequence
tagtggagtgtggggcagga

SEQ ID NO: 733227 - DNA, 20 bp, Artificial
  CRISPR gRNA sequence
gggactccctccacccgtcc

SEQ ID NO: 733228 - DNA, 20 bp, Artificial
  CRISPR gRNA sequence
gactccctccacccgtccca

SEQ ID NO: 733229 - DNA, 20 bp, Artificial
  CRISPR gRNA sequence
cacccgtcccagagccactg

SEQ ID NO: 733230 - DNA, 20 bp, Artificial
  CRISPR gRNA sequence
gccactgcagcctgctcacc

SEQ ID NO: 733231 - DNA, 20 bp, Artificial
  CRISPR gRNA sequence
cactgcagcctgctcacctg

SEQ ID NO: 733232 - DNA, 20 bp, Artificial
  CRISPR gRNA sequence
tgctcacctggagacacatc

SEQ ID NO: 733233 - DNA, 20 bp, Artificial
  CRISPR gRNA sequence
cacctggagacacatccagc

SEQ ID NO: 733234 - DNA, 20 bp, Artificial
  CRISPR gRNA sequence
ctggagacacatccagctgg

SEQ ID NO: 733235 - DNA, 20 bp, Artificial
  CRISPR gRNA sequence
catccagctggaagcccatc

SEQ ID NO: 733236 - DNA, 20 bp, Artificial
  CRISPR gRNA sequence
atccagctggaagcccatca

SEQ ID NO: 733237 - DNA, 20 bp, Artificial
  CRISPR gRNA sequence
tccagctggaagcccatcaa

SEQ ID NO: 733238 - DNA, 20 bp, Artificial
  CRISPR gRNA sequence
ccagctggaagcccatcaag

SEQ ID NO: 733239 - DNA, 20 bp, Artificial
  CRISPR gRNA sequence
tggaagcccatcaaggggta

SEQ ID NO: 733240 - DNA, 20 bp, Artificial
  CRISPR gRNA sequence
ggaagcccatcaaggggtac

SEQ ID NO: 733241 - DNA, 20 bp, Artificial
  CRISPR gRNA sequence
catcaaggggtacaggatcc

SEQ ID NO: 733242 - DNA, 20 bp, Artificial
  CRISPR gRNA sequence
tcaaggggtacaggatccca

SEQ ID NO: 733243 - DNA, 20 bp, Artificial
  CRISPR gRNA sequence
caaggggtacaggatcccag

SEQ ID NO: 733244 - DNA, 20 bp, Artificial
  CRISPR gRNA sequence
cagaggtgttgcgcatgcac

SEQ ID NO: 733245 - DNA, 20 bp, Artificial
  CRISPR gRNA sequence
tgttgcgcatgcaccagtat

SEQ ID NO: 733246 - DNA, 20 bp, Artificial
  CRISPR gRNA sequence
gcatgcaccagtatcggcct

SEQ ID NO: 733247 - DNA, 20 bp, Artificial
  CRISPR gRNA sequence
accagtatcggcctgagtcc

SEQ ID NO: 733248 - DNA, 20 bp, Artificial
  CRISPR gRNA sequence
cagtatcggcctgagtcctg

SEQ ID NO: 733249 - DNA, 20 bp, Artificial
  CRISPR gRNA sequence
cggcctgagtcctggagctt

SEQ ID NO: 733250 - DNA, 20 bp, Artificial
  CRISPR gRNA sequence
ggcctgagtcctggagcttg

SEQ ID NO: 733251 - DNA, 20 bp, Artificial
  CRISPR gRNA sequence
gcctgagtcctggagcttga

SEQ ID NO: 733252 - DNA, 20 bp, Artificial
  CRISPR gRNA sequence
ctggagcttgagggccacca

SEQ ID NO: 733253 - DNA, 20 bp, Artificial
  CRISPR gRNA sequence
catggtgatgttgaccacct

SEQ ID NO: 733254 - DNA, 20 bp, Artificial
  CRISPR gRNA sequence
tgatgttgaccaccttggcc

SEQ ID NO: 733255 - DNA, 20 bp, Artificial
  CRISPR gRNA sequence
gatgttgaccaccttggcct

SEQ ID NO: 733256 - DNA, 20 bp, Artificial
  CRISPR gRNA sequence
ttggcctgggcatcgtcctg

SEQ ID NO: 733257 - DNA, 20 bp, Artificial
  CRISPR gRNA sequence
cctgggcatcgtcctgcagc

SEQ ID NO: 733258 - DNA, 20 bp, Artificial
  CRISPR gRNA sequence
gggcatcgtcctgcagcaag

SEQ ID NO: 733259 - DNA, 20 bp, Artificial
  CRISPR gRNA sequence
catcgtcctgcagcaagtag

SEQ ID NO: 733260 - DNA, 20 bp, Artificial
  CRISPR gRNA sequence
atcgtcctgcagcaagtagc

SEQ ID NO: 733261 - DNA, 20 bp, Artificial
  CRISPR gRNA sequence
tcgtcctgcagcaagtagcg

SEQ ID NO: 733262 - DNA, 20 bp, Artificial
  CRISPR gRNA sequence
agtagcggggccctttcacc

SEQ ID NO: 733263 - DNA, 20 bp, Artificial
  CRISPR gRNA sequence
ggggccctttcacccagact

SEQ ID NO: 733264 - DNA, 20 bp, Artificial
  CRISPR gRNA sequence
gggccctttcacccagactc

SEQ ID NO: 733265 - DNA, 20 bp, Artificial
  CRISPR gRNA sequence
ctttcacccagactcgggca

SEQ ID NO: 733266 - DNA, 20 bp, Artificial
  CRISPR gRNA sequence
cacccagactcgggcaaagc

SEQ ID NO: 733267 - DNA, 20 bp, Artificial
  CRISPR gRNA sequence
acccagactcgggcaaagcc

SEQ ID NO: 733268 - DNA, 20 bp, Artificial
  CRISPR gRNA sequence
accaaaccttgccctccacg

SEQ ID NO: 733269 - DNA, 20 bp, Artificial
  CRISPR gRNA sequence
tgccctccacgcggtttttg

SEQ ID NO: 733270 - DNA, 20 bp, Artificial
  CRISPR gRNA sequence
cgcggtttttgtagccctta

SEQ ID NO: 733271 - DNA, 20 bp, Artificial
  CRISPR gRNA sequence
gcggtttttgtagcccttat

SEQ ID NO: 733272 - DNA, 20 bp, Artificial
  CRISPR gRNA sequence
ggtttttgtagcccttatag

SEQ ID NO: 733273 - DNA, 20 bp, Artificial
  CRISPR gRNA sequence
gcccttataggagcactgca

SEQ ID NO: 733274 - DNA, 20 bp, Artificial
  CRISPR gRNA sequence
ttataggagcactgcacaga

SEQ ID NO: 733275 - DNA, 20 bp, Artificial
  CRISPR gRNA sequence
ataggagcactgcacagaca

SEQ ID NO: 733276 - DNA, 20 bp, Artificial
  CRISPR gRNA sequence
acagacagagtctccccttc

SEQ ID NO: 733277 - DNA, 20 bp, Artificial
  CRISPR gRNA sequence
cagacagagtctccccttca

SEQ ID NO: 733278 - DNA, 20 bp, Artificial
  CRISPR gRNA sequence
gacagagtctccccttcaag

SEQ ID NO: 733279 - DNA, 20 bp, Artificial
  CRISPR gRNA sequence
cacttttgtgtatacactgt

SEQ ID NO: 733280 - DNA, 20 bp, Artificial
  CRISPR gRNA sequence
ttttgtgtatacactgtcag

SEQ ID NO: 733281 - DNA, 20 bp, Artificial
  CRISPR gRNA sequence
ttgtgtatacactgtcagca

SEQ ID NO: 733282 - DNA, 20 bp, Artificial
  CRISPR gRNA sequence
tgtgtatacactgtcagcag

SEQ ID NO: 733283 - DNA, 20 bp, Artificial
  CRISPR gRNA sequence
gtgtatacactgtcagcaga

SEQ ID NO: 733284 - DNA, 20 bp, Artificial
  CRISPR gRNA sequence
tgtatacactgtcagcagag

SEQ ID NO: 733285 - DNA, 20 bp, Artificial
  CRISPR gRNA sequence
actgtcagcagaggggcctg

SEQ ID NO: 733286 - DNA, 20 bp, Artificial
  CRISPR gRNA sequence
tgtcagcagaggggcctgtg

SEQ ID NO: 733287 - DNA, 20 bp, Artificial
  CRISPR gRNA sequence
ggagacaatacttattgaat

SEQ ID NO: 733288 - DNA, 20 bp, Artificial
  CRISPR gRNA sequence
gagacaatacttattgaata

SEQ ID NO: 733289 - DNA, 20 bp, Artificial
  CRISPR gRNA sequence
aatacttattgaataaggtc

SEQ ID NO: 733290 - DNA, 20 bp, Artificial
  CRISPR gRNA sequence
cttattgaataaggtctggc

SEQ ID NO: 733291 - DNA, 20 bp, Artificial
  CRISPR gRNA sequence
tattgaataaggtctggcaa

SEQ ID NO: 733292 - DNA, 20 bp, Artificial
  CRISPR gRNA sequence
attgaataaggtctggcaag

SEQ ID NO: 733293 - DNA, 20 bp, Artificial
  CRISPR gRNA sequence
tgaataaggtctggcaagag

SEQ ID NO: 733294 - DNA, 20 bp, Artificial
  CRISPR gRNA sequence
aataaggtctggcaagagga

SEQ ID NO: 733295 - DNA, 20 bp, Artificial
  CRISPR gRNA sequence
ataaggtctggcaagaggag

SEQ ID NO: 733296 - DNA, 20 bp, Artificial
  CRISPR gRNA sequence
aggtctggcaagaggagagg

SEQ ID NO: 733297 - DNA, 20 bp, Artificial
  CRISPR gRNA sequence
tctggcaagaggagaggaag

SEQ ID NO: 733298 - DNA, 20 bp, Artificial
  CRISPR gRNA sequence
agaggaagaagacatcatga

SEQ ID NO: 733299 - DNA, 20 bp, Artificial
  CRISPR gRNA sequence
agaagacatcatgaaagttg

SEQ ID NO: 733300 - DNA, 20 bp, Artificial
  CRISPR gRNA sequence
atcatgaaagttgaagatca

SEQ ID NO: 733301 - DNA, 20 bp, Artificial
  CRISPR gRNA sequence
gaaagttgaagatcatggtg

SEQ ID NO: 733302 - DNA, 20 bp, Artificial
  CRISPR gRNA sequence
aaagttgaagatcatggtga

SEQ ID NO: 733303 - DNA, 20 bp, Artificial
  CRISPR gRNA sequence
aagttgaagatcatggtgaa

SEQ ID NO: 733304 - DNA, 20 bp, Artificial
  CRISPR gRNA sequence
ttgaagatcatggtgaaggg

SEQ ID NO: 733305 - DNA, 20 bp, Artificial
  CRISPR gRNA sequence
gaagatcatggtgaagggta

SEQ ID NO: 733306 - DNA, 20 bp, Artificial
  CRISPR gRNA sequence
gatcatggtgaagggtagag

SEQ ID NO: 733307 - DNA, 20 bp, Artificial
  CRISPR gRNA sequence
tggatattgtcctgctgtca

SEQ ID NO: 733308 - DNA, 20 bp, Artificial
  CRISPR gRNA sequence
tcctgctgtcacagaaccca

SEQ ID NO: 733309 - DNA, 20 bp, Artificial
  CRISPR gRNA sequence
tgtcacagaacccacagatt

SEQ ID NO: 733310 - DNA, 20 bp, Artificial
  CRISPR gRNA sequence
gtcacagaacccacagattg

SEQ ID NO: 733311 - DNA, 20 bp, Artificial
  CRISPR gRNA sequence
tcacagaacccacagattga

SEQ ID NO: 733312 - DNA, 20 bp, Artificial
  CRISPR gRNA sequence
cacagaacccacagattgag

SEQ ID NO: 733313 - DNA, 20 bp, Artificial
  CRISPR gRNA sequence
acagaacccacagattgagg

SEQ ID NO: 733314 - DNA, 20 bp, Artificial
  CRISPR gRNA sequence
cacagattgagggggaaata

SEQ ID NO: 733315 - DNA, 20 bp, Artificial
  CRISPR gRNA sequence
gggaaatacagccccgcctt

SEQ ID NO: 733316 - DNA, 20 bp, Artificial
  CRISPR gRNA sequence
ggaaatacagccccgccttc

SEQ ID NO: 733317 - DNA, 20 bp, Artificial
  CRISPR gRNA sequence
gaaatacagccccgccttca

SEQ ID NO: 733318 - DNA, 20 bp, Artificial
  CRISPR gRNA sequence
aatacagccccgccttcagg

SEQ ID NO: 733319 - DNA, 20 bp, Artificial
  CRISPR gRNA sequence
agggagcttgccccaatctg

SEQ ID NO: 733320 - DNA, 20 bp, Artificial
  CRISPR gRNA sequence
gggagcttgccccaatctga

SEQ ID NO: 733321 - DNA, 20 bp, Artificial
  CRISPR gRNA sequence
ggagcttgccccaatctgaa

SEQ ID NO: 733322 - DNA, 20 bp, Artificial
  CRISPR gRNA sequence
agcttgccccaatctgaagg

SEQ ID NO: 733323 - DNA, 20 bp, Artificial
  CRISPR gRNA sequence
gcttgccccaatctgaaggg

SEQ ID NO: 733324 - DNA, 20 bp, Artificial
  CRISPR gRNA sequence
ccaatctgaagggaggtgaa

SEQ ID NO: 733325 - DNA, 20 bp, Artificial
  CRISPR gRNA sequence
caatctgaagggaggtgaat

SEQ ID NO: 733326 - DNA, 20 bp, Artificial
  CRISPR gRNA sequence
aggtgaatgggccctgaaaa

SEQ ID NO: 733327 - DNA, 20 bp, Artificial
  CRISPR gRNA sequence
gaatgggccctgaaaacagc

SEQ ID NO: 733328 - DNA, 20 bp, Artificial
  CRISPR gRNA sequence
ccctgaaaacagctagcttc

SEQ ID NO: 733329 - DNA, 20 bp, Artificial
  CRISPR gRNA sequence
acagctagcttccagtatta

SEQ ID NO: 733330 - DNA, 20 bp, Artificial
  CRISPR gRNA sequence
gctagcttccagtattacag

SEQ ID NO: 733331 - DNA, 20 bp, Artificial
  CRISPR gRNA sequence
tagcttccagtattacagtg

SEQ ID NO: 733332 - DNA, 20 bp, Artificial
  CRISPR gRNA sequence
ggagacacaacccccgctct

SEQ ID NO: 733333 - DNA, 20 bp, Artificial
  CRISPR gRNA sequence
gagacacaacccccgctctc

SEQ ID NO: 733334 - DNA, 20 bp, Artificial
  CRISPR gRNA sequence
agacacaacccccgctctca

SEQ ID NO: 733335 - DNA, 20 bp, Artificial
  CRISPR gRNA sequence
acacaacccccgctctcagg

SEQ ID NO: 733336 - DNA, 20 bp, Artificial
  CRISPR gRNA sequence
ccccgctctcagggagcttt

SEQ ID NO: 733337 - DNA, 20 bp, Artificial
  CRISPR gRNA sequence
tcagggagctttcagtctga

SEQ ID NO: 733338 - DNA, 20 bp, Artificial
  CRISPR gRNA sequence
agggagctttcagtctgatg

SEQ ID NO: 733339 - DNA, 20 bp, Artificial
  CRISPR gRNA sequence
gggagctttcagtctgatgg

SEQ ID NO: 733340 - DNA, 20 bp, Artificial
  CRISPR gRNA sequence
gagctttcagtctgatggag

SEQ ID NO: 733341 - DNA, 20 bp, Artificial
  CRISPR gRNA sequence
agctttcagtctgatggagg

SEQ ID NO: 733342 - DNA, 20 bp, Artificial
  CRISPR gRNA sequence
tttcagtctgatggaggagg

SEQ ID NO: 733343 - DNA, 20 bp, Artificial
  CRISPR gRNA sequence
ttcagtctgatggaggaggc

SEQ ID NO: 733344 - DNA, 20 bp, Artificial
  CRISPR gRNA sequence
gaggaggcaggtatatccct

SEQ ID NO: 733345 - DNA, 20 bp, Artificial
  CRISPR gRNA sequence
aggcaggtatatccctcagt

SEQ ID NO: 733346 - DNA, 20 bp, Artificial
  CRISPR gRNA sequence
tatatccctcagtgagtccc

SEQ ID NO: 733347 - DNA, 20 bp, Artificial
  CRISPR gRNA sequence
tcagtgagtccccagtctaa

SEQ ID NO: 733348 - DNA, 20 bp, Artificial
  CRISPR gRNA sequence
agtgagtccccagtctaatg

SEQ ID NO: 733349 - DNA, 20 bp, Artificial
  CRISPR gRNA sequence
gtgagtccccagtctaatgg

SEQ ID NO: 733350 - DNA, 20 bp, Artificial
  CRISPR gRNA sequence
ccagtctaatggaggaaacg

SEQ ID NO: 733351 - DNA, 20 bp, Artificial
  CRISPR gRNA sequence
ggaaacgcagcatttacact

SEQ ID NO: 733352 - DNA, 20 bp, Artificial
  CRISPR gRNA sequence
aaacgcagcatttacactcg

SEQ ID NO: 733353 - DNA, 20 bp, Artificial
  CRISPR gRNA sequence
atttacactcggagctccat

SEQ ID NO: 733354 - DNA, 20 bp, Artificial
  CRISPR gRNA sequence
actcggagctccatcagaca

SEQ ID NO: 733355 - DNA, 20 bp, Artificial
  CRISPR gRNA sequence
agacacagcccctttcctca

SEQ ID NO: 733356 - DNA, 20 bp, Artificial
  CRISPR gRNA sequence
cctttcctcatggtattttc

SEQ ID NO: 733357 - DNA, 20 bp, Artificial
  CRISPR gRNA sequence
catggtattttctagtctga

SEQ ID NO: 733358 - DNA, 20 bp, Artificial
  CRISPR gRNA sequence
atggtattttctagtctgat

SEQ ID NO: 733359 - DNA, 20 bp, Artificial
  CRISPR gRNA sequence
tattttctagtctgatggga

SEQ ID NO: 733360 - DNA, 20 bp, Artificial
  CRISPR gRNA sequence
tagtctgatgggaaagtgac

SEQ ID NO: 733361 - DNA, 20 bp, Artificial
  CRISPR gRNA sequence
aaagtgacaagctctgtctt

SEQ ID NO: 733362 - DNA, 20 bp, Artificial
  CRISPR gRNA sequence
aagtgacaagctctgtcttc

SEQ ID NO: 733363 - DNA, 20 bp, Artificial
  CRISPR gRNA sequence
agtgacaagctctgtcttca

SEQ ID NO: 733364 - DNA, 20 bp, Artificial
  CRISPR gRNA sequence
gctctgtcttcagggattcc

SEQ ID NO: 733365 - DNA, 20 bp, Artificial
  CRISPR gRNA sequence
ctctgtcttcagggattccc

SEQ ID NO: 733366 - DNA, 20 bp, Artificial
  CRISPR gRNA sequence
tctgtcttcagggattccca

SEQ ID NO: 733367 - DNA, 20 bp, Artificial
  CRISPR gRNA sequence
ttttgttttgttttgttttt

SEQ ID NO: 733368 - DNA, 20 bp, Artificial
  CRISPR gRNA sequence
gttttgttttgtttttgaga

SEQ ID NO: 733369 - DNA, 20 bp, Artificial
  CRISPR gRNA sequence
tttgttttgtttttgagacg

SEQ ID NO: 733370 - DNA, 20 bp, Artificial
  CRISPR gRNA sequence
cggagtctcgctctgttgcc

SEQ ID NO: 733371 - DNA, 20 bp, Artificial
  CRISPR gRNA sequence
ggagtctcgctctgttgccc

SEQ ID NO: 733372 - DNA, 20 bp, Artificial
  CRISPR gRNA sequence
tctcgctctgttgcccaggc

SEQ ID NO: 733373 - DNA, 20 bp, Artificial
  CRISPR gRNA sequence
tcgctctgttgcccaggctg

SEQ ID NO: 733374 - DNA, 20 bp, Artificial
  CRISPR gRNA sequence
ctgttgcccaggctggagtg

SEQ ID NO: 733375 - DNA, 20 bp, Artificial
  CRISPR gRNA sequence
ttgcccaggctggagtgcag

SEQ ID NO: 733376 - DNA, 20 bp, Artificial
  CRISPR gRNA sequence
ggagtgcagtggcacgatct

SEQ ID NO: 733377 - DNA, 20 bp, Artificial
  CRISPR gRNA sequence
tcactgtaacctccgcctcc

SEQ ID NO: 733378 - DNA, 20 bp, Artificial
  CRISPR gRNA sequence
cactgtaacctccgcctcct

SEQ ID NO: 733379 - DNA, 20 bp, Artificial
  CRISPR gRNA sequence
ttcaaactattctcctgcct

SEQ ID NO: 733380 - DNA, 20 bp, Artificial
  CRISPR gRNA sequence
ttctcctgcctcagcctcct

SEQ ID NO: 733381 - DNA, 20 bp, Artificial
  CRISPR gRNA sequence
tcctgcctcagcctcctgag

SEQ ID NO: 733382 - DNA, 20 bp, Artificial
  CRISPR gRNA sequence
gcctcagcctcctgagtagc

SEQ ID NO: 733383 - DNA, 20 bp, Artificial
  CRISPR gRNA sequence
cctcagcctcctgagtagct

SEQ ID NO: 733384 - DNA, 20 bp, Artificial
  CRISPR gRNA sequence
ctcctgagtagctgggacta

SEQ ID NO: 733385 - DNA, 20 bp, Artificial
  CRISPR gRNA sequence
tcctgagtagctgggactac

SEQ ID NO: 733386 - DNA, 20 bp, Artificial
  CRISPR gRNA sequence
caggtgcctgccaccacgtc

SEQ ID NO: 733387 - DNA, 20 bp, Artificial
  CRISPR gRNA sequence
cggctaattttttgtatttt

SEQ ID NO: 733388 - DNA, 20 bp, Artificial
  CRISPR gRNA sequence
ctaattttttgtatttttag

SEQ ID NO: 733389 - DNA, 20 bp, Artificial
  CRISPR gRNA sequence
aattttttgtatttttagta

SEQ ID NO: 733390 - DNA, 20 bp, Artificial
  CRISPR gRNA sequence
ttttgtatttttagtagaga

SEQ ID NO: 733391 - DNA, 20 bp, Artificial
  CRISPR gRNA sequence
tttgtatttttagtagagac

SEQ ID NO: 733392 - DNA, 20 bp, Artificial
  CRISPR gRNA sequence
gagacgggatttcaccatgt

SEQ ID NO: 733393 - DNA, 20 bp, Artificial
  CRISPR gRNA sequence
cgggatttcaccatgttagc

SEQ ID NO: 733394 - DNA, 20 bp, Artificial
  CRISPR gRNA sequence
gggatttcaccatgttagcc

SEQ ID NO: 733395 - DNA, 20 bp, Artificial
  CRISPR gRNA sequence
tttcaccatgttagccagga

SEQ ID NO: 733396 - DNA, 20 bp, Artificial
  CRISPR gRNA sequence
acttcgtgatccacctgcct

SEQ ID NO: 733397 - DNA, 20 bp, Artificial
  CRISPR gRNA sequence
ccacctgcctcggcctccca

SEQ ID NO: 733398 - DNA, 20 bp, Artificial
  CRISPR gRNA sequence
gcctcggcctcccaaagtgc

SEQ ID NO: 733399 - DNA, 20 bp, Artificial
  CRISPR gRNA sequence
cctcggcctcccaaagtgct

SEQ ID NO: 733400 - DNA, 20 bp, Artificial
  CRISPR gRNA sequence
ctcccaaagtgctgggattg

SEQ ID NO: 733401 - DNA, 20 bp, Artificial
  CRISPR gRNA sequence
tcccaaagtgctgggattgc

SEQ ID NO: 733402 - DNA, 20 bp, Artificial
  CRISPR gRNA sequence
agtgctgggattgcaggcgt

SEQ ID NO: 733403 - DNA, 20 bp, Artificial
  CRISPR gRNA sequence
caggcgtgagccactgtgcc

SEQ ID NO: 733404 - DNA, 20 bp, Artificial
  CRISPR gRNA sequence
agccactgtgcccggcatcc

SEQ ID NO: 733405 - DNA, 20 bp, Artificial
  CRISPR gRNA sequence
gccactgtgcccggcatccc

SEQ ID NO: 733406 - DNA, 20 bp, Artificial
  CRISPR gRNA sequence
ccactgtgcccggcatccca

SEQ ID NO: 733407 - DNA, 20 bp, Artificial
  CRISPR gRNA sequence
ggcatcccagggaattcttg

SEQ ID NO: 733408 - DNA, 20 bp, Artificial
  CRISPR gRNA sequence
gcatcccagggaattcttgt

SEQ ID NO: 733409 - DNA, 20 bp, Artificial
  CRISPR gRNA sequence
gaattcttgtgggaaaaacc

SEQ ID NO: 733410 - DNA, 20 bp, Artificial
  CRISPR gRNA sequence
aattcttgtgggaaaaaccc

SEQ ID NO: 733411 - DNA, 20 bp, Artificial
  CRISPR gRNA sequence
aaaaacccaggtcatgccct

SEQ ID NO: 733412 - DNA, 20 bp, Artificial
  CRISPR gRNA sequence
acccaggtcatgccctcagt

SEQ ID NO: 733413 - DNA, 20 bp, Artificial
  CRISPR gRNA sequence
aggtcatgccctcagtgaga

SEQ ID NO: 733414 - DNA, 20 bp, Artificial
  CRISPR gRNA sequence
tgccctcagtgagacagatg

SEQ ID NO: 733415 - DNA, 20 bp, Artificial
  CRISPR gRNA sequence
ccctcagtgagacagatgca

SEQ ID NO: 733416 - DNA, 20 bp, Artificial
  CRISPR gRNA sequence
cagatgcagagacacaaaca

SEQ ID NO: 733417 - DNA, 20 bp, Artificial
  CRISPR gRNA sequence
agatgcagagacacaaacac

SEQ ID NO: 733418 - DNA, 20 bp, Artificial
  CRISPR gRNA sequence
agacacaaacacaggtcatt

SEQ ID NO: 733419 - DNA, 20 bp, Artificial
  CRISPR gRNA sequence
gtcattaagttgtgaaattt

SEQ ID NO: 733420 - DNA, 20 bp, Artificial
  CRISPR gRNA sequence
aatttcagtgcccaactaac

SEQ ID NO: 733421 - DNA, 20 bp, Artificial
  CRISPR gRNA sequence
atttcagtgcccaactaact

SEQ ID NO: 733422 - DNA, 20 bp, Artificial
  CRISPR gRNA sequence
tcagtgcccaactaactagg

SEQ ID NO: 733423 - DNA, 20 bp, Artificial
  CRISPR gRNA sequence
gcccaactaactaggtagat

SEQ ID NO: 733424 - DNA, 20 bp, Artificial
  CRISPR gRNA sequence
actaggtagataagaaaatc

SEQ ID NO: 733425 - DNA, 20 bp, Artificial
  CRISPR gRNA sequence
gtatttgaaaatatgattaa

SEQ ID NO: 733426 - DNA, 20 bp, Artificial
  CRISPR gRNA sequence
acagttatttatttcacaaa

SEQ ID NO: 733427 - DNA, 20 bp, Artificial
  CRISPR gRNA sequence
cagttatttatttcacaaat

SEQ ID NO: 733428 - DNA, 20 bp, Artificial
  CRISPR gRNA sequence
atttcacaaataggttcact

SEQ ID NO: 733429 - DNA, 20 bp, Artificial
  CRISPR gRNA sequence
ctttaaataataactctcct

SEQ ID NO: 733430 - DNA, 20 bp, Artificial
  CRISPR gRNA sequence
tctccttagttcattccatc

SEQ ID NO: 733431 - DNA, 20 bp, Artificial
  CRISPR gRNA sequence
agttcattccatctggtgtt

SEQ ID NO: 733432 - DNA, 20 bp, Artificial
  CRISPR gRNA sequence
tgtttagttttaaaatattc

SEQ ID NO: 733433 - DNA, 20 bp, Artificial
  CRISPR gRNA sequence
ttctagttacataaaaccca

SEQ ID NO: 733434 - DNA, 20 bp, Artificial
  CRISPR gRNA sequence
ttacataaaacccatagatc

SEQ ID NO: 733435 - DNA, 20 bp, Artificial
  CRISPR gRNA sequence
acatgtaaacaaactcccaa

SEQ ID NO: 733436 - DNA, 20 bp, Artificial
  CRISPR gRNA sequence
atgtaaacaaactcccaatg

SEQ ID NO: 733437 - DNA, 20 bp, Artificial
  CRISPR gRNA sequence
tcccaatggagtgtgaacca

SEQ ID NO: 733438 - DNA, 20 bp, Artificial
  CRISPR gRNA sequence
cccaatggagtgtgaaccac

SEQ ID NO: 733439 - DNA, 20 bp, Artificial
  CRISPR gRNA sequence
aatatctttctctctatgct

SEQ ID NO: 733440 - DNA, 20 bp, Artificial
  CRISPR gRNA sequence
atatctttctctctatgctg

SEQ ID NO: 733441 - DNA, 20 bp, Artificial
  CRISPR gRNA sequence
atctttctctctatgctgag

SEQ ID NO: 733442 - DNA, 20 bp, Artificial
  CRISPR gRNA sequence
ttctctctatgctgaggagt

SEQ ID NO: 733443 - DNA, 20 bp, Artificial
  CRISPR gRNA sequence
ctatgctgaggagtaagatg

SEQ ID NO: 733444 - DNA, 20 bp, Artificial
  CRISPR gRNA sequence
tgaggagtaagatgtggtcc

SEQ ID NO: 733445 - DNA, 20 bp, Artificial
  CRISPR gRNA sequence
gtccaagccttcataatcca

SEQ ID NO: 733446 - DNA, 20 bp, Artificial
  CRISPR gRNA sequence
agccttcataatccacagtc

SEQ ID NO: 733447 - DNA, 20 bp, Artificial
  CRISPR gRNA sequence
cttcataatccacagtctgg

SEQ ID NO: 733448 - DNA, 20 bp, Artificial
  CRISPR gRNA sequence
tcataatccacagtctggta

SEQ ID NO: 733449 - DNA, 20 bp, Artificial
  CRISPR gRNA sequence
aatccacagtctggtagaga

SEQ ID NO: 733450 - DNA, 20 bp, Artificial
  CRISPR gRNA sequence
tccacagtctggtagagaca

SEQ ID NO: 733451 - DNA, 20 bp, Artificial
  CRISPR gRNA sequence
acagtctggtagagacagag

SEQ ID NO: 733452 - DNA, 20 bp, Artificial
  CRISPR gRNA sequence
tggtagagacagagcagaac

SEQ ID NO: 733453 - DNA, 20 bp, Artificial
  CRISPR gRNA sequence
ggtagagacagagcagaact

SEQ ID NO: 733454 - DNA, 20 bp, Artificial
  CRISPR gRNA sequence
gtagagacagagcagaactg

SEQ ID NO: 733455 - DNA, 20 bp, Artificial
  CRISPR gRNA sequence
cagagcagaactggggtgtg

SEQ ID NO: 733456 - DNA, 20 bp, Artificial
  CRISPR gRNA sequence
agagcagaactggggtgtgc

SEQ ID NO: 733457 - DNA, 20 bp, Artificial
  CRISPR gRNA sequence
gagcagaactggggtgtgca

SEQ ID NO: 733458 - DNA, 20 bp, Artificial
  CRISPR gRNA sequence
ctggggtgtgcagggtgact

SEQ ID NO: 733459 - DNA, 20 bp, Artificial
  CRISPR gRNA sequence
tggggtgtgcagggtgactc

SEQ ID NO: 733460 - DNA, 20 bp, Artificial
  CRISPR gRNA sequence
ggggtgtgcagggtgactca

SEQ ID NO: 733461 - DNA, 20 bp, Artificial
  CRISPR gRNA sequence
gggtgtgcagggtgactcag

SEQ ID NO: 733462 - DNA, 20 bp, Artificial
  CRISPR gRNA sequence
gtgcagggtgactcagggga

SEQ ID NO: 733463 - DNA, 20 bp, Artificial
  CRISPR gRNA sequence
gcagggtgactcaggggaca

SEQ ID NO: 733464 - DNA, 20 bp, Artificial
  CRISPR gRNA sequence
agggtgactcaggggacaga

SEQ ID NO: 733465 - DNA, 20 bp, Artificial
  CRISPR gRNA sequence
ggtgactcaggggacagaga

SEQ ID NO: 733466 - DNA, 20 bp, Artificial
  CRISPR gRNA sequence
gtgactcaggggacagagag

SEQ ID NO: 733467 - DNA, 20 bp, Artificial
  CRISPR gRNA sequence
tgactcaggggacagagaga

SEQ ID NO: 733468 - DNA, 20 bp, Artificial
  CRISPR gRNA sequence
actcaggggacagagagagg

SEQ ID NO: 733469 - DNA, 20 bp, Artificial
  CRISPR gRNA sequence
aggggacagagagagggaga

SEQ ID NO: 733470 - DNA, 20 bp, Artificial
  CRISPR gRNA sequence
agagagggagaaagctgcct

SEQ ID NO: 733471 - DNA, 20 bp, Artificial
  CRISPR gRNA sequence
gagagggagaaagctgcctt

SEQ ID NO: 733472 - DNA, 20 bp, Artificial
  CRISPR gRNA sequence
tccacccctctgcctgcctt

SEQ ID NO: 733473 - DNA, 20 bp, Artificial
  CRISPR gRNA sequence
ccctctgcctgccttaagct

SEQ ID NO: 733474 - DNA, 20 bp, Artificial
  CRISPR gRNA sequence
ctcttctgataatttcaccc

SEQ ID NO: 733475 - DNA, 20 bp, Artificial
  CRISPR gRNA sequence
cttctgataatttcacccca

SEQ ID NO: 733476 - DNA, 20 bp, Artificial
  CRISPR gRNA sequence
ccaaaaaaaccacatataaa

SEQ ID NO: 733477 - DNA, 20 bp, Artificial
  CRISPR gRNA sequence
tataaaaagactctccccca

SEQ ID NO: 733478 - DNA, 20 bp, Artificial
  CRISPR gRNA sequence
aaaaagactctcccccatag

SEQ ID NO: 733479 - DNA, 20 bp, Artificial
  CRISPR gRNA sequence
aaagactctcccccatagta

SEQ ID NO: 733480 - DNA, 20 bp, Artificial
  CRISPR gRNA sequence
ctctcccccatagtagagaa

SEQ ID NO: 733481 - DNA, 20 bp, Artificial
  CRISPR gRNA sequence
ctcccccatagtagagaaca

SEQ ID NO: 733482 - DNA, 20 bp, Artificial
  CRISPR gRNA sequence
cccccatagtagagaacaga

SEQ ID NO: 733483 - DNA, 20 bp, Artificial
  CRISPR gRNA sequence
agaacagagagcacacattt

SEQ ID NO: 733484 - DNA, 20 bp, Artificial
  CRISPR gRNA sequence
aacagagagcacacattttg

SEQ ID NO: 733485 - DNA, 20 bp, Artificial
  CRISPR gRNA sequence
attttggagtcaaaataaac

SEQ ID NO: 733486 - DNA, 20 bp, Artificial
  CRISPR gRNA sequence
ttttggagtcaaaataaaca

SEQ ID NO: 733487 - DNA, 20 bp, Artificial
  CRISPR gRNA sequence
tttggagtcaaaataaacaa

SEQ ID NO: 733488 - DNA, 20 bp, Artificial
  CRISPR gRNA sequence
gaaaccctgtttctaccact

SEQ ID NO: 733489 - DNA, 20 bp, Artificial
  CRISPR gRNA sequence
accctgtttctaccacttag

SEQ ID NO: 733490 - DNA, 20 bp, Artificial
  CRISPR gRNA sequence
ctaccacttagtggtgtgat

SEQ ID NO: 733491 - DNA, 20 bp, Artificial
  CRISPR gRNA sequence
taccacttagtggtgtgatt

SEQ ID NO: 733492 - DNA, 20 bp, Artificial
  CRISPR gRNA sequence
attaggtcacctgtttgata

SEQ ID NO: 733493 - DNA, 20 bp, Artificial
  CRISPR gRNA sequence
ttgatacagaaatatcaaaa

SEQ ID NO: 733494 - DNA, 20 bp, Artificial
  CRISPR gRNA sequence
aaacagacacttgactgata

SEQ ID NO: 733495 - DNA, 20 bp, Artificial
  CRISPR gRNA sequence
aaatatctctgtttctttat

SEQ ID NO: 733496 - DNA, 20 bp, Artificial
  CRISPR gRNA sequence
tctctgtttctttatcagtc

SEQ ID NO: 733497 - DNA, 20 bp, Artificial
  CRISPR gRNA sequence
tgtttctttatcagtcaagt

SEQ ID NO: 733498 - DNA, 20 bp, Artificial
  CRISPR gRNA sequence
ctttatcagtcaagtgagaa

SEQ ID NO: 733499 - DNA, 20 bp, Artificial
  CRISPR gRNA sequence
gaatagcaccacacccctca

SEQ ID NO: 733500 - DNA, 20 bp, Artificial
  CRISPR gRNA sequence
aatagcaccacacccctcac

SEQ ID NO: 733501 - DNA, 20 bp, Artificial
  CRISPR gRNA sequence
cacccctcacaggttgctgt

SEQ ID NO: 733502 - DNA, 20 bp, Artificial
  CRISPR gRNA sequence
ttgctgtgagaattctgccc

SEQ ID NO: 733503 - DNA, 20 bp, Artificial
  CRISPR gRNA sequence
tgctgtgagaattctgcccc

SEQ ID NO: 733504 - DNA, 20 bp, Artificial
  CRISPR gRNA sequence
gtgagaattctgccccaggt

SEQ ID NO: 733505 - DNA, 20 bp, Artificial
  CRISPR gRNA sequence
ccaggtcagtgctttgcaca

SEQ ID NO: 733506 - DNA, 20 bp, Artificial
  CRISPR gRNA sequence
tgcttccttttcccacatgc

SEQ ID NO: 733507 - DNA, 20 bp, Artificial
  CRISPR gRNA sequence
gcttccttttcccacatgct

SEQ ID NO: 733508 - DNA, 20 bp, Artificial
  CRISPR gRNA sequence
cttccttttcccacatgctg

SEQ ID NO: 733509 - DNA, 20 bp, Artificial
  CRISPR gRNA sequence
tcccacatgctggggcctcc

SEQ ID NO: 733510 - DNA, 20 bp, Artificial
  CRISPR gRNA sequence
gggcctcccagttcccccaa

SEQ ID NO: 733511 - DNA, 20 bp, Artificial
  CRISPR gRNA sequence
ccagttcccccaatggaacc

SEQ ID NO: 733512 - DNA, 20 bp, Artificial
  CRISPR gRNA sequence
agttcccccaatggaaccca

SEQ ID NO: 733513 - DNA, 20 bp, Artificial
  CRISPR gRNA sequence
aatggaacccagagctgtga

SEQ ID NO: 733514 - DNA, 20 bp, Artificial
  CRISPR gRNA sequence
aacccagagctgtgacagtc

SEQ ID NO: 733515 - DNA, 20 bp, Artificial
  CRISPR gRNA sequence
acccagagctgtgacagtca

SEQ ID NO: 733516 - DNA, 20 bp, Artificial
  CRISPR gRNA sequence
cccagagctgtgacagtcaa

SEQ ID NO: 733517 - DNA, 20 bp, Artificial
  CRISPR gRNA sequence
agctgtgacagtcaagggcc

SEQ ID NO: 733518 - DNA, 20 bp, Artificial
  CRISPR gRNA sequence
acagtcaagggcccagaatc

SEQ ID NO: 733519 - DNA, 20 bp, Artificial
  CRISPR gRNA sequence
cagtcaagggcccagaatcc

SEQ ID NO: 733520 - DNA, 20 bp, Artificial
  CRISPR gRNA sequence
atccaggacatctgtcccac

SEQ ID NO: 733521 - DNA, 20 bp, Artificial
  CRISPR gRNA sequence
acatctgtcccaccagaatc

SEQ ID NO: 733522 - DNA, 20 bp, Artificial
  CRISPR gRNA sequence
catctgtcccaccagaatcc

SEQ ID NO: 733523 - DNA, 20 bp, Artificial
  CRISPR gRNA sequence
gaatccaggatatccgtccc

SEQ ID NO: 733524 - DNA, 20 bp, Artificial
  CRISPR gRNA sequence
aggatatccgtcccaagtcc

SEQ ID NO: 733525 - DNA, 20 bp, Artificial
  CRISPR gRNA sequence
tatccgtcccaagtcccagc

SEQ ID NO: 733526 - DNA, 20 bp, Artificial
  CRISPR gRNA sequence
ccgtcccaagtcccagccag

SEQ ID NO: 733527 - DNA, 20 bp, Artificial
  CRISPR gRNA sequence
aagtcccagccagcagccac

SEQ ID NO: 733528 - DNA, 20 bp, Artificial
  CRISPR gRNA sequence
gtcccagccagcagccacta

SEQ ID NO: 733529 - DNA, 20 bp, Artificial
  CRISPR gRNA sequence
agccagcagccactagagct

SEQ ID NO: 733530 - DNA, 20 bp, Artificial
  CRISPR gRNA sequence
gccagcagccactagagctg

SEQ ID NO: 733531 - DNA, 20 bp, Artificial
  CRISPR gRNA sequence
tagagctgaggctctgtgtg

SEQ ID NO: 733532 - DNA, 20 bp, Artificial
  CRISPR gRNA sequence
agctgaggctctgtgtgaag

SEQ ID NO: 733533 - DNA, 20 bp, Artificial
  CRISPR gRNA sequence
tgtgaagcagcaccctctct

SEQ ID NO: 733534 - DNA, 20 bp, Artificial
  CRISPR gRNA sequence
tctgtcccttgcaaactaaa

SEQ ID NO: 733535 - DNA, 20 bp, Artificial
  CRISPR gRNA sequence
aatgatccaacttcattatt

SEQ ID NO: 733536 - DNA, 20 bp, Artificial
  CRISPR gRNA sequence
gatccaacttcattatttgg

SEQ ID NO: 733537 - DNA, 20 bp, Artificial
  CRISPR gRNA sequence
aacttcattatttggtggat

SEQ ID NO: 733538 - DNA, 20 bp, Artificial
  CRISPR gRNA sequence
cattatttggtggatgagcc

SEQ ID NO: 733539 - DNA, 20 bp, Artificial
  CRISPR gRNA sequence
attatttggtggatgagccc

SEQ ID NO: 733540 - DNA, 20 bp, Artificial
  CRISPR gRNA sequence
tggatgagcccaggatttct

SEQ ID NO: 733541 - DNA, 20 bp, Artificial
  CRISPR gRNA sequence
agcccaggatttcttagcac

SEQ ID NO: 733542 - DNA, 20 bp, Artificial
  CRISPR gRNA sequence
cccaggatttcttagcacaa

SEQ ID NO: 733543 - DNA, 20 bp, Artificial
  CRISPR gRNA sequence
caggatttcttagcacaaga

SEQ ID NO: 733544 - DNA, 20 bp, Artificial
  CRISPR gRNA sequence
agagagacccctttctgccc

SEQ ID NO: 733545 - DNA, 20 bp, Artificial
  CRISPR gRNA sequence
gagacccctttctgccctgg

SEQ ID NO: 733546 - DNA, 20 bp, Artificial
  CRISPR gRNA sequence
acccctttctgccctggcag

SEQ ID NO: 733547 - DNA, 20 bp, Artificial
  CRISPR gRNA sequence
cccctttctgccctggcagt

SEQ ID NO: 733548 - DNA, 20 bp, Artificial
  CRISPR gRNA sequence
ctttctgccctggcagtggg

SEQ ID NO: 733549 - DNA, 20 bp, Artificial
  CRISPR gRNA sequence
gaagctgtttctctaccctc

SEQ ID NO: 733550 - DNA, 20 bp, Artificial
  CRISPR gRNA sequence
aagctgtttctctaccctct

SEQ ID NO: 733551 - DNA, 20 bp, Artificial
  CRISPR gRNA sequence
gctgtttctctaccctctgg

SEQ ID NO: 733552 - DNA, 20 bp, Artificial
  CRISPR gRNA sequence
ctgtttctctaccctctggg

SEQ ID NO: 733553 - DNA, 20 bp, Artificial
  CRISPR gRNA sequence
tctctaccctctgggaggtg

SEQ ID NO: 733554 - DNA, 20 bp, Artificial
  CRISPR gRNA sequence
tctaccctctgggaggtgca

SEQ ID NO: 733555 - DNA, 20 bp, Artificial
  CRISPR gRNA sequence
ccctctgggaggtgcagagt

SEQ ID NO: 733556 - DNA, 20 bp, Artificial
  CRISPR gRNA sequence
cctctgggaggtgcagagtt

SEQ ID NO: 733557 - DNA, 20 bp, Artificial
  CRISPR gRNA sequence
ggtgcagagttgggtgacct

SEQ ID NO: 733558 - DNA, 20 bp, Artificial
  CRISPR gRNA sequence
gtgcagagttgggtgacctt

SEQ ID NO: 733559 - DNA, 20 bp, Artificial
  CRISPR gRNA sequence
agagttgggtgaccttggga

SEQ ID NO: 733560 - DNA, 20 bp, Artificial
  CRISPR gRNA sequence
gagttgggtgaccttgggat

SEQ ID NO: 733561 - DNA, 20 bp, Artificial
  CRISPR gRNA sequence
gtgaccttgggatgggtctc

SEQ ID NO: 733562 - DNA, 20 bp, Artificial
  CRISPR gRNA sequence
tgaccttgggatgggtctcc

SEQ ID NO: 733563 - DNA, 20 bp, Artificial
  CRISPR gRNA sequence
gaccttgggatgggtctcca

SEQ ID NO: 733564 - DNA, 20 bp, Artificial
  CRISPR gRNA sequence
tacacctcccacccctctca

SEQ ID NO: 733565 - DNA, 20 bp, Artificial
  CRISPR gRNA sequence
acacctcccacccctctcac

SEQ ID NO: 733566 - DNA, 20 bp, Artificial
  CRISPR gRNA sequence
cctcccacccctctcacagg

SEQ ID NO: 733567 - DNA, 20 bp, Artificial
  CRISPR gRNA sequence
cccacccctctcacaggcag

SEQ ID NO: 733568 - DNA, 20 bp, Artificial
  CRISPR gRNA sequence
cccctctcacaggcagtggt

SEQ ID NO: 733569 - DNA, 20 bp, Artificial
  CRISPR gRNA sequence
ttgccaacccccaccatgcc

SEQ ID NO: 733570 - DNA, 20 bp, Artificial
  CRISPR gRNA sequence
ccaccatgcccagaactgaa

SEQ ID NO: 733571 - DNA, 20 bp, Artificial
  CRISPR gRNA sequence
caccatgcccagaactgaac

SEQ ID NO: 733572 - DNA, 20 bp, Artificial
  CRISPR gRNA sequence
catgcccagaactgaacagg

SEQ ID NO: 733573 - DNA, 20 bp, Artificial
  CRISPR gRNA sequence
gcccagaactgaacaggaag

SEQ ID NO: 733574 - DNA, 20 bp, Artificial
  CRISPR gRNA sequence
ctgaacaggaagtggtaact

SEQ ID NO: 733575 - DNA, 20 bp, Artificial
  CRISPR gRNA sequence
aagtggtaacttggttgcca

SEQ ID NO: 733576 - DNA, 20 bp, Artificial
  CRISPR gRNA sequence
tggtaacttggttgccatgg

SEQ ID NO: 733577 - DNA, 20 bp, Artificial
  CRISPR gRNA sequence
aacttggttgccatggcagc

SEQ ID NO: 733578 - DNA, 20 bp, Artificial
  CRISPR gRNA sequence
cttggttgccatggcagcga

SEQ ID NO: 733579 - DNA, 20 bp, Artificial
  CRISPR gRNA sequence
ttggttgccatggcagcgag

SEQ ID NO: 733580 - DNA, 20 bp, Artificial
  CRISPR gRNA sequence
tggttgccatggcagcgaga

SEQ ID NO: 733581 - DNA, 20 bp, Artificial
  CRISPR gRNA sequence
ggttgccatggcagcgagag

SEQ ID NO: 733582 - DNA, 20 bp, Artificial
  CRISPR gRNA sequence
tgccatggcagcgagagggg

SEQ ID NO: 733583 - DNA, 20 bp, Artificial
  CRISPR gRNA sequence
gccatggcagcgagaggggc

SEQ ID NO: 733584 - DNA, 20 bp, Artificial
  CRISPR gRNA sequence
ggcagcgagaggggcaggaa

SEQ ID NO: 733585 - DNA, 20 bp, Artificial
  CRISPR gRNA sequence
gcagcgagaggggcaggaat

SEQ ID NO: 733586 - DNA, 20 bp, Artificial
  CRISPR gRNA sequence
cgagaggggcaggaatgggt

SEQ ID NO: 733587 - DNA, 20 bp, Artificial
  CRISPR gRNA sequence
gagaggggcaggaatgggtg

SEQ ID NO: 733588 - DNA, 20 bp, Artificial
  CRISPR gRNA sequence
aggaatgggtgaggttcctc

SEQ ID NO: 733589 - DNA, 20 bp, Artificial
  CRISPR gRNA sequence
ggaatgggtgaggttcctca

SEQ ID NO: 733590 - DNA, 20 bp, Artificial
  CRISPR gRNA sequence
aatgggtgaggttcctcaag

SEQ ID NO: 733591 - DNA, 20 bp, Artificial
  CRISPR gRNA sequence
tgaggttcctcaaggagcat

SEQ ID NO: 733592 - DNA, 20 bp, Artificial
  CRISPR gRNA sequence
caaggagcattggtatctgt

SEQ ID NO: 733593 - DNA, 20 bp, Artificial
  CRISPR gRNA sequence
aaggagcattggtatctgtg

SEQ ID NO: 733594 - DNA, 20 bp, Artificial
  CRISPR gRNA sequence
gagcattggtatctgtgagg

SEQ ID NO: 733595 - DNA, 20 bp, Artificial
  CRISPR gRNA sequence
agcattggtatctgtgaggt

SEQ ID NO: 733596 - DNA, 20 bp, Artificial
  CRISPR gRNA sequence
ttggtatctgtgaggtggga

SEQ ID NO: 733597 - DNA, 20 bp, Artificial
  CRISPR gRNA sequence
tggtatctgtgaggtgggaa

SEQ ID NO: 733598 - DNA, 20 bp, Artificial
  CRISPR gRNA sequence
tgggaaaggcattcacacac

SEQ ID NO: 733599 - DNA, 20 bp, Artificial
  CRISPR gRNA sequence
cattcacacactggtccctt

SEQ ID NO: 733600 - DNA, 20 bp, Artificial
  CRISPR gRNA sequence
attcacacactggtcccttc

SEQ ID NO: 733601 - DNA, 20 bp, Artificial
  CRISPR gRNA sequence
acacactggtcccttcagga

SEQ ID NO: 733602 - DNA, 20 bp, Artificial
  CRISPR gRNA sequence
acactggtcccttcaggaca

SEQ ID NO: 733603 - DNA, 20 bp, Artificial
  CRISPR gRNA sequence
cactggtcccttcaggacag

SEQ ID NO: 733604 - DNA, 20 bp, Artificial
  CRISPR gRNA sequence
tggtcccttcaggacagagg

SEQ ID NO: 733605 - DNA, 20 bp, Artificial
  CRISPR gRNA sequence
ggtcccttcaggacagaggc

SEQ ID NO: 733606 - DNA, 20 bp, Artificial
  CRISPR gRNA sequence
gtcccttcaggacagaggca

SEQ ID NO: 733607 - DNA, 20 bp, Artificial
  CRISPR gRNA sequence
cttcaggacagaggcaggga

SEQ ID NO: 733608 - DNA, 20 bp, Artificial
  CRISPR gRNA sequence
ttcaggacagaggcagggac

SEQ ID NO: 733609 - DNA, 20 bp, Artificial
  CRISPR gRNA sequence
acagaggcagggacaggatg

SEQ ID NO: 733610 - DNA, 20 bp, Artificial
  CRISPR gRNA sequence
gcagggacaggatgtggcat

SEQ ID NO: 733611 - DNA, 20 bp, Artificial
  CRISPR gRNA sequence
ggatgtggcatcagcatttc

SEQ ID NO: 733612 - DNA, 20 bp, Artificial
  CRISPR gRNA sequence
tcaagaaaaatgttcaaatt

SEQ ID NO: 733613 - DNA, 20 bp, Artificial
  CRISPR gRNA sequence
caatgattgctgtcataact

SEQ ID NO: 733614 - DNA, 20 bp, Artificial
  CRISPR gRNA sequence
tgattgctgtcataactaag

SEQ ID NO: 733615 - DNA, 20 bp, Artificial
  CRISPR gRNA sequence
gattgctgtcataactaagc

SEQ ID NO: 733616 - DNA, 20 bp, Artificial
  CRISPR gRNA sequence
attgctgtcataactaagca

SEQ ID NO: 733617 - DNA, 20 bp, Artificial
  CRISPR gRNA sequence
aactaagcagggcttcctga

SEQ ID NO: 733618 - DNA, 20 bp, Artificial
  CRISPR gRNA sequence
ctaagcagggcttcctgaca

SEQ ID NO: 733619 - DNA, 20 bp, Artificial
  CRISPR gRNA sequence
taagcagggcttcctgacag

SEQ ID NO: 733620 - DNA, 20 bp, Artificial
  CRISPR gRNA sequence
agggcttcctgacagaggcc

SEQ ID NO: 733621 - DNA, 20 bp, Artificial
  CRISPR gRNA sequence
gcttcctgacagaggccaag

SEQ ID NO: 733622 - DNA, 20 bp, Artificial
  CRISPR gRNA sequence
ttcctgacagaggccaagca

SEQ ID NO: 733623 - DNA, 20 bp, Artificial
  CRISPR gRNA sequence
tgacagaggccaagcagaga

SEQ ID NO: 733624 - DNA, 20 bp, Artificial
  CRISPR gRNA sequence
gcagagaaagctatttgtgt

SEQ ID NO: 733625 - DNA, 20 bp, Artificial
  CRISPR gRNA sequence
cagagaaagctatttgtgtg

SEQ ID NO: 733626 - DNA, 20 bp, Artificial
  CRISPR gRNA sequence
gctatttgtgtgaggaaatt

SEQ ID NO: 733627 - DNA, 20 bp, Artificial
  CRISPR gRNA sequence
ctatttgtgtgaggaaattg

SEQ ID NO: 733628 - DNA, 20 bp, Artificial
  CRISPR gRNA sequence
tatttgtgtgaggaaattga

SEQ ID NO: 733629 - DNA, 20 bp, Artificial
  CRISPR gRNA sequence
aaattgagggctctgcttta

SEQ ID NO: 733630 - DNA, 20 bp, Artificial
  CRISPR gRNA sequence
agggctctgctttaaagcct

SEQ ID NO: 733631 - DNA, 20 bp, Artificial
  CRISPR gRNA sequence
gggctctgctttaaagcctg

SEQ ID NO: 733632 - DNA, 20 bp, Artificial
  CRISPR gRNA sequence
ctctgctttaaagcctgagg

SEQ ID NO: 733633 - DNA, 20 bp, Artificial
  CRISPR gRNA sequence
ctttaaagcctgaggaagcc

SEQ ID NO: 733634 - DNA, 20 bp, Artificial
  CRISPR gRNA sequence
taaagcctgaggaagcctag

SEQ ID NO: 733635 - DNA, 20 bp, Artificial
  CRISPR gRNA sequence
ctgaggaagcctagcagata

SEQ ID NO: 733636 - DNA, 20 bp, Artificial
  CRISPR gRNA sequence
tgaggaagcctagcagataa

SEQ ID NO: 733637 - DNA, 20 bp, Artificial
  CRISPR gRNA sequence
aggaagcctagcagataaag

SEQ ID NO: 733638 - DNA, 20 bp, Artificial
  CRISPR gRNA sequence
agcagataaaggagccaatg

SEQ ID NO: 733639 - DNA, 20 bp, Artificial
  CRISPR gRNA sequence
cagataaaggagccaatgca

SEQ ID NO: 733640 - DNA, 20 bp, Artificial
  CRISPR gRNA sequence
gataaaggagccaatgcaga

SEQ ID NO: 733641 - DNA, 20 bp, Artificial
  CRISPR gRNA sequence
ataaaggagccaatgcagag

SEQ ID NO: 733642 - DNA, 20 bp, Artificial
  CRISPR gRNA sequence
taaaggagccaatgcagaga

SEQ ID NO: 733643 - DNA, 20 bp, Artificial
  CRISPR gRNA sequence
gagccaatgcagagagggtc

SEQ ID NO: 733644 - DNA, 20 bp, Artificial
  CRISPR gRNA sequence
gccaatgcagagagggtcca

SEQ ID NO: 733645 - DNA, 20 bp, Artificial
  CRISPR gRNA sequence
gagggtccagagctttatct

SEQ ID NO: 733646 - DNA, 20 bp, Artificial
  CRISPR gRNA sequence
tccagagctttatcttggct

SEQ ID NO: 733647 - DNA, 20 bp, Artificial
  CRISPR gRNA sequence
ccagagctttatcttggctt

SEQ ID NO: 733648 - DNA, 20 bp, Artificial
  CRISPR gRNA sequence
agagctttatcttggcttgg

SEQ ID NO: 733649 - DNA, 20 bp, Artificial
  CRISPR gRNA sequence
gagctttatcttggcttggg

SEQ ID NO: 733650 - DNA, 20 bp, Artificial
  CRISPR gRNA sequence
ttatcttggcttgggaggcc

SEQ ID NO: 733651 - DNA, 20 bp, Artificial
  CRISPR gRNA sequence
tatcttggcttgggaggcct

SEQ ID NO: 733652 - DNA, 20 bp, Artificial
  CRISPR gRNA sequence
ttggcttgggaggcctgggt

SEQ ID NO: 733653 - DNA, 20 bp, Artificial
  CRISPR gRNA sequence
aggcctgggttagcttcgcc

SEQ ID NO: 733654 - DNA, 20 bp, Artificial
  CRISPR gRNA sequence
ggcctgggttagcttcgcct

SEQ ID NO: 733655 - DNA, 20 bp, Artificial
  CRISPR gRNA sequence
gcctgggttagcttcgcctg

SEQ ID NO: 733656 - DNA, 20 bp, Artificial
  CRISPR gRNA sequence
cttcgcctggggcctgatat

SEQ ID NO: 733657 - DNA, 20 bp, Artificial
  CRISPR gRNA sequence
ttcgcctggggcctgatatt

SEQ ID NO: 733658 - DNA, 20 bp, Artificial
  CRISPR gRNA sequence
tcgcctggggcctgatatta

SEQ ID NO: 733659 - DNA, 20 bp, Artificial
  CRISPR gRNA sequence
tggggcctgatattagggta

SEQ ID NO: 733660 - DNA, 20 bp, Artificial
  CRISPR gRNA sequence
gggcctgatattagggtaaa

SEQ ID NO: 733661 - DNA, 20 bp, Artificial
  CRISPR gRNA sequence
tgatattagggtaaagagct

SEQ ID NO: 733662 - DNA, 20 bp, Artificial
  CRISPR gRNA sequence
attagggtaaagagctaagt

SEQ ID NO: 733663 - DNA, 20 bp, Artificial
  CRISPR gRNA sequence
caacccacaaaacactaaac

SEQ ID NO: 733664 - DNA, 20 bp, Artificial
  CRISPR gRNA sequence
acactaaacaagaaaactgc

SEQ ID NO: 733665 - DNA, 20 bp, Artificial
  CRISPR gRNA sequence
taaacaagaaaactgctggt

SEQ ID NO: 733666 - DNA, 20 bp, Artificial
  CRISPR gRNA sequence
aaacaagaaaactgctggta

SEQ ID NO: 733667 - DNA, 20 bp, Artificial
  CRISPR gRNA sequence
acaagaaaactgctggtaag

SEQ ID NO: 733668 - DNA, 20 bp, Artificial
  CRISPR gRNA sequence
caagaaaactgctggtaagg

SEQ ID NO: 733669 - DNA, 20 bp, Artificial
  CRISPR gRNA sequence
aagaaaactgctggtaagga

SEQ ID NO: 733670 - DNA, 20 bp, Artificial
  CRISPR gRNA sequence
aaactgctggtaaggagggt

SEQ ID NO: 733671 - DNA, 20 bp, Artificial
  CRISPR gRNA sequence
ctggtaaggagggtaagaaa

SEQ ID NO: 733672 - DNA, 20 bp, Artificial
  CRISPR gRNA sequence
tggtaaggagggtaagaaaa

SEQ ID NO: 733673 - DNA, 20 bp, Artificial
  CRISPR gRNA sequence
gagggtaagaaaaaggccct

SEQ ID NO: 733674 - DNA, 20 bp, Artificial
  CRISPR gRNA sequence
gtacccactccctcctccac

SEQ ID NO: 733675 - DNA, 20 bp, Artificial
  CRISPR gRNA sequence
ccactccctcctccacaagt

SEQ ID NO: 733676 - DNA, 20 bp, Artificial
  CRISPR gRNA sequence
agccccttctcccctcacct

SEQ ID NO: 733677 - DNA, 20 bp, Artificial
  CRISPR gRNA sequence
tcacctgagacgcaaccctg

SEQ ID NO: 733678 - DNA, 20 bp, Artificial
  CRISPR gRNA sequence
gagacgcaaccctgtggcca

SEQ ID NO: 733679 - DNA, 20 bp, Artificial
  CRISPR gRNA sequence
acgcaaccctgtggccacag

SEQ ID NO: 733680 - DNA, 20 bp, Artificial
  CRISPR gRNA sequence
caaccctgtggccacagcag

SEQ ID NO: 733681 - DNA, 20 bp, Artificial
  CRISPR gRNA sequence
ccctgtggccacagcagcag

SEQ ID NO: 733682 - DNA, 20 bp, Artificial
  CRISPR gRNA sequence
tgtggccacagcagcagcag

SEQ ID NO: 733683 - DNA, 20 bp, Artificial
  CRISPR gRNA sequence
ggccacagcagcagcagcag

SEQ ID NO: 733684 - DNA, 20 bp, Artificial
  CRISPR gRNA sequence
gccacagcagcagcagcagc

SEQ ID NO: 733685 - DNA, 20 bp, Artificial
  CRISPR gRNA sequence
acagcagcagcagcagcagg

SEQ ID NO: 733686 - DNA, 20 bp, Artificial
  CRISPR gRNA sequence
cagcagcagcagcagcagga

SEQ ID NO: 733687 - DNA, 20 bp, Artificial
  CRISPR gRNA sequence
agcagcagcagcaggaaggc

SEQ ID NO: 733688 - DNA, 20 bp, Artificial
  CRISPR gRNA sequence
gcagcagcagcaggaaggct

SEQ ID NO: 733689 - DNA, 20 bp, Artificial
  CRISPR gRNA sequence
cagcagcagcaggaaggctg

SEQ ID NO: 733690 - DNA, 20 bp, Artificial
  CRISPR gRNA sequence
cagcaggaaggctggggcca

SEQ ID NO: 733691 - DNA, 20 bp, Artificial
  CRISPR gRNA sequence
gctggggccatggttccatc

SEQ ID NO: 733692 - DNA, 20 bp, Artificial
  CRISPR gRNA sequence
gggccatggttccatccagc

SEQ ID NO: 733693 - DNA, 20 bp, Artificial
  CRISPR gRNA sequence
ggccatggttccatccagct

SEQ ID NO: 733694 - DNA, 20 bp, Artificial
  CRISPR gRNA sequence
catggttccatccagctggg

SEQ ID NO: 733695 - DNA, 20 bp, Artificial
  CRISPR gRNA sequence
tccatccagctgggcagtgt

SEQ ID NO: 733696 - DNA, 20 bp, Artificial
  CRISPR gRNA sequence
ccatccagctgggcagtgtc

SEQ ID NO: 733697 - DNA, 20 bp, Artificial
  CRISPR gRNA sequence
cagctgggcagtgtcaggcc

SEQ ID NO: 733698 - DNA, 20 bp, Artificial
  CRISPR gRNA sequence
gctgggcagtgtcaggcctg

SEQ ID NO: 733699 - DNA, 20 bp, Artificial
  CRISPR gRNA sequence
agtgtcaggcctggagatcc

SEQ ID NO: 733700 - DNA, 20 bp, Artificial
  CRISPR gRNA sequence
gtgtcaggcctggagatcca

SEQ ID NO: 733701 - DNA, 20 bp, Artificial
  CRISPR gRNA sequence
caggcctggagatccaaggt

SEQ ID NO: 733702 - DNA, 20 bp, Artificial
  CRISPR gRNA sequence
aggcctggagatccaaggtg

SEQ ID NO: 733703 - DNA, 20 bp, Artificial
  CRISPR gRNA sequence
ggcctggagatccaaggtga

SEQ ID NO: 733704 - DNA, 20 bp, Artificial
  CRISPR gRNA sequence
aggtgagggcccacccgaca

SEQ ID NO: 733705 - DNA, 20 bp, Artificial
  CRISPR gRNA sequence
ggtgagggcccacccgacac

SEQ ID NO: 733706 - DNA, 20 bp, Artificial
  CRISPR gRNA sequence
ccgacacaggatgtgccacc

SEQ ID NO: 733707 - DNA, 20 bp, Artificial
  CRISPR gRNA sequence
cgacacaggatgtgccacct

SEQ ID NO: 733708 - DNA, 20 bp, Artificial
  CRISPR gRNA sequence
gatgtgccacctgggcctgc

SEQ ID NO: 733709 - DNA, 20 bp, Artificial
  CRISPR gRNA sequence
atgtgccacctgggcctgcc

SEQ ID NO: 733710 - DNA, 20 bp, Artificial
  CRISPR gRNA sequence
tgtgccacctgggcctgcca

SEQ ID NO: 733711 - DNA, 20 bp, Artificial
  CRISPR gRNA sequence
gccacctgggcctgccaggg

SEQ ID NO: 733712 - DNA, 20 bp, Artificial
  CRISPR gRNA sequence
ccacctgggcctgccaggga

SEQ ID NO: 733713 - DNA, 20 bp, Artificial
  CRISPR gRNA sequence
gggcctgccagggaaggacc

SEQ ID NO: 733714 - DNA, 20 bp, Artificial
  CRISPR gRNA sequence
ggcctgccagggaaggaccc

SEQ ID NO: 733715 - DNA, 20 bp, Artificial
  CRISPR gRNA sequence
gcctgccagggaaggacccg

SEQ ID NO: 733716 - DNA, 20 bp, Artificial
  CRISPR gRNA sequence
ggaaggacccggggttctaa

SEQ ID NO: 733717 - DNA, 20 bp, Artificial
  CRISPR gRNA sequence
gacccggggttctaaaagtg

SEQ ID NO: 733718 - DNA, 20 bp, Artificial
  CRISPR gRNA sequence
taaaagtgaagctgcccatt

SEQ ID NO: 733719 - DNA, 20 bp, Artificial
  CRISPR gRNA sequence
aaaagtgaagctgcccattt

SEQ ID NO: 733720 - DNA, 20 bp, Artificial
  CRISPR gRNA sequence
aaagtgaagctgcccattta

SEQ ID NO: 733721 - DNA, 20 bp, Artificial
  CRISPR gRNA sequence
gtgaagctgcccatttaggg

SEQ ID NO: 733722 - DNA, 20 bp, Artificial
  CRISPR gRNA sequence
agctgcccatttagggaagt

SEQ ID NO: 733723 - DNA, 20 bp, Artificial
  CRISPR gRNA sequence
gctgcccatttagggaagtg

SEQ ID NO: 733724 - DNA, 20 bp, Artificial
  CRISPR gRNA sequence
gcccatttagggaagtgagg

SEQ ID NO: 733725 - DNA, 20 bp, Artificial
  CRISPR gRNA sequence
tttagggaagtgaggcagtg

SEQ ID NO: 733726 - DNA, 20 bp, Artificial
  CRISPR gRNA sequence
ttagggaagtgaggcagtgt

SEQ ID NO: 733727 - DNA, 20 bp, Artificial
  CRISPR gRNA sequence
agtgtgggacccactgcccc

SEQ ID NO: 733728 - DNA, 20 bp, Artificial
  CRISPR gRNA sequence
ccactgcccccagccaaccg

SEQ ID NO: 733729 - DNA, 20 bp, Artificial
  CRISPR gRNA sequence
cactgcccccagccaaccgc

SEQ ID NO: 733730 - DNA, 20 bp, Artificial
  CRISPR gRNA sequence
actgcccccagccaaccgca

SEQ ID NO: 733731 - DNA, 20 bp, Artificial
  CRISPR gRNA sequence
gccaaccgcagggattcatt

SEQ ID NO: 733732 - DNA, 20 bp, Artificial
  CRISPR gRNA sequence
ggattcattgagcctattat

SEQ ID NO: 733733 - DNA, 20 bp, Artificial
  CRISPR gRNA sequence
gattcattgagcctattatg

SEQ ID NO: 733734 - DNA, 20 bp, Artificial
  CRISPR gRNA sequence
attcattgagcctattatga

SEQ ID NO: 733735 - DNA, 20 bp, Artificial
  CRISPR gRNA sequence
cattgagcctattatgaggg

SEQ ID NO: 733736 - DNA, 20 bp, Artificial
  CRISPR gRNA sequence
gcctattatgagggcggtgc

SEQ ID NO: 733737 - DNA, 20 bp, Artificial
  CRISPR gRNA sequence
tattatgagggcggtgctgg

SEQ ID NO: 733738 - DNA, 20 bp, Artificial
  CRISPR gRNA sequence
gctgtttccgcccttttcct

SEQ ID NO: 733739 - DNA, 20 bp, Artificial
  CRISPR gRNA sequence
cgcccttttcctcggaactt

SEQ ID NO: 733740 - DNA, 20 bp, Artificial
  CRISPR gRNA sequence
gcccttttcctcggaacttc

SEQ ID NO: 733741 - DNA, 20 bp, Artificial
  CRISPR gRNA sequence
cttttcctcggaacttcagg

SEQ ID NO: 733742 - DNA, 20 bp, Artificial
  CRISPR gRNA sequence
ttttcctcggaacttcaggc

SEQ ID NO: 733743 - DNA, 20 bp, Artificial
  CRISPR gRNA sequence
ctcggaacttcaggcaggtg

SEQ ID NO: 733744 - DNA, 20 bp, Artificial
  CRISPR gRNA sequence
gcaggtgtggctgctccacc

SEQ ID NO: 733745 - DNA, 20 bp, Artificial
  CRISPR gRNA sequence
tgtggctgctccacccagtc

SEQ ID NO: 733746 - DNA, 20 bp, Artificial
  CRISPR gRNA sequence
gtggctgctccacccagtct

SEQ ID NO: 733747 - DNA, 20 bp, Artificial
  CRISPR gRNA sequence
tggctgctccacccagtctg

SEQ ID NO: 733748 - DNA, 20 bp, Artificial
  CRISPR gRNA sequence
tccacccagtctggggcccc

SEQ ID NO: 733749 - DNA, 20 bp, Artificial
  CRISPR gRNA sequence
cccagtctggggccccaagc

SEQ ID NO: 733750 - DNA, 20 bp, Artificial
  CRISPR gRNA sequence
ccagtctggggccccaagcc

SEQ ID NO: 733751 - DNA, 20 bp, Artificial
  CRISPR gRNA sequence
cccggcttggggccccagac

SEQ ID NO: 733752 - DNA, 20 bp, Artificial
  CRISPR gRNA sequence
ccggcttggggccccagact

SEQ ID NO: 733753 - DNA, 20 bp, Artificial
  CRISPR gRNA sequence
gcttggggccccagactggg

SEQ ID NO: 733754 - DNA, 20 bp, Artificial
  CRISPR gRNA sequence
ttggggccccagactgggtg

SEQ ID NO: 733755 - DNA, 20 bp, Artificial
  CRISPR gRNA sequence
gggccccagactgggtggag

SEQ ID NO: 733756 - DNA, 20 bp, Artificial
  CRISPR gRNA sequence
ggagcagccacacctgcctg

SEQ ID NO: 733757 - DNA, 20 bp, Artificial
  CRISPR gRNA sequence
ccacacctgcctgaagttcc

SEQ ID NO: 733758 - DNA, 20 bp, Artificial
  CRISPR gRNA sequence
cacacctgcctgaagttccg

SEQ ID NO: 733759 - DNA, 20 bp, Artificial
  CRISPR gRNA sequence
ctgcctgaagttccgaggaa

SEQ ID NO: 733760 - DNA, 20 bp, Artificial
  CRISPR gRNA sequence
tgcctgaagttccgaggaaa

SEQ ID NO: 733761 - DNA, 20 bp, Artificial
  CRISPR gRNA sequence
gcctgaagttccgaggaaaa

SEQ ID NO: 733762 - DNA, 20 bp, Artificial
  CRISPR gRNA sequence
tgaagttccgaggaaaaggg

SEQ ID NO: 733763 - DNA, 20 bp, Artificial
  CRISPR gRNA sequence
tccgaggaaaagggcggaaa

SEQ ID NO: 733764 - DNA, 20 bp, Artificial
  CRISPR gRNA sequence
aaaagggcggaaacagctgc

SEQ ID NO: 733765 - DNA, 20 bp, Artificial
  CRISPR gRNA sequence
tgccagcaccgccctcataa

SEQ ID NO: 733766 - DNA, 20 bp, Artificial
  CRISPR gRNA sequence
gccagcaccgccctcataat

SEQ ID NO: 733767 - DNA, 20 bp, Artificial
  CRISPR gRNA sequence
ataggctcaatgaatccctg

SEQ ID NO: 733768 - DNA, 20 bp, Artificial
  CRISPR gRNA sequence
gctcaatgaatccctgcggt

SEQ ID NO: 733769 - DNA, 20 bp, Artificial
  CRISPR gRNA sequence
aatgaatccctgcggttggc

SEQ ID NO: 733770 - DNA, 20 bp, Artificial
  CRISPR gRNA sequence
atgaatccctgcggttggct

SEQ ID NO: 733771 - DNA, 20 bp, Artificial
  CRISPR gRNA sequence
tgaatccctgcggttggctg

SEQ ID NO: 733772 - DNA, 20 bp, Artificial
  CRISPR gRNA sequence
gaatccctgcggttggctgg

SEQ ID NO: 733773 - DNA, 20 bp, Artificial
  CRISPR gRNA sequence
tccctgcggttggctggggg

SEQ ID NO: 733774 - DNA, 20 bp, Artificial
  CRISPR gRNA sequence
ctgcggttggctgggggcag

SEQ ID NO: 733775 - DNA, 20 bp, Artificial
  CRISPR gRNA sequence
tgcggttggctgggggcagt

SEQ ID NO: 733776 - DNA, 20 bp, Artificial
  CRISPR gRNA sequence
cactgcctcacttccctaaa

SEQ ID NO: 733777 - DNA, 20 bp, Artificial
  CRISPR gRNA sequence
actgcctcacttccctaaat

SEQ ID NO: 733778 - DNA, 20 bp, Artificial
  CRISPR gRNA sequence
gcctcacttccctaaatggg

SEQ ID NO: 733779 - DNA, 20 bp, Artificial
  CRISPR gRNA sequence
taaatgggcagcttcacttt

SEQ ID NO: 733780 - DNA, 20 bp, Artificial
  CRISPR gRNA sequence
cagcttcacttttagaaccc

SEQ ID NO: 733781 - DNA, 20 bp, Artificial
  CRISPR gRNA sequence
agcttcacttttagaacccc

SEQ ID NO: 733782 - DNA, 20 bp, Artificial
  CRISPR gRNA sequence
tagaaccccgggtccttccc

SEQ ID NO: 733783 - DNA, 20 bp, Artificial
  CRISPR gRNA sequence
aaccccgggtccttccctgg

SEQ ID NO: 733784 - DNA, 20 bp, Artificial
  CRISPR gRNA sequence
accccgggtccttccctggc

SEQ ID NO: 733785 - DNA, 20 bp, Artificial
  CRISPR gRNA sequence
gggtccttccctggcaggcc

SEQ ID NO: 733786 - DNA, 20 bp, Artificial
  CRISPR gRNA sequence
ggtccttccctggcaggccc

SEQ ID NO: 733787 - DNA, 20 bp, Artificial
  CRISPR gRNA sequence
ccttccctggcaggcccagg

SEQ ID NO: 733788 - DNA, 20 bp, Artificial
  CRISPR gRNA sequence
ccaggtggcacatcctgtgt

SEQ ID NO: 733789 - DNA, 20 bp, Artificial
  CRISPR gRNA sequence
caggtggcacatcctgtgtc

SEQ ID NO: 733790 - DNA, 20 bp, Artificial
  CRISPR gRNA sequence
gtggcacatcctgtgtcggg

SEQ ID NO: 733791 - DNA, 20 bp, Artificial
  CRISPR gRNA sequence
tggcacatcctgtgtcgggt

SEQ ID NO: 733792 - DNA, 20 bp, Artificial
  CRISPR gRNA sequence
tgtcgggtgggccctcacct

SEQ ID NO: 733793 - DNA, 20 bp, Artificial
  CRISPR gRNA sequence
gggccctcaccttggatctc

SEQ ID NO: 733794 - DNA, 20 bp, Artificial
  CRISPR gRNA sequence
ggccctcaccttggatctcc

SEQ ID NO: 733795 - DNA, 20 bp, Artificial
  CRISPR gRNA sequence
tctccaggcctgacactgcc

SEQ ID NO: 733796 - DNA, 20 bp, Artificial
  CRISPR gRNA sequence
caggcctgacactgcccagc

SEQ ID NO: 733797 - DNA, 20 bp, Artificial
  CRISPR gRNA sequence
cctgacactgcccagctgga

SEQ ID NO: 733798 - DNA, 20 bp, Artificial
  CRISPR gRNA sequence
tgcccagctggatggaacca

SEQ ID NO: 733799 - DNA, 20 bp, Artificial
  CRISPR gRNA sequence
gctggatggaaccatggccc

SEQ ID NO: 733800 - DNA, 20 bp, Artificial
  CRISPR gRNA sequence
tcctgctgctgctgctgctg

SEQ ID NO: 733801 - DNA, 20 bp, Artificial
  CRISPR gRNA sequence
tgctgctgctgctgtggcca

SEQ ID NO: 733802 - DNA, 20 bp, Artificial
  CRISPR gRNA sequence
gctgctgctgctgtggccac

SEQ ID NO: 733803 - DNA, 20 bp, Artificial
  CRISPR gRNA sequence
ctgctgctgctgtggccaca

SEQ ID NO: 733804 - DNA, 20 bp, Artificial
  CRISPR gRNA sequence
gtggccacagggttgcgtct

SEQ ID NO: 733805 - DNA, 20 bp, Artificial
  CRISPR gRNA sequence
tggccacagggttgcgtctc

SEQ ID NO: 733806 - DNA, 20 bp, Artificial
  CRISPR gRNA sequence
cacagggttgcgtctcaggt

SEQ ID NO: 733807 - DNA, 20 bp, Artificial
  CRISPR gRNA sequence
acagggttgcgtctcaggtg

SEQ ID NO: 733808 - DNA, 20 bp, Artificial
  CRISPR gRNA sequence
cagggttgcgtctcaggtga

SEQ ID NO: 733809 - DNA, 20 bp, Artificial
  CRISPR gRNA sequence
agggttgcgtctcaggtgag

SEQ ID NO: 733810 - DNA, 20 bp, Artificial
  CRISPR gRNA sequence
ggttgcgtctcaggtgaggg

SEQ ID NO: 733811 - DNA, 20 bp, Artificial
  CRISPR gRNA sequence
tgcgtctcaggtgaggggag

SEQ ID NO: 733812 - DNA, 20 bp, Artificial
  CRISPR gRNA sequence
gcgtctcaggtgaggggaga

SEQ ID NO: 733813 - DNA, 20 bp, Artificial
  CRISPR gRNA sequence
cgtctcaggtgaggggagaa

SEQ ID NO: 733814 - DNA, 20 bp, Artificial
  CRISPR gRNA sequence
gtctcaggtgaggggagaag

SEQ ID NO: 733815 - DNA, 20 bp, Artificial
  CRISPR gRNA sequence
ggggagaaggggctgacttg

SEQ ID NO: 733816 - DNA, 20 bp, Artificial
  CRISPR gRNA sequence
ggagaaggggctgacttgtg

SEQ ID NO: 733817 - DNA, 20 bp, Artificial
  CRISPR gRNA sequence
gagaaggggctgacttgtgg

SEQ ID NO: 733818 - DNA, 20 bp, Artificial
  CRISPR gRNA sequence
gaaggggctgacttgtggag

SEQ ID NO: 733819 - DNA, 20 bp, Artificial
  CRISPR gRNA sequence
aaggggctgacttgtggagg

SEQ ID NO: 733820 - DNA, 20 bp, Artificial
  CRISPR gRNA sequence
aggggctgacttgtggagga

SEQ ID NO: 733821 - DNA, 20 bp, Artificial
  CRISPR gRNA sequence
gggctgacttgtggaggagg

SEQ ID NO: 733822 - DNA, 20 bp, Artificial
  CRISPR gRNA sequence
ctgacttgtggaggagggag

SEQ ID NO: 733823 - DNA, 20 bp, Artificial
  CRISPR gRNA sequence
tgacttgtggaggagggagt

SEQ ID NO: 733824 - DNA, 20 bp, Artificial
  CRISPR gRNA sequence
tgtggaggagggagtgggta

SEQ ID NO: 733825 - DNA, 20 bp, Artificial
  CRISPR gRNA sequence
tggaggagggagtgggtaca

SEQ ID NO: 733826 - DNA, 20 bp, Artificial
  CRISPR gRNA sequence
ggaggagggagtgggtacag

SEQ ID NO: 733827 - DNA, 20 bp, Artificial
  CRISPR gRNA sequence
ggagggagtgggtacagagg

SEQ ID NO: 733828 - DNA, 20 bp, Artificial
  CRISPR gRNA sequence
gagggagtgggtacagaggc

SEQ ID NO: 733829 - DNA, 20 bp, Artificial
  CRISPR gRNA sequence
gggagtgggtacagaggcag

SEQ ID NO: 733830 - DNA, 20 bp, Artificial
  CRISPR gRNA sequence
tgggtacagaggcaggagct

SEQ ID NO: 733831 - DNA, 20 bp, Artificial
  CRISPR gRNA sequence
gggtacagaggcaggagctc

SEQ ID NO: 733832 - DNA, 20 bp, Artificial
  CRISPR gRNA sequence
ggtacagaggcaggagctca

SEQ ID NO: 733833 - DNA, 20 bp, Artificial
  CRISPR gRNA sequence
ctttttcttaccctccttac

SEQ ID NO: 733834 - DNA, 20 bp, Artificial
  CRISPR gRNA sequence
tttcttaccctccttaccag

SEQ ID NO: 733835 - DNA, 20 bp, Artificial
  CRISPR gRNA sequence
ttaccagcagttttcttgtt

SEQ ID NO: 733836 - DNA, 20 bp, Artificial
  CRISPR gRNA sequence
ttttcttgtttagtgttttg

SEQ ID NO: 733837 - DNA, 20 bp, Artificial
  CRISPR gRNA sequence
tttcttgtttagtgttttgt

SEQ ID NO: 733838 - DNA, 20 bp, Artificial
  CRISPR gRNA sequence
ttgtttagtgttttgtgggt

SEQ ID NO: 733839 - DNA, 20 bp, Artificial
  CRISPR gRNA sequence
tgtttagtgttttgtgggtt

SEQ ID NO: 733840 - DNA, 20 bp, Artificial
  CRISPR gRNA sequence
gtttagtgttttgtgggttg

SEQ ID NO: 733841 - DNA, 20 bp, Artificial
  CRISPR gRNA sequence
tagtgttttgtgggttgggg

SEQ ID NO: 733842 - DNA, 20 bp, Artificial
  CRISPR gRNA sequence
agtgttttgtgggttgggga

SEQ ID NO: 733843 - DNA, 20 bp, Artificial
  CRISPR gRNA sequence
tgttttgtgggttggggaag

SEQ ID NO: 733844 - DNA, 20 bp, Artificial
  CRISPR gRNA sequence
gttttgtgggttggggaagg

SEQ ID NO: 733845 - DNA, 20 bp, Artificial
  CRISPR gRNA sequence
tttgtgggttggggaaggag

SEQ ID NO: 733846 - DNA, 20 bp, Artificial
  CRISPR gRNA sequence
gggttggggaaggaggagat

SEQ ID NO: 733847 - DNA, 20 bp, Artificial
  CRISPR gRNA sequence
ggttggggaaggaggagatt

SEQ ID NO: 733848 - DNA, 20 bp, Artificial
  CRISPR gRNA sequence
gttggggaaggaggagatta

SEQ ID NO: 733849 - DNA, 20 bp, Artificial
  CRISPR gRNA sequence
ggaggagattagggctgact

SEQ ID NO: 733850 - DNA, 20 bp, Artificial
  CRISPR gRNA sequence
ttagctctttaccctaatat

SEQ ID NO: 733851 - DNA, 20 bp, Artificial
  CRISPR gRNA sequence
tagctctttaccctaatatc

SEQ ID NO: 733852 - DNA, 20 bp, Artificial
  CRISPR gRNA sequence
tttaccctaatatcaggccc

SEQ ID NO: 733853 - DNA, 20 bp, Artificial
  CRISPR gRNA sequence
ttaccctaatatcaggcccc

SEQ ID NO: 733854 - DNA, 20 bp, Artificial
  CRISPR gRNA sequence
ctaatatcaggccccaggcg

SEQ ID NO: 733855 - DNA, 20 bp, Artificial
  CRISPR gRNA sequence
ggccccaggcgaagctaacc

SEQ ID NO: 733856 - DNA, 20 bp, Artificial
  CRISPR gRNA sequence
gccccaggcgaagctaaccc

SEQ ID NO: 733857 - DNA, 20 bp, Artificial
  CRISPR gRNA sequence
gaagctaacccaggcctccc

SEQ ID NO: 733858 - DNA, 20 bp, Artificial
  CRISPR gRNA sequence
taacccaggcctcccaagcc

SEQ ID NO: 733859 - DNA, 20 bp, Artificial
  CRISPR gRNA sequence
aggcctcccaagccaagata

SEQ ID NO: 733860 - DNA, 20 bp, Artificial
  CRISPR gRNA sequence
cccaagccaagataaagctc

SEQ ID NO: 733861 - DNA, 20 bp, Artificial
  CRISPR gRNA sequence
gctctggaccctctctgcat

SEQ ID NO: 733862 - DNA, 20 bp, Artificial
  CRISPR gRNA sequence
gcattggctcctttatctgc

SEQ ID NO: 733863 - DNA, 20 bp, Artificial
  CRISPR gRNA sequence
cattggctcctttatctgct

SEQ ID NO: 733864 - DNA, 20 bp, Artificial
  CRISPR gRNA sequence
ctttatctgctaggcttcct

SEQ ID NO: 733865 - DNA, 20 bp, Artificial
  CRISPR gRNA sequence
tttatctgctaggcttcctc

SEQ ID NO: 733866 - DNA, 20 bp, Artificial
  CRISPR gRNA sequence
ctaggcttcctcaggcttta

SEQ ID NO: 733867 - DNA, 20 bp, Artificial
  CRISPR gRNA sequence
ggcttcctcaggctttaaag

SEQ ID NO: 733868 - DNA, 20 bp, Artificial
  CRISPR gRNA sequence
cttcctcaggctttaaagca

SEQ ID NO: 733869 - DNA, 20 bp, Artificial
  CRISPR gRNA sequence
cctcaatttcctcacacaaa

SEQ ID NO: 733870 - DNA, 20 bp, Artificial
  CRISPR gRNA sequence
cacaaatagctttctctgct

SEQ ID NO: 733871 - DNA, 20 bp, Artificial
  CRISPR gRNA sequence
tttctctgcttggcctctgt

SEQ ID NO: 733872 - DNA, 20 bp, Artificial
  CRISPR gRNA sequence
ttctctgcttggcctctgtc

SEQ ID NO: 733873 - DNA, 20 bp, Artificial
  CRISPR gRNA sequence
tctgcttggcctctgtcagg

SEQ ID NO: 733874 - DNA, 20 bp, Artificial
  CRISPR gRNA sequence
ctctgtcaggaagccctgct

SEQ ID NO: 733875 - DNA, 20 bp, Artificial
  CRISPR gRNA sequence
gaagccctgcttagttatga

SEQ ID NO: 733876 - DNA, 20 bp, Artificial
  CRISPR gRNA sequence
ctgtccctgcctctgtcctg

SEQ ID NO: 733877 - DNA, 20 bp, Artificial
  CRISPR gRNA sequence
tgtccctgcctctgtcctga

SEQ ID NO: 733878 - DNA, 20 bp, Artificial
  CRISPR gRNA sequence
gtccctgcctctgtcctgaa

SEQ ID NO: 733879 - DNA, 20 bp, Artificial
  CRISPR gRNA sequence
tgcctctgtcctgaagggac

SEQ ID NO: 733880 - DNA, 20 bp, Artificial
  CRISPR gRNA sequence
tgaatgcctttcccacctca

SEQ ID NO: 733881 - DNA, 20 bp, Artificial
  CRISPR gRNA sequence
cacagataccaatgctcctt

SEQ ID NO: 733882 - DNA, 20 bp, Artificial
  CRISPR gRNA sequence
acagataccaatgctccttg

SEQ ID NO: 733883 - DNA, 20 bp, Artificial
  CRISPR gRNA sequence
tcctgcccctctcgctgcca

SEQ ID NO: 733884 - DNA, 20 bp, Artificial
  CRISPR gRNA sequence
ctctcgctgccatggcaacc

SEQ ID NO: 733885 - DNA, 20 bp, Artificial
  CRISPR gRNA sequence
ccaagttaccacttcctgtt

SEQ ID NO: 733886 - DNA, 20 bp, Artificial
  CRISPR gRNA sequence
taccacttcctgttcagttc

SEQ ID NO: 733887 - DNA, 20 bp, Artificial
  CRISPR gRNA sequence
accacttcctgttcagttct

SEQ ID NO: 733888 - DNA, 20 bp, Artificial
  CRISPR gRNA sequence
ttcctgttcagttctgggca

SEQ ID NO: 733889 - DNA, 20 bp, Artificial
  CRISPR gRNA sequence
ctgttcagttctgggcatgg

SEQ ID NO: 733890 - DNA, 20 bp, Artificial
  CRISPR gRNA sequence
tgttcagttctgggcatggt

SEQ ID NO: 733891 - DNA, 20 bp, Artificial
  CRISPR gRNA sequence
gttcagttctgggcatggtg

SEQ ID NO: 733892 - DNA, 20 bp, Artificial
  CRISPR gRNA sequence
ttcagttctgggcatggtgg

SEQ ID NO: 733893 - DNA, 20 bp, Artificial
  CRISPR gRNA sequence
gttctgggcatggtgggggt

SEQ ID NO: 733894 - DNA, 20 bp, Artificial
  CRISPR gRNA sequence
caaaactcaccactgcctgt

SEQ ID NO: 733895 - DNA, 20 bp, Artificial
  CRISPR gRNA sequence
aaactcaccactgcctgtga

SEQ ID NO: 733896 - DNA, 20 bp, Artificial
  CRISPR gRNA sequence
aactcaccactgcctgtgag

SEQ ID NO: 733897 - DNA, 20 bp, Artificial
  CRISPR gRNA sequence
actcaccactgcctgtgaga

SEQ ID NO: 733898 - DNA, 20 bp, Artificial
  CRISPR gRNA sequence
ctcaccactgcctgtgagag

SEQ ID NO: 733899 - DNA, 20 bp, Artificial
  CRISPR gRNA sequence
accactgcctgtgagagggg

SEQ ID NO: 733900 - DNA, 20 bp, Artificial
  CRISPR gRNA sequence
ccactgcctgtgagaggggt

SEQ ID NO: 733901 - DNA, 20 bp, Artificial
  CRISPR gRNA sequence
actgcctgtgagaggggtgg

SEQ ID NO: 733902 - DNA, 20 bp, Artificial
  CRISPR gRNA sequence
ctgcctgtgagaggggtggg

SEQ ID NO: 733903 - DNA, 20 bp, Artificial
  CRISPR gRNA sequence
tgtgagaggggtgggaggtg

SEQ ID NO: 733904 - DNA, 20 bp, Artificial
  CRISPR gRNA sequence
gtgagaggggtgggaggtgt

SEQ ID NO: 733905 - DNA, 20 bp, Artificial
  CRISPR gRNA sequence
gggaggtgtaggcacacatg

SEQ ID NO: 733906 - DNA, 20 bp, Artificial
  CRISPR gRNA sequence
cacacatgaagacattgccc

SEQ ID NO: 733907 - DNA, 20 bp, Artificial
  CRISPR gRNA sequence
cacatgaagacattgccctg

SEQ ID NO: 733908 - DNA, 20 bp, Artificial
  CRISPR gRNA sequence
ttgccctggagacccatccc

SEQ ID NO: 733909 - DNA, 20 bp, Artificial
  CRISPR gRNA sequence
tgccctggagacccatccca

SEQ ID NO: 733910 - DNA, 20 bp, Artificial
  CRISPR gRNA sequence
tcacccaactctgcacctcc

SEQ ID NO: 733911 - DNA, 20 bp, Artificial
  CRISPR gRNA sequence
acccaactctgcacctccca

SEQ ID NO: 733912 - DNA, 20 bp, Artificial
  CRISPR gRNA sequence
cccaactctgcacctcccag

SEQ ID NO: 733913 - DNA, 20 bp, Artificial
  CRISPR gRNA sequence
ccaactctgcacctcccaga

SEQ ID NO: 733914 - DNA, 20 bp, Artificial
  CRISPR gRNA sequence
actctgcacctcccagaggg

SEQ ID NO: 733915 - DNA, 20 bp, Artificial
  CRISPR gRNA sequence
tctgcacctcccagagggta

SEQ ID NO: 733916 - DNA, 20 bp, Artificial
  CRISPR gRNA sequence
cctcccagagggtagagaaa

SEQ ID NO: 733917 - DNA, 20 bp, Artificial
  CRISPR gRNA sequence
gagaaacagcttcccactgc

SEQ ID NO: 733918 - DNA, 20 bp, Artificial
  CRISPR gRNA sequence
agaaacagcttcccactgcc

SEQ ID NO: 733919 - DNA, 20 bp, Artificial
  CRISPR gRNA sequence
gaaacagcttcccactgcca

SEQ ID NO: 733920 - DNA, 20 bp, Artificial
  CRISPR gRNA sequence
acagcttcccactgccaggg

SEQ ID NO: 733921 - DNA, 20 bp, Artificial
  CRISPR gRNA sequence
cttcccactgccagggcaga

SEQ ID NO: 733922 - DNA, 20 bp, Artificial
  CRISPR gRNA sequence
ttcccactgccagggcagaa

SEQ ID NO: 733923 - DNA, 20 bp, Artificial
  CRISPR gRNA sequence
tcccactgccagggcagaaa

SEQ ID NO: 733924 - DNA, 20 bp, Artificial
  CRISPR gRNA sequence
cccactgccagggcagaaag

SEQ ID NO: 733925 - DNA, 20 bp, Artificial
  CRISPR gRNA sequence
aaaggggtctctcttgtgct

SEQ ID NO: 733926 - DNA, 20 bp, Artificial
  CRISPR gRNA sequence
tctcttgtgctaagaaatcc

SEQ ID NO: 733927 - DNA, 20 bp, Artificial
  CRISPR gRNA sequence
ctcttgtgctaagaaatcct

SEQ ID NO: 733928 - DNA, 20 bp, Artificial
  CRISPR gRNA sequence
ggctcatccaccaaataatg

SEQ ID NO: 733929 - DNA, 20 bp, Artificial
  CRISPR gRNA sequence
catccaccaaataatgaagt

SEQ ID NO: 733930 - DNA, 20 bp, Artificial
  CRISPR gRNA sequence
tgaagttggatcattctgtt

SEQ ID NO: 733931 - DNA, 20 bp, Artificial
  CRISPR gRNA sequence
gatcattctgtttagtttgc

SEQ ID NO: 733932 - DNA, 20 bp, Artificial
  CRISPR gRNA sequence
atcattctgtttagtttgca

SEQ ID NO: 733933 - DNA, 20 bp, Artificial
  CRISPR gRNA sequence
tcattctgtttagtttgcaa

SEQ ID NO: 733934 - DNA, 20 bp, Artificial
  CRISPR gRNA sequence
tctgtttagtttgcaaggga

SEQ ID NO: 733935 - DNA, 20 bp, Artificial
  CRISPR gRNA sequence
tgtttagtttgcaagggaca

SEQ ID NO: 733936 - DNA, 20 bp, Artificial
  CRISPR gRNA sequence
gtttagtttgcaagggacag

SEQ ID NO: 733937 - DNA, 20 bp, Artificial
  CRISPR gRNA sequence
tttagtttgcaagggacaga

SEQ ID NO: 733938 - DNA, 20 bp, Artificial
  CRISPR gRNA sequence
gcaagggacagagggatgct

SEQ ID NO: 733939 - DNA, 20 bp, Artificial
  CRISPR gRNA sequence
aagggacagagggatgctta

SEQ ID NO: 733940 - DNA, 20 bp, Artificial
  CRISPR gRNA sequence
gggacagagggatgcttaga

SEQ ID NO: 733941 - DNA, 20 bp, Artificial
  CRISPR gRNA sequence
ggacagagggatgcttagag

SEQ ID NO: 733942 - DNA, 20 bp, Artificial
  CRISPR gRNA sequence
gacagagggatgcttagaga

SEQ ID NO: 733943 - DNA, 20 bp, Artificial
  CRISPR gRNA sequence
agagagggtgctgcttcaca

SEQ ID NO: 733944 - DNA, 20 bp, Artificial
  CRISPR gRNA sequence
agagggtgctgcttcacaca

SEQ ID NO: 733945 - DNA, 20 bp, Artificial
  CRISPR gRNA sequence
tgctgcttcacacagagcct

SEQ ID NO: 733946 - DNA, 20 bp, Artificial
  CRISPR gRNA sequence
ttcacacagagcctcagctc

SEQ ID NO: 733947 - DNA, 20 bp, Artificial
  CRISPR gRNA sequence
acacagagcctcagctctag

SEQ ID NO: 733948 - DNA, 20 bp, Artificial
  CRISPR gRNA sequence
gcctcagctctagtggctgc

SEQ ID NO: 733949 - DNA, 20 bp, Artificial
  CRISPR gRNA sequence
cagctctagtggctgctggc

SEQ ID NO: 733950 - DNA, 20 bp, Artificial
  CRISPR gRNA sequence
agctctagtggctgctggct

SEQ ID NO: 733951 - DNA, 20 bp, Artificial
  CRISPR gRNA sequence
agtggctgctggctgggact

SEQ ID NO: 733952 - DNA, 20 bp, Artificial
  CRISPR gRNA sequence
gtggctgctggctgggactt

SEQ ID NO: 733953 - DNA, 20 bp, Artificial
  CRISPR gRNA sequence
ctgctggctgggacttggga

SEQ ID NO: 733954 - DNA, 20 bp, Artificial
  CRISPR gRNA sequence
gggacttgggacggatatcc

SEQ ID NO: 733955 - DNA, 20 bp, Artificial
  CRISPR gRNA sequence
gggacggatatcctggattc

SEQ ID NO: 733956 - DNA, 20 bp, Artificial
  CRISPR gRNA sequence
acggatatcctggattctgg

SEQ ID NO: 733957 - DNA, 20 bp, Artificial
  CRISPR gRNA sequence
cggatatcctggattctggt

SEQ ID NO: 733958 - DNA, 20 bp, Artificial
  CRISPR gRNA sequence
tatcctggattctggtggga

SEQ ID NO: 733959 - DNA, 20 bp, Artificial
  CRISPR gRNA sequence
ttctggtgggacagatgtcc

SEQ ID NO: 733960 - DNA, 20 bp, Artificial
  CRISPR gRNA sequence
gggacagatgtcctggattc

SEQ ID NO: 733961 - DNA, 20 bp, Artificial
  CRISPR gRNA sequence
ggacagatgtcctggattct

SEQ ID NO: 733962 - DNA, 20 bp, Artificial
  CRISPR gRNA sequence
ttctgggcccttgactgtca

SEQ ID NO: 733963 - DNA, 20 bp, Artificial
  CRISPR gRNA sequence
gcccttgactgtcacagctc

SEQ ID NO: 733964 - DNA, 20 bp, Artificial
  CRISPR gRNA sequence
cccttgactgtcacagctct

SEQ ID NO: 733965 - DNA, 20 bp, Artificial
  CRISPR gRNA sequence
gtcacagctctgggttccat

SEQ ID NO: 733966 - DNA, 20 bp, Artificial
  CRISPR gRNA sequence
tcacagctctgggttccatt

SEQ ID NO: 733967 - DNA, 20 bp, Artificial
  CRISPR gRNA sequence
cacagctctgggttccattg

SEQ ID NO: 733968 - DNA, 20 bp, Artificial
  CRISPR gRNA sequence
acagctctgggttccattgg

SEQ ID NO: 733969 - DNA, 20 bp, Artificial
  CRISPR gRNA sequence
ctgggttccattgggggaac

SEQ ID NO: 733970 - DNA, 20 bp, Artificial
  CRISPR gRNA sequence
tgggttccattgggggaact

SEQ ID NO: 733971 - DNA, 20 bp, Artificial
  CRISPR gRNA sequence
ggttccattgggggaactgg

SEQ ID NO: 733972 - DNA, 20 bp, Artificial
  CRISPR gRNA sequence
gttccattgggggaactggg

SEQ ID NO: 733973 - DNA, 20 bp, Artificial
  CRISPR gRNA sequence
ttgggggaactgggaggccc

SEQ ID NO: 733974 - DNA, 20 bp, Artificial
  CRISPR gRNA sequence
aactgggaggccccagcatg

SEQ ID NO: 733975 - DNA, 20 bp, Artificial
  CRISPR gRNA sequence
actgggaggccccagcatgt

SEQ ID NO: 733976 - DNA, 20 bp, Artificial
  CRISPR gRNA sequence
gaggccccagcatgtgggaa

SEQ ID NO: 733977 - DNA, 20 bp, Artificial
  CRISPR gRNA sequence
aggccccagcatgtgggaaa

SEQ ID NO: 733978 - DNA, 20 bp, Artificial
  CRISPR gRNA sequence
ccccagcatgtgggaaaagg

SEQ ID NO: 733979 - DNA, 20 bp, Artificial
  CRISPR gRNA sequence
catgtgggaaaaggaagcat

SEQ ID NO: 733980 - DNA, 20 bp, Artificial
  CRISPR gRNA sequence
gggaaaaggaagcatgagtt

SEQ ID NO: 733981 - DNA, 20 bp, Artificial
  CRISPR gRNA sequence
ttgagcatgcactgtgtgca

SEQ ID NO: 733982 - DNA, 20 bp, Artificial
  CRISPR gRNA sequence
ctgtgtgcaaagcactgacc

SEQ ID NO: 733983 - DNA, 20 bp, Artificial
  CRISPR gRNA sequence
tgtgtgcaaagcactgacct

SEQ ID NO: 733984 - DNA, 20 bp, Artificial
  CRISPR gRNA sequence
gtgtgcaaagcactgacctg

SEQ ID NO: 733985 - DNA, 20 bp, Artificial
  CRISPR gRNA sequence
tgcaaagcactgacctgggg

SEQ ID NO: 733986 - DNA, 20 bp, Artificial
  CRISPR gRNA sequence
gacctggggcagaattctca

SEQ ID NO: 733987 - DNA, 20 bp, Artificial
  CRISPR gRNA sequence
gaattctcacagcaacctgt

SEQ ID NO: 733988 - DNA, 20 bp, Artificial
  CRISPR gRNA sequence
aattctcacagcaacctgtg

SEQ ID NO: 733989 - DNA, 20 bp, Artificial
  CRISPR gRNA sequence
attctcacagcaacctgtga

SEQ ID NO: 733990 - DNA, 20 bp, Artificial
  CRISPR gRNA sequence
ttctcacagcaacctgtgag

SEQ ID NO: 733991 - DNA, 20 bp, Artificial
  CRISPR gRNA sequence
acagcaacctgtgaggggtg

SEQ ID NO: 733992 - DNA, 20 bp, Artificial
  CRISPR gRNA sequence
ctattctcacttgactgata

SEQ ID NO: 733993 - DNA, 20 bp, Artificial
  CRISPR gRNA sequence
tcacttgactgataaagaaa

SEQ ID NO: 733994 - DNA, 20 bp, Artificial
  CRISPR gRNA sequence
acttgactgataaagaaaca

SEQ ID NO: 733995 - DNA, 20 bp, Artificial
  CRISPR gRNA sequence
aaacagagatatttctgtat

SEQ ID NO: 733996 - DNA, 20 bp, Artificial
  CRISPR gRNA sequence
gagatatttctgtatcagtc

SEQ ID NO: 733997 - DNA, 20 bp, Artificial
  CRISPR gRNA sequence
tttgatatttctgtatcaaa

SEQ ID NO: 733998 - DNA, 20 bp, Artificial
  CRISPR gRNA sequence
ttgatatttctgtatcaaac

SEQ ID NO: 733999 - DNA, 20 bp, Artificial
  CRISPR gRNA sequence
ggtgacctaatcacaccact

SEQ ID NO: 734000 - DNA, 20 bp, Artificial
  CRISPR gRNA sequence
gacctaatcacaccactaag

SEQ ID NO: 734001 - DNA, 20 bp, Artificial
  CRISPR gRNA sequence
ctaatcacaccactaagtgg

SEQ ID NO: 734002 - DNA, 20 bp, Artificial
  CRISPR gRNA sequence
acaccactaagtggtagaaa

SEQ ID NO: 734003 - DNA, 20 bp, Artificial
  CRISPR gRNA sequence
caccactaagtggtagaaac

SEQ ID NO: 734004 - DNA, 20 bp, Artificial
  CRISPR gRNA sequence
accactaagtggtagaaaca

SEQ ID NO: 734005 - DNA, 20 bp, Artificial
  CRISPR gRNA sequence
gtgctctctgttctctacta

SEQ ID NO: 734006 - DNA, 20 bp, Artificial
  CRISPR gRNA sequence
tgctctctgttctctactat

SEQ ID NO: 734007 - DNA, 20 bp, Artificial
  CRISPR gRNA sequence
gctctctgttctctactatg

SEQ ID NO: 734008 - DNA, 20 bp, Artificial
  CRISPR gRNA sequence
ctctctgttctctactatgg

SEQ ID NO: 734009 - DNA, 20 bp, Artificial
  CRISPR gRNA sequence
ctctgttctctactatgggg

SEQ ID NO: 734010 - DNA, 20 bp, Artificial
  CRISPR gRNA sequence
ctgttctctactatggggga

SEQ ID NO: 734011 - DNA, 20 bp, Artificial
  CRISPR gRNA sequence
ggggagagtctttttatatg

SEQ ID NO: 734012 - DNA, 20 bp, Artificial
  CRISPR gRNA sequence
ctttttatatgtggtttttt

SEQ ID NO: 734013 - DNA, 20 bp, Artificial
  CRISPR gRNA sequence
tttatatgtggtttttttgg

SEQ ID NO: 734014 - DNA, 20 bp, Artificial
  CRISPR gRNA sequence
gtggtttttttggaagactc

SEQ ID NO: 734015 - DNA, 20 bp, Artificial
  CRISPR gRNA sequence
tggtttttttggaagactct

SEQ ID NO: 734016 - DNA, 20 bp, Artificial
  CRISPR gRNA sequence
ggtttttttggaagactctg

SEQ ID NO: 734017 - DNA, 20 bp, Artificial
  CRISPR gRNA sequence
agactctggggtgaaattat

SEQ ID NO: 734018 - DNA, 20 bp, Artificial
  CRISPR gRNA sequence
ctctggggtgaaattatcag

SEQ ID NO: 734019 - DNA, 20 bp, Artificial
  CRISPR gRNA sequence
ctggggtgaaattatcagaa

SEQ ID NO: 734020 - DNA, 20 bp, Artificial
  CRISPR gRNA sequence
ggtgaaattatcagaagagt

SEQ ID NO: 734021 - DNA, 20 bp, Artificial
  CRISPR gRNA sequence
aattatcagaagagtcagct

SEQ ID NO: 734022 - DNA, 20 bp, Artificial
  CRISPR gRNA sequence
cagaagagtcagctgagctt

SEQ ID NO: 734023 - DNA, 20 bp, Artificial
  CRISPR gRNA sequence
agaagagtcagctgagctta

SEQ ID NO: 734024 - DNA, 20 bp, Artificial
  CRISPR gRNA sequence
agagtcagctgagcttaagg

SEQ ID NO: 734025 - DNA, 20 bp, Artificial
  CRISPR gRNA sequence
gagtcagctgagcttaaggc

SEQ ID NO: 734026 - DNA, 20 bp, Artificial
  CRISPR gRNA sequence
tcagctgagcttaaggcagg

SEQ ID NO: 734027 - DNA, 20 bp, Artificial
  CRISPR gRNA sequence
agctgagcttaaggcaggca

SEQ ID NO: 734028 - DNA, 20 bp, Artificial
  CRISPR gRNA sequence
gctgagcttaaggcaggcag

SEQ ID NO: 734029 - DNA, 20 bp, Artificial
  CRISPR gRNA sequence
ctgagcttaaggcaggcaga

SEQ ID NO: 734030 - DNA, 20 bp, Artificial
  CRISPR gRNA sequence
tgagcttaaggcaggcagag

SEQ ID NO: 734031 - DNA, 20 bp, Artificial
  CRISPR gRNA sequence
gcttaaggcaggcagagggg

SEQ ID NO: 734032 - DNA, 20 bp, Artificial
  CRISPR gRNA sequence
ttaaggcaggcagaggggtg

SEQ ID NO: 734033 - DNA, 20 bp, Artificial
  CRISPR gRNA sequence
taaggcaggcagaggggtgg

SEQ ID NO: 734034 - DNA, 20 bp, Artificial
  CRISPR gRNA sequence
aaggcaggcagaggggtgga

SEQ ID NO: 734035 - DNA, 20 bp, Artificial
  CRISPR gRNA sequence
ggcaggcagaggggtggagg

SEQ ID NO: 734036 - DNA, 20 bp, Artificial
  CRISPR gRNA sequence
cagaggggtggagggagccc

SEQ ID NO: 734037 - DNA, 20 bp, Artificial
  CRISPR gRNA sequence
agaggggtggagggagccca

SEQ ID NO: 734038 - DNA, 20 bp, Artificial
  CRISPR gRNA sequence
ggggtggagggagcccaagg

SEQ ID NO: 734039 - DNA, 20 bp, Artificial
  CRISPR gRNA sequence
tctccctctctctgtcccct

SEQ ID NO: 734040 - DNA, 20 bp, Artificial
  CRISPR gRNA sequence
ctgagtcaccctgcacaccc

SEQ ID NO: 734041 - DNA, 20 bp, Artificial
  CRISPR gRNA sequence
cagttctgctctgtctctac

SEQ ID NO: 734042 - DNA, 20 bp, Artificial
  CRISPR gRNA sequence
gctctgtctctaccagactg

SEQ ID NO: 734043 - DNA, 20 bp, Artificial
  CRISPR gRNA sequence
ctaccagactgtggattatg

SEQ ID NO: 734044 - DNA, 20 bp, Artificial
  CRISPR gRNA sequence
taccagactgtggattatga

SEQ ID NO: 734045 - DNA, 20 bp, Artificial
  CRISPR gRNA sequence
gactgtggattatgaaggct

SEQ ID NO: 734046 - DNA, 20 bp, Artificial
  CRISPR gRNA sequence
ttggaccacatcttactcct

SEQ ID NO: 734047 - DNA, 20 bp, Artificial
  CRISPR gRNA sequence
ccacatcttactcctcagca

SEQ ID NO: 734048 - DNA, 20 bp, Artificial
  CRISPR gRNA sequence
acatcttactcctcagcata

SEQ ID NO: 734049 - DNA, 20 bp, Artificial
  CRISPR gRNA sequence
atcttactcctcagcataga

SEQ ID NO: 734050 - DNA, 20 bp, Artificial
  CRISPR gRNA sequence
tactcctcagcatagagaga

SEQ ID NO: 734051 - DNA, 20 bp, Artificial
  CRISPR gRNA sequence
gcatagagagaaagatattg

SEQ ID NO: 734052 - DNA, 20 bp, Artificial
  CRISPR gRNA sequence
catagagagaaagatattgc

SEQ ID NO: 734053 - DNA, 20 bp, Artificial
  CRISPR gRNA sequence
agagagaaagatattgcagg

SEQ ID NO: 734054 - DNA, 20 bp, Artificial
  CRISPR gRNA sequence
agaaagatattgcaggtgga

SEQ ID NO: 734055 - DNA, 20 bp, Artificial
  CRISPR gRNA sequence
aggtggaaagtgaataattg

SEQ ID NO: 734056 - DNA, 20 bp, Artificial
  CRISPR gRNA sequence
tgaataattgtagaatcctg

SEQ ID NO: 734057 - DNA, 20 bp, Artificial
  CRISPR gRNA sequence
tcctgtggttcacactccat

SEQ ID NO: 734058 - DNA, 20 bp, Artificial
  CRISPR gRNA sequence
cctgtggttcacactccatt

SEQ ID NO: 734059 - DNA, 20 bp, Artificial
  CRISPR gRNA sequence
tgtggttcacactccattgg

SEQ ID NO: 734060 - DNA, 20 bp, Artificial
  CRISPR gRNA sequence
agtttgtttacatgtatatt

SEQ ID NO: 734061 - DNA, 20 bp, Artificial
  CRISPR gRNA sequence
tgtttacatgtatatttaga

SEQ ID NO: 734062 - DNA, 20 bp, Artificial
  CRISPR gRNA sequence
gtttacatgtatatttagac

SEQ ID NO: 734063 - DNA, 20 bp, Artificial
  CRISPR gRNA sequence
atttagacaggcttgatcta

SEQ ID NO: 734064 - DNA, 20 bp, Artificial
  CRISPR gRNA sequence
tttagacaggcttgatctat

SEQ ID NO: 734065 - DNA, 20 bp, Artificial
  CRISPR gRNA sequence
atctatgggttttatgtaac

SEQ ID NO: 734066 - DNA, 20 bp, Artificial
  CRISPR gRNA sequence
aatattttaaaactaaacac

SEQ ID NO: 734067 - DNA, 20 bp, Artificial
  CRISPR gRNA sequence
ttttaaaactaaacaccaga

SEQ ID NO: 734068 - DNA, 20 bp, Artificial
  CRISPR gRNA sequence
aacaccagatggaatgaact

SEQ ID NO: 734069 - DNA, 20 bp, Artificial
  CRISPR gRNA sequence
acaccagatggaatgaacta

SEQ ID NO: 734070 - DNA, 20 bp, Artificial
  CRISPR gRNA sequence
accagatggaatgaactaag

SEQ ID NO: 734071 - DNA, 20 bp, Artificial
  CRISPR gRNA sequence
cagatggaatgaactaagga

SEQ ID NO: 734072 - DNA, 20 bp, Artificial
  CRISPR gRNA sequence
ctaaggagagttattattta

SEQ ID NO: 734073 - DNA, 20 bp, Artificial
  CRISPR gRNA sequence
aaggagagttattatttaaa

SEQ ID NO: 734074 - DNA, 20 bp, Artificial
  CRISPR gRNA sequence
aggagagttattatttaaag

SEQ ID NO: 734075 - DNA, 20 bp, Artificial
  CRISPR gRNA sequence
gttattatttaaagaggact

SEQ ID NO: 734076 - DNA, 20 bp, Artificial
  CRISPR gRNA sequence
ttaatcatattttcaaatac

SEQ ID NO: 734077 - DNA, 20 bp, Artificial
  CRISPR gRNA sequence
actagattttcttatctacc

SEQ ID NO: 734078 - DNA, 20 bp, Artificial
  CRISPR gRNA sequence
gattttcttatctacctagt

SEQ ID NO: 734079 - DNA, 20 bp, Artificial
  CRISPR gRNA sequence
ttcttatctacctagttagt

SEQ ID NO: 734080 - DNA, 20 bp, Artificial
  CRISPR gRNA sequence
tcttatctacctagttagtt

SEQ ID NO: 734081 - DNA, 20 bp, Artificial
  CRISPR gRNA sequence
gtctctgcatctgtctcact

SEQ ID NO: 734082 - DNA, 20 bp, Artificial
  CRISPR gRNA sequence
tctctgcatctgtctcactg

SEQ ID NO: 734083 - DNA, 20 bp, Artificial
  CRISPR gRNA sequence
ctctgcatctgtctcactga

SEQ ID NO: 734084 - DNA, 20 bp, Artificial
  CRISPR gRNA sequence
gtctcactgagggcatgacc

SEQ ID NO: 734085 - DNA, 20 bp, Artificial
  CRISPR gRNA sequence
tctcactgagggcatgacct

SEQ ID NO: 734086 - DNA, 20 bp, Artificial
  CRISPR gRNA sequence
atgacctgggtttttcccac

SEQ ID NO: 734087 - DNA, 20 bp, Artificial
  CRISPR gRNA sequence
tttttcccacaagaattccc

SEQ ID NO: 734088 - DNA, 20 bp, Artificial
  CRISPR gRNA sequence
ttttcccacaagaattccct

SEQ ID NO: 734089 - DNA, 20 bp, Artificial
  CRISPR gRNA sequence
acaagaattccctgggatgc

SEQ ID NO: 734090 - DNA, 20 bp, Artificial
  CRISPR gRNA sequence
caagaattccctgggatgcc

SEQ ID NO: 734091 - DNA, 20 bp, Artificial
  CRISPR gRNA sequence
attccctgggatgccgggca

SEQ ID NO: 734092 - DNA, 20 bp, Artificial
  CRISPR gRNA sequence
ccctgggatgccgggcacag

SEQ ID NO: 734093 - DNA, 20 bp, Artificial
  CRISPR gRNA sequence
gtggctcacgcctgcaatcc

SEQ ID NO: 734094 - DNA, 20 bp, Artificial
  CRISPR gRNA sequence
cgcctgcaatcccagcactt

SEQ ID NO: 734095 - DNA, 20 bp, Artificial
  CRISPR gRNA sequence
gcctgcaatcccagcacttt

SEQ ID NO: 734096 - DNA, 20 bp, Artificial
  CRISPR gRNA sequence
ctgcaatcccagcactttgg

SEQ ID NO: 734097 - DNA, 20 bp, Artificial
  CRISPR gRNA sequence
tgcaatcccagcactttggg

SEQ ID NO: 734098 - DNA, 20 bp, Artificial
  CRISPR gRNA sequence
tcccagcactttgggaggcc

SEQ ID NO: 734099 - DNA, 20 bp, Artificial
  CRISPR gRNA sequence
cccagcactttgggaggccg

SEQ ID NO: 734100 - DNA, 20 bp, Artificial
  CRISPR gRNA sequence
agcactttgggaggccgagg

SEQ ID NO: 734101 - DNA, 20 bp, Artificial
  CRISPR gRNA sequence
gcactttgggaggccgaggc

SEQ ID NO: 734102 - DNA, 20 bp, Artificial
  CRISPR gRNA sequence
ctttgggaggccgaggcagg

SEQ ID NO: 734103 - DNA, 20 bp, Artificial
  CRISPR gRNA sequence
gccgaggcaggtggatcacg

SEQ ID NO: 734104 - DNA, 20 bp, Artificial
  CRISPR gRNA sequence
ggcaggtggatcacgaagtc

SEQ ID NO: 734105 - DNA, 20 bp, Artificial
  CRISPR gRNA sequence
caggtggatcacgaagtcaa

SEQ ID NO: 734106 - DNA, 20 bp, Artificial
  CRISPR gRNA sequence
gatcacgaagtcaagagatt

SEQ ID NO: 734107 - DNA, 20 bp, Artificial
  CRISPR gRNA sequence
tcaagagattgagaccatcc

SEQ ID NO: 734108 - DNA, 20 bp, Artificial
  CRISPR gRNA sequence
tgagaccatcctggctaaca

SEQ ID NO: 734109 - DNA, 20 bp, Artificial
  CRISPR gRNA sequence
ctactaaaaatacaaaaaat

SEQ ID NO: 734110 - DNA, 20 bp, Artificial
  CRISPR gRNA sequence
taaaaatacaaaaaattagc

SEQ ID NO: 734111 - DNA, 20 bp, Artificial
  CRISPR gRNA sequence
tacaaaaaattagccggacg

SEQ ID NO: 734112 - DNA, 20 bp, Artificial
  CRISPR gRNA sequence
aaaaaattagccggacgtgg

SEQ ID NO: 734113 - DNA, 20 bp, Artificial
  CRISPR gRNA sequence
aaattagccggacgtggtgg

SEQ ID NO: 734114 - DNA, 20 bp, Artificial
  CRISPR gRNA sequence
aattagccggacgtggtggc

SEQ ID NO: 734115 - DNA, 20 bp, Artificial
  CRISPR gRNA sequence
gacgtggtggcaggcacctg

SEQ ID NO: 734116 - DNA, 20 bp, Artificial
  CRISPR gRNA sequence
gtggcaggcacctgtagtcc

SEQ ID NO: 734117 - DNA, 20 bp, Artificial
  CRISPR gRNA sequence
cacctgtagtcccagctact

SEQ ID NO: 734118 - DNA, 20 bp, Artificial
  CRISPR gRNA sequence
acctgtagtcccagctactc

SEQ ID NO: 734119 - DNA, 20 bp, Artificial
  CRISPR gRNA sequence
ctgtagtcccagctactcag

SEQ ID NO: 734120 - DNA, 20 bp, Artificial
  CRISPR gRNA sequence
tgtagtcccagctactcagg

SEQ ID NO: 734121 - DNA, 20 bp, Artificial
  CRISPR gRNA sequence
tcccagctactcaggaggct

SEQ ID NO: 734122 - DNA, 20 bp, Artificial
  CRISPR gRNA sequence
cccagctactcaggaggctg

SEQ ID NO: 734123 - DNA, 20 bp, Artificial
  CRISPR gRNA sequence
agctactcaggaggctgagg

SEQ ID NO: 734124 - DNA, 20 bp, Artificial
  CRISPR gRNA sequence
gctactcaggaggctgaggc

SEQ ID NO: 734125 - DNA, 20 bp, Artificial
  CRISPR gRNA sequence
tactcaggaggctgaggcag

SEQ ID NO: 734126 - DNA, 20 bp, Artificial
  CRISPR gRNA sequence
aggaggctgaggcaggagaa

SEQ ID NO: 734127 - DNA, 20 bp, Artificial
  CRISPR gRNA sequence
gcaggagaatagtttgaacc

SEQ ID NO: 734128 - DNA, 20 bp, Artificial
  CRISPR gRNA sequence
caggagaatagtttgaaccc

SEQ ID NO: 734129 - DNA, 20 bp, Artificial
  CRISPR gRNA sequence
ggagaatagtttgaacccag

SEQ ID NO: 734130 - DNA, 20 bp, Artificial
  CRISPR gRNA sequence
gagaatagtttgaacccagg

SEQ ID NO: 734131 - DNA, 20 bp, Artificial
  CRISPR gRNA sequence
aatagtttgaacccaggagg

SEQ ID NO: 734132 - DNA, 20 bp, Artificial
  CRISPR gRNA sequence
tagtttgaacccaggaggcg

SEQ ID NO: 734133 - DNA, 20 bp, Artificial
  CRISPR gRNA sequence
agtttgaacccaggaggcgg

SEQ ID NO: 734134 - DNA, 20 bp, Artificial
  CRISPR gRNA sequence
aacccaggaggcggaggtta

SEQ ID NO: 734135 - DNA, 20 bp, Artificial
  CRISPR gRNA sequence
caggaggcggaggttacagt

SEQ ID NO: 734136 - DNA, 20 bp, Artificial
  CRISPR gRNA sequence
ggcggaggttacagtgagct

SEQ ID NO: 734137 - DNA, 20 bp, Artificial
  CRISPR gRNA sequence
gagatcgtgccactgcactc

SEQ ID NO: 734138 - DNA, 20 bp, Artificial
  CRISPR gRNA sequence
cgtgccactgcactccagcc

SEQ ID NO: 734139 - DNA, 20 bp, Artificial
  CRISPR gRNA sequence
gtgccactgcactccagcct

SEQ ID NO: 734140 - DNA, 20 bp, Artificial
  CRISPR gRNA sequence
ctgcactccagcctgggcaa

SEQ ID NO: 734141 - DNA, 20 bp, Artificial
  CRISPR gRNA sequence
gcactccagcctgggcaaca

SEQ ID NO: 734142 - DNA, 20 bp, Artificial
  CRISPR gRNA sequence
tccagcctgggcaacagagc

SEQ ID NO: 734143 - DNA, 20 bp, Artificial
  CRISPR gRNA sequence
caaaacaaaaatgaattccc

SEQ ID NO: 734144 - DNA, 20 bp, Artificial
  CRISPR gRNA sequence
aaaacaaaaatgaattccct

SEQ ID NO: 734145 - DNA, 20 bp, Artificial
  CRISPR gRNA sequence
gaattccctgggaatccctg

SEQ ID NO: 734146 - DNA, 20 bp, Artificial
  CRISPR gRNA sequence
tccctgggaatccctgaaga

SEQ ID NO: 734147 - DNA, 20 bp, Artificial
  CRISPR gRNA sequence
cctgggaatccctgaagaca

SEQ ID NO: 734148 - DNA, 20 bp, Artificial
  CRISPR gRNA sequence
agagcttgtcactttcccat

SEQ ID NO: 734149 - DNA, 20 bp, Artificial
  CRISPR gRNA sequence
ttgtcactttcccatcagac

SEQ ID NO: 734150 - DNA, 20 bp, Artificial
  CRISPR gRNA sequence
atcagactagaaaataccat

SEQ ID NO: 734151 - DNA, 20 bp, Artificial
  CRISPR gRNA sequence
tcagactagaaaataccatg

SEQ ID NO: 734152 - DNA, 20 bp, Artificial
  CRISPR gRNA sequence
actagaaaataccatgagga

SEQ ID NO: 734153 - DNA, 20 bp, Artificial
  CRISPR gRNA sequence
ctagaaaataccatgaggaa

SEQ ID NO: 734154 - DNA, 20 bp, Artificial
  CRISPR gRNA sequence
tagaaaataccatgaggaaa

SEQ ID NO: 734155 - DNA, 20 bp, Artificial
  CRISPR gRNA sequence
agaaaataccatgaggaaag

SEQ ID NO: 734156 - DNA, 20 bp, Artificial
  CRISPR gRNA sequence
aggaaaggggctgtgtctga

SEQ ID NO: 734157 - DNA, 20 bp, Artificial
  CRISPR gRNA sequence
gaaaggggctgtgtctgatg

SEQ ID NO: 734158 - DNA, 20 bp, Artificial
  CRISPR gRNA sequence
gctgtgtctgatggagctcc

SEQ ID NO: 734159 - DNA, 20 bp, Artificial
  CRISPR gRNA sequence
aaatgctgcgtttcctccat

SEQ ID NO: 734160 - DNA, 20 bp, Artificial
  CRISPR gRNA sequence
ctgcgtttcctccattagac

SEQ ID NO: 734161 - DNA, 20 bp, Artificial
  CRISPR gRNA sequence
tgcgtttcctccattagact

SEQ ID NO: 734162 - DNA, 20 bp, Artificial
  CRISPR gRNA sequence
gcgtttcctccattagactg

SEQ ID NO: 734163 - DNA, 20 bp, Artificial
  CRISPR gRNA sequence
cattagactggggactcact

SEQ ID NO: 734164 - DNA, 20 bp, Artificial
  CRISPR gRNA sequence
attagactggggactcactg

SEQ ID NO: 734165 - DNA, 20 bp, Artificial
  CRISPR gRNA sequence
ttagactggggactcactga

SEQ ID NO: 734166 - DNA, 20 bp, Artificial
  CRISPR gRNA sequence
gatatacctgcctcctccat

SEQ ID NO: 734167 - DNA, 20 bp, Artificial
  CRISPR gRNA sequence
tgcctcctccatcagactga

SEQ ID NO: 734168 - DNA, 20 bp, Artificial
  CRISPR gRNA sequence
catcagactgaaagctccct

SEQ ID NO: 734169 - DNA, 20 bp, Artificial
  CRISPR gRNA sequence
tcagactgaaagctccctga

SEQ ID NO: 734170 - DNA, 20 bp, Artificial
  CRISPR gRNA sequence
gactgaaagctccctgagag

SEQ ID NO: 734171 - DNA, 20 bp, Artificial
  CRISPR gRNA sequence
actgaaagctccctgagagc

SEQ ID NO: 734172 - DNA, 20 bp, Artificial
  CRISPR gRNA sequence
ctgaaagctccctgagagcg

SEQ ID NO: 734173 - DNA, 20 bp, Artificial
  CRISPR gRNA sequence
tgaaagctccctgagagcgg

SEQ ID NO: 734174 - DNA, 20 bp, Artificial
  CRISPR gRNA sequence
ttgtgtctccactgtaatac

SEQ ID NO: 734175 - DNA, 20 bp, Artificial
  CRISPR gRNA sequence
tgtctccactgtaatactgg

SEQ ID NO: 734176 - DNA, 20 bp, Artificial
  CRISPR gRNA sequence
tccactgtaatactggaagc

SEQ ID NO: 734177 - DNA, 20 bp, Artificial
  CRISPR gRNA sequence
tactggaagctagctgtttt

SEQ ID NO: 734178 - DNA, 20 bp, Artificial
  CRISPR gRNA sequence
actggaagctagctgttttc

SEQ ID NO: 734179 - DNA, 20 bp, Artificial
  CRISPR gRNA sequence
ctggaagctagctgttttca

SEQ ID NO: 734180 - DNA, 20 bp, Artificial
  CRISPR gRNA sequence
agggcccattcacctccctt

SEQ ID NO: 734181 - DNA, 20 bp, Artificial
  CRISPR gRNA sequence
ccattcacctcccttcagat

SEQ ID NO: 734182 - DNA, 20 bp, Artificial
  CRISPR gRNA sequence
cattcacctcccttcagatt

SEQ ID NO: 734183 - DNA, 20 bp, Artificial
  CRISPR gRNA sequence
attcacctcccttcagattg

SEQ ID NO: 734184 - DNA, 20 bp, Artificial
  CRISPR gRNA sequence
acctcccttcagattggggc

SEQ ID NO: 734185 - DNA, 20 bp, Artificial
  CRISPR gRNA sequence
agattggggcaagctccctg

SEQ ID NO: 734186 - DNA, 20 bp, Artificial
  CRISPR gRNA sequence
gattggggcaagctccctga

SEQ ID NO: 734187 - DNA, 20 bp, Artificial
  CRISPR gRNA sequence
tggggcaagctccctgaagg

SEQ ID NO: 734188 - DNA, 20 bp, Artificial
  CRISPR gRNA sequence
ggggcaagctccctgaaggc

SEQ ID NO: 734189 - DNA, 20 bp, Artificial
  CRISPR gRNA sequence
gggcaagctccctgaaggcg

SEQ ID NO: 734190 - DNA, 20 bp, Artificial
  CRISPR gRNA sequence
tgtatttccccctcaatctg

SEQ ID NO: 734191 - DNA, 20 bp, Artificial
  CRISPR gRNA sequence
gtatttccccctcaatctgt

SEQ ID NO: 734192 - DNA, 20 bp, Artificial
  CRISPR gRNA sequence
tcaatctgtgggttctgtga

SEQ ID NO: 734193 - DNA, 20 bp, Artificial
  CRISPR gRNA sequence
atctgtgggttctgtgacag

SEQ ID NO: 734194 - DNA, 20 bp, Artificial
  CRISPR gRNA sequence
tctgtgggttctgtgacagc

SEQ ID NO: 734195 - DNA, 20 bp, Artificial
  CRISPR gRNA sequence
tcttcttcctctcctcttgc

SEQ ID NO: 734196 - DNA, 20 bp, Artificial
  CRISPR gRNA sequence
cttgccagaccttattcaat

SEQ ID NO: 734197 - DNA, 20 bp, Artificial
  CRISPR gRNA sequence
ttcaataagtattgtctcca

SEQ ID NO: 734198 - DNA, 20 bp, Artificial
  CRISPR gRNA sequence
tcaataagtattgtctccac

SEQ ID NO: 734199 - DNA, 20 bp, Artificial
  CRISPR gRNA sequence
tccacaggcccctctgctga

SEQ ID NO: 734200 - DNA, 20 bp, Artificial
  CRISPR gRNA sequence
tgctgacagtgtatacacaa

SEQ ID NO: 734201 - DNA, 20 bp, Artificial
  CRISPR gRNA sequence
gacagtgtatacacaaaagt

SEQ ID NO: 734202 - DNA, 20 bp, Artificial
  CRISPR gRNA sequence
acagtgtatacacaaaagtg

SEQ ID NO: 734203 - DNA, 20 bp, Artificial
  CRISPR gRNA sequence
cacaaaagtgaggctccttg

SEQ ID NO: 734204 - DNA, 20 bp, Artificial
  CRISPR gRNA sequence
acaaaagtgaggctccttga

SEQ ID NO: 734205 - DNA, 20 bp, Artificial
  CRISPR gRNA sequence
caaaagtgaggctccttgaa

SEQ ID NO: 734206 - DNA, 20 bp, Artificial
  CRISPR gRNA sequence
aaaagtgaggctccttgaag

SEQ ID NO: 734207 - DNA, 20 bp, Artificial
  CRISPR gRNA sequence
aagtgaggctccttgaaggg

SEQ ID NO: 734208 - DNA, 20 bp, Artificial
  CRISPR gRNA sequence
aaggggagactctgtctgtg

SEQ ID NO: 734209 - DNA, 20 bp, Artificial
  CRISPR gRNA sequence
tgtctgtgcagtgctcctat

SEQ ID NO: 734210 - DNA, 20 bp, Artificial
  CRISPR gRNA sequence
gtctgtgcagtgctcctata

SEQ ID NO: 734211 - DNA, 20 bp, Artificial
  CRISPR gRNA sequence
tctgtgcagtgctcctataa

SEQ ID NO: 734212 - DNA, 20 bp, Artificial
  CRISPR gRNA sequence
taagggctacaaaaaccgcg

SEQ ID NO: 734213 - DNA, 20 bp, Artificial
  CRISPR gRNA sequence
agggctacaaaaaccgcgtg

SEQ ID NO: 734214 - DNA, 20 bp, Artificial
  CRISPR gRNA sequence
gggctacaaaaaccgcgtgg

SEQ ID NO: 734215 - DNA, 20 bp, Artificial
  CRISPR gRNA sequence
ggctacaaaaaccgcgtgga

SEQ ID NO: 734216 - DNA, 20 bp, Artificial
  CRISPR gRNA sequence
acaaaaaccgcgtggagggc

SEQ ID NO: 734217 - DNA, 20 bp, Artificial
  CRISPR gRNA sequence
caaaaaccgcgtggagggca

SEQ ID NO: 734218 - DNA, 20 bp, Artificial
  CRISPR gRNA sequence
accgcgtggagggcaaggtt

SEQ ID NO: 734219 - DNA, 20 bp, Artificial
  CRISPR gRNA sequence
ggcaaggtttggtgcaaaat

SEQ ID NO: 734220 - DNA, 20 bp, Artificial
  CRISPR gRNA sequence
gcaaggtttggtgcaaaatc

SEQ ID NO: 734221 - DNA, 20 bp, Artificial
  CRISPR gRNA sequence
aggtttggtgcaaaatcagg

SEQ ID NO: 734222 - DNA, 20 bp, Artificial
  CRISPR gRNA sequence
tttggtgcaaaatcaggaag

SEQ ID NO: 734223 - DNA, 20 bp, Artificial
  CRISPR gRNA sequence
ggtgcaaaatcaggaagaag

SEQ ID NO: 734224 - DNA, 20 bp, Artificial
  CRISPR gRNA sequence
aaatcaggaagaagaagtgt

SEQ ID NO: 734225 - DNA, 20 bp, Artificial
  CRISPR gRNA sequence
aggaagaagaagtgtgagcc

SEQ ID NO: 734226 - DNA, 20 bp, Artificial
  CRISPR gRNA sequence
gtgtgagcctggctttgccc

SEQ ID NO: 734227 - DNA, 20 bp, Artificial
  CRISPR gRNA sequence
agcctggctttgcccgagtc

SEQ ID NO: 734228 - DNA, 20 bp, Artificial
  CRISPR gRNA sequence
gcctggctttgcccgagtct

SEQ ID NO: 734229 - DNA, 20 bp, Artificial
  CRISPR gRNA sequence
ctttgcccgagtctgggtga

SEQ ID NO: 734230 - DNA, 20 bp, Artificial
  CRISPR gRNA sequence
tttgcccgagtctgggtgaa

SEQ ID NO: 734231 - DNA, 20 bp, Artificial
  CRISPR gRNA sequence
ttgcccgagtctgggtgaaa

SEQ ID NO: 734232 - DNA, 20 bp, Artificial
  CRISPR gRNA sequence
aagggccccgctacttgctg

SEQ ID NO: 734233 - DNA, 20 bp, Artificial
  CRISPR gRNA sequence
agggccccgctacttgctgc

SEQ ID NO: 734234 - DNA, 20 bp, Artificial
  CRISPR gRNA sequence
acttgctgcaggacgatgcc

SEQ ID NO: 734235 - DNA, 20 bp, Artificial
  CRISPR gRNA sequence
cttgctgcaggacgatgccc

SEQ ID NO: 734236 - DNA, 20 bp, Artificial
  CRISPR gRNA sequence
tgcaggacgatgcccaggcc

SEQ ID NO: 734237 - DNA, 20 bp, Artificial
  CRISPR gRNA sequence
gcaggacgatgcccaggcca

SEQ ID NO: 734238 - DNA, 20 bp, Artificial
  CRISPR gRNA sequence
ggacgatgcccaggccaagg

SEQ ID NO: 734239 - DNA, 20 bp, Artificial
  CRISPR gRNA sequence
caaggtggtcaacatcacca

SEQ ID NO: 734240 - DNA, 20 bp, Artificial
  CRISPR gRNA sequence
ggtggtcaacatcaccatgg

SEQ ID NO: 734241 - DNA, 20 bp, Artificial
  CRISPR gRNA sequence
acatcaccatggtggccctc

SEQ ID NO: 734242 - DNA, 20 bp, Artificial
  CRISPR gRNA sequence
ccatggtggccctcaagctc

SEQ ID NO: 734243 - DNA, 20 bp, Artificial
  CRISPR gRNA sequence
catggtggccctcaagctcc

SEQ ID NO: 734244 - DNA, 20 bp, Artificial
  CRISPR gRNA sequence
ggccctcaagctccaggact

SEQ ID NO: 734245 - DNA, 20 bp, Artificial
  CRISPR gRNA sequence
gccctcaagctccaggactc

SEQ ID NO: 734246 - DNA, 20 bp, Artificial
  CRISPR gRNA sequence
tccaggactcaggccgatac

SEQ ID NO: 734247 - DNA, 20 bp, Artificial
  CRISPR gRNA sequence
tggtgcatgcgcaacacctc

SEQ ID NO: 734248 - DNA, 20 bp, Artificial
  CRISPR gRNA sequence
ggtgcatgcgcaacacctct

SEQ ID NO: 734249 - DNA, 20 bp, Artificial
  CRISPR gRNA sequence
tgggatcctgtaccccttga

SEQ ID NO: 734250 - DNA, 20 bp, Artificial
  CRISPR gRNA sequence
gggatcctgtaccccttgat

SEQ ID NO: 734251 - DNA, 20 bp, Artificial
  CRISPR gRNA sequence
tgtaccccttgatgggcttc

SEQ ID NO: 734252 - DNA, 20 bp, Artificial
  CRISPR gRNA sequence
ccccttgatgggcttccagc

SEQ ID NO: 734253 - DNA, 20 bp, Artificial
  CRISPR gRNA sequence
cttccagctggatgtgtctc

SEQ ID NO: 734254 - DNA, 20 bp, Artificial
  CRISPR gRNA sequence
ttccagctggatgtgtctcc

SEQ ID NO: 734255 - DNA, 20 bp, Artificial
  CRISPR gRNA sequence
agctggatgtgtctccaggt

SEQ ID NO: 734256 - DNA, 20 bp, Artificial
  CRISPR gRNA sequence
tggatgtgtctccaggtgag

SEQ ID NO: 734257 - DNA, 20 bp, Artificial
  CRISPR gRNA sequence
ggatgtgtctccaggtgagc

SEQ ID NO: 734258 - DNA, 20 bp, Artificial
  CRISPR gRNA sequence
gtctccaggtgagcaggctg

SEQ ID NO: 734259 - DNA, 20 bp, Artificial
  CRISPR gRNA sequence
tccaggtgagcaggctgcag

SEQ ID NO: 734260 - DNA, 20 bp, Artificial
  CRISPR gRNA sequence
tgagcaggctgcagtggctc

SEQ ID NO: 734261 - DNA, 20 bp, Artificial
  CRISPR gRNA sequence
gagcaggctgcagtggctct

SEQ ID NO: 734262 - DNA, 20 bp, Artificial
  CRISPR gRNA sequence
aggctgcagtggctctggga

SEQ ID NO: 734263 - DNA, 20 bp, Artificial
  CRISPR gRNA sequence
ggctgcagtggctctgggac

SEQ ID NO: 734264 - DNA, 20 bp, Artificial
  CRISPR gRNA sequence
tgcagtggctctgggacggg

SEQ ID NO: 734265 - DNA, 20 bp, Artificial
  CRISPR gRNA sequence
cagtggctctgggacgggtg

SEQ ID NO: 734266 - DNA, 20 bp, Artificial
  CRISPR gRNA sequence
agtggctctgggacgggtgg

SEQ ID NO: 734267 - DNA, 20 bp, Artificial
  CRISPR gRNA sequence
gtggctctgggacgggtgga

SEQ ID NO: 734268 - DNA, 20 bp, Artificial
  CRISPR gRNA sequence
ggctctgggacgggtggagg

SEQ ID NO: 734269 - DNA, 20 bp, Artificial
  CRISPR gRNA sequence
gccccacactccactaacat

SEQ ID NO: 734270 - DNA, 20 bp, Artificial
  CRISPR gRNA sequence
cccacactccactaacatca

SEQ ID NO: 734271 - DNA, 20 bp, Artificial
  CRISPR gRNA sequence
ccactaacatcagagataat

SEQ ID NO: 734272 - DNA, 20 bp, Artificial
  CRISPR gRNA sequence
cactaacatcagagataata

SEQ ID NO: 734273 - DNA, 20 bp, Artificial
  CRISPR gRNA sequence
taataaggataataatccat

SEQ ID NO: 734274 - DNA, 20 bp, Artificial
  CRISPR gRNA sequence
taaggataataatccatcag

SEQ ID NO: 734275 - DNA, 20 bp, Artificial
  CRISPR gRNA sequence
tcagtggtcatgttgcactg

SEQ ID NO: 734276 - DNA, 20 bp, Artificial
  CRISPR gRNA sequence
atgttgcactgtagtgtttt

SEQ ID NO: 734277 - DNA, 20 bp, Artificial
  CRISPR gRNA sequence
gttgcactgtagtgttttca

SEQ ID NO: 734278 - DNA, 20 bp, Artificial
  CRISPR gRNA sequence
gtgttttcagagtgccttta

SEQ ID NO: 734279 - DNA, 20 bp, Artificial
  CRISPR gRNA sequence
tgcctttatggcactattcg

SEQ ID NO: 734280 - DNA, 20 bp, Artificial
  CRISPR gRNA sequence
gcactattgtcaccatttta

SEQ ID NO: 734281 - DNA, 20 bp, Artificial
  CRISPR gRNA sequence
ttgtcaccattttacagatg

SEQ ID NO: 734282 - DNA, 20 bp, Artificial
  CRISPR gRNA sequence
attttacagatgaagataat

SEQ ID NO: 734283 - DNA, 20 bp, Artificial
  CRISPR gRNA sequence
gataatgagacctgaaaacc

SEQ ID NO: 734284 - DNA, 20 bp, Artificial
  CRISPR gRNA sequence
tgaaaacccagtgtgactct

SEQ ID NO: 734285 - DNA, 20 bp, Artificial
  CRISPR gRNA sequence
agtgtgactctgagcttgtc

SEQ ID NO: 734286 - DNA, 20 bp, Artificial
  CRISPR gRNA sequence
gtgtgactctgagcttgtcc

SEQ ID NO: 734287 - DNA, 20 bp, Artificial
  CRISPR gRNA sequence
tgtgactctgagcttgtccg

SEQ ID NO: 734288 - DNA, 20 bp, Artificial
  CRISPR gRNA sequence
tctgagcttgtccggggtcc

SEQ ID NO: 734289 - DNA, 20 bp, Artificial
  CRISPR gRNA sequence
tgagcttgtccggggtccca

SEQ ID NO: 734290 - DNA, 20 bp, Artificial
  CRISPR gRNA sequence
cttgtccggggtcccagagc

SEQ ID NO: 734291 - DNA, 20 bp, Artificial
  CRISPR gRNA sequence
gtccggggtcccagagctag

SEQ ID NO: 734292 - DNA, 20 bp, Artificial
  CRISPR gRNA sequence
tccggggtcccagagctagc

SEQ ID NO: 734293 - DNA, 20 bp, Artificial
  CRISPR gRNA sequence
ggggtcccagagctagcagg

SEQ ID NO: 734294 - DNA, 20 bp, Artificial
  CRISPR gRNA sequence
cccagagctagcaggtggct

SEQ ID NO: 734295 - DNA, 20 bp, Artificial
  CRISPR gRNA sequence
agctagcaggtggctgagat

SEQ ID NO: 734296 - DNA, 20 bp, Artificial
  CRISPR gRNA sequence
gctagcaggtggctgagata

SEQ ID NO: 734297 - DNA, 20 bp, Artificial
  CRISPR gRNA sequence
gctgagataaggttcaaact

SEQ ID NO: 734298 - DNA, 20 bp, Artificial
  CRISPR gRNA sequence
ttgcttcaacataattcatt

SEQ ID NO: 734299 - DNA, 20 bp, Artificial
  CRISPR gRNA sequence
aattcattgagcccctatta

SEQ ID NO: 734300 - DNA, 20 bp, Artificial
  CRISPR gRNA sequence
attcattgagcccctattat

SEQ ID NO: 734301 - DNA, 20 bp, Artificial
  CRISPR gRNA sequence
ttcattgagcccctattatg

SEQ ID NO: 734302 - DNA, 20 bp, Artificial
  CRISPR gRNA sequence
attgagcccctattatgggg

SEQ ID NO: 734303 - DNA, 20 bp, Artificial
  CRISPR gRNA sequence
ttgagcccctattatggggc

SEQ ID NO: 734304 - DNA, 20 bp, Artificial
  CRISPR gRNA sequence
ttatggggcaggcactattc

SEQ ID NO: 734305 - DNA, 20 bp, Artificial
  CRISPR gRNA sequence
tatggggcaggcactattct

SEQ ID NO: 734306 - DNA, 20 bp, Artificial
  CRISPR gRNA sequence
caggcactattctaggctct

SEQ ID NO: 734307 - DNA, 20 bp, Artificial
  CRISPR gRNA sequence
aggcactattctaggctcta

SEQ ID NO: 734308 - DNA, 20 bp, Artificial
  CRISPR gRNA sequence
gcactattctaggctctaag

SEQ ID NO: 734309 - DNA, 20 bp, Artificial
  CRISPR gRNA sequence
tattctaggctctaaggaga

SEQ ID NO: 734310 - DNA, 20 bp, Artificial
  CRISPR gRNA sequence
ctaggctctaaggagacagt

SEQ ID NO: 734311 - DNA, 20 bp, Artificial
  CRISPR gRNA sequence
acactcacaatcctgcacta

SEQ ID NO: 734312 - DNA, 20 bp, Artificial
  CRISPR gRNA sequence
cactcacaatcctgcactat

SEQ ID NO: 734313 - DNA, 20 bp, Artificial
  CRISPR gRNA sequence
ctcacaatcctgcactatgg

SEQ ID NO: 734314 - DNA, 20 bp, Artificial
  CRISPR gRNA sequence
tcctgcactatgggagatga

SEQ ID NO: 734315 - DNA, 20 bp, Artificial
  CRISPR gRNA sequence
cctgcactatgggagatgac

SEQ ID NO: 734316 - DNA, 20 bp, Artificial
  CRISPR gRNA sequence
tgacaggcacacttattatc

SEQ ID NO: 734317 - DNA, 20 bp, Artificial
  CRISPR gRNA sequence
attatccagacaaataattg

SEQ ID NO: 734318 - DNA, 20 bp, Artificial
  CRISPR gRNA sequence
gacaaataattgcagaaaac

SEQ ID NO: 734319 - DNA, 20 bp, Artificial
  CRISPR gRNA sequence
caaataattgcagaaaacaa

SEQ ID NO: 734320 - DNA, 20 bp, Artificial
  CRISPR gRNA sequence
aaataattgcagaaaacaag

SEQ ID NO: 734321 - DNA, 20 bp, Artificial
  CRISPR gRNA sequence
agaaaacaagaggtgttcat

SEQ ID NO: 734322 - DNA, 20 bp, Artificial
  CRISPR gRNA sequence
aagaggtgttcataagaaac

SEQ ID NO: 734323 - DNA, 20 bp, Artificial
  CRISPR gRNA sequence
agaggtgttcataagaaact

SEQ ID NO: 734324 - DNA, 20 bp, Artificial
  CRISPR gRNA sequence
ttcaaataattgcaaataac

SEQ ID NO: 734325 - DNA, 20 bp, Artificial
  CRISPR gRNA sequence
caaataattgcaaataacta

SEQ ID NO: 734326 - DNA, 20 bp, Artificial
  CRISPR gRNA sequence
aaataattgcaaataactag

SEQ ID NO: 734327 - DNA, 20 bp, Artificial
  CRISPR gRNA sequence
aactagaggtgttcatgaac

SEQ ID NO: 734328 - DNA, 20 bp, Artificial
  CRISPR gRNA sequence
agaggtgttcatgaactagt

SEQ ID NO: 734329 - DNA, 20 bp, Artificial
  CRISPR gRNA sequence
tcatgaactagtaagcgact

SEQ ID NO: 734330 - DNA, 20 bp, Artificial
  CRISPR gRNA sequence
tgaactagtaagcgactcgg

SEQ ID NO: 734331 - DNA, 20 bp, Artificial
  CRISPR gRNA sequence
actagtaagcgactcggtgg

SEQ ID NO: 734332 - DNA, 20 bp, Artificial
  CRISPR gRNA sequence
ctagtaagcgactcggtggt

SEQ ID NO: 734333 - DNA, 20 bp, Artificial
  CRISPR gRNA sequence
tagtaagcgactcggtggtg

SEQ ID NO: 734334 - DNA, 20 bp, Artificial
  CRISPR gRNA sequence
agtaagcgactcggtggtgg

SEQ ID NO: 734335 - DNA, 20 bp, Artificial
  CRISPR gRNA sequence
taagcgactcggtggtgggg

SEQ ID NO: 734336 - DNA, 20 bp, Artificial
  CRISPR gRNA sequence
cggtggtgggggagctactg

SEQ ID NO: 734337 - DNA, 20 bp, Artificial
  CRISPR gRNA sequence
tgggggagctactgaagtac

SEQ ID NO: 734338 - DNA, 20 bp, Artificial
  CRISPR gRNA sequence
gggggagctactgaagtact

SEQ ID NO: 734339 - DNA, 20 bp, Artificial
  CRISPR gRNA sequence
ggggagctactgaagtactg

SEQ ID NO: 734340 - DNA, 20 bp, Artificial
  CRISPR gRNA sequence
gggagctactgaagtactgg

SEQ ID NO: 734341 - DNA, 20 bp, Artificial
  CRISPR gRNA sequence
gctactgaagtactgggggt

SEQ ID NO: 734342 - DNA, 20 bp, Artificial
  CRISPR gRNA sequence
tactgaagtactgggggtca

SEQ ID NO: 734343 - DNA, 20 bp, Artificial
  CRISPR gRNA sequence
gggtcagagaacacctccct

SEQ ID NO: 734344 - DNA, 20 bp, Artificial
  CRISPR gRNA sequence
tcagagaacacctcccttag

SEQ ID NO: 734345 - DNA, 20 bp, Artificial
  CRISPR gRNA sequence
ctcccttagcagacaacacc

SEQ ID NO: 734346 - DNA, 20 bp, Artificial
  CRISPR gRNA sequence
ccttagcagacaacaccaag

SEQ ID NO: 734347 - DNA, 20 bp, Artificial
  CRISPR gRNA sequence
ttagcagacaacaccaagca

SEQ ID NO: 734348 - DNA, 20 bp, Artificial
  CRISPR gRNA sequence
acaccaagcagagccctgaa

SEQ ID NO: 734349 - DNA, 20 bp, Artificial
  CRISPR gRNA sequence
caagcagagccctgaatggt

SEQ ID NO: 734350 - DNA, 20 bp, Artificial
  CRISPR gRNA sequence
cctgaatggtgagcattttc

SEQ ID NO: 734351 - DNA, 20 bp, Artificial
  CRISPR gRNA sequence
tttccagccctgttgaaatc

SEQ ID NO: 734352 - DNA, 20 bp, Artificial
  CRISPR gRNA sequence
ttccagccctgttgaaatct

SEQ ID NO: 734353 - DNA, 20 bp, Artificial
  CRISPR gRNA sequence
gttgaaatctgggtgctttg

SEQ ID NO: 734354 - DNA, 20 bp, Artificial
  CRISPR gRNA sequence
tgaaatctgggtgctttgaa

SEQ ID NO: 734355 - DNA, 20 bp, Artificial
  CRISPR gRNA sequence
tttgaagagcactttgtcgc

SEQ ID NO: 734356 - DNA, 20 bp, Artificial
  CRISPR gRNA sequence
tgaagagcactttgtcgcaa

SEQ ID NO: 734357 - DNA, 20 bp, Artificial
  CRISPR gRNA sequence
tcgcaagagctgaatatgca

SEQ ID NO: 734358 - DNA, 20 bp, Artificial
  CRISPR gRNA sequence
cgcaagagctgaatatgcaa

SEQ ID NO: 734359 - DNA, 20 bp, Artificial
  CRISPR gRNA sequence
gctgaatatgcaaaggtcct

SEQ ID NO: 734360 - DNA, 20 bp, Artificial
  CRISPR gRNA sequence
ctgaatatgcaaaggtcctg

SEQ ID NO: 734361 - DNA, 20 bp, Artificial
  CRISPR gRNA sequence
atatgcaaaggtcctgaggt

SEQ ID NO: 734362 - DNA, 20 bp, Artificial
  CRISPR gRNA sequence
tgcaaaggtcctgaggtcag

SEQ ID NO: 734363 - DNA, 20 bp, Artificial
  CRISPR gRNA sequence
gcaaaggtcctgaggtcaga

SEQ ID NO: 734364 - DNA, 20 bp, Artificial
  CRISPR gRNA sequence
aaaggtcctgaggtcagaag

SEQ ID NO: 734365 - DNA, 20 bp, Artificial
  CRISPR gRNA sequence
tcctgaggtcagaaggagct

SEQ ID NO: 734366 - DNA, 20 bp, Artificial
  CRISPR gRNA sequence
agaaggagcttggcttgtat

SEQ ID NO: 734367 - DNA, 20 bp, Artificial
  CRISPR gRNA sequence
gaaggagcttggcttgtata

SEQ ID NO: 734368 - DNA, 20 bp, Artificial
  CRISPR gRNA sequence
tggcttgtataaggcttatt

SEQ ID NO: 734369 - DNA, 20 bp, Artificial
  CRISPR gRNA sequence
gcttatttagtcactctata

SEQ ID NO: 734370 - DNA, 20 bp, Artificial
  CRISPR gRNA sequence
ttatttagtcactctatatg

SEQ ID NO: 734371 - DNA, 20 bp, Artificial
  CRISPR gRNA sequence
agtcactctatatggagtgt

SEQ ID NO: 734372 - DNA, 20 bp, Artificial
  CRISPR gRNA sequence
gtcactctatatggagtgtg

SEQ ID NO: 734373 - DNA, 20 bp, Artificial
  CRISPR gRNA sequence
tggagtgtgaggcaatgaat

SEQ ID NO: 734374 - DNA, 20 bp, Artificial
  CRISPR gRNA sequence
ggagtgtgaggcaatgaatg

SEQ ID NO: 734375 - DNA, 20 bp, Artificial
  CRISPR gRNA sequence
agtgtgaggcaatgaatgag

SEQ ID NO: 734376 - DNA, 20 bp, Artificial
  CRISPR gRNA sequence
gtgtgaggcaatgaatgagg

SEQ ID NO: 734377 - DNA, 20 bp, Artificial
  CRISPR gRNA sequence
gaggcaatgaatgaggaggt

SEQ ID NO: 734378 - DNA, 20 bp, Artificial
  CRISPR gRNA sequence
ggcaatgaatgaggaggttg

SEQ ID NO: 734379 - DNA, 20 bp, Artificial
  CRISPR gRNA sequence
caatgaatgaggaggttgga

SEQ ID NO: 734380 - DNA, 20 bp, Artificial
  CRISPR gRNA sequence
aatgaggaggttggagagtc

SEQ ID NO: 734381 - DNA, 20 bp, Artificial
  CRISPR gRNA sequence
gaggaggttggagagtcaag

SEQ ID NO: 734382 - DNA, 20 bp, Artificial
  CRISPR gRNA sequence
tggagagtcaagcagccctg

SEQ ID NO: 734383 - DNA, 20 bp, Artificial
  CRISPR gRNA sequence
caagcagccctgaagaccat

SEQ ID NO: 734384 - DNA, 20 bp, Artificial
  CRISPR gRNA sequence
cagccctgaagaccataagt

SEQ ID NO: 734385 - DNA, 20 bp, Artificial
  CRISPR gRNA sequence
gaagaccataagttggaatt

SEQ ID NO: 734386 - DNA, 20 bp, Artificial
  CRISPR gRNA sequence
aagaccataagttggaattt

SEQ ID NO: 734387 - DNA, 20 bp, Artificial
  CRISPR gRNA sequence
ataagttggaatttaggtat

SEQ ID NO: 734388 - DNA, 20 bp, Artificial
  CRISPR gRNA sequence
aagttggaatttaggtataa

SEQ ID NO: 734389 - DNA, 20 bp, Artificial
  CRISPR gRNA sequence
agttggaatttaggtataag

SEQ ID NO: 734390 - DNA, 20 bp, Artificial
  CRISPR gRNA sequence
tggaatttaggtataagagg

SEQ ID NO: 734391 - DNA, 20 bp, Artificial
  CRISPR gRNA sequence
taggtataagaggaagctac

SEQ ID NO: 734392 - DNA, 20 bp, Artificial
  CRISPR gRNA sequence
ggtataagaggaagctacta

SEQ ID NO: 734393 - DNA, 20 bp, Artificial
  CRISPR gRNA sequence
tataagaggaagctactaga

SEQ ID NO: 734394 - DNA, 20 bp, Artificial
  CRISPR gRNA sequence
gaggaagctactagagagct

SEQ ID NO: 734395 - DNA, 20 bp, Artificial
  CRISPR gRNA sequence
ggaagctactagagagctca

SEQ ID NO: 734396 - DNA, 20 bp, Artificial
  CRISPR gRNA sequence
aagctactagagagctcaga

SEQ ID NO: 734397 - DNA, 20 bp, Artificial
  CRISPR gRNA sequence
agctgtcatgacttgttttt

SEQ ID NO: 734398 - DNA, 20 bp, Artificial
  CRISPR gRNA sequence
atgacttgtttttaagaatg

SEQ ID NO: 734399 - DNA, 20 bp, Artificial
  CRISPR gRNA sequence
acttgtttttaagaatgtag

SEQ ID NO: 734400 - DNA, 20 bp, Artificial
  CRISPR gRNA sequence
gaatgtagtggccacttgtt

SEQ ID NO: 734401 - DNA, 20 bp, Artificial
  CRISPR gRNA sequence
aatgtagtggccacttgttg

SEQ ID NO: 734402 - DNA, 20 bp, Artificial
  CRISPR gRNA sequence
tagtggccacttgttgagga

SEQ ID NO: 734403 - DNA, 20 bp, Artificial
  CRISPR gRNA sequence
tgttgaggatggattgtgaa

SEQ ID NO: 734404 - DNA, 20 bp, Artificial
  CRISPR gRNA sequence
gattgtgaatggtatgaaca

SEQ ID NO: 734405 - DNA, 20 bp, Artificial
  CRISPR gRNA sequence
attgtgaatggtatgaacac

SEQ ID NO: 734406 - DNA, 20 bp, Artificial
  CRISPR gRNA sequence
gtgaatggtatgaacacggg

SEQ ID NO: 734407 - DNA, 20 bp, Artificial
  CRISPR gRNA sequence
gaatggtatgaacacgggta

SEQ ID NO: 734408 - DNA, 20 bp, Artificial
  CRISPR gRNA sequence
atggtatgaacacgggtaga

SEQ ID NO: 734409 - DNA, 20 bp, Artificial
  CRISPR gRNA sequence
tggtatgaacacgggtagag

SEQ ID NO: 734410 - DNA, 20 bp, Artificial
  CRISPR gRNA sequence
cacgggtagagaggccattg

SEQ ID NO: 734411 - DNA, 20 bp, Artificial
  CRISPR gRNA sequence
acgggtagagaggccattgt

SEQ ID NO: 734412 - DNA, 20 bp, Artificial
  CRISPR gRNA sequence
gagaggccattgtgggcatc

SEQ ID NO: 734413 - DNA, 20 bp, Artificial
  CRISPR gRNA sequence
ggccattgtgggcatctggc

SEQ ID NO: 734414 - DNA, 20 bp, Artificial
  CRISPR gRNA sequence
gggcatctggctggaaacaa

SEQ ID NO: 734415 - DNA, 20 bp, Artificial
  CRISPR gRNA sequence
catctggctggaaacaacag

SEQ ID NO: 734416 - DNA, 20 bp, Artificial
  CRISPR gRNA sequence
ggctggaaacaacagtggcc

SEQ ID NO: 734417 - DNA, 20 bp, Artificial
  CRISPR gRNA sequence
ctggaaacaacagtggcctg

SEQ ID NO: 734418 - DNA, 20 bp, Artificial
  CRISPR gRNA sequence
cagtggcctggagtacaatg

SEQ ID NO: 734419 - DNA, 20 bp, Artificial
  CRISPR gRNA sequence
agtggcctggagtacaatgt

SEQ ID NO: 734420 - DNA, 20 bp, Artificial
  CRISPR gRNA sequence
ctggagtacaatgtaggcac

SEQ ID NO: 734421 - DNA, 20 bp, Artificial
  CRISPR gRNA sequence
gagtacaatgtaggcactag

SEQ ID NO: 734422 - DNA, 20 bp, Artificial
  CRISPR gRNA sequence
tacaatgtaggcactagtgg

SEQ ID NO: 734423 - DNA, 20 bp, Artificial
  CRISPR gRNA sequence
caatgtaggcactagtggca

SEQ ID NO: 734424 - DNA, 20 bp, Artificial
  CRISPR gRNA sequence
atgtaggcactagtggcaga

SEQ ID NO: 734425 - DNA, 20 bp, Artificial
  CRISPR gRNA sequence
tagtggcagagagatgtgaa

SEQ ID NO: 734426 - DNA, 20 bp, Artificial
  CRISPR gRNA sequence
agtggcagagagatgtgaat

SEQ ID NO: 734427 - DNA, 20 bp, Artificial
  CRISPR gRNA sequence
gggctcaaatctatgttttt

SEQ ID NO: 734428 - DNA, 20 bp, Artificial
  CRISPR gRNA sequence
tgtttttcagactttctgtt

SEQ ID NO: 734429 - DNA, 20 bp, Artificial
  CRISPR gRNA sequence
tgttcagctcatatgttttg

SEQ ID NO: 734430 - DNA, 20 bp, Artificial
  CRISPR gRNA sequence
gttcagctcatatgttttga

SEQ ID NO: 734431 - DNA, 20 bp, Artificial
  CRISPR gRNA sequence
cagctcatatgttttgaagg

SEQ ID NO: 734432 - DNA, 20 bp, Artificial
  CRISPR gRNA sequence
agctcatatgttttgaaggt

SEQ ID NO: 734433 - DNA, 20 bp, Artificial
  CRISPR gRNA sequence
catatgttttgaaggtagga

SEQ ID NO: 734434 - DNA, 20 bp, Artificial
  CRISPR gRNA sequence
atatgttttgaaggtaggac

SEQ ID NO: 734435 - DNA, 20 bp, Artificial
  CRISPR gRNA sequence
aaggtaggacaggatttgct

SEQ ID NO: 734436 - DNA, 20 bp, Artificial
  CRISPR gRNA sequence
aggacaggatttgctcagtt

SEQ ID NO: 734437 - DNA, 20 bp, Artificial
  CRISPR gRNA sequence
ggacaggatttgctcagttg

SEQ ID NO: 734438 - DNA, 20 bp, Artificial
  CRISPR gRNA sequence
gacaggatttgctcagttga

SEQ ID NO: 734439 - DNA, 20 bp, Artificial
  CRISPR gRNA sequence
acaggatttgctcagttgag

SEQ ID NO: 734440 - DNA, 20 bp, Artificial
  CRISPR gRNA sequence
gatttgctcagttgaggggt

SEQ ID NO: 734441 - DNA, 20 bp, Artificial
  CRISPR gRNA sequence
tcagttgaggggtgagccaa

SEQ ID NO: 734442 - DNA, 20 bp, Artificial
  CRISPR gRNA sequence
cagttgaggggtgagccaaa

SEQ ID NO: 734443 - DNA, 20 bp, Artificial
  CRISPR gRNA sequence
gttgaggggtgagccaaaag

SEQ ID NO: 734444 - DNA, 20 bp, Artificial
  CRISPR gRNA sequence
ttgaggggtgagccaaaagg

SEQ ID NO: 734445 - DNA, 20 bp, Artificial
  CRISPR gRNA sequence
tgagccaaaaggaggaatca

SEQ ID NO: 734446 - DNA, 20 bp, Artificial
  CRISPR gRNA sequence
ggaggaatcatggatgatcc

SEQ ID NO: 734447 - DNA, 20 bp, Artificial
  CRISPR gRNA sequence
gaggaatcatggatgatcca

SEQ ID NO: 734448 - DNA, 20 bp, Artificial
  CRISPR gRNA sequence
tccaaggttttctatttgat

SEQ ID NO: 734449 - DNA, 20 bp, Artificial
  CRISPR gRNA sequence
aaggttttctatttgatcag

SEQ ID NO: 734450 - DNA, 20 bp, Artificial
  CRISPR gRNA sequence
aggttttctatttgatcagc

SEQ ID NO: 734451 - DNA, 20 bp, Artificial
  CRISPR gRNA sequence
ttttctatttgatcagcagg

SEQ ID NO: 734452 - DNA, 20 bp, Artificial
  CRISPR gRNA sequence
tttgatcagcaggtggatga

SEQ ID NO: 734453 - DNA, 20 bp, Artificial
  CRISPR gRNA sequence
gtggatgatggtaccattga

SEQ ID NO: 734454 - DNA, 20 bp, Artificial
  CRISPR gRNA sequence
tgatggtaccattgatagcg

SEQ ID NO: 734455 - DNA, 20 bp, Artificial
  CRISPR gRNA sequence
gatggtaccattgatagcgt

SEQ ID NO: 734456 - DNA, 20 bp, Artificial
  CRISPR gRNA sequence
atggtaccattgatagcgta

SEQ ID NO: 734457 - DNA, 20 bp, Artificial
  CRISPR gRNA sequence
atagcgtagggtaaatctga

SEQ ID NO: 734458 - DNA, 20 bp, Artificial
  CRISPR gRNA sequence
agcgtagggtaaatctgaaa

SEQ ID NO: 734459 - DNA, 20 bp, Artificial
  CRISPR gRNA sequence
gcgtagggtaaatctgaaag

SEQ ID NO: 734460 - DNA, 20 bp, Artificial
  CRISPR gRNA sequence
gtagggtaaatctgaaagag

SEQ ID NO: 734461 - DNA, 20 bp, Artificial
  CRISPR gRNA sequence
atctgaaagaggagctaatt

SEQ ID NO: 734462 - DNA, 20 bp, Artificial
  CRISPR gRNA sequence
ctgaaagaggagctaatttg

SEQ ID NO: 734463 - DNA, 20 bp, Artificial
  CRISPR gRNA sequence
tgaaagaggagctaatttgg

SEQ ID NO: 734464 - DNA, 20 bp, Artificial
  CRISPR gRNA sequence
aaagaggagctaatttggag

SEQ ID NO: 734465 - DNA, 20 bp, Artificial
  CRISPR gRNA sequence
taatttggaggagaaaaatc

SEQ ID NO: 734466 - DNA, 20 bp, Artificial
  CRISPR gRNA sequence
atttggaggagaaaaatcaa

SEQ ID NO: 734467 - DNA, 20 bp, Artificial
  CRISPR gRNA sequence
gagctctcttttgtcatgtt

SEQ ID NO: 734468 - DNA, 20 bp, Artificial
  CRISPR gRNA sequence
tcttttgtcatgttaagttt

SEQ ID NO: 734469 - DNA, 20 bp, Artificial
  CRISPR gRNA sequence
gttaagtttaagatacctcc

SEQ ID NO: 734470 - DNA, 20 bp, Artificial
  CRISPR gRNA sequence
aagatacctcctagaacccc

SEQ ID NO: 734471 - DNA, 20 bp, Artificial
  CRISPR gRNA sequence
atacctcctagaaccccaag

SEQ ID NO: 734472 - DNA, 20 bp, Artificial
  CRISPR gRNA sequence
tacctcctagaaccccaagt

SEQ ID NO: 734473 - DNA, 20 bp, Artificial
  CRISPR gRNA sequence
acctcctagaaccccaagtg

SEQ ID NO: 734474 - DNA, 20 bp, Artificial
  CRISPR gRNA sequence
gaaccccaagtggggaaatg

SEQ ID NO: 734475 - DNA, 20 bp, Artificial
  CRISPR gRNA sequence
cccaagtggggaaatgcagc

SEQ ID NO: 734476 - DNA, 20 bp, Artificial
  CRISPR gRNA sequence
aagtggggaaatgcagccag

SEQ ID NO: 734477 - DNA, 20 bp, Artificial
  CRISPR gRNA sequence
ccagcagtgatatacctgcc

SEQ ID NO: 734478 - DNA, 20 bp, Artificial
  CRISPR gRNA sequence
agcagtgatatacctgcctg

SEQ ID NO: 734479 - DNA, 20 bp, Artificial
  CRISPR gRNA sequence
gtgatatacctgcctggagc

SEQ ID NO: 734480 - DNA, 20 bp, Artificial
  CRISPR gRNA sequence
tgatatacctgcctggagct

SEQ ID NO: 734481 - DNA, 20 bp, Artificial
  CRISPR gRNA sequence
gatatacctgcctggagcta

SEQ ID NO: 734482 - DNA, 20 bp, Artificial
  CRISPR gRNA sequence
tacctgcctggagctagggt

SEQ ID NO: 734483 - DNA, 20 bp, Artificial
  CRISPR gRNA sequence
cctgcctggagctagggtga

SEQ ID NO: 734484 - DNA, 20 bp, Artificial
  CRISPR gRNA sequence
ctgcctggagctagggtgag

SEQ ID NO: 734485 - DNA, 20 bp, Artificial
  CRISPR gRNA sequence
ctggagctagggtgagaggt

SEQ ID NO: 734486 - DNA, 20 bp, Artificial
  CRISPR gRNA sequence
ggagctagggtgagaggtca

SEQ ID NO: 734487 - DNA, 20 bp, Artificial
  CRISPR gRNA sequence
ctagggtgagaggtcagagc

SEQ ID NO: 734488 - DNA, 20 bp, Artificial
  CRISPR gRNA sequence
tagggtgagaggtcagagct

SEQ ID NO: 734489 - DNA, 20 bp, Artificial
  CRISPR gRNA sequence
agggtgagaggtcagagctg

SEQ ID NO: 734490 - DNA, 20 bp, Artificial
  CRISPR gRNA sequence
gagctggggtatgtatttga

SEQ ID NO: 734491 - DNA, 20 bp, Artificial
  CRISPR gRNA sequence
tatttgaaagtatctctata

SEQ ID NO: 734492 - DNA, 20 bp, Artificial
  CRISPR gRNA sequence
tgaaagtatctctataaaga

SEQ ID NO: 734493 - DNA, 20 bp, Artificial
  CRISPR gRNA sequence
ctctataaagatagtgttta

SEQ ID NO: 734494 - DNA, 20 bp, Artificial
  CRISPR gRNA sequence
taaagatagtgtttaaagtc

SEQ ID NO: 734495 - DNA, 20 bp, Artificial
  CRISPR gRNA sequence
aaagatagtgtttaaagtcc

SEQ ID NO: 734496 - DNA, 20 bp, Artificial
  CRISPR gRNA sequence
aagatagtgtttaaagtcca

SEQ ID NO: 734497 - DNA, 20 bp, Artificial
  CRISPR gRNA sequence
gtgtttaaagtccagggaat

SEQ ID NO: 734498 - DNA, 20 bp, Artificial
  CRISPR gRNA sequence
gtttaaagtccagggaatta

SEQ ID NO: 734499 - DNA, 20 bp, Artificial
  CRISPR gRNA sequence
cagggaattagagaaatcta

SEQ ID NO: 734500 - DNA, 20 bp, Artificial
  CRISPR gRNA sequence
attagagaaatctacagaca

SEQ ID NO: 734501 - DNA, 20 bp, Artificial
  CRISPR gRNA sequence
gagaaatctacagacacaga

SEQ ID NO: 734502 - DNA, 20 bp, Artificial
  CRISPR gRNA sequence
aaatctacagacacagaaag

SEQ ID NO: 734503 - DNA, 20 bp, Artificial
  CRISPR gRNA sequence
tacagacacagaaagtagat

SEQ ID NO: 734504 - DNA, 20 bp, Artificial
  CRISPR gRNA sequence
agacacagaaagtagattag

SEQ ID NO: 734505 - DNA, 20 bp, Artificial
  CRISPR gRNA sequence
aaagtagattagtggttgct

SEQ ID NO: 734506 - DNA, 20 bp, Artificial
  CRISPR gRNA sequence
aagtagattagtggttgctt

SEQ ID NO: 734507 - DNA, 20 bp, Artificial
  CRISPR gRNA sequence
agtagattagtggttgctta

SEQ ID NO: 734508 - DNA, 20 bp, Artificial
  CRISPR gRNA sequence
gattagtggttgcttagggc

SEQ ID NO: 734509 - DNA, 20 bp, Artificial
  CRISPR gRNA sequence
attagtggttgcttagggct

SEQ ID NO: 734510 - DNA, 20 bp, Artificial
  CRISPR gRNA sequence
ttagtggttgcttagggctg

SEQ ID NO: 734511 - DNA, 20 bp, Artificial
  CRISPR gRNA sequence
tagtggttgcttagggctgg

SEQ ID NO: 734512 - DNA, 20 bp, Artificial
  CRISPR gRNA sequence
tggttgcttagggctggggg

SEQ ID NO: 734513 - DNA, 20 bp, Artificial
  CRISPR gRNA sequence
ggttgcttagggctggggga

SEQ ID NO: 734514 - DNA, 20 bp, Artificial
  CRISPR gRNA sequence
cttagggctgggggaaggaa

SEQ ID NO: 734515 - DNA, 20 bp, Artificial
  CRISPR gRNA sequence
ttagggctgggggaaggaaa

SEQ ID NO: 734516 - DNA, 20 bp, Artificial
  CRISPR gRNA sequence
tagggctgggggaaggaaaa

SEQ ID NO: 734517 - DNA, 20 bp, Artificial
  CRISPR gRNA sequence
agggctgggggaaggaaaag

SEQ ID NO: 734518 - DNA, 20 bp, Artificial
  CRISPR gRNA sequence
gggggaaggaaaaggggata

SEQ ID NO: 734519 - DNA, 20 bp, Artificial
  CRISPR gRNA sequence
gaaaaggggatacagaatca

SEQ ID NO: 734520 - DNA, 20 bp, Artificial
  CRISPR gRNA sequence
gatacagaatcatagataaa

SEQ ID NO: 734521 - DNA, 20 bp, Artificial
  CRISPR gRNA sequence
cagaatcatagataaacagt

SEQ ID NO: 734522 - DNA, 20 bp, Artificial
  CRISPR gRNA sequence
agaatcatagataaacagta

SEQ ID NO: 734523 - DNA, 20 bp, Artificial
  CRISPR gRNA sequence
gaatcatagataaacagtaa

SEQ ID NO: 734524 - DNA, 20 bp, Artificial
  CRISPR gRNA sequence
aatcatagataaacagtaag

SEQ ID NO: 734525 - DNA, 20 bp, Artificial
  CRISPR gRNA sequence
aaacagtaaggggtttcttt

SEQ ID NO: 734526 - DNA, 20 bp, Artificial
  CRISPR gRNA sequence
acagtaaggggtttcttttg

SEQ ID NO: 734527 - DNA, 20 bp, Artificial
  CRISPR gRNA sequence
ggtttcttttggagatgatg

SEQ ID NO: 734528 - DNA, 20 bp, Artificial
  CRISPR gRNA sequence
gtttcttttggagatgatga

SEQ ID NO: 734529 - DNA, 20 bp, Artificial
  CRISPR gRNA sequence
tctgaaactcactgtgatga

SEQ ID NO: 734530 - DNA, 20 bp, Artificial
  CRISPR gRNA sequence
tgatggttgcataactttgt

SEQ ID NO: 734531 - DNA, 20 bp, Artificial
  CRISPR gRNA sequence
ataactttgtaagcataata

SEQ ID NO: 734532 - DNA, 20 bp, Artificial
  CRISPR gRNA sequence
aagcataataaagaaccact

SEQ ID NO: 734533 - DNA, 20 bp, Artificial
  CRISPR gRNA sequence
actgagctttatactataaa

SEQ ID NO: 734534 - DNA, 20 bp, Artificial
  CRISPR gRNA sequence
ctgagctttatactataaat

SEQ ID NO: 734535 - DNA, 20 bp, Artificial
  CRISPR gRNA sequence
ttatactataaatgggatgt

SEQ ID NO: 734536 - DNA, 20 bp, Artificial
  CRISPR gRNA sequence
atgtgagttatatctcaata

SEQ ID NO: 734537 - DNA, 20 bp, Artificial
  CRISPR gRNA sequence
ataaagttcttaaaaatatc

SEQ ID NO: 734538 - DNA, 20 bp, Artificial
  CRISPR gRNA sequence
ttaaaaatatcaagatctaa

SEQ ID NO: 734539 - DNA, 20 bp, Artificial
  CRISPR gRNA sequence
agatctaaaagctctccctt

SEQ ID NO: 734540 - DNA, 20 bp, Artificial
  CRISPR gRNA sequence
taaaagctctcccttgagtg

SEQ ID NO: 734541 - DNA, 20 bp, Artificial
  CRISPR gRNA sequence
aaaagctctcccttgagtgt

SEQ ID NO: 734542 - DNA, 20 bp, Artificial
  CRISPR gRNA sequence
tcccttgagtgtaggcaaaa

SEQ ID NO: 734543 - DNA, 20 bp, Artificial
  CRISPR gRNA sequence
ccttgagtgtaggcaaaaaa

SEQ ID NO: 734544 - DNA, 20 bp, Artificial
  CRISPR gRNA sequence
tgagtgtaggcaaaaaagag

SEQ ID NO: 734545 - DNA, 20 bp, Artificial
  CRISPR gRNA sequence
agtgtaggcaaaaaagagtg

SEQ ID NO: 734546 - DNA, 20 bp, Artificial
  CRISPR gRNA sequence
gcaaaaaagagtggagcacc

SEQ ID NO: 734547 - DNA, 20 bp, Artificial
  CRISPR gRNA sequence
aagagtggagcaccaagccg

SEQ ID NO: 734548 - DNA, 20 bp, Artificial
  CRISPR gRNA sequence
agagtggagcaccaagccgt

SEQ ID NO: 734549 - DNA, 20 bp, Artificial
  CRISPR gRNA sequence
gagtggagcaccaagccgtg

SEQ ID NO: 734550 - DNA, 20 bp, Artificial
  CRISPR gRNA sequence
tggggtccttccacatttat

SEQ ID NO: 734551 - DNA, 20 bp, Artificial
  CRISPR gRNA sequence
gtccttccacatttattaga

SEQ ID NO: 734552 - DNA, 20 bp, Artificial
  CRISPR gRNA sequence
tccacatttattagatagaa

SEQ ID NO: 734553 - DNA, 20 bp, Artificial
  CRISPR gRNA sequence
ccacatttattagatagaaa

SEQ ID NO: 734554 - DNA, 20 bp, Artificial
  CRISPR gRNA sequence
cacatttattagatagaaaa

SEQ ID NO: 734555 - DNA, 20 bp, Artificial
  CRISPR gRNA sequence
tttattagatagaaaaggga

SEQ ID NO: 734556 - DNA, 20 bp, Artificial
  CRISPR gRNA sequence
ttattagatagaaaagggaa

SEQ ID NO: 734557 - DNA, 20 bp, Artificial
  CRISPR gRNA sequence
gatagaaaagggaaaggact

SEQ ID NO: 734558 - DNA, 20 bp, Artificial
  CRISPR gRNA sequence
aaagggaaaggactcagcta

SEQ ID NO: 734559 - DNA, 20 bp, Artificial
  CRISPR gRNA sequence
aaggactcagctaaagaccc

SEQ ID NO: 734560 - DNA, 20 bp, Artificial
  CRISPR gRNA sequence
ctcagctaaagaccccggaa

SEQ ID NO: 734561 - DNA, 20 bp, Artificial
  CRISPR gRNA sequence
tcagctaaagaccccggaaa

SEQ ID NO: 734562 - DNA, 20 bp, Artificial
  CRISPR gRNA sequence
gctaaagaccccggaaaagg

SEQ ID NO: 734563 - DNA, 20 bp, Artificial
  CRISPR gRNA sequence
aagaccccggaaaaggcagc

SEQ ID NO: 734564 - DNA, 20 bp, Artificial
  CRISPR gRNA sequence
aattgcatctccatcttcca

SEQ ID NO: 734565 - DNA, 20 bp, Artificial
  CRISPR gRNA sequence
attgcatctccatcttccac

SEQ ID NO: 734566 - DNA, 20 bp, Artificial
  CRISPR gRNA sequence
ttgcatctccatcttccaca

SEQ ID NO: 734567 - DNA, 20 bp, Artificial
  CRISPR gRNA sequence
atcttccacagggtctgaac

SEQ ID NO: 734568 - DNA, 20 bp, Artificial
  CRISPR gRNA sequence
tcttccacagggtctgaact

SEQ ID NO: 734569 - DNA, 20 bp, Artificial
  CRISPR gRNA sequence
cttccacagggtctgaacta

SEQ ID NO: 734570 - DNA, 20 bp, Artificial
  CRISPR gRNA sequence
aaaatgctgtcgctaaaatg

SEQ ID NO: 734571 - DNA, 20 bp, Artificial
  CRISPR gRNA sequence
aatgctgtcgctaaaatgtg

SEQ ID NO: 734572 - DNA, 20 bp, Artificial
  CRISPR gRNA sequence
aatctcattgctcccctctc

SEQ ID NO: 734573 - DNA, 20 bp, Artificial
  CRISPR gRNA sequence
ttgctcccctctccagttct

SEQ ID NO: 734574 - DNA, 20 bp, Artificial
  CRISPR gRNA sequence
tcccctctccagttctgagt

SEQ ID NO: 734575 - DNA, 20 bp, Artificial
  CRISPR gRNA sequence
ctccagttctgagtgagacc

SEQ ID NO: 734576 - DNA, 20 bp, Artificial
  CRISPR gRNA sequence
tccagttctgagtgagaccc

SEQ ID NO: 734577 - DNA, 20 bp, Artificial
  CRISPR gRNA sequence
ccagttctgagtgagaccca

SEQ ID NO: 734578 - DNA, 20 bp, Artificial
  CRISPR gRNA sequence
gttctgagtgagacccaggg

SEQ ID NO: 734579 - DNA, 20 bp, Artificial
  CRISPR gRNA sequence
agacccagggaagtcgaaac

SEQ ID NO: 734580 - DNA, 20 bp, Artificial
  CRISPR gRNA sequence
aagtcgaaactggttcactg

SEQ ID NO: 734581 - DNA, 20 bp, Artificial
  CRISPR gRNA sequence
ttcactgaagtcttaatatt

SEQ ID NO: 734582 - DNA, 20 bp, Artificial
  CRISPR gRNA sequence
tcactgaagtcttaatattt

SEQ ID NO: 734583 - DNA, 20 bp, Artificial
  CRISPR gRNA sequence
cactgaagtcttaatattta

SEQ ID NO: 734584 - DNA, 20 bp, Artificial
  CRISPR gRNA sequence
gaagtcttaatatttaggga

SEQ ID NO: 734585 - DNA, 20 bp, Artificial
  CRISPR gRNA sequence
catctcactttccacctctt

SEQ ID NO: 734586 - DNA, 20 bp, Artificial
  CRISPR gRNA sequence
atctcactttccacctctta

SEQ ID NO: 734587 - DNA, 20 bp, Artificial
  CRISPR gRNA sequence
cctcttaaggacaatttgtg

SEQ ID NO: 734588 - DNA, 20 bp, Artificial
  CRISPR gRNA sequence
ttgtgaagatttcaactttg

SEQ ID NO: 734589 - DNA, 20 bp, Artificial
  CRISPR gRNA sequence
ttgcagaccttttctgttat

SEQ ID NO: 734590 - DNA, 20 bp, Artificial
  CRISPR gRNA sequence
tgcagaccttttctgttatt

SEQ ID NO: 734591 - DNA, 20 bp, Artificial
  CRISPR gRNA sequence
cttattccaactacaaactc

SEQ ID NO: 734592 - DNA, 20 bp, Artificial
  CRISPR gRNA sequence
aactacaaactctggtcatc

SEQ ID NO: 734593 - DNA, 20 bp, Artificial
  CRISPR gRNA sequence
tacaaactctggtcatctag

SEQ ID NO: 734594 - DNA, 20 bp, Artificial
  CRISPR gRNA sequence
actctggtcatctagcagta

SEQ ID NO: 734595 - DNA, 20 bp, Artificial
  CRISPR gRNA sequence
ctctggtcatctagcagtat

SEQ ID NO: 734596 - DNA, 20 bp, Artificial
  CRISPR gRNA sequence
ggatattccactgccccctg

SEQ ID NO: 734597 - DNA, 20 bp, Artificial
  CRISPR gRNA sequence
ttccactgccccctgaagac

SEQ ID NO: 734598 - DNA, 20 bp, Artificial
  CRISPR gRNA sequence
tccactgccccctgaagacc

SEQ ID NO: 734599 - DNA, 20 bp, Artificial
  CRISPR gRNA sequence
cccctgaagaccaggtttta

SEQ ID NO: 734600 - DNA, 20 bp, Artificial
  CRISPR gRNA sequence
aagaccaggttttatggtcc

SEQ ID NO: 734601 - DNA, 20 bp, Artificial
  CRISPR gRNA sequence
agaccaggttttatggtcca

SEQ ID NO: 734602 - DNA, 20 bp, Artificial
  CRISPR gRNA sequence
tttatggtccaaggcatcta

SEQ ID NO: 734603 - DNA, 20 bp, Artificial
  CRISPR gRNA sequence
atggtccaaggcatctaaag

SEQ ID NO: 734604 - DNA, 20 bp, Artificial
  CRISPR gRNA sequence
ggtccaaggcatctaaagtg

SEQ ID NO: 734605 - DNA, 20 bp, Artificial
  CRISPR gRNA sequence
ccaaggcatctaaagtggag

SEQ ID NO: 734606 - DNA, 20 bp, Artificial
  CRISPR gRNA sequence
caaggcatctaaagtggaga

SEQ ID NO: 734607 - DNA, 20 bp, Artificial
  CRISPR gRNA sequence
gcatctaaagtggagaagga

SEQ ID NO: 734608 - DNA, 20 bp, Artificial
  CRISPR gRNA sequence
aagtggagaaggaaagttac

SEQ ID NO: 734609 - DNA, 20 bp, Artificial
  CRISPR gRNA sequence
aaggaaagttactggctgcc

SEQ ID NO: 734610 - DNA, 20 bp, Artificial
  CRISPR gRNA sequence
cagctccccatcctgcatct

SEQ ID NO: 734611 - DNA, 20 bp, Artificial
  CRISPR gRNA sequence
agctccccatcctgcatctt

SEQ ID NO: 734612 - DNA, 20 bp, Artificial
  CRISPR gRNA sequence
atcctgcatcttgggctgtg

SEQ ID NO: 734613 - DNA, 20 bp, Artificial
  CRISPR gRNA sequence
ctgcatcttgggctgtgaag

SEQ ID NO: 734614 - DNA, 20 bp, Artificial
  CRISPR gRNA sequence
tgcatcttgggctgtgaaga

SEQ ID NO: 734615 - DNA, 20 bp, Artificial
  CRISPR gRNA sequence
atcttgggctgtgaagaagg

SEQ ID NO: 734616 - DNA, 20 bp, Artificial
  CRISPR gRNA sequence
tcttgggctgtgaagaaggc

SEQ ID NO: 734617 - DNA, 20 bp, Artificial
  CRISPR gRNA sequence
cttgggctgtgaagaaggcg

SEQ ID NO: 734618 - DNA, 20 bp, Artificial
  CRISPR gRNA sequence
gaagaaggcggggttcctct

SEQ ID NO: 734619 - DNA, 20 bp, Artificial
  CRISPR gRNA sequence
tcctcttggttacctcttct

SEQ ID NO: 734620 - DNA, 20 bp, Artificial
  CRISPR gRNA sequence
ttacctcttcttggccctct

SEQ ID NO: 734621 - DNA, 20 bp, Artificial
  CRISPR gRNA sequence
gccctcttagtgtgttgatg

SEQ ID NO: 734622 - DNA, 20 bp, Artificial
  CRISPR gRNA sequence
ccctcttagtgtgttgatgc

SEQ ID NO: 734623 - DNA, 20 bp, Artificial
  CRISPR gRNA sequence
tagtgtgttgatgcaggaat

SEQ ID NO: 734624 - DNA, 20 bp, Artificial
  CRISPR gRNA sequence
agtgtgttgatgcaggaatg

SEQ ID NO: 734625 - DNA, 20 bp, Artificial
  CRISPR gRNA sequence
gtgtgttgatgcaggaatga

SEQ ID NO: 734626 - DNA, 20 bp, Artificial
  CRISPR gRNA sequence
gtgttgatgcaggaatgagg

SEQ ID NO: 734627 - DNA, 20 bp, Artificial
  CRISPR gRNA sequence
tgttgatgcaggaatgaggg

SEQ ID NO: 734628 - DNA, 20 bp, Artificial
  CRISPR gRNA sequence
gttgatgcaggaatgaggga

SEQ ID NO: 734629 - DNA, 20 bp, Artificial
  CRISPR gRNA sequence
ttgatgcaggaatgagggag

SEQ ID NO: 734630 - DNA, 20 bp, Artificial
  CRISPR gRNA sequence
tgatgcaggaatgagggagg

SEQ ID NO: 734631 - DNA, 20 bp, Artificial
  CRISPR gRNA sequence
atgcaggaatgagggagggg

SEQ ID NO: 734632 - DNA, 20 bp, Artificial
  CRISPR gRNA sequence
aggaatgagggagggggaga

SEQ ID NO: 734633 - DNA, 20 bp, Artificial
  CRISPR gRNA sequence
gggagggggagatggttatg

SEQ ID NO: 734634 - DNA, 20 bp, Artificial
  CRISPR gRNA sequence
gatggttatgtggcttaact

SEQ ID NO: 734635 - DNA, 20 bp, Artificial
  CRISPR gRNA sequence
tgtggcttaactgagtgttg

SEQ ID NO: 734636 - DNA, 20 bp, Artificial
  CRISPR gRNA sequence
gtggcttaactgagtgttgt

SEQ ID NO: 734637 - DNA, 20 bp, Artificial
  CRISPR gRNA sequence
tgtaggaatgctttccctgt

SEQ ID NO: 734638 - DNA, 20 bp, Artificial
  CRISPR gRNA sequence
ggatgtcattgcttgtctgc

SEQ ID NO: 734639 - DNA, 20 bp, Artificial
  CRISPR gRNA sequence
tgcttgtctgccagcccttt

SEQ ID NO: 734640 - DNA, 20 bp, Artificial
  CRISPR gRNA sequence
agccctttgagatcctctct

SEQ ID NO: 734641 - DNA, 20 bp, Artificial
  CRISPR gRNA sequence
gagtgtccatatactctccc

SEQ ID NO: 734642 - DNA, 20 bp, Artificial
  CRISPR gRNA sequence
agtgtccatatactctccca

SEQ ID NO: 734643 - DNA, 20 bp, Artificial
  CRISPR gRNA sequence
actgatgtgtgaattctctg

SEQ ID NO: 734644 - DNA, 20 bp, Artificial
  CRISPR gRNA sequence
tgatgtgtgaattctctgaa

SEQ ID NO: 734645 - DNA, 20 bp, Artificial
  CRISPR gRNA sequence
gaattctctgaagagttctt

SEQ ID NO: 734646 - DNA, 20 bp, Artificial
  CRISPR gRNA sequence
aattctctgaagagttcttt

SEQ ID NO: 734647 - DNA, 20 bp, Artificial
  CRISPR gRNA sequence
attctctgaagagttctttg

SEQ ID NO: 734648 - DNA, 20 bp, Artificial
  CRISPR gRNA sequence
ttctctgaagagttctttgg

SEQ ID NO: 734649 - DNA, 20 bp, Artificial
  CRISPR gRNA sequence
ttgggggtgtccccactgct

SEQ ID NO: 734650 - DNA, 20 bp, Artificial
  CRISPR gRNA sequence
cactgctgagtatgatgttg

SEQ ID NO: 734651 - DNA, 20 bp, Artificial
  CRISPR gRNA sequence
actgctgagtatgatgttgt

SEQ ID NO: 734652 - DNA, 20 bp, Artificial
  CRISPR gRNA sequence
tgctgagtatgatgttgtgg

SEQ ID NO: 734653 - DNA, 20 bp, Artificial
  CRISPR gRNA sequence
tgttgtgggagctctgactc

SEQ ID NO: 734654 - DNA, 20 bp, Artificial
  CRISPR gRNA sequence
gttgtgggagctctgactcc

SEQ ID NO: 734655 - DNA, 20 bp, Artificial
  CRISPR gRNA sequence
tgggagctctgactccaggt

SEQ ID NO: 734656 - DNA, 20 bp, Artificial
  CRISPR gRNA sequence
ctcaccaatgctgcttgttc

SEQ ID NO: 734657 - DNA, 20 bp, Artificial
  CRISPR gRNA sequence
tcaccaatgctgcttgttct

SEQ ID NO: 734658 - DNA, 20 bp, Artificial
  CRISPR gRNA sequence
ttgttctgggtccccttctc

SEQ ID NO: 734659 - DNA, 20 bp, Artificial
  CRISPR gRNA sequence
ggtccccttctccagaaaaa

SEQ ID NO: 734660 - DNA, 20 bp, Artificial
  CRISPR gRNA sequence
cttctccagaaaaatggctc

SEQ ID NO: 734661 - DNA, 20 bp, Artificial
  CRISPR gRNA sequence
ccagaaaaatggctcaagct

SEQ ID NO: 734662 - DNA, 20 bp, Artificial
  CRISPR gRNA sequence
caccttccatgatgacaatt

SEQ ID NO: 734663 - DNA, 20 bp, Artificial
  CRISPR gRNA sequence
catgatgacaatttggccct

SEQ ID NO: 734664 - DNA, 20 bp, Artificial
  CRISPR gRNA sequence
atgatgacaatttggccctt

SEQ ID NO: 734665 - DNA, 20 bp, Artificial
  CRISPR gRNA sequence
gaaattgccctttccatgca

SEQ ID NO: 734666 - DNA, 20 bp, Artificial
  CRISPR gRNA sequence
attgccctttccatgcacag

SEQ ID NO: 734667 - DNA, 20 bp, Artificial
  CRISPR gRNA sequence
gccctttccatgcacagtag

SEQ ID NO: 734668 - DNA, 20 bp, Artificial
  CRISPR gRNA sequence
ccctttccatgcacagtagt

SEQ ID NO: 734669 - DNA, 20 bp, Artificial
  CRISPR gRNA sequence
ccatgcacagtagtgggatg

SEQ ID NO: 734670 - DNA, 20 bp, Artificial
  CRISPR gRNA sequence
tgcacagtagtgggatgtag

SEQ ID NO: 734671 - DNA, 20 bp, Artificial
  CRISPR gRNA sequence
caattttcacattccatgct

SEQ ID NO: 734672 - DNA, 20 bp, Artificial
  CRISPR gRNA sequence
ataaaaccatcactcactgc

SEQ ID NO: 734673 - DNA, 20 bp, Artificial
  CRISPR gRNA sequence
taaaaccatcactcactgct

SEQ ID NO: 734674 - DNA, 20 bp, Artificial
  CRISPR gRNA sequence
actgctaggttgatgcctca

SEQ ID NO: 734675 - DNA, 20 bp, Artificial
  CRISPR gRNA sequence
ctcatccactgtccaaaacc

SEQ ID NO: 734676 - DNA, 20 bp, Artificial
  CRISPR gRNA sequence
tcatccactgtccaaaaccc

SEQ ID NO: 734677 - DNA, 20 bp, Artificial
  CRISPR gRNA sequence
tccaaaacccaggcttcttc

SEQ ID NO: 734678 - DNA, 20 bp, Artificial
  CRISPR gRNA sequence
cccaggcttcttctagaaaa

SEQ ID NO: 734679 - DNA, 20 bp, Artificial
  CRISPR gRNA sequence
ccaggcttcttctagaaaat

SEQ ID NO: 734680 - DNA, 20 bp, Artificial
  CRISPR gRNA sequence
gcttcttctagaaaatggga

SEQ ID NO: 734681 - DNA, 20 bp, Artificial
  CRISPR gRNA sequence
ttctagaaaatgggatggaa

SEQ ID NO: 734682 - DNA, 20 bp, Artificial
  CRISPR gRNA sequence
tctagaaaatgggatggaaa

SEQ ID NO: 734683 - DNA, 20 bp, Artificial
  CRISPR gRNA sequence
ctagaaaatgggatggaaaa

SEQ ID NO: 734684 - DNA, 20 bp, Artificial
  CRISPR gRNA sequence
aaaatgggatggaaaagggc

SEQ ID NO: 734685 - DNA, 20 bp, Artificial
  CRISPR gRNA sequence
aaatgggatggaaaagggct

SEQ ID NO: 734686 - DNA, 20 bp, Artificial
  CRISPR gRNA sequence
atggaaaagggctgggttga

SEQ ID NO: 734687 - DNA, 20 bp, Artificial
  CRISPR gRNA sequence
tggaaaagggctgggttgat

SEQ ID NO: 734688 - DNA, 20 bp, Artificial
  CRISPR gRNA sequence
aaagggctgggttgatgggt

SEQ ID NO: 734689 - DNA, 20 bp, Artificial
  CRISPR gRNA sequence
gctgggttgatgggtgagtg

SEQ ID NO: 734690 - DNA, 20 bp, Artificial
  CRISPR gRNA sequence
gggttgatgggtgagtgtag

SEQ ID NO: 734691 - DNA, 20 bp, Artificial
  CRISPR gRNA sequence
ggttgatgggtgagtgtagc

SEQ ID NO: 734692 - DNA, 20 bp, Artificial
  CRISPR gRNA sequence
atgggtgagtgtagcaggac

SEQ ID NO: 734693 - DNA, 20 bp, Artificial
  CRISPR gRNA sequence
aggaccagtttgatatctct

SEQ ID NO: 734694 - DNA, 20 bp, Artificial
  CRISPR gRNA sequence
ccagtttgatatctcttagt

SEQ ID NO: 734695 - DNA, 20 bp, Artificial
  CRISPR gRNA sequence
atatctcttagtgagccccc

SEQ ID NO: 734696 - DNA, 20 bp, Artificial
  CRISPR gRNA sequence
tatctcttagtgagccccca

SEQ ID NO: 734697 - DNA, 20 bp, Artificial
  CRISPR gRNA sequence
tcttagtgagcccccaagga

SEQ ID NO: 734698 - DNA, 20 bp, Artificial
  CRISPR gRNA sequence
tgtctgaccccaactgactg

SEQ ID NO: 734699 - DNA, 20 bp, Artificial
  CRISPR gRNA sequence
caactgactgcagctttctt

SEQ ID NO: 734700 - DNA, 20 bp, Artificial
  CRISPR gRNA sequence
tgcagctttctttggaattt

SEQ ID NO: 734701 - DNA, 20 bp, Artificial
  CRISPR gRNA sequence
gcagctttctttggaatttg

SEQ ID NO: 734702 - DNA, 20 bp, Artificial
  CRISPR gRNA sequence
tgcctccttgtcctcatctc

SEQ ID NO: 734703 - DNA, 20 bp, Artificial
  CRISPR gRNA sequence
tggaccctacttgtcaatta

SEQ ID NO: 734704 - DNA, 20 bp, Artificial
  CRISPR gRNA sequence
cctacttgtcaattatggaa

SEQ ID NO: 734705 - DNA, 20 bp, Artificial
  CRISPR gRNA sequence
cttgtcaattatggaatagc

SEQ ID NO: 734706 - DNA, 20 bp, Artificial
  CRISPR gRNA sequence
caattatggaatagctggaa

SEQ ID NO: 734707 - DNA, 20 bp, Artificial
  CRISPR gRNA sequence
tcttgtttgacattatttta

SEQ ID NO: 734708 - DNA, 20 bp, Artificial
  CRISPR gRNA sequence
ttattttatggaaatctttt

SEQ ID NO: 734709 - DNA, 20 bp, Artificial
  CRISPR gRNA sequence
atggaaatctttttggccca

SEQ ID NO: 734710 - DNA, 20 bp, Artificial
  CRISPR gRNA sequence
tggaaatctttttggcccat

SEQ ID NO: 734711 - DNA, 20 bp, Artificial
  CRISPR gRNA sequence
ctttttggcccataggaacg

SEQ ID NO: 734712 - DNA, 20 bp, Artificial
  CRISPR gRNA sequence
ttttggcccataggaacgaa

SEQ ID NO: 734713 - DNA, 20 bp, Artificial
  CRISPR gRNA sequence
tttggcccataggaacgaag

SEQ ID NO: 734714 - DNA, 20 bp, Artificial
  CRISPR gRNA sequence
ttggcccataggaacgaaga

SEQ ID NO: 734715 - DNA, 20 bp, Artificial
  CRISPR gRNA sequence
ccataggaacgaagagggcc

SEQ ID NO: 734716 - DNA, 20 bp, Artificial
  CRISPR gRNA sequence
aggaacgaagagggcctgga

SEQ ID NO: 734717 - DNA, 20 bp, Artificial
  CRISPR gRNA sequence
aagagggcctggaaagtgaa

SEQ ID NO: 734718 - DNA, 20 bp, Artificial
  CRISPR gRNA sequence
gagggcctggaaagtgaaaa

SEQ ID NO: 734719 - DNA, 20 bp, Artificial
  CRISPR gRNA sequence
gggcctggaaagtgaaaaga

SEQ ID NO: 734720 - DNA, 20 bp, Artificial
  CRISPR gRNA sequence
gcctggaaagtgaaaagaga

SEQ ID NO: 734721 - DNA, 20 bp, Artificial
  CRISPR gRNA sequence
ggaaagtgaaaagagagaga

SEQ ID NO: 734722 - DNA, 20 bp, Artificial
  CRISPR gRNA sequence
gaaagtgaaaagagagagat

SEQ ID NO: 734723 - DNA, 20 bp, Artificial
  CRISPR gRNA sequence
aaagtgaaaagagagagatg

SEQ ID NO: 734724 - DNA, 20 bp, Artificial
  CRISPR gRNA sequence
tgaaaagagagagatgggga

SEQ ID NO: 734725 - DNA, 20 bp, Artificial
  CRISPR gRNA sequence
aaaagagagagatggggatg

SEQ ID NO: 734726 - DNA, 20 bp, Artificial
  CRISPR gRNA sequence
aagagagagatggggatgga

SEQ ID NO: 734727 - DNA, 20 bp, Artificial
  CRISPR gRNA sequence
agagagagatggggatggag

SEQ ID NO: 734728 - DNA, 20 bp, Artificial
  CRISPR gRNA sequence
gagagagatggggatggaga

SEQ ID NO: 734729 - DNA, 20 bp, Artificial
  CRISPR gRNA sequence
agatggggatggagagggaa

SEQ ID NO: 734730 - DNA, 20 bp, Artificial
  CRISPR gRNA sequence
gatggggatggagagggaac

SEQ ID NO: 734731 - DNA, 20 bp, Artificial
  CRISPR gRNA sequence
ggggatggagagggaacagg

SEQ ID NO: 734732 - DNA, 20 bp, Artificial
  CRISPR gRNA sequence
agggaacaggtggcctgaca

SEQ ID NO: 734733 - DNA, 20 bp, Artificial
  CRISPR gRNA sequence
gggaacaggtggcctgacac

SEQ ID NO: 734734 - DNA, 20 bp, Artificial
  CRISPR gRNA sequence
gaacaggtggcctgacacgg

SEQ ID NO: 734735 - DNA, 20 bp, Artificial
  CRISPR gRNA sequence
aacaggtggcctgacacggg

SEQ ID NO: 734736 - DNA, 20 bp, Artificial
  CRISPR gRNA sequence
acaggtggcctgacacggga

SEQ ID NO: 734737 - DNA, 20 bp, Artificial
  CRISPR gRNA sequence
ggcctgacacgggagggaaa

SEQ ID NO: 734738 - DNA, 20 bp, Artificial
  CRISPR gRNA sequence
cgggagggaaaaagaaattg

SEQ ID NO: 734739 - DNA, 20 bp, Artificial
  CRISPR gRNA sequence
gagggaaaaagaaattgtgg

SEQ ID NO: 734740 - DNA, 20 bp, Artificial
  CRISPR gRNA sequence
gtggtagtctctcccttctt

SEQ ID NO: 734741 - DNA, 20 bp, Artificial
  CRISPR gRNA sequence
caaatacacatctgatcact

SEQ ID NO: 734742 - DNA, 20 bp, Artificial
  CRISPR gRNA sequence
atacacatctgatcactcag

SEQ ID NO: 734743 - DNA, 20 bp, Artificial
  CRISPR gRNA sequence
acatctgatcactcagcagc

SEQ ID NO: 734744 - DNA, 20 bp, Artificial
  CRISPR gRNA sequence
tcactcagcagccagaatcc

SEQ ID NO: 734745 - DNA, 20 bp, Artificial
  CRISPR gRNA sequence
cactcagcagccagaatcct

SEQ ID NO: 734746 - DNA, 20 bp, Artificial
  CRISPR gRNA sequence
gcagccagaatcctaggccc

SEQ ID NO: 734747 - DNA, 20 bp, Artificial
  CRISPR gRNA sequence
cagccagaatcctaggccca

SEQ ID NO: 734748 - DNA, 20 bp, Artificial
  CRISPR gRNA sequence
agaatcctaggcccaaggtc

SEQ ID NO: 734749 - DNA, 20 bp, Artificial
  CRISPR gRNA sequence
gaatcctaggcccaaggtca

SEQ ID NO: 734750 - DNA, 20 bp, Artificial
  CRISPR gRNA sequence
atcctaggcccaaggtcaag

SEQ ID NO: 734751 - DNA, 20 bp, Artificial
  CRISPR gRNA sequence
ctaggcccaaggtcaaggag

SEQ ID NO: 734752 - DNA, 20 bp, Artificial
  CRISPR gRNA sequence
aggcccaaggtcaaggagaa

SEQ ID NO: 734753 - DNA, 20 bp, Artificial
  CRISPR gRNA sequence
cccaaggtcaaggagaagag

SEQ ID NO: 734754 - DNA, 20 bp, Artificial
  CRISPR gRNA sequence
caaggtcaaggagaagagaa

SEQ ID NO: 734755 - DNA, 20 bp, Artificial
  CRISPR gRNA sequence
aaggtcaaggagaagagaag

SEQ ID NO: 734756 - DNA, 20 bp, Artificial
  CRISPR gRNA sequence
tcaaggagaagagaagagga

SEQ ID NO: 734757 - DNA, 20 bp, Artificial
  CRISPR gRNA sequence
caaggagaagagaagaggac

SEQ ID NO: 734758 - DNA, 20 bp, Artificial
  CRISPR gRNA sequence
gaagaggacaggcccccatc

SEQ ID NO: 734759 - DNA, 20 bp, Artificial
  CRISPR gRNA sequence
aagaggacaggcccccatcc

SEQ ID NO: 734760 - DNA, 20 bp, Artificial
  CRISPR gRNA sequence
caggcccccatccaggcttc

SEQ ID NO: 734761 - DNA, 20 bp, Artificial
  CRISPR gRNA sequence
aggcccccatccaggcttcc

SEQ ID NO: 734762 - DNA, 20 bp, Artificial
  CRISPR gRNA sequence
caggcttccaggcaactgtg

SEQ ID NO: 734763 - DNA, 20 bp, Artificial
  CRISPR gRNA sequence
aggcttccaggcaactgtgt

SEQ ID NO: 734764 - DNA, 20 bp, Artificial
  CRISPR gRNA sequence
caggcaactgtgtgggttgc

SEQ ID NO: 734765 - DNA, 20 bp, Artificial
  CRISPR gRNA sequence
aggcaactgtgtgggttgcc

SEQ ID NO: 734766 - DNA, 20 bp, Artificial
  CRISPR gRNA sequence
gggttgccaggatctgctcc

SEQ ID NO: 734767 - DNA, 20 bp, Artificial
  CRISPR gRNA sequence
caggatctgctcccagcact

SEQ ID NO: 734768 - DNA, 20 bp, Artificial
  CRISPR gRNA sequence
aggatctgctcccagcactg

SEQ ID NO: 734769 - DNA, 20 bp, Artificial
  CRISPR gRNA sequence
ctcccagcactgaggcaccc

SEQ ID NO: 734770 - DNA, 20 bp, Artificial
  CRISPR gRNA sequence
gttcctccctttctgtcttt

SEQ ID NO: 734771 - DNA, 20 bp, Artificial
  CRISPR gRNA sequence
gtctttcagctccccaaact

SEQ ID NO: 734772 - DNA, 20 bp, Artificial
  CRISPR gRNA sequence
ctttcagctccccaaactga

SEQ ID NO: 734773 - DNA, 20 bp, Artificial
  CRISPR gRNA sequence
tttcagctccccaaactgag

SEQ ID NO: 734774 - DNA, 20 bp, Artificial
  CRISPR gRNA sequence
gaacattcctttcacacatc

SEQ ID NO: 734775 - DNA, 20 bp, Artificial
  CRISPR gRNA sequence
cacatctggacaacatcctc

SEQ ID NO: 734776 - DNA, 20 bp, Artificial
  CRISPR gRNA sequence
catctggacaacatcctcaa

SEQ ID NO: 734777 - DNA, 20 bp, Artificial
  CRISPR gRNA sequence
ctggacaacatcctcaagag

SEQ ID NO: 734778 - DNA, 20 bp, Artificial
  CRISPR gRNA sequence
aagagtggaactgtcacaac

SEQ ID NO: 734779 - DNA, 20 bp, Artificial
  CRISPR gRNA sequence
tggaactgtcacaactggcc

SEQ ID NO: 734780 - DNA, 20 bp, Artificial
  CRISPR gRNA sequence
aactggccaagcccctacct

SEQ ID NO: 734781 - DNA, 20 bp, Artificial
  CRISPR gRNA sequence
actggccaagcccctacctc

SEQ ID NO: 734782 - DNA, 20 bp, Artificial
  CRISPR gRNA sequence
cctgatgccccttttaccac

SEQ ID NO: 734783 - DNA, 20 bp, Artificial
  CRISPR gRNA sequence
cccttttaccactggtgtga

SEQ ID NO: 734784 - DNA, 20 bp, Artificial
  CRISPR gRNA sequence
tggtgtgatggtgttcaccc

SEQ ID NO: 734785 - DNA, 20 bp, Artificial
  CRISPR gRNA sequence
ggtgtgatggtgttcacccc

SEQ ID NO: 734786 - DNA, 20 bp, Artificial
  CRISPR gRNA sequence
ccaggactcatcaccttgcc

SEQ ID NO: 734787 - DNA, 20 bp, Artificial
  CRISPR gRNA sequence
caggactcatcaccttgcct

SEQ ID NO: 734788 - DNA, 20 bp, Artificial
  CRISPR gRNA sequence
catcaccttgcctaggctct

SEQ ID NO: 734789 - DNA, 20 bp, Artificial
  CRISPR gRNA sequence
cctaggctcttagcctccac

SEQ ID NO: 734790 - DNA, 20 bp, Artificial
  CRISPR gRNA sequence
cctccaccagacctgcctcc

SEQ ID NO: 734791 - DNA, 20 bp, Artificial
  CRISPR gRNA sequence
caccagacctgcctccaaga

SEQ ID NO: 734792 - DNA, 20 bp, Artificial
  CRISPR gRNA sequence
accagacctgcctccaagac

SEQ ID NO: 734793 - DNA, 20 bp, Artificial
  CRISPR gRNA sequence
cctgcctccaagacaggcta

SEQ ID NO: 734794 - DNA, 20 bp, Artificial
  CRISPR gRNA sequence
ggctacagcttcactgctac

SEQ ID NO: 734795 - DNA, 20 bp, Artificial
  CRISPR gRNA sequence
ttcactgctaccagcaccac

SEQ ID NO: 734796 - DNA, 20 bp, Artificial
  CRISPR gRNA sequence
ctgctaccagcaccaccagc

SEQ ID NO: 734797 - DNA, 20 bp, Artificial
  CRISPR gRNA sequence
tgctaccagcaccaccagcc

SEQ ID NO: 734798 - DNA, 20 bp, Artificial
  CRISPR gRNA sequence
gctaccagcaccaccagcca

SEQ ID NO: 734799 - DNA, 20 bp, Artificial
  CRISPR gRNA sequence
agcaccaccagccagggacc

SEQ ID NO: 734800 - DNA, 20 bp, Artificial
  CRISPR gRNA sequence
gcaccaccagccagggaccc

SEQ ID NO: 734801 - DNA, 20 bp, Artificial
  CRISPR gRNA sequence
accaccagccagggacccag

SEQ ID NO: 734802 - DNA, 20 bp, Artificial
  CRISPR gRNA sequence
ccaccagccagggacccagg

SEQ ID NO: 734803 - DNA, 20 bp, Artificial
  CRISPR gRNA sequence
ccagggacccaggaggacca

SEQ ID NO: 734804 - DNA, 20 bp, Artificial
  CRISPR gRNA sequence
cagggacccaggaggaccat

SEQ ID NO: 734805 - DNA, 20 bp, Artificial
  CRISPR gRNA sequence
agggacccaggaggaccatg

SEQ ID NO: 734806 - DNA, 20 bp, Artificial
  CRISPR gRNA sequence
ccaggaggaccatggggtcc

SEQ ID NO: 734807 - DNA, 20 bp, Artificial
  CRISPR gRNA sequence
gaggaccatggggtcccaga

SEQ ID NO: 734808 - DNA, 20 bp, Artificial
  CRISPR gRNA sequence
cagacagtgaccgcgtctcc

SEQ ID NO: 734809 - DNA, 20 bp, Artificial
  CRISPR gRNA sequence
accgcgtctcccagcaatgc

SEQ ID NO: 734810 - DNA, 20 bp, Artificial
  CRISPR gRNA sequence
ccgcgtctcccagcaatgcc

SEQ ID NO: 734811 - DNA, 20 bp, Artificial
  CRISPR gRNA sequence
cgcgtctcccagcaatgcca

SEQ ID NO: 734812 - DNA, 20 bp, Artificial
  CRISPR gRNA sequence
aatgccagggactcctctgc

SEQ ID NO: 734813 - DNA, 20 bp, Artificial
  CRISPR gRNA sequence
cagggactcctctgctggcc

SEQ ID NO: 734814 - DNA, 20 bp, Artificial
  CRISPR gRNA sequence
gcccagaatccatctccact

SEQ ID NO: 734815 - DNA, 20 bp, Artificial
  CRISPR gRNA sequence
gaatccatctccactaagtc

SEQ ID NO: 734816 - DNA, 20 bp, Artificial
  CRISPR gRNA sequence
aatccatctccactaagtct

SEQ ID NO: 734817 - DNA, 20 bp, Artificial
  CRISPR gRNA sequence
atccatctccactaagtctg

SEQ ID NO: 734818 - DNA, 20 bp, Artificial
  CRISPR gRNA sequence
tccactaagtctggggacct

SEQ ID NO: 734819 - DNA, 20 bp, Artificial
  CRISPR gRNA sequence
aagtctggggacctcagcac

SEQ ID NO: 734820 - DNA, 20 bp, Artificial
  CRISPR gRNA sequence
cagcaccagatcgcccacca

SEQ ID NO: 734821 - DNA, 20 bp, Artificial
  CRISPR gRNA sequence
agcaccagatcgcccaccac

SEQ ID NO: 734822 - DNA, 20 bp, Artificial
  CRISPR gRNA sequence
gcaccagatcgcccaccaca

SEQ ID NO: 734823 - DNA, 20 bp, Artificial
  CRISPR gRNA sequence
accacagggctctgcctcac

SEQ ID NO: 734824 - DNA, 20 bp, Artificial
  CRISPR gRNA sequence
acagggctctgcctcaccag

SEQ ID NO: 734825 - DNA, 20 bp, Artificial
  CRISPR gRNA sequence
accagcagatctctcctcaa

SEQ ID NO: 734826 - DNA, 20 bp, Artificial
  CRISPR gRNA sequence
ctaccctccatgccctccat

SEQ ID NO: 734827 - DNA, 20 bp, Artificial
  CRISPR gRNA sequence
taccctccatgccctccatc

SEQ ID NO: 734828 - DNA, 20 bp, Artificial
  CRISPR gRNA sequence
tgccctccatcaggtacctg

SEQ ID NO: 734829 - DNA, 20 bp, Artificial
  CRISPR gRNA sequence
gccctccatcaggtacctgt

SEQ ID NO: 734830 - DNA, 20 bp, Artificial
  CRISPR gRNA sequence
ccctccatcaggtacctgtg

SEQ ID NO: 734831 - DNA, 20 bp, Artificial
  CRISPR gRNA sequence
catcaggtacctgtggggcc

SEQ ID NO: 734832 - DNA, 20 bp, Artificial
  CRISPR gRNA sequence
atcaggtacctgtggggcct

SEQ ID NO: 734833 - DNA, 20 bp, Artificial
  CRISPR gRNA sequence
tcaggtacctgtggggcctg

SEQ ID NO: 734834 - DNA, 20 bp, Artificial
  CRISPR gRNA sequence
tacctgtggggcctggggtt

SEQ ID NO: 734835 - DNA, 20 bp, Artificial
  CRISPR gRNA sequence
ctgtggggcctggggttgag

SEQ ID NO: 734836 - DNA, 20 bp, Artificial
  CRISPR gRNA sequence
ggcctggggttgagtggcac

SEQ ID NO: 734837 - DNA, 20 bp, Artificial
  CRISPR gRNA sequence
ggttgagtggcaccagcact

SEQ ID NO: 734838 - DNA, 20 bp, Artificial
  CRISPR gRNA sequence
accagcacttagtgcccaaa

SEQ ID NO: 734839 - DNA, 20 bp, Artificial
  CRISPR gRNA sequence
acttagtgcccaaacagacc

SEQ ID NO: 734840 - DNA, 20 bp, Artificial
  CRISPR gRNA sequence
ttagtgcccaaacagacctg

SEQ ID NO: 734841 - DNA, 20 bp, Artificial
  CRISPR gRNA sequence
tagtgcccaaacagacctgg

SEQ ID NO: 734842 - DNA, 20 bp, Artificial
  CRISPR gRNA sequence
ccaaacagacctggaggtgc

SEQ ID NO: 734843 - DNA, 20 bp, Artificial
  CRISPR gRNA sequence
gaccttccccttttgctccc

SEQ ID NO: 734844 - DNA, 20 bp, Artificial
  CRISPR gRNA sequence
accttccccttttgctcccc

SEQ ID NO: 734845 - DNA, 20 bp, Artificial
  CRISPR gRNA sequence
tgctccccaggaacccaatg

SEQ ID NO: 734846 - DNA, 20 bp, Artificial
  CRISPR gRNA sequence
tgtggcctgcttctgaatgt

SEQ ID NO: 734847 - DNA, 20 bp, Artificial
  CRISPR gRNA sequence
gtggcctgcttctgaatgtg

SEQ ID NO: 734848 - DNA, 20 bp, Artificial
  CRISPR gRNA sequence
gcctgcttctgaatgtgagg

SEQ ID NO: 734849 - DNA, 20 bp, Artificial
  CRISPR gRNA sequence
cctgcttctgaatgtgaggt

SEQ ID NO: 734850 - DNA, 20 bp, Artificial
  CRISPR gRNA sequence
ctgcttctgaatgtgaggtg

SEQ ID NO: 734851 - DNA, 20 bp, Artificial
  CRISPR gRNA sequence
tgcttctgaatgtgaggtgg

SEQ ID NO: 734852 - DNA, 20 bp, Artificial
  CRISPR gRNA sequence
ctgaatgtgaggtgggggac

SEQ ID NO: 734853 - DNA, 20 bp, Artificial
  CRISPR gRNA sequence
aatgtgaggtgggggactgg

SEQ ID NO: 734854 - DNA, 20 bp, Artificial
  CRISPR gRNA sequence
gggggactggaagtgacata

SEQ ID NO: 734855 - DNA, 20 bp, Artificial
  CRISPR gRNA sequence
ggggactggaagtgacataa

SEQ ID NO: 734856 - DNA, 20 bp, Artificial
  CRISPR gRNA sequence
actggaagtgacataaagga

SEQ ID NO: 734857 - DNA, 20 bp, Artificial
  CRISPR gRNA sequence
agtgacataaaggatggcaa

SEQ ID NO: 734858 - DNA, 20 bp, Artificial
  CRISPR gRNA sequence
tgacataaaggatggcaatg

SEQ ID NO: 734859 - DNA, 20 bp, Artificial
  CRISPR gRNA sequence
acataaaggatggcaatgga

SEQ ID NO: 734860 - DNA, 20 bp, Artificial
  CRISPR gRNA sequence
cataaaggatggcaatggag

SEQ ID NO: 734861 - DNA, 20 bp, Artificial
  CRISPR gRNA sequence
taaaggatggcaatggagag

SEQ ID NO: 734862 - DNA, 20 bp, Artificial
  CRISPR gRNA sequence
aaaggatggcaatggagagg

SEQ ID NO: 734863 - DNA, 20 bp, Artificial
  CRISPR gRNA sequence
aaggatggcaatggagagga

SEQ ID NO: 734864 - DNA, 20 bp, Artificial
  CRISPR gRNA sequence
aggatggcaatggagaggag

SEQ ID NO: 734865 - DNA, 20 bp, Artificial
  CRISPR gRNA sequence
atggcaatggagaggagggg

SEQ ID NO: 734866 - DNA, 20 bp, Artificial
  CRISPR gRNA sequence
tggcaatggagaggaggggc

SEQ ID NO: 734867 - DNA, 20 bp, Artificial
  CRISPR gRNA sequence
gcaatggagaggaggggcag

SEQ ID NO: 734868 - DNA, 20 bp, Artificial
  CRISPR gRNA sequence
aatggagaggaggggcagga

SEQ ID NO: 734869 - DNA, 20 bp, Artificial
  CRISPR gRNA sequence
tggagaggaggggcaggaga

SEQ ID NO: 734870 - DNA, 20 bp, Artificial
  CRISPR gRNA sequence
ggagaggaggggcaggagag

SEQ ID NO: 734871 - DNA, 20 bp, Artificial
  CRISPR gRNA sequence
agaggaggggcaggagagag

SEQ ID NO: 734872 - DNA, 20 bp, Artificial
  CRISPR gRNA sequence
gaggaggggcaggagagagg

SEQ ID NO: 734873 - DNA, 20 bp, Artificial
  CRISPR gRNA sequence
aggaggggcaggagagagga

SEQ ID NO: 734874 - DNA, 20 bp, Artificial
  CRISPR gRNA sequence
ggaggggcaggagagaggag

SEQ ID NO: 734875 - DNA, 20 bp, Artificial
  CRISPR gRNA sequence
ggggcaggagagaggagggg

SEQ ID NO: 734876 - DNA, 20 bp, Artificial
  CRISPR gRNA sequence
gggcaggagagaggaggggc

SEQ ID NO: 734877 - DNA, 20 bp, Artificial
  CRISPR gRNA sequence
ggcaggagagaggaggggca

SEQ ID NO: 734878 - DNA, 20 bp, Artificial
  CRISPR gRNA sequence
gcaggagagaggaggggcag

SEQ ID NO: 734879 - DNA, 20 bp, Artificial
  CRISPR gRNA sequence
gagagaggaggggcagggga

SEQ ID NO: 734880 - DNA, 20 bp, Artificial
  CRISPR gRNA sequence
agagaggaggggcaggggaa

SEQ ID NO: 734881 - DNA, 20 bp, Artificial
  CRISPR gRNA sequence
agaggaggggcaggggaaag

SEQ ID NO: 734882 - DNA, 20 bp, Artificial
  CRISPR gRNA sequence
gaggaggggcaggggaaagg

SEQ ID NO: 734883 - DNA, 20 bp, Artificial
  CRISPR gRNA sequence
aggaggggcaggggaaagga

SEQ ID NO: 734884 - DNA, 20 bp, Artificial
  CRISPR gRNA sequence
ggggcaggggaaaggagggt

SEQ ID NO: 734885 - DNA, 20 bp, Artificial
  CRISPR gRNA sequence
gggcaggggaaaggagggtc

SEQ ID NO: 734886 - DNA, 20 bp, Artificial
  CRISPR gRNA sequence
ggcaggggaaaggagggtcg

SEQ ID NO: 734887 - DNA, 20 bp, Artificial
  CRISPR gRNA sequence
gcaggggaaaggagggtcgg

SEQ ID NO: 734888 - DNA, 20 bp, Artificial
  CRISPR gRNA sequence
ggggaaaggagggtcggggg

SEQ ID NO: 734889 - DNA, 20 bp, Artificial
  CRISPR gRNA sequence
gggaaaggagggtcgggggt

SEQ ID NO: 734890 - DNA, 20 bp, Artificial
  CRISPR gRNA sequence
ggaaaggagggtcgggggtg

SEQ ID NO: 734891 - DNA, 20 bp, Artificial
  CRISPR gRNA sequence
aaaggagggtcgggggtggg

SEQ ID NO: 734892 - DNA, 20 bp, Artificial
  CRISPR gRNA sequence
aaggagggtcgggggtgggg

SEQ ID NO: 734893 - DNA, 20 bp, Artificial
  CRISPR gRNA sequence
ggagggtcgggggtggggag

SEQ ID NO: 734894 - DNA, 20 bp, Artificial
  CRISPR gRNA sequence
gagggtcgggggtggggagg

SEQ ID NO: 734895 - DNA, 20 bp, Artificial
  CRISPR gRNA sequence
agggtcgggggtggggagga

SEQ ID NO: 734896 - DNA, 20 bp, Artificial
  CRISPR gRNA sequence
gggtcgggggtggggaggag

SEQ ID NO: 734897 - DNA, 20 bp, Artificial
  CRISPR gRNA sequence
tcgggggtggggaggagggg

SEQ ID NO: 734898 - DNA, 20 bp, Artificial
  CRISPR gRNA sequence
cgggggtggggaggaggggc

SEQ ID NO: 734899 - DNA, 20 bp, Artificial
  CRISPR gRNA sequence
gggggtggggaggaggggca

SEQ ID NO: 734900 - DNA, 20 bp, Artificial
  CRISPR gRNA sequence
ggggtggggaggaggggcag

SEQ ID NO: 734901 - DNA, 20 bp, Artificial
  CRISPR gRNA sequence
tggggaggaggggcagggga

SEQ ID NO: 734902 - DNA, 20 bp, Artificial
  CRISPR gRNA sequence
ggggaggaggggcaggggaa

SEQ ID NO: 734903 - DNA, 20 bp, Artificial
  CRISPR gRNA sequence
ggaggaggggcaggggaaag

SEQ ID NO: 734904 - DNA, 20 bp, Artificial
  CRISPR gRNA sequence
gaggaggggcaggggaaagg

SEQ ID NO: 734905 - DNA, 20 bp, Artificial
  CRISPR gRNA sequence
aggaggggcaggggaaagga

SEQ ID NO: 734906 - DNA, 20 bp, Artificial
  CRISPR gRNA sequence
ggggcaggggaaaggagggt

SEQ ID NO: 734907 - DNA, 20 bp, Artificial
  CRISPR gRNA sequence
gcaggggaaaggagggtcag

SEQ ID NO: 734908 - DNA, 20 bp, Artificial
  CRISPR gRNA sequence
caggggaaaggagggtcagt

SEQ ID NO: 734909 - DNA, 20 bp, Artificial
  CRISPR gRNA sequence
aggggaaaggagggtcagtg

SEQ ID NO: 734910 - DNA, 20 bp, Artificial
  CRISPR gRNA sequence
gggaaaggagggtcagtggg

SEQ ID NO: 734911 - DNA, 20 bp, Artificial
  CRISPR gRNA sequence
ggaaaggagggtcagtgggg

SEQ ID NO: 734912 - DNA, 20 bp, Artificial
  CRISPR gRNA sequence
aaaggagggtcagtggggag

SEQ ID NO: 734913 - DNA, 20 bp, Artificial
  CRISPR gRNA sequence
aaggagggtcagtggggagg

SEQ ID NO: 734914 - DNA, 20 bp, Artificial
  CRISPR gRNA sequence
aggagggtcagtggggagga

SEQ ID NO: 734915 - DNA, 20 bp, Artificial
  CRISPR gRNA sequence
ggagggtcagtggggaggag

SEQ ID NO: 734916 - DNA, 20 bp, Artificial
  CRISPR gRNA sequence
gggtcagtggggaggagggg

SEQ ID NO: 734917 - DNA, 20 bp, Artificial
  CRISPR gRNA sequence
ggtcagtggggaggaggggc

SEQ ID NO: 734918 - DNA, 20 bp, Artificial
  CRISPR gRNA sequence
gtcagtggggaggaggggca

SEQ ID NO: 734919 - DNA, 20 bp, Artificial
  CRISPR gRNA sequence
tcagtggggaggaggggcag

SEQ ID NO: 734920 - DNA, 20 bp, Artificial
  CRISPR gRNA sequence
tggggaggaggggcagggga

SEQ ID NO: 734921 - DNA, 20 bp, Artificial
  CRISPR gRNA sequence
ggaggaggggcaggggaaag

SEQ ID NO: 734922 - DNA, 20 bp, Artificial
  CRISPR gRNA sequence
gaggaggggcaggggaaaga

SEQ ID NO: 734923 - DNA, 20 bp, Artificial
  CRISPR gRNA sequence
aggaggggcaggggaaagaa

SEQ ID NO: 734924 - DNA, 20 bp, Artificial
  CRISPR gRNA sequence
aggggcaggggaaagaaggg

SEQ ID NO: 734925 - DNA, 20 bp, Artificial
  CRISPR gRNA sequence
ggggcaggggaaagaagggt

SEQ ID NO: 734926 - DNA, 20 bp, Artificial
  CRISPR gRNA sequence
gggcaggggaaagaagggtg

SEQ ID NO: 734927 - DNA, 20 bp, Artificial
  CRISPR gRNA sequence
aggggaaagaagggtgggga

SEQ ID NO: 734928 - DNA, 20 bp, Artificial
  CRISPR gRNA sequence
ggggaaagaagggtggggac

SEQ ID NO: 734929 - DNA, 20 bp, Artificial
  CRISPR gRNA sequence
ggaaagaagggtggggacag

SEQ ID NO: 734930 - DNA, 20 bp, Artificial
  CRISPR gRNA sequence
gaaagaagggtggggacagg

SEQ ID NO: 734931 - DNA, 20 bp, Artificial
  CRISPR gRNA sequence
aaagaagggtggggacagga

SEQ ID NO: 734932 - DNA, 20 bp, Artificial
  CRISPR gRNA sequence
aagggtggggacaggaggga

SEQ ID NO: 734933 - DNA, 20 bp, Artificial
  CRISPR gRNA sequence
agggtggggacaggagggac

SEQ ID NO: 734934 - DNA, 20 bp, Artificial
  CRISPR gRNA sequence
gggtggggacaggagggaca

SEQ ID NO: 734935 - DNA, 20 bp, Artificial
  CRISPR gRNA sequence
ggtggggacaggagggacag

SEQ ID NO: 734936 - DNA, 20 bp, Artificial
  CRISPR gRNA sequence
gggacaggagggacagggga

SEQ ID NO: 734937 - DNA, 20 bp, Artificial
  CRISPR gRNA sequence
ggacaggagggacaggggaa

SEQ ID NO: 734938 - DNA, 20 bp, Artificial
  CRISPR gRNA sequence
acaggagggacaggggaaag

SEQ ID NO: 734939 - DNA, 20 bp, Artificial
  CRISPR gRNA sequence
caggagggacaggggaaagg

SEQ ID NO: 734940 - DNA, 20 bp, Artificial
  CRISPR gRNA sequence
aggagggacaggggaaagga

SEQ ID NO: 734941 - DNA, 20 bp, Artificial
  CRISPR gRNA sequence
gggacaggggaaaggagggt

SEQ ID NO: 734942 - DNA, 20 bp, Artificial
  CRISPR gRNA sequence
ggacaggggaaaggagggtc

SEQ ID NO: 734943 - DNA, 20 bp, Artificial
  CRISPR gRNA sequence
gacaggggaaaggagggtcg

SEQ ID NO: 734944 - DNA, 20 bp, Artificial
  CRISPR gRNA sequence
acaggggaaaggagggtcgg

SEQ ID NO: 734945 - DNA, 20 bp, Artificial
  CRISPR gRNA sequence
aggggaaaggagggtcgggg

SEQ ID NO: 734946 - DNA, 20 bp, Artificial
  CRISPR gRNA sequence
ggggaaaggagggtcggggg

SEQ ID NO: 734947 - DNA, 20 bp, Artificial
  CRISPR gRNA sequence
ggaaaggagggtcgggggag

SEQ ID NO: 734948 - DNA, 20 bp, Artificial
  CRISPR gRNA sequence
gaaaggagggtcgggggagg

SEQ ID NO: 734949 - DNA, 20 bp, Artificial
  CRISPR gRNA sequence
gagggtcgggggaggaggat

SEQ ID NO: 734950 - DNA, 20 bp, Artificial
  CRISPR gRNA sequence
agggtcgggggaggaggatc

SEQ ID NO: 734951 - DNA, 20 bp, Artificial
  CRISPR gRNA sequence
gggtcgggggaggaggatca

SEQ ID NO: 734952 - DNA, 20 bp, Artificial
  CRISPR gRNA sequence
gtcgggggaggaggatcagg

SEQ ID NO: 734953 - DNA, 20 bp, Artificial
  CRISPR gRNA sequence
tcgggggaggaggatcaggg

SEQ ID NO: 734954 - DNA, 20 bp, Artificial
  CRISPR gRNA sequence
gggggaggaggatcagggag

SEQ ID NO: 734955 - DNA, 20 bp, Artificial
  CRISPR gRNA sequence
ggggaggaggatcagggagg

SEQ ID NO: 734956 - DNA, 20 bp, Artificial
  CRISPR gRNA sequence
gaggaggatcagggaggagg

SEQ ID NO: 734957 - DNA, 20 bp, Artificial
  CRISPR gRNA sequence
aggaggatcagggaggagga

SEQ ID NO: 734958 - DNA, 20 bp, Artificial
  CRISPR gRNA sequence
ggatcagggaggaggaaggt

SEQ ID NO: 734959 - DNA, 20 bp, Artificial
  CRISPR gRNA sequence
gatcagggaggaggaaggtc

SEQ ID NO: 734960 - DNA, 20 bp, Artificial
  CRISPR gRNA sequence
ggaggaggaaggtcaggtga

SEQ ID NO: 734961 - DNA, 20 bp, Artificial
  CRISPR gRNA sequence
gaggaggaaggtcaggtgaa

SEQ ID NO: 734962 - DNA, 20 bp, Artificial
  CRISPR gRNA sequence
ggaggaaggtcaggtgaaag

SEQ ID NO: 734963 - DNA, 20 bp, Artificial
  CRISPR gRNA sequence
gaggaaggtcaggtgaaagg

SEQ ID NO: 734964 - DNA, 20 bp, Artificial
  CRISPR gRNA sequence
aggtcaggtgaaaggaggat

SEQ ID NO: 734965 - DNA, 20 bp, Artificial
  CRISPR gRNA sequence
ggtcaggtgaaaggaggatc

SEQ ID NO: 734966 - DNA, 20 bp, Artificial
  CRISPR gRNA sequence
caggtgaaaggaggatcagg

SEQ ID NO: 734967 - DNA, 20 bp, Artificial
  CRISPR gRNA sequence
aggtgaaaggaggatcagga

SEQ ID NO: 734968 - DNA, 20 bp, Artificial
  CRISPR gRNA sequence
aaaggaggatcaggaaggat

SEQ ID NO: 734969 - DNA, 20 bp, Artificial
  CRISPR gRNA sequence
aaggaggatcaggaaggatg

SEQ ID NO: 734970 - DNA, 20 bp, Artificial
  CRISPR gRNA sequence
aggaggatcaggaaggatga

SEQ ID NO: 734971 - DNA, 20 bp, Artificial
  CRISPR gRNA sequence
ggatcaggaaggatgagggt

SEQ ID NO: 734972 - DNA, 20 bp, Artificial
  CRISPR gRNA sequence
tcaggaaggatgagggtcag

SEQ ID NO: 734973 - DNA, 20 bp, Artificial
  CRISPR gRNA sequence
caggaaggatgagggtcagt

SEQ ID NO: 734974 - DNA, 20 bp, Artificial
  CRISPR gRNA sequence
aggaaggatgagggtcagtg

SEQ ID NO: 734975 - DNA, 20 bp, Artificial
  CRISPR gRNA sequence
gaaggatgagggtcagtggg

SEQ ID NO: 734976 - DNA, 20 bp, Artificial
  CRISPR gRNA sequence
ggatgagggtcagtggggag

SEQ ID NO: 734977 - DNA, 20 bp, Artificial
  CRISPR gRNA sequence
atgagggtcagtggggagcg

SEQ ID NO: 734978 - DNA, 20 bp, Artificial
  CRISPR gRNA sequence
gggtcagtggggagcggagt

SEQ ID NO: 734979 - DNA, 20 bp, Artificial
  CRISPR gRNA sequence
tcagtggggagcggagttgg

SEQ ID NO: 734980 - DNA, 20 bp, Artificial
  CRISPR gRNA sequence
cagtggggagcggagttggt

SEQ ID NO: 734981 - DNA, 20 bp, Artificial
  CRISPR gRNA sequence
gtggggagcggagttggtgg

SEQ ID NO: 734982 - DNA, 20 bp, Artificial
  CRISPR gRNA sequence
tggggagcggagttggtggg

SEQ ID NO: 734983 - DNA, 20 bp, Artificial
  CRISPR gRNA sequence
ggagcggagttggtgggagg

SEQ ID NO: 734984 - DNA, 20 bp, Artificial
  CRISPR gRNA sequence
gagcggagttggtgggagga

SEQ ID NO: 734985 - DNA, 20 bp, Artificial
  CRISPR gRNA sequence
cggagttggtgggaggaagg

SEQ ID NO: 734986 - DNA, 20 bp, Artificial
  CRISPR gRNA sequence
ggagttggtgggaggaaggt

SEQ ID NO: 734987 - DNA, 20 bp, Artificial
  CRISPR gRNA sequence
gagttggtgggaggaaggtg

SEQ ID NO: 734988 - DNA, 20 bp, Artificial
  CRISPR gRNA sequence
agttggtgggaggaaggtgg

SEQ ID NO: 734989 - DNA, 20 bp, Artificial
  CRISPR gRNA sequence
tggtgggaggaaggtggggg

SEQ ID NO: 734990 - DNA, 20 bp, Artificial
  CRISPR gRNA sequence
gaggaaggtgggggaagtgt

SEQ ID NO: 734991 - DNA, 20 bp, Artificial
  CRISPR gRNA sequence
gaaggtgggggaagtgtcag

SEQ ID NO: 734992 - DNA, 20 bp, Artificial
  CRISPR gRNA sequence
aggtgggggaagtgtcagca

SEQ ID NO: 734993 - DNA, 20 bp, Artificial
  CRISPR gRNA sequence
gtgggggaagtgtcagcaga

SEQ ID NO: 734994 - DNA, 20 bp, Artificial
  CRISPR gRNA sequence
tgggggaagtgtcagcagag

SEQ ID NO: 734995 - DNA, 20 bp, Artificial
  CRISPR gRNA sequence
ggggaagtgtcagcagagag

SEQ ID NO: 734996 - DNA, 20 bp, Artificial
  CRISPR gRNA sequence
gggaagtgtcagcagagagg

SEQ ID NO: 734997 - DNA, 20 bp, Artificial
  CRISPR gRNA sequence
ggaagtgtcagcagagagga

SEQ ID NO: 734998 - DNA, 20 bp, Artificial
  CRISPR gRNA sequence
gtgtcagcagagaggagggt

SEQ ID NO: 734999 - DNA, 20 bp, Artificial
  CRISPR gRNA sequence
tgtcagcagagaggagggtc

SEQ ID NO: 735000 - DNA, 20 bp, Artificial
  CRISPR gRNA sequence
cagagaggagggtcgggata

SEQ ID NO: 735001 - DNA, 20 bp, Artificial
  CRISPR gRNA sequence
agagaggagggtcgggataa

SEQ ID NO: 735002 - DNA, 20 bp, Artificial
  CRISPR gRNA sequence
gaggagggtcgggataaagg

SEQ ID NO: 735003 - DNA, 20 bp, Artificial
  CRISPR gRNA sequence
aggagggtcgggataaaggt

SEQ ID NO: 735004 - DNA, 20 bp, Artificial
  CRISPR gRNA sequence
ggagggtcgggataaaggta

SEQ ID NO: 735005 - DNA, 20 bp, Artificial
  CRISPR gRNA sequence
gagggtcgggataaaggtag

SEQ ID NO: 735006 - DNA, 20 bp, Artificial
  CRISPR gRNA sequence
agggtcgggataaaggtagg

SEQ ID NO: 735007 - DNA, 20 bp, Artificial
  CRISPR gRNA sequence
ggtcgggataaaggtagggg

SEQ ID NO: 735008 - DNA, 20 bp, Artificial
  CRISPR gRNA sequence
ggataaaggtagggggagat

SEQ ID NO: 735009 - DNA, 20 bp, Artificial
  CRISPR gRNA sequence
gataaaggtagggggagatg

SEQ ID NO: 735010 - DNA, 20 bp, Artificial
  CRISPR gRNA sequence
ataaaggtagggggagatga

SEQ ID NO: 735011 - DNA, 20 bp, Artificial
  CRISPR gRNA sequence
gtagggggagatgagggttg

SEQ ID NO: 735012 - DNA, 20 bp, Artificial
  CRISPR gRNA sequence
tagggggagatgagggttgc

SEQ ID NO: 735013 - DNA, 20 bp, Artificial
  CRISPR gRNA sequence
agggggagatgagggttgca

SEQ ID NO: 735014 - DNA, 20 bp, Artificial
  CRISPR gRNA sequence
gagatgagggttgcagggat

SEQ ID NO: 735015 - DNA, 20 bp, Artificial
  CRISPR gRNA sequence
agatgagggttgcagggatg

SEQ ID NO: 735016 - DNA, 20 bp, Artificial
  CRISPR gRNA sequence
gatgagggttgcagggatga

SEQ ID NO: 735017 - DNA, 20 bp, Artificial
  CRISPR gRNA sequence
gagggttgcagggatgaggg

SEQ ID NO: 735018 - DNA, 20 bp, Artificial
  CRISPR gRNA sequence
agggttgcagggatgagggc

SEQ ID NO: 735019 - DNA, 20 bp, Artificial
  CRISPR gRNA sequence
gggttgcagggatgagggca

SEQ ID NO: 735020 - DNA, 20 bp, Artificial
  CRISPR gRNA sequence
ggttgcagggatgagggcag

SEQ ID NO: 735021 - DNA, 20 bp, Artificial
  CRISPR gRNA sequence
ggatgagggcaggggactat

SEQ ID NO: 735022 - DNA, 20 bp, Artificial
  CRISPR gRNA sequence
atgagggcaggggactatga

SEQ ID NO: 735023 - DNA, 20 bp, Artificial
  CRISPR gRNA sequence
gggcaggggactatgagagt

SEQ ID NO: 735024 - DNA, 20 bp, Artificial
  CRISPR gRNA sequence
ggcaggggactatgagagtc

SEQ ID NO: 735025 - DNA, 20 bp, Artificial
  CRISPR gRNA sequence
gcaggggactatgagagtcg

SEQ ID NO: 735026 - DNA, 20 bp, Artificial
  CRISPR gRNA sequence
caggggactatgagagtcgg

SEQ ID NO: 735027 - DNA, 20 bp, Artificial
  CRISPR gRNA sequence
actatgagagtcgggggcat

SEQ ID NO: 735028 - DNA, 20 bp, Artificial
  CRISPR gRNA sequence
ctatgagagtcgggggcatt

SEQ ID NO: 735029 - DNA, 20 bp, Artificial
  CRISPR gRNA sequence
tatgagagtcgggggcatta

SEQ ID NO: 735030 - DNA, 20 bp, Artificial
  CRISPR gRNA sequence
agagtcgggggcattagggt

SEQ ID NO: 735031 - DNA, 20 bp, Artificial
  CRISPR gRNA sequence
gagtcgggggcattagggtc

SEQ ID NO: 735032 - DNA, 20 bp, Artificial
  CRISPR gRNA sequence
agtcgggggcattagggtca

SEQ ID NO: 735033 - DNA, 20 bp, Artificial
  CRISPR gRNA sequence
gtcgggggcattagggtcag

SEQ ID NO: 735034 - DNA, 20 bp, Artificial
  CRISPR gRNA sequence
tcgggggcattagggtcagg

SEQ ID NO: 735035 - DNA, 20 bp, Artificial
  CRISPR gRNA sequence
ggcattagggtcagggggat

SEQ ID NO: 735036 - DNA, 20 bp, Artificial
  CRISPR gRNA sequence
gcattagggtcagggggatg

SEQ ID NO: 735037 - DNA, 20 bp, Artificial
  CRISPR gRNA sequence
tagggtcagggggatgagga

SEQ ID NO: 735038 - DNA, 20 bp, Artificial
  CRISPR gRNA sequence
agggtcagggggatgaggat

SEQ ID NO: 735039 - DNA, 20 bp, Artificial
  CRISPR gRNA sequence
gggtcagggggatgaggatg

SEQ ID NO: 735040 - DNA, 20 bp, Artificial
  CRISPR gRNA sequence
ggtcagggggatgaggatgg

SEQ ID NO: 735041 - DNA, 20 bp, Artificial
  CRISPR gRNA sequence
gatgaggatgggggtaaatg

SEQ ID NO: 735042 - DNA, 20 bp, Artificial
  CRISPR gRNA sequence
atgaggatgggggtaaatga

SEQ ID NO: 735043 - DNA, 20 bp, Artificial
  CRISPR gRNA sequence
atgggggtaaatgaaggttg

SEQ ID NO: 735044 - DNA, 20 bp, Artificial
  CRISPR gRNA sequence
tgggggtaaatgaaggttgt

SEQ ID NO: 735045 - DNA, 20 bp, Artificial
  CRISPR gRNA sequence
gggggtaaatgaaggttgtg

SEQ ID NO: 735046 - DNA, 20 bp, Artificial
  CRISPR gRNA sequence
ggggtaaatgaaggttgtgg

SEQ ID NO: 735047 - DNA, 20 bp, Artificial
  CRISPR gRNA sequence
ggtaaatgaaggttgtgggg

SEQ ID NO: 735048 - DNA, 20 bp, Artificial
  CRISPR gRNA sequence
gtaaatgaaggttgtggggg

SEQ ID NO: 735049 - DNA, 20 bp, Artificial
  CRISPR gRNA sequence
aaatgaaggttgtgggggag

SEQ ID NO: 735050 - DNA, 20 bp, Artificial
  CRISPR gRNA sequence
atgaaggttgtgggggagga

SEQ ID NO: 735051 - DNA, 20 bp, Artificial
  CRISPR gRNA sequence
aggttgtgggggaggagagt

SEQ ID NO: 735052 - DNA, 20 bp, Artificial
  CRISPR gRNA sequence
gttgtgggggaggagagtca

SEQ ID NO: 735053 - DNA, 20 bp, Artificial
  CRISPR gRNA sequence
gtgggggaggagagtcagag

SEQ ID NO: 735054 - DNA, 20 bp, Artificial
  CRISPR gRNA sequence
ggggaggagagtcagagaag

SEQ ID NO: 735055 - DNA, 20 bp, Artificial
  CRISPR gRNA sequence
gggaggagagtcagagaaga

SEQ ID NO: 735056 - DNA, 20 bp, Artificial
  CRISPR gRNA sequence
ggagagtcagagaagaaggt

SEQ ID NO: 735057 - DNA, 20 bp, Artificial
  CRISPR gRNA sequence
gagtcagagaagaaggtcag

SEQ ID NO: 735058 - DNA, 20 bp, Artificial
  CRISPR gRNA sequence
agtcagagaagaaggtcagt

SEQ ID NO: 735059 - DNA, 20 bp, Artificial
  CRISPR gRNA sequence
tcagagaagaaggtcagtgg

SEQ ID NO: 735060 - DNA, 20 bp, Artificial
  CRISPR gRNA sequence
cagagaagaaggtcagtggg

SEQ ID NO: 735061 - DNA, 20 bp, Artificial
  CRISPR gRNA sequence
gagaagaaggtcagtgggag

SEQ ID NO: 735062 - DNA, 20 bp, Artificial
  CRISPR gRNA sequence
aaggtcagtgggaggagtat

SEQ ID NO: 735063 - DNA, 20 bp, Artificial
  CRISPR gRNA sequence
aggtcagtgggaggagtatc

SEQ ID NO: 735064 - DNA, 20 bp, Artificial
  CRISPR gRNA sequence
ggtcagtgggaggagtatca

SEQ ID NO: 735065 - DNA, 20 bp, Artificial
  CRISPR gRNA sequence
gtcagtgggaggagtatcag

SEQ ID NO: 735066 - DNA, 20 bp, Artificial
  CRISPR gRNA sequence
cagtgggaggagtatcaggg

SEQ ID NO: 735067 - DNA, 20 bp, Artificial
  CRISPR gRNA sequence
gtgggaggagtatcagggga

SEQ ID NO: 735068 - DNA, 20 bp, Artificial
  CRISPR gRNA sequence
tgggaggagtatcaggggag

SEQ ID NO: 735069 - DNA, 20 bp, Artificial
  CRISPR gRNA sequence
gggaggagtatcaggggaga

SEQ ID NO: 735070 - DNA, 20 bp, Artificial
  CRISPR gRNA sequence
ggaggagtatcaggggagag

SEQ ID NO: 735071 - DNA, 20 bp, Artificial
  CRISPR gRNA sequence
gaggagtatcaggggagagg

SEQ ID NO: 735072 - DNA, 20 bp, Artificial
  CRISPR gRNA sequence
aggagtatcaggggagaggg

SEQ ID NO: 735073 - DNA, 20 bp, Artificial
  CRISPR gRNA sequence
atcaggggagaggggggctg

SEQ ID NO: 735074 - DNA, 20 bp, Artificial
  CRISPR gRNA sequence
caggggagaggggggctgca

SEQ ID NO: 735075 - DNA, 20 bp, Artificial
  CRISPR gRNA sequence
gagaggggggctgcagagat

SEQ ID NO: 735076 - DNA, 20 bp, Artificial
  CRISPR gRNA sequence
agaggggggctgcagagatg

SEQ ID NO: 735077 - DNA, 20 bp, Artificial
  CRISPR gRNA sequence
gaggggggctgcagagatga

SEQ ID NO: 735078 - DNA, 20 bp, Artificial
  CRISPR gRNA sequence
gggggctgcagagatgaggg

SEQ ID NO: 735079 - DNA, 20 bp, Artificial
  CRISPR gRNA sequence
ggggctgcagagatgagggt

SEQ ID NO: 735080 - DNA, 20 bp, Artificial
  CRISPR gRNA sequence
gggctgcagagatgagggta

SEQ ID NO: 735081 - DNA, 20 bp, Artificial
  CRISPR gRNA sequence
ggctgcagagatgagggtag

SEQ ID NO: 735082 - DNA, 20 bp, Artificial
  CRISPR gRNA sequence
gctgcagagatgagggtagg

SEQ ID NO: 735083 - DNA, 20 bp, Artificial
  CRISPR gRNA sequence
agatgagggtagggggcaat

SEQ ID NO: 735084 - DNA, 20 bp, Artificial
  CRISPR gRNA sequence
atgagggtagggggcaatga

SEQ ID NO: 735085 - DNA, 20 bp, Artificial
  CRISPR gRNA sequence
gggtagggggcaatgagagt

SEQ ID NO: 735086 - DNA, 20 bp, Artificial
  CRISPR gRNA sequence
tagggggcaatgagagttgg

SEQ ID NO: 735087 - DNA, 20 bp, Artificial
  CRISPR gRNA sequence
gcaatgagagttggtagaat

SEQ ID NO: 735088 - DNA, 20 bp, Artificial
  CRISPR gRNA sequence
caatgagagttggtagaatt

SEQ ID NO: 735089 - DNA, 20 bp, Artificial
  CRISPR gRNA sequence
aatgagagttggtagaatta

SEQ ID NO: 735090 - DNA, 20 bp, Artificial
  CRISPR gRNA sequence
agagttggtagaattagggc

SEQ ID NO: 735091 - DNA, 20 bp, Artificial
  CRISPR gRNA sequence
gagttggtagaattagggcc

SEQ ID NO: 735092 - DNA, 20 bp, Artificial
  CRISPR gRNA sequence
agttggtagaattagggcca

SEQ ID NO: 735093 - DNA, 20 bp, Artificial
  CRISPR gRNA sequence
gttggtagaattagggccag

SEQ ID NO: 735094 - DNA, 20 bp, Artificial
  CRISPR gRNA sequence
ttggtagaattagggccagg

SEQ ID NO: 735095 - DNA, 20 bp, Artificial
  CRISPR gRNA sequence
tggtagaattagggccaggg

SEQ ID NO: 735096 - DNA, 20 bp, Artificial
  CRISPR gRNA sequence
gaattagggccaggggggat

SEQ ID NO: 735097 - DNA, 20 bp, Artificial
  CRISPR gRNA sequence
attagggccaggggggatga

SEQ ID NO: 735098 - DNA, 20 bp, Artificial
  CRISPR gRNA sequence
gggccaggggggatgagagt

SEQ ID NO: 735099 - DNA, 20 bp, Artificial
  CRISPR gRNA sequence
gccaggggggatgagagtca

SEQ ID NO: 735100 - DNA, 20 bp, Artificial
  CRISPR gRNA sequence
gggggatgagagtcagagat

SEQ ID NO: 735101 - DNA, 20 bp, Artificial
  CRISPR gRNA sequence
agagtcagagatgagcatgt

SEQ ID NO: 735102 - DNA, 20 bp, Artificial
  CRISPR gRNA sequence
gagtcagagatgagcatgtc

SEQ ID NO: 735103 - DNA, 20 bp, Artificial
  CRISPR gRNA sequence
agtcagagatgagcatgtca

SEQ ID NO: 735104 - DNA, 20 bp, Artificial
  CRISPR gRNA sequence
gtcagagatgagcatgtcag

SEQ ID NO: 735105 - DNA, 20 bp, Artificial
  CRISPR gRNA sequence
gagatgagcatgtcagggga

SEQ ID NO: 735106 - DNA, 20 bp, Artificial
  CRISPR gRNA sequence
agatgagcatgtcaggggat

SEQ ID NO: 735107 - DNA, 20 bp, Artificial
  CRISPR gRNA sequence
gtcaggggatgggtgtcctg

SEQ ID NO: 735108 - DNA, 20 bp, Artificial
  CRISPR gRNA sequence
tgggtgtcctgaagtgtctg

SEQ ID NO: 735109 - DNA, 20 bp, Artificial
  CRISPR gRNA sequence
tgtcctgaagtgtctgtgga

SEQ ID NO: 735110 - DNA, 20 bp, Artificial
  CRISPR gRNA sequence
tcctgaagtgtctgtggatg

SEQ ID NO: 735111 - DNA, 20 bp, Artificial
  CRISPR gRNA sequence
ctgaagtgtctgtggatgga

SEQ ID NO: 735112 - DNA, 20 bp, Artificial
  CRISPR gRNA sequence
tgaagtgtctgtggatggag

SEQ ID NO: 735113 - DNA, 20 bp, Artificial
  CRISPR gRNA sequence
aagtgtctgtggatggagag

SEQ ID NO: 735114 - DNA, 20 bp, Artificial
  CRISPR gRNA sequence
gtgtctgtggatggagagga

SEQ ID NO: 735115 - DNA, 20 bp, Artificial
  CRISPR gRNA sequence
tgtctgtggatggagaggag

SEQ ID NO: 735116 - DNA, 20 bp, Artificial
  CRISPR gRNA sequence
gtctgtggatggagaggaga

SEQ ID NO: 735117 - DNA, 20 bp, Artificial
  CRISPR gRNA sequence
gtggatggagaggagagggt

SEQ ID NO: 735118 - DNA, 20 bp, Artificial
  CRISPR gRNA sequence
tggatggagaggagagggtg

SEQ ID NO: 735119 - DNA, 20 bp, Artificial
  CRISPR gRNA sequence
tggagaggagagggtgagga

SEQ ID NO: 735120 - DNA, 20 bp, Artificial
  CRISPR gRNA sequence
ggagaggagagggtgaggat

SEQ ID NO: 735121 - DNA, 20 bp, Artificial
  CRISPR gRNA sequence
gagaggagagggtgaggata

SEQ ID NO: 735122 - DNA, 20 bp, Artificial
  CRISPR gRNA sequence
ggagagggtgaggatagggc

SEQ ID NO: 735123 - DNA, 20 bp, Artificial
  CRISPR gRNA sequence
gagagggtgaggatagggca

SEQ ID NO: 735124 - DNA, 20 bp, Artificial
  CRISPR gRNA sequence
tagggcaaggatgcgcctca

SEQ ID NO: 735125 - DNA, 20 bp, Artificial
  CRISPR gRNA sequence
gggcaaggatgcgcctcatg

SEQ ID NO: 735126 - DNA, 20 bp, Artificial
  CRISPR gRNA sequence
caaggatgcgcctcatggag

SEQ ID NO: 735127 - DNA, 20 bp, Artificial
  CRISPR gRNA sequence
aaggatgcgcctcatggagt

SEQ ID NO: 735128 - DNA, 20 bp, Artificial
  CRISPR gRNA sequence
gatgcgcctcatggagtagg

SEQ ID NO: 735129 - DNA, 20 bp, Artificial
  CRISPR gRNA sequence
gcgcctcatggagtaggaag

SEQ ID NO: 735130 - DNA, 20 bp, Artificial
  CRISPR gRNA sequence
atggagtaggaagtggaaaa

SEQ ID NO: 735131 - DNA, 20 bp, Artificial
  CRISPR gRNA sequence
tggagtaggaagtggaaaat

SEQ ID NO: 735132 - DNA, 20 bp, Artificial
  CRISPR gRNA sequence
ggagtaggaagtggaaaatg

SEQ ID NO: 735133 - DNA, 20 bp, Artificial
  CRISPR gRNA sequence
gagtaggaagtggaaaatgg

SEQ ID NO: 735134 - DNA, 20 bp, Artificial
  CRISPR gRNA sequence
aaatgggggatgctttaatt

SEQ ID NO: 735135 - DNA, 20 bp, Artificial
  CRISPR gRNA sequence
tgctttaatttggattcctc

SEQ ID NO: 735136 - DNA, 20 bp, Artificial
  CRISPR gRNA sequence
ctttaatttggattcctcta

SEQ ID NO: 735137 - DNA, 20 bp, Artificial
  CRISPR gRNA sequence
cctctagagaaactgactct

SEQ ID NO: 735138 - DNA, 20 bp, Artificial
  CRISPR gRNA sequence
tagagaaactgactctgagt

SEQ ID NO: 735139 - DNA, 20 bp, Artificial
  CRISPR gRNA sequence
agagaaactgactctgagtc

SEQ ID NO: 735140 - DNA, 20 bp, Artificial
  CRISPR gRNA sequence
gagaaactgactctgagtca

SEQ ID NO: 735141 - DNA, 20 bp, Artificial
  CRISPR gRNA sequence
tttgcgtcttatatgaacac

SEQ ID NO: 735142 - DNA, 20 bp, Artificial
  CRISPR gRNA sequence
cttatatgaacactggaaaa

SEQ ID NO: 735143 - DNA, 20 bp, Artificial
  CRISPR gRNA sequence
ttatatgaacactggaaaaa

SEQ ID NO: 735144 - DNA, 20 bp, Artificial
  CRISPR gRNA sequence
tatgaacactggaaaaaagg

SEQ ID NO: 735145 - DNA, 20 bp, Artificial
  CRISPR gRNA sequence
atgaacactggaaaaaaggt

SEQ ID NO: 735146 - DNA, 20 bp, Artificial
  CRISPR gRNA sequence
tgaacactggaaaaaaggtg

SEQ ID NO: 735147 - DNA, 20 bp, Artificial
  CRISPR gRNA sequence
gaacactggaaaaaaggtgg

SEQ ID NO: 735148 - DNA, 20 bp, Artificial
  CRISPR gRNA sequence
acactggaaaaaaggtgggg

SEQ ID NO: 735149 - DNA, 20 bp, Artificial
  CRISPR gRNA sequence
ctggaaaaaaggtgggggag

SEQ ID NO: 735150 - DNA, 20 bp, Artificial
  CRISPR gRNA sequence
tggaaaaaaggtgggggagt

SEQ ID NO: 735151 - DNA, 20 bp, Artificial
  CRISPR gRNA sequence
aaaaaggtgggggagtggga

SEQ ID NO: 735152 - DNA, 20 bp, Artificial
  CRISPR gRNA sequence
aaaaggtgggggagtgggac

SEQ ID NO: 735153 - DNA, 20 bp, Artificial
  CRISPR gRNA sequence
aaaggtgggggagtgggaca

SEQ ID NO: 735154 - DNA, 20 bp, Artificial
  CRISPR gRNA sequence
ggtgggggagtgggacaggg

SEQ ID NO: 735155 - DNA, 20 bp, Artificial
  CRISPR gRNA sequence
gtgggggagtgggacagggc

SEQ ID NO: 735156 - DNA, 20 bp, Artificial
  CRISPR gRNA sequence
tgggggagtgggacagggca

SEQ ID NO: 735157 - DNA, 20 bp, Artificial
  CRISPR gRNA sequence
gggagtgggacagggcaggg

SEQ ID NO: 735158 - DNA, 20 bp, Artificial
  CRISPR gRNA sequence
ggagtgggacagggcaggga

SEQ ID NO: 735159 - DNA, 20 bp, Artificial
  CRISPR gRNA sequence
ggcagggaaggcctctaata

SEQ ID NO: 735160 - DNA, 20 bp, Artificial
  CRISPR gRNA sequence
cagggaaggcctctaataaa

SEQ ID NO: 735161 - DNA, 20 bp, Artificial
  CRISPR gRNA sequence
ctaataaagagtacttaacc

SEQ ID NO: 735162 - DNA, 20 bp, Artificial
  CRISPR gRNA sequence
ataaagagtacttaaccaag

SEQ ID NO: 735163 - DNA, 20 bp, Artificial
  CRISPR gRNA sequence
aagcagctgctgtgcacaac

SEQ ID NO: 735164 - DNA, 20 bp, Artificial
  CRISPR gRNA sequence
gcagctgctgtgcacaacaa

SEQ ID NO: 735165 - DNA, 20 bp, Artificial
  CRISPR gRNA sequence
caacaagagcctaatcccaa

SEQ ID NO: 735166 - DNA, 20 bp, Artificial
  CRISPR gRNA sequence
aacaagagcctaatcccaac

SEQ ID NO: 735167 - DNA, 20 bp, Artificial
  CRISPR gRNA sequence
acaagagcctaatcccaacg

SEQ ID NO: 735168 - DNA, 20 bp, Artificial
  CRISPR gRNA sequence
aagagcctaatcccaacggg

SEQ ID NO: 735169 - DNA, 20 bp, Artificial
  CRISPR gRNA sequence
gagcctaatcccaacgggga

SEQ ID NO: 735170 - DNA, 20 bp, Artificial
  CRISPR gRNA sequence
ctaatcccaacggggagagt

SEQ ID NO: 735171 - DNA, 20 bp, Artificial
  CRISPR gRNA sequence
ccaacggggagagtcagatc

SEQ ID NO: 735172 - DNA, 20 bp, Artificial
  CRISPR gRNA sequence
tagcataaaacacacatctg

SEQ ID NO: 735173 - DNA, 20 bp, Artificial
  CRISPR gRNA sequence
agcataaaacacacatctga

SEQ ID NO: 735174 - DNA, 20 bp, Artificial
  CRISPR gRNA sequence
gcataaaacacacatctgaa

SEQ ID NO: 735175 - DNA, 20 bp, Artificial
  CRISPR gRNA sequence
aaacacacatctgaagggca

SEQ ID NO: 735176 - DNA, 20 bp, Artificial
  CRISPR gRNA sequence
aacacacatctgaagggcaa

SEQ ID NO: 735177 - DNA, 20 bp, Artificial
  CRISPR gRNA sequence
cacacatctgaagggcaaag

SEQ ID NO: 735178 - DNA, 20 bp, Artificial
  CRISPR gRNA sequence
gaagggcaaaggagcccgca

SEQ ID NO: 735179 - DNA, 20 bp, Artificial
  CRISPR gRNA sequence
agttacacaccaactccaat

SEQ ID NO: 735180 - DNA, 20 bp, Artificial
  CRISPR gRNA sequence
caccaactccaattggttat

SEQ ID NO: 735181 - DNA, 20 bp, Artificial
  CRISPR gRNA sequence
caactccaattggttatcag

SEQ ID NO: 735182 - DNA, 20 bp, Artificial
  CRISPR gRNA sequence
actccaattggttatcagta

SEQ ID NO: 735183 - DNA, 20 bp, Artificial
  CRISPR gRNA sequence
ctccaattggttatcagtag

SEQ ID NO: 735184 - DNA, 20 bp, Artificial
  CRISPR gRNA sequence
tccaattggttatcagtaga

SEQ ID NO: 735185 - DNA, 20 bp, Artificial
  CRISPR gRNA sequence
agagggctgcctgctgtgtg

SEQ ID NO: 735186 - DNA, 20 bp, Artificial
  CRISPR gRNA sequence
gctgcctgctgtgtgtggca

SEQ ID NO: 735187 - DNA, 20 bp, Artificial
  CRISPR gRNA sequence
tgcctgctgtgtgtggcata

SEQ ID NO: 735188 - DNA, 20 bp, Artificial
  CRISPR gRNA sequence
gcctgctgtgtgtggcatag

SEQ ID NO: 735189 - DNA, 20 bp, Artificial
  CRISPR gRNA sequence
cctgctgtgtgtggcataga

SEQ ID NO: 735190 - DNA, 20 bp, Artificial
  CRISPR gRNA sequence
gtgtgtggcatagagggctc

SEQ ID NO: 735191 - DNA, 20 bp, Artificial
  CRISPR gRNA sequence
gcatagagggctctagtgac

SEQ ID NO: 735192 - DNA, 20 bp, Artificial
  CRISPR gRNA sequence
atagagggctctagtgacaa

SEQ ID NO: 735193 - DNA, 20 bp, Artificial
  CRISPR gRNA sequence
agggctctagtgacaagaga

SEQ ID NO: 735194 - DNA, 20 bp, Artificial
  CRISPR gRNA sequence
gggctctagtgacaagagaa

SEQ ID NO: 735195 - DNA, 20 bp, Artificial
  CRISPR gRNA sequence
tagtgacaagagaaaggcct

SEQ ID NO: 735196 - DNA, 20 bp, Artificial
  CRISPR gRNA sequence
aggcctcagcctcccaccca

SEQ ID NO: 735197 - DNA, 20 bp, Artificial
  CRISPR gRNA sequence
tcagcctcccacccacagaa

SEQ ID NO: 735198 - DNA, 20 bp, Artificial
  CRISPR gRNA sequence
cagcctcccacccacagaaa

SEQ ID NO: 735199 - DNA, 20 bp, Artificial
  CRISPR gRNA sequence
gcctcccacccacagaaaag

SEQ ID NO: 735200 - DNA, 20 bp, Artificial
  CRISPR gRNA sequence
cctcccacccacagaaaagg

SEQ ID NO: 735201 - DNA, 20 bp, Artificial
  CRISPR gRNA sequence
ggaggtgctgatgatgtgtg

SEQ ID NO: 735202 - DNA, 20 bp, Artificial
  CRISPR gRNA sequence
gaggtgctgatgatgtgtgc

SEQ ID NO: 735203 - DNA, 20 bp, Artificial
  CRISPR gRNA sequence
gtgctgatgatgtgtgcagg

SEQ ID NO: 735204 - DNA, 20 bp, Artificial
  CRISPR gRNA sequence
gtgtgcaggtggaaatgaca

SEQ ID NO: 735205 - DNA, 20 bp, Artificial
  CRISPR gRNA sequence
tgtgcaggtggaaatgacac

SEQ ID NO: 735206 - DNA, 20 bp, Artificial
  CRISPR gRNA sequence
caggtggaaatgacacaggc

SEQ ID NO: 735207 - DNA, 20 bp, Artificial
  CRISPR gRNA sequence
ggtggaaatgacacaggcaa

SEQ ID NO: 735208 - DNA, 20 bp, Artificial
  CRISPR gRNA sequence
gtggaaatgacacaggcaag

SEQ ID NO: 735209 - DNA, 20 bp, Artificial
  CRISPR gRNA sequence
atgacacaggcaagaggaca

SEQ ID NO: 735210 - DNA, 20 bp, Artificial
  CRISPR gRNA sequence
tgacacaggcaagaggacac

SEQ ID NO: 735211 - DNA, 20 bp, Artificial
  CRISPR gRNA sequence
cacaggcaagaggacacagg

SEQ ID NO: 735212 - DNA, 20 bp, Artificial
  CRISPR gRNA sequence
acaggcaagaggacacaggc

SEQ ID NO: 735213 - DNA, 20 bp, Artificial
  CRISPR gRNA sequence
caggcaagaggacacaggca

SEQ ID NO: 735214 - DNA, 20 bp, Artificial
  CRISPR gRNA sequence
aggcaagaggacacaggcag

SEQ ID NO: 735215 - DNA, 20 bp, Artificial
  CRISPR gRNA sequence
ggacacaggcaggggcccga

SEQ ID NO: 735216 - DNA, 20 bp, Artificial
  CRISPR gRNA sequence
gggcccgacagcatctgcta

SEQ ID NO: 735217 - DNA, 20 bp, Artificial
  CRISPR gRNA sequence
gcccgacagcatctgctaca

SEQ ID NO: 735218 - DNA, 20 bp, Artificial
  CRISPR gRNA sequence
cccgacagcatctgctacag

SEQ ID NO: 735219 - DNA, 20 bp, Artificial
  CRISPR gRNA sequence
acagcatctgctacagagga

SEQ ID NO: 735220 - DNA, 20 bp, Artificial
  CRISPR gRNA sequence
agcatctgctacagaggata

SEQ ID NO: 735221 - DNA, 20 bp, Artificial
  CRISPR gRNA sequence
atctgctacagaggatagag

SEQ ID NO: 735222 - DNA, 20 bp, Artificial
  CRISPR gRNA sequence
tctgctacagaggatagagt

SEQ ID NO: 735223 - DNA, 20 bp, Artificial
  CRISPR gRNA sequence
ctgctacagaggatagagtg

SEQ ID NO: 735224 - DNA, 20 bp, Artificial
  CRISPR gRNA sequence
tgctacagaggatagagtgg

SEQ ID NO: 735225 - DNA, 20 bp, Artificial
  CRISPR gRNA sequence
cagaggatagagtgggggaa

SEQ ID NO: 735226 - DNA, 20 bp, Artificial
  CRISPR gRNA sequence
agaggatagagtgggggaac

SEQ ID NO: 735227 - DNA, 20 bp, Artificial
  CRISPR gRNA sequence
agtgggggaacaggcatcct

SEQ ID NO: 735228 - DNA, 20 bp, Artificial
  CRISPR gRNA sequence
caggcatcctcagacccctt

SEQ ID NO: 735229 - DNA, 20 bp, Artificial
  CRISPR gRNA sequence
aggcatcctcagaccccttg

SEQ ID NO: 735230 - DNA, 20 bp, Artificial
  CRISPR gRNA sequence
gcatcctcagaccccttgag

SEQ ID NO: 735231 - DNA, 20 bp, Artificial
  CRISPR gRNA sequence
atcctcagaccccttgagga

SEQ ID NO: 735232 - DNA, 20 bp, Artificial
  CRISPR gRNA sequence
tcagaccccttgaggagagc

SEQ ID NO: 735233 - DNA, 20 bp, Artificial
  CRISPR gRNA sequence
agcaagcatcttgatctctt

SEQ ID NO: 735234 - DNA, 20 bp, Artificial
  CRISPR gRNA sequence
ttgatctctttagccacaaa

SEQ ID NO: 735235 - DNA, 20 bp, Artificial
  CRISPR gRNA sequence
tgatctctttagccacaaat

SEQ ID NO: 735236 - DNA, 20 bp, Artificial
  CRISPR gRNA sequence
atctctttagccacaaatgg

SEQ ID NO: 735237 - DNA, 20 bp, Artificial
  CRISPR gRNA sequence
agccacaaatgggagtctcc

SEQ ID NO: 735238 - DNA, 20 bp, Artificial
  CRISPR gRNA sequence
tcctcatcctcactgatgaa

SEQ ID NO: 735239 - DNA, 20 bp, Artificial
  CRISPR gRNA sequence
tcctcactgatgaacagatt

SEQ ID NO: 735240 - DNA, 20 bp, Artificial
  CRISPR gRNA sequence
cctcactgatgaacagattt

SEQ ID NO: 735241 - DNA, 20 bp, Artificial
  CRISPR gRNA sequence
ctcactgatgaacagatttg

SEQ ID NO: 735242 - DNA, 20 bp, Artificial
  CRISPR gRNA sequence
tcactgatgaacagatttgg

SEQ ID NO: 735243 - DNA, 20 bp, Artificial
  CRISPR gRNA sequence
gaacagatttgggggcataa

SEQ ID NO: 735244 - DNA, 20 bp, Artificial
  CRISPR gRNA sequence
acagatttgggggcataatg

SEQ ID NO: 735245 - DNA, 20 bp, Artificial
  CRISPR gRNA sequence
cagatttgggggcataatgg

SEQ ID NO: 735246 - DNA, 20 bp, Artificial
  CRISPR gRNA sequence
gatttgggggcataatggag

SEQ ID NO: 735247 - DNA, 20 bp, Artificial
  CRISPR gRNA sequence
tttgggggcataatggagga

SEQ ID NO: 735248 - DNA, 20 bp, Artificial
  CRISPR gRNA sequence
ttgggggcataatggaggag

SEQ ID NO: 735249 - DNA, 20 bp, Artificial
  CRISPR gRNA sequence
ataatggaggagaggtacca

SEQ ID NO: 735250 - DNA, 20 bp, Artificial
  CRISPR gRNA sequence
atggaggagaggtaccaaag

SEQ ID NO: 735251 - DNA, 20 bp, Artificial
  CRISPR gRNA sequence
ggaggagaggtaccaaagta

SEQ ID NO: 735252 - DNA, 20 bp, Artificial
  CRISPR gRNA sequence
aggagaggtaccaaagtaga

SEQ ID NO: 735253 - DNA, 20 bp, Artificial
  CRISPR gRNA sequence
gagagatgttcccctctacc

SEQ ID NO: 735254 - DNA, 20 bp, Artificial
  CRISPR gRNA sequence
agagatgttcccctctacct

SEQ ID NO: 735255 - DNA, 20 bp, Artificial
  CRISPR gRNA sequence
gagatgttcccctctacctg

SEQ ID NO: 735256 - DNA, 20 bp, Artificial
  CRISPR gRNA sequence
ggacgtcctcctcttaactc

SEQ ID NO: 735257 - DNA, 20 bp, Artificial
  CRISPR gRNA sequence
ggatgtcacacttgcttctg

SEQ ID NO: 735258 - DNA, 20 bp, Artificial
  CRISPR gRNA sequence
gtcacacttgcttctgtggc

SEQ ID NO: 735259 - DNA, 20 bp, Artificial
  CRISPR gRNA sequence
tcacacttgcttctgtggcc

SEQ ID NO: 735260 - DNA, 20 bp, Artificial
  CRISPR gRNA sequence
gcttctgtggccgggtctgt

SEQ ID NO: 735261 - DNA, 20 bp, Artificial
  CRISPR gRNA sequence
cttctgtggccgggtctgta

SEQ ID NO: 735262 - DNA, 20 bp, Artificial
  CRISPR gRNA sequence
ctgtggccgggtctgtaagg

SEQ ID NO: 735263 - DNA, 20 bp, Artificial
  CRISPR gRNA sequence
gtggccgggtctgtaaggaa

SEQ ID NO: 735264 - DNA, 20 bp, Artificial
  CRISPR gRNA sequence
tggccgggtctgtaaggaag

SEQ ID NO: 735265 - DNA, 20 bp, Artificial
  CRISPR gRNA sequence
ggccgggtctgtaaggaaga

SEQ ID NO: 735266 - DNA, 20 bp, Artificial
  CRISPR gRNA sequence
cgggtctgtaaggaagaggg

SEQ ID NO: 735267 - DNA, 20 bp, Artificial
  CRISPR gRNA sequence
aagagggtggccgtctaccc

SEQ ID NO: 735268 - DNA, 20 bp, Artificial
  CRISPR gRNA sequence
agagggtggccgtctacccc

SEQ ID NO: 735269 - DNA, 20 bp, Artificial
  CRISPR gRNA sequence
gggtggccgtctaccccggg

SEQ ID NO: 735270 - DNA, 20 bp, Artificial
  CRISPR gRNA sequence
ggtggccgtctaccccggga

SEQ ID NO: 735271 - DNA, 20 bp, Artificial
  CRISPR gRNA sequence
gtggccgtctaccccgggaa

SEQ ID NO: 735272 - DNA, 20 bp, Artificial
  CRISPR gRNA sequence
ccccgggaagggcacgctct

SEQ ID NO: 735273 - DNA, 20 bp, Artificial
  CRISPR gRNA sequence
cccgggaagggcacgctctc

SEQ ID NO: 735274 - DNA, 20 bp, Artificial
  CRISPR gRNA sequence
ccgggaagggcacgctctca

SEQ ID NO: 735275 - DNA, 20 bp, Artificial
  CRISPR gRNA sequence
gctctcagggtttctgctgc

SEQ ID NO: 735276 - DNA, 20 bp, Artificial
  CRISPR gRNA sequence
ctgctggtccgatcccaacg

SEQ ID NO: 735277 - DNA, 20 bp, Artificial
  CRISPR gRNA sequence
tgctggtccgatcccaacgt

SEQ ID NO: 735278 - DNA, 20 bp, Artificial
  CRISPR gRNA sequence
ggtccgatcccaacgtgggt

SEQ ID NO: 735279 - DNA, 20 bp, Artificial
  CRISPR gRNA sequence
gtccgatcccaacgtgggtt

SEQ ID NO: 735280 - DNA, 20 bp, Artificial
  CRISPR gRNA sequence
gatcccaacgtgggttagga

SEQ ID NO: 735281 - DNA, 20 bp, Artificial
  CRISPR gRNA sequence
atcccaacgtgggttaggat

SEQ ID NO: 735282 - DNA, 20 bp, Artificial
  CRISPR gRNA sequence
tcccaacgtgggttaggatg

SEQ ID NO: 735283 - DNA, 20 bp, Artificial
  CRISPR gRNA sequence
cccaacgtgggttaggatgg

SEQ ID NO: 735284 - DNA, 20 bp, Artificial
  CRISPR gRNA sequence
tgggttaggatgggggacct

SEQ ID NO: 735285 - DNA, 20 bp, Artificial
  CRISPR gRNA sequence
tccaccctgtcccttcttct

SEQ ID NO: 735286 - DNA, 20 bp, Artificial
  CRISPR gRNA sequence
ccaccctgtcccttcttctc

SEQ ID NO: 735287 - DNA, 20 bp, Artificial
  CRISPR gRNA sequence
tgtcccttcttctcaggcac

SEQ ID NO: 735288 - DNA, 20 bp, Artificial
  CRISPR gRNA sequence
gtcccttcttctcaggcacc

SEQ ID NO: 735289 - DNA, 20 bp, Artificial
  CRISPR gRNA sequence
gatgtttactccactgtgct

SEQ ID NO: 735290 - DNA, 20 bp, Artificial
  CRISPR gRNA sequence
atgtttactccactgtgctt

SEQ ID NO: 735291 - DNA, 20 bp, Artificial
  CRISPR gRNA sequence
tgtttactccactgtgcttg

SEQ ID NO: 735292 - DNA, 20 bp, Artificial
  CRISPR gRNA sequence
ttactccactgtgcttgggg

SEQ ID NO: 735293 - DNA, 20 bp, Artificial
  CRISPR gRNA sequence
tggggtggtgctgaccctcc

SEQ ID NO: 735294 - DNA, 20 bp, Artificial
  CRISPR gRNA sequence
cctggtgctgatgctgatca

SEQ ID NO: 735295 - DNA, 20 bp, Artificial
  CRISPR gRNA sequence
ctgatgctgatcatggtcta

SEQ ID NO: 735296 - DNA, 20 bp, Artificial
  CRISPR gRNA sequence
tgatgctgatcatggtctat

SEQ ID NO: 735297 - DNA, 20 bp, Artificial
  CRISPR gRNA sequence
tgatcatggtctatgggttt

SEQ ID NO: 735298 - DNA, 20 bp, Artificial
  CRISPR gRNA sequence
tcatggtctatgggttttgg

SEQ ID NO: 735299 - DNA, 20 bp, Artificial
  CRISPR gRNA sequence
tggtctatgggttttggaag

SEQ ID NO: 735300 - DNA, 20 bp, Artificial
  CRISPR gRNA sequence
gtctatgggttttggaagaa

SEQ ID NO: 735301 - DNA, 20 bp, Artificial
  CRISPR gRNA sequence
gttttggaagaagagacaca

SEQ ID NO: 735302 - DNA, 20 bp, Artificial
  CRISPR gRNA sequence
tggaagaagagacacatggc

SEQ ID NO: 735303 - DNA, 20 bp, Artificial
  CRISPR gRNA sequence
agaagagacacatggcaagt

SEQ ID NO: 735304 - DNA, 20 bp, Artificial
  CRISPR gRNA sequence
agagacacatggcaagtgag

SEQ ID NO: 735305 - DNA, 20 bp, Artificial
  CRISPR gRNA sequence
agacacatggcaagtgagta

SEQ ID NO: 735306 - DNA, 20 bp, Artificial
  CRISPR gRNA sequence
agtgagtagagcccacctcc

SEQ ID NO: 735307 - DNA, 20 bp, Artificial
  CRISPR gRNA sequence
agcccacctcccagcctcct

SEQ ID NO: 735308 - DNA, 20 bp, Artificial
  CRISPR gRNA sequence
gcccacctcccagcctcctg

SEQ ID NO: 735309 - DNA, 20 bp, Artificial
  CRISPR gRNA sequence
cccacctcccagcctcctga

SEQ ID NO: 735310 - DNA, 20 bp, Artificial
  CRISPR gRNA sequence
acctcccagcctcctgaggg

SEQ ID NO: 735311 - DNA, 20 bp, Artificial
  CRISPR gRNA sequence
ctcccagcctcctgagggca

SEQ ID NO: 735312 - DNA, 20 bp, Artificial
  CRISPR gRNA sequence
gcctcctgagggcagagctc

SEQ ID NO: 735313 - DNA, 20 bp, Artificial
  CRISPR gRNA sequence
cctcctgagggcagagctct

SEQ ID NO: 735314 - DNA, 20 bp, Artificial
  CRISPR gRNA sequence
gagctctgggtaactgcact

SEQ ID NO: 735315 - DNA, 20 bp, Artificial
  CRISPR gRNA sequence
agctctgggtaactgcacta

SEQ ID NO: 735316 - DNA, 20 bp, Artificial
  CRISPR gRNA sequence
gctctgggtaactgcactaa

SEQ ID NO: 735317 - DNA, 20 bp, Artificial
  CRISPR gRNA sequence
gcactaagggttatgacctc

SEQ ID NO: 735318 - DNA, 20 bp, Artificial
  CRISPR gRNA sequence
tatgacctcgagtccccacg

SEQ ID NO: 735319 - DNA, 20 bp, Artificial
  CRISPR gRNA sequence
cctcgagtccccacgtggta

SEQ ID NO: 735320 - DNA, 20 bp, Artificial
  CRISPR gRNA sequence
tccccacgtggtatggccct

SEQ ID NO: 735321 - DNA, 20 bp, Artificial
  CRISPR gRNA sequence
tatggcccttggcctgtgtc

SEQ ID NO: 735322 - DNA, 20 bp, Artificial
  CRISPR gRNA sequence
cttggcctgtgtccagtcaa

SEQ ID NO: 735323 - DNA, 20 bp, Artificial
  CRISPR gRNA sequence
ttggcctgtgtccagtcaaa

SEQ ID NO: 735324 - DNA, 20 bp, Artificial
  CRISPR gRNA sequence
aggactatgacgcttccacc

SEQ ID NO: 735325 - DNA, 20 bp, Artificial
  CRISPR gRNA sequence
ggactatgacgcttccacct

SEQ ID NO: 735326 - DNA, 20 bp, Artificial
  CRISPR gRNA sequence
gactatgacgcttccacctg

SEQ ID NO: 735327 - DNA, 20 bp, Artificial
  CRISPR gRNA sequence
ctatgacgcttccacctggg

SEQ ID NO: 735328 - DNA, 20 bp, Artificial
  CRISPR gRNA sequence
tatgacgcttccacctgggg

SEQ ID NO: 735329 - DNA, 20 bp, Artificial
  CRISPR gRNA sequence
tgacgcttccacctggggag

SEQ ID NO: 735330 - DNA, 20 bp, Artificial
  CRISPR gRNA sequence
gacgcttccacctggggagg

SEQ ID NO: 735331 - DNA, 20 bp, Artificial
  CRISPR gRNA sequence
acgcttccacctggggagga

SEQ ID NO: 735332 - DNA, 20 bp, Artificial
  CRISPR gRNA sequence
cttccacctggggaggaggg

SEQ ID NO: 735333 - DNA, 20 bp, Artificial
  CRISPR gRNA sequence
cacctggggaggagggcggc

SEQ ID NO: 735334 - DNA, 20 bp, Artificial
  CRISPR gRNA sequence
acctggggaggagggcggcc

SEQ ID NO: 735335 - DNA, 20 bp, Artificial
  CRISPR gRNA sequence
tggggaggagggcggccagg

SEQ ID NO: 735336 - DNA, 20 bp, Artificial
  CRISPR gRNA sequence
gggaggagggcggccaggcg

SEQ ID NO: 735337 - DNA, 20 bp, Artificial
  CRISPR gRNA sequence
gcggccaggcggagaccacc

SEQ ID NO: 735338 - DNA, 20 bp, Artificial
  CRISPR gRNA sequence
agaccacccagcacaaccct

SEQ ID NO: 735339 - DNA, 20 bp, Artificial
  CRISPR gRNA sequence
gaccacccagcacaacccta

SEQ ID NO: 735340 - DNA, 20 bp, Artificial
  CRISPR gRNA sequence
accacccagcacaaccctaa

SEQ ID NO: 735341 - DNA, 20 bp, Artificial
  CRISPR gRNA sequence
ccacccagcacaaccctaag

SEQ ID NO: 735342 - DNA, 20 bp, Artificial
  CRISPR gRNA sequence
acaaccctaaggggatgacc

SEQ ID NO: 735343 - DNA, 20 bp, Artificial
  CRISPR gRNA sequence
accctaaggggatgacctgg

SEQ ID NO: 735344 - DNA, 20 bp, Artificial
  CRISPR gRNA sequence
ccctaaggggatgacctgga

SEQ ID NO: 735345 - DNA, 20 bp, Artificial
  CRISPR gRNA sequence
ggggatgacctggaaggaac

SEQ ID NO: 735346 - DNA, 20 bp, Artificial
  CRISPR gRNA sequence
ggatgacctggaaggaacca

SEQ ID NO: 735347 - DNA, 20 bp, Artificial
  CRISPR gRNA sequence
gatgacctggaaggaaccag

SEQ ID NO: 735348 - DNA, 20 bp, Artificial
  CRISPR gRNA sequence
gacctggaaggaaccagagg

SEQ ID NO: 735349 - DNA, 20 bp, Artificial
  CRISPR gRNA sequence
cctggaaggaaccagaggca

SEQ ID NO: 735350 - DNA, 20 bp, Artificial
  CRISPR gRNA sequence
gaaggaaccagaggcagagc

SEQ ID NO: 735351 - DNA, 20 bp, Artificial
  CRISPR gRNA sequence
gaaccagaggcagagccaga

SEQ ID NO: 735352 - DNA, 20 bp, Artificial
  CRISPR gRNA sequence
aaccagaggcagagccagaa

SEQ ID NO: 735353 - DNA, 20 bp, Artificial
  CRISPR gRNA sequence
accagaggcagagccagaaa

SEQ ID NO: 735354 - DNA, 20 bp, Artificial
  CRISPR gRNA sequence
ccagaggcagagccagaaag

SEQ ID NO: 735355 - DNA, 20 bp, Artificial
  CRISPR gRNA sequence
aggcagagccagaaaggggc

SEQ ID NO: 735356 - DNA, 20 bp, Artificial
  CRISPR gRNA sequence
ggcagagccagaaaggggct

SEQ ID NO: 735357 - DNA, 20 bp, Artificial
  CRISPR gRNA sequence
gcagagccagaaaggggctg

SEQ ID NO: 735358 - DNA, 20 bp, Artificial
  CRISPR gRNA sequence
agccagaaaggggctggggc

SEQ ID NO: 735359 - DNA, 20 bp, Artificial
  CRISPR gRNA sequence
cagaaaggggctggggctgg

SEQ ID NO: 735360 - DNA, 20 bp, Artificial
  CRISPR gRNA sequence
gaaaggggctggggctggtg

SEQ ID NO: 735361 - DNA, 20 bp, Artificial
  CRISPR gRNA sequence
aaaggggctggggctggtgg

SEQ ID NO: 735362 - DNA, 20 bp, Artificial
  CRISPR gRNA sequence
aggggctggggctggtggag

SEQ ID NO: 735363 - DNA, 20 bp, Artificial
  CRISPR gRNA sequence
tggggctggtggaggagcat

SEQ ID NO: 735364 - DNA, 20 bp, Artificial
  CRISPR gRNA sequence
ggggctggtggaggagcatc

SEQ ID NO: 735365 - DNA, 20 bp, Artificial
  CRISPR gRNA sequence
gggctggtggaggagcatcg

SEQ ID NO: 735366 - DNA, 20 bp, Artificial
  CRISPR gRNA sequence
ggaggagcatcggggcaccg

SEQ ID NO: 735367 - DNA, 20 bp, Artificial
  CRISPR gRNA sequence
gaggagcatcggggcaccgt

SEQ ID NO: 735368 - DNA, 20 bp, Artificial
  CRISPR gRNA sequence
gagcatcggggcaccgtggg

SEQ ID NO: 735369 - DNA, 20 bp, Artificial
  CRISPR gRNA sequence
agcatcggggcaccgtgggc

SEQ ID NO: 735370 - DNA, 20 bp, Artificial
  CRISPR gRNA sequence
gcatcggggcaccgtgggca

SEQ ID NO: 735371 - DNA, 20 bp, Artificial
  CRISPR gRNA sequence
tcggggcaccgtgggcaggg

SEQ ID NO: 735372 - DNA, 20 bp, Artificial
  CRISPR gRNA sequence
cggggcaccgtgggcagggc

SEQ ID NO: 735373 - DNA, 20 bp, Artificial
  CRISPR gRNA sequence
ggcagggcaggacacttcct

SEQ ID NO: 735374 - DNA, 20 bp, Artificial
  CRISPR gRNA sequence
tcagctctccctgtttcttg

SEQ ID NO: 735375 - DNA, 20 bp, Artificial
  CRISPR gRNA sequence
cagctctccctgtttcttgc

SEQ ID NO: 735376 - DNA, 20 bp, Artificial
  CRISPR gRNA sequence
tccctgtttcttgcaggcta

SEQ ID NO: 735377 - DNA, 20 bp, Artificial
  CRISPR gRNA sequence
cttgcaggctacagcatgtg

SEQ ID NO: 735378 - DNA, 20 bp, Artificial
  CRISPR gRNA sequence
ccttctacacgtgacccacc

SEQ ID NO: 735379 - DNA, 20 bp, Artificial
  CRISPR gRNA sequence
tctacacgtgacccacctgg

SEQ ID NO: 735380 - DNA, 20 bp, Artificial
  CRISPR gRNA sequence
acgtgacccacctggaagac

SEQ ID NO: 735381 - DNA, 20 bp, Artificial
  CRISPR gRNA sequence
gtgacccacctggaagacca

SEQ ID NO: 735382 - DNA, 20 bp, Artificial
  CRISPR gRNA sequence
tggaagaccagagccctatg

SEQ ID NO: 735383 - DNA, 20 bp, Artificial
  CRISPR gRNA sequence
aagaccagagccctatgtgg

SEQ ID NO: 735384 - DNA, 20 bp, Artificial
  CRISPR gRNA sequence
tgtggaagtctacttgatct

SEQ ID NO: 735385 - DNA, 20 bp, Artificial
  CRISPR gRNA sequence
gtggaagtctacttgatctg

SEQ ID NO: 735386 - DNA, 20 bp, Artificial
  CRISPR gRNA sequence
tacttgatctgaggccactt

SEQ ID NO: 735387 - DNA, 20 bp, Artificial
  CRISPR gRNA sequence
gatctgaggccacttaagca

SEQ ID NO: 735388 - DNA, 20 bp, Artificial
  CRISPR gRNA sequence
atctgaggccacttaagcat

SEQ ID NO: 735389 - DNA, 20 bp, Artificial
  CRISPR gRNA sequence
tctgaggccacttaagcatg

SEQ ID NO: 735390 - DNA, 20 bp, Artificial
  CRISPR gRNA sequence
gaggccacttaagcatgggg

SEQ ID NO: 735391 - DNA, 20 bp, Artificial
  CRISPR gRNA sequence
aggccacttaagcatggggt

SEQ ID NO: 735392 - DNA, 20 bp, Artificial
  CRISPR gRNA sequence
ggccacttaagcatggggtg

SEQ ID NO: 735393 - DNA, 20 bp, Artificial
  CRISPR gRNA sequence
ccacttaagcatggggtggg

SEQ ID NO: 735394 - DNA, 20 bp, Artificial
  CRISPR gRNA sequence
atggggtggggagcttctcc

SEQ ID NO: 735395 - DNA, 20 bp, Artificial
  CRISPR gRNA sequence
ggggtggggagcttctccca

SEQ ID NO: 735396 - DNA, 20 bp, Artificial
  CRISPR gRNA sequence
gtggggagcttctcccagag

SEQ ID NO: 735397 - DNA, 20 bp, Artificial
  CRISPR gRNA sequence
agcttctcccagagtggccc

SEQ ID NO: 735398 - DNA, 20 bp, Artificial
  CRISPR gRNA sequence
gcttctcccagagtggcccc

SEQ ID NO: 735399 - DNA, 20 bp, Artificial
  CRISPR gRNA sequence
cttctcccagagtggcccca

SEQ ID NO: 735400 - DNA, 20 bp, Artificial
  CRISPR gRNA sequence
ttctcccagagtggccccag

SEQ ID NO: 735401 - DNA, 20 bp, Artificial
  CRISPR gRNA sequence
tctcccagagtggccccagg

SEQ ID NO: 735402 - DNA, 20 bp, Artificial
  CRISPR gRNA sequence
ccagagtggccccagggggt

SEQ ID NO: 735403 - DNA, 20 bp, Artificial
  CRISPR gRNA sequence
agagtggccccagggggtta

SEQ ID NO: 735404 - DNA, 20 bp, Artificial
  CRISPR gRNA sequence
gagtggccccagggggttag

SEQ ID NO: 735405 - DNA, 20 bp, Artificial
  CRISPR gRNA sequence
gtggccccagggggttagag

SEQ ID NO: 735406 - DNA, 20 bp, Artificial
  CRISPR gRNA sequence
tggccccagggggttagagg

SEQ ID NO: 735407 - DNA, 20 bp, Artificial
  CRISPR gRNA sequence
ggccccagggggttagagga

SEQ ID NO: 735408 - DNA, 20 bp, Artificial
  CRISPR gRNA sequence
gccccagggggttagaggag

SEQ ID NO: 735409 - DNA, 20 bp, Artificial
  CRISPR gRNA sequence
agggggttagaggaggggtg

SEQ ID NO: 735410 - DNA, 20 bp, Artificial
  CRISPR gRNA sequence
gttagaggaggggtgaagat

SEQ ID NO: 735411 - DNA, 20 bp, Artificial
  CRISPR gRNA sequence
ttagaggaggggtgaagatt

SEQ ID NO: 735412 - DNA, 20 bp, Artificial
  CRISPR gRNA sequence
tagaggaggggtgaagattg

SEQ ID NO: 735413 - DNA, 20 bp, Artificial
  CRISPR gRNA sequence
ggaggggtgaagattggggc

SEQ ID NO: 735414 - DNA, 20 bp, Artificial
  CRISPR gRNA sequence
gggccagtatcgatcttatg

SEQ ID NO: 735415 - DNA, 20 bp, Artificial
  CRISPR gRNA sequence
cagtatcgatcttatgaagc

SEQ ID NO: 735416 - DNA, 20 bp, Artificial
  CRISPR gRNA sequence
gtatcgatcttatgaagctg

SEQ ID NO: 735417 - DNA, 20 bp, Artificial
  CRISPR gRNA sequence
tatcgatcttatgaagctgg

SEQ ID NO: 735418 - DNA, 20 bp, Artificial
  CRISPR gRNA sequence
atgaagctggaggacttgtg

SEQ ID NO: 735419 - DNA, 20 bp, Artificial
  CRISPR gRNA sequence
ctggaggacttgtgcagtgc

SEQ ID NO: 735420 - DNA, 20 bp, Artificial
  CRISPR gRNA sequence
tgtgcagtgctggactcacc

SEQ ID NO: 735421 - DNA, 20 bp, Artificial
  CRISPR gRNA sequence
gtgcagtgctggactcaccc

SEQ ID NO: 735422 - DNA, 20 bp, Artificial
  CRISPR gRNA sequence
cacccaggacttcccaaacc

SEQ ID NO: 735423 - DNA, 20 bp, Artificial
  CRISPR gRNA sequence
cccaggacttcccaaaccca

SEQ ID NO: 735424 - DNA, 20 bp, Artificial
  CRISPR gRNA sequence
ccaggacttcccaaacccag

SEQ ID NO: 735425 - DNA, 20 bp, Artificial
  CRISPR gRNA sequence
aacccagaggctgccatcct

SEQ ID NO: 735426 - DNA, 20 bp, Artificial
  CRISPR gRNA sequence
ccagaggctgccatcctaag

SEQ ID NO: 735427 - DNA, 20 bp, Artificial
  CRISPR gRNA sequence
tgccatcctaagcagcccca

SEQ ID NO: 735428 - DNA, 20 bp, Artificial
  CRISPR gRNA sequence
tcctaagcagccccacagcc

SEQ ID NO: 735429 - DNA, 20 bp, Artificial
  CRISPR gRNA sequence
ccacagcccagtgttctcct

SEQ ID NO: 735430 - DNA, 20 bp, Artificial
  CRISPR gRNA sequence
cacagcccagtgttctcctt

SEQ ID NO: 735431 - DNA, 20 bp, Artificial
  CRISPR gRNA sequence
acagcccagtgttctccttg

SEQ ID NO: 735432 - DNA, 20 bp, Artificial
  CRISPR gRNA sequence
cagcccagtgttctccttgg

SEQ ID NO: 735433 - DNA, 20 bp, Artificial
  CRISPR gRNA sequence
cccagtgttctccttggggg

SEQ ID NO: 735434 - DNA, 20 bp, Artificial
  CRISPR gRNA sequence
ccagtgttctccttgggggc

SEQ ID NO: 735435 - DNA, 20 bp, Artificial
  CRISPR gRNA sequence
tctccttgggggcaggaacc

SEQ ID NO: 735436 - DNA, 20 bp, Artificial
  CRISPR gRNA sequence
ctccttgggggcaggaacct

SEQ ID NO: 735437 - DNA, 20 bp, Artificial
  CRISPR gRNA sequence
tccttgggggcaggaacctg

SEQ ID NO: 735438 - DNA, 20 bp, Artificial
  CRISPR gRNA sequence
cttgggggcaggaacctggg

SEQ ID NO: 735439 - DNA, 20 bp, Artificial
  CRISPR gRNA sequence
ttgggggcaggaacctgggg

SEQ ID NO: 735440 - DNA, 20 bp, Artificial
  CRISPR gRNA sequence
tgggggcaggaacctgggga

SEQ ID NO: 735441 - DNA, 20 bp, Artificial
  CRISPR gRNA sequence
gggggcaggaacctggggag

SEQ ID NO: 735442 - DNA, 20 bp, Artificial
  CRISPR gRNA sequence
caggaacctggggaggggcc

SEQ ID NO: 735443 - DNA, 20 bp, Artificial
  CRISPR gRNA sequence
ggaacctggggaggggccca

SEQ ID NO: 735444 - DNA, 20 bp, Artificial
  CRISPR gRNA sequence
ctggggaggggcccagagca

SEQ ID NO: 735445 - DNA, 20 bp, Artificial
  CRISPR gRNA sequence
tggggaggggcccagagcaa

SEQ ID NO: 735446 - DNA, 20 bp, Artificial
  CRISPR gRNA sequence
ggggaggggcccagagcaaa

SEQ ID NO: 735447 - DNA, 20 bp, Artificial
  CRISPR gRNA sequence
gggcccagagcaaagggcat

SEQ ID NO: 735448 - DNA, 20 bp, Artificial
  CRISPR gRNA sequence
ggcccagagcaaagggcatc

SEQ ID NO: 735449 - DNA, 20 bp, Artificial
  CRISPR gRNA sequence
gcccagagcaaagggcatca

SEQ ID NO: 735450 - DNA, 20 bp, Artificial
  CRISPR gRNA sequence
ccagagcaaagggcatcagg

SEQ ID NO: 735451 - DNA, 20 bp, Artificial
  CRISPR gRNA sequence
agcaaagggcatcagggaga

SEQ ID NO: 735452 - DNA, 20 bp, Artificial
  CRISPR gRNA sequence
ggcatcagggagaaagtccc

SEQ ID NO: 735453 - DNA, 20 bp, Artificial
  CRISPR gRNA sequence
gcatcagggagaaagtcccg

SEQ ID NO: 735454 - DNA, 20 bp, Artificial
  CRISPR gRNA sequence
aagtcccgaggaaatgtgac

SEQ ID NO: 735455 - DNA, 20 bp, Artificial
  CRISPR gRNA sequence
tcccgaggaaatgtgaccag

SEQ ID NO: 735456 - DNA, 20 bp, Artificial
  CRISPR gRNA sequence
tgtgaccagtggtttctgct

SEQ ID NO: 735457 - DNA, 20 bp, Artificial
  CRISPR gRNA sequence
tgaccagtggtttctgctcg

SEQ ID NO: 735458 - DNA, 20 bp, Artificial
  CRISPR gRNA sequence
gtggtttctgctcggagctg

SEQ ID NO: 735459 - DNA, 20 bp, Artificial
  CRISPR gRNA sequence
ctgctcggagctgcagaccc

SEQ ID NO: 735460 - DNA, 20 bp, Artificial
  CRISPR gRNA sequence
tgctcggagctgcagacccc

SEQ ID NO: 735461 - DNA, 20 bp, Artificial
  CRISPR gRNA sequence
gctcggagctgcagacccca

SEQ ID NO: 735462 - DNA, 20 bp, Artificial
  CRISPR gRNA sequence
gctgcagaccccagggctct

SEQ ID NO: 735463 - DNA, 20 bp, Artificial
  CRISPR gRNA sequence
gcagaccccagggctcttgg

SEQ ID NO: 735464 - DNA, 20 bp, Artificial
  CRISPR gRNA sequence
agaccccagggctcttggtg

SEQ ID NO: 735465 - DNA, 20 bp, Artificial
  CRISPR gRNA sequence
gaccccagggctcttggtgg

SEQ ID NO: 735466 - DNA, 20 bp, Artificial
  CRISPR gRNA sequence
cccagggctcttggtggagg

SEQ ID NO: 735467 - DNA, 20 bp, Artificial
  CRISPR gRNA sequence
ccagggctcttggtggaggc

SEQ ID NO: 735468 - DNA, 20 bp, Artificial
  CRISPR gRNA sequence
cagggctcttggtggaggca

SEQ ID NO: 735469 - DNA, 20 bp, Artificial
  CRISPR gRNA sequence
agggctcttggtggaggcag

SEQ ID NO: 735470 - DNA, 20 bp, Artificial
  CRISPR gRNA sequence
ggtggaggcaggggaaccct

SEQ ID NO: 735471 - DNA, 20 bp, Artificial
  CRISPR gRNA sequence
tggaggcaggggaaccctga

SEQ ID NO: 735472 - DNA, 20 bp, Artificial
  CRISPR gRNA sequence
aaccctgagagtgctgttta

SEQ ID NO: 735473 - DNA, 20 bp, Artificial
  CRISPR gRNA sequence
ccctgagagtgctgtttaca

SEQ ID NO: 735474 - DNA, 20 bp, Artificial
  CRISPR gRNA sequence
gtgctgtttacagagaacct

SEQ ID NO: 735475 - DNA, 20 bp, Artificial
  CRISPR gRNA sequence
acctcagctcccgtctgcct

SEQ ID NO: 735476 - DNA, 20 bp, Artificial
  CRISPR gRNA sequence
gtctgcctcagaaaccctat

SEQ ID NO: 735477 - DNA, 20 bp, Artificial
  CRISPR gRNA sequence
tctgcctcagaaaccctatt

SEQ ID NO: 735478 - DNA, 20 bp, Artificial
  CRISPR gRNA sequence
ctcagaaaccctattgggct

SEQ ID NO: 735479 - DNA, 20 bp, Artificial
  CRISPR gRNA sequence
ggctgagctgccctccccac

SEQ ID NO: 735480 - DNA, 20 bp, Artificial
  CRISPR gRNA sequence
gctgagctgccctccccacc

SEQ ID NO: 735481 - DNA, 20 bp, Artificial
  CRISPR gRNA sequence
ctgagctgccctccccacca

SEQ ID NO: 735482 - DNA, 20 bp, Artificial
  CRISPR gRNA sequence
tgcttccctccgttctgctt

SEQ ID NO: 735483 - DNA, 20 bp, Artificial
  CRISPR gRNA sequence
gttctgcttcagcttcccct

SEQ ID NO: 735484 - DNA, 20 bp, Artificial
  CRISPR gRNA sequence
ttctgcttcagcttccccta

SEQ ID NO: 735485 - DNA, 20 bp, Artificial
  CRISPR gRNA sequence
gcttcagcttcccctaaggt

SEQ ID NO: 735486 - DNA, 20 bp, Artificial
  CRISPR gRNA sequence
cttcagcttcccctaaggtt

SEQ ID NO: 735487 - DNA, 20 bp, Artificial
  CRISPR gRNA sequence
ttcagcttcccctaaggtta

SEQ ID NO: 735488 - DNA, 20 bp, Artificial
  CRISPR gRNA sequence
agcttcccctaaggttaggg

SEQ ID NO: 735489 - DNA, 20 bp, Artificial
  CRISPR gRNA sequence
tcccctaaggttagggaaga

SEQ ID NO: 735490 - DNA, 20 bp, Artificial
  CRISPR gRNA sequence
aaggttagggaagaaagaat

SEQ ID NO: 735491 - DNA, 20 bp, Artificial
  CRISPR gRNA sequence
aggttagggaagaaagaatc

SEQ ID NO: 735492 - DNA, 20 bp, Artificial
  CRISPR gRNA sequence
agaatcgggctcacgaatgc

SEQ ID NO: 735493 - DNA, 20 bp, Artificial
  CRISPR gRNA sequence
aatcgggctcacgaatgcca

SEQ ID NO: 735494 - DNA, 20 bp, Artificial
  CRISPR gRNA sequence
atcgggctcacgaatgccag

SEQ ID NO: 735495 - DNA, 20 bp, Artificial
  CRISPR gRNA sequence
gggctcacgaatgccagagg

SEQ ID NO: 735496 - DNA, 20 bp, Artificial
  CRISPR gRNA sequence
gaggcagtgatgtcccatcc

SEQ ID NO: 735497 - DNA, 20 bp, Artificial
  CRISPR gRNA sequence
ggcagtgatgtcccatcctg

SEQ ID NO: 735498 - DNA, 20 bp, Artificial
  CRISPR gRNA sequence
gcagtgatgtcccatcctgg

SEQ ID NO: 735499 - DNA, 20 bp, Artificial
  CRISPR gRNA sequence
agtgatgtcccatcctggag

SEQ ID NO: 735500 - DNA, 20 bp, Artificial
  CRISPR gRNA sequence
tgatgtcccatcctggagga

SEQ ID NO: 735501 - DNA, 20 bp, Artificial
  CRISPR gRNA sequence
gatgtcccatcctggaggag

SEQ ID NO: 735502 - DNA, 20 bp, Artificial
  CRISPR gRNA sequence
ccatcctggaggagaggaaa

SEQ ID NO: 735503 - DNA, 20 bp, Artificial
  CRISPR gRNA sequence
ggagaggaaacagtgactaa

SEQ ID NO: 735504 - DNA, 20 bp, Artificial
  CRISPR gRNA sequence
aggaaacagtgactaaaagc

SEQ ID NO: 735505 - DNA, 20 bp, Artificial
  CRISPR gRNA sequence
ggaaacagtgactaaaagct

SEQ ID NO: 735506 - DNA, 20 bp, Artificial
  CRISPR gRNA sequence
gaaacagtgactaaaagctg

SEQ ID NO: 735507 - DNA, 20 bp, Artificial
  CRISPR gRNA sequence
gactaaaagctggggaccca

SEQ ID NO: 735508 - DNA, 20 bp, Artificial
  CRISPR gRNA sequence
ctaaaagctggggacccaca

SEQ ID NO: 735509 - DNA, 20 bp, Artificial
  CRISPR gRNA sequence
taaaagctggggacccacag

SEQ ID NO: 735510 - DNA, 20 bp, Artificial
  CRISPR gRNA sequence
aaaagctggggacccacaga

SEQ ID NO: 735511 - DNA, 20 bp, Artificial
  CRISPR gRNA sequence
aaagctggggacccacagag

SEQ ID NO: 735512 - DNA, 20 bp, Artificial
  CRISPR gRNA sequence
ctggggacccacagaggggt

SEQ ID NO: 735513 - DNA, 20 bp, Artificial
  CRISPR gRNA sequence
gggacccacagaggggttgg

SEQ ID NO: 735514 - DNA, 20 bp, Artificial
  CRISPR gRNA sequence
gggttggcagcttctcttgt

SEQ ID NO: 735515 - DNA, 20 bp, Artificial
  CRISPR gRNA sequence
ggttggcagcttctcttgtc

SEQ ID NO: 735516 - DNA, 20 bp, Artificial
  CRISPR gRNA sequence
ggcagcttctcttgtcggga

SEQ ID NO: 735517 - DNA, 20 bp, Artificial
  CRISPR gRNA sequence
gcagcttctcttgtcgggac

SEQ ID NO: 735518 - DNA, 20 bp, Artificial
  CRISPR gRNA sequence
tcgggacaggtgtcctttgc

SEQ ID NO: 735519 - DNA, 20 bp, Artificial
  CRISPR gRNA sequence
cgggacaggtgtcctttgct

SEQ ID NO: 735520 - DNA, 20 bp, Artificial
  CRISPR gRNA sequence
ggtgtcctttgctgggcctc

SEQ ID NO: 735521 - DNA, 20 bp, Artificial
  CRISPR gRNA sequence
tcctttgctgggcctctgga

SEQ ID NO: 735522 - DNA, 20 bp, Artificial
  CRISPR gRNA sequence
ctggatggccctgccctgac

SEQ ID NO: 735523 - DNA, 20 bp, Artificial
  CRISPR gRNA sequence
tggatggccctgccctgact

SEQ ID NO: 735524 - DNA, 20 bp, Artificial
  CRISPR gRNA sequence
ggatggccctgccctgactg

SEQ ID NO: 735525 - DNA, 20 bp, Artificial
  CRISPR gRNA sequence
gctgctcctccctcctgtcc

SEQ ID NO: 735526 - DNA, 20 bp, Artificial
  CRISPR gRNA sequence
ctgctcctccctcctgtcct

SEQ ID NO: 735527 - DNA, 20 bp, Artificial
  CRISPR gRNA sequence
cctcctgtcctgggaccgcg

SEQ ID NO: 735528 - DNA, 20 bp, Artificial
  CRISPR gRNA sequence
tcctgtcctgggaccgcgca

SEQ ID NO: 735529 - DNA, 20 bp, Artificial
  CRISPR gRNA sequence
ctctcactgctgcctcctgc

SEQ ID NO: 735530 - DNA, 20 bp, Artificial
  CRISPR gRNA sequence
cctgctggccgctgcctcct

SEQ ID NO: 735531 - DNA, 20 bp, Artificial
  CRISPR gRNA sequence
ctggccgctgcctccttaga

SEQ ID NO: 735532 - DNA, 20 bp, Artificial
  CRISPR gRNA sequence
cctccttagaaagctgtgac

SEQ ID NO: 735533 - DNA, 20 bp, Artificial
  CRISPR gRNA sequence
ctccttagaaagctgtgacc

SEQ ID NO: 735534 - DNA, 20 bp, Artificial
  CRISPR gRNA sequence
cttagaaagctgtgaccagg

SEQ ID NO: 735535 - DNA, 20 bp, Artificial
  CRISPR gRNA sequence
aaagctgtgaccaggcagct

SEQ ID NO: 735536 - DNA, 20 bp, Artificial
  CRISPR gRNA sequence
agctgtgaccaggcagctaa

SEQ ID NO: 735537 - DNA, 20 bp, Artificial
  CRISPR gRNA sequence
accaggcagctaagagcctc

SEQ ID NO: 735538 - DNA, 20 bp, Artificial
  CRISPR gRNA sequence
ccaggcagctaagagcctct

SEQ ID NO: 735539 - DNA, 20 bp, Artificial
  CRISPR gRNA sequence
agctaagagcctctgggctg

SEQ ID NO: 735540 - DNA, 20 bp, Artificial
  CRISPR gRNA sequence
gctaagagcctctgggctgc

SEQ ID NO: 735541 - DNA, 20 bp, Artificial
  CRISPR gRNA sequence
ctaagagcctctgggctgca

SEQ ID NO: 735542 - DNA, 20 bp, Artificial
  CRISPR gRNA sequence
gagcctctgggctgcagggt

SEQ ID NO: 735543 - DNA, 20 bp, Artificial
  CRISPR gRNA sequence
ctgcagggtcagcctctccc

SEQ ID NO: 735544 - DNA, 20 bp, Artificial
  CRISPR gRNA sequence
gtcagcctctcccaagactg

SEQ ID NO: 735545 - DNA, 20 bp, Artificial
  CRISPR gRNA sequence
cctctcccaagactgaagtg

SEQ ID NO: 735546 - DNA, 20 bp, Artificial
  CRISPR gRNA sequence
tctcccaagactgaagtgca

SEQ ID NO: 735547 - DNA, 20 bp, Artificial
  CRISPR gRNA sequence
ctcccaagactgaagtgcag

SEQ ID NO: 735548 - DNA, 20 bp, Artificial
  CRISPR gRNA sequence
caagactgaagtgcagaggc

SEQ ID NO: 735549 - DNA, 20 bp, Artificial
  CRISPR gRNA sequence
tgaagtgcagaggctggact

SEQ ID NO: 735550 - DNA, 20 bp, Artificial
  CRISPR gRNA sequence
gaagtgcagaggctggactt

SEQ ID NO: 735551 - DNA, 20 bp, Artificial
  CRISPR gRNA sequence
aagtgcagaggctggacttg

SEQ ID NO: 735552 - DNA, 20 bp, Artificial
  CRISPR gRNA sequence
ggacttggggctctctcccc

SEQ ID NO: 735553 - DNA, 20 bp, Artificial
  CRISPR gRNA sequence
tctcccccagcttctacacc

SEQ ID NO: 735554 - DNA, 20 bp, Artificial
  CRISPR gRNA sequence
ctcccccagcttctacacct

SEQ ID NO: 735555 - DNA, 20 bp, Artificial
  CRISPR gRNA sequence
agcttctacacctgggctcc

SEQ ID NO: 735556 - DNA, 20 bp, Artificial
  CRISPR gRNA sequence
tacacctgggctccaagtct

SEQ ID NO: 735557 - DNA, 20 bp, Artificial
  CRISPR gRNA sequence
gctccaagtctgagttccca

SEQ ID NO: 735558 - DNA, 20 bp, Artificial
  CRISPR gRNA sequence
ctccaagtctgagttcccac

SEQ ID NO: 735559 - DNA, 20 bp, Artificial
  CRISPR gRNA sequence
tccaagtctgagttcccaca

SEQ ID NO: 735560 - DNA, 20 bp, Artificial
  CRISPR gRNA sequence
ccaagtctgagttcccacag

SEQ ID NO: 735561 - DNA, 20 bp, Artificial
  CRISPR gRNA sequence
ctgagttcccacaggggacc

SEQ ID NO: 735562 - DNA, 20 bp, Artificial
  CRISPR gRNA sequence
agttcccacaggggacccag

SEQ ID NO: 735563 - DNA, 20 bp, Artificial
  CRISPR gRNA sequence
acaggggacccagcagcctc

SEQ ID NO: 735564 - DNA, 20 bp, Artificial
  CRISPR gRNA sequence
caggggacccagcagcctcc

SEQ ID NO: 735565 - DNA, 20 bp, Artificial
  CRISPR gRNA sequence
gggacccagcagcctccagg

SEQ ID NO: 735566 - DNA, 20 bp, Artificial
  CRISPR gRNA sequence
cctccaggaagtccataccc

SEQ ID NO: 735567 - DNA, 20 bp, Artificial
  CRISPR gRNA sequence
ctccaggaagtccataccct

SEQ ID NO: 735568 - DNA, 20 bp, Artificial
  CRISPR gRNA sequence
tccaggaagtccataccctg

SEQ ID NO: 735569 - DNA, 20 bp, Artificial
  CRISPR gRNA sequence
aggaagtccataccctgggg

SEQ ID NO: 735570 - DNA, 20 bp, Artificial
  CRISPR gRNA sequence
gtccataccctggggtggct

SEQ ID NO: 735571 - DNA, 20 bp, Artificial
  CRISPR gRNA sequence
ccctggggtggctgagacct

SEQ ID NO: 735572 - DNA, 20 bp, Artificial
  CRISPR gRNA sequence
gctgagaccttggctctgta

SEQ ID NO: 735573 - DNA, 20 bp, Artificial
  CRISPR gRNA sequence
tgagaccttggctctgtatg

SEQ ID NO: 735574 - DNA, 20 bp, Artificial
  CRISPR gRNA sequence
gagaccttggctctgtatgg

SEQ ID NO: 735575 - DNA, 20 bp, Artificial
  CRISPR gRNA sequence
tatggaggctgctcacccca

SEQ ID NO: 735576 - DNA, 20 bp, Artificial
  CRISPR gRNA sequence
gctgctcaccccacagacac

SEQ ID NO: 735577 - DNA, 20 bp, Artificial
  CRISPR gRNA sequence
gctcaccccacagacactgg

SEQ ID NO: 735578 - DNA, 20 bp, Artificial
  CRISPR gRNA sequence
ctcaccccacagacactggt

SEQ ID NO: 735579 - DNA, 20 bp, Artificial
  CRISPR gRNA sequence
tcaccccacagacactggtg

SEQ ID NO: 735580 - DNA, 20 bp, Artificial
  CRISPR gRNA sequence
accccacagacactggtggg

SEQ ID NO: 735581 - DNA, 20 bp, Artificial
  CRISPR gRNA sequence
agacactggtggggagacca

SEQ ID NO: 735582 - DNA, 20 bp, Artificial
  CRISPR gRNA sequence
ctggtggggagaccatggct

SEQ ID NO: 735583 - DNA, 20 bp, Artificial
  CRISPR gRNA sequence
ggtggggagaccatggctca

SEQ ID NO: 735584 - DNA, 20 bp, Artificial
  CRISPR gRNA sequence
gtggggagaccatggctcag

SEQ ID NO: 735585 - DNA, 20 bp, Artificial
  CRISPR gRNA sequence
gggagaccatggctcagagg

SEQ ID NO: 735586 - DNA, 20 bp, Artificial
  CRISPR gRNA sequence
ggagaccatggctcagagga

SEQ ID NO: 735587 - DNA, 20 bp, Artificial
  CRISPR gRNA sequence
gagaccatggctcagaggaa

SEQ ID NO: 735588 - DNA, 20 bp, Artificial
  CRISPR gRNA sequence
accatggctcagaggaaggg

SEQ ID NO: 735589 - DNA, 20 bp, Artificial
  CRISPR gRNA sequence
catggctcagaggaagggtg

SEQ ID NO: 735590 - DNA, 20 bp, Artificial
  CRISPR gRNA sequence
gcaaccctcctcctacccct

SEQ ID NO: 735591 - DNA, 20 bp, Artificial
  CRISPR gRNA sequence
caaccctcctcctacccctc

SEQ ID NO: 735592 - DNA, 20 bp, Artificial
  CRISPR gRNA sequence
cctcctcctacccctcagga

SEQ ID NO: 735593 - DNA, 20 bp, Artificial
  CRISPR gRNA sequence
tcctcctacccctcaggata

SEQ ID NO: 735594 - DNA, 20 bp, Artificial
  CRISPR gRNA sequence
ctcctacccctcaggataga

SEQ ID NO: 735595 - DNA, 20 bp, Artificial
  CRISPR gRNA sequence
cctacccctcaggatagaga

SEQ ID NO: 735596 - DNA, 20 bp, Artificial
  CRISPR gRNA sequence
acccctcaggatagagagag

SEQ ID NO: 735597 - DNA, 20 bp, Artificial
  CRISPR gRNA sequence
atagagagagaagacacact

SEQ ID NO: 735598 - DNA, 20 bp, Artificial
  CRISPR gRNA sequence
tagagagagaagacacactt

SEQ ID NO: 735599 - DNA, 20 bp, Artificial
  CRISPR gRNA sequence
gagaagacacacttgggaca

SEQ ID NO: 735600 - DNA, 20 bp, Artificial
  CRISPR gRNA sequence
gacacacttgggacacagtg

SEQ ID NO: 735601 - DNA, 20 bp, Artificial
  CRISPR gRNA sequence
cacttgggacacagtgaaga

SEQ ID NO: 735602 - DNA, 20 bp, Artificial
  CRISPR gRNA sequence
acacagtgaagacagtaact

SEQ ID NO: 735603 - DNA, 20 bp, Artificial
  CRISPR gRNA sequence
cagtaacttggaactgacca

SEQ ID NO: 735604 - DNA, 20 bp, Artificial
  CRISPR gRNA sequence
acttggaactgaccacggcc

SEQ ID NO: 735605 - DNA, 20 bp, Artificial
  CRISPR gRNA sequence
ttggaactgaccacggcctg

SEQ ID NO: 735606 - DNA, 20 bp, Artificial
  CRISPR gRNA sequence
tggaactgaccacggcctgg

SEQ ID NO: 735607 - DNA, 20 bp, Artificial
  CRISPR gRNA sequence
ctgaccacggcctggaggac

SEQ ID NO: 735608 - DNA, 20 bp, Artificial
  CRISPR gRNA sequence
cacggcctggaggactggcc

SEQ ID NO: 735609 - DNA, 20 bp, Artificial
  CRISPR gRNA sequence
acggcctggaggactggccc

SEQ ID NO: 735610 - DNA, 20 bp, Artificial
  CRISPR gRNA sequence
gcctggaggactggcccagg

SEQ ID NO: 735611 - DNA, 20 bp, Artificial
  CRISPR gRNA sequence
cctggaggactggcccaggc

SEQ ID NO: 735612 - DNA, 20 bp, Artificial
  CRISPR gRNA sequence
ctggaggactggcccaggca

SEQ ID NO: 735613 - DNA, 20 bp, Artificial
  CRISPR gRNA sequence
tggaggactggcccaggcag

SEQ ID NO: 735614 - DNA, 20 bp, Artificial
  CRISPR gRNA sequence
ggaggactggcccaggcagg

SEQ ID NO: 735615 - DNA, 20 bp, Artificial
  CRISPR gRNA sequence
gactggcccaggcaggggga

SEQ ID NO: 735616 - DNA, 20 bp, Artificial
  CRISPR gRNA sequence
actggcccaggcagggggac

SEQ ID NO: 735617 - DNA, 20 bp, Artificial
  CRISPR gRNA sequence
ctggcccaggcagggggaca

SEQ ID NO: 735618 - DNA, 20 bp, Artificial
  CRISPR gRNA sequence
aggcagggggacagggaaaa

SEQ ID NO: 735619 - DNA, 20 bp, Artificial
  CRISPR gRNA sequence
gcagggggacagggaaaatg

SEQ ID NO: 735620 - DNA, 20 bp, Artificial
  CRISPR gRNA sequence
ggacagggaaaatggagccc

SEQ ID NO: 735621 - DNA, 20 bp, Artificial
  CRISPR gRNA sequence
cagggaaaatggagcccaag

SEQ ID NO: 735622 - DNA, 20 bp, Artificial
  CRISPR gRNA sequence
aatggagcccaagtagcctc

SEQ ID NO: 735623 - DNA, 20 bp, Artificial
  CRISPR gRNA sequence
gagcccaagtagcctctggc

SEQ ID NO: 735624 - DNA, 20 bp, Artificial
  CRISPR gRNA sequence
agcccaagtagcctctggcc

SEQ ID NO: 735625 - DNA, 20 bp, Artificial
  CRISPR gRNA sequence
gcccaagtagcctctggcca

SEQ ID NO: 735626 - DNA, 20 bp, Artificial
  CRISPR gRNA sequence
ggccagggacccaatgtccc

SEQ ID NO: 735627 - DNA, 20 bp, Artificial
  CRISPR gRNA sequence
gccagggacccaatgtcccg

SEQ ID NO: 735628 - DNA, 20 bp, Artificial
  CRISPR gRNA sequence
ctgcctcccacccactgact

SEQ ID NO: 735629 - DNA, 20 bp, Artificial
  CRISPR gRNA sequence
tgcctcccacccactgactc

SEQ ID NO: 735630 - DNA, 20 bp, Artificial
  CRISPR gRNA sequence
gcctcccacccactgactca

SEQ ID NO: 735631 - DNA, 20 bp, Artificial
  CRISPR gRNA sequence
ccacccactgactcagggct

SEQ ID NO: 735632 - DNA, 20 bp, Artificial
  CRISPR gRNA sequence
actgactcagggctcagact

SEQ ID NO: 735633 - DNA, 20 bp, Artificial
  CRISPR gRNA sequence
cagactcagcctctattgtc

SEQ ID NO: 735634 - DNA, 20 bp, Artificial
  CRISPR gRNA sequence
gactcagcctctattgtcca

SEQ ID NO: 735635 - DNA, 20 bp, Artificial
  CRISPR gRNA sequence
gcctctattgtccagagcac

SEQ ID NO: 735636 - DNA, 20 bp, Artificial
  CRISPR gRNA sequence
tattgtccagagcactggct

SEQ ID NO: 735637 - DNA, 20 bp, Artificial
  CRISPR gRNA sequence
cagagcactggcttggcgtc

SEQ ID NO: 735638 - DNA, 20 bp, Artificial
  CRISPR gRNA sequence
tggcttggcgtccagcaatg

SEQ ID NO: 735639 - DNA, 20 bp, Artificial
  CRISPR gRNA sequence
ggcttggcgtccagcaatga

SEQ ID NO: 735640 - DNA, 20 bp, Artificial
  CRISPR gRNA sequence
tggcgtccagcaatgaaggc

SEQ ID NO: 735641 - DNA, 20 bp, Artificial
  CRISPR gRNA sequence
gcgtccagcaatgaaggctg

SEQ ID NO: 735642 - DNA, 20 bp, Artificial
  CRISPR gRNA sequence
gcaatgaaggctggagaatg

SEQ ID NO: 735643 - DNA, 20 bp, Artificial
  CRISPR gRNA sequence
gaaggctggagaatgcagcc

SEQ ID NO: 735644 - DNA, 20 bp, Artificial
  CRISPR gRNA sequence
cacacacacacacacacaca

SEQ ID NO: 735645 - DNA, 20 bp, Artificial
  CRISPR gRNA sequence
acacacacacacacacacac

SEQ ID NO: 735646 - DNA, 20 bp, Artificial
  CRISPR gRNA sequence
cacacaggtgtctactgacc

SEQ ID NO: 735647 - DNA, 20 bp, Artificial
  CRISPR gRNA sequence
cacaggtgtctactgacctg

SEQ ID NO: 735648 - DNA, 20 bp, Artificial
  CRISPR gRNA sequence
gtctactgacctggagtgac

SEQ ID NO: 735649 - DNA, 20 bp, Artificial
  CRISPR gRNA sequence
ctgacctggagtgactggaa

SEQ ID NO: 735650 - DNA, 20 bp, Artificial
  CRISPR gRNA sequence
ggagtgactggaatagcacc

SEQ ID NO: 735651 - DNA, 20 bp, Artificial
  CRISPR gRNA sequence
gagtgactggaatagcacct

SEQ ID NO: 735652 - DNA, 20 bp, Artificial
  CRISPR gRNA sequence
agtgactggaatagcacctg

SEQ ID NO: 735653 - DNA, 20 bp, Artificial
  CRISPR gRNA sequence
gacaactgtgcattgaaccc

SEQ ID NO: 735654 - DNA, 20 bp, Artificial
  CRISPR gRNA sequence
acaactgtgcattgaaccct

SEQ ID NO: 735655 - DNA, 20 bp, Artificial
  CRISPR gRNA sequence
ctgtgcattgaaccctgggt

SEQ ID NO: 735656 - DNA, 20 bp, Artificial
  CRISPR gRNA sequence
tgtgcattgaaccctgggtc

SEQ ID NO: 735657 - DNA, 20 bp, Artificial
  CRISPR gRNA sequence
gtgcattgaaccctgggtca

SEQ ID NO: 735658 - DNA, 20 bp, Artificial
  CRISPR gRNA sequence
ctgggtcagggacgttccaa

SEQ ID NO: 735659 - DNA, 20 bp, Artificial
  CRISPR gRNA sequence
tcagggacgttccaatggcc

SEQ ID NO: 735660 - DNA, 20 bp, Artificial
  CRISPR gRNA sequence
agggacgttccaatggccaa

SEQ ID NO: 735661 - DNA, 20 bp, Artificial
  CRISPR gRNA sequence
ggacgttccaatggccaaga

SEQ ID NO: 735662 - DNA, 20 bp, Artificial
  CRISPR gRNA sequence
caatggccaagagagtgaca

SEQ ID NO: 735663 - DNA, 20 bp, Artificial
  CRISPR gRNA sequence
ggccaagagagtgacacagc

SEQ ID NO: 735664 - DNA, 20 bp, Artificial
  CRISPR gRNA sequence
gccaagagagtgacacagcc

SEQ ID NO: 735665 - DNA, 20 bp, Artificial
  CRISPR gRNA sequence
gagtgacacagccaggaccc

SEQ ID NO: 735666 - DNA, 20 bp, Artificial
  CRISPR gRNA sequence
tgacacagccaggaccctgg

SEQ ID NO: 735667 - DNA, 20 bp, Artificial
  CRISPR gRNA sequence
acagccaggaccctggtgga

SEQ ID NO: 735668 - DNA, 20 bp, Artificial
  CRISPR gRNA sequence
ccaggaccctggtggacagc

SEQ ID NO: 735669 - DNA, 20 bp, Artificial
  CRISPR gRNA sequence
aggaccctggtggacagcca

SEQ ID NO: 735670 - DNA, 20 bp, Artificial
  CRISPR gRNA sequence
ggaccctggtggacagccag

SEQ ID NO: 735671 - DNA, 20 bp, Artificial
  CRISPR gRNA sequence
gaccctggtggacagccaga

SEQ ID NO: 735672 - DNA, 20 bp, Artificial
  CRISPR gRNA sequence
accctggtggacagccagag

SEQ ID NO: 735673 - DNA, 20 bp, Artificial
  CRISPR gRNA sequence
gacagccagaggggccactt

SEQ ID NO: 735674 - DNA, 20 bp, Artificial
  CRISPR gRNA sequence
acagccagaggggccacttc

SEQ ID NO: 735675 - DNA, 20 bp, Artificial
  CRISPR gRNA sequence
ccagaggggccacttcagga

SEQ ID NO: 735676 - DNA, 20 bp, Artificial
  CRISPR gRNA sequence
gggccacttcaggatggatg

SEQ ID NO: 735677 - DNA, 20 bp, Artificial
  CRISPR gRNA sequence
ggccacttcaggatggatgt

SEQ ID NO: 735678 - DNA, 20 bp, Artificial
  CRISPR gRNA sequence
gccacttcaggatggatgtg

SEQ ID NO: 735679 - DNA, 20 bp, Artificial
  CRISPR gRNA sequence
cacttcaggatggatgtggg

SEQ ID NO: 735680 - DNA, 20 bp, Artificial
  CRISPR gRNA sequence
cttcaggatggatgtgggga

SEQ ID NO: 735681 - DNA, 20 bp, Artificial
  CRISPR gRNA sequence
caggatggatgtggggagag

SEQ ID NO: 735682 - DNA, 20 bp, Artificial
  CRISPR gRNA sequence
gatggatgtggggagagtgg

SEQ ID NO: 735683 - DNA, 20 bp, Artificial
  CRISPR gRNA sequence
tggatgtggggagagtggaa

SEQ ID NO: 735684 - DNA, 20 bp, Artificial
  CRISPR gRNA sequence
ggatgtggggagagtggaag

SEQ ID NO: 735685 - DNA, 20 bp, Artificial
  CRISPR gRNA sequence
tgtggggagagtggaagagg

SEQ ID NO: 735686 - DNA, 20 bp, Artificial
  CRISPR gRNA sequence
gtggggagagtggaagaggc

SEQ ID NO: 735687 - DNA, 20 bp, Artificial
  CRISPR gRNA sequence
tggggagagtggaagaggca

SEQ ID NO: 735688 - DNA, 20 bp, Artificial
  CRISPR gRNA sequence
gggagagtggaagaggcagg

SEQ ID NO: 735689 - DNA, 20 bp, Artificial
  CRISPR gRNA sequence
gaagaggcagggagtaatcc

SEQ ID NO: 735690 - DNA, 20 bp, Artificial
  CRISPR gRNA sequence
aagaggcagggagtaatcct

SEQ ID NO: 735691 - DNA, 20 bp, Artificial
  CRISPR gRNA sequence
agaggcagggagtaatcctg

SEQ ID NO: 735692 - DNA, 20 bp, Artificial
  CRISPR gRNA sequence
gaggcagggagtaatcctgg

SEQ ID NO: 735693 - DNA, 20 bp, Artificial
  CRISPR gRNA sequence
cagggagtaatcctggggga

SEQ ID NO: 735694 - DNA, 20 bp, Artificial
  CRISPR gRNA sequence
ggagtaatcctgggggacag

SEQ ID NO: 735695 - DNA, 20 bp, Artificial
  CRISPR gRNA sequence
gagtaatcctgggggacagc

SEQ ID NO: 735696 - DNA, 20 bp, Artificial
  CRISPR gRNA sequence
agtaatcctgggggacagca

SEQ ID NO: 735697 - DNA, 20 bp, Artificial
  CRISPR gRNA sequence
taatcctgggggacagcagg

SEQ ID NO: 735698 - DNA, 20 bp, Artificial
  CRISPR gRNA sequence
aatcctgggggacagcaggg

SEQ ID NO: 735699 - DNA, 20 bp, Artificial
  CRISPR gRNA sequence
tcctgggggacagcagggag

SEQ ID NO: 735700 - DNA, 20 bp, Artificial
  CRISPR gRNA sequence
cctgggggacagcagggagg

SEQ ID NO: 735701 - DNA, 20 bp, Artificial
  CRISPR gRNA sequence
aggcacttcttccctatgtc

SEQ ID NO: 735702 - DNA, 20 bp, Artificial
  CRISPR gRNA sequence
ggcacttcttccctatgtcc

SEQ ID NO: 735703 - DNA, 20 bp, Artificial
  CRISPR gRNA sequence
cacttcttccctatgtccag

SEQ ID NO: 735704 - DNA, 20 bp, Artificial
  CRISPR gRNA sequence
cttcttccctatgtccagga

SEQ ID NO: 735705 - DNA, 20 bp, Artificial
  CRISPR gRNA sequence
ttcttccctatgtccaggag

SEQ ID NO: 735706 - DNA, 20 bp, Artificial
  CRISPR gRNA sequence
tcttccctatgtccaggaga

SEQ ID NO: 735707 - DNA, 20 bp, Artificial
  CRISPR gRNA sequence
ctatgtccaggagagggcaa

SEQ ID NO: 735708 - DNA, 20 bp, Artificial
  CRISPR gRNA sequence
atgtccaggagagggcaata

SEQ ID NO: 735709 - DNA, 20 bp, Artificial
  CRISPR gRNA sequence
tgtccaggagagggcaatag

SEQ ID NO: 735710 - DNA, 20 bp, Artificial
  CRISPR gRNA sequence
gtccaggagagggcaataga

SEQ ID NO: 735711 - DNA, 20 bp, Artificial
  CRISPR gRNA sequence
caggagagggcaatagaggg

SEQ ID NO: 735712 - DNA, 20 bp, Artificial
  CRISPR gRNA sequence
agggcaatagagggaagact

SEQ ID NO: 735713 - DNA, 20 bp, Artificial
  CRISPR gRNA sequence
gggcaatagagggaagactg

SEQ ID NO: 735714 - DNA, 20 bp, Artificial
  CRISPR gRNA sequence
tagagggaagactgaggctg

SEQ ID NO: 735715 - DNA, 20 bp, Artificial
  CRISPR gRNA sequence
gactgaggctgaagaattga

SEQ ID NO: 735716 - DNA, 20 bp, Artificial
  CRISPR gRNA sequence
ggctgaagaattgacggctc

SEQ ID NO: 735717 - DNA, 20 bp, Artificial
  CRISPR gRNA sequence
agaattgacggctctggacc

SEQ ID NO: 735718 - DNA, 20 bp, Artificial
  CRISPR gRNA sequence
gaattgacggctctggaccc

SEQ ID NO: 735719 - DNA, 20 bp, Artificial
  CRISPR gRNA sequence
tgacggctctggacccagga

SEQ ID NO: 735720 - DNA, 20 bp, Artificial
  CRISPR gRNA sequence
ggctctggacccaggacaga

SEQ ID NO: 735721 - DNA, 20 bp, Artificial
  CRISPR gRNA sequence
ctggacccaggacagacaga

SEQ ID NO: 735722 - DNA, 20 bp, Artificial
  CRISPR gRNA sequence
acccaggacagacagacaga

SEQ ID NO: 735723 - DNA, 20 bp, Artificial
  CRISPR gRNA sequence
aggacagacagacagacaga

SEQ ID NO: 735724 - DNA, 20 bp, Artificial
  CRISPR gRNA sequence
cagacagacagacagacaga

SEQ ID NO: 735725 - DNA, 20 bp, Artificial
  CRISPR gRNA sequence
cagacagacagacagacaga

SEQ ID NO: 735726 - DNA, 20 bp, Artificial
  CRISPR gRNA sequence
cagacagacagacagacaga

SEQ ID NO: 735727 - DNA, 20 bp, Artificial
  CRISPR gRNA sequence
cagacagacagacagacaga

SEQ ID NO: 735728 - DNA, 20 bp, Artificial
  CRISPR gRNA sequence
cacacacacccatctctgtc

SEQ ID NO: 735729 - DNA, 20 bp, Artificial
  CRISPR gRNA sequence
cacacccatctctgtctagc

SEQ ID NO: 735730 - DNA, 20 bp, Artificial
  CRISPR gRNA sequence
acccatctctgtctagcaag

SEQ ID NO: 735731 - DNA, 20 bp, Artificial
  CRISPR gRNA sequence
tgtctagcaagcagcctcct

SEQ ID NO: 735732 - DNA, 20 bp, Artificial
  CRISPR gRNA sequence
tagcaagcagcctcctaaga

SEQ ID NO: 735733 - DNA, 20 bp, Artificial
  CRISPR gRNA sequence
agctgttctccctatcatga

SEQ ID NO: 735734 - DNA, 20 bp, Artificial
  CRISPR gRNA sequence
ttctccctatcatgacggtg

SEQ ID NO: 735735 - DNA, 20 bp, Artificial
  CRISPR gRNA sequence
gccaccatcctgttgtatac

SEQ ID NO: 735736 - DNA, 20 bp, Artificial
  CRISPR gRNA sequence
ccaccatcctgttgtatact

SEQ ID NO: 735737 - DNA, 20 bp, Artificial
  CRISPR gRNA sequence
accatcctgttgtatactag

SEQ ID NO: 735738 - DNA, 20 bp, Artificial
  CRISPR gRNA sequence
catcctgttgtatactagga

SEQ ID NO: 735739 - DNA, 20 bp, Artificial
  CRISPR gRNA sequence
aggagagaacttaacccacc

SEQ ID NO: 735740 - DNA, 20 bp, Artificial
  CRISPR gRNA sequence
ggagagaacttaacccacct

SEQ ID NO: 735741 - DNA, 20 bp, Artificial
  CRISPR gRNA sequence
gagagaacttaacccacctg

SEQ ID NO: 735742 - DNA, 20 bp, Artificial
  CRISPR gRNA sequence
agagaacttaacccacctgg

SEQ ID NO: 735743 - DNA, 20 bp, Artificial
  CRISPR gRNA sequence
ttaacccacctgggggaaaa

SEQ ID NO: 735744 - DNA, 20 bp, Artificial
  CRISPR gRNA sequence
ctgggggaaaatagctcccc

SEQ ID NO: 735745 - DNA, 20 bp, Artificial
  CRISPR gRNA sequence
gggggaaaatagctccccaa

SEQ ID NO: 735746 - DNA, 20 bp, Artificial
  CRISPR gRNA sequence
gaaaatagctccccaagagc

SEQ ID NO: 735747 - DNA, 20 bp, Artificial
  CRISPR gRNA sequence
agctccccaagagctggcac

SEQ ID NO: 735748 - DNA, 20 bp, Artificial
  CRISPR gRNA sequence
gctggcaccagtaccactga

SEQ ID NO: 735749 - DNA, 20 bp, Artificial
  CRISPR gRNA sequence
ctgatggccctgcttcctct

SEQ ID NO: 735750 - DNA, 20 bp, Artificial
  CRISPR gRNA sequence
tggccctgcttcctctgagt

SEQ ID NO: 735751 - DNA, 20 bp, Artificial
  CRISPR gRNA sequence
cttcctctgagtgagatgcc

SEQ ID NO: 735752 - DNA, 20 bp, Artificial
  CRISPR gRNA sequence
ttcctctgagtgagatgccc

SEQ ID NO: 735753 - DNA, 20 bp, Artificial
  CRISPR gRNA sequence
cctctgagtgagatgcccag

SEQ ID NO: 735754 - DNA, 20 bp, Artificial
  CRISPR gRNA sequence
ctctgagtgagatgcccagg

SEQ ID NO: 735755 - DNA, 20 bp, Artificial
  CRISPR gRNA sequence
ctgagtgagatgcccaggag

SEQ ID NO: 735756 - DNA, 20 bp, Artificial
  CRISPR gRNA sequence
tgagtgagatgcccaggagg

SEQ ID NO: 735757 - DNA, 20 bp, Artificial
  CRISPR gRNA sequence
agtgagatgcccaggaggag

SEQ ID NO: 735758 - DNA, 20 bp, Artificial
  CRISPR gRNA sequence
atgcccaggaggaggagccc

SEQ ID NO: 735759 - DNA, 20 bp, Artificial
  CRISPR gRNA sequence
tgcccaggaggaggagccct

SEQ ID NO: 735760 - DNA, 20 bp, Artificial
  CRISPR gRNA sequence
gcccaggaggaggagcccta

SEQ ID NO: 735761 - DNA, 20 bp, Artificial
  CRISPR gRNA sequence
caggaggaggagccctaggg

SEQ ID NO: 735762 - DNA, 20 bp, Artificial
  CRISPR gRNA sequence
gaggaggagccctagggaag

SEQ ID NO: 735763 - DNA, 20 bp, Artificial
  CRISPR gRNA sequence
aggagccctagggaagaagt

SEQ ID NO: 735764 - DNA, 20 bp, Artificial
  CRISPR gRNA sequence
ggagccctagggaagaagtc

SEQ ID NO: 735765 - DNA, 20 bp, Artificial
  CRISPR gRNA sequence
gagccctagggaagaagtca

SEQ ID NO: 735766 - DNA, 20 bp, Artificial
  CRISPR gRNA sequence
cctagggaagaagtcaggga

SEQ ID NO: 735767 - DNA, 20 bp, Artificial
  CRISPR gRNA sequence
ctagggaagaagtcagggac

SEQ ID NO: 735768 - DNA, 20 bp, Artificial
  CRISPR gRNA sequence
tagggaagaagtcagggaca

SEQ ID NO: 735769 - DNA, 20 bp, Artificial
  CRISPR gRNA sequence
aagaagtcagggacagggac

SEQ ID NO: 735770 - DNA, 20 bp, Artificial
  CRISPR gRNA sequence
agaagtcagggacagggacc

SEQ ID NO: 735771 - DNA, 20 bp, Artificial
  CRISPR gRNA sequence
ctctgtcactgtgtgaccct

SEQ ID NO: 735772 - DNA, 20 bp, Artificial
  CRISPR gRNA sequence
gtcactgtgtgaccctcagc

SEQ ID NO: 735773 - DNA, 20 bp, Artificial
  CRISPR gRNA sequence
ctcagcaagtcactaaccct

SEQ ID NO: 735774 - DNA, 20 bp, Artificial
  CRISPR gRNA sequence
tcatttttcctgtcttgtga

SEQ ID NO: 735775 - DNA, 20 bp, Artificial
  CRISPR gRNA sequence
atttttcctgtcttgtgaaa

SEQ ID NO: 735776 - DNA, 20 bp, Artificial
  CRISPR gRNA sequence
tttttcctgtcttgtgaaag

SEQ ID NO: 735777 - DNA, 20 bp, Artificial
  CRISPR gRNA sequence
gacaataattcctacttctc

SEQ ID NO: 735778 - DNA, 20 bp, Artificial
  CRISPR gRNA sequence
tacttctcaagattgttttc

SEQ ID NO: 735779 - DNA, 20 bp, Artificial
  CRISPR gRNA sequence
ttttcaagataaaataacat

SEQ ID NO: 735780 - DNA, 20 bp, Artificial
  CRISPR gRNA sequence
cctcattaccattattcctt

SEQ ID NO: 735781 - DNA, 20 bp, Artificial
  CRISPR gRNA sequence
ttattccttaagttgttttc

SEQ ID NO: 735782 - DNA, 20 bp, Artificial
  CRISPR gRNA sequence
ttgtttccaacattacattt

SEQ ID NO: 735783 - DNA, 20 bp, Artificial
  CRISPR gRNA sequence
caacattacatttaagacct

SEQ ID NO: 735784 - DNA, 20 bp, Artificial
  CRISPR gRNA sequence
aacattacatttaagacctt

SEQ ID NO: 735785 - DNA, 20 bp, Artificial
  CRISPR gRNA sequence
cttttgtcatatctcttccc

SEQ ID NO: 735786 - DNA, 20 bp, Artificial
  CRISPR gRNA sequence
tcccaagtgtcatcactata

SEQ ID NO: 735787 - DNA, 20 bp, Artificial
  CRISPR gRNA sequence
gtcatcactatatggatgtt

SEQ ID NO: 735788 - DNA, 20 bp, Artificial
  CRISPR gRNA sequence
tcatcactatatggatgttg

SEQ ID NO: 735789 - DNA, 20 bp, Artificial
  CRISPR gRNA sequence
catcactatatggatgttga

SEQ ID NO: 735790 - DNA, 20 bp, Artificial
  CRISPR gRNA sequence
atgttgagggcccccgatga

SEQ ID NO: 735791 - DNA, 20 bp, Artificial
  CRISPR gRNA sequence
gcccccgatgacagtccctt

SEQ ID NO: 735792 - DNA, 20 bp, Artificial
  CRISPR gRNA sequence
ccgatgacagtccctttggt

SEQ ID NO: 735793 - DNA, 20 bp, Artificial
  CRISPR gRNA sequence
cgatgacagtccctttggta

SEQ ID NO: 735794 - DNA, 20 bp, Artificial
  CRISPR gRNA sequence
ctttggtaaggtcctctttt

SEQ ID NO: 735795 - DNA, 20 bp, Artificial
  CRISPR gRNA sequence
tttggtaaggtcctcttttg

SEQ ID NO: 735796 - DNA, 20 bp, Artificial
  CRISPR gRNA sequence
tggtaaggtcctcttttgag

SEQ ID NO: 735797 - DNA, 20 bp, Artificial
  CRISPR gRNA sequence
ggtaaggtcctcttttgagg

SEQ ID NO: 735798 - DNA, 20 bp, Artificial
  CRISPR gRNA sequence
gtaaggtcctcttttgagga

SEQ ID NO: 735799 - DNA, 20 bp, Artificial
  CRISPR gRNA sequence
taaggtcctcttttgaggag

SEQ ID NO: 735800 - DNA, 20 bp, Artificial
  CRISPR gRNA sequence
aggtcctcttttgaggaggg

SEQ ID NO: 735801 - DNA, 20 bp, Artificial
  CRISPR gRNA sequence
ggtcctcttttgaggagggg

SEQ ID NO: 735802 - DNA, 20 bp, Artificial
  CRISPR gRNA sequence
gtcctcttttgaggagggga

SEQ ID NO: 735803 - DNA, 20 bp, Artificial
  CRISPR gRNA sequence
cttttgaggaggggagggta

SEQ ID NO: 735804 - DNA, 20 bp, Artificial
  CRISPR gRNA sequence
ttttgaggaggggagggtac

SEQ ID NO: 735805 - DNA, 20 bp, Artificial
  CRISPR gRNA sequence
tttgaggaggggagggtaca

SEQ ID NO: 735806 - DNA, 20 bp, Artificial
  CRISPR gRNA sequence
gaggaggggagggtacaggg

SEQ ID NO: 735807 - DNA, 20 bp, Artificial
  CRISPR gRNA sequence
ggtacagggtggactcatct

SEQ ID NO: 735808 - DNA, 20 bp, Artificial
  CRISPR gRNA sequence
gactcatctcagtgtgaact

SEQ ID NO: 735809 - DNA, 20 bp, Artificial
  CRISPR gRNA sequence
catctcagtgtgaacttggc

SEQ ID NO: 735810 - DNA, 20 bp, Artificial
  CRISPR gRNA sequence
tctgatcttgtttcctcatc

SEQ ID NO: 735811 - DNA, 20 bp, Artificial
  CRISPR gRNA sequence
tgatcttgtttcctcatctg

SEQ ID NO: 735812 - DNA, 20 bp, Artificial
  CRISPR gRNA sequence
tcttgtttcctcatctggag

SEQ ID NO: 735813 - DNA, 20 bp, Artificial
  CRISPR gRNA sequence
cttgtttcctcatctggaga

SEQ ID NO: 735814 - DNA, 20 bp, Artificial
  CRISPR gRNA sequence
tgtttcctcatctggagaag

SEQ ID NO: 735815 - DNA, 20 bp, Artificial
  CRISPR gRNA sequence
tcctcatctggagaaggagt

SEQ ID NO: 735816 - DNA, 20 bp, Artificial
  CRISPR gRNA sequence
ctcatctggagaaggagtga

SEQ ID NO: 735817 - DNA, 20 bp, Artificial
  CRISPR gRNA sequence
catctggagaaggagtgaga

SEQ ID NO: 735818 - DNA, 20 bp, Artificial
  CRISPR gRNA sequence
atctggagaaggagtgagag

SEQ ID NO: 735819 - DNA, 20 bp, Artificial
  CRISPR gRNA sequence
ctggagaaggagtgagagag

SEQ ID NO: 735820 - DNA, 20 bp, Artificial
  CRISPR gRNA sequence
agaaggagtgagagaggaga

SEQ ID NO: 735821 - DNA, 20 bp, Artificial
  CRISPR gRNA sequence
gaaggagtgagagaggagaa

SEQ ID NO: 735822 - DNA, 20 bp, Artificial
  CRISPR gRNA sequence
ggagtgagagaggagaaagg

SEQ ID NO: 735823 - DNA, 20 bp, Artificial
  CRISPR gRNA sequence
gagaggagaaaggaagaaac

SEQ ID NO: 735824 - DNA, 20 bp, Artificial
  CRISPR gRNA sequence
ggagaaaggaagaaaccagt

SEQ ID NO: 735825 - DNA, 20 bp, Artificial
  CRISPR gRNA sequence
gagaaaggaagaaaccagtc

SEQ ID NO: 735826 - DNA, 20 bp, Artificial
  CRISPR gRNA sequence
aaaggaagaaaccagtcagg

SEQ ID NO: 735827 - DNA, 20 bp, Artificial
  CRISPR gRNA sequence
aaggaagaaaccagtcaggc

SEQ ID NO: 735828 - DNA, 20 bp, Artificial
  CRISPR gRNA sequence
gaagaaaccagtcaggcagg

SEQ ID NO: 735829 - DNA, 20 bp, Artificial
  CRISPR gRNA sequence
aaaccagtcaggcaggcagt

SEQ ID NO: 735830 - DNA, 20 bp, Artificial
  CRISPR gRNA sequence
aaccagtcaggcaggcagtt

SEQ ID NO: 735831 - DNA, 20 bp, Artificial
  CRISPR gRNA sequence
accagtcaggcaggcagtta

SEQ ID NO: 735832 - DNA, 20 bp, Artificial
  CRISPR gRNA sequence
agtcaggcaggcagttaggg

SEQ ID NO: 735833 - DNA, 20 bp, Artificial
  CRISPR gRNA sequence
gtcaggcaggcagttagggt

SEQ ID NO: 735834 - DNA, 20 bp, Artificial
  CRISPR gRNA sequence
aggcagttagggtgggttct

SEQ ID NO: 735835 - DNA, 20 bp, Artificial
  CRISPR gRNA sequence
cagttagggtgggttctcgg

SEQ ID NO: 735836 - DNA, 20 bp, Artificial
  CRISPR gRNA sequence
ggtagaattcttttaaacaa

SEQ ID NO: 735837 - DNA, 20 bp, Artificial
  CRISPR gRNA sequence
aattcttttaaacaaaagaa

SEQ ID NO: 735838 - DNA, 20 bp, Artificial
  CRISPR gRNA sequence
aaagaacagcctgaaaaatc

SEQ ID NO: 735839 - DNA, 20 bp, Artificial
  CRISPR gRNA sequence
cagcctgaaaaatcaagctg

SEQ ID NO: 735840 - DNA, 20 bp, Artificial
  CRISPR gRNA sequence
agcctgaaaaatcaagctgc

SEQ ID NO: 735841 - DNA, 20 bp, Artificial
  CRISPR gRNA sequence
gaaaaatcaagctgcaggca

SEQ ID NO: 735842 - DNA, 20 bp, Artificial
  CRISPR gRNA sequence
tcaagctgcaggcacagata

SEQ ID NO: 735843 - DNA, 20 bp, Artificial
  CRISPR gRNA sequence
caagctgcaggcacagatat

SEQ ID NO: 735844 - DNA, 20 bp, Artificial
  CRISPR gRNA sequence
cacagatatgggaacttgca

SEQ ID NO: 735845 - DNA, 20 bp, Artificial
  CRISPR gRNA sequence
acagatatgggaacttgcac

SEQ ID NO: 735846 - DNA, 20 bp, Artificial
  CRISPR gRNA sequence
cagatatgggaacttgcaca

SEQ ID NO: 735847 - DNA, 20 bp, Artificial
  CRISPR gRNA sequence
agatatgggaacttgcacag

SEQ ID NO: 735848 - DNA, 20 bp, Artificial
  CRISPR gRNA sequence
gatatgggaacttgcacagg

SEQ ID NO: 735849 - DNA, 20 bp, Artificial
  CRISPR gRNA sequence
atatgggaacttgcacaggg

SEQ ID NO: 735850 - DNA, 20 bp, Artificial
  CRISPR gRNA sequence
ttgcacaggggggcttgcct

SEQ ID NO: 735851 - DNA, 20 bp, Artificial
  CRISPR gRNA sequence
gcttgcctaagacatgccca

SEQ ID NO: 735852 - DNA, 20 bp, Artificial
  CRISPR gRNA sequence
aagacatgcccacagcctca

SEQ ID NO: 735853 - DNA, 20 bp, Artificial
  CRISPR gRNA sequence
atgcccacagcctcatagat

SEQ ID NO: 735854 - DNA, 20 bp, Artificial
  CRISPR gRNA sequence
ccacagcctcatagataaga

SEQ ID NO: 735855 - DNA, 20 bp, Artificial
  CRISPR gRNA sequence
catagataagacagactaca

SEQ ID NO: 735856 - DNA, 20 bp, Artificial
  CRISPR gRNA sequence
atagataagacagactacac

SEQ ID NO: 735857 - DNA, 20 bp, Artificial
  CRISPR gRNA sequence
ttgcccaaacatgcctgcaa

SEQ ID NO: 735858 - DNA, 20 bp, Artificial
  CRISPR gRNA sequence
atttcatcccctgacatgtg

SEQ ID NO: 735859 - DNA, 20 bp, Artificial
  CRISPR gRNA sequence
catcccctgacatgtgcagt

SEQ ID NO: 735860 - DNA, 20 bp, Artificial
  CRISPR gRNA sequence
atcccctgacatgtgcagta

SEQ ID NO: 735861 - DNA, 20 bp, Artificial
  CRISPR gRNA sequence
tcccctgacatgtgcagtaa

SEQ ID NO: 735862 - DNA, 20 bp, Artificial
  CRISPR gRNA sequence
cccctgacatgtgcagtaag

SEQ ID NO: 735863 - DNA, 20 bp, Artificial
  CRISPR gRNA sequence
catgtgcagtaaggggaaca

SEQ ID NO: 735864 - DNA, 20 bp, Artificial
  CRISPR gRNA sequence
gtaaggggaacaaagcaata

SEQ ID NO: 735865 - DNA, 20 bp, Artificial
  CRISPR gRNA sequence
aaggggaacaaagcaatatg

SEQ ID NO: 735866 - DNA, 20 bp, Artificial
  CRISPR gRNA sequence
ggaacaaagcaatatggagt

SEQ ID NO: 735867 - DNA, 20 bp, Artificial
  CRISPR gRNA sequence
caatatggagtaagtaactc

SEQ ID NO: 735868 - DNA, 20 bp, Artificial
  CRISPR gRNA sequence
tggagtaagtaactcaagcc

SEQ ID NO: 735869 - DNA, 20 bp, Artificial
  CRISPR gRNA sequence
ggagtaagtaactcaagcca

SEQ ID NO: 735870 - DNA, 20 bp, Artificial
  CRISPR gRNA sequence
gagtaagtaactcaagccaa

SEQ ID NO: 735871 - DNA, 20 bp, Artificial
  CRISPR gRNA sequence
ccaagggcccacatgtacat

SEQ ID NO: 735872 - DNA, 20 bp, Artificial
  CRISPR gRNA sequence
agggcccacatgtacattag

SEQ ID NO: 735873 - DNA, 20 bp, Artificial
  CRISPR gRNA sequence
gggcccacatgtacattaga

SEQ ID NO: 735874 - DNA, 20 bp, Artificial
  CRISPR gRNA sequence
ccacatgtacattagaagga

SEQ ID NO: 735875 - DNA, 20 bp, Artificial
  CRISPR gRNA sequence
catgtacattagaaggacag

SEQ ID NO: 735876 - DNA, 20 bp, Artificial
  CRISPR gRNA sequence
atgtacattagaaggacagc

SEQ ID NO: 735877 - DNA, 20 bp, Artificial
  CRISPR gRNA sequence
tgtacattagaaggacagca

SEQ ID NO: 735878 - DNA, 20 bp, Artificial
  CRISPR gRNA sequence
tacattagaaggacagcagg

SEQ ID NO: 735879 - DNA, 20 bp, Artificial
  CRISPR gRNA sequence
gaaggacagcagggagctac

SEQ ID NO: 735880 - DNA, 20 bp, Artificial
  CRISPR gRNA sequence
ccagaaattcatgccttatg

SEQ ID NO: 735881 - DNA, 20 bp, Artificial
  CRISPR gRNA sequence
aattcatgccttatgcagat

SEQ ID NO: 735882 - DNA, 20 bp, Artificial
  CRISPR gRNA sequence
ccttatgcagatgagctgcc

SEQ ID NO: 735883 - DNA, 20 bp, Artificial
  CRISPR gRNA sequence
atgagctgcccagtcctcat

SEQ ID NO: 735884 - DNA, 20 bp, Artificial
  CRISPR gRNA sequence
tcctcatcggtttcttataa

SEQ ID NO: 735885 - DNA, 20 bp, Artificial
  CRISPR gRNA sequence
tttacattcaactgtaaaaa

SEQ ID NO: 735886 - DNA, 20 bp, Artificial
  CRISPR gRNA sequence
taaaaatggcaaccctcttt

SEQ ID NO: 735887 - DNA, 20 bp, Artificial
  CRISPR gRNA sequence
aaaaatggcaaccctctttc

SEQ ID NO: 735888 - DNA, 20 bp, Artificial
  CRISPR gRNA sequence
tctttcaggcctcctctcca

SEQ ID NO: 735889 - DNA, 20 bp, Artificial
  CRISPR gRNA sequence
ttcaggcctcctctccacag

SEQ ID NO: 735890 - DNA, 20 bp, Artificial
  CRISPR gRNA sequence
caggcctcctctccacagca

SEQ ID NO: 735891 - DNA, 20 bp, Artificial
  CRISPR gRNA sequence
ggcctcctctccacagcaga

SEQ ID NO: 735892 - DNA, 20 bp, Artificial
  CRISPR gRNA sequence
tttcactccaacctcatcct

SEQ ID NO: 735893 - DNA, 20 bp, Artificial
  CRISPR gRNA sequence
tccttaattttcattgttgt

SEQ ID NO: 735894 - DNA, 20 bp, Artificial
  CRISPR gRNA sequence
attttcattgttgtgagaca

SEQ ID NO: 735895 - DNA, 20 bp, Artificial
  CRISPR gRNA sequence
tgttgtgagacaaagaactc

SEQ ID NO: 735896 - DNA, 20 bp, Artificial
  CRISPR gRNA sequence
ccagtgatacctcaaacaat

SEQ ID NO: 735897 - DNA, 20 bp, Artificial
  CRISPR gRNA sequence
agtgatacctcaaacaatga

SEQ ID NO: 735898 - DNA, 20 bp, Artificial
  CRISPR gRNA sequence
aatgagagactgctacattg

SEQ ID NO: 735899 - DNA, 20 bp, Artificial
  CRISPR gRNA sequence
actgctacattgtggtgcac

SEQ ID NO: 735900 - DNA, 20 bp, Artificial
  CRISPR gRNA sequence
ctcattgtttgaggtatcac

SEQ ID NO: 735901 - DNA, 20 bp, Artificial
  CRISPR gRNA sequence
aattaaggagcgtggacacc

SEQ ID NO: 735902 - DNA, 20 bp, Artificial
  CRISPR gRNA sequence
gtggacaccaaggatgaggt

SEQ ID NO: 735903 - DNA, 20 bp, Artificial
  CRISPR gRNA sequence
gaggttggagtgaaagttta

SEQ ID NO: 735904 - DNA, 20 bp, Artificial
  CRISPR gRNA sequence
tgtggagaggaggcctgaaa

SEQ ID NO: 735905 - DNA, 20 bp, Artificial
  CRISPR gRNA sequence
gagggttgccatttttacag

SEQ ID NO: 735906 - DNA, 20 bp, Artificial
  CRISPR gRNA sequence
gcagctcatctgcataaggc

SEQ ID NO: 735907 - DNA, 20 bp, Artificial
  CRISPR gRNA sequence
tgtacatgtgggcccttggc

SEQ ID NO: 735908 - DNA, 20 bp, Artificial
  CRISPR gRNA sequence
tccccttactgcacatgtca

SEQ ID NO: 735909 - DNA, 20 bp, Artificial
  CRISPR gRNA sequence
caggctgttcttttgtttaa

SEQ ID NO: 735910 - DNA, 20 bp, Artificial
  CRISPR gRNA sequence
cttgccaagttcacactgag

SEQ ID NO: 735911 - DNA, 20 bp, Artificial
  CRISPR gRNA sequence
gatatgacaaaagcaagaaa

SEQ ID NO: 735912 - DNA, 20 bp, Artificial
  CRISPR gRNA sequence
tagagctggaaaacaactta

SEQ ID NO: 735913 - DNA, 20 bp, Artificial
  CRISPR gRNA sequence
tgaaaacaatcttgagaagt

SEQ ID NO: 735914 - DNA, 20 bp, Artificial
  CRISPR gRNA sequence
aagacaggaaaaatgaggcc

SEQ ID NO: 735915 - DNA, 20 bp, Artificial
  CRISPR gRNA sequence
ccaagggttagtgacttgct

SEQ ID NO: 735916 - DNA, 20 bp, Artificial
  CRISPR gRNA sequence
tgctgagggtcacacagtga

SEQ ID NO: 735917 - DNA, 20 bp, Artificial
  CRISPR gRNA sequence
ggggagctattttcccccag

SEQ ID NO: 735918 - DNA, 20 bp, Artificial
  CRISPR gRNA sequence
agttctctcctagtatacaa

SEQ ID NO: 735919 - DNA, 20 bp, Artificial
  CRISPR gRNA sequence
aggctgcttgctagacagag

SEQ ID NO: 735920 - DNA, 20 bp, Artificial
  CRISPR gRNA sequence
tgtctgtctgtctgtctgtc

SEQ ID NO: 735921 - DNA, 20 bp, Artificial
  CRISPR gRNA sequence
gcctcctccctgctgtcccc

SEQ ID NO: 735922 - DNA, 20 bp, Artificial
  CRISPR gRNA sequence
tggcccctctggctgtccac

SEQ ID NO: 735923 - DNA, 20 bp, Artificial
  CRISPR gRNA sequence
ccattggaacgtccctgacc

SEQ ID NO: 735924 - DNA, 20 bp, Artificial
  CRISPR gRNA sequence
gtgtgtgtgtgtgtgtgtag

SEQ ID NO: 735925 - DNA, 20 bp, Artificial
  CRISPR gRNA sequence
agtgctctggacaatagagg

SEQ ID NO: 735926 - DNA, 20 bp, Artificial
  CRISPR gRNA sequence
atagaggctgagtctgagcc

SEQ ID NO: 735927 - DNA, 20 bp, Artificial
  CRISPR gRNA sequence
tgagtctgagccctgagtca

SEQ ID NO: 735928 - DNA, 20 bp, Artificial
  CRISPR gRNA sequence
gaggcagattcctcgggaca

SEQ ID NO: 735929 - DNA, 20 bp, Artificial
  CRISPR gRNA sequence
tgtcttctctctctatcctg

SEQ ID NO: 735930 - DNA, 20 bp, Artificial
  CRISPR gRNA sequence
tctatcctgaggggtaggag

SEQ ID NO: 735931 - DNA, 20 bp, Artificial
  CRISPR gRNA sequence
ggtctccccaccagtgtctg

SEQ ID NO: 735932 - DNA, 20 bp, Artificial
  CRISPR gRNA sequence
agccaaggtctcagccaccc

SEQ ID NO: 735933 - DNA, 20 bp, Artificial
  CRISPR gRNA sequence
tatggacttcctggaggctg

SEQ ID NO: 735934 - DNA, 20 bp, Artificial
  CRISPR gRNA sequence
gagaagctgccaacccctct

SEQ ID NO: 735935 - DNA, 20 bp, Artificial
  CRISPR gRNA sequence
agtcactgtttcctctcctc

SEQ ID NO: 735936 - DNA, 20 bp, Artificial
  CRISPR gRNA sequence
gggagggcagctcagcccaa

SEQ ID NO: 735937 - DNA, 20 bp, Artificial
  CRISPR gRNA sequence
ttctctgtaaacagcactct

SEQ ID NO: 735938 - DNA, 20 bp, Artificial
  CRISPR gRNA sequence
cctgcctccaccaagagccc

SEQ ID NO: 735939 - DNA, 20 bp, Artificial
  CRISPR gRNA sequence
cactgggctgtggggctgct

SEQ ID NO: 735940 - DNA, 20 bp, Artificial
  CRISPR gRNA sequence
gctgcttaggatggcagcct

SEQ ID NO: 735941 - DNA, 20 bp, Artificial
  CRISPR gRNA sequence
gcctctgggtttgggaagtc

SEQ ID NO: 735942 - DNA, 20 bp, Artificial
  CRISPR gRNA sequence
ctgggtttgggaagtcctgg

SEQ ID NO: 735943 - DNA, 20 bp, Artificial
  CRISPR gRNA sequence
atagggctctggtcttccag

SEQ ID NO: 735944 - DNA, 20 bp, Artificial
  CRISPR gRNA sequence
tccaggtgggtcacgtgtag

SEQ ID NO: 735945 - DNA, 20 bp, Artificial
  CRISPR gRNA sequence
ttccttccaggtcatcccct

SEQ ID NO: 735946 - DNA, 20 bp, Artificial
  CRISPR gRNA sequence
gtcatccccttagggttgtg

SEQ ID NO: 735947 - DNA, 20 bp, Artificial
  CRISPR gRNA sequence
atgatcagcatcagcaccag

SEQ ID NO: 735948 - DNA, 20 bp, Artificial
  CRISPR gRNA sequence
cagcaccaccccaagcacag

SEQ ID NO: 735949 - DNA, 20 bp, Artificial
  CRISPR gRNA sequence
tggtgcctgagaagaaggga

SEQ ID NO: 735950 - DNA, 20 bp, Artificial
  CRISPR gRNA sequence
gaagaagggacagggtggaa

SEQ ID NO: 735951 - DNA, 20 bp, Artificial
  CRISPR gRNA sequence
tcccccatcctaacccacgt

SEQ ID NO: 735952 - DNA, 20 bp, Artificial
  CRISPR gRNA sequence
ccctgagagcgtgcccttcc

SEQ ID NO: 735953 - DNA, 20 bp, Artificial
  CRISPR gRNA sequence
acagaagcaagtgtgacatc

SEQ ID NO: 735954 - DNA, 20 bp, Artificial
  CRISPR gRNA sequence
ccccaaatctgttcatcagt

SEQ ID NO: 735955 - DNA, 20 bp, Artificial
  CRISPR gRNA sequence
atctgttcatcagtgaggat

SEQ ID NO: 735956 - DNA, 20 bp, Artificial
  CRISPR gRNA sequence
caagatgcttgctctcctca

SEQ ID NO: 735957 - DNA, 20 bp, Artificial
  CRISPR gRNA sequence
ttgctctcctcaaggggtct

SEQ ID NO: 735958 - DNA, 20 bp, Artificial
  CRISPR gRNA sequence
tcatcagcacctccttttct

SEQ ID NO: 735959 - DNA, 20 bp, Artificial
  CRISPR gRNA sequence
gccctctactgataaccaat

SEQ ID NO: 735960 - DNA, 20 bp, Artificial
  CRISPR gRNA sequence
ctagatctgactctccccgt

SEQ ID NO: 735961 - DNA, 20 bp, Artificial
  CRISPR gRNA sequence
taagacgcaaatccctgact

SEQ ID NO: 735962 - DNA, 20 bp, Artificial
  CRISPR gRNA sequence
ctcagagtcagtttctctag

SEQ ID NO: 735963 - DNA, 20 bp, Artificial
  CRISPR gRNA sequence
acattcagaagcaggccaca

SEQ ID NO: 735964 - DNA, 20 bp, Artificial
  CRISPR gRNA sequence
ggtacctgatggagggcatg

SEQ ID NO: 735965 - DNA, 20 bp, Artificial
  CRISPR gRNA sequence
ggtccccagacttagtggag

SEQ ID NO: 735966 - DNA, 20 bp, Artificial
  CRISPR gRNA sequence
gatggattctgggccagcag

SEQ ID NO: 735967 - DNA, 20 bp, Artificial
  CRISPR gRNA sequence
tctgggaccccatggtcctc

SEQ ID NO: 735968 - DNA, 20 bp, Artificial
  CRISPR gRNA sequence
ctaagagcctaggcaaggtg

SEQ ID NO: 735969 - DNA, 20 bp, Artificial
  CRISPR gRNA sequence
ctaggcaaggtgatgagtcc

SEQ ID NO: 735970 - DNA, 20 bp, Artificial
  CRISPR gRNA sequence
gttgtgacagttccactctt

SEQ ID NO: 735971 - DNA, 20 bp, Artificial
  CRISPR gRNA sequence
atgttgtccagatgtgtgaa

SEQ ID NO: 735972 - DNA, 20 bp, Artificial
  CRISPR gRNA sequence
gggaggaacgttagattgac

SEQ ID NO: 735973 - DNA, 20 bp, Artificial
  CRISPR gRNA sequence
ccacacagttgcctggaagc

SEQ ID NO: 735974 - DNA, 20 bp, Artificial
  CRISPR gRNA sequence
cttctccttgaccttgggcc

SEQ ID NO: 735975 - DNA, 20 bp, Artificial
  CRISPR gRNA sequence
tgggcctaggattctggctg

SEQ ID NO: 735976 - DNA, 20 bp, Artificial
  CRISPR gRNA sequence
gctattccataattgacaag

SEQ ID NO: 735977 - DNA, 20 bp, Artificial
  CRISPR gRNA sequence
caaagaaagctgcagtcagt

SEQ ID NO: 735978 - DNA, 20 bp, Artificial
  CRISPR gRNA sequence
tcccattttctagaagaagc

SEQ ID NO: 735979 - DNA, 20 bp, Artificial
  CRISPR gRNA sequence
agaagcctgggttttggaca

SEQ ID NO: 735980 - DNA, 20 bp, Artificial
  CRISPR gRNA sequence
tgtgaggcatcaacctagca

SEQ ID NO: 735981 - DNA, 20 bp, Artificial
  CRISPR gRNA sequence
gtgatggttttatctcagca

SEQ ID NO: 735982 - DNA, 20 bp, Artificial
  CRISPR gRNA sequence
ccagaacaagcagcattggt

SEQ ID NO: 735983 - DNA, 20 bp, Artificial
  CRISPR gRNA sequence
caagcagcattggtgaggat

SEQ ID NO: 735984 - DNA, 20 bp, Artificial
  CRISPR gRNA sequence
aatagaggaagacgctcacc

SEQ ID NO: 735985 - DNA, 20 bp, Artificial
  CRISPR gRNA sequence
cacccccaaagaactcttca

SEQ ID NO: 735986 - DNA, 20 bp, Artificial
  CRISPR gRNA sequence
ttcacacatcagtgccttgg

SEQ ID NO: 735987 - DNA, 20 bp, Artificial
  CRISPR gRNA sequence
agagtatatggacactcaga

SEQ ID NO: 735988 - DNA, 20 bp, Artificial
  CRISPR gRNA sequence
cttcttcacagcccaagatg

SEQ ID NO: 735989 - DNA, 20 bp, Artificial
  CRISPR gRNA sequence
acctggtcttcagggggcag

SEQ ID NO: 735990 - DNA, 20 bp, Artificial
  CRISPR gRNA sequence
atcctatactgctagatgac

SEQ ID NO: 735991 - DNA, 20 bp, Artificial
  CRISPR gRNA sequence
agatgaccagagtttgtagt

SEQ ID NO: 735992 - DNA, 20 bp, Artificial
  CRISPR gRNA sequence
ccagagtttgtagttggaat

SEQ ID NO: 735993 - DNA, 20 bp, Artificial
  CRISPR gRNA sequence
gtgaaccagtttcgacttcc

SEQ ID NO: 735994 - DNA, 20 bp, Artificial
  CRISPR gRNA sequence
tgtggaagatggagatgcaa

SEQ ID NO: 735995 - DNA, 20 bp, Artificial
  CRISPR gRNA sequence
attgggttaggtgaacgggg

SEQ ID NO: 735996 - DNA, 20 bp, Artificial
  CRISPR gRNA sequence
ggttaggtgaacggggaagg

SEQ ID NO: 735997 - DNA, 20 bp, Artificial
  CRISPR gRNA sequence
taataactggctgccttttc

SEQ ID NO: 735998 - DNA, 20 bp, Artificial
  CRISPR gRNA sequence
gccttttccggggtctttag

SEQ ID NO: 735999 - DNA, 20 bp, Artificial
  CRISPR gRNA sequence
gttatgcaaccatcatcaca

SEQ ID NO: 736000 - DNA, 20 bp, Artificial
  CRISPR gRNA sequence
gctggctgcatttccccact

SEQ ID NO: 736001 - DNA, 20 bp, Artificial
  CRISPR gRNA sequence
tgctgatcaaatagaaaacc

SEQ ID NO: 736002 - DNA, 20 bp, Artificial
  CRISPR gRNA sequence
tcattgcctcacactccata

SEQ ID NO: 736003 - DNA, 20 bp, Artificial
  CRISPR gRNA sequence
cttcagtagctcccccacca

SEQ ID NO: 736004 - DNA, 20 bp, Artificial
  CRISPR gRNA sequence
tgttttctgcaattatttgt

SEQ ID NO: 736005 - DNA, 20 bp, Artificial
  CRISPR gRNA sequence
gcctgtcatctcccatagtg

SEQ ID NO: 736006 - DNA, 20 bp, Artificial
  CRISPR gRNA sequence
atctcccatagtgcaggatt

SEQ ID NO: 736007 - DNA, 20 bp, Artificial
  CRISPR gRNA sequence
ctcactgtctccttagagcc

SEQ ID NO: 736008 - DNA, 20 bp, Artificial
  CRISPR gRNA sequence
tgccccataataggggctca

SEQ ID NO: 736009 - DNA, 20 bp, Artificial
  CRISPR gRNA sequence
caatgaattatgttgaagca

SEQ ID NO: 736010 - DNA, 20 bp, Artificial
  CRISPR gRNA sequence
gaattatgttgaagcaatga

SEQ ID NO: 736011 - DNA, 20 bp, Artificial
  CRISPR gRNA sequence
tctgggaccccggacaagct

SEQ ID NO: 736012 - DNA, 20 bp, Artificial
  CRISPR gRNA sequence
cggacaagctcagagtcaca

SEQ ID NO: 736013 - DNA, 20 bp, Artificial
  CRISPR gRNA sequence
aaaatggtgacaatagtgcc

SEQ ID NO: 736014 - DNA, 20 bp, Artificial
  CRISPR gRNA sequence
acagtgcaacatgaccactg

SEQ ID NO: 736015 - DNA, 20 bp, Artificial
  CRISPR gRNA sequence
cttattatctctgatgttag

SEQ ID NO: 736016 - DNA, 20 bp, Artificial
  CRISPR gRNA sequence
atccagctggaagcccatca

SEQ ID NO: 736017 - DNA, 20 bp, Artificial
  CRISPR gRNA sequence
tggaagcccatcaaggggta

SEQ ID NO: 736018 - DNA, 20 bp, Artificial
  CRISPR gRNA sequence
gcgcatgcaccagtatcggc

SEQ ID NO: 736019 - DNA, 20 bp, Artificial
  CRISPR gRNA sequence
ttataggagcactgcacaga

SEQ ID NO: 736020 - DNA, 20 bp, Artificial
  CRISPR gRNA sequence
gcctgtggagacaatactta

SEQ ID NO: 736021 - DNA, 20 bp, Artificial
  CRISPR gRNA sequence
gaaagttgaagatcatggtg

SEQ ID NO: 736022 - DNA, 20 bp, Artificial
  CRISPR gRNA sequence
ttgaagatcatggtgaaggg

SEQ ID NO: 736023 - DNA, 20 bp, Artificial
  CRISPR gRNA sequence
agatcatggtgaagggtaga

SEQ ID NO: 736024 - DNA, 20 bp, Artificial
  CRISPR gRNA sequence
ttgccccaatctgaagggag

SEQ ID NO: 736025 - DNA, 20 bp, Artificial
  CRISPR gRNA sequence
ggaggcaggtatatccctca

SEQ ID NO: 736026 - DNA, 20 bp, Artificial
  CRISPR gRNA sequence
aagtgacaagctctgtcttc

SEQ ID NO: 736027 - DNA, 20 bp, Artificial
  CRISPR gRNA sequence
tctgtcttcagggattccca

SEQ ID NO: 736028 - DNA, 20 bp, Artificial
  CRISPR gRNA sequence
gttttgttttgtttttgaga

SEQ ID NO: 736029 - DNA, 20 bp, Artificial
  CRISPR gRNA sequence
tctcgctctgttgcccaggc

SEQ ID NO: 736030 - DNA, 20 bp, Artificial
  CRISPR gRNA sequence
ctcactgtaacctccgcctc

SEQ ID NO: 736031 - DNA, 20 bp, Artificial
  CRISPR gRNA sequence
tattctcctgcctcagcctc

SEQ ID NO: 736032 - DNA, 20 bp, Artificial
  CRISPR gRNA sequence
ttttgtatttttagtagaga

SEQ ID NO: 736033 - DNA, 20 bp, Artificial
  CRISPR gRNA sequence
cgggatttcaccatgttagc

SEQ ID NO: 736034 - DNA, 20 bp, Artificial
  CRISPR gRNA sequence
gcctcggcctcccaaagtgc

SEQ ID NO: 736035 - DNA, 20 bp, Artificial
  CRISPR gRNA sequence
ccactgtgcccggcatccca

SEQ ID NO: 736036 - DNA, 20 bp, Artificial
  CRISPR gRNA sequence
acatgtaaacaaactcccaa

SEQ ID NO: 736037 - DNA, 20 bp, Artificial
  CRISPR gRNA sequence
tcccaatggagtgtgaacca

SEQ ID NO: 736038 - DNA, 20 bp, Artificial
  CRISPR gRNA sequence
atatctttctctctatgctg

SEQ ID NO: 736039 - DNA, 20 bp, Artificial
  CRISPR gRNA sequence
tggtagagacagagcagaac

SEQ ID NO: 736040 - DNA, 20 bp, Artificial
  CRISPR gRNA sequence
cagagcagaactggggtgtg

SEQ ID NO: 736041 - DNA, 20 bp, Artificial
  CRISPR gRNA sequence
ctcttctgataatttcaccc

SEQ ID NO: 736042 - DNA, 20 bp, Artificial
  CRISPR gRNA sequence
agaacagagagcacacattt

SEQ ID NO: 736043 - DNA, 20 bp, Artificial
  CRISPR gRNA sequence
attttggagtcaaaataaac

SEQ ID NO: 736044 - DNA, 20 bp, Artificial
  CRISPR gRNA sequence
tgtttctttatcagtcaagt

SEQ ID NO: 736045 - DNA, 20 bp, Artificial
  CRISPR gRNA sequence
cacccctcacaggttgctgt

SEQ ID NO: 736046 - DNA, 20 bp, Artificial
  CRISPR gRNA sequence
agctgtgacagtcaagggcc

SEQ ID NO: 736047 - DNA, 20 bp, Artificial
  CRISPR gRNA sequence
atccaggacatctgtcccac

SEQ ID NO: 736048 - DNA, 20 bp, Artificial
  CRISPR gRNA sequence
acatctgtcccaccagaatc

SEQ ID NO: 736049 - DNA, 20 bp, Artificial
  CRISPR gRNA sequence
tctgtcccttgcaaactaaa

SEQ ID NO: 736050 - DNA, 20 bp, Artificial
  CRISPR gRNA sequence
tgatccaacttcattatttg

SEQ ID NO: 736051 - DNA, 20 bp, Artificial
  CRISPR gRNA sequence
cattatttggtggatgagcc

SEQ ID NO: 736052 - DNA, 20 bp, Artificial
  CRISPR gRNA sequence
tctctaccctctgggaggtg

SEQ ID NO: 736053 - DNA, 20 bp, Artificial
  CRISPR gRNA sequence
accctctgggaggtgcagag

SEQ ID NO: 736054 - DNA, 20 bp, Artificial
  CRISPR gRNA sequence
ggtgcagagttgggtgacct

SEQ ID NO: 736055 - DNA, 20 bp, Artificial
  CRISPR gRNA sequence
cagagttgggtgaccttggg

SEQ ID NO: 736056 - DNA, 20 bp, Artificial
  CRISPR gRNA sequence
cacccctctcacaggcagtg

SEQ ID NO: 736057 - DNA, 20 bp, Artificial
  CRISPR gRNA sequence
gccatggcagcgagaggggc

SEQ ID NO: 736058 - DNA, 20 bp, Artificial
  CRISPR gRNA sequence
tggcagcgagaggggcagga

SEQ ID NO: 736059 - DNA, 20 bp, Artificial
  CRISPR gRNA sequence
cttcaggacagaggcaggga

SEQ ID NO: 736060 - DNA, 20 bp, Artificial
  CRISPR gRNA sequence
gataaaggagccaatgcaga

SEQ ID NO: 736061 - DNA, 20 bp, Artificial
  CRISPR gRNA sequence
tttatcttggcttgggaggc

SEQ ID NO: 736062 - DNA, 20 bp, Artificial
  CRISPR gRNA sequence
cttcgcctggggcctgatat

SEQ ID NO: 736063 - DNA, 20 bp, Artificial
  CRISPR gRNA sequence
acaagaaaactgctggtaag

SEQ ID NO: 736064 - DNA, 20 bp, Artificial
  CRISPR gRNA sequence
aggtgagggcccacccgaca

SEQ ID NO: 736065 - DNA, 20 bp, Artificial
  CRISPR gRNA sequence
gggcctgccagggaaggacc

SEQ ID NO: 736066 - DNA, 20 bp, Artificial
  CRISPR gRNA sequence
cactgcccccagccaaccgc

SEQ ID NO: 736067 - DNA, 20 bp, Artificial
  CRISPR gRNA sequence
tcccggcttggggccccaga

SEQ ID NO: 736068 - DNA, 20 bp, Artificial
  CRISPR gRNA sequence
ccgccctcataataggctca

SEQ ID NO: 736069 - DNA, 20 bp, Artificial
  CRISPR gRNA sequence
cctgcggttggctgggggca

SEQ ID NO: 736070 - DNA, 20 bp, Artificial
  CRISPR gRNA sequence
gcagcttcacttttagaacc

SEQ ID NO: 736071 - DNA, 20 bp, Artificial
  CRISPR gRNA sequence
cccaggtggcacatcctgtg

SEQ ID NO: 736072 - DNA, 20 bp, Artificial
  CRISPR gRNA sequence
gtgtcgggtgggccctcacc

SEQ ID NO: 736073 - DNA, 20 bp, Artificial
  CRISPR gRNA sequence
ccaggcctgacactgcccag

SEQ ID NO: 736074 - DNA, 20 bp, Artificial
  CRISPR gRNA sequence
tgctgctgctgctgtggcca

SEQ ID NO: 736075 - DNA, 20 bp, Artificial
  CRISPR gRNA sequence
aggggctgacttgtggagga

SEQ ID NO: 736076 - DNA, 20 bp, Artificial
  CRISPR gRNA sequence
gctgacttgtggaggaggga

SEQ ID NO: 736077 - DNA, 20 bp, Artificial
  CRISPR gRNA sequence
gttttcttgtttagtgtttt

SEQ ID NO: 736078 - DNA, 20 bp, Artificial
  CRISPR gRNA sequence
tgcatcatgtgtgttttgaa

SEQ ID NO: 736079 - DNA, 20 bp, Artificial
  CRISPR gRNA sequence
tgtcctgaagggaccagtgt

SEQ ID NO: 736080 - DNA, 20 bp, Artificial
  CRISPR gRNA sequence
tgttcagttctgggcatggt

SEQ ID NO: 736081 - DNA, 20 bp, Artificial
  CRISPR gRNA sequence
aactcaccactgcctgtgag

SEQ ID NO: 736082 - DNA, 20 bp, Artificial
  CRISPR gRNA sequence
acccaactctgcacctccca

SEQ ID NO: 736083 - DNA, 20 bp, Artificial
  CRISPR gRNA sequence
ttcccactgccagggcagaa

SEQ ID NO: 736084 - DNA, 20 bp, Artificial
  CRISPR gRNA sequence
tcatccaccaaataatgaag

SEQ ID NO: 736085 - DNA, 20 bp, Artificial
  CRISPR gRNA sequence
gtttagtttgcaagggacag

SEQ ID NO: 736086 - DNA, 20 bp, Artificial
  CRISPR gRNA sequence
gggacagagggatgcttaga

SEQ ID NO: 736087 - DNA, 20 bp, Artificial
  CRISPR gRNA sequence
gctgctggctgggacttggg

SEQ ID NO: 736088 - DNA, 20 bp, Artificial
  CRISPR gRNA sequence
tgggacttgggacggatatc

SEQ ID NO: 736089 - DNA, 20 bp, Artificial
  CRISPR gRNA sequence
attctggtgggacagatgtc

SEQ ID NO: 736090 - DNA, 20 bp, Artificial
  CRISPR gRNA sequence
ggcccttgactgtcacagct

SEQ ID NO: 736091 - DNA, 20 bp, Artificial
  CRISPR gRNA sequence
agcatgtgggaaaaggaagc

SEQ ID NO: 736092 - DNA, 20 bp, Artificial
  CRISPR gRNA sequence
tgcaaagcactgacctgggg

SEQ ID NO: 736093 - DNA, 20 bp, Artificial
  CRISPR gRNA sequence
aattctcacagcaacctgtg

SEQ ID NO: 736094 - DNA, 20 bp, Artificial
  CRISPR gRNA sequence
acaccactaagtggtagaaa

SEQ ID NO: 736095 - DNA, 20 bp, Artificial
  CRISPR gRNA sequence
ctctgttctctactatgggg

SEQ ID NO: 736096 - DNA, 20 bp, Artificial
  CRISPR gRNA sequence
gtggtttttttggaagactc

SEQ ID NO: 736097 - DNA, 20 bp, Artificial
  CRISPR gRNA sequence
ctctggggtgaaattatcag

SEQ ID NO: 736098 - DNA, 20 bp, Artificial
  CRISPR gRNA sequence
gctgagcttaaggcaggcag

SEQ ID NO: 736099 - DNA, 20 bp, Artificial
  CRISPR gRNA sequence
tttctccctctctctgtccc

SEQ ID NO: 736100 - DNA, 20 bp, Artificial
  CRISPR gRNA sequence
tgctctgtctctaccagact

SEQ ID NO: 736101 - DNA, 20 bp, Artificial
  CRISPR gRNA sequence
aaagatattgcaggtggaaa

SEQ ID NO: 736102 - DNA, 20 bp, Artificial
  CRISPR gRNA sequence
aggtggaaagtgaataattg

SEQ ID NO: 736103 - DNA, 20 bp, Artificial
  CRISPR gRNA sequence
cctgtggttcacactccatt

SEQ ID NO: 736104 - DNA, 20 bp, Artificial
  CRISPR gRNA sequence
tatttagacaggcttgatct

SEQ ID NO: 736105 - DNA, 20 bp, Artificial
  CRISPR gRNA sequence
atctatgggttttatgtaac

SEQ ID NO: 736106 - DNA, 20 bp, Artificial
  CRISPR gRNA sequence
ttttaaaactaaacaccaga

SEQ ID NO: 736107 - DNA, 20 bp, Artificial
  CRISPR gRNA sequence
accagatggaatgaactaag

SEQ ID NO: 736108 - DNA, 20 bp, Artificial
  CRISPR gRNA sequence
tgtctcactgagggcatgac

SEQ ID NO: 736109 - DNA, 20 bp, Artificial
  CRISPR gRNA sequence
atgacctgggtttttcccac

SEQ ID NO: 736110 - DNA, 20 bp, Artificial
  CRISPR gRNA sequence
tttttcccacaagaattccc

SEQ ID NO: 736111 - DNA, 20 bp, Artificial
  CRISPR gRNA sequence
actttgggaggccgaggcag

SEQ ID NO: 736112 - DNA, 20 bp, Artificial
  CRISPR gRNA sequence
tactcaggaggctgaggcag

SEQ ID NO: 736113 - DNA, 20 bp, Artificial
  CRISPR gRNA sequence
caaaacaaaacaaaacaaaa

SEQ ID NO: 736114 - DNA, 20 bp, Artificial
  CRISPR gRNA sequence
aaaacaaaaatgaattccct

SEQ ID NO: 736115 - DNA, 20 bp, Artificial
  CRISPR gRNA sequence
gggctgtgtctgatggagct

SEQ ID NO: 736116 - DNA, 20 bp, Artificial
  CRISPR gRNA sequence
attagactggggactcactg

SEQ ID NO: 736117 - DNA, 20 bp, Artificial
  CRISPR gRNA sequence
actgaaagctccctgagagc

SEQ ID NO: 736118 - DNA, 20 bp, Artificial
  CRISPR gRNA sequence
ctgtatttccccctcaatct

SEQ ID NO: 736119 - DNA, 20 bp, Artificial
  CRISPR gRNA sequence
aagtgtgagcctggctttgc

SEQ ID NO: 736120 - DNA, 20 bp, Artificial
  CRISPR gRNA sequence
gagcctggctttgcccgagt

SEQ ID NO: 736121 - DNA, 20 bp, Artificial
  CRISPR gRNA sequence
tggtgcatgcgcaacacctc

SEQ ID NO: 736122 - DNA, 20 bp, Artificial
  CRISPR gRNA sequence
accccttgatgggcttccag

SEQ ID NO: 736123 - DNA, 20 bp, Artificial
  CRISPR gRNA sequence
caggctgcagtggctctggg

SEQ ID NO: 736124 - DNA, 20 bp, Artificial
  CRISPR gRNA sequence
gtggctctgggacgggtgga

SEQ ID NO: 736125 - DNA, 20 bp, Artificial
  CRISPR gRNA sequence
ccactaacatcagagataat

SEQ ID NO: 736126 - DNA, 20 bp, Artificial
  CRISPR gRNA sequence
atgttgcactgtagtgtttt

SEQ ID NO: 736127 - DNA, 20 bp, Artificial
  CRISPR gRNA sequence
agtgtgactctgagcttgtc

SEQ ID NO: 736128 - DNA, 20 bp, Artificial
  CRISPR gRNA sequence
gggggagctactgaagtact

SEQ ID NO: 736129 - DNA, 20 bp, Artificial
  CRISPR gRNA sequence
agacaacaccaagcagagcc

SEQ ID NO: 736130 - DNA, 20 bp, Artificial
  CRISPR gRNA sequence
ttttccagccctgttgaaat

SEQ ID NO: 736131 - DNA, 20 bp, Artificial
  CRISPR gRNA sequence
agagcactttgtcgcaagag

SEQ ID NO: 736132 - DNA, 20 bp, Artificial
  CRISPR gRNA sequence
gcttatttagtcactctata

SEQ ID NO: 736133 - DNA, 20 bp, Artificial
  CRISPR gRNA sequence
tctatatggagtgtgaggca

SEQ ID NO: 736134 - DNA, 20 bp, Artificial
  CRISPR gRNA sequence
ggcaatgaatgaggaggttg

SEQ ID NO: 736135 - DNA, 20 bp, Artificial
  CRISPR gRNA sequence
cagccctgaagaccataagt

SEQ ID NO: 736136 - DNA, 20 bp, Artificial
  CRISPR gRNA sequence
agctgtcatgacttgttttt

SEQ ID NO: 736137 - DNA, 20 bp, Artificial
  CRISPR gRNA sequence
gaatgtagtggccacttgtt

SEQ ID NO: 736138 - DNA, 20 bp, Artificial
  CRISPR gRNA sequence
gtagtggccacttgttgagg

SEQ ID NO: 736139 - DNA, 20 bp, Artificial
  CRISPR gRNA sequence
ccacttgttgaggatggatt

SEQ ID NO: 736140 - DNA, 20 bp, Artificial
  CRISPR gRNA sequence
ggattgtgaatggtatgaac

SEQ ID NO: 736141 - DNA, 20 bp, Artificial
  CRISPR gRNA sequence
ggctggaaacaacagtggcc

SEQ ID NO: 736142 - DNA, 20 bp, Artificial
  CRISPR gRNA sequence
ggcactagtggcagagagat

SEQ ID NO: 736143 - DNA, 20 bp, Artificial
  CRISPR gRNA sequence
catatgttttgaaggtagga

SEQ ID NO: 736144 - DNA, 20 bp, Artificial
  CRISPR gRNA sequence
ggacaggatttgctcagttg

SEQ ID NO: 736145 - DNA, 20 bp, Artificial
  CRISPR gRNA sequence
ttgaggggtgagccaaaagg

SEQ ID NO: 736146 - DNA, 20 bp, Artificial
  CRISPR gRNA sequence
gtgagccaaaaggaggaatc

SEQ ID NO: 736147 - DNA, 20 bp, Artificial
  CRISPR gRNA sequence
gttttctatttgatcagcag

SEQ ID NO: 736148 - DNA, 20 bp, Artificial
  CRISPR gRNA sequence
tgatggtaccattgatagcg

SEQ ID NO: 736149 - DNA, 20 bp, Artificial
  CRISPR gRNA sequence
gtgatatacctgcctggagc

SEQ ID NO: 736150 - DNA, 20 bp, Artificial
  CRISPR gRNA sequence
ctagggtgagaggtcagagc

SEQ ID NO: 736151 - DNA, 20 bp, Artificial
  CRISPR gRNA sequence
aagatagtgtttaaagtcca

SEQ ID NO: 736152 - DNA, 20 bp, Artificial
  CRISPR gRNA sequence
tagggctgggggaaggaaaa

SEQ ID NO: 736153 - DNA, 20 bp, Artificial
  CRISPR gRNA sequence
gggggaaggaaaaggggata

SEQ ID NO: 736154 - DNA, 20 bp, Artificial
  CRISPR gRNA sequence
agaatcatagataaacagta

SEQ ID NO: 736155 - DNA, 20 bp, Artificial
  CRISPR gRNA sequence
actgagctttatactataaa

SEQ ID NO: 736156 - DNA, 20 bp, Artificial
  CRISPR gRNA sequence
ctttatactataaatgggat

SEQ ID NO: 736157 - DNA, 20 bp, Artificial
  CRISPR gRNA sequence
caagatctaaaagctctccc

SEQ ID NO: 736158 - DNA, 20 bp, Artificial
  CRISPR gRNA sequence
tcccttgagtgtaggcaaaa

SEQ ID NO: 736159 - DNA, 20 bp, Artificial
  CRISPR gRNA sequence
aagagtggagcaccaagccg

SEQ ID NO: 736160 - DNA, 20 bp, Artificial
  CRISPR gRNA sequence
aattgcatctccatcttcca

SEQ ID NO: 736161 - DNA, 20 bp, Artificial
  CRISPR gRNA sequence
cattgctcccctctccagtt

SEQ ID NO: 736162 - DNA, 20 bp, Artificial
  CRISPR gRNA sequence
tcactgaagtcttaatattt

SEQ ID NO: 736163 - DNA, 20 bp, Artificial
  CRISPR gRNA sequence
actctggtcatctagcagta

SEQ ID NO: 736164 - DNA, 20 bp, Artificial
  CRISPR gRNA sequence
atcttgggctgtgaagaagg

SEQ ID NO: 736165 - DNA, 20 bp, Artificial
  CRISPR gRNA sequence
ccctcttagtgtgttgatgc

SEQ ID NO: 736166 - DNA, 20 bp, Artificial
  CRISPR gRNA sequence
gagatggttatgtggcttaa

SEQ ID NO: 736167 - DNA, 20 bp, Artificial
  CRISPR gRNA sequence
gtggcttaactgagtgttgt

SEQ ID NO: 736168 - DNA, 20 bp, Artificial
  CRISPR gRNA sequence
ttgtaggaatgctttccctg

SEQ ID NO: 736169 - DNA, 20 bp, Artificial
  CRISPR gRNA sequence
ccagccctttgagatcctct

SEQ ID NO: 736170 - DNA, 20 bp, Artificial
  CRISPR gRNA sequence
ctctcccaaggcactgatgt

SEQ ID NO: 736171 - DNA, 20 bp, Artificial
  CRISPR gRNA sequence
actgatgtgtgaattctctg

SEQ ID NO: 736172 - DNA, 20 bp, Artificial
  CRISPR gRNA sequence
aattctctgaagagttcttt

SEQ ID NO: 736173 - DNA, 20 bp, Artificial
  CRISPR gRNA sequence
ctttgggggtgtccccactg

SEQ ID NO: 736174 - DNA, 20 bp, Artificial
  CRISPR gRNA sequence
cctcaccaatgctgcttgtt

SEQ ID NO: 736175 - DNA, 20 bp, Artificial
  CRISPR gRNA sequence
gccctttccatgcacagtag

SEQ ID NO: 736176 - DNA, 20 bp, Artificial
  CRISPR gRNA sequence
cccaggcttcttctagaaaa

SEQ ID NO: 736177 - DNA, 20 bp, Artificial
  CRISPR gRNA sequence
gaaaatgggatggaaaaggg

SEQ ID NO: 736178 - DNA, 20 bp, Artificial
  CRISPR gRNA sequence
gatggaaaagggctgggttg

SEQ ID NO: 736179 - DNA, 20 bp, Artificial
  CRISPR gRNA sequence
gaaaagggctgggttgatgg

SEQ ID NO: 736180 - DNA, 20 bp, Artificial
  CRISPR gRNA sequence
caactgactgcagctttctt

SEQ ID NO: 736181 - DNA, 20 bp, Artificial
  CRISPR gRNA sequence
tggaccctacttgtcaatta

SEQ ID NO: 736182 - DNA, 20 bp, Artificial
  CRISPR gRNA sequence
gaaagtgaaaagagagagat

SEQ ID NO: 736183 - DNA, 20 bp, Artificial
  CRISPR gRNA sequence
acatctgatcactcagcagc

SEQ ID NO: 736184 - DNA, 20 bp, Artificial
  CRISPR gRNA sequence
ccaggcttccaggcaactgt

SEQ ID NO: 736185 - DNA, 20 bp, Artificial
  CRISPR gRNA sequence
caggcaactgtgtgggttgc

SEQ ID NO: 736186 - DNA, 20 bp, Artificial
  CRISPR gRNA sequence
cacatctggacaacatcctc

SEQ ID NO: 736187 - DNA, 20 bp, Artificial
  CRISPR gRNA sequence
ccagggacccaggaggacca

SEQ ID NO: 736188 - DNA, 20 bp, Artificial
  CRISPR gRNA sequence
cagggactcctctgctggcc

SEQ ID NO: 736189 - DNA, 20 bp, Artificial
  CRISPR gRNA sequence
catcaggtacctgtggggcc

SEQ ID NO: 736190 - DNA, 20 bp, Artificial
  CRISPR gRNA sequence
ggtacctgtggggcctgggg

SEQ ID NO: 736191 - DNA, 20 bp, Artificial
  CRISPR gRNA sequence
gaacccaatgtggcctgctt

SEQ ID NO: 736192 - DNA, 20 bp, Artificial
  CRISPR gRNA sequence
gggggactggaagtgacata

SEQ ID NO: 736193 - DNA, 20 bp, Artificial
  CRISPR gRNA sequence
agaggaggggcaggggaaag

SEQ ID NO: 736194 - DNA, 20 bp, Artificial
  CRISPR gRNA sequence
gggcaggggaaaggagggtc

SEQ ID NO: 736195 - DNA, 20 bp, Artificial
  CRISPR gRNA sequence
ggaggaggggcaggggaaag

SEQ ID NO: 736196 - DNA, 20 bp, Artificial
  CRISPR gRNA sequence
ggaggaggggcaggggaaag

SEQ ID NO: 736197 - DNA, 20 bp, Artificial
  CRISPR gRNA sequence
acaggagggacaggggaaag

SEQ ID NO: 736198 - DNA, 20 bp, Artificial
  CRISPR gRNA sequence
ggaaaggagggtcgggggag

SEQ ID NO: 736199 - DNA, 20 bp, Artificial
  CRISPR gRNA sequence
ggaggaaggtcaggtgaaag

SEQ ID NO: 736200 - DNA, 20 bp, Artificial
  CRISPR gRNA sequence
caggtgaaaggaggatcagg

SEQ ID NO: 736201 - DNA, 20 bp, Artificial
  CRISPR gRNA sequence
aaaggaggatcaggaaggat

SEQ ID NO: 736202 - DNA, 20 bp, Artificial
  CRISPR gRNA sequence
ggatgagggtcagtggggag

SEQ ID NO: 736203 - DNA, 20 bp, Artificial
  CRISPR gRNA sequence
ggggaagtgtcagcagagag

SEQ ID NO: 736204 - DNA, 20 bp, Artificial
  CRISPR gRNA sequence
gtgtcagcagagaggagggt

SEQ ID NO: 736205 - DNA, 20 bp, Artificial
  CRISPR gRNA sequence
ggataaaggtagggggagat

SEQ ID NO: 736206 - DNA, 20 bp, Artificial
  CRISPR gRNA sequence
tagggggagatgagggttgc

SEQ ID NO: 736207 - DNA, 20 bp, Artificial
  CRISPR gRNA sequence
ggatgagggcaggggactat

SEQ ID NO: 736208 - DNA, 20 bp, Artificial
  CRISPR gRNA sequence
actatgagagtcgggggcat

SEQ ID NO: 736209 - DNA, 20 bp, Artificial
  CRISPR gRNA sequence
gtcgggggcattagggtcag

SEQ ID NO: 736210 - DNA, 20 bp, Artificial
  CRISPR gRNA sequence
ggcattagggtcagggggat

SEQ ID NO: 736211 - DNA, 20 bp, Artificial
  CRISPR gRNA sequence
agggtcagggggatgaggat

SEQ ID NO: 736212 - DNA, 20 bp, Artificial
  CRISPR gRNA sequence
aaatgaaggttgtgggggag

SEQ ID NO: 736213 - DNA, 20 bp, Artificial
  CRISPR gRNA sequence
cagagaagaaggtcagtggg

SEQ ID NO: 736214 - DNA, 20 bp, Artificial
  CRISPR gRNA sequence
gagaggggggctgcagagat

SEQ ID NO: 736215 - DNA, 20 bp, Artificial
  CRISPR gRNA sequence
agatgagggtagggggcaat

SEQ ID NO: 736216 - DNA, 20 bp, Artificial
  CRISPR gRNA sequence
tagggggcaatgagagttgg

SEQ ID NO: 736217 - DNA, 20 bp, Artificial
  CRISPR gRNA sequence
ttggtagaattagggccagg

SEQ ID NO: 736218 - DNA, 20 bp, Artificial
  CRISPR gRNA sequence
gaattagggccaggggggat

SEQ ID NO: 736219 - DNA, 20 bp, Artificial
  CRISPR gRNA sequence
agtcagagatgagcatgtca

SEQ ID NO: 736220 - DNA, 20 bp, Artificial
  CRISPR gRNA sequence
agagatgagcatgtcagggg

SEQ ID NO: 736221 - DNA, 20 bp, Artificial
  CRISPR gRNA sequence
atgggtgtcctgaagtgtct

SEQ ID NO: 736222 - DNA, 20 bp, Artificial
  CRISPR gRNA sequence
gtgtctgtggatggagagga

SEQ ID NO: 736223 - DNA, 20 bp, Artificial
  CRISPR gRNA sequence
gtggatggagaggagagggt

SEQ ID NO: 736224 - DNA, 20 bp, Artificial
  CRISPR gRNA sequence
ggagagggtgaggatagggc

SEQ ID NO: 736225 - DNA, 20 bp, Artificial
  CRISPR gRNA sequence
tagggcaaggatgcgcctca

SEQ ID NO: 736226 - DNA, 20 bp, Artificial
  CRISPR gRNA sequence
ggagtaggaagtggaaaatg

SEQ ID NO: 736227 - DNA, 20 bp, Artificial
  CRISPR gRNA sequence
aaaatgggggatgctttaat

SEQ ID NO: 736228 - DNA, 20 bp, Artificial
  CRISPR gRNA sequence
ttcctctagagaaactgact

SEQ ID NO: 736229 - DNA, 20 bp, Artificial
  CRISPR gRNA sequence
agagaaactgactctgagtc

SEQ ID NO: 736230 - DNA, 20 bp, Artificial
  CRISPR gRNA sequence
gaacactggaaaaaaggtgg

SEQ ID NO: 736231 - DNA, 20 bp, Artificial
  CRISPR gRNA sequence
ggcagggaaggcctctaata

SEQ ID NO: 736232 - DNA, 20 bp, Artificial
  CRISPR gRNA sequence
aagagcctaatcccaacggg

SEQ ID NO: 736233 - DNA, 20 bp, Artificial
  CRISPR gRNA sequence
gcccgacagcatctgctaca

SEQ ID NO: 736234 - DNA, 20 bp, Artificial
  CRISPR gRNA sequence
acagcatctgctacagagga

SEQ ID NO: 736235 - DNA, 20 bp, Artificial
  CRISPR gRNA sequence
tgatctctttagccacaaat

SEQ ID NO: 736236 - DNA, 20 bp, Artificial
  CRISPR gRNA sequence
agccacaaatgggagtctcc

SEQ ID NO: 736237 - DNA, 20 bp, Artificial
  CRISPR gRNA sequence
gggacgtcctcctcttaact

SEQ ID NO: 736238 - DNA, 20 bp, Artificial
  CRISPR gRNA sequence
tgtcacacttgcttctgtgg

SEQ ID NO: 736239 - DNA, 20 bp, Artificial
  CRISPR gRNA sequence
gtggccgggtctgtaaggaa

SEQ ID NO: 736240 - DNA, 20 bp, Artificial
  CRISPR gRNA sequence
ccccgggaagggcacgctct

SEQ ID NO: 736241 - DNA, 20 bp, Artificial
  CRISPR gRNA sequence
gctgctggtccgatcccaac

SEQ ID NO: 736242 - DNA, 20 bp, Artificial
  CRISPR gRNA sequence
ggtccgatcccaacgtgggt

SEQ ID NO: 736243 - DNA, 20 bp, Artificial
  CRISPR gRNA sequence
tgtcccttcttctcaggcac

SEQ ID NO: 736244 - DNA, 20 bp, Artificial
  CRISPR gRNA sequence
gatgtttactccactgtgct

SEQ ID NO: 736245 - DNA, 20 bp, Artificial
  CRISPR gRNA sequence
gctgatgctgatcatggtct

SEQ ID NO: 736246 - DNA, 20 bp, Artificial
  CRISPR gRNA sequence
gaagaagagacacatggcaa

SEQ ID NO: 736247 - DNA, 20 bp, Artificial
  CRISPR gRNA sequence
agcctcctgagggcagagct

SEQ ID NO: 736248 - DNA, 20 bp, Artificial
  CRISPR gRNA sequence
gagctctgggtaactgcact

SEQ ID NO: 736249 - DNA, 20 bp, Artificial
  CRISPR gRNA sequence
ctgcactaagggttatgacc

SEQ ID NO: 736250 - DNA, 20 bp, Artificial
  CRISPR gRNA sequence
accacccagcacaaccctaa

SEQ ID NO: 736251 - DNA, 20 bp, Artificial
  CRISPR gRNA sequence
gatctgaggccacttaagca

SEQ ID NO: 736252 - DNA, 20 bp, Artificial
  CRISPR gRNA sequence
atggggtggggagcttctcc

SEQ ID NO: 736253 - DNA, 20 bp, Artificial
  CRISPR gRNA sequence
cttctcccagagtggcccca

SEQ ID NO: 736254 - DNA, 20 bp, Artificial
  CRISPR gRNA sequence
tggccccagggggttagagg

SEQ ID NO: 736255 - DNA, 20 bp, Artificial
  CRISPR gRNA sequence
ggtggaggcaggggaaccct

SEQ ID NO: 736256 - DNA, 20 bp, Artificial
  CRISPR gRNA sequence
tcccctaaggttagggaaga

SEQ ID NO: 736257 - DNA, 20 bp, Artificial
  CRISPR gRNA sequence
gggaagaaagaatcgggctc

SEQ ID NO: 736258 - DNA, 20 bp, Artificial
  CRISPR gRNA sequence
taaaagctggggacccacag

SEQ ID NO: 736259 - DNA, 20 bp, Artificial
  CRISPR gRNA sequence
aggtgtcctttgctgggcct

SEQ ID NO: 736260 - DNA, 20 bp, Artificial
  CRISPR gRNA sequence
agctaagagcctctgggctg

SEQ ID NO: 736261 - DNA, 20 bp, Artificial
  CRISPR gRNA sequence
tctacacctgggctccaagt

SEQ ID NO: 736262 - DNA, 20 bp, Artificial
  CRISPR gRNA sequence
cctccaggaagtccataccc

SEQ ID NO: 736263 - DNA, 20 bp, Artificial
  CRISPR gRNA sequence
gggagaccatggctcagagg

SEQ ID NO: 736264 - DNA, 20 bp, Artificial
  CRISPR gRNA sequence
gcaaccctcctcctacccct

SEQ ID NO: 736265 - DNA, 20 bp, Artificial
  CRISPR gRNA sequence
gccagggacccaatgtcccg

SEQ ID NO: 736266 - DNA, 20 bp, Artificial
  CRISPR gRNA sequence
gcgtccagcaatgaaggctg

SEQ ID NO: 736267 - DNA, 20 bp, Artificial
  CRISPR gRNA sequence
tgaaggctggagaatgcagc

SEQ ID NO: 736268 - DNA, 20 bp, Artificial
  CRISPR gRNA sequence
cacacaggtgtctactgacc

SEQ ID NO: 736269 - DNA, 20 bp, Artificial
  CRISPR gRNA sequence
gtctactgacctggagtgac

SEQ ID NO: 736270 - DNA, 20 bp, Artificial
  CRISPR gRNA sequence
gagtgactggaatagcacct

SEQ ID NO: 736271 - DNA, 20 bp, Artificial
  CRISPR gRNA sequence
tgacaactgtgcattgaacc

SEQ ID NO: 736272 - DNA, 20 bp, Artificial
  CRISPR gRNA sequence
agggacgttccaatggccaa

SEQ ID NO: 736273 - DNA, 20 bp, Artificial
  CRISPR gRNA sequence
gacagccagaggggccactt

SEQ ID NO: 736274 - DNA, 20 bp, Artificial
  CRISPR gRNA sequence
gccagaggggccacttcagg

SEQ ID NO: 736275 - DNA, 20 bp, Artificial
  CRISPR gRNA sequence
cacttcaggatggatgtggg

SEQ ID NO: 736276 - DNA, 20 bp, Artificial
  CRISPR gRNA sequence
tggggagagtggaagaggca

SEQ ID NO: 736277 - DNA, 20 bp, Artificial
  CRISPR gRNA sequence
tagagggaagactgaggctg

SEQ ID NO: 736278 - DNA, 20 bp, Artificial
  CRISPR gRNA sequence
cactgatggccctgcttcct

SEQ ID NO: 736279 - DNA, 20 bp, Artificial
  CRISPR gRNA sequence
aagaagtcagggacagggac

SEQ ID NO: 736280 - DNA, 20 bp, Artificial
  CRISPR gRNA sequence
caacattacatttaagacct

SEQ ID NO: 736281 - DNA, 20 bp, Artificial
  CRISPR gRNA sequence
ttcccaagtgtcatcactat

SEQ ID NO: 736282 - DNA, 20 bp, Artificial
  CRISPR gRNA sequence
aggtcctcttttgaggaggg

SEQ ID NO: 736283 - DNA, 20 bp, Artificial
  CRISPR gRNA sequence
cttttgaggaggggagggta

SEQ ID NO: 736284 - DNA, 20 bp, Artificial
  CRISPR gRNA sequence
cttgtttcctcatctggaga

SEQ ID NO: 736285 - DNA, 20 bp, Artificial
  CRISPR gRNA sequence
aaaccagtcaggcaggcagt

SEQ ID NO: 736286 - DNA, 20 bp, Artificial
  CRISPR gRNA sequence
cagtcaggcaggcagttagg

SEQ ID NO: 736287 - DNA, 20 bp, Artificial
  CRISPR gRNA sequence
cagttagggtgggttctcgg

SEQ ID NO: 736288 - DNA, 20 bp, Artificial
  CRISPR gRNA sequence
gtaaggggaacaaagcaata

SEQ ID NO: 736289 - DNA, 20 bp, Artificial
  CRISPR gRNA sequence
accacaatgtagcagtctct

SEQ ID NO: 736290 - DNA, 20 bp, Artificial
  CRISPR gRNA sequence
accaaggatgaggttggagt

SEQ ID NO: 736291 - DNA, 20 bp, Artificial
  CRISPR gRNA sequence
ccatttttacagttgaatgt

SEQ ID NO: 736292 - DNA, 20 bp, Artificial
  CRISPR gRNA sequence
ttctaatgtacatgtgggcc

SEQ ID NO: 736293 - DNA, 20 bp, Artificial
  CRISPR gRNA sequence
ggcttgagttacttactcca

SEQ ID NO: 736294 - DNA, 20 bp, Artificial
  CRISPR gRNA sequence
gatgaaattttccattgcag

SEQ ID NO: 736295 - DNA, 20 bp, Artificial
  CRISPR gRNA sequence
caagttcccatatctgtgcc

SEQ ID NO: 736296 - DNA, 20 bp, Artificial
  CRISPR gRNA sequence
ttcccatatctgtgcctgca

SEQ ID NO: 736297 - DNA, 20 bp, Artificial
  CRISPR gRNA sequence
cttgatttttcaggctgttc

SEQ ID NO: 736298 - DNA, 20 bp, Artificial
  CRISPR gRNA sequence
ccaccctaactgcctgcctg

SEQ ID NO: 736299 - DNA, 20 bp, Artificial
  CRISPR gRNA sequence
ggagaacagctatcttagga

SEQ ID NO: 736300 - DNA, 20 bp, Artificial
  CRISPR gRNA sequence
tgcctcctccctgctgtccc

SEQ ID NO: 736301 - DNA, 20 bp, Artificial
  CRISPR gRNA sequence
ccctgagtcagtgggtggga

SEQ ID NO: 736302 - DNA, 20 bp, Artificial
  CRISPR gRNA sequence
gaggctcttagctgcctggt

SEQ ID NO: 736303 - DNA, 20 bp, Artificial
  CRISPR gRNA sequence
tgccaacccctctgtgggtc

SEQ ID NO: 736304 - DNA, 20 bp, Artificial
  CRISPR gRNA sequence
gtgggtccccagcttttagt

SEQ ID NO: 736305 - DNA, 20 bp, Artificial
  CRISPR gRNA sequence
actgcctctggcattcgtga

SEQ ID NO: 736306 - DNA, 20 bp, Artificial
  CRISPR gRNA sequence
gggagggcagctcagcccaa

SEQ ID NO: 736307 - DNA, 20 bp, Artificial
  CRISPR gRNA sequence
aggagaacactgggctgtgg

SEQ ID NO: 736308 - DNA, 20 bp, Artificial
  CRISPR gRNA sequence
gctgcttaggatggcagcct

SEQ ID NO: 736309 - DNA, 20 bp, Artificial
  CRISPR gRNA sequence
gtccagcactgcacaagtcc

SEQ ID NO: 736310 - DNA, 20 bp, Artificial
  CRISPR gRNA sequence
tctgggagaagctccccacc

SEQ ID NO: 736311 - DNA, 20 bp, Artificial
  CRISPR gRNA sequence
aatctgttcatcagtgagga

SEQ ID NO: 736312 - DNA, 20 bp, Artificial
  CRISPR gRNA sequence
atttgtggctaaagagatca

SEQ ID NO: 736313 - DNA, 20 bp, Artificial
  CRISPR gRNA sequence
ggctcctttgcccttcagat

SEQ ID NO: 736314 - DNA, 20 bp, Artificial
  CRISPR gRNA sequence
gctagatctgactctccccg

SEQ ID NO: 736315 - DNA, 20 bp, Artificial
  CRISPR gRNA sequence
aggctcttgttgtgcacagc

SEQ ID NO: 736316 - DNA, 20 bp, Artificial
  CRISPR gRNA sequence
acgcaaatccctgactcaga

SEQ ID NO: 736317 - DNA, 20 bp, Artificial
  CRISPR gRNA sequence
tataagacttgcacctccag

SEQ ID NO: 736318 - DNA, 20 bp, Artificial
  CRISPR gRNA sequence
aggtccccagacttagtgga

SEQ ID NO: 736319 - DNA, 20 bp, Artificial
  CRISPR gRNA sequence
ggggcatcagggcctgaggt

SEQ ID NO: 736320 - DNA, 20 bp, Artificial
  CRISPR gRNA sequence
tgtgtgaaaggaatgttcct

SEQ ID NO: 736321 - DNA, 20 bp, Artificial
  CRISPR gRNA sequence
aaagacagaaagggaggaac

SEQ ID NO: 736322 - DNA, 20 bp, Artificial
  CRISPR gRNA sequence
tcttctccttgaccttgggc

SEQ ID NO: 736323 - DNA, 20 bp, Artificial
  CRISPR gRNA sequence
ctcttcgttcctatgggcca

SEQ ID NO: 736324 - DNA, 20 bp, Artificial
  CRISPR gRNA sequence
tcccattttctagaagaagc

SEQ ID NO: 736325 - DNA, 20 bp, Artificial
  CRISPR gRNA sequence
gcatcaacctagcagtgagt

SEQ ID NO: 736326 - DNA, 20 bp, Artificial
  CRISPR gRNA sequence
attgtcatcatggaaggtgg

SEQ ID NO: 736327 - DNA, 20 bp, Artificial
  CRISPR gRNA sequence
atcctatactgctagatgac

SEQ ID NO: 736328 - DNA, 20 bp, Artificial
  CRISPR gRNA sequence
accagagtttgtagttggaa

SEQ ID NO: 736329 - DNA, 20 bp, Artificial
  CRISPR gRNA sequence
ggaaagtgagatgtgacata

SEQ ID NO: 736330 - DNA, 20 bp, Artificial
  CRISPR gRNA sequence
tgagaaaaaataaaagcata

SEQ ID NO: 736331 - DNA, 20 bp, Artificial
  CRISPR gRNA sequence
aaataaaagcatataatgtt

SEQ ID NO: 736332 - DNA, 20 bp, Artificial
  CRISPR gRNA sequence
aaatattaagacttcagtga

SEQ ID NO: 736333 - DNA, 20 bp, Artificial
  CRISPR gRNA sequence
cagaactggagaggggagca

SEQ ID NO: 736334 - DNA, 20 bp, Artificial
  CRISPR gRNA sequence
taataaatgtggaaggaccc

SEQ ID NO: 736335 - DNA, 20 bp, Artificial
  CRISPR gRNA sequence
ttttttgcctacactcaagg

SEQ ID NO: 736336 - DNA, 20 bp, Artificial
  CRISPR gRNA sequence
taaagctcagtggttcttta

SEQ ID NO: 736337 - DNA, 20 bp, Artificial
  CRISPR gRNA sequence
gttatgcaaccatcatcaca

SEQ ID NO: 736338 - DNA, 20 bp, Artificial
  CRISPR gRNA sequence
catctccaaaagaaacccct

SEQ ID NO: 736339 - DNA, 20 bp, Artificial
  CRISPR gRNA sequence
agaaaccccttactgtttat

SEQ ID NO: 736340 - DNA, 20 bp, Artificial
  CRISPR gRNA sequence
actaatctactttctgtgtc

SEQ ID NO: 736341 - DNA, 20 bp, Artificial
  CRISPR gRNA sequence
ttaacatgacaaaagagagc

SEQ ID NO: 736342 - DNA, 20 bp, Artificial
  CRISPR gRNA sequence
tcctccaaattagctcctct

SEQ ID NO: 736343 - DNA, 20 bp, Artificial
  CRISPR gRNA sequence
aatagaaaaccttggatcat

SEQ ID NO: 736344 - DNA, 20 bp, Artificial
  CRISPR gRNA sequence
tgaacagaaagtctgaaaaa

SEQ ID NO: 736345 - DNA, 20 bp, Artificial
  CRISPR gRNA sequence
tacattgtactccaggccac

SEQ ID NO: 736346 - DNA, 20 bp, Artificial
  CRISPR gRNA sequence
gacagctctctgagctctct

SEQ ID NO: 736347 - DNA, 20 bp, Artificial
  CRISPR gRNA sequence
ttccaacttatggtcttcag

SEQ ID NO: 736348 - DNA, 20 bp, Artificial
  CRISPR gRNA sequence
acaaagtgctcttcaaagca

SEQ ID NO: 736349 - DNA, 20 bp, Artificial
  CRISPR gRNA sequence
aaaatgctcaccattcaggg

SEQ ID NO: 736350 - DNA, 20 bp, Artificial
  CRISPR gRNA sequence
cagtagctcccccaccaccg

SEQ ID NO: 736351 - DNA, 20 bp, Artificial
  CRISPR gRNA sequence
tgcaattatttgaaacagtt

SEQ ID NO: 736352 - DNA, 20 bp, Artificial
  CRISPR gRNA sequence
cctagtttcttatgaacacc

SEQ ID NO: 736353 - DNA, 20 bp, Artificial
  CRISPR gRNA sequence
tgcctgtcatctcccatagt

SEQ ID NO: 736354 - DNA, 20 bp, Artificial
  CRISPR gRNA sequence
ctcccatagtgcaggattgt

SEQ ID NO: 736355 - DNA, 20 bp, Artificial
  CRISPR gRNA sequence
aaaacacagcacagacagtg

SEQ ID NO: 736356 - DNA, 20 bp, Artificial
  CRISPR gRNA sequence
cggacaagctcagagtcaca

SEQ ID NO: 736357 - DNA, 20 bp, Artificial
  CRISPR gRNA sequence
tacagtgcaacatgaccact

SEQ ID NO: 736358 - DNA, 20 bp, Artificial
  CRISPR gRNA sequence
accagtatcggcctgagtcc

SEQ ID NO: 736359 - DNA, 20 bp, Artificial
  CRISPR gRNA sequence
gccaggctcacacttcttct

SEQ ID NO: 736360 - DNA, 20 bp, Artificial
  CRISPR gRNA sequence
gcaccaaaccttgccctcca

SEQ ID NO: 736361 - DNA, 20 bp, Artificial
  CRISPR gRNA sequence
tgtcctgctgtcacagaacc

SEQ ID NO: 736362 - DNA, 20 bp, Artificial
  CRISPR gRNA sequence
gaaatacagccccgccttca

SEQ ID NO: 736363 - DNA, 20 bp, Artificial
  CRISPR gRNA sequence
gtgaatgggccctgaaaaca

SEQ ID NO: 736364 - DNA, 20 bp, Artificial
  CRISPR gRNA sequence
agacacaacccccgctctca

SEQ ID NO: 736365 - DNA, 20 bp, Artificial
  CRISPR gRNA sequence
aaagtgacaagctctgtctt

SEQ ID NO: 736366 - DNA, 20 bp, Artificial
  CRISPR gRNA sequence
gggattcccagggaattcat

SEQ ID NO: 736367 - DNA, 20 bp, Artificial
  CRISPR gRNA sequence
tcccagggaattcatttttg

SEQ ID NO: 736368 - DNA, 20 bp, Artificial
  CRISPR gRNA sequence
gggaattcatttttgttttg

SEQ ID NO: 736369 - DNA, 20 bp, Artificial
  CRISPR gRNA sequence
ttcatttttgttttgttttg

SEQ ID NO: 736370 - DNA, 20 bp, Artificial
  CRISPR gRNA sequence
ttttgttttgttttgttttg

SEQ ID NO: 736371 - DNA, 20 bp, Artificial
  CRISPR gRNA sequence
ttttgttttgttttgttttg

SEQ ID NO: 736372 - DNA, 20 bp, Artificial
  CRISPR gRNA sequence
tttttgtatttttagtagag

SEQ ID NO: 736373 - DNA, 20 bp, Artificial
  CRISPR gRNA sequence
tgcctcggcctcccaaagtg

SEQ ID NO: 736374 - DNA, 20 bp, Artificial
  CRISPR gRNA sequence
agaaaatctagtatttgaaa

SEQ ID NO: 736375 - DNA, 20 bp, Artificial
  CRISPR gRNA sequence
tctccttagttcattccatc

SEQ ID NO: 736376 - DNA, 20 bp, Artificial
  CRISPR gRNA sequence
ttagttcattccatctggtg

SEQ ID NO: 736377 - DNA, 20 bp, Artificial
  CRISPR gRNA sequence
ctcccaatggagtgtgaacc

SEQ ID NO: 736378 - DNA, 20 bp, Artificial
  CRISPR gRNA sequence
aaaataaacaagggttgaaa

SEQ ID NO: 736379 - DNA, 20 bp, Artificial
  CRISPR gRNA sequence
cctgtttctaccacttagtg

SEQ ID NO: 736380 - DNA, 20 bp, Artificial
  CRISPR gRNA sequence
cttagtggtgtgattaggtc

SEQ ID NO: 736381 - DNA, 20 bp, Artificial
  CRISPR gRNA sequence
cttgactgatacagaaatat

SEQ ID NO: 736382 - DNA, 20 bp, Artificial
  CRISPR gRNA sequence
gtgagaattctgccccaggt

SEQ ID NO: 736383 - DNA, 20 bp, Artificial
  CRISPR gRNA sequence
gcacacagtgcatgctcaac

SEQ ID NO: 736384 - DNA, 20 bp, Artificial
  CRISPR gRNA sequence
tcattatttggtggatgagc

SEQ ID NO: 736385 - DNA, 20 bp, Artificial
  CRISPR gRNA sequence
tttctgccctggcagtggga

SEQ ID NO: 736386 - DNA, 20 bp, Artificial
  CRISPR gRNA sequence
cacccctctcacaggcagtg

SEQ ID NO: 736387 - DNA, 20 bp, Artificial
  CRISPR gRNA sequence
agttcaaaacacacatgatg

SEQ ID NO: 736388 - DNA, 20 bp, Artificial
  CRISPR gRNA sequence
tgattgctgtcataactaag

SEQ ID NO: 736389 - DNA, 20 bp, Artificial
  CRISPR gRNA sequence
ttgtgtgaggaaattgaggg

SEQ ID NO: 736390 - DNA, 20 bp, Artificial
  CRISPR gRNA sequence
gagccaatgcagagagggtc

SEQ ID NO: 736391 - DNA, 20 bp, Artificial
  CRISPR gRNA sequence
gagagggtccagagctttat

SEQ ID NO: 736392 - DNA, 20 bp, Artificial
  CRISPR gRNA sequence
tcttggcttgggaggcctgg

SEQ ID NO: 736393 - DNA, 20 bp, Artificial
  CRISPR gRNA sequence
ccactgcccccagccaaccg

SEQ ID NO: 736394 - DNA, 20 bp, Artificial
  CRISPR gRNA sequence
attatgagggcggtgctggc

SEQ ID NO: 736395 - DNA, 20 bp, Artificial
  CRISPR gRNA sequence
ctgcctcacttccctaaatg

SEQ ID NO: 736396 - DNA, 20 bp, Artificial
  CRISPR gRNA sequence
tttttcttaccctccttacc

SEQ ID NO: 736397 - DNA, 20 bp, Artificial
  CRISPR gRNA sequence
accctccttaccagcagttt

SEQ ID NO: 736398 - DNA, 20 bp, Artificial
  CRISPR gRNA sequence
ttaccagcagttttcttgtt

SEQ ID NO: 736399 - DNA, 20 bp, Artificial
  CRISPR gRNA sequence
gttttgtgggttggggaagg

SEQ ID NO: 736400 - DNA, 20 bp, Artificial
  CRISPR gRNA sequence
tgcattggctcctttatctg

SEQ ID NO: 736401 - DNA, 20 bp, Artificial
  CRISPR gRNA sequence
cctttatctgctaggcttcc

SEQ ID NO: 736402 - DNA, 20 bp, Artificial
  CRISPR gRNA sequence
gccctcaatttcctcacaca

SEQ ID NO: 736403 - DNA, 20 bp, Artificial
  CRISPR gRNA sequence
ttcctcacacaaatagcttt

SEQ ID NO: 736404 - DNA, 20 bp, Artificial
  CRISPR gRNA sequence
gcttggcctctgtcaggaag

SEQ ID NO: 736405 - DNA, 20 bp, Artificial
  CRISPR gRNA sequence
gacagcaatcattgcatcat

SEQ ID NO: 736406 - DNA, 20 bp, Artificial
  CRISPR gRNA sequence
cacctcccagagggtagaga

SEQ ID NO: 736407 - DNA, 20 bp, Artificial
  CRISPR gRNA sequence
caaataatgaagttggatca

SEQ ID NO: 736408 - DNA, 20 bp, Artificial
  CRISPR gRNA sequence
aatgaagttggatcattctg

SEQ ID NO: 736409 - DNA, 20 bp, Artificial
  CRISPR gRNA sequence
ttagtttgcaagggacagag

SEQ ID NO: 736410 - DNA, 20 bp, Artificial
  CRISPR gRNA sequence
agagggatgcttagagaggg

SEQ ID NO: 736411 - DNA, 20 bp, Artificial
  CRISPR gRNA sequence
ctgggacttgggacggatat

SEQ ID NO: 736412 - DNA, 20 bp, Artificial
  CRISPR gRNA sequence
gattctggtgggacagatgt

SEQ ID NO: 736413 - DNA, 20 bp, Artificial
  CRISPR gRNA sequence
tatttctgtatcagtcaagt

SEQ ID NO: 736414 - DNA, 20 bp, Artificial
  CRISPR gRNA sequence
acaccactaagtggtagaaa

SEQ ID NO: 736415 - DNA, 20 bp, Artificial
  CRISPR gRNA sequence
ggtagaaacagggtttcaac

SEQ ID NO: 736416 - DNA, 20 bp, Artificial
  CRISPR gRNA sequence
tgggggagagtctttttata

SEQ ID NO: 736417 - DNA, 20 bp, Artificial
  CRISPR gRNA sequence
gaaattatcagaagagtcag

SEQ ID NO: 736418 - DNA, 20 bp, Artificial
  CRISPR gRNA sequence
gaggggtggagggagcccaa

SEQ ID NO: 736419 - DNA, 20 bp, Artificial
  CRISPR gRNA sequence
ctgctctgtctctaccagac

SEQ ID NO: 736420 - DNA, 20 bp, Artificial
  CRISPR gRNA sequence
tctaccagactgtggattat

SEQ ID NO: 736421 - DNA, 20 bp, Artificial
  CRISPR gRNA sequence
cctgtggttcacactccatt

SEQ ID NO: 736422 - DNA, 20 bp, Artificial
  CRISPR gRNA sequence
tggttcacactccattggga

SEQ ID NO: 736423 - DNA, 20 bp, Artificial
  CRISPR gRNA sequence
ttgtttacatgtatatttag

SEQ ID NO: 736424 - DNA, 20 bp, Artificial
  CRISPR gRNA sequence
tatttagacaggcttgatct

SEQ ID NO: 736425 - DNA, 20 bp, Artificial
  CRISPR gRNA sequence
tgttaatcatattttcaaat

SEQ ID NO: 736426 - DNA, 20 bp, Artificial
  CRISPR gRNA sequence
aaatttcacaacttaatgac

SEQ ID NO: 736427 - DNA, 20 bp, Artificial
  CRISPR gRNA sequence
tgtctcactgagggcatgac

SEQ ID NO: 736428 - DNA, 20 bp, Artificial
  CRISPR gRNA sequence
ggcaggtggatcacgaagtc

SEQ ID NO: 736429 - DNA, 20 bp, Artificial
  CRISPR gRNA sequence
tcaggaggctgaggcaggag

SEQ ID NO: 736430 - DNA, 20 bp, Artificial
  CRISPR gRNA sequence
tccctgggaatccctgaaga

SEQ ID NO: 736431 - DNA, 20 bp, Artificial
  CRISPR gRNA sequence
tggagctccgagtgtaaatg

SEQ ID NO: 736432 - DNA, 20 bp, Artificial
  CRISPR gRNA sequence
ccactgtaatactggaagct

SEQ ID NO: 736433 - DNA, 20 bp, Artificial
  CRISPR gRNA sequence
tcagggcccattcacctccc

SEQ ID NO: 736434 - DNA, 20 bp, Artificial
  CRISPR gRNA sequence
tacaaaaaccgcgtggaggg

SEQ ID NO: 736435 - DNA, 20 bp, Artificial
  CRISPR gRNA sequence
tcaggaagaagaagtgtgag

SEQ ID NO: 736436 - DNA, 20 bp, Artificial
  CRISPR gRNA sequence
ctgggatcctgtaccccttg

SEQ ID NO: 736437 - DNA, 20 bp, Artificial
  CRISPR gRNA sequence
tcagtggtcatgttgcactg

SEQ ID NO: 736438 - DNA, 20 bp, Artificial
  CRISPR gRNA sequence
cctgaaaacccagtgtgact

SEQ ID NO: 736439 - DNA, 20 bp, Artificial
  CRISPR gRNA sequence
caaacttggcactgtctgtg

SEQ ID NO: 736440 - DNA, 20 bp, Artificial
  CRISPR gRNA sequence
tgtgctgtgttttattcact

SEQ ID NO: 736441 - DNA, 20 bp, Artificial
  CRISPR gRNA sequence
ggtgttcataagaaactagg

SEQ ID NO: 736442 - DNA, 20 bp, Artificial
  CRISPR gRNA sequence
ttccagccctgttgaaatct

SEQ ID NO: 736443 - DNA, 20 bp, Artificial
  CRISPR gRNA sequence
gcaaaggtcctgaggtcaga

SEQ ID NO: 736444 - DNA, 20 bp, Artificial
  CRISPR gRNA sequence
ggtcctgaggtcagaaggag

SEQ ID NO: 736445 - DNA, 20 bp, Artificial
  CRISPR gRNA sequence
cagaaggagcttggcttgta

SEQ ID NO: 736446 - DNA, 20 bp, Artificial
  CRISPR gRNA sequence
gagctcagagagctgtcatg

SEQ ID NO: 736447 - DNA, 20 bp, Artificial
  CRISPR gRNA sequence
tgtagtggccacttgttgag

SEQ ID NO: 736448 - DNA, 20 bp, Artificial
  CRISPR gRNA sequence
agatgtgaatgggctcaaat

SEQ ID NO: 736449 - DNA, 20 bp, Artificial
  CRISPR gRNA sequence
tcagactttctgttcagctc

SEQ ID NO: 736450 - DNA, 20 bp, Artificial
  CRISPR gRNA sequence
tcatatgttttgaaggtagg

SEQ ID NO: 736451 - DNA, 20 bp, Artificial
  CRISPR gRNA sequence
aggaggaatcatggatgatc

SEQ ID NO: 736452 - DNA, 20 bp, Artificial
  CRISPR gRNA sequence
aagagctctcttttgtcatg

SEQ ID NO: 736453 - DNA, 20 bp, Artificial
  CRISPR gRNA sequence
tgaaagtatctctataaaga

SEQ ID NO: 736454 - DNA, 20 bp, Artificial
  CRISPR gRNA sequence
agaaatctacagacacagaa

SEQ ID NO: 736455 - DNA, 20 bp, Artificial
  CRISPR gRNA sequence
gacacagaaagtagattagt

SEQ ID NO: 736456 - DNA, 20 bp, Artificial
  CRISPR gRNA sequence
agaatcatagataaacagta

SEQ ID NO: 736457 - DNA, 20 bp, Artificial
  CRISPR gRNA sequence
gtaagcataataaagaacca

SEQ ID NO: 736458 - DNA, 20 bp, Artificial
  CRISPR gRNA sequence
ggatagaaacattaaacatt

SEQ ID NO: 736459 - DNA, 20 bp, Artificial
  CRISPR gRNA sequence
cacctcttaaggacaatttg

SEQ ID NO: 736460 - DNA, 20 bp, Artificial
  CRISPR gRNA sequence
attccactgccccctgaaga

SEQ ID NO: 736461 - DNA, 20 bp, Artificial
  CRISPR gRNA sequence
gagggagggggagatggtta

SEQ ID NO: 736462 - DNA, 20 bp, Artificial
  CRISPR gRNA sequence
ggcttaactgagtgttgtag

SEQ ID NO: 736463 - DNA, 20 bp, Artificial
  CRISPR gRNA sequence
atgctttccctgttggatgt

SEQ ID NO: 736464 - DNA, 20 bp, Artificial
  CRISPR gRNA sequence
tctattcccatcctcaccaa

SEQ ID NO: 736465 - DNA, 20 bp, Artificial
  CRISPR gRNA sequence
cctcatccactgtccaaaac

SEQ ID NO: 736466 - DNA, 20 bp, Artificial
  CRISPR gRNA sequence
tgatgggtgagtgtagcagg

SEQ ID NO: 736467 - DNA, 20 bp, Artificial
  CRISPR gRNA sequence
agtgtctgaccccaactgac

SEQ ID NO: 736468 - DNA, 20 bp, Artificial
  CRISPR gRNA sequence
tatggaatagctggaaaagt

SEQ ID NO: 736469 - DNA, 20 bp, Artificial
  CRISPR gRNA sequence
agaagaggacaggcccccat

SEQ ID NO: 736470 - DNA, 20 bp, Artificial
  CRISPR gRNA sequence
gacctgcctccaagacaggc

SEQ ID NO: 736471 - DNA, 20 bp, Artificial
  CRISPR gRNA sequence
ctccccaggaacccaatgtg

SEQ ID NO: 736472 - DNA, 20 bp, Artificial
  CRISPR gRNA sequence
agtaggaagtggaaaatggg

SEQ ID NO: 736473 - DNA, 20 bp, Artificial
  CRISPR gRNA sequence
gaaaatgggggatgctttaa

SEQ ID NO: 736474 - DNA, 20 bp, Artificial
  CRISPR gRNA sequence
tagagaaactgactctgagt

SEQ ID NO: 736475 - DNA, 20 bp, Artificial
  CRISPR gRNA sequence
aatcctcatcctcactgatg

SEQ ID NO: 736476 - DNA, 20 bp, Artificial
  CRISPR gRNA sequence
ctcttaactccggatgtcac

SEQ ID NO: 736477 - DNA, 20 bp, Artificial
  CRISPR gRNA sequence
ccccgggaagggcacgctct

SEQ ID NO: 736478 - DNA, 20 bp, Artificial
  CRISPR gRNA sequence
gatgggggaccttggtgctc

SEQ ID NO: 736479 - DNA, 20 bp, Artificial
  CRISPR gRNA sequence
tcccttcttctcaggcacca

SEQ ID NO: 736480 - DNA, 20 bp, Artificial
  CRISPR gRNA sequence
gcaccaggatgtttactcca

SEQ ID NO: 736481 - DNA, 20 bp, Artificial
  CRISPR gRNA sequence
gctgatgctgatcatggtct

SEQ ID NO: 736482 - DNA, 20 bp, Artificial
  CRISPR gRNA sequence
gtgtccagtcaaaaggacta

SEQ ID NO: 736483 - DNA, 20 bp, Artificial
  CRISPR gRNA sequence
caggacacttcctcagctct

SEQ ID NO: 736484 - DNA, 20 bp, Artificial
  CRISPR gRNA sequence
ggccacttaagcatggggtg

SEQ ID NO: 736485 - DNA, 20 bp, Artificial
  CRISPR gRNA sequence
ccagggggttagaggagggg

SEQ ID NO: 736486 - DNA, 20 bp, Artificial
  CRISPR gRNA sequence
agtcccgaggaaatgtgacc

SEQ ID NO: 736487 - DNA, 20 bp, Artificial
  CRISPR gRNA sequence
aggcaggggaaccctgagag

SEQ ID NO: 736488 - DNA, 20 bp, Artificial
  CRISPR gRNA sequence
cccaccagggccactgtgtc

SEQ ID NO: 736489 - DNA, 20 bp, Artificial
  CRISPR gRNA sequence
gtgtcctctgcttccctccg

SEQ ID NO: 736490 - DNA, 20 bp, Artificial
  CRISPR gRNA sequence
tctgcttccctccgttctgc

SEQ ID NO: 736491 - DNA, 20 bp, Artificial
  CRISPR gRNA sequence
tggggacccacagaggggtt

SEQ ID NO: 736492 - DNA, 20 bp, Artificial
  CRISPR gRNA sequence
ctggacttggggctctctcc

SEQ ID NO: 736493 - DNA, 20 bp, Artificial
  CRISPR gRNA sequence
cagcctctattgtccagagc

SEQ ID NO: 736494 - DNA, 20 bp, Artificial
  CRISPR gRNA sequence
atgaaggctggagaatgcag

SEQ ID NO: 736495 - DNA, 20 bp, Artificial
  CRISPR gRNA sequence
ggcaccagtaccactgatgg

SEQ ID NO: 736496 - DNA, 20 bp, Artificial
  CRISPR gRNA sequence
aggacaataattcctacttc

SEQ ID NO: 736497 - DNA, 20 bp, Artificial
  CRISPR gRNA sequence
caataattcctacttctcaa

SEQ ID NO: 736498 - DNA, 20 bp, Artificial
  CRISPR gRNA sequence
ctcattaccattattcctta

SEQ ID NO: 736499 - DNA, 20 bp, Artificial
  CRISPR gRNA sequence
aagttgttttccagctctaa

SEQ ID NO: 736500 - DNA, 20 bp, Artificial
  CRISPR gRNA sequence
ccaacattacatttaagacc

SEQ ID NO: 736501 - DNA, 20 bp, Artificial
  CRISPR gRNA sequence
ttacatttaagaccttagga

SEQ ID NO: 736502 - DNA, 20 bp, Artificial
  CRISPR gRNA sequence
taagaccttaggattctgtt

SEQ ID NO: 736503 - DNA, 20 bp, Artificial
  CRISPR gRNA sequence
aagtcactgtccctctctga

SEQ ID NO: 736504 - DNA, 20 bp, Artificial
  CRISPR gRNA sequence
agatatgggaacttgcacag

SEQ ID NO: 736505 - DNA, 20 bp, Artificial
  CRISPR gRNA sequence
agatgagctgcccagtcctc

SEQ ID NO: 736506 - DNA, 20 bp, Artificial
  CRISPR gRNA sequence
caggcctcctctccacagca

SEQ ID NO: 736507 - DNA, 20 bp, Artificial
  CRISPR gRNA sequence
tgaaagtttaatgagtgaga

SEQ ID NO: 736508 - DNA, 20 bp, Artificial
  CRISPR gRNA sequence
gttgaatgtaaaggctttta

SEQ ID NO: 736509 - DNA, 20 bp, Artificial
  CRISPR gRNA sequence
tcaggctgttcttttgttta

SEQ ID NO: 736510 - DNA, 20 bp, Artificial
  CRISPR gRNA sequence
gggaagagatatgacaaaag

SEQ ID NO: 736511 - DNA, 20 bp, Artificial
  CRISPR gRNA sequence
agatatgacaaaagcaagaa

SEQ ID NO: 736512 - DNA, 20 bp, Artificial
  CRISPR gRNA sequence
cctggggtctgcagctccga

SEQ ID NO: 736513 - DNA, 20 bp, Artificial
  CRISPR gRNA sequence
gctgcacatgctgtagcctg

SEQ ID NO: 736514 - DNA, 20 bp, Artificial
  CRISPR gRNA sequence
acgttgggatcggaccagca

SEQ ID NO: 736515 - DNA, 20 bp, Artificial
  CRISPR gRNA sequence
tcagtttggggagctgaaag

SEQ ID NO: 736516 - DNA, 20 bp, Artificial
  CRISPR gRNA sequence
gtgatcagatgtgtatttgt

SEQ ID NO: 736517 - DNA, 20 bp, Artificial
  CRISPR gRNA sequence
catcaaggtcctcaaattcc

SEQ ID NO: 736518 - DNA, 20 bp, Artificial
  CRISPR gRNA sequence
acacccccaaagaactcttc

SEQ ID NO: 736519 - DNA, 20 bp, Artificial
  CRISPR gRNA sequence
attttttttatttcctaata

SEQ ID NO: 736520 - DNA, 20 bp, Artificial
  CRISPR gRNA sequence
aacatgattagaggaaatga

SEQ ID NO: 736521 - DNA, 20 bp, Artificial
  CRISPR gRNA sequence
gaacaccttcatcatctcca

SEQ ID NO: 736522 - DNA, 20 bp, Artificial
  CRISPR gRNA sequence
atcatccacctgctgatcaa

SEQ ID NO: 736523 - DNA, 20 bp, Artificial
  CRISPR gRNA sequence
cttcaaaacatatgagctga

SEQ ID NO: 736524 - DNA, 20 bp, Artificial
  CRISPR gRNA sequence
gctcactgtctccttagagc

SEQ ID NO: 736525 - DNA, 20 bp, Artificial
  CRISPR gRNA sequence
tgcccaactaactaggtaga

SEQ ID NO: 736526 - DNA, 20 bp, Artificial
  CRISPR gRNA sequence
gactcaggggacagagagag

SEQ ID NO: 736527 - DNA, 20 bp, Artificial
  CRISPR gRNA sequence
gattaggtcacctgtttgat

SEQ ID NO: 736528 - DNA, 20 bp, Artificial
  CRISPR gRNA sequence
aaaacagacacttgactgat

SEQ ID NO: 736529 - DNA, 20 bp, Artificial
  CRISPR gRNA sequence
ctgtttctttatcagtcaag

SEQ ID NO: 736530 - DNA, 20 bp, Artificial
  CRISPR gRNA sequence
acacccctcacaggttgctg

SEQ ID NO: 736531 - DNA, 20 bp, Artificial
  CRISPR gRNA sequence
gagctgtgacagtcaagggc

SEQ ID NO: 736532 - DNA, 20 bp, Artificial
  CRISPR gRNA sequence
aatccaggacatctgtccca

SEQ ID NO: 736533 - DNA, 20 bp, Artificial
  CRISPR gRNA sequence
ctctgtcccttgcaaactaa

SEQ ID NO: 736534 - DNA, 20 bp, Artificial
  CRISPR gRNA sequence
aggatgtggcatcagcattt

SEQ ID NO: 736535 - DNA, 20 bp, Artificial
  CRISPR gRNA sequence
cttcctgacagaggccaagc

SEQ ID NO: 736536 - DNA, 20 bp, Artificial
  CRISPR gRNA sequence
ccaacccacaaaacactaaa

SEQ ID NO: 736537 - DNA, 20 bp, Artificial
  CRISPR gRNA sequence
aaaactgctggtaaggaggg

SEQ ID NO: 736538 - DNA, 20 bp, Artificial
  CRISPR gRNA sequence
ctctgcacctcccagagggt

SEQ ID NO: 736539 - DNA, 20 bp, Artificial
  CRISPR gRNA sequence
aacagcttcccactgccagg

SEQ ID NO: 736540 - DNA, 20 bp, Artificial
  CRISPR gRNA sequence
gaaaggggtctctcttgtgc

SEQ ID NO: 736541 - DNA, 20 bp, Artificial
  CRISPR gRNA sequence
gtgcaaagcactgacctggg

SEQ ID NO: 736542 - DNA, 20 bp, Artificial
  CRISPR gRNA sequence
gctattctcacttgactgat

SEQ ID NO: 736543 - DNA, 20 bp, Artificial
  CRISPR gRNA sequence
cctaatcacaccactaagtg

SEQ ID NO: 736544 - DNA, 20 bp, Artificial
  CRISPR gRNA sequence
catcttactcctcagcatag

SEQ ID NO: 736545 - DNA, 20 bp, Artificial
  CRISPR gRNA sequence
caggtggaaagtgaataatt

SEQ ID NO: 736546 - DNA, 20 bp, Artificial
  CRISPR gRNA sequence
gatctatgggttttatgtaa

SEQ ID NO: 736547 - DNA, 20 bp, Artificial
  CRISPR gRNA sequence
catgacctgggtttttccca

SEQ ID NO: 736548 - DNA, 20 bp, Artificial
  CRISPR gRNA sequence
ctactcaggaggctgaggca

SEQ ID NO: 736549 - DNA, 20 bp, Artificial
  CRISPR gRNA sequence
cttgtcactttcccatcaga

SEQ ID NO: 736550 - DNA, 20 bp, Artificial
  CRISPR gRNA sequence
tattatccagacaaataatt

SEQ ID NO: 736551 - DNA, 20 bp, Artificial
  CRISPR gRNA sequence
cagaaaacaagaggtgttca

SEQ ID NO: 736552 - DNA, 20 bp, Artificial
  CRISPR gRNA sequence
gagctgtcatgacttgtttt

SEQ ID NO: 736553 - DNA, 20 bp, Artificial
  CRISPR gRNA sequence
gaaagaggagctaatttgga

SEQ ID NO: 736554 - DNA, 20 bp, Artificial
  CRISPR gRNA sequence
tgtttaaagtccagggaatt

SEQ ID NO: 736555 - DNA, 20 bp, Artificial
  CRISPR gRNA sequence
aattagagaaatctacagac

SEQ ID NO: 736556 - DNA, 20 bp, Artificial
  CRISPR gRNA sequence
tgggggaaggaaaaggggat

SEQ ID NO: 736557 - DNA, 20 bp, Artificial
  CRISPR gRNA sequence
ggtccttccacatttattag

SEQ ID NO: 736558 - DNA, 20 bp, Artificial
  CRISPR gRNA sequence
tgaagtcttaatatttaggg

SEQ ID NO: 736559 - DNA, 20 bp, Artificial
  CRISPR gRNA sequence
cttgttctgggtccccttct

SEQ ID NO: 736560 - DNA, 20 bp, Artificial
  CRISPR gRNA sequence
gtccaaaacccaggcttctt

SEQ ID NO: 736561 - DNA, 20 bp, Artificial
  CRISPR gRNA sequence
tggcctgacacgggagggaa

SEQ ID NO: 736562 - DNA, 20 bp, Artificial
  CRISPR gRNA sequence
cacatctgatcactcagcag

SEQ ID NO: 736563 - DNA, 20 bp, Artificial
  CRISPR gRNA sequence
ccagggactcctctgctggc

SEQ ID NO: 736564 - DNA, 20 bp, Artificial
  CRISPR gRNA sequence
gtagggggcaatgagagttg

SEQ ID NO: 736565 - DNA, 20 bp, Artificial
  CRISPR gRNA sequence
gctttaatttggattcctct

SEQ ID NO: 736566 - DNA, 20 bp, Artificial
  CRISPR gRNA sequence
catagagggctctagtgaca

SEQ ID NO: 736567 - DNA, 20 bp, Artificial
  CRISPR gRNA sequence
aaggcctcagcctcccaccc

SEQ ID NO: 736568 - DNA, 20 bp, Artificial
  CRISPR gRNA sequence
tagccacaaatgggagtctc

SEQ ID NO: 736569 - DNA, 20 bp, Artificial
  CRISPR gRNA sequence
ggaaggaaccagaggcagag

SEQ ID NO: 736570 - DNA, 20 bp, Artificial
  CRISPR gRNA sequence
cccagagcaaagggcatcag

SEQ ID NO: 736571 - DNA, 20 bp, Artificial
  CRISPR gRNA sequence
aacctcagctcccgtctgcc

SEQ ID NO: 736572 - DNA, 20 bp, Artificial
  CRISPR gRNA sequence
cagcttcccctaaggttagg

SEQ ID NO: 736573 - DNA, 20 bp, Artificial
  CRISPR gRNA sequence
ttcccctaaggttagggaag

SEQ ID NO: 736574 - DNA, 20 bp, Artificial
  CRISPR gRNA sequence
tcctgctggccgctgcctcc

SEQ ID NO: 736575 - DNA, 20 bp, Artificial
  CRISPR gRNA sequence
ggcgtccagcaatgaaggct

SEQ ID NO: 736576 - DNA, 20 bp, Artificial
  CRISPR gRNA sequence
atagagggaagactgaggct

SEQ ID NO: 736577 - DNA, 20 bp, Artificial
  CRISPR gRNA sequence
tctggagaaggagtgagaga

SEQ ID NO: 736578 - DNA, 20 bp, Artificial
  CRISPR gRNA sequence
aggagtgagagaggagaaag

SEQ ID NO: 736579 - DNA, 20 bp, Artificial
  CRISPR gRNA sequence
gcagttagggtgggttctcg

SEQ ID NO: 736580 - DNA, 20 bp, Artificial
  CRISPR gRNA sequence
agaaggacagcagggagcta

SEQ ID NO: 736581 - DNA, 20 bp, Artificial
  CRISPR gRNA sequence
tggaaacaacattagagctg

SEQ ID NO: 736582 - DNA, 20 bp, Artificial
  CRISPR gRNA sequence
tgctaatgttattttatctt

SEQ ID NO: 736583 - DNA, 20 bp, Artificial
  CRISPR gRNA sequence
ttgccatgtgtctcttcttc

SEQ ID NO: 736584 - DNA, 20 bp, Artificial
  CRISPR gRNA sequence
actttagatgccttggacca

SEQ ID NO: 736585 - DNA, 20 bp, Artificial
  CRISPR gRNA sequence
atccacctgctgatcaaata

SEQ ID NO: 736586 - DNA, 20 bp, Artificial
  CRISPR gRNA sequence
agcaaatcctgtcctacctt

SEQ ID NO: 736587 - DNA, 20 bp, Artificial
  CRISPR gRNA sequence
tgagctgaacagaaagtctg

SEQ ID NO: 736588 - DNA, 20 bp, Artificial
  CRISPR gRNA sequence
caagtggccactacattctt

SEQ ID NO: 736589 - DNA, 20 bp, Artificial
  CRISPR gRNA sequence
atgttgaagcaatgagtgaa

SEQ ID NO: 736590 - DNA, 20 bp, Artificial
  CRISPR gRNA sequence
tagtgccataaaggcactct

SEQ ID NO: 736591 - DNA, 20 bp, Artificial
  CRISPR gRNA sequence
aagggaggtgaatgggccct

SEQ ID NO: 736592 - DNA, 20 bp, Artificial
  CRISPR gRNA sequence
tcccagggaattcttgtggg

SEQ ID NO: 736593 - DNA, 20 bp, Artificial
  CRISPR gRNA sequence
tttaaaatattctagttaca

SEQ ID NO: 736594 - DNA, 20 bp, Artificial
  CRISPR gRNA sequence
ttcaccccagagtcttccaa

SEQ ID NO: 736595 - DNA, 20 bp, Artificial
  CRISPR gRNA sequence
cctgtttgatacagaaatat

SEQ ID NO: 736596 - DNA, 20 bp, Artificial
  CRISPR gRNA sequence
aaaaatgttcaaattcagtt

SEQ ID NO: 736597 - DNA, 20 bp, Artificial
  CRISPR gRNA sequence
tctcctccttccccaaccca

SEQ ID NO: 736598 - DNA, 20 bp, Artificial
  CRISPR gRNA sequence
acccacaaaacactaaacaa

SEQ ID NO: 736599 - DNA, 20 bp, Artificial
  CRISPR gRNA sequence
ctgggcatggtgggggttgg

SEQ ID NO: 736600 - DNA, 20 bp, Artificial
  CRISPR gRNA sequence
tttatgtaactagaatattt

SEQ ID NO: 736601 - DNA, 20 bp, Artificial
  CRISPR gRNA sequence
acagagcgagactccgtctc

SEQ ID NO: 736602 - DNA, 20 bp, Artificial
  CRISPR gRNA sequence
gcgagactccgtctcaaaaa

SEQ ID NO: 736603 - DNA, 20 bp, Artificial
  CRISPR gRNA sequence
actccgtctcaaaaacaaaa

SEQ ID NO: 736604 - DNA, 20 bp, Artificial
  CRISPR gRNA sequence
gtctcaaaaacaaaacaaaa

SEQ ID NO: 736605 - DNA, 20 bp, Artificial
  CRISPR gRNA sequence
aaaaacaaaacaaaacaaaa

SEQ ID NO: 736606 - DNA, 20 bp, Artificial
  CRISPR gRNA sequence
caaaacaaaacaaaacaaaa

SEQ ID NO: 736607 - DNA, 20 bp, Artificial
  CRISPR gRNA sequence
agtgctcctataagggctac

SEQ ID NO: 736608 - DNA, 20 bp, Artificial
  CRISPR gRNA sequence
agatgaagataatgagacct

SEQ ID NO: 736609 - DNA, 20 bp, Artificial
  CRISPR gRNA sequence
gctctaaggagacagtgagc

SEQ ID NO: 736610 - DNA, 20 bp, Artificial
  CRISPR gRNA sequence
tatccagacaaataattgca

SEQ ID NO: 736611 - DNA, 20 bp, Artificial
  CRISPR gRNA sequence
tttcacattccatgctgaga

SEQ ID NO: 736612 - DNA, 20 bp, Artificial
  CRISPR gRNA sequence
ctccctcctcatccactgtc

SEQ ID NO: 736613 - DNA, 20 bp, Artificial
  CRISPR gRNA sequence
ggggagagtcagatctagca

SEQ ID NO: 736614 - DNA, 20 bp, Artificial
  CRISPR gRNA sequence
tcattgtttgaggtatcact

SEQ ID NO: 736615 - DNA, 20 bp, Artificial
  CRISPR gRNA sequence
attgtttgaggtatcactgg

SEQ ID NO: 736616 - DNA, 20 bp, Artificial
  CRISPR gRNA sequence
tttgaggtatcactggagtt

SEQ ID NO: 736617 - DNA, 20 bp, Artificial
  CRISPR gRNA sequence
gaggtatcactggagttctt

SEQ ID NO: 736618 - DNA, 20 bp, Artificial
  CRISPR gRNA sequence
aggtatcactggagttcttt

SEQ ID NO: 736619 - DNA, 20 bp, Artificial
  CRISPR gRNA sequence
gagttctttgtctcacaaca

SEQ ID NO: 736620 - DNA, 20 bp, Artificial
  CRISPR gRNA sequence
tttgtctcacaacaatgaaa

SEQ ID NO: 736621 - DNA, 20 bp, Artificial
  CRISPR gRNA sequence
tgtctcacaacaatgaaaat

SEQ ID NO: 736622 - DNA, 20 bp, Artificial
  CRISPR gRNA sequence
gtctcacaacaatgaaaatt

SEQ ID NO: 736623 - DNA, 20 bp, Artificial
  CRISPR gRNA sequence
tctcacaacaatgaaaatta

SEQ ID NO: 736624 - DNA, 20 bp, Artificial
  CRISPR gRNA sequence
acaacaatgaaaattaagga

SEQ ID NO: 736625 - DNA, 20 bp, Artificial
  CRISPR gRNA sequence
aggagcgtggacaccaagga

SEQ ID NO: 736626 - DNA, 20 bp, Artificial
  CRISPR gRNA sequence
gagtgaaagtttaatgagtg

SEQ ID NO: 736627 - DNA, 20 bp, Artificial
  CRISPR gRNA sequence
aatgagtgagagaagaaagc

SEQ ID NO: 736628 - DNA, 20 bp, Artificial
  CRISPR gRNA sequence
atgagtgagagaagaaagct

SEQ ID NO: 736629 - DNA, 20 bp, Artificial
  CRISPR gRNA sequence
tctgctgtggagaggaggcc

SEQ ID NO: 736630 - DNA, 20 bp, Artificial
  CRISPR gRNA sequence
tgctgtggagaggaggcctg

SEQ ID NO: 736631 - DNA, 20 bp, Artificial
  CRISPR gRNA sequence
ctgtggagaggaggcctgaa

SEQ ID NO: 736632 - DNA, 20 bp, Artificial
  CRISPR gRNA sequence
tggagaggaggcctgaaaga

SEQ ID NO: 736633 - DNA, 20 bp, Artificial
  CRISPR gRNA sequence
aaagagggttgccattttta

SEQ ID NO: 736634 - DNA, 20 bp, Artificial
  CRISPR gRNA sequence
ccatttttacagttgaatgt

SEQ ID NO: 736635 - DNA, 20 bp, Artificial
  CRISPR gRNA sequence
ttacagttgaatgtaaaggc

SEQ ID NO: 736636 - DNA, 20 bp, Artificial
  CRISPR gRNA sequence
tacagttgaatgtaaaggct

SEQ ID NO: 736637 - DNA, 20 bp, Artificial
  CRISPR gRNA sequence
acagttgaatgtaaaggctt

SEQ ID NO: 736638 - DNA, 20 bp, Artificial
  CRISPR gRNA sequence
cagttgaatgtaaaggcttt

SEQ ID NO: 736639 - DNA, 20 bp, Artificial
  CRISPR gRNA sequence
aatgtaaaggcttttataag

SEQ ID NO: 736640 - DNA, 20 bp, Artificial
  CRISPR gRNA sequence
ttataagaaaccgatgagga

SEQ ID NO: 736641 - DNA, 20 bp, Artificial
  CRISPR gRNA sequence
tataagaaaccgatgaggac

SEQ ID NO: 736642 - DNA, 20 bp, Artificial
  CRISPR gRNA sequence
ataagaaaccgatgaggact

SEQ ID NO: 736643 - DNA, 20 bp, Artificial
  CRISPR gRNA sequence
taagaaaccgatgaggactg

SEQ ID NO: 736644 - DNA, 20 bp, Artificial
  CRISPR gRNA sequence
ggcagctcatctgcataagg

SEQ ID NO: 736645 - DNA, 20 bp, Artificial
  CRISPR gRNA sequence
atctgcataaggcatgaatt

SEQ ID NO: 736646 - DNA, 20 bp, Artificial
  CRISPR gRNA sequence
cataaggcatgaatttctgg

SEQ ID NO: 736647 - DNA, 20 bp, Artificial
  CRISPR gRNA sequence
ctggtagctccctgctgtcc

SEQ ID NO: 736648 - DNA, 20 bp, Artificial
  CRISPR gRNA sequence
tggtagctccctgctgtcct

SEQ ID NO: 736649 - DNA, 20 bp, Artificial
  CRISPR gRNA sequence
gtagctccctgctgtccttc

SEQ ID NO: 736650 - DNA, 20 bp, Artificial
  CRISPR gRNA sequence
cctgctgtccttctaatgta

SEQ ID NO: 736651 - DNA, 20 bp, Artificial
  CRISPR gRNA sequence
ctgtccttctaatgtacatg

SEQ ID NO: 736652 - DNA, 20 bp, Artificial
  CRISPR gRNA sequence
tccttctaatgtacatgtgg

SEQ ID NO: 736653 - DNA, 20 bp, Artificial
  CRISPR gRNA sequence
ctaatgtacatgtgggccct

SEQ ID NO: 736654 - DNA, 20 bp, Artificial
  CRISPR gRNA sequence
taatgtacatgtgggccctt

SEQ ID NO: 736655 - DNA, 20 bp, Artificial
  CRISPR gRNA sequence
atgtacatgtgggcccttgg

SEQ ID NO: 736656 - DNA, 20 bp, Artificial
  CRISPR gRNA sequence
ggcttgagttacttactcca

SEQ ID NO: 736657 - DNA, 20 bp, Artificial
  CRISPR gRNA sequence
gcttgagttacttactccat

SEQ ID NO: 736658 - DNA, 20 bp, Artificial
  CRISPR gRNA sequence
gagttacttactccatattg

SEQ ID NO: 736659 - DNA, 20 bp, Artificial
  CRISPR gRNA sequence
agttacttactccatattgc

SEQ ID NO: 736660 - DNA, 20 bp, Artificial
  CRISPR gRNA sequence
cttactccatattgctttgt

SEQ ID NO: 736661 - DNA, 20 bp, Artificial
  CRISPR gRNA sequence
actccatattgctttgttcc

SEQ ID NO: 736662 - DNA, 20 bp, Artificial
  CRISPR gRNA sequence
ctccatattgctttgttccc

SEQ ID NO: 736663 - DNA, 20 bp, Artificial
  CRISPR gRNA sequence
catattgctttgttcccctt

SEQ ID NO: 736664 - DNA, 20 bp, Artificial
  CRISPR gRNA sequence
ctttgttccccttactgcac

SEQ ID NO: 736665 - DNA, 20 bp, Artificial
  CRISPR gRNA sequence
tgttccccttactgcacatg

SEQ ID NO: 736666 - DNA, 20 bp, Artificial
  CRISPR gRNA sequence
gttccccttactgcacatgt

SEQ ID NO: 736667 - DNA, 20 bp, Artificial
  CRISPR gRNA sequence
ttccccttactgcacatgtc

SEQ ID NO: 736668 - DNA, 20 bp, Artificial
  CRISPR gRNA sequence
cccttactgcacatgtcagg

SEQ ID NO: 736669 - DNA, 20 bp, Artificial
  CRISPR gRNA sequence
actgcacatgtcaggggatg

SEQ ID NO: 736670 - DNA, 20 bp, Artificial
  CRISPR gRNA sequence
ctgcacatgtcaggggatga

SEQ ID NO: 736671 - DNA, 20 bp, Artificial
  CRISPR gRNA sequence
cacatgtcaggggatgaaat

SEQ ID NO: 736672 - DNA, 20 bp, Artificial
  CRISPR gRNA sequence
tccattgcaggcatgtttgg

SEQ ID NO: 736673 - DNA, 20 bp, Artificial
  CRISPR gRNA sequence
ccattgcaggcatgtttggg

SEQ ID NO: 736674 - DNA, 20 bp, Artificial
  CRISPR gRNA sequence
cattgcaggcatgtttgggc

SEQ ID NO: 736675 - DNA, 20 bp, Artificial
  CRISPR gRNA sequence
caggcatgtttgggcaagtc

SEQ ID NO: 736676 - DNA, 20 bp, Artificial
  CRISPR gRNA sequence
gggcaagtcacctgtgtagt

SEQ ID NO: 736677 - DNA, 20 bp, Artificial
  CRISPR gRNA sequence
ggcaagtcacctgtgtagtc

SEQ ID NO: 736678 - DNA, 20 bp, Artificial
  CRISPR gRNA sequence
tgtagtctgtcttatctatg

SEQ ID NO: 736679 - DNA, 20 bp, Artificial
  CRISPR gRNA sequence
tcttatctatgaggctgtgg

SEQ ID NO: 736680 - DNA, 20 bp, Artificial
  CRISPR gRNA sequence
atctatgaggctgtgggcat

SEQ ID NO: 736681 - DNA, 20 bp, Artificial
  CRISPR gRNA sequence
tctatgaggctgtgggcatg

SEQ ID NO: 736682 - DNA, 20 bp, Artificial
  CRISPR gRNA sequence
tgaggctgtgggcatgtctt

SEQ ID NO: 736683 - DNA, 20 bp, Artificial
  CRISPR gRNA sequence
tgggcatgtcttaggcaagc

SEQ ID NO: 736684 - DNA, 20 bp, Artificial
  CRISPR gRNA sequence
aggcaagcccccctgtgcaa

SEQ ID NO: 736685 - DNA, 20 bp, Artificial
  CRISPR gRNA sequence
ggcaagcccccctgtgcaag

SEQ ID NO: 736686 - DNA, 20 bp, Artificial
  CRISPR gRNA sequence
tgcaagttcccatatctgtg

SEQ ID NO: 736687 - DNA, 20 bp, Artificial
  CRISPR gRNA sequence
ccatatctgtgcctgcagct

SEQ ID NO: 736688 - DNA, 20 bp, Artificial
  CRISPR gRNA sequence
tgcctgcagcttgatttttc

SEQ ID NO: 736689 - DNA, 20 bp, Artificial
  CRISPR gRNA sequence
cagcttgatttttcaggctg

SEQ ID NO: 736690 - DNA, 20 bp, Artificial
  CRISPR gRNA sequence
gatttttcaggctgttcttt

SEQ ID NO: 736691 - DNA, 20 bp, Artificial
  CRISPR gRNA sequence
atttttcaggctgttctttt

SEQ ID NO: 736692 - DNA, 20 bp, Artificial
  CRISPR gRNA sequence
ttcaggctgttcttttgttt

SEQ ID NO: 736693 - DNA, 20 bp, Artificial
  CRISPR gRNA sequence
tcaggctgttcttttgttta

SEQ ID NO: 736694 - DNA, 20 bp, Artificial
  CRISPR gRNA sequence
caggctgttcttttgtttaa

SEQ ID NO: 736695 - DNA, 20 bp, Artificial
  CRISPR gRNA sequence
aggctgttcttttgtttaaa

SEQ ID NO: 736696 - DNA, 20 bp, Artificial
  CRISPR gRNA sequence
ttcttttgtttaaaagaatt

SEQ ID NO: 736697 - DNA, 20 bp, Artificial
  CRISPR gRNA sequence
ttttgtttaaaagaattcta

SEQ ID NO: 736698 - DNA, 20 bp, Artificial
  CRISPR gRNA sequence
ttgtttaaaagaattctacc

SEQ ID NO: 736699 - DNA, 20 bp, Artificial
  CRISPR gRNA sequence
tgtttaaaagaattctaccg

SEQ ID NO: 736700 - DNA, 20 bp, Artificial
  CRISPR gRNA sequence
gtttaaaagaattctaccga

SEQ ID NO: 736701 - DNA, 20 bp, Artificial
  CRISPR gRNA sequence
tttaaaagaattctaccgag

SEQ ID NO: 736702 - DNA, 20 bp, Artificial
  CRISPR gRNA sequence
aaaagaattctaccgagaac

SEQ ID NO: 736703 - DNA, 20 bp, Artificial
  CRISPR gRNA sequence
aaagaattctaccgagaacc

SEQ ID NO: 736704 - DNA, 20 bp, Artificial
  CRISPR gRNA sequence
taccgagaacccaccctaac

SEQ ID NO: 736705 - DNA, 20 bp, Artificial
  CRISPR gRNA sequence
ccgagaacccaccctaactg

SEQ ID NO: 736706 - DNA, 20 bp, Artificial
  CRISPR gRNA sequence
actgcctgcctgactggttt

SEQ ID NO: 736707 - DNA, 20 bp, Artificial
  CRISPR gRNA sequence
cctgcctgactggtttcttc

SEQ ID NO: 736708 - DNA, 20 bp, Artificial
  CRISPR gRNA sequence
cctgactggtttcttccttt

SEQ ID NO: 736709 - DNA, 20 bp, Artificial
  CRISPR gRNA sequence
actggtttcttcctttctcc

SEQ ID NO: 736710 - DNA, 20 bp, Artificial
  CRISPR gRNA sequence
gtttcttcctttctcctctc

SEQ ID NO: 736711 - DNA, 20 bp, Artificial
  CRISPR gRNA sequence
cttcctttctcctctctcac

SEQ ID NO: 736712 - DNA, 20 bp, Artificial
  CRISPR gRNA sequence
ttcctttctcctctctcact

SEQ ID NO: 736713 - DNA, 20 bp, Artificial
  CRISPR gRNA sequence
cctttctcctctctcactcc

SEQ ID NO: 736714 - DNA, 20 bp, Artificial
  CRISPR gRNA sequence
ctttctcctctctcactcct

SEQ ID NO: 736715 - DNA, 20 bp, Artificial
  CRISPR gRNA sequence
tctcctctctcactccttct

SEQ ID NO: 736716 - DNA, 20 bp, Artificial
  CRISPR gRNA sequence
ctcctctctcactccttctc

SEQ ID NO: 736717 - DNA, 20 bp, Artificial
  CRISPR gRNA sequence
tcctctctcactccttctcc

SEQ ID NO: 736718 - DNA, 20 bp, Artificial
  CRISPR gRNA sequence
ctctctcactccttctccag

SEQ ID NO: 736719 - DNA, 20 bp, Artificial
  CRISPR gRNA sequence
tctcactccttctccagatg

SEQ ID NO: 736720 - DNA, 20 bp, Artificial
  CRISPR gRNA sequence
tcactccttctccagatgag

SEQ ID NO: 736721 - DNA, 20 bp, Artificial
  CRISPR gRNA sequence
actccttctccagatgagga

SEQ ID NO: 736722 - DNA, 20 bp, Artificial
  CRISPR gRNA sequence
cttctccagatgaggaaaca

SEQ ID NO: 736723 - DNA, 20 bp, Artificial
  CRISPR gRNA sequence
ctccagatgaggaaacaaga

SEQ ID NO: 736724 - DNA, 20 bp, Artificial
  CRISPR gRNA sequence
tccagatgaggaaacaagat

SEQ ID NO: 736725 - DNA, 20 bp, Artificial
  CRISPR gRNA sequence
cagatgaggaaacaagatca

SEQ ID NO: 736726 - DNA, 20 bp, Artificial
  CRISPR gRNA sequence
gccaagttcacactgagatg

SEQ ID NO: 736727 - DNA, 20 bp, Artificial
  CRISPR gRNA sequence
ccaagttcacactgagatga

SEQ ID NO: 736728 - DNA, 20 bp, Artificial
  CRISPR gRNA sequence
acactgagatgagtccaccc

SEQ ID NO: 736729 - DNA, 20 bp, Artificial
  CRISPR gRNA sequence
agatgagtccaccctgtacc

SEQ ID NO: 736730 - DNA, 20 bp, Artificial
  CRISPR gRNA sequence
taccctcccctcctcaaaag

SEQ ID NO: 736731 - DNA, 20 bp, Artificial
  CRISPR gRNA sequence
ccctcctcaaaagaggacct

SEQ ID NO: 736732 - DNA, 20 bp, Artificial
  CRISPR gRNA sequence
ctcaaaagaggaccttacca

SEQ ID NO: 736733 - DNA, 20 bp, Artificial
  CRISPR gRNA sequence
aaaagaggaccttaccaaag

SEQ ID NO: 736734 - DNA, 20 bp, Artificial
  CRISPR gRNA sequence
accaaagggactgtcatcgg

SEQ ID NO: 736735 - DNA, 20 bp, Artificial
  CRISPR gRNA sequence
ccaaagggactgtcatcggg

SEQ ID NO: 736736 - DNA, 20 bp, Artificial
  CRISPR gRNA sequence
tcatcgggggccctcaacat

SEQ ID NO: 736737 - DNA, 20 bp, Artificial
  CRISPR gRNA sequence
aacatccatatagtgatgac

SEQ ID NO: 736738 - DNA, 20 bp, Artificial
  CRISPR gRNA sequence
gggaagagatatgacaaaag

SEQ ID NO: 736739 - DNA, 20 bp, Artificial
  CRISPR gRNA sequence
ggaagagatatgacaaaagc

SEQ ID NO: 736740 - DNA, 20 bp, Artificial
  CRISPR gRNA sequence
aggtcttaaatgtaatgttg

SEQ ID NO: 736741 - DNA, 20 bp, Artificial
  CRISPR gRNA sequence
aaatgtaatgttggaaacaa

SEQ ID NO: 736742 - DNA, 20 bp, Artificial
  CRISPR gRNA sequence
aatgtaatgttggaaacaac

SEQ ID NO: 736743 - DNA, 20 bp, Artificial
  CRISPR gRNA sequence
gaaacaacattagagctgga

SEQ ID NO: 736744 - DNA, 20 bp, Artificial
  CRISPR gRNA sequence
gagctggaaaacaacttaag

SEQ ID NO: 736745 - DNA, 20 bp, Artificial
  CRISPR gRNA sequence
gaaaacaacttaaggaataa

SEQ ID NO: 736746 - DNA, 20 bp, Artificial
  CRISPR gRNA sequence
aaggaataatggtaatgagg

SEQ ID NO: 736747 - DNA, 20 bp, Artificial
  CRISPR gRNA sequence
aggaataatggtaatgaggc

SEQ ID NO: 736748 - DNA, 20 bp, Artificial
  CRISPR gRNA sequence
gcatcattgtacaatgctaa

SEQ ID NO: 736749 - DNA, 20 bp, Artificial
  CRISPR gRNA sequence
catcattgtacaatgctaat

SEQ ID NO: 736750 - DNA, 20 bp, Artificial
  CRISPR gRNA sequence
tacaatgctaatgttatttt

SEQ ID NO: 736751 - DNA, 20 bp, Artificial
  CRISPR gRNA sequence
atgttattttatcttgaaaa

SEQ ID NO: 736752 - DNA, 20 bp, Artificial
  CRISPR gRNA sequence
ttttatcttgaaaacaatct

SEQ ID NO: 736753 - DNA, 20 bp, Artificial
  CRISPR gRNA sequence
tatcttgaaaacaatcttga

SEQ ID NO: 736754 - DNA, 20 bp, Artificial
  CRISPR gRNA sequence
atcttgaaaacaatcttgag

SEQ ID NO: 736755 - DNA, 20 bp, Artificial
  CRISPR gRNA sequence
tcttgaaaacaatcttgaga

SEQ ID NO: 736756 - DNA, 20 bp, Artificial
  CRISPR gRNA sequence
gaaaacaatcttgagaagta

SEQ ID NO: 736757 - DNA, 20 bp, Artificial
  CRISPR gRNA sequence
aaaacaatcttgagaagtag

SEQ ID NO: 736758 - DNA, 20 bp, Artificial
  CRISPR gRNA sequence
gagaagtaggaattattgtc

SEQ ID NO: 736759 - DNA, 20 bp, Artificial
  CRISPR gRNA sequence
agaagtaggaattattgtcc

SEQ ID NO: 736760 - DNA, 20 bp, Artificial
  CRISPR gRNA sequence
ttgtcctctttcacaagaca

SEQ ID NO: 736761 - DNA, 20 bp, Artificial
  CRISPR gRNA sequence
tcctctttcacaagacagga

SEQ ID NO: 736762 - DNA, 20 bp, Artificial
  CRISPR gRNA sequence
tttcacaagacaggaaaaat

SEQ ID NO: 736763 - DNA, 20 bp, Artificial
  CRISPR gRNA sequence
tcacaagacaggaaaaatga

SEQ ID NO: 736764 - DNA, 20 bp, Artificial
  CRISPR gRNA sequence
cacaagacaggaaaaatgag

SEQ ID NO: 736765 - DNA, 20 bp, Artificial
  CRISPR gRNA sequence
acaagacaggaaaaatgagg

SEQ ID NO: 736766 - DNA, 20 bp, Artificial
  CRISPR gRNA sequence
gtgacttgctgagggtcaca

SEQ ID NO: 736767 - DNA, 20 bp, Artificial
  CRISPR gRNA sequence
gctgagggtcacacagtgac

SEQ ID NO: 736768 - DNA, 20 bp, Artificial
  CRISPR gRNA sequence
ctgagggtcacacagtgaca

SEQ ID NO: 736769 - DNA, 20 bp, Artificial
  CRISPR gRNA sequence
agggtcacacagtgacagag

SEQ ID NO: 736770 - DNA, 20 bp, Artificial
  CRISPR gRNA sequence
gtccctgtccctgacttctt

SEQ ID NO: 736771 - DNA, 20 bp, Artificial
  CRISPR gRNA sequence
tccctgacttcttccctagg

SEQ ID NO: 736772 - DNA, 20 bp, Artificial
  CRISPR gRNA sequence
acttcttccctagggctcct

SEQ ID NO: 736773 - DNA, 20 bp, Artificial
  CRISPR gRNA sequence
cttccctagggctcctcctc

SEQ ID NO: 736774 - DNA, 20 bp, Artificial
  CRISPR gRNA sequence
ttccctagggctcctcctcc

SEQ ID NO: 736775 - DNA, 20 bp, Artificial
  CRISPR gRNA sequence
ccctagggctcctcctcctg

SEQ ID NO: 736776 - DNA, 20 bp, Artificial
  CRISPR gRNA sequence
cctagggctcctcctcctgg

SEQ ID NO: 736777 - DNA, 20 bp, Artificial
  CRISPR gRNA sequence
gggctcctcctcctgggcat

SEQ ID NO: 736778 - DNA, 20 bp, Artificial
  CRISPR gRNA sequence
ctcctcctgggcatctcact

SEQ ID NO: 736779 - DNA, 20 bp, Artificial
  CRISPR gRNA sequence
ctcctgggcatctcactcag

SEQ ID NO: 736780 - DNA, 20 bp, Artificial
  CRISPR gRNA sequence
ctgggcatctcactcagagg

SEQ ID NO: 736781 - DNA, 20 bp, Artificial
  CRISPR gRNA sequence
ggcatctcactcagaggaag

SEQ ID NO: 736782 - DNA, 20 bp, Artificial
  CRISPR gRNA sequence
actcagaggaagcagggcca

SEQ ID NO: 736783 - DNA, 20 bp, Artificial
  CRISPR gRNA sequence
agaggaagcagggccatcag

SEQ ID NO: 736784 - DNA, 20 bp, Artificial
  CRISPR gRNA sequence
gtgccagctcttggggagct

SEQ ID NO: 736785 - DNA, 20 bp, Artificial
  CRISPR gRNA sequence
ttggggagctattttccccc

SEQ ID NO: 736786 - DNA, 20 bp, Artificial
  CRISPR gRNA sequence
ggggagctattttcccccag

SEQ ID NO: 736787 - DNA, 20 bp, Artificial
  CRISPR gRNA sequence
gggagctattttcccccagg

SEQ ID NO: 736788 - DNA, 20 bp, Artificial
  CRISPR gRNA sequence
ttttcccccaggtgggttaa

SEQ ID NO: 736789 - DNA, 20 bp, Artificial
  CRISPR gRNA sequence
tcccccaggtgggttaagtt

SEQ ID NO: 736790 - DNA, 20 bp, Artificial
  CRISPR gRNA sequence
cccccaggtgggttaagttc

SEQ ID NO: 736791 - DNA, 20 bp, Artificial
  CRISPR gRNA sequence
ccccaggtgggttaagttct

SEQ ID NO: 736792 - DNA, 20 bp, Artificial
  CRISPR gRNA sequence
agttctctcctagtatacaa

SEQ ID NO: 736793 - DNA, 20 bp, Artificial
  CRISPR gRNA sequence
tctcctagtatacaacagga

SEQ ID NO: 736794 - DNA, 20 bp, Artificial
  CRISPR gRNA sequence
tcctagtatacaacaggatg

SEQ ID NO: 736795 - DNA, 20 bp, Artificial
  CRISPR gRNA sequence
ctagtatacaacaggatggt

SEQ ID NO: 736796 - DNA, 20 bp, Artificial
  CRISPR gRNA sequence
gtatacaacaggatggtggc

SEQ ID NO: 736797 - DNA, 20 bp, Artificial
  CRISPR gRNA sequence
caccgtcatgatagggagaa

SEQ ID NO: 736798 - DNA, 20 bp, Artificial
  CRISPR gRNA sequence
tcttaggaggctgcttgcta

SEQ ID NO: 736799 - DNA, 20 bp, Artificial
  CRISPR gRNA sequence
aggaggctgcttgctagaca

SEQ ID NO: 736800 - DNA, 20 bp, Artificial
  CRISPR gRNA sequence
ggaggctgcttgctagacag

SEQ ID NO: 736801 - DNA, 20 bp, Artificial
  CRISPR gRNA sequence
cttgctagacagagatgggt

SEQ ID NO: 736802 - DNA, 20 bp, Artificial
  CRISPR gRNA sequence
gctagacagagatgggtgtg

SEQ ID NO: 736803 - DNA, 20 bp, Artificial
  CRISPR gRNA sequence
ctagacagagatgggtgtgt

SEQ ID NO: 736804 - DNA, 20 bp, Artificial
  CRISPR gRNA sequence
gacagagatgggtgtgtgtg

SEQ ID NO: 736805 - DNA, 20 bp, Artificial
  CRISPR gRNA sequence
tctgtctgtctgtctgtctg

SEQ ID NO: 736806 - DNA, 20 bp, Artificial
  CRISPR gRNA sequence
tctgtctgtctgtctgtctg

SEQ ID NO: 736807 - DNA, 20 bp, Artificial
  CRISPR gRNA sequence
tctgtctgtctgtctgtctg

SEQ ID NO: 736808 - DNA, 20 bp, Artificial
  CRISPR gRNA sequence
tctgtctgtctgtctgtctg

SEQ ID NO: 736809 - DNA, 20 bp, Artificial
  CRISPR gRNA sequence
tctgtctgtctgtctgtcct

SEQ ID NO: 736810 - DNA, 20 bp, Artificial
  CRISPR gRNA sequence
tctgtctgtctgtcctgggt

SEQ ID NO: 736811 - DNA, 20 bp, Artificial
  CRISPR gRNA sequence
tctgtctgtcctgggtccag

SEQ ID NO: 736812 - DNA, 20 bp, Artificial
  CRISPR gRNA sequence
tctgtcctgggtccagagcc

SEQ ID NO: 736813 - DNA, 20 bp, Artificial
  CRISPR gRNA sequence
tcctgggtccagagccgtca

SEQ ID NO: 736814 - DNA, 20 bp, Artificial
  CRISPR gRNA sequence
ggtccagagccgtcaattct

SEQ ID NO: 736815 - DNA, 20 bp, Artificial
  CRISPR gRNA sequence
ttcagcctcagtcttccctc

SEQ ID NO: 736816 - DNA, 20 bp, Artificial
  CRISPR gRNA sequence
cagcctcagtcttccctcta

SEQ ID NO: 736817 - DNA, 20 bp, Artificial
  CRISPR gRNA sequence
agcctcagtcttccctctat

SEQ ID NO: 736818 - DNA, 20 bp, Artificial
  CRISPR gRNA sequence
agtcttccctctattgccct

SEQ ID NO: 736819 - DNA, 20 bp, Artificial
  CRISPR gRNA sequence
ccctctattgccctctcctg

SEQ ID NO: 736820 - DNA, 20 bp, Artificial
  CRISPR gRNA sequence
cctctattgccctctcctgg

SEQ ID NO: 736821 - DNA, 20 bp, Artificial
  CRISPR gRNA sequence
tattgccctctcctggacat

SEQ ID NO: 736822 - DNA, 20 bp, Artificial
  CRISPR gRNA sequence
ttgccctctcctggacatag

SEQ ID NO: 736823 - DNA, 20 bp, Artificial
  CRISPR gRNA sequence
ccctctcctggacataggga

SEQ ID NO: 736824 - DNA, 20 bp, Artificial
  CRISPR gRNA sequence
tcctggacatagggaagaag

SEQ ID NO: 736825 - DNA, 20 bp, Artificial
  CRISPR gRNA sequence
ctggacatagggaagaagtg

SEQ ID NO: 736826 - DNA, 20 bp, Artificial
  CRISPR gRNA sequence
gacatagggaagaagtgcct

SEQ ID NO: 736827 - DNA, 20 bp, Artificial
  CRISPR gRNA sequence
ctccctgctgtcccccagga

SEQ ID NO: 736828 - DNA, 20 bp, Artificial
  CRISPR gRNA sequence
cctgctgtcccccaggatta

SEQ ID NO: 736829 - DNA, 20 bp, Artificial
  CRISPR gRNA sequence
ctgtcccccaggattactcc

SEQ ID NO: 736830 - DNA, 20 bp, Artificial
  CRISPR gRNA sequence
tcccccaggattactccctg

SEQ ID NO: 736831 - DNA, 20 bp, Artificial
  CRISPR gRNA sequence
ctccctgcctcttccactct

SEQ ID NO: 736832 - DNA, 20 bp, Artificial
  CRISPR gRNA sequence
cctgcctcttccactctccc

SEQ ID NO: 736833 - DNA, 20 bp, Artificial
  CRISPR gRNA sequence
cctcttccactctccccaca

SEQ ID NO: 736834 - DNA, 20 bp, Artificial
  CRISPR gRNA sequence
ttccactctccccacatcca

SEQ ID NO: 736835 - DNA, 20 bp, Artificial
  CRISPR gRNA sequence
ccactctccccacatccatc

SEQ ID NO: 736836 - DNA, 20 bp, Artificial
  CRISPR gRNA sequence
cactctccccacatccatcc

SEQ ID NO: 736837 - DNA, 20 bp, Artificial
  CRISPR gRNA sequence
tccccacatccatcctgaag

SEQ ID NO: 736838 - DNA, 20 bp, Artificial
  CRISPR gRNA sequence
cccacatccatcctgaagtg

SEQ ID NO: 736839 - DNA, 20 bp, Artificial
  CRISPR gRNA sequence
aagtggcccctctggctgtc

SEQ ID NO: 736840 - DNA, 20 bp, Artificial
  CRISPR gRNA sequence
tggctgtccaccagggtcct

SEQ ID NO: 736841 - DNA, 20 bp, Artificial
  CRISPR gRNA sequence
gctgtccaccagggtcctgg

SEQ ID NO: 736842 - DNA, 20 bp, Artificial
  CRISPR gRNA sequence
tccaccagggtcctggctgt

SEQ ID NO: 736843 - DNA, 20 bp, Artificial
  CRISPR gRNA sequence
gctgtgtcactctcttggcc

SEQ ID NO: 736844 - DNA, 20 bp, Artificial
  CRISPR gRNA sequence
tgtcactctcttggccattg

SEQ ID NO: 736845 - DNA, 20 bp, Artificial
  CRISPR gRNA sequence
tcttggccattggaacgtcc

SEQ ID NO: 736846 - DNA, 20 bp, Artificial
  CRISPR gRNA sequence
ttggccattggaacgtccct

SEQ ID NO: 736847 - DNA, 20 bp, Artificial
  CRISPR gRNA sequence
ggccattggaacgtccctga

SEQ ID NO: 736848 - DNA, 20 bp, Artificial
  CRISPR gRNA sequence
gccattggaacgtccctgac

SEQ ID NO: 736849 - DNA, 20 bp, Artificial
  CRISPR gRNA sequence
gaacgtccctgacccagggt

SEQ ID NO: 736850 - DNA, 20 bp, Artificial
  CRISPR gRNA sequence
acccagggttcaatgcacag

SEQ ID NO: 736851 - DNA, 20 bp, Artificial
  CRISPR gRNA sequence
aatgcacagttgtcacattt

SEQ ID NO: 736852 - DNA, 20 bp, Artificial
  CRISPR gRNA sequence
tcacatttatccccaggtgc

SEQ ID NO: 736853 - DNA, 20 bp, Artificial
  CRISPR gRNA sequence
atccccaggtgctattccag

SEQ ID NO: 736854 - DNA, 20 bp, Artificial
  CRISPR gRNA sequence
tccccaggtgctattccagt

SEQ ID NO: 736855 - DNA, 20 bp, Artificial
  CRISPR gRNA sequence
ttccagtcactccaggtcag

SEQ ID NO: 736856 - DNA, 20 bp, Artificial
  CRISPR gRNA sequence
cagtcactccaggtcagtag

SEQ ID NO: 736857 - DNA, 20 bp, Artificial
  CRISPR gRNA sequence
caggtcagtagacacctgtg

SEQ ID NO: 736858 - DNA, 20 bp, Artificial
  CRISPR gRNA sequence
tgtgtgtgtgtgtgtgtgtg

SEQ ID NO: 736859 - DNA, 20 bp, Artificial
  CRISPR gRNA sequence
cattctccagccttcattgc

SEQ ID NO: 736860 - DNA, 20 bp, Artificial
  CRISPR gRNA sequence
tccagccttcattgctggac

SEQ ID NO: 736861 - DNA, 20 bp, Artificial
  CRISPR gRNA sequence
cagccttcattgctggacgc

SEQ ID NO: 736862 - DNA, 20 bp, Artificial
  CRISPR gRNA sequence
cattgctggacgccaagcca

SEQ ID NO: 736863 - DNA, 20 bp, Artificial
  CRISPR gRNA sequence
attgctggacgccaagccag

SEQ ID NO: 736864 - DNA, 20 bp, Artificial
  CRISPR gRNA sequence
ctggacgccaagccagtgct

SEQ ID NO: 736865 - DNA, 20 bp, Artificial
  CRISPR gRNA sequence
gacgccaagccagtgctctg

SEQ ID NO: 736866 - DNA, 20 bp, Artificial
  CRISPR gRNA sequence
tggacaatagaggctgagtc

SEQ ID NO: 736867 - DNA, 20 bp, Artificial
  CRISPR gRNA sequence
gacaatagaggctgagtctg

SEQ ID NO: 736868 - DNA, 20 bp, Artificial
  CRISPR gRNA sequence
agtctgagccctgagtcagt

SEQ ID NO: 736869 - DNA, 20 bp, Artificial
  CRISPR gRNA sequence
agccctgagtcagtgggtgg

SEQ ID NO: 736870 - DNA, 20 bp, Artificial
  CRISPR gRNA sequence
agtcagtgggtgggaggcag

SEQ ID NO: 736871 - DNA, 20 bp, Artificial
  CRISPR gRNA sequence
ctcgggacattgggtccctg

SEQ ID NO: 736872 - DNA, 20 bp, Artificial
  CRISPR gRNA sequence
gggacattgggtccctggcc

SEQ ID NO: 736873 - DNA, 20 bp, Artificial
  CRISPR gRNA sequence
ggtccctggccagaggctac

SEQ ID NO: 736874 - DNA, 20 bp, Artificial
  CRISPR gRNA sequence
gccagaggctacttgggctc

SEQ ID NO: 736875 - DNA, 20 bp, Artificial
  CRISPR gRNA sequence
cttgggctccattttccctg

SEQ ID NO: 736876 - DNA, 20 bp, Artificial
  CRISPR gRNA sequence
gggctccattttccctgtcc

SEQ ID NO: 736877 - DNA, 20 bp, Artificial
  CRISPR gRNA sequence
ggctccattttccctgtccc

SEQ ID NO: 736878 - DNA, 20 bp, Artificial
  CRISPR gRNA sequence
cattttccctgtccccctgc

SEQ ID NO: 736879 - DNA, 20 bp, Artificial
  CRISPR gRNA sequence
tccctgtccccctgcctggg

SEQ ID NO: 736880 - DNA, 20 bp, Artificial
  CRISPR gRNA sequence
ccctgtccccctgcctgggc

SEQ ID NO: 736881 - DNA, 20 bp, Artificial
  CRISPR gRNA sequence
cctgtccccctgcctgggcc

SEQ ID NO: 736882 - DNA, 20 bp, Artificial
  CRISPR gRNA sequence
tccccctgcctgggccagtc

SEQ ID NO: 736883 - DNA, 20 bp, Artificial
  CRISPR gRNA sequence
cctgggccagtcctccaggc

SEQ ID NO: 736884 - DNA, 20 bp, Artificial
  CRISPR gRNA sequence
ggccagtcctccaggccgtg

SEQ ID NO: 736885 - DNA, 20 bp, Artificial
  CRISPR gRNA sequence
caggccgtggtcagttccaa

SEQ ID NO: 736886 - DNA, 20 bp, Artificial
  CRISPR gRNA sequence
caagttactgtcttcactgt

SEQ ID NO: 736887 - DNA, 20 bp, Artificial
  CRISPR gRNA sequence
ctgtcttcactgtgtcccaa

SEQ ID NO: 736888 - DNA, 20 bp, Artificial
  CRISPR gRNA sequence
tcttcactgtgtcccaagtg

SEQ ID NO: 736889 - DNA, 20 bp, Artificial
  CRISPR gRNA sequence
cactgtgtcccaagtgtgtc

SEQ ID NO: 736890 - DNA, 20 bp, Artificial
  CRISPR gRNA sequence
actgtgtcccaagtgtgtct

SEQ ID NO: 736891 - DNA, 20 bp, Artificial
  CRISPR gRNA sequence
tgtcccaagtgtgtcttctc

SEQ ID NO: 736892 - DNA, 20 bp, Artificial
  CRISPR gRNA sequence
ctctctctatcctgaggggt

SEQ ID NO: 736893 - DNA, 20 bp, Artificial
  CRISPR gRNA sequence
tctctctatcctgaggggta

SEQ ID NO: 736894 - DNA, 20 bp, Artificial
  CRISPR gRNA sequence
tctctatcctgaggggtagg

SEQ ID NO: 736895 - DNA, 20 bp, Artificial
  CRISPR gRNA sequence
tctatcctgaggggtaggag

SEQ ID NO: 736896 - DNA, 20 bp, Artificial
  CRISPR gRNA sequence
tatcctgaggggtaggagga

SEQ ID NO: 736897 - DNA, 20 bp, Artificial
  CRISPR gRNA sequence
tcctgaggggtaggaggagg

SEQ ID NO: 736898 - DNA, 20 bp, Artificial
  CRISPR gRNA sequence
aggggtaggaggagggttgc

SEQ ID NO: 736899 - DNA, 20 bp, Artificial
  CRISPR gRNA sequence
ctccacccttcctctgagcc

SEQ ID NO: 736900 - DNA, 20 bp, Artificial
  CRISPR gRNA sequence
cacccttcctctgagccatg

SEQ ID NO: 736901 - DNA, 20 bp, Artificial
  CRISPR gRNA sequence
cctctgagccatggtctccc

SEQ ID NO: 736902 - DNA, 20 bp, Artificial
  CRISPR gRNA sequence
ctctgagccatggtctcccc

SEQ ID NO: 736903 - DNA, 20 bp, Artificial
  CRISPR gRNA sequence
tgagccatggtctccccacc

SEQ ID NO: 736904 - DNA, 20 bp, Artificial
  CRISPR gRNA sequence
agccatggtctccccaccag

SEQ ID NO: 736905 - DNA, 20 bp, Artificial
  CRISPR gRNA sequence
cccaccagtgtctgtggggt

SEQ ID NO: 736906 - DNA, 20 bp, Artificial
  CRISPR gRNA sequence
tggggtgagcagcctccata

SEQ ID NO: 736907 - DNA, 20 bp, Artificial
  CRISPR gRNA sequence
catacagagccaaggtctca

SEQ ID NO: 736908 - DNA, 20 bp, Artificial
  CRISPR gRNA sequence
agccaccccagggtatggac

SEQ ID NO: 736909 - DNA, 20 bp, Artificial
  CRISPR gRNA sequence
cctggaggctgctgggtccc

SEQ ID NO: 736910 - DNA, 20 bp, Artificial
  CRISPR gRNA sequence
ctggaggctgctgggtcccc

SEQ ID NO: 736911 - DNA, 20 bp, Artificial
  CRISPR gRNA sequence
gaggctgctgggtcccctgt

SEQ ID NO: 736912 - DNA, 20 bp, Artificial
  CRISPR gRNA sequence
ctgggtcccctgtgggaact

SEQ ID NO: 736913 - DNA, 20 bp, Artificial
  CRISPR gRNA sequence
ggtcccctgtgggaactcag

SEQ ID NO: 736914 - DNA, 20 bp, Artificial
  CRISPR gRNA sequence
tgggaactcagacttggagc

SEQ ID NO: 736915 - DNA, 20 bp, Artificial
  CRISPR gRNA sequence
agacttggagcccaggtgta

SEQ ID NO: 736916 - DNA, 20 bp, Artificial
  CRISPR gRNA sequence
ggagcccaggtgtagaagct

SEQ ID NO: 736917 - DNA, 20 bp, Artificial
  CRISPR gRNA sequence
gagcccaggtgtagaagctg

SEQ ID NO: 736918 - DNA, 20 bp, Artificial
  CRISPR gRNA sequence
ggggagagagccccaagtcc

SEQ ID NO: 736919 - DNA, 20 bp, Artificial
  CRISPR gRNA sequence
tgcacttcagtcttgggaga

SEQ ID NO: 736920 - DNA, 20 bp, Artificial
  CRISPR gRNA sequence
cacttcagtcttgggagagg

SEQ ID NO: 736921 - DNA, 20 bp, Artificial
  CRISPR gRNA sequence
cagtcttgggagaggctgac

SEQ ID NO: 736922 - DNA, 20 bp, Artificial
  CRISPR gRNA sequence
agtcttgggagaggctgacc

SEQ ID NO: 736923 - DNA, 20 bp, Artificial
  CRISPR gRNA sequence
gggagaggctgaccctgcag

SEQ ID NO: 736924 - DNA, 20 bp, Artificial
  CRISPR gRNA sequence
ggagaggctgaccctgcagc

SEQ ID NO: 736925 - DNA, 20 bp, Artificial
  CRISPR gRNA sequence
accctgcagcccagaggctc

SEQ ID NO: 736926 - DNA, 20 bp, Artificial
  CRISPR gRNA sequence
cagcccagaggctcttagct

SEQ ID NO: 736927 - DNA, 20 bp, Artificial
  CRISPR gRNA sequence
ttagctgcctggtcacagct

SEQ ID NO: 736928 - DNA, 20 bp, Artificial
  CRISPR gRNA sequence
agctgcctggtcacagcttt

SEQ ID NO: 736929 - DNA, 20 bp, Artificial
  CRISPR gRNA sequence
gctgcctggtcacagctttc

SEQ ID NO: 736930 - DNA, 20 bp, Artificial
  CRISPR gRNA sequence
cctggtcacagctttctaag

SEQ ID NO: 736931 - DNA, 20 bp, Artificial
  CRISPR gRNA sequence
gtcacagctttctaaggagg

SEQ ID NO: 736932 - DNA, 20 bp, Artificial
  CRISPR gRNA sequence
tctaaggaggcagcggccag

SEQ ID NO: 736933 - DNA, 20 bp, Artificial
  CRISPR gRNA sequence
ctaaggaggcagcggccagc

SEQ ID NO: 736934 - DNA, 20 bp, Artificial
  CRISPR gRNA sequence
taaggaggcagcggccagca

SEQ ID NO: 736935 - DNA, 20 bp, Artificial
  CRISPR gRNA sequence
aggaggcagcggccagcagg

SEQ ID NO: 736936 - DNA, 20 bp, Artificial
  CRISPR gRNA sequence
tgcgcggtcccaggacagga

SEQ ID NO: 736937 - DNA, 20 bp, Artificial
  CRISPR gRNA sequence
cgcggtcccaggacaggagg

SEQ ID NO: 736938 - DNA, 20 bp, Artificial
  CRISPR gRNA sequence
tcccgacaagagaagctgcc

SEQ ID NO: 736939 - DNA, 20 bp, Artificial
  CRISPR gRNA sequence
ccaacccctctgtgggtccc

SEQ ID NO: 736940 - DNA, 20 bp, Artificial
  CRISPR gRNA sequence
tgtgggtccccagcttttag

SEQ ID NO: 736941 - DNA, 20 bp, Artificial
  CRISPR gRNA sequence
tgggtccccagcttttagtc

SEQ ID NO: 736942 - DNA, 20 bp, Artificial
  CRISPR gRNA sequence
ttagtcactgtttcctctcc

SEQ ID NO: 736943 - DNA, 20 bp, Artificial
  CRISPR gRNA sequence
tagtcactgtttcctctcct

SEQ ID NO: 736944 - DNA, 20 bp, Artificial
  CRISPR gRNA sequence
agtcactgtttcctctcctc

SEQ ID NO: 736945 - DNA, 20 bp, Artificial
  CRISPR gRNA sequence
gtcactgtttcctctcctcc

SEQ ID NO: 736946 - DNA, 20 bp, Artificial
  CRISPR gRNA sequence
tttcctctcctccaggatgg

SEQ ID NO: 736947 - DNA, 20 bp, Artificial
  CRISPR gRNA sequence
cctctcctccaggatgggac

SEQ ID NO: 736948 - DNA, 20 bp, Artificial
  CRISPR gRNA sequence
ctctcctccaggatgggaca

SEQ ID NO: 736949 - DNA, 20 bp, Artificial
  CRISPR gRNA sequence
tcctccaggatgggacatca

SEQ ID NO: 736950 - DNA, 20 bp, Artificial
  CRISPR gRNA sequence
ctccaggatgggacatcact

SEQ ID NO: 736951 - DNA, 20 bp, Artificial
  CRISPR gRNA sequence
caggatgggacatcactgcc

SEQ ID NO: 736952 - DNA, 20 bp, Artificial
  CRISPR gRNA sequence
cctctggcattcgtgagccc

SEQ ID NO: 736953 - DNA, 20 bp, Artificial
  CRISPR gRNA sequence
tggcattcgtgagcccgatt

SEQ ID NO: 736954 - DNA, 20 bp, Artificial
  CRISPR gRNA sequence
gcattcgtgagcccgattct

SEQ ID NO: 736955 - DNA, 20 bp, Artificial
  CRISPR gRNA sequence
gtgagcccgattctttcttc

SEQ ID NO: 736956 - DNA, 20 bp, Artificial
  CRISPR gRNA sequence
tttcttccctaaccttaggg

SEQ ID NO: 736957 - DNA, 20 bp, Artificial
  CRISPR gRNA sequence
tcttccctaaccttagggga

SEQ ID NO: 736958 - DNA, 20 bp, Artificial
  CRISPR gRNA sequence
cttccctaaccttaggggaa

SEQ ID NO: 736959 - DNA, 20 bp, Artificial
  CRISPR gRNA sequence
ttccctaaccttaggggaag

SEQ ID NO: 736960 - DNA, 20 bp, Artificial
  CRISPR gRNA sequence
ccctaaccttaggggaagct

SEQ ID NO: 736961 - DNA, 20 bp, Artificial
  CRISPR gRNA sequence
cctaaccttaggggaagctg

SEQ ID NO: 736962 - DNA, 20 bp, Artificial
  CRISPR gRNA sequence
accttaggggaagctgaagc

SEQ ID NO: 736963 - DNA, 20 bp, Artificial
  CRISPR gRNA sequence
aggggaagctgaagcagaac

SEQ ID NO: 736964 - DNA, 20 bp, Artificial
  CRISPR gRNA sequence
ggggaagctgaagcagaacg

SEQ ID NO: 736965 - DNA, 20 bp, Artificial
  CRISPR gRNA sequence
aagcagaacggagggaagca

SEQ ID NO: 736966 - DNA, 20 bp, Artificial
  CRISPR gRNA sequence
gtggggagggcagctcagcc

SEQ ID NO: 736967 - DNA, 20 bp, Artificial
  CRISPR gRNA sequence
agcccaatagggtttctgag

SEQ ID NO: 736968 - DNA, 20 bp, Artificial
  CRISPR gRNA sequence
ctgaggcagacgggagctga

SEQ ID NO: 736969 - DNA, 20 bp, Artificial
  CRISPR gRNA sequence
tgaggcagacgggagctgag

SEQ ID NO: 736970 - DNA, 20 bp, Artificial
  CRISPR gRNA sequence
aggcagacgggagctgaggt

SEQ ID NO: 736971 - DNA, 20 bp, Artificial
  CRISPR gRNA sequence
aggttctctgtaaacagcac

SEQ ID NO: 736972 - DNA, 20 bp, Artificial
  CRISPR gRNA sequence
tctgtaaacagcactctcag

SEQ ID NO: 736973 - DNA, 20 bp, Artificial
  CRISPR gRNA sequence
tgtaaacagcactctcaggg

SEQ ID NO: 736974 - DNA, 20 bp, Artificial
  CRISPR gRNA sequence
taaacagcactctcagggtt

SEQ ID NO: 736975 - DNA, 20 bp, Artificial
  CRISPR gRNA sequence
tcagggttcccctgcctcca

SEQ ID NO: 736976 - DNA, 20 bp, Artificial
  CRISPR gRNA sequence
agggttcccctgcctccacc

SEQ ID NO: 736977 - DNA, 20 bp, Artificial
  CRISPR gRNA sequence
ccctgcctccaccaagagcc

SEQ ID NO: 736978 - DNA, 20 bp, Artificial
  CRISPR gRNA sequence
cctccaccaagagccctggg

SEQ ID NO: 736979 - DNA, 20 bp, Artificial
  CRISPR gRNA sequence
caccaagagccctggggtct

SEQ ID NO: 736980 - DNA, 20 bp, Artificial
  CRISPR gRNA sequence
gggtctgcagctccgagcag

SEQ ID NO: 736981 - DNA, 20 bp, Artificial
  CRISPR gRNA sequence
cagctccgagcagaaaccac

SEQ ID NO: 736982 - DNA, 20 bp, Artificial
  CRISPR gRNA sequence
cgagcagaaaccactggtca

SEQ ID NO: 736983 - DNA, 20 bp, Artificial
  CRISPR gRNA sequence
gtcacatttcctcgggactt

SEQ ID NO: 736984 - DNA, 20 bp, Artificial
  CRISPR gRNA sequence
cctcgggactttctccctga

SEQ ID NO: 736985 - DNA, 20 bp, Artificial
  CRISPR gRNA sequence
ctcgggactttctccctgat

SEQ ID NO: 736986 - DNA, 20 bp, Artificial
  CRISPR gRNA sequence
gggactttctccctgatgcc

SEQ ID NO: 736987 - DNA, 20 bp, Artificial
  CRISPR gRNA sequence
tctccctgatgccctttgct

SEQ ID NO: 736988 - DNA, 20 bp, Artificial
  CRISPR gRNA sequence
ctccctgatgccctttgctc

SEQ ID NO: 736989 - DNA, 20 bp, Artificial
  CRISPR gRNA sequence
tccctgatgccctttgctct

SEQ ID NO: 736990 - DNA, 20 bp, Artificial
  CRISPR gRNA sequence
cctgatgccctttgctctgg

SEQ ID NO: 736991 - DNA, 20 bp, Artificial
  CRISPR gRNA sequence
atgccctttgctctgggccc

SEQ ID NO: 736992 - DNA, 20 bp, Artificial
  CRISPR gRNA sequence
tgctctgggcccctccccag

SEQ ID NO: 736993 - DNA, 20 bp, Artificial
  CRISPR gRNA sequence
gctctgggcccctccccagg

SEQ ID NO: 736994 - DNA, 20 bp, Artificial
  CRISPR gRNA sequence
ctctgggcccctccccaggt

SEQ ID NO: 736995 - DNA, 20 bp, Artificial
  CRISPR gRNA sequence
tgggcccctccccaggttcc

SEQ ID NO: 736996 - DNA, 20 bp, Artificial
  CRISPR gRNA sequence
ggcccctccccaggttcctg

SEQ ID NO: 736997 - DNA, 20 bp, Artificial
  CRISPR gRNA sequence
cccaggttcctgcccccaag

SEQ ID NO: 736998 - DNA, 20 bp, Artificial
  CRISPR gRNA sequence
ctgcccccaaggagaacact

SEQ ID NO: 736999 - DNA, 20 bp, Artificial
  CRISPR gRNA sequence
cccccaaggagaacactggg

SEQ ID NO: 737000 - DNA, 20 bp, Artificial
  CRISPR gRNA sequence
ggctgtggggctgcttagga

SEQ ID NO: 737001 - DNA, 20 bp, Artificial
  CRISPR gRNA sequence
tggggctgcttaggatggca

SEQ ID NO: 737002 - DNA, 20 bp, Artificial
  CRISPR gRNA sequence
cttaggatggcagcctctgg

SEQ ID NO: 737003 - DNA, 20 bp, Artificial
  CRISPR gRNA sequence
aggatggcagcctctgggtt

SEQ ID NO: 737004 - DNA, 20 bp, Artificial
  CRISPR gRNA sequence
ggatggcagcctctgggttt

SEQ ID NO: 737005 - DNA, 20 bp, Artificial
  CRISPR gRNA sequence
tgggtttgggaagtcctggg

SEQ ID NO: 737006 - DNA, 20 bp, Artificial
  CRISPR gRNA sequence
ggtttgggaagtcctgggtg

SEQ ID NO: 737007 - DNA, 20 bp, Artificial
  CRISPR gRNA sequence
gggaagtcctgggtgagtcc

SEQ ID NO: 737008 - DNA, 20 bp, Artificial
  CRISPR gRNA sequence
ggaagtcctgggtgagtcca

SEQ ID NO: 737009 - DNA, 20 bp, Artificial
  CRISPR gRNA sequence
ggtgagtccagcactgcaca

SEQ ID NO: 737010 - DNA, 20 bp, Artificial
  CRISPR gRNA sequence
cacaagtcctccagcttcat

SEQ ID NO: 737011 - DNA, 20 bp, Artificial
  CRISPR gRNA sequence
cagcttcataagatcgatac

SEQ ID NO: 737012 - DNA, 20 bp, Artificial
  CRISPR gRNA sequence
cataagatcgatactggccc

SEQ ID NO: 737013 - DNA, 20 bp, Artificial
  CRISPR gRNA sequence
ataagatcgatactggcccc

SEQ ID NO: 737014 - DNA, 20 bp, Artificial
  CRISPR gRNA sequence
gccccaatcttcacccctcc

SEQ ID NO: 737015 - DNA, 20 bp, Artificial
  CRISPR gRNA sequence
cacccctcctctaaccccct

SEQ ID NO: 737016 - DNA, 20 bp, Artificial
  CRISPR gRNA sequence
acccctcctctaaccccctg

SEQ ID NO: 737017 - DNA, 20 bp, Artificial
  CRISPR gRNA sequence
ctctaaccccctggggccac

SEQ ID NO: 737018 - DNA, 20 bp, Artificial
  CRISPR gRNA sequence
taaccccctggggccactct

SEQ ID NO: 737019 - DNA, 20 bp, Artificial
  CRISPR gRNA sequence
accccctggggccactctgg

SEQ ID NO: 737020 - DNA, 20 bp, Artificial
  CRISPR gRNA sequence
gggccactctgggagaagct

SEQ ID NO: 737021 - DNA, 20 bp, Artificial
  CRISPR gRNA sequence
tgggagaagctccccacccc

SEQ ID NO: 737022 - DNA, 20 bp, Artificial
  CRISPR gRNA sequence
ggagaagctccccaccccat

SEQ ID NO: 737023 - DNA, 20 bp, Artificial
  CRISPR gRNA sequence
cccaccccatgcttaagtgg

SEQ ID NO: 737024 - DNA, 20 bp, Artificial
  CRISPR gRNA sequence
aagtggcctcagatcaagta

SEQ ID NO: 737025 - DNA, 20 bp, Artificial
  CRISPR gRNA sequence
agtggcctcagatcaagtag

SEQ ID NO: 737026 - DNA, 20 bp, Artificial
  CRISPR gRNA sequence
agatcaagtagacttccaca

SEQ ID NO: 737027 - DNA, 20 bp, Artificial
  CRISPR gRNA sequence
ccacatagggctctggtctt

SEQ ID NO: 737028 - DNA, 20 bp, Artificial
  CRISPR gRNA sequence
cacatagggctctggtcttc

SEQ ID NO: 737029 - DNA, 20 bp, Artificial
  CRISPR gRNA sequence
tggtcttccaggtgggtcac

SEQ ID NO: 737030 - DNA, 20 bp, Artificial
  CRISPR gRNA sequence
gtcttccaggtgggtcacgt

SEQ ID NO: 737031 - DNA, 20 bp, Artificial
  CRISPR gRNA sequence
ccaggtgggtcacgtgtaga

SEQ ID NO: 737032 - DNA, 20 bp, Artificial
  CRISPR gRNA sequence
caggtgggtcacgtgtagaa

SEQ ID NO: 737033 - DNA, 20 bp, Artificial
  CRISPR gRNA sequence
cacatgctgtagcctgcaag

SEQ ID NO: 737034 - DNA, 20 bp, Artificial
  CRISPR gRNA sequence
tagcctgcaagaaacaggga

SEQ ID NO: 737035 - DNA, 20 bp, Artificial
  CRISPR gRNA sequence
caagaaacagggagagctga

SEQ ID NO: 737036 - DNA, 20 bp, Artificial
  CRISPR gRNA sequence
aggaagtgtcctgccctgcc

SEQ ID NO: 737037 - DNA, 20 bp, Artificial
  CRISPR gRNA sequence
ccctgcccacggtgccccga

SEQ ID NO: 737038 - DNA, 20 bp, Artificial
  CRISPR gRNA sequence
cccacggtgccccgatgctc

SEQ ID NO: 737039 - DNA, 20 bp, Artificial
  CRISPR gRNA sequence
ctccaccagccccagcccct

SEQ ID NO: 737040 - DNA, 20 bp, Artificial
  CRISPR gRNA sequence
caccagccccagcccctttc

SEQ ID NO: 737041 - DNA, 20 bp, Artificial
  CRISPR gRNA sequence
tctggctctgcctctggttc

SEQ ID NO: 737042 - DNA, 20 bp, Artificial
  CRISPR gRNA sequence
ctggctctgcctctggttcc

SEQ ID NO: 737043 - DNA, 20 bp, Artificial
  CRISPR gRNA sequence
tggctctgcctctggttcct

SEQ ID NO: 737044 - DNA, 20 bp, Artificial
  CRISPR gRNA sequence
gctctgcctctggttccttc

SEQ ID NO: 737045 - DNA, 20 bp, Artificial
  CRISPR gRNA sequence
tgcctctggttccttccagg

SEQ ID NO: 737046 - DNA, 20 bp, Artificial
  CRISPR gRNA sequence
cctctggttccttccaggtc

SEQ ID NO: 737047 - DNA, 20 bp, Artificial
  CRISPR gRNA sequence
tggttccttccaggtcatcc

SEQ ID NO: 737048 - DNA, 20 bp, Artificial
  CRISPR gRNA sequence
gttccttccaggtcatcccc

SEQ ID NO: 737049 - DNA, 20 bp, Artificial
  CRISPR gRNA sequence
cttccaggtcatccccttag

SEQ ID NO: 737050 - DNA, 20 bp, Artificial
  CRISPR gRNA sequence
ccaggtcatccccttagggt

SEQ ID NO: 737051 - DNA, 20 bp, Artificial
  CRISPR gRNA sequence
caggtcatccccttagggtt

SEQ ID NO: 737052 - DNA, 20 bp, Artificial
  CRISPR gRNA sequence
agggttgtgctgggtggtct

SEQ ID NO: 737053 - DNA, 20 bp, Artificial
  CRISPR gRNA sequence
gggttgtgctgggtggtctc

SEQ ID NO: 737054 - DNA, 20 bp, Artificial
  CRISPR gRNA sequence
tgctgggtggtctccgcctg

SEQ ID NO: 737055 - DNA, 20 bp, Artificial
  CRISPR gRNA sequence
ggtggtctccgcctggccgc

SEQ ID NO: 737056 - DNA, 20 bp, Artificial
  CRISPR gRNA sequence
cgcctggccgccctcctccc

SEQ ID NO: 737057 - DNA, 20 bp, Artificial
  CRISPR gRNA sequence
gccgccctcctccccaggtg

SEQ ID NO: 737058 - DNA, 20 bp, Artificial
  CRISPR gRNA sequence
ctccccaggtggaagcgtca

SEQ ID NO: 737059 - DNA, 20 bp, Artificial
  CRISPR gRNA sequence
cccaggtggaagcgtcatag

SEQ ID NO: 737060 - DNA, 20 bp, Artificial
  CRISPR gRNA sequence
ttgactggacacaggccaag

SEQ ID NO: 737061 - DNA, 20 bp, Artificial
  CRISPR gRNA sequence
tgactggacacaggccaagg

SEQ ID NO: 737062 - DNA, 20 bp, Artificial
  CRISPR gRNA sequence
gactggacacaggccaaggg

SEQ ID NO: 737063 - DNA, 20 bp, Artificial
  CRISPR gRNA sequence
actggacacaggccaagggc

SEQ ID NO: 737064 - DNA, 20 bp, Artificial
  CRISPR gRNA sequence
gacacaggccaagggccata

SEQ ID NO: 737065 - DNA, 20 bp, Artificial
  CRISPR gRNA sequence
gaggtcataacccttagtgc

SEQ ID NO: 737066 - DNA, 20 bp, Artificial
  CRISPR gRNA sequence
agtgcagttacccagagctc

SEQ ID NO: 737067 - DNA, 20 bp, Artificial
  CRISPR gRNA sequence
gtgcagttacccagagctct

SEQ ID NO: 737068 - DNA, 20 bp, Artificial
  CRISPR gRNA sequence
cccagagctctgccctcagg

SEQ ID NO: 737069 - DNA, 20 bp, Artificial
  CRISPR gRNA sequence
tgccctcaggaggctgggag

SEQ ID NO: 737070 - DNA, 20 bp, Artificial
  CRISPR gRNA sequence
ccctcaggaggctgggaggt

SEQ ID NO: 737071 - DNA, 20 bp, Artificial
  CRISPR gRNA sequence
aggaggctgggaggtgggct

SEQ ID NO: 737072 - DNA, 20 bp, Artificial
  CRISPR gRNA sequence
ggaggtgggctctactcact

SEQ ID NO: 737073 - DNA, 20 bp, Artificial
  CRISPR gRNA sequence
tactcacttgccatgtgtct

SEQ ID NO: 737074 - DNA, 20 bp, Artificial
  CRISPR gRNA sequence
ctcacttgccatgtgtctct

SEQ ID NO: 737075 - DNA, 20 bp, Artificial
  CRISPR gRNA sequence
acttgccatgtgtctcttct

SEQ ID NO: 737076 - DNA, 20 bp, Artificial
  CRISPR gRNA sequence
gccatgtgtctcttcttcca

SEQ ID NO: 737077 - DNA, 20 bp, Artificial
  CRISPR gRNA sequence
ccatgtgtctcttcttccaa

SEQ ID NO: 737078 - DNA, 20 bp, Artificial
  CRISPR gRNA sequence
ttcttccaaaacccatagac

SEQ ID NO: 737079 - DNA, 20 bp, Artificial
  CRISPR gRNA sequence
cttccaaaacccatagacca

SEQ ID NO: 737080 - DNA, 20 bp, Artificial
  CRISPR gRNA sequence
ttccaaaacccatagaccat

SEQ ID NO: 737081 - DNA, 20 bp, Artificial
  CRISPR gRNA sequence
ccaaaacccatagaccatga

SEQ ID NO: 737082 - DNA, 20 bp, Artificial
  CRISPR gRNA sequence
caaaacccatagaccatgat

SEQ ID NO: 737083 - DNA, 20 bp, Artificial
  CRISPR gRNA sequence
gtgcctgagaagaagggaca

SEQ ID NO: 737084 - DNA, 20 bp, Artificial
  CRISPR gRNA sequence
agaagaagggacagggtgga

SEQ ID NO: 737085 - DNA, 20 bp, Artificial
  CRISPR gRNA sequence
acccacgttgggatcggacc

SEQ ID NO: 737086 - DNA, 20 bp, Artificial
  CRISPR gRNA sequence
ggatcggaccagcagcagaa

SEQ ID NO: 737087 - DNA, 20 bp, Artificial
  CRISPR gRNA sequence
agagcgtgcccttcccgggg

SEQ ID NO: 737088 - DNA, 20 bp, Artificial
  CRISPR gRNA sequence
cccggggtagacggccaccc

SEQ ID NO: 737089 - DNA, 20 bp, Artificial
  CRISPR gRNA sequence
ccggggtagacggccaccct

SEQ ID NO: 737090 - DNA, 20 bp, Artificial
  CRISPR gRNA sequence
ttccttacagacccggccac

SEQ ID NO: 737091 - DNA, 20 bp, Artificial
  CRISPR gRNA sequence
ccttacagacccggccacag

SEQ ID NO: 737092 - DNA, 20 bp, Artificial
  CRISPR gRNA sequence
cttacagacccggccacaga

SEQ ID NO: 737093 - DNA, 20 bp, Artificial
  CRISPR gRNA sequence
acagacccggccacagaagc

SEQ ID NO: 737094 - DNA, 20 bp, Artificial
  CRISPR gRNA sequence
cagacccggccacagaagca

SEQ ID NO: 737095 - DNA, 20 bp, Artificial
  CRISPR gRNA sequence
agaggaggacgtccccaggt

SEQ ID NO: 737096 - DNA, 20 bp, Artificial
  CRISPR gRNA sequence
tctactttggtacctctcct

SEQ ID NO: 737097 - DNA, 20 bp, Artificial
  CRISPR gRNA sequence
tactttggtacctctcctcc

SEQ ID NO: 737098 - DNA, 20 bp, Artificial
  CRISPR gRNA sequence
ctttggtacctctcctccat

SEQ ID NO: 737099 - DNA, 20 bp, Artificial
  CRISPR gRNA sequence
tggtacctctcctccattat

SEQ ID NO: 737100 - DNA, 20 bp, Artificial
  CRISPR gRNA sequence
ggtacctctcctccattatg

SEQ ID NO: 737101 - DNA, 20 bp, Artificial
  CRISPR gRNA sequence
gtacctctcctccattatgc

SEQ ID NO: 737102 - DNA, 20 bp, Artificial
  CRISPR gRNA sequence
tcctccattatgcccccaaa

SEQ ID NO: 737103 - DNA, 20 bp, Artificial
  CRISPR gRNA sequence
ctccattatgcccccaaatc

SEQ ID NO: 737104 - DNA, 20 bp, Artificial
  CRISPR gRNA sequence
cattatgcccccaaatctgt

SEQ ID NO: 737105 - DNA, 20 bp, Artificial
  CRISPR gRNA sequence
tgcccccaaatctgttcatc

SEQ ID NO: 737106 - DNA, 20 bp, Artificial
  CRISPR gRNA sequence
ttcatcagtgaggatgagga

SEQ ID NO: 737107 - DNA, 20 bp, Artificial
  CRISPR gRNA sequence
atcagtgaggatgaggattc

SEQ ID NO: 737108 - DNA, 20 bp, Artificial
  CRISPR gRNA sequence
taggagactcccatttgtgg

SEQ ID NO: 737109 - DNA, 20 bp, Artificial
  CRISPR gRNA sequence
ggagactcccatttgtggct

SEQ ID NO: 737110 - DNA, 20 bp, Artificial
  CRISPR gRNA sequence
ccatttgtggctaaagagat

SEQ ID NO: 737111 - DNA, 20 bp, Artificial
  CRISPR gRNA sequence
gtggctaaagagatcaagat

SEQ ID NO: 737112 - DNA, 20 bp, Artificial
  CRISPR gRNA sequence
tggctaaagagatcaagatg

SEQ ID NO: 737113 - DNA, 20 bp, Artificial
  CRISPR gRNA sequence
aagagatcaagatgcttgct

SEQ ID NO: 737114 - DNA, 20 bp, Artificial
  CRISPR gRNA sequence
gctctcctcaaggggtctga

SEQ ID NO: 737115 - DNA, 20 bp, Artificial
  CRISPR gRNA sequence
ctctcctcaaggggtctgag

SEQ ID NO: 737116 - DNA, 20 bp, Artificial
  CRISPR gRNA sequence
tcctcaaggggtctgaggat

SEQ ID NO: 737117 - DNA, 20 bp, Artificial
  CRISPR gRNA sequence
ctcaaggggtctgaggatgc

SEQ ID NO: 737118 - DNA, 20 bp, Artificial
  CRISPR gRNA sequence
aaggggtctgaggatgcctg

SEQ ID NO: 737119 - DNA, 20 bp, Artificial
  CRISPR gRNA sequence
aggatgcctgttcccccact

SEQ ID NO: 737120 - DNA, 20 bp, Artificial
  CRISPR gRNA sequence
ttcccccactctatcctctg

SEQ ID NO: 737121 - DNA, 20 bp, Artificial
  CRISPR gRNA sequence
ccccactctatcctctgtag

SEQ ID NO: 737122 - DNA, 20 bp, Artificial
  CRISPR gRNA sequence
tatcctctgtagcagatgct

SEQ ID NO: 737123 - DNA, 20 bp, Artificial
  CRISPR gRNA sequence
tcctctgtagcagatgctgt

SEQ ID NO: 737124 - DNA, 20 bp, Artificial
  CRISPR gRNA sequence
tgtagcagatgctgtcgggc

SEQ ID NO: 737125 - DNA, 20 bp, Artificial
  CRISPR gRNA sequence
tagcagatgctgtcgggccc

SEQ ID NO: 737126 - DNA, 20 bp, Artificial
  CRISPR gRNA sequence
tcgggcccctgcctgtgtcc

SEQ ID NO: 737127 - DNA, 20 bp, Artificial
  CRISPR gRNA sequence
cctgtgtcctcttgcctgtg

SEQ ID NO: 737128 - DNA, 20 bp, Artificial
  CRISPR gRNA sequence
tgtcctcttgcctgtgtcat

SEQ ID NO: 737129 - DNA, 20 bp, Artificial
  CRISPR gRNA sequence
ttgcctgtgtcatttccacc

SEQ ID NO: 737130 - DNA, 20 bp, Artificial
  CRISPR gRNA sequence
gcctgtgtcatttccacctg

SEQ ID NO: 737131 - DNA, 20 bp, Artificial
  CRISPR gRNA sequence
cctgtgtcatttccacctgc

SEQ ID NO: 737132 - DNA, 20 bp, Artificial
  CRISPR gRNA sequence
tgtcatttccacctgcacac

SEQ ID NO: 737133 - DNA, 20 bp, Artificial
  CRISPR gRNA sequence
ccacctgcacacatcatcag

SEQ ID NO: 737134 - DNA, 20 bp, Artificial
  CRISPR gRNA sequence
cacctgcacacatcatcagc

SEQ ID NO: 737135 - DNA, 20 bp, Artificial
  CRISPR gRNA sequence
cacacatcatcagcacctcc

SEQ ID NO: 737136 - DNA, 20 bp, Artificial
  CRISPR gRNA sequence
cttttctgtgggtgggaggc

SEQ ID NO: 737137 - DNA, 20 bp, Artificial
  CRISPR gRNA sequence
ttctgtgggtgggaggctga

SEQ ID NO: 737138 - DNA, 20 bp, Artificial
  CRISPR gRNA sequence
tctgtgggtgggaggctgag

SEQ ID NO: 737139 - DNA, 20 bp, Artificial
  CRISPR gRNA sequence
ctgtgggtgggaggctgagg

SEQ ID NO: 737140 - DNA, 20 bp, Artificial
  CRISPR gRNA sequence
tgtgggtgggaggctgaggc

SEQ ID NO: 737141 - DNA, 20 bp, Artificial
  CRISPR gRNA sequence
tgggtgggaggctgaggcct

SEQ ID NO: 737142 - DNA, 20 bp, Artificial
  CRISPR gRNA sequence
aggcctttctcttgtcacta

SEQ ID NO: 737143 - DNA, 20 bp, Artificial
  CRISPR gRNA sequence
tctcttgtcactagagccct

SEQ ID NO: 737144 - DNA, 20 bp, Artificial
  CRISPR gRNA sequence
ctcttgtcactagagccctc

SEQ ID NO: 737145 - DNA, 20 bp, Artificial
  CRISPR gRNA sequence
tcttgtcactagagccctct

SEQ ID NO: 737146 - DNA, 20 bp, Artificial
  CRISPR gRNA sequence
ttgtcactagagccctctat

SEQ ID NO: 737147 - DNA, 20 bp, Artificial
  CRISPR gRNA sequence
gtcactagagccctctatgc

SEQ ID NO: 737148 - DNA, 20 bp, Artificial
  CRISPR gRNA sequence
tcactagagccctctatgcc

SEQ ID NO: 737149 - DNA, 20 bp, Artificial
  CRISPR gRNA sequence
gagccctctatgccacacac

SEQ ID NO: 737150 - DNA, 20 bp, Artificial
  CRISPR gRNA sequence
tatgccacacacagcaggca

SEQ ID NO: 737151 - DNA, 20 bp, Artificial
  CRISPR gRNA sequence
tgccacacacagcaggcagc

SEQ ID NO: 737152 - DNA, 20 bp, Artificial
  CRISPR gRNA sequence
tactgataaccaattggagt

SEQ ID NO: 737153 - DNA, 20 bp, Artificial
  CRISPR gRNA sequence
ctgataaccaattggagttg

SEQ ID NO: 737154 - DNA, 20 bp, Artificial
  CRISPR gRNA sequence
ataaccaattggagttggtg

SEQ ID NO: 737155 - DNA, 20 bp, Artificial
  CRISPR gRNA sequence
gagttggtgtgtaactatgc

SEQ ID NO: 737156 - DNA, 20 bp, Artificial
  CRISPR gRNA sequence
gtgtgtaactatgcgggctc

SEQ ID NO: 737157 - DNA, 20 bp, Artificial
  CRISPR gRNA sequence
tgcgggctcctttgcccttc

SEQ ID NO: 737158 - DNA, 20 bp, Artificial
  CRISPR gRNA sequence
ctttgcccttcagatgtgtg

SEQ ID NO: 737159 - DNA, 20 bp, Artificial
  CRISPR gRNA sequence
tgcccttcagatgtgtgttt

SEQ ID NO: 737160 - DNA, 20 bp, Artificial
  CRISPR gRNA sequence
gcccttcagatgtgtgtttt

SEQ ID NO: 737161 - DNA, 20 bp, Artificial
  CRISPR gRNA sequence
cccttcagatgtgtgtttta

SEQ ID NO: 737162 - DNA, 20 bp, Artificial
  CRISPR gRNA sequence
cagatgtgtgttttatgcta

SEQ ID NO: 737163 - DNA, 20 bp, Artificial
  CRISPR gRNA sequence
agatgtgtgttttatgctag

SEQ ID NO: 737164 - DNA, 20 bp, Artificial
  CRISPR gRNA sequence
tatgctagatctgactctcc

SEQ ID NO: 737165 - DNA, 20 bp, Artificial
  CRISPR gRNA sequence
atgctagatctgactctccc

SEQ ID NO: 737166 - DNA, 20 bp, Artificial
  CRISPR gRNA sequence
tgctagatctgactctcccc

SEQ ID NO: 737167 - DNA, 20 bp, Artificial
  CRISPR gRNA sequence
gatctgactctccccgttgg

SEQ ID NO: 737168 - DNA, 20 bp, Artificial
  CRISPR gRNA sequence
actctccccgttgggattag

SEQ ID NO: 737169 - DNA, 20 bp, Artificial
  CRISPR gRNA sequence
tccccgttgggattaggctc

SEQ ID NO: 737170 - DNA, 20 bp, Artificial
  CRISPR gRNA sequence
cccgttgggattaggctctt

SEQ ID NO: 737171 - DNA, 20 bp, Artificial
  CRISPR gRNA sequence
ggattaggctcttgttgtgc

SEQ ID NO: 737172 - DNA, 20 bp, Artificial
  CRISPR gRNA sequence
ggctcttgttgtgcacagca

SEQ ID NO: 737173 - DNA, 20 bp, Artificial
  CRISPR gRNA sequence
ttgttgtgcacagcagctgc

SEQ ID NO: 737174 - DNA, 20 bp, Artificial
  CRISPR gRNA sequence
gttgtgcacagcagctgctt

SEQ ID NO: 737175 - DNA, 20 bp, Artificial
  CRISPR gRNA sequence
ttgtgcacagcagctgcttg

SEQ ID NO: 737176 - DNA, 20 bp, Artificial
  CRISPR gRNA sequence
tgcacagcagctgcttggtt

SEQ ID NO: 737177 - DNA, 20 bp, Artificial
  CRISPR gRNA sequence
cttggttaagtactctttat

SEQ ID NO: 737178 - DNA, 20 bp, Artificial
  CRISPR gRNA sequence
ggttaagtactctttattag

SEQ ID NO: 737179 - DNA, 20 bp, Artificial
  CRISPR gRNA sequence
gttaagtactctttattaga

SEQ ID NO: 737180 - DNA, 20 bp, Artificial
  CRISPR gRNA sequence
agtactctttattagaggcc

SEQ ID NO: 737181 - DNA, 20 bp, Artificial
  CRISPR gRNA sequence
tttattagaggccttccctg

SEQ ID NO: 737182 - DNA, 20 bp, Artificial
  CRISPR gRNA sequence
tattagaggccttccctgcc

SEQ ID NO: 737183 - DNA, 20 bp, Artificial
  CRISPR gRNA sequence
attagaggccttccctgccc

SEQ ID NO: 737184 - DNA, 20 bp, Artificial
  CRISPR gRNA sequence
ttagaggccttccctgccct

SEQ ID NO: 737185 - DNA, 20 bp, Artificial
  CRISPR gRNA sequence
gaggccttccctgccctgtc

SEQ ID NO: 737186 - DNA, 20 bp, Artificial
  CRISPR gRNA sequence
ccctgccctgtcccactccc

SEQ ID NO: 737187 - DNA, 20 bp, Artificial
  CRISPR gRNA sequence
cctgccctgtcccactcccc

SEQ ID NO: 737188 - DNA, 20 bp, Artificial
  CRISPR gRNA sequence
ccctgtcccactcccccacc

SEQ ID NO: 737189 - DNA, 20 bp, Artificial
  CRISPR gRNA sequence
tcccactcccccaccttttt

SEQ ID NO: 737190 - DNA, 20 bp, Artificial
  CRISPR gRNA sequence
ccccaccttttttccagtgt

SEQ ID NO: 737191 - DNA, 20 bp, Artificial
  CRISPR gRNA sequence
ttttccagtgttcatataag

SEQ ID NO: 737192 - DNA, 20 bp, Artificial
  CRISPR gRNA sequence
tttccagtgttcatataaga

SEQ ID NO: 737193 - DNA, 20 bp, Artificial
  CRISPR gRNA sequence
ttccagtgttcatataagac

SEQ ID NO: 737194 - DNA, 20 bp, Artificial
  CRISPR gRNA sequence
tccagtgttcatataagacg

SEQ ID NO: 737195 - DNA, 20 bp, Artificial
  CRISPR gRNA sequence
ccagtgttcatataagacgc

SEQ ID NO: 737196 - DNA, 20 bp, Artificial
  CRISPR gRNA sequence
cagtgttcatataagacgca

SEQ ID NO: 737197 - DNA, 20 bp, Artificial
  CRISPR gRNA sequence
atataagacgcaaatccctg

SEQ ID NO: 737198 - DNA, 20 bp, Artificial
  CRISPR gRNA sequence
actcagagtcagtttctcta

SEQ ID NO: 737199 - DNA, 20 bp, Artificial
  CRISPR gRNA sequence
agagtcagtttctctagagg

SEQ ID NO: 737200 - DNA, 20 bp, Artificial
  CRISPR gRNA sequence
ctctagaggaatccaaatta

SEQ ID NO: 737201 - DNA, 20 bp, Artificial
  CRISPR gRNA sequence
tctagaggaatccaaattaa

SEQ ID NO: 737202 - DNA, 20 bp, Artificial
  CRISPR gRNA sequence
tagaggaatccaaattaaag

SEQ ID NO: 737203 - DNA, 20 bp, Artificial
  CRISPR gRNA sequence
gaggaatccaaattaaagca

SEQ ID NO: 737204 - DNA, 20 bp, Artificial
  CRISPR gRNA sequence
aagcatcccccattttccac

SEQ ID NO: 737205 - DNA, 20 bp, Artificial
  CRISPR gRNA sequence
tccacttcctactccatgag

SEQ ID NO: 737206 - DNA, 20 bp, Artificial
  CRISPR gRNA sequence
ccacttcctactccatgagg

SEQ ID NO: 737207 - DNA, 20 bp, Artificial
  CRISPR gRNA sequence
cacttcctactccatgaggc

SEQ ID NO: 737208 - DNA, 20 bp, Artificial
  CRISPR gRNA sequence
cctactccatgaggcgcatc

SEQ ID NO: 737209 - DNA, 20 bp, Artificial
  CRISPR gRNA sequence
ctactccatgaggcgcatcc

SEQ ID NO: 737210 - DNA, 20 bp, Artificial
  CRISPR gRNA sequence
ctccatgaggcgcatccttg

SEQ ID NO: 737211 - DNA, 20 bp, Artificial
  CRISPR gRNA sequence
catgaggcgcatccttgccc

SEQ ID NO: 737212 - DNA, 20 bp, Artificial
  CRISPR gRNA sequence
gccctatcctcaccctctcc

SEQ ID NO: 737213 - DNA, 20 bp, Artificial
  CRISPR gRNA sequence
ccctatcctcaccctctcct

SEQ ID NO: 737214 - DNA, 20 bp, Artificial
  CRISPR gRNA sequence
tcctcaccctctcctctcca

SEQ ID NO: 737215 - DNA, 20 bp, Artificial
  CRISPR gRNA sequence
accctctcctctccatccac

SEQ ID NO: 737216 - DNA, 20 bp, Artificial
  CRISPR gRNA sequence
tcctctccatccacagacac

SEQ ID NO: 737217 - DNA, 20 bp, Artificial
  CRISPR gRNA sequence
ctctccatccacagacactt

SEQ ID NO: 737218 - DNA, 20 bp, Artificial
  CRISPR gRNA sequence
tccatccacagacacttcag

SEQ ID NO: 737219 - DNA, 20 bp, Artificial
  CRISPR gRNA sequence
catccacagacacttcagga

SEQ ID NO: 737220 - DNA, 20 bp, Artificial
  CRISPR gRNA sequence
caggacacccatcccctgac

SEQ ID NO: 737221 - DNA, 20 bp, Artificial
  CRISPR gRNA sequence
aggacacccatcccctgaca

SEQ ID NO: 737222 - DNA, 20 bp, Artificial
  CRISPR gRNA sequence
acatgctcatctctgactct

SEQ ID NO: 737223 - DNA, 20 bp, Artificial
  CRISPR gRNA sequence
atctctgactctcatccccc

SEQ ID NO: 737224 - DNA, 20 bp, Artificial
  CRISPR gRNA sequence
tgactctcatcccccctggc

SEQ ID NO: 737225 - DNA, 20 bp, Artificial
  CRISPR gRNA sequence
actctcatcccccctggccc

SEQ ID NO: 737226 - DNA, 20 bp, Artificial
  CRISPR gRNA sequence
tcatcccccctggccctaat

SEQ ID NO: 737227 - DNA, 20 bp, Artificial
  CRISPR gRNA sequence
atcccccctggccctaattc

SEQ ID NO: 737228 - DNA, 20 bp, Artificial
  CRISPR gRNA sequence
gccctaattctaccaactct

SEQ ID NO: 737229 - DNA, 20 bp, Artificial
  CRISPR gRNA sequence
attctaccaactctcattgc

SEQ ID NO: 737230 - DNA, 20 bp, Artificial
  CRISPR gRNA sequence
taccaactctcattgccccc

SEQ ID NO: 737231 - DNA, 20 bp, Artificial
  CRISPR gRNA sequence
ccaactctcattgcccccta

SEQ ID NO: 737232 - DNA, 20 bp, Artificial
  CRISPR gRNA sequence
tcattgccccctaccctcat

SEQ ID NO: 737233 - DNA, 20 bp, Artificial
  CRISPR gRNA sequence
attgccccctaccctcatct

SEQ ID NO: 737234 - DNA, 20 bp, Artificial
  CRISPR gRNA sequence
ccccctaccctcatctctgc

SEQ ID NO: 737235 - DNA, 20 bp, Artificial
  CRISPR gRNA sequence
ccctcatctctgcagccccc

SEQ ID NO: 737236 - DNA, 20 bp, Artificial
  CRISPR gRNA sequence
atctctgcagcccccctctc

SEQ ID NO: 737237 - DNA, 20 bp, Artificial
  CRISPR gRNA sequence
tgcagcccccctctcccctg

SEQ ID NO: 737238 - DNA, 20 bp, Artificial
  CRISPR gRNA sequence
cagcccccctctcccctgat

SEQ ID NO: 737239 - DNA, 20 bp, Artificial
  CRISPR gRNA sequence
tcccctgatactcctcccac

SEQ ID NO: 737240 - DNA, 20 bp, Artificial
  CRISPR gRNA sequence
ccctgatactcctcccactg

SEQ ID NO: 737241 - DNA, 20 bp, Artificial
  CRISPR gRNA sequence
atactcctcccactgacctt

SEQ ID NO: 737242 - DNA, 20 bp, Artificial
  CRISPR gRNA sequence
ctcccactgaccttcttctc

SEQ ID NO: 737243 - DNA, 20 bp, Artificial
  CRISPR gRNA sequence
ccactgaccttcttctctga

SEQ ID NO: 737244 - DNA, 20 bp, Artificial
  CRISPR gRNA sequence
accttcttctctgactctcc

SEQ ID NO: 737245 - DNA, 20 bp, Artificial
  CRISPR gRNA sequence
cttctctgactctcctcccc

SEQ ID NO: 737246 - DNA, 20 bp, Artificial
  CRISPR gRNA sequence
ttctctgactctcctccccc

SEQ ID NO: 737247 - DNA, 20 bp, Artificial
  CRISPR gRNA sequence
ctctgactctcctcccccac

SEQ ID NO: 737248 - DNA, 20 bp, Artificial
  CRISPR gRNA sequence
tctgactctcctcccccaca

SEQ ID NO: 737249 - DNA, 20 bp, Artificial
  CRISPR gRNA sequence
tgactctcctcccccacaac

SEQ ID NO: 737250 - DNA, 20 bp, Artificial
  CRISPR gRNA sequence
actctcctcccccacaacct

SEQ ID NO: 737251 - DNA, 20 bp, Artificial
  CRISPR gRNA sequence
tcctcccccacaaccttcat

SEQ ID NO: 737252 - DNA, 20 bp, Artificial
  CRISPR gRNA sequence
ctcccccacaaccttcattt

SEQ ID NO: 737253 - DNA, 20 bp, Artificial
  CRISPR gRNA sequence
ccccacaaccttcatttacc

SEQ ID NO: 737254 - DNA, 20 bp, Artificial
  CRISPR gRNA sequence
catttacccccatcctcatc

SEQ ID NO: 737255 - DNA, 20 bp, Artificial
  CRISPR gRNA sequence
atttacccccatcctcatcc

SEQ ID NO: 737256 - DNA, 20 bp, Artificial
  CRISPR gRNA sequence
acccccatcctcatccccct

SEQ ID NO: 737257 - DNA, 20 bp, Artificial
  CRISPR gRNA sequence
cccccatcctcatccccctg

SEQ ID NO: 737258 - DNA, 20 bp, Artificial
  CRISPR gRNA sequence
atccccctgaccctaatgcc

SEQ ID NO: 737259 - DNA, 20 bp, Artificial
  CRISPR gRNA sequence
accctaatgcccccgactct

SEQ ID NO: 737260 - DNA, 20 bp, Artificial
  CRISPR gRNA sequence
atgcccccgactctcatagt

SEQ ID NO: 737261 - DNA, 20 bp, Artificial
  CRISPR gRNA sequence
tcatagtcccctgccctcat

SEQ ID NO: 737262 - DNA, 20 bp, Artificial
  CRISPR gRNA sequence
atagtcccctgccctcatcc

SEQ ID NO: 737263 - DNA, 20 bp, Artificial
  CRISPR gRNA sequence
ccctcatccctgcaaccctc

SEQ ID NO: 737264 - DNA, 20 bp, Artificial
  CRISPR gRNA sequence
atccctgcaaccctcatctc

SEQ ID NO: 737265 - DNA, 20 bp, Artificial
  CRISPR gRNA sequence
caaccctcatctccccctac

SEQ ID NO: 737266 - DNA, 20 bp, Artificial
  CRISPR gRNA sequence
atctccccctacctttatcc

SEQ ID NO: 737267 - DNA, 20 bp, Artificial
  CRISPR gRNA sequence
cccctacctttatcccgacc

SEQ ID NO: 737268 - DNA, 20 bp, Artificial
  CRISPR gRNA sequence
cctttatcccgaccctcctc

SEQ ID NO: 737269 - DNA, 20 bp, Artificial
  CRISPR gRNA sequence
tatcccgaccctcctctctg

SEQ ID NO: 737270 - DNA, 20 bp, Artificial
  CRISPR gRNA sequence
atcccgaccctcctctctgc

SEQ ID NO: 737271 - DNA, 20 bp, Artificial
  CRISPR gRNA sequence
tcccgaccctcctctctgct

SEQ ID NO: 737272 - DNA, 20 bp, Artificial
  CRISPR gRNA sequence
ctctctgctgacacttcccc

SEQ ID NO: 737273 - DNA, 20 bp, Artificial
  CRISPR gRNA sequence
tctgctgacacttcccccac

SEQ ID NO: 737274 - DNA, 20 bp, Artificial
  CRISPR gRNA sequence
tgctgacacttcccccacct

SEQ ID NO: 737275 - DNA, 20 bp, Artificial
  CRISPR gRNA sequence
ctgacacttcccccaccttc

SEQ ID NO: 737276 - DNA, 20 bp, Artificial
  CRISPR gRNA sequence
acacttcccccaccttcctc

SEQ ID NO: 737277 - DNA, 20 bp, Artificial
  CRISPR gRNA sequence
cccccaccttcctcccacca

SEQ ID NO: 737278 - DNA, 20 bp, Artificial
  CRISPR gRNA sequence
ccccaccttcctcccaccaa

SEQ ID NO: 737279 - DNA, 20 bp, Artificial
  CRISPR gRNA sequence
cctcccaccaactccgctcc

SEQ ID NO: 737280 - DNA, 20 bp, Artificial
  CRISPR gRNA sequence
ctcccaccaactccgctccc

SEQ ID NO: 737281 - DNA, 20 bp, Artificial
  CRISPR gRNA sequence
ccaccaactccgctccccac

SEQ ID NO: 737282 - DNA, 20 bp, Artificial
  CRISPR gRNA sequence
cgctccccactgaccctcat

SEQ ID NO: 737283 - DNA, 20 bp, Artificial
  CRISPR gRNA sequence
cccactgaccctcatccttc

SEQ ID NO: 737284 - DNA, 20 bp, Artificial
  CRISPR gRNA sequence
accctcatccttcctgatcc

SEQ ID NO: 737285 - DNA, 20 bp, Artificial
  CRISPR gRNA sequence
atccttcctgatcctccttt

SEQ ID NO: 737286 - DNA, 20 bp, Artificial
  CRISPR gRNA sequence
cctgatcctcctttcacctg

SEQ ID NO: 737287 - DNA, 20 bp, Artificial
  CRISPR gRNA sequence
ctgatcctcctttcacctga

SEQ ID NO: 737288 - DNA, 20 bp, Artificial
  CRISPR gRNA sequence
atcctcctttcacctgacct

SEQ ID NO: 737289 - DNA, 20 bp, Artificial
  CRISPR gRNA sequence
ctttcacctgaccttcctcc

SEQ ID NO: 737290 - DNA, 20 bp, Artificial
  CRISPR gRNA sequence
tcacctgaccttcctcctcc

SEQ ID NO: 737291 - DNA, 20 bp, Artificial
  CRISPR gRNA sequence
cacctgaccttcctcctccc

SEQ ID NO: 737292 - DNA, 20 bp, Artificial
  CRISPR gRNA sequence
acctgaccttcctcctccct

SEQ ID NO: 737293 - DNA, 20 bp, Artificial
  CRISPR gRNA sequence
accttcctcctccctgatcc

SEQ ID NO: 737294 - DNA, 20 bp, Artificial
  CRISPR gRNA sequence
cctcctccctgatcctcctc

SEQ ID NO: 737295 - DNA, 20 bp, Artificial
  CRISPR gRNA sequence
ctcctccctgatcctcctcc

SEQ ID NO: 737296 - DNA, 20 bp, Artificial
  CRISPR gRNA sequence
ctccctgatcctcctccccc

SEQ ID NO: 737297 - DNA, 20 bp, Artificial
  CRISPR gRNA sequence
cctgatcctcctcccccgac

SEQ ID NO: 737298 - DNA, 20 bp, Artificial
  CRISPR gRNA sequence
atcctcctcccccgaccctc

SEQ ID NO: 737299 - DNA, 20 bp, Artificial
  CRISPR gRNA sequence
ctcccccgaccctcctttcc

SEQ ID NO: 737300 - DNA, 20 bp, Artificial
  CRISPR gRNA sequence
ccccgaccctcctttcccct

SEQ ID NO: 737301 - DNA, 20 bp, Artificial
  CRISPR gRNA sequence
ctttcccctgtccctcctgt

SEQ ID NO: 737302 - DNA, 20 bp, Artificial
  CRISPR gRNA sequence
tcccctgtccctcctgtccc

SEQ ID NO: 737303 - DNA, 20 bp, Artificial
  CRISPR gRNA sequence
cccctgtccctcctgtcccc

SEQ ID NO: 737304 - DNA, 20 bp, Artificial
  CRISPR gRNA sequence
ccctgtccctcctgtcccca

SEQ ID NO: 737305 - DNA, 20 bp, Artificial
  CRISPR gRNA sequence
tccctcctgtccccaccctt

SEQ ID NO: 737306 - DNA, 20 bp, Artificial
  CRISPR gRNA sequence
ctgtccccacccttctttcc

SEQ ID NO: 737307 - DNA, 20 bp, Artificial
  CRISPR gRNA sequence
tccccacccttctttcccct

SEQ ID NO: 737308 - DNA, 20 bp, Artificial
  CRISPR gRNA sequence
ctttcccctgcccctcctcc

SEQ ID NO: 737309 - DNA, 20 bp, Artificial
  CRISPR gRNA sequence
tttcccctgcccctcctccc

SEQ ID NO: 737310 - DNA, 20 bp, Artificial
  CRISPR gRNA sequence
tcccctgcccctcctcccca

SEQ ID NO: 737311 - DNA, 20 bp, Artificial
  CRISPR gRNA sequence
cccctgcccctcctccccac

SEQ ID NO: 737312 - DNA, 20 bp, Artificial
  CRISPR gRNA sequence
ccctgcccctcctccccact

SEQ ID NO: 737313 - DNA, 20 bp, Artificial
  CRISPR gRNA sequence
cccctcctccccactgaccc

SEQ ID NO: 737314 - DNA, 20 bp, Artificial
  CRISPR gRNA sequence
ctccccactgaccctccttt

SEQ ID NO: 737315 - DNA, 20 bp, Artificial
  CRISPR gRNA sequence
cccactgaccctcctttccc

SEQ ID NO: 737316 - DNA, 20 bp, Artificial
  CRISPR gRNA sequence
accctcctttcccctgcccc

SEQ ID NO: 737317 - DNA, 20 bp, Artificial
  CRISPR gRNA sequence
ctttcccctgcccctcctcc

SEQ ID NO: 737318 - DNA, 20 bp, Artificial
  CRISPR gRNA sequence
tcccctgcccctcctcccca

SEQ ID NO: 737319 - DNA, 20 bp, Artificial
  CRISPR gRNA sequence
cccctgcccctcctccccac

SEQ ID NO: 737320 - DNA, 20 bp, Artificial
  CRISPR gRNA sequence
ccctgcccctcctccccacc

SEQ ID NO: 737321 - DNA, 20 bp, Artificial
  CRISPR gRNA sequence
cccctcctccccacccccga

SEQ ID NO: 737322 - DNA, 20 bp, Artificial
  CRISPR gRNA sequence
ctccccacccccgaccctcc

SEQ ID NO: 737323 - DNA, 20 bp, Artificial
  CRISPR gRNA sequence
cccacccccgaccctccttt

SEQ ID NO: 737324 - DNA, 20 bp, Artificial
  CRISPR gRNA sequence
ctttcccctgcccctcctct

SEQ ID NO: 737325 - DNA, 20 bp, Artificial
  CRISPR gRNA sequence
tcccctgcccctcctctctc

SEQ ID NO: 737326 - DNA, 20 bp, Artificial
  CRISPR gRNA sequence
cccctgcccctcctctctcc

SEQ ID NO: 737327 - DNA, 20 bp, Artificial
  CRISPR gRNA sequence
ccctgcccctcctctctcct

SEQ ID NO: 737328 - DNA, 20 bp, Artificial
  CRISPR gRNA sequence
cccctcctctctcctgcccc

SEQ ID NO: 737329 - DNA, 20 bp, Artificial
  CRISPR gRNA sequence
ctctctcctgcccctcctct

SEQ ID NO: 737330 - DNA, 20 bp, Artificial
  CRISPR gRNA sequence
tctcctgcccctcctctcca

SEQ ID NO: 737331 - DNA, 20 bp, Artificial
  CRISPR gRNA sequence
tcctgcccctcctctccatt

SEQ ID NO: 737332 - DNA, 20 bp, Artificial
  CRISPR gRNA sequence
ctgcccctcctctccattgc

SEQ ID NO: 737333 - DNA, 20 bp, Artificial
  CRISPR gRNA sequence
cccctcctctccattgccat

SEQ ID NO: 737334 - DNA, 20 bp, Artificial
  CRISPR gRNA sequence
ctctccattgccatccttta

SEQ ID NO: 737335 - DNA, 20 bp, Artificial
  CRISPR gRNA sequence
tccattgccatcctttatgt

SEQ ID NO: 737336 - DNA, 20 bp, Artificial
  CRISPR gRNA sequence
cattgccatcctttatgtca

SEQ ID NO: 737337 - DNA, 20 bp, Artificial
  CRISPR gRNA sequence
ccatcctttatgtcacttcc

SEQ ID NO: 737338 - DNA, 20 bp, Artificial
  CRISPR gRNA sequence
tatgtcacttccagtccccc

SEQ ID NO: 737339 - DNA, 20 bp, Artificial
  CRISPR gRNA sequence
atgtcacttccagtccccca

SEQ ID NO: 737340 - DNA, 20 bp, Artificial
  CRISPR gRNA sequence
tgtcacttccagtcccccac

SEQ ID NO: 737341 - DNA, 20 bp, Artificial
  CRISPR gRNA sequence
ccagtcccccacctcacatt

SEQ ID NO: 737342 - DNA, 20 bp, Artificial
  CRISPR gRNA sequence
cagtcccccacctcacattc

SEQ ID NO: 737343 - DNA, 20 bp, Artificial
  CRISPR gRNA sequence
acattcagaagcaggccaca

SEQ ID NO: 737344 - DNA, 20 bp, Artificial
  CRISPR gRNA sequence
agaagcaggccacattgggt

SEQ ID NO: 737345 - DNA, 20 bp, Artificial
  CRISPR gRNA sequence
ggttcctggggagcaaaagg

SEQ ID NO: 737346 - DNA, 20 bp, Artificial
  CRISPR gRNA sequence
ctggggagcaaaaggggaag

SEQ ID NO: 737347 - DNA, 20 bp, Artificial
  CRISPR gRNA sequence
gggagcaaaaggggaaggtc

SEQ ID NO: 737348 - DNA, 20 bp, Artificial
  CRISPR gRNA sequence
gcacctccaggtctgtttgg

SEQ ID NO: 737349 - DNA, 20 bp, Artificial
  CRISPR gRNA sequence
cacctccaggtctgtttggg

SEQ ID NO: 737350 - DNA, 20 bp, Artificial
  CRISPR gRNA sequence
caggtctgtttgggcactaa

SEQ ID NO: 737351 - DNA, 20 bp, Artificial
  CRISPR gRNA sequence
tttgggcactaagtgctggt

SEQ ID NO: 737352 - DNA, 20 bp, Artificial
  CRISPR gRNA sequence
gggcactaagtgctggtgcc

SEQ ID NO: 737353 - DNA, 20 bp, Artificial
  CRISPR gRNA sequence
ggcactaagtgctggtgcca

SEQ ID NO: 737354 - DNA, 20 bp, Artificial
  CRISPR gRNA sequence
agtgctggtgccactcaacc

SEQ ID NO: 737355 - DNA, 20 bp, Artificial
  CRISPR gRNA sequence
gtgccactcaaccccaggcc

SEQ ID NO: 737356 - DNA, 20 bp, Artificial
  CRISPR gRNA sequence
aaccccaggccccacaggta

SEQ ID NO: 737357 - DNA, 20 bp, Artificial
  CRISPR gRNA sequence
atggagggcatggagggtag

SEQ ID NO: 737358 - DNA, 20 bp, Artificial
  CRISPR gRNA sequence
ttgaggagagatctgctggt

SEQ ID NO: 737359 - DNA, 20 bp, Artificial
  CRISPR gRNA sequence
aggagagatctgctggtgag

SEQ ID NO: 737360 - DNA, 20 bp, Artificial
  CRISPR gRNA sequence
ctggtgaggcagagccctgt

SEQ ID NO: 737361 - DNA, 20 bp, Artificial
  CRISPR gRNA sequence
gtgaggcagagccctgtggt

SEQ ID NO: 737362 - DNA, 20 bp, Artificial
  CRISPR gRNA sequence
tggtgggcgatctggtgctg

SEQ ID NO: 737363 - DNA, 20 bp, Artificial
  CRISPR gRNA sequence
gtgctgaggtccccagactt

SEQ ID NO: 737364 - DNA, 20 bp, Artificial
  CRISPR gRNA sequence
aggtccccagacttagtgga

SEQ ID NO: 737365 - DNA, 20 bp, Artificial
  CRISPR gRNA sequence
agtggagatggattctgggc

SEQ ID NO: 737366 - DNA, 20 bp, Artificial
  CRISPR gRNA sequence
gtggagatggattctgggcc

SEQ ID NO: 737367 - DNA, 20 bp, Artificial
  CRISPR gRNA sequence
tgggccagcagaggagtccc

SEQ ID NO: 737368 - DNA, 20 bp, Artificial
  CRISPR gRNA sequence
ggccagcagaggagtccctg

SEQ ID NO: 737369 - DNA, 20 bp, Artificial
  CRISPR gRNA sequence
gcattgctgggagacgcggt

SEQ ID NO: 737370 - DNA, 20 bp, Artificial
  CRISPR gRNA sequence
ctgggagacgcggtcactgt

SEQ ID NO: 737371 - DNA, 20 bp, Artificial
  CRISPR gRNA sequence
ggagacgcggtcactgtctg

SEQ ID NO: 737372 - DNA, 20 bp, Artificial
  CRISPR gRNA sequence
tctgggaccccatggtcctc

SEQ ID NO: 737373 - DNA, 20 bp, Artificial
  CRISPR gRNA sequence
ggaccccatggtcctcctgg

SEQ ID NO: 737374 - DNA, 20 bp, Artificial
  CRISPR gRNA sequence
ctgggtccctggctggtggt

SEQ ID NO: 737375 - DNA, 20 bp, Artificial
  CRISPR gRNA sequence
ggtccctggctggtggtgct

SEQ ID NO: 737376 - DNA, 20 bp, Artificial
  CRISPR gRNA sequence
gctggtggtgctggtagcag

SEQ ID NO: 737377 - DNA, 20 bp, Artificial
  CRISPR gRNA sequence
gtggtgctggtagcagtgaa

SEQ ID NO: 737378 - DNA, 20 bp, Artificial
  CRISPR gRNA sequence
gtagcagtgaagctgtagcc

SEQ ID NO: 737379 - DNA, 20 bp, Artificial
  CRISPR gRNA sequence
tagcctgtcttggaggcagg

SEQ ID NO: 737380 - DNA, 20 bp, Artificial
  CRISPR gRNA sequence
tcttggaggcaggtctggtg

SEQ ID NO: 737381 - DNA, 20 bp, Artificial
  CRISPR gRNA sequence
ggaggcaggtctggtggagg

SEQ ID NO: 737382 - DNA, 20 bp, Artificial
  CRISPR gRNA sequence
gaggcaggtctggtggaggc

SEQ ID NO: 737383 - DNA, 20 bp, Artificial
  CRISPR gRNA sequence
gtggaggctaagagcctagg

SEQ ID NO: 737384 - DNA, 20 bp, Artificial
  CRISPR gRNA sequence
agagcctaggcaaggtgatg

SEQ ID NO: 737385 - DNA, 20 bp, Artificial
  CRISPR gRNA sequence
ggcaaggtgatgagtcctgg

SEQ ID NO: 737386 - DNA, 20 bp, Artificial
  CRISPR gRNA sequence
gggtgaacaccatcacacca

SEQ ID NO: 737387 - DNA, 20 bp, Artificial
  CRISPR gRNA sequence
aggtaggggcttggccagtt

SEQ ID NO: 737388 - DNA, 20 bp, Artificial
  CRISPR gRNA sequence
ggccagttgtgacagttcca

SEQ ID NO: 737389 - DNA, 20 bp, Artificial
  CRISPR gRNA sequence
gccagttgtgacagttccac

SEQ ID NO: 737390 - DNA, 20 bp, Artificial
  CRISPR gRNA sequence
tgacagttccactcttgagg

SEQ ID NO: 737391 - DNA, 20 bp, Artificial
  CRISPR gRNA sequence
cactcttgaggatgttgtcc

SEQ ID NO: 737392 - DNA, 20 bp, Artificial
  CRISPR gRNA sequence
ttgaggatgttgtccagatg

SEQ ID NO: 737393 - DNA, 20 bp, Artificial
  CRISPR gRNA sequence
gaggatgttgtccagatgtg

SEQ ID NO: 737394 - DNA, 20 bp, Artificial
  CRISPR gRNA sequence
aggatgttgtccagatgtgt

SEQ ID NO: 737395 - DNA, 20 bp, Artificial
  CRISPR gRNA sequence
tccagatgtgtgaaaggaat

SEQ ID NO: 737396 - DNA, 20 bp, Artificial
  CRISPR gRNA sequence
ctctcagtttggggagctga

SEQ ID NO: 737397 - DNA, 20 bp, Artificial
  CRISPR gRNA sequence
tcagtttggggagctgaaag

SEQ ID NO: 737398 - DNA, 20 bp, Artificial
  CRISPR gRNA sequence
agtttggggagctgaaagac

SEQ ID NO: 737399 - DNA, 20 bp, Artificial
  CRISPR gRNA sequence
ggggagctgaaagacagaaa

SEQ ID NO: 737400 - DNA, 20 bp, Artificial
  CRISPR gRNA sequence
gggagctgaaagacagaaag

SEQ ID NO: 737401 - DNA, 20 bp, Artificial
  CRISPR gRNA sequence
aaagacagaaagggaggaac

SEQ ID NO: 737402 - DNA, 20 bp, Artificial
  CRISPR gRNA sequence
gattgacttgggtgcctcag

SEQ ID NO: 737403 - DNA, 20 bp, Artificial
  CRISPR gRNA sequence
acttgggtgcctcagtgctg

SEQ ID NO: 737404 - DNA, 20 bp, Artificial
  CRISPR gRNA sequence
gggtgcctcagtgctgggag

SEQ ID NO: 737405 - DNA, 20 bp, Artificial
  CRISPR gRNA sequence
ggtgcctcagtgctgggagc

SEQ ID NO: 737406 - DNA, 20 bp, Artificial
  CRISPR gRNA sequence
agtgctgggagcagatcctg

SEQ ID NO: 737407 - DNA, 20 bp, Artificial
  CRISPR gRNA sequence
ggagcagatcctggcaaccc

SEQ ID NO: 737408 - DNA, 20 bp, Artificial
  CRISPR gRNA sequence
gcaacccacacagttgcctg

SEQ ID NO: 737409 - DNA, 20 bp, Artificial
  CRISPR gRNA sequence
cctggaagcctggatggggg

SEQ ID NO: 737410 - DNA, 20 bp, Artificial
  CRISPR gRNA sequence
gaagcctggatgggggcctg

SEQ ID NO: 737411 - DNA, 20 bp, Artificial
  CRISPR gRNA sequence
gatgggggcctgtcctcttc

SEQ ID NO: 737412 - DNA, 20 bp, Artificial
  CRISPR gRNA sequence
tcctcttctcttctccttga

SEQ ID NO: 737413 - DNA, 20 bp, Artificial
  CRISPR gRNA sequence
ttctcttctccttgaccttg

SEQ ID NO: 737414 - DNA, 20 bp, Artificial
  CRISPR gRNA sequence
ctcttctccttgaccttggg

SEQ ID NO: 737415 - DNA, 20 bp, Artificial
  CRISPR gRNA sequence
tcttctccttgaccttgggc

SEQ ID NO: 737416 - DNA, 20 bp, Artificial
  CRISPR gRNA sequence
ttctccttgaccttgggcct

SEQ ID NO: 737417 - DNA, 20 bp, Artificial
  CRISPR gRNA sequence
ctccttgaccttgggcctag

SEQ ID NO: 737418 - DNA, 20 bp, Artificial
  CRISPR gRNA sequence
tccttgaccttgggcctagg

SEQ ID NO: 737419 - DNA, 20 bp, Artificial
  CRISPR gRNA sequence
cttgaccttgggcctaggat

SEQ ID NO: 737420 - DNA, 20 bp, Artificial
  CRISPR gRNA sequence
gaccttgggcctaggattct

SEQ ID NO: 737421 - DNA, 20 bp, Artificial
  CRISPR gRNA sequence
accttgggcctaggattctg

SEQ ID NO: 737422 - DNA, 20 bp, Artificial
  CRISPR gRNA sequence
gggcctaggattctggctgc

SEQ ID NO: 737423 - DNA, 20 bp, Artificial
  CRISPR gRNA sequence
ggcctaggattctggctgct

SEQ ID NO: 737424 - DNA, 20 bp, Artificial
  CRISPR gRNA sequence
ggattctggctgctgagtga

SEQ ID NO: 737425 - DNA, 20 bp, Artificial
  CRISPR gRNA sequence
tggctgctgagtgatcagat

SEQ ID NO: 737426 - DNA, 20 bp, Artificial
  CRISPR gRNA sequence
gctgctgagtgatcagatgt

SEQ ID NO: 737427 - DNA, 20 bp, Artificial
  CRISPR gRNA sequence
ctgagtgatcagatgtgtat

SEQ ID NO: 737428 - DNA, 20 bp, Artificial
  CRISPR gRNA sequence
agtgatcagatgtgtatttg

SEQ ID NO: 737429 - DNA, 20 bp, Artificial
  CRISPR gRNA sequence
gttcagaaagtgatatcagg

SEQ ID NO: 737430 - DNA, 20 bp, Artificial
  CRISPR gRNA sequence
ttcagaaagtgatatcagga

SEQ ID NO: 737431 - DNA, 20 bp, Artificial
  CRISPR gRNA sequence
agaaagtgatatcaggagga

SEQ ID NO: 737432 - DNA, 20 bp, Artificial
  CRISPR gRNA sequence
aagaagggagagactaccac

SEQ ID NO: 737433 - DNA, 20 bp, Artificial
  CRISPR gRNA sequence
ccacaatttctttttccctc

SEQ ID NO: 737434 - DNA, 20 bp, Artificial
  CRISPR gRNA sequence
ctttttccctcccgtgtcag

SEQ ID NO: 737435 - DNA, 20 bp, Artificial
  CRISPR gRNA sequence
tttttccctcccgtgtcagg

SEQ ID NO: 737436 - DNA, 20 bp, Artificial
  CRISPR gRNA sequence
tttccctcccgtgtcaggcc

SEQ ID NO: 737437 - DNA, 20 bp, Artificial
  CRISPR gRNA sequence
ttccctcccgtgtcaggcca

SEQ ID NO: 737438 - DNA, 20 bp, Artificial
  CRISPR gRNA sequence
tccctcccgtgtcaggccac

SEQ ID NO: 737439 - DNA, 20 bp, Artificial
  CRISPR gRNA sequence
ccctcccgtgtcaggccacc

SEQ ID NO: 737440 - DNA, 20 bp, Artificial
  CRISPR gRNA sequence
cctcccgtgtcaggccacct

SEQ ID NO: 737441 - DNA, 20 bp, Artificial
  CRISPR gRNA sequence
ccgtgtcaggccacctgttc

SEQ ID NO: 737442 - DNA, 20 bp, Artificial
  CRISPR gRNA sequence
ttccctctccatccccatct

SEQ ID NO: 737443 - DNA, 20 bp, Artificial
  CRISPR gRNA sequence
cctctccatccccatctctc

SEQ ID NO: 737444 - DNA, 20 bp, Artificial
  CRISPR gRNA sequence
tccatccccatctctctctt

SEQ ID NO: 737445 - DNA, 20 bp, Artificial
  CRISPR gRNA sequence
catccccatctctctctttt

SEQ ID NO: 737446 - DNA, 20 bp, Artificial
  CRISPR gRNA sequence
tctcttttcactttccaggc

SEQ ID NO: 737447 - DNA, 20 bp, Artificial
  CRISPR gRNA sequence
tcttttcactttccaggccc

SEQ ID NO: 737448 - DNA, 20 bp, Artificial
  CRISPR gRNA sequence
ttttcactttccaggccctc

SEQ ID NO: 737449 - DNA, 20 bp, Artificial
  CRISPR gRNA sequence
ttcactttccaggccctctt

SEQ ID NO: 737450 - DNA, 20 bp, Artificial
  CRISPR gRNA sequence
tcactttccaggccctcttc

SEQ ID NO: 737451 - DNA, 20 bp, Artificial
  CRISPR gRNA sequence
cactttccaggccctcttcg

SEQ ID NO: 737452 - DNA, 20 bp, Artificial
  CRISPR gRNA sequence
actttccaggccctcttcgt

SEQ ID NO: 737453 - DNA, 20 bp, Artificial
  CRISPR gRNA sequence
tccaggccctcttcgttcct

SEQ ID NO: 737454 - DNA, 20 bp, Artificial
  CRISPR gRNA sequence
ccaggccctcttcgttccta

SEQ ID NO: 737455 - DNA, 20 bp, Artificial
  CRISPR gRNA sequence
caggccctcttcgttcctat

SEQ ID NO: 737456 - DNA, 20 bp, Artificial
  CRISPR gRNA sequence
ttcgttcctatgggccaaaa

SEQ ID NO: 737457 - DNA, 20 bp, Artificial
  CRISPR gRNA sequence
cgttcctatgggccaaaaag

SEQ ID NO: 737458 - DNA, 20 bp, Artificial
  CRISPR gRNA sequence
gttcctatgggccaaaaaga

SEQ ID NO: 737459 - DNA, 20 bp, Artificial
  CRISPR gRNA sequence
ctatgggccaaaaagatttc

SEQ ID NO: 737460 - DNA, 20 bp, Artificial
  CRISPR gRNA sequence
tgggccaaaaagatttccat

SEQ ID NO: 737461 - DNA, 20 bp, Artificial
  CRISPR gRNA sequence
ccataaaataatgtcaaaca

SEQ ID NO: 737462 - DNA, 20 bp, Artificial
  CRISPR gRNA sequence
cataaaataatgtcaaacaa

SEQ ID NO: 737463 - DNA, 20 bp, Artificial
  CRISPR gRNA sequence
ttccagctattccataattg

SEQ ID NO: 737464 - DNA, 20 bp, Artificial
  CRISPR gRNA sequence
tccagctattccataattga

SEQ ID NO: 737465 - DNA, 20 bp, Artificial
  CRISPR gRNA sequence
ccagctattccataattgac

SEQ ID NO: 737466 - DNA, 20 bp, Artificial
  CRISPR gRNA sequence
cagctattccataattgaca

SEQ ID NO: 737467 - DNA, 20 bp, Artificial
  CRISPR gRNA sequence
ttccataattgacaagtagg

SEQ ID NO: 737468 - DNA, 20 bp, Artificial
  CRISPR gRNA sequence
cataattgacaagtagggtc

SEQ ID NO: 737469 - DNA, 20 bp, Artificial
  CRISPR gRNA sequence
acaagtagggtccagagatg

SEQ ID NO: 737470 - DNA, 20 bp, Artificial
  CRISPR gRNA sequence
aaattccaaagaaagctgca

SEQ ID NO: 737471 - DNA, 20 bp, Artificial
  CRISPR gRNA sequence
caaagaaagctgcagtcagt

SEQ ID NO: 737472 - DNA, 20 bp, Artificial
  CRISPR gRNA sequence
cagtcagttggggtcagaca

SEQ ID NO: 737473 - DNA, 20 bp, Artificial
  CRISPR gRNA sequence
gggtcagacactttccttgg

SEQ ID NO: 737474 - DNA, 20 bp, Artificial
  CRISPR gRNA sequence
tccttgggggctcactaaga

SEQ ID NO: 737475 - DNA, 20 bp, Artificial
  CRISPR gRNA sequence
ccttgggggctcactaagag

SEQ ID NO: 737476 - DNA, 20 bp, Artificial
  CRISPR gRNA sequence
cttgggggctcactaagaga

SEQ ID NO: 737477 - DNA, 20 bp, Artificial
  CRISPR gRNA sequence
gggggctcactaagagatat

SEQ ID NO: 737478 - DNA, 20 bp, Artificial
  CRISPR gRNA sequence
ggggctcactaagagatatc

SEQ ID NO: 737479 - DNA, 20 bp, Artificial
  CRISPR gRNA sequence
actaagagatatcaaactgg

SEQ ID NO: 737480 - DNA, 20 bp, Artificial
  CRISPR gRNA sequence
agagatatcaaactggtcct

SEQ ID NO: 737481 - DNA, 20 bp, Artificial
  CRISPR gRNA sequence
gtcctgctacactcacccat

SEQ ID NO: 737482 - DNA, 20 bp, Artificial
  CRISPR gRNA sequence
ctacactcacccatcaaccc

SEQ ID NO: 737483 - DNA, 20 bp, Artificial
  CRISPR gRNA sequence
cactcacccatcaacccagc

SEQ ID NO: 737484 - DNA, 20 bp, Artificial
  CRISPR gRNA sequence
acccatcaacccagcccttt

SEQ ID NO: 737485 - DNA, 20 bp, Artificial
  CRISPR gRNA sequence
ttccatcccattttctagaa

SEQ ID NO: 737486 - DNA, 20 bp, Artificial
  CRISPR gRNA sequence
tccatcccattttctagaag

SEQ ID NO: 737487 - DNA, 20 bp, Artificial
  CRISPR gRNA sequence
ccatcccattttctagaaga

SEQ ID NO: 737488 - DNA, 20 bp, Artificial
  CRISPR gRNA sequence
catcccattttctagaagaa

SEQ ID NO: 737489 - DNA, 20 bp, Artificial
  CRISPR gRNA sequence
tctagaagaagcctgggttt

SEQ ID NO: 737490 - DNA, 20 bp, Artificial
  CRISPR gRNA sequence
ctagaagaagcctgggtttt

SEQ ID NO: 737491 - DNA, 20 bp, Artificial
  CRISPR gRNA sequence
tagaagaagcctgggttttg

SEQ ID NO: 737492 - DNA, 20 bp, Artificial
  CRISPR gRNA sequence
gaagaagcctgggttttgga

SEQ ID NO: 737493 - DNA, 20 bp, Artificial
  CRISPR gRNA sequence
ggttttggacagtggatgag

SEQ ID NO: 737494 - DNA, 20 bp, Artificial
  CRISPR gRNA sequence
tggacagtggatgaggaggg

SEQ ID NO: 737495 - DNA, 20 bp, Artificial
  CRISPR gRNA sequence
ggacagtggatgaggaggga

SEQ ID NO: 737496 - DNA, 20 bp, Artificial
  CRISPR gRNA sequence
gacagtggatgaggagggag

SEQ ID NO: 737497 - DNA, 20 bp, Artificial
  CRISPR gRNA sequence
tgaggcatcaacctagcagt

SEQ ID NO: 737498 - DNA, 20 bp, Artificial
  CRISPR gRNA sequence
gcagtgagtgatggttttat

SEQ ID NO: 737499 - DNA, 20 bp, Artificial
  CRISPR gRNA sequence
tatctcagcatggaatgtga

SEQ ID NO: 737500 - DNA, 20 bp, Artificial
  CRISPR gRNA sequence
atctcagcatggaatgtgaa

SEQ ID NO: 737501 - DNA, 20 bp, Artificial
  CRISPR gRNA sequence
tctcagcatggaatgtgaaa

SEQ ID NO: 737502 - DNA, 20 bp, Artificial
  CRISPR gRNA sequence
agcatggaatgtgaaaattg

SEQ ID NO: 737503 - DNA, 20 bp, Artificial
  CRISPR gRNA sequence
gagacagaggctgctacatc

SEQ ID NO: 737504 - DNA, 20 bp, Artificial
  CRISPR gRNA sequence
ctacatcccactactgtgca

SEQ ID NO: 737505 - DNA, 20 bp, Artificial
  CRISPR gRNA sequence
catcccactactgtgcatgg

SEQ ID NO: 737506 - DNA, 20 bp, Artificial
  CRISPR gRNA sequence
ctgtgcatggaaagggcaat

SEQ ID NO: 737507 - DNA, 20 bp, Artificial
  CRISPR gRNA sequence
tgcatggaaagggcaatttc

SEQ ID NO: 737508 - DNA, 20 bp, Artificial
  CRISPR gRNA sequence
cctaagggccaaattgtcat

SEQ ID NO: 737509 - DNA, 20 bp, Artificial
  CRISPR gRNA sequence
ctaagggccaaattgtcatc

SEQ ID NO: 737510 - DNA, 20 bp, Artificial
  CRISPR gRNA sequence
agggccaaattgtcatcatg

SEQ ID NO: 737511 - DNA, 20 bp, Artificial
  CRISPR gRNA sequence
tcatcatggaaggtggctga

SEQ ID NO: 737512 - DNA, 20 bp, Artificial
  CRISPR gRNA sequence
agcttgagccatttttctgg

SEQ ID NO: 737513 - DNA, 20 bp, Artificial
  CRISPR gRNA sequence
gagccatttttctggagaag

SEQ ID NO: 737514 - DNA, 20 bp, Artificial
  CRISPR gRNA sequence
agccatttttctggagaagg

SEQ ID NO: 737515 - DNA, 20 bp, Artificial
  CRISPR gRNA sequence
ttctggagaaggggacccag

SEQ ID NO: 737516 - DNA, 20 bp, Artificial
  CRISPR gRNA sequence
tctggagaaggggacccaga

SEQ ID NO: 737517 - DNA, 20 bp, Artificial
  CRISPR gRNA sequence
ctggagaaggggacccagaa

SEQ ID NO: 737518 - DNA, 20 bp, Artificial
  CRISPR gRNA sequence
tggagaaggggacccagaac

SEQ ID NO: 737519 - DNA, 20 bp, Artificial
  CRISPR gRNA sequence
gagaaggggacccagaacaa

SEQ ID NO: 737520 - DNA, 20 bp, Artificial
  CRISPR gRNA sequence
gtgaggatgggaatagagga

SEQ ID NO: 737521 - DNA, 20 bp, Artificial
  CRISPR gRNA sequence
acctggagtcagagctccca

SEQ ID NO: 737522 - DNA, 20 bp, Artificial
  CRISPR gRNA sequence
gagtcagagctcccacaaca

SEQ ID NO: 737523 - DNA, 20 bp, Artificial
  CRISPR gRNA sequence
ccacaacatcatactcagca

SEQ ID NO: 737524 - DNA, 20 bp, Artificial
  CRISPR gRNA sequence
agcagtggggacacccccaa

SEQ ID NO: 737525 - DNA, 20 bp, Artificial
  CRISPR gRNA sequence
ttcagagaattcacacatca

SEQ ID NO: 737526 - DNA, 20 bp, Artificial
  CRISPR gRNA sequence
cagagaattcacacatcagt

SEQ ID NO: 737527 - DNA, 20 bp, Artificial
  CRISPR gRNA sequence
agagaattcacacatcagtg

SEQ ID NO: 737528 - DNA, 20 bp, Artificial
  CRISPR gRNA sequence
acacatcagtgccttgggag

SEQ ID NO: 737529 - DNA, 20 bp, Artificial
  CRISPR gRNA sequence
gggagagtatatggacactc

SEQ ID NO: 737530 - DNA, 20 bp, Artificial
  CRISPR gRNA sequence
ggagagtatatggacactca

SEQ ID NO: 737531 - DNA, 20 bp, Artificial
  CRISPR gRNA sequence
agagaggatctcaaagggct

SEQ ID NO: 737532 - DNA, 20 bp, Artificial
  CRISPR gRNA sequence
aaagggctggcagacaagca

SEQ ID NO: 737533 - DNA, 20 bp, Artificial
  CRISPR gRNA sequence
gcagacaagcaatgacatcc

SEQ ID NO: 737534 - DNA, 20 bp, Artificial
  CRISPR gRNA sequence
ctacaacactcagttaagcc

SEQ ID NO: 737535 - DNA, 20 bp, Artificial
  CRISPR gRNA sequence
caacactcagttaagccaca

SEQ ID NO: 737536 - DNA, 20 bp, Artificial
  CRISPR gRNA sequence
agttaagccacataaccatc

SEQ ID NO: 737537 - DNA, 20 bp, Artificial
  CRISPR gRNA sequence
agccacataaccatctcccc

SEQ ID NO: 737538 - DNA, 20 bp, Artificial
  CRISPR gRNA sequence
cccctccctcattcctgcat

SEQ ID NO: 737539 - DNA, 20 bp, Artificial
  CRISPR gRNA sequence
cctcattcctgcatcaacac

SEQ ID NO: 737540 - DNA, 20 bp, Artificial
  CRISPR gRNA sequence
attcctgcatcaacacacta

SEQ ID NO: 737541 - DNA, 20 bp, Artificial
  CRISPR gRNA sequence
ctgcatcaacacactaagag

SEQ ID NO: 737542 - DNA, 20 bp, Artificial
  CRISPR gRNA sequence
catcaacacactaagagggc

SEQ ID NO: 737543 - DNA, 20 bp, Artificial
  CRISPR gRNA sequence
agagggccaagaagaggtaa

SEQ ID NO: 737544 - DNA, 20 bp, Artificial
  CRISPR gRNA sequence
cttcacagcccaagatgcag

SEQ ID NO: 737545 - DNA, 20 bp, Artificial
  CRISPR gRNA sequence
ttcacagcccaagatgcagg

SEQ ID NO: 737546 - DNA, 20 bp, Artificial
  CRISPR gRNA sequence
cacagcccaagatgcaggat

SEQ ID NO: 737547 - DNA, 20 bp, Artificial
  CRISPR gRNA sequence
acagcccaagatgcaggatg

SEQ ID NO: 737548 - DNA, 20 bp, Artificial
  CRISPR gRNA sequence
ggcagccagtaactttcctt

SEQ ID NO: 737549 - DNA, 20 bp, Artificial
  CRISPR gRNA sequence
tccttctccactttagatgc

SEQ ID NO: 737550 - DNA, 20 bp, Artificial
  CRISPR gRNA sequence
ccttctccactttagatgcc

SEQ ID NO: 737551 - DNA, 20 bp, Artificial
  CRISPR gRNA sequence
cttctccactttagatgcct

SEQ ID NO: 737552 - DNA, 20 bp, Artificial
  CRISPR gRNA sequence
ctccactttagatgccttgg

SEQ ID NO: 737553 - DNA, 20 bp, Artificial
  CRISPR gRNA sequence
tccactttagatgccttgga

SEQ ID NO: 737554 - DNA, 20 bp, Artificial
  CRISPR gRNA sequence
cactttagatgccttggacc

SEQ ID NO: 737555 - DNA, 20 bp, Artificial
  CRISPR gRNA sequence
tagatgccttggaccataaa

SEQ ID NO: 737556 - DNA, 20 bp, Artificial
  CRISPR gRNA sequence
agatgccttggaccataaaa

SEQ ID NO: 737557 - DNA, 20 bp, Artificial
  CRISPR gRNA sequence
gatgccttggaccataaaac

SEQ ID NO: 737558 - DNA, 20 bp, Artificial
  CRISPR gRNA sequence
ggaccataaaacctggtctt

SEQ ID NO: 737559 - DNA, 20 bp, Artificial
  CRISPR gRNA sequence
gaccataaaacctggtcttc

SEQ ID NO: 737560 - DNA, 20 bp, Artificial
  CRISPR gRNA sequence
gtcttcagggggcagtggaa

SEQ ID NO: 737561 - DNA, 20 bp, Artificial
  CRISPR gRNA sequence
cagggggcagtggaatatcc

SEQ ID NO: 737562 - DNA, 20 bp, Artificial
  CRISPR gRNA sequence
agggggcagtggaatatcct

SEQ ID NO: 737563 - DNA, 20 bp, Artificial
  CRISPR gRNA sequence
tactgctagatgaccagagt

SEQ ID NO: 737564 - DNA, 20 bp, Artificial
  CRISPR gRNA sequence
ctagatgaccagagtttgta

SEQ ID NO: 737565 - DNA, 20 bp, Artificial
  CRISPR gRNA sequence
gatgaccagagtttgtagtt

SEQ ID NO: 737566 - DNA, 20 bp, Artificial
  CRISPR gRNA sequence
gtagttggaataaggatttt

SEQ ID NO: 737567 - DNA, 20 bp, Artificial
  CRISPR gRNA sequence
tagttggaataaggattttt

SEQ ID NO: 737568 - DNA, 20 bp, Artificial
  CRISPR gRNA sequence
gaataaggattttttttatt

SEQ ID NO: 737569 - DNA, 20 bp, Artificial
  CRISPR gRNA sequence
tttttatttcctaataacag

SEQ ID NO: 737570 - DNA, 20 bp, Artificial
  CRISPR gRNA sequence
ttttatttcctaataacaga

SEQ ID NO: 737571 - DNA, 20 bp, Artificial
  CRISPR gRNA sequence
tttatttcctaataacagaa

SEQ ID NO: 737572 - DNA, 20 bp, Artificial
  CRISPR gRNA sequence
ttatttcctaataacagaaa

SEQ ID NO: 737573 - DNA, 20 bp, Artificial
  CRISPR gRNA sequence
tatttcctaataacagaaaa

SEQ ID NO: 737574 - DNA, 20 bp, Artificial
  CRISPR gRNA sequence
atttcctaataacagaaaag

SEQ ID NO: 737575 - DNA, 20 bp, Artificial
  CRISPR gRNA sequence
tttcctaataacagaaaagg

SEQ ID NO: 737576 - DNA, 20 bp, Artificial
  CRISPR gRNA sequence
cctaataacagaaaaggtct

SEQ ID NO: 737577 - DNA, 20 bp, Artificial
  CRISPR gRNA sequence
ctaataacagaaaaggtctg

SEQ ID NO: 737578 - DNA, 20 bp, Artificial
  CRISPR gRNA sequence
ataacagaaaaggtctgcaa

SEQ ID NO: 737579 - DNA, 20 bp, Artificial
  CRISPR gRNA sequence
caaagttgaaatcttcacaa

SEQ ID NO: 737580 - DNA, 20 bp, Artificial
  CRISPR gRNA sequence
aaatcttcacaaattgtcct

SEQ ID NO: 737581 - DNA, 20 bp, Artificial
  CRISPR gRNA sequence
cacaaattgtccttaagagg

SEQ ID NO: 737582 - DNA, 20 bp, Artificial
  CRISPR gRNA sequence
acaaattgtccttaagaggt

SEQ ID NO: 737583 - DNA, 20 bp, Artificial
  CRISPR gRNA sequence
tccttaagaggtggaaagtg

SEQ ID NO: 737584 - DNA, 20 bp, Artificial
  CRISPR gRNA sequence
aagaggtggaaagtgagatg

SEQ ID NO: 737585 - DNA, 20 bp, Artificial
  CRISPR gRNA sequence
agaggtggaaagtgagatgt

SEQ ID NO: 737586 - DNA, 20 bp, Artificial
  CRISPR gRNA sequence
gaggaaatgatgagaaaaaa

SEQ ID NO: 737587 - DNA, 20 bp, Artificial
  CRISPR gRNA sequence
aatgtttctatccctaaata

SEQ ID NO: 737588 - DNA, 20 bp, Artificial
  CRISPR gRNA sequence
atgtttctatccctaaatat

SEQ ID NO: 737589 - DNA, 20 bp, Artificial
  CRISPR gRNA sequence
ctatccctaaatattaagac

SEQ ID NO: 737590 - DNA, 20 bp, Artificial
  CRISPR gRNA sequence
tatccctaaatattaagact

SEQ ID NO: 737591 - DNA, 20 bp, Artificial
  CRISPR gRNA sequence
tccctaaatattaagacttc

SEQ ID NO: 737592 - DNA, 20 bp, Artificial
  CRISPR gRNA sequence
aatattaagacttcagtgaa

SEQ ID NO: 737593 - DNA, 20 bp, Artificial
  CRISPR gRNA sequence
agacttcagtgaaccagttt

SEQ ID NO: 737594 - DNA, 20 bp, Artificial
  CRISPR gRNA sequence
cagtgaaccagtttcgactt

SEQ ID NO: 737595 - DNA, 20 bp, Artificial
  CRISPR gRNA sequence
agtgaaccagtttcgacttc

SEQ ID NO: 737596 - DNA, 20 bp, Artificial
  CRISPR gRNA sequence
cgacttccctgggtctcact

SEQ ID NO: 737597 - DNA, 20 bp, Artificial
  CRISPR gRNA sequence
gacttccctgggtctcactc

SEQ ID NO: 737598 - DNA, 20 bp, Artificial
  CRISPR gRNA sequence
ccctgggtctcactcagaac

SEQ ID NO: 737599 - DNA, 20 bp, Artificial
  CRISPR gRNA sequence
cctgggtctcactcagaact

SEQ ID NO: 737600 - DNA, 20 bp, Artificial
  CRISPR gRNA sequence
ggtctcactcagaactggag

SEQ ID NO: 737601 - DNA, 20 bp, Artificial
  CRISPR gRNA sequence
actcagaactggagagggga

SEQ ID NO: 737602 - DNA, 20 bp, Artificial
  CRISPR gRNA sequence
agaactggagaggggagcaa

SEQ ID NO: 737603 - DNA, 20 bp, Artificial
  CRISPR gRNA sequence
gagaggggagcaatgagatt

SEQ ID NO: 737604 - DNA, 20 bp, Artificial
  CRISPR gRNA sequence
ggctccacattttagcgaca

SEQ ID NO: 737605 - DNA, 20 bp, Artificial
  CRISPR gRNA sequence
gctccacattttagcgacag

SEQ ID NO: 737606 - DNA, 20 bp, Artificial
  CRISPR gRNA sequence
cacattttagcgacagcatt

SEQ ID NO: 737607 - DNA, 20 bp, Artificial
  CRISPR gRNA sequence
tagcgacagcattttcccta

SEQ ID NO: 737608 - DNA, 20 bp, Artificial
  CRISPR gRNA sequence
agcgacagcattttccctag

SEQ ID NO: 737609 - DNA, 20 bp, Artificial
  CRISPR gRNA sequence
gcgacagcattttccctagt

SEQ ID NO: 737610 - DNA, 20 bp, Artificial
  CRISPR gRNA sequence
tccctagttcagaccctgtg

SEQ ID NO: 737611 - DNA, 20 bp, Artificial
  CRISPR gRNA sequence
ccctagttcagaccctgtgg

SEQ ID NO: 737612 - DNA, 20 bp, Artificial
  CRISPR gRNA sequence
cctagttcagaccctgtgga

SEQ ID NO: 737613 - DNA, 20 bp, Artificial
  CRISPR gRNA sequence
gttcagaccctgtggaagat

SEQ ID NO: 737614 - DNA, 20 bp, Artificial
  CRISPR gRNA sequence
agaccctgtggaagatggag

SEQ ID NO: 737615 - DNA, 20 bp, Artificial
  CRISPR gRNA sequence
tggaagatggagatgcaatt

SEQ ID NO: 737616 - DNA, 20 bp, Artificial
  CRISPR gRNA sequence
ggttaggtgaacggggaagg

SEQ ID NO: 737617 - DNA, 20 bp, Artificial
  CRISPR gRNA sequence
ggtgaacggggaaggatgga

SEQ ID NO: 737618 - DNA, 20 bp, Artificial
  CRISPR gRNA sequence
cataataactggctgccttt

SEQ ID NO: 737619 - DNA, 20 bp, Artificial
  CRISPR gRNA sequence
gctgccttttccggggtctt

SEQ ID NO: 737620 - DNA, 20 bp, Artificial
  CRISPR gRNA sequence
ccttttccggggtctttagc

SEQ ID NO: 737621 - DNA, 20 bp, Artificial
  CRISPR gRNA sequence
ttccggggtctttagctgag

SEQ ID NO: 737622 - DNA, 20 bp, Artificial
  CRISPR gRNA sequence
tccggggtctttagctgagt

SEQ ID NO: 737623 - DNA, 20 bp, Artificial
  CRISPR gRNA sequence
ccggggtctttagctgagtc

SEQ ID NO: 737624 - DNA, 20 bp, Artificial
  CRISPR gRNA sequence
cggggtctttagctgagtcc

SEQ ID NO: 737625 - DNA, 20 bp, Artificial
  CRISPR gRNA sequence
tagctgagtcctttcccttt

SEQ ID NO: 737626 - DNA, 20 bp, Artificial
  CRISPR gRNA sequence
agctgagtcctttccctttt

SEQ ID NO: 737627 - DNA, 20 bp, Artificial
  CRISPR gRNA sequence
gctgagtcctttcccttttc

SEQ ID NO: 737628 - DNA, 20 bp, Artificial
  CRISPR gRNA sequence
agtcctttcccttttctatc

SEQ ID NO: 737629 - DNA, 20 bp, Artificial
  CRISPR gRNA sequence
tcccttttctatctaataaa

SEQ ID NO: 737630 - DNA, 20 bp, Artificial
  CRISPR gRNA sequence
cccttttctatctaataaat

SEQ ID NO: 737631 - DNA, 20 bp, Artificial
  CRISPR gRNA sequence
ccttttctatctaataaatg

SEQ ID NO: 737632 - DNA, 20 bp, Artificial
  CRISPR gRNA sequence
ttctatctaataaatgtgga

SEQ ID NO: 737633 - DNA, 20 bp, Artificial
  CRISPR gRNA sequence
tctatctaataaatgtggaa

SEQ ID NO: 737634 - DNA, 20 bp, Artificial
  CRISPR gRNA sequence
ctatctaataaatgtggaag

SEQ ID NO: 737635 - DNA, 20 bp, Artificial
  CRISPR gRNA sequence
tatctaataaatgtggaagg

SEQ ID NO: 737636 - DNA, 20 bp, Artificial
  CRISPR gRNA sequence
tctaataaatgtggaaggac

SEQ ID NO: 737637 - DNA, 20 bp, Artificial
  CRISPR gRNA sequence
ataaatgtggaaggacccca

SEQ ID NO: 737638 - DNA, 20 bp, Artificial
  CRISPR gRNA sequence
ggtgctccactcttttttgc

SEQ ID NO: 737639 - DNA, 20 bp, Artificial
  CRISPR gRNA sequence
gtgctccactcttttttgcc

SEQ ID NO: 737640 - DNA, 20 bp, Artificial
  CRISPR gRNA sequence
cactcttttttgcctacact

SEQ ID NO: 737641 - DNA, 20 bp, Artificial
  CRISPR gRNA sequence
ttttttgcctacactcaagg

SEQ ID NO: 737642 - DNA, 20 bp, Artificial
  CRISPR gRNA sequence
ttttgcctacactcaaggga

SEQ ID NO: 737643 - DNA, 20 bp, Artificial
  CRISPR gRNA sequence
tttgcctacactcaagggag

SEQ ID NO: 737644 - DNA, 20 bp, Artificial
  CRISPR gRNA sequence
ttgcctacactcaagggaga

SEQ ID NO: 737645 - DNA, 20 bp, Artificial
  CRISPR gRNA sequence
tgcctacactcaagggagag

SEQ ID NO: 737646 - DNA, 20 bp, Artificial
  CRISPR gRNA sequence
gcctacactcaagggagagc

SEQ ID NO: 737647 - DNA, 20 bp, Artificial
  CRISPR gRNA sequence
cctacactcaagggagagct

SEQ ID NO: 737648 - DNA, 20 bp, Artificial
  CRISPR gRNA sequence
cactcaagggagagctttta

SEQ ID NO: 737649 - DNA, 20 bp, Artificial
  CRISPR gRNA sequence
aagggagagcttttagatct

SEQ ID NO: 737650 - DNA, 20 bp, Artificial
  CRISPR gRNA sequence
ttagatcttgatatttttaa

SEQ ID NO: 737651 - DNA, 20 bp, Artificial
  CRISPR gRNA sequence
tagatcttgatatttttaag

SEQ ID NO: 737652 - DNA, 20 bp, Artificial
  CRISPR gRNA sequence
agatcttgatatttttaaga

SEQ ID NO: 737653 - DNA, 20 bp, Artificial
  CRISPR gRNA sequence
gatcttgatatttttaagaa

SEQ ID NO: 737654 - DNA, 20 bp, Artificial
  CRISPR gRNA sequence
gatatttttaagaactttat

SEQ ID NO: 737655 - DNA, 20 bp, Artificial
  CRISPR gRNA sequence
atatttttaagaactttatt

SEQ ID NO: 737656 - DNA, 20 bp, Artificial
  CRISPR gRNA sequence
ttaagaactttattgagata

SEQ ID NO: 737657 - DNA, 20 bp, Artificial
  CRISPR gRNA sequence
taagaactttattgagatat

SEQ ID NO: 737658 - DNA, 20 bp, Artificial
  CRISPR gRNA sequence
aagaactttattgagatata

SEQ ID NO: 737659 - DNA, 20 bp, Artificial
  CRISPR gRNA sequence
agaactttattgagatataa

SEQ ID NO: 737660 - DNA, 20 bp, Artificial
  CRISPR gRNA sequence
tattgagatataactcacat

SEQ ID NO: 737661 - DNA, 20 bp, Artificial
  CRISPR gRNA sequence
attgagatataactcacatc

SEQ ID NO: 737662 - DNA, 20 bp, Artificial
  CRISPR gRNA sequence
ttgagatataactcacatcc

SEQ ID NO: 737663 - DNA, 20 bp, Artificial
  CRISPR gRNA sequence
agatataactcacatcccat

SEQ ID NO: 737664 - DNA, 20 bp, Artificial
  CRISPR gRNA sequence
acatcccatttatagtataa

SEQ ID NO: 737665 - DNA, 20 bp, Artificial
  CRISPR gRNA sequence
atagtataaagctcagtggt

SEQ ID NO: 737666 - DNA, 20 bp, Artificial
  CRISPR gRNA sequence
tagtataaagctcagtggtt

SEQ ID NO: 737667 - DNA, 20 bp, Artificial
  CRISPR gRNA sequence
agtggttctttattatgctt

SEQ ID NO: 737668 - DNA, 20 bp, Artificial
  CRISPR gRNA sequence
tttattatgcttacaaagtt

SEQ ID NO: 737669 - DNA, 20 bp, Artificial
  CRISPR gRNA sequence
tattatgcttacaaagttat

SEQ ID NO: 737670 - DNA, 20 bp, Artificial
  CRISPR gRNA sequence
attatgcttacaaagttatg

SEQ ID NO: 737671 - DNA, 20 bp, Artificial
  CRISPR gRNA sequence
ttatgcttacaaagttatgc

SEQ ID NO: 737672 - DNA, 20 bp, Artificial
  CRISPR gRNA sequence
tgcttacaaagttatgcaac

SEQ ID NO: 737673 - DNA, 20 bp, Artificial
  CRISPR gRNA sequence
acaaagttatgcaaccatca

SEQ ID NO: 737674 - DNA, 20 bp, Artificial
  CRISPR gRNA sequence
caaagttatgcaaccatcat

SEQ ID NO: 737675 - DNA, 20 bp, Artificial
  CRISPR gRNA sequence
tgcaaccatcatcacagtga

SEQ ID NO: 737676 - DNA, 20 bp, Artificial
  CRISPR gRNA sequence
cagaacaccttcatcatctc

SEQ ID NO: 737677 - DNA, 20 bp, Artificial
  CRISPR gRNA sequence
agaacaccttcatcatctcc

SEQ ID NO: 737678 - DNA, 20 bp, Artificial
  CRISPR gRNA sequence
catcatctccaaaagaaacc

SEQ ID NO: 737679 - DNA, 20 bp, Artificial
  CRISPR gRNA sequence
atcatctccaaaagaaaccc

SEQ ID NO: 737680 - DNA, 20 bp, Artificial
  CRISPR gRNA sequence
caaaagaaaccccttactgt

SEQ ID NO: 737681 - DNA, 20 bp, Artificial
  CRISPR gRNA sequence
actgtttatctatgattctg

SEQ ID NO: 737682 - DNA, 20 bp, Artificial
  CRISPR gRNA sequence
ctgtttatctatgattctgt

SEQ ID NO: 737683 - DNA, 20 bp, Artificial
  CRISPR gRNA sequence
tttatctatgattctgtatc

SEQ ID NO: 737684 - DNA, 20 bp, Artificial
  CRISPR gRNA sequence
atctatgattctgtatcccc

SEQ ID NO: 737685 - DNA, 20 bp, Artificial
  CRISPR gRNA sequence
tctatgattctgtatcccct

SEQ ID NO: 737686 - DNA, 20 bp, Artificial
  CRISPR gRNA sequence
tgattctgtatccccttttc

SEQ ID NO: 737687 - DNA, 20 bp, Artificial
  CRISPR gRNA sequence
tgtatccccttttccttccc

SEQ ID NO: 737688 - DNA, 20 bp, Artificial
  CRISPR gRNA sequence
tatccccttttccttccccc

SEQ ID NO: 737689 - DNA, 20 bp, Artificial
  CRISPR gRNA sequence
ttccttcccccagccctaag

SEQ ID NO: 737690 - DNA, 20 bp, Artificial
  CRISPR gRNA sequence
tccttcccccagccctaagc

SEQ ID NO: 737691 - DNA, 20 bp, Artificial
  CRISPR gRNA sequence
ccttcccccagccctaagca

SEQ ID NO: 737692 - DNA, 20 bp, Artificial
  CRISPR gRNA sequence
cttcccccagccctaagcaa

SEQ ID NO: 737693 - DNA, 20 bp, Artificial
  CRISPR gRNA sequence
cccccagccctaagcaacca

SEQ ID NO: 737694 - DNA, 20 bp, Artificial
  CRISPR gRNA sequence
ccccagccctaagcaaccac

SEQ ID NO: 737695 - DNA, 20 bp, Artificial
  CRISPR gRNA sequence
agcaaccactaatctacttt

SEQ ID NO: 737696 - DNA, 20 bp, Artificial
  CRISPR gRNA sequence
atctactttctgtgtctgta

SEQ ID NO: 737697 - DNA, 20 bp, Artificial
  CRISPR gRNA sequence
ctttctgtgtctgtagattt

SEQ ID NO: 737698 - DNA, 20 bp, Artificial
  CRISPR gRNA sequence
tctgtgtctgtagatttctc

SEQ ID NO: 737699 - DNA, 20 bp, Artificial
  CRISPR gRNA sequence
ctgtgtctgtagatttctct

SEQ ID NO: 737700 - DNA, 20 bp, Artificial
  CRISPR gRNA sequence
tgtgtctgtagatttctcta

SEQ ID NO: 737701 - DNA, 20 bp, Artificial
  CRISPR gRNA sequence
tgtctgtagatttctctaat

SEQ ID NO: 737702 - DNA, 20 bp, Artificial
  CRISPR gRNA sequence
tagatttctctaattccctg

SEQ ID NO: 737703 - DNA, 20 bp, Artificial
  CRISPR gRNA sequence
ctctaattccctggacttta

SEQ ID NO: 737704 - DNA, 20 bp, Artificial
  CRISPR gRNA sequence
tctaattccctggactttaa

SEQ ID NO: 737705 - DNA, 20 bp, Artificial
  CRISPR gRNA sequence
taattccctggactttaaac

SEQ ID NO: 737706 - DNA, 20 bp, Artificial
  CRISPR gRNA sequence
attccctggactttaaacac

SEQ ID NO: 737707 - DNA, 20 bp, Artificial
  CRISPR gRNA sequence
cctggactttaaacactatc

SEQ ID NO: 737708 - DNA, 20 bp, Artificial
  CRISPR gRNA sequence
gactttaaacactatcttta

SEQ ID NO: 737709 - DNA, 20 bp, Artificial
  CRISPR gRNA sequence
taaacactatctttatagag

SEQ ID NO: 737710 - DNA, 20 bp, Artificial
  CRISPR gRNA sequence
aaacactatctttatagaga

SEQ ID NO: 737711 - DNA, 20 bp, Artificial
  CRISPR gRNA sequence
aacactatctttatagagat

SEQ ID NO: 737712 - DNA, 20 bp, Artificial
  CRISPR gRNA sequence
tctttatagagatactttca

SEQ ID NO: 737713 - DNA, 20 bp, Artificial
  CRISPR gRNA sequence
tatagagatactttcaaata

SEQ ID NO: 737714 - DNA, 20 bp, Artificial
  CRISPR gRNA sequence
atagagatactttcaaatac

SEQ ID NO: 737715 - DNA, 20 bp, Artificial
  CRISPR gRNA sequence
tagagatactttcaaataca

SEQ ID NO: 737716 - DNA, 20 bp, Artificial
  CRISPR gRNA sequence
tcaaatacataccccagctc

SEQ ID NO: 737717 - DNA, 20 bp, Artificial
  CRISPR gRNA sequence
caaatacataccccagctct

SEQ ID NO: 737718 - DNA, 20 bp, Artificial
  CRISPR gRNA sequence
aaatacataccccagctctg

SEQ ID NO: 737719 - DNA, 20 bp, Artificial
  CRISPR gRNA sequence
tgacctctcaccctagctcc

SEQ ID NO: 737720 - DNA, 20 bp, Artificial
  CRISPR gRNA sequence
acctctcaccctagctccag

SEQ ID NO: 737721 - DNA, 20 bp, Artificial
  CRISPR gRNA sequence
tcaccctagctccaggcagg

SEQ ID NO: 737722 - DNA, 20 bp, Artificial
  CRISPR gRNA sequence
accctagctccaggcaggta

SEQ ID NO: 737723 - DNA, 20 bp, Artificial
  CRISPR gRNA sequence
gctccaggcaggtatatcac

SEQ ID NO: 737724 - DNA, 20 bp, Artificial
  CRISPR gRNA sequence
caggcaggtatatcactgct

SEQ ID NO: 737725 - DNA, 20 bp, Artificial
  CRISPR gRNA sequence
ctggctgcatttccccactt

SEQ ID NO: 737726 - DNA, 20 bp, Artificial
  CRISPR gRNA sequence
gctgcatttccccacttggg

SEQ ID NO: 737727 - DNA, 20 bp, Artificial
  CRISPR gRNA sequence
catttccccacttggggttc

SEQ ID NO: 737728 - DNA, 20 bp, Artificial
  CRISPR gRNA sequence
ccccacttggggttctagga

SEQ ID NO: 737729 - DNA, 20 bp, Artificial
  CRISPR gRNA sequence
cccacttggggttctaggag

SEQ ID NO: 737730 - DNA, 20 bp, Artificial
  CRISPR gRNA sequence
ggggttctaggaggtatctt

SEQ ID NO: 737731 - DNA, 20 bp, Artificial
  CRISPR gRNA sequence
gggttctaggaggtatctta

SEQ ID NO: 737732 - DNA, 20 bp, Artificial
  CRISPR gRNA sequence
taggaggtatcttaaactta

SEQ ID NO: 737733 - DNA, 20 bp, Artificial
  CRISPR gRNA sequence
ggaggtatcttaaacttaac

SEQ ID NO: 737734 - DNA, 20 bp, Artificial
  CRISPR gRNA sequence
aaacttaacatgacaaaaga

SEQ ID NO: 737735 - DNA, 20 bp, Artificial
  CRISPR gRNA sequence
aacttaacatgacaaaagag

SEQ ID NO: 737736 - DNA, 20 bp, Artificial
  CRISPR gRNA sequence
aacatgacaaaagagagctc

SEQ ID NO: 737737 - DNA, 20 bp, Artificial
  CRISPR gRNA sequence
acatgacaaaagagagctct

SEQ ID NO: 737738 - DNA, 20 bp, Artificial
  CRISPR gRNA sequence
ttgatttttctcctccaaat

SEQ ID NO: 737739 - DNA, 20 bp, Artificial
  CRISPR gRNA sequence
gatttttctcctccaaatta

SEQ ID NO: 737740 - DNA, 20 bp, Artificial
  CRISPR gRNA sequence
atttttctcctccaaattag

SEQ ID NO: 737741 - DNA, 20 bp, Artificial
  CRISPR gRNA sequence
ttctcctccaaattagctcc

SEQ ID NO: 737742 - DNA, 20 bp, Artificial
  CRISPR gRNA sequence
tctcctccaaattagctcct

SEQ ID NO: 737743 - DNA, 20 bp, Artificial
  CRISPR gRNA sequence
ctcctccaaattagctcctc

SEQ ID NO: 737744 - DNA, 20 bp, Artificial
  CRISPR gRNA sequence
tcctccaaattagctcctct

SEQ ID NO: 737745 - DNA, 20 bp, Artificial
  CRISPR gRNA sequence
ctccaaattagctcctcttt

SEQ ID NO: 737746 - DNA, 20 bp, Artificial
  CRISPR gRNA sequence
caaattagctcctctttcag

SEQ ID NO: 737747 - DNA, 20 bp, Artificial
  CRISPR gRNA sequence
gctcctctttcagatttacc

SEQ ID NO: 737748 - DNA, 20 bp, Artificial
  CRISPR gRNA sequence
ctctttcagatttaccctac

SEQ ID NO: 737749 - DNA, 20 bp, Artificial
  CRISPR gRNA sequence
tttcagatttaccctacgct

SEQ ID NO: 737750 - DNA, 20 bp, Artificial
  CRISPR gRNA sequence
tcagatttaccctacgctat

SEQ ID NO: 737751 - DNA, 20 bp, Artificial
  CRISPR gRNA sequence
cagatttaccctacgctatc

SEQ ID NO: 737752 - DNA, 20 bp, Artificial
  CRISPR gRNA sequence
agatttaccctacgctatca

SEQ ID NO: 737753 - DNA, 20 bp, Artificial
  CRISPR gRNA sequence
accctacgctatcaatggta

SEQ ID NO: 737754 - DNA, 20 bp, Artificial
  CRISPR gRNA sequence
ccctacgctatcaatggtac

SEQ ID NO: 737755 - DNA, 20 bp, Artificial
  CRISPR gRNA sequence
cgctatcaatggtaccatca

SEQ ID NO: 737756 - DNA, 20 bp, Artificial
  CRISPR gRNA sequence
tcaatggtaccatcatccac

SEQ ID NO: 737757 - DNA, 20 bp, Artificial
  CRISPR gRNA sequence
ctgatcaaatagaaaacctt

SEQ ID NO: 737758 - DNA, 20 bp, Artificial
  CRISPR gRNA sequence
atcaaatagaaaaccttgga

SEQ ID NO: 737759 - DNA, 20 bp, Artificial
  CRISPR gRNA sequence
ggatcatccatgattcctcc

SEQ ID NO: 737760 - DNA, 20 bp, Artificial
  CRISPR gRNA sequence
gatcatccatgattcctcct

SEQ ID NO: 737761 - DNA, 20 bp, Artificial
  CRISPR gRNA sequence
ctccttttggctcacccctc

SEQ ID NO: 737762 - DNA, 20 bp, Artificial
  CRISPR gRNA sequence
cttttggctcacccctcaac

SEQ ID NO: 737763 - DNA, 20 bp, Artificial
  CRISPR gRNA sequence
ttggctcacccctcaactga

SEQ ID NO: 737764 - DNA, 20 bp, Artificial
  CRISPR gRNA sequence
tggctcacccctcaactgag

SEQ ID NO: 737765 - DNA, 20 bp, Artificial
  CRISPR gRNA sequence
ggctcacccctcaactgagc

SEQ ID NO: 737766 - DNA, 20 bp, Artificial
  CRISPR gRNA sequence
gctcacccctcaactgagca

SEQ ID NO: 737767 - DNA, 20 bp, Artificial
  CRISPR gRNA sequence
acccctcaactgagcaaatc

SEQ ID NO: 737768 - DNA, 20 bp, Artificial
  CRISPR gRNA sequence
aactgagcaaatcctgtcct

SEQ ID NO: 737769 - DNA, 20 bp, Artificial
  CRISPR gRNA sequence
agcaaatcctgtcctacctt

SEQ ID NO: 737770 - DNA, 20 bp, Artificial
  CRISPR gRNA sequence
tcctaccttcaaaacatatg

SEQ ID NO: 737771 - DNA, 20 bp, Artificial
  CRISPR gRNA sequence
ccttcaaaacatatgagctg

SEQ ID NO: 737772 - DNA, 20 bp, Artificial
  CRISPR gRNA sequence
caaaacatatgagctgaaca

SEQ ID NO: 737773 - DNA, 20 bp, Artificial
  CRISPR gRNA sequence
aaaacatatgagctgaacag

SEQ ID NO: 737774 - DNA, 20 bp, Artificial
  CRISPR gRNA sequence
aacagaaagtctgaaaaaca

SEQ ID NO: 737775 - DNA, 20 bp, Artificial
  CRISPR gRNA sequence
aaaaacatagatttgagccc

SEQ ID NO: 737776 - DNA, 20 bp, Artificial
  CRISPR gRNA sequence
gagcccattcacatctctct

SEQ ID NO: 737777 - DNA, 20 bp, Artificial
  CRISPR gRNA sequence
agcccattcacatctctctg

SEQ ID NO: 737778 - DNA, 20 bp, Artificial
  CRISPR gRNA sequence
acatctctctgccactagtg

SEQ ID NO: 737779 - DNA, 20 bp, Artificial
  CRISPR gRNA sequence
tctgccactagtgcctacat

SEQ ID NO: 737780 - DNA, 20 bp, Artificial
  CRISPR gRNA sequence
tgccactagtgcctacattg

SEQ ID NO: 737781 - DNA, 20 bp, Artificial
  CRISPR gRNA sequence
ccactagtgcctacattgta

SEQ ID NO: 737782 - DNA, 20 bp, Artificial
  CRISPR gRNA sequence
gtgcctacattgtactccag

SEQ ID NO: 737783 - DNA, 20 bp, Artificial
  CRISPR gRNA sequence
cattgtactccaggccactg

SEQ ID NO: 737784 - DNA, 20 bp, Artificial
  CRISPR gRNA sequence
tactccaggccactgttgtt

SEQ ID NO: 737785 - DNA, 20 bp, Artificial
  CRISPR gRNA sequence
caggccactgttgtttccag

SEQ ID NO: 737786 - DNA, 20 bp, Artificial
  CRISPR gRNA sequence
ttgtttccagccagatgccc

SEQ ID NO: 737787 - DNA, 20 bp, Artificial
  CRISPR gRNA sequence
tttccagccagatgcccaca

SEQ ID NO: 737788 - DNA, 20 bp, Artificial
  CRISPR gRNA sequence
ccagccagatgcccacaatg

SEQ ID NO: 737789 - DNA, 20 bp, Artificial
  CRISPR gRNA sequence
cagccagatgcccacaatgg

SEQ ID NO: 737790 - DNA, 20 bp, Artificial
  CRISPR gRNA sequence
tctacccgtgttcataccat

SEQ ID NO: 737791 - DNA, 20 bp, Artificial
  CRISPR gRNA sequence
tacccgtgttcataccattc

SEQ ID NO: 737792 - DNA, 20 bp, Artificial
  CRISPR gRNA sequence
cccgtgttcataccattcac

SEQ ID NO: 737793 - DNA, 20 bp, Artificial
  CRISPR gRNA sequence
ataccattcacaatccatcc

SEQ ID NO: 737794 - DNA, 20 bp, Artificial
  CRISPR gRNA sequence
acaatccatcctcaacaagt

SEQ ID NO: 737795 - DNA, 20 bp, Artificial
  CRISPR gRNA sequence
aacaagtggccactacattc

SEQ ID NO: 737796 - DNA, 20 bp, Artificial
  CRISPR gRNA sequence
cattcttaaaaacaagtcat

SEQ ID NO: 737797 - DNA, 20 bp, Artificial
  CRISPR gRNA sequence
ttaaaaacaagtcatgacag

SEQ ID NO: 737798 - DNA, 20 bp, Artificial
  CRISPR gRNA sequence
aaaaacaagtcatgacagct

SEQ ID NO: 737799 - DNA, 20 bp, Artificial
  CRISPR gRNA sequence
aaaacaagtcatgacagctc

SEQ ID NO: 737800 - DNA, 20 bp, Artificial
  CRISPR gRNA sequence
tctgagctctctagtagctt

SEQ ID NO: 737801 - DNA, 20 bp, Artificial
  CRISPR gRNA sequence
tgagctctctagtagcttcc

SEQ ID NO: 737802 - DNA, 20 bp, Artificial
  CRISPR gRNA sequence
agctctctagtagcttcctc

SEQ ID NO: 737803 - DNA, 20 bp, Artificial
  CRISPR gRNA sequence
tctagtagcttcctcttata

SEQ ID NO: 737804 - DNA, 20 bp, Artificial
  CRISPR gRNA sequence
tagtagcttcctcttatacc

SEQ ID NO: 737805 - DNA, 20 bp, Artificial
  CRISPR gRNA sequence
gtagcttcctcttataccta

SEQ ID NO: 737806 - DNA, 20 bp, Artificial
  CRISPR gRNA sequence
cctcttatacctaaattcca

SEQ ID NO: 737807 - DNA, 20 bp, Artificial
  CRISPR gRNA sequence
ctcttatacctaaattccaa

SEQ ID NO: 737808 - DNA, 20 bp, Artificial
  CRISPR gRNA sequence
ttatacctaaattccaactt

SEQ ID NO: 737809 - DNA, 20 bp, Artificial
  CRISPR gRNA sequence
atacctaaattccaacttat

SEQ ID NO: 737810 - DNA, 20 bp, Artificial
  CRISPR gRNA sequence
tacctaaattccaacttatg

SEQ ID NO: 737811 - DNA, 20 bp, Artificial
  CRISPR gRNA sequence
aattccaacttatggtcttc

SEQ ID NO: 737812 - DNA, 20 bp, Artificial
  CRISPR gRNA sequence
caacttatggtcttcagggc

SEQ ID NO: 737813 - DNA, 20 bp, Artificial
  CRISPR gRNA sequence
atggtcttcagggctgcttg

SEQ ID NO: 737814 - DNA, 20 bp, Artificial
  CRISPR gRNA sequence
tggtcttcagggctgcttga

SEQ ID NO: 737815 - DNA, 20 bp, Artificial
  CRISPR gRNA sequence
cagggctgcttgactctcca

SEQ ID NO: 737816 - DNA, 20 bp, Artificial
  CRISPR gRNA sequence
agggctgcttgactctccaa

SEQ ID NO: 737817 - DNA, 20 bp, Artificial
  CRISPR gRNA sequence
cttgactctccaacctcctc

SEQ ID NO: 737818 - DNA, 20 bp, Artificial
  CRISPR gRNA sequence
gactctccaacctcctcatt

SEQ ID NO: 737819 - DNA, 20 bp, Artificial
  CRISPR gRNA sequence
actctccaacctcctcattc

SEQ ID NO: 737820 - DNA, 20 bp, Artificial
  CRISPR gRNA sequence
tccaacctcctcattcattg

SEQ ID NO: 737821 - DNA, 20 bp, Artificial
  CRISPR gRNA sequence
caacctcctcattcattgcc

SEQ ID NO: 737822 - DNA, 20 bp, Artificial
  CRISPR gRNA sequence
ctcattcattgcctcacact

SEQ ID NO: 737823 - DNA, 20 bp, Artificial
  CRISPR gRNA sequence
attcattgcctcacactcca

SEQ ID NO: 737824 - DNA, 20 bp, Artificial
  CRISPR gRNA sequence
attgcctcacactccatata

SEQ ID NO: 737825 - DNA, 20 bp, Artificial
  CRISPR gRNA sequence
cctcacactccatatagagt

SEQ ID NO: 737826 - DNA, 20 bp, Artificial
  CRISPR gRNA sequence
acactccatatagagtgact

SEQ ID NO: 737827 - DNA, 20 bp, Artificial
  CRISPR gRNA sequence
catatagagtgactaaataa

SEQ ID NO: 737828 - DNA, 20 bp, Artificial
  CRISPR gRNA sequence
aataagccttatacaagcca

SEQ ID NO: 737829 - DNA, 20 bp, Artificial
  CRISPR gRNA sequence
atacaagccaagctccttct

SEQ ID NO: 737830 - DNA, 20 bp, Artificial
  CRISPR gRNA sequence
tacaagccaagctccttctg

SEQ ID NO: 737831 - DNA, 20 bp, Artificial
  CRISPR gRNA sequence
cttctgacctcaggaccttt

SEQ ID NO: 737832 - DNA, 20 bp, Artificial
  CRISPR gRNA sequence
ctgacctcaggacctttgca

SEQ ID NO: 737833 - DNA, 20 bp, Artificial
  CRISPR gRNA sequence
tgacctcaggacctttgcat

SEQ ID NO: 737834 - DNA, 20 bp, Artificial
  CRISPR gRNA sequence
acctcaggacctttgcatat

SEQ ID NO: 737835 - DNA, 20 bp, Artificial
  CRISPR gRNA sequence
aggacctttgcatattcagc

SEQ ID NO: 737836 - DNA, 20 bp, Artificial
  CRISPR gRNA sequence
tgcatattcagctcttgcga

SEQ ID NO: 737837 - DNA, 20 bp, Artificial
  CRISPR gRNA sequence
gcatattcagctcttgcgac

SEQ ID NO: 737838 - DNA, 20 bp, Artificial
  CRISPR gRNA sequence
catattcagctcttgcgaca

SEQ ID NO: 737839 - DNA, 20 bp, Artificial
  CRISPR gRNA sequence
agctcttgcgacaaagtgct

SEQ ID NO: 737840 - DNA, 20 bp, Artificial
  CRISPR gRNA sequence
ttgcgacaaagtgctcttca

SEQ ID NO: 737841 - DNA, 20 bp, Artificial
  CRISPR gRNA sequence
gcgacaaagtgctcttcaaa

SEQ ID NO: 737842 - DNA, 20 bp, Artificial
  CRISPR gRNA sequence
cgacaaagtgctcttcaaag

SEQ ID NO: 737843 - DNA, 20 bp, Artificial
  CRISPR gRNA sequence
ttcaaagcacccagatttca

SEQ ID NO: 737844 - DNA, 20 bp, Artificial
  CRISPR gRNA sequence
caaagcacccagatttcaac

SEQ ID NO: 737845 - DNA, 20 bp, Artificial
  CRISPR gRNA sequence
aaagcacccagatttcaaca

SEQ ID NO: 737846 - DNA, 20 bp, Artificial
  CRISPR gRNA sequence
caacagggctggaaaatgct

SEQ ID NO: 737847 - DNA, 20 bp, Artificial
  CRISPR gRNA sequence
aacagggctggaaaatgctc

SEQ ID NO: 737848 - DNA, 20 bp, Artificial
  CRISPR gRNA sequence
gaaaatgctcaccattcagg

SEQ ID NO: 737849 - DNA, 20 bp, Artificial
  CRISPR gRNA sequence
accattcagggctctgcttg

SEQ ID NO: 737850 - DNA, 20 bp, Artificial
  CRISPR gRNA sequence
agggctctgcttggtgttgt

SEQ ID NO: 737851 - DNA, 20 bp, Artificial
  CRISPR gRNA sequence
tgcttggtgttgtctgctaa

SEQ ID NO: 737852 - DNA, 20 bp, Artificial
  CRISPR gRNA sequence
cttggtgttgtctgctaagg

SEQ ID NO: 737853 - DNA, 20 bp, Artificial
  CRISPR gRNA sequence
ggtgttgtctgctaagggag

SEQ ID NO: 737854 - DNA, 20 bp, Artificial
  CRISPR gRNA sequence
gtgttgtctgctaagggagg

SEQ ID NO: 737855 - DNA, 20 bp, Artificial
  CRISPR gRNA sequence
tctgctaagggaggtgttct

SEQ ID NO: 737856 - DNA, 20 bp, Artificial
  CRISPR gRNA sequence
ctaagggaggtgttctctga

SEQ ID NO: 737857 - DNA, 20 bp, Artificial
  CRISPR gRNA sequence
agggaggtgttctctgaccc

SEQ ID NO: 737858 - DNA, 20 bp, Artificial
  CRISPR gRNA sequence
tctgacccccagtacttcag

SEQ ID NO: 737859 - DNA, 20 bp, Artificial
  CRISPR gRNA sequence
tgacccccagtacttcagta

SEQ ID NO: 737860 - DNA, 20 bp, Artificial
  CRISPR gRNA sequence
acccccagtacttcagtagc

SEQ ID NO: 737861 - DNA, 20 bp, Artificial
  CRISPR gRNA sequence
cagtagctcccccaccaccg

SEQ ID NO: 737862 - DNA, 20 bp, Artificial
  CRISPR gRNA sequence
agtagctcccccaccaccga

SEQ ID NO: 737863 - DNA, 20 bp, Artificial
  CRISPR gRNA sequence
ccccaccaccgagtcgctta

SEQ ID NO: 737864 - DNA, 20 bp, Artificial
  CRISPR gRNA sequence
actagttcatgaacacctct

SEQ ID NO: 737865 - DNA, 20 bp, Artificial
  CRISPR gRNA sequence
ctagttcatgaacacctcta

SEQ ID NO: 737866 - DNA, 20 bp, Artificial
  CRISPR gRNA sequence
gttcatgaacacctctagtt

SEQ ID NO: 737867 - DNA, 20 bp, Artificial
  CRISPR gRNA sequence
atgaacacctctagttattt

SEQ ID NO: 737868 - DNA, 20 bp, Artificial
  CRISPR gRNA sequence
tagttatttgcaattatttg

SEQ ID NO: 737869 - DNA, 20 bp, Artificial
  CRISPR gRNA sequence
gttatttgcaattatttgaa

SEQ ID NO: 737870 - DNA, 20 bp, Artificial
  CRISPR gRNA sequence
tttgcaattatttgaaacag

SEQ ID NO: 737871 - DNA, 20 bp, Artificial
  CRISPR gRNA sequence
gcaattatttgaaacagttc

SEQ ID NO: 737872 - DNA, 20 bp, Artificial
  CRISPR gRNA sequence
caattatttgaaacagttcc

SEQ ID NO: 737873 - DNA, 20 bp, Artificial
  CRISPR gRNA sequence
tttgaaacagttcctagttt

SEQ ID NO: 737874 - DNA, 20 bp, Artificial
  CRISPR gRNA sequence
gaaacagttcctagtttctt

SEQ ID NO: 737875 - DNA, 20 bp, Artificial
  CRISPR gRNA sequence
aaacagttcctagtttctta

SEQ ID NO: 737876 - DNA, 20 bp, Artificial
  CRISPR gRNA sequence
ctagtttcttatgaacacct

SEQ ID NO: 737877 - DNA, 20 bp, Artificial
  CRISPR gRNA sequence
gtttcttatgaacacctctt

SEQ ID NO: 737878 - DNA, 20 bp, Artificial
  CRISPR gRNA sequence
cttatgaacacctcttgttt

SEQ ID NO: 737879 - DNA, 20 bp, Artificial
  CRISPR gRNA sequence
ttatgaacacctcttgtttt

SEQ ID NO: 737880 - DNA, 20 bp, Artificial
  CRISPR gRNA sequence
atgaacacctcttgttttct

SEQ ID NO: 737881 - DNA, 20 bp, Artificial
  CRISPR gRNA sequence
tgaacacctcttgttttctg

SEQ ID NO: 737882 - DNA, 20 bp, Artificial
  CRISPR gRNA sequence
ttgttttctgcaattatttg

SEQ ID NO: 737883 - DNA, 20 bp, Artificial
  CRISPR gRNA sequence
gttttctgcaattatttgtc

SEQ ID NO: 737884 - DNA, 20 bp, Artificial
  CRISPR gRNA sequence
ttttctgcaattatttgtct

SEQ ID NO: 737885 - DNA, 20 bp, Artificial
  CRISPR gRNA sequence
tctgcaattatttgtctgga

SEQ ID NO: 737886 - DNA, 20 bp, Artificial
  CRISPR gRNA sequence
ctgcaattatttgtctggat

SEQ ID NO: 737887 - DNA, 20 bp, Artificial
  CRISPR gRNA sequence
tgcaattatttgtctggata

SEQ ID NO: 737888 - DNA, 20 bp, Artificial
  CRISPR gRNA sequence
caattatttgtctggataat

SEQ ID NO: 737889 - DNA, 20 bp, Artificial
  CRISPR gRNA sequence
tttgtctggataataagtgt

SEQ ID NO: 737890 - DNA, 20 bp, Artificial
  CRISPR gRNA sequence
gtctggataataagtgtgcc

SEQ ID NO: 737891 - DNA, 20 bp, Artificial
  CRISPR gRNA sequence
tctggataataagtgtgcct

SEQ ID NO: 737892 - DNA, 20 bp, Artificial
  CRISPR gRNA sequence
gataataagtgtgcctgtca

SEQ ID NO: 737893 - DNA, 20 bp, Artificial
  CRISPR gRNA sequence
tcatctcccatagtgcagga

SEQ ID NO: 737894 - DNA, 20 bp, Artificial
  CRISPR gRNA sequence
ccatagtgcaggattgtgag

SEQ ID NO: 737895 - DNA, 20 bp, Artificial
  CRISPR gRNA sequence
tgagtgtttttgctcactgt

SEQ ID NO: 737896 - DNA, 20 bp, Artificial
  CRISPR gRNA sequence
ttgctcactgtctccttaga

SEQ ID NO: 737897 - DNA, 20 bp, Artificial
  CRISPR gRNA sequence
tgctcactgtctccttagag

SEQ ID NO: 737898 - DNA, 20 bp, Artificial
  CRISPR gRNA sequence
gctcactgtctccttagagc

SEQ ID NO: 737899 - DNA, 20 bp, Artificial
  CRISPR gRNA sequence
ctcactgtctccttagagcc

SEQ ID NO: 737900 - DNA, 20 bp, Artificial
  CRISPR gRNA sequence
actgtctccttagagcctag

SEQ ID NO: 737901 - DNA, 20 bp, Artificial
  CRISPR gRNA sequence
tctccttagagcctagaata

SEQ ID NO: 737902 - DNA, 20 bp, Artificial
  CRISPR gRNA sequence
cttagagcctagaatagtgc

SEQ ID NO: 737903 - DNA, 20 bp, Artificial
  CRISPR gRNA sequence
agagcctagaatagtgcctg

SEQ ID NO: 737904 - DNA, 20 bp, Artificial
  CRISPR gRNA sequence
gagcctagaatagtgcctgc

SEQ ID NO: 737905 - DNA, 20 bp, Artificial
  CRISPR gRNA sequence
gaatagtgcctgccccataa

SEQ ID NO: 737906 - DNA, 20 bp, Artificial
  CRISPR gRNA sequence
ccccataataggggctcaat

SEQ ID NO: 737907 - DNA, 20 bp, Artificial
  CRISPR gRNA sequence
aatgaattatgttgaagcaa

SEQ ID NO: 737908 - DNA, 20 bp, Artificial
  CRISPR gRNA sequence
tgttgaagcaatgagtgaat

SEQ ID NO: 737909 - DNA, 20 bp, Artificial
  CRISPR gRNA sequence
aagcaatgagtgaataaaac

SEQ ID NO: 737910 - DNA, 20 bp, Artificial
  CRISPR gRNA sequence
gaaccttatctcagccacct

SEQ ID NO: 737911 - DNA, 20 bp, Artificial
  CRISPR gRNA sequence
aaccttatctcagccacctg

SEQ ID NO: 737912 - DNA, 20 bp, Artificial
  CRISPR gRNA sequence
atctcagccacctgctagct

SEQ ID NO: 737913 - DNA, 20 bp, Artificial
  CRISPR gRNA sequence
tctcagccacctgctagctc

SEQ ID NO: 737914 - DNA, 20 bp, Artificial
  CRISPR gRNA sequence
agccacctgctagctctggg

SEQ ID NO: 737915 - DNA, 20 bp, Artificial
  CRISPR gRNA sequence
ctagctctgggaccccggac

SEQ ID NO: 737916 - DNA, 20 bp, Artificial
  CRISPR gRNA sequence
gctctgggaccccggacaag

SEQ ID NO: 737917 - DNA, 20 bp, Artificial
  CRISPR gRNA sequence
tgggaccccggacaagctca

SEQ ID NO: 737918 - DNA, 20 bp, Artificial
  CRISPR gRNA sequence
ggaccccggacaagctcaga

SEQ ID NO: 737919 - DNA, 20 bp, Artificial
  CRISPR gRNA sequence
agagtcacactgggttttca

SEQ ID NO: 737920 - DNA, 20 bp, Artificial
  CRISPR gRNA sequence
ggttttcaggtctcattatc

SEQ ID NO: 737921 - DNA, 20 bp, Artificial
  CRISPR gRNA sequence
tcaggtctcattatcttcat

SEQ ID NO: 737922 - DNA, 20 bp, Artificial
  CRISPR gRNA sequence
caggtctcattatcttcatc

SEQ ID NO: 737923 - DNA, 20 bp, Artificial
  CRISPR gRNA sequence
aggtctcattatcttcatct

SEQ ID NO: 737924 - DNA, 20 bp, Artificial
  CRISPR gRNA sequence
attatcttcatctgtaaaat

SEQ ID NO: 737925 - DNA, 20 bp, Artificial
  CRISPR gRNA sequence
tcttcatctgtaaaatggtg

SEQ ID NO: 737926 - DNA, 20 bp, Artificial
  CRISPR gRNA sequence
catctgtaaaatggtgacaa

SEQ ID NO: 737927 - DNA, 20 bp, Artificial
  CRISPR gRNA sequence
atctgtaaaatggtgacaat

SEQ ID NO: 737928 - DNA, 20 bp, Artificial
  CRISPR gRNA sequence
taaaatggtgacaatagtgc

SEQ ID NO: 737929 - DNA, 20 bp, Artificial
  CRISPR gRNA sequence
tgaaaacactacagtgcaac

SEQ ID NO: 737930 - DNA, 20 bp, Artificial
  CRISPR gRNA sequence
aaaacactacagtgcaacat

SEQ ID NO: 737931 - DNA, 20 bp, Artificial
  CRISPR gRNA sequence
cagtgcaacatgaccactga

SEQ ID NO: 737932 - DNA, 20 bp, Artificial
  CRISPR gRNA sequence
atggattattatccttatta

SEQ ID NO: 737933 - DNA, 20 bp, Artificial
  CRISPR gRNA sequence
ttatccttattatctctgat

SEQ ID NO: 737934 - DNA, 20 bp, Artificial
  CRISPR gRNA sequence
tccttattatctctgatgtt

SEQ ID NO: 737935 - DNA, 20 bp, Artificial
  CRISPR gRNA sequence
attatctctgatgttagtgg

SEQ ID NO: 737936 - DNA, 20 bp, Artificial
  CRISPR gRNA sequence
ttatctctgatgttagtgga

SEQ ID NO: 737937 - DNA, 20 bp, Artificial
  CRISPR gRNA sequence
tctctgatgttagtggagtg

SEQ ID NO: 737938 - DNA, 20 bp, Artificial
  CRISPR gRNA sequence
tgatgttagtggagtgtggg

SEQ ID NO: 737939 - DNA, 20 bp, Artificial
  CRISPR gRNA sequence
atgttagtggagtgtggggc

SEQ ID NO: 737940 - DNA, 20 bp, Artificial
  CRISPR gRNA sequence
gtggagtgtggggcaggagg

SEQ ID NO: 737941 - DNA, 20 bp, Artificial
  CRISPR gRNA sequence
cctccacccgtcccagagcc

SEQ ID NO: 737942 - DNA, 20 bp, Artificial
  CRISPR gRNA sequence
cacccgtcccagagccactg

SEQ ID NO: 737943 - DNA, 20 bp, Artificial
  CRISPR gRNA sequence
cagcctgctcacctggagac

SEQ ID NO: 737944 - DNA, 20 bp, Artificial
  CRISPR gRNA sequence
ctcacctggagacacatcca

SEQ ID NO: 737945 - DNA, 20 bp, Artificial
  CRISPR gRNA sequence
acctggagacacatccagct

SEQ ID NO: 737946 - DNA, 20 bp, Artificial
  CRISPR gRNA sequence
gagacacatccagctggaag

SEQ ID NO: 737947 - DNA, 20 bp, Artificial
  CRISPR gRNA sequence
gaagcccatcaaggggtaca

SEQ ID NO: 737948 - DNA, 20 bp, Artificial
  CRISPR gRNA sequence
cgcatgcaccagtatcggcc

SEQ ID NO: 737949 - DNA, 20 bp, Artificial
  CRISPR gRNA sequence
agtcctggagcttgagggcc

SEQ ID NO: 737950 - DNA, 20 bp, Artificial
  CRISPR gRNA sequence
gagcttgagggccaccatgg

SEQ ID NO: 737951 - DNA, 20 bp, Artificial
  CRISPR gRNA sequence
gagggccaccatggtgatgt

SEQ ID NO: 737952 - DNA, 20 bp, Artificial
  CRISPR gRNA sequence
agggccaccatggtgatgtt

SEQ ID NO: 737953 - DNA, 20 bp, Artificial
  CRISPR gRNA sequence
accaccttggcctgggcatc

SEQ ID NO: 737954 - DNA, 20 bp, Artificial
  CRISPR gRNA sequence
ggcctgggcatcgtcctgca

SEQ ID NO: 737955 - DNA, 20 bp, Artificial
  CRISPR gRNA sequence
gcctgggcatcgtcctgcag

SEQ ID NO: 737956 - DNA, 20 bp, Artificial
  CRISPR gRNA sequence
ggcatcgtcctgcagcaagt

SEQ ID NO: 737957 - DNA, 20 bp, Artificial
  CRISPR gRNA sequence
cagcaagtagcggggccctt

SEQ ID NO: 737958 - DNA, 20 bp, Artificial
  CRISPR gRNA sequence
tcacccagactcgggcaaag

SEQ ID NO: 737959 - DNA, 20 bp, Artificial
  CRISPR gRNA sequence
cacccagactcgggcaaagc

SEQ ID NO: 737960 - DNA, 20 bp, Artificial
  CRISPR gRNA sequence
acccagactcgggcaaagcc

SEQ ID NO: 737961 - DNA, 20 bp, Artificial
  CRISPR gRNA sequence
gggcaaagccaggctcacac

SEQ ID NO: 737962 - DNA, 20 bp, Artificial
  CRISPR gRNA sequence
acacttcttcttcctgattt

SEQ ID NO: 737963 - DNA, 20 bp, Artificial
  CRISPR gRNA sequence
cttcttcctgattttgcacc

SEQ ID NO: 737964 - DNA, 20 bp, Artificial
  CRISPR gRNA sequence
ttcttcctgattttgcacca

SEQ ID NO: 737965 - DNA, 20 bp, Artificial
  CRISPR gRNA sequence
cttcctgattttgcaccaaa

SEQ ID NO: 737966 - DNA, 20 bp, Artificial
  CRISPR gRNA sequence
ttcctgattttgcaccaaac

SEQ ID NO: 737967 - DNA, 20 bp, Artificial
  CRISPR gRNA sequence
cctgattttgcaccaaacct

SEQ ID NO: 737968 - DNA, 20 bp, Artificial
  CRISPR gRNA sequence
ctgattttgcaccaaacctt

SEQ ID NO: 737969 - DNA, 20 bp, Artificial
  CRISPR gRNA sequence
attttgcaccaaaccttgcc

SEQ ID NO: 737970 - DNA, 20 bp, Artificial
  CRISPR gRNA sequence
tgcaccaaaccttgccctcc

SEQ ID NO: 737971 - DNA, 20 bp, Artificial
  CRISPR gRNA sequence
gcaccaaaccttgccctcca

SEQ ID NO: 737972 - DNA, 20 bp, Artificial
  CRISPR gRNA sequence
caccaaaccttgccctccac

SEQ ID NO: 737973 - DNA, 20 bp, Artificial
  CRISPR gRNA sequence
gccctccacgcggtttttgt

SEQ ID NO: 737974 - DNA, 20 bp, Artificial
  CRISPR gRNA sequence
ccctccacgcggtttttgta

SEQ ID NO: 737975 - DNA, 20 bp, Artificial
  CRISPR gRNA sequence
cacgcggtttttgtagccct

SEQ ID NO: 737976 - DNA, 20 bp, Artificial
  CRISPR gRNA sequence
ttgtagcccttataggagca

SEQ ID NO: 737977 - DNA, 20 bp, Artificial
  CRISPR gRNA sequence
tgtagcccttataggagcac

SEQ ID NO: 737978 - DNA, 20 bp, Artificial
  CRISPR gRNA sequence
gtagcccttataggagcact

SEQ ID NO: 737979 - DNA, 20 bp, Artificial
  CRISPR gRNA sequence
tagcccttataggagcactg

SEQ ID NO: 737980 - DNA, 20 bp, Artificial
  CRISPR gRNA sequence
ataggagcactgcacagaca

SEQ ID NO: 737981 - DNA, 20 bp, Artificial
  CRISPR gRNA sequence
taggagcactgcacagacag

SEQ ID NO: 737982 - DNA, 20 bp, Artificial
  CRISPR gRNA sequence
cacagacagagtctcccctt

SEQ ID NO: 737983 - DNA, 20 bp, Artificial
  CRISPR gRNA sequence
cccttcaaggagcctcactt

SEQ ID NO: 737984 - DNA, 20 bp, Artificial
  CRISPR gRNA sequence
caaggagcctcacttttgtg

SEQ ID NO: 737985 - DNA, 20 bp, Artificial
  CRISPR gRNA sequence
aaggagcctcacttttgtgt

SEQ ID NO: 737986 - DNA, 20 bp, Artificial
  CRISPR gRNA sequence
acttttgtgtatacactgtc

SEQ ID NO: 737987 - DNA, 20 bp, Artificial
  CRISPR gRNA sequence
ttgtgtatacactgtcagca

SEQ ID NO: 737988 - DNA, 20 bp, Artificial
  CRISPR gRNA sequence
tgtgtatacactgtcagcag

SEQ ID NO: 737989 - DNA, 20 bp, Artificial
  CRISPR gRNA sequence
gtgtatacactgtcagcaga

SEQ ID NO: 737990 - DNA, 20 bp, Artificial
  CRISPR gRNA sequence
tgtatacactgtcagcagag

SEQ ID NO: 737991 - DNA, 20 bp, Artificial
  CRISPR gRNA sequence
tcagcagaggggcctgtgga

SEQ ID NO: 737992 - DNA, 20 bp, Artificial
  CRISPR gRNA sequence
tggagacaatacttattgaa

SEQ ID NO: 737993 - DNA, 20 bp, Artificial
  CRISPR gRNA sequence
attgaataaggtctggcaag

SEQ ID NO: 737994 - DNA, 20 bp, Artificial
  CRISPR gRNA sequence
ttgaataaggtctggcaaga

SEQ ID NO: 737995 - DNA, 20 bp, Artificial
  CRISPR gRNA sequence
aataaggtctggcaagagga

SEQ ID NO: 737996 - DNA, 20 bp, Artificial
  CRISPR gRNA sequence
gcaagaggagaggaagaaga

SEQ ID NO: 737997 - DNA, 20 bp, Artificial
  CRISPR gRNA sequence
aagatcatggtgaagggtag

SEQ ID NO: 737998 - DNA, 20 bp, Artificial
  CRISPR gRNA sequence
tcctgctgtcacagaaccca

SEQ ID NO: 737999 - DNA, 20 bp, Artificial
  CRISPR gRNA sequence
ctgtcacagaacccacagat

SEQ ID NO: 738000 - DNA, 20 bp, Artificial
  CRISPR gRNA sequence
tcacagaacccacagattga

SEQ ID NO: 738001 - DNA, 20 bp, Artificial
  CRISPR gRNA sequence
agggggaaatacagccccgc

SEQ ID NO: 738002 - DNA, 20 bp, Artificial
  CRISPR gRNA sequence
cagggagcttgccccaatct

SEQ ID NO: 738003 - DNA, 20 bp, Artificial
  CRISPR gRNA sequence
agggagcttgccccaatctg

SEQ ID NO: 738004 - DNA, 20 bp, Artificial
  CRISPR gRNA sequence
gccccaatctgaagggaggt

SEQ ID NO: 738005 - DNA, 20 bp, Artificial
  CRISPR gRNA sequence
ccccaatctgaagggaggtg

SEQ ID NO: 738006 - DNA, 20 bp, Artificial
  CRISPR gRNA sequence
aagggaggtgaatgggccct

SEQ ID NO: 738007 - DNA, 20 bp, Artificial
  CRISPR gRNA sequence
aaaacagctagcttccagta

SEQ ID NO: 738008 - DNA, 20 bp, Artificial
  CRISPR gRNA sequence
gcttccagtattacagtgga

SEQ ID NO: 738009 - DNA, 20 bp, Artificial
  CRISPR gRNA sequence
ccagtattacagtggagaca

SEQ ID NO: 738010 - DNA, 20 bp, Artificial
  CRISPR gRNA sequence
cagtattacagtggagacac

SEQ ID NO: 738011 - DNA, 20 bp, Artificial
  CRISPR gRNA sequence
cagtggagacacaacccccg

SEQ ID NO: 738012 - DNA, 20 bp, Artificial
  CRISPR gRNA sequence
tcagggagctttcagtctga

SEQ ID NO: 738013 - DNA, 20 bp, Artificial
  CRISPR gRNA sequence
agggagctttcagtctgatg

SEQ ID NO: 738014 - DNA, 20 bp, Artificial
  CRISPR gRNA sequence
tcagtctgatggaggaggca

SEQ ID NO: 738015 - DNA, 20 bp, Artificial
  CRISPR gRNA sequence
cagtctgatggaggaggcag

SEQ ID NO: 738016 - DNA, 20 bp, Artificial
  CRISPR gRNA sequence
agtctgatggaggaggcagg

SEQ ID NO: 738017 - DNA, 20 bp, Artificial
  CRISPR gRNA sequence
atggaggaggcaggtatatc

SEQ ID NO: 738018 - DNA, 20 bp, Artificial
  CRISPR gRNA sequence
agtgagtccccagtctaatg

SEQ ID NO: 738019 - DNA, 20 bp, Artificial
  CRISPR gRNA sequence
atggaggaaacgcagcattt

SEQ ID NO: 738020 - DNA, 20 bp, Artificial
  CRISPR gRNA sequence
acactcggagctccatcaga

SEQ ID NO: 738021 - DNA, 20 bp, Artificial
  CRISPR gRNA sequence
cactcggagctccatcagac

SEQ ID NO: 738022 - DNA, 20 bp, Artificial
  CRISPR gRNA sequence
ggagctccatcagacacagc

SEQ ID NO: 738023 - DNA, 20 bp, Artificial
  CRISPR gRNA sequence
catcagacacagcccctttc

SEQ ID NO: 738024 - DNA, 20 bp, Artificial
  CRISPR gRNA sequence
tcctcatggtattttctagt

SEQ ID NO: 738025 - DNA, 20 bp, Artificial
  CRISPR gRNA sequence
cctcatggtattttctagtc

SEQ ID NO: 738026 - DNA, 20 bp, Artificial
  CRISPR gRNA sequence
ctcatggtattttctagtct

SEQ ID NO: 738027 - DNA, 20 bp, Artificial
  CRISPR gRNA sequence
atggtattttctagtctgat

SEQ ID NO: 738028 - DNA, 20 bp, Artificial
  CRISPR gRNA sequence
tctagtctgatgggaaagtg

SEQ ID NO: 738029 - DNA, 20 bp, Artificial
  CRISPR gRNA sequence
ctagtctgatgggaaagtga

SEQ ID NO: 738030 - DNA, 20 bp, Artificial
  CRISPR gRNA sequence
tagtctgatgggaaagtgac

SEQ ID NO: 738031 - DNA, 20 bp, Artificial
  CRISPR gRNA sequence
gtctgatgggaaagtgacaa

SEQ ID NO: 738032 - DNA, 20 bp, Artificial
  CRISPR gRNA sequence
atgggaaagtgacaagctct

SEQ ID NO: 738033 - DNA, 20 bp, Artificial
  CRISPR gRNA sequence
tgtcttcagggattcccagg

SEQ ID NO: 738034 - DNA, 20 bp, Artificial
  CRISPR gRNA sequence
tcttcagggattcccaggga

SEQ ID NO: 738035 - DNA, 20 bp, Artificial
  CRISPR gRNA sequence
cagggattcccagggaattc

SEQ ID NO: 738036 - DNA, 20 bp, Artificial
  CRISPR gRNA sequence
agggattcccagggaattca

SEQ ID NO: 738037 - DNA, 20 bp, Artificial
  CRISPR gRNA sequence
ccagggaattcatttttgtt

SEQ ID NO: 738038 - DNA, 20 bp, Artificial
  CRISPR gRNA sequence
atttttgttttgttttgttt

SEQ ID NO: 738039 - DNA, 20 bp, Artificial
  CRISPR gRNA sequence
ttgttttgttttgttttgtt

SEQ ID NO: 738040 - DNA, 20 bp, Artificial
  CRISPR gRNA sequence
tgttttgttttgttttgttt

SEQ ID NO: 738041 - DNA, 20 bp, Artificial
  CRISPR gRNA sequence
gttttgttttgttttgtttt

SEQ ID NO: 738042 - DNA, 20 bp, Artificial
  CRISPR gRNA sequence
ttttgttttgttttgttttg

SEQ ID NO: 738043 - DNA, 20 bp, Artificial
  CRISPR gRNA sequence
tgttttgttttgttttgttt

SEQ ID NO: 738044 - DNA, 20 bp, Artificial
  CRISPR gRNA sequence
gttttgttttgttttgtttt

SEQ ID NO: 738045 - DNA, 20 bp, Artificial
  CRISPR gRNA sequence
ttttgttttgttttgttttg

SEQ ID NO: 738046 - DNA, 20 bp, Artificial
  CRISPR gRNA sequence
tgttttgttttgttttgttt

SEQ ID NO: 738047 - DNA, 20 bp, Artificial
  CRISPR gRNA sequence
gttttgttttgttttgtttt

SEQ ID NO: 738048 - DNA, 20 bp, Artificial
  CRISPR gRNA sequence
ttttgttttgttttgttttt

SEQ ID NO: 738049 - DNA, 20 bp, Artificial
  CRISPR gRNA sequence
tgttttgttttgtttttgag

SEQ ID NO: 738050 - DNA, 20 bp, Artificial
  CRISPR gRNA sequence
gttttgttttgtttttgaga

SEQ ID NO: 738051 - DNA, 20 bp, Artificial
  CRISPR gRNA sequence
ttttgttttgtttttgagac

SEQ ID NO: 738052 - DNA, 20 bp, Artificial
  CRISPR gRNA sequence
tgttttgtttttgagacgga

SEQ ID NO: 738053 - DNA, 20 bp, Artificial
  CRISPR gRNA sequence
gttttgtttttgagacggag

SEQ ID NO: 738054 - DNA, 20 bp, Artificial
  CRISPR gRNA sequence
ttttgtttttgagacggagt

SEQ ID NO: 738055 - DNA, 20 bp, Artificial
  CRISPR gRNA sequence
tgtttttgagacggagtctc

SEQ ID NO: 738056 - DNA, 20 bp, Artificial
  CRISPR gRNA sequence
gtttttgagacggagtctcg

SEQ ID NO: 738057 - DNA, 20 bp, Artificial
  CRISPR gRNA sequence
tttttgagacggagtctcgc

SEQ ID NO: 738058 - DNA, 20 bp, Artificial
  CRISPR gRNA sequence
ttgagacggagtctcgctct

SEQ ID NO: 738059 - DNA, 20 bp, Artificial
  CRISPR gRNA sequence
tgagacggagtctcgctctg

SEQ ID NO: 738060 - DNA, 20 bp, Artificial
  CRISPR gRNA sequence
gagacggagtctcgctctgt

SEQ ID NO: 738061 - DNA, 20 bp, Artificial
  CRISPR gRNA sequence
agacggagtctcgctctgtt

SEQ ID NO: 738062 - DNA, 20 bp, Artificial
  CRISPR gRNA sequence
gctctgttgcccaggctgga

SEQ ID NO: 738063 - DNA, 20 bp, Artificial
  CRISPR gRNA sequence
tgttgcccaggctggagtgc

SEQ ID NO: 738064 - DNA, 20 bp, Artificial
  CRISPR gRNA sequence
ttgcccaggctggagtgcag

SEQ ID NO: 738065 - DNA, 20 bp, Artificial
  CRISPR gRNA sequence
cccaggctggagtgcagtgg

SEQ ID NO: 738066 - DNA, 20 bp, Artificial
  CRISPR gRNA sequence
gagtgcagtggcacgatctc

SEQ ID NO: 738067 - DNA, 20 bp, Artificial
  CRISPR gRNA sequence
agctcactgtaacctccgcc

SEQ ID NO: 738068 - DNA, 20 bp, Artificial
  CRISPR gRNA sequence
actgtaacctccgcctcctg

SEQ ID NO: 738069 - DNA, 20 bp, Artificial
  CRISPR gRNA sequence
taacctccgcctcctgggtt

SEQ ID NO: 738070 - DNA, 20 bp, Artificial
  CRISPR gRNA sequence
cgcctcctgggttcaaacta

SEQ ID NO: 738071 - DNA, 20 bp, Artificial
  CRISPR gRNA sequence
ctgggttcaaactattctcc

SEQ ID NO: 738072 - DNA, 20 bp, Artificial
  CRISPR gRNA sequence
ggttcaaactattctcctgc

SEQ ID NO: 738073 - DNA, 20 bp, Artificial
  CRISPR gRNA sequence
aaactattctcctgcctcag

SEQ ID NO: 738074 - DNA, 20 bp, Artificial
  CRISPR gRNA sequence
ttctcctgcctcagcctcct

SEQ ID NO: 738075 - DNA, 20 bp, Artificial
  CRISPR gRNA sequence
tcctgcctcagcctcctgag

SEQ ID NO: 738076 - DNA, 20 bp, Artificial
  CRISPR gRNA sequence
ctgcctcagcctcctgagta

SEQ ID NO: 738077 - DNA, 20 bp, Artificial
  CRISPR gRNA sequence
cctcagcctcctgagtagct

SEQ ID NO: 738078 - DNA, 20 bp, Artificial
  CRISPR gRNA sequence
agcctcctgagtagctggga

SEQ ID NO: 738079 - DNA, 20 bp, Artificial
  CRISPR gRNA sequence
ctgagtagctgggactacag

SEQ ID NO: 738080 - DNA, 20 bp, Artificial
  CRISPR gRNA sequence
agtagctgggactacaggtg

SEQ ID NO: 738081 - DNA, 20 bp, Artificial
  CRISPR gRNA sequence
ggactacaggtgcctgccac

SEQ ID NO: 738082 - DNA, 20 bp, Artificial
  CRISPR gRNA sequence
caggtgcctgccaccacgtc

SEQ ID NO: 738083 - DNA, 20 bp, Artificial
  CRISPR gRNA sequence
ccaccacgtccggctaattt

SEQ ID NO: 738084 - DNA, 20 bp, Artificial
  CRISPR gRNA sequence
attttttgtatttttagtag

SEQ ID NO: 738085 - DNA, 20 bp, Artificial
  CRISPR gRNA sequence
tttgtatttttagtagagac

SEQ ID NO: 738086 - DNA, 20 bp, Artificial
  CRISPR gRNA sequence
ttgtatttttagtagagacg

SEQ ID NO: 738087 - DNA, 20 bp, Artificial
  CRISPR gRNA sequence
tgtatttttagtagagacgg

SEQ ID NO: 738088 - DNA, 20 bp, Artificial
  CRISPR gRNA sequence
gtatttttagtagagacggg

SEQ ID NO: 738089 - DNA, 20 bp, Artificial
  CRISPR gRNA sequence
tatttttagtagagacggga

SEQ ID NO: 738090 - DNA, 20 bp, Artificial
  CRISPR gRNA sequence
ttagtagagacgggatttca

SEQ ID NO: 738091 - DNA, 20 bp, Artificial
  CRISPR gRNA sequence
tagtagagacgggatttcac

SEQ ID NO: 738092 - DNA, 20 bp, Artificial
  CRISPR gRNA sequence
agtagagacgggatttcacc

SEQ ID NO: 738093 - DNA, 20 bp, Artificial
  CRISPR gRNA sequence
gtagagacgggatttcacca

SEQ ID NO: 738094 - DNA, 20 bp, Artificial
  CRISPR gRNA sequence
caccatgttagccaggatgg

SEQ ID NO: 738095 - DNA, 20 bp, Artificial
  CRISPR gRNA sequence
accatgttagccaggatggt

SEQ ID NO: 738096 - DNA, 20 bp, Artificial
  CRISPR gRNA sequence
gccaggatggtctcaatctc

SEQ ID NO: 738097 - DNA, 20 bp, Artificial
  CRISPR gRNA sequence
aatctcttgacttcgtgatc

SEQ ID NO: 738098 - DNA, 20 bp, Artificial
  CRISPR gRNA sequence
ttgacttcgtgatccacctg

SEQ ID NO: 738099 - DNA, 20 bp, Artificial
  CRISPR gRNA sequence
gacttcgtgatccacctgcc

SEQ ID NO: 738100 - DNA, 20 bp, Artificial
  CRISPR gRNA sequence
acttcgtgatccacctgcct

SEQ ID NO: 738101 - DNA, 20 bp, Artificial
  CRISPR gRNA sequence
cgtgatccacctgcctcggc

SEQ ID NO: 738102 - DNA, 20 bp, Artificial
  CRISPR gRNA sequence
gtgatccacctgcctcggcc

SEQ ID NO: 738103 - DNA, 20 bp, Artificial
  CRISPR gRNA sequence
cctcggcctcccaaagtgct

SEQ ID NO: 738104 - DNA, 20 bp, Artificial
  CRISPR gRNA sequence
ggcctcccaaagtgctggga

SEQ ID NO: 738105 - DNA, 20 bp, Artificial
  CRISPR gRNA sequence
ccaaagtgctgggattgcag

SEQ ID NO: 738106 - DNA, 20 bp, Artificial
  CRISPR gRNA sequence
ggattgcaggcgtgagccac

SEQ ID NO: 738107 - DNA, 20 bp, Artificial
  CRISPR gRNA sequence
caggcgtgagccactgtgcc

SEQ ID NO: 738108 - DNA, 20 bp, Artificial
  CRISPR gRNA sequence
tgcccggcatcccagggaat

SEQ ID NO: 738109 - DNA, 20 bp, Artificial
  CRISPR gRNA sequence
ttgtgggaaaaacccaggtc

SEQ ID NO: 738110 - DNA, 20 bp, Artificial
  CRISPR gRNA sequence
gtgggaaaaacccaggtcat

SEQ ID NO: 738111 - DNA, 20 bp, Artificial
  CRISPR gRNA sequence
tgggaaaaacccaggtcatg

SEQ ID NO: 738112 - DNA, 20 bp, Artificial
  CRISPR gRNA sequence
agtgagacagatgcagagac

SEQ ID NO: 738113 - DNA, 20 bp, Artificial
  CRISPR gRNA sequence
agttgtgaaatttcagtgcc

SEQ ID NO: 738114 - DNA, 20 bp, Artificial
  CRISPR gRNA sequence
tgaaatttcagtgcccaact

SEQ ID NO: 738115 - DNA, 20 bp, Artificial
  CRISPR gRNA sequence
cagtgcccaactaactaggt

SEQ ID NO: 738116 - DNA, 20 bp, Artificial
  CRISPR gRNA sequence
agtgcccaactaactaggta

SEQ ID NO: 738117 - DNA, 20 bp, Artificial
  CRISPR gRNA sequence
actaggtagataagaaaatc

SEQ ID NO: 738118 - DNA, 20 bp, Artificial
  CRISPR gRNA sequence
ggtagataagaaaatctagt

SEQ ID NO: 738119 - DNA, 20 bp, Artificial
  CRISPR gRNA sequence
gtatttgaaaatatgattaa

SEQ ID NO: 738120 - DNA, 20 bp, Artificial
  CRISPR gRNA sequence
gaaaatatgattaacagtta

SEQ ID NO: 738121 - DNA, 20 bp, Artificial
  CRISPR gRNA sequence
aaaatatgattaacagttat

SEQ ID NO: 738122 - DNA, 20 bp, Artificial
  CRISPR gRNA sequence
acagttatttatttcacaaa

SEQ ID NO: 738123 - DNA, 20 bp, Artificial
  CRISPR gRNA sequence
tttatttcacaaataggttc

SEQ ID NO: 738124 - DNA, 20 bp, Artificial
  CRISPR gRNA sequence
atttcacaaataggttcact

SEQ ID NO: 738125 - DNA, 20 bp, Artificial
  CRISPR gRNA sequence
tttcacaaataggttcactt

SEQ ID NO: 738126 - DNA, 20 bp, Artificial
  CRISPR gRNA sequence
cacaaataggttcacttagt

SEQ ID NO: 738127 - DNA, 20 bp, Artificial
  CRISPR gRNA sequence
acaaataggttcacttagtc

SEQ ID NO: 738128 - DNA, 20 bp, Artificial
  CRISPR gRNA sequence
acttagtcctctttaaataa

SEQ ID NO: 738129 - DNA, 20 bp, Artificial
  CRISPR gRNA sequence
agtcctctttaaataataac

SEQ ID NO: 738130 - DNA, 20 bp, Artificial
  CRISPR gRNA sequence
gtcctctttaaataataact

SEQ ID NO: 738131 - DNA, 20 bp, Artificial
  CRISPR gRNA sequence
tttaaataataactctcctt

SEQ ID NO: 738132 - DNA, 20 bp, Artificial
  CRISPR gRNA sequence
taaataataactctccttag

SEQ ID NO: 738133 - DNA, 20 bp, Artificial
  CRISPR gRNA sequence
aaataataactctccttagt

SEQ ID NO: 738134 - DNA, 20 bp, Artificial
  CRISPR gRNA sequence
aataataactctccttagtt

SEQ ID NO: 738135 - DNA, 20 bp, Artificial
  CRISPR gRNA sequence
tccttagttcattccatctg

SEQ ID NO: 738136 - DNA, 20 bp, Artificial
  CRISPR gRNA sequence
cttagttcattccatctggt

SEQ ID NO: 738137 - DNA, 20 bp, Artificial
  CRISPR gRNA sequence
agttcattccatctggtgtt

SEQ ID NO: 738138 - DNA, 20 bp, Artificial
  CRISPR gRNA sequence
gttcattccatctggtgttt

SEQ ID NO: 738139 - DNA, 20 bp, Artificial
  CRISPR gRNA sequence
attccatctggtgtttagtt

SEQ ID NO: 738140 - DNA, 20 bp, Artificial
  CRISPR gRNA sequence
catctggtgtttagttttaa

SEQ ID NO: 738141 - DNA, 20 bp, Artificial
  CRISPR gRNA sequence
gtgtttagttttaaaatatt

SEQ ID NO: 738142 - DNA, 20 bp, Artificial
  CRISPR gRNA sequence
agttttaaaatattctagtt

SEQ ID NO: 738143 - DNA, 20 bp, Artificial
  CRISPR gRNA sequence
gttttaaaatattctagtta

SEQ ID NO: 738144 - DNA, 20 bp, Artificial
  CRISPR gRNA sequence
taaaatattctagttacata

SEQ ID NO: 738145 - DNA, 20 bp, Artificial
  CRISPR gRNA sequence
aaaatattctagttacataa

SEQ ID NO: 738146 - DNA, 20 bp, Artificial
  CRISPR gRNA sequence
aaatattctagttacataaa

SEQ ID NO: 738147 - DNA, 20 bp, Artificial
  CRISPR gRNA sequence
tagttacataaaacccatag

SEQ ID NO: 738148 - DNA, 20 bp, Artificial
  CRISPR gRNA sequence
gttacataaaacccatagat

SEQ ID NO: 738149 - DNA, 20 bp, Artificial
  CRISPR gRNA sequence
cataaaacccatagatcaag

SEQ ID NO: 738150 - DNA, 20 bp, Artificial
  CRISPR gRNA sequence
tctaaatatacatgtaaaca

SEQ ID NO: 738151 - DNA, 20 bp, Artificial
  CRISPR gRNA sequence
aatatacatgtaaacaaact

SEQ ID NO: 738152 - DNA, 20 bp, Artificial
  CRISPR gRNA sequence
ccaatggagtgtgaaccaca

SEQ ID NO: 738153 - DNA, 20 bp, Artificial
  CRISPR gRNA sequence
tacaattattcactttccac

SEQ ID NO: 738154 - DNA, 20 bp, Artificial
  CRISPR gRNA sequence
caattattcactttccacct

SEQ ID NO: 738155 - DNA, 20 bp, Artificial
  CRISPR gRNA sequence
ttcactttccacctgcaata

SEQ ID NO: 738156 - DNA, 20 bp, Artificial
  CRISPR gRNA sequence
actttccacctgcaatatct

SEQ ID NO: 738157 - DNA, 20 bp, Artificial
  CRISPR gRNA sequence
tccacctgcaatatctttct

SEQ ID NO: 738158 - DNA, 20 bp, Artificial
  CRISPR gRNA sequence
ccacctgcaatatctttctc

SEQ ID NO: 738159 - DNA, 20 bp, Artificial
  CRISPR gRNA sequence
cacctgcaatatctttctct

SEQ ID NO: 738160 - DNA, 20 bp, Artificial
  CRISPR gRNA sequence
caatatctttctctctatgc

SEQ ID NO: 738161 - DNA, 20 bp, Artificial
  CRISPR gRNA sequence
tctctctatgctgaggagta

SEQ ID NO: 738162 - DNA, 20 bp, Artificial
  CRISPR gRNA sequence
ctctctatgctgaggagtaa

SEQ ID NO: 738163 - DNA, 20 bp, Artificial
  CRISPR gRNA sequence
tctctatgctgaggagtaag

SEQ ID NO: 738164 - DNA, 20 bp, Artificial
  CRISPR gRNA sequence
tctatgctgaggagtaagat

SEQ ID NO: 738165 - DNA, 20 bp, Artificial
  CRISPR gRNA sequence
tatgctgaggagtaagatgt

SEQ ID NO: 738166 - DNA, 20 bp, Artificial
  CRISPR gRNA sequence
tgctgaggagtaagatgtgg

SEQ ID NO: 738167 - DNA, 20 bp, Artificial
  CRISPR gRNA sequence
aggagtaagatgtggtccaa

SEQ ID NO: 738168 - DNA, 20 bp, Artificial
  CRISPR gRNA sequence
cataatccacagtctggtag

SEQ ID NO: 738169 - DNA, 20 bp, Artificial
  CRISPR gRNA sequence
ataatccacagtctggtaga

SEQ ID NO: 738170 - DNA, 20 bp, Artificial
  CRISPR gRNA sequence
gtagagacagagcagaactg

SEQ ID NO: 738171 - DNA, 20 bp, Artificial
  CRISPR gRNA sequence
gggtgtgcagggtgactcag

SEQ ID NO: 738172 - DNA, 20 bp, Artificial
  CRISPR gRNA sequence
aggggacagagagagggaga

SEQ ID NO: 738173 - DNA, 20 bp, Artificial
  CRISPR gRNA sequence
ccttgggctccctccacccc

SEQ ID NO: 738174 - DNA, 20 bp, Artificial
  CRISPR gRNA sequence
gggctccctccacccctctg

SEQ ID NO: 738175 - DNA, 20 bp, Artificial
  CRISPR gRNA sequence
ggctccctccacccctctgc

SEQ ID NO: 738176 - DNA, 20 bp, Artificial
  CRISPR gRNA sequence
cctccacccctctgcctgcc

SEQ ID NO: 738177 - DNA, 20 bp, Artificial
  CRISPR gRNA sequence
cacccctctgcctgccttaa

SEQ ID NO: 738178 - DNA, 20 bp, Artificial
  CRISPR gRNA sequence
tgcctgccttaagctcagct

SEQ ID NO: 738179 - DNA, 20 bp, Artificial
  CRISPR gRNA sequence
cctgccttaagctcagctga

SEQ ID NO: 738180 - DNA, 20 bp, Artificial
  CRISPR gRNA sequence
ccttaagctcagctgactct

SEQ ID NO: 738181 - DNA, 20 bp, Artificial
  CRISPR gRNA sequence
aagctcagctgactcttctg

SEQ ID NO: 738182 - DNA, 20 bp, Artificial
  CRISPR gRNA sequence
agctcagctgactcttctga

SEQ ID NO: 738183 - DNA, 20 bp, Artificial
  CRISPR gRNA sequence
agctgactcttctgataatt

SEQ ID NO: 738184 - DNA, 20 bp, Artificial
  CRISPR gRNA sequence
actcttctgataatttcacc

SEQ ID NO: 738185 - DNA, 20 bp, Artificial
  CRISPR gRNA sequence
ttctgataatttcaccccag

SEQ ID NO: 738186 - DNA, 20 bp, Artificial
  CRISPR gRNA sequence
ctgataatttcaccccagag

SEQ ID NO: 738187 - DNA, 20 bp, Artificial
  CRISPR gRNA sequence
tgataatttcaccccagagt

SEQ ID NO: 738188 - DNA, 20 bp, Artificial
  CRISPR gRNA sequence
ataatttcaccccagagtct

SEQ ID NO: 738189 - DNA, 20 bp, Artificial
  CRISPR gRNA sequence
caccccagagtcttccaaaa

SEQ ID NO: 738190 - DNA, 20 bp, Artificial
  CRISPR gRNA sequence
accccagagtcttccaaaaa

SEQ ID NO: 738191 - DNA, 20 bp, Artificial
  CRISPR gRNA sequence
ccaaaaaaaccacatataaa

SEQ ID NO: 738192 - DNA, 20 bp, Artificial
  CRISPR gRNA sequence
caaaaaaaccacatataaaa

SEQ ID NO: 738193 - DNA, 20 bp, Artificial
  CRISPR gRNA sequence
tcccccatagtagagaacag

SEQ ID NO: 738194 - DNA, 20 bp, Artificial
  CRISPR gRNA sequence
ccccatagtagagaacagag

SEQ ID NO: 738195 - DNA, 20 bp, Artificial
  CRISPR gRNA sequence
tggagtcaaaataaacaagg

SEQ ID NO: 738196 - DNA, 20 bp, Artificial
  CRISPR gRNA sequence
ggagtcaaaataaacaaggg

SEQ ID NO: 738197 - DNA, 20 bp, Artificial
  CRISPR gRNA sequence
gagtcaaaataaacaagggt

SEQ ID NO: 738198 - DNA, 20 bp, Artificial
  CRISPR gRNA sequence
aaaccctgtttctaccactt

SEQ ID NO: 738199 - DNA, 20 bp, Artificial
  CRISPR gRNA sequence
tttctaccacttagtggtgt

SEQ ID NO: 738200 - DNA, 20 bp, Artificial
  CRISPR gRNA sequence
ctaccacttagtggtgtgat

SEQ ID NO: 738201 - DNA, 20 bp, Artificial
  CRISPR gRNA sequence
taccacttagtggtgtgatt

SEQ ID NO: 738202 - DNA, 20 bp, Artificial
  CRISPR gRNA sequence
ccacttagtggtgtgattag

SEQ ID NO: 738203 - DNA, 20 bp, Artificial
  CRISPR gRNA sequence
agtggtgtgattaggtcacc

SEQ ID NO: 738204 - DNA, 20 bp, Artificial
  CRISPR gRNA sequence
gtggtgtgattaggtcacct

SEQ ID NO: 738205 - DNA, 20 bp, Artificial
  CRISPR gRNA sequence
ggtcacctgtttgatacaga

SEQ ID NO: 738206 - DNA, 20 bp, Artificial
  CRISPR gRNA sequence
tttgatacagaaatatcaaa

SEQ ID NO: 738207 - DNA, 20 bp, Artificial
  CRISPR gRNA sequence
gatacagaaatatcaaaaca

SEQ ID NO: 738208 - DNA, 20 bp, Artificial
  CRISPR gRNA sequence
atacagaaatatcaaaacag

SEQ ID NO: 738209 - DNA, 20 bp, Artificial
  CRISPR gRNA sequence
gactgatacagaaatatctc

SEQ ID NO: 738210 - DNA, 20 bp, Artificial
  CRISPR gRNA sequence
actgatacagaaatatctct

SEQ ID NO: 738211 - DNA, 20 bp, Artificial
  CRISPR gRNA sequence
atacagaaatatctctgttt

SEQ ID NO: 738212 - DNA, 20 bp, Artificial
  CRISPR gRNA sequence
tgtttctttatcagtcaagt

SEQ ID NO: 738213 - DNA, 20 bp, Artificial
  CRISPR gRNA sequence
tttctttatcagtcaagtga

SEQ ID NO: 738214 - DNA, 20 bp, Artificial
  CRISPR gRNA sequence
ctttatcagtcaagtgagaa

SEQ ID NO: 738215 - DNA, 20 bp, Artificial
  CRISPR gRNA sequence
tttatcagtcaagtgagaat

SEQ ID NO: 738216 - DNA, 20 bp, Artificial
  CRISPR gRNA sequence
tatcagtcaagtgagaatag

SEQ ID NO: 738217 - DNA, 20 bp, Artificial
  CRISPR gRNA sequence
atcagtcaagtgagaatagc

SEQ ID NO: 738218 - DNA, 20 bp, Artificial
  CRISPR gRNA sequence
tcagtcaagtgagaatagca

SEQ ID NO: 738219 - DNA, 20 bp, Artificial
  CRISPR gRNA sequence
acaggttgctgtgagaattc

SEQ ID NO: 738220 - DNA, 20 bp, Artificial
  CRISPR gRNA sequence
ctgtgagaattctgccccag

SEQ ID NO: 738221 - DNA, 20 bp, Artificial
  CRISPR gRNA sequence
tgagaattctgccccaggtc

SEQ ID NO: 738222 - DNA, 20 bp, Artificial
  CRISPR gRNA sequence
tgccccaggtcagtgctttg

SEQ ID NO: 738223 - DNA, 20 bp, Artificial
  CRISPR gRNA sequence
ccccaggtcagtgctttgca

SEQ ID NO: 738224 - DNA, 20 bp, Artificial
  CRISPR gRNA sequence
tgcacacagtgcatgctcaa

SEQ ID NO: 738225 - DNA, 20 bp, Artificial
  CRISPR gRNA sequence
gcacacagtgcatgctcaac

SEQ ID NO: 738226 - DNA, 20 bp, Artificial
  CRISPR gRNA sequence
cacacagtgcatgctcaact

SEQ ID NO: 738227 - DNA, 20 bp, Artificial
  CRISPR gRNA sequence
aactcatgcttccttttccc

SEQ ID NO: 738228 - DNA, 20 bp, Artificial
  CRISPR gRNA sequence
atgcttccttttcccacatg

SEQ ID NO: 738229 - DNA, 20 bp, Artificial
  CRISPR gRNA sequence
ccttttcccacatgctgggg

SEQ ID NO: 738230 - DNA, 20 bp, Artificial
  CRISPR gRNA sequence
cttttcccacatgctggggc

SEQ ID NO: 738231 - DNA, 20 bp, Artificial
  CRISPR gRNA sequence
ttcccacatgctggggcctc

SEQ ID NO: 738232 - DNA, 20 bp, Artificial
  CRISPR gRNA sequence
tcccacatgctggggcctcc

SEQ ID NO: 738233 - DNA, 20 bp, Artificial
  CRISPR gRNA sequence
cccacatgctggggcctccc

SEQ ID NO: 738234 - DNA, 20 bp, Artificial
  CRISPR gRNA sequence
ccacatgctggggcctccca

SEQ ID NO: 738235 - DNA, 20 bp, Artificial
  CRISPR gRNA sequence
gggcctcccagttcccccaa

SEQ ID NO: 738236 - DNA, 20 bp, Artificial
  CRISPR gRNA sequence
ccagttcccccaatggaacc

SEQ ID NO: 738237 - DNA, 20 bp, Artificial
  CRISPR gRNA sequence
ccccaatggaacccagagct

SEQ ID NO: 738238 - DNA, 20 bp, Artificial
  CRISPR gRNA sequence
tgacagtcaagggcccagaa

SEQ ID NO: 738239 - DNA, 20 bp, Artificial
  CRISPR gRNA sequence
tcccaccagaatccaggata

SEQ ID NO: 738240 - DNA, 20 bp, Artificial
  CRISPR gRNA sequence
gagctgaggctctgtgtgaa

SEQ ID NO: 738241 - DNA, 20 bp, Artificial
  CRISPR gRNA sequence
aggctctgtgtgaagcagca

SEQ ID NO: 738242 - DNA, 20 bp, Artificial
  CRISPR gRNA sequence
tgtgtgaagcagcaccctct

SEQ ID NO: 738243 - DNA, 20 bp, Artificial
  CRISPR gRNA sequence
tgtgaagcagcaccctctct

SEQ ID NO: 738244 - DNA, 20 bp, Artificial
  CRISPR gRNA sequence
tctaagcatccctctgtccc

SEQ ID NO: 738245 - DNA, 20 bp, Artificial
  CRISPR gRNA sequence
taagcatccctctgtccctt

SEQ ID NO: 738246 - DNA, 20 bp, Artificial
  CRISPR gRNA sequence
agcatccctctgtcccttgc

SEQ ID NO: 738247 - DNA, 20 bp, Artificial
  CRISPR gRNA sequence
tgtcccttgcaaactaaaca

SEQ ID NO: 738248 - DNA, 20 bp, Artificial
  CRISPR gRNA sequence
tcccttgcaaactaaacaga

SEQ ID NO: 738249 - DNA, 20 bp, Artificial
  CRISPR gRNA sequence
gcaaactaaacagaatgatc

SEQ ID NO: 738250 - DNA, 20 bp, Artificial
  CRISPR gRNA sequence
caaactaaacagaatgatcc

SEQ ID NO: 738251 - DNA, 20 bp, Artificial
  CRISPR gRNA sequence
aacagaatgatccaacttca

SEQ ID NO: 738252 - DNA, 20 bp, Artificial
  CRISPR gRNA sequence
cattatttggtggatgagcc

SEQ ID NO: 738253 - DNA, 20 bp, Artificial
  CRISPR gRNA sequence
attatttggtggatgagccc

SEQ ID NO: 738254 - DNA, 20 bp, Artificial
  CRISPR gRNA sequence
tttggtggatgagcccagga

SEQ ID NO: 738255 - DNA, 20 bp, Artificial
  CRISPR gRNA sequence
ggtggatgagcccaggattt

SEQ ID NO: 738256 - DNA, 20 bp, Artificial
  CRISPR gRNA sequence
gtggatgagcccaggatttc

SEQ ID NO: 738257 - DNA, 20 bp, Artificial
  CRISPR gRNA sequence
cttagcacaagagagacccc

SEQ ID NO: 738258 - DNA, 20 bp, Artificial
  CRISPR gRNA sequence
ttagcacaagagagacccct

SEQ ID NO: 738259 - DNA, 20 bp, Artificial
  CRISPR gRNA sequence
agcacaagagagaccccttt

SEQ ID NO: 738260 - DNA, 20 bp, Artificial
  CRISPR gRNA sequence
gcacaagagagacccctttc

SEQ ID NO: 738261 - DNA, 20 bp, Artificial
  CRISPR gRNA sequence
tctgccctggcagtgggaag

SEQ ID NO: 738262 - DNA, 20 bp, Artificial
  CRISPR gRNA sequence
ctgccctggcagtgggaagc

SEQ ID NO: 738263 - DNA, 20 bp, Artificial
  CRISPR gRNA sequence
tgccctggcagtgggaagct

SEQ ID NO: 738264 - DNA, 20 bp, Artificial
  CRISPR gRNA sequence
ccctggcagtgggaagctgt

SEQ ID NO: 738265 - DNA, 20 bp, Artificial
  CRISPR gRNA sequence
gcagtgggaagctgtttctc

SEQ ID NO: 738266 - DNA, 20 bp, Artificial
  CRISPR gRNA sequence
tttctctaccctctgggagg

SEQ ID NO: 738267 - DNA, 20 bp, Artificial
  CRISPR gRNA sequence
ctctaccctctgggaggtgc

SEQ ID NO: 738268 - DNA, 20 bp, Artificial
  CRISPR gRNA sequence
tctaccctctgggaggtgca

SEQ ID NO: 738269 - DNA, 20 bp, Artificial
  CRISPR gRNA sequence
taccctctgggaggtgcaga

SEQ ID NO: 738270 - DNA, 20 bp, Artificial
  CRISPR gRNA sequence
ccctctgggaggtgcagagt

SEQ ID NO: 738271 - DNA, 20 bp, Artificial
  CRISPR gRNA sequence
tgggaggtgcagagttgggt

SEQ ID NO: 738272 - DNA, 20 bp, Artificial
  CRISPR gRNA sequence
ggaggtgcagagttgggtga

SEQ ID NO: 738273 - DNA, 20 bp, Artificial
  CRISPR gRNA sequence
ggtgaccttgggatgggtct

SEQ ID NO: 738274 - DNA, 20 bp, Artificial
  CRISPR gRNA sequence
gggatgggtctccagggcaa

SEQ ID NO: 738275 - DNA, 20 bp, Artificial
  CRISPR gRNA sequence
ggatgggtctccagggcaat

SEQ ID NO: 738276 - DNA, 20 bp, Artificial
  CRISPR gRNA sequence
cagggcaatgtcttcatgtg

SEQ ID NO: 738277 - DNA, 20 bp, Artificial
  CRISPR gRNA sequence
catgtgtgcctacacctccc

SEQ ID NO: 738278 - DNA, 20 bp, Artificial
  CRISPR gRNA sequence
atgtgtgcctacacctccca

SEQ ID NO: 738279 - DNA, 20 bp, Artificial
  CRISPR gRNA sequence
cacctcccacccctctcaca

SEQ ID NO: 738280 - DNA, 20 bp, Artificial
  CRISPR gRNA sequence
ccacccctctcacaggcagt

SEQ ID NO: 738281 - DNA, 20 bp, Artificial
  CRISPR gRNA sequence
tcacaggcagtggtgagttt

SEQ ID NO: 738282 - DNA, 20 bp, Artificial
  CRISPR gRNA sequence
acaggcagtggtgagttttg

SEQ ID NO: 738283 - DNA, 20 bp, Artificial
  CRISPR gRNA sequence
tgccaacccccaccatgccc

SEQ ID NO: 738284 - DNA, 20 bp, Artificial
  CRISPR gRNA sequence
gccaacccccaccatgccca

SEQ ID NO: 738285 - DNA, 20 bp, Artificial
  CRISPR gRNA sequence
ccaacccccaccatgcccag

SEQ ID NO: 738286 - DNA, 20 bp, Artificial
  CRISPR gRNA sequence
aacaggaagtggtaacttgg

SEQ ID NO: 738287 - DNA, 20 bp, Artificial
  CRISPR gRNA sequence
ggttgccatggcagcgagag

SEQ ID NO: 738288 - DNA, 20 bp, Artificial
  CRISPR gRNA sequence
gttgccatggcagcgagagg

SEQ ID NO: 738289 - DNA, 20 bp, Artificial
  CRISPR gRNA sequence
ccatggcagcgagaggggca

SEQ ID NO: 738290 - DNA, 20 bp, Artificial
  CRISPR gRNA sequence
ctcaaggagcattggtatct

SEQ ID NO: 738291 - DNA, 20 bp, Artificial
  CRISPR gRNA sequence
aaggagcattggtatctgtg

SEQ ID NO: 738292 - DNA, 20 bp, Artificial
  CRISPR gRNA sequence
gtatctgtgaggtgggaaag

SEQ ID NO: 738293 - DNA, 20 bp, Artificial
  CRISPR gRNA sequence
tgaggtgggaaaggcattca

SEQ ID NO: 738294 - DNA, 20 bp, Artificial
  CRISPR gRNA sequence
acacactggtcccttcagga

SEQ ID NO: 738295 - DNA, 20 bp, Artificial
  CRISPR gRNA sequence
gtcccttcaggacagaggca

SEQ ID NO: 738296 - DNA, 20 bp, Artificial
  CRISPR gRNA sequence
caggacagaggcagggacag

SEQ ID NO: 738297 - DNA, 20 bp, Artificial
  CRISPR gRNA sequence
aggacagaggcagggacagg

SEQ ID NO: 738298 - DNA, 20 bp, Artificial
  CRISPR gRNA sequence
caagaaaaatgttcaaattc

SEQ ID NO: 738299 - DNA, 20 bp, Artificial
  CRISPR gRNA sequence
aagaaaaatgttcaaattca

SEQ ID NO: 738300 - DNA, 20 bp, Artificial
  CRISPR gRNA sequence
aaattcagttcaaaacacac

SEQ ID NO: 738301 - DNA, 20 bp, Artificial
  CRISPR gRNA sequence
agttcaaaacacacatgatg

SEQ ID NO: 738302 - DNA, 20 bp, Artificial
  CRISPR gRNA sequence
aaaacacacatgatgcaatg

SEQ ID NO: 738303 - DNA, 20 bp, Artificial
  CRISPR gRNA sequence
ctgtcataactaagcagggc

SEQ ID NO: 738304 - DNA, 20 bp, Artificial
  CRISPR gRNA sequence
tcataactaagcagggcttc

SEQ ID NO: 738305 - DNA, 20 bp, Artificial
  CRISPR gRNA sequence
agcagggcttcctgacagag

SEQ ID NO: 738306 - DNA, 20 bp, Artificial
  CRISPR gRNA sequence
cctgacagaggccaagcaga

SEQ ID NO: 738307 - DNA, 20 bp, Artificial
  CRISPR gRNA sequence
ctgacagaggccaagcagag

SEQ ID NO: 738308 - DNA, 20 bp, Artificial
  CRISPR gRNA sequence
acagaggccaagcagagaaa

SEQ ID NO: 738309 - DNA, 20 bp, Artificial
  CRISPR gRNA sequence
tttgtgtgaggaaattgagg

SEQ ID NO: 738310 - DNA, 20 bp, Artificial
  CRISPR gRNA sequence
gtgtgaggaaattgagggct

SEQ ID NO: 738311 - DNA, 20 bp, Artificial
  CRISPR gRNA sequence
tgtgaggaaattgagggctc

SEQ ID NO: 738312 - DNA, 20 bp, Artificial
  CRISPR gRNA sequence
agggctctgctttaaagcct

SEQ ID NO: 738313 - DNA, 20 bp, Artificial
  CRISPR gRNA sequence
tgctttaaagcctgaggaag

SEQ ID NO: 738314 - DNA, 20 bp, Artificial
  CRISPR gRNA sequence
ctttaaagcctgaggaagcc

SEQ ID NO: 738315 - DNA, 20 bp, Artificial
  CRISPR gRNA sequence
taaagcctgaggaagcctag

SEQ ID NO: 738316 - DNA, 20 bp, Artificial
  CRISPR gRNA sequence
aaagcctgaggaagcctagc

SEQ ID NO: 738317 - DNA, 20 bp, Artificial
  CRISPR gRNA sequence
aagcctgaggaagcctagca

SEQ ID NO: 738318 - DNA, 20 bp, Artificial
  CRISPR gRNA sequence
aggaagcctagcagataaag

SEQ ID NO: 738319 - DNA, 20 bp, Artificial
  CRISPR gRNA sequence
gcagataaaggagccaatgc

SEQ ID NO: 738320 - DNA, 20 bp, Artificial
  CRISPR gRNA sequence
tatcttggcttgggaggcct

SEQ ID NO: 738321 - DNA, 20 bp, Artificial
  CRISPR gRNA sequence
atcttggcttgggaggcctg

SEQ ID NO: 738322 - DNA, 20 bp, Artificial
  CRISPR gRNA sequence
tcttggcttgggaggcctgg

SEQ ID NO: 738323 - DNA, 20 bp, Artificial
  CRISPR gRNA sequence
ggcttgggaggcctgggtta

SEQ ID NO: 738324 - DNA, 20 bp, Artificial
  CRISPR gRNA sequence
gcttgggaggcctgggttag

SEQ ID NO: 738325 - DNA, 20 bp, Artificial
  CRISPR gRNA sequence
gggaggcctgggttagcttc

SEQ ID NO: 738326 - DNA, 20 bp, Artificial
  CRISPR gRNA sequence
ggaggcctgggttagcttcg

SEQ ID NO: 738327 - DNA, 20 bp, Artificial
  CRISPR gRNA sequence
ggttagcttcgcctggggcc

SEQ ID NO: 738328 - DNA, 20 bp, Artificial
  CRISPR gRNA sequence
gcttcgcctggggcctgata

SEQ ID NO: 738329 - DNA, 20 bp, Artificial
  CRISPR gRNA sequence
cgcctggggcctgatattag

SEQ ID NO: 738330 - DNA, 20 bp, Artificial
  CRISPR gRNA sequence
gcctggggcctgatattagg

SEQ ID NO: 738331 - DNA, 20 bp, Artificial
  CRISPR gRNA sequence
gggcctgatattagggtaaa

SEQ ID NO: 738332 - DNA, 20 bp, Artificial
  CRISPR gRNA sequence
atattagggtaaagagctaa

SEQ ID NO: 738333 - DNA, 20 bp, Artificial
  CRISPR gRNA sequence
gggtaaagagctaagtcagc

SEQ ID NO: 738334 - DNA, 20 bp, Artificial
  CRISPR gRNA sequence
agtcagccctaatctcctcc

SEQ ID NO: 738335 - DNA, 20 bp, Artificial
  CRISPR gRNA sequence
atctcctccttccccaaccc

SEQ ID NO: 738336 - DNA, 20 bp, Artificial
  CRISPR gRNA sequence
ctccttccccaacccacaaa

SEQ ID NO: 738337 - DNA, 20 bp, Artificial
  CRISPR gRNA sequence
cttccccaacccacaaaaca

SEQ ID NO: 738338 - DNA, 20 bp, Artificial
  CRISPR gRNA sequence
ccccaacccacaaaacacta

SEQ ID NO: 738339 - DNA, 20 bp, Artificial
  CRISPR gRNA sequence
cccaacccacaaaacactaa

SEQ ID NO: 738340 - DNA, 20 bp, Artificial
  CRISPR gRNA sequence
aacaagaaaactgctggtaa

SEQ ID NO: 738341 - DNA, 20 bp, Artificial
  CRISPR gRNA sequence
ctggtaaggagggtaagaaa

SEQ ID NO: 738342 - DNA, 20 bp, Artificial
  CRISPR gRNA sequence
gtaaggagggtaagaaaaag

SEQ ID NO: 738343 - DNA, 20 bp, Artificial
  CRISPR gRNA sequence
agctcctgcctctgtaccca

SEQ ID NO: 738344 - DNA, 20 bp, Artificial
  CRISPR gRNA sequence
ctgcctctgtacccactccc

SEQ ID NO: 738345 - DNA, 20 bp, Artificial
  CRISPR gRNA sequence
cctctgtacccactccctcc

SEQ ID NO: 738346 - DNA, 20 bp, Artificial
  CRISPR gRNA sequence
tgtacccactccctcctcca

SEQ ID NO: 738347 - DNA, 20 bp, Artificial
  CRISPR gRNA sequence
tacccactccctcctccaca

SEQ ID NO: 738348 - DNA, 20 bp, Artificial
  CRISPR gRNA sequence
cctcctccacaagtcagccc

SEQ ID NO: 738349 - DNA, 20 bp, Artificial
  CRISPR gRNA sequence
ctccacaagtcagccccttc

SEQ ID NO: 738350 - DNA, 20 bp, Artificial
  CRISPR gRNA sequence
cacaagtcagccccttctcc

SEQ ID NO: 738351 - DNA, 20 bp, Artificial
  CRISPR gRNA sequence
ctcccctcacctgagacgca

SEQ ID NO: 738352 - DNA, 20 bp, Artificial
  CRISPR gRNA sequence
tcccctcacctgagacgcaa

SEQ ID NO: 738353 - DNA, 20 bp, Artificial
  CRISPR gRNA sequence
ccctcacctgagacgcaacc

SEQ ID NO: 738354 - DNA, 20 bp, Artificial
  CRISPR gRNA sequence
acctgagacgcaaccctgtg

SEQ ID NO: 738355 - DNA, 20 bp, Artificial
  CRISPR gRNA sequence
agacgcaaccctgtggccac

SEQ ID NO: 738356 - DNA, 20 bp, Artificial
  CRISPR gRNA sequence
tggccacagcagcagcagca

SEQ ID NO: 738357 - DNA, 20 bp, Artificial
  CRISPR gRNA sequence
gggccatggttccatccagc

SEQ ID NO: 738358 - DNA, 20 bp, Artificial
  CRISPR gRNA sequence
catccagctgggcagtgtca

SEQ ID NO: 738359 - DNA, 20 bp, Artificial
  CRISPR gRNA sequence
ggcagtgtcaggcctggaga

SEQ ID NO: 738360 - DNA, 20 bp, Artificial
  CRISPR gRNA sequence
gagatccaaggtgagggccc

SEQ ID NO: 738361 - DNA, 20 bp, Artificial
  CRISPR gRNA sequence
ggcctgccagggaaggaccc

SEQ ID NO: 738362 - DNA, 20 bp, Artificial
  CRISPR gRNA sequence
ccagggaaggacccggggtt

SEQ ID NO: 738363 - DNA, 20 bp, Artificial
  CRISPR gRNA sequence
taaaagtgaagctgcccatt

SEQ ID NO: 738364 - DNA, 20 bp, Artificial
  CRISPR gRNA sequence
aaagtgaagctgcccattta

SEQ ID NO: 738365 - DNA, 20 bp, Artificial
  CRISPR gRNA sequence
cccatttagggaagtgaggc

SEQ ID NO: 738366 - DNA, 20 bp, Artificial
  CRISPR gRNA sequence
agggaagtgaggcagtgtgg

SEQ ID NO: 738367 - DNA, 20 bp, Artificial
  CRISPR gRNA sequence
gggaagtgaggcagtgtggg

SEQ ID NO: 738368 - DNA, 20 bp, Artificial
  CRISPR gRNA sequence
cccccagccaaccgcaggga

SEQ ID NO: 738369 - DNA, 20 bp, Artificial
  CRISPR gRNA sequence
attgagcctattatgagggc

SEQ ID NO: 738370 - DNA, 20 bp, Artificial
  CRISPR gRNA sequence
agcctattatgagggcggtg

SEQ ID NO: 738371 - DNA, 20 bp, Artificial
  CRISPR gRNA sequence
ttatgagggcggtgctggca

SEQ ID NO: 738372 - DNA, 20 bp, Artificial
  CRISPR gRNA sequence
tgagggcggtgctggcagct

SEQ ID NO: 738373 - DNA, 20 bp, Artificial
  CRISPR gRNA sequence
gcagctgtttccgccctttt

SEQ ID NO: 738374 - DNA, 20 bp, Artificial
  CRISPR gRNA sequence
tttccgcccttttcctcgga

SEQ ID NO: 738375 - DNA, 20 bp, Artificial
  CRISPR gRNA sequence
ccgcccttttcctcggaact

SEQ ID NO: 738376 - DNA, 20 bp, Artificial
  CRISPR gRNA sequence
cgcccttttcctcggaactt

SEQ ID NO: 738377 - DNA, 20 bp, Artificial
  CRISPR gRNA sequence
ttcctcggaacttcaggcag

SEQ ID NO: 738378 - DNA, 20 bp, Artificial
  CRISPR gRNA sequence
tcctcggaacttcaggcagg

SEQ ID NO: 738379 - DNA, 20 bp, Artificial
  CRISPR gRNA sequence
cctcggaacttcaggcaggt

SEQ ID NO: 738380 - DNA, 20 bp, Artificial
  CRISPR gRNA sequence
ctcggaacttcaggcaggtg

SEQ ID NO: 738381 - DNA, 20 bp, Artificial
  CRISPR gRNA sequence
ggaacttcaggcaggtgtgg

SEQ ID NO: 738382 - DNA, 20 bp, Artificial
  CRISPR gRNA sequence
caggcaggtgtggctgctcc

SEQ ID NO: 738383 - DNA, 20 bp, Artificial
  CRISPR gRNA sequence
aggcaggtgtggctgctcca

SEQ ID NO: 738384 - DNA, 20 bp, Artificial
  CRISPR gRNA sequence
ctccacccagtctggggccc

SEQ ID NO: 738385 - DNA, 20 bp, Artificial
  CRISPR gRNA sequence
cacccagtctggggccccaa

SEQ ID NO: 738386 - DNA, 20 bp, Artificial
  CRISPR gRNA sequence
ggggccccagactgggtgga

SEQ ID NO: 738387 - DNA, 20 bp, Artificial
  CRISPR gRNA sequence
gggccccagactgggtggag

SEQ ID NO: 738388 - DNA, 20 bp, Artificial
  CRISPR gRNA sequence
ggtggagcagccacacctgc

SEQ ID NO: 738389 - DNA, 20 bp, Artificial
  CRISPR gRNA sequence
cctgaagttccgaggaaaag

SEQ ID NO: 738390 - DNA, 20 bp, Artificial
  CRISPR gRNA sequence
aagttccgaggaaaagggcg

SEQ ID NO: 738391 - DNA, 20 bp, Artificial
  CRISPR gRNA sequence
cgaggaaaagggcggaaaca

SEQ ID NO: 738392 - DNA, 20 bp, Artificial
  CRISPR gRNA sequence
ccagcaccgccctcataata

SEQ ID NO: 738393 - DNA, 20 bp, Artificial
  CRISPR gRNA sequence
ataataggctcaatgaatcc

SEQ ID NO: 738394 - DNA, 20 bp, Artificial
  CRISPR gRNA sequence
aatgaatccctgcggttggc

SEQ ID NO: 738395 - DNA, 20 bp, Artificial
  CRISPR gRNA sequence
cggttggctgggggcagtgg

SEQ ID NO: 738396 - DNA, 20 bp, Artificial
  CRISPR gRNA sequence
gctgggggcagtgggtccca

SEQ ID NO: 738397 - DNA, 20 bp, Artificial
  CRISPR gRNA sequence
ggggcagtgggtcccacact

SEQ ID NO: 738398 - DNA, 20 bp, Artificial
  CRISPR gRNA sequence
cctcacttccctaaatgggc

SEQ ID NO: 738399 - DNA, 20 bp, Artificial
  CRISPR gRNA sequence
acttccctaaatgggcagct

SEQ ID NO: 738400 - DNA, 20 bp, Artificial
  CRISPR gRNA sequence
ccctaaatgggcagcttcac

SEQ ID NO: 738401 - DNA, 20 bp, Artificial
  CRISPR gRNA sequence
cctaaatgggcagcttcact

SEQ ID NO: 738402 - DNA, 20 bp, Artificial
  CRISPR gRNA sequence
aatgggcagcttcactttta

SEQ ID NO: 738403 - DNA, 20 bp, Artificial
  CRISPR gRNA sequence
cacttttagaaccccgggtc

SEQ ID NO: 738404 - DNA, 20 bp, Artificial
  CRISPR gRNA sequence
acttttagaaccccgggtcc

SEQ ID NO: 738405 - DNA, 20 bp, Artificial
  CRISPR gRNA sequence
ttagaaccccgggtccttcc

SEQ ID NO: 738406 - DNA, 20 bp, Artificial
  CRISPR gRNA sequence
tagaaccccgggtccttccc

SEQ ID NO: 738407 - DNA, 20 bp, Artificial
  CRISPR gRNA sequence
agaaccccgggtccttccct

SEQ ID NO: 738408 - DNA, 20 bp, Artificial
  CRISPR gRNA sequence
gaaccccgggtccttccctg

SEQ ID NO: 738409 - DNA, 20 bp, Artificial
  CRISPR gRNA sequence
ccctggcaggcccaggtggc

SEQ ID NO: 738410 - DNA, 20 bp, Artificial
  CRISPR gRNA sequence
cctggcaggcccaggtggca

SEQ ID NO: 738411 - DNA, 20 bp, Artificial
  CRISPR gRNA sequence
gcaggcccaggtggcacatc

SEQ ID NO: 738412 - DNA, 20 bp, Artificial
  CRISPR gRNA sequence
tgtcgggtgggccctcacct

SEQ ID NO: 738413 - DNA, 20 bp, Artificial
  CRISPR gRNA sequence
accttggatctccaggcctg

SEQ ID NO: 738414 - DNA, 20 bp, Artificial
  CRISPR gRNA sequence
ggatctccaggcctgacact

SEQ ID NO: 738415 - DNA, 20 bp, Artificial
  CRISPR gRNA sequence
gatctccaggcctgacactg

SEQ ID NO: 738416 - DNA, 20 bp, Artificial
  CRISPR gRNA sequence
caggcctgacactgcccagc

SEQ ID NO: 738417 - DNA, 20 bp, Artificial
  CRISPR gRNA sequence
acactgcccagctggatgga

SEQ ID NO: 738418 - DNA, 20 bp, Artificial
  CRISPR gRNA sequence
cccagctggatggaaccatg

SEQ ID NO: 738419 - DNA, 20 bp, Artificial
  CRISPR gRNA sequence
gatggaaccatggccccagc

SEQ ID NO: 738420 - DNA, 20 bp, Artificial
  CRISPR gRNA sequence
cctgctgctgctgctgctgt

SEQ ID NO: 738421 - DNA, 20 bp, Artificial
  CRISPR gRNA sequence
ctgctgctgctgctgctgtg

SEQ ID NO: 738422 - DNA, 20 bp, Artificial
  CRISPR gRNA sequence
ctgctgctgctgctgtggcc

SEQ ID NO: 738423 - DNA, 20 bp, Artificial
  CRISPR gRNA sequence
ctgctgctgctgtggccaca

SEQ ID NO: 738424 - DNA, 20 bp, Artificial
  CRISPR gRNA sequence
ctgctgctgtggccacaggg

SEQ ID NO: 738425 - DNA, 20 bp, Artificial
  CRISPR gRNA sequence
ctgctgtggccacagggttg

SEQ ID NO: 738426 - DNA, 20 bp, Artificial
  CRISPR gRNA sequence
ctgtggccacagggttgcgt

SEQ ID NO: 738427 - DNA, 20 bp, Artificial
  CRISPR gRNA sequence
tggccacagggttgcgtctc

SEQ ID NO: 738428 - DNA, 20 bp, Artificial
  CRISPR gRNA sequence
cgtctcaggtgaggggagaa

SEQ ID NO: 738429 - DNA, 20 bp, Artificial
  CRISPR gRNA sequence
aggtgaggggagaaggggct

SEQ ID NO: 738430 - DNA, 20 bp, Artificial
  CRISPR gRNA sequence
acttgtggaggagggagtgg

SEQ ID NO: 738431 - DNA, 20 bp, Artificial
  CRISPR gRNA sequence
gtggaggagggagtgggtac

SEQ ID NO: 738432 - DNA, 20 bp, Artificial
  CRISPR gRNA sequence
tggaggagggagtgggtaca

SEQ ID NO: 738433 - DNA, 20 bp, Artificial
  CRISPR gRNA sequence
agggcctttttcttaccctc

SEQ ID NO: 738434 - DNA, 20 bp, Artificial
  CRISPR gRNA sequence
tttcttaccctccttaccag

SEQ ID NO: 738435 - DNA, 20 bp, Artificial
  CRISPR gRNA sequence
ttcttaccctccttaccagc

SEQ ID NO: 738436 - DNA, 20 bp, Artificial
  CRISPR gRNA sequence
tcttaccctccttaccagca

SEQ ID NO: 738437 - DNA, 20 bp, Artificial
  CRISPR gRNA sequence
cttaccctccttaccagcag

SEQ ID NO: 738438 - DNA, 20 bp, Artificial
  CRISPR gRNA sequence
ttaccctccttaccagcagt

SEQ ID NO: 738439 - DNA, 20 bp, Artificial
  CRISPR gRNA sequence
accctccttaccagcagttt

SEQ ID NO: 738440 - DNA, 20 bp, Artificial
  CRISPR gRNA sequence
ccctccttaccagcagtttt

SEQ ID NO: 738441 - DNA, 20 bp, Artificial
  CRISPR gRNA sequence
cttaccagcagttttcttgt

SEQ ID NO: 738442 - DNA, 20 bp, Artificial
  CRISPR gRNA sequence
accagcagttttcttgttta

SEQ ID NO: 738443 - DNA, 20 bp, Artificial
  CRISPR gRNA sequence
ccagcagttttcttgtttag

SEQ ID NO: 738444 - DNA, 20 bp, Artificial
  CRISPR gRNA sequence
tcttgtttagtgttttgtgg

SEQ ID NO: 738445 - DNA, 20 bp, Artificial
  CRISPR gRNA sequence
cttgtttagtgttttgtggg

SEQ ID NO: 738446 - DNA, 20 bp, Artificial
  CRISPR gRNA sequence
ttgtttagtgttttgtgggt

SEQ ID NO: 738447 - DNA, 20 bp, Artificial
  CRISPR gRNA sequence
gtttagtgttttgtgggttg

SEQ ID NO: 738448 - DNA, 20 bp, Artificial
  CRISPR gRNA sequence
tttagtgttttgtgggttgg

SEQ ID NO: 738449 - DNA, 20 bp, Artificial
  CRISPR gRNA sequence
agtgttttgtgggttgggga

SEQ ID NO: 738450 - DNA, 20 bp, Artificial
  CRISPR gRNA sequence
gtgttttgtgggttggggaa

SEQ ID NO: 738451 - DNA, 20 bp, Artificial
  CRISPR gRNA sequence
tgtgggttggggaaggagga

SEQ ID NO: 738452 - DNA, 20 bp, Artificial
  CRISPR gRNA sequence
gtgggttggggaaggaggag

SEQ ID NO: 738453 - DNA, 20 bp, Artificial
  CRISPR gRNA sequence
tgggttggggaaggaggaga

SEQ ID NO: 738454 - DNA, 20 bp, Artificial
  CRISPR gRNA sequence
gggaaggaggagattagggc

SEQ ID NO: 738455 - DNA, 20 bp, Artificial
  CRISPR gRNA sequence
gggctgacttagctctttac

SEQ ID NO: 738456 - DNA, 20 bp, Artificial
  CRISPR gRNA sequence
acttagctctttaccctaat

SEQ ID NO: 738457 - DNA, 20 bp, Artificial
  CRISPR gRNA sequence
agctctttaccctaatatca

SEQ ID NO: 738458 - DNA, 20 bp, Artificial
  CRISPR gRNA sequence
gctctttaccctaatatcag

SEQ ID NO: 738459 - DNA, 20 bp, Artificial
  CRISPR gRNA sequence
tttaccctaatatcaggccc

SEQ ID NO: 738460 - DNA, 20 bp, Artificial
  CRISPR gRNA sequence
taccctaatatcaggcccca

SEQ ID NO: 738461 - DNA, 20 bp, Artificial
  CRISPR gRNA sequence
accctaatatcaggccccag

SEQ ID NO: 738462 - DNA, 20 bp, Artificial
  CRISPR gRNA sequence
ccctaatatcaggccccagg

SEQ ID NO: 738463 - DNA, 20 bp, Artificial
  CRISPR gRNA sequence
atatcaggccccaggcgaag

SEQ ID NO: 738464 - DNA, 20 bp, Artificial
  CRISPR gRNA sequence
acccaggcctcccaagccaa

SEQ ID NO: 738465 - DNA, 20 bp, Artificial
  CRISPR gRNA sequence
ccaagccaagataaagctct

SEQ ID NO: 738466 - DNA, 20 bp, Artificial
  CRISPR gRNA sequence
tggaccctctctgcattggc

SEQ ID NO: 738467 - DNA, 20 bp, Artificial
  CRISPR gRNA sequence
gaccctctctgcattggctc

SEQ ID NO: 738468 - DNA, 20 bp, Artificial
  CRISPR gRNA sequence
tctgcattggctcctttatc

SEQ ID NO: 738469 - DNA, 20 bp, Artificial
  CRISPR gRNA sequence
tgcattggctcctttatctg

SEQ ID NO: 738470 - DNA, 20 bp, Artificial
  CRISPR gRNA sequence
cattggctcctttatctgct

SEQ ID NO: 738471 - DNA, 20 bp, Artificial
  CRISPR gRNA sequence
gctcctttatctgctaggct

SEQ ID NO: 738472 - DNA, 20 bp, Artificial
  CRISPR gRNA sequence
ctttatctgctaggcttcct

SEQ ID NO: 738473 - DNA, 20 bp, Artificial
  CRISPR gRNA sequence
tatctgctaggcttcctcag

SEQ ID NO: 738474 - DNA, 20 bp, Artificial
  CRISPR gRNA sequence
atctgctaggcttcctcagg

SEQ ID NO: 738475 - DNA, 20 bp, Artificial
  CRISPR gRNA sequence
tctgctaggcttcctcaggc

SEQ ID NO: 738476 - DNA, 20 bp, Artificial
  CRISPR gRNA sequence
ctaggcttcctcaggcttta

SEQ ID NO: 738477 - DNA, 20 bp, Artificial
  CRISPR gRNA sequence
ggcttcctcaggctttaaag

SEQ ID NO: 738478 - DNA, 20 bp, Artificial
  CRISPR gRNA sequence
cctcaggctttaaagcagag

SEQ ID NO: 738479 - DNA, 20 bp, Artificial
  CRISPR gRNA sequence
ctcaggctttaaagcagagc

SEQ ID NO: 738480 - DNA, 20 bp, Artificial
  CRISPR gRNA sequence
aggctttaaagcagagccct

SEQ ID NO: 738481 - DNA, 20 bp, Artificial
  CRISPR gRNA sequence
taaagcagagccctcaattt

SEQ ID NO: 738482 - DNA, 20 bp, Artificial
  CRISPR gRNA sequence
aaagcagagccctcaatttc

SEQ ID NO: 738483 - DNA, 20 bp, Artificial
  CRISPR gRNA sequence
aagcagagccctcaatttcc

SEQ ID NO: 738484 - DNA, 20 bp, Artificial
  CRISPR gRNA sequence
aatttcctcacacaaatagc

SEQ ID NO: 738485 - DNA, 20 bp, Artificial
  CRISPR gRNA sequence
cctcacacaaatagctttct

SEQ ID NO: 738486 - DNA, 20 bp, Artificial
  CRISPR gRNA sequence
ctcacacaaatagctttctc

SEQ ID NO: 738487 - DNA, 20 bp, Artificial
  CRISPR gRNA sequence
acacaaatagctttctctgc

SEQ ID NO: 738488 - DNA, 20 bp, Artificial
  CRISPR gRNA sequence
tctctgcttggcctctgtca

SEQ ID NO: 738489 - DNA, 20 bp, Artificial
  CRISPR gRNA sequence
ctctgcttggcctctgtcag

SEQ ID NO: 738490 - DNA, 20 bp, Artificial
  CRISPR gRNA sequence
tctgcttggcctctgtcagg

SEQ ID NO: 738491 - DNA, 20 bp, Artificial
  CRISPR gRNA sequence
tgcttggcctctgtcaggaa

SEQ ID NO: 738492 - DNA, 20 bp, Artificial
  CRISPR gRNA sequence
cttggcctctgtcaggaagc

SEQ ID NO: 738493 - DNA, 20 bp, Artificial
  CRISPR gRNA sequence
ggcctctgtcaggaagccct

SEQ ID NO: 738494 - DNA, 20 bp, Artificial
  CRISPR gRNA sequence
gcctctgtcaggaagccctg

SEQ ID NO: 738495 - DNA, 20 bp, Artificial
  CRISPR gRNA sequence
tgtcaggaagccctgcttag

SEQ ID NO: 738496 - DNA, 20 bp, Artificial
  CRISPR gRNA sequence
tcaggaagccctgcttagtt

SEQ ID NO: 738497 - DNA, 20 bp, Artificial
  CRISPR gRNA sequence
cttagttatgacagcaatca

SEQ ID NO: 738498 - DNA, 20 bp, Artificial
  CRISPR gRNA sequence
agttatgacagcaatcattg

SEQ ID NO: 738499 - DNA, 20 bp, Artificial
  CRISPR gRNA sequence
gttatgacagcaatcattgc

SEQ ID NO: 738500 - DNA, 20 bp, Artificial
  CRISPR gRNA sequence
tgacagcaatcattgcatca

SEQ ID NO: 738501 - DNA, 20 bp, Artificial
  CRISPR gRNA sequence
catcatgtgtgttttgaact

SEQ ID NO: 738502 - DNA, 20 bp, Artificial
  CRISPR gRNA sequence
tgaactgaatttgaacattt

SEQ ID NO: 738503 - DNA, 20 bp, Artificial
  CRISPR gRNA sequence
gaactgaatttgaacatttt

SEQ ID NO: 738504 - DNA, 20 bp, Artificial
  CRISPR gRNA sequence
aactgaatttgaacattttt

SEQ ID NO: 738505 - DNA, 20 bp, Artificial
  CRISPR gRNA sequence
aatttgaacatttttcttga

SEQ ID NO: 738506 - DNA, 20 bp, Artificial
  CRISPR gRNA sequence
gaacatttttcttgaaatgc

SEQ ID NO: 738507 - DNA, 20 bp, Artificial
  CRISPR gRNA sequence
aacatttttcttgaaatgct

SEQ ID NO: 738508 - DNA, 20 bp, Artificial
  CRISPR gRNA sequence
ttcttgaaatgctgatgcca

SEQ ID NO: 738509 - DNA, 20 bp, Artificial
  CRISPR gRNA sequence
tcttgaaatgctgatgccac

SEQ ID NO: 738510 - DNA, 20 bp, Artificial
  CRISPR gRNA sequence
cttgaaatgctgatgccaca

SEQ ID NO: 738511 - DNA, 20 bp, Artificial
  CRISPR gRNA sequence
ttgaaatgctgatgccacat

SEQ ID NO: 738512 - DNA, 20 bp, Artificial
  CRISPR gRNA sequence
gaaatgctgatgccacatcc

SEQ ID NO: 738513 - DNA, 20 bp, Artificial
  CRISPR gRNA sequence
aaatgctgatgccacatcct

SEQ ID NO: 738514 - DNA, 20 bp, Artificial
  CRISPR gRNA sequence
atgccacatcctgtccctgc

SEQ ID NO: 738515 - DNA, 20 bp, Artificial
  CRISPR gRNA sequence
tccctgcctctgtcctgaag

SEQ ID NO: 738516 - DNA, 20 bp, Artificial
  CRISPR gRNA sequence
cctctgtcctgaagggacca

SEQ ID NO: 738517 - DNA, 20 bp, Artificial
  CRISPR gRNA sequence
tgtcctgaagggaccagtgt

SEQ ID NO: 738518 - DNA, 20 bp, Artificial
  CRISPR gRNA sequence
tcctgaagggaccagtgtgt

SEQ ID NO: 738519 - DNA, 20 bp, Artificial
  CRISPR gRNA sequence
aagggaccagtgtgtgaatg

SEQ ID NO: 738520 - DNA, 20 bp, Artificial
  CRISPR gRNA sequence
tcccacctcacagataccaa

SEQ ID NO: 738521 - DNA, 20 bp, Artificial
  CRISPR gRNA sequence
cccacctcacagataccaat

SEQ ID NO: 738522 - DNA, 20 bp, Artificial
  CRISPR gRNA sequence
ccacctcacagataccaatg

SEQ ID NO: 738523 - DNA, 20 bp, Artificial
  CRISPR gRNA sequence
acagataccaatgctccttg

SEQ ID NO: 738524 - DNA, 20 bp, Artificial
  CRISPR gRNA sequence
cttgaggaacctcacccatt

SEQ ID NO: 738525 - DNA, 20 bp, Artificial
  CRISPR gRNA sequence
gaggaacctcacccattcct

SEQ ID NO: 738526 - DNA, 20 bp, Artificial
  CRISPR gRNA sequence
aggaacctcacccattcctg

SEQ ID NO: 738527 - DNA, 20 bp, Artificial
  CRISPR gRNA sequence
acccattcctgcccctctcg

SEQ ID NO: 738528 - DNA, 20 bp, Artificial
  CRISPR gRNA sequence
ctgcccctctcgctgccatg

SEQ ID NO: 738529 - DNA, 20 bp, Artificial
  CRISPR gRNA sequence
cccctctcgctgccatggca

SEQ ID NO: 738530 - DNA, 20 bp, Artificial
  CRISPR gRNA sequence
tcgctgccatggcaaccaag

SEQ ID NO: 738531 - DNA, 20 bp, Artificial
  CRISPR gRNA sequence
gctgccatggcaaccaagtt

SEQ ID NO: 738532 - DNA, 20 bp, Artificial
  CRISPR gRNA sequence
ccatggcaaccaagttacca

SEQ ID NO: 738533 - DNA, 20 bp, Artificial
  CRISPR gRNA sequence
ccacttcctgttcagttctg

SEQ ID NO: 738534 - DNA, 20 bp, Artificial
  CRISPR gRNA sequence
cctgttcagttctgggcatg

SEQ ID NO: 738535 - DNA, 20 bp, Artificial
  CRISPR gRNA sequence
ctgttcagttctgggcatgg

SEQ ID NO: 738536 - DNA, 20 bp, Artificial
  CRISPR gRNA sequence
ttcagttctgggcatggtgg

SEQ ID NO: 738537 - DNA, 20 bp, Artificial
  CRISPR gRNA sequence
agttctgggcatggtggggg

SEQ ID NO: 738538 - DNA, 20 bp, Artificial
  CRISPR gRNA sequence
tgggcatggtgggggttggc

SEQ ID NO: 738539 - DNA, 20 bp, Artificial
  CRISPR gRNA sequence
ggcatggtgggggttggcaa

SEQ ID NO: 738540 - DNA, 20 bp, Artificial
  CRISPR gRNA sequence
gcaaaactcaccactgcctg

SEQ ID NO: 738541 - DNA, 20 bp, Artificial
  CRISPR gRNA sequence
accactgcctgtgagagggg

SEQ ID NO: 738542 - DNA, 20 bp, Artificial
  CRISPR gRNA sequence
cctgtgagaggggtgggagg

SEQ ID NO: 738543 - DNA, 20 bp, Artificial
  CRISPR gRNA sequence
tgagaggggtgggaggtgta

SEQ ID NO: 738544 - DNA, 20 bp, Artificial
  CRISPR gRNA sequence
ccctggagacccatcccaag

SEQ ID NO: 738545 - DNA, 20 bp, Artificial
  CRISPR gRNA sequence
gagacccatcccaaggtcac

SEQ ID NO: 738546 - DNA, 20 bp, Artificial
  CRISPR gRNA sequence
tgcacctcccagagggtaga

SEQ ID NO: 738547 - DNA, 20 bp, Artificial
  CRISPR gRNA sequence
cacctcccagagggtagaga

SEQ ID NO: 738548 - DNA, 20 bp, Artificial
  CRISPR gRNA sequence
ccagagggtagagaaacagc

SEQ ID NO: 738549 - DNA, 20 bp, Artificial
  CRISPR gRNA sequence
cccactgccagggcagaaag

SEQ ID NO: 738550 - DNA, 20 bp, Artificial
  CRISPR gRNA sequence
ccactgccagggcagaaagg

SEQ ID NO: 738551 - DNA, 20 bp, Artificial
  CRISPR gRNA sequence
ccagggcagaaaggggtctc

SEQ ID NO: 738552 - DNA, 20 bp, Artificial
  CRISPR gRNA sequence
tcttgtgctaagaaatcctg

SEQ ID NO: 738553 - DNA, 20 bp, Artificial
  CRISPR gRNA sequence
ttgtgctaagaaatcctggg

SEQ ID NO: 738554 - DNA, 20 bp, Artificial
  CRISPR gRNA sequence
gtgctaagaaatcctgggct

SEQ ID NO: 738555 - DNA, 20 bp, Artificial
  CRISPR gRNA sequence
tgctaagaaatcctgggctc

SEQ ID NO: 738556 - DNA, 20 bp, Artificial
  CRISPR gRNA sequence
agaaatcctgggctcatcca

SEQ ID NO: 738557 - DNA, 20 bp, Artificial
  CRISPR gRNA sequence
ggctcatccaccaaataatg

SEQ ID NO: 738558 - DNA, 20 bp, Artificial
  CRISPR gRNA sequence
atccaccaaataatgaagtt

SEQ ID NO: 738559 - DNA, 20 bp, Artificial
  CRISPR gRNA sequence
gatcattctgtttagtttgc

SEQ ID NO: 738560 - DNA, 20 bp, Artificial
  CRISPR gRNA sequence
tgtttagtttgcaagggaca

SEQ ID NO: 738561 - DNA, 20 bp, Artificial
  CRISPR gRNA sequence
tttagtttgcaagggacaga

SEQ ID NO: 738562 - DNA, 20 bp, Artificial
  CRISPR gRNA sequence
agtttgcaagggacagaggg

SEQ ID NO: 738563 - DNA, 20 bp, Artificial
  CRISPR gRNA sequence
gtttgcaagggacagaggga

SEQ ID NO: 738564 - DNA, 20 bp, Artificial
  CRISPR gRNA sequence
gcaagggacagagggatgct

SEQ ID NO: 738565 - DNA, 20 bp, Artificial
  CRISPR gRNA sequence
caagggacagagggatgctt

SEQ ID NO: 738566 - DNA, 20 bp, Artificial
  CRISPR gRNA sequence
agagagggtgctgcttcaca

SEQ ID NO: 738567 - DNA, 20 bp, Artificial
  CRISPR gRNA sequence
gagagggtgctgcttcacac

SEQ ID NO: 738568 - DNA, 20 bp, Artificial
  CRISPR gRNA sequence
cttcacacagagcctcagct

SEQ ID NO: 738569 - DNA, 20 bp, Artificial
  CRISPR gRNA sequence
cacacagagcctcagctcta

SEQ ID NO: 738570 - DNA, 20 bp, Artificial
  CRISPR gRNA sequence
acacagagcctcagctctag

SEQ ID NO: 738571 - DNA, 20 bp, Artificial
  CRISPR gRNA sequence
agctctagtggctgctggct

SEQ ID NO: 738572 - DNA, 20 bp, Artificial
  CRISPR gRNA sequence
tagtggctgctggctgggac

SEQ ID NO: 738573 - DNA, 20 bp, Artificial
  CRISPR gRNA sequence
gtggctgctggctgggactt

SEQ ID NO: 738574 - DNA, 20 bp, Artificial
  CRISPR gRNA sequence
ctggctgggacttgggacgg

SEQ ID NO: 738575 - DNA, 20 bp, Artificial
  CRISPR gRNA sequence
gctgggacttgggacggata

SEQ ID NO: 738576 - DNA, 20 bp, Artificial
  CRISPR gRNA sequence
ggacttgggacggatatcct

SEQ ID NO: 738577 - DNA, 20 bp, Artificial
  CRISPR gRNA sequence
gggacggatatcctggattc

SEQ ID NO: 738578 - DNA, 20 bp, Artificial
  CRISPR gRNA sequence
ggacggatatcctggattct

SEQ ID NO: 738579 - DNA, 20 bp, Artificial
  CRISPR gRNA sequence
gattctggtgggacagatgt

SEQ ID NO: 738580 - DNA, 20 bp, Artificial
  CRISPR gRNA sequence
tggtgggacagatgtcctgg

SEQ ID NO: 738581 - DNA, 20 bp, Artificial
  CRISPR gRNA sequence
gtgggacagatgtcctggat

SEQ ID NO: 738582 - DNA, 20 bp, Artificial
  CRISPR gRNA sequence
gattctgggcccttgactgt

SEQ ID NO: 738583 - DNA, 20 bp, Artificial
  CRISPR gRNA sequence
tgggcccttgactgtcacag

SEQ ID NO: 738584 - DNA, 20 bp, Artificial
  CRISPR gRNA sequence
ggcccttgactgtcacagct

SEQ ID NO: 738585 - DNA, 20 bp, Artificial
  CRISPR gRNA sequence
gactgtcacagctctgggtt

SEQ ID NO: 738586 - DNA, 20 bp, Artificial
  CRISPR gRNA sequence
actgtcacagctctgggttc

SEQ ID NO: 738587 - DNA, 20 bp, Artificial
  CRISPR gRNA sequence
tcacagctctgggttccatt

SEQ ID NO: 738588 - DNA, 20 bp, Artificial
  CRISPR gRNA sequence
tgggttccattgggggaact

SEQ ID NO: 738589 - DNA, 20 bp, Artificial
  CRISPR gRNA sequence
ggttccattgggggaactgg

SEQ ID NO: 738590 - DNA, 20 bp, Artificial
  CRISPR gRNA sequence
cattgggggaactgggaggc

SEQ ID NO: 738591 - DNA, 20 bp, Artificial
  CRISPR gRNA sequence
ggggaactgggaggccccag

SEQ ID NO: 738592 - DNA, 20 bp, Artificial
  CRISPR gRNA sequence
ggaggccccagcatgtggga

SEQ ID NO: 738593 - DNA, 20 bp, Artificial
  CRISPR gRNA sequence
agcatgcactgtgtgcaaag

SEQ ID NO: 738594 - DNA, 20 bp, Artificial
  CRISPR gRNA sequence
tgtgcaaagcactgacctgg

SEQ ID NO: 738595 - DNA, 20 bp, Artificial
  CRISPR gRNA sequence
acctggggcagaattctcac

SEQ ID NO: 738596 - DNA, 20 bp, Artificial
  CRISPR gRNA sequence
gggcagaattctcacagcaa

SEQ ID NO: 738597 - DNA, 20 bp, Artificial
  CRISPR gRNA sequence
tcacagcaacctgtgagggg

SEQ ID NO: 738598 - DNA, 20 bp, Artificial
  CRISPR gRNA sequence
acagcaacctgtgaggggtg

SEQ ID NO: 738599 - DNA, 20 bp, Artificial
  CRISPR gRNA sequence
tgaggggtgtggtgctattc

SEQ ID NO: 738600 - DNA, 20 bp, Artificial
  CRISPR gRNA sequence
ttctcacttgactgataaag

SEQ ID NO: 738601 - DNA, 20 bp, Artificial
  CRISPR gRNA sequence
tcacttgactgataaagaaa

SEQ ID NO: 738602 - DNA, 20 bp, Artificial
  CRISPR gRNA sequence
acttgactgataaagaaaca

SEQ ID NO: 738603 - DNA, 20 bp, Artificial
  CRISPR gRNA sequence
gactgataaagaaacagaga

SEQ ID NO: 738604 - DNA, 20 bp, Artificial
  CRISPR gRNA sequence
actgataaagaaacagagat

SEQ ID NO: 738605 - DNA, 20 bp, Artificial
  CRISPR gRNA sequence
ataaagaaacagagatattt

SEQ ID NO: 738606 - DNA, 20 bp, Artificial
  CRISPR gRNA sequence
ctgtatcagtcaagtgtctg

SEQ ID NO: 738607 - DNA, 20 bp, Artificial
  CRISPR gRNA sequence
tgtatcagtcaagtgtctgt

SEQ ID NO: 738608 - DNA, 20 bp, Artificial
  CRISPR gRNA sequence
tatcagtcaagtgtctgttt

SEQ ID NO: 738609 - DNA, 20 bp, Artificial
  CRISPR gRNA sequence
ttttgatatttctgtatcaa

SEQ ID NO: 738610 - DNA, 20 bp, Artificial
  CRISPR gRNA sequence
tgatatttctgtatcaaaca

SEQ ID NO: 738611 - DNA, 20 bp, Artificial
  CRISPR gRNA sequence
gatatttctgtatcaaacag

SEQ ID NO: 738612 - DNA, 20 bp, Artificial
  CRISPR gRNA sequence
atatttctgtatcaaacagg

SEQ ID NO: 738613 - DNA, 20 bp, Artificial
  CRISPR gRNA sequence
ctgtatcaaacaggtgacct

SEQ ID NO: 738614 - DNA, 20 bp, Artificial
  CRISPR gRNA sequence
tgtatcaaacaggtgaccta

SEQ ID NO: 738615 - DNA, 20 bp, Artificial
  CRISPR gRNA sequence
tatcaaacaggtgacctaat

SEQ ID NO: 738616 - DNA, 20 bp, Artificial
  CRISPR gRNA sequence
atcacaccactaagtggtag

SEQ ID NO: 738617 - DNA, 20 bp, Artificial
  CRISPR gRNA sequence
agtggtagaaacagggtttc

SEQ ID NO: 738618 - DNA, 20 bp, Artificial
  CRISPR gRNA sequence
caacccttgtttattttgac

SEQ ID NO: 738619 - DNA, 20 bp, Artificial
  CRISPR gRNA sequence
aacccttgtttattttgact

SEQ ID NO: 738620 - DNA, 20 bp, Artificial
  CRISPR gRNA sequence
gtttattttgactccaaaat

SEQ ID NO: 738621 - DNA, 20 bp, Artificial
  CRISPR gRNA sequence
tttattttgactccaaaatg

SEQ ID NO: 738622 - DNA, 20 bp, Artificial
  CRISPR gRNA sequence
attttgactccaaaatgtgt

SEQ ID NO: 738623 - DNA, 20 bp, Artificial
  CRISPR gRNA sequence
ttttgactccaaaatgtgtg

SEQ ID NO: 738624 - DNA, 20 bp, Artificial
  CRISPR gRNA sequence
tgactccaaaatgtgtgctc

SEQ ID NO: 738625 - DNA, 20 bp, Artificial
  CRISPR gRNA sequence
gactccaaaatgtgtgctct

SEQ ID NO: 738626 - DNA, 20 bp, Artificial
  CRISPR gRNA sequence
actccaaaatgtgtgctctc

SEQ ID NO: 738627 - DNA, 20 bp, Artificial
  CRISPR gRNA sequence
caaaatgtgtgctctctgtt

SEQ ID NO: 738628 - DNA, 20 bp, Artificial
  CRISPR gRNA sequence
tctgttctctactatggggg

SEQ ID NO: 738629 - DNA, 20 bp, Artificial
  CRISPR gRNA sequence
tgttctctactatgggggag

SEQ ID NO: 738630 - DNA, 20 bp, Artificial
  CRISPR gRNA sequence
ttctctactatgggggagag

SEQ ID NO: 738631 - DNA, 20 bp, Artificial
  CRISPR gRNA sequence
tctactatgggggagagtct

SEQ ID NO: 738632 - DNA, 20 bp, Artificial
  CRISPR gRNA sequence
tactatgggggagagtcttt

SEQ ID NO: 738633 - DNA, 20 bp, Artificial
  CRISPR gRNA sequence
ctatgggggagagtcttttt

SEQ ID NO: 738634 - DNA, 20 bp, Artificial
  CRISPR gRNA sequence
tgggggagagtctttttata

SEQ ID NO: 738635 - DNA, 20 bp, Artificial
  CRISPR gRNA sequence
tttatatgtggtttttttgg

SEQ ID NO: 738636 - DNA, 20 bp, Artificial
  CRISPR gRNA sequence
ttatatgtggtttttttgga

SEQ ID NO: 738637 - DNA, 20 bp, Artificial
  CRISPR gRNA sequence
tatatgtggtttttttggaa

SEQ ID NO: 738638 - DNA, 20 bp, Artificial
  CRISPR gRNA sequence
atatgtggtttttttggaag

SEQ ID NO: 738639 - DNA, 20 bp, Artificial
  CRISPR gRNA sequence
tatgtggtttttttggaaga

SEQ ID NO: 738640 - DNA, 20 bp, Artificial
  CRISPR gRNA sequence
ttttggaagactctggggtg

SEQ ID NO: 738641 - DNA, 20 bp, Artificial
  CRISPR gRNA sequence
tttggaagactctggggtga

SEQ ID NO: 738642 - DNA, 20 bp, Artificial
  CRISPR gRNA sequence
ttggaagactctggggtgaa

SEQ ID NO: 738643 - DNA, 20 bp, Artificial
  CRISPR gRNA sequence
tggaagactctggggtgaaa

SEQ ID NO: 738644 - DNA, 20 bp, Artificial
  CRISPR gRNA sequence
ggaagactctggggtgaaat

SEQ ID NO: 738645 - DNA, 20 bp, Artificial
  CRISPR gRNA sequence
gaagactctggggtgaaatt

SEQ ID NO: 738646 - DNA, 20 bp, Artificial
  CRISPR gRNA sequence
tggggtgaaattatcagaag

SEQ ID NO: 738647 - DNA, 20 bp, Artificial
  CRISPR gRNA sequence
gggtgaaattatcagaagag

SEQ ID NO: 738648 - DNA, 20 bp, Artificial
  CRISPR gRNA sequence
tcagaagagtcagctgagct

SEQ ID NO: 738649 - DNA, 20 bp, Artificial
  CRISPR gRNA sequence
agcttaaggcaggcagaggg

SEQ ID NO: 738650 - DNA, 20 bp, Artificial
  CRISPR gRNA sequence
aaggcaggcagaggggtgga

SEQ ID NO: 738651 - DNA, 20 bp, Artificial
  CRISPR gRNA sequence
aggcaggcagaggggtggag

SEQ ID NO: 738652 - DNA, 20 bp, Artificial
  CRISPR gRNA sequence
tctccctctctctgtcccct

SEQ ID NO: 738653 - DNA, 20 bp, Artificial
  CRISPR gRNA sequence
ctccctctctctgtcccctg

SEQ ID NO: 738654 - DNA, 20 bp, Artificial
  CRISPR gRNA sequence
tccctctctctgtcccctga

SEQ ID NO: 738655 - DNA, 20 bp, Artificial
  CRISPR gRNA sequence
cctctctctgtcccctgagt

SEQ ID NO: 738656 - DNA, 20 bp, Artificial
  CRISPR gRNA sequence
tctctgtcccctgagtcacc

SEQ ID NO: 738657 - DNA, 20 bp, Artificial
  CRISPR gRNA sequence
tctgtcccctgagtcaccct

SEQ ID NO: 738658 - DNA, 20 bp, Artificial
  CRISPR gRNA sequence
tgtcccctgagtcaccctgc

SEQ ID NO: 738659 - DNA, 20 bp, Artificial
  CRISPR gRNA sequence
tcccctgagtcaccctgcac

SEQ ID NO: 738660 - DNA, 20 bp, Artificial
  CRISPR gRNA sequence
agtcaccctgcacaccccag

SEQ ID NO: 738661 - DNA, 20 bp, Artificial
  CRISPR gRNA sequence
cacaccccagttctgctctg

SEQ ID NO: 738662 - DNA, 20 bp, Artificial
  CRISPR gRNA sequence
tgctctgtctctaccagact

SEQ ID NO: 738663 - DNA, 20 bp, Artificial
  CRISPR gRNA sequence
ctctgtctctaccagactgt

SEQ ID NO: 738664 - DNA, 20 bp, Artificial
  CRISPR gRNA sequence
tgtctctaccagactgtgga

SEQ ID NO: 738665 - DNA, 20 bp, Artificial
  CRISPR gRNA sequence
tctctaccagactgtggatt

SEQ ID NO: 738666 - DNA, 20 bp, Artificial
  CRISPR gRNA sequence
taccagactgtggattatga

SEQ ID NO: 738667 - DNA, 20 bp, Artificial
  CRISPR gRNA sequence
ccagactgtggattatgaag

SEQ ID NO: 738668 - DNA, 20 bp, Artificial
  CRISPR gRNA sequence
tggattatgaaggcttggac

SEQ ID NO: 738669 - DNA, 20 bp, Artificial
  CRISPR gRNA sequence
tgaaggcttggaccacatct

SEQ ID NO: 738670 - DNA, 20 bp, Artificial
  CRISPR gRNA sequence
ggaccacatcttactcctca

SEQ ID NO: 738671 - DNA, 20 bp, Artificial
  CRISPR gRNA sequence
gaccacatcttactcctcag

SEQ ID NO: 738672 - DNA, 20 bp, Artificial
  CRISPR gRNA sequence
actcctcagcatagagagaa

SEQ ID NO: 738673 - DNA, 20 bp, Artificial
  CRISPR gRNA sequence
ctcctcagcatagagagaaa

SEQ ID NO: 738674 - DNA, 20 bp, Artificial
  CRISPR gRNA sequence
ctcagcatagagagaaagat

SEQ ID NO: 738675 - DNA, 20 bp, Artificial
  CRISPR gRNA sequence
agcatagagagaaagatatt

SEQ ID NO: 738676 - DNA, 20 bp, Artificial
  CRISPR gRNA sequence
caggtggaaagtgaataatt

SEQ ID NO: 738677 - DNA, 20 bp, Artificial
  CRISPR gRNA sequence
tagaatcctgtggttcacac

SEQ ID NO: 738678 - DNA, 20 bp, Artificial
  CRISPR gRNA sequence
tggttcacactccattggga

SEQ ID NO: 738679 - DNA, 20 bp, Artificial
  CRISPR gRNA sequence
acactccattgggagtttgt

SEQ ID NO: 738680 - DNA, 20 bp, Artificial
  CRISPR gRNA sequence
cattgggagtttgtttacat

SEQ ID NO: 738681 - DNA, 20 bp, Artificial
  CRISPR gRNA sequence
ggagtttgtttacatgtata

SEQ ID NO: 738682 - DNA, 20 bp, Artificial
  CRISPR gRNA sequence
gtttacatgtatatttagac

SEQ ID NO: 738683 - DNA, 20 bp, Artificial
  CRISPR gRNA sequence
tttacatgtatatttagaca

SEQ ID NO: 738684 - DNA, 20 bp, Artificial
  CRISPR gRNA sequence
acatgtatatttagacaggc

SEQ ID NO: 738685 - DNA, 20 bp, Artificial
  CRISPR gRNA sequence
catgtatatttagacaggct

SEQ ID NO: 738686 - DNA, 20 bp, Artificial
  CRISPR gRNA sequence
agacaggcttgatctatggg

SEQ ID NO: 738687 - DNA, 20 bp, Artificial
  CRISPR gRNA sequence
gacaggcttgatctatgggt

SEQ ID NO: 738688 - DNA, 20 bp, Artificial
  CRISPR gRNA sequence
gatctatgggttttatgtaa

SEQ ID NO: 738689 - DNA, 20 bp, Artificial
  CRISPR gRNA sequence
atctatgggttttatgtaac

SEQ ID NO: 738690 - DNA, 20 bp, Artificial
  CRISPR gRNA sequence
tgggttttatgtaactagaa

SEQ ID NO: 738691 - DNA, 20 bp, Artificial
  CRISPR gRNA sequence
tatgtaactagaatatttta

SEQ ID NO: 738692 - DNA, 20 bp, Artificial
  CRISPR gRNA sequence
atgtaactagaatattttaa

SEQ ID NO: 738693 - DNA, 20 bp, Artificial
  CRISPR gRNA sequence
tgtaactagaatattttaaa

SEQ ID NO: 738694 - DNA, 20 bp, Artificial
  CRISPR gRNA sequence
gaatattttaaaactaaaca

SEQ ID NO: 738695 - DNA, 20 bp, Artificial
  CRISPR gRNA sequence
taaaactaaacaccagatgg

SEQ ID NO: 738696 - DNA, 20 bp, Artificial
  CRISPR gRNA sequence
aaaactaaacaccagatgga

SEQ ID NO: 738697 - DNA, 20 bp, Artificial
  CRISPR gRNA sequence
aaactaaacaccagatggaa

SEQ ID NO: 738698 - DNA, 20 bp, Artificial
  CRISPR gRNA sequence
aacaccagatggaatgaact

SEQ ID NO: 738699 - DNA, 20 bp, Artificial
  CRISPR gRNA sequence
aggagagttattatttaaag

SEQ ID NO: 738700 - DNA, 20 bp, Artificial
  CRISPR gRNA sequence
ttatttaaagaggactaagt

SEQ ID NO: 738701 - DNA, 20 bp, Artificial
  CRISPR gRNA sequence
tttaaagaggactaagtgaa

SEQ ID NO: 738702 - DNA, 20 bp, Artificial
  CRISPR gRNA sequence
aaagaggactaagtgaacct

SEQ ID NO: 738703 - DNA, 20 bp, Artificial
  CRISPR gRNA sequence
aagaggactaagtgaaccta

SEQ ID NO: 738704 - DNA, 20 bp, Artificial
  CRISPR gRNA sequence
agtgaacctatttgtgaaat

SEQ ID NO: 738705 - DNA, 20 bp, Artificial
  CRISPR gRNA sequence
tttgtgaaataaataactgt

SEQ ID NO: 738706 - DNA, 20 bp, Artificial
  CRISPR gRNA sequence
gtgaaataaataactgttaa

SEQ ID NO: 738707 - DNA, 20 bp, Artificial
  CRISPR gRNA sequence
tgaaataaataactgttaat

SEQ ID NO: 738708 - DNA, 20 bp, Artificial
  CRISPR gRNA sequence
ttaatcatattttcaaatac

SEQ ID NO: 738709 - DNA, 20 bp, Artificial
  CRISPR gRNA sequence
atcatattttcaaatactag

SEQ ID NO: 738710 - DNA, 20 bp, Artificial
  CRISPR gRNA sequence
tcaaatactagattttctta

SEQ ID NO: 738711 - DNA, 20 bp, Artificial
  CRISPR gRNA sequence
caaatactagattttcttat

SEQ ID NO: 738712 - DNA, 20 bp, Artificial
  CRISPR gRNA sequence
aaatactagattttcttatc

SEQ ID NO: 738713 - DNA, 20 bp, Artificial
  CRISPR gRNA sequence
gattttcttatctacctagt

SEQ ID NO: 738714 - DNA, 20 bp, Artificial
  CRISPR gRNA sequence
tcttatctacctagttagtt

SEQ ID NO: 738715 - DNA, 20 bp, Artificial
  CRISPR gRNA sequence
cttatctacctagttagttg

SEQ ID NO: 738716 - DNA, 20 bp, Artificial
  CRISPR gRNA sequence
ttatctacctagttagttgg

SEQ ID NO: 738717 - DNA, 20 bp, Artificial
  CRISPR gRNA sequence
atctacctagttagttgggc

SEQ ID NO: 738718 - DNA, 20 bp, Artificial
  CRISPR gRNA sequence
tctacctagttagttgggca

SEQ ID NO: 738719 - DNA, 20 bp, Artificial
  CRISPR gRNA sequence
cctagttagttgggcactga

SEQ ID NO: 738720 - DNA, 20 bp, Artificial
  CRISPR gRNA sequence
gttagttgggcactgaaatt

SEQ ID NO: 738721 - DNA, 20 bp, Artificial
  CRISPR gRNA sequence
gttgggcactgaaatttcac

SEQ ID NO: 738722 - DNA, 20 bp, Artificial
  CRISPR gRNA sequence
ggcactgaaatttcacaact

SEQ ID NO: 738723 - DNA, 20 bp, Artificial
  CRISPR gRNA sequence
aaatttcacaacttaatgac

SEQ ID NO: 738724 - DNA, 20 bp, Artificial
  CRISPR gRNA sequence
cacaacttaatgacctgtgt

SEQ ID NO: 738725 - DNA, 20 bp, Artificial
  CRISPR gRNA sequence
acaacttaatgacctgtgtt

SEQ ID NO: 738726 - DNA, 20 bp, Artificial
  CRISPR gRNA sequence
aatgacctgtgtttgtgtct

SEQ ID NO: 738727 - DNA, 20 bp, Artificial
  CRISPR gRNA sequence
atgacctgtgtttgtgtctc

SEQ ID NO: 738728 - DNA, 20 bp, Artificial
  CRISPR gRNA sequence
tgtttgtgtctctgcatctg

SEQ ID NO: 738729 - DNA, 20 bp, Artificial
  CRISPR gRNA sequence
gtgtctctgcatctgtctca

SEQ ID NO: 738730 - DNA, 20 bp, Artificial
  CRISPR gRNA sequence
tgtctctgcatctgtctcac

SEQ ID NO: 738731 - DNA, 20 bp, Artificial
  CRISPR gRNA sequence
tgcatctgtctcactgaggg

SEQ ID NO: 738732 - DNA, 20 bp, Artificial
  CRISPR gRNA sequence
catctgtctcactgagggca

SEQ ID NO: 738733 - DNA, 20 bp, Artificial
  CRISPR gRNA sequence
tctcactgagggcatgacct

SEQ ID NO: 738734 - DNA, 20 bp, Artificial
  CRISPR gRNA sequence
actgagggcatgacctgggt

SEQ ID NO: 738735 - DNA, 20 bp, Artificial
  CRISPR gRNA sequence
agggcatgacctgggttttt

SEQ ID NO: 738736 - DNA, 20 bp, Artificial
  CRISPR gRNA sequence
ggtttttcccacaagaattc

SEQ ID NO: 738737 - DNA, 20 bp, Artificial
  CRISPR gRNA sequence
ttcccacaagaattccctgg

SEQ ID NO: 738738 - DNA, 20 bp, Artificial
  CRISPR gRNA sequence
tcccacaagaattccctggg

SEQ ID NO: 738739 - DNA, 20 bp, Artificial
  CRISPR gRNA sequence
cccacaagaattccctggga

SEQ ID NO: 738740 - DNA, 20 bp, Artificial
  CRISPR gRNA sequence
ccacaagaattccctgggat

SEQ ID NO: 738741 - DNA, 20 bp, Artificial
  CRISPR gRNA sequence
cctgggatgccgggcacagt

SEQ ID NO: 738742 - DNA, 20 bp, Artificial
  CRISPR gRNA sequence
ggatgccgggcacagtggct

SEQ ID NO: 738743 - DNA, 20 bp, Artificial
  CRISPR gRNA sequence
acgcctgcaatcccagcact

SEQ ID NO: 738744 - DNA, 20 bp, Artificial
  CRISPR gRNA sequence
caatcccagcactttgggag

SEQ ID NO: 738745 - DNA, 20 bp, Artificial
  CRISPR gRNA sequence
tgggaggccgaggcaggtgg

SEQ ID NO: 738746 - DNA, 20 bp, Artificial
  CRISPR gRNA sequence
gggaggccgaggcaggtgga

SEQ ID NO: 738747 - DNA, 20 bp, Artificial
  CRISPR gRNA sequence
ggaggccgaggcaggtggat

SEQ ID NO: 738748 - DNA, 20 bp, Artificial
  CRISPR gRNA sequence
agaccatcctggctaacatg

SEQ ID NO: 738749 - DNA, 20 bp, Artificial
  CRISPR gRNA sequence
gctaacatggtgaaatcccg

SEQ ID NO: 738750 - DNA, 20 bp, Artificial
  CRISPR gRNA sequence
acatggtgaaatcccgtctc

SEQ ID NO: 738751 - DNA, 20 bp, Artificial
  CRISPR gRNA sequence
tactaaaaatacaaaaaatt

SEQ ID NO: 738752 - DNA, 20 bp, Artificial
  CRISPR gRNA sequence
ctaaaaatacaaaaaattag

SEQ ID NO: 738753 - DNA, 20 bp, Artificial
  CRISPR gRNA sequence
aaaatacaaaaaattagccg

SEQ ID NO: 738754 - DNA, 20 bp, Artificial
  CRISPR gRNA sequence
gccggacgtggtggcaggca

SEQ ID NO: 738755 - DNA, 20 bp, Artificial
  CRISPR gRNA sequence
tagtcccagctactcaggag

SEQ ID NO: 738756 - DNA, 20 bp, Artificial
  CRISPR gRNA sequence
ctcaggaggctgaggcagga

SEQ ID NO: 738757 - DNA, 20 bp, Artificial
  CRISPR gRNA sequence
aggaggctgaggcaggagaa

SEQ ID NO: 738758 - DNA, 20 bp, Artificial
  CRISPR gRNA sequence
aggcaggagaatagtttgaa

SEQ ID NO: 738759 - DNA, 20 bp, Artificial
  CRISPR gRNA sequence
gaacccaggaggcggaggtt

SEQ ID NO: 738760 - DNA, 20 bp, Artificial
  CRISPR gRNA sequence
aacccaggaggcggaggtta

SEQ ID NO: 738761 - DNA, 20 bp, Artificial
  CRISPR gRNA sequence
cagtgagctgagatcgtgcc

SEQ ID NO: 738762 - DNA, 20 bp, Artificial
  CRISPR gRNA sequence
agatcgtgccactgcactcc

SEQ ID NO: 738763 - DNA, 20 bp, Artificial
  CRISPR gRNA sequence
cactccagcctgggcaacag

SEQ ID NO: 738764 - DNA, 20 bp, Artificial
  CRISPR gRNA sequence
cagcctgggcaacagagcga

SEQ ID NO: 738765 - DNA, 20 bp, Artificial
  CRISPR gRNA sequence
ggcaacagagcgagactccg

SEQ ID NO: 738766 - DNA, 20 bp, Artificial
  CRISPR gRNA sequence
cgtctcaaaaacaaaacaaa

SEQ ID NO: 738767 - DNA, 20 bp, Artificial
  CRISPR gRNA sequence
aaaaacaaaacaaaacaaaa

SEQ ID NO: 738768 - DNA, 20 bp, Artificial
  CRISPR gRNA sequence
cctgggaatccctgaagaca

SEQ ID NO: 738769 - DNA, 20 bp, Artificial
  CRISPR gRNA sequence
ggaatccctgaagacagagc

SEQ ID NO: 738770 - DNA, 20 bp, Artificial
  CRISPR gRNA sequence
aagacagagcttgtcacttt

SEQ ID NO: 738771 - DNA, 20 bp, Artificial
  CRISPR gRNA sequence
gtcactttcccatcagacta

SEQ ID NO: 738772 - DNA, 20 bp, Artificial
  CRISPR gRNA sequence
tcactttcccatcagactag

SEQ ID NO: 738773 - DNA, 20 bp, Artificial
  CRISPR gRNA sequence
tcccatcagactagaaaata

SEQ ID NO: 738774 - DNA, 20 bp, Artificial
  CRISPR gRNA sequence
cccatcagactagaaaatac

SEQ ID NO: 738775 - DNA, 20 bp, Artificial
  CRISPR gRNA sequence
ccatcagactagaaaatacc

SEQ ID NO: 738776 - DNA, 20 bp, Artificial
  CRISPR gRNA sequence
gaaaataccatgaggaaagg

SEQ ID NO: 738777 - DNA, 20 bp, Artificial
  CRISPR gRNA sequence
tgtctgatggagctccgagt

SEQ ID NO: 738778 - DNA, 20 bp, Artificial
  CRISPR gRNA sequence
atggagctccgagtgtaaat

SEQ ID NO: 738779 - DNA, 20 bp, Artificial
  CRISPR gRNA sequence
cgagtgtaaatgctgcgttt

SEQ ID NO: 738780 - DNA, 20 bp, Artificial
  CRISPR gRNA sequence
cgtttcctccattagactgg

SEQ ID NO: 738781 - DNA, 20 bp, Artificial
  CRISPR gRNA sequence
cctccattagactggggact

SEQ ID NO: 738782 - DNA, 20 bp, Artificial
  CRISPR gRNA sequence
ctccattagactggggactc

SEQ ID NO: 738783 - DNA, 20 bp, Artificial
  CRISPR gRNA sequence
cattagactggggactcact

SEQ ID NO: 738784 - DNA, 20 bp, Artificial
  CRISPR gRNA sequence
gactggggactcactgaggg

SEQ ID NO: 738785 - DNA, 20 bp, Artificial
  CRISPR gRNA sequence
gggactcactgagggatata

SEQ ID NO: 738786 - DNA, 20 bp, Artificial
  CRISPR gRNA sequence
actgagggatatacctgcct

SEQ ID NO: 738787 - DNA, 20 bp, Artificial
  CRISPR gRNA sequence
agggatatacctgcctcctc

SEQ ID NO: 738788 - DNA, 20 bp, Artificial
  CRISPR gRNA sequence
cctcctccatcagactgaaa

SEQ ID NO: 738789 - DNA, 20 bp, Artificial
  CRISPR gRNA sequence
ctccatcagactgaaagctc

SEQ ID NO: 738790 - DNA, 20 bp, Artificial
  CRISPR gRNA sequence
catcagactgaaagctccct

SEQ ID NO: 738791 - DNA, 20 bp, Artificial
  CRISPR gRNA sequence
aaagctccctgagagcgggg

SEQ ID NO: 738792 - DNA, 20 bp, Artificial
  CRISPR gRNA sequence
cctgagagcgggggttgtgt

SEQ ID NO: 738793 - DNA, 20 bp, Artificial
  CRISPR gRNA sequence
agagcgggggttgtgtctcc

SEQ ID NO: 738794 - DNA, 20 bp, Artificial
  CRISPR gRNA sequence
tgtctccactgtaatactgg

SEQ ID NO: 738795 - DNA, 20 bp, Artificial
  CRISPR gRNA sequence
cactgtaatactggaagcta

SEQ ID NO: 738796 - DNA, 20 bp, Artificial
  CRISPR gRNA sequence
taatactggaagctagctgt

SEQ ID NO: 738797 - DNA, 20 bp, Artificial
  CRISPR gRNA sequence
gaagctagctgttttcaggg

SEQ ID NO: 738798 - DNA, 20 bp, Artificial
  CRISPR gRNA sequence
gctgttttcagggcccattc

SEQ ID NO: 738799 - DNA, 20 bp, Artificial
  CRISPR gRNA sequence
ttttcagggcccattcacct

SEQ ID NO: 738800 - DNA, 20 bp, Artificial
  CRISPR gRNA sequence
tcagggcccattcacctccc

SEQ ID NO: 738801 - DNA, 20 bp, Artificial
  CRISPR gRNA sequence
cagggcccattcacctccct

SEQ ID NO: 738802 - DNA, 20 bp, Artificial
  CRISPR gRNA sequence
agggcccattcacctccctt

SEQ ID NO: 738803 - DNA, 20 bp, Artificial
  CRISPR gRNA sequence
acctcccttcagattggggc

SEQ ID NO: 738804 - DNA, 20 bp, Artificial
  CRISPR gRNA sequence
ccttcagattggggcaagct

SEQ ID NO: 738805 - DNA, 20 bp, Artificial
  CRISPR gRNA sequence
cagattggggcaagctccct

SEQ ID NO: 738806 - DNA, 20 bp, Artificial
  CRISPR gRNA sequence
agattggggcaagctccctg

SEQ ID NO: 738807 - DNA, 20 bp, Artificial
  CRISPR gRNA sequence
gggcaagctccctgaaggcg

SEQ ID NO: 738808 - DNA, 20 bp, Artificial
  CRISPR gRNA sequence
cctgaaggcggggctgtatt

SEQ ID NO: 738809 - DNA, 20 bp, Artificial
  CRISPR gRNA sequence
aaggcggggctgtatttccc

SEQ ID NO: 738810 - DNA, 20 bp, Artificial
  CRISPR gRNA sequence
tatttccccctcaatctgtg

SEQ ID NO: 738811 - DNA, 20 bp, Artificial
  CRISPR gRNA sequence
ccccctcaatctgtgggttc

SEQ ID NO: 738812 - DNA, 20 bp, Artificial
  CRISPR gRNA sequence
cccctcaatctgtgggttct

SEQ ID NO: 738813 - DNA, 20 bp, Artificial
  CRISPR gRNA sequence
aatctgtgggttctgtgaca

SEQ ID NO: 738814 - DNA, 20 bp, Artificial
  CRISPR gRNA sequence
tgggttctgtgacagcagga

SEQ ID NO: 738815 - DNA, 20 bp, Artificial
  CRISPR gRNA sequence
tgtgacagcaggacaatatc

SEQ ID NO: 738816 - DNA, 20 bp, Artificial
  CRISPR gRNA sequence
tgacagcaggacaatatcca

SEQ ID NO: 738817 - DNA, 20 bp, Artificial
  CRISPR gRNA sequence
tacccttcaccatgatcttc

SEQ ID NO: 738818 - DNA, 20 bp, Artificial
  CRISPR gRNA sequence
cccttcaccatgatcttcaa

SEQ ID NO: 738819 - DNA, 20 bp, Artificial
  CRISPR gRNA sequence
caccatgatcttcaactttc

SEQ ID NO: 738820 - DNA, 20 bp, Artificial
  CRISPR gRNA sequence
accatgatcttcaactttca

SEQ ID NO: 738821 - DNA, 20 bp, Artificial
  CRISPR gRNA sequence
caactttcatgatgtcttct

SEQ ID NO: 738822 - DNA, 20 bp, Artificial
  CRISPR gRNA sequence
aactttcatgatgtcttctt

SEQ ID NO: 738823 - DNA, 20 bp, Artificial
  CRISPR gRNA sequence
tcatgatgtcttcttcctct

SEQ ID NO: 738824 - DNA, 20 bp, Artificial
  CRISPR gRNA sequence
catgatgtcttcttcctctc

SEQ ID NO: 738825 - DNA, 20 bp, Artificial
  CRISPR gRNA sequence
atgatgtcttcttcctctcc

SEQ ID NO: 738826 - DNA, 20 bp, Artificial
  CRISPR gRNA sequence
cttcctctcctcttgccaga

SEQ ID NO: 738827 - DNA, 20 bp, Artificial
  CRISPR gRNA sequence
ttcctctcctcttgccagac

SEQ ID NO: 738828 - DNA, 20 bp, Artificial
  CRISPR gRNA sequence
cctctcctcttgccagacct

SEQ ID NO: 738829 - DNA, 20 bp, Artificial
  CRISPR gRNA sequence
ctctcctcttgccagacctt

SEQ ID NO: 738830 - DNA, 20 bp, Artificial
  CRISPR gRNA sequence
tcctcttgccagaccttatt

SEQ ID NO: 738831 - DNA, 20 bp, Artificial
  CRISPR gRNA sequence
ctcttgccagaccttattca

SEQ ID NO: 738832 - DNA, 20 bp, Artificial
  CRISPR gRNA sequence
ttgccagaccttattcaata

SEQ ID NO: 738833 - DNA, 20 bp, Artificial
  CRISPR gRNA sequence
gccagaccttattcaataag

SEQ ID NO: 738834 - DNA, 20 bp, Artificial
  CRISPR gRNA sequence
ccagaccttattcaataagt

SEQ ID NO: 738835 - DNA, 20 bp, Artificial
  CRISPR gRNA sequence
attcaataagtattgtctcc

SEQ ID NO: 738836 - DNA, 20 bp, Artificial
  CRISPR gRNA sequence
ttcaataagtattgtctcca

SEQ ID NO: 738837 - DNA, 20 bp, Artificial
  CRISPR gRNA sequence
aataagtattgtctccacag

SEQ ID NO: 738838 - DNA, 20 bp, Artificial
  CRISPR gRNA sequence
tctccacaggcccctctgct

SEQ ID NO: 738839 - DNA, 20 bp, Artificial
  CRISPR gRNA sequence
cacaggcccctctgctgaca

SEQ ID NO: 738840 - DNA, 20 bp, Artificial
  CRISPR gRNA sequence
tgctgacagtgtatacacaa

SEQ ID NO: 738841 - DNA, 20 bp, Artificial
  CRISPR gRNA sequence
ctgacagtgtatacacaaaa

SEQ ID NO: 738842 - DNA, 20 bp, Artificial
  CRISPR gRNA sequence
acagtgtatacacaaaagtg

SEQ ID NO: 738843 - DNA, 20 bp, Artificial
  CRISPR gRNA sequence
cttgaaggggagactctgtc

SEQ ID NO: 738844 - DNA, 20 bp, Artificial
  CRISPR gRNA sequence
gaaggggagactctgtctgt

SEQ ID NO: 738845 - DNA, 20 bp, Artificial
  CRISPR gRNA sequence
aaggggagactctgtctgtg

SEQ ID NO: 738846 - DNA, 20 bp, Artificial
  CRISPR gRNA sequence
tgtctgtgcagtgctcctat

SEQ ID NO: 738847 - DNA, 20 bp, Artificial
  CRISPR gRNA sequence
tctgtgcagtgctcctataa

SEQ ID NO: 738848 - DNA, 20 bp, Artificial
  CRISPR gRNA sequence
tgcagtgctcctataagggc

SEQ ID NO: 738849 - DNA, 20 bp, Artificial
  CRISPR gRNA sequence
ctataagggctacaaaaacc

SEQ ID NO: 738850 - DNA, 20 bp, Artificial
  CRISPR gRNA sequence
taagggctacaaaaaccgcg

SEQ ID NO: 738851 - DNA, 20 bp, Artificial
  CRISPR gRNA sequence
caaaaaccgcgtggagggca

SEQ ID NO: 738852 - DNA, 20 bp, Artificial
  CRISPR gRNA sequence
ggtgcaaaatcaggaagaag

SEQ ID NO: 738853 - DNA, 20 bp, Artificial
  CRISPR gRNA sequence
gtgcaaaatcaggaagaaga

SEQ ID NO: 738854 - DNA, 20 bp, Artificial
  CRISPR gRNA sequence
gctttgcccgagtctgggtg

SEQ ID NO: 738855 - DNA, 20 bp, Artificial
  CRISPR gRNA sequence
tgcccgagtctgggtgaaag

SEQ ID NO: 738856 - DNA, 20 bp, Artificial
  CRISPR gRNA sequence
gcccgagtctgggtgaaagg

SEQ ID NO: 738857 - DNA, 20 bp, Artificial
  CRISPR gRNA sequence
cccgagtctgggtgaaaggg

SEQ ID NO: 738858 - DNA, 20 bp, Artificial
  CRISPR gRNA sequence
ggtgaaagggccccgctact

SEQ ID NO: 738859 - DNA, 20 bp, Artificial
  CRISPR gRNA sequence
cttgctgcaggacgatgccc

SEQ ID NO: 738860 - DNA, 20 bp, Artificial
  CRISPR gRNA sequence
gctgcaggacgatgcccagg

SEQ ID NO: 738861 - DNA, 20 bp, Artificial
  CRISPR gRNA sequence
ctgcaggacgatgcccaggc

SEQ ID NO: 738862 - DNA, 20 bp, Artificial
  CRISPR gRNA sequence
caggacgatgcccaggccaa

SEQ ID NO: 738863 - DNA, 20 bp, Artificial
  CRISPR gRNA sequence
aagctccaggactcaggccg

SEQ ID NO: 738864 - DNA, 20 bp, Artificial
  CRISPR gRNA sequence
caggactcaggccgatactg

SEQ ID NO: 738865 - DNA, 20 bp, Artificial
  CRISPR gRNA sequence
aggccgatactggtgcatgc

SEQ ID NO: 738866 - DNA, 20 bp, Artificial
  CRISPR gRNA sequence
gtgcatgcgcaacacctctg

SEQ ID NO: 738867 - DNA, 20 bp, Artificial
  CRISPR gRNA sequence
tgggatcctgtaccccttga

SEQ ID NO: 738868 - DNA, 20 bp, Artificial
  CRISPR gRNA sequence
ggatcctgtaccccttgatg

SEQ ID NO: 738869 - DNA, 20 bp, Artificial
  CRISPR gRNA sequence
taccccttgatgggcttcca

SEQ ID NO: 738870 - DNA, 20 bp, Artificial
  CRISPR gRNA sequence
gatgggcttccagctggatg

SEQ ID NO: 738871 - DNA, 20 bp, Artificial
  CRISPR gRNA sequence
atgggcttccagctggatgt

SEQ ID NO: 738872 - DNA, 20 bp, Artificial
  CRISPR gRNA sequence
ccagctggatgtgtctccag

SEQ ID NO: 738873 - DNA, 20 bp, Artificial
  CRISPR gRNA sequence
cagctggatgtgtctccagg

SEQ ID NO: 738874 - DNA, 20 bp, Artificial
  CRISPR gRNA sequence
gatgtgtctccaggtgagca

SEQ ID NO: 738875 - DNA, 20 bp, Artificial
  CRISPR gRNA sequence
caggtgagcaggctgcagtg

SEQ ID NO: 738876 - DNA, 20 bp, Artificial
  CRISPR gRNA sequence
cagtggctctgggacgggtg

SEQ ID NO: 738877 - DNA, 20 bp, Artificial
  CRISPR gRNA sequence
tgggacgggtggagggagtc

SEQ ID NO: 738878 - DNA, 20 bp, Artificial
  CRISPR gRNA sequence
ggacgggtggagggagtccc

SEQ ID NO: 738879 - DNA, 20 bp, Artificial
  CRISPR gRNA sequence
ctgccccacactccactaac

SEQ ID NO: 738880 - DNA, 20 bp, Artificial
  CRISPR gRNA sequence
ccccacactccactaacatc

SEQ ID NO: 738881 - DNA, 20 bp, Artificial
  CRISPR gRNA sequence
cactaacatcagagataata

SEQ ID NO: 738882 - DNA, 20 bp, Artificial
  CRISPR gRNA sequence
acatcagagataataaggat

SEQ ID NO: 738883 - DNA, 20 bp, Artificial
  CRISPR gRNA sequence
cactgtagtgttttcagagt

SEQ ID NO: 738884 - DNA, 20 bp, Artificial
  CRISPR gRNA sequence
tagtgttttcagagtgcctt

SEQ ID NO: 738885 - DNA, 20 bp, Artificial
  CRISPR gRNA sequence
tcagagtgcctttatggcac

SEQ ID NO: 738886 - DNA, 20 bp, Artificial
  CRISPR gRNA sequence
cagagtgcctttatggcact

SEQ ID NO: 738887 - DNA, 20 bp, Artificial
  CRISPR gRNA sequence
agagtgcctttatggcacta

SEQ ID NO: 738888 - DNA, 20 bp, Artificial
  CRISPR gRNA sequence
tatggcactattcgtggcac

SEQ ID NO: 738889 - DNA, 20 bp, Artificial
  CRISPR gRNA sequence
atggcactattcgtggcact

SEQ ID NO: 738890 - DNA, 20 bp, Artificial
  CRISPR gRNA sequence
tggcactattcgtggcacta

SEQ ID NO: 738891 - DNA, 20 bp, Artificial
  CRISPR gRNA sequence
ttcgtggcactattgtcacc

SEQ ID NO: 738892 - DNA, 20 bp, Artificial
  CRISPR gRNA sequence
gtggcactattgtcaccatt

SEQ ID NO: 738893 - DNA, 20 bp, Artificial
  CRISPR gRNA sequence
ttgtcaccattttacagatg

SEQ ID NO: 738894 - DNA, 20 bp, Artificial
  CRISPR gRNA sequence
tcaccattttacagatgaag

SEQ ID NO: 738895 - DNA, 20 bp, Artificial
  CRISPR gRNA sequence
tacagatgaagataatgaga

SEQ ID NO: 738896 - DNA, 20 bp, Artificial
  CRISPR gRNA sequence
acagatgaagataatgagac

SEQ ID NO: 738897 - DNA, 20 bp, Artificial
  CRISPR gRNA sequence
cagatgaagataatgagacc

SEQ ID NO: 738898 - DNA, 20 bp, Artificial
  CRISPR gRNA sequence
aaaacccagtgtgactctga

SEQ ID NO: 738899 - DNA, 20 bp, Artificial
  CRISPR gRNA sequence
tgagcttgtccggggtccca

SEQ ID NO: 738900 - DNA, 20 bp, Artificial
  CRISPR gRNA sequence
agcttgtccggggtcccaga

SEQ ID NO: 738901 - DNA, 20 bp, Artificial
  CRISPR gRNA sequence
gtccggggtcccagagctag

SEQ ID NO: 738902 - DNA, 20 bp, Artificial
  CRISPR gRNA sequence
tccggggtcccagagctagc

SEQ ID NO: 738903 - DNA, 20 bp, Artificial
  CRISPR gRNA sequence
gcaggtggctgagataaggt

SEQ ID NO: 738904 - DNA, 20 bp, Artificial
  CRISPR gRNA sequence
agataaggttcaaacttggc

SEQ ID NO: 738905 - DNA, 20 bp, Artificial
  CRISPR gRNA sequence
aaacttggcactgtctgtgc

SEQ ID NO: 738906 - DNA, 20 bp, Artificial
  CRISPR gRNA sequence
ggcactgtctgtgctgtgtt

SEQ ID NO: 738907 - DNA, 20 bp, Artificial
  CRISPR gRNA sequence
gcactgtctgtgctgtgttt

SEQ ID NO: 738908 - DNA, 20 bp, Artificial
  CRISPR gRNA sequence
tctgtgctgtgttttattca

SEQ ID NO: 738909 - DNA, 20 bp, Artificial
  CRISPR gRNA sequence
tgctgtgttttattcactca

SEQ ID NO: 738910 - DNA, 20 bp, Artificial
  CRISPR gRNA sequence
tgttttattcactcattgct

SEQ ID NO: 738911 - DNA, 20 bp, Artificial
  CRISPR gRNA sequence
tattcactcattgcttcaac

SEQ ID NO: 738912 - DNA, 20 bp, Artificial
  CRISPR gRNA sequence
attcactcattgcttcaaca

SEQ ID NO: 738913 - DNA, 20 bp, Artificial
  CRISPR gRNA sequence
ttcactcattgcttcaacat

SEQ ID NO: 738914 - DNA, 20 bp, Artificial
  CRISPR gRNA sequence
actcattgcttcaacataat

SEQ ID NO: 738915 - DNA, 20 bp, Artificial
  CRISPR gRNA sequence
attgcttcaacataattcat

SEQ ID NO: 738916 - DNA, 20 bp, Artificial
  CRISPR gRNA sequence
cttcaacataattcattgag

SEQ ID NO: 738917 - DNA, 20 bp, Artificial
  CRISPR gRNA sequence
caacataattcattgagccc

SEQ ID NO: 738918 - DNA, 20 bp, Artificial
  CRISPR gRNA sequence
aacataattcattgagcccc

SEQ ID NO: 738919 - DNA, 20 bp, Artificial
  CRISPR gRNA sequence
attgagcccctattatgggg

SEQ ID NO: 738920 - DNA, 20 bp, Artificial
  CRISPR gRNA sequence
agcccctattatggggcagg

SEQ ID NO: 738921 - DNA, 20 bp, Artificial
  CRISPR gRNA sequence
ttatggggcaggcactattc

SEQ ID NO: 738922 - DNA, 20 bp, Artificial
  CRISPR gRNA sequence
tggggcaggcactattctag

SEQ ID NO: 738923 - DNA, 20 bp, Artificial
  CRISPR gRNA sequence
ttctaggctctaaggagaca

SEQ ID NO: 738924 - DNA, 20 bp, Artificial
  CRISPR gRNA sequence
taggctctaaggagacagtg

SEQ ID NO: 738925 - DNA, 20 bp, Artificial
  CRISPR gRNA sequence
ggctctaaggagacagtgag

SEQ ID NO: 738926 - DNA, 20 bp, Artificial
  CRISPR gRNA sequence
taaggagacagtgagcaaaa

SEQ ID NO: 738927 - DNA, 20 bp, Artificial
  CRISPR gRNA sequence
aggagacagtgagcaaaaac

SEQ ID NO: 738928 - DNA, 20 bp, Artificial
  CRISPR gRNA sequence
acaatcctgcactatgggag

SEQ ID NO: 738929 - DNA, 20 bp, Artificial
  CRISPR gRNA sequence
cactatgggagatgacaggc

SEQ ID NO: 738930 - DNA, 20 bp, Artificial
  CRISPR gRNA sequence
tgggagatgacaggcacact

SEQ ID NO: 738931 - DNA, 20 bp, Artificial
  CRISPR gRNA sequence
attatccagacaaataattg

SEQ ID NO: 738932 - DNA, 20 bp, Artificial
  CRISPR gRNA sequence
ttatccagacaaataattgc

SEQ ID NO: 738933 - DNA, 20 bp, Artificial
  CRISPR gRNA sequence
tccagacaaataattgcaga

SEQ ID NO: 738934 - DNA, 20 bp, Artificial
  CRISPR gRNA sequence
cagaaaacaagaggtgttca

SEQ ID NO: 738935 - DNA, 20 bp, Artificial
  CRISPR gRNA sequence
ataagaaactaggaactgtt

SEQ ID NO: 738936 - DNA, 20 bp, Artificial
  CRISPR gRNA sequence
ggaactgtttcaaataattg

SEQ ID NO: 738937 - DNA, 20 bp, Artificial
  CRISPR gRNA sequence
tttcaaataattgcaaataa

SEQ ID NO: 738938 - DNA, 20 bp, Artificial
  CRISPR gRNA sequence
caaataattgcaaataacta

SEQ ID NO: 738939 - DNA, 20 bp, Artificial
  CRISPR gRNA sequence
aaataattgcaaataactag

SEQ ID NO: 738940 - DNA, 20 bp, Artificial
  CRISPR gRNA sequence
caaataactagaggtgttca

SEQ ID NO: 738941 - DNA, 20 bp, Artificial
  CRISPR gRNA sequence
gaggtgttcatgaactagta

SEQ ID NO: 738942 - DNA, 20 bp, Artificial
  CRISPR gRNA sequence
atgaactagtaagcgactcg

SEQ ID NO: 738943 - DNA, 20 bp, Artificial
  CRISPR gRNA sequence
gtaagcgactcggtggtggg

SEQ ID NO: 738944 - DNA, 20 bp, Artificial
  CRISPR gRNA sequence
ggtggtgggggagctactga

SEQ ID NO: 738945 - DNA, 20 bp, Artificial
  CRISPR gRNA sequence
ctgaagtactgggggtcaga

SEQ ID NO: 738946 - DNA, 20 bp, Artificial
  CRISPR gRNA sequence
aagtactgggggtcagagaa

SEQ ID NO: 738947 - DNA, 20 bp, Artificial
  CRISPR gRNA sequence
ggggtcagagaacacctccc

SEQ ID NO: 738948 - DNA, 20 bp, Artificial
  CRISPR gRNA sequence
ccttagcagacaacaccaag

SEQ ID NO: 738949 - DNA, 20 bp, Artificial
  CRISPR gRNA sequence
agcagacaacaccaagcaga

SEQ ID NO: 738950 - DNA, 20 bp, Artificial
  CRISPR gRNA sequence
gcagacaacaccaagcagag

SEQ ID NO: 738951 - DNA, 20 bp, Artificial
  CRISPR gRNA sequence
aatggtgagcattttccagc

SEQ ID NO: 738952 - DNA, 20 bp, Artificial
  CRISPR gRNA sequence
tccagccctgttgaaatctg

SEQ ID NO: 738953 - DNA, 20 bp, Artificial
  CRISPR gRNA sequence
ccagccctgttgaaatctgg

SEQ ID NO: 738954 - DNA, 20 bp, Artificial
  CRISPR gRNA sequence
cagccctgttgaaatctggg

SEQ ID NO: 738955 - DNA, 20 bp, Artificial
  CRISPR gRNA sequence
ttgaaatctgggtgctttga

SEQ ID NO: 738956 - DNA, 20 bp, Artificial
  CRISPR gRNA sequence
aaatctgggtgctttgaaga

SEQ ID NO: 738957 - DNA, 20 bp, Artificial
  CRISPR gRNA sequence
ggtgctttgaagagcacttt

SEQ ID NO: 738958 - DNA, 20 bp, Artificial
  CRISPR gRNA sequence
tgaagagcactttgtcgcaa

SEQ ID NO: 738959 - DNA, 20 bp, Artificial
  CRISPR gRNA sequence
gaagagcactttgtcgcaag

SEQ ID NO: 738960 - DNA, 20 bp, Artificial
  CRISPR gRNA sequence
aagagcactttgtcgcaaga

SEQ ID NO: 738961 - DNA, 20 bp, Artificial
  CRISPR gRNA sequence
tgtcgcaagagctgaatatg

SEQ ID NO: 738962 - DNA, 20 bp, Artificial
  CRISPR gRNA sequence
gtcgcaagagctgaatatgc

SEQ ID NO: 738963 - DNA, 20 bp, Artificial
  CRISPR gRNA sequence
tcgcaagagctgaatatgca

SEQ ID NO: 738964 - DNA, 20 bp, Artificial
  CRISPR gRNA sequence
aatatgcaaaggtcctgagg

SEQ ID NO: 738965 - DNA, 20 bp, Artificial
  CRISPR gRNA sequence
aggtcagaaggagcttggct

SEQ ID NO: 738966 - DNA, 20 bp, Artificial
  CRISPR gRNA sequence
ggcttgtataaggcttattt

SEQ ID NO: 738967 - DNA, 20 bp, Artificial
  CRISPR gRNA sequence
gcttgtataaggcttattta

SEQ ID NO: 738968 - DNA, 20 bp, Artificial
  CRISPR gRNA sequence
gtataaggcttatttagtca

SEQ ID NO: 738969 - DNA, 20 bp, Artificial
  CRISPR gRNA sequence
tataaggcttatttagtcac

SEQ ID NO: 738970 - DNA, 20 bp, Artificial
  CRISPR gRNA sequence
atttagtcactctatatgga

SEQ ID NO: 738971 - DNA, 20 bp, Artificial
  CRISPR gRNA sequence
tttagtcactctatatggag

SEQ ID NO: 738972 - DNA, 20 bp, Artificial
  CRISPR gRNA sequence
agtcactctatatggagtgt

SEQ ID NO: 738973 - DNA, 20 bp, Artificial
  CRISPR gRNA sequence
gtcactctatatggagtgtg

SEQ ID NO: 738974 - DNA, 20 bp, Artificial
  CRISPR gRNA sequence
tatatggagtgtgaggcaat

SEQ ID NO: 738975 - DNA, 20 bp, Artificial
  CRISPR gRNA sequence
tatggagtgtgaggcaatga

SEQ ID NO: 738976 - DNA, 20 bp, Artificial
  CRISPR gRNA sequence
gagagtcaagcagccctgaa

SEQ ID NO: 738977 - DNA, 20 bp, Artificial
  CRISPR gRNA sequence
aagaccataagttggaattt

SEQ ID NO: 738978 - DNA, 20 bp, Artificial
  CRISPR gRNA sequence
gaatttaggtataagaggaa

SEQ ID NO: 738979 - DNA, 20 bp, Artificial
  CRISPR gRNA sequence
aggtataagaggaagctact

SEQ ID NO: 738980 - DNA, 20 bp, Artificial
  CRISPR gRNA sequence
ggtataagaggaagctacta

SEQ ID NO: 738981 - DNA, 20 bp, Artificial
  CRISPR gRNA sequence
ctagagagctcagagagctg

SEQ ID NO: 738982 - DNA, 20 bp, Artificial
  CRISPR gRNA sequence
gagagctcagagagctgtca

SEQ ID NO: 738983 - DNA, 20 bp, Artificial
  CRISPR gRNA sequence
agagagctgtcatgacttgt

SEQ ID NO: 738984 - DNA, 20 bp, Artificial
  CRISPR gRNA sequence
tcatgacttgtttttaagaa

SEQ ID NO: 738985 - DNA, 20 bp, Artificial
  CRISPR gRNA sequence
gtttttaagaatgtagtggc

SEQ ID NO: 738986 - DNA, 20 bp, Artificial
  CRISPR gRNA sequence
tttttaagaatgtagtggcc

SEQ ID NO: 738987 - DNA, 20 bp, Artificial
  CRISPR gRNA sequence
ttaagaatgtagtggccact

SEQ ID NO: 738988 - DNA, 20 bp, Artificial
  CRISPR gRNA sequence
taagaatgtagtggccactt

SEQ ID NO: 738989 - DNA, 20 bp, Artificial
  CRISPR gRNA sequence
aagaatgtagtggccacttg

SEQ ID NO: 738990 - DNA, 20 bp, Artificial
  CRISPR gRNA sequence
agaatgtagtggccacttgt

SEQ ID NO: 738991 - DNA, 20 bp, Artificial
  CRISPR gRNA sequence
gttgaggatggattgtgaat

SEQ ID NO: 738992 - DNA, 20 bp, Artificial
  CRISPR gRNA sequence
ttgaggatggattgtgaatg

SEQ ID NO: 738993 - DNA, 20 bp, Artificial
  CRISPR gRNA sequence
aggatggattgtgaatggta

SEQ ID NO: 738994 - DNA, 20 bp, Artificial
  CRISPR gRNA sequence
tgaatggtatgaacacgggt

SEQ ID NO: 738995 - DNA, 20 bp, Artificial
  CRISPR gRNA sequence
tgggcatctggctggaaaca

SEQ ID NO: 738996 - DNA, 20 bp, Artificial
  CRISPR gRNA sequence
gctggaaacaacagtggcct

SEQ ID NO: 738997 - DNA, 20 bp, Artificial
  CRISPR gRNA sequence
gaaacaacagtggcctggag

SEQ ID NO: 738998 - DNA, 20 bp, Artificial
  CRISPR gRNA sequence
gagtacaatgtaggcactag

SEQ ID NO: 738999 - DNA, 20 bp, Artificial
  CRISPR gRNA sequence
gtggcagagagatgtgaatg

SEQ ID NO: 739000 - DNA, 20 bp, Artificial
  CRISPR gRNA sequence
aaatctatgtttttcagact

SEQ ID NO: 739001 - DNA, 20 bp, Artificial
  CRISPR gRNA sequence
tgtttttcagactttctgtt

SEQ ID NO: 739002 - DNA, 20 bp, Artificial
  CRISPR gRNA sequence
ttcagactttctgttcagct

SEQ ID NO: 739003 - DNA, 20 bp, Artificial
  CRISPR gRNA sequence
tcagactttctgttcagctc

SEQ ID NO: 739004 - DNA, 20 bp, Artificial
  CRISPR gRNA sequence
cagactttctgttcagctca

SEQ ID NO: 739005 - DNA, 20 bp, Artificial
  CRISPR gRNA sequence
agactttctgttcagctcat

SEQ ID NO: 739006 - DNA, 20 bp, Artificial
  CRISPR gRNA sequence
tctgttcagctcatatgttt

SEQ ID NO: 739007 - DNA, 20 bp, Artificial
  CRISPR gRNA sequence
ctgttcagctcatatgtttt

SEQ ID NO: 739008 - DNA, 20 bp, Artificial
  CRISPR gRNA sequence
tgttcagctcatatgttttg

SEQ ID NO: 739009 - DNA, 20 bp, Artificial
  CRISPR gRNA sequence
ttcagctcatatgttttgaa

SEQ ID NO: 739010 - DNA, 20 bp, Artificial
  CRISPR gRNA sequence
agctcatatgttttgaaggt

SEQ ID NO: 739011 - DNA, 20 bp, Artificial
  CRISPR gRNA sequence
atatgttttgaaggtaggac

SEQ ID NO: 739012 - DNA, 20 bp, Artificial
  CRISPR gRNA sequence
tgaaggtaggacaggatttg

SEQ ID NO: 739013 - DNA, 20 bp, Artificial
  CRISPR gRNA sequence
gaaggtaggacaggatttgc

SEQ ID NO: 739014 - DNA, 20 bp, Artificial
  CRISPR gRNA sequence
aaggtaggacaggatttgct

SEQ ID NO: 739015 - DNA, 20 bp, Artificial
  CRISPR gRNA sequence
gctcagttgaggggtgagcc

SEQ ID NO: 739016 - DNA, 20 bp, Artificial
  CRISPR gRNA sequence
ctcagttgaggggtgagcca

SEQ ID NO: 739017 - DNA, 20 bp, Artificial
  CRISPR gRNA sequence
agttgaggggtgagccaaaa

SEQ ID NO: 739018 - DNA, 20 bp, Artificial
  CRISPR gRNA sequence
aggggtgagccaaaaggagg

SEQ ID NO: 739019 - DNA, 20 bp, Artificial
  CRISPR gRNA sequence
tctatttgatcagcaggtgg

SEQ ID NO: 739020 - DNA, 20 bp, Artificial
  CRISPR gRNA sequence
ctatttgatcagcaggtgga

SEQ ID NO: 739021 - DNA, 20 bp, Artificial
  CRISPR gRNA sequence
tatttgatcagcaggtggat

SEQ ID NO: 739022 - DNA, 20 bp, Artificial
  CRISPR gRNA sequence
tttgatcagcaggtggatga

SEQ ID NO: 739023 - DNA, 20 bp, Artificial
  CRISPR gRNA sequence
gatcagcaggtggatgatgg

SEQ ID NO: 739024 - DNA, 20 bp, Artificial
  CRISPR gRNA sequence
atcagcaggtggatgatggt

SEQ ID NO: 739025 - DNA, 20 bp, Artificial
  CRISPR gRNA sequence
atagcgtagggtaaatctga

SEQ ID NO: 739026 - DNA, 20 bp, Artificial
  CRISPR gRNA sequence
aaagaggagctaatttggag

SEQ ID NO: 739027 - DNA, 20 bp, Artificial
  CRISPR gRNA sequence
atttggaggagaaaaatcaa

SEQ ID NO: 739028 - DNA, 20 bp, Artificial
  CRISPR gRNA sequence
ggaggagaaaaatcaagagc

SEQ ID NO: 739029 - DNA, 20 bp, Artificial
  CRISPR gRNA sequence
gaggagaaaaatcaagagct

SEQ ID NO: 739030 - DNA, 20 bp, Artificial
  CRISPR gRNA sequence
tcttttgtcatgttaagttt

SEQ ID NO: 739031 - DNA, 20 bp, Artificial
  CRISPR gRNA sequence
ttttgtcatgttaagtttaa

SEQ ID NO: 739032 - DNA, 20 bp, Artificial
  CRISPR gRNA sequence
ttgtcatgttaagtttaaga

SEQ ID NO: 739033 - DNA, 20 bp, Artificial
  CRISPR gRNA sequence
tgtcatgttaagtttaagat

SEQ ID NO: 739034 - DNA, 20 bp, Artificial
  CRISPR gRNA sequence
gtcatgttaagtttaagata

SEQ ID NO: 739035 - DNA, 20 bp, Artificial
  CRISPR gRNA sequence
tcatgttaagtttaagatac

SEQ ID NO: 739036 - DNA, 20 bp, Artificial
  CRISPR gRNA sequence
agtttaagatacctcctaga

SEQ ID NO: 739037 - DNA, 20 bp, Artificial
  CRISPR gRNA sequence
aagatacctcctagaacccc

SEQ ID NO: 739038 - DNA, 20 bp, Artificial
  CRISPR gRNA sequence
agatacctcctagaacccca

SEQ ID NO: 739039 - DNA, 20 bp, Artificial
  CRISPR gRNA sequence
ctagaaccccaagtggggaa

SEQ ID NO: 739040 - DNA, 20 bp, Artificial
  CRISPR gRNA sequence
gaaccccaagtggggaaatg

SEQ ID NO: 739041 - DNA, 20 bp, Artificial
  CRISPR gRNA sequence
cctggagctagggtgagagg

SEQ ID NO: 739042 - DNA, 20 bp, Artificial
  CRISPR gRNA sequence
gagctagggtgagaggtcag

SEQ ID NO: 739043 - DNA, 20 bp, Artificial
  CRISPR gRNA sequence
gggtgagaggtcagagctgg

SEQ ID NO: 739044 - DNA, 20 bp, Artificial
  CRISPR gRNA sequence
gggtatgtatttgaaagtat

SEQ ID NO: 739045 - DNA, 20 bp, Artificial
  CRISPR gRNA sequence
gaaagtatctctataaagat

SEQ ID NO: 739046 - DNA, 20 bp, Artificial
  CRISPR gRNA sequence
aaagtatctctataaagata

SEQ ID NO: 739047 - DNA, 20 bp, Artificial
  CRISPR gRNA sequence
tataaagatagtgtttaaag

SEQ ID NO: 739048 - DNA, 20 bp, Artificial
  CRISPR gRNA sequence
taaagatagtgtttaaagtc

SEQ ID NO: 739049 - DNA, 20 bp, Artificial
  CRISPR gRNA sequence
aaagtccagggaattagaga

SEQ ID NO: 739050 - DNA, 20 bp, Artificial
  CRISPR gRNA sequence
aagtccagggaattagagaa

SEQ ID NO: 739051 - DNA, 20 bp, Artificial
  CRISPR gRNA sequence
gagaaatctacagacacaga

SEQ ID NO: 739052 - DNA, 20 bp, Artificial
  CRISPR gRNA sequence
cagacacagaaagtagatta

SEQ ID NO: 739053 - DNA, 20 bp, Artificial
  CRISPR gRNA sequence
gtggttgcttagggctgggg

SEQ ID NO: 739054 - DNA, 20 bp, Artificial
  CRISPR gRNA sequence
cttagggctgggggaaggaa

SEQ ID NO: 739055 - DNA, 20 bp, Artificial
  CRISPR gRNA sequence
agggctgggggaaggaaaag

SEQ ID NO: 739056 - DNA, 20 bp, Artificial
  CRISPR gRNA sequence
gggctgggggaaggaaaagg

SEQ ID NO: 739057 - DNA, 20 bp, Artificial
  CRISPR gRNA sequence
ggggaaggaaaaggggatac

SEQ ID NO: 739058 - DNA, 20 bp, Artificial
  CRISPR gRNA sequence
cttttggagatgatgaaggt

SEQ ID NO: 739059 - DNA, 20 bp, Artificial
  CRISPR gRNA sequence
ttttggagatgatgaaggtg

SEQ ID NO: 739060 - DNA, 20 bp, Artificial
  CRISPR gRNA sequence
ttggagatgatgaaggtgtt

SEQ ID NO: 739061 - DNA, 20 bp, Artificial
  CRISPR gRNA sequence
tggagatgatgaaggtgttc

SEQ ID NO: 739062 - DNA, 20 bp, Artificial
  CRISPR gRNA sequence
ggagatgatgaaggtgttct

SEQ ID NO: 739063 - DNA, 20 bp, Artificial
  CRISPR gRNA sequence
gagatgatgaaggtgttctg

SEQ ID NO: 739064 - DNA, 20 bp, Artificial
  CRISPR gRNA sequence
tgaaactcactgtgatgatg

SEQ ID NO: 739065 - DNA, 20 bp, Artificial
  CRISPR gRNA sequence
aaactcactgtgatgatggt

SEQ ID NO: 739066 - DNA, 20 bp, Artificial
  CRISPR gRNA sequence
actgtgatgatggttgcata

SEQ ID NO: 739067 - DNA, 20 bp, Artificial
  CRISPR gRNA sequence
tgatgatggttgcataactt

SEQ ID NO: 739068 - DNA, 20 bp, Artificial
  CRISPR gRNA sequence
cataactttgtaagcataat

SEQ ID NO: 739069 - DNA, 20 bp, Artificial
  CRISPR gRNA sequence
tgtaagcataataaagaacc

SEQ ID NO: 739070 - DNA, 20 bp, Artificial
  CRISPR gRNA sequence
gtaagcataataaagaacca

SEQ ID NO: 739071 - DNA, 20 bp, Artificial
  CRISPR gRNA sequence
taagcataataaagaaccac

SEQ ID NO: 739072 - DNA, 20 bp, Artificial
  CRISPR gRNA sequence
agctttatactataaatggg

SEQ ID NO: 739073 - DNA, 20 bp, Artificial
  CRISPR gRNA sequence
tatactataaatgggatgtg

SEQ ID NO: 739074 - DNA, 20 bp, Artificial
  CRISPR gRNA sequence
atactataaatgggatgtga

SEQ ID NO: 739075 - DNA, 20 bp, Artificial
  CRISPR gRNA sequence
tactataaatgggatgtgag

SEQ ID NO: 739076 - DNA, 20 bp, Artificial
  CRISPR gRNA sequence
taaatgggatgtgagttata

SEQ ID NO: 739077 - DNA, 20 bp, Artificial
  CRISPR gRNA sequence
tatctcaataaagttcttaa

SEQ ID NO: 739078 - DNA, 20 bp, Artificial
  CRISPR gRNA sequence
aataaagttcttaaaaatat

SEQ ID NO: 739079 - DNA, 20 bp, Artificial
  CRISPR gRNA sequence
ttaaaaatatcaagatctaa

SEQ ID NO: 739080 - DNA, 20 bp, Artificial
  CRISPR gRNA sequence
aaaaatatcaagatctaaaa

SEQ ID NO: 739081 - DNA, 20 bp, Artificial
  CRISPR gRNA sequence
aaaatatcaagatctaaaag

SEQ ID NO: 739082 - DNA, 20 bp, Artificial
  CRISPR gRNA sequence
aaagctctcccttgagtgta

SEQ ID NO: 739083 - DNA, 20 bp, Artificial
  CRISPR gRNA sequence
tcccttgagtgtaggcaaaa

SEQ ID NO: 739084 - DNA, 20 bp, Artificial
  CRISPR gRNA sequence
ccttgagtgtaggcaaaaaa

SEQ ID NO: 739085 - DNA, 20 bp, Artificial
  CRISPR gRNA sequence
gagtgtaggcaaaaaagagt

SEQ ID NO: 739086 - DNA, 20 bp, Artificial
  CRISPR gRNA sequence
agtgtaggcaaaaaagagtg

SEQ ID NO: 739087 - DNA, 20 bp, Artificial
  CRISPR gRNA sequence
ccacatttattagatagaaa

SEQ ID NO: 739088 - DNA, 20 bp, Artificial
  CRISPR gRNA sequence
cacatttattagatagaaaa

SEQ ID NO: 739089 - DNA, 20 bp, Artificial
  CRISPR gRNA sequence
attagatagaaaagggaaag

SEQ ID NO: 739090 - DNA, 20 bp, Artificial
  CRISPR gRNA sequence
ttagatagaaaagggaaagg

SEQ ID NO: 739091 - DNA, 20 bp, Artificial
  CRISPR gRNA sequence
gatagaaaagggaaaggact

SEQ ID NO: 739092 - DNA, 20 bp, Artificial
  CRISPR gRNA sequence
agctaaagaccccggaaaag

SEQ ID NO: 739093 - DNA, 20 bp, Artificial
  CRISPR gRNA sequence
aagaccccggaaaaggcagc

SEQ ID NO: 739094 - DNA, 20 bp, Artificial
  CRISPR gRNA sequence
ttatgcaatttactatccat

SEQ ID NO: 739095 - DNA, 20 bp, Artificial
  CRISPR gRNA sequence
tgcaatttactatccatcct

SEQ ID NO: 739096 - DNA, 20 bp, Artificial
  CRISPR gRNA sequence
actatccatccttccccgtt

SEQ ID NO: 739097 - DNA, 20 bp, Artificial
  CRISPR gRNA sequence
ctatccatccttccccgttc

SEQ ID NO: 739098 - DNA, 20 bp, Artificial
  CRISPR gRNA sequence
tccatccttccccgttcacc

SEQ ID NO: 739099 - DNA, 20 bp, Artificial
  CRISPR gRNA sequence
ccccgttcacctaacccaat

SEQ ID NO: 739100 - DNA, 20 bp, Artificial
  CRISPR gRNA sequence
cccgttcacctaacccaatt

SEQ ID NO: 739101 - DNA, 20 bp, Artificial
  CRISPR gRNA sequence
acctaacccaattgcatctc

SEQ ID NO: 739102 - DNA, 20 bp, Artificial
  CRISPR gRNA sequence
acccaattgcatctccatct

SEQ ID NO: 739103 - DNA, 20 bp, Artificial
  CRISPR gRNA sequence
catctccatcttccacaggg

SEQ ID NO: 739104 - DNA, 20 bp, Artificial
  CRISPR gRNA sequence
catcttccacagggtctgaa

SEQ ID NO: 739105 - DNA, 20 bp, Artificial
  CRISPR gRNA sequence
ccacagggtctgaactaggg

SEQ ID NO: 739106 - DNA, 20 bp, Artificial
  CRISPR gRNA sequence
cacagggtctgaactaggga

SEQ ID NO: 739107 - DNA, 20 bp, Artificial
  CRISPR gRNA sequence
aactagggaaaatgctgtcg

SEQ ID NO: 739108 - DNA, 20 bp, Artificial
  CRISPR gRNA sequence
gggaaaatgctgtcgctaaa

SEQ ID NO: 739109 - DNA, 20 bp, Artificial
  CRISPR gRNA sequence
tcgctaaaatgtggagccaa

SEQ ID NO: 739110 - DNA, 20 bp, Artificial
  CRISPR gRNA sequence
aaatgtggagccaaatctca

SEQ ID NO: 739111 - DNA, 20 bp, Artificial
  CRISPR gRNA sequence
attgctcccctctccagttc

SEQ ID NO: 739112 - DNA, 20 bp, Artificial
  CRISPR gRNA sequence
ctcccctctccagttctgag

SEQ ID NO: 739113 - DNA, 20 bp, Artificial
  CRISPR gRNA sequence
ccctctccagttctgagtga

SEQ ID NO: 739114 - DNA, 20 bp, Artificial
  CRISPR gRNA sequence
tccagttctgagtgagaccc

SEQ ID NO: 739115 - DNA, 20 bp, Artificial
  CRISPR gRNA sequence
cagttctgagtgagacccag

SEQ ID NO: 739116 - DNA, 20 bp, Artificial
  CRISPR gRNA sequence
tgagtgagacccagggaagt

SEQ ID NO: 739117 - DNA, 20 bp, Artificial
  CRISPR gRNA sequence
agtgagacccagggaagtcg

SEQ ID NO: 739118 - DNA, 20 bp, Artificial
  CRISPR gRNA sequence
gttcactgaagtcttaatat

SEQ ID NO: 739119 - DNA, 20 bp, Artificial
  CRISPR gRNA sequence
actgaagtcttaatatttag

SEQ ID NO: 739120 - DNA, 20 bp, Artificial
  CRISPR gRNA sequence
aagtcttaatatttagggat

SEQ ID NO: 739121 - DNA, 20 bp, Artificial
  CRISPR gRNA sequence
aatatttagggatagaaaca

SEQ ID NO: 739122 - DNA, 20 bp, Artificial
  CRISPR gRNA sequence
atatttagggatagaaacat

SEQ ID NO: 739123 - DNA, 20 bp, Artificial
  CRISPR gRNA sequence
agggatagaaacattaaaca

SEQ ID NO: 739124 - DNA, 20 bp, Artificial
  CRISPR gRNA sequence
gggatagaaacattaaacat

SEQ ID NO: 739125 - DNA, 20 bp, Artificial
  CRISPR gRNA sequence
aacattatatgcttttattt

SEQ ID NO: 739126 - DNA, 20 bp, Artificial
  CRISPR gRNA sequence
tatgcttttattttttctca

SEQ ID NO: 739127 - DNA, 20 bp, Artificial
  CRISPR gRNA sequence
ttattttttctcatcatttc

SEQ ID NO: 739128 - DNA, 20 bp, Artificial
  CRISPR gRNA sequence
tattttttctcatcatttcc

SEQ ID NO: 739129 - DNA, 20 bp, Artificial
  CRISPR gRNA sequence
attttttctcatcatttcct

SEQ ID NO: 739130 - DNA, 20 bp, Artificial
  CRISPR gRNA sequence
ttttttctcatcatttcctc

SEQ ID NO: 739131 - DNA, 20 bp, Artificial
  CRISPR gRNA sequence
tttctcatcatttcctctaa

SEQ ID NO: 739132 - DNA, 20 bp, Artificial
  CRISPR gRNA sequence
ttctcatcatttcctctaat

SEQ ID NO: 739133 - DNA, 20 bp, Artificial
  CRISPR gRNA sequence
tctcatcatttcctctaatc

SEQ ID NO: 739134 - DNA, 20 bp, Artificial
  CRISPR gRNA sequence
ctcatcatttcctctaatca

SEQ ID NO: 739135 - DNA, 20 bp, Artificial
  CRISPR gRNA sequence
tcatcatttcctctaatcat

SEQ ID NO: 739136 - DNA, 20 bp, Artificial
  CRISPR gRNA sequence
atcatttcctctaatcatgt

SEQ ID NO: 739137 - DNA, 20 bp, Artificial
  CRISPR gRNA sequence
cctctaatcatgttatgtca

SEQ ID NO: 739138 - DNA, 20 bp, Artificial
  CRISPR gRNA sequence
ctctaatcatgttatgtcac

SEQ ID NO: 739139 - DNA, 20 bp, Artificial
  CRISPR gRNA sequence
taatcatgttatgtcacatc

SEQ ID NO: 739140 - DNA, 20 bp, Artificial
  CRISPR gRNA sequence
atcatgttatgtcacatctc

SEQ ID NO: 739141 - DNA, 20 bp, Artificial
  CRISPR gRNA sequence
tgtcacatctcactttccac

SEQ ID NO: 739142 - DNA, 20 bp, Artificial
  CRISPR gRNA sequence
actttccacctcttaaggac

SEQ ID NO: 739143 - DNA, 20 bp, Artificial
  CRISPR gRNA sequence
tccacctcttaaggacaatt

SEQ ID NO: 739144 - DNA, 20 bp, Artificial
  CRISPR gRNA sequence
ccacctcttaaggacaattt

SEQ ID NO: 739145 - DNA, 20 bp, Artificial
  CRISPR gRNA sequence
cacctcttaaggacaatttg

SEQ ID NO: 739146 - DNA, 20 bp, Artificial
  CRISPR gRNA sequence
ttaaggacaatttgtgaaga

SEQ ID NO: 739147 - DNA, 20 bp, Artificial
  CRISPR gRNA sequence
aaggacaatttgtgaagatt

SEQ ID NO: 739148 - DNA, 20 bp, Artificial
  CRISPR gRNA sequence
aggacaatttgtgaagattt

SEQ ID NO: 739149 - DNA, 20 bp, Artificial
  CRISPR gRNA sequence
gtgaagatttcaactttgca

SEQ ID NO: 739150 - DNA, 20 bp, Artificial
  CRISPR gRNA sequence
tgaagatttcaactttgcag

SEQ ID NO: 739151 - DNA, 20 bp, Artificial
  CRISPR gRNA sequence
caactttgcagaccttttct

SEQ ID NO: 739152 - DNA, 20 bp, Artificial
  CRISPR gRNA sequence
aactttgcagaccttttctg

SEQ ID NO: 739153 - DNA, 20 bp, Artificial
  CRISPR gRNA sequence
tgcagaccttttctgttatt

SEQ ID NO: 739154 - DNA, 20 bp, Artificial
  CRISPR gRNA sequence
gcagaccttttctgttatta

SEQ ID NO: 739155 - DNA, 20 bp, Artificial
  CRISPR gRNA sequence
cagaccttttctgttattag

SEQ ID NO: 739156 - DNA, 20 bp, Artificial
  CRISPR gRNA sequence
ttctgttattaggaaataaa

SEQ ID NO: 739157 - DNA, 20 bp, Artificial
  CRISPR gRNA sequence
tctgttattaggaaataaaa

SEQ ID NO: 739158 - DNA, 20 bp, Artificial
  CRISPR gRNA sequence
ctgttattaggaaataaaaa

SEQ ID NO: 739159 - DNA, 20 bp, Artificial
  CRISPR gRNA sequence
tgttattaggaaataaaaaa

SEQ ID NO: 739160 - DNA, 20 bp, Artificial
  CRISPR gRNA sequence
ttattaggaaataaaaaaaa

SEQ ID NO: 739161 - DNA, 20 bp, Artificial
  CRISPR gRNA sequence
ttaggaaataaaaaaaatcc

SEQ ID NO: 739162 - DNA, 20 bp, Artificial
  CRISPR gRNA sequence
ggaaataaaaaaaatcctta

SEQ ID NO: 739163 - DNA, 20 bp, Artificial
  CRISPR gRNA sequence
attccaactacaaactctgg

SEQ ID NO: 739164 - DNA, 20 bp, Artificial
  CRISPR gRNA sequence
ttccaactacaaactctggt

SEQ ID NO: 739165 - DNA, 20 bp, Artificial
  CRISPR gRNA sequence
caactacaaactctggtcat

SEQ ID NO: 739166 - DNA, 20 bp, Artificial
  CRISPR gRNA sequence
caaactctggtcatctagca

SEQ ID NO: 739167 - DNA, 20 bp, Artificial
  CRISPR gRNA sequence
tggtcatctagcagtatagg

SEQ ID NO: 739168 - DNA, 20 bp, Artificial
  CRISPR gRNA sequence
gtcatctagcagtataggat

SEQ ID NO: 739169 - DNA, 20 bp, Artificial
  CRISPR gRNA sequence
gcagtataggatattccact

SEQ ID NO: 739170 - DNA, 20 bp, Artificial
  CRISPR gRNA sequence
cactgccccctgaagaccag

SEQ ID NO: 739171 - DNA, 20 bp, Artificial
  CRISPR gRNA sequence
ccccctgaagaccaggtttt

SEQ ID NO: 739172 - DNA, 20 bp, Artificial
  CRISPR gRNA sequence
aagaccaggttttatggtcc

SEQ ID NO: 739173 - DNA, 20 bp, Artificial
  CRISPR gRNA sequence
tatggtccaaggcatctaaa

SEQ ID NO: 739174 - DNA, 20 bp, Artificial
  CRISPR gRNA sequence
atggtccaaggcatctaaag

SEQ ID NO: 739175 - DNA, 20 bp, Artificial
  CRISPR gRNA sequence
tggtccaaggcatctaaagt

SEQ ID NO: 739176 - DNA, 20 bp, Artificial
  CRISPR gRNA sequence
aagtggagaaggaaagttac

SEQ ID NO: 739177 - DNA, 20 bp, Artificial
  CRISPR gRNA sequence
ctggctgcccagctccccat

SEQ ID NO: 739178 - DNA, 20 bp, Artificial
  CRISPR gRNA sequence
gctgcccagctccccatcct

SEQ ID NO: 739179 - DNA, 20 bp, Artificial
  CRISPR gRNA sequence
cccagctccccatcctgcat

SEQ ID NO: 739180 - DNA, 20 bp, Artificial
  CRISPR gRNA sequence
cccatcctgcatcttgggct

SEQ ID NO: 739181 - DNA, 20 bp, Artificial
  CRISPR gRNA sequence
catcttgggctgtgaagaag

SEQ ID NO: 739182 - DNA, 20 bp, Artificial
  CRISPR gRNA sequence
gggctgtgaagaaggcgggg

SEQ ID NO: 739183 - DNA, 20 bp, Artificial
  CRISPR gRNA sequence
ggctgtgaagaaggcggggt

SEQ ID NO: 739184 - DNA, 20 bp, Artificial
  CRISPR gRNA sequence
tgaagaaggcggggttcctc

SEQ ID NO: 739185 - DNA, 20 bp, Artificial
  CRISPR gRNA sequence
ctcttggttacctcttcttg

SEQ ID NO: 739186 - DNA, 20 bp, Artificial
  CRISPR gRNA sequence
ttggttacctcttcttggcc

SEQ ID NO: 739187 - DNA, 20 bp, Artificial
  CRISPR gRNA sequence
ggttacctcttcttggccct

SEQ ID NO: 739188 - DNA, 20 bp, Artificial
  CRISPR gRNA sequence
gttacctcttcttggccctc

SEQ ID NO: 739189 - DNA, 20 bp, Artificial
  CRISPR gRNA sequence
cctcttcttggccctcttag

SEQ ID NO: 739190 - DNA, 20 bp, Artificial
  CRISPR gRNA sequence
ttcttggccctcttagtgtg

SEQ ID NO: 739191 - DNA, 20 bp, Artificial
  CRISPR gRNA sequence
cttggccctcttagtgtgtt

SEQ ID NO: 739192 - DNA, 20 bp, Artificial
  CRISPR gRNA sequence
ttggccctcttagtgtgttg

SEQ ID NO: 739193 - DNA, 20 bp, Artificial
  CRISPR gRNA sequence
ggccctcttagtgtgttgat

SEQ ID NO: 739194 - DNA, 20 bp, Artificial
  CRISPR gRNA sequence
gccctcttagtgtgttgatg

SEQ ID NO: 739195 - DNA, 20 bp, Artificial
  CRISPR gRNA sequence
ttagtgtgttgatgcaggaa

SEQ ID NO: 739196 - DNA, 20 bp, Artificial
  CRISPR gRNA sequence
agtgtgttgatgcaggaatg

SEQ ID NO: 739197 - DNA, 20 bp, Artificial
  CRISPR gRNA sequence
gtgtgttgatgcaggaatga

SEQ ID NO: 739198 - DNA, 20 bp, Artificial
  CRISPR gRNA sequence
atgcaggaatgagggagggg

SEQ ID NO: 739199 - DNA, 20 bp, Artificial
  CRISPR gRNA sequence
tgtggcttaactgagtgttg

SEQ ID NO: 739200 - DNA, 20 bp, Artificial
  CRISPR gRNA sequence
aactgagtgttgtaggaatg

SEQ ID NO: 739201 - DNA, 20 bp, Artificial
  CRISPR gRNA sequence
actgagtgttgtaggaatgc

SEQ ID NO: 739202 - DNA, 20 bp, Artificial
  CRISPR gRNA sequence
agtgttgtaggaatgctttc

SEQ ID NO: 739203 - DNA, 20 bp, Artificial
  CRISPR gRNA sequence
taggaatgctttccctgttg

SEQ ID NO: 739204 - DNA, 20 bp, Artificial
  CRISPR gRNA sequence
tccctgttggatgtcattgc

SEQ ID NO: 739205 - DNA, 20 bp, Artificial
  CRISPR gRNA sequence
ccctgttggatgtcattgct

SEQ ID NO: 739206 - DNA, 20 bp, Artificial
  CRISPR gRNA sequence
cctgttggatgtcattgctt

SEQ ID NO: 739207 - DNA, 20 bp, Artificial
  CRISPR gRNA sequence
ttggatgtcattgcttgtct

SEQ ID NO: 739208 - DNA, 20 bp, Artificial
  CRISPR gRNA sequence
gatgtcattgcttgtctgcc

SEQ ID NO: 739209 - DNA, 20 bp, Artificial
  CRISPR gRNA sequence
cttgtctgccagccctttga

SEQ ID NO: 739210 - DNA, 20 bp, Artificial
  CRISPR gRNA sequence
gtctgccagccctttgagat

SEQ ID NO: 739211 - DNA, 20 bp, Artificial
  CRISPR gRNA sequence
tctgccagccctttgagatc

SEQ ID NO: 739212 - DNA, 20 bp, Artificial
  CRISPR gRNA sequence
ccagccctttgagatcctct

SEQ ID NO: 739213 - DNA, 20 bp, Artificial
  CRISPR gRNA sequence
tgagatcctctctgagtgtc

SEQ ID NO: 739214 - DNA, 20 bp, Artificial
  CRISPR gRNA sequence
gagatcctctctgagtgtcc

SEQ ID NO: 739215 - DNA, 20 bp, Artificial
  CRISPR gRNA sequence
agatcctctctgagtgtcca

SEQ ID NO: 739216 - DNA, 20 bp, Artificial
  CRISPR gRNA sequence
tctgagtgtccatatactct

SEQ ID NO: 739217 - DNA, 20 bp, Artificial
  CRISPR gRNA sequence
tgagtgtccatatactctcc

SEQ ID NO: 739218 - DNA, 20 bp, Artificial
  CRISPR gRNA sequence
agtgtccatatactctccca

SEQ ID NO: 739219 - DNA, 20 bp, Artificial
  CRISPR gRNA sequence
tcccaaggcactgatgtgtg

SEQ ID NO: 739220 - DNA, 20 bp, Artificial
  CRISPR gRNA sequence
ccaaggcactgatgtgtgaa

SEQ ID NO: 739221 - DNA, 20 bp, Artificial
  CRISPR gRNA sequence
atgtgtgaattctctgaaga

SEQ ID NO: 739222 - DNA, 20 bp, Artificial
  CRISPR gRNA sequence
tctgaagagttctttggggg

SEQ ID NO: 739223 - DNA, 20 bp, Artificial
  CRISPR gRNA sequence
tgaagagttctttgggggtg

SEQ ID NO: 739224 - DNA, 20 bp, Artificial
  CRISPR gRNA sequence
aagagttctttgggggtgtc

SEQ ID NO: 739225 - DNA, 20 bp, Artificial
  CRISPR gRNA sequence
tttgggggtgtccccactgc

SEQ ID NO: 739226 - DNA, 20 bp, Artificial
  CRISPR gRNA sequence
tgggggtgtccccactgctg

SEQ ID NO: 739227 - DNA, 20 bp, Artificial
  CRISPR gRNA sequence
gggggtgtccccactgctga

SEQ ID NO: 739228 - DNA, 20 bp, Artificial
  CRISPR gRNA sequence
ggggtgtccccactgctgag

SEQ ID NO: 739229 - DNA, 20 bp, Artificial
  CRISPR gRNA sequence
ctgagtatgatgttgtggga

SEQ ID NO: 739230 - DNA, 20 bp, Artificial
  CRISPR gRNA sequence
agtatgatgttgtgggagct

SEQ ID NO: 739231 - DNA, 20 bp, Artificial
  CRISPR gRNA sequence
tgggagctctgactccaggt

SEQ ID NO: 739232 - DNA, 20 bp, Artificial
  CRISPR gRNA sequence
tgactccaggtgagcgtctt

SEQ ID NO: 739233 - DNA, 20 bp, Artificial
  CRISPR gRNA sequence
actccaggtgagcgtcttcc

SEQ ID NO: 739234 - DNA, 20 bp, Artificial
  CRISPR gRNA sequence
caggtgagcgtcttcctcta

SEQ ID NO: 739235 - DNA, 20 bp, Artificial
  CRISPR gRNA sequence
cctctattcccatcctcacc

SEQ ID NO: 739236 - DNA, 20 bp, Artificial
  CRISPR gRNA sequence
ctctattcccatcctcacca

SEQ ID NO: 739237 - DNA, 20 bp, Artificial
  CRISPR gRNA sequence
tattcccatcctcaccaatg

SEQ ID NO: 739238 - DNA, 20 bp, Artificial
  CRISPR gRNA sequence
ttcccatcctcaccaatgct

SEQ ID NO: 739239 - DNA, 20 bp, Artificial
  CRISPR gRNA sequence
ccatcctcaccaatgctgct

SEQ ID NO: 739240 - DNA, 20 bp, Artificial
  CRISPR gRNA sequence
accaatgctgcttgttctgg

SEQ ID NO: 739241 - DNA, 20 bp, Artificial
  CRISPR gRNA sequence
cttgttctgggtccccttct

SEQ ID NO: 739242 - DNA, 20 bp, Artificial
  CRISPR gRNA sequence
gttctgggtccccttctcca

SEQ ID NO: 739243 - DNA, 20 bp, Artificial
  CRISPR gRNA sequence
ttctgggtccccttctccag

SEQ ID NO: 739244 - DNA, 20 bp, Artificial
  CRISPR gRNA sequence
tgggtccccttctccagaaa

SEQ ID NO: 739245 - DNA, 20 bp, Artificial
  CRISPR gRNA sequence
ggtccccttctccagaaaaa

SEQ ID NO: 739246 - DNA, 20 bp, Artificial
  CRISPR gRNA sequence
ctccagaaaaatggctcaag

SEQ ID NO: 739247 - DNA, 20 bp, Artificial
  CRISPR gRNA sequence
tccagaaaaatggctcaagc

SEQ ID NO: 739248 - DNA, 20 bp, Artificial
  CRISPR gRNA sequence
cagaaaaatggctcaagctc

SEQ ID NO: 739249 - DNA, 20 bp, Artificial
  CRISPR gRNA sequence
aagctcagccaccttccatg

SEQ ID NO: 739250 - DNA, 20 bp, Artificial
  CRISPR gRNA sequence
agccaccttccatgatgaca

SEQ ID NO: 739251 - DNA, 20 bp, Artificial
  CRISPR gRNA sequence
ccatgatgacaatttggccc

SEQ ID NO: 739252 - DNA, 20 bp, Artificial
  CRISPR gRNA sequence
catgatgacaatttggccct

SEQ ID NO: 739253 - DNA, 20 bp, Artificial
  CRISPR gRNA sequence
ggcccttaggaaattgccct

SEQ ID NO: 739254 - DNA, 20 bp, Artificial
  CRISPR gRNA sequence
gcccttaggaaattgccctt

SEQ ID NO: 739255 - DNA, 20 bp, Artificial
  CRISPR gRNA sequence
aggaaattgccctttccatg

SEQ ID NO: 739256 - DNA, 20 bp, Artificial
  CRISPR gRNA sequence
ggaaattgccctttccatgc

SEQ ID NO: 739257 - DNA, 20 bp, Artificial
  CRISPR gRNA sequence
ccctttccatgcacagtagt

SEQ ID NO: 739258 - DNA, 20 bp, Artificial
  CRISPR gRNA sequence
tccatgcacagtagtgggat

SEQ ID NO: 739259 - DNA, 20 bp, Artificial
  CRISPR gRNA sequence
ccatgcacagtagtgggatg

SEQ ID NO: 739260 - DNA, 20 bp, Artificial
  CRISPR gRNA sequence
catgcacagtagtgggatgt

SEQ ID NO: 739261 - DNA, 20 bp, Artificial
  CRISPR gRNA sequence
tgtctccaattttcacattc

SEQ ID NO: 739262 - DNA, 20 bp, Artificial
  CRISPR gRNA sequence
tctccaattttcacattcca

SEQ ID NO: 739263 - DNA, 20 bp, Artificial
  CRISPR gRNA sequence
caattttcacattccatgct

SEQ ID NO: 739264 - DNA, 20 bp, Artificial
  CRISPR gRNA sequence
tcacattccatgctgagata

SEQ ID NO: 739265 - DNA, 20 bp, Artificial
  CRISPR gRNA sequence
cacattccatgctgagataa

SEQ ID NO: 739266 - DNA, 20 bp, Artificial
  CRISPR gRNA sequence
acattccatgctgagataaa

SEQ ID NO: 739267 - DNA, 20 bp, Artificial
  CRISPR gRNA sequence
catgctgagataaaaccatc

SEQ ID NO: 739268 - DNA, 20 bp, Artificial
  CRISPR gRNA sequence
agataaaaccatcactcact

SEQ ID NO: 739269 - DNA, 20 bp, Artificial
  CRISPR gRNA sequence
actgctaggttgatgcctca

SEQ ID NO: 739270 - DNA, 20 bp, Artificial
  CRISPR gRNA sequence
ctaggttgatgcctcacagc

SEQ ID NO: 739271 - DNA, 20 bp, Artificial
  CRISPR gRNA sequence
ggttgatgcctcacagctcc

SEQ ID NO: 739272 - DNA, 20 bp, Artificial
  CRISPR gRNA sequence
atgcctcacagctcctccac

SEQ ID NO: 739273 - DNA, 20 bp, Artificial
  CRISPR gRNA sequence
acagctcctccacctccctc

SEQ ID NO: 739274 - DNA, 20 bp, Artificial
  CRISPR gRNA sequence
ctccacctccctcctcatcc

SEQ ID NO: 739275 - DNA, 20 bp, Artificial
  CRISPR gRNA sequence
cacctccctcctcatccact

SEQ ID NO: 739276 - DNA, 20 bp, Artificial
  CRISPR gRNA sequence
cctcctcatccactgtccaa

SEQ ID NO: 739277 - DNA, 20 bp, Artificial
  CRISPR gRNA sequence
ctcatccactgtccaaaacc

SEQ ID NO: 739278 - DNA, 20 bp, Artificial
  CRISPR gRNA sequence
atccactgtccaaaacccag

SEQ ID NO: 739279 - DNA, 20 bp, Artificial
  CRISPR gRNA sequence
tccaaaacccaggcttcttc

SEQ ID NO: 739280 - DNA, 20 bp, Artificial
  CRISPR gRNA sequence
cttctagaaaatgggatgga

SEQ ID NO: 739281 - DNA, 20 bp, Artificial
  CRISPR gRNA sequence
ttctagaaaatgggatggaa

SEQ ID NO: 739282 - DNA, 20 bp, Artificial
  CRISPR gRNA sequence
ctagaaaatgggatggaaaa

SEQ ID NO: 739283 - DNA, 20 bp, Artificial
  CRISPR gRNA sequence
tagaaaatgggatggaaaag

SEQ ID NO: 739284 - DNA, 20 bp, Artificial
  CRISPR gRNA sequence
gaaaatgggatggaaaaggg

SEQ ID NO: 739285 - DNA, 20 bp, Artificial
  CRISPR gRNA sequence
ggttgatgggtgagtgtagc

SEQ ID NO: 739286 - DNA, 20 bp, Artificial
  CRISPR gRNA sequence
atgggtgagtgtagcaggac

SEQ ID NO: 739287 - DNA, 20 bp, Artificial
  CRISPR gRNA sequence
gatatctcttagtgagcccc

SEQ ID NO: 739288 - DNA, 20 bp, Artificial
  CRISPR gRNA sequence
atatctcttagtgagccccc

SEQ ID NO: 739289 - DNA, 20 bp, Artificial
  CRISPR gRNA sequence
ttagtgagcccccaaggaaa

SEQ ID NO: 739290 - DNA, 20 bp, Artificial
  CRISPR gRNA sequence
agtgagcccccaaggaaagt

SEQ ID NO: 739291 - DNA, 20 bp, Artificial
  CRISPR gRNA sequence
gtgagcccccaaggaaagtg

SEQ ID NO: 739292 - DNA, 20 bp, Artificial
  CRISPR gRNA sequence
accccaactgactgcagctt

SEQ ID NO: 739293 - DNA, 20 bp, Artificial
  CRISPR gRNA sequence
actgcagctttctttggaat

SEQ ID NO: 739294 - DNA, 20 bp, Artificial
  CRISPR gRNA sequence
cagctttctttggaatttga

SEQ ID NO: 739295 - DNA, 20 bp, Artificial
  CRISPR gRNA sequence
tctttggaatttgaggacct

SEQ ID NO: 739296 - DNA, 20 bp, Artificial
  CRISPR gRNA sequence
ctttggaatttgaggacctt

SEQ ID NO: 739297 - DNA, 20 bp, Artificial
  CRISPR gRNA sequence
tttggaatttgaggaccttg

SEQ ID NO: 739298 - DNA, 20 bp, Artificial
  CRISPR gRNA sequence
tggaatttgaggaccttgat

SEQ ID NO: 739299 - DNA, 20 bp, Artificial
  CRISPR gRNA sequence
ggaatttgaggaccttgatg

SEQ ID NO: 739300 - DNA, 20 bp, Artificial
  CRISPR gRNA sequence
gaatttgaggaccttgatgc

SEQ ID NO: 739301 - DNA, 20 bp, Artificial
  CRISPR gRNA sequence
gaggaccttgatgcctcctt

SEQ ID NO: 739302 - DNA, 20 bp, Artificial
  CRISPR gRNA sequence
aggaccttgatgcctccttg

SEQ ID NO: 739303 - DNA, 20 bp, Artificial
  CRISPR gRNA sequence
gatgcctccttgtcctcatc

SEQ ID NO: 739304 - DNA, 20 bp, Artificial
  CRISPR gRNA sequence
atgcctccttgtcctcatct

SEQ ID NO: 739305 - DNA, 20 bp, Artificial
  CRISPR gRNA sequence
cttgtcctcatctctggacc

SEQ ID NO: 739306 - DNA, 20 bp, Artificial
  CRISPR gRNA sequence
gtcctcatctctggacccta

SEQ ID NO: 739307 - DNA, 20 bp, Artificial
  CRISPR gRNA sequence
tcctcatctctggaccctac

SEQ ID NO: 739308 - DNA, 20 bp, Artificial
  CRISPR gRNA sequence
atctctggaccctacttgtc

SEQ ID NO: 739309 - DNA, 20 bp, Artificial
  CRISPR gRNA sequence
tggaccctacttgtcaatta

SEQ ID NO: 739310 - DNA, 20 bp, Artificial
  CRISPR gRNA sequence
gaccctacttgtcaattatg

SEQ ID NO: 739311 - DNA, 20 bp, Artificial
  CRISPR gRNA sequence
cttgtcaattatggaatagc

SEQ ID NO: 739312 - DNA, 20 bp, Artificial
  CRISPR gRNA sequence
gtcaattatggaatagctgg

SEQ ID NO: 739313 - DNA, 20 bp, Artificial
  CRISPR gRNA sequence
tcaattatggaatagctgga

SEQ ID NO: 739314 - DNA, 20 bp, Artificial
  CRISPR gRNA sequence
tggaatagctggaaaagttc

SEQ ID NO: 739315 - DNA, 20 bp, Artificial
  CRISPR gRNA sequence
gaaaagttcttgtttgacat

SEQ ID NO: 739316 - DNA, 20 bp, Artificial
  CRISPR gRNA sequence
ttgtttgacattattttatg

SEQ ID NO: 739317 - DNA, 20 bp, Artificial
  CRISPR gRNA sequence
gtttgacattattttatgga

SEQ ID NO: 739318 - DNA, 20 bp, Artificial
  CRISPR gRNA sequence
tttgacattattttatggaa

SEQ ID NO: 739319 - DNA, 20 bp, Artificial
  CRISPR gRNA sequence
gacattattttatggaaatc

SEQ ID NO: 739320 - DNA, 20 bp, Artificial
  CRISPR gRNA sequence
acattattttatggaaatct

SEQ ID NO: 739321 - DNA, 20 bp, Artificial
  CRISPR gRNA sequence
ttttatggaaatctttttgg

SEQ ID NO: 739322 - DNA, 20 bp, Artificial
  CRISPR gRNA sequence
tatggaaatctttttggccc

SEQ ID NO: 739323 - DNA, 20 bp, Artificial
  CRISPR gRNA sequence
atggaaatctttttggccca

SEQ ID NO: 739324 - DNA, 20 bp, Artificial
  CRISPR gRNA sequence
tggaaatctttttggcccat

SEQ ID NO: 739325 - DNA, 20 bp, Artificial
  CRISPR gRNA sequence
tttggcccataggaacgaag

SEQ ID NO: 739326 - DNA, 20 bp, Artificial
  CRISPR gRNA sequence
ttggcccataggaacgaaga

SEQ ID NO: 739327 - DNA, 20 bp, Artificial
  CRISPR gRNA sequence
tggcccataggaacgaagag

SEQ ID NO: 739328 - DNA, 20 bp, Artificial
  CRISPR gRNA sequence
ggcccataggaacgaagagg

SEQ ID NO: 739329 - DNA, 20 bp, Artificial
  CRISPR gRNA sequence
gcccataggaacgaagaggg

SEQ ID NO: 739330 - DNA, 20 bp, Artificial
  CRISPR gRNA sequence
gaaagtgaaaagagagagat

SEQ ID NO: 739331 - DNA, 20 bp, Artificial
  CRISPR gRNA sequence
acacgggagggaaaaagaaa

SEQ ID NO: 739332 - DNA, 20 bp, Artificial
  CRISPR gRNA sequence
tggtagtctctcccttcttc

SEQ ID NO: 739333 - DNA, 20 bp, Artificial
  CRISPR gRNA sequence
tcccttcttcagtacaccta

SEQ ID NO: 739334 - DNA, 20 bp, Artificial
  CRISPR gRNA sequence
ccttcttcagtacacctact

SEQ ID NO: 739335 - DNA, 20 bp, Artificial
  CRISPR gRNA sequence
cttcagtacacctacttcct

SEQ ID NO: 739336 - DNA, 20 bp, Artificial
  CRISPR gRNA sequence
ttcagtacacctacttcctt

SEQ ID NO: 739337 - DNA, 20 bp, Artificial
  CRISPR gRNA sequence
cagtacacctacttccttcc

SEQ ID NO: 739338 - DNA, 20 bp, Artificial
  CRISPR gRNA sequence
agtacacctacttccttcct

SEQ ID NO: 739339 - DNA, 20 bp, Artificial
  CRISPR gRNA sequence
cttccttcctcctgatatca

SEQ ID NO: 739340 - DNA, 20 bp, Artificial
  CRISPR gRNA sequence
ccttcctcctgatatcactt

SEQ ID NO: 739341 - DNA, 20 bp, Artificial
  CRISPR gRNA sequence
cttcctcctgatatcacttt

SEQ ID NO: 739342 - DNA, 20 bp, Artificial
  CRISPR gRNA sequence
cctcctgatatcactttctg

SEQ ID NO: 739343 - DNA, 20 bp, Artificial
  CRISPR gRNA sequence
ctcctgatatcactttctga

SEQ ID NO: 739344 - DNA, 20 bp, Artificial
  CRISPR gRNA sequence
ctgatatcactttctgaaca

SEQ ID NO: 739345 - DNA, 20 bp, Artificial
  CRISPR gRNA sequence
atatcactttctgaacaaat

SEQ ID NO: 739346 - DNA, 20 bp, Artificial
  CRISPR gRNA sequence
tctgaacaaatacacatctg

SEQ ID NO: 739347 - DNA, 20 bp, Artificial
  CRISPR gRNA sequence
ctgaacaaatacacatctga

SEQ ID NO: 739348 - DNA, 20 bp, Artificial
  CRISPR gRNA sequence
tgaacaaatacacatctgat

SEQ ID NO: 739349 - DNA, 20 bp, Artificial
  CRISPR gRNA sequence
aacaaatacacatctgatca

SEQ ID NO: 739350 - DNA, 20 bp, Artificial
  CRISPR gRNA sequence
atcactcagcagccagaatc

SEQ ID NO: 739351 - DNA, 20 bp, Artificial
  CRISPR gRNA sequence
agcagccagaatcctaggcc

SEQ ID NO: 739352 - DNA, 20 bp, Artificial
  CRISPR gRNA sequence
ggcccaaggtcaaggagaag

SEQ ID NO: 739353 - DNA, 20 bp, Artificial
  CRISPR gRNA sequence
ccaggcaactgtgtgggttg

SEQ ID NO: 739354 - DNA, 20 bp, Artificial
  CRISPR gRNA sequence
caggcaactgtgtgggttgc

SEQ ID NO: 739355 - DNA, 20 bp, Artificial
  CRISPR gRNA sequence
tgtgggttgccaggatctgc

SEQ ID NO: 739356 - DNA, 20 bp, Artificial
  CRISPR gRNA sequence
ccaggatctgctcccagcac

SEQ ID NO: 739357 - DNA, 20 bp, Artificial
  CRISPR gRNA sequence
ctcccagcactgaggcaccc

SEQ ID NO: 739358 - DNA, 20 bp, Artificial
  CRISPR gRNA sequence
ccagcactgaggcacccaag

SEQ ID NO: 739359 - DNA, 20 bp, Artificial
  CRISPR gRNA sequence
aggcacccaagtcaatctaa

SEQ ID NO: 739360 - DNA, 20 bp, Artificial
  CRISPR gRNA sequence
acgttcctccctttctgtct

SEQ ID NO: 739361 - DNA, 20 bp, Artificial
  CRISPR gRNA sequence
ctccctttctgtctttcagc

SEQ ID NO: 739362 - DNA, 20 bp, Artificial
  CRISPR gRNA sequence
cctttctgtctttcagctcc

SEQ ID NO: 739363 - DNA, 20 bp, Artificial
  CRISPR gRNA sequence
tctgtctttcagctccccaa

SEQ ID NO: 739364 - DNA, 20 bp, Artificial
  CRISPR gRNA sequence
ctgtctttcagctccccaaa

SEQ ID NO: 739365 - DNA, 20 bp, Artificial
  CRISPR gRNA sequence
tgtctttcagctccccaaac

SEQ ID NO: 739366 - DNA, 20 bp, Artificial
  CRISPR gRNA sequence
tctttcagctccccaaactg

SEQ ID NO: 739367 - DNA, 20 bp, Artificial
  CRISPR gRNA sequence
tcagctccccaaactgagag

SEQ ID NO: 739368 - DNA, 20 bp, Artificial
  CRISPR gRNA sequence
cagctccccaaactgagagg

SEQ ID NO: 739369 - DNA, 20 bp, Artificial
  CRISPR gRNA sequence
agctccccaaactgagagga

SEQ ID NO: 739370 - DNA, 20 bp, Artificial
  CRISPR gRNA sequence
cccaaactgagaggaacatt

SEQ ID NO: 739371 - DNA, 20 bp, Artificial
  CRISPR gRNA sequence
agaggaacattcctttcaca

SEQ ID NO: 739372 - DNA, 20 bp, Artificial
  CRISPR gRNA sequence
ctttcacacatctggacaac

SEQ ID NO: 739373 - DNA, 20 bp, Artificial
  CRISPR gRNA sequence
tcacacatctggacaacatc

SEQ ID NO: 739374 - DNA, 20 bp, Artificial
  CRISPR gRNA sequence
cacacatctggacaacatcc

SEQ ID NO: 739375 - DNA, 20 bp, Artificial
  CRISPR gRNA sequence
acacatctggacaacatcct

SEQ ID NO: 739376 - DNA, 20 bp, Artificial
  CRISPR gRNA sequence
gacaacatcctcaagagtgg

SEQ ID NO: 739377 - DNA, 20 bp, Artificial
  CRISPR gRNA sequence
aagagtggaactgtcacaac

SEQ ID NO: 739378 - DNA, 20 bp, Artificial
  CRISPR gRNA sequence
tcacaactggccaagcccct

SEQ ID NO: 739379 - DNA, 20 bp, Artificial
  CRISPR gRNA sequence
gccaagcccctacctcaggc

SEQ ID NO: 739380 - DNA, 20 bp, Artificial
  CRISPR gRNA sequence
cctcaggccctgatgcccct

SEQ ID NO: 739381 - DNA, 20 bp, Artificial
  CRISPR gRNA sequence
aggccctgatgcccctttta

SEQ ID NO: 739382 - DNA, 20 bp, Artificial
  CRISPR gRNA sequence
atgccccttttaccactggt

SEQ ID NO: 739383 - DNA, 20 bp, Artificial
  CRISPR gRNA sequence
ttaccactggtgtgatggtg

SEQ ID NO: 739384 - DNA, 20 bp, Artificial
  CRISPR gRNA sequence
taccactggtgtgatggtgt

SEQ ID NO: 739385 - DNA, 20 bp, Artificial
  CRISPR gRNA sequence
accactggtgtgatggtgtt

SEQ ID NO: 739386 - DNA, 20 bp, Artificial
  CRISPR gRNA sequence
ccactggtgtgatggtgttc

SEQ ID NO: 739387 - DNA, 20 bp, Artificial
  CRISPR gRNA sequence
gtgtgatggtgttcacccca

SEQ ID NO: 739388 - DNA, 20 bp, Artificial
  CRISPR gRNA sequence
accccaggactcatcacctt

SEQ ID NO: 739389 - DNA, 20 bp, Artificial
  CRISPR gRNA sequence
atcaccttgcctaggctctt

SEQ ID NO: 739390 - DNA, 20 bp, Artificial
  CRISPR gRNA sequence
gcctaggctcttagcctcca

SEQ ID NO: 739391 - DNA, 20 bp, Artificial
  CRISPR gRNA sequence
cctaggctcttagcctccac

SEQ ID NO: 739392 - DNA, 20 bp, Artificial
  CRISPR gRNA sequence
ggctcttagcctccaccaga

SEQ ID NO: 739393 - DNA, 20 bp, Artificial
  CRISPR gRNA sequence
ttagcctccaccagacctgc

SEQ ID NO: 739394 - DNA, 20 bp, Artificial
  CRISPR gRNA sequence
agcctccaccagacctgcct

SEQ ID NO: 739395 - DNA, 20 bp, Artificial
  CRISPR gRNA sequence
gcctccaccagacctgcctc

SEQ ID NO: 739396 - DNA, 20 bp, Artificial
  CRISPR gRNA sequence
caccagacctgcctccaaga

SEQ ID NO: 739397 - DNA, 20 bp, Artificial
  CRISPR gRNA sequence
cctccaagacaggctacagc

SEQ ID NO: 739398 - DNA, 20 bp, Artificial
  CRISPR gRNA sequence
caagacaggctacagcttca

SEQ ID NO: 739399 - DNA, 20 bp, Artificial
  CRISPR gRNA sequence
cagcttcactgctaccagca

SEQ ID NO: 739400 - DNA, 20 bp, Artificial
  CRISPR gRNA sequence
cactgctaccagcaccacca

SEQ ID NO: 739401 - DNA, 20 bp, Artificial
  CRISPR gRNA sequence
actgctaccagcaccaccag

SEQ ID NO: 739402 - DNA, 20 bp, Artificial
  CRISPR gRNA sequence
ctaccagcaccaccagccag

SEQ ID NO: 739403 - DNA, 20 bp, Artificial
  CRISPR gRNA sequence
ccagcaccaccagccaggga

SEQ ID NO: 739404 - DNA, 20 bp, Artificial
  CRISPR gRNA sequence
ccagcaatgccagggactcc

SEQ ID NO: 739405 - DNA, 20 bp, Artificial
  CRISPR gRNA sequence
ctctgctggcccagaatcca

SEQ ID NO: 739406 - DNA, 20 bp, Artificial
  CRISPR gRNA sequence
tgctggcccagaatccatct

SEQ ID NO: 739407 - DNA, 20 bp, Artificial
  CRISPR gRNA sequence
ctggcccagaatccatctcc

SEQ ID NO: 739408 - DNA, 20 bp, Artificial
  CRISPR gRNA sequence
gcccagaatccatctccact

SEQ ID NO: 739409 - DNA, 20 bp, Artificial
  CRISPR gRNA sequence
cactaagtctggggacctca

SEQ ID NO: 739410 - DNA, 20 bp, Artificial
  CRISPR gRNA sequence
agtctggggacctcagcacc

SEQ ID NO: 739411 - DNA, 20 bp, Artificial
  CRISPR gRNA sequence
gggacctcagcaccagatcg

SEQ ID NO: 739412 - DNA, 20 bp, Artificial
  CRISPR gRNA sequence
agcaccagatcgcccaccac

SEQ ID NO: 739413 - DNA, 20 bp, Artificial
  CRISPR gRNA sequence
tgcctcaccagcagatctct

SEQ ID NO: 739414 - DNA, 20 bp, Artificial
  CRISPR gRNA sequence
cctcaccagcagatctctcc

SEQ ID NO: 739415 - DNA, 20 bp, Artificial
  CRISPR gRNA sequence
accagcagatctctcctcaa

SEQ ID NO: 739416 - DNA, 20 bp, Artificial
  CRISPR gRNA sequence
tcctcaacagactaccctcc

SEQ ID NO: 739417 - DNA, 20 bp, Artificial
  CRISPR gRNA sequence
ctcaacagactaccctccat

SEQ ID NO: 739418 - DNA, 20 bp, Artificial
  CRISPR gRNA sequence
aacagactaccctccatgcc

SEQ ID NO: 739419 - DNA, 20 bp, Artificial
  CRISPR gRNA sequence
ccctccatgccctccatcag

SEQ ID NO: 739420 - DNA, 20 bp, Artificial
  CRISPR gRNA sequence
catgccctccatcaggtacc

SEQ ID NO: 739421 - DNA, 20 bp, Artificial
  CRISPR gRNA sequence
catcaggtacctgtggggcc

SEQ ID NO: 739422 - DNA, 20 bp, Artificial
  CRISPR gRNA sequence
tggggcctggggttgagtgg

SEQ ID NO: 739423 - DNA, 20 bp, Artificial
  CRISPR gRNA sequence
gggttgagtggcaccagcac

SEQ ID NO: 739424 - DNA, 20 bp, Artificial
  CRISPR gRNA sequence
agtggcaccagcacttagtg

SEQ ID NO: 739425 - DNA, 20 bp, Artificial
  CRISPR gRNA sequence
agtgcccaaacagacctgga

SEQ ID NO: 739426 - DNA, 20 bp, Artificial
  CRISPR gRNA sequence
gtgcccaaacagacctggag

SEQ ID NO: 739427 - DNA, 20 bp, Artificial
  CRISPR gRNA sequence
gaggtgcaagtcttatatct

SEQ ID NO: 739428 - DNA, 20 bp, Artificial
  CRISPR gRNA sequence
atatctgaccttcccctttt

SEQ ID NO: 739429 - DNA, 20 bp, Artificial
  CRISPR gRNA sequence
tatctgaccttccccttttg

SEQ ID NO: 739430 - DNA, 20 bp, Artificial
  CRISPR gRNA sequence
accttccccttttgctcccc

SEQ ID NO: 739431 - DNA, 20 bp, Artificial
  CRISPR gRNA sequence
ccccttttgctccccaggaa

SEQ ID NO: 739432 - DNA, 20 bp, Artificial
  CRISPR gRNA sequence
cccttttgctccccaggaac

SEQ ID NO: 739433 - DNA, 20 bp, Artificial
  CRISPR gRNA sequence
ttgctccccaggaacccaat

SEQ ID NO: 739434 - DNA, 20 bp, Artificial
  CRISPR gRNA sequence
tgctccccaggaacccaatg

SEQ ID NO: 739435 - DNA, 20 bp, Artificial
  CRISPR gRNA sequence
gctccccaggaacccaatgt

SEQ ID NO: 739436 - DNA, 20 bp, Artificial
  CRISPR gRNA sequence
ctccccaggaacccaatgtg

SEQ ID NO: 739437 - DNA, 20 bp, Artificial
  CRISPR gRNA sequence
cccaggaacccaatgtggcc

SEQ ID NO: 739438 - DNA, 20 bp, Artificial
  CRISPR gRNA sequence
cttctgaatgtgaggtgggg

SEQ ID NO: 739439 - DNA, 20 bp, Artificial
  CRISPR gRNA sequence
ctgaatgtgaggtgggggac

SEQ ID NO: 739440 - DNA, 20 bp, Artificial
  CRISPR gRNA sequence
tgaatgtgaggtgggggact

SEQ ID NO: 739441 - DNA, 20 bp, Artificial
  CRISPR gRNA sequence
aatgtgaggtgggggactgg

SEQ ID NO: 739442 - DNA, 20 bp, Artificial
  CRISPR gRNA sequence
gaagtgacataaaggatggc

SEQ ID NO: 739443 - DNA, 20 bp, Artificial
  CRISPR gRNA sequence
gtgggaggaaggtgggggaa

SEQ ID NO: 739444 - DNA, 20 bp, Artificial
  CRISPR gRNA sequence
cagggatgagggcaggggac

SEQ ID NO: 739445 - DNA, 20 bp, Artificial
  CRISPR gRNA sequence
tgagagtcgggggcattagg

SEQ ID NO: 739446 - DNA, 20 bp, Artificial
  CRISPR gRNA sequence
gggtcagggggatgaggatg

SEQ ID NO: 739447 - DNA, 20 bp, Artificial
  CRISPR gRNA sequence
tgggggaggagagtcagaga

SEQ ID NO: 739448 - DNA, 20 bp, Artificial
  CRISPR gRNA sequence
cagagatgagggtagggggc

SEQ ID NO: 739449 - DNA, 20 bp, Artificial
  CRISPR gRNA sequence
gtagaattagggccaggggg

SEQ ID NO: 739450 - DNA, 20 bp, Artificial
  CRISPR gRNA sequence
gggccaggggggatgagagt

SEQ ID NO: 739451 - DNA, 20 bp, Artificial
  CRISPR gRNA sequence
aagtgtctgtggatggagag

SEQ ID NO: 739452 - DNA, 20 bp, Artificial
  CRISPR gRNA sequence
tggatggagaggagagggtg

SEQ ID NO: 739453 - DNA, 20 bp, Artificial
  CRISPR gRNA sequence
atggagtaggaagtggaaaa

SEQ ID NO: 739454 - DNA, 20 bp, Artificial
  CRISPR gRNA sequence
taatttggattcctctagag

SEQ ID NO: 739455 - DNA, 20 bp, Artificial
  CRISPR gRNA sequence
aatttggattcctctagaga

SEQ ID NO: 739456 - DNA, 20 bp, Artificial
  CRISPR gRNA sequence
atttggattcctctagagaa

SEQ ID NO: 739457 - DNA, 20 bp, Artificial
  CRISPR gRNA sequence
ggattcctctagagaaactg

SEQ ID NO: 739458 - DNA, 20 bp, Artificial
  CRISPR gRNA sequence
gattcctctagagaaactga

SEQ ID NO: 739459 - DNA, 20 bp, Artificial
  CRISPR gRNA sequence
ctctagagaaactgactctg

SEQ ID NO: 739460 - DNA, 20 bp, Artificial
  CRISPR gRNA sequence
tagagaaactgactctgagt

SEQ ID NO: 739461 - DNA, 20 bp, Artificial
  CRISPR gRNA sequence
gagaaactgactctgagtca

SEQ ID NO: 739462 - DNA, 20 bp, Artificial
  CRISPR gRNA sequence
actctgagtcagggatttgc

SEQ ID NO: 739463 - DNA, 20 bp, Artificial
  CRISPR gRNA sequence
tgagtcagggatttgcgtct

SEQ ID NO: 739464 - DNA, 20 bp, Artificial
  CRISPR gRNA sequence
agtcagggatttgcgtctta

SEQ ID NO: 739465 - DNA, 20 bp, Artificial
  CRISPR gRNA sequence
gcgtcttatatgaacactgg

SEQ ID NO: 739466 - DNA, 20 bp, Artificial
  CRISPR gRNA sequence
cgtcttatatgaacactgga

SEQ ID NO: 739467 - DNA, 20 bp, Artificial
  CRISPR gRNA sequence
atatgaacactggaaaaaag

SEQ ID NO: 739468 - DNA, 20 bp, Artificial
  CRISPR gRNA sequence
tatgaacactggaaaaaagg

SEQ ID NO: 739469 - DNA, 20 bp, Artificial
  CRISPR gRNA sequence
gaaaaaaggtgggggagtgg

SEQ ID NO: 739470 - DNA, 20 bp, Artificial
  CRISPR gRNA sequence
taataaagagtacttaacca

SEQ ID NO: 739471 - DNA, 20 bp, Artificial
  CRISPR gRNA sequence
ataaagagtacttaaccaag

SEQ ID NO: 739472 - DNA, 20 bp, Artificial
  CRISPR gRNA sequence
aaccaagcagctgctgtgca

SEQ ID NO: 739473 - DNA, 20 bp, Artificial
  CRISPR gRNA sequence
accaagcagctgctgtgcac

SEQ ID NO: 739474 - DNA, 20 bp, Artificial
  CRISPR gRNA sequence
ctgtgcacaacaagagccta

SEQ ID NO: 739475 - DNA, 20 bp, Artificial
  CRISPR gRNA sequence
tgcacaacaagagcctaatc

SEQ ID NO: 739476 - DNA, 20 bp, Artificial
  CRISPR gRNA sequence
atcccaacggggagagtcag

SEQ ID NO: 739477 - DNA, 20 bp, Artificial
  CRISPR gRNA sequence
gcataaaacacacatctgaa

SEQ ID NO: 739478 - DNA, 20 bp, Artificial
  CRISPR gRNA sequence
aagggcaaaggagcccgcat

SEQ ID NO: 739479 - DNA, 20 bp, Artificial
  CRISPR gRNA sequence
cacaccaactccaattggtt

SEQ ID NO: 739480 - DNA, 20 bp, Artificial
  CRISPR gRNA sequence
caattggttatcagtagagg

SEQ ID NO: 739481 - DNA, 20 bp, Artificial
  CRISPR gRNA sequence
gttatcagtagagggctgcc

SEQ ID NO: 739482 - DNA, 20 bp, Artificial
  CRISPR gRNA sequence
tcagtagagggctgcctgct

SEQ ID NO: 739483 - DNA, 20 bp, Artificial
  CRISPR gRNA sequence
cctgctgtgtgtggcataga

SEQ ID NO: 739484 - DNA, 20 bp, Artificial
  CRISPR gRNA sequence
ctgtgtgtggcatagagggc

SEQ ID NO: 739485 - DNA, 20 bp, Artificial
  CRISPR gRNA sequence
tgtgtggcatagagggctct

SEQ ID NO: 739486 - DNA, 20 bp, Artificial
  CRISPR gRNA sequence
tagtgacaagagaaaggcct

SEQ ID NO: 739487 - DNA, 20 bp, Artificial
  CRISPR gRNA sequence
gtgacaagagaaaggcctca

SEQ ID NO: 739488 - DNA, 20 bp, Artificial
  CRISPR gRNA sequence
agcctcccacccacagaaaa

SEQ ID NO: 739489 - DNA, 20 bp, Artificial
  CRISPR gRNA sequence
ccacccacagaaaaggaggt

SEQ ID NO: 739490 - DNA, 20 bp, Artificial
  CRISPR gRNA sequence
atgatgtgtgcaggtggaaa

SEQ ID NO: 739491 - DNA, 20 bp, Artificial
  CRISPR gRNA sequence
ctacagaggatagagtgggg

SEQ ID NO: 739492 - DNA, 20 bp, Artificial
  CRISPR gRNA sequence
cagaggatagagtgggggaa

SEQ ID NO: 739493 - DNA, 20 bp, Artificial
  CRISPR gRNA sequence
agaccccttgaggagagcaa

SEQ ID NO: 739494 - DNA, 20 bp, Artificial
  CRISPR gRNA sequence
gaggagagcaagcatcttga

SEQ ID NO: 739495 - DNA, 20 bp, Artificial
  CRISPR gRNA sequence
aggagagcaagcatcttgat

SEQ ID NO: 739496 - DNA, 20 bp, Artificial
  CRISPR gRNA sequence
gatctctttagccacaaatg

SEQ ID NO: 739497 - DNA, 20 bp, Artificial
  CRISPR gRNA sequence
atctctttagccacaaatgg

SEQ ID NO: 739498 - DNA, 20 bp, Artificial
  CRISPR gRNA sequence
tttagccacaaatgggagtc

SEQ ID NO: 739499 - DNA, 20 bp, Artificial
  CRISPR gRNA sequence
tagccacaaatgggagtctc

SEQ ID NO: 739500 - DNA, 20 bp, Artificial
  CRISPR gRNA sequence
agccacaaatgggagtctcc

SEQ ID NO: 739501 - DNA, 20 bp, Artificial
  CRISPR gRNA sequence
gccacaaatgggagtctcct

SEQ ID NO: 739502 - DNA, 20 bp, Artificial
  CRISPR gRNA sequence
ctagaatcctcatcctcact

SEQ ID NO: 739503 - DNA, 20 bp, Artificial
  CRISPR gRNA sequence
gaatcctcatcctcactgat

SEQ ID NO: 739504 - DNA, 20 bp, Artificial
  CRISPR gRNA sequence
atcctcactgatgaacagat

SEQ ID NO: 739505 - DNA, 20 bp, Artificial
  CRISPR gRNA sequence
actgatgaacagatttgggg

SEQ ID NO: 739506 - DNA, 20 bp, Artificial
  CRISPR gRNA sequence
atgaacagatttgggggcat

SEQ ID NO: 739507 - DNA, 20 bp, Artificial
  CRISPR gRNA sequence
gggggcataatggaggagag

SEQ ID NO: 739508 - DNA, 20 bp, Artificial
  CRISPR gRNA sequence
ggggcataatggaggagagg

SEQ ID NO: 739509 - DNA, 20 bp, Artificial
  CRISPR gRNA sequence
ccctctacctggggacgtcc

SEQ ID NO: 739510 - DNA, 20 bp, Artificial
  CRISPR gRNA sequence
tacctggggacgtcctcctc

SEQ ID NO: 739511 - DNA, 20 bp, Artificial
  CRISPR gRNA sequence
cctggggacgtcctcctctt

SEQ ID NO: 739512 - DNA, 20 bp, Artificial
  CRISPR gRNA sequence
gggacgtcctcctcttaact

SEQ ID NO: 739513 - DNA, 20 bp, Artificial
  CRISPR gRNA sequence
ctcttaactccggatgtcac

SEQ ID NO: 739514 - DNA, 20 bp, Artificial
  CRISPR gRNA sequence
ttaactccggatgtcacact

SEQ ID NO: 739515 - DNA, 20 bp, Artificial
  CRISPR gRNA sequence
aactccggatgtcacacttg

SEQ ID NO: 739516 - DNA, 20 bp, Artificial
  CRISPR gRNA sequence
actccggatgtcacacttgc

SEQ ID NO: 739517 - DNA, 20 bp, Artificial
  CRISPR gRNA sequence
cggatgtcacacttgcttct

SEQ ID NO: 739518 - DNA, 20 bp, Artificial
  CRISPR gRNA sequence
gcttctgtggccgggtctgt

SEQ ID NO: 739519 - DNA, 20 bp, Artificial
  CRISPR gRNA sequence
cttctgtggccgggtctgta

SEQ ID NO: 739520 - DNA, 20 bp, Artificial
  CRISPR gRNA sequence
ctgtggccgggtctgtaagg

SEQ ID NO: 739521 - DNA, 20 bp, Artificial
  CRISPR gRNA sequence
tgtggccgggtctgtaagga

SEQ ID NO: 739522 - DNA, 20 bp, Artificial
  CRISPR gRNA sequence
tggccgggtctgtaaggaag

SEQ ID NO: 739523 - DNA, 20 bp, Artificial
  CRISPR gRNA sequence
taaggaagagggtggccgtc

SEQ ID NO: 739524 - DNA, 20 bp, Artificial
  CRISPR gRNA sequence
ccccgggaagggcacgctct

SEQ ID NO: 739525 - DNA, 20 bp, Artificial
  CRISPR gRNA sequence
tcagggtttctgctgctggt

SEQ ID NO: 739526 - DNA, 20 bp, Artificial
  CRISPR gRNA sequence
agggtttctgctgctggtcc

SEQ ID NO: 739527 - DNA, 20 bp, Artificial
  CRISPR gRNA sequence
ctgctgctggtccgatccca

SEQ ID NO: 739528 - DNA, 20 bp, Artificial
  CRISPR gRNA sequence
tgctgctggtccgatcccaa

SEQ ID NO: 739529 - DNA, 20 bp, Artificial
  CRISPR gRNA sequence
ctgctggtccgatcccaacg

SEQ ID NO: 739530 - DNA, 20 bp, Artificial
  CRISPR gRNA sequence
ctggtccgatcccaacgtgg

SEQ ID NO: 739531 - DNA, 20 bp, Artificial
  CRISPR gRNA sequence
gtccgatcccaacgtgggtt

SEQ ID NO: 739532 - DNA, 20 bp, Artificial
  CRISPR gRNA sequence
ggatgggggaccttggtgct

SEQ ID NO: 739533 - DNA, 20 bp, Artificial
  CRISPR gRNA sequence
ggtgctcacccgcttccacc

SEQ ID NO: 739534 - DNA, 20 bp, Artificial
  CRISPR gRNA sequence
gtgctcacccgcttccaccc

SEQ ID NO: 739535 - DNA, 20 bp, Artificial
  CRISPR gRNA sequence
acccgcttccaccctgtccc

SEQ ID NO: 739536 - DNA, 20 bp, Artificial
  CRISPR gRNA sequence
ccaccctgtcccttcttctc

SEQ ID NO: 739537 - DNA, 20 bp, Artificial
  CRISPR gRNA sequence
caccctgtcccttcttctca

SEQ ID NO: 739538 - DNA, 20 bp, Artificial
  CRISPR gRNA sequence
tcccttcttctcaggcacca

SEQ ID NO: 739539 - DNA, 20 bp, Artificial
  CRISPR gRNA sequence
cttctcaggcaccaggatgt

SEQ ID NO: 739540 - DNA, 20 bp, Artificial
  CRISPR gRNA sequence
ttctcaggcaccaggatgtt

SEQ ID NO: 739541 - DNA, 20 bp, Artificial
  CRISPR gRNA sequence
ctcaggcaccaggatgttta

SEQ ID NO: 739542 - DNA, 20 bp, Artificial
  CRISPR gRNA sequence
tcaggcaccaggatgtttac

SEQ ID NO: 739543 - DNA, 20 bp, Artificial
  CRISPR gRNA sequence
aggcaccaggatgtttactc

SEQ ID NO: 739544 - DNA, 20 bp, Artificial
  CRISPR gRNA sequence
actccactgtgcttggggtg

SEQ ID NO: 739545 - DNA, 20 bp, Artificial
  CRISPR gRNA sequence
ctccactgtgcttggggtgg

SEQ ID NO: 739546 - DNA, 20 bp, Artificial
  CRISPR gRNA sequence
cactgtgcttggggtggtgc

SEQ ID NO: 739547 - DNA, 20 bp, Artificial
  CRISPR gRNA sequence
tgcttggggtggtgctgacc

SEQ ID NO: 739548 - DNA, 20 bp, Artificial
  CRISPR gRNA sequence
ggggtggtgctgaccctcct

SEQ ID NO: 739549 - DNA, 20 bp, Artificial
  CRISPR gRNA sequence
gggtggtgctgaccctcctg

SEQ ID NO: 739550 - DNA, 20 bp, Artificial
  CRISPR gRNA sequence
accctcctggtgctgatgct

SEQ ID NO: 739551 - DNA, 20 bp, Artificial
  CRISPR gRNA sequence
ctggtgctgatgctgatcat

SEQ ID NO: 739552 - DNA, 20 bp, Artificial
  CRISPR gRNA sequence
gtgctgatgctgatcatggt

SEQ ID NO: 739553 - DNA, 20 bp, Artificial
  CRISPR gRNA sequence
atgctgatcatggtctatgg

SEQ ID NO: 739554 - DNA, 20 bp, Artificial
  CRISPR gRNA sequence
atcatggtctatgggttttg

SEQ ID NO: 739555 - DNA, 20 bp, Artificial
  CRISPR gRNA sequence
tgggttttggaagaagagac

SEQ ID NO: 739556 - DNA, 20 bp, Artificial
  CRISPR gRNA sequence
tggaagaagagacacatggc

SEQ ID NO: 739557 - DNA, 20 bp, Artificial
  CRISPR gRNA sequence
ggaagaagagacacatggca

SEQ ID NO: 739558 - DNA, 20 bp, Artificial
  CRISPR gRNA sequence
gaagaagagacacatggcaa

SEQ ID NO: 739559 - DNA, 20 bp, Artificial
  CRISPR gRNA sequence
ccagcctcctgagggcagag

SEQ ID NO: 739560 - DNA, 20 bp, Artificial
  CRISPR gRNA sequence
ctgagggcagagctctgggt

SEQ ID NO: 739561 - DNA, 20 bp, Artificial
  CRISPR gRNA sequence
agggcagagctctgggtaac

SEQ ID NO: 739562 - DNA, 20 bp, Artificial
  CRISPR gRNA sequence
tgggtaactgcactaagggt

SEQ ID NO: 739563 - DNA, 20 bp, Artificial
  CRISPR gRNA sequence
ggtaactgcactaagggtta

SEQ ID NO: 739564 - DNA, 20 bp, Artificial
  CRISPR gRNA sequence
cactaagggttatgacctcg

SEQ ID NO: 739565 - DNA, 20 bp, Artificial
  CRISPR gRNA sequence
agggttatgacctcgagtcc

SEQ ID NO: 739566 - DNA, 20 bp, Artificial
  CRISPR gRNA sequence
tgacctcgagtccccacgtg

SEQ ID NO: 739567 - DNA, 20 bp, Artificial
  CRISPR gRNA sequence
gagtccccacgtggtatggc

SEQ ID NO: 739568 - DNA, 20 bp, Artificial
  CRISPR gRNA sequence
ggcctgtgtccagtcaaaag

SEQ ID NO: 739569 - DNA, 20 bp, Artificial
  CRISPR gRNA sequence
gcctgtgtccagtcaaaagg

SEQ ID NO: 739570 - DNA, 20 bp, Artificial
  CRISPR gRNA sequence
tgtccagtcaaaaggactat

SEQ ID NO: 739571 - DNA, 20 bp, Artificial
  CRISPR gRNA sequence
tgacgcttccacctggggag

SEQ ID NO: 739572 - DNA, 20 bp, Artificial
  CRISPR gRNA sequence
ccacctggggaggagggcgg

SEQ ID NO: 739573 - DNA, 20 bp, Artificial
  CRISPR gRNA sequence
cacctggggaggagggcggc

SEQ ID NO: 739574 - DNA, 20 bp, Artificial
  CRISPR gRNA sequence
gggaggagggcggccaggcg

SEQ ID NO: 739575 - DNA, 20 bp, Artificial
  CRISPR gRNA sequence
aggggatgacctggaaggaa

SEQ ID NO: 739576 - DNA, 20 bp, Artificial
  CRISPR gRNA sequence
gaaggaaccagaggcagagc

SEQ ID NO: 739577 - DNA, 20 bp, Artificial
  CRISPR gRNA sequence
gggctggtggaggagcatcg

SEQ ID NO: 739578 - DNA, 20 bp, Artificial
  CRISPR gRNA sequence
gtggaggagcatcggggcac

SEQ ID NO: 739579 - DNA, 20 bp, Artificial
  CRISPR gRNA sequence
cctcagctctccctgtttct

SEQ ID NO: 739580 - DNA, 20 bp, Artificial
  CRISPR gRNA sequence
ctcagctctccctgtttctt

SEQ ID NO: 739581 - DNA, 20 bp, Artificial
  CRISPR gRNA sequence
agctctccctgtttcttgca

SEQ ID NO: 739582 - DNA, 20 bp, Artificial
  CRISPR gRNA sequence
tccctgtttcttgcaggcta

SEQ ID NO: 739583 - DNA, 20 bp, Artificial
  CRISPR gRNA sequence
cctgtttcttgcaggctaca

SEQ ID NO: 739584 - DNA, 20 bp, Artificial
  CRISPR gRNA sequence
tttcttgcaggctacagcat

SEQ ID NO: 739585 - DNA, 20 bp, Artificial
  CRISPR gRNA sequence
cttgcaggctacagcatgtg

SEQ ID NO: 739586 - DNA, 20 bp, Artificial
  CRISPR gRNA sequence
ttgcaggctacagcatgtgc

SEQ ID NO: 739587 - DNA, 20 bp, Artificial
  CRISPR gRNA sequence
gcaggctacagcatgtgcag

SEQ ID NO: 739588 - DNA, 20 bp, Artificial
  CRISPR gRNA sequence
caggctacagcatgtgcagc

SEQ ID NO: 739589 - DNA, 20 bp, Artificial
  CRISPR gRNA sequence
cagcatgtgcagcgatcctt

SEQ ID NO: 739590 - DNA, 20 bp, Artificial
  CRISPR gRNA sequence
ctacacgtgacccacctgga

SEQ ID NO: 739591 - DNA, 20 bp, Artificial
  CRISPR gRNA sequence
tacacgtgacccacctggaa

SEQ ID NO: 739592 - DNA, 20 bp, Artificial
  CRISPR gRNA sequence
cacgtgacccacctggaaga

SEQ ID NO: 739593 - DNA, 20 bp, Artificial
  CRISPR gRNA sequence
gaagaccagagccctatgtg

SEQ ID NO: 739594 - DNA, 20 bp, Artificial
  CRISPR gRNA sequence
tgtggaagtctacttgatct

SEQ ID NO: 739595 - DNA, 20 bp, Artificial
  CRISPR gRNA sequence
cttgatctgaggccacttaa

SEQ ID NO: 739596 - DNA, 20 bp, Artificial
  CRISPR gRNA sequence
gatctgaggccacttaagca

SEQ ID NO: 739597 - DNA, 20 bp, Artificial
  CRISPR gRNA sequence
atctgaggccacttaagcat

SEQ ID NO: 739598 - DNA, 20 bp, Artificial
  CRISPR gRNA sequence
aggccacttaagcatggggt

SEQ ID NO: 739599 - DNA, 20 bp, Artificial
  CRISPR gRNA sequence
aagcatggggtggggagctt

SEQ ID NO: 739600 - DNA, 20 bp, Artificial
  CRISPR gRNA sequence
agcatggggtggggagcttc

SEQ ID NO: 739601 - DNA, 20 bp, Artificial
  CRISPR gRNA sequence
ctcccagagtggccccaggg

SEQ ID NO: 739602 - DNA, 20 bp, Artificial
  CRISPR gRNA sequence
tcccagagtggccccagggg

SEQ ID NO: 739603 - DNA, 20 bp, Artificial
  CRISPR gRNA sequence
ccagagtggccccagggggt

SEQ ID NO: 739604 - DNA, 20 bp, Artificial
  CRISPR gRNA sequence
gaggaggggtgaagattggg

SEQ ID NO: 739605 - DNA, 20 bp, Artificial
  CRISPR gRNA sequence
gggccagtatcgatcttatg

SEQ ID NO: 739606 - DNA, 20 bp, Artificial
  CRISPR gRNA sequence
atgaagctggaggacttgtg

SEQ ID NO: 739607 - DNA, 20 bp, Artificial
  CRISPR gRNA sequence
tgaagctggaggacttgtgc

SEQ ID NO: 739608 - DNA, 20 bp, Artificial
  CRISPR gRNA sequence
gaggacttgtgcagtgctgg

SEQ ID NO: 739609 - DNA, 20 bp, Artificial
  CRISPR gRNA sequence
gtgcagtgctggactcaccc

SEQ ID NO: 739610 - DNA, 20 bp, Artificial
  CRISPR gRNA sequence
tgcagtgctggactcaccca

SEQ ID NO: 739611 - DNA, 20 bp, Artificial
  CRISPR gRNA sequence
gactcacccaggacttccca

SEQ ID NO: 739612 - DNA, 20 bp, Artificial
  CRISPR gRNA sequence
acccaggacttcccaaaccc

SEQ ID NO: 739613 - DNA, 20 bp, Artificial
  CRISPR gRNA sequence
cccaaacccagaggctgcca

SEQ ID NO: 739614 - DNA, 20 bp, Artificial
  CRISPR gRNA sequence
ccaaacccagaggctgccat

SEQ ID NO: 739615 - DNA, 20 bp, Artificial
  CRISPR gRNA sequence
ccatcctaagcagccccaca

SEQ ID NO: 739616 - DNA, 20 bp, Artificial
  CRISPR gRNA sequence
agcagccccacagcccagtg

SEQ ID NO: 739617 - DNA, 20 bp, Artificial
  CRISPR gRNA sequence
tccttgggggcaggaacctg

SEQ ID NO: 739618 - DNA, 20 bp, Artificial
  CRISPR gRNA sequence
cttgggggcaggaacctggg

SEQ ID NO: 739619 - DNA, 20 bp, Artificial
  CRISPR gRNA sequence
gggggcaggaacctggggag

SEQ ID NO: 739620 - DNA, 20 bp, Artificial
  CRISPR gRNA sequence
ggggcaggaacctggggagg

SEQ ID NO: 739621 - DNA, 20 bp, Artificial
  CRISPR gRNA sequence
gggaggggcccagagcaaag

SEQ ID NO: 739622 - DNA, 20 bp, Artificial
  CRISPR gRNA sequence
ctgctcggagctgcagaccc

SEQ ID NO: 739623 - DNA, 20 bp, Artificial
  CRISPR gRNA sequence
tgctcggagctgcagacccc

SEQ ID NO: 739624 - DNA, 20 bp, Artificial
  CRISPR gRNA sequence
ctcggagctgcagaccccag

SEQ ID NO: 739625 - DNA, 20 bp, Artificial
  CRISPR gRNA sequence
ggagctgcagaccccagggc

SEQ ID NO: 739626 - DNA, 20 bp, Artificial
  CRISPR gRNA sequence
cagaccccagggctcttggt

SEQ ID NO: 739627 - DNA, 20 bp, Artificial
  CRISPR gRNA sequence
ttggtggaggcaggggaacc

SEQ ID NO: 739628 - DNA, 20 bp, Artificial
  CRISPR gRNA sequence
ggtggaggcaggggaaccct

SEQ ID NO: 739629 - DNA, 20 bp, Artificial
  CRISPR gRNA sequence
gtggaggcaggggaaccctg

SEQ ID NO: 739630 - DNA, 20 bp, Artificial
  CRISPR gRNA sequence
agagtgctgtttacagagaa

SEQ ID NO: 739631 - DNA, 20 bp, Artificial
  CRISPR gRNA sequence
tttacagagaacctcagctc

SEQ ID NO: 739632 - DNA, 20 bp, Artificial
  CRISPR gRNA sequence
acagagaacctcagctcccg

SEQ ID NO: 739633 - DNA, 20 bp, Artificial
  CRISPR gRNA sequence
cagagaacctcagctcccgt

SEQ ID NO: 739634 - DNA, 20 bp, Artificial
  CRISPR gRNA sequence
agctcccgtctgcctcagaa

SEQ ID NO: 739635 - DNA, 20 bp, Artificial
  CRISPR gRNA sequence
ccgtctgcctcagaaaccct

SEQ ID NO: 739636 - DNA, 20 bp, Artificial
  CRISPR gRNA sequence
cctcagaaaccctattgggc

SEQ ID NO: 739637 - DNA, 20 bp, Artificial
  CRISPR gRNA sequence
agaaaccctattgggctgag

SEQ ID NO: 739638 - DNA, 20 bp, Artificial
  CRISPR gRNA sequence
ttgggctgagctgccctccc

SEQ ID NO: 739639 - DNA, 20 bp, Artificial
  CRISPR gRNA sequence
ggctgagctgccctccccac

SEQ ID NO: 739640 - DNA, 20 bp, Artificial
  CRISPR gRNA sequence
agctgccctccccaccaggg

SEQ ID NO: 739641 - DNA, 20 bp, Artificial
  CRISPR gRNA sequence
ccctccccaccagggccact

SEQ ID NO: 739642 - DNA, 20 bp, Artificial
  CRISPR gRNA sequence
cccaccagggccactgtgtc

SEQ ID NO: 739643 - DNA, 20 bp, Artificial
  CRISPR gRNA sequence
tgtcctctgcttccctccgt

SEQ ID NO: 739644 - DNA, 20 bp, Artificial
  CRISPR gRNA sequence
tgcttccctccgttctgctt

SEQ ID NO: 739645 - DNA, 20 bp, Artificial
  CRISPR gRNA sequence
cttccctccgttctgcttca

SEQ ID NO: 739646 - DNA, 20 bp, Artificial
  CRISPR gRNA sequence
ccctccgttctgcttcagct

SEQ ID NO: 739647 - DNA, 20 bp, Artificial
  CRISPR gRNA sequence
cctccgttctgcttcagctt

SEQ ID NO: 739648 - DNA, 20 bp, Artificial
  CRISPR gRNA sequence
cgttctgcttcagcttcccc

SEQ ID NO: 739649 - DNA, 20 bp, Artificial
  CRISPR gRNA sequence
tgcttcagcttcccctaagg

SEQ ID NO: 739650 - DNA, 20 bp, Artificial
  CRISPR gRNA sequence
cttcagcttcccctaaggtt

SEQ ID NO: 739651 - DNA, 20 bp, Artificial
  CRISPR gRNA sequence
cagcttcccctaaggttagg

SEQ ID NO: 739652 - DNA, 20 bp, Artificial
  CRISPR gRNA sequence
agcttcccctaaggttaggg

SEQ ID NO: 739653 - DNA, 20 bp, Artificial
  CRISPR gRNA sequence
cccctaaggttagggaagaa

SEQ ID NO: 739654 - DNA, 20 bp, Artificial
  CRISPR gRNA sequence
ccctaaggttagggaagaaa

SEQ ID NO: 739655 - DNA, 20 bp, Artificial
  CRISPR gRNA sequence
aggttagggaagaaagaatc

SEQ ID NO: 739656 - DNA, 20 bp, Artificial
  CRISPR gRNA sequence
gggaagaaagaatcgggctc

SEQ ID NO: 739657 - DNA, 20 bp, Artificial
  CRISPR gRNA sequence
acgaatgccagaggcagtga

SEQ ID NO: 739658 - DNA, 20 bp, Artificial
  CRISPR gRNA sequence
gaggagaggaaacagtgact

SEQ ID NO: 739659 - DNA, 20 bp, Artificial
  CRISPR gRNA sequence
aaagctggggacccacagag

SEQ ID NO: 739660 - DNA, 20 bp, Artificial
  CRISPR gRNA sequence
gggacccacagaggggttgg

SEQ ID NO: 739661 - DNA, 20 bp, Artificial
  CRISPR gRNA sequence
gcagcttctcttgtcgggac

SEQ ID NO: 739662 - DNA, 20 bp, Artificial
  CRISPR gRNA sequence
ctcttgtcgggacaggtgtc

SEQ ID NO: 739663 - DNA, 20 bp, Artificial
  CRISPR gRNA sequence
tcttgtcgggacaggtgtcc

SEQ ID NO: 739664 - DNA, 20 bp, Artificial
  CRISPR gRNA sequence
ttgtcgggacaggtgtcctt

SEQ ID NO: 739665 - DNA, 20 bp, Artificial
  CRISPR gRNA sequence
gtcgggacaggtgtcctttg

SEQ ID NO: 739666 - DNA, 20 bp, Artificial
  CRISPR gRNA sequence
tcgggacaggtgtcctttgc

SEQ ID NO: 739667 - DNA, 20 bp, Artificial
  CRISPR gRNA sequence
tgctgggcctctggatggcc

SEQ ID NO: 739668 - DNA, 20 bp, Artificial
  CRISPR gRNA sequence
gctgggcctctggatggccc

SEQ ID NO: 739669 - DNA, 20 bp, Artificial
  CRISPR gRNA sequence
ctgggcctctggatggccct

SEQ ID NO: 739670 - DNA, 20 bp, Artificial
  CRISPR gRNA sequence
ggcctctggatggccctgcc

SEQ ID NO: 739671 - DNA, 20 bp, Artificial
  CRISPR gRNA sequence
tggatggccctgccctgact

SEQ ID NO: 739672 - DNA, 20 bp, Artificial
  CRISPR gRNA sequence
gatggccctgccctgactgg

SEQ ID NO: 739673 - DNA, 20 bp, Artificial
  CRISPR gRNA sequence
ccctgactggggctgctcct

SEQ ID NO: 739674 - DNA, 20 bp, Artificial
  CRISPR gRNA sequence
actggggctgctcctccctc

SEQ ID NO: 739675 - DNA, 20 bp, Artificial
  CRISPR gRNA sequence
gggctgctcctccctcctgt

SEQ ID NO: 739676 - DNA, 20 bp, Artificial
  CRISPR gRNA sequence
ctcctccctcctgtcctggg

SEQ ID NO: 739677 - DNA, 20 bp, Artificial
  CRISPR gRNA sequence
ctccctcctgtcctgggacc

SEQ ID NO: 739678 - DNA, 20 bp, Artificial
  CRISPR gRNA sequence
cctcctgtcctgggaccgcg

SEQ ID NO: 739679 - DNA, 20 bp, Artificial
  CRISPR gRNA sequence
ctgtcctgggaccgcgcaga

SEQ ID NO: 739680 - DNA, 20 bp, Artificial
  CRISPR gRNA sequence
tcctgggaccgcgcagagcc

SEQ ID NO: 739681 - DNA, 20 bp, Artificial
  CRISPR gRNA sequence
ggaccgcgcagagcccacgc

SEQ ID NO: 739682 - DNA, 20 bp, Artificial
  CRISPR gRNA sequence
tcactgctgcctcctgctgg

SEQ ID NO: 739683 - DNA, 20 bp, Artificial
  CRISPR gRNA sequence
actgctgcctcctgctggcc

SEQ ID NO: 739684 - DNA, 20 bp, Artificial
  CRISPR gRNA sequence
ctgcctcctgctggccgctg

SEQ ID NO: 739685 - DNA, 20 bp, Artificial
  CRISPR gRNA sequence
cctcctgctggccgctgcct

SEQ ID NO: 739686 - DNA, 20 bp, Artificial
  CRISPR gRNA sequence
ctgctggccgctgcctcctt

SEQ ID NO: 739687 - DNA, 20 bp, Artificial
  CRISPR gRNA sequence
ctggccgctgcctccttaga

SEQ ID NO: 739688 - DNA, 20 bp, Artificial
  CRISPR gRNA sequence
gccgctgcctccttagaaag

SEQ ID NO: 739689 - DNA, 20 bp, Artificial
  CRISPR gRNA sequence
cctccttagaaagctgtgac

SEQ ID NO: 739690 - DNA, 20 bp, Artificial
  CRISPR gRNA sequence
cttagaaagctgtgaccagg

SEQ ID NO: 739691 - DNA, 20 bp, Artificial
  CRISPR gRNA sequence
agaaagctgtgaccaggcag

SEQ ID NO: 739692 - DNA, 20 bp, Artificial
  CRISPR gRNA sequence
gaaagctgtgaccaggcagc

SEQ ID NO: 739693 - DNA, 20 bp, Artificial
  CRISPR gRNA sequence
tgaccaggcagctaagagcc

SEQ ID NO: 739694 - DNA, 20 bp, Artificial
  CRISPR gRNA sequence
agagcctctgggctgcaggg

SEQ ID NO: 739695 - DNA, 20 bp, Artificial
  CRISPR gRNA sequence
tgggctgcagggtcagcctc

SEQ ID NO: 739696 - DNA, 20 bp, Artificial
  CRISPR gRNA sequence
ggctgcagggtcagcctctc

SEQ ID NO: 739697 - DNA, 20 bp, Artificial
  CRISPR gRNA sequence
cagggtcagcctctcccaag

SEQ ID NO: 739698 - DNA, 20 bp, Artificial
  CRISPR gRNA sequence
tcccaagactgaagtgcaga

SEQ ID NO: 739699 - DNA, 20 bp, Artificial
  CRISPR gRNA sequence
ccaagactgaagtgcagagg

SEQ ID NO: 739700 - DNA, 20 bp, Artificial
  CRISPR gRNA sequence
aagtgcagaggctggacttg

SEQ ID NO: 739701 - DNA, 20 bp, Artificial
  CRISPR gRNA sequence
gacttggggctctctccccc

SEQ ID NO: 739702 - DNA, 20 bp, Artificial
  CRISPR gRNA sequence
ggggctctctcccccagctt

SEQ ID NO: 739703 - DNA, 20 bp, Artificial
  CRISPR gRNA sequence
gggctctctcccccagcttc

SEQ ID NO: 739704 - DNA, 20 bp, Artificial
  CRISPR gRNA sequence
tctcccccagcttctacacc

SEQ ID NO: 739705 - DNA, 20 bp, Artificial
  CRISPR gRNA sequence
tcccccagcttctacacctg

SEQ ID NO: 739706 - DNA, 20 bp, Artificial
  CRISPR gRNA sequence
ccccagcttctacacctggg

SEQ ID NO: 739707 - DNA, 20 bp, Artificial
  CRISPR gRNA sequence
ctacacctgggctccaagtc

SEQ ID NO: 739708 - DNA, 20 bp, Artificial
  CRISPR gRNA sequence
tacacctgggctccaagtct

SEQ ID NO: 739709 - DNA, 20 bp, Artificial
  CRISPR gRNA sequence
cacctgggctccaagtctga

SEQ ID NO: 739710 - DNA, 20 bp, Artificial
  CRISPR gRNA sequence
ggctccaagtctgagttccc

SEQ ID NO: 739711 - DNA, 20 bp, Artificial
  CRISPR gRNA sequence
caagtctgagttcccacagg

SEQ ID NO: 739712 - DNA, 20 bp, Artificial
  CRISPR gRNA sequence
agttcccacaggggacccag

SEQ ID NO: 739713 - DNA, 20 bp, Artificial
  CRISPR gRNA sequence
ccacaggggacccagcagcc

SEQ ID NO: 739714 - DNA, 20 bp, Artificial
  CRISPR gRNA sequence
caggaagtccataccctggg

SEQ ID NO: 739715 - DNA, 20 bp, Artificial
  CRISPR gRNA sequence
gggtggctgagaccttggct

SEQ ID NO: 739716 - DNA, 20 bp, Artificial
  CRISPR gRNA sequence
agaccttggctctgtatgga

SEQ ID NO: 739717 - DNA, 20 bp, Artificial
  CRISPR gRNA sequence
ggctctgtatggaggctgct

SEQ ID NO: 739718 - DNA, 20 bp, Artificial
  CRISPR gRNA sequence
gctctgtatggaggctgctc

SEQ ID NO: 739719 - DNA, 20 bp, Artificial
  CRISPR gRNA sequence
tgtatggaggctgctcaccc

SEQ ID NO: 739720 - DNA, 20 bp, Artificial
  CRISPR gRNA sequence
tatggaggctgctcacccca

SEQ ID NO: 739721 - DNA, 20 bp, Artificial
  CRISPR gRNA sequence
ctcaccccacagacactggt

SEQ ID NO: 739722 - DNA, 20 bp, Artificial
  CRISPR gRNA sequence
accccacagacactggtggg

SEQ ID NO: 739723 - DNA, 20 bp, Artificial
  CRISPR gRNA sequence
gtggggagaccatggctcag

SEQ ID NO: 739724 - DNA, 20 bp, Artificial
  CRISPR gRNA sequence
agaggaagggtggagcaacc

SEQ ID NO: 739725 - DNA, 20 bp, Artificial
  CRISPR gRNA sequence
ctcctacccctcaggataga

SEQ ID NO: 739726 - DNA, 20 bp, Artificial
  CRISPR gRNA sequence
ctacccctcaggatagagag

SEQ ID NO: 739727 - DNA, 20 bp, Artificial
  CRISPR gRNA sequence
cccctcaggatagagagaga

SEQ ID NO: 739728 - DNA, 20 bp, Artificial
  CRISPR gRNA sequence
aggatagagagagaagacac

SEQ ID NO: 739729 - DNA, 20 bp, Artificial
  CRISPR gRNA sequence
gggacacagtgaagacagta

SEQ ID NO: 739730 - DNA, 20 bp, Artificial
  CRISPR gRNA sequence
ggacacagtgaagacagtaa

SEQ ID NO: 739731 - DNA, 20 bp, Artificial
  CRISPR gRNA sequence
ggaactgaccacggcctgga

SEQ ID NO: 739732 - DNA, 20 bp, Artificial
  CRISPR gRNA sequence
gaactgaccacggcctggag

SEQ ID NO: 739733 - DNA, 20 bp, Artificial
  CRISPR gRNA sequence
accacggcctggaggactgg

SEQ ID NO: 739734 - DNA, 20 bp, Artificial
  CRISPR gRNA sequence
gaggactggcccaggcaggg

SEQ ID NO: 739735 - DNA, 20 bp, Artificial
  CRISPR gRNA sequence
gcccaggcagggggacaggg

SEQ ID NO: 739736 - DNA, 20 bp, Artificial
  CRISPR gRNA sequence
tggccagggacccaatgtcc

SEQ ID NO: 739737 - DNA, 20 bp, Artificial
  CRISPR gRNA sequence
gccagggacccaatgtcccg

SEQ ID NO: 739738 - DNA, 20 bp, Artificial
  CRISPR gRNA sequence
cctcccacccactgactcag

SEQ ID NO: 739739 - DNA, 20 bp, Artificial
  CRISPR gRNA sequence
ccacccactgactcagggct

SEQ ID NO: 739740 - DNA, 20 bp, Artificial
  CRISPR gRNA sequence
actcagggctcagactcagc

SEQ ID NO: 739741 - DNA, 20 bp, Artificial
  CRISPR gRNA sequence
agggctcagactcagcctct

SEQ ID NO: 739742 - DNA, 20 bp, Artificial
  CRISPR gRNA sequence
agactcagcctctattgtcc

SEQ ID NO: 739743 - DNA, 20 bp, Artificial
  CRISPR gRNA sequence
agcctctattgtccagagca

SEQ ID NO: 739744 - DNA, 20 bp, Artificial
  CRISPR gRNA sequence
tattgtccagagcactggct

SEQ ID NO: 739745 - DNA, 20 bp, Artificial
  CRISPR gRNA sequence
ttgtccagagcactggcttg

SEQ ID NO: 739746 - DNA, 20 bp, Artificial
  CRISPR gRNA sequence
tccagagcactggcttggcg

SEQ ID NO: 739747 - DNA, 20 bp, Artificial
  CRISPR gRNA sequence
gcttggcgtccagcaatgaa

SEQ ID NO: 739748 - DNA, 20 bp, Artificial
  CRISPR gRNA sequence
ggcgtccagcaatgaaggct

SEQ ID NO: 739749 - DNA, 20 bp, Artificial
  CRISPR gRNA sequence
gcgtccagcaatgaaggctg

SEQ ID NO: 739750 - DNA, 20 bp, Artificial
  CRISPR gRNA sequence
gagaatgcagcctggattcc

SEQ ID NO: 739751 - DNA, 20 bp, Artificial
  CRISPR gRNA sequence
gattcccctacacacacaca

SEQ ID NO: 739752 - DNA, 20 bp, Artificial
  CRISPR gRNA sequence
ccctacacacacacacacac

SEQ ID NO: 739753 - DNA, 20 bp, Artificial
  CRISPR gRNA sequence
cacacacacacacacacaca

SEQ ID NO: 739754 - DNA, 20 bp, Artificial
  CRISPR gRNA sequence
ctgacctggagtgactggaa

SEQ ID NO: 739755 - DNA, 20 bp, Artificial
  CRISPR gRNA sequence
acctggagtgactggaatag

SEQ ID NO: 739756 - DNA, 20 bp, Artificial
  CRISPR gRNA sequence
gagtgactggaatagcacct

SEQ ID NO: 739757 - DNA, 20 bp, Artificial
  CRISPR gRNA sequence
gaatagcacctggggataaa

SEQ ID NO: 739758 - DNA, 20 bp, Artificial
  CRISPR gRNA sequence
gggataaatgtgacaactgt

SEQ ID NO: 739759 - DNA, 20 bp, Artificial
  CRISPR gRNA sequence
tgcattgaaccctgggtcag

SEQ ID NO: 739760 - DNA, 20 bp, Artificial
  CRISPR gRNA sequence
aaccctgggtcagggacgtt

SEQ ID NO: 739761 - DNA, 20 bp, Artificial
  CRISPR gRNA sequence
ggtcagggacgttccaatgg

SEQ ID NO: 739762 - DNA, 20 bp, Artificial
  CRISPR gRNA sequence
caatggccaagagagtgaca

SEQ ID NO: 739763 - DNA, 20 bp, Artificial
  CRISPR gRNA sequence
gtggacagccagaggggcca

SEQ ID NO: 739764 - DNA, 20 bp, Artificial
  CRISPR gRNA sequence
caggatggatgtggggagag

SEQ ID NO: 739765 - DNA, 20 bp, Artificial
  CRISPR gRNA sequence
aggatggatgtggggagagt

SEQ ID NO: 739766 - DNA, 20 bp, Artificial
  CRISPR gRNA sequence
ggggacagcagggaggaggc

SEQ ID NO: 739767 - DNA, 20 bp, Artificial
  CRISPR gRNA sequence
cttccctatgtccaggagag

SEQ ID NO: 739768 - DNA, 20 bp, Artificial
  CRISPR gRNA sequence
ttccctatgtccaggagagg

SEQ ID NO: 739769 - DNA, 20 bp, Artificial
  CRISPR gRNA sequence
ccctatgtccaggagagggc

SEQ ID NO: 739770 - DNA, 20 bp, Artificial
  CRISPR gRNA sequence
cctatgtccaggagagggca

SEQ ID NO: 739771 - DNA, 20 bp, Artificial
  CRISPR gRNA sequence
tgtccaggagagggcaatag

SEQ ID NO: 739772 - DNA, 20 bp, Artificial
  CRISPR gRNA sequence
aggctgaagaattgacggct

SEQ ID NO: 739773 - DNA, 20 bp, Artificial
  CRISPR gRNA sequence
aagaattgacggctctggac

SEQ ID NO: 739774 - DNA, 20 bp, Artificial
  CRISPR gRNA sequence
acggctctggacccaggaca

SEQ ID NO: 739775 - DNA, 20 bp, Artificial
  CRISPR gRNA sequence
tggacccaggacagacagac

SEQ ID NO: 739776 - DNA, 20 bp, Artificial
  CRISPR gRNA sequence
gacccaggacagacagacag

SEQ ID NO: 739777 - DNA, 20 bp, Artificial
  CRISPR gRNA sequence
tgtctagcaagcagcctcct

SEQ ID NO: 739778 - DNA, 20 bp, Artificial
  CRISPR gRNA sequence
tctagcaagcagcctcctaa

SEQ ID NO: 739779 - DNA, 20 bp, Artificial
  CRISPR gRNA sequence
gcaagcagcctcctaagata

SEQ ID NO: 739780 - DNA, 20 bp, Artificial
  CRISPR gRNA sequence
ctaagatagctgttctccct

SEQ ID NO: 739781 - DNA, 20 bp, Artificial
  CRISPR gRNA sequence
agatagctgttctccctatc

SEQ ID NO: 739782 - DNA, 20 bp, Artificial
  CRISPR gRNA sequence
ttctccctatcatgacggtg

SEQ ID NO: 739783 - DNA, 20 bp, Artificial
  CRISPR gRNA sequence
tccctatcatgacggtgtag

SEQ ID NO: 739784 - DNA, 20 bp, Artificial
  CRISPR gRNA sequence
cctatcatgacggtgtagcc

SEQ ID NO: 739785 - DNA, 20 bp, Artificial
  CRISPR gRNA sequence
tcatgacggtgtagccacca

SEQ ID NO: 739786 - DNA, 20 bp, Artificial
  CRISPR gRNA sequence
ttgtatactaggagagaact

SEQ ID NO: 739787 - DNA, 20 bp, Artificial
  CRISPR gRNA sequence
tatactaggagagaacttaa

SEQ ID NO: 739788 - DNA, 20 bp, Artificial
  CRISPR gRNA sequence
ggagagaacttaacccacct

SEQ ID NO: 739789 - DNA, 20 bp, Artificial
  CRISPR gRNA sequence
aacccacctgggggaaaata

SEQ ID NO: 739790 - DNA, 20 bp, Artificial
  CRISPR gRNA sequence
acccacctgggggaaaatag

SEQ ID NO: 739791 - DNA, 20 bp, Artificial
  CRISPR gRNA sequence
ggggaaaatagctccccaag

SEQ ID NO: 739792 - DNA, 20 bp, Artificial
  CRISPR gRNA sequence
cccaagagctggcaccagta

SEQ ID NO: 739793 - DNA, 20 bp, Artificial
  CRISPR gRNA sequence
gcaccagtaccactgatggc

SEQ ID NO: 739794 - DNA, 20 bp, Artificial
  CRISPR gRNA sequence
atggccctgcttcctctgag

SEQ ID NO: 739795 - DNA, 20 bp, Artificial
  CRISPR gRNA sequence
cttcctctgagtgagatgcc

SEQ ID NO: 739796 - DNA, 20 bp, Artificial
  CRISPR gRNA sequence
cctctgagtgagatgcccag

SEQ ID NO: 739797 - DNA, 20 bp, Artificial
  CRISPR gRNA sequence
ctctgagtgagatgcccagg

SEQ ID NO: 739798 - DNA, 20 bp, Artificial
  CRISPR gRNA sequence
tgagtgagatgcccaggagg

SEQ ID NO: 739799 - DNA, 20 bp, Artificial
  CRISPR gRNA sequence
agtgagatgcccaggaggag

SEQ ID NO: 739800 - DNA, 20 bp, Artificial
  CRISPR gRNA sequence
gggaagaagtcagggacagg

SEQ ID NO: 739801 - DNA, 20 bp, Artificial
  CRISPR gRNA sequence
tgtcactgtgtgaccctcag

SEQ ID NO: 739802 - DNA, 20 bp, Artificial
  CRISPR gRNA sequence
tcactgtgtgaccctcagca

SEQ ID NO: 739803 - DNA, 20 bp, Artificial
  CRISPR gRNA sequence
tgtgaccctcagcaagtcac

SEQ ID NO: 739804 - DNA, 20 bp, Artificial
  CRISPR gRNA sequence
agcaagtcactaacccttgg

SEQ ID NO: 739805 - DNA, 20 bp, Artificial
  CRISPR gRNA sequence
acccttggcctcatttttcc

SEQ ID NO: 739806 - DNA, 20 bp, Artificial
  CRISPR gRNA sequence
ggcctcatttttcctgtctt

SEQ ID NO: 739807 - DNA, 20 bp, Artificial
  CRISPR gRNA sequence
gcctcatttttcctgtcttg

SEQ ID NO: 739808 - DNA, 20 bp, Artificial
  CRISPR gRNA sequence
atttttcctgtcttgtgaaa

SEQ ID NO: 739809 - DNA, 20 bp, Artificial
  CRISPR gRNA sequence
ttcctgtcttgtgaaagagg

SEQ ID NO: 739810 - DNA, 20 bp, Artificial
  CRISPR gRNA sequence
tcctgtcttgtgaaagagga

SEQ ID NO: 739811 - DNA, 20 bp, Artificial
  CRISPR gRNA sequence
cctgtcttgtgaaagaggac

SEQ ID NO: 739812 - DNA, 20 bp, Artificial
  CRISPR gRNA sequence
ctgtcttgtgaaagaggaca

SEQ ID NO: 739813 - DNA, 20 bp, Artificial
  CRISPR gRNA sequence
tcttgtgaaagaggacaata

SEQ ID NO: 739814 - DNA, 20 bp, Artificial
  CRISPR gRNA sequence
gtgaaagaggacaataattc

SEQ ID NO: 739815 - DNA, 20 bp, Artificial
  CRISPR gRNA sequence
tgaaagaggacaataattcc

SEQ ID NO: 739816 - DNA, 20 bp, Artificial
  CRISPR gRNA sequence
ctacttctcaagattgtttt

SEQ ID NO: 739817 - DNA, 20 bp, Artificial
  CRISPR gRNA sequence
cttctcaagattgttttcaa

SEQ ID NO: 739818 - DNA, 20 bp, Artificial
  CRISPR gRNA sequence
ctcaagattgttttcaagat

SEQ ID NO: 739819 - DNA, 20 bp, Artificial
  CRISPR gRNA sequence
tcaagattgttttcaagata

SEQ ID NO: 739820 - DNA, 20 bp, Artificial
  CRISPR gRNA sequence
aagattgttttcaagataaa

SEQ ID NO: 739821 - DNA, 20 bp, Artificial
  CRISPR gRNA sequence
ttttcaagataaaataacat

SEQ ID NO: 739822 - DNA, 20 bp, Artificial
  CRISPR gRNA sequence
tcaagataaaataacattag

SEQ ID NO: 739823 - DNA, 20 bp, Artificial
  CRISPR gRNA sequence
caagataaaataacattagc

SEQ ID NO: 739824 - DNA, 20 bp, Artificial
  CRISPR gRNA sequence
aagataaaataacattagca

SEQ ID NO: 739825 - DNA, 20 bp, Artificial
  CRISPR gRNA sequence
gcattgtacaatgatgcaaa

SEQ ID NO: 739826 - DNA, 20 bp, Artificial
  CRISPR gRNA sequence
tacaatgatgcaaatgcctc

SEQ ID NO: 739827 - DNA, 20 bp, Artificial
  CRISPR gRNA sequence
attaccattattccttaagt

SEQ ID NO: 739828 - DNA, 20 bp, Artificial
  CRISPR gRNA sequence
ccattattccttaagttgtt

SEQ ID NO: 739829 - DNA, 20 bp, Artificial
  CRISPR gRNA sequence
ttccttaagttgttttccag

SEQ ID NO: 739830 - DNA, 20 bp, Artificial
  CRISPR gRNA sequence
cttaagttgttttccagctc

SEQ ID NO: 739831 - DNA, 20 bp, Artificial
  CRISPR gRNA sequence
aagttgttttccagctctaa

SEQ ID NO: 739832 - DNA, 20 bp, Artificial
  CRISPR gRNA sequence
agttgttttccagctctaat

SEQ ID NO: 739833 - DNA, 20 bp, Artificial
  CRISPR gRNA sequence
ttttccagctctaatgttgt

SEQ ID NO: 739834 - DNA, 20 bp, Artificial
  CRISPR gRNA sequence
tccagctctaatgttgtttc

SEQ ID NO: 739835 - DNA, 20 bp, Artificial
  CRISPR gRNA sequence
ccagctctaatgttgtttcc

SEQ ID NO: 739836 - DNA, 20 bp, Artificial
  CRISPR gRNA sequence
cagctctaatgttgtttcca

SEQ ID NO: 739837 - DNA, 20 bp, Artificial
  CRISPR gRNA sequence
taatgttgtttccaacatta

SEQ ID NO: 739838 - DNA, 20 bp, Artificial
  CRISPR gRNA sequence
atgttgtttccaacattaca

SEQ ID NO: 739839 - DNA, 20 bp, Artificial
  CRISPR gRNA sequence
tttccaacattacatttaag

SEQ ID NO: 739840 - DNA, 20 bp, Artificial
  CRISPR gRNA sequence
ccaacattacatttaagacc

SEQ ID NO: 739841 - DNA, 20 bp, Artificial
  CRISPR gRNA sequence
caacattacatttaagacct

SEQ ID NO: 739842 - DNA, 20 bp, Artificial
  CRISPR gRNA sequence
catttaagaccttaggattc

SEQ ID NO: 739843 - DNA, 20 bp, Artificial
  CRISPR gRNA sequence
aagaccttaggattctgttt

SEQ ID NO: 739844 - DNA, 20 bp, Artificial
  CRISPR gRNA sequence
agaccttaggattctgtttc

SEQ ID NO: 739845 - DNA, 20 bp, Artificial
  CRISPR gRNA sequence
aggattctgtttcttgcttt

SEQ ID NO: 739846 - DNA, 20 bp, Artificial
  CRISPR gRNA sequence
ggattctgtttcttgctttt

SEQ ID NO: 739847 - DNA, 20 bp, Artificial
  CRISPR gRNA sequence
tgtttcttgcttttgtcata

SEQ ID NO: 739848 - DNA, 20 bp, Artificial
  CRISPR gRNA sequence
tttcttgcttttgtcatatc

SEQ ID NO: 739849 - DNA, 20 bp, Artificial
  CRISPR gRNA sequence
cttgcttttgtcatatctct

SEQ ID NO: 739850 - DNA, 20 bp, Artificial
  CRISPR gRNA sequence
ttgcttttgtcatatctctt

SEQ ID NO: 739851 - DNA, 20 bp, Artificial
  CRISPR gRNA sequence
gcttttgtcatatctcttcc

SEQ ID NO: 739852 - DNA, 20 bp, Artificial
  CRISPR gRNA sequence
cttttgtcatatctcttccc

SEQ ID NO: 739853 - DNA, 20 bp, Artificial
  CRISPR gRNA sequence
ttgtcatatctcttcccaag

SEQ ID NO: 739854 - DNA, 20 bp, Artificial
  CRISPR gRNA sequence
tgtcatatctcttcccaagt

SEQ ID NO: 739855 - DNA, 20 bp, Artificial
  CRISPR gRNA sequence
gtcatatctcttcccaagtg

SEQ ID NO: 739856 - DNA, 20 bp, Artificial
  CRISPR gRNA sequence
tcatatctcttcccaagtgt

SEQ ID NO: 739857 - DNA, 20 bp, Artificial
  CRISPR gRNA sequence
ttcccaagtgtcatcactat

SEQ ID NO: 739858 - DNA, 20 bp, Artificial
  CRISPR gRNA sequence
cccaagtgtcatcactatat

SEQ ID NO: 739859 - DNA, 20 bp, Artificial
  CRISPR gRNA sequence
ccaagtgtcatcactatatg

SEQ ID NO: 739860 - DNA, 20 bp, Artificial
  CRISPR gRNA sequence
tatggatgttgagggccccc

SEQ ID NO: 739861 - DNA, 20 bp, Artificial
  CRISPR gRNA sequence
agggcccccgatgacagtcc

SEQ ID NO: 739862 - DNA, 20 bp, Artificial
  CRISPR gRNA sequence
tggtaaggtcctcttttgag

SEQ ID NO: 739863 - DNA, 20 bp, Artificial
  CRISPR gRNA sequence
ggtaaggtcctcttttgagg

SEQ ID NO: 739864 - DNA, 20 bp, Artificial
  CRISPR gRNA sequence
gtaaggtcctcttttgagga

SEQ ID NO: 739865 - DNA, 20 bp, Artificial
  CRISPR gRNA sequence
ttttgaggaggggagggtac

SEQ ID NO: 739866 - DNA, 20 bp, Artificial
  CRISPR gRNA sequence
ttgaggaggggagggtacag

SEQ ID NO: 739867 - DNA, 20 bp, Artificial
  CRISPR gRNA sequence
tgaggaggggagggtacagg

SEQ ID NO: 739868 - DNA, 20 bp, Artificial
  CRISPR gRNA sequence
gaggaggggagggtacaggg

SEQ ID NO: 739869 - DNA, 20 bp, Artificial
  CRISPR gRNA sequence
aggaggggagggtacagggt

SEQ ID NO: 739870 - DNA, 20 bp, Artificial
  CRISPR gRNA sequence
atctcagtgtgaacttggca

SEQ ID NO: 739871 - DNA, 20 bp, Artificial
  CRISPR gRNA sequence
agtgtgaacttggcaagtca

SEQ ID NO: 739872 - DNA, 20 bp, Artificial
  CRISPR gRNA sequence
ggcaagtcactgtccctctc

SEQ ID NO: 739873 - DNA, 20 bp, Artificial
  CRISPR gRNA sequence
gcaagtcactgtccctctct

SEQ ID NO: 739874 - DNA, 20 bp, Artificial
  CRISPR gRNA sequence
tccctctctgatcttgtttc

SEQ ID NO: 739875 - DNA, 20 bp, Artificial
  CRISPR gRNA sequence
tctgatcttgtttcctcatc

SEQ ID NO: 739876 - DNA, 20 bp, Artificial
  CRISPR gRNA sequence
tgatcttgtttcctcatctg

SEQ ID NO: 739877 - DNA, 20 bp, Artificial
  CRISPR gRNA sequence
atcttgtttcctcatctgga

SEQ ID NO: 739878 - DNA, 20 bp, Artificial
  CRISPR gRNA sequence
gtttcctcatctggagaagg

SEQ ID NO: 739879 - DNA, 20 bp, Artificial
  CRISPR gRNA sequence
tttcctcatctggagaagga

SEQ ID NO: 739880 - DNA, 20 bp, Artificial
  CRISPR gRNA sequence
cctcatctggagaaggagtg

SEQ ID NO: 739881 - DNA, 20 bp, Artificial
  CRISPR gRNA sequence
ctcatctggagaaggagtga

SEQ ID NO: 739882 - DNA, 20 bp, Artificial
  CRISPR gRNA sequence
atctggagaaggagtgagag

SEQ ID NO: 739883 - DNA, 20 bp, Artificial
  CRISPR gRNA sequence
gagaaggagtgagagaggag

SEQ ID NO: 739884 - DNA, 20 bp, Artificial
  CRISPR gRNA sequence
gggtgggttctcggtagaat

SEQ ID NO: 739885 - DNA, 20 bp, Artificial
  CRISPR gRNA sequence
tcggtagaattcttttaaac

SEQ ID NO: 739886 - DNA, 20 bp, Artificial
  CRISPR gRNA sequence
ggtagaattcttttaaacaa

SEQ ID NO: 739887 - DNA, 20 bp, Artificial
  CRISPR gRNA sequence
ttttaaacaaaagaacagcc

SEQ ID NO: 739888 - DNA, 20 bp, Artificial
  CRISPR gRNA sequence
ttaaacaaaagaacagcctg

SEQ ID NO: 739889 - DNA, 20 bp, Artificial
  CRISPR gRNA sequence
taaacaaaagaacagcctga

SEQ ID NO: 739890 - DNA, 20 bp, Artificial
  CRISPR gRNA sequence
aaacaaaagaacagcctgaa

SEQ ID NO: 739891 - DNA, 20 bp, Artificial
  CRISPR gRNA sequence
aacaaaagaacagcctgaaa

SEQ ID NO: 739892 - DNA, 20 bp, Artificial
  CRISPR gRNA sequence
aaaaatcaagctgcaggcac

SEQ ID NO: 739893 - DNA, 20 bp, Artificial
  CRISPR gRNA sequence
caggcacagatatgggaact

SEQ ID NO: 739894 - DNA, 20 bp, Artificial
  CRISPR gRNA sequence
gcacaggggggcttgcctaa

SEQ ID NO: 739895 - DNA, 20 bp, Artificial
  CRISPR gRNA sequence
cacaggggggcttgcctaag

SEQ ID NO: 739896 - DNA, 20 bp, Artificial
  CRISPR gRNA sequence
gcctaagacatgcccacagc

SEQ ID NO: 739897 - DNA, 20 bp, Artificial
  CRISPR gRNA sequence
cctaagacatgcccacagcc

SEQ ID NO: 739898 - DNA, 20 bp, Artificial
  CRISPR gRNA sequence
agacatgcccacagcctcat

SEQ ID NO: 739899 - DNA, 20 bp, Artificial
  CRISPR gRNA sequence
atagataagacagactacac

SEQ ID NO: 739900 - DNA, 20 bp, Artificial
  CRISPR gRNA sequence
cacaggtgacttgcccaaac

SEQ ID NO: 739901 - DNA, 20 bp, Artificial
  CRISPR gRNA sequence
gcccaaacatgcctgcaatg

SEQ ID NO: 739902 - DNA, 20 bp, Artificial
  CRISPR gRNA sequence
cccaaacatgcctgcaatgg

SEQ ID NO: 739903 - DNA, 20 bp, Artificial
  CRISPR gRNA sequence
caatggaaaatttcatcccc

SEQ ID NO: 739904 - DNA, 20 bp, Artificial
  CRISPR gRNA sequence
catcccctgacatgtgcagt

SEQ ID NO: 739905 - DNA, 20 bp, Artificial
  CRISPR gRNA sequence
atcccctgacatgtgcagta

SEQ ID NO: 739906 - DNA, 20 bp, Artificial
  CRISPR gRNA sequence
acatgtgcagtaaggggaac

SEQ ID NO: 739907 - DNA, 20 bp, Artificial
  CRISPR gRNA sequence
aagccaagggcccacatgta

SEQ ID NO: 739908 - DNA, 20 bp, Artificial
  CRISPR gRNA sequence
gaaggacagcagggagctac

SEQ ID NO: 739909 - DNA, 20 bp, Artificial
  CRISPR gRNA sequence
ccagaaattcatgccttatg

SEQ ID NO: 739910 - DNA, 20 bp, Artificial
  CRISPR gRNA sequence
atgccttatgcagatgagct

SEQ ID NO: 739911 - DNA, 20 bp, Artificial
  CRISPR gRNA sequence
atgcagatgagctgcccagt

SEQ ID NO: 739912 - DNA, 20 bp, Artificial
  CRISPR gRNA sequence
tgcagatgagctgcccagtc

SEQ ID NO: 739913 - DNA, 20 bp, Artificial
  CRISPR gRNA sequence
cccagtcctcatcggtttct

SEQ ID NO: 739914 - DNA, 20 bp, Artificial
  CRISPR gRNA sequence
atcggtttcttataaaagcc

SEQ ID NO: 739915 - DNA, 20 bp, Artificial
  CRISPR gRNA sequence
cttataaaagcctttacatt

SEQ ID NO: 739916 - DNA, 20 bp, Artificial
  CRISPR gRNA sequence
ttataaaagcctttacattc

SEQ ID NO: 739917 - DNA, 20 bp, Artificial
  CRISPR gRNA sequence
ataaaagcctttacattcaa

SEQ ID NO: 739918 - DNA, 20 bp, Artificial
  CRISPR gRNA sequence
taaaagcctttacattcaac

SEQ ID NO: 739919 - DNA, 20 bp, Artificial
  CRISPR gRNA sequence
tacattcaactgtaaaaatg

SEQ ID NO: 739920 - DNA, 20 bp, Artificial
  CRISPR gRNA sequence
acattcaactgtaaaaatgg

SEQ ID NO: 739921 - DNA, 20 bp, Artificial
  CRISPR gRNA sequence
cattcaactgtaaaaatggc

SEQ ID NO: 739922 - DNA, 20 bp, Artificial
  CRISPR gRNA sequence
aactgtaaaaatggcaaccc

SEQ ID NO: 739923 - DNA, 20 bp, Artificial
  CRISPR gRNA sequence
taaaaatggcaaccctcttt

SEQ ID NO: 739924 - DNA, 20 bp, Artificial
  CRISPR gRNA sequence
tttcaggcctcctctccaca

SEQ ID NO: 739925 - DNA, 20 bp, Artificial
  CRISPR gRNA sequence
tcaggcctcctctccacagc

SEQ ID NO: 739926 - DNA, 20 bp, Artificial
  CRISPR gRNA sequence
caggcctcctctccacagca

SEQ ID NO: 739927 - DNA, 20 bp, Artificial
  CRISPR gRNA sequence
aggcctcctctccacagcag

SEQ ID NO: 739928 - DNA, 20 bp, Artificial
  CRISPR gRNA sequence
ctctccacagcagagagctt

SEQ ID NO: 739929 - DNA, 20 bp, Artificial
  CRISPR gRNA sequence
tccacagcagagagctttct

SEQ ID NO: 739930 - DNA, 20 bp, Artificial
  CRISPR gRNA sequence
cacagcagagagctttcttc

SEQ ID NO: 739931 - DNA, 20 bp, Artificial
  CRISPR gRNA sequence
tcttctctcactcattaaac

SEQ ID NO: 739932 - DNA, 20 bp, Artificial
  CRISPR gRNA sequence
cttctctcactcattaaact

SEQ ID NO: 739933 - DNA, 20 bp, Artificial
  CRISPR gRNA sequence
ttctctcactcattaaactt

SEQ ID NO: 739934 - DNA, 20 bp, Artificial
  CRISPR gRNA sequence
ctctcactcattaaactttc

SEQ ID NO: 739935 - DNA, 20 bp, Artificial
  CRISPR gRNA sequence
tctcactcattaaactttca

SEQ ID NO: 739936 - DNA, 20 bp, Artificial
  CRISPR gRNA sequence
tcactcattaaactttcact

SEQ ID NO: 739937 - DNA, 20 bp, Artificial
  CRISPR gRNA sequence
actcattaaactttcactcc

SEQ ID NO: 739938 - DNA, 20 bp, Artificial
  CRISPR gRNA sequence
attaaactttcactccaacc

SEQ ID NO: 739939 - DNA, 20 bp, Artificial
  CRISPR gRNA sequence
aactttcactccaacctcat

SEQ ID NO: 739940 - DNA, 20 bp, Artificial
  CRISPR gRNA sequence
tcactccaacctcatccttg

SEQ ID NO: 739941 - DNA, 20 bp, Artificial
  CRISPR gRNA sequence
cactccaacctcatccttgg

SEQ ID NO: 739942 - DNA, 20 bp, Artificial
  CRISPR gRNA sequence
actccaacctcatccttggt

SEQ ID NO: 739943 - DNA, 20 bp, Artificial
  CRISPR gRNA sequence
caacctcatccttggtgtcc

SEQ ID NO: 739944 - DNA, 20 bp, Artificial
  CRISPR gRNA sequence
atccttggtgtccacgctcc

SEQ ID NO: 739945 - DNA, 20 bp, Artificial
  CRISPR gRNA sequence
ggtgtccacgctccttaatt

SEQ ID NO: 739946 - DNA, 20 bp, Artificial
  CRISPR gRNA sequence
gtgtccacgctccttaattt

SEQ ID NO: 739947 - DNA, 20 bp, Artificial
  CRISPR gRNA sequence
cttaattttcattgttgtga

SEQ ID NO: 739948 - DNA, 20 bp, Artificial
  CRISPR gRNA sequence
aattttcattgttgtgagac

SEQ ID NO: 739949 - DNA, 20 bp, Artificial
  CRISPR gRNA sequence
attttcattgttgtgagaca

SEQ ID NO: 739950 - DNA, 20 bp, Artificial
  CRISPR gRNA sequence
tcattgttgtgagacaaaga

SEQ ID NO: 739951 - DNA, 20 bp, Artificial
  CRISPR gRNA sequence
cattgttgtgagacaaagaa

SEQ ID NO: 739952 - DNA, 20 bp, Artificial
  CRISPR gRNA sequence
attgttgtgagacaaagaac

SEQ ID NO: 739953 - DNA, 20 bp, Artificial
  CRISPR gRNA sequence
ttgtgagacaaagaactcca

SEQ ID NO: 739954 - DNA, 20 bp, Artificial
  CRISPR gRNA sequence
tgagacaaagaactccagtg

SEQ ID NO: 739955 - DNA, 20 bp, Artificial
  CRISPR gRNA sequence
cagtgatacctcaaacaatg

SEQ ID NO: 739956 - DNA, 20 bp, Artificial
  CRISPR gRNA sequence
aaacaatgagagactgctac

SEQ ID NO: 739957 - DNA, 20 bp, Artificial
  CRISPR gRNA sequence
ctacattgtggtgcactggt

SEQ ID NO: 739958 - DNA, 20 bp, Artificial
  CRISPR gRNA sequence
cccttgtatgtgctctaagc

SEQ ID NO: 739959 - DNA, 20 bp, Artificial
  CRISPR gRNA sequence
tatgtgctctaagcaagtcc

SEQ ID NO: 739960 - DNA, 20 bp, Artificial
  CRISPR gRNA sequence
atgtgctctaagcaagtcca

SEQ ID NO: 739961 - DNA, 20 bp, Artificial
  CRISPR gRNA sequence
ctctaagcaagtccaaggtg

SEQ ID NO: 739962 - DNA, 20 bp, Artificial
  CRISPR gRNA sequence
tctaagcaagtccaaggtga

SEQ ID NO: 739963 - DNA, 20 bp, Artificial
  CRISPR gRNA sequence
gcaagtccaaggtgaaggcc

SEQ ID NO: 739964 - DNA, 20 bp, Artificial
  CRISPR gRNA sequence
gtccaaggtgaaggccaagc

SEQ ID NO: 739965 - DNA, 20 bp, Artificial
  CRISPR gRNA sequence
tccaaggtgaaggccaagcc

SEQ ID NO: 739966 - DNA, 20 bp, Artificial
  CRISPR gRNA sequence
gtgaaggccaagccaggccc

SEQ ID NO: 739967 - DNA, 20 bp, Artificial
  CRISPR gRNA sequence
gcccataataccaatccatt

SEQ ID NO: 739968 - DNA, 20 bp, Artificial
  CRISPR gRNA sequence
ataataccaatccattcagt

SEQ ID NO: 739969 - DNA, 20 bp, Artificial
  CRISPR gRNA sequence
taataccaatccattcagtg

SEQ ID NO: 739970 - DNA, 20 bp, Artificial
  CRISPR gRNA sequence
ataccaatccattcagtgag

SEQ ID NO: 739971 - DNA, 20 bp, Artificial
  CRISPR gRNA sequence
taccaatccattcagtgagg

SEQ ID NO: 739972 - DNA, 20 bp, Artificial
  CRISPR gRNA sequence
caatccattcagtgaggagg

SEQ ID NO: 739973 - DNA, 20 bp, Artificial
  CRISPR gRNA sequence
tccattcagtgaggaggaag

SEQ ID NO: 739974 - DNA, 20 bp, Artificial
  CRISPR gRNA sequence
ccattcagtgaggaggaagc

SEQ ID NO: 739975 - DNA, 20 bp, Artificial
  CRISPR gRNA sequence
attcagtgaggaggaagcag

SEQ ID NO: 739976 - DNA, 20 bp, Artificial
  CRISPR gRNA sequence
tgaggaggaagcaggagacc

SEQ ID NO: 739977 - DNA, 20 bp, Artificial
  CRISPR gRNA sequence
gaggaggaagcaggagaccc

SEQ ID NO: 739978 - DNA, 20 bp, Artificial
  CRISPR gRNA sequence
aggaggaagcaggagaccca

SEQ ID NO: 739979 - DNA, 20 bp, Artificial
  CRISPR gRNA sequence
gaagcaggagacccagggtt

SEQ ID NO: 739980 - DNA, 20 bp, Artificial
  CRISPR gRNA sequence
ggagacccagggtttagtcg

SEQ ID NO: 739981 - DNA, 20 bp, Artificial
  CRISPR gRNA sequence
caccgtttacttgttttgac

SEQ ID NO: 739982 - DNA, 20 bp, Artificial
  CRISPR gRNA sequence
ttacttgttttgacaagaca

SEQ ID NO: 739983 - DNA, 20 bp, Artificial
  CRISPR gRNA sequence
ttgacaagacacagaccttt

SEQ ID NO: 739984 - DNA, 20 bp, Artificial
  CRISPR gRNA sequence
ctattgccctctgtgttaaa

SEQ ID NO: 739985 - DNA, 20 bp, Artificial
  CRISPR gRNA sequence
ttgccctctgtgttaaatgg

SEQ ID NO: 739986 - DNA, 20 bp, Artificial
  CRISPR gRNA sequence
atggcagcaataaaacctcc

SEQ ID NO: 739987 - DNA, 20 bp, Artificial
  CRISPR gRNA sequence
tggcagcaataaaacctccc

SEQ ID NO: 739988 - DNA, 20 bp, Artificial
  CRISPR gRNA sequence
ataaaacctcccaggatttt

SEQ ID NO: 739989 - DNA, 20 bp, Artificial
  CRISPR gRNA sequence
taaaacctcccaggattttc

SEQ ID NO: 739990 - DNA, 20 bp, Artificial
  CRISPR gRNA sequence
aaaacctcccaggattttca

SEQ ID NO: 739991 - DNA, 20 bp, Artificial
  CRISPR gRNA sequence
acctcccaggattttcaggg

SEQ ID NO: 739992 - DNA, 20 bp, Artificial
  CRISPR gRNA sequence
cctcccaggattttcaggga

SEQ ID NO: 739993 - DNA, 20 bp, Artificial
  CRISPR gRNA sequence
ctcccaggattttcagggaa

SEQ ID NO: 739994 - DNA, 20 bp, Artificial
  CRISPR gRNA sequence
tcccaggattttcagggaag

SEQ ID NO: 739995 - DNA, 20 bp, Artificial
  CRISPR gRNA sequence
cccaggattttcagggaagg

SEQ ID NO: 739996 - DNA, 20 bp, Artificial
  CRISPR gRNA sequence
aggattttcagggaaggggg

SEQ ID NO: 739997 - DNA, 20 bp, Artificial
  CRISPR gRNA sequence
gggaagggggtggatcaaac

SEQ ID NO: 739998 - DNA, 20 bp, Artificial
  CRISPR gRNA sequence
acaagttacaacacatgtga

SEQ ID NO: 739999 - DNA, 20 bp, Artificial
  CRISPR gRNA sequence
caacacatgtgaaagtgtgt

SEQ ID NO: 740000 - DNA, 20 bp, Artificial
  CRISPR gRNA sequence
acatgtgaaagtgtgttgga

SEQ ID NO: 740001 - DNA, 20 bp, Artificial
  CRISPR gRNA sequence
aaagtgtgttggaaagcacc

SEQ ID NO: 740002 - DNA, 20 bp, Artificial
  CRISPR gRNA sequence
gaaagcaccaagtattctaa

SEQ ID NO: 740003 - DNA, 20 bp, Artificial
  CRISPR gRNA sequence
caccaagtattctaacagaa

SEQ ID NO: 740004 - DNA, 20 bp, Artificial
  CRISPR gRNA sequence
accaagtattctaacagaaa

SEQ ID NO: 740005 - DNA, 20 bp, Artificial
  CRISPR gRNA sequence
gtattctaacagaaaaggcc

SEQ ID NO: 740006 - DNA, 20 bp, Artificial
  CRISPR gRNA sequence
taacagaaaaggccaagaaa

SEQ ID NO: 740007 - DNA, 20 bp, Artificial
  CRISPR gRNA sequence
cacttccctctcccgtgccc

SEQ ID NO: 740008 - DNA, 20 bp, Artificial
  CRISPR gRNA sequence
acttccctctcccgtgccca

SEQ ID NO: 740009 - DNA, 20 bp, Artificial
  CRISPR gRNA sequence
tccctctcccgtgcccaagg

SEQ ID NO: 740010 - DNA, 20 bp, Artificial
  CRISPR gRNA sequence
tcccgtgcccaaggcagaca

SEQ ID NO: 740011 - DNA, 20 bp, Artificial
  CRISPR gRNA sequence
gcagacatggctatctatct

SEQ ID NO: 740012 - DNA, 20 bp, Artificial
  CRISPR gRNA sequence
tatctcggcactgtctcacc

SEQ ID NO: 740013 - DNA, 20 bp, Artificial
  CRISPR gRNA sequence
accaagctatattgatcatt

SEQ ID NO: 740014 - DNA, 20 bp, Artificial
  CRISPR gRNA sequence
gaatccctctcaacacattc

SEQ ID NO: 740015 - DNA, 20 bp, Artificial
  CRISPR gRNA sequence
aatccctctcaacacattcc

SEQ ID NO: 740016 - DNA, 20 bp, Artificial
  CRISPR gRNA sequence
cctctcaacacattccagga

SEQ ID NO: 740017 - DNA, 20 bp, Artificial
  CRISPR gRNA sequence
tcaacacattccaggatagt

SEQ ID NO: 740018 - DNA, 20 bp, Artificial
  CRISPR gRNA sequence
caacacattccaggatagtt

SEQ ID NO: 740019 - DNA, 20 bp, Artificial
  CRISPR gRNA sequence
aacacattccaggatagtta

SEQ ID NO: 740020 - DNA, 20 bp, Artificial
  CRISPR gRNA sequence
ccaggatagttagggtgaca

SEQ ID NO: 740021 - DNA, 20 bp, Artificial
  CRISPR gRNA sequence
ttagggtgacatagcctcca

SEQ ID NO: 740022 - DNA, 20 bp, Artificial
  CRISPR gRNA sequence
tagggtgacatagcctccat

SEQ ID NO: 740023 - DNA, 20 bp, Artificial
  CRISPR gRNA sequence
agggtgacatagcctccatg

SEQ ID NO: 740024 - DNA, 20 bp, Artificial
  CRISPR gRNA sequence
gacatagcctccatggggtg

SEQ ID NO: 740025 - DNA, 20 bp, Artificial
  CRISPR gRNA sequence
catagcctccatggggtgaa

SEQ ID NO: 740026 - DNA, 20 bp, Artificial
  CRISPR gRNA sequence
agcctccatggggtgaagag

SEQ ID NO: 740027 - DNA, 20 bp, Artificial
  CRISPR gRNA sequence
ctccatggggtgaagagaag

SEQ ID NO: 740028 - DNA, 20 bp, Artificial
  CRISPR gRNA sequence
tgaagagaagcagcaatgca

SEQ ID NO: 740029 - DNA, 20 bp, Artificial
  CRISPR gRNA sequence
agagaagcagcaatgcaaag

SEQ ID NO: 740030 - DNA, 20 bp, Artificial
  CRISPR gRNA sequence
gagaagcagcaatgcaaagc

SEQ ID NO: 740031 - DNA, 20 bp, Artificial
  CRISPR gRNA sequence
agaagcagcaatgcaaagca

SEQ ID NO: 740032 - DNA, 20 bp, Artificial
  CRISPR gRNA sequence
aatgcaaagcagggaatgcc

SEQ ID NO: 740033 - DNA, 20 bp, Artificial
  CRISPR gRNA sequence
atgcaaagcagggaatgccc

SEQ ID NO: 740034 - DNA, 20 bp, Artificial
  CRISPR gRNA sequence
tgcaaagcagggaatgccca

SEQ ID NO: 740035 - DNA, 20 bp, Artificial
  CRISPR gRNA sequence
agcagggaatgcccagggaa

SEQ ID NO: 740036 - DNA, 20 bp, Artificial
  CRISPR gRNA sequence
gcagggaatgcccagggaat

SEQ ID NO: 740037 - DNA, 20 bp, Artificial
  CRISPR gRNA sequence
ggaatgcccagggaatgggc

SEQ ID NO: 740038 - DNA, 20 bp, Artificial
  CRISPR gRNA sequence
gaatgcccagggaatgggcc

SEQ ID NO: 740039 - DNA, 20 bp, Artificial
  CRISPR gRNA sequence
tgcccagggaatgggccagg

SEQ ID NO: 740040 - DNA, 20 bp, Artificial
  CRISPR gRNA sequence
caggtggcctgtgccgtcta

SEQ ID NO: 740041 - DNA, 20 bp, Artificial
  CRISPR gRNA sequence
aggtggcctgtgccgtctat

SEQ ID NO: 740042 - DNA, 20 bp, Artificial
  CRISPR gRNA sequence
ggcctgtgccgtctatgggc

SEQ ID NO: 740043 - DNA, 20 bp, Artificial
  CRISPR gRNA sequence
gcctgtgccgtctatgggct

SEQ ID NO: 740044 - DNA, 20 bp, Artificial
  CRISPR gRNA sequence
tatgggctgggcctcatgct

SEQ ID NO: 740045 - DNA, 20 bp, Artificial
  CRISPR gRNA sequence
ggctgggcctcatgctcagc

SEQ ID NO: 740046 - DNA, 20 bp, Artificial
  CRISPR gRNA sequence
gctgggcctcatgctcagct

SEQ ID NO: 740047 - DNA, 20 bp, Artificial
  CRISPR gRNA sequence
cctcatgctcagctgggctg

SEQ ID NO: 740048 - DNA, 20 bp, Artificial
  CRISPR gRNA sequence
atgctcagctgggctgtggc

SEQ ID NO: 740049 - DNA, 20 bp, Artificial
  CRISPR gRNA sequence
tgctcagctgggctgtggct

SEQ ID NO: 740050 - DNA, 20 bp, Artificial
  CRISPR gRNA sequence
ctgggctgtggctgggcttc

SEQ ID NO: 740051 - DNA, 20 bp, Artificial
  CRISPR gRNA sequence
gggctgtggctgggcttcaa

SEQ ID NO: 740052 - DNA, 20 bp, Artificial
  CRISPR gRNA sequence
ggctgtggctgggcttcaag

SEQ ID NO: 740053 - DNA, 20 bp, Artificial
  CRISPR gRNA sequence
cttcaagaggcctttgttcc

SEQ ID NO: 740054 - DNA, 20 bp, Artificial
  CRISPR gRNA sequence
ggcctttgttcccagcatcc

SEQ ID NO: 740055 - DNA, 20 bp, Artificial
  CRISPR gRNA sequence
tttgttcccagcatcctggt

SEQ ID NO: 740056 - DNA, 20 bp, Artificial
  CRISPR gRNA sequence
agcatcctggttagcaaccc

SEQ ID NO: 740057 - DNA, 20 bp, Artificial
  CRISPR gRNA sequence
agttcctctttcgtgcattg

SEQ ID NO: 740058 - DNA, 20 bp, Artificial
  CRISPR gRNA sequence
ttcgtgcattgtggttccct

SEQ ID NO: 740059 - DNA, 20 bp, Artificial
  CRISPR gRNA sequence
tccctgagaaaacgttaacc

SEQ ID NO: 740060 - DNA, 20 bp, Artificial
  CRISPR gRNA sequence
gaaaacgttaacccagcccc

SEQ ID NO: 740061 - DNA, 20 bp, Artificial
  CRISPR gRNA sequence
cgttaacccagcccccagca

SEQ ID NO: 740062 - DNA, 20 bp, Artificial
  CRISPR gRNA sequence
aacccagcccccagcacagt

SEQ ID NO: 740063 - DNA, 20 bp, Artificial
  CRISPR gRNA sequence
acccagcccccagcacagtc

SEQ ID NO: 740064 - DNA, 20 bp, Artificial
  CRISPR gRNA sequence
agcccccagcacagtcaggc

SEQ ID NO: 740065 - DNA, 20 bp, Artificial
  CRISPR gRNA sequence
cagcacagtcaggccagccc

SEQ ID NO: 740066 - DNA, 20 bp, Artificial
  CRISPR gRNA sequence
agcacagtcaggccagccct

SEQ ID NO: 740067 - DNA, 20 bp, Artificial
  CRISPR gRNA sequence
gcacagtcaggccagccctg

SEQ ID NO: 740068 - DNA, 20 bp, Artificial
  CRISPR gRNA sequence
cagtcaggccagccctgggg

SEQ ID NO: 740069 - DNA, 20 bp, Artificial
  CRISPR gRNA sequence
agtcaggccagccctgggga

SEQ ID NO: 740070 - DNA, 20 bp, Artificial
  CRISPR gRNA sequence
ctggggaaggcctcattcat

SEQ ID NO: 740071 - DNA, 20 bp, Artificial
  CRISPR gRNA sequence
tggggaaggcctcattcatg

SEQ ID NO: 740072 - DNA, 20 bp, Artificial
  CRISPR gRNA sequence
ggaaggcctcattcatgagg

SEQ ID NO: 740073 - DNA, 20 bp, Artificial
  CRISPR gRNA sequence
gaaggcctcattcatgaggc

SEQ ID NO: 740074 - DNA, 20 bp, Artificial
  CRISPR gRNA sequence
tcattcatgaggcaggaccc

SEQ ID NO: 740075 - DNA, 20 bp, Artificial
  CRISPR gRNA sequence
cattcatgaggcaggacccc

SEQ ID NO: 740076 - DNA, 20 bp, Artificial
  CRISPR gRNA sequence
attcatgaggcaggacccca

SEQ ID NO: 740077 - DNA, 20 bp, Artificial
  CRISPR gRNA sequence
ttcatgaggcaggaccccag

SEQ ID NO: 740078 - DNA, 20 bp, Artificial
  CRISPR gRNA sequence
gaggcaggaccccaggggcc

SEQ ID NO: 740079 - DNA, 20 bp, Artificial
  CRISPR gRNA sequence
caggaccccaggggccaagt

SEQ ID NO: 740080 - DNA, 20 bp, Artificial
  CRISPR gRNA sequence
ccaggggccaagttggtgct

SEQ ID NO: 740081 - DNA, 20 bp, Artificial
  CRISPR gRNA sequence
ggggccaagttggtgctcgg

SEQ ID NO: 740082 - DNA, 20 bp, Artificial
  CRISPR gRNA sequence
gccaagttggtgctcggtgg

SEQ ID NO: 740083 - DNA, 20 bp, Artificial
  CRISPR gRNA sequence
aagttggtgctcggtggtgg

SEQ ID NO: 740084 - DNA, 20 bp, Artificial
  CRISPR gRNA sequence
agttggtgctcggtggtggc

SEQ ID NO: 740085 - DNA, 20 bp, Artificial
  CRISPR gRNA sequence
cggtggtggcaggacccctg

SEQ ID NO: 740086 - DNA, 20 bp, Artificial
  CRISPR gRNA sequence
ctgtcccactgcacactccc

SEQ ID NO: 740087 - DNA, 20 bp, Artificial
  CRISPR gRNA sequence
cactcccaagtccaccccgc

SEQ ID NO: 740088 - DNA, 20 bp, Artificial
  CRISPR gRNA sequence
actcccaagtccaccccgcg

SEQ ID NO: 740089 - DNA, 20 bp, Artificial
  CRISPR gRNA sequence
tcccaagtccaccccgcgag

SEQ ID NO: 740090 - DNA, 20 bp, Artificial
  CRISPR gRNA sequence
gcgaggagcaccccctgaaa

SEQ ID NO: 740091 - DNA, 20 bp, Artificial
  CRISPR gRNA sequence
cgaggagcaccccctgaaaa

SEQ ID NO: 740092 - DNA, 20 bp, Artificial
  CRISPR gRNA sequence
ccctgaaaaaggccatgtat

SEQ ID NO: 740093 - DNA, 20 bp, Artificial
  CRISPR gRNA sequence
atgtatcagcccctctgccc

SEQ ID NO: 740094 - DNA, 20 bp, Artificial
  CRISPR gRNA sequence
tgtatcagcccctctgccct

SEQ ID NO: 740095 - DNA, 20 bp, Artificial
  CRISPR gRNA sequence
ctgccctgggccactgcatg

SEQ ID NO: 740096 - DNA, 20 bp, Artificial
  CRISPR gRNA sequence
ccctgggccactgcatgtag

SEQ ID NO: 740097 - DNA, 20 bp, Artificial
  CRISPR gRNA sequence
cctgggccactgcatgtagt

SEQ ID NO: 740098 - DNA, 20 bp, Artificial
  CRISPR gRNA sequence
tgggccactgcatgtagtgg

SEQ ID NO: 740099 - DNA, 20 bp, Artificial
  CRISPR gRNA sequence
actgcatgtagtgggagctc

SEQ ID NO: 740100 - DNA, 20 bp, Artificial
  CRISPR gRNA sequence
catgtagtgggagctctggt

SEQ ID NO: 740101 - DNA, 20 bp, Artificial
  CRISPR gRNA sequence
atgtagtgggagctctggtc

SEQ ID NO: 740102 - DNA, 20 bp, Artificial
  CRISPR gRNA sequence
tagtgggagctctggtcagg

SEQ ID NO: 740103 - DNA, 20 bp, Artificial
  CRISPR gRNA sequence
tgggagctctggtcaggcag

SEQ ID NO: 740104 - DNA, 20 bp, Artificial
  CRISPR gRNA sequence
tcaggcagaagtcttttgaa

SEQ ID NO: 740105 - DNA, 20 bp, Artificial
  CRISPR gRNA sequence
ggcagaagtcttttgaaaag

SEQ ID NO: 740106 - DNA, 20 bp, Artificial
  CRISPR gRNA sequence
gcagaagtcttttgaaaagc

SEQ ID NO: 740107 - DNA, 20 bp, Artificial
  CRISPR gRNA sequence
gtcttttgaaaagcaggtcc

SEQ ID NO: 740108 - DNA, 20 bp, Artificial
  CRISPR gRNA sequence
tcttttgaaaagcaggtcct

SEQ ID NO: 740109 - DNA, 20 bp, Artificial
  CRISPR gRNA sequence
cttttgaaaagcaggtcctg

SEQ ID NO: 740110 - DNA, 20 bp, Artificial
  CRISPR gRNA sequence
gggctcctgcacctccaccc

SEQ ID NO: 740111 - DNA, 20 bp, Artificial
  CRISPR gRNA sequence
caccccagcgcccatcgcca

SEQ ID NO: 740112 - DNA, 20 bp, Artificial
  CRISPR gRNA sequence
cccatcgccacggactcccc

SEQ ID NO: 740113 - DNA, 20 bp, Artificial
  CRISPR gRNA sequence
ccatcgccacggactccccc

SEQ ID NO: 740114 - DNA, 20 bp, Artificial
  CRISPR gRNA sequence
tcgccacggactcccccagg

SEQ ID NO: 740115 - DNA, 20 bp, Artificial
  CRISPR gRNA sequence
cgccacggactcccccaggc

SEQ ID NO: 740116 - DNA, 20 bp, Artificial
  CRISPR gRNA sequence
gccacggactcccccaggca

SEQ ID NO: 740117 - DNA, 20 bp, Artificial
  CRISPR gRNA sequence
cggactcccccaggcagggc

SEQ ID NO: 740118 - DNA, 20 bp, Artificial
  CRISPR gRNA sequence
ggcagggccagcctgcccac

SEQ ID NO: 740119 - DNA, 20 bp, Artificial
  CRISPR gRNA sequence
agggccagcctgcccaccag

SEQ ID NO: 740120 - DNA, 20 bp, Artificial
  CRISPR gRNA sequence
gcctgcccaccagcagtcac

SEQ ID NO: 740121 - DNA, 20 bp, Artificial
  CRISPR gRNA sequence
tgcccaccagcagtcaccag

SEQ ID NO: 740122 - DNA, 20 bp, Artificial
  CRISPR gRNA sequence
gcagtcaccagtggcctcca

SEQ ID NO: 740123 - DNA, 20 bp, Artificial
  CRISPR gRNA sequence
tggcctccatggtgtgtttt

SEQ ID NO: 740124 - DNA, 20 bp, Artificial
  CRISPR gRNA sequence
ggcctccatggtgtgttttt

SEQ ID NO: 740125 - DNA, 20 bp, Artificial
  CRISPR gRNA sequence
gcctccatggtgtgttttta

SEQ ID NO: 740126 - DNA, 20 bp, Artificial
  CRISPR gRNA sequence
ctccatggtgtgtttttagg

SEQ ID NO: 740127 - DNA, 20 bp, Artificial
  CRISPR gRNA sequence
gtgtgtttttagggagtgct

SEQ ID NO: 740128 - DNA, 20 bp, Artificial
  CRISPR gRNA sequence
tgtttttagggagtgctgag

SEQ ID NO: 740129 - DNA, 20 bp, Artificial
  CRISPR gRNA sequence
ctgagcagtccccgctgtgt

SEQ ID NO: 740130 - DNA, 20 bp, Artificial
  CRISPR gRNA sequence
tgtcagcaaaaccctccaaa

SEQ ID NO: 740131 - DNA, 20 bp, Artificial
  CRISPR gRNA sequence
tgctttcaattccattcctt

SEQ ID NO: 740132 - DNA, 20 bp, Artificial
  CRISPR gRNA sequence
ccattccttcagcctctccc

SEQ ID NO: 740133 - DNA, 20 bp, Artificial
  CRISPR gRNA sequence
cattccttcagcctctccct

SEQ ID NO: 740134 - DNA, 20 bp, Artificial
  CRISPR gRNA sequence
ttccttcagcctctccctgg

SEQ ID NO: 740135 - DNA, 20 bp, Artificial
  CRISPR gRNA sequence
tccttcagcctctccctggg

SEQ ID NO: 740136 - DNA, 20 bp, Artificial
  CRISPR gRNA sequence
ccttcagcctctccctggga

SEQ ID NO: 740137 - DNA, 20 bp, Artificial
  CRISPR gRNA sequence
cctctccctgggagggaata

SEQ ID NO: 740138 - DNA, 20 bp, Artificial
  CRISPR gRNA sequence
ctctccctgggagggaataa

SEQ ID NO: 740139 - DNA, 20 bp, Artificial
  CRISPR gRNA sequence
tccctgggagggaataaagg

SEQ ID NO: 740140 - DNA, 20 bp, Artificial
  CRISPR gRNA sequence
ccctgggagggaataaaggc

SEQ ID NO: 740141 - DNA, 20 bp, Artificial
  CRISPR gRNA sequence
tgggagggaataaaggcagg

SEQ ID NO: 740142 - DNA, 20 bp, Artificial
  CRISPR gRNA sequence
ctctattaaactgtgaatgt

SEQ ID NO: 740143 - DNA, 20 bp, Artificial
  CRISPR gRNA sequence
tctattaaactgtgaatgtc

SEQ ID NO: 740144 - DNA, 20 bp, Artificial
  CRISPR gRNA sequence
tattaaactgtgaatgtcag

SEQ ID NO: 740145 - DNA, 20 bp, Artificial
  CRISPR gRNA sequence
aaactgtgaatgtcaggaga

SEQ ID NO: 740146 - DNA, 20 bp, Artificial
  CRISPR gRNA sequence
aactgtgaatgtcaggagat

SEQ ID NO: 740147 - DNA, 20 bp, Artificial
  CRISPR gRNA sequence
gtgaatgtcaggagataggt

SEQ ID NO: 740148 - DNA, 20 bp, Artificial
  CRISPR gRNA sequence
atgtcaggagataggtaaga

SEQ ID NO: 740149 - DNA, 20 bp, Artificial
  CRISPR gRNA sequence
ttgatctcctaacaatgaat

SEQ ID NO: 740150 - DNA, 20 bp, Artificial
  CRISPR gRNA sequence
aacaatgaattagttcttaa

SEQ ID NO: 740151 - DNA, 20 bp, Artificial
  CRISPR gRNA sequence
tgaattagttcttaaaagca

SEQ ID NO: 740152 - DNA, 20 bp, Artificial
  CRISPR gRNA sequence
aaaagcatggatttccctct

SEQ ID NO: 740153 - DNA, 20 bp, Artificial
  CRISPR gRNA sequence
aaagcatggatttccctctc

SEQ ID NO: 740154 - DNA, 20 bp, Artificial
  CRISPR gRNA sequence
aagcatggatttccctctca

SEQ ID NO: 740155 - DNA, 20 bp, Artificial
  CRISPR gRNA sequence
ggatttccctctcagggcct

SEQ ID NO: 740156 - DNA, 20 bp, Artificial
  CRISPR gRNA sequence
ctcagactgtgccacgaatc

SEQ ID NO: 740157 - DNA, 20 bp, Artificial
  CRISPR gRNA sequence
gtgccacgaatccagcgctc

SEQ ID NO: 740158 - DNA, 20 bp, Artificial
  CRISPR gRNA sequence
tgccacgaatccagcgctcc

SEQ ID NO: 740159 - DNA, 20 bp, Artificial
  CRISPR gRNA sequence
ccacgaatccagcgctccag

SEQ ID NO: 740160 - DNA, 20 bp, Artificial
  CRISPR gRNA sequence
gctccaggagcctcctgccc

SEQ ID NO: 740161 - DNA, 20 bp, Artificial
  CRISPR gRNA sequence
gagcctcctgccccagcccc

SEQ ID NO: 740162 - DNA, 20 bp, Artificial
  CRISPR gRNA sequence
ctagtgctcctcccgccccc

SEQ ID NO: 740163 - DNA, 20 bp, Artificial
  CRISPR gRNA sequence
agtgctcctcccgccccctg

SEQ ID NO: 740164 - DNA, 20 bp, Artificial
  CRISPR gRNA sequence
gtgctcctcccgccccctgg

SEQ ID NO: 740165 - DNA, 20 bp, Artificial
  CRISPR gRNA sequence
aggcgccatgttctcgcacc

SEQ ID NO: 740166 - DNA, 20 bp, Artificial
  CRISPR gRNA sequence
cccagctctcccatgcaccc

SEQ ID NO: 740167 - DNA, 20 bp, Artificial
  CRISPR gRNA sequence
ctcccatgcaccccagccca

SEQ ID NO: 740168 - DNA, 20 bp, Artificial
  CRISPR gRNA sequence
gcaccccagcccacagccac

SEQ ID NO: 740169 - DNA, 20 bp, Artificial
  CRISPR gRNA sequence
caccccagcccacagccacc

SEQ ID NO: 740170 - DNA, 20 bp, Artificial
  CRISPR gRNA sequence
accccagcccacagccacca

SEQ ID NO: 740171 - DNA, 20 bp, Artificial
  CRISPR gRNA sequence
cagcccacagccaccagggc

SEQ ID NO: 740172 - DNA, 20 bp, Artificial
  CRISPR gRNA sequence
acagccaccagggctggcat

SEQ ID NO: 740173 - DNA, 20 bp, Artificial
  CRISPR gRNA sequence
agccaccagggctggcatca

SEQ ID NO: 740174 - DNA, 20 bp, Artificial
  CRISPR gRNA sequence
gccaccagggctggcatcag

SEQ ID NO: 740175 - DNA, 20 bp, Artificial
  CRISPR gRNA sequence
catcagaggcactaccatcc

SEQ ID NO: 740176 - DNA, 20 bp, Artificial
  CRISPR gRNA sequence
atcagaggcactaccatccc

SEQ ID NO: 740177 - DNA, 20 bp, Artificial
  CRISPR gRNA sequence
cactaccatcccgggcaact

SEQ ID NO: 740178 - DNA, 20 bp, Artificial
  CRISPR gRNA sequence
ctaccatcccgggcaactca

SEQ ID NO: 740179 - DNA, 20 bp, Artificial
  CRISPR gRNA sequence
taccatcccgggcaactcag

SEQ ID NO: 740180 - DNA, 20 bp, Artificial
  CRISPR gRNA sequence
accatcccgggcaactcaga

SEQ ID NO: 740181 - DNA, 20 bp, Artificial
  CRISPR gRNA sequence
atcccgggcaactcagaggg

SEQ ID NO: 740182 - DNA, 20 bp, Artificial
  CRISPR gRNA sequence
ggcaactcagagggcggctc

SEQ ID NO: 740183 - DNA, 20 bp, Artificial
  CRISPR gRNA sequence
aactcagagggcggctccag

SEQ ID NO: 740184 - DNA, 20 bp, Artificial
  CRISPR gRNA sequence
tccagcagcctgcccctccc

SEQ ID NO: 740185 - DNA, 20 bp, Artificial
  CRISPR gRNA sequence
agcagcctgcccctccccag

SEQ ID NO: 740186 - DNA, 20 bp, Artificial
  CRISPR gRNA sequence
agcctgcccctccccagcag

SEQ ID NO: 740187 - DNA, 20 bp, Artificial
  CRISPR gRNA sequence
ctgcccctccccagcagcag

SEQ ID NO: 740188 - DNA, 20 bp, Artificial
  CRISPR gRNA sequence
tgcccctccccagcagcagc

SEQ ID NO: 740189 - DNA, 20 bp, Artificial
  CRISPR gRNA sequence
gcccctccccagcagcagca

SEQ ID NO: 740190 - DNA, 20 bp, Artificial
  CRISPR gRNA sequence
ccctccccagcagcagcagg

SEQ ID NO: 740191 - DNA, 20 bp, Artificial
  CRISPR gRNA sequence
cctccccagcagcagcaggg

SEQ ID NO: 740192 - DNA, 20 bp, Artificial
  CRISPR gRNA sequence
ctccccagcagcagcaggga

SEQ ID NO: 740193 - DNA, 20 bp, Artificial
  CRISPR gRNA sequence
gcagcagggagggacgtccc

SEQ ID NO: 740194 - DNA, 20 bp, Artificial
  CRISPR gRNA sequence
gggacgtccctagtgcgttg

SEQ ID NO: 740195 - DNA, 20 bp, Artificial
  CRISPR gRNA sequence
ggacgtccctagtgcgttgt

SEQ ID NO: 740196 - DNA, 20 bp, Artificial
  CRISPR gRNA sequence
cgtccctagtgcgttgtagg

SEQ ID NO: 740197 - DNA, 20 bp, Artificial
  CRISPR gRNA sequence
gtccctagtgcgttgtaggc

SEQ ID NO: 740198 - DNA, 20 bp, Artificial
  CRISPR gRNA sequence
tccctagtgcgttgtaggca

SEQ ID NO: 740199 - DNA, 20 bp, Artificial
  CRISPR gRNA sequence
tgcgttgtaggcagggcctg

SEQ ID NO: 740200 - DNA, 20 bp, Artificial
  CRISPR gRNA sequence
gtaggcagggcctgtggcca

SEQ ID NO: 740201 - DNA, 20 bp, Artificial
  CRISPR gRNA sequence
agggcctgtggccatggatg

SEQ ID NO: 740202 - DNA, 20 bp, Artificial
  CRISPR gRNA sequence
cctgtggccatggatgaaga

SEQ ID NO: 740203 - DNA, 20 bp, Artificial
  CRISPR gRNA sequence
gccatggatgaagatggaac

SEQ ID NO: 740204 - DNA, 20 bp, Artificial
  CRISPR gRNA sequence
ccatggatgaagatggaact

SEQ ID NO: 740205 - DNA, 20 bp, Artificial
  CRISPR gRNA sequence
atggatgaagatggaactgg

SEQ ID NO: 740206 - DNA, 20 bp, Artificial
  CRISPR gRNA sequence
tgaagatggaactgggagct

SEQ ID NO: 740207 - DNA, 20 bp, Artificial
  CRISPR gRNA sequence
aagatggaactgggagctca

SEQ ID NO: 740208 - DNA, 20 bp, Artificial
  CRISPR gRNA sequence
agagtaaatttcgctgaaaa

SEQ ID NO: 740209 - DNA, 20 bp, Artificial
  CRISPR gRNA sequence
gagtaaatttcgctgaaaac

SEQ ID NO: 740210 - DNA, 20 bp, Artificial
  CRISPR gRNA sequence
gctgaaaacaggaaaccacg

SEQ ID NO: 740211 - DNA, 20 bp, Artificial
  CRISPR gRNA sequence
aaacaggaaaccacgaagcc

SEQ ID NO: 740212 - DNA, 20 bp, Artificial
  CRISPR gRNA sequence
ccacgaagcccagatgcgtt

SEQ ID NO: 740213 - DNA, 20 bp, Artificial
  CRISPR gRNA sequence
ccagatgcgttcagttgtaa

SEQ ID NO: 740214 - DNA, 20 bp, Artificial
  CRISPR gRNA sequence
cagatgcgttcagttgtaaa

SEQ ID NO: 740215 - DNA, 20 bp, Artificial
  CRISPR gRNA sequence
agatgcgttcagttgtaaaa

SEQ ID NO: 740216 - DNA, 20 bp, Artificial
  CRISPR gRNA sequence
cgttcagttgtaaaagggtc

SEQ ID NO: 740217 - DNA, 20 bp, Artificial
  CRISPR gRNA sequence
ttcagttgtaaaagggtcca

SEQ ID NO: 740218 - DNA, 20 bp, Artificial
  CRISPR gRNA sequence
agttgtaaaagggtccagag

SEQ ID NO: 740219 - DNA, 20 bp, Artificial
  CRISPR gRNA sequence
ttgtaaaagggtccagagaa

SEQ ID NO: 740220 - DNA, 20 bp, Artificial
  CRISPR gRNA sequence
gtaaaagggtccagagaaga

SEQ ID NO: 740221 - DNA, 20 bp, Artificial
  CRISPR gRNA sequence
taaaagggtccagagaagag

SEQ ID NO: 740222 - DNA, 20 bp, Artificial
  CRISPR gRNA sequence
aaaagggtccagagaagaga

SEQ ID NO: 740223 - DNA, 20 bp, Artificial
  CRISPR gRNA sequence
agggtccagagaagagaggg

SEQ ID NO: 740224 - DNA, 20 bp, Artificial
  CRISPR gRNA sequence
gggtccagagaagagagggc

SEQ ID NO: 740225 - DNA, 20 bp, Artificial
  CRISPR gRNA sequence
ggtccagagaagagagggca

SEQ ID NO: 740226 - DNA, 20 bp, Artificial
  CRISPR gRNA sequence
aagagagggcagggccgcac

SEQ ID NO: 740227 - DNA, 20 bp, Artificial
  CRISPR gRNA sequence
gagagggcagggccgcacca

SEQ ID NO: 740228 - DNA, 20 bp, Artificial
  CRISPR gRNA sequence
agagggcagggccgcaccag

SEQ ID NO: 740229 - DNA, 20 bp, Artificial
  CRISPR gRNA sequence
gggcagggccgcaccagagg

SEQ ID NO: 740230 - DNA, 20 bp, Artificial
  CRISPR gRNA sequence
gggccgcaccagaggaagct

SEQ ID NO: 740231 - DNA, 20 bp, Artificial
  CRISPR gRNA sequence
ggccgcaccagaggaagctg

SEQ ID NO: 740232 - DNA, 20 bp, Artificial
  CRISPR gRNA sequence
ccgcaccagaggaagctgag

SEQ ID NO: 740233 - DNA, 20 bp, Artificial
  CRISPR gRNA sequence
cgcaccagaggaagctgagg

SEQ ID NO: 740234 - DNA, 20 bp, Artificial
  CRISPR gRNA sequence
accagaggaagctgaggagg

SEQ ID NO: 740235 - DNA, 20 bp, Artificial
  CRISPR gRNA sequence
aggaagctgaggaggaagtg

SEQ ID NO: 740236 - DNA, 20 bp, Artificial
  CRISPR gRNA sequence
aagctgaggaggaagtgcgg

SEQ ID NO: 740237 - DNA, 20 bp, Artificial
  CRISPR gRNA sequence
gtgcggtggctgttctgctg

SEQ ID NO: 740238 - DNA, 20 bp, Artificial
  CRISPR gRNA sequence
tgcggtggctgttctgctgc

SEQ ID NO: 740239 - DNA, 20 bp, Artificial
  CRISPR gRNA sequence
gggccgcctccctctccaca

SEQ ID NO: 740240 - DNA, 20 bp, Artificial
  CRISPR gRNA sequence
ccgcctccctctccacacag

SEQ ID NO: 740241 - DNA, 20 bp, Artificial
  CRISPR gRNA sequence
cctccctctccacacagcag

SEQ ID NO: 740242 - DNA, 20 bp, Artificial
  CRISPR gRNA sequence
cctctccacacagcagcagc

SEQ ID NO: 740243 - DNA, 20 bp, Artificial
  CRISPR gRNA sequence
ctctccacacagcagcagcc

SEQ ID NO: 740244 - DNA, 20 bp, Artificial
  CRISPR gRNA sequence
cacacagcagcagccaggcc

SEQ ID NO: 740245 - DNA, 20 bp, Artificial
  CRISPR gRNA sequence
acacagcagcagccaggcct

SEQ ID NO: 740246 - DNA, 20 bp, Artificial
  CRISPR gRNA sequence
cacagcagcagccaggcctg

SEQ ID NO: 740247 - DNA, 20 bp, Artificial
  CRISPR gRNA sequence
cagcagccaggcctggggtc

SEQ ID NO: 740248 - DNA, 20 bp, Artificial
  CRISPR gRNA sequence
cagccaggcctggggtctgg

SEQ ID NO: 740249 - DNA, 20 bp, Artificial
  CRISPR gRNA sequence
gggtctggcagccaaattct

SEQ ID NO: 740250 - DNA, 20 bp, Artificial
  CRISPR gRNA sequence
tctggcagccaaattcttag

SEQ ID NO: 740251 - DNA, 20 bp, Artificial
  CRISPR gRNA sequence
ttagaagttgtctctgcctc

SEQ ID NO: 740252 - DNA, 20 bp, Artificial
  CRISPR gRNA sequence
tagaagttgtctctgcctca

SEQ ID NO: 740253 - DNA, 20 bp, Artificial
  CRISPR gRNA sequence
agttgtctctgcctcaaggt

SEQ ID NO: 740254 - DNA, 20 bp, Artificial
  CRISPR gRNA sequence
tgtctctgcctcaaggtcag

SEQ ID NO: 740255 - DNA, 20 bp, Artificial
  CRISPR gRNA sequence
ctgcctcaaggtcagcagct

SEQ ID NO: 740256 - DNA, 20 bp, Artificial
  CRISPR gRNA sequence
tgcctcaaggtcagcagctg

SEQ ID NO: 740257 - DNA, 20 bp, Artificial
  CRISPR gRNA sequence
gcctcaaggtcagcagctga

SEQ ID NO: 740258 - DNA, 20 bp, Artificial
  CRISPR gRNA sequence
caaggtcagcagctgagggc

SEQ ID NO: 740259 - DNA, 20 bp, Artificial
  CRISPR gRNA sequence
aaggtcagcagctgagggct

SEQ ID NO: 740260 - DNA, 20 bp, Artificial
  CRISPR gRNA sequence
aggtcagcagctgagggctg

SEQ ID NO: 740261 - DNA, 20 bp, Artificial
  CRISPR gRNA sequence
cagcagctgagggctggggc

SEQ ID NO: 740262 - DNA, 20 bp, Artificial
  CRISPR gRNA sequence
agcagctgagggctggggcc

SEQ ID NO: 740263 - DNA, 20 bp, Artificial
  CRISPR gRNA sequence
gctgagggctggggccaggc

SEQ ID NO: 740264 - DNA, 20 bp, Artificial
  CRISPR gRNA sequence
tggggccaggccagcctccc

SEQ ID NO: 740265 - DNA, 20 bp, Artificial
  CRISPR gRNA sequence
gggccaggccagcctcccca

SEQ ID NO: 740266 - DNA, 20 bp, Artificial
  CRISPR gRNA sequence
ggccaggccagcctccccag

SEQ ID NO: 740267 - DNA, 20 bp, Artificial
  CRISPR gRNA sequence
gccaggccagcctccccaga

SEQ ID NO: 740268 - DNA, 20 bp, Artificial
  CRISPR gRNA sequence
aggccagcctccccagaggg

SEQ ID NO: 740269 - DNA, 20 bp, Artificial
  CRISPR gRNA sequence
ggccagcctccccagagggc

SEQ ID NO: 740270 - DNA, 20 bp, Artificial
  CRISPR gRNA sequence
gccagcctccccagagggca

SEQ ID NO: 740271 - DNA, 20 bp, Artificial
  CRISPR gRNA sequence
gggcagggcatgctcttcct

SEQ ID NO: 740272 - DNA, 20 bp, Artificial
  CRISPR gRNA sequence
agggcatgctcttcctgagt

SEQ ID NO: 740273 - DNA, 20 bp, Artificial
  CRISPR gRNA sequence
gggcatgctcttcctgagtt

SEQ ID NO: 740274 - DNA, 20 bp, Artificial
  CRISPR gRNA sequence
gcatgctcttcctgagttgg

SEQ ID NO: 740275 - DNA, 20 bp, Artificial
  CRISPR gRNA sequence
tcttcctgagttgggagaac

SEQ ID NO: 740276 - DNA, 20 bp, Artificial
  CRISPR gRNA sequence
gagttgggagaaccggaatc

SEQ ID NO: 740277 - DNA, 20 bp, Artificial
  CRISPR gRNA sequence
agttgggagaaccggaatct

SEQ ID NO: 740278 - DNA, 20 bp, Artificial
  CRISPR gRNA sequence
gagaaccggaatctgggctg

SEQ ID NO: 740279 - DNA, 20 bp, Artificial
  CRISPR gRNA sequence
agaaccggaatctgggctgt

SEQ ID NO: 740280 - DNA, 20 bp, Artificial
  CRISPR gRNA sequence
gtgggcttgtccttcgactc

SEQ ID NO: 740281 - DNA, 20 bp, Artificial
  CRISPR gRNA sequence
tgggcttgtccttcgactcc

SEQ ID NO: 740282 - DNA, 20 bp, Artificial
  CRISPR gRNA sequence
ttgtccttcgactccaggaa

SEQ ID NO: 740283 - DNA, 20 bp, Artificial
  CRISPR gRNA sequence
tccttcgactccaggaacag

SEQ ID NO: 740284 - DNA, 20 bp, Artificial
  CRISPR gRNA sequence
ccttcgactccaggaacagc

SEQ ID NO: 740285 - DNA, 20 bp, Artificial
  CRISPR gRNA sequence
ctgtccccactcctgccatg

SEQ ID NO: 740286 - DNA, 20 bp, Artificial
  CRISPR gRNA sequence
tgtccccactcctgccatgc

SEQ ID NO: 740287 - DNA, 20 bp, Artificial
  CRISPR gRNA sequence
ttctttttaaaatttgtttt

SEQ ID NO: 740288 - DNA, 20 bp, Artificial
  CRISPR gRNA sequence
tctttttaaaatttgttttg

SEQ ID NO: 740289 - DNA, 20 bp, Artificial
  CRISPR gRNA sequence
ttaaaatttgttttgaggca

SEQ ID NO: 740290 - DNA, 20 bp, Artificial
  CRISPR gRNA sequence
gcaaagttttgctccgtccc

SEQ ID NO: 740291 - DNA, 20 bp, Artificial
  CRISPR gRNA sequence
caaagttttgctccgtcccc

SEQ ID NO: 740292 - DNA, 20 bp, Artificial
  CRISPR gRNA sequence
gttttgctccgtccccaggc

SEQ ID NO: 740293 - DNA, 20 bp, Artificial
  CRISPR gRNA sequence
tttgctccgtccccaggctg

SEQ ID NO: 740294 - DNA, 20 bp, Artificial
  CRISPR gRNA sequence
tccgtccccaggctggagtg

SEQ ID NO: 740295 - DNA, 20 bp, Artificial
  CRISPR gRNA sequence
gtccccaggctggagtgtag

SEQ ID NO: 740296 - DNA, 20 bp, Artificial
  CRISPR gRNA sequence
ggagtgtagtggctcgaaca

SEQ ID NO: 740297 - DNA, 20 bp, Artificial
  CRISPR gRNA sequence
agtggctcgaacacagctca

SEQ ID NO: 740298 - DNA, 20 bp, Artificial
  CRISPR gRNA sequence
ggctcgaacacagctcacag

SEQ ID NO: 740299 - DNA, 20 bp, Artificial
  CRISPR gRNA sequence
tcacagcagccttgaacacc

SEQ ID NO: 740300 - DNA, 20 bp, Artificial
  CRISPR gRNA sequence
cacagcagccttgaacacct

SEQ ID NO: 740301 - DNA, 20 bp, Artificial
  CRISPR gRNA sequence
agccttgaacacctgggctt

SEQ ID NO: 740302 - DNA, 20 bp, Artificial
  CRISPR gRNA sequence
cttgaacacctgggcttaag

SEQ ID NO: 740303 - DNA, 20 bp, Artificial
  CRISPR gRNA sequence
cttaagcggtccttccacct

SEQ ID NO: 740304 - DNA, 20 bp, Artificial
  CRISPR gRNA sequence
ccttccacctcagccctgca

SEQ ID NO: 740305 - DNA, 20 bp, Artificial
  CRISPR gRNA sequence
acctcagccctgcaaagtgc

SEQ ID NO: 740306 - DNA, 20 bp, Artificial
  CRISPR gRNA sequence
cctcagccctgcaaagtgct

SEQ ID NO: 740307 - DNA, 20 bp, Artificial
  CRISPR gRNA sequence
tcagccctgcaaagtgctgg

SEQ ID NO: 740308 - DNA, 20 bp, Artificial
  CRISPR gRNA sequence
cagccctgcaaagtgctggg

SEQ ID NO: 740309 - DNA, 20 bp, Artificial
  CRISPR gRNA sequence
cctgcaaagtgctgggagga

SEQ ID NO: 740310 - DNA, 20 bp, Artificial
  CRISPR gRNA sequence
ctgcaaagtgctgggaggac

SEQ ID NO: 740311 - DNA, 20 bp, Artificial
  CRISPR gRNA sequence
aggacaggtgtgtgccacca

SEQ ID NO: 740312 - DNA, 20 bp, Artificial
  CRISPR gRNA sequence
caggtgtgtgccaccatggc

SEQ ID NO: 740313 - DNA, 20 bp, Artificial
  CRISPR gRNA sequence
tgtgtgccaccatggccagc

SEQ ID NO: 740314 - DNA, 20 bp, Artificial
  CRISPR gRNA sequence
cagccagcaccctcttccta

SEQ ID NO: 740315 - DNA, 20 bp, Artificial
  CRISPR gRNA sequence
ccagcaccctcttcctatgg

SEQ ID NO: 740316 - DNA, 20 bp, Artificial
  CRISPR gRNA sequence
caccctcttcctatggcagc

SEQ ID NO: 740317 - DNA, 20 bp, Artificial
  CRISPR gRNA sequence
ttcctatggcagctggcatc

SEQ ID NO: 740318 - DNA, 20 bp, Artificial
  CRISPR gRNA sequence
gcagctggcatcaagcattg

SEQ ID NO: 740319 - DNA, 20 bp, Artificial
  CRISPR gRNA sequence
gcatcaagcattgtggtgac

SEQ ID NO: 740320 - DNA, 20 bp, Artificial
  CRISPR gRNA sequence
atcaagcattgtggtgacca

SEQ ID NO: 740321 - DNA, 20 bp, Artificial
  CRISPR gRNA sequence
tcaagcattgtggtgaccag

SEQ ID NO: 740322 - DNA, 20 bp, Artificial
  CRISPR gRNA sequence
caagcattgtggtgaccaga

SEQ ID NO: 740323 - DNA, 20 bp, Artificial
  CRISPR gRNA sequence
gtggtgaccagagggaacaa

SEQ ID NO: 740324 - DNA, 20 bp, Artificial
  CRISPR gRNA sequence
gtgaccagagggaacaaaag

SEQ ID NO: 740325 - DNA, 20 bp, Artificial
  CRISPR gRNA sequence
tgaccagagggaacaaaaga

SEQ ID NO: 740326 - DNA, 20 bp, Artificial
  CRISPR gRNA sequence
gaccagagggaacaaaagaa

SEQ ID NO: 740327 - DNA, 20 bp, Artificial
  CRISPR gRNA sequence
agaagggacccccctctgcc

SEQ ID NO: 740328 - DNA, 20 bp, Artificial
  CRISPR gRNA sequence
gaagggacccccctctgcct

SEQ ID NO: 740329 - DNA, 20 bp, Artificial
  CRISPR gRNA sequence
aagggacccccctctgccta

SEQ ID NO: 740330 - DNA, 20 bp, Artificial
  CRISPR gRNA sequence
acccccctctgcctagggac

SEQ ID NO: 740331 - DNA, 20 bp, Artificial
  CRISPR gRNA sequence
cccccctctgcctagggaca

SEQ ID NO: 740332 - DNA, 20 bp, Artificial
  CRISPR gRNA sequence
ccccctctgcctagggacaa

SEQ ID NO: 740333 - DNA, 20 bp, Artificial
  CRISPR gRNA sequence
ccctctgcctagggacaagg

SEQ ID NO: 740334 - DNA, 20 bp, Artificial
  CRISPR gRNA sequence
tctgcctagggacaagggag

SEQ ID NO: 740335 - DNA, 20 bp, Artificial
  CRISPR gRNA sequence
cctagggacaagggagaagc

SEQ ID NO: 740336 - DNA, 20 bp, Artificial
  CRISPR gRNA sequence
ctagggacaagggagaagcc

SEQ ID NO: 740337 - DNA, 20 bp, Artificial
  CRISPR gRNA sequence
tagggacaagggagaagccg

SEQ ID NO: 740338 - DNA, 20 bp, Artificial
  CRISPR gRNA sequence
acaagggagaagccggggtt

SEQ ID NO: 740339 - DNA, 20 bp, Artificial
  CRISPR gRNA sequence
caagggagaagccggggttt

SEQ ID NO: 740340 - DNA, 20 bp, Artificial
  CRISPR gRNA sequence
gccggggtttgggcatattc

SEQ ID NO: 740341 - DNA, 20 bp, Artificial
  CRISPR gRNA sequence
tgggcatattctggccactc

SEQ ID NO: 740342 - DNA, 20 bp, Artificial
  CRISPR gRNA sequence
gggcatattctggccactcg

SEQ ID NO: 740343 - DNA, 20 bp, Artificial
  CRISPR gRNA sequence
attctggccactcgaggtgt

SEQ ID NO: 740344 - DNA, 20 bp, Artificial
  CRISPR gRNA sequence
cgaggtgtcagccccatctc

SEQ ID NO: 740345 - DNA, 20 bp, Artificial
  CRISPR gRNA sequence
gaggtgtcagccccatctcc

SEQ ID NO: 740346 - DNA, 20 bp, Artificial
  CRISPR gRNA sequence
ctatgtttaccctctcctca

SEQ ID NO: 740347 - DNA, 20 bp, Artificial
  CRISPR gRNA sequence
taccctctcctcaaagcccc

SEQ ID NO: 740348 - DNA, 20 bp, Artificial
  CRISPR gRNA sequence
tctcctcaaagcccctggcc

SEQ ID NO: 740349 - DNA, 20 bp, Artificial
  CRISPR gRNA sequence
tcaaagcccctggcccagcc

SEQ ID NO: 740350 - DNA, 20 bp, Artificial
  CRISPR gRNA sequence
caaagcccctggcccagccc

SEQ ID NO: 740351 - DNA, 20 bp, Artificial
  CRISPR gRNA sequence
agcccctggcccagcccagg

SEQ ID NO: 740352 - DNA, 20 bp, Artificial
  CRISPR gRNA sequence
cccctggcccagcccaggca

SEQ ID NO: 740353 - DNA, 20 bp, Artificial
  CRISPR gRNA sequence
ctggcccagcccaggcagag

SEQ ID NO: 740354 - DNA, 20 bp, Artificial
  CRISPR gRNA sequence
tggcccagcccaggcagagc

SEQ ID NO: 740355 - DNA, 20 bp, Artificial
  CRISPR gRNA sequence
gcccagcccaggcagagcag

SEQ ID NO: 740356 - DNA, 20 bp, Artificial
  CRISPR gRNA sequence
cccagcccaggcagagcagg

SEQ ID NO: 740357 - DNA, 20 bp, Artificial
  CRISPR gRNA sequence
caggcagagcaggaggccct

SEQ ID NO: 740358 - DNA, 20 bp, Artificial
  CRISPR gRNA sequence
gcagagcaggaggccctcag

SEQ ID NO: 740359 - DNA, 20 bp, Artificial
  CRISPR gRNA sequence
ccctcagtggaccattcctt

SEQ ID NO: 740360 - DNA, 20 bp, Artificial
  CRISPR gRNA sequence
cctcagtggaccattccttt

SEQ ID NO: 740361 - DNA, 20 bp, Artificial
  CRISPR gRNA sequence
accattcctttgggcctaac

SEQ ID NO: 740362 - DNA, 20 bp, Artificial
  CRISPR gRNA sequence
ccattcctttgggcctaact

SEQ ID NO: 740363 - DNA, 20 bp, Artificial
  CRISPR gRNA sequence
cattcctttgggcctaactg

SEQ ID NO: 740364 - DNA, 20 bp, Artificial
  CRISPR gRNA sequence
attcctttgggcctaactgg

SEQ ID NO: 740365 - DNA, 20 bp, Artificial
  CRISPR gRNA sequence
ttcctttgggcctaactggg

SEQ ID NO: 740366 - DNA, 20 bp, Artificial
  CRISPR gRNA sequence
ttgggcctaactggggggct

SEQ ID NO: 740367 - DNA, 20 bp, Artificial
  CRISPR gRNA sequence
ggcctaactggggggcttag

SEQ ID NO: 740368 - DNA, 20 bp, Artificial
  CRISPR gRNA sequence
ctaactggggggcttagaag

SEQ ID NO: 740369 - DNA, 20 bp, Artificial
  CRISPR gRNA sequence
taactggggggcttagaagc

SEQ ID NO: 740370 - DNA, 20 bp, Artificial
  CRISPR gRNA sequence
aactggggggcttagaagca

SEQ ID NO: 740371 - DNA, 20 bp, Artificial
  CRISPR gRNA sequence
tagaagcagggccatgtgtc

SEQ ID NO: 740372 - DNA, 20 bp, Artificial
  CRISPR gRNA sequence
agaagcagggccatgtgtcc

SEQ ID NO: 740373 - DNA, 20 bp, Artificial
  CRISPR gRNA sequence
agcagggccatgtgtccagg

SEQ ID NO: 740374 - DNA, 20 bp, Artificial
  CRISPR gRNA sequence
gcagggccatgtgtccaggt

SEQ ID NO: 740375 - DNA, 20 bp, Artificial
  CRISPR gRNA sequence
cagggccatgtgtccaggtg

SEQ ID NO: 740376 - DNA, 20 bp, Artificial
  CRISPR gRNA sequence
tgtgtccaggtggggttccc

SEQ ID NO: 740377 - DNA, 20 bp, Artificial
  CRISPR gRNA sequence
caggtggggttccctggctg

SEQ ID NO: 740378 - DNA, 20 bp, Artificial
  CRISPR gRNA sequence
gggttccctggctgtagcca

SEQ ID NO: 740379 - DNA, 20 bp, Artificial
  CRISPR gRNA sequence
ggttccctggctgtagccac

SEQ ID NO: 740380 - DNA, 20 bp, Artificial
  CRISPR gRNA sequence
cctggctgtagccacaggcc

SEQ ID NO: 740381 - DNA, 20 bp, Artificial
  CRISPR gRNA sequence
ctggctgtagccacaggccc

SEQ ID NO: 740382 - DNA, 20 bp, Artificial
  CRISPR gRNA sequence
tggctgtagccacaggccca

SEQ ID NO: 740383 - DNA, 20 bp, Artificial
  CRISPR gRNA sequence
ggcccagggctcactgctgc

SEQ ID NO: 740384 - DNA, 20 bp, Artificial
  CRISPR gRNA sequence
gcccagggctcactgctgcc

SEQ ID NO: 740385 - DNA, 20 bp, Artificial
  CRISPR gRNA sequence
cagggctcactgctgccagg

SEQ ID NO: 740386 - DNA, 20 bp, Artificial
  CRISPR gRNA sequence
ctcactgctgccaggcagcc

SEQ ID NO: 740387 - DNA, 20 bp, Artificial
  CRISPR gRNA sequence
cactgctgccaggcagccta

SEQ ID NO: 740388 - DNA, 20 bp, Artificial
  CRISPR gRNA sequence
actgctgccaggcagcctag

SEQ ID NO: 740389 - DNA, 20 bp, Artificial
  CRISPR gRNA sequence
ttccatccccccaacccccc

SEQ ID NO: 740390 - DNA, 20 bp, Artificial
  CRISPR gRNA sequence
cccccaaccccccaagcaat

SEQ ID NO: 740391 - DNA, 20 bp, Artificial
  CRISPR gRNA sequence
ccccaaccccccaagcaatt

SEQ ID NO: 740392 - DNA, 20 bp, Artificial
  CRISPR gRNA sequence
tgggcgaacatcttcccgcc

SEQ ID NO: 740393 - DNA, 20 bp, Artificial
  CRISPR gRNA sequence
tcccgcctagccccaaatcc

SEQ ID NO: 740394 - DNA, 20 bp, Artificial
  CRISPR gRNA sequence
tagccccaaatcctggcttt

SEQ ID NO: 740395 - DNA, 20 bp, Artificial
  CRISPR gRNA sequence
aaatcctggctttcagcacc

SEQ ID NO: 740396 - DNA, 20 bp, Artificial
  CRISPR gRNA sequence
aatcctggctttcagcaccc

SEQ ID NO: 740397 - DNA, 20 bp, Artificial
  CRISPR gRNA sequence
tggctttcagcacccaggcc

SEQ ID NO: 740398 - DNA, 20 bp, Artificial
  CRISPR gRNA sequence
ttcagcacccaggcccagct

SEQ ID NO: 740399 - DNA, 20 bp, Artificial
  CRISPR gRNA sequence
agcacccaggcccagctcag

SEQ ID NO: 740400 - DNA, 20 bp, Artificial
  CRISPR gRNA sequence
cacccaggcccagctcagca

SEQ ID NO: 740401 - DNA, 20 bp, Artificial
  CRISPR gRNA sequence
caggcccagctcagcagagc

SEQ ID NO: 740402 - DNA, 20 bp, Artificial
  CRISPR gRNA sequence
ccagctcagcagagccagtg

SEQ ID NO: 740403 - DNA, 20 bp, Artificial
  CRISPR gRNA sequence
cagctcagcagagccagtgt

SEQ ID NO: 740404 - DNA, 20 bp, Artificial
  CRISPR gRNA sequence
gcagagccagtgtaggctgc

SEQ ID NO: 740405 - DNA, 20 bp, Artificial
  CRISPR gRNA sequence
cagagccagtgtaggctgct

SEQ ID NO: 740406 - DNA, 20 bp, Artificial
  CRISPR gRNA sequence
gagccagtgtaggctgctag

SEQ ID NO: 740407 - DNA, 20 bp, Artificial
  CRISPR gRNA sequence
gctgctaggagacaaatgcc

SEQ ID NO: 740408 - DNA, 20 bp, Artificial
  CRISPR gRNA sequence
ctgctaggagacaaatgccc

SEQ ID NO: 740409 - DNA, 20 bp, Artificial
  CRISPR gRNA sequence
taggagacaaatgcccaggc

SEQ ID NO: 740410 - DNA, 20 bp, Artificial
  CRISPR gRNA sequence
aggctggactatgctctcca

SEQ ID NO: 740411 - DNA, 20 bp, Artificial
  CRISPR gRNA sequence
actatgctctccacagtacc

SEQ ID NO: 740412 - DNA, 20 bp, Artificial
  CRISPR gRNA sequence
ctatgctctccacagtacct

SEQ ID NO: 740413 - DNA, 20 bp, Artificial
  CRISPR gRNA sequence
tatgctctccacagtacctg

SEQ ID NO: 740414 - DNA, 20 bp, Artificial
  CRISPR gRNA sequence
ccccatcctgctaaacgcta

SEQ ID NO: 740415 - DNA, 20 bp, Artificial
  CRISPR gRNA sequence
cccatcctgctaaacgctac

SEQ ID NO: 740416 - DNA, 20 bp, Artificial
  CRISPR gRNA sequence
ccatcctgctaaacgctaca

SEQ ID NO: 740417 - DNA, 20 bp, Artificial
  CRISPR gRNA sequence
catcctgctaaacgctacag

SEQ ID NO: 740418 - DNA, 20 bp, Artificial
  CRISPR gRNA sequence
atcctgctaaacgctacagg

SEQ ID NO: 740419 - DNA, 20 bp, Artificial
  CRISPR gRNA sequence
aacgctacagggggtctgcc

SEQ ID NO: 740420 - DNA, 20 bp, Artificial
  CRISPR gRNA sequence
acctcacctgtccccatgct

SEQ ID NO: 740421 - DNA, 20 bp, Artificial
  CRISPR gRNA sequence
cctcacctgtccccatgctc

SEQ ID NO: 740422 - DNA, 20 bp, Artificial
  CRISPR gRNA sequence
tgccttccctgttttacccc

SEQ ID NO: 740423 - DNA, 20 bp, Artificial
  CRISPR gRNA sequence
ccttccctgttttaccccca

SEQ ID NO: 740424 - DNA, 20 bp, Artificial
  CRISPR gRNA sequence
tgttttacccccagagtgta

SEQ ID NO: 740425 - DNA, 20 bp, Artificial
  CRISPR gRNA sequence
ttttacccccagagtgtaca

SEQ ID NO: 740426 - DNA, 20 bp, Artificial
  CRISPR gRNA sequence
atccttcaatcacaattcca

SEQ ID NO: 740427 - DNA, 20 bp, Artificial
  CRISPR gRNA sequence
ccttcaatcacaattccaca

SEQ ID NO: 740428 - DNA, 20 bp, Artificial
  CRISPR gRNA sequence
cttcaatcacaattccacag

SEQ ID NO: 740429 - DNA, 20 bp, Artificial
  CRISPR gRNA sequence
tgcctatgtgtataaaaaca

SEQ ID NO: 740430 - DNA, 20 bp, Artificial
  CRISPR gRNA sequence
tatgtgtataaaaacaaagc

SEQ ID NO: 740431 - DNA, 20 bp, Artificial
  CRISPR gRNA sequence
atgtgtataaaaacaaagcc

SEQ ID NO: 740432 - DNA, 20 bp, Artificial
  CRISPR gRNA sequence
tgtgtataaaaacaaagcca

SEQ ID NO: 740433 - DNA, 20 bp, Artificial
  CRISPR gRNA sequence
caaagccagggcatgcccac

SEQ ID NO: 740434 - DNA, 20 bp, Artificial
  CRISPR gRNA sequence
agccagggcatgcccacaag

SEQ ID NO: 740435 - DNA, 20 bp, Artificial
  CRISPR gRNA sequence
gccagggcatgcccacaagc

SEQ ID NO: 740436 - DNA, 20 bp, Artificial
  CRISPR gRNA sequence
cagggcatgcccacaagcag

SEQ ID NO: 740437 - DNA, 20 bp, Artificial
  CRISPR gRNA sequence
gcatgcccacaagcaggaga

SEQ ID NO: 740438 - DNA, 20 bp, Artificial
  CRISPR gRNA sequence
catgcccacaagcaggagat

SEQ ID NO: 740439 - DNA, 20 bp, Artificial
  CRISPR gRNA sequence
atgggaacatcacccgcacc

SEQ ID NO: 740440 - DNA, 20 bp, Artificial
  CRISPR gRNA sequence
atcacccgcacctggccgaa

SEQ ID NO: 740441 - DNA, 20 bp, Artificial
  CRISPR gRNA sequence
cacctggccgaatggctctg

SEQ ID NO: 740442 - DNA, 20 bp, Artificial
  CRISPR gRNA sequence
ggccgaatggctctgaagcg

SEQ ID NO: 740443 - DNA, 20 bp, Artificial
  CRISPR gRNA sequence
ctctgaagcgaagactccac

SEQ ID NO: 740444 - DNA, 20 bp, Artificial
  CRISPR gRNA sequence
tctgaagcgaagactccacc

SEQ ID NO: 740445 - DNA, 20 bp, Artificial
  CRISPR gRNA sequence
agcgaagactccaccaggcc

SEQ ID NO: 740446 - DNA, 20 bp, Artificial
  CRISPR gRNA sequence
tccaccaggcccagattgta

SEQ ID NO: 740447 - DNA, 20 bp, Artificial
  CRISPR gRNA sequence
caccaggcccagattgtatg

SEQ ID NO: 740448 - DNA, 20 bp, Artificial
  CRISPR gRNA sequence
caggcccagattgtatggag

SEQ ID NO: 740449 - DNA, 20 bp, Artificial
  CRISPR gRNA sequence
gcccagattgtatggagtgg

SEQ ID NO: 740450 - DNA, 20 bp, Artificial
  CRISPR gRNA sequence
cccagattgtatggagtgga

SEQ ID NO: 740451 - DNA, 20 bp, Artificial
  CRISPR gRNA sequence
agattgtatggagtggaagg

SEQ ID NO: 740452 - DNA, 20 bp, Artificial
  CRISPR gRNA sequence
gattgtatggagtggaaggt

SEQ ID NO: 740453 - DNA, 20 bp, Artificial
  CRISPR gRNA sequence
attgtatggagtggaaggtg

SEQ ID NO: 740454 - DNA, 20 bp, Artificial
  CRISPR gRNA sequence
ttgtatggagtggaaggtgg

SEQ ID NO: 740455 - DNA, 20 bp, Artificial
  CRISPR gRNA sequence
tatggagtggaaggtggggg

SEQ ID NO: 740456 - DNA, 20 bp, Artificial
  CRISPR gRNA sequence
atggagtggaaggtgggggt

SEQ ID NO: 740457 - DNA, 20 bp, Artificial
  CRISPR gRNA sequence
tggagtggaaggtgggggtg

SEQ ID NO: 740458 - DNA, 20 bp, Artificial
  CRISPR gRNA sequence
ggagtggaaggtgggggtgg

SEQ ID NO: 740459 - DNA, 20 bp, Artificial
  CRISPR gRNA sequence
agtggaaggtgggggtgggg

SEQ ID NO: 740460 - DNA, 20 bp, Artificial
  CRISPR gRNA sequence
gtggaaggtgggggtggggg

SEQ ID NO: 740461 - DNA, 20 bp, Artificial
  CRISPR gRNA sequence
ggaaggtgggggtgggggag

SEQ ID NO: 740462 - DNA, 20 bp, Artificial
  CRISPR gRNA sequence
aggtgggggtgggggaggag

SEQ ID NO: 740463 - DNA, 20 bp, Artificial
  CRISPR gRNA sequence
tgggggtgggggaggagcag

SEQ ID NO: 740464 - DNA, 20 bp, Artificial
  CRISPR gRNA sequence
ggggtgggggaggagcagca

SEQ ID NO: 740465 - DNA, 20 bp, Artificial
  CRISPR gRNA sequence
gggggaggagcagcagagtg

SEQ ID NO: 740466 - DNA, 20 bp, Artificial
  CRISPR gRNA sequence
agcagagtgcagatttaaac

SEQ ID NO: 740467 - DNA, 20 bp, Artificial
  CRISPR gRNA sequence
tggctcttacaatccatctc

SEQ ID NO: 740468 - DNA, 20 bp, Artificial
  CRISPR gRNA sequence
ggctcttacaatccatctcc

SEQ ID NO: 740469 - DNA, 20 bp, Artificial
  CRISPR gRNA sequence
gctcttacaatccatctcca

SEQ ID NO: 740470 - DNA, 20 bp, Artificial
  CRISPR gRNA sequence
tttgcacctgtttccccatg

SEQ ID NO: 740471 - DNA, 20 bp, Artificial
  CRISPR gRNA sequence
tttccccatgtagtttttaa

SEQ ID NO: 740472 - DNA, 20 bp, Artificial
  CRISPR gRNA sequence
atagcatcccgcttcatact

SEQ ID NO: 740473 - DNA, 20 bp, Artificial
  CRISPR gRNA sequence
gcatcccgcttcatactcag

SEQ ID NO: 740474 - DNA, 20 bp, Artificial
  CRISPR gRNA sequence
cttcatactcagaagtgtcc

SEQ ID NO: 740475 - DNA, 20 bp, Artificial
  CRISPR gRNA sequence
ttcatactcagaagtgtccc

SEQ ID NO: 740476 - DNA, 20 bp, Artificial
  CRISPR gRNA sequence
tcatactcagaagtgtccca

SEQ ID NO: 740477 - DNA, 20 bp, Artificial
  CRISPR gRNA sequence
tactcagaagtgtcccaggg

SEQ ID NO: 740478 - DNA, 20 bp, Artificial
  CRISPR gRNA sequence
agaagtgtcccagggtggac

SEQ ID NO: 740479 - DNA, 20 bp, Artificial
  CRISPR gRNA sequence
agggtggacaagacattgtg

SEQ ID NO: 740480 - DNA, 20 bp, Artificial
  CRISPR gRNA sequence
attgtgtggcacccttgcaa

SEQ ID NO: 740481 - DNA, 20 bp, Artificial
  CRISPR gRNA sequence
cccttgcaatggcccgcgct

SEQ ID NO: 740482 - DNA, 20 bp, Artificial
  CRISPR gRNA sequence
ttgcaatggcccgcgctgag

SEQ ID NO: 740483 - DNA, 20 bp, Artificial
  CRISPR gRNA sequence
caatggcccgcgctgagcag

SEQ ID NO: 740484 - DNA, 20 bp, Artificial
  CRISPR gRNA sequence
aatggcccgcgctgagcagt

SEQ ID NO: 740485 - DNA, 20 bp, Artificial
  CRISPR gRNA sequence
tggcccgcgctgagcagtgg

SEQ ID NO: 740486 - DNA, 20 bp, Artificial
  CRISPR gRNA sequence
cccgcgctgagcagtgggag

SEQ ID NO: 740487 - DNA, 20 bp, Artificial
  CRISPR gRNA sequence
ccgcgctgagcagtgggagt

SEQ ID NO: 740488 - DNA, 20 bp, Artificial
  CRISPR gRNA sequence
cgcgctgagcagtgggagta

SEQ ID NO: 740489 - DNA, 20 bp, Artificial
  CRISPR gRNA sequence
gcgctgagcagtgggagtag

SEQ ID NO: 740490 - DNA, 20 bp, Artificial
  CRISPR gRNA sequence
tgagcagtgggagtagggga

SEQ ID NO: 740491 - DNA, 20 bp, Artificial
  CRISPR gRNA sequence
gagcagtgggagtaggggat

SEQ ID NO: 740492 - DNA, 20 bp, Artificial
  CRISPR gRNA sequence
agcagtgggagtaggggatg

SEQ ID NO: 740493 - DNA, 20 bp, Artificial
  CRISPR gRNA sequence
cagtgggagtaggggatggg

SEQ ID NO: 740494 - DNA, 20 bp, Artificial
  CRISPR gRNA sequence
agtgggagtaggggatgggg

SEQ ID NO: 740495 - DNA, 20 bp, Artificial
  CRISPR gRNA sequence
gtgggagtaggggatgggga

SEQ ID NO: 740496 - DNA, 20 bp, Artificial
  CRISPR gRNA sequence
ggagtaggggatggggaggg

SEQ ID NO: 740497 - DNA, 20 bp, Artificial
  CRISPR gRNA sequence
gagtaggggatggggagggc

SEQ ID NO: 740498 - DNA, 20 bp, Artificial
  CRISPR gRNA sequence
agtaggggatggggagggcg

SEQ ID NO: 740499 - DNA, 20 bp, Artificial
  CRISPR gRNA sequence
gtaggggatggggagggcgg

SEQ ID NO: 740500 - DNA, 20 bp, Artificial
  CRISPR gRNA sequence
taggggatggggagggcggg

SEQ ID NO: 740501 - DNA, 20 bp, Artificial
  CRISPR gRNA sequence
gggatggggagggcgggggg

SEQ ID NO: 740502 - DNA, 20 bp, Artificial
  CRISPR gRNA sequence
ggatggggagggcggggggc

SEQ ID NO: 740503 - DNA, 20 bp, Artificial
  CRISPR gRNA sequence
cccctctccactcaccttcc

SEQ ID NO: 740504 - DNA, 20 bp, Artificial
  CRISPR gRNA sequence
ctctccactcaccttcccag

SEQ ID NO: 740505 - DNA, 20 bp, Artificial
  CRISPR gRNA sequence
tctccactcaccttcccaga

SEQ ID NO: 740506 - DNA, 20 bp, Artificial
  CRISPR gRNA sequence
aaggccccacccacctccct

SEQ ID NO: 740507 - DNA, 20 bp, Artificial
  CRISPR gRNA sequence
acctccctcagcaccatctc

SEQ ID NO: 740508 - DNA, 20 bp, Artificial
  CRISPR gRNA sequence
tccctcagcaccatctccag

SEQ ID NO: 740509 - DNA, 20 bp, Artificial
  CRISPR gRNA sequence
ccctcagcaccatctccagt

SEQ ID NO: 740510 - DNA, 20 bp, Artificial
  CRISPR gRNA sequence
tcagcaccatctccagtggg

SEQ ID NO: 740511 - DNA, 20 bp, Artificial
  CRISPR gRNA sequence
cagcaccatctccagtgggt

SEQ ID NO: 740512 - DNA, 20 bp, Artificial
  CRISPR gRNA sequence
agcaccatctccagtgggtg

SEQ ID NO: 740513 - DNA, 20 bp, Artificial
  CRISPR gRNA sequence
gggtggggcaacatctgtcc

SEQ ID NO: 740514 - DNA, 20 bp, Artificial
  CRISPR gRNA sequence
ggcaacatctgtcctggcct

SEQ ID NO: 740515 - DNA, 20 bp, Artificial
  CRISPR gRNA sequence
gtcctggcctcagattgccc

SEQ ID NO: 740516 - DNA, 20 bp, Artificial
  CRISPR gRNA sequence
cccaagacaccatttgctca

SEQ ID NO: 740517 - DNA, 20 bp, Artificial
  CRISPR gRNA sequence
caagacaccatttgctcacg

SEQ ID NO: 740518 - DNA, 20 bp, Artificial
  CRISPR gRNA sequence
aagacaccatttgctcacgg

SEQ ID NO: 740519 - DNA, 20 bp, Artificial
  CRISPR gRNA sequence
ccaatatgtacttcccgttt

SEQ ID NO: 740520 - DNA, 20 bp, Artificial
  CRISPR gRNA sequence
caatatgtacttcccgtttc

SEQ ID NO: 740521 - DNA, 20 bp, Artificial
  CRISPR gRNA sequence
cttcccgtttcgggaccacc

SEQ ID NO: 740522 - DNA, 20 bp, Artificial
  CRISPR gRNA sequence
gtttcgggaccaccaagctc

SEQ ID NO: 740523 - DNA, 20 bp, Artificial
  CRISPR gRNA sequence
tttcgggaccaccaagctct

SEQ ID NO: 740524 - DNA, 20 bp, Artificial
  CRISPR gRNA sequence
ttcgggaccaccaagctctg

SEQ ID NO: 740525 - DNA, 20 bp, Artificial
  CRISPR gRNA sequence
gaccaccaagctctggggac

SEQ ID NO: 740526 - DNA, 20 bp, Artificial
  CRISPR gRNA sequence
aagctctggggactggaatg

SEQ ID NO: 740527 - DNA, 20 bp, Artificial
  CRISPR gRNA sequence
agctctggggactggaatgc

SEQ ID NO: 740528 - DNA, 20 bp, Artificial
  CRISPR gRNA sequence
tctggggactggaatgcagg

SEQ ID NO: 740529 - DNA, 20 bp, Artificial
  CRISPR gRNA sequence
ggggactggaatgcaggcag

SEQ ID NO: 740530 - DNA, 20 bp, Artificial
  CRISPR gRNA sequence
gactggaatgcaggcagtgg

SEQ ID NO: 740531 - DNA, 20 bp, Artificial
  CRISPR gRNA sequence
aatgcaggcagtggaagccc

SEQ ID NO: 740532 - DNA, 20 bp, Artificial
  CRISPR gRNA sequence
agattgacttaacctgttga

SEQ ID NO: 740533 - DNA, 20 bp, Artificial
  CRISPR gRNA sequence
ttaacctgttgacagatctt

SEQ ID NO: 740534 - DNA, 20 bp, Artificial
  CRISPR gRNA sequence
aacctgttgacagatcttca

SEQ ID NO: 740535 - DNA, 20 bp, Artificial
  CRISPR gRNA sequence
cagatcttcagagaaactgc

SEQ ID NO: 740536 - DNA, 20 bp, Artificial
  CRISPR gRNA sequence
atcttcagagaaactgctgg

SEQ ID NO: 740537 - DNA, 20 bp, Artificial
  CRISPR gRNA sequence
tcttcagagaaactgctggt

SEQ ID NO: 740538 - DNA, 20 bp, Artificial
  CRISPR gRNA sequence
ttcagagaaactgctggtag

SEQ ID NO: 740539 - DNA, 20 bp, Artificial
  CRISPR gRNA sequence
tcagagaaactgctggtagg

SEQ ID NO: 740540 - DNA, 20 bp, Artificial
  CRISPR gRNA sequence
gagaaactgctggtaggagg

SEQ ID NO: 740541 - DNA, 20 bp, Artificial
  CRISPR gRNA sequence
aactgctggtaggaggcagc

SEQ ID NO: 740542 - DNA, 20 bp, Artificial
  CRISPR gRNA sequence
actgctggtaggaggcagct

SEQ ID NO: 740543 - DNA, 20 bp, Artificial
  CRISPR gRNA sequence
ctgctggtaggaggcagctg

SEQ ID NO: 740544 - DNA, 20 bp, Artificial
  CRISPR gRNA sequence
ctggtaggaggcagctgggg

SEQ ID NO: 740545 - DNA, 20 bp, Artificial
  CRISPR gRNA sequence
tggtaggaggcagctgggga

SEQ ID NO: 740546 - DNA, 20 bp, Artificial
  CRISPR gRNA sequence
taggaggcagctggggaagg

SEQ ID NO: 740547 - DNA, 20 bp, Artificial
  CRISPR gRNA sequence
gcagctggggaaggtggcga

SEQ ID NO: 740548 - DNA, 20 bp, Artificial
  CRISPR gRNA sequence
ctggggaaggtggcgatggc

SEQ ID NO: 740549 - DNA, 20 bp, Artificial
  CRISPR gRNA sequence
gggaaggtggcgatggccag

SEQ ID NO: 740550 - DNA, 20 bp, Artificial
  CRISPR gRNA sequence
ggaaggtggcgatggccagt

SEQ ID NO: 740551 - DNA, 20 bp, Artificial
  CRISPR gRNA sequence
aggtggcgatggccagtggg

SEQ ID NO: 740552 - DNA, 20 bp, Artificial
  CRISPR gRNA sequence
ggtggcgatggccagtgggc

SEQ ID NO: 740553 - DNA, 20 bp, Artificial
  CRISPR gRNA sequence
ggcgatggccagtgggcagg

SEQ ID NO: 740554 - DNA, 20 bp, Artificial
  CRISPR gRNA sequence
gcgatggccagtgggcaggc

SEQ ID NO: 740555 - DNA, 20 bp, Artificial
  CRISPR gRNA sequence
ggccagtgggcaggcaggcc

SEQ ID NO: 740556 - DNA, 20 bp, Artificial
  CRISPR gRNA sequence
tgggcaggcaggcctggccc

SEQ ID NO: 740557 - DNA, 20 bp, Artificial
  CRISPR gRNA sequence
ggcaggcaggcctggcccca

SEQ ID NO: 740558 - DNA, 20 bp, Artificial
  CRISPR gRNA sequence
gcctggccccagagccactg

SEQ ID NO: 740559 - DNA, 20 bp, Artificial
  CRISPR gRNA sequence
cccagagccactgtggtaca

SEQ ID NO: 740560 - DNA, 20 bp, Artificial
  CRISPR gRNA sequence
cagagccactgtggtacaaa

SEQ ID NO: 740561 - DNA, 20 bp, Artificial
  CRISPR gRNA sequence
agagccactgtggtacaaag

SEQ ID NO: 740562 - DNA, 20 bp, Artificial
  CRISPR gRNA sequence
gccactgtggtacaaagagg

SEQ ID NO: 740563 - DNA, 20 bp, Artificial
  CRISPR gRNA sequence
ggtacaaagaggaagtctga

SEQ ID NO: 740564 - DNA, 20 bp, Artificial
  CRISPR gRNA sequence
acaaagaggaagtctgacag

SEQ ID NO: 740565 - DNA, 20 bp, Artificial
  CRISPR gRNA sequence
aaagaggaagtctgacagaa

SEQ ID NO: 740566 - DNA, 20 bp, Artificial
  CRISPR gRNA sequence
gaggaagtctgacagaagag

SEQ ID NO: 740567 - DNA, 20 bp, Artificial
  CRISPR gRNA sequence
gtctgacagaagagcagcct

SEQ ID NO: 740568 - DNA, 20 bp, Artificial
  CRISPR gRNA sequence
tctgacagaagagcagcctc

SEQ ID NO: 740569 - DNA, 20 bp, Artificial
  CRISPR gRNA sequence
aagagcagcctcgggcaaaa

SEQ ID NO: 740570 - DNA, 20 bp, Artificial
  CRISPR gRNA sequence
agagcagcctcgggcaaaac

SEQ ID NO: 740571 - DNA, 20 bp, Artificial
  CRISPR gRNA sequence
gagcagcctcgggcaaaacg

SEQ ID NO: 740572 - DNA, 20 bp, Artificial
  CRISPR gRNA sequence
agcagcctcgggcaaaacgg

SEQ ID NO: 740573 - DNA, 20 bp, Artificial
  CRISPR gRNA sequence
cagcctcgggcaaaacgggg

SEQ ID NO: 740574 - DNA, 20 bp, Artificial
  CRISPR gRNA sequence
tcgggcaaaacgggggagcc

SEQ ID NO: 740575 - DNA, 20 bp, Artificial
  CRISPR gRNA sequence
cgggcaaaacgggggagcca

SEQ ID NO: 740576 - DNA, 20 bp, Artificial
  CRISPR gRNA sequence
gcaaaacgggggagccaagg

SEQ ID NO: 740577 - DNA, 20 bp, Artificial
  CRISPR gRNA sequence
cgggggagccaaggcggcca

SEQ ID NO: 740578 - DNA, 20 bp, Artificial
  CRISPR gRNA sequence
gggggagccaaggcggccac

SEQ ID NO: 740579 - DNA, 20 bp, Artificial
  CRISPR gRNA sequence
ggggagccaaggcggccacg

SEQ ID NO: 740580 - DNA, 20 bp, Artificial
  CRISPR gRNA sequence
gggagccaaggcggccacgg

SEQ ID NO: 740581 - DNA, 20 bp, Artificial
  CRISPR gRNA sequence
gagccaaggcggccacgggg

SEQ ID NO: 740582 - DNA, 20 bp, Artificial
  CRISPR gRNA sequence
ccaaggcggccacgggggag

SEQ ID NO: 740583 - DNA, 20 bp, Artificial
  CRISPR gRNA sequence
tctccaccgtgccctgtgtc

SEQ ID NO: 740584 - DNA, 20 bp, Artificial
  CRISPR gRNA sequence
cgtgccctgtgtctggtgcc

SEQ ID NO: 740585 - DNA, 20 bp, Artificial
  CRISPR gRNA sequence
gtgccctgtgtctggtgcct

SEQ ID NO: 740586 - DNA, 20 bp, Artificial
  CRISPR gRNA sequence
gccctgtgtctggtgcctgg

SEQ ID NO: 740587 - DNA, 20 bp, Artificial
  CRISPR gRNA sequence
ccctgtgtctggtgcctggg

SEQ ID NO: 740588 - DNA, 20 bp, Artificial
  CRISPR gRNA sequence
cctgtgtctggtgcctggga

SEQ ID NO: 740589 - DNA, 20 bp, Artificial
  CRISPR gRNA sequence
gtgtctggtgcctgggaggg

SEQ ID NO: 740590 - DNA, 20 bp, Artificial
  CRISPR gRNA sequence
tggtgcctgggagggtggcc

SEQ ID NO: 740591 - DNA, 20 bp, Artificial
  CRISPR gRNA sequence
cactgatgctgccacatccc

SEQ ID NO: 740592 - DNA, 20 bp, Artificial
  CRISPR gRNA sequence
actgatgctgccacatccca

SEQ ID NO: 740593 - DNA, 20 bp, Artificial
  CRISPR gRNA sequence
acatcccaaggctcatgtct

SEQ ID NO: 740594 - DNA, 20 bp, Artificial
  CRISPR gRNA sequence
caaggctcatgtctcagaac

SEQ ID NO: 740595 - DNA, 20 bp, Artificial
  CRISPR gRNA sequence
aggctcatgtctcagaacga

SEQ ID NO: 740596 - DNA, 20 bp, Artificial
  CRISPR gRNA sequence
tctcagaacgagagctgctg

SEQ ID NO: 740597 - DNA, 20 bp, Artificial
  CRISPR gRNA sequence
ctcagaacgagagctgctga

SEQ ID NO: 740598 - DNA, 20 bp, Artificial
  CRISPR gRNA sequence
tcagaacgagagctgctgaa

SEQ ID NO: 740599 - DNA, 20 bp, Artificial
  CRISPR gRNA sequence
aacgagagctgctgaagggc

SEQ ID NO: 740600 - DNA, 20 bp, Artificial
  CRISPR gRNA sequence
gctgaagggctggacgttct

SEQ ID NO: 740601 - DNA, 20 bp, Artificial
  CRISPR gRNA sequence
tggacgttctgagacttctt

SEQ ID NO: 740602 - DNA, 20 bp, Artificial
  CRISPR gRNA sequence
tctgagacttcttaagatgt

SEQ ID NO: 740603 - DNA, 20 bp, Artificial
  CRISPR gRNA sequence
ttcttaagatgtaagtcatt

SEQ ID NO: 740604 - DNA, 20 bp, Artificial
  CRISPR gRNA sequence
tgtaagtcatttggcatctg

SEQ ID NO: 740605 - DNA, 20 bp, Artificial
  CRISPR gRNA sequence
agtcatttggcatctgtagc

SEQ ID NO: 740606 - DNA, 20 bp, Artificial
  CRISPR gRNA sequence
catctgtagctggtgaattt

SEQ ID NO: 740607 - DNA, 20 bp, Artificial
  CRISPR gRNA sequence
atctgtagctggtgaatttc

SEQ ID NO: 740608 - DNA, 20 bp, Artificial
  CRISPR gRNA sequence
gctggtgaatttcaggtctc

SEQ ID NO: 740609 - DNA, 20 bp, Artificial
  CRISPR gRNA sequence
ctggtgaatttcaggtctct

SEQ ID NO: 740610 - DNA, 20 bp, Artificial
  CRISPR gRNA sequence
tggtgaatttcaggtctcta

SEQ ID NO: 740611 - DNA, 20 bp, Artificial
  CRISPR gRNA sequence
ggtgaatttcaggtctctag

SEQ ID NO: 740612 - DNA, 20 bp, Artificial
  CRISPR gRNA sequence
tgaatttcaggtctctaggg

SEQ ID NO: 740613 - DNA, 20 bp, Artificial
  CRISPR gRNA sequence
aggtctctaggggagaatct

SEQ ID NO: 740614 - DNA, 20 bp, Artificial
  CRISPR gRNA sequence
tctcagcaccccaaaatcct

SEQ ID NO: 740615 - DNA, 20 bp, Artificial
  CRISPR gRNA sequence
gcaccccaaaatccttggaa

SEQ ID NO: 740616 - DNA, 20 bp, Artificial
  CRISPR gRNA sequence
caccccaaaatccttggaac

SEQ ID NO: 740617 - DNA, 20 bp, Artificial
  CRISPR gRNA sequence
accccaaaatccttggaaca

SEQ ID NO: 740618 - DNA, 20 bp, Artificial
  CRISPR gRNA sequence
ccccaaaatccttggaacag

SEQ ID NO: 740619 - DNA, 20 bp, Artificial
  CRISPR gRNA sequence
aaatccttggaacaggggct

SEQ ID NO: 740620 - DNA, 20 bp, Artificial
  CRISPR gRNA sequence
ggaacaggggctgagccgtc

SEQ ID NO: 740621 - DNA, 20 bp, Artificial
  CRISPR gRNA sequence
agccgtccagcatccccatg

SEQ ID NO: 740622 - DNA, 20 bp, Artificial
  CRISPR gRNA sequence
cagcatccccatgtagcatc

SEQ ID NO: 740623 - DNA, 20 bp, Artificial
  CRISPR gRNA sequence
gcatccccatgtagcatcca

SEQ ID NO: 740624 - DNA, 20 bp, Artificial
  CRISPR gRNA sequence
catccccatgtagcatccag

SEQ ID NO: 740625 - DNA, 20 bp, Artificial
  CRISPR gRNA sequence
atccccatgtagcatccaga

SEQ ID NO: 740626 - DNA, 20 bp, Artificial
  CRISPR gRNA sequence
tccccatgtagcatccagag

SEQ ID NO: 740627 - DNA, 20 bp, Artificial
  CRISPR gRNA sequence
atgtagcatccagaggggtt

SEQ ID NO: 740628 - DNA, 20 bp, Artificial
  CRISPR gRNA sequence
tgtagcatccagaggggttg

SEQ ID NO: 740629 - DNA, 20 bp, Artificial
  CRISPR gRNA sequence
gtagcatccagaggggttga

SEQ ID NO: 740630 - DNA, 20 bp, Artificial
  CRISPR gRNA sequence
tagcatccagaggggttgag

SEQ ID NO: 740631 - DNA, 20 bp, Artificial
  CRISPR gRNA sequence
atccagaggggttgaggggc

SEQ ID NO: 740632 - DNA, 20 bp, Artificial
  CRISPR gRNA sequence
tccagaggggttgaggggct

SEQ ID NO: 740633 - DNA, 20 bp, Artificial
  CRISPR gRNA sequence
gggttgaggggctgggcttc

SEQ ID NO: 740634 - DNA, 20 bp, Artificial
  CRISPR gRNA sequence
ggttgaggggctgggcttct

SEQ ID NO: 740635 - DNA, 20 bp, Artificial
  CRISPR gRNA sequence
gctgggcttctgggatgtca

SEQ ID NO: 740636 - DNA, 20 bp, Artificial
  CRISPR gRNA sequence
tctgggatgtcacagtatct

SEQ ID NO: 740637 - DNA, 20 bp, Artificial
  CRISPR gRNA sequence
gatgtcacagtatctgagcc

SEQ ID NO: 740638 - DNA, 20 bp, Artificial
  CRISPR gRNA sequence
tgtcacagtatctgagccca

SEQ ID NO: 740639 - DNA, 20 bp, Artificial
  CRISPR gRNA sequence
cacagtatctgagcccagag

SEQ ID NO: 740640 - DNA, 20 bp, Artificial
  CRISPR gRNA sequence
acagtatctgagcccagagc

SEQ ID NO: 740641 - DNA, 20 bp, Artificial
  CRISPR gRNA sequence
agtatctgagcccagagcag

SEQ ID NO: 740642 - DNA, 20 bp, Artificial
  CRISPR gRNA sequence
gtatctgagcccagagcagg

SEQ ID NO: 740643 - DNA, 20 bp, Artificial
  CRISPR gRNA sequence
tatctgagcccagagcagga

SEQ ID NO: 740644 - DNA, 20 bp, Artificial
  CRISPR gRNA sequence
tctgagcccagagcaggagg

SEQ ID NO: 740645 - DNA, 20 bp, Artificial
  CRISPR gRNA sequence
ctgagcccagagcaggaggg

SEQ ID NO: 740646 - DNA, 20 bp, Artificial
  CRISPR gRNA sequence
tgagcccagagcaggaggga

SEQ ID NO: 740647 - DNA, 20 bp, Artificial
  CRISPR gRNA sequence
cagagcaggagggagggaac

SEQ ID NO: 740648 - DNA, 20 bp, Artificial
  CRISPR gRNA sequence
agagcaggagggagggaacc

SEQ ID NO: 740649 - DNA, 20 bp, Artificial
  CRISPR gRNA sequence
gagcaggagggagggaacca

SEQ ID NO: 740650 - DNA, 20 bp, Artificial
  CRISPR gRNA sequence
ggagggagggaaccagggcc

SEQ ID NO: 740651 - DNA, 20 bp, Artificial
  CRISPR gRNA sequence
gagggagggaaccagggccg

SEQ ID NO: 740652 - DNA, 20 bp, Artificial
  CRISPR gRNA sequence
agggaaccagggccgaggcc

SEQ ID NO: 740653 - DNA, 20 bp, Artificial
  CRISPR gRNA sequence
gggaaccagggccgaggcca

SEQ ID NO: 740654 - DNA, 20 bp, Artificial
  CRISPR gRNA sequence
gaaccagggccgaggccaag

SEQ ID NO: 740655 - DNA, 20 bp, Artificial
  CRISPR gRNA sequence
aaccagggccgaggccaagg

SEQ ID NO: 740656 - DNA, 20 bp, Artificial
  CRISPR gRNA sequence
gaggccaaggaggccactca

SEQ ID NO: 740657 - DNA, 20 bp, Artificial
  CRISPR gRNA sequence
ggccaaggaggccactcaca

SEQ ID NO: 740658 - DNA, 20 bp, Artificial
  CRISPR gRNA sequence
aaggaggccactcacagagc

SEQ ID NO: 740659 - DNA, 20 bp, Artificial
  CRISPR gRNA sequence
gccactcacagagccagccc

SEQ ID NO: 740660 - DNA, 20 bp, Artificial
  CRISPR gRNA sequence
tggctcaaatgcacctgccc

SEQ ID NO: 740661 - DNA, 20 bp, Artificial
  CRISPR gRNA sequence
aaatgcacctgccccagacc

SEQ ID NO: 740662 - DNA, 20 bp, Artificial
  CRISPR gRNA sequence
tgccccagacccagccacaa

SEQ ID NO: 740663 - DNA, 20 bp, Artificial
  CRISPR gRNA sequence
cacaacagcccactgtcccc

SEQ ID NO: 740664 - DNA, 20 bp, Artificial
  CRISPR gRNA sequence
acagcccactgtcccccagc

SEQ ID NO: 740665 - DNA, 20 bp, Artificial
  CRISPR gRNA sequence
cagcccactgtcccccagct

SEQ ID NO: 740666 - DNA, 20 bp, Artificial
  CRISPR gRNA sequence
ccactgtcccccagctgggc

SEQ ID NO: 740667 - DNA, 20 bp, Artificial
  CRISPR gRNA sequence
agctgggctagatgacctca

SEQ ID NO: 740668 - DNA, 20 bp, Artificial
  CRISPR gRNA sequence
ggctagatgacctcaaagtt

SEQ ID NO: 740669 - DNA, 20 bp, Artificial
  CRISPR gRNA sequence
ctagatgacctcaaagtttg

SEQ ID NO: 740670 - DNA, 20 bp, Artificial
  CRISPR gRNA sequence
agatgacctcaaagtttgga

SEQ ID NO: 740671 - DNA, 20 bp, Artificial
  CRISPR gRNA sequence
gacctcaaagtttggagagt

SEQ ID NO: 740672 - DNA, 20 bp, Artificial
  CRISPR gRNA sequence
acctcaaagtttggagagtc

SEQ ID NO: 740673 - DNA, 20 bp, Artificial
  CRISPR gRNA sequence
cctcaaagtttggagagtca

SEQ ID NO: 740674 - DNA, 20 bp, Artificial
  CRISPR gRNA sequence
aaagtttggagagtcaggga

SEQ ID NO: 740675 - DNA, 20 bp, Artificial
  CRISPR gRNA sequence
aagtttggagagtcagggac

SEQ ID NO: 740676 - DNA, 20 bp, Artificial
  CRISPR gRNA sequence
agtttggagagtcagggaca

SEQ ID NO: 740677 - DNA, 20 bp, Artificial
  CRISPR gRNA sequence
gagtcagggacagggtctgc

SEQ ID NO: 740678 - DNA, 20 bp, Artificial
  CRISPR gRNA sequence
agggacagggtctgcaagaa

SEQ ID NO: 740679 - DNA, 20 bp, Artificial
  CRISPR gRNA sequence
gggacagggtctgcaagaaa

SEQ ID NO: 740680 - DNA, 20 bp, Artificial
  CRISPR gRNA sequence
gacagggtctgcaagaaaag

SEQ ID NO: 740681 - DNA, 20 bp, Artificial
  CRISPR gRNA sequence
agggtctgcaagaaaaggag

SEQ ID NO: 740682 - DNA, 20 bp, Artificial
  CRISPR gRNA sequence
ctgcaagaaaaggagaagca

SEQ ID NO: 740683 - DNA, 20 bp, Artificial
  CRISPR gRNA sequence
aaaaggagaagcaaagtgaa

SEQ ID NO: 740684 - DNA, 20 bp, Artificial
  CRISPR gRNA sequence
aaaggagaagcaaagtgaac

SEQ ID NO: 740685 - DNA, 20 bp, Artificial
  CRISPR gRNA sequence
aaggagaagcaaagtgaacg

SEQ ID NO: 740686 - DNA, 20 bp, Artificial
  CRISPR gRNA sequence
caccctcaaccccaccccgt

SEQ ID NO: 740687 - DNA, 20 bp, Artificial
  CRISPR gRNA sequence
accctcaaccccaccccgtg

SEQ ID NO: 740688 - DNA, 20 bp, Artificial
  CRISPR gRNA sequence
aaccccaccccgtgaggccg

SEQ ID NO: 740689 - DNA, 20 bp, Artificial
  CRISPR gRNA sequence
cgtgaggccgtggaactctt

SEQ ID NO: 740690 - DNA, 20 bp, Artificial
  CRISPR gRNA sequence
gtgaggccgtggaactcttc

SEQ ID NO: 740691 - DNA, 20 bp, Artificial
  CRISPR gRNA sequence
tgaggccgtggaactcttca

SEQ ID NO: 740692 - DNA, 20 bp, Artificial
  CRISPR gRNA sequence
aggccgtggaactcttcagg

SEQ ID NO: 740693 - DNA, 20 bp, Artificial
  CRISPR gRNA sequence
ggccgtggaactcttcaggg

SEQ ID NO: 740694 - DNA, 20 bp, Artificial
  CRISPR gRNA sequence
gaactcttcagggaggtgaa

SEQ ID NO: 740695 - DNA, 20 bp, Artificial
  CRISPR gRNA sequence
aactcttcagggaggtgaat

SEQ ID NO: 740696 - DNA, 20 bp, Artificial
  CRISPR gRNA sequence
actcttcagggaggtgaatg

SEQ ID NO: 740697 - DNA, 20 bp, Artificial
  CRISPR gRNA sequence
ctcttcagggaggtgaatgg

SEQ ID NO: 740698 - DNA, 20 bp, Artificial
  CRISPR gRNA sequence
caccctcaaccccaccccgt

SEQ ID NO: 740699 - DNA, 20 bp, Artificial
  CRISPR gRNA sequence
accctcaaccccaccccgtg

SEQ ID NO: 740700 - DNA, 20 bp, Artificial
  CRISPR gRNA sequence
aaccccaccccgtgaggccg

SEQ ID NO: 740701 - DNA, 20 bp, Artificial
  CRISPR gRNA sequence
cgtgaggccgtggaactctt

SEQ ID NO: 740702 - DNA, 20 bp, Artificial
  CRISPR gRNA sequence
gtgaggccgtggaactcttc

SEQ ID NO: 740703 - DNA, 20 bp, Artificial
  CRISPR gRNA sequence
tgaggccgtggaactcttca

SEQ ID NO: 740704 - DNA, 20 bp, Artificial
  CRISPR gRNA sequence
aggccgtggaactcttcagg

SEQ ID NO: 740705 - DNA, 20 bp, Artificial
  CRISPR gRNA sequence
ggccgtggaactcttcaggg

SEQ ID NO: 740706 - DNA, 20 bp, Artificial
  CRISPR gRNA sequence
gaactcttcagggaggtgaa

SEQ ID NO: 740707 - DNA, 20 bp, Artificial
  CRISPR gRNA sequence
aactcttcagggaggtgaat

SEQ ID NO: 740708 - DNA, 20 bp, Artificial
  CRISPR gRNA sequence
actcttcagggaggtgaatg

SEQ ID NO: 740709 - DNA, 20 bp, Artificial
  CRISPR gRNA sequence
ctcttcagggaggtgaatgg

SEQ ID NO: 740710 - DNA, 20 bp, Artificial
  CRISPR gRNA sequence
caccctcaaccccaccccgt

SEQ ID NO: 740711 - DNA, 20 bp, Artificial
  CRISPR gRNA sequence
accctcaaccccaccccgtg

SEQ ID NO: 740712 - DNA, 20 bp, Artificial
  CRISPR gRNA sequence
aaccccaccccgtgaggccg

SEQ ID NO: 740713 - DNA, 20 bp, Artificial
  CRISPR gRNA sequence
cgtgaggccgtggaactctt

SEQ ID NO: 740714 - DNA, 20 bp, Artificial
  CRISPR gRNA sequence
gtgaggccgtggaactcttc

SEQ ID NO: 740715 - DNA, 20 bp, Artificial
  CRISPR gRNA sequence
tgaggccgtggaactcttca

SEQ ID NO: 740716 - DNA, 20 bp, Artificial
  CRISPR gRNA sequence
aggccgtggaactcttcagg

SEQ ID NO: 740717 - DNA, 20 bp, Artificial
  CRISPR gRNA sequence
ggccgtggaactcttcaggg

SEQ ID NO: 740718 - DNA, 20 bp, Artificial
  CRISPR gRNA sequence
gaactcttcagggaggtgaa

SEQ ID NO: 740719 - DNA, 20 bp, Artificial
  CRISPR gRNA sequence
aactcttcagggaggtgaat

SEQ ID NO: 740720 - DNA, 20 bp, Artificial
  CRISPR gRNA sequence
actcttcagggaggtgaatg

SEQ ID NO: 740721 - DNA, 20 bp, Artificial
  CRISPR gRNA sequence
ctcttcagggaggtgaatgg

SEQ ID NO: 740722 - DNA, 20 bp, Artificial
  CRISPR gRNA sequence
caccctcaaccccaccccgt

SEQ ID NO: 740723 - DNA, 20 bp, Artificial
  CRISPR gRNA sequence
accctcaaccccaccccgtg

SEQ ID NO: 740724 - DNA, 20 bp, Artificial
  CRISPR gRNA sequence
aaccccaccccgtgaggccg

SEQ ID NO: 740725 - DNA, 20 bp, Artificial
  CRISPR gRNA sequence
cgtgaggccgtggaactctt

SEQ ID NO: 740726 - DNA, 20 bp, Artificial
  CRISPR gRNA sequence
gtgaggccgtggaactcttc

SEQ ID NO: 740727 - DNA, 20 bp, Artificial
  CRISPR gRNA sequence
tgaggccgtggaactcttca

SEQ ID NO: 740728 - DNA, 20 bp, Artificial
  CRISPR gRNA sequence
aggccgtggaactcttcagg

SEQ ID NO: 740729 - DNA, 20 bp, Artificial
  CRISPR gRNA sequence
ggccgtggaactcttcaggg

SEQ ID NO: 740730 - DNA, 20 bp, Artificial
  CRISPR gRNA sequence
gccgtggaactcttcaggga

SEQ ID NO: 740731 - DNA, 20 bp, Artificial
  CRISPR gRNA sequence
gtggaactcttcagggaggg

SEQ ID NO: 740732 - DNA, 20 bp, Artificial
  CRISPR gRNA sequence
tggaactcttcagggagggc

SEQ ID NO: 740733 - DNA, 20 bp, Artificial
  CRISPR gRNA sequence
ggaactcttcagggagggca

SEQ ID NO: 740734 - DNA, 20 bp, Artificial
  CRISPR gRNA sequence
aactcttcagggagggcagg

SEQ ID NO: 740735 - DNA, 20 bp, Artificial
  CRISPR gRNA sequence
cttcagggagggcagggagt

SEQ ID NO: 740736 - DNA, 20 bp, Artificial
  CRISPR gRNA sequence
ttcagggagggcagggagtg

SEQ ID NO: 740737 - DNA, 20 bp, Artificial
  CRISPR gRNA sequence
ggagtgaggccgatgccctg

SEQ ID NO: 740738 - DNA, 20 bp, Artificial
  CRISPR gRNA sequence
gagtgaggccgatgccctgc

SEQ ID NO: 740739 - DNA, 20 bp, Artificial
  CRISPR gRNA sequence
gccgatgccctgcaggccat

SEQ ID NO: 740740 - DNA, 20 bp, Artificial
  CRISPR gRNA sequence
ccgatgccctgcaggccatg

SEQ ID NO: 740741 - DNA, 20 bp, Artificial
  CRISPR gRNA sequence
gccatgaggtcatgacctta

SEQ ID NO: 740742 - DNA, 20 bp, Artificial
  CRISPR gRNA sequence
ccatgaggtcatgaccttac

SEQ ID NO: 740743 - DNA, 20 bp, Artificial
  CRISPR gRNA sequence
ttacaggtcatcgtgctgtg

SEQ ID NO: 740744 - DNA, 20 bp, Artificial
  CRISPR gRNA sequence
tacaggtcatcgtgctgtga

SEQ ID NO: 740745 - DNA, 20 bp, Artificial
  CRISPR gRNA sequence
ggtcatcgtgctgtgaaggt

SEQ ID NO: 740746 - DNA, 20 bp, Artificial
  CRISPR gRNA sequence
gtcatcgtgctgtgaaggtc

SEQ ID NO: 740747 - DNA, 20 bp, Artificial
  CRISPR gRNA sequence
aaggtcaggaaacacttacc

SEQ ID NO: 740748 - DNA, 20 bp, Artificial
  CRISPR gRNA sequence
aggtcaggaaacacttaccc

SEQ ID NO: 740749 - DNA, 20 bp, Artificial
  CRISPR gRNA sequence
ggtcaggaaacacttaccca

SEQ ID NO: 740750 - DNA, 20 bp, Artificial
  CRISPR gRNA sequence
aggaaacacttacccaggga

SEQ ID NO: 740751 - DNA, 20 bp, Artificial
  CRISPR gRNA sequence
ggaaacacttacccagggat

SEQ ID NO: 740752 - DNA, 20 bp, Artificial
  CRISPR gRNA sequence
aacacttacccagggatggg

SEQ ID NO: 740753 - DNA, 20 bp, Artificial
  CRISPR gRNA sequence
acttacccagggatgggaag

SEQ ID NO: 740754 - DNA, 20 bp, Artificial
  CRISPR gRNA sequence
ggatgggaagaagacgtctc

SEQ ID NO: 740755 - DNA, 20 bp, Artificial
  CRISPR gRNA sequence
gatgggaagaagacgtctcc

SEQ ID NO: 740756 - DNA, 20 bp, Artificial
  CRISPR gRNA sequence
atgggaagaagacgtctccg

SEQ ID NO: 740757 - DNA, 20 bp, Artificial
  CRISPR gRNA sequence
aagaagacgtctccggggcc

SEQ ID NO: 740758 - DNA, 20 bp, Artificial
  CRISPR gRNA sequence
gaagacgtctccggggcctg

SEQ ID NO: 740759 - DNA, 20 bp, Artificial
  CRISPR gRNA sequence
aagacgtctccggggcctgg

SEQ ID NO: 740760 - DNA, 20 bp, Artificial
  CRISPR gRNA sequence
gacgtctccggggcctggag

SEQ ID NO: 740761 - DNA, 20 bp, Artificial
  CRISPR gRNA sequence
tctccggggcctggaggaga

SEQ ID NO: 740762 - DNA, 20 bp, Artificial
  CRISPR gRNA sequence
ctccggggcctggaggagac

SEQ ID NO: 740763 - DNA, 20 bp, Artificial
  CRISPR gRNA sequence
tccggggcctggaggagaca

SEQ ID NO: 740764 - DNA, 20 bp, Artificial
  CRISPR gRNA sequence
ccggggcctggaggagacag

SEQ ID NO: 740765 - DNA, 20 bp, Artificial
  CRISPR gRNA sequence
cggggcctggaggagacagg

SEQ ID NO: 740766 - DNA, 20 bp, Artificial
  CRISPR gRNA sequence
ggggcctggaggagacaggg

SEQ ID NO: 740767 - DNA, 20 bp, Artificial
  CRISPR gRNA sequence
tggaggagacaggggggtgc

SEQ ID NO: 740768 - DNA, 20 bp, Artificial
  CRISPR gRNA sequence
ggaggagacaggggggtgct

SEQ ID NO: 740769 - DNA, 20 bp, Artificial
  CRISPR gRNA sequence
aggggggtgctgggctccga

SEQ ID NO: 740770 - DNA, 20 bp, Artificial
  CRISPR gRNA sequence
ggggtgctgggctccgaaag

SEQ ID NO: 740771 - DNA, 20 bp, Artificial
  CRISPR gRNA sequence
ctccgaaagcagatgccgcc

SEQ ID NO: 740772 - DNA, 20 bp, Artificial
  CRISPR gRNA sequence
aagcagatgccgcccagact

SEQ ID NO: 740773 - DNA, 20 bp, Artificial
  CRISPR gRNA sequence
cagatgccgcccagactcag

SEQ ID NO: 740774 - DNA, 20 bp, Artificial
  CRISPR gRNA sequence
agatgccgcccagactcaga

SEQ ID NO: 740775 - DNA, 20 bp, Artificial
  CRISPR gRNA sequence
cagactcagaaggctgccgc

SEQ ID NO: 740776 - DNA, 20 bp, Artificial
  CRISPR gRNA sequence
agactcagaaggctgccgct

SEQ ID NO: 740777 - DNA, 20 bp, Artificial
  CRISPR gRNA sequence
aaggctgccgctgggccaca

SEQ ID NO: 740778 - DNA, 20 bp, Artificial
  CRISPR gRNA sequence
aggctgccgctgggccacat

SEQ ID NO: 740779 - DNA, 20 bp, Artificial
  CRISPR gRNA sequence
tgccgctgggccacatagga

SEQ ID NO: 740780 - DNA, 20 bp, Artificial
  CRISPR gRNA sequence
gccgctgggccacataggac

SEQ ID NO: 740781 - DNA, 20 bp, Artificial
  CRISPR gRNA sequence
ccgctgggccacataggaca

SEQ ID NO: 740782 - DNA, 20 bp, Artificial
  CRISPR gRNA sequence
cgctgggccacataggacag

SEQ ID NO: 740783 - DNA, 20 bp, Artificial
  CRISPR gRNA sequence
gctgggccacataggacagg

SEQ ID NO: 740784 - DNA, 20 bp, Artificial
  CRISPR gRNA sequence
ggacagggggtgcctgactt

SEQ ID NO: 740785 - DNA, 20 bp, Artificial
  CRISPR gRNA sequence
ggggtgcctgactttggcct

SEQ ID NO: 740786 - DNA, 20 bp, Artificial
  CRISPR gRNA sequence
gggtgcctgactttggcctc

SEQ ID NO: 740787 - DNA, 20 bp, Artificial
  CRISPR gRNA sequence
ctttggcctcgggtatcccc

SEQ ID NO: 740788 - DNA, 20 bp, Artificial
  CRISPR gRNA sequence
tttggcctcgggtatcccct

SEQ ID NO: 740789 - DNA, 20 bp, Artificial
  CRISPR gRNA sequence
ggcctcgggtatcccctggg

SEQ ID NO: 740790 - DNA, 20 bp, Artificial
  CRISPR gRNA sequence
gcctcgggtatcccctgggc

SEQ ID NO: 740791 - DNA, 20 bp, Artificial
  CRISPR gRNA sequence
tcgggtatcccctgggcagg

SEQ ID NO: 740792 - DNA, 20 bp, Artificial
  CRISPR gRNA sequence
gtatcccctgggcaggtggt

SEQ ID NO: 740793 - DNA, 20 bp, Artificial
  CRISPR gRNA sequence
tatcccctgggcaggtggtg

SEQ ID NO: 740794 - DNA, 20 bp, Artificial
  CRISPR gRNA sequence
gggcaggtggtgaggcttca

SEQ ID NO: 740795 - DNA, 20 bp, Artificial
  CRISPR gRNA sequence
aggtggtgaggcttcaaagc

SEQ ID NO: 740796 - DNA, 20 bp, Artificial
  CRISPR gRNA sequence
ggtggtgaggcttcaaagcc

SEQ ID NO: 740797 - DNA, 20 bp, Artificial
  CRISPR gRNA sequence
gtggtgaggcttcaaagccg

SEQ ID NO: 740798 - DNA, 20 bp, Artificial
  CRISPR gRNA sequence
tcccttgaatgttgctgcca

SEQ ID NO: 740799 - DNA, 20 bp, Artificial
  CRISPR gRNA sequence
gaatgttgctgccacagaac

SEQ ID NO: 740800 - DNA, 20 bp, Artificial
  CRISPR gRNA sequence
ttgctgccacagaaccagaa

SEQ ID NO: 740801 - DNA, 20 bp, Artificial
  CRISPR gRNA sequence
ctgccacagaaccagaatgg

SEQ ID NO: 740802 - DNA, 20 bp, Artificial
  CRISPR gRNA sequence
tgccacagaaccagaatgga

SEQ ID NO: 740803 - DNA, 20 bp, Artificial
  CRISPR gRNA sequence
ggaaggtcatctgtgctgtc

SEQ ID NO: 740804 - DNA, 20 bp, Artificial
  CRISPR gRNA sequence
aaggtcatctgtgctgtccg

SEQ ID NO: 740805 - DNA, 20 bp, Artificial
  CRISPR gRNA sequence
aactctgccctccctgcccc

SEQ ID NO: 740806 - DNA, 20 bp, Artificial
  CRISPR gRNA sequence
tcacctacatccccatcccc

SEQ ID NO: 740807 - DNA, 20 bp, Artificial
  CRISPR gRNA sequence
acatccccatccccaagcct

SEQ ID NO: 740808 - DNA, 20 bp, Artificial
  CRISPR gRNA sequence
tccccatccccaagcctcag

SEQ ID NO: 740809 - DNA, 20 bp, Artificial
  CRISPR gRNA sequence
caagcctcagcagcatctcc

SEQ ID NO: 740810 - DNA, 20 bp, Artificial
  CRISPR gRNA sequence
cctcagcagcatctccaagc

SEQ ID NO: 740811 - DNA, 20 bp, Artificial
  CRISPR gRNA sequence
cagcagcatctccaagcaag

SEQ ID NO: 740812 - DNA, 20 bp, Artificial
  CRISPR gRNA sequence
agcagcatctccaagcaaga

SEQ ID NO: 740813 - DNA, 20 bp, Artificial
  CRISPR gRNA sequence
agcatctccaagcaagaagg

SEQ ID NO: 740814 - DNA, 20 bp, Artificial
  CRISPR gRNA sequence
gcatctccaagcaagaaggc

SEQ ID NO: 740815 - DNA, 20 bp, Artificial
  CRISPR gRNA sequence
atctccaagcaagaaggcag

SEQ ID NO: 740816 - DNA, 20 bp, Artificial
  CRISPR gRNA sequence
ccaagcaagaaggcaggagc

SEQ ID NO: 740817 - DNA, 20 bp, Artificial
  CRISPR gRNA sequence
caagcaagaaggcaggagcc

SEQ ID NO: 740818 - DNA, 20 bp, Artificial
  CRISPR gRNA sequence
gaaggcaggagccaggccca

SEQ ID NO: 740819 - DNA, 20 bp, Artificial
  CRISPR gRNA sequence
aggcaggagccaggcccaca

SEQ ID NO: 740820 - DNA, 20 bp, Artificial
  CRISPR gRNA sequence
ggagccaggcccacagagca

SEQ ID NO: 740821 - DNA, 20 bp, Artificial
  CRISPR gRNA sequence
gagccaggcccacagagcaa

SEQ ID NO: 740822 - DNA, 20 bp, Artificial
  CRISPR gRNA sequence
ggcccacagagcaaaggcca

SEQ ID NO: 740823 - DNA, 20 bp, Artificial
  CRISPR gRNA sequence
gcccacagagcaaaggccat

SEQ ID NO: 740824 - DNA, 20 bp, Artificial
  CRISPR gRNA sequence
tgcacctgcccacctgtcct

SEQ ID NO: 740825 - DNA, 20 bp, Artificial
  CRISPR gRNA sequence
ctgcccacctgtcctgagct

SEQ ID NO: 740826 - DNA, 20 bp, Artificial
  CRISPR gRNA sequence
tgcccacctgtcctgagctg

SEQ ID NO: 740827 - DNA, 20 bp, Artificial
  CRISPR gRNA sequence
gcccacctgtcctgagctga

SEQ ID NO: 740828 - DNA, 20 bp, Artificial
  CRISPR gRNA sequence
ctgtcctgagctgagggcat

SEQ ID NO: 740829 - DNA, 20 bp, Artificial
  CRISPR gRNA sequence
tgtcctgagctgagggcatc

SEQ ID NO: 740830 - DNA, 20 bp, Artificial
  CRISPR gRNA sequence
gtcctgagctgagggcatca

SEQ ID NO: 740831 - DNA, 20 bp, Artificial
  CRISPR gRNA sequence
ctgagggcatcagggcccac

SEQ ID NO: 740832 - DNA, 20 bp, Artificial
  CRISPR gRNA sequence
ggcatcagggcccaccagaa

SEQ ID NO: 740833 - DNA, 20 bp, Artificial
  CRISPR gRNA sequence
gggcccaccagaacagaccc

SEQ ID NO: 740834 - DNA, 20 bp, Artificial
  CRISPR gRNA sequence
cagaccccagctcctccctg

SEQ ID NO: 740835 - DNA, 20 bp, Artificial
  CRISPR gRNA sequence
tgtggtctgaccatcaaccc

SEQ ID NO: 740836 - DNA, 20 bp, Artificial
  CRISPR gRNA sequence
gtggtctgaccatcaacccc

SEQ ID NO: 740837 - DNA, 20 bp, Artificial
  CRISPR gRNA sequence
ctgaccatcaaccccgggca

SEQ ID NO: 740838 - DNA, 20 bp, Artificial
  CRISPR gRNA sequence
ccatcaaccccgggcacagc

SEQ ID NO: 740839 - DNA, 20 bp, Artificial
  CRISPR gRNA sequence
catcaaccccgggcacagcc

SEQ ID NO: 740840 - DNA, 20 bp, Artificial
  CRISPR gRNA sequence
caaccccgggcacagccagg

SEQ ID NO: 740841 - DNA, 20 bp, Artificial
  CRISPR gRNA sequence
agccaggaagccaaaaatca

SEQ ID NO: 740842 - DNA, 20 bp, Artificial
  CRISPR gRNA sequence
ccaaaaatcacagacacttc

SEQ ID NO: 740843 - DNA, 20 bp, Artificial
  CRISPR gRNA sequence
cacagacacttctagaactt
